United States Patent 11,492,591 (UNIVERSAL DONOR STEM CELLS AND RELATED METHODS) - sequence listing, part 6

SEQ ID NO: 164043 - DNA, 20 bp, Artificial
  CRISPR gRNA sequence
tctgggcagtctttgctact

SEQ ID NO: 164044 - DNA, 20 bp, Artificial
  CRISPR gRNA sequence
ctgggcagtctttgctactg

SEQ ID NO: 164045 - DNA, 20 bp, Artificial
  CRISPR gRNA sequence
tgggcagtctttgctactgt

SEQ ID NO: 164046 - DNA, 20 bp, Artificial
  CRISPR gRNA sequence
ggcagtctttgctactgtaa

SEQ ID NO: 164047 - DNA, 20 bp, Artificial
  CRISPR gRNA sequence
tgctactgtaaacatccttg

SEQ ID NO: 164048 - DNA, 20 bp, Artificial
  CRISPR gRNA sequence
gctactgtaaacatccttga

SEQ ID NO: 164049 - DNA, 20 bp, Artificial
  CRISPR gRNA sequence
ctactgtaaacatccttgac

SEQ ID NO: 164050 - DNA, 20 bp, Artificial
  CRISPR gRNA sequence
ctgtaaacatccttgactgg

SEQ ID NO: 164051 - DNA, 20 bp, Artificial
  CRISPR gRNA sequence
taaacatccttgactggaag

SEQ ID NO: 164052 - DNA, 20 bp, Artificial
  CRISPR gRNA sequence
gactggaagctgtaaggtgt

SEQ ID NO: 164053 - DNA, 20 bp, Artificial
  CRISPR gRNA sequence
actggaagctgtaaggtgtt

SEQ ID NO: 164054 - DNA, 20 bp, Artificial
  CRISPR gRNA sequence
gaagctgtaaggtgttcaga

SEQ ID NO: 164055 - DNA, 20 bp, Artificial
  CRISPR gRNA sequence
taaggtgttcagaggagctt

SEQ ID NO: 164056 - DNA, 20 bp, Artificial
  CRISPR gRNA sequence
agaggagctttcagtcggat

SEQ ID NO: 164057 - DNA, 20 bp, Artificial
  CRISPR gRNA sequence
tcagtcggatgtttacagcg

SEQ ID NO: 164058 - DNA, 20 bp, Artificial
  CRISPR gRNA sequence
cagtcggatgtttacagcgg

SEQ ID NO: 164059 - DNA, 20 bp, Artificial
  CRISPR gRNA sequence
agtcggatgtttacagcggc

SEQ ID NO: 164060 - DNA, 20 bp, Artificial
  CRISPR gRNA sequence
acagcggcaggctgccacgg

SEQ ID NO: 164061 - DNA, 20 bp, Artificial
  CRISPR gRNA sequence
cagcggcaggctgccacggt

SEQ ID NO: 164062 - DNA, 20 bp, Artificial
  CRISPR gRNA sequence
ccacggtcgtccccagctac

SEQ ID NO: 164063 - DNA, 20 bp, Artificial
  CRISPR gRNA sequence
cgcaccggctttgaaacatt

SEQ ID NO: 164064 - DNA, 20 bp, Artificial
  CRISPR gRNA sequence
tgaaacattgcaggtttgtg

SEQ ID NO: 164065 - DNA, 20 bp, Artificial
  CRISPR gRNA sequence
gaaacattgcaggtttgtgc

SEQ ID NO: 164066 - DNA, 20 bp, Artificial
  CRISPR gRNA sequence
aaacattgcaggtttgtgcc

SEQ ID NO: 164067 - DNA, 20 bp, Artificial
  CRISPR gRNA sequence
caggtttgtgcccacaggct

SEQ ID NO: 164068 - DNA, 20 bp, Artificial
  CRISPR gRNA sequence
gtgcccacaggctcaattcc

SEQ ID NO: 164069 - DNA, 20 bp, Artificial
  CRISPR gRNA sequence
tgcccacaggctcaattcct

SEQ ID NO: 164070 - DNA, 20 bp, Artificial
  CRISPR gRNA sequence
aattcctcctcttgggggtc

SEQ ID NO: 164071 - DNA, 20 bp, Artificial
  CRISPR gRNA sequence
ctcctcttgggggtccttcc

SEQ ID NO: 164072 - DNA, 20 bp, Artificial
  CRISPR gRNA sequence
ctcttgggggtccttccctc

SEQ ID NO: 164073 - DNA, 20 bp, Artificial
  CRISPR gRNA sequence
ttgggggtccttccctcctc

SEQ ID NO: 164074 - DNA, 20 bp, Artificial
  CRISPR gRNA sequence
gggggtccttccctcctctc

SEQ ID NO: 164075 - DNA, 20 bp, Artificial
  CRISPR gRNA sequence
ggggtccttccctcctctct

SEQ ID NO: 164076 - DNA, 20 bp, Artificial
  CRISPR gRNA sequence
ccctcctctctcagaagtca

SEQ ID NO: 164077 - DNA, 20 bp, Artificial
  CRISPR gRNA sequence
cctcctctctcagaagtcac

SEQ ID NO: 164078 - DNA, 20 bp, Artificial
  CRISPR gRNA sequence
ctctctcagaagtcacaaca

SEQ ID NO: 164079 - DNA, 20 bp, Artificial
  CRISPR gRNA sequence
tctcagaagtcacaacaaga

SEQ ID NO: 164080 - DNA, 20 bp, Artificial
  CRISPR gRNA sequence
tcagaagtcacaacaagaac

SEQ ID NO: 164081 - DNA, 20 bp, Artificial
  CRISPR gRNA sequence
agaagtcacaacaagaactc

SEQ ID NO: 164082 - DNA, 20 bp, Artificial
  CRISPR gRNA sequence
aggccatttatcttccttca

SEQ ID NO: 164083 - DNA, 20 bp, Artificial
  CRISPR gRNA sequence
atcttccttcagaacaaaga

SEQ ID NO: 164084 - DNA, 20 bp, Artificial
  CRISPR gRNA sequence
tcttccttcagaacaaagag

SEQ ID NO: 164085 - DNA, 20 bp, Artificial
  CRISPR gRNA sequence
ccttcagaacaaagagtatc

SEQ ID NO: 164086 - DNA, 20 bp, Artificial
  CRISPR gRNA sequence
cttcagaacaaagagtatca

SEQ ID NO: 164087 - DNA, 20 bp, Artificial
  CRISPR gRNA sequence
cagaacaaagagtatcatac

SEQ ID NO: 164088 - DNA, 20 bp, Artificial
  CRISPR gRNA sequence
agaacaaagagtatcataca

SEQ ID NO: 164089 - DNA, 20 bp, Artificial
  CRISPR gRNA sequence
ctttccttgttgaaattgtt

SEQ ID NO: 164090 - DNA, 20 bp, Artificial
  CRISPR gRNA sequence
tccttgttgaaattgttttc

SEQ ID NO: 164091 - DNA, 20 bp, Artificial
  CRISPR gRNA sequence
ccttgttgaaattgttttct

SEQ ID NO: 164092 - DNA, 20 bp, Artificial
  CRISPR gRNA sequence
cttgttgaaattgttttctc

SEQ ID NO: 164093 - DNA, 20 bp, Artificial
  CRISPR gRNA sequence
gttgaaattgttttctcctt

SEQ ID NO: 164094 - DNA, 20 bp, Artificial
  CRISPR gRNA sequence
ttgaaattgttttctccttt

SEQ ID NO: 164095 - DNA, 20 bp, Artificial
  CRISPR gRNA sequence
aaattgttttctccttttgt

SEQ ID NO: 164096 - DNA, 20 bp, Artificial
  CRISPR gRNA sequence
ttttctccttttgtctatca

SEQ ID NO: 164097 - DNA, 20 bp, Artificial
  CRISPR gRNA sequence
tctccttttgtctatcagaa

SEQ ID NO: 164098 - DNA, 20 bp, Artificial
  CRISPR gRNA sequence
ctccttttgtctatcagaag

SEQ ID NO: 164099 - DNA, 20 bp, Artificial
  CRISPR gRNA sequence
tccttttgtctatcagaagc

SEQ ID NO: 164100 - DNA, 20 bp, Artificial
  CRISPR gRNA sequence
cttttgtctatcagaagccc

SEQ ID NO: 164101 - DNA, 20 bp, Artificial
  CRISPR gRNA sequence
ttgtctatcagaagccccct

SEQ ID NO: 164102 - DNA, 20 bp, Artificial
  CRISPR gRNA sequence
tgtctatcagaagccccctt

SEQ ID NO: 164103 - DNA, 20 bp, Artificial
  CRISPR gRNA sequence
gtctatcagaagcccccttt

SEQ ID NO: 164104 - DNA, 20 bp, Artificial
  CRISPR gRNA sequence
tctatcagaagcccccttta

SEQ ID NO: 164105 - DNA, 20 bp, Artificial
  CRISPR gRNA sequence
tcagaagccccctttaaaac

SEQ ID NO: 164106 - DNA, 20 bp, Artificial
  CRISPR gRNA sequence
taaaacaagattgtgagctc

SEQ ID NO: 164107 - DNA, 20 bp, Artificial
  CRISPR gRNA sequence
aaaacaagattgtgagctct

SEQ ID NO: 164108 - DNA, 20 bp, Artificial
  CRISPR gRNA sequence
aaacaagattgtgagctctg

SEQ ID NO: 164109 - DNA, 20 bp, Artificial
  CRISPR gRNA sequence
tgagctctgtgatgaaatca

SEQ ID NO: 164110 - DNA, 20 bp, Artificial
  CRISPR gRNA sequence
tgtgatgaaatcaggccttg

SEQ ID NO: 164111 - DNA, 20 bp, Artificial
  CRISPR gRNA sequence
tgatgaaatcaggccttgct

SEQ ID NO: 164112 - DNA, 20 bp, Artificial
  CRISPR gRNA sequence
gctcactctcattgtgctaa

SEQ ID NO: 164113 - DNA, 20 bp, Artificial
  CRISPR gRNA sequence
ctcactctcattgtgctaac

SEQ ID NO: 164114 - DNA, 20 bp, Artificial
  CRISPR gRNA sequence
actctcattgtgctaactcc

SEQ ID NO: 164115 - DNA, 20 bp, Artificial
  CRISPR gRNA sequence
tcattgtgctaactccttgt

SEQ ID NO: 164116 - DNA, 20 bp, Artificial
  CRISPR gRNA sequence
attgtgctaactccttgttt

SEQ ID NO: 164117 - DNA, 20 bp, Artificial
  CRISPR gRNA sequence
tgctaactccttgttttctg

SEQ ID NO: 164118 - DNA, 20 bp, Artificial
  CRISPR gRNA sequence
actccttgttttctgtgggc

SEQ ID NO: 164119 - DNA, 20 bp, Artificial
  CRISPR gRNA sequence
cttgttttctgtgggctgcc

SEQ ID NO: 164120 - DNA, 20 bp, Artificial
  CRISPR gRNA sequence
gttttctgtgggctgcctgc

SEQ ID NO: 164121 - DNA, 20 bp, Artificial
  CRISPR gRNA sequence
ttttctgtgggctgcctgct

SEQ ID NO: 164122 - DNA, 20 bp, Artificial
  CRISPR gRNA sequence
tctgtgggctgcctgctgaa

SEQ ID NO: 164123 - DNA, 20 bp, Artificial
  CRISPR gRNA sequence
ctgtgggctgcctgctgaat

SEQ ID NO: 164124 - DNA, 20 bp, Artificial
  CRISPR gRNA sequence
tgtgggctgcctgctgaata

SEQ ID NO: 164125 - DNA, 20 bp, Artificial
  CRISPR gRNA sequence
tgggctgcctgctgaataca

SEQ ID NO: 164126 - DNA, 20 bp, Artificial
  CRISPR gRNA sequence
cctgctgaatacactggctg

SEQ ID NO: 164127 - DNA, 20 bp, Artificial
  CRISPR gRNA sequence
ctgaatacactggctggaga

SEQ ID NO: 164128 - DNA, 20 bp, Artificial
  CRISPR gRNA sequence
aatacactggctggagagaa

SEQ ID NO: 164129 - DNA, 20 bp, Artificial
  CRISPR gRNA sequence
gctggagagaagggtcacat

SEQ ID NO: 164130 - DNA, 20 bp, Artificial
  CRISPR gRNA sequence
gagagaagggtcacatcctg

SEQ ID NO: 164131 - DNA, 20 bp, Artificial
  CRISPR gRNA sequence
tcagttcctccaaattcctc

SEQ ID NO: 164132 - DNA, 20 bp, Artificial
  CRISPR gRNA sequence
ctccaaattcctcagtgctt

SEQ ID NO: 164133 - DNA, 20 bp, Artificial
  CRISPR gRNA sequence
caaattcctcagtgcttctg

SEQ ID NO: 164134 - DNA, 20 bp, Artificial
  CRISPR gRNA sequence
ctcagtgcttctgggtctct

SEQ ID NO: 164135 - DNA, 20 bp, Artificial
  CRISPR gRNA sequence
agtgcttctgggtctctcgg

SEQ ID NO: 164136 - DNA, 20 bp, Artificial
  CRISPR gRNA sequence
ctgggtctctcggggtgtca

SEQ ID NO: 164137 - DNA, 20 bp, Artificial
  CRISPR gRNA sequence
tgggtctctcggggtgtcat

SEQ ID NO: 164138 - DNA, 20 bp, Artificial
  CRISPR gRNA sequence
ggtctctcggggtgtcatac

SEQ ID NO: 164139 - DNA, 20 bp, Artificial
  CRISPR gRNA sequence
tcggggtgtcatacagctcc

SEQ ID NO: 164140 - DNA, 20 bp, Artificial
  CRISPR gRNA sequence
ggggtgtcatacagctcctt

SEQ ID NO: 164141 - DNA, 20 bp, Artificial
  CRISPR gRNA sequence
cttattccatcttagccaga

SEQ ID NO: 164142 - DNA, 20 bp, Artificial
  CRISPR gRNA sequence
attccatcttagccagactc

SEQ ID NO: 164143 - DNA, 20 bp, Artificial
  CRISPR gRNA sequence
ttccatcttagccagactca

SEQ ID NO: 164144 - DNA, 20 bp, Artificial
  CRISPR gRNA sequence
catcttagccagactcaaaa

SEQ ID NO: 164145 - DNA, 20 bp, Artificial
  CRISPR gRNA sequence
agccagactcaaaatgctat

SEQ ID NO: 164146 - DNA, 20 bp, Artificial
  CRISPR gRNA sequence
gccagactcaaaatgctatg

SEQ ID NO: 164147 - DNA, 20 bp, Artificial
  CRISPR gRNA sequence
aaaatgctatgatccatctg

SEQ ID NO: 164148 - DNA, 20 bp, Artificial
  CRISPR gRNA sequence
tgatccatctgattttaaag

SEQ ID NO: 164149 - DNA, 20 bp, Artificial
  CRISPR gRNA sequence
attttaaagtgtgtctagct

SEQ ID NO: 164150 - DNA, 20 bp, Artificial
  CRISPR gRNA sequence
taaagtgtgtctagctgaaa

SEQ ID NO: 164151 - DNA, 20 bp, Artificial
  CRISPR gRNA sequence
aaagtgtgtctagctgaaac

SEQ ID NO: 164152 - DNA, 20 bp, Artificial
  CRISPR gRNA sequence
aagtgtgtctagctgaaaca

SEQ ID NO: 164153 - DNA, 20 bp, Artificial
  CRISPR gRNA sequence
gctgaaacagcttcttgttg

SEQ ID NO: 164154 - DNA, 20 bp, Artificial
  CRISPR gRNA sequence
aaacagcttcttgttgcttg

SEQ ID NO: 164155 - DNA, 20 bp, Artificial
  CRISPR gRNA sequence
cttgttgcttggatttagtt

SEQ ID NO: 164156 - DNA, 20 bp, Artificial
  CRISPR gRNA sequence
ttgttgcttggatttagttc

SEQ ID NO: 164157 - DNA, 20 bp, Artificial
  CRISPR gRNA sequence
gttgcttggatttagttctt

SEQ ID NO: 164158 - DNA, 20 bp, Artificial
  CRISPR gRNA sequence
ttgcttggatttagttcttt

SEQ ID NO: 164159 - DNA, 20 bp, Artificial
  CRISPR gRNA sequence
cttggatttagttctttgta

SEQ ID NO: 164160 - DNA, 20 bp, Artificial
  CRISPR gRNA sequence
ggatttagttctttgtaggt

SEQ ID NO: 164161 - DNA, 20 bp, Artificial
  CRISPR gRNA sequence
gatttagttctttgtaggtg

SEQ ID NO: 164162 - DNA, 20 bp, Artificial
  CRISPR gRNA sequence
agttctttgtaggtgttcga

SEQ ID NO: 164163 - DNA, 20 bp, Artificial
  CRISPR gRNA sequence
gttctttgtaggtgttcgag

SEQ ID NO: 164164 - DNA, 20 bp, Artificial
  CRISPR gRNA sequence
tttgtaggtgttcgaggcat

SEQ ID NO: 164165 - DNA, 20 bp, Artificial
  CRISPR gRNA sequence
tgtaggtgttcgaggcattg

SEQ ID NO: 164166 - DNA, 20 bp, Artificial
  CRISPR gRNA sequence
gtaggtgttcgaggcattga

SEQ ID NO: 164167 - DNA, 20 bp, Artificial
  CRISPR gRNA sequence
taggtgttcgaggcattgat

SEQ ID NO: 164168 - DNA, 20 bp, Artificial
  CRISPR gRNA sequence
gaggcattgattggcatcgt

SEQ ID NO: 164169 - DNA, 20 bp, Artificial
  CRISPR gRNA sequence
attggcatcgtattcgggac

SEQ ID NO: 164170 - DNA, 20 bp, Artificial
  CRISPR gRNA sequence
gcatcgtattcgggacagct

SEQ ID NO: 164171 - DNA, 20 bp, Artificial
  CRISPR gRNA sequence
gggacagctgctgcctggcc

SEQ ID NO: 164172 - DNA, 20 bp, Artificial
  CRISPR gRNA sequence
ctgcctggcctttgaaaggt

SEQ ID NO: 164173 - DNA, 20 bp, Artificial
  CRISPR gRNA sequence
cctggcctttgaaaggttga

SEQ ID NO: 164174 - DNA, 20 bp, Artificial
  CRISPR gRNA sequence
gcctttgaaaggttgagatt

SEQ ID NO: 164175 - DNA, 20 bp, Artificial
  CRISPR gRNA sequence
tgaaaggttgagattgctga

SEQ ID NO: 164176 - DNA, 20 bp, Artificial
  CRISPR gRNA sequence
gaaaggttgagattgctgaa

SEQ ID NO: 164177 - DNA, 20 bp, Artificial
  CRISPR gRNA sequence
aaaggttgagattgctgaaa

SEQ ID NO: 164178 - DNA, 20 bp, Artificial
  CRISPR gRNA sequence
agattgctgaaagctggcct

SEQ ID NO: 164179 - DNA, 20 bp, Artificial
  CRISPR gRNA sequence
ctgaaagctggcctgaaatt

SEQ ID NO: 164180 - DNA, 20 bp, Artificial
  CRISPR gRNA sequence
aaagctggcctgaaattcta

SEQ ID NO: 164181 - DNA, 20 bp, Artificial
  CRISPR gRNA sequence
gcctgaaattctaagatagc

SEQ ID NO: 164182 - DNA, 20 bp, Artificial
  CRISPR gRNA sequence
aaattctaagatagcatttt

SEQ ID NO: 164183 - DNA, 20 bp, Artificial
  CRISPR gRNA sequence
taagatagcatttttaatcc

SEQ ID NO: 164184 - DNA, 20 bp, Artificial
  CRISPR gRNA sequence
agatagcatttttaatcctc

SEQ ID NO: 164185 - DNA, 20 bp, Artificial
  CRISPR gRNA sequence
ttaatcctctgtagacatga

SEQ ID NO: 164186 - DNA, 20 bp, Artificial
  CRISPR gRNA sequence
taatcctctgtagacatgaa

SEQ ID NO: 164187 - DNA, 20 bp, Artificial
  CRISPR gRNA sequence
aatcctctgtagacatgaag

SEQ ID NO: 164188 - DNA, 20 bp, Artificial
  CRISPR gRNA sequence
atcctctgtagacatgaagt

SEQ ID NO: 164189 - DNA, 20 bp, Artificial
  CRISPR gRNA sequence
tgtagacatgaagttttccc

SEQ ID NO: 164190 - DNA, 20 bp, Artificial
  CRISPR gRNA sequence
tagacatgaagttttcccag

SEQ ID NO: 164191 - DNA, 20 bp, Artificial
  CRISPR gRNA sequence
tcccaggcttcaaattggct

SEQ ID NO: 164192 - DNA, 20 bp, Artificial
  CRISPR gRNA sequence
cccaggcttcaaattggctg

SEQ ID NO: 164193 - DNA, 20 bp, Artificial
  CRISPR gRNA sequence
ccaggcttcaaattggctgg

SEQ ID NO: 164194 - DNA, 20 bp, Artificial
  CRISPR gRNA sequence
caaattggctggcacctcct

SEQ ID NO: 164195 - DNA, 20 bp, Artificial
  CRISPR gRNA sequence
aaattggctggcacctccta

SEQ ID NO: 164196 - DNA, 20 bp, Artificial
  CRISPR gRNA sequence
gctggcacctcctaaagtcc

SEQ ID NO: 164197 - DNA, 20 bp, Artificial
  CRISPR gRNA sequence
gcacctcctaaagtccttta

SEQ ID NO: 164198 - DNA, 20 bp, Artificial
  CRISPR gRNA sequence
ctaaagtcctttaaaacgcc

SEQ ID NO: 164199 - DNA, 20 bp, Artificial
  CRISPR gRNA sequence
aagtcctttaaaacgcctac

SEQ ID NO: 164200 - DNA, 20 bp, Artificial
  CRISPR gRNA sequence
taaaacgcctactctccaaa

SEQ ID NO: 164201 - DNA, 20 bp, Artificial
  CRISPR gRNA sequence
aaaacgcctactctccaaaa

SEQ ID NO: 164202 - DNA, 20 bp, Artificial
  CRISPR gRNA sequence
aaacgcctactctccaaaac

SEQ ID NO: 164203 - DNA, 20 bp, Artificial
  CRISPR gRNA sequence
ctctccaaaacccacccttt

SEQ ID NO: 164204 - DNA, 20 bp, Artificial
  CRISPR gRNA sequence
tccaaaacccaccctttctg

SEQ ID NO: 164205 - DNA, 20 bp, Artificial
  CRISPR gRNA sequence
caaaacccaccctttctgaa

SEQ ID NO: 164206 - DNA, 20 bp, Artificial
  CRISPR gRNA sequence
tctgaaggaggcagcagttc

SEQ ID NO: 164207 - DNA, 20 bp, Artificial
  CRISPR gRNA sequence
ctgaaggaggcagcagttca

SEQ ID NO: 164208 - DNA, 20 bp, Artificial
  CRISPR gRNA sequence
tgaaggaggcagcagttcac

SEQ ID NO: 164209 - DNA, 20 bp, Artificial
  CRISPR gRNA sequence
aaggaggcagcagttcactc

SEQ ID NO: 164210 - DNA, 20 bp, Artificial
  CRISPR gRNA sequence
actcttgctactaaagcgaa

SEQ ID NO: 164211 - DNA, 20 bp, Artificial
  CRISPR gRNA sequence
ttgctactaaagcgaatgta

SEQ ID NO: 164212 - DNA, 20 bp, Artificial
  CRISPR gRNA sequence
gctactaaagcgaatgtact

SEQ ID NO: 164213 - DNA, 20 bp, Artificial
  CRISPR gRNA sequence
ctactaaagcgaatgtactt

SEQ ID NO: 164214 - DNA, 20 bp, Artificial
  CRISPR gRNA sequence
ctaaagcgaatgtacttttt

SEQ ID NO: 164215 - DNA, 20 bp, Artificial
  CRISPR gRNA sequence
aagcgaatgtacttttttcc

SEQ ID NO: 164216 - DNA, 20 bp, Artificial
  CRISPR gRNA sequence
ttttccagtcagggctggtt

SEQ ID NO: 164217 - DNA, 20 bp, Artificial
  CRISPR gRNA sequence
tttccagtcagggctggttg

SEQ ID NO: 164218 - DNA, 20 bp, Artificial
  CRISPR gRNA sequence
ttccagtcagggctggttgc

SEQ ID NO: 164219 - DNA, 20 bp, Artificial
  CRISPR gRNA sequence
tccagtcagggctggttgca

SEQ ID NO: 164220 - DNA, 20 bp, Artificial
  CRISPR gRNA sequence
ccagtcagggctggttgcac

SEQ ID NO: 164221 - DNA, 20 bp, Artificial
  CRISPR gRNA sequence
cagtcagggctggttgcaca

SEQ ID NO: 164222 - DNA, 20 bp, Artificial
  CRISPR gRNA sequence
gttgcacaacactgtagaga

SEQ ID NO: 164223 - DNA, 20 bp, Artificial
  CRISPR gRNA sequence
cacaacactgtagagatggc

SEQ ID NO: 164224 - DNA, 20 bp, Artificial
  CRISPR gRNA sequence
tagagatggccctaggatgt

SEQ ID NO: 164225 - DNA, 20 bp, Artificial
  CRISPR gRNA sequence
ggatgtgatgctgctcttct

SEQ ID NO: 164226 - DNA, 20 bp, Artificial
  CRISPR gRNA sequence
ctcttctctggcactgttcg

SEQ ID NO: 164227 - DNA, 20 bp, Artificial
  CRISPR gRNA sequence
ttctctggcactgttcgtca

SEQ ID NO: 164228 - DNA, 20 bp, Artificial
  CRISPR gRNA sequence
ctctggcactgttcgtcagt

SEQ ID NO: 164229 - DNA, 20 bp, Artificial
  CRISPR gRNA sequence
tctggcactgttcgtcagtc

SEQ ID NO: 164230 - DNA, 20 bp, Artificial
  CRISPR gRNA sequence
tggcactgttcgtcagtctc

SEQ ID NO: 164231 - DNA, 20 bp, Artificial
  CRISPR gRNA sequence
gcactgttcgtcagtctcag

SEQ ID NO: 164232 - DNA, 20 bp, Artificial
  CRISPR gRNA sequence
ttcgtcagtctcagcttctg

SEQ ID NO: 164233 - DNA, 20 bp, Artificial
  CRISPR gRNA sequence
gtcagtctcagcttctggaa

SEQ ID NO: 164234 - DNA, 20 bp, Artificial
  CRISPR gRNA sequence
agcttctggaaagattccaa

SEQ ID NO: 164235 - DNA, 20 bp, Artificial
  CRISPR gRNA sequence
ctggaaagattccaagagca

SEQ ID NO: 164236 - DNA, 20 bp, Artificial
  CRISPR gRNA sequence
tggaaagattccaagagcaa

SEQ ID NO: 164237 - DNA, 20 bp, Artificial
  CRISPR gRNA sequence
gaaagattccaagagcaagc

SEQ ID NO: 164238 - DNA, 20 bp, Artificial
  CRISPR gRNA sequence
caagagcaagccctgtagtt

SEQ ID NO: 164239 - DNA, 20 bp, Artificial
  CRISPR gRNA sequence
tagttggggaggccactgct

SEQ ID NO: 164240 - DNA, 20 bp, Artificial
  CRISPR gRNA sequence
gggaggccactgctaaagtt

SEQ ID NO: 164241 - DNA, 20 bp, Artificial
  CRISPR gRNA sequence
ctaaagttgagcaagtgccc

SEQ ID NO: 164242 - DNA, 20 bp, Artificial
  CRISPR gRNA sequence
aagttgagcaagtgccccat

SEQ ID NO: 164243 - DNA, 20 bp, Artificial
  CRISPR gRNA sequence
agcaagtgccccattctgga

SEQ ID NO: 164244 - DNA, 20 bp, Artificial
  CRISPR gRNA sequence
tggattgatccagtcattaa

SEQ ID NO: 164245 - DNA, 20 bp, Artificial
  CRISPR gRNA sequence
gattgatccagtcattaaag

SEQ ID NO: 164246 - DNA, 20 bp, Artificial
  CRISPR gRNA sequence
atccagtcattaaagcattg

SEQ ID NO: 164247 - DNA, 20 bp, Artificial
  CRISPR gRNA sequence
aagcattgttctgccacttg

SEQ ID NO: 164248 - DNA, 20 bp, Artificial
  CRISPR gRNA sequence
ttctgccacttggggcaacc

SEQ ID NO: 164249 - DNA, 20 bp, Artificial
  CRISPR gRNA sequence
tgccacttggggcaacctcc

SEQ ID NO: 164250 - DNA, 20 bp, Artificial
  CRISPR gRNA sequence
ccacttggggcaacctccca

SEQ ID NO: 164251 - DNA, 20 bp, Artificial
  CRISPR gRNA sequence
ggggcaacctcccactgctg

SEQ ID NO: 164252 - DNA, 20 bp, Artificial
  CRISPR gRNA sequence
gggcaacctcccactgctgg

SEQ ID NO: 164253 - DNA, 20 bp, Artificial
  CRISPR gRNA sequence
ccactgctgggaaaaggaac

SEQ ID NO: 164254 - DNA, 20 bp, Artificial
  CRISPR gRNA sequence
ctgggaaaaggaactagtca

SEQ ID NO: 164255 - DNA, 20 bp, Artificial
  CRISPR gRNA sequence
ggaaaaggaactagtcagaa

SEQ ID NO: 164256 - DNA, 20 bp, Artificial
  CRISPR gRNA sequence
gtcagaaatactgaattgtg

SEQ ID NO: 164257 - DNA, 20 bp, Artificial
  CRISPR gRNA sequence
aattgtgagtccaaggccct

SEQ ID NO: 164258 - DNA, 20 bp, Artificial
  CRISPR gRNA sequence
tgagtccaaggccctgactt

SEQ ID NO: 164259 - DNA, 20 bp, Artificial
  CRISPR gRNA sequence
acttctcaaagatacttgag

SEQ ID NO: 164260 - DNA, 20 bp, Artificial
  CRISPR gRNA sequence
ctcaaagatacttgagagtt

SEQ ID NO: 164261 - DNA, 20 bp, Artificial
  CRISPR gRNA sequence
tcaaagatacttgagagttt

SEQ ID NO: 164262 - DNA, 20 bp, Artificial
  CRISPR gRNA sequence
aaagatacttgagagtttcg

SEQ ID NO: 164263 - DNA, 20 bp, Artificial
  CRISPR gRNA sequence
gagagtttcgcttgttcttc

SEQ ID NO: 164264 - DNA, 20 bp, Artificial
  CRISPR gRNA sequence
agagtttcgcttgttcttca

SEQ ID NO: 164265 - DNA, 20 bp, Artificial
  CRISPR gRNA sequence
cgcttgttcttcagagaagc

SEQ ID NO: 164266 - DNA, 20 bp, Artificial
  CRISPR gRNA sequence
gcttgttcttcagagaagca

SEQ ID NO: 164267 - DNA, 20 bp, Artificial
  CRISPR gRNA sequence
gttcttcagagaagcaagta

SEQ ID NO: 164268 - DNA, 20 bp, Artificial
  CRISPR gRNA sequence
ttcttcagagaagcaagtaa

SEQ ID NO: 164269 - DNA, 20 bp, Artificial
  CRISPR gRNA sequence
ttcagagaagcaagtaaaga

SEQ ID NO: 164270 - DNA, 20 bp, Artificial
  CRISPR gRNA sequence
cagagaagcaagtaaagatt

SEQ ID NO: 164271 - DNA, 20 bp, Artificial
  CRISPR gRNA sequence
agagaagcaagtaaagatta

SEQ ID NO: 164272 - DNA, 20 bp, Artificial
  CRISPR gRNA sequence
tttgaaggtaggaggtagtt

SEQ ID NO: 164273 - DNA, 20 bp, Artificial
  CRISPR gRNA sequence
gaaggtaggaggtagttgag

SEQ ID NO: 164274 - DNA, 20 bp, Artificial
  CRISPR gRNA sequence
aaggtaggaggtagttgagg

SEQ ID NO: 164275 - DNA, 20 bp, Artificial
  CRISPR gRNA sequence
aggcctgacttctgccccac

SEQ ID NO: 164276 - DNA, 20 bp, Artificial
  CRISPR gRNA sequence
acttctgccccactaaagct

SEQ ID NO: 164277 - DNA, 20 bp, Artificial
  CRISPR gRNA sequence
ctgccccactaaagctattg

SEQ ID NO: 164278 - DNA, 20 bp, Artificial
  CRISPR gRNA sequence
tgccccactaaagctattga

SEQ ID NO: 164279 - DNA, 20 bp, Artificial
  CRISPR gRNA sequence
ccccactaaagctattgagt

SEQ ID NO: 164280 - DNA, 20 bp, Artificial
  CRISPR gRNA sequence
aagctattgagttgaaagtt

SEQ ID NO: 164281 - DNA, 20 bp, Artificial
  CRISPR gRNA sequence
ttgagttgaaagttcctgcc

SEQ ID NO: 164282 - DNA, 20 bp, Artificial
  CRISPR gRNA sequence
agttgaaagttcctgcccat

SEQ ID NO: 164283 - DNA, 20 bp, Artificial
  CRISPR gRNA sequence
aaagttcctgcccattgaaa

SEQ ID NO: 164284 - DNA, 20 bp, Artificial
  CRISPR gRNA sequence
ctgcccattgaaatgtcatt

SEQ ID NO: 164285 - DNA, 20 bp, Artificial
  CRISPR gRNA sequence
cccattgaaatgtcattatc

SEQ ID NO: 164286 - DNA, 20 bp, Artificial
  CRISPR gRNA sequence
aaatgtcattatcttttcac

SEQ ID NO: 164287 - DNA, 20 bp, Artificial
  CRISPR gRNA sequence
tcttttcacccatttcttta

SEQ ID NO: 164288 - DNA, 20 bp, Artificial
  CRISPR gRNA sequence
ttcacccatttctttaaacc

SEQ ID NO: 164289 - DNA, 20 bp, Artificial
  CRISPR gRNA sequence
tcacccatttctttaaacca

SEQ ID NO: 164290 - DNA, 20 bp, Artificial
  CRISPR gRNA sequence
cacccatttctttaaaccaa

SEQ ID NO: 164291 - DNA, 20 bp, Artificial
  CRISPR gRNA sequence
acccatttctttaaaccaag

SEQ ID NO: 164292 - DNA, 20 bp, Artificial
  CRISPR gRNA sequence
ctttaaaccaagcataatca

SEQ ID NO: 164293 - DNA, 20 bp, Artificial
  CRISPR gRNA sequence
tttaaaccaagcataatcat

SEQ ID NO: 164294 - DNA, 20 bp, Artificial
  CRISPR gRNA sequence
taaaccaagcataatcattt

SEQ ID NO: 164295 - DNA, 20 bp, Artificial
  CRISPR gRNA sequence
aaaccaagcataatcatttc

SEQ ID NO: 164296 - DNA, 20 bp, Artificial
  CRISPR gRNA sequence
aaccaagcataatcatttcc

SEQ ID NO: 164297 - DNA, 20 bp, Artificial
  CRISPR gRNA sequence
ccttgctggcttgacctcca

SEQ ID NO: 164298 - DNA, 20 bp, Artificial
  CRISPR gRNA sequence
cttgctggcttgacctccat

SEQ ID NO: 164299 - DNA, 20 bp, Artificial
  CRISPR gRNA sequence
gctggcttgacctccattgg

SEQ ID NO: 164300 - DNA, 20 bp, Artificial
  CRISPR gRNA sequence
ctggcttgacctccattggc

SEQ ID NO: 164301 - DNA, 20 bp, Artificial
  CRISPR gRNA sequence
gcttgacctccattggcaga

SEQ ID NO: 164302 - DNA, 20 bp, Artificial
  CRISPR gRNA sequence
gacctccattggcagaatga

SEQ ID NO: 164303 - DNA, 20 bp, Artificial
  CRISPR gRNA sequence
acctccattggcagaatgag

SEQ ID NO: 164304 - DNA, 20 bp, Artificial
  CRISPR gRNA sequence
cattggcagaatgagtcttc

SEQ ID NO: 164305 - DNA, 20 bp, Artificial
  CRISPR gRNA sequence
gcagaatgagtcttcataat

SEQ ID NO: 164306 - DNA, 20 bp, Artificial
  CRISPR gRNA sequence
cataatgcagaagagcctta

SEQ ID NO: 164307 - DNA, 20 bp, Artificial
  CRISPR gRNA sequence
ataatgcagaagagccttag

SEQ ID NO: 164308 - DNA, 20 bp, Artificial
  CRISPR gRNA sequence
agatatgccttcttccattc

SEQ ID NO: 164309 - DNA, 20 bp, Artificial
  CRISPR gRNA sequence
gatatgccttcttccattcc

SEQ ID NO: 164310 - DNA, 20 bp, Artificial
  CRISPR gRNA sequence
cttccattccagtgatttga

SEQ ID NO: 164311 - DNA, 20 bp, Artificial
  CRISPR gRNA sequence
ttccattccagtgatttgag

SEQ ID NO: 164312 - DNA, 20 bp, Artificial
  CRISPR gRNA sequence
ccattccagtgatttgagaa

SEQ ID NO: 164313 - DNA, 20 bp, Artificial
  CRISPR gRNA sequence
cattccagtgatttgagaac

SEQ ID NO: 164314 - DNA, 20 bp, Artificial
  CRISPR gRNA sequence
cagtgatttgagaacagttg

SEQ ID NO: 164315 - DNA, 20 bp, Artificial
  CRISPR gRNA sequence
gagaacagttgtgccttgtc

SEQ ID NO: 164316 - DNA, 20 bp, Artificial
  CRISPR gRNA sequence
agaacagttgtgccttgtcc

SEQ ID NO: 164317 - DNA, 20 bp, Artificial
  CRISPR gRNA sequence
tgccttgtcctaacaacaca

SEQ ID NO: 164318 - DNA, 20 bp, Artificial
  CRISPR gRNA sequence
gtcctaacaacacaaaccta

SEQ ID NO: 164319 - DNA, 20 bp, Artificial
  CRISPR gRNA sequence
tcctaacaacacaaacctag

SEQ ID NO: 164320 - DNA, 20 bp, Artificial
  CRISPR gRNA sequence
acaacacaaacctaggtgcc

SEQ ID NO: 164321 - DNA, 20 bp, Artificial
  CRISPR gRNA sequence
ggtgcctccacttgattctc

SEQ ID NO: 164322 - DNA, 20 bp, Artificial
  CRISPR gRNA sequence
cacttgattctcagtgtcct

SEQ ID NO: 164323 - DNA, 20 bp, Artificial
  CRISPR gRNA sequence
gattctcagtgtcctagata

SEQ ID NO: 164324 - DNA, 20 bp, Artificial
  CRISPR gRNA sequence
attctcagtgtcctagatac

SEQ ID NO: 164325 - DNA, 20 bp, Artificial
  CRISPR gRNA sequence
tcagtgtcctagatactgtc

SEQ ID NO: 164326 - DNA, 20 bp, Artificial
  CRISPR gRNA sequence
agtgtcctagatactgtcta

SEQ ID NO: 164327 - DNA, 20 bp, Artificial
  CRISPR gRNA sequence
gatactgtctagttcataaa

SEQ ID NO: 164328 - DNA, 20 bp, Artificial
  CRISPR gRNA sequence
tctagttcataaacagttta

SEQ ID NO: 164329 - DNA, 20 bp, Artificial
  CRISPR gRNA sequence
gttcataaacagtttaagag

SEQ ID NO: 164330 - DNA, 20 bp, Artificial
  CRISPR gRNA sequence
ataaacagtttaagaggatg

SEQ ID NO: 164331 - DNA, 20 bp, Artificial
  CRISPR gRNA sequence
aagaggatgtagtaagcagc

SEQ ID NO: 164332 - DNA, 20 bp, Artificial
  CRISPR gRNA sequence
agaggatgtagtaagcagca

SEQ ID NO: 164333 - DNA, 20 bp, Artificial
  CRISPR gRNA sequence
ttgtcctgctctcacagctt

SEQ ID NO: 164334 - DNA, 20 bp, Artificial
  CRISPR gRNA sequence
gtcctgctctcacagctttt

SEQ ID NO: 164335 - DNA, 20 bp, Artificial
  CRISPR gRNA sequence
tcctgctctcacagcttttg

SEQ ID NO: 164336 - DNA, 20 bp, Artificial
  CRISPR gRNA sequence
ctctcacagcttttggcaag

SEQ ID NO: 164337 - DNA, 20 bp, Artificial
  CRISPR gRNA sequence
tcacagcttttggcaagaga

SEQ ID NO: 164338 - DNA, 20 bp, Artificial
  CRISPR gRNA sequence
acagcttttggcaagagata

SEQ ID NO: 164339 - DNA, 20 bp, Artificial
  CRISPR gRNA sequence
ttggcaagagatattttggg

SEQ ID NO: 164340 - DNA, 20 bp, Artificial
  CRISPR gRNA sequence
tggcaagagatattttgggt

SEQ ID NO: 164341 - DNA, 20 bp, Artificial
  CRISPR gRNA sequence
ggcaagagatattttgggtt

SEQ ID NO: 164342 - DNA, 20 bp, Artificial
  CRISPR gRNA sequence
gcaagagatattttgggttc

SEQ ID NO: 164343 - DNA, 20 bp, Artificial
  CRISPR gRNA sequence
tgggttctggaaggggtttt

SEQ ID NO: 164344 - DNA, 20 bp, Artificial
  CRISPR gRNA sequence
gggttctggaaggggttttt

SEQ ID NO: 164345 - DNA, 20 bp, Artificial
  CRISPR gRNA sequence
ggttctggaaggggttttta

SEQ ID NO: 164346 - DNA, 20 bp, Artificial
  CRISPR gRNA sequence
tggaaggggtttttaaaggg

SEQ ID NO: 164347 - DNA, 20 bp, Artificial
  CRISPR gRNA sequence
gaaggggtttttaaagggtt

SEQ ID NO: 164348 - DNA, 20 bp, Artificial
  CRISPR gRNA sequence
ttaaagggtttgctttttgt

SEQ ID NO: 164349 - DNA, 20 bp, Artificial
  CRISPR gRNA sequence
taaagggtttgctttttgtc

SEQ ID NO: 164350 - DNA, 20 bp, Artificial
  CRISPR gRNA sequence
aaagggtttgctttttgtct

SEQ ID NO: 164351 - DNA, 20 bp, Artificial
  CRISPR gRNA sequence
aagggtttgctttttgtctg

SEQ ID NO: 164352 - DNA, 20 bp, Artificial
  CRISPR gRNA sequence
gctttttgtctgacaaaaag

SEQ ID NO: 164353 - DNA, 20 bp, Artificial
  CRISPR gRNA sequence
ctttttgtctgacaaaaaga

SEQ ID NO: 164354 - DNA, 20 bp, Artificial
  CRISPR gRNA sequence
tttgtctgacaaaaagatca

SEQ ID NO: 164355 - DNA, 20 bp, Artificial
  CRISPR gRNA sequence
ttgtctgacaaaaagatcat

SEQ ID NO: 164356 - DNA, 20 bp, Artificial
  CRISPR gRNA sequence
tgtctgacaaaaagatcata

SEQ ID NO: 164357 - DNA, 20 bp, Artificial
  CRISPR gRNA sequence
gtctgacaaaaagatcatat

SEQ ID NO: 164358 - DNA, 20 bp, Artificial
  CRISPR gRNA sequence
tctgacaaaaagatcatatt

SEQ ID NO: 164359 - DNA, 20 bp, Artificial
  CRISPR gRNA sequence
acaaaaagatcatattcaat

SEQ ID NO: 164360 - DNA, 20 bp, Artificial
  CRISPR gRNA sequence
aatactagatcagctgtagt

SEQ ID NO: 164361 - DNA, 20 bp, Artificial
  CRISPR gRNA sequence
gatcagctgtagttggggat

SEQ ID NO: 164362 - DNA, 20 bp, Artificial
  CRISPR gRNA sequence
tagttggggataactggaga

SEQ ID NO: 164363 - DNA, 20 bp, Artificial
  CRISPR gRNA sequence
gggataactggagactaaac

SEQ ID NO: 164364 - DNA, 20 bp, Artificial
  CRISPR gRNA sequence
gagactaaacaatcacaggt

SEQ ID NO: 164365 - DNA, 20 bp, Artificial
  CRISPR gRNA sequence
aacaatcacaggtcacggct

SEQ ID NO: 164366 - DNA, 20 bp, Artificial
  CRISPR gRNA sequence
gaaaatgcaggtgtctccct

SEQ ID NO: 164367 - DNA, 20 bp, Artificial
  CRISPR gRNA sequence
cctgctgcctagcttcctac

SEQ ID NO: 164368 - DNA, 20 bp, Artificial
  CRISPR gRNA sequence
ctgcctagcttcctacacag

SEQ ID NO: 164369 - DNA, 20 bp, Artificial
  CRISPR gRNA sequence
cctagcttcctacacagctg

SEQ ID NO: 164370 - DNA, 20 bp, Artificial
  CRISPR gRNA sequence
gcttcctacacagctggttc

SEQ ID NO: 164371 - DNA, 20 bp, Artificial
  CRISPR gRNA sequence
cctacacagctggttctgag

SEQ ID NO: 164372 - DNA, 20 bp, Artificial
  CRISPR gRNA sequence
ctacacagctggttctgagg

SEQ ID NO: 164373 - DNA, 20 bp, Artificial
  CRISPR gRNA sequence
cacagctggttctgaggctc

SEQ ID NO: 164374 - DNA, 20 bp, Artificial
  CRISPR gRNA sequence
gttctgaggctctcattcct

SEQ ID NO: 164375 - DNA, 20 bp, Artificial
  CRISPR gRNA sequence
tgaggctctcattcctgtat

SEQ ID NO: 164376 - DNA, 20 bp, Artificial
  CRISPR gRNA sequence
aggctctcattcctgtatac

SEQ ID NO: 164377 - DNA, 20 bp, Artificial
  CRISPR gRNA sequence
tcattcctgtataccctctc

SEQ ID NO: 164378 - DNA, 20 bp, Artificial
  CRISPR gRNA sequence
attcctgtataccctctcat

SEQ ID NO: 164379 - DNA, 20 bp, Artificial
  CRISPR gRNA sequence
ctgtataccctctcattacc

SEQ ID NO: 164380 - DNA, 20 bp, Artificial
  CRISPR gRNA sequence
tataccctctcattacccaa

SEQ ID NO: 164381 - DNA, 20 bp, Artificial
  CRISPR gRNA sequence
tcattacccaagagcttttc

SEQ ID NO: 164382 - DNA, 20 bp, Artificial
  CRISPR gRNA sequence
attacccaagagcttttcca

SEQ ID NO: 164383 - DNA, 20 bp, Artificial
  CRISPR gRNA sequence
cccaagagcttttccaagtt

SEQ ID NO: 164384 - DNA, 20 bp, Artificial
  CRISPR gRNA sequence
ttccaagttaggtctggatt

SEQ ID NO: 164385 - DNA, 20 bp, Artificial
  CRISPR gRNA sequence
tccaagttaggtctggattt

SEQ ID NO: 164386 - DNA, 20 bp, Artificial
  CRISPR gRNA sequence
ccaagttaggtctggatttc

SEQ ID NO: 164387 - DNA, 20 bp, Artificial
  CRISPR gRNA sequence
caagttaggtctggatttca

SEQ ID NO: 164388 - DNA, 20 bp, Artificial
  CRISPR gRNA sequence
ggtctggatttcagtgattt

SEQ ID NO: 164389 - DNA, 20 bp, Artificial
  CRISPR gRNA sequence
gatttcagtgatttgtgctt

SEQ ID NO: 164390 - DNA, 20 bp, Artificial
  CRISPR gRNA sequence
cagtgatttgtgctttttgt

SEQ ID NO: 164391 - DNA, 20 bp, Artificial
  CRISPR gRNA sequence
agtgatttgtgctttttgta

SEQ ID NO: 164392 - DNA, 20 bp, Artificial
  CRISPR gRNA sequence
gtgctttttgtaaaataata

SEQ ID NO: 164393 - DNA, 20 bp, Artificial
  CRISPR gRNA sequence
tgctttttgtaaaataataa

SEQ ID NO: 164394 - DNA, 20 bp, Artificial
  CRISPR gRNA sequence
tttgtaaaataataagggag

SEQ ID NO: 164395 - DNA, 20 bp, Artificial
  CRISPR gRNA sequence
ttgtaaaataataagggaga

SEQ ID NO: 164396 - DNA, 20 bp, Artificial
  CRISPR gRNA sequence
tgtaaaataataagggagat

SEQ ID NO: 164397 - DNA, 20 bp, Artificial
  CRISPR gRNA sequence
gtaaaataataagggagatc

SEQ ID NO: 164398 - DNA, 20 bp, Artificial
  CRISPR gRNA sequence
taaaataataagggagatct

SEQ ID NO: 164399 - DNA, 20 bp, Artificial
  CRISPR gRNA sequence
agtggaacacaagtaccttg

SEQ ID NO: 164400 - DNA, 20 bp, Artificial
  CRISPR gRNA sequence
gaacctacttcaatagcttt

SEQ ID NO: 164401 - DNA, 20 bp, Artificial
  CRISPR gRNA sequence
aacctacttcaatagctttg

SEQ ID NO: 164402 - DNA, 20 bp, Artificial
  CRISPR gRNA sequence
cttcaatagctttgcaaaga

SEQ ID NO: 164403 - DNA, 20 bp, Artificial
  CRISPR gRNA sequence
caatagctttgcaaagagca

SEQ ID NO: 164404 - DNA, 20 bp, Artificial
  CRISPR gRNA sequence
aatagctttgcaaagagcag

SEQ ID NO: 164405 - DNA, 20 bp, Artificial
  CRISPR gRNA sequence
tgcaaagagcagttggcttc

SEQ ID NO: 164406 - DNA, 20 bp, Artificial
  CRISPR gRNA sequence
gcaaagagcagttggcttct

SEQ ID NO: 164407 - DNA, 20 bp, Artificial
  CRISPR gRNA sequence
caaagagcagttggcttctg

SEQ ID NO: 164408 - DNA, 20 bp, Artificial
  CRISPR gRNA sequence
gcttctgtttcttggctgca

SEQ ID NO: 164409 - DNA, 20 bp, Artificial
  CRISPR gRNA sequence
ctgtttcttggctgcaaaag

SEQ ID NO: 164410 - DNA, 20 bp, Artificial
  CRISPR gRNA sequence
tgtttcttggctgcaaaagg

SEQ ID NO: 164411 - DNA, 20 bp, Artificial
  CRISPR gRNA sequence
tttcttggctgcaaaaggta

SEQ ID NO: 164412 - DNA, 20 bp, Artificial
  CRISPR gRNA sequence
cttggctgcaaaaggtatca

SEQ ID NO: 164413 - DNA, 20 bp, Artificial
  CRISPR gRNA sequence
ttggctgcaaaaggtatcag

SEQ ID NO: 164414 - DNA, 20 bp, Artificial
  CRISPR gRNA sequence
ggctgcaaaaggtatcagta

SEQ ID NO: 164415 - DNA, 20 bp, Artificial
  CRISPR gRNA sequence
gctgcaaaaggtatcagtat

SEQ ID NO: 164416 - DNA, 20 bp, Artificial
  CRISPR gRNA sequence
caaaaggtatcagtatttta

SEQ ID NO: 164417 - DNA, 20 bp, Artificial
  CRISPR gRNA sequence
tagctttgccacagccaata

SEQ ID NO: 164418 - DNA, 20 bp, Artificial
  CRISPR gRNA sequence
agctttgccacagccaatac

SEQ ID NO: 164419 - DNA, 20 bp, Artificial
  CRISPR gRNA sequence
gctttgccacagccaatacc

SEQ ID NO: 164420 - DNA, 20 bp, Artificial
  CRISPR gRNA sequence
tgccacagccaatacctagt

SEQ ID NO: 164421 - DNA, 20 bp, Artificial
  CRISPR gRNA sequence
gccacagccaatacctagtt

SEQ ID NO: 164422 - DNA, 20 bp, Artificial
  CRISPR gRNA sequence
ccacagccaatacctagttt

SEQ ID NO: 164423 - DNA, 20 bp, Artificial
  CRISPR gRNA sequence
gtttccaggctgacatttat

SEQ ID NO: 164424 - DNA, 20 bp, Artificial
  CRISPR gRNA sequence
ccaggctgacatttatttat

SEQ ID NO: 164425 - DNA, 20 bp, Artificial
  CRISPR gRNA sequence
caggctgacatttatttata

SEQ ID NO: 164426 - DNA, 20 bp, Artificial
  CRISPR gRNA sequence
acatttatttataatgatga

SEQ ID NO: 164427 - DNA, 20 bp, Artificial
  CRISPR gRNA sequence
atttataatgatgataagtt

SEQ ID NO: 164428 - DNA, 20 bp, Artificial
  CRISPR gRNA sequence
tttataatgatgataagttg

SEQ ID NO: 164429 - DNA, 20 bp, Artificial
  CRISPR gRNA sequence
ataatgatgataagttgggg

SEQ ID NO: 164430 - DNA, 20 bp, Artificial
  CRISPR gRNA sequence
taatgatgataagttggggt

SEQ ID NO: 164431 - DNA, 20 bp, Artificial
  CRISPR gRNA sequence
gggttgaaattgttgtggaa

SEQ ID NO: 164432 - DNA, 20 bp, Artificial
  CRISPR gRNA sequence
aaattgttgtggaaattgag

SEQ ID NO: 164433 - DNA, 20 bp, Artificial
  CRISPR gRNA sequence
ttgtggaaattgagacctag

SEQ ID NO: 164434 - DNA, 20 bp, Artificial
  CRISPR gRNA sequence
tggaaattgagacctagatg

SEQ ID NO: 164435 - DNA, 20 bp, Artificial
  CRISPR gRNA sequence
agacctagatgaaaataaaa

SEQ ID NO: 164436 - DNA, 20 bp, Artificial
  CRISPR gRNA sequence
gatgaaaataaaagggaatc

SEQ ID NO: 164437 - DNA, 20 bp, Artificial
  CRISPR gRNA sequence
cttttccttctgccttagca

SEQ ID NO: 164438 - DNA, 20 bp, Artificial
  CRISPR gRNA sequence
ttccttctgccttagcataa

SEQ ID NO: 164439 - DNA, 20 bp, Artificial
  CRISPR gRNA sequence
tccttctgccttagcataat

SEQ ID NO: 164440 - DNA, 20 bp, Artificial
  CRISPR gRNA sequence
ccttctgccttagcataatc

SEQ ID NO: 164441 - DNA, 20 bp, Artificial
  CRISPR gRNA sequence
cttctgccttagcataatca

SEQ ID NO: 164442 - DNA, 20 bp, Artificial
  CRISPR gRNA sequence
ctgccttagcataatcatat

SEQ ID NO: 164443 - DNA, 20 bp, Artificial
  CRISPR gRNA sequence
tgccttagcataatcatatt

SEQ ID NO: 164444 - DNA, 20 bp, Artificial
  CRISPR gRNA sequence
ccttagcataatcatattga

SEQ ID NO: 164445 - DNA, 20 bp, Artificial
  CRISPR gRNA sequence
agcataatcatattgagggt

SEQ ID NO: 164446 - DNA, 20 bp, Artificial
  CRISPR gRNA sequence
gcataatcatattgagggtt

SEQ ID NO: 164447 - DNA, 20 bp, Artificial
  CRISPR gRNA sequence
agggttaaaactatttgtgt

SEQ ID NO: 164448 - DNA, 20 bp, Artificial
  CRISPR gRNA sequence
aaactatttgtgtctgaagc

SEQ ID NO: 164449 - DNA, 20 bp, Artificial
  CRISPR gRNA sequence
tttgtgtctgaagcacagac

SEQ ID NO: 164450 - DNA, 20 bp, Artificial
  CRISPR gRNA sequence
gtgtctgaagcacagactat

SEQ ID NO: 164451 - DNA, 20 bp, Artificial
  CRISPR gRNA sequence
tgtctgaagcacagactata

SEQ ID NO: 164452 - DNA, 20 bp, Artificial
  CRISPR gRNA sequence
aagcacagactatatcaacc

SEQ ID NO: 164453 - DNA, 20 bp, Artificial
  CRISPR gRNA sequence
tatcaacctaaaaagtcagt

SEQ ID NO: 164454 - DNA, 20 bp, Artificial
  CRISPR gRNA sequence
aaaagtcagttcatatatta

SEQ ID NO: 164455 - DNA, 20 bp, Artificial
  CRISPR gRNA sequence
atatattaacttagaaaccc

SEQ ID NO: 164456 - DNA, 20 bp, Artificial
  CRISPR gRNA sequence
acttagaaacccagaatgtt

SEQ ID NO: 164457 - DNA, 20 bp, Artificial
  CRISPR gRNA sequence
agaaacccagaatgttacag

SEQ ID NO: 164458 - DNA, 20 bp, Artificial
  CRISPR gRNA sequence
gaaacccagaatgttacagg

SEQ ID NO: 164459 - DNA, 20 bp, Artificial
  CRISPR gRNA sequence
caggtatctccctaagctgg

SEQ ID NO: 164460 - DNA, 20 bp, Artificial
  CRISPR gRNA sequence
cctaagctgggtagatggct

SEQ ID NO: 164461 - DNA, 20 bp, Artificial
  CRISPR gRNA sequence
agctgggtagatggctgtca

SEQ ID NO: 164462 - DNA, 20 bp, Artificial
  CRISPR gRNA sequence
ggtagatggctgtcaagtaa

SEQ ID NO: 164463 - DNA, 20 bp, Artificial
  CRISPR gRNA sequence
tcaagtaaccatgtcatgca

SEQ ID NO: 164464 - DNA, 20 bp, Artificial
  CRISPR gRNA sequence
ctcaggggtagatactggca

SEQ ID NO: 164465 - DNA, 20 bp, Artificial
  CRISPR gRNA sequence
tcaggggtagatactggcag

SEQ ID NO: 164466 - DNA, 20 bp, Artificial
  CRISPR gRNA sequence
aggggtagatactggcagtc

SEQ ID NO: 164467 - DNA, 20 bp, Artificial
  CRISPR gRNA sequence
gcagtcctagttttagtatc

SEQ ID NO: 164468 - DNA, 20 bp, Artificial
  CRISPR gRNA sequence
gttttagtatcctagccccc

SEQ ID NO: 164469 - DNA, 20 bp, Artificial
  CRISPR gRNA sequence
tagtatcctagcccccagac

SEQ ID NO: 164470 - DNA, 20 bp, Artificial
  CRISPR gRNA sequence
agtatcctagcccccagaca

SEQ ID NO: 164471 - DNA, 20 bp, Artificial
  CRISPR gRNA sequence
gtatcctagcccccagacat

SEQ ID NO: 164472 - DNA, 20 bp, Artificial
  CRISPR gRNA sequence
gcccccagacatcaggcaaa

SEQ ID NO: 164473 - DNA, 20 bp, Artificial
  CRISPR gRNA sequence
agctctgttccacaggggac

SEQ ID NO: 164474 - DNA, 20 bp, Artificial
  CRISPR gRNA sequence
tgttccacaggggacactag

SEQ ID NO: 164475 - DNA, 20 bp, Artificial
  CRISPR gRNA sequence
ttccacaggggacactagct

SEQ ID NO: 164476 - DNA, 20 bp, Artificial
  CRISPR gRNA sequence
cacaggggacactagctgct

SEQ ID NO: 164477 - DNA, 20 bp, Artificial
  CRISPR gRNA sequence
gctgcttcctcacactgtgg

SEQ ID NO: 164478 - DNA, 20 bp, Artificial
  CRISPR gRNA sequence
cttcctcacactgtggccac

SEQ ID NO: 164479 - DNA, 20 bp, Artificial
  CRISPR gRNA sequence
cctcacactgtggccacaga

SEQ ID NO: 164480 - DNA, 20 bp, Artificial
  CRISPR gRNA sequence
ctcacactgtggccacagag

SEQ ID NO: 164481 - DNA, 20 bp, Artificial
  CRISPR gRNA sequence
acactgtggccacagagtct

SEQ ID NO: 164482 - DNA, 20 bp, Artificial
  CRISPR gRNA sequence
tggccacagagtcttagagg

SEQ ID NO: 164483 - DNA, 20 bp, Artificial
  CRISPR gRNA sequence
agaggtaccaaaagagagtt

SEQ ID NO: 164484 - DNA, 20 bp, Artificial
  CRISPR gRNA sequence
gaggtaccaaaagagagttt

SEQ ID NO: 164485 - DNA, 20 bp, Artificial
  CRISPR gRNA sequence
agagactacttttttctatt

SEQ ID NO: 164486 - DNA, 20 bp, Artificial
  CRISPR gRNA sequence
gagactacttttttctattg

SEQ ID NO: 164487 - DNA, 20 bp, Artificial
  CRISPR gRNA sequence
cttttttctattggtaacag

SEQ ID NO: 164488 - DNA, 20 bp, Artificial
  CRISPR gRNA sequence
ttttctattggtaacagctg

SEQ ID NO: 164489 - DNA, 20 bp, Artificial
  CRISPR gRNA sequence
tttctattggtaacagctgt

SEQ ID NO: 164490 - DNA, 20 bp, Artificial
  CRISPR gRNA sequence
ttctattggtaacagctgtt

SEQ ID NO: 164491 - DNA, 20 bp, Artificial
  CRISPR gRNA sequence
tctattggtaacagctgttg

SEQ ID NO: 164492 - DNA, 20 bp, Artificial
  CRISPR gRNA sequence
ctattggtaacagctgttgg

SEQ ID NO: 164493 - DNA, 20 bp, Artificial
  CRISPR gRNA sequence
tattggtaacagctgttggg

SEQ ID NO: 164494 - DNA, 20 bp, Artificial
  CRISPR gRNA sequence
ttggtaacagctgttgggtt

SEQ ID NO: 164495 - DNA, 20 bp, Artificial
  CRISPR gRNA sequence
gtaacagctgttgggtttaa

SEQ ID NO: 164496 - DNA, 20 bp, Artificial
  CRISPR gRNA sequence
ttgggtttaagagaatttgt

SEQ ID NO: 164497 - DNA, 20 bp, Artificial
  CRISPR gRNA sequence
ggtttaagagaatttgtcat

SEQ ID NO: 164498 - DNA, 20 bp, Artificial
  CRISPR gRNA sequence
aagagaatttgtcatatcag

SEQ ID NO: 164499 - DNA, 20 bp, Artificial
  CRISPR gRNA sequence
agagaatttgtcatatcagc

SEQ ID NO: 164500 - DNA, 20 bp, Artificial
  CRISPR gRNA sequence
gtcatatcagcaagttggat

SEQ ID NO: 164501 - DNA, 20 bp, Artificial
  CRISPR gRNA sequence
tcatatcagcaagttggatt

SEQ ID NO: 164502 - DNA, 20 bp, Artificial
  CRISPR gRNA sequence
gattcagagaactactttcc

SEQ ID NO: 164503 - DNA, 20 bp, Artificial
  CRISPR gRNA sequence
agagaactactttcctgcct

SEQ ID NO: 164504 - DNA, 20 bp, Artificial
  CRISPR gRNA sequence
ctttcctgcctctaactgtc

SEQ ID NO: 164505 - DNA, 20 bp, Artificial
  CRISPR gRNA sequence
tcctgcctctaactgtctgc

SEQ ID NO: 164506 - DNA, 20 bp, Artificial
  CRISPR gRNA sequence
cctgcctctaactgtctgcc

SEQ ID NO: 164507 - DNA, 20 bp, Artificial
  CRISPR gRNA sequence
ctgcctctaactgtctgcct

SEQ ID NO: 164508 - DNA, 20 bp, Artificial
  CRISPR gRNA sequence
cctctaactgtctgcctgtc

SEQ ID NO: 164509 - DNA, 20 bp, Artificial
  CRISPR gRNA sequence
taactgtctgcctgtctaaa

SEQ ID NO: 164510 - DNA, 20 bp, Artificial
  CRISPR gRNA sequence
actgtctgcctgtctaaatc

SEQ ID NO: 164511 - DNA, 20 bp, Artificial
  CRISPR gRNA sequence
tctgcctgtctaaatccatt

SEQ ID NO: 164512 - DNA, 20 bp, Artificial
  CRISPR gRNA sequence
cctgtctaaatccattcatc

SEQ ID NO: 164513 - DNA, 20 bp, Artificial
  CRISPR gRNA sequence
tctaaatccattcatcattc

SEQ ID NO: 164514 - DNA, 20 bp, Artificial
  CRISPR gRNA sequence
aatccattcatcattcatca

SEQ ID NO: 164515 - DNA, 20 bp, Artificial
  CRISPR gRNA sequence
atcattcatcacgcacttac

SEQ ID NO: 164516 - DNA, 20 bp, Artificial
  CRISPR gRNA sequence
atcacgcacttactgagtgc

SEQ ID NO: 164517 - DNA, 20 bp, Artificial
  CRISPR gRNA sequence
actgagtgcctacctgggaa

SEQ ID NO: 164518 - DNA, 20 bp, Artificial
  CRISPR gRNA sequence
ctgagtgcctacctgggaac

SEQ ID NO: 164519 - DNA, 20 bp, Artificial
  CRISPR gRNA sequence
agtgcctacctgggaacgcg

SEQ ID NO: 164520 - DNA, 20 bp, Artificial
  CRISPR gRNA sequence
cctgggaacgcgggggatag

SEQ ID NO: 164521 - DNA, 20 bp, Artificial
  CRISPR gRNA sequence
ggaacgcgggggatagcaga

SEQ ID NO: 164522 - DNA, 20 bp, Artificial
  CRISPR gRNA sequence
ggctttgccctcatggtgct

SEQ ID NO: 164523 - DNA, 20 bp, Artificial
  CRISPR gRNA sequence
tgccctcatggtgcttaaca

SEQ ID NO: 164524 - DNA, 20 bp, Artificial
  CRISPR gRNA sequence
gccctcatggtgcttaacat

SEQ ID NO: 164525 - DNA, 20 bp, Artificial
  CRISPR gRNA sequence
ccctcatggtgcttaacatt

SEQ ID NO: 164526 - DNA, 20 bp, Artificial
  CRISPR gRNA sequence
atggtgcttaacattttagt

SEQ ID NO: 164527 - DNA, 20 bp, Artificial
  CRISPR gRNA sequence
aacattttagtagaacagac

SEQ ID NO: 164528 - DNA, 20 bp, Artificial
  CRISPR gRNA sequence
acattttagtagaacagaca

SEQ ID NO: 164529 - DNA, 20 bp, Artificial
  CRISPR gRNA sequence
tagtagaacagacagttaat

SEQ ID NO: 164530 - DNA, 20 bp, Artificial
  CRISPR gRNA sequence
agtagaacagacagttaatt

SEQ ID NO: 164531 - DNA, 20 bp, Artificial
  CRISPR gRNA sequence
gtagaacagacagttaattt

SEQ ID NO: 164532 - DNA, 20 bp, Artificial
  CRISPR gRNA sequence
atttgacatgcaagtgcaaa

SEQ ID NO: 164533 - DNA, 20 bp, Artificial
  CRISPR gRNA sequence
gacatgcaagtgcaaaaatg

SEQ ID NO: 164534 - DNA, 20 bp, Artificial
  CRISPR gRNA sequence
acatgcaagtgcaaaaatgt

SEQ ID NO: 164535 - DNA, 20 bp, Artificial
  CRISPR gRNA sequence
tgaggacagtactttggaag

SEQ ID NO: 164536 - DNA, 20 bp, Artificial
  CRISPR gRNA sequence
tggaagcacagttgagggca

SEQ ID NO: 164537 - DNA, 20 bp, Artificial
  CRISPR gRNA sequence
ggaagcacagttgagggcac

SEQ ID NO: 164538 - DNA, 20 bp, Artificial
  CRISPR gRNA sequence
gaagcacagttgagggcacc

SEQ ID NO: 164539 - DNA, 20 bp, Artificial
  CRISPR gRNA sequence
agggcacctaacatagtgtg

SEQ ID NO: 164540 - DNA, 20 bp, Artificial
  CRISPR gRNA sequence
acatagtgtggggatggggt

SEQ ID NO: 164541 - DNA, 20 bp, Artificial
  CRISPR gRNA sequence
tgtaaatgttactttgggga

SEQ ID NO: 164542 - DNA, 20 bp, Artificial
  CRISPR gRNA sequence
gtaaatgttactttggggag

SEQ ID NO: 164543 - DNA, 20 bp, Artificial
  CRISPR gRNA sequence
taaatgttactttggggagt

SEQ ID NO: 164544 - DNA, 20 bp, Artificial
  CRISPR gRNA sequence
ctttggggagttggaggcaa

SEQ ID NO: 164545 - DNA, 20 bp, Artificial
  CRISPR gRNA sequence
tggggagttggaggcaatcc

SEQ ID NO: 164546 - DNA, 20 bp, Artificial
  CRISPR gRNA sequence
ggggagttggaggcaatcca

SEQ ID NO: 164547 - DNA, 20 bp, Artificial
  CRISPR gRNA sequence
gggagttggaggcaatccac

SEQ ID NO: 164548 - DNA, 20 bp, Artificial
  CRISPR gRNA sequence
gaggcaatccacagggtctg

SEQ ID NO: 164549 - DNA, 20 bp, Artificial
  CRISPR gRNA sequence
tgtacatctaagaagtgtct

SEQ ID NO: 164550 - DNA, 20 bp, Artificial
  CRISPR gRNA sequence
agaagtgtcttttcctcttt

SEQ ID NO: 164551 - DNA, 20 bp, Artificial
  CRISPR gRNA sequence
ttcctcttttctggaacgtg

SEQ ID NO: 164552 - DNA, 20 bp, Artificial
  CRISPR gRNA sequence
tcctcttttctggaacgtgg

SEQ ID NO: 164553 - DNA, 20 bp, Artificial
  CRISPR gRNA sequence
cctcttttctggaacgtggc

SEQ ID NO: 164554 - DNA, 20 bp, Artificial
  CRISPR gRNA sequence
ctcttttctggaacgtggca

SEQ ID NO: 164555 - DNA, 20 bp, Artificial
  CRISPR gRNA sequence
ttttctggaacgtggcaaac

SEQ ID NO: 164556 - DNA, 20 bp, Artificial
  CRISPR gRNA sequence
ttctggaacgtggcaaactt

SEQ ID NO: 164557 - DNA, 20 bp, Artificial
  CRISPR gRNA sequence
tctggaacgtggcaaacttt

SEQ ID NO: 164558 - DNA, 20 bp, Artificial
  CRISPR gRNA sequence
ctggaacgtggcaaactttg

SEQ ID NO: 164559 - DNA, 20 bp, Artificial
  CRISPR gRNA sequence
tggaacgtggcaaactttgc

SEQ ID NO: 164560 - DNA, 20 bp, Artificial
  CRISPR gRNA sequence
gaacgtggcaaactttgccc

SEQ ID NO: 164561 - DNA, 20 bp, Artificial
  CRISPR gRNA sequence
tgccctgaataaggacatga

SEQ ID NO: 164562 - DNA, 20 bp, Artificial
  CRISPR gRNA sequence
gccctgaataaggacatgag

SEQ ID NO: 164563 - DNA, 20 bp, Artificial
  CRISPR gRNA sequence
ccctgaataaggacatgagt

SEQ ID NO: 164564 - DNA, 20 bp, Artificial
  CRISPR gRNA sequence
aataaggacatgagtaaatt

SEQ ID NO: 164565 - DNA, 20 bp, Artificial
  CRISPR gRNA sequence
agctaatatttttactcagc

SEQ ID NO: 164566 - DNA, 20 bp, Artificial
  CRISPR gRNA sequence
gctaatatttttactcagcc

SEQ ID NO: 164567 - DNA, 20 bp, Artificial
  CRISPR gRNA sequence
atatttttactcagccagcc

SEQ ID NO: 164568 - DNA, 20 bp, Artificial
  CRISPR gRNA sequence
ttactcagccagcccaagtg

SEQ ID NO: 164569 - DNA, 20 bp, Artificial
  CRISPR gRNA sequence
tactcagccagcccaagtgg

SEQ ID NO: 164570 - DNA, 20 bp, Artificial
  CRISPR gRNA sequence
actcagccagcccaagtggt

SEQ ID NO: 164571 - DNA, 20 bp, Artificial
  CRISPR gRNA sequence
ctcagccagcccaagtggtt

SEQ ID NO: 164572 - DNA, 20 bp, Artificial
  CRISPR gRNA sequence
agccagcccaagtggttctg

SEQ ID NO: 164573 - DNA, 20 bp, Artificial
  CRISPR gRNA sequence
tgtgtttttattgtttttgt

SEQ ID NO: 164574 - DNA, 20 bp, Artificial
  CRISPR gRNA sequence
tgtttttattgtttttgttg

SEQ ID NO: 164575 - DNA, 20 bp, Artificial
  CRISPR gRNA sequence
ttattgtttttgttgtccca

SEQ ID NO: 164576 - DNA, 20 bp, Artificial
  CRISPR gRNA sequence
tattgtttttgttgtcccag

SEQ ID NO: 164577 - DNA, 20 bp, Artificial
  CRISPR gRNA sequence
attgtttttgttgtcccagg

SEQ ID NO: 164578 - DNA, 20 bp, Artificial
  CRISPR gRNA sequence
ttgtttttgttgtcccaggc

SEQ ID NO: 164579 - DNA, 20 bp, Artificial
  CRISPR gRNA sequence
tttttgttgtcccaggcagg

SEQ ID NO: 164580 - DNA, 20 bp, Artificial
  CRISPR gRNA sequence
ttgttgtcccaggcaggggc

SEQ ID NO: 164581 - DNA, 20 bp, Artificial
  CRISPR gRNA sequence
tgttgtcccaggcaggggca

SEQ ID NO: 164582 - DNA, 20 bp, Artificial
  CRISPR gRNA sequence
gttgtcccaggcaggggcac

SEQ ID NO: 164583 - DNA, 20 bp, Artificial
  CRISPR gRNA sequence
ttgtcccaggcaggggcacc

SEQ ID NO: 164584 - DNA, 20 bp, Artificial
  CRISPR gRNA sequence
tcccaggcaggggcaccatg

SEQ ID NO: 164585 - DNA, 20 bp, Artificial
  CRISPR gRNA sequence
cggatcagacgccgttctgt

SEQ ID NO: 164586 - DNA, 20 bp, Artificial
  CRISPR gRNA sequence
tgtgtcagtggtcaggggct

SEQ ID NO: 164587 - DNA, 20 bp, Artificial
  CRISPR gRNA sequence
tgtcagtggtcaggggctga

SEQ ID NO: 164588 - DNA, 20 bp, Artificial
  CRISPR gRNA sequence
atcaaccctggaccctgtgg

SEQ ID NO: 164589 - DNA, 20 bp, Artificial
  CRISPR gRNA sequence
gaccctgtgggctataacca

SEQ ID NO: 164590 - DNA, 20 bp, Artificial
  CRISPR gRNA sequence
tgggctataaccatgctgta

SEQ ID NO: 164591 - DNA, 20 bp, Artificial
  CRISPR gRNA sequence
taaccatgctgtagtgtgtg

SEQ ID NO: 164592 - DNA, 20 bp, Artificial
  CRISPR gRNA sequence
tagtgtgtgtaaacatccta

SEQ ID NO: 164593 - DNA, 20 bp, Artificial
  CRISPR gRNA sequence
cactctcagctgtgagctca

SEQ ID NO: 164594 - DNA, 20 bp, Artificial
  CRISPR gRNA sequence
tcagctgtgagctcaaggtg

SEQ ID NO: 164595 - DNA, 20 bp, Artificial
  CRISPR gRNA sequence
agctgtgagctcaaggtggc

SEQ ID NO: 164596 - DNA, 20 bp, Artificial
  CRISPR gRNA sequence
tgagctcaaggtggctggga

SEQ ID NO: 164597 - DNA, 20 bp, Artificial
  CRISPR gRNA sequence
aaggtggctgggagagggtt

SEQ ID NO: 164598 - DNA, 20 bp, Artificial
  CRISPR gRNA sequence
ggagagggttgtttactcct

SEQ ID NO: 164599 - DNA, 20 bp, Artificial
  CRISPR gRNA sequence
tttactccttctgccatgga

SEQ ID NO: 164600 - DNA, 20 bp, Artificial
  CRISPR gRNA sequence
actccttctgccatggaaaa

SEQ ID NO: 164601 - DNA, 20 bp, Artificial
  CRISPR gRNA sequence
ctccttctgccatggaaaac

SEQ ID NO: 164602 - DNA, 20 bp, Artificial
  CRISPR gRNA sequence
cttctgccatggaaaacatc

SEQ ID NO: 164603 - DNA, 20 bp, Artificial
  CRISPR gRNA sequence
ctgccatggaaaacatcagc

SEQ ID NO: 164604 - DNA, 20 bp, Artificial
  CRISPR gRNA sequence
tgccatggaaaacatcagct

SEQ ID NO: 164605 - DNA, 20 bp, Artificial
  CRISPR gRNA sequence
ccatggaaaacatcagctga

SEQ ID NO: 164606 - DNA, 20 bp, Artificial
  CRISPR gRNA sequence
aagaaggaacagtctccact

SEQ ID NO: 164607 - DNA, 20 bp, Artificial
  CRISPR gRNA sequence
cactccgcagatcggacaga

SEQ ID NO: 164608 - DNA, 20 bp, Artificial
  CRISPR gRNA sequence
cgcagatcggacagaatgcg

SEQ ID NO: 164609 - DNA, 20 bp, Artificial
  CRISPR gRNA sequence
cctaatcagccaaggcagta

SEQ ID NO: 164610 - DNA, 20 bp, Artificial
  CRISPR gRNA sequence
atcagccaaggcagtacccc

SEQ ID NO: 164611 - DNA, 20 bp, Artificial
  CRISPR gRNA sequence
tccatcaggccccctgggtt

SEQ ID NO: 164612 - DNA, 20 bp, Artificial
  CRISPR gRNA sequence
ggttgcgcttctgtggctaa

SEQ ID NO: 164613 - DNA, 20 bp, Artificial
  CRISPR gRNA sequence
cgcttctgtggctaagtaca

SEQ ID NO: 164614 - DNA, 20 bp, Artificial
  CRISPR gRNA sequence
ctgtggctaagtacaaccag

SEQ ID NO: 164615 - DNA, 20 bp, Artificial
  CRISPR gRNA sequence
tgtggctaagtacaaccaga

SEQ ID NO: 164616 - DNA, 20 bp, Artificial
  CRISPR gRNA sequence
tggctaagtacaaccagaac

SEQ ID NO: 164617 - DNA, 20 bp, Artificial
  CRISPR gRNA sequence
agtacaaccagaaccagatg

SEQ ID NO: 164618 - DNA, 20 bp, Artificial
  CRISPR gRNA sequence
gatagacatgccctcagtga

SEQ ID NO: 164619 - DNA, 20 bp, Artificial
  CRISPR gRNA sequence
agtgaccacagagctttcaa

SEQ ID NO: 164620 - DNA, 20 bp, Artificial
  CRISPR gRNA sequence
tcaacaagctgtgaaaagct

SEQ ID NO: 164621 - DNA, 20 bp, Artificial
  CRISPR gRNA sequence
caacaagctgtgaaaagctg

SEQ ID NO: 164622 - DNA, 20 bp, Artificial
  CRISPR gRNA sequence
aacaagctgtgaaaagctgg

SEQ ID NO: 164623 - DNA, 20 bp, Artificial
  CRISPR gRNA sequence
tgaaaagctgggtacttgcc

SEQ ID NO: 164624 - DNA, 20 bp, Artificial
  CRISPR gRNA sequence
ggtacttgcctaccagtgct

SEQ ID NO: 164625 - DNA, 20 bp, Artificial
  CRISPR gRNA sequence
gcctaccagtgctctcgatc

SEQ ID NO: 164626 - DNA, 20 bp, Artificial
  CRISPR gRNA sequence
cctaccagtgctctcgatcc

SEQ ID NO: 164627 - DNA, 20 bp, Artificial
  CRISPR gRNA sequence
ccagtgctctcgatcctgaa

SEQ ID NO: 164628 - DNA, 20 bp, Artificial
  CRISPR gRNA sequence
tcgatcctgaaatttcagct

SEQ ID NO: 164629 - DNA, 20 bp, Artificial
  CRISPR gRNA sequence
gatcctgaaatttcagctca

SEQ ID NO: 164630 - DNA, 20 bp, Artificial
  CRISPR gRNA sequence
aaatttcagctcaggaaaag

SEQ ID NO: 164631 - DNA, 20 bp, Artificial
  CRISPR gRNA sequence
cagctcaggaaaagccctgt

SEQ ID NO: 164632 - DNA, 20 bp, Artificial
  CRISPR gRNA sequence
agctcaggaaaagccctgtt

SEQ ID NO: 164633 - DNA, 20 bp, Artificial
  CRISPR gRNA sequence
aggaaaagccctgtttccca

SEQ ID NO: 164634 - DNA, 20 bp, Artificial
  CRISPR gRNA sequence
tttcccattaacctgttctg

SEQ ID NO: 164635 - DNA, 20 bp, Artificial
  CRISPR gRNA sequence
cccattaacctgttctgtcc

SEQ ID NO: 164636 - DNA, 20 bp, Artificial
  CRISPR gRNA sequence
ccattaacctgttctgtccc

SEQ ID NO: 164637 - DNA, 20 bp, Artificial
  CRISPR gRNA sequence
acctgttctgtcccccttga

SEQ ID NO: 164638 - DNA, 20 bp, Artificial
  CRISPR gRNA sequence
ttctgtcccccttgaagtgg

SEQ ID NO: 164639 - DNA, 20 bp, Artificial
  CRISPR gRNA sequence
tgtcccccttgaagtggtgg

SEQ ID NO: 164640 - DNA, 20 bp, Artificial
  CRISPR gRNA sequence
tcccccttgaagtggtgggg

SEQ ID NO: 164641 - DNA, 20 bp, Artificial
  CRISPR gRNA sequence
gaagtggtggggctaaaacg

SEQ ID NO: 164642 - DNA, 20 bp, Artificial
  CRISPR gRNA sequence
aagtggtggggctaaaacga

SEQ ID NO: 164643 - DNA, 20 bp, Artificial
  CRISPR gRNA sequence
aaacgagaagagtgctgcct

SEQ ID NO: 164644 - DNA, 20 bp, Artificial
  CRISPR gRNA sequence
cctatttgggagattgggac

SEQ ID NO: 164645 - DNA, 20 bp, Artificial
  CRISPR gRNA sequence
tttgggagattgggaccagg

SEQ ID NO: 164646 - DNA, 20 bp, Artificial
  CRISPR gRNA sequence
gggagattgggaccaggcct

SEQ ID NO: 164647 - DNA, 20 bp, Artificial
  CRISPR gRNA sequence
ggagattgggaccaggcctg

SEQ ID NO: 164648 - DNA, 20 bp, Artificial
  CRISPR gRNA sequence
ggaccaggcctgagaggcat

SEQ ID NO: 164649 - DNA, 20 bp, Artificial
  CRISPR gRNA sequence
agaggcatgatgtttgggta

SEQ ID NO: 164650 - DNA, 20 bp, Artificial
  CRISPR gRNA sequence
gggtagcatcttcccaacac

SEQ ID NO: 164651 - DNA, 20 bp, Artificial
  CRISPR gRNA sequence
ggtagcatcttcccaacact

SEQ ID NO: 164652 - DNA, 20 bp, Artificial
  CRISPR gRNA sequence
cccaacacttgcaattagca

SEQ ID NO: 164653 - DNA, 20 bp, Artificial
  CRISPR gRNA sequence
ccaacacttgcaattagcac

SEQ ID NO: 164654 - DNA, 20 bp, Artificial
  CRISPR gRNA sequence
gcaattagcactgttctcag

SEQ ID NO: 164655 - DNA, 20 bp, Artificial
  CRISPR gRNA sequence
caattagcactgttctcaga

SEQ ID NO: 164656 - DNA, 20 bp, Artificial
  CRISPR gRNA sequence
gcactgttctcagatcacag

SEQ ID NO: 164657 - DNA, 20 bp, Artificial
  CRISPR gRNA sequence
ttctcagatcacaggccttg

SEQ ID NO: 164658 - DNA, 20 bp, Artificial
  CRISPR gRNA sequence
tcagatcacaggccttgaca

SEQ ID NO: 164659 - DNA, 20 bp, Artificial
  CRISPR gRNA sequence
agatcacaggccttgacagc

SEQ ID NO: 164660 - DNA, 20 bp, Artificial
  CRISPR gRNA sequence
gacagcatttactgacaagc

SEQ ID NO: 164661 - DNA, 20 bp, Artificial
  CRISPR gRNA sequence
acagcatttactgacaagca

SEQ ID NO: 164662 - DNA, 20 bp, Artificial
  CRISPR gRNA sequence
actgacaagcactgctggtg

SEQ ID NO: 164663 - DNA, 20 bp, Artificial
  CRISPR gRNA sequence
ctgacaagcactgctggtgt

SEQ ID NO: 164664 - DNA, 20 bp, Artificial
  CRISPR gRNA sequence
acaagcactgctggtgtgtg

SEQ ID NO: 164665 - DNA, 20 bp, Artificial
  CRISPR gRNA sequence
ctggtgtgtggtttttagtt

SEQ ID NO: 164666 - DNA, 20 bp, Artificial
  CRISPR gRNA sequence
gtgtgtggtttttagttacg

SEQ ID NO: 164667 - DNA, 20 bp, Artificial
  CRISPR gRNA sequence
ttagttacggtacttatttg

SEQ ID NO: 164668 - DNA, 20 bp, Artificial
  CRISPR gRNA sequence
tagttacggtacttatttgc

SEQ ID NO: 164669 - DNA, 20 bp, Artificial
  CRISPR gRNA sequence
agttacggtacttatttgcc

SEQ ID NO: 164670 - DNA, 20 bp, Artificial
  CRISPR gRNA sequence
gttacggtacttatttgccc

SEQ ID NO: 164671 - DNA, 20 bp, Artificial
  CRISPR gRNA sequence
cggtacttatttgcccgttt

SEQ ID NO: 164672 - DNA, 20 bp, Artificial
  CRISPR gRNA sequence
atttgcccgtttgcaactta

SEQ ID NO: 164673 - DNA, 20 bp, Artificial
  CRISPR gRNA sequence
tttgcccgtttgcaacttat

SEQ ID NO: 164674 - DNA, 20 bp, Artificial
  CRISPR gRNA sequence
gcccgtttgcaacttatcat

SEQ ID NO: 164675 - DNA, 20 bp, Artificial
  CRISPR gRNA sequence
cccgtttgcaacttatcatg

SEQ ID NO: 164676 - DNA, 20 bp, Artificial
  CRISPR gRNA sequence
gcaacttatcatgcaatggg

SEQ ID NO: 164677 - DNA, 20 bp, Artificial
  CRISPR gRNA sequence
caacttatcatgcaatgggt

SEQ ID NO: 164678 - DNA, 20 bp, Artificial
  CRISPR gRNA sequence
atcatgcaatgggtgattat

SEQ ID NO: 164679 - DNA, 20 bp, Artificial
  CRISPR gRNA sequence
tcatgcaatgggtgattatt

SEQ ID NO: 164680 - DNA, 20 bp, Artificial
  CRISPR gRNA sequence
tttcgtacttcagaaattgg

SEQ ID NO: 164681 - DNA, 20 bp, Artificial
  CRISPR gRNA sequence
cgtacttcagaaattggctg

SEQ ID NO: 164682 - DNA, 20 bp, Artificial
  CRISPR gRNA sequence
gtacttcagaaattggctgt

SEQ ID NO: 164683 - DNA, 20 bp, Artificial
  CRISPR gRNA sequence
cagaaattggctgtatgttt

SEQ ID NO: 164684 - DNA, 20 bp, Artificial
  CRISPR gRNA sequence
agaaattggctgtatgtttt

SEQ ID NO: 164685 - DNA, 20 bp, Artificial
  CRISPR gRNA sequence
gctgtatgttttgtgaagcc

SEQ ID NO: 164686 - DNA, 20 bp, Artificial
  CRISPR gRNA sequence
tatgttttgtgaagcctata

SEQ ID NO: 164687 - DNA, 20 bp, Artificial
  CRISPR gRNA sequence
tgtgaagcctataggatctg

SEQ ID NO: 164688 - DNA, 20 bp, Artificial
  CRISPR gRNA sequence
gtgaagcctataggatctgt

SEQ ID NO: 164689 - DNA, 20 bp, Artificial
  CRISPR gRNA sequence
tgaagcctataggatctgtt

SEQ ID NO: 164690 - DNA, 20 bp, Artificial
  CRISPR gRNA sequence
taggatctgttatttttagt

SEQ ID NO: 164691 - DNA, 20 bp, Artificial
  CRISPR gRNA sequence
ttatttttagtttgatttag

SEQ ID NO: 164692 - DNA, 20 bp, Artificial
  CRISPR gRNA sequence
tttttagtttgatttagcat

SEQ ID NO: 164693 - DNA, 20 bp, Artificial
  CRISPR gRNA sequence
ttagtttgatttagcataac

SEQ ID NO: 164694 - DNA, 20 bp, Artificial
  CRISPR gRNA sequence
tagtttgatttagcataact

SEQ ID NO: 164695 - DNA, 20 bp, Artificial
  CRISPR gRNA sequence
agtttgatttagcataactg

SEQ ID NO: 164696 - DNA, 20 bp, Artificial
  CRISPR gRNA sequence
gtttgatttagcataactgg

SEQ ID NO: 164697 - DNA, 20 bp, Artificial
  CRISPR gRNA sequence
gatttagcataactggtctc

SEQ ID NO: 164698 - DNA, 20 bp, Artificial
  CRISPR gRNA sequence
atttagcataactggtctct

SEQ ID NO: 164699 - DNA, 20 bp, Artificial
  CRISPR gRNA sequence
agcataactggtctctttga

SEQ ID NO: 164700 - DNA, 20 bp, Artificial
  CRISPR gRNA sequence
gcataactggtctctttgaa

SEQ ID NO: 164701 - DNA, 20 bp, Artificial
  CRISPR gRNA sequence
gtctctttgaattccacttt

SEQ ID NO: 164702 - DNA, 20 bp, Artificial
  CRISPR gRNA sequence
tttgaattccactttccttt

SEQ ID NO: 164703 - DNA, 20 bp, Artificial
  CRISPR gRNA sequence
tgaattccactttcctttgg

SEQ ID NO: 164704 - DNA, 20 bp, Artificial
  CRISPR gRNA sequence
gaattccactttcctttggc

SEQ ID NO: 164705 - DNA, 20 bp, Artificial
  CRISPR gRNA sequence
aattccactttcctttggct

SEQ ID NO: 164706 - DNA, 20 bp, Artificial
  CRISPR gRNA sequence
cactttcctttggcttcaaa

SEQ ID NO: 164707 - DNA, 20 bp, Artificial
  CRISPR gRNA sequence
tcctttggcttcaaatgtgg

SEQ ID NO: 164708 - DNA, 20 bp, Artificial
  CRISPR gRNA sequence
cctttggcttcaaatgtgga

SEQ ID NO: 164709 - DNA, 20 bp, Artificial
  CRISPR gRNA sequence
ctttggcttcaaatgtggag

SEQ ID NO: 164710 - DNA, 20 bp, Artificial
  CRISPR gRNA sequence
tggcttcaaatgtggagagc

SEQ ID NO: 164711 - DNA, 20 bp, Artificial
  CRISPR gRNA sequence
ggcttcaaatgtggagagct

SEQ ID NO: 164712 - DNA, 20 bp, Artificial
  CRISPR gRNA sequence
gcttcaaatgtggagagctc

SEQ ID NO: 164713 - DNA, 20 bp, Artificial
  CRISPR gRNA sequence
caaatgtggagagctcagca

SEQ ID NO: 164714 - DNA, 20 bp, Artificial
  CRISPR gRNA sequence
aaatgtggagagctcagcat

SEQ ID NO: 164715 - DNA, 20 bp, Artificial
  CRISPR gRNA sequence
agcattcagcaggcaactgc

SEQ ID NO: 164716 - DNA, 20 bp, Artificial
  CRISPR gRNA sequence
agcaggcaactgcacatagc

SEQ ID NO: 164717 - DNA, 20 bp, Artificial
  CRISPR gRNA sequence
cacatagcctgtttggggga

SEQ ID NO: 164718 - DNA, 20 bp, Artificial
  CRISPR gRNA sequence
tttgggggaagagtggaaat

SEQ ID NO: 164719 - DNA, 20 bp, Artificial
  CRISPR gRNA sequence
gggggaagagtggaaattca

SEQ ID NO: 164720 - DNA, 20 bp, Artificial
  CRISPR gRNA sequence
ggggaagagtggaaattcac

SEQ ID NO: 164721 - DNA, 20 bp, Artificial
  CRISPR gRNA sequence
actgtggcggctgctgagtt

SEQ ID NO: 164722 - DNA, 20 bp, Artificial
  CRISPR gRNA sequence
tggcggctgctgagttggtt

SEQ ID NO: 164723 - DNA, 20 bp, Artificial
  CRISPR gRNA sequence
ctgagttggttcttttcctc

SEQ ID NO: 164724 - DNA, 20 bp, Artificial
  CRISPR gRNA sequence
agttggttcttttcctctta

SEQ ID NO: 164725 - DNA, 20 bp, Artificial
  CRISPR gRNA sequence
gttcttttcctcttacctgc

SEQ ID NO: 164726 - DNA, 20 bp, Artificial
  CRISPR gRNA sequence
ttttcctcttacctgcctct

SEQ ID NO: 164727 - DNA, 20 bp, Artificial
  CRISPR gRNA sequence
ttcctcttacctgcctctct

SEQ ID NO: 164728 - DNA, 20 bp, Artificial
  CRISPR gRNA sequence
tcctcttacctgcctctctt

SEQ ID NO: 164729 - DNA, 20 bp, Artificial
  CRISPR gRNA sequence
cctcttacctgcctctcttt

SEQ ID NO: 164730 - DNA, 20 bp, Artificial
  CRISPR gRNA sequence
ctcttacctgcctctctttc

SEQ ID NO: 164731 - DNA, 20 bp, Artificial
  CRISPR gRNA sequence
ttacctgcctctctttccac

SEQ ID NO: 164732 - DNA, 20 bp, Artificial
  CRISPR gRNA sequence
acctgcctctctttccaccc

SEQ ID NO: 164733 - DNA, 20 bp, Artificial
  CRISPR gRNA sequence
cctgcctctctttccaccca

SEQ ID NO: 164734 - DNA, 20 bp, Artificial
  CRISPR gRNA sequence
cctctctttccacccaacag

SEQ ID NO: 164735 - DNA, 20 bp, Artificial
  CRISPR gRNA sequence
tctttccacccaacaggagg

SEQ ID NO: 164736 - DNA, 20 bp, Artificial
  CRISPR gRNA sequence
tttccacccaacaggaggag

SEQ ID NO: 164737 - DNA, 20 bp, Artificial
  CRISPR gRNA sequence
tccacccaacaggaggaggt

SEQ ID NO: 164738 - DNA, 20 bp, Artificial
  CRISPR gRNA sequence
ccacccaacaggaggaggtg

SEQ ID NO: 164739 - DNA, 20 bp, Artificial
  CRISPR gRNA sequence
cacccaacaggaggaggtgc

SEQ ID NO: 164740 - DNA, 20 bp, Artificial
  CRISPR gRNA sequence
taactcctgccgagccagtc

SEQ ID NO: 164741 - DNA, 20 bp, Artificial
  CRISPR gRNA sequence
ctgccgagccagtccagtac

SEQ ID NO: 164742 - DNA, 20 bp, Artificial
  CRISPR gRNA sequence
ccgagccagtccagtactat

SEQ ID NO: 164743 - DNA, 20 bp, Artificial
  CRISPR gRNA sequence
tttcacgctggctcagcaac

SEQ ID NO: 164744 - DNA, 20 bp, Artificial
  CRISPR gRNA sequence
cacgctggctcagcaaccca

SEQ ID NO: 164745 - DNA, 20 bp, Artificial
  CRISPR gRNA sequence
acgctggctcagcaacccac

SEQ ID NO: 164746 - DNA, 20 bp, Artificial
  CRISPR gRNA sequence
gctcagcaacccaccgctgt

SEQ ID NO: 164747 - DNA, 20 bp, Artificial
  CRISPR gRNA sequence
agcaacccaccgctgtccaa

SEQ ID NO: 164748 - DNA, 20 bp, Artificial
  CRISPR gRNA sequence
tccaagtccagggccagcag

SEQ ID NO: 164749 - DNA, 20 bp, Artificial
  CRISPR gRNA sequence
cacgaccaccatccagcctg

SEQ ID NO: 164750 - DNA, 20 bp, Artificial
  CRISPR gRNA sequence
ggcagatcatcatcgcacag

SEQ ID NO: 164751 - DNA, 20 bp, Artificial
  CRISPR gRNA sequence
agcagggccaggtctgtgag

SEQ ID NO: 164752 - DNA, 20 bp, Artificial
  CRISPR gRNA sequence
tgagctgctgaggatgccca

SEQ ID NO: 164753 - DNA, 20 bp, Artificial
  CRISPR gRNA sequence
ctgaggatgcccatccagca

SEQ ID NO: 164754 - DNA, 20 bp, Artificial
  CRISPR gRNA sequence
aggatgcccatccagcaaga

SEQ ID NO: 164755 - DNA, 20 bp, Artificial
  CRISPR gRNA sequence
aggtttttggatgggcagag

SEQ ID NO: 164756 - DNA, 20 bp, Artificial
  CRISPR gRNA sequence
ggtttttggatgggcagagc

SEQ ID NO: 164757 - DNA, 20 bp, Artificial
  CRISPR gRNA sequence
ttggatgggcagagcttgat

SEQ ID NO: 164758 - DNA, 20 bp, Artificial
  CRISPR gRNA sequence
tggatgggcagagcttgatg

SEQ ID NO: 164759 - DNA, 20 bp, Artificial
  CRISPR gRNA sequence
ggatgggcagagcttgatga

SEQ ID NO: 164760 - DNA, 20 bp, Artificial
  CRISPR gRNA sequence
gatgggcagagcttgatgag

SEQ ID NO: 164761 - DNA, 20 bp, Artificial
  CRISPR gRNA sequence
gatgagggcagagaggcagc

SEQ ID NO: 164762 - DNA, 20 bp, Artificial
  CRISPR gRNA sequence
atgagggcagagaggcagcc

SEQ ID NO: 164763 - DNA, 20 bp, Artificial
  CRISPR gRNA sequence
tagagcactggatttaaagt

SEQ ID NO: 164764 - DNA, 20 bp, Artificial
  CRISPR gRNA sequence
gatttaaagtctggaaactg

SEQ ID NO: 164765 - DNA, 20 bp, Artificial
  CRISPR gRNA sequence
aaagtctggaaactggaact

SEQ ID NO: 164766 - DNA, 20 bp, Artificial
  CRISPR gRNA sequence
aagtctggaaactggaactt

SEQ ID NO: 164767 - DNA, 20 bp, Artificial
  CRISPR gRNA sequence
gaaactggaacttttcccca

SEQ ID NO: 164768 - DNA, 20 bp, Artificial
  CRISPR gRNA sequence
gaacttttccccagattcag

SEQ ID NO: 164769 - DNA, 20 bp, Artificial
  CRISPR gRNA sequence
ttccccagattcagctactg

SEQ ID NO: 164770 - DNA, 20 bp, Artificial
  CRISPR gRNA sequence
tccccagattcagctactgg

SEQ ID NO: 164771 - DNA, 20 bp, Artificial
  CRISPR gRNA sequence
ccccagattcagctactggg

SEQ ID NO: 164772 - DNA, 20 bp, Artificial
  CRISPR gRNA sequence
cccagattcagctactgggg

SEQ ID NO: 164773 - DNA, 20 bp, Artificial
  CRISPR gRNA sequence
agctactggggtgagatgtt

SEQ ID NO: 164774 - DNA, 20 bp, Artificial
  CRISPR gRNA sequence
ctggggtgagatgttaccct

SEQ ID NO: 164775 - DNA, 20 bp, Artificial
  CRISPR gRNA sequence
gggtgagatgttaccctaat

SEQ ID NO: 164776 - DNA, 20 bp, Artificial
  CRISPR gRNA sequence
ccctaatctctctggaccct

SEQ ID NO: 164777 - DNA, 20 bp, Artificial
  CRISPR gRNA sequence
atctctctggaccctgtttt

SEQ ID NO: 164778 - DNA, 20 bp, Artificial
  CRISPR gRNA sequence
tctggaccctgtttttctca

SEQ ID NO: 164779 - DNA, 20 bp, Artificial
  CRISPR gRNA sequence
tggaccctgtttttctcaaa

SEQ ID NO: 164780 - DNA, 20 bp, Artificial
  CRISPR gRNA sequence
gaccctgtttttctcaaagg

SEQ ID NO: 164781 - DNA, 20 bp, Artificial
  CRISPR gRNA sequence
tttttctcaaaggtcaaatg

SEQ ID NO: 164782 - DNA, 20 bp, Artificial
  CRISPR gRNA sequence
ttctcaaaggtcaaatgagg

SEQ ID NO: 164783 - DNA, 20 bp, Artificial
  CRISPR gRNA sequence
tctcaaaggtcaaatgagga

SEQ ID NO: 164784 - DNA, 20 bp, Artificial
  CRISPR gRNA sequence
ctcaaaggtcaaatgaggaa

SEQ ID NO: 164785 - DNA, 20 bp, Artificial
  CRISPR gRNA sequence
tcaaaggtcaaatgaggaaa

SEQ ID NO: 164786 - DNA, 20 bp, Artificial
  CRISPR gRNA sequence
aaaggtcaaatgaggaaagt

SEQ ID NO: 164787 - DNA, 20 bp, Artificial
  CRISPR gRNA sequence
gacagtatgttctccaggat

SEQ ID NO: 164788 - DNA, 20 bp, Artificial
  CRISPR gRNA sequence
tccaggatccctattagctc

SEQ ID NO: 164789 - DNA, 20 bp, Artificial
  CRISPR gRNA sequence
caggatccctattagctcag

SEQ ID NO: 164790 - DNA, 20 bp, Artificial
  CRISPR gRNA sequence
ttagctcagaaattttagaa

SEQ ID NO: 164791 - DNA, 20 bp, Artificial
  CRISPR gRNA sequence
gctcagaaattttagaaggg

SEQ ID NO: 164792 - DNA, 20 bp, Artificial
  CRISPR gRNA sequence
agaaattttagaagggaaaa

SEQ ID NO: 164793 - DNA, 20 bp, Artificial
  CRISPR gRNA sequence
tagaagggaaaaaaaaatgt

SEQ ID NO: 164794 - DNA, 20 bp, Artificial
  CRISPR gRNA sequence
agaagggaaaaaaaaatgtc

SEQ ID NO: 164795 - DNA, 20 bp, Artificial
  CRISPR gRNA sequence
gaagggaaaaaaaaatgtct

SEQ ID NO: 164796 - DNA, 20 bp, Artificial
  CRISPR gRNA sequence
aaatgccttatgaagagtag

SEQ ID NO: 164797 - DNA, 20 bp, Artificial
  CRISPR gRNA sequence
atgaagagtagaggtgctaa

SEQ ID NO: 164798 - DNA, 20 bp, Artificial
  CRISPR gRNA sequence
tgaagagtagaggtgctaaa

SEQ ID NO: 164799 - DNA, 20 bp, Artificial
  CRISPR gRNA sequence
aagtgaactccatgcctgct

SEQ ID NO: 164800 - DNA, 20 bp, Artificial
  CRISPR gRNA sequence
catgcctgctgtctgtgtgt

SEQ ID NO: 164801 - DNA, 20 bp, Artificial
  CRISPR gRNA sequence
ctgtctgtgtgtctgtgtga

SEQ ID NO: 164802 - DNA, 20 bp, Artificial
  CRISPR gRNA sequence
tctgtgtgtctgtgtgagaa

SEQ ID NO: 164803 - DNA, 20 bp, Artificial
  CRISPR gRNA sequence
tgtgtctgtgtgagaagtgg

SEQ ID NO: 164804 - DNA, 20 bp, Artificial
  CRISPR gRNA sequence
tgtgagaagtggaatttgtg

SEQ ID NO: 164805 - DNA, 20 bp, Artificial
  CRISPR gRNA sequence
gtgcccttaaagggagagat

SEQ ID NO: 164806 - DNA, 20 bp, Artificial
  CRISPR gRNA sequence
tgcccttaaagggagagatt

SEQ ID NO: 164807 - DNA, 20 bp, Artificial
  CRISPR gRNA sequence
aaagggagagattaggtatc

SEQ ID NO: 164808 - DNA, 20 bp, Artificial
  CRISPR gRNA sequence
aagggagagattaggtatca

SEQ ID NO: 164809 - DNA, 20 bp, Artificial
  CRISPR gRNA sequence
ggtatcattgccaagttgca

SEQ ID NO: 164810 - DNA, 20 bp, Artificial
  CRISPR gRNA sequence
ccaagttgcatactccttct

SEQ ID NO: 164811 - DNA, 20 bp, Artificial
  CRISPR gRNA sequence
catactccttctccccgtca

SEQ ID NO: 164812 - DNA, 20 bp, Artificial
  CRISPR gRNA sequence
cttctccccgtcatttctct

SEQ ID NO: 164813 - DNA, 20 bp, Artificial
  CRISPR gRNA sequence
ctccccgtcatttctctgtc

SEQ ID NO: 164814 - DNA, 20 bp, Artificial
  CRISPR gRNA sequence
tccccgtcatttctctgtcc

SEQ ID NO: 164815 - DNA, 20 bp, Artificial
  CRISPR gRNA sequence
cccgtcatttctctgtccca

SEQ ID NO: 164816 - DNA, 20 bp, Artificial
  CRISPR gRNA sequence
ctctgtcccatatttgtgtt

SEQ ID NO: 164817 - DNA, 20 bp, Artificial
  CRISPR gRNA sequence
tctgtcccatatttgtgtta

SEQ ID NO: 164818 - DNA, 20 bp, Artificial
  CRISPR gRNA sequence
tgtcccatatttgtgttaag

SEQ ID NO: 164819 - DNA, 20 bp, Artificial
  CRISPR gRNA sequence
tcccatatttgtgttaagtg

SEQ ID NO: 164820 - DNA, 20 bp, Artificial
  CRISPR gRNA sequence
gtgttaagtgaccttctctt

SEQ ID NO: 164821 - DNA, 20 bp, Artificial
  CRISPR gRNA sequence
tgttaagtgaccttctcttt

SEQ ID NO: 164822 - DNA, 20 bp, Artificial
  CRISPR gRNA sequence
agtgaccttctctttttacg

SEQ ID NO: 164823 - DNA, 20 bp, Artificial
  CRISPR gRNA sequence
ctctttttacgatagtaatc

SEQ ID NO: 164824 - DNA, 20 bp, Artificial
  CRISPR gRNA sequence
tctttttacgatagtaatca

SEQ ID NO: 164825 - DNA, 20 bp, Artificial
  CRISPR gRNA sequence
tttttacgatagtaatcaga

SEQ ID NO: 164826 - DNA, 20 bp, Artificial
  CRISPR gRNA sequence
tttacgatagtaatcagagg

SEQ ID NO: 164827 - DNA, 20 bp, Artificial
  CRISPR gRNA sequence
ttacgatagtaatcagagga

SEQ ID NO: 164828 - DNA, 20 bp, Artificial
  CRISPR gRNA sequence
tacgatagtaatcagaggac

SEQ ID NO: 164829 - DNA, 20 bp, Artificial
  CRISPR gRNA sequence
acgatagtaatcagaggact

SEQ ID NO: 164830 - DNA, 20 bp, Artificial
  CRISPR gRNA sequence
cgatagtaatcagaggactc

SEQ ID NO: 164831 - DNA, 20 bp, Artificial
  CRISPR gRNA sequence
tttctctccccagtagtagt

SEQ ID NO: 164832 - DNA, 20 bp, Artificial
  CRISPR gRNA sequence
tctctccccagtagtagtgt

SEQ ID NO: 164833 - DNA, 20 bp, Artificial
  CRISPR gRNA sequence
ctctccccagtagtagtgtt

SEQ ID NO: 164834 - DNA, 20 bp, Artificial
  CRISPR gRNA sequence
tctccccagtagtagtgtta

SEQ ID NO: 164835 - DNA, 20 bp, Artificial
  CRISPR gRNA sequence
tccccagtagtagtgttaag

SEQ ID NO: 164836 - DNA, 20 bp, Artificial
  CRISPR gRNA sequence
cccagtagtagtgttaagag

SEQ ID NO: 164837 - DNA, 20 bp, Artificial
  CRISPR gRNA sequence
agagcagtagcattcatgtt

SEQ ID NO: 164838 - DNA, 20 bp, Artificial
  CRISPR gRNA sequence
atgtttgttgggggtcatgt

SEQ ID NO: 164839 - DNA, 20 bp, Artificial
  CRISPR gRNA sequence
gttgggggtcatgtgaggct

SEQ ID NO: 164840 - DNA, 20 bp, Artificial
  CRISPR gRNA sequence
ttgggggtcatgtgaggctg

SEQ ID NO: 164841 - DNA, 20 bp, Artificial
  CRISPR gRNA sequence
ggggtcatgtgaggctgcag

SEQ ID NO: 164842 - DNA, 20 bp, Artificial
  CRISPR gRNA sequence
cagagaactctgtactatga

SEQ ID NO: 164843 - DNA, 20 bp, Artificial
  CRISPR gRNA sequence
tgtactatgagctctgaatc

SEQ ID NO: 164844 - DNA, 20 bp, Artificial
  CRISPR gRNA sequence
tactatgagctctgaatcca

SEQ ID NO: 164845 - DNA, 20 bp, Artificial
  CRISPR gRNA sequence
tgagctctgaatccaaattc

SEQ ID NO: 164846 - DNA, 20 bp, Artificial
  CRISPR gRNA sequence
tgaatccaaattctctgtca

SEQ ID NO: 164847 - DNA, 20 bp, Artificial
  CRISPR gRNA sequence
aatccaaattctctgtcaat

SEQ ID NO: 164848 - DNA, 20 bp, Artificial
  CRISPR gRNA sequence
tctgtcaatcattatttatt

SEQ ID NO: 164849 - DNA, 20 bp, Artificial
  CRISPR gRNA sequence
tgtcaatcattatttattca

SEQ ID NO: 164850 - DNA, 20 bp, Artificial
  CRISPR gRNA sequence
tcaatcattatttattcatc

SEQ ID NO: 164851 - DNA, 20 bp, Artificial
  CRISPR gRNA sequence
tttattcatcaaacactgag

SEQ ID NO: 164852 - DNA, 20 bp, Artificial
  CRISPR gRNA sequence
attcatcaaacactgagcat

SEQ ID NO: 164853 - DNA, 20 bp, Artificial
  CRISPR gRNA sequence
ttcatcaaacactgagcatc

SEQ ID NO: 164854 - DNA, 20 bp, Artificial
  CRISPR gRNA sequence
atcaaacactgagcatcctc

SEQ ID NO: 164855 - DNA, 20 bp, Artificial
  CRISPR gRNA sequence
agcatcctctgagggtaaag

SEQ ID NO: 164856 - DNA, 20 bp, Artificial
  CRISPR gRNA sequence
tgagggtaaagttctgtgct

SEQ ID NO: 164857 - DNA, 20 bp, Artificial
  CRISPR gRNA sequence
agggtaaagttctgtgctat

SEQ ID NO: 164858 - DNA, 20 bp, Artificial
  CRISPR gRNA sequence
tgtgctatgtattggggata

SEQ ID NO: 164859 - DNA, 20 bp, Artificial
  CRISPR gRNA sequence
tgctatgtattggggataca

SEQ ID NO: 164860 - DNA, 20 bp, Artificial
  CRISPR gRNA sequence
tgtattggggatacaagcat

SEQ ID NO: 164861 - DNA, 20 bp, Artificial
  CRISPR gRNA sequence
gggatacaagcatgaataaa

SEQ ID NO: 164862 - DNA, 20 bp, Artificial
  CRISPR gRNA sequence
attttcaaggaattcacaat

SEQ ID NO: 164863 - DNA, 20 bp, Artificial
  CRISPR gRNA sequence
ttttcaaggaattcacaatt

SEQ ID NO: 164864 - DNA, 20 bp, Artificial
  CRISPR gRNA sequence
tcaaggaattcacaatttag

SEQ ID NO: 164865 - DNA, 20 bp, Artificial
  CRISPR gRNA sequence
caaggaattcacaatttagt

SEQ ID NO: 164866 - DNA, 20 bp, Artificial
  CRISPR gRNA sequence
aaggaattcacaatttagtt

SEQ ID NO: 164867 - DNA, 20 bp, Artificial
  CRISPR gRNA sequence
acaatttagttggggataca

SEQ ID NO: 164868 - DNA, 20 bp, Artificial
  CRISPR gRNA sequence
agttggggatacaaatactt

SEQ ID NO: 164869 - DNA, 20 bp, Artificial
  CRISPR gRNA sequence
gttggggatacaaatactta

SEQ ID NO: 164870 - DNA, 20 bp, Artificial
  CRISPR gRNA sequence
gggatacaaatacttaaagg

SEQ ID NO: 164871 - DNA, 20 bp, Artificial
  CRISPR gRNA sequence
aaaggttgtaccaccacgtg

SEQ ID NO: 164872 - DNA, 20 bp, Artificial
  CRISPR gRNA sequence
aaggttgtaccaccacgtgg

SEQ ID NO: 164873 - DNA, 20 bp, Artificial
  CRISPR gRNA sequence
taccaccacgtgggaatgtg

SEQ ID NO: 164874 - DNA, 20 bp, Artificial
  CRISPR gRNA sequence
aaggaacacattaaaagaag

SEQ ID NO: 164875 - DNA, 20 bp, Artificial
  CRISPR gRNA sequence
aaagaagtaccttggctcag

SEQ ID NO: 164876 - DNA, 20 bp, Artificial
  CRISPR gRNA sequence
ggctcagcgcagtggctcat

SEQ ID NO: 164877 - DNA, 20 bp, Artificial
  CRISPR gRNA sequence
gctcagcgcagtggctcatg

SEQ ID NO: 164878 - DNA, 20 bp, Artificial
  CRISPR gRNA sequence
agcgcagtggctcatgcctg

SEQ ID NO: 164879 - DNA, 20 bp, Artificial
  CRISPR gRNA sequence
atgcctgtaatcccaacact

SEQ ID NO: 164880 - DNA, 20 bp, Artificial
  CRISPR gRNA sequence
taatcccaacactttgggag

SEQ ID NO: 164881 - DNA, 20 bp, Artificial
  CRISPR gRNA sequence
tgggaggccaatgtgggagg

SEQ ID NO: 164882 - DNA, 20 bp, Artificial
  CRISPR gRNA sequence
gggaggccaatgtgggagga

SEQ ID NO: 164883 - DNA, 20 bp, Artificial
  CRISPR gRNA sequence
ggaggccaatgtgggaggaa

SEQ ID NO: 164884 - DNA, 20 bp, Artificial
  CRISPR gRNA sequence
gaggttacagtgaggtagga

SEQ ID NO: 164885 - DNA, 20 bp, Artificial
  CRISPR gRNA sequence
aggttacagtgaggtaggat

SEQ ID NO: 164886 - DNA, 20 bp, Artificial
  CRISPR gRNA sequence
cagtgaggtaggatcatgcc

SEQ ID NO: 164887 - DNA, 20 bp, Artificial
  CRISPR gRNA sequence
cacttcagcctgggcagcac

SEQ ID NO: 164888 - DNA, 20 bp, Artificial
  CRISPR gRNA sequence
cagcctgggcagcacagcaa

SEQ ID NO: 164889 - DNA, 20 bp, Artificial
  CRISPR gRNA sequence
agcctgggcagcacagcaag

SEQ ID NO: 164890 - DNA, 20 bp, Artificial
  CRISPR gRNA sequence
ggcagcacagcaagacctct

SEQ ID NO: 164891 - DNA, 20 bp, Artificial
  CRISPR gRNA sequence
ttctttaattaaaaaaaaaa

SEQ ID NO: 164892 - DNA, 20 bp, Artificial
  CRISPR gRNA sequence
ctttaattaaaaaaaaaaaa

SEQ ID NO: 164893 - DNA, 20 bp, Artificial
  CRISPR gRNA sequence
tttaattaaaaaaaaaaaaa

SEQ ID NO: 164894 - DNA, 20 bp, Artificial
  CRISPR gRNA sequence
taattaaaaaaaaaaaaaaa

SEQ ID NO: 164895 - DNA, 20 bp, Artificial
  CRISPR gRNA sequence
aattaaaaaaaaaaaaaaaa

SEQ ID NO: 164896 - DNA, 20 bp, Artificial
  CRISPR gRNA sequence
attaaaaaaaaaaaaaaaag

SEQ ID NO: 164897 - DNA, 20 bp, Artificial
  CRISPR gRNA sequence
aaaaaaaaaaaaaaaggcag

SEQ ID NO: 164898 - DNA, 20 bp, Artificial
  CRISPR gRNA sequence
atgtctgtaattccagcact

SEQ ID NO: 164899 - DNA, 20 bp, Artificial
  CRISPR gRNA sequence
taattccagcactttgggag

SEQ ID NO: 164900 - DNA, 20 bp, Artificial
  CRISPR gRNA sequence
cagcactttgggaggccgag

SEQ ID NO: 164901 - DNA, 20 bp, Artificial
  CRISPR gRNA sequence
tgggaggccgaggcaggagg

SEQ ID NO: 164902 - DNA, 20 bp, Artificial
  CRISPR gRNA sequence
gggaggccgaggcaggagga

SEQ ID NO: 164903 - DNA, 20 bp, Artificial
  CRISPR gRNA sequence
ggaggccgaggcaggaggat

SEQ ID NO: 164904 - DNA, 20 bp, Artificial
  CRISPR gRNA sequence
cttgagcccacgtgttcaag

SEQ ID NO: 164905 - DNA, 20 bp, Artificial
  CRISPR gRNA sequence
gagcccacgtgttcaagacc

SEQ ID NO: 164906 - DNA, 20 bp, Artificial
  CRISPR gRNA sequence
agcccacgtgttcaagacca

SEQ ID NO: 164907 - DNA, 20 bp, Artificial
  CRISPR gRNA sequence
aagaccagcctgggcaacat

SEQ ID NO: 164908 - DNA, 20 bp, Artificial
  CRISPR gRNA sequence
ggcaacatggtgagaccttg

SEQ ID NO: 164909 - DNA, 20 bp, Artificial
  CRISPR gRNA sequence
gtctccaccagaacatcaga

SEQ ID NO: 164910 - DNA, 20 bp, Artificial
  CRISPR gRNA sequence
tctccaccagaacatcagaa

SEQ ID NO: 164911 - DNA, 20 bp, Artificial
  CRISPR gRNA sequence
caccagaacatcagaacatt

SEQ ID NO: 164912 - DNA, 20 bp, Artificial
  CRISPR gRNA sequence
gccagccatggtggcatgct

SEQ ID NO: 164913 - DNA, 20 bp, Artificial
  CRISPR gRNA sequence
ttatggccccagctacttaa

SEQ ID NO: 164914 - DNA, 20 bp, Artificial
  CRISPR gRNA sequence
atggccccagctacttaaga

SEQ ID NO: 164915 - DNA, 20 bp, Artificial
  CRISPR gRNA sequence
tggccccagctacttaagag

SEQ ID NO: 164916 - DNA, 20 bp, Artificial
  CRISPR gRNA sequence
cttaagaggctgagttggga

SEQ ID NO: 164917 - DNA, 20 bp, Artificial
  CRISPR gRNA sequence
aagaggctgagttgggagga

SEQ ID NO: 164918 - DNA, 20 bp, Artificial
  CRISPR gRNA sequence
agaggctgagttgggaggat

SEQ ID NO: 164919 - DNA, 20 bp, Artificial
  CRISPR gRNA sequence
agttgggaggatcgcttgag

SEQ ID NO: 164920 - DNA, 20 bp, Artificial
  CRISPR gRNA sequence
ggaggatcgcttgagccaag

SEQ ID NO: 164921 - DNA, 20 bp, Artificial
  CRISPR gRNA sequence
gagccaaggaggtcaaggct

SEQ ID NO: 164922 - DNA, 20 bp, Artificial
  CRISPR gRNA sequence
agccaaggaggtcaaggcta

SEQ ID NO: 164923 - DNA, 20 bp, Artificial
  CRISPR gRNA sequence
cagtgagctgtgattgtgcc

SEQ ID NO: 164924 - DNA, 20 bp, Artificial
  CRISPR gRNA sequence
tgattgtgccattgcactcc

SEQ ID NO: 164925 - DNA, 20 bp, Artificial
  CRISPR gRNA sequence
tgccattgcactccagccag

SEQ ID NO: 164926 - DNA, 20 bp, Artificial
  CRISPR gRNA sequence
cactccagccagggtgacag

SEQ ID NO: 164927 - DNA, 20 bp, Artificial
  CRISPR gRNA sequence
cagccagggtgacagagcaa

SEQ ID NO: 164928 - DNA, 20 bp, Artificial
  CRISPR gRNA sequence
tctcaaaaaaaaaacaaaaa

SEQ ID NO: 164929 - DNA, 20 bp, Artificial
  CRISPR gRNA sequence
aaaaaaaaaacaaaaaaaag

SEQ ID NO: 164930 - DNA, 20 bp, Artificial
  CRISPR gRNA sequence
tatatgtgtgtatatatatg

SEQ ID NO: 164931 - DNA, 20 bp, Artificial
  CRISPR gRNA sequence
agaaagatgtgaacgaggtg

SEQ ID NO: 164932 - DNA, 20 bp, Artificial
  CRISPR gRNA sequence
ctgaagggaataatatgagt

SEQ ID NO: 164933 - DNA, 20 bp, Artificial
  CRISPR gRNA sequence
tgaagggaataatatgagtc

SEQ ID NO: 164934 - DNA, 20 bp, Artificial
  CRISPR gRNA sequence
aagggaataatatgagtctt

SEQ ID NO: 164935 - DNA, 20 bp, Artificial
  CRISPR gRNA sequence
ggggaacagtggaaattaat

SEQ ID NO: 164936 - DNA, 20 bp, Artificial
  CRISPR gRNA sequence
gggaacagtggaaattaatc

SEQ ID NO: 164937 - DNA, 20 bp, Artificial
  CRISPR gRNA sequence
atcaaagaaagtgggaaagg

SEQ ID NO: 164938 - DNA, 20 bp, Artificial
  CRISPR gRNA sequence
ccagtagagggcacagcaca

SEQ ID NO: 164939 - DNA, 20 bp, Artificial
  CRISPR gRNA sequence
agaggtgagaaacagtacag

SEQ ID NO: 164940 - DNA, 20 bp, Artificial
  CRISPR gRNA sequence
cgcaagtttggaaagataga

SEQ ID NO: 164941 - DNA, 20 bp, Artificial
  CRISPR gRNA sequence
ggaaagatagatagtaaaca

SEQ ID NO: 164942 - DNA, 20 bp, Artificial
  CRISPR gRNA sequence
gaaagatagatagtaaacac

SEQ ID NO: 164943 - DNA, 20 bp, Artificial
  CRISPR gRNA sequence
gacagcctcgtatattctaa

SEQ ID NO: 164944 - DNA, 20 bp, Artificial
  CRISPR gRNA sequence
gtatattctaataaggagct

SEQ ID NO: 164945 - DNA, 20 bp, Artificial
  CRISPR gRNA sequence
taataaggagctgagtttgc

SEQ ID NO: 164946 - DNA, 20 bp, Artificial
  CRISPR gRNA sequence
ataaggagctgagtttgcct

SEQ ID NO: 164947 - DNA, 20 bp, Artificial
  CRISPR gRNA sequence
agtttgcctagaagaaaaaa

SEQ ID NO: 164948 - DNA, 20 bp, Artificial
  CRISPR gRNA sequence
gcctagaagaaaaaaaaatg

SEQ ID NO: 164949 - DNA, 20 bp, Artificial
  CRISPR gRNA sequence
cctagaagaaaaaaaaatgg

SEQ ID NO: 164950 - DNA, 20 bp, Artificial
  CRISPR gRNA sequence
gaagaaaaaaaaatggagta

SEQ ID NO: 164951 - DNA, 20 bp, Artificial
  CRISPR gRNA sequence
attgattgatgtttttttaa

SEQ ID NO: 164952 - DNA, 20 bp, Artificial
  CRISPR gRNA sequence
attgatgtttttttaaagat

SEQ ID NO: 164953 - DNA, 20 bp, Artificial
  CRISPR gRNA sequence
atgtttttttaaagataagt

SEQ ID NO: 164954 - DNA, 20 bp, Artificial
  CRISPR gRNA sequence
ttttaaagataagttctcac

SEQ ID NO: 164955 - DNA, 20 bp, Artificial
  CRISPR gRNA sequence
tttaaagataagttctcact

SEQ ID NO: 164956 - DNA, 20 bp, Artificial
  CRISPR gRNA sequence
ttaaagataagttctcactt

SEQ ID NO: 164957 - DNA, 20 bp, Artificial
  CRISPR gRNA sequence
taaagataagttctcacttc

SEQ ID NO: 164958 - DNA, 20 bp, Artificial
  CRISPR gRNA sequence
aaagataagttctcacttcg

SEQ ID NO: 164959 - DNA, 20 bp, Artificial
  CRISPR gRNA sequence
aagataagttctcacttcgt

SEQ ID NO: 164960 - DNA, 20 bp, Artificial
  CRISPR gRNA sequence
tcacttcgtcactcaggctg

SEQ ID NO: 164961 - DNA, 20 bp, Artificial
  CRISPR gRNA sequence
acttcgtcactcaggctgga

SEQ ID NO: 164962 - DNA, 20 bp, Artificial
  CRISPR gRNA sequence
cgtcactcaggctggagtgt

SEQ ID NO: 164963 - DNA, 20 bp, Artificial
  CRISPR gRNA sequence
gtcactcaggctggagtgta

SEQ ID NO: 164964 - DNA, 20 bp, Artificial
  CRISPR gRNA sequence
aggctggagtgtagtagcac

SEQ ID NO: 164965 - DNA, 20 bp, Artificial
  CRISPR gRNA sequence
gagtgtagtagcacaatcat

SEQ ID NO: 164966 - DNA, 20 bp, Artificial
  CRISPR gRNA sequence
actgcagcttcaaactactg

SEQ ID NO: 164967 - DNA, 20 bp, Artificial
  CRISPR gRNA sequence
ctgcagcttcaaactactgg

SEQ ID NO: 164968 - DNA, 20 bp, Artificial
  CRISPR gRNA sequence
cagcttcaaactactgggct

SEQ ID NO: 164969 - DNA, 20 bp, Artificial
  CRISPR gRNA sequence
caaactactgggctcaagca

SEQ ID NO: 164970 - DNA, 20 bp, Artificial
  CRISPR gRNA sequence
aaactactgggctcaagcag

SEQ ID NO: 164971 - DNA, 20 bp, Artificial
  CRISPR gRNA sequence
ctgggctcaagcagtccttc

SEQ ID NO: 164972 - DNA, 20 bp, Artificial
  CRISPR gRNA sequence
ggctcaagcagtccttctgc

SEQ ID NO: 164973 - DNA, 20 bp, Artificial
  CRISPR gRNA sequence
aagcagtccttctgcctcag

SEQ ID NO: 164974 - DNA, 20 bp, Artificial
  CRISPR gRNA sequence
ctgcctcagcctcccgagga

SEQ ID NO: 164975 - DNA, 20 bp, Artificial
  CRISPR gRNA sequence
tgcctcagcctcccgaggag

SEQ ID NO: 164976 - DNA, 20 bp, Artificial
  CRISPR gRNA sequence
cctcagcctcccgaggagct

SEQ ID NO: 164977 - DNA, 20 bp, Artificial
  CRISPR gRNA sequence
agcctcccgaggagctggga

SEQ ID NO: 164978 - DNA, 20 bp, Artificial
  CRISPR gRNA sequence
ccgaggagctgggactccca

SEQ ID NO: 164979 - DNA, 20 bp, Artificial
  CRISPR gRNA sequence
ggactcccaggcatgtgcca

SEQ ID NO: 164980 - DNA, 20 bp, Artificial
  CRISPR gRNA sequence
ccaggcatgtgccaccacac

SEQ ID NO: 164981 - DNA, 20 bp, Artificial
  CRISPR gRNA sequence
gataatttttaatttttttg

SEQ ID NO: 164982 - DNA, 20 bp, Artificial
  CRISPR gRNA sequence
ttaatttttttgtggagatg

SEQ ID NO: 164983 - DNA, 20 bp, Artificial
  CRISPR gRNA sequence
taatttttttgtggagatgg

SEQ ID NO: 164984 - DNA, 20 bp, Artificial
  CRISPR gRNA sequence
aatttttttgtggagatggg

SEQ ID NO: 164985 - DNA, 20 bp, Artificial
  CRISPR gRNA sequence
atttttttgtggagatgggg

SEQ ID NO: 164986 - DNA, 20 bp, Artificial
  CRISPR gRNA sequence
ttttgtggagatggggtctc

SEQ ID NO: 164987 - DNA, 20 bp, Artificial
  CRISPR gRNA sequence
tttgtggagatggggtctca

SEQ ID NO: 164988 - DNA, 20 bp, Artificial
  CRISPR gRNA sequence
ttgtggagatggggtctcat

SEQ ID NO: 164989 - DNA, 20 bp, Artificial
  CRISPR gRNA sequence
tgtggagatggggtctcatt

SEQ ID NO: 164990 - DNA, 20 bp, Artificial
  CRISPR gRNA sequence
gtggagatggggtctcatta

SEQ ID NO: 164991 - DNA, 20 bp, Artificial
  CRISPR gRNA sequence
tggagatggggtctcattat

SEQ ID NO: 164992 - DNA, 20 bp, Artificial
  CRISPR gRNA sequence
attatgtttcccaggctggt

SEQ ID NO: 164993 - DNA, 20 bp, Artificial
  CRISPR gRNA sequence
tgtttcccaggctggtctca

SEQ ID NO: 164994 - DNA, 20 bp, Artificial
  CRISPR gRNA sequence
cccaggctggtctcaaactc

SEQ ID NO: 164995 - DNA, 20 bp, Artificial
  CRISPR gRNA sequence
ccaggctggtctcaaactcc

SEQ ID NO: 164996 - DNA, 20 bp, Artificial
  CRISPR gRNA sequence
gtctcaaactcctggcttta

SEQ ID NO: 164997 - DNA, 20 bp, Artificial
  CRISPR gRNA sequence
aaactcctggctttatgcca

SEQ ID NO: 164998 - DNA, 20 bp, Artificial
  CRISPR gRNA sequence
ctggctttatgccatcctcc

SEQ ID NO: 164999 - DNA, 20 bp, Artificial
  CRISPR gRNA sequence
gctttatgccatcctcccac

SEQ ID NO: 165000 - DNA, 20 bp, Artificial
  CRISPR gRNA sequence
tatgccatcctcccaccttg

SEQ ID NO: 165001 - DNA, 20 bp, Artificial
  CRISPR gRNA sequence
atgccatcctcccaccttgg

SEQ ID NO: 165002 - DNA, 20 bp, Artificial
  CRISPR gRNA sequence
tgccatcctcccaccttggc

SEQ ID NO: 165003 - DNA, 20 bp, Artificial
  CRISPR gRNA sequence
ccaccttggcctcccacagt

SEQ ID NO: 165004 - DNA, 20 bp, Artificial
  CRISPR gRNA sequence
ggcctcccacagtggtggga

SEQ ID NO: 165005 - DNA, 20 bp, Artificial
  CRISPR gRNA sequence
gcctcccacagtggtgggat

SEQ ID NO: 165006 - DNA, 20 bp, Artificial
  CRISPR gRNA sequence
ccacagtggtgggatgacag

SEQ ID NO: 165007 - DNA, 20 bp, Artificial
  CRISPR gRNA sequence
ggaggtagatttaagtaatt

SEQ ID NO: 165008 - DNA, 20 bp, Artificial
  CRISPR gRNA sequence
aagtaattatgatttggcca

SEQ ID NO: 165009 - DNA, 20 bp, Artificial
  CRISPR gRNA sequence
agtaattatgatttggccag

SEQ ID NO: 165010 - DNA, 20 bp, Artificial
  CRISPR gRNA sequence
tgatttggccaggtgcggtg

SEQ ID NO: 165011 - DNA, 20 bp, Artificial
  CRISPR gRNA sequence
ggccaggtgcggtggctcac

SEQ ID NO: 165012 - DNA, 20 bp, Artificial
  CRISPR gRNA sequence
gccaggtgcggtggctcaca

SEQ ID NO: 165013 - DNA, 20 bp, Artificial
  CRISPR gRNA sequence
acacctataatcccatcact

SEQ ID NO: 165014 - DNA, 20 bp, Artificial
  CRISPR gRNA sequence
taatcccatcactttgggag

SEQ ID NO: 165015 - DNA, 20 bp, Artificial
  CRISPR gRNA sequence
tgggaggccaaagcaggagg

SEQ ID NO: 165016 - DNA, 20 bp, Artificial
  CRISPR gRNA sequence
gggaggccaaagcaggaggg

SEQ ID NO: 165017 - DNA, 20 bp, Artificial
  CRISPR gRNA sequence
ggaggccaaagcaggagggt

SEQ ID NO: 165018 - DNA, 20 bp, Artificial
  CRISPR gRNA sequence
gagaccagcctgggcaatat

SEQ ID NO: 165019 - DNA, 20 bp, Artificial
  CRISPR gRNA sequence
ggcaatatggcaagaccttg

SEQ ID NO: 165020 - DNA, 20 bp, Artificial
  CRISPR gRNA sequence
gtctcaaaaacaaacacaca

SEQ ID NO: 165021 - DNA, 20 bp, Artificial
  CRISPR gRNA sequence
tctcaaaaacaaacacacag

SEQ ID NO: 165022 - DNA, 20 bp, Artificial
  CRISPR gRNA sequence
aaaaacaaacacacagagaa

SEQ ID NO: 165023 - DNA, 20 bp, Artificial
  CRISPR gRNA sequence
aaaataagtaattatggctg

SEQ ID NO: 165024 - DNA, 20 bp, Artificial
  CRISPR gRNA sequence
tggctgggcgtagtggctca

SEQ ID NO: 165025 - DNA, 20 bp, Artificial
  CRISPR gRNA sequence
ggcgtagtggctcacacctg

SEQ ID NO: 165026 - DNA, 20 bp, Artificial
  CRISPR gRNA sequence
acacctgtaatcccagtact

SEQ ID NO: 165027 - DNA, 20 bp, Artificial
  CRISPR gRNA sequence
taatcccagtactttgggag

SEQ ID NO: 165028 - DNA, 20 bp, Artificial
  CRISPR gRNA sequence
tgggaggccgaggtgggcgg

SEQ ID NO: 165029 - DNA, 20 bp, Artificial
  CRISPR gRNA sequence
gggaggccgaggtgggcgga

SEQ ID NO: 165030 - DNA, 20 bp, Artificial
  CRISPR gRNA sequence
ggaggccgaggtgggcggat

SEQ ID NO: 165031 - DNA, 20 bp, Artificial
  CRISPR gRNA sequence
aagaccagcctggccaatat

SEQ ID NO: 165032 - DNA, 20 bp, Artificial
  CRISPR gRNA sequence
gccaatatggtgaaacccca

SEQ ID NO: 165033 - DNA, 20 bp, Artificial
  CRISPR gRNA sequence
tactaaaaatacaaaaatta

SEQ ID NO: 165034 - DNA, 20 bp, Artificial
  CRISPR gRNA sequence
ctaaaaatacaaaaattagc

SEQ ID NO: 165035 - DNA, 20 bp, Artificial
  CRISPR gRNA sequence
aaaatacaaaaattagccgg

SEQ ID NO: 165036 - DNA, 20 bp, Artificial
  CRISPR gRNA sequence
gccgggcgtggtggcgggcg

SEQ ID NO: 165037 - DNA, 20 bp, Artificial
  CRISPR gRNA sequence
tagtcccagctacccgggga

SEQ ID NO: 165038 - DNA, 20 bp, Artificial
  CRISPR gRNA sequence
cccggggaggctgaggcagg

SEQ ID NO: 165039 - DNA, 20 bp, Artificial
  CRISPR gRNA sequence
aggcaggagaatctcttgaa

SEQ ID NO: 165040 - DNA, 20 bp, Artificial
  CRISPR gRNA sequence
ttgaacctgggaggcggatg

SEQ ID NO: 165041 - DNA, 20 bp, Artificial
  CRISPR gRNA sequence
gaacctgggaggcggatgtt

SEQ ID NO: 165042 - DNA, 20 bp, Artificial
  CRISPR gRNA sequence
aacctgggaggcggatgttg

SEQ ID NO: 165043 - DNA, 20 bp, Artificial
  CRISPR gRNA sequence
ggaggcggatgttgcagtaa

SEQ ID NO: 165044 - DNA, 20 bp, Artificial
  CRISPR gRNA sequence
cagtaagctgagatcgtgcc

SEQ ID NO: 165045 - DNA, 20 bp, Artificial
  CRISPR gRNA sequence
agatcgtgccactgcactcc

SEQ ID NO: 165046 - DNA, 20 bp, Artificial
  CRISPR gRNA sequence
cactccaatctgggtgacag

SEQ ID NO: 165047 - DNA, 20 bp, Artificial
  CRISPR gRNA sequence
caatctgggtgacagagcga

SEQ ID NO: 165048 - DNA, 20 bp, Artificial
  CRISPR gRNA sequence
ggtgacagagcgagactgtc

SEQ ID NO: 165049 - DNA, 20 bp, Artificial
  CRISPR gRNA sequence
tctcaaaaaaaaaaaaaggt

SEQ ID NO: 165050 - DNA, 20 bp, Artificial
  CRISPR gRNA sequence
aaaaaaaaaaaaaggtaatt

SEQ ID NO: 165051 - DNA, 20 bp, Artificial
  CRISPR gRNA sequence
tgattttaggatttattctc

SEQ ID NO: 165052 - DNA, 20 bp, Artificial
  CRISPR gRNA sequence
taggatttattctctgctca

SEQ ID NO: 165053 - DNA, 20 bp, Artificial
  CRISPR gRNA sequence
aggatttattctctgctcat

SEQ ID NO: 165054 - DNA, 20 bp, Artificial
  CRISPR gRNA sequence
ggatttattctctgctcatt

SEQ ID NO: 165055 - DNA, 20 bp, Artificial
  CRISPR gRNA sequence
attctctgctcattttactt

SEQ ID NO: 165056 - DNA, 20 bp, Artificial
  CRISPR gRNA sequence
ttctctgctcattttactta

SEQ ID NO: 165057 - DNA, 20 bp, Artificial
  CRISPR gRNA sequence
tctgctcattttacttatcc

SEQ ID NO: 165058 - DNA, 20 bp, Artificial
  CRISPR gRNA sequence
tgctcattttacttatccat

SEQ ID NO: 165059 - DNA, 20 bp, Artificial
  CRISPR gRNA sequence
ctcattttacttatccatat

SEQ ID NO: 165060 - DNA, 20 bp, Artificial
  CRISPR gRNA sequence
attttacttatccatataac

SEQ ID NO: 165061 - DNA, 20 bp, Artificial
  CRISPR gRNA sequence
tacttatccatataacaaaa

SEQ ID NO: 165062 - DNA, 20 bp, Artificial
  CRISPR gRNA sequence
acttatccatataacaaaaa

SEQ ID NO: 165063 - DNA, 20 bp, Artificial
  CRISPR gRNA sequence
cttatccatataacaaaaat

SEQ ID NO: 165064 - DNA, 20 bp, Artificial
  CRISPR gRNA sequence
atccatataacaaaaatgta

SEQ ID NO: 165065 - DNA, 20 bp, Artificial
  CRISPR gRNA sequence
tccatataacaaaaatgtat

SEQ ID NO: 165066 - DNA, 20 bp, Artificial
  CRISPR gRNA sequence
agtgcttgttctatgccaga

SEQ ID NO: 165067 - DNA, 20 bp, Artificial
  CRISPR gRNA sequence
gttctatgccagacactgtg

SEQ ID NO: 165068 - DNA, 20 bp, Artificial
  CRISPR gRNA sequence
ttctatgccagacactgtgc

SEQ ID NO: 165069 - DNA, 20 bp, Artificial
  CRISPR gRNA sequence
tatgccagacactgtgctag

SEQ ID NO: 165070 - DNA, 20 bp, Artificial
  CRISPR gRNA sequence
tgccagacactgtgctaggc

SEQ ID NO: 165071 - DNA, 20 bp, Artificial
  CRISPR gRNA sequence
tgctaggcaggagggttcaa

SEQ ID NO: 165072 - DNA, 20 bp, Artificial
  CRISPR gRNA sequence
ggcaggagggttcaaagata

SEQ ID NO: 165073 - DNA, 20 bp, Artificial
  CRISPR gRNA sequence
aaagataatggctgctcagt

SEQ ID NO: 165074 - DNA, 20 bp, Artificial
  CRISPR gRNA sequence
ctcagtcactggctcaaggc

SEQ ID NO: 165075 - DNA, 20 bp, Artificial
  CRISPR gRNA sequence
agtcactggctcaaggcctc

SEQ ID NO: 165076 - DNA, 20 bp, Artificial
  CRISPR gRNA sequence
gctcaaggcctcgactgtat

SEQ ID NO: 165077 - DNA, 20 bp, Artificial
  CRISPR gRNA sequence
aaggcctcgactgtatcatg

SEQ ID NO: 165078 - DNA, 20 bp, Artificial
  CRISPR gRNA sequence
gactgtatcatgatgcctaa

SEQ ID NO: 165079 - DNA, 20 bp, Artificial
  CRISPR gRNA sequence
tatcatgatgcctaagggac

SEQ ID NO: 165080 - DNA, 20 bp, Artificial
  CRISPR gRNA sequence
agggaccttctttggctaat

SEQ ID NO: 165081 - DNA, 20 bp, Artificial
  CRISPR gRNA sequence
ctttggctaatgcttgtgcc

SEQ ID NO: 165082 - DNA, 20 bp, Artificial
  CRISPR gRNA sequence
tttggctaatgcttgtgcct

SEQ ID NO: 165083 - DNA, 20 bp, Artificial
  CRISPR gRNA sequence
tggctaatgcttgtgcctct

SEQ ID NO: 165084 - DNA, 20 bp, Artificial
  CRISPR gRNA sequence
ggctaatgcttgtgcctctg

SEQ ID NO: 165085 - DNA, 20 bp, Artificial
  CRISPR gRNA sequence
gctaatgcttgtgcctctgc

SEQ ID NO: 165086 - DNA, 20 bp, Artificial
  CRISPR gRNA sequence
atgcttgtgcctctgcagtg

SEQ ID NO: 165087 - DNA, 20 bp, Artificial
  CRISPR gRNA sequence
gtgcctctgcagtggtgaaa

SEQ ID NO: 165088 - DNA, 20 bp, Artificial
  CRISPR gRNA sequence
tgcctctgcagtggtgaaaa

SEQ ID NO: 165089 - DNA, 20 bp, Artificial
  CRISPR gRNA sequence
tgcagtggtgaaaactttac

SEQ ID NO: 165090 - DNA, 20 bp, Artificial
  CRISPR gRNA sequence
cagtggtgaaaactttacct

SEQ ID NO: 165091 - DNA, 20 bp, Artificial
  CRISPR gRNA sequence
tacctgccaaaggctttatc

SEQ ID NO: 165092 - DNA, 20 bp, Artificial
  CRISPR gRNA sequence
acctgccaaaggctttatcc

SEQ ID NO: 165093 - DNA, 20 bp, Artificial
  CRISPR gRNA sequence
cctgccaaaggctttatccc

SEQ ID NO: 165094 - DNA, 20 bp, Artificial
  CRISPR gRNA sequence
ccaaaggctttatcccttta

SEQ ID NO: 165095 - DNA, 20 bp, Artificial
  CRISPR gRNA sequence
tatccctttacagaatgaac

SEQ ID NO: 165096 - DNA, 20 bp, Artificial
  CRISPR gRNA sequence
atccctttacagaatgaact

SEQ ID NO: 165097 - DNA, 20 bp, Artificial
  CRISPR gRNA sequence
tccctttacagaatgaactt

SEQ ID NO: 165098 - DNA, 20 bp, Artificial
  CRISPR gRNA sequence
tacagaatgaacttagaggg

SEQ ID NO: 165099 - DNA, 20 bp, Artificial
  CRISPR gRNA sequence
acagaatgaacttagaggga

SEQ ID NO: 165100 - DNA, 20 bp, Artificial
  CRISPR gRNA sequence
cagaatgaacttagagggag

SEQ ID NO: 165101 - DNA, 20 bp, Artificial
  CRISPR gRNA sequence
agagggagtctgccaagggc

SEQ ID NO: 165102 - DNA, 20 bp, Artificial
  CRISPR gRNA sequence
gagggagtctgccaagggca

SEQ ID NO: 165103 - DNA, 20 bp, Artificial
  CRISPR gRNA sequence
ccaagggcaggctctgattg

SEQ ID NO: 165104 - DNA, 20 bp, Artificial
  CRISPR gRNA sequence
tgattggctgatcatcctaa

SEQ ID NO: 165105 - DNA, 20 bp, Artificial
  CRISPR gRNA sequence
attggctgatcatcctaaga

SEQ ID NO: 165106 - DNA, 20 bp, Artificial
  CRISPR gRNA sequence
gctgatcatcctaagaagct

SEQ ID NO: 165107 - DNA, 20 bp, Artificial
  CRISPR gRNA sequence
atcatcctaagaagctcatg

SEQ ID NO: 165108 - DNA, 20 bp, Artificial
  CRISPR gRNA sequence
agaagctcatggctgttgtg

SEQ ID NO: 165109 - DNA, 20 bp, Artificial
  CRISPR gRNA sequence
atggctgttgtgccctgaca

SEQ ID NO: 165110 - DNA, 20 bp, Artificial
  CRISPR gRNA sequence
ttgtgccctgacagcagggc

SEQ ID NO: 165111 - DNA, 20 bp, Artificial
  CRISPR gRNA sequence
tgccctgacagcagggcaca

SEQ ID NO: 165112 - DNA, 20 bp, Artificial
  CRISPR gRNA sequence
acagcagggcacaccataca

SEQ ID NO: 165113 - DNA, 20 bp, Artificial
  CRISPR gRNA sequence
gacagctgccatgctaacac

SEQ ID NO: 165114 - DNA, 20 bp, Artificial
  CRISPR gRNA sequence
acagctgccatgctaacaca

SEQ ID NO: 165115 - DNA, 20 bp, Artificial
  CRISPR gRNA sequence
ccatgctaacacaagccctc

SEQ ID NO: 165116 - DNA, 20 bp, Artificial
  CRISPR gRNA sequence
acacaagccctcattttcct

SEQ ID NO: 165117 - DNA, 20 bp, Artificial
  CRISPR gRNA sequence
attttcctgaaatgatttag

SEQ ID NO: 165118 - DNA, 20 bp, Artificial
  CRISPR gRNA sequence
tcctgaaatgatttagaaat

SEQ ID NO: 165119 - DNA, 20 bp, Artificial
  CRISPR gRNA sequence
cctgaaatgatttagaaata

SEQ ID NO: 165120 - DNA, 20 bp, Artificial
  CRISPR gRNA sequence
ctgaaatgatttagaaatac

SEQ ID NO: 165121 - DNA, 20 bp, Artificial
  CRISPR gRNA sequence
aaatgatttagaaatacctt

SEQ ID NO: 165122 - DNA, 20 bp, Artificial
  CRISPR gRNA sequence
agaaataccttggaaatcct

SEQ ID NO: 165123 - DNA, 20 bp, Artificial
  CRISPR gRNA sequence
gaaataccttggaaatcctc

SEQ ID NO: 165124 - DNA, 20 bp, Artificial
  CRISPR gRNA sequence
ggaaatcctctcgggaaaat

SEQ ID NO: 165125 - DNA, 20 bp, Artificial
  CRISPR gRNA sequence
gaaatcctctcgggaaaatt

SEQ ID NO: 165126 - DNA, 20 bp, Artificial
  CRISPR gRNA sequence
tcgggaaaattgggttgata

SEQ ID NO: 165127 - DNA, 20 bp, Artificial
  CRISPR gRNA sequence
gggaaaattgggttgataca

SEQ ID NO: 165128 - DNA, 20 bp, Artificial
  CRISPR gRNA sequence
ggttgatacagtacagtgat

SEQ ID NO: 165129 - DNA, 20 bp, Artificial
  CRISPR gRNA sequence
atacagtacagtgatgagtt

SEQ ID NO: 165130 - DNA, 20 bp, Artificial
  CRISPR gRNA sequence
gcagcatgcatttcttttta

SEQ ID NO: 165131 - DNA, 20 bp, Artificial
  CRISPR gRNA sequence
ctttttagtcagcgagaatt

SEQ ID NO: 165132 - DNA, 20 bp, Artificial
  CRISPR gRNA sequence
tttttagtcagcgagaattt

SEQ ID NO: 165133 - DNA, 20 bp, Artificial
  CRISPR gRNA sequence
tttagtcagcgagaatttca

SEQ ID NO: 165134 - DNA, 20 bp, Artificial
  CRISPR gRNA sequence
ttagtcagcgagaatttcat

SEQ ID NO: 165135 - DNA, 20 bp, Artificial
  CRISPR gRNA sequence
tagtcagcgagaatttcatc

SEQ ID NO: 165136 - DNA, 20 bp, Artificial
  CRISPR gRNA sequence
agtcagcgagaatttcatct

SEQ ID NO: 165137 - DNA, 20 bp, Artificial
  CRISPR gRNA sequence
gtcagcgagaatttcatctg

SEQ ID NO: 165138 - DNA, 20 bp, Artificial
  CRISPR gRNA sequence
catctgtgctcctctctgcc

SEQ ID NO: 165139 - DNA, 20 bp, Artificial
  CRISPR gRNA sequence
atctgtgctcctctctgcca

SEQ ID NO: 165140 - DNA, 20 bp, Artificial
  CRISPR gRNA sequence
tgctcctctctgccaaccca

SEQ ID NO: 165141 - DNA, 20 bp, Artificial
  CRISPR gRNA sequence
ctctctgccaacccagacgt

SEQ ID NO: 165142 - DNA, 20 bp, Artificial
  CRISPR gRNA sequence
tctgccaacccagacgtgct

SEQ ID NO: 165143 - DNA, 20 bp, Artificial
  CRISPR gRNA sequence
tgccaacccagacgtgctca

SEQ ID NO: 165144 - DNA, 20 bp, Artificial
  CRISPR gRNA sequence
ccaacccagacgtgctcagc

SEQ ID NO: 165145 - DNA, 20 bp, Artificial
  CRISPR gRNA sequence
agcttggagctgataaggct

SEQ ID NO: 165146 - DNA, 20 bp, Artificial
  CRISPR gRNA sequence
ggagctgataaggcttgtga

SEQ ID NO: 165147 - DNA, 20 bp, Artificial
  CRISPR gRNA sequence
gagctgataaggcttgtgag

SEQ ID NO: 165148 - DNA, 20 bp, Artificial
  CRISPR gRNA sequence
ataaggcttgtgaggatggt

SEQ ID NO: 165149 - DNA, 20 bp, Artificial
  CRISPR gRNA sequence
gtgaggatggtgaagttggt

SEQ ID NO: 165150 - DNA, 20 bp, Artificial
  CRISPR gRNA sequence
tgaggatggtgaagttggtc

SEQ ID NO: 165151 - DNA, 20 bp, Artificial
  CRISPR gRNA sequence
gtccttcccagcatttcctg

SEQ ID NO: 165152 - DNA, 20 bp, Artificial
  CRISPR gRNA sequence
cccagcatttcctggctgtt

SEQ ID NO: 165153 - DNA, 20 bp, Artificial
  CRISPR gRNA sequence
ccagcatttcctggctgttg

SEQ ID NO: 165154 - DNA, 20 bp, Artificial
  CRISPR gRNA sequence
cctggctgttgtttcaccat

SEQ ID NO: 165155 - DNA, 20 bp, Artificial
  CRISPR gRNA sequence
ctggctgttgtttcaccatc

SEQ ID NO: 165156 - DNA, 20 bp, Artificial
  CRISPR gRNA sequence
gctgttgtttcaccatcctg

SEQ ID NO: 165157 - DNA, 20 bp, Artificial
  CRISPR gRNA sequence
ttgtttcaccatcctgctgc

SEQ ID NO: 165158 - DNA, 20 bp, Artificial
  CRISPR gRNA sequence
tttcaccatcctgctgcttc

SEQ ID NO: 165159 - DNA, 20 bp, Artificial
  CRISPR gRNA sequence
caccatcctgctgcttcagg

SEQ ID NO: 165160 - DNA, 20 bp, Artificial
  CRISPR gRNA sequence
accatcctgctgcttcaggg

SEQ ID NO: 165161 - DNA, 20 bp, Artificial
  CRISPR gRNA sequence
ctgcttcagggtggccttgt

SEQ ID NO: 165162 - DNA, 20 bp, Artificial
  CRISPR gRNA sequence
cttcagggtggccttgtgct

SEQ ID NO: 165163 - DNA, 20 bp, Artificial
  CRISPR gRNA sequence
cagggtggccttgtgctgtg

SEQ ID NO: 165164 - DNA, 20 bp, Artificial
  CRISPR gRNA sequence
agggtggccttgtgctgtgt

SEQ ID NO: 165165 - DNA, 20 bp, Artificial
  CRISPR gRNA sequence
gtgctgtgtcacacctccct

SEQ ID NO: 165166 - DNA, 20 bp, Artificial
  CRISPR gRNA sequence
tgctgtgtcacacctccctg

SEQ ID NO: 165167 - DNA, 20 bp, Artificial
  CRISPR gRNA sequence
tgtcacacctccctggaccc

SEQ ID NO: 165168 - DNA, 20 bp, Artificial
  CRISPR gRNA sequence
cctggacccgtagtgatggc

SEQ ID NO: 165169 - DNA, 20 bp, Artificial
  CRISPR gRNA sequence
gacccgtagtgatggctatt

SEQ ID NO: 165170 - DNA, 20 bp, Artificial
  CRISPR gRNA sequence
tttcaagttgagtgcaaata

SEQ ID NO: 165171 - DNA, 20 bp, Artificial
  CRISPR gRNA sequence
caagttgagtgcaaatatcc

SEQ ID NO: 165172 - DNA, 20 bp, Artificial
  CRISPR gRNA sequence
aagttgagtgcaaatatcct

SEQ ID NO: 165173 - DNA, 20 bp, Artificial
  CRISPR gRNA sequence
agtgcaaatatccttcgtag

SEQ ID NO: 165174 - DNA, 20 bp, Artificial
  CRISPR gRNA sequence
cgtaggacagaatacatatg

SEQ ID NO: 165175 - DNA, 20 bp, Artificial
  CRISPR gRNA sequence
gtaggacagaatacatatgt

SEQ ID NO: 165176 - DNA, 20 bp, Artificial
  CRISPR gRNA sequence
aagcagagttggaaagaatg

SEQ ID NO: 165177 - DNA, 20 bp, Artificial
  CRISPR gRNA sequence
gaaagaatgcatattttggt

SEQ ID NO: 165178 - DNA, 20 bp, Artificial
  CRISPR gRNA sequence
tggtaaaattaatcctgtgt

SEQ ID NO: 165179 - DNA, 20 bp, Artificial
  CRISPR gRNA sequence
ggtaaaattaatcctgtgtt

SEQ ID NO: 165180 - DNA, 20 bp, Artificial
  CRISPR gRNA sequence
gtaaaattaatcctgtgttt

SEQ ID NO: 165181 - DNA, 20 bp, Artificial
  CRISPR gRNA sequence
atcctgtgttttctgtcata

SEQ ID NO: 165182 - DNA, 20 bp, Artificial
  CRISPR gRNA sequence
tgttttctgtcataaattga

SEQ ID NO: 165183 - DNA, 20 bp, Artificial
  CRISPR gRNA sequence
tctgtcataaattgaaaact

SEQ ID NO: 165184 - DNA, 20 bp, Artificial
  CRISPR gRNA sequence
ctgtcataaattgaaaactt

SEQ ID NO: 165185 - DNA, 20 bp, Artificial
  CRISPR gRNA sequence
tgtcataaattgaaaactta

SEQ ID NO: 165186 - DNA, 20 bp, Artificial
  CRISPR gRNA sequence
tcataaattgaaaacttatt

SEQ ID NO: 165187 - DNA, 20 bp, Artificial
  CRISPR gRNA sequence
aaaacttatttctggaggtt

SEQ ID NO: 165188 - DNA, 20 bp, Artificial
  CRISPR gRNA sequence
atttctggaggttgggaata

SEQ ID NO: 165189 - DNA, 20 bp, Artificial
  CRISPR gRNA sequence
tttctggaggttgggaatag

SEQ ID NO: 165190 - DNA, 20 bp, Artificial
  CRISPR gRNA sequence
ctggaggttgggaataggct

SEQ ID NO: 165191 - DNA, 20 bp, Artificial
  CRISPR gRNA sequence
tggaggttgggaataggctg

SEQ ID NO: 165192 - DNA, 20 bp, Artificial
  CRISPR gRNA sequence
gaggttgggaataggctgag

SEQ ID NO: 165193 - DNA, 20 bp, Artificial
  CRISPR gRNA sequence
ggaataggctgagttgaaaa

SEQ ID NO: 165194 - DNA, 20 bp, Artificial
  CRISPR gRNA sequence
agttgaaaattgtggtacaa

SEQ ID NO: 165195 - DNA, 20 bp, Artificial
  CRISPR gRNA sequence
aaaattgtggtacaagaatg

SEQ ID NO: 165196 - DNA, 20 bp, Artificial
  CRISPR gRNA sequence
tggtacaagaatggaagaaa

SEQ ID NO: 165197 - DNA, 20 bp, Artificial
  CRISPR gRNA sequence
tctgttagcctagcccactg

SEQ ID NO: 165198 - DNA, 20 bp, Artificial
  CRISPR gRNA sequence
ctgttagcctagcccactgc

SEQ ID NO: 165199 - DNA, 20 bp, Artificial
  CRISPR gRNA sequence
tgttagcctagcccactgca

SEQ ID NO: 165200 - DNA, 20 bp, Artificial
  CRISPR gRNA sequence
ttagcctagcccactgcatg

SEQ ID NO: 165201 - DNA, 20 bp, Artificial
  CRISPR gRNA sequence
gcctagcccactgcatgtac

SEQ ID NO: 165202 - DNA, 20 bp, Artificial
  CRISPR gRNA sequence
gcccactgcatgtactttta

SEQ ID NO: 165203 - DNA, 20 bp, Artificial
  CRISPR gRNA sequence
catgtacttttagaacactc

SEQ ID NO: 165204 - DNA, 20 bp, Artificial
  CRISPR gRNA sequence
ttagaacactctgtcgtctt

SEQ ID NO: 165205 - DNA, 20 bp, Artificial
  CRISPR gRNA sequence
tagaacactctgtcgtcttt

SEQ ID NO: 165206 - DNA, 20 bp, Artificial
  CRISPR gRNA sequence
agaacactctgtcgtctttc

SEQ ID NO: 165207 - DNA, 20 bp, Artificial
  CRISPR gRNA sequence
gaacactctgtcgtctttct

SEQ ID NO: 165208 - DNA, 20 bp, Artificial
  CRISPR gRNA sequence
tgtcgtctttctttttggcc

SEQ ID NO: 165209 - DNA, 20 bp, Artificial
  CRISPR gRNA sequence
tcgtctttctttttggccct

SEQ ID NO: 165210 - DNA, 20 bp, Artificial
  CRISPR gRNA sequence
tctttttggccctcctccag

SEQ ID NO: 165211 - DNA, 20 bp, Artificial
  CRISPR gRNA sequence
ctttttggccctcctccagt

SEQ ID NO: 165212 - DNA, 20 bp, Artificial
  CRISPR gRNA sequence
tttttggccctcctccagtt

SEQ ID NO: 165213 - DNA, 20 bp, Artificial
  CRISPR gRNA sequence
tttggccctcctccagttta

SEQ ID NO: 165214 - DNA, 20 bp, Artificial
  CRISPR gRNA sequence
ttggccctcctccagtttat

SEQ ID NO: 165215 - DNA, 20 bp, Artificial
  CRISPR gRNA sequence
tggccctcctccagtttata

SEQ ID NO: 165216 - DNA, 20 bp, Artificial
  CRISPR gRNA sequence
ggccctcctccagtttatag

SEQ ID NO: 165217 - DNA, 20 bp, Artificial
  CRISPR gRNA sequence
gccctcctccagtttatagt

SEQ ID NO: 165218 - DNA, 20 bp, Artificial
  CRISPR gRNA sequence
ctccagtttatagtaatttc

SEQ ID NO: 165219 - DNA, 20 bp, Artificial
  CRISPR gRNA sequence
cagtttatagtaatttctcc

SEQ ID NO: 165220 - DNA, 20 bp, Artificial
  CRISPR gRNA sequence
atagtaatttctccgtagta

SEQ ID NO: 165221 - DNA, 20 bp, Artificial
  CRISPR gRNA sequence
tagtaatttctccgtagtaa

SEQ ID NO: 165222 - DNA, 20 bp, Artificial
  CRISPR gRNA sequence
ctccgtagtaatcccttgaa

SEQ ID NO: 165223 - DNA, 20 bp, Artificial
  CRISPR gRNA sequence
tccgtagtaatcccttgaat

SEQ ID NO: 165224 - DNA, 20 bp, Artificial
  CRISPR gRNA sequence
cgtagtaatcccttgaatct

SEQ ID NO: 165225 - DNA, 20 bp, Artificial
  CRISPR gRNA sequence
gaatctcatctgtcgttccc

SEQ ID NO: 165226 - DNA, 20 bp, Artificial
  CRISPR gRNA sequence
aatctcatctgtcgttccca

SEQ ID NO: 165227 - DNA, 20 bp, Artificial
  CRISPR gRNA sequence
atctgtcgttcccagaacac

SEQ ID NO: 165228 - DNA, 20 bp, Artificial
  CRISPR gRNA sequence
tcgttcccagaacacatccc

SEQ ID NO: 165229 - DNA, 20 bp, Artificial
  CRISPR gRNA sequence
ccagaacacatccccttccc

SEQ ID NO: 165230 - DNA, 20 bp, Artificial
  CRISPR gRNA sequence
cccttgtaactttggatgca

SEQ ID NO: 165231 - DNA, 20 bp, Artificial
  CRISPR gRNA sequence
ccttgtaactttggatgcat

SEQ ID NO: 165232 - DNA, 20 bp, Artificial
  CRISPR gRNA sequence
gtaactttggatgcatagtt

SEQ ID NO: 165233 - DNA, 20 bp, Artificial
  CRISPR gRNA sequence
taactttggatgcatagttg

SEQ ID NO: 165234 - DNA, 20 bp, Artificial
  CRISPR gRNA sequence
tggatgcatagttgtaattt

SEQ ID NO: 165235 - DNA, 20 bp, Artificial
  CRISPR gRNA sequence
ggatgcatagttgtaatttt

SEQ ID NO: 165236 - DNA, 20 bp, Artificial
  CRISPR gRNA sequence
gatgcatagttgtaattttc

SEQ ID NO: 165237 - DNA, 20 bp, Artificial
  CRISPR gRNA sequence
taattttcagtaacctatgc

SEQ ID NO: 165238 - DNA, 20 bp, Artificial
  CRISPR gRNA sequence
tcagtaacctatgcagtcag

SEQ ID NO: 165239 - DNA, 20 bp, Artificial
  CRISPR gRNA sequence
cagtaacctatgcagtcaga

SEQ ID NO: 165240 - DNA, 20 bp, Artificial
  CRISPR gRNA sequence
agtaacctatgcagtcagaa

SEQ ID NO: 165241 - DNA, 20 bp, Artificial
  CRISPR gRNA sequence
tgcagtcagaattaagaaca

SEQ ID NO: 165242 - DNA, 20 bp, Artificial
  CRISPR gRNA sequence
agaacatcagaatagcaaca

SEQ ID NO: 165243 - DNA, 20 bp, Artificial
  CRISPR gRNA sequence
aagtttatgattcattgaga

SEQ ID NO: 165244 - DNA, 20 bp, Artificial
  CRISPR gRNA sequence
atgattcattgagagttcca

SEQ ID NO: 165245 - DNA, 20 bp, Artificial
  CRISPR gRNA sequence
tgattcattgagagttccat

SEQ ID NO: 165246 - DNA, 20 bp, Artificial
  CRISPR gRNA sequence
attgagagttccatagtctt

SEQ ID NO: 165247 - DNA, 20 bp, Artificial
  CRISPR gRNA sequence
agagttccatagtcttctta

SEQ ID NO: 165248 - DNA, 20 bp, Artificial
  CRISPR gRNA sequence
catagtcttcttattgaggt

SEQ ID NO: 165249 - DNA, 20 bp, Artificial
  CRISPR gRNA sequence
cttattgaggtgattaattc

SEQ ID NO: 165250 - DNA, 20 bp, Artificial
  CRISPR gRNA sequence
ttattgaggtgattaattca

SEQ ID NO: 165251 - DNA, 20 bp, Artificial
  CRISPR gRNA sequence
attgaggtgattaattcaaa

SEQ ID NO: 165252 - DNA, 20 bp, Artificial
  CRISPR gRNA sequence
ttgaggtgattaattcaaag

SEQ ID NO: 165253 - DNA, 20 bp, Artificial
  CRISPR gRNA sequence
aggtgattaattcaaagtga

SEQ ID NO: 165254 - DNA, 20 bp, Artificial
  CRISPR gRNA sequence
attcaaagtgaggagagata

SEQ ID NO: 165255 - DNA, 20 bp, Artificial
  CRISPR gRNA sequence
aaagtgaggagagatagtga

SEQ ID NO: 165256 - DNA, 20 bp, Artificial
  CRISPR gRNA sequence
aagtcagggattgggtgtac

SEQ ID NO: 165257 - DNA, 20 bp, Artificial
  CRISPR gRNA sequence
ggtgtacaggtgtagtttaa

SEQ ID NO: 165258 - DNA, 20 bp, Artificial
  CRISPR gRNA sequence
aaaaggctccacccacgccc

SEQ ID NO: 165259 - DNA, 20 bp, Artificial
  CRISPR gRNA sequence
aaaggctccacccacgccca

SEQ ID NO: 165260 - DNA, 20 bp, Artificial
  CRISPR gRNA sequence
cacccacgcccacacccccg

SEQ ID NO: 165261 - DNA, 20 bp, Artificial
  CRISPR gRNA sequence
ccaccaccagatgagcccag

SEQ ID NO: 165262 - DNA, 20 bp, Artificial
  CRISPR gRNA sequence
actgctctaggtaacctgta

SEQ ID NO: 165263 - DNA, 20 bp, Artificial
  CRISPR gRNA sequence
ctctaggtaacctgtaaaag

SEQ ID NO: 165264 - DNA, 20 bp, Artificial
  CRISPR gRNA sequence
taggtaacctgtaaaagtca

SEQ ID NO: 165265 - DNA, 20 bp, Artificial
  CRISPR gRNA sequence
ggtaacctgtaaaagtcaca

SEQ ID NO: 165266 - DNA, 20 bp, Artificial
  CRISPR gRNA sequence
taaaagtcacaaacagtact

SEQ ID NO: 165267 - DNA, 20 bp, Artificial
  CRISPR gRNA sequence
aaggtttgagatttgaaaga

SEQ ID NO: 165268 - DNA, 20 bp, Artificial
  CRISPR gRNA sequence
gagatttgaaagaataattg

SEQ ID NO: 165269 - DNA, 20 bp, Artificial
  CRISPR gRNA sequence
agatttgaaagaataattga

SEQ ID NO: 165270 - DNA, 20 bp, Artificial
  CRISPR gRNA sequence
gaaagaataattgacccttt

SEQ ID NO: 165271 - DNA, 20 bp, Artificial
  CRISPR gRNA sequence
aaagaataattgaccctttt

SEQ ID NO: 165272 - DNA, 20 bp, Artificial
  CRISPR gRNA sequence
acccttttggcagcttgtgt

SEQ ID NO: 165273 - DNA, 20 bp, Artificial
  CRISPR gRNA sequence
ttggcagcttgtgtctttac

SEQ ID NO: 165274 - DNA, 20 bp, Artificial
  CRISPR gRNA sequence
tggcagcttgtgtctttacc

SEQ ID NO: 165275 - DNA, 20 bp, Artificial
  CRISPR gRNA sequence
ggcagcttgtgtctttaccg

SEQ ID NO: 165276 - DNA, 20 bp, Artificial
  CRISPR gRNA sequence
gcagcttgtgtctttaccgt

SEQ ID NO: 165277 - DNA, 20 bp, Artificial
  CRISPR gRNA sequence
gtgtctttaccgtctcaaaa

SEQ ID NO: 165278 - DNA, 20 bp, Artificial
  CRISPR gRNA sequence
tgtctttaccgtctcaaaag

SEQ ID NO: 165279 - DNA, 20 bp, Artificial
  CRISPR gRNA sequence
taccgtctcaaaagagtaca

SEQ ID NO: 165280 - DNA, 20 bp, Artificial
  CRISPR gRNA sequence
accgtctcaaaagagtacat

SEQ ID NO: 165281 - DNA, 20 bp, Artificial
  CRISPR gRNA sequence
ccgtctcaaaagagtacatt

SEQ ID NO: 165282 - DNA, 20 bp, Artificial
  CRISPR gRNA sequence
aaaagagtacatttcatagg

SEQ ID NO: 165283 - DNA, 20 bp, Artificial
  CRISPR gRNA sequence
cataggactacaaccattgt

SEQ ID NO: 165284 - DNA, 20 bp, Artificial
  CRISPR gRNA sequence
ataggactacaaccattgtg

SEQ ID NO: 165285 - DNA, 20 bp, Artificial
  CRISPR gRNA sequence
caaccattgtgtgtgagaga

SEQ ID NO: 165286 - DNA, 20 bp, Artificial
  CRISPR gRNA sequence
tgtgtgagagacagaatctg

SEQ ID NO: 165287 - DNA, 20 bp, Artificial
  CRISPR gRNA sequence
ccaagtcatacacattgggc

SEQ ID NO: 165288 - DNA, 20 bp, Artificial
  CRISPR gRNA sequence
ggcagaaatttcttaaatct

SEQ ID NO: 165289 - DNA, 20 bp, Artificial
  CRISPR gRNA sequence
cttaaatctgagattgctat

SEQ ID NO: 165290 - DNA, 20 bp, Artificial
  CRISPR gRNA sequence
ttaaatctgagattgctatt

SEQ ID NO: 165291 - DNA, 20 bp, Artificial
  CRISPR gRNA sequence
aaatctgagattgctatttt

SEQ ID NO: 165292 - DNA, 20 bp, Artificial
  CRISPR gRNA sequence
aatctgagattgctattttt

SEQ ID NO: 165293 - DNA, 20 bp, Artificial
  CRISPR gRNA sequence
agattgctatttttagaaag

SEQ ID NO: 165294 - DNA, 20 bp, Artificial
  CRISPR gRNA sequence
ctatttttagaaagttagag

SEQ ID NO: 165295 - DNA, 20 bp, Artificial
  CRISPR gRNA sequence
tttttagaaagttagagttc

SEQ ID NO: 165296 - DNA, 20 bp, Artificial
  CRISPR gRNA sequence
ttagaaagttagagttcttg

SEQ ID NO: 165297 - DNA, 20 bp, Artificial
  CRISPR gRNA sequence
tagaaagttagagttcttgc

SEQ ID NO: 165298 - DNA, 20 bp, Artificial
  CRISPR gRNA sequence
agaaagttagagttcttgct

SEQ ID NO: 165299 - DNA, 20 bp, Artificial
  CRISPR gRNA sequence
gaaagttagagttcttgctt

SEQ ID NO: 165300 - DNA, 20 bp, Artificial
  CRISPR gRNA sequence
gagttcttgctttcttaaat

SEQ ID NO: 165301 - DNA, 20 bp, Artificial
  CRISPR gRNA sequence
ttgctttcttaaattctatt

SEQ ID NO: 165302 - DNA, 20 bp, Artificial
  CRISPR gRNA sequence
gctttcttaaattctattaa

SEQ ID NO: 165303 - DNA, 20 bp, Artificial
  CRISPR gRNA sequence
ctttcttaaattctattaat

SEQ ID NO: 165304 - DNA, 20 bp, Artificial
  CRISPR gRNA sequence
tcttaaattctattaattag

SEQ ID NO: 165305 - DNA, 20 bp, Artificial
  CRISPR gRNA sequence
cttaaattctattaattagg

SEQ ID NO: 165306 - DNA, 20 bp, Artificial
  CRISPR gRNA sequence
ttaaattctattaattaggg

SEQ ID NO: 165307 - DNA, 20 bp, Artificial
  CRISPR gRNA sequence
aaattctattaattaggggt

SEQ ID NO: 165308 - DNA, 20 bp, Artificial
  CRISPR gRNA sequence
aattctattaattaggggta

SEQ ID NO: 165309 - DNA, 20 bp, Artificial
  CRISPR gRNA sequence
tattaattaggggtagactt

SEQ ID NO: 165310 - DNA, 20 bp, Artificial
  CRISPR gRNA sequence
ttaattaggggtagacttag

SEQ ID NO: 165311 - DNA, 20 bp, Artificial
  CRISPR gRNA sequence
attaggggtagacttagtta

SEQ ID NO: 165312 - DNA, 20 bp, Artificial
  CRISPR gRNA sequence
ggggtagacttagttaagag

SEQ ID NO: 165313 - DNA, 20 bp, Artificial
  CRISPR gRNA sequence
agttaagagtctgtgtctta

SEQ ID NO: 165314 - DNA, 20 bp, Artificial
  CRISPR gRNA sequence
gttaagagtctgtgtcttaa

SEQ ID NO: 165315 - DNA, 20 bp, Artificial
  CRISPR gRNA sequence
agagtctgtgtcttaacagt

SEQ ID NO: 165316 - DNA, 20 bp, Artificial
  CRISPR gRNA sequence
tgtcttaacagtgcccagtg

SEQ ID NO: 165317 - DNA, 20 bp, Artificial
  CRISPR gRNA sequence
aacagtgcccagtgagttag

SEQ ID NO: 165318 - DNA, 20 bp, Artificial
  CRISPR gRNA sequence
acagtgcccagtgagttagc

SEQ ID NO: 165319 - DNA, 20 bp, Artificial
  CRISPR gRNA sequence
gcagtgtttgctctcctttg

SEQ ID NO: 165320 - DNA, 20 bp, Artificial
  CRISPR gRNA sequence
gctctcctttgggaagccat

SEQ ID NO: 165321 - DNA, 20 bp, Artificial
  CRISPR gRNA sequence
ctctcctttgggaagccata

SEQ ID NO: 165322 - DNA, 20 bp, Artificial
  CRISPR gRNA sequence
tcctttgggaagccatactg

SEQ ID NO: 165323 - DNA, 20 bp, Artificial
  CRISPR gRNA sequence
ctttgggaagccatactgtg

SEQ ID NO: 165324 - DNA, 20 bp, Artificial
  CRISPR gRNA sequence
tgggaagccatactgtggtc

SEQ ID NO: 165325 - DNA, 20 bp, Artificial
  CRISPR gRNA sequence
gggaagccatactgtggtcc

SEQ ID NO: 165326 - DNA, 20 bp, Artificial
  CRISPR gRNA sequence
ggaagccatactgtggtcca

SEQ ID NO: 165327 - DNA, 20 bp, Artificial
  CRISPR gRNA sequence
tggtccagagcagccatctg

SEQ ID NO: 165328 - DNA, 20 bp, Artificial
  CRISPR gRNA sequence
gccagtgtgggcaggaattg

SEQ ID NO: 165329 - DNA, 20 bp, Artificial
  CRISPR gRNA sequence
ctctgcagcttgaatggggt

SEQ ID NO: 165330 - DNA, 20 bp, Artificial
  CRISPR gRNA sequence
tgcagcttgaatggggtgag

SEQ ID NO: 165331 - DNA, 20 bp, Artificial
  CRISPR gRNA sequence
cagcttgaatggggtgagag

SEQ ID NO: 165332 - DNA, 20 bp, Artificial
  CRISPR gRNA sequence
gaatggggtgagagccagcg

SEQ ID NO: 165333 - DNA, 20 bp, Artificial
  CRISPR gRNA sequence
aatggggtgagagccagcgt

SEQ ID NO: 165334 - DNA, 20 bp, Artificial
  CRISPR gRNA sequence
gggcccgccttggagatgca

SEQ ID NO: 165335 - DNA, 20 bp, Artificial
  CRISPR gRNA sequence
ggagatgcacccctgtgctt

SEQ ID NO: 165336 - DNA, 20 bp, Artificial
  CRISPR gRNA sequence
gagatgcacccctgtgcttt

SEQ ID NO: 165337 - DNA, 20 bp, Artificial
  CRISPR gRNA sequence
tgctttatttttctctcagt

SEQ ID NO: 165338 - DNA, 20 bp, Artificial
  CRISPR gRNA sequence
tatttttctctcagtgtctt

SEQ ID NO: 165339 - DNA, 20 bp, Artificial
  CRISPR gRNA sequence
atttttctctcagtgtctta

SEQ ID NO: 165340 - DNA, 20 bp, Artificial
  CRISPR gRNA sequence
tttttctctcagtgtcttac

SEQ ID NO: 165341 - DNA, 20 bp, Artificial
  CRISPR gRNA sequence
ttctctcagtgtcttacatg

SEQ ID NO: 165342 - DNA, 20 bp, Artificial
  CRISPR gRNA sequence
tctctcagtgtcttacatgc

SEQ ID NO: 165343 - DNA, 20 bp, Artificial
  CRISPR gRNA sequence
ctctcagtgtcttacatgcc

SEQ ID NO: 165344 - DNA, 20 bp, Artificial
  CRISPR gRNA sequence
tctcagtgtcttacatgcct

SEQ ID NO: 165345 - DNA, 20 bp, Artificial
  CRISPR gRNA sequence
tcagtgtcttacatgcctaa

SEQ ID NO: 165346 - DNA, 20 bp, Artificial
  CRISPR gRNA sequence
agtgtcttacatgcctaaga

SEQ ID NO: 165347 - DNA, 20 bp, Artificial
  CRISPR gRNA sequence
acatgcctaagaaagagcac

SEQ ID NO: 165348 - DNA, 20 bp, Artificial
  CRISPR gRNA sequence
catgcctaagaaagagcaca

SEQ ID NO: 165349 - DNA, 20 bp, Artificial
  CRISPR gRNA sequence
agaaagagcacatgaccctg

SEQ ID NO: 165350 - DNA, 20 bp, Artificial
  CRISPR gRNA sequence
aactaaataaattcatactg

SEQ ID NO: 165351 - DNA, 20 bp, Artificial
  CRISPR gRNA sequence
aataaattcatactgaccct

SEQ ID NO: 165352 - DNA, 20 bp, Artificial
  CRISPR gRNA sequence
atactgaccctttccattta

SEQ ID NO: 165353 - DNA, 20 bp, Artificial
  CRISPR gRNA sequence
accctttccatttaatgttc

SEQ ID NO: 165354 - DNA, 20 bp, Artificial
  CRISPR gRNA sequence
tccatttaatgttcccctcc

SEQ ID NO: 165355 - DNA, 20 bp, Artificial
  CRISPR gRNA sequence
ccatttaatgttcccctcca

SEQ ID NO: 165356 - DNA, 20 bp, Artificial
  CRISPR gRNA sequence
catttaatgttcccctccaa

SEQ ID NO: 165357 - DNA, 20 bp, Artificial
  CRISPR gRNA sequence
aatgttcccctccaaattca

SEQ ID NO: 165358 - DNA, 20 bp, Artificial
  CRISPR gRNA sequence
atgttcccctccaaattcac

SEQ ID NO: 165359 - DNA, 20 bp, Artificial
  CRISPR gRNA sequence
ccctccaaattcacctgccc

SEQ ID NO: 165360 - DNA, 20 bp, Artificial
  CRISPR gRNA sequence
caaattcacctgccccagac

SEQ ID NO: 165361 - DNA, 20 bp, Artificial
  CRISPR gRNA sequence
acctgccccagacttgactt

SEQ ID NO: 165362 - DNA, 20 bp, Artificial
  CRISPR gRNA sequence
ccccagacttgactttggct

SEQ ID NO: 165363 - DNA, 20 bp, Artificial
  CRISPR gRNA sequence
gactttggctatttctgaag

SEQ ID NO: 165364 - DNA, 20 bp, Artificial
  CRISPR gRNA sequence
actttggctatttctgaagt

SEQ ID NO: 165365 - DNA, 20 bp, Artificial
  CRISPR gRNA sequence
tggctatttctgaagtaaac

SEQ ID NO: 165366 - DNA, 20 bp, Artificial
  CRISPR gRNA sequence
ggctatttctgaagtaaacg

SEQ ID NO: 165367 - DNA, 20 bp, Artificial
  CRISPR gRNA sequence
gctatttctgaagtaaacgg

SEQ ID NO: 165368 - DNA, 20 bp, Artificial
  CRISPR gRNA sequence
tttctgaagtaaacggtcat

SEQ ID NO: 165369 - DNA, 20 bp, Artificial
  CRISPR gRNA sequence
ctgaagtaaacggtcatggt

SEQ ID NO: 165370 - DNA, 20 bp, Artificial
  CRISPR gRNA sequence
tgaagtaaacggtcatggtt

SEQ ID NO: 165371 - DNA, 20 bp, Artificial
  CRISPR gRNA sequence
aagtaaacggtcatggttgc

SEQ ID NO: 165372 - DNA, 20 bp, Artificial
  CRISPR gRNA sequence
cttttgattttttctgtagt

SEQ ID NO: 165373 - DNA, 20 bp, Artificial
  CRISPR gRNA sequence
ttgattttttctgtagtgta

SEQ ID NO: 165374 - DNA, 20 bp, Artificial
  CRISPR gRNA sequence
tgattttttctgtagtgtat

SEQ ID NO: 165375 - DNA, 20 bp, Artificial
  CRISPR gRNA sequence
gattttttctgtagtgtatg

SEQ ID NO: 165376 - DNA, 20 bp, Artificial
  CRISPR gRNA sequence
attttttctgtagtgtatgt

SEQ ID NO: 165377 - DNA, 20 bp, Artificial
  CRISPR gRNA sequence
tttctgtagtgtatgtgcct

SEQ ID NO: 165378 - DNA, 20 bp, Artificial
  CRISPR gRNA sequence
ttctgtagtgtatgtgcctt

SEQ ID NO: 165379 - DNA, 20 bp, Artificial
  CRISPR gRNA sequence
tctgtagtgtatgtgcctta

SEQ ID NO: 165380 - DNA, 20 bp, Artificial
  CRISPR gRNA sequence
ctgtagtgtatgtgccttat

SEQ ID NO: 165381 - DNA, 20 bp, Artificial
  CRISPR gRNA sequence
tgtagtgtatgtgccttatc

SEQ ID NO: 165382 - DNA, 20 bp, Artificial
  CRISPR gRNA sequence
tagtgtatgtgccttatcac

SEQ ID NO: 165383 - DNA, 20 bp, Artificial
  CRISPR gRNA sequence
atcactaaaggggctgtgaa

SEQ ID NO: 165384 - DNA, 20 bp, Artificial
  CRISPR gRNA sequence
tcactaaaggggctgtgaaa

SEQ ID NO: 165385 - DNA, 20 bp, Artificial
  CRISPR gRNA sequence
aaggggctgtgaaaagttgc

SEQ ID NO: 165386 - DNA, 20 bp, Artificial
  CRISPR gRNA sequence
tgaaaagttgcagcatttgg

SEQ ID NO: 165387 - DNA, 20 bp, Artificial
  CRISPR gRNA sequence
cagcatttggggcacagaga

SEQ ID NO: 165388 - DNA, 20 bp, Artificial
  CRISPR gRNA sequence
ggggcacagagatttatgtt

SEQ ID NO: 165389 - DNA, 20 bp, Artificial
  CRISPR gRNA sequence
gggcacagagatttatgttt

SEQ ID NO: 165390 - DNA, 20 bp, Artificial
  CRISPR gRNA sequence
atgtttgggacccatgcaaa

SEQ ID NO: 165391 - DNA, 20 bp, Artificial
  CRISPR gRNA sequence
tgtttgggacccatgcaaat

SEQ ID NO: 165392 - DNA, 20 bp, Artificial
  CRISPR gRNA sequence
gggacccatgcaaatatttg

SEQ ID NO: 165393 - DNA, 20 bp, Artificial
  CRISPR gRNA sequence
ggacccatgcaaatatttgt

SEQ ID NO: 165394 - DNA, 20 bp, Artificial
  CRISPR gRNA sequence
gtactgtgagcctaaaaata

SEQ ID NO: 165395 - DNA, 20 bp, Artificial
  CRISPR gRNA sequence
tactgtgagcctaaaaatat

SEQ ID NO: 165396 - DNA, 20 bp, Artificial
  CRISPR gRNA sequence
tgagcctaaaaatatttttg

SEQ ID NO: 165397 - DNA, 20 bp, Artificial
  CRISPR gRNA sequence
aaaatatttttggtttttct

SEQ ID NO: 165398 - DNA, 20 bp, Artificial
  CRISPR gRNA sequence
ttggtttttctttcgttttg

SEQ ID NO: 165399 - DNA, 20 bp, Artificial
  CRISPR gRNA sequence
tggtttttctttcgttttgg

SEQ ID NO: 165400 - DNA, 20 bp, Artificial
  CRISPR gRNA sequence
ggtttttctttcgttttgga

SEQ ID NO: 165401 - DNA, 20 bp, Artificial
  CRISPR gRNA sequence
gtttttctttcgttttggag

SEQ ID NO: 165402 - DNA, 20 bp, Artificial
  CRISPR gRNA sequence
ttctttcgttttggagagta

SEQ ID NO: 165403 - DNA, 20 bp, Artificial
  CRISPR gRNA sequence
tctttcgttttggagagtaa

SEQ ID NO: 165404 - DNA, 20 bp, Artificial
  CRISPR gRNA sequence
ctttcgttttggagagtaac

SEQ ID NO: 165405 - DNA, 20 bp, Artificial
  CRISPR gRNA sequence
tttcgttttggagagtaact

SEQ ID NO: 165406 - DNA, 20 bp, Artificial
  CRISPR gRNA sequence
tcgttttggagagtaacttc

SEQ ID NO: 165407 - DNA, 20 bp, Artificial
  CRISPR gRNA sequence
cgttttggagagtaacttca

SEQ ID NO: 165408 - DNA, 20 bp, Artificial
  CRISPR gRNA sequence
gttttggagagtaacttcag

SEQ ID NO: 165409 - DNA, 20 bp, Artificial
  CRISPR gRNA sequence
tggagagtaacttcagcaat

SEQ ID NO: 165410 - DNA, 20 bp, Artificial
  CRISPR gRNA sequence
ggagagtaacttcagcaatg

SEQ ID NO: 165411 - DNA, 20 bp, Artificial
  CRISPR gRNA sequence
gagagtaacttcagcaatgc

SEQ ID NO: 165412 - DNA, 20 bp, Artificial
  CRISPR gRNA sequence
cagcaatgctgtaaacccag

SEQ ID NO: 165413 - DNA, 20 bp, Artificial
  CRISPR gRNA sequence
agcaatgctgtaaacccaga

SEQ ID NO: 165414 - DNA, 20 bp, Artificial
  CRISPR gRNA sequence
taaacccagaggactctgta

SEQ ID NO: 165415 - DNA, 20 bp, Artificial
  CRISPR gRNA sequence
tgtaggttattactagtact

SEQ ID NO: 165416 - DNA, 20 bp, Artificial
  CRISPR gRNA sequence
taggttattactagtactga

SEQ ID NO: 165417 - DNA, 20 bp, Artificial
  CRISPR gRNA sequence
ttactagtactgagatgacc

SEQ ID NO: 165418 - DNA, 20 bp, Artificial
  CRISPR gRNA sequence
ctagtactgagatgacctta

SEQ ID NO: 165419 - DNA, 20 bp, Artificial
  CRISPR gRNA sequence
gtactgagatgaccttaggc

SEQ ID NO: 165420 - DNA, 20 bp, Artificial
  CRISPR gRNA sequence
agatgaccttaggcattcat

SEQ ID NO: 165421 - DNA, 20 bp, Artificial
  CRISPR gRNA sequence
aggcattcatggagagggtt

SEQ ID NO: 165422 - DNA, 20 bp, Artificial
  CRISPR gRNA sequence
ggcattcatggagagggttt

SEQ ID NO: 165423 - DNA, 20 bp, Artificial
  CRISPR gRNA sequence
atggagagggtttgctccca

SEQ ID NO: 165424 - DNA, 20 bp, Artificial
  CRISPR gRNA sequence
gctcccagcacattgctcgt

SEQ ID NO: 165425 - DNA, 20 bp, Artificial
  CRISPR gRNA sequence
ctcccagcacattgctcgtt

SEQ ID NO: 165426 - DNA, 20 bp, Artificial
  CRISPR gRNA sequence
ccagcacattgctcgttatt

SEQ ID NO: 165427 - DNA, 20 bp, Artificial
  CRISPR gRNA sequence
ctcgttattaacctctcggt

SEQ ID NO: 165428 - DNA, 20 bp, Artificial
  CRISPR gRNA sequence
gttattaacctctcggtaat

SEQ ID NO: 165429 - DNA, 20 bp, Artificial
  CRISPR gRNA sequence
ttaacctctcggtaatcctg

SEQ ID NO: 165430 - DNA, 20 bp, Artificial
  CRISPR gRNA sequence
acctctcggtaatcctgtgg

SEQ ID NO: 165431 - DNA, 20 bp, Artificial
  CRISPR gRNA sequence
tcggtaatcctgtgggctct

SEQ ID NO: 165432 - DNA, 20 bp, Artificial
  CRISPR gRNA sequence
ggtaatcctgtgggctctga

SEQ ID NO: 165433 - DNA, 20 bp, Artificial
  CRISPR gRNA sequence
tgggctctgagcctgaactc

SEQ ID NO: 165434 - DNA, 20 bp, Artificial
  CRISPR gRNA sequence
tgagcctgaactcacgcagc

SEQ ID NO: 165435 - DNA, 20 bp, Artificial
  CRISPR gRNA sequence
agcctgaactcacgcagcat

SEQ ID NO: 165436 - DNA, 20 bp, Artificial
  CRISPR gRNA sequence
aactcacgcagcattctcat

SEQ ID NO: 165437 - DNA, 20 bp, Artificial
  CRISPR gRNA sequence
acgcagcattctcataactc

SEQ ID NO: 165438 - DNA, 20 bp, Artificial
  CRISPR gRNA sequence
tcataactcttcctttcaga

SEQ ID NO: 165439 - DNA, 20 bp, Artificial
  CRISPR gRNA sequence
ataactcttcctttcagacc

SEQ ID NO: 165440 - DNA, 20 bp, Artificial
  CRISPR gRNA sequence
ttcctttcagaccacacctg

SEQ ID NO: 165441 - DNA, 20 bp, Artificial
  CRISPR gRNA sequence
cctttcagaccacacctgtg

SEQ ID NO: 165442 - DNA, 20 bp, Artificial
  CRISPR gRNA sequence
ctttcagaccacacctgtga

SEQ ID NO: 165443 - DNA, 20 bp, Artificial
  CRISPR gRNA sequence
tcagaccacacctgtgacaa

SEQ ID NO: 165444 - DNA, 20 bp, Artificial
  CRISPR gRNA sequence
cagaccacacctgtgacaat

SEQ ID NO: 165445 - DNA, 20 bp, Artificial
  CRISPR gRNA sequence
agaccacacctgtgacaatg

SEQ ID NO: 165446 - DNA, 20 bp, Artificial
  CRISPR gRNA sequence
tgacaatgcaggttggagaa

SEQ ID NO: 165447 - DNA, 20 bp, Artificial
  CRISPR gRNA sequence
gagaaggtcagcaggtgcag

SEQ ID NO: 165448 - DNA, 20 bp, Artificial
  CRISPR gRNA sequence
tccaggctcagccacagggt

SEQ ID NO: 165449 - DNA, 20 bp, Artificial
  CRISPR gRNA sequence
agccacagggtcaagcccaa

SEQ ID NO: 165450 - DNA, 20 bp, Artificial
  CRISPR gRNA sequence
gacagaccatgcaggtgatg

SEQ ID NO: 165451 - DNA, 20 bp, Artificial
  CRISPR gRNA sequence
acacaggagagatccagcag

SEQ ID NO: 165452 - DNA, 20 bp, Artificial
  CRISPR gRNA sequence
ccctgaggtctgtctttaca

SEQ ID NO: 165453 - DNA, 20 bp, Artificial
  CRISPR gRNA sequence
aggtctgtctttacaacttt

SEQ ID NO: 165454 - DNA, 20 bp, Artificial
  CRISPR gRNA sequence
tctttacaactttatagaag

SEQ ID NO: 165455 - DNA, 20 bp, Artificial
  CRISPR gRNA sequence
tacaactttatagaaggaaa

SEQ ID NO: 165456 - DNA, 20 bp, Artificial
  CRISPR gRNA sequence
acaactttatagaaggaaat

SEQ ID NO: 165457 - DNA, 20 bp, Artificial
  CRISPR gRNA sequence
caactttatagaaggaaata

SEQ ID NO: 165458 - DNA, 20 bp, Artificial
  CRISPR gRNA sequence
tatagaaggaaatacttaaa

SEQ ID NO: 165459 - DNA, 20 bp, Artificial
  CRISPR gRNA sequence
atagaaggaaatacttaaag

SEQ ID NO: 165460 - DNA, 20 bp, Artificial
  CRISPR gRNA sequence
tagaaggaaatacttaaaga

SEQ ID NO: 165461 - DNA, 20 bp, Artificial
  CRISPR gRNA sequence
aaagatatatataccttgat

SEQ ID NO: 165462 - DNA, 20 bp, Artificial
  CRISPR gRNA sequence
aagatatatataccttgata

SEQ ID NO: 165463 - DNA, 20 bp, Artificial
  CRISPR gRNA sequence
gatatatatatgtatatctc

SEQ ID NO: 165464 - DNA, 20 bp, Artificial
  CRISPR gRNA sequence
atatatatatgtatatctct

SEQ ID NO: 165465 - DNA, 20 bp, Artificial
  CRISPR gRNA sequence
tatatataccttgatatgta

SEQ ID NO: 165466 - DNA, 20 bp, Artificial
  CRISPR gRNA sequence
tatataccttgatatgtata

SEQ ID NO: 165467 - DNA, 20 bp, Artificial
  CRISPR gRNA sequence
gatatgtatatctatagcta

SEQ ID NO: 165468 - DNA, 20 bp, Artificial
  CRISPR gRNA sequence
atatgtatatctatagctat

SEQ ID NO: 165469 - DNA, 20 bp, Artificial
  CRISPR gRNA sequence
tagctatatatataccttga

SEQ ID NO: 165470 - DNA, 20 bp, Artificial
  CRISPR gRNA sequence
tatatataccttgatatata

SEQ ID NO: 165471 - DNA, 20 bp, Artificial
  CRISPR gRNA sequence
gatatatatatctatagcta

SEQ ID NO: 165472 - DNA, 20 bp, Artificial
  CRISPR gRNA sequence
atatatatatctatagctat

SEQ ID NO: 165473 - DNA, 20 bp, Artificial
  CRISPR gRNA sequence
tagctatatatataccttga

SEQ ID NO: 165474 - DNA, 20 bp, Artificial
  CRISPR gRNA sequence
tatatataccttgatatata

SEQ ID NO: 165475 - DNA, 20 bp, Artificial
  CRISPR gRNA sequence
gatatatatatgtatgtctc

SEQ ID NO: 165476 - DNA, 20 bp, Artificial
  CRISPR gRNA sequence
atatatatatgtatgtctct

SEQ ID NO: 165477 - DNA, 20 bp, Artificial
  CRISPR gRNA sequence
tatatataccttgatatgta

SEQ ID NO: 165478 - DNA, 20 bp, Artificial
  CRISPR gRNA sequence
tatataccttgatatgtata

SEQ ID NO: 165479 - DNA, 20 bp, Artificial
  CRISPR gRNA sequence
gatatgtatatctatagcta

SEQ ID NO: 165480 - DNA, 20 bp, Artificial
  CRISPR gRNA sequence
atatgtatatctatagctat

SEQ ID NO: 165481 - DNA, 20 bp, Artificial
  CRISPR gRNA sequence
tagctatatatataccttga

SEQ ID NO: 165482 - DNA, 20 bp, Artificial
  CRISPR gRNA sequence
tatatataccttgatatata

SEQ ID NO: 165483 - DNA, 20 bp, Artificial
  CRISPR gRNA sequence
gatatatatatctgtagcta

SEQ ID NO: 165484 - DNA, 20 bp, Artificial
  CRISPR gRNA sequence
atatatatatctgtagctat

SEQ ID NO: 165485 - DNA, 20 bp, Artificial
  CRISPR gRNA sequence
tagctatatatataccttga

SEQ ID NO: 165486 - DNA, 20 bp, Artificial
  CRISPR gRNA sequence
tatatataccttgatatata

SEQ ID NO: 165487 - DNA, 20 bp, Artificial
  CRISPR gRNA sequence
gatatatatatagagatata

SEQ ID NO: 165488 - DNA, 20 bp, Artificial
  CRISPR gRNA sequence
atatatatatagagatatat

SEQ ID NO: 165489 - DNA, 20 bp, Artificial
  CRISPR gRNA sequence
tttttctttttaggagacag

SEQ ID NO: 165490 - DNA, 20 bp, Artificial
  CRISPR gRNA sequence
ttttctttttaggagacagg

SEQ ID NO: 165491 - DNA, 20 bp, Artificial
  CRISPR gRNA sequence
tttctttttaggagacaggt

SEQ ID NO: 165492 - DNA, 20 bp, Artificial
  CRISPR gRNA sequence
ttctttttaggagacaggtc

SEQ ID NO: 165493 - DNA, 20 bp, Artificial
  CRISPR gRNA sequence
tctttttaggagacaggtct

SEQ ID NO: 165494 - DNA, 20 bp, Artificial
  CRISPR gRNA sequence
ctttttaggagacaggtctt

SEQ ID NO: 165495 - DNA, 20 bp, Artificial
  CRISPR gRNA sequence
tttttaggagacaggtcttg

SEQ ID NO: 165496 - DNA, 20 bp, Artificial
  CRISPR gRNA sequence
tttaggagacaggtcttgct

SEQ ID NO: 165497 - DNA, 20 bp, Artificial
  CRISPR gRNA sequence
ttaggagacaggtcttgctg

SEQ ID NO: 165498 - DNA, 20 bp, Artificial
  CRISPR gRNA sequence
taggagacaggtcttgctgt

SEQ ID NO: 165499 - DNA, 20 bp, Artificial
  CRISPR gRNA sequence
aggagacaggtcttgctgtg

SEQ ID NO: 165500 - DNA, 20 bp, Artificial
  CRISPR gRNA sequence
ggagacaggtcttgctgtgt

SEQ ID NO: 165501 - DNA, 20 bp, Artificial
  CRISPR gRNA sequence
gctgtgtcactcagactgat

SEQ ID NO: 165502 - DNA, 20 bp, Artificial
  CRISPR gRNA sequence
ctgtgtcactcagactgatg

SEQ ID NO: 165503 - DNA, 20 bp, Artificial
  CRISPR gRNA sequence
tgtcactcagactgatgaag

SEQ ID NO: 165504 - DNA, 20 bp, Artificial
  CRISPR gRNA sequence
agactgatgaagtgcagtgg

SEQ ID NO: 165505 - DNA, 20 bp, Artificial
  CRISPR gRNA sequence
atgaagtgcagtggcttgat

SEQ ID NO: 165506 - DNA, 20 bp, Artificial
  CRISPR gRNA sequence
gatctcagctcactgcagct

SEQ ID NO: 165507 - DNA, 20 bp, Artificial
  CRISPR gRNA sequence
atctcagctcactgcagctt

SEQ ID NO: 165508 - DNA, 20 bp, Artificial
  CRISPR gRNA sequence
agctcactgcagcttccgcc

SEQ ID NO: 165509 - DNA, 20 bp, Artificial
  CRISPR gRNA sequence
actgcagcttccgcctccca

SEQ ID NO: 165510 - DNA, 20 bp, Artificial
  CRISPR gRNA sequence
cagcttccgcctcccaggtt

SEQ ID NO: 165511 - DNA, 20 bp, Artificial
  CRISPR gRNA sequence
ccgcctcccaggttcaagcg

SEQ ID NO: 165512 - DNA, 20 bp, Artificial
  CRISPR gRNA sequence
cgcctcccaggttcaagcga

SEQ ID NO: 165513 - DNA, 20 bp, Artificial
  CRISPR gRNA sequence
ccaggttcaagcgattctcc

SEQ ID NO: 165514 - DNA, 20 bp, Artificial
  CRISPR gRNA sequence
aagcgattctcctgcctcag

SEQ ID NO: 165515 - DNA, 20 bp, Artificial
  CRISPR gRNA sequence
tcctgcctcagcctcccgag

SEQ ID NO: 165516 - DNA, 20 bp, Artificial
  CRISPR gRNA sequence
ctgcctcagcctcccgagta

SEQ ID NO: 165517 - DNA, 20 bp, Artificial
  CRISPR gRNA sequence
cctcagcctcccgagtagct

SEQ ID NO: 165518 - DNA, 20 bp, Artificial
  CRISPR gRNA sequence
agcctcccgagtagctggga

SEQ ID NO: 165519 - DNA, 20 bp, Artificial
  CRISPR gRNA sequence
ccgagtagctgggattatag

SEQ ID NO: 165520 - DNA, 20 bp, Artificial
  CRISPR gRNA sequence
ggattataggcacgtgccac

SEQ ID NO: 165521 - DNA, 20 bp, Artificial
  CRISPR gRNA sequence
taggcacgtgccactatgcc

SEQ ID NO: 165522 - DNA, 20 bp, Artificial
  CRISPR gRNA sequence
tgcccggctgatttttgtat

SEQ ID NO: 165523 - DNA, 20 bp, Artificial
  CRISPR gRNA sequence
atttttgtatttttagtaga

SEQ ID NO: 165524 - DNA, 20 bp, Artificial
  CRISPR gRNA sequence
ttgtatttttagtagagatg

SEQ ID NO: 165525 - DNA, 20 bp, Artificial
  CRISPR gRNA sequence
tgtatttttagtagagatgg

SEQ ID NO: 165526 - DNA, 20 bp, Artificial
  CRISPR gRNA sequence
gtatttttagtagagatggg

SEQ ID NO: 165527 - DNA, 20 bp, Artificial
  CRISPR gRNA sequence
tatttttagtagagatgggg

SEQ ID NO: 165528 - DNA, 20 bp, Artificial
  CRISPR gRNA sequence
ttagtagagatggggtttca

SEQ ID NO: 165529 - DNA, 20 bp, Artificial
  CRISPR gRNA sequence
tagtagagatggggtttcac

SEQ ID NO: 165530 - DNA, 20 bp, Artificial
  CRISPR gRNA sequence
agtagagatggggtttcaca

SEQ ID NO: 165531 - DNA, 20 bp, Artificial
  CRISPR gRNA sequence
gtagagatggggtttcacag

SEQ ID NO: 165532 - DNA, 20 bp, Artificial
  CRISPR gRNA sequence
cacagtgttggccaggctgg

SEQ ID NO: 165533 - DNA, 20 bp, Artificial
  CRISPR gRNA sequence
acagtgttggccaggctggt

SEQ ID NO: 165534 - DNA, 20 bp, Artificial
  CRISPR gRNA sequence
gccaggctggtctctaactc

SEQ ID NO: 165535 - DNA, 20 bp, Artificial
  CRISPR gRNA sequence
gtctctaactcctaacctca

SEQ ID NO: 165536 - DNA, 20 bp, Artificial
  CRISPR gRNA sequence
taactcctaacctcaggtga

SEQ ID NO: 165537 - DNA, 20 bp, Artificial
  CRISPR gRNA sequence
actcctaacctcaggtgatc

SEQ ID NO: 165538 - DNA, 20 bp, Artificial
  CRISPR gRNA sequence
ctaacctcaggtgatccgcc

SEQ ID NO: 165539 - DNA, 20 bp, Artificial
  CRISPR gRNA sequence
acctcaggtgatccgcccgc

SEQ ID NO: 165540 - DNA, 20 bp, Artificial
  CRISPR gRNA sequence
aggtgatccgcccgcctcgg

SEQ ID NO: 165541 - DNA, 20 bp, Artificial
  CRISPR gRNA sequence
ggcctcccaaagtgctggga

SEQ ID NO: 165542 - DNA, 20 bp, Artificial
  CRISPR gRNA sequence
ccaaagtgctgggattacag

SEQ ID NO: 165543 - DNA, 20 bp, Artificial
  CRISPR gRNA sequence
ggattacaggcatgagccat

SEQ ID NO: 165544 - DNA, 20 bp, Artificial
  CRISPR gRNA sequence
caggcatgagccatcacgcc

SEQ ID NO: 165545 - DNA, 20 bp, Artificial
  CRISPR gRNA sequence
agtacttatttatatatatg

SEQ ID NO: 165546 - DNA, 20 bp, Artificial
  CRISPR gRNA sequence
atttatatatatgcgtgtgt

SEQ ID NO: 165547 - DNA, 20 bp, Artificial
  CRISPR gRNA sequence
tttatatatatgcgtgtgtg

SEQ ID NO: 165548 - DNA, 20 bp, Artificial
  CRISPR gRNA sequence
atatatatgcgtgtgtgtgt

SEQ ID NO: 165549 - DNA, 20 bp, Artificial
  CRISPR gRNA sequence
tatatatgcgtgtgtgtgtt

SEQ ID NO: 165550 - DNA, 20 bp, Artificial
  CRISPR gRNA sequence
gttttgtttttaacctatat

SEQ ID NO: 165551 - DNA, 20 bp, Artificial
  CRISPR gRNA sequence
ttttgtttttaacctatatg

SEQ ID NO: 165552 - DNA, 20 bp, Artificial
  CRISPR gRNA sequence
tgtttttaacctatatgccc

SEQ ID NO: 165553 - DNA, 20 bp, Artificial
  CRISPR gRNA sequence
gtttttaacctatatgccca

SEQ ID NO: 165554 - DNA, 20 bp, Artificial
  CRISPR gRNA sequence
tttttaacctatatgcccag

SEQ ID NO: 165555 - DNA, 20 bp, Artificial
  CRISPR gRNA sequence
ttaacctatatgcccagtgt

SEQ ID NO: 165556 - DNA, 20 bp, Artificial
  CRISPR gRNA sequence
taacctatatgcccagtgtt

SEQ ID NO: 165557 - DNA, 20 bp, Artificial
  CRISPR gRNA sequence
aacctatatgcccagtgttc

SEQ ID NO: 165558 - DNA, 20 bp, Artificial
  CRISPR gRNA sequence
acctatatgcccagtgttcc

SEQ ID NO: 165559 - DNA, 20 bp, Artificial
  CRISPR gRNA sequence
tatgcccagtgttcctgacc

SEQ ID NO: 165560 - DNA, 20 bp, Artificial
  CRISPR gRNA sequence
ctgaccacaacttgcttcac

SEQ ID NO: 165561 - DNA, 20 bp, Artificial
  CRISPR gRNA sequence
accacaacttgcttcactgt

SEQ ID NO: 165562 - DNA, 20 bp, Artificial
  CRISPR gRNA sequence
gcttcactgtgtttgttccc

SEQ ID NO: 165563 - DNA, 20 bp, Artificial
  CRISPR gRNA sequence
cttcactgtgtttgttccct

SEQ ID NO: 165564 - DNA, 20 bp, Artificial
  CRISPR gRNA sequence
cactgtgtttgttccctgct

SEQ ID NO: 165565 - DNA, 20 bp, Artificial
  CRISPR gRNA sequence
actgtgtttgttccctgctt

SEQ ID NO: 165566 - DNA, 20 bp, Artificial
  CRISPR gRNA sequence
tgtttgttccctgctttcct

SEQ ID NO: 165567 - DNA, 20 bp, Artificial
  CRISPR gRNA sequence
gttccctgctttcctttaat

SEQ ID NO: 165568 - DNA, 20 bp, Artificial
  CRISPR gRNA sequence
ttccctgctttcctttaatc

SEQ ID NO: 165569 - DNA, 20 bp, Artificial
  CRISPR gRNA sequence
cctgctttcctttaatctag

SEQ ID NO: 165570 - DNA, 20 bp, Artificial
  CRISPR gRNA sequence
ctttcctttaatctaggttc

SEQ ID NO: 165571 - DNA, 20 bp, Artificial
  CRISPR gRNA sequence
tcctttaatctaggttcagg

SEQ ID NO: 165572 - DNA, 20 bp, Artificial
  CRISPR gRNA sequence
cctttaatctaggttcaggt

SEQ ID NO: 165573 - DNA, 20 bp, Artificial
  CRISPR gRNA sequence
ctttaatctaggttcaggtt

SEQ ID NO: 165574 - DNA, 20 bp, Artificial
  CRISPR gRNA sequence
taatctaggttcaggttcac

SEQ ID NO: 165575 - DNA, 20 bp, Artificial
  CRISPR gRNA sequence
aatctaggttcaggttcacc

SEQ ID NO: 165576 - DNA, 20 bp, Artificial
  CRISPR gRNA sequence
atctaggttcaggttcacca

SEQ ID NO: 165577 - DNA, 20 bp, Artificial
  CRISPR gRNA sequence
ggttcaggttcaccacgatt

SEQ ID NO: 165578 - DNA, 20 bp, Artificial
  CRISPR gRNA sequence
aggttcaccacgattgggcg

SEQ ID NO: 165579 - DNA, 20 bp, Artificial
  CRISPR gRNA sequence
accacgattgggcggcttct

SEQ ID NO: 165580 - DNA, 20 bp, Artificial
  CRISPR gRNA sequence
ggcggcttctctcgatttcc

SEQ ID NO: 165581 - DNA, 20 bp, Artificial
  CRISPR gRNA sequence
ctctcgatttcccctcattc

SEQ ID NO: 165582 - DNA, 20 bp, Artificial
  CRISPR gRNA sequence
tctcgatttcccctcattct

SEQ ID NO: 165583 - DNA, 20 bp, Artificial
  CRISPR gRNA sequence
tcgatttcccctcattctac

SEQ ID NO: 165584 - DNA, 20 bp, Artificial
  CRISPR gRNA sequence
gatttcccctcattctacct

SEQ ID NO: 165585 - DNA, 20 bp, Artificial
  CRISPR gRNA sequence
cccctcattctacctatgca

SEQ ID NO: 165586 - DNA, 20 bp, Artificial
  CRISPR gRNA sequence
ccctcattctacctatgcag

SEQ ID NO: 165587 - DNA, 20 bp, Artificial
  CRISPR gRNA sequence
attctacctatgcagggaaa

SEQ ID NO: 165588 - DNA, 20 bp, Artificial
  CRISPR gRNA sequence
tacctatgcagggaaatcat

SEQ ID NO: 165589 - DNA, 20 bp, Artificial
  CRISPR gRNA sequence
cctatgcagggaaatcattg

SEQ ID NO: 165590 - DNA, 20 bp, Artificial
  CRISPR gRNA sequence
tgcagggaaatcattgtaac

SEQ ID NO: 165591 - DNA, 20 bp, Artificial
  CRISPR gRNA sequence
taaccactacccatgccaag

SEQ ID NO: 165592 - DNA, 20 bp, Artificial
  CRISPR gRNA sequence
cccatgccaaggcccaaagg

SEQ ID NO: 165593 - DNA, 20 bp, Artificial
  CRISPR gRNA sequence
tgaggcagtcctgtatttga

SEQ ID NO: 165594 - DNA, 20 bp, Artificial
  CRISPR gRNA sequence
tatttgattagcagaggata

SEQ ID NO: 165595 - DNA, 20 bp, Artificial
  CRISPR gRNA sequence
gattagcagaggataagagg

SEQ ID NO: 165596 - DNA, 20 bp, Artificial
  CRISPR gRNA sequence
attagcagaggataagaggg

SEQ ID NO: 165597 - DNA, 20 bp, Artificial
  CRISPR gRNA sequence
gcagaggataagagggaggc

SEQ ID NO: 165598 - DNA, 20 bp, Artificial
  CRISPR gRNA sequence
gttgcatattcatgagtcag

SEQ ID NO: 165599 - DNA, 20 bp, Artificial
  CRISPR gRNA sequence
ttgcatattcatgagtcagt

SEQ ID NO: 165600 - DNA, 20 bp, Artificial
  CRISPR gRNA sequence
catattcatgagtcagttcc

SEQ ID NO: 165601 - DNA, 20 bp, Artificial
  CRISPR gRNA sequence
atgagtcagttcccagtgga

SEQ ID NO: 165602 - DNA, 20 bp, Artificial
  CRISPR gRNA sequence
ccagtggagcctgcagcaaa

SEQ ID NO: 165603 - DNA, 20 bp, Artificial
  CRISPR gRNA sequence
cagcaaagtgtatttttggc

SEQ ID NO: 165604 - DNA, 20 bp, Artificial
  CRISPR gRNA sequence
ttggctttcatataacttat

SEQ ID NO: 165605 - DNA, 20 bp, Artificial
  CRISPR gRNA sequence
tggctttcatataacttatc

SEQ ID NO: 165606 - DNA, 20 bp, Artificial
  CRISPR gRNA sequence
ggctttcatataacttatct

SEQ ID NO: 165607 - DNA, 20 bp, Artificial
  CRISPR gRNA sequence
gctttcatataacttatcta

SEQ ID NO: 165608 - DNA, 20 bp, Artificial
  CRISPR gRNA sequence
tcatataacttatctattcc

SEQ ID NO: 165609 - DNA, 20 bp, Artificial
  CRISPR gRNA sequence
catataacttatctattcct

SEQ ID NO: 165610 - DNA, 20 bp, Artificial
  CRISPR gRNA sequence
atataacttatctattcctt

SEQ ID NO: 165611 - DNA, 20 bp, Artificial
  CRISPR gRNA sequence
atctattcctttactgtgga

SEQ ID NO: 165612 - DNA, 20 bp, Artificial
  CRISPR gRNA sequence
tctattcctttactgtggac

SEQ ID NO: 165613 - DNA, 20 bp, Artificial
  CRISPR gRNA sequence
ttcctttactgtggactgct

SEQ ID NO: 165614 - DNA, 20 bp, Artificial
  CRISPR gRNA sequence
ctttactgtggactgctgct

SEQ ID NO: 165615 - DNA, 20 bp, Artificial
  CRISPR gRNA sequence
tactgtggactgctgcttcc

SEQ ID NO: 165616 - DNA, 20 bp, Artificial
  CRISPR gRNA sequence
actgtggactgctgcttcct

SEQ ID NO: 165617 - DNA, 20 bp, Artificial
  CRISPR gRNA sequence
ctgtggactgctgcttcctg

SEQ ID NO: 165618 - DNA, 20 bp, Artificial
  CRISPR gRNA sequence
tggactgctgcttcctgtgt

SEQ ID NO: 165619 - DNA, 20 bp, Artificial
  CRISPR gRNA sequence
ctgcttcctgtgtgccttga

SEQ ID NO: 165620 - DNA, 20 bp, Artificial
  CRISPR gRNA sequence
cttcctgtgtgccttgaggg

SEQ ID NO: 165621 - DNA, 20 bp, Artificial
  CRISPR gRNA sequence
cctgtgtgccttgagggatt

SEQ ID NO: 165622 - DNA, 20 bp, Artificial
  CRISPR gRNA sequence
ctgtgtgccttgagggattt

SEQ ID NO: 165623 - DNA, 20 bp, Artificial
  CRISPR gRNA sequence
tgtgccttgagggatttcat

SEQ ID NO: 165624 - DNA, 20 bp, Artificial
  CRISPR gRNA sequence
gagggatttcatttcttaga

SEQ ID NO: 165625 - DNA, 20 bp, Artificial
  CRISPR gRNA sequence
agggatttcatttcttagat

SEQ ID NO: 165626 - DNA, 20 bp, Artificial
  CRISPR gRNA sequence
catttcttagatttgttggc

SEQ ID NO: 165627 - DNA, 20 bp, Artificial
  CRISPR gRNA sequence
atttcttagatttgttggct

SEQ ID NO: 165628 - DNA, 20 bp, Artificial
  CRISPR gRNA sequence
cttagatttgttggcttttt

SEQ ID NO: 165629 - DNA, 20 bp, Artificial
  CRISPR gRNA sequence
ttagatttgttggctttttt

SEQ ID NO: 165630 - DNA, 20 bp, Artificial
  CRISPR gRNA sequence
agatttgttggcttttttat

SEQ ID NO: 165631 - DNA, 20 bp, Artificial
  CRISPR gRNA sequence
gatttgttggcttttttatt

SEQ ID NO: 165632 - DNA, 20 bp, Artificial
  CRISPR gRNA sequence
gttggcttttttatttgtac

SEQ ID NO: 165633 - DNA, 20 bp, Artificial
  CRISPR gRNA sequence
ttggcttttttatttgtact

SEQ ID NO: 165634 - DNA, 20 bp, Artificial
  CRISPR gRNA sequence
gcttttttatttgtactcct

SEQ ID NO: 165635 - DNA, 20 bp, Artificial
  CRISPR gRNA sequence
ttttatttgtactccttttg

SEQ ID NO: 165636 - DNA, 20 bp, Artificial
  CRISPR gRNA sequence
tttatttgtactccttttgt

SEQ ID NO: 165637 - DNA, 20 bp, Artificial
  CRISPR gRNA sequence
ttatttgtactccttttgta

SEQ ID NO: 165638 - DNA, 20 bp, Artificial
  CRISPR gRNA sequence
tatttgtactccttttgtaa

SEQ ID NO: 165639 - DNA, 20 bp, Artificial
  CRISPR gRNA sequence
atttgtactccttttgtaaa

SEQ ID NO: 165640 - DNA, 20 bp, Artificial
  CRISPR gRNA sequence
tttgtactccttttgtaaaa

SEQ ID NO: 165641 - DNA, 20 bp, Artificial
  CRISPR gRNA sequence
gtactccttttgtaaaatgt

SEQ ID NO: 165642 - DNA, 20 bp, Artificial
  CRISPR gRNA sequence
tactccttttgtaaaatgtg

SEQ ID NO: 165643 - DNA, 20 bp, Artificial
  CRISPR gRNA sequence
cttttgtaaaatgtgtcctt

SEQ ID NO: 165644 - DNA, 20 bp, Artificial
  CRISPR gRNA sequence
ttgtaaaatgtgtccttgtc

SEQ ID NO: 165645 - DNA, 20 bp, Artificial
  CRISPR gRNA sequence
tgtaaaatgtgtccttgtct

SEQ ID NO: 165646 - DNA, 20 bp, Artificial
  CRISPR gRNA sequence
gtaaaatgtgtccttgtctt

SEQ ID NO: 165647 - DNA, 20 bp, Artificial
  CRISPR gRNA sequence
taaaatgtgtccttgtctta

SEQ ID NO: 165648 - DNA, 20 bp, Artificial
  CRISPR gRNA sequence
gtcttaacacttgcagtctt

SEQ ID NO: 165649 - DNA, 20 bp, Artificial
  CRISPR gRNA sequence
tcttaacacttgcagtcttt

SEQ ID NO: 165650 - DNA, 20 bp, Artificial
  CRISPR gRNA sequence
aacacttgcagtctttacat

SEQ ID NO: 165651 - DNA, 20 bp, Artificial
  CRISPR gRNA sequence
acacttgcagtctttacatt

SEQ ID NO: 165652 - DNA, 20 bp, Artificial
  CRISPR gRNA sequence
gcagtctttacattggtcat

SEQ ID NO: 165653 - DNA, 20 bp, Artificial
  CRISPR gRNA sequence
cagtctttacattggtcatt

SEQ ID NO: 165654 - DNA, 20 bp, Artificial
  CRISPR gRNA sequence
tacattggtcattttgaccc

SEQ ID NO: 165655 - DNA, 20 bp, Artificial
  CRISPR gRNA sequence
acattggtcattttgacccc

SEQ ID NO: 165656 - DNA, 20 bp, Artificial
  CRISPR gRNA sequence
cattggtcattttgaccccc

SEQ ID NO: 165657 - DNA, 20 bp, Artificial
  CRISPR gRNA sequence
gtcattttgaccccccaaaa

SEQ ID NO: 165658 - DNA, 20 bp, Artificial
  CRISPR gRNA sequence
tgaccccccaaaactggaaa

SEQ ID NO: 165659 - DNA, 20 bp, Artificial
  CRISPR gRNA sequence
gaccccccaaaactggaaag

SEQ ID NO: 165660 - DNA, 20 bp, Artificial
  CRISPR gRNA sequence
accccccaaaactggaaagt

SEQ ID NO: 165661 - DNA, 20 bp, Artificial
  CRISPR gRNA sequence
gaaagtgagtgaaacagagc

SEQ ID NO: 165662 - DNA, 20 bp, Artificial
  CRISPR gRNA sequence
ctattccctgccctttgcca

SEQ ID NO: 165663 - DNA, 20 bp, Artificial
  CRISPR gRNA sequence
tattccctgccctttgccat

SEQ ID NO: 165664 - DNA, 20 bp, Artificial
  CRISPR gRNA sequence
ttccctgccctttgccattt

SEQ ID NO: 165665 - DNA, 20 bp, Artificial
  CRISPR gRNA sequence
cctgccctttgccatttttg

SEQ ID NO: 165666 - DNA, 20 bp, Artificial
  CRISPR gRNA sequence
ccctttgccatttttgtcat

SEQ ID NO: 165667 - DNA, 20 bp, Artificial
  CRISPR gRNA sequence
tgccatttttgtcataaatg

SEQ ID NO: 165668 - DNA, 20 bp, Artificial
  CRISPR gRNA sequence
gccatttttgtcataaatga

SEQ ID NO: 165669 - DNA, 20 bp, Artificial
  CRISPR gRNA sequence
ccatttttgtcataaatgaa

SEQ ID NO: 165670 - DNA, 20 bp, Artificial
  CRISPR gRNA sequence
ttgtcataaatgaaacgtag

SEQ ID NO: 165671 - DNA, 20 bp, Artificial
  CRISPR gRNA sequence
tgtcataaatgaaacgtagg

SEQ ID NO: 165672 - DNA, 20 bp, Artificial
  CRISPR gRNA sequence
gtcataaatgaaacgtaggc

SEQ ID NO: 165673 - DNA, 20 bp, Artificial
  CRISPR gRNA sequence
tcataaatgaaacgtaggca

SEQ ID NO: 165674 - DNA, 20 bp, Artificial
  CRISPR gRNA sequence
acgtagacttggttaaccac

SEQ ID NO: 165675 - DNA, 20 bp, Artificial
  CRISPR gRNA sequence
ggttaaccacttcctctgtg

SEQ ID NO: 165676 - DNA, 20 bp, Artificial
  CRISPR gRNA sequence
gttaaccacttcctctgtga

SEQ ID NO: 165677 - DNA, 20 bp, Artificial
  CRISPR gRNA sequence
accacttcctctgtgaaaat

SEQ ID NO: 165678 - DNA, 20 bp, Artificial
  CRISPR gRNA sequence
cctctgtgaaaataactcta

SEQ ID NO: 165679 - DNA, 20 bp, Artificial
  CRISPR gRNA sequence
ctctgtgaaaataactctaa

SEQ ID NO: 165680 - DNA, 20 bp, Artificial
  CRISPR gRNA sequence
tgtgaaaataactctaaaag

SEQ ID NO: 165681 - DNA, 20 bp, Artificial
  CRISPR gRNA sequence
tgaaaataactctaaaagta

SEQ ID NO: 165682 - DNA, 20 bp, Artificial
  CRISPR gRNA sequence
taaaagtatcctgagatcag

SEQ ID NO: 165683 - DNA, 20 bp, Artificial
  CRISPR gRNA sequence
aaagtatcctgagatcagtt

SEQ ID NO: 165684 - DNA, 20 bp, Artificial
  CRISPR gRNA sequence
agatcagtttaggaattgtt

SEQ ID NO: 165685 - DNA, 20 bp, Artificial
  CRISPR gRNA sequence
aggaattgttcttcatctga

SEQ ID NO: 165686 - DNA, 20 bp, Artificial
  CRISPR gRNA sequence
ggaattgttcttcatctgaa

SEQ ID NO: 165687 - DNA, 20 bp, Artificial
  CRISPR gRNA sequence
ttcttcatctgaagttaaca

SEQ ID NO: 165688 - DNA, 20 bp, Artificial
  CRISPR gRNA sequence
ttcatctgaagttaacatag

SEQ ID NO: 165689 - DNA, 20 bp, Artificial
  CRISPR gRNA sequence
catctgaagttaacatagta

SEQ ID NO: 165690 - DNA, 20 bp, Artificial
  CRISPR gRNA sequence
atctgaagttaacatagtaa

SEQ ID NO: 165691 - DNA, 20 bp, Artificial
  CRISPR gRNA sequence
aagttaacatagtaataggc

SEQ ID NO: 165692 - DNA, 20 bp, Artificial
  CRISPR gRNA sequence
acatagtaataggccaagag

SEQ ID NO: 165693 - DNA, 20 bp, Artificial
  CRISPR gRNA sequence
aggaaagtggagtgtgtatg

SEQ ID NO: 165694 - DNA, 20 bp, Artificial
  CRISPR gRNA sequence
ggaaagtggagtgtgtatgt

SEQ ID NO: 165695 - DNA, 20 bp, Artificial
  CRISPR gRNA sequence
tttctctacctctctcacgt

SEQ ID NO: 165696 - DNA, 20 bp, Artificial
  CRISPR gRNA sequence
tctctacctctctcacgtgt

SEQ ID NO: 165697 - DNA, 20 bp, Artificial
  CRISPR gRNA sequence
ctctacctctctcacgtgtg

SEQ ID NO: 165698 - DNA, 20 bp, Artificial
  CRISPR gRNA sequence
tctacctctctcacgtgtgc

SEQ ID NO: 165699 - DNA, 20 bp, Artificial
  CRISPR gRNA sequence
tacctctctcacgtgtgctt

SEQ ID NO: 165700 - DNA, 20 bp, Artificial
  CRISPR gRNA sequence
cctctctcacgtgtgcttac

SEQ ID NO: 165701 - DNA, 20 bp, Artificial
  CRISPR gRNA sequence
tctcacgtgtgcttacgata

SEQ ID NO: 165702 - DNA, 20 bp, Artificial
  CRISPR gRNA sequence
tcacgtgtgcttacgatacc

SEQ ID NO: 165703 - DNA, 20 bp, Artificial
  CRISPR gRNA sequence
acgtgtgcttacgataccca

SEQ ID NO: 165704 - DNA, 20 bp, Artificial
  CRISPR gRNA sequence
acgatacccaggattgcaga

SEQ ID NO: 165705 - DNA, 20 bp, Artificial
  CRISPR gRNA sequence
cgatacccaggattgcagat

SEQ ID NO: 165706 - DNA, 20 bp, Artificial
  CRISPR gRNA sequence
cagatgactgagctctgcct

SEQ ID NO: 165707 - DNA, 20 bp, Artificial
  CRISPR gRNA sequence
agctctgccttgcttcattg

SEQ ID NO: 165708 - DNA, 20 bp, Artificial
  CRISPR gRNA sequence
tgccttgcttcattgtttca

SEQ ID NO: 165709 - DNA, 20 bp, Artificial
  CRISPR gRNA sequence
ccttgcttcattgtttcagt

SEQ ID NO: 165710 - DNA, 20 bp, Artificial
  CRISPR gRNA sequence
gcttcattgtttcagtcctc

SEQ ID NO: 165711 - DNA, 20 bp, Artificial
  CRISPR gRNA sequence
cttcattgtttcagtcctca

SEQ ID NO: 165712 - DNA, 20 bp, Artificial
  CRISPR gRNA sequence
cattgtttcagtcctcaacc

SEQ ID NO: 165713 - DNA, 20 bp, Artificial
  CRISPR gRNA sequence
attgtttcagtcctcaaccc

SEQ ID NO: 165714 - DNA, 20 bp, Artificial
  CRISPR gRNA sequence
tttcagtcctcaaccccaag

SEQ ID NO: 165715 - DNA, 20 bp, Artificial
  CRISPR gRNA sequence
cagtcctcaaccccaagatt

SEQ ID NO: 165716 - DNA, 20 bp, Artificial
  CRISPR gRNA sequence
agtcctcaaccccaagattt

SEQ ID NO: 165717 - DNA, 20 bp, Artificial
  CRISPR gRNA sequence
aaccccaagatttctgttga

SEQ ID NO: 165718 - DNA, 20 bp, Artificial
  CRISPR gRNA sequence
ctgttgaatggttctcattt

SEQ ID NO: 165719 - DNA, 20 bp, Artificial
  CRISPR gRNA sequence
tgttgaatggttctcatttt

SEQ ID NO: 165720 - DNA, 20 bp, Artificial
  CRISPR gRNA sequence
ttgaatggttctcatttttg

SEQ ID NO: 165721 - DNA, 20 bp, Artificial
  CRISPR gRNA sequence
aatggttctcatttttgcaa

SEQ ID NO: 165722 - DNA, 20 bp, Artificial
  CRISPR gRNA sequence
tcatttttgcaagcgaaggc

SEQ ID NO: 165723 - DNA, 20 bp, Artificial
  CRISPR gRNA sequence
atttttgcaagcgaaggcac

SEQ ID NO: 165724 - DNA, 20 bp, Artificial
  CRISPR gRNA sequence
ttgcaagcgaaggcaccacc

SEQ ID NO: 165725 - DNA, 20 bp, Artificial
  CRISPR gRNA sequence
tgcaagcgaaggcaccacca

SEQ ID NO: 165726 - DNA, 20 bp, Artificial
  CRISPR gRNA sequence
gcaagcgaaggcaccaccac

SEQ ID NO: 165727 - DNA, 20 bp, Artificial
  CRISPR gRNA sequence
caagcgaaggcaccaccaca

SEQ ID NO: 165728 - DNA, 20 bp, Artificial
  CRISPR gRNA sequence
atttaagacagagaagagtt

SEQ ID NO: 165729 - DNA, 20 bp, Artificial
  CRISPR gRNA sequence
aagacagagaagagttccac

SEQ ID NO: 165730 - DNA, 20 bp, Artificial
  CRISPR gRNA sequence
agacagagaagagttccacc

SEQ ID NO: 165731 - DNA, 20 bp, Artificial
  CRISPR gRNA sequence
caccttgcagatactttaac

SEQ ID NO: 165732 - DNA, 20 bp, Artificial
  CRISPR gRNA sequence
gcagatactttaactctctg

SEQ ID NO: 165733 - DNA, 20 bp, Artificial
  CRISPR gRNA sequence
cagatactttaactctctgg

SEQ ID NO: 165734 - DNA, 20 bp, Artificial
  CRISPR gRNA sequence
taactctctggggcacagag

SEQ ID NO: 165735 - DNA, 20 bp, Artificial
  CRISPR gRNA sequence
aactctctggggcacagagc

SEQ ID NO: 165736 - DNA, 20 bp, Artificial
  CRISPR gRNA sequence
actctctggggcacagagct

SEQ ID NO: 165737 - DNA, 20 bp, Artificial
  CRISPR gRNA sequence
tctggggcacagagctttag

SEQ ID NO: 165738 - DNA, 20 bp, Artificial
  CRISPR gRNA sequence
tggggcacagagctttagcc

SEQ ID NO: 165739 - DNA, 20 bp, Artificial
  CRISPR gRNA sequence
gggcacagagctttagccca

SEQ ID NO: 165740 - DNA, 20 bp, Artificial
  CRISPR gRNA sequence
tagcccagaagatttgttgc

SEQ ID NO: 165741 - DNA, 20 bp, Artificial
  CRISPR gRNA sequence
agcccagaagatttgttgca

SEQ ID NO: 165742 - DNA, 20 bp, Artificial
  CRISPR gRNA sequence
gcccagaagatttgttgcag

SEQ ID NO: 165743 - DNA, 20 bp, Artificial
  CRISPR gRNA sequence
gttgcagaattcactacttc

SEQ ID NO: 165744 - DNA, 20 bp, Artificial
  CRISPR gRNA sequence
ttgcagaattcactacttca

SEQ ID NO: 165745 - DNA, 20 bp, Artificial
  CRISPR gRNA sequence
cagaattcactacttcatct

SEQ ID NO: 165746 - DNA, 20 bp, Artificial
  CRISPR gRNA sequence
actacttcatcttcactggc

SEQ ID NO: 165747 - DNA, 20 bp, Artificial
  CRISPR gRNA sequence
cttcatcttcactggctcag

SEQ ID NO: 165748 - DNA, 20 bp, Artificial
  CRISPR gRNA sequence
catcttcactggctcaggca

SEQ ID NO: 165749 - DNA, 20 bp, Artificial
  CRISPR gRNA sequence
atcttcactggctcaggcac

SEQ ID NO: 165750 - DNA, 20 bp, Artificial
  CRISPR gRNA sequence
cactggctcaggcaccttct

SEQ ID NO: 165751 - DNA, 20 bp, Artificial
  CRISPR gRNA sequence
actggctcaggcaccttctg

SEQ ID NO: 165752 - DNA, 20 bp, Artificial
  CRISPR gRNA sequence
gctcaggcaccttctgtagg

SEQ ID NO: 165753 - DNA, 20 bp, Artificial
  CRISPR gRNA sequence
aggcaccttctgtaggagtc

SEQ ID NO: 165754 - DNA, 20 bp, Artificial
  CRISPR gRNA sequence
ctgtaggagtcttcatttcc

SEQ ID NO: 165755 - DNA, 20 bp, Artificial
  CRISPR gRNA sequence
tgtaggagtcttcatttcca

SEQ ID NO: 165756 - DNA, 20 bp, Artificial
  CRISPR gRNA sequence
taggagtcttcatttccaga

SEQ ID NO: 165757 - DNA, 20 bp, Artificial
  CRISPR gRNA sequence
catttccagactctttaggc

SEQ ID NO: 165758 - DNA, 20 bp, Artificial
  CRISPR gRNA sequence
atttccagactctttaggca

SEQ ID NO: 165759 - DNA, 20 bp, Artificial
  CRISPR gRNA sequence
ccagactctttaggcagctc

SEQ ID NO: 165760 - DNA, 20 bp, Artificial
  CRISPR gRNA sequence
cagactctttaggcagctca

SEQ ID NO: 165761 - DNA, 20 bp, Artificial
  CRISPR gRNA sequence
tttaggcagctcattggaat

SEQ ID NO: 165762 - DNA, 20 bp, Artificial
  CRISPR gRNA sequence
taggcagctcattggaatgt

SEQ ID NO: 165763 - DNA, 20 bp, Artificial
  CRISPR gRNA sequence
aggcagctcattggaatgtt

SEQ ID NO: 165764 - DNA, 20 bp, Artificial
  CRISPR gRNA sequence
ggcagctcattggaatgttc

SEQ ID NO: 165765 - DNA, 20 bp, Artificial
  CRISPR gRNA sequence
attggaatgttcctaatagt

SEQ ID NO: 165766 - DNA, 20 bp, Artificial
  CRISPR gRNA sequence
gaatgttcctaatagtgatg

SEQ ID NO: 165767 - DNA, 20 bp, Artificial
  CRISPR gRNA sequence
ctaatagtgatgagcttcag

SEQ ID NO: 165768 - DNA, 20 bp, Artificial
  CRISPR gRNA sequence
atagtgatgagcttcaggaa

SEQ ID NO: 165769 - DNA, 20 bp, Artificial
  CRISPR gRNA sequence
caggaaggaaactttatttc

SEQ ID NO: 165770 - DNA, 20 bp, Artificial
  CRISPR gRNA sequence
aggaaggaaactttatttcc

SEQ ID NO: 165771 - DNA, 20 bp, Artificial
  CRISPR gRNA sequence
tatttccctttcaaaaaccc

SEQ ID NO: 165772 - DNA, 20 bp, Artificial
  CRISPR gRNA sequence
atttccctttcaaaaaccca

SEQ ID NO: 165773 - DNA, 20 bp, Artificial
  CRISPR gRNA sequence
tttccctttcaaaaacccag

SEQ ID NO: 165774 - DNA, 20 bp, Artificial
  CRISPR gRNA sequence
ccctttcaaaaacccagagc

SEQ ID NO: 165775 - DNA, 20 bp, Artificial
  CRISPR gRNA sequence
cctttcaaaaacccagagct

SEQ ID NO: 165776 - DNA, 20 bp, Artificial
  CRISPR gRNA sequence
tcaaaaacccagagcttatt

SEQ ID NO: 165777 - DNA, 20 bp, Artificial
  CRISPR gRNA sequence
caaaaacccagagcttattt

SEQ ID NO: 165778 - DNA, 20 bp, Artificial
  CRISPR gRNA sequence
aaaaacccagagcttatttt

SEQ ID NO: 165779 - DNA, 20 bp, Artificial
  CRISPR gRNA sequence
attttctctgtaattaatgt

SEQ ID NO: 165780 - DNA, 20 bp, Artificial
  CRISPR gRNA sequence
ttttctctgtaattaatgta

SEQ ID NO: 165781 - DNA, 20 bp, Artificial
  CRISPR gRNA sequence
tctctgtaattaatgtaaaa

SEQ ID NO: 165782 - DNA, 20 bp, Artificial
  CRISPR gRNA sequence
ctctgtaattaatgtaaaaa

SEQ ID NO: 165783 - DNA, 20 bp, Artificial
  CRISPR gRNA sequence
tctgtaattaatgtaaaaaa

SEQ ID NO: 165784 - DNA, 20 bp, Artificial
  CRISPR gRNA sequence
tgtaattaatgtaaaaaagc

SEQ ID NO: 165785 - DNA, 20 bp, Artificial
  CRISPR gRNA sequence
taattaatgtaaaaaagcta

SEQ ID NO: 165786 - DNA, 20 bp, Artificial
  CRISPR gRNA sequence
atgtaaaaaagctatgaggg

SEQ ID NO: 165787 - DNA, 20 bp, Artificial
  CRISPR gRNA sequence
tgagggtccccagacctgtc

SEQ ID NO: 165788 - DNA, 20 bp, Artificial
  CRISPR gRNA sequence
tcctgctgtagaggaatgag

SEQ ID NO: 165789 - DNA, 20 bp, Artificial
  CRISPR gRNA sequence
ctgtagaggaatgagggacg

SEQ ID NO: 165790 - DNA, 20 bp, Artificial
  CRISPR gRNA sequence
tagaggaatgagggacggat

SEQ ID NO: 165791 - DNA, 20 bp, Artificial
  CRISPR gRNA sequence
aacctaggccaaaaaggaaa

SEQ ID NO: 165792 - DNA, 20 bp, Artificial
  CRISPR gRNA sequence
acctaggccaaaaaggaaag

SEQ ID NO: 165793 - DNA, 20 bp, Artificial
  CRISPR gRNA sequence
ggccaaaaaggaaagcttct

SEQ ID NO: 165794 - DNA, 20 bp, Artificial
  CRISPR gRNA sequence
cttgctttgttgaagagctg

SEQ ID NO: 165795 - DNA, 20 bp, Artificial
  CRISPR gRNA sequence
ttgctttgttgaagagctgc

SEQ ID NO: 165796 - DNA, 20 bp, Artificial
  CRISPR gRNA sequence
gctttgttgaagagctgctt

SEQ ID NO: 165797 - DNA, 20 bp, Artificial
  CRISPR gRNA sequence
ctttgttgaagagctgcttg

SEQ ID NO: 165798 - DNA, 20 bp, Artificial
  CRISPR gRNA sequence
tgttgaagagctgcttggaa

SEQ ID NO: 165799 - DNA, 20 bp, Artificial
  CRISPR gRNA sequence
gttgaagagctgcttggaac

SEQ ID NO: 165800 - DNA, 20 bp, Artificial
  CRISPR gRNA sequence
ttgaagagctgcttggaacc

SEQ ID NO: 165801 - DNA, 20 bp, Artificial
  CRISPR gRNA sequence
aagagctgcttggaaccatt

SEQ ID NO: 165802 - DNA, 20 bp, Artificial
  CRISPR gRNA sequence
cttggaaccatttggctcac

SEQ ID NO: 165803 - DNA, 20 bp, Artificial
  CRISPR gRNA sequence
ggaaccatttggctcacagc

SEQ ID NO: 165804 - DNA, 20 bp, Artificial
  CRISPR gRNA sequence
gaaccatttggctcacagct

SEQ ID NO: 165805 - DNA, 20 bp, Artificial
  CRISPR gRNA sequence
ggctcacagcttttcagtca

SEQ ID NO: 165806 - DNA, 20 bp, Artificial
  CRISPR gRNA sequence
gctcacagcttttcagtcac

SEQ ID NO: 165807 - DNA, 20 bp, Artificial
  CRISPR gRNA sequence
acagcttttcagtcacattt

SEQ ID NO: 165808 - DNA, 20 bp, Artificial
  CRISPR gRNA sequence
ttcagtcacatttgggtttc

SEQ ID NO: 165809 - DNA, 20 bp, Artificial
  CRISPR gRNA sequence
tcagtcacatttgggtttct

SEQ ID NO: 165810 - DNA, 20 bp, Artificial
  CRISPR gRNA sequence
cagtcacatttgggtttctg

SEQ ID NO: 165811 - DNA, 20 bp, Artificial
  CRISPR gRNA sequence
agtcacatttgggtttctgc

SEQ ID NO: 165812 - DNA, 20 bp, Artificial
  CRISPR gRNA sequence
gggtttctgcaaagagctct

SEQ ID NO: 165813 - DNA, 20 bp, Artificial
  CRISPR gRNA sequence
ggtttctgcaaagagctctt

SEQ ID NO: 165814 - DNA, 20 bp, Artificial
  CRISPR gRNA sequence
ctgcaaagagctcttcccag

SEQ ID NO: 165815 - DNA, 20 bp, Artificial
  CRISPR gRNA sequence
tgcaaagagctcttcccagc

SEQ ID NO: 165816 - DNA, 20 bp, Artificial
  CRISPR gRNA sequence
caaagagctcttcccagcta

SEQ ID NO: 165817 - DNA, 20 bp, Artificial
  CRISPR gRNA sequence
ttcccagctagaaaatttta

SEQ ID NO: 165818 - DNA, 20 bp, Artificial
  CRISPR gRNA sequence
cccagctagaaaattttaac

SEQ ID NO: 165819 - DNA, 20 bp, Artificial
  CRISPR gRNA sequence
ccagctagaaaattttaaca

SEQ ID NO: 165820 - DNA, 20 bp, Artificial
  CRISPR gRNA sequence
gaaaattttaacatccctgt

SEQ ID NO: 165821 - DNA, 20 bp, Artificial
  CRISPR gRNA sequence
taacatccctgtagctgtca

SEQ ID NO: 165822 - DNA, 20 bp, Artificial
  CRISPR gRNA sequence
aacatccctgtagctgtcag

SEQ ID NO: 165823 - DNA, 20 bp, Artificial
  CRISPR gRNA sequence
acatccctgtagctgtcagt

SEQ ID NO: 165824 - DNA, 20 bp, Artificial
  CRISPR gRNA sequence
tagctgtcagtataccttct

SEQ ID NO: 165825 - DNA, 20 bp, Artificial
  CRISPR gRNA sequence
tcagtataccttctcccact

SEQ ID NO: 165826 - DNA, 20 bp, Artificial
  CRISPR gRNA sequence
ctcccactcctgggacaagg

SEQ ID NO: 165827 - DNA, 20 bp, Artificial
  CRISPR gRNA sequence
tcccactcctgggacaaggc

SEQ ID NO: 165828 - DNA, 20 bp, Artificial
  CRISPR gRNA sequence
ccactcctgggacaaggctt

SEQ ID NO: 165829 - DNA, 20 bp, Artificial
  CRISPR gRNA sequence
ctgggacaaggctttagttt

SEQ ID NO: 165830 - DNA, 20 bp, Artificial
  CRISPR gRNA sequence
ggacaaggctttagtttttc

SEQ ID NO: 165831 - DNA, 20 bp, Artificial
  CRISPR gRNA sequence
tagtttttcatcttgtgatc

SEQ ID NO: 165832 - DNA, 20 bp, Artificial
  CRISPR gRNA sequence
agtttttcatcttgtgatcc

SEQ ID NO: 165833 - DNA, 20 bp, Artificial
  CRISPR gRNA sequence
gtttttcatcttgtgatccc

SEQ ID NO: 165834 - DNA, 20 bp, Artificial
  CRISPR gRNA sequence
ttcatcttgtgatccctggc

SEQ ID NO: 165835 - DNA, 20 bp, Artificial
  CRISPR gRNA sequence
tcatcttgtgatccctggct

SEQ ID NO: 165836 - DNA, 20 bp, Artificial
  CRISPR gRNA sequence
catcttgtgatccctggctg

SEQ ID NO: 165837 - DNA, 20 bp, Artificial
  CRISPR gRNA sequence
atcttgtgatccctggctgg

SEQ ID NO: 165838 - DNA, 20 bp, Artificial
  CRISPR gRNA sequence
gtgatccctggctggagttc

SEQ ID NO: 165839 - DNA, 20 bp, Artificial
  CRISPR gRNA sequence
tgatccctggctggagttct

SEQ ID NO: 165840 - DNA, 20 bp, Artificial
  CRISPR gRNA sequence
gctggagttctggggactcc

SEQ ID NO: 165841 - DNA, 20 bp, Artificial
  CRISPR gRNA sequence
gagttctggggactcctgga

SEQ ID NO: 165842 - DNA, 20 bp, Artificial
  CRISPR gRNA sequence
tggggactcctggaactagc

SEQ ID NO: 165843 - DNA, 20 bp, Artificial
  CRISPR gRNA sequence
gggactcctggaactagcca

SEQ ID NO: 165844 - DNA, 20 bp, Artificial
  CRISPR gRNA sequence
ctggaactagccaccatcag

SEQ ID NO: 165845 - DNA, 20 bp, Artificial
  CRISPR gRNA sequence
gaactagccaccatcagtct

SEQ ID NO: 165846 - DNA, 20 bp, Artificial
  CRISPR gRNA sequence
gccaccatcagtctctgtag

SEQ ID NO: 165847 - DNA, 20 bp, Artificial
  CRISPR gRNA sequence
tgtagatgaggttttccaaa

SEQ ID NO: 165848 - DNA, 20 bp, Artificial
  CRISPR gRNA sequence
tagatgaggttttccaaact

SEQ ID NO: 165849 - DNA, 20 bp, Artificial
  CRISPR gRNA sequence
tccaaacttctgcccagctg

SEQ ID NO: 165850 - DNA, 20 bp, Artificial
  CRISPR gRNA sequence
ccaaacttctgcccagctgc

SEQ ID NO: 165851 - DNA, 20 bp, Artificial
  CRISPR gRNA sequence
caaacttctgcccagctgcc

SEQ ID NO: 165852 - DNA, 20 bp, Artificial
  CRISPR gRNA sequence
ctgcccagctgccttcctcc

SEQ ID NO: 165853 - DNA, 20 bp, Artificial
  CRISPR gRNA sequence
tgcccagctgccttcctccc

SEQ ID NO: 165854 - DNA, 20 bp, Artificial
  CRISPR gRNA sequence
cccagctgccttcctcccca

SEQ ID NO: 165855 - DNA, 20 bp, Artificial
  CRISPR gRNA sequence
ccttcctccccacaagcaac

SEQ ID NO: 165856 - DNA, 20 bp, Artificial
  CRISPR gRNA sequence
cctccccacaagcaacttaa

SEQ ID NO: 165857 - DNA, 20 bp, Artificial
  CRISPR gRNA sequence
ctccccacaagcaacttaac

SEQ ID NO: 165858 - DNA, 20 bp, Artificial
  CRISPR gRNA sequence
cccacaagcaacttaacatt

SEQ ID NO: 165859 - DNA, 20 bp, Artificial
  CRISPR gRNA sequence
aacattgttgccaggaagct

SEQ ID NO: 165860 - DNA, 20 bp, Artificial
  CRISPR gRNA sequence
acattgttgccaggaagctg

SEQ ID NO: 165861 - DNA, 20 bp, Artificial
  CRISPR gRNA sequence
ttgccaggaagctgcattat

SEQ ID NO: 165862 - DNA, 20 bp, Artificial
  CRISPR gRNA sequence
ccaggaagctgcattatagg

SEQ ID NO: 165863 - DNA, 20 bp, Artificial
  CRISPR gRNA sequence
cattataggatttaggtggg

SEQ ID NO: 165864 - DNA, 20 bp, Artificial
  CRISPR gRNA sequence
taggatttaggtggggaatt

SEQ ID NO: 165865 - DNA, 20 bp, Artificial
  CRISPR gRNA sequence
aggtggggaattcaggcttg

SEQ ID NO: 165866 - DNA, 20 bp, Artificial
  CRISPR gRNA sequence
ggtggggaattcaggcttgg

SEQ ID NO: 165867 - DNA, 20 bp, Artificial
  CRISPR gRNA sequence
aggcttggcaccacagcctc

SEQ ID NO: 165868 - DNA, 20 bp, Artificial
  CRISPR gRNA sequence
ggcaccacagcctcccagca

SEQ ID NO: 165869 - DNA, 20 bp, Artificial
  CRISPR gRNA sequence
gcaccacagcctcccagcag

SEQ ID NO: 165870 - DNA, 20 bp, Artificial
  CRISPR gRNA sequence
ccagcagcttctcttggcat

SEQ ID NO: 165871 - DNA, 20 bp, Artificial
  CRISPR gRNA sequence
ctcttggcatattctcagga

SEQ ID NO: 165872 - DNA, 20 bp, Artificial
  CRISPR gRNA sequence
tcttggcatattctcaggaa

SEQ ID NO: 165873 - DNA, 20 bp, Artificial
  CRISPR gRNA sequence
ttggcatattctcaggaaag

SEQ ID NO: 165874 - DNA, 20 bp, Artificial
  CRISPR gRNA sequence
ggcatattctcaggaaagaa

SEQ ID NO: 165875 - DNA, 20 bp, Artificial
  CRISPR gRNA sequence
gcatattctcaggaaagaaa

SEQ ID NO: 165876 - DNA, 20 bp, Artificial
  CRISPR gRNA sequence
tcaggaaagaaatgactgca

SEQ ID NO: 165877 - DNA, 20 bp, Artificial
  CRISPR gRNA sequence
aggaaagaaatgactgcagg

SEQ ID NO: 165878 - DNA, 20 bp, Artificial
  CRISPR gRNA sequence
caggtcctaatactcttgcc

SEQ ID NO: 165879 - DNA, 20 bp, Artificial
  CRISPR gRNA sequence
atactcttgccctgtctcct

SEQ ID NO: 165880 - DNA, 20 bp, Artificial
  CRISPR gRNA sequence
ttgccctgtctcctttgaac

SEQ ID NO: 165881 - DNA, 20 bp, Artificial
  CRISPR gRNA sequence
gccctgtctcctttgaacca

SEQ ID NO: 165882 - DNA, 20 bp, Artificial
  CRISPR gRNA sequence
ccctgtctcctttgaaccag

SEQ ID NO: 165883 - DNA, 20 bp, Artificial
  CRISPR gRNA sequence
tctcctttgaaccagatttt

SEQ ID NO: 165884 - DNA, 20 bp, Artificial
  CRISPR gRNA sequence
ctttgaaccagatttttaat

SEQ ID NO: 165885 - DNA, 20 bp, Artificial
  CRISPR gRNA sequence
tgaaccagatttttaatggg

SEQ ID NO: 165886 - DNA, 20 bp, Artificial
  CRISPR gRNA sequence
gaaccagatttttaatgggt

SEQ ID NO: 165887 - DNA, 20 bp, Artificial
  CRISPR gRNA sequence
aaccagatttttaatgggtt

SEQ ID NO: 165888 - DNA, 20 bp, Artificial
  CRISPR gRNA sequence
ttaatgggtttagattgggt

SEQ ID NO: 165889 - DNA, 20 bp, Artificial
  CRISPR gRNA sequence
taatgggtttagattgggtg

SEQ ID NO: 165890 - DNA, 20 bp, Artificial
  CRISPR gRNA sequence
aatgggtttagattgggtgt

SEQ ID NO: 165891 - DNA, 20 bp, Artificial
  CRISPR gRNA sequence
atgggtttagattgggtgtc

SEQ ID NO: 165892 - DNA, 20 bp, Artificial
  CRISPR gRNA sequence
agattgggtgtccctccatc

SEQ ID NO: 165893 - DNA, 20 bp, Artificial
  CRISPR gRNA sequence
gattgggtgtccctccatct

SEQ ID NO: 165894 - DNA, 20 bp, Artificial
  CRISPR gRNA sequence
ggtgtccctccatcttgcct

SEQ ID NO: 165895 - DNA, 20 bp, Artificial
  CRISPR gRNA sequence
catcttgcctcaagtgggca

SEQ ID NO: 165896 - DNA, 20 bp, Artificial
  CRISPR gRNA sequence
gcctcaagtgggcaattctg

SEQ ID NO: 165897 - DNA, 20 bp, Artificial
  CRISPR gRNA sequence
cctcaagtgggcaattctgg

SEQ ID NO: 165898 - DNA, 20 bp, Artificial
  CRISPR gRNA sequence
aagtgggcaattctggaatg

SEQ ID NO: 165899 - DNA, 20 bp, Artificial
  CRISPR gRNA sequence
tggaatggtctaccgtgaac

SEQ ID NO: 165900 - DNA, 20 bp, Artificial
  CRISPR gRNA sequence
gaatggtctaccgtgaactt

SEQ ID NO: 165901 - DNA, 20 bp, Artificial
  CRISPR gRNA sequence
ccgtgaacttgagaggtcgt

SEQ ID NO: 165902 - DNA, 20 bp, Artificial
  CRISPR gRNA sequence
gagaggtcgttttttctcgg

SEQ ID NO: 165903 - DNA, 20 bp, Artificial
  CRISPR gRNA sequence
agaggtcgttttttctcggt

SEQ ID NO: 165904 - DNA, 20 bp, Artificial
  CRISPR gRNA sequence
tttctcggtagttcaaattc

SEQ ID NO: 165905 - DNA, 20 bp, Artificial
  CRISPR gRNA sequence
ttctcggtagttcaaattct

SEQ ID NO: 165906 - DNA, 20 bp, Artificial
  CRISPR gRNA sequence
tctcggtagttcaaattctg

SEQ ID NO: 165907 - DNA, 20 bp, Artificial
  CRISPR gRNA sequence
ctcggtagttcaaattctgt

SEQ ID NO: 165908 - DNA, 20 bp, Artificial
  CRISPR gRNA sequence
tcggtagttcaaattctgtg

SEQ ID NO: 165909 - DNA, 20 bp, Artificial
  CRISPR gRNA sequence
ggtagttcaaattctgtgag

SEQ ID NO: 165910 - DNA, 20 bp, Artificial
  CRISPR gRNA sequence
aaattctgtgaggctggaag

SEQ ID NO: 165911 - DNA, 20 bp, Artificial
  CRISPR gRNA sequence
tgtgaggctggaagtctcag

SEQ ID NO: 165912 - DNA, 20 bp, Artificial
  CRISPR gRNA sequence
tgaggctggaagtctcagag

SEQ ID NO: 165913 - DNA, 20 bp, Artificial
  CRISPR gRNA sequence
gaagtctcagagaagcattt

SEQ ID NO: 165914 - DNA, 20 bp, Artificial
  CRISPR gRNA sequence
agagaagcattttgattgaa

SEQ ID NO: 165915 - DNA, 20 bp, Artificial
  CRISPR gRNA sequence
tgattgaacactgcgtgcag

SEQ ID NO: 165916 - DNA, 20 bp, Artificial
  CRISPR gRNA sequence
gattgaacactgcgtgcagg

SEQ ID NO: 165917 - DNA, 20 bp, Artificial
  CRISPR gRNA sequence
attgaacactgcgtgcagga

SEQ ID NO: 165918 - DNA, 20 bp, Artificial
  CRISPR gRNA sequence
aacactgcgtgcaggaatgc

SEQ ID NO: 165919 - DNA, 20 bp, Artificial
  CRISPR gRNA sequence
cgtgcaggaatgcagcttca

SEQ ID NO: 165920 - DNA, 20 bp, Artificial
  CRISPR gRNA sequence
catcccattagcattttcct

SEQ ID NO: 165921 - DNA, 20 bp, Artificial
  CRISPR gRNA sequence
atcccattagcattttcctc

SEQ ID NO: 165922 - DNA, 20 bp, Artificial
  CRISPR gRNA sequence
gcattttcctcatggaagag

SEQ ID NO: 165923 - DNA, 20 bp, Artificial
  CRISPR gRNA sequence
tcctcatggaagagtcctgc

SEQ ID NO: 165924 - DNA, 20 bp, Artificial
  CRISPR gRNA sequence
cctcatggaagagtcctgca

SEQ ID NO: 165925 - DNA, 20 bp, Artificial
  CRISPR gRNA sequence
ctcatggaagagtcctgcag

SEQ ID NO: 165926 - DNA, 20 bp, Artificial
  CRISPR gRNA sequence
atggaagagtcctgcagtga

SEQ ID NO: 165927 - DNA, 20 bp, Artificial
  CRISPR gRNA sequence
cagtgaagttagctcttgaa

SEQ ID NO: 165928 - DNA, 20 bp, Artificial
  CRISPR gRNA sequence
gctcttgaaggccagaggga

SEQ ID NO: 165929 - DNA, 20 bp, Artificial
  CRISPR gRNA sequence
ttgaaggccagagggaaatt

SEQ ID NO: 165930 - DNA, 20 bp, Artificial
  CRISPR gRNA sequence
gaaggccagagggaaatttg

SEQ ID NO: 165931 - DNA, 20 bp, Artificial
  CRISPR gRNA sequence
aaggccagagggaaatttgc

SEQ ID NO: 165932 - DNA, 20 bp, Artificial
  CRISPR gRNA sequence
gctccagagcagaggcaata

SEQ ID NO: 165933 - DNA, 20 bp, Artificial
  CRISPR gRNA sequence
ctccagagcagaggcaatac

SEQ ID NO: 165934 - DNA, 20 bp, Artificial
  CRISPR gRNA sequence
cagagcagaggcaatacttg

SEQ ID NO: 165935 - DNA, 20 bp, Artificial
  CRISPR gRNA sequence
gcctgttagccacaagaagc

SEQ ID NO: 165936 - DNA, 20 bp, Artificial
  CRISPR gRNA sequence
cctgttagccacaagaagct

SEQ ID NO: 165937 - DNA, 20 bp, Artificial
  CRISPR gRNA sequence
ttagccacaagaagcttccc

SEQ ID NO: 165938 - DNA, 20 bp, Artificial
  CRISPR gRNA sequence
gccacaagaagcttcccctt

SEQ ID NO: 165939 - DNA, 20 bp, Artificial
  CRISPR gRNA sequence
ccccttgcaacaaaggcagg

SEQ ID NO: 165940 - DNA, 20 bp, Artificial
  CRISPR gRNA sequence
cccttgcaacaaaggcaggc

SEQ ID NO: 165941 - DNA, 20 bp, Artificial
  CRISPR gRNA sequence
gcaacaaaggcaggctgggc

SEQ ID NO: 165942 - DNA, 20 bp, Artificial
  CRISPR gRNA sequence
caacaaaggcaggctgggca

SEQ ID NO: 165943 - DNA, 20 bp, Artificial
  CRISPR gRNA sequence
ggcagccagggcaggtggtt

SEQ ID NO: 165944 - DNA, 20 bp, Artificial
  CRISPR gRNA sequence
ctggaccccgcagatagaga

SEQ ID NO: 165945 - DNA, 20 bp, Artificial
  CRISPR gRNA sequence
tggaccccgcagatagagac

SEQ ID NO: 165946 - DNA, 20 bp, Artificial
  CRISPR gRNA sequence
gaccccgcagatagagacct

SEQ ID NO: 165947 - DNA, 20 bp, Artificial
  CRISPR gRNA sequence
gtctatccatgctcccagaa

SEQ ID NO: 165948 - DNA, 20 bp, Artificial
  CRISPR gRNA sequence
tccatgctcccagaacccct

SEQ ID NO: 165949 - DNA, 20 bp, Artificial
  CRISPR gRNA sequence
ccagaacccctttcatttcc

SEQ ID NO: 165950 - DNA, 20 bp, Artificial
  CRISPR gRNA sequence
tcatttcctctaaattgagg

SEQ ID NO: 165951 - DNA, 20 bp, Artificial
  CRISPR gRNA sequence
catttcctctaaattgaggg

SEQ ID NO: 165952 - DNA, 20 bp, Artificial
  CRISPR gRNA sequence
atttcctctaaattgagggt

SEQ ID NO: 165953 - DNA, 20 bp, Artificial
  CRISPR gRNA sequence
cctctaaattgagggtgtga

SEQ ID NO: 165954 - DNA, 20 bp, Artificial
  CRISPR gRNA sequence
ctctaaattgagggtgtgaa

SEQ ID NO: 165955 - DNA, 20 bp, Artificial
  CRISPR gRNA sequence
taaattgagggtgtgaatgt

SEQ ID NO: 165956 - DNA, 20 bp, Artificial
  CRISPR gRNA sequence
aattgagggtgtgaatgtct

SEQ ID NO: 165957 - DNA, 20 bp, Artificial
  CRISPR gRNA sequence
agggtgtgaatgtctgcagt

SEQ ID NO: 165958 - DNA, 20 bp, Artificial
  CRISPR gRNA sequence
cagtcctcctctgctgacca

SEQ ID NO: 165959 - DNA, 20 bp, Artificial
  CRISPR gRNA sequence
ctctgctgaccatcatcttt

SEQ ID NO: 165960 - DNA, 20 bp, Artificial
  CRISPR gRNA sequence
tgctgaccatcatctttgct

SEQ ID NO: 165961 - DNA, 20 bp, Artificial
  CRISPR gRNA sequence
ctgaccatcatctttgctga

SEQ ID NO: 165962 - DNA, 20 bp, Artificial
  CRISPR gRNA sequence
accatcatctttgctgagct

SEQ ID NO: 165963 - DNA, 20 bp, Artificial
  CRISPR gRNA sequence
tgctgagctacagttctctg

SEQ ID NO: 165964 - DNA, 20 bp, Artificial
  CRISPR gRNA sequence
gctgagctacagttctctga

SEQ ID NO: 165965 - DNA, 20 bp, Artificial
  CRISPR gRNA sequence
ctgagctacagttctctgat

SEQ ID NO: 165966 - DNA, 20 bp, Artificial
  CRISPR gRNA sequence
agctacagttctctgatgtg

SEQ ID NO: 165967 - DNA, 20 bp, Artificial
  CRISPR gRNA sequence
cagttctctgatgtggtaac

SEQ ID NO: 165968 - DNA, 20 bp, Artificial
  CRISPR gRNA sequence
tctgatgtggtaaccgcctt

SEQ ID NO: 165969 - DNA, 20 bp, Artificial
  CRISPR gRNA sequence
tgatgtggtaaccgccttgg

SEQ ID NO: 165970 - DNA, 20 bp, Artificial
  CRISPR gRNA sequence
atgtggtaaccgccttggtc

SEQ ID NO: 165971 - DNA, 20 bp, Artificial
  CRISPR gRNA sequence
ggtcctcttttcatccccag

SEQ ID NO: 165972 - DNA, 20 bp, Artificial
  CRISPR gRNA sequence
gtcctcttttcatccccagc

SEQ ID NO: 165973 - DNA, 20 bp, Artificial
  CRISPR gRNA sequence
ttttcatccccagctcaaaa

SEQ ID NO: 165974 - DNA, 20 bp, Artificial
  CRISPR gRNA sequence
ttcatccccagctcaaaaca

SEQ ID NO: 165975 - DNA, 20 bp, Artificial
  CRISPR gRNA sequence
tcatccccagctcaaaacac

SEQ ID NO: 165976 - DNA, 20 bp, Artificial
  CRISPR gRNA sequence
catccccagctcaaaacact

SEQ ID NO: 165977 - DNA, 20 bp, Artificial
  CRISPR gRNA sequence
atccccagctcaaaacacta

SEQ ID NO: 165978 - DNA, 20 bp, Artificial
  CRISPR gRNA sequence
aaaacactaatactttcatg

SEQ ID NO: 165979 - DNA, 20 bp, Artificial
  CRISPR gRNA sequence
atactttcatggtacactgg

SEQ ID NO: 165980 - DNA, 20 bp, Artificial
  CRISPR gRNA sequence
tcatggtacactggagcatt

SEQ ID NO: 165981 - DNA, 20 bp, Artificial
  CRISPR gRNA sequence
catggtacactggagcatta

SEQ ID NO: 165982 - DNA, 20 bp, Artificial
  CRISPR gRNA sequence
atggtacactggagcattaa

SEQ ID NO: 165983 - DNA, 20 bp, Artificial
  CRISPR gRNA sequence
gagcattaagagcctgagtt

SEQ ID NO: 165984 - DNA, 20 bp, Artificial
  CRISPR gRNA sequence
agagcctgagttaaggcttt

SEQ ID NO: 165985 - DNA, 20 bp, Artificial
  CRISPR gRNA sequence
agttaaggcttttagcacac

SEQ ID NO: 165986 - DNA, 20 bp, Artificial
  CRISPR gRNA sequence
aggcttttagcacacaatta

SEQ ID NO: 165987 - DNA, 20 bp, Artificial
  CRISPR gRNA sequence
ttagcacacaattaaatgca

SEQ ID NO: 165988 - DNA, 20 bp, Artificial
  CRISPR gRNA sequence
tagcacacaattaaatgcag

SEQ ID NO: 165989 - DNA, 20 bp, Artificial
  CRISPR gRNA sequence
agcacacaattaaatgcagc

SEQ ID NO: 165990 - DNA, 20 bp, Artificial
  CRISPR gRNA sequence
gcacacaattaaatgcagca

SEQ ID NO: 165991 - DNA, 20 bp, Artificial
  CRISPR gRNA sequence
aatgcagcatgtggtattat

SEQ ID NO: 165992 - DNA, 20 bp, Artificial
  CRISPR gRNA sequence
ttgtattatctgagatttaa

SEQ ID NO: 165993 - DNA, 20 bp, Artificial
  CRISPR gRNA sequence
tattatctgagatttaatcg

SEQ ID NO: 165994 - DNA, 20 bp, Artificial
  CRISPR gRNA sequence
tctgagatttaatcgtaagc

SEQ ID NO: 165995 - DNA, 20 bp, Artificial
  CRISPR gRNA sequence
agatttaatcgtaagcatga

SEQ ID NO: 165996 - DNA, 20 bp, Artificial
  CRISPR gRNA sequence
aatcgtaagcatgagagact

SEQ ID NO: 165997 - DNA, 20 bp, Artificial
  CRISPR gRNA sequence
atcgtaagcatgagagactc

SEQ ID NO: 165998 - DNA, 20 bp, Artificial
  CRISPR gRNA sequence
taagggcgctttcgtagctt

SEQ ID NO: 165999 - DNA, 20 bp, Artificial
  CRISPR gRNA sequence
agggcgctttcgtagctttg

SEQ ID NO: 166000 - DNA, 20 bp, Artificial
  CRISPR gRNA sequence
tcgtagctttggtttcccat

SEQ ID NO: 166001 - DNA, 20 bp, Artificial
  CRISPR gRNA sequence
cgtagctttggtttcccatg

SEQ ID NO: 166002 - DNA, 20 bp, Artificial
  CRISPR gRNA sequence
gtagctttggtttcccatga

SEQ ID NO: 166003 - DNA, 20 bp, Artificial
  CRISPR gRNA sequence
tggtttcccatgatggggtt

SEQ ID NO: 166004 - DNA, 20 bp, Artificial
  CRISPR gRNA sequence
ggtttcccatgatggggttt

SEQ ID NO: 166005 - DNA, 20 bp, Artificial
  CRISPR gRNA sequence
gtttcccatgatggggtttt

SEQ ID NO: 166006 - DNA, 20 bp, Artificial
  CRISPR gRNA sequence
cccatgatggggttttctat

SEQ ID NO: 166007 - DNA, 20 bp, Artificial
  CRISPR gRNA sequence
ccatgatggggttttctatg

SEQ ID NO: 166008 - DNA, 20 bp, Artificial
  CRISPR gRNA sequence
tctatgaaaggtttattgat

SEQ ID NO: 166009 - DNA, 20 bp, Artificial
  CRISPR gRNA sequence
ctatgaaaggtttattgatt

SEQ ID NO: 166010 - DNA, 20 bp, Artificial
  CRISPR gRNA sequence
tatgaaaggtttattgattc

SEQ ID NO: 166011 - DNA, 20 bp, Artificial
  CRISPR gRNA sequence
tgaaaggtttattgattctg

SEQ ID NO: 166012 - DNA, 20 bp, Artificial
  CRISPR gRNA sequence
attgattctgcttccccttg

SEQ ID NO: 166013 - DNA, 20 bp, Artificial
  CRISPR gRNA sequence
ttgattctgcttccccttgg

SEQ ID NO: 166014 - DNA, 20 bp, Artificial
  CRISPR gRNA sequence
attctgcttccccttgggag

SEQ ID NO: 166015 - DNA, 20 bp, Artificial
  CRISPR gRNA sequence
tgcttccccttgggaggtgt

SEQ ID NO: 166016 - DNA, 20 bp, Artificial
  CRISPR gRNA sequence
cttccccttgggaggtgttt

SEQ ID NO: 166017 - DNA, 20 bp, Artificial
  CRISPR gRNA sequence
ccccttgggaggtgtttggc

SEQ ID NO: 166018 - DNA, 20 bp, Artificial
  CRISPR gRNA sequence
cccttgggaggtgtttggcc

SEQ ID NO: 166019 - DNA, 20 bp, Artificial
  CRISPR gRNA sequence
gggaggtgtttggccagaag

SEQ ID NO: 166020 - DNA, 20 bp, Artificial
  CRISPR gRNA sequence
ggaggtgtttggccagaagc

SEQ ID NO: 166021 - DNA, 20 bp, Artificial
  CRISPR gRNA sequence
ggccagaagctagtgctgaa

SEQ ID NO: 166022 - DNA, 20 bp, Artificial
  CRISPR gRNA sequence
gccagaagctagtgctgaac

SEQ ID NO: 166023 - DNA, 20 bp, Artificial
  CRISPR gRNA sequence
gtgctgaacaccaaagatcc

SEQ ID NO: 166024 - DNA, 20 bp, Artificial
  CRISPR gRNA sequence
aacaccaaagatcctaaaag

SEQ ID NO: 166025 - DNA, 20 bp, Artificial
  CRISPR gRNA sequence
aaagccccacagacccccat

SEQ ID NO: 166026 - DNA, 20 bp, Artificial
  CRISPR gRNA sequence
gctcttggggacagagatgg

SEQ ID NO: 166027 - DNA, 20 bp, Artificial
  CRISPR gRNA sequence
ttggggacagagatggttaa

SEQ ID NO: 166028 - DNA, 20 bp, Artificial
  CRISPR gRNA sequence
ggggacagagatggttaagc

SEQ ID NO: 166029 - DNA, 20 bp, Artificial
  CRISPR gRNA sequence
gggacagagatggttaagca

SEQ ID NO: 166030 - DNA, 20 bp, Artificial
  CRISPR gRNA sequence
agcagtccagcttttgcctc

SEQ ID NO: 166031 - DNA, 20 bp, Artificial
  CRISPR gRNA sequence
ttgcctccaaaatgtgcagc

SEQ ID NO: 166032 - DNA, 20 bp, Artificial
  CRISPR gRNA sequence
tgcctccaaaatgtgcagca

SEQ ID NO: 166033 - DNA, 20 bp, Artificial
  CRISPR gRNA sequence
gcctccaaaatgtgcagcat

SEQ ID NO: 166034 - DNA, 20 bp, Artificial
  CRISPR gRNA sequence
cctccaaaatgtgcagcatg

SEQ ID NO: 166035 - DNA, 20 bp, Artificial
  CRISPR gRNA sequence
caaaatgtgcagcatggggc

SEQ ID NO: 166036 - DNA, 20 bp, Artificial
  CRISPR gRNA sequence
tgatgcggaatgatggctgt

SEQ ID NO: 166037 - DNA, 20 bp, Artificial
  CRISPR gRNA sequence
tttgctttgggatcctggca

SEQ ID NO: 166038 - DNA, 20 bp, Artificial
  CRISPR gRNA sequence
gctttgggatcctggcagat

SEQ ID NO: 166039 - DNA, 20 bp, Artificial
  CRISPR gRNA sequence
ctttgggatcctggcagatg

SEQ ID NO: 166040 - DNA, 20 bp, Artificial
  CRISPR gRNA sequence
tgggatcctggcagatgctg

SEQ ID NO: 166041 - DNA, 20 bp, Artificial
  CRISPR gRNA sequence
gggatcctggcagatgctgg

SEQ ID NO: 166042 - DNA, 20 bp, Artificial
  CRISPR gRNA sequence
ggatcctggcagatgctgga

SEQ ID NO: 166043 - DNA, 20 bp, Artificial
  CRISPR gRNA sequence
gcagatgctggatctcttta

SEQ ID NO: 166044 - DNA, 20 bp, Artificial
  CRISPR gRNA sequence
gatctctttacagatgggag

SEQ ID NO: 166045 - DNA, 20 bp, Artificial
  CRISPR gRNA sequence
tttacagatgggagcgaaag

SEQ ID NO: 166046 - DNA, 20 bp, Artificial
  CRISPR gRNA sequence
tacagatgggagcgaaagag

SEQ ID NO: 166047 - DNA, 20 bp, Artificial
  CRISPR gRNA sequence
acagatgggagcgaaagagg

SEQ ID NO: 166048 - DNA, 20 bp, Artificial
  CRISPR gRNA sequence
cagatgggagcgaaagaggc

SEQ ID NO: 166049 - DNA, 20 bp, Artificial
  CRISPR gRNA sequence
aatgtacaggcattctgatg

SEQ ID NO: 166050 - DNA, 20 bp, Artificial
  CRISPR gRNA sequence
atgtacaggcattctgatga

SEQ ID NO: 166051 - DNA, 20 bp, Artificial
  CRISPR gRNA sequence
tgatgatgtcagtcagataa

SEQ ID NO: 166052 - DNA, 20 bp, Artificial
  CRISPR gRNA sequence
atgatgtcagtcagataaat

SEQ ID NO: 166053 - DNA, 20 bp, Artificial
  CRISPR gRNA sequence
ctaagataagctgtgatcat

SEQ ID NO: 166054 - DNA, 20 bp, Artificial
  CRISPR gRNA sequence
agataagctgtgatcatgta

SEQ ID NO: 166055 - DNA, 20 bp, Artificial
  CRISPR gRNA sequence
tgatcatgtagctaagagct

SEQ ID NO: 166056 - DNA, 20 bp, Artificial
  CRISPR gRNA sequence
agagctggcaaataatgagc

SEQ ID NO: 166057 - DNA, 20 bp, Artificial
  CRISPR gRNA sequence
gcaaataatgagcatgcagc

SEQ ID NO: 166058 - DNA, 20 bp, Artificial
  CRISPR gRNA sequence
ttctcacctttgtgacagga

SEQ ID NO: 166059 - DNA, 20 bp, Artificial
  CRISPR gRNA sequence
tcacctttgtgacaggatct

SEQ ID NO: 166060 - DNA, 20 bp, Artificial
  CRISPR gRNA sequence
acctttgtgacaggatcttc

SEQ ID NO: 166061 - DNA, 20 bp, Artificial
  CRISPR gRNA sequence
tgtgacaggatcttctggga

SEQ ID NO: 166062 - DNA, 20 bp, Artificial
  CRISPR gRNA sequence
gtgacaggatcttctgggag

SEQ ID NO: 166063 - DNA, 20 bp, Artificial
  CRISPR gRNA sequence
tgacaggatcttctgggagt

SEQ ID NO: 166064 - DNA, 20 bp, Artificial
  CRISPR gRNA sequence
ctgggagttttttctgaagt

SEQ ID NO: 166065 - DNA, 20 bp, Artificial
  CRISPR gRNA sequence
tgggagttttttctgaagtc

SEQ ID NO: 166066 - DNA, 20 bp, Artificial
  CRISPR gRNA sequence
ggagttttttctgaagtcca

SEQ ID NO: 166067 - DNA, 20 bp, Artificial
  CRISPR gRNA sequence
tttctgaagtccattcaggg

SEQ ID NO: 166068 - DNA, 20 bp, Artificial
  CRISPR gRNA sequence
ttctgaagtccattcaggga

SEQ ID NO: 166069 - DNA, 20 bp, Artificial
  CRISPR gRNA sequence
tctgaagtccattcagggaa

SEQ ID NO: 166070 - DNA, 20 bp, Artificial
  CRISPR gRNA sequence
ctgaagtccattcagggaat

SEQ ID NO: 166071 - DNA, 20 bp, Artificial
  CRISPR gRNA sequence
tgaagtccattcagggaata

SEQ ID NO: 166072 - DNA, 20 bp, Artificial
  CRISPR gRNA sequence
aagtccattcagggaatata

SEQ ID NO: 166073 - DNA, 20 bp, Artificial
  CRISPR gRNA sequence
agggaatatattctcttctg

SEQ ID NO: 166074 - DNA, 20 bp, Artificial
  CRISPR gRNA sequence
tcttctgtgctgtgtgactt

SEQ ID NO: 166075 - DNA, 20 bp, Artificial
  CRISPR gRNA sequence
ttctgtgctgtgtgacttgt

SEQ ID NO: 166076 - DNA, 20 bp, Artificial
  CRISPR gRNA sequence
ctgtgctgtgtgacttgtgg

SEQ ID NO: 166077 - DNA, 20 bp, Artificial
  CRISPR gRNA sequence
tgtgctgtgtgacttgtggg

SEQ ID NO: 166078 - DNA, 20 bp, Artificial
  CRISPR gRNA sequence
tgctgtgtgacttgtgggat

SEQ ID NO: 166079 - DNA, 20 bp, Artificial
  CRISPR gRNA sequence
tgtgacttgtgggatgtgga

SEQ ID NO: 166080 - DNA, 20 bp, Artificial
  CRISPR gRNA sequence
gtgggatgtggatgttctga

SEQ ID NO: 166081 - DNA, 20 bp, Artificial
  CRISPR gRNA sequence
tgggatgtggatgttctgat

SEQ ID NO: 166082 - DNA, 20 bp, Artificial
  CRISPR gRNA sequence
tgattttgcttgttttgacc

SEQ ID NO: 166083 - DNA, 20 bp, Artificial
  CRISPR gRNA sequence
attttgcttgttttgacctc

SEQ ID NO: 166084 - DNA, 20 bp, Artificial
  CRISPR gRNA sequence
tgcttgttttgacctctgtt

SEQ ID NO: 166085 - DNA, 20 bp, Artificial
  CRISPR gRNA sequence
gcttgttttgacctctgttt

SEQ ID NO: 166086 - DNA, 20 bp, Artificial
  CRISPR gRNA sequence
cttgttttgacctctgttta

SEQ ID NO: 166087 - DNA, 20 bp, Artificial
  CRISPR gRNA sequence
gttttgacctctgtttaaaa

SEQ ID NO: 166088 - DNA, 20 bp, Artificial
  CRISPR gRNA sequence
ttttgacctctgtttaaaag

SEQ ID NO: 166089 - DNA, 20 bp, Artificial
  CRISPR gRNA sequence
tgacctctgtttaaaaggga

SEQ ID NO: 166090 - DNA, 20 bp, Artificial
  CRISPR gRNA sequence
gacctctgtttaaaagggac

SEQ ID NO: 166091 - DNA, 20 bp, Artificial
  CRISPR gRNA sequence
acctctgtttaaaagggact

SEQ ID NO: 166092 - DNA, 20 bp, Artificial
  CRISPR gRNA sequence
tgtttaaaagggactttttt

SEQ ID NO: 166093 - DNA, 20 bp, Artificial
  CRISPR gRNA sequence
tttaaaagggacttttttca

SEQ ID NO: 166094 - DNA, 20 bp, Artificial
  CRISPR gRNA sequence
aaaagggacttttttcaggg

SEQ ID NO: 166095 - DNA, 20 bp, Artificial
  CRISPR gRNA sequence
aaagggacttttttcagggc

SEQ ID NO: 166096 - DNA, 20 bp, Artificial
  CRISPR gRNA sequence
ttttcagggcaggcttcttt

SEQ ID NO: 166097 - DNA, 20 bp, Artificial
  CRISPR gRNA sequence
tttcagggcaggcttctttg

SEQ ID NO: 166098 - DNA, 20 bp, Artificial
  CRISPR gRNA sequence
ttcagggcaggcttctttgg

SEQ ID NO: 166099 - DNA, 20 bp, Artificial
  CRISPR gRNA sequence
tcagggcaggcttctttgga

SEQ ID NO: 166100 - DNA, 20 bp, Artificial
  CRISPR gRNA sequence
cagggcaggcttctttggag

SEQ ID NO: 166101 - DNA, 20 bp, Artificial
  CRISPR gRNA sequence
agggcaggcttctttggagg

SEQ ID NO: 166102 - DNA, 20 bp, Artificial
  CRISPR gRNA sequence
ctttggagggcttgaggggt

SEQ ID NO: 166103 - DNA, 20 bp, Artificial
  CRISPR gRNA sequence
tttggagggcttgaggggta

SEQ ID NO: 166104 - DNA, 20 bp, Artificial
  CRISPR gRNA sequence
tggagggcttgaggggtagg

SEQ ID NO: 166105 - DNA, 20 bp, Artificial
  CRISPR gRNA sequence
ggagggcttgaggggtaggg

SEQ ID NO: 166106 - DNA, 20 bp, Artificial
  CRISPR gRNA sequence
gagggcttgaggggtagggg

SEQ ID NO: 166107 - DNA, 20 bp, Artificial
  CRISPR gRNA sequence
gaggggtagggggcaatcaa

SEQ ID NO: 166108 - DNA, 20 bp, Artificial
  CRISPR gRNA sequence
aggggtagggggcaatcaac

SEQ ID NO: 166109 - DNA, 20 bp, Artificial
  CRISPR gRNA sequence
tggtcatggaaagtttgcct

SEQ ID NO: 166110 - DNA, 20 bp, Artificial
  CRISPR gRNA sequence
gtcatggaaagtttgcctgt

SEQ ID NO: 166111 - DNA, 20 bp, Artificial
  CRISPR gRNA sequence
gcctgtttgagattatactc

SEQ ID NO: 166112 - DNA, 20 bp, Artificial
  CRISPR gRNA sequence
cctgtttgagattatactca

SEQ ID NO: 166113 - DNA, 20 bp, Artificial
  CRISPR gRNA sequence
tttgagattatactcaatgt

SEQ ID NO: 166114 - DNA, 20 bp, Artificial
  CRISPR gRNA sequence
gagattatactcaatgtctt

SEQ ID NO: 166115 - DNA, 20 bp, Artificial
  CRISPR gRNA sequence
agattatactcaatgtctta

SEQ ID NO: 166116 - DNA, 20 bp, Artificial
  CRISPR gRNA sequence
tactcaatgtcttatggtct

SEQ ID NO: 166117 - DNA, 20 bp, Artificial
  CRISPR gRNA sequence
aatgtcttatggtctctttg

SEQ ID NO: 166118 - DNA, 20 bp, Artificial
  CRISPR gRNA sequence
atggtctctttgtctctgcc

SEQ ID NO: 166119 - DNA, 20 bp, Artificial
  CRISPR gRNA sequence
tggtctctttgtctctgccc

SEQ ID NO: 166120 - DNA, 20 bp, Artificial
  CRISPR gRNA sequence
tttgtctctgcccctgccct

SEQ ID NO: 166121 - DNA, 20 bp, Artificial
  CRISPR gRNA sequence
tgtctctgcccctgccctag

SEQ ID NO: 166122 - DNA, 20 bp, Artificial
  CRISPR gRNA sequence
gtctctgcccctgccctagg

SEQ ID NO: 166123 - DNA, 20 bp, Artificial
  CRISPR gRNA sequence
tctctgcccctgccctaggt

SEQ ID NO: 166124 - DNA, 20 bp, Artificial
  CRISPR gRNA sequence
tgcccctgccctaggtgcag

SEQ ID NO: 166125 - DNA, 20 bp, Artificial
  CRISPR gRNA sequence
cccctgccctaggtgcagct

SEQ ID NO: 166126 - DNA, 20 bp, Artificial
  CRISPR gRNA sequence
ccctaggtgcagctgaatgc

SEQ ID NO: 166127 - DNA, 20 bp, Artificial
  CRISPR gRNA sequence
ggtgcagctgaatgccggcc

SEQ ID NO: 166128 - DNA, 20 bp, Artificial
  CRISPR gRNA sequence
aatgccggccagctgcagta

SEQ ID NO: 166129 - DNA, 20 bp, Artificial
  CRISPR gRNA sequence
cagtatatccgcttagccca

SEQ ID NO: 166130 - DNA, 20 bp, Artificial
  CRISPR gRNA sequence
agcccagcctgtatcaggca

SEQ ID NO: 166131 - DNA, 20 bp, Artificial
  CRISPR gRNA sequence
gcccagcctgtatcaggcac

SEQ ID NO: 166132 - DNA, 20 bp, Artificial
  CRISPR gRNA sequence
tatcaggcactcaagttgtg

SEQ ID NO: 166133 - DNA, 20 bp, Artificial
  CRISPR gRNA sequence
aagttgtgcagggacagatc

SEQ ID NO: 166134 - DNA, 20 bp, Artificial
  CRISPR gRNA sequence
tgcagggacagatccagaca

SEQ ID NO: 166135 - DNA, 20 bp, Artificial
  CRISPR gRNA sequence
gccaccaatgctcaacaggt

SEQ ID NO: 166136 - DNA, 20 bp, Artificial
  CRISPR gRNA sequence
ccaccaatgctcaacaggta

SEQ ID NO: 166137 - DNA, 20 bp, Artificial
  CRISPR gRNA sequence
aacaggtatgtgccccagag

SEQ ID NO: 166138 - DNA, 20 bp, Artificial
  CRISPR gRNA sequence
tgttggagaccaggagcaga

SEQ ID NO: 166139 - DNA, 20 bp, Artificial
  CRISPR gRNA sequence
gagaccaggagcagatggct

SEQ ID NO: 166140 - DNA, 20 bp, Artificial
  CRISPR gRNA sequence
ctgacaggaaaggagcgctc

SEQ ID NO: 166141 - DNA, 20 bp, Artificial
  CRISPR gRNA sequence
tgacaggaaaggagcgctca

SEQ ID NO: 166142 - DNA, 20 bp, Artificial
  CRISPR gRNA sequence
acaggaaaggagcgctcagc

SEQ ID NO: 166143 - DNA, 20 bp, Artificial
  CRISPR gRNA sequence
agcacacagctgtcttgcca

SEQ ID NO: 166144 - DNA, 20 bp, Artificial
  CRISPR gRNA sequence
tcttgccacctcatccttca

SEQ ID NO: 166145 - DNA, 20 bp, Artificial
  CRISPR gRNA sequence
gccacctcatccttcaacca

SEQ ID NO: 166146 - DNA, 20 bp, Artificial
  CRISPR gRNA sequence
ccacctcatccttcaaccag

SEQ ID NO: 166147 - DNA, 20 bp, Artificial
  CRISPR gRNA sequence
atccttcaaccagaagcacc

SEQ ID NO: 166148 - DNA, 20 bp, Artificial
  CRISPR gRNA sequence
caaccagaagcaccaccccc

SEQ ID NO: 166149 - DNA, 20 bp, Artificial
  CRISPR gRNA sequence
aaccagaagcaccaccccca

SEQ ID NO: 166150 - DNA, 20 bp, Artificial
  CRISPR gRNA sequence
catatccttctgcacccaag

SEQ ID NO: 166151 - DNA, 20 bp, Artificial
  CRISPR gRNA sequence
ctgcacccaagaggcatggg

SEQ ID NO: 166152 - DNA, 20 bp, Artificial
  CRISPR gRNA sequence
tgcacccaagaggcatgggt

SEQ ID NO: 166153 - DNA, 20 bp, Artificial
  CRISPR gRNA sequence
cacccaagaggcatgggtgg

SEQ ID NO: 166154 - DNA, 20 bp, Artificial
  CRISPR gRNA sequence
gaacattagattcaaagtgt

SEQ ID NO: 166155 - DNA, 20 bp, Artificial
  CRISPR gRNA sequence
gattcaaagtgttttctctt

SEQ ID NO: 166156 - DNA, 20 bp, Artificial
  CRISPR gRNA sequence
aaagtgttttctcttaccat

SEQ ID NO: 166157 - DNA, 20 bp, Artificial
  CRISPR gRNA sequence
tctcttaccatcttgttctc

SEQ ID NO: 166158 - DNA, 20 bp, Artificial
  CRISPR gRNA sequence
ctcttaccatcttgttctca

SEQ ID NO: 166159 - DNA, 20 bp, Artificial
  CRISPR gRNA sequence
tcttaccatcttgttctcaa

SEQ ID NO: 166160 - DNA, 20 bp, Artificial
  CRISPR gRNA sequence
ttaccatcttgttctcaagg

SEQ ID NO: 166161 - DNA, 20 bp, Artificial
  CRISPR gRNA sequence
accatcttgttctcaagggg

SEQ ID NO: 166162 - DNA, 20 bp, Artificial
  CRISPR gRNA sequence
ccatcttgttctcaaggggc

SEQ ID NO: 166163 - DNA, 20 bp, Artificial
  CRISPR gRNA sequence
gttctcaaggggcaaagaaa

SEQ ID NO: 166164 - DNA, 20 bp, Artificial
  CRISPR gRNA sequence
ttctcaaggggcaaagaaat

SEQ ID NO: 166165 - DNA, 20 bp, Artificial
  CRISPR gRNA sequence
tcaaggggcaaagaaatgca

SEQ ID NO: 166166 - DNA, 20 bp, Artificial
  CRISPR gRNA sequence
aaggggcaaagaaatgcaag

SEQ ID NO: 166167 - DNA, 20 bp, Artificial
  CRISPR gRNA sequence
gaaggtgcctgaaagaaacc

SEQ ID NO: 166168 - DNA, 20 bp, Artificial
  CRISPR gRNA sequence
aaagaaaccttacaggtgtg

SEQ ID NO: 166169 - DNA, 20 bp, Artificial
  CRISPR gRNA sequence
acaggtgtgcacacccatca

SEQ ID NO: 166170 - DNA, 20 bp, Artificial
  CRISPR gRNA sequence
caggtgtgcacacccatcag

SEQ ID NO: 166171 - DNA, 20 bp, Artificial
  CRISPR gRNA sequence
ggaaatgttcgacagatcgc

SEQ ID NO: 166172 - DNA, 20 bp, Artificial
  CRISPR gRNA sequence
gacagatcgcctgatcgtca

SEQ ID NO: 166173 - DNA, 20 bp, Artificial
  CRISPR gRNA sequence
atcgtcaggctgtttccatc

SEQ ID NO: 166174 - DNA, 20 bp, Artificial
  CRISPR gRNA sequence
tttccatctttaaacccaag

SEQ ID NO: 166175 - DNA, 20 bp, Artificial
  CRISPR gRNA sequence
ccatctttaaacccaagtgg

SEQ ID NO: 166176 - DNA, 20 bp, Artificial
  CRISPR gRNA sequence
catctttaaacccaagtggc

SEQ ID NO: 166177 - DNA, 20 bp, Artificial
  CRISPR gRNA sequence
taaacccaagtggctgttgt

SEQ ID NO: 166178 - DNA, 20 bp, Artificial
  CRISPR gRNA sequence
aaacccaagtggctgttgtg

SEQ ID NO: 166179 - DNA, 20 bp, Artificial
  CRISPR gRNA sequence
aacccaagtggctgttgtgt

SEQ ID NO: 166180 - DNA, 20 bp, Artificial
  CRISPR gRNA sequence
ttgtgttctggcacctcctg

SEQ ID NO: 166181 - DNA, 20 bp, Artificial
  CRISPR gRNA sequence
tgttctggcacctcctgtgc

SEQ ID NO: 166182 - DNA, 20 bp, Artificial
  CRISPR gRNA sequence
tggcacctcctgtgctcttt

SEQ ID NO: 166183 - DNA, 20 bp, Artificial
  CRISPR gRNA sequence
gcacctcctgtgctctttgg

SEQ ID NO: 166184 - DNA, 20 bp, Artificial
  CRISPR gRNA sequence
ctgtgctctttggaaagctt

SEQ ID NO: 166185 - DNA, 20 bp, Artificial
  CRISPR gRNA sequence
tgctctttggaaagcttact

SEQ ID NO: 166186 - DNA, 20 bp, Artificial
  CRISPR gRNA sequence
tttggaaagcttacttagat

SEQ ID NO: 166187 - DNA, 20 bp, Artificial
  CRISPR gRNA sequence
tggaaagcttacttagattt

SEQ ID NO: 166188 - DNA, 20 bp, Artificial
  CRISPR gRNA sequence
ggaaagcttacttagatttt

SEQ ID NO: 166189 - DNA, 20 bp, Artificial
  CRISPR gRNA sequence
gaaagcttacttagatttta

SEQ ID NO: 166190 - DNA, 20 bp, Artificial
  CRISPR gRNA sequence
acttagattttacccctacc

SEQ ID NO: 166191 - DNA, 20 bp, Artificial
  CRISPR gRNA sequence
cttagattttacccctacct

SEQ ID NO: 166192 - DNA, 20 bp, Artificial
  CRISPR gRNA sequence
agattttacccctacctcct

SEQ ID NO: 166193 - DNA, 20 bp, Artificial
  CRISPR gRNA sequence
gattttacccctacctcctc

SEQ ID NO: 166194 - DNA, 20 bp, Artificial
  CRISPR gRNA sequence
tacccctacctcctcttgca

SEQ ID NO: 166195 - DNA, 20 bp, Artificial
  CRISPR gRNA sequence
acccctacctcctcttgcat

SEQ ID NO: 166196 - DNA, 20 bp, Artificial
  CRISPR gRNA sequence
cccctacctcctcttgcatc

SEQ ID NO: 166197 - DNA, 20 bp, Artificial
  CRISPR gRNA sequence
cctcctcttgcatccctaac

SEQ ID NO: 166198 - DNA, 20 bp, Artificial
  CRISPR gRNA sequence
ctcttgcatccctaaccaga

SEQ ID NO: 166199 - DNA, 20 bp, Artificial
  CRISPR gRNA sequence
ttgcatccctaaccagaaaa

SEQ ID NO: 166200 - DNA, 20 bp, Artificial
  CRISPR gRNA sequence
gcatccctaaccagaaaaat

SEQ ID NO: 166201 - DNA, 20 bp, Artificial
  CRISPR gRNA sequence
catccctaaccagaaaaatt

SEQ ID NO: 166202 - DNA, 20 bp, Artificial
  CRISPR gRNA sequence
accagaaaaattgcccttct

SEQ ID NO: 166203 - DNA, 20 bp, Artificial
  CRISPR gRNA sequence
cccttctcctctcctctcgt

SEQ ID NO: 166204 - DNA, 20 bp, Artificial
  CRISPR gRNA sequence
ctcctctcctctcgtgccct

SEQ ID NO: 166205 - DNA, 20 bp, Artificial
  CRISPR gRNA sequence
tcctctcctctcgtgcccta

SEQ ID NO: 166206 - DNA, 20 bp, Artificial
  CRISPR gRNA sequence
ctctcctctcgtgccctaca

SEQ ID NO: 166207 - DNA, 20 bp, Artificial
  CRISPR gRNA sequence
tcctctcgtgccctacaata

SEQ ID NO: 166208 - DNA, 20 bp, Artificial
  CRISPR gRNA sequence
ctctcgtgccctacaatatt

SEQ ID NO: 166209 - DNA, 20 bp, Artificial
  CRISPR gRNA sequence
tcgtgccctacaatattgat

SEQ ID NO: 166210 - DNA, 20 bp, Artificial
  CRISPR gRNA sequence
gtgccctacaatattgatgg

SEQ ID NO: 166211 - DNA, 20 bp, Artificial
  CRISPR gRNA sequence
caatattgatggctatgagt

SEQ ID NO: 166212 - DNA, 20 bp, Artificial
  CRISPR gRNA sequence
atggctatgagtcacagatg

SEQ ID NO: 166213 - DNA, 20 bp, Artificial
  CRISPR gRNA sequence
tgagtcacagatggtgaggg

SEQ ID NO: 166214 - DNA, 20 bp, Artificial
  CRISPR gRNA sequence
cctccctgggcttgggggtg

SEQ ID NO: 166215 - DNA, 20 bp, Artificial
  CRISPR gRNA sequence
cctgggcttgggggtgttga

SEQ ID NO: 166216 - DNA, 20 bp, Artificial
  CRISPR gRNA sequence
ggcttgggggtgttgaggga

SEQ ID NO: 166217 - DNA, 20 bp, Artificial
  CRISPR gRNA sequence
gggggtgttgagggacatgg

SEQ ID NO: 166218 - DNA, 20 bp, Artificial
  CRISPR gRNA sequence
ggggtgttgagggacatggg

SEQ ID NO: 166219 - DNA, 20 bp, Artificial
  CRISPR gRNA sequence
agggacatgggtattacttg

SEQ ID NO: 166220 - DNA, 20 bp, Artificial
  CRISPR gRNA sequence
cttgcagaagatggggggtg

SEQ ID NO: 166221 - DNA, 20 bp, Artificial
  CRISPR gRNA sequence
gcagaagatggggggtgctg

SEQ ID NO: 166222 - DNA, 20 bp, Artificial
  CRISPR gRNA sequence
cagaagatggggggtgctgg

SEQ ID NO: 166223 - DNA, 20 bp, Artificial
  CRISPR gRNA sequence
gtcaaggggaggcattgtta

SEQ ID NO: 166224 - DNA, 20 bp, Artificial
  CRISPR gRNA sequence
ttaatggattcttttgcctc

SEQ ID NO: 166225 - DNA, 20 bp, Artificial
  CRISPR gRNA sequence
atggattcttttgcctcaga

SEQ ID NO: 166226 - DNA, 20 bp, Artificial
  CRISPR gRNA sequence
ttttgcctcagacccaaaaa

SEQ ID NO: 166227 - DNA, 20 bp, Artificial
  CRISPR gRNA sequence
ttgcctcagacccaaaaaaa

SEQ ID NO: 166228 - DNA, 20 bp, Artificial
  CRISPR gRNA sequence
tgcctcagacccaaaaaaag

SEQ ID NO: 166229 - DNA, 20 bp, Artificial
  CRISPR gRNA sequence
gcctcagacccaaaaaaagc

SEQ ID NO: 166230 - DNA, 20 bp, Artificial
  CRISPR gRNA sequence
cctcagacccaaaaaaagca

SEQ ID NO: 166231 - DNA, 20 bp, Artificial
  CRISPR gRNA sequence
agacccaaaaaaagcagcga

SEQ ID NO: 166232 - DNA, 20 bp, Artificial
  CRISPR gRNA sequence
aagagctggacccgtctggc

SEQ ID NO: 166233 - DNA, 20 bp, Artificial
  CRISPR gRNA sequence
agagctggacccgtctggcc

SEQ ID NO: 166234 - DNA, 20 bp, Artificial
  CRISPR gRNA sequence
gacccgtctggcccagttgc

SEQ ID NO: 166235 - DNA, 20 bp, Artificial
  CRISPR gRNA sequence
gcccagttgcatttctggtg

SEQ ID NO: 166236 - DNA, 20 bp, Artificial
  CRISPR gRNA sequence
catttctggtgatgtatcta

SEQ ID NO: 166237 - DNA, 20 bp, Artificial
  CRISPR gRNA sequence
ctggtgatgtatctattgac

SEQ ID NO: 166238 - DNA, 20 bp, Artificial
  CRISPR gRNA sequence
tggtgatgtatctattgaca

SEQ ID NO: 166239 - DNA, 20 bp, Artificial
  CRISPR gRNA sequence
gtgatgtatctattgacagt

SEQ ID NO: 166240 - DNA, 20 bp, Artificial
  CRISPR gRNA sequence
ttgacagtggtgacagagct

SEQ ID NO: 166241 - DNA, 20 bp, Artificial
  CRISPR gRNA sequence
acagtggtgacagagctgag

SEQ ID NO: 166242 - DNA, 20 bp, Artificial
  CRISPR gRNA sequence
agtttgtagagcaggtctcc

SEQ ID NO: 166243 - DNA, 20 bp, Artificial
  CRISPR gRNA sequence
gtagagcaggtctccaaaga

SEQ ID NO: 166244 - DNA, 20 bp, Artificial
  CRISPR gRNA sequence
tagagcaggtctccaaagat

SEQ ID NO: 166245 - DNA, 20 bp, Artificial
  CRISPR gRNA sequence
caaagatctcatttgggaaa

SEQ ID NO: 166246 - DNA, 20 bp, Artificial
  CRISPR gRNA sequence
atttgggaaaatacgaggaa

SEQ ID NO: 166247 - DNA, 20 bp, Artificial
  CRISPR gRNA sequence
gggaaaatacgaggaatgag

SEQ ID NO: 166248 - DNA, 20 bp, Artificial
  CRISPR gRNA sequence
ggaaaatacgaggaatgagc

SEQ ID NO: 166249 - DNA, 20 bp, Artificial
  CRISPR gRNA sequence
ctgagttccatatagtctct

SEQ ID NO: 166250 - DNA, 20 bp, Artificial
  CRISPR gRNA sequence
tgagttccatatagtctctg

SEQ ID NO: 166251 - DNA, 20 bp, Artificial
  CRISPR gRNA sequence
agttccatatagtctctggg

SEQ ID NO: 166252 - DNA, 20 bp, Artificial
  CRISPR gRNA sequence
catatagtctctgggatcat

SEQ ID NO: 166253 - DNA, 20 bp, Artificial
  CRISPR gRNA sequence
tgggatcattaagggctgtt

SEQ ID NO: 166254 - DNA, 20 bp, Artificial
  CRISPR gRNA sequence
ggatcattaagggctgtttc

SEQ ID NO: 166255 - DNA, 20 bp, Artificial
  CRISPR gRNA sequence
agggctgtttctgtgcccac

SEQ ID NO: 166256 - DNA, 20 bp, Artificial
  CRISPR gRNA sequence
tttctgtgcccactccccgg

SEQ ID NO: 166257 - DNA, 20 bp, Artificial
  CRISPR gRNA sequence
ctgtgcccactccccggctt

SEQ ID NO: 166258 - DNA, 20 bp, Artificial
  CRISPR gRNA sequence
tgtgcccactccccggctta

SEQ ID NO: 166259 - DNA, 20 bp, Artificial
  CRISPR gRNA sequence
tgcccactccccggcttacc

SEQ ID NO: 166260 - DNA, 20 bp, Artificial
  CRISPR gRNA sequence
cccggcttacctaaggacgc

SEQ ID NO: 166261 - DNA, 20 bp, Artificial
  CRISPR gRNA sequence
acctaaggacgcggcttttc

SEQ ID NO: 166262 - DNA, 20 bp, Artificial
  CRISPR gRNA sequence
cctaaggacgcggcttttcc

SEQ ID NO: 166263 - DNA, 20 bp, Artificial
  CRISPR gRNA sequence
aggacgcggcttttccgtag

SEQ ID NO: 166264 - DNA, 20 bp, Artificial
  CRISPR gRNA sequence
ttccgtagctgatactgact

SEQ ID NO: 166265 - DNA, 20 bp, Artificial
  CRISPR gRNA sequence
tccgtagctgatactgactc

SEQ ID NO: 166266 - DNA, 20 bp, Artificial
  CRISPR gRNA sequence
ccgtagctgatactgactca

SEQ ID NO: 166267 - DNA, 20 bp, Artificial
  CRISPR gRNA sequence
cgtagctgatactgactcac

SEQ ID NO: 166268 - DNA, 20 bp, Artificial
  CRISPR gRNA sequence
atactgactcacacccttcc

SEQ ID NO: 166269 - DNA, 20 bp, Artificial
  CRISPR gRNA sequence
actcacacccttcccccagc

SEQ ID NO: 166270 - DNA, 20 bp, Artificial
  CRISPR gRNA sequence
acacccttcccccagcccct

SEQ ID NO: 166271 - DNA, 20 bp, Artificial
  CRISPR gRNA sequence
cccccagcccctctttttaa

SEQ ID NO: 166272 - DNA, 20 bp, Artificial
  CRISPR gRNA sequence
ccccagcccctctttttaac

SEQ ID NO: 166273 - DNA, 20 bp, Artificial
  CRISPR gRNA sequence
tttttaacctcataagattc

SEQ ID NO: 166274 - DNA, 20 bp, Artificial
  CRISPR gRNA sequence
tttaacctcataagattctt

SEQ ID NO: 166275 - DNA, 20 bp, Artificial
  CRISPR gRNA sequence
ttaacctcataagattcttc

SEQ ID NO: 166276 - DNA, 20 bp, Artificial
  CRISPR gRNA sequence
taacctcataagattcttcc

SEQ ID NO: 166277 - DNA, 20 bp, Artificial
  CRISPR gRNA sequence
aacctcataagattcttccc

SEQ ID NO: 166278 - DNA, 20 bp, Artificial
  CRISPR gRNA sequence
acctcataagattcttccct

SEQ ID NO: 166279 - DNA, 20 bp, Artificial
  CRISPR gRNA sequence
ataagattcttccctgggat

SEQ ID NO: 166280 - DNA, 20 bp, Artificial
  CRISPR gRNA sequence
ttccctgggatccaaaaaac

SEQ ID NO: 166281 - DNA, 20 bp, Artificial
  CRISPR gRNA sequence
ccctgggatccaaaaaacat

SEQ ID NO: 166282 - DNA, 20 bp, Artificial
  CRISPR gRNA sequence
cctgggatccaaaaaacata

SEQ ID NO: 166283 - DNA, 20 bp, Artificial
  CRISPR gRNA sequence
ggatccaaaaaacataacgg

SEQ ID NO: 166284 - DNA, 20 bp, Artificial
  CRISPR gRNA sequence
cttggttcctcagaagtcag

SEQ ID NO: 166285 - DNA, 20 bp, Artificial
  CRISPR gRNA sequence
ttggttcctcagaagtcagt

SEQ ID NO: 166286 - DNA, 20 bp, Artificial
  CRISPR gRNA sequence
ggttcctcagaagtcagttt

SEQ ID NO: 166287 - DNA, 20 bp, Artificial
  CRISPR gRNA sequence
gttcctcagaagtcagtttg

SEQ ID NO: 166288 - DNA, 20 bp, Artificial
  CRISPR gRNA sequence
ctcagaagtcagtttggggc

SEQ ID NO: 166289 - DNA, 20 bp, Artificial
  CRISPR gRNA sequence
agaagtcagtttggggctgg

SEQ ID NO: 166290 - DNA, 20 bp, Artificial
  CRISPR gRNA sequence
ggggctgggcacagtgggtc

SEQ ID NO: 166291 - DNA, 20 bp, Artificial
  CRISPR gRNA sequence
gggctgggcacagtgggtca

SEQ ID NO: 166292 - DNA, 20 bp, Artificial
  CRISPR gRNA sequence
ggcacagtgggtcacgcctg

SEQ ID NO: 166293 - DNA, 20 bp, Artificial
  CRISPR gRNA sequence
taatcccagcactttgggag

SEQ ID NO: 166294 - DNA, 20 bp, Artificial
  CRISPR gRNA sequence
tgggagggaggctgaggcag

SEQ ID NO: 166295 - DNA, 20 bp, Artificial
  CRISPR gRNA sequence
gggagggaggctgaggcagg

SEQ ID NO: 166296 - DNA, 20 bp, Artificial
  CRISPR gRNA sequence
ggagggaggctgaggcaggt

SEQ ID NO: 166297 - DNA, 20 bp, Artificial
  CRISPR gRNA sequence
aggcaggtgatcacatgagg

SEQ ID NO: 166298 - DNA, 20 bp, Artificial
  CRISPR gRNA sequence
gagaccagcctggccaacat

SEQ ID NO: 166299 - DNA, 20 bp, Artificial
  CRISPR gRNA sequence
agaccagcctggccaacatg

SEQ ID NO: 166300 - DNA, 20 bp, Artificial
  CRISPR gRNA sequence
gccaacatggcaaaaccgtt

SEQ ID NO: 166301 - DNA, 20 bp, Artificial
  CRISPR gRNA sequence
ccactaaaaatacaaaatta

SEQ ID NO: 166302 - DNA, 20 bp, Artificial
  CRISPR gRNA sequence
cactaaaaatacaaaattag

SEQ ID NO: 166303 - DNA, 20 bp, Artificial
  CRISPR gRNA sequence
aaaatacaaaattagctggg

SEQ ID NO: 166304 - DNA, 20 bp, Artificial
  CRISPR gRNA sequence
gctgggcgtggtggtgcatg

SEQ ID NO: 166305 - DNA, 20 bp, Artificial
  CRISPR gRNA sequence
ggcgtggtggtgcatgcctg

SEQ ID NO: 166306 - DNA, 20 bp, Artificial
  CRISPR gRNA sequence
tcatcccagctacttgggag

SEQ ID NO: 166307 - DNA, 20 bp, Artificial
  CRISPR gRNA sequence
cttgggaggctgagacacaa

SEQ ID NO: 166308 - DNA, 20 bp, Artificial
  CRISPR gRNA sequence
gggaggctgagacacaagaa

SEQ ID NO: 166309 - DNA, 20 bp, Artificial
  CRISPR gRNA sequence
ggaggctgagacacaagaat

SEQ ID NO: 166310 - DNA, 20 bp, Artificial
  CRISPR gRNA sequence
agacacaagaatcacttgaa

SEQ ID NO: 166311 - DNA, 20 bp, Artificial
  CRISPR gRNA sequence
gaacccaggaggtggaggtt

SEQ ID NO: 166312 - DNA, 20 bp, Artificial
  CRISPR gRNA sequence
aacccaggaggtggaggttg

SEQ ID NO: 166313 - DNA, 20 bp, Artificial
  CRISPR gRNA sequence
cagtgagctgagattgtgcc

SEQ ID NO: 166314 - DNA, 20 bp, Artificial
  CRISPR gRNA sequence
agattgtgccactgcactcc

SEQ ID NO: 166315 - DNA, 20 bp, Artificial
  CRISPR gRNA sequence
tgccactgcactccagcctg

SEQ ID NO: 166316 - DNA, 20 bp, Artificial
  CRISPR gRNA sequence
cactccagcctgggcgacag

SEQ ID NO: 166317 - DNA, 20 bp, Artificial
  CRISPR gRNA sequence
cagcctgggcgacagagtga

SEQ ID NO: 166318 - DNA, 20 bp, Artificial
  CRISPR gRNA sequence
ggcgacagagtgagactctg

SEQ ID NO: 166319 - DNA, 20 bp, Artificial
  CRISPR gRNA sequence
tgtctcaaaaaataaaaatt

SEQ ID NO: 166320 - DNA, 20 bp, Artificial
  CRISPR gRNA sequence
tctcaaaaaataaaaattaa

SEQ ID NO: 166321 - DNA, 20 bp, Artificial
  CRISPR gRNA sequence
aaaaaataaaaattaaaaaa

SEQ ID NO: 166322 - DNA, 20 bp, Artificial
  CRISPR gRNA sequence
aaaaaagtccgttttgggaa

SEQ ID NO: 166323 - DNA, 20 bp, Artificial
  CRISPR gRNA sequence
tgggaacagaactaaagcca

SEQ ID NO: 166324 - DNA, 20 bp, Artificial
  CRISPR gRNA sequence
gggaacagaactaaagccaa

SEQ ID NO: 166325 - DNA, 20 bp, Artificial
  CRISPR gRNA sequence
ggaacagaactaaagccaaa

SEQ ID NO: 166326 - DNA, 20 bp, Artificial
  CRISPR gRNA sequence
aagccaaaaaatgggagagg

SEQ ID NO: 166327 - DNA, 20 bp, Artificial
  CRISPR gRNA sequence
gggagaagcaagaaagtggt

SEQ ID NO: 166328 - DNA, 20 bp, Artificial
  CRISPR gRNA sequence
aaggcaatgaaaatctttgt

SEQ ID NO: 166329 - DNA, 20 bp, Artificial
  CRISPR gRNA sequence
tgtaacaacaggttgtaatt

SEQ ID NO: 166330 - DNA, 20 bp, Artificial
  CRISPR gRNA sequence
gtaacaacaggttgtaatta

SEQ ID NO: 166331 - DNA, 20 bp, Artificial
  CRISPR gRNA sequence
taacaacaggttgtaattat

SEQ ID NO: 166332 - DNA, 20 bp, Artificial
  CRISPR gRNA sequence
taattatgacaacctaatac

SEQ ID NO: 166333 - DNA, 20 bp, Artificial
  CRISPR gRNA sequence
tgacaacctaatacttagta

SEQ ID NO: 166334 - DNA, 20 bp, Artificial
  CRISPR gRNA sequence
atacttagtaggtgctcagt

SEQ ID NO: 166335 - DNA, 20 bp, Artificial
  CRISPR gRNA sequence
agtaggtgctcagtaaatgt

SEQ ID NO: 166336 - DNA, 20 bp, Artificial
  CRISPR gRNA sequence
gtaggtgctcagtaaatgtt

SEQ ID NO: 166337 - DNA, 20 bp, Artificial
  CRISPR gRNA sequence
agtaaatgtttgttgaatga

SEQ ID NO: 166338 - DNA, 20 bp, Artificial
  CRISPR gRNA sequence
gttgaatgaagctgaatgaa

SEQ ID NO: 166339 - DNA, 20 bp, Artificial
  CRISPR gRNA sequence
ttgaatgaagctgaatgaat

SEQ ID NO: 166340 - DNA, 20 bp, Artificial
  CRISPR gRNA sequence
aatgaagctgaatgaataat

SEQ ID NO: 166341 - DNA, 20 bp, Artificial
  CRISPR gRNA sequence
aatgaataatatgtaaataa

SEQ ID NO: 166342 - DNA, 20 bp, Artificial
  CRISPR gRNA sequence
agctaatatgaatggcaatc

SEQ ID NO: 166343 - DNA, 20 bp, Artificial
  CRISPR gRNA sequence
atatgaatggcaatcctgct

SEQ ID NO: 166344 - DNA, 20 bp, Artificial
  CRISPR gRNA sequence
ctggccacagagcagttaac

SEQ ID NO: 166345 - DNA, 20 bp, Artificial
  CRISPR gRNA sequence
gccacagagcagttaacctt

SEQ ID NO: 166346 - DNA, 20 bp, Artificial
  CRISPR gRNA sequence
accttcttatctatgtggaa

SEQ ID NO: 166347 - DNA, 20 bp, Artificial
  CRISPR gRNA sequence
cttatctatgtggaatattt

SEQ ID NO: 166348 - DNA, 20 bp, Artificial
  CRISPR gRNA sequence
ttatctatgtggaatatttt

SEQ ID NO: 166349 - DNA, 20 bp, Artificial
  CRISPR gRNA sequence
atctatgtggaatattttcc

SEQ ID NO: 166350 - DNA, 20 bp, Artificial
  CRISPR gRNA sequence
tctatgtggaatattttcca

SEQ ID NO: 166351 - DNA, 20 bp, Artificial
  CRISPR gRNA sequence
tgtggaatattttccatttg

SEQ ID NO: 166352 - DNA, 20 bp, Artificial
  CRISPR gRNA sequence
tccatttgtctcaggctcac

SEQ ID NO: 166353 - DNA, 20 bp, Artificial
  CRISPR gRNA sequence
ccatttgtctcaggctcact

SEQ ID NO: 166354 - DNA, 20 bp, Artificial
  CRISPR gRNA sequence
catttgtctcaggctcactt

SEQ ID NO: 166355 - DNA, 20 bp, Artificial
  CRISPR gRNA sequence
gtctcaggctcacttgttta

SEQ ID NO: 166356 - DNA, 20 bp, Artificial
  CRISPR gRNA sequence
tctcaggctcacttgtttat

SEQ ID NO: 166357 - DNA, 20 bp, Artificial
  CRISPR gRNA sequence
aggctcacttgtttattctg

SEQ ID NO: 166358 - DNA, 20 bp, Artificial
  CRISPR gRNA sequence
acttgtttattctgcaacat

SEQ ID NO: 166359 - DNA, 20 bp, Artificial
  CRISPR gRNA sequence
gtttattctgcaacatttct

SEQ ID NO: 166360 - DNA, 20 bp, Artificial
  CRISPR gRNA sequence
tttattctgcaacatttctg

SEQ ID NO: 166361 - DNA, 20 bp, Artificial
  CRISPR gRNA sequence
attctgcaacatttctggaa

SEQ ID NO: 166362 - DNA, 20 bp, Artificial
  CRISPR gRNA sequence
ttctgcaacatttctggaat

SEQ ID NO: 166363 - DNA, 20 bp, Artificial
  CRISPR gRNA sequence
tgcaacatttctggaatact

SEQ ID NO: 166364 - DNA, 20 bp, Artificial
  CRISPR gRNA sequence
caacatttctggaatactaa

SEQ ID NO: 166365 - DNA, 20 bp, Artificial
  CRISPR gRNA sequence
ctggaatactaactttgtat

SEQ ID NO: 166366 - DNA, 20 bp, Artificial
  CRISPR gRNA sequence
tggaatactaactttgtatg

SEQ ID NO: 166367 - DNA, 20 bp, Artificial
  CRISPR gRNA sequence
gaatactaactttgtatggg

SEQ ID NO: 166368 - DNA, 20 bp, Artificial
  CRISPR gRNA sequence
actttgtatgggctcctgcc

SEQ ID NO: 166369 - DNA, 20 bp, Artificial
  CRISPR gRNA sequence
tgtatgggctcctgccctca

SEQ ID NO: 166370 - DNA, 20 bp, Artificial
  CRISPR gRNA sequence
gtatgggctcctgccctcag

SEQ ID NO: 166371 - DNA, 20 bp, Artificial
  CRISPR gRNA sequence
tatgggctcctgccctcagg

SEQ ID NO: 166372 - DNA, 20 bp, Artificial
  CRISPR gRNA sequence
ctgccctcaggcatcttata

SEQ ID NO: 166373 - DNA, 20 bp, Artificial
  CRISPR gRNA sequence
ccctcaggcatcttataggc

SEQ ID NO: 166374 - DNA, 20 bp, Artificial
  CRISPR gRNA sequence
aggcatcttataggctgttg

SEQ ID NO: 166375 - DNA, 20 bp, Artificial
  CRISPR gRNA sequence
ataggctgttggaaggaaaa

SEQ ID NO: 166376 - DNA, 20 bp, Artificial
  CRISPR gRNA sequence
taggctgttggaaggaaaag

SEQ ID NO: 166377 - DNA, 20 bp, Artificial
  CRISPR gRNA sequence
ttggaaggaaaaggaccaaa

SEQ ID NO: 166378 - DNA, 20 bp, Artificial
  CRISPR gRNA sequence
gaaggaaaaggaccaaaata

SEQ ID NO: 166379 - DNA, 20 bp, Artificial
  CRISPR gRNA sequence
tcatacctgttccctttctt

SEQ ID NO: 166380 - DNA, 20 bp, Artificial
  CRISPR gRNA sequence
ttccctttcttgttcctcat

SEQ ID NO: 166381 - DNA, 20 bp, Artificial
  CRISPR gRNA sequence
cctttcttgttcctcatagc

SEQ ID NO: 166382 - DNA, 20 bp, Artificial
  CRISPR gRNA sequence
tcttgttcctcatagcctca

SEQ ID NO: 166383 - DNA, 20 bp, Artificial
  CRISPR gRNA sequence
cttgttcctcatagcctcat

SEQ ID NO: 166384 - DNA, 20 bp, Artificial
  CRISPR gRNA sequence
ttgttcctcatagcctcatg

SEQ ID NO: 166385 - DNA, 20 bp, Artificial
  CRISPR gRNA sequence
gttcctcatagcctcatggg

SEQ ID NO: 166386 - DNA, 20 bp, Artificial
  CRISPR gRNA sequence
ttcctcatagcctcatgggt

SEQ ID NO: 166387 - DNA, 20 bp, Artificial
  CRISPR gRNA sequence
ctcatagcctcatgggtagg

SEQ ID NO: 166388 - DNA, 20 bp, Artificial
  CRISPR gRNA sequence
atagcctcatgggtaggcct

SEQ ID NO: 166389 - DNA, 20 bp, Artificial
  CRISPR gRNA sequence
atgggtaggcctgcaggggt

SEQ ID NO: 166390 - DNA, 20 bp, Artificial
  CRISPR gRNA sequence
caggggttgtttttggccat

SEQ ID NO: 166391 - DNA, 20 bp, Artificial
  CRISPR gRNA sequence
tttttggccatggtgaggac

SEQ ID NO: 166392 - DNA, 20 bp, Artificial
  CRISPR gRNA sequence
ttggccatggtgaggacatt

SEQ ID NO: 166393 - DNA, 20 bp, Artificial
  CRISPR gRNA sequence
tggccatggtgaggacattt

SEQ ID NO: 166394 - DNA, 20 bp, Artificial
  CRISPR gRNA sequence
ggccatggtgaggacatttg

SEQ ID NO: 166395 - DNA, 20 bp, Artificial
  CRISPR gRNA sequence
gccatggtgaggacatttga

SEQ ID NO: 166396 - DNA, 20 bp, Artificial
  CRISPR gRNA sequence
gagaggacagtccttgtctt

SEQ ID NO: 166397 - DNA, 20 bp, Artificial
  CRISPR gRNA sequence
agaggacagtccttgtcttg

SEQ ID NO: 166398 - DNA, 20 bp, Artificial
  CRISPR gRNA sequence
gtcttgcaggctggctgtga

SEQ ID NO: 166399 - DNA, 20 bp, Artificial
  CRISPR gRNA sequence
tcttgcaggctggctgtgat

SEQ ID NO: 166400 - DNA, 20 bp, Artificial
  CRISPR gRNA sequence
gcaggctggctgtgatgatt

SEQ ID NO: 166401 - DNA, 20 bp, Artificial
  CRISPR gRNA sequence
caggctggctgtgatgattc

SEQ ID NO: 166402 - DNA, 20 bp, Artificial
  CRISPR gRNA sequence
gctgtgatgattccaggaaa

SEQ ID NO: 166403 - DNA, 20 bp, Artificial
  CRISPR gRNA sequence
tgatgattccaggaaatggt

SEQ ID NO: 166404 - DNA, 20 bp, Artificial
  CRISPR gRNA sequence
caggaaatggtacacagagg

SEQ ID NO: 166405 - DNA, 20 bp, Artificial
  CRISPR gRNA sequence
ctggccaaatgttccatagg

SEQ ID NO: 166406 - DNA, 20 bp, Artificial
  CRISPR gRNA sequence
gccaaatgttccataggaac

SEQ ID NO: 166407 - DNA, 20 bp, Artificial
  CRISPR gRNA sequence
cataggaacacatgtgcatg

SEQ ID NO: 166408 - DNA, 20 bp, Artificial
  CRISPR gRNA sequence
ctttctagtttaccgagctg

SEQ ID NO: 166409 - DNA, 20 bp, Artificial
  CRISPR gRNA sequence
tttctagtttaccgagctgc

SEQ ID NO: 166410 - DNA, 20 bp, Artificial
  CRISPR gRNA sequence
tctagtttaccgagctgctc

SEQ ID NO: 166411 - DNA, 20 bp, Artificial
  CRISPR gRNA sequence
ctagtttaccgagctgctcc

SEQ ID NO: 166412 - DNA, 20 bp, Artificial
  CRISPR gRNA sequence
tagtttaccgagctgctccc

SEQ ID NO: 166413 - DNA, 20 bp, Artificial
  CRISPR gRNA sequence
gtttaccgagctgctcccag

SEQ ID NO: 166414 - DNA, 20 bp, Artificial
  CRISPR gRNA sequence
accgagctgctcccagcagt

SEQ ID NO: 166415 - DNA, 20 bp, Artificial
  CRISPR gRNA sequence
ccgagctgctcccagcagtt

SEQ ID NO: 166416 - DNA, 20 bp, Artificial
  CRISPR gRNA sequence
ctcccagcagttgtcattat

SEQ ID NO: 166417 - DNA, 20 bp, Artificial
  CRISPR gRNA sequence
ccagcagttgtcattatata

SEQ ID NO: 166418 - DNA, 20 bp, Artificial
  CRISPR gRNA sequence
tcattatatatgcagttcta

SEQ ID NO: 166419 - DNA, 20 bp, Artificial
  CRISPR gRNA sequence
tatatgcagttctacatgtc

SEQ ID NO: 166420 - DNA, 20 bp, Artificial
  CRISPR gRNA sequence
tacatgtcagtacatttatc

SEQ ID NO: 166421 - DNA, 20 bp, Artificial
  CRISPR gRNA sequence
catgtcagtacatttatcta

SEQ ID NO: 166422 - DNA, 20 bp, Artificial
  CRISPR gRNA sequence
atctaaaatccattcacagt

SEQ ID NO: 166423 - DNA, 20 bp, Artificial
  CRISPR gRNA sequence
tctaaaatccattcacagtc

SEQ ID NO: 166424 - DNA, 20 bp, Artificial
  CRISPR gRNA sequence
aaatccattcacagtccaca

SEQ ID NO: 166425 - DNA, 20 bp, Artificial
  CRISPR gRNA sequence
acagtccacacataagattt

SEQ ID NO: 166426 - DNA, 20 bp, Artificial
  CRISPR gRNA sequence
taagtacttgtgataaatgt

SEQ ID NO: 166427 - DNA, 20 bp, Artificial
  CRISPR gRNA sequence
aagtacttgtgataaatgtt

SEQ ID NO: 166428 - DNA, 20 bp, Artificial
  CRISPR gRNA sequence
agtacttgtgataaatgttg

SEQ ID NO: 166429 - DNA, 20 bp, Artificial
  CRISPR gRNA sequence
gtgataaatgttgtctttgt

SEQ ID NO: 166430 - DNA, 20 bp, Artificial
  CRISPR gRNA sequence
tgataaatgttgtctttgtt

SEQ ID NO: 166431 - DNA, 20 bp, Artificial
  CRISPR gRNA sequence
tctttgttccactcccggtc

SEQ ID NO: 166432 - DNA, 20 bp, Artificial
  CRISPR gRNA sequence
tgttccactcccggtccctc

SEQ ID NO: 166433 - DNA, 20 bp, Artificial
  CRISPR gRNA sequence
gttccactcccggtccctcc

SEQ ID NO: 166434 - DNA, 20 bp, Artificial
  CRISPR gRNA sequence
ttccactcccggtccctccc

SEQ ID NO: 166435 - DNA, 20 bp, Artificial
  CRISPR gRNA sequence
cactcccggtccctcccctt

SEQ ID NO: 166436 - DNA, 20 bp, Artificial
  CRISPR gRNA sequence
ccggtccctccccttttctc

SEQ ID NO: 166437 - DNA, 20 bp, Artificial
  CRISPR gRNA sequence
cccttttctcctcccctcct

SEQ ID NO: 166438 - DNA, 20 bp, Artificial
  CRISPR gRNA sequence
ttctcctcccctcctttggc

SEQ ID NO: 166439 - DNA, 20 bp, Artificial
  CRISPR gRNA sequence
tctcctcccctcctttggcc

SEQ ID NO: 166440 - DNA, 20 bp, Artificial
  CRISPR gRNA sequence
ctcctcccctcctttggccc

SEQ ID NO: 166441 - DNA, 20 bp, Artificial
  CRISPR gRNA sequence
tcctcccctcctttggccca

SEQ ID NO: 166442 - DNA, 20 bp, Artificial
  CRISPR gRNA sequence
ctcccctcctttggcccaga

SEQ ID NO: 166443 - DNA, 20 bp, Artificial
  CRISPR gRNA sequence
ccctcctttggcccagaggg

SEQ ID NO: 166444 - DNA, 20 bp, Artificial
  CRISPR gRNA sequence
ctttggcccagagggctgca

SEQ ID NO: 166445 - DNA, 20 bp, Artificial
  CRISPR gRNA sequence
tggcccagagggctgcacag

SEQ ID NO: 166446 - DNA, 20 bp, Artificial
  CRISPR gRNA sequence
ggcccagagggctgcacagt

SEQ ID NO: 166447 - DNA, 20 bp, Artificial
  CRISPR gRNA sequence
gcccagagggctgcacagtg

SEQ ID NO: 166448 - DNA, 20 bp, Artificial
  CRISPR gRNA sequence
cacagtgcctctctcggaaa

SEQ ID NO: 166449 - DNA, 20 bp, Artificial
  CRISPR gRNA sequence
tctcggaaaaagtacttcat

SEQ ID NO: 166450 - DNA, 20 bp, Artificial
  CRISPR gRNA sequence
tcggaaaaagtacttcatag

SEQ ID NO: 166451 - DNA, 20 bp, Artificial
  CRISPR gRNA sequence
ggaaaaagtacttcataggt

SEQ ID NO: 166452 - DNA, 20 bp, Artificial
  CRISPR gRNA sequence
cataggtttgccatgaggac

SEQ ID NO: 166453 - DNA, 20 bp, Artificial
  CRISPR gRNA sequence
ataggtttgccatgaggact

SEQ ID NO: 166454 - DNA, 20 bp, Artificial
  CRISPR gRNA sequence
gccatgaggactgctgggac

SEQ ID NO: 166455 - DNA, 20 bp, Artificial
  CRISPR gRNA sequence
ccatgaggactgctgggacc

SEQ ID NO: 166456 - DNA, 20 bp, Artificial
  CRISPR gRNA sequence
ctgggaccaaggccacttgc

SEQ ID NO: 166457 - DNA, 20 bp, Artificial
  CRISPR gRNA sequence
ggaccaaggccacttgctcg

SEQ ID NO: 166458 - DNA, 20 bp, Artificial
  CRISPR gRNA sequence
gctcgccagggtgtttcata

SEQ ID NO: 166459 - DNA, 20 bp, Artificial
  CRISPR gRNA sequence
ctcgccagggtgtttcatat

SEQ ID NO: 166460 - DNA, 20 bp, Artificial
  CRISPR gRNA sequence
gccagggtgtttcatattcc

SEQ ID NO: 166461 - DNA, 20 bp, Artificial
  CRISPR gRNA sequence
catattccagtcagatgatc

SEQ ID NO: 166462 - DNA, 20 bp, Artificial
  CRISPR gRNA sequence
atattccagtcagatgatct

SEQ ID NO: 166463 - DNA, 20 bp, Artificial
  CRISPR gRNA sequence
cagtcagatgatctgggtga

SEQ ID NO: 166464 - DNA, 20 bp, Artificial
  CRISPR gRNA sequence
ggtgatacgggtttggtttg

SEQ ID NO: 166465 - DNA, 20 bp, Artificial
  CRISPR gRNA sequence
ggtttggagcccaccttcca

SEQ ID NO: 166466 - DNA, 20 bp, Artificial
  CRISPR gRNA sequence
gtttggagcccaccttccaa

SEQ ID NO: 166467 - DNA, 20 bp, Artificial
  CRISPR gRNA sequence
ggagcccaccttccaagaat

SEQ ID NO: 166468 - DNA, 20 bp, Artificial
  CRISPR gRNA sequence
gagcccaccttccaagaatg

SEQ ID NO: 166469 - DNA, 20 bp, Artificial
  CRISPR gRNA sequence
ccaagaatgaaagaggccac

SEQ ID NO: 166470 - DNA, 20 bp, Artificial
  CRISPR gRNA sequence
caagaatgaaagaggccact

SEQ ID NO: 166471 - DNA, 20 bp, Artificial
  CRISPR gRNA sequence
accactttgtctgacacttt

SEQ ID NO: 166472 - DNA, 20 bp, Artificial
  CRISPR gRNA sequence
ccactttgtctgacactttg

SEQ ID NO: 166473 - DNA, 20 bp, Artificial
  CRISPR gRNA sequence
tgtctgacactttgcagtcc

SEQ ID NO: 166474 - DNA, 20 bp, Artificial
  CRISPR gRNA sequence
gtctgacactttgcagtccg

SEQ ID NO: 166475 - DNA, 20 bp, Artificial
  CRISPR gRNA sequence
tctgacactttgcagtccgc

SEQ ID NO: 166476 - DNA, 20 bp, Artificial
  CRISPR gRNA sequence
acactttgcagtccgccttc

SEQ ID NO: 166477 - DNA, 20 bp, Artificial
  CRISPR gRNA sequence
tgcagtccgccttcactggc

SEQ ID NO: 166478 - DNA, 20 bp, Artificial
  CRISPR gRNA sequence
gcagtccgccttcactggct

SEQ ID NO: 166479 - DNA, 20 bp, Artificial
  CRISPR gRNA sequence
cagtccgccttcactggctg

SEQ ID NO: 166480 - DNA, 20 bp, Artificial
  CRISPR gRNA sequence
cactggctgaaagactgact

SEQ ID NO: 166481 - DNA, 20 bp, Artificial
  CRISPR gRNA sequence
actggctgaaagactgactc

SEQ ID NO: 166482 - DNA, 20 bp, Artificial
  CRISPR gRNA sequence
gctgaaagactgactcttag

SEQ ID NO: 166483 - DNA, 20 bp, Artificial
  CRISPR gRNA sequence
aaagactgactcttaggact

SEQ ID NO: 166484 - DNA, 20 bp, Artificial
  CRISPR gRNA sequence
actcttaggacttctacccc

SEQ ID NO: 166485 - DNA, 20 bp, Artificial
  CRISPR gRNA sequence
ttaggacttctaccccaaac

SEQ ID NO: 166486 - DNA, 20 bp, Artificial
  CRISPR gRNA sequence
aggacttctaccccaaacca

SEQ ID NO: 166487 - DNA, 20 bp, Artificial
  CRISPR gRNA sequence
ggacttctaccccaaaccat

SEQ ID NO: 166488 - DNA, 20 bp, Artificial
  CRISPR gRNA sequence
ctaccccaaaccatagcacc

SEQ ID NO: 166489 - DNA, 20 bp, Artificial
  CRISPR gRNA sequence
taccccaaaccatagcacct

SEQ ID NO: 166490 - DNA, 20 bp, Artificial
  CRISPR gRNA sequence
ccccaaaccatagcacctag

SEQ ID NO: 166491 - DNA, 20 bp, Artificial
  CRISPR gRNA sequence
gggtccatgtgttctgtttg

SEQ ID NO: 166492 - DNA, 20 bp, Artificial
  CRISPR gRNA sequence
tgtttgagcctcagagtttg

SEQ ID NO: 166493 - DNA, 20 bp, Artificial
  CRISPR gRNA sequence
tttgagcctcagagtttgag

SEQ ID NO: 166494 - DNA, 20 bp, Artificial
  CRISPR gRNA sequence
gagcctcagagtttgagatg

SEQ ID NO: 166495 - DNA, 20 bp, Artificial
  CRISPR gRNA sequence
agcctcagagtttgagatga

SEQ ID NO: 166496 - DNA, 20 bp, Artificial
  CRISPR gRNA sequence
agagtttgagatgagtgggt

SEQ ID NO: 166497 - DNA, 20 bp, Artificial
  CRISPR gRNA sequence
gagatgagtgggtggttgag

SEQ ID NO: 166498 - DNA, 20 bp, Artificial
  CRISPR gRNA sequence
agatgagtgggtggttgagg

SEQ ID NO: 166499 - DNA, 20 bp, Artificial
  CRISPR gRNA sequence
agggagtaggcattcattag

SEQ ID NO: 166500 - DNA, 20 bp, Artificial
  CRISPR gRNA sequence
attagagagatgggtgtggg

SEQ ID NO: 166501 - DNA, 20 bp, Artificial
  CRISPR gRNA sequence
gagagatgggtgtgggaact

SEQ ID NO: 166502 - DNA, 20 bp, Artificial
  CRISPR gRNA sequence
tctattatgtgctccaggat

SEQ ID NO: 166503 - DNA, 20 bp, Artificial
  CRISPR gRNA sequence
ttatgtgctccaggattctc

SEQ ID NO: 166504 - DNA, 20 bp, Artificial
  CRISPR gRNA sequence
tgtgctccaggattctcgat

SEQ ID NO: 166505 - DNA, 20 bp, Artificial
  CRISPR gRNA sequence
caggattctcgatgtcactt

SEQ ID NO: 166506 - DNA, 20 bp, Artificial
  CRISPR gRNA sequence
tcgatgtcactttgtgctgc

SEQ ID NO: 166507 - DNA, 20 bp, Artificial
  CRISPR gRNA sequence
gatgtcactttgtgctgcca

SEQ ID NO: 166508 - DNA, 20 bp, Artificial
  CRISPR gRNA sequence
tgtgctgccaactcttgacg

SEQ ID NO: 166509 - DNA, 20 bp, Artificial
  CRISPR gRNA sequence
gtgctgccaactcttgacgt

SEQ ID NO: 166510 - DNA, 20 bp, Artificial
  CRISPR gRNA sequence
tgctgccaactcttgacgta

SEQ ID NO: 166511 - DNA, 20 bp, Artificial
  CRISPR gRNA sequence
ccaactcttgacgtagccat

SEQ ID NO: 166512 - DNA, 20 bp, Artificial
  CRISPR gRNA sequence
ttgacgtagccatcagtgct

SEQ ID NO: 166513 - DNA, 20 bp, Artificial
  CRISPR gRNA sequence
gacgtagccatcagtgctag

SEQ ID NO: 166514 - DNA, 20 bp, Artificial
  CRISPR gRNA sequence
acgtagccatcagtgctaga

SEQ ID NO: 166515 - DNA, 20 bp, Artificial
  CRISPR gRNA sequence
gattaggaggggtgcttgct

SEQ ID NO: 166516 - DNA, 20 bp, Artificial
  CRISPR gRNA sequence
ggaggggtgcttgcttgctt

SEQ ID NO: 166517 - DNA, 20 bp, Artificial
  CRISPR gRNA sequence
gcttgcttactacccattga

SEQ ID NO: 166518 - DNA, 20 bp, Artificial
  CRISPR gRNA sequence
cttgcttactacccattgag

SEQ ID NO: 166519 - DNA, 20 bp, Artificial
  CRISPR gRNA sequence
gcttactacccattgagcac

SEQ ID NO: 166520 - DNA, 20 bp, Artificial
  CRISPR gRNA sequence
cttactacccattgagcacc

SEQ ID NO: 166521 - DNA, 20 bp, Artificial
  CRISPR gRNA sequence
actacccattgagcacctgc

SEQ ID NO: 166522 - DNA, 20 bp, Artificial
  CRISPR gRNA sequence
ctacccattgagcacctgct

SEQ ID NO: 166523 - DNA, 20 bp, Artificial
  CRISPR gRNA sequence
cccattgagcacctgctggg

SEQ ID NO: 166524 - DNA, 20 bp, Artificial
  CRISPR gRNA sequence
agcacctgctgggcacttta

SEQ ID NO: 166525 - DNA, 20 bp, Artificial
  CRISPR gRNA sequence
ctgggcactttatatgcatt

SEQ ID NO: 166526 - DNA, 20 bp, Artificial
  CRISPR gRNA sequence
ggcactttatatgcattgtc

SEQ ID NO: 166527 - DNA, 20 bp, Artificial
  CRISPR gRNA sequence
tatatgcattgtctcatttg

SEQ ID NO: 166528 - DNA, 20 bp, Artificial
  CRISPR gRNA sequence
atatgcattgtctcatttga

SEQ ID NO: 166529 - DNA, 20 bp, Artificial
  CRISPR gRNA sequence
tatgcattgtctcatttgat

SEQ ID NO: 166530 - DNA, 20 bp, Artificial
  CRISPR gRNA sequence
tctcatttgatctttatgac

SEQ ID NO: 166531 - DNA, 20 bp, Artificial
  CRISPR gRNA sequence
atttgatctttatgaccctc

SEQ ID NO: 166532 - DNA, 20 bp, Artificial
  CRISPR gRNA sequence
gatctttatgaccctctttt

SEQ ID NO: 166533 - DNA, 20 bp, Artificial
  CRISPR gRNA sequence
atctttatgaccctcttttg

SEQ ID NO: 166534 - DNA, 20 bp, Artificial
  CRISPR gRNA sequence
tatgaccctcttttgggtgg

SEQ ID NO: 166535 - DNA, 20 bp, Artificial
  CRISPR gRNA sequence
atgaccctcttttgggtggt

SEQ ID NO: 166536 - DNA, 20 bp, Artificial
  CRISPR gRNA sequence
tgaccctcttttgggtggtg

SEQ ID NO: 166537 - DNA, 20 bp, Artificial
  CRISPR gRNA sequence
ttttgggtggtgggctggtg

SEQ ID NO: 166538 - DNA, 20 bp, Artificial
  CRISPR gRNA sequence
ttgggtggtgggctggtgga

SEQ ID NO: 166539 - DNA, 20 bp, Artificial
  CRISPR gRNA sequence
tgggtggtgggctggtggat

SEQ ID NO: 166540 - DNA, 20 bp, Artificial
  CRISPR gRNA sequence
gggtggtgggctggtggatc

SEQ ID NO: 166541 - DNA, 20 bp, Artificial
  CRISPR gRNA sequence
ggtggtgggctggtggatca

SEQ ID NO: 166542 - DNA, 20 bp, Artificial
  CRISPR gRNA sequence
gtggatcagaccctgcagct

SEQ ID NO: 166543 - DNA, 20 bp, Artificial
  CRISPR gRNA sequence
cagctgacataccaactcta

SEQ ID NO: 166544 - DNA, 20 bp, Artificial
  CRISPR gRNA sequence
acataccaactctaccatct

SEQ ID NO: 166545 - DNA, 20 bp, Artificial
  CRISPR gRNA sequence
taccatcttgattcttacag

SEQ ID NO: 166546 - DNA, 20 bp, Artificial
  CRISPR gRNA sequence
ccatcttgattcttacagat

SEQ ID NO: 166547 - DNA, 20 bp, Artificial
  CRISPR gRNA sequence
gattcttacagattacacag

SEQ ID NO: 166548 - DNA, 20 bp, Artificial
  CRISPR gRNA sequence
attcttacagattacacaga

SEQ ID NO: 166549 - DNA, 20 bp, Artificial
  CRISPR gRNA sequence
ttacagattacacagacaga

SEQ ID NO: 166550 - DNA, 20 bp, Artificial
  CRISPR gRNA sequence
acagattacacagacagagg

SEQ ID NO: 166551 - DNA, 20 bp, Artificial
  CRISPR gRNA sequence
cagattacacagacagaggt

SEQ ID NO: 166552 - DNA, 20 bp, Artificial
  CRISPR gRNA sequence
cacagacagaggtccagcaa

SEQ ID NO: 166553 - DNA, 20 bp, Artificial
  CRISPR gRNA sequence
agccagttcacagatggaca

SEQ ID NO: 166554 - DNA, 20 bp, Artificial
  CRISPR gRNA sequence
acagatggacaggtagggta

SEQ ID NO: 166555 - DNA, 20 bp, Artificial
  CRISPR gRNA sequence
ggctgggcagagggtgagga

SEQ ID NO: 166556 - DNA, 20 bp, Artificial
  CRISPR gRNA sequence
ggcagagggtgaggatttgc

SEQ ID NO: 166557 - DNA, 20 bp, Artificial
  CRISPR gRNA sequence
gcggggcagggtagcaggta

SEQ ID NO: 166558 - DNA, 20 bp, Artificial
  CRISPR gRNA sequence
cggggcagggtagcaggtag

SEQ ID NO: 166559 - DNA, 20 bp, Artificial
  CRISPR gRNA sequence
ggtttggatggttagggcaa

SEQ ID NO: 166560 - DNA, 20 bp, Artificial
  CRISPR gRNA sequence
ggatggttagggcaactgtc

SEQ ID NO: 166561 - DNA, 20 bp, Artificial
  CRISPR gRNA sequence
gatggttagggcaactgtcc

SEQ ID NO: 166562 - DNA, 20 bp, Artificial
  CRISPR gRNA sequence
gggcaactgtcctgtcctct

SEQ ID NO: 166563 - DNA, 20 bp, Artificial
  CRISPR gRNA sequence
tcctgtcctctactaacagt

SEQ ID NO: 166564 - DNA, 20 bp, Artificial
  CRISPR gRNA sequence
tcctctactaacagtgagtg

SEQ ID NO: 166565 - DNA, 20 bp, Artificial
  CRISPR gRNA sequence
tactaacagtgagtggacag

SEQ ID NO: 166566 - DNA, 20 bp, Artificial
  CRISPR gRNA sequence
ctaacagtgagtggacagaa

SEQ ID NO: 166567 - DNA, 20 bp, Artificial
  CRISPR gRNA sequence
acagtgagtggacagaaatt

SEQ ID NO: 166568 - DNA, 20 bp, Artificial
  CRISPR gRNA sequence
ttaaaacaagtacggtattt

SEQ ID NO: 166569 - DNA, 20 bp, Artificial
  CRISPR gRNA sequence
aaacaagtacggtatttaaa

SEQ ID NO: 166570 - DNA, 20 bp, Artificial
  CRISPR gRNA sequence
aaatcagggcacctatcctt

SEQ ID NO: 166571 - DNA, 20 bp, Artificial
  CRISPR gRNA sequence
aatcagggcacctatccttt

SEQ ID NO: 166572 - DNA, 20 bp, Artificial
  CRISPR gRNA sequence
tcctttagttttatagactt

SEQ ID NO: 166573 - DNA, 20 bp, Artificial
  CRISPR gRNA sequence
tagttttatagacttagtgg

SEQ ID NO: 166574 - DNA, 20 bp, Artificial
  CRISPR gRNA sequence
agttttatagacttagtggg

SEQ ID NO: 166575 - DNA, 20 bp, Artificial
  CRISPR gRNA sequence
gttttatagacttagtggga

SEQ ID NO: 166576 - DNA, 20 bp, Artificial
  CRISPR gRNA sequence
tatagacttagtgggaacta

SEQ ID NO: 166577 - DNA, 20 bp, Artificial
  CRISPR gRNA sequence
atagacttagtgggaactaa

SEQ ID NO: 166578 - DNA, 20 bp, Artificial
  CRISPR gRNA sequence
tagacttagtgggaactaaa

SEQ ID NO: 166579 - DNA, 20 bp, Artificial
  CRISPR gRNA sequence
agtgggaactaaaataatct

SEQ ID NO: 166580 - DNA, 20 bp, Artificial
  CRISPR gRNA sequence
gtgggaactaaaataatctt

SEQ ID NO: 166581 - DNA, 20 bp, Artificial
  CRISPR gRNA sequence
aaataatcttagacatgtag

SEQ ID NO: 166582 - DNA, 20 bp, Artificial
  CRISPR gRNA sequence
agacatgtagcccaaattgc

SEQ ID NO: 166583 - DNA, 20 bp, Artificial
  CRISPR gRNA sequence
gacatgtagcccaaattgcc

SEQ ID NO: 166584 - DNA, 20 bp, Artificial
  CRISPR gRNA sequence
ccattttacagatgagtaaa

SEQ ID NO: 166585 - DNA, 20 bp, Artificial
  CRISPR gRNA sequence
tacagatgagtaaactgaac

SEQ ID NO: 166586 - DNA, 20 bp, Artificial
  CRISPR gRNA sequence
acagatgagtaaactgaacc

SEQ ID NO: 166587 - DNA, 20 bp, Artificial
  CRISPR gRNA sequence
cagatgagtaaactgaaccc

SEQ ID NO: 166588 - DNA, 20 bp, Artificial
  CRISPR gRNA sequence
aaccctggagatgggaagtg

SEQ ID NO: 166589 - DNA, 20 bp, Artificial
  CRISPR gRNA sequence
gagatgggaagtgccttgtc

SEQ ID NO: 166590 - DNA, 20 bp, Artificial
  CRISPR gRNA sequence
gtccatgctcccctagatgt

SEQ ID NO: 166591 - DNA, 20 bp, Artificial
  CRISPR gRNA sequence
tccatgctcccctagatgtt

SEQ ID NO: 166592 - DNA, 20 bp, Artificial
  CRISPR gRNA sequence
ccctagatgttcattgcaga

SEQ ID NO: 166593 - DNA, 20 bp, Artificial
  CRISPR gRNA sequence
gatgttcattgcagagccag

SEQ ID NO: 166594 - DNA, 20 bp, Artificial
  CRISPR gRNA sequence
attgcagagccaggactaga

SEQ ID NO: 166595 - DNA, 20 bp, Artificial
  CRISPR gRNA sequence
cagagccaggactagagagc

SEQ ID NO: 166596 - DNA, 20 bp, Artificial
  CRISPR gRNA sequence
gagagcaggtttcctgtttc

SEQ ID NO: 166597 - DNA, 20 bp, Artificial
  CRISPR gRNA sequence
cctgtttccctctctagaac

SEQ ID NO: 166598 - DNA, 20 bp, Artificial
  CRISPR gRNA sequence
ctgtttccctctctagaact

SEQ ID NO: 166599 - DNA, 20 bp, Artificial
  CRISPR gRNA sequence
tttccctctctagaactgta

SEQ ID NO: 166600 - DNA, 20 bp, Artificial
  CRISPR gRNA sequence
ccctctctagaactgtattt

SEQ ID NO: 166601 - DNA, 20 bp, Artificial
  CRISPR gRNA sequence
cctctctagaactgtatttt

SEQ ID NO: 166602 - DNA, 20 bp, Artificial
  CRISPR gRNA sequence
tctagaactgtatttttttc

SEQ ID NO: 166603 - DNA, 20 bp, Artificial
  CRISPR gRNA sequence
tagaactgtatttttttccc

SEQ ID NO: 166604 - DNA, 20 bp, Artificial
  CRISPR gRNA sequence
gaactgtatttttttcccct

SEQ ID NO: 166605 - DNA, 20 bp, Artificial
  CRISPR gRNA sequence
tatttttttcccctctaagc

SEQ ID NO: 166606 - DNA, 20 bp, Artificial
  CRISPR gRNA sequence
ttttcccctctaagccatga

SEQ ID NO: 166607 - DNA, 20 bp, Artificial
  CRISPR gRNA sequence
tttcccctctaagccatgat

SEQ ID NO: 166608 - DNA, 20 bp, Artificial
  CRISPR gRNA sequence
ttcccctctaagccatgatg

SEQ ID NO: 166609 - DNA, 20 bp, Artificial
  CRISPR gRNA sequence
tcccctctaagccatgatgc

SEQ ID NO: 166610 - DNA, 20 bp, Artificial
  CRISPR gRNA sequence
cccctctaagccatgatgct

SEQ ID NO: 166611 - DNA, 20 bp, Artificial
  CRISPR gRNA sequence
ccctctaagccatgatgctg

SEQ ID NO: 166612 - DNA, 20 bp, Artificial
  CRISPR gRNA sequence
taagccatgatgctgtttta

SEQ ID NO: 166613 - DNA, 20 bp, Artificial
  CRISPR gRNA sequence
agccatgatgctgttttaat

SEQ ID NO: 166614 - DNA, 20 bp, Artificial
  CRISPR gRNA sequence
ttttaatagcatggactgtt

SEQ ID NO: 166615 - DNA, 20 bp, Artificial
  CRISPR gRNA sequence
taatagcatggactgttgag

SEQ ID NO: 166616 - DNA, 20 bp, Artificial
  CRISPR gRNA sequence
aatagcatggactgttgaga

SEQ ID NO: 166617 - DNA, 20 bp, Artificial
  CRISPR gRNA sequence
atagcatggactgttgagac

SEQ ID NO: 166618 - DNA, 20 bp, Artificial
  CRISPR gRNA sequence
ttgagacgcagagaacacgt

SEQ ID NO: 166619 - DNA, 20 bp, Artificial
  CRISPR gRNA sequence
agacgcagagaacacgtgac

SEQ ID NO: 166620 - DNA, 20 bp, Artificial
  CRISPR gRNA sequence
ttgagctctctgggtgcctg

SEQ ID NO: 166621 - DNA, 20 bp, Artificial
  CRISPR gRNA sequence
gagctctctgggtgcctgaa

SEQ ID NO: 166622 - DNA, 20 bp, Artificial
  CRISPR gRNA sequence
agctctctgggtgcctgaaa

SEQ ID NO: 166623 - DNA, 20 bp, Artificial
  CRISPR gRNA sequence
tctgggtgcctgaaattcag

SEQ ID NO: 166624 - DNA, 20 bp, Artificial
  CRISPR gRNA sequence
tgggtgcctgaaattcagtc

SEQ ID NO: 166625 - DNA, 20 bp, Artificial
  CRISPR gRNA sequence
ggtgcctgaaattcagtcat

SEQ ID NO: 166626 - DNA, 20 bp, Artificial
  CRISPR gRNA sequence
aaattcagtcattttcagtc

SEQ ID NO: 166627 - DNA, 20 bp, Artificial
  CRISPR gRNA sequence
agtcattttcagtccatgcg

SEQ ID NO: 166628 - DNA, 20 bp, Artificial
  CRISPR gRNA sequence
tcagtccatgcgaggagaga

SEQ ID NO: 166629 - DNA, 20 bp, Artificial
  CRISPR gRNA sequence
cagtccatgcgaggagagaa

SEQ ID NO: 166630 - DNA, 20 bp, Artificial
  CRISPR gRNA sequence
agtccatgcgaggagagaat

SEQ ID NO: 166631 - DNA, 20 bp, Artificial
  CRISPR gRNA sequence
cccttttccctctgctttcc

SEQ ID NO: 166632 - DNA, 20 bp, Artificial
  CRISPR gRNA sequence
ccttttccctctgctttccc

SEQ ID NO: 166633 - DNA, 20 bp, Artificial
  CRISPR gRNA sequence
ttccctctgctttcccctca

SEQ ID NO: 166634 - DNA, 20 bp, Artificial
  CRISPR gRNA sequence
tccctctgctttcccctcac

SEQ ID NO: 166635 - DNA, 20 bp, Artificial
  CRISPR gRNA sequence
ccctctgctttcccctcaca

SEQ ID NO: 166636 - DNA, 20 bp, Artificial
  CRISPR gRNA sequence
cctctgctttcccctcacag

SEQ ID NO: 166637 - DNA, 20 bp, Artificial
  CRISPR gRNA sequence
tgctttcccctcacagtaca

SEQ ID NO: 166638 - DNA, 20 bp, Artificial
  CRISPR gRNA sequence
ctttcccctcacagtacagt

SEQ ID NO: 166639 - DNA, 20 bp, Artificial
  CRISPR gRNA sequence
tcccctcacagtacagtccc

SEQ ID NO: 166640 - DNA, 20 bp, Artificial
  CRISPR gRNA sequence
cccctcacagtacagtccca

SEQ ID NO: 166641 - DNA, 20 bp, Artificial
  CRISPR gRNA sequence
ccctcacagtacagtcccag

SEQ ID NO: 166642 - DNA, 20 bp, Artificial
  CRISPR gRNA sequence
acagtacagtcccagagacc

SEQ ID NO: 166643 - DNA, 20 bp, Artificial
  CRISPR gRNA sequence
aggacatgataggatgacat

SEQ ID NO: 166644 - DNA, 20 bp, Artificial
  CRISPR gRNA sequence
gtgccctctgctgctcaaaa

SEQ ID NO: 166645 - DNA, 20 bp, Artificial
  CRISPR gRNA sequence
tgccctctgctgctcaaaag

SEQ ID NO: 166646 - DNA, 20 bp, Artificial
  CRISPR gRNA sequence
tgctgctcaaaagggagaag

SEQ ID NO: 166647 - DNA, 20 bp, Artificial
  CRISPR gRNA sequence
ctgctcaaaagggagaagag

SEQ ID NO: 166648 - DNA, 20 bp, Artificial
  CRISPR gRNA sequence
ctcaaaagggagaagagctg

SEQ ID NO: 166649 - DNA, 20 bp, Artificial
  CRISPR gRNA sequence
aaaagggagaagagctggca

SEQ ID NO: 166650 - DNA, 20 bp, Artificial
  CRISPR gRNA sequence
gcatcaggacccacctctgg

SEQ ID NO: 166651 - DNA, 20 bp, Artificial
  CRISPR gRNA sequence
tggcttctgccagcaccaca

SEQ ID NO: 166652 - DNA, 20 bp, Artificial
  CRISPR gRNA sequence
gcttctgccagcaccacatg

SEQ ID NO: 166653 - DNA, 20 bp, Artificial
  CRISPR gRNA sequence
ctgccagcaccacatgctag

SEQ ID NO: 166654 - DNA, 20 bp, Artificial
  CRISPR gRNA sequence
tgccagcaccacatgctagg

SEQ ID NO: 166655 - DNA, 20 bp, Artificial
  CRISPR gRNA sequence
ccagcaccacatgctaggct

SEQ ID NO: 166656 - DNA, 20 bp, Artificial
  CRISPR gRNA sequence
ggcttacatgccagggctcc

SEQ ID NO: 166657 - DNA, 20 bp, Artificial
  CRISPR gRNA sequence
acatgccagggctcccatga

SEQ ID NO: 166658 - DNA, 20 bp, Artificial
  CRISPR gRNA sequence
catgccagggctcccatgag

SEQ ID NO: 166659 - DNA, 20 bp, Artificial
  CRISPR gRNA sequence
ccatgagggcttggcttttg

SEQ ID NO: 166660 - DNA, 20 bp, Artificial
  CRISPR gRNA sequence
ggcttttggcttctttgggg

SEQ ID NO: 166661 - DNA, 20 bp, Artificial
  CRISPR gRNA sequence
gcttttggcttctttgggga

SEQ ID NO: 166662 - DNA, 20 bp, Artificial
  CRISPR gRNA sequence
ttggcttctttggggagcgc

SEQ ID NO: 166663 - DNA, 20 bp, Artificial
  CRISPR gRNA sequence
tggcttctttggggagcgcc

SEQ ID NO: 166664 - DNA, 20 bp, Artificial
  CRISPR gRNA sequence
ggcttctttggggagcgcct

SEQ ID NO: 166665 - DNA, 20 bp, Artificial
  CRISPR gRNA sequence
gcttctttggggagcgcctg

SEQ ID NO: 166666 - DNA, 20 bp, Artificial
  CRISPR gRNA sequence
ctttggggagcgcctgggaa

SEQ ID NO: 166667 - DNA, 20 bp, Artificial
  CRISPR gRNA sequence
tttggggagcgcctgggaaa

SEQ ID NO: 166668 - DNA, 20 bp, Artificial
  CRISPR gRNA sequence
tggggagcgcctgggaaacc

SEQ ID NO: 166669 - DNA, 20 bp, Artificial
  CRISPR gRNA sequence
ggggagcgcctgggaaacca

SEQ ID NO: 166670 - DNA, 20 bp, Artificial
  CRISPR gRNA sequence
gggagcgcctgggaaaccaa

SEQ ID NO: 166671 - DNA, 20 bp, Artificial
  CRISPR gRNA sequence
ggaaaccaagtagtcaatta

SEQ ID NO: 166672 - DNA, 20 bp, Artificial
  CRISPR gRNA sequence
gccctgaccttcctaagtgg

SEQ ID NO: 166673 - DNA, 20 bp, Artificial
  CRISPR gRNA sequence
accttcctaagtggctgtgt

SEQ ID NO: 166674 - DNA, 20 bp, Artificial
  CRISPR gRNA sequence
cctaagtggctgtgtgagta

SEQ ID NO: 166675 - DNA, 20 bp, Artificial
  CRISPR gRNA sequence
ctaagtggctgtgtgagtat

SEQ ID NO: 166676 - DNA, 20 bp, Artificial
  CRISPR gRNA sequence
agtggctgtgtgagtatctt

SEQ ID NO: 166677 - DNA, 20 bp, Artificial
  CRISPR gRNA sequence
tgtgagtatcttctccaccc

SEQ ID NO: 166678 - DNA, 20 bp, Artificial
  CRISPR gRNA sequence
ctccacccctggagcgtctt

SEQ ID NO: 166679 - DNA, 20 bp, Artificial
  CRISPR gRNA sequence
tccacccctggagcgtcttg

SEQ ID NO: 166680 - DNA, 20 bp, Artificial
  CRISPR gRNA sequence
cacccctggagcgtcttggc

SEQ ID NO: 166681 - DNA, 20 bp, Artificial
  CRISPR gRNA sequence
gagcgtcttggctatagtta

SEQ ID NO: 166682 - DNA, 20 bp, Artificial
  CRISPR gRNA sequence
ggctatagttaagtgtttaa

SEQ ID NO: 166683 - DNA, 20 bp, Artificial
  CRISPR gRNA sequence
gctatagttaagtgtttaat

SEQ ID NO: 166684 - DNA, 20 bp, Artificial
  CRISPR gRNA sequence
tagttaagtgtttaatacca

SEQ ID NO: 166685 - DNA, 20 bp, Artificial
  CRISPR gRNA sequence
agtgtttaataccaggccac

SEQ ID NO: 166686 - DNA, 20 bp, Artificial
  CRISPR gRNA sequence
aataccaggccacctcctta

SEQ ID NO: 166687 - DNA, 20 bp, Artificial
  CRISPR gRNA sequence
ataccaggccacctccttag

SEQ ID NO: 166688 - DNA, 20 bp, Artificial
  CRISPR gRNA sequence
cttagcagggtccatggaga

SEQ ID NO: 166689 - DNA, 20 bp, Artificial
  CRISPR gRNA sequence
agcagggtccatggagaaaa

SEQ ID NO: 166690 - DNA, 20 bp, Artificial
  CRISPR gRNA sequence
gcagggtccatggagaaaat

SEQ ID NO: 166691 - DNA, 20 bp, Artificial
  CRISPR gRNA sequence
aaattcagtttagtttcaac

SEQ ID NO: 166692 - DNA, 20 bp, Artificial
  CRISPR gRNA sequence
agtttagtttcaacctgagc

SEQ ID NO: 166693 - DNA, 20 bp, Artificial
  CRISPR gRNA sequence
agtttcaacctgagccagat

SEQ ID NO: 166694 - DNA, 20 bp, Artificial
  CRISPR gRNA sequence
gtttcaacctgagccagata

SEQ ID NO: 166695 - DNA, 20 bp, Artificial
  CRISPR gRNA sequence
caacctgagccagatattct

SEQ ID NO: 166696 - DNA, 20 bp, Artificial
  CRISPR gRNA sequence
aacctgagccagatattctg

SEQ ID NO: 166697 - DNA, 20 bp, Artificial
  CRISPR gRNA sequence
agccagatattctgagaaaa

SEQ ID NO: 166698 - DNA, 20 bp, Artificial
  CRISPR gRNA sequence
tgagaaaagaaggagaggag

SEQ ID NO: 166699 - DNA, 20 bp, Artificial
  CRISPR gRNA sequence
agaaaagaaggagaggaggg

SEQ ID NO: 166700 - DNA, 20 bp, Artificial
  CRISPR gRNA sequence
ctgcccctgccagtgtagat

SEQ ID NO: 166701 - DNA, 20 bp, Artificial
  CRISPR gRNA sequence
cccctgccagtgtagattac

SEQ ID NO: 166702 - DNA, 20 bp, Artificial
  CRISPR gRNA sequence
ccagtgtagattaccaagag

SEQ ID NO: 166703 - DNA, 20 bp, Artificial
  CRISPR gRNA sequence
ccaagagttggggaaatgct

SEQ ID NO: 166704 - DNA, 20 bp, Artificial
  CRISPR gRNA sequence
gggaaatgctgacttccaag

SEQ ID NO: 166705 - DNA, 20 bp, Artificial
  CRISPR gRNA sequence
acttccaagctgctggtaca

SEQ ID NO: 166706 - DNA, 20 bp, Artificial
  CRISPR gRNA sequence
ccaagctgctggtacagtgg

SEQ ID NO: 166707 - DNA, 20 bp, Artificial
  CRISPR gRNA sequence
caagctgctggtacagtggt

SEQ ID NO: 166708 - DNA, 20 bp, Artificial
  CRISPR gRNA sequence
ctggtacagtggttcgaatt

SEQ ID NO: 166709 - DNA, 20 bp, Artificial
  CRISPR gRNA sequence
gtacagtggttcgaattgct

SEQ ID NO: 166710 - DNA, 20 bp, Artificial
  CRISPR gRNA sequence
gaattgcttgtgtttgccac

SEQ ID NO: 166711 - DNA, 20 bp, Artificial
  CRISPR gRNA sequence
cttgtgtttgccacagagga

SEQ ID NO: 166712 - DNA, 20 bp, Artificial
  CRISPR gRNA sequence
gtgtttgccacagaggaaca

SEQ ID NO: 166713 - DNA, 20 bp, Artificial
  CRISPR gRNA sequence
tgtttgccacagaggaacag

SEQ ID NO: 166714 - DNA, 20 bp, Artificial
  CRISPR gRNA sequence
gccacagaggaacagcgtgc

SEQ ID NO: 166715 - DNA, 20 bp, Artificial
  CRISPR gRNA sequence
ccacagaggaacagcgtgca

SEQ ID NO: 166716 - DNA, 20 bp, Artificial
  CRISPR gRNA sequence
gagtctctgagctaacggga

SEQ ID NO: 166717 - DNA, 20 bp, Artificial
  CRISPR gRNA sequence
tgagctaacgggagaggcag

SEQ ID NO: 166718 - DNA, 20 bp, Artificial
  CRISPR gRNA sequence
agctaacgggagaggcagag

SEQ ID NO: 166719 - DNA, 20 bp, Artificial
  CRISPR gRNA sequence
acgggagaggcagagcccag

SEQ ID NO: 166720 - DNA, 20 bp, Artificial
  CRISPR gRNA sequence
aactccctgcacctcttccc

SEQ ID NO: 166721 - DNA, 20 bp, Artificial
  CRISPR gRNA sequence
cctgcacctcttccctgccc

SEQ ID NO: 166722 - DNA, 20 bp, Artificial
  CRISPR gRNA sequence
cacctcttccctgcccacca

SEQ ID NO: 166723 - DNA, 20 bp, Artificial
  CRISPR gRNA sequence
ttccctgcccaccacacacc

SEQ ID NO: 166724 - DNA, 20 bp, Artificial
  CRISPR gRNA sequence
ccctgcccaccacacacccc

SEQ ID NO: 166725 - DNA, 20 bp, Artificial
  CRISPR gRNA sequence
cctgcccaccacacaccccc

SEQ ID NO: 166726 - DNA, 20 bp, Artificial
  CRISPR gRNA sequence
cccaccacacaccccccctc

SEQ ID NO: 166727 - DNA, 20 bp, Artificial
  CRISPR gRNA sequence
acaccgggctggtgcctcct

SEQ ID NO: 166728 - DNA, 20 bp, Artificial
  CRISPR gRNA sequence
gtgcctcctgtgtctgctgc

SEQ ID NO: 166729 - DNA, 20 bp, Artificial
  CRISPR gRNA sequence
ctgtgtctgctgctcccaac

SEQ ID NO: 166730 - DNA, 20 bp, Artificial
  CRISPR gRNA sequence
tgtctgctgctcccaacccc

SEQ ID NO: 166731 - DNA, 20 bp, Artificial
  CRISPR gRNA sequence
ctgctcccaaccccagcaga

SEQ ID NO: 166732 - DNA, 20 bp, Artificial
  CRISPR gRNA sequence
ctcccaaccccagcagagct

SEQ ID NO: 166733 - DNA, 20 bp, Artificial
  CRISPR gRNA sequence
ccaaccccagcagagctcca

SEQ ID NO: 166734 - DNA, 20 bp, Artificial
  CRISPR gRNA sequence
cacttcccctcctccttctg

SEQ ID NO: 166735 - DNA, 20 bp, Artificial
  CRISPR gRNA sequence
cccctcctccttctgacgcc

SEQ ID NO: 166736 - DNA, 20 bp, Artificial
  CRISPR gRNA sequence
ccctcctccttctgacgcct

SEQ ID NO: 166737 - DNA, 20 bp, Artificial
  CRISPR gRNA sequence
ctccttctgacgccttgcag

SEQ ID NO: 166738 - DNA, 20 bp, Artificial
  CRISPR gRNA sequence
cttctgacgccttgcagtgg

SEQ ID NO: 166739 - DNA, 20 bp, Artificial
  CRISPR gRNA sequence
ctgacgccttgcagtgggtg

SEQ ID NO: 166740 - DNA, 20 bp, Artificial
  CRISPR gRNA sequence
tgacgccttgcagtgggtgg

SEQ ID NO: 166741 - DNA, 20 bp, Artificial
  CRISPR gRNA sequence
acgccttgcagtgggtggtg

SEQ ID NO: 166742 - DNA, 20 bp, Artificial
  CRISPR gRNA sequence
gcagtgggtggtggttgagg

SEQ ID NO: 166743 - DNA, 20 bp, Artificial
  CRISPR gRNA sequence
cagtgggtggtggttgaggt

SEQ ID NO: 166744 - DNA, 20 bp, Artificial
  CRISPR gRNA sequence
aggtatctgggacccccaac

SEQ ID NO: 166745 - DNA, 20 bp, Artificial
  CRISPR gRNA sequence
ggacccccaaccagctcgag

SEQ ID NO: 166746 - DNA, 20 bp, Artificial
  CRISPR gRNA sequence
gagacccatagggagctgca

SEQ ID NO: 166747 - DNA, 20 bp, Artificial
  CRISPR gRNA sequence
catgcccctctcccagggat

SEQ ID NO: 166748 - DNA, 20 bp, Artificial
  CRISPR gRNA sequence
tcccagggatgacctcactc

SEQ ID NO: 166749 - DNA, 20 bp, Artificial
  CRISPR gRNA sequence
ccagggatgacctcactctc

SEQ ID NO: 166750 - DNA, 20 bp, Artificial
  CRISPR gRNA sequence
actctctcctctccacccct

SEQ ID NO: 166751 - DNA, 20 bp, Artificial
  CRISPR gRNA sequence
tctcctctccacccctcgca

SEQ ID NO: 166752 - DNA, 20 bp, Artificial
  CRISPR gRNA sequence
tcctctccacccctcgcagc

SEQ ID NO: 166753 - DNA, 20 bp, Artificial
  CRISPR gRNA sequence
ctctccacccctcgcagcag

SEQ ID NO: 166754 - DNA, 20 bp, Artificial
  CRISPR gRNA sequence
tccacccctcgcagcagctc

SEQ ID NO: 166755 - DNA, 20 bp, Artificial
  CRISPR gRNA sequence
cacccctcgcagcagctcta

SEQ ID NO: 166756 - DNA, 20 bp, Artificial
  CRISPR gRNA sequence
gcagcagctctaccagatcc

SEQ ID NO: 166757 - DNA, 20 bp, Artificial
  CRISPR gRNA sequence
taccagatccagcaagtcac

SEQ ID NO: 166758 - DNA, 20 bp, Artificial
  CRISPR gRNA sequence
ccagatccagcaagtcacca

SEQ ID NO: 166759 - DNA, 20 bp, Artificial
  CRISPR gRNA sequence
cgggccaggacctcgcccag

SEQ ID NO: 166760 - DNA, 20 bp, Artificial
  CRISPR gRNA sequence
gcccagcccatgttcatcca

SEQ ID NO: 166761 - DNA, 20 bp, Artificial
  CRISPR gRNA sequence
atccagtcagccaaccagcc

SEQ ID NO: 166762 - DNA, 20 bp, Artificial
  CRISPR gRNA sequence
cgacgggcaggccccccagg

SEQ ID NO: 166763 - DNA, 20 bp, Artificial
  CRISPR gRNA sequence
agggcctgagctggcaaggc

SEQ ID NO: 166764 - DNA, 20 bp, Artificial
  CRISPR gRNA sequence
agctggcaaggccaaggaca

SEQ ID NO: 166765 - DNA, 20 bp, Artificial
  CRISPR gRNA sequence
gcaaggccaaggacacccaa

SEQ ID NO: 166766 - DNA, 20 bp, Artificial
  CRISPR gRNA sequence
ttgccatacagccccaggca

SEQ ID NO: 166767 - DNA, 20 bp, Artificial
  CRISPR gRNA sequence
tgccatacagccccaggcaa

SEQ ID NO: 166768 - DNA, 20 bp, Artificial
  CRISPR gRNA sequence
gccatacagccccaggcaat

SEQ ID NO: 166769 - DNA, 20 bp, Artificial
  CRISPR gRNA sequence
ccatacagccccaggcaatg

SEQ ID NO: 166770 - DNA, 20 bp, Artificial
  CRISPR gRNA sequence
cctccccagaggacccggcc

SEQ ID NO: 166771 - DNA, 20 bp, Artificial
  CRISPR gRNA sequence
ctccccagaggacccggccg

SEQ ID NO: 166772 - DNA, 20 bp, Artificial
  CRISPR gRNA sequence
cccagaggacccggccgacc

SEQ ID NO: 166773 - DNA, 20 bp, Artificial
  CRISPR gRNA sequence
agcgcctcctgcaggctagg

SEQ ID NO: 166774 - DNA, 20 bp, Artificial
  CRISPR gRNA sequence
ctgcaggctaggacactggt

SEQ ID NO: 166775 - DNA, 20 bp, Artificial
  CRISPR gRNA sequence
caggctaggacactggtgca

SEQ ID NO: 166776 - DNA, 20 bp, Artificial
  CRISPR gRNA sequence
ggacactggtgcactacacc

SEQ ID NO: 166777 - DNA, 20 bp, Artificial
  CRISPR gRNA sequence
gtgcactacaccccatgcct

SEQ ID NO: 166778 - DNA, 20 bp, Artificial
  CRISPR gRNA sequence
caccccatgcctgggggccg

SEQ ID NO: 166779 - DNA, 20 bp, Artificial
  CRISPR gRNA sequence
ggggccgagattctccagca

SEQ ID NO: 166780 - DNA, 20 bp, Artificial
  CRISPR gRNA sequence
tccagcagaaagatgcaata

SEQ ID NO: 166781 - DNA, 20 bp, Artificial
  CRISPR gRNA sequence
cagcagaaagatgcaatatt

SEQ ID NO: 166782 - DNA, 20 bp, Artificial
  CRISPR gRNA sequence
tttgtttcctttttttccat

SEQ ID NO: 166783 - DNA, 20 bp, Artificial
  CRISPR gRNA sequence
ttgtttcctttttttccatt

SEQ ID NO: 166784 - DNA, 20 bp, Artificial
  CRISPR gRNA sequence
tgtttcctttttttccattt

SEQ ID NO: 166785 - DNA, 20 bp, Artificial
  CRISPR gRNA sequence
gtttcctttttttccatttt

SEQ ID NO: 166786 - DNA, 20 bp, Artificial
  CRISPR gRNA sequence
tttcctttttttccattttt

SEQ ID NO: 166787 - DNA, 20 bp, Artificial
  CRISPR gRNA sequence
cctttttttccatttttttc

SEQ ID NO: 166788 - DNA, 20 bp, Artificial
  CRISPR gRNA sequence
ctttttttccatttttttct

SEQ ID NO: 166789 - DNA, 20 bp, Artificial
  CRISPR gRNA sequence
tttttccatttttttctcta

SEQ ID NO: 166790 - DNA, 20 bp, Artificial
  CRISPR gRNA sequence
ttttccatttttttctctaa

SEQ ID NO: 166791 - DNA, 20 bp, Artificial
  CRISPR gRNA sequence
tttccatttttttctctaag

SEQ ID NO: 166792 - DNA, 20 bp, Artificial
  CRISPR gRNA sequence
ttccatttttttctctaagg

SEQ ID NO: 166793 - DNA, 20 bp, Artificial
  CRISPR gRNA sequence
tccatttttttctctaagga

SEQ ID NO: 166794 - DNA, 20 bp, Artificial
  CRISPR gRNA sequence
ccatttttttctctaaggaa

SEQ ID NO: 166795 - DNA, 20 bp, Artificial
  CRISPR gRNA sequence
catttttttctctaaggaat

SEQ ID NO: 166796 - DNA, 20 bp, Artificial
  CRISPR gRNA sequence
ttttctctaaggaatcaata

SEQ ID NO: 166797 - DNA, 20 bp, Artificial
  CRISPR gRNA sequence
tttctctaaggaatcaatat

SEQ ID NO: 166798 - DNA, 20 bp, Artificial
  CRISPR gRNA sequence
ttctctaaggaatcaatatt

SEQ ID NO: 166799 - DNA, 20 bp, Artificial
  CRISPR gRNA sequence
tctctaaggaatcaatattt

SEQ ID NO: 166800 - DNA, 20 bp, Artificial
  CRISPR gRNA sequence
ctctaaggaatcaatatttc

SEQ ID NO: 166801 - DNA, 20 bp, Artificial
  CRISPR gRNA sequence
tctaaggaatcaatatttca

SEQ ID NO: 166802 - DNA, 20 bp, Artificial
  CRISPR gRNA sequence
taaggaatcaatatttcaat

SEQ ID NO: 166803 - DNA, 20 bp, Artificial
  CRISPR gRNA sequence
aggaatcaatatttcaatat

SEQ ID NO: 166804 - DNA, 20 bp, Artificial
  CRISPR gRNA sequence
caatatgttgagtgtgtgtc

SEQ ID NO: 166805 - DNA, 20 bp, Artificial
  CRISPR gRNA sequence
aatatgttgagtgtgtgtcc

SEQ ID NO: 166806 - DNA, 20 bp, Artificial
  CRISPR gRNA sequence
agtgtgtgtccaatgctatg

SEQ ID NO: 166807 - DNA, 20 bp, Artificial
  CRISPR gRNA sequence
tgaaattaaaatattaaata

SEQ ID NO: 166808 - DNA, 20 bp, Artificial
  CRISPR gRNA sequence
aaatattaaataacatattt

SEQ ID NO: 166809 - DNA, 20 bp, Artificial
  CRISPR gRNA sequence
aataacatatttatggcatt

SEQ ID NO: 166810 - DNA, 20 bp, Artificial
  CRISPR gRNA sequence
atggcattttcttgaagagt

SEQ ID NO: 166811 - DNA, 20 bp, Artificial
  CRISPR gRNA sequence
tggcattttcttgaagagtg

SEQ ID NO: 166812 - DNA, 20 bp, Artificial
  CRISPR gRNA sequence
tcttgaagagtgtggttgaa

SEQ ID NO: 166813 - DNA, 20 bp, Artificial
  CRISPR gRNA sequence
cttgaagagtgtggttgaag

SEQ ID NO: 166814 - DNA, 20 bp, Artificial
  CRISPR gRNA sequence
ttgaagagtgtggttgaaga

SEQ ID NO: 166815 - DNA, 20 bp, Artificial
  CRISPR gRNA sequence
gaagagtgtggttgaagaaa

SEQ ID NO: 166816 - DNA, 20 bp, Artificial
  CRISPR gRNA sequence
aagagtgtggttgaagaaat

SEQ ID NO: 166817 - DNA, 20 bp, Artificial
  CRISPR gRNA sequence
aagaaatatttctccttttg

SEQ ID NO: 166818 - DNA, 20 bp, Artificial
  CRISPR gRNA sequence
ctccttttgtttttcttttt

SEQ ID NO: 166819 - DNA, 20 bp, Artificial
  CRISPR gRNA sequence
tccttttgtttttctttttt

SEQ ID NO: 166820 - DNA, 20 bp, Artificial
  CRISPR gRNA sequence
cttttgtttttctttttttt

SEQ ID NO: 166821 - DNA, 20 bp, Artificial
  CRISPR gRNA sequence
ttgtttttcttttttttttg

SEQ ID NO: 166822 - DNA, 20 bp, Artificial
  CRISPR gRNA sequence
tgtttttcttttttttttgt

SEQ ID NO: 166823 - DNA, 20 bp, Artificial
  CRISPR gRNA sequence
gtttttcttttttttttgtt

SEQ ID NO: 166824 - DNA, 20 bp, Artificial
  CRISPR gRNA sequence
tttttcttttttttttgttt

SEQ ID NO: 166825 - DNA, 20 bp, Artificial
  CRISPR gRNA sequence
ttcttttttttttgtttgtt

SEQ ID NO: 166826 - DNA, 20 bp, Artificial
  CRISPR gRNA sequence
tcttttttttttgtttgtta

SEQ ID NO: 166827 - DNA, 20 bp, Artificial
  CRISPR gRNA sequence
cttttttttttgtttgttac

SEQ ID NO: 166828 - DNA, 20 bp, Artificial
  CRISPR gRNA sequence
ttttttttttgtttgttact

SEQ ID NO: 166829 - DNA, 20 bp, Artificial
  CRISPR gRNA sequence
ttttttttgtttgttactgc

SEQ ID NO: 166830 - DNA, 20 bp, Artificial
  CRISPR gRNA sequence
tttttttgtttgttactgcc

SEQ ID NO: 166831 - DNA, 20 bp, Artificial
  CRISPR gRNA sequence
ttttttgtttgttactgcca

SEQ ID NO: 166832 - DNA, 20 bp, Artificial
  CRISPR gRNA sequence
tttttgtttgttactgccac

SEQ ID NO: 166833 - DNA, 20 bp, Artificial
  CRISPR gRNA sequence
ttttgtttgttactgccact

SEQ ID NO: 166834 - DNA, 20 bp, Artificial
  CRISPR gRNA sequence
tttgtttgttactgccactt

SEQ ID NO: 166835 - DNA, 20 bp, Artificial
  CRISPR gRNA sequence
ttgtttgttactgccacttc

SEQ ID NO: 166836 - DNA, 20 bp, Artificial
  CRISPR gRNA sequence
tgtttgttactgccacttct

SEQ ID NO: 166837 - DNA, 20 bp, Artificial
  CRISPR gRNA sequence
gtttgttactgccacttctt

SEQ ID NO: 166838 - DNA, 20 bp, Artificial
  CRISPR gRNA sequence
tttgttactgccacttcttt

SEQ ID NO: 166839 - DNA, 20 bp, Artificial
  CRISPR gRNA sequence
gttactgccacttcttttta

SEQ ID NO: 166840 - DNA, 20 bp, Artificial
  CRISPR gRNA sequence
ttactgccacttctttttag

SEQ ID NO: 166841 - DNA, 20 bp, Artificial
  CRISPR gRNA sequence
ctgccacttctttttaggag

SEQ ID NO: 166842 - DNA, 20 bp, Artificial
  CRISPR gRNA sequence
ccacttctttttaggagcaa

SEQ ID NO: 166843 - DNA, 20 bp, Artificial
  CRISPR gRNA sequence
ctttttaggagcaaatctcc

SEQ ID NO: 166844 - DNA, 20 bp, Artificial
  CRISPR gRNA sequence
tttttaggagcaaatctccc

SEQ ID NO: 166845 - DNA, 20 bp, Artificial
  CRISPR gRNA sequence
tttaggagcaaatctcccca

SEQ ID NO: 166846 - DNA, 20 bp, Artificial
  CRISPR gRNA sequence
ttaggagcaaatctccccag

SEQ ID NO: 166847 - DNA, 20 bp, Artificial
  CRISPR gRNA sequence
taggagcaaatctccccagg

SEQ ID NO: 166848 - DNA, 20 bp, Artificial
  CRISPR gRNA sequence
aggagcaaatctccccaggg

SEQ ID NO: 166849 - DNA, 20 bp, Artificial
  CRISPR gRNA sequence
ggagcaaatctccccagggg

SEQ ID NO: 166850 - DNA, 20 bp, Artificial
  CRISPR gRNA sequence
cccaggggtgtacggtattt

SEQ ID NO: 166851 - DNA, 20 bp, Artificial
  CRISPR gRNA sequence
cttgactctgggaacagctg

SEQ ID NO: 166852 - DNA, 20 bp, Artificial
  CRISPR gRNA sequence
ttgactctgggaacagctgc

SEQ ID NO: 166853 - DNA, 20 bp, Artificial
  CRISPR gRNA sequence
gactctgggaacagctgcta

SEQ ID NO: 166854 - DNA, 20 bp, Artificial
  CRISPR gRNA sequence
actctgggaacagctgctac

SEQ ID NO: 166855 - DNA, 20 bp, Artificial
  CRISPR gRNA sequence
tgggaacagctgctaccccc

SEQ ID NO: 166856 - DNA, 20 bp, Artificial
  CRISPR gRNA sequence
ggaacagctgctacccccaa

SEQ ID NO: 166857 - DNA, 20 bp, Artificial
  CRISPR gRNA sequence
ctacccccaagacttgccac

SEQ ID NO: 166858 - DNA, 20 bp, Artificial
  CRISPR gRNA sequence
cccccaagacttgccacgtt

SEQ ID NO: 166859 - DNA, 20 bp, Artificial
  CRISPR gRNA sequence
gccacgttgttctgccctca

SEQ ID NO: 166860 - DNA, 20 bp, Artificial
  CRISPR gRNA sequence
ccacgttgttctgccctcag

SEQ ID NO: 166861 - DNA, 20 bp, Artificial
  CRISPR gRNA sequence
ttctgccctcagatggaatt

SEQ ID NO: 166862 - DNA, 20 bp, Artificial
  CRISPR gRNA sequence
tgccctcagatggaattagg

SEQ ID NO: 166863 - DNA, 20 bp, Artificial
  CRISPR gRNA sequence
ccctcagatggaattaggtg

SEQ ID NO: 166864 - DNA, 20 bp, Artificial
  CRISPR gRNA sequence
agatggaattaggtgaatgt

SEQ ID NO: 166865 - DNA, 20 bp, Artificial
  CRISPR gRNA sequence
ggtgaatgtgtgtagctgct

SEQ ID NO: 166866 - DNA, 20 bp, Artificial
  CRISPR gRNA sequence
ctttttcactcgtggtcctc

SEQ ID NO: 166867 - DNA, 20 bp, Artificial
  CRISPR gRNA sequence
tttcactcgtggtcctctcc

SEQ ID NO: 166868 - DNA, 20 bp, Artificial
  CRISPR gRNA sequence
ttcactcgtggtcctctccc

SEQ ID NO: 166869 - DNA, 20 bp, Artificial
  CRISPR gRNA sequence
tcactcgtggtcctctcccc

SEQ ID NO: 166870 - DNA, 20 bp, Artificial
  CRISPR gRNA sequence
cactcgtggtcctctcccca

SEQ ID NO: 166871 - DNA, 20 bp, Artificial
  CRISPR gRNA sequence
actcgtggtcctctccccat

SEQ ID NO: 166872 - DNA, 20 bp, Artificial
  CRISPR gRNA sequence
gtggtcctctccccatccct

SEQ ID NO: 166873 - DNA, 20 bp, Artificial
  CRISPR gRNA sequence
tccccatcccttgctctgac

SEQ ID NO: 166874 - DNA, 20 bp, Artificial
  CRISPR gRNA sequence
cccatcccttgctctgaccc

SEQ ID NO: 166875 - DNA, 20 bp, Artificial
  CRISPR gRNA sequence
gctctgaccccagagctctg

SEQ ID NO: 166876 - DNA, 20 bp, Artificial
  CRISPR gRNA sequence
ctctgaccccagagctctgt

SEQ ID NO: 166877 - DNA, 20 bp, Artificial
  CRISPR gRNA sequence
tgaccccagagctctgtgta

SEQ ID NO: 166878 - DNA, 20 bp, Artificial
  CRISPR gRNA sequence
accccagagctctgtgtatt

SEQ ID NO: 166879 - DNA, 20 bp, Artificial
  CRISPR gRNA sequence
tgtgtatttgcatccagagg

SEQ ID NO: 166880 - DNA, 20 bp, Artificial
  CRISPR gRNA sequence
tgtatttgcatccagaggcc

SEQ ID NO: 166881 - DNA, 20 bp, Artificial
  CRISPR gRNA sequence
gcatccagaggccatggaaa

SEQ ID NO: 166882 - DNA, 20 bp, Artificial
  CRISPR gRNA sequence
catccagaggccatggaaac

SEQ ID NO: 166883 - DNA, 20 bp, Artificial
  CRISPR gRNA sequence
tttgcatttaagagacagat

SEQ ID NO: 166884 - DNA, 20 bp, Artificial
  CRISPR gRNA sequence
tgcatttaagagacagattt

SEQ ID NO: 166885 - DNA, 20 bp, Artificial
  CRISPR gRNA sequence
gcatttaagagacagattta

SEQ ID NO: 166886 - DNA, 20 bp, Artificial
  CRISPR gRNA sequence
catttaagagacagatttat

SEQ ID NO: 166887 - DNA, 20 bp, Artificial
  CRISPR gRNA sequence
aagagacagatttattccct

SEQ ID NO: 166888 - DNA, 20 bp, Artificial
  CRISPR gRNA sequence
agagacagatttattccctg

SEQ ID NO: 166889 - DNA, 20 bp, Artificial
  CRISPR gRNA sequence
attccctgtggagagtgggt

SEQ ID NO: 166890 - DNA, 20 bp, Artificial
  CRISPR gRNA sequence
ttccctgtggagagtgggtg

SEQ ID NO: 166891 - DNA, 20 bp, Artificial
  CRISPR gRNA sequence
cctgtggagagtgggtggat

SEQ ID NO: 166892 - DNA, 20 bp, Artificial
  CRISPR gRNA sequence
tggagagtgggtggattcat

SEQ ID NO: 166893 - DNA, 20 bp, Artificial
  CRISPR gRNA sequence
attgccacactcttttctcc

SEQ ID NO: 166894 - DNA, 20 bp, Artificial
  CRISPR gRNA sequence
ccacactcttttctcccagg

SEQ ID NO: 166895 - DNA, 20 bp, Artificial
  CRISPR gRNA sequence
ttttctcccagggacccagg

SEQ ID NO: 166896 - DNA, 20 bp, Artificial
  CRISPR gRNA sequence
ttctcccagggacccaggaa

SEQ ID NO: 166897 - DNA, 20 bp, Artificial
  CRISPR gRNA sequence
tctcccagggacccaggaaa

SEQ ID NO: 166898 - DNA, 20 bp, Artificial
  CRISPR gRNA sequence
ctcccagggacccaggaaac

SEQ ID NO: 166899 - DNA, 20 bp, Artificial
  CRISPR gRNA sequence
tcccagggacccaggaaact

SEQ ID NO: 166900 - DNA, 20 bp, Artificial
  CRISPR gRNA sequence
ccagggacccaggaaactag

SEQ ID NO: 166901 - DNA, 20 bp, Artificial
  CRISPR gRNA sequence
ggactttgtgtgtttgctgc

SEQ ID NO: 166902 - DNA, 20 bp, Artificial
  CRISPR gRNA sequence
tgtgtgtttgctgcccacct

SEQ ID NO: 166903 - DNA, 20 bp, Artificial
  CRISPR gRNA sequence
gtgtgtttgctgcccacctc

SEQ ID NO: 166904 - DNA, 20 bp, Artificial
  CRISPR gRNA sequence
tgtgtttgctgcccacctcc

SEQ ID NO: 166905 - DNA, 20 bp, Artificial
  CRISPR gRNA sequence
gctgcccacctcccttttat

SEQ ID NO: 166906 - DNA, 20 bp, Artificial
  CRISPR gRNA sequence
ctgcccacctcccttttatt

SEQ ID NO: 166907 - DNA, 20 bp, Artificial
  CRISPR gRNA sequence
cccacctcccttttattttt

SEQ ID NO: 166908 - DNA, 20 bp, Artificial
  CRISPR gRNA sequence
ccttttattttttaaatgca

SEQ ID NO: 166909 - DNA, 20 bp, Artificial
  CRISPR gRNA sequence
ttattttttaaatgcattaa

SEQ ID NO: 166910 - DNA, 20 bp, Artificial
  CRISPR gRNA sequence
tattttttaaatgcattaaa

SEQ ID NO: 166911 - DNA, 20 bp, Artificial
  CRISPR gRNA sequence
attttttaaatgcattaaaa

SEQ ID NO: 166912 - DNA, 20 bp, Artificial
  CRISPR gRNA sequence
ttttttaaatgcattaaaaa

SEQ ID NO: 166913 - DNA, 20 bp, Artificial
  CRISPR gRNA sequence
tttaaatgcattaaaaactg

SEQ ID NO: 166914 - DNA, 20 bp, Artificial
  CRISPR gRNA sequence
ttaaatgcattaaaaactgt

SEQ ID NO: 166915 - DNA, 20 bp, Artificial
  CRISPR gRNA sequence
taaatgcattaaaaactgtg

SEQ ID NO: 166916 - DNA, 20 bp, Artificial
  CRISPR gRNA sequence
aaatgcattaaaaactgtgc

SEQ ID NO: 166917 - DNA, 20 bp, Artificial
  CRISPR gRNA sequence
aatgcattaaaaactgtgct

SEQ ID NO: 166918 - DNA, 20 bp, Artificial
  CRISPR gRNA sequence
aaaactgtgctagtctcctt

SEQ ID NO: 166919 - DNA, 20 bp, Artificial
  CRISPR gRNA sequence
tgctagtctcctttgcatgg

SEQ ID NO: 166920 - DNA, 20 bp, Artificial
  CRISPR gRNA sequence
gtctcctttgcatggacttc

SEQ ID NO: 166921 - DNA, 20 bp, Artificial
  CRISPR gRNA sequence
ctttgcatggacttcaagct

SEQ ID NO: 166922 - DNA, 20 bp, Artificial
  CRISPR gRNA sequence
tgcatggacttcaagctgca

SEQ ID NO: 166923 - DNA, 20 bp, Artificial
  CRISPR gRNA sequence
gcatggacttcaagctgcat

SEQ ID NO: 166924 - DNA, 20 bp, Artificial
  CRISPR gRNA sequence
catggacttcaagctgcatg

SEQ ID NO: 166925 - DNA, 20 bp, Artificial
  CRISPR gRNA sequence
caagctgcatgaaatgcaat

SEQ ID NO: 166926 - DNA, 20 bp, Artificial
  CRISPR gRNA sequence
aagctgcatgaaatgcaata

SEQ ID NO: 166927 - DNA, 20 bp, Artificial
  CRISPR gRNA sequence
catgaaatgcaataaatctc

SEQ ID NO: 166928 - DNA, 20 bp, Artificial
  CRISPR gRNA sequence
attttagataatttagagtc

SEQ ID NO: 166929 - DNA, 20 bp, Artificial
  CRISPR gRNA sequence
tagataatttagagtctggg

SEQ ID NO: 166930 - DNA, 20 bp, Artificial
  CRISPR gRNA sequence
agataatttagagtctgggt

SEQ ID NO: 166931 - DNA, 20 bp, Artificial
  CRISPR gRNA sequence
gataatttagagtctgggtt

SEQ ID NO: 166932 - DNA, 20 bp, Artificial
  CRISPR gRNA sequence
agagtctgggtttctgtgtc

SEQ ID NO: 166933 - DNA, 20 bp, Artificial
  CRISPR gRNA sequence
gagtctgggtttctgtgtct

SEQ ID NO: 166934 - DNA, 20 bp, Artificial
  CRISPR gRNA sequence
ggtttctgtgtctgggggca

SEQ ID NO: 166935 - DNA, 20 bp, Artificial
  CRISPR gRNA sequence
ctgtgtctgggggcattcat

SEQ ID NO: 166936 - DNA, 20 bp, Artificial
  CRISPR gRNA sequence
tgtgtctgggggcattcatg

SEQ ID NO: 166937 - DNA, 20 bp, Artificial
  CRISPR gRNA sequence
tgtctgggggcattcatggg

SEQ ID NO: 166938 - DNA, 20 bp, Artificial
  CRISPR gRNA sequence
ggggcattcatggggccact

SEQ ID NO: 166939 - DNA, 20 bp, Artificial
  CRISPR gRNA sequence
atggggccactttgcttgga

SEQ ID NO: 166940 - DNA, 20 bp, Artificial
  CRISPR gRNA sequence
tgcttggaaaggttcatttg

SEQ ID NO: 166941 - DNA, 20 bp, Artificial
  CRISPR gRNA sequence
gcttggaaaggttcatttgc

SEQ ID NO: 166942 - DNA, 20 bp, Artificial
  CRISPR gRNA sequence
cttggaaaggttcatttgcc

SEQ ID NO: 166943 - DNA, 20 bp, Artificial
  CRISPR gRNA sequence
ggaaaggttcatttgccctc

SEQ ID NO: 166944 - DNA, 20 bp, Artificial
  CRISPR gRNA sequence
gaaaggttcatttgccctca

SEQ ID NO: 166945 - DNA, 20 bp, Artificial
  CRISPR gRNA sequence
atttgccctcagtttgtgtg

SEQ ID NO: 166946 - DNA, 20 bp, Artificial
  CRISPR gRNA sequence
gccctcagtttgtgtgtctg

SEQ ID NO: 166947 - DNA, 20 bp, Artificial
  CRISPR gRNA sequence
ccctcagtttgtgtgtctgg

SEQ ID NO: 166948 - DNA, 20 bp, Artificial
  CRISPR gRNA sequence
agtttgtgtgtctgggagag

SEQ ID NO: 166949 - DNA, 20 bp, Artificial
  CRISPR gRNA sequence
gtgtgtctgggagagagggc

SEQ ID NO: 166950 - DNA, 20 bp, Artificial
  CRISPR gRNA sequence
tgtgtctgggagagagggcc

SEQ ID NO: 166951 - DNA, 20 bp, Artificial
  CRISPR gRNA sequence
tctcccagacacacaaactg

SEQ ID NO: 166952 - DNA, 20 bp, Artificial
  CRISPR gRNA sequence
tcccagacacacaaactgag

SEQ ID NO: 166953 - DNA, 20 bp, Artificial
  CRISPR gRNA sequence
ccagacacacaaactgaggg

SEQ ID NO: 166954 - DNA, 20 bp, Artificial
  CRISPR gRNA sequence
agggcaaatgaacctttcca

SEQ ID NO: 166955 - DNA, 20 bp, Artificial
  CRISPR gRNA sequence
tccaagcaaagtggccccat

SEQ ID NO: 166956 - DNA, 20 bp, Artificial
  CRISPR gRNA sequence
ccaagcaaagtggccccatg

SEQ ID NO: 166957 - DNA, 20 bp, Artificial
  CRISPR gRNA sequence
caagcaaagtggccccatga

SEQ ID NO: 166958 - DNA, 20 bp, Artificial
  CRISPR gRNA sequence
taaattatctaaaatgagat

SEQ ID NO: 166959 - DNA, 20 bp, Artificial
  CRISPR gRNA sequence
aattatctaaaatgagattt

SEQ ID NO: 166960 - DNA, 20 bp, Artificial
  CRISPR gRNA sequence
tctaaaatgagatttattgc

SEQ ID NO: 166961 - DNA, 20 bp, Artificial
  CRISPR gRNA sequence
aaatgagatttattgcattt

SEQ ID NO: 166962 - DNA, 20 bp, Artificial
  CRISPR gRNA sequence
attgcatttcatgcagcttg

SEQ ID NO: 166963 - DNA, 20 bp, Artificial
  CRISPR gRNA sequence
ttgcatttcatgcagcttga

SEQ ID NO: 166964 - DNA, 20 bp, Artificial
  CRISPR gRNA sequence
catttcatgcagcttgaagt

SEQ ID NO: 166965 - DNA, 20 bp, Artificial
  CRISPR gRNA sequence
catgcagcttgaagtccatg

SEQ ID NO: 166966 - DNA, 20 bp, Artificial
  CRISPR gRNA sequence
atgcagcttgaagtccatgc

SEQ ID NO: 166967 - DNA, 20 bp, Artificial
  CRISPR gRNA sequence
gaagtccatgcaaaggagac

SEQ ID NO: 166968 - DNA, 20 bp, Artificial
  CRISPR gRNA sequence
aagtccatgcaaaggagact

SEQ ID NO: 166969 - DNA, 20 bp, Artificial
  CRISPR gRNA sequence
gcacagtttttaatgcattt

SEQ ID NO: 166970 - DNA, 20 bp, Artificial
  CRISPR gRNA sequence
ttaatgcatttaaaaaataa

SEQ ID NO: 166971 - DNA, 20 bp, Artificial
  CRISPR gRNA sequence
taatgcatttaaaaaataaa

SEQ ID NO: 166972 - DNA, 20 bp, Artificial
  CRISPR gRNA sequence
aatgcatttaaaaaataaaa

SEQ ID NO: 166973 - DNA, 20 bp, Artificial
  CRISPR gRNA sequence
atgcatttaaaaaataaaag

SEQ ID NO: 166974 - DNA, 20 bp, Artificial
  CRISPR gRNA sequence
aaaaaataaaagggaggtgg

SEQ ID NO: 166975 - DNA, 20 bp, Artificial
  CRISPR gRNA sequence
aaaaataaaagggaggtggg

SEQ ID NO: 166976 - DNA, 20 bp, Artificial
  CRISPR gRNA sequence
gtttcctgggtccctgggag

SEQ ID NO: 166977 - DNA, 20 bp, Artificial
  CRISPR gRNA sequence
cctgggtccctgggagaaaa

SEQ ID NO: 166978 - DNA, 20 bp, Artificial
  CRISPR gRNA sequence
ctgggtccctgggagaaaag

SEQ ID NO: 166979 - DNA, 20 bp, Artificial
  CRISPR gRNA sequence
ggtccctgggagaaaagagt

SEQ ID NO: 166980 - DNA, 20 bp, Artificial
  CRISPR gRNA sequence
ggagaaaagagtgtggcaat

SEQ ID NO: 166981 - DNA, 20 bp, Artificial
  CRISPR gRNA sequence
tccacagggaataaatctgt

SEQ ID NO: 166982 - DNA, 20 bp, Artificial
  CRISPR gRNA sequence
cacagggaataaatctgtct

SEQ ID NO: 166983 - DNA, 20 bp, Artificial
  CRISPR gRNA sequence
tctcttaaatgcaaagaatg

SEQ ID NO: 166984 - DNA, 20 bp, Artificial
  CRISPR gRNA sequence
ttaaatgcaaagaatgtttc

SEQ ID NO: 166985 - DNA, 20 bp, Artificial
  CRISPR gRNA sequence
aaatgcaaagaatgtttcca

SEQ ID NO: 166986 - DNA, 20 bp, Artificial
  CRISPR gRNA sequence
aatgcaaagaatgtttccat

SEQ ID NO: 166987 - DNA, 20 bp, Artificial
  CRISPR gRNA sequence
ccatggcctctggatgcaaa

SEQ ID NO: 166988 - DNA, 20 bp, Artificial
  CRISPR gRNA sequence
catggcctctggatgcaaat

SEQ ID NO: 166989 - DNA, 20 bp, Artificial
  CRISPR gRNA sequence
tggatgcaaatacacagagc

SEQ ID NO: 166990 - DNA, 20 bp, Artificial
  CRISPR gRNA sequence
gatgcaaatacacagagctc

SEQ ID NO: 166991 - DNA, 20 bp, Artificial
  CRISPR gRNA sequence
tggggtcagagcaagggatg

SEQ ID NO: 166992 - DNA, 20 bp, Artificial
  CRISPR gRNA sequence
gggtcagagcaagggatggg

SEQ ID NO: 166993 - DNA, 20 bp, Artificial
  CRISPR gRNA sequence
cacacattcacctaattcca

SEQ ID NO: 166994 - DNA, 20 bp, Artificial
  CRISPR gRNA sequence
acctaattccatctgagggc

SEQ ID NO: 166995 - DNA, 20 bp, Artificial
  CRISPR gRNA sequence
attccatctgagggcagaac

SEQ ID NO: 166996 - DNA, 20 bp, Artificial
  CRISPR gRNA sequence
catctgagggcagaacaacg

SEQ ID NO: 166997 - DNA, 20 bp, Artificial
  CRISPR gRNA sequence
agggcagaacaacgtggcaa

SEQ ID NO: 166998 - DNA, 20 bp, Artificial
  CRISPR gRNA sequence
gggggtagcagctgttccca

SEQ ID NO: 166999 - DNA, 20 bp, Artificial
  CRISPR gRNA sequence
ggggtagcagctgttcccag

SEQ ID NO: 167000 - DNA, 20 bp, Artificial
  CRISPR gRNA sequence
ttcccagagtcaagaaatac

SEQ ID NO: 167001 - DNA, 20 bp, Artificial
  CRISPR gRNA sequence
ccagagtcaagaaataccgt

SEQ ID NO: 167002 - DNA, 20 bp, Artificial
  CRISPR gRNA sequence
gggagatttgctcctaaaaa

SEQ ID NO: 167003 - DNA, 20 bp, Artificial
  CRISPR gRNA sequence
gctcctaaaaagaagtggca

SEQ ID NO: 167004 - DNA, 20 bp, Artificial
  CRISPR gRNA sequence
ctcctaaaaagaagtggcag

SEQ ID NO: 167005 - DNA, 20 bp, Artificial
  CRISPR gRNA sequence
ctaaaaagaagtggcagtaa

SEQ ID NO: 167006 - DNA, 20 bp, Artificial
  CRISPR gRNA sequence
aaaagaagtggcagtaacaa

SEQ ID NO: 167007 - DNA, 20 bp, Artificial
  CRISPR gRNA sequence
cttcaaccacactcttcaag

SEQ ID NO: 167008 - DNA, 20 bp, Artificial
  CRISPR gRNA sequence
ttcaaccacactcttcaaga

SEQ ID NO: 167009 - DNA, 20 bp, Artificial
  CRISPR gRNA sequence
caaccacactcttcaagaaa

SEQ ID NO: 167010 - DNA, 20 bp, Artificial
  CRISPR gRNA sequence
aaccacactcttcaagaaaa

SEQ ID NO: 167011 - DNA, 20 bp, Artificial
  CRISPR gRNA sequence
ttcaagaaaatgccataaat

SEQ ID NO: 167012 - DNA, 20 bp, Artificial
  CRISPR gRNA sequence
caagaaaatgccataaatat

SEQ ID NO: 167013 - DNA, 20 bp, Artificial
  CRISPR gRNA sequence
aagaaaatgccataaatatg

SEQ ID NO: 167014 - DNA, 20 bp, Artificial
  CRISPR gRNA sequence
tttaatattttaatttcata

SEQ ID NO: 167015 - DNA, 20 bp, Artificial
  CRISPR gRNA sequence
aatattttaatttcatagca

SEQ ID NO: 167016 - DNA, 20 bp, Artificial
  CRISPR gRNA sequence
atattttaatttcatagcat

SEQ ID NO: 167017 - DNA, 20 bp, Artificial
  CRISPR gRNA sequence
taatttcatagcattggaca

SEQ ID NO: 167018 - DNA, 20 bp, Artificial
  CRISPR gRNA sequence
aatttcatagcattggacac

SEQ ID NO: 167019 - DNA, 20 bp, Artificial
  CRISPR gRNA sequence
atttcatagcattggacaca

SEQ ID NO: 167020 - DNA, 20 bp, Artificial
  CRISPR gRNA sequence
catagcattggacacacact

SEQ ID NO: 167021 - DNA, 20 bp, Artificial
  CRISPR gRNA sequence
atagcattggacacacactc

SEQ ID NO: 167022 - DNA, 20 bp, Artificial
  CRISPR gRNA sequence
gacacacactcaacatattg

SEQ ID NO: 167023 - DNA, 20 bp, Artificial
  CRISPR gRNA sequence
aacatattgaaatattgatt

SEQ ID NO: 167024 - DNA, 20 bp, Artificial
  CRISPR gRNA sequence
aaatattgattccttagaga

SEQ ID NO: 167025 - DNA, 20 bp, Artificial
  CRISPR gRNA sequence
attccttagagaaaaaaatg

SEQ ID NO: 167026 - DNA, 20 bp, Artificial
  CRISPR gRNA sequence
cttagagaaaaaaatggaaa

SEQ ID NO: 167027 - DNA, 20 bp, Artificial
  CRISPR gRNA sequence
agagaaaaaaatggaaaaaa

SEQ ID NO: 167028 - DNA, 20 bp, Artificial
  CRISPR gRNA sequence
gagaaaaaaatggaaaaaaa

SEQ ID NO: 167029 - DNA, 20 bp, Artificial
  CRISPR gRNA sequence
catctttctgctggagaatc

SEQ ID NO: 167030 - DNA, 20 bp, Artificial
  CRISPR gRNA sequence
tctgctggagaatctcggcc

SEQ ID NO: 167031 - DNA, 20 bp, Artificial
  CRISPR gRNA sequence
ctgctggagaatctcggccc

SEQ ID NO: 167032 - DNA, 20 bp, Artificial
  CRISPR gRNA sequence
tgctggagaatctcggcccc

SEQ ID NO: 167033 - DNA, 20 bp, Artificial
  CRISPR gRNA sequence
ctggagaatctcggccccca

SEQ ID NO: 167034 - DNA, 20 bp, Artificial
  CRISPR gRNA sequence
gagaatctcggcccccaggc

SEQ ID NO: 167035 - DNA, 20 bp, Artificial
  CRISPR gRNA sequence
ggcccccaggcatggggtgt

SEQ ID NO: 167036 - DNA, 20 bp, Artificial
  CRISPR gRNA sequence
gcctgcaggaggcgctgagg

SEQ ID NO: 167037 - DNA, 20 bp, Artificial
  CRISPR gRNA sequence
caggaggcgctgaggtcggc

SEQ ID NO: 167038 - DNA, 20 bp, Artificial
  CRISPR gRNA sequence
aggtcggccgggtcctctgg

SEQ ID NO: 167039 - DNA, 20 bp, Artificial
  CRISPR gRNA sequence
tggggaggaaggctgtgccc

SEQ ID NO: 167040 - DNA, 20 bp, Artificial
  CRISPR gRNA sequence
gggaggaaggctgtgcccat

SEQ ID NO: 167041 - DNA, 20 bp, Artificial
  CRISPR gRNA sequence
tgcccattgcctggggctgt

SEQ ID NO: 167042 - DNA, 20 bp, Artificial
  CRISPR gRNA sequence
cctggggctgtatggcaaaa

SEQ ID NO: 167043 - DNA, 20 bp, Artificial
  CRISPR gRNA sequence
gggctgtatggcaaaaattg

SEQ ID NO: 167044 - DNA, 20 bp, Artificial
  CRISPR gRNA sequence
tatggcaaaaattgtgttgg

SEQ ID NO: 167045 - DNA, 20 bp, Artificial
  CRISPR gRNA sequence
tgttgggtgtccttggcctt

SEQ ID NO: 167046 - DNA, 20 bp, Artificial
  CRISPR gRNA sequence
ggtgtccttggccttgccag

SEQ ID NO: 167047 - DNA, 20 bp, Artificial
  CRISPR gRNA sequence
ggccttgccagctcaggccc

SEQ ID NO: 167048 - DNA, 20 bp, Artificial
  CRISPR gRNA sequence
gccttgccagctcaggccct

SEQ ID NO: 167049 - DNA, 20 bp, Artificial
  CRISPR gRNA sequence
gccagctcaggccctcagtc

SEQ ID NO: 167050 - DNA, 20 bp, Artificial
  CRISPR gRNA sequence
ccagctcaggccctcagtcg

SEQ ID NO: 167051 - DNA, 20 bp, Artificial
  CRISPR gRNA sequence
aggccctcagtcgccggtca

SEQ ID NO: 167052 - DNA, 20 bp, Artificial
  CRISPR gRNA sequence
agtcgccggtcacctggggg

SEQ ID NO: 167053 - DNA, 20 bp, Artificial
  CRISPR gRNA sequence
gggggcctgcccgtcggagg

SEQ ID NO: 167054 - DNA, 20 bp, Artificial
  CRISPR gRNA sequence
cccgtcggagggctggttgg

SEQ ID NO: 167055 - DNA, 20 bp, Artificial
  CRISPR gRNA sequence
gttggctgactggatgaaca

SEQ ID NO: 167056 - DNA, 20 bp, Artificial
  CRISPR gRNA sequence
gctgactggatgaacatggg

SEQ ID NO: 167057 - DNA, 20 bp, Artificial
  CRISPR gRNA sequence
actggatgaacatgggctgg

SEQ ID NO: 167058 - DNA, 20 bp, Artificial
  CRISPR gRNA sequence
gatgaacatgggctgggcga

SEQ ID NO: 167059 - DNA, 20 bp, Artificial
  CRISPR gRNA sequence
ggcgaggtcctggcccgcag

SEQ ID NO: 167060 - DNA, 20 bp, Artificial
  CRISPR gRNA sequence
gcccgcaggcatggtgactt

SEQ ID NO: 167061 - DNA, 20 bp, Artificial
  CRISPR gRNA sequence
gctggatctggtagagctgc

SEQ ID NO: 167062 - DNA, 20 bp, Artificial
  CRISPR gRNA sequence
ctggatctggtagagctgct

SEQ ID NO: 167063 - DNA, 20 bp, Artificial
  CRISPR gRNA sequence
gatctggtagagctgctgcg

SEQ ID NO: 167064 - DNA, 20 bp, Artificial
  CRISPR gRNA sequence
gtagagctgctgcgaggggt

SEQ ID NO: 167065 - DNA, 20 bp, Artificial
  CRISPR gRNA sequence
ctgcgaggggtggagaggag

SEQ ID NO: 167066 - DNA, 20 bp, Artificial
  CRISPR gRNA sequence
cgaggggtggagaggagaga

SEQ ID NO: 167067 - DNA, 20 bp, Artificial
  CRISPR gRNA sequence
ggagaggggcatgcagctcc

SEQ ID NO: 167068 - DNA, 20 bp, Artificial
  CRISPR gRNA sequence
cctatgggtctcgagctggt

SEQ ID NO: 167069 - DNA, 20 bp, Artificial
  CRISPR gRNA sequence
tgggtctcgagctggttggg

SEQ ID NO: 167070 - DNA, 20 bp, Artificial
  CRISPR gRNA sequence
gagctggttgggggtcccag

SEQ ID NO: 167071 - DNA, 20 bp, Artificial
  CRISPR gRNA sequence
gttgggggtcccagatacct

SEQ ID NO: 167072 - DNA, 20 bp, Artificial
  CRISPR gRNA sequence
ggggtcccagatacctcaac

SEQ ID NO: 167073 - DNA, 20 bp, Artificial
  CRISPR gRNA sequence
aaccaccacccactgcaagg

SEQ ID NO: 167074 - DNA, 20 bp, Artificial
  CRISPR gRNA sequence
caaggcgtcagaaggaggag

SEQ ID NO: 167075 - DNA, 20 bp, Artificial
  CRISPR gRNA sequence
tgctggggttgggagcagca

SEQ ID NO: 167076 - DNA, 20 bp, Artificial
  CRISPR gRNA sequence
ctggggttgggagcagcaga

SEQ ID NO: 167077 - DNA, 20 bp, Artificial
  CRISPR gRNA sequence
gggttgggagcagcagacac

SEQ ID NO: 167078 - DNA, 20 bp, Artificial
  CRISPR gRNA sequence
ggagcagcagacacaggagg

SEQ ID NO: 167079 - DNA, 20 bp, Artificial
  CRISPR gRNA sequence
aatttcctgtggctttcact

SEQ ID NO: 167080 - DNA, 20 bp, Artificial
  CRISPR gRNA sequence
cctgtggctttcacttctct

SEQ ID NO: 167081 - DNA, 20 bp, Artificial
  CRISPR gRNA sequence
ctgtggctttcacttctctg

SEQ ID NO: 167082 - DNA, 20 bp, Artificial
  CRISPR gRNA sequence
tggctttcacttctctgggc

SEQ ID NO: 167083 - DNA, 20 bp, Artificial
  CRISPR gRNA sequence
tcacttctctgggctctgcc

SEQ ID NO: 167084 - DNA, 20 bp, Artificial
  CRISPR gRNA sequence
cacttctctgggctctgcct

SEQ ID NO: 167085 - DNA, 20 bp, Artificial
  CRISPR gRNA sequence
acttctctgggctctgcctc

SEQ ID NO: 167086 - DNA, 20 bp, Artificial
  CRISPR gRNA sequence
ctctgggctctgcctctccc

SEQ ID NO: 167087 - DNA, 20 bp, Artificial
  CRISPR gRNA sequence
tctgggctctgcctctcccg

SEQ ID NO: 167088 - DNA, 20 bp, Artificial
  CRISPR gRNA sequence
tgggctctgcctctcccgtt

SEQ ID NO: 167089 - DNA, 20 bp, Artificial
  CRISPR gRNA sequence
ggctctgcctctcccgttag

SEQ ID NO: 167090 - DNA, 20 bp, Artificial
  CRISPR gRNA sequence
tgcctctcccgttagctcag

SEQ ID NO: 167091 - DNA, 20 bp, Artificial
  CRISPR gRNA sequence
cctctcccgttagctcagag

SEQ ID NO: 167092 - DNA, 20 bp, Artificial
  CRISPR gRNA sequence
tcccgttagctcagagactc

SEQ ID NO: 167093 - DNA, 20 bp, Artificial
  CRISPR gRNA sequence
ccgttagctcagagactcga

SEQ ID NO: 167094 - DNA, 20 bp, Artificial
  CRISPR gRNA sequence
gctcagagactcgagcttgc

SEQ ID NO: 167095 - DNA, 20 bp, Artificial
  CRISPR gRNA sequence
agagactcgagcttgctgca

SEQ ID NO: 167096 - DNA, 20 bp, Artificial
  CRISPR gRNA sequence
gagcttgctgcacgctgttc

SEQ ID NO: 167097 - DNA, 20 bp, Artificial
  CRISPR gRNA sequence
gctgcacgctgttcctctgt

SEQ ID NO: 167098 - DNA, 20 bp, Artificial
  CRISPR gRNA sequence
ctgcacgctgttcctctgtg

SEQ ID NO: 167099 - DNA, 20 bp, Artificial
  CRISPR gRNA sequence
cacgctgttcctctgtggca

SEQ ID NO: 167100 - DNA, 20 bp, Artificial
  CRISPR gRNA sequence
ttcctctgtggcaaacacaa

SEQ ID NO: 167101 - DNA, 20 bp, Artificial
  CRISPR gRNA sequence
ctctgtggcaaacacaagca

SEQ ID NO: 167102 - DNA, 20 bp, Artificial
  CRISPR gRNA sequence
tgtggcaaacacaagcaatt

SEQ ID NO: 167103 - DNA, 20 bp, Artificial
  CRISPR gRNA sequence
tggcaaacacaagcaattcg

SEQ ID NO: 167104 - DNA, 20 bp, Artificial
  CRISPR gRNA sequence
gaaccactgtaccagcagct

SEQ ID NO: 167105 - DNA, 20 bp, Artificial
  CRISPR gRNA sequence
taccagcagcttggaagtca

SEQ ID NO: 167106 - DNA, 20 bp, Artificial
  CRISPR gRNA sequence
ggaagtcagcatttccccaa

SEQ ID NO: 167107 - DNA, 20 bp, Artificial
  CRISPR gRNA sequence
gaagtcagcatttccccaac

SEQ ID NO: 167108 - DNA, 20 bp, Artificial
  CRISPR gRNA sequence
ccccaactcttggtaatcta

SEQ ID NO: 167109 - DNA, 20 bp, Artificial
  CRISPR gRNA sequence
cccaactcttggtaatctac

SEQ ID NO: 167110 - DNA, 20 bp, Artificial
  CRISPR gRNA sequence
ttggtaatctacactggcag

SEQ ID NO: 167111 - DNA, 20 bp, Artificial
  CRISPR gRNA sequence
ggtaatctacactggcaggg

SEQ ID NO: 167112 - DNA, 20 bp, Artificial
  CRISPR gRNA sequence
gtaatctacactggcagggg

SEQ ID NO: 167113 - DNA, 20 bp, Artificial
  CRISPR gRNA sequence
cactggcaggggcagtagga

SEQ ID NO: 167114 - DNA, 20 bp, Artificial
  CRISPR gRNA sequence
gcaggggcagtaggattacc

SEQ ID NO: 167115 - DNA, 20 bp, Artificial
  CRISPR gRNA sequence
ccccctcctctccttctttt

SEQ ID NO: 167116 - DNA, 20 bp, Artificial
  CRISPR gRNA sequence
ctctccttcttttctcagaa

SEQ ID NO: 167117 - DNA, 20 bp, Artificial
  CRISPR gRNA sequence
tccttcttttctcagaatat

SEQ ID NO: 167118 - DNA, 20 bp, Artificial
  CRISPR gRNA sequence
cttcttttctcagaatatct

SEQ ID NO: 167119 - DNA, 20 bp, Artificial
  CRISPR gRNA sequence
cttttctcagaatatctggc

SEQ ID NO: 167120 - DNA, 20 bp, Artificial
  CRISPR gRNA sequence
ttttctcagaatatctggct

SEQ ID NO: 167121 - DNA, 20 bp, Artificial
  CRISPR gRNA sequence
ttctcagaatatctggctca

SEQ ID NO: 167122 - DNA, 20 bp, Artificial
  CRISPR gRNA sequence
tctcagaatatctggctcag

SEQ ID NO: 167123 - DNA, 20 bp, Artificial
  CRISPR gRNA sequence
ctcagaatatctggctcagg

SEQ ID NO: 167124 - DNA, 20 bp, Artificial
  CRISPR gRNA sequence
tcagaatatctggctcaggt

SEQ ID NO: 167125 - DNA, 20 bp, Artificial
  CRISPR gRNA sequence
agaatatctggctcaggttg

SEQ ID NO: 167126 - DNA, 20 bp, Artificial
  CRISPR gRNA sequence
gctcaggttgaaactaaact

SEQ ID NO: 167127 - DNA, 20 bp, Artificial
  CRISPR gRNA sequence
aggttgaaactaaactgaat

SEQ ID NO: 167128 - DNA, 20 bp, Artificial
  CRISPR gRNA sequence
aaactaaactgaatttgaat

SEQ ID NO: 167129 - DNA, 20 bp, Artificial
  CRISPR gRNA sequence
aactgaatttgaattttctc

SEQ ID NO: 167130 - DNA, 20 bp, Artificial
  CRISPR gRNA sequence
aatttgaattttctccatgg

SEQ ID NO: 167131 - DNA, 20 bp, Artificial
  CRISPR gRNA sequence
gaattttctccatggaccct

SEQ ID NO: 167132 - DNA, 20 bp, Artificial
  CRISPR gRNA sequence
aattttctccatggaccctg

SEQ ID NO: 167133 - DNA, 20 bp, Artificial
  CRISPR gRNA sequence
tctccatggaccctgctaag

SEQ ID NO: 167134 - DNA, 20 bp, Artificial
  CRISPR gRNA sequence
ctccatggaccctgctaagg

SEQ ID NO: 167135 - DNA, 20 bp, Artificial
  CRISPR gRNA sequence
tccatggaccctgctaagga

SEQ ID NO: 167136 - DNA, 20 bp, Artificial
  CRISPR gRNA sequence
catggaccctgctaaggagg

SEQ ID NO: 167137 - DNA, 20 bp, Artificial
  CRISPR gRNA sequence
ctaaggaggtggcctggtat

SEQ ID NO: 167138 - DNA, 20 bp, Artificial
  CRISPR gRNA sequence
aggaggtggcctggtattaa

SEQ ID NO: 167139 - DNA, 20 bp, Artificial
  CRISPR gRNA sequence
gtattaaacacttaactata

SEQ ID NO: 167140 - DNA, 20 bp, Artificial
  CRISPR gRNA sequence
aacacttaactatagccaag

SEQ ID NO: 167141 - DNA, 20 bp, Artificial
  CRISPR gRNA sequence
aactatagccaagacgctcc

SEQ ID NO: 167142 - DNA, 20 bp, Artificial
  CRISPR gRNA sequence
actatagccaagacgctcca

SEQ ID NO: 167143 - DNA, 20 bp, Artificial
  CRISPR gRNA sequence
tagccaagacgctccagggg

SEQ ID NO: 167144 - DNA, 20 bp, Artificial
  CRISPR gRNA sequence
caggggtggagaagatactc

SEQ ID NO: 167145 - DNA, 20 bp, Artificial
  CRISPR gRNA sequence
acacagccacttaggaaggt

SEQ ID NO: 167146 - DNA, 20 bp, Artificial
  CRISPR gRNA sequence
aggaaggtcagggctaattg

SEQ ID NO: 167147 - DNA, 20 bp, Artificial
  CRISPR gRNA sequence
ggaaggtcagggctaattga

SEQ ID NO: 167148 - DNA, 20 bp, Artificial
  CRISPR gRNA sequence
attgactacttggtttccca

SEQ ID NO: 167149 - DNA, 20 bp, Artificial
  CRISPR gRNA sequence
actacttggtttcccaggcg

SEQ ID NO: 167150 - DNA, 20 bp, Artificial
  CRISPR gRNA sequence
cttggtttcccaggcgctcc

SEQ ID NO: 167151 - DNA, 20 bp, Artificial
  CRISPR gRNA sequence
ggtttcccaggcgctcccca

SEQ ID NO: 167152 - DNA, 20 bp, Artificial
  CRISPR gRNA sequence
gtttcccaggcgctccccaa

SEQ ID NO: 167153 - DNA, 20 bp, Artificial
  CRISPR gRNA sequence
cccaggcgctccccaaagaa

SEQ ID NO: 167154 - DNA, 20 bp, Artificial
  CRISPR gRNA sequence
ccaggcgctccccaaagaag

SEQ ID NO: 167155 - DNA, 20 bp, Artificial
  CRISPR gRNA sequence
cccaaagaagccaaaagcca

SEQ ID NO: 167156 - DNA, 20 bp, Artificial
  CRISPR gRNA sequence
atgggagccctggcatgtaa

SEQ ID NO: 167157 - DNA, 20 bp, Artificial
  CRISPR gRNA sequence
gcatgtaagcctagcatgtg

SEQ ID NO: 167158 - DNA, 20 bp, Artificial
  CRISPR gRNA sequence
gcatgtggtgctggcagaag

SEQ ID NO: 167159 - DNA, 20 bp, Artificial
  CRISPR gRNA sequence
gcagaagccagaggtgggtc

SEQ ID NO: 167160 - DNA, 20 bp, Artificial
  CRISPR gRNA sequence
atgccagctcttctcccttt

SEQ ID NO: 167161 - DNA, 20 bp, Artificial
  CRISPR gRNA sequence
ttctcccttttgagcagcag

SEQ ID NO: 167162 - DNA, 20 bp, Artificial
  CRISPR gRNA sequence
ctcccttttgagcagcagag

SEQ ID NO: 167163 - DNA, 20 bp, Artificial
  CRISPR gRNA sequence
tcccttttgagcagcagagg

SEQ ID NO: 167164 - DNA, 20 bp, Artificial
  CRISPR gRNA sequence
ccttttgagcagcagagggc

SEQ ID NO: 167165 - DNA, 20 bp, Artificial
  CRISPR gRNA sequence
ttgagcagcagagggcacaa

SEQ ID NO: 167166 - DNA, 20 bp, Artificial
  CRISPR gRNA sequence
tgagcagcagagggcacaag

SEQ ID NO: 167167 - DNA, 20 bp, Artificial
  CRISPR gRNA sequence
gagcagcagagggcacaagt

SEQ ID NO: 167168 - DNA, 20 bp, Artificial
  CRISPR gRNA sequence
agcagcagagggcacaagtt

SEQ ID NO: 167169 - DNA, 20 bp, Artificial
  CRISPR gRNA sequence
gggcatgtcatcctatcatg

SEQ ID NO: 167170 - DNA, 20 bp, Artificial
  CRISPR gRNA sequence
ggcatgtcatcctatcatgt

SEQ ID NO: 167171 - DNA, 20 bp, Artificial
  CRISPR gRNA sequence
tcatgtcctcagtggtctct

SEQ ID NO: 167172 - DNA, 20 bp, Artificial
  CRISPR gRNA sequence
agtggtctctgggactgtac

SEQ ID NO: 167173 - DNA, 20 bp, Artificial
  CRISPR gRNA sequence
tgggactgtactgtgagggg

SEQ ID NO: 167174 - DNA, 20 bp, Artificial
  CRISPR gRNA sequence
ggactgtactgtgaggggaa

SEQ ID NO: 167175 - DNA, 20 bp, Artificial
  CRISPR gRNA sequence
tactgtgaggggaaagcaga

SEQ ID NO: 167176 - DNA, 20 bp, Artificial
  CRISPR gRNA sequence
tgaggggaaagcagagggaa

SEQ ID NO: 167177 - DNA, 20 bp, Artificial
  CRISPR gRNA sequence
tctcctcgcatggactgaaa

SEQ ID NO: 167178 - DNA, 20 bp, Artificial
  CRISPR gRNA sequence
tcctcgcatggactgaaaat

SEQ ID NO: 167179 - DNA, 20 bp, Artificial
  CRISPR gRNA sequence
ctcgcatggactgaaaatga

SEQ ID NO: 167180 - DNA, 20 bp, Artificial
  CRISPR gRNA sequence
gcatggactgaaaatgactg

SEQ ID NO: 167181 - DNA, 20 bp, Artificial
  CRISPR gRNA sequence
aaaatgactgaatttcaggc

SEQ ID NO: 167182 - DNA, 20 bp, Artificial
  CRISPR gRNA sequence
aatttcaggcacccagagag

SEQ ID NO: 167183 - DNA, 20 bp, Artificial
  CRISPR gRNA sequence
caggcacccagagagctcaa

SEQ ID NO: 167184 - DNA, 20 bp, Artificial
  CRISPR gRNA sequence
aggcacccagagagctcaag

SEQ ID NO: 167185 - DNA, 20 bp, Artificial
  CRISPR gRNA sequence
aagaggtcacgtgttctctg

SEQ ID NO: 167186 - DNA, 20 bp, Artificial
  CRISPR gRNA sequence
tctgcgtctcaacagtccat

SEQ ID NO: 167187 - DNA, 20 bp, Artificial
  CRISPR gRNA sequence
tgcgtctcaacagtccatgc

SEQ ID NO: 167188 - DNA, 20 bp, Artificial
  CRISPR gRNA sequence
cgtctcaacagtccatgcta

SEQ ID NO: 167189 - DNA, 20 bp, Artificial
  CRISPR gRNA sequence
aacagtccatgctattaaaa

SEQ ID NO: 167190 - DNA, 20 bp, Artificial
  CRISPR gRNA sequence
ttaaaacagcatcatggctt

SEQ ID NO: 167191 - DNA, 20 bp, Artificial
  CRISPR gRNA sequence
aaacagcatcatggcttaga

SEQ ID NO: 167192 - DNA, 20 bp, Artificial
  CRISPR gRNA sequence
agaggggaaaaaaatacagt

SEQ ID NO: 167193 - DNA, 20 bp, Artificial
  CRISPR gRNA sequence
gaggggaaaaaaatacagtt

SEQ ID NO: 167194 - DNA, 20 bp, Artificial
  CRISPR gRNA sequence
tagagagggaaacaggaaac

SEQ ID NO: 167195 - DNA, 20 bp, Artificial
  CRISPR gRNA sequence
gagagggaaacaggaaacct

SEQ ID NO: 167196 - DNA, 20 bp, Artificial
  CRISPR gRNA sequence
ctctctagtcctggctctgc

SEQ ID NO: 167197 - DNA, 20 bp, Artificial
  CRISPR gRNA sequence
tctagtcctggctctgcaat

SEQ ID NO: 167198 - DNA, 20 bp, Artificial
  CRISPR gRNA sequence
tagtcctggctctgcaatga

SEQ ID NO: 167199 - DNA, 20 bp, Artificial
  CRISPR gRNA sequence
gtcctggctctgcaatgaac

SEQ ID NO: 167200 - DNA, 20 bp, Artificial
  CRISPR gRNA sequence
gctctgcaatgaacatctag

SEQ ID NO: 167201 - DNA, 20 bp, Artificial
  CRISPR gRNA sequence
tgcaatgaacatctagggga

SEQ ID NO: 167202 - DNA, 20 bp, Artificial
  CRISPR gRNA sequence
caatgaacatctaggggagc

SEQ ID NO: 167203 - DNA, 20 bp, Artificial
  CRISPR gRNA sequence
ggggagcatggacaaggcac

SEQ ID NO: 167204 - DNA, 20 bp, Artificial
  CRISPR gRNA sequence
cccatctccagggttcagtt

SEQ ID NO: 167205 - DNA, 20 bp, Artificial
  CRISPR gRNA sequence
ccatctccagggttcagttt

SEQ ID NO: 167206 - DNA, 20 bp, Artificial
  CRISPR gRNA sequence
cagggttcagtttactcatc

SEQ ID NO: 167207 - DNA, 20 bp, Artificial
  CRISPR gRNA sequence
agtttactcatctgtaaaat

SEQ ID NO: 167208 - DNA, 20 bp, Artificial
  CRISPR gRNA sequence
actcatctgtaaaatggcaa

SEQ ID NO: 167209 - DNA, 20 bp, Artificial
  CRISPR gRNA sequence
ctcatctgtaaaatggcaat

SEQ ID NO: 167210 - DNA, 20 bp, Artificial
  CRISPR gRNA sequence
atctgtaaaatggcaatttg

SEQ ID NO: 167211 - DNA, 20 bp, Artificial
  CRISPR gRNA sequence
taaaatggcaatttgggcta

SEQ ID NO: 167212 - DNA, 20 bp, Artificial
  CRISPR gRNA sequence
gggctacatgtctaagatta

SEQ ID NO: 167213 - DNA, 20 bp, Artificial
  CRISPR gRNA sequence
ggctacatgtctaagattat

SEQ ID NO: 167214 - DNA, 20 bp, Artificial
  CRISPR gRNA sequence
catgtctaagattattttag

SEQ ID NO: 167215 - DNA, 20 bp, Artificial
  CRISPR gRNA sequence
agattattttagttcccact

SEQ ID NO: 167216 - DNA, 20 bp, Artificial
  CRISPR gRNA sequence
ttttagttcccactaagtct

SEQ ID NO: 167217 - DNA, 20 bp, Artificial
  CRISPR gRNA sequence
tagttcccactaagtctata

SEQ ID NO: 167218 - DNA, 20 bp, Artificial
  CRISPR gRNA sequence
agttcccactaagtctataa

SEQ ID NO: 167219 - DNA, 20 bp, Artificial
  CRISPR gRNA sequence
gttcccactaagtctataaa

SEQ ID NO: 167220 - DNA, 20 bp, Artificial
  CRISPR gRNA sequence
ccactaagtctataaaacta

SEQ ID NO: 167221 - DNA, 20 bp, Artificial
  CRISPR gRNA sequence
agtctataaaactaaaggat

SEQ ID NO: 167222 - DNA, 20 bp, Artificial
  CRISPR gRNA sequence
taaaactaaaggataggtgc

SEQ ID NO: 167223 - DNA, 20 bp, Artificial
  CRISPR gRNA sequence
aaggataggtgccctgattt

SEQ ID NO: 167224 - DNA, 20 bp, Artificial
  CRISPR gRNA sequence
atttaaataccgtacttgtt

SEQ ID NO: 167225 - DNA, 20 bp, Artificial
  CRISPR gRNA sequence
aaataccgtacttgttttaa

SEQ ID NO: 167226 - DNA, 20 bp, Artificial
  CRISPR gRNA sequence
aataccgtacttgttttaac

SEQ ID NO: 167227 - DNA, 20 bp, Artificial
  CRISPR gRNA sequence
gttttaacaatttctgtcca

SEQ ID NO: 167228 - DNA, 20 bp, Artificial
  CRISPR gRNA sequence
ttttaacaatttctgtccac

SEQ ID NO: 167229 - DNA, 20 bp, Artificial
  CRISPR gRNA sequence
taacaatttctgtccactca

SEQ ID NO: 167230 - DNA, 20 bp, Artificial
  CRISPR gRNA sequence
aacaatttctgtccactcac

SEQ ID NO: 167231 - DNA, 20 bp, Artificial
  CRISPR gRNA sequence
acaatttctgtccactcact

SEQ ID NO: 167232 - DNA, 20 bp, Artificial
  CRISPR gRNA sequence
ctgtccactcactgttagta

SEQ ID NO: 167233 - DNA, 20 bp, Artificial
  CRISPR gRNA sequence
tgtccactcactgttagtag

SEQ ID NO: 167234 - DNA, 20 bp, Artificial
  CRISPR gRNA sequence
tccactcactgttagtagag

SEQ ID NO: 167235 - DNA, 20 bp, Artificial
  CRISPR gRNA sequence
actgttagtagaggacagga

SEQ ID NO: 167236 - DNA, 20 bp, Artificial
  CRISPR gRNA sequence
ttagtagaggacaggacagt

SEQ ID NO: 167237 - DNA, 20 bp, Artificial
  CRISPR gRNA sequence
gtagaggacaggacagttgc

SEQ ID NO: 167238 - DNA, 20 bp, Artificial
  CRISPR gRNA sequence
ccctaaccatccaaacccag

SEQ ID NO: 167239 - DNA, 20 bp, Artificial
  CRISPR gRNA sequence
accatccaaacccagatact

SEQ ID NO: 167240 - DNA, 20 bp, Artificial
  CRISPR gRNA sequence
cctgctaccctgccccgcaa

SEQ ID NO: 167241 - DNA, 20 bp, Artificial
  CRISPR gRNA sequence
ctaccctgccccgcaaatcc

SEQ ID NO: 167242 - DNA, 20 bp, Artificial
  CRISPR gRNA sequence
ccctgccccgcaaatcctca

SEQ ID NO: 167243 - DNA, 20 bp, Artificial
  CRISPR gRNA sequence
ccccgcaaatcctcaccctc

SEQ ID NO: 167244 - DNA, 20 bp, Artificial
  CRISPR gRNA sequence
accctctgcccagcccaggt

SEQ ID NO: 167245 - DNA, 20 bp, Artificial
  CRISPR gRNA sequence
tgcccagcccaggttgggta

SEQ ID NO: 167246 - DNA, 20 bp, Artificial
  CRISPR gRNA sequence
cccagcccaggttgggtacc

SEQ ID NO: 167247 - DNA, 20 bp, Artificial
  CRISPR gRNA sequence
ggtaccctacctgtccatct

SEQ ID NO: 167248 - DNA, 20 bp, Artificial
  CRISPR gRNA sequence
cctgtccatctgtgaactgg

SEQ ID NO: 167249 - DNA, 20 bp, Artificial
  CRISPR gRNA sequence
tccatctgtgaactggctga

SEQ ID NO: 167250 - DNA, 20 bp, Artificial
  CRISPR gRNA sequence
tgaactggctgaactgctgc

SEQ ID NO: 167251 - DNA, 20 bp, Artificial
  CRISPR gRNA sequence
gctgaactgctgctgtcctt

SEQ ID NO: 167252 - DNA, 20 bp, Artificial
  CRISPR gRNA sequence
aactgctgctgtccttgctg

SEQ ID NO: 167253 - DNA, 20 bp, Artificial
  CRISPR gRNA sequence
ctgctgtccttgctggacct

SEQ ID NO: 167254 - DNA, 20 bp, Artificial
  CRISPR gRNA sequence
ctgtccttgctggacctctg

SEQ ID NO: 167255 - DNA, 20 bp, Artificial
  CRISPR gRNA sequence
tccttgctggacctctgtct

SEQ ID NO: 167256 - DNA, 20 bp, Artificial
  CRISPR gRNA sequence
gctggacctctgtctgtgta

SEQ ID NO: 167257 - DNA, 20 bp, Artificial
  CRISPR gRNA sequence
ctggacctctgtctgtgtaa

SEQ ID NO: 167258 - DNA, 20 bp, Artificial
  CRISPR gRNA sequence
gacctctgtctgtgtaatct

SEQ ID NO: 167259 - DNA, 20 bp, Artificial
  CRISPR gRNA sequence
tgtctgtgtaatctgtaaga

SEQ ID NO: 167260 - DNA, 20 bp, Artificial
  CRISPR gRNA sequence
tctgtgtaatctgtaagaat

SEQ ID NO: 167261 - DNA, 20 bp, Artificial
  CRISPR gRNA sequence
tgtaatctgtaagaatcaag

SEQ ID NO: 167262 - DNA, 20 bp, Artificial
  CRISPR gRNA sequence
taagaatcaagatggtagag

SEQ ID NO: 167263 - DNA, 20 bp, Artificial
  CRISPR gRNA sequence
gtatgtcagctgcagggtct

SEQ ID NO: 167264 - DNA, 20 bp, Artificial
  CRISPR gRNA sequence
cagggtctgatccaccagcc

SEQ ID NO: 167265 - DNA, 20 bp, Artificial
  CRISPR gRNA sequence
atccaccagcccaccaccca

SEQ ID NO: 167266 - DNA, 20 bp, Artificial
  CRISPR gRNA sequence
aatgggtagtaagcaagcaa

SEQ ID NO: 167267 - DNA, 20 bp, Artificial
  CRISPR gRNA sequence
ctaatctagcactgatggct

SEQ ID NO: 167268 - DNA, 20 bp, Artificial
  CRISPR gRNA sequence
atctagcactgatggctacg

SEQ ID NO: 167269 - DNA, 20 bp, Artificial
  CRISPR gRNA sequence
gcactgatggctacgtcaag

SEQ ID NO: 167270 - DNA, 20 bp, Artificial
  CRISPR gRNA sequence
atggctacgtcaagagttgg

SEQ ID NO: 167271 - DNA, 20 bp, Artificial
  CRISPR gRNA sequence
cgtcaagagttggcagcaca

SEQ ID NO: 167272 - DNA, 20 bp, Artificial
  CRISPR gRNA sequence
gcagcacaaagtgacatcga

SEQ ID NO: 167273 - DNA, 20 bp, Artificial
  CRISPR gRNA sequence
gagcacataatagatagttc

SEQ ID NO: 167274 - DNA, 20 bp, Artificial
  CRISPR gRNA sequence
ccacacccatctctctaatg

SEQ ID NO: 167275 - DNA, 20 bp, Artificial
  CRISPR gRNA sequence
tctaatgaatgcctactccc

SEQ ID NO: 167276 - DNA, 20 bp, Artificial
  CRISPR gRNA sequence
taatgaatgcctactccctc

SEQ ID NO: 167277 - DNA, 20 bp, Artificial
  CRISPR gRNA sequence
atgaatgcctactccctcaa

SEQ ID NO: 167278 - DNA, 20 bp, Artificial
  CRISPR gRNA sequence
ctccctcaaccacccactca

SEQ ID NO: 167279 - DNA, 20 bp, Artificial
  CRISPR gRNA sequence
cctcaaccacccactcatct

SEQ ID NO: 167280 - DNA, 20 bp, Artificial
  CRISPR gRNA sequence
aaccacccactcatctcaaa

SEQ ID NO: 167281 - DNA, 20 bp, Artificial
  CRISPR gRNA sequence
atctcaaactctgaggctca

SEQ ID NO: 167282 - DNA, 20 bp, Artificial
  CRISPR gRNA sequence
aaactctgaggctcaaacag

SEQ ID NO: 167283 - DNA, 20 bp, Artificial
  CRISPR gRNA sequence
tgaggctcaaacagaacaca

SEQ ID NO: 167284 - DNA, 20 bp, Artificial
  CRISPR gRNA sequence
aggctcaaacagaacacatg

SEQ ID NO: 167285 - DNA, 20 bp, Artificial
  CRISPR gRNA sequence
aaacagaacacatggaccct

SEQ ID NO: 167286 - DNA, 20 bp, Artificial
  CRISPR gRNA sequence
ggtgctatggtttggggtag

SEQ ID NO: 167287 - DNA, 20 bp, Artificial
  CRISPR gRNA sequence
tggtttggggtagaagtcct

SEQ ID NO: 167288 - DNA, 20 bp, Artificial
  CRISPR gRNA sequence
ggggtagaagtcctaagagt

SEQ ID NO: 167289 - DNA, 20 bp, Artificial
  CRISPR gRNA sequence
gggtagaagtcctaagagtc

SEQ ID NO: 167290 - DNA, 20 bp, Artificial
  CRISPR gRNA sequence
agagtcagtctttcagccag

SEQ ID NO: 167291 - DNA, 20 bp, Artificial
  CRISPR gRNA sequence
tcagccagtgaaggcggact

SEQ ID NO: 167292 - DNA, 20 bp, Artificial
  CRISPR gRNA sequence
cagccagtgaaggcggactg

SEQ ID NO: 167293 - DNA, 20 bp, Artificial
  CRISPR gRNA sequence
agccagtgaaggcggactgc

SEQ ID NO: 167294 - DNA, 20 bp, Artificial
  CRISPR gRNA sequence
caaagtgtcagacaaagtgg

SEQ ID NO: 167295 - DNA, 20 bp, Artificial
  CRISPR gRNA sequence
tttcattcttggaaggtggg

SEQ ID NO: 167296 - DNA, 20 bp, Artificial
  CRISPR gRNA sequence
tcattcttggaaggtgggct

SEQ ID NO: 167297 - DNA, 20 bp, Artificial
  CRISPR gRNA sequence
cattcttggaaggtgggctc

SEQ ID NO: 167298 - DNA, 20 bp, Artificial
  CRISPR gRNA sequence
attcttggaaggtgggctcc

SEQ ID NO: 167299 - DNA, 20 bp, Artificial
  CRISPR gRNA sequence
ttggaaggtgggctccaaac

SEQ ID NO: 167300 - DNA, 20 bp, Artificial
  CRISPR gRNA sequence
ggaaggtgggctccaaacca

SEQ ID NO: 167301 - DNA, 20 bp, Artificial
  CRISPR gRNA sequence
gaaggtgggctccaaaccaa

SEQ ID NO: 167302 - DNA, 20 bp, Artificial
  CRISPR gRNA sequence
caaaccaaacccgtatcacc

SEQ ID NO: 167303 - DNA, 20 bp, Artificial
  CRISPR gRNA sequence
actggaatatgaaacaccct

SEQ ID NO: 167304 - DNA, 20 bp, Artificial
  CRISPR gRNA sequence
gaatatgaaacaccctggcg

SEQ ID NO: 167305 - DNA, 20 bp, Artificial
  CRISPR gRNA sequence
gcgagcaagtggccttggtc

SEQ ID NO: 167306 - DNA, 20 bp, Artificial
  CRISPR gRNA sequence
ggtcccagcagtcctcatgg

SEQ ID NO: 167307 - DNA, 20 bp, Artificial
  CRISPR gRNA sequence
gtcccagcagtcctcatggc

SEQ ID NO: 167308 - DNA, 20 bp, Artificial
  CRISPR gRNA sequence
atggcaaacctatgaagtac

SEQ ID NO: 167309 - DNA, 20 bp, Artificial
  CRISPR gRNA sequence
tgaagtactttttccgagag

SEQ ID NO: 167310 - DNA, 20 bp, Artificial
  CRISPR gRNA sequence
tttccgagagaggcactgtg

SEQ ID NO: 167311 - DNA, 20 bp, Artificial
  CRISPR gRNA sequence
ttccgagagaggcactgtgc

SEQ ID NO: 167312 - DNA, 20 bp, Artificial
  CRISPR gRNA sequence
tccgagagaggcactgtgca

SEQ ID NO: 167313 - DNA, 20 bp, Artificial
  CRISPR gRNA sequence
ccgagagaggcactgtgcag

SEQ ID NO: 167314 - DNA, 20 bp, Artificial
  CRISPR gRNA sequence
cgagagaggcactgtgcagc

SEQ ID NO: 167315 - DNA, 20 bp, Artificial
  CRISPR gRNA sequence
tgcagccctctgggccaaag

SEQ ID NO: 167316 - DNA, 20 bp, Artificial
  CRISPR gRNA sequence
tgggccaaaggaggggagga

SEQ ID NO: 167317 - DNA, 20 bp, Artificial
  CRISPR gRNA sequence
ggccaaaggaggggaggaga

SEQ ID NO: 167318 - DNA, 20 bp, Artificial
  CRISPR gRNA sequence
atcacaagtacttaaaatct

SEQ ID NO: 167319 - DNA, 20 bp, Artificial
  CRISPR gRNA sequence
tcacaagtacttaaaatctt

SEQ ID NO: 167320 - DNA, 20 bp, Artificial
  CRISPR gRNA sequence
aaaatcttatgtgtggactg

SEQ ID NO: 167321 - DNA, 20 bp, Artificial
  CRISPR gRNA sequence
aaatcttatgtgtggactgt

SEQ ID NO: 167322 - DNA, 20 bp, Artificial
  CRISPR gRNA sequence
atgtgtggactgtgaatgga

SEQ ID NO: 167323 - DNA, 20 bp, Artificial
  CRISPR gRNA sequence
tgtgtggactgtgaatggat

SEQ ID NO: 167324 - DNA, 20 bp, Artificial
  CRISPR gRNA sequence
tgaatggattttagataaat

SEQ ID NO: 167325 - DNA, 20 bp, Artificial
  CRISPR gRNA sequence
tagataaatgtactgacatg

SEQ ID NO: 167326 - DNA, 20 bp, Artificial
  CRISPR gRNA sequence
agataaatgtactgacatgt

SEQ ID NO: 167327 - DNA, 20 bp, Artificial
  CRISPR gRNA sequence
gataaatgtactgacatgta

SEQ ID NO: 167328 - DNA, 20 bp, Artificial
  CRISPR gRNA sequence
acatgtagaactgcatatat

SEQ ID NO: 167329 - DNA, 20 bp, Artificial
  CRISPR gRNA sequence
catatataatgacaactgct

SEQ ID NO: 167330 - DNA, 20 bp, Artificial
  CRISPR gRNA sequence
ctgggagcagctcggtaaac

SEQ ID NO: 167331 - DNA, 20 bp, Artificial
  CRISPR gRNA sequence
ggagcagctcggtaaactag

SEQ ID NO: 167332 - DNA, 20 bp, Artificial
  CRISPR gRNA sequence
ggtaaactagaaagaagact

SEQ ID NO: 167333 - DNA, 20 bp, Artificial
  CRISPR gRNA sequence
gaaagaagactgcggtgtgc

SEQ ID NO: 167334 - DNA, 20 bp, Artificial
  CRISPR gRNA sequence
cggtgtgcatgcacatgtgt

SEQ ID NO: 167335 - DNA, 20 bp, Artificial
  CRISPR gRNA sequence
ctatggaacatttggccagc

SEQ ID NO: 167336 - DNA, 20 bp, Artificial
  CRISPR gRNA sequence
tggaacatttggccagcagt

SEQ ID NO: 167337 - DNA, 20 bp, Artificial
  CRISPR gRNA sequence
ggccagcagtgtcctctgtg

SEQ ID NO: 167338 - DNA, 20 bp, Artificial
  CRISPR gRNA sequence
gccagcagtgtcctctgtgt

SEQ ID NO: 167339 - DNA, 20 bp, Artificial
  CRISPR gRNA sequence
tgtgtaccatttcctggaat

SEQ ID NO: 167340 - DNA, 20 bp, Artificial
  CRISPR gRNA sequence
tgtaccatttcctggaatca

SEQ ID NO: 167341 - DNA, 20 bp, Artificial
  CRISPR gRNA sequence
cctggaatcatcacagccag

SEQ ID NO: 167342 - DNA, 20 bp, Artificial
  CRISPR gRNA sequence
ctggaatcatcacagccagc

SEQ ID NO: 167343 - DNA, 20 bp, Artificial
  CRISPR gRNA sequence
gaatcatcacagccagcctg

SEQ ID NO: 167344 - DNA, 20 bp, Artificial
  CRISPR gRNA sequence
caagacaaggactgtcctct

SEQ ID NO: 167345 - DNA, 20 bp, Artificial
  CRISPR gRNA sequence
tcctctcaaatgtcctcacc

SEQ ID NO: 167346 - DNA, 20 bp, Artificial
  CRISPR gRNA sequence
tcaaatgtcctcaccatggc

SEQ ID NO: 167347 - DNA, 20 bp, Artificial
  CRISPR gRNA sequence
aaatgtcctcaccatggcca

SEQ ID NO: 167348 - DNA, 20 bp, Artificial
  CRISPR gRNA sequence
accatggccaaaaacaaccc

SEQ ID NO: 167349 - DNA, 20 bp, Artificial
  CRISPR gRNA sequence
caggcctacccatgaggcta

SEQ ID NO: 167350 - DNA, 20 bp, Artificial
  CRISPR gRNA sequence
cccatgaggctatgaggaac

SEQ ID NO: 167351 - DNA, 20 bp, Artificial
  CRISPR gRNA sequence
tgaggaacaagaaagggaac

SEQ ID NO: 167352 - DNA, 20 bp, Artificial
  CRISPR gRNA sequence
catgactattttttactatt

SEQ ID NO: 167353 - DNA, 20 bp, Artificial
  CRISPR gRNA sequence
atgactattttttactattg

SEQ ID NO: 167354 - DNA, 20 bp, Artificial
  CRISPR gRNA sequence
ttttttactattgttcctta

SEQ ID NO: 167355 - DNA, 20 bp, Artificial
  CRISPR gRNA sequence
tttactattgttccttattt

SEQ ID NO: 167356 - DNA, 20 bp, Artificial
  CRISPR gRNA sequence
ttactattgttccttatttt

SEQ ID NO: 167357 - DNA, 20 bp, Artificial
  CRISPR gRNA sequence
tactattgttccttattttg

SEQ ID NO: 167358 - DNA, 20 bp, Artificial
  CRISPR gRNA sequence
actattgttccttattttgg

SEQ ID NO: 167359 - DNA, 20 bp, Artificial
  CRISPR gRNA sequence
ctattgttccttattttggt

SEQ ID NO: 167360 - DNA, 20 bp, Artificial
  CRISPR gRNA sequence
ttgttccttattttggtcct

SEQ ID NO: 167361 - DNA, 20 bp, Artificial
  CRISPR gRNA sequence
ttccttattttggtcctttt

SEQ ID NO: 167362 - DNA, 20 bp, Artificial
  CRISPR gRNA sequence
cttattttggtccttttcct

SEQ ID NO: 167363 - DNA, 20 bp, Artificial
  CRISPR gRNA sequence
attttggtccttttccttcc

SEQ ID NO: 167364 - DNA, 20 bp, Artificial
  CRISPR gRNA sequence
ttttggtccttttccttcca

SEQ ID NO: 167365 - DNA, 20 bp, Artificial
  CRISPR gRNA sequence
tggtccttttccttccaaca

SEQ ID NO: 167366 - DNA, 20 bp, Artificial
  CRISPR gRNA sequence
ggtccttttccttccaacag

SEQ ID NO: 167367 - DNA, 20 bp, Artificial
  CRISPR gRNA sequence
gtccttttccttccaacagc

SEQ ID NO: 167368 - DNA, 20 bp, Artificial
  CRISPR gRNA sequence
ttccttccaacagcctataa

SEQ ID NO: 167369 - DNA, 20 bp, Artificial
  CRISPR gRNA sequence
tccttccaacagcctataag

SEQ ID NO: 167370 - DNA, 20 bp, Artificial
  CRISPR gRNA sequence
ccttccaacagcctataaga

SEQ ID NO: 167371 - DNA, 20 bp, Artificial
  CRISPR gRNA sequence
cttccaacagcctataagat

SEQ ID NO: 167372 - DNA, 20 bp, Artificial
  CRISPR gRNA sequence
ccaacagcctataagatgcc

SEQ ID NO: 167373 - DNA, 20 bp, Artificial
  CRISPR gRNA sequence
caacagcctataagatgcct

SEQ ID NO: 167374 - DNA, 20 bp, Artificial
  CRISPR gRNA sequence
taagatgcctgagggcagga

SEQ ID NO: 167375 - DNA, 20 bp, Artificial
  CRISPR gRNA sequence
agggcaggagcccatacaaa

SEQ ID NO: 167376 - DNA, 20 bp, Artificial
  CRISPR gRNA sequence
gtattccagaaatgttgcag

SEQ ID NO: 167377 - DNA, 20 bp, Artificial
  CRISPR gRNA sequence
cagaaatgttgcagaataaa

SEQ ID NO: 167378 - DNA, 20 bp, Artificial
  CRISPR gRNA sequence
cagaataaacaagtgagcct

SEQ ID NO: 167379 - DNA, 20 bp, Artificial
  CRISPR gRNA sequence
agacaaatggaaaatattcc

SEQ ID NO: 167380 - DNA, 20 bp, Artificial
  CRISPR gRNA sequence
cacatagataagaaggttaa

SEQ ID NO: 167381 - DNA, 20 bp, Artificial
  CRISPR gRNA sequence
actgctctgtggccagcagg

SEQ ID NO: 167382 - DNA, 20 bp, Artificial
  CRISPR gRNA sequence
ctctgtggccagcaggattg

SEQ ID NO: 167383 - DNA, 20 bp, Artificial
  CRISPR gRNA sequence
tgtggccagcaggattgcca

SEQ ID NO: 167384 - DNA, 20 bp, Artificial
  CRISPR gRNA sequence
tggccagcaggattgccatt

SEQ ID NO: 167385 - DNA, 20 bp, Artificial
  CRISPR gRNA sequence
ccattcatattagctgagat

SEQ ID NO: 167386 - DNA, 20 bp, Artificial
  CRISPR gRNA sequence
atattagctgagatttcatt

SEQ ID NO: 167387 - DNA, 20 bp, Artificial
  CRISPR gRNA sequence
gctgagatttcatttacctt

SEQ ID NO: 167388 - DNA, 20 bp, Artificial
  CRISPR gRNA sequence
agatttcatttacctttaca

SEQ ID NO: 167389 - DNA, 20 bp, Artificial
  CRISPR gRNA sequence
catttacctttacattttat

SEQ ID NO: 167390 - DNA, 20 bp, Artificial
  CRISPR gRNA sequence
atttacctttacattttatt

SEQ ID NO: 167391 - DNA, 20 bp, Artificial
  CRISPR gRNA sequence
acctttacattttatttaca

SEQ ID NO: 167392 - DNA, 20 bp, Artificial
  CRISPR gRNA sequence
cctttacattttatttacat

SEQ ID NO: 167393 - DNA, 20 bp, Artificial
  CRISPR gRNA sequence
tacattttatttacatatta

SEQ ID NO: 167394 - DNA, 20 bp, Artificial
  CRISPR gRNA sequence
acattttatttacatattat

SEQ ID NO: 167395 - DNA, 20 bp, Artificial
  CRISPR gRNA sequence
cattttatttacatattatt

SEQ ID NO: 167396 - DNA, 20 bp, Artificial
  CRISPR gRNA sequence
tatttacatattattcattc

SEQ ID NO: 167397 - DNA, 20 bp, Artificial
  CRISPR gRNA sequence
atttacatattattcattca

SEQ ID NO: 167398 - DNA, 20 bp, Artificial
  CRISPR gRNA sequence
tttacatattattcattcag

SEQ ID NO: 167399 - DNA, 20 bp, Artificial
  CRISPR gRNA sequence
acatattattcattcagctt

SEQ ID NO: 167400 - DNA, 20 bp, Artificial
  CRISPR gRNA sequence
catattattcattcagcttc

SEQ ID NO: 167401 - DNA, 20 bp, Artificial
  CRISPR gRNA sequence
ttcattcagcttcattcaac

SEQ ID NO: 167402 - DNA, 20 bp, Artificial
  CRISPR gRNA sequence
attcagcttcattcaacaaa

SEQ ID NO: 167403 - DNA, 20 bp, Artificial
  CRISPR gRNA sequence
agcttcattcaacaaacatt

SEQ ID NO: 167404 - DNA, 20 bp, Artificial
  CRISPR gRNA sequence
cattcaacaaacatttactg

SEQ ID NO: 167405 - DNA, 20 bp, Artificial
  CRISPR gRNA sequence
attcaacaaacatttactga

SEQ ID NO: 167406 - DNA, 20 bp, Artificial
  CRISPR gRNA sequence
aacaaacatttactgagcac

SEQ ID NO: 167407 - DNA, 20 bp, Artificial
  CRISPR gRNA sequence
actgagcacctactaagtat

SEQ ID NO: 167408 - DNA, 20 bp, Artificial
  CRISPR gRNA sequence
ctgagcacctactaagtatt

SEQ ID NO: 167409 - DNA, 20 bp, Artificial
  CRISPR gRNA sequence
agcacctactaagtattagg

SEQ ID NO: 167410 - DNA, 20 bp, Artificial
  CRISPR gRNA sequence
ctaagtattaggttgtcata

SEQ ID NO: 167411 - DNA, 20 bp, Artificial
  CRISPR gRNA sequence
agtattaggttgtcataatt

SEQ ID NO: 167412 - DNA, 20 bp, Artificial
  CRISPR gRNA sequence
ggttgtcataattacaacct

SEQ ID NO: 167413 - DNA, 20 bp, Artificial
  CRISPR gRNA sequence
tcataattacaacctgttgt

SEQ ID NO: 167414 - DNA, 20 bp, Artificial
  CRISPR gRNA sequence
caacctgttgttacaaagat

SEQ ID NO: 167415 - DNA, 20 bp, Artificial
  CRISPR gRNA sequence
ttgttacaaagattttcatt

SEQ ID NO: 167416 - DNA, 20 bp, Artificial
  CRISPR gRNA sequence
ttacaaagattttcattgcc

SEQ ID NO: 167417 - DNA, 20 bp, Artificial
  CRISPR gRNA sequence
caaagattttcattgccttc

SEQ ID NO: 167418 - DNA, 20 bp, Artificial
  CRISPR gRNA sequence
tcattgccttcagctaccac

SEQ ID NO: 167419 - DNA, 20 bp, Artificial
  CRISPR gRNA sequence
cattgccttcagctaccact

SEQ ID NO: 167420 - DNA, 20 bp, Artificial
  CRISPR gRNA sequence
attgccttcagctaccactt

SEQ ID NO: 167421 - DNA, 20 bp, Artificial
  CRISPR gRNA sequence
ccttcagctaccactttctt

SEQ ID NO: 167422 - DNA, 20 bp, Artificial
  CRISPR gRNA sequence
cagctaccactttcttgctt

SEQ ID NO: 167423 - DNA, 20 bp, Artificial
  CRISPR gRNA sequence
agctaccactttcttgcttc

SEQ ID NO: 167424 - DNA, 20 bp, Artificial
  CRISPR gRNA sequence
ccactttcttgcttctcccc

SEQ ID NO: 167425 - DNA, 20 bp, Artificial
  CRISPR gRNA sequence
tcttgcttctccccagcctc

SEQ ID NO: 167426 - DNA, 20 bp, Artificial
  CRISPR gRNA sequence
cttgcttctccccagcctct

SEQ ID NO: 167427 - DNA, 20 bp, Artificial
  CRISPR gRNA sequence
ttgcttctccccagcctctc

SEQ ID NO: 167428 - DNA, 20 bp, Artificial
  CRISPR gRNA sequence
gcttctccccagcctctccc

SEQ ID NO: 167429 - DNA, 20 bp, Artificial
  CRISPR gRNA sequence
cttctccccagcctctccca

SEQ ID NO: 167430 - DNA, 20 bp, Artificial
  CRISPR gRNA sequence
ctccccagcctctcccattt

SEQ ID NO: 167431 - DNA, 20 bp, Artificial
  CRISPR gRNA sequence
tccccagcctctcccatttt

SEQ ID NO: 167432 - DNA, 20 bp, Artificial
  CRISPR gRNA sequence
cccagcctctcccatttttt

SEQ ID NO: 167433 - DNA, 20 bp, Artificial
  CRISPR gRNA sequence
tcccattttttggctttagt

SEQ ID NO: 167434 - DNA, 20 bp, Artificial
  CRISPR gRNA sequence
ccattttttggctttagttc

SEQ ID NO: 167435 - DNA, 20 bp, Artificial
  CRISPR gRNA sequence
tttggctttagttctgttcc

SEQ ID NO: 167436 - DNA, 20 bp, Artificial
  CRISPR gRNA sequence
ttggctttagttctgttccc

SEQ ID NO: 167437 - DNA, 20 bp, Artificial
  CRISPR gRNA sequence
tggctttagttctgttccca

SEQ ID NO: 167438 - DNA, 20 bp, Artificial
  CRISPR gRNA sequence
ggctttagttctgttcccaa

SEQ ID NO: 167439 - DNA, 20 bp, Artificial
  CRISPR gRNA sequence
gctttagttctgttcccaaa

SEQ ID NO: 167440 - DNA, 20 bp, Artificial
  CRISPR gRNA sequence
tagttctgttcccaaaacgg

SEQ ID NO: 167441 - DNA, 20 bp, Artificial
  CRISPR gRNA sequence
agttctgttcccaaaacgga

SEQ ID NO: 167442 - DNA, 20 bp, Artificial
  CRISPR gRNA sequence
gttctgttcccaaaacggac

SEQ ID NO: 167443 - DNA, 20 bp, Artificial
  CRISPR gRNA sequence
tgttcccaaaacggactttt

SEQ ID NO: 167444 - DNA, 20 bp, Artificial
  CRISPR gRNA sequence
ttcccaaaacggactttttt

SEQ ID NO: 167445 - DNA, 20 bp, Artificial
  CRISPR gRNA sequence
ccaaaacggactttttttaa

SEQ ID NO: 167446 - DNA, 20 bp, Artificial
  CRISPR gRNA sequence
tttttaatttttattttttg

SEQ ID NO: 167447 - DNA, 20 bp, Artificial
  CRISPR gRNA sequence
ttttaatttttattttttga

SEQ ID NO: 167448 - DNA, 20 bp, Artificial
  CRISPR gRNA sequence
tttaatttttattttttgag

SEQ ID NO: 167449 - DNA, 20 bp, Artificial
  CRISPR gRNA sequence
ttaatttttattttttgaga

SEQ ID NO: 167450 - DNA, 20 bp, Artificial
  CRISPR gRNA sequence
taatttttattttttgagac

SEQ ID NO: 167451 - DNA, 20 bp, Artificial
  CRISPR gRNA sequence
aatttttattttttgagaca

SEQ ID NO: 167452 - DNA, 20 bp, Artificial
  CRISPR gRNA sequence
atttttattttttgagacag

SEQ ID NO: 167453 - DNA, 20 bp, Artificial
  CRISPR gRNA sequence
ttattttttgagacagagtc

SEQ ID NO: 167454 - DNA, 20 bp, Artificial
  CRISPR gRNA sequence
tattttttgagacagagtct

SEQ ID NO: 167455 - DNA, 20 bp, Artificial
  CRISPR gRNA sequence
attttttgagacagagtctc

SEQ ID NO: 167456 - DNA, 20 bp, Artificial
  CRISPR gRNA sequence
ttttttgagacagagtctca

SEQ ID NO: 167457 - DNA, 20 bp, Artificial
  CRISPR gRNA sequence
tttgagacagagtctcactc

SEQ ID NO: 167458 - DNA, 20 bp, Artificial
  CRISPR gRNA sequence
ttgagacagagtctcactct

SEQ ID NO: 167459 - DNA, 20 bp, Artificial
  CRISPR gRNA sequence
tgagacagagtctcactctg

SEQ ID NO: 167460 - DNA, 20 bp, Artificial
  CRISPR gRNA sequence
gagacagagtctcactctgt

SEQ ID NO: 167461 - DNA, 20 bp, Artificial
  CRISPR gRNA sequence
agacagagtctcactctgtc

SEQ ID NO: 167462 - DNA, 20 bp, Artificial
  CRISPR gRNA sequence
actctgtcgcccaggctgga

SEQ ID NO: 167463 - DNA, 20 bp, Artificial
  CRISPR gRNA sequence
tgtcgcccaggctggagtgc

SEQ ID NO: 167464 - DNA, 20 bp, Artificial
  CRISPR gRNA sequence
tcgcccaggctggagtgcag

SEQ ID NO: 167465 - DNA, 20 bp, Artificial
  CRISPR gRNA sequence
gagtgcagtggcacaatctc

SEQ ID NO: 167466 - DNA, 20 bp, Artificial
  CRISPR gRNA sequence
agctcactgcaacctccacc

SEQ ID NO: 167467 - DNA, 20 bp, Artificial
  CRISPR gRNA sequence
actgcaacctccacctcctg

SEQ ID NO: 167468 - DNA, 20 bp, Artificial
  CRISPR gRNA sequence
caacctccacctcctgggtt

SEQ ID NO: 167469 - DNA, 20 bp, Artificial
  CRISPR gRNA sequence
cacctcctgggttcaagtga

SEQ ID NO: 167470 - DNA, 20 bp, Artificial
  CRISPR gRNA sequence
ctgggttcaagtgattcttg

SEQ ID NO: 167471 - DNA, 20 bp, Artificial
  CRISPR gRNA sequence
ggttcaagtgattcttgtgt

SEQ ID NO: 167472 - DNA, 20 bp, Artificial
  CRISPR gRNA sequence
aagtgattcttgtgtctcag

SEQ ID NO: 167473 - DNA, 20 bp, Artificial
  CRISPR gRNA sequence
ttgtgtctcagcctcccaag

SEQ ID NO: 167474 - DNA, 20 bp, Artificial
  CRISPR gRNA sequence
gtgtctcagcctcccaagta

SEQ ID NO: 167475 - DNA, 20 bp, Artificial
  CRISPR gRNA sequence
tgtctcagcctcccaagtag

SEQ ID NO: 167476 - DNA, 20 bp, Artificial
  CRISPR gRNA sequence
agcctcccaagtagctggga

SEQ ID NO: 167477 - DNA, 20 bp, Artificial
  CRISPR gRNA sequence
ccaagtagctgggatgacag

SEQ ID NO: 167478 - DNA, 20 bp, Artificial
  CRISPR gRNA sequence
ggatgacaggcatgcaccac

SEQ ID NO: 167479 - DNA, 20 bp, Artificial
  CRISPR gRNA sequence
attttgtatttttagtggaa

SEQ ID NO: 167480 - DNA, 20 bp, Artificial
  CRISPR gRNA sequence
tgtatttttagtggaaacgg

SEQ ID NO: 167481 - DNA, 20 bp, Artificial
  CRISPR gRNA sequence
gtatttttagtggaaacggt

SEQ ID NO: 167482 - DNA, 20 bp, Artificial
  CRISPR gRNA sequence
tatttttagtggaaacggtt

SEQ ID NO: 167483 - DNA, 20 bp, Artificial
  CRISPR gRNA sequence
ttagtggaaacggttttgcc

SEQ ID NO: 167484 - DNA, 20 bp, Artificial
  CRISPR gRNA sequence
tagtggaaacggttttgcca

SEQ ID NO: 167485 - DNA, 20 bp, Artificial
  CRISPR gRNA sequence
agtggaaacggttttgccat

SEQ ID NO: 167486 - DNA, 20 bp, Artificial
  CRISPR gRNA sequence
gtggaaacggttttgccatg

SEQ ID NO: 167487 - DNA, 20 bp, Artificial
  CRISPR gRNA sequence
tgccatgttggccaggctgg

SEQ ID NO: 167488 - DNA, 20 bp, Artificial
  CRISPR gRNA sequence
gccatgttggccaggctggt

SEQ ID NO: 167489 - DNA, 20 bp, Artificial
  CRISPR gRNA sequence
ccatgttggccaggctggtc

SEQ ID NO: 167490 - DNA, 20 bp, Artificial
  CRISPR gRNA sequence
gccaggctggtctcaaactc

SEQ ID NO: 167491 - DNA, 20 bp, Artificial
  CRISPR gRNA sequence
gtctcaaactcccgacctca

SEQ ID NO: 167492 - DNA, 20 bp, Artificial
  CRISPR gRNA sequence
aaactcccgacctcatgtga

SEQ ID NO: 167493 - DNA, 20 bp, Artificial
  CRISPR gRNA sequence
ccgacctcatgtgatcacct

SEQ ID NO: 167494 - DNA, 20 bp, Artificial
  CRISPR gRNA sequence
atgtgatcacctgcctcagc

SEQ ID NO: 167495 - DNA, 20 bp, Artificial
  CRISPR gRNA sequence
cctcagcctccctcccaaag

SEQ ID NO: 167496 - DNA, 20 bp, Artificial
  CRISPR gRNA sequence
agcctccctcccaaagtgct

SEQ ID NO: 167497 - DNA, 20 bp, Artificial
  CRISPR gRNA sequence
cctcccaaagtgctgggatt

SEQ ID NO: 167498 - DNA, 20 bp, Artificial
  CRISPR gRNA sequence
ccaaagtgctgggattacag

SEQ ID NO: 167499 - DNA, 20 bp, Artificial
  CRISPR gRNA sequence
ggattacaggcgtgacccac

SEQ ID NO: 167500 - DNA, 20 bp, Artificial
  CRISPR gRNA sequence
caggcgtgacccactgtgcc

SEQ ID NO: 167501 - DNA, 20 bp, Artificial
  CRISPR gRNA sequence
tgcccagccccaaactgact

SEQ ID NO: 167502 - DNA, 20 bp, Artificial
  CRISPR gRNA sequence
acttctgaggaaccaagaag

SEQ ID NO: 167503 - DNA, 20 bp, Artificial
  CRISPR gRNA sequence
ctgaggaaccaagaagcttc

SEQ ID NO: 167504 - DNA, 20 bp, Artificial
  CRISPR gRNA sequence
tgaggaaccaagaagcttcc

SEQ ID NO: 167505 - DNA, 20 bp, Artificial
  CRISPR gRNA sequence
aggaaccaagaagcttcctt

SEQ ID NO: 167506 - DNA, 20 bp, Artificial
  CRISPR gRNA sequence
ccttctcatttcctcccact

SEQ ID NO: 167507 - DNA, 20 bp, Artificial
  CRISPR gRNA sequence
cttctcatttcctcccactc

SEQ ID NO: 167508 - DNA, 20 bp, Artificial
  CRISPR gRNA sequence
ctcatttcctcccactccca

SEQ ID NO: 167509 - DNA, 20 bp, Artificial
  CRISPR gRNA sequence
tcatttcctcccactcccat

SEQ ID NO: 167510 - DNA, 20 bp, Artificial
  CRISPR gRNA sequence
atttcctcccactcccatgc

SEQ ID NO: 167511 - DNA, 20 bp, Artificial
  CRISPR gRNA sequence
cctcccactcccatgccgtt

SEQ ID NO: 167512 - DNA, 20 bp, Artificial
  CRISPR gRNA sequence
ctcccactcccatgccgtta

SEQ ID NO: 167513 - DNA, 20 bp, Artificial
  CRISPR gRNA sequence
ccactcccatgccgttatgt

SEQ ID NO: 167514 - DNA, 20 bp, Artificial
  CRISPR gRNA sequence
ccatgccgttatgttttttg

SEQ ID NO: 167515 - DNA, 20 bp, Artificial
  CRISPR gRNA sequence
tgttttttggatcccaggga

SEQ ID NO: 167516 - DNA, 20 bp, Artificial
  CRISPR gRNA sequence
tttggatcccagggaagaat

SEQ ID NO: 167517 - DNA, 20 bp, Artificial
  CRISPR gRNA sequence
ttggatcccagggaagaatc

SEQ ID NO: 167518 - DNA, 20 bp, Artificial
  CRISPR gRNA sequence
tggatcccagggaagaatct

SEQ ID NO: 167519 - DNA, 20 bp, Artificial
  CRISPR gRNA sequence
ggatcccagggaagaatctt

SEQ ID NO: 167520 - DNA, 20 bp, Artificial
  CRISPR gRNA sequence
gatcccagggaagaatctta

SEQ ID NO: 167521 - DNA, 20 bp, Artificial
  CRISPR gRNA sequence
atgaggttaaaaagaggggc

SEQ ID NO: 167522 - DNA, 20 bp, Artificial
  CRISPR gRNA sequence
tgaggttaaaaagaggggct

SEQ ID NO: 167523 - DNA, 20 bp, Artificial
  CRISPR gRNA sequence
aaaagaggggctgggggaag

SEQ ID NO: 167524 - DNA, 20 bp, Artificial
  CRISPR gRNA sequence
ggggaagggtgtgagtcagt

SEQ ID NO: 167525 - DNA, 20 bp, Artificial
  CRISPR gRNA sequence
cggaaaagccgcgtccttag

SEQ ID NO: 167526 - DNA, 20 bp, Artificial
  CRISPR gRNA sequence
aggtaagccggggagtgggc

SEQ ID NO: 167527 - DNA, 20 bp, Artificial
  CRISPR gRNA sequence
ggtaagccggggagtgggca

SEQ ID NO: 167528 - DNA, 20 bp, Artificial
  CRISPR gRNA sequence
aatgatcccagagactatat

SEQ ID NO: 167529 - DNA, 20 bp, Artificial
  CRISPR gRNA sequence
atgatcccagagactatatg

SEQ ID NO: 167530 - DNA, 20 bp, Artificial
  CRISPR gRNA sequence
tatggaactcagaagccttg

SEQ ID NO: 167531 - DNA, 20 bp, Artificial
  CRISPR gRNA sequence
agaagccttgcttttggctc

SEQ ID NO: 167532 - DNA, 20 bp, Artificial
  CRISPR gRNA sequence
gcttttggctcattcctcgt

SEQ ID NO: 167533 - DNA, 20 bp, Artificial
  CRISPR gRNA sequence
cttttggctcattcctcgta

SEQ ID NO: 167534 - DNA, 20 bp, Artificial
  CRISPR gRNA sequence
ttggctcattcctcgtattt

SEQ ID NO: 167535 - DNA, 20 bp, Artificial
  CRISPR gRNA sequence
tggctcattcctcgtatttt

SEQ ID NO: 167536 - DNA, 20 bp, Artificial
  CRISPR gRNA sequence
ggctcattcctcgtattttc

SEQ ID NO: 167537 - DNA, 20 bp, Artificial
  CRISPR gRNA sequence
gctcattcctcgtattttcc

SEQ ID NO: 167538 - DNA, 20 bp, Artificial
  CRISPR gRNA sequence
attcctcgtattttcccaaa

SEQ ID NO: 167539 - DNA, 20 bp, Artificial
  CRISPR gRNA sequence
ctcgtattttcccaaatgag

SEQ ID NO: 167540 - DNA, 20 bp, Artificial
  CRISPR gRNA sequence
gtattttcccaaatgagatc

SEQ ID NO: 167541 - DNA, 20 bp, Artificial
  CRISPR gRNA sequence
tcccaaatgagatctttgga

SEQ ID NO: 167542 - DNA, 20 bp, Artificial
  CRISPR gRNA sequence
cccaaatgagatctttggag

SEQ ID NO: 167543 - DNA, 20 bp, Artificial
  CRISPR gRNA sequence
ccaaatgagatctttggaga

SEQ ID NO: 167544 - DNA, 20 bp, Artificial
  CRISPR gRNA sequence
tggagacctgctctacaaac

SEQ ID NO: 167545 - DNA, 20 bp, Artificial
  CRISPR gRNA sequence
ggagacctgctctacaaact

SEQ ID NO: 167546 - DNA, 20 bp, Artificial
  CRISPR gRNA sequence
gagacctgctctacaaactc

SEQ ID NO: 167547 - DNA, 20 bp, Artificial
  CRISPR gRNA sequence
ctctacaaactcagctctgt

SEQ ID NO: 167548 - DNA, 20 bp, Artificial
  CRISPR gRNA sequence
tacaaactcagctctgtcac

SEQ ID NO: 167549 - DNA, 20 bp, Artificial
  CRISPR gRNA sequence
caaactcagctctgtcacca

SEQ ID NO: 167550 - DNA, 20 bp, Artificial
  CRISPR gRNA sequence
agctctgtcaccactgtcaa

SEQ ID NO: 167551 - DNA, 20 bp, Artificial
  CRISPR gRNA sequence
tgtcaccactgtcaatagat

SEQ ID NO: 167552 - DNA, 20 bp, Artificial
  CRISPR gRNA sequence
tcaccactgtcaatagatac

SEQ ID NO: 167553 - DNA, 20 bp, Artificial
  CRISPR gRNA sequence
tcaatagatacatcaccaga

SEQ ID NO: 167554 - DNA, 20 bp, Artificial
  CRISPR gRNA sequence
ggccagacgggtccagctct

SEQ ID NO: 167555 - DNA, 20 bp, Artificial
  CRISPR gRNA sequence
ttaaacgatcgctgcttttt

SEQ ID NO: 167556 - DNA, 20 bp, Artificial
  CRISPR gRNA sequence
aaacgatcgctgcttttttt

SEQ ID NO: 167557 - DNA, 20 bp, Artificial
  CRISPR gRNA sequence
aacgatcgctgctttttttg

SEQ ID NO: 167558 - DNA, 20 bp, Artificial
  CRISPR gRNA sequence
ctttttttgggtctgaggca

SEQ ID NO: 167559 - DNA, 20 bp, Artificial
  CRISPR gRNA sequence
tttttgggtctgaggcaaaa

SEQ ID NO: 167560 - DNA, 20 bp, Artificial
  CRISPR gRNA sequence
ttttgggtctgaggcaaaag

SEQ ID NO: 167561 - DNA, 20 bp, Artificial
  CRISPR gRNA sequence
tttgggtctgaggcaaaaga

SEQ ID NO: 167562 - DNA, 20 bp, Artificial
  CRISPR gRNA sequence
ttgggtctgaggcaaaagaa

SEQ ID NO: 167563 - DNA, 20 bp, Artificial
  CRISPR gRNA sequence
tgggtctgaggcaaaagaat

SEQ ID NO: 167564 - DNA, 20 bp, Artificial
  CRISPR gRNA sequence
gggtctgaggcaaaagaatc

SEQ ID NO: 167565 - DNA, 20 bp, Artificial
  CRISPR gRNA sequence
ggtctgaggcaaaagaatcc

SEQ ID NO: 167566 - DNA, 20 bp, Artificial
  CRISPR gRNA sequence
aggcaaaagaatccattaac

SEQ ID NO: 167567 - DNA, 20 bp, Artificial
  CRISPR gRNA sequence
acaatgcctccccttgacca

SEQ ID NO: 167568 - DNA, 20 bp, Artificial
  CRISPR gRNA sequence
cccttgaccagcacccccca

SEQ ID NO: 167569 - DNA, 20 bp, Artificial
  CRISPR gRNA sequence
gaccagcaccccccatcttc

SEQ ID NO: 167570 - DNA, 20 bp, Artificial
  CRISPR gRNA sequence
accagcaccccccatcttct

SEQ ID NO: 167571 - DNA, 20 bp, Artificial
  CRISPR gRNA sequence
ctgcaagtaatacccatgtc

SEQ ID NO: 167572 - DNA, 20 bp, Artificial
  CRISPR gRNA sequence
tgcaagtaatacccatgtcc

SEQ ID NO: 167573 - DNA, 20 bp, Artificial
  CRISPR gRNA sequence
caagtaatacccatgtccct

SEQ ID NO: 167574 - DNA, 20 bp, Artificial
  CRISPR gRNA sequence
aacacccccaagcccaggga

SEQ ID NO: 167575 - DNA, 20 bp, Artificial
  CRISPR gRNA sequence
accatctgtgactcatagcc

SEQ ID NO: 167576 - DNA, 20 bp, Artificial
  CRISPR gRNA sequence
tgactcatagccatcaatat

SEQ ID NO: 167577 - DNA, 20 bp, Artificial
  CRISPR gRNA sequence
atagccatcaatattgtagg

SEQ ID NO: 167578 - DNA, 20 bp, Artificial
  CRISPR gRNA sequence
tagggcacgagaggagagga

SEQ ID NO: 167579 - DNA, 20 bp, Artificial
  CRISPR gRNA sequence
ttctggttagggatgcaaga

SEQ ID NO: 167580 - DNA, 20 bp, Artificial
  CRISPR gRNA sequence
tctggttagggatgcaagag

SEQ ID NO: 167581 - DNA, 20 bp, Artificial
  CRISPR gRNA sequence
ctggttagggatgcaagagg

SEQ ID NO: 167582 - DNA, 20 bp, Artificial
  CRISPR gRNA sequence
tggttagggatgcaagagga

SEQ ID NO: 167583 - DNA, 20 bp, Artificial
  CRISPR gRNA sequence
gttagggatgcaagaggagg

SEQ ID NO: 167584 - DNA, 20 bp, Artificial
  CRISPR gRNA sequence
gggatgcaagaggaggtagg

SEQ ID NO: 167585 - DNA, 20 bp, Artificial
  CRISPR gRNA sequence
agtaagctttccaaagagca

SEQ ID NO: 167586 - DNA, 20 bp, Artificial
  CRISPR gRNA sequence
tccaaagagcacaggaggtg

SEQ ID NO: 167587 - DNA, 20 bp, Artificial
  CRISPR gRNA sequence
ccaaagagcacaggaggtgc

SEQ ID NO: 167588 - DNA, 20 bp, Artificial
  CRISPR gRNA sequence
caaagagcacaggaggtgcc

SEQ ID NO: 167589 - DNA, 20 bp, Artificial
  CRISPR gRNA sequence
gggtttaaagatggaaacag

SEQ ID NO: 167590 - DNA, 20 bp, Artificial
  CRISPR gRNA sequence
ggtttaaagatggaaacagc

SEQ ID NO: 167591 - DNA, 20 bp, Artificial
  CRISPR gRNA sequence
aaagatggaaacagcctgac

SEQ ID NO: 167592 - DNA, 20 bp, Artificial
  CRISPR gRNA sequence
aagatggaaacagcctgacg

SEQ ID NO: 167593 - DNA, 20 bp, Artificial
  CRISPR gRNA sequence
acgatcaggcgatctgtcga

SEQ ID NO: 167594 - DNA, 20 bp, Artificial
  CRISPR gRNA sequence
tcgaacatttcccaggtctg

SEQ ID NO: 167595 - DNA, 20 bp, Artificial
  CRISPR gRNA sequence
cccaggtctgatgggtgtgc

SEQ ID NO: 167596 - DNA, 20 bp, Artificial
  CRISPR gRNA sequence
ccaggtctgatgggtgtgca

SEQ ID NO: 167597 - DNA, 20 bp, Artificial
  CRISPR gRNA sequence
atgggtgtgcacacctgtaa

SEQ ID NO: 167598 - DNA, 20 bp, Artificial
  CRISPR gRNA sequence
taaggtttctttcaggcacc

SEQ ID NO: 167599 - DNA, 20 bp, Artificial
  CRISPR gRNA sequence
ctttcaggcaccttcgaggc

SEQ ID NO: 167600 - DNA, 20 bp, Artificial
  CRISPR gRNA sequence
tttcaggcaccttcgaggct

SEQ ID NO: 167601 - DNA, 20 bp, Artificial
  CRISPR gRNA sequence
tcaggcaccttcgaggcttc

SEQ ID NO: 167602 - DNA, 20 bp, Artificial
  CRISPR gRNA sequence
caggcaccttcgaggcttcc

SEQ ID NO: 167603 - DNA, 20 bp, Artificial
  CRISPR gRNA sequence
aggcaccttcgaggcttccc

SEQ ID NO: 167604 - DNA, 20 bp, Artificial
  CRISPR gRNA sequence
cgaggcttcccctgacttgc

SEQ ID NO: 167605 - DNA, 20 bp, Artificial
  CRISPR gRNA sequence
gaggcttcccctgacttgca

SEQ ID NO: 167606 - DNA, 20 bp, Artificial
  CRISPR gRNA sequence
cccctgacttgcatttcttt

SEQ ID NO: 167607 - DNA, 20 bp, Artificial
  CRISPR gRNA sequence
ccctgacttgcatttctttg

SEQ ID NO: 167608 - DNA, 20 bp, Artificial
  CRISPR gRNA sequence
acttgcatttctttgcccct

SEQ ID NO: 167609 - DNA, 20 bp, Artificial
  CRISPR gRNA sequence
gcatttctttgccccttgag

SEQ ID NO: 167610 - DNA, 20 bp, Artificial
  CRISPR gRNA sequence
catttctttgccccttgaga

SEQ ID NO: 167611 - DNA, 20 bp, Artificial
  CRISPR gRNA sequence
ctttgccccttgagaacaag

SEQ ID NO: 167612 - DNA, 20 bp, Artificial
  CRISPR gRNA sequence
tttgccccttgagaacaaga

SEQ ID NO: 167613 - DNA, 20 bp, Artificial
  CRISPR gRNA sequence
tgccccttgagaacaagatg

SEQ ID NO: 167614 - DNA, 20 bp, Artificial
  CRISPR gRNA sequence
gccccttgagaacaagatgg

SEQ ID NO: 167615 - DNA, 20 bp, Artificial
  CRISPR gRNA sequence
ccccttgagaacaagatggt

SEQ ID NO: 167616 - DNA, 20 bp, Artificial
  CRISPR gRNA sequence
gagaacaagatggtaagaga

SEQ ID NO: 167617 - DNA, 20 bp, Artificial
  CRISPR gRNA sequence
agaacaagatggtaagagaa

SEQ ID NO: 167618 - DNA, 20 bp, Artificial
  CRISPR gRNA sequence
tgaatctaatgttccaatta

SEQ ID NO: 167619 - DNA, 20 bp, Artificial
  CRISPR gRNA sequence
gaatctaatgttccaattac

SEQ ID NO: 167620 - DNA, 20 bp, Artificial
  CRISPR gRNA sequence
aatctaatgttccaattacc

SEQ ID NO: 167621 - DNA, 20 bp, Artificial
  CRISPR gRNA sequence
atgttccaattaccacccat

SEQ ID NO: 167622 - DNA, 20 bp, Artificial
  CRISPR gRNA sequence
caattaccacccatgcctct

SEQ ID NO: 167623 - DNA, 20 bp, Artificial
  CRISPR gRNA sequence
ccacccatgcctcttgggtg

SEQ ID NO: 167624 - DNA, 20 bp, Artificial
  CRISPR gRNA sequence
ttgggtgcagaaggatatgg

SEQ ID NO: 167625 - DNA, 20 bp, Artificial
  CRISPR gRNA sequence
gggtgcagaaggatatggag

SEQ ID NO: 167626 - DNA, 20 bp, Artificial
  CRISPR gRNA sequence
ggtgcagaaggatatggagg

SEQ ID NO: 167627 - DNA, 20 bp, Artificial
  CRISPR gRNA sequence
ctggttgaaggatgaggtgg

SEQ ID NO: 167628 - DNA, 20 bp, Artificial
  CRISPR gRNA sequence
tggttgaaggatgaggtggc

SEQ ID NO: 167629 - DNA, 20 bp, Artificial
  CRISPR gRNA sequence
gttgaaggatgaggtggcaa

SEQ ID NO: 167630 - DNA, 20 bp, Artificial
  CRISPR gRNA sequence
aaggatgaggtggcaagaca

SEQ ID NO: 167631 - DNA, 20 bp, Artificial
  CRISPR gRNA sequence
tgtgctgagcgctcctttcc

SEQ ID NO: 167632 - DNA, 20 bp, Artificial
  CRISPR gRNA sequence
agcgctcctttcctgtcaga

SEQ ID NO: 167633 - DNA, 20 bp, Artificial
  CRISPR gRNA sequence
ctttcctgtcagaagccatc

SEQ ID NO: 167634 - DNA, 20 bp, Artificial
  CRISPR gRNA sequence
tcctgtcagaagccatctgc

SEQ ID NO: 167635 - DNA, 20 bp, Artificial
  CRISPR gRNA sequence
cctgtcagaagccatctgct

SEQ ID NO: 167636 - DNA, 20 bp, Artificial
  CRISPR gRNA sequence
ctgtcagaagccatctgctc

SEQ ID NO: 167637 - DNA, 20 bp, Artificial
  CRISPR gRNA sequence
tcagaagccatctgctcctg

SEQ ID NO: 167638 - DNA, 20 bp, Artificial
  CRISPR gRNA sequence
ctcctggtctccaacacagg

SEQ ID NO: 167639 - DNA, 20 bp, Artificial
  CRISPR gRNA sequence
ctggtctccaacacaggcct

SEQ ID NO: 167640 - DNA, 20 bp, Artificial
  CRISPR gRNA sequence
gtctccaacacaggccttgt

SEQ ID NO: 167641 - DNA, 20 bp, Artificial
  CRISPR gRNA sequence
caacacaggccttgtgtctc

SEQ ID NO: 167642 - DNA, 20 bp, Artificial
  CRISPR gRNA sequence
gtgtctctggggcacatacc

SEQ ID NO: 167643 - DNA, 20 bp, Artificial
  CRISPR gRNA sequence
tgtctctggggcacatacct

SEQ ID NO: 167644 - DNA, 20 bp, Artificial
  CRISPR gRNA sequence
tggggcacatacctgttgag

SEQ ID NO: 167645 - DNA, 20 bp, Artificial
  CRISPR gRNA sequence
gggcacatacctgttgagca

SEQ ID NO: 167646 - DNA, 20 bp, Artificial
  CRISPR gRNA sequence
ttgagcattggtggcaagtg

SEQ ID NO: 167647 - DNA, 20 bp, Artificial
  CRISPR gRNA sequence
agcattggtggcaagtgtct

SEQ ID NO: 167648 - DNA, 20 bp, Artificial
  CRISPR gRNA sequence
gtggcaagtgtctggatctg

SEQ ID NO: 167649 - DNA, 20 bp, Artificial
  CRISPR gRNA sequence
gatctgtccctgcacaactt

SEQ ID NO: 167650 - DNA, 20 bp, Artificial
  CRISPR gRNA sequence
tccctgcacaacttgagtgc

SEQ ID NO: 167651 - DNA, 20 bp, Artificial
  CRISPR gRNA sequence
cacaacttgagtgcctgata

SEQ ID NO: 167652 - DNA, 20 bp, Artificial
  CRISPR gRNA sequence
gagtgcctgatacaggctgg

SEQ ID NO: 167653 - DNA, 20 bp, Artificial
  CRISPR gRNA sequence
agtgcctgatacaggctggg

SEQ ID NO: 167654 - DNA, 20 bp, Artificial
  CRISPR gRNA sequence
atacaggctgggctaagcgg

SEQ ID NO: 167655 - DNA, 20 bp, Artificial
  CRISPR gRNA sequence
ggctaagcggatatactgca

SEQ ID NO: 167656 - DNA, 20 bp, Artificial
  CRISPR gRNA sequence
agcggatatactgcagctgg

SEQ ID NO: 167657 - DNA, 20 bp, Artificial
  CRISPR gRNA sequence
cagctggccggcattcagct

SEQ ID NO: 167658 - DNA, 20 bp, Artificial
  CRISPR gRNA sequence
gccggcattcagctgcacct

SEQ ID NO: 167659 - DNA, 20 bp, Artificial
  CRISPR gRNA sequence
agctgcacctagggcagggg

SEQ ID NO: 167660 - DNA, 20 bp, Artificial
  CRISPR gRNA sequence
cacctagggcaggggcagag

SEQ ID NO: 167661 - DNA, 20 bp, Artificial
  CRISPR gRNA sequence
gggcaggggcagagacaaag

SEQ ID NO: 167662 - DNA, 20 bp, Artificial
  CRISPR gRNA sequence
agtataatctcaaacaggca

SEQ ID NO: 167663 - DNA, 20 bp, Artificial
  CRISPR gRNA sequence
aaacaggcaaactttccatg

SEQ ID NO: 167664 - DNA, 20 bp, Artificial
  CRISPR gRNA sequence
tccatgaccagagatgttga

SEQ ID NO: 167665 - DNA, 20 bp, Artificial
  CRISPR gRNA sequence
ccatgaccagagatgttgat

SEQ ID NO: 167666 - DNA, 20 bp, Artificial
  CRISPR gRNA sequence
catgaccagagatgttgatt

SEQ ID NO: 167667 - DNA, 20 bp, Artificial
  CRISPR gRNA sequence
attgccccctacccctcaag

SEQ ID NO: 167668 - DNA, 20 bp, Artificial
  CRISPR gRNA sequence
ccccctacccctcaagccct

SEQ ID NO: 167669 - DNA, 20 bp, Artificial
  CRISPR gRNA sequence
cccctcaagccctccaaaga

SEQ ID NO: 167670 - DNA, 20 bp, Artificial
  CRISPR gRNA sequence
aagccctccaaagaagcctg

SEQ ID NO: 167671 - DNA, 20 bp, Artificial
  CRISPR gRNA sequence
caaagaagcctgccctgaaa

SEQ ID NO: 167672 - DNA, 20 bp, Artificial
  CRISPR gRNA sequence
ccctgaaaaaagtccctttt

SEQ ID NO: 167673 - DNA, 20 bp, Artificial
  CRISPR gRNA sequence
aaaaaagtcccttttaaaca

SEQ ID NO: 167674 - DNA, 20 bp, Artificial
  CRISPR gRNA sequence
ttaaacagaggtcaaaacaa

SEQ ID NO: 167675 - DNA, 20 bp, Artificial
  CRISPR gRNA sequence
taaacagaggtcaaaacaag

SEQ ID NO: 167676 - DNA, 20 bp, Artificial
  CRISPR gRNA sequence
aaacagaggtcaaaacaagc

SEQ ID NO: 167677 - DNA, 20 bp, Artificial
  CRISPR gRNA sequence
aacagaggtcaaaacaagca

SEQ ID NO: 167678 - DNA, 20 bp, Artificial
  CRISPR gRNA sequence
cctgaatggacttcagaaaa

SEQ ID NO: 167679 - DNA, 20 bp, Artificial
  CRISPR gRNA sequence
aatggacttcagaaaaaact

SEQ ID NO: 167680 - DNA, 20 bp, Artificial
  CRISPR gRNA sequence
cagaaaaaactcccagaaga

SEQ ID NO: 167681 - DNA, 20 bp, Artificial
  CRISPR gRNA sequence
agaaaaaactcccagaagat

SEQ ID NO: 167682 - DNA, 20 bp, Artificial
  CRISPR gRNA sequence
ccagaagatcctgtcacaaa

SEQ ID NO: 167683 - DNA, 20 bp, Artificial
  CRISPR gRNA sequence
tcacaaaggtgagaacagca

SEQ ID NO: 167684 - DNA, 20 bp, Artificial
  CRISPR gRNA sequence
catgctcattatttgccagc

SEQ ID NO: 167685 - DNA, 20 bp, Artificial
  CRISPR gRNA sequence
attatttgccagctcttagc

SEQ ID NO: 167686 - DNA, 20 bp, Artificial
  CRISPR gRNA sequence
tttgccagctcttagctaca

SEQ ID NO: 167687 - DNA, 20 bp, Artificial
  CRISPR gRNA sequence
gccagctcttagctacatga

SEQ ID NO: 167688 - DNA, 20 bp, Artificial
  CRISPR gRNA sequence
ccagctcttagctacatgat

SEQ ID NO: 167689 - DNA, 20 bp, Artificial
  CRISPR gRNA sequence
ttagctacatgatcacagct

SEQ ID NO: 167690 - DNA, 20 bp, Artificial
  CRISPR gRNA sequence
agctacatgatcacagctta

SEQ ID NO: 167691 - DNA, 20 bp, Artificial
  CRISPR gRNA sequence
gctacatgatcacagcttat

SEQ ID NO: 167692 - DNA, 20 bp, Artificial
  CRISPR gRNA sequence
catgatcacagcttatctta

SEQ ID NO: 167693 - DNA, 20 bp, Artificial
  CRISPR gRNA sequence
atcttaggaatttatctgac

SEQ ID NO: 167694 - DNA, 20 bp, Artificial
  CRISPR gRNA sequence
tcttaggaatttatctgact

SEQ ID NO: 167695 - DNA, 20 bp, Artificial
  CRISPR gRNA sequence
aggaatttatctgactgaca

SEQ ID NO: 167696 - DNA, 20 bp, Artificial
  CRISPR gRNA sequence
ggaatttatctgactgacat

SEQ ID NO: 167697 - DNA, 20 bp, Artificial
  CRISPR gRNA sequence
atctgactgacatcatcaga

SEQ ID NO: 167698 - DNA, 20 bp, Artificial
  CRISPR gRNA sequence
tctgactgacatcatcagaa

SEQ ID NO: 167699 - DNA, 20 bp, Artificial
  CRISPR gRNA sequence
actgacatcatcagaatgcc

SEQ ID NO: 167700 - DNA, 20 bp, Artificial
  CRISPR gRNA sequence
acatcatcagaatgcctgta

SEQ ID NO: 167701 - DNA, 20 bp, Artificial
  CRISPR gRNA sequence
tacattaagtgtgggcctct

SEQ ID NO: 167702 - DNA, 20 bp, Artificial
  CRISPR gRNA sequence
agtgtgggcctctttcgctc

SEQ ID NO: 167703 - DNA, 20 bp, Artificial
  CRISPR gRNA sequence
tttcgctcccatctgtaaag

SEQ ID NO: 167704 - DNA, 20 bp, Artificial
  CRISPR gRNA sequence
tcgctcccatctgtaaagag

SEQ ID NO: 167705 - DNA, 20 bp, Artificial
  CRISPR gRNA sequence
cgctcccatctgtaaagaga

SEQ ID NO: 167706 - DNA, 20 bp, Artificial
  CRISPR gRNA sequence
gctcccatctgtaaagagat

SEQ ID NO: 167707 - DNA, 20 bp, Artificial
  CRISPR gRNA sequence
ccatctgtaaagagatccag

SEQ ID NO: 167708 - DNA, 20 bp, Artificial
  CRISPR gRNA sequence
taaagagatccagcatctgc

SEQ ID NO: 167709 - DNA, 20 bp, Artificial
  CRISPR gRNA sequence
ccaggatcccaaagcaaaca

SEQ ID NO: 167710 - DNA, 20 bp, Artificial
  CRISPR gRNA sequence
cgcatcatagccctcacact

SEQ ID NO: 167711 - DNA, 20 bp, Artificial
  CRISPR gRNA sequence
acactgccctgccccatgct

SEQ ID NO: 167712 - DNA, 20 bp, Artificial
  CRISPR gRNA sequence
ccctgccccatgctgcacat

SEQ ID NO: 167713 - DNA, 20 bp, Artificial
  CRISPR gRNA sequence
ccccatgctgcacattttgg

SEQ ID NO: 167714 - DNA, 20 bp, Artificial
  CRISPR gRNA sequence
cacattttggaggcaaaagc

SEQ ID NO: 167715 - DNA, 20 bp, Artificial
  CRISPR gRNA sequence
tggaggcaaaagctggactg

SEQ ID NO: 167716 - DNA, 20 bp, Artificial
  CRISPR gRNA sequence
ggaggcaaaagctggactgc

SEQ ID NO: 167717 - DNA, 20 bp, Artificial
  CRISPR gRNA sequence
gaggcaaaagctggactgct

SEQ ID NO: 167718 - DNA, 20 bp, Artificial
  CRISPR gRNA sequence
gactgcttaaccatctctgt

SEQ ID NO: 167719 - DNA, 20 bp, Artificial
  CRISPR gRNA sequence
cttaaccatctctgtcccca

SEQ ID NO: 167720 - DNA, 20 bp, Artificial
  CRISPR gRNA sequence
aaccatctctgtccccaaga

SEQ ID NO: 167721 - DNA, 20 bp, Artificial
  CRISPR gRNA sequence
accatctctgtccccaagag

SEQ ID NO: 167722 - DNA, 20 bp, Artificial
  CRISPR gRNA sequence
tgtccccaagagccaggctg

SEQ ID NO: 167723 - DNA, 20 bp, Artificial
  CRISPR gRNA sequence
tccccaagagccaggctgga

SEQ ID NO: 167724 - DNA, 20 bp, Artificial
  CRISPR gRNA sequence
gatgggggtctgtggggctt

SEQ ID NO: 167725 - DNA, 20 bp, Artificial
  CRISPR gRNA sequence
tggggcttttaggatctttg

SEQ ID NO: 167726 - DNA, 20 bp, Artificial
  CRISPR gRNA sequence
ttaggatctttggtgttcag

SEQ ID NO: 167727 - DNA, 20 bp, Artificial
  CRISPR gRNA sequence
taggatctttggtgttcagc

SEQ ID NO: 167728 - DNA, 20 bp, Artificial
  CRISPR gRNA sequence
aggatctttggtgttcagca

SEQ ID NO: 167729 - DNA, 20 bp, Artificial
  CRISPR gRNA sequence
ggatctttggtgttcagcac

SEQ ID NO: 167730 - DNA, 20 bp, Artificial
  CRISPR gRNA sequence
tggtgttcagcactagcttc

SEQ ID NO: 167731 - DNA, 20 bp, Artificial
  CRISPR gRNA sequence
ggtgttcagcactagcttct

SEQ ID NO: 167732 - DNA, 20 bp, Artificial
  CRISPR gRNA sequence
gtgttcagcactagcttctg

SEQ ID NO: 167733 - DNA, 20 bp, Artificial
  CRISPR gRNA sequence
agcactagcttctggccaaa

SEQ ID NO: 167734 - DNA, 20 bp, Artificial
  CRISPR gRNA sequence
gcttctggccaaacacctcc

SEQ ID NO: 167735 - DNA, 20 bp, Artificial
  CRISPR gRNA sequence
ctggccaaacacctcccaag

SEQ ID NO: 167736 - DNA, 20 bp, Artificial
  CRISPR gRNA sequence
tggccaaacacctcccaagg

SEQ ID NO: 167737 - DNA, 20 bp, Artificial
  CRISPR gRNA sequence
gccaaacacctcccaagggg

SEQ ID NO: 167738 - DNA, 20 bp, Artificial
  CRISPR gRNA sequence
ccaaggggaagcagaatcaa

SEQ ID NO: 167739 - DNA, 20 bp, Artificial
  CRISPR gRNA sequence
tcatagaaaaccccatcatg

SEQ ID NO: 167740 - DNA, 20 bp, Artificial
  CRISPR gRNA sequence
catagaaaaccccatcatgg

SEQ ID NO: 167741 - DNA, 20 bp, Artificial
  CRISPR gRNA sequence
atagaaaaccccatcatggg

SEQ ID NO: 167742 - DNA, 20 bp, Artificial
  CRISPR gRNA sequence
cgaaagcgcccttagagtct

SEQ ID NO: 167743 - DNA, 20 bp, Artificial
  CRISPR gRNA sequence
agagtctctcatgcttacga

SEQ ID NO: 167744 - DNA, 20 bp, Artificial
  CRISPR gRNA sequence
gagtctctcatgcttacgat

SEQ ID NO: 167745 - DNA, 20 bp, Artificial
  CRISPR gRNA sequence
tcatgcttacgattaaatct

SEQ ID NO: 167746 - DNA, 20 bp, Artificial
  CRISPR gRNA sequence
atgcttacgattaaatctca

SEQ ID NO: 167747 - DNA, 20 bp, Artificial
  CRISPR gRNA sequence
acgattaaatctcagataat

SEQ ID NO: 167748 - DNA, 20 bp, Artificial
  CRISPR gRNA sequence
cgattaaatctcagataata

SEQ ID NO: 167749 - DNA, 20 bp, Artificial
  CRISPR gRNA sequence
aatctcagataatacaataa

SEQ ID NO: 167750 - DNA, 20 bp, Artificial
  CRISPR gRNA sequence
agataatacaataataccac

SEQ ID NO: 167751 - DNA, 20 bp, Artificial
  CRISPR gRNA sequence
catttaattgtgtgctaaaa

SEQ ID NO: 167752 - DNA, 20 bp, Artificial
  CRISPR gRNA sequence
aattgtgtgctaaaagcctt

SEQ ID NO: 167753 - DNA, 20 bp, Artificial
  CRISPR gRNA sequence
attgtgtgctaaaagcctta

SEQ ID NO: 167754 - DNA, 20 bp, Artificial
  CRISPR gRNA sequence
tgtgctaaaagccttaactc

SEQ ID NO: 167755 - DNA, 20 bp, Artificial
  CRISPR gRNA sequence
aaagccttaactcaggctct

SEQ ID NO: 167756 - DNA, 20 bp, Artificial
  CRISPR gRNA sequence
aactcaggctcttaatgctc

SEQ ID NO: 167757 - DNA, 20 bp, Artificial
  CRISPR gRNA sequence
actcaggctcttaatgctcc

SEQ ID NO: 167758 - DNA, 20 bp, Artificial
  CRISPR gRNA sequence
aggctcttaatgctccagtg

SEQ ID NO: 167759 - DNA, 20 bp, Artificial
  CRISPR gRNA sequence
ttaatgctccagtgtaccat

SEQ ID NO: 167760 - DNA, 20 bp, Artificial
  CRISPR gRNA sequence
aatgctccagtgtaccatga

SEQ ID NO: 167761 - DNA, 20 bp, Artificial
  CRISPR gRNA sequence
atgctccagtgtaccatgaa

SEQ ID NO: 167762 - DNA, 20 bp, Artificial
  CRISPR gRNA sequence
cagtgtaccatgaaagtatt

SEQ ID NO: 167763 - DNA, 20 bp, Artificial
  CRISPR gRNA sequence
gtgttttgagctggggatga

SEQ ID NO: 167764 - DNA, 20 bp, Artificial
  CRISPR gRNA sequence
tgagctggggatgaaaagag

SEQ ID NO: 167765 - DNA, 20 bp, Artificial
  CRISPR gRNA sequence
gagctggggatgaaaagagg

SEQ ID NO: 167766 - DNA, 20 bp, Artificial
  CRISPR gRNA sequence
agctggggatgaaaagagga

SEQ ID NO: 167767 - DNA, 20 bp, Artificial
  CRISPR gRNA sequence
gggatgaaaagaggaccaag

SEQ ID NO: 167768 - DNA, 20 bp, Artificial
  CRISPR gRNA sequence
ccacatcagagaactgtagc

SEQ ID NO: 167769 - DNA, 20 bp, Artificial
  CRISPR gRNA sequence
tagctcagcaaagatgatgg

SEQ ID NO: 167770 - DNA, 20 bp, Artificial
  CRISPR gRNA sequence
agcaaagatgatggtcagca

SEQ ID NO: 167771 - DNA, 20 bp, Artificial
  CRISPR gRNA sequence
cagacattcacaccctcaat

SEQ ID NO: 167772 - DNA, 20 bp, Artificial
  CRISPR gRNA sequence
acaccctcaatttagaggaa

SEQ ID NO: 167773 - DNA, 20 bp, Artificial
  CRISPR gRNA sequence
aatttagaggaaatgaaagg

SEQ ID NO: 167774 - DNA, 20 bp, Artificial
  CRISPR gRNA sequence
agaggaaatgaaaggggttc

SEQ ID NO: 167775 - DNA, 20 bp, Artificial
  CRISPR gRNA sequence
gaggaaatgaaaggggttct

SEQ ID NO: 167776 - DNA, 20 bp, Artificial
  CRISPR gRNA sequence
tgggagcatggatagactag

SEQ ID NO: 167777 - DNA, 20 bp, Artificial
  CRISPR gRNA sequence
ggagcatggatagactaggt

SEQ ID NO: 167778 - DNA, 20 bp, Artificial
  CRISPR gRNA sequence
ggtctctatctgcggggtcc

SEQ ID NO: 167779 - DNA, 20 bp, Artificial
  CRISPR gRNA sequence
tatctgcggggtccagaaac

SEQ ID NO: 167780 - DNA, 20 bp, Artificial
  CRISPR gRNA sequence
tctgcggggtccagaaacca

SEQ ID NO: 167781 - DNA, 20 bp, Artificial
  CRISPR gRNA sequence
cggggtccagaaaccacctg

SEQ ID NO: 167782 - DNA, 20 bp, Artificial
  CRISPR gRNA sequence
ccctggctgcccagcctgcc

SEQ ID NO: 167783 - DNA, 20 bp, Artificial
  CRISPR gRNA sequence
gctgcccagcctgcctttgt

SEQ ID NO: 167784 - DNA, 20 bp, Artificial
  CRISPR gRNA sequence
cccagcctgcctttgttgca

SEQ ID NO: 167785 - DNA, 20 bp, Artificial
  CRISPR gRNA sequence
cctttgttgcaaggggaagc

SEQ ID NO: 167786 - DNA, 20 bp, Artificial
  CRISPR gRNA sequence
tgttgcaaggggaagcttct

SEQ ID NO: 167787 - DNA, 20 bp, Artificial
  CRISPR gRNA sequence
gttgcaaggggaagcttctt

SEQ ID NO: 167788 - DNA, 20 bp, Artificial
  CRISPR gRNA sequence
ttgcaaggggaagcttcttg

SEQ ID NO: 167789 - DNA, 20 bp, Artificial
  CRISPR gRNA sequence
caaggggaagcttcttgtgg

SEQ ID NO: 167790 - DNA, 20 bp, Artificial
  CRISPR gRNA sequence
cttgtggctaacaggcaagt

SEQ ID NO: 167791 - DNA, 20 bp, Artificial
  CRISPR gRNA sequence
ttgtggctaacaggcaagta

SEQ ID NO: 167792 - DNA, 20 bp, Artificial
  CRISPR gRNA sequence
gtggctaacaggcaagtatt

SEQ ID NO: 167793 - DNA, 20 bp, Artificial
  CRISPR gRNA sequence
tggctaacaggcaagtattg

SEQ ID NO: 167794 - DNA, 20 bp, Artificial
  CRISPR gRNA sequence
acaggcaagtattgcctctg

SEQ ID NO: 167795 - DNA, 20 bp, Artificial
  CRISPR gRNA sequence
cctctgctctggagcaaatt

SEQ ID NO: 167796 - DNA, 20 bp, Artificial
  CRISPR gRNA sequence
tgctctggagcaaatttccc

SEQ ID NO: 167797 - DNA, 20 bp, Artificial
  CRISPR gRNA sequence
ctctggagcaaatttccctc

SEQ ID NO: 167798 - DNA, 20 bp, Artificial
  CRISPR gRNA sequence
tggagcaaatttccctctgg

SEQ ID NO: 167799 - DNA, 20 bp, Artificial
  CRISPR gRNA sequence
gagcaaatttccctctggcc

SEQ ID NO: 167800 - DNA, 20 bp, Artificial
  CRISPR gRNA sequence
ccctctggccttcaagagct

SEQ ID NO: 167801 - DNA, 20 bp, Artificial
  CRISPR gRNA sequence
cctctggccttcaagagcta

SEQ ID NO: 167802 - DNA, 20 bp, Artificial
  CRISPR gRNA sequence
tggccttcaagagctaactt

SEQ ID NO: 167803 - DNA, 20 bp, Artificial
  CRISPR gRNA sequence
gccttcaagagctaacttca

SEQ ID NO: 167804 - DNA, 20 bp, Artificial
  CRISPR gRNA sequence
caagagctaacttcactgca

SEQ ID NO: 167805 - DNA, 20 bp, Artificial
  CRISPR gRNA sequence
aagagctaacttcactgcag

SEQ ID NO: 167806 - DNA, 20 bp, Artificial
  CRISPR gRNA sequence
acttcactgcaggactcttc

SEQ ID NO: 167807 - DNA, 20 bp, Artificial
  CRISPR gRNA sequence
cactgcaggactcttccatg

SEQ ID NO: 167808 - DNA, 20 bp, Artificial
  CRISPR gRNA sequence
actgcaggactcttccatga

SEQ ID NO: 167809 - DNA, 20 bp, Artificial
  CRISPR gRNA sequence
caggactcttccatgaggaa

SEQ ID NO: 167810 - DNA, 20 bp, Artificial
  CRISPR gRNA sequence
ttccatgaggaaaatgctaa

SEQ ID NO: 167811 - DNA, 20 bp, Artificial
  CRISPR gRNA sequence
ccatgaggaaaatgctaatg

SEQ ID NO: 167812 - DNA, 20 bp, Artificial
  CRISPR gRNA sequence
catgaggaaaatgctaatgg

SEQ ID NO: 167813 - DNA, 20 bp, Artificial
  CRISPR gRNA sequence
atgggatgaagctgcattcc

SEQ ID NO: 167814 - DNA, 20 bp, Artificial
  CRISPR gRNA sequence
cattcctgcacgcagtgttc

SEQ ID NO: 167815 - DNA, 20 bp, Artificial
  CRISPR gRNA sequence
ctgcacgcagtgttcaatca

SEQ ID NO: 167816 - DNA, 20 bp, Artificial
  CRISPR gRNA sequence
cacgcagtgttcaatcaaaa

SEQ ID NO: 167817 - DNA, 20 bp, Artificial
  CRISPR gRNA sequence
aatcaaaatgcttctctgag

SEQ ID NO: 167818 - DNA, 20 bp, Artificial
  CRISPR gRNA sequence
ctctgagacttccagcctca

SEQ ID NO: 167819 - DNA, 20 bp, Artificial
  CRISPR gRNA sequence
tctgagacttccagcctcac

SEQ ID NO: 167820 - DNA, 20 bp, Artificial
  CRISPR gRNA sequence
tgagacttccagcctcacag

SEQ ID NO: 167821 - DNA, 20 bp, Artificial
  CRISPR gRNA sequence
agacttccagcctcacagaa

SEQ ID NO: 167822 - DNA, 20 bp, Artificial
  CRISPR gRNA sequence
ccagcctcacagaatttgaa

SEQ ID NO: 167823 - DNA, 20 bp, Artificial
  CRISPR gRNA sequence
cagcctcacagaatttgaac

SEQ ID NO: 167824 - DNA, 20 bp, Artificial
  CRISPR gRNA sequence
acagaatttgaactaccgag

SEQ ID NO: 167825 - DNA, 20 bp, Artificial
  CRISPR gRNA sequence
gaactaccgagaaaaaacga

SEQ ID NO: 167826 - DNA, 20 bp, Artificial
  CRISPR gRNA sequence
aactaccgagaaaaaacgac

SEQ ID NO: 167827 - DNA, 20 bp, Artificial
  CRISPR gRNA sequence
ccgagaaaaaacgacctctc

SEQ ID NO: 167828 - DNA, 20 bp, Artificial
  CRISPR gRNA sequence
tcaagttcacggtagaccat

SEQ ID NO: 167829 - DNA, 20 bp, Artificial
  CRISPR gRNA sequence
aagttcacggtagaccattc

SEQ ID NO: 167830 - DNA, 20 bp, Artificial
  CRISPR gRNA sequence
acggtagaccattccagaat

SEQ ID NO: 167831 - DNA, 20 bp, Artificial
  CRISPR gRNA sequence
cagaattgcccacttgaggc

SEQ ID NO: 167832 - DNA, 20 bp, Artificial
  CRISPR gRNA sequence
cccacttgaggcaagatgga

SEQ ID NO: 167833 - DNA, 20 bp, Artificial
  CRISPR gRNA sequence
gaggcaagatggagggacac

SEQ ID NO: 167834 - DNA, 20 bp, Artificial
  CRISPR gRNA sequence
aggcaagatggagggacacc

SEQ ID NO: 167835 - DNA, 20 bp, Artificial
  CRISPR gRNA sequence
aacccattaaaaatctggtt

SEQ ID NO: 167836 - DNA, 20 bp, Artificial
  CRISPR gRNA sequence
aaaatctggttcaaaggaga

SEQ ID NO: 167837 - DNA, 20 bp, Artificial
  CRISPR gRNA sequence
gttcaaaggagacagggcaa

SEQ ID NO: 167838 - DNA, 20 bp, Artificial
  CRISPR gRNA sequence
aaaggagacagggcaagagt

SEQ ID NO: 167839 - DNA, 20 bp, Artificial
  CRISPR gRNA sequence
ggacctgcagtcatttcttt

SEQ ID NO: 167840 - DNA, 20 bp, Artificial
  CRISPR gRNA sequence
cagtcatttctttcctgaga

SEQ ID NO: 167841 - DNA, 20 bp, Artificial
  CRISPR gRNA sequence
ctttcctgagaatatgccaa

SEQ ID NO: 167842 - DNA, 20 bp, Artificial
  CRISPR gRNA sequence
tttcctgagaatatgccaag

SEQ ID NO: 167843 - DNA, 20 bp, Artificial
  CRISPR gRNA sequence
tcctgagaatatgccaagag

SEQ ID NO: 167844 - DNA, 20 bp, Artificial
  CRISPR gRNA sequence
cctgagaatatgccaagaga

SEQ ID NO: 167845 - DNA, 20 bp, Artificial
  CRISPR gRNA sequence
ctgagaatatgccaagagaa

SEQ ID NO: 167846 - DNA, 20 bp, Artificial
  CRISPR gRNA sequence
agaatatgccaagagaagct

SEQ ID NO: 167847 - DNA, 20 bp, Artificial
  CRISPR gRNA sequence
ctgggaggctgtggtgccaa

SEQ ID NO: 167848 - DNA, 20 bp, Artificial
  CRISPR gRNA sequence
ggaggctgtggtgccaagcc

SEQ ID NO: 167849 - DNA, 20 bp, Artificial
  CRISPR gRNA sequence
tggtgccaagcctgaattcc

SEQ ID NO: 167850 - DNA, 20 bp, Artificial
  CRISPR gRNA sequence
aattccccacctaaatccta

SEQ ID NO: 167851 - DNA, 20 bp, Artificial
  CRISPR gRNA sequence
cccacctaaatcctataatg

SEQ ID NO: 167852 - DNA, 20 bp, Artificial
  CRISPR gRNA sequence
aatcctataatgcagcttcc

SEQ ID NO: 167853 - DNA, 20 bp, Artificial
  CRISPR gRNA sequence
taatgcagcttcctggcaac

SEQ ID NO: 167854 - DNA, 20 bp, Artificial
  CRISPR gRNA sequence
cctggcaacaatgttaagtt

SEQ ID NO: 167855 - DNA, 20 bp, Artificial
  CRISPR gRNA sequence
ctggcaacaatgttaagttg

SEQ ID NO: 167856 - DNA, 20 bp, Artificial
  CRISPR gRNA sequence
gcaacaatgttaagttgctt

SEQ ID NO: 167857 - DNA, 20 bp, Artificial
  CRISPR gRNA sequence
agttgcttgtggggaggaag

SEQ ID NO: 167858 - DNA, 20 bp, Artificial
  CRISPR gRNA sequence
cttgtggggaggaaggcagc

SEQ ID NO: 167859 - DNA, 20 bp, Artificial
  CRISPR gRNA sequence
gtggggaggaaggcagctgg

SEQ ID NO: 167860 - DNA, 20 bp, Artificial
  CRISPR gRNA sequence
tggggaggaaggcagctggg

SEQ ID NO: 167861 - DNA, 20 bp, Artificial
  CRISPR gRNA sequence
ggcagaagtttggaaaacct

SEQ ID NO: 167862 - DNA, 20 bp, Artificial
  CRISPR gRNA sequence
ggaaaacctcatctacagag

SEQ ID NO: 167863 - DNA, 20 bp, Artificial
  CRISPR gRNA sequence
gaaaacctcatctacagaga

SEQ ID NO: 167864 - DNA, 20 bp, Artificial
  CRISPR gRNA sequence
atctacagagactgatggtg

SEQ ID NO: 167865 - DNA, 20 bp, Artificial
  CRISPR gRNA sequence
cagagactgatggtggctag

SEQ ID NO: 167866 - DNA, 20 bp, Artificial
  CRISPR gRNA sequence
atggtggctagttccaggag

SEQ ID NO: 167867 - DNA, 20 bp, Artificial
  CRISPR gRNA sequence
gttccaggagtccccagaac

SEQ ID NO: 167868 - DNA, 20 bp, Artificial
  CRISPR gRNA sequence
caggagtccccagaactcca

SEQ ID NO: 167869 - DNA, 20 bp, Artificial
  CRISPR gRNA sequence
cagccagggatcacaagatg

SEQ ID NO: 167870 - DNA, 20 bp, Artificial
  CRISPR gRNA sequence
aagccttgtcccaggagtgg

SEQ ID NO: 167871 - DNA, 20 bp, Artificial
  CRISPR gRNA sequence
gtcccaggagtgggagaagg

SEQ ID NO: 167872 - DNA, 20 bp, Artificial
  CRISPR gRNA sequence
tcccaggagtgggagaaggt

SEQ ID NO: 167873 - DNA, 20 bp, Artificial
  CRISPR gRNA sequence
acagctacagggatgttaaa

SEQ ID NO: 167874 - DNA, 20 bp, Artificial
  CRISPR gRNA sequence
cagggatgttaaaattttct

SEQ ID NO: 167875 - DNA, 20 bp, Artificial
  CRISPR gRNA sequence
aaattttctagctgggaaga

SEQ ID NO: 167876 - DNA, 20 bp, Artificial
  CRISPR gRNA sequence
tctagctgggaagagctctt

SEQ ID NO: 167877 - DNA, 20 bp, Artificial
  CRISPR gRNA sequence
ctagctgggaagagctcttt

SEQ ID NO: 167878 - DNA, 20 bp, Artificial
  CRISPR gRNA sequence
tagctgggaagagctctttg

SEQ ID NO: 167879 - DNA, 20 bp, Artificial
  CRISPR gRNA sequence
gctgggaagagctctttgca

SEQ ID NO: 167880 - DNA, 20 bp, Artificial
  CRISPR gRNA sequence
ggaagagctctttgcagaaa

SEQ ID NO: 167881 - DNA, 20 bp, Artificial
  CRISPR gRNA sequence
tttgcagaaacccaaatgtg

SEQ ID NO: 167882 - DNA, 20 bp, Artificial
  CRISPR gRNA sequence
tgcagaaacccaaatgtgac

SEQ ID NO: 167883 - DNA, 20 bp, Artificial
  CRISPR gRNA sequence
gcagaaacccaaatgtgact

SEQ ID NO: 167884 - DNA, 20 bp, Artificial
  CRISPR gRNA sequence
cagaaacccaaatgtgactg

SEQ ID NO: 167885 - DNA, 20 bp, Artificial
  CRISPR gRNA sequence
aaaagctgtgagccaaatgg

SEQ ID NO: 167886 - DNA, 20 bp, Artificial
  CRISPR gRNA sequence
tgagccaaatggttccaagc

SEQ ID NO: 167887 - DNA, 20 bp, Artificial
  CRISPR gRNA sequence
caagcagctcttcaacaaag

SEQ ID NO: 167888 - DNA, 20 bp, Artificial
  CRISPR gRNA sequence
ttcaacaaagcaagaagctt

SEQ ID NO: 167889 - DNA, 20 bp, Artificial
  CRISPR gRNA sequence
caacaaagcaagaagctttc

SEQ ID NO: 167890 - DNA, 20 bp, Artificial
  CRISPR gRNA sequence
aacaaagcaagaagctttcc

SEQ ID NO: 167891 - DNA, 20 bp, Artificial
  CRISPR gRNA sequence
tcctttttggcctaggttaa

SEQ ID NO: 167892 - DNA, 20 bp, Artificial
  CRISPR gRNA sequence
cctttttggcctaggttaag

SEQ ID NO: 167893 - DNA, 20 bp, Artificial
  CRISPR gRNA sequence
ctttttggcctaggttaaga

SEQ ID NO: 167894 - DNA, 20 bp, Artificial
  CRISPR gRNA sequence
tttggcctaggttaagacat

SEQ ID NO: 167895 - DNA, 20 bp, Artificial
  CRISPR gRNA sequence
ttggcctaggttaagacatt

SEQ ID NO: 167896 - DNA, 20 bp, Artificial
  CRISPR gRNA sequence
tggcctaggttaagacattt

SEQ ID NO: 167897 - DNA, 20 bp, Artificial
  CRISPR gRNA sequence
ggcctaggttaagacatttg

SEQ ID NO: 167898 - DNA, 20 bp, Artificial
  CRISPR gRNA sequence
gcctaggttaagacatttgg

SEQ ID NO: 167899 - DNA, 20 bp, Artificial
  CRISPR gRNA sequence
ggttaagacatttggtgatg

SEQ ID NO: 167900 - DNA, 20 bp, Artificial
  CRISPR gRNA sequence
agacatttggtgatgatccg

SEQ ID NO: 167901 - DNA, 20 bp, Artificial
  CRISPR gRNA sequence
ggtgatgatccgtccctcat

SEQ ID NO: 167902 - DNA, 20 bp, Artificial
  CRISPR gRNA sequence
gtgatgatccgtccctcatt

SEQ ID NO: 167903 - DNA, 20 bp, Artificial
  CRISPR gRNA sequence
attcctctacagcaggacag

SEQ ID NO: 167904 - DNA, 20 bp, Artificial
  CRISPR gRNA sequence
ctctacagcaggacaggtct

SEQ ID NO: 167905 - DNA, 20 bp, Artificial
  CRISPR gRNA sequence
tacagcaggacaggtctggg

SEQ ID NO: 167906 - DNA, 20 bp, Artificial
  CRISPR gRNA sequence
cagcaggacaggtctgggga

SEQ ID NO: 167907 - DNA, 20 bp, Artificial
  CRISPR gRNA sequence
gggaccctcatagctttttt

SEQ ID NO: 167908 - DNA, 20 bp, Artificial
  CRISPR gRNA sequence
atagcttttttacattaatt

SEQ ID NO: 167909 - DNA, 20 bp, Artificial
  CRISPR gRNA sequence
ttttacattaattacagaga

SEQ ID NO: 167910 - DNA, 20 bp, Artificial
  CRISPR gRNA sequence
tttacattaattacagagaa

SEQ ID NO: 167911 - DNA, 20 bp, Artificial
  CRISPR gRNA sequence
ttacattaattacagagaaa

SEQ ID NO: 167912 - DNA, 20 bp, Artificial
  CRISPR gRNA sequence
tacattaattacagagaaaa

SEQ ID NO: 167913 - DNA, 20 bp, Artificial
  CRISPR gRNA sequence
acattaattacagagaaaat

SEQ ID NO: 167914 - DNA, 20 bp, Artificial
  CRISPR gRNA sequence
cattaattacagagaaaata

SEQ ID NO: 167915 - DNA, 20 bp, Artificial
  CRISPR gRNA sequence
attacagagaaaataagctc

SEQ ID NO: 167916 - DNA, 20 bp, Artificial
  CRISPR gRNA sequence
cagagaaaataagctctggg

SEQ ID NO: 167917 - DNA, 20 bp, Artificial
  CRISPR gRNA sequence
tgggtttttgaaagggaaat

SEQ ID NO: 167918 - DNA, 20 bp, Artificial
  CRISPR gRNA sequence
ggtttttgaaagggaaataa

SEQ ID NO: 167919 - DNA, 20 bp, Artificial
  CRISPR gRNA sequence
ttgaaagggaaataaagttt

SEQ ID NO: 167920 - DNA, 20 bp, Artificial
  CRISPR gRNA sequence
tgaaagggaaataaagtttc

SEQ ID NO: 167921 - DNA, 20 bp, Artificial
  CRISPR gRNA sequence
gaaagggaaataaagtttcc

SEQ ID NO: 167922 - DNA, 20 bp, Artificial
  CRISPR gRNA sequence
aaagggaaataaagtttcct

SEQ ID NO: 167923 - DNA, 20 bp, Artificial
  CRISPR gRNA sequence
ccttcctgaagctcatcact

SEQ ID NO: 167924 - DNA, 20 bp, Artificial
  CRISPR gRNA sequence
cttcctgaagctcatcacta

SEQ ID NO: 167925 - DNA, 20 bp, Artificial
  CRISPR gRNA sequence
cctgaagctcatcactatta

SEQ ID NO: 167926 - DNA, 20 bp, Artificial
  CRISPR gRNA sequence
ctgaagctcatcactattag

SEQ ID NO: 167927 - DNA, 20 bp, Artificial
  CRISPR gRNA sequence
aagctcatcactattaggaa

SEQ ID NO: 167928 - DNA, 20 bp, Artificial
  CRISPR gRNA sequence
atcactattaggaacattcc

SEQ ID NO: 167929 - DNA, 20 bp, Artificial
  CRISPR gRNA sequence
ttaggaacattccaatgagc

SEQ ID NO: 167930 - DNA, 20 bp, Artificial
  CRISPR gRNA sequence
ggaacattccaatgagctgc

SEQ ID NO: 167931 - DNA, 20 bp, Artificial
  CRISPR gRNA sequence
caatgagctgcctaaagagt

SEQ ID NO: 167932 - DNA, 20 bp, Artificial
  CRISPR gRNA sequence
cctaaagagtctggaaatga

SEQ ID NO: 167933 - DNA, 20 bp, Artificial
  CRISPR gRNA sequence
aagagtctggaaatgaagac

SEQ ID NO: 167934 - DNA, 20 bp, Artificial
  CRISPR gRNA sequence
gaaatgaagactcctacaga

SEQ ID NO: 167935 - DNA, 20 bp, Artificial
  CRISPR gRNA sequence
ctacagaaggtgcctgagcc

SEQ ID NO: 167936 - DNA, 20 bp, Artificial
  CRISPR gRNA sequence
cagaaggtgcctgagccagt

SEQ ID NO: 167937 - DNA, 20 bp, Artificial
  CRISPR gRNA sequence
agccagtgaagatgaagtag

SEQ ID NO: 167938 - DNA, 20 bp, Artificial
  CRISPR gRNA sequence
tgcaacaaatcttctgggct

SEQ ID NO: 167939 - DNA, 20 bp, Artificial
  CRISPR gRNA sequence
caacaaatcttctgggctaa

SEQ ID NO: 167940 - DNA, 20 bp, Artificial
  CRISPR gRNA sequence
ctgggctaaagctctgtgcc

SEQ ID NO: 167941 - DNA, 20 bp, Artificial
  CRISPR gRNA sequence
tgggctaaagctctgtgccc

SEQ ID NO: 167942 - DNA, 20 bp, Artificial
  CRISPR gRNA sequence
ggctaaagctctgtgcccca

SEQ ID NO: 167943 - DNA, 20 bp, Artificial
  CRISPR gRNA sequence
aagctctgtgccccagagag

SEQ ID NO: 167944 - DNA, 20 bp, Artificial
  CRISPR gRNA sequence
tgtgccccagagagttaaag

SEQ ID NO: 167945 - DNA, 20 bp, Artificial
  CRISPR gRNA sequence
tgccccagagagttaaagta

SEQ ID NO: 167946 - DNA, 20 bp, Artificial
  CRISPR gRNA sequence
aagtatctgcaaggtggaac

SEQ ID NO: 167947 - DNA, 20 bp, Artificial
  CRISPR gRNA sequence
caaggtggaactcttctctg

SEQ ID NO: 167948 - DNA, 20 bp, Artificial
  CRISPR gRNA sequence
ttctctgtcttaaatgaacc

SEQ ID NO: 167949 - DNA, 20 bp, Artificial
  CRISPR gRNA sequence
ctctgtcttaaatgaacctg

SEQ ID NO: 167950 - DNA, 20 bp, Artificial
  CRISPR gRNA sequence
tctgtcttaaatgaacctgt

SEQ ID NO: 167951 - DNA, 20 bp, Artificial
  CRISPR gRNA sequence
tgtcttaaatgaacctgtgg

SEQ ID NO: 167952 - DNA, 20 bp, Artificial
  CRISPR gRNA sequence
tcttaaatgaacctgtggtg

SEQ ID NO: 167953 - DNA, 20 bp, Artificial
  CRISPR gRNA sequence
aaatgaacctgtggtggtgc

SEQ ID NO: 167954 - DNA, 20 bp, Artificial
  CRISPR gRNA sequence
aatgaacctgtggtggtgcc

SEQ ID NO: 167955 - DNA, 20 bp, Artificial
  CRISPR gRNA sequence
tggtggtgccttcgcttgca

SEQ ID NO: 167956 - DNA, 20 bp, Artificial
  CRISPR gRNA sequence
cgcttgcaaaaatgagaacc

SEQ ID NO: 167957 - DNA, 20 bp, Artificial
  CRISPR gRNA sequence
gcttgcaaaaatgagaacca

SEQ ID NO: 167958 - DNA, 20 bp, Artificial
  CRISPR gRNA sequence
gcaaaaatgagaaccattca

SEQ ID NO: 167959 - DNA, 20 bp, Artificial
  CRISPR gRNA sequence
caaaaatgagaaccattcaa

SEQ ID NO: 167960 - DNA, 20 bp, Artificial
  CRISPR gRNA sequence
aacagaaatcttggggttga

SEQ ID NO: 167961 - DNA, 20 bp, Artificial
  CRISPR gRNA sequence
ggggttgaggactgaaacaa

SEQ ID NO: 167962 - DNA, 20 bp, Artificial
  CRISPR gRNA sequence
gggttgaggactgaaacaat

SEQ ID NO: 167963 - DNA, 20 bp, Artificial
  CRISPR gRNA sequence
aggactgaaacaatgaagca

SEQ ID NO: 167964 - DNA, 20 bp, Artificial
  CRISPR gRNA sequence
aaacaatgaagcaaggcaga

SEQ ID NO: 167965 - DNA, 20 bp, Artificial
  CRISPR gRNA sequence
agtcatctgcaatcctgggt

SEQ ID NO: 167966 - DNA, 20 bp, Artificial
  CRISPR gRNA sequence
caatcctgggtatcgtaagc

SEQ ID NO: 167967 - DNA, 20 bp, Artificial
  CRISPR gRNA sequence
ggtatcgtaagcacacgtga

SEQ ID NO: 167968 - DNA, 20 bp, Artificial
  CRISPR gRNA sequence
cactttcctaagctttctct

SEQ ID NO: 167969 - DNA, 20 bp, Artificial
  CRISPR gRNA sequence
tcctaagctttctcttggcc

SEQ ID NO: 167970 - DNA, 20 bp, Artificial
  CRISPR gRNA sequence
cctaagctttctcttggcct

SEQ ID NO: 167971 - DNA, 20 bp, Artificial
  CRISPR gRNA sequence
ctaagctttctcttggccta

SEQ ID NO: 167972 - DNA, 20 bp, Artificial
  CRISPR gRNA sequence
agctttctcttggcctatta

SEQ ID NO: 167973 - DNA, 20 bp, Artificial
  CRISPR gRNA sequence
tctcttggcctattactatg

SEQ ID NO: 167974 - DNA, 20 bp, Artificial
  CRISPR gRNA sequence
ctcttggcctattactatgt

SEQ ID NO: 167975 - DNA, 20 bp, Artificial
  CRISPR gRNA sequence
tcttggcctattactatgtt

SEQ ID NO: 167976 - DNA, 20 bp, Artificial
  CRISPR gRNA sequence
ttggcctattactatgttaa

SEQ ID NO: 167977 - DNA, 20 bp, Artificial
  CRISPR gRNA sequence
ggcctattactatgttaact

SEQ ID NO: 167978 - DNA, 20 bp, Artificial
  CRISPR gRNA sequence
gcctattactatgttaactt

SEQ ID NO: 167979 - DNA, 20 bp, Artificial
  CRISPR gRNA sequence
ttactatgttaacttcagat

SEQ ID NO: 167980 - DNA, 20 bp, Artificial
  CRISPR gRNA sequence
ctatgttaacttcagatgaa

SEQ ID NO: 167981 - DNA, 20 bp, Artificial
  CRISPR gRNA sequence
tgttaacttcagatgaagaa

SEQ ID NO: 167982 - DNA, 20 bp, Artificial
  CRISPR gRNA sequence
acttcagatgaagaacaatt

SEQ ID NO: 167983 - DNA, 20 bp, Artificial
  CRISPR gRNA sequence
cagatgaagaacaattccta

SEQ ID NO: 167984 - DNA, 20 bp, Artificial
  CRISPR gRNA sequence
agatgaagaacaattcctaa

SEQ ID NO: 167985 - DNA, 20 bp, Artificial
  CRISPR gRNA sequence
ctaaactgatctcaggatac

SEQ ID NO: 167986 - DNA, 20 bp, Artificial
  CRISPR gRNA sequence
aactgatctcaggatacttt

SEQ ID NO: 167987 - DNA, 20 bp, Artificial
  CRISPR gRNA sequence
atctcaggatacttttagag

SEQ ID NO: 167988 - DNA, 20 bp, Artificial
  CRISPR gRNA sequence
aggatacttttagagttatt

SEQ ID NO: 167989 - DNA, 20 bp, Artificial
  CRISPR gRNA sequence
ttagagttattttcacagag

SEQ ID NO: 167990 - DNA, 20 bp, Artificial
  CRISPR gRNA sequence
tagagttattttcacagagg

SEQ ID NO: 167991 - DNA, 20 bp, Artificial
  CRISPR gRNA sequence
agagttattttcacagagga

SEQ ID NO: 167992 - DNA, 20 bp, Artificial
  CRISPR gRNA sequence
gagttattttcacagaggaa

SEQ ID NO: 167993 - DNA, 20 bp, Artificial
  CRISPR gRNA sequence
ttttcacagaggaagtggtt

SEQ ID NO: 167994 - DNA, 20 bp, Artificial
  CRISPR gRNA sequence
tcacagaggaagtggttaac

SEQ ID NO: 167995 - DNA, 20 bp, Artificial
  CRISPR gRNA sequence
cacagaggaagtggttaacc

SEQ ID NO: 167996 - DNA, 20 bp, Artificial
  CRISPR gRNA sequence
acagaggaagtggttaacca

SEQ ID NO: 167997 - DNA, 20 bp, Artificial
  CRISPR gRNA sequence
accaagtctacgtgagtttc

SEQ ID NO: 167998 - DNA, 20 bp, Artificial
  CRISPR gRNA sequence
cgtgagtttctatacctgcc

SEQ ID NO: 167999 - DNA, 20 bp, Artificial
  CRISPR gRNA sequence
ctatacctgcctacgtttca

SEQ ID NO: 168000 - DNA, 20 bp, Artificial
  CRISPR gRNA sequence
tatacctgcctacgtttcat

SEQ ID NO: 168001 - DNA, 20 bp, Artificial
  CRISPR gRNA sequence
tacctgcctacgtttcattt

SEQ ID NO: 168002 - DNA, 20 bp, Artificial
  CRISPR gRNA sequence
cctacgtttcatttatgaca

SEQ ID NO: 168003 - DNA, 20 bp, Artificial
  CRISPR gRNA sequence
cgtttcatttatgacaaaaa

SEQ ID NO: 168004 - DNA, 20 bp, Artificial
  CRISPR gRNA sequence
catttatgacaaaaatggca

SEQ ID NO: 168005 - DNA, 20 bp, Artificial
  CRISPR gRNA sequence
atttatgacaaaaatggcaa

SEQ ID NO: 168006 - DNA, 20 bp, Artificial
  CRISPR gRNA sequence
atgacaaaaatggcaaaggg

SEQ ID NO: 168007 - DNA, 20 bp, Artificial
  CRISPR gRNA sequence
tgacaaaaatggcaaagggc

SEQ ID NO: 168008 - DNA, 20 bp, Artificial
  CRISPR gRNA sequence
ctctgtttcactcactttcc

SEQ ID NO: 168009 - DNA, 20 bp, Artificial
  CRISPR gRNA sequence
tgtttcactcactttccagt

SEQ ID NO: 168010 - DNA, 20 bp, Artificial
  CRISPR gRNA sequence
tttcactcactttccagttt

SEQ ID NO: 168011 - DNA, 20 bp, Artificial
  CRISPR gRNA sequence
cactcactttccagttttgg

SEQ ID NO: 168012 - DNA, 20 bp, Artificial
  CRISPR gRNA sequence
actcactttccagttttggg

SEQ ID NO: 168013 - DNA, 20 bp, Artificial
  CRISPR gRNA sequence
actttccagttttggggggt

SEQ ID NO: 168014 - DNA, 20 bp, Artificial
  CRISPR gRNA sequence
tccagttttggggggtcaaa

SEQ ID NO: 168015 - DNA, 20 bp, Artificial
  CRISPR gRNA sequence
ccagttttggggggtcaaaa

SEQ ID NO: 168016 - DNA, 20 bp, Artificial
  CRISPR gRNA sequence
cagttttggggggtcaaaat

SEQ ID NO: 168017 - DNA, 20 bp, Artificial
  CRISPR gRNA sequence
tggggggtcaaaatgaccaa

SEQ ID NO: 168018 - DNA, 20 bp, Artificial
  CRISPR gRNA sequence
ggggggtcaaaatgaccaat

SEQ ID NO: 168019 - DNA, 20 bp, Artificial
  CRISPR gRNA sequence
gggggtcaaaatgaccaatg

SEQ ID NO: 168020 - DNA, 20 bp, Artificial
  CRISPR gRNA sequence
caagtgttaagacaaggaca

SEQ ID NO: 168021 - DNA, 20 bp, Artificial
  CRISPR gRNA sequence
agacaaggacacattttaca

SEQ ID NO: 168022 - DNA, 20 bp, Artificial
  CRISPR gRNA sequence
tacaaaaggagtacaaataa

SEQ ID NO: 168023 - DNA, 20 bp, Artificial
  CRISPR gRNA sequence
acaaaaggagtacaaataaa

SEQ ID NO: 168024 - DNA, 20 bp, Artificial
  CRISPR gRNA sequence
caaaaggagtacaaataaaa

SEQ ID NO: 168025 - DNA, 20 bp, Artificial
  CRISPR gRNA sequence
agaaatgaaatccctcaagg

SEQ ID NO: 168026 - DNA, 20 bp, Artificial
  CRISPR gRNA sequence
aaggcacacaggaagcagca

SEQ ID NO: 168027 - DNA, 20 bp, Artificial
  CRISPR gRNA sequence
tatgaaagccaaaaatacac

SEQ ID NO: 168028 - DNA, 20 bp, Artificial
  CRISPR gRNA sequence
tgctgcaggctccactggga

SEQ ID NO: 168029 - DNA, 20 bp, Artificial
  CRISPR gRNA sequence
gctgcaggctccactgggaa

SEQ ID NO: 168030 - DNA, 20 bp, Artificial
  CRISPR gRNA sequence
ctgcaggctccactgggaac

SEQ ID NO: 168031 - DNA, 20 bp, Artificial
  CRISPR gRNA sequence
caggctccactgggaactga

SEQ ID NO: 168032 - DNA, 20 bp, Artificial
  CRISPR gRNA sequence
cactgggaactgactcatga

SEQ ID NO: 168033 - DNA, 20 bp, Artificial
  CRISPR gRNA sequence
ggaactgactcatgaatatg

SEQ ID NO: 168034 - DNA, 20 bp, Artificial
  CRISPR gRNA sequence
actcatgaatatgcaacaag

SEQ ID NO: 168035 - DNA, 20 bp, Artificial
  CRISPR gRNA sequence
atgaatatgcaacaagtgta

SEQ ID NO: 168036 - DNA, 20 bp, Artificial
  CRISPR gRNA sequence
atggccttccctatacgcct

SEQ ID NO: 168037 - DNA, 20 bp, Artificial
  CRISPR gRNA sequence
tggccttccctatacgcctc

SEQ ID NO: 168038 - DNA, 20 bp, Artificial
  CRISPR gRNA sequence
ccctatacgcctccctctta

SEQ ID NO: 168039 - DNA, 20 bp, Artificial
  CRISPR gRNA sequence
cctatacgcctccctcttat

SEQ ID NO: 168040 - DNA, 20 bp, Artificial
  CRISPR gRNA sequence
tacgcctccctcttatcctc

SEQ ID NO: 168041 - DNA, 20 bp, Artificial
  CRISPR gRNA sequence
cctcttatcctctgctaatc

SEQ ID NO: 168042 - DNA, 20 bp, Artificial
  CRISPR gRNA sequence
ttatcctctgctaatcaaat

SEQ ID NO: 168043 - DNA, 20 bp, Artificial
  CRISPR gRNA sequence
atcctctgctaatcaaatac

SEQ ID NO: 168044 - DNA, 20 bp, Artificial
  CRISPR gRNA sequence
tcctctgctaatcaaataca

SEQ ID NO: 168045 - DNA, 20 bp, Artificial
  CRISPR gRNA sequence
tgctaatcaaatacaggact

SEQ ID NO: 168046 - DNA, 20 bp, Artificial
  CRISPR gRNA sequence
ctaatcaaatacaggactgc

SEQ ID NO: 168047 - DNA, 20 bp, Artificial
  CRISPR gRNA sequence
atcaaatacaggactgcctc

SEQ ID NO: 168048 - DNA, 20 bp, Artificial
  CRISPR gRNA sequence
cctcacagggcctttgggcc

SEQ ID NO: 168049 - DNA, 20 bp, Artificial
  CRISPR gRNA sequence
acagggcctttgggccttgg

SEQ ID NO: 168050 - DNA, 20 bp, Artificial
  CRISPR gRNA sequence
tgggccttggcatgggtagt

SEQ ID NO: 168051 - DNA, 20 bp, Artificial
  CRISPR gRNA sequence
gggccttggcatgggtagtg

SEQ ID NO: 168052 - DNA, 20 bp, Artificial
  CRISPR gRNA sequence
ggccttggcatgggtagtgg

SEQ ID NO: 168053 - DNA, 20 bp, Artificial
  CRISPR gRNA sequence
ggcatgggtagtggttacaa

SEQ ID NO: 168054 - DNA, 20 bp, Artificial
  CRISPR gRNA sequence
gcatgggtagtggttacaat

SEQ ID NO: 168055 - DNA, 20 bp, Artificial
  CRISPR gRNA sequence
caatgatttccctgcatagg

SEQ ID NO: 168056 - DNA, 20 bp, Artificial
  CRISPR gRNA sequence
ccctgcataggtagaatgag

SEQ ID NO: 168057 - DNA, 20 bp, Artificial
  CRISPR gRNA sequence
cctgcataggtagaatgagg

SEQ ID NO: 168058 - DNA, 20 bp, Artificial
  CRISPR gRNA sequence
cataggtagaatgaggggaa

SEQ ID NO: 168059 - DNA, 20 bp, Artificial
  CRISPR gRNA sequence
aacctagattaaaggaaagc

SEQ ID NO: 168060 - DNA, 20 bp, Artificial
  CRISPR gRNA sequence
gattaaaggaaagcagggaa

SEQ ID NO: 168061 - DNA, 20 bp, Artificial
  CRISPR gRNA sequence
aaggaaagcagggaacaaac

SEQ ID NO: 168062 - DNA, 20 bp, Artificial
  CRISPR gRNA sequence
tggtcaggaacactgggcat

SEQ ID NO: 168063 - DNA, 20 bp, Artificial
  CRISPR gRNA sequence
ggcatataggttaaaaacaa

SEQ ID NO: 168064 - DNA, 20 bp, Artificial
  CRISPR gRNA sequence
aaaacaaaacaaacacacac

SEQ ID NO: 168065 - DNA, 20 bp, Artificial
  CRISPR gRNA sequence
agggctgggcgtgatggctc

SEQ ID NO: 168066 - DNA, 20 bp, Artificial
  CRISPR gRNA sequence
ggcgtgatggctcatgcctg

SEQ ID NO: 168067 - DNA, 20 bp, Artificial
  CRISPR gRNA sequence
atgcctgtaatcccagcact

SEQ ID NO: 168068 - DNA, 20 bp, Artificial
  CRISPR gRNA sequence
taatcccagcactttgggag

SEQ ID NO: 168069 - DNA, 20 bp, Artificial
  CRISPR gRNA sequence
tgggaggccgaggcgggcgg

SEQ ID NO: 168070 - DNA, 20 bp, Artificial
  CRISPR gRNA sequence
gggaggccgaggcgggcgga

SEQ ID NO: 168071 - DNA, 20 bp, Artificial
  CRISPR gRNA sequence
ggaggccgaggcgggcggat

SEQ ID NO: 168072 - DNA, 20 bp, Artificial
  CRISPR gRNA sequence
aggttaggagttagagacca

SEQ ID NO: 168073 - DNA, 20 bp, Artificial
  CRISPR gRNA sequence
ggagttagagaccagcctgg

SEQ ID NO: 168074 - DNA, 20 bp, Artificial
  CRISPR gRNA sequence
gagaccagcctggccaacac

SEQ ID NO: 168075 - DNA, 20 bp, Artificial
  CRISPR gRNA sequence
gccaacactgtgaaacccca

SEQ ID NO: 168076 - DNA, 20 bp, Artificial
  CRISPR gRNA sequence
tgaaaccccatctctactaa

SEQ ID NO: 168077 - DNA, 20 bp, Artificial
  CRISPR gRNA sequence
tactaaaaatacaaaaatca

SEQ ID NO: 168078 - DNA, 20 bp, Artificial
  CRISPR gRNA sequence
ctaaaaatacaaaaatcagc

SEQ ID NO: 168079 - DNA, 20 bp, Artificial
  CRISPR gRNA sequence
aaaatacaaaaatcagccgg

SEQ ID NO: 168080 - DNA, 20 bp, Artificial
  CRISPR gRNA sequence
taatcccagctactcgggag

SEQ ID NO: 168081 - DNA, 20 bp, Artificial
  CRISPR gRNA sequence
ctcgggaggctgaggcagga

SEQ ID NO: 168082 - DNA, 20 bp, Artificial
  CRISPR gRNA sequence
gggaggctgaggcaggagaa

SEQ ID NO: 168083 - DNA, 20 bp, Artificial
  CRISPR gRNA sequence
aggcaggagaatcgcttgaa

SEQ ID NO: 168084 - DNA, 20 bp, Artificial
  CRISPR gRNA sequence
gaacctgggaggcggaagct

SEQ ID NO: 168085 - DNA, 20 bp, Artificial
  CRISPR gRNA sequence
aacctgggaggcggaagctg

SEQ ID NO: 168086 - DNA, 20 bp, Artificial
  CRISPR gRNA sequence
ggaggcggaagctgcagtga

SEQ ID NO: 168087 - DNA, 20 bp, Artificial
  CRISPR gRNA sequence
cagtgagctgagatcaagcc

SEQ ID NO: 168088 - DNA, 20 bp, Artificial
  CRISPR gRNA sequence
agatcaagccactgcacttc

SEQ ID NO: 168089 - DNA, 20 bp, Artificial
  CRISPR gRNA sequence
cacttcatcagtctgagtga

SEQ ID NO: 168090 - DNA, 20 bp, Artificial
  CRISPR gRNA sequence
catcagtctgagtgacacag

SEQ ID NO: 168091 - DNA, 20 bp, Artificial
  CRISPR gRNA sequence
atcagtctgagtgacacagc

SEQ ID NO: 168092 - DNA, 20 bp, Artificial
  CRISPR gRNA sequence
agtgacacagcaagacctgt

SEQ ID NO: 168093 - DNA, 20 bp, Artificial
  CRISPR gRNA sequence
tctcctaaaaagaaaaaaag

SEQ ID NO: 168094 - DNA, 20 bp, Artificial
  CRISPR gRNA sequence
ctaaaaagaaaaaaaggatt

SEQ ID NO: 168095 - DNA, 20 bp, Artificial
  CRISPR gRNA sequence
aaaagaaaaaaaggattatg

SEQ ID NO: 168096 - DNA, 20 bp, Artificial
  CRISPR gRNA sequence
tgcatgcgtgtgatatatat

SEQ ID NO: 168097 - DNA, 20 bp, Artificial
  CRISPR gRNA sequence
tatatatatatcaaggtata

SEQ ID NO: 168098 - DNA, 20 bp, Artificial
  CRISPR gRNA sequence
tatatatatcaaggtatata

SEQ ID NO: 168099 - DNA, 20 bp, Artificial
  CRISPR gRNA sequence
cagatatatatatcaaggta

SEQ ID NO: 168100 - DNA, 20 bp, Artificial
  CRISPR gRNA sequence
tagatatacatatcaaggta

SEQ ID NO: 168101 - DNA, 20 bp, Artificial
  CRISPR gRNA sequence
tagatatatatatcaaggta

SEQ ID NO: 168102 - DNA, 20 bp, Artificial
  CRISPR gRNA sequence
tagatatacatatcaaggta

SEQ ID NO: 168103 - DNA, 20 bp, Artificial
  CRISPR gRNA sequence
taagtatttccttctataaa

SEQ ID NO: 168104 - DNA, 20 bp, Artificial
  CRISPR gRNA sequence
aagtatttccttctataaag

SEQ ID NO: 168105 - DNA, 20 bp, Artificial
  CRISPR gRNA sequence
agtatttccttctataaagt

SEQ ID NO: 168106 - DNA, 20 bp, Artificial
  CRISPR gRNA sequence
ccttctataaagttgtaaag

SEQ ID NO: 168107 - DNA, 20 bp, Artificial
  CRISPR gRNA sequence
cttctataaagttgtaaaga

SEQ ID NO: 168108 - DNA, 20 bp, Artificial
  CRISPR gRNA sequence
ctataaagttgtaaagacag

SEQ ID NO: 168109 - DNA, 20 bp, Artificial
  CRISPR gRNA sequence
tataaagttgtaaagacaga

SEQ ID NO: 168110 - DNA, 20 bp, Artificial
  CRISPR gRNA sequence
taaagttgtaaagacagacc

SEQ ID NO: 168111 - DNA, 20 bp, Artificial
  CRISPR gRNA sequence
taaagacagacctcagggca

SEQ ID NO: 168112 - DNA, 20 bp, Artificial
  CRISPR gRNA sequence
agggcaggactcaccgggat

SEQ ID NO: 168113 - DNA, 20 bp, Artificial
  CRISPR gRNA sequence
accgggatctgctggatctc

SEQ ID NO: 168114 - DNA, 20 bp, Artificial
  CRISPR gRNA sequence
ctggatctctcctgtgttag

SEQ ID NO: 168115 - DNA, 20 bp, Artificial
  CRISPR gRNA sequence
gatctctcctgtgttagtga

SEQ ID NO: 168116 - DNA, 20 bp, Artificial
  CRISPR gRNA sequence
tcctgtgttagtgatgatct

SEQ ID NO: 168117 - DNA, 20 bp, Artificial
  CRISPR gRNA sequence
ctgtgttagtgatgatctgc

SEQ ID NO: 168118 - DNA, 20 bp, Artificial
  CRISPR gRNA sequence
tgttagtgatgatctgctgc

SEQ ID NO: 168119 - DNA, 20 bp, Artificial
  CRISPR gRNA sequence
gtgatgatctgctgcatcac

SEQ ID NO: 168120 - DNA, 20 bp, Artificial
  CRISPR gRNA sequence
ctgcatcacctgcatggtct

SEQ ID NO: 168121 - DNA, 20 bp, Artificial
  CRISPR gRNA sequence
catcacctgcatggtctgtc

SEQ ID NO: 168122 - DNA, 20 bp, Artificial
  CRISPR gRNA sequence
catggtctgtccagtgccac

SEQ ID NO: 168123 - DNA, 20 bp, Artificial
  CRISPR gRNA sequence
tccagtgccactctgggcct

SEQ ID NO: 168124 - DNA, 20 bp, Artificial
  CRISPR gRNA sequence
tgggcctgttgggcttgacc

SEQ ID NO: 168125 - DNA, 20 bp, Artificial
  CRISPR gRNA sequence
ggcctgttgggcttgaccct

SEQ ID NO: 168126 - DNA, 20 bp, Artificial
  CRISPR gRNA sequence
ttgggcttgaccctgtggct

SEQ ID NO: 168127 - DNA, 20 bp, Artificial
  CRISPR gRNA sequence
ggcttgaccctgtggctgag

SEQ ID NO: 168128 - DNA, 20 bp, Artificial
  CRISPR gRNA sequence
gaccctgtggctgagcctgg

SEQ ID NO: 168129 - DNA, 20 bp, Artificial
  CRISPR gRNA sequence
accctgtggctgagcctgga

SEQ ID NO: 168130 - DNA, 20 bp, Artificial
  CRISPR gRNA sequence
tggctgagcctggacaatct

SEQ ID NO: 168131 - DNA, 20 bp, Artificial
  CRISPR gRNA sequence
agcctggacaatctgcacct

SEQ ID NO: 168132 - DNA, 20 bp, Artificial
  CRISPR gRNA sequence
gacaatctgcacctgctgac

SEQ ID NO: 168133 - DNA, 20 bp, Artificial
  CRISPR gRNA sequence
cacctgctgaccttctccaa

SEQ ID NO: 168134 - DNA, 20 bp, Artificial
  CRISPR gRNA sequence
ctgaccttctccaacctgca

SEQ ID NO: 168135 - DNA, 20 bp, Artificial
  CRISPR gRNA sequence
accttctccaacctgcattg

SEQ ID NO: 168136 - DNA, 20 bp, Artificial
  CRISPR gRNA sequence
ctccaacctgcattgtcaca

SEQ ID NO: 168137 - DNA, 20 bp, Artificial
  CRISPR gRNA sequence
tccaacctgcattgtcacag

SEQ ID NO: 168138 - DNA, 20 bp, Artificial
  CRISPR gRNA sequence
caacctgcattgtcacaggt

SEQ ID NO: 168139 - DNA, 20 bp, Artificial
  CRISPR gRNA sequence
cattgtcacaggtgtggtct

SEQ ID NO: 168140 - DNA, 20 bp, Artificial
  CRISPR gRNA sequence
tcacaggtgtggtctgaaag

SEQ ID NO: 168141 - DNA, 20 bp, Artificial
  CRISPR gRNA sequence
aaaggaagagttatgagaat

SEQ ID NO: 168142 - DNA, 20 bp, Artificial
  CRISPR gRNA sequence
tgagaatgctgcgtgagttc

SEQ ID NO: 168143 - DNA, 20 bp, Artificial
  CRISPR gRNA sequence
cgtgagttcaggctcagagc

SEQ ID NO: 168144 - DNA, 20 bp, Artificial
  CRISPR gRNA sequence
aggctcagagcccacaggat

SEQ ID NO: 168145 - DNA, 20 bp, Artificial
  CRISPR gRNA sequence
agagcccacaggattaccga

SEQ ID NO: 168146 - DNA, 20 bp, Artificial
  CRISPR gRNA sequence
ccgagaggttaataacgagc

SEQ ID NO: 168147 - DNA, 20 bp, Artificial
  CRISPR gRNA sequence
ataacgagcaatgtgctggg

SEQ ID NO: 168148 - DNA, 20 bp, Artificial
  CRISPR gRNA sequence
ggagcaaaccctctccatga

SEQ ID NO: 168149 - DNA, 20 bp, Artificial
  CRISPR gRNA sequence
tccatgaatgcctaaggtca

SEQ ID NO: 168150 - DNA, 20 bp, Artificial
  CRISPR gRNA sequence
catgaatgcctaaggtcatc

SEQ ID NO: 168151 - DNA, 20 bp, Artificial
  CRISPR gRNA sequence
aggtcatctcagtactagta

SEQ ID NO: 168152 - DNA, 20 bp, Artificial
  CRISPR gRNA sequence
agtactagtaataacctaca

SEQ ID NO: 168153 - DNA, 20 bp, Artificial
  CRISPR gRNA sequence
gtaataacctacagagtcct

SEQ ID NO: 168154 - DNA, 20 bp, Artificial
  CRISPR gRNA sequence
cagagtcctctgggtttaca

SEQ ID NO: 168155 - DNA, 20 bp, Artificial
  CRISPR gRNA sequence
tgggtttacagcattgctga

SEQ ID NO: 168156 - DNA, 20 bp, Artificial
  CRISPR gRNA sequence
ggtttacagcattgctgaag

SEQ ID NO: 168157 - DNA, 20 bp, Artificial
  CRISPR gRNA sequence
acagcattgctgaagttact

SEQ ID NO: 168158 - DNA, 20 bp, Artificial
  CRISPR gRNA sequence
cagcattgctgaagttactc

SEQ ID NO: 168159 - DNA, 20 bp, Artificial
  CRISPR gRNA sequence
ctgaagttactctccaaaac

SEQ ID NO: 168160 - DNA, 20 bp, Artificial
  CRISPR gRNA sequence
aagttactctccaaaacgaa

SEQ ID NO: 168161 - DNA, 20 bp, Artificial
  CRISPR gRNA sequence
ctctccaaaacgaaagaaaa

SEQ ID NO: 168162 - DNA, 20 bp, Artificial
  CRISPR gRNA sequence
tccaaaacgaaagaaaaacc

SEQ ID NO: 168163 - DNA, 20 bp, Artificial
  CRISPR gRNA sequence
caaaacgaaagaaaaaccaa

SEQ ID NO: 168164 - DNA, 20 bp, Artificial
  CRISPR gRNA sequence
ttaggctcacagtacaaata

SEQ ID NO: 168165 - DNA, 20 bp, Artificial
  CRISPR gRNA sequence
taggctcacagtacaaatat

SEQ ID NO: 168166 - DNA, 20 bp, Artificial
  CRISPR gRNA sequence
aggctcacagtacaaatatt

SEQ ID NO: 168167 - DNA, 20 bp, Artificial
  CRISPR gRNA sequence
ggctcacagtacaaatattt

SEQ ID NO: 168168 - DNA, 20 bp, Artificial
  CRISPR gRNA sequence
acagtacaaatatttgcatg

SEQ ID NO: 168169 - DNA, 20 bp, Artificial
  CRISPR gRNA sequence
gcatgggtcccaaacataaa

SEQ ID NO: 168170 - DNA, 20 bp, Artificial
  CRISPR gRNA sequence
catgggtcccaaacataaat

SEQ ID NO: 168171 - DNA, 20 bp, Artificial
  CRISPR gRNA sequence
tgtgccccaaatgctgcaac

SEQ ID NO: 168172 - DNA, 20 bp, Artificial
  CRISPR gRNA sequence
tgccccaaatgctgcaactt

SEQ ID NO: 168173 - DNA, 20 bp, Artificial
  CRISPR gRNA sequence
caacttttcacagccccttt

SEQ ID NO: 168174 - DNA, 20 bp, Artificial
  CRISPR gRNA sequence
ttcacagcccctttagtgat

SEQ ID NO: 168175 - DNA, 20 bp, Artificial
  CRISPR gRNA sequence
tcacagcccctttagtgata

SEQ ID NO: 168176 - DNA, 20 bp, Artificial
  CRISPR gRNA sequence
cacagcccctttagtgataa

SEQ ID NO: 168177 - DNA, 20 bp, Artificial
  CRISPR gRNA sequence
acagcccctttagtgataag

SEQ ID NO: 168178 - DNA, 20 bp, Artificial
  CRISPR gRNA sequence
tagtgataaggcacatacac

SEQ ID NO: 168179 - DNA, 20 bp, Artificial
  CRISPR gRNA sequence
agtgataaggcacatacact

SEQ ID NO: 168180 - DNA, 20 bp, Artificial
  CRISPR gRNA sequence
gtgataaggcacatacacta

SEQ ID NO: 168181 - DNA, 20 bp, Artificial
  CRISPR gRNA sequence
cagaaaaaatcaaaagcaac

SEQ ID NO: 168182 - DNA, 20 bp, Artificial
  CRISPR gRNA sequence
acttcagaaatagccaaagt

SEQ ID NO: 168183 - DNA, 20 bp, Artificial
  CRISPR gRNA sequence
cttcagaaatagccaaagtc

SEQ ID NO: 168184 - DNA, 20 bp, Artificial
  CRISPR gRNA sequence
cagaaatagccaaagtcaag

SEQ ID NO: 168185 - DNA, 20 bp, Artificial
  CRISPR gRNA sequence
agaaatagccaaagtcaagt

SEQ ID NO: 168186 - DNA, 20 bp, Artificial
  CRISPR gRNA sequence
gggcaggtgaatttggaggg

SEQ ID NO: 168187 - DNA, 20 bp, Artificial
  CRISPR gRNA sequence
ggaggggaacattaaatgga

SEQ ID NO: 168188 - DNA, 20 bp, Artificial
  CRISPR gRNA sequence
gaggggaacattaaatggaa

SEQ ID NO: 168189 - DNA, 20 bp, Artificial
  CRISPR gRNA sequence
aatggaaagggtcagtatga

SEQ ID NO: 168190 - DNA, 20 bp, Artificial
  CRISPR gRNA sequence
atttagttcagggtcatgtg

SEQ ID NO: 168191 - DNA, 20 bp, Artificial
  CRISPR gRNA sequence
tttagttcagggtcatgtgc

SEQ ID NO: 168192 - DNA, 20 bp, Artificial
  CRISPR gRNA sequence
agttcagggtcatgtgctct

SEQ ID NO: 168193 - DNA, 20 bp, Artificial
  CRISPR gRNA sequence
gttcagggtcatgtgctctt

SEQ ID NO: 168194 - DNA, 20 bp, Artificial
  CRISPR gRNA sequence
agggtcatgtgctctttctt

SEQ ID NO: 168195 - DNA, 20 bp, Artificial
  CRISPR gRNA sequence
tttcttaggcatgtaagaca

SEQ ID NO: 168196 - DNA, 20 bp, Artificial
  CRISPR gRNA sequence
tcttaggcatgtaagacact

SEQ ID NO: 168197 - DNA, 20 bp, Artificial
  CRISPR gRNA sequence
cttaggcatgtaagacactg

SEQ ID NO: 168198 - DNA, 20 bp, Artificial
  CRISPR gRNA sequence
ttaggcatgtaagacactga

SEQ ID NO: 168199 - DNA, 20 bp, Artificial
  CRISPR gRNA sequence
aggcatgtaagacactgaga

SEQ ID NO: 168200 - DNA, 20 bp, Artificial
  CRISPR gRNA sequence
ggcatgtaagacactgagag

SEQ ID NO: 168201 - DNA, 20 bp, Artificial
  CRISPR gRNA sequence
agagaaaaataaagcacagg

SEQ ID NO: 168202 - DNA, 20 bp, Artificial
  CRISPR gRNA sequence
caaggcgggccctagtgcac

SEQ ID NO: 168203 - DNA, 20 bp, Artificial
  CRISPR gRNA sequence
gtgcacgctggctctcaccc

SEQ ID NO: 168204 - DNA, 20 bp, Artificial
  CRISPR gRNA sequence
gctctcaccccattcaagct

SEQ ID NO: 168205 - DNA, 20 bp, Artificial
  CRISPR gRNA sequence
tcaccccattcaagctgcag

SEQ ID NO: 168206 - DNA, 20 bp, Artificial
  CRISPR gRNA sequence
accccattcaagctgcagag

SEQ ID NO: 168207 - DNA, 20 bp, Artificial
  CRISPR gRNA sequence
aagctgcagagcaattcctg

SEQ ID NO: 168208 - DNA, 20 bp, Artificial
  CRISPR gRNA sequence
cagagcaattcctgcccaca

SEQ ID NO: 168209 - DNA, 20 bp, Artificial
  CRISPR gRNA sequence
ctgcccacactggccagatg

SEQ ID NO: 168210 - DNA, 20 bp, Artificial
  CRISPR gRNA sequence
cccacactggccagatggct

SEQ ID NO: 168211 - DNA, 20 bp, Artificial
  CRISPR gRNA sequence
gccagatggctgctctggac

SEQ ID NO: 168212 - DNA, 20 bp, Artificial
  CRISPR gRNA sequence
ctctggaccacagtatggct

SEQ ID NO: 168213 - DNA, 20 bp, Artificial
  CRISPR gRNA sequence
tggaccacagtatggcttcc

SEQ ID NO: 168214 - DNA, 20 bp, Artificial
  CRISPR gRNA sequence
gaccacagtatggcttccca

SEQ ID NO: 168215 - DNA, 20 bp, Artificial
  CRISPR gRNA sequence
cccaaaggagagcaaacact

SEQ ID NO: 168216 - DNA, 20 bp, Artificial
  CRISPR gRNA sequence
ccaaaggagagcaaacactg

SEQ ID NO: 168217 - DNA, 20 bp, Artificial
  CRISPR gRNA sequence
ctaactcactgggcactgtt

SEQ ID NO: 168218 - DNA, 20 bp, Artificial
  CRISPR gRNA sequence
actcactgggcactgttaag

SEQ ID NO: 168219 - DNA, 20 bp, Artificial
  CRISPR gRNA sequence
actgggcactgttaagacac

SEQ ID NO: 168220 - DNA, 20 bp, Artificial
  CRISPR gRNA sequence
ggcactgttaagacacagac

SEQ ID NO: 168221 - DNA, 20 bp, Artificial
  CRISPR gRNA sequence
ttaagacacagactcttaac

SEQ ID NO: 168222 - DNA, 20 bp, Artificial
  CRISPR gRNA sequence
agacacagactcttaactaa

SEQ ID NO: 168223 - DNA, 20 bp, Artificial
  CRISPR gRNA sequence
ttaactaagtctacccctaa

SEQ ID NO: 168224 - DNA, 20 bp, Artificial
  CRISPR gRNA sequence
aactaagtctacccctaatt

SEQ ID NO: 168225 - DNA, 20 bp, Artificial
  CRISPR gRNA sequence
actaagtctacccctaatta

SEQ ID NO: 168226 - DNA, 20 bp, Artificial
  CRISPR gRNA sequence
agtctacccctaattaatag

SEQ ID NO: 168227 - DNA, 20 bp, Artificial
  CRISPR gRNA sequence
cccctaattaatagaattta

SEQ ID NO: 168228 - DNA, 20 bp, Artificial
  CRISPR gRNA sequence
attaatagaatttaagaaag

SEQ ID NO: 168229 - DNA, 20 bp, Artificial
  CRISPR gRNA sequence
atagaatttaagaaagcaag

SEQ ID NO: 168230 - DNA, 20 bp, Artificial
  CRISPR gRNA sequence
aagaaagcaagaactctaac

SEQ ID NO: 168231 - DNA, 20 bp, Artificial
  CRISPR gRNA sequence
agaaagcaagaactctaact

SEQ ID NO: 168232 - DNA, 20 bp, Artificial
  CRISPR gRNA sequence
taactttctaaaaatagcaa

SEQ ID NO: 168233 - DNA, 20 bp, Artificial
  CRISPR gRNA sequence
actttctaaaaatagcaatc

SEQ ID NO: 168234 - DNA, 20 bp, Artificial
  CRISPR gRNA sequence
tctaaaaatagcaatctcag

SEQ ID NO: 168235 - DNA, 20 bp, Artificial
  CRISPR gRNA sequence
ctaaaaatagcaatctcaga

SEQ ID NO: 168236 - DNA, 20 bp, Artificial
  CRISPR gRNA sequence
taaaaatagcaatctcagat

SEQ ID NO: 168237 - DNA, 20 bp, Artificial
  CRISPR gRNA sequence
aaaatagcaatctcagattt

SEQ ID NO: 168238 - DNA, 20 bp, Artificial
  CRISPR gRNA sequence
agatttaagaaatttctgcc

SEQ ID NO: 168239 - DNA, 20 bp, Artificial
  CRISPR gRNA sequence
aagaaatttctgcccaatgt

SEQ ID NO: 168240 - DNA, 20 bp, Artificial
  CRISPR gRNA sequence
agaaatttctgcccaatgtg

SEQ ID NO: 168241 - DNA, 20 bp, Artificial
  CRISPR gRNA sequence
ctgcccaatgtgtatgactt

SEQ ID NO: 168242 - DNA, 20 bp, Artificial
  CRISPR gRNA sequence
tgcccaatgtgtatgacttg

SEQ ID NO: 168243 - DNA, 20 bp, Artificial
  CRISPR gRNA sequence
cccaatgtgtatgacttggc

SEQ ID NO: 168244 - DNA, 20 bp, Artificial
  CRISPR gRNA sequence
ggcagattctgtctctcaca

SEQ ID NO: 168245 - DNA, 20 bp, Artificial
  CRISPR gRNA sequence
gcagattctgtctctcacac

SEQ ID NO: 168246 - DNA, 20 bp, Artificial
  CRISPR gRNA sequence
tgtctctcacacacaatggt

SEQ ID NO: 168247 - DNA, 20 bp, Artificial
  CRISPR gRNA sequence
tctctcacacacaatggttg

SEQ ID NO: 168248 - DNA, 20 bp, Artificial
  CRISPR gRNA sequence
tcacacacaatggttgtagt

SEQ ID NO: 168249 - DNA, 20 bp, Artificial
  CRISPR gRNA sequence
acacacaatggttgtagtcc

SEQ ID NO: 168250 - DNA, 20 bp, Artificial
  CRISPR gRNA sequence
tagtcctatgaaatgtactc

SEQ ID NO: 168251 - DNA, 20 bp, Artificial
  CRISPR gRNA sequence
tgaaatgtactcttttgaga

SEQ ID NO: 168252 - DNA, 20 bp, Artificial
  CRISPR gRNA sequence
ttttgagacggtaaagacac

SEQ ID NO: 168253 - DNA, 20 bp, Artificial
  CRISPR gRNA sequence
ttgagacggtaaagacacaa

SEQ ID NO: 168254 - DNA, 20 bp, Artificial
  CRISPR gRNA sequence
tgagacggtaaagacacaag

SEQ ID NO: 168255 - DNA, 20 bp, Artificial
  CRISPR gRNA sequence
gagacggtaaagacacaagc

SEQ ID NO: 168256 - DNA, 20 bp, Artificial
  CRISPR gRNA sequence
agacggtaaagacacaagct

SEQ ID NO: 168257 - DNA, 20 bp, Artificial
  CRISPR gRNA sequence
ccaaaagggtcaattattct

SEQ ID NO: 168258 - DNA, 20 bp, Artificial
  CRISPR gRNA sequence
ttctttcaaatctcaaacct

SEQ ID NO: 168259 - DNA, 20 bp, Artificial
  CRISPR gRNA sequence
tttcaaatctcaaaccttta

SEQ ID NO: 168260 - DNA, 20 bp, Artificial
  CRISPR gRNA sequence
tcaaatctcaaacctttagt

SEQ ID NO: 168261 - DNA, 20 bp, Artificial
  CRISPR gRNA sequence
caaatctcaaacctttagta

SEQ ID NO: 168262 - DNA, 20 bp, Artificial
  CRISPR gRNA sequence
aaatctcaaacctttagtac

SEQ ID NO: 168263 - DNA, 20 bp, Artificial
  CRISPR gRNA sequence
aaacctttagtactgtttgt

SEQ ID NO: 168264 - DNA, 20 bp, Artificial
  CRISPR gRNA sequence
tagtactgtttgtgactttt

SEQ ID NO: 168265 - DNA, 20 bp, Artificial
  CRISPR gRNA sequence
agtactgtttgtgactttta

SEQ ID NO: 168266 - DNA, 20 bp, Artificial
  CRISPR gRNA sequence
gtactgtttgtgacttttac

SEQ ID NO: 168267 - DNA, 20 bp, Artificial
  CRISPR gRNA sequence
tttgtgacttttacaggtta

SEQ ID NO: 168268 - DNA, 20 bp, Artificial
  CRISPR gRNA sequence
gtgacttttacaggttacct

SEQ ID NO: 168269 - DNA, 20 bp, Artificial
  CRISPR gRNA sequence
tgacttttacaggttaccta

SEQ ID NO: 168270 - DNA, 20 bp, Artificial
  CRISPR gRNA sequence
ttacaggttacctagagcag

SEQ ID NO: 168271 - DNA, 20 bp, Artificial
  CRISPR gRNA sequence
tacaggttacctagagcagt

SEQ ID NO: 168272 - DNA, 20 bp, Artificial
  CRISPR gRNA sequence
acaggttacctagagcagtg

SEQ ID NO: 168273 - DNA, 20 bp, Artificial
  CRISPR gRNA sequence
caggttacctagagcagtga

SEQ ID NO: 168274 - DNA, 20 bp, Artificial
  CRISPR gRNA sequence
cctagagcagtgagcctatc

SEQ ID NO: 168275 - DNA, 20 bp, Artificial
  CRISPR gRNA sequence
gagcagtgagcctatctggg

SEQ ID NO: 168276 - DNA, 20 bp, Artificial
  CRISPR gRNA sequence
tctgggctcatctggtggtg

SEQ ID NO: 168277 - DNA, 20 bp, Artificial
  CRISPR gRNA sequence
ggctcatctggtggtggtag

SEQ ID NO: 168278 - DNA, 20 bp, Artificial
  CRISPR gRNA sequence
atctggtggtggtagtgatg

SEQ ID NO: 168279 - DNA, 20 bp, Artificial
  CRISPR gRNA sequence
gtggtggtagtgatgggggg

SEQ ID NO: 168280 - DNA, 20 bp, Artificial
  CRISPR gRNA sequence
ttaaactacacctgtacacc

SEQ ID NO: 168281 - DNA, 20 bp, Artificial
  CRISPR gRNA sequence
taaactacacctgtacaccc

SEQ ID NO: 168282 - DNA, 20 bp, Artificial
  CRISPR gRNA sequence
aaactacacctgtacaccca

SEQ ID NO: 168283 - DNA, 20 bp, Artificial
  CRISPR gRNA sequence
aactacacctgtacacccaa

SEQ ID NO: 168284 - DNA, 20 bp, Artificial
  CRISPR gRNA sequence
cacctgtacacccaatccct

SEQ ID NO: 168285 - DNA, 20 bp, Artificial
  CRISPR gRNA sequence
tacacccaatccctgacttg

SEQ ID NO: 168286 - DNA, 20 bp, Artificial
  CRISPR gRNA sequence
acttgaattccatcactatc

SEQ ID NO: 168287 - DNA, 20 bp, Artificial
  CRISPR gRNA sequence
gaattccatcactatctctc

SEQ ID NO: 168288 - DNA, 20 bp, Artificial
  CRISPR gRNA sequence
aattccatcactatctctcc

SEQ ID NO: 168289 - DNA, 20 bp, Artificial
  CRISPR gRNA sequence
catcactatctctcctcact

SEQ ID NO: 168290 - DNA, 20 bp, Artificial
  CRISPR gRNA sequence
tctctcctcactttgaatta

SEQ ID NO: 168291 - DNA, 20 bp, Artificial
  CRISPR gRNA sequence
tcctcactttgaattaatca

SEQ ID NO: 168292 - DNA, 20 bp, Artificial
  CRISPR gRNA sequence
ctcactttgaattaatcacc

SEQ ID NO: 168293 - DNA, 20 bp, Artificial
  CRISPR gRNA sequence
actttgaattaatcacctca

SEQ ID NO: 168294 - DNA, 20 bp, Artificial
  CRISPR gRNA sequence
tgaattaatcacctcaataa

SEQ ID NO: 168295 - DNA, 20 bp, Artificial
  CRISPR gRNA sequence
gaattaatcacctcaataag

SEQ ID NO: 168296 - DNA, 20 bp, Artificial
  CRISPR gRNA sequence
aattaatcacctcaataaga

SEQ ID NO: 168297 - DNA, 20 bp, Artificial
  CRISPR gRNA sequence
atcacctcaataagaagact

SEQ ID NO: 168298 - DNA, 20 bp, Artificial
  CRISPR gRNA sequence
aataagaagactatggaact

SEQ ID NO: 168299 - DNA, 20 bp, Artificial
  CRISPR gRNA sequence
tggaactctcaatgaatcat

SEQ ID NO: 168300 - DNA, 20 bp, Artificial
  CRISPR gRNA sequence
tcaatgaatcataaacttca

SEQ ID NO: 168301 - DNA, 20 bp, Artificial
  CRISPR gRNA sequence
aatgaatcataaacttcaac

SEQ ID NO: 168302 - DNA, 20 bp, Artificial
  CRISPR gRNA sequence
caaccgatgttgctattctg

SEQ ID NO: 168303 - DNA, 20 bp, Artificial
  CRISPR gRNA sequence
aaccgatgttgctattctga

SEQ ID NO: 168304 - DNA, 20 bp, Artificial
  CRISPR gRNA sequence
ctattctgatgttcttaatt

SEQ ID NO: 168305 - DNA, 20 bp, Artificial
  CRISPR gRNA sequence
ttctgatgttcttaattctg

SEQ ID NO: 168306 - DNA, 20 bp, Artificial
  CRISPR gRNA sequence
tgatgttcttaattctgact

SEQ ID NO: 168307 - DNA, 20 bp, Artificial
  CRISPR gRNA sequence
atgttcttaattctgactgc

SEQ ID NO: 168308 - DNA, 20 bp, Artificial
  CRISPR gRNA sequence
ttaattctgactgcataggt

SEQ ID NO: 168309 - DNA, 20 bp, Artificial
  CRISPR gRNA sequence
aattctgactgcataggtta

SEQ ID NO: 168310 - DNA, 20 bp, Artificial
  CRISPR gRNA sequence
attctgactgcataggttac

SEQ ID NO: 168311 - DNA, 20 bp, Artificial
  CRISPR gRNA sequence
tgactgcataggttactgaa

SEQ ID NO: 168312 - DNA, 20 bp, Artificial
  CRISPR gRNA sequence
actgcataggttactgaaaa

SEQ ID NO: 168313 - DNA, 20 bp, Artificial
  CRISPR gRNA sequence
cataggttactgaaaattac

SEQ ID NO: 168314 - DNA, 20 bp, Artificial
  CRISPR gRNA sequence
ctgaaaattacaactatgca

SEQ ID NO: 168315 - DNA, 20 bp, Artificial
  CRISPR gRNA sequence
aaaattacaactatgcatcc

SEQ ID NO: 168316 - DNA, 20 bp, Artificial
  CRISPR gRNA sequence
caactatgcatccaaagtta

SEQ ID NO: 168317 - DNA, 20 bp, Artificial
  CRISPR gRNA sequence
tgcatccaaagttacaaggg

SEQ ID NO: 168318 - DNA, 20 bp, Artificial
  CRISPR gRNA sequence
caagggaaggggatgtgttc

SEQ ID NO: 168319 - DNA, 20 bp, Artificial
  CRISPR gRNA sequence
tgggaacgacagatgagatt

SEQ ID NO: 168320 - DNA, 20 bp, Artificial
  CRISPR gRNA sequence
ggaacgacagatgagattca

SEQ ID NO: 168321 - DNA, 20 bp, Artificial
  CRISPR gRNA sequence
aagggattactacggagaaa

SEQ ID NO: 168322 - DNA, 20 bp, Artificial
  CRISPR gRNA sequence
ctacggagaaattactataa

SEQ ID NO: 168323 - DNA, 20 bp, Artificial
  CRISPR gRNA sequence
cggagaaattactataaact

SEQ ID NO: 168324 - DNA, 20 bp, Artificial
  CRISPR gRNA sequence
ctataaactggaggagggcc

SEQ ID NO: 168325 - DNA, 20 bp, Artificial
  CRISPR gRNA sequence
taaactggaggagggccaaa

SEQ ID NO: 168326 - DNA, 20 bp, Artificial
  CRISPR gRNA sequence
gaggagggccaaaaagaaag

SEQ ID NO: 168327 - DNA, 20 bp, Artificial
  CRISPR gRNA sequence
taaaagtacatgcagtgggc

SEQ ID NO: 168328 - DNA, 20 bp, Artificial
  CRISPR gRNA sequence
aaagtacatgcagtgggcta

SEQ ID NO: 168329 - DNA, 20 bp, Artificial
  CRISPR gRNA sequence
ggctaacagaaaacatttct

SEQ ID NO: 168330 - DNA, 20 bp, Artificial
  CRISPR gRNA sequence
acagaaaacatttcttccat

SEQ ID NO: 168331 - DNA, 20 bp, Artificial
  CRISPR gRNA sequence
cttccattcttgtaccacaa

SEQ ID NO: 168332 - DNA, 20 bp, Artificial
  CRISPR gRNA sequence
ttccattcttgtaccacaat

SEQ ID NO: 168333 - DNA, 20 bp, Artificial
  CRISPR gRNA sequence
ccattcttgtaccacaattt

SEQ ID NO: 168334 - DNA, 20 bp, Artificial
  CRISPR gRNA sequence
cattcttgtaccacaatttt

SEQ ID NO: 168335 - DNA, 20 bp, Artificial
  CRISPR gRNA sequence
ttgtaccacaattttcaact

SEQ ID NO: 168336 - DNA, 20 bp, Artificial
  CRISPR gRNA sequence
gtaccacaattttcaactca

SEQ ID NO: 168337 - DNA, 20 bp, Artificial
  CRISPR gRNA sequence
taccacaattttcaactcag

SEQ ID NO: 168338 - DNA, 20 bp, Artificial
  CRISPR gRNA sequence
tcaactcagcctattcccaa

SEQ ID NO: 168339 - DNA, 20 bp, Artificial
  CRISPR gRNA sequence
caactcagcctattcccaac

SEQ ID NO: 168340 - DNA, 20 bp, Artificial
  CRISPR gRNA sequence
aactcagcctattcccaacc

SEQ ID NO: 168341 - DNA, 20 bp, Artificial
  CRISPR gRNA sequence
agcctattcccaacctccag

SEQ ID NO: 168342 - DNA, 20 bp, Artificial
  CRISPR gRNA sequence
ttcccaacctccagaaataa

SEQ ID NO: 168343 - DNA, 20 bp, Artificial
  CRISPR gRNA sequence
ccaacctccagaaataagtt

SEQ ID NO: 168344 - DNA, 20 bp, Artificial
  CRISPR gRNA sequence
cagaaataagttttcaattt

SEQ ID NO: 168345 - DNA, 20 bp, Artificial
  CRISPR gRNA sequence
tcaatttatgacagaaaaca

SEQ ID NO: 168346 - DNA, 20 bp, Artificial
  CRISPR gRNA sequence
caatttatgacagaaaacac

SEQ ID NO: 168347 - DNA, 20 bp, Artificial
  CRISPR gRNA sequence
aatttatgacagaaaacaca

SEQ ID NO: 168348 - DNA, 20 bp, Artificial
  CRISPR gRNA sequence
atgacagaaaacacaggatt

SEQ ID NO: 168349 - DNA, 20 bp, Artificial
  CRISPR gRNA sequence
tgacagaaaacacaggatta

SEQ ID NO: 168350 - DNA, 20 bp, Artificial
  CRISPR gRNA sequence
attttaccaaaatatgcatt

SEQ ID NO: 168351 - DNA, 20 bp, Artificial
  CRISPR gRNA sequence
taccaaaatatgcattcttt

SEQ ID NO: 168352 - DNA, 20 bp, Artificial
  CRISPR gRNA sequence
accaaaatatgcattctttc

SEQ ID NO: 168353 - DNA, 20 bp, Artificial
  CRISPR gRNA sequence
ccaaaatatgcattctttcc

SEQ ID NO: 168354 - DNA, 20 bp, Artificial
  CRISPR gRNA sequence
tttccaactctgctttaata

SEQ ID NO: 168355 - DNA, 20 bp, Artificial
  CRISPR gRNA sequence
tccaactctgctttaataca

SEQ ID NO: 168356 - DNA, 20 bp, Artificial
  CRISPR gRNA sequence
ccaactctgctttaatacat

SEQ ID NO: 168357 - DNA, 20 bp, Artificial
  CRISPR gRNA sequence
caactctgctttaatacata

SEQ ID NO: 168358 - DNA, 20 bp, Artificial
  CRISPR gRNA sequence
tgctttaatacatatgtatt

SEQ ID NO: 168359 - DNA, 20 bp, Artificial
  CRISPR gRNA sequence
ctttaatacatatgtattct

SEQ ID NO: 168360 - DNA, 20 bp, Artificial
  CRISPR gRNA sequence
taatacatatgtattctgtc

SEQ ID NO: 168361 - DNA, 20 bp, Artificial
  CRISPR gRNA sequence
aatacatatgtattctgtcc

SEQ ID NO: 168362 - DNA, 20 bp, Artificial
  CRISPR gRNA sequence
atacatatgtattctgtcct

SEQ ID NO: 168363 - DNA, 20 bp, Artificial
  CRISPR gRNA sequence
tgtcctacgaaggatatttg

SEQ ID NO: 168364 - DNA, 20 bp, Artificial
  CRISPR gRNA sequence
tcctacgaaggatatttgca

SEQ ID NO: 168365 - DNA, 20 bp, Artificial
  CRISPR gRNA sequence
cgaaggatatttgcactcaa

SEQ ID NO: 168366 - DNA, 20 bp, Artificial
  CRISPR gRNA sequence
gcactcaacttgaaatagcc

SEQ ID NO: 168367 - DNA, 20 bp, Artificial
  CRISPR gRNA sequence
cactcaacttgaaatagcca

SEQ ID NO: 168368 - DNA, 20 bp, Artificial
  CRISPR gRNA sequence
aacttgaaatagccatcact

SEQ ID NO: 168369 - DNA, 20 bp, Artificial
  CRISPR gRNA sequence
gaaatagccatcactacggg

SEQ ID NO: 168370 - DNA, 20 bp, Artificial
  CRISPR gRNA sequence
aaatagccatcactacgggt

SEQ ID NO: 168371 - DNA, 20 bp, Artificial
  CRISPR gRNA sequence
cgggtccagggaggtgtgac

SEQ ID NO: 168372 - DNA, 20 bp, Artificial
  CRISPR gRNA sequence
aagcagcaggatggtgaaac

SEQ ID NO: 168373 - DNA, 20 bp, Artificial
  CRISPR gRNA sequence
ggaaggaccaacttcaccat

SEQ ID NO: 168374 - DNA, 20 bp, Artificial
  CRISPR gRNA sequence
caccatcctcacaagcctta

SEQ ID NO: 168375 - DNA, 20 bp, Artificial
  CRISPR gRNA sequence
accatcctcacaagccttat

SEQ ID NO: 168376 - DNA, 20 bp, Artificial
  CRISPR gRNA sequence
acaagccttatcagctccaa

SEQ ID NO: 168377 - DNA, 20 bp, Artificial
  CRISPR gRNA sequence
atcagctccaagctgagcac

SEQ ID NO: 168378 - DNA, 20 bp, Artificial
  CRISPR gRNA sequence
tcagctccaagctgagcacg

SEQ ID NO: 168379 - DNA, 20 bp, Artificial
  CRISPR gRNA sequence
caagctgagcacgtctgggt

SEQ ID NO: 168380 - DNA, 20 bp, Artificial
  CRISPR gRNA sequence
agcacgtctgggttggcaga

SEQ ID NO: 168381 - DNA, 20 bp, Artificial
  CRISPR gRNA sequence
ggttggcagagaggagcaca

SEQ ID NO: 168382 - DNA, 20 bp, Artificial
  CRISPR gRNA sequence
gcagagaggagcacagatga

SEQ ID NO: 168383 - DNA, 20 bp, Artificial
  CRISPR gRNA sequence
tcgctgactaaaaagaaatg

SEQ ID NO: 168384 - DNA, 20 bp, Artificial
  CRISPR gRNA sequence
gctgactaaaaagaaatgca

SEQ ID NO: 168385 - DNA, 20 bp, Artificial
  CRISPR gRNA sequence
actaaaaagaaatgcatgct

SEQ ID NO: 168386 - DNA, 20 bp, Artificial
  CRISPR gRNA sequence
aaaagaaatgcatgctgcca

SEQ ID NO: 168387 - DNA, 20 bp, Artificial
  CRISPR gRNA sequence
ccaactcatcactgtactgt

SEQ ID NO: 168388 - DNA, 20 bp, Artificial
  CRISPR gRNA sequence
atcactgtactgtatcaacc

SEQ ID NO: 168389 - DNA, 20 bp, Artificial
  CRISPR gRNA sequence
tactgtatcaacccaatttt

SEQ ID NO: 168390 - DNA, 20 bp, Artificial
  CRISPR gRNA sequence
tatcaacccaattttcccga

SEQ ID NO: 168391 - DNA, 20 bp, Artificial
  CRISPR gRNA sequence
tcccgagaggatttccaagg

SEQ ID NO: 168392 - DNA, 20 bp, Artificial
  CRISPR gRNA sequence
cccgagaggatttccaaggt

SEQ ID NO: 168393 - DNA, 20 bp, Artificial
  CRISPR gRNA sequence
ccgagaggatttccaaggta

SEQ ID NO: 168394 - DNA, 20 bp, Artificial
  CRISPR gRNA sequence
ccaaggtatttctaaatcat

SEQ ID NO: 168395 - DNA, 20 bp, Artificial
  CRISPR gRNA sequence
caaggtatttctaaatcatt

SEQ ID NO: 168396 - DNA, 20 bp, Artificial
  CRISPR gRNA sequence
ctaaatcatttcaggaaaat

SEQ ID NO: 168397 - DNA, 20 bp, Artificial
  CRISPR gRNA sequence
taaatcatttcaggaaaatg

SEQ ID NO: 168398 - DNA, 20 bp, Artificial
  CRISPR gRNA sequence
aatcatttcaggaaaatgag

SEQ ID NO: 168399 - DNA, 20 bp, Artificial
  CRISPR gRNA sequence
caggaaaatgagggcttgtg

SEQ ID NO: 168400 - DNA, 20 bp, Artificial
  CRISPR gRNA sequence
aggaaaatgagggcttgtgt

SEQ ID NO: 168401 - DNA, 20 bp, Artificial
  CRISPR gRNA sequence
gtgttagcatggcagctgtc

SEQ ID NO: 168402 - DNA, 20 bp, Artificial
  CRISPR gRNA sequence
tgttagcatggcagctgtca

SEQ ID NO: 168403 - DNA, 20 bp, Artificial
  CRISPR gRNA sequence
gcatggcagctgtcaaatca

SEQ ID NO: 168404 - DNA, 20 bp, Artificial
  CRISPR gRNA sequence
tcaaatcatgtatggtgtgc

SEQ ID NO: 168405 - DNA, 20 bp, Artificial
  CRISPR gRNA sequence
ctgtcagggcacaacagcca

SEQ ID NO: 168406 - DNA, 20 bp, Artificial
  CRISPR gRNA sequence
tcagggcacaacagccatga

SEQ ID NO: 168407 - DNA, 20 bp, Artificial
  CRISPR gRNA sequence
cttaggatgatcagccaatc

SEQ ID NO: 168408 - DNA, 20 bp, Artificial
  CRISPR gRNA sequence
ttaggatgatcagccaatca

SEQ ID NO: 168409 - DNA, 20 bp, Artificial
  CRISPR gRNA sequence
aggatgatcagccaatcaga

SEQ ID NO: 168410 - DNA, 20 bp, Artificial
  CRISPR gRNA sequence
ggatgatcagccaatcagag

SEQ ID NO: 168411 - DNA, 20 bp, Artificial
  CRISPR gRNA sequence
cccttggcagactccctcta

SEQ ID NO: 168412 - DNA, 20 bp, Artificial
  CRISPR gRNA sequence
ggcagactccctctaagttc

SEQ ID NO: 168413 - DNA, 20 bp, Artificial
  CRISPR gRNA sequence
gcagactccctctaagttca

SEQ ID NO: 168414 - DNA, 20 bp, Artificial
  CRISPR gRNA sequence
cctctaagttcattctgtaa

SEQ ID NO: 168415 - DNA, 20 bp, Artificial
  CRISPR gRNA sequence
taagttcattctgtaaaggg

SEQ ID NO: 168416 - DNA, 20 bp, Artificial
  CRISPR gRNA sequence
agttcattctgtaaagggat

SEQ ID NO: 168417 - DNA, 20 bp, Artificial
  CRISPR gRNA sequence
attctgtaaagggataaagc

SEQ ID NO: 168418 - DNA, 20 bp, Artificial
  CRISPR gRNA sequence
tgtaaagggataaagccttt

SEQ ID NO: 168419 - DNA, 20 bp, Artificial
  CRISPR gRNA sequence
taaagggataaagcctttgg

SEQ ID NO: 168420 - DNA, 20 bp, Artificial
  CRISPR gRNA sequence
tggcaggtaaagttttcacc

SEQ ID NO: 168421 - DNA, 20 bp, Artificial
  CRISPR gRNA sequence
ggcaggtaaagttttcacca

SEQ ID NO: 168422 - DNA, 20 bp, Artificial
  CRISPR gRNA sequence
gcaggtaaagttttcaccac

SEQ ID NO: 168423 - DNA, 20 bp, Artificial
  CRISPR gRNA sequence
tcaccactgcagaggcacaa

SEQ ID NO: 168424 - DNA, 20 bp, Artificial
  CRISPR gRNA sequence
caccactgcagaggcacaag

SEQ ID NO: 168425 - DNA, 20 bp, Artificial
  CRISPR gRNA sequence
accactgcagaggcacaagc

SEQ ID NO: 168426 - DNA, 20 bp, Artificial
  CRISPR gRNA sequence
cagaggcacaagcattagcc

SEQ ID NO: 168427 - DNA, 20 bp, Artificial
  CRISPR gRNA sequence
gccaaagaaggtcccttagg

SEQ ID NO: 168428 - DNA, 20 bp, Artificial
  CRISPR gRNA sequence
aggcatcatgatacagtcga

SEQ ID NO: 168429 - DNA, 20 bp, Artificial
  CRISPR gRNA sequence
ggcatcatgatacagtcgag

SEQ ID NO: 168430 - DNA, 20 bp, Artificial
  CRISPR gRNA sequence
gagccagtgactgagcagcc

SEQ ID NO: 168431 - DNA, 20 bp, Artificial
  CRISPR gRNA sequence
agccagtgactgagcagcca

SEQ ID NO: 168432 - DNA, 20 bp, Artificial
  CRISPR gRNA sequence
agcagccattatctttgaac

SEQ ID NO: 168433 - DNA, 20 bp, Artificial
  CRISPR gRNA sequence
tctttgaaccctcctgccta

SEQ ID NO: 168434 - DNA, 20 bp, Artificial
  CRISPR gRNA sequence
tgaaccctcctgcctagcac

SEQ ID NO: 168435 - DNA, 20 bp, Artificial
  CRISPR gRNA sequence
gaaccctcctgcctagcaca

SEQ ID NO: 168436 - DNA, 20 bp, Artificial
  CRISPR gRNA sequence
aaccctcctgcctagcacag

SEQ ID NO: 168437 - DNA, 20 bp, Artificial
  CRISPR gRNA sequence
ctgcctagcacagtgtctgg

SEQ ID NO: 168438 - DNA, 20 bp, Artificial
  CRISPR gRNA sequence
cctagcacagtgtctggcat

SEQ ID NO: 168439 - DNA, 20 bp, Artificial
  CRISPR gRNA sequence
gcacagtgtctggcatagaa

SEQ ID NO: 168440 - DNA, 20 bp, Artificial
  CRISPR gRNA sequence
gcatagaacaagcactcaat

SEQ ID NO: 168441 - DNA, 20 bp, Artificial
  CRISPR gRNA sequence
aatacatttttgttatatgg

SEQ ID NO: 168442 - DNA, 20 bp, Artificial
  CRISPR gRNA sequence
ttgttatatggataagtaaa

SEQ ID NO: 168443 - DNA, 20 bp, Artificial
  CRISPR gRNA sequence
tgttatatggataagtaaaa

SEQ ID NO: 168444 - DNA, 20 bp, Artificial
  CRISPR gRNA sequence
gttatatggataagtaaaat

SEQ ID NO: 168445 - DNA, 20 bp, Artificial
  CRISPR gRNA sequence
ttatatggataagtaaaatg

SEQ ID NO: 168446 - DNA, 20 bp, Artificial
  CRISPR gRNA sequence
tatggataagtaaaatgagc

SEQ ID NO: 168447 - DNA, 20 bp, Artificial
  CRISPR gRNA sequence
aaatcataattacctttttt

SEQ ID NO: 168448 - DNA, 20 bp, Artificial
  CRISPR gRNA sequence
cctttttttttttttgagac

SEQ ID NO: 168449 - DNA, 20 bp, Artificial
  CRISPR gRNA sequence
tttttttttttgagacagtc

SEQ ID NO: 168450 - DNA, 20 bp, Artificial
  CRISPR gRNA sequence
ttttttttttgagacagtct

SEQ ID NO: 168451 - DNA, 20 bp, Artificial
  CRISPR gRNA sequence
tttttttttgagacagtctc

SEQ ID NO: 168452 - DNA, 20 bp, Artificial
  CRISPR gRNA sequence
ttttttttgagacagtctcg

SEQ ID NO: 168453 - DNA, 20 bp, Artificial
  CRISPR gRNA sequence
tttttttgagacagtctcgc

SEQ ID NO: 168454 - DNA, 20 bp, Artificial
  CRISPR gRNA sequence
ttttttgagacagtctcgct

SEQ ID NO: 168455 - DNA, 20 bp, Artificial
  CRISPR gRNA sequence
tttttgagacagtctcgctc

SEQ ID NO: 168456 - DNA, 20 bp, Artificial
  CRISPR gRNA sequence
ttttgagacagtctcgctct

SEQ ID NO: 168457 - DNA, 20 bp, Artificial
  CRISPR gRNA sequence
tttgagacagtctcgctctg

SEQ ID NO: 168458 - DNA, 20 bp, Artificial
  CRISPR gRNA sequence
ttgagacagtctcgctctgt

SEQ ID NO: 168459 - DNA, 20 bp, Artificial
  CRISPR gRNA sequence
tgagacagtctcgctctgtc

SEQ ID NO: 168460 - DNA, 20 bp, Artificial
  CRISPR gRNA sequence
gagacagtctcgctctgtca

SEQ ID NO: 168461 - DNA, 20 bp, Artificial
  CRISPR gRNA sequence
agacagtctcgctctgtcac

SEQ ID NO: 168462 - DNA, 20 bp, Artificial
  CRISPR gRNA sequence
gctctgtcacccagattgga

SEQ ID NO: 168463 - DNA, 20 bp, Artificial
  CRISPR gRNA sequence
tgtcacccagattggagtgc

SEQ ID NO: 168464 - DNA, 20 bp, Artificial
  CRISPR gRNA sequence
tcacccagattggagtgcag

SEQ ID NO: 168465 - DNA, 20 bp, Artificial
  CRISPR gRNA sequence
gagtgcagtggcacgatctc

SEQ ID NO: 168466 - DNA, 20 bp, Artificial
  CRISPR gRNA sequence
agcttactgcaacatccgcc

SEQ ID NO: 168467 - DNA, 20 bp, Artificial
  CRISPR gRNA sequence
actgcaacatccgcctccca

SEQ ID NO: 168468 - DNA, 20 bp, Artificial
  CRISPR gRNA sequence
ctgcaacatccgcctcccag

SEQ ID NO: 168469 - DNA, 20 bp, Artificial
  CRISPR gRNA sequence
caacatccgcctcccaggtt

SEQ ID NO: 168470 - DNA, 20 bp, Artificial
  CRISPR gRNA sequence
ccaggttcaagagattctcc

SEQ ID NO: 168471 - DNA, 20 bp, Artificial
  CRISPR gRNA sequence
aagagattctcctgcctcag

SEQ ID NO: 168472 - DNA, 20 bp, Artificial
  CRISPR gRNA sequence
tcctgcctcagcctccccgg

SEQ ID NO: 168473 - DNA, 20 bp, Artificial
  CRISPR gRNA sequence
ctgcctcagcctccccgggt

SEQ ID NO: 168474 - DNA, 20 bp, Artificial
  CRISPR gRNA sequence
cctcagcctccccgggtagc

SEQ ID NO: 168475 - DNA, 20 bp, Artificial
  CRISPR gRNA sequence
agcctccccgggtagctggg

SEQ ID NO: 168476 - DNA, 20 bp, Artificial
  CRISPR gRNA sequence
cccgggtagctgggactata

SEQ ID NO: 168477 - DNA, 20 bp, Artificial
  CRISPR gRNA sequence
ggactataggcgcccgccac

SEQ ID NO: 168478 - DNA, 20 bp, Artificial
  CRISPR gRNA sequence
taggcgcccgccaccacgcc

SEQ ID NO: 168479 - DNA, 20 bp, Artificial
  CRISPR gRNA sequence
atttttgtatttttagtaga

SEQ ID NO: 168480 - DNA, 20 bp, Artificial
  CRISPR gRNA sequence
ttgtatttttagtagagatg

SEQ ID NO: 168481 - DNA, 20 bp, Artificial
  CRISPR gRNA sequence
tgtatttttagtagagatgg

SEQ ID NO: 168482 - DNA, 20 bp, Artificial
  CRISPR gRNA sequence
gtatttttagtagagatggg

SEQ ID NO: 168483 - DNA, 20 bp, Artificial
  CRISPR gRNA sequence
tatttttagtagagatgggg

SEQ ID NO: 168484 - DNA, 20 bp, Artificial
  CRISPR gRNA sequence
ttagtagagatggggtttca

SEQ ID NO: 168485 - DNA, 20 bp, Artificial
  CRISPR gRNA sequence
tagtagagatggggtttcac

SEQ ID NO: 168486 - DNA, 20 bp, Artificial
  CRISPR gRNA sequence
agtagagatggggtttcacc

SEQ ID NO: 168487 - DNA, 20 bp, Artificial
  CRISPR gRNA sequence
gtagagatggggtttcacca

SEQ ID NO: 168488 - DNA, 20 bp, Artificial
  CRISPR gRNA sequence
caccatattggccaggctgg

SEQ ID NO: 168489 - DNA, 20 bp, Artificial
  CRISPR gRNA sequence
accatattggccaggctggt

SEQ ID NO: 168490 - DNA, 20 bp, Artificial
  CRISPR gRNA sequence
gccaggctggtcttgaactc

SEQ ID NO: 168491 - DNA, 20 bp, Artificial
  CRISPR gRNA sequence
gtcttgaactcctggctttg

SEQ ID NO: 168492 - DNA, 20 bp, Artificial
  CRISPR gRNA sequence
gaactcctggctttgtgatc

SEQ ID NO: 168493 - DNA, 20 bp, Artificial
  CRISPR gRNA sequence
aactcctggctttgtgatcc

SEQ ID NO: 168494 - DNA, 20 bp, Artificial
  CRISPR gRNA sequence
ctggctttgtgatccgccca

SEQ ID NO: 168495 - DNA, 20 bp, Artificial
  CRISPR gRNA sequence
gctttgtgatccgcccacct

SEQ ID NO: 168496 - DNA, 20 bp, Artificial
  CRISPR gRNA sequence
tgtgatccgcccacctcggc

SEQ ID NO: 168497 - DNA, 20 bp, Artificial
  CRISPR gRNA sequence
gtgatccgcccacctcggcc

SEQ ID NO: 168498 - DNA, 20 bp, Artificial
  CRISPR gRNA sequence
tgatccgcccacctcggcct

SEQ ID NO: 168499 - DNA, 20 bp, Artificial
  CRISPR gRNA sequence
ggcctcccaaagtactggga

SEQ ID NO: 168500 - DNA, 20 bp, Artificial
  CRISPR gRNA sequence
ccaaagtactgggattacag

SEQ ID NO: 168501 - DNA, 20 bp, Artificial
  CRISPR gRNA sequence
ggattacaggtgtgagccac

SEQ ID NO: 168502 - DNA, 20 bp, Artificial
  CRISPR gRNA sequence
caggtgtgagccactacgcc

SEQ ID NO: 168503 - DNA, 20 bp, Artificial
  CRISPR gRNA sequence
cgcccagccataattactta

SEQ ID NO: 168504 - DNA, 20 bp, Artificial
  CRISPR gRNA sequence
cttatttttaattctctgtg

SEQ ID NO: 168505 - DNA, 20 bp, Artificial
  CRISPR gRNA sequence
atttttaattctctgtgtgt

SEQ ID NO: 168506 - DNA, 20 bp, Artificial
  CRISPR gRNA sequence
tttttaattctctgtgtgtt

SEQ ID NO: 168507 - DNA, 20 bp, Artificial
  CRISPR gRNA sequence
ttaattctctgtgtgtttgt

SEQ ID NO: 168508 - DNA, 20 bp, Artificial
  CRISPR gRNA sequence
taattctctgtgtgtttgtt

SEQ ID NO: 168509 - DNA, 20 bp, Artificial
  CRISPR gRNA sequence
aattctctgtgtgtttgttt

SEQ ID NO: 168510 - DNA, 20 bp, Artificial
  CRISPR gRNA sequence
attctctgtgtgtttgtttt

SEQ ID NO: 168511 - DNA, 20 bp, Artificial
  CRISPR gRNA sequence
tctgtgtgtttgtttttgag

SEQ ID NO: 168512 - DNA, 20 bp, Artificial
  CRISPR gRNA sequence
tgtgtgtttgtttttgagac

SEQ ID NO: 168513 - DNA, 20 bp, Artificial
  CRISPR gRNA sequence
tgtgtttgtttttgagacaa

SEQ ID NO: 168514 - DNA, 20 bp, Artificial
  CRISPR gRNA sequence
gtttttgagacaaggtcttg

SEQ ID NO: 168515 - DNA, 20 bp, Artificial
  CRISPR gRNA sequence
tttttgagacaaggtcttgc

SEQ ID NO: 168516 - DNA, 20 bp, Artificial
  CRISPR gRNA sequence
ttgagacaaggtcttgccat

SEQ ID NO: 168517 - DNA, 20 bp, Artificial
  CRISPR gRNA sequence
tgagacaaggtcttgccata

SEQ ID NO: 168518 - DNA, 20 bp, Artificial
  CRISPR gRNA sequence
gagacaaggtcttgccatat

SEQ ID NO: 168519 - DNA, 20 bp, Artificial
  CRISPR gRNA sequence
agacaaggtcttgccatatt

SEQ ID NO: 168520 - DNA, 20 bp, Artificial
  CRISPR gRNA sequence
gccatattgcccaggctggt

SEQ ID NO: 168521 - DNA, 20 bp, Artificial
  CRISPR gRNA sequence
ccatattgcccaggctggtc

SEQ ID NO: 168522 - DNA, 20 bp, Artificial
  CRISPR gRNA sequence
cccaggctggtctccaactc

SEQ ID NO: 168523 - DNA, 20 bp, Artificial
  CRISPR gRNA sequence
gtctccaactcccgggccca

SEQ ID NO: 168524 - DNA, 20 bp, Artificial
  CRISPR gRNA sequence
caactcccgggcccatgcga

SEQ ID NO: 168525 - DNA, 20 bp, Artificial
  CRISPR gRNA sequence
ccgggcccatgcgaccctcc

SEQ ID NO: 168526 - DNA, 20 bp, Artificial
  CRISPR gRNA sequence
ctgctttggcctcccaaagt

SEQ ID NO: 168527 - DNA, 20 bp, Artificial
  CRISPR gRNA sequence
ctttggcctcccaaagtgat

SEQ ID NO: 168528 - DNA, 20 bp, Artificial
  CRISPR gRNA sequence
tggcctcccaaagtgatggg

SEQ ID NO: 168529 - DNA, 20 bp, Artificial
  CRISPR gRNA sequence
ggcctcccaaagtgatggga

SEQ ID NO: 168530 - DNA, 20 bp, Artificial
  CRISPR gRNA sequence
gcctcccaaagtgatgggat

SEQ ID NO: 168531 - DNA, 20 bp, Artificial
  CRISPR gRNA sequence
ccaaagtgatgggattatag

SEQ ID NO: 168532 - DNA, 20 bp, Artificial
  CRISPR gRNA sequence
taggtgtgagccaccgcacc

SEQ ID NO: 168533 - DNA, 20 bp, Artificial
  CRISPR gRNA sequence
gccaaatcataattacttaa

SEQ ID NO: 168534 - DNA, 20 bp, Artificial
  CRISPR gRNA sequence
cttaaatctacctcctaact

SEQ ID NO: 168535 - DNA, 20 bp, Artificial
  CRISPR gRNA sequence
aaatctacctcctaactggg

SEQ ID NO: 168536 - DNA, 20 bp, Artificial
  CRISPR gRNA sequence
aatctacctcctaactgggc

SEQ ID NO: 168537 - DNA, 20 bp, Artificial
  CRISPR gRNA sequence
cctcctaactgggcatggtg

SEQ ID NO: 168538 - DNA, 20 bp, Artificial
  CRISPR gRNA sequence
ctaactgggcatggtggctc

SEQ ID NO: 168539 - DNA, 20 bp, Artificial
  CRISPR gRNA sequence
actgggcatggtggctcatg

SEQ ID NO: 168540 - DNA, 20 bp, Artificial
  CRISPR gRNA sequence
ggcatggtggctcatgcctg

SEQ ID NO: 168541 - DNA, 20 bp, Artificial
  CRISPR gRNA sequence
atgcctgtcatcccaccact

SEQ ID NO: 168542 - DNA, 20 bp, Artificial
  CRISPR gRNA sequence
tcatcccaccactgtgggag

SEQ ID NO: 168543 - DNA, 20 bp, Artificial
  CRISPR gRNA sequence
tgggaggccaaggtgggagg

SEQ ID NO: 168544 - DNA, 20 bp, Artificial
  CRISPR gRNA sequence
gagaccagcctgggaaacat

SEQ ID NO: 168545 - DNA, 20 bp, Artificial
  CRISPR gRNA sequence
agaccagcctgggaaacata

SEQ ID NO: 168546 - DNA, 20 bp, Artificial
  CRISPR gRNA sequence
ggaaacataatgagacccca

SEQ ID NO: 168547 - DNA, 20 bp, Artificial
  CRISPR gRNA sequence
cacaaaaaaattaaaaatta

SEQ ID NO: 168548 - DNA, 20 bp, Artificial
  CRISPR gRNA sequence
aaaattatccaggtgtggtg

SEQ ID NO: 168549 - DNA, 20 bp, Artificial
  CRISPR gRNA sequence
tccaggtgtggtggcacatg

SEQ ID NO: 168550 - DNA, 20 bp, Artificial
  CRISPR gRNA sequence
ggagtcccagctcctcggga

SEQ ID NO: 168551 - DNA, 20 bp, Artificial
  CRISPR gRNA sequence
ctcgggaggctgaggcagaa

SEQ ID NO: 168552 - DNA, 20 bp, Artificial
  CRISPR gRNA sequence
gggaggctgaggcagaagga

SEQ ID NO: 168553 - DNA, 20 bp, Artificial
  CRISPR gRNA sequence
aggcagaaggactgcttgag

SEQ ID NO: 168554 - DNA, 20 bp, Artificial
  CRISPR gRNA sequence
cttgagcccagtagtttgaa

SEQ ID NO: 168555 - DNA, 20 bp, Artificial
  CRISPR gRNA sequence
gagcccagtagtttgaagct

SEQ ID NO: 168556 - DNA, 20 bp, Artificial
  CRISPR gRNA sequence
agcccagtagtttgaagctg

SEQ ID NO: 168557 - DNA, 20 bp, Artificial
  CRISPR gRNA sequence
gaagctgcagtaagctatga

SEQ ID NO: 168558 - DNA, 20 bp, Artificial
  CRISPR gRNA sequence
aagctgcagtaagctatgat

SEQ ID NO: 168559 - DNA, 20 bp, Artificial
  CRISPR gRNA sequence
cagtaagctatgattgtgct

SEQ ID NO: 168560 - DNA, 20 bp, Artificial
  CRISPR gRNA sequence
tgattgtgctactacactcc

SEQ ID NO: 168561 - DNA, 20 bp, Artificial
  CRISPR gRNA sequence
tgctactacactccagcctg

SEQ ID NO: 168562 - DNA, 20 bp, Artificial
  CRISPR gRNA sequence
ctacactccagcctgagtga

SEQ ID NO: 168563 - DNA, 20 bp, Artificial
  CRISPR gRNA sequence
cactccagcctgagtgacga

SEQ ID NO: 168564 - DNA, 20 bp, Artificial
  CRISPR gRNA sequence
cagcctgagtgacgaagtga

SEQ ID NO: 168565 - DNA, 20 bp, Artificial
  CRISPR gRNA sequence
agtgacgaagtgagaactta

SEQ ID NO: 168566 - DNA, 20 bp, Artificial
  CRISPR gRNA sequence
atctttaaaaaaacatcaat

SEQ ID NO: 168567 - DNA, 20 bp, Artificial
  CRISPR gRNA sequence
tctttaaaaaaacatcaatc

SEQ ID NO: 168568 - DNA, 20 bp, Artificial
  CRISPR gRNA sequence
taaaaaaacatcaatcaatc

SEQ ID NO: 168569 - DNA, 20 bp, Artificial
  CRISPR gRNA sequence
aaaaaaacatcaatcaatca

SEQ ID NO: 168570 - DNA, 20 bp, Artificial
  CRISPR gRNA sequence
aaaaaacatcaatcaatcaa

SEQ ID NO: 168571 - DNA, 20 bp, Artificial
  CRISPR gRNA sequence
cctctactccattttttttt

SEQ ID NO: 168572 - DNA, 20 bp, Artificial
  CRISPR gRNA sequence
tactccatttttttttcttc

SEQ ID NO: 168573 - DNA, 20 bp, Artificial
  CRISPR gRNA sequence
ctccatttttttttcttcta

SEQ ID NO: 168574 - DNA, 20 bp, Artificial
  CRISPR gRNA sequence
catttttttttcttctaggc

SEQ ID NO: 168575 - DNA, 20 bp, Artificial
  CRISPR gRNA sequence
ttttttcttctaggcaaact

SEQ ID NO: 168576 - DNA, 20 bp, Artificial
  CRISPR gRNA sequence
tttttcttctaggcaaactc

SEQ ID NO: 168577 - DNA, 20 bp, Artificial
  CRISPR gRNA sequence
ttttcttctaggcaaactca

SEQ ID NO: 168578 - DNA, 20 bp, Artificial
  CRISPR gRNA sequence
tttcttctaggcaaactcag

SEQ ID NO: 168579 - DNA, 20 bp, Artificial
  CRISPR gRNA sequence
ttcttctaggcaaactcagc

SEQ ID NO: 168580 - DNA, 20 bp, Artificial
  CRISPR gRNA sequence
tcttctaggcaaactcagct

SEQ ID NO: 168581 - DNA, 20 bp, Artificial
  CRISPR gRNA sequence
cttctaggcaaactcagctc

SEQ ID NO: 168582 - DNA, 20 bp, Artificial
  CRISPR gRNA sequence
ttctaggcaaactcagctcc

SEQ ID NO: 168583 - DNA, 20 bp, Artificial
  CRISPR gRNA sequence
ctaggcaaactcagctcctt

SEQ ID NO: 168584 - DNA, 20 bp, Artificial
  CRISPR gRNA sequence
taggcaaactcagctcctta

SEQ ID NO: 168585 - DNA, 20 bp, Artificial
  CRISPR gRNA sequence
ggcaaactcagctccttatt

SEQ ID NO: 168586 - DNA, 20 bp, Artificial
  CRISPR gRNA sequence
agctccttattagaatatac

SEQ ID NO: 168587 - DNA, 20 bp, Artificial
  CRISPR gRNA sequence
cttattagaatatacgaggc

SEQ ID NO: 168588 - DNA, 20 bp, Artificial
  CRISPR gRNA sequence
attagaatatacgaggctgt

SEQ ID NO: 168589 - DNA, 20 bp, Artificial
  CRISPR gRNA sequence
ttagaatatacgaggctgtc

SEQ ID NO: 168590 - DNA, 20 bp, Artificial
  CRISPR gRNA sequence
gaatatacgaggctgtccag

SEQ ID NO: 168591 - DNA, 20 bp, Artificial
  CRISPR gRNA sequence
tccaggatgtgtttactatc

SEQ ID NO: 168592 - DNA, 20 bp, Artificial
  CRISPR gRNA sequence
actatctatctttccaaact

SEQ ID NO: 168593 - DNA, 20 bp, Artificial
  CRISPR gRNA sequence
ctatctatctttccaaactt

SEQ ID NO: 168594 - DNA, 20 bp, Artificial
  CRISPR gRNA sequence
tctatctttccaaacttgcg

SEQ ID NO: 168595 - DNA, 20 bp, Artificial
  CRISPR gRNA sequence
tctttccaaacttgcgtaga

SEQ ID NO: 168596 - DNA, 20 bp, Artificial
  CRISPR gRNA sequence
tccaaacttgcgtagatggt

SEQ ID NO: 168597 - DNA, 20 bp, Artificial
  CRISPR gRNA sequence
ccaaacttgcgtagatggtc

SEQ ID NO: 168598 - DNA, 20 bp, Artificial
  CRISPR gRNA sequence
caaacttgcgtagatggtcc

SEQ ID NO: 168599 - DNA, 20 bp, Artificial
  CRISPR gRNA sequence
gcgtagatggtcccctacgc

SEQ ID NO: 168600 - DNA, 20 bp, Artificial
  CRISPR gRNA sequence
cgtagatggtcccctacgct

SEQ ID NO: 168601 - DNA, 20 bp, Artificial
  CRISPR gRNA sequence
cgctgactactttcctacgg

SEQ ID NO: 168602 - DNA, 20 bp, Artificial
  CRISPR gRNA sequence
actactttcctacggccccc

SEQ ID NO: 168603 - DNA, 20 bp, Artificial
  CRISPR gRNA sequence
ctttcctacggccccctgta

SEQ ID NO: 168604 - DNA, 20 bp, Artificial
  CRISPR gRNA sequence
tcctacggccccctgtactg

SEQ ID NO: 168605 - DNA, 20 bp, Artificial
  CRISPR gRNA sequence
cctacggccccctgtactgt

SEQ ID NO: 168606 - DNA, 20 bp, Artificial
  CRISPR gRNA sequence
ctacggccccctgtactgtt

SEQ ID NO: 168607 - DNA, 20 bp, Artificial
  CRISPR gRNA sequence
cggccccctgtactgtttct

SEQ ID NO: 168608 - DNA, 20 bp, Artificial
  CRISPR gRNA sequence
tactgtttctcacctctgag

SEQ ID NO: 168609 - DNA, 20 bp, Artificial
  CRISPR gRNA sequence
tttctcacctctgagccttt

SEQ ID NO: 168610 - DNA, 20 bp, Artificial
  CRISPR gRNA sequence
ctcacctctgagcctttgcc

SEQ ID NO: 168611 - DNA, 20 bp, Artificial
  CRISPR gRNA sequence
tcacctctgagcctttgcct

SEQ ID NO: 168612 - DNA, 20 bp, Artificial
  CRISPR gRNA sequence
acctctgagcctttgcctgt

SEQ ID NO: 168613 - DNA, 20 bp, Artificial
  CRISPR gRNA sequence
tgagcctttgcctgtgctgt

SEQ ID NO: 168614 - DNA, 20 bp, Artificial
  CRISPR gRNA sequence
agcctttgcctgtgctgtgc

SEQ ID NO: 168615 - DNA, 20 bp, Artificial
  CRISPR gRNA sequence
tgcctgtgctgtgccctcta

SEQ ID NO: 168616 - DNA, 20 bp, Artificial
  CRISPR gRNA sequence
gcctgtgctgtgccctctac

SEQ ID NO: 168617 - DNA, 20 bp, Artificial
  CRISPR gRNA sequence
cctgtgctgtgccctctact

SEQ ID NO: 168618 - DNA, 20 bp, Artificial
  CRISPR gRNA sequence
tgctgtgccctctactggca

SEQ ID NO: 168619 - DNA, 20 bp, Artificial
  CRISPR gRNA sequence
tgccctctactggcaatacc

SEQ ID NO: 168620 - DNA, 20 bp, Artificial
  CRISPR gRNA sequence
tactggcaataccacccttt

SEQ ID NO: 168621 - DNA, 20 bp, Artificial
  CRISPR gRNA sequence
ctggcaataccaccctttcc

SEQ ID NO: 168622 - DNA, 20 bp, Artificial
  CRISPR gRNA sequence
gcaataccaccctttcccac

SEQ ID NO: 168623 - DNA, 20 bp, Artificial
  CRISPR gRNA sequence
tcccactttctttgattaat

SEQ ID NO: 168624 - DNA, 20 bp, Artificial
  CRISPR gRNA sequence
cccactttctttgattaatt

SEQ ID NO: 168625 - DNA, 20 bp, Artificial
  CRISPR gRNA sequence
ccactttctttgattaattt

SEQ ID NO: 168626 - DNA, 20 bp, Artificial
  CRISPR gRNA sequence
tctttgattaatttccactg

SEQ ID NO: 168627 - DNA, 20 bp, Artificial
  CRISPR gRNA sequence
ctttgattaatttccactgt

SEQ ID NO: 168628 - DNA, 20 bp, Artificial
  CRISPR gRNA sequence
tttgattaatttccactgtt

SEQ ID NO: 168629 - DNA, 20 bp, Artificial
  CRISPR gRNA sequence
tgattaatttccactgttcc

SEQ ID NO: 168630 - DNA, 20 bp, Artificial
  CRISPR gRNA sequence
gattaatttccactgttccc

SEQ ID NO: 168631 - DNA, 20 bp, Artificial
  CRISPR gRNA sequence
attaatttccactgttcccc

SEQ ID NO: 168632 - DNA, 20 bp, Artificial
  CRISPR gRNA sequence
atttccactgttccccaaga

SEQ ID NO: 168633 - DNA, 20 bp, Artificial
  CRISPR gRNA sequence
ccactgttccccaagactca

SEQ ID NO: 168634 - DNA, 20 bp, Artificial
  CRISPR gRNA sequence
cactgttccccaagactcat

SEQ ID NO: 168635 - DNA, 20 bp, Artificial
  CRISPR gRNA sequence
ttccccaagactcatattat

SEQ ID NO: 168636 - DNA, 20 bp, Artificial
  CRISPR gRNA sequence
cccaagactcatattattcc

SEQ ID NO: 168637 - DNA, 20 bp, Artificial
  CRISPR gRNA sequence
atattattcccttcagaaac

SEQ ID NO: 168638 - DNA, 20 bp, Artificial
  CRISPR gRNA sequence
ttcccttcagaaacattatc

SEQ ID NO: 168639 - DNA, 20 bp, Artificial
  CRISPR gRNA sequence
ccttcagaaacattatctga

SEQ ID NO: 168640 - DNA, 20 bp, Artificial
  CRISPR gRNA sequence
cagaaacattatctgaccac

SEQ ID NO: 168641 - DNA, 20 bp, Artificial
  CRISPR gRNA sequence
agaaacattatctgaccacc

SEQ ID NO: 168642 - DNA, 20 bp, Artificial
  CRISPR gRNA sequence
tctgaccacctcgttcacat

SEQ ID NO: 168643 - DNA, 20 bp, Artificial
  CRISPR gRNA sequence
accacctcgttcacatcttt

SEQ ID NO: 168644 - DNA, 20 bp, Artificial
  CRISPR gRNA sequence
gttcacatctttctcagcta

SEQ ID NO: 168645 - DNA, 20 bp, Artificial
  CRISPR gRNA sequence
acatctttctcagctactca

SEQ ID NO: 168646 - DNA, 20 bp, Artificial
  CRISPR gRNA sequence
tctcagctactcatcccctc

SEQ ID NO: 168647 - DNA, 20 bp, Artificial
  CRISPR gRNA sequence
ctcagctactcatcccctcc

SEQ ID NO: 168648 - DNA, 20 bp, Artificial
  CRISPR gRNA sequence
tcagctactcatcccctccc

SEQ ID NO: 168649 - DNA, 20 bp, Artificial
  CRISPR gRNA sequence
agctactcatcccctcccct

SEQ ID NO: 168650 - DNA, 20 bp, Artificial
  CRISPR gRNA sequence
ctcatcccctcccctacata

SEQ ID NO: 168651 - DNA, 20 bp, Artificial
  CRISPR gRNA sequence
atcccctcccctacatacat

SEQ ID NO: 168652 - DNA, 20 bp, Artificial
  CRISPR gRNA sequence
ccctacatacatacacacac

SEQ ID NO: 168653 - DNA, 20 bp, Artificial
  CRISPR gRNA sequence
catacatacacacacatata

SEQ ID NO: 168654 - DNA, 20 bp, Artificial
  CRISPR gRNA sequence
ttttttgttttttttttgag

SEQ ID NO: 168655 - DNA, 20 bp, Artificial
  CRISPR gRNA sequence
tttttgttttttttttgaga

SEQ ID NO: 168656 - DNA, 20 bp, Artificial
  CRISPR gRNA sequence
ttttgttttttttttgagac

SEQ ID NO: 168657 - DNA, 20 bp, Artificial
  CRISPR gRNA sequence
tttgttttttttttgagaca

SEQ ID NO: 168658 - DNA, 20 bp, Artificial
  CRISPR gRNA sequence
ttgttttttttttgagacag

SEQ ID NO: 168659 - DNA, 20 bp, Artificial
  CRISPR gRNA sequence
tgttttttttttgagacagg

SEQ ID NO: 168660 - DNA, 20 bp, Artificial
  CRISPR gRNA sequence
gttttttttttgagacagga

SEQ ID NO: 168661 - DNA, 20 bp, Artificial
  CRISPR gRNA sequence
ttttttttttgagacaggat

SEQ ID NO: 168662 - DNA, 20 bp, Artificial
  CRISPR gRNA sequence
tttttttgagacaggatctt

SEQ ID NO: 168663 - DNA, 20 bp, Artificial
  CRISPR gRNA sequence
ttttttgagacaggatcttg

SEQ ID NO: 168664 - DNA, 20 bp, Artificial
  CRISPR gRNA sequence
tttttgagacaggatcttgc

SEQ ID NO: 168665 - DNA, 20 bp, Artificial
  CRISPR gRNA sequence
ttttgagacaggatcttgct

SEQ ID NO: 168666 - DNA, 20 bp, Artificial
  CRISPR gRNA sequence
tttgagacaggatcttgctc

SEQ ID NO: 168667 - DNA, 20 bp, Artificial
  CRISPR gRNA sequence
ttgagacaggatcttgctct

SEQ ID NO: 168668 - DNA, 20 bp, Artificial
  CRISPR gRNA sequence
tgagacaggatcttgctctg

SEQ ID NO: 168669 - DNA, 20 bp, Artificial
  CRISPR gRNA sequence
gagacaggatcttgctctgt

SEQ ID NO: 168670 - DNA, 20 bp, Artificial
  CRISPR gRNA sequence
agacaggatcttgctctgtc

SEQ ID NO: 168671 - DNA, 20 bp, Artificial
  CRISPR gRNA sequence
gctctgtcaccctggctgga

SEQ ID NO: 168672 - DNA, 20 bp, Artificial
  CRISPR gRNA sequence
ctctgtcaccctggctggag

SEQ ID NO: 168673 - DNA, 20 bp, Artificial
  CRISPR gRNA sequence
tgtcaccctggctggagtgc

SEQ ID NO: 168674 - DNA, 20 bp, Artificial
  CRISPR gRNA sequence
tcaccctggctggagtgcaa

SEQ ID NO: 168675 - DNA, 20 bp, Artificial
  CRISPR gRNA sequence
gctggagtgcaatggcacaa

SEQ ID NO: 168676 - DNA, 20 bp, Artificial
  CRISPR gRNA sequence
gagtgcaatggcacaatcac

SEQ ID NO: 168677 - DNA, 20 bp, Artificial
  CRISPR gRNA sequence
actgtagccttgacctcctt

SEQ ID NO: 168678 - DNA, 20 bp, Artificial
  CRISPR gRNA sequence
tagccttgacctccttggct

SEQ ID NO: 168679 - DNA, 20 bp, Artificial
  CRISPR gRNA sequence
gacctccttggctcaagcga

SEQ ID NO: 168680 - DNA, 20 bp, Artificial
  CRISPR gRNA sequence
acctccttggctcaagcgat

SEQ ID NO: 168681 - DNA, 20 bp, Artificial
  CRISPR gRNA sequence
cttggctcaagcgatcctcc

SEQ ID NO: 168682 - DNA, 20 bp, Artificial
  CRISPR gRNA sequence
ggctcaagcgatcctcccaa

SEQ ID NO: 168683 - DNA, 20 bp, Artificial
  CRISPR gRNA sequence
gctcaagcgatcctcccaac

SEQ ID NO: 168684 - DNA, 20 bp, Artificial
  CRISPR gRNA sequence
aagcgatcctcccaactcag

SEQ ID NO: 168685 - DNA, 20 bp, Artificial
  CRISPR gRNA sequence
ccaactcagcctcttaagta

SEQ ID NO: 168686 - DNA, 20 bp, Artificial
  CRISPR gRNA sequence
agcctcttaagtagctgggg

SEQ ID NO: 168687 - DNA, 20 bp, Artificial
  CRISPR gRNA sequence
ttaagtagctggggccataa

SEQ ID NO: 168688 - DNA, 20 bp, Artificial
  CRISPR gRNA sequence
aagtagctggggccataaga

SEQ ID NO: 168689 - DNA, 20 bp, Artificial
  CRISPR gRNA sequence
agtagctggggccataagag

SEQ ID NO: 168690 - DNA, 20 bp, Artificial
  CRISPR gRNA sequence
gggccataagagcatgccac

SEQ ID NO: 168691 - DNA, 20 bp, Artificial
  CRISPR gRNA sequence
gctaatgttctgatgttctg

SEQ ID NO: 168692 - DNA, 20 bp, Artificial
  CRISPR gRNA sequence
atgttctgatgttctggtgg

SEQ ID NO: 168693 - DNA, 20 bp, Artificial
  CRISPR gRNA sequence
tgatgttctggtggagacaa

SEQ ID NO: 168694 - DNA, 20 bp, Artificial
  CRISPR gRNA sequence
atgttctggtggagacaagg

SEQ ID NO: 168695 - DNA, 20 bp, Artificial
  CRISPR gRNA sequence
tggtggagacaaggtctcac

SEQ ID NO: 168696 - DNA, 20 bp, Artificial
  CRISPR gRNA sequence
gtggagacaaggtctcacca

SEQ ID NO: 168697 - DNA, 20 bp, Artificial
  CRISPR gRNA sequence
accatgttgcccaggctggt

SEQ ID NO: 168698 - DNA, 20 bp, Artificial
  CRISPR gRNA sequence
cccaggctggtcttgaacac

SEQ ID NO: 168699 - DNA, 20 bp, Artificial
  CRISPR gRNA sequence
gtcttgaacacgtgggctca

SEQ ID NO: 168700 - DNA, 20 bp, Artificial
  CRISPR gRNA sequence
gaacacgtgggctcaagcaa

SEQ ID NO: 168701 - DNA, 20 bp, Artificial
  CRISPR gRNA sequence
aacacgtgggctcaagcaat

SEQ ID NO: 168702 - DNA, 20 bp, Artificial
  CRISPR gRNA sequence
aagcaatcctcctgcctcgg

SEQ ID NO: 168703 - DNA, 20 bp, Artificial
  CRISPR gRNA sequence
ctgcctcggcctcccaaagt

SEQ ID NO: 168704 - DNA, 20 bp, Artificial
  CRISPR gRNA sequence
cctcggcctcccaaagtgct

SEQ ID NO: 168705 - DNA, 20 bp, Artificial
  CRISPR gRNA sequence
ggcctcccaaagtgctggaa

SEQ ID NO: 168706 - DNA, 20 bp, Artificial
  CRISPR gRNA sequence
ccaaagtgctggaattacag

SEQ ID NO: 168707 - DNA, 20 bp, Artificial
  CRISPR gRNA sequence
gaattacagacatgagccac

SEQ ID NO: 168708 - DNA, 20 bp, Artificial
  CRISPR gRNA sequence
cagacatgagccaccacatg

SEQ ID NO: 168709 - DNA, 20 bp, Artificial
  CRISPR gRNA sequence
ccttttttttttttttttaa

SEQ ID NO: 168710 - DNA, 20 bp, Artificial
  CRISPR gRNA sequence
ttttttttttttttaattaa

SEQ ID NO: 168711 - DNA, 20 bp, Artificial
  CRISPR gRNA sequence
tttttttttttttaattaaa

SEQ ID NO: 168712 - DNA, 20 bp, Artificial
  CRISPR gRNA sequence
ttttttttttttaattaaag

SEQ ID NO: 168713 - DNA, 20 bp, Artificial
  CRISPR gRNA sequence
tttttttttttaattaaaga

SEQ ID NO: 168714 - DNA, 20 bp, Artificial
  CRISPR gRNA sequence
ttttttttttaattaaagaa

SEQ ID NO: 168715 - DNA, 20 bp, Artificial
  CRISPR gRNA sequence
tttttttttaattaaagaag

SEQ ID NO: 168716 - DNA, 20 bp, Artificial
  CRISPR gRNA sequence
ttttttttaattaaagaaga

SEQ ID NO: 168717 - DNA, 20 bp, Artificial
  CRISPR gRNA sequence
tttttttaattaaagaagag

SEQ ID NO: 168718 - DNA, 20 bp, Artificial
  CRISPR gRNA sequence
ttttttaattaaagaagagg

SEQ ID NO: 168719 - DNA, 20 bp, Artificial
  CRISPR gRNA sequence
tttttaattaaagaagaggt

SEQ ID NO: 168720 - DNA, 20 bp, Artificial
  CRISPR gRNA sequence
ttttaattaaagaagaggtc

SEQ ID NO: 168721 - DNA, 20 bp, Artificial
  CRISPR gRNA sequence
tttaattaaagaagaggtct

SEQ ID NO: 168722 - DNA, 20 bp, Artificial
  CRISPR gRNA sequence
ttaattaaagaagaggtctt

SEQ ID NO: 168723 - DNA, 20 bp, Artificial
  CRISPR gRNA sequence
taattaaagaagaggtcttg

SEQ ID NO: 168724 - DNA, 20 bp, Artificial
  CRISPR gRNA sequence
aattaaagaagaggtcttgc

SEQ ID NO: 168725 - DNA, 20 bp, Artificial
  CRISPR gRNA sequence
attaaagaagaggtcttgct

SEQ ID NO: 168726 - DNA, 20 bp, Artificial
  CRISPR gRNA sequence
aagaagaggtcttgctgtgc

SEQ ID NO: 168727 - DNA, 20 bp, Artificial
  CRISPR gRNA sequence
gctgtgctgcccaggctgaa

SEQ ID NO: 168728 - DNA, 20 bp, Artificial
  CRISPR gRNA sequence
ctgtgctgcccaggctgaag

SEQ ID NO: 168729 - DNA, 20 bp, Artificial
  CRISPR gRNA sequence
tgctgcccaggctgaagtgc

SEQ ID NO: 168730 - DNA, 20 bp, Artificial
  CRISPR gRNA sequence
cccaggctgaagtgcagtgg

SEQ ID NO: 168731 - DNA, 20 bp, Artificial
  CRISPR gRNA sequence
aagtgcagtggcatgatcct

SEQ ID NO: 168732 - DNA, 20 bp, Artificial
  CRISPR gRNA sequence
cctcactgtaacctcaaact

SEQ ID NO: 168733 - DNA, 20 bp, Artificial
  CRISPR gRNA sequence
actgtaacctcaaactcctg

SEQ ID NO: 168734 - DNA, 20 bp, Artificial
  CRISPR gRNA sequence
taacctcaaactcctgggtt

SEQ ID NO: 168735 - DNA, 20 bp, Artificial
  CRISPR gRNA sequence
aaactcctgggttcctccca

SEQ ID NO: 168736 - DNA, 20 bp, Artificial
  CRISPR gRNA sequence
ctgggttcctcccacattgg

SEQ ID NO: 168737 - DNA, 20 bp, Artificial
  CRISPR gRNA sequence
ggttcctcccacattggcct

SEQ ID NO: 168738 - DNA, 20 bp, Artificial
  CRISPR gRNA sequence
ctcccacattggcctcccaa

SEQ ID NO: 168739 - DNA, 20 bp, Artificial
  CRISPR gRNA sequence
ccacattggcctcccaaagt

SEQ ID NO: 168740 - DNA, 20 bp, Artificial
  CRISPR gRNA sequence
gcctcccaaagtgttgggat

SEQ ID NO: 168741 - DNA, 20 bp, Artificial
  CRISPR gRNA sequence
ccaaagtgttgggattacag

SEQ ID NO: 168742 - DNA, 20 bp, Artificial
  CRISPR gRNA sequence
ggattacaggcatgagccac

SEQ ID NO: 168743 - DNA, 20 bp, Artificial
  CRISPR gRNA sequence
caggcatgagccactgcgct

SEQ ID NO: 168744 - DNA, 20 bp, Artificial
  CRISPR gRNA sequence
cgctgagccaaggtacttct

SEQ ID NO: 168745 - DNA, 20 bp, Artificial
  CRISPR gRNA sequence
agccaaggtacttcttttaa

SEQ ID NO: 168746 - DNA, 20 bp, Artificial
  CRISPR gRNA sequence
cttttaatgtgttcctttaa

SEQ ID NO: 168747 - DNA, 20 bp, Artificial
  CRISPR gRNA sequence
ttttaatgtgttcctttaac

SEQ ID NO: 168748 - DNA, 20 bp, Artificial
  CRISPR gRNA sequence
ttaatgtgttcctttaacac

SEQ ID NO: 168749 - DNA, 20 bp, Artificial
  CRISPR gRNA sequence
taatgtgttcctttaacacc

SEQ ID NO: 168750 - DNA, 20 bp, Artificial
  CRISPR gRNA sequence
aatgtgttcctttaacaccc

SEQ ID NO: 168751 - DNA, 20 bp, Artificial
  CRISPR gRNA sequence
atgtgttcctttaacaccct

SEQ ID NO: 168752 - DNA, 20 bp, Artificial
  CRISPR gRNA sequence
ctttaacaccctgtacacat

SEQ ID NO: 168753 - DNA, 20 bp, Artificial
  CRISPR gRNA sequence
taacaccctgtacacattcc

SEQ ID NO: 168754 - DNA, 20 bp, Artificial
  CRISPR gRNA sequence
aacaccctgtacacattccc

SEQ ID NO: 168755 - DNA, 20 bp, Artificial
  CRISPR gRNA sequence
acaccctgtacacattccca

SEQ ID NO: 168756 - DNA, 20 bp, Artificial
  CRISPR gRNA sequence
tacacattcccacgtggtgg

SEQ ID NO: 168757 - DNA, 20 bp, Artificial
  CRISPR gRNA sequence
ccacgtggtggtacaacctt

SEQ ID NO: 168758 - DNA, 20 bp, Artificial
  CRISPR gRNA sequence
taagtatttgtatccccaac

SEQ ID NO: 168759 - DNA, 20 bp, Artificial
  CRISPR gRNA sequence
aagtatttgtatccccaact

SEQ ID NO: 168760 - DNA, 20 bp, Artificial
  CRISPR gRNA sequence
agtatttgtatccccaacta

SEQ ID NO: 168761 - DNA, 20 bp, Artificial
  CRISPR gRNA sequence
gtatccccaactaaattgtg

SEQ ID NO: 168762 - DNA, 20 bp, Artificial
  CRISPR gRNA sequence
tatccccaactaaattgtga

SEQ ID NO: 168763 - DNA, 20 bp, Artificial
  CRISPR gRNA sequence
aattgtgaattccttgaaaa

SEQ ID NO: 168764 - DNA, 20 bp, Artificial
  CRISPR gRNA sequence
tgaattccttgaaaataagg

SEQ ID NO: 168765 - DNA, 20 bp, Artificial
  CRISPR gRNA sequence
cttgaaaataaggactgttt

SEQ ID NO: 168766 - DNA, 20 bp, Artificial
  CRISPR gRNA sequence
gaaaataaggactgttttat

SEQ ID NO: 168767 - DNA, 20 bp, Artificial
  CRISPR gRNA sequence
aaaataaggactgttttatt

SEQ ID NO: 168768 - DNA, 20 bp, Artificial
  CRISPR gRNA sequence
ttttattcatgcttgtatcc

SEQ ID NO: 168769 - DNA, 20 bp, Artificial
  CRISPR gRNA sequence
tattcatgcttgtatcccca

SEQ ID NO: 168770 - DNA, 20 bp, Artificial
  CRISPR gRNA sequence
attcatgcttgtatccccaa

SEQ ID NO: 168771 - DNA, 20 bp, Artificial
  CRISPR gRNA sequence
ttcatgcttgtatccccaat

SEQ ID NO: 168772 - DNA, 20 bp, Artificial
  CRISPR gRNA sequence
atgcttgtatccccaataca

SEQ ID NO: 168773 - DNA, 20 bp, Artificial
  CRISPR gRNA sequence
gtatccccaatacatagcac

SEQ ID NO: 168774 - DNA, 20 bp, Artificial
  CRISPR gRNA sequence
tatccccaatacatagcaca

SEQ ID NO: 168775 - DNA, 20 bp, Artificial
  CRISPR gRNA sequence
taccctcagaggatgctcag

SEQ ID NO: 168776 - DNA, 20 bp, Artificial
  CRISPR gRNA sequence
accctcagaggatgctcagt

SEQ ID NO: 168777 - DNA, 20 bp, Artificial
  CRISPR gRNA sequence
ccctcagaggatgctcagtg

SEQ ID NO: 168778 - DNA, 20 bp, Artificial
  CRISPR gRNA sequence
agaggatgctcagtgtttga

SEQ ID NO: 168779 - DNA, 20 bp, Artificial
  CRISPR gRNA sequence
agtgtttgatgaataaataa

SEQ ID NO: 168780 - DNA, 20 bp, Artificial
  CRISPR gRNA sequence
gatgaataaataatgattga

SEQ ID NO: 168781 - DNA, 20 bp, Artificial
  CRISPR gRNA sequence
atgaataaataatgattgac

SEQ ID NO: 168782 - DNA, 20 bp, Artificial
  CRISPR gRNA sequence
acagagaatttggattcaga

SEQ ID NO: 168783 - DNA, 20 bp, Artificial
  CRISPR gRNA sequence
ggattcagagctcatagtac

SEQ ID NO: 168784 - DNA, 20 bp, Artificial
  CRISPR gRNA sequence
gattcagagctcatagtaca

SEQ ID NO: 168785 - DNA, 20 bp, Artificial
  CRISPR gRNA sequence
agagctcatagtacagagtt

SEQ ID NO: 168786 - DNA, 20 bp, Artificial
  CRISPR gRNA sequence
atagtacagagttctctgca

SEQ ID NO: 168787 - DNA, 20 bp, Artificial
  CRISPR gRNA sequence
tctgcagcctcacatgaccc

SEQ ID NO: 168788 - DNA, 20 bp, Artificial
  CRISPR gRNA sequence
tgcagcctcacatgaccccc

SEQ ID NO: 168789 - DNA, 20 bp, Artificial
  CRISPR gRNA sequence
cagcctcacatgacccccaa

SEQ ID NO: 168790 - DNA, 20 bp, Artificial
  CRISPR gRNA sequence
acatgacccccaacaaacat

SEQ ID NO: 168791 - DNA, 20 bp, Artificial
  CRISPR gRNA sequence
ctgctcttaacactactact

SEQ ID NO: 168792 - DNA, 20 bp, Artificial
  CRISPR gRNA sequence
ctcttaacactactactggg

SEQ ID NO: 168793 - DNA, 20 bp, Artificial
  CRISPR gRNA sequence
ttaacactactactggggag

SEQ ID NO: 168794 - DNA, 20 bp, Artificial
  CRISPR gRNA sequence
aacactactactggggagag

SEQ ID NO: 168795 - DNA, 20 bp, Artificial
  CRISPR gRNA sequence
acactactactggggagaga

SEQ ID NO: 168796 - DNA, 20 bp, Artificial
  CRISPR gRNA sequence
ctactggggagagaaagagt

SEQ ID NO: 168797 - DNA, 20 bp, Artificial
  CRISPR gRNA sequence
ctggggagagaaagagtcct

SEQ ID NO: 168798 - DNA, 20 bp, Artificial
  CRISPR gRNA sequence
gggagagaaagagtcctctg

SEQ ID NO: 168799 - DNA, 20 bp, Artificial
  CRISPR gRNA sequence
tgattactatcgtaaaaaga

SEQ ID NO: 168800 - DNA, 20 bp, Artificial
  CRISPR gRNA sequence
attactatcgtaaaaagaga

SEQ ID NO: 168801 - DNA, 20 bp, Artificial
  CRISPR gRNA sequence
ctatcgtaaaaagagaaggt

SEQ ID NO: 168802 - DNA, 20 bp, Artificial
  CRISPR gRNA sequence
tcgtaaaaagagaaggtcac

SEQ ID NO: 168803 - DNA, 20 bp, Artificial
  CRISPR gRNA sequence
aacacaaatatgggacagag

SEQ ID NO: 168804 - DNA, 20 bp, Artificial
  CRISPR gRNA sequence
acacaaatatgggacagaga

SEQ ID NO: 168805 - DNA, 20 bp, Artificial
  CRISPR gRNA sequence
ggcaatgatacctaatctct

SEQ ID NO: 168806 - DNA, 20 bp, Artificial
  CRISPR gRNA sequence
gcaatgatacctaatctctc

SEQ ID NO: 168807 - DNA, 20 bp, Artificial
  CRISPR gRNA sequence
atctctccctttaagggcac

SEQ ID NO: 168808 - DNA, 20 bp, Artificial
  CRISPR gRNA sequence
tccctttaagggcacaaatt

SEQ ID NO: 168809 - DNA, 20 bp, Artificial
  CRISPR gRNA sequence
cctttaagggcacaaattcc

SEQ ID NO: 168810 - DNA, 20 bp, Artificial
  CRISPR gRNA sequence
taagggcacaaattccactt

SEQ ID NO: 168811 - DNA, 20 bp, Artificial
  CRISPR gRNA sequence
aagggcacaaattccacttc

SEQ ID NO: 168812 - DNA, 20 bp, Artificial
  CRISPR gRNA sequence
agggcacaaattccacttct

SEQ ID NO: 168813 - DNA, 20 bp, Artificial
  CRISPR gRNA sequence
cacttctcacacagacacac

SEQ ID NO: 168814 - DNA, 20 bp, Artificial
  CRISPR gRNA sequence
ctcacacagacacacagaca

SEQ ID NO: 168815 - DNA, 20 bp, Artificial
  CRISPR gRNA sequence
tcacacagacacacagacag

SEQ ID NO: 168816 - DNA, 20 bp, Artificial
  CRISPR gRNA sequence
acacagacacacagacagca

SEQ ID NO: 168817 - DNA, 20 bp, Artificial
  CRISPR gRNA sequence
actttagcacctctactctt

SEQ ID NO: 168818 - DNA, 20 bp, Artificial
  CRISPR gRNA sequence
tagcacctctactcttcata

SEQ ID NO: 168819 - DNA, 20 bp, Artificial
  CRISPR gRNA sequence
agcacctctactcttcataa

SEQ ID NO: 168820 - DNA, 20 bp, Artificial
  CRISPR gRNA sequence
gcacctctactcttcataag

SEQ ID NO: 168821 - DNA, 20 bp, Artificial
  CRISPR gRNA sequence
tactcttcataaggcatttc

SEQ ID NO: 168822 - DNA, 20 bp, Artificial
  CRISPR gRNA sequence
ctcttcataaggcatttcag

SEQ ID NO: 168823 - DNA, 20 bp, Artificial
  CRISPR gRNA sequence
ttcataaggcatttcagaca

SEQ ID NO: 168824 - DNA, 20 bp, Artificial
  CRISPR gRNA sequence
cataaggcatttcagacatt

SEQ ID NO: 168825 - DNA, 20 bp, Artificial
  CRISPR gRNA sequence
ataaggcatttcagacattt

SEQ ID NO: 168826 - DNA, 20 bp, Artificial
  CRISPR gRNA sequence
cagacatttttttttccctt

SEQ ID NO: 168827 - DNA, 20 bp, Artificial
  CRISPR gRNA sequence
agacatttttttttcccttc

SEQ ID NO: 168828 - DNA, 20 bp, Artificial
  CRISPR gRNA sequence
ttttttcccttctaaaattt

SEQ ID NO: 168829 - DNA, 20 bp, Artificial
  CRISPR gRNA sequence
tttttcccttctaaaatttc

SEQ ID NO: 168830 - DNA, 20 bp, Artificial
  CRISPR gRNA sequence
ttttcccttctaaaatttct

SEQ ID NO: 168831 - DNA, 20 bp, Artificial
  CRISPR gRNA sequence
tttcccttctaaaatttctg

SEQ ID NO: 168832 - DNA, 20 bp, Artificial
  CRISPR gRNA sequence
ttcccttctaaaatttctga

SEQ ID NO: 168833 - DNA, 20 bp, Artificial
  CRISPR gRNA sequence
tcccttctaaaatttctgag

SEQ ID NO: 168834 - DNA, 20 bp, Artificial
  CRISPR gRNA sequence
cccttctaaaatttctgagc

SEQ ID NO: 168835 - DNA, 20 bp, Artificial
  CRISPR gRNA sequence
ccttctaaaatttctgagct

SEQ ID NO: 168836 - DNA, 20 bp, Artificial
  CRISPR gRNA sequence
ctaaaatttctgagctaata

SEQ ID NO: 168837 - DNA, 20 bp, Artificial
  CRISPR gRNA sequence
taaaatttctgagctaatag

SEQ ID NO: 168838 - DNA, 20 bp, Artificial
  CRISPR gRNA sequence
aaatttctgagctaataggg

SEQ ID NO: 168839 - DNA, 20 bp, Artificial
  CRISPR gRNA sequence
ctgagctaatagggatcctg

SEQ ID NO: 168840 - DNA, 20 bp, Artificial
  CRISPR gRNA sequence
tgagctaatagggatcctgg

SEQ ID NO: 168841 - DNA, 20 bp, Artificial
  CRISPR gRNA sequence
agctaatagggatcctggag

SEQ ID NO: 168842 - DNA, 20 bp, Artificial
  CRISPR gRNA sequence
atagggatcctggagaacat

SEQ ID NO: 168843 - DNA, 20 bp, Artificial
  CRISPR gRNA sequence
gagaacatactgtctagtac

SEQ ID NO: 168844 - DNA, 20 bp, Artificial
  CRISPR gRNA sequence
tctagtacactttcctcatt

SEQ ID NO: 168845 - DNA, 20 bp, Artificial
  CRISPR gRNA sequence
gtacactttcctcatttgac

SEQ ID NO: 168846 - DNA, 20 bp, Artificial
  CRISPR gRNA sequence
tcctcatttgacctttgaga

SEQ ID NO: 168847 - DNA, 20 bp, Artificial
  CRISPR gRNA sequence
cctcatttgacctttgagaa

SEQ ID NO: 168848 - DNA, 20 bp, Artificial
  CRISPR gRNA sequence
ctcatttgacctttgagaaa

SEQ ID NO: 168849 - DNA, 20 bp, Artificial
  CRISPR gRNA sequence
atttgacctttgagaaaaac

SEQ ID NO: 168850 - DNA, 20 bp, Artificial
  CRISPR gRNA sequence
gacctttgagaaaaacaggg

SEQ ID NO: 168851 - DNA, 20 bp, Artificial
  CRISPR gRNA sequence
acctttgagaaaaacagggt

SEQ ID NO: 168852 - DNA, 20 bp, Artificial
  CRISPR gRNA sequence
tgagaaaaacagggtccaga

SEQ ID NO: 168853 - DNA, 20 bp, Artificial
  CRISPR gRNA sequence
gagaaaaacagggtccagag

SEQ ID NO: 168854 - DNA, 20 bp, Artificial
  CRISPR gRNA sequence
agaaaaacagggtccagaga

SEQ ID NO: 168855 - DNA, 20 bp, Artificial
  CRISPR gRNA sequence
gggtaacatctcaccccagt

SEQ ID NO: 168856 - DNA, 20 bp, Artificial
  CRISPR gRNA sequence
accccagtagctgaatctgg

SEQ ID NO: 168857 - DNA, 20 bp, Artificial
  CRISPR gRNA sequence
aatctggggaaaagttccag

SEQ ID NO: 168858 - DNA, 20 bp, Artificial
  CRISPR gRNA sequence
gggaaaagttccagtttcca

SEQ ID NO: 168859 - DNA, 20 bp, Artificial
  CRISPR gRNA sequence
cagtttccagactttaaatc

SEQ ID NO: 168860 - DNA, 20 bp, Artificial
  CRISPR gRNA sequence
ccagactttaaatccagtgc

SEQ ID NO: 168861 - DNA, 20 bp, Artificial
  CRISPR gRNA sequence
cagactttaaatccagtgct

SEQ ID NO: 168862 - DNA, 20 bp, Artificial
  CRISPR gRNA sequence
taaatccagtgctctataat

SEQ ID NO: 168863 - DNA, 20 bp, Artificial
  CRISPR gRNA sequence
aaatccagtgctctataatg

SEQ ID NO: 168864 - DNA, 20 bp, Artificial
  CRISPR gRNA sequence
aatccagtgctctataatga

SEQ ID NO: 168865 - DNA, 20 bp, Artificial
  CRISPR gRNA sequence
tataatgatctggctgcctc

SEQ ID NO: 168866 - DNA, 20 bp, Artificial
  CRISPR gRNA sequence
taatgatctggctgcctctc

SEQ ID NO: 168867 - DNA, 20 bp, Artificial
  CRISPR gRNA sequence
gctgcctctctgccctcatc

SEQ ID NO: 168868 - DNA, 20 bp, Artificial
  CRISPR gRNA sequence
cctctctgccctcatcaagc

SEQ ID NO: 168869 - DNA, 20 bp, Artificial
  CRISPR gRNA sequence
tctgccctcatcaagctctg

SEQ ID NO: 168870 - DNA, 20 bp, Artificial
  CRISPR gRNA sequence
tgccctcatcaagctctgcc

SEQ ID NO: 168871 - DNA, 20 bp, Artificial
  CRISPR gRNA sequence
ccctcatcaagctctgccca

SEQ ID NO: 168872 - DNA, 20 bp, Artificial
  CRISPR gRNA sequence
atcaagctctgcccatccaa

SEQ ID NO: 168873 - DNA, 20 bp, Artificial
  CRISPR gRNA sequence
tgcccatccaaaaacctaag

SEQ ID NO: 168874 - DNA, 20 bp, Artificial
  CRISPR gRNA sequence
cccatccaaaaacctaaggg

SEQ ID NO: 168875 - DNA, 20 bp, Artificial
  CRISPR gRNA sequence
aggggcactgtcttgctgga

SEQ ID NO: 168876 - DNA, 20 bp, Artificial
  CRISPR gRNA sequence
tcttgctggatgggcatcct

SEQ ID NO: 168877 - DNA, 20 bp, Artificial
  CRISPR gRNA sequence
gctggatgggcatcctcagc

SEQ ID NO: 168878 - DNA, 20 bp, Artificial
  CRISPR gRNA sequence
ctggatgggcatcctcagca

SEQ ID NO: 168879 - DNA, 20 bp, Artificial
  CRISPR gRNA sequence
gatgggcatcctcagcagct

SEQ ID NO: 168880 - DNA, 20 bp, Artificial
  CRISPR gRNA sequence
agcagctcacagacctggcc

SEQ ID NO: 168881 - DNA, 20 bp, Artificial
  CRISPR gRNA sequence
acagacctggccctgctgag

SEQ ID NO: 168882 - DNA, 20 bp, Artificial
  CRISPR gRNA sequence
gccctgctgaggctgtgcga

SEQ ID NO: 168883 - DNA, 20 bp, Artificial
  CRISPR gRNA sequence
ctgaggctgtgcgatgatga

SEQ ID NO: 168884 - DNA, 20 bp, Artificial
  CRISPR gRNA sequence
aggctgtgcgatgatgatct

SEQ ID NO: 168885 - DNA, 20 bp, Artificial
  CRISPR gRNA sequence
tgcgatgatgatctgcccag

SEQ ID NO: 168886 - DNA, 20 bp, Artificial
  CRISPR gRNA sequence
cccaggctggatggtggtcg

SEQ ID NO: 168887 - DNA, 20 bp, Artificial
  CRISPR gRNA sequence
gatggtggtcgtggagctgg

SEQ ID NO: 168888 - DNA, 20 bp, Artificial
  CRISPR gRNA sequence
gtggtctgctggccttgctg

SEQ ID NO: 168889 - DNA, 20 bp, Artificial
  CRISPR gRNA sequence
ctggccttgctgctggccct

SEQ ID NO: 168890 - DNA, 20 bp, Artificial
  CRISPR gRNA sequence
gccttgctgctggccctgga

SEQ ID NO: 168891 - DNA, 20 bp, Artificial
  CRISPR gRNA sequence
gctgctggccctggacttgg

SEQ ID NO: 168892 - DNA, 20 bp, Artificial
  CRISPR gRNA sequence
ctgctggccctggacttgga

SEQ ID NO: 168893 - DNA, 20 bp, Artificial
  CRISPR gRNA sequence
ctggccctggacttggacag

SEQ ID NO: 168894 - DNA, 20 bp, Artificial
  CRISPR gRNA sequence
gccctggacttggacagcgg

SEQ ID NO: 168895 - DNA, 20 bp, Artificial
  CRISPR gRNA sequence
gacttggacagcggtgggtt

SEQ ID NO: 168896 - DNA, 20 bp, Artificial
  CRISPR gRNA sequence
ggacagcggtgggttgctga

SEQ ID NO: 168897 - DNA, 20 bp, Artificial
  CRISPR gRNA sequence
gacagcggtgggttgctgag

SEQ ID NO: 168898 - DNA, 20 bp, Artificial
  CRISPR gRNA sequence
ctgagccagcgtgaaatagt

SEQ ID NO: 168899 - DNA, 20 bp, Artificial
  CRISPR gRNA sequence
agccagcgtgaaatagtact

SEQ ID NO: 168900 - DNA, 20 bp, Artificial
  CRISPR gRNA sequence
gactggctcggcaggagtta

SEQ ID NO: 168901 - DNA, 20 bp, Artificial
  CRISPR gRNA sequence
gctcggcaggagttacagac

SEQ ID NO: 168902 - DNA, 20 bp, Artificial
  CRISPR gRNA sequence
ggcaggagttacagactggc

SEQ ID NO: 168903 - DNA, 20 bp, Artificial
  CRISPR gRNA sequence
cagactggcgcacctcctcc

SEQ ID NO: 168904 - DNA, 20 bp, Artificial
  CRISPR gRNA sequence
gcgcacctcctcctgttggg

SEQ ID NO: 168905 - DNA, 20 bp, Artificial
  CRISPR gRNA sequence
ctcctgttgggtggaaagag

SEQ ID NO: 168906 - DNA, 20 bp, Artificial
  CRISPR gRNA sequence
ctgttgggtggaaagagagg

SEQ ID NO: 168907 - DNA, 20 bp, Artificial
  CRISPR gRNA sequence
ttgggtggaaagagaggcag

SEQ ID NO: 168908 - DNA, 20 bp, Artificial
  CRISPR gRNA sequence
ggtggaaagagaggcaggta

SEQ ID NO: 168909 - DNA, 20 bp, Artificial
  CRISPR gRNA sequence
agcagccgccacagtgaatt

SEQ ID NO: 168910 - DNA, 20 bp, Artificial
  CRISPR gRNA sequence
ccactcttcccccaaacagg

SEQ ID NO: 168911 - DNA, 20 bp, Artificial
  CRISPR gRNA sequence
cactcttcccccaaacaggc

SEQ ID NO: 168912 - DNA, 20 bp, Artificial
  CRISPR gRNA sequence
ttcccccaaacaggctatgt

SEQ ID NO: 168913 - DNA, 20 bp, Artificial
  CRISPR gRNA sequence
cccccaaacaggctatgtgc

SEQ ID NO: 168914 - DNA, 20 bp, Artificial
  CRISPR gRNA sequence
ccccaaacaggctatgtgca

SEQ ID NO: 168915 - DNA, 20 bp, Artificial
  CRISPR gRNA sequence
tgtgcagttgcctgctgaat

SEQ ID NO: 168916 - DNA, 20 bp, Artificial
  CRISPR gRNA sequence
cctgctgaatgctgagctct

SEQ ID NO: 168917 - DNA, 20 bp, Artificial
  CRISPR gRNA sequence
ctgaatgctgagctctccac

SEQ ID NO: 168918 - DNA, 20 bp, Artificial
  CRISPR gRNA sequence
aatgctgagctctccacatt

SEQ ID NO: 168919 - DNA, 20 bp, Artificial
  CRISPR gRNA sequence
agctctccacatttgaagcc

SEQ ID NO: 168920 - DNA, 20 bp, Artificial
  CRISPR gRNA sequence
tccacatttgaagccaaagg

SEQ ID NO: 168921 - DNA, 20 bp, Artificial
  CRISPR gRNA sequence
cacatttgaagccaaaggaa

SEQ ID NO: 168922 - DNA, 20 bp, Artificial
  CRISPR gRNA sequence
gaagccaaaggaaagtggaa

SEQ ID NO: 168923 - DNA, 20 bp, Artificial
  CRISPR gRNA sequence
aagccaaaggaaagtggaat

SEQ ID NO: 168924 - DNA, 20 bp, Artificial
  CRISPR gRNA sequence
aaagagaccagttatgctaa

SEQ ID NO: 168925 - DNA, 20 bp, Artificial
  CRISPR gRNA sequence
tgctaaatcaaactaaaaat

SEQ ID NO: 168926 - DNA, 20 bp, Artificial
  CRISPR gRNA sequence
aatcaaactaaaaataacag

SEQ ID NO: 168927 - DNA, 20 bp, Artificial
  CRISPR gRNA sequence
aaaataacagatcctatagg

SEQ ID NO: 168928 - DNA, 20 bp, Artificial
  CRISPR gRNA sequence
taggcttcacaaaacataca

SEQ ID NO: 168929 - DNA, 20 bp, Artificial
  CRISPR gRNA sequence
cacaaaacatacagccaatt

SEQ ID NO: 168930 - DNA, 20 bp, Artificial
  CRISPR gRNA sequence
acaaaacatacagccaattt

SEQ ID NO: 168931 - DNA, 20 bp, Artificial
  CRISPR gRNA sequence
ctgaagtacgaaataatcac

SEQ ID NO: 168932 - DNA, 20 bp, Artificial
  CRISPR gRNA sequence
tgaagtacgaaataatcacc

SEQ ID NO: 168933 - DNA, 20 bp, Artificial
  CRISPR gRNA sequence
aagtacgaaataatcaccca

SEQ ID NO: 168934 - DNA, 20 bp, Artificial
  CRISPR gRNA sequence
catgataagttgcaaacggg

SEQ ID NO: 168935 - DNA, 20 bp, Artificial
  CRISPR gRNA sequence
caaacgggcaaataagtacc

SEQ ID NO: 168936 - DNA, 20 bp, Artificial
  CRISPR gRNA sequence
aaaaccacacaccagcagtg

SEQ ID NO: 168937 - DNA, 20 bp, Artificial
  CRISPR gRNA sequence
gtcagtaaatgctgtcaagg

SEQ ID NO: 168938 - DNA, 20 bp, Artificial
  CRISPR gRNA sequence
tcagtaaatgctgtcaaggc

SEQ ID NO: 168939 - DNA, 20 bp, Artificial
  CRISPR gRNA sequence
tcaaggcctgtgatctgaga

SEQ ID NO: 168940 - DNA, 20 bp, Artificial
  CRISPR gRNA sequence
tgatctgagaacagtgctaa

SEQ ID NO: 168941 - DNA, 20 bp, Artificial
  CRISPR gRNA sequence
agaacagtgctaattgcaag

SEQ ID NO: 168942 - DNA, 20 bp, Artificial
  CRISPR gRNA sequence
attgcaagtgttgggaagat

SEQ ID NO: 168943 - DNA, 20 bp, Artificial
  CRISPR gRNA sequence
caagtgttgggaagatgcta

SEQ ID NO: 168944 - DNA, 20 bp, Artificial
  CRISPR gRNA sequence
ggaagatgctacccaaacat

SEQ ID NO: 168945 - DNA, 20 bp, Artificial
  CRISPR gRNA sequence
cccaaacatcatgcctctca

SEQ ID NO: 168946 - DNA, 20 bp, Artificial
  CRISPR gRNA sequence
tcaggcctggtcccaatctc

SEQ ID NO: 168947 - DNA, 20 bp, Artificial
  CRISPR gRNA sequence
aggcctggtcccaatctccc

SEQ ID NO: 168948 - DNA, 20 bp, Artificial
  CRISPR gRNA sequence
gtcccaatctcccaaatagg

SEQ ID NO: 168949 - DNA, 20 bp, Artificial
  CRISPR gRNA sequence
ccaaataggcagcactcttc

SEQ ID NO: 168950 - DNA, 20 bp, Artificial
  CRISPR gRNA sequence
ttctcgttttagccccacca

SEQ ID NO: 168951 - DNA, 20 bp, Artificial
  CRISPR gRNA sequence
ctcgttttagccccaccact

SEQ ID NO: 168952 - DNA, 20 bp, Artificial
  CRISPR gRNA sequence
tcgttttagccccaccactt

SEQ ID NO: 168953 - DNA, 20 bp, Artificial
  CRISPR gRNA sequence
gttttagccccaccacttca

SEQ ID NO: 168954 - DNA, 20 bp, Artificial
  CRISPR gRNA sequence
tagccccaccacttcaaggg

SEQ ID NO: 168955 - DNA, 20 bp, Artificial
  CRISPR gRNA sequence
agccccaccacttcaagggg

SEQ ID NO: 168956 - DNA, 20 bp, Artificial
  CRISPR gRNA sequence
gccccaccacttcaaggggg

SEQ ID NO: 168957 - DNA, 20 bp, Artificial
  CRISPR gRNA sequence
caagggggacagaacaggtt

SEQ ID NO: 168958 - DNA, 20 bp, Artificial
  CRISPR gRNA sequence
aagggggacagaacaggtta

SEQ ID NO: 168959 - DNA, 20 bp, Artificial
  CRISPR gRNA sequence
atgggaaacagggcttttcc

SEQ ID NO: 168960 - DNA, 20 bp, Artificial
  CRISPR gRNA sequence
ttcctgagctgaaatttcag

SEQ ID NO: 168961 - DNA, 20 bp, Artificial
  CRISPR gRNA sequence
tcctgagctgaaatttcagg

SEQ ID NO: 168962 - DNA, 20 bp, Artificial
  CRISPR gRNA sequence
cctgagctgaaatttcagga

SEQ ID NO: 168963 - DNA, 20 bp, Artificial
  CRISPR gRNA sequence
ctgagctgaaatttcaggat

SEQ ID NO: 168964 - DNA, 20 bp, Artificial
  CRISPR gRNA sequence
agctgaaatttcaggatcga

SEQ ID NO: 168965 - DNA, 20 bp, Artificial
  CRISPR gRNA sequence
aaatttcaggatcgagagca

SEQ ID NO: 168966 - DNA, 20 bp, Artificial
  CRISPR gRNA sequence
caggatcgagagcactggta

SEQ ID NO: 168967 - DNA, 20 bp, Artificial
  CRISPR gRNA sequence
aggatcgagagcactggtag

SEQ ID NO: 168968 - DNA, 20 bp, Artificial
  CRISPR gRNA sequence
gtaggcaagtacccagcttt

SEQ ID NO: 168969 - DNA, 20 bp, Artificial
  CRISPR gRNA sequence
ttcacagcttgttgaaagct

SEQ ID NO: 168970 - DNA, 20 bp, Artificial
  CRISPR gRNA sequence
tcacagcttgttgaaagctc

SEQ ID NO: 168971 - DNA, 20 bp, Artificial
  CRISPR gRNA sequence
cacagcttgttgaaagctct

SEQ ID NO: 168972 - DNA, 20 bp, Artificial
  CRISPR gRNA sequence
acagcttgttgaaagctctg

SEQ ID NO: 168973 - DNA, 20 bp, Artificial
  CRISPR gRNA sequence
gttgaaagctctgtggtcac

SEQ ID NO: 168974 - DNA, 20 bp, Artificial
  CRISPR gRNA sequence
ttgaaagctctgtggtcact

SEQ ID NO: 168975 - DNA, 20 bp, Artificial
  CRISPR gRNA sequence
aaagctctgtggtcactgag

SEQ ID NO: 168976 - DNA, 20 bp, Artificial
  CRISPR gRNA sequence
tgtggtcactgagggcatgt

SEQ ID NO: 168977 - DNA, 20 bp, Artificial
  CRISPR gRNA sequence
tggtcactgagggcatgtct

SEQ ID NO: 168978 - DNA, 20 bp, Artificial
  CRISPR gRNA sequence
agggcatgtctatccagtgt

SEQ ID NO: 168979 - DNA, 20 bp, Artificial
  CRISPR gRNA sequence
tccagtgtcacatctggttc

SEQ ID NO: 168980 - DNA, 20 bp, Artificial
  CRISPR gRNA sequence
gttctggttgtacttagcca

SEQ ID NO: 168981 - DNA, 20 bp, Artificial
  CRISPR gRNA sequence
tggttgtacttagccacaga

SEQ ID NO: 168982 - DNA, 20 bp, Artificial
  CRISPR gRNA sequence
gttgtacttagccacagaag

SEQ ID NO: 168983 - DNA, 20 bp, Artificial
  CRISPR gRNA sequence
tacttagccacagaagcgca

SEQ ID NO: 168984 - DNA, 20 bp, Artificial
  CRISPR gRNA sequence
agccacagaagcgcaaccca

SEQ ID NO: 168985 - DNA, 20 bp, Artificial
  CRISPR gRNA sequence
gccacagaagcgcaacccag

SEQ ID NO: 168986 - DNA, 20 bp, Artificial
  CRISPR gRNA sequence
atggacagctctccgctggg

SEQ ID NO: 168987 - DNA, 20 bp, Artificial
  CRISPR gRNA sequence
tccgctggggtactgccttg

SEQ ID NO: 168988 - DNA, 20 bp, Artificial
  CRISPR gRNA sequence
cgctggggtactgccttggc

SEQ ID NO: 168989 - DNA, 20 bp, Artificial
  CRISPR gRNA sequence
gggtactgccttggctgatt

SEQ ID NO: 168990 - DNA, 20 bp, Artificial
  CRISPR gRNA sequence
ccttggctgattagggaggt

SEQ ID NO: 168991 - DNA, 20 bp, Artificial
  CRISPR gRNA sequence
ggctgattagggaggtcgca

SEQ ID NO: 168992 - DNA, 20 bp, Artificial
  CRISPR gRNA sequence
gctgattagggaggtcgcat

SEQ ID NO: 168993 - DNA, 20 bp, Artificial
  CRISPR gRNA sequence
attagggaggtcgcattctg

SEQ ID NO: 168994 - DNA, 20 bp, Artificial
  CRISPR gRNA sequence
gggaggtcgcattctgtccg

SEQ ID NO: 168995 - DNA, 20 bp, Artificial
  CRISPR gRNA sequence
tgtccgatctgcggagtgga

SEQ ID NO: 168996 - DNA, 20 bp, Artificial
  CRISPR gRNA sequence
tccgatctgcggagtggaga

SEQ ID NO: 168997 - DNA, 20 bp, Artificial
  CRISPR gRNA sequence
cggagtggagactgttcctt

SEQ ID NO: 168998 - DNA, 20 bp, Artificial
  CRISPR gRNA sequence
ttccttcttcagctgatgtt

SEQ ID NO: 168999 - DNA, 20 bp, Artificial
  CRISPR gRNA sequence
cttcttcagctgatgttttc

SEQ ID NO: 169000 - DNA, 20 bp, Artificial
  CRISPR gRNA sequence
cttcagctgatgttttccat

SEQ ID NO: 169001 - DNA, 20 bp, Artificial
  CRISPR gRNA sequence
ttcagctgatgttttccatg

SEQ ID NO: 169002 - DNA, 20 bp, Artificial
  CRISPR gRNA sequence
cagctgatgttttccatggc

SEQ ID NO: 169003 - DNA, 20 bp, Artificial
  CRISPR gRNA sequence
agctgatgttttccatggca

SEQ ID NO: 169004 - DNA, 20 bp, Artificial
  CRISPR gRNA sequence
atgttttccatggcagaagg

SEQ ID NO: 169005 - DNA, 20 bp, Artificial
  CRISPR gRNA sequence
tccatggcagaaggagtaaa

SEQ ID NO: 169006 - DNA, 20 bp, Artificial
  CRISPR gRNA sequence
ccatggcagaaggagtaaac

SEQ ID NO: 169007 - DNA, 20 bp, Artificial
  CRISPR gRNA sequence
catggcagaaggagtaaaca

SEQ ID NO: 169008 - DNA, 20 bp, Artificial
  CRISPR gRNA sequence
tcccagccaccttgagctca

SEQ ID NO: 169009 - DNA, 20 bp, Artificial
  CRISPR gRNA sequence
ccagccaccttgagctcaca

SEQ ID NO: 169010 - DNA, 20 bp, Artificial
  CRISPR gRNA sequence
gagctcacagctgagagtgt

SEQ ID NO: 169011 - DNA, 20 bp, Artificial
  CRISPR gRNA sequence
agctcacagctgagagtgta

SEQ ID NO: 169012 - DNA, 20 bp, Artificial
  CRISPR gRNA sequence
acagctgagagtgtaggatg

SEQ ID NO: 169013 - DNA, 20 bp, Artificial
  CRISPR gRNA sequence
agagtgtaggatgtttacac

SEQ ID NO: 169014 - DNA, 20 bp, Artificial
  CRISPR gRNA sequence
acacacactacagcatggtt

SEQ ID NO: 169015 - DNA, 20 bp, Artificial
  CRISPR gRNA sequence
cacacactacagcatggtta

SEQ ID NO: 169016 - DNA, 20 bp, Artificial
  CRISPR gRNA sequence
cagcatggttatagcccaca

SEQ ID NO: 169017 - DNA, 20 bp, Artificial
  CRISPR gRNA sequence
tagcccacagggtccagggt

SEQ ID NO: 169018 - DNA, 20 bp, Artificial
  CRISPR gRNA sequence
atcagcccctgaccactgac

SEQ ID NO: 169019 - DNA, 20 bp, Artificial
  CRISPR gRNA sequence
accactgacacagaacggcg

SEQ ID NO: 169020 - DNA, 20 bp, Artificial
  CRISPR gRNA sequence
acacagaacggcgtctgatc

SEQ ID NO: 169021 - DNA, 20 bp, Artificial
  CRISPR gRNA sequence
atccggagtgacctgtgtga

SEQ ID NO: 169022 - DNA, 20 bp, Artificial
  CRISPR gRNA sequence
tgtgacacatggtgcccctg

SEQ ID NO: 169023 - DNA, 20 bp, Artificial
  CRISPR gRNA sequence
cctgggacaacaaaaacaat

SEQ ID NO: 169024 - DNA, 20 bp, Artificial
  CRISPR gRNA sequence
ggacaacaaaaacaataaaa

SEQ ID NO: 169025 - DNA, 20 bp, Artificial
  CRISPR gRNA sequence
gggctggctgagtaaaaata

SEQ ID NO: 169026 - DNA, 20 bp, Artificial
  CRISPR gRNA sequence
ggctggctgagtaaaaatat

SEQ ID NO: 169027 - DNA, 20 bp, Artificial
  CRISPR gRNA sequence
gctgagtaaaaatattagct

SEQ ID NO: 169028 - DNA, 20 bp, Artificial
  CRISPR gRNA sequence
agtaaaaatattagctaaat

SEQ ID NO: 169029 - DNA, 20 bp, Artificial
  CRISPR gRNA sequence
gctaaatttactcatgtcct

SEQ ID NO: 169030 - DNA, 20 bp, Artificial
  CRISPR gRNA sequence
aatttactcatgtccttatt

SEQ ID NO: 169031 - DNA, 20 bp, Artificial
  CRISPR gRNA sequence
actcatgtccttattcaggg

SEQ ID NO: 169032 - DNA, 20 bp, Artificial
  CRISPR gRNA sequence
ctcatgtccttattcagggc

SEQ ID NO: 169033 - DNA, 20 bp, Artificial
  CRISPR gRNA sequence
atgtccttattcagggcaaa

SEQ ID NO: 169034 - DNA, 20 bp, Artificial
  CRISPR gRNA sequence
attcagggcaaagtttgcca

SEQ ID NO: 169035 - DNA, 20 bp, Artificial
  CRISPR gRNA sequence
ttcagggcaaagtttgccac

SEQ ID NO: 169036 - DNA, 20 bp, Artificial
  CRISPR gRNA sequence
agggcaaagtttgccacgtt

SEQ ID NO: 169037 - DNA, 20 bp, Artificial
  CRISPR gRNA sequence
gccacgttccagaaaagagg

SEQ ID NO: 169038 - DNA, 20 bp, Artificial
  CRISPR gRNA sequence
ccacgttccagaaaagagga

SEQ ID NO: 169039 - DNA, 20 bp, Artificial
  CRISPR gRNA sequence
cagaaaagaggaaaagacac

SEQ ID NO: 169040 - DNA, 20 bp, Artificial
  CRISPR gRNA sequence
cttagatgtacacagaccct

SEQ ID NO: 169041 - DNA, 20 bp, Artificial
  CRISPR gRNA sequence
ttagatgtacacagaccctg

SEQ ID NO: 169042 - DNA, 20 bp, Artificial
  CRISPR gRNA sequence
agatgtacacagaccctgtg

SEQ ID NO: 169043 - DNA, 20 bp, Artificial
  CRISPR gRNA sequence
gatgtacacagaccctgtgg

SEQ ID NO: 169044 - DNA, 20 bp, Artificial
  CRISPR gRNA sequence
tggattgcctccaactcccc

SEQ ID NO: 169045 - DNA, 20 bp, Artificial
  CRISPR gRNA sequence
cctccaactccccaaagtaa

SEQ ID NO: 169046 - DNA, 20 bp, Artificial
  CRISPR gRNA sequence
caactccccaaagtaacatt

SEQ ID NO: 169047 - DNA, 20 bp, Artificial
  CRISPR gRNA sequence
cccaaagtaacatttacaaa

SEQ ID NO: 169048 - DNA, 20 bp, Artificial
  CRISPR gRNA sequence
acaaagctggtattgacccc

SEQ ID NO: 169049 - DNA, 20 bp, Artificial
  CRISPR gRNA sequence
caaagctggtattgacccca

SEQ ID NO: 169050 - DNA, 20 bp, Artificial
  CRISPR gRNA sequence
gtattgaccccatccccaca

SEQ ID NO: 169051 - DNA, 20 bp, Artificial
  CRISPR gRNA sequence
accccatccccacactatgt

SEQ ID NO: 169052 - DNA, 20 bp, Artificial
  CRISPR gRNA sequence
tgttaggtgccctcaactgt

SEQ ID NO: 169053 - DNA, 20 bp, Artificial
  CRISPR gRNA sequence
ggtgccctcaactgtgcttc

SEQ ID NO: 169054 - DNA, 20 bp, Artificial
  CRISPR gRNA sequence
aactgtgcttccaaagtact

SEQ ID NO: 169055 - DNA, 20 bp, Artificial
  CRISPR gRNA sequence
tgcttccaaagtactgtcct

SEQ ID NO: 169056 - DNA, 20 bp, Artificial
  CRISPR gRNA sequence
ccaaagtactgtcctcacag

SEQ ID NO: 169057 - DNA, 20 bp, Artificial
  CRISPR gRNA sequence
caaagtactgtcctcacagt

SEQ ID NO: 169058 - DNA, 20 bp, Artificial
  CRISPR gRNA sequence
tcctcacagtatacattttt

SEQ ID NO: 169059 - DNA, 20 bp, Artificial
  CRISPR gRNA sequence
acagtatacatttttgcact

SEQ ID NO: 169060 - DNA, 20 bp, Artificial
  CRISPR gRNA sequence
ttgcacttgcatgtcaaatt

SEQ ID NO: 169061 - DNA, 20 bp, Artificial
  CRISPR gRNA sequence
tgcacttgcatgtcaaatta

SEQ ID NO: 169062 - DNA, 20 bp, Artificial
  CRISPR gRNA sequence
gcacttgcatgtcaaattaa

SEQ ID NO: 169063 - DNA, 20 bp, Artificial
  CRISPR gRNA sequence
cacttgcatgtcaaattaac

SEQ ID NO: 169064 - DNA, 20 bp, Artificial
  CRISPR gRNA sequence
gcatgtcaaattaactgtct

SEQ ID NO: 169065 - DNA, 20 bp, Artificial
  CRISPR gRNA sequence
catgtcaaattaactgtctg

SEQ ID NO: 169066 - DNA, 20 bp, Artificial
  CRISPR gRNA sequence
actgtctgttctactaaaat

SEQ ID NO: 169067 - DNA, 20 bp, Artificial
  CRISPR gRNA sequence
tctgttctactaaaatgtta

SEQ ID NO: 169068 - DNA, 20 bp, Artificial
  CRISPR gRNA sequence
ttctactaaaatgttaagca

SEQ ID NO: 169069 - DNA, 20 bp, Artificial
  CRISPR gRNA sequence
tactaaaatgttaagcacca

SEQ ID NO: 169070 - DNA, 20 bp, Artificial
  CRISPR gRNA sequence
ctaaaatgttaagcaccatg

SEQ ID NO: 169071 - DNA, 20 bp, Artificial
  CRISPR gRNA sequence
aaatgttaagcaccatgagg

SEQ ID NO: 169072 - DNA, 20 bp, Artificial
  CRISPR gRNA sequence
agcaccatgagggcaaagcc

SEQ ID NO: 169073 - DNA, 20 bp, Artificial
  CRISPR gRNA sequence
gctctctcttgctctctgct

SEQ ID NO: 169074 - DNA, 20 bp, Artificial
  CRISPR gRNA sequence
tctcttgctctctgctatcc

SEQ ID NO: 169075 - DNA, 20 bp, Artificial
  CRISPR gRNA sequence
tcttgctctctgctatcccc

SEQ ID NO: 169076 - DNA, 20 bp, Artificial
  CRISPR gRNA sequence
ttgctctctgctatcccccg

SEQ ID NO: 169077 - DNA, 20 bp, Artificial
  CRISPR gRNA sequence
gctctctgctatcccccgcg

SEQ ID NO: 169078 - DNA, 20 bp, Artificial
  CRISPR gRNA sequence
ctctctgctatcccccgcgt

SEQ ID NO: 169079 - DNA, 20 bp, Artificial
  CRISPR gRNA sequence
tctgctatcccccgcgttcc

SEQ ID NO: 169080 - DNA, 20 bp, Artificial
  CRISPR gRNA sequence
tgctatcccccgcgttccca

SEQ ID NO: 169081 - DNA, 20 bp, Artificial
  CRISPR gRNA sequence
ctatcccccgcgttcccagg

SEQ ID NO: 169082 - DNA, 20 bp, Artificial
  CRISPR gRNA sequence
tcccccgcgttcccaggtag

SEQ ID NO: 169083 - DNA, 20 bp, Artificial
  CRISPR gRNA sequence
ccaggtaggcactcagtaag

SEQ ID NO: 169084 - DNA, 20 bp, Artificial
  CRISPR gRNA sequence
agtaagtgcgtgatgaatga

SEQ ID NO: 169085 - DNA, 20 bp, Artificial
  CRISPR gRNA sequence
agacaggcagacagttagag

SEQ ID NO: 169086 - DNA, 20 bp, Artificial
  CRISPR gRNA sequence
gacaggcagacagttagagg

SEQ ID NO: 169087 - DNA, 20 bp, Artificial
  CRISPR gRNA sequence
gaggcaggaaagtagttctc

SEQ ID NO: 169088 - DNA, 20 bp, Artificial
  CRISPR gRNA sequence
tctgaatccaacttgctgat

SEQ ID NO: 169089 - DNA, 20 bp, Artificial
  CRISPR gRNA sequence
tgaatccaacttgctgatat

SEQ ID NO: 169090 - DNA, 20 bp, Artificial
  CRISPR gRNA sequence
aatccaacttgctgatatga

SEQ ID NO: 169091 - DNA, 20 bp, Artificial
  CRISPR gRNA sequence
gctgatatgacaaattctct

SEQ ID NO: 169092 - DNA, 20 bp, Artificial
  CRISPR gRNA sequence
ctgatatgacaaattctctt

SEQ ID NO: 169093 - DNA, 20 bp, Artificial
  CRISPR gRNA sequence
atatgacaaattctcttaaa

SEQ ID NO: 169094 - DNA, 20 bp, Artificial
  CRISPR gRNA sequence
tcttaaacccaacagctgtt

SEQ ID NO: 169095 - DNA, 20 bp, Artificial
  CRISPR gRNA sequence
ttaaacccaacagctgttac

SEQ ID NO: 169096 - DNA, 20 bp, Artificial
  CRISPR gRNA sequence
aaacccaacagctgttacca

SEQ ID NO: 169097 - DNA, 20 bp, Artificial
  CRISPR gRNA sequence
aacccaacagctgttaccaa

SEQ ID NO: 169098 - DNA, 20 bp, Artificial
  CRISPR gRNA sequence
ttaccaatagaaaaaagtag

SEQ ID NO: 169099 - DNA, 20 bp, Artificial
  CRISPR gRNA sequence
ccaatagaaaaaagtagtct

SEQ ID NO: 169100 - DNA, 20 bp, Artificial
  CRISPR gRNA sequence
taaactctcttttggtacct

SEQ ID NO: 169101 - DNA, 20 bp, Artificial
  CRISPR gRNA sequence
aactctcttttggtacctct

SEQ ID NO: 169102 - DNA, 20 bp, Artificial
  CRISPR gRNA sequence
tcttttggtacctctaagac

SEQ ID NO: 169103 - DNA, 20 bp, Artificial
  CRISPR gRNA sequence
ttttggtacctctaagactc

SEQ ID NO: 169104 - DNA, 20 bp, Artificial
  CRISPR gRNA sequence
ttggtacctctaagactctg

SEQ ID NO: 169105 - DNA, 20 bp, Artificial
  CRISPR gRNA sequence
tggtacctctaagactctgt

SEQ ID NO: 169106 - DNA, 20 bp, Artificial
  CRISPR gRNA sequence
ggtacctctaagactctgtg

SEQ ID NO: 169107 - DNA, 20 bp, Artificial
  CRISPR gRNA sequence
gtacctctaagactctgtgg

SEQ ID NO: 169108 - DNA, 20 bp, Artificial
  CRISPR gRNA sequence
taagactctgtggccacagt

SEQ ID NO: 169109 - DNA, 20 bp, Artificial
  CRISPR gRNA sequence
agactctgtggccacagtgt

SEQ ID NO: 169110 - DNA, 20 bp, Artificial
  CRISPR gRNA sequence
tgtggccacagtgtgaggaa

SEQ ID NO: 169111 - DNA, 20 bp, Artificial
  CRISPR gRNA sequence
tggccacagtgtgaggaagc

SEQ ID NO: 169112 - DNA, 20 bp, Artificial
  CRISPR gRNA sequence
gtgtcccctgtggaacagag

SEQ ID NO: 169113 - DNA, 20 bp, Artificial
  CRISPR gRNA sequence
tggaacagagctgagtatcc

SEQ ID NO: 169114 - DNA, 20 bp, Artificial
  CRISPR gRNA sequence
agtatcctttgtttgcctga

SEQ ID NO: 169115 - DNA, 20 bp, Artificial
  CRISPR gRNA sequence
tgtttgcctgatgtctgggg

SEQ ID NO: 169116 - DNA, 20 bp, Artificial
  CRISPR gRNA sequence
gtttgcctgatgtctggggg

SEQ ID NO: 169117 - DNA, 20 bp, Artificial
  CRISPR gRNA sequence
tttgcctgatgtctgggggc

SEQ ID NO: 169118 - DNA, 20 bp, Artificial
  CRISPR gRNA sequence
gcctgatgtctgggggctag

SEQ ID NO: 169119 - DNA, 20 bp, Artificial
  CRISPR gRNA sequence
cctgatgtctgggggctagg

SEQ ID NO: 169120 - DNA, 20 bp, Artificial
  CRISPR gRNA sequence
atgtctgggggctaggatac

SEQ ID NO: 169121 - DNA, 20 bp, Artificial
  CRISPR gRNA sequence
ggggctaggatactaaaact

SEQ ID NO: 169122 - DNA, 20 bp, Artificial
  CRISPR gRNA sequence
ggatactaaaactaggactg

SEQ ID NO: 169123 - DNA, 20 bp, Artificial
  CRISPR gRNA sequence
aaactaggactgccagtatc

SEQ ID NO: 169124 - DNA, 20 bp, Artificial
  CRISPR gRNA sequence
ggactgccagtatctacccc

SEQ ID NO: 169125 - DNA, 20 bp, Artificial
  CRISPR gRNA sequence
ccagtatctacccctgagaa

SEQ ID NO: 169126 - DNA, 20 bp, Artificial
  CRISPR gRNA sequence
cccctgagaaacatgggtct

SEQ ID NO: 169127 - DNA, 20 bp, Artificial
  CRISPR gRNA sequence
agaaacatgggtctctgcat

SEQ ID NO: 169128 - DNA, 20 bp, Artificial
  CRISPR gRNA sequence
tgcatgacatggttacttga

SEQ ID NO: 169129 - DNA, 20 bp, Artificial
  CRISPR gRNA sequence
catgacatggttacttgaca

SEQ ID NO: 169130 - DNA, 20 bp, Artificial
  CRISPR gRNA sequence
cttgacagccatctacccag

SEQ ID NO: 169131 - DNA, 20 bp, Artificial
  CRISPR gRNA sequence
gacagccatctacccagctt

SEQ ID NO: 169132 - DNA, 20 bp, Artificial
  CRISPR gRNA sequence
acagccatctacccagctta

SEQ ID NO: 169133 - DNA, 20 bp, Artificial
  CRISPR gRNA sequence
cccagcttagggagatacct

SEQ ID NO: 169134 - DNA, 20 bp, Artificial
  CRISPR gRNA sequence
agggagatacctgtaacatt

SEQ ID NO: 169135 - DNA, 20 bp, Artificial
  CRISPR gRNA sequence
gggagatacctgtaacattc

SEQ ID NO: 169136 - DNA, 20 bp, Artificial
  CRISPR gRNA sequence
taacattctgggtttctaag

SEQ ID NO: 169137 - DNA, 20 bp, Artificial
  CRISPR gRNA sequence
tgggtttctaagttaatata

SEQ ID NO: 169138 - DNA, 20 bp, Artificial
  CRISPR gRNA sequence
ggtttctaagttaatatatg

SEQ ID NO: 169139 - DNA, 20 bp, Artificial
  CRISPR gRNA sequence
ctaagttaatatatgaactg

SEQ ID NO: 169140 - DNA, 20 bp, Artificial
  CRISPR gRNA sequence
taagttaatatatgaactga

SEQ ID NO: 169141 - DNA, 20 bp, Artificial
  CRISPR gRNA sequence
agttaatatatgaactgact

SEQ ID NO: 169142 - DNA, 20 bp, Artificial
  CRISPR gRNA sequence
atatatgaactgacttttta

SEQ ID NO: 169143 - DNA, 20 bp, Artificial
  CRISPR gRNA sequence
actttttaggttgatatagt

SEQ ID NO: 169144 - DNA, 20 bp, Artificial
  CRISPR gRNA sequence
tttaggttgatatagtctgt

SEQ ID NO: 169145 - DNA, 20 bp, Artificial
  CRISPR gRNA sequence
ttaggttgatatagtctgtg

SEQ ID NO: 169146 - DNA, 20 bp, Artificial
  CRISPR gRNA sequence
taggttgatatagtctgtgc

SEQ ID NO: 169147 - DNA, 20 bp, Artificial
  CRISPR gRNA sequence
aggttgatatagtctgtgct

SEQ ID NO: 169148 - DNA, 20 bp, Artificial
  CRISPR gRNA sequence
ggttgatatagtctgtgctt

SEQ ID NO: 169149 - DNA, 20 bp, Artificial
  CRISPR gRNA sequence
atatagtctgtgcttcagac

SEQ ID NO: 169150 - DNA, 20 bp, Artificial
  CRISPR gRNA sequence
tgcttcagacacaaatagtt

SEQ ID NO: 169151 - DNA, 20 bp, Artificial
  CRISPR gRNA sequence
cagacacaaatagttttaac

SEQ ID NO: 169152 - DNA, 20 bp, Artificial
  CRISPR gRNA sequence
agacacaaatagttttaacc

SEQ ID NO: 169153 - DNA, 20 bp, Artificial
  CRISPR gRNA sequence
taaccctcaatatgattatg

SEQ ID NO: 169154 - DNA, 20 bp, Artificial
  CRISPR gRNA sequence
aaccctcaatatgattatgc

SEQ ID NO: 169155 - DNA, 20 bp, Artificial
  CRISPR gRNA sequence
accctcaatatgattatgct

SEQ ID NO: 169156 - DNA, 20 bp, Artificial
  CRISPR gRNA sequence
aatatgattatgctaaggca

SEQ ID NO: 169157 - DNA, 20 bp, Artificial
  CRISPR gRNA sequence
tgctaaggcagaaggaaaag

SEQ ID NO: 169158 - DNA, 20 bp, Artificial
  CRISPR gRNA sequence
aggcagaaggaaaaggagat

SEQ ID NO: 169159 - DNA, 20 bp, Artificial
  CRISPR gRNA sequence
ccttttattttcatctaggt

SEQ ID NO: 169160 - DNA, 20 bp, Artificial
  CRISPR gRNA sequence
ttattttcatctaggtctca

SEQ ID NO: 169161 - DNA, 20 bp, Artificial
  CRISPR gRNA sequence
tattttcatctaggtctcaa

SEQ ID NO: 169162 - DNA, 20 bp, Artificial
  CRISPR gRNA sequence
attttcatctaggtctcaat

SEQ ID NO: 169163 - DNA, 20 bp, Artificial
  CRISPR gRNA sequence
ttttcatctaggtctcaatt

SEQ ID NO: 169164 - DNA, 20 bp, Artificial
  CRISPR gRNA sequence
tcatctaggtctcaatttcc

SEQ ID NO: 169165 - DNA, 20 bp, Artificial
  CRISPR gRNA sequence
catctaggtctcaatttcca

SEQ ID NO: 169166 - DNA, 20 bp, Artificial
  CRISPR gRNA sequence
atctaggtctcaatttccac

SEQ ID NO: 169167 - DNA, 20 bp, Artificial
  CRISPR gRNA sequence
ggtctcaatttccacaacaa

SEQ ID NO: 169168 - DNA, 20 bp, Artificial
  CRISPR gRNA sequence
aatttccacaacaatttcaa

SEQ ID NO: 169169 - DNA, 20 bp, Artificial
  CRISPR gRNA sequence
ccacaacaatttcaacccca

SEQ ID NO: 169170 - DNA, 20 bp, Artificial
  CRISPR gRNA sequence
cacaacaatttcaaccccaa

SEQ ID NO: 169171 - DNA, 20 bp, Artificial
  CRISPR gRNA sequence
caaccccaacttatcatcat

SEQ ID NO: 169172 - DNA, 20 bp, Artificial
  CRISPR gRNA sequence
aaccccaacttatcatcatt

SEQ ID NO: 169173 - DNA, 20 bp, Artificial
  CRISPR gRNA sequence
atcatcattataaataaatg

SEQ ID NO: 169174 - DNA, 20 bp, Artificial
  CRISPR gRNA sequence
tcatcattataaataaatgt

SEQ ID NO: 169175 - DNA, 20 bp, Artificial
  CRISPR gRNA sequence
taaataaatgtcagcctgga

SEQ ID NO: 169176 - DNA, 20 bp, Artificial
  CRISPR gRNA sequence
gaaactaggtattggctgtg

SEQ ID NO: 169177 - DNA, 20 bp, Artificial
  CRISPR gRNA sequence
ggtattggctgtggcaaagc

SEQ ID NO: 169178 - DNA, 20 bp, Artificial
  CRISPR gRNA sequence
gctgtggcaaagctaaaata

SEQ ID NO: 169179 - DNA, 20 bp, Artificial
  CRISPR gRNA sequence
tggcaaagctaaaatactga

SEQ ID NO: 169180 - DNA, 20 bp, Artificial
  CRISPR gRNA sequence
aaatactgataccttttgca

SEQ ID NO: 169181 - DNA, 20 bp, Artificial
  CRISPR gRNA sequence
ataccttttgcagccaagaa

SEQ ID NO: 169182 - DNA, 20 bp, Artificial
  CRISPR gRNA sequence
ttgcagccaagaaacagaag

SEQ ID NO: 169183 - DNA, 20 bp, Artificial
  CRISPR gRNA sequence
tgcagccaagaaacagaagc

SEQ ID NO: 169184 - DNA, 20 bp, Artificial
  CRISPR gRNA sequence
gcagccaagaaacagaagcc

SEQ ID NO: 169185 - DNA, 20 bp, Artificial
  CRISPR gRNA sequence
cagccaagaaacagaagcca

SEQ ID NO: 169186 - DNA, 20 bp, Artificial
  CRISPR gRNA sequence
ctctttgcaaagctattgaa

SEQ ID NO: 169187 - DNA, 20 bp, Artificial
  CRISPR gRNA sequence
tttgcaaagctattgaagta

SEQ ID NO: 169188 - DNA, 20 bp, Artificial
  CRISPR gRNA sequence
tgcaaagctattgaagtagg

SEQ ID NO: 169189 - DNA, 20 bp, Artificial
  CRISPR gRNA sequence
gcaaagctattgaagtaggt

SEQ ID NO: 169190 - DNA, 20 bp, Artificial
  CRISPR gRNA sequence
caaagctattgaagtaggtt

SEQ ID NO: 169191 - DNA, 20 bp, Artificial
  CRISPR gRNA sequence
ttgaagtaggttcaaggtac

SEQ ID NO: 169192 - DNA, 20 bp, Artificial
  CRISPR gRNA sequence
aagtaggttcaaggtacttg

SEQ ID NO: 169193 - DNA, 20 bp, Artificial
  CRISPR gRNA sequence
aaggtacttgtgttccactg

SEQ ID NO: 169194 - DNA, 20 bp, Artificial
  CRISPR gRNA sequence
gtgttccactgagatctccc

SEQ ID NO: 169195 - DNA, 20 bp, Artificial
  CRISPR gRNA sequence
tgttccactgagatctccct

SEQ ID NO: 169196 - DNA, 20 bp, Artificial
  CRISPR gRNA sequence
cactgagatctcccttatta

SEQ ID NO: 169197 - DNA, 20 bp, Artificial
  CRISPR gRNA sequence
agatctcccttattatttta

SEQ ID NO: 169198 - DNA, 20 bp, Artificial
  CRISPR gRNA sequence
ccttattattttacaaaaag

SEQ ID NO: 169199 - DNA, 20 bp, Artificial
  CRISPR gRNA sequence
attattttacaaaaagcaca

SEQ ID NO: 169200 - DNA, 20 bp, Artificial
  CRISPR gRNA sequence
ttattttacaaaaagcacaa

SEQ ID NO: 169201 - DNA, 20 bp, Artificial
  CRISPR gRNA sequence
ttttacaaaaagcacaaatc

SEQ ID NO: 169202 - DNA, 20 bp, Artificial
  CRISPR gRNA sequence
tacaaaaagcacaaatcact

SEQ ID NO: 169203 - DNA, 20 bp, Artificial
  CRISPR gRNA sequence
acaaaaagcacaaatcactg

SEQ ID NO: 169204 - DNA, 20 bp, Artificial
  CRISPR gRNA sequence
caaaaagcacaaatcactga

SEQ ID NO: 169205 - DNA, 20 bp, Artificial
  CRISPR gRNA sequence
aaatccagacctaacttgga

SEQ ID NO: 169206 - DNA, 20 bp, Artificial
  CRISPR gRNA sequence
acttggaaaagctcttgggt

SEQ ID NO: 169207 - DNA, 20 bp, Artificial
  CRISPR gRNA sequence
ggaaaagctcttgggtaatg

SEQ ID NO: 169208 - DNA, 20 bp, Artificial
  CRISPR gRNA sequence
gaaaagctcttgggtaatga

SEQ ID NO: 169209 - DNA, 20 bp, Artificial
  CRISPR gRNA sequence
ttgggtaatgagagggtata

SEQ ID NO: 169210 - DNA, 20 bp, Artificial
  CRISPR gRNA sequence
gggtaatgagagggtataca

SEQ ID NO: 169211 - DNA, 20 bp, Artificial
  CRISPR gRNA sequence
ggtaatgagagggtatacag

SEQ ID NO: 169212 - DNA, 20 bp, Artificial
  CRISPR gRNA sequence
agaaccagctgtgtaggaag

SEQ ID NO: 169213 - DNA, 20 bp, Artificial
  CRISPR gRNA sequence
tgtaggaagctaggcagcag

SEQ ID NO: 169214 - DNA, 20 bp, Artificial
  CRISPR gRNA sequence
ggcagcagggagacacctgc

SEQ ID NO: 169215 - DNA, 20 bp, Artificial
  CRISPR gRNA sequence
cattttctagccgtgacctg

SEQ ID NO: 169216 - DNA, 20 bp, Artificial
  CRISPR gRNA sequence
tctagccgtgacctgtgatt

SEQ ID NO: 169217 - DNA, 20 bp, Artificial
  CRISPR gRNA sequence
ctagccgtgacctgtgattg

SEQ ID NO: 169218 - DNA, 20 bp, Artificial
  CRISPR gRNA sequence
tagccgtgacctgtgattgt

SEQ ID NO: 169219 - DNA, 20 bp, Artificial
  CRISPR gRNA sequence
gccgtgacctgtgattgttt

SEQ ID NO: 169220 - DNA, 20 bp, Artificial
  CRISPR gRNA sequence
tgattgtttagtctccagtt

SEQ ID NO: 169221 - DNA, 20 bp, Artificial
  CRISPR gRNA sequence
tttagtctccagttatcccc

SEQ ID NO: 169222 - DNA, 20 bp, Artificial
  CRISPR gRNA sequence
agtctccagttatccccaac

SEQ ID NO: 169223 - DNA, 20 bp, Artificial
  CRISPR gRNA sequence
gtctccagttatccccaact

SEQ ID NO: 169224 - DNA, 20 bp, Artificial
  CRISPR gRNA sequence
cagttatccccaactacagc

SEQ ID NO: 169225 - DNA, 20 bp, Artificial
  CRISPR gRNA sequence
tccccaactacagctgatct

SEQ ID NO: 169226 - DNA, 20 bp, Artificial
  CRISPR gRNA sequence
cagctgatctagtattgaat

SEQ ID NO: 169227 - DNA, 20 bp, Artificial
  CRISPR gRNA sequence
atctagtattgaatatgatc

SEQ ID NO: 169228 - DNA, 20 bp, Artificial
  CRISPR gRNA sequence
gtattgaatatgatcttttt

SEQ ID NO: 169229 - DNA, 20 bp, Artificial
  CRISPR gRNA sequence
aatatgatctttttgtcaga

SEQ ID NO: 169230 - DNA, 20 bp, Artificial
  CRISPR gRNA sequence
tttgtcagacaaaaagcaaa

SEQ ID NO: 169231 - DNA, 20 bp, Artificial
  CRISPR gRNA sequence
ttgtcagacaaaaagcaaac

SEQ ID NO: 169232 - DNA, 20 bp, Artificial
  CRISPR gRNA sequence
tgtcagacaaaaagcaaacc

SEQ ID NO: 169233 - DNA, 20 bp, Artificial
  CRISPR gRNA sequence
gtcagacaaaaagcaaaccc

SEQ ID NO: 169234 - DNA, 20 bp, Artificial
  CRISPR gRNA sequence
tcagacaaaaagcaaaccct

SEQ ID NO: 169235 - DNA, 20 bp, Artificial
  CRISPR gRNA sequence
taaaaaccccttccagaacc

SEQ ID NO: 169236 - DNA, 20 bp, Artificial
  CRISPR gRNA sequence
aaaaaccccttccagaaccc

SEQ ID NO: 169237 - DNA, 20 bp, Artificial
  CRISPR gRNA sequence
aaaaccccttccagaaccca

SEQ ID NO: 169238 - DNA, 20 bp, Artificial
  CRISPR gRNA sequence
ccagaacccaaaatatctct

SEQ ID NO: 169239 - DNA, 20 bp, Artificial
  CRISPR gRNA sequence
cagaacccaaaatatctctt

SEQ ID NO: 169240 - DNA, 20 bp, Artificial
  CRISPR gRNA sequence
ttgccaaaagctgtgagagc

SEQ ID NO: 169241 - DNA, 20 bp, Artificial
  CRISPR gRNA sequence
gccaaaagctgtgagagcag

SEQ ID NO: 169242 - DNA, 20 bp, Artificial
  CRISPR gRNA sequence
ccaaaagctgtgagagcagg

SEQ ID NO: 169243 - DNA, 20 bp, Artificial
  CRISPR gRNA sequence
tgagagcaggacaagagctc

SEQ ID NO: 169244 - DNA, 20 bp, Artificial
  CRISPR gRNA sequence
ctcctatgctgcttactaca

SEQ ID NO: 169245 - DNA, 20 bp, Artificial
  CRISPR gRNA sequence
ctatgctgcttactacatcc

SEQ ID NO: 169246 - DNA, 20 bp, Artificial
  CRISPR gRNA sequence
tgctgcttactacatcctct

SEQ ID NO: 169247 - DNA, 20 bp, Artificial
  CRISPR gRNA sequence
cttactacatcctcttaaac

SEQ ID NO: 169248 - DNA, 20 bp, Artificial
  CRISPR gRNA sequence
actacatcctcttaaactgt

SEQ ID NO: 169249 - DNA, 20 bp, Artificial
  CRISPR gRNA sequence
ctacatcctcttaaactgtt

SEQ ID NO: 169250 - DNA, 20 bp, Artificial
  CRISPR gRNA sequence
catcctcttaaactgtttat

SEQ ID NO: 169251 - DNA, 20 bp, Artificial
  CRISPR gRNA sequence
ttaaactgtttatgaactag

SEQ ID NO: 169252 - DNA, 20 bp, Artificial
  CRISPR gRNA sequence
aaactgtttatgaactagac

SEQ ID NO: 169253 - DNA, 20 bp, Artificial
  CRISPR gRNA sequence
aactgtttatgaactagaca

SEQ ID NO: 169254 - DNA, 20 bp, Artificial
  CRISPR gRNA sequence
tttatgaactagacagtatc

SEQ ID NO: 169255 - DNA, 20 bp, Artificial
  CRISPR gRNA sequence
atgaactagacagtatctag

SEQ ID NO: 169256 - DNA, 20 bp, Artificial
  CRISPR gRNA sequence
tgaactagacagtatctagg

SEQ ID NO: 169257 - DNA, 20 bp, Artificial
  CRISPR gRNA sequence
gacagtatctaggacactga

SEQ ID NO: 169258 - DNA, 20 bp, Artificial
  CRISPR gRNA sequence
ggacactgagaatcaagtgg

SEQ ID NO: 169259 - DNA, 20 bp, Artificial
  CRISPR gRNA sequence
agaatcaagtggaggcacct

SEQ ID NO: 169260 - DNA, 20 bp, Artificial
  CRISPR gRNA sequence
ggtttgtgttgttaggacaa

SEQ ID NO: 169261 - DNA, 20 bp, Artificial
  CRISPR gRNA sequence
gtgttgttaggacaaggcac

SEQ ID NO: 169262 - DNA, 20 bp, Artificial
  CRISPR gRNA sequence
tgttgttaggacaaggcaca

SEQ ID NO: 169263 - DNA, 20 bp, Artificial
  CRISPR gRNA sequence
ttaggacaaggcacaactgt

SEQ ID NO: 169264 - DNA, 20 bp, Artificial
  CRISPR gRNA sequence
ggacaaggcacaactgttct

SEQ ID NO: 169265 - DNA, 20 bp, Artificial
  CRISPR gRNA sequence
ttctcaaatcactggaatgg

SEQ ID NO: 169266 - DNA, 20 bp, Artificial
  CRISPR gRNA sequence
tcaaatcactggaatggaag

SEQ ID NO: 169267 - DNA, 20 bp, Artificial
  CRISPR gRNA sequence
aaatcactggaatggaagaa

SEQ ID NO: 169268 - DNA, 20 bp, Artificial
  CRISPR gRNA sequence
gaatggaagaaggcatatct

SEQ ID NO: 169269 - DNA, 20 bp, Artificial
  CRISPR gRNA sequence
aggctcttctgcattatgaa

SEQ ID NO: 169270 - DNA, 20 bp, Artificial
  CRISPR gRNA sequence
ttctgcattatgaagactca

SEQ ID NO: 169271 - DNA, 20 bp, Artificial
  CRISPR gRNA sequence
ctgcattatgaagactcatt

SEQ ID NO: 169272 - DNA, 20 bp, Artificial
  CRISPR gRNA sequence
tgcattatgaagactcattc

SEQ ID NO: 169273 - DNA, 20 bp, Artificial
  CRISPR gRNA sequence
cattatgaagactcattctg

SEQ ID NO: 169274 - DNA, 20 bp, Artificial
  CRISPR gRNA sequence
tgaagactcattctgccaat

SEQ ID NO: 169275 - DNA, 20 bp, Artificial
  CRISPR gRNA sequence
attctgccaatggaggtcaa

SEQ ID NO: 169276 - DNA, 20 bp, Artificial
  CRISPR gRNA sequence
tgccaatggaggtcaagcca

SEQ ID NO: 169277 - DNA, 20 bp, Artificial
  CRISPR gRNA sequence
ccaatggaggtcaagccagc

SEQ ID NO: 169278 - DNA, 20 bp, Artificial
  CRISPR gRNA sequence
tgcttggtttaaagaaatgg

SEQ ID NO: 169279 - DNA, 20 bp, Artificial
  CRISPR gRNA sequence
ggtttaaagaaatgggtgaa

SEQ ID NO: 169280 - DNA, 20 bp, Artificial
  CRISPR gRNA sequence
gtttaaagaaatgggtgaaa

SEQ ID NO: 169281 - DNA, 20 bp, Artificial
  CRISPR gRNA sequence
aaagaaatgggtgaaaagat

SEQ ID NO: 169282 - DNA, 20 bp, Artificial
  CRISPR gRNA sequence
aagaaatgggtgaaaagata

SEQ ID NO: 169283 - DNA, 20 bp, Artificial
  CRISPR gRNA sequence
caatgggcaggaactttcaa

SEQ ID NO: 169284 - DNA, 20 bp, Artificial
  CRISPR gRNA sequence
aatgggcaggaactttcaac

SEQ ID NO: 169285 - DNA, 20 bp, Artificial
  CRISPR gRNA sequence
tcaactcaatagctttagtg

SEQ ID NO: 169286 - DNA, 20 bp, Artificial
  CRISPR gRNA sequence
caactcaatagctttagtgg

SEQ ID NO: 169287 - DNA, 20 bp, Artificial
  CRISPR gRNA sequence
aactcaatagctttagtggg

SEQ ID NO: 169288 - DNA, 20 bp, Artificial
  CRISPR gRNA sequence
aatagctttagtggggcaga

SEQ ID NO: 169289 - DNA, 20 bp, Artificial
  CRISPR gRNA sequence
tagtggggcagaagtcaggc

SEQ ID NO: 169290 - DNA, 20 bp, Artificial
  CRISPR gRNA sequence
agtggggcagaagtcaggcc

SEQ ID NO: 169291 - DNA, 20 bp, Artificial
  CRISPR gRNA sequence
gtggggcagaagtcaggcct

SEQ ID NO: 169292 - DNA, 20 bp, Artificial
  CRISPR gRNA sequence
aactacctcctaccttcaaa

SEQ ID NO: 169293 - DNA, 20 bp, Artificial
  CRISPR gRNA sequence
cctcctaccttcaaataatc

SEQ ID NO: 169294 - DNA, 20 bp, Artificial
  CRISPR gRNA sequence
ctaccttcaaataatcttta

SEQ ID NO: 169295 - DNA, 20 bp, Artificial
  CRISPR gRNA sequence
ccttcaaataatctttactt

SEQ ID NO: 169296 - DNA, 20 bp, Artificial
  CRISPR gRNA sequence
caaataatctttacttgctt

SEQ ID NO: 169297 - DNA, 20 bp, Artificial
  CRISPR gRNA sequence
aaataatctttacttgcttc

SEQ ID NO: 169298 - DNA, 20 bp, Artificial
  CRISPR gRNA sequence
tacttgcttctctgaagaac

SEQ ID NO: 169299 - DNA, 20 bp, Artificial
  CRISPR gRNA sequence
acttgcttctctgaagaaca

SEQ ID NO: 169300 - DNA, 20 bp, Artificial
  CRISPR gRNA sequence
cttgcttctctgaagaacaa

SEQ ID NO: 169301 - DNA, 20 bp, Artificial
  CRISPR gRNA sequence
gcttctctgaagaacaagcg

SEQ ID NO: 169302 - DNA, 20 bp, Artificial
  CRISPR gRNA sequence
cttctctgaagaacaagcga

SEQ ID NO: 169303 - DNA, 20 bp, Artificial
  CRISPR gRNA sequence
ctctgaagaacaagcgaaac

SEQ ID NO: 169304 - DNA, 20 bp, Artificial
  CRISPR gRNA sequence
tctgaagaacaagcgaaact

SEQ ID NO: 169305 - DNA, 20 bp, Artificial
  CRISPR gRNA sequence
tgaagaacaagcgaaactct

SEQ ID NO: 169306 - DNA, 20 bp, Artificial
  CRISPR gRNA sequence
aagaacaagcgaaactctca

SEQ ID NO: 169307 - DNA, 20 bp, Artificial
  CRISPR gRNA sequence
tcaagtatctttgagaagtc

SEQ ID NO: 169308 - DNA, 20 bp, Artificial
  CRISPR gRNA sequence
aagtatctttgagaagtcag

SEQ ID NO: 169309 - DNA, 20 bp, Artificial
  CRISPR gRNA sequence
tgagaagtcagggccttgga

SEQ ID NO: 169310 - DNA, 20 bp, Artificial
  CRISPR gRNA sequence
gagaagtcagggccttggac

SEQ ID NO: 169311 - DNA, 20 bp, Artificial
  CRISPR gRNA sequence
agaagtcagggccttggact

SEQ ID NO: 169312 - DNA, 20 bp, Artificial
  CRISPR gRNA sequence
ggactcacaattcagtattt

SEQ ID NO: 169313 - DNA, 20 bp, Artificial
  CRISPR gRNA sequence
gactcacaattcagtatttc

SEQ ID NO: 169314 - DNA, 20 bp, Artificial
  CRISPR gRNA sequence
acaattcagtatttctgact

SEQ ID NO: 169315 - DNA, 20 bp, Artificial
  CRISPR gRNA sequence
agtatttctgactagttcct

SEQ ID NO: 169316 - DNA, 20 bp, Artificial
  CRISPR gRNA sequence
ctgactagttccttttccca

SEQ ID NO: 169317 - DNA, 20 bp, Artificial
  CRISPR gRNA sequence
tgactagttccttttcccag

SEQ ID NO: 169318 - DNA, 20 bp, Artificial
  CRISPR gRNA sequence
actagttccttttcccagca

SEQ ID NO: 169319 - DNA, 20 bp, Artificial
  CRISPR gRNA sequence
gttccttttcccagcagtgg

SEQ ID NO: 169320 - DNA, 20 bp, Artificial
  CRISPR gRNA sequence
cttttcccagcagtgggagg

SEQ ID NO: 169321 - DNA, 20 bp, Artificial
  CRISPR gRNA sequence
ttcccagcagtgggaggttg

SEQ ID NO: 169322 - DNA, 20 bp, Artificial
  CRISPR gRNA sequence
tcccagcagtgggaggttgc

SEQ ID NO: 169323 - DNA, 20 bp, Artificial
  CRISPR gRNA sequence
cccagcagtgggaggttgcc

SEQ ID NO: 169324 - DNA, 20 bp, Artificial
  CRISPR gRNA sequence
ccagcagtgggaggttgccc

SEQ ID NO: 169325 - DNA, 20 bp, Artificial
  CRISPR gRNA sequence
ccccaagtggcagaacaatg

SEQ ID NO: 169326 - DNA, 20 bp, Artificial
  CRISPR gRNA sequence
taatgactggatcaatccag

SEQ ID NO: 169327 - DNA, 20 bp, Artificial
  CRISPR gRNA sequence
aatgactggatcaatccaga

SEQ ID NO: 169328 - DNA, 20 bp, Artificial
  CRISPR gRNA sequence
atgactggatcaatccagaa

SEQ ID NO: 169329 - DNA, 20 bp, Artificial
  CRISPR gRNA sequence
gatcaatccagaatggggca

SEQ ID NO: 169330 - DNA, 20 bp, Artificial
  CRISPR gRNA sequence
gctcaactttagcagtggcc

SEQ ID NO: 169331 - DNA, 20 bp, Artificial
  CRISPR gRNA sequence
ctcaactttagcagtggcct

SEQ ID NO: 169332 - DNA, 20 bp, Artificial
  CRISPR gRNA sequence
aactttagcagtggcctccc

SEQ ID NO: 169333 - DNA, 20 bp, Artificial
  CRISPR gRNA sequence
tagcagtggcctccccaact

SEQ ID NO: 169334 - DNA, 20 bp, Artificial
  CRISPR gRNA sequence
agcagtggcctccccaacta

SEQ ID NO: 169335 - DNA, 20 bp, Artificial
  CRISPR gRNA sequence
gcagtggcctccccaactac

SEQ ID NO: 169336 - DNA, 20 bp, Artificial
  CRISPR gRNA sequence
cccaactacagggcttgctc

SEQ ID NO: 169337 - DNA, 20 bp, Artificial
  CRISPR gRNA sequence
cagggcttgctcttggaatc

SEQ ID NO: 169338 - DNA, 20 bp, Artificial
  CRISPR gRNA sequence
gctcttggaatctttccaga

SEQ ID NO: 169339 - DNA, 20 bp, Artificial
  CRISPR gRNA sequence
ctcttggaatctttccagaa

SEQ ID NO: 169340 - DNA, 20 bp, Artificial
  CRISPR gRNA sequence
ttggaatctttccagaagct

SEQ ID NO: 169341 - DNA, 20 bp, Artificial
  CRISPR gRNA sequence
ggaatctttccagaagctga

SEQ ID NO: 169342 - DNA, 20 bp, Artificial
  CRISPR gRNA sequence
gaatctttccagaagctgag

SEQ ID NO: 169343 - DNA, 20 bp, Artificial
  CRISPR gRNA sequence
tccagaagctgagactgacg

SEQ ID NO: 169344 - DNA, 20 bp, Artificial
  CRISPR gRNA sequence
ccagaagctgagactgacga

SEQ ID NO: 169345 - DNA, 20 bp, Artificial
  CRISPR gRNA sequence
cagaagctgagactgacgaa

SEQ ID NO: 169346 - DNA, 20 bp, Artificial
  CRISPR gRNA sequence
agactgacgaacagtgccag

SEQ ID NO: 169347 - DNA, 20 bp, Artificial
  CRISPR gRNA sequence
acgaacagtgccagagaaga

SEQ ID NO: 169348 - DNA, 20 bp, Artificial
  CRISPR gRNA sequence
gggccatctctacagtgttg

SEQ ID NO: 169349 - DNA, 20 bp, Artificial
  CRISPR gRNA sequence
tacagtgttgtgcaaccagc

SEQ ID NO: 169350 - DNA, 20 bp, Artificial
  CRISPR gRNA sequence
cagtgttgtgcaaccagccc

SEQ ID NO: 169351 - DNA, 20 bp, Artificial
  CRISPR gRNA sequence
tgcaaccagccctgactgga

SEQ ID NO: 169352 - DNA, 20 bp, Artificial
  CRISPR gRNA sequence
actggaaaaaagtacattcg

SEQ ID NO: 169353 - DNA, 20 bp, Artificial
  CRISPR gRNA sequence
gaaaaaagtacattcgcttt

SEQ ID NO: 169354 - DNA, 20 bp, Artificial
  CRISPR gRNA sequence
gctttagtagcaagagtgaa

SEQ ID NO: 169355 - DNA, 20 bp, Artificial
  CRISPR gRNA sequence
tagtagcaagagtgaactgc

SEQ ID NO: 169356 - DNA, 20 bp, Artificial
  CRISPR gRNA sequence
agtagcaagagtgaactgct

SEQ ID NO: 169357 - DNA, 20 bp, Artificial
  CRISPR gRNA sequence
gtagcaagagtgaactgctg

SEQ ID NO: 169358 - DNA, 20 bp, Artificial
  CRISPR gRNA sequence
ctgcctccttcagaaagggt

SEQ ID NO: 169359 - DNA, 20 bp, Artificial
  CRISPR gRNA sequence
cctccttcagaaagggtggg

SEQ ID NO: 169360 - DNA, 20 bp, Artificial
  CRISPR gRNA sequence
cttcagaaagggtgggtttt

SEQ ID NO: 169361 - DNA, 20 bp, Artificial
  CRISPR gRNA sequence
cagaaagggtgggttttgga

SEQ ID NO: 169362 - DNA, 20 bp, Artificial
  CRISPR gRNA sequence
agaaagggtgggttttggag

SEQ ID NO: 169363 - DNA, 20 bp, Artificial
  CRISPR gRNA sequence
tggagagtaggcgttttaaa

SEQ ID NO: 169364 - DNA, 20 bp, Artificial
  CRISPR gRNA sequence
ggagagtaggcgttttaaag

SEQ ID NO: 169365 - DNA, 20 bp, Artificial
  CRISPR gRNA sequence
gagagtaggcgttttaaagg

SEQ ID NO: 169366 - DNA, 20 bp, Artificial
  CRISPR gRNA sequence
taaaggactttaggaggtgc

SEQ ID NO: 169367 - DNA, 20 bp, Artificial
  CRISPR gRNA sequence
aaaggactttaggaggtgcc

SEQ ID NO: 169368 - DNA, 20 bp, Artificial
  CRISPR gRNA sequence
aaggactttaggaggtgcca

SEQ ID NO: 169369 - DNA, 20 bp, Artificial
  CRISPR gRNA sequence
taggaggtgccagccaattt

SEQ ID NO: 169370 - DNA, 20 bp, Artificial
  CRISPR gRNA sequence
aggaggtgccagccaatttg

SEQ ID NO: 169371 - DNA, 20 bp, Artificial
  CRISPR gRNA sequence
ggaggtgccagccaatttga

SEQ ID NO: 169372 - DNA, 20 bp, Artificial
  CRISPR gRNA sequence
gaagcctgggaaaacttcat

SEQ ID NO: 169373 - DNA, 20 bp, Artificial
  CRISPR gRNA sequence
aagcctgggaaaacttcatg

SEQ ID NO: 169374 - DNA, 20 bp, Artificial
  CRISPR gRNA sequence
ggaaaacttcatgtctacag

SEQ ID NO: 169375 - DNA, 20 bp, Artificial
  CRISPR gRNA sequence
catgtctacagaggattaaa

SEQ ID NO: 169376 - DNA, 20 bp, Artificial
  CRISPR gRNA sequence
atgtctacagaggattaaaa

SEQ ID NO: 169377 - DNA, 20 bp, Artificial
  CRISPR gRNA sequence
cagaggattaaaaatgctat

SEQ ID NO: 169378 - DNA, 20 bp, Artificial
  CRISPR gRNA sequence
aaaatgctatcttagaattt

SEQ ID NO: 169379 - DNA, 20 bp, Artificial
  CRISPR gRNA sequence
tcttagaatttcaggccagc

SEQ ID NO: 169380 - DNA, 20 bp, Artificial
  CRISPR gRNA sequence
agaatttcaggccagctttc

SEQ ID NO: 169381 - DNA, 20 bp, Artificial
  CRISPR gRNA sequence
gaatttcaggccagctttca

SEQ ID NO: 169382 - DNA, 20 bp, Artificial
  CRISPR gRNA sequence
caggccagctttcagcaatc

SEQ ID NO: 169383 - DNA, 20 bp, Artificial
  CRISPR gRNA sequence
aggccagctttcagcaatct

SEQ ID NO: 169384 - DNA, 20 bp, Artificial
  CRISPR gRNA sequence
tcagcaatctcaacctttca

SEQ ID NO: 169385 - DNA, 20 bp, Artificial
  CRISPR gRNA sequence
cagcaatctcaacctttcaa

SEQ ID NO: 169386 - DNA, 20 bp, Artificial
  CRISPR gRNA sequence
agcaatctcaacctttcaaa

SEQ ID NO: 169387 - DNA, 20 bp, Artificial
  CRISPR gRNA sequence
aacctttcaaaggccaggca

SEQ ID NO: 169388 - DNA, 20 bp, Artificial
  CRISPR gRNA sequence
tcaaaggccaggcagcagct

SEQ ID NO: 169389 - DNA, 20 bp, Artificial
  CRISPR gRNA sequence
caaaggccaggcagcagctg

SEQ ID NO: 169390 - DNA, 20 bp, Artificial
  CRISPR gRNA sequence
aaaggccaggcagcagctgt

SEQ ID NO: 169391 - DNA, 20 bp, Artificial
  CRISPR gRNA sequence
tcccgaatacgatgccaatc

SEQ ID NO: 169392 - DNA, 20 bp, Artificial
  CRISPR gRNA sequence
gaacacctacaaagaactaa

SEQ ID NO: 169393 - DNA, 20 bp, Artificial
  CRISPR gRNA sequence
caaagaactaaatccaagca

SEQ ID NO: 169394 - DNA, 20 bp, Artificial
  CRISPR gRNA sequence
aatccaagcaacaagaagct

SEQ ID NO: 169395 - DNA, 20 bp, Artificial
  CRISPR gRNA sequence
tttcagctagacacacttta

SEQ ID NO: 169396 - DNA, 20 bp, Artificial
  CRISPR gRNA sequence
cagctagacacactttaaaa

SEQ ID NO: 169397 - DNA, 20 bp, Artificial
  CRISPR gRNA sequence
agctagacacactttaaaat

SEQ ID NO: 169398 - DNA, 20 bp, Artificial
  CRISPR gRNA sequence
gacacactttaaaatcagat

SEQ ID NO: 169399 - DNA, 20 bp, Artificial
  CRISPR gRNA sequence
taaaatcagatggatcatag

SEQ ID NO: 169400 - DNA, 20 bp, Artificial
  CRISPR gRNA sequence
aaaatcagatggatcatagc

SEQ ID NO: 169401 - DNA, 20 bp, Artificial
  CRISPR gRNA sequence
aaatcagatggatcatagca

SEQ ID NO: 169402 - DNA, 20 bp, Artificial
  CRISPR gRNA sequence
tgagtctggctaagatggaa

SEQ ID NO: 169403 - DNA, 20 bp, Artificial
  CRISPR gRNA sequence
gagtctggctaagatggaat

SEQ ID NO: 169404 - DNA, 20 bp, Artificial
  CRISPR gRNA sequence
agtctggctaagatggaata

SEQ ID NO: 169405 - DNA, 20 bp, Artificial
  CRISPR gRNA sequence
gctaagatggaataaggagc

SEQ ID NO: 169406 - DNA, 20 bp, Artificial
  CRISPR gRNA sequence
agatggaataaggagctgta

SEQ ID NO: 169407 - DNA, 20 bp, Artificial
  CRISPR gRNA sequence
tatgacaccccgagagaccc

SEQ ID NO: 169408 - DNA, 20 bp, Artificial
  CRISPR gRNA sequence
aggaatttggaggaactgac

SEQ ID NO: 169409 - DNA, 20 bp, Artificial
  CRISPR gRNA sequence
ggaggaactgacaggatgtg

SEQ ID NO: 169410 - DNA, 20 bp, Artificial
  CRISPR gRNA sequence
gaggaactgacaggatgtga

SEQ ID NO: 169411 - DNA, 20 bp, Artificial
  CRISPR gRNA sequence
acaggatgtgacccttctct

SEQ ID NO: 169412 - DNA, 20 bp, Artificial
  CRISPR gRNA sequence
ctctccagccagtgtattca

SEQ ID NO: 169413 - DNA, 20 bp, Artificial
  CRISPR gRNA sequence
tctccagccagtgtattcag

SEQ ID NO: 169414 - DNA, 20 bp, Artificial
  CRISPR gRNA sequence
tccagccagtgtattcagca

SEQ ID NO: 169415 - DNA, 20 bp, Artificial
  CRISPR gRNA sequence
cagccagtgtattcagcagg

SEQ ID NO: 169416 - DNA, 20 bp, Artificial
  CRISPR gRNA sequence
agcaggcagcccacagaaaa

SEQ ID NO: 169417 - DNA, 20 bp, Artificial
  CRISPR gRNA sequence
gcacaatgagagtgagcaag

SEQ ID NO: 169418 - DNA, 20 bp, Artificial
  CRISPR gRNA sequence
atttcatcacagagctcaca

SEQ ID NO: 169419 - DNA, 20 bp, Artificial
  CRISPR gRNA sequence
catcacagagctcacaatct

SEQ ID NO: 169420 - DNA, 20 bp, Artificial
  CRISPR gRNA sequence
atcacagagctcacaatctt

SEQ ID NO: 169421 - DNA, 20 bp, Artificial
  CRISPR gRNA sequence
acaatcttgttttaaagggg

SEQ ID NO: 169422 - DNA, 20 bp, Artificial
  CRISPR gRNA sequence
gttttaaagggggcttctga

SEQ ID NO: 169423 - DNA, 20 bp, Artificial
  CRISPR gRNA sequence
ttttaaagggggcttctgat

SEQ ID NO: 169424 - DNA, 20 bp, Artificial
  CRISPR gRNA sequence
taaagggggcttctgataga

SEQ ID NO: 169425 - DNA, 20 bp, Artificial
  CRISPR gRNA sequence
aaagggggcttctgatagac

SEQ ID NO: 169426 - DNA, 20 bp, Artificial
  CRISPR gRNA sequence
aagggggcttctgatagaca

SEQ ID NO: 169427 - DNA, 20 bp, Artificial
  CRISPR gRNA sequence
ctgatagacaaaaggagaaa

SEQ ID NO: 169428 - DNA, 20 bp, Artificial
  CRISPR gRNA sequence
tgatagacaaaaggagaaaa

SEQ ID NO: 169429 - DNA, 20 bp, Artificial
  CRISPR gRNA sequence
atagacaaaaggagaaaaca

SEQ ID NO: 169430 - DNA, 20 bp, Artificial
  CRISPR gRNA sequence
caacaaggaaagcaggtgta

SEQ ID NO: 169431 - DNA, 20 bp, Artificial
  CRISPR gRNA sequence
aacaaggaaagcaggtgtat

SEQ ID NO: 169432 - DNA, 20 bp, Artificial
  CRISPR gRNA sequence
tttgttctgaaggaagataa

SEQ ID NO: 169433 - DNA, 20 bp, Artificial
  CRISPR gRNA sequence
tgttctgaaggaagataaat

SEQ ID NO: 169434 - DNA, 20 bp, Artificial
  CRISPR gRNA sequence
gttctgaaggaagataaatg

SEQ ID NO: 169435 - DNA, 20 bp, Artificial
  CRISPR gRNA sequence
ttctgaaggaagataaatgg

SEQ ID NO: 169436 - DNA, 20 bp, Artificial
  CRISPR gRNA sequence
tgaaggaagataaatggcct

SEQ ID NO: 169437 - DNA, 20 bp, Artificial
  CRISPR gRNA sequence
aaggaagataaatggcctga

SEQ ID NO: 169438 - DNA, 20 bp, Artificial
  CRISPR gRNA sequence
agttcttgttgtgacttctg

SEQ ID NO: 169439 - DNA, 20 bp, Artificial
  CRISPR gRNA sequence
ttgttgtgacttctgagaga

SEQ ID NO: 169440 - DNA, 20 bp, Artificial
  CRISPR gRNA sequence
gttgtgacttctgagagagg

SEQ ID NO: 169441 - DNA, 20 bp, Artificial
  CRISPR gRNA sequence
ttgtgacttctgagagagga

SEQ ID NO: 169442 - DNA, 20 bp, Artificial
  CRISPR gRNA sequence
tgacttctgagagaggaggg

SEQ ID NO: 169443 - DNA, 20 bp, Artificial
  CRISPR gRNA sequence
ctgagagaggagggaaggac

SEQ ID NO: 169444 - DNA, 20 bp, Artificial
  CRISPR gRNA sequence
tgagagaggagggaaggacc

SEQ ID NO: 169445 - DNA, 20 bp, Artificial
  CRISPR gRNA sequence
agagaggagggaaggacccc

SEQ ID NO: 169446 - DNA, 20 bp, Artificial
  CRISPR gRNA sequence
agcctgtgggcacaaacctg

SEQ ID NO: 169447 - DNA, 20 bp, Artificial
  CRISPR gRNA sequence
tgggcacaaacctgcaatgt

SEQ ID NO: 169448 - DNA, 20 bp, Artificial
  CRISPR gRNA sequence
caatgtttcaaagccggtgc

SEQ ID NO: 169449 - DNA, 20 bp, Artificial
  CRISPR gRNA sequence
caaagccggtgcgtagctgg

SEQ ID NO: 169450 - DNA, 20 bp, Artificial
  CRISPR gRNA sequence
aaagccggtgcgtagctggg

SEQ ID NO: 169451 - DNA, 20 bp, Artificial
  CRISPR gRNA sequence
gggacgaccgtggcagcctg

SEQ ID NO: 169452 - DNA, 20 bp, Artificial
  CRISPR gRNA sequence
ccgctgtaaacatccgactg

SEQ ID NO: 169453 - DNA, 20 bp, Artificial
  CRISPR gRNA sequence
taaacatccgactgaaagct

SEQ ID NO: 169454 - DNA, 20 bp, Artificial
  CRISPR gRNA sequence
aaagctcctctgaacacctt

SEQ ID NO: 169455 - DNA, 20 bp, Artificial
  CRISPR gRNA sequence
ctctgaacaccttacagctt

SEQ ID NO: 169456 - DNA, 20 bp, Artificial
  CRISPR gRNA sequence
tgaacaccttacagcttcca

SEQ ID NO: 169457 - DNA, 20 bp, Artificial
  CRISPR gRNA sequence
aacaccttacagcttccagt

SEQ ID NO: 169458 - DNA, 20 bp, Artificial
  CRISPR gRNA sequence
acagcttccagtcaaggatg

SEQ ID NO: 169459 - DNA, 20 bp, Artificial
  CRISPR gRNA sequence
cagcttccagtcaaggatgt

SEQ ID NO: 169460 - DNA, 20 bp, Artificial
  CRISPR gRNA sequence
ccagtcaaggatgtttacag

SEQ ID NO: 169461 - DNA, 20 bp, Artificial
  CRISPR gRNA sequence
cagtcaaggatgtttacagt

SEQ ID NO: 169462 - DNA, 20 bp, Artificial
  CRISPR gRNA sequence
acagtagcaaagactgccca

SEQ ID NO: 169463 - DNA, 20 bp, Artificial
  CRISPR gRNA sequence
cagtagcaaagactgcccag

SEQ ID NO: 169464 - DNA, 20 bp, Artificial
  CRISPR gRNA sequence
cccagaaagaacggagacgc

SEQ ID NO: 169465 - DNA, 20 bp, Artificial
  CRISPR gRNA sequence
ctctagtaaggaggtgacag

SEQ ID NO: 169466 - DNA, 20 bp, Artificial
  CRISPR gRNA sequence
tagtaaggaggtgacagagg

SEQ ID NO: 169467 - DNA, 20 bp, Artificial
  CRISPR gRNA sequence
gtaaggaggtgacagagggc

SEQ ID NO: 169468 - DNA, 20 bp, Artificial
  CRISPR gRNA sequence
gctaatccaaaggccctcat

SEQ ID NO: 169469 - DNA, 20 bp, Artificial
  CRISPR gRNA sequence
ctaatccaaaggccctcatg

SEQ ID NO: 169470 - DNA, 20 bp, Artificial
  CRISPR gRNA sequence
atccaaaggccctcatgcag

SEQ ID NO: 169471 - DNA, 20 bp, Artificial
  CRISPR gRNA sequence
atgcagggtcagaattacaa

SEQ ID NO: 169472 - DNA, 20 bp, Artificial
  CRISPR gRNA sequence
caaatgttcattaggatgcc

SEQ ID NO: 169473 - DNA, 20 bp, Artificial
  CRISPR gRNA sequence
attaggatgcccacttctcc

SEQ ID NO: 169474 - DNA, 20 bp, Artificial
  CRISPR gRNA sequence
ggatgcccacttctcctaga

SEQ ID NO: 169475 - DNA, 20 bp, Artificial
  CRISPR gRNA sequence
ctcctagactttctctgact

SEQ ID NO: 169476 - DNA, 20 bp, Artificial
  CRISPR gRNA sequence
tcctagactttctctgactg

SEQ ID NO: 169477 - DNA, 20 bp, Artificial
  CRISPR gRNA sequence
ctagactttctctgactggt

SEQ ID NO: 169478 - DNA, 20 bp, Artificial
  CRISPR gRNA sequence
gactttctctgactggttat

SEQ ID NO: 169479 - DNA, 20 bp, Artificial
  CRISPR gRNA sequence
tctctgactggttattaata

SEQ ID NO: 169480 - DNA, 20 bp, Artificial
  CRISPR gRNA sequence
ctctgactggttattaatac

SEQ ID NO: 169481 - DNA, 20 bp, Artificial
  CRISPR gRNA sequence
tctgactggttattaataca

SEQ ID NO: 169482 - DNA, 20 bp, Artificial
  CRISPR gRNA sequence
tgactggttattaatacagg

SEQ ID NO: 169483 - DNA, 20 bp, Artificial
  CRISPR gRNA sequence
actggttattaatacaggct

SEQ ID NO: 169484 - DNA, 20 bp, Artificial
  CRISPR gRNA sequence
gttattaatacaggctggga

SEQ ID NO: 169485 - DNA, 20 bp, Artificial
  CRISPR gRNA sequence
ttaatacaggctgggatggg

SEQ ID NO: 169486 - DNA, 20 bp, Artificial
  CRISPR gRNA sequence
atacaggctgggatggggag

SEQ ID NO: 169487 - DNA, 20 bp, Artificial
  CRISPR gRNA sequence
ggatggggagaatggctgtc

SEQ ID NO: 169488 - DNA, 20 bp, Artificial
  CRISPR gRNA sequence
tcactgaatgactgcttcta

SEQ ID NO: 169489 - DNA, 20 bp, Artificial
  CRISPR gRNA sequence
aatgactgcttctaaggata

SEQ ID NO: 169490 - DNA, 20 bp, Artificial
  CRISPR gRNA sequence
cttctaaggataatatacta

SEQ ID NO: 169491 - DNA, 20 bp, Artificial
  CRISPR gRNA sequence
ctaaggataatatactatga

SEQ ID NO: 169492 - DNA, 20 bp, Artificial
  CRISPR gRNA sequence
taaggataatatactatgaa

SEQ ID NO: 169493 - DNA, 20 bp, Artificial
  CRISPR gRNA sequence
aggataatatactatgaaat

SEQ ID NO: 169494 - DNA, 20 bp, Artificial
  CRISPR gRNA sequence
tgaaataattcattaaaaat

SEQ ID NO: 169495 - DNA, 20 bp, Artificial
  CRISPR gRNA sequence
attaaaaataaagttttata

SEQ ID NO: 169496 - DNA, 20 bp, Artificial
  CRISPR gRNA sequence
aaaataaagttttatataac

SEQ ID NO: 169497 - DNA, 20 bp, Artificial
  CRISPR gRNA sequence
tatataacaaagcaagcaga

SEQ ID NO: 169498 - DNA, 20 bp, Artificial
  CRISPR gRNA sequence
atataacaaagcaagcagaa

SEQ ID NO: 169499 - DNA, 20 bp, Artificial
  CRISPR gRNA sequence
tataacaaagcaagcagaac

SEQ ID NO: 169500 - DNA, 20 bp, Artificial
  CRISPR gRNA sequence
tgctcctgtgagattctgcc

SEQ ID NO: 169501 - DNA, 20 bp, Artificial
  CRISPR gRNA sequence
gctcctgtgagattctgcca

SEQ ID NO: 169502 - DNA, 20 bp, Artificial
  CRISPR gRNA sequence
ctcctgtgagattctgccac

SEQ ID NO: 169503 - DNA, 20 bp, Artificial
  CRISPR gRNA sequence
ctgtgagattctgccacaat

SEQ ID NO: 169504 - DNA, 20 bp, Artificial
  CRISPR gRNA sequence
tgagattctgccacaatttc

SEQ ID NO: 169505 - DNA, 20 bp, Artificial
  CRISPR gRNA sequence
tgccacaatttcccaagtgg

SEQ ID NO: 169506 - DNA, 20 bp, Artificial
  CRISPR gRNA sequence
ccacaatttcccaagtggca

SEQ ID NO: 169507 - DNA, 20 bp, Artificial
  CRISPR gRNA sequence
cccaagtggcacctagtgaa

SEQ ID NO: 169508 - DNA, 20 bp, Artificial
  CRISPR gRNA sequence
ccaagtggcacctagtgaat

SEQ ID NO: 169509 - DNA, 20 bp, Artificial
  CRISPR gRNA sequence
gtgaatcatgcaatctgcat

SEQ ID NO: 169510 - DNA, 20 bp, Artificial
  CRISPR gRNA sequence
catgcttaaaacaatgagct

SEQ ID NO: 169511 - DNA, 20 bp, Artificial
  CRISPR gRNA sequence
aaaacaatgagctctaaagg

SEQ ID NO: 169512 - DNA, 20 bp, Artificial
  CRISPR gRNA sequence
aaacaatgagctctaaagga

SEQ ID NO: 169513 - DNA, 20 bp, Artificial
  CRISPR gRNA sequence
taaaggacagaggtctatta

SEQ ID NO: 169514 - DNA, 20 bp, Artificial
  CRISPR gRNA sequence
aaggacagaggtctattaca

SEQ ID NO: 169515 - DNA, 20 bp, Artificial
  CRISPR gRNA sequence
ttacaatcacaattaagagc

SEQ ID NO: 169516 - DNA, 20 bp, Artificial
  CRISPR gRNA sequence
caatcacaattaagagctat

SEQ ID NO: 169517 - DNA, 20 bp, Artificial
  CRISPR gRNA sequence
agagctatatgcacccaagg

SEQ ID NO: 169518 - DNA, 20 bp, Artificial
  CRISPR gRNA sequence
tatgcacccaaggtgctgaa

SEQ ID NO: 169519 - DNA, 20 bp, Artificial
  CRISPR gRNA sequence
aaaaaacaactagtgtgacc

SEQ ID NO: 169520 - DNA, 20 bp, Artificial
  CRISPR gRNA sequence
gtgtgacctttggagagggg

SEQ ID NO: 169521 - DNA, 20 bp, Artificial
  CRISPR gRNA sequence
tggagaggggcaggcagaag

SEQ ID NO: 169522 - DNA, 20 bp, Artificial
  CRISPR gRNA sequence
ggagaggggcaggcagaaga

SEQ ID NO: 169523 - DNA, 20 bp, Artificial
  CRISPR gRNA sequence
gagaggggcaggcagaagag

SEQ ID NO: 169524 - DNA, 20 bp, Artificial
  CRISPR gRNA sequence
atattctttcttgtgattgc

SEQ ID NO: 169525 - DNA, 20 bp, Artificial
  CRISPR gRNA sequence
tttcttgtgattgcttgcaa

SEQ ID NO: 169526 - DNA, 20 bp, Artificial
  CRISPR gRNA sequence
tcttgtgattgcttgcaaaa

SEQ ID NO: 169527 - DNA, 20 bp, Artificial
  CRISPR gRNA sequence
cttgtgattgcttgcaaaac

SEQ ID NO: 169528 - DNA, 20 bp, Artificial
  CRISPR gRNA sequence
ttgtgattgcttgcaaaaca

SEQ ID NO: 169529 - DNA, 20 bp, Artificial
  CRISPR gRNA sequence
gtgattgcttgcaaaacagc

SEQ ID NO: 169530 - DNA, 20 bp, Artificial
  CRISPR gRNA sequence
tgattgcttgcaaaacagct

SEQ ID NO: 169531 - DNA, 20 bp, Artificial
  CRISPR gRNA sequence
cttgcaaaacagctcaagtg

SEQ ID NO: 169532 - DNA, 20 bp, Artificial
  CRISPR gRNA sequence
gcaaaacagctcaagtggtg

SEQ ID NO: 169533 - DNA, 20 bp, Artificial
  CRISPR gRNA sequence
caaaacagctcaagtggtgg

SEQ ID NO: 169534 - DNA, 20 bp, Artificial
  CRISPR gRNA sequence
aagtggtggttctcaaatct

SEQ ID NO: 169535 - DNA, 20 bp, Artificial
  CRISPR gRNA sequence
tcaaatctgactgcacatta

SEQ ID NO: 169536 - DNA, 20 bp, Artificial
  CRISPR gRNA sequence
aaatctgactgcacattaaa

SEQ ID NO: 169537 - DNA, 20 bp, Artificial
  CRISPR gRNA sequence
actgcacattaaaagcatcc

SEQ ID NO: 169538 - DNA, 20 bp, Artificial
  CRISPR gRNA sequence
cacattaaaagcatccaggg

SEQ ID NO: 169539 - DNA, 20 bp, Artificial
  CRISPR gRNA sequence
aaagcatccagggagtttta

SEQ ID NO: 169540 - DNA, 20 bp, Artificial
  CRISPR gRNA sequence
taaaaggtactgatgcctgg

SEQ ID NO: 169541 - DNA, 20 bp, Artificial
  CRISPR gRNA sequence
aaaaggtactgatgcctggg

SEQ ID NO: 169542 - DNA, 20 bp, Artificial
  CRISPR gRNA sequence
aaaggtactgatgcctgggc

SEQ ID NO: 169543 - DNA, 20 bp, Artificial
  CRISPR gRNA sequence
atgcctgggctccatcatga

SEQ ID NO: 169544 - DNA, 20 bp, Artificial
  CRISPR gRNA sequence
ggctccatcatgagattctg

SEQ ID NO: 169545 - DNA, 20 bp, Artificial
  CRISPR gRNA sequence
catcatgagattctgattca

SEQ ID NO: 169546 - DNA, 20 bp, Artificial
  CRISPR gRNA sequence
tgattcagctgatgtgggtt

SEQ ID NO: 169547 - DNA, 20 bp, Artificial
  CRISPR gRNA sequence
attcagctgatgtgggttag

SEQ ID NO: 169548 - DNA, 20 bp, Artificial
  CRISPR gRNA sequence
agctgatgtgggttagagcc

SEQ ID NO: 169549 - DNA, 20 bp, Artificial
  CRISPR gRNA sequence
atgtgggttagagcctgggc

SEQ ID NO: 169550 - DNA, 20 bp, Artificial
  CRISPR gRNA sequence
gagcctgggcgctgatattt

SEQ ID NO: 169551 - DNA, 20 bp, Artificial
  CRISPR gRNA sequence
ggcgctgatatttttaaaac

SEQ ID NO: 169552 - DNA, 20 bp, Artificial
  CRISPR gRNA sequence
atatttttaaaaccccaaca

SEQ ID NO: 169553 - DNA, 20 bp, Artificial
  CRISPR gRNA sequence
ttaaaaccccaacaggtgat

SEQ ID NO: 169554 - DNA, 20 bp, Artificial
  CRISPR gRNA sequence
taaaaccccaacaggtgatt

SEQ ID NO: 169555 - DNA, 20 bp, Artificial
  CRISPR gRNA sequence
aaaaccccaacaggtgattc

SEQ ID NO: 169556 - DNA, 20 bp, Artificial
  CRISPR gRNA sequence
aaaccccaacaggtgattct

SEQ ID NO: 169557 - DNA, 20 bp, Artificial
  CRISPR gRNA sequence
tagtgtgcagtcagggtact

SEQ ID NO: 169558 - DNA, 20 bp, Artificial
  CRISPR gRNA sequence
gtgtgcagtcagggtactat

SEQ ID NO: 169559 - DNA, 20 bp, Artificial
  CRISPR gRNA sequence
tataaagatataatgaacca

SEQ ID NO: 169560 - DNA, 20 bp, Artificial
  CRISPR gRNA sequence
actccaaatgccactgtgca

SEQ ID NO: 169561 - DNA, 20 bp, Artificial
  CRISPR gRNA sequence
caaatgccactgtgcacata

SEQ ID NO: 169562 - DNA, 20 bp, Artificial
  CRISPR gRNA sequence
tgcacatagagaagctgttt

SEQ ID NO: 169563 - DNA, 20 bp, Artificial
  CRISPR gRNA sequence
tttcttaaaaatctaaaatc

SEQ ID NO: 169564 - DNA, 20 bp, Artificial
  CRISPR gRNA sequence
cttaaaaatctaaaatctat

SEQ ID NO: 169565 - DNA, 20 bp, Artificial
  CRISPR gRNA sequence
ttaaaaatctaaaatctata

SEQ ID NO: 169566 - DNA, 20 bp, Artificial
  CRISPR gRNA sequence
aaaaatctaaaatctataac

SEQ ID NO: 169567 - DNA, 20 bp, Artificial
  CRISPR gRNA sequence
aaaatctaaaatctataact

SEQ ID NO: 169568 - DNA, 20 bp, Artificial
  CRISPR gRNA sequence
aaatctataactttctggga

SEQ ID NO: 169569 - DNA, 20 bp, Artificial
  CRISPR gRNA sequence
taactttctgggaatattct

SEQ ID NO: 169570 - DNA, 20 bp, Artificial
  CRISPR gRNA sequence
tctgggaatattctcctatc

SEQ ID NO: 169571 - DNA, 20 bp, Artificial
  CRISPR gRNA sequence
ctgggaatattctcctatcc

SEQ ID NO: 169572 - DNA, 20 bp, Artificial
  CRISPR gRNA sequence
tgggaatattctcctatccc

SEQ ID NO: 169573 - DNA, 20 bp, Artificial
  CRISPR gRNA sequence
ggaatattctcctatcccag

SEQ ID NO: 169574 - DNA, 20 bp, Artificial
  CRISPR gRNA sequence
tcctatcccagatgaagagc

SEQ ID NO: 169575 - DNA, 20 bp, Artificial
  CRISPR gRNA sequence
ctatcccagatgaagagctc

SEQ ID NO: 169576 - DNA, 20 bp, Artificial
  CRISPR gRNA sequence
tcccagatgaagagctctga

SEQ ID NO: 169577 - DNA, 20 bp, Artificial
  CRISPR gRNA sequence
tgatagacttcctaagataa

SEQ ID NO: 169578 - DNA, 20 bp, Artificial
  CRISPR gRNA sequence
atagacttcctaagataact

SEQ ID NO: 169579 - DNA, 20 bp, Artificial
  CRISPR gRNA sequence
cctaagataacttgaaatga

SEQ ID NO: 169580 - DNA, 20 bp, Artificial
  CRISPR gRNA sequence
ctaagataacttgaaatgag

SEQ ID NO: 169581 - DNA, 20 bp, Artificial
  CRISPR gRNA sequence
agataacttgaaatgagctt

SEQ ID NO: 169582 - DNA, 20 bp, Artificial
  CRISPR gRNA sequence
gaaatgagcttaactttacc

SEQ ID NO: 169583 - DNA, 20 bp, Artificial
  CRISPR gRNA sequence
aaatgagcttaactttacca

SEQ ID NO: 169584 - DNA, 20 bp, Artificial
  CRISPR gRNA sequence
aactttaccatttgtaacta

SEQ ID NO: 169585 - DNA, 20 bp, Artificial
  CRISPR gRNA sequence
actttaccatttgtaactaa

SEQ ID NO: 169586 - DNA, 20 bp, Artificial
  CRISPR gRNA sequence
taccatttgtaactaaagtc

SEQ ID NO: 169587 - DNA, 20 bp, Artificial
  CRISPR gRNA sequence
accatttgtaactaaagtct

SEQ ID NO: 169588 - DNA, 20 bp, Artificial
  CRISPR gRNA sequence
ccatttgtaactaaagtctt

SEQ ID NO: 169589 - DNA, 20 bp, Artificial
  CRISPR gRNA sequence
gtaactaaagtctttcattt

SEQ ID NO: 169590 - DNA, 20 bp, Artificial
  CRISPR gRNA sequence
taactaaagtctttcatttt

SEQ ID NO: 169591 - DNA, 20 bp, Artificial
  CRISPR gRNA sequence
aagtctttcattttcatttt

SEQ ID NO: 169592 - DNA, 20 bp, Artificial
  CRISPR gRNA sequence
tcattttcattttgtctatt

SEQ ID NO: 169593 - DNA, 20 bp, Artificial
  CRISPR gRNA sequence
cattttcattttgtctattt

SEQ ID NO: 169594 - DNA, 20 bp, Artificial
  CRISPR gRNA sequence
attttcattttgtctatttt

SEQ ID NO: 169595 - DNA, 20 bp, Artificial
  CRISPR gRNA sequence
tcattttgtctattttcact

SEQ ID NO: 169596 - DNA, 20 bp, Artificial
  CRISPR gRNA sequence
cattttgtctattttcactg

SEQ ID NO: 169597 - DNA, 20 bp, Artificial
  CRISPR gRNA sequence
attttgtctattttcactga

SEQ ID NO: 169598 - DNA, 20 bp, Artificial
  CRISPR gRNA sequence
tgtctattttcactgaaata

SEQ ID NO: 169599 - DNA, 20 bp, Artificial
  CRISPR gRNA sequence
gtctattttcactgaaatac

SEQ ID NO: 169600 - DNA, 20 bp, Artificial
  CRISPR gRNA sequence
tctattttcactgaaatacc

SEQ ID NO: 169601 - DNA, 20 bp, Artificial
  CRISPR gRNA sequence
ttttcactgaaataccactt

SEQ ID NO: 169602 - DNA, 20 bp, Artificial
  CRISPR gRNA sequence
tcactgaaataccacttcgg

SEQ ID NO: 169603 - DNA, 20 bp, Artificial
  CRISPR gRNA sequence
cactgaaataccacttcgga

SEQ ID NO: 169604 - DNA, 20 bp, Artificial
  CRISPR gRNA sequence
actgaaataccacttcggag

SEQ ID NO: 169605 - DNA, 20 bp, Artificial
  CRISPR gRNA sequence
aaataccacttcggaggcac

SEQ ID NO: 169606 - DNA, 20 bp, Artificial
  CRISPR gRNA sequence
cggaggcactgagttaaaag

SEQ ID NO: 169607 - DNA, 20 bp, Artificial
  CRISPR gRNA sequence
ggaggcactgagttaaaagt

SEQ ID NO: 169608 - DNA, 20 bp, Artificial
  CRISPR gRNA sequence
agttaaaagtatccagaaat

SEQ ID NO: 169609 - DNA, 20 bp, Artificial
  CRISPR gRNA sequence
aaagtatccagaaatgagta

SEQ ID NO: 169610 - DNA, 20 bp, Artificial
  CRISPR gRNA sequence
agaatgaatctggtctagaa

SEQ ID NO: 169611 - DNA, 20 bp, Artificial
  CRISPR gRNA sequence
gtctagaaacgagaagcaaa

SEQ ID NO: 169612 - DNA, 20 bp, Artificial
  CRISPR gRNA sequence
gaaacgagaagcaaaaggaa

SEQ ID NO: 169613 - DNA, 20 bp, Artificial
  CRISPR gRNA sequence
gtgctgagagagaaggagcg

SEQ ID NO: 169614 - DNA, 20 bp, Artificial
  CRISPR gRNA sequence
tgctgagagagaaggagcgt

SEQ ID NO: 169615 - DNA, 20 bp, Artificial
  CRISPR gRNA sequence
agagagaaggagcgtatctg

SEQ ID NO: 169616 - DNA, 20 bp, Artificial
  CRISPR gRNA sequence
acaccagtatacaaagcgct

SEQ ID NO: 169617 - DNA, 20 bp, Artificial
  CRISPR gRNA sequence
ttcagtcagcagcaactgca

SEQ ID NO: 169618 - DNA, 20 bp, Artificial
  CRISPR gRNA sequence
cagtcagcagcaactgcaat

SEQ ID NO: 169619 - DNA, 20 bp, Artificial
  CRISPR gRNA sequence
agtcagcagcaactgcaatc

SEQ ID NO: 169620 - DNA, 20 bp, Artificial
  CRISPR gRNA sequence
caatcccttcacagctcacc

SEQ ID NO: 169621 - DNA, 20 bp, Artificial
  CRISPR gRNA sequence
cacagctcacctgacgcttt

SEQ ID NO: 169622 - DNA, 20 bp, Artificial
  CRISPR gRNA sequence
acagctcacctgacgctttg

SEQ ID NO: 169623 - DNA, 20 bp, Artificial
  CRISPR gRNA sequence
acctgacgctttggaggttt

SEQ ID NO: 169624 - DNA, 20 bp, Artificial
  CRISPR gRNA sequence
acgctttggaggtttcagtt

SEQ ID NO: 169625 - DNA, 20 bp, Artificial
  CRISPR gRNA sequence
tggaggtttcagttcatctc

SEQ ID NO: 169626 - DNA, 20 bp, Artificial
  CRISPR gRNA sequence
ggaggtttcagttcatctct

SEQ ID NO: 169627 - DNA, 20 bp, Artificial
  CRISPR gRNA sequence
gaggtttcagttcatctctt

SEQ ID NO: 169628 - DNA, 20 bp, Artificial
  CRISPR gRNA sequence
cagttcatctcttggaacaa

SEQ ID NO: 169629 - DNA, 20 bp, Artificial
  CRISPR gRNA sequence
agttcatctcttggaacaat

SEQ ID NO: 169630 - DNA, 20 bp, Artificial
  CRISPR gRNA sequence
atctcttggaacaatatcga

SEQ ID NO: 169631 - DNA, 20 bp, Artificial
  CRISPR gRNA sequence
ttggaacaatatcgatgaga

SEQ ID NO: 169632 - DNA, 20 bp, Artificial
  CRISPR gRNA sequence
ggaacaatatcgatgagaaa

SEQ ID NO: 169633 - DNA, 20 bp, Artificial
  CRISPR gRNA sequence
gaacaatatcgatgagaaaa

SEQ ID NO: 169634 - DNA, 20 bp, Artificial
  CRISPR gRNA sequence
atcaaattttgtaattgcca

SEQ ID NO: 169635 - DNA, 20 bp, Artificial
  CRISPR gRNA sequence
tgtaattgccatggcgatat

SEQ ID NO: 169636 - DNA, 20 bp, Artificial
  CRISPR gRNA sequence
gtaattgccatggcgatatc

SEQ ID NO: 169637 - DNA, 20 bp, Artificial
  CRISPR gRNA sequence
taattgccatggcgatatca

SEQ ID NO: 169638 - DNA, 20 bp, Artificial
  CRISPR gRNA sequence
ccatggcgatatcatttctc

SEQ ID NO: 169639 - DNA, 20 bp, Artificial
  CRISPR gRNA sequence
ctctgtaacaaagaagagcg

SEQ ID NO: 169640 - DNA, 20 bp, Artificial
  CRISPR gRNA sequence
tctgtaacaaagaagagcgg

SEQ ID NO: 169641 - DNA, 20 bp, Artificial
  CRISPR gRNA sequence
tgtaacaaagaagagcggtg

SEQ ID NO: 169642 - DNA, 20 bp, Artificial
  CRISPR gRNA sequence
taacaaagaagagcggtgtg

SEQ ID NO: 169643 - DNA, 20 bp, Artificial
  CRISPR gRNA sequence
gcctggggagaaactagttc

SEQ ID NO: 169644 - DNA, 20 bp, Artificial
  CRISPR gRNA sequence
gggagaaactagttcacttg

SEQ ID NO: 169645 - DNA, 20 bp, Artificial
  CRISPR gRNA sequence
gttcacttggctttataccc

SEQ ID NO: 169646 - DNA, 20 bp, Artificial
  CRISPR gRNA sequence
acttggctttataccctcca

SEQ ID NO: 169647 - DNA, 20 bp, Artificial
  CRISPR gRNA sequence
ggctttataccctccaagta

SEQ ID NO: 169648 - DNA, 20 bp, Artificial
  CRISPR gRNA sequence
gctttataccctccaagtaa

SEQ ID NO: 169649 - DNA, 20 bp, Artificial
  CRISPR gRNA sequence
tataccctccaagtaaggta

SEQ ID NO: 169650 - DNA, 20 bp, Artificial
  CRISPR gRNA sequence
ataccctccaagtaaggtaa

SEQ ID NO: 169651 - DNA, 20 bp, Artificial
  CRISPR gRNA sequence
taccctccaagtaaggtaag

SEQ ID NO: 169652 - DNA, 20 bp, Artificial
  CRISPR gRNA sequence
caagtaaggtaagacgactt

SEQ ID NO: 169653 - DNA, 20 bp, Artificial
  CRISPR gRNA sequence
ttaagccaaactaaacacct

SEQ ID NO: 169654 - DNA, 20 bp, Artificial
  CRISPR gRNA sequence
taagccaaactaaacaccta

SEQ ID NO: 169655 - DNA, 20 bp, Artificial
  CRISPR gRNA sequence
aagccaaactaaacacctac

SEQ ID NO: 169656 - DNA, 20 bp, Artificial
  CRISPR gRNA sequence
agccaaactaaacacctacg

SEQ ID NO: 169657 - DNA, 20 bp, Artificial
  CRISPR gRNA sequence
aacacctacgggcaagtcta

SEQ ID NO: 169658 - DNA, 20 bp, Artificial
  CRISPR gRNA sequence
cgggcaagtctacagctgaa

SEQ ID NO: 169659 - DNA, 20 bp, Artificial
  CRISPR gRNA sequence
cagctgaaataagcacagcc

SEQ ID NO: 169660 - DNA, 20 bp, Artificial
  CRISPR gRNA sequence
aaataagcacagccaaactc

SEQ ID NO: 169661 - DNA, 20 bp, Artificial
  CRISPR gRNA sequence
atatactttaaatgatcaga

SEQ ID NO: 169662 - DNA, 20 bp, Artificial
  CRISPR gRNA sequence
taaatgatcagacctggtgg

SEQ ID NO: 169663 - DNA, 20 bp, Artificial
  CRISPR gRNA sequence
aaatgatcagacctggtggg

SEQ ID NO: 169664 - DNA, 20 bp, Artificial
  CRISPR gRNA sequence
aatgatcagacctggtgggc

SEQ ID NO: 169665 - DNA, 20 bp, Artificial
  CRISPR gRNA sequence
gtgggcaaccatcaacaaaa

SEQ ID NO: 169666 - DNA, 20 bp, Artificial
  CRISPR gRNA sequence
acactgtaaaatggggtatc

SEQ ID NO: 169667 - DNA, 20 bp, Artificial
  CRISPR gRNA sequence
taaaatggggtatctgagcc

SEQ ID NO: 169668 - DNA, 20 bp, Artificial
  CRISPR gRNA sequence
agcctccaaccactgctact

SEQ ID NO: 169669 - DNA, 20 bp, Artificial
  CRISPR gRNA sequence
caaccactgctactcctgct

SEQ ID NO: 169670 - DNA, 20 bp, Artificial
  CRISPR gRNA sequence
ctactcctgcttgatcctct

SEQ ID NO: 169671 - DNA, 20 bp, Artificial
  CRISPR gRNA sequence
ctcctgcttgatcctctccc

SEQ ID NO: 169672 - DNA, 20 bp, Artificial
  CRISPR gRNA sequence
ctgcttgatcctctccccgc

SEQ ID NO: 169673 - DNA, 20 bp, Artificial
  CRISPR gRNA sequence
cttgatcctctccccgcgat

SEQ ID NO: 169674 - DNA, 20 bp, Artificial
  CRISPR gRNA sequence
gatcctctccccgcgatttt

SEQ ID NO: 169675 - DNA, 20 bp, Artificial
  CRISPR gRNA sequence
atcctctccccgcgattttc

SEQ ID NO: 169676 - DNA, 20 bp, Artificial
  CRISPR gRNA sequence
tccccgcgattttcaaatta

SEQ ID NO: 169677 - DNA, 20 bp, Artificial
  CRISPR gRNA sequence
cccgcgattttcaaattaca

SEQ ID NO: 169678 - DNA, 20 bp, Artificial
  CRISPR gRNA sequence
tcaaattacaaacctagtaa

SEQ ID NO: 169679 - DNA, 20 bp, Artificial
  CRISPR gRNA sequence
caaattacaaacctagtaat

SEQ ID NO: 169680 - DNA, 20 bp, Artificial
  CRISPR gRNA sequence
aaattacaaacctagtaatc

SEQ ID NO: 169681 - DNA, 20 bp, Artificial
  CRISPR gRNA sequence
caaacctagtaatctcaatt

SEQ ID NO: 169682 - DNA, 20 bp, Artificial
  CRISPR gRNA sequence
gtaatctcaattagcaggtt

SEQ ID NO: 169683 - DNA, 20 bp, Artificial
  CRISPR gRNA sequence
aattagcaggtttctggtca

SEQ ID NO: 169684 - DNA, 20 bp, Artificial
  CRISPR gRNA sequence
gcaggtttctggtcattctg

SEQ ID NO: 169685 - DNA, 20 bp, Artificial
  CRISPR gRNA sequence
ctggtcattctgtgggttag

SEQ ID NO: 169686 - DNA, 20 bp, Artificial
  CRISPR gRNA sequence
tggtcattctgtgggttagc

SEQ ID NO: 169687 - DNA, 20 bp, Artificial
  CRISPR gRNA sequence
gtcattctgtgggttagcaa

SEQ ID NO: 169688 - DNA, 20 bp, Artificial
  CRISPR gRNA sequence
tgtgggttagcaaagttagg

SEQ ID NO: 169689 - DNA, 20 bp, Artificial
  CRISPR gRNA sequence
tgggttagcaaagttaggtt

SEQ ID NO: 169690 - DNA, 20 bp, Artificial
  CRISPR gRNA sequence
gcaaagttaggtttataatc

SEQ ID NO: 169691 - DNA, 20 bp, Artificial
  CRISPR gRNA sequence
ggtttataatctttttaagg

SEQ ID NO: 169692 - DNA, 20 bp, Artificial
  CRISPR gRNA sequence
ataatctttttaaggcccta

SEQ ID NO: 169693 - DNA, 20 bp, Artificial
  CRISPR gRNA sequence
taatctttttaaggccctaa

SEQ ID NO: 169694 - DNA, 20 bp, Artificial
  CRISPR gRNA sequence
tttaaggccctaaataatat

SEQ ID NO: 169695 - DNA, 20 bp, Artificial
  CRISPR gRNA sequence
ttaaggccctaaataatatt

SEQ ID NO: 169696 - DNA, 20 bp, Artificial
  CRISPR gRNA sequence
taaggccctaaataatattt

SEQ ID NO: 169697 - DNA, 20 bp, Artificial
  CRISPR gRNA sequence
aaggccctaaataatatttt

SEQ ID NO: 169698 - DNA, 20 bp, Artificial
  CRISPR gRNA sequence
aggccctaaataatattttc

SEQ ID NO: 169699 - DNA, 20 bp, Artificial
  CRISPR gRNA sequence
aataatattttccctttggt

SEQ ID NO: 169700 - DNA, 20 bp, Artificial
  CRISPR gRNA sequence
tccctttggttcacaagtat

SEQ ID NO: 169701 - DNA, 20 bp, Artificial
  CRISPR gRNA sequence
ccctttggttcacaagtatt

SEQ ID NO: 169702 - DNA, 20 bp, Artificial
  CRISPR gRNA sequence
cctttggttcacaagtattg

SEQ ID NO: 169703 - DNA, 20 bp, Artificial
  CRISPR gRNA sequence
tggttcacaagtattgaatt

SEQ ID NO: 169704 - DNA, 20 bp, Artificial
  CRISPR gRNA sequence
ggttcacaagtattgaatta

SEQ ID NO: 169705 - DNA, 20 bp, Artificial
  CRISPR gRNA sequence
gttcacaagtattgaattag

SEQ ID NO: 169706 - DNA, 20 bp, Artificial
  CRISPR gRNA sequence
acaagtattgaattaggtaa

SEQ ID NO: 169707 - DNA, 20 bp, Artificial
  CRISPR gRNA sequence
aattaggtaaaatcctaatt

SEQ ID NO: 169708 - DNA, 20 bp, Artificial
  CRISPR gRNA sequence
ggtaaaatcctaattcaata

SEQ ID NO: 169709 - DNA, 20 bp, Artificial
  CRISPR gRNA sequence
attcaataactttttgcaac

SEQ ID NO: 169710 - DNA, 20 bp, Artificial
  CRISPR gRNA sequence
aataactttttgcaacattt

SEQ ID NO: 169711 - DNA, 20 bp, Artificial
  CRISPR gRNA sequence
tttgcaacattttcaagtca

SEQ ID NO: 169712 - DNA, 20 bp, Artificial
  CRISPR gRNA sequence
ttgcaacattttcaagtcac

SEQ ID NO: 169713 - DNA, 20 bp, Artificial
  CRISPR gRNA sequence
tgcaacattttcaagtcact

SEQ ID NO: 169714 - DNA, 20 bp, Artificial
  CRISPR gRNA sequence
gcaacattttcaagtcactg

SEQ ID NO: 169715 - DNA, 20 bp, Artificial
  CRISPR gRNA sequence
caacattttcaagtcactgg

SEQ ID NO: 169716 - DNA, 20 bp, Artificial
  CRISPR gRNA sequence
tcaagtcactggatctatat

SEQ ID NO: 169717 - DNA, 20 bp, Artificial
  CRISPR gRNA sequence
caagtcactggatctatata

SEQ ID NO: 169718 - DNA, 20 bp, Artificial
  CRISPR gRNA sequence
aagtcactggatctatatac

SEQ ID NO: 169719 - DNA, 20 bp, Artificial
  CRISPR gRNA sequence
gatctatatacactaagttc

SEQ ID NO: 169720 - DNA, 20 bp, Artificial
  CRISPR gRNA sequence
tatacactaagttctcacaa

SEQ ID NO: 169721 - DNA, 20 bp, Artificial
  CRISPR gRNA sequence
agttctcacaagctatgatt

SEQ ID NO: 169722 - DNA, 20 bp, Artificial
  CRISPR gRNA sequence
tcacaagctatgatttttat

SEQ ID NO: 169723 - DNA, 20 bp, Artificial
  CRISPR gRNA sequence
acaagctatgatttttattt

SEQ ID NO: 169724 - DNA, 20 bp, Artificial
  CRISPR gRNA sequence
tgatttttatttgggaattc

SEQ ID NO: 169725 - DNA, 20 bp, Artificial
  CRISPR gRNA sequence
ttatttgggaattctaaatt

SEQ ID NO: 169726 - DNA, 20 bp, Artificial
  CRISPR gRNA sequence
tatttgggaattctaaattg

SEQ ID NO: 169727 - DNA, 20 bp, Artificial
  CRISPR gRNA sequence
atttgggaattctaaattgc

SEQ ID NO: 169728 - DNA, 20 bp, Artificial
  CRISPR gRNA sequence
tttgggaattctaaattgca

SEQ ID NO: 169729 - DNA, 20 bp, Artificial
  CRISPR gRNA sequence
gggaattctaaattgcaata

SEQ ID NO: 169730 - DNA, 20 bp, Artificial
  CRISPR gRNA sequence
ggaattctaaattgcaatac

SEQ ID NO: 169731 - DNA, 20 bp, Artificial
  CRISPR gRNA sequence
taaattgcaatacttaaacc

SEQ ID NO: 169732 - DNA, 20 bp, Artificial
  CRISPR gRNA sequence
aattgcaatacttaaaccat

SEQ ID NO: 169733 - DNA, 20 bp, Artificial
  CRISPR gRNA sequence
caatacttaaaccatgggtt

SEQ ID NO: 169734 - DNA, 20 bp, Artificial
  CRISPR gRNA sequence
aaaccatgggtttatcattg

SEQ ID NO: 169735 - DNA, 20 bp, Artificial
  CRISPR gRNA sequence
aaccatgggtttatcattgc

SEQ ID NO: 169736 - DNA, 20 bp, Artificial
  CRISPR gRNA sequence
atcattgcagttctgaattc

SEQ ID NO: 169737 - DNA, 20 bp, Artificial
  CRISPR gRNA sequence
tcattgcagttctgaattcc

SEQ ID NO: 169738 - DNA, 20 bp, Artificial
  CRISPR gRNA sequence
cagttctgaattcccaaata

SEQ ID NO: 169739 - DNA, 20 bp, Artificial
  CRISPR gRNA sequence
tgaattcccaaataaaaaac

SEQ ID NO: 169740 - DNA, 20 bp, Artificial
  CRISPR gRNA sequence
aattcccaaataaaaaacat

SEQ ID NO: 169741 - DNA, 20 bp, Artificial
  CRISPR gRNA sequence
ccaaataaaaaacatagctt

SEQ ID NO: 169742 - DNA, 20 bp, Artificial
  CRISPR gRNA sequence
gtgagaattctgatattcat

SEQ ID NO: 169743 - DNA, 20 bp, Artificial
  CRISPR gRNA sequence
tgagaattctgatattcata

SEQ ID NO: 169744 - DNA, 20 bp, Artificial
  CRISPR gRNA sequence
tgatattcatagtttgtgct

SEQ ID NO: 169745 - DNA, 20 bp, Artificial
  CRISPR gRNA sequence
atattcatagtttgtgctat

SEQ ID NO: 169746 - DNA, 20 bp, Artificial
  CRISPR gRNA sequence
atagtttgtgctatgaacag

SEQ ID NO: 169747 - DNA, 20 bp, Artificial
  CRISPR gRNA sequence
gtgctatgaacagcagcaag

SEQ ID NO: 169748 - DNA, 20 bp, Artificial
  CRISPR gRNA sequence
tgctatgaacagcagcaaga

SEQ ID NO: 169749 - DNA, 20 bp, Artificial
  CRISPR gRNA sequence
tgaacagcagcaagagaggt

SEQ ID NO: 169750 - DNA, 20 bp, Artificial
  CRISPR gRNA sequence
atgatactgaaaccaagacc

SEQ ID NO: 169751 - DNA, 20 bp, Artificial
  CRISPR gRNA sequence
aaaccaagacctgctctaat

SEQ ID NO: 169752 - DNA, 20 bp, Artificial
  CRISPR gRNA sequence
ctctaatgggggtttctctc

SEQ ID NO: 169753 - DNA, 20 bp, Artificial
  CRISPR gRNA sequence
taatgggggtttctctccaa

SEQ ID NO: 169754 - DNA, 20 bp, Artificial
  CRISPR gRNA sequence
atgggggtttctctccaagt

SEQ ID NO: 169755 - DNA, 20 bp, Artificial
  CRISPR gRNA sequence
ctctccaagtgtgatacttc

SEQ ID NO: 169756 - DNA, 20 bp, Artificial
  CRISPR gRNA sequence
tctccaagtgtgatacttcc

SEQ ID NO: 169757 - DNA, 20 bp, Artificial
  CRISPR gRNA sequence
tccaagtgtgatacttcctt

SEQ ID NO: 169758 - DNA, 20 bp, Artificial
  CRISPR gRNA sequence
caagtgtgatacttcctttc

SEQ ID NO: 169759 - DNA, 20 bp, Artificial
  CRISPR gRNA sequence
cctttctttgaataataaaa

SEQ ID NO: 169760 - DNA, 20 bp, Artificial
  CRISPR gRNA sequence
ctttctttgaataataaaat

SEQ ID NO: 169761 - DNA, 20 bp, Artificial
  CRISPR gRNA sequence
tctttgaataataaaattaa

SEQ ID NO: 169762 - DNA, 20 bp, Artificial
  CRISPR gRNA sequence
ctttgaataataaaattaaa

SEQ ID NO: 169763 - DNA, 20 bp, Artificial
  CRISPR gRNA sequence
tttgaataataaaattaaaa

SEQ ID NO: 169764 - DNA, 20 bp, Artificial
  CRISPR gRNA sequence
tgaataataaaattaaaaga

SEQ ID NO: 169765 - DNA, 20 bp, Artificial
  CRISPR gRNA sequence
gaataataaaattaaaagat

SEQ ID NO: 169766 - DNA, 20 bp, Artificial
  CRISPR gRNA sequence
aataataaaattaaaagatt

SEQ ID NO: 169767 - DNA, 20 bp, Artificial
  CRISPR gRNA sequence
aaagatttttactaaaaccc

SEQ ID NO: 169768 - DNA, 20 bp, Artificial
  CRISPR gRNA sequence
ttactaaaacccaacatatt

SEQ ID NO: 169769 - DNA, 20 bp, Artificial
  CRISPR gRNA sequence
tactaaaacccaacatatta

SEQ ID NO: 169770 - DNA, 20 bp, Artificial
  CRISPR gRNA sequence
actaaaacccaacatattat

SEQ ID NO: 169771 - DNA, 20 bp, Artificial
  CRISPR gRNA sequence
ctaaaacccaacatattatg

SEQ ID NO: 169772 - DNA, 20 bp, Artificial
  CRISPR gRNA sequence
aaacccaacatattatgtat

SEQ ID NO: 169773 - DNA, 20 bp, Artificial
  CRISPR gRNA sequence
tgtatagttaagatttgtgt

SEQ ID NO: 169774 - DNA, 20 bp, Artificial
  CRISPR gRNA sequence
agatttgtgtactttactaa

SEQ ID NO: 169775 - DNA, 20 bp, Artificial
  CRISPR gRNA sequence
gtgtactttactaaagattt

SEQ ID NO: 169776 - DNA, 20 bp, Artificial
  CRISPR gRNA sequence
tgtactttactaaagattta

SEQ ID NO: 169777 - DNA, 20 bp, Artificial
  CRISPR gRNA sequence
tactaaagatttaaagcaaa

SEQ ID NO: 169778 - DNA, 20 bp, Artificial
  CRISPR gRNA sequence
actaaagatttaaagcaaaa

SEQ ID NO: 169779 - DNA, 20 bp, Artificial
  CRISPR gRNA sequence
ctaaagatttaaagcaaaag

SEQ ID NO: 169780 - DNA, 20 bp, Artificial
  CRISPR gRNA sequence
aagatttaaagcaaaaggaa

SEQ ID NO: 169781 - DNA, 20 bp, Artificial
  CRISPR gRNA sequence
aaagcaaaaggaaaaacaat

SEQ ID NO: 169782 - DNA, 20 bp, Artificial
  CRISPR gRNA sequence
aagcaaaaggaaaaacaata

SEQ ID NO: 169783 - DNA, 20 bp, Artificial
  CRISPR gRNA sequence
aacgctagtgaatgatatgc

SEQ ID NO: 169784 - DNA, 20 bp, Artificial
  CRISPR gRNA sequence
gtgaatgatatgcatgttaa

SEQ ID NO: 169785 - DNA, 20 bp, Artificial
  CRISPR gRNA sequence
aagtatttgggcaaagtaaa

SEQ ID NO: 169786 - DNA, 20 bp, Artificial
  CRISPR gRNA sequence
gggcaaagtaaactttacaa

SEQ ID NO: 169787 - DNA, 20 bp, Artificial
  CRISPR gRNA sequence
ggcaaagtaaactttacaat

SEQ ID NO: 169788 - DNA, 20 bp, Artificial
  CRISPR gRNA sequence
tacaatgcacttaaaaacag

SEQ ID NO: 169789 - DNA, 20 bp, Artificial
  CRISPR gRNA sequence
acaatgcacttaaaaacaga

SEQ ID NO: 169790 - DNA, 20 bp, Artificial
  CRISPR gRNA sequence
caatgcacttaaaaacagat

SEQ ID NO: 169791 - DNA, 20 bp, Artificial
  CRISPR gRNA sequence
aaaaacagattacttgaagg

SEQ ID NO: 169792 - DNA, 20 bp, Artificial
  CRISPR gRNA sequence
aaaacagattacttgaagga

SEQ ID NO: 169793 - DNA, 20 bp, Artificial
  CRISPR gRNA sequence
cttgaaggatggatagaggg

SEQ ID NO: 169794 - DNA, 20 bp, Artificial
  CRISPR gRNA sequence
gaaggatggatagagggata

SEQ ID NO: 169795 - DNA, 20 bp, Artificial
  CRISPR gRNA sequence
aaggatggatagagggataa

SEQ ID NO: 169796 - DNA, 20 bp, Artificial
  CRISPR gRNA sequence
atggtagaatctaggttgta

SEQ ID NO: 169797 - DNA, 20 bp, Artificial
  CRISPR gRNA sequence
tggtagaatctaggttgtaa

SEQ ID NO: 169798 - DNA, 20 bp, Artificial
  CRISPR gRNA sequence
ggttgtaagtatacaggtat

SEQ ID NO: 169799 - DNA, 20 bp, Artificial
  CRISPR gRNA sequence
taagtatacaggtattcact

SEQ ID NO: 169800 - DNA, 20 bp, Artificial
  CRISPR gRNA sequence
actgtaaactttgcttatgt

SEQ ID NO: 169801 - DNA, 20 bp, Artificial
  CRISPR gRNA sequence
taaactttgcttatgtttga

SEQ ID NO: 169802 - DNA, 20 bp, Artificial
  CRISPR gRNA sequence
tgcttatgtttgaaattttt

SEQ ID NO: 169803 - DNA, 20 bp, Artificial
  CRISPR gRNA sequence
gcttatgtttgaaatttttc

SEQ ID NO: 169804 - DNA, 20 bp, Artificial
  CRISPR gRNA sequence
cttatgtttgaaatttttca

SEQ ID NO: 169805 - DNA, 20 bp, Artificial
  CRISPR gRNA sequence
atgtttgaaatttttcataa

SEQ ID NO: 169806 - DNA, 20 bp, Artificial
  CRISPR gRNA sequence
tgtttgaaatttttcataat

SEQ ID NO: 169807 - DNA, 20 bp, Artificial
  CRISPR gRNA sequence
gaaatttttcataataaaat

SEQ ID NO: 169808 - DNA, 20 bp, Artificial
  CRISPR gRNA sequence
aaatttttcataataaaatg

SEQ ID NO: 169809 - DNA, 20 bp, Artificial
  CRISPR gRNA sequence
ttcataataaaatgctgggg

SEQ ID NO: 169810 - DNA, 20 bp, Artificial
  CRISPR gRNA sequence
tcataataaaatgctgggga

SEQ ID NO: 169811 - DNA, 20 bp, Artificial
  CRISPR gRNA sequence
cataataaaatgctggggaa

SEQ ID NO: 169812 - DNA, 20 bp, Artificial
  CRISPR gRNA sequence
ataataaaatgctggggaaa

SEQ ID NO: 169813 - DNA, 20 bp, Artificial
  CRISPR gRNA sequence
gggaaaatgttaacacacta

SEQ ID NO: 169814 - DNA, 20 bp, Artificial
  CRISPR gRNA sequence
acacactaacagaaatcctt

SEQ ID NO: 169815 - DNA, 20 bp, Artificial
  CRISPR gRNA sequence
acagaaatccttagcaaact

SEQ ID NO: 169816 - DNA, 20 bp, Artificial
  CRISPR gRNA sequence
agcaaactctatataccaca

SEQ ID NO: 169817 - DNA, 20 bp, Artificial
  CRISPR gRNA sequence
gcaaactctatataccacac

SEQ ID NO: 169818 - DNA, 20 bp, Artificial
  CRISPR gRNA sequence
tatataccacaccttaaaag

SEQ ID NO: 169819 - DNA, 20 bp, Artificial
  CRISPR gRNA sequence
tataccacaccttaaaaggt

SEQ ID NO: 169820 - DNA, 20 bp, Artificial
  CRISPR gRNA sequence
aaaaggtgactcatcggaca

SEQ ID NO: 169821 - DNA, 20 bp, Artificial
  CRISPR gRNA sequence
aaaggtgactcatcggacaa

SEQ ID NO: 169822 - DNA, 20 bp, Artificial
  CRISPR gRNA sequence
atcggacaaaacaggagagg

SEQ ID NO: 169823 - DNA, 20 bp, Artificial
  CRISPR gRNA sequence
tttttttctttcccttgtat

SEQ ID NO: 169824 - DNA, 20 bp, Artificial
  CRISPR gRNA sequence
ttttttctttcccttgtatc

SEQ ID NO: 169825 - DNA, 20 bp, Artificial
  CRISPR gRNA sequence
tttttctttcccttgtatct

SEQ ID NO: 169826 - DNA, 20 bp, Artificial
  CRISPR gRNA sequence
ttttctttcccttgtatctg

SEQ ID NO: 169827 - DNA, 20 bp, Artificial
  CRISPR gRNA sequence
tttctttcccttgtatctgt

SEQ ID NO: 169828 - DNA, 20 bp, Artificial
  CRISPR gRNA sequence
ttctttcccttgtatctgtg

SEQ ID NO: 169829 - DNA, 20 bp, Artificial
  CRISPR gRNA sequence
tctttcccttgtatctgtga

SEQ ID NO: 169830 - DNA, 20 bp, Artificial
  CRISPR gRNA sequence
ctttcccttgtatctgtgat

SEQ ID NO: 169831 - DNA, 20 bp, Artificial
  CRISPR gRNA sequence
tttcccttgtatctgtgatg

SEQ ID NO: 169832 - DNA, 20 bp, Artificial
  CRISPR gRNA sequence
tcccttgtatctgtgatggc

SEQ ID NO: 169833 - DNA, 20 bp, Artificial
  CRISPR gRNA sequence
cccttgtatctgtgatggcc

SEQ ID NO: 169834 - DNA, 20 bp, Artificial
  CRISPR gRNA sequence
ccttgtatctgtgatggccc

SEQ ID NO: 169835 - DNA, 20 bp, Artificial
  CRISPR gRNA sequence
gtatctgtgatggccccaag

SEQ ID NO: 169836 - DNA, 20 bp, Artificial
  CRISPR gRNA sequence
tatctgtgatggccccaagc

SEQ ID NO: 169837 - DNA, 20 bp, Artificial
  CRISPR gRNA sequence
tgatggccccaagcctctga

SEQ ID NO: 169838 - DNA, 20 bp, Artificial
  CRISPR gRNA sequence
tgaaatgcaaaactctagtc

SEQ ID NO: 169839 - DNA, 20 bp, Artificial
  CRISPR gRNA sequence
aaatgcaaaactctagtccg

SEQ ID NO: 169840 - DNA, 20 bp, Artificial
  CRISPR gRNA sequence
tagtccgcccttcttgccaa

SEQ ID NO: 169841 - DNA, 20 bp, Artificial
  CRISPR gRNA sequence
gtccgcccttcttgccaacc

SEQ ID NO: 169842 - DNA, 20 bp, Artificial
  CRISPR gRNA sequence
cttgccaaccacgagcttga

SEQ ID NO: 169843 - DNA, 20 bp, Artificial
  CRISPR gRNA sequence
ttgccaaccacgagcttgac

SEQ ID NO: 169844 - DNA, 20 bp, Artificial
  CRISPR gRNA sequence
gccaaccacgagcttgacga

SEQ ID NO: 169845 - DNA, 20 bp, Artificial
  CRISPR gRNA sequence
ccaaccacgagcttgacgat

SEQ ID NO: 169846 - DNA, 20 bp, Artificial
  CRISPR gRNA sequence
gacgataaaccctcccaact

SEQ ID NO: 169847 - DNA, 20 bp, Artificial
  CRISPR gRNA sequence
acgataaaccctcccaactg

SEQ ID NO: 169848 - DNA, 20 bp, Artificial
  CRISPR gRNA sequence
ccaactgaagcagggcccat

SEQ ID NO: 169849 - DNA, 20 bp, Artificial
  CRISPR gRNA sequence
aagcagggcccatcttaaga

SEQ ID NO: 169850 - DNA, 20 bp, Artificial
  CRISPR gRNA sequence
aagattgccagaactcattt

SEQ ID NO: 169851 - DNA, 20 bp, Artificial
  CRISPR gRNA sequence
agattgccagaactcattta

SEQ ID NO: 169852 - DNA, 20 bp, Artificial
  CRISPR gRNA sequence
ccagaactcatttaagatga

SEQ ID NO: 169853 - DNA, 20 bp, Artificial
  CRISPR gRNA sequence
atttaagatgactacaatat

SEQ ID NO: 169854 - DNA, 20 bp, Artificial
  CRISPR gRNA sequence
aagatgactacaatatagtg

SEQ ID NO: 169855 - DNA, 20 bp, Artificial
  CRISPR gRNA sequence
agatgactacaatatagtgt

SEQ ID NO: 169856 - DNA, 20 bp, Artificial
  CRISPR gRNA sequence
caatatagtgtcacattttt

SEQ ID NO: 169857 - DNA, 20 bp, Artificial
  CRISPR gRNA sequence
tttgatgtcatctactcaat

SEQ ID NO: 169858 - DNA, 20 bp, Artificial
  CRISPR gRNA sequence
ttgatgtcatctactcaatc

SEQ ID NO: 169859 - DNA, 20 bp, Artificial
  CRISPR gRNA sequence
tgatgtcatctactcaatct

SEQ ID NO: 169860 - DNA, 20 bp, Artificial
  CRISPR gRNA sequence
gatgtcatctactcaatcta

SEQ ID NO: 169861 - DNA, 20 bp, Artificial
  CRISPR gRNA sequence
atgtcatctactcaatctat

SEQ ID NO: 169862 - DNA, 20 bp, Artificial
  CRISPR gRNA sequence
ctcaatctatctaaatggct

SEQ ID NO: 169863 - DNA, 20 bp, Artificial
  CRISPR gRNA sequence
aatctatctaaatggctcat

SEQ ID NO: 169864 - DNA, 20 bp, Artificial
  CRISPR gRNA sequence
tctaaatggctcatttattg

SEQ ID NO: 169865 - DNA, 20 bp, Artificial
  CRISPR gRNA sequence
aatggctcatttattgatgg

SEQ ID NO: 169866 - DNA, 20 bp, Artificial
  CRISPR gRNA sequence
atttattgatggaataaaag

SEQ ID NO: 169867 - DNA, 20 bp, Artificial
  CRISPR gRNA sequence
attgatggaataaaagggga

SEQ ID NO: 169868 - DNA, 20 bp, Artificial
  CRISPR gRNA sequence
ttgatggaataaaaggggaa

SEQ ID NO: 169869 - DNA, 20 bp, Artificial
  CRISPR gRNA sequence
atggaataaaaggggaaaaa

SEQ ID NO: 169870 - DNA, 20 bp, Artificial
  CRISPR gRNA sequence
cagcatataataaaatattc

SEQ ID NO: 169871 - DNA, 20 bp, Artificial
  CRISPR gRNA sequence
tagagtattttggaaacata

SEQ ID NO: 169872 - DNA, 20 bp, Artificial
  CRISPR gRNA sequence
gagtattttggaaacataga

SEQ ID NO: 169873 - DNA, 20 bp, Artificial
  CRISPR gRNA sequence
tggaaacatagatatactta

SEQ ID NO: 169874 - DNA, 20 bp, Artificial
  CRISPR gRNA sequence
ggaaacatagatatacttaa

SEQ ID NO: 169875 - DNA, 20 bp, Artificial
  CRISPR gRNA sequence
gaaacatagatatacttaag

SEQ ID NO: 169876 - DNA, 20 bp, Artificial
  CRISPR gRNA sequence
aagttggtcttcctaaaatt

SEQ ID NO: 169877 - DNA, 20 bp, Artificial
  CRISPR gRNA sequence
agttggtcttcctaaaattt

SEQ ID NO: 169878 - DNA, 20 bp, Artificial
  CRISPR gRNA sequence
gtcttcctaaaatttttatt

SEQ ID NO: 169879 - DNA, 20 bp, Artificial
  CRISPR gRNA sequence
cctaaaatttttatttgctt

SEQ ID NO: 169880 - DNA, 20 bp, Artificial
  CRISPR gRNA sequence
ctaaaatttttatttgcttt

SEQ ID NO: 169881 - DNA, 20 bp, Artificial
  CRISPR gRNA sequence
aaatttttatttgcttttta

SEQ ID NO: 169882 - DNA, 20 bp, Artificial
  CRISPR gRNA sequence
ttatttgctttttaaattcc

SEQ ID NO: 169883 - DNA, 20 bp, Artificial
  CRISPR gRNA sequence
tatttgctttttaaattccc

SEQ ID NO: 169884 - DNA, 20 bp, Artificial
  CRISPR gRNA sequence
atttgctttttaaattccct

SEQ ID NO: 169885 - DNA, 20 bp, Artificial
  CRISPR gRNA sequence
tttgctttttaaattccctg

SEQ ID NO: 169886 - DNA, 20 bp, Artificial
  CRISPR gRNA sequence
gctttttaaattccctgagg

SEQ ID NO: 169887 - DNA, 20 bp, Artificial
  CRISPR gRNA sequence
ctttttaaattccctgaggc

SEQ ID NO: 169888 - DNA, 20 bp, Artificial
  CRISPR gRNA sequence
tttaaattccctgaggcagg

SEQ ID NO: 169889 - DNA, 20 bp, Artificial
  CRISPR gRNA sequence
ttaaattccctgaggcagga

SEQ ID NO: 169890 - DNA, 20 bp, Artificial
  CRISPR gRNA sequence
taaattccctgaggcaggag

SEQ ID NO: 169891 - DNA, 20 bp, Artificial
  CRISPR gRNA sequence
aaattccctgaggcaggagg

SEQ ID NO: 169892 - DNA, 20 bp, Artificial
  CRISPR gRNA sequence
aattccctgaggcaggagga

SEQ ID NO: 169893 - DNA, 20 bp, Artificial
  CRISPR gRNA sequence
cctgaggcaggaggatcgct

SEQ ID NO: 169894 - DNA, 20 bp, Artificial
  CRISPR gRNA sequence
aggcaggaggatcgcttgag

SEQ ID NO: 169895 - DNA, 20 bp, Artificial
  CRISPR gRNA sequence
gagccaggagtttcaagacc

SEQ ID NO: 169896 - DNA, 20 bp, Artificial
  CRISPR gRNA sequence
agccaggagtttcaagacca

SEQ ID NO: 169897 - DNA, 20 bp, Artificial
  CRISPR gRNA sequence
caagaccagctctgggcaac

SEQ ID NO: 169898 - DNA, 20 bp, Artificial
  CRISPR gRNA sequence
aagaccagctctgggcaaca

SEQ ID NO: 169899 - DNA, 20 bp, Artificial
  CRISPR gRNA sequence
tgggcaacatagtaaggcct

SEQ ID NO: 169900 - DNA, 20 bp, Artificial
  CRISPR gRNA sequence
ggcaacatagtaaggcctca

SEQ ID NO: 169901 - DNA, 20 bp, Artificial
  CRISPR gRNA sequence
atctctacaacaacaacaac

SEQ ID NO: 169902 - DNA, 20 bp, Artificial
  CRISPR gRNA sequence
tacaacaacaacaacaaaaa

SEQ ID NO: 169903 - DNA, 20 bp, Artificial
  CRISPR gRNA sequence
caacaacaacaacaaaaatt

SEQ ID NO: 169904 - DNA, 20 bp, Artificial
  CRISPR gRNA sequence
taagccagatatggtggcat

SEQ ID NO: 169905 - DNA, 20 bp, Artificial
  CRISPR gRNA sequence
aagccagatatggtggcatg

SEQ ID NO: 169906 - DNA, 20 bp, Artificial
  CRISPR gRNA sequence
agccagatatggtggcatgc

SEQ ID NO: 169907 - DNA, 20 bp, Artificial
  CRISPR gRNA sequence
tagtctcagctacttgggag

SEQ ID NO: 169908 - DNA, 20 bp, Artificial
  CRISPR gRNA sequence
agctacttgggaggctgagg

SEQ ID NO: 169909 - DNA, 20 bp, Artificial
  CRISPR gRNA sequence
cttgggaggctgaggtggga

SEQ ID NO: 169910 - DNA, 20 bp, Artificial
  CRISPR gRNA sequence
gggaggctgaggtgggagga

SEQ ID NO: 169911 - DNA, 20 bp, Artificial
  CRISPR gRNA sequence
ggaggctgaggtgggaggat

SEQ ID NO: 169912 - DNA, 20 bp, Artificial
  CRISPR gRNA sequence
aggtgggaggatcacttgag

SEQ ID NO: 169913 - DNA, 20 bp, Artificial
  CRISPR gRNA sequence
gagcccaggaggtcgaggct

SEQ ID NO: 169914 - DNA, 20 bp, Artificial
  CRISPR gRNA sequence
agcccaggaggtcgaggctg

SEQ ID NO: 169915 - DNA, 20 bp, Artificial
  CRISPR gRNA sequence
caatgagctgtgattgcgcc

SEQ ID NO: 169916 - DNA, 20 bp, Artificial
  CRISPR gRNA sequence
tgattgcgccactgcactcc

SEQ ID NO: 169917 - DNA, 20 bp, Artificial
  CRISPR gRNA sequence
cgccactgcactccagccta

SEQ ID NO: 169918 - DNA, 20 bp, Artificial
  CRISPR gRNA sequence
cactccagcctaggccacag

SEQ ID NO: 169919 - DNA, 20 bp, Artificial
  CRISPR gRNA sequence
cagcctaggccacagagtga

SEQ ID NO: 169920 - DNA, 20 bp, Artificial
  CRISPR gRNA sequence
ggccacagagtgagacccta

SEQ ID NO: 169921 - DNA, 20 bp, Artificial
  CRISPR gRNA sequence
tctcaaaaaataaaaaagga

SEQ ID NO: 169922 - DNA, 20 bp, Artificial
  CRISPR gRNA sequence
aaaaaataaaaaaggaatat

SEQ ID NO: 169923 - DNA, 20 bp, Artificial
  CRISPR gRNA sequence
cttctagccctttccagtca

SEQ ID NO: 169924 - DNA, 20 bp, Artificial
  CRISPR gRNA sequence
ctagccctttccagtcaata

SEQ ID NO: 169925 - DNA, 20 bp, Artificial
  CRISPR gRNA sequence
tagccctttccagtcaatat

SEQ ID NO: 169926 - DNA, 20 bp, Artificial
  CRISPR gRNA sequence
gccctttccagtcaatatcc

SEQ ID NO: 169927 - DNA, 20 bp, Artificial
  CRISPR gRNA sequence
tccagtcaatatccttcccc

SEQ ID NO: 169928 - DNA, 20 bp, Artificial
  CRISPR gRNA sequence
ccagtcaatatccttcccca

SEQ ID NO: 169929 - DNA, 20 bp, Artificial
  CRISPR gRNA sequence
cagtcaatatccttccccac

SEQ ID NO: 169930 - DNA, 20 bp, Artificial
  CRISPR gRNA sequence
ccccacactcccctaaatct

SEQ ID NO: 169931 - DNA, 20 bp, Artificial
  CRISPR gRNA sequence
cccacactcccctaaatctg

SEQ ID NO: 169932 - DNA, 20 bp, Artificial
  CRISPR gRNA sequence
ccctaaatctgggcaaccac

SEQ ID NO: 169933 - DNA, 20 bp, Artificial
  CRISPR gRNA sequence
aatctgggcaaccacaactc

SEQ ID NO: 169934 - DNA, 20 bp, Artificial
  CRISPR gRNA sequence
ggcaaccacaactctgattt

SEQ ID NO: 169935 - DNA, 20 bp, Artificial
  CRISPR gRNA sequence
tgatttctatcactataggt

SEQ ID NO: 169936 - DNA, 20 bp, Artificial
  CRISPR gRNA sequence
atttctatcactataggtgg

SEQ ID NO: 169937 - DNA, 20 bp, Artificial
  CRISPR gRNA sequence
ctatcactataggtggtaat

SEQ ID NO: 169938 - DNA, 20 bp, Artificial
  CRISPR gRNA sequence
tatcactataggtggtaata

SEQ ID NO: 169939 - DNA, 20 bp, Artificial
  CRISPR gRNA sequence
tcactataggtggtaataat

SEQ ID NO: 169940 - DNA, 20 bp, Artificial
  CRISPR gRNA sequence
taggtggtaataatgcattg

SEQ ID NO: 169941 - DNA, 20 bp, Artificial
  CRISPR gRNA sequence
tatcatgcactatgtaattt

SEQ ID NO: 169942 - DNA, 20 bp, Artificial
  CRISPR gRNA sequence
tgtaattttttccctctggt

SEQ ID NO: 169943 - DNA, 20 bp, Artificial
  CRISPR gRNA sequence
tttccctctggttccttttg

SEQ ID NO: 169944 - DNA, 20 bp, Artificial
  CRISPR gRNA sequence
ttccctctggttccttttgt

SEQ ID NO: 169945 - DNA, 20 bp, Artificial
  CRISPR gRNA sequence
tccctctggttccttttgtt

SEQ ID NO: 169946 - DNA, 20 bp, Artificial
  CRISPR gRNA sequence
ccctctggttccttttgtta

SEQ ID NO: 169947 - DNA, 20 bp, Artificial
  CRISPR gRNA sequence
cctctggttccttttgttaa

SEQ ID NO: 169948 - DNA, 20 bp, Artificial
  CRISPR gRNA sequence
tggttccttttgttaacata

SEQ ID NO: 169949 - DNA, 20 bp, Artificial
  CRISPR gRNA sequence
gttccttttgttaacatagt

SEQ ID NO: 169950 - DNA, 20 bp, Artificial
  CRISPR gRNA sequence
cttttgttaacatagtatct

SEQ ID NO: 169951 - DNA, 20 bp, Artificial
  CRISPR gRNA sequence
ttgttaacatagtatctttg

SEQ ID NO: 169952 - DNA, 20 bp, Artificial
  CRISPR gRNA sequence
tgttaacatagtatctttga

SEQ ID NO: 169953 - DNA, 20 bp, Artificial
  CRISPR gRNA sequence
gttaacatagtatctttgag

SEQ ID NO: 169954 - DNA, 20 bp, Artificial
  CRISPR gRNA sequence
ttaacatagtatctttgaga

SEQ ID NO: 169955 - DNA, 20 bp, Artificial
  CRISPR gRNA sequence
acatagtatctttgagattt

SEQ ID NO: 169956 - DNA, 20 bp, Artificial
  CRISPR gRNA sequence
tgagatttatccatgttgta

SEQ ID NO: 169957 - DNA, 20 bp, Artificial
  CRISPR gRNA sequence
gagatttatccatgttgtat

SEQ ID NO: 169958 - DNA, 20 bp, Artificial
  CRISPR gRNA sequence
agatttatccatgttgtatg

SEQ ID NO: 169959 - DNA, 20 bp, Artificial
  CRISPR gRNA sequence
atccatgttgtatggagcaa

SEQ ID NO: 169960 - DNA, 20 bp, Artificial
  CRISPR gRNA sequence
tccatgttgtatggagcaat

SEQ ID NO: 169961 - DNA, 20 bp, Artificial
  CRISPR gRNA sequence
tatggagcaatggtttgttt

SEQ ID NO: 169962 - DNA, 20 bp, Artificial
  CRISPR gRNA sequence
gtttctttttattgctgagg

SEQ ID NO: 169963 - DNA, 20 bp, Artificial
  CRISPR gRNA sequence
tttctttttattgctgagga

SEQ ID NO: 169964 - DNA, 20 bp, Artificial
  CRISPR gRNA sequence
ctttttattgctgaggagga

SEQ ID NO: 169965 - DNA, 20 bp, Artificial
  CRISPR gRNA sequence
tttttattgctgaggaggaa

SEQ ID NO: 169966 - DNA, 20 bp, Artificial
  CRISPR gRNA sequence
tttattgctgaggaggaatc

SEQ ID NO: 169967 - DNA, 20 bp, Artificial
  CRISPR gRNA sequence
ttattgctgaggaggaatcc

SEQ ID NO: 169968 - DNA, 20 bp, Artificial
  CRISPR gRNA sequence
tattgctgaggaggaatcca

SEQ ID NO: 169969 - DNA, 20 bp, Artificial
  CRISPR gRNA sequence
attgctgaggaggaatccat

SEQ ID NO: 169970 - DNA, 20 bp, Artificial
  CRISPR gRNA sequence
ttgctgaggaggaatccatt

SEQ ID NO: 169971 - DNA, 20 bp, Artificial
  CRISPR gRNA sequence
ctgaggaggaatccatttca

SEQ ID NO: 169972 - DNA, 20 bp, Artificial
  CRISPR gRNA sequence
aggaggaatccatttcatca

SEQ ID NO: 169973 - DNA, 20 bp, Artificial
  CRISPR gRNA sequence
catcaatacctcagaatttg

SEQ ID NO: 169974 - DNA, 20 bp, Artificial
  CRISPR gRNA sequence
atcaatacctcagaatttgt

SEQ ID NO: 169975 - DNA, 20 bp, Artificial
  CRISPR gRNA sequence
agaatttgtttatatattcc

SEQ ID NO: 169976 - DNA, 20 bp, Artificial
  CRISPR gRNA sequence
gtttatatattcctatattg

SEQ ID NO: 169977 - DNA, 20 bp, Artificial
  CRISPR gRNA sequence
tttatatattcctatattga

SEQ ID NO: 169978 - DNA, 20 bp, Artificial
  CRISPR gRNA sequence
atatattcctatattgatgg

SEQ ID NO: 169979 - DNA, 20 bp, Artificial
  CRISPR gRNA sequence
tatattcctatattgatgga

SEQ ID NO: 169980 - DNA, 20 bp, Artificial
  CRISPR gRNA sequence
ctatattgatggacacttga

SEQ ID NO: 169981 - DNA, 20 bp, Artificial
  CRISPR gRNA sequence
tattgatggacacttgagtt

SEQ ID NO: 169982 - DNA, 20 bp, Artificial
  CRISPR gRNA sequence
atggacacttgagttgtttc

SEQ ID NO: 169983 - DNA, 20 bp, Artificial
  CRISPR gRNA sequence
gagttgtttccagttttgag

SEQ ID NO: 169984 - DNA, 20 bp, Artificial
  CRISPR gRNA sequence
agttgtttccagttttgagg

SEQ ID NO: 169985 - DNA, 20 bp, Artificial
  CRISPR gRNA sequence
tttccagttttgaggtagta

SEQ ID NO: 169986 - DNA, 20 bp, Artificial
  CRISPR gRNA sequence
ccagttttgaggtagtataa

SEQ ID NO: 169987 - DNA, 20 bp, Artificial
  CRISPR gRNA sequence
cagttttgaggtagtataaa

SEQ ID NO: 169988 - DNA, 20 bp, Artificial
  CRISPR gRNA sequence
tgaggtagtataaacaaggt

SEQ ID NO: 169989 - DNA, 20 bp, Artificial
  CRISPR gRNA sequence
gaggtagtataaacaaggtt

SEQ ID NO: 169990 - DNA, 20 bp, Artificial
  CRISPR gRNA sequence
aggtagtataaacaaggttg

SEQ ID NO: 169991 - DNA, 20 bp, Artificial
  CRISPR gRNA sequence
ttaagagcatttttatataa

SEQ ID NO: 169992 - DNA, 20 bp, Artificial
  CRISPR gRNA sequence
agagcatttttatataagaa

SEQ ID NO: 169993 - DNA, 20 bp, Artificial
  CRISPR gRNA sequence
ttatataagaatggctacag

SEQ ID NO: 169994 - DNA, 20 bp, Artificial
  CRISPR gRNA sequence
tatataagaatggctacagt

SEQ ID NO: 169995 - DNA, 20 bp, Artificial
  CRISPR gRNA sequence
atataagaatggctacagtt

SEQ ID NO: 169996 - DNA, 20 bp, Artificial
  CRISPR gRNA sequence
tataagaatggctacagttc

SEQ ID NO: 169997 - DNA, 20 bp, Artificial
  CRISPR gRNA sequence
cagttcttttgggtacaaac

SEQ ID NO: 169998 - DNA, 20 bp, Artificial
  CRISPR gRNA sequence
ttttgggtacaaacctagga

SEQ ID NO: 169999 - DNA, 20 bp, Artificial
  CRISPR gRNA sequence
ttgggtacaaacctaggaat

SEQ ID NO: 170000 - DNA, 20 bp, Artificial
  CRISPR gRNA sequence
tgggtacaaacctaggaatg

SEQ ID NO: 170001 - DNA, 20 bp, Artificial
  CRISPR gRNA sequence
gggtacaaacctaggaatga

SEQ ID NO: 170002 - DNA, 20 bp, Artificial
  CRISPR gRNA sequence
ggtacaaacctaggaatgaa

SEQ ID NO: 170003 - DNA, 20 bp, Artificial
  CRISPR gRNA sequence
ggaatgaaatggctgggtta

SEQ ID NO: 170004 - DNA, 20 bp, Artificial
  CRISPR gRNA sequence
ggttacagagtagggggata

SEQ ID NO: 170005 - DNA, 20 bp, Artificial
  CRISPR gRNA sequence
cagagtagggggatatgttt

SEQ ID NO: 170006 - DNA, 20 bp, Artificial
  CRISPR gRNA sequence
atcagaaaatgtctaatatt

SEQ ID NO: 170007 - DNA, 20 bp, Artificial
  CRISPR gRNA sequence
tcagaaaatgtctaatattt

SEQ ID NO: 170008 - DNA, 20 bp, Artificial
  CRISPR gRNA sequence
atattttttcaaactgactg

SEQ ID NO: 170009 - DNA, 20 bp, Artificial
  CRISPR gRNA sequence
tttcaaactgactgaccact

SEQ ID NO: 170010 - DNA, 20 bp, Artificial
  CRISPR gRNA sequence
ttcaaactgactgaccactt

SEQ ID NO: 170011 - DNA, 20 bp, Artificial
  CRISPR gRNA sequence
tcaaactgactgaccacttt

SEQ ID NO: 170012 - DNA, 20 bp, Artificial
  CRISPR gRNA sequence
caaactgactgaccacttta

SEQ ID NO: 170013 - DNA, 20 bp, Artificial
  CRISPR gRNA sequence
aaactgactgaccactttag

SEQ ID NO: 170014 - DNA, 20 bp, Artificial
  CRISPR gRNA sequence
actgaccactttagattctg

SEQ ID NO: 170015 - DNA, 20 bp, Artificial
  CRISPR gRNA sequence
accactttagattctgacca

SEQ ID NO: 170016 - DNA, 20 bp, Artificial
  CRISPR gRNA sequence
tagattctgaccagcaatat

SEQ ID NO: 170017 - DNA, 20 bp, Artificial
  CRISPR gRNA sequence
agattctgaccagcaatata

SEQ ID NO: 170018 - DNA, 20 bp, Artificial
  CRISPR gRNA sequence
gattctgaccagcaatatat

SEQ ID NO: 170019 - DNA, 20 bp, Artificial
  CRISPR gRNA sequence
tgaccagcaatatatgagtt

SEQ ID NO: 170020 - DNA, 20 bp, Artificial
  CRISPR gRNA sequence
accagcaatatatgagtttc

SEQ ID NO: 170021 - DNA, 20 bp, Artificial
  CRISPR gRNA sequence
cagacactccacttcctcac

SEQ ID NO: 170022 - DNA, 20 bp, Artificial
  CRISPR gRNA sequence
agacactccacttcctcacc

SEQ ID NO: 170023 - DNA, 20 bp, Artificial
  CRISPR gRNA sequence
cacttcctcaccaactgtgg

SEQ ID NO: 170024 - DNA, 20 bp, Artificial
  CRISPR gRNA sequence
cctcaccaactgtggtattg

SEQ ID NO: 170025 - DNA, 20 bp, Artificial
  CRISPR gRNA sequence
ctcaccaactgtggtattgt

SEQ ID NO: 170026 - DNA, 20 bp, Artificial
  CRISPR gRNA sequence
accaactgtggtattgtcag

SEQ ID NO: 170027 - DNA, 20 bp, Artificial
  CRISPR gRNA sequence
tggtattgtcagtctttttt

SEQ ID NO: 170028 - DNA, 20 bp, Artificial
  CRISPR gRNA sequence
tcagtcttttttattttagg

SEQ ID NO: 170029 - DNA, 20 bp, Artificial
  CRISPR gRNA sequence
ttttattttaggtattctag

SEQ ID NO: 170030 - DNA, 20 bp, Artificial
  CRISPR gRNA sequence
tttattttaggtattctagt

SEQ ID NO: 170031 - DNA, 20 bp, Artificial
  CRISPR gRNA sequence
ttattttaggtattctagtg

SEQ ID NO: 170032 - DNA, 20 bp, Artificial
  CRISPR gRNA sequence
tattttaggtattctagtgg

SEQ ID NO: 170033 - DNA, 20 bp, Artificial
  CRISPR gRNA sequence
attttaggtattctagtggg

SEQ ID NO: 170034 - DNA, 20 bp, Artificial
  CRISPR gRNA sequence
ttttaggtattctagtgggt

SEQ ID NO: 170035 - DNA, 20 bp, Artificial
  CRISPR gRNA sequence
taggtattctagtgggtgta

SEQ ID NO: 170036 - DNA, 20 bp, Artificial
  CRISPR gRNA sequence
aggtattctagtgggtgtaa

SEQ ID NO: 170037 - DNA, 20 bp, Artificial
  CRISPR gRNA sequence
ggtattctagtgggtgtaaa

SEQ ID NO: 170038 - DNA, 20 bp, Artificial
  CRISPR gRNA sequence
tagtgggtgtaaaacagtat

SEQ ID NO: 170039 - DNA, 20 bp, Artificial
  CRISPR gRNA sequence
gtgggtgtaaaacagtatct

SEQ ID NO: 170040 - DNA, 20 bp, Artificial
  CRISPR gRNA sequence
actgcagttttttatttccc

SEQ ID NO: 170041 - DNA, 20 bp, Artificial
  CRISPR gRNA sequence
cagttttttatttccctgat

SEQ ID NO: 170042 - DNA, 20 bp, Artificial
  CRISPR gRNA sequence
tttatttccctgatgactaa

SEQ ID NO: 170043 - DNA, 20 bp, Artificial
  CRISPR gRNA sequence
ttatttccctgatgactaat

SEQ ID NO: 170044 - DNA, 20 bp, Artificial
  CRISPR gRNA sequence
tatttccctgatgactaatg

SEQ ID NO: 170045 - DNA, 20 bp, Artificial
  CRISPR gRNA sequence
atttccctgatgactaatga

SEQ ID NO: 170046 - DNA, 20 bp, Artificial
  CRISPR gRNA sequence
tttccctgatgactaatgat

SEQ ID NO: 170047 - DNA, 20 bp, Artificial
  CRISPR gRNA sequence
ccctgatgactaatgatgtt

SEQ ID NO: 170048 - DNA, 20 bp, Artificial
  CRISPR gRNA sequence
cctgatgactaatgatgttg

SEQ ID NO: 170049 - DNA, 20 bp, Artificial
  CRISPR gRNA sequence
atgactaatgatgttgcata

SEQ ID NO: 170050 - DNA, 20 bp, Artificial
  CRISPR gRNA sequence
atgatgttgcatatcttctc

SEQ ID NO: 170051 - DNA, 20 bp, Artificial
  CRISPR gRNA sequence
catatcttctcatgggttta

SEQ ID NO: 170052 - DNA, 20 bp, Artificial
  CRISPR gRNA sequence
ctcatgggtttattgggcat

SEQ ID NO: 170053 - DNA, 20 bp, Artificial
  CRISPR gRNA sequence
tcatgggtttattgggcatt

SEQ ID NO: 170054 - DNA, 20 bp, Artificial
  CRISPR gRNA sequence
atgggtttattgggcatttg

SEQ ID NO: 170055 - DNA, 20 bp, Artificial
  CRISPR gRNA sequence
attgggcatttgtttatctt

SEQ ID NO: 170056 - DNA, 20 bp, Artificial
  CRISPR gRNA sequence
ttgggcatttgtttatcttt

SEQ ID NO: 170057 - DNA, 20 bp, Artificial
  CRISPR gRNA sequence
ggcatttgtttatctttttt

SEQ ID NO: 170058 - DNA, 20 bp, Artificial
  CRISPR gRNA sequence
gtttatctttttttctgaag

SEQ ID NO: 170059 - DNA, 20 bp, Artificial
  CRISPR gRNA sequence
tttatctttttttctgaagg

SEQ ID NO: 170060 - DNA, 20 bp, Artificial
  CRISPR gRNA sequence
atctttttttctgaaggtct

SEQ ID NO: 170061 - DNA, 20 bp, Artificial
  CRISPR gRNA sequence
tctttttttctgaaggtctg

SEQ ID NO: 170062 - DNA, 20 bp, Artificial
  CRISPR gRNA sequence
tttttctgaaggtctgtcca

SEQ ID NO: 170063 - DNA, 20 bp, Artificial
  CRISPR gRNA sequence
ttttctgaaggtctgtccaa

SEQ ID NO: 170064 - DNA, 20 bp, Artificial
  CRISPR gRNA sequence
tttctgaaggtctgtccaag

SEQ ID NO: 170065 - DNA, 20 bp, Artificial
  CRISPR gRNA sequence
ttctgaaggtctgtccaagt

SEQ ID NO: 170066 - DNA, 20 bp, Artificial
  CRISPR gRNA sequence
tctgaaggtctgtccaagtg

SEQ ID NO: 170067 - DNA, 20 bp, Artificial
  CRISPR gRNA sequence
ctgaaggtctgtccaagtgt

SEQ ID NO: 170068 - DNA, 20 bp, Artificial
  CRISPR gRNA sequence
tgaaggtctgtccaagtgtt

SEQ ID NO: 170069 - DNA, 20 bp, Artificial
  CRISPR gRNA sequence
aaggtctgtccaagtgtttt

SEQ ID NO: 170070 - DNA, 20 bp, Artificial
  CRISPR gRNA sequence
tccaagtgttttgcctattt

SEQ ID NO: 170071 - DNA, 20 bp, Artificial
  CRISPR gRNA sequence
tgcctattttattttctaat

SEQ ID NO: 170072 - DNA, 20 bp, Artificial
  CRISPR gRNA sequence
gcctattttattttctaatc

SEQ ID NO: 170073 - DNA, 20 bp, Artificial
  CRISPR gRNA sequence
cctattttattttctaatct

SEQ ID NO: 170074 - DNA, 20 bp, Artificial
  CRISPR gRNA sequence
ttttattttctaatctgaat

SEQ ID NO: 170075 - DNA, 20 bp, Artificial
  CRISPR gRNA sequence
tattttctaatctgaattga

SEQ ID NO: 170076 - DNA, 20 bp, Artificial
  CRISPR gRNA sequence
attttctaatctgaattgat

SEQ ID NO: 170077 - DNA, 20 bp, Artificial
  CRISPR gRNA sequence
ttttctaatctgaattgatc

SEQ ID NO: 170078 - DNA, 20 bp, Artificial
  CRISPR gRNA sequence
tctaatctgaattgatcttg

SEQ ID NO: 170079 - DNA, 20 bp, Artificial
  CRISPR gRNA sequence
ctaatctgaattgatcttga

SEQ ID NO: 170080 - DNA, 20 bp, Artificial
  CRISPR gRNA sequence
taatctgaattgatcttgaa

SEQ ID NO: 170081 - DNA, 20 bp, Artificial
  CRISPR gRNA sequence
atctgaattgatcttgaagg

SEQ ID NO: 170082 - DNA, 20 bp, Artificial
  CRISPR gRNA sequence
aattgatcttgaagggagct

SEQ ID NO: 170083 - DNA, 20 bp, Artificial
  CRISPR gRNA sequence
atcttgaagggagctttaac

SEQ ID NO: 170084 - DNA, 20 bp, Artificial
  CRISPR gRNA sequence
gaagggagctttaactggat

SEQ ID NO: 170085 - DNA, 20 bp, Artificial
  CRISPR gRNA sequence
aagggagctttaactggatc

SEQ ID NO: 170086 - DNA, 20 bp, Artificial
  CRISPR gRNA sequence
taactggatctctctggatc

SEQ ID NO: 170087 - DNA, 20 bp, Artificial
  CRISPR gRNA sequence
aactggatctctctggatcc

SEQ ID NO: 170088 - DNA, 20 bp, Artificial
  CRISPR gRNA sequence
actggatctctctggatcca

SEQ ID NO: 170089 - DNA, 20 bp, Artificial
  CRISPR gRNA sequence
gatctctctggatccacaga

SEQ ID NO: 170090 - DNA, 20 bp, Artificial
  CRISPR gRNA sequence
tctggatccacagactaact

SEQ ID NO: 170091 - DNA, 20 bp, Artificial
  CRISPR gRNA sequence
tggatccacagactaacttc

SEQ ID NO: 170092 - DNA, 20 bp, Artificial
  CRISPR gRNA sequence
gatccacagactaacttcaa

SEQ ID NO: 170093 - DNA, 20 bp, Artificial
  CRISPR gRNA sequence
acttcaaggcaacataaatt

SEQ ID NO: 170094 - DNA, 20 bp, Artificial
  CRISPR gRNA sequence
caaggcaacataaattttgt

SEQ ID NO: 170095 - DNA, 20 bp, Artificial
  CRISPR gRNA sequence
aaggcaacataaattttgtg

SEQ ID NO: 170096 - DNA, 20 bp, Artificial
  CRISPR gRNA sequence
tgtgacttcaacatgcatat

SEQ ID NO: 170097 - DNA, 20 bp, Artificial
  CRISPR gRNA sequence
gtgacttcaacatgcatatc

SEQ ID NO: 170098 - DNA, 20 bp, Artificial
  CRISPR gRNA sequence
tgacttcaacatgcatatca

SEQ ID NO: 170099 - DNA, 20 bp, Artificial
  CRISPR gRNA sequence
caacatgcatatcatttatt

SEQ ID NO: 170100 - DNA, 20 bp, Artificial
  CRISPR gRNA sequence
aacatgcatatcatttattg

SEQ ID NO: 170101 - DNA, 20 bp, Artificial
  CRISPR gRNA sequence
attggagctcagtatttttt

SEQ ID NO: 170102 - DNA, 20 bp, Artificial
  CRISPR gRNA sequence
ttggagctcagtattttttg

SEQ ID NO: 170103 - DNA, 20 bp, Artificial
  CRISPR gRNA sequence
gagctcagtattttttgctt

SEQ ID NO: 170104 - DNA, 20 bp, Artificial
  CRISPR gRNA sequence
agtattttttgctttttttg

SEQ ID NO: 170105 - DNA, 20 bp, Artificial
  CRISPR gRNA sequence
tttgctttttttgctttaaa

SEQ ID NO: 170106 - DNA, 20 bp, Artificial
  CRISPR gRNA sequence
ttgctttttttgctttaaaa

SEQ ID NO: 170107 - DNA, 20 bp, Artificial
  CRISPR gRNA sequence
tgctttttttgctttaaaac

SEQ ID NO: 170108 - DNA, 20 bp, Artificial
  CRISPR gRNA sequence
gctttttttgctttaaaact

SEQ ID NO: 170109 - DNA, 20 bp, Artificial
  CRISPR gRNA sequence
ctttttttgctttaaaactt

SEQ ID NO: 170110 - DNA, 20 bp, Artificial
  CRISPR gRNA sequence
tttttgctttaaaactttca

SEQ ID NO: 170111 - DNA, 20 bp, Artificial
  CRISPR gRNA sequence
ttttgctttaaaactttcat

SEQ ID NO: 170112 - DNA, 20 bp, Artificial
  CRISPR gRNA sequence
tttgctttaaaactttcata

SEQ ID NO: 170113 - DNA, 20 bp, Artificial
  CRISPR gRNA sequence
ttgctttaaaactttcatat

SEQ ID NO: 170114 - DNA, 20 bp, Artificial
  CRISPR gRNA sequence
tgctttaaaactttcatata

SEQ ID NO: 170115 - DNA, 20 bp, Artificial
  CRISPR gRNA sequence
gctttaaaactttcatatag

SEQ ID NO: 170116 - DNA, 20 bp, Artificial
  CRISPR gRNA sequence
ctttaaaactttcatatagt

SEQ ID NO: 170117 - DNA, 20 bp, Artificial
  CRISPR gRNA sequence
taaaactttcatatagtaat

SEQ ID NO: 170118 - DNA, 20 bp, Artificial
  CRISPR gRNA sequence
aaaactttcatatagtaatg

SEQ ID NO: 170119 - DNA, 20 bp, Artificial
  CRISPR gRNA sequence
aaactttcatatagtaatgt

SEQ ID NO: 170120 - DNA, 20 bp, Artificial
  CRISPR gRNA sequence
tcatatagtaatgtacacaa

SEQ ID NO: 170121 - DNA, 20 bp, Artificial
  CRISPR gRNA sequence
catatagtaatgtacacaaa

SEQ ID NO: 170122 - DNA, 20 bp, Artificial
  CRISPR gRNA sequence
atatagtaatgtacacaaat

SEQ ID NO: 170123 - DNA, 20 bp, Artificial
  CRISPR gRNA sequence
actttatgacgcattgacaa

SEQ ID NO: 170124 - DNA, 20 bp, Artificial
  CRISPR gRNA sequence
tatgacgcattgacaagctg

SEQ ID NO: 170125 - DNA, 20 bp, Artificial
  CRISPR gRNA sequence
atgacgcattgacaagctgt

SEQ ID NO: 170126 - DNA, 20 bp, Artificial
  CRISPR gRNA sequence
tgacgcattgacaagctgta

SEQ ID NO: 170127 - DNA, 20 bp, Artificial
  CRISPR gRNA sequence
acaagctgtactagaatgca

SEQ ID NO: 170128 - DNA, 20 bp, Artificial
  CRISPR gRNA sequence
tactagaatgcaggcttccc

SEQ ID NO: 170129 - DNA, 20 bp, Artificial
  CRISPR gRNA sequence
gaatgcaggcttcccacaga

SEQ ID NO: 170130 - DNA, 20 bp, Artificial
  CRISPR gRNA sequence
cccacagataaggatttttg

SEQ ID NO: 170131 - DNA, 20 bp, Artificial
  CRISPR gRNA sequence
ccacagataaggatttttgt

SEQ ID NO: 170132 - DNA, 20 bp, Artificial
  CRISPR gRNA sequence
ttgtctgttgtgtgtatcgt

SEQ ID NO: 170133 - DNA, 20 bp, Artificial
  CRISPR gRNA sequence
tgtctgttgtgtgtatcgtt

SEQ ID NO: 170134 - DNA, 20 bp, Artificial
  CRISPR gRNA sequence
gtctgttgtgtgtatcgtta

SEQ ID NO: 170135 - DNA, 20 bp, Artificial
  CRISPR gRNA sequence
tctgttgtgtgtatcgttaa

SEQ ID NO: 170136 - DNA, 20 bp, Artificial
  CRISPR gRNA sequence
ttgtgtgtatcgttaatccc

SEQ ID NO: 170137 - DNA, 20 bp, Artificial
  CRISPR gRNA sequence
tgtgtatcgttaatccccag

SEQ ID NO: 170138 - DNA, 20 bp, Artificial
  CRISPR gRNA sequence
atccccagagcctagaaaag

SEQ ID NO: 170139 - DNA, 20 bp, Artificial
  CRISPR gRNA sequence
gaaaagtgcccggcacattg

SEQ ID NO: 170140 - DNA, 20 bp, Artificial
  CRISPR gRNA sequence
tgggtgttcagtaagtattt

SEQ ID NO: 170141 - DNA, 20 bp, Artificial
  CRISPR gRNA sequence
agtaagtatttttagaataa

SEQ ID NO: 170142 - DNA, 20 bp, Artificial
  CRISPR gRNA sequence
ttagaataaatgaataaaca

SEQ ID NO: 170143 - DNA, 20 bp, Artificial
  CRISPR gRNA sequence
tagaataaatgaataaacac

SEQ ID NO: 170144 - DNA, 20 bp, Artificial
  CRISPR gRNA sequence
agaataaatgaataaacaca

SEQ ID NO: 170145 - DNA, 20 bp, Artificial
  CRISPR gRNA sequence
gaataaatgaataaacacat

SEQ ID NO: 170146 - DNA, 20 bp, Artificial
  CRISPR gRNA sequence
tctactttgtaggtaaaggg

SEQ ID NO: 170147 - DNA, 20 bp, Artificial
  CRISPR gRNA sequence
ctactttgtaggtaaaggga

SEQ ID NO: 170148 - DNA, 20 bp, Artificial
  CRISPR gRNA sequence
tactttgtaggtaaagggaa

SEQ ID NO: 170149 - DNA, 20 bp, Artificial
  CRISPR gRNA sequence
ctttgtaggtaaagggaaac

SEQ ID NO: 170150 - DNA, 20 bp, Artificial
  CRISPR gRNA sequence
tgtaggtaaagggaaacaag

SEQ ID NO: 170151 - DNA, 20 bp, Artificial
  CRISPR gRNA sequence
gtaggtaaagggaaacaaga

SEQ ID NO: 170152 - DNA, 20 bp, Artificial
  CRISPR gRNA sequence
taggtaaagggaaacaagaa

SEQ ID NO: 170153 - DNA, 20 bp, Artificial
  CRISPR gRNA sequence
actttcttggcttcattgtt

SEQ ID NO: 170154 - DNA, 20 bp, Artificial
  CRISPR gRNA sequence
ctttcttggcttcattgtta

SEQ ID NO: 170155 - DNA, 20 bp, Artificial
  CRISPR gRNA sequence
tcttggcttcattgttaaaa

SEQ ID NO: 170156 - DNA, 20 bp, Artificial
  CRISPR gRNA sequence
cttggcttcattgttaaaat

SEQ ID NO: 170157 - DNA, 20 bp, Artificial
  CRISPR gRNA sequence
ttggcttcattgttaaaata

SEQ ID NO: 170158 - DNA, 20 bp, Artificial
  CRISPR gRNA sequence
ggcttcattgttaaaatact

SEQ ID NO: 170159 - DNA, 20 bp, Artificial
  CRISPR gRNA sequence
gcttcattgttaaaatactg

SEQ ID NO: 170160 - DNA, 20 bp, Artificial
  CRISPR gRNA sequence
cattgttaaaatactgccac

SEQ ID NO: 170161 - DNA, 20 bp, Artificial
  CRISPR gRNA sequence
attgttaaaatactgccacc

SEQ ID NO: 170162 - DNA, 20 bp, Artificial
  CRISPR gRNA sequence
ttaaaatactgccaccactg

SEQ ID NO: 170163 - DNA, 20 bp, Artificial
  CRISPR gRNA sequence
aaatactgccaccactgttt

SEQ ID NO: 170164 - DNA, 20 bp, Artificial
  CRISPR gRNA sequence
ccaccactgttttatacttg

SEQ ID NO: 170165 - DNA, 20 bp, Artificial
  CRISPR gRNA sequence
ttttatacttgttacactct

SEQ ID NO: 170166 - DNA, 20 bp, Artificial
  CRISPR gRNA sequence
tatacttgttacactcttct

SEQ ID NO: 170167 - DNA, 20 bp, Artificial
  CRISPR gRNA sequence
atacttgttacactcttctt

SEQ ID NO: 170168 - DNA, 20 bp, Artificial
  CRISPR gRNA sequence
tacttgttacactcttcttc

SEQ ID NO: 170169 - DNA, 20 bp, Artificial
  CRISPR gRNA sequence
gttacactcttcttcttgta

SEQ ID NO: 170170 - DNA, 20 bp, Artificial
  CRISPR gRNA sequence
ttacactcttcttcttgtat

SEQ ID NO: 170171 - DNA, 20 bp, Artificial
  CRISPR gRNA sequence
cactcttcttcttgtatctg

SEQ ID NO: 170172 - DNA, 20 bp, Artificial
  CRISPR gRNA sequence
ttcttcttgtatctgggaaa

SEQ ID NO: 170173 - DNA, 20 bp, Artificial
  CRISPR gRNA sequence
cttcttgtatctgggaaatc

SEQ ID NO: 170174 - DNA, 20 bp, Artificial
  CRISPR gRNA sequence
ttcttgtatctgggaaatct

SEQ ID NO: 170175 - DNA, 20 bp, Artificial
  CRISPR gRNA sequence
cttgtatctgggaaatcttt

SEQ ID NO: 170176 - DNA, 20 bp, Artificial
  CRISPR gRNA sequence
ttgtatctgggaaatctttc

SEQ ID NO: 170177 - DNA, 20 bp, Artificial
  CRISPR gRNA sequence
gtatctgggaaatctttcct

SEQ ID NO: 170178 - DNA, 20 bp, Artificial
  CRISPR gRNA sequence
tatctgggaaatctttcctc

SEQ ID NO: 170179 - DNA, 20 bp, Artificial
  CRISPR gRNA sequence
ggaaatctttcctctaagag

SEQ ID NO: 170180 - DNA, 20 bp, Artificial
  CRISPR gRNA sequence
tcctctaagagccagggctt

SEQ ID NO: 170181 - DNA, 20 bp, Artificial
  CRISPR gRNA sequence
cctctaagagccagggcttg

SEQ ID NO: 170182 - DNA, 20 bp, Artificial
  CRISPR gRNA sequence
ctctaagagccagggcttgg

SEQ ID NO: 170183 - DNA, 20 bp, Artificial
  CRISPR gRNA sequence
taagagccagggcttggcta

SEQ ID NO: 170184 - DNA, 20 bp, Artificial
  CRISPR gRNA sequence
agagccagggcttggctata

SEQ ID NO: 170185 - DNA, 20 bp, Artificial
  CRISPR gRNA sequence
ggctatagggtgagggtttc

SEQ ID NO: 170186 - DNA, 20 bp, Artificial
  CRISPR gRNA sequence
gctatagggtgagggtttct

SEQ ID NO: 170187 - DNA, 20 bp, Artificial
  CRISPR gRNA sequence
tagggtgagggtttctagag

SEQ ID NO: 170188 - DNA, 20 bp, Artificial
  CRISPR gRNA sequence
ctagagtcaatgaccaaggg

SEQ ID NO: 170189 - DNA, 20 bp, Artificial
  CRISPR gRNA sequence
tagagtcaatgaccaagggc

SEQ ID NO: 170190 - DNA, 20 bp, Artificial
  CRISPR gRNA sequence
gagtcaatgaccaagggctc

SEQ ID NO: 170191 - DNA, 20 bp, Artificial
  CRISPR gRNA sequence
tgcatacagtatgaatgtga

SEQ ID NO: 170192 - DNA, 20 bp, Artificial
  CRISPR gRNA sequence
catacagtatgaatgtgaat

SEQ ID NO: 170193 - DNA, 20 bp, Artificial
  CRISPR gRNA sequence
gctaggttaaaaattaaaat

SEQ ID NO: 170194 - DNA, 20 bp, Artificial
  CRISPR gRNA sequence
ggttaaaaattaaaattaaa

SEQ ID NO: 170195 - DNA, 20 bp, Artificial
  CRISPR gRNA sequence
aaaattaaaattaaaaaaaa

SEQ ID NO: 170196 - DNA, 20 bp, Artificial
  CRISPR gRNA sequence
aaattaaaaaaaaaagaaga

SEQ ID NO: 170197 - DNA, 20 bp, Artificial
  CRISPR gRNA sequence
aaaaaaaaagaagaagaaaa

SEQ ID NO: 170198 - DNA, 20 bp, Artificial
  CRISPR gRNA sequence
ccaggaaggctgacaaggaa

SEQ ID NO: 170199 - DNA, 20 bp, Artificial
  CRISPR gRNA sequence
acaaggaacaaaaagcctaa

SEQ ID NO: 170200 - DNA, 20 bp, Artificial
  CRISPR gRNA sequence
atgaagctagtgagactgat

SEQ ID NO: 170201 - DNA, 20 bp, Artificial
  CRISPR gRNA sequence
gtgagactgatgatacttcc

SEQ ID NO: 170202 - DNA, 20 bp, Artificial
  CRISPR gRNA sequence
atgatacttcctggaatctc

SEQ ID NO: 170203 - DNA, 20 bp, Artificial
  CRISPR gRNA sequence
cctggaatctctcaaggctc

SEQ ID NO: 170204 - DNA, 20 bp, Artificial
  CRISPR gRNA sequence
ctggaatctctcaaggctcc

SEQ ID NO: 170205 - DNA, 20 bp, Artificial
  CRISPR gRNA sequence
gaatctctcaaggctcccaa

SEQ ID NO: 170206 - DNA, 20 bp, Artificial
  CRISPR gRNA sequence
tcaaggctcccaaccagaag

SEQ ID NO: 170207 - DNA, 20 bp, Artificial
  CRISPR gRNA sequence
aaggctcccaaccagaagtt

SEQ ID NO: 170208 - DNA, 20 bp, Artificial
  CRISPR gRNA sequence
ccaaccagaagttgattacg

SEQ ID NO: 170209 - DNA, 20 bp, Artificial
  CRISPR gRNA sequence
attacgtttggaaacaggta

SEQ ID NO: 170210 - DNA, 20 bp, Artificial
  CRISPR gRNA sequence
cgtttggaaacaggtaaata

SEQ ID NO: 170211 - DNA, 20 bp, Artificial
  CRISPR gRNA sequence
ggaaacaggtaaatactctt

SEQ ID NO: 170212 - DNA, 20 bp, Artificial
  CRISPR gRNA sequence
gaaacaggtaaatactctta

SEQ ID NO: 170213 - DNA, 20 bp, Artificial
  CRISPR gRNA sequence
ttatcacttgagcctctgtt

SEQ ID NO: 170214 - DNA, 20 bp, Artificial
  CRISPR gRNA sequence
atcacttgagcctctgttta

SEQ ID NO: 170215 - DNA, 20 bp, Artificial
  CRISPR gRNA sequence
tcacttgagcctctgtttat

SEQ ID NO: 170216 - DNA, 20 bp, Artificial
  CRISPR gRNA sequence
gagcctctgtttatagtgag

SEQ ID NO: 170217 - DNA, 20 bp, Artificial
  CRISPR gRNA sequence
agcctctgtttatagtgagg

SEQ ID NO: 170218 - DNA, 20 bp, Artificial
  CRISPR gRNA sequence
tgtttatagtgagggctcac

SEQ ID NO: 170219 - DNA, 20 bp, Artificial
  CRISPR gRNA sequence
tttatagtgagggctcacca

SEQ ID NO: 170220 - DNA, 20 bp, Artificial
  CRISPR gRNA sequence
atagtgagggctcaccaagg

SEQ ID NO: 170221 - DNA, 20 bp, Artificial
  CRISPR gRNA sequence
tagtgagggctcaccaaggg

SEQ ID NO: 170222 - DNA, 20 bp, Artificial
  CRISPR gRNA sequence
accaagggaaaagagttcag

SEQ ID NO: 170223 - DNA, 20 bp, Artificial
  CRISPR gRNA sequence
agtcactaagctgtgaaaac

SEQ ID NO: 170224 - DNA, 20 bp, Artificial
  CRISPR gRNA sequence
agctgtgaaaaccaggagag

SEQ ID NO: 170225 - DNA, 20 bp, Artificial
  CRISPR gRNA sequence
tgaaaaccaggagagaattg

SEQ ID NO: 170226 - DNA, 20 bp, Artificial
  CRISPR gRNA sequence
attaagatttttggtggaga

SEQ ID NO: 170227 - DNA, 20 bp, Artificial
  CRISPR gRNA sequence
agatttttggtggagaaaca

SEQ ID NO: 170228 - DNA, 20 bp, Artificial
  CRISPR gRNA sequence
ttggtggagaaacacaatca

SEQ ID NO: 170229 - DNA, 20 bp, Artificial
  CRISPR gRNA sequence
tggtggagaaacacaatcac

SEQ ID NO: 170230 - DNA, 20 bp, Artificial
  CRISPR gRNA sequence
ggtggagaaacacaatcacc

SEQ ID NO: 170231 - DNA, 20 bp, Artificial
  CRISPR gRNA sequence
gtggagaaacacaatcacca

SEQ ID NO: 170232 - DNA, 20 bp, Artificial
  CRISPR gRNA sequence
gaaggtatgtctgcctccca

SEQ ID NO: 170233 - DNA, 20 bp, Artificial
  CRISPR gRNA sequence
cctcccaacagtggtgatgc

SEQ ID NO: 170234 - DNA, 20 bp, Artificial
  CRISPR gRNA sequence
ccaacagtggtgatgccaat

SEQ ID NO: 170235 - DNA, 20 bp, Artificial
  CRISPR gRNA sequence
gatagaggcctaaaggagaa

SEQ ID NO: 170236 - DNA, 20 bp, Artificial
  CRISPR gRNA sequence
atagaggcctaaaggagaac

SEQ ID NO: 170237 - DNA, 20 bp, Artificial
  CRISPR gRNA sequence
aaggagaacaatctttggtc

SEQ ID NO: 170238 - DNA, 20 bp, Artificial
  CRISPR gRNA sequence
tggtcctaaaggagaacaat

SEQ ID NO: 170239 - DNA, 20 bp, Artificial
  CRISPR gRNA sequence
ggtcctaaaggagaacaatc

SEQ ID NO: 170240 - DNA, 20 bp, Artificial
  CRISPR gRNA sequence
gtcctaaaggagaacaatct

SEQ ID NO: 170241 - DNA, 20 bp, Artificial
  CRISPR gRNA sequence
aaggagaacaatctttggtc

SEQ ID NO: 170242 - DNA, 20 bp, Artificial
  CRISPR gRNA sequence
tggtcctaaaggagaacaat

SEQ ID NO: 170243 - DNA, 20 bp, Artificial
  CRISPR gRNA sequence
ggtcctaaaggagaacaatc

SEQ ID NO: 170244 - DNA, 20 bp, Artificial
  CRISPR gRNA sequence
gtcctaaaggagaacaatct

SEQ ID NO: 170245 - DNA, 20 bp, Artificial
  CRISPR gRNA sequence
aaggagaacaatctttctcc

SEQ ID NO: 170246 - DNA, 20 bp, Artificial
  CRISPR gRNA sequence
tctccaacaccacgcaggaa

SEQ ID NO: 170247 - DNA, 20 bp, Artificial
  CRISPR gRNA sequence
ctccaacaccacgcaggaaa

SEQ ID NO: 170248 - DNA, 20 bp, Artificial
  CRISPR gRNA sequence
tccaacaccacgcaggaaaa

SEQ ID NO: 170249 - DNA, 20 bp, Artificial
  CRISPR gRNA sequence
caacaccacgcaggaaaaca

SEQ ID NO: 170250 - DNA, 20 bp, Artificial
  CRISPR gRNA sequence
ctgcttaccccagttttcct

SEQ ID NO: 170251 - DNA, 20 bp, Artificial
  CRISPR gRNA sequence
cttaccccagttttcctaat

SEQ ID NO: 170252 - DNA, 20 bp, Artificial
  CRISPR gRNA sequence
accccagttttcctaatcta

SEQ ID NO: 170253 - DNA, 20 bp, Artificial
  CRISPR gRNA sequence
ccccagttttcctaatctaa

SEQ ID NO: 170254 - DNA, 20 bp, Artificial
  CRISPR gRNA sequence
tcctaatctaagtctgcaat

SEQ ID NO: 170255 - DNA, 20 bp, Artificial
  CRISPR gRNA sequence
cctaatctaagtctgcaata

SEQ ID NO: 170256 - DNA, 20 bp, Artificial
  CRISPR gRNA sequence
ctaatctaagtctgcaataa

SEQ ID NO: 170257 - DNA, 20 bp, Artificial
  CRISPR gRNA sequence
atctaagtctgcaataatac

SEQ ID NO: 170258 - DNA, 20 bp, Artificial
  CRISPR gRNA sequence
agtctgcaataatacctgta

SEQ ID NO: 170259 - DNA, 20 bp, Artificial
  CRISPR gRNA sequence
caataatacctgtagagtcc

SEQ ID NO: 170260 - DNA, 20 bp, Artificial
  CRISPR gRNA sequence
tagagtccggcgcttgttat

SEQ ID NO: 170261 - DNA, 20 bp, Artificial
  CRISPR gRNA sequence
gttatcttctgtgtgaatcc

SEQ ID NO: 170262 - DNA, 20 bp, Artificial
  CRISPR gRNA sequence
ttatcttctgtgtgaatcca

SEQ ID NO: 170263 - DNA, 20 bp, Artificial
  CRISPR gRNA sequence
tcttctgtgtgaatccaggc

SEQ ID NO: 170264 - DNA, 20 bp, Artificial
  CRISPR gRNA sequence
ctgtgtgaatccaggctcga

SEQ ID NO: 170265 - DNA, 20 bp, Artificial
  CRISPR gRNA sequence
tgtgtgaatccaggctcgaa

SEQ ID NO: 170266 - DNA, 20 bp, Artificial
  CRISPR gRNA sequence
tgtgaatccaggctcgaaga

SEQ ID NO: 170267 - DNA, 20 bp, Artificial
  CRISPR gRNA sequence
gaagagtcaactctgtgata

SEQ ID NO: 170268 - DNA, 20 bp, Artificial
  CRISPR gRNA sequence
tgtgataaaaatctgggctg

SEQ ID NO: 170269 - DNA, 20 bp, Artificial
  CRISPR gRNA sequence
tgataaaaatctgggctgcc

SEQ ID NO: 170270 - DNA, 20 bp, Artificial
  CRISPR gRNA sequence
ggctgccttggcaaagagta

SEQ ID NO: 170271 - DNA, 20 bp, Artificial
  CRISPR gRNA sequence
ccttggcaaagagtacaggc

SEQ ID NO: 170272 - DNA, 20 bp, Artificial
  CRISPR gRNA sequence
ggcaaagagtacaggcgctt

SEQ ID NO: 170273 - DNA, 20 bp, Artificial
  CRISPR gRNA sequence
gcaaagagtacaggcgcttc

SEQ ID NO: 170274 - DNA, 20 bp, Artificial
  CRISPR gRNA sequence
ctgcactgatcatctgtaac

SEQ ID NO: 170275 - DNA, 20 bp, Artificial
  CRISPR gRNA sequence
tgcactgatcatctgtaaca

SEQ ID NO: 170276 - DNA, 20 bp, Artificial
  CRISPR gRNA sequence
cactgatcatctgtaacaga

SEQ ID NO: 170277 - DNA, 20 bp, Artificial
  CRISPR gRNA sequence
atcatctgtaacagacacag

SEQ ID NO: 170278 - DNA, 20 bp, Artificial
  CRISPR gRNA sequence
taacagacacaggccctccc

SEQ ID NO: 170279 - DNA, 20 bp, Artificial
  CRISPR gRNA sequence
cctgtcaatcaccagcaagt

SEQ ID NO: 170280 - DNA, 20 bp, Artificial
  CRISPR gRNA sequence
tcaatcaccagcaagtcatg

SEQ ID NO: 170281 - DNA, 20 bp, Artificial
  CRISPR gRNA sequence
tctcttgcctcattgcctgg

SEQ ID NO: 170282 - DNA, 20 bp, Artificial
  CRISPR gRNA sequence
ttgcctcattgcctggcatg

SEQ ID NO: 170283 - DNA, 20 bp, Artificial
  CRISPR gRNA sequence
gcctcattgcctggcatggg

SEQ ID NO: 170284 - DNA, 20 bp, Artificial
  CRISPR gRNA sequence
cctcattgcctggcatggga

SEQ ID NO: 170285 - DNA, 20 bp, Artificial
  CRISPR gRNA sequence
attgcctggcatgggactat

SEQ ID NO: 170286 - DNA, 20 bp, Artificial
  CRISPR gRNA sequence
cctggcatgggactatgggg

SEQ ID NO: 170287 - DNA, 20 bp, Artificial
  CRISPR gRNA sequence
gcatgggactatggggcaag

SEQ ID NO: 170288 - DNA, 20 bp, Artificial
  CRISPR gRNA sequence
tggggcaagggtcaaaaaat

SEQ ID NO: 170289 - DNA, 20 bp, Artificial
  CRISPR gRNA sequence
aagagattccaaggtaaaat

SEQ ID NO: 170290 - DNA, 20 bp, Artificial
  CRISPR gRNA sequence
caaggtaaaataaatccatg

SEQ ID NO: 170291 - DNA, 20 bp, Artificial
  CRISPR gRNA sequence
atctagcacataccatgcgc

SEQ ID NO: 170292 - DNA, 20 bp, Artificial
  CRISPR gRNA sequence
tctagcacataccatgcgcc

SEQ ID NO: 170293 - DNA, 20 bp, Artificial
  CRISPR gRNA sequence
gcacataccatgcgccaaac

SEQ ID NO: 170294 - DNA, 20 bp, Artificial
  CRISPR gRNA sequence
gtgcaaggtgttttcttact

SEQ ID NO: 170295 - DNA, 20 bp, Artificial
  CRISPR gRNA sequence
tgcaaggtgttttcttactc

SEQ ID NO: 170296 - DNA, 20 bp, Artificial
  CRISPR gRNA sequence
tcttactcttataatagcct

SEQ ID NO: 170297 - DNA, 20 bp, Artificial
  CRISPR gRNA sequence
cttactcttataatagcctt

SEQ ID NO: 170298 - DNA, 20 bp, Artificial
  CRISPR gRNA sequence
ttactcttataatagccttt

SEQ ID NO: 170299 - DNA, 20 bp, Artificial
  CRISPR gRNA sequence
actcttataatagcctttca

SEQ ID NO: 170300 - DNA, 20 bp, Artificial
  CRISPR gRNA sequence
ctcttataatagcctttcaa

SEQ ID NO: 170301 - DNA, 20 bp, Artificial
  CRISPR gRNA sequence
ttataatagcctttcaaaga

SEQ ID NO: 170302 - DNA, 20 bp, Artificial
  CRISPR gRNA sequence
ataatagcctttcaaagaaa

SEQ ID NO: 170303 - DNA, 20 bp, Artificial
  CRISPR gRNA sequence
taatagcctttcaaagaaac

SEQ ID NO: 170304 - DNA, 20 bp, Artificial
  CRISPR gRNA sequence
tcaaagaaactaggggtcaa

SEQ ID NO: 170305 - DNA, 20 bp, Artificial
  CRISPR gRNA sequence
caaagaaactaggggtcaag

SEQ ID NO: 170306 - DNA, 20 bp, Artificial
  CRISPR gRNA sequence
aaagaaactaggggtcaaga

SEQ ID NO: 170307 - DNA, 20 bp, Artificial
  CRISPR gRNA sequence
ggggtcaagagagatgaagt

SEQ ID NO: 170308 - DNA, 20 bp, Artificial
  CRISPR gRNA sequence
gcccacagccatagagccag

SEQ ID NO: 170309 - DNA, 20 bp, Artificial
  CRISPR gRNA sequence
cccacagccatagagccagt

SEQ ID NO: 170310 - DNA, 20 bp, Artificial
  CRISPR gRNA sequence
aggttctaatccaaggagaa

SEQ ID NO: 170311 - DNA, 20 bp, Artificial
  CRISPR gRNA sequence
ggttctaatccaaggagaaa

SEQ ID NO: 170312 - DNA, 20 bp, Artificial
  CRISPR gRNA sequence
taatccaaggagaaacaata

SEQ ID NO: 170313 - DNA, 20 bp, Artificial
  CRISPR gRNA sequence
atccaaggagaaacaatatg

SEQ ID NO: 170314 - DNA, 20 bp, Artificial
  CRISPR gRNA sequence
gaaagccaatggatttggat

SEQ ID NO: 170315 - DNA, 20 bp, Artificial
  CRISPR gRNA sequence
aaagccaatggatttggata

SEQ ID NO: 170316 - DNA, 20 bp, Artificial
  CRISPR gRNA sequence
ggataaaattgcaggcttcc

SEQ ID NO: 170317 - DNA, 20 bp, Artificial
  CRISPR gRNA sequence
gataaaattgcaggcttccc

SEQ ID NO: 170318 - DNA, 20 bp, Artificial
  CRISPR gRNA sequence
caggcttcccatccttttgg

SEQ ID NO: 170319 - DNA, 20 bp, Artificial
  CRISPR gRNA sequence
cccatccttttgggcttttt

SEQ ID NO: 170320 - DNA, 20 bp, Artificial
  CRISPR gRNA sequence
ccatccttttgggctttttc

SEQ ID NO: 170321 - DNA, 20 bp, Artificial
  CRISPR gRNA sequence
ttgggctttttcatgtactg

SEQ ID NO: 170322 - DNA, 20 bp, Artificial
  CRISPR gRNA sequence
tgggctttttcatgtactga

SEQ ID NO: 170323 - DNA, 20 bp, Artificial
  CRISPR gRNA sequence
gggctttttcatgtactgaa

SEQ ID NO: 170324 - DNA, 20 bp, Artificial
  CRISPR gRNA sequence
ggctttttcatgtactgaaa

SEQ ID NO: 170325 - DNA, 20 bp, Artificial
  CRISPR gRNA sequence
tttcatgtactgaaaaagag

SEQ ID NO: 170326 - DNA, 20 bp, Artificial
  CRISPR gRNA sequence
ttcatgtactgaaaaagagg

SEQ ID NO: 170327 - DNA, 20 bp, Artificial
  CRISPR gRNA sequence
tcatgtactgaaaaagagga

SEQ ID NO: 170328 - DNA, 20 bp, Artificial
  CRISPR gRNA sequence
catgtactgaaaaagaggat

SEQ ID NO: 170329 - DNA, 20 bp, Artificial
  CRISPR gRNA sequence
atgtactgaaaaagaggata

SEQ ID NO: 170330 - DNA, 20 bp, Artificial
  CRISPR gRNA sequence
aaaaagaggataacctttca

SEQ ID NO: 170331 - DNA, 20 bp, Artificial
  CRISPR gRNA sequence
tcagttttattgtggcaatc

SEQ ID NO: 170332 - DNA, 20 bp, Artificial
  CRISPR gRNA sequence
cagttttattgtggcaatca

SEQ ID NO: 170333 - DNA, 20 bp, Artificial
  CRISPR gRNA sequence
agttttattgtggcaatcaa

SEQ ID NO: 170334 - DNA, 20 bp, Artificial
  CRISPR gRNA sequence
tattgtggcaatcaaatgag

SEQ ID NO: 170335 - DNA, 20 bp, Artificial
  CRISPR gRNA sequence
attgtggcaatcaaatgaga

SEQ ID NO: 170336 - DNA, 20 bp, Artificial
  CRISPR gRNA sequence
ttgtggcaatcaaatgagat

SEQ ID NO: 170337 - DNA, 20 bp, Artificial
  CRISPR gRNA sequence
tggcaatcaaatgagataat

SEQ ID NO: 170338 - DNA, 20 bp, Artificial
  CRISPR gRNA sequence
ggcatataggaaatgctcaa

SEQ ID NO: 170339 - DNA, 20 bp, Artificial
  CRISPR gRNA sequence
gcatataggaaatgctcaag

SEQ ID NO: 170340 - DNA, 20 bp, Artificial
  CRISPR gRNA sequence
aagccatataaactttcttg

SEQ ID NO: 170341 - DNA, 20 bp, Artificial
  CRISPR gRNA sequence
tcttgatgtgtctgatttca

SEQ ID NO: 170342 - DNA, 20 bp, Artificial
  CRISPR gRNA sequence
cttgatgtgtctgatttcaa

SEQ ID NO: 170343 - DNA, 20 bp, Artificial
  CRISPR gRNA sequence
ttgatgtgtctgatttcaaa

SEQ ID NO: 170344 - DNA, 20 bp, Artificial
  CRISPR gRNA sequence
gatgtgtctgatttcaaagt

SEQ ID NO: 170345 - DNA, 20 bp, Artificial
  CRISPR gRNA sequence
atgtgtctgatttcaaagtt

SEQ ID NO: 170346 - DNA, 20 bp, Artificial
  CRISPR gRNA sequence
atttcaaagttgaagctctt

SEQ ID NO: 170347 - DNA, 20 bp, Artificial
  CRISPR gRNA sequence
caaagttgaagctcttggtc

SEQ ID NO: 170348 - DNA, 20 bp, Artificial
  CRISPR gRNA sequence
aaagttgaagctcttggtca

SEQ ID NO: 170349 - DNA, 20 bp, Artificial
  CRISPR gRNA sequence
aagctcttggtcaaacaagg

SEQ ID NO: 170350 - DNA, 20 bp, Artificial
  CRISPR gRNA sequence
ttggtcaaacaaggttctaa

SEQ ID NO: 170351 - DNA, 20 bp, Artificial
  CRISPR gRNA sequence
ggtcaaacaaggttctaaac

SEQ ID NO: 170352 - DNA, 20 bp, Artificial
  CRISPR gRNA sequence
gtcaaacaaggttctaaacc

SEQ ID NO: 170353 - DNA, 20 bp, Artificial
  CRISPR gRNA sequence
taaacctttggtgaggtagt

SEQ ID NO: 170354 - DNA, 20 bp, Artificial
  CRISPR gRNA sequence
aacctttggtgaggtagtct

SEQ ID NO: 170355 - DNA, 20 bp, Artificial
  CRISPR gRNA sequence
tggtgaggtagtctgtgcag

SEQ ID NO: 170356 - DNA, 20 bp, Artificial
  CRISPR gRNA sequence
ggtgaggtagtctgtgcagg

SEQ ID NO: 170357 - DNA, 20 bp, Artificial
  CRISPR gRNA sequence
gtgaggtagtctgtgcagga

SEQ ID NO: 170358 - DNA, 20 bp, Artificial
  CRISPR gRNA sequence
tgcaggatacagccacagaa

SEQ ID NO: 170359 - DNA, 20 bp, Artificial
  CRISPR gRNA sequence
tggagttaaagaagcagcag

SEQ ID NO: 170360 - DNA, 20 bp, Artificial
  CRISPR gRNA sequence
gagttaaagaagcagcagat

SEQ ID NO: 170361 - DNA, 20 bp, Artificial
  CRISPR gRNA sequence
aagaagcagcagatgggaaa

SEQ ID NO: 170362 - DNA, 20 bp, Artificial
  CRISPR gRNA sequence
ggtcctatcactctgggtga

SEQ ID NO: 170363 - DNA, 20 bp, Artificial
  CRISPR gRNA sequence
gtcctatcactctgggtgag

SEQ ID NO: 170364 - DNA, 20 bp, Artificial
  CRISPR gRNA sequence
tcactctgggtgagtcactt

SEQ ID NO: 170365 - DNA, 20 bp, Artificial
  CRISPR gRNA sequence
tgggtgagtcacttaacctc

SEQ ID NO: 170366 - DNA, 20 bp, Artificial
  CRISPR gRNA sequence
ggtgagtcacttaacctctt

SEQ ID NO: 170367 - DNA, 20 bp, Artificial
  CRISPR gRNA sequence
aacctctttgtgtctatttc

SEQ ID NO: 170368 - DNA, 20 bp, Artificial
  CRISPR gRNA sequence
acctctttgtgtctatttcc

SEQ ID NO: 170369 - DNA, 20 bp, Artificial
  CRISPR gRNA sequence
tttgtgtctatttccattgt

SEQ ID NO: 170370 - DNA, 20 bp, Artificial
  CRISPR gRNA sequence
tgtgtctatttccattgtct

SEQ ID NO: 170371 - DNA, 20 bp, Artificial
  CRISPR gRNA sequence
gtgtctatttccattgtctg

SEQ ID NO: 170372 - DNA, 20 bp, Artificial
  CRISPR gRNA sequence
tgtctatttccattgtctgt

SEQ ID NO: 170373 - DNA, 20 bp, Artificial
  CRISPR gRNA sequence
tttccattgtctgtaaaatg

SEQ ID NO: 170374 - DNA, 20 bp, Artificial
  CRISPR gRNA sequence
ccattgtctgtaaaatggaa

SEQ ID NO: 170375 - DNA, 20 bp, Artificial
  CRISPR gRNA sequence
cattgtctgtaaaatggaac

SEQ ID NO: 170376 - DNA, 20 bp, Artificial
  CRISPR gRNA sequence
tctgtaaaatggaactgata

SEQ ID NO: 170377 - DNA, 20 bp, Artificial
  CRISPR gRNA sequence
taaaatggaactgataattc

SEQ ID NO: 170378 - DNA, 20 bp, Artificial
  CRISPR gRNA sequence
ataattcttattatatcaaa

SEQ ID NO: 170379 - DNA, 20 bp, Artificial
  CRISPR gRNA sequence
ttattatatcaaatctcaca

SEQ ID NO: 170380 - DNA, 20 bp, Artificial
  CRISPR gRNA sequence
attatatcaaatctcacagg

SEQ ID NO: 170381 - DNA, 20 bp, Artificial
  CRISPR gRNA sequence
ttatatcaaatctcacaggg

SEQ ID NO: 170382 - DNA, 20 bp, Artificial
  CRISPR gRNA sequence
tatcaaatctcacagggcta

SEQ ID NO: 170383 - DNA, 20 bp, Artificial
  CRISPR gRNA sequence
acagggctactgtgaggaag

SEQ ID NO: 170384 - DNA, 20 bp, Artificial
  CRISPR gRNA sequence
ctgtgaggaagaaaggagct

SEQ ID NO: 170385 - DNA, 20 bp, Artificial
  CRISPR gRNA sequence
tgaggaagaaaggagctaat

SEQ ID NO: 170386 - DNA, 20 bp, Artificial
  CRISPR gRNA sequence
ataaaagggaaaattactat

SEQ ID NO: 170387 - DNA, 20 bp, Artificial
  CRISPR gRNA sequence
ctatcaattgttagctttct

SEQ ID NO: 170388 - DNA, 20 bp, Artificial
  CRISPR gRNA sequence
tcaattgttagctttctgtg

SEQ ID NO: 170389 - DNA, 20 bp, Artificial
  CRISPR gRNA sequence
ttagctttctgtgaaaatac

SEQ ID NO: 170390 - DNA, 20 bp, Artificial
  CRISPR gRNA sequence
gctttctgtgaaaatacaaa

SEQ ID NO: 170391 - DNA, 20 bp, Artificial
  CRISPR gRNA sequence
tctgtgaaaatacaaaagac

SEQ ID NO: 170392 - DNA, 20 bp, Artificial
  CRISPR gRNA sequence
ctgtgaaaatacaaaagact

SEQ ID NO: 170393 - DNA, 20 bp, Artificial
  CRISPR gRNA sequence
tgtgaaaatacaaaagacta

SEQ ID NO: 170394 - DNA, 20 bp, Artificial
  CRISPR gRNA sequence
tgaaaatacaaaagactatt

SEQ ID NO: 170395 - DNA, 20 bp, Artificial
  CRISPR gRNA sequence
ttaattttgagtggtaaaga

SEQ ID NO: 170396 - DNA, 20 bp, Artificial
  CRISPR gRNA sequence
attttgagtggtaaagagac

SEQ ID NO: 170397 - DNA, 20 bp, Artificial
  CRISPR gRNA sequence
tgagtggtaaagagacagag

SEQ ID NO: 170398 - DNA, 20 bp, Artificial
  CRISPR gRNA sequence
gagtggtaaagagacagagt

SEQ ID NO: 170399 - DNA, 20 bp, Artificial
  CRISPR gRNA sequence
agtggtaaagagacagagtt

SEQ ID NO: 170400 - DNA, 20 bp, Artificial
  CRISPR gRNA sequence
ctctttctctgagatctgta

SEQ ID NO: 170401 - DNA, 20 bp, Artificial
  CRISPR gRNA sequence
tttctctgagatctgtaatg

SEQ ID NO: 170402 - DNA, 20 bp, Artificial
  CRISPR gRNA sequence
tctctgagatctgtaatgga

SEQ ID NO: 170403 - DNA, 20 bp, Artificial
  CRISPR gRNA sequence
ctctgagatctgtaatggag

SEQ ID NO: 170404 - DNA, 20 bp, Artificial
  CRISPR gRNA sequence
tctgagatctgtaatggaga

SEQ ID NO: 170405 - DNA, 20 bp, Artificial
  CRISPR gRNA sequence
tgagatctgtaatggagatg

SEQ ID NO: 170406 - DNA, 20 bp, Artificial
  CRISPR gRNA sequence
agatctgtaatggagatgga

SEQ ID NO: 170407 - DNA, 20 bp, Artificial
  CRISPR gRNA sequence
taatggagatggactcctag

SEQ ID NO: 170408 - DNA, 20 bp, Artificial
  CRISPR gRNA sequence
ctaggaatacagaaatggcc

SEQ ID NO: 170409 - DNA, 20 bp, Artificial
  CRISPR gRNA sequence
ggaatacagaaatggccaag

SEQ ID NO: 170410 - DNA, 20 bp, Artificial
  CRISPR gRNA sequence
tcacaagtattattcatgta

SEQ ID NO: 170411 - DNA, 20 bp, Artificial
  CRISPR gRNA sequence
acaagtattattcatgtaaa

SEQ ID NO: 170412 - DNA, 20 bp, Artificial
  CRISPR gRNA sequence
ttcatgtaaaagaaactcat

SEQ ID NO: 170413 - DNA, 20 bp, Artificial
  CRISPR gRNA sequence
atgtaaaagaaactcataga

SEQ ID NO: 170414 - DNA, 20 bp, Artificial
  CRISPR gRNA sequence
atagatcaaaaggttagaac

SEQ ID NO: 170415 - DNA, 20 bp, Artificial
  CRISPR gRNA sequence
gaacaggtagaatatcatta

SEQ ID NO: 170416 - DNA, 20 bp, Artificial
  CRISPR gRNA sequence
tcaaaaatttcttaagagtt

SEQ ID NO: 170417 - DNA, 20 bp, Artificial
  CRISPR gRNA sequence
cttaagagttcagatcaaca

SEQ ID NO: 170418 - DNA, 20 bp, Artificial
  CRISPR gRNA sequence
ttaagagttcagatcaacaa

SEQ ID NO: 170419 - DNA, 20 bp, Artificial
  CRISPR gRNA sequence
aagagttcagatcaacaaac

SEQ ID NO: 170420 - DNA, 20 bp, Artificial
  CRISPR gRNA sequence
agagttcagatcaacaaact

SEQ ID NO: 170421 - DNA, 20 bp, Artificial
  CRISPR gRNA sequence
agatcaacaaactatgtaag

SEQ ID NO: 170422 - DNA, 20 bp, Artificial
  CRISPR gRNA sequence
tgtaagacgctaagatgatg

SEQ ID NO: 170423 - DNA, 20 bp, Artificial
  CRISPR gRNA sequence
agatgatggcactgtcctgt

SEQ ID NO: 170424 - DNA, 20 bp, Artificial
  CRISPR gRNA sequence
tcctgttgatttgatgatac

SEQ ID NO: 170425 - DNA, 20 bp, Artificial
  CRISPR gRNA sequence
ttgatttgatgatacatgta

SEQ ID NO: 170426 - DNA, 20 bp, Artificial
  CRISPR gRNA sequence
atttgatgatacatgtatat

SEQ ID NO: 170427 - DNA, 20 bp, Artificial
  CRISPR gRNA sequence
gatgatacatgtatatacta

SEQ ID NO: 170428 - DNA, 20 bp, Artificial
  CRISPR gRNA sequence
atgatacatgtatatactac

SEQ ID NO: 170429 - DNA, 20 bp, Artificial
  CRISPR gRNA sequence
cactgtgaacagaactgtga

SEQ ID NO: 170430 - DNA, 20 bp, Artificial
  CRISPR gRNA sequence
tgaacagaactgtgagatac

SEQ ID NO: 170431 - DNA, 20 bp, Artificial
  CRISPR gRNA sequence
tgagataccagctgggcatg

SEQ ID NO: 170432 - DNA, 20 bp, Artificial
  CRISPR gRNA sequence
ggcatggtggctcatgccta

SEQ ID NO: 170433 - DNA, 20 bp, Artificial
  CRISPR gRNA sequence
atgcctaatcctagcacttt

SEQ ID NO: 170434 - DNA, 20 bp, Artificial
  CRISPR gRNA sequence
atcctagcactttgggaggc

SEQ ID NO: 170435 - DNA, 20 bp, Artificial
  CRISPR gRNA sequence
gcactttgggaggctgaggc

SEQ ID NO: 170436 - DNA, 20 bp, Artificial
  CRISPR gRNA sequence
tgggaggctgaggctggagg

SEQ ID NO: 170437 - DNA, 20 bp, Artificial
  CRISPR gRNA sequence
gggaggctgaggctggagga

SEQ ID NO: 170438 - DNA, 20 bp, Artificial
  CRISPR gRNA sequence
ggaggctgaggctggaggac

SEQ ID NO: 170439 - DNA, 20 bp, Artificial
  CRISPR gRNA sequence
aggctggaggactgcttgag

SEQ ID NO: 170440 - DNA, 20 bp, Artificial
  CRISPR gRNA sequence
gaggactgcttgagcccagg

SEQ ID NO: 170441 - DNA, 20 bp, Artificial
  CRISPR gRNA sequence
cttgagcccaggagttcgtg

SEQ ID NO: 170442 - DNA, 20 bp, Artificial
  CRISPR gRNA sequence
gagcccaggagttcgtgact

SEQ ID NO: 170443 - DNA, 20 bp, Artificial
  CRISPR gRNA sequence
agcccaggagttcgtgacta

SEQ ID NO: 170444 - DNA, 20 bp, Artificial
  CRISPR gRNA sequence
gtgactagcctggacaacat

SEQ ID NO: 170445 - DNA, 20 bp, Artificial
  CRISPR gRNA sequence
gcctggacaacatggtgaga

SEQ ID NO: 170446 - DNA, 20 bp, Artificial
  CRISPR gRNA sequence
gacaacatggtgagatcctg

SEQ ID NO: 170447 - DNA, 20 bp, Artificial
  CRISPR gRNA sequence
tcccccactccaaaaaaaca

SEQ ID NO: 170448 - DNA, 20 bp, Artificial
  CRISPR gRNA sequence
caaaaaaacattaaaaatta

SEQ ID NO: 170449 - DNA, 20 bp, Artificial
  CRISPR gRNA sequence
aaaattaagccagacatgat

SEQ ID NO: 170450 - DNA, 20 bp, Artificial
  CRISPR gRNA sequence
agccagacatgatggcacgt

SEQ ID NO: 170451 - DNA, 20 bp, Artificial
  CRISPR gRNA sequence
tagtcccagctacttgggag

SEQ ID NO: 170452 - DNA, 20 bp, Artificial
  CRISPR gRNA sequence
cttgggaggctgaggtggga

SEQ ID NO: 170453 - DNA, 20 bp, Artificial
  CRISPR gRNA sequence
gggaggctgaggtgggaaga

SEQ ID NO: 170454 - DNA, 20 bp, Artificial
  CRISPR gRNA sequence
ggaggctgaggtgggaagat

SEQ ID NO: 170455 - DNA, 20 bp, Artificial
  CRISPR gRNA sequence
aggtgggaagatcacttaag

SEQ ID NO: 170456 - DNA, 20 bp, Artificial
  CRISPR gRNA sequence
aagcctgggaggtgaaggct

SEQ ID NO: 170457 - DNA, 20 bp, Artificial
  CRISPR gRNA sequence
agcctgggaggtgaaggcta

SEQ ID NO: 170458 - DNA, 20 bp, Artificial
  CRISPR gRNA sequence
ggaggtgaaggctacagtga

SEQ ID NO: 170459 - DNA, 20 bp, Artificial
  CRISPR gRNA sequence
cagtgagccgtgattatgcc

SEQ ID NO: 170460 - DNA, 20 bp, Artificial
  CRISPR gRNA sequence
tgccattgccctccagcctg

SEQ ID NO: 170461 - DNA, 20 bp, Artificial
  CRISPR gRNA sequence
ccctccagcctgggtgacag

SEQ ID NO: 170462 - DNA, 20 bp, Artificial
  CRISPR gRNA sequence
cagcctgggtgacagagtga

SEQ ID NO: 170463 - DNA, 20 bp, Artificial
  CRISPR gRNA sequence
ggtgacagagtgagaccctg

SEQ ID NO: 170464 - DNA, 20 bp, Artificial
  CRISPR gRNA sequence
tctcaaaaagaaagaaaagg

SEQ ID NO: 170465 - DNA, 20 bp, Artificial
  CRISPR gRNA sequence
aaaaagaaagaaaaggccag

SEQ ID NO: 170466 - DNA, 20 bp, Artificial
  CRISPR gRNA sequence
acacctgtaatcccagcact

SEQ ID NO: 170467 - DNA, 20 bp, Artificial
  CRISPR gRNA sequence
taatcccagcactttgggag

SEQ ID NO: 170468 - DNA, 20 bp, Artificial
  CRISPR gRNA sequence
tgggaggcagaggcaggcat

SEQ ID NO: 170469 - DNA, 20 bp, Artificial
  CRISPR gRNA sequence
gggaggcagaggcaggcata

SEQ ID NO: 170470 - DNA, 20 bp, Artificial
  CRISPR gRNA sequence
ggaggcagaggcaggcatat

SEQ ID NO: 170471 - DNA, 20 bp, Artificial
  CRISPR gRNA sequence
aggtcgggagttcaagacca

SEQ ID NO: 170472 - DNA, 20 bp, Artificial
  CRISPR gRNA sequence
aagaccagcctggccaacat

SEQ ID NO: 170473 - DNA, 20 bp, Artificial
  CRISPR gRNA sequence
gccaacatggtgaaaccctg

SEQ ID NO: 170474 - DNA, 20 bp, Artificial
  CRISPR gRNA sequence
tctctacaaaaaatacaaaa

SEQ ID NO: 170475 - DNA, 20 bp, Artificial
  CRISPR gRNA sequence
tacaaaaaatacaaaaatta

SEQ ID NO: 170476 - DNA, 20 bp, Artificial
  CRISPR gRNA sequence
caaaaaatacaaaaattagc

SEQ ID NO: 170477 - DNA, 20 bp, Artificial
  CRISPR gRNA sequence
gctaggtgtggtggcgggcg

SEQ ID NO: 170478 - DNA, 20 bp, Artificial
  CRISPR gRNA sequence
ggtgtggtggcgggcgcctg

SEQ ID NO: 170479 - DNA, 20 bp, Artificial
  CRISPR gRNA sequence
taatcctagctactcgggag

SEQ ID NO: 170480 - DNA, 20 bp, Artificial
  CRISPR gRNA sequence
gctactcgggagtctgaggc

SEQ ID NO: 170481 - DNA, 20 bp, Artificial
  CRISPR gRNA sequence
ctcgggagtctgaggcatgg

SEQ ID NO: 170482 - DNA, 20 bp, Artificial
  CRISPR gRNA sequence
gggagtctgaggcatgggaa

SEQ ID NO: 170483 - DNA, 20 bp, Artificial
  CRISPR gRNA sequence
aggcatgggaattgcctgaa

SEQ ID NO: 170484 - DNA, 20 bp, Artificial
  CRISPR gRNA sequence
cctgaacctgggaggcagag

SEQ ID NO: 170485 - DNA, 20 bp, Artificial
  CRISPR gRNA sequence
aacctgggaggcagaggttg

SEQ ID NO: 170486 - DNA, 20 bp, Artificial
  CRISPR gRNA sequence
ggaggcagaggttgcagtga

SEQ ID NO: 170487 - DNA, 20 bp, Artificial
  CRISPR gRNA sequence
cagtgagctaagctcgcacc

SEQ ID NO: 170488 - DNA, 20 bp, Artificial
  CRISPR gRNA sequence
agctcgcaccactgcactgc

SEQ ID NO: 170489 - DNA, 20 bp, Artificial
  CRISPR gRNA sequence
gcaccactgcactgcggcct

SEQ ID NO: 170490 - DNA, 20 bp, Artificial
  CRISPR gRNA sequence
cactgcggcctggataacag

SEQ ID NO: 170491 - DNA, 20 bp, Artificial
  CRISPR gRNA sequence
cggcctggataacagagtaa

SEQ ID NO: 170492 - DNA, 20 bp, Artificial
  CRISPR gRNA sequence
gataacagagtaaaactctc

SEQ ID NO: 170493 - DNA, 20 bp, Artificial
  CRISPR gRNA sequence
tcaaaaaaaaaaaaaaaacc

SEQ ID NO: 170494 - DNA, 20 bp, Artificial
  CRISPR gRNA sequence
aaaaaaaaaaaaaaaaccca

SEQ ID NO: 170495 - DNA, 20 bp, Artificial
  CRISPR gRNA sequence
ttttttcaacatctaaaaaa

SEQ ID NO: 170496 - DNA, 20 bp, Artificial
  CRISPR gRNA sequence
tttcaacatctaaaaaattt

SEQ ID NO: 170497 - DNA, 20 bp, Artificial
  CRISPR gRNA sequence
ttcaacatctaaaaaatttt

SEQ ID NO: 170498 - DNA, 20 bp, Artificial
  CRISPR gRNA sequence
tcaacatctaaaaaattttc

SEQ ID NO: 170499 - DNA, 20 bp, Artificial
  CRISPR gRNA sequence
caacatctaaaaaattttca

SEQ ID NO: 170500 - DNA, 20 bp, Artificial
  CRISPR gRNA sequence
aacatctaaaaaattttcag

SEQ ID NO: 170501 - DNA, 20 bp, Artificial
  CRISPR gRNA sequence
aaaaattttcaggatgatcc

SEQ ID NO: 170502 - DNA, 20 bp, Artificial
  CRISPR gRNA sequence
tcaggatgatccatatagta

SEQ ID NO: 170503 - DNA, 20 bp, Artificial
  CRISPR gRNA sequence
caggatgatccatatagtaa

SEQ ID NO: 170504 - DNA, 20 bp, Artificial
  CRISPR gRNA sequence
aggatgatccatatagtaac

SEQ ID NO: 170505 - DNA, 20 bp, Artificial
  CRISPR gRNA sequence
ctcaattttggctcacttaa

SEQ ID NO: 170506 - DNA, 20 bp, Artificial
  CRISPR gRNA sequence
aattttggctcacttaacaa

SEQ ID NO: 170507 - DNA, 20 bp, Artificial
  CRISPR gRNA sequence
tggctcacttaacaattttg

SEQ ID NO: 170508 - DNA, 20 bp, Artificial
  CRISPR gRNA sequence
ggctcacttaacaattttgc

SEQ ID NO: 170509 - DNA, 20 bp, Artificial
  CRISPR gRNA sequence
gctcacttaacaattttgca

SEQ ID NO: 170510 - DNA, 20 bp, Artificial
  CRISPR gRNA sequence
acttaacaattttgcacagg

SEQ ID NO: 170511 - DNA, 20 bp, Artificial
  CRISPR gRNA sequence
aacaattttgcacaggaacc

SEQ ID NO: 170512 - DNA, 20 bp, Artificial
  CRISPR gRNA sequence
acaattttgcacaggaacca

SEQ ID NO: 170513 - DNA, 20 bp, Artificial
  CRISPR gRNA sequence
tgcacaggaaccaaataaca

SEQ ID NO: 170514 - DNA, 20 bp, Artificial
  CRISPR gRNA sequence
gcacaggaaccaaataacaa

SEQ ID NO: 170515 - DNA, 20 bp, Artificial
  CRISPR gRNA sequence
cacaggaaccaaataacaaa

SEQ ID NO: 170516 - DNA, 20 bp, Artificial
  CRISPR gRNA sequence
ttgtgtgttcttgtttaatt

SEQ ID NO: 170517 - DNA, 20 bp, Artificial
  CRISPR gRNA sequence
tgtgtgttcttgtttaatta

SEQ ID NO: 170518 - DNA, 20 bp, Artificial
  CRISPR gRNA sequence
gtgtgttcttgtttaattaa

SEQ ID NO: 170519 - DNA, 20 bp, Artificial
  CRISPR gRNA sequence
tgtgttcttgtttaattaaa

SEQ ID NO: 170520 - DNA, 20 bp, Artificial
  CRISPR gRNA sequence
ttgtttaattaaactttgag

SEQ ID NO: 170521 - DNA, 20 bp, Artificial
  CRISPR gRNA sequence
gtttaattaaactttgagct

SEQ ID NO: 170522 - DNA, 20 bp, Artificial
  CRISPR gRNA sequence
tttaattaaactttgagctc

SEQ ID NO: 170523 - DNA, 20 bp, Artificial
  CRISPR gRNA sequence
aattaaactttgagctctag

SEQ ID NO: 170524 - DNA, 20 bp, Artificial
  CRISPR gRNA sequence
attaaactttgagctctaga

SEQ ID NO: 170525 - DNA, 20 bp, Artificial
  CRISPR gRNA sequence
aactttgagctctagagaaa

SEQ ID NO: 170526 - DNA, 20 bp, Artificial
  CRISPR gRNA sequence
tgagctctagagaaatgagc

SEQ ID NO: 170527 - DNA, 20 bp, Artificial
  CRISPR gRNA sequence
gagctctagagaaatgagca

SEQ ID NO: 170528 - DNA, 20 bp, Artificial
  CRISPR gRNA sequence
agctctagagaaatgagcaa

SEQ ID NO: 170529 - DNA, 20 bp, Artificial
  CRISPR gRNA sequence
tagagaaatgagcaataacc

SEQ ID NO: 170530 - DNA, 20 bp, Artificial
  CRISPR gRNA sequence
gagaaatgagcaataaccta

SEQ ID NO: 170531 - DNA, 20 bp, Artificial
  CRISPR gRNA sequence
cccatcacttagcttcaata

SEQ ID NO: 170532 - DNA, 20 bp, Artificial
  CRISPR gRNA sequence
agcttcaataagaaataata

SEQ ID NO: 170533 - DNA, 20 bp, Artificial
  CRISPR gRNA sequence
gcttcaataagaaataataa

SEQ ID NO: 170534 - DNA, 20 bp, Artificial
  CRISPR gRNA sequence
caataagaaataataaaaat

SEQ ID NO: 170535 - DNA, 20 bp, Artificial
  CRISPR gRNA sequence
aataagaaataataaaaatg

SEQ ID NO: 170536 - DNA, 20 bp, Artificial
  CRISPR gRNA sequence
accttcacatcttcatccag

SEQ ID NO: 170537 - DNA, 20 bp, Artificial
  CRISPR gRNA sequence
cacatcttcatccagtttca

SEQ ID NO: 170538 - DNA, 20 bp, Artificial
  CRISPR gRNA sequence
acatcttcatccagtttcat

SEQ ID NO: 170539 - DNA, 20 bp, Artificial
  CRISPR gRNA sequence
catccagtttcataatcttc

SEQ ID NO: 170540 - DNA, 20 bp, Artificial
  CRISPR gRNA sequence
atccagtttcataatcttct

SEQ ID NO: 170541 - DNA, 20 bp, Artificial
  CRISPR gRNA sequence
cataatcttcttaatacgag

SEQ ID NO: 170542 - DNA, 20 bp, Artificial
  CRISPR gRNA sequence
ataatcttcttaatacgagc

SEQ ID NO: 170543 - DNA, 20 bp, Artificial
  CRISPR gRNA sequence
cttaatacgagccagtggga

SEQ ID NO: 170544 - DNA, 20 bp, Artificial
  CRISPR gRNA sequence
ttaatacgagccagtgggag

SEQ ID NO: 170545 - DNA, 20 bp, Artificial
  CRISPR gRNA sequence
aatacgagccagtgggagtt

SEQ ID NO: 170546 - DNA, 20 bp, Artificial
  CRISPR gRNA sequence
atacgagccagtgggagttc

SEQ ID NO: 170547 - DNA, 20 bp, Artificial
  CRISPR gRNA sequence
ctgcactcggaagtctttct

SEQ ID NO: 170548 - DNA, 20 bp, Artificial
  CRISPR gRNA sequence
cactcggaagtctttctgaa

SEQ ID NO: 170549 - DNA, 20 bp, Artificial
  CRISPR gRNA sequence
ggaagtctttctgaaatgaa

SEQ ID NO: 170550 - DNA, 20 bp, Artificial
  CRISPR gRNA sequence
tctgaaatgaacaacaagag

SEQ ID NO: 170551 - DNA, 20 bp, Artificial
  CRISPR gRNA sequence
ctgaaatgaacaacaagaga

SEQ ID NO: 170552 - DNA, 20 bp, Artificial
  CRISPR gRNA sequence
tgaaatgaacaacaagagat

SEQ ID NO: 170553 - DNA, 20 bp, Artificial
  CRISPR gRNA sequence
aaatgaacaacaagagatgc

SEQ ID NO: 170554 - DNA, 20 bp, Artificial
  CRISPR gRNA sequence
tggcttggtccctctcttca

SEQ ID NO: 170555 - DNA, 20 bp, Artificial
  CRISPR gRNA sequence
gcttggtccctctcttcagg

SEQ ID NO: 170556 - DNA, 20 bp, Artificial
  CRISPR gRNA sequence
ggtccctctcttcaggaagc

SEQ ID NO: 170557 - DNA, 20 bp, Artificial
  CRISPR gRNA sequence
gtccctctcttcaggaagcg

SEQ ID NO: 170558 - DNA, 20 bp, Artificial
  CRISPR gRNA sequence
tcttcaggaagcgtatgtcg

SEQ ID NO: 170559 - DNA, 20 bp, Artificial
  CRISPR gRNA sequence
ttcaggaagcgtatgtcggg

SEQ ID NO: 170560 - DNA, 20 bp, Artificial
  CRISPR gRNA sequence
caggaagcgtatgtcgggag

SEQ ID NO: 170561 - DNA, 20 bp, Artificial
  CRISPR gRNA sequence
aggaagcgtatgtcgggaga

SEQ ID NO: 170562 - DNA, 20 bp, Artificial
  CRISPR gRNA sequence
cagagcaaaattcttcttta

SEQ ID NO: 170563 - DNA, 20 bp, Artificial
  CRISPR gRNA sequence
ttctttacttaacatatgca

SEQ ID NO: 170564 - DNA, 20 bp, Artificial
  CRISPR gRNA sequence
ctttacttaacatatgcagg

SEQ ID NO: 170565 - DNA, 20 bp, Artificial
  CRISPR gRNA sequence
tttacttaacatatgcaggt

SEQ ID NO: 170566 - DNA, 20 bp, Artificial
  CRISPR gRNA sequence
tacttaacatatgcaggtct

SEQ ID NO: 170567 - DNA, 20 bp, Artificial
  CRISPR gRNA sequence
acttaacatatgcaggtctt

SEQ ID NO: 170568 - DNA, 20 bp, Artificial
  CRISPR gRNA sequence
cttaacatatgcaggtcttc

SEQ ID NO: 170569 - DNA, 20 bp, Artificial
  CRISPR gRNA sequence
aacatatgcaggtcttcaaa

SEQ ID NO: 170570 - DNA, 20 bp, Artificial
  CRISPR gRNA sequence
acatatgcaggtcttcaaag

SEQ ID NO: 170571 - DNA, 20 bp, Artificial
  CRISPR gRNA sequence
caaagaattaatgggcttta

SEQ ID NO: 170572 - DNA, 20 bp, Artificial
  CRISPR gRNA sequence
aaagaattaatgggctttag

SEQ ID NO: 170573 - DNA, 20 bp, Artificial
  CRISPR gRNA sequence
atgggctttagaaaaagctt

SEQ ID NO: 170574 - DNA, 20 bp, Artificial
  CRISPR gRNA sequence
tagaaaaagcttaggatggc

SEQ ID NO: 170575 - DNA, 20 bp, Artificial
  CRISPR gRNA sequence
agaaaaagcttaggatggcc

SEQ ID NO: 170576 - DNA, 20 bp, Artificial
  CRISPR gRNA sequence
gaaaaagcttaggatggcct

SEQ ID NO: 170577 - DNA, 20 bp, Artificial
  CRISPR gRNA sequence
aggatggcctctaacagtgc

SEQ ID NO: 170578 - DNA, 20 bp, Artificial
  CRISPR gRNA sequence
ggatggcctctaacagtgct

SEQ ID NO: 170579 - DNA, 20 bp, Artificial
  CRISPR gRNA sequence
taacagtgctctcatgaaac

SEQ ID NO: 170580 - DNA, 20 bp, Artificial
  CRISPR gRNA sequence
acagtgctctcatgaaacac

SEQ ID NO: 170581 - DNA, 20 bp, Artificial
  CRISPR gRNA sequence
tcatgaaacacagccccaag

SEQ ID NO: 170582 - DNA, 20 bp, Artificial
  CRISPR gRNA sequence
atgaaacacagccccaagca

SEQ ID NO: 170583 - DNA, 20 bp, Artificial
  CRISPR gRNA sequence
tttttttttttttttcgtca

SEQ ID NO: 170584 - DNA, 20 bp, Artificial
  CRISPR gRNA sequence
ttttttttttttcgtcagca

SEQ ID NO: 170585 - DNA, 20 bp, Artificial
  CRISPR gRNA sequence
tttttttttttcgtcagcac

SEQ ID NO: 170586 - DNA, 20 bp, Artificial
  CRISPR gRNA sequence
ttttttttttcgtcagcaca

SEQ ID NO: 170587 - DNA, 20 bp, Artificial
  CRISPR gRNA sequence
tttttttttcgtcagcacaa

SEQ ID NO: 170588 - DNA, 20 bp, Artificial
  CRISPR gRNA sequence
ttttttttcgtcagcacaac

SEQ ID NO: 170589 - DNA, 20 bp, Artificial
  CRISPR gRNA sequence
tttttttcgtcagcacaaca

SEQ ID NO: 170590 - DNA, 20 bp, Artificial
  CRISPR gRNA sequence
ttttttcgtcagcacaacat

SEQ ID NO: 170591 - DNA, 20 bp, Artificial
  CRISPR gRNA sequence
tttttcgtcagcacaacata

SEQ ID NO: 170592 - DNA, 20 bp, Artificial
  CRISPR gRNA sequence
ttttcgtcagcacaacatag

SEQ ID NO: 170593 - DNA, 20 bp, Artificial
  CRISPR gRNA sequence
tttcgtcagcacaacataga

SEQ ID NO: 170594 - DNA, 20 bp, Artificial
  CRISPR gRNA sequence
ttcgtcagcacaacatagag

SEQ ID NO: 170595 - DNA, 20 bp, Artificial
  CRISPR gRNA sequence
tcgtcagcacaacatagagg

SEQ ID NO: 170596 - DNA, 20 bp, Artificial
  CRISPR gRNA sequence
cgtcagcacaacatagaggg

SEQ ID NO: 170597 - DNA, 20 bp, Artificial
  CRISPR gRNA sequence
gtcagcacaacatagaggga

SEQ ID NO: 170598 - DNA, 20 bp, Artificial
  CRISPR gRNA sequence
tgagcgccttcttttttttt

SEQ ID NO: 170599 - DNA, 20 bp, Artificial
  CRISPR gRNA sequence
ctttttttttccaagtaagt

SEQ ID NO: 170600 - DNA, 20 bp, Artificial
  CRISPR gRNA sequence
tttttttttccaagtaagtt

SEQ ID NO: 170601 - DNA, 20 bp, Artificial
  CRISPR gRNA sequence
tttttttccaagtaagttta

SEQ ID NO: 170602 - DNA, 20 bp, Artificial
  CRISPR gRNA sequence
ttttttccaagtaagtttac

SEQ ID NO: 170603 - DNA, 20 bp, Artificial
  CRISPR gRNA sequence
tttttccaagtaagtttacc

SEQ ID NO: 170604 - DNA, 20 bp, Artificial
  CRISPR gRNA sequence
ttttccaagtaagtttacca

SEQ ID NO: 170605 - DNA, 20 bp, Artificial
  CRISPR gRNA sequence
tttccaagtaagtttaccag

SEQ ID NO: 170606 - DNA, 20 bp, Artificial
  CRISPR gRNA sequence
ttccaagtaagtttaccagt

SEQ ID NO: 170607 - DNA, 20 bp, Artificial
  CRISPR gRNA sequence
tccaagtaagtttaccagtc

SEQ ID NO: 170608 - DNA, 20 bp, Artificial
  CRISPR gRNA sequence
ccaagtaagtttaccagtct

SEQ ID NO: 170609 - DNA, 20 bp, Artificial
  CRISPR gRNA sequence
caagtaagtttaccagtctg

SEQ ID NO: 170610 - DNA, 20 bp, Artificial
  CRISPR gRNA sequence
accagtctgcaatatgcaga

SEQ ID NO: 170611 - DNA, 20 bp, Artificial
  CRISPR gRNA sequence
ccagtctgcaatatgcagat

SEQ ID NO: 170612 - DNA, 20 bp, Artificial
  CRISPR gRNA sequence
caatatgcagattaaaatga

SEQ ID NO: 170613 - DNA, 20 bp, Artificial
  CRISPR gRNA sequence
aaatgagatttctgtctcag

SEQ ID NO: 170614 - DNA, 20 bp, Artificial
  CRISPR gRNA sequence
ctgtctcaggggtattcctc

SEQ ID NO: 170615 - DNA, 20 bp, Artificial
  CRISPR gRNA sequence
tgtctcaggggtattcctct

SEQ ID NO: 170616 - DNA, 20 bp, Artificial
  CRISPR gRNA sequence
tctcaggggtattcctctaa

SEQ ID NO: 170617 - DNA, 20 bp, Artificial
  CRISPR gRNA sequence
aggggtattcctctaaactg

SEQ ID NO: 170618 - DNA, 20 bp, Artificial
  CRISPR gRNA sequence
ctctaaactgccagttcttt

SEQ ID NO: 170619 - DNA, 20 bp, Artificial
  CRISPR gRNA sequence
taaactgccagttctttctt

SEQ ID NO: 170620 - DNA, 20 bp, Artificial
  CRISPR gRNA sequence
aactgccagttctttcttcc

SEQ ID NO: 170621 - DNA, 20 bp, Artificial
  CRISPR gRNA sequence
ccagttctttcttccattca

SEQ ID NO: 170622 - DNA, 20 bp, Artificial
  CRISPR gRNA sequence
tttcttccattcagtgacca

SEQ ID NO: 170623 - DNA, 20 bp, Artificial
  CRISPR gRNA sequence
tcttccattcagtgaccaaa

SEQ ID NO: 170624 - DNA, 20 bp, Artificial
  CRISPR gRNA sequence
cttccattcagtgaccaaac

SEQ ID NO: 170625 - DNA, 20 bp, Artificial
  CRISPR gRNA sequence
ttccattcagtgaccaaact

SEQ ID NO: 170626 - DNA, 20 bp, Artificial
  CRISPR gRNA sequence
ccattcagtgaccaaactaa

SEQ ID NO: 170627 - DNA, 20 bp, Artificial
  CRISPR gRNA sequence
cattcagtgaccaaactaac

SEQ ID NO: 170628 - DNA, 20 bp, Artificial
  CRISPR gRNA sequence
agtgaccaaactaacagcaa

SEQ ID NO: 170629 - DNA, 20 bp, Artificial
  CRISPR gRNA sequence
acagcaacgccggggcactt

SEQ ID NO: 170630 - DNA, 20 bp, Artificial
  CRISPR gRNA sequence
gaccacagtgatccacagtt

SEQ ID NO: 170631 - DNA, 20 bp, Artificial
  CRISPR gRNA sequence
accacagtgatccacagttc

SEQ ID NO: 170632 - DNA, 20 bp, Artificial
  CRISPR gRNA sequence
tttacaactgatagtggcca

SEQ ID NO: 170633 - DNA, 20 bp, Artificial
  CRISPR gRNA sequence
tacaactgatagtggccatt

SEQ ID NO: 170634 - DNA, 20 bp, Artificial
  CRISPR gRNA sequence
acaactgatagtggccattt

SEQ ID NO: 170635 - DNA, 20 bp, Artificial
  CRISPR gRNA sequence
caactgatagtggccatttc

SEQ ID NO: 170636 - DNA, 20 bp, Artificial
  CRISPR gRNA sequence
atagtggccatttctgacat

SEQ ID NO: 170637 - DNA, 20 bp, Artificial
  CRISPR gRNA sequence
ctgacatttgcactaacctg

SEQ ID NO: 170638 - DNA, 20 bp, Artificial
  CRISPR gRNA sequence
tgacatttgcactaacctga

SEQ ID NO: 170639 - DNA, 20 bp, Artificial
  CRISPR gRNA sequence
acatttgcactaacctgaca

SEQ ID NO: 170640 - DNA, 20 bp, Artificial
  CRISPR gRNA sequence
gcactaacctgacaacagaa

SEQ ID NO: 170641 - DNA, 20 bp, Artificial
  CRISPR gRNA sequence
cactaacctgacaacagaaa

SEQ ID NO: 170642 - DNA, 20 bp, Artificial
  CRISPR gRNA sequence
acctgacaacagaaactggg

SEQ ID NO: 170643 - DNA, 20 bp, Artificial
  CRISPR gRNA sequence
acaacagaaactggggagga

SEQ ID NO: 170644 - DNA, 20 bp, Artificial
  CRISPR gRNA sequence
gggaggagagctcctttctc

SEQ ID NO: 170645 - DNA, 20 bp, Artificial
  CRISPR gRNA sequence
ctttctcatcacagtagcaa

SEQ ID NO: 170646 - DNA, 20 bp, Artificial
  CRISPR gRNA sequence
tctcatcacagtagcaatgg

SEQ ID NO: 170647 - DNA, 20 bp, Artificial
  CRISPR gRNA sequence
ctcatcacagtagcaatggc

SEQ ID NO: 170648 - DNA, 20 bp, Artificial
  CRISPR gRNA sequence
tcatcacagtagcaatggcc

SEQ ID NO: 170649 - DNA, 20 bp, Artificial
  CRISPR gRNA sequence
atcacagtagcaatggcctt

SEQ ID NO: 170650 - DNA, 20 bp, Artificial
  CRISPR gRNA sequence
gtctccaaaatttgtttcaa

SEQ ID NO: 170651 - DNA, 20 bp, Artificial
  CRISPR gRNA sequence
tctccaaaatttgtttcaag

SEQ ID NO: 170652 - DNA, 20 bp, Artificial
  CRISPR gRNA sequence
caaaatttgtttcaagtggg

SEQ ID NO: 170653 - DNA, 20 bp, Artificial
  CRISPR gRNA sequence
gtttcaagtgggggtagagg

SEQ ID NO: 170654 - DNA, 20 bp, Artificial
  CRISPR gRNA sequence
tttcaagtgggggtagagga

SEQ ID NO: 170655 - DNA, 20 bp, Artificial
  CRISPR gRNA sequence
caagtgggggtagaggagta

SEQ ID NO: 170656 - DNA, 20 bp, Artificial
  CRISPR gRNA sequence
aagtgggggtagaggagtat

SEQ ID NO: 170657 - DNA, 20 bp, Artificial
  CRISPR gRNA sequence
gtcagctgccttttaggaac

SEQ ID NO: 170658 - DNA, 20 bp, Artificial
  CRISPR gRNA sequence
tcagctgccttttaggaaca

SEQ ID NO: 170659 - DNA, 20 bp, Artificial
  CRISPR gRNA sequence
ccttttaggaacagctgtgt

SEQ ID NO: 170660 - DNA, 20 bp, Artificial
  CRISPR gRNA sequence
ttaggaacagctgtgttatt

SEQ ID NO: 170661 - DNA, 20 bp, Artificial
  CRISPR gRNA sequence
taggaacagctgtgttattt

SEQ ID NO: 170662 - DNA, 20 bp, Artificial
  CRISPR gRNA sequence
aggaacagctgtgttatttt

SEQ ID NO: 170663 - DNA, 20 bp, Artificial
  CRISPR gRNA sequence
ggaacagctgtgttattttt

SEQ ID NO: 170664 - DNA, 20 bp, Artificial
  CRISPR gRNA sequence
tgttattttttcttaacaag

SEQ ID NO: 170665 - DNA, 20 bp, Artificial
  CRISPR gRNA sequence
ttttttcttaacaagcctgg

SEQ ID NO: 170666 - DNA, 20 bp, Artificial
  CRISPR gRNA sequence
tttcttaacaagcctggagt

SEQ ID NO: 170667 - DNA, 20 bp, Artificial
  CRISPR gRNA sequence
ttcttaacaagcctggagtg

SEQ ID NO: 170668 - DNA, 20 bp, Artificial
  CRISPR gRNA sequence
tcttaacaagcctggagtgg

SEQ ID NO: 170669 - DNA, 20 bp, Artificial
  CRISPR gRNA sequence
cttaacaagcctggagtggg

SEQ ID NO: 170670 - DNA, 20 bp, Artificial
  CRISPR gRNA sequence
ttaacaagcctggagtgggg

SEQ ID NO: 170671 - DNA, 20 bp, Artificial
  CRISPR gRNA sequence
aacaagcctggagtggggga

SEQ ID NO: 170672 - DNA, 20 bp, Artificial
  CRISPR gRNA sequence
acaagcctggagtgggggag

SEQ ID NO: 170673 - DNA, 20 bp, Artificial
  CRISPR gRNA sequence
gagtgggggaggaccatata

SEQ ID NO: 170674 - DNA, 20 bp, Artificial
  CRISPR gRNA sequence
cactgtggatatagtttagg

SEQ ID NO: 170675 - DNA, 20 bp, Artificial
  CRISPR gRNA sequence
actgtggatatagtttagga

SEQ ID NO: 170676 - DNA, 20 bp, Artificial
  CRISPR gRNA sequence
tggatatagtttaggaaagg

SEQ ID NO: 170677 - DNA, 20 bp, Artificial
  CRISPR gRNA sequence
aggaaagggcttttttgatc

SEQ ID NO: 170678 - DNA, 20 bp, Artificial
  CRISPR gRNA sequence
ggaaagggcttttttgatca

SEQ ID NO: 170679 - DNA, 20 bp, Artificial
  CRISPR gRNA sequence
ttttgatcagcactactcaa

SEQ ID NO: 170680 - DNA, 20 bp, Artificial
  CRISPR gRNA sequence
tttgatcagcactactcaat

SEQ ID NO: 170681 - DNA, 20 bp, Artificial
  CRISPR gRNA sequence
ttgatcagcactactcaata

SEQ ID NO: 170682 - DNA, 20 bp, Artificial
  CRISPR gRNA sequence
tgatcagcactactcaataa

SEQ ID NO: 170683 - DNA, 20 bp, Artificial
  CRISPR gRNA sequence
gatcagcactactcaataat

SEQ ID NO: 170684 - DNA, 20 bp, Artificial
  CRISPR gRNA sequence
atcagcactactcaataatt

SEQ ID NO: 170685 - DNA, 20 bp, Artificial
  CRISPR gRNA sequence
ctcaataatttgagacttaa

SEQ ID NO: 170686 - DNA, 20 bp, Artificial
  CRISPR gRNA sequence
aataatttgagacttaagcc

SEQ ID NO: 170687 - DNA, 20 bp, Artificial
  CRISPR gRNA sequence
gagacttaagcccttttttg

SEQ ID NO: 170688 - DNA, 20 bp, Artificial
  CRISPR gRNA sequence
agacttaagcccttttttgt

SEQ ID NO: 170689 - DNA, 20 bp, Artificial
  CRISPR gRNA sequence
aagcccttttttgttttatt

SEQ ID NO: 170690 - DNA, 20 bp, Artificial
  CRISPR gRNA sequence
agcccttttttgttttattt

SEQ ID NO: 170691 - DNA, 20 bp, Artificial
  CRISPR gRNA sequence
ttttgttttattttgaaact

SEQ ID NO: 170692 - DNA, 20 bp, Artificial
  CRISPR gRNA sequence
tttgttttattttgaaacta

SEQ ID NO: 170693 - DNA, 20 bp, Artificial
  CRISPR gRNA sequence
ttgttttattttgaaactac

SEQ ID NO: 170694 - DNA, 20 bp, Artificial
  CRISPR gRNA sequence
tgttttattttgaaactact

SEQ ID NO: 170695 - DNA, 20 bp, Artificial
  CRISPR gRNA sequence
gttttattttgaaactactg

SEQ ID NO: 170696 - DNA, 20 bp, Artificial
  CRISPR gRNA sequence
ttttattttgaaactactgg

SEQ ID NO: 170697 - DNA, 20 bp, Artificial
  CRISPR gRNA sequence
tattttgaaactactggtat

SEQ ID NO: 170698 - DNA, 20 bp, Artificial
  CRISPR gRNA sequence
attttgaaactactggtatt

SEQ ID NO: 170699 - DNA, 20 bp, Artificial
  CRISPR gRNA sequence
ttttgaaactactggtattt

SEQ ID NO: 170700 - DNA, 20 bp, Artificial
  CRISPR gRNA sequence
tgaaactactggtatttaaa

SEQ ID NO: 170701 - DNA, 20 bp, Artificial
  CRISPR gRNA sequence
gaaactactggtatttaaac

SEQ ID NO: 170702 - DNA, 20 bp, Artificial
  CRISPR gRNA sequence
aaactactggtatttaaaca

SEQ ID NO: 170703 - DNA, 20 bp, Artificial
  CRISPR gRNA sequence
ctggtatttaaacacatgcc

SEQ ID NO: 170704 - DNA, 20 bp, Artificial
  CRISPR gRNA sequence
gtatttaaacacatgcccaa

SEQ ID NO: 170705 - DNA, 20 bp, Artificial
  CRISPR gRNA sequence
aaacacatgcccaatgatgg

SEQ ID NO: 170706 - DNA, 20 bp, Artificial
  CRISPR gRNA sequence
aacacatgcccaatgatgga

SEQ ID NO: 170707 - DNA, 20 bp, Artificial
  CRISPR gRNA sequence
taggaaaaaaatcaattttg

SEQ ID NO: 170708 - DNA, 20 bp, Artificial
  CRISPR gRNA sequence
ggaaaaaaatcaattttgag

SEQ ID NO: 170709 - DNA, 20 bp, Artificial
  CRISPR gRNA sequence
tgagtttcagagctgcaatg

SEQ ID NO: 170710 - DNA, 20 bp, Artificial
  CRISPR gRNA sequence
gagtttcagagctgcaatga

SEQ ID NO: 170711 - DNA, 20 bp, Artificial
  CRISPR gRNA sequence
agtttcagagctgcaatgaa

SEQ ID NO: 170712 - DNA, 20 bp, Artificial
  CRISPR gRNA sequence
cagagctgcaatgaagagga

SEQ ID NO: 170713 - DNA, 20 bp, Artificial
  CRISPR gRNA sequence
agagctgcaatgaagaggaa

SEQ ID NO: 170714 - DNA, 20 bp, Artificial
  CRISPR gRNA sequence
caatgaagaggaaggtgcaa

SEQ ID NO: 170715 - DNA, 20 bp, Artificial
  CRISPR gRNA sequence
gctaaaatcagcaaaatctc

SEQ ID NO: 170716 - DNA, 20 bp, Artificial
  CRISPR gRNA sequence
aaatcagcaaaatctctact

SEQ ID NO: 170717 - DNA, 20 bp, Artificial
  CRISPR gRNA sequence
tactgggactaggtgtcaaa

SEQ ID NO: 170718 - DNA, 20 bp, Artificial
  CRISPR gRNA sequence
ctgggactaggtgtcaaatg

SEQ ID NO: 170719 - DNA, 20 bp, Artificial
  CRISPR gRNA sequence
ggactaggtgtcaaatgatt

SEQ ID NO: 170720 - DNA, 20 bp, Artificial
  CRISPR gRNA sequence
ggtgtcaaatgattgattct

SEQ ID NO: 170721 - DNA, 20 bp, Artificial
  CRISPR gRNA sequence
attctataagtggtctgaaa

SEQ ID NO: 170722 - DNA, 20 bp, Artificial
  CRISPR gRNA sequence
tataagtggtctgaaatgtg

SEQ ID NO: 170723 - DNA, 20 bp, Artificial
  CRISPR gRNA sequence
taagtggtctgaaatgtgac

SEQ ID NO: 170724 - DNA, 20 bp, Artificial
  CRISPR gRNA sequence
aaatgtgactcactaaacct

SEQ ID NO: 170725 - DNA, 20 bp, Artificial
  CRISPR gRNA sequence
actaaacctaatatgctcac

SEQ ID NO: 170726 - DNA, 20 bp, Artificial
  CRISPR gRNA sequence
aacctaatatgctcacctgg

SEQ ID NO: 170727 - DNA, 20 bp, Artificial
  CRISPR gRNA sequence
atatgctcacctgggaattt

SEQ ID NO: 170728 - DNA, 20 bp, Artificial
  CRISPR gRNA sequence
acctgggaatttgcatcatc

SEQ ID NO: 170729 - DNA, 20 bp, Artificial
  CRISPR gRNA sequence
ggaatttgcatcatcacatt

SEQ ID NO: 170730 - DNA, 20 bp, Artificial
  CRISPR gRNA sequence
gcatcatcacattatggaag

SEQ ID NO: 170731 - DNA, 20 bp, Artificial
  CRISPR gRNA sequence
catcatcacattatggaagg

SEQ ID NO: 170732 - DNA, 20 bp, Artificial
  CRISPR gRNA sequence
tggaaggagcatatattatt

SEQ ID NO: 170733 - DNA, 20 bp, Artificial
  CRISPR gRNA sequence
tttcagatttgatgtaatta

SEQ ID NO: 170734 - DNA, 20 bp, Artificial
  CRISPR gRNA sequence
cagatttgatgtaattaaca

SEQ ID NO: 170735 - DNA, 20 bp, Artificial
  CRISPR gRNA sequence
agatttgatgtaattaacaa

SEQ ID NO: 170736 - DNA, 20 bp, Artificial
  CRISPR gRNA sequence
gatgtaattaacaagcataa

SEQ ID NO: 170737 - DNA, 20 bp, Artificial
  CRISPR gRNA sequence
atgtaattaacaagcataag

SEQ ID NO: 170738 - DNA, 20 bp, Artificial
  CRISPR gRNA sequence
acaagcataagtgaactttc

SEQ ID NO: 170739 - DNA, 20 bp, Artificial
  CRISPR gRNA sequence
tcttttgcaagaccaacaga

SEQ ID NO: 170740 - DNA, 20 bp, Artificial
  CRISPR gRNA sequence
cttttgcaagaccaacagaa

SEQ ID NO: 170741 - DNA, 20 bp, Artificial
  CRISPR gRNA sequence
ttttgcaagaccaacagaaa

SEQ ID NO: 170742 - DNA, 20 bp, Artificial
  CRISPR gRNA sequence
ttgcaagaccaacagaaaat

SEQ ID NO: 170743 - DNA, 20 bp, Artificial
  CRISPR gRNA sequence
tgcaagaccaacagaaaatc

SEQ ID NO: 170744 - DNA, 20 bp, Artificial
  CRISPR gRNA sequence
gcaagaccaacagaaaatct

SEQ ID NO: 170745 - DNA, 20 bp, Artificial
  CRISPR gRNA sequence
caagaccaacagaaaatctc

SEQ ID NO: 170746 - DNA, 20 bp, Artificial
  CRISPR gRNA sequence
aaatatatgtcaaaaaaagg

SEQ ID NO: 170747 - DNA, 20 bp, Artificial
  CRISPR gRNA sequence
tggaaaaacatcaacagtct

SEQ ID NO: 170748 - DNA, 20 bp, Artificial
  CRISPR gRNA sequence
ggaaaaacatcaacagtctt

SEQ ID NO: 170749 - DNA, 20 bp, Artificial
  CRISPR gRNA sequence
gaaaaacatcaacagtcttc

SEQ ID NO: 170750 - DNA, 20 bp, Artificial
  CRISPR gRNA sequence
cccagaacctattttatgat

SEQ ID NO: 170751 - DNA, 20 bp, Artificial
  CRISPR gRNA sequence
ccagaacctattttatgatt

SEQ ID NO: 170752 - DNA, 20 bp, Artificial
  CRISPR gRNA sequence
ttttatgattatagaaagaa

SEQ ID NO: 170753 - DNA, 20 bp, Artificial
  CRISPR gRNA sequence
tatgattatagaaagaagag

SEQ ID NO: 170754 - DNA, 20 bp, Artificial
  CRISPR gRNA sequence
atgattatagaaagaagaga

SEQ ID NO: 170755 - DNA, 20 bp, Artificial
  CRISPR gRNA sequence
tgattatagaaagaagagaa

SEQ ID NO: 170756 - DNA, 20 bp, Artificial
  CRISPR gRNA sequence
tagaaagaagagaatctatt

SEQ ID NO: 170757 - DNA, 20 bp, Artificial
  CRISPR gRNA sequence
ttaggataaaatgtacacca

SEQ ID NO: 170758 - DNA, 20 bp, Artificial
  CRISPR gRNA sequence
ggataaaatgtacaccaaga

SEQ ID NO: 170759 - DNA, 20 bp, Artificial
  CRISPR gRNA sequence
atttttccatgcaaacccaa

SEQ ID NO: 170760 - DNA, 20 bp, Artificial
  CRISPR gRNA sequence
ttccatgcaaacccaacaag

SEQ ID NO: 170761 - DNA, 20 bp, Artificial
  CRISPR gRNA sequence
tccatgcaaacccaacaagc

SEQ ID NO: 170762 - DNA, 20 bp, Artificial
  CRISPR gRNA sequence
ccatgcaaacccaacaagct

SEQ ID NO: 170763 - DNA, 20 bp, Artificial
  CRISPR gRNA sequence
catgcaaacccaacaagctg

SEQ ID NO: 170764 - DNA, 20 bp, Artificial
  CRISPR gRNA sequence
cttggctaccactctgctct

SEQ ID NO: 170765 - DNA, 20 bp, Artificial
  CRISPR gRNA sequence
ggctaccactctgctctaca

SEQ ID NO: 170766 - DNA, 20 bp, Artificial
  CRISPR gRNA sequence
gctaccactctgctctacaa

SEQ ID NO: 170767 - DNA, 20 bp, Artificial
  CRISPR gRNA sequence
ccactctgctctacaaactt

SEQ ID NO: 170768 - DNA, 20 bp, Artificial
  CRISPR gRNA sequence
tgctctacaaacttcaaaca

SEQ ID NO: 170769 - DNA, 20 bp, Artificial
  CRISPR gRNA sequence
ctctacaaacttcaaacacc

SEQ ID NO: 170770 - DNA, 20 bp, Artificial
  CRISPR gRNA sequence
tacaaacttcaaacaccaat

SEQ ID NO: 170771 - DNA, 20 bp, Artificial
  CRISPR gRNA sequence
caaacttcaaacaccaattt

SEQ ID NO: 170772 - DNA, 20 bp, Artificial
  CRISPR gRNA sequence
caaacaccaatttttcatct

SEQ ID NO: 170773 - DNA, 20 bp, Artificial
  CRISPR gRNA sequence
aaacaccaatttttcatctt

SEQ ID NO: 170774 - DNA, 20 bp, Artificial
  CRISPR gRNA sequence
ttcatcttttccttttccaa

SEQ ID NO: 170775 - DNA, 20 bp, Artificial
  CRISPR gRNA sequence
tcatcttttccttttccaaa

SEQ ID NO: 170776 - DNA, 20 bp, Artificial
  CRISPR gRNA sequence
catcttttccttttccaaat

SEQ ID NO: 170777 - DNA, 20 bp, Artificial
  CRISPR gRNA sequence
atcttttccttttccaaatt

SEQ ID NO: 170778 - DNA, 20 bp, Artificial
  CRISPR gRNA sequence
ttccttttccaaattaggta

SEQ ID NO: 170779 - DNA, 20 bp, Artificial
  CRISPR gRNA sequence
tccttttccaaattaggtat

SEQ ID NO: 170780 - DNA, 20 bp, Artificial
  CRISPR gRNA sequence
ccttttccaaattaggtatc

SEQ ID NO: 170781 - DNA, 20 bp, Artificial
  CRISPR gRNA sequence
cttttccaaattaggtatca

SEQ ID NO: 170782 - DNA, 20 bp, Artificial
  CRISPR gRNA sequence
ttccaaattaggtatcaaca

SEQ ID NO: 170783 - DNA, 20 bp, Artificial
  CRISPR gRNA sequence
tccaaattaggtatcaacat

SEQ ID NO: 170784 - DNA, 20 bp, Artificial
  CRISPR gRNA sequence
ccaaattaggtatcaacatt

SEQ ID NO: 170785 - DNA, 20 bp, Artificial
  CRISPR gRNA sequence
caaattaggtatcaacattt

SEQ ID NO: 170786 - DNA, 20 bp, Artificial
  CRISPR gRNA sequence
ggtatcaacattttccatga

SEQ ID NO: 170787 - DNA, 20 bp, Artificial
  CRISPR gRNA sequence
tccatgaaccctctactaaa

SEQ ID NO: 170788 - DNA, 20 bp, Artificial
  CRISPR gRNA sequence
ccatgaaccctctactaaaa

SEQ ID NO: 170789 - DNA, 20 bp, Artificial
  CRISPR gRNA sequence
catgaaccctctactaaaac

SEQ ID NO: 170790 - DNA, 20 bp, Artificial
  CRISPR gRNA sequence
tactaaaactaaccctggag

SEQ ID NO: 170791 - DNA, 20 bp, Artificial
  CRISPR gRNA sequence
ctaaaactaaccctggagta

SEQ ID NO: 170792 - DNA, 20 bp, Artificial
  CRISPR gRNA sequence
aaactaaccctggagtaaca

SEQ ID NO: 170793 - DNA, 20 bp, Artificial
  CRISPR gRNA sequence
accctggagtaacagagact

SEQ ID NO: 170794 - DNA, 20 bp, Artificial
  CRISPR gRNA sequence
gagtaacagagacttagaag

SEQ ID NO: 170795 - DNA, 20 bp, Artificial
  CRISPR gRNA sequence
agaagttcagtttattaaaa

SEQ ID NO: 170796 - DNA, 20 bp, Artificial
  CRISPR gRNA sequence
gaagttcagtttattaaaat

SEQ ID NO: 170797 - DNA, 20 bp, Artificial
  CRISPR gRNA sequence
agtttattaaaatttcaaca

SEQ ID NO: 170798 - DNA, 20 bp, Artificial
  CRISPR gRNA sequence
attaaaatttcaacaaaagg

SEQ ID NO: 170799 - DNA, 20 bp, Artificial
  CRISPR gRNA sequence
ttaaaatttcaacaaaagga

SEQ ID NO: 170800 - DNA, 20 bp, Artificial
  CRISPR gRNA sequence
aaatttcaacaaaaggaaac

SEQ ID NO: 170801 - DNA, 20 bp, Artificial
  CRISPR gRNA sequence
caacaaaaggaaacagtagc

SEQ ID NO: 170802 - DNA, 20 bp, Artificial
  CRISPR gRNA sequence
aacaaaaggaaacagtagcg

SEQ ID NO: 170803 - DNA, 20 bp, Artificial
  CRISPR gRNA sequence
attctattcttgtttttccc

SEQ ID NO: 170804 - DNA, 20 bp, Artificial
  CRISPR gRNA sequence
tattcttgtttttccccttg

SEQ ID NO: 170805 - DNA, 20 bp, Artificial
  CRISPR gRNA sequence
ttcttgtttttccccttgct

SEQ ID NO: 170806 - DNA, 20 bp, Artificial
  CRISPR gRNA sequence
ttgtttttccccttgctctt

SEQ ID NO: 170807 - DNA, 20 bp, Artificial
  CRISPR gRNA sequence
gtttttccccttgctctttc

SEQ ID NO: 170808 - DNA, 20 bp, Artificial
  CRISPR gRNA sequence
tttttccccttgctctttca

SEQ ID NO: 170809 - DNA, 20 bp, Artificial
  CRISPR gRNA sequence
ttccccttgctctttcattt

SEQ ID NO: 170810 - DNA, 20 bp, Artificial
  CRISPR gRNA sequence
tccccttgctctttcattta

SEQ ID NO: 170811 - DNA, 20 bp, Artificial
  CRISPR gRNA sequence
ccccttgctctttcatttac

SEQ ID NO: 170812 - DNA, 20 bp, Artificial
  CRISPR gRNA sequence
cccttgctctttcatttact

SEQ ID NO: 170813 - DNA, 20 bp, Artificial
  CRISPR gRNA sequence
gctctttcatttactgattc

SEQ ID NO: 170814 - DNA, 20 bp, Artificial
  CRISPR gRNA sequence
ctctttcatttactgattca

SEQ ID NO: 170815 - DNA, 20 bp, Artificial
  CRISPR gRNA sequence
tttcatttactgattcaagc

SEQ ID NO: 170816 - DNA, 20 bp, Artificial
  CRISPR gRNA sequence
tcatttactgattcaagcaa

SEQ ID NO: 170817 - DNA, 20 bp, Artificial
  CRISPR gRNA sequence
catttactgattcaagcaac

SEQ ID NO: 170818 - DNA, 20 bp, Artificial
  CRISPR gRNA sequence
atttactgattcaagcaact

SEQ ID NO: 170819 - DNA, 20 bp, Artificial
  CRISPR gRNA sequence
actgattcaagcaactcaac

SEQ ID NO: 170820 - DNA, 20 bp, Artificial
  CRISPR gRNA sequence
ctgattcaagcaactcaact

SEQ ID NO: 170821 - DNA, 20 bp, Artificial
  CRISPR gRNA sequence
attcaagcaactcaactaat

SEQ ID NO: 170822 - DNA, 20 bp, Artificial
  CRISPR gRNA sequence
aagcaactcaactaatagta

SEQ ID NO: 170823 - DNA, 20 bp, Artificial
  CRISPR gRNA sequence
aactaatagtaaatgtatga

SEQ ID NO: 170824 - DNA, 20 bp, Artificial
  CRISPR gRNA sequence
atagtaaatgtatgatacct

SEQ ID NO: 170825 - DNA, 20 bp, Artificial
  CRISPR gRNA sequence
ctactatgcaaaaaatacac

SEQ ID NO: 170826 - DNA, 20 bp, Artificial
  CRISPR gRNA sequence
ctatgcaaaaaatacacatg

SEQ ID NO: 170827 - DNA, 20 bp, Artificial
  CRISPR gRNA sequence
tgcaaaaaatacacatgtag

SEQ ID NO: 170828 - DNA, 20 bp, Artificial
  CRISPR gRNA sequence
atgcctgtaatcccagcact

SEQ ID NO: 170829 - DNA, 20 bp, Artificial
  CRISPR gRNA sequence
taatcccagcactctggaag

SEQ ID NO: 170830 - DNA, 20 bp, Artificial
  CRISPR gRNA sequence
tggaaggctgagatgggaga

SEQ ID NO: 170831 - DNA, 20 bp, Artificial
  CRISPR gRNA sequence
gaaggctgagatgggagaat

SEQ ID NO: 170832 - DNA, 20 bp, Artificial
  CRISPR gRNA sequence
agatgggagaatcgcttgag

SEQ ID NO: 170833 - DNA, 20 bp, Artificial
  CRISPR gRNA sequence
gaggccaggagtttgagacc

SEQ ID NO: 170834 - DNA, 20 bp, Artificial
  CRISPR gRNA sequence
aggccaggagtttgagacca

SEQ ID NO: 170835 - DNA, 20 bp, Artificial
  CRISPR gRNA sequence
gagaccagtctggtcaacat

SEQ ID NO: 170836 - DNA, 20 bp, Artificial
  CRISPR gRNA sequence
agaccagtctggtcaacata

SEQ ID NO: 170837 - DNA, 20 bp, Artificial
  CRISPR gRNA sequence
gtcaacatagtgagacccca

SEQ ID NO: 170838 - DNA, 20 bp, Artificial
  CRISPR gRNA sequence
tttaaaaaagaaagaaaaaa

SEQ ID NO: 170839 - DNA, 20 bp, Artificial
  CRISPR gRNA sequence
aaaaaagaaagaaaaaaaat

SEQ ID NO: 170840 - DNA, 20 bp, Artificial
  CRISPR gRNA sequence
aaaaagaaagaaaaaaaata

SEQ ID NO: 170841 - DNA, 20 bp, Artificial
  CRISPR gRNA sequence
ctcctacctttgaagagctt

SEQ ID NO: 170842 - DNA, 20 bp, Artificial
  CRISPR gRNA sequence
ctacctttgaagagcttgtg

SEQ ID NO: 170843 - DNA, 20 bp, Artificial
  CRISPR gRNA sequence
cctttgaagagcttgtggtt

SEQ ID NO: 170844 - DNA, 20 bp, Artificial
  CRISPR gRNA sequence
tgaagagcttgtggtttgtc

SEQ ID NO: 170845 - DNA, 20 bp, Artificial
  CRISPR gRNA sequence
gaagagcttgtggtttgtca

SEQ ID NO: 170846 - DNA, 20 bp, Artificial
  CRISPR gRNA sequence
aagagcttgtggtttgtcag

SEQ ID NO: 170847 - DNA, 20 bp, Artificial
  CRISPR gRNA sequence
gtggtttgtcagagatagtc

SEQ ID NO: 170848 - DNA, 20 bp, Artificial
  CRISPR gRNA sequence
tggtttgtcagagatagtca

SEQ ID NO: 170849 - DNA, 20 bp, Artificial
  CRISPR gRNA sequence
gtcagagatagtcacataaa

SEQ ID NO: 170850 - DNA, 20 bp, Artificial
  CRISPR gRNA sequence
tcagagatagtcacataaaa

SEQ ID NO: 170851 - DNA, 20 bp, Artificial
  CRISPR gRNA sequence
taatcccctacccaatactg

SEQ ID NO: 170852 - DNA, 20 bp, Artificial
  CRISPR gRNA sequence
cccaatactggaggggaggg

SEQ ID NO: 170853 - DNA, 20 bp, Artificial
  CRISPR gRNA sequence
gaggggagggatcccctgcg

SEQ ID NO: 170854 - DNA, 20 bp, Artificial
  CRISPR gRNA sequence
cggggacacaaagaaggaca

SEQ ID NO: 170855 - DNA, 20 bp, Artificial
  CRISPR gRNA sequence
ctagggacagctagcaatgt

SEQ ID NO: 170856 - DNA, 20 bp, Artificial
  CRISPR gRNA sequence
gggacagctagcaatgtggg

SEQ ID NO: 170857 - DNA, 20 bp, Artificial
  CRISPR gRNA sequence
gcaatgtggggctggaggga

SEQ ID NO: 170858 - DNA, 20 bp, Artificial
  CRISPR gRNA sequence
gagggagagtgagggattgg

SEQ ID NO: 170859 - DNA, 20 bp, Artificial
  CRISPR gRNA sequence
ggaaatgttccacaaagggg

SEQ ID NO: 170860 - DNA, 20 bp, Artificial
  CRISPR gRNA sequence
cacaaaggggatgacatctg

SEQ ID NO: 170861 - DNA, 20 bp, Artificial
  CRISPR gRNA sequence
aattgtgtctaagggatgct

SEQ ID NO: 170862 - DNA, 20 bp, Artificial
  CRISPR gRNA sequence
tgtctaagggatgctgggaa

SEQ ID NO: 170863 - DNA, 20 bp, Artificial
  CRISPR gRNA sequence
agggatgctgggaatttgcc

SEQ ID NO: 170864 - DNA, 20 bp, Artificial
  CRISPR gRNA sequence
ggaatttgcctgttgaaaaa

SEQ ID NO: 170865 - DNA, 20 bp, Artificial
  CRISPR gRNA sequence
gcctgttgaaaaagtatgag

SEQ ID NO: 170866 - DNA, 20 bp, Artificial
  CRISPR gRNA sequence
cctgttgaaaaagtatgaga

SEQ ID NO: 170867 - DNA, 20 bp, Artificial
  CRISPR gRNA sequence
ttgaaaaagtatgagaatgt

SEQ ID NO: 170868 - DNA, 20 bp, Artificial
  CRISPR gRNA sequence
aaaaagtatgagaatgttat

SEQ ID NO: 170869 - DNA, 20 bp, Artificial
  CRISPR gRNA sequence
ttcagacagaacaacaaaga

SEQ ID NO: 170870 - DNA, 20 bp, Artificial
  CRISPR gRNA sequence
agacagaacaacaaagacag

SEQ ID NO: 170871 - DNA, 20 bp, Artificial
  CRISPR gRNA sequence
tttaagttttagatctacta

SEQ ID NO: 170872 - DNA, 20 bp, Artificial
  CRISPR gRNA sequence
aagttttagatctactacct

SEQ ID NO: 170873 - DNA, 20 bp, Artificial
  CRISPR gRNA sequence
agttttagatctactacctg

SEQ ID NO: 170874 - DNA, 20 bp, Artificial
  CRISPR gRNA sequence
tagatctactacctgagtat

SEQ ID NO: 170875 - DNA, 20 bp, Artificial
  CRISPR gRNA sequence
agatctactacctgagtata

SEQ ID NO: 170876 - DNA, 20 bp, Artificial
  CRISPR gRNA sequence
gatctactacctgagtatag

SEQ ID NO: 170877 - DNA, 20 bp, Artificial
  CRISPR gRNA sequence
ctacctgagtatagagggga

SEQ ID NO: 170878 - DNA, 20 bp, Artificial
  CRISPR gRNA sequence
cctgagtatagaggggaaaa

SEQ ID NO: 170879 - DNA, 20 bp, Artificial
  CRISPR gRNA sequence
agtatagaggggaaaagcag

SEQ ID NO: 170880 - DNA, 20 bp, Artificial
  CRISPR gRNA sequence
ggttggggccagatcctaaa

SEQ ID NO: 170881 - DNA, 20 bp, Artificial
  CRISPR gRNA sequence
gggccagatcctaaagagtt

SEQ ID NO: 170882 - DNA, 20 bp, Artificial
  CRISPR gRNA sequence
aagagtttttttaaaagttt

SEQ ID NO: 170883 - DNA, 20 bp, Artificial
  CRISPR gRNA sequence
ttttaaaagtttaatcccag

SEQ ID NO: 170884 - DNA, 20 bp, Artificial
  CRISPR gRNA sequence
tttaaaagtttaatcccaga

SEQ ID NO: 170885 - DNA, 20 bp, Artificial
  CRISPR gRNA sequence
ttaaaagtttaatcccagaa

SEQ ID NO: 170886 - DNA, 20 bp, Artificial
  CRISPR gRNA sequence
taaaagtttaatcccagaaa

SEQ ID NO: 170887 - DNA, 20 bp, Artificial
  CRISPR gRNA sequence
aaaagtttaatcccagaaat

SEQ ID NO: 170888 - DNA, 20 bp, Artificial
  CRISPR gRNA sequence
aaagtttaatcccagaaatc

SEQ ID NO: 170889 - DNA, 20 bp, Artificial
  CRISPR gRNA sequence
aatcccagaaatcaaccact

SEQ ID NO: 170890 - DNA, 20 bp, Artificial
  CRISPR gRNA sequence
atcccagaaatcaaccactg

SEQ ID NO: 170891 - DNA, 20 bp, Artificial
  CRISPR gRNA sequence
gtcttccttcttgtgtggca

SEQ ID NO: 170892 - DNA, 20 bp, Artificial
  CRISPR gRNA sequence
ccttcttgtgtggcatatca

SEQ ID NO: 170893 - DNA, 20 bp, Artificial
  CRISPR gRNA sequence
cttcttgtgtggcatatcac

SEQ ID NO: 170894 - DNA, 20 bp, Artificial
  CRISPR gRNA sequence
cttgtgtggcatatcacaga

SEQ ID NO: 170895 - DNA, 20 bp, Artificial
  CRISPR gRNA sequence
ttgtgtggcatatcacagaa

SEQ ID NO: 170896 - DNA, 20 bp, Artificial
  CRISPR gRNA sequence
gtgtggcatatcacagaaga

SEQ ID NO: 170897 - DNA, 20 bp, Artificial
  CRISPR gRNA sequence
tgtggcatatcacagaagat

SEQ ID NO: 170898 - DNA, 20 bp, Artificial
  CRISPR gRNA sequence
catagaaatgccaaagagaa

SEQ ID NO: 170899 - DNA, 20 bp, Artificial
  CRISPR gRNA sequence
gggatgatcattcctttgga

SEQ ID NO: 170900 - DNA, 20 bp, Artificial
  CRISPR gRNA sequence
ctttggaaaacctcccaggc

SEQ ID NO: 170901 - DNA, 20 bp, Artificial
  CRISPR gRNA sequence
tggaaaacctcccaggctaa

SEQ ID NO: 170902 - DNA, 20 bp, Artificial
  CRISPR gRNA sequence
ggaaaacctcccaggctaat

SEQ ID NO: 170903 - DNA, 20 bp, Artificial
  CRISPR gRNA sequence
gaaaacctcccaggctaata

SEQ ID NO: 170904 - DNA, 20 bp, Artificial
  CRISPR gRNA sequence
ccaggctaatacatacagca

SEQ ID NO: 170905 - DNA, 20 bp, Artificial
  CRISPR gRNA sequence
atacatacagcacaagatga

SEQ ID NO: 170906 - DNA, 20 bp, Artificial
  CRISPR gRNA sequence
agctctcttgcaagtgtgct

SEQ ID NO: 170907 - DNA, 20 bp, Artificial
  CRISPR gRNA sequence
gctctcttgcaagtgtgctc

SEQ ID NO: 170908 - DNA, 20 bp, Artificial
  CRISPR gRNA sequence
tcttgcaagtgtgctcttgt

SEQ ID NO: 170909 - DNA, 20 bp, Artificial
  CRISPR gRNA sequence
ttgcaagtgtgctcttgttt

SEQ ID NO: 170910 - DNA, 20 bp, Artificial
  CRISPR gRNA sequence
gcaagtgtgctcttgtttgg

SEQ ID NO: 170911 - DNA, 20 bp, Artificial
  CRISPR gRNA sequence
caagtgtgctcttgtttggc

SEQ ID NO: 170912 - DNA, 20 bp, Artificial
  CRISPR gRNA sequence
ttgtttggcttggttttaaa

SEQ ID NO: 170913 - DNA, 20 bp, Artificial
  CRISPR gRNA sequence
gtttggcttggttttaaata

SEQ ID NO: 170914 - DNA, 20 bp, Artificial
  CRISPR gRNA sequence
tttggcttggttttaaatat

SEQ ID NO: 170915 - DNA, 20 bp, Artificial
  CRISPR gRNA sequence
ggcttggttttaaatataat

SEQ ID NO: 170916 - DNA, 20 bp, Artificial
  CRISPR gRNA sequence
gcttggttttaaatataatt

SEQ ID NO: 170917 - DNA, 20 bp, Artificial
  CRISPR gRNA sequence
ggttttaaatataatttgta

SEQ ID NO: 170918 - DNA, 20 bp, Artificial
  CRISPR gRNA sequence
gttttaaatataatttgtac

SEQ ID NO: 170919 - DNA, 20 bp, Artificial
  CRISPR gRNA sequence
taaatataatttgtacaaga

SEQ ID NO: 170920 - DNA, 20 bp, Artificial
  CRISPR gRNA sequence
aaatataatttgtacaagaa

SEQ ID NO: 170921 - DNA, 20 bp, Artificial
  CRISPR gRNA sequence
aatataatttgtacaagaac

SEQ ID NO: 170922 - DNA, 20 bp, Artificial
  CRISPR gRNA sequence
gtacaagaacgttccatgat

SEQ ID NO: 170923 - DNA, 20 bp, Artificial
  CRISPR gRNA sequence
tacaagaacgttccatgatt

SEQ ID NO: 170924 - DNA, 20 bp, Artificial
  CRISPR gRNA sequence
catgattacttaactaaagc

SEQ ID NO: 170925 - DNA, 20 bp, Artificial
  CRISPR gRNA sequence
cttaactaaagcccaaagtt

SEQ ID NO: 170926 - DNA, 20 bp, Artificial
  CRISPR gRNA sequence
aactaaagcccaaagttgat

SEQ ID NO: 170927 - DNA, 20 bp, Artificial
  CRISPR gRNA sequence
actaaagcccaaagttgata

SEQ ID NO: 170928 - DNA, 20 bp, Artificial
  CRISPR gRNA sequence
aagcccaaagttgataaaaa

SEQ ID NO: 170929 - DNA, 20 bp, Artificial
  CRISPR gRNA sequence
ataaaaaagacctctttccc

SEQ ID NO: 170930 - DNA, 20 bp, Artificial
  CRISPR gRNA sequence
tttccccaaattgaaagagt

SEQ ID NO: 170931 - DNA, 20 bp, Artificial
  CRISPR gRNA sequence
tccccaaattgaaagagtaa

SEQ ID NO: 170932 - DNA, 20 bp, Artificial
  CRISPR gRNA sequence
ccccaaattgaaagagtaaa

SEQ ID NO: 170933 - DNA, 20 bp, Artificial
  CRISPR gRNA sequence
cccaaattgaaagagtaaac

SEQ ID NO: 170934 - DNA, 20 bp, Artificial
  CRISPR gRNA sequence
aaagagtaaactattactcc

SEQ ID NO: 170935 - DNA, 20 bp, Artificial
  CRISPR gRNA sequence
ttactccttcaatttctctt

SEQ ID NO: 170936 - DNA, 20 bp, Artificial
  CRISPR gRNA sequence
ctccttcaatttctcttctt

SEQ ID NO: 170937 - DNA, 20 bp, Artificial
  CRISPR gRNA sequence
cttcaatttctcttctttaa

SEQ ID NO: 170938 - DNA, 20 bp, Artificial
  CRISPR gRNA sequence
caatttctcttctttaatca

SEQ ID NO: 170939 - DNA, 20 bp, Artificial
  CRISPR gRNA sequence
aatttctcttctttaatcaa

SEQ ID NO: 170940 - DNA, 20 bp, Artificial
  CRISPR gRNA sequence
ctcttctttaatcaaaagca

SEQ ID NO: 170941 - DNA, 20 bp, Artificial
  CRISPR gRNA sequence
tcttctttaatcaaaagcaa

SEQ ID NO: 170942 - DNA, 20 bp, Artificial
  CRISPR gRNA sequence
ttctttaatcaaaagcaaca

SEQ ID NO: 170943 - DNA, 20 bp, Artificial
  CRISPR gRNA sequence
ctttaatcaaaagcaacaaa

SEQ ID NO: 170944 - DNA, 20 bp, Artificial
  CRISPR gRNA sequence
tttaatcaaaagcaacaaaa

SEQ ID NO: 170945 - DNA, 20 bp, Artificial
  CRISPR gRNA sequence
taatcaaaagcaacaaaagt

SEQ ID NO: 170946 - DNA, 20 bp, Artificial
  CRISPR gRNA sequence
aatcaaaagcaacaaaagtc

SEQ ID NO: 170947 - DNA, 20 bp, Artificial
  CRISPR gRNA sequence
atcaaaagcaacaaaagtca

SEQ ID NO: 170948 - DNA, 20 bp, Artificial
  CRISPR gRNA sequence
ccgccttgcagagatgtaaa

SEQ ID NO: 170949 - DNA, 20 bp, Artificial
  CRISPR gRNA sequence
gcagagatgtaaaatgaggc

SEQ ID NO: 170950 - DNA, 20 bp, Artificial
  CRISPR gRNA sequence
cagagatgtaaaatgaggca

SEQ ID NO: 170951 - DNA, 20 bp, Artificial
  CRISPR gRNA sequence
ataataagctctgctttaat

SEQ ID NO: 170952 - DNA, 20 bp, Artificial
  CRISPR gRNA sequence
taataagctctgctttaatc

SEQ ID NO: 170953 - DNA, 20 bp, Artificial
  CRISPR gRNA sequence
tgctttaatccccttcccaa

SEQ ID NO: 170954 - DNA, 20 bp, Artificial
  CRISPR gRNA sequence
ctttaatccccttcccaaag

SEQ ID NO: 170955 - DNA, 20 bp, Artificial
  CRISPR gRNA sequence
taatccccttcccaaagctt

SEQ ID NO: 170956 - DNA, 20 bp, Artificial
  CRISPR gRNA sequence
aatccccttcccaaagcttt

SEQ ID NO: 170957 - DNA, 20 bp, Artificial
  CRISPR gRNA sequence
atccccttcccaaagctttt

SEQ ID NO: 170958 - DNA, 20 bp, Artificial
  CRISPR gRNA sequence
cccaaagcttttctttgtga

SEQ ID NO: 170959 - DNA, 20 bp, Artificial
  CRISPR gRNA sequence
ccaaagcttttctttgtgac

SEQ ID NO: 170960 - DNA, 20 bp, Artificial
  CRISPR gRNA sequence
ttctttgtgacaaactattt

SEQ ID NO: 170961 - DNA, 20 bp, Artificial
  CRISPR gRNA sequence
tctttgtgacaaactatttt

SEQ ID NO: 170962 - DNA, 20 bp, Artificial
  CRISPR gRNA sequence
ctttgtgacaaactattttt

SEQ ID NO: 170963 - DNA, 20 bp, Artificial
  CRISPR gRNA sequence
tttgtgacaaactatttttt

SEQ ID NO: 170964 - DNA, 20 bp, Artificial
  CRISPR gRNA sequence
tgtgacaaactattttttca

SEQ ID NO: 170965 - DNA, 20 bp, Artificial
  CRISPR gRNA sequence
gtgacaaactattttttcat

SEQ ID NO: 170966 - DNA, 20 bp, Artificial
  CRISPR gRNA sequence
tgacaaactattttttcatg

SEQ ID NO: 170967 - DNA, 20 bp, Artificial
  CRISPR gRNA sequence
ttttttcatgttcctgaaac

SEQ ID NO: 170968 - DNA, 20 bp, Artificial
  CRISPR gRNA sequence
tttcatgttcctgaaacctt

SEQ ID NO: 170969 - DNA, 20 bp, Artificial
  CRISPR gRNA sequence
ttcatgttcctgaaaccttg

SEQ ID NO: 170970 - DNA, 20 bp, Artificial
  CRISPR gRNA sequence
tcatgttcctgaaaccttga

SEQ ID NO: 170971 - DNA, 20 bp, Artificial
  CRISPR gRNA sequence
catgttcctgaaaccttgag

SEQ ID NO: 170972 - DNA, 20 bp, Artificial
  CRISPR gRNA sequence
atgttcctgaaaccttgaga

SEQ ID NO: 170973 - DNA, 20 bp, Artificial
  CRISPR gRNA sequence
ctgaaaccttgagatctcaa

SEQ ID NO: 170974 - DNA, 20 bp, Artificial
  CRISPR gRNA sequence
aaaccttgagatctcaagaa

SEQ ID NO: 170975 - DNA, 20 bp, Artificial
  CRISPR gRNA sequence
gagatctcaagaagcagtgt

SEQ ID NO: 170976 - DNA, 20 bp, Artificial
  CRISPR gRNA sequence
agatctcaagaagcagtgtg

SEQ ID NO: 170977 - DNA, 20 bp, Artificial
  CRISPR gRNA sequence
aagaagcagtgtgtaaaagt

SEQ ID NO: 170978 - DNA, 20 bp, Artificial
  CRISPR gRNA sequence
gaggggtgtgtatggttcat

SEQ ID NO: 170979 - DNA, 20 bp, Artificial
  CRISPR gRNA sequence
aggggtgtgtatggttcatc

SEQ ID NO: 170980 - DNA, 20 bp, Artificial
  CRISPR gRNA sequence
atccctgttgacaatcaccc

SEQ ID NO: 170981 - DNA, 20 bp, Artificial
  CRISPR gRNA sequence
ttgacaatcacccagttttc

SEQ ID NO: 170982 - DNA, 20 bp, Artificial
  CRISPR gRNA sequence
acaatcacccagttttctat

SEQ ID NO: 170983 - DNA, 20 bp, Artificial
  CRISPR gRNA sequence
tctataatcctatcctagcc

SEQ ID NO: 170984 - DNA, 20 bp, Artificial
  CRISPR gRNA sequence
ctataatcctatcctagcct

SEQ ID NO: 170985 - DNA, 20 bp, Artificial
  CRISPR gRNA sequence
tataatcctatcctagcctt

SEQ ID NO: 170986 - DNA, 20 bp, Artificial
  CRISPR gRNA sequence
taatcctatcctagccttct

SEQ ID NO: 170987 - DNA, 20 bp, Artificial
  CRISPR gRNA sequence
tcctagccttctagttacat

SEQ ID NO: 170988 - DNA, 20 bp, Artificial
  CRISPR gRNA sequence
gccttctagttacatgtaag

SEQ ID NO: 170989 - DNA, 20 bp, Artificial
  CRISPR gRNA sequence
ctagttacatgtaaggattt

SEQ ID NO: 170990 - DNA, 20 bp, Artificial
  CRISPR gRNA sequence
tagttacatgtaaggattta

SEQ ID NO: 170991 - DNA, 20 bp, Artificial
  CRISPR gRNA sequence
gttacatgtaaggatttacc

SEQ ID NO: 170992 - DNA, 20 bp, Artificial
  CRISPR gRNA sequence
catgtaaggatttaccataa

SEQ ID NO: 170993 - DNA, 20 bp, Artificial
  CRISPR gRNA sequence
accataagcttgttggaaaa

SEQ ID NO: 170994 - DNA, 20 bp, Artificial
  CRISPR gRNA sequence
ccataagcttgttggaaaag

SEQ ID NO: 170995 - DNA, 20 bp, Artificial
  CRISPR gRNA sequence
gttggaaaagggaggccctc

SEQ ID NO: 170996 - DNA, 20 bp, Artificial
  CRISPR gRNA sequence
ttggaaaagggaggccctct

SEQ ID NO: 170997 - DNA, 20 bp, Artificial
  CRISPR gRNA sequence
gaaaagggaggccctctaca

SEQ ID NO: 170998 - DNA, 20 bp, Artificial
  CRISPR gRNA sequence
tacaatcagtagattgaggc

SEQ ID NO: 170999 - DNA, 20 bp, Artificial
  CRISPR gRNA sequence
caatcagtagattgaggccc

SEQ ID NO: 171000 - DNA, 20 bp, Artificial
  CRISPR gRNA sequence
aggcccacgaaacttggatt

SEQ ID NO: 171001 - DNA, 20 bp, Artificial
  CRISPR gRNA sequence
ggattcatgctccccacttc

SEQ ID NO: 171002 - DNA, 20 bp, Artificial
  CRISPR gRNA sequence
gattcatgctccccacttca

SEQ ID NO: 171003 - DNA, 20 bp, Artificial
  CRISPR gRNA sequence
atgctccccacttcactagc

SEQ ID NO: 171004 - DNA, 20 bp, Artificial
  CRISPR gRNA sequence
cccacttcactagctaccat

SEQ ID NO: 171005 - DNA, 20 bp, Artificial
  CRISPR gRNA sequence
cactagctaccatgtaactg

SEQ ID NO: 171006 - DNA, 20 bp, Artificial
  CRISPR gRNA sequence
actagctaccatgtaactga

SEQ ID NO: 171007 - DNA, 20 bp, Artificial
  CRISPR gRNA sequence
gctaccatgtaactgaagtg

SEQ ID NO: 171008 - DNA, 20 bp, Artificial
  CRISPR gRNA sequence
ccatgtaactgaagtgagta

SEQ ID NO: 171009 - DNA, 20 bp, Artificial
  CRISPR gRNA sequence
aagtgagtaacatttaactc

SEQ ID NO: 171010 - DNA, 20 bp, Artificial
  CRISPR gRNA sequence
aactccttaactccttctcc

SEQ ID NO: 171011 - DNA, 20 bp, Artificial
  CRISPR gRNA sequence
actccttaactccttctcct

SEQ ID NO: 171012 - DNA, 20 bp, Artificial
  CRISPR gRNA sequence
cttaactccttctcctgata

SEQ ID NO: 171013 - DNA, 20 bp, Artificial
  CRISPR gRNA sequence
aactccttctcctgatactg

SEQ ID NO: 171014 - DNA, 20 bp, Artificial
  CRISPR gRNA sequence
actccttctcctgatactga

SEQ ID NO: 171015 - DNA, 20 bp, Artificial
  CRISPR gRNA sequence
cttctcctgatactgattca

SEQ ID NO: 171016 - DNA, 20 bp, Artificial
  CRISPR gRNA sequence
ctcctgatactgattcaact

SEQ ID NO: 171017 - DNA, 20 bp, Artificial
  CRISPR gRNA sequence
tcctgatactgattcaactg

SEQ ID NO: 171018 - DNA, 20 bp, Artificial
  CRISPR gRNA sequence
ctgatactgattcaactgga

SEQ ID NO: 171019 - DNA, 20 bp, Artificial
  CRISPR gRNA sequence
atactgattcaactggaaga

SEQ ID NO: 171020 - DNA, 20 bp, Artificial
  CRISPR gRNA sequence
attcaactggaagaacagct

SEQ ID NO: 171021 - DNA, 20 bp, Artificial
  CRISPR gRNA sequence
aactggaagaacagctgaca

SEQ ID NO: 171022 - DNA, 20 bp, Artificial
  CRISPR gRNA sequence
gaagaacagctgacacacac

SEQ ID NO: 171023 - DNA, 20 bp, Artificial
  CRISPR gRNA sequence
acacacactgctccccccta

SEQ ID NO: 171024 - DNA, 20 bp, Artificial
  CRISPR gRNA sequence
ctcccccctacttttgggag

SEQ ID NO: 171025 - DNA, 20 bp, Artificial
  CRISPR gRNA sequence
ccccctacttttgggagttc

SEQ ID NO: 171026 - DNA, 20 bp, Artificial
  CRISPR gRNA sequence
cttttgggagttctatcagt

SEQ ID NO: 171027 - DNA, 20 bp, Artificial
  CRISPR gRNA sequence
ttgggagttctatcagtaag

SEQ ID NO: 171028 - DNA, 20 bp, Artificial
  CRISPR gRNA sequence
tgggagttctatcagtaagg

SEQ ID NO: 171029 - DNA, 20 bp, Artificial
  CRISPR gRNA sequence
gggagttctatcagtaaggc

SEQ ID NO: 171030 - DNA, 20 bp, Artificial
  CRISPR gRNA sequence
ggagttctatcagtaaggca

SEQ ID NO: 171031 - DNA, 20 bp, Artificial
  CRISPR gRNA sequence
tatcagtaaggcagaagagc

SEQ ID NO: 171032 - DNA, 20 bp, Artificial
  CRISPR gRNA sequence
tcagtaaggcagaagagcag

SEQ ID NO: 171033 - DNA, 20 bp, Artificial
  CRISPR gRNA sequence
tctctcagaacattctcatg

SEQ ID NO: 171034 - DNA, 20 bp, Artificial
  CRISPR gRNA sequence
tcagaacattctcatgctcc

SEQ ID NO: 171035 - DNA, 20 bp, Artificial
  CRISPR gRNA sequence
agaacattctcatgctcctg

SEQ ID NO: 171036 - DNA, 20 bp, Artificial
  CRISPR gRNA sequence
tcatgctcctgaccactacc

SEQ ID NO: 171037 - DNA, 20 bp, Artificial
  CRISPR gRNA sequence
atgctcctgaccactaccaa

SEQ ID NO: 171038 - DNA, 20 bp, Artificial
  CRISPR gRNA sequence
ctgaccactaccaaagaact

SEQ ID NO: 171039 - DNA, 20 bp, Artificial
  CRISPR gRNA sequence
accactaccaaagaactacg

SEQ ID NO: 171040 - DNA, 20 bp, Artificial
  CRISPR gRNA sequence
ccaaagaactacgttaaaaa

SEQ ID NO: 171041 - DNA, 20 bp, Artificial
  CRISPR gRNA sequence
cgttaaaaatgcttccatct

SEQ ID NO: 171042 - DNA, 20 bp, Artificial
  CRISPR gRNA sequence
aaaatgcttccatctgaaac

SEQ ID NO: 171043 - DNA, 20 bp, Artificial
  CRISPR gRNA sequence
ccatctgaaactgctgcatt

SEQ ID NO: 171044 - DNA, 20 bp, Artificial
  CRISPR gRNA sequence
catctgaaactgctgcattt

SEQ ID NO: 171045 - DNA, 20 bp, Artificial
  CRISPR gRNA sequence
aaactgctgcatttcaagac

SEQ ID NO: 171046 - DNA, 20 bp, Artificial
  CRISPR gRNA sequence
ctgcatttcaagacaaattc

SEQ ID NO: 171047 - DNA, 20 bp, Artificial
  CRISPR gRNA sequence
catttcaagacaaattcaaa

SEQ ID NO: 171048 - DNA, 20 bp, Artificial
  CRISPR gRNA sequence
caagacaaattcaaatctga

SEQ ID NO: 171049 - DNA, 20 bp, Artificial
  CRISPR gRNA sequence
aagacaaattcaaatctgaa

SEQ ID NO: 171050 - DNA, 20 bp, Artificial
  CRISPR gRNA sequence
aaatctgaattcactcaatg

SEQ ID NO: 171051 - DNA, 20 bp, Artificial
  CRISPR gRNA sequence
aattcactcaatgagagttt

SEQ ID NO: 171052 - DNA, 20 bp, Artificial
  CRISPR gRNA sequence
actcaatgagagtttggaga

SEQ ID NO: 171053 - DNA, 20 bp, Artificial
  CRISPR gRNA sequence
aatgagagtttggagacaaa

SEQ ID NO: 171054 - DNA, 20 bp, Artificial
  CRISPR gRNA sequence
ggagacaaagaaaagtcaac

SEQ ID NO: 171055 - DNA, 20 bp, Artificial
  CRISPR gRNA sequence
gagacaaagaaaagtcaaca

SEQ ID NO: 171056 - DNA, 20 bp, Artificial
  CRISPR gRNA sequence
gggctgcactgaagaacatc

SEQ ID NO: 171057 - DNA, 20 bp, Artificial
  CRISPR gRNA sequence
ggctgcactgaagaacatcc

SEQ ID NO: 171058 - DNA, 20 bp, Artificial
  CRISPR gRNA sequence
cactgaagaacatccagagt

SEQ ID NO: 171059 - DNA, 20 bp, Artificial
  CRISPR gRNA sequence
aagaacatccagagtttcaa

SEQ ID NO: 171060 - DNA, 20 bp, Artificial
  CRISPR gRNA sequence
caaataataaagagaaacct

SEQ ID NO: 171061 - DNA, 20 bp, Artificial
  CRISPR gRNA sequence
aaataataaagagaaacctt

SEQ ID NO: 171062 - DNA, 20 bp, Artificial
  CRISPR gRNA sequence
ttccaggcctacccagtcag

SEQ ID NO: 171063 - DNA, 20 bp, Artificial
  CRISPR gRNA sequence
tccaggcctacccagtcagg

SEQ ID NO: 171064 - DNA, 20 bp, Artificial
  CRISPR gRNA sequence
ccaggcctacccagtcaggc

SEQ ID NO: 171065 - DNA, 20 bp, Artificial
  CRISPR gRNA sequence
caggcctacccagtcaggca

SEQ ID NO: 171066 - DNA, 20 bp, Artificial
  CRISPR gRNA sequence
cccagtcaggcactctggca

SEQ ID NO: 171067 - DNA, 20 bp, Artificial
  CRISPR gRNA sequence
tggcaagtcaagattctcaa

SEQ ID NO: 171068 - DNA, 20 bp, Artificial
  CRISPR gRNA sequence
gcaagtcaagattctcaacc

SEQ ID NO: 171069 - DNA, 20 bp, Artificial
  CRISPR gRNA sequence
tcaaccctttgaaatcaatg

SEQ ID NO: 171070 - DNA, 20 bp, Artificial
  CRISPR gRNA sequence
aaccctttgaaatcaatgat

SEQ ID NO: 171071 - DNA, 20 bp, Artificial
  CRISPR gRNA sequence
tgaaatcaatgattctcaat

SEQ ID NO: 171072 - DNA, 20 bp, Artificial
  CRISPR gRNA sequence
gaaatcaatgattctcaatc

SEQ ID NO: 171073 - DNA, 20 bp, Artificial
  CRISPR gRNA sequence
aaatcaatgattctcaatct

SEQ ID NO: 171074 - DNA, 20 bp, Artificial
  CRISPR gRNA sequence
tcaatcttggggctgcaggt

SEQ ID NO: 171075 - DNA, 20 bp, Artificial
  CRISPR gRNA sequence
aatcttggggctgcaggtta

SEQ ID NO: 171076 - DNA, 20 bp, Artificial
  CRISPR gRNA sequence
ggggctgcaggttagaatca

SEQ ID NO: 171077 - DNA, 20 bp, Artificial
  CRISPR gRNA sequence
gggctgcaggttagaatcac

SEQ ID NO: 171078 - DNA, 20 bp, Artificial
  CRISPR gRNA sequence
caggttagaatcacctgaaa

SEQ ID NO: 171079 - DNA, 20 bp, Artificial
  CRISPR gRNA sequence
gaatcacctgaaaagctttt

SEQ ID NO: 171080 - DNA, 20 bp, Artificial
  CRISPR gRNA sequence
aaaagcttttgaaaaacaag

SEQ ID NO: 171081 - DNA, 20 bp, Artificial
  CRISPR gRNA sequence
ttgaaaaacaagatgcctga

SEQ ID NO: 171082 - DNA, 20 bp, Artificial
  CRISPR gRNA sequence
tgaaaaacaagatgcctgag

SEQ ID NO: 171083 - DNA, 20 bp, Artificial
  CRISPR gRNA sequence
gaaaaacaagatgcctgagc

SEQ ID NO: 171084 - DNA, 20 bp, Artificial
  CRISPR gRNA sequence
aaaaacaagatgcctgagct

SEQ ID NO: 171085 - DNA, 20 bp, Artificial
  CRISPR gRNA sequence
agctctctcctggagaccaa

SEQ ID NO: 171086 - DNA, 20 bp, Artificial
  CRISPR gRNA sequence
tctcctggagaccaactgaa

SEQ ID NO: 171087 - DNA, 20 bp, Artificial
  CRISPR gRNA sequence
tcctggagaccaactgaatc

SEQ ID NO: 171088 - DNA, 20 bp, Artificial
  CRISPR gRNA sequence
ctggagaccaactgaatcag

SEQ ID NO: 171089 - DNA, 20 bp, Artificial
  CRISPR gRNA sequence
gagaccaactgaatcaggaa

SEQ ID NO: 171090 - DNA, 20 bp, Artificial
  CRISPR gRNA sequence
aatcaggaactctaggacag

SEQ ID NO: 171091 - DNA, 20 bp, Artificial
  CRISPR gRNA sequence
taggacagtggtccccaacc

SEQ ID NO: 171092 - DNA, 20 bp, Artificial
  CRISPR gRNA sequence
ggacagtggtccccaacctc

SEQ ID NO: 171093 - DNA, 20 bp, Artificial
  CRISPR gRNA sequence
aggaaccagttttgtgcaag

SEQ ID NO: 171094 - DNA, 20 bp, Artificial
  CRISPR gRNA sequence
tgtgcaagacaatttttcca

SEQ ID NO: 171095 - DNA, 20 bp, Artificial
  CRISPR gRNA sequence
gtgcaagacaatttttccag

SEQ ID NO: 171096 - DNA, 20 bp, Artificial
  CRISPR gRNA sequence
tgcaagacaatttttccaga

SEQ ID NO: 171097 - DNA, 20 bp, Artificial
  CRISPR gRNA sequence
ttccagagatgggcagggtg

SEQ ID NO: 171098 - DNA, 20 bp, Artificial
  CRISPR gRNA sequence
tccagagatgggcagggtgg

SEQ ID NO: 171099 - DNA, 20 bp, Artificial
  CRISPR gRNA sequence
ccagagatgggcagggtggg

SEQ ID NO: 171100 - DNA, 20 bp, Artificial
  CRISPR gRNA sequence
cagagatgggcagggtgggc

SEQ ID NO: 171101 - DNA, 20 bp, Artificial
  CRISPR gRNA sequence
gattctcataaggagtgtgc

SEQ ID NO: 171102 - DNA, 20 bp, Artificial
  CRISPR gRNA sequence
tcataaggagtgtgctacct

SEQ ID NO: 171103 - DNA, 20 bp, Artificial
  CRISPR gRNA sequence
ataaggagtgtgctacctag

SEQ ID NO: 171104 - DNA, 20 bp, Artificial
  CRISPR gRNA sequence
cctagatccctcacatgcgc

SEQ ID NO: 171105 - DNA, 20 bp, Artificial
  CRISPR gRNA sequence
gatccctcacatgcgcagtt

SEQ ID NO: 171106 - DNA, 20 bp, Artificial
  CRISPR gRNA sequence
acatgcgcagttcatgatag

SEQ ID NO: 171107 - DNA, 20 bp, Artificial
  CRISPR gRNA sequence
atgatagggttcacattcct

SEQ ID NO: 171108 - DNA, 20 bp, Artificial
  CRISPR gRNA sequence
acattcctttgagaatctaa

SEQ ID NO: 171109 - DNA, 20 bp, Artificial
  CRISPR gRNA sequence
ctttgagaatctaatgccac

SEQ ID NO: 171110 - DNA, 20 bp, Artificial
  CRISPR gRNA sequence
tgagaatctaatgccactgc

SEQ ID NO: 171111 - DNA, 20 bp, Artificial
  CRISPR gRNA sequence
gagaatctaatgccactgct

SEQ ID NO: 171112 - DNA, 20 bp, Artificial
  CRISPR gRNA sequence
agaatctaatgccactgctg

SEQ ID NO: 171113 - DNA, 20 bp, Artificial
  CRISPR gRNA sequence
atgccactgctgatctgaca

SEQ ID NO: 171114 - DNA, 20 bp, Artificial
  CRISPR gRNA sequence
ctgatctgacaggaggtgga

SEQ ID NO: 171115 - DNA, 20 bp, Artificial
  CRISPR gRNA sequence
atctgacaggaggtggagct

SEQ ID NO: 171116 - DNA, 20 bp, Artificial
  CRISPR gRNA sequence
acaggaggtggagctcaggc

SEQ ID NO: 171117 - DNA, 20 bp, Artificial
  CRISPR gRNA sequence
aggcagtaatgcttgcttac

SEQ ID NO: 171118 - DNA, 20 bp, Artificial
  CRISPR gRNA sequence
gcttactggctgctcacctc

SEQ ID NO: 171119 - DNA, 20 bp, Artificial
  CRISPR gRNA sequence
cttactggctgctcacctcc

SEQ ID NO: 171120 - DNA, 20 bp, Artificial
  CRISPR gRNA sequence
actggctgctcacctcctgc

SEQ ID NO: 171121 - DNA, 20 bp, Artificial
  CRISPR gRNA sequence
ctggctgctcacctcctgct

SEQ ID NO: 171122 - DNA, 20 bp, Artificial
  CRISPR gRNA sequence
gctgctcacctcctgctgtg

SEQ ID NO: 171123 - DNA, 20 bp, Artificial
  CRISPR gRNA sequence
ctcacctcctgctgtgcagc

SEQ ID NO: 171124 - DNA, 20 bp, Artificial
  CRISPR gRNA sequence
acctcctgctgtgcagccca

SEQ ID NO: 171125 - DNA, 20 bp, Artificial
  CRISPR gRNA sequence
ctgctgtgcagcccagttcc

SEQ ID NO: 171126 - DNA, 20 bp, Artificial
  CRISPR gRNA sequence
ctgtgcagcccagttcctag

SEQ ID NO: 171127 - DNA, 20 bp, Artificial
  CRISPR gRNA sequence
tgcagcccagttcctaggtt

SEQ ID NO: 171128 - DNA, 20 bp, Artificial
  CRISPR gRNA sequence
ctaggttcctaacaggccat

SEQ ID NO: 171129 - DNA, 20 bp, Artificial
  CRISPR gRNA sequence
ggttcctaacaggccatgga

SEQ ID NO: 171130 - DNA, 20 bp, Artificial
  CRISPR gRNA sequence
ctaacaggccatggacccat

SEQ ID NO: 171131 - DNA, 20 bp, Artificial
  CRISPR gRNA sequence
acaggccatggacccatacc

SEQ ID NO: 171132 - DNA, 20 bp, Artificial
  CRISPR gRNA sequence
tggcccaggggttggggacc

SEQ ID NO: 171133 - DNA, 20 bp, Artificial
  CRISPR gRNA sequence
gggacccctgctctagtggg

SEQ ID NO: 171134 - DNA, 20 bp, Artificial
  CRISPR gRNA sequence
ctctagtgggtagagtactg

SEQ ID NO: 171135 - DNA, 20 bp, Artificial
  CRISPR gRNA sequence
tagtgggtagagtactggca

SEQ ID NO: 171136 - DNA, 20 bp, Artificial
  CRISPR gRNA sequence
gtgggtagagtactggcatc

SEQ ID NO: 171137 - DNA, 20 bp, Artificial
  CRISPR gRNA sequence
gcatcatgttttttgaaaac

SEQ ID NO: 171138 - DNA, 20 bp, Artificial
  CRISPR gRNA sequence
tttgaaaactccccttgtga

SEQ ID NO: 171139 - DNA, 20 bp, Artificial
  CRISPR gRNA sequence
ttgaaaactccccttgtgac

SEQ ID NO: 171140 - DNA, 20 bp, Artificial
  CRISPR gRNA sequence
tgaaaactccccttgtgact

SEQ ID NO: 171141 - DNA, 20 bp, Artificial
  CRISPR gRNA sequence
gaaaactccccttgtgacta

SEQ ID NO: 171142 - DNA, 20 bp, Artificial
  CRISPR gRNA sequence
aaaactccccttgtgactat

SEQ ID NO: 171143 - DNA, 20 bp, Artificial
  CRISPR gRNA sequence
cccttgtgactatgatccaa

SEQ ID NO: 171144 - DNA, 20 bp, Artificial
  CRISPR gRNA sequence
gtgactatgatccaagtgag

SEQ ID NO: 171145 - DNA, 20 bp, Artificial
  CRISPR gRNA sequence
tgactatgatccaagtgaga

SEQ ID NO: 171146 - DNA, 20 bp, Artificial
  CRISPR gRNA sequence
tgatccaagtgagagttaag

SEQ ID NO: 171147 - DNA, 20 bp, Artificial
  CRISPR gRNA sequence
aggactactgttttacggcc

SEQ ID NO: 171148 - DNA, 20 bp, Artificial
  CRISPR gRNA sequence
ctgttttacggccctgctac

SEQ ID NO: 171149 - DNA, 20 bp, Artificial
  CRISPR gRNA sequence
ttttacggccctgctactca

SEQ ID NO: 171150 - DNA, 20 bp, Artificial
  CRISPR gRNA sequence
tacggccctgctactcaaag

SEQ ID NO: 171151 - DNA, 20 bp, Artificial
  CRISPR gRNA sequence
acggccctgctactcaaagt

SEQ ID NO: 171152 - DNA, 20 bp, Artificial
  CRISPR gRNA sequence
cggccctgctactcaaagta

SEQ ID NO: 171153 - DNA, 20 bp, Artificial
  CRISPR gRNA sequence
ctactcaaagtaaggtcctt

SEQ ID NO: 171154 - DNA, 20 bp, Artificial
  CRISPR gRNA sequence
ctcaaagtaaggtccttgga

SEQ ID NO: 171155 - DNA, 20 bp, Artificial
  CRISPR gRNA sequence
aaagtaaggtccttggacca

SEQ ID NO: 171156 - DNA, 20 bp, Artificial
  CRISPR gRNA sequence
ggaccagcaatggtatcacc

SEQ ID NO: 171157 - DNA, 20 bp, Artificial
  CRISPR gRNA sequence
gaccagcaatggtatcacct

SEQ ID NO: 171158 - DNA, 20 bp, Artificial
  CRISPR gRNA sequence
ggaactcaaaagaaacacag

SEQ ID NO: 171159 - DNA, 20 bp, Artificial
  CRISPR gRNA sequence
aaaagaaacacagaatccca

SEQ ID NO: 171160 - DNA, 20 bp, Artificial
  CRISPR gRNA sequence
cgttcctaacctactaaatc

SEQ ID NO: 171161 - DNA, 20 bp, Artificial
  CRISPR gRNA sequence
ctaacctactaaatcagcat

SEQ ID NO: 171162 - DNA, 20 bp, Artificial
  CRISPR gRNA sequence
acctactaaatcagcatcaa

SEQ ID NO: 171163 - DNA, 20 bp, Artificial
  CRISPR gRNA sequence
ctaaatcagcatcaatattt

SEQ ID NO: 171164 - DNA, 20 bp, Artificial
  CRISPR gRNA sequence
aatcagcatcaatattttaa

SEQ ID NO: 171165 - DNA, 20 bp, Artificial
  CRISPR gRNA sequence
taagaagatcctccctcacg

SEQ ID NO: 171166 - DNA, 20 bp, Artificial
  CRISPR gRNA sequence
aagaagatcctccctcacgt

SEQ ID NO: 171167 - DNA, 20 bp, Artificial
  CRISPR gRNA sequence
agaagatcctccctcacgtg

SEQ ID NO: 171168 - DNA, 20 bp, Artificial
  CRISPR gRNA sequence
cctcacgtggttcatacaga

SEQ ID NO: 171169 - DNA, 20 bp, Artificial
  CRISPR gRNA sequence
acgtggttcatacagacaat

SEQ ID NO: 171170 - DNA, 20 bp, Artificial
  CRISPR gRNA sequence
atacagacaataaagtttga

SEQ ID NO: 171171 - DNA, 20 bp, Artificial
  CRISPR gRNA sequence
gagaagcactgctctacaga

SEQ ID NO: 171172 - DNA, 20 bp, Artificial
  CRISPR gRNA sequence
agaagcactgctctacagaa

SEQ ID NO: 171173 - DNA, 20 bp, Artificial
  CRISPR gRNA sequence
ctctacagaaagggctcaca

SEQ ID NO: 171174 - DNA, 20 bp, Artificial
  CRISPR gRNA sequence
tacagaaagggctcacacag

SEQ ID NO: 171175 - DNA, 20 bp, Artificial
  CRISPR gRNA sequence
cagaaagggctcacacagca

SEQ ID NO: 171176 - DNA, 20 bp, Artificial
  CRISPR gRNA sequence
acacagcacaggacctgttt

SEQ ID NO: 171177 - DNA, 20 bp, Artificial
  CRISPR gRNA sequence
ttttgtaacagtccaccaac

SEQ ID NO: 171178 - DNA, 20 bp, Artificial
  CRISPR gRNA sequence
tgtaacagtccaccaacctt

SEQ ID NO: 171179 - DNA, 20 bp, Artificial
  CRISPR gRNA sequence
gtaacagtccaccaaccttc

SEQ ID NO: 171180 - DNA, 20 bp, Artificial
  CRISPR gRNA sequence
taacagtccaccaaccttca

SEQ ID NO: 171181 - DNA, 20 bp, Artificial
  CRISPR gRNA sequence
catcaccaagttcttgttta

SEQ ID NO: 171182 - DNA, 20 bp, Artificial
  CRISPR gRNA sequence
atcaccaagttcttgtttaa

SEQ ID NO: 171183 - DNA, 20 bp, Artificial
  CRISPR gRNA sequence
ttgtttaaacagttatctga

SEQ ID NO: 171184 - DNA, 20 bp, Artificial
  CRISPR gRNA sequence
gtttaaacagttatctgatt

SEQ ID NO: 171185 - DNA, 20 bp, Artificial
  CRISPR gRNA sequence
tttaaacagttatctgattt

SEQ ID NO: 171186 - DNA, 20 bp, Artificial
  CRISPR gRNA sequence
aaacagttatctgatttgat

SEQ ID NO: 171187 - DNA, 20 bp, Artificial
  CRISPR gRNA sequence
aacagttatctgatttgatt

SEQ ID NO: 171188 - DNA, 20 bp, Artificial
  CRISPR gRNA sequence
tctgatttgattgtaatgtt

SEQ ID NO: 171189 - DNA, 20 bp, Artificial
  CRISPR gRNA sequence
atttgattgtaatgttagaa

SEQ ID NO: 171190 - DNA, 20 bp, Artificial
  CRISPR gRNA sequence
gattgtaatgttagaaatgt

SEQ ID NO: 171191 - DNA, 20 bp, Artificial
  CRISPR gRNA sequence
attgtaatgttagaaatgtc

SEQ ID NO: 171192 - DNA, 20 bp, Artificial
  CRISPR gRNA sequence
taatgttagaaatgtcatca

SEQ ID NO: 171193 - DNA, 20 bp, Artificial
  CRISPR gRNA sequence
gaaatgtcatcacccaatca

SEQ ID NO: 171194 - DNA, 20 bp, Artificial
  CRISPR gRNA sequence
aggaatgaaaagatgaaact

SEQ ID NO: 171195 - DNA, 20 bp, Artificial
  CRISPR gRNA sequence
ccaattaaaagaaagtgacc

SEQ ID NO: 171196 - DNA, 20 bp, Artificial
  CRISPR gRNA sequence
aaagaaagtgacctaggcac

SEQ ID NO: 171197 - DNA, 20 bp, Artificial
  CRISPR gRNA sequence
ggcactcaattacagttaag

SEQ ID NO: 171198 - DNA, 20 bp, Artificial
  CRISPR gRNA sequence
aattacagttaagtgaaggc

SEQ ID NO: 171199 - DNA, 20 bp, Artificial
  CRISPR gRNA sequence
cagttaagtgaaggctgaat

SEQ ID NO: 171200 - DNA, 20 bp, Artificial
  CRISPR gRNA sequence
agtgaaggctgaatgggatg

SEQ ID NO: 171201 - DNA, 20 bp, Artificial
  CRISPR gRNA sequence
aatgggatgtaaagagtaag

SEQ ID NO: 171202 - DNA, 20 bp, Artificial
  CRISPR gRNA sequence
gatttttcttttcgaaattc

SEQ ID NO: 171203 - DNA, 20 bp, Artificial
  CRISPR gRNA sequence
ttcttttcgaaattcagcat

SEQ ID NO: 171204 - DNA, 20 bp, Artificial
  CRISPR gRNA sequence
tcttttcgaaattcagcatt

SEQ ID NO: 171205 - DNA, 20 bp, Artificial
  CRISPR gRNA sequence
cttttcgaaattcagcattg

SEQ ID NO: 171206 - DNA, 20 bp, Artificial
  CRISPR gRNA sequence
ttttcgaaattcagcattgt

SEQ ID NO: 171207 - DNA, 20 bp, Artificial
  CRISPR gRNA sequence
ttcgaaattcagcattgttg

SEQ ID NO: 171208 - DNA, 20 bp, Artificial
  CRISPR gRNA sequence
tcgaaattcagcattgttgc

SEQ ID NO: 171209 - DNA, 20 bp, Artificial
  CRISPR gRNA sequence
cgaaattcagcattgttgcc

SEQ ID NO: 171210 - DNA, 20 bp, Artificial
  CRISPR gRNA sequence
gaaattcagcattgttgccc

SEQ ID NO: 171211 - DNA, 20 bp, Artificial
  CRISPR gRNA sequence
agcattgttgcccacctgcc

SEQ ID NO: 171212 - DNA, 20 bp, Artificial
  CRISPR gRNA sequence
ttgcccacctgcccccaact

SEQ ID NO: 171213 - DNA, 20 bp, Artificial
  CRISPR gRNA sequence
cccacctgcccccaactcac

SEQ ID NO: 171214 - DNA, 20 bp, Artificial
  CRISPR gRNA sequence
cccccaactcacctccataa

SEQ ID NO: 171215 - DNA, 20 bp, Artificial
  CRISPR gRNA sequence
acctccataaagacaaagtt

SEQ ID NO: 171216 - DNA, 20 bp, Artificial
  CRISPR gRNA sequence
cataaagacaaagttagctt

SEQ ID NO: 171217 - DNA, 20 bp, Artificial
  CRISPR gRNA sequence
gctttctctttcctattttc

SEQ ID NO: 171218 - DNA, 20 bp, Artificial
  CRISPR gRNA sequence
tctctttcctattttcaaag

SEQ ID NO: 171219 - DNA, 20 bp, Artificial
  CRISPR gRNA sequence
ctctttcctattttcaaaga

SEQ ID NO: 171220 - DNA, 20 bp, Artificial
  CRISPR gRNA sequence
tctttcctattttcaaagag

SEQ ID NO: 171221 - DNA, 20 bp, Artificial
  CRISPR gRNA sequence
tttcctattttcaaagaggc

SEQ ID NO: 171222 - DNA, 20 bp, Artificial
  CRISPR gRNA sequence
tcctattttcaaagaggccc

SEQ ID NO: 171223 - DNA, 20 bp, Artificial
  CRISPR gRNA sequence
cctattttcaaagaggccca

SEQ ID NO: 171224 - DNA, 20 bp, Artificial
  CRISPR gRNA sequence
ctattttcaaagaggcccac

SEQ ID NO: 171225 - DNA, 20 bp, Artificial
  CRISPR gRNA sequence
ttttcaaagaggcccactgg

SEQ ID NO: 171226 - DNA, 20 bp, Artificial
  CRISPR gRNA sequence
tcaaagaggcccactggggc

SEQ ID NO: 171227 - DNA, 20 bp, Artificial
  CRISPR gRNA sequence
caaagaggcccactggggca

SEQ ID NO: 171228 - DNA, 20 bp, Artificial
  CRISPR gRNA sequence
aaagaggcccactggggcaa

SEQ ID NO: 171229 - DNA, 20 bp, Artificial
  CRISPR gRNA sequence
gggcaaaactcaacacgaag

SEQ ID NO: 171230 - DNA, 20 bp, Artificial
  CRISPR gRNA sequence
aacacgaagaagtctgttat

SEQ ID NO: 171231 - DNA, 20 bp, Artificial
  CRISPR gRNA sequence
ttatttgctgttcccagagc

SEQ ID NO: 171232 - DNA, 20 bp, Artificial
  CRISPR gRNA sequence
tttgctgttcccagagctct

SEQ ID NO: 171233 - DNA, 20 bp, Artificial
  CRISPR gRNA sequence
gctgttcccagagctctgct

SEQ ID NO: 171234 - DNA, 20 bp, Artificial
  CRISPR gRNA sequence
ctgttcccagagctctgctg

SEQ ID NO: 171235 - DNA, 20 bp, Artificial
  CRISPR gRNA sequence
ttcccagagctctgctgtgc

SEQ ID NO: 171236 - DNA, 20 bp, Artificial
  CRISPR gRNA sequence
ccagagctctgctgtgcggg

SEQ ID NO: 171237 - DNA, 20 bp, Artificial
  CRISPR gRNA sequence
tgctgtgcgggaatataggg

SEQ ID NO: 171238 - DNA, 20 bp, Artificial
  CRISPR gRNA sequence
ctgtgcgggaatatagggtt

SEQ ID NO: 171239 - DNA, 20 bp, Artificial
  CRISPR gRNA sequence
tgcgggaatatagggtttta

SEQ ID NO: 171240 - DNA, 20 bp, Artificial
  CRISPR gRNA sequence
tacacaatcactctggtgca

SEQ ID NO: 171241 - DNA, 20 bp, Artificial
  CRISPR gRNA sequence
acacaatcactctggtgcac

SEQ ID NO: 171242 - DNA, 20 bp, Artificial
  CRISPR gRNA sequence
cacaatcactctggtgcaca

SEQ ID NO: 171243 - DNA, 20 bp, Artificial
  CRISPR gRNA sequence
tggtgcacaatcatcttgat

SEQ ID NO: 171244 - DNA, 20 bp, Artificial
  CRISPR gRNA sequence
gtgcacaatcatcttgatat

SEQ ID NO: 171245 - DNA, 20 bp, Artificial
  CRISPR gRNA sequence
gatatggtttttaactaatt

SEQ ID NO: 171246 - DNA, 20 bp, Artificial
  CRISPR gRNA sequence
atatggtttttaactaattt

SEQ ID NO: 171247 - DNA, 20 bp, Artificial
  CRISPR gRNA sequence
ttaactaatttcaatcccag

SEQ ID NO: 171248 - DNA, 20 bp, Artificial
  CRISPR gRNA sequence
taactaatttcaatcccagc

SEQ ID NO: 171249 - DNA, 20 bp, Artificial
  CRISPR gRNA sequence
aactaatttcaatcccagct

SEQ ID NO: 171250 - DNA, 20 bp, Artificial
  CRISPR gRNA sequence
actaatttcaatcccagctg

SEQ ID NO: 171251 - DNA, 20 bp, Artificial
  CRISPR gRNA sequence
atttcaatcccagctgaaca

SEQ ID NO: 171252 - DNA, 20 bp, Artificial
  CRISPR gRNA sequence
caatcccagctgaacaccac

SEQ ID NO: 171253 - DNA, 20 bp, Artificial
  CRISPR gRNA sequence
aatcccagctgaacaccacc

SEQ ID NO: 171254 - DNA, 20 bp, Artificial
  CRISPR gRNA sequence
aacaccacctggatttatag

SEQ ID NO: 171255 - DNA, 20 bp, Artificial
  CRISPR gRNA sequence
gatttatagacaactacaga

SEQ ID NO: 171256 - DNA, 20 bp, Artificial
  CRISPR gRNA sequence
atagacaactacagagcttt

SEQ ID NO: 171257 - DNA, 20 bp, Artificial
  CRISPR gRNA sequence
tagacaactacagagctttt

SEQ ID NO: 171258 - DNA, 20 bp, Artificial
  CRISPR gRNA sequence
cagagcttttaagaatcatg

SEQ ID NO: 171259 - DNA, 20 bp, Artificial
  CRISPR gRNA sequence
ttaagaatcatgagaacaag

SEQ ID NO: 171260 - DNA, 20 bp, Artificial
  CRISPR gRNA sequence
taagaatcatgagaacaagc

SEQ ID NO: 171261 - DNA, 20 bp, Artificial
  CRISPR gRNA sequence
aagaatcatgagaacaagct

SEQ ID NO: 171262 - DNA, 20 bp, Artificial
  CRISPR gRNA sequence
agaatcatgagaacaagcta

SEQ ID NO: 171263 - DNA, 20 bp, Artificial
  CRISPR gRNA sequence
aaatgaaagataaattgctt

SEQ ID NO: 171264 - DNA, 20 bp, Artificial
  CRISPR gRNA sequence
cttttacaggacgcagacca

SEQ ID NO: 171265 - DNA, 20 bp, Artificial
  CRISPR gRNA sequence
ttacaggacgcagaccaaaa

SEQ ID NO: 171266 - DNA, 20 bp, Artificial
  CRISPR gRNA sequence
tacaggacgcagaccaaaag

SEQ ID NO: 171267 - DNA, 20 bp, Artificial
  CRISPR gRNA sequence
acaggacgcagaccaaaagg

SEQ ID NO: 171268 - DNA, 20 bp, Artificial
  CRISPR gRNA sequence
caggacgcagaccaaaagga

SEQ ID NO: 171269 - DNA, 20 bp, Artificial
  CRISPR gRNA sequence
gaggccagtgtttccaacac

SEQ ID NO: 171270 - DNA, 20 bp, Artificial
  CRISPR gRNA sequence
aggccagtgtttccaacaca

SEQ ID NO: 171271 - DNA, 20 bp, Artificial
  CRISPR gRNA sequence
ccaacacatcatgaaatata

SEQ ID NO: 171272 - DNA, 20 bp, Artificial
  CRISPR gRNA sequence
caacacatcatgaaatatat

SEQ ID NO: 171273 - DNA, 20 bp, Artificial
  CRISPR gRNA sequence
gcaaacttcaattacttctt

SEQ ID NO: 171274 - DNA, 20 bp, Artificial
  CRISPR gRNA sequence
caattacttctttttgaaac

SEQ ID NO: 171275 - DNA, 20 bp, Artificial
  CRISPR gRNA sequence
aattacttctttttgaaaca

SEQ ID NO: 171276 - DNA, 20 bp, Artificial
  CRISPR gRNA sequence
cttctttttgaaacaaattg

SEQ ID NO: 171277 - DNA, 20 bp, Artificial
  CRISPR gRNA sequence
ctttttgaaacaaattgtgt

SEQ ID NO: 171278 - DNA, 20 bp, Artificial
  CRISPR gRNA sequence
tttttgaaacaaattgtgtc

SEQ ID NO: 171279 - DNA, 20 bp, Artificial
  CRISPR gRNA sequence
tttgaaacaaattgtgtccc

SEQ ID NO: 171280 - DNA, 20 bp, Artificial
  CRISPR gRNA sequence
ttgaaacaaattgtgtccca

SEQ ID NO: 171281 - DNA, 20 bp, Artificial
  CRISPR gRNA sequence
tgaaacaaattgtgtcccag

SEQ ID NO: 171282 - DNA, 20 bp, Artificial
  CRISPR gRNA sequence
gaaacaaattgtgtcccagt

SEQ ID NO: 171283 - DNA, 20 bp, Artificial
  CRISPR gRNA sequence
aaacaaattgtgtcccagtc

SEQ ID NO: 171284 - DNA, 20 bp, Artificial
  CRISPR gRNA sequence
tgtcccagtctgagatcaca

SEQ ID NO: 171285 - DNA, 20 bp, Artificial
  CRISPR gRNA sequence
agatcacattttatgaatat

SEQ ID NO: 171286 - DNA, 20 bp, Artificial
  CRISPR gRNA sequence
tatgaatattctcgtaagtt

SEQ ID NO: 171287 - DNA, 20 bp, Artificial
  CRISPR gRNA sequence
atgaatattctcgtaagttt

SEQ ID NO: 171288 - DNA, 20 bp, Artificial
  CRISPR gRNA sequence
tgaatattctcgtaagtttt

SEQ ID NO: 171289 - DNA, 20 bp, Artificial
  CRISPR gRNA sequence
tcgtaagttttacttatgat

SEQ ID NO: 171290 - DNA, 20 bp, Artificial
  CRISPR gRNA sequence
gtaagttttacttatgattg

SEQ ID NO: 171291 - DNA, 20 bp, Artificial
  CRISPR gRNA sequence
tacttatgattggctagttt

SEQ ID NO: 171292 - DNA, 20 bp, Artificial
  CRISPR gRNA sequence
acttatgattggctagttta

SEQ ID NO: 171293 - DNA, 20 bp, Artificial
  CRISPR gRNA sequence
cttatgattggctagtttaa

SEQ ID NO: 171294 - DNA, 20 bp, Artificial
  CRISPR gRNA sequence
atgattggctagtttaaaca

SEQ ID NO: 171295 - DNA, 20 bp, Artificial
  CRISPR gRNA sequence
tgattggctagtttaaacat

SEQ ID NO: 171296 - DNA, 20 bp, Artificial
  CRISPR gRNA sequence
gctagtttaaacataaggaa

SEQ ID NO: 171297 - DNA, 20 bp, Artificial
  CRISPR gRNA sequence
gtttaaacataaggaatttt

SEQ ID NO: 171298 - DNA, 20 bp, Artificial
  CRISPR gRNA sequence
aaacataaggaatttttttc

SEQ ID NO: 171299 - DNA, 20 bp, Artificial
  CRISPR gRNA sequence
aacataaggaatttttttct

SEQ ID NO: 171300 - DNA, 20 bp, Artificial
  CRISPR gRNA sequence
ttttctttttaatctgttag

SEQ ID NO: 171301 - DNA, 20 bp, Artificial
  CRISPR gRNA sequence
tttctttttaatctgttaga

SEQ ID NO: 171302 - DNA, 20 bp, Artificial
  CRISPR gRNA sequence
ttctttttaatctgttagat

SEQ ID NO: 171303 - DNA, 20 bp, Artificial
  CRISPR gRNA sequence
tctttttaatctgttagata

SEQ ID NO: 171304 - DNA, 20 bp, Artificial
  CRISPR gRNA sequence
ctttttaatctgttagatat

SEQ ID NO: 171305 - DNA, 20 bp, Artificial
  CRISPR gRNA sequence
tttttaatctgttagatatt

SEQ ID NO: 171306 - DNA, 20 bp, Artificial
  CRISPR gRNA sequence
tttaatctgttagatattgt

SEQ ID NO: 171307 - DNA, 20 bp, Artificial
  CRISPR gRNA sequence
ttaatctgttagatattgtg

SEQ ID NO: 171308 - DNA, 20 bp, Artificial
  CRISPR gRNA sequence
taatctgttagatattgtga

SEQ ID NO: 171309 - DNA, 20 bp, Artificial
  CRISPR gRNA sequence
aatctgttagatattgtgag

SEQ ID NO: 171310 - DNA, 20 bp, Artificial
  CRISPR gRNA sequence
atctgttagatattgtgagg

SEQ ID NO: 171311 - DNA, 20 bp, Artificial
  CRISPR gRNA sequence
ttagatattgtgaggtgtca

SEQ ID NO: 171312 - DNA, 20 bp, Artificial
  CRISPR gRNA sequence
gatattgtgaggtgtcaacc

SEQ ID NO: 171313 - DNA, 20 bp, Artificial
  CRISPR gRNA sequence
tgaggtgtcaacctaagagg

SEQ ID NO: 171314 - DNA, 20 bp, Artificial
  CRISPR gRNA sequence
agaggctctgacacatctga

SEQ ID NO: 171315 - DNA, 20 bp, Artificial
  CRISPR gRNA sequence
tgacacatctgaggaagtct

SEQ ID NO: 171316 - DNA, 20 bp, Artificial
  CRISPR gRNA sequence
acacatctgaggaagtctgg

SEQ ID NO: 171317 - DNA, 20 bp, Artificial
  CRISPR gRNA sequence
aggaagtctggttttaagta

SEQ ID NO: 171318 - DNA, 20 bp, Artificial
  CRISPR gRNA sequence
gttttaagtactgttgagtt

SEQ ID NO: 171319 - DNA, 20 bp, Artificial
  CRISPR gRNA sequence
taagtactgttgagttctgg

SEQ ID NO: 171320 - DNA, 20 bp, Artificial
  CRISPR gRNA sequence
aagtactgttgagttctgga

SEQ ID NO: 171321 - DNA, 20 bp, Artificial
  CRISPR gRNA sequence
agtactgttgagttctggaa

SEQ ID NO: 171322 - DNA, 20 bp, Artificial
  CRISPR gRNA sequence
ttgagttctggaaagggaca

SEQ ID NO: 171323 - DNA, 20 bp, Artificial
  CRISPR gRNA sequence
agttctggaaagggacagat

SEQ ID NO: 171324 - DNA, 20 bp, Artificial
  CRISPR gRNA sequence
tggaaagggacagattaaat

SEQ ID NO: 171325 - DNA, 20 bp, Artificial
  CRISPR gRNA sequence
gaaagggacagattaaatgc

SEQ ID NO: 171326 - DNA, 20 bp, Artificial
  CRISPR gRNA sequence
aatgctaaaatgtttggtca

SEQ ID NO: 171327 - DNA, 20 bp, Artificial
  CRISPR gRNA sequence
aaatgtttggtcatgttaca

SEQ ID NO: 171328 - DNA, 20 bp, Artificial
  CRISPR gRNA sequence
ggtcatgttacacaggcagc

SEQ ID NO: 171329 - DNA, 20 bp, Artificial
  CRISPR gRNA sequence
gtcatgttacacaggcagca

SEQ ID NO: 171330 - DNA, 20 bp, Artificial
  CRISPR gRNA sequence
cacaggcagcagcgcagtca

SEQ ID NO: 171331 - DNA, 20 bp, Artificial
  CRISPR gRNA sequence
cactcctgagaagaggggaa

SEQ ID NO: 171332 - DNA, 20 bp, Artificial
  CRISPR gRNA sequence
ctgagaagaggggaaaataa

SEQ ID NO: 171333 - DNA, 20 bp, Artificial
  CRISPR gRNA sequence
agaagaggggaaaataagag

SEQ ID NO: 171334 - DNA, 20 bp, Artificial
  CRISPR gRNA sequence
ccctgactttactggattgc

SEQ ID NO: 171335 - DNA, 20 bp, Artificial
  CRISPR gRNA sequence
actttactggattgcattct

SEQ ID NO: 171336 - DNA, 20 bp, Artificial
  CRISPR gRNA sequence
tactggattgcattcttact

SEQ ID NO: 171337 - DNA, 20 bp, Artificial
  CRISPR gRNA sequence
actggattgcattcttactc

SEQ ID NO: 171338 - DNA, 20 bp, Artificial
  CRISPR gRNA sequence
ctggattgcattcttactca

SEQ ID NO: 171339 - DNA, 20 bp, Artificial
  CRISPR gRNA sequence
gattgcattcttactcaaat

SEQ ID NO: 171340 - DNA, 20 bp, Artificial
  CRISPR gRNA sequence
cattcttactcaaatatgga

SEQ ID NO: 171341 - DNA, 20 bp, Artificial
  CRISPR gRNA sequence
ttactcaaatatggaattga

SEQ ID NO: 171342 - DNA, 20 bp, Artificial
  CRISPR gRNA sequence
actcaaatatggaattgatg

SEQ ID NO: 171343 - DNA, 20 bp, Artificial
  CRISPR gRNA sequence
ctcaaatatggaattgatgt

SEQ ID NO: 171344 - DNA, 20 bp, Artificial
  CRISPR gRNA sequence
aaatatggaattgatgttgc

SEQ ID NO: 171345 - DNA, 20 bp, Artificial
  CRISPR gRNA sequence
atgttgctttgcactaaacc

SEQ ID NO: 171346 - DNA, 20 bp, Artificial
  CRISPR gRNA sequence
ctttgcactaaacctgaagt

SEQ ID NO: 171347 - DNA, 20 bp, Artificial
  CRISPR gRNA sequence
tgcactaaacctgaagtgga

SEQ ID NO: 171348 - DNA, 20 bp, Artificial
  CRISPR gRNA sequence
gcactaaacctgaagtggag

SEQ ID NO: 171349 - DNA, 20 bp, Artificial
  CRISPR gRNA sequence
cactaaacctgaagtggagt

SEQ ID NO: 171350 - DNA, 20 bp, Artificial
  CRISPR gRNA sequence
aacctgaagtggagtctaat

SEQ ID NO: 171351 - DNA, 20 bp, Artificial
  CRISPR gRNA sequence
aagtggagtctaatttgttc

SEQ ID NO: 171352 - DNA, 20 bp, Artificial
  CRISPR gRNA sequence
atttgttcaaatatttattg

SEQ ID NO: 171353 - DNA, 20 bp, Artificial
  CRISPR gRNA sequence
gttcaaatatttattgtgca

SEQ ID NO: 171354 - DNA, 20 bp, Artificial
  CRISPR gRNA sequence
ttcaaatatttattgtgcac

SEQ ID NO: 171355 - DNA, 20 bp, Artificial
  CRISPR gRNA sequence
aaatatttattgtgcaccta

SEQ ID NO: 171356 - DNA, 20 bp, Artificial
  CRISPR gRNA sequence
attgtgcacctactacatgc

SEQ ID NO: 171357 - DNA, 20 bp, Artificial
  CRISPR gRNA sequence
ttgtgcacctactacatgcc

SEQ ID NO: 171358 - DNA, 20 bp, Artificial
  CRISPR gRNA sequence
tgcacctactacatgccaga

SEQ ID NO: 171359 - DNA, 20 bp, Artificial
  CRISPR gRNA sequence
ctacatgccagacattgttc

SEQ ID NO: 171360 - DNA, 20 bp, Artificial
  CRISPR gRNA sequence
catgccagacattgttctaa

SEQ ID NO: 171361 - DNA, 20 bp, Artificial
  CRISPR gRNA sequence
ttctaagcacctgatataaa

SEQ ID NO: 171362 - DNA, 20 bp, Artificial
  CRISPR gRNA sequence
taagcacctgatataaaaga

SEQ ID NO: 171363 - DNA, 20 bp, Artificial
  CRISPR gRNA sequence
agcacctgatataaaagaca

SEQ ID NO: 171364 - DNA, 20 bp, Artificial
  CRISPR gRNA sequence
atataaaagacatagcatgg

SEQ ID NO: 171365 - DNA, 20 bp, Artificial
  CRISPR gRNA sequence
ggagtccctttcaaaagtac

SEQ ID NO: 171366 - DNA, 20 bp, Artificial
  CRISPR gRNA sequence
tcaaaagtacataggaggag

SEQ ID NO: 171367 - DNA, 20 bp, Artificial
  CRISPR gRNA sequence
caaaagtacataggaggaga

SEQ ID NO: 171368 - DNA, 20 bp, Artificial
  CRISPR gRNA sequence
aaaagtacataggaggagaa

SEQ ID NO: 171369 - DNA, 20 bp, Artificial
  CRISPR gRNA sequence
taattagtcaccaatacaag

SEQ ID NO: 171370 - DNA, 20 bp, Artificial
  CRISPR gRNA sequence
aattagtcaccaatacaaga

SEQ ID NO: 171371 - DNA, 20 bp, Artificial
  CRISPR gRNA sequence
attagtcaccaatacaagaa

SEQ ID NO: 171372 - DNA, 20 bp, Artificial
  CRISPR gRNA sequence
gtcaccaatacaagaaggat

SEQ ID NO: 171373 - DNA, 20 bp, Artificial
  CRISPR gRNA sequence
aagacaacttcctctttact

SEQ ID NO: 171374 - DNA, 20 bp, Artificial
  CRISPR gRNA sequence
cctctttacttttctttctc

SEQ ID NO: 171375 - DNA, 20 bp, Artificial
  CRISPR gRNA sequence
ctctttacttttctttctct

SEQ ID NO: 171376 - DNA, 20 bp, Artificial
  CRISPR gRNA sequence
tttacttttctttctcttca

SEQ ID NO: 171377 - DNA, 20 bp, Artificial
  CRISPR gRNA sequence
tacttttctttctcttcacc

SEQ ID NO: 171378 - DNA, 20 bp, Artificial
  CRISPR gRNA sequence
acttttctttctcttcaccc

SEQ ID NO: 171379 - DNA, 20 bp, Artificial
  CRISPR gRNA sequence
cttttctttctcttcaccca

SEQ ID NO: 171380 - DNA, 20 bp, Artificial
  CRISPR gRNA sequence
ttctttctcttcacccacaa

SEQ ID NO: 171381 - DNA, 20 bp, Artificial
  CRISPR gRNA sequence
tctttctcttcacccacaaa

SEQ ID NO: 171382 - DNA, 20 bp, Artificial
  CRISPR gRNA sequence
ctttctcttcacccacaaaa

SEQ ID NO: 171383 - DNA, 20 bp, Artificial
  CRISPR gRNA sequence
tttctcttcacccacaaaac

SEQ ID NO: 171384 - DNA, 20 bp, Artificial
  CRISPR gRNA sequence
tctcttcacccacaaaactt

SEQ ID NO: 171385 - DNA, 20 bp, Artificial
  CRISPR gRNA sequence
ctcttcacccacaaaacttg

SEQ ID NO: 171386 - DNA, 20 bp, Artificial
  CRISPR gRNA sequence
tcttcacccacaaaacttga

SEQ ID NO: 171387 - DNA, 20 bp, Artificial
  CRISPR gRNA sequence
ttcacccacaaaacttgaac

SEQ ID NO: 171388 - DNA, 20 bp, Artificial
  CRISPR gRNA sequence
cacccacaaaacttgaacca

SEQ ID NO: 171389 - DNA, 20 bp, Artificial
  CRISPR gRNA sequence
acccacaaaacttgaaccaa

SEQ ID NO: 171390 - DNA, 20 bp, Artificial
  CRISPR gRNA sequence
gaaccaaaactgaatccctc

SEQ ID NO: 171391 - DNA, 20 bp, Artificial
  CRISPR gRNA sequence
aaccaaaactgaatccctca

SEQ ID NO: 171392 - DNA, 20 bp, Artificial
  CRISPR gRNA sequence
aatccctcaaagtaattctc

SEQ ID NO: 171393 - DNA, 20 bp, Artificial
  CRISPR gRNA sequence
aaagtaattctcttttaact

SEQ ID NO: 171394 - DNA, 20 bp, Artificial
  CRISPR gRNA sequence
tcttttaacttctgatagac

SEQ ID NO: 171395 - DNA, 20 bp, Artificial
  CRISPR gRNA sequence
ttttaacttctgatagacta

SEQ ID NO: 171396 - DNA, 20 bp, Artificial
  CRISPR gRNA sequence
ttaacttctgatagactaag

SEQ ID NO: 171397 - DNA, 20 bp, Artificial
  CRISPR gRNA sequence
taacttctgatagactaagt

SEQ ID NO: 171398 - DNA, 20 bp, Artificial
  CRISPR gRNA sequence
aacttctgatagactaagtc

SEQ ID NO: 171399 - DNA, 20 bp, Artificial
  CRISPR gRNA sequence
acttctgatagactaagtct

SEQ ID NO: 171400 - DNA, 20 bp, Artificial
  CRISPR gRNA sequence
ctgatagactaagtctaggt

SEQ ID NO: 171401 - DNA, 20 bp, Artificial
  CRISPR gRNA sequence
tgatagactaagtctaggta

SEQ ID NO: 171402 - DNA, 20 bp, Artificial
  CRISPR gRNA sequence
atagactaagtctaggtact

SEQ ID NO: 171403 - DNA, 20 bp, Artificial
  CRISPR gRNA sequence
agtctaggtactaaaatttg

SEQ ID NO: 171404 - DNA, 20 bp, Artificial
  CRISPR gRNA sequence
ggtactaaaatttggtcaac

SEQ ID NO: 171405 - DNA, 20 bp, Artificial
  CRISPR gRNA sequence
aaatttggtcaacatcatga

SEQ ID NO: 171406 - DNA, 20 bp, Artificial
  CRISPR gRNA sequence
ggtcaacatcatgatcagct

SEQ ID NO: 171407 - DNA, 20 bp, Artificial
  CRISPR gRNA sequence
gtcaacatcatgatcagctt

SEQ ID NO: 171408 - DNA, 20 bp, Artificial
  CRISPR gRNA sequence
tgttggcaatcaaacttgta

SEQ ID NO: 171409 - DNA, 20 bp, Artificial
  CRISPR gRNA sequence
gttggcaatcaaacttgtaa

SEQ ID NO: 171410 - DNA, 20 bp, Artificial
  CRISPR gRNA sequence
ttggcaatcaaacttgtaaa

SEQ ID NO: 171411 - DNA, 20 bp, Artificial
  CRISPR gRNA sequence
gcaatcaaacttgtaaacca

SEQ ID NO: 171412 - DNA, 20 bp, Artificial
  CRISPR gRNA sequence
gtaaaccaagtaggttacaa

SEQ ID NO: 171413 - DNA, 20 bp, Artificial
  CRISPR gRNA sequence
taaaccaagtaggttacaaa

SEQ ID NO: 171414 - DNA, 20 bp, Artificial
  CRISPR gRNA sequence
caaatcaaagcccagggtct

SEQ ID NO: 171415 - DNA, 20 bp, Artificial
  CRISPR gRNA sequence
gaagaggtatttgcacactc

SEQ ID NO: 171416 - DNA, 20 bp, Artificial
  CRISPR gRNA sequence
aagaggtatttgcacactca

SEQ ID NO: 171417 - DNA, 20 bp, Artificial
  CRISPR gRNA sequence
gcacactcatgtaacacagc

SEQ ID NO: 171418 - DNA, 20 bp, Artificial
  CRISPR gRNA sequence
cacactcatgtaacacagca

SEQ ID NO: 171419 - DNA, 20 bp, Artificial
  CRISPR gRNA sequence
atgtaacacagcagcactat

SEQ ID NO: 171420 - DNA, 20 bp, Artificial
  CRISPR gRNA sequence
ttcacaatagccaagaggtg

SEQ ID NO: 171421 - DNA, 20 bp, Artificial
  CRISPR gRNA sequence
acaatagccaagaggtgaaa

SEQ ID NO: 171422 - DNA, 20 bp, Artificial
  CRISPR gRNA sequence
acagatgaacggataaacaa

SEQ ID NO: 171423 - DNA, 20 bp, Artificial
  CRISPR gRNA sequence
tgccttaaaaaaaaaaaaag

SEQ ID NO: 171424 - DNA, 20 bp, Artificial
  CRISPR gRNA sequence
ccttaaaaaaaaaaaaagga

SEQ ID NO: 171425 - DNA, 20 bp, Artificial
  CRISPR gRNA sequence
aaaaaaaaaaaaaggatagg

SEQ ID NO: 171426 - DNA, 20 bp, Artificial
  CRISPR gRNA sequence
aaaaaaaaaaaaggataggc

SEQ ID NO: 171427 - DNA, 20 bp, Artificial
  CRISPR gRNA sequence
atgtctgtaatcccagtgct

SEQ ID NO: 171428 - DNA, 20 bp, Artificial
  CRISPR gRNA sequence
taatcccagtgctttggagg

SEQ ID NO: 171429 - DNA, 20 bp, Artificial
  CRISPR gRNA sequence
tggagggccaaggcaagagg

SEQ ID NO: 171430 - DNA, 20 bp, Artificial
  CRISPR gRNA sequence
ggagggccaaggcaagagga

SEQ ID NO: 171431 - DNA, 20 bp, Artificial
  CRISPR gRNA sequence
gagggccaaggcaagaggat

SEQ ID NO: 171432 - DNA, 20 bp, Artificial
  CRISPR gRNA sequence
cttgaggccaggaatttgag

SEQ ID NO: 171433 - DNA, 20 bp, Artificial
  CRISPR gRNA sequence
gaggccaggaatttgagacc

SEQ ID NO: 171434 - DNA, 20 bp, Artificial
  CRISPR gRNA sequence
aggccaggaatttgagacca

SEQ ID NO: 171435 - DNA, 20 bp, Artificial
  CRISPR gRNA sequence
gagaccagcctaggcaacat

SEQ ID NO: 171436 - DNA, 20 bp, Artificial
  CRISPR gRNA sequence
agaccagcctaggcaacata

SEQ ID NO: 171437 - DNA, 20 bp, Artificial
  CRISPR gRNA sequence
ggcaacatagtgagacctcc

SEQ ID NO: 171438 - DNA, 20 bp, Artificial
  CRISPR gRNA sequence
catctctacataagattttt

SEQ ID NO: 171439 - DNA, 20 bp, Artificial
  CRISPR gRNA sequence
tacataagattttttttttt

SEQ ID NO: 171440 - DNA, 20 bp, Artificial
  CRISPR gRNA sequence
cataagatttttttttttta

SEQ ID NO: 171441 - DNA, 20 bp, Artificial
  CRISPR gRNA sequence
tttttttttaattagccagg

SEQ ID NO: 171442 - DNA, 20 bp, Artificial
  CRISPR gRNA sequence
ttttttttaattagccaggt

SEQ ID NO: 171443 - DNA, 20 bp, Artificial
  CRISPR gRNA sequence
tttttttaattagccaggtg

SEQ ID NO: 171444 - DNA, 20 bp, Artificial
  CRISPR gRNA sequence
ttttttaattagccaggtgt

SEQ ID NO: 171445 - DNA, 20 bp, Artificial
  CRISPR gRNA sequence
tttttaattagccaggtgtg

SEQ ID NO: 171446 - DNA, 20 bp, Artificial
  CRISPR gRNA sequence
ttttaattagccaggtgtgg

SEQ ID NO: 171447 - DNA, 20 bp, Artificial
  CRISPR gRNA sequence
tttaattagccaggtgtggt

SEQ ID NO: 171448 - DNA, 20 bp, Artificial
  CRISPR gRNA sequence
ttaattagccaggtgtggtg

SEQ ID NO: 171449 - DNA, 20 bp, Artificial
  CRISPR gRNA sequence
taattagccaggtgtggtgg

SEQ ID NO: 171450 - DNA, 20 bp, Artificial
  CRISPR gRNA sequence
aattagccaggtgtggtggt

SEQ ID NO: 171451 - DNA, 20 bp, Artificial
  CRISPR gRNA sequence
attagccaggtgtggtggtg

SEQ ID NO: 171452 - DNA, 20 bp, Artificial
  CRISPR gRNA sequence
gccaggtgtggtggtgcaca

SEQ ID NO: 171453 - DNA, 20 bp, Artificial
  CRISPR gRNA sequence
gagtcctagctacttggggg

SEQ ID NO: 171454 - DNA, 20 bp, Artificial
  CRISPR gRNA sequence
gctacttgggggactgagta

SEQ ID NO: 171455 - DNA, 20 bp, Artificial
  CRISPR gRNA sequence
cttgggggactgagtaggaa

SEQ ID NO: 171456 - DNA, 20 bp, Artificial
  CRISPR gRNA sequence
gggggactgagtaggaaggg

SEQ ID NO: 171457 - DNA, 20 bp, Artificial
  CRISPR gRNA sequence
ggggactgagtaggaagggt

SEQ ID NO: 171458 - DNA, 20 bp, Artificial
  CRISPR gRNA sequence
agtaggaagggtcccttgag

SEQ ID NO: 171459 - DNA, 20 bp, Artificial
  CRISPR gRNA sequence
gagcccaagagttcaaggct

SEQ ID NO: 171460 - DNA, 20 bp, Artificial
  CRISPR gRNA sequence
agcccaagagttcaaggcta

SEQ ID NO: 171461 - DNA, 20 bp, Artificial
  CRISPR gRNA sequence
aaggctacagtgagctataa

SEQ ID NO: 171462 - DNA, 20 bp, Artificial
  CRISPR gRNA sequence
cagtgagctataatcctgcc

SEQ ID NO: 171463 - DNA, 20 bp, Artificial
  CRISPR gRNA sequence
taatcctgccactgcactcc

SEQ ID NO: 171464 - DNA, 20 bp, Artificial
  CRISPR gRNA sequence
ccactgcactccagcaatga

SEQ ID NO: 171465 - DNA, 20 bp, Artificial
  CRISPR gRNA sequence
cactccagcaatgaacagag

SEQ ID NO: 171466 - DNA, 20 bp, Artificial
  CRISPR gRNA sequence
cagcaatgaacagagtgaga

SEQ ID NO: 171467 - DNA, 20 bp, Artificial
  CRISPR gRNA sequence
tctctttaaaaaagaaaaaa

SEQ ID NO: 171468 - DNA, 20 bp, Artificial
  CRISPR gRNA sequence
tttaaaaaagaaaaaacaaa

SEQ ID NO: 171469 - DNA, 20 bp, Artificial
  CRISPR gRNA sequence
taaaaaagaaaaaacaaagg

SEQ ID NO: 171470 - DNA, 20 bp, Artificial
  CRISPR gRNA sequence
aaaaaagaaaaaacaaaggc

SEQ ID NO: 171471 - DNA, 20 bp, Artificial
  CRISPR gRNA sequence
aaaaagaaaaaacaaaggcc

SEQ ID NO: 171472 - DNA, 20 bp, Artificial
  CRISPR gRNA sequence
acacctataatcccagcact

SEQ ID NO: 171473 - DNA, 20 bp, Artificial
  CRISPR gRNA sequence
taatcccagcactttgggag

SEQ ID NO: 171474 - DNA, 20 bp, Artificial
  CRISPR gRNA sequence
tgggaggcagatgtgggagg

SEQ ID NO: 171475 - DNA, 20 bp, Artificial
  CRISPR gRNA sequence
gggaggcagatgtgggagga

SEQ ID NO: 171476 - DNA, 20 bp, Artificial
  CRISPR gRNA sequence
ggaggcagatgtgggaggaa

SEQ ID NO: 171477 - DNA, 20 bp, Artificial
  CRISPR gRNA sequence
gagcccagaagtttgagacc

SEQ ID NO: 171478 - DNA, 20 bp, Artificial
  CRISPR gRNA sequence
agcccagaagtttgagacca

SEQ ID NO: 171479 - DNA, 20 bp, Artificial
  CRISPR gRNA sequence
gagaccagccagggtaacat

SEQ ID NO: 171480 - DNA, 20 bp, Artificial
  CRISPR gRNA sequence
agaccagccagggtaacatg

SEQ ID NO: 171481 - DNA, 20 bp, Artificial
  CRISPR gRNA sequence
cctctacagaaaaatacaaa

SEQ ID NO: 171482 - DNA, 20 bp, Artificial
  CRISPR gRNA sequence
tacagaaaaatacaaaaatt

SEQ ID NO: 171483 - DNA, 20 bp, Artificial
  CRISPR gRNA sequence
cagaaaaatacaaaaattag

SEQ ID NO: 171484 - DNA, 20 bp, Artificial
  CRISPR gRNA sequence
gctgggtgtggtggcgtgca

SEQ ID NO: 171485 - DNA, 20 bp, Artificial
  CRISPR gRNA sequence
ggtgtggtggcgtgcacctg

SEQ ID NO: 171486 - DNA, 20 bp, Artificial
  CRISPR gRNA sequence
tagtctcagctactcaggag

SEQ ID NO: 171487 - DNA, 20 bp, Artificial
  CRISPR gRNA sequence
agctactcaggaggctgagg

SEQ ID NO: 171488 - DNA, 20 bp, Artificial
  CRISPR gRNA sequence
ctcaggaggctgaggcggga

SEQ ID NO: 171489 - DNA, 20 bp, Artificial
  CRISPR gRNA sequence
aggaggctgaggcgggagga

SEQ ID NO: 171490 - DNA, 20 bp, Artificial
  CRISPR gRNA sequence
aggcgggaggatcgcttgag

SEQ ID NO: 171491 - DNA, 20 bp, Artificial
  CRISPR gRNA sequence
gagcctgagaggtcgaggct

SEQ ID NO: 171492 - DNA, 20 bp, Artificial
  CRISPR gRNA sequence
agcctgagaggtcgaggctg

SEQ ID NO: 171493 - DNA, 20 bp, Artificial
  CRISPR gRNA sequence
agaggtcgaggctgcagtga

SEQ ID NO: 171494 - DNA, 20 bp, Artificial
  CRISPR gRNA sequence
cagtgagccataattgtacc

SEQ ID NO: 171495 - DNA, 20 bp, Artificial
  CRISPR gRNA sequence
taccactacactccagcctg

SEQ ID NO: 171496 - DNA, 20 bp, Artificial
  CRISPR gRNA sequence
cactccagcctggatgacag

SEQ ID NO: 171497 - DNA, 20 bp, Artificial
  CRISPR gRNA sequence
cagcctggatgacagagtga

SEQ ID NO: 171498 - DNA, 20 bp, Artificial
  CRISPR gRNA sequence
gatgacagagtgagaccctg

SEQ ID NO: 171499 - DNA, 20 bp, Artificial
  CRISPR gRNA sequence
tctccaaaaaggaaaaaaaa

SEQ ID NO: 171500 - DNA, 20 bp, Artificial
  CRISPR gRNA sequence
caaaaaggaaaaaaaaaaaa

SEQ ID NO: 171501 - DNA, 20 bp, Artificial
  CRISPR gRNA sequence
tcacatgcttcaacagacat

SEQ ID NO: 171502 - DNA, 20 bp, Artificial
  CRISPR gRNA sequence
caacagacatgctaagtgaa

SEQ ID NO: 171503 - DNA, 20 bp, Artificial
  CRISPR gRNA sequence
aacagacatgctaagtgaaa

SEQ ID NO: 171504 - DNA, 20 bp, Artificial
  CRISPR gRNA sequence
agtgaaataagataagacaa

SEQ ID NO: 171505 - DNA, 20 bp, Artificial
  CRISPR gRNA sequence
ttctacttacaatggggtta

SEQ ID NO: 171506 - DNA, 20 bp, Artificial
  CRISPR gRNA sequence
tacttacaatggggttacat

SEQ ID NO: 171507 - DNA, 20 bp, Artificial
  CRISPR gRNA sequence
cttacaatggggttacatcc

SEQ ID NO: 171508 - DNA, 20 bp, Artificial
  CRISPR gRNA sequence
acaatggggttacatcctga

SEQ ID NO: 171509 - DNA, 20 bp, Artificial
  CRISPR gRNA sequence
caatggggttacatcctgat

SEQ ID NO: 171510 - DNA, 20 bp, Artificial
  CRISPR gRNA sequence
catcctgataaagctattgt

SEQ ID NO: 171511 - DNA, 20 bp, Artificial
  CRISPR gRNA sequence
ataaagctattgttaagttg

SEQ ID NO: 171512 - DNA, 20 bp, Artificial
  CRISPR gRNA sequence
ttgttaagttgaaaagatcc

SEQ ID NO: 171513 - DNA, 20 bp, Artificial
  CRISPR gRNA sequence
ttaagttgaaaagatcctaa

SEQ ID NO: 171514 - DNA, 20 bp, Artificial
  CRISPR gRNA sequence
agttgaaaagatcctaagtt

SEQ ID NO: 171515 - DNA, 20 bp, Artificial
  CRISPR gRNA sequence
aaaagatcctaagttgaaaa

SEQ ID NO: 171516 - DNA, 20 bp, Artificial
  CRISPR gRNA sequence
agttgaaaatgcatttacta

SEQ ID NO: 171517 - DNA, 20 bp, Artificial
  CRISPR gRNA sequence
aaaatgcatttactacacct

SEQ ID NO: 171518 - DNA, 20 bp, Artificial
  CRISPR gRNA sequence
actacacctagcctatcaaa

SEQ ID NO: 171519 - DNA, 20 bp, Artificial
  CRISPR gRNA sequence
ctacacctagcctatcaaac

SEQ ID NO: 171520 - DNA, 20 bp, Artificial
  CRISPR gRNA sequence
cacctagcctatcaaacatc

SEQ ID NO: 171521 - DNA, 20 bp, Artificial
  CRISPR gRNA sequence
gcctatcaaacatcatagtt

SEQ ID NO: 171522 - DNA, 20 bp, Artificial
  CRISPR gRNA sequence
tcaaacatcatagttaagcc

SEQ ID NO: 171523 - DNA, 20 bp, Artificial
  CRISPR gRNA sequence
agcctcgcccaccttaaatg

SEQ ID NO: 171524 - DNA, 20 bp, Artificial
  CRISPR gRNA sequence
gcccaccttaaatgtgctca

SEQ ID NO: 171525 - DNA, 20 bp, Artificial
  CRISPR gRNA sequence
aaatgtgctcagaacactta

SEQ ID NO: 171526 - DNA, 20 bp, Artificial
  CRISPR gRNA sequence
aatgtgctcagaacacttac

SEQ ID NO: 171527 - DNA, 20 bp, Artificial
  CRISPR gRNA sequence
agaacacttacattagccta

SEQ ID NO: 171528 - DNA, 20 bp, Artificial
  CRISPR gRNA sequence
acattagcctaaagttgggc

SEQ ID NO: 171529 - DNA, 20 bp, Artificial
  CRISPR gRNA sequence
cattagcctaaagttgggca

SEQ ID NO: 171530 - DNA, 20 bp, Artificial
  CRISPR gRNA sequence
gcctaaagttgggcaaaata

SEQ ID NO: 171531 - DNA, 20 bp, Artificial
  CRISPR gRNA sequence
aagttgggcaaaataatata

SEQ ID NO: 171532 - DNA, 20 bp, Artificial
  CRISPR gRNA sequence
ggcaaaataatataacacaa

SEQ ID NO: 171533 - DNA, 20 bp, Artificial
  CRISPR gRNA sequence
ttttatagtaaagtgttgag

SEQ ID NO: 171534 - DNA, 20 bp, Artificial
  CRISPR gRNA sequence
tatagtaaagtgttgagtat

SEQ ID NO: 171535 - DNA, 20 bp, Artificial
  CRISPR gRNA sequence
atagtaaagtgttgagtatc

SEQ ID NO: 171536 - DNA, 20 bp, Artificial
  CRISPR gRNA sequence
tagtaaagtgttgagtatct

SEQ ID NO: 171537 - DNA, 20 bp, Artificial
  CRISPR gRNA sequence
agtatctcataatttattga

SEQ ID NO: 171538 - DNA, 20 bp, Artificial
  CRISPR gRNA sequence
ataatttattgaatactaga

SEQ ID NO: 171539 - DNA, 20 bp, Artificial
  CRISPR gRNA sequence
attgaatactagattgaaag

SEQ ID NO: 171540 - DNA, 20 bp, Artificial
  CRISPR gRNA sequence
ttgaatactagattgaaagc

SEQ ID NO: 171541 - DNA, 20 bp, Artificial
  CRISPR gRNA sequence
aatactagattgaaagcgaa

SEQ ID NO: 171542 - DNA, 20 bp, Artificial
  CRISPR gRNA sequence
gattgaaagcgaaaaacaga

SEQ ID NO: 171543 - DNA, 20 bp, Artificial
  CRISPR gRNA sequence
aaagcgaaaaacagaatggt

SEQ ID NO: 171544 - DNA, 20 bp, Artificial
  CRISPR gRNA sequence
aatgggtactcaaagtacaa

SEQ ID NO: 171545 - DNA, 20 bp, Artificial
  CRISPR gRNA sequence
aaagtacaactgctactgaa

SEQ ID NO: 171546 - DNA, 20 bp, Artificial
  CRISPR gRNA sequence
ctactgaatgcacatcgttt

SEQ ID NO: 171547 - DNA, 20 bp, Artificial
  CRISPR gRNA sequence
ctgaatgcacatcgttttct

SEQ ID NO: 171548 - DNA, 20 bp, Artificial
  CRISPR gRNA sequence
aatgcacatcgttttctaac

SEQ ID NO: 171549 - DNA, 20 bp, Artificial
  CRISPR gRNA sequence
tctaaccactgtaaagtgga

SEQ ID NO: 171550 - DNA, 20 bp, Artificial
  CRISPR gRNA sequence
ctaaccactgtaaagtggaa

SEQ ID NO: 171551 - DNA, 20 bp, Artificial
  CRISPR gRNA sequence
taaccactgtaaagtggaaa

SEQ ID NO: 171552 - DNA, 20 bp, Artificial
  CRISPR gRNA sequence
accactgtaaagtggaaaaa

SEQ ID NO: 171553 - DNA, 20 bp, Artificial
  CRISPR gRNA sequence
taaagtggaaaaaaaacatt

SEQ ID NO: 171554 - DNA, 20 bp, Artificial
  CRISPR gRNA sequence
agttgaatcattgtaagtag

SEQ ID NO: 171555 - DNA, 20 bp, Artificial
  CRISPR gRNA sequence
aatcattgtaagtaggggac

SEQ ID NO: 171556 - DNA, 20 bp, Artificial
  CRISPR gRNA sequence
taagtaggggactgtacgat

SEQ ID NO: 171557 - DNA, 20 bp, Artificial
  CRISPR gRNA sequence
tacgatatgatcccacttct

SEQ ID NO: 171558 - DNA, 20 bp, Artificial
  CRISPR gRNA sequence
ctatgaggtatcaaaaatag

SEQ ID NO: 171559 - DNA, 20 bp, Artificial
  CRISPR gRNA sequence
tatgaggtatcaaaaatagt

SEQ ID NO: 171560 - DNA, 20 bp, Artificial
  CRISPR gRNA sequence
tgaggtatcaaaaatagtca

SEQ ID NO: 171561 - DNA, 20 bp, Artificial
  CRISPR gRNA sequence
atagaaagcagaatggtggc

SEQ ID NO: 171562 - DNA, 20 bp, Artificial
  CRISPR gRNA sequence
tttattgagtgcacagtttc

SEQ ID NO: 171563 - DNA, 20 bp, Artificial
  CRISPR gRNA sequence
attgagtgcacagtttcagt

SEQ ID NO: 171564 - DNA, 20 bp, Artificial
  CRISPR gRNA sequence
ttgagtgcacagtttcagta

SEQ ID NO: 171565 - DNA, 20 bp, Artificial
  CRISPR gRNA sequence
agtgcacagtttcagtactg

SEQ ID NO: 171566 - DNA, 20 bp, Artificial
  CRISPR gRNA sequence
cagtactgcaatatgaaaaa

SEQ ID NO: 171567 - DNA, 20 bp, Artificial
  CRISPR gRNA sequence
agtactgcaatatgaaaaaa

SEQ ID NO: 171568 - DNA, 20 bp, Artificial
  CRISPR gRNA sequence
caatatgaaaaaattctcaa

SEQ ID NO: 171569 - DNA, 20 bp, Artificial
  CRISPR gRNA sequence
tcaaggtaagttccataaca

SEQ ID NO: 171570 - DNA, 20 bp, Artificial
  CRISPR gRNA sequence
aaggtaagttccataacaat

SEQ ID NO: 171571 - DNA, 20 bp, Artificial
  CRISPR gRNA sequence
cataacaatgtgattatact

SEQ ID NO: 171572 - DNA, 20 bp, Artificial
  CRISPR gRNA sequence
tacttaacacttctgaactg

SEQ ID NO: 171573 - DNA, 20 bp, Artificial
  CRISPR gRNA sequence
aacacttctgaactgtacat

SEQ ID NO: 171574 - DNA, 20 bp, Artificial
  CRISPR gRNA sequence
acacttctgaactgtacatt

SEQ ID NO: 171575 - DNA, 20 bp, Artificial
  CRISPR gRNA sequence
ctgaactgtacatttaaaaa

SEQ ID NO: 171576 - DNA, 20 bp, Artificial
  CRISPR gRNA sequence
tgaactgtacatttaaaaat

SEQ ID NO: 171577 - DNA, 20 bp, Artificial
  CRISPR gRNA sequence
aactgtacatttaaaaatgg

SEQ ID NO: 171578 - DNA, 20 bp, Artificial
  CRISPR gRNA sequence
tacatttaaaaatggataag

SEQ ID NO: 171579 - DNA, 20 bp, Artificial
  CRISPR gRNA sequence
aaaaatggataaggggcgaa

SEQ ID NO: 171580 - DNA, 20 bp, Artificial
  CRISPR gRNA sequence
aaaatggataaggggcgaaa

SEQ ID NO: 171581 - DNA, 20 bp, Artificial
  CRISPR gRNA sequence
tatgtgtttttttactacaa

SEQ ID NO: 171582 - DNA, 20 bp, Artificial
  CRISPR gRNA sequence
atgtgtttttttactacaac

SEQ ID NO: 171583 - DNA, 20 bp, Artificial
  CRISPR gRNA sequence
tgtgtttttttactacaact

SEQ ID NO: 171584 - DNA, 20 bp, Artificial
  CRISPR gRNA sequence
ttttactacaactaaaaaaa

SEQ ID NO: 171585 - DNA, 20 bp, Artificial
  CRISPR gRNA sequence
tttactacaactaaaaaaaa

SEQ ID NO: 171586 - DNA, 20 bp, Artificial
  CRISPR gRNA sequence
ttactacaactaaaaaaaaa

SEQ ID NO: 171587 - DNA, 20 bp, Artificial
  CRISPR gRNA sequence
tactacaactaaaaaaaaaa

SEQ ID NO: 171588 - DNA, 20 bp, Artificial
  CRISPR gRNA sequence
actacaactaaaaaaaaaaa

SEQ ID NO: 171589 - DNA, 20 bp, Artificial
  CRISPR gRNA sequence
ctacaactaaaaaaaaaaaa

SEQ ID NO: 171590 - DNA, 20 bp, Artificial
  CRISPR gRNA sequence
caactaaaaaaaaaaaaaaa

SEQ ID NO: 171591 - DNA, 20 bp, Artificial
  CRISPR gRNA sequence
aaaaaaaaaaaaaatcaaag

SEQ ID NO: 171592 - DNA, 20 bp, Artificial
  CRISPR gRNA sequence
agtgctgagcttaaacctcc

SEQ ID NO: 171593 - DNA, 20 bp, Artificial
  CRISPR gRNA sequence
agcttaaacctccagagttt

SEQ ID NO: 171594 - DNA, 20 bp, Artificial
  CRISPR gRNA sequence
aaacctccagagtttatctg

SEQ ID NO: 171595 - DNA, 20 bp, Artificial
  CRISPR gRNA sequence
aacctccagagtttatctgg

SEQ ID NO: 171596 - DNA, 20 bp, Artificial
  CRISPR gRNA sequence
cagagtttatctggccactt

SEQ ID NO: 171597 - DNA, 20 bp, Artificial
  CRISPR gRNA sequence
atctggccacttgcctgatc

SEQ ID NO: 171598 - DNA, 20 bp, Artificial
  CRISPR gRNA sequence
tctggccacttgcctgatcc

SEQ ID NO: 171599 - DNA, 20 bp, Artificial
  CRISPR gRNA sequence
gccacttgcctgatcctgga

SEQ ID NO: 171600 - DNA, 20 bp, Artificial
  CRISPR gRNA sequence
gcctgatcctggatttatgc

SEQ ID NO: 171601 - DNA, 20 bp, Artificial
  CRISPR gRNA sequence
cctgatcctggatttatgcc

SEQ ID NO: 171602 - DNA, 20 bp, Artificial
  CRISPR gRNA sequence
atcctggatttatgcctctc

SEQ ID NO: 171603 - DNA, 20 bp, Artificial
  CRISPR gRNA sequence
gatttatgcctctcggctca

SEQ ID NO: 171604 - DNA, 20 bp, Artificial
  CRISPR gRNA sequence
atgcctctcggctcaagctg

SEQ ID NO: 171605 - DNA, 20 bp, Artificial
  CRISPR gRNA sequence
tgcctctcggctcaagctgc

SEQ ID NO: 171606 - DNA, 20 bp, Artificial
  CRISPR gRNA sequence
tcggctcaagctgcggcaca

SEQ ID NO: 171607 - DNA, 20 bp, Artificial
  CRISPR gRNA sequence
ggctcaagctgcggcacaga

SEQ ID NO: 171608 - DNA, 20 bp, Artificial
  CRISPR gRNA sequence
aagctgcggcacagacttgc

SEQ ID NO: 171609 - DNA, 20 bp, Artificial
  CRISPR gRNA sequence
cggcacagacttgctcgatt

SEQ ID NO: 171610 - DNA, 20 bp, Artificial
  CRISPR gRNA sequence
gctcgattggcctagtccca

SEQ ID NO: 171611 - DNA, 20 bp, Artificial
  CRISPR gRNA sequence
ctcgattggcctagtcccac

SEQ ID NO: 171612 - DNA, 20 bp, Artificial
  CRISPR gRNA sequence
gattggcctagtcccaccac

SEQ ID NO: 171613 - DNA, 20 bp, Artificial
  CRISPR gRNA sequence
gcctagtcccaccacacccc

SEQ ID NO: 171614 - DNA, 20 bp, Artificial
  CRISPR gRNA sequence
gtcccaccacaccccaggac

SEQ ID NO: 171615 - DNA, 20 bp, Artificial
  CRISPR gRNA sequence
attttacaccaagctgaccc

SEQ ID NO: 171616 - DNA, 20 bp, Artificial
  CRISPR gRNA sequence
tacaccaagctgaccccagc

SEQ ID NO: 171617 - DNA, 20 bp, Artificial
  CRISPR gRNA sequence
acaccaagctgaccccagca

SEQ ID NO: 171618 - DNA, 20 bp, Artificial
  CRISPR gRNA sequence
caccaagctgaccccagcac

SEQ ID NO: 171619 - DNA, 20 bp, Artificial
  CRISPR gRNA sequence
accccagcaccaaaagctga

SEQ ID NO: 171620 - DNA, 20 bp, Artificial
  CRISPR gRNA sequence
ataagcttaatcatgagatt

SEQ ID NO: 171621 - DNA, 20 bp, Artificial
  CRISPR gRNA sequence
aatcatgagattaaccccct

SEQ ID NO: 171622 - DNA, 20 bp, Artificial
  CRISPR gRNA sequence
atcatgagattaacccccta

SEQ ID NO: 171623 - DNA, 20 bp, Artificial
  CRISPR gRNA sequence
accccctaaaatatgaacaa

SEQ ID NO: 171624 - DNA, 20 bp, Artificial
  CRISPR gRNA sequence
aaatatgaacaaaacacccc

SEQ ID NO: 171625 - DNA, 20 bp, Artificial
  CRISPR gRNA sequence
ttgactttatcatttcattt

SEQ ID NO: 171626 - DNA, 20 bp, Artificial
  CRISPR gRNA sequence
tgactttatcatttcattta

SEQ ID NO: 171627 - DNA, 20 bp, Artificial
  CRISPR gRNA sequence
gactttatcatttcatttat

SEQ ID NO: 171628 - DNA, 20 bp, Artificial
  CRISPR gRNA sequence
actttatcatttcatttatt

SEQ ID NO: 171629 - DNA, 20 bp, Artificial
  CRISPR gRNA sequence
tatcatttcatttattcctc

SEQ ID NO: 171630 - DNA, 20 bp, Artificial
  CRISPR gRNA sequence
atcatttcatttattcctcc

SEQ ID NO: 171631 - DNA, 20 bp, Artificial
  CRISPR gRNA sequence
tcatttcatttattcctccc

SEQ ID NO: 171632 - DNA, 20 bp, Artificial
  CRISPR gRNA sequence
catttattcctcccttctct

SEQ ID NO: 171633 - DNA, 20 bp, Artificial
  CRISPR gRNA sequence
atttattcctcccttctctt

SEQ ID NO: 171634 - DNA, 20 bp, Artificial
  CRISPR gRNA sequence
attcctcccttctctttcat

SEQ ID NO: 171635 - DNA, 20 bp, Artificial
  CRISPR gRNA sequence
ttcctcccttctctttcata

SEQ ID NO: 171636 - DNA, 20 bp, Artificial
  CRISPR gRNA sequence
ctcccttctctttcatatct

SEQ ID NO: 171637 - DNA, 20 bp, Artificial
  CRISPR gRNA sequence
ccttctctttcatatctgag

SEQ ID NO: 171638 - DNA, 20 bp, Artificial
  CRISPR gRNA sequence
ctctttcatatctgagacag

SEQ ID NO: 171639 - DNA, 20 bp, Artificial
  CRISPR gRNA sequence
tctttcatatctgagacagt

SEQ ID NO: 171640 - DNA, 20 bp, Artificial
  CRISPR gRNA sequence
tttcatatctgagacagttt

SEQ ID NO: 171641 - DNA, 20 bp, Artificial
  CRISPR gRNA sequence
tcatatctgagacagtttag

SEQ ID NO: 171642 - DNA, 20 bp, Artificial
  CRISPR gRNA sequence
catatctgagacagtttaga

SEQ ID NO: 171643 - DNA, 20 bp, Artificial
  CRISPR gRNA sequence
atatctgagacagtttagat

SEQ ID NO: 171644 - DNA, 20 bp, Artificial
  CRISPR gRNA sequence
agacagtttagataactact

SEQ ID NO: 171645 - DNA, 20 bp, Artificial
  CRISPR gRNA sequence
agataactactaccttagac

SEQ ID NO: 171646 - DNA, 20 bp, Artificial
  CRISPR gRNA sequence
gataactactaccttagact

SEQ ID NO: 171647 - DNA, 20 bp, Artificial
  CRISPR gRNA sequence
ctaccttagactgcagaaga

SEQ ID NO: 171648 - DNA, 20 bp, Artificial
  CRISPR gRNA sequence
ccttagactgcagaagagga

SEQ ID NO: 171649 - DNA, 20 bp, Artificial
  CRISPR gRNA sequence
agactgcagaagaggaacaa

SEQ ID NO: 171650 - DNA, 20 bp, Artificial
  CRISPR gRNA sequence
gactgcagaagaggaacaat

SEQ ID NO: 171651 - DNA, 20 bp, Artificial
  CRISPR gRNA sequence
cagaagaggaacaatgactt

SEQ ID NO: 171652 - DNA, 20 bp, Artificial
  CRISPR gRNA sequence
ttcagtggaaatccactctg

SEQ ID NO: 171653 - DNA, 20 bp, Artificial
  CRISPR gRNA sequence
tcagtggaaatccactctga

SEQ ID NO: 171654 - DNA, 20 bp, Artificial
  CRISPR gRNA sequence
cagtggaaatccactctgaa

SEQ ID NO: 171655 - DNA, 20 bp, Artificial
  CRISPR gRNA sequence
agtggaaatccactctgaac

SEQ ID NO: 171656 - DNA, 20 bp, Artificial
  CRISPR gRNA sequence
tgaacccaggccagtctgag

SEQ ID NO: 171657 - DNA, 20 bp, Artificial
  CRISPR gRNA sequence
aacccaggccagtctgagaa

SEQ ID NO: 171658 - DNA, 20 bp, Artificial
  CRISPR gRNA sequence
agaaaggctaagccaagttc

SEQ ID NO: 171659 - DNA, 20 bp, Artificial
  CRISPR gRNA sequence
agccaagttcaactgctgaa

SEQ ID NO: 171660 - DNA, 20 bp, Artificial
  CRISPR gRNA sequence
aactgctgaaaactcttcat

SEQ ID NO: 171661 - DNA, 20 bp, Artificial
  CRISPR gRNA sequence
ctgaaaactcttcatataaa

SEQ ID NO: 171662 - DNA, 20 bp, Artificial
  CRISPR gRNA sequence
aaaactcttcatataaacaa

SEQ ID NO: 171663 - DNA, 20 bp, Artificial
  CRISPR gRNA sequence
ttcatataaacaaacatgac

SEQ ID NO: 171664 - DNA, 20 bp, Artificial
  CRISPR gRNA sequence
catataaacaaacatgaccc

SEQ ID NO: 171665 - DNA, 20 bp, Artificial
  CRISPR gRNA sequence
atataaacaaacatgaccca

SEQ ID NO: 171666 - DNA, 20 bp, Artificial
  CRISPR gRNA sequence
ctttttatccctgaagtcag

SEQ ID NO: 171667 - DNA, 20 bp, Artificial
  CRISPR gRNA sequence
tttatccctgaagtcagtgg

SEQ ID NO: 171668 - DNA, 20 bp, Artificial
  CRISPR gRNA sequence
ttatccctgaagtcagtggg

SEQ ID NO: 171669 - DNA, 20 bp, Artificial
  CRISPR gRNA sequence
tatccctgaagtcagtgggc

SEQ ID NO: 171670 - DNA, 20 bp, Artificial
  CRISPR gRNA sequence
atccctgaagtcagtgggca

SEQ ID NO: 171671 - DNA, 20 bp, Artificial
  CRISPR gRNA sequence
tccctgaagtcagtgggcat

SEQ ID NO: 171672 - DNA, 20 bp, Artificial
  CRISPR gRNA sequence
aagtcagtgggcatttatca

SEQ ID NO: 171673 - DNA, 20 bp, Artificial
  CRISPR gRNA sequence
atcataataagttatttcat

SEQ ID NO: 171674 - DNA, 20 bp, Artificial
  CRISPR gRNA sequence
tcataataagttatttcatt

SEQ ID NO: 171675 - DNA, 20 bp, Artificial
  CRISPR gRNA sequence
tttcatttcattaattactt

SEQ ID NO: 171676 - DNA, 20 bp, Artificial
  CRISPR gRNA sequence
catttcattaattacttgtt

SEQ ID NO: 171677 - DNA, 20 bp, Artificial
  CRISPR gRNA sequence
atttcattaattacttgttt

SEQ ID NO: 171678 - DNA, 20 bp, Artificial
  CRISPR gRNA sequence
cattaattacttgtttatta

SEQ ID NO: 171679 - DNA, 20 bp, Artificial
  CRISPR gRNA sequence
attaattacttgtttattag

SEQ ID NO: 171680 - DNA, 20 bp, Artificial
  CRISPR gRNA sequence
attacttgtttattagcctg

SEQ ID NO: 171681 - DNA, 20 bp, Artificial
  CRISPR gRNA sequence
cttgtttattagcctgtctc

SEQ ID NO: 171682 - DNA, 20 bp, Artificial
  CRISPR gRNA sequence
gtttattagcctgtctcatc

SEQ ID NO: 171683 - DNA, 20 bp, Artificial
  CRISPR gRNA sequence
tttattagcctgtctcatca

SEQ ID NO: 171684 - DNA, 20 bp, Artificial
  CRISPR gRNA sequence
attagcctgtctcatcagaa

SEQ ID NO: 171685 - DNA, 20 bp, Artificial
  CRISPR gRNA sequence
ttagcctgtctcatcagaat

SEQ ID NO: 171686 - DNA, 20 bp, Artificial
  CRISPR gRNA sequence
gcctgtctcatcagaatata

SEQ ID NO: 171687 - DNA, 20 bp, Artificial
  CRISPR gRNA sequence
tctcatcagaatatatgttc

SEQ ID NO: 171688 - DNA, 20 bp, Artificial
  CRISPR gRNA sequence
atcagaatatatgttccatg

SEQ ID NO: 171689 - DNA, 20 bp, Artificial
  CRISPR gRNA sequence
catgagcgcaatgatcctgt

SEQ ID NO: 171690 - DNA, 20 bp, Artificial
  CRISPR gRNA sequence
tctgtctggttcattactgt

SEQ ID NO: 171691 - DNA, 20 bp, Artificial
  CRISPR gRNA sequence
tctggttcattactgtatcc

SEQ ID NO: 171692 - DNA, 20 bp, Artificial
  CRISPR gRNA sequence
gttcattactgtatccacag

SEQ ID NO: 171693 - DNA, 20 bp, Artificial
  CRISPR gRNA sequence
attactgtatccacagtatc

SEQ ID NO: 171694 - DNA, 20 bp, Artificial
  CRISPR gRNA sequence
ctgtatccacagtatctagc

SEQ ID NO: 171695 - DNA, 20 bp, Artificial
  CRISPR gRNA sequence
tatccacagtatctagcata

SEQ ID NO: 171696 - DNA, 20 bp, Artificial
  CRISPR gRNA sequence
gcatagccttagttggtaca

SEQ ID NO: 171697 - DNA, 20 bp, Artificial
  CRISPR gRNA sequence
agttggtacataataagtat

SEQ ID NO: 171698 - DNA, 20 bp, Artificial
  CRISPR gRNA sequence
gttggtacataataagtatt

SEQ ID NO: 171699 - DNA, 20 bp, Artificial
  CRISPR gRNA sequence
gtacataataagtatttgtt

SEQ ID NO: 171700 - DNA, 20 bp, Artificial
  CRISPR gRNA sequence
gttgagtgaatgaataaact

SEQ ID NO: 171701 - DNA, 20 bp, Artificial
  CRISPR gRNA sequence
ttgagtgaatgaataaactg

SEQ ID NO: 171702 - DNA, 20 bp, Artificial
  CRISPR gRNA sequence
agtgaatgaataaactgaca

SEQ ID NO: 171703 - DNA, 20 bp, Artificial
  CRISPR gRNA sequence
acattgtaacgtcagaagtt

SEQ ID NO: 171704 - DNA, 20 bp, Artificial
  CRISPR gRNA sequence
taacgtcagaagttaaaggt

SEQ ID NO: 171705 - DNA, 20 bp, Artificial
  CRISPR gRNA sequence
aaggtcactaaccttaagca

SEQ ID NO: 171706 - DNA, 20 bp, Artificial
  CRISPR gRNA sequence
accttaagcaattgcaacat

SEQ ID NO: 171707 - DNA, 20 bp, Artificial
  CRISPR gRNA sequence
aagcaattgcaacattaatt

SEQ ID NO: 171708 - DNA, 20 bp, Artificial
  CRISPR gRNA sequence
agcaattgcaacattaattc

SEQ ID NO: 171709 - DNA, 20 bp, Artificial
  CRISPR gRNA sequence
caacattaattctacatcag

SEQ ID NO: 171710 - DNA, 20 bp, Artificial
  CRISPR gRNA sequence
attctacatcaggaaggaat

SEQ ID NO: 171711 - DNA, 20 bp, Artificial
  CRISPR gRNA sequence
tacatcaggaaggaatccag

SEQ ID NO: 171712 - DNA, 20 bp, Artificial
  CRISPR gRNA sequence
catcaggaaggaatccagtg

SEQ ID NO: 171713 - DNA, 20 bp, Artificial
  CRISPR gRNA sequence
ctctgccaggatgctagtat

SEQ ID NO: 171714 - DNA, 20 bp, Artificial
  CRISPR gRNA sequence
tgccaggatgctagtatttc

SEQ ID NO: 171715 - DNA, 20 bp, Artificial
  CRISPR gRNA sequence
ccaggatgctagtatttcca

SEQ ID NO: 171716 - DNA, 20 bp, Artificial
  CRISPR gRNA sequence
gtatttccagggcaggaatg

SEQ ID NO: 171717 - DNA, 20 bp, Artificial
  CRISPR gRNA sequence
ccagggcaggaatgacacag

SEQ ID NO: 171718 - DNA, 20 bp, Artificial
  CRISPR gRNA sequence
cagggcaggaatgacacagc

SEQ ID NO: 171719 - DNA, 20 bp, Artificial
  CRISPR gRNA sequence
ctttagtatgtgctaaaatg

SEQ ID NO: 171720 - DNA, 20 bp, Artificial
  CRISPR gRNA sequence
tagtatgtgctaaaatgaca

SEQ ID NO: 171721 - DNA, 20 bp, Artificial
  CRISPR gRNA sequence
agtatgtgctaaaatgacac

SEQ ID NO: 171722 - DNA, 20 bp, Artificial
  CRISPR gRNA sequence
gtatgtgctaaaatgacacc

SEQ ID NO: 171723 - DNA, 20 bp, Artificial
  CRISPR gRNA sequence
aaatgacaccttaatgaaca

SEQ ID NO: 171724 - DNA, 20 bp, Artificial
  CRISPR gRNA sequence
aatgaacattcttcattaag

SEQ ID NO: 171725 - DNA, 20 bp, Artificial
  CRISPR gRNA sequence
atgaacattcttcattaagg

SEQ ID NO: 171726 - DNA, 20 bp, Artificial
  CRISPR gRNA sequence
ttcattaaggacatgacaac

SEQ ID NO: 171727 - DNA, 20 bp, Artificial
  CRISPR gRNA sequence
cattaaggacatgacaactg

SEQ ID NO: 171728 - DNA, 20 bp, Artificial
  CRISPR gRNA sequence
attaaggacatgacaactgt

SEQ ID NO: 171729 - DNA, 20 bp, Artificial
  CRISPR gRNA sequence
aggacatgacaactgtatta

SEQ ID NO: 171730 - DNA, 20 bp, Artificial
  CRISPR gRNA sequence
tattatgaaaatattccaac

SEQ ID NO: 171731 - DNA, 20 bp, Artificial
  CRISPR gRNA sequence
tgaaaatattccaactctaa

SEQ ID NO: 171732 - DNA, 20 bp, Artificial
  CRISPR gRNA sequence
caactctaacctgtctcacc

SEQ ID NO: 171733 - DNA, 20 bp, Artificial
  CRISPR gRNA sequence
taacctgtctcaccttccac

SEQ ID NO: 171734 - DNA, 20 bp, Artificial
  CRISPR gRNA sequence
acctgtctcaccttccacta

SEQ ID NO: 171735 - DNA, 20 bp, Artificial
  CRISPR gRNA sequence
tctcaccttccactaccact

SEQ ID NO: 171736 - DNA, 20 bp, Artificial
  CRISPR gRNA sequence
accttccactaccactctca

SEQ ID NO: 171737 - DNA, 20 bp, Artificial
  CRISPR gRNA sequence
ccactaccactctcatacca

SEQ ID NO: 171738 - DNA, 20 bp, Artificial
  CRISPR gRNA sequence
cactaccactctcataccac

SEQ ID NO: 171739 - DNA, 20 bp, Artificial
  CRISPR gRNA sequence
ccactctcataccacatact

SEQ ID NO: 171740 - DNA, 20 bp, Artificial
  CRISPR gRNA sequence
tcataccacatacttactcc

SEQ ID NO: 171741 - DNA, 20 bp, Artificial
  CRISPR gRNA sequence
ataccacatacttactcctt

SEQ ID NO: 171742 - DNA, 20 bp, Artificial
  CRISPR gRNA sequence
actccttccctcaacctcca

SEQ ID NO: 171743 - DNA, 20 bp, Artificial
  CRISPR gRNA sequence
ctccttccctcaacctccac

SEQ ID NO: 171744 - DNA, 20 bp, Artificial
  CRISPR gRNA sequence
cttccctcaacctccactaa

SEQ ID NO: 171745 - DNA, 20 bp, Artificial
  CRISPR gRNA sequence
ccctcaacctccactaaaca

SEQ ID NO: 171746 - DNA, 20 bp, Artificial
  CRISPR gRNA sequence
cctcaacctccactaaacac

SEQ ID NO: 171747 - DNA, 20 bp, Artificial
  CRISPR gRNA sequence
aacctccactaaacacacag

SEQ ID NO: 171748 - DNA, 20 bp, Artificial
  CRISPR gRNA sequence
cactaaacacacagtaacct

SEQ ID NO: 171749 - DNA, 20 bp, Artificial
  CRISPR gRNA sequence
aacacacagtaacctccagg

SEQ ID NO: 171750 - DNA, 20 bp, Artificial
  CRISPR gRNA sequence
caggcactctgaatgtcttg

SEQ ID NO: 171751 - DNA, 20 bp, Artificial
  CRISPR gRNA sequence
tgaatgtcttgatgttcccc

SEQ ID NO: 171752 - DNA, 20 bp, Artificial
  CRISPR gRNA sequence
aatgtcttgatgttccccta

SEQ ID NO: 171753 - DNA, 20 bp, Artificial
  CRISPR gRNA sequence
gatgttcccctaactacaag

SEQ ID NO: 171754 - DNA, 20 bp, Artificial
  CRISPR gRNA sequence
atgttcccctaactacaagg

SEQ ID NO: 171755 - DNA, 20 bp, Artificial
  CRISPR gRNA sequence
ccctaactacaaggtcctct

SEQ ID NO: 171756 - DNA, 20 bp, Artificial
  CRISPR gRNA sequence
actacaaggtcctctctggg

SEQ ID NO: 171757 - DNA, 20 bp, Artificial
  CRISPR gRNA sequence
caaggtcctctctgggcctc

SEQ ID NO: 171758 - DNA, 20 bp, Artificial
  CRISPR gRNA sequence
tctgggcctccatgccttta

SEQ ID NO: 171759 - DNA, 20 bp, Artificial
  CRISPR gRNA sequence
tgggcctccatgcctttatg

SEQ ID NO: 171760 - DNA, 20 bp, Artificial
  CRISPR gRNA sequence
ggcctccatgcctttatgca

SEQ ID NO: 171761 - DNA, 20 bp, Artificial
  CRISPR gRNA sequence
catgcctttatgcatgccct

SEQ ID NO: 171762 - DNA, 20 bp, Artificial
  CRISPR gRNA sequence
tatgcatgcccttgtctttg

SEQ ID NO: 171763 - DNA, 20 bp, Artificial
  CRISPR gRNA sequence
atgcatgcccttgtctttgc

SEQ ID NO: 171764 - DNA, 20 bp, Artificial
  CRISPR gRNA sequence
tgcatgcccttgtctttgcc

SEQ ID NO: 171765 - DNA, 20 bp, Artificial
  CRISPR gRNA sequence
gtctttgccctcccatcctt

SEQ ID NO: 171766 - DNA, 20 bp, Artificial
  CRISPR gRNA sequence
tctttgccctcccatccttc

SEQ ID NO: 171767 - DNA, 20 bp, Artificial
  CRISPR gRNA sequence
tgccctcccatccttcacat

SEQ ID NO: 171768 - DNA, 20 bp, Artificial
  CRISPR gRNA sequence
gccctcccatccttcacatc

SEQ ID NO: 171769 - DNA, 20 bp, Artificial
  CRISPR gRNA sequence
ccctcccatccttcacatct

SEQ ID NO: 171770 - DNA, 20 bp, Artificial
  CRISPR gRNA sequence
ccatccttcacatctggtga

SEQ ID NO: 171771 - DNA, 20 bp, Artificial
  CRISPR gRNA sequence
cacatctggtgaatgcttac

SEQ ID NO: 171772 - DNA, 20 bp, Artificial
  CRISPR gRNA sequence
acatctggtgaatgcttact

SEQ ID NO: 171773 - DNA, 20 bp, Artificial
  CRISPR gRNA sequence
gtgaatgcttactcatattt

SEQ ID NO: 171774 - DNA, 20 bp, Artificial
  CRISPR gRNA sequence
actcatattttaagactcaa

SEQ ID NO: 171775 - DNA, 20 bp, Artificial
  CRISPR gRNA sequence
ctcatattttaagactcaac

SEQ ID NO: 171776 - DNA, 20 bp, Artificial
  CRISPR gRNA sequence
atattttaagactcaacaaa

SEQ ID NO: 171777 - DNA, 20 bp, Artificial
  CRISPR gRNA sequence
taagactcaacaaaaatgtt

SEQ ID NO: 171778 - DNA, 20 bp, Artificial
  CRISPR gRNA sequence
aagactcaacaaaaatgttc

SEQ ID NO: 171779 - DNA, 20 bp, Artificial
  CRISPR gRNA sequence
agactcaacaaaaatgttcc

SEQ ID NO: 171780 - DNA, 20 bp, Artificial
  CRISPR gRNA sequence
aacaaaaatgttccctttac

SEQ ID NO: 171781 - DNA, 20 bp, Artificial
  CRISPR gRNA sequence
cctttacttaaactcaacca

SEQ ID NO: 171782 - DNA, 20 bp, Artificial
  CRISPR gRNA sequence
tacttaaactcaaccagaaa

SEQ ID NO: 171783 - DNA, 20 bp, Artificial
  CRISPR gRNA sequence
acttaaactcaaccagaaag

SEQ ID NO: 171784 - DNA, 20 bp, Artificial
  CRISPR gRNA sequence
cttaaactcaaccagaaaga

SEQ ID NO: 171785 - DNA, 20 bp, Artificial
  CRISPR gRNA sequence
aaactcaaccagaaagaatc

SEQ ID NO: 171786 - DNA, 20 bp, Artificial
  CRISPR gRNA sequence
aactcaaccagaaagaatca

SEQ ID NO: 171787 - DNA, 20 bp, Artificial
  CRISPR gRNA sequence
aaccagaaagaatcaagcac

SEQ ID NO: 171788 - DNA, 20 bp, Artificial
  CRISPR gRNA sequence
tgtcctctgtgctccttgac

SEQ ID NO: 171789 - DNA, 20 bp, Artificial
  CRISPR gRNA sequence
tgtgctccttgacttttact

SEQ ID NO: 171790 - DNA, 20 bp, Artificial
  CRISPR gRNA sequence
tgctccttgacttttactgc

SEQ ID NO: 171791 - DNA, 20 bp, Artificial
  CRISPR gRNA sequence
cttgacttttactgcttcag

SEQ ID NO: 171792 - DNA, 20 bp, Artificial
  CRISPR gRNA sequence
gacttttactgcttcaggac

SEQ ID NO: 171793 - DNA, 20 bp, Artificial
  CRISPR gRNA sequence
acttttactgcttcaggact

SEQ ID NO: 171794 - DNA, 20 bp, Artificial
  CRISPR gRNA sequence
ttactgcttcaggactcatc

SEQ ID NO: 171795 - DNA, 20 bp, Artificial
  CRISPR gRNA sequence
tactgcttcaggactcatca

SEQ ID NO: 171796 - DNA, 20 bp, Artificial
  CRISPR gRNA sequence
actgcttcaggactcatcac

SEQ ID NO: 171797 - DNA, 20 bp, Artificial
  CRISPR gRNA sequence
ctgcttcaggactcatcact

SEQ ID NO: 171798 - DNA, 20 bp, Artificial
  CRISPR gRNA sequence
cttcaggactcatcactgtg

SEQ ID NO: 171799 - DNA, 20 bp, Artificial
  CRISPR gRNA sequence
caggactcatcactgtgcct

SEQ ID NO: 171800 - DNA, 20 bp, Artificial
  CRISPR gRNA sequence
aggactcatcactgtgcctg

SEQ ID NO: 171801 - DNA, 20 bp, Artificial
  CRISPR gRNA sequence
atcactgtgcctgattcagt

SEQ ID NO: 171802 - DNA, 20 bp, Artificial
  CRISPR gRNA sequence
tgcctgattcagtaagtact

SEQ ID NO: 171803 - DNA, 20 bp, Artificial
  CRISPR gRNA sequence
attcagtaagtacttagtaa

SEQ ID NO: 171804 - DNA, 20 bp, Artificial
  CRISPR gRNA sequence
agtaagtacttagtaaatac

SEQ ID NO: 171805 - DNA, 20 bp, Artificial
  CRISPR gRNA sequence
agtaaatacctactgactaa

SEQ ID NO: 171806 - DNA, 20 bp, Artificial
  CRISPR gRNA sequence
gtaaatacctactgactaaa

SEQ ID NO: 171807 - DNA, 20 bp, Artificial
  CRISPR gRNA sequence
ctgactaaattattctggtt

SEQ ID NO: 171808 - DNA, 20 bp, Artificial
  CRISPR gRNA sequence
actaaattattctggttgta

SEQ ID NO: 171809 - DNA, 20 bp, Artificial
  CRISPR gRNA sequence
aattattctggttgtaatta

SEQ ID NO: 171810 - DNA, 20 bp, Artificial
  CRISPR gRNA sequence
ttctggttgtaattactaga

SEQ ID NO: 171811 - DNA, 20 bp, Artificial
  CRISPR gRNA sequence
tggttgtaattactagattg

SEQ ID NO: 171812 - DNA, 20 bp, Artificial
  CRISPR gRNA sequence
gttgtaattactagattgta

SEQ ID NO: 171813 - DNA, 20 bp, Artificial
  CRISPR gRNA sequence
taattactagattgtaagct

SEQ ID NO: 171814 - DNA, 20 bp, Artificial
  CRISPR gRNA sequence
ctagattgtaagctcctcac

SEQ ID NO: 171815 - DNA, 20 bp, Artificial
  CRISPR gRNA sequence
gattgtaagctcctcacagg

SEQ ID NO: 171816 - DNA, 20 bp, Artificial
  CRISPR gRNA sequence
taagctcctcacaggccgag

SEQ ID NO: 171817 - DNA, 20 bp, Artificial
  CRISPR gRNA sequence
ctcacaggccgaggttatat

SEQ ID NO: 171818 - DNA, 20 bp, Artificial
  CRISPR gRNA sequence
acaggccgaggttatattta

SEQ ID NO: 171819 - DNA, 20 bp, Artificial
  CRISPR gRNA sequence
tatttaattattctgagtca

SEQ ID NO: 171820 - DNA, 20 bp, Artificial
  CRISPR gRNA sequence
aattattctgagtcagtagt

SEQ ID NO: 171821 - DNA, 20 bp, Artificial
  CRISPR gRNA sequence
attattctgagtcagtagtt

SEQ ID NO: 171822 - DNA, 20 bp, Artificial
  CRISPR gRNA sequence
ttctgagtcagtagttctca

SEQ ID NO: 171823 - DNA, 20 bp, Artificial
  CRISPR gRNA sequence
tgagtcagtagttctcaaca

SEQ ID NO: 171824 - DNA, 20 bp, Artificial
  CRISPR gRNA sequence
agtcagtagttctcaacaag

SEQ ID NO: 171825 - DNA, 20 bp, Artificial
  CRISPR gRNA sequence
tcaacaagggatgatttttg

SEQ ID NO: 171826 - DNA, 20 bp, Artificial
  CRISPR gRNA sequence
aacaagggatgatttttgcc

SEQ ID NO: 171827 - DNA, 20 bp, Artificial
  CRISPR gRNA sequence
ttgcccatggggacatttgc

SEQ ID NO: 171828 - DNA, 20 bp, Artificial
  CRISPR gRNA sequence
tgcccatggggacatttgcc

SEQ ID NO: 171829 - DNA, 20 bp, Artificial
  CRISPR gRNA sequence
gcccatggggacatttgcca

SEQ ID NO: 171830 - DNA, 20 bp, Artificial
  CRISPR gRNA sequence
cccatggggacatttgccaa

SEQ ID NO: 171831 - DNA, 20 bp, Artificial
  CRISPR gRNA sequence
gccaatgtctggagacattt

SEQ ID NO: 171832 - DNA, 20 bp, Artificial
  CRISPR gRNA sequence
ccaatgtctggagacatttt

SEQ ID NO: 171833 - DNA, 20 bp, Artificial
  CRISPR gRNA sequence
gagacattttctggttgtca

SEQ ID NO: 171834 - DNA, 20 bp, Artificial
  CRISPR gRNA sequence
tctggttgtcacaactcggg

SEQ ID NO: 171835 - DNA, 20 bp, Artificial
  CRISPR gRNA sequence
ctggttgtcacaactcgggg

SEQ ID NO: 171836 - DNA, 20 bp, Artificial
  CRISPR gRNA sequence
tggttgtcacaactcgggga

SEQ ID NO: 171837 - DNA, 20 bp, Artificial
  CRISPR gRNA sequence
gttgtcacaactcggggagg

SEQ ID NO: 171838 - DNA, 20 bp, Artificial
  CRISPR gRNA sequence
tcacaactcggggaggggtg

SEQ ID NO: 171839 - DNA, 20 bp, Artificial
  CRISPR gRNA sequence
ggggaggggtgctactggca

SEQ ID NO: 171840 - DNA, 20 bp, Artificial
  CRISPR gRNA sequence
ctggcatctagtgagtagag

SEQ ID NO: 171841 - DNA, 20 bp, Artificial
  CRISPR gRNA sequence
gcatctagtgagtagaggct

SEQ ID NO: 171842 - DNA, 20 bp, Artificial
  CRISPR gRNA sequence
gtgagtagaggctaggggtg

SEQ ID NO: 171843 - DNA, 20 bp, Artificial
  CRISPR gRNA sequence
ggggtgctgctaaacatgct

SEQ ID NO: 171844 - DNA, 20 bp, Artificial
  CRISPR gRNA sequence
ctaaacatgctgttatgcat

SEQ ID NO: 171845 - DNA, 20 bp, Artificial
  CRISPR gRNA sequence
aacatgctgttatgcataag

SEQ ID NO: 171846 - DNA, 20 bp, Artificial
  CRISPR gRNA sequence
ttatgcataagacggcccct

SEQ ID NO: 171847 - DNA, 20 bp, Artificial
  CRISPR gRNA sequence
tgcataagacggcccctcac

SEQ ID NO: 171848 - DNA, 20 bp, Artificial
  CRISPR gRNA sequence
acaacaaagaattatctggc

SEQ ID NO: 171849 - DNA, 20 bp, Artificial
  CRISPR gRNA sequence
tctggcccaaaatgtcaata

SEQ ID NO: 171850 - DNA, 20 bp, Artificial
  CRISPR gRNA sequence
gcccaaaatgtcaataatgc

SEQ ID NO: 171851 - DNA, 20 bp, Artificial
  CRISPR gRNA sequence
ttgagaaactgcgatcaaag

SEQ ID NO: 171852 - DNA, 20 bp, Artificial
  CRISPR gRNA sequence
agaaactgcgatcaaagtat

SEQ ID NO: 171853 - DNA, 20 bp, Artificial
  CRISPR gRNA sequence
cgatcaaagtatatcttttt

SEQ ID NO: 171854 - DNA, 20 bp, Artificial
  CRISPR gRNA sequence
tttaacacctagaaagagtt

SEQ ID NO: 171855 - DNA, 20 bp, Artificial
  CRISPR gRNA sequence
ttaacacctagaaagagttc

SEQ ID NO: 171856 - DNA, 20 bp, Artificial
  CRISPR gRNA sequence
taacacctagaaagagttcc

SEQ ID NO: 171857 - DNA, 20 bp, Artificial
  CRISPR gRNA sequence
aacacctagaaagagttcct

SEQ ID NO: 171858 - DNA, 20 bp, Artificial
  CRISPR gRNA sequence
acacctagaaagagttcctg

SEQ ID NO: 171859 - DNA, 20 bp, Artificial
  CRISPR gRNA sequence
gaaagagttcctgactcaca

SEQ ID NO: 171860 - DNA, 20 bp, Artificial
  CRISPR gRNA sequence
ctgactcacaatagatttgt

SEQ ID NO: 171861 - DNA, 20 bp, Artificial
  CRISPR gRNA sequence
actcacaatagatttgttgt

SEQ ID NO: 171862 - DNA, 20 bp, Artificial
  CRISPR gRNA sequence
acaatagatttgttgttgaa

SEQ ID NO: 171863 - DNA, 20 bp, Artificial
  CRISPR gRNA sequence
gttgttgaataaattgccca

SEQ ID NO: 171864 - DNA, 20 bp, Artificial
  CRISPR gRNA sequence
ttgttgaataaattgcccaa

SEQ ID NO: 171865 - DNA, 20 bp, Artificial
  CRISPR gRNA sequence
ttgaataaattgcccaatag

SEQ ID NO: 171866 - DNA, 20 bp, Artificial
  CRISPR gRNA sequence
aataaattgcccaatagttt

SEQ ID NO: 171867 - DNA, 20 bp, Artificial
  CRISPR gRNA sequence
cccaatagtttttaccaagt

SEQ ID NO: 171868 - DNA, 20 bp, Artificial
  CRISPR gRNA sequence
ttaccaagttctagaaatgt

SEQ ID NO: 171869 - DNA, 20 bp, Artificial
  CRISPR gRNA sequence
taccaagttctagaaatgtc

SEQ ID NO: 171870 - DNA, 20 bp, Artificial
  CRISPR gRNA sequence
accaagttctagaaatgtcg

SEQ ID NO: 171871 - DNA, 20 bp, Artificial
  CRISPR gRNA sequence
ccaagttctagaaatgtcgt

SEQ ID NO: 171872 - DNA, 20 bp, Artificial
  CRISPR gRNA sequence
tagaaatgtcgtagggccac

SEQ ID NO: 171873 - DNA, 20 bp, Artificial
  CRISPR gRNA sequence
gaaatgtcgtagggccacta

SEQ ID NO: 171874 - DNA, 20 bp, Artificial
  CRISPR gRNA sequence
aatcaggcctaaaaaattga

SEQ ID NO: 171875 - DNA, 20 bp, Artificial
  CRISPR gRNA sequence
aaaaattgagctacagctac

SEQ ID NO: 171876 - DNA, 20 bp, Artificial
  CRISPR gRNA sequence
agctacagctactgaaggaa

SEQ ID NO: 171877 - DNA, 20 bp, Artificial
  CRISPR gRNA sequence
cagctactgaaggaagatga

SEQ ID NO: 171878 - DNA, 20 bp, Artificial
  CRISPR gRNA sequence
ctgaaggaagatgagatctc

SEQ ID NO: 171879 - DNA, 20 bp, Artificial
  CRISPR gRNA sequence
aaggaagatgagatctctgt

SEQ ID NO: 171880 - DNA, 20 bp, Artificial
  CRISPR gRNA sequence
tgtttttctgtaagtcctaa

SEQ ID NO: 171881 - DNA, 20 bp, Artificial
  CRISPR gRNA sequence
tttttctgtaagtcctaaag

SEQ ID NO: 171882 - DNA, 20 bp, Artificial
  CRISPR gRNA sequence
ttctgtaagtcctaaaggat

SEQ ID NO: 171883 - DNA, 20 bp, Artificial
  CRISPR gRNA sequence
tctgtaagtcctaaaggata

SEQ ID NO: 171884 - DNA, 20 bp, Artificial
  CRISPR gRNA sequence
ctgtaagtcctaaaggatat

SEQ ID NO: 171885 - DNA, 20 bp, Artificial
  CRISPR gRNA sequence
tgtaagtcctaaaggatatg

SEQ ID NO: 171886 - DNA, 20 bp, Artificial
  CRISPR gRNA sequence
taagtcctaaaggatatgcc

SEQ ID NO: 171887 - DNA, 20 bp, Artificial
  CRISPR gRNA sequence
aaggatatgcctcacattaa

SEQ ID NO: 171888 - DNA, 20 bp, Artificial
  CRISPR gRNA sequence
acattaaactacctccaagt

SEQ ID NO: 171889 - DNA, 20 bp, Artificial
  CRISPR gRNA sequence
aactacctccaagtcaaagt

SEQ ID NO: 171890 - DNA, 20 bp, Artificial
  CRISPR gRNA sequence
cctccaagtcaaagtatcca

SEQ ID NO: 171891 - DNA, 20 bp, Artificial
  CRISPR gRNA sequence
caagtcaaagtatccactgc

SEQ ID NO: 171892 - DNA, 20 bp, Artificial
  CRISPR gRNA sequence
cacaccacacgcctatggaa

SEQ ID NO: 171893 - DNA, 20 bp, Artificial
  CRISPR gRNA sequence
tggaagaacactgagatata

SEQ ID NO: 171894 - DNA, 20 bp, Artificial
  CRISPR gRNA sequence
agatataaaagactcttgca

SEQ ID NO: 171895 - DNA, 20 bp, Artificial
  CRISPR gRNA sequence
ttgcagttacctcacggaag

SEQ ID NO: 171896 - DNA, 20 bp, Artificial
  CRISPR gRNA sequence
gcagttacctcacggaaggc

SEQ ID NO: 171897 - DNA, 20 bp, Artificial
  CRISPR gRNA sequence
cagttacctcacggaaggca

SEQ ID NO: 171898 - DNA, 20 bp, Artificial
  CRISPR gRNA sequence
cctcacggaaggcaaattat

SEQ ID NO: 171899 - DNA, 20 bp, Artificial
  CRISPR gRNA sequence
acggaaggcaaattatgttt

SEQ ID NO: 171900 - DNA, 20 bp, Artificial
  CRISPR gRNA sequence
tgttttcattttcctaccca

SEQ ID NO: 171901 - DNA, 20 bp, Artificial
  CRISPR gRNA sequence
tcattttcctacccacaggt

SEQ ID NO: 171902 - DNA, 20 bp, Artificial
  CRISPR gRNA sequence
cattttcctacccacaggtc

SEQ ID NO: 171903 - DNA, 20 bp, Artificial
  CRISPR gRNA sequence
attttcctacccacaggtca

SEQ ID NO: 171904 - DNA, 20 bp, Artificial
  CRISPR gRNA sequence
tcctacccacaggtcagggg

SEQ ID NO: 171905 - DNA, 20 bp, Artificial
  CRISPR gRNA sequence
cctacccacaggtcaggggt

SEQ ID NO: 171906 - DNA, 20 bp, Artificial
  CRISPR gRNA sequence
ctacccacaggtcaggggtg

SEQ ID NO: 171907 - DNA, 20 bp, Artificial
  CRISPR gRNA sequence
cccacaggtcaggggtgaac

SEQ ID NO: 171908 - DNA, 20 bp, Artificial
  CRISPR gRNA sequence
tgtaaatgtgcttgaaatta

SEQ ID NO: 171909 - DNA, 20 bp, Artificial
  CRISPR gRNA sequence
taaatgtgcttgaaattaaa

SEQ ID NO: 171910 - DNA, 20 bp, Artificial
  CRISPR gRNA sequence
gaaattaaaaatgctttagt

SEQ ID NO: 171911 - DNA, 20 bp, Artificial
  CRISPR gRNA sequence
aaattaaaaatgctttagtc

SEQ ID NO: 171912 - DNA, 20 bp, Artificial
  CRISPR gRNA sequence
aaaatgctttagtctgagtt

SEQ ID NO: 171913 - DNA, 20 bp, Artificial
  CRISPR gRNA sequence
tagtctgagttttggttaat

SEQ ID NO: 171914 - DNA, 20 bp, Artificial
  CRISPR gRNA sequence
agtctgagttttggttaatt

SEQ ID NO: 171915 - DNA, 20 bp, Artificial
  CRISPR gRNA sequence
gtctgagttttggttaattt

SEQ ID NO: 171916 - DNA, 20 bp, Artificial
  CRISPR gRNA sequence
agttttggttaatttcccag

SEQ ID NO: 171917 - DNA, 20 bp, Artificial
  CRISPR gRNA sequence
tggttaatttcccagagctc

SEQ ID NO: 171918 - DNA, 20 bp, Artificial
  CRISPR gRNA sequence
ggttaatttcccagagctct

SEQ ID NO: 171919 - DNA, 20 bp, Artificial
  CRISPR gRNA sequence
gttaatttcccagagctctt

SEQ ID NO: 171920 - DNA, 20 bp, Artificial
  CRISPR gRNA sequence
atttcccagagctctttata

SEQ ID NO: 171921 - DNA, 20 bp, Artificial
  CRISPR gRNA sequence
cccagagctctttatactct

SEQ ID NO: 171922 - DNA, 20 bp, Artificial
  CRISPR gRNA sequence
ccagagctctttatactctt

SEQ ID NO: 171923 - DNA, 20 bp, Artificial
  CRISPR gRNA sequence
tttatactctttaaaagttt

SEQ ID NO: 171924 - DNA, 20 bp, Artificial
  CRISPR gRNA sequence
tatactctttaaaagtttct

SEQ ID NO: 171925 - DNA, 20 bp, Artificial
  CRISPR gRNA sequence
atactctttaaaagtttcta

SEQ ID NO: 171926 - DNA, 20 bp, Artificial
  CRISPR gRNA sequence
tactctttaaaagtttctaa

SEQ ID NO: 171927 - DNA, 20 bp, Artificial
  CRISPR gRNA sequence
tttaaaagtttctaataaaa

SEQ ID NO: 171928 - DNA, 20 bp, Artificial
  CRISPR gRNA sequence
taaaagtttctaataaaagt

SEQ ID NO: 171929 - DNA, 20 bp, Artificial
  CRISPR gRNA sequence
aaaagtttctaataaaagtt

SEQ ID NO: 171930 - DNA, 20 bp, Artificial
  CRISPR gRNA sequence
aaagtttctaataaaagttt

SEQ ID NO: 171931 - DNA, 20 bp, Artificial
  CRISPR gRNA sequence
ctaataaaagtttctcattc

SEQ ID NO: 171932 - DNA, 20 bp, Artificial
  CRISPR gRNA sequence
taataaaagtttctcattct

SEQ ID NO: 171933 - DNA, 20 bp, Artificial
  CRISPR gRNA sequence
ataaaagtttctcattcttc

SEQ ID NO: 171934 - DNA, 20 bp, Artificial
  CRISPR gRNA sequence
ctcattcttcctcaccactg

SEQ ID NO: 171935 - DNA, 20 bp, Artificial
  CRISPR gRNA sequence
tcattcttcctcaccactgt

SEQ ID NO: 171936 - DNA, 20 bp, Artificial
  CRISPR gRNA sequence
attcttcctcaccactgtta

SEQ ID NO: 171937 - DNA, 20 bp, Artificial
  CRISPR gRNA sequence
ttcctcaccactgttaaatt

SEQ ID NO: 171938 - DNA, 20 bp, Artificial
  CRISPR gRNA sequence
cctcaccactgttaaattcc

SEQ ID NO: 171939 - DNA, 20 bp, Artificial
  CRISPR gRNA sequence
ctcaccactgttaaattccg

SEQ ID NO: 171940 - DNA, 20 bp, Artificial
  CRISPR gRNA sequence
accactgttaaattccggat

SEQ ID NO: 171941 - DNA, 20 bp, Artificial
  CRISPR gRNA sequence
ttaaattccggatttcttcc

SEQ ID NO: 171942 - DNA, 20 bp, Artificial
  CRISPR gRNA sequence
aattccggatttcttccatg

SEQ ID NO: 171943 - DNA, 20 bp, Artificial
  CRISPR gRNA sequence
cggatttcttccatgacccg

SEQ ID NO: 171944 - DNA, 20 bp, Artificial
  CRISPR gRNA sequence
cttccatgacccgaggccag

SEQ ID NO: 171945 - DNA, 20 bp, Artificial
  CRISPR gRNA sequence
ttccatgacccgaggccaga

SEQ ID NO: 171946 - DNA, 20 bp, Artificial
  CRISPR gRNA sequence
ccatgacccgaggccagaac

SEQ ID NO: 171947 - DNA, 20 bp, Artificial
  CRISPR gRNA sequence
catgacccgaggccagaacg

SEQ ID NO: 171948 - DNA, 20 bp, Artificial
  CRISPR gRNA sequence
taggctttgctgggcatcac

SEQ ID NO: 171949 - DNA, 20 bp, Artificial
  CRISPR gRNA sequence
tgctgggcatcactgctgct

SEQ ID NO: 171950 - DNA, 20 bp, Artificial
  CRISPR gRNA sequence
gctgggcatcactgctgcta

SEQ ID NO: 171951 - DNA, 20 bp, Artificial
  CRISPR gRNA sequence
ctgggcatcactgctgctag

SEQ ID NO: 171952 - DNA, 20 bp, Artificial
  CRISPR gRNA sequence
ggcatcactgctgctagtac

SEQ ID NO: 171953 - DNA, 20 bp, Artificial
  CRISPR gRNA sequence
ctgctagtaccaccaaatcc

SEQ ID NO: 171954 - DNA, 20 bp, Artificial
  CRISPR gRNA sequence
ctagtaccaccaaatcctcc

SEQ ID NO: 171955 - DNA, 20 bp, Artificial
  CRISPR gRNA sequence
gtaccaccaaatcctccttc

SEQ ID NO: 171956 - DNA, 20 bp, Artificial
  CRISPR gRNA sequence
cttctgtggacatctcgaca

SEQ ID NO: 171957 - DNA, 20 bp, Artificial
  CRISPR gRNA sequence
ctgtggacatctcgacaact

SEQ ID NO: 171958 - DNA, 20 bp, Artificial
  CRISPR gRNA sequence
tgtggacatctcgacaactg

SEQ ID NO: 171959 - DNA, 20 bp, Artificial
  CRISPR gRNA sequence
tggacatctcgacaactgaa

SEQ ID NO: 171960 - DNA, 20 bp, Artificial
  CRISPR gRNA sequence
gacaactgaaaataaacaca

SEQ ID NO: 171961 - DNA, 20 bp, Artificial
  CRISPR gRNA sequence
aaaataaacacatacataag

SEQ ID NO: 171962 - DNA, 20 bp, Artificial
  CRISPR gRNA sequence
gaaacaataaagtcagactt

SEQ ID NO: 171963 - DNA, 20 bp, Artificial
  CRISPR gRNA sequence
tctgtccagattaggcattt

SEQ ID NO: 171964 - DNA, 20 bp, Artificial
  CRISPR gRNA sequence
ctgtccagattaggcatttg

SEQ ID NO: 171965 - DNA, 20 bp, Artificial
  CRISPR gRNA sequence
tgtccagattaggcatttgt

SEQ ID NO: 171966 - DNA, 20 bp, Artificial
  CRISPR gRNA sequence
tccagattaggcatttgtat

SEQ ID NO: 171967 - DNA, 20 bp, Artificial
  CRISPR gRNA sequence
ggcatttgtatatttgtgga

SEQ ID NO: 171968 - DNA, 20 bp, Artificial
  CRISPR gRNA sequence
gtatatttgtggatgttttt

SEQ ID NO: 171969 - DNA, 20 bp, Artificial
  CRISPR gRNA sequence
tatatttgtggatgttttta

SEQ ID NO: 171970 - DNA, 20 bp, Artificial
  CRISPR gRNA sequence
gtggatgtttttatgaatct

SEQ ID NO: 171971 - DNA, 20 bp, Artificial
  CRISPR gRNA sequence
tggatgtttttatgaatcta

SEQ ID NO: 171972 - DNA, 20 bp, Artificial
  CRISPR gRNA sequence
ttatgaatctattcaatctt

SEQ ID NO: 171973 - DNA, 20 bp, Artificial
  CRISPR gRNA sequence
tatgaatctattcaatcttt

SEQ ID NO: 171974 - DNA, 20 bp, Artificial
  CRISPR gRNA sequence
atgaatctattcaatctttc

SEQ ID NO: 171975 - DNA, 20 bp, Artificial
  CRISPR gRNA sequence
tgaatctattcaatctttca

SEQ ID NO: 171976 - DNA, 20 bp, Artificial
  CRISPR gRNA sequence
ttcaatctttcagtttgata

SEQ ID NO: 171977 - DNA, 20 bp, Artificial
  CRISPR gRNA sequence
aatctttcagtttgataagg

SEQ ID NO: 171978 - DNA, 20 bp, Artificial
  CRISPR gRNA sequence
tcagtttgataaggtatata

SEQ ID NO: 171979 - DNA, 20 bp, Artificial
  CRISPR gRNA sequence
cagtttgataaggtatataa

SEQ ID NO: 171980 - DNA, 20 bp, Artificial
  CRISPR gRNA sequence
agtttgataaggtatataat

SEQ ID NO: 171981 - DNA, 20 bp, Artificial
  CRISPR gRNA sequence
gataaggtatataattacgc

SEQ ID NO: 171982 - DNA, 20 bp, Artificial
  CRISPR gRNA sequence
ataaggtatataattacgct

SEQ ID NO: 171983 - DNA, 20 bp, Artificial
  CRISPR gRNA sequence
cgctaaaaagattttaacac

SEQ ID NO: 171984 - DNA, 20 bp, Artificial
  CRISPR gRNA sequence
aaaagattttaacacagact

SEQ ID NO: 171985 - DNA, 20 bp, Artificial
  CRISPR gRNA sequence
taacacagacttacatctta

SEQ ID NO: 171986 - DNA, 20 bp, Artificial
  CRISPR gRNA sequence
aacacagacttacatcttaa

SEQ ID NO: 171987 - DNA, 20 bp, Artificial
  CRISPR gRNA sequence
acacagacttacatcttaaa

SEQ ID NO: 171988 - DNA, 20 bp, Artificial
  CRISPR gRNA sequence
acatcttaaaaacattggta

SEQ ID NO: 171989 - DNA, 20 bp, Artificial
  CRISPR gRNA sequence
catcttaaaaacattggtag

SEQ ID NO: 171990 - DNA, 20 bp, Artificial
  CRISPR gRNA sequence
aaaaacattggtaggaaagt

SEQ ID NO: 171991 - DNA, 20 bp, Artificial
  CRISPR gRNA sequence
aaaacattggtaggaaagtt

SEQ ID NO: 171992 - DNA, 20 bp, Artificial
  CRISPR gRNA sequence
gtaggaaagtttttccttct

SEQ ID NO: 171993 - DNA, 20 bp, Artificial
  CRISPR gRNA sequence
ttccttctatctagcttata

SEQ ID NO: 171994 - DNA, 20 bp, Artificial
  CRISPR gRNA sequence
tccttctatctagcttatac

SEQ ID NO: 171995 - DNA, 20 bp, Artificial
  CRISPR gRNA sequence
ccttctatctagcttatacc

SEQ ID NO: 171996 - DNA, 20 bp, Artificial
  CRISPR gRNA sequence
cttctatctagcttatacca

SEQ ID NO: 171997 - DNA, 20 bp, Artificial
  CRISPR gRNA sequence
ctatctagcttataccatag

SEQ ID NO: 171998 - DNA, 20 bp, Artificial
  CRISPR gRNA sequence
tatctagcttataccataga

SEQ ID NO: 171999 - DNA, 20 bp, Artificial
  CRISPR gRNA sequence
tctagcttataccatagaga

SEQ ID NO: 172000 - DNA, 20 bp, Artificial
  CRISPR gRNA sequence
gcttataccatagagactac

SEQ ID NO: 172001 - DNA, 20 bp, Artificial
  CRISPR gRNA sequence
ataccatagagactactgaa

SEQ ID NO: 172002 - DNA, 20 bp, Artificial
  CRISPR gRNA sequence
taccatagagactactgaag

SEQ ID NO: 172003 - DNA, 20 bp, Artificial
  CRISPR gRNA sequence
ctgaagacctccaactagaa

SEQ ID NO: 172004 - DNA, 20 bp, Artificial
  CRISPR gRNA sequence
aagacctccaactagaatat

SEQ ID NO: 172005 - DNA, 20 bp, Artificial
  CRISPR gRNA sequence
caactagaatatcaaaagtt

SEQ ID NO: 172006 - DNA, 20 bp, Artificial
  CRISPR gRNA sequence
gaatatcaaaagttgctaga

SEQ ID NO: 172007 - DNA, 20 bp, Artificial
  CRISPR gRNA sequence
ctagaaatgtaagctgaaat

SEQ ID NO: 172008 - DNA, 20 bp, Artificial
  CRISPR gRNA sequence
gaaatgtaagctgaaatcct

SEQ ID NO: 172009 - DNA, 20 bp, Artificial
  CRISPR gRNA sequence
aaatcctaatgttaatcaag

SEQ ID NO: 172010 - DNA, 20 bp, Artificial
  CRISPR gRNA sequence
atgttaatcaaggactttta

SEQ ID NO: 172011 - DNA, 20 bp, Artificial
  CRISPR gRNA sequence
atcaaggacttttaacttct

SEQ ID NO: 172012 - DNA, 20 bp, Artificial
  CRISPR gRNA sequence
ttaacttcttatatgggtgt

SEQ ID NO: 172013 - DNA, 20 bp, Artificial
  CRISPR gRNA sequence
taacttcttatatgggtgtg

SEQ ID NO: 172014 - DNA, 20 bp, Artificial
  CRISPR gRNA sequence
aacttcttatatgggtgtgg

SEQ ID NO: 172015 - DNA, 20 bp, Artificial
  CRISPR gRNA sequence
acttcttatatgggtgtggg

SEQ ID NO: 172016 - DNA, 20 bp, Artificial
  CRISPR gRNA sequence
cttatatgggtgtggggtga

SEQ ID NO: 172017 - DNA, 20 bp, Artificial
  CRISPR gRNA sequence
ttatatgggtgtggggtgag

SEQ ID NO: 172018 - DNA, 20 bp, Artificial
  CRISPR gRNA sequence
atatgggtgtggggtgagga

SEQ ID NO: 172019 - DNA, 20 bp, Artificial
  CRISPR gRNA sequence
tatgggtgtggggtgaggaa

SEQ ID NO: 172020 - DNA, 20 bp, Artificial
  CRISPR gRNA sequence
tgttgccctagtctagccca

SEQ ID NO: 172021 - DNA, 20 bp, Artificial
  CRISPR gRNA sequence
gttgccctagtctagcccat

SEQ ID NO: 172022 - DNA, 20 bp, Artificial
  CRISPR gRNA sequence
ttgccctagtctagcccata

SEQ ID NO: 172023 - DNA, 20 bp, Artificial
  CRISPR gRNA sequence
ccctagtctagcccataatt

SEQ ID NO: 172024 - DNA, 20 bp, Artificial
  CRISPR gRNA sequence
gtctagcccataattttcaa

SEQ ID NO: 172025 - DNA, 20 bp, Artificial
  CRISPR gRNA sequence
gcccataattttcaatgcca

SEQ ID NO: 172026 - DNA, 20 bp, Artificial
  CRISPR gRNA sequence
tcaatgccattctttccaaa

SEQ ID NO: 172027 - DNA, 20 bp, Artificial
  CRISPR gRNA sequence
caatgccattctttccaaag

SEQ ID NO: 172028 - DNA, 20 bp, Artificial
  CRISPR gRNA sequence
aatgccattctttccaaagc

SEQ ID NO: 172029 - DNA, 20 bp, Artificial
  CRISPR gRNA sequence
tttccaaagctttttcaagt

SEQ ID NO: 172030 - DNA, 20 bp, Artificial
  CRISPR gRNA sequence
tccaaagctttttcaagttc

SEQ ID NO: 172031 - DNA, 20 bp, Artificial
  CRISPR gRNA sequence
ccaaagctttttcaagttct

SEQ ID NO: 172032 - DNA, 20 bp, Artificial
  CRISPR gRNA sequence
caaagctttttcaagttctc

SEQ ID NO: 172033 - DNA, 20 bp, Artificial
  CRISPR gRNA sequence
tttcaagttctctgtggctt

SEQ ID NO: 172034 - DNA, 20 bp, Artificial
  CRISPR gRNA sequence
ttcaagttctctgtggcttc

SEQ ID NO: 172035 - DNA, 20 bp, Artificial
  CRISPR gRNA sequence
tcaagttctctgtggcttct

SEQ ID NO: 172036 - DNA, 20 bp, Artificial
  CRISPR gRNA sequence
caagttctctgtggcttctc

SEQ ID NO: 172037 - DNA, 20 bp, Artificial
  CRISPR gRNA sequence
aagttctctgtggcttctca

SEQ ID NO: 172038 - DNA, 20 bp, Artificial
  CRISPR gRNA sequence
tctgtggcttctcatcctcc

SEQ ID NO: 172039 - DNA, 20 bp, Artificial
  CRISPR gRNA sequence
tgtggcttctcatcctccat

SEQ ID NO: 172040 - DNA, 20 bp, Artificial
  CRISPR gRNA sequence
tggcttctcatcctccatgc

SEQ ID NO: 172041 - DNA, 20 bp, Artificial
  CRISPR gRNA sequence
ctcatcctccatgccacagc

SEQ ID NO: 172042 - DNA, 20 bp, Artificial
  CRISPR gRNA sequence
tcatcctccatgccacagcc

SEQ ID NO: 172043 - DNA, 20 bp, Artificial
  CRISPR gRNA sequence
atcctccatgccacagcctt

SEQ ID NO: 172044 - DNA, 20 bp, Artificial
  CRISPR gRNA sequence
catgccacagccttcagcaa

SEQ ID NO: 172045 - DNA, 20 bp, Artificial
  CRISPR gRNA sequence
cagcaaattcttatattaaa

SEQ ID NO: 172046 - DNA, 20 bp, Artificial
  CRISPR gRNA sequence
agcaaattcttatattaaaa

SEQ ID NO: 172047 - DNA, 20 bp, Artificial
  CRISPR gRNA sequence
ttatattaaaagtccccagt

SEQ ID NO: 172048 - DNA, 20 bp, Artificial
  CRISPR gRNA sequence
atattaaaagtccccagtga

SEQ ID NO: 172049 - DNA, 20 bp, Artificial
  CRISPR gRNA sequence
tattaaaagtccccagtgat

SEQ ID NO: 172050 - DNA, 20 bp, Artificial
  CRISPR gRNA sequence
aaagtccccagtgattagta

SEQ ID NO: 172051 - DNA, 20 bp, Artificial
  CRISPR gRNA sequence
gtactgtacagaaatgtaaa

SEQ ID NO: 172052 - DNA, 20 bp, Artificial
  CRISPR gRNA sequence
tacagaaatgtaaacccagt

SEQ ID NO: 172053 - DNA, 20 bp, Artificial
  CRISPR gRNA sequence
aaaagataaaagccaagctg

SEQ ID NO: 172054 - DNA, 20 bp, Artificial
  CRISPR gRNA sequence
aaagataaaagccaagctgg

SEQ ID NO: 172055 - DNA, 20 bp, Artificial
  CRISPR gRNA sequence
ggcacaaaggtgcatgcctg

SEQ ID NO: 172056 - DNA, 20 bp, Artificial
  CRISPR gRNA sequence
tggttccagctactcaggaa

SEQ ID NO: 172057 - DNA, 20 bp, Artificial
  CRISPR gRNA sequence
cagctactcaggaaggtgag

SEQ ID NO: 172058 - DNA, 20 bp, Artificial
  CRISPR gRNA sequence
ctcaggaaggtgagccagga

SEQ ID NO: 172059 - DNA, 20 bp, Artificial
  CRISPR gRNA sequence
aggaaggtgagccaggagga

SEQ ID NO: 172060 - DNA, 20 bp, Artificial
  CRISPR gRNA sequence
gggcccaagagttcaagaca

SEQ ID NO: 172061 - DNA, 20 bp, Artificial
  CRISPR gRNA sequence
ggcccaagagttcaagacag

SEQ ID NO: 172062 - DNA, 20 bp, Artificial
  CRISPR gRNA sequence
aagacagcctgggcaacata

SEQ ID NO: 172063 - DNA, 20 bp, Artificial
  CRISPR gRNA sequence
ggcaacatagcaagcgtctg

SEQ ID NO: 172064 - DNA, 20 bp, Artificial
  CRISPR gRNA sequence
tctcttaaaaaaagagagag

SEQ ID NO: 172065 - DNA, 20 bp, Artificial
  CRISPR gRNA sequence
ttaaaaaaagagagagggcc

SEQ ID NO: 172066 - DNA, 20 bp, Artificial
  CRISPR gRNA sequence
aaaaaaagagagagggccgg

SEQ ID NO: 172067 - DNA, 20 bp, Artificial
  CRISPR gRNA sequence
aaaaaagagagagggccggg

SEQ ID NO: 172068 - DNA, 20 bp, Artificial
  CRISPR gRNA sequence
acgcctgtaatcccagcact

SEQ ID NO: 172069 - DNA, 20 bp, Artificial
  CRISPR gRNA sequence
taatcccagcactttgggag

SEQ ID NO: 172070 - DNA, 20 bp, Artificial
  CRISPR gRNA sequence
tgggaggccgaggcgggcgg

SEQ ID NO: 172071 - DNA, 20 bp, Artificial
  CRISPR gRNA sequence
gggaggccgaggcgggcgga

SEQ ID NO: 172072 - DNA, 20 bp, Artificial
  CRISPR gRNA sequence
ggaggccgaggcgggcggat

SEQ ID NO: 172073 - DNA, 20 bp, Artificial
  CRISPR gRNA sequence
gctaaaacagtgaaaccccg

SEQ ID NO: 172074 - DNA, 20 bp, Artificial
  CRISPR gRNA sequence
aaacagtgaaaccccgtctc

SEQ ID NO: 172075 - DNA, 20 bp, Artificial
  CRISPR gRNA sequence
tactaaaaatacaaaaaatt

SEQ ID NO: 172076 - DNA, 20 bp, Artificial
  CRISPR gRNA sequence
ctaaaaatacaaaaaattag

SEQ ID NO: 172077 - DNA, 20 bp, Artificial
  CRISPR gRNA sequence
aaaatacaaaaaattagccg

SEQ ID NO: 172078 - DNA, 20 bp, Artificial
  CRISPR gRNA sequence
gccgggcgtagtggcgggcg

SEQ ID NO: 172079 - DNA, 20 bp, Artificial
  CRISPR gRNA sequence
tagtcccagctacttgggag

SEQ ID NO: 172080 - DNA, 20 bp, Artificial
  CRISPR gRNA sequence
cttgggaggctgaggcagga

SEQ ID NO: 172081 - DNA, 20 bp, Artificial
  CRISPR gRNA sequence
gggaggctgaggcaggagaa

SEQ ID NO: 172082 - DNA, 20 bp, Artificial
  CRISPR gRNA sequence
ggaggctgaggcaggagaat

SEQ ID NO: 172083 - DNA, 20 bp, Artificial
  CRISPR gRNA sequence
aggcaggagaatggcgtgaa

SEQ ID NO: 172084 - DNA, 20 bp, Artificial
  CRISPR gRNA sequence
gcagtgagccgagatcccgc

SEQ ID NO: 172085 - DNA, 20 bp, Artificial
  CRISPR gRNA sequence
cagtgagccgagatcccgcc

SEQ ID NO: 172086 - DNA, 20 bp, Artificial
  CRISPR gRNA sequence
cactccagcctgggcgacag

SEQ ID NO: 172087 - DNA, 20 bp, Artificial
  CRISPR gRNA sequence
cagcctgggcgacagagcga

SEQ ID NO: 172088 - DNA, 20 bp, Artificial
  CRISPR gRNA sequence
ggcgacagagcgagactccg

SEQ ID NO: 172089 - DNA, 20 bp, Artificial
  CRISPR gRNA sequence
cgtctcaaaaaaaaaaaaaa

SEQ ID NO: 172090 - DNA, 20 bp, Artificial
  CRISPR gRNA sequence
aaaaaaaaaaaaaaaaaaag

SEQ ID NO: 172091 - DNA, 20 bp, Artificial
  CRISPR gRNA sequence
agtttcttcttttgttttag

SEQ ID NO: 172092 - DNA, 20 bp, Artificial
  CRISPR gRNA sequence
cttcttttgttttagacact

SEQ ID NO: 172093 - DNA, 20 bp, Artificial
  CRISPR gRNA sequence
ttcttttgttttagacactg

SEQ ID NO: 172094 - DNA, 20 bp, Artificial
  CRISPR gRNA sequence
cttttgttttagacactgtg

SEQ ID NO: 172095 - DNA, 20 bp, Artificial
  CRISPR gRNA sequence
ttttgttttagacactgtga

SEQ ID NO: 172096 - DNA, 20 bp, Artificial
  CRISPR gRNA sequence
ttgttttagacactgtgatc

SEQ ID NO: 172097 - DNA, 20 bp, Artificial
  CRISPR gRNA sequence
tgttttagacactgtgatcc

SEQ ID NO: 172098 - DNA, 20 bp, Artificial
  CRISPR gRNA sequence
gttttagacactgtgatcct

SEQ ID NO: 172099 - DNA, 20 bp, Artificial
  CRISPR gRNA sequence
ttttagacactgtgatcctg

SEQ ID NO: 172100 - DNA, 20 bp, Artificial
  CRISPR gRNA sequence
tagacactgtgatcctgttt

SEQ ID NO: 172101 - DNA, 20 bp, Artificial
  CRISPR gRNA sequence
agacactgtgatcctgtttc

SEQ ID NO: 172102 - DNA, 20 bp, Artificial
  CRISPR gRNA sequence
gacactgtgatcctgtttct

SEQ ID NO: 172103 - DNA, 20 bp, Artificial
  CRISPR gRNA sequence
tgatcctgtttctctggggc

SEQ ID NO: 172104 - DNA, 20 bp, Artificial
  CRISPR gRNA sequence
tttctctggggctcctgatg

SEQ ID NO: 172105 - DNA, 20 bp, Artificial
  CRISPR gRNA sequence
ctctggggctcctgatgatg

SEQ ID NO: 172106 - DNA, 20 bp, Artificial
  CRISPR gRNA sequence
tctggggctcctgatgatga

SEQ ID NO: 172107 - DNA, 20 bp, Artificial
  CRISPR gRNA sequence
tggggctcctgatgatgatt

SEQ ID NO: 172108 - DNA, 20 bp, Artificial
  CRISPR gRNA sequence
gggctcctgatgatgattat

SEQ ID NO: 172109 - DNA, 20 bp, Artificial
  CRISPR gRNA sequence
ctgatgatgattattccttc

SEQ ID NO: 172110 - DNA, 20 bp, Artificial
  CRISPR gRNA sequence
atgatgattattccttctaa

SEQ ID NO: 172111 - DNA, 20 bp, Artificial
  CRISPR gRNA sequence
ttccttctaatctcagacaa

SEQ ID NO: 172112 - DNA, 20 bp, Artificial
  CRISPR gRNA sequence
cttctaatctcagacaaatc

SEQ ID NO: 172113 - DNA, 20 bp, Artificial
  CRISPR gRNA sequence
ctaatctcagacaaatctgt

SEQ ID NO: 172114 - DNA, 20 bp, Artificial
  CRISPR gRNA sequence
taatctcagacaaatctgtc

SEQ ID NO: 172115 - DNA, 20 bp, Artificial
  CRISPR gRNA sequence
atctcagacaaatctgtctc

SEQ ID NO: 172116 - DNA, 20 bp, Artificial
  CRISPR gRNA sequence
agacaaatctgtctcaaagg

SEQ ID NO: 172117 - DNA, 20 bp, Artificial
  CRISPR gRNA sequence
tctcaaaggacatgaggcca

SEQ ID NO: 172118 - DNA, 20 bp, Artificial
  CRISPR gRNA sequence
aaaggacatgaggccattaa

SEQ ID NO: 172119 - DNA, 20 bp, Artificial
  CRISPR gRNA sequence
actgtgtaggtaacatgaag

SEQ ID NO: 172120 - DNA, 20 bp, Artificial
  CRISPR gRNA sequence
tgtaggtaacatgaagcccc

SEQ ID NO: 172121 - DNA, 20 bp, Artificial
  CRISPR gRNA sequence
aaatgaaactacttgccagt

SEQ ID NO: 172122 - DNA, 20 bp, Artificial
  CRISPR gRNA sequence
cttgccagttcgcccagttc

SEQ ID NO: 172123 - DNA, 20 bp, Artificial
  CRISPR gRNA sequence
gccagttcgcccagttcttt

SEQ ID NO: 172124 - DNA, 20 bp, Artificial
  CRISPR gRNA sequence
ccagttcgcccagttctttc

SEQ ID NO: 172125 - DNA, 20 bp, Artificial
  CRISPR gRNA sequence
gcccagttctttcctaacct

SEQ ID NO: 172126 - DNA, 20 bp, Artificial
  CRISPR gRNA sequence
tttcctaaccttaaccatgt

SEQ ID NO: 172127 - DNA, 20 bp, Artificial
  CRISPR gRNA sequence
tcctaaccttaaccatgtta

SEQ ID NO: 172128 - DNA, 20 bp, Artificial
  CRISPR gRNA sequence
cctaaccttaaccatgttat

SEQ ID NO: 172129 - DNA, 20 bp, Artificial
  CRISPR gRNA sequence
ctaaccttaaccatgttatt

SEQ ID NO: 172130 - DNA, 20 bp, Artificial
  CRISPR gRNA sequence
accttaaccatgttattaaa

SEQ ID NO: 172131 - DNA, 20 bp, Artificial
  CRISPR gRNA sequence
aaccatgttattaaacacaa

SEQ ID NO: 172132 - DNA, 20 bp, Artificial
  CRISPR gRNA sequence
accatgttattaaacacaag

SEQ ID NO: 172133 - DNA, 20 bp, Artificial
  CRISPR gRNA sequence
ttaaacacaagcctaacaca

SEQ ID NO: 172134 - DNA, 20 bp, Artificial
  CRISPR gRNA sequence
aacacaagcctaacacagca

SEQ ID NO: 172135 - DNA, 20 bp, Artificial
  CRISPR gRNA sequence
acacagcacactggcaactg

SEQ ID NO: 172136 - DNA, 20 bp, Artificial
  CRISPR gRNA sequence
gcaactggaagccttaaaga

SEQ ID NO: 172137 - DNA, 20 bp, Artificial
  CRISPR gRNA sequence
gaagccttaaagacagttaa

SEQ ID NO: 172138 - DNA, 20 bp, Artificial
  CRISPR gRNA sequence
aaagacagttaaaaaaacga

SEQ ID NO: 172139 - DNA, 20 bp, Artificial
  CRISPR gRNA sequence
aagacagttaaaaaaacgaa

SEQ ID NO: 172140 - DNA, 20 bp, Artificial
  CRISPR gRNA sequence
aaaaaacgaaggagaggcca

SEQ ID NO: 172141 - DNA, 20 bp, Artificial
  CRISPR gRNA sequence
atgcctgtaatccaaacact

SEQ ID NO: 172142 - DNA, 20 bp, Artificial
  CRISPR gRNA sequence
taatccaaacactctgggaa

SEQ ID NO: 172143 - DNA, 20 bp, Artificial
  CRISPR gRNA sequence
tgggaagccgaggcaggtgg

SEQ ID NO: 172144 - DNA, 20 bp, Artificial
  CRISPR gRNA sequence
ggaagccgaggcaggtggat

SEQ ID NO: 172145 - DNA, 20 bp, Artificial
  CRISPR gRNA sequence
aggtcaaaagttcgagacca

SEQ ID NO: 172146 - DNA, 20 bp, Artificial
  CRISPR gRNA sequence
gagaccagcctgggcaacat

SEQ ID NO: 172147 - DNA, 20 bp, Artificial
  CRISPR gRNA sequence
ggcaacatggtgaaacccca

SEQ ID NO: 172148 - DNA, 20 bp, Artificial
  CRISPR gRNA sequence
tactaaaaatacaaaaatta

SEQ ID NO: 172149 - DNA, 20 bp, Artificial
  CRISPR gRNA sequence
ctaaaaatacaaaaattagc

SEQ ID NO: 172150 - DNA, 20 bp, Artificial
  CRISPR gRNA sequence
aaaatacaaaaattagccgg

SEQ ID NO: 172151 - DNA, 20 bp, Artificial
  CRISPR gRNA sequence
gccgggcgtggcggcagacg

SEQ ID NO: 172152 - DNA, 20 bp, Artificial
  CRISPR gRNA sequence
gtaatcccagttactcagga

SEQ ID NO: 172153 - DNA, 20 bp, Artificial
  CRISPR gRNA sequence
taatcccagttactcaggag

SEQ ID NO: 172154 - DNA, 20 bp, Artificial
  CRISPR gRNA sequence
ctcaggaggctgaggcagga

SEQ ID NO: 172155 - DNA, 20 bp, Artificial
  CRISPR gRNA sequence
aggaggctgaggcaggagaa

SEQ ID NO: 172156 - DNA, 20 bp, Artificial
  CRISPR gRNA sequence
aggcaggagaatcgcttgaa

SEQ ID NO: 172157 - DNA, 20 bp, Artificial
  CRISPR gRNA sequence
gaacccaggaggcagaggtt

SEQ ID NO: 172158 - DNA, 20 bp, Artificial
  CRISPR gRNA sequence
aacccaggaggcagaggttg

SEQ ID NO: 172159 - DNA, 20 bp, Artificial
  CRISPR gRNA sequence
cagtgagccaagatcacgcc

SEQ ID NO: 172160 - DNA, 20 bp, Artificial
  CRISPR gRNA sequence
cactccagcctgggcaacag

SEQ ID NO: 172161 - DNA, 20 bp, Artificial
  CRISPR gRNA sequence
cagcctgggcaacagagcaa

SEQ ID NO: 172162 - DNA, 20 bp, Artificial
  CRISPR gRNA sequence
ggcaacagagcaagactcca

SEQ ID NO: 172163 - DNA, 20 bp, Artificial
  CRISPR gRNA sequence
catcgcaaaaaaaaaaaaag

SEQ ID NO: 172164 - DNA, 20 bp, Artificial
  CRISPR gRNA sequence
aaattaggatagagaaagag

SEQ ID NO: 172165 - DNA, 20 bp, Artificial
  CRISPR gRNA sequence
ggatagagaaagagggctag

SEQ ID NO: 172166 - DNA, 20 bp, Artificial
  CRISPR gRNA sequence
gaacctgcaatttagtcaac

SEQ ID NO: 172167 - DNA, 20 bp, Artificial
  CRISPR gRNA sequence
caatttagtcaactgctttg

SEQ ID NO: 172168 - DNA, 20 bp, Artificial
  CRISPR gRNA sequence
agtcaactgctttgtgacaa

SEQ ID NO: 172169 - DNA, 20 bp, Artificial
  CRISPR gRNA sequence
gtcaactgctttgtgacaaa

SEQ ID NO: 172170 - DNA, 20 bp, Artificial
  CRISPR gRNA sequence
ctttgtgacaaaggagggaa

SEQ ID NO: 172171 - DNA, 20 bp, Artificial
  CRISPR gRNA sequence
tgtgacaaaggagggaagat

SEQ ID NO: 172172 - DNA, 20 bp, Artificial
  CRISPR gRNA sequence
gtgacaaaggagggaagatg

SEQ ID NO: 172173 - DNA, 20 bp, Artificial
  CRISPR gRNA sequence
tgacaaaggagggaagatga

SEQ ID NO: 172174 - DNA, 20 bp, Artificial
  CRISPR gRNA sequence
atgtcagctataactgtaga

SEQ ID NO: 172175 - DNA, 20 bp, Artificial
  CRISPR gRNA sequence
taactgtagataacacaggt

SEQ ID NO: 172176 - DNA, 20 bp, Artificial
  CRISPR gRNA sequence
tagataacacaggttgagta

SEQ ID NO: 172177 - DNA, 20 bp, Artificial
  CRISPR gRNA sequence
agtatcccttatctgaaatt

SEQ ID NO: 172178 - DNA, 20 bp, Artificial
  CRISPR gRNA sequence
atctgaaattctgaaatgcc

SEQ ID NO: 172179 - DNA, 20 bp, Artificial
  CRISPR gRNA sequence
tctgaaattctgaaatgcct

SEQ ID NO: 172180 - DNA, 20 bp, Artificial
  CRISPR gRNA sequence
aaattctgaaatgcctgggg

SEQ ID NO: 172181 - DNA, 20 bp, Artificial
  CRISPR gRNA sequence
tgaaatgcctggggaccaga

SEQ ID NO: 172182 - DNA, 20 bp, Artificial
  CRISPR gRNA sequence
aaatgcctggggaccagaaa

SEQ ID NO: 172183 - DNA, 20 bp, Artificial
  CRISPR gRNA sequence
gggaccagaaatgtctggga

SEQ ID NO: 172184 - DNA, 20 bp, Artificial
  CRISPR gRNA sequence
ggattttgactttttttttt

SEQ ID NO: 172185 - DNA, 20 bp, Artificial
  CRISPR gRNA sequence
tgactttttttttttttttt

SEQ ID NO: 172186 - DNA, 20 bp, Artificial
  CRISPR gRNA sequence
gacttttttttttttttttt

SEQ ID NO: 172187 - DNA, 20 bp, Artificial
  CRISPR gRNA sequence
actttttttttttttttttt

SEQ ID NO: 172188 - DNA, 20 bp, Artificial
  CRISPR gRNA sequence
tttttttttttttttttttt

SEQ ID NO: 172189 - DNA, 20 bp, Artificial
  CRISPR gRNA sequence
tttttttttttttttttttg

SEQ ID NO: 172190 - DNA, 20 bp, Artificial
  CRISPR gRNA sequence
ttttttttttttttttttga

SEQ ID NO: 172191 - DNA, 20 bp, Artificial
  CRISPR gRNA sequence
tttttttttttttttttgag

SEQ ID NO: 172192 - DNA, 20 bp, Artificial
  CRISPR gRNA sequence
ttttttttttttttttgaga

SEQ ID NO: 172193 - DNA, 20 bp, Artificial
  CRISPR gRNA sequence
tttttttttttttttgagac

SEQ ID NO: 172194 - DNA, 20 bp, Artificial
  CRISPR gRNA sequence
ttttttttttttttgagaca

SEQ ID NO: 172195 - DNA, 20 bp, Artificial
  CRISPR gRNA sequence
tttttttttttttgagacag

SEQ ID NO: 172196 - DNA, 20 bp, Artificial
  CRISPR gRNA sequence
ttttttttttttgagacaga

SEQ ID NO: 172197 - DNA, 20 bp, Artificial
  CRISPR gRNA sequence
tttttttttttgagacagag

SEQ ID NO: 172198 - DNA, 20 bp, Artificial
  CRISPR gRNA sequence
ttttttttttgagacagagt

SEQ ID NO: 172199 - DNA, 20 bp, Artificial
  CRISPR gRNA sequence
tttttttttgagacagagtt

SEQ ID NO: 172200 - DNA, 20 bp, Artificial
  CRISPR gRNA sequence
ttttttttgagacagagttt

SEQ ID NO: 172201 - DNA, 20 bp, Artificial
  CRISPR gRNA sequence
tttttttgagacagagtttc

SEQ ID NO: 172202 - DNA, 20 bp, Artificial
  CRISPR gRNA sequence
ttttttgagacagagtttcg

SEQ ID NO: 172203 - DNA, 20 bp, Artificial
  CRISPR gRNA sequence
tttttgagacagagtttcgc

SEQ ID NO: 172204 - DNA, 20 bp, Artificial
  CRISPR gRNA sequence
ttttgagacagagtttcgct

SEQ ID NO: 172205 - DNA, 20 bp, Artificial
  CRISPR gRNA sequence
tttgagacagagtttcgctc

SEQ ID NO: 172206 - DNA, 20 bp, Artificial
  CRISPR gRNA sequence
ttgagacagagtttcgctct

SEQ ID NO: 172207 - DNA, 20 bp, Artificial
  CRISPR gRNA sequence
tgagacagagtttcgctctt

SEQ ID NO: 172208 - DNA, 20 bp, Artificial
  CRISPR gRNA sequence
gagacagagtttcgctcttg

SEQ ID NO: 172209 - DNA, 20 bp, Artificial
  CRISPR gRNA sequence
agacagagtttcgctcttgt

SEQ ID NO: 172210 - DNA, 20 bp, Artificial
  CRISPR gRNA sequence
cgctcttgttgcccagactg

SEQ ID NO: 172211 - DNA, 20 bp, Artificial
  CRISPR gRNA sequence
gctcttgttgcccagactgg

SEQ ID NO: 172212 - DNA, 20 bp, Artificial
  CRISPR gRNA sequence
ttgttgcccagactggagtg

SEQ ID NO: 172213 - DNA, 20 bp, Artificial
  CRISPR gRNA sequence
gttgcccagactggagtgca

SEQ ID NO: 172214 - DNA, 20 bp, Artificial
  CRISPR gRNA sequence
ttgcccagactggagtgcag

SEQ ID NO: 172215 - DNA, 20 bp, Artificial
  CRISPR gRNA sequence
cccagactggagtgcagtgg

SEQ ID NO: 172216 - DNA, 20 bp, Artificial
  CRISPR gRNA sequence
gagtgcagtggtgcaatttc

SEQ ID NO: 172217 - DNA, 20 bp, Artificial
  CRISPR gRNA sequence
cagctcactgcaacctctgc

SEQ ID NO: 172218 - DNA, 20 bp, Artificial
  CRISPR gRNA sequence
agctcactgcaacctctgcc

SEQ ID NO: 172219 - DNA, 20 bp, Artificial
  CRISPR gRNA sequence
actgcaacctctgcctccca

SEQ ID NO: 172220 - DNA, 20 bp, Artificial
  CRISPR gRNA sequence
caacctctgcctcccaggtt

SEQ ID NO: 172221 - DNA, 20 bp, Artificial
  CRISPR gRNA sequence
tgcctcccaggttcatgtga

SEQ ID NO: 172222 - DNA, 20 bp, Artificial
  CRISPR gRNA sequence
cctcccaggttcatgtgatt

SEQ ID NO: 172223 - DNA, 20 bp, Artificial
  CRISPR gRNA sequence
ccaggttcatgtgattctcc

SEQ ID NO: 172224 - DNA, 20 bp, Artificial
  CRISPR gRNA sequence
atgtgattctcctgcctcag

SEQ ID NO: 172225 - DNA, 20 bp, Artificial
  CRISPR gRNA sequence
tcctgcctcagcctcctgag

SEQ ID NO: 172226 - DNA, 20 bp, Artificial
  CRISPR gRNA sequence
ctgcctcagcctcctgagta

SEQ ID NO: 172227 - DNA, 20 bp, Artificial
  CRISPR gRNA sequence
cctcagcctcctgagtagct

SEQ ID NO: 172228 - DNA, 20 bp, Artificial
  CRISPR gRNA sequence
agcctcctgagtagctggga

SEQ ID NO: 172229 - DNA, 20 bp, Artificial
  CRISPR gRNA sequence
ctgagtagctgggattacag

SEQ ID NO: 172230 - DNA, 20 bp, Artificial
  CRISPR gRNA sequence
agtagctgggattacaggca

SEQ ID NO: 172231 - DNA, 20 bp, Artificial
  CRISPR gRNA sequence
ggattacaggcatctgccac

SEQ ID NO: 172232 - DNA, 20 bp, Artificial
  CRISPR gRNA sequence
caggcatctgccaccacgcc

SEQ ID NO: 172233 - DNA, 20 bp, Artificial
  CRISPR gRNA sequence
ccaccacgcctagctaattt

SEQ ID NO: 172234 - DNA, 20 bp, Artificial
  CRISPR gRNA sequence
gctaattttttatattttta

SEQ ID NO: 172235 - DNA, 20 bp, Artificial
  CRISPR gRNA sequence
attttttatatttttagtaa

SEQ ID NO: 172236 - DNA, 20 bp, Artificial
  CRISPR gRNA sequence
tttatatttttagtaaagat

SEQ ID NO: 172237 - DNA, 20 bp, Artificial
  CRISPR gRNA sequence
ttatatttttagtaaagatg

SEQ ID NO: 172238 - DNA, 20 bp, Artificial
  CRISPR gRNA sequence
tatatttttagtaaagatgg

SEQ ID NO: 172239 - DNA, 20 bp, Artificial
  CRISPR gRNA sequence
atatttttagtaaagatggg

SEQ ID NO: 172240 - DNA, 20 bp, Artificial
  CRISPR gRNA sequence
tatttttagtaaagatgggg

SEQ ID NO: 172241 - DNA, 20 bp, Artificial
  CRISPR gRNA sequence
ttagtaaagatggggtttcg

SEQ ID NO: 172242 - DNA, 20 bp, Artificial
  CRISPR gRNA sequence
tagtaaagatggggtttcgc

SEQ ID NO: 172243 - DNA, 20 bp, Artificial
  CRISPR gRNA sequence
agtaaagatggggtttcgcc

SEQ ID NO: 172244 - DNA, 20 bp, Artificial
  CRISPR gRNA sequence
gtaaagatggggtttcgcca

SEQ ID NO: 172245 - DNA, 20 bp, Artificial
  CRISPR gRNA sequence
cgccatgttggccaggctgc

SEQ ID NO: 172246 - DNA, 20 bp, Artificial
  CRISPR gRNA sequence
gccatgttggccaggctgcc

SEQ ID NO: 172247 - DNA, 20 bp, Artificial
  CRISPR gRNA sequence
gccaggctgcctcaaactcc

SEQ ID NO: 172248 - DNA, 20 bp, Artificial
  CRISPR gRNA sequence
cctcaaactcctgacctcag

SEQ ID NO: 172249 - DNA, 20 bp, Artificial
  CRISPR gRNA sequence
aaactcctgacctcagatga

SEQ ID NO: 172250 - DNA, 20 bp, Artificial
  CRISPR gRNA sequence
ctgacctcagatgatccacc

SEQ ID NO: 172251 - DNA, 20 bp, Artificial
  CRISPR gRNA sequence
acctcagatgatccacctgc

SEQ ID NO: 172252 - DNA, 20 bp, Artificial
  CRISPR gRNA sequence
agatgatccacctgcctcgt

SEQ ID NO: 172253 - DNA, 20 bp, Artificial
  CRISPR gRNA sequence
cctcgtcctcccaaagtgct

SEQ ID NO: 172254 - DNA, 20 bp, Artificial
  CRISPR gRNA sequence
gtcctcccaaagtgctggga

SEQ ID NO: 172255 - DNA, 20 bp, Artificial
  CRISPR gRNA sequence
ccaaagtgctgggattacag

SEQ ID NO: 172256 - DNA, 20 bp, Artificial
  CRISPR gRNA sequence
ggattacaggcgtgagccac

SEQ ID NO: 172257 - DNA, 20 bp, Artificial
  CRISPR gRNA sequence
caggcgtgagccaccgcgcc

SEQ ID NO: 172258 - DNA, 20 bp, Artificial
  CRISPR gRNA sequence
tttttttttttttttttttt

SEQ ID NO: 172259 - DNA, 20 bp, Artificial
  CRISPR gRNA sequence
tttttttttttttttttttt

SEQ ID NO: 172260 - DNA, 20 bp, Artificial
  CRISPR gRNA sequence
tttttttttttttttttttt

SEQ ID NO: 172261 - DNA, 20 bp, Artificial
  CRISPR gRNA sequence
tttttttttttttttttttg

SEQ ID NO: 172262 - DNA, 20 bp, Artificial
  CRISPR gRNA sequence
ttttttttttttttttttgg

SEQ ID NO: 172263 - DNA, 20 bp, Artificial
  CRISPR gRNA sequence
tttttttttttttttttgga

SEQ ID NO: 172264 - DNA, 20 bp, Artificial
  CRISPR gRNA sequence
ttttttttttttttttggaa

SEQ ID NO: 172265 - DNA, 20 bp, Artificial
  CRISPR gRNA sequence
tttttttttttttttggaat

SEQ ID NO: 172266 - DNA, 20 bp, Artificial
  CRISPR gRNA sequence
ttttttttttttttggaata

SEQ ID NO: 172267 - DNA, 20 bp, Artificial
  CRISPR gRNA sequence
tttttttttttttggaataa

SEQ ID NO: 172268 - DNA, 20 bp, Artificial
  CRISPR gRNA sequence
ttttttttttttggaataag

SEQ ID NO: 172269 - DNA, 20 bp, Artificial
  CRISPR gRNA sequence
tttttttttttggaataagt

SEQ ID NO: 172270 - DNA, 20 bp, Artificial
  CRISPR gRNA sequence
ttttttttttggaataagtt

SEQ ID NO: 172271 - DNA, 20 bp, Artificial
  CRISPR gRNA sequence
tttttttttggaataagttt

SEQ ID NO: 172272 - DNA, 20 bp, Artificial
  CRISPR gRNA sequence
ttttttttggaataagtttg

SEQ ID NO: 172273 - DNA, 20 bp, Artificial
  CRISPR gRNA sequence
tttttttggaataagtttgc

SEQ ID NO: 172274 - DNA, 20 bp, Artificial
  CRISPR gRNA sequence
ttttttggaataagtttgca

SEQ ID NO: 172275 - DNA, 20 bp, Artificial
  CRISPR gRNA sequence
tttttggaataagtttgcat

SEQ ID NO: 172276 - DNA, 20 bp, Artificial
  CRISPR gRNA sequence
ttttggaataagtttgcatt

SEQ ID NO: 172277 - DNA, 20 bp, Artificial
  CRISPR gRNA sequence
tttggaataagtttgcatta

SEQ ID NO: 172278 - DNA, 20 bp, Artificial
  CRISPR gRNA sequence
ttggaataagtttgcattat

SEQ ID NO: 172279 - DNA, 20 bp, Artificial
  CRISPR gRNA sequence
tggaataagtttgcattata

SEQ ID NO: 172280 - DNA, 20 bp, Artificial
  CRISPR gRNA sequence
ggaataagtttgcattatac

SEQ ID NO: 172281 - DNA, 20 bp, Artificial
  CRISPR gRNA sequence
gaataagtttgcattatact

SEQ ID NO: 172282 - DNA, 20 bp, Artificial
  CRISPR gRNA sequence
gcattatacttactggttga

SEQ ID NO: 172283 - DNA, 20 bp, Artificial
  CRISPR gRNA sequence
cattatacttactggttgag

SEQ ID NO: 172284 - DNA, 20 bp, Artificial
  CRISPR gRNA sequence
tacttactggttgagcatcc

SEQ ID NO: 172285 - DNA, 20 bp, Artificial
  CRISPR gRNA sequence
actggttgagcatcccaaat

SEQ ID NO: 172286 - DNA, 20 bp, Artificial
  CRISPR gRNA sequence
ctggttgagcatcccaaatc

SEQ ID NO: 172287 - DNA, 20 bp, Artificial
  CRISPR gRNA sequence
gttgagcatcccaaatctga

SEQ ID NO: 172288 - DNA, 20 bp, Artificial
  CRISPR gRNA sequence
agcatcccaaatctgaaaat

SEQ ID NO: 172289 - DNA, 20 bp, Artificial
  CRISPR gRNA sequence
aaaatccaaaatcgaaaatg

SEQ ID NO: 172290 - DNA, 20 bp, Artificial
  CRISPR gRNA sequence
cctttgagcgtcatgtcagg

SEQ ID NO: 172291 - DNA, 20 bp, Artificial
  CRISPR gRNA sequence
ctttgagcgtcatgtcaggg

SEQ ID NO: 172292 - DNA, 20 bp, Artificial
  CRISPR gRNA sequence
tgagcgtcatgtcagggctc

SEQ ID NO: 172293 - DNA, 20 bp, Artificial
  CRISPR gRNA sequence
gagcgtcatgtcagggctca

SEQ ID NO: 172294 - DNA, 20 bp, Artificial
  CRISPR gRNA sequence
agcgtcatgtcagggctcaa

SEQ ID NO: 172295 - DNA, 20 bp, Artificial
  CRISPR gRNA sequence
aaaaagtttcggatttcaga

SEQ ID NO: 172296 - DNA, 20 bp, Artificial
  CRISPR gRNA sequence
cggatttcagattttcagat

SEQ ID NO: 172297 - DNA, 20 bp, Artificial
  CRISPR gRNA sequence
ggatttcagattttcagatt

SEQ ID NO: 172298 - DNA, 20 bp, Artificial
  CRISPR gRNA sequence
cagattttcagattaaggat

SEQ ID NO: 172299 - DNA, 20 bp, Artificial
  CRISPR gRNA sequence
agattttcagattaaggata

SEQ ID NO: 172300 - DNA, 20 bp, Artificial
  CRISPR gRNA sequence
tcagattaaggatactcaac

SEQ ID NO: 172301 - DNA, 20 bp, Artificial
  CRISPR gRNA sequence
cagattaaggatactcaacc

SEQ ID NO: 172302 - DNA, 20 bp, Artificial
  CRISPR gRNA sequence
agattaaggatactcaacct

SEQ ID NO: 172303 - DNA, 20 bp, Artificial
  CRISPR gRNA sequence
aggatactcaacctgtattg

SEQ ID NO: 172304 - DNA, 20 bp, Artificial
  CRISPR gRNA sequence
aacctgtattgtaatgtctt

SEQ ID NO: 172305 - DNA, 20 bp, Artificial
  CRISPR gRNA sequence
tattgtaatgtcttaagcgc

SEQ ID NO: 172306 - DNA, 20 bp, Artificial
  CRISPR gRNA sequence
taatgtcttaagcgcttatc

SEQ ID NO: 172307 - DNA, 20 bp, Artificial
  CRISPR gRNA sequence
aagcgcttatctggcaaata

SEQ ID NO: 172308 - DNA, 20 bp, Artificial
  CRISPR gRNA sequence
agcgcttatctggcaaatat

SEQ ID NO: 172309 - DNA, 20 bp, Artificial
  CRISPR gRNA sequence
atctggcaaatattaaaatg

SEQ ID NO: 172310 - DNA, 20 bp, Artificial
  CRISPR gRNA sequence
tctggcaaatattaaaatgc

SEQ ID NO: 172311 - DNA, 20 bp, Artificial
  CRISPR gRNA sequence
gcaaatattaaaatgcaaga

SEQ ID NO: 172312 - DNA, 20 bp, Artificial
  CRISPR gRNA sequence
aaatgcaagaacagtttaat

SEQ ID NO: 172313 - DNA, 20 bp, Artificial
  CRISPR gRNA sequence
aattaaacacaaagaatgga

SEQ ID NO: 172314 - DNA, 20 bp, Artificial
  CRISPR gRNA sequence
attaaacacaaagaatggag

SEQ ID NO: 172315 - DNA, 20 bp, Artificial
  CRISPR gRNA sequence
aacacaaagaatggagaaat

SEQ ID NO: 172316 - DNA, 20 bp, Artificial
  CRISPR gRNA sequence
agtgctctcctaagaatctc

SEQ ID NO: 172317 - DNA, 20 bp, Artificial
  CRISPR gRNA sequence
gtgctctcctaagaatctct

SEQ ID NO: 172318 - DNA, 20 bp, Artificial
  CRISPR gRNA sequence
tcctaagaatctctattctg

SEQ ID NO: 172319 - DNA, 20 bp, Artificial
  CRISPR gRNA sequence
ctaagaatctctattctgag

SEQ ID NO: 172320 - DNA, 20 bp, Artificial
  CRISPR gRNA sequence
agaatctctattctgaggaa

SEQ ID NO: 172321 - DNA, 20 bp, Artificial
  CRISPR gRNA sequence
tattctgaggaattatttga

SEQ ID NO: 172322 - DNA, 20 bp, Artificial
  CRISPR gRNA sequence
ttctgaggaattatttgaaa

SEQ ID NO: 172323 - DNA, 20 bp, Artificial
  CRISPR gRNA sequence
tgaggaattatttgaaaagg

SEQ ID NO: 172324 - DNA, 20 bp, Artificial
  CRISPR gRNA sequence
aggaattatttgaaaaggtt

SEQ ID NO: 172325 - DNA, 20 bp, Artificial
  CRISPR gRNA sequence
tttgaaaaggtttaacgtgc

SEQ ID NO: 172326 - DNA, 20 bp, Artificial
  CRISPR gRNA sequence
gaaaaggtttaacgtgccag

SEQ ID NO: 172327 - DNA, 20 bp, Artificial
  CRISPR gRNA sequence
aaaaggtttaacgtgccagt

SEQ ID NO: 172328 - DNA, 20 bp, Artificial
  CRISPR gRNA sequence
aacgtgccagtgacgggatg

SEQ ID NO: 172329 - DNA, 20 bp, Artificial
  CRISPR gRNA sequence
acgtgccagtgacgggatgc

SEQ ID NO: 172330 - DNA, 20 bp, Artificial
  CRISPR gRNA sequence
gcagggagctatgtgagcca

SEQ ID NO: 172331 - DNA, 20 bp, Artificial
  CRISPR gRNA sequence
tgtgagccattaggaactaa

SEQ ID NO: 172332 - DNA, 20 bp, Artificial
  CRISPR gRNA sequence
ggaactaattctgaggggct

SEQ ID NO: 172333 - DNA, 20 bp, Artificial
  CRISPR gRNA sequence
attctgaggggctgaaagca

SEQ ID NO: 172334 - DNA, 20 bp, Artificial
  CRISPR gRNA sequence
tgaggggctgaaagcaaagc

SEQ ID NO: 172335 - DNA, 20 bp, Artificial
  CRISPR gRNA sequence
aggggctgaaagcaaagcac

SEQ ID NO: 172336 - DNA, 20 bp, Artificial
  CRISPR gRNA sequence
aaagcaaagcaccaaagcca

SEQ ID NO: 172337 - DNA, 20 bp, Artificial
  CRISPR gRNA sequence
tcacatgaccagacttgtta

SEQ ID NO: 172338 - DNA, 20 bp, Artificial
  CRISPR gRNA sequence
gttactttccaggctccatg

SEQ ID NO: 172339 - DNA, 20 bp, Artificial
  CRISPR gRNA sequence
ttactttccaggctccatgt

SEQ ID NO: 172340 - DNA, 20 bp, Artificial
  CRISPR gRNA sequence
ctttccaggctccatgtgga

SEQ ID NO: 172341 - DNA, 20 bp, Artificial
  CRISPR gRNA sequence
tccaggctccatgtggatac

SEQ ID NO: 172342 - DNA, 20 bp, Artificial
  CRISPR gRNA sequence
ccaggctccatgtggataca

SEQ ID NO: 172343 - DNA, 20 bp, Artificial
  CRISPR gRNA sequence
caggctccatgtggatacat

SEQ ID NO: 172344 - DNA, 20 bp, Artificial
  CRISPR gRNA sequence
catgtggatacatactgggc

SEQ ID NO: 172345 - DNA, 20 bp, Artificial
  CRISPR gRNA sequence
ggcagaacactctatcacag

SEQ ID NO: 172346 - DNA, 20 bp, Artificial
  CRISPR gRNA sequence
tatcacagcagaatggaatg

SEQ ID NO: 172347 - DNA, 20 bp, Artificial
  CRISPR gRNA sequence
tcacagcagaatggaatgaa

SEQ ID NO: 172348 - DNA, 20 bp, Artificial
  CRISPR gRNA sequence
acaactctaggtttagcctg

SEQ ID NO: 172349 - DNA, 20 bp, Artificial
  CRISPR gRNA sequence
taggtttagcctgtggggat

SEQ ID NO: 172350 - DNA, 20 bp, Artificial
  CRISPR gRNA sequence
ggtttagcctgtggggatgt

SEQ ID NO: 172351 - DNA, 20 bp, Artificial
  CRISPR gRNA sequence
agcctgtggggatgtccaat

SEQ ID NO: 172352 - DNA, 20 bp, Artificial
  CRISPR gRNA sequence
gcctgtggggatgtccaatt

SEQ ID NO: 172353 - DNA, 20 bp, Artificial
  CRISPR gRNA sequence
tggggatgtccaattcactc

SEQ ID NO: 172354 - DNA, 20 bp, Artificial
  CRISPR gRNA sequence
actcttaaatgtttacaggt

SEQ ID NO: 172355 - DNA, 20 bp, Artificial
  CRISPR gRNA sequence
ttaaatgtttacaggtctct

SEQ ID NO: 172356 - DNA, 20 bp, Artificial
  CRISPR gRNA sequence
aaatgtttacaggtctctga

SEQ ID NO: 172357 - DNA, 20 bp, Artificial
  CRISPR gRNA sequence
aatgtttacaggtctctgat

SEQ ID NO: 172358 - DNA, 20 bp, Artificial
  CRISPR gRNA sequence
acaggtctctgatttttttc

SEQ ID NO: 172359 - DNA, 20 bp, Artificial
  CRISPR gRNA sequence
caggtctctgatttttttct

SEQ ID NO: 172360 - DNA, 20 bp, Artificial
  CRISPR gRNA sequence
tgatttttttcttttttttt

SEQ ID NO: 172361 - DNA, 20 bp, Artificial
  CRISPR gRNA sequence
atttttttctttttttttcc

SEQ ID NO: 172362 - DNA, 20 bp, Artificial
  CRISPR gRNA sequence
ttttctttttttttccttcc

SEQ ID NO: 172363 - DNA, 20 bp, Artificial
  CRISPR gRNA sequence
tttctttttttttccttccc

SEQ ID NO: 172364 - DNA, 20 bp, Artificial
  CRISPR gRNA sequence
ttctttttttttccttccct

SEQ ID NO: 172365 - DNA, 20 bp, Artificial
  CRISPR gRNA sequence
tctttttttttccttccctt

SEQ ID NO: 172366 - DNA, 20 bp, Artificial
  CRISPR gRNA sequence
ctttttttttccttcccttt

SEQ ID NO: 172367 - DNA, 20 bp, Artificial
  CRISPR gRNA sequence
tttttttttccttccctttt

SEQ ID NO: 172368 - DNA, 20 bp, Artificial
  CRISPR gRNA sequence
tttttttccttcccttttcc

SEQ ID NO: 172369 - DNA, 20 bp, Artificial
  CRISPR gRNA sequence
ttttttccttcccttttcct

SEQ ID NO: 172370 - DNA, 20 bp, Artificial
  CRISPR gRNA sequence
tttttccttcccttttcctt

SEQ ID NO: 172371 - DNA, 20 bp, Artificial
  CRISPR gRNA sequence
ttttccttcccttttccttc

SEQ ID NO: 172372 - DNA, 20 bp, Artificial
  CRISPR gRNA sequence
tttccttcccttttccttct

SEQ ID NO: 172373 - DNA, 20 bp, Artificial
  CRISPR gRNA sequence
ttccttcccttttccttcta

SEQ ID NO: 172374 - DNA, 20 bp, Artificial
  CRISPR gRNA sequence
tccttcccttttccttctaa

SEQ ID NO: 172375 - DNA, 20 bp, Artificial
  CRISPR gRNA sequence
ccttcccttttccttctaaa

SEQ ID NO: 172376 - DNA, 20 bp, Artificial
  CRISPR gRNA sequence
cttcccttttccttctaaag

SEQ ID NO: 172377 - DNA, 20 bp, Artificial
  CRISPR gRNA sequence
cccttttccttctaaaggaa

SEQ ID NO: 172378 - DNA, 20 bp, Artificial
  CRISPR gRNA sequence
ccttttccttctaaaggaaa

SEQ ID NO: 172379 - DNA, 20 bp, Artificial
  CRISPR gRNA sequence
ttccttctaaaggaaatgat

SEQ ID NO: 172380 - DNA, 20 bp, Artificial
  CRISPR gRNA sequence
tccttctaaaggaaatgatg

SEQ ID NO: 172381 - DNA, 20 bp, Artificial
  CRISPR gRNA sequence
ccttctaaaggaaatgatga

SEQ ID NO: 172382 - DNA, 20 bp, Artificial
  CRISPR gRNA sequence
cttctaaaggaaatgatgag

SEQ ID NO: 172383 - DNA, 20 bp, Artificial
  CRISPR gRNA sequence
ctaaaggaaatgatgagggg

SEQ ID NO: 172384 - DNA, 20 bp, Artificial
  CRISPR gRNA sequence
taaaggaaatgatgagggga

SEQ ID NO: 172385 - DNA, 20 bp, Artificial
  CRISPR gRNA sequence
aaggaaatgatgaggggaaa

SEQ ID NO: 172386 - DNA, 20 bp, Artificial
  CRISPR gRNA sequence
aaagcagatttcattctggt

SEQ ID NO: 172387 - DNA, 20 bp, Artificial
  CRISPR gRNA sequence
cattctggtgtaatgacatt

SEQ ID NO: 172388 - DNA, 20 bp, Artificial
  CRISPR gRNA sequence
attctggtgtaatgacatta

SEQ ID NO: 172389 - DNA, 20 bp, Artificial
  CRISPR gRNA sequence
tggtgtaatgacattagtgg

SEQ ID NO: 172390 - DNA, 20 bp, Artificial
  CRISPR gRNA sequence
gtgtaatgacattagtgggt

SEQ ID NO: 172391 - DNA, 20 bp, Artificial
  CRISPR gRNA sequence
gtgggtgatgatgtaatggg

SEQ ID NO: 172392 - DNA, 20 bp, Artificial
  CRISPR gRNA sequence
ggagccaatttcttgtggtg

SEQ ID NO: 172393 - DNA, 20 bp, Artificial
  CRISPR gRNA sequence
gagccaatttcttgtggtgg

SEQ ID NO: 172394 - DNA, 20 bp, Artificial
  CRISPR gRNA sequence
cttgtggtggaggcctataa

SEQ ID NO: 172395 - DNA, 20 bp, Artificial
  CRISPR gRNA sequence
ttgtggtggaggcctataaa

SEQ ID NO: 172396 - DNA, 20 bp, Artificial
  CRISPR gRNA sequence
gtggtggaggcctataaaca

SEQ ID NO: 172397 - DNA, 20 bp, Artificial
  CRISPR gRNA sequence
tggtggaggcctataaacag

SEQ ID NO: 172398 - DNA, 20 bp, Artificial
  CRISPR gRNA sequence
taaacagctgaacagaaatt

SEQ ID NO: 172399 - DNA, 20 bp, Artificial
  CRISPR gRNA sequence
aacagaaattctagtacctg

SEQ ID NO: 172400 - DNA, 20 bp, Artificial
  CRISPR gRNA sequence
tagtacctgggatacaatat

SEQ ID NO: 172401 - DNA, 20 bp, Artificial
  CRISPR gRNA sequence
gtacctgggatacaatatga

SEQ ID NO: 172402 - DNA, 20 bp, Artificial
  CRISPR gRNA sequence
ggatacaatatgatcttgga

SEQ ID NO: 172403 - DNA, 20 bp, Artificial
  CRISPR gRNA sequence
ggagtttctgaagggagtta

SEQ ID NO: 172404 - DNA, 20 bp, Artificial
  CRISPR gRNA sequence
gagtttctgaagggagttaa

SEQ ID NO: 172405 - DNA, 20 bp, Artificial
  CRISPR gRNA sequence
ctgaagggagttaaagggaa

SEQ ID NO: 172406 - DNA, 20 bp, Artificial
  CRISPR gRNA sequence
tgaagggagttaaagggaag

SEQ ID NO: 172407 - DNA, 20 bp, Artificial
  CRISPR gRNA sequence
aagggagttaaagggaagtg

SEQ ID NO: 172408 - DNA, 20 bp, Artificial
  CRISPR gRNA sequence
aagggaagtgttcaatcaca

SEQ ID NO: 172409 - DNA, 20 bp, Artificial
  CRISPR gRNA sequence
aatcacagttgaaaatgact

SEQ ID NO: 172410 - DNA, 20 bp, Artificial
  CRISPR gRNA sequence
aaaatgactagataaaatct

SEQ ID NO: 172411 - DNA, 20 bp, Artificial
  CRISPR gRNA sequence
gataaaatcttaagtcctaa

SEQ ID NO: 172412 - DNA, 20 bp, Artificial
  CRISPR gRNA sequence
aagtcctaaataaccaagta

SEQ ID NO: 172413 - DNA, 20 bp, Artificial
  CRISPR gRNA sequence
agtcctaaataaccaagtaa

SEQ ID NO: 172414 - DNA, 20 bp, Artificial
  CRISPR gRNA sequence
aataaccaagtaagacccct

SEQ ID NO: 172415 - DNA, 20 bp, Artificial
  CRISPR gRNA sequence
cattttcatttatcaccaca

SEQ ID NO: 172416 - DNA, 20 bp, Artificial
  CRISPR gRNA sequence
tcatttatcaccacatacac

SEQ ID NO: 172417 - DNA, 20 bp, Artificial
  CRISPR gRNA sequence
catttatcaccacatacaca

SEQ ID NO: 172418 - DNA, 20 bp, Artificial
  CRISPR gRNA sequence
atttatcaccacatacacat

SEQ ID NO: 172419 - DNA, 20 bp, Artificial
  CRISPR gRNA sequence
atcaccacatacacatggcc

SEQ ID NO: 172420 - DNA, 20 bp, Artificial
  CRISPR gRNA sequence
tcaccacatacacatggcct

SEQ ID NO: 172421 - DNA, 20 bp, Artificial
  CRISPR gRNA sequence
tatgctactctcttagatgt

SEQ ID NO: 172422 - DNA, 20 bp, Artificial
  CRISPR gRNA sequence
ctctcttagatgtactgaga

SEQ ID NO: 172423 - DNA, 20 bp, Artificial
  CRISPR gRNA sequence
tcttagatgtactgagaaca

SEQ ID NO: 172424 - DNA, 20 bp, Artificial
  CRISPR gRNA sequence
ttagatgtactgagaacaac

SEQ ID NO: 172425 - DNA, 20 bp, Artificial
  CRISPR gRNA sequence
agatgtactgagaacaacaa

SEQ ID NO: 172426 - DNA, 20 bp, Artificial
  CRISPR gRNA sequence
gatgtactgagaacaacaac

SEQ ID NO: 172427 - DNA, 20 bp, Artificial
  CRISPR gRNA sequence
agaacaacaacaaaaaaatt

SEQ ID NO: 172428 - DNA, 20 bp, Artificial
  CRISPR gRNA sequence
aggtaatctagagaagttta

SEQ ID NO: 172429 - DNA, 20 bp, Artificial
  CRISPR gRNA sequence
gagaagtttagttatttatc

SEQ ID NO: 172430 - DNA, 20 bp, Artificial
  CRISPR gRNA sequence
agttatttatcattattaat

SEQ ID NO: 172431 - DNA, 20 bp, Artificial
  CRISPR gRNA sequence
gttatttatcattattaata

SEQ ID NO: 172432 - DNA, 20 bp, Artificial
  CRISPR gRNA sequence
tttatcattattaatagttt

SEQ ID NO: 172433 - DNA, 20 bp, Artificial
  CRISPR gRNA sequence
atcattattaatagttttct

SEQ ID NO: 172434 - DNA, 20 bp, Artificial
  CRISPR gRNA sequence
tcattattaatagttttcta

SEQ ID NO: 172435 - DNA, 20 bp, Artificial
  CRISPR gRNA sequence
ttaatagttttctacaaggt

SEQ ID NO: 172436 - DNA, 20 bp, Artificial
  CRISPR gRNA sequence
atagttttctacaaggtact

SEQ ID NO: 172437 - DNA, 20 bp, Artificial
  CRISPR gRNA sequence
tctacaaggtactcatgaaa

SEQ ID NO: 172438 - DNA, 20 bp, Artificial
  CRISPR gRNA sequence
ctacaaggtactcatgaaaa

SEQ ID NO: 172439 - DNA, 20 bp, Artificial
  CRISPR gRNA sequence
tacaaggtactcatgaaaat

SEQ ID NO: 172440 - DNA, 20 bp, Artificial
  CRISPR gRNA sequence
caaggtactcatgaaaatga

SEQ ID NO: 172441 - DNA, 20 bp, Artificial
  CRISPR gRNA sequence
atgaaaatgaagacagtgac

SEQ ID NO: 172442 - DNA, 20 bp, Artificial
  CRISPR gRNA sequence
aatttaaccttttttaaatg

SEQ ID NO: 172443 - DNA, 20 bp, Artificial
  CRISPR gRNA sequence
aaccttttttaaatggggca

SEQ ID NO: 172444 - DNA, 20 bp, Artificial
  CRISPR gRNA sequence
accttttttaaatggggcaa

SEQ ID NO: 172445 - DNA, 20 bp, Artificial
  CRISPR gRNA sequence
ttttaaatggggcaaacaaa

SEQ ID NO: 172446 - DNA, 20 bp, Artificial
  CRISPR gRNA sequence
tttaaatggggcaaacaaaa

SEQ ID NO: 172447 - DNA, 20 bp, Artificial
  CRISPR gRNA sequence
ttaaatggggcaaacaaaaa

SEQ ID NO: 172448 - DNA, 20 bp, Artificial
  CRISPR gRNA sequence
taaatggggcaaacaaaaat

SEQ ID NO: 172449 - DNA, 20 bp, Artificial
  CRISPR gRNA sequence
aaatggggcaaacaaaaata

SEQ ID NO: 172450 - DNA, 20 bp, Artificial
  CRISPR gRNA sequence
aatggggcaaacaaaaatat

SEQ ID NO: 172451 - DNA, 20 bp, Artificial
  CRISPR gRNA sequence
tctggaaataataataatta

SEQ ID NO: 172452 - DNA, 20 bp, Artificial
  CRISPR gRNA sequence
ctggaaataataataattat

SEQ ID NO: 172453 - DNA, 20 bp, Artificial
  CRISPR gRNA sequence
tggaaataataataattatc

SEQ ID NO: 172454 - DNA, 20 bp, Artificial
  CRISPR gRNA sequence
gaaataataataattatcaa

SEQ ID NO: 172455 - DNA, 20 bp, Artificial
  CRISPR gRNA sequence
tcaaaaagctttaaaagaat

SEQ ID NO: 172456 - DNA, 20 bp, Artificial
  CRISPR gRNA sequence
taaaagaatctaacctttta

SEQ ID NO: 172457 - DNA, 20 bp, Artificial
  CRISPR gRNA sequence
aaaagaatctaaccttttat

SEQ ID NO: 172458 - DNA, 20 bp, Artificial
  CRISPR gRNA sequence
aaagaatctaaccttttatt

SEQ ID NO: 172459 - DNA, 20 bp, Artificial
  CRISPR gRNA sequence
accttttattgcatgggtcc

SEQ ID NO: 172460 - DNA, 20 bp, Artificial
  CRISPR gRNA sequence
ttattgcatgggtccctgga

SEQ ID NO: 172461 - DNA, 20 bp, Artificial
  CRISPR gRNA sequence
tattgcatgggtccctggac

SEQ ID NO: 172462 - DNA, 20 bp, Artificial
  CRISPR gRNA sequence
attgcatgggtccctggaca

SEQ ID NO: 172463 - DNA, 20 bp, Artificial
  CRISPR gRNA sequence
ttgcatgggtccctggacag

SEQ ID NO: 172464 - DNA, 20 bp, Artificial
  CRISPR gRNA sequence
catgggtccctggacaggcc

SEQ ID NO: 172465 - DNA, 20 bp, Artificial
  CRISPR gRNA sequence
gacaggcctcatcttggcac

SEQ ID NO: 172466 - DNA, 20 bp, Artificial
  CRISPR gRNA sequence
atcttggcacaatctgccat

SEQ ID NO: 172467 - DNA, 20 bp, Artificial
  CRISPR gRNA sequence
ggcacaatctgccatgcaaa

SEQ ID NO: 172468 - DNA, 20 bp, Artificial
  CRISPR gRNA sequence
gcacaatctgccatgcaaac

SEQ ID NO: 172469 - DNA, 20 bp, Artificial
  CRISPR gRNA sequence
ccatgcaaactgctaaggtc

SEQ ID NO: 172470 - DNA, 20 bp, Artificial
  CRISPR gRNA sequence
ctaaggtcaaaggagaaaga

SEQ ID NO: 172471 - DNA, 20 bp, Artificial
  CRISPR gRNA sequence
aggtcaaaggagaaagatgc

SEQ ID NO: 172472 - DNA, 20 bp, Artificial
  CRISPR gRNA sequence
ccaggacgatatctctgtac

SEQ ID NO: 172473 - DNA, 20 bp, Artificial
  CRISPR gRNA sequence
tgtacacttgctaatggatg

SEQ ID NO: 172474 - DNA, 20 bp, Artificial
  CRISPR gRNA sequence
tacacttgctaatggatggg

SEQ ID NO: 172475 - DNA, 20 bp, Artificial
  CRISPR gRNA sequence
gctaatggatgggtaggttt

SEQ ID NO: 172476 - DNA, 20 bp, Artificial
  CRISPR gRNA sequence
ctaatggatgggtaggttta

SEQ ID NO: 172477 - DNA, 20 bp, Artificial
  CRISPR gRNA sequence
atggatgggtaggtttagtt

SEQ ID NO: 172478 - DNA, 20 bp, Artificial
  CRISPR gRNA sequence
agttggagtacaaagacctg

SEQ ID NO: 172479 - DNA, 20 bp, Artificial
  CRISPR gRNA sequence
gttggagtacaaagacctgt

SEQ ID NO: 172480 - DNA, 20 bp, Artificial
  CRISPR gRNA sequence
gagtacaaagacctgtacga

SEQ ID NO: 172481 - DNA, 20 bp, Artificial
  CRISPR gRNA sequence
tacgatttaaaagtctggta

SEQ ID NO: 172482 - DNA, 20 bp, Artificial
  CRISPR gRNA sequence
aaaagtctggtaacaaattc

SEQ ID NO: 172483 - DNA, 20 bp, Artificial
  CRISPR gRNA sequence
aaagtctggtaacaaattct

SEQ ID NO: 172484 - DNA, 20 bp, Artificial
  CRISPR gRNA sequence
gtaacaaattctggctgtcc

SEQ ID NO: 172485 - DNA, 20 bp, Artificial
  CRISPR gRNA sequence
tggctgtcctctgatatccc

SEQ ID NO: 172486 - DNA, 20 bp, Artificial
  CRISPR gRNA sequence
gctgtcctctgatatccccc

SEQ ID NO: 172487 - DNA, 20 bp, Artificial
  CRISPR gRNA sequence
tcctctgatatccccccaaa

SEQ ID NO: 172488 - DNA, 20 bp, Artificial
  CRISPR gRNA sequence
tgatatccccccaaaacatt

SEQ ID NO: 172489 - DNA, 20 bp, Artificial
  CRISPR gRNA sequence
atatccccccaaaacattac

SEQ ID NO: 172490 - DNA, 20 bp, Artificial
  CRISPR gRNA sequence
caaaggtacacaattcaaaa

SEQ ID NO: 172491 - DNA, 20 bp, Artificial
  CRISPR gRNA sequence
aaaaagcacgtctagaacca

SEQ ID NO: 172492 - DNA, 20 bp, Artificial
  CRISPR gRNA sequence
gaaccatctgtgcagtctgc

SEQ ID NO: 172493 - DNA, 20 bp, Artificial
  CRISPR gRNA sequence
tgcagtctgcttttaaattt

SEQ ID NO: 172494 - DNA, 20 bp, Artificial
  CRISPR gRNA sequence
cttttaaattttgaactgtc

SEQ ID NO: 172495 - DNA, 20 bp, Artificial
  CRISPR gRNA sequence
ttaaattttgaactgtccca

SEQ ID NO: 172496 - DNA, 20 bp, Artificial
  CRISPR gRNA sequence
taaattttgaactgtcccaa

SEQ ID NO: 172497 - DNA, 20 bp, Artificial
  CRISPR gRNA sequence
aaattttgaactgtcccaac

SEQ ID NO: 172498 - DNA, 20 bp, Artificial
  CRISPR gRNA sequence
aattttgaactgtcccaact

SEQ ID NO: 172499 - DNA, 20 bp, Artificial
  CRISPR gRNA sequence
tgaactgtcccaactacaga

SEQ ID NO: 172500 - DNA, 20 bp, Artificial
  CRISPR gRNA sequence
gaactgtcccaactacagat

SEQ ID NO: 172501 - DNA, 20 bp, Artificial
  CRISPR gRNA sequence
aactgtcccaactacagatg

SEQ ID NO: 172502 - DNA, 20 bp, Artificial
  CRISPR gRNA sequence
tcccaactacagatgtgcag

SEQ ID NO: 172503 - DNA, 20 bp, Artificial
  CRISPR gRNA sequence
cagatgtgcaggcatgatca

SEQ ID NO: 172504 - DNA, 20 bp, Artificial
  CRISPR gRNA sequence
tgtagtcaacagatcatgaa

SEQ ID NO: 172505 - DNA, 20 bp, Artificial
  CRISPR gRNA sequence
tggctggctcagagccacat

SEQ ID NO: 172506 - DNA, 20 bp, Artificial
  CRISPR gRNA sequence
ggctggctcagagccacata

SEQ ID NO: 172507 - DNA, 20 bp, Artificial
  CRISPR gRNA sequence
gctggctcagagccacatac

SEQ ID NO: 172508 - DNA, 20 bp, Artificial
  CRISPR gRNA sequence
gctcagagccacatactgta

SEQ ID NO: 172509 - DNA, 20 bp, Artificial
  CRISPR gRNA sequence
agagccacatactgtagtag

SEQ ID NO: 172510 - DNA, 20 bp, Artificial
  CRISPR gRNA sequence
tagtagtggaagttaggtac

SEQ ID NO: 172511 - DNA, 20 bp, Artificial
  CRISPR gRNA sequence
ggtacaaaacagaagttatc

SEQ ID NO: 172512 - DNA, 20 bp, Artificial
  CRISPR gRNA sequence
tcaaatttttttggaactga

SEQ ID NO: 172513 - DNA, 20 bp, Artificial
  CRISPR gRNA sequence
ttttggaactgaaaatgtat

SEQ ID NO: 172514 - DNA, 20 bp, Artificial
  CRISPR gRNA sequence
tttggaactgaaaatgtatt

SEQ ID NO: 172515 - DNA, 20 bp, Artificial
  CRISPR gRNA sequence
ttggaactgaaaatgtatta

SEQ ID NO: 172516 - DNA, 20 bp, Artificial
  CRISPR gRNA sequence
tggaactgaaaatgtattaa

SEQ ID NO: 172517 - DNA, 20 bp, Artificial
  CRISPR gRNA sequence
ggaactgaaaatgtattaaa

SEQ ID NO: 172518 - DNA, 20 bp, Artificial
  CRISPR gRNA sequence
gaactgaaaatgtattaaag

SEQ ID NO: 172519 - DNA, 20 bp, Artificial
  CRISPR gRNA sequence
aaaatgtattaaaggttaag

SEQ ID NO: 172520 - DNA, 20 bp, Artificial
  CRISPR gRNA sequence
aaggttaagttttaaaattg

SEQ ID NO: 172521 - DNA, 20 bp, Artificial
  CRISPR gRNA sequence
agttttaaaattgagaagcc

SEQ ID NO: 172522 - DNA, 20 bp, Artificial
  CRISPR gRNA sequence
taaaattgagaagcccatct

SEQ ID NO: 172523 - DNA, 20 bp, Artificial
  CRISPR gRNA sequence
aaaattgagaagcccatcta

SEQ ID NO: 172524 - DNA, 20 bp, Artificial
  CRISPR gRNA sequence
aaattgagaagcccatctac

SEQ ID NO: 172525 - DNA, 20 bp, Artificial
  CRISPR gRNA sequence
agaagcccatctacattagg

SEQ ID NO: 172526 - DNA, 20 bp, Artificial
  CRISPR gRNA sequence
cattaggaaatcccaaatag

SEQ ID NO: 172527 - DNA, 20 bp, Artificial
  CRISPR gRNA sequence
ggaaatcccaaataggtaaa

SEQ ID NO: 172528 - DNA, 20 bp, Artificial
  CRISPR gRNA sequence
tacattttactgcatcatag

SEQ ID NO: 172529 - DNA, 20 bp, Artificial
  CRISPR gRNA sequence
acattttactgcatcataga

SEQ ID NO: 172530 - DNA, 20 bp, Artificial
  CRISPR gRNA sequence
cattttactgcatcatagaa

SEQ ID NO: 172531 - DNA, 20 bp, Artificial
  CRISPR gRNA sequence
tactgcatcatagaagttca

SEQ ID NO: 172532 - DNA, 20 bp, Artificial
  CRISPR gRNA sequence
actgcatcatagaagttcag

SEQ ID NO: 172533 - DNA, 20 bp, Artificial
  CRISPR gRNA sequence
ctgcatcatagaagttcagg

SEQ ID NO: 172534 - DNA, 20 bp, Artificial
  CRISPR gRNA sequence
catcatagaagttcaggact

SEQ ID NO: 172535 - DNA, 20 bp, Artificial
  CRISPR gRNA sequence
aggactgaaaaaaaaaaaaa

SEQ ID NO: 172536 - DNA, 20 bp, Artificial
  CRISPR gRNA sequence
aaaaaaaaaaaaaaagacat

SEQ ID NO: 172537 - DNA, 20 bp, Artificial
  CRISPR gRNA sequence
aggcccaccccttcataaga

SEQ ID NO: 172538 - DNA, 20 bp, Artificial
  CRISPR gRNA sequence
cataagacgctcgcagcttt

SEQ ID NO: 172539 - DNA, 20 bp, Artificial
  CRISPR gRNA sequence
ataagacgctcgcagctttt

SEQ ID NO: 172540 - DNA, 20 bp, Artificial
  CRISPR gRNA sequence
gcagcttttcttcaacctct

SEQ ID NO: 172541 - DNA, 20 bp, Artificial
  CRISPR gRNA sequence
ttcttcaacctctgcccaac

SEQ ID NO: 172542 - DNA, 20 bp, Artificial
  CRISPR gRNA sequence
tcttcaacctctgcccaacc

SEQ ID NO: 172543 - DNA, 20 bp, Artificial
  CRISPR gRNA sequence
cttcaacctctgcccaaccc

SEQ ID NO: 172544 - DNA, 20 bp, Artificial
  CRISPR gRNA sequence
ttcaacctctgcccaacccc

SEQ ID NO: 172545 - DNA, 20 bp, Artificial
  CRISPR gRNA sequence
caacctctgcccaaccccgg

SEQ ID NO: 172546 - DNA, 20 bp, Artificial
  CRISPR gRNA sequence
aacctctgcccaaccccggg

SEQ ID NO: 172547 - DNA, 20 bp, Artificial
  CRISPR gRNA sequence
tgcccaaccccgggtgattc

SEQ ID NO: 172548 - DNA, 20 bp, Artificial
  CRISPR gRNA sequence
cccaaccccgggtgattcta

SEQ ID NO: 172549 - DNA, 20 bp, Artificial
  CRISPR gRNA sequence
taccttaagtgttcaaccag

SEQ ID NO: 172550 - DNA, 20 bp, Artificial
  CRISPR gRNA sequence
ccttaagtgttcaaccagct

SEQ ID NO: 172551 - DNA, 20 bp, Artificial
  CRISPR gRNA sequence
aagtgttcaaccagcttaca

SEQ ID NO: 172552 - DNA, 20 bp, Artificial
  CRISPR gRNA sequence
agtgttcaaccagcttacat

SEQ ID NO: 172553 - DNA, 20 bp, Artificial
  CRISPR gRNA sequence
aaccagcttacatttgaggg

SEQ ID NO: 172554 - DNA, 20 bp, Artificial
  CRISPR gRNA sequence
acatttgagggcccccccac

SEQ ID NO: 172555 - DNA, 20 bp, Artificial
  CRISPR gRNA sequence
catttgagggcccccccact

SEQ ID NO: 172556 - DNA, 20 bp, Artificial
  CRISPR gRNA sequence
gagggcccccccactccagt

SEQ ID NO: 172557 - DNA, 20 bp, Artificial
  CRISPR gRNA sequence
agggcccccccactccagtt

SEQ ID NO: 172558 - DNA, 20 bp, Artificial
  CRISPR gRNA sequence
cagttctgggaaactggctt

SEQ ID NO: 172559 - DNA, 20 bp, Artificial
  CRISPR gRNA sequence
tgggaaactggcttactggt

SEQ ID NO: 172560 - DNA, 20 bp, Artificial
  CRISPR gRNA sequence
ggaaactggcttactggtaa

SEQ ID NO: 172561 - DNA, 20 bp, Artificial
  CRISPR gRNA sequence
gcttactggtaagacattct

SEQ ID NO: 172562 - DNA, 20 bp, Artificial
  CRISPR gRNA sequence
actggtaagacattctttcc

SEQ ID NO: 172563 - DNA, 20 bp, Artificial
  CRISPR gRNA sequence
ctggtaagacattctttccc

SEQ ID NO: 172564 - DNA, 20 bp, Artificial
  CRISPR gRNA sequence
gtaagacattctttcccatc

SEQ ID NO: 172565 - DNA, 20 bp, Artificial
  CRISPR gRNA sequence
tttcccatctttggacagct

SEQ ID NO: 172566 - DNA, 20 bp, Artificial
  CRISPR gRNA sequence
tcccatctttggacagctct

SEQ ID NO: 172567 - DNA, 20 bp, Artificial
  CRISPR gRNA sequence
cccatctttggacagctcta

SEQ ID NO: 172568 - DNA, 20 bp, Artificial
  CRISPR gRNA sequence
ccatctttggacagctctaa

SEQ ID NO: 172569 - DNA, 20 bp, Artificial
  CRISPR gRNA sequence
tggacagctctaactgttct

SEQ ID NO: 172570 - DNA, 20 bp, Artificial
  CRISPR gRNA sequence
ggacagctctaactgttctt

SEQ ID NO: 172571 - DNA, 20 bp, Artificial
  CRISPR gRNA sequence
gacagctctaactgttcttc

SEQ ID NO: 172572 - DNA, 20 bp, Artificial
  CRISPR gRNA sequence
taactgttcttctttacatt

SEQ ID NO: 172573 - DNA, 20 bp, Artificial
  CRISPR gRNA sequence
actgttcttctttacattag

SEQ ID NO: 172574 - DNA, 20 bp, Artificial
  CRISPR gRNA sequence
ttcttctttacattaggttt

SEQ ID NO: 172575 - DNA, 20 bp, Artificial
  CRISPR gRNA sequence
ttctttacattaggttttag

SEQ ID NO: 172576 - DNA, 20 bp, Artificial
  CRISPR gRNA sequence
ctttacattaggttttagag

SEQ ID NO: 172577 - DNA, 20 bp, Artificial
  CRISPR gRNA sequence
tttacattaggttttagagt

SEQ ID NO: 172578 - DNA, 20 bp, Artificial
  CRISPR gRNA sequence
tacattaggttttagagtta

SEQ ID NO: 172579 - DNA, 20 bp, Artificial
  CRISPR gRNA sequence
acattaggttttagagttat

SEQ ID NO: 172580 - DNA, 20 bp, Artificial
  CRISPR gRNA sequence
cattaggttttagagttatg

SEQ ID NO: 172581 - DNA, 20 bp, Artificial
  CRISPR gRNA sequence
ggttttagagttatggcctt

SEQ ID NO: 172582 - DNA, 20 bp, Artificial
  CRISPR gRNA sequence
tagagttatggcctttatga

SEQ ID NO: 172583 - DNA, 20 bp, Artificial
  CRISPR gRNA sequence
agagttatggcctttatgat

SEQ ID NO: 172584 - DNA, 20 bp, Artificial
  CRISPR gRNA sequence
gagttatggcctttatgatt

SEQ ID NO: 172585 - DNA, 20 bp, Artificial
  CRISPR gRNA sequence
tggcctttatgatttttcca

SEQ ID NO: 172586 - DNA, 20 bp, Artificial
  CRISPR gRNA sequence
tatgatttttccatccagca

SEQ ID NO: 172587 - DNA, 20 bp, Artificial
  CRISPR gRNA sequence
atgatttttccatccagcaa

SEQ ID NO: 172588 - DNA, 20 bp, Artificial
  CRISPR gRNA sequence
tgatttttccatccagcaaa

SEQ ID NO: 172589 - DNA, 20 bp, Artificial
  CRISPR gRNA sequence
ttccatccagcaaactcttt

SEQ ID NO: 172590 - DNA, 20 bp, Artificial
  CRISPR gRNA sequence
tccatccagcaaactctttt

SEQ ID NO: 172591 - DNA, 20 bp, Artificial
  CRISPR gRNA sequence
ccatccagcaaactcttttt

SEQ ID NO: 172592 - DNA, 20 bp, Artificial
  CRISPR gRNA sequence
catccagcaaactcttttta

SEQ ID NO: 172593 - DNA, 20 bp, Artificial
  CRISPR gRNA sequence
tttttataaattcctgactt

SEQ ID NO: 172594 - DNA, 20 bp, Artificial
  CRISPR gRNA sequence
tttataaattcctgacttcg

SEQ ID NO: 172595 - DNA, 20 bp, Artificial
  CRISPR gRNA sequence
ttataaattcctgacttcga

SEQ ID NO: 172596 - DNA, 20 bp, Artificial
  CRISPR gRNA sequence
tataaattcctgacttcgaa

SEQ ID NO: 172597 - DNA, 20 bp, Artificial
  CRISPR gRNA sequence
ataaattcctgacttcgaaa

SEQ ID NO: 172598 - DNA, 20 bp, Artificial
  CRISPR gRNA sequence
taaattcctgacttcgaaag

SEQ ID NO: 172599 - DNA, 20 bp, Artificial
  CRISPR gRNA sequence
ctgacttcgaaagacaaagg

SEQ ID NO: 172600 - DNA, 20 bp, Artificial
  CRISPR gRNA sequence
acttcgaaagacaaaggtaa

SEQ ID NO: 172601 - DNA, 20 bp, Artificial
  CRISPR gRNA sequence
cgaaagacaaaggtaatctt

SEQ ID NO: 172602 - DNA, 20 bp, Artificial
  CRISPR gRNA sequence
gaaagacaaaggtaatcttc

SEQ ID NO: 172603 - DNA, 20 bp, Artificial
  CRISPR gRNA sequence
cttttgaaggacacaagttc

SEQ ID NO: 172604 - DNA, 20 bp, Artificial
  CRISPR gRNA sequence
ttttgaaggacacaagttct

SEQ ID NO: 172605 - DNA, 20 bp, Artificial
  CRISPR gRNA sequence
ttgaaggacacaagttcttc

SEQ ID NO: 172606 - DNA, 20 bp, Artificial
  CRISPR gRNA sequence
tgaaggacacaagttcttct

SEQ ID NO: 172607 - DNA, 20 bp, Artificial
  CRISPR gRNA sequence
gaaggacacaagttcttctc

SEQ ID NO: 172608 - DNA, 20 bp, Artificial
  CRISPR gRNA sequence
aaggacacaagttcttctca

SEQ ID NO: 172609 - DNA, 20 bp, Artificial
  CRISPR gRNA sequence
ttctcaccaggaaaaaagag

SEQ ID NO: 172610 - DNA, 20 bp, Artificial
  CRISPR gRNA sequence
ctcaccaggaaaaaagagaa

SEQ ID NO: 172611 - DNA, 20 bp, Artificial
  CRISPR gRNA sequence
tcaccaggaaaaaagagaaa

SEQ ID NO: 172612 - DNA, 20 bp, Artificial
  CRISPR gRNA sequence
accaggaaaaaagagaaaaa

SEQ ID NO: 172613 - DNA, 20 bp, Artificial
  CRISPR gRNA sequence
gaagcatgttttctaacatc

SEQ ID NO: 172614 - DNA, 20 bp, Artificial
  CRISPR gRNA sequence
aagcatgttttctaacatct

SEQ ID NO: 172615 - DNA, 20 bp, Artificial
  CRISPR gRNA sequence
tctaacatctttgcagatat

SEQ ID NO: 172616 - DNA, 20 bp, Artificial
  CRISPR gRNA sequence
ctaacatctttgcagatatt

SEQ ID NO: 172617 - DNA, 20 bp, Artificial
  CRISPR gRNA sequence
taacatctttgcagatatta

SEQ ID NO: 172618 - DNA, 20 bp, Artificial
  CRISPR gRNA sequence
acatctttgcagatattatt

SEQ ID NO: 172619 - DNA, 20 bp, Artificial
  CRISPR gRNA sequence
tgcagatattattagtaatg

SEQ ID NO: 172620 - DNA, 20 bp, Artificial
  CRISPR gRNA sequence
gcagatattattagtaatgt

SEQ ID NO: 172621 - DNA, 20 bp, Artificial
  CRISPR gRNA sequence
cagatattattagtaatgtc

SEQ ID NO: 172622 - DNA, 20 bp, Artificial
  CRISPR gRNA sequence
ttagtaatgtctcttagaag

SEQ ID NO: 172623 - DNA, 20 bp, Artificial
  CRISPR gRNA sequence
gtaatgtctcttagaagaac

SEQ ID NO: 172624 - DNA, 20 bp, Artificial
  CRISPR gRNA sequence
ttagaagaacataaattgtt

SEQ ID NO: 172625 - DNA, 20 bp, Artificial
  CRISPR gRNA sequence
agaagaacataaattgttaa

SEQ ID NO: 172626 - DNA, 20 bp, Artificial
  CRISPR gRNA sequence
gaagaacataaattgttaat

SEQ ID NO: 172627 - DNA, 20 bp, Artificial
  CRISPR gRNA sequence
ttaatgtaaattcctggaaa

SEQ ID NO: 172628 - DNA, 20 bp, Artificial
  CRISPR gRNA sequence
atgtaaattcctggaaaaag

SEQ ID NO: 172629 - DNA, 20 bp, Artificial
  CRISPR gRNA sequence
ctggaaaaagtgagtacttt

SEQ ID NO: 172630 - DNA, 20 bp, Artificial
  CRISPR gRNA sequence
gaaaaagtgagtacttttat

SEQ ID NO: 172631 - DNA, 20 bp, Artificial
  CRISPR gRNA sequence
ttattcaaaaggcttttcct

SEQ ID NO: 172632 - DNA, 20 bp, Artificial
  CRISPR gRNA sequence
tattcaaaaggcttttccta

SEQ ID NO: 172633 - DNA, 20 bp, Artificial
  CRISPR gRNA sequence
attcaaaaggcttttcctaa

SEQ ID NO: 172634 - DNA, 20 bp, Artificial
  CRISPR gRNA sequence
ttcaaaaggcttttcctaaa

SEQ ID NO: 172635 - DNA, 20 bp, Artificial
  CRISPR gRNA sequence
aaaaggcttttcctaaagca

SEQ ID NO: 172636 - DNA, 20 bp, Artificial
  CRISPR gRNA sequence
ttcctaaagcagatccattc

SEQ ID NO: 172637 - DNA, 20 bp, Artificial
  CRISPR gRNA sequence
tcctaaagcagatccattct

SEQ ID NO: 172638 - DNA, 20 bp, Artificial
  CRISPR gRNA sequence
cctaaagcagatccattctt

SEQ ID NO: 172639 - DNA, 20 bp, Artificial
  CRISPR gRNA sequence
ctaaagcagatccattcttt

SEQ ID NO: 172640 - DNA, 20 bp, Artificial
  CRISPR gRNA sequence
aagcagatccattctttgca

SEQ ID NO: 172641 - DNA, 20 bp, Artificial
  CRISPR gRNA sequence
tttgcatggagctttaaaaa

SEQ ID NO: 172642 - DNA, 20 bp, Artificial
  CRISPR gRNA sequence
tgcatggagctttaaaaaca

SEQ ID NO: 172643 - DNA, 20 bp, Artificial
  CRISPR gRNA sequence
gcatggagctttaaaaacac

SEQ ID NO: 172644 - DNA, 20 bp, Artificial
  CRISPR gRNA sequence
catggagctttaaaaacacc

SEQ ID NO: 172645 - DNA, 20 bp, Artificial
  CRISPR gRNA sequence
taaaaacacccaacaattaa

SEQ ID NO: 172646 - DNA, 20 bp, Artificial
  CRISPR gRNA sequence
aaaaacacccaacaattaat

SEQ ID NO: 172647 - DNA, 20 bp, Artificial
  CRISPR gRNA sequence
aaaacacccaacaattaata

SEQ ID NO: 172648 - DNA, 20 bp, Artificial
  CRISPR gRNA sequence
atattatatatataaagcag

SEQ ID NO: 172649 - DNA, 20 bp, Artificial
  CRISPR gRNA sequence
tatatataaagcaggccggg

SEQ ID NO: 172650 - DNA, 20 bp, Artificial
  CRISPR gRNA sequence
acgtctgtaatcccagcact

SEQ ID NO: 172651 - DNA, 20 bp, Artificial
  CRISPR gRNA sequence
taatcccagcactttgggag

SEQ ID NO: 172652 - DNA, 20 bp, Artificial
  CRISPR gRNA sequence
tgggaggccaaggcgggtgg

SEQ ID NO: 172653 - DNA, 20 bp, Artificial
  CRISPR gRNA sequence
gggaggccaaggcgggtgga

SEQ ID NO: 172654 - DNA, 20 bp, Artificial
  CRISPR gRNA sequence
ggaggccaaggcgggtggat

SEQ ID NO: 172655 - DNA, 20 bp, Artificial
  CRISPR gRNA sequence
aggtcaggagttcgagacca

SEQ ID NO: 172656 - DNA, 20 bp, Artificial
  CRISPR gRNA sequence
gagaccagcctggccaacat

SEQ ID NO: 172657 - DNA, 20 bp, Artificial
  CRISPR gRNA sequence
gccaacatggtgaaacctca

SEQ ID NO: 172658 - DNA, 20 bp, Artificial
  CRISPR gRNA sequence
atctctactaaaaatgcaaa

SEQ ID NO: 172659 - DNA, 20 bp, Artificial
  CRISPR gRNA sequence
tactaaaaatgcaaaaatta

SEQ ID NO: 172660 - DNA, 20 bp, Artificial
  CRISPR gRNA sequence
ctaaaaatgcaaaaattagc

SEQ ID NO: 172661 - DNA, 20 bp, Artificial
  CRISPR gRNA sequence
aaaatgcaaaaattagctgg

SEQ ID NO: 172662 - DNA, 20 bp, Artificial
  CRISPR gRNA sequence
gctggctgtggtggcacatg

SEQ ID NO: 172663 - DNA, 20 bp, Artificial
  CRISPR gRNA sequence
gctgtggtggcacatgcctg

SEQ ID NO: 172664 - DNA, 20 bp, Artificial
  CRISPR gRNA sequence
tggtggcacatgcctgtagt

SEQ ID NO: 172665 - DNA, 20 bp, Artificial
  CRISPR gRNA sequence
tagtcccagctactcgggaa

SEQ ID NO: 172666 - DNA, 20 bp, Artificial
  CRISPR gRNA sequence
ctcgggaaccaaggaggtgg

SEQ ID NO: 172667 - DNA, 20 bp, Artificial
  CRISPR gRNA sequence
gggaaccaaggaggtggagg

SEQ ID NO: 172668 - DNA, 20 bp, Artificial
  CRISPR gRNA sequence
caaacccaggaggtggaggt

SEQ ID NO: 172669 - DNA, 20 bp, Artificial
  CRISPR gRNA sequence
cagtgagccgaggtcatgcc

SEQ ID NO: 172670 - DNA, 20 bp, Artificial
  CRISPR gRNA sequence
cactccagcctgggtgacag

SEQ ID NO: 172671 - DNA, 20 bp, Artificial
  CRISPR gRNA sequence
cagcctgggtgacagagcaa

SEQ ID NO: 172672 - DNA, 20 bp, Artificial
  CRISPR gRNA sequence
ggtgacagagcaagactcca

SEQ ID NO: 172673 - DNA, 20 bp, Artificial
  CRISPR gRNA sequence
catctcaaaataaataaata

SEQ ID NO: 172674 - DNA, 20 bp, Artificial
  CRISPR gRNA sequence
aaaataaataaataaataaa

SEQ ID NO: 172675 - DNA, 20 bp, Artificial
  CRISPR gRNA sequence
atcacctcttattttaatgc

SEQ ID NO: 172676 - DNA, 20 bp, Artificial
  CRISPR gRNA sequence
ttattttaatgcattaattg

SEQ ID NO: 172677 - DNA, 20 bp, Artificial
  CRISPR gRNA sequence
attttaatgcattaattgca

SEQ ID NO: 172678 - DNA, 20 bp, Artificial
  CRISPR gRNA sequence
ttttaatgcattaattgcaa

SEQ ID NO: 172679 - DNA, 20 bp, Artificial
  CRISPR gRNA sequence
taatgcattaattgcaaata

SEQ ID NO: 172680 - DNA, 20 bp, Artificial
  CRISPR gRNA sequence
aatgcattaattgcaaataa

SEQ ID NO: 172681 - DNA, 20 bp, Artificial
  CRISPR gRNA sequence
atgcattaattgcaaataaa

SEQ ID NO: 172682 - DNA, 20 bp, Artificial
  CRISPR gRNA sequence
attgcaaataaattgatttt

SEQ ID NO: 172683 - DNA, 20 bp, Artificial
  CRISPR gRNA sequence
caaataaattgattttgcta

SEQ ID NO: 172684 - DNA, 20 bp, Artificial
  CRISPR gRNA sequence
attttgctacagaagtagtc

SEQ ID NO: 172685 - DNA, 20 bp, Artificial
  CRISPR gRNA sequence
tgctacagaagtagtccatt

SEQ ID NO: 172686 - DNA, 20 bp, Artificial
  CRISPR gRNA sequence
gctacagaagtagtccattt

SEQ ID NO: 172687 - DNA, 20 bp, Artificial
  CRISPR gRNA sequence
ctacagaagtagtccattta

SEQ ID NO: 172688 - DNA, 20 bp, Artificial
  CRISPR gRNA sequence
cagaagtagtccatttacaa

SEQ ID NO: 172689 - DNA, 20 bp, Artificial
  CRISPR gRNA sequence
acaacatctacaagcccatg

SEQ ID NO: 172690 - DNA, 20 bp, Artificial
  CRISPR gRNA sequence
caacatctacaagcccatgg

SEQ ID NO: 172691 - DNA, 20 bp, Artificial
  CRISPR gRNA sequence
caagcccatggaaaatattc

SEQ ID NO: 172692 - DNA, 20 bp, Artificial
  CRISPR gRNA sequence
tgggttcatcttctaggata

SEQ ID NO: 172693 - DNA, 20 bp, Artificial
  CRISPR gRNA sequence
ggttcatcttctaggataat

SEQ ID NO: 172694 - DNA, 20 bp, Artificial
  CRISPR gRNA sequence
atcttctaggataataaggg

SEQ ID NO: 172695 - DNA, 20 bp, Artificial
  CRISPR gRNA sequence
ctaggataataagggaaaga

SEQ ID NO: 172696 - DNA, 20 bp, Artificial
  CRISPR gRNA sequence
taggataataagggaaagaa

SEQ ID NO: 172697 - DNA, 20 bp, Artificial
  CRISPR gRNA sequence
ggataataagggaaagaatg

SEQ ID NO: 172698 - DNA, 20 bp, Artificial
  CRISPR gRNA sequence
aaaagtaagaggaggctggg

SEQ ID NO: 172699 - DNA, 20 bp, Artificial
  CRISPR gRNA sequence
aaagtaagaggaggctgggt

SEQ ID NO: 172700 - DNA, 20 bp, Artificial
  CRISPR gRNA sequence
ggtgttgtggcttatgtctg

SEQ ID NO: 172701 - DNA, 20 bp, Artificial
  CRISPR gRNA sequence
tggcttatgtctgtaatccc

SEQ ID NO: 172702 - DNA, 20 bp, Artificial
  CRISPR gRNA sequence
atgtctgtaatcccaacaac

SEQ ID NO: 172703 - DNA, 20 bp, Artificial
  CRISPR gRNA sequence
tgtctgtaatcccaacaact

SEQ ID NO: 172704 - DNA, 20 bp, Artificial
  CRISPR gRNA sequence
taatcccaacaactccggag

SEQ ID NO: 172705 - DNA, 20 bp, Artificial
  CRISPR gRNA sequence
cggaggctgagacaggagaa

SEQ ID NO: 172706 - DNA, 20 bp, Artificial
  CRISPR gRNA sequence
agacaggagaatcacttcag

SEQ ID NO: 172707 - DNA, 20 bp, Artificial
  CRISPR gRNA sequence
caggccagtagtttgagacc

SEQ ID NO: 172708 - DNA, 20 bp, Artificial
  CRISPR gRNA sequence
aggccagtagtttgagacca

SEQ ID NO: 172709 - DNA, 20 bp, Artificial
  CRISPR gRNA sequence
gagaccagccttggcaacac

SEQ ID NO: 172710 - DNA, 20 bp, Artificial
  CRISPR gRNA sequence
agaccagccttggcaacaca

SEQ ID NO: 172711 - DNA, 20 bp, Artificial
  CRISPR gRNA sequence
ggcaacacagtgagactctg

SEQ ID NO: 172712 - DNA, 20 bp, Artificial
  CRISPR gRNA sequence
gcaacacagtgagactctgt

SEQ ID NO: 172713 - DNA, 20 bp, Artificial
  CRISPR gRNA sequence
tgtctctaaaaaaaggattt

SEQ ID NO: 172714 - DNA, 20 bp, Artificial
  CRISPR gRNA sequence
tctctaaaaaaaggattttt

SEQ ID NO: 172715 - DNA, 20 bp, Artificial
  CRISPR gRNA sequence
taaaaaaaggattttttaag

SEQ ID NO: 172716 - DNA, 20 bp, Artificial
  CRISPR gRNA sequence
aaaaaaggattttttaaggc

SEQ ID NO: 172717 - DNA, 20 bp, Artificial
  CRISPR gRNA sequence
tttaaggccaggggctgtgg

SEQ ID NO: 172718 - DNA, 20 bp, Artificial
  CRISPR gRNA sequence
ttaaggccaggggctgtggc

SEQ ID NO: 172719 - DNA, 20 bp, Artificial
  CRISPR gRNA sequence
taaggccaggggctgtggct

SEQ ID NO: 172720 - DNA, 20 bp, Artificial
  CRISPR gRNA sequence
aaggccaggggctgtggctc

SEQ ID NO: 172721 - DNA, 20 bp, Artificial
  CRISPR gRNA sequence
aggccaggggctgtggctca

SEQ ID NO: 172722 - DNA, 20 bp, Artificial
  CRISPR gRNA sequence
tggctcacacctgtaatccc

SEQ ID NO: 172723 - DNA, 20 bp, Artificial
  CRISPR gRNA sequence
acacctgtaatcccaacact

SEQ ID NO: 172724 - DNA, 20 bp, Artificial
  CRISPR gRNA sequence
taatcccaacactttgggag

SEQ ID NO: 172725 - DNA, 20 bp, Artificial
  CRISPR gRNA sequence
tgggaggctgaggtggagga

SEQ ID NO: 172726 - DNA, 20 bp, Artificial
  CRISPR gRNA sequence
gggaggctgaggtggaggat

SEQ ID NO: 172727 - DNA, 20 bp, Artificial
  CRISPR gRNA sequence
ggaggctgaggtggaggatc

SEQ ID NO: 172728 - DNA, 20 bp, Artificial
  CRISPR gRNA sequence
aggtggaggatcacttgagg

SEQ ID NO: 172729 - DNA, 20 bp, Artificial
  CRISPR gRNA sequence
gaggtcaggagttcaagacc

SEQ ID NO: 172730 - DNA, 20 bp, Artificial
  CRISPR gRNA sequence
aggtcaggagttcaagacca

SEQ ID NO: 172731 - DNA, 20 bp, Artificial
  CRISPR gRNA sequence
aagaccagcctggctaatat

SEQ ID NO: 172732 - DNA, 20 bp, Artificial
  CRISPR gRNA sequence
gctaatatagcaaaaccctg

SEQ ID NO: 172733 - DNA, 20 bp, Artificial
  CRISPR gRNA sequence
atatagcaaaaccctgtttc

SEQ ID NO: 172734 - DNA, 20 bp, Artificial
  CRISPR gRNA sequence
tttctactaaaaacacaaaa

SEQ ID NO: 172735 - DNA, 20 bp, Artificial
  CRISPR gRNA sequence
ctactaaaaacacaaaatac

SEQ ID NO: 172736 - DNA, 20 bp, Artificial
  CRISPR gRNA sequence
tactaaaaacacaaaataca

SEQ ID NO: 172737 - DNA, 20 bp, Artificial
  CRISPR gRNA sequence
ctaaaaacacaaaatacatt

SEQ ID NO: 172738 - DNA, 20 bp, Artificial
  CRISPR gRNA sequence
aaaacacaaaatacattagc

SEQ ID NO: 172739 - DNA, 20 bp, Artificial
  CRISPR gRNA sequence
gccgagcatggtggcacatg

SEQ ID NO: 172740 - DNA, 20 bp, Artificial
  CRISPR gRNA sequence
ataatcccagctacttggga

SEQ ID NO: 172741 - DNA, 20 bp, Artificial
  CRISPR gRNA sequence
taatcccagctacttgggag

SEQ ID NO: 172742 - DNA, 20 bp, Artificial
  CRISPR gRNA sequence
cttgggaggctgaggcaaca

SEQ ID NO: 172743 - DNA, 20 bp, Artificial
  CRISPR gRNA sequence
gggaggctgaggcaacagtt

SEQ ID NO: 172744 - DNA, 20 bp, Artificial
  CRISPR gRNA sequence
ggaggctgaggcaacagttt

SEQ ID NO: 172745 - DNA, 20 bp, Artificial
  CRISPR gRNA sequence
aggcaacagtttcactggaa

SEQ ID NO: 172746 - DNA, 20 bp, Artificial
  CRISPR gRNA sequence
cactggaacctgggaagcgg

SEQ ID NO: 172747 - DNA, 20 bp, Artificial
  CRISPR gRNA sequence
actggaacctgggaagcgga

SEQ ID NO: 172748 - DNA, 20 bp, Artificial
  CRISPR gRNA sequence
gaacctgggaagcggaggtt

SEQ ID NO: 172749 - DNA, 20 bp, Artificial
  CRISPR gRNA sequence
ggaagcggaggttgcagtga

SEQ ID NO: 172750 - DNA, 20 bp, Artificial
  CRISPR gRNA sequence
cagtgagtcaagataatgcc

SEQ ID NO: 172751 - DNA, 20 bp, Artificial
  CRISPR gRNA sequence
cacaacagcctgggcgacag

SEQ ID NO: 172752 - DNA, 20 bp, Artificial
  CRISPR gRNA sequence
ggcgacagagcgagactcca

SEQ ID NO: 172753 - DNA, 20 bp, Artificial
  CRISPR gRNA sequence
catctcaaaaagaagaataa

SEQ ID NO: 172754 - DNA, 20 bp, Artificial
  CRISPR gRNA sequence
aaaaagaagaataaaaaaaa

SEQ ID NO: 172755 - DNA, 20 bp, Artificial
  CRISPR gRNA sequence
ttaaataggcattgtggcac

SEQ ID NO: 172756 - DNA, 20 bp, Artificial
  CRISPR gRNA sequence
taaataggcattgtggcaca

SEQ ID NO: 172757 - DNA, 20 bp, Artificial
  CRISPR gRNA sequence
aaataggcattgtggcacac

SEQ ID NO: 172758 - DNA, 20 bp, Artificial
  CRISPR gRNA sequence
aataggcattgtggcacaca

SEQ ID NO: 172759 - DNA, 20 bp, Artificial
  CRISPR gRNA sequence
tggcacacacgtgtaagtct

SEQ ID NO: 172760 - DNA, 20 bp, Artificial
  CRISPR gRNA sequence
agctactcaggaggctgagg

SEQ ID NO: 172761 - DNA, 20 bp, Artificial
  CRISPR gRNA sequence
gctactcaggaggctgaggc

SEQ ID NO: 172762 - DNA, 20 bp, Artificial
  CRISPR gRNA sequence
ctcaggaggctgaggcagaa

SEQ ID NO: 172763 - DNA, 20 bp, Artificial
  CRISPR gRNA sequence
aggaggctgaggcagaagga

SEQ ID NO: 172764 - DNA, 20 bp, Artificial
  CRISPR gRNA sequence
aggcagaaggatctcctggg

SEQ ID NO: 172765 - DNA, 20 bp, Artificial
  CRISPR gRNA sequence
ctgggcccaggagtttgagg

SEQ ID NO: 172766 - DNA, 20 bp, Artificial
  CRISPR gRNA sequence
ggcccaggagtttgaggcta

SEQ ID NO: 172767 - DNA, 20 bp, Artificial
  CRISPR gRNA sequence
gaggctacagtgagctatga

SEQ ID NO: 172768 - DNA, 20 bp, Artificial
  CRISPR gRNA sequence
aggctacagtgagctatgat

SEQ ID NO: 172769 - DNA, 20 bp, Artificial
  CRISPR gRNA sequence
cagtgagctatgatcacacc

SEQ ID NO: 172770 - DNA, 20 bp, Artificial
  CRISPR gRNA sequence
tgatcacaccactgcactcc

SEQ ID NO: 172771 - DNA, 20 bp, Artificial
  CRISPR gRNA sequence
cactccagcctgggcaacag

SEQ ID NO: 172772 - DNA, 20 bp, Artificial
  CRISPR gRNA sequence
cagcctgggcaacagaggga

SEQ ID NO: 172773 - DNA, 20 bp, Artificial
  CRISPR gRNA sequence
ggcaacagagggagaccctg

SEQ ID NO: 172774 - DNA, 20 bp, Artificial
  CRISPR gRNA sequence
cctcaaaaaaattataataa

SEQ ID NO: 172775 - DNA, 20 bp, Artificial
  CRISPR gRNA sequence
aaaaaaattataataataaa

SEQ ID NO: 172776 - DNA, 20 bp, Artificial
  CRISPR gRNA sequence
taataataaaaaatacaaga

SEQ ID NO: 172777 - DNA, 20 bp, Artificial
  CRISPR gRNA sequence
attccaggatcctcttcatt

SEQ ID NO: 172778 - DNA, 20 bp, Artificial
  CRISPR gRNA sequence
caggatcctcttcattccat

SEQ ID NO: 172779 - DNA, 20 bp, Artificial
  CRISPR gRNA sequence
ttcattccatgttaaactac

SEQ ID NO: 172780 - DNA, 20 bp, Artificial
  CRISPR gRNA sequence
cattccatgttaaactactc

SEQ ID NO: 172781 - DNA, 20 bp, Artificial
  CRISPR gRNA sequence
attccatgttaaactactct

SEQ ID NO: 172782 - DNA, 20 bp, Artificial
  CRISPR gRNA sequence
catgttaaactactctttct

SEQ ID NO: 172783 - DNA, 20 bp, Artificial
  CRISPR gRNA sequence
aactactctttctctctatt

SEQ ID NO: 172784 - DNA, 20 bp, Artificial
  CRISPR gRNA sequence
ctctttctctctattttttt

SEQ ID NO: 172785 - DNA, 20 bp, Artificial
  CRISPR gRNA sequence
tttctctctatttttttttt

SEQ ID NO: 172786 - DNA, 20 bp, Artificial
  CRISPR gRNA sequence
tctctctattttttttttct

SEQ ID NO: 172787 - DNA, 20 bp, Artificial
  CRISPR gRNA sequence
ctctctattttttttttctc

SEQ ID NO: 172788 - DNA, 20 bp, Artificial
  CRISPR gRNA sequence
tctctattttttttttctca

SEQ ID NO: 172789 - DNA, 20 bp, Artificial
  CRISPR gRNA sequence
tctattttttttttctcaaa

SEQ ID NO: 172790 - DNA, 20 bp, Artificial
  CRISPR gRNA sequence
tattttttttttctcaaagc

SEQ ID NO: 172791 - DNA, 20 bp, Artificial
  CRISPR gRNA sequence
ttttttttttctcaaagcca

SEQ ID NO: 172792 - DNA, 20 bp, Artificial
  CRISPR gRNA sequence
tttttttctcaaagccaggg

SEQ ID NO: 172793 - DNA, 20 bp, Artificial
  CRISPR gRNA sequence
ttttttctcaaagccagggt

SEQ ID NO: 172794 - DNA, 20 bp, Artificial
  CRISPR gRNA sequence
tttttctcaaagccagggtt

SEQ ID NO: 172795 - DNA, 20 bp, Artificial
  CRISPR gRNA sequence
ttttctcaaagccagggttt

SEQ ID NO: 172796 - DNA, 20 bp, Artificial
  CRISPR gRNA sequence
tttctcaaagccagggtttc

SEQ ID NO: 172797 - DNA, 20 bp, Artificial
  CRISPR gRNA sequence
ttctcaaagccagggtttcg

SEQ ID NO: 172798 - DNA, 20 bp, Artificial
  CRISPR gRNA sequence
tctcaaagccagggtttcgc

SEQ ID NO: 172799 - DNA, 20 bp, Artificial
  CRISPR gRNA sequence
ctcaaagccagggtttcgct

SEQ ID NO: 172800 - DNA, 20 bp, Artificial
  CRISPR gRNA sequence
tcaaagccagggtttcgctc

SEQ ID NO: 172801 - DNA, 20 bp, Artificial
  CRISPR gRNA sequence
aaagccagggtttcgctctg

SEQ ID NO: 172802 - DNA, 20 bp, Artificial
  CRISPR gRNA sequence
cgctctgttgcccaggctgg

SEQ ID NO: 172803 - DNA, 20 bp, Artificial
  CRISPR gRNA sequence
gctctgttgcccaggctgga

SEQ ID NO: 172804 - DNA, 20 bp, Artificial
  CRISPR gRNA sequence
tgttgcccaggctggagtgc

SEQ ID NO: 172805 - DNA, 20 bp, Artificial
  CRISPR gRNA sequence
ttgcccaggctggagtgcaa

SEQ ID NO: 172806 - DNA, 20 bp, Artificial
  CRISPR gRNA sequence
cccaggctggagtgcaatgg

SEQ ID NO: 172807 - DNA, 20 bp, Artificial
  CRISPR gRNA sequence
gagtgcaatggtgtgatctt

SEQ ID NO: 172808 - DNA, 20 bp, Artificial
  CRISPR gRNA sequence
ggctcactgcagcctctacc

SEQ ID NO: 172809 - DNA, 20 bp, Artificial
  CRISPR gRNA sequence
gctcactgcagcctctacct

SEQ ID NO: 172810 - DNA, 20 bp, Artificial
  CRISPR gRNA sequence
actgcagcctctacctcctg

SEQ ID NO: 172811 - DNA, 20 bp, Artificial
  CRISPR gRNA sequence
cagcctctacctcctgggct

SEQ ID NO: 172812 - DNA, 20 bp, Artificial
  CRISPR gRNA sequence
tacctcctgggctcaagcaa

SEQ ID NO: 172813 - DNA, 20 bp, Artificial
  CRISPR gRNA sequence
cctcctgggctcaagcaatc

SEQ ID NO: 172814 - DNA, 20 bp, Artificial
  CRISPR gRNA sequence
ctgggctcaagcaatcctcc

SEQ ID NO: 172815 - DNA, 20 bp, Artificial
  CRISPR gRNA sequence
ggctcaagcaatcctcctac

SEQ ID NO: 172816 - DNA, 20 bp, Artificial
  CRISPR gRNA sequence
aagcaatcctcctaccacag

SEQ ID NO: 172817 - DNA, 20 bp, Artificial
  CRISPR gRNA sequence
ctaccacagcctcccaagta

SEQ ID NO: 172818 - DNA, 20 bp, Artificial
  CRISPR gRNA sequence
ccacagcctcccaagtagct

SEQ ID NO: 172819 - DNA, 20 bp, Artificial
  CRISPR gRNA sequence
ccaagtagctgggactacag

SEQ ID NO: 172820 - DNA, 20 bp, Artificial
  CRISPR gRNA sequence
ggactacaggcactcaactc

SEQ ID NO: 172821 - DNA, 20 bp, Artificial
  CRISPR gRNA sequence
caggcactcaactcaattac

SEQ ID NO: 172822 - DNA, 20 bp, Artificial
  CRISPR gRNA sequence
aactcaattactatctctcc

SEQ ID NO: 172823 - DNA, 20 bp, Artificial
  CRISPR gRNA sequence
aattactatctctccacgaa

SEQ ID NO: 172824 - DNA, 20 bp, Artificial
  CRISPR gRNA sequence
ctatctctccacgaagtatt

SEQ ID NO: 172825 - DNA, 20 bp, Artificial
  CRISPR gRNA sequence
tctctccacgaagtattctc

SEQ ID NO: 172826 - DNA, 20 bp, Artificial
  CRISPR gRNA sequence
tccacgaagtattctctact

SEQ ID NO: 172827 - DNA, 20 bp, Artificial
  CRISPR gRNA sequence
cacgaagtattctctactgc

SEQ ID NO: 172828 - DNA, 20 bp, Artificial
  CRISPR gRNA sequence
tctactgctttctggaactg

SEQ ID NO: 172829 - DNA, 20 bp, Artificial
  CRISPR gRNA sequence
tactgctttctggaactggt

SEQ ID NO: 172830 - DNA, 20 bp, Artificial
  CRISPR gRNA sequence
ctgctttctggaactggtcc

SEQ ID NO: 172831 - DNA, 20 bp, Artificial
  CRISPR gRNA sequence
ctttctggaactggtccctc

SEQ ID NO: 172832 - DNA, 20 bp, Artificial
  CRISPR gRNA sequence
tctggaactggtccctccct

SEQ ID NO: 172833 - DNA, 20 bp, Artificial
  CRISPR gRNA sequence
ctggaactggtccctccctt

SEQ ID NO: 172834 - DNA, 20 bp, Artificial
  CRISPR gRNA sequence
tggaactggtccctcccttg

SEQ ID NO: 172835 - DNA, 20 bp, Artificial
  CRISPR gRNA sequence
gaactggtccctcccttggg

SEQ ID NO: 172836 - DNA, 20 bp, Artificial
  CRISPR gRNA sequence
gtccctcccttgggagcatt

SEQ ID NO: 172837 - DNA, 20 bp, Artificial
  CRISPR gRNA sequence
ccttgggagcattaaggagg

SEQ ID NO: 172838 - DNA, 20 bp, Artificial
  CRISPR gRNA sequence
gggagcattaaggaggcccg

SEQ ID NO: 172839 - DNA, 20 bp, Artificial
  CRISPR gRNA sequence
ggagcattaaggaggcccga

SEQ ID NO: 172840 - DNA, 20 bp, Artificial
  CRISPR gRNA sequence
aggaggcccgatctgcacct

SEQ ID NO: 172841 - DNA, 20 bp, Artificial
  CRISPR gRNA sequence
cacctctctttctgtcctca

SEQ ID NO: 172842 - DNA, 20 bp, Artificial
  CRISPR gRNA sequence
tctttctgtcctcaccacat

SEQ ID NO: 172843 - DNA, 20 bp, Artificial
  CRISPR gRNA sequence
tttctgtcctcaccacatta

SEQ ID NO: 172844 - DNA, 20 bp, Artificial
  CRISPR gRNA sequence
tctgtcctcaccacattacc

SEQ ID NO: 172845 - DNA, 20 bp, Artificial
  CRISPR gRNA sequence
ctgtcctcaccacattacct

SEQ ID NO: 172846 - DNA, 20 bp, Artificial
  CRISPR gRNA sequence
tgtcctcaccacattacctt

SEQ ID NO: 172847 - DNA, 20 bp, Artificial
  CRISPR gRNA sequence
tcctcaccacattaccttgt

SEQ ID NO: 172848 - DNA, 20 bp, Artificial
  CRISPR gRNA sequence
accacattaccttgtacaat

SEQ ID NO: 172849 - DNA, 20 bp, Artificial
  CRISPR gRNA sequence
ccttgtacaatcattgtatt

SEQ ID NO: 172850 - DNA, 20 bp, Artificial
  CRISPR gRNA sequence
gtacaatcattgtatttgat

SEQ ID NO: 172851 - DNA, 20 bp, Artificial
  CRISPR gRNA sequence
tacaatcattgtatttgata

SEQ ID NO: 172852 - DNA, 20 bp, Artificial
  CRISPR gRNA sequence
tatttgataccttgtatgac

SEQ ID NO: 172853 - DNA, 20 bp, Artificial
  CRISPR gRNA sequence
gataccttgtatgacataca

SEQ ID NO: 172854 - DNA, 20 bp, Artificial
  CRISPR gRNA sequence
ataccttgtatgacatacac

SEQ ID NO: 172855 - DNA, 20 bp, Artificial
  CRISPR gRNA sequence
gtatgacatacacatcaatg

SEQ ID NO: 172856 - DNA, 20 bp, Artificial
  CRISPR gRNA sequence
tatgacatacacatcaatgt

SEQ ID NO: 172857 - DNA, 20 bp, Artificial
  CRISPR gRNA sequence
atttcccctcctgctataca

SEQ ID NO: 172858 - DNA, 20 bp, Artificial
  CRISPR gRNA sequence
tttcccctcctgctatacaa

SEQ ID NO: 172859 - DNA, 20 bp, Artificial
  CRISPR gRNA sequence
cccctcctgctatacaagct

SEQ ID NO: 172860 - DNA, 20 bp, Artificial
  CRISPR gRNA sequence
ccctcctgctatacaagctc

SEQ ID NO: 172861 - DNA, 20 bp, Artificial
  CRISPR gRNA sequence
ctgctatacaagctccttga

SEQ ID NO: 172862 - DNA, 20 bp, Artificial
  CRISPR gRNA sequence
ctatacaagctccttgaggg

SEQ ID NO: 172863 - DNA, 20 bp, Artificial
  CRISPR gRNA sequence
tacaagctccttgagggtag

SEQ ID NO: 172864 - DNA, 20 bp, Artificial
  CRISPR gRNA sequence
cttgagggtaggatctgcat

SEQ ID NO: 172865 - DNA, 20 bp, Artificial
  CRISPR gRNA sequence
gagggtaggatctgcatatg

SEQ ID NO: 172866 - DNA, 20 bp, Artificial
  CRISPR gRNA sequence
agggtaggatctgcatatga

SEQ ID NO: 172867 - DNA, 20 bp, Artificial
  CRISPR gRNA sequence
catatgattcatctctctgg

SEQ ID NO: 172868 - DNA, 20 bp, Artificial
  CRISPR gRNA sequence
atctctctggatccctcaca

SEQ ID NO: 172869 - DNA, 20 bp, Artificial
  CRISPR gRNA sequence
tctggatccctcacagtatc

SEQ ID NO: 172870 - DNA, 20 bp, Artificial
  CRISPR gRNA sequence
tggatccctcacagtatcca

SEQ ID NO: 172871 - DNA, 20 bp, Artificial
  CRISPR gRNA sequence
gatccctcacagtatccagc

SEQ ID NO: 172872 - DNA, 20 bp, Artificial
  CRISPR gRNA sequence
acagtatccagcacacagtc

SEQ ID NO: 172873 - DNA, 20 bp, Artificial
  CRISPR gRNA sequence
ataactaattacccctaaga

SEQ ID NO: 172874 - DNA, 20 bp, Artificial
  CRISPR gRNA sequence
attacccctaagaggaggtg

SEQ ID NO: 172875 - DNA, 20 bp, Artificial
  CRISPR gRNA sequence
cccctaagaggaggtgcaag

SEQ ID NO: 172876 - DNA, 20 bp, Artificial
  CRISPR gRNA sequence
agaggaggtgcaagactgat

SEQ ID NO: 172877 - DNA, 20 bp, Artificial
  CRISPR gRNA sequence
atgctgggtatggcctttca

SEQ ID NO: 172878 - DNA, 20 bp, Artificial
  CRISPR gRNA sequence
ggtatggcctttcaggaaaa

SEQ ID NO: 172879 - DNA, 20 bp, Artificial
  CRISPR gRNA sequence
tcaggaaaaaaaaaaaaggg

SEQ ID NO: 172880 - DNA, 20 bp, Artificial
  CRISPR gRNA sequence
caggaaaaaaaaaaaagggg

SEQ ID NO: 172881 - DNA, 20 bp, Artificial
  CRISPR gRNA sequence
aggaaaaaaaaaaaaggggg

SEQ ID NO: 172882 - DNA, 20 bp, Artificial
  CRISPR gRNA sequence
ggaaagcttggccctgacat

SEQ ID NO: 172883 - DNA, 20 bp, Artificial
  CRISPR gRNA sequence
gaaagcttggccctgacata

SEQ ID NO: 172884 - DNA, 20 bp, Artificial
  CRISPR gRNA sequence
ggccctgacatacttattgg

SEQ ID NO: 172885 - DNA, 20 bp, Artificial
  CRISPR gRNA sequence
gccctgacatacttattgga

SEQ ID NO: 172886 - DNA, 20 bp, Artificial
  CRISPR gRNA sequence
acatacttattggaattgcc

SEQ ID NO: 172887 - DNA, 20 bp, Artificial
  CRISPR gRNA sequence
attggaattgcctaaccaaa

SEQ ID NO: 172888 - DNA, 20 bp, Artificial
  CRISPR gRNA sequence
ttggaattgcctaaccaaag

SEQ ID NO: 172889 - DNA, 20 bp, Artificial
  CRISPR gRNA sequence
gaattgcctaaccaaaggaa

SEQ ID NO: 172890 - DNA, 20 bp, Artificial
  CRISPR gRNA sequence
cctaaccaaaggaaatggtt

SEQ ID NO: 172891 - DNA, 20 bp, Artificial
  CRISPR gRNA sequence
accaaaggaaatggttacac

SEQ ID NO: 172892 - DNA, 20 bp, Artificial
  CRISPR gRNA sequence
cacaagctattccagaagct

SEQ ID NO: 172893 - DNA, 20 bp, Artificial
  CRISPR gRNA sequence
ttccagaagcttagactaaa

SEQ ID NO: 172894 - DNA, 20 bp, Artificial
  CRISPR gRNA sequence
cagaagcttagactaaatga

SEQ ID NO: 172895 - DNA, 20 bp, Artificial
  CRISPR gRNA sequence
agactaaatgagctccagga

SEQ ID NO: 172896 - DNA, 20 bp, Artificial
  CRISPR gRNA sequence
gactaaatgagctccaggac

SEQ ID NO: 172897 - DNA, 20 bp, Artificial
  CRISPR gRNA sequence
aatgagctccaggactttaa

SEQ ID NO: 172898 - DNA, 20 bp, Artificial
  CRISPR gRNA sequence
caggactttaaagcaagact

SEQ ID NO: 172899 - DNA, 20 bp, Artificial
  CRISPR gRNA sequence
taaagcaagactgcaatcag

SEQ ID NO: 172900 - DNA, 20 bp, Artificial
  CRISPR gRNA sequence
aaagcaagactgcaatcaga

SEQ ID NO: 172901 - DNA, 20 bp, Artificial
  CRISPR gRNA sequence
aagcaagactgcaatcagaa

SEQ ID NO: 172902 - DNA, 20 bp, Artificial
  CRISPR gRNA sequence
caatcagaaatctacctgaa

SEQ ID NO: 172903 - DNA, 20 bp, Artificial
  CRISPR gRNA sequence
cctgaaactgatttactgaa

SEQ ID NO: 172904 - DNA, 20 bp, Artificial
  CRISPR gRNA sequence
aaactgatttactgaaatgg

SEQ ID NO: 172905 - DNA, 20 bp, Artificial
  CRISPR gRNA sequence
atttactgaaatggatttaa

SEQ ID NO: 172906 - DNA, 20 bp, Artificial
  CRISPR gRNA sequence
actgaaatggatttaaaata

SEQ ID NO: 172907 - DNA, 20 bp, Artificial
  CRISPR gRNA sequence
ctgaaatggatttaaaataa

SEQ ID NO: 172908 - DNA, 20 bp, Artificial
  CRISPR gRNA sequence
aaatggatttaaaataaaag

SEQ ID NO: 172909 - DNA, 20 bp, Artificial
  CRISPR gRNA sequence
aaaataaaaggggatgacag

SEQ ID NO: 172910 - DNA, 20 bp, Artificial
  CRISPR gRNA sequence
aaataaaaggggatgacaga

SEQ ID NO: 172911 - DNA, 20 bp, Artificial
  CRISPR gRNA sequence
agacagtgctggaagctgaa

SEQ ID NO: 172912 - DNA, 20 bp, Artificial
  CRISPR gRNA sequence
gaagctgaaaggcagacttg

SEQ ID NO: 172913 - DNA, 20 bp, Artificial
  CRISPR gRNA sequence
aaaggcagacttgaaggctg

SEQ ID NO: 172914 - DNA, 20 bp, Artificial
  CRISPR gRNA sequence
gaaggctggaaatgtggatg

SEQ ID NO: 172915 - DNA, 20 bp, Artificial
  CRISPR gRNA sequence
aaggctggaaatgtggatgc

SEQ ID NO: 172916 - DNA, 20 bp, Artificial
  CRISPR gRNA sequence
gaaatgtggatgcataccat

SEQ ID NO: 172917 - DNA, 20 bp, Artificial
  CRISPR gRNA sequence
tcaagtgtaaatcttttcaa

SEQ ID NO: 172918 - DNA, 20 bp, Artificial
  CRISPR gRNA sequence
aagtgtaaatcttttcaaag

SEQ ID NO: 172919 - DNA, 20 bp, Artificial
  CRISPR gRNA sequence
ttcaaagtcagaacctcttc

SEQ ID NO: 172920 - DNA, 20 bp, Artificial
  CRISPR gRNA sequence
tcaaagtcagaacctcttca

SEQ ID NO: 172921 - DNA, 20 bp, Artificial
  CRISPR gRNA sequence
caaagtcagaacctcttcag

SEQ ID NO: 172922 - DNA, 20 bp, Artificial
  CRISPR gRNA sequence
aaagtcagaacctcttcaga

SEQ ID NO: 172923 - DNA, 20 bp, Artificial
  CRISPR gRNA sequence
ttcagaaaagtgaccaggat

SEQ ID NO: 172924 - DNA, 20 bp, Artificial
  CRISPR gRNA sequence
cagaaaagtgaccaggatag

SEQ ID NO: 172925 - DNA, 20 bp, Artificial
  CRISPR gRNA sequence
agaaaagtgaccaggataga

SEQ ID NO: 172926 - DNA, 20 bp, Artificial
  CRISPR gRNA sequence
gcaaagtctgaaatattaat

SEQ ID NO: 172927 - DNA, 20 bp, Artificial
  CRISPR gRNA sequence
aaatattaatgacaatgggt

SEQ ID NO: 172928 - DNA, 20 bp, Artificial
  CRISPR gRNA sequence
atgacaatgggtaagtagga

SEQ ID NO: 172929 - DNA, 20 bp, Artificial
  CRISPR gRNA sequence
tgcctggccatccattagca

SEQ ID NO: 172930 - DNA, 20 bp, Artificial
  CRISPR gRNA sequence
cctggccatccattagcaag

SEQ ID NO: 172931 - DNA, 20 bp, Artificial
  CRISPR gRNA sequence
gccatccattagcaagaagg

SEQ ID NO: 172932 - DNA, 20 bp, Artificial
  CRISPR gRNA sequence
gcaagaaggggaaaatcatg

SEQ ID NO: 172933 - DNA, 20 bp, Artificial
  CRISPR gRNA sequence
gatcagaccactgatgagtg

SEQ ID NO: 172934 - DNA, 20 bp, Artificial
  CRISPR gRNA sequence
atcagaccactgatgagtgg

SEQ ID NO: 172935 - DNA, 20 bp, Artificial
  CRISPR gRNA sequence
atgagtgggcaatctagctg

SEQ ID NO: 172936 - DNA, 20 bp, Artificial
  CRISPR gRNA sequence
gctgttactcttatatccag

SEQ ID NO: 172937 - DNA, 20 bp, Artificial
  CRISPR gRNA sequence
ttactcttatatccagttac

SEQ ID NO: 172938 - DNA, 20 bp, Artificial
  CRISPR gRNA sequence
ctcttatatccagttactct

SEQ ID NO: 172939 - DNA, 20 bp, Artificial
  CRISPR gRNA sequence
ttatatccagttactcttta

SEQ ID NO: 172940 - DNA, 20 bp, Artificial
  CRISPR gRNA sequence
atatccagttactctttatc

SEQ ID NO: 172941 - DNA, 20 bp, Artificial
  CRISPR gRNA sequence
tatccagttactctttatca

SEQ ID NO: 172942 - DNA, 20 bp, Artificial
  CRISPR gRNA sequence
ctctttatcattcttaaaga

SEQ ID NO: 172943 - DNA, 20 bp, Artificial
  CRISPR gRNA sequence
tttatcattcttaaagaaaa

SEQ ID NO: 172944 - DNA, 20 bp, Artificial
  CRISPR gRNA sequence
tatcattcttaaagaaaaaa

SEQ ID NO: 172945 - DNA, 20 bp, Artificial
  CRISPR gRNA sequence
atcattcttaaagaaaaaaa

SEQ ID NO: 172946 - DNA, 20 bp, Artificial
  CRISPR gRNA sequence
tcattcttaaagaaaaaaat

SEQ ID NO: 172947 - DNA, 20 bp, Artificial
  CRISPR gRNA sequence
ttaaagaaaaaaatgaaact

SEQ ID NO: 172948 - DNA, 20 bp, Artificial
  CRISPR gRNA sequence
aaagaaaaaaatgaaacttc

SEQ ID NO: 172949 - DNA, 20 bp, Artificial
  CRISPR gRNA sequence
aagaaaaaaatgaaacttca

SEQ ID NO: 172950 - DNA, 20 bp, Artificial
  CRISPR gRNA sequence
cagaagttttcaaaacatcc

SEQ ID NO: 172951 - DNA, 20 bp, Artificial
  CRISPR gRNA sequence
agaagttttcaaaacatccc

SEQ ID NO: 172952 - DNA, 20 bp, Artificial
  CRISPR gRNA sequence
tcaaaacatcccaaaatcag

SEQ ID NO: 172953 - DNA, 20 bp, Artificial
  CRISPR gRNA sequence
caaaacatcccaaaatcaga

SEQ ID NO: 172954 - DNA, 20 bp, Artificial
  CRISPR gRNA sequence
aaaacatcccaaaatcagag

SEQ ID NO: 172955 - DNA, 20 bp, Artificial
  CRISPR gRNA sequence
cttttaaaattgtttggaaa

SEQ ID NO: 172956 - DNA, 20 bp, Artificial
  CRISPR gRNA sequence
ttaaaattgtttggaaatct

SEQ ID NO: 172957 - DNA, 20 bp, Artificial
  CRISPR gRNA sequence
taaaattgtttggaaatctt

SEQ ID NO: 172958 - DNA, 20 bp, Artificial
  CRISPR gRNA sequence
aaaattgtttggaaatcttt

SEQ ID NO: 172959 - DNA, 20 bp, Artificial
  CRISPR gRNA sequence
aaattgtttggaaatctttc

SEQ ID NO: 172960 - DNA, 20 bp, Artificial
  CRISPR gRNA sequence
tttggaaatctttcaagctc

SEQ ID NO: 172961 - DNA, 20 bp, Artificial
  CRISPR gRNA sequence
ggaaatctttcaagctcttg

SEQ ID NO: 172962 - DNA, 20 bp, Artificial
  CRISPR gRNA sequence
gaaatctttcaagctcttgc

SEQ ID NO: 172963 - DNA, 20 bp, Artificial
  CRISPR gRNA sequence
tcaagctcttgctctcaacc

SEQ ID NO: 172964 - DNA, 20 bp, Artificial
  CRISPR gRNA sequence
caagctcttgctctcaacca

SEQ ID NO: 172965 - DNA, 20 bp, Artificial
  CRISPR gRNA sequence
aagctcttgctctcaaccag

SEQ ID NO: 172966 - DNA, 20 bp, Artificial
  CRISPR gRNA sequence
ttgctctcaaccaggtacca

SEQ ID NO: 172967 - DNA, 20 bp, Artificial
  CRISPR gRNA sequence
gctctcaaccaggtaccatg

SEQ ID NO: 172968 - DNA, 20 bp, Artificial
  CRISPR gRNA sequence
ctctcaaccaggtaccatgc

SEQ ID NO: 172969 - DNA, 20 bp, Artificial
  CRISPR gRNA sequence
tcaaccaggtaccatgcctg

SEQ ID NO: 172970 - DNA, 20 bp, Artificial
  CRISPR gRNA sequence
aaccaggtaccatgcctgcc

SEQ ID NO: 172971 - DNA, 20 bp, Artificial
  CRISPR gRNA sequence
ccaaatcttctcttagtgat

SEQ ID NO: 172972 - DNA, 20 bp, Artificial
  CRISPR gRNA sequence
ctcttagtgatatgcctggg

SEQ ID NO: 172973 - DNA, 20 bp, Artificial
  CRISPR gRNA sequence
tcttagtgatatgcctgggc

SEQ ID NO: 172974 - DNA, 20 bp, Artificial
  CRISPR gRNA sequence
ttagtgatatgcctgggcat

SEQ ID NO: 172975 - DNA, 20 bp, Artificial
  CRISPR gRNA sequence
agtgatatgcctgggcatgg

SEQ ID NO: 172976 - DNA, 20 bp, Artificial
  CRISPR gRNA sequence
gtgatatgcctgggcatgga

SEQ ID NO: 172977 - DNA, 20 bp, Artificial
  CRISPR gRNA sequence
ggcatggaacaacaggatgt

SEQ ID NO: 172978 - DNA, 20 bp, Artificial
  CRISPR gRNA sequence
tcaacctcataaataaaaag

SEQ ID NO: 172979 - DNA, 20 bp, Artificial
  CRISPR gRNA sequence
ataaataaaaagaaatctaa

SEQ ID NO: 172980 - DNA, 20 bp, Artificial
  CRISPR gRNA sequence
aggttttattgcaatatgac

SEQ ID NO: 172981 - DNA, 20 bp, Artificial
  CRISPR gRNA sequence
tattgcaatatgacctggtt

SEQ ID NO: 172982 - DNA, 20 bp, Artificial
  CRISPR gRNA sequence
attgcaatatgacctggttt

SEQ ID NO: 172983 - DNA, 20 bp, Artificial
  CRISPR gRNA sequence
ttgcaatatgacctggtttc

SEQ ID NO: 172984 - DNA, 20 bp, Artificial
  CRISPR gRNA sequence
caatatgacctggtttctga

SEQ ID NO: 172985 - DNA, 20 bp, Artificial
  CRISPR gRNA sequence
gtttctgaaactcaggacct

SEQ ID NO: 172986 - DNA, 20 bp, Artificial
  CRISPR gRNA sequence
ctgaaactcaggacctttag

SEQ ID NO: 172987 - DNA, 20 bp, Artificial
  CRISPR gRNA sequence
tgaaactcaggacctttaga

SEQ ID NO: 172988 - DNA, 20 bp, Artificial
  CRISPR gRNA sequence
aaactcaggacctttagact

SEQ ID NO: 172989 - DNA, 20 bp, Artificial
  CRISPR gRNA sequence
aggacctttagacttcagtt

SEQ ID NO: 172990 - DNA, 20 bp, Artificial
  CRISPR gRNA sequence
tagacttcagttcagctctc

SEQ ID NO: 172991 - DNA, 20 bp, Artificial
  CRISPR gRNA sequence
agacttcagttcagctctct

SEQ ID NO: 172992 - DNA, 20 bp, Artificial
  CRISPR gRNA sequence
gacttcagttcagctctcta

SEQ ID NO: 172993 - DNA, 20 bp, Artificial
  CRISPR gRNA sequence
cagttcagctctctattcct

SEQ ID NO: 172994 - DNA, 20 bp, Artificial
  CRISPR gRNA sequence
agttcagctctctattcctt

SEQ ID NO: 172995 - DNA, 20 bp, Artificial
  CRISPR gRNA sequence
agctctctattccttggcat

SEQ ID NO: 172996 - DNA, 20 bp, Artificial
  CRISPR gRNA sequence
tctattccttggcatgtact

SEQ ID NO: 172997 - DNA, 20 bp, Artificial
  CRISPR gRNA sequence
tattccttggcatgtacttc

SEQ ID NO: 172998 - DNA, 20 bp, Artificial
  CRISPR gRNA sequence
ttccttggcatgtacttcat

SEQ ID NO: 172999 - DNA, 20 bp, Artificial
  CRISPR gRNA sequence
cttggcatgtacttcattct

SEQ ID NO: 173000 - DNA, 20 bp, Artificial
  CRISPR gRNA sequence
ggcatgtacttcattctcta

SEQ ID NO: 173001 - DNA, 20 bp, Artificial
  CRISPR gRNA sequence
gcatgtacttcattctctat

SEQ ID NO: 173002 - DNA, 20 bp, Artificial
  CRISPR gRNA sequence
cattctctataccaaactct

SEQ ID NO: 173003 - DNA, 20 bp, Artificial
  CRISPR gRNA sequence
attctctataccaaactctt

SEQ ID NO: 173004 - DNA, 20 bp, Artificial
  CRISPR gRNA sequence
tctataccaaactcttttat

SEQ ID NO: 173005 - DNA, 20 bp, Artificial
  CRISPR gRNA sequence
tataccaaactcttttatag

SEQ ID NO: 173006 - DNA, 20 bp, Artificial
  CRISPR gRNA sequence
taccaaactcttttatagta

SEQ ID NO: 173007 - DNA, 20 bp, Artificial
  CRISPR gRNA sequence
ttttatagtagcctaaaccc

SEQ ID NO: 173008 - DNA, 20 bp, Artificial
  CRISPR gRNA sequence
ttatagtagcctaaacccac

SEQ ID NO: 173009 - DNA, 20 bp, Artificial
  CRISPR gRNA sequence
tatagtagcctaaacccaca

SEQ ID NO: 173010 - DNA, 20 bp, Artificial
  CRISPR gRNA sequence
atagtagcctaaacccacaa

SEQ ID NO: 173011 - DNA, 20 bp, Artificial
  CRISPR gRNA sequence
tagtagcctaaacccacaat

SEQ ID NO: 173012 - DNA, 20 bp, Artificial
  CRISPR gRNA sequence
aacccacaatacagctcttt

SEQ ID NO: 173013 - DNA, 20 bp, Artificial
  CRISPR gRNA sequence
tttgaggtaactaaaactaa

SEQ ID NO: 173014 - DNA, 20 bp, Artificial
  CRISPR gRNA sequence
tgaggtaactaaaactaaat

SEQ ID NO: 173015 - DNA, 20 bp, Artificial
  CRISPR gRNA sequence
gaggtaactaaaactaaata

SEQ ID NO: 173016 - DNA, 20 bp, Artificial
  CRISPR gRNA sequence
aggtaactaaaactaaatag

SEQ ID NO: 173017 - DNA, 20 bp, Artificial
  CRISPR gRNA sequence
aaactaaatagatgttgttg

SEQ ID NO: 173018 - DNA, 20 bp, Artificial
  CRISPR gRNA sequence
aatagatgttgttgggagat

SEQ ID NO: 173019 - DNA, 20 bp, Artificial
  CRISPR gRNA sequence
ttgggagataatacttaaaa

SEQ ID NO: 173020 - DNA, 20 bp, Artificial
  CRISPR gRNA sequence
ggagataatacttaaaaacc

SEQ ID NO: 173021 - DNA, 20 bp, Artificial
  CRISPR gRNA sequence
aaaaacctaacatcacaaca

SEQ ID NO: 173022 - DNA, 20 bp, Artificial
  CRISPR gRNA sequence
aaaacctaacatcacaacaa

SEQ ID NO: 173023 - DNA, 20 bp, Artificial
  CRISPR gRNA sequence
acatcacaacaactgtccaa

SEQ ID NO: 173024 - DNA, 20 bp, Artificial
  CRISPR gRNA sequence
tccaagggaaaaagaccaca

SEQ ID NO: 173025 - DNA, 20 bp, Artificial
  CRISPR gRNA sequence
cgctaaaatgaaacccaatt

SEQ ID NO: 173026 - DNA, 20 bp, Artificial
  CRISPR gRNA sequence
aaatgaaacccaattcttga

SEQ ID NO: 173027 - DNA, 20 bp, Artificial
  CRISPR gRNA sequence
ttgaccaatgctgcttccaa

SEQ ID NO: 173028 - DNA, 20 bp, Artificial
  CRISPR gRNA sequence
gaccaatgctgcttccaatt

SEQ ID NO: 173029 - DNA, 20 bp, Artificial
  CRISPR gRNA sequence
accaatgctgcttccaatta

SEQ ID NO: 173030 - DNA, 20 bp, Artificial
  CRISPR gRNA sequence
cttccaattaaagcaaagtt

SEQ ID NO: 173031 - DNA, 20 bp, Artificial
  CRISPR gRNA sequence
ccaattaaagcaaagttaag

SEQ ID NO: 173032 - DNA, 20 bp, Artificial
  CRISPR gRNA sequence
caattaaagcaaagttaagt

SEQ ID NO: 173033 - DNA, 20 bp, Artificial
  CRISPR gRNA sequence
aagcaaagttaagtcctccc

SEQ ID NO: 173034 - DNA, 20 bp, Artificial
  CRISPR gRNA sequence
agtcctcccttaatgtcttc

SEQ ID NO: 173035 - DNA, 20 bp, Artificial
  CRISPR gRNA sequence
ccttaatgtcttcgataggc

SEQ ID NO: 173036 - DNA, 20 bp, Artificial
  CRISPR gRNA sequence
aatgtcttcgataggctctt

SEQ ID NO: 173037 - DNA, 20 bp, Artificial
  CRISPR gRNA sequence
atgtcttcgataggctcttg

SEQ ID NO: 173038 - DNA, 20 bp, Artificial
  CRISPR gRNA sequence
cgataggctcttggaaaccg

SEQ ID NO: 173039 - DNA, 20 bp, Artificial
  CRISPR gRNA sequence
gataggctcttggaaaccgc

SEQ ID NO: 173040 - DNA, 20 bp, Artificial
  CRISPR gRNA sequence
ttggaaaccgcaacttaagc

SEQ ID NO: 173041 - DNA, 20 bp, Artificial
  CRISPR gRNA sequence
ggaaaccgcaacttaagcca

SEQ ID NO: 173042 - DNA, 20 bp, Artificial
  CRISPR gRNA sequence
gaaaccgcaacttaagccaa

SEQ ID NO: 173043 - DNA, 20 bp, Artificial
  CRISPR gRNA sequence
aagccaaacatataacaaaa

SEQ ID NO: 173044 - DNA, 20 bp, Artificial
  CRISPR gRNA sequence
agccaaacatataacaaaac

SEQ ID NO: 173045 - DNA, 20 bp, Artificial
  CRISPR gRNA sequence
taccaaaggctaattgacat

SEQ ID NO: 173046 - DNA, 20 bp, Artificial
  CRISPR gRNA sequence
accaaaggctaattgacata

SEQ ID NO: 173047 - DNA, 20 bp, Artificial
  CRISPR gRNA sequence
ccaaaggctaattgacataa

SEQ ID NO: 173048 - DNA, 20 bp, Artificial
  CRISPR gRNA sequence
attgacataaataagagtta

SEQ ID NO: 173049 - DNA, 20 bp, Artificial
  CRISPR gRNA sequence
acataaataagagttagttc

SEQ ID NO: 173050 - DNA, 20 bp, Artificial
  CRISPR gRNA sequence
gttcctattccatatttctg

SEQ ID NO: 173051 - DNA, 20 bp, Artificial
  CRISPR gRNA sequence
ctattccatatttctggtca

SEQ ID NO: 173052 - DNA, 20 bp, Artificial
  CRISPR gRNA sequence
ttccatatttctggtcacaa

SEQ ID NO: 173053 - DNA, 20 bp, Artificial
  CRISPR gRNA sequence
catatttctggtcacaaaaa

SEQ ID NO: 173054 - DNA, 20 bp, Artificial
  CRISPR gRNA sequence
ctggtcacaaaaacatcacc

SEQ ID NO: 173055 - DNA, 20 bp, Artificial
  CRISPR gRNA sequence
tggtcacaaaaacatcacca

SEQ ID NO: 173056 - DNA, 20 bp, Artificial
  CRISPR gRNA sequence
gtcacaaaaacatcaccaaa

SEQ ID NO: 173057 - DNA, 20 bp, Artificial
  CRISPR gRNA sequence
ctaaataaagatcaagacac

SEQ ID NO: 173058 - DNA, 20 bp, Artificial
  CRISPR gRNA sequence
taaataaagatcaagacact

SEQ ID NO: 173059 - DNA, 20 bp, Artificial
  CRISPR gRNA sequence
aataaagatcaagacacttc

SEQ ID NO: 173060 - DNA, 20 bp, Artificial
  CRISPR gRNA sequence
ctaatattaaacactgaaat

SEQ ID NO: 173061 - DNA, 20 bp, Artificial
  CRISPR gRNA sequence
taatattaaacactgaaata

SEQ ID NO: 173062 - DNA, 20 bp, Artificial
  CRISPR gRNA sequence
atattaaacactgaaataag

SEQ ID NO: 173063 - DNA, 20 bp, Artificial
  CRISPR gRNA sequence
aacactgaaataagtatgaa

SEQ ID NO: 173064 - DNA, 20 bp, Artificial
  CRISPR gRNA sequence
aaataagtatgaactataca

SEQ ID NO: 173065 - DNA, 20 bp, Artificial
  CRISPR gRNA sequence
tacatacattgaagaaagat

SEQ ID NO: 173066 - DNA, 20 bp, Artificial
  CRISPR gRNA sequence
aagaaagattaagaaaaata

SEQ ID NO: 173067 - DNA, 20 bp, Artificial
  CRISPR gRNA sequence
agaaaaataaaggccggggc

SEQ ID NO: 173068 - DNA, 20 bp, Artificial
  CRISPR gRNA sequence
acgcctgtaaacccagcact

SEQ ID NO: 173069 - DNA, 20 bp, Artificial
  CRISPR gRNA sequence
taaacccagcactttgagag

SEQ ID NO: 173070 - DNA, 20 bp, Artificial
  CRISPR gRNA sequence
tgagaggccgaggtgggcag

SEQ ID NO: 173071 - DNA, 20 bp, Artificial
  CRISPR gRNA sequence
gagaggccgaggtgggcaga

SEQ ID NO: 173072 - DNA, 20 bp, Artificial
  CRISPR gRNA sequence
agaggccgaggtgggcagat

SEQ ID NO: 173073 - DNA, 20 bp, Artificial
  CRISPR gRNA sequence
agaccatcctggccaacatg

SEQ ID NO: 173074 - DNA, 20 bp, Artificial
  CRISPR gRNA sequence
gccaacatggtgaaacccca

SEQ ID NO: 173075 - DNA, 20 bp, Artificial
  CRISPR gRNA sequence
tactaaaaatataaaaaatt

SEQ ID NO: 173076 - DNA, 20 bp, Artificial
  CRISPR gRNA sequence
ctaaaaatataaaaaattag

SEQ ID NO: 173077 - DNA, 20 bp, Artificial
  CRISPR gRNA sequence
aaaatataaaaaattagctg

SEQ ID NO: 173078 - DNA, 20 bp, Artificial
  CRISPR gRNA sequence
gctgggtgtggtggcgtaca

SEQ ID NO: 173079 - DNA, 20 bp, Artificial
  CRISPR gRNA sequence
ggtgtggtggcgtacacctg

SEQ ID NO: 173080 - DNA, 20 bp, Artificial
  CRISPR gRNA sequence
tagtcccagctactcaggag

SEQ ID NO: 173081 - DNA, 20 bp, Artificial
  CRISPR gRNA sequence
ctcaggaggctgaggcgggg

SEQ ID NO: 173082 - DNA, 20 bp, Artificial
  CRISPR gRNA sequence
aggaggctgaggcgggggaa

SEQ ID NO: 173083 - DNA, 20 bp, Artificial
  CRISPR gRNA sequence
aggcgggggaatcgcttgaa

SEQ ID NO: 173084 - DNA, 20 bp, Artificial
  CRISPR gRNA sequence
gaatccaggaggtggaggct

SEQ ID NO: 173085 - DNA, 20 bp, Artificial
  CRISPR gRNA sequence
aatccaggaggtggaggctg

SEQ ID NO: 173086 - DNA, 20 bp, Artificial
  CRISPR gRNA sequence
cagtgagctgaggtcgcgcc

SEQ ID NO: 173087 - DNA, 20 bp, Artificial
  CRISPR gRNA sequence
aggtcgcgccactgcactag

SEQ ID NO: 173088 - DNA, 20 bp, Artificial
  CRISPR gRNA sequence
cactagagcctggcaacaga

SEQ ID NO: 173089 - DNA, 20 bp, Artificial
  CRISPR gRNA sequence
gagcctggcaacagagcaag

SEQ ID NO: 173090 - DNA, 20 bp, Artificial
  CRISPR gRNA sequence
gcaacagagcaagactctgt

SEQ ID NO: 173091 - DNA, 20 bp, Artificial
  CRISPR gRNA sequence
tgtcccccgcccccgccaaa

SEQ ID NO: 173092 - DNA, 20 bp, Artificial
  CRISPR gRNA sequence
tcccccgcccccgccaaaag

SEQ ID NO: 173093 - DNA, 20 bp, Artificial
  CRISPR gRNA sequence
acacctgtaaccccaacttt

SEQ ID NO: 173094 - DNA, 20 bp, Artificial
  CRISPR gRNA sequence
taaccccaactttgggaggc

SEQ ID NO: 173095 - DNA, 20 bp, Artificial
  CRISPR gRNA sequence
tgggaggctgaggcaggagg

SEQ ID NO: 173096 - DNA, 20 bp, Artificial
  CRISPR gRNA sequence
gggaggctgaggcaggagga

SEQ ID NO: 173097 - DNA, 20 bp, Artificial
  CRISPR gRNA sequence
ggaggctgaggcaggaggat

SEQ ID NO: 173098 - DNA, 20 bp, Artificial
  CRISPR gRNA sequence
aggcaggaggatcacctgag

SEQ ID NO: 173099 - DNA, 20 bp, Artificial
  CRISPR gRNA sequence
aggtcaggagttcaagacca

SEQ ID NO: 173100 - DNA, 20 bp, Artificial
  CRISPR gRNA sequence
aagaccagcctggccaacat

SEQ ID NO: 173101 - DNA, 20 bp, Artificial
  CRISPR gRNA sequence
gccaacatggtaaaaccctg

SEQ ID NO: 173102 - DNA, 20 bp, Artificial
  CRISPR gRNA sequence
tctctactaaaaatacaaaa

SEQ ID NO: 173103 - DNA, 20 bp, Artificial
  CRISPR gRNA sequence
tactaaaaatacaaaaatta

SEQ ID NO: 173104 - DNA, 20 bp, Artificial
  CRISPR gRNA sequence
ctaaaaatacaaaaattagc

SEQ ID NO: 173105 - DNA, 20 bp, Artificial
  CRISPR gRNA sequence
aaaatacaaaaattagccag

SEQ ID NO: 173106 - DNA, 20 bp, Artificial
  CRISPR gRNA sequence
gccaggcatggtggcaggcg

SEQ ID NO: 173107 - DNA, 20 bp, Artificial
  CRISPR gRNA sequence
taatcccagctacttgggag

SEQ ID NO: 173108 - DNA, 20 bp, Artificial
  CRISPR gRNA sequence
cttgggaggctaaggcatga

SEQ ID NO: 173109 - DNA, 20 bp, Artificial
  CRISPR gRNA sequence
gggaggctaaggcatgagaa

SEQ ID NO: 173110 - DNA, 20 bp, Artificial
  CRISPR gRNA sequence
ggaggctaaggcatgagaat

SEQ ID NO: 173111 - DNA, 20 bp, Artificial
  CRISPR gRNA sequence
aggcatgagaatcgcttgaa

SEQ ID NO: 173112 - DNA, 20 bp, Artificial
  CRISPR gRNA sequence
gaacccaggaggtggaggtt

SEQ ID NO: 173113 - DNA, 20 bp, Artificial
  CRISPR gRNA sequence
aacccaggaggtggaggttg

SEQ ID NO: 173114 - DNA, 20 bp, Artificial
  CRISPR gRNA sequence
cagtgaaccaagatcatgcc

SEQ ID NO: 173115 - DNA, 20 bp, Artificial
  CRISPR gRNA sequence
cactccatactgggatacag

SEQ ID NO: 173116 - DNA, 20 bp, Artificial
  CRISPR gRNA sequence
catactgggatacagcaaga

SEQ ID NO: 173117 - DNA, 20 bp, Artificial
  CRISPR gRNA sequence
ggatacagcaagactccgtc

SEQ ID NO: 173118 - DNA, 20 bp, Artificial
  CRISPR gRNA sequence
cgtcccaaaaaaaaaagtaa

SEQ ID NO: 173119 - DNA, 20 bp, Artificial
  CRISPR gRNA sequence
tttatccaattattccagtt

SEQ ID NO: 173120 - DNA, 20 bp, Artificial
  CRISPR gRNA sequence
atccaattattccagttcag

SEQ ID NO: 173121 - DNA, 20 bp, Artificial
  CRISPR gRNA sequence
tccaattattccagttcagg

SEQ ID NO: 173122 - DNA, 20 bp, Artificial
  CRISPR gRNA sequence
ttccagttcagggttgcaga

SEQ ID NO: 173123 - DNA, 20 bp, Artificial
  CRISPR gRNA sequence
cagttcagggttgcagatga

SEQ ID NO: 173124 - DNA, 20 bp, Artificial
  CRISPR gRNA sequence
agggttgcagatgattgaag

SEQ ID NO: 173125 - DNA, 20 bp, Artificial
  CRISPR gRNA sequence
cagatgattgaagcctatcc

SEQ ID NO: 173126 - DNA, 20 bp, Artificial
  CRISPR gRNA sequence
aagcctatcccaacagttca

SEQ ID NO: 173127 - DNA, 20 bp, Artificial
  CRISPR gRNA sequence
tcccaacagttcagggcaca

SEQ ID NO: 173128 - DNA, 20 bp, Artificial
  CRISPR gRNA sequence
agggcacaaggtgggaacca

SEQ ID NO: 173129 - DNA, 20 bp, Artificial
  CRISPR gRNA sequence
gacaactcaatcacagggca

SEQ ID NO: 173130 - DNA, 20 bp, Artificial
  CRISPR gRNA sequence
aatcacagggcacactctca

SEQ ID NO: 173131 - DNA, 20 bp, Artificial
  CRISPR gRNA sequence
tcactcaggctgagacaatt

SEQ ID NO: 173132 - DNA, 20 bp, Artificial
  CRISPR gRNA sequence
actcaggctgagacaattta

SEQ ID NO: 173133 - DNA, 20 bp, Artificial
  CRISPR gRNA sequence
aggctgagacaatttagatg

SEQ ID NO: 173134 - DNA, 20 bp, Artificial
  CRISPR gRNA sequence
agacaatttagatgtgccaa

SEQ ID NO: 173135 - DNA, 20 bp, Artificial
  CRISPR gRNA sequence
agatgtgccaattaacctaa

SEQ ID NO: 173136 - DNA, 20 bp, Artificial
  CRISPR gRNA sequence
gatgtgccaattaacctaac

SEQ ID NO: 173137 - DNA, 20 bp, Artificial
  CRISPR gRNA sequence
acctaacatgcacatattcg

SEQ ID NO: 173138 - DNA, 20 bp, Artificial
  CRISPR gRNA sequence
acatgcacatattcgggatg

SEQ ID NO: 173139 - DNA, 20 bp, Artificial
  CRISPR gRNA sequence
gggatgcaagaagaaagcag

SEQ ID NO: 173140 - DNA, 20 bp, Artificial
  CRISPR gRNA sequence
gaaaaaaaaccaaacagacg

SEQ ID NO: 173141 - DNA, 20 bp, Artificial
  CRISPR gRNA sequence
aaactccacacagagagtga

SEQ ID NO: 173142 - DNA, 20 bp, Artificial
  CRISPR gRNA sequence
cacacagagagtgaccccgg

SEQ ID NO: 173143 - DNA, 20 bp, Artificial
  CRISPR gRNA sequence
gtttcttttttcttcatcaa

SEQ ID NO: 173144 - DNA, 20 bp, Artificial
  CRISPR gRNA sequence
cttttttcttcatcaatatt

SEQ ID NO: 173145 - DNA, 20 bp, Artificial
  CRISPR gRNA sequence
ttttttcttcatcaatatta

SEQ ID NO: 173146 - DNA, 20 bp, Artificial
  CRISPR gRNA sequence
ttttcttcatcaatattata

SEQ ID NO: 173147 - DNA, 20 bp, Artificial
  CRISPR gRNA sequence
tttcttcatcaatattataa

SEQ ID NO: 173148 - DNA, 20 bp, Artificial
  CRISPR gRNA sequence
ttcttcatcaatattataat

SEQ ID NO: 173149 - DNA, 20 bp, Artificial
  CRISPR gRNA sequence
tcttcatcaatattataatc

SEQ ID NO: 173150 - DNA, 20 bp, Artificial
  CRISPR gRNA sequence
cttcatcaatattataatca

SEQ ID NO: 173151 - DNA, 20 bp, Artificial
  CRISPR gRNA sequence
ttcatcaatattataatcaa

SEQ ID NO: 173152 - DNA, 20 bp, Artificial
  CRISPR gRNA sequence
catcaatattataatcaaac

SEQ ID NO: 173153 - DNA, 20 bp, Artificial
  CRISPR gRNA sequence
atcaatattataatcaaaca

SEQ ID NO: 173154 - DNA, 20 bp, Artificial
  CRISPR gRNA sequence
taatcaaacaacattgtctg

SEQ ID NO: 173155 - DNA, 20 bp, Artificial
  CRISPR gRNA sequence
tctgaagaccctctgtacta

SEQ ID NO: 173156 - DNA, 20 bp, Artificial
  CRISPR gRNA sequence
aagaccctctgtactactag

SEQ ID NO: 173157 - DNA, 20 bp, Artificial
  CRISPR gRNA sequence
tgtactactagttgaaccat

SEQ ID NO: 173158 - DNA, 20 bp, Artificial
  CRISPR gRNA sequence
tactactagttgaaccatcc

SEQ ID NO: 173159 - DNA, 20 bp, Artificial
  CRISPR gRNA sequence
ctagttgaaccatcctggga

SEQ ID NO: 173160 - DNA, 20 bp, Artificial
  CRISPR gRNA sequence
gttgaaccatcctgggaaga

SEQ ID NO: 173161 - DNA, 20 bp, Artificial
  CRISPR gRNA sequence
aaccatcctgggaagacatg

SEQ ID NO: 173162 - DNA, 20 bp, Artificial
  CRISPR gRNA sequence
ggaagacatgttttacctaa

SEQ ID NO: 173163 - DNA, 20 bp, Artificial
  CRISPR gRNA sequence
tacctaaaaataatgctctc

SEQ ID NO: 173164 - DNA, 20 bp, Artificial
  CRISPR gRNA sequence
acctaaaaataatgctctca

SEQ ID NO: 173165 - DNA, 20 bp, Artificial
  CRISPR gRNA sequence
cctaaaaataatgctctcac

SEQ ID NO: 173166 - DNA, 20 bp, Artificial
  CRISPR gRNA sequence
aaaataatgctctcactgtc

SEQ ID NO: 173167 - DNA, 20 bp, Artificial
  CRISPR gRNA sequence
tcactgtcaaatgcaaacaa

SEQ ID NO: 173168 - DNA, 20 bp, Artificial
  CRISPR gRNA sequence
actgtcaaatgcaaacaaat

SEQ ID NO: 173169 - DNA, 20 bp, Artificial
  CRISPR gRNA sequence
tcaaatgcaaacaaatatat

SEQ ID NO: 173170 - DNA, 20 bp, Artificial
  CRISPR gRNA sequence
agctcagtactgactaagaa

SEQ ID NO: 173171 - DNA, 20 bp, Artificial
  CRISPR gRNA sequence
gctcagtactgactaagaaa

SEQ ID NO: 173172 - DNA, 20 bp, Artificial
  CRISPR gRNA sequence
agtactgactaagaaacaaa

SEQ ID NO: 173173 - DNA, 20 bp, Artificial
  CRISPR gRNA sequence
actaagaaacaaatataatg

SEQ ID NO: 173174 - DNA, 20 bp, Artificial
  CRISPR gRNA sequence
agaaacaaatataatgttgg

SEQ ID NO: 173175 - DNA, 20 bp, Artificial
  CRISPR gRNA sequence
gtattatcattcccctttaa

SEQ ID NO: 173176 - DNA, 20 bp, Artificial
  CRISPR gRNA sequence
tcattcccctttaatgttcc

SEQ ID NO: 173177 - DNA, 20 bp, Artificial
  CRISPR gRNA sequence
ccctttaatgttccccaaac

SEQ ID NO: 173178 - DNA, 20 bp, Artificial
  CRISPR gRNA sequence
taatgttccccaaaccgact

SEQ ID NO: 173179 - DNA, 20 bp, Artificial
  CRISPR gRNA sequence
aatgttccccaaaccgactt

SEQ ID NO: 173180 - DNA, 20 bp, Artificial
  CRISPR gRNA sequence
atgttccccaaaccgacttg

SEQ ID NO: 173181 - DNA, 20 bp, Artificial
  CRISPR gRNA sequence
cccaaaccgacttgcagccc

SEQ ID NO: 173182 - DNA, 20 bp, Artificial
  CRISPR gRNA sequence
gcagcccttaggctttttgg

SEQ ID NO: 173183 - DNA, 20 bp, Artificial
  CRISPR gRNA sequence
cagcccttaggctttttggg

SEQ ID NO: 173184 - DNA, 20 bp, Artificial
  CRISPR gRNA sequence
aggctttttgggttgagttc

SEQ ID NO: 173185 - DNA, 20 bp, Artificial
  CRISPR gRNA sequence
ggctttttgggttgagttcc

SEQ ID NO: 173186 - DNA, 20 bp, Artificial
  CRISPR gRNA sequence
tttgggttgagttcccaacc

SEQ ID NO: 173187 - DNA, 20 bp, Artificial
  CRISPR gRNA sequence
ttgggttgagttcccaacca

SEQ ID NO: 173188 - DNA, 20 bp, Artificial
  CRISPR gRNA sequence
tgggttgagttcccaaccat

SEQ ID NO: 173189 - DNA, 20 bp, Artificial
  CRISPR gRNA sequence
gggttgagttcccaaccatt

SEQ ID NO: 173190 - DNA, 20 bp, Artificial
  CRISPR gRNA sequence
ggttgagttcccaaccattc

SEQ ID NO: 173191 - DNA, 20 bp, Artificial
  CRISPR gRNA sequence
agttcccaaccattcctgtg

SEQ ID NO: 173192 - DNA, 20 bp, Artificial
  CRISPR gRNA sequence
ccaaccattcctgtgcatct

SEQ ID NO: 173193 - DNA, 20 bp, Artificial
  CRISPR gRNA sequence
ctgtgcatctccaacttaac

SEQ ID NO: 173194 - DNA, 20 bp, Artificial
  CRISPR gRNA sequence
tgcatctccaacttaacatg

SEQ ID NO: 173195 - DNA, 20 bp, Artificial
  CRISPR gRNA sequence
caacttaacatgtcaacaag

SEQ ID NO: 173196 - DNA, 20 bp, Artificial
  CRISPR gRNA sequence
aacatgtcaacaagtatctc

SEQ ID NO: 173197 - DNA, 20 bp, Artificial
  CRISPR gRNA sequence
acatgtcaacaagtatctct

SEQ ID NO: 173198 - DNA, 20 bp, Artificial
  CRISPR gRNA sequence
tctatgatcaaggcacttac

SEQ ID NO: 173199 - DNA, 20 bp, Artificial
  CRISPR gRNA sequence
tatgatcaaggcacttacct

SEQ ID NO: 173200 - DNA, 20 bp, Artificial
  CRISPR gRNA sequence
tgatcaaggcacttaccttc

SEQ ID NO: 173201 - DNA, 20 bp, Artificial
  CRISPR gRNA sequence
accttcttcactcacttttg

SEQ ID NO: 173202 - DNA, 20 bp, Artificial
  CRISPR gRNA sequence
ccttcttcactcacttttgt

SEQ ID NO: 173203 - DNA, 20 bp, Artificial
  CRISPR gRNA sequence
cttcactcacttttgtgact

SEQ ID NO: 173204 - DNA, 20 bp, Artificial
  CRISPR gRNA sequence
ttcactcacttttgtgactt

SEQ ID NO: 173205 - DNA, 20 bp, Artificial
  CRISPR gRNA sequence
cactcacttttgtgacttgc

SEQ ID NO: 173206 - DNA, 20 bp, Artificial
  CRISPR gRNA sequence
actcacttttgtgacttgca

SEQ ID NO: 173207 - DNA, 20 bp, Artificial
  CRISPR gRNA sequence
acttttgtgacttgcatttt

SEQ ID NO: 173208 - DNA, 20 bp, Artificial
  CRISPR gRNA sequence
ttgtgacttgcattttgatc

SEQ ID NO: 173209 - DNA, 20 bp, Artificial
  CRISPR gRNA sequence
tgtgacttgcattttgatca

SEQ ID NO: 173210 - DNA, 20 bp, Artificial
  CRISPR gRNA sequence
gtgacttgcattttgatcat

SEQ ID NO: 173211 - DNA, 20 bp, Artificial
  CRISPR gRNA sequence
tgacttgcattttgatcata

SEQ ID NO: 173212 - DNA, 20 bp, Artificial
  CRISPR gRNA sequence
gcattttgatcatatcttcc

SEQ ID NO: 173213 - DNA, 20 bp, Artificial
  CRISPR gRNA sequence
cattttgatcatatcttcct

SEQ ID NO: 173214 - DNA, 20 bp, Artificial
  CRISPR gRNA sequence
tgatcatatcttcctctgtc

SEQ ID NO: 173215 - DNA, 20 bp, Artificial
  CRISPR gRNA sequence
gatcatatcttcctctgtca

SEQ ID NO: 173216 - DNA, 20 bp, Artificial
  CRISPR gRNA sequence
atcatatcttcctctgtcat

SEQ ID NO: 173217 - DNA, 20 bp, Artificial
  CRISPR gRNA sequence
cctctgtcatgaggtgacat

SEQ ID NO: 173218 - DNA, 20 bp, Artificial
  CRISPR gRNA sequence
ctctgtcatgaggtgacatc

SEQ ID NO: 173219 - DNA, 20 bp, Artificial
  CRISPR gRNA sequence
tgtcatgaggtgacatcctt

SEQ ID NO: 173220 - DNA, 20 bp, Artificial
  CRISPR gRNA sequence
tcatgaggtgacatcctttt

SEQ ID NO: 173221 - DNA, 20 bp, Artificial
  CRISPR gRNA sequence
tttacaactataccttgttt

SEQ ID NO: 173222 - DNA, 20 bp, Artificial
  CRISPR gRNA sequence
ttacaactataccttgtttt

SEQ ID NO: 173223 - DNA, 20 bp, Artificial
  CRISPR gRNA sequence
tacaactataccttgtttta

SEQ ID NO: 173224 - DNA, 20 bp, Artificial
  CRISPR gRNA sequence
acaactataccttgttttat

SEQ ID NO: 173225 - DNA, 20 bp, Artificial
  CRISPR gRNA sequence
caactataccttgttttatt

SEQ ID NO: 173226 - DNA, 20 bp, Artificial
  CRISPR gRNA sequence
taccttgttttattgcattt

SEQ ID NO: 173227 - DNA, 20 bp, Artificial
  CRISPR gRNA sequence
gttttattgcatttcacttt

SEQ ID NO: 173228 - DNA, 20 bp, Artificial
  CRISPR gRNA sequence
ttttattgcatttcacttta

SEQ ID NO: 173229 - DNA, 20 bp, Artificial
  CRISPR gRNA sequence
tattgcatttcactttattg

SEQ ID NO: 173230 - DNA, 20 bp, Artificial
  CRISPR gRNA sequence
attgcatttcactttattgt

SEQ ID NO: 173231 - DNA, 20 bp, Artificial
  CRISPR gRNA sequence
ttgcatttcactttattgtg

SEQ ID NO: 173232 - DNA, 20 bp, Artificial
  CRISPR gRNA sequence
catttcactttattgtgctt

SEQ ID NO: 173233 - DNA, 20 bp, Artificial
  CRISPR gRNA sequence
cactttattgtgcttcacag

SEQ ID NO: 173234 - DNA, 20 bp, Artificial
  CRISPR gRNA sequence
actttattgtgcttcacaga

SEQ ID NO: 173235 - DNA, 20 bp, Artificial
  CRISPR gRNA sequence
tattgtgcttcacagatact

SEQ ID NO: 173236 - DNA, 20 bp, Artificial
  CRISPR gRNA sequence
attgtgcttcacagatactg

SEQ ID NO: 173237 - DNA, 20 bp, Artificial
  CRISPR gRNA sequence
ttgtgcttcacagatactgc

SEQ ID NO: 173238 - DNA, 20 bp, Artificial
  CRISPR gRNA sequence
tgcttcacagatactgctct

SEQ ID NO: 173239 - DNA, 20 bp, Artificial
  CRISPR gRNA sequence
cacagatactgctctaccaa

SEQ ID NO: 173240 - DNA, 20 bp, Artificial
  CRISPR gRNA sequence
acagatactgctctaccaac

SEQ ID NO: 173241 - DNA, 20 bp, Artificial
  CRISPR gRNA sequence
ctctaccaactggccattcc

SEQ ID NO: 173242 - DNA, 20 bp, Artificial
  CRISPR gRNA sequence
taccaactggccattcccac

SEQ ID NO: 173243 - DNA, 20 bp, Artificial
  CRISPR gRNA sequence
ccaactggccattcccacct

SEQ ID NO: 173244 - DNA, 20 bp, Artificial
  CRISPR gRNA sequence
gccattcccacctcgggcct

SEQ ID NO: 173245 - DNA, 20 bp, Artificial
  CRISPR gRNA sequence
ccacctcgggcctccctatt

SEQ ID NO: 173246 - DNA, 20 bp, Artificial
  CRISPR gRNA sequence
gggcctccctattacctgag

SEQ ID NO: 173247 - DNA, 20 bp, Artificial
  CRISPR gRNA sequence
cctattacctgagacacagc

SEQ ID NO: 173248 - DNA, 20 bp, Artificial
  CRISPR gRNA sequence
ttacctgagacacagcaata

SEQ ID NO: 173249 - DNA, 20 bp, Artificial
  CRISPR gRNA sequence
cctgagacacagcaatactg

SEQ ID NO: 173250 - DNA, 20 bp, Artificial
  CRISPR gRNA sequence
agacacagcaatactgaaat

SEQ ID NO: 173251 - DNA, 20 bp, Artificial
  CRISPR gRNA sequence
aaattacgccacttaataac

SEQ ID NO: 173252 - DNA, 20 bp, Artificial
  CRISPR gRNA sequence
cgccacttaataaccctaca

SEQ ID NO: 173253 - DNA, 20 bp, Artificial
  CRISPR gRNA sequence
aataaccctacaacggcctc

SEQ ID NO: 173254 - DNA, 20 bp, Artificial
  CRISPR gRNA sequence
ataaccctacaacggcctct

SEQ ID NO: 173255 - DNA, 20 bp, Artificial
  CRISPR gRNA sequence
caacggcctctaagcgttca

SEQ ID NO: 173256 - DNA, 20 bp, Artificial
  CRISPR gRNA sequence
taagcgttcaagtaaaagaa

SEQ ID NO: 173257 - DNA, 20 bp, Artificial
  CRISPR gRNA sequence
agcgttcaagtaaaagaaca

SEQ ID NO: 173258 - DNA, 20 bp, Artificial
  CRISPR gRNA sequence
aagtaaaagaacagtctcac

SEQ ID NO: 173259 - DNA, 20 bp, Artificial
  CRISPR gRNA sequence
acatctttcacttaaaagct

SEQ ID NO: 173260 - DNA, 20 bp, Artificial
  CRISPR gRNA sequence
tcacttaaaagctaaaggcc

SEQ ID NO: 173261 - DNA, 20 bp, Artificial
  CRISPR gRNA sequence
cacttaaaagctaaaggcca

SEQ ID NO: 173262 - DNA, 20 bp, Artificial
  CRISPR gRNA sequence
acttaaaagctaaaggccag

SEQ ID NO: 173263 - DNA, 20 bp, Artificial
  CRISPR gRNA sequence
aaaagctaaaggccaggtgt

SEQ ID NO: 173264 - DNA, 20 bp, Artificial
  CRISPR gRNA sequence
aaagctaaaggccaggtgtg

SEQ ID NO: 173265 - DNA, 20 bp, Artificial
  CRISPR gRNA sequence
aaggccaggtgtggtggctc

SEQ ID NO: 173266 - DNA, 20 bp, Artificial
  CRISPR gRNA sequence
acgcctgtaatcccagaact

SEQ ID NO: 173267 - DNA, 20 bp, Artificial
  CRISPR gRNA sequence
taatcccagaactttgaggc

SEQ ID NO: 173268 - DNA, 20 bp, Artificial
  CRISPR gRNA sequence
tgaggcaccaaggagggctg

SEQ ID NO: 173269 - DNA, 20 bp, Artificial
  CRISPR gRNA sequence
gaggcaccaaggagggctga

SEQ ID NO: 173270 - DNA, 20 bp, Artificial
  CRISPR gRNA sequence
aggcaccaaggagggctgac

SEQ ID NO: 173271 - DNA, 20 bp, Artificial
  CRISPR gRNA sequence
actgcatgaatccaggagtt

SEQ ID NO: 173272 - DNA, 20 bp, Artificial
  CRISPR gRNA sequence
catgaatccaggagttcgag

SEQ ID NO: 173273 - DNA, 20 bp, Artificial
  CRISPR gRNA sequence
gagaccagcttggcaacaca

SEQ ID NO: 173274 - DNA, 20 bp, Artificial
  CRISPR gRNA sequence
ggcaacacagagagacaccc

SEQ ID NO: 173275 - DNA, 20 bp, Artificial
  CRISPR gRNA sequence
gcaacacagagagacacccc

SEQ ID NO: 173276 - DNA, 20 bp, Artificial
  CRISPR gRNA sequence
tctctaccaaaaaaaaaaaa

SEQ ID NO: 173277 - DNA, 20 bp, Artificial
  CRISPR gRNA sequence
taccaaaaaaaaaaaaaaaa

SEQ ID NO: 173278 - DNA, 20 bp, Artificial
  CRISPR gRNA sequence
ccaaaaaaaaaaaaaaaaaa

SEQ ID NO: 173279 - DNA, 20 bp, Artificial
  CRISPR gRNA sequence
gccagtcctgctgatggcat

SEQ ID NO: 173280 - DNA, 20 bp, Artificial
  CRISPR gRNA sequence
ctgatggcatgcacctgtgg

SEQ ID NO: 173281 - DNA, 20 bp, Artificial
  CRISPR gRNA sequence
atggcatgcacctgtggtcc

SEQ ID NO: 173282 - DNA, 20 bp, Artificial
  CRISPR gRNA sequence
tggtcctagctactcagaag

SEQ ID NO: 173283 - DNA, 20 bp, Artificial
  CRISPR gRNA sequence
gctactcagaaggctgaggt

SEQ ID NO: 173284 - DNA, 20 bp, Artificial
  CRISPR gRNA sequence
ctcagaaggctgaggtggga

SEQ ID NO: 173285 - DNA, 20 bp, Artificial
  CRISPR gRNA sequence
agaaggctgaggtgggagga

SEQ ID NO: 173286 - DNA, 20 bp, Artificial
  CRISPR gRNA sequence
aggtgggaggatcacttggg

SEQ ID NO: 173287 - DNA, 20 bp, Artificial
  CRISPR gRNA sequence
gggcagcagtgagctatgat

SEQ ID NO: 173288 - DNA, 20 bp, Artificial
  CRISPR gRNA sequence
ggcagcagtgagctatgatc

SEQ ID NO: 173289 - DNA, 20 bp, Artificial
  CRISPR gRNA sequence
tgatcatgccaccacactcc

SEQ ID NO: 173290 - DNA, 20 bp, Artificial
  CRISPR gRNA sequence
cagcctgggtgacagaacaa

SEQ ID NO: 173291 - DNA, 20 bp, Artificial
  CRISPR gRNA sequence
ggtgacagaacaaaactctg

SEQ ID NO: 173292 - DNA, 20 bp, Artificial
  CRISPR gRNA sequence
tgtctctaactcaatcaatc

SEQ ID NO: 173293 - DNA, 20 bp, Artificial
  CRISPR gRNA sequence
tctctaactcaatcaatcga

SEQ ID NO: 173294 - DNA, 20 bp, Artificial
  CRISPR gRNA sequence
taactcaatcaatcgaaagc

SEQ ID NO: 173295 - DNA, 20 bp, Artificial
  CRISPR gRNA sequence
actcaatcaatcgaaagcta

SEQ ID NO: 173296 - DNA, 20 bp, Artificial
  CRISPR gRNA sequence
aatcaatcgaaagctagaaa

SEQ ID NO: 173297 - DNA, 20 bp, Artificial
  CRISPR gRNA sequence
gaaatgattaagcttagtga

SEQ ID NO: 173298 - DNA, 20 bp, Artificial
  CRISPR gRNA sequence
agcttagtgaggaaagcaca

SEQ ID NO: 173299 - DNA, 20 bp, Artificial
  CRISPR gRNA sequence
agtgaggaaagcacatcaaa

SEQ ID NO: 173300 - DNA, 20 bp, Artificial
  CRISPR gRNA sequence
gtgaggaaagcacatcaaaa

SEQ ID NO: 173301 - DNA, 20 bp, Artificial
  CRISPR gRNA sequence
atatggggctgggcgcggtg

SEQ ID NO: 173302 - DNA, 20 bp, Artificial
  CRISPR gRNA sequence
ggcgcggtggctcatgcctg

SEQ ID NO: 173303 - DNA, 20 bp, Artificial
  CRISPR gRNA sequence
atgcctgtaatcccagcact

SEQ ID NO: 173304 - DNA, 20 bp, Artificial
  CRISPR gRNA sequence
taatcccagcactttgggag

SEQ ID NO: 173305 - DNA, 20 bp, Artificial
  CRISPR gRNA sequence
tgggaggccgaggcgggtgg

SEQ ID NO: 173306 - DNA, 20 bp, Artificial
  CRISPR gRNA sequence
gggaggccgaggcgggtgga

SEQ ID NO: 173307 - DNA, 20 bp, Artificial
  CRISPR gRNA sequence
ggaggccgaggcgggtggat

SEQ ID NO: 173308 - DNA, 20 bp, Artificial
  CRISPR gRNA sequence
aggtcaggagttcaagacca

SEQ ID NO: 173309 - DNA, 20 bp, Artificial
  CRISPR gRNA sequence
aagaccaccctgaccaacat

SEQ ID NO: 173310 - DNA, 20 bp, Artificial
  CRISPR gRNA sequence
accaacatgatgaaacccct

SEQ ID NO: 173311 - DNA, 20 bp, Artificial
  CRISPR gRNA sequence
ctctaccaaaaatacaaaaa

SEQ ID NO: 173312 - DNA, 20 bp, Artificial
  CRISPR gRNA sequence
tctaccaaaaatacaaaaat

SEQ ID NO: 173313 - DNA, 20 bp, Artificial
  CRISPR gRNA sequence
taccaaaaatacaaaaatta

SEQ ID NO: 173314 - DNA, 20 bp, Artificial
  CRISPR gRNA sequence
ccaaaaatacaaaaattagc

SEQ ID NO: 173315 - DNA, 20 bp, Artificial
  CRISPR gRNA sequence
gccaggcatggtagtgggcg

SEQ ID NO: 173316 - DNA, 20 bp, Artificial
  CRISPR gRNA sequence
taatcccagctacttgggaa

SEQ ID NO: 173317 - DNA, 20 bp, Artificial
  CRISPR gRNA sequence
cttgggaagctgaggcagaa

SEQ ID NO: 173318 - DNA, 20 bp, Artificial
  CRISPR gRNA sequence
gggaagctgaggcagaagaa

SEQ ID NO: 173319 - DNA, 20 bp, Artificial
  CRISPR gRNA sequence
ggaagctgaggcagaagaat

SEQ ID NO: 173320 - DNA, 20 bp, Artificial
  CRISPR gRNA sequence
aggcagaagaatctcttgaa

SEQ ID NO: 173321 - DNA, 20 bp, Artificial
  CRISPR gRNA sequence
ttgaacccaggaggcgaagg

SEQ ID NO: 173322 - DNA, 20 bp, Artificial
  CRISPR gRNA sequence
gaacccaggaggcgaaggtt

SEQ ID NO: 173323 - DNA, 20 bp, Artificial
  CRISPR gRNA sequence
aacccaggaggcgaaggttg

SEQ ID NO: 173324 - DNA, 20 bp, Artificial
  CRISPR gRNA sequence
cagtcagctgagatcgtacc

SEQ ID NO: 173325 - DNA, 20 bp, Artificial
  CRISPR gRNA sequence
agatcgtaccattgcactcc

SEQ ID NO: 173326 - DNA, 20 bp, Artificial
  CRISPR gRNA sequence
cactccagcctgggcgacag

SEQ ID NO: 173327 - DNA, 20 bp, Artificial
  CRISPR gRNA sequence
cagcctgggcgacagtgcaa

SEQ ID NO: 173328 - DNA, 20 bp, Artificial
  CRISPR gRNA sequence
ggcgacagtgcaagactccg

SEQ ID NO: 173329 - DNA, 20 bp, Artificial
  CRISPR gRNA sequence
cggttcaaaaaaaaaaaaaa

SEQ ID NO: 173330 - DNA, 20 bp, Artificial
  CRISPR gRNA sequence
aaaaaaaaaaaaaagagctg

SEQ ID NO: 173331 - DNA, 20 bp, Artificial
  CRISPR gRNA sequence
agatggaccaagagctaggc

SEQ ID NO: 173332 - DNA, 20 bp, Artificial
  CRISPR gRNA sequence
ggcctcttgcaccaaacact

SEQ ID NO: 173333 - DNA, 20 bp, Artificial
  CRISPR gRNA sequence
ttgcaccaaacacttaccca

SEQ ID NO: 173334 - DNA, 20 bp, Artificial
  CRISPR gRNA sequence
gcaccaaacacttacccaag

SEQ ID NO: 173335 - DNA, 20 bp, Artificial
  CRISPR gRNA sequence
caccaaacacttacccaagc

SEQ ID NO: 173336 - DNA, 20 bp, Artificial
  CRISPR gRNA sequence
acccaagctgtgactgcaaa

SEQ ID NO: 173337 - DNA, 20 bp, Artificial
  CRISPR gRNA sequence
cccaagctgtgactgcaaag

SEQ ID NO: 173338 - DNA, 20 bp, Artificial
  CRISPR gRNA sequence
tgactgcaaagaaaaagttc

SEQ ID NO: 173339 - DNA, 20 bp, Artificial
  CRISPR gRNA sequence
caaagaaaaagttcttgaag

SEQ ID NO: 173340 - DNA, 20 bp, Artificial
  CRISPR gRNA sequence
ttgaaggaaattaaaagtgc

SEQ ID NO: 173341 - DNA, 20 bp, Artificial
  CRISPR gRNA sequence
gaaggaaattaaaagtgctc

SEQ ID NO: 173342 - DNA, 20 bp, Artificial
  CRISPR gRNA sequence
aaggaaattaaaagtgctcc

SEQ ID NO: 173343 - DNA, 20 bp, Artificial
  CRISPR gRNA sequence
aaagtgctcctccagtgaac

SEQ ID NO: 173344 - DNA, 20 bp, Artificial
  CRISPR gRNA sequence
ctccagtgaacacacaaata

SEQ ID NO: 173345 - DNA, 20 bp, Artificial
  CRISPR gRNA sequence
cagtgaacacacaaataaga

SEQ ID NO: 173346 - DNA, 20 bp, Artificial
  CRISPR gRNA sequence
tattgctgatatgaagaaag

SEQ ID NO: 173347 - DNA, 20 bp, Artificial
  CRISPR gRNA sequence
attgctgatatgaagaaagt

SEQ ID NO: 173348 - DNA, 20 bp, Artificial
  CRISPR gRNA sequence
ttgctgatatgaagaaagtt

SEQ ID NO: 173349 - DNA, 20 bp, Artificial
  CRISPR gRNA sequence
ctgatatgaagaaagtttca

SEQ ID NO: 173350 - DNA, 20 bp, Artificial
  CRISPR gRNA sequence
atatgaagaaagtttcagtg

SEQ ID NO: 173351 - DNA, 20 bp, Artificial
  CRISPR gRNA sequence
cagtggtctagacagaagat

SEQ ID NO: 173352 - DNA, 20 bp, Artificial
  CRISPR gRNA sequence
agtggtctagacagaagatc

SEQ ID NO: 173353 - DNA, 20 bp, Artificial
  CRISPR gRNA sequence
gacagaagatcaaaccaacc

SEQ ID NO: 173354 - DNA, 20 bp, Artificial
  CRISPR gRNA sequence
ctttaagccaaagcctaatg

SEQ ID NO: 173355 - DNA, 20 bp, Artificial
  CRISPR gRNA sequence
taagccaaagcctaatgtgg

SEQ ID NO: 173356 - DNA, 20 bp, Artificial
  CRISPR gRNA sequence
aagccaaagcctaatgtgga

SEQ ID NO: 173357 - DNA, 20 bp, Artificial
  CRISPR gRNA sequence
agccaaagcctaatgtggag

SEQ ID NO: 173358 - DNA, 20 bp, Artificial
  CRISPR gRNA sequence
atgtggagcaatgccctaac

SEQ ID NO: 173359 - DNA, 20 bp, Artificial
  CRISPR gRNA sequence
actctcaattctatgaaggc

SEQ ID NO: 173360 - DNA, 20 bp, Artificial
  CRISPR gRNA sequence
tcaattctatgaaggctgag

SEQ ID NO: 173361 - DNA, 20 bp, Artificial
  CRISPR gRNA sequence
aattctatgaaggctgagag

SEQ ID NO: 173362 - DNA, 20 bp, Artificial
  CRISPR gRNA sequence
tatgaaggctgagagaggtg

SEQ ID NO: 173363 - DNA, 20 bp, Artificial
  CRISPR gRNA sequence
tgaaggctgagagaggtgag

SEQ ID NO: 173364 - DNA, 20 bp, Artificial
  CRISPR gRNA sequence
agagaggtgagggggctgca

SEQ ID NO: 173365 - DNA, 20 bp, Artificial
  CRISPR gRNA sequence
cagaagaaaagttggttcat

SEQ ID NO: 173366 - DNA, 20 bp, Artificial
  CRISPR gRNA sequence
gttcatgaggtttaagcaaa

SEQ ID NO: 173367 - DNA, 20 bp, Artificial
  CRISPR gRNA sequence
atgaggtttaagcaaagaag

SEQ ID NO: 173368 - DNA, 20 bp, Artificial
  CRISPR gRNA sequence
aagcaaagaagccatctcca

SEQ ID NO: 173369 - DNA, 20 bp, Artificial
  CRISPR gRNA sequence
agcaaagaagccatctccat

SEQ ID NO: 173370 - DNA, 20 bp, Artificial
  CRISPR gRNA sequence
cataacataaaagtataagg

SEQ ID NO: 173371 - DNA, 20 bp, Artificial
  CRISPR gRNA sequence
atgtagaagctgcagcaagt

SEQ ID NO: 173372 - DNA, 20 bp, Artificial
  CRISPR gRNA sequence
cagcaagttttatcccgaag

SEQ ID NO: 173373 - DNA, 20 bp, Artificial
  CRISPR gRNA sequence
tatcccgaagatctagctag

SEQ ID NO: 173374 - DNA, 20 bp, Artificial
  CRISPR gRNA sequence
atcccgaagatctagctaga

SEQ ID NO: 173375 - DNA, 20 bp, Artificial
  CRISPR gRNA sequence
tcccgaagatctagctagag

SEQ ID NO: 173376 - DNA, 20 bp, Artificial
  CRISPR gRNA sequence
gctagagtaattgatgcaac

SEQ ID NO: 173377 - DNA, 20 bp, Artificial
  CRISPR gRNA sequence
gagtaattgatgcaactggc

SEQ ID NO: 173378 - DNA, 20 bp, Artificial
  CRISPR gRNA sequence
atgcaactggctacattaaa

SEQ ID NO: 173379 - DNA, 20 bp, Artificial
  CRISPR gRNA sequence
gctacattaaacaacagaat

SEQ ID NO: 173380 - DNA, 20 bp, Artificial
  CRISPR gRNA sequence
cattaaacaacagaatttca

SEQ ID NO: 173381 - DNA, 20 bp, Artificial
  CRISPR gRNA sequence
aacaacagaatttcagtgca

SEQ ID NO: 173382 - DNA, 20 bp, Artificial
  CRISPR gRNA sequence
cagtgcagacaaaatggact

SEQ ID NO: 173383 - DNA, 20 bp, Artificial
  CRISPR gRNA sequence
agtgcagacaaaatggactt

SEQ ID NO: 173384 - DNA, 20 bp, Artificial
  CRISPR gRNA sequence
ttactggaagaagatgccat

SEQ ID NO: 173385 - DNA, 20 bp, Artificial
  CRISPR gRNA sequence
tactggaagaagatgccatc

SEQ ID NO: 173386 - DNA, 20 bp, Artificial
  CRISPR gRNA sequence
actggaagaagatgccatca

SEQ ID NO: 173387 - DNA, 20 bp, Artificial
  CRISPR gRNA sequence
ctggaagaagatgccatcaa

SEQ ID NO: 173388 - DNA, 20 bp, Artificial
  CRISPR gRNA sequence
gaagaagatgccatcaagga

SEQ ID NO: 173389 - DNA, 20 bp, Artificial
  CRISPR gRNA sequence
tcatagctacaaagaagtca

SEQ ID NO: 173390 - DNA, 20 bp, Artificial
  CRISPR gRNA sequence
catagctacaaagaagtcaa

SEQ ID NO: 173391 - DNA, 20 bp, Artificial
  CRISPR gRNA sequence
atagctacaaagaagtcaat

SEQ ID NO: 173392 - DNA, 20 bp, Artificial
  CRISPR gRNA sequence
caaagaagtcaatgcctgtg

SEQ ID NO: 173393 - DNA, 20 bp, Artificial
  CRISPR gRNA sequence
tggaagccgatgctcattta

SEQ ID NO: 173394 - DNA, 20 bp, Artificial
  CRISPR gRNA sequence
atttaccattccaaaaattc

SEQ ID NO: 173395 - DNA, 20 bp, Artificial
  CRISPR gRNA sequence
accattccaaaaattctagg

SEQ ID NO: 173396 - DNA, 20 bp, Artificial
  CRISPR gRNA sequence
ccattccaaaaattctaggg

SEQ ID NO: 173397 - DNA, 20 bp, Artificial
  CRISPR gRNA sequence
caaaaattctagggccctta

SEQ ID NO: 173398 - DNA, 20 bp, Artificial
  CRISPR gRNA sequence
tagggcccttaagaattata

SEQ ID NO: 173399 - DNA, 20 bp, Artificial
  CRISPR gRNA sequence
gggcccttaagaattataca

SEQ ID NO: 173400 - DNA, 20 bp, Artificial
  CRISPR gRNA sequence
aagaattatacaaaatctac

SEQ ID NO: 173401 - DNA, 20 bp, Artificial
  CRISPR gRNA sequence
agaattatacaaaatctact

SEQ ID NO: 173402 - DNA, 20 bp, Artificial
  CRISPR gRNA sequence
tacaaaatctactctgcctg

SEQ ID NO: 173403 - DNA, 20 bp, Artificial
  CRISPR gRNA sequence
ctctgcctgtgctctataaa

SEQ ID NO: 173404 - DNA, 20 bp, Artificial
  CRISPR gRNA sequence
tgcctgtgctctataaatgg

SEQ ID NO: 173405 - DNA, 20 bp, Artificial
  CRISPR gRNA sequence
cctgtgctctataaatggag

SEQ ID NO: 173406 - DNA, 20 bp, Artificial
  CRISPR gRNA sequence
tgctctataaatggagcaaa

SEQ ID NO: 173407 - DNA, 20 bp, Artificial
  CRISPR gRNA sequence
tataaatggagcaaagcttg

SEQ ID NO: 173408 - DNA, 20 bp, Artificial
  CRISPR gRNA sequence
taaatggagcaaagcttgga

SEQ ID NO: 173409 - DNA, 20 bp, Artificial
  CRISPR gRNA sequence
ggatgacagcacatctgttt

SEQ ID NO: 173410 - DNA, 20 bp, Artificial
  CRISPR gRNA sequence
gatgacagcacatctgttta

SEQ ID NO: 173411 - DNA, 20 bp, Artificial
  CRISPR gRNA sequence
tttacagcgtggttgactat

SEQ ID NO: 173412 - DNA, 20 bp, Artificial
  CRISPR gRNA sequence
acagcgtggttgactattta

SEQ ID NO: 173413 - DNA, 20 bp, Artificial
  CRISPR gRNA sequence
cagcgtggttgactatttaa

SEQ ID NO: 173414 - DNA, 20 bp, Artificial
  CRISPR gRNA sequence
actatttaagctcactgttg

SEQ ID NO: 173415 - DNA, 20 bp, Artificial
  CRISPR gRNA sequence
tttaagctcactgttgagac

SEQ ID NO: 173416 - DNA, 20 bp, Artificial
  CRISPR gRNA sequence
aagctcactgttgagaccta

SEQ ID NO: 173417 - DNA, 20 bp, Artificial
  CRISPR gRNA sequence
agctcactgttgagacctac

SEQ ID NO: 173418 - DNA, 20 bp, Artificial
  CRISPR gRNA sequence
actgttgagacctactgctc

SEQ ID NO: 173419 - DNA, 20 bp, Artificial
  CRISPR gRNA sequence
ttgagacctactgctcagaa

SEQ ID NO: 173420 - DNA, 20 bp, Artificial
  CRISPR gRNA sequence
agacctactgctcagaaaaa

SEQ ID NO: 173421 - DNA, 20 bp, Artificial
  CRISPR gRNA sequence
ctgctcagaaaaaaaagatt

SEQ ID NO: 173422 - DNA, 20 bp, Artificial
  CRISPR gRNA sequence
ctcagaaaaaaaagattcct

SEQ ID NO: 173423 - DNA, 20 bp, Artificial
  CRISPR gRNA sequence
agaaaaaaaagattcctttg

SEQ ID NO: 173424 - DNA, 20 bp, Artificial
  CRISPR gRNA sequence
ctttgaaaatattactgctc

SEQ ID NO: 173425 - DNA, 20 bp, Artificial
  CRISPR gRNA sequence
tgaaaatattactgctcact

SEQ ID NO: 173426 - DNA, 20 bp, Artificial
  CRISPR gRNA sequence
gaaaatattactgctcacta

SEQ ID NO: 173427 - DNA, 20 bp, Artificial
  CRISPR gRNA sequence
aaaatattactgctcactaa

SEQ ID NO: 173428 - DNA, 20 bp, Artificial
  CRISPR gRNA sequence
ctgctcactaacaatatacc

SEQ ID NO: 173429 - DNA, 20 bp, Artificial
  CRISPR gRNA sequence
ctcactaacaatatacctgg

SEQ ID NO: 173430 - DNA, 20 bp, Artificial
  CRISPR gRNA sequence
actaacaatatacctggtca

SEQ ID NO: 173431 - DNA, 20 bp, Artificial
  CRISPR gRNA sequence
acaatatacctggtcatcca

SEQ ID NO: 173432 - DNA, 20 bp, Artificial
  CRISPR gRNA sequence
gtcatccaaaaactgatgga

SEQ ID NO: 173433 - DNA, 20 bp, Artificial
  CRISPR gRNA sequence
atggaggctgggagcagtgg

SEQ ID NO: 173434 - DNA, 20 bp, Artificial
  CRISPR gRNA sequence
ggagcagtggctcacgcctg

SEQ ID NO: 173435 - DNA, 20 bp, Artificial
  CRISPR gRNA sequence
acgcctgtaatcccaacact

SEQ ID NO: 173436 - DNA, 20 bp, Artificial
  CRISPR gRNA sequence
taatcccaacactttgggag

SEQ ID NO: 173437 - DNA, 20 bp, Artificial
  CRISPR gRNA sequence
tgggaggccaaggcgggcgg

SEQ ID NO: 173438 - DNA, 20 bp, Artificial
  CRISPR gRNA sequence
gggaggccaaggcgggcgga

SEQ ID NO: 173439 - DNA, 20 bp, Artificial
  CRISPR gRNA sequence
ggaggccaaggcgggcggat

SEQ ID NO: 173440 - DNA, 20 bp, Artificial
  CRISPR gRNA sequence
aggtcaggagttcgagacca

SEQ ID NO: 173441 - DNA, 20 bp, Artificial
  CRISPR gRNA sequence
gagaccagcctggccaacat

SEQ ID NO: 173442 - DNA, 20 bp, Artificial
  CRISPR gRNA sequence
gccaacatagtgaaacccag

SEQ ID NO: 173443 - DNA, 20 bp, Artificial
  CRISPR gRNA sequence
cattaaaaatacaaaaatta

SEQ ID NO: 173444 - DNA, 20 bp, Artificial
  CRISPR gRNA sequence
aaaatacaaaaattagctcg

SEQ ID NO: 173445 - DNA, 20 bp, Artificial
  CRISPR gRNA sequence
gctcggcgtggtggcgggca

SEQ ID NO: 173446 - DNA, 20 bp, Artificial
  CRISPR gRNA sequence
ggcgtggtggcgggcacctg

SEQ ID NO: 173447 - DNA, 20 bp, Artificial
  CRISPR gRNA sequence
taatcccagctactcaagag

SEQ ID NO: 173448 - DNA, 20 bp, Artificial
  CRISPR gRNA sequence
ctcaagaggctgaggcagga

SEQ ID NO: 173449 - DNA, 20 bp, Artificial
  CRISPR gRNA sequence
aagaggctgaggcaggagaa

SEQ ID NO: 173450 - DNA, 20 bp, Artificial
  CRISPR gRNA sequence
aggcaggagaatcgcttaaa

SEQ ID NO: 173451 - DNA, 20 bp, Artificial
  CRISPR gRNA sequence
aaacccaggaggcagaggtt

SEQ ID NO: 173452 - DNA, 20 bp, Artificial
  CRISPR gRNA sequence
aacccaggaggcagaggttg

SEQ ID NO: 173453 - DNA, 20 bp, Artificial
  CRISPR gRNA sequence
cagtgagccaagattgcacc

SEQ ID NO: 173454 - DNA, 20 bp, Artificial
  CRISPR gRNA sequence
caccactgcactccagcctg

SEQ ID NO: 173455 - DNA, 20 bp, Artificial
  CRISPR gRNA sequence
cactccagcctgggtagcac

SEQ ID NO: 173456 - DNA, 20 bp, Artificial
  CRISPR gRNA sequence
cagcctgggtagcacagcga

SEQ ID NO: 173457 - DNA, 20 bp, Artificial
  CRISPR gRNA sequence
ggtagcacagcgagactccg

SEQ ID NO: 173458 - DNA, 20 bp, Artificial
  CRISPR gRNA sequence
cgtctcaaaaaacaaaacaa

SEQ ID NO: 173459 - DNA, 20 bp, Artificial
  CRISPR gRNA sequence
aaaaaacaaaacaaaaaaca

SEQ ID NO: 173460 - DNA, 20 bp, Artificial
  CRISPR gRNA sequence
atctgcttgcacaactccat

SEQ ID NO: 173461 - DNA, 20 bp, Artificial
  CRISPR gRNA sequence
cttgcacaactccatcagag

SEQ ID NO: 173462 - DNA, 20 bp, Artificial
  CRISPR gRNA sequence
gcacaactccatcagagttt

SEQ ID NO: 173463 - DNA, 20 bp, Artificial
  CRISPR gRNA sequence
cacaactccatcagagtttt

SEQ ID NO: 173464 - DNA, 20 bp, Artificial
  CRISPR gRNA sequence
catcagagttttgttttgtt

SEQ ID NO: 173465 - DNA, 20 bp, Artificial
  CRISPR gRNA sequence
tgttttgttttgtgacagtc

SEQ ID NO: 173466 - DNA, 20 bp, Artificial
  CRISPR gRNA sequence
gttttgttttgtgacagtct

SEQ ID NO: 173467 - DNA, 20 bp, Artificial
  CRISPR gRNA sequence
ttttgttttgtgacagtctc

SEQ ID NO: 173468 - DNA, 20 bp, Artificial
  CRISPR gRNA sequence
tgttttgtgacagtctcact

SEQ ID NO: 173469 - DNA, 20 bp, Artificial
  CRISPR gRNA sequence
gttttgtgacagtctcactc

SEQ ID NO: 173470 - DNA, 20 bp, Artificial
  CRISPR gRNA sequence
ttttgtgacagtctcactct

SEQ ID NO: 173471 - DNA, 20 bp, Artificial
  CRISPR gRNA sequence
tgtgacagtctcactctgtc

SEQ ID NO: 173472 - DNA, 20 bp, Artificial
  CRISPR gRNA sequence
gtgacagtctcactctgtcg

SEQ ID NO: 173473 - DNA, 20 bp, Artificial
  CRISPR gRNA sequence
tgacagtctcactctgtcgc

SEQ ID NO: 173474 - DNA, 20 bp, Artificial
  CRISPR gRNA sequence
actctgtcgcccaggctgga

SEQ ID NO: 173475 - DNA, 20 bp, Artificial
  CRISPR gRNA sequence
tgtcgcccaggctggagtgc

SEQ ID NO: 173476 - DNA, 20 bp, Artificial
  CRISPR gRNA sequence
tcgcccaggctggagtgcag

SEQ ID NO: 173477 - DNA, 20 bp, Artificial
  CRISPR gRNA sequence
gagtgcagtggtgccatctc

SEQ ID NO: 173478 - DNA, 20 bp, Artificial
  CRISPR gRNA sequence
aggtcactgcaacctccgcc

SEQ ID NO: 173479 - DNA, 20 bp, Artificial
  CRISPR gRNA sequence
caacctccgccttctgggtt

SEQ ID NO: 173480 - DNA, 20 bp, Artificial
  CRISPR gRNA sequence
cgccttctgggttcaagcga

SEQ ID NO: 173481 - DNA, 20 bp, Artificial
  CRISPR gRNA sequence
ctgggttcaagcgattctca

SEQ ID NO: 173482 - DNA, 20 bp, Artificial
  CRISPR gRNA sequence
tgggttcaagcgattctcat

SEQ ID NO: 173483 - DNA, 20 bp, Artificial
  CRISPR gRNA sequence
ggttcaagcgattctcatgc

SEQ ID NO: 173484 - DNA, 20 bp, Artificial
  CRISPR gRNA sequence
aagcgattctcatgcccagc

SEQ ID NO: 173485 - DNA, 20 bp, Artificial
  CRISPR gRNA sequence
tcatgcccagcctcccgagt

SEQ ID NO: 173486 - DNA, 20 bp, Artificial
  CRISPR gRNA sequence
atgcccagcctcccgagtag

SEQ ID NO: 173487 - DNA, 20 bp, Artificial
  CRISPR gRNA sequence
ccgagtagctgggatggcag

SEQ ID NO: 173488 - DNA, 20 bp, Artificial
  CRISPR gRNA sequence
ggatggcaggcatgcgccac

SEQ ID NO: 173489 - DNA, 20 bp, Artificial
  CRISPR gRNA sequence
atttttgtaattttagtaaa

SEQ ID NO: 173490 - DNA, 20 bp, Artificial
  CRISPR gRNA sequence
ttgtaattttagtaaagaca

SEQ ID NO: 173491 - DNA, 20 bp, Artificial
  CRISPR gRNA sequence
tgtaattttagtaaagacag

SEQ ID NO: 173492 - DNA, 20 bp, Artificial
  CRISPR gRNA sequence
gtaattttagtaaagacagg

SEQ ID NO: 173493 - DNA, 20 bp, Artificial
  CRISPR gRNA sequence
taattttagtaaagacaggg

SEQ ID NO: 173494 - DNA, 20 bp, Artificial
  CRISPR gRNA sequence
tagtaaagacagggtttcgc

SEQ ID NO: 173495 - DNA, 20 bp, Artificial
  CRISPR gRNA sequence
agtaaagacagggtttcgcc

SEQ ID NO: 173496 - DNA, 20 bp, Artificial
  CRISPR gRNA sequence
gtaaagacagggtttcgcca

SEQ ID NO: 173497 - DNA, 20 bp, Artificial
  CRISPR gRNA sequence
cgccacgttggccagactgg

SEQ ID NO: 173498 - DNA, 20 bp, Artificial
  CRISPR gRNA sequence
gccacgttggccagactggt

SEQ ID NO: 173499 - DNA, 20 bp, Artificial
  CRISPR gRNA sequence
gccagactggtctcaaactc

SEQ ID NO: 173500 - DNA, 20 bp, Artificial
  CRISPR gRNA sequence
gtctcaaactcttgatttca

SEQ ID NO: 173501 - DNA, 20 bp, Artificial
  CRISPR gRNA sequence
aaactcttgatttcaagtaa

SEQ ID NO: 173502 - DNA, 20 bp, Artificial
  CRISPR gRNA sequence
ttgatttcaagtaatccgcc

SEQ ID NO: 173503 - DNA, 20 bp, Artificial
  CRISPR gRNA sequence
gatttcaagtaatccgcccg

SEQ ID NO: 173504 - DNA, 20 bp, Artificial
  CRISPR gRNA sequence
atttcaagtaatccgcccgc

SEQ ID NO: 173505 - DNA, 20 bp, Artificial
  CRISPR gRNA sequence
caagtaatccgcccgcctca

SEQ ID NO: 173506 - DNA, 20 bp, Artificial
  CRISPR gRNA sequence
aagtaatccgcccgcctcag

SEQ ID NO: 173507 - DNA, 20 bp, Artificial
  CRISPR gRNA sequence
agcctcccaaagtgttggga

SEQ ID NO: 173508 - DNA, 20 bp, Artificial
  CRISPR gRNA sequence
ccaaagtgttgggattacag

SEQ ID NO: 173509 - DNA, 20 bp, Artificial
  CRISPR gRNA sequence
ggattacaggtgtaaaccat

SEQ ID NO: 173510 - DNA, 20 bp, Artificial
  CRISPR gRNA sequence
caggtgtaaaccatcgcgcc

SEQ ID NO: 173511 - DNA, 20 bp, Artificial
  CRISPR gRNA sequence
gtattttaacacctgctaac

SEQ ID NO: 173512 - DNA, 20 bp, Artificial
  CRISPR gRNA sequence
taacacctgctaacacaata

SEQ ID NO: 173513 - DNA, 20 bp, Artificial
  CRISPR gRNA sequence
aacacctgctaacacaatat

SEQ ID NO: 173514 - DNA, 20 bp, Artificial
  CRISPR gRNA sequence
acacctgctaacacaatatc

SEQ ID NO: 173515 - DNA, 20 bp, Artificial
  CRISPR gRNA sequence
ctaacacaatatccattctg

SEQ ID NO: 173516 - DNA, 20 bp, Artificial
  CRISPR gRNA sequence
acacaatatccattctgcag

SEQ ID NO: 173517 - DNA, 20 bp, Artificial
  CRISPR gRNA sequence
tgcagcccatggaccaaaga

SEQ ID NO: 173518 - DNA, 20 bp, Artificial
  CRISPR gRNA sequence
cagcccatggaccaaagagt

SEQ ID NO: 173519 - DNA, 20 bp, Artificial
  CRISPR gRNA sequence
caacattcaagtcttattat

SEQ ID NO: 173520 - DNA, 20 bp, Artificial
  CRISPR gRNA sequence
aacattcaagtcttattatt

SEQ ID NO: 173521 - DNA, 20 bp, Artificial
  CRISPR gRNA sequence
aagtcttattattgaagaaa

SEQ ID NO: 173522 - DNA, 20 bp, Artificial
  CRISPR gRNA sequence
attattgaagaaaatacatg

SEQ ID NO: 173523 - DNA, 20 bp, Artificial
  CRISPR gRNA sequence
ttattgaagaaaatacatgg

SEQ ID NO: 173524 - DNA, 20 bp, Artificial
  CRISPR gRNA sequence
ttgaagaaaatacatggccg

SEQ ID NO: 173525 - DNA, 20 bp, Artificial
  CRISPR gRNA sequence
aagaaaatacatggccgggc

SEQ ID NO: 173526 - DNA, 20 bp, Artificial
  CRISPR gRNA sequence
atgcctataatcccagcact

SEQ ID NO: 173527 - DNA, 20 bp, Artificial
  CRISPR gRNA sequence
taatcccagcactttgggag

SEQ ID NO: 173528 - DNA, 20 bp, Artificial
  CRISPR gRNA sequence
tgggaggccaaggcagaagg

SEQ ID NO: 173529 - DNA, 20 bp, Artificial
  CRISPR gRNA sequence
gggaggccaaggcagaagga

SEQ ID NO: 173530 - DNA, 20 bp, Artificial
  CRISPR gRNA sequence
ggaggccaaggcagaaggat

SEQ ID NO: 173531 - DNA, 20 bp, Artificial
  CRISPR gRNA sequence
aggtcaggagttcgagacca

SEQ ID NO: 173532 - DNA, 20 bp, Artificial
  CRISPR gRNA sequence
gagaccatcctggccaacat

SEQ ID NO: 173533 - DNA, 20 bp, Artificial
  CRISPR gRNA sequence
gccaacataatgaaacccca

SEQ ID NO: 173534 - DNA, 20 bp, Artificial
  CRISPR gRNA sequence
tactaaaaacacaaaaatta

SEQ ID NO: 173535 - DNA, 20 bp, Artificial
  CRISPR gRNA sequence
ctaaaaacacaaaaattagc

SEQ ID NO: 173536 - DNA, 20 bp, Artificial
  CRISPR gRNA sequence
aaaacacaaaaattagcagg

SEQ ID NO: 173537 - DNA, 20 bp, Artificial
  CRISPR gRNA sequence
gcagggcttgttggtgcacg

SEQ ID NO: 173538 - DNA, 20 bp, Artificial
  CRISPR gRNA sequence
gttggtgcacgcctgtagtc

SEQ ID NO: 173539 - DNA, 20 bp, Artificial
  CRISPR gRNA sequence
ttggtgcacgcctgtagtcc

SEQ ID NO: 173540 - DNA, 20 bp, Artificial
  CRISPR gRNA sequence
gtgcacgcctgtagtcccag

SEQ ID NO: 173541 - DNA, 20 bp, Artificial
  CRISPR gRNA sequence
tagtcccagctactctagag

SEQ ID NO: 173542 - DNA, 20 bp, Artificial
  CRISPR gRNA sequence
ctctagaggccaaagcatga

SEQ ID NO: 173543 - DNA, 20 bp, Artificial
  CRISPR gRNA sequence
tagaggccaaagcatgaggc

SEQ ID NO: 173544 - DNA, 20 bp, Artificial
  CRISPR gRNA sequence
gaggccaaagcatgaggctg

SEQ ID NO: 173545 - DNA, 20 bp, Artificial
  CRISPR gRNA sequence
cagtgatccgagatcacacc

SEQ ID NO: 173546 - DNA, 20 bp, Artificial
  CRISPR gRNA sequence
cactccagcctaggtgacag

SEQ ID NO: 173547 - DNA, 20 bp, Artificial
  CRISPR gRNA sequence
cagcctaggtgacagagtga

SEQ ID NO: 173548 - DNA, 20 bp, Artificial
  CRISPR gRNA sequence
ggtgacagagtgagactctg

SEQ ID NO: 173549 - DNA, 20 bp, Artificial
  CRISPR gRNA sequence
tgtctcagaaataaaaacac

SEQ ID NO: 173550 - DNA, 20 bp, Artificial
  CRISPR gRNA sequence
tctcagaaataaaaacactt

SEQ ID NO: 173551 - DNA, 20 bp, Artificial
  CRISPR gRNA sequence
agaaataaaaacacttcata

SEQ ID NO: 173552 - DNA, 20 bp, Artificial
  CRISPR gRNA sequence
cataaggacacagctgccat

SEQ ID NO: 173553 - DNA, 20 bp, Artificial
  CRISPR gRNA sequence
ataaggacacagctgccata

SEQ ID NO: 173554 - DNA, 20 bp, Artificial
  CRISPR gRNA sequence
ccatagacagggattcctca

SEQ ID NO: 173555 - DNA, 20 bp, Artificial
  CRISPR gRNA sequence
ctcagacagatctgagtaaa

SEQ ID NO: 173556 - DNA, 20 bp, Artificial
  CRISPR gRNA sequence
agacagatctgagtaaactg

SEQ ID NO: 173557 - DNA, 20 bp, Artificial
  CRISPR gRNA sequence
agtaaactgaaaaccttcta

SEQ ID NO: 173558 - DNA, 20 bp, Artificial
  CRISPR gRNA sequence
aaaaccttctagacaggatt

SEQ ID NO: 173559 - DNA, 20 bp, Artificial
  CRISPR gRNA sequence
ctagacaggattcaccattt

SEQ ID NO: 173560 - DNA, 20 bp, Artificial
  CRISPR gRNA sequence
tagacaggattcaccatttt

SEQ ID NO: 173561 - DNA, 20 bp, Artificial
  CRISPR gRNA sequence
gacaggattcaccattttaa

SEQ ID NO: 173562 - DNA, 20 bp, Artificial
  CRISPR gRNA sequence
accattttaaataccattaa

SEQ ID NO: 173563 - DNA, 20 bp, Artificial
  CRISPR gRNA sequence
taaataccattaagaatatt

SEQ ID NO: 173564 - DNA, 20 bp, Artificial
  CRISPR gRNA sequence
aaataccattaagaatattc

SEQ ID NO: 173565 - DNA, 20 bp, Artificial
  CRISPR gRNA sequence
aataccattaagaatattca

SEQ ID NO: 173566 - DNA, 20 bp, Artificial
  CRISPR gRNA sequence
agaatattcatggcaggctg

SEQ ID NO: 173567 - DNA, 20 bp, Artificial
  CRISPR gRNA sequence
atggcaggctgggcgcggtg

SEQ ID NO: 173568 - DNA, 20 bp, Artificial
  CRISPR gRNA sequence
ggcgcggtgactcatgcctg

SEQ ID NO: 173569 - DNA, 20 bp, Artificial
  CRISPR gRNA sequence
atgcctgtaatcctagcact

SEQ ID NO: 173570 - DNA, 20 bp, Artificial
  CRISPR gRNA sequence
taatcctagcactttgggag

SEQ ID NO: 173571 - DNA, 20 bp, Artificial
  CRISPR gRNA sequence
gcactttgggaggccgaggc

SEQ ID NO: 173572 - DNA, 20 bp, Artificial
  CRISPR gRNA sequence
tgggaggccgaggcgggcga

SEQ ID NO: 173573 - DNA, 20 bp, Artificial
  CRISPR gRNA sequence
gggaggccgaggcgggcgaa

SEQ ID NO: 173574 - DNA, 20 bp, Artificial
  CRISPR gRNA sequence
ggaggccgaggcgggcgaat

SEQ ID NO: 173575 - DNA, 20 bp, Artificial
  CRISPR gRNA sequence
gagaccagccgggccaacat

SEQ ID NO: 173576 - DNA, 20 bp, Artificial
  CRISPR gRNA sequence
agaccagccgggccaacatg

SEQ ID NO: 173577 - DNA, 20 bp, Artificial
  CRISPR gRNA sequence
tctctactaaaaaaatacaa

SEQ ID NO: 173578 - DNA, 20 bp, Artificial
  CRISPR gRNA sequence
tactaaaaaaatacaaaaat

SEQ ID NO: 173579 - DNA, 20 bp, Artificial
  CRISPR gRNA sequence
ctaaaaaaatacaaaaatta

SEQ ID NO: 173580 - DNA, 20 bp, Artificial
  CRISPR gRNA sequence
aaaaaatacaaaaattagcc

SEQ ID NO: 173581 - DNA, 20 bp, Artificial
  CRISPR gRNA sequence
gccgggcatggtggtgtggg

SEQ ID NO: 173582 - DNA, 20 bp, Artificial
  CRISPR gRNA sequence
aaatcccagctacttggaaa

SEQ ID NO: 173583 - DNA, 20 bp, Artificial
  CRISPR gRNA sequence
cttggaaagctgaggcagga

SEQ ID NO: 173584 - DNA, 20 bp, Artificial
  CRISPR gRNA sequence
ggaaagctgaggcaggagaa

SEQ ID NO: 173585 - DNA, 20 bp, Artificial
  CRISPR gRNA sequence
gaaagctgaggcaggagaat

SEQ ID NO: 173586 - DNA, 20 bp, Artificial
  CRISPR gRNA sequence
aggcaggagaatcacttgaa

SEQ ID NO: 173587 - DNA, 20 bp, Artificial
  CRISPR gRNA sequence
gaatctgggaggcggaggtt

SEQ ID NO: 173588 - DNA, 20 bp, Artificial
  CRISPR gRNA sequence
aatctgggaggcggaggttg

SEQ ID NO: 173589 - DNA, 20 bp, Artificial
  CRISPR gRNA sequence
ggaggcggaggttgcagtga

SEQ ID NO: 173590 - DNA, 20 bp, Artificial
  CRISPR gRNA sequence
cagtgagccgaaatcgtgcc

SEQ ID NO: 173591 - DNA, 20 bp, Artificial
  CRISPR gRNA sequence
cactccagcctgggcgacag

SEQ ID NO: 173592 - DNA, 20 bp, Artificial
  CRISPR gRNA sequence
cagcctgggcgacagagcaa

SEQ ID NO: 173593 - DNA, 20 bp, Artificial
  CRISPR gRNA sequence
ggcgacagagcaagactttg

SEQ ID NO: 173594 - DNA, 20 bp, Artificial
  CRISPR gRNA sequence
tgtctcaaaaaaaaaaaaaa

SEQ ID NO: 173595 - DNA, 20 bp, Artificial
  CRISPR gRNA sequence
gtctcaaaaaaaaaaaaaaa

SEQ ID NO: 173596 - DNA, 20 bp, Artificial
  CRISPR gRNA sequence
tctcaaaaaaaaaaaaaaaa

SEQ ID NO: 173597 - DNA, 20 bp, Artificial
  CRISPR gRNA sequence
aaaaaaaaaaaaaaaagaat

SEQ ID NO: 173598 - DNA, 20 bp, Artificial
  CRISPR gRNA sequence
atggccaggcacagtgcctc

SEQ ID NO: 173599 - DNA, 20 bp, Artificial
  CRISPR gRNA sequence
aggcctgtaattccagcagt

SEQ ID NO: 173600 - DNA, 20 bp, Artificial
  CRISPR gRNA sequence
taattccagcagtttgggag

SEQ ID NO: 173601 - DNA, 20 bp, Artificial
  CRISPR gRNA sequence
cagcagtttgggaggccaag

SEQ ID NO: 173602 - DNA, 20 bp, Artificial
  CRISPR gRNA sequence
gggaggccaaggcgggagga

SEQ ID NO: 173603 - DNA, 20 bp, Artificial
  CRISPR gRNA sequence
ggaggccaaggcgggaggac

SEQ ID NO: 173604 - DNA, 20 bp, Artificial
  CRISPR gRNA sequence
ctttagctcaggacttcaaa

SEQ ID NO: 173605 - DNA, 20 bp, Artificial
  CRISPR gRNA sequence
tagctcaggacttcaaaacc

SEQ ID NO: 173606 - DNA, 20 bp, Artificial
  CRISPR gRNA sequence
agctcaggacttcaaaacca

SEQ ID NO: 173607 - DNA, 20 bp, Artificial
  CRISPR gRNA sequence
gctcaggacttcaaaaccag

SEQ ID NO: 173608 - DNA, 20 bp, Artificial
  CRISPR gRNA sequence
aggacttcaaaaccagcctg

SEQ ID NO: 173609 - DNA, 20 bp, Artificial
  CRISPR gRNA sequence
caaaaccagcctgggcaaca

SEQ ID NO: 173610 - DNA, 20 bp, Artificial
  CRISPR gRNA sequence
aaaaccagcctgggcaacat

SEQ ID NO: 173611 - DNA, 20 bp, Artificial
  CRISPR gRNA sequence
ggcaacatggcaaaacctgt

SEQ ID NO: 173612 - DNA, 20 bp, Artificial
  CRISPR gRNA sequence
tctctacaaaaaatacaaaa

SEQ ID NO: 173613 - DNA, 20 bp, Artificial
  CRISPR gRNA sequence
tacaaaaaatacaaaaatta

SEQ ID NO: 173614 - DNA, 20 bp, Artificial
  CRISPR gRNA sequence
caaaaaatacaaaaattagc

SEQ ID NO: 173615 - DNA, 20 bp, Artificial
  CRISPR gRNA sequence
gctggttgtggtggcacatg

SEQ ID NO: 173616 - DNA, 20 bp, Artificial
  CRISPR gRNA sequence
gttgtggtggcacatgctta

SEQ ID NO: 173617 - DNA, 20 bp, Artificial
  CRISPR gRNA sequence
tggtggcacatgcttattgt

SEQ ID NO: 173618 - DNA, 20 bp, Artificial
  CRISPR gRNA sequence
attgtcccaactacttagga

SEQ ID NO: 173619 - DNA, 20 bp, Artificial
  CRISPR gRNA sequence
ttgtcccaactacttaggag

SEQ ID NO: 173620 - DNA, 20 bp, Artificial
  CRISPR gRNA sequence
tcccaactacttaggaggct

SEQ ID NO: 173621 - DNA, 20 bp, Artificial
  CRISPR gRNA sequence
cttaggaggctgaggtggga

SEQ ID NO: 173622 - DNA, 20 bp, Artificial
  CRISPR gRNA sequence
aggaggctgaggtgggagga

SEQ ID NO: 173623 - DNA, 20 bp, Artificial
  CRISPR gRNA sequence
ggaggctgaggtgggaggat

SEQ ID NO: 173624 - DNA, 20 bp, Artificial
  CRISPR gRNA sequence
aggtgggaggatcacttgag

SEQ ID NO: 173625 - DNA, 20 bp, Artificial
  CRISPR gRNA sequence
gagcctgggagatcagggct

SEQ ID NO: 173626 - DNA, 20 bp, Artificial
  CRISPR gRNA sequence
agcctgggagatcagggctg

SEQ ID NO: 173627 - DNA, 20 bp, Artificial
  CRISPR gRNA sequence
ggagatcagggctgcagtga

SEQ ID NO: 173628 - DNA, 20 bp, Artificial
  CRISPR gRNA sequence
cagtgagccaagatcttgct

SEQ ID NO: 173629 - DNA, 20 bp, Artificial
  CRISPR gRNA sequence
gctactgcactccagtctgg

SEQ ID NO: 173630 - DNA, 20 bp, Artificial
  CRISPR gRNA sequence
ctactgcactccagtctggg

SEQ ID NO: 173631 - DNA, 20 bp, Artificial
  CRISPR gRNA sequence
ctgcactccagtctgggcaa

SEQ ID NO: 173632 - DNA, 20 bp, Artificial
  CRISPR gRNA sequence
cactccagtctgggcaacag

SEQ ID NO: 173633 - DNA, 20 bp, Artificial
  CRISPR gRNA sequence
cagtctgggcaacagagtaa

SEQ ID NO: 173634 - DNA, 20 bp, Artificial
  CRISPR gRNA sequence
ggcaacagagtaagaccctg

SEQ ID NO: 173635 - DNA, 20 bp, Artificial
  CRISPR gRNA sequence
tctcaaaaaccaaccaacca

SEQ ID NO: 173636 - DNA, 20 bp, Artificial
  CRISPR gRNA sequence
aaaaaccaaccaaccaacca

SEQ ID NO: 173637 - DNA, 20 bp, Artificial
  CRISPR gRNA sequence
aaaattcatgggaggaagtc

SEQ ID NO: 173638 - DNA, 20 bp, Artificial
  CRISPR gRNA sequence
atgggaggaagtcaaaatat

SEQ ID NO: 173639 - DNA, 20 bp, Artificial
  CRISPR gRNA sequence
acaggagtctgaagttgatt

SEQ ID NO: 173640 - DNA, 20 bp, Artificial
  CRISPR gRNA sequence
aagttgattccaatcctcct

SEQ ID NO: 173641 - DNA, 20 bp, Artificial
  CRISPR gRNA sequence
attccaatcctcctggatga

SEQ ID NO: 173642 - DNA, 20 bp, Artificial
  CRISPR gRNA sequence
caatcctcctggatgatttt

SEQ ID NO: 173643 - DNA, 20 bp, Artificial
  CRISPR gRNA sequence
ctggatgattttgaggggtt

SEQ ID NO: 173644 - DNA, 20 bp, Artificial
  CRISPR gRNA sequence
gatgattttgaggggtttga

SEQ ID NO: 173645 - DNA, 20 bp, Artificial
  CRISPR gRNA sequence
tgaggggtttgagacttcag

SEQ ID NO: 173646 - DNA, 20 bp, Artificial
  CRISPR gRNA sequence
gaggggtttgagacttcagt

SEQ ID NO: 173647 - DNA, 20 bp, Artificial
  CRISPR gRNA sequence
aggggtttgagacttcagtg

SEQ ID NO: 173648 - DNA, 20 bp, Artificial
  CRISPR gRNA sequence
gagacttcagtggaagaagt

SEQ ID NO: 173649 - DNA, 20 bp, Artificial
  CRISPR gRNA sequence
agacttcagtggaagaagta

SEQ ID NO: 173650 - DNA, 20 bp, Artificial
  CRISPR gRNA sequence
cagtggaagaagtaactgta

SEQ ID NO: 173651 - DNA, 20 bp, Artificial
  CRISPR gRNA sequence
agtggaagaagtaactgtag

SEQ ID NO: 173652 - DNA, 20 bp, Artificial
  CRISPR gRNA sequence
tagatgtggtagaaatagca

SEQ ID NO: 173653 - DNA, 20 bp, Artificial
  CRISPR gRNA sequence
taattagaagcggagcctga

SEQ ID NO: 173654 - DNA, 20 bp, Artificial
  CRISPR gRNA sequence
gaagcggagcctgagatgtg

SEQ ID NO: 173655 - DNA, 20 bp, Artificial
  CRISPR gRNA sequence
agatgtgactggattgctgc

SEQ ID NO: 173656 - DNA, 20 bp, Artificial
  CRISPR gRNA sequence
gattgctgcaatctcatgat

SEQ ID NO: 173657 - DNA, 20 bp, Artificial
  CRISPR gRNA sequence
ctgcaatctcatgataaaac

SEQ ID NO: 173658 - DNA, 20 bp, Artificial
  CRISPR gRNA sequence
caatctcatgataaaacttt

SEQ ID NO: 173659 - DNA, 20 bp, Artificial
  CRISPR gRNA sequence
atgataaaactttaacagat

SEQ ID NO: 173660 - DNA, 20 bp, Artificial
  CRISPR gRNA sequence
taacagatgaggagttgctt

SEQ ID NO: 173661 - DNA, 20 bp, Artificial
  CRISPR gRNA sequence
aacagatgaggagttgcttc

SEQ ID NO: 173662 - DNA, 20 bp, Artificial
  CRISPR gRNA sequence
acagatgaggagttgcttct

SEQ ID NO: 173663 - DNA, 20 bp, Artificial
  CRISPR gRNA sequence
cttcttatggaaggcaaaga

SEQ ID NO: 173664 - DNA, 20 bp, Artificial
  CRISPR gRNA sequence
cttatggaaggcaaagaaag

SEQ ID NO: 173665 - DNA, 20 bp, Artificial
  CRISPR gRNA sequence
ttatggaaggcaaagaaagt

SEQ ID NO: 173666 - DNA, 20 bp, Artificial
  CRISPR gRNA sequence
atggaaggcaaagaaagtcg

SEQ ID NO: 173667 - DNA, 20 bp, Artificial
  CRISPR gRNA sequence
tggaaggcaaagaaagtcgt

SEQ ID NO: 173668 - DNA, 20 bp, Artificial
  CRISPR gRNA sequence
cttgaaatggaacctactcc

SEQ ID NO: 173669 - DNA, 20 bp, Artificial
  CRISPR gRNA sequence
gaaatggaacctactcccag

SEQ ID NO: 173670 - DNA, 20 bp, Artificial
  CRISPR gRNA sequence
aaatggaacctactcccagt

SEQ ID NO: 173671 - DNA, 20 bp, Artificial
  CRISPR gRNA sequence
ctcccagtgaaaatgctatg

SEQ ID NO: 173672 - DNA, 20 bp, Artificial
  CRISPR gRNA sequence
ccagtgaaaatgctatgaac

SEQ ID NO: 173673 - DNA, 20 bp, Artificial
  CRISPR gRNA sequence
tgaacattagaatattatat

SEQ ID NO: 173674 - DNA, 20 bp, Artificial
  CRISPR gRNA sequence
gaatattatataaacttagt

SEQ ID NO: 173675 - DNA, 20 bp, Artificial
  CRISPR gRNA sequence
tataaacttagttcataaaa

SEQ ID NO: 173676 - DNA, 20 bp, Artificial
  CRISPR gRNA sequence
agttcataaaatagtggcag

SEQ ID NO: 173677 - DNA, 20 bp, Artificial
  CRISPR gRNA sequence
gttcataaaatagtggcagg

SEQ ID NO: 173678 - DNA, 20 bp, Artificial
  CRISPR gRNA sequence
ataaaatagtggcaggattt

SEQ ID NO: 173679 - DNA, 20 bp, Artificial
  CRISPR gRNA sequence
gagaggacaaactccagttt

SEQ ID NO: 173680 - DNA, 20 bp, Artificial
  CRISPR gRNA sequence
agaggacaaactccagtttt

SEQ ID NO: 173681 - DNA, 20 bp, Artificial
  CRISPR gRNA sequence
cagttttgaaagaagctcta

SEQ ID NO: 173682 - DNA, 20 bp, Artificial
  CRISPR gRNA sequence
tgaaagaagctctactctgg

SEQ ID NO: 173683 - DNA, 20 bp, Artificial
  CRISPR gRNA sequence
gaaagaagctctactctggg

SEQ ID NO: 173684 - DNA, 20 bp, Artificial
  CRISPR gRNA sequence
aaagaagctctactctgggt

SEQ ID NO: 173685 - DNA, 20 bp, Artificial
  CRISPR gRNA sequence
tactctgggtaaaatgctat

SEQ ID NO: 173686 - DNA, 20 bp, Artificial
  CRISPR gRNA sequence
ctctgggtaaaatgctatca

SEQ ID NO: 173687 - DNA, 20 bp, Artificial
  CRISPR gRNA sequence
tgggtaaaatgctatcaaac

SEQ ID NO: 173688 - DNA, 20 bp, Artificial
  CRISPR gRNA sequence
ggtaaaatgctatcaaacag

SEQ ID NO: 173689 - DNA, 20 bp, Artificial
  CRISPR gRNA sequence
tcaaacagaaaagcagctac

SEQ ID NO: 173690 - DNA, 20 bp, Artificial
  CRISPR gRNA sequence
cagagaaatctttcatgaaa

SEQ ID NO: 173691 - DNA, 20 bp, Artificial
  CRISPR gRNA sequence
tcatgaaaggaagagtcaac

SEQ ID NO: 173692 - DNA, 20 bp, Artificial
  CRISPR gRNA sequence
catgaaaggaagagtcaact

SEQ ID NO: 173693 - DNA, 20 bp, Artificial
  CRISPR gRNA sequence
atgaaaggaagagtcaactg

SEQ ID NO: 173694 - DNA, 20 bp, Artificial
  CRISPR gRNA sequence
aagcaacaaacttcactgct

SEQ ID NO: 173695 - DNA, 20 bp, Artificial
  CRISPR gRNA sequence
cactgctgccttattttaag

SEQ ID NO: 173696 - DNA, 20 bp, Artificial
  CRISPR gRNA sequence
actgctgccttattttaaga

SEQ ID NO: 173697 - DNA, 20 bp, Artificial
  CRISPR gRNA sequence
ctgccttattttaagaaatt

SEQ ID NO: 173698 - DNA, 20 bp, Artificial
  CRISPR gRNA sequence
ccttattttaagaaattgcc

SEQ ID NO: 173699 - DNA, 20 bp, Artificial
  CRISPR gRNA sequence
attttaagaaattgccagcc

SEQ ID NO: 173700 - DNA, 20 bp, Artificial
  CRISPR gRNA sequence
ttttaagaaattgccagcca

SEQ ID NO: 173701 - DNA, 20 bp, Artificial
  CRISPR gRNA sequence
taagaaattgccagccaggc

SEQ ID NO: 173702 - DNA, 20 bp, Artificial
  CRISPR gRNA sequence
aagaaattgccagccaggca

SEQ ID NO: 173703 - DNA, 20 bp, Artificial
  CRISPR gRNA sequence
agaaattgccagccaggcac

SEQ ID NO: 173704 - DNA, 20 bp, Artificial
  CRISPR gRNA sequence
ccagccaggcacagtggctc

SEQ ID NO: 173705 - DNA, 20 bp, Artificial
  CRISPR gRNA sequence
acgccagtaatcccagcact

SEQ ID NO: 173706 - DNA, 20 bp, Artificial
  CRISPR gRNA sequence
tgggaggctagggcaagagg

SEQ ID NO: 173707 - DNA, 20 bp, Artificial
  CRISPR gRNA sequence
gggaggctagggcaagagga

SEQ ID NO: 173708 - DNA, 20 bp, Artificial
  CRISPR gRNA sequence
ggaggctagggcaagaggat

SEQ ID NO: 173709 - DNA, 20 bp, Artificial
  CRISPR gRNA sequence
gggcaagaggatcacttcag

SEQ ID NO: 173710 - DNA, 20 bp, Artificial
  CRISPR gRNA sequence
cagcccaggagtttgagaca

SEQ ID NO: 173711 - DNA, 20 bp, Artificial
  CRISPR gRNA sequence
agcccaggagtttgagacat

SEQ ID NO: 173712 - DNA, 20 bp, Artificial
  CRISPR gRNA sequence
gagacatcaagatcagtctg

SEQ ID NO: 173713 - DNA, 20 bp, Artificial
  CRISPR gRNA sequence
agacatcaagatcagtctgg

SEQ ID NO: 173714 - DNA, 20 bp, Artificial
  CRISPR gRNA sequence
ggcaacacaggagaccctgt

SEQ ID NO: 173715 - DNA, 20 bp, Artificial
  CRISPR gRNA sequence
tctatacaaaaaatacaaaa

SEQ ID NO: 173716 - DNA, 20 bp, Artificial
  CRISPR gRNA sequence
tacaaaaaatacaaaaatca

SEQ ID NO: 173717 - DNA, 20 bp, Artificial
  CRISPR gRNA sequence
ggtgtggtggcacgtgtctg

SEQ ID NO: 173718 - DNA, 20 bp, Artificial
  CRISPR gRNA sequence
tagtcccagctacttgggag

SEQ ID NO: 173719 - DNA, 20 bp, Artificial
  CRISPR gRNA sequence
cttgggaggctgaagtagga

SEQ ID NO: 173720 - DNA, 20 bp, Artificial
  CRISPR gRNA sequence
gggaggctgaagtaggagga

SEQ ID NO: 173721 - DNA, 20 bp, Artificial
  CRISPR gRNA sequence
ggaggctgaagtaggaggat

SEQ ID NO: 173722 - DNA, 20 bp, Artificial
  CRISPR gRNA sequence
aagtaggaggatggcttgaa

SEQ ID NO: 173723 - DNA, 20 bp, Artificial
  CRISPR gRNA sequence
gaacctggaaggcagaggtt

SEQ ID NO: 173724 - DNA, 20 bp, Artificial
  CRISPR gRNA sequence
aacctggaaggcagaggttg

SEQ ID NO: 173725 - DNA, 20 bp, Artificial
  CRISPR gRNA sequence
gaaggcagaggttgcaatca

SEQ ID NO: 173726 - DNA, 20 bp, Artificial
  CRISPR gRNA sequence
caatcagccaagatcatgac

SEQ ID NO: 173727 - DNA, 20 bp, Artificial
  CRISPR gRNA sequence
tactccagcctgggtgacag

SEQ ID NO: 173728 - DNA, 20 bp, Artificial
  CRISPR gRNA sequence
cagcctgggtgacagtgtgg

SEQ ID NO: 173729 - DNA, 20 bp, Artificial
  CRISPR gRNA sequence
ggtgacagtgtggagagagg

SEQ ID NO: 173730 - DNA, 20 bp, Artificial
  CRISPR gRNA sequence
acgcctgtaatcccagcact

SEQ ID NO: 173731 - DNA, 20 bp, Artificial
  CRISPR gRNA sequence
taatcccagcactttgggag

SEQ ID NO: 173732 - DNA, 20 bp, Artificial
  CRISPR gRNA sequence
tgggagactgaggtgggtgg

SEQ ID NO: 173733 - DNA, 20 bp, Artificial
  CRISPR gRNA sequence
gggagactgaggtgggtgga

SEQ ID NO: 173734 - DNA, 20 bp, Artificial
  CRISPR gRNA sequence
ggagactgaggtgggtggat

SEQ ID NO: 173735 - DNA, 20 bp, Artificial
  CRISPR gRNA sequence
aggtgggtggatcacctgag

SEQ ID NO: 173736 - DNA, 20 bp, Artificial
  CRISPR gRNA sequence
aggtcaggagttcgaaacca

SEQ ID NO: 173737 - DNA, 20 bp, Artificial
  CRISPR gRNA sequence
gaaaccagcctggccaacat

SEQ ID NO: 173738 - DNA, 20 bp, Artificial
  CRISPR gRNA sequence
gccaacatggtgaaaccccg

SEQ ID NO: 173739 - DNA, 20 bp, Artificial
  CRISPR gRNA sequence
tactaaaaatacaaaaatta

SEQ ID NO: 173740 - DNA, 20 bp, Artificial
  CRISPR gRNA sequence
ctaaaaatacaaaaattagc

SEQ ID NO: 173741 - DNA, 20 bp, Artificial
  CRISPR gRNA sequence
aaaatacaaaaattagctgg

SEQ ID NO: 173742 - DNA, 20 bp, Artificial
  CRISPR gRNA sequence
gctgggcatggtggtgcggg

SEQ ID NO: 173743 - DNA, 20 bp, Artificial
  CRISPR gRNA sequence
ggcatggtggtgcgggcctg

SEQ ID NO: 173744 - DNA, 20 bp, Artificial
  CRISPR gRNA sequence
caatcccagctacttgggaa

SEQ ID NO: 173745 - DNA, 20 bp, Artificial
  CRISPR gRNA sequence
cttgggaagctggggcagca

SEQ ID NO: 173746 - DNA, 20 bp, Artificial
  CRISPR gRNA sequence
gggaagctggggcagcagaa

SEQ ID NO: 173747 - DNA, 20 bp, Artificial
  CRISPR gRNA sequence
ggaagctggggcagcagaat

SEQ ID NO: 173748 - DNA, 20 bp, Artificial
  CRISPR gRNA sequence
gggcagcagaatcgcttgag

SEQ ID NO: 173749 - DNA, 20 bp, Artificial
  CRISPR gRNA sequence
gagcccaggaggcagaggtt

SEQ ID NO: 173750 - DNA, 20 bp, Artificial
  CRISPR gRNA sequence
agcccaggaggcagaggttg

SEQ ID NO: 173751 - DNA, 20 bp, Artificial
  CRISPR gRNA sequence
cagtgagctgagatggcgcc

SEQ ID NO: 173752 - DNA, 20 bp, Artificial
  CRISPR gRNA sequence
agatggcgccactgcactcc

SEQ ID NO: 173753 - DNA, 20 bp, Artificial
  CRISPR gRNA sequence
cactccagcctgagcaacag

SEQ ID NO: 173754 - DNA, 20 bp, Artificial
  CRISPR gRNA sequence
cagcctgagcaacaggagcg

SEQ ID NO: 173755 - DNA, 20 bp, Artificial
  CRISPR gRNA sequence
agcaacaggagcgaaactcc

SEQ ID NO: 173756 - DNA, 20 bp, Artificial
  CRISPR gRNA sequence
catctcaaaaaaaaacacac

SEQ ID NO: 173757 - DNA, 20 bp, Artificial
  CRISPR gRNA sequence
aaaaaaaaacacacacacac

SEQ ID NO: 173758 - DNA, 20 bp, Artificial
  CRISPR gRNA sequence
ccaaagccaccccaaacttc

SEQ ID NO: 173759 - DNA, 20 bp, Artificial
  CRISPR gRNA sequence
cagcaactaccacccgaatc

SEQ ID NO: 173760 - DNA, 20 bp, Artificial
  CRISPR gRNA sequence
agcaactaccacccgaatca

SEQ ID NO: 173761 - DNA, 20 bp, Artificial
  CRISPR gRNA sequence
ccacccgaatcagtcagcag

SEQ ID NO: 173762 - DNA, 20 bp, Artificial
  CRISPR gRNA sequence
aagcagcaaaaggttatgac

SEQ ID NO: 173763 - DNA, 20 bp, Artificial
  CRISPR gRNA sequence
tgacttgctgcaagttcaga

SEQ ID NO: 173764 - DNA, 20 bp, Artificial
  CRISPR gRNA sequence
gctgcaagttcagatgataa

SEQ ID NO: 173765 - DNA, 20 bp, Artificial
  CRISPR gRNA sequence
ctgcaagttcagatgataat

SEQ ID NO: 173766 - DNA, 20 bp, Artificial
  CRISPR gRNA sequence
caagttcagatgataatttg

SEQ ID NO: 173767 - DNA, 20 bp, Artificial
  CRISPR gRNA sequence
agatgataatttgcattttt

SEQ ID NO: 173768 - DNA, 20 bp, Artificial
  CRISPR gRNA sequence
gcatttttaccaataaggta

SEQ ID NO: 173769 - DNA, 20 bp, Artificial
  CRISPR gRNA sequence
catttttaccaataaggtat

SEQ ID NO: 173770 - DNA, 20 bp, Artificial
  CRISPR gRNA sequence
ttaccaataaggtattttaa

SEQ ID NO: 173771 - DNA, 20 bp, Artificial
  CRISPR gRNA sequence
taccaataaggtattttaaa

SEQ ID NO: 173772 - DNA, 20 bp, Artificial
  CRISPR gRNA sequence
accaataaggtattttaaaa

SEQ ID NO: 173773 - DNA, 20 bp, Artificial
  CRISPR gRNA sequence
ccaataaggtattttaaaat

SEQ ID NO: 173774 - DNA, 20 bp, Artificial
  CRISPR gRNA sequence
taaaattaaaataagcacat

SEQ ID NO: 173775 - DNA, 20 bp, Artificial
  CRISPR gRNA sequence
aaaattaaaataagcacatt

SEQ ID NO: 173776 - DNA, 20 bp, Artificial
  CRISPR gRNA sequence
aaattaaaataagcacattt

SEQ ID NO: 173777 - DNA, 20 bp, Artificial
  CRISPR gRNA sequence
aaataagcacattttttaga

SEQ ID NO: 173778 - DNA, 20 bp, Artificial
  CRISPR gRNA sequence
tttagacattatgctgttgc

SEQ ID NO: 173779 - DNA, 20 bp, Artificial
  CRISPR gRNA sequence
ttagacattatgctgttgca

SEQ ID NO: 173780 - DNA, 20 bp, Artificial
  CRISPR gRNA sequence
tagacattatgctgttgcac

SEQ ID NO: 173781 - DNA, 20 bp, Artificial
  CRISPR gRNA sequence
agacattatgctgttgcaca

SEQ ID NO: 173782 - DNA, 20 bp, Artificial
  CRISPR gRNA sequence
gacattatgctgttgcacac

SEQ ID NO: 173783 - DNA, 20 bp, Artificial
  CRISPR gRNA sequence
tgctgttgcacacttaatag

SEQ ID NO: 173784 - DNA, 20 bp, Artificial
  CRISPR gRNA sequence
ttgcacacttaataggctac

SEQ ID NO: 173785 - DNA, 20 bp, Artificial
  CRISPR gRNA sequence
cacacttaataggctacact

SEQ ID NO: 173786 - DNA, 20 bp, Artificial
  CRISPR gRNA sequence
aataggctacactataatat

SEQ ID NO: 173787 - DNA, 20 bp, Artificial
  CRISPR gRNA sequence
ataggctacactataatata

SEQ ID NO: 173788 - DNA, 20 bp, Artificial
  CRISPR gRNA sequence
cactataatataaacataac

SEQ ID NO: 173789 - DNA, 20 bp, Artificial
  CRISPR gRNA sequence
taatataaacataacttcta

SEQ ID NO: 173790 - DNA, 20 bp, Artificial
  CRISPR gRNA sequence
ctatttgcactgggaaacca

SEQ ID NO: 173791 - DNA, 20 bp, Artificial
  CRISPR gRNA sequence
tatttgcactgggaaaccaa

SEQ ID NO: 173792 - DNA, 20 bp, Artificial
  CRISPR gRNA sequence
tttgcactgggaaaccaaca

SEQ ID NO: 173793 - DNA, 20 bp, Artificial
  CRISPR gRNA sequence
gcactgggaaaccaacaaat

SEQ ID NO: 173794 - DNA, 20 bp, Artificial
  CRISPR gRNA sequence
cactgggaaaccaacaaatt

SEQ ID NO: 173795 - DNA, 20 bp, Artificial
  CRISPR gRNA sequence
ggaaaccaacaaatttgtgt

SEQ ID NO: 173796 - DNA, 20 bp, Artificial
  CRISPR gRNA sequence
gtgtgactctctttattata

SEQ ID NO: 173797 - DNA, 20 bp, Artificial
  CRISPR gRNA sequence
tgtgactctctttattataa

SEQ ID NO: 173798 - DNA, 20 bp, Artificial
  CRISPR gRNA sequence
tctttattataatgttagct

SEQ ID NO: 173799 - DNA, 20 bp, Artificial
  CRISPR gRNA sequence
tttattataatgttagcttt

SEQ ID NO: 173800 - DNA, 20 bp, Artificial
  CRISPR gRNA sequence
tattataatgttagctttat

SEQ ID NO: 173801 - DNA, 20 bp, Artificial
  CRISPR gRNA sequence
attataatgttagctttatt

SEQ ID NO: 173802 - DNA, 20 bp, Artificial
  CRISPR gRNA sequence
ttataatgttagctttattg

SEQ ID NO: 173803 - DNA, 20 bp, Artificial
  CRISPR gRNA sequence
taatgttagctttattgtat

SEQ ID NO: 173804 - DNA, 20 bp, Artificial
  CRISPR gRNA sequence
gctttattgtattttgccct

SEQ ID NO: 173805 - DNA, 20 bp, Artificial
  CRISPR gRNA sequence
tattgtattttgccctagtg

SEQ ID NO: 173806 - DNA, 20 bp, Artificial
  CRISPR gRNA sequence
attgtattttgccctagtgg

SEQ ID NO: 173807 - DNA, 20 bp, Artificial
  CRISPR gRNA sequence
ttgtattttgccctagtggc

SEQ ID NO: 173808 - DNA, 20 bp, Artificial
  CRISPR gRNA sequence
tattttgccctagtggcagc

SEQ ID NO: 173809 - DNA, 20 bp, Artificial
  CRISPR gRNA sequence
tgccctagtggcagcactat

SEQ ID NO: 173810 - DNA, 20 bp, Artificial
  CRISPR gRNA sequence
gccctagtggcagcactatc

SEQ ID NO: 173811 - DNA, 20 bp, Artificial
  CRISPR gRNA sequence
ccctagtggcagcactatca

SEQ ID NO: 173812 - DNA, 20 bp, Artificial
  CRISPR gRNA sequence
gtggcagcactatcacaagc

SEQ ID NO: 173813 - DNA, 20 bp, Artificial
  CRISPR gRNA sequence
tcacaagcattttatgtacc

SEQ ID NO: 173814 - DNA, 20 bp, Artificial
  CRISPR gRNA sequence
tatgtaccagtactgctcag

SEQ ID NO: 173815 - DNA, 20 bp, Artificial
  CRISPR gRNA sequence
atgtaccagtactgctcagg

SEQ ID NO: 173816 - DNA, 20 bp, Artificial
  CRISPR gRNA sequence
tgtaccagtactgctcaggt

SEQ ID NO: 173817 - DNA, 20 bp, Artificial
  CRISPR gRNA sequence
ctcaggtatttactgaggtt

SEQ ID NO: 173818 - DNA, 20 bp, Artificial
  CRISPR gRNA sequence
aggtatttactgaggttagt

SEQ ID NO: 173819 - DNA, 20 bp, Artificial
  CRISPR gRNA sequence
actgaggttagttctaggtt

SEQ ID NO: 173820 - DNA, 20 bp, Artificial
  CRISPR gRNA sequence
ctgaggttagttctaggttt

SEQ ID NO: 173821 - DNA, 20 bp, Artificial
  CRISPR gRNA sequence
aggttagttctaggtttctt

SEQ ID NO: 173822 - DNA, 20 bp, Artificial
  CRISPR gRNA sequence
gttctaggtttcttcattta

SEQ ID NO: 173823 - DNA, 20 bp, Artificial
  CRISPR gRNA sequence
taggtttcttcatttaaatg

SEQ ID NO: 173824 - DNA, 20 bp, Artificial
  CRISPR gRNA sequence
ggtttcttcatttaaatgag

SEQ ID NO: 173825 - DNA, 20 bp, Artificial
  CRISPR gRNA sequence
cttcatttaaatgagctaag

SEQ ID NO: 173826 - DNA, 20 bp, Artificial
  CRISPR gRNA sequence
ttcatttaaatgagctaagg

SEQ ID NO: 173827 - DNA, 20 bp, Artificial
  CRISPR gRNA sequence
catttaaatgagctaaggtt

SEQ ID NO: 173828 - DNA, 20 bp, Artificial
  CRISPR gRNA sequence
atttaaatgagctaaggttt

SEQ ID NO: 173829 - DNA, 20 bp, Artificial
  CRISPR gRNA sequence
aaatgagctaaggtttgtaa

SEQ ID NO: 173830 - DNA, 20 bp, Artificial
  CRISPR gRNA sequence
aatgagctaaggtttgtaag

SEQ ID NO: 173831 - DNA, 20 bp, Artificial
  CRISPR gRNA sequence
aggtttgtaagatgttatat

SEQ ID NO: 173832 - DNA, 20 bp, Artificial
  CRISPR gRNA sequence
gtaagatgttatattttaaa

SEQ ID NO: 173833 - DNA, 20 bp, Artificial
  CRISPR gRNA sequence
taagatgttatattttaaat

SEQ ID NO: 173834 - DNA, 20 bp, Artificial
  CRISPR gRNA sequence
tattttaaatgatgatggga

SEQ ID NO: 173835 - DNA, 20 bp, Artificial
  CRISPR gRNA sequence
taaatgatgatgggagatac

SEQ ID NO: 173836 - DNA, 20 bp, Artificial
  CRISPR gRNA sequence
aaatgatgatgggagataca

SEQ ID NO: 173837 - DNA, 20 bp, Artificial
  CRISPR gRNA sequence
aatgatgatgggagatacag

SEQ ID NO: 173838 - DNA, 20 bp, Artificial
  CRISPR gRNA sequence
ataaaaataaatggatggat

SEQ ID NO: 173839 - DNA, 20 bp, Artificial
  CRISPR gRNA sequence
atttactaacagactatttg

SEQ ID NO: 173840 - DNA, 20 bp, Artificial
  CRISPR gRNA sequence
tttactaacagactatttgg

SEQ ID NO: 173841 - DNA, 20 bp, Artificial
  CRISPR gRNA sequence
actaacagactatttggttt

SEQ ID NO: 173842 - DNA, 20 bp, Artificial
  CRISPR gRNA sequence
ctaacagactatttggtttt

SEQ ID NO: 173843 - DNA, 20 bp, Artificial
  CRISPR gRNA sequence
acagactatttggtttttat

SEQ ID NO: 173844 - DNA, 20 bp, Artificial
  CRISPR gRNA sequence
tttggtttttatgtttacac

SEQ ID NO: 173845 - DNA, 20 bp, Artificial
  CRISPR gRNA sequence
ggtttttatgtttacacaga

SEQ ID NO: 173846 - DNA, 20 bp, Artificial
  CRISPR gRNA sequence
gtttttatgtttacacagat

SEQ ID NO: 173847 - DNA, 20 bp, Artificial
  CRISPR gRNA sequence
ttatgtttacacagatggac

SEQ ID NO: 173848 - DNA, 20 bp, Artificial
  CRISPR gRNA sequence
tatgtttacacagatggacc

SEQ ID NO: 173849 - DNA, 20 bp, Artificial
  CRISPR gRNA sequence
atgtttacacagatggacct

SEQ ID NO: 173850 - DNA, 20 bp, Artificial
  CRISPR gRNA sequence
tgtttacacagatggacctt

SEQ ID NO: 173851 - DNA, 20 bp, Artificial
  CRISPR gRNA sequence
acacagatggaccttaggac

SEQ ID NO: 173852 - DNA, 20 bp, Artificial
  CRISPR gRNA sequence
cacagatggaccttaggact

SEQ ID NO: 173853 - DNA, 20 bp, Artificial
  CRISPR gRNA sequence
aggacttatgctattatcga

SEQ ID NO: 173854 - DNA, 20 bp, Artificial
  CRISPR gRNA sequence
ggacttatgctattatcgat

SEQ ID NO: 173855 - DNA, 20 bp, Artificial
  CRISPR gRNA sequence
atgctattatcgatcacaac

SEQ ID NO: 173856 - DNA, 20 bp, Artificial
  CRISPR gRNA sequence
tgctattatcgatcacaaca

SEQ ID NO: 173857 - DNA, 20 bp, Artificial
  CRISPR gRNA sequence
ttatcgatcacaacagctaa

SEQ ID NO: 173858 - DNA, 20 bp, Artificial
  CRISPR gRNA sequence
tcgatcacaacagctaaaaa

SEQ ID NO: 173859 - DNA, 20 bp, Artificial
  CRISPR gRNA sequence
aaaagcatttcttaagaagg

SEQ ID NO: 173860 - DNA, 20 bp, Artificial
  CRISPR gRNA sequence
cttaagaaggcttatactct

SEQ ID NO: 173861 - DNA, 20 bp, Artificial
  CRISPR gRNA sequence
ttaagaaggcttatactctc

SEQ ID NO: 173862 - DNA, 20 bp, Artificial
  CRISPR gRNA sequence
aagaaggcttatactctcca

SEQ ID NO: 173863 - DNA, 20 bp, Artificial
  CRISPR gRNA sequence
agaaggcttatactctccaa

SEQ ID NO: 173864 - DNA, 20 bp, Artificial
  CRISPR gRNA sequence
atactctccaaaataaaacc

SEQ ID NO: 173865 - DNA, 20 bp, Artificial
  CRISPR gRNA sequence
tactctccaaaataaaacca

SEQ ID NO: 173866 - DNA, 20 bp, Artificial
  CRISPR gRNA sequence
tccaaaataaaaccaatcta

SEQ ID NO: 173867 - DNA, 20 bp, Artificial
  CRISPR gRNA sequence
caaaataaaaccaatctaaa

SEQ ID NO: 173868 - DNA, 20 bp, Artificial
  CRISPR gRNA sequence
aaattgacaatttcacaaga

SEQ ID NO: 173869 - DNA, 20 bp, Artificial
  CRISPR gRNA sequence
acaatttcacaagaagaaaa

SEQ ID NO: 173870 - DNA, 20 bp, Artificial
  CRISPR gRNA sequence
cacaagaagaaaaacagcac

SEQ ID NO: 173871 - DNA, 20 bp, Artificial
  CRISPR gRNA sequence
acaagaagaaaaacagcact

SEQ ID NO: 173872 - DNA, 20 bp, Artificial
  CRISPR gRNA sequence
gtctggaaattaaaagacct

SEQ ID NO: 173873 - DNA, 20 bp, Artificial
  CRISPR gRNA sequence
gaaattaaaagacctacgtc

SEQ ID NO: 173874 - DNA, 20 bp, Artificial
  CRISPR gRNA sequence
aaagacctacgtctgtgtac

SEQ ID NO: 173875 - DNA, 20 bp, Artificial
  CRISPR gRNA sequence
cgtctgtgtactggacgctt

SEQ ID NO: 173876 - DNA, 20 bp, Artificial
  CRISPR gRNA sequence
tgtactggacgcttgctgcc

SEQ ID NO: 173877 - DNA, 20 bp, Artificial
  CRISPR gRNA sequence
gacgcttgctgcctactagc

SEQ ID NO: 173878 - DNA, 20 bp, Artificial
  CRISPR gRNA sequence
gctgcctactagctggtggc

SEQ ID NO: 173879 - DNA, 20 bp, Artificial
  CRISPR gRNA sequence
ctgcctactagctggtggcc

SEQ ID NO: 173880 - DNA, 20 bp, Artificial
  CRISPR gRNA sequence
cctactagctggtggccctg

SEQ ID NO: 173881 - DNA, 20 bp, Artificial
  CRISPR gRNA sequence
ctagctggtggccctgggcc

SEQ ID NO: 173882 - DNA, 20 bp, Artificial
  CRISPR gRNA sequence
gctggtggccctgggccagt

SEQ ID NO: 173883 - DNA, 20 bp, Artificial
  CRISPR gRNA sequence
gtggccctgggccagtcact

SEQ ID NO: 173884 - DNA, 20 bp, Artificial
  CRISPR gRNA sequence
ggccagtcactctactaagc

SEQ ID NO: 173885 - DNA, 20 bp, Artificial
  CRISPR gRNA sequence
tactaagccactccagcaat

SEQ ID NO: 173886 - DNA, 20 bp, Artificial
  CRISPR gRNA sequence
ctaagccactccagcaatga

SEQ ID NO: 173887 - DNA, 20 bp, Artificial
  CRISPR gRNA sequence
agccactccagcaatgatgt

SEQ ID NO: 173888 - DNA, 20 bp, Artificial
  CRISPR gRNA sequence
cagcaatgatgtatactgaa

SEQ ID NO: 173889 - DNA, 20 bp, Artificial
  CRISPR gRNA sequence
aacacattccaaaggggtct

SEQ ID NO: 173890 - DNA, 20 bp, Artificial
  CRISPR gRNA sequence
caaaggggtctctggtggtt

SEQ ID NO: 173891 - DNA, 20 bp, Artificial
  CRISPR gRNA sequence
tggtggtttggtggggaagt

SEQ ID NO: 173892 - DNA, 20 bp, Artificial
  CRISPR gRNA sequence
gtggtttggtggggaagtcc

SEQ ID NO: 173893 - DNA, 20 bp, Artificial
  CRISPR gRNA sequence
ggtggggaagtcctacactt

SEQ ID NO: 173894 - DNA, 20 bp, Artificial
  CRISPR gRNA sequence
gtggggaagtcctacacttc

SEQ ID NO: 173895 - DNA, 20 bp, Artificial
  CRISPR gRNA sequence
cacttcactacttgaagatg

SEQ ID NO: 173896 - DNA, 20 bp, Artificial
  CRISPR gRNA sequence
cactacttgaagatgcaata

SEQ ID NO: 173897 - DNA, 20 bp, Artificial
  CRISPR gRNA sequence
actacttgaagatgcaataa

SEQ ID NO: 173898 - DNA, 20 bp, Artificial
  CRISPR gRNA sequence
cttgaagatgcaataaatga

SEQ ID NO: 173899 - DNA, 20 bp, Artificial
  CRISPR gRNA sequence
gaagatgcaataaatgaatg

SEQ ID NO: 173900 - DNA, 20 bp, Artificial
  CRISPR gRNA sequence
aagatgcaataaatgaatga

SEQ ID NO: 173901 - DNA, 20 bp, Artificial
  CRISPR gRNA sequence
gagagaagagaaggttcaat

SEQ ID NO: 173902 - DNA, 20 bp, Artificial
  CRISPR gRNA sequence
aatagtctctatttaaactc

SEQ ID NO: 173903 - DNA, 20 bp, Artificial
  CRISPR gRNA sequence
tatttaaactcatctaaggt

SEQ ID NO: 173904 - DNA, 20 bp, Artificial
  CRISPR gRNA sequence
tttaaactcatctaaggttt

SEQ ID NO: 173905 - DNA, 20 bp, Artificial
  CRISPR gRNA sequence
aaactcatctaaggttttta

SEQ ID NO: 173906 - DNA, 20 bp, Artificial
  CRISPR gRNA sequence
aactcatctaaggtttttat

SEQ ID NO: 173907 - DNA, 20 bp, Artificial
  CRISPR gRNA sequence
atctaaggtttttatatagt

SEQ ID NO: 173908 - DNA, 20 bp, Artificial
  CRISPR gRNA sequence
aggtttttatatagtcatgc

SEQ ID NO: 173909 - DNA, 20 bp, Artificial
  CRISPR gRNA sequence
ttatatagtcatgcaggaaa

SEQ ID NO: 173910 - DNA, 20 bp, Artificial
  CRISPR gRNA sequence
tatatagtcatgcaggaaac

SEQ ID NO: 173911 - DNA, 20 bp, Artificial
  CRISPR gRNA sequence
atatagtcatgcaggaaact

SEQ ID NO: 173912 - DNA, 20 bp, Artificial
  CRISPR gRNA sequence
tatagtcatgcaggaaacta

SEQ ID NO: 173913 - DNA, 20 bp, Artificial
  CRISPR gRNA sequence
agttcaggcactacgtttag

SEQ ID NO: 173914 - DNA, 20 bp, Artificial
  CRISPR gRNA sequence
aggcactacgtttagtgcct

SEQ ID NO: 173915 - DNA, 20 bp, Artificial
  CRISPR gRNA sequence
cgtttagtgcctgaaacctt

SEQ ID NO: 173916 - DNA, 20 bp, Artificial
  CRISPR gRNA sequence
agtgcctgaaaccttattac

SEQ ID NO: 173917 - DNA, 20 bp, Artificial
  CRISPR gRNA sequence
gtgcctgaaaccttattact

SEQ ID NO: 173918 - DNA, 20 bp, Artificial
  CRISPR gRNA sequence
aaaccttattacttacattc

SEQ ID NO: 173919 - DNA, 20 bp, Artificial
  CRISPR gRNA sequence
attacttacattctaaaccc

SEQ ID NO: 173920 - DNA, 20 bp, Artificial
  CRISPR gRNA sequence
ttacttacattctaaaccct

SEQ ID NO: 173921 - DNA, 20 bp, Artificial
  CRISPR gRNA sequence
cttacattctaaacccttac

SEQ ID NO: 173922 - DNA, 20 bp, Artificial
  CRISPR gRNA sequence
acattctaaacccttacata

SEQ ID NO: 173923 - DNA, 20 bp, Artificial
  CRISPR gRNA sequence
cattctaaacccttacatag

SEQ ID NO: 173924 - DNA, 20 bp, Artificial
  CRISPR gRNA sequence
taaacccttacatagctggg

SEQ ID NO: 173925 - DNA, 20 bp, Artificial
  CRISPR gRNA sequence
aacccttacatagctgggta

SEQ ID NO: 173926 - DNA, 20 bp, Artificial
  CRISPR gRNA sequence
acatagctgggtaccagctg

SEQ ID NO: 173927 - DNA, 20 bp, Artificial
  CRISPR gRNA sequence
catagctgggtaccagctgg

SEQ ID NO: 173928 - DNA, 20 bp, Artificial
  CRISPR gRNA sequence
ggtaccagctggtcatattt

SEQ ID NO: 173929 - DNA, 20 bp, Artificial
  CRISPR gRNA sequence
gtcatatttactggcaggct

SEQ ID NO: 173930 - DNA, 20 bp, Artificial
  CRISPR gRNA sequence
actggcaggctactgaatag

SEQ ID NO: 173931 - DNA, 20 bp, Artificial
  CRISPR gRNA sequence
ctggcaggctactgaatagt

SEQ ID NO: 173932 - DNA, 20 bp, Artificial
  CRISPR gRNA sequence
gcaggctactgaatagtctt

SEQ ID NO: 173933 - DNA, 20 bp, Artificial
  CRISPR gRNA sequence
ctgaatagtcttcactacta

SEQ ID NO: 173934 - DNA, 20 bp, Artificial
  CRISPR gRNA sequence
aatagtcttcactactataa

SEQ ID NO: 173935 - DNA, 20 bp, Artificial
  CRISPR gRNA sequence
cactactataatacaagaat

SEQ ID NO: 173936 - DNA, 20 bp, Artificial
  CRISPR gRNA sequence
actactataatacaagaatg

SEQ ID NO: 173937 - DNA, 20 bp, Artificial
  CRISPR gRNA sequence
ctataatacaagaatgaata

SEQ ID NO: 173938 - DNA, 20 bp, Artificial
  CRISPR gRNA sequence
taatacaagaatgaataaca

SEQ ID NO: 173939 - DNA, 20 bp, Artificial
  CRISPR gRNA sequence
tacttccccaactctgatta

SEQ ID NO: 173940 - DNA, 20 bp, Artificial
  CRISPR gRNA sequence
cttccccaactctgattaat

SEQ ID NO: 173941 - DNA, 20 bp, Artificial
  CRISPR gRNA sequence
ccccaactctgattaatgcc

SEQ ID NO: 173942 - DNA, 20 bp, Artificial
  CRISPR gRNA sequence
cccaactctgattaatgcca

SEQ ID NO: 173943 - DNA, 20 bp, Artificial
  CRISPR gRNA sequence
tgattaatgccaagtttgac

SEQ ID NO: 173944 - DNA, 20 bp, Artificial
  CRISPR gRNA sequence
attaatgccaagtttgacgt

SEQ ID NO: 173945 - DNA, 20 bp, Artificial
  CRISPR gRNA sequence
atgccaagtttgacgtttga

SEQ ID NO: 173946 - DNA, 20 bp, Artificial
  CRISPR gRNA sequence
gacgtttgaaggtatatctg

SEQ ID NO: 173947 - DNA, 20 bp, Artificial
  CRISPR gRNA sequence
acgtttgaaggtatatctgt

SEQ ID NO: 173948 - DNA, 20 bp, Artificial
  CRISPR gRNA sequence
gaaggtatatctgtgttaag

SEQ ID NO: 173949 - DNA, 20 bp, Artificial
  CRISPR gRNA sequence
aaggtatatctgtgttaaga

SEQ ID NO: 173950 - DNA, 20 bp, Artificial
  CRISPR gRNA sequence
tgttaagaggaagccgcttt

SEQ ID NO: 173951 - DNA, 20 bp, Artificial
  CRISPR gRNA sequence
agaggaagccgcttttcaaa

SEQ ID NO: 173952 - DNA, 20 bp, Artificial
  CRISPR gRNA sequence
ttcaaagtgcctactggaaa

SEQ ID NO: 173953 - DNA, 20 bp, Artificial
  CRISPR gRNA sequence
tcaaagtgcctactggaaaa

SEQ ID NO: 173954 - DNA, 20 bp, Artificial
  CRISPR gRNA sequence
caaagtgcctactggaaaac

SEQ ID NO: 173955 - DNA, 20 bp, Artificial
  CRISPR gRNA sequence
aaagtgcctactggaaaacc

SEQ ID NO: 173956 - DNA, 20 bp, Artificial
  CRISPR gRNA sequence
ctggaaaaccatgcttccta

SEQ ID NO: 173957 - DNA, 20 bp, Artificial
  CRISPR gRNA sequence
gaaaaccatgcttcctaaaa

SEQ ID NO: 173958 - DNA, 20 bp, Artificial
  CRISPR gRNA sequence
cctaaaagacttaggcttag

SEQ ID NO: 173959 - DNA, 20 bp, Artificial
  CRISPR gRNA sequence
ctaaaagacttaggcttaga

SEQ ID NO: 173960 - DNA, 20 bp, Artificial
  CRISPR gRNA sequence
aaagacttaggcttagaagt

SEQ ID NO: 173961 - DNA, 20 bp, Artificial
  CRISPR gRNA sequence
aggcttagaagtggctgcac

SEQ ID NO: 173962 - DNA, 20 bp, Artificial
  CRISPR gRNA sequence
ggcttagaagtggctgcaca

SEQ ID NO: 173963 - DNA, 20 bp, Artificial
  CRISPR gRNA sequence
agaagtggctgcacactgct

SEQ ID NO: 173964 - DNA, 20 bp, Artificial
  CRISPR gRNA sequence
gaagtggctgcacactgctc

SEQ ID NO: 173965 - DNA, 20 bp, Artificial
  CRISPR gRNA sequence
cacactgctctccttaaaga

SEQ ID NO: 173966 - DNA, 20 bp, Artificial
  CRISPR gRNA sequence
ctctccttaaagatctgtac

SEQ ID NO: 173967 - DNA, 20 bp, Artificial
  CRISPR gRNA sequence
tccttaaagatctgtacaca

SEQ ID NO: 173968 - DNA, 20 bp, Artificial
  CRISPR gRNA sequence
cttaaagatctgtacacaag

SEQ ID NO: 173969 - DNA, 20 bp, Artificial
  CRISPR gRNA sequence
aaagatctgtacacaaggac

SEQ ID NO: 173970 - DNA, 20 bp, Artificial
  CRISPR gRNA sequence
aagatctgtacacaaggaca

SEQ ID NO: 173971 - DNA, 20 bp, Artificial
  CRISPR gRNA sequence
tacacaaggacacattttca

SEQ ID NO: 173972 - DNA, 20 bp, Artificial
  CRISPR gRNA sequence
tcaaactggcagaagagcca

SEQ ID NO: 173973 - DNA, 20 bp, Artificial
  CRISPR gRNA sequence
caaactggcagaagagccac

SEQ ID NO: 173974 - DNA, 20 bp, Artificial
  CRISPR gRNA sequence
aaactggcagaagagccact

SEQ ID NO: 173975 - DNA, 20 bp, Artificial
  CRISPR gRNA sequence
gcagaagagccacttttcct

SEQ ID NO: 173976 - DNA, 20 bp, Artificial
  CRISPR gRNA sequence
ttccttcaaaaacaaaaata

SEQ ID NO: 173977 - DNA, 20 bp, Artificial
  CRISPR gRNA sequence
tccttcaaaaacaaaaatac

SEQ ID NO: 173978 - DNA, 20 bp, Artificial
  CRISPR gRNA sequence
ccttcaaaaacaaaaatact

SEQ ID NO: 173979 - DNA, 20 bp, Artificial
  CRISPR gRNA sequence
cttcaaaaacaaaaatactt

SEQ ID NO: 173980 - DNA, 20 bp, Artificial
  CRISPR gRNA sequence
caaaaacaaaaatacttttc

SEQ ID NO: 173981 - DNA, 20 bp, Artificial
  CRISPR gRNA sequence
aaaaacaaaaatacttttct

SEQ ID NO: 173982 - DNA, 20 bp, Artificial
  CRISPR gRNA sequence
ttctatttggtatctagtac

SEQ ID NO: 173983 - DNA, 20 bp, Artificial
  CRISPR gRNA sequence
tctatttggtatctagtaca

SEQ ID NO: 173984 - DNA, 20 bp, Artificial
  CRISPR gRNA sequence
ctatttggtatctagtacaa

SEQ ID NO: 173985 - DNA, 20 bp, Artificial
  CRISPR gRNA sequence
tatttggtatctagtacaat

SEQ ID NO: 173986 - DNA, 20 bp, Artificial
  CRISPR gRNA sequence
tttggtatctagtacaatat

SEQ ID NO: 173987 - DNA, 20 bp, Artificial
  CRISPR gRNA sequence
ggtatctagtacaatataat

SEQ ID NO: 173988 - DNA, 20 bp, Artificial
  CRISPR gRNA sequence
gtatctagtacaatataatc

SEQ ID NO: 173989 - DNA, 20 bp, Artificial
  CRISPR gRNA sequence
gtacaatataatctttgaaa

SEQ ID NO: 173990 - DNA, 20 bp, Artificial
  CRISPR gRNA sequence
tgaaacaggggccagatcat

SEQ ID NO: 173991 - DNA, 20 bp, Artificial
  CRISPR gRNA sequence
gaaacaggggccagatcata

SEQ ID NO: 173992 - DNA, 20 bp, Artificial
  CRISPR gRNA sequence
aaacaggggccagatcataa

SEQ ID NO: 173993 - DNA, 20 bp, Artificial
  CRISPR gRNA sequence
tagcacaactagagaaaaat

SEQ ID NO: 173994 - DNA, 20 bp, Artificial
  CRISPR gRNA sequence
gagaaaaatgaaggcacagc

SEQ ID NO: 173995 - DNA, 20 bp, Artificial
  CRISPR gRNA sequence
gtataaacaatgaaagtgac

SEQ ID NO: 173996 - DNA, 20 bp, Artificial
  CRISPR gRNA sequence
gaaaacttttttctgtggaa

SEQ ID NO: 173997 - DNA, 20 bp, Artificial
  CRISPR gRNA sequence
aaaacttttttctgtggaat

SEQ ID NO: 173998 - DNA, 20 bp, Artificial
  CRISPR gRNA sequence
ttttctgtggaatagaaaac

SEQ ID NO: 173999 - DNA, 20 bp, Artificial
  CRISPR gRNA sequence
tttctgtggaatagaaaacg

SEQ ID NO: 174000 - DNA, 20 bp, Artificial
  CRISPR gRNA sequence
ttctgtggaatagaaaacga

SEQ ID NO: 174001 - DNA, 20 bp, Artificial
  CRISPR gRNA sequence
tctgtggaatagaaaacgat

SEQ ID NO: 174002 - DNA, 20 bp, Artificial
  CRISPR gRNA sequence
ctgtggaatagaaaacgata

SEQ ID NO: 174003 - DNA, 20 bp, Artificial
  CRISPR gRNA sequence
tgtggaatagaaaacgatat

SEQ ID NO: 174004 - DNA, 20 bp, Artificial
  CRISPR gRNA sequence
tggaatagaaaacgatatgt

SEQ ID NO: 174005 - DNA, 20 bp, Artificial
  CRISPR gRNA sequence
acttcacacacattcttact

SEQ ID NO: 174006 - DNA, 20 bp, Artificial
  CRISPR gRNA sequence
cttcacacacattcttactc

SEQ ID NO: 174007 - DNA, 20 bp, Artificial
  CRISPR gRNA sequence
cacacacattcttactcatc

SEQ ID NO: 174008 - DNA, 20 bp, Artificial
  CRISPR gRNA sequence
acacacattcttactcatcc

SEQ ID NO: 174009 - DNA, 20 bp, Artificial
  CRISPR gRNA sequence
ttactcatcctttcaatgct

SEQ ID NO: 174010 - DNA, 20 bp, Artificial
  CRISPR gRNA sequence
actcatcctttcaatgctca

SEQ ID NO: 174011 - DNA, 20 bp, Artificial
  CRISPR gRNA sequence
ctcatcctttcaatgctcaa

SEQ ID NO: 174012 - DNA, 20 bp, Artificial
  CRISPR gRNA sequence
atcctttcaatgctcaaact

SEQ ID NO: 174013 - DNA, 20 bp, Artificial
  CRISPR gRNA sequence
tcaatgctcaaacttaaacc

SEQ ID NO: 174014 - DNA, 20 bp, Artificial
  CRISPR gRNA sequence
caatgctcaaacttaaacca

SEQ ID NO: 174015 - DNA, 20 bp, Artificial
  CRISPR gRNA sequence
aatgctcaaacttaaaccat

SEQ ID NO: 174016 - DNA, 20 bp, Artificial
  CRISPR gRNA sequence
aaacttaaaccatctctgca

SEQ ID NO: 174017 - DNA, 20 bp, Artificial
  CRISPR gRNA sequence
aaaccatctctgcatatata

SEQ ID NO: 174018 - DNA, 20 bp, Artificial
  CRISPR gRNA sequence
aaccatctctgcatatataa

SEQ ID NO: 174019 - DNA, 20 bp, Artificial
  CRISPR gRNA sequence
tgcatatataacagcaataa

SEQ ID NO: 174020 - DNA, 20 bp, Artificial
  CRISPR gRNA sequence
catatataacagcaataaaa

SEQ ID NO: 174021 - DNA, 20 bp, Artificial
  CRISPR gRNA sequence
tcagtattttgtatgatgaa

SEQ ID NO: 174022 - DNA, 20 bp, Artificial
  CRISPR gRNA sequence
tgtatgatgaagaaaaagga

SEQ ID NO: 174023 - DNA, 20 bp, Artificial
  CRISPR gRNA sequence
gtatgatgaagaaaaaggat

SEQ ID NO: 174024 - DNA, 20 bp, Artificial
  CRISPR gRNA sequence
tatgatgaagaaaaaggatc

SEQ ID NO: 174025 - DNA, 20 bp, Artificial
  CRISPR gRNA sequence
agtgaagtattctaaagcaa

SEQ ID NO: 174026 - DNA, 20 bp, Artificial
  CRISPR gRNA sequence
gtgaagtattctaaagcaag

SEQ ID NO: 174027 - DNA, 20 bp, Artificial
  CRISPR gRNA sequence
taaagcaagggtctaaaaac

SEQ ID NO: 174028 - DNA, 20 bp, Artificial
  CRISPR gRNA sequence
aagcaagggtctaaaaacta

SEQ ID NO: 174029 - DNA, 20 bp, Artificial
  CRISPR gRNA sequence
aaaactacagctcataggcc

SEQ ID NO: 174030 - DNA, 20 bp, Artificial
  CRISPR gRNA sequence
cagctcataggccacatctg

SEQ ID NO: 174031 - DNA, 20 bp, Artificial
  CRISPR gRNA sequence
ataggccacatctggcctac

SEQ ID NO: 174032 - DNA, 20 bp, Artificial
  CRISPR gRNA sequence
gcctacagcctgtttttaga

SEQ ID NO: 174033 - DNA, 20 bp, Artificial
  CRISPR gRNA sequence
cagcctgtttttagaaacag

SEQ ID NO: 174034 - DNA, 20 bp, Artificial
  CRISPR gRNA sequence
tttttagaaacagtttcact

SEQ ID NO: 174035 - DNA, 20 bp, Artificial
  CRISPR gRNA sequence
ttagaaacagtttcactgga

SEQ ID NO: 174036 - DNA, 20 bp, Artificial
  CRISPR gRNA sequence
tagaaacagtttcactggaa

SEQ ID NO: 174037 - DNA, 20 bp, Artificial
  CRISPR gRNA sequence
agaaacagtttcactggaag

SEQ ID NO: 174038 - DNA, 20 bp, Artificial
  CRISPR gRNA sequence
gaaacagtttcactggaaga

SEQ ID NO: 174039 - DNA, 20 bp, Artificial
  CRISPR gRNA sequence
cactggaagacatcaaccct

SEQ ID NO: 174040 - DNA, 20 bp, Artificial
  CRISPR gRNA sequence
actggaagacatcaacccta

SEQ ID NO: 174041 - DNA, 20 bp, Artificial
  CRISPR gRNA sequence
gaagacatcaaccctaatta

SEQ ID NO: 174042 - DNA, 20 bp, Artificial
  CRISPR gRNA sequence
attatttatttatttattca

SEQ ID NO: 174043 - DNA, 20 bp, Artificial
  CRISPR gRNA sequence
tttatttatttattcattta

SEQ ID NO: 174044 - DNA, 20 bp, Artificial
  CRISPR gRNA sequence
atttatttattcatttactt

SEQ ID NO: 174045 - DNA, 20 bp, Artificial
  CRISPR gRNA sequence
tttatttattcatttacttt

SEQ ID NO: 174046 - DNA, 20 bp, Artificial
  CRISPR gRNA sequence
atttattcatttacttttag

SEQ ID NO: 174047 - DNA, 20 bp, Artificial
  CRISPR gRNA sequence
tttattcatttacttttaga

SEQ ID NO: 174048 - DNA, 20 bp, Artificial
  CRISPR gRNA sequence
attcatttacttttagacgg

SEQ ID NO: 174049 - DNA, 20 bp, Artificial
  CRISPR gRNA sequence
ttcatttacttttagacgga

SEQ ID NO: 174050 - DNA, 20 bp, Artificial
  CRISPR gRNA sequence
atttacttttagacggagcc

SEQ ID NO: 174051 - DNA, 20 bp, Artificial
  CRISPR gRNA sequence
acttttagacggagcctcag

SEQ ID NO: 174052 - DNA, 20 bp, Artificial
  CRISPR gRNA sequence
cttttagacggagcctcagt

SEQ ID NO: 174053 - DNA, 20 bp, Artificial
  CRISPR gRNA sequence
ttagacggagcctcagtctg

SEQ ID NO: 174054 - DNA, 20 bp, Artificial
  CRISPR gRNA sequence
tagacggagcctcagtctgt

SEQ ID NO: 174055 - DNA, 20 bp, Artificial
  CRISPR gRNA sequence
agacggagcctcagtctgtc

SEQ ID NO: 174056 - DNA, 20 bp, Artificial
  CRISPR gRNA sequence
gacggagcctcagtctgtca

SEQ ID NO: 174057 - DNA, 20 bp, Artificial
  CRISPR gRNA sequence
agtctgtcatccaggctgga

SEQ ID NO: 174058 - DNA, 20 bp, Artificial
  CRISPR gRNA sequence
tcatccaggctggagtacaa

SEQ ID NO: 174059 - DNA, 20 bp, Artificial
  CRISPR gRNA sequence
gagtacaatggcacgatctc

SEQ ID NO: 174060 - DNA, 20 bp, Artificial
  CRISPR gRNA sequence
ggctcactgcaacctccacc

SEQ ID NO: 174061 - DNA, 20 bp, Artificial
  CRISPR gRNA sequence
actgcaacctccacctcccg

SEQ ID NO: 174062 - DNA, 20 bp, Artificial
  CRISPR gRNA sequence
caacctccacctcccgggtt

SEQ ID NO: 174063 - DNA, 20 bp, Artificial
  CRISPR gRNA sequence
cacctcccgggttcaagcga

SEQ ID NO: 174064 - DNA, 20 bp, Artificial
  CRISPR gRNA sequence
ccgggttcaagcgattctcc

SEQ ID NO: 174065 - DNA, 20 bp, Artificial
  CRISPR gRNA sequence
aagcgattctcccacctcag

SEQ ID NO: 174066 - DNA, 20 bp, Artificial
  CRISPR gRNA sequence
tcccacctcagcctcccaag

SEQ ID NO: 174067 - DNA, 20 bp, Artificial
  CRISPR gRNA sequence
ccacctcagcctcccaagca

SEQ ID NO: 174068 - DNA, 20 bp, Artificial
  CRISPR gRNA sequence
agcctcccaagcagctggga

SEQ ID NO: 174069 - DNA, 20 bp, Artificial
  CRISPR gRNA sequence
ccaagcagctgggattatag

SEQ ID NO: 174070 - DNA, 20 bp, Artificial
  CRISPR gRNA sequence
ggattataggcacccgccat

SEQ ID NO: 174071 - DNA, 20 bp, Artificial
  CRISPR gRNA sequence
taggcacccgccatcacacc

SEQ ID NO: 174072 - DNA, 20 bp, Artificial
  CRISPR gRNA sequence
atttttgtatttttgaagag

SEQ ID NO: 174073 - DNA, 20 bp, Artificial
  CRISPR gRNA sequence
ttgtatttttgaagagacgg

SEQ ID NO: 174074 - DNA, 20 bp, Artificial
  CRISPR gRNA sequence
tgtatttttgaagagacggg

SEQ ID NO: 174075 - DNA, 20 bp, Artificial
  CRISPR gRNA sequence
gtatttttgaagagacgggt

SEQ ID NO: 174076 - DNA, 20 bp, Artificial
  CRISPR gRNA sequence
tatttttgaagagacgggtt

SEQ ID NO: 174077 - DNA, 20 bp, Artificial
  CRISPR gRNA sequence
ttgaagagacgggtttcacc

SEQ ID NO: 174078 - DNA, 20 bp, Artificial
  CRISPR gRNA sequence
tgaagagacgggtttcacca

SEQ ID NO: 174079 - DNA, 20 bp, Artificial
  CRISPR gRNA sequence
gaagagacgggtttcaccat

SEQ ID NO: 174080 - DNA, 20 bp, Artificial
  CRISPR gRNA sequence
aagagacgggtttcaccatg

SEQ ID NO: 174081 - DNA, 20 bp, Artificial
  CRISPR gRNA sequence
caccatgttgaccaggttgg

SEQ ID NO: 174082 - DNA, 20 bp, Artificial
  CRISPR gRNA sequence
accatgttgaccaggttggt

SEQ ID NO: 174083 - DNA, 20 bp, Artificial
  CRISPR gRNA sequence
accaggttggtcttgaactc

SEQ ID NO: 174084 - DNA, 20 bp, Artificial
  CRISPR gRNA sequence
gtcttgaactcctgacctta

SEQ ID NO: 174085 - DNA, 20 bp, Artificial
  CRISPR gRNA sequence
gaactcctgaccttaagtga

SEQ ID NO: 174086 - DNA, 20 bp, Artificial
  CRISPR gRNA sequence
aactcctgaccttaagtgat

SEQ ID NO: 174087 - DNA, 20 bp, Artificial
  CRISPR gRNA sequence
ctgaccttaagtgatctgcc

SEQ ID NO: 174088 - DNA, 20 bp, Artificial
  CRISPR gRNA sequence
accttaagtgatctgcccac

SEQ ID NO: 174089 - DNA, 20 bp, Artificial
  CRISPR gRNA sequence
aagtgatctgcccacctcgg

SEQ ID NO: 174090 - DNA, 20 bp, Artificial
  CRISPR gRNA sequence
agtgatctgcccacctcggc

SEQ ID NO: 174091 - DNA, 20 bp, Artificial
  CRISPR gRNA sequence
cccacctcggcctcccaaaa

SEQ ID NO: 174092 - DNA, 20 bp, Artificial
  CRISPR gRNA sequence
ggcctcccaaaacgctggga

SEQ ID NO: 174093 - DNA, 20 bp, Artificial
  CRISPR gRNA sequence
ccaaaacgctgggattacag

SEQ ID NO: 174094 - DNA, 20 bp, Artificial
  CRISPR gRNA sequence
ggattacaggcgtgagccac

SEQ ID NO: 174095 - DNA, 20 bp, Artificial
  CRISPR gRNA sequence
caggcgtgagccaccatgtc

SEQ ID NO: 174096 - DNA, 20 bp, Artificial
  CRISPR gRNA sequence
attagtttatattgtctgtt

SEQ ID NO: 174097 - DNA, 20 bp, Artificial
  CRISPR gRNA sequence
gtttatattgtctgttcatg

SEQ ID NO: 174098 - DNA, 20 bp, Artificial
  CRISPR gRNA sequence
atattgtctgttcatgctaa

SEQ ID NO: 174099 - DNA, 20 bp, Artificial
  CRISPR gRNA sequence
tattgtctgttcatgctaaa

SEQ ID NO: 174100 - DNA, 20 bp, Artificial
  CRISPR gRNA sequence
tctgttcatgctaaacagta

SEQ ID NO: 174101 - DNA, 20 bp, Artificial
  CRISPR gRNA sequence
ttcatgctaaacagtagagt

SEQ ID NO: 174102 - DNA, 20 bp, Artificial
  CRISPR gRNA sequence
atgctaaacagtagagttga

SEQ ID NO: 174103 - DNA, 20 bp, Artificial
  CRISPR gRNA sequence
aacagtagagttgaagagtt

SEQ ID NO: 174104 - DNA, 20 bp, Artificial
  CRISPR gRNA sequence
aagagttacaacaaaaatca

SEQ ID NO: 174105 - DNA, 20 bp, Artificial
  CRISPR gRNA sequence
caacaaaaatcatacagcca

SEQ ID NO: 174106 - DNA, 20 bp, Artificial
  CRISPR gRNA sequence
aaatatctggccctttaagg

SEQ ID NO: 174107 - DNA, 20 bp, Artificial
  CRISPR gRNA sequence
gccctttaaggaaaaaggtt

SEQ ID NO: 174108 - DNA, 20 bp, Artificial
  CRISPR gRNA sequence
taaggaaaaaggttcagcca

SEQ ID NO: 174109 - DNA, 20 bp, Artificial
  CRISPR gRNA sequence
aaggaaaaaggttcagccag

SEQ ID NO: 174110 - DNA, 20 bp, Artificial
  CRISPR gRNA sequence
aggaaaaaggttcagccagg

SEQ ID NO: 174111 - DNA, 20 bp, Artificial
  CRISPR gRNA sequence
agccaggcatggtagctcat

SEQ ID NO: 174112 - DNA, 20 bp, Artificial
  CRISPR gRNA sequence
atgcctctaatcctagcact

SEQ ID NO: 174113 - DNA, 20 bp, Artificial
  CRISPR gRNA sequence
taatcctagcactctgggag

SEQ ID NO: 174114 - DNA, 20 bp, Artificial
  CRISPR gRNA sequence
atcctagcactctgggaggc

SEQ ID NO: 174115 - DNA, 20 bp, Artificial
  CRISPR gRNA sequence
gcactctgggaggccaaggc

SEQ ID NO: 174116 - DNA, 20 bp, Artificial
  CRISPR gRNA sequence
tgggaggccaaggcgggagg

SEQ ID NO: 174117 - DNA, 20 bp, Artificial
  CRISPR gRNA sequence
ggaggccaaggcgggaggat

SEQ ID NO: 174118 - DNA, 20 bp, Artificial
  CRISPR gRNA sequence
gaacccaagagctcgagatc

SEQ ID NO: 174119 - DNA, 20 bp, Artificial
  CRISPR gRNA sequence
aacccaagagctcgagatca

SEQ ID NO: 174120 - DNA, 20 bp, Artificial
  CRISPR gRNA sequence
gagatcagcctgggcaacat

SEQ ID NO: 174121 - DNA, 20 bp, Artificial
  CRISPR gRNA sequence
ggcaacatagtgagaccccc

SEQ ID NO: 174122 - DNA, 20 bp, Artificial
  CRISPR gRNA sequence
aatagaaaataaaaaataaa

SEQ ID NO: 174123 - DNA, 20 bp, Artificial
  CRISPR gRNA sequence
gccaggtgtagtggcccaca

SEQ ID NO: 174124 - DNA, 20 bp, Artificial
  CRISPR gRNA sequence
tagtcccagctactcacgag

SEQ ID NO: 174125 - DNA, 20 bp, Artificial
  CRISPR gRNA sequence
ctcacgaggctgaggcggga

SEQ ID NO: 174126 - DNA, 20 bp, Artificial
  CRISPR gRNA sequence
acgaggctgaggcgggagga

SEQ ID NO: 174127 - DNA, 20 bp, Artificial
  CRISPR gRNA sequence
aggcgggaggactgcttgag

SEQ ID NO: 174128 - DNA, 20 bp, Artificial
  CRISPR gRNA sequence
cttgagcctgggtggtcaag

SEQ ID NO: 174129 - DNA, 20 bp, Artificial
  CRISPR gRNA sequence
gagcctgggtggtcaagcct

SEQ ID NO: 174130 - DNA, 20 bp, Artificial
  CRISPR gRNA sequence
agcctgggtggtcaagcctg

SEQ ID NO: 174131 - DNA, 20 bp, Artificial
  CRISPR gRNA sequence
ggtggtcaagcctgcagtga

SEQ ID NO: 174132 - DNA, 20 bp, Artificial
  CRISPR gRNA sequence
cagtgagccatgattgcgcc

SEQ ID NO: 174133 - DNA, 20 bp, Artificial
  CRISPR gRNA sequence
cgccactgcactccagcctg

SEQ ID NO: 174134 - DNA, 20 bp, Artificial
  CRISPR gRNA sequence
cactccagcctgagcaggaa

SEQ ID NO: 174135 - DNA, 20 bp, Artificial
  CRISPR gRNA sequence
cagcctgagcaggaacagca

SEQ ID NO: 174136 - DNA, 20 bp, Artificial
  CRISPR gRNA sequence
agcaggaacagcagagcaag

SEQ ID NO: 174137 - DNA, 20 bp, Artificial
  CRISPR gRNA sequence
tctcaaaaaaaaaagaaaag

SEQ ID NO: 174138 - DNA, 20 bp, Artificial
  CRISPR gRNA sequence
aaaaaaaaaagaaaagaaaa

SEQ ID NO: 174139 - DNA, 20 bp, Artificial
  CRISPR gRNA sequence
cagataatattctgatcttg

SEQ ID NO: 174140 - DNA, 20 bp, Artificial
  CRISPR gRNA sequence
agataatattctgatcttgt

SEQ ID NO: 174141 - DNA, 20 bp, Artificial
  CRISPR gRNA sequence
tgatcttgttttaaagcact

SEQ ID NO: 174142 - DNA, 20 bp, Artificial
  CRISPR gRNA sequence
atcttgttttaaagcactgt

SEQ ID NO: 174143 - DNA, 20 bp, Artificial
  CRISPR gRNA sequence
gttttaaagcactgttaggt

SEQ ID NO: 174144 - DNA, 20 bp, Artificial
  CRISPR gRNA sequence
ttttaaagcactgttaggtg

SEQ ID NO: 174145 - DNA, 20 bp, Artificial
  CRISPR gRNA sequence
taaagcactgttaggtgttt

SEQ ID NO: 174146 - DNA, 20 bp, Artificial
  CRISPR gRNA sequence
aaagcactgttaggtgtttt

SEQ ID NO: 174147 - DNA, 20 bp, Artificial
  CRISPR gRNA sequence
aagcactgttaggtgtttta

SEQ ID NO: 174148 - DNA, 20 bp, Artificial
  CRISPR gRNA sequence
ttaggtgttttatttatccc

SEQ ID NO: 174149 - DNA, 20 bp, Artificial
  CRISPR gRNA sequence
ggtgttttatttatccctga

SEQ ID NO: 174150 - DNA, 20 bp, Artificial
  CRISPR gRNA sequence
tatttatccctgatttactg

SEQ ID NO: 174151 - DNA, 20 bp, Artificial
  CRISPR gRNA sequence
atttatccctgatttactga

SEQ ID NO: 174152 - DNA, 20 bp, Artificial
  CRISPR gRNA sequence
tttatccctgatttactgat

SEQ ID NO: 174153 - DNA, 20 bp, Artificial
  CRISPR gRNA sequence
atccctgatttactgatggg

SEQ ID NO: 174154 - DNA, 20 bp, Artificial
  CRISPR gRNA sequence
tccctgatttactgatgggg

SEQ ID NO: 174155 - DNA, 20 bp, Artificial
  CRISPR gRNA sequence
atttactgatggggaaactg

SEQ ID NO: 174156 - DNA, 20 bp, Artificial
  CRISPR gRNA sequence
actgatggggaaactgacac

SEQ ID NO: 174157 - DNA, 20 bp, Artificial
  CRISPR gRNA sequence
ctgatggggaaactgacact

SEQ ID NO: 174158 - DNA, 20 bp, Artificial
  CRISPR gRNA sequence
atggggaaactgacactaga

SEQ ID NO: 174159 - DNA, 20 bp, Artificial
  CRISPR gRNA sequence
acactagaagttgagaagct

SEQ ID NO: 174160 - DNA, 20 bp, Artificial
  CRISPR gRNA sequence
gaagttgagaagctggtcct

SEQ ID NO: 174161 - DNA, 20 bp, Artificial
  CRISPR gRNA sequence
agaagctggtcctagatcac

SEQ ID NO: 174162 - DNA, 20 bp, Artificial
  CRISPR gRNA sequence
gtcctagatcacacaactgt

SEQ ID NO: 174163 - DNA, 20 bp, Artificial
  CRISPR gRNA sequence
gatcacacaactgttactta

SEQ ID NO: 174164 - DNA, 20 bp, Artificial
  CRISPR gRNA sequence
ttacttagctcccctgcctc

SEQ ID NO: 174165 - DNA, 20 bp, Artificial
  CRISPR gRNA sequence
cttagctcccctgcctccct

SEQ ID NO: 174166 - DNA, 20 bp, Artificial
  CRISPR gRNA sequence
agctcccctgcctccctcac

SEQ ID NO: 174167 - DNA, 20 bp, Artificial
  CRISPR gRNA sequence
gctcccctgcctccctcacc

SEQ ID NO: 174168 - DNA, 20 bp, Artificial
  CRISPR gRNA sequence
ccctgcctccctcacctgtt

SEQ ID NO: 174169 - DNA, 20 bp, Artificial
  CRISPR gRNA sequence
cctccctcacctgttcatcc

SEQ ID NO: 174170 - DNA, 20 bp, Artificial
  CRISPR gRNA sequence
cctcacctgttcatcctcaa

SEQ ID NO: 174171 - DNA, 20 bp, Artificial
  CRISPR gRNA sequence
acctgttcatcctcaattag

SEQ ID NO: 174172 - DNA, 20 bp, Artificial
  CRISPR gRNA sequence
ttcatcctcaattagaagta

SEQ ID NO: 174173 - DNA, 20 bp, Artificial
  CRISPR gRNA sequence
atcctcaattagaagtaagc

SEQ ID NO: 174174 - DNA, 20 bp, Artificial
  CRISPR gRNA sequence
aattagaagtaagctgggcc

SEQ ID NO: 174175 - DNA, 20 bp, Artificial
  CRISPR gRNA sequence
gaagtaagctgggccagacc

SEQ ID NO: 174176 - DNA, 20 bp, Artificial
  CRISPR gRNA sequence
ggccagaccccctctgcccc

SEQ ID NO: 174177 - DNA, 20 bp, Artificial
  CRISPR gRNA sequence
tgccccacagaagtatctgt

SEQ ID NO: 174178 - DNA, 20 bp, Artificial
  CRISPR gRNA sequence
ccccacagaagtatctgtta

SEQ ID NO: 174179 - DNA, 20 bp, Artificial
  CRISPR gRNA sequence
ttagtctctctgaccctcca

SEQ ID NO: 174180 - DNA, 20 bp, Artificial
  CRISPR gRNA sequence
gtctctctgaccctccagcc

SEQ ID NO: 174181 - DNA, 20 bp, Artificial
  CRISPR gRNA sequence
tctgaccctccagcctaacg

SEQ ID NO: 174182 - DNA, 20 bp, Artificial
  CRISPR gRNA sequence
tgaccctccagcctaacgag

SEQ ID NO: 174183 - DNA, 20 bp, Artificial
  CRISPR gRNA sequence
accctccagcctaacgagta

SEQ ID NO: 174184 - DNA, 20 bp, Artificial
  CRISPR gRNA sequence
cagcctaacgagtaaataaa

SEQ ID NO: 174185 - DNA, 20 bp, Artificial
  CRISPR gRNA sequence
acgagtaaataaatccttgt

SEQ ID NO: 174186 - DNA, 20 bp, Artificial
  CRISPR gRNA sequence
gtaggaagaatggtgagtaa

SEQ ID NO: 174187 - DNA, 20 bp, Artificial
  CRISPR gRNA sequence
taggaagaatggtgagtaac

SEQ ID NO: 174188 - DNA, 20 bp, Artificial
  CRISPR gRNA sequence
gtttttcaggcctcaatccc

SEQ ID NO: 174189 - DNA, 20 bp, Artificial
  CRISPR gRNA sequence
ttcaggcctcaatcccgaaa

SEQ ID NO: 174190 - DNA, 20 bp, Artificial
  CRISPR gRNA sequence
tcaggcctcaatcccgaaaa

SEQ ID NO: 174191 - DNA, 20 bp, Artificial
  CRISPR gRNA sequence
caggcctcaatcccgaaaag

SEQ ID NO: 174192 - DNA, 20 bp, Artificial
  CRISPR gRNA sequence
aggcctcaatcccgaaaagg

SEQ ID NO: 174193 - DNA, 20 bp, Artificial
  CRISPR gRNA sequence
aatcccgaaaaggaattgtg

SEQ ID NO: 174194 - DNA, 20 bp, Artificial
  CRISPR gRNA sequence
tgacatgagctagagacaga

SEQ ID NO: 174195 - DNA, 20 bp, Artificial
  CRISPR gRNA sequence
gagacagaaagagtgcctgt

SEQ ID NO: 174196 - DNA, 20 bp, Artificial
  CRISPR gRNA sequence
tagcctaagttaagttgtat

SEQ ID NO: 174197 - DNA, 20 bp, Artificial
  CRISPR gRNA sequence
agttaagttgtattctaaaa

SEQ ID NO: 174198 - DNA, 20 bp, Artificial
  CRISPR gRNA sequence
agttgtattctaaaacaaag

SEQ ID NO: 174199 - DNA, 20 bp, Artificial
  CRISPR gRNA sequence
tattctaaaacaaagcatca

SEQ ID NO: 174200 - DNA, 20 bp, Artificial
  CRISPR gRNA sequence
taaaacaaagcatcattttc

SEQ ID NO: 174201 - DNA, 20 bp, Artificial
  CRISPR gRNA sequence
aaacaaagcatcattttctt

SEQ ID NO: 174202 - DNA, 20 bp, Artificial
  CRISPR gRNA sequence
tcttaccgggtgccttctga

SEQ ID NO: 174203 - DNA, 20 bp, Artificial
  CRISPR gRNA sequence
cttaccgggtgccttctgag

SEQ ID NO: 174204 - DNA, 20 bp, Artificial
  CRISPR gRNA sequence
ttaccgggtgccttctgaga

SEQ ID NO: 174205 - DNA, 20 bp, Artificial
  CRISPR gRNA sequence
accgggtgccttctgagatt

SEQ ID NO: 174206 - DNA, 20 bp, Artificial
  CRISPR gRNA sequence
ccgggtgccttctgagattc

SEQ ID NO: 174207 - DNA, 20 bp, Artificial
  CRISPR gRNA sequence
ctgagattcacaaacagcct

SEQ ID NO: 174208 - DNA, 20 bp, Artificial
  CRISPR gRNA sequence
tgagattcacaaacagcctc

SEQ ID NO: 174209 - DNA, 20 bp, Artificial
  CRISPR gRNA sequence
agattcacaaacagcctctt

SEQ ID NO: 174210 - DNA, 20 bp, Artificial
  CRISPR gRNA sequence
acaaacagcctcttgcccag

SEQ ID NO: 174211 - DNA, 20 bp, Artificial
  CRISPR gRNA sequence
ttgcccagtttctggcagta

SEQ ID NO: 174212 - DNA, 20 bp, Artificial
  CRISPR gRNA sequence
gcccagtttctggcagtatc

SEQ ID NO: 174213 - DNA, 20 bp, Artificial
  CRISPR gRNA sequence
cccagtttctggcagtatcc

SEQ ID NO: 174214 - DNA, 20 bp, Artificial
  CRISPR gRNA sequence
ctggcagtatcctgtgtttg

SEQ ID NO: 174215 - DNA, 20 bp, Artificial
  CRISPR gRNA sequence
tggcagtatcctgtgtttgt

SEQ ID NO: 174216 - DNA, 20 bp, Artificial
  CRISPR gRNA sequence
gcagtatcctgtgtttgtgt

SEQ ID NO: 174217 - DNA, 20 bp, Artificial
  CRISPR gRNA sequence
tgtttgtgtgtctagcagag

SEQ ID NO: 174218 - DNA, 20 bp, Artificial
  CRISPR gRNA sequence
gtgtgtctagcagagggaag

SEQ ID NO: 174219 - DNA, 20 bp, Artificial
  CRISPR gRNA sequence
tgtgtctagcagagggaaga

SEQ ID NO: 174220 - DNA, 20 bp, Artificial
  CRISPR gRNA sequence
gcagagggaagaagtgtgat

SEQ ID NO: 174221 - DNA, 20 bp, Artificial
  CRISPR gRNA sequence
tgaagaatgtttcatagatg

SEQ ID NO: 174222 - DNA, 20 bp, Artificial
  CRISPR gRNA sequence
aagaatgtttcatagatgcc

SEQ ID NO: 174223 - DNA, 20 bp, Artificial
  CRISPR gRNA sequence
catagatgccaacttacggg

SEQ ID NO: 174224 - DNA, 20 bp, Artificial
  CRISPR gRNA sequence
atagatgccaacttacgggc

SEQ ID NO: 174225 - DNA, 20 bp, Artificial
  CRISPR gRNA sequence
acgggcttcagagttcataa

SEQ ID NO: 174226 - DNA, 20 bp, Artificial
  CRISPR gRNA sequence
cgggcttcagagttcataaa

SEQ ID NO: 174227 - DNA, 20 bp, Artificial
  CRISPR gRNA sequence
cagagttcataaaatacatg

SEQ ID NO: 174228 - DNA, 20 bp, Artificial
  CRISPR gRNA sequence
agagttcataaaatacatgc

SEQ ID NO: 174229 - DNA, 20 bp, Artificial
  CRISPR gRNA sequence
ataaaatacatgccacatac

SEQ ID NO: 174230 - DNA, 20 bp, Artificial
  CRISPR gRNA sequence
aattgacccttacttagctc

SEQ ID NO: 174231 - DNA, 20 bp, Artificial
  CRISPR gRNA sequence
acccttacttagctcagtga

SEQ ID NO: 174232 - DNA, 20 bp, Artificial
  CRISPR gRNA sequence
acttagctcagtgataaatt

SEQ ID NO: 174233 - DNA, 20 bp, Artificial
  CRISPR gRNA sequence
cttagctcagtgataaattt

SEQ ID NO: 174234 - DNA, 20 bp, Artificial
  CRISPR gRNA sequence
agctcagtgataaatttacc

SEQ ID NO: 174235 - DNA, 20 bp, Artificial
  CRISPR gRNA sequence
gctcagtgataaatttacca

SEQ ID NO: 174236 - DNA, 20 bp, Artificial
  CRISPR gRNA sequence
agtgataaatttaccaatat

SEQ ID NO: 174237 - DNA, 20 bp, Artificial
  CRISPR gRNA sequence
accaatattattccaatttt

SEQ ID NO: 174238 - DNA, 20 bp, Artificial
  CRISPR gRNA sequence
ccaatattattccaatttta

SEQ ID NO: 174239 - DNA, 20 bp, Artificial
  CRISPR gRNA sequence
ttccaattttacagataagg

SEQ ID NO: 174240 - DNA, 20 bp, Artificial
  CRISPR gRNA sequence
caattttacagataaggttg

SEQ ID NO: 174241 - DNA, 20 bp, Artificial
  CRISPR gRNA sequence
tacagataaggttgagggtt

SEQ ID NO: 174242 - DNA, 20 bp, Artificial
  CRISPR gRNA sequence
acagataaggttgagggttg

SEQ ID NO: 174243 - DNA, 20 bp, Artificial
  CRISPR gRNA sequence
cagataaggttgagggttga

SEQ ID NO: 174244 - DNA, 20 bp, Artificial
  CRISPR gRNA sequence
agggttgaatatcaaattac

SEQ ID NO: 174245 - DNA, 20 bp, Artificial
  CRISPR gRNA sequence
aatatcaaattacttgctca

SEQ ID NO: 174246 - DNA, 20 bp, Artificial
  CRISPR gRNA sequence
cttgctcaagatcacaatac

SEQ ID NO: 174247 - DNA, 20 bp, Artificial
  CRISPR gRNA sequence
gctcaagatcacaatacaat

SEQ ID NO: 174248 - DNA, 20 bp, Artificial
  CRISPR gRNA sequence
ctcaagatcacaatacaata

SEQ ID NO: 174249 - DNA, 20 bp, Artificial
  CRISPR gRNA sequence
aagatcacaatacaataaat

SEQ ID NO: 174250 - DNA, 20 bp, Artificial
  CRISPR gRNA sequence
taaaattctgtcttgattta

SEQ ID NO: 174251 - DNA, 20 bp, Artificial
  CRISPR gRNA sequence
aaattctgtcttgatttatt

SEQ ID NO: 174252 - DNA, 20 bp, Artificial
  CRISPR gRNA sequence
tgtcttgatttattataact

SEQ ID NO: 174253 - DNA, 20 bp, Artificial
  CRISPR gRNA sequence
tcttgatttattataacttg

SEQ ID NO: 174254 - DNA, 20 bp, Artificial
  CRISPR gRNA sequence
gatttattataacttgctct

SEQ ID NO: 174255 - DNA, 20 bp, Artificial
  CRISPR gRNA sequence
atttattataacttgctctt

SEQ ID NO: 174256 - DNA, 20 bp, Artificial
  CRISPR gRNA sequence
attataacttgctctttccc

SEQ ID NO: 174257 - DNA, 20 bp, Artificial
  CRISPR gRNA sequence
ttataacttgctctttccca

SEQ ID NO: 174258 - DNA, 20 bp, Artificial
  CRISPR gRNA sequence
taacttgctctttcccactt

SEQ ID NO: 174259 - DNA, 20 bp, Artificial
  CRISPR gRNA sequence
gctctttcccactttttgca

SEQ ID NO: 174260 - DNA, 20 bp, Artificial
  CRISPR gRNA sequence
ctctttcccactttttgcac

SEQ ID NO: 174261 - DNA, 20 bp, Artificial
  CRISPR gRNA sequence
tttcccactttttgcactgt

SEQ ID NO: 174262 - DNA, 20 bp, Artificial
  CRISPR gRNA sequence
tcccactttttgcactgttt

SEQ ID NO: 174263 - DNA, 20 bp, Artificial
  CRISPR gRNA sequence
cccactttttgcactgttta

SEQ ID NO: 174264 - DNA, 20 bp, Artificial
  CRISPR gRNA sequence
ccactttttgcactgtttaa

SEQ ID NO: 174265 - DNA, 20 bp, Artificial
  CRISPR gRNA sequence
tttgcactgtttaagctgtc

SEQ ID NO: 174266 - DNA, 20 bp, Artificial
  CRISPR gRNA sequence
ttgcactgtttaagctgtca

SEQ ID NO: 174267 - DNA, 20 bp, Artificial
  CRISPR gRNA sequence
tgcactgtttaagctgtcac

SEQ ID NO: 174268 - DNA, 20 bp, Artificial
  CRISPR gRNA sequence
gcactgtttaagctgtcact

SEQ ID NO: 174269 - DNA, 20 bp, Artificial
  CRISPR gRNA sequence
cactgtttaagctgtcactc

SEQ ID NO: 174270 - DNA, 20 bp, Artificial
  CRISPR gRNA sequence
tttaagctgtcactcttttt

SEQ ID NO: 174271 - DNA, 20 bp, Artificial
  CRISPR gRNA sequence
aagctgtcactcttttttct

SEQ ID NO: 174272 - DNA, 20 bp, Artificial
  CRISPR gRNA sequence
agctgtcactcttttttctt

SEQ ID NO: 174273 - DNA, 20 bp, Artificial
  CRISPR gRNA sequence
tcactcttttttcttttctg

SEQ ID NO: 174274 - DNA, 20 bp, Artificial
  CRISPR gRNA sequence
ttttttcttttctgttttat

SEQ ID NO: 174275 - DNA, 20 bp, Artificial
  CRISPR gRNA sequence
ttttcttttctgttttatcc

SEQ ID NO: 174276 - DNA, 20 bp, Artificial
  CRISPR gRNA sequence
tttcttttctgttttatcct

SEQ ID NO: 174277 - DNA, 20 bp, Artificial
  CRISPR gRNA sequence
ttcttttctgttttatcctt

SEQ ID NO: 174278 - DNA, 20 bp, Artificial
  CRISPR gRNA sequence
tcttttctgttttatccttc

SEQ ID NO: 174279 - DNA, 20 bp, Artificial
  CRISPR gRNA sequence
cttttctgttttatccttcc

SEQ ID NO: 174280 - DNA, 20 bp, Artificial
  CRISPR gRNA sequence
ttttctgttttatccttccc

SEQ ID NO: 174281 - DNA, 20 bp, Artificial
  CRISPR gRNA sequence
ttctgttttatccttcccct

SEQ ID NO: 174282 - DNA, 20 bp, Artificial
  CRISPR gRNA sequence
tctgttttatccttcccctt

SEQ ID NO: 174283 - DNA, 20 bp, Artificial
  CRISPR gRNA sequence
ctgttttatccttccccttt

SEQ ID NO: 174284 - DNA, 20 bp, Artificial
  CRISPR gRNA sequence
tgttttatccttcccctttg

SEQ ID NO: 174285 - DNA, 20 bp, Artificial
  CRISPR gRNA sequence
ttttatccttcccctttgca

SEQ ID NO: 174286 - DNA, 20 bp, Artificial
  CRISPR gRNA sequence
tatccttcccctttgcatgt

SEQ ID NO: 174287 - DNA, 20 bp, Artificial
  CRISPR gRNA sequence
atccttcccctttgcatgtc

SEQ ID NO: 174288 - DNA, 20 bp, Artificial
  CRISPR gRNA sequence
tccttcccctttgcatgtct

SEQ ID NO: 174289 - DNA, 20 bp, Artificial
  CRISPR gRNA sequence
cccctttgcatgtctctagg

SEQ ID NO: 174290 - DNA, 20 bp, Artificial
  CRISPR gRNA sequence
ccctttgcatgtctctaggc

SEQ ID NO: 174291 - DNA, 20 bp, Artificial
  CRISPR gRNA sequence
tgcatgtctctaggcaggtt

SEQ ID NO: 174292 - DNA, 20 bp, Artificial
  CRISPR gRNA sequence
gcatgtctctaggcaggtta

SEQ ID NO: 174293 - DNA, 20 bp, Artificial
  CRISPR gRNA sequence
catgtctctaggcaggttag

SEQ ID NO: 174294 - DNA, 20 bp, Artificial
  CRISPR gRNA sequence
taggcaggttagcagcacct

SEQ ID NO: 174295 - DNA, 20 bp, Artificial
  CRISPR gRNA sequence
ggcaggttagcagcacctat

SEQ ID NO: 174296 - DNA, 20 bp, Artificial
  CRISPR gRNA sequence
gcagcacctatgaatactca

SEQ ID NO: 174297 - DNA, 20 bp, Artificial
  CRISPR gRNA sequence
tgaatactcagctgcgaaca

SEQ ID NO: 174298 - DNA, 20 bp, Artificial
  CRISPR gRNA sequence
agctgcgaacagttgggggc

SEQ ID NO: 174299 - DNA, 20 bp, Artificial
  CRISPR gRNA sequence
cgaacagttgggggcactaa

SEQ ID NO: 174300 - DNA, 20 bp, Artificial
  CRISPR gRNA sequence
ggggcactaaagcacgaggt

SEQ ID NO: 174301 - DNA, 20 bp, Artificial
  CRISPR gRNA sequence
aagcacgaggtaaatacata

SEQ ID NO: 174302 - DNA, 20 bp, Artificial
  CRISPR gRNA sequence
gacctgggggttcttagctc

SEQ ID NO: 174303 - DNA, 20 bp, Artificial
  CRISPR gRNA sequence
ggggttcttagctctctggc

SEQ ID NO: 174304 - DNA, 20 bp, Artificial
  CRISPR gRNA sequence
ttagctctctggcgaactgt

SEQ ID NO: 174305 - DNA, 20 bp, Artificial
  CRISPR gRNA sequence
agctctctggcgaactgtga

SEQ ID NO: 174306 - DNA, 20 bp, Artificial
  CRISPR gRNA sequence
gctctctggcgaactgtgat

SEQ ID NO: 174307 - DNA, 20 bp, Artificial
  CRISPR gRNA sequence
tctggcgaactgtgatcttg

SEQ ID NO: 174308 - DNA, 20 bp, Artificial
  CRISPR gRNA sequence
tggcgaactgtgatcttgag

SEQ ID NO: 174309 - DNA, 20 bp, Artificial
  CRISPR gRNA sequence
gcgaactgtgatcttgagca

SEQ ID NO: 174310 - DNA, 20 bp, Artificial
  CRISPR gRNA sequence
tgatcttgagcaaatctctt

SEQ ID NO: 174311 - DNA, 20 bp, Artificial
  CRISPR gRNA sequence
gagcaaatctcttaacttct

SEQ ID NO: 174312 - DNA, 20 bp, Artificial
  CRISPR gRNA sequence
agcaaatctcttaacttctt

SEQ ID NO: 174313 - DNA, 20 bp, Artificial
  CRISPR gRNA sequence
ttaacttcttagaaacttct

SEQ ID NO: 174314 - DNA, 20 bp, Artificial
  CRISPR gRNA sequence
aacttcttagaaacttctct

SEQ ID NO: 174315 - DNA, 20 bp, Artificial
  CRISPR gRNA sequence
acttcttagaaacttctcta

SEQ ID NO: 174316 - DNA, 20 bp, Artificial
  CRISPR gRNA sequence
cttagaaacttctctattca

SEQ ID NO: 174317 - DNA, 20 bp, Artificial
  CRISPR gRNA sequence
ttagaaacttctctattcat

SEQ ID NO: 174318 - DNA, 20 bp, Artificial
  CRISPR gRNA sequence
agaaacttctctattcatct

SEQ ID NO: 174319 - DNA, 20 bp, Artificial
  CRISPR gRNA sequence
gaaacttctctattcatcta

SEQ ID NO: 174320 - DNA, 20 bp, Artificial
  CRISPR gRNA sequence
ctctattcatctaaagcaac

SEQ ID NO: 174321 - DNA, 20 bp, Artificial
  CRISPR gRNA sequence
tctattcatctaaagcaaca

SEQ ID NO: 174322 - DNA, 20 bp, Artificial
  CRISPR gRNA sequence
tattcatctaaagcaacatc

SEQ ID NO: 174323 - DNA, 20 bp, Artificial
  CRISPR gRNA sequence
ttcatctaaagcaacatccc

SEQ ID NO: 174324 - DNA, 20 bp, Artificial
  CRISPR gRNA sequence
atctaaagcaacatcccaca

SEQ ID NO: 174325 - DNA, 20 bp, Artificial
  CRISPR gRNA sequence
aagcaacatcccacagagca

SEQ ID NO: 174326 - DNA, 20 bp, Artificial
  CRISPR gRNA sequence
aaacacacaaatggtaaaac

SEQ ID NO: 174327 - DNA, 20 bp, Artificial
  CRISPR gRNA sequence
gaaggcctcaaaaaatagca

SEQ ID NO: 174328 - DNA, 20 bp, Artificial
  CRISPR gRNA sequence
aaaaaatagcaagcttcata

SEQ ID NO: 174329 - DNA, 20 bp, Artificial
  CRISPR gRNA sequence
catacaaatgccagatggca

SEQ ID NO: 174330 - DNA, 20 bp, Artificial
  CRISPR gRNA sequence
atacaaatgccagatggcat

SEQ ID NO: 174331 - DNA, 20 bp, Artificial
  CRISPR gRNA sequence
cctgaagctagacaagacac

SEQ ID NO: 174332 - DNA, 20 bp, Artificial
  CRISPR gRNA sequence
aagctagacaagacaccaac

SEQ ID NO: 174333 - DNA, 20 bp, Artificial
  CRISPR gRNA sequence
gacaagacaccaactactgg

SEQ ID NO: 174334 - DNA, 20 bp, Artificial
  CRISPR gRNA sequence
ctggtctgaagagtcccaga

SEQ ID NO: 174335 - DNA, 20 bp, Artificial
  CRISPR gRNA sequence
gtctgaagagtcccagatac

SEQ ID NO: 174336 - DNA, 20 bp, Artificial
  CRISPR gRNA sequence
aagagtcccagatacagtac

SEQ ID NO: 174337 - DNA, 20 bp, Artificial
  CRISPR gRNA sequence
aagaccaactagcttctttt

SEQ ID NO: 174338 - DNA, 20 bp, Artificial
  CRISPR gRNA sequence
gcttctttttctctataatt

SEQ ID NO: 174339 - DNA, 20 bp, Artificial
  CRISPR gRNA sequence
ctttttctctataatttaga

SEQ ID NO: 174340 - DNA, 20 bp, Artificial
  CRISPR gRNA sequence
tttttctctataatttagac

SEQ ID NO: 174341 - DNA, 20 bp, Artificial
  CRISPR gRNA sequence
tttctctataatttagactt

SEQ ID NO: 174342 - DNA, 20 bp, Artificial
  CRISPR gRNA sequence
ttctctataatttagactta

SEQ ID NO: 174343 - DNA, 20 bp, Artificial
  CRISPR gRNA sequence
tctctataatttagacttac

SEQ ID NO: 174344 - DNA, 20 bp, Artificial
  CRISPR gRNA sequence
ctctataatttagacttact

SEQ ID NO: 174345 - DNA, 20 bp, Artificial
  CRISPR gRNA sequence
tctataatttagacttactt

SEQ ID NO: 174346 - DNA, 20 bp, Artificial
  CRISPR gRNA sequence
tataatttagacttactttg

SEQ ID NO: 174347 - DNA, 20 bp, Artificial
  CRISPR gRNA sequence
taatttagacttactttgct

SEQ ID NO: 174348 - DNA, 20 bp, Artificial
  CRISPR gRNA sequence
agacttactttgcttttgac

SEQ ID NO: 174349 - DNA, 20 bp, Artificial
  CRISPR gRNA sequence
gacttactttgcttttgaca

SEQ ID NO: 174350 - DNA, 20 bp, Artificial
  CRISPR gRNA sequence
actttgcttttgacatattt

SEQ ID NO: 174351 - DNA, 20 bp, Artificial
  CRISPR gRNA sequence
ctttgcttttgacatatttc

SEQ ID NO: 174352 - DNA, 20 bp, Artificial
  CRISPR gRNA sequence
tgcttttgacatatttcttt

SEQ ID NO: 174353 - DNA, 20 bp, Artificial
  CRISPR gRNA sequence
gcttttgacatatttcttta

SEQ ID NO: 174354 - DNA, 20 bp, Artificial
  CRISPR gRNA sequence
cttttgacatatttctttaa

SEQ ID NO: 174355 - DNA, 20 bp, Artificial
  CRISPR gRNA sequence
ttgacatatttctttaaaaa

SEQ ID NO: 174356 - DNA, 20 bp, Artificial
  CRISPR gRNA sequence
tgacatatttctttaaaaag

SEQ ID NO: 174357 - DNA, 20 bp, Artificial
  CRISPR gRNA sequence
gacatatttctttaaaaagc

SEQ ID NO: 174358 - DNA, 20 bp, Artificial
  CRISPR gRNA sequence
acatatttctttaaaaagcc

SEQ ID NO: 174359 - DNA, 20 bp, Artificial
  CRISPR gRNA sequence
ctttaaaaagcctagtttca

SEQ ID NO: 174360 - DNA, 20 bp, Artificial
  CRISPR gRNA sequence
tttaaaaagcctagtttcag

SEQ ID NO: 174361 - DNA, 20 bp, Artificial
  CRISPR gRNA sequence
taaaaagcctagtttcagat

SEQ ID NO: 174362 - DNA, 20 bp, Artificial
  CRISPR gRNA sequence
aaaaagcctagtttcagatg

SEQ ID NO: 174363 - DNA, 20 bp, Artificial
  CRISPR gRNA sequence
aaaagcctagtttcagatgc

SEQ ID NO: 174364 - DNA, 20 bp, Artificial
  CRISPR gRNA sequence
gtttcagatgcatggaaata

SEQ ID NO: 174365 - DNA, 20 bp, Artificial
  CRISPR gRNA sequence
cagatgcatggaaatacata

SEQ ID NO: 174366 - DNA, 20 bp, Artificial
  CRISPR gRNA sequence
agatgcatggaaatacatat

SEQ ID NO: 174367 - DNA, 20 bp, Artificial
  CRISPR gRNA sequence
aaatagagaaagatgttctc

SEQ ID NO: 174368 - DNA, 20 bp, Artificial
  CRISPR gRNA sequence
tcctatctcttttataaaca

SEQ ID NO: 174369 - DNA, 20 bp, Artificial
  CRISPR gRNA sequence
ctatctcttttataaacatg

SEQ ID NO: 174370 - DNA, 20 bp, Artificial
  CRISPR gRNA sequence
tctcttttataaacatgaaa

SEQ ID NO: 174371 - DNA, 20 bp, Artificial
  CRISPR gRNA sequence
ttttataaacatgaaataat

SEQ ID NO: 174372 - DNA, 20 bp, Artificial
  CRISPR gRNA sequence
ttataaacatgaaataattt

SEQ ID NO: 174373 - DNA, 20 bp, Artificial
  CRISPR gRNA sequence
tataaacatgaaataatttt

SEQ ID NO: 174374 - DNA, 20 bp, Artificial
  CRISPR gRNA sequence
ataaacatgaaataattttt

SEQ ID NO: 174375 - DNA, 20 bp, Artificial
  CRISPR gRNA sequence
taaacatgaaataattttta

SEQ ID NO: 174376 - DNA, 20 bp, Artificial
  CRISPR gRNA sequence
ttaagccctttaaactatta

SEQ ID NO: 174377 - DNA, 20 bp, Artificial
  CRISPR gRNA sequence
taagccctttaaactattaa

SEQ ID NO: 174378 - DNA, 20 bp, Artificial
  CRISPR gRNA sequence
aagccctttaaactattaaa

SEQ ID NO: 174379 - DNA, 20 bp, Artificial
  CRISPR gRNA sequence
agccctttaaactattaaat

SEQ ID NO: 174380 - DNA, 20 bp, Artificial
  CRISPR gRNA sequence
taaactattaaatttggaac

SEQ ID NO: 174381 - DNA, 20 bp, Artificial
  CRISPR gRNA sequence
aaactattaaatttggaaca

SEQ ID NO: 174382 - DNA, 20 bp, Artificial
  CRISPR gRNA sequence
aactattaaatttggaacaa

SEQ ID NO: 174383 - DNA, 20 bp, Artificial
  CRISPR gRNA sequence
ttaaatttggaacaaatgta

SEQ ID NO: 174384 - DNA, 20 bp, Artificial
  CRISPR gRNA sequence
aatttggaacaaatgtacta

SEQ ID NO: 174385 - DNA, 20 bp, Artificial
  CRISPR gRNA sequence
ggaacaaatgtactagttcc

SEQ ID NO: 174386 - DNA, 20 bp, Artificial
  CRISPR gRNA sequence
gaacaaatgtactagttcca

SEQ ID NO: 174387 - DNA, 20 bp, Artificial
  CRISPR gRNA sequence
gttccaaaaaagcaaagaat

SEQ ID NO: 174388 - DNA, 20 bp, Artificial
  CRISPR gRNA sequence
caaaaaagcaaagaattcaa

SEQ ID NO: 174389 - DNA, 20 bp, Artificial
  CRISPR gRNA sequence
aagctgaacatgggaacgtt

SEQ ID NO: 174390 - DNA, 20 bp, Artificial
  CRISPR gRNA sequence
aacatgggaacgttccaaat

SEQ ID NO: 174391 - DNA, 20 bp, Artificial
  CRISPR gRNA sequence
caaatttaaatccttgggtg

SEQ ID NO: 174392 - DNA, 20 bp, Artificial
  CRISPR gRNA sequence
aaatccttgggtgtgtcaat

SEQ ID NO: 174393 - DNA, 20 bp, Artificial
  CRISPR gRNA sequence
aatccttgggtgtgtcaatg

SEQ ID NO: 174394 - DNA, 20 bp, Artificial
  CRISPR gRNA sequence
gggtgtgtcaatgatcaata

SEQ ID NO: 174395 - DNA, 20 bp, Artificial
  CRISPR gRNA sequence
ggtgtgtcaatgatcaatag

SEQ ID NO: 174396 - DNA, 20 bp, Artificial
  CRISPR gRNA sequence
tactaggttttctctccaca

SEQ ID NO: 174397 - DNA, 20 bp, Artificial
  CRISPR gRNA sequence
ggttttctctccacactaat

SEQ ID NO: 174398 - DNA, 20 bp, Artificial
  CRISPR gRNA sequence
tctctccacactaatccaaa

SEQ ID NO: 174399 - DNA, 20 bp, Artificial
  CRISPR gRNA sequence
ctctccacactaatccaaaa

SEQ ID NO: 174400 - DNA, 20 bp, Artificial
  CRISPR gRNA sequence
tctccacactaatccaaaaa

SEQ ID NO: 174401 - DNA, 20 bp, Artificial
  CRISPR gRNA sequence
tccacactaatccaaaaaca

SEQ ID NO: 174402 - DNA, 20 bp, Artificial
  CRISPR gRNA sequence
cacactaatccaaaaacatt

SEQ ID NO: 174403 - DNA, 20 bp, Artificial
  CRISPR gRNA sequence
atccaaaaacatttaaattc

SEQ ID NO: 174404 - DNA, 20 bp, Artificial
  CRISPR gRNA sequence
aaattctttttttaaattaa

SEQ ID NO: 174405 - DNA, 20 bp, Artificial
  CRISPR gRNA sequence
aattctttttttaaattaat

SEQ ID NO: 174406 - DNA, 20 bp, Artificial
  CRISPR gRNA sequence
tttttttaaattaattattt

SEQ ID NO: 174407 - DNA, 20 bp, Artificial
  CRISPR gRNA sequence
tttttaaattaattatttat

SEQ ID NO: 174408 - DNA, 20 bp, Artificial
  CRISPR gRNA sequence
ttttaaattaattatttatt

SEQ ID NO: 174409 - DNA, 20 bp, Artificial
  CRISPR gRNA sequence
tttaaattaattatttattt

SEQ ID NO: 174410 - DNA, 20 bp, Artificial
  CRISPR gRNA sequence
ttaaattaattatttattta

SEQ ID NO: 174411 - DNA, 20 bp, Artificial
  CRISPR gRNA sequence
taaattaattatttatttat

SEQ ID NO: 174412 - DNA, 20 bp, Artificial
  CRISPR gRNA sequence
aaattaattatttatttata

SEQ ID NO: 174413 - DNA, 20 bp, Artificial
  CRISPR gRNA sequence
aattaattatttatttatat

SEQ ID NO: 174414 - DNA, 20 bp, Artificial
  CRISPR gRNA sequence
attatttatttatatatatt

SEQ ID NO: 174415 - DNA, 20 bp, Artificial
  CRISPR gRNA sequence
tttatttatatatatttttt

SEQ ID NO: 174416 - DNA, 20 bp, Artificial
  CRISPR gRNA sequence
atttatatatattttttggg

SEQ ID NO: 174417 - DNA, 20 bp, Artificial
  CRISPR gRNA sequence
tttatatatattttttggga

SEQ ID NO: 174418 - DNA, 20 bp, Artificial
  CRISPR gRNA sequence
atatatattttttgggatgg

SEQ ID NO: 174419 - DNA, 20 bp, Artificial
  CRISPR gRNA sequence
tatatattttttgggatgga

SEQ ID NO: 174420 - DNA, 20 bp, Artificial
  CRISPR gRNA sequence
tttgggatggaatctcactc

SEQ ID NO: 174421 - DNA, 20 bp, Artificial
  CRISPR gRNA sequence
ttgggatggaatctcactct

SEQ ID NO: 174422 - DNA, 20 bp, Artificial
  CRISPR gRNA sequence
tgggatggaatctcactctg

SEQ ID NO: 174423 - DNA, 20 bp, Artificial
  CRISPR gRNA sequence
gggatggaatctcactctgt

SEQ ID NO: 174424 - DNA, 20 bp, Artificial
  CRISPR gRNA sequence
ggatggaatctcactctgtc

SEQ ID NO: 174425 - DNA, 20 bp, Artificial
  CRISPR gRNA sequence
actctgtcacccaggctgga

SEQ ID NO: 174426 - DNA, 20 bp, Artificial
  CRISPR gRNA sequence
tgtcacccaggctggaatgc

SEQ ID NO: 174427 - DNA, 20 bp, Artificial
  CRISPR gRNA sequence
tcacccaggctggaatgcag

SEQ ID NO: 174428 - DNA, 20 bp, Artificial
  CRISPR gRNA sequence
gaatgcagtagcatgatctt

SEQ ID NO: 174429 - DNA, 20 bp, Artificial
  CRISPR gRNA sequence
ggctcactgcaagcttcgcc

SEQ ID NO: 174430 - DNA, 20 bp, Artificial
  CRISPR gRNA sequence
gctcactgcaagcttcgcct

SEQ ID NO: 174431 - DNA, 20 bp, Artificial
  CRISPR gRNA sequence
actgcaagcttcgcctcccg

SEQ ID NO: 174432 - DNA, 20 bp, Artificial
  CRISPR gRNA sequence
caagcttcgcctcccgggtc

SEQ ID NO: 174433 - DNA, 20 bp, Artificial
  CRISPR gRNA sequence
cgcctcccgggtccacacca

SEQ ID NO: 174434 - DNA, 20 bp, Artificial
  CRISPR gRNA sequence
gcctcccgggtccacaccat

SEQ ID NO: 174435 - DNA, 20 bp, Artificial
  CRISPR gRNA sequence
ccgggtccacaccattctcc

SEQ ID NO: 174436 - DNA, 20 bp, Artificial
  CRISPR gRNA sequence
tcctgcctcagcctcccaag

SEQ ID NO: 174437 - DNA, 20 bp, Artificial
  CRISPR gRNA sequence
ctgcctcagcctcccaagta

SEQ ID NO: 174438 - DNA, 20 bp, Artificial
  CRISPR gRNA sequence
cctcagcctcccaagtagct

SEQ ID NO: 174439 - DNA, 20 bp, Artificial
  CRISPR gRNA sequence
agcctcccaagtagctggga

SEQ ID NO: 174440 - DNA, 20 bp, Artificial
  CRISPR gRNA sequence
ccaagtagctgggaccacag

SEQ ID NO: 174441 - DNA, 20 bp, Artificial
  CRISPR gRNA sequence
ggaccacaggtgcccaccac

SEQ ID NO: 174442 - DNA, 20 bp, Artificial
  CRISPR gRNA sequence
gctaacttttttgtattttt

SEQ ID NO: 174443 - DNA, 20 bp, Artificial
  CRISPR gRNA sequence
acttttttgtatttttagta

SEQ ID NO: 174444 - DNA, 20 bp, Artificial
  CRISPR gRNA sequence
ttttgtatttttagtagaga

SEQ ID NO: 174445 - DNA, 20 bp, Artificial
  CRISPR gRNA sequence
tttgtatttttagtagagac

SEQ ID NO: 174446 - DNA, 20 bp, Artificial
  CRISPR gRNA sequence
ttgtatttttagtagagaca

SEQ ID NO: 174447 - DNA, 20 bp, Artificial
  CRISPR gRNA sequence
tgtatttttagtagagacag

SEQ ID NO: 174448 - DNA, 20 bp, Artificial
  CRISPR gRNA sequence
gtatttttagtagagacagg

SEQ ID NO: 174449 - DNA, 20 bp, Artificial
  CRISPR gRNA sequence
tatttttagtagagacaggg

SEQ ID NO: 174450 - DNA, 20 bp, Artificial
  CRISPR gRNA sequence
ttagtagagacagggtttca

SEQ ID NO: 174451 - DNA, 20 bp, Artificial
  CRISPR gRNA sequence
tagtagagacagggtttcac

SEQ ID NO: 174452 - DNA, 20 bp, Artificial
  CRISPR gRNA sequence
agtagagacagggtttcacc

SEQ ID NO: 174453 - DNA, 20 bp, Artificial
  CRISPR gRNA sequence
gtagagacagggtttcaccg

SEQ ID NO: 174454 - DNA, 20 bp, Artificial
  CRISPR gRNA sequence
caccgtgttagccaggatgg

SEQ ID NO: 174455 - DNA, 20 bp, Artificial
  CRISPR gRNA sequence
accgtgttagccaggatggt

SEQ ID NO: 174456 - DNA, 20 bp, Artificial
  CRISPR gRNA sequence
gccaggatggtctccatctc

SEQ ID NO: 174457 - DNA, 20 bp, Artificial
  CRISPR gRNA sequence
catctcctgacctcctgatc

SEQ ID NO: 174458 - DNA, 20 bp, Artificial
  CRISPR gRNA sequence
ctgacctcctgatccgccca

SEQ ID NO: 174459 - DNA, 20 bp, Artificial
  CRISPR gRNA sequence
acctcctgatccgcccacct

SEQ ID NO: 174460 - DNA, 20 bp, Artificial
  CRISPR gRNA sequence
ctgatccgcccaccttggcc

SEQ ID NO: 174461 - DNA, 20 bp, Artificial
  CRISPR gRNA sequence
atccgcccaccttggcctcc

SEQ ID NO: 174462 - DNA, 20 bp, Artificial
  CRISPR gRNA sequence
ggcctcccaaagtgctggga

SEQ ID NO: 174463 - DNA, 20 bp, Artificial
  CRISPR gRNA sequence
gcctcccaaagtgctgggat

SEQ ID NO: 174464 - DNA, 20 bp, Artificial
  CRISPR gRNA sequence
ccaaagtgctgggattacag

SEQ ID NO: 174465 - DNA, 20 bp, Artificial
  CRISPR gRNA sequence
ggattacaggcatgagccac

SEQ ID NO: 174466 - DNA, 20 bp, Artificial
  CRISPR gRNA sequence
caggcatgagccaccgcgcc

SEQ ID NO: 174467 - DNA, 20 bp, Artificial
  CRISPR gRNA sequence
caattcttagaatatgtctc

SEQ ID NO: 174468 - DNA, 20 bp, Artificial
  CRISPR gRNA sequence
aattcttagaatatgtctcc

SEQ ID NO: 174469 - DNA, 20 bp, Artificial
  CRISPR gRNA sequence
ttagaatatgtctccttggg

SEQ ID NO: 174470 - DNA, 20 bp, Artificial
  CRISPR gRNA sequence
agaatatgtctccttgggct

SEQ ID NO: 174471 - DNA, 20 bp, Artificial
  CRISPR gRNA sequence
gaatatgtctccttgggctg

SEQ ID NO: 174472 - DNA, 20 bp, Artificial
  CRISPR gRNA sequence
cttgggctgggaacggtggc

SEQ ID NO: 174473 - DNA, 20 bp, Artificial
  CRISPR gRNA sequence
gggctgggaacggtggctca

SEQ ID NO: 174474 - DNA, 20 bp, Artificial
  CRISPR gRNA sequence
ggctgggaacggtggctcat

SEQ ID NO: 174475 - DNA, 20 bp, Artificial
  CRISPR gRNA sequence
ggaacggtggctcatgcctg

SEQ ID NO: 174476 - DNA, 20 bp, Artificial
  CRISPR gRNA sequence
atgcctgtaatctcagcact

SEQ ID NO: 174477 - DNA, 20 bp, Artificial
  CRISPR gRNA sequence
taatctcagcactttgggaa

SEQ ID NO: 174478 - DNA, 20 bp, Artificial
  CRISPR gRNA sequence
agcactttgggaagccaaag

SEQ ID NO: 174479 - DNA, 20 bp, Artificial
  CRISPR gRNA sequence
tgggaagccaaagcaggagg

SEQ ID NO: 174480 - DNA, 20 bp, Artificial
  CRISPR gRNA sequence
gggaagccaaagcaggagga

SEQ ID NO: 174481 - DNA, 20 bp, Artificial
  CRISPR gRNA sequence
ggaagccaaagcaggaggat

SEQ ID NO: 174482 - DNA, 20 bp, Artificial
  CRISPR gRNA sequence
gagcccaggagttcaagatc

SEQ ID NO: 174483 - DNA, 20 bp, Artificial
  CRISPR gRNA sequence
agcccaggagttcaagatca

SEQ ID NO: 174484 - DNA, 20 bp, Artificial
  CRISPR gRNA sequence
aagatcagcctgggaaacat

SEQ ID NO: 174485 - DNA, 20 bp, Artificial
  CRISPR gRNA sequence
ggaaacatagaaagacctcg

SEQ ID NO: 174486 - DNA, 20 bp, Artificial
  CRISPR gRNA sequence
gtctctacaaaaaagaaaaa

SEQ ID NO: 174487 - DNA, 20 bp, Artificial
  CRISPR gRNA sequence
tacaaaaaagaaaaaaaaat

SEQ ID NO: 174488 - DNA, 20 bp, Artificial
  CRISPR gRNA sequence
caaaaaagaaaaaaaaatta

SEQ ID NO: 174489 - DNA, 20 bp, Artificial
  CRISPR gRNA sequence
gcctgtgtggtggcacgcac

SEQ ID NO: 174490 - DNA, 20 bp, Artificial
  CRISPR gRNA sequence
tgtggtggcacgcacctgta

SEQ ID NO: 174491 - DNA, 20 bp, Artificial
  CRISPR gRNA sequence
tagctcccgctactcaggag

SEQ ID NO: 174492 - DNA, 20 bp, Artificial
  CRISPR gRNA sequence
ccgctactcaggaggctggg

SEQ ID NO: 174493 - DNA, 20 bp, Artificial
  CRISPR gRNA sequence
ctcaggaggctggggcagga

SEQ ID NO: 174494 - DNA, 20 bp, Artificial
  CRISPR gRNA sequence
aggaggctggggcaggagga

SEQ ID NO: 174495 - DNA, 20 bp, Artificial
  CRISPR gRNA sequence
gggcaggaggatcacttgag

SEQ ID NO: 174496 - DNA, 20 bp, Artificial
  CRISPR gRNA sequence
gagccgaggagctgggagac

SEQ ID NO: 174497 - DNA, 20 bp, Artificial
  CRISPR gRNA sequence
agccgaggagctgggagact

SEQ ID NO: 174498 - DNA, 20 bp, Artificial
  CRISPR gRNA sequence
ggagactgcaatgagccatg

SEQ ID NO: 174499 - DNA, 20 bp, Artificial
  CRISPR gRNA sequence
caatgagccatgattgcact

SEQ ID NO: 174500 - DNA, 20 bp, Artificial
  CRISPR gRNA sequence
cactactgcacttcagcctg

SEQ ID NO: 174501 - DNA, 20 bp, Artificial
  CRISPR gRNA sequence
ctgcacttcagcctggcaac

SEQ ID NO: 174502 - DNA, 20 bp, Artificial
  CRISPR gRNA sequence
cacttcagcctggcaacaga

SEQ ID NO: 174503 - DNA, 20 bp, Artificial
  CRISPR gRNA sequence
cagcctggcaacagagtgag

SEQ ID NO: 174504 - DNA, 20 bp, Artificial
  CRISPR gRNA sequence
agcctggcaacagagtgaga

SEQ ID NO: 174505 - DNA, 20 bp, Artificial
  CRISPR gRNA sequence
gcaacagagtgagaccctgt

SEQ ID NO: 174506 - DNA, 20 bp, Artificial
  CRISPR gRNA sequence
tatcaaaaaaaaaccccaaa

SEQ ID NO: 174507 - DNA, 20 bp, Artificial
  CRISPR gRNA sequence
cttggatacctaagacttcc

SEQ ID NO: 174508 - DNA, 20 bp, Artificial
  CRISPR gRNA sequence
ggatacctaagacttccaca

SEQ ID NO: 174509 - DNA, 20 bp, Artificial
  CRISPR gRNA sequence
gatacctaagacttccacaa

SEQ ID NO: 174510 - DNA, 20 bp, Artificial
  CRISPR gRNA sequence
agacttccacaagctaggag

SEQ ID NO: 174511 - DNA, 20 bp, Artificial
  CRISPR gRNA sequence
ccacaagctaggagtacgtg

SEQ ID NO: 174512 - DNA, 20 bp, Artificial
  CRISPR gRNA sequence
cacaagctaggagtacgtgc

SEQ ID NO: 174513 - DNA, 20 bp, Artificial
  CRISPR gRNA sequence
ggagtacgtgcctgttttgt

SEQ ID NO: 174514 - DNA, 20 bp, Artificial
  CRISPR gRNA sequence
ttttgtcttgtgaaaggaat

SEQ ID NO: 174515 - DNA, 20 bp, Artificial
  CRISPR gRNA sequence
tgtcttgtgaaaggaatctt

SEQ ID NO: 174516 - DNA, 20 bp, Artificial
  CRISPR gRNA sequence
gtcttgtgaaaggaatcttg

SEQ ID NO: 174517 - DNA, 20 bp, Artificial
  CRISPR gRNA sequence
tcttgtgaaaggaatcttgt

SEQ ID NO: 174518 - DNA, 20 bp, Artificial
  CRISPR gRNA sequence
gtgaaaggaatcttgtttat

SEQ ID NO: 174519 - DNA, 20 bp, Artificial
  CRISPR gRNA sequence
tgaaaggaatcttgtttatg

SEQ ID NO: 174520 - DNA, 20 bp, Artificial
  CRISPR gRNA sequence
gtttatgttagagggtagag

SEQ ID NO: 174521 - DNA, 20 bp, Artificial
  CRISPR gRNA sequence
tttatgttagagggtagagg

SEQ ID NO: 174522 - DNA, 20 bp, Artificial
  CRISPR gRNA sequence
atgttagagggtagaggaaa

SEQ ID NO: 174523 - DNA, 20 bp, Artificial
  CRISPR gRNA sequence
tgttagagggtagaggaaac

SEQ ID NO: 174524 - DNA, 20 bp, Artificial
  CRISPR gRNA sequence
gagggtagaggaaacctgga

SEQ ID NO: 174525 - DNA, 20 bp, Artificial
  CRISPR gRNA sequence
gagtccaggcagctccccac

SEQ ID NO: 174526 - DNA, 20 bp, Artificial
  CRISPR gRNA sequence
cccactcaacctggccccac

SEQ ID NO: 174527 - DNA, 20 bp, Artificial
  CRISPR gRNA sequence
aacctggccccaccatccaa

SEQ ID NO: 174528 - DNA, 20 bp, Artificial
  CRISPR gRNA sequence
gccccaccatccaagcaaaa

SEQ ID NO: 174529 - DNA, 20 bp, Artificial
  CRISPR gRNA sequence
tgtttggagctctaaagaga

SEQ ID NO: 174530 - DNA, 20 bp, Artificial
  CRISPR gRNA sequence
tttggagctctaaagagagc

SEQ ID NO: 174531 - DNA, 20 bp, Artificial
  CRISPR gRNA sequence
ggagctctaaagagagctcc

SEQ ID NO: 174532 - DNA, 20 bp, Artificial
  CRISPR gRNA sequence
gagctctaaagagagctcca

SEQ ID NO: 174533 - DNA, 20 bp, Artificial
  CRISPR gRNA sequence
taaagagagctccacccact

SEQ ID NO: 174534 - DNA, 20 bp, Artificial
  CRISPR gRNA sequence
aagagagctccacccacttc

SEQ ID NO: 174535 - DNA, 20 bp, Artificial
  CRISPR gRNA sequence
cacccacttccatctatatc

SEQ ID NO: 174536 - DNA, 20 bp, Artificial
  CRISPR gRNA sequence
ccatctatatccaacatcct

SEQ ID NO: 174537 - DNA, 20 bp, Artificial
  CRISPR gRNA sequence
catctatatccaacatcctg

SEQ ID NO: 174538 - DNA, 20 bp, Artificial
  CRISPR gRNA sequence
tatccaacatcctgaagtga

SEQ ID NO: 174539 - DNA, 20 bp, Artificial
  CRISPR gRNA sequence
aagtgaacatgaaggaaaca

SEQ ID NO: 174540 - DNA, 20 bp, Artificial
  CRISPR gRNA sequence
tggaaagttggaatttctca

SEQ ID NO: 174541 - DNA, 20 bp, Artificial
  CRISPR gRNA sequence
gaaagttggaatttctcaga

SEQ ID NO: 174542 - DNA, 20 bp, Artificial
  CRISPR gRNA sequence
gaatttctcagactatctca

SEQ ID NO: 174543 - DNA, 20 bp, Artificial
  CRISPR gRNA sequence
ctcagactatctcatgggtt

SEQ ID NO: 174544 - DNA, 20 bp, Artificial
  CRISPR gRNA sequence
tcagactatctcatgggttg

SEQ ID NO: 174545 - DNA, 20 bp, Artificial
  CRISPR gRNA sequence
agactatctcatgggttgaa

SEQ ID NO: 174546 - DNA, 20 bp, Artificial
  CRISPR gRNA sequence
tctcatgggttgaaaccaat

SEQ ID NO: 174547 - DNA, 20 bp, Artificial
  CRISPR gRNA sequence
atgggttgaaaccaatgttt

SEQ ID NO: 174548 - DNA, 20 bp, Artificial
  CRISPR gRNA sequence
aaaccaatgtttaaggctct

SEQ ID NO: 174549 - DNA, 20 bp, Artificial
  CRISPR gRNA sequence
aaggctcttctgcaatagca

SEQ ID NO: 174550 - DNA, 20 bp, Artificial
  CRISPR gRNA sequence
aggctcttctgcaatagcat

SEQ ID NO: 174551 - DNA, 20 bp, Artificial
  CRISPR gRNA sequence
ttctgcaatagcattgataa

SEQ ID NO: 174552 - DNA, 20 bp, Artificial
  CRISPR gRNA sequence
ctgcaatagcattgataaga

SEQ ID NO: 174553 - DNA, 20 bp, Artificial
  CRISPR gRNA sequence
tgcaatagcattgataagaa

SEQ ID NO: 174554 - DNA, 20 bp, Artificial
  CRISPR gRNA sequence
caatagcattgataagaagc

SEQ ID NO: 174555 - DNA, 20 bp, Artificial
  CRISPR gRNA sequence
ataagaagcttgcctttaca

SEQ ID NO: 174556 - DNA, 20 bp, Artificial
  CRISPR gRNA sequence
gcctttacagtacaaatgta

SEQ ID NO: 174557 - DNA, 20 bp, Artificial
  CRISPR gRNA sequence
cctttacagtacaaatgtaa

SEQ ID NO: 174558 - DNA, 20 bp, Artificial
  CRISPR gRNA sequence
tacagtacaaatgtaaagaa

SEQ ID NO: 174559 - DNA, 20 bp, Artificial
  CRISPR gRNA sequence
acagtacaaatgtaaagaaa

SEQ ID NO: 174560 - DNA, 20 bp, Artificial
  CRISPR gRNA sequence
cagtacaaatgtaaagaaat

SEQ ID NO: 174561 - DNA, 20 bp, Artificial
  CRISPR gRNA sequence
aacactgtctacacattcac

SEQ ID NO: 174562 - DNA, 20 bp, Artificial
  CRISPR gRNA sequence
tctacacattcactaatcag

SEQ ID NO: 174563 - DNA, 20 bp, Artificial
  CRISPR gRNA sequence
cacattcactaatcagtgat

SEQ ID NO: 174564 - DNA, 20 bp, Artificial
  CRISPR gRNA sequence
actaatcagtgatgataaat

SEQ ID NO: 174565 - DNA, 20 bp, Artificial
  CRISPR gRNA sequence
atcagtgatgataaattttt

SEQ ID NO: 174566 - DNA, 20 bp, Artificial
  CRISPR gRNA sequence
tttttctccccaagaaacca

SEQ ID NO: 174567 - DNA, 20 bp, Artificial
  CRISPR gRNA sequence
ttttctccccaagaaaccat

SEQ ID NO: 174568 - DNA, 20 bp, Artificial
  CRISPR gRNA sequence
tttctccccaagaaaccatt

SEQ ID NO: 174569 - DNA, 20 bp, Artificial
  CRISPR gRNA sequence
ttctccccaagaaaccattc

SEQ ID NO: 174570 - DNA, 20 bp, Artificial
  CRISPR gRNA sequence
tctccccaagaaaccattcc

SEQ ID NO: 174571 - DNA, 20 bp, Artificial
  CRISPR gRNA sequence
ctccccaagaaaccattcct

SEQ ID NO: 174572 - DNA, 20 bp, Artificial
  CRISPR gRNA sequence
tccccaagaaaccattcctg

SEQ ID NO: 174573 - DNA, 20 bp, Artificial
  CRISPR gRNA sequence
cccaagaaaccattcctggc

SEQ ID NO: 174574 - DNA, 20 bp, Artificial
  CRISPR gRNA sequence
ctggcacacaatcaaatcta

SEQ ID NO: 174575 - DNA, 20 bp, Artificial
  CRISPR gRNA sequence
gcacacaatcaaatctattt

SEQ ID NO: 174576 - DNA, 20 bp, Artificial
  CRISPR gRNA sequence
tttctctaattagcatattc

SEQ ID NO: 174577 - DNA, 20 bp, Artificial
  CRISPR gRNA sequence
ctctaattagcatattcact

SEQ ID NO: 174578 - DNA, 20 bp, Artificial
  CRISPR gRNA sequence
tctaattagcatattcactt

SEQ ID NO: 174579 - DNA, 20 bp, Artificial
  CRISPR gRNA sequence
taattagcatattcacttgc

SEQ ID NO: 174580 - DNA, 20 bp, Artificial
  CRISPR gRNA sequence
attagcatattcacttgctt

SEQ ID NO: 174581 - DNA, 20 bp, Artificial
  CRISPR gRNA sequence
gcatattcacttgcttcaga

SEQ ID NO: 174582 - DNA, 20 bp, Artificial
  CRISPR gRNA sequence
acttgcttcagacttgtgta

SEQ ID NO: 174583 - DNA, 20 bp, Artificial
  CRISPR gRNA sequence
gcttcagacttgtgtaacat

SEQ ID NO: 174584 - DNA, 20 bp, Artificial
  CRISPR gRNA sequence
cttcagacttgtgtaacatg

SEQ ID NO: 174585 - DNA, 20 bp, Artificial
  CRISPR gRNA sequence
cagacttgtgtaacatgttc

SEQ ID NO: 174586 - DNA, 20 bp, Artificial
  CRISPR gRNA sequence
agacttgtgtaacatgttct

SEQ ID NO: 174587 - DNA, 20 bp, Artificial
  CRISPR gRNA sequence
gtgtaacatgttctcttttt

SEQ ID NO: 174588 - DNA, 20 bp, Artificial
  CRISPR gRNA sequence
tgtaacatgttctctttttt

SEQ ID NO: 174589 - DNA, 20 bp, Artificial
  CRISPR gRNA sequence
tctttttttagggggcatat

SEQ ID NO: 174590 - DNA, 20 bp, Artificial
  CRISPR gRNA sequence
tttttttagggggcatatta

SEQ ID NO: 174591 - DNA, 20 bp, Artificial
  CRISPR gRNA sequence
tttttagggggcatattatt

SEQ ID NO: 174592 - DNA, 20 bp, Artificial
  CRISPR gRNA sequence
ttttagggggcatattattt

SEQ ID NO: 174593 - DNA, 20 bp, Artificial
  CRISPR gRNA sequence
tttagggggcatattatttt

SEQ ID NO: 174594 - DNA, 20 bp, Artificial
  CRISPR gRNA sequence
ttagggggcatattattttt

SEQ ID NO: 174595 - DNA, 20 bp, Artificial
  CRISPR gRNA sequence
tagggggcatattatttttt

SEQ ID NO: 174596 - DNA, 20 bp, Artificial
  CRISPR gRNA sequence
agggggcatattatttttta

SEQ ID NO: 174597 - DNA, 20 bp, Artificial
  CRISPR gRNA sequence
gggggcatattattttttaa

SEQ ID NO: 174598 - DNA, 20 bp, Artificial
  CRISPR gRNA sequence
ttttttaagcttaaattttt

SEQ ID NO: 174599 - DNA, 20 bp, Artificial
  CRISPR gRNA sequence
tttaagcttaaatttttcat

SEQ ID NO: 174600 - DNA, 20 bp, Artificial
  CRISPR gRNA sequence
ttaagcttaaatttttcatg

SEQ ID NO: 174601 - DNA, 20 bp, Artificial
  CRISPR gRNA sequence
taagcttaaatttttcatgc

SEQ ID NO: 174602 - DNA, 20 bp, Artificial
  CRISPR gRNA sequence
aagcttaaatttttcatgct

SEQ ID NO: 174603 - DNA, 20 bp, Artificial
  CRISPR gRNA sequence
agcttaaatttttcatgctc

SEQ ID NO: 174604 - DNA, 20 bp, Artificial
  CRISPR gRNA sequence
aaatttttcatgctcctatt

SEQ ID NO: 174605 - DNA, 20 bp, Artificial
  CRISPR gRNA sequence
aatttttcatgctcctattt

SEQ ID NO: 174606 - DNA, 20 bp, Artificial
  CRISPR gRNA sequence
ttcatgctcctattttttcc

SEQ ID NO: 174607 - DNA, 20 bp, Artificial
  CRISPR gRNA sequence
tcatgctcctattttttccc

SEQ ID NO: 174608 - DNA, 20 bp, Artificial
  CRISPR gRNA sequence
catgctcctattttttcccc

SEQ ID NO: 174609 - DNA, 20 bp, Artificial
  CRISPR gRNA sequence
atgctcctattttttccccc

SEQ ID NO: 174610 - DNA, 20 bp, Artificial
  CRISPR gRNA sequence
ctattttttcccccgtttgt

SEQ ID NO: 174611 - DNA, 20 bp, Artificial
  CRISPR gRNA sequence
ttttttcccccgtttgtaag

SEQ ID NO: 174612 - DNA, 20 bp, Artificial
  CRISPR gRNA sequence
tttcccccgtttgtaagaca

SEQ ID NO: 174613 - DNA, 20 bp, Artificial
  CRISPR gRNA sequence
ttcccccgtttgtaagacaa

SEQ ID NO: 174614 - DNA, 20 bp, Artificial
  CRISPR gRNA sequence
tcccccgtttgtaagacaaa

SEQ ID NO: 174615 - DNA, 20 bp, Artificial
  CRISPR gRNA sequence
cccccgtttgtaagacaaac

SEQ ID NO: 174616 - DNA, 20 bp, Artificial
  CRISPR gRNA sequence
ccccgtttgtaagacaaaca

SEQ ID NO: 174617 - DNA, 20 bp, Artificial
  CRISPR gRNA sequence
gtaagacaaacataatcatt

SEQ ID NO: 174618 - DNA, 20 bp, Artificial
  CRISPR gRNA sequence
taagacaaacataatcattt

SEQ ID NO: 174619 - DNA, 20 bp, Artificial
  CRISPR gRNA sequence
tgtttctgatacaccctcaa

SEQ ID NO: 174620 - DNA, 20 bp, Artificial
  CRISPR gRNA sequence
gtttctgatacaccctcaag

SEQ ID NO: 174621 - DNA, 20 bp, Artificial
  CRISPR gRNA sequence
tttctgatacaccctcaagg

SEQ ID NO: 174622 - DNA, 20 bp, Artificial
  CRISPR gRNA sequence
ctgatacaccctcaaggcaa

SEQ ID NO: 174623 - DNA, 20 bp, Artificial
  CRISPR gRNA sequence
tgatacaccctcaaggcaaa

SEQ ID NO: 174624 - DNA, 20 bp, Artificial
  CRISPR gRNA sequence
atacaccctcaaggcaaata

SEQ ID NO: 174625 - DNA, 20 bp, Artificial
  CRISPR gRNA sequence
aaggcaaatatgccttgcac

SEQ ID NO: 174626 - DNA, 20 bp, Artificial
  CRISPR gRNA sequence
gcacatagtggggattcaat

SEQ ID NO: 174627 - DNA, 20 bp, Artificial
  CRISPR gRNA sequence
cacatagtggggattcaata

SEQ ID NO: 174628 - DNA, 20 bp, Artificial
  CRISPR gRNA sequence
aatacacatctactgaatga

SEQ ID NO: 174629 - DNA, 20 bp, Artificial
  CRISPR gRNA sequence
ctgaatgaacaaacacaggt

SEQ ID NO: 174630 - DNA, 20 bp, Artificial
  CRISPR gRNA sequence
aatgaacaaacacaggttcc

SEQ ID NO: 174631 - DNA, 20 bp, Artificial
  CRISPR gRNA sequence
ctcaagaacttaaaaaaaaa

SEQ ID NO: 174632 - DNA, 20 bp, Artificial
  CRISPR gRNA sequence
aagaacttaaaaaaaaattt

SEQ ID NO: 174633 - DNA, 20 bp, Artificial
  CRISPR gRNA sequence
aaaaaaaaattttttttaaa

SEQ ID NO: 174634 - DNA, 20 bp, Artificial
  CRISPR gRNA sequence
aaaaaaaattttttttaaat

SEQ ID NO: 174635 - DNA, 20 bp, Artificial
  CRISPR gRNA sequence
tttttaaataacagtgtctt

SEQ ID NO: 174636 - DNA, 20 bp, Artificial
  CRISPR gRNA sequence
ttttaaataacagtgtcttg

SEQ ID NO: 174637 - DNA, 20 bp, Artificial
  CRISPR gRNA sequence
tttaaataacagtgtcttgc

SEQ ID NO: 174638 - DNA, 20 bp, Artificial
  CRISPR gRNA sequence
ttaaataacagtgtcttgct

SEQ ID NO: 174639 - DNA, 20 bp, Artificial
  CRISPR gRNA sequence
taaataacagtgtcttgctc

SEQ ID NO: 174640 - DNA, 20 bp, Artificial
  CRISPR gRNA sequence
aaataacagtgtcttgctct

SEQ ID NO: 174641 - DNA, 20 bp, Artificial
  CRISPR gRNA sequence
aataacagtgtcttgctctg

SEQ ID NO: 174642 - DNA, 20 bp, Artificial
  CRISPR gRNA sequence
gctctgttgcccacgctgga

SEQ ID NO: 174643 - DNA, 20 bp, Artificial
  CRISPR gRNA sequence
ctctgttgcccacgctggag

SEQ ID NO: 174644 - DNA, 20 bp, Artificial
  CRISPR gRNA sequence
tgttgcccacgctggagtgc

SEQ ID NO: 174645 - DNA, 20 bp, Artificial
  CRISPR gRNA sequence
ttgcccacgctggagtgcag

SEQ ID NO: 174646 - DNA, 20 bp, Artificial
  CRISPR gRNA sequence
cccacgctggagtgcagtgg

SEQ ID NO: 174647 - DNA, 20 bp, Artificial
  CRISPR gRNA sequence
gagtgcagtggcgtaatcat

SEQ ID NO: 174648 - DNA, 20 bp, Artificial
  CRISPR gRNA sequence
actgaagcctcaacctcctg

SEQ ID NO: 174649 - DNA, 20 bp, Artificial
  CRISPR gRNA sequence
aagcctcaacctcctgggtt

SEQ ID NO: 174650 - DNA, 20 bp, Artificial
  CRISPR gRNA sequence
aacctcctgggttcaagtga

SEQ ID NO: 174651 - DNA, 20 bp, Artificial
  CRISPR gRNA sequence
ctgggttcaagtgatcctcc

SEQ ID NO: 174652 - DNA, 20 bp, Artificial
  CRISPR gRNA sequence
ggttcaagtgatcctcccct

SEQ ID NO: 174653 - DNA, 20 bp, Artificial
  CRISPR gRNA sequence
aagtgatcctcccctgctca

SEQ ID NO: 174654 - DNA, 20 bp, Artificial
  CRISPR gRNA sequence
ccctgctcagcctcctgagt

SEQ ID NO: 174655 - DNA, 20 bp, Artificial
  CRISPR gRNA sequence
ctcagcctcctgagtagcgg

SEQ ID NO: 174656 - DNA, 20 bp, Artificial
  CRISPR gRNA sequence
agcctcctgagtagcgggga

SEQ ID NO: 174657 - DNA, 20 bp, Artificial
  CRISPR gRNA sequence
ctgagtagcggggactacag

SEQ ID NO: 174658 - DNA, 20 bp, Artificial
  CRISPR gRNA sequence
agtagcggggactacaggtg

SEQ ID NO: 174659 - DNA, 20 bp, Artificial
  CRISPR gRNA sequence
caggtgcttgccaccatacc

SEQ ID NO: 174660 - DNA, 20 bp, Artificial
  CRISPR gRNA sequence
gccaccatacctggctaatt

SEQ ID NO: 174661 - DNA, 20 bp, Artificial
  CRISPR gRNA sequence
ccaccatacctggctaattt

SEQ ID NO: 174662 - DNA, 20 bp, Artificial
  CRISPR gRNA sequence
gctaatttttaaaatttttt

SEQ ID NO: 174663 - DNA, 20 bp, Artificial
  CRISPR gRNA sequence
atttttaaaattttttgtaa

SEQ ID NO: 174664 - DNA, 20 bp, Artificial
  CRISPR gRNA sequence
ttaaaattttttgtaaagac

SEQ ID NO: 174665 - DNA, 20 bp, Artificial
  CRISPR gRNA sequence
taaaattttttgtaaagaca

SEQ ID NO: 174666 - DNA, 20 bp, Artificial
  CRISPR gRNA sequence
aaaattttttgtaaagacag

SEQ ID NO: 174667 - DNA, 20 bp, Artificial
  CRISPR gRNA sequence
aaattttttgtaaagacagg

SEQ ID NO: 174668 - DNA, 20 bp, Artificial
  CRISPR gRNA sequence
tttgtaaagacagggtcttg

SEQ ID NO: 174669 - DNA, 20 bp, Artificial
  CRISPR gRNA sequence
ttgtaaagacagggtcttgc

SEQ ID NO: 174670 - DNA, 20 bp, Artificial
  CRISPR gRNA sequence
tgtaaagacagggtcttgct

SEQ ID NO: 174671 - DNA, 20 bp, Artificial
  CRISPR gRNA sequence
gtaaagacagggtcttgcta

SEQ ID NO: 174672 - DNA, 20 bp, Artificial
  CRISPR gRNA sequence
taaagacagggtcttgctat

SEQ ID NO: 174673 - DNA, 20 bp, Artificial
  CRISPR gRNA sequence
gctatcttgcccaggctggt

SEQ ID NO: 174674 - DNA, 20 bp, Artificial
  CRISPR gRNA sequence
ctatcttgcccaggctggtc

SEQ ID NO: 174675 - DNA, 20 bp, Artificial
  CRISPR gRNA sequence
tcttgcccaggctggtctca

SEQ ID NO: 174676 - DNA, 20 bp, Artificial
  CRISPR gRNA sequence
gcccaggctggtctcaaact

SEQ ID NO: 174677 - DNA, 20 bp, Artificial
  CRISPR gRNA sequence
cccaggctggtctcaaactc

SEQ ID NO: 174678 - DNA, 20 bp, Artificial
  CRISPR gRNA sequence
gtctcaaactcctgggctca

SEQ ID NO: 174679 - DNA, 20 bp, Artificial
  CRISPR gRNA sequence
aaactcctgggctcaagtga

SEQ ID NO: 174680 - DNA, 20 bp, Artificial
  CRISPR gRNA sequence
ctgggctcaagtgatcctct

SEQ ID NO: 174681 - DNA, 20 bp, Artificial
  CRISPR gRNA sequence
ggctcaagtgatcctctcac

SEQ ID NO: 174682 - DNA, 20 bp, Artificial
  CRISPR gRNA sequence
aagtgatcctctcactttgg

SEQ ID NO: 174683 - DNA, 20 bp, Artificial
  CRISPR gRNA sequence
tcactttggcctgccaaagt

SEQ ID NO: 174684 - DNA, 20 bp, Artificial
  CRISPR gRNA sequence
actttggcctgccaaagtgc

SEQ ID NO: 174685 - DNA, 20 bp, Artificial
  CRISPR gRNA sequence
tggcctgccaaagtgctggg

SEQ ID NO: 174686 - DNA, 20 bp, Artificial
  CRISPR gRNA sequence
ggcctgccaaagtgctggga

SEQ ID NO: 174687 - DNA, 20 bp, Artificial
  CRISPR gRNA sequence
gcctgccaaagtgctgggat

SEQ ID NO: 174688 - DNA, 20 bp, Artificial
  CRISPR gRNA sequence
ccaaagtgctgggattacag

SEQ ID NO: 174689 - DNA, 20 bp, Artificial
  CRISPR gRNA sequence
ggattacagatgtgagccac

SEQ ID NO: 174690 - DNA, 20 bp, Artificial
  CRISPR gRNA sequence
cagatgtgagccaccatgcc

SEQ ID NO: 174691 - DNA, 20 bp, Artificial
  CRISPR gRNA sequence
gacaagaactattttaagac

SEQ ID NO: 174692 - DNA, 20 bp, Artificial
  CRISPR gRNA sequence
ttttaagaccccaagtatcc

SEQ ID NO: 174693 - DNA, 20 bp, Artificial
  CRISPR gRNA sequence
taagaccccaagtatccttg

SEQ ID NO: 174694 - DNA, 20 bp, Artificial
  CRISPR gRNA sequence
aagaccccaagtatccttgg

SEQ ID NO: 174695 - DNA, 20 bp, Artificial
  CRISPR gRNA sequence
agaccccaagtatccttggc

SEQ ID NO: 174696 - DNA, 20 bp, Artificial
  CRISPR gRNA sequence
ggcctcattctaggtacttt

SEQ ID NO: 174697 - DNA, 20 bp, Artificial
  CRISPR gRNA sequence
gcctcattctaggtactttt

SEQ ID NO: 174698 - DNA, 20 bp, Artificial
  CRISPR gRNA sequence
attctaggtacttttctttg

SEQ ID NO: 174699 - DNA, 20 bp, Artificial
  CRISPR gRNA sequence
taggtacttttctttgaaat

SEQ ID NO: 174700 - DNA, 20 bp, Artificial
  CRISPR gRNA sequence
ggtacttttctttgaaatgg

SEQ ID NO: 174701 - DNA, 20 bp, Artificial
  CRISPR gRNA sequence
ttctttgaaatgggaaaatt

SEQ ID NO: 174702 - DNA, 20 bp, Artificial
  CRISPR gRNA sequence
tctttgaaatgggaaaattc

SEQ ID NO: 174703 - DNA, 20 bp, Artificial
  CRISPR gRNA sequence
ctttgaaatgggaaaattcc

SEQ ID NO: 174704 - DNA, 20 bp, Artificial
  CRISPR gRNA sequence
tttgaaatgggaaaattcct

SEQ ID NO: 174705 - DNA, 20 bp, Artificial
  CRISPR gRNA sequence
tgaaatgggaaaattccttc

SEQ ID NO: 174706 - DNA, 20 bp, Artificial
  CRISPR gRNA sequence
gaaatgggaaaattccttct

SEQ ID NO: 174707 - DNA, 20 bp, Artificial
  CRISPR gRNA sequence
aaatgggaaaattccttctt

SEQ ID NO: 174708 - DNA, 20 bp, Artificial
  CRISPR gRNA sequence
cttcttaagtatctgtgctc

SEQ ID NO: 174709 - DNA, 20 bp, Artificial
  CRISPR gRNA sequence
cttaagtatctgtgctcagt

SEQ ID NO: 174710 - DNA, 20 bp, Artificial
  CRISPR gRNA sequence
ttaagtatctgtgctcagtt

SEQ ID NO: 174711 - DNA, 20 bp, Artificial
  CRISPR gRNA sequence
aagtatctgtgctcagttgt

SEQ ID NO: 174712 - DNA, 20 bp, Artificial
  CRISPR gRNA sequence
agtatctgtgctcagttgtg

SEQ ID NO: 174713 - DNA, 20 bp, Artificial
  CRISPR gRNA sequence
tgctcagttgtgcagtaacc

SEQ ID NO: 174714 - DNA, 20 bp, Artificial
  CRISPR gRNA sequence
agttgtgcagtaacctttgt

SEQ ID NO: 174715 - DNA, 20 bp, Artificial
  CRISPR gRNA sequence
tgcagtaacctttgtgcagt

SEQ ID NO: 174716 - DNA, 20 bp, Artificial
  CRISPR gRNA sequence
tgtgcagtaatccaatggaa

SEQ ID NO: 174717 - DNA, 20 bp, Artificial
  CRISPR gRNA sequence
gtgcagtaatccaatggaag

SEQ ID NO: 174718 - DNA, 20 bp, Artificial
  CRISPR gRNA sequence
tgcagtaatccaatggaaga

SEQ ID NO: 174719 - DNA, 20 bp, Artificial
  CRISPR gRNA sequence
gagaaaaacttgttctactt

SEQ ID NO: 174720 - DNA, 20 bp, Artificial
  CRISPR gRNA sequence
gttctactttggaaaatgta

SEQ ID NO: 174721 - DNA, 20 bp, Artificial
  CRISPR gRNA sequence
ttctactttggaaaatgtag

SEQ ID NO: 174722 - DNA, 20 bp, Artificial
  CRISPR gRNA sequence
tactttggaaaatgtagaca

SEQ ID NO: 174723 - DNA, 20 bp, Artificial
  CRISPR gRNA sequence
ctttggaaaatgtagacaat

SEQ ID NO: 174724 - DNA, 20 bp, Artificial
  CRISPR gRNA sequence
tggaaaatgtagacaattat

SEQ ID NO: 174725 - DNA, 20 bp, Artificial
  CRISPR gRNA sequence
ggaaaatgtagacaattatc

SEQ ID NO: 174726 - DNA, 20 bp, Artificial
  CRISPR gRNA sequence
gaaaatgtagacaattatct

SEQ ID NO: 174727 - DNA, 20 bp, Artificial
  CRISPR gRNA sequence
tctaatcatcggctccactg

SEQ ID NO: 174728 - DNA, 20 bp, Artificial
  CRISPR gRNA sequence
atcatcggctccactgaaaa

SEQ ID NO: 174729 - DNA, 20 bp, Artificial
  CRISPR gRNA sequence
cactgaaaaatgggagattg

SEQ ID NO: 174730 - DNA, 20 bp, Artificial
  CRISPR gRNA sequence
aaaaatgggagattgtgctg

SEQ ID NO: 174731 - DNA, 20 bp, Artificial
  CRISPR gRNA sequence
tgctggtgacttaatacatc

SEQ ID NO: 174732 - DNA, 20 bp, Artificial
  CRISPR gRNA sequence
gtgacttaatacatctaaaa

SEQ ID NO: 174733 - DNA, 20 bp, Artificial
  CRISPR gRNA sequence
aatacatctaaaaaccaggg

SEQ ID NO: 174734 - DNA, 20 bp, Artificial
  CRISPR gRNA sequence
atacatctaaaaaccagggg

SEQ ID NO: 174735 - DNA, 20 bp, Artificial
  CRISPR gRNA sequence
aaaaccaggggggtggtggg

SEQ ID NO: 174736 - DNA, 20 bp, Artificial
  CRISPR gRNA sequence
tcaattaaaaacctagaggg

SEQ ID NO: 174737 - DNA, 20 bp, Artificial
  CRISPR gRNA sequence
aaaacctagagggcgttata

SEQ ID NO: 174738 - DNA, 20 bp, Artificial
  CRISPR gRNA sequence
gagggcgttataataatgtc

SEQ ID NO: 174739 - DNA, 20 bp, Artificial
  CRISPR gRNA sequence
taataatgtcaatatgagct

SEQ ID NO: 174740 - DNA, 20 bp, Artificial
  CRISPR gRNA sequence
ggctgtattgattctgctgt

SEQ ID NO: 174741 - DNA, 20 bp, Artificial
  CRISPR gRNA sequence
gctgtattgattctgctgtc

SEQ ID NO: 174742 - DNA, 20 bp, Artificial
  CRISPR gRNA sequence
tattgattctgctgtctaga

SEQ ID NO: 174743 - DNA, 20 bp, Artificial
  CRISPR gRNA sequence
attctgctgtctagattctg

SEQ ID NO: 174744 - DNA, 20 bp, Artificial
  CRISPR gRNA sequence
tgctgtctagattctgctca

SEQ ID NO: 174745 - DNA, 20 bp, Artificial
  CRISPR gRNA sequence
ctgtctagattctgctcatt

SEQ ID NO: 174746 - DNA, 20 bp, Artificial
  CRISPR gRNA sequence
tctagattctgctcattcag

SEQ ID NO: 174747 - DNA, 20 bp, Artificial
  CRISPR gRNA sequence
gattctgctcattcagatac

SEQ ID NO: 174748 - DNA, 20 bp, Artificial
  CRISPR gRNA sequence
tgctcattcagatacactgt

SEQ ID NO: 174749 - DNA, 20 bp, Artificial
  CRISPR gRNA sequence
ctcattcagatacactgtga

SEQ ID NO: 174750 - DNA, 20 bp, Artificial
  CRISPR gRNA sequence
attcagatacactgtgaatt

SEQ ID NO: 174751 - DNA, 20 bp, Artificial
  CRISPR gRNA sequence
agatacactgtgaattcttc

SEQ ID NO: 174752 - DNA, 20 bp, Artificial
  CRISPR gRNA sequence
tgaattcttccctctgttta

SEQ ID NO: 174753 - DNA, 20 bp, Artificial
  CRISPR gRNA sequence
ttccctctgtttagtgtctt

SEQ ID NO: 174754 - DNA, 20 bp, Artificial
  CRISPR gRNA sequence
ccctctgtttagtgtctttt

SEQ ID NO: 174755 - DNA, 20 bp, Artificial
  CRISPR gRNA sequence
cctctgtttagtgtctttta

SEQ ID NO: 174756 - DNA, 20 bp, Artificial
  CRISPR gRNA sequence
tgtttagtgtcttttattga

SEQ ID NO: 174757 - DNA, 20 bp, Artificial
  CRISPR gRNA sequence
tttagtgtcttttattgatt

SEQ ID NO: 174758 - DNA, 20 bp, Artificial
  CRISPR gRNA sequence
agtgtcttttattgatttaa

SEQ ID NO: 174759 - DNA, 20 bp, Artificial
  CRISPR gRNA sequence
gtgtcttttattgatttaaa

SEQ ID NO: 174760 - DNA, 20 bp, Artificial
  CRISPR gRNA sequence
ttattgatttaaatgtttaa

SEQ ID NO: 174761 - DNA, 20 bp, Artificial
  CRISPR gRNA sequence
tattgatttaaatgtttaaa

SEQ ID NO: 174762 - DNA, 20 bp, Artificial
  CRISPR gRNA sequence
attgatttaaatgtttaaaa

SEQ ID NO: 174763 - DNA, 20 bp, Artificial
  CRISPR gRNA sequence
ttgatttaaatgtttaaaag

SEQ ID NO: 174764 - DNA, 20 bp, Artificial
  CRISPR gRNA sequence
atttaaatgtttaaaagagg

SEQ ID NO: 174765 - DNA, 20 bp, Artificial
  CRISPR gRNA sequence
aaatgtttaaaagaggagaa

SEQ ID NO: 174766 - DNA, 20 bp, Artificial
  CRISPR gRNA sequence
aatgtttaaaagaggagaag

SEQ ID NO: 174767 - DNA, 20 bp, Artificial
  CRISPR gRNA sequence
aaaagaggagaagaaagaaa

SEQ ID NO: 174768 - DNA, 20 bp, Artificial
  CRISPR gRNA sequence
aaagaggagaagaaagaaag

SEQ ID NO: 174769 - DNA, 20 bp, Artificial
  CRISPR gRNA sequence
ccaagccaaccaaaccataa

SEQ ID NO: 174770 - DNA, 20 bp, Artificial
  CRISPR gRNA sequence
caagccaaccaaaccataaa

SEQ ID NO: 174771 - DNA, 20 bp, Artificial
  CRISPR gRNA sequence
ttaacttcatgtatacagct

SEQ ID NO: 174772 - DNA, 20 bp, Artificial
  CRISPR gRNA sequence
aacttcatgtatacagctgt

SEQ ID NO: 174773 - DNA, 20 bp, Artificial
  CRISPR gRNA sequence
acttcatgtatacagctgtc

SEQ ID NO: 174774 - DNA, 20 bp, Artificial
  CRISPR gRNA sequence
catgtatacagctgtcagga

SEQ ID NO: 174775 - DNA, 20 bp, Artificial
  CRISPR gRNA sequence
atgtatacagctgtcaggaa

SEQ ID NO: 174776 - DNA, 20 bp, Artificial
  CRISPR gRNA sequence
tcaggaactgagaacataaa

SEQ ID NO: 174777 - DNA, 20 bp, Artificial
  CRISPR gRNA sequence
agaacataaagacctcttca

SEQ ID NO: 174778 - DNA, 20 bp, Artificial
  CRISPR gRNA sequence
ttcaaagagggcaaagtgac

SEQ ID NO: 174779 - DNA, 20 bp, Artificial
  CRISPR gRNA sequence
caaagagggcaaagtgactg

SEQ ID NO: 174780 - DNA, 20 bp, Artificial
  CRISPR gRNA sequence
aaagagggcaaagtgactga

SEQ ID NO: 174781 - DNA, 20 bp, Artificial
  CRISPR gRNA sequence
agatagttatgctaatccct

SEQ ID NO: 174782 - DNA, 20 bp, Artificial
  CRISPR gRNA sequence
tgctaatcccttacatttgt

SEQ ID NO: 174783 - DNA, 20 bp, Artificial
  CRISPR gRNA sequence
atcccttacatttgtacata

SEQ ID NO: 174784 - DNA, 20 bp, Artificial
  CRISPR gRNA sequence
acatttgtacatactttaca

SEQ ID NO: 174785 - DNA, 20 bp, Artificial
  CRISPR gRNA sequence
catttgtacatactttacac

SEQ ID NO: 174786 - DNA, 20 bp, Artificial
  CRISPR gRNA sequence
gtacatactttacacttctt

SEQ ID NO: 174787 - DNA, 20 bp, Artificial
  CRISPR gRNA sequence
tacatactttacacttctta

SEQ ID NO: 174788 - DNA, 20 bp, Artificial
  CRISPR gRNA sequence
tacacttcttaaagtagttt

SEQ ID NO: 174789 - DNA, 20 bp, Artificial
  CRISPR gRNA sequence
acacttcttaaagtagtttc

SEQ ID NO: 174790 - DNA, 20 bp, Artificial
  CRISPR gRNA sequence
cacttcttaaagtagtttca

SEQ ID NO: 174791 - DNA, 20 bp, Artificial
  CRISPR gRNA sequence
cttaaagtagtttcatgtta

SEQ ID NO: 174792 - DNA, 20 bp, Artificial
  CRISPR gRNA sequence
ttaaagtagtttcatgttat

SEQ ID NO: 174793 - DNA, 20 bp, Artificial
  CRISPR gRNA sequence
aaagtagtttcatgttattt

SEQ ID NO: 174794 - DNA, 20 bp, Artificial
  CRISPR gRNA sequence
aagtagtttcatgttatttt

SEQ ID NO: 174795 - DNA, 20 bp, Artificial
  CRISPR gRNA sequence
catgttattttatgtgtttc

SEQ ID NO: 174796 - DNA, 20 bp, Artificial
  CRISPR gRNA sequence
atgttattttatgtgtttct

SEQ ID NO: 174797 - DNA, 20 bp, Artificial
  CRISPR gRNA sequence
ttttatgtgtttctcaccat

SEQ ID NO: 174798 - DNA, 20 bp, Artificial
  CRISPR gRNA sequence
tatgtgtttctcaccataaa

SEQ ID NO: 174799 - DNA, 20 bp, Artificial
  CRISPR gRNA sequence
atgtgtttctcaccataaac

SEQ ID NO: 174800 - DNA, 20 bp, Artificial
  CRISPR gRNA sequence
tgtgtttctcaccataaaca

SEQ ID NO: 174801 - DNA, 20 bp, Artificial
  CRISPR gRNA sequence
ctcaccataaacacataaga

SEQ ID NO: 174802 - DNA, 20 bp, Artificial
  CRISPR gRNA sequence
tcaccataaacacataagat

SEQ ID NO: 174803 - DNA, 20 bp, Artificial
  CRISPR gRNA sequence
accataaacacataagataa

SEQ ID NO: 174804 - DNA, 20 bp, Artificial
  CRISPR gRNA sequence
acagataaagatactttatc

SEQ ID NO: 174805 - DNA, 20 bp, Artificial
  CRISPR gRNA sequence
tatccaggtggactgaggaa

SEQ ID NO: 174806 - DNA, 20 bp, Artificial
  CRISPR gRNA sequence
atccaggtggactgaggaac

SEQ ID NO: 174807 - DNA, 20 bp, Artificial
  CRISPR gRNA sequence
tccaggtggactgaggaact

SEQ ID NO: 174808 - DNA, 20 bp, Artificial
  CRISPR gRNA sequence
aggaacttggcagaattcac

SEQ ID NO: 174809 - DNA, 20 bp, Artificial
  CRISPR gRNA sequence
ggcagaattcaccaggacaa

SEQ ID NO: 174810 - DNA, 20 bp, Artificial
  CRISPR gRNA sequence
gcagaattcaccaggacaag

SEQ ID NO: 174811 - DNA, 20 bp, Artificial
  CRISPR gRNA sequence
accaggacaagtatatgcca

SEQ ID NO: 174812 - DNA, 20 bp, Artificial
  CRISPR gRNA sequence
aaattcatgtcttctgattc

SEQ ID NO: 174813 - DNA, 20 bp, Artificial
  CRISPR gRNA sequence
atgtcttctgattctcagtt

SEQ ID NO: 174814 - DNA, 20 bp, Artificial
  CRISPR gRNA sequence
ctgattctcagttctgtgct

SEQ ID NO: 174815 - DNA, 20 bp, Artificial
  CRISPR gRNA sequence
tgattctcagttctgtgctc

SEQ ID NO: 174816 - DNA, 20 bp, Artificial
  CRISPR gRNA sequence
attctcagttctgtgctctt

SEQ ID NO: 174817 - DNA, 20 bp, Artificial
  CRISPR gRNA sequence
tcagttctgtgctctttcat

SEQ ID NO: 174818 - DNA, 20 bp, Artificial
  CRISPR gRNA sequence
agttctgtgctctttcatta

SEQ ID NO: 174819 - DNA, 20 bp, Artificial
  CRISPR gRNA sequence
tgtgctctttcattaaatct

SEQ ID NO: 174820 - DNA, 20 bp, Artificial
  CRISPR gRNA sequence
tgctctttcattaaatcttc

SEQ ID NO: 174821 - DNA, 20 bp, Artificial
  CRISPR gRNA sequence
tttcattaaatcttctcctt

SEQ ID NO: 174822 - DNA, 20 bp, Artificial
  CRISPR gRNA sequence
tcattaaatcttctccttct

SEQ ID NO: 174823 - DNA, 20 bp, Artificial
  CRISPR gRNA sequence
cattaaatcttctccttcta

SEQ ID NO: 174824 - DNA, 20 bp, Artificial
  CRISPR gRNA sequence
attaaatcttctccttctac

SEQ ID NO: 174825 - DNA, 20 bp, Artificial
  CRISPR gRNA sequence
aatcttctccttctacttta

SEQ ID NO: 174826 - DNA, 20 bp, Artificial
  CRISPR gRNA sequence
ctccttctactttagaattg

SEQ ID NO: 174827 - DNA, 20 bp, Artificial
  CRISPR gRNA sequence
tccttctactttagaattga

SEQ ID NO: 174828 - DNA, 20 bp, Artificial
  CRISPR gRNA sequence
cttctactttagaattgata

SEQ ID NO: 174829 - DNA, 20 bp, Artificial
  CRISPR gRNA sequence
ctactttagaattgataaca

SEQ ID NO: 174830 - DNA, 20 bp, Artificial
  CRISPR gRNA sequence
tactttagaattgataacaa

SEQ ID NO: 174831 - DNA, 20 bp, Artificial
  CRISPR gRNA sequence
ctttagaattgataacaaca

SEQ ID NO: 174832 - DNA, 20 bp, Artificial
  CRISPR gRNA sequence
tagaattgataacaacagaa

SEQ ID NO: 174833 - DNA, 20 bp, Artificial
  CRISPR gRNA sequence
agaattgataacaacagaaa

SEQ ID NO: 174834 - DNA, 20 bp, Artificial
  CRISPR gRNA sequence
gaattgataacaacagaaaa

SEQ ID NO: 174835 - DNA, 20 bp, Artificial
  CRISPR gRNA sequence
ataacaacagaaaacacaaa

SEQ ID NO: 174836 - DNA, 20 bp, Artificial
  CRISPR gRNA sequence
aagaacctatagcttttctc

SEQ ID NO: 174837 - DNA, 20 bp, Artificial
  CRISPR gRNA sequence
agaacctatagcttttctca

SEQ ID NO: 174838 - DNA, 20 bp, Artificial
  CRISPR gRNA sequence
tagcttttctcagcctggaa

SEQ ID NO: 174839 - DNA, 20 bp, Artificial
  CRISPR gRNA sequence
ttctcagcctggaacacaaa

SEQ ID NO: 174840 - DNA, 20 bp, Artificial
  CRISPR gRNA sequence
tctcagcctggaacacaaat

SEQ ID NO: 174841 - DNA, 20 bp, Artificial
  CRISPR gRNA sequence
ctcagcctggaacacaaatc

SEQ ID NO: 174842 - DNA, 20 bp, Artificial
  CRISPR gRNA sequence
tcagcctggaacacaaatcc

SEQ ID NO: 174843 - DNA, 20 bp, Artificial
  CRISPR gRNA sequence
agcctggaacacaaatccac

SEQ ID NO: 174844 - DNA, 20 bp, Artificial
  CRISPR gRNA sequence
gaacacaaatccaccaggcc

SEQ ID NO: 174845 - DNA, 20 bp, Artificial
  CRISPR gRNA sequence
tttacctttcgttttcctga

SEQ ID NO: 174846 - DNA, 20 bp, Artificial
  CRISPR gRNA sequence
ttacctttcgttttcctgat

SEQ ID NO: 174847 - DNA, 20 bp, Artificial
  CRISPR gRNA sequence
tacctttcgttttcctgatc

SEQ ID NO: 174848 - DNA, 20 bp, Artificial
  CRISPR gRNA sequence
acctttcgttttcctgatca

SEQ ID NO: 174849 - DNA, 20 bp, Artificial
  CRISPR gRNA sequence
cctttcgttttcctgatcac

SEQ ID NO: 174850 - DNA, 20 bp, Artificial
  CRISPR gRNA sequence
tcgttttcctgatcactctc

SEQ ID NO: 174851 - DNA, 20 bp, Artificial
  CRISPR gRNA sequence
cgttttcctgatcactctcc

SEQ ID NO: 174852 - DNA, 20 bp, Artificial
  CRISPR gRNA sequence
gttttcctgatcactctcct

SEQ ID NO: 174853 - DNA, 20 bp, Artificial
  CRISPR gRNA sequence
tcctgatcactctcctgaaa

SEQ ID NO: 174854 - DNA, 20 bp, Artificial
  CRISPR gRNA sequence
cctgatcactctcctgaaaa

SEQ ID NO: 174855 - DNA, 20 bp, Artificial
  CRISPR gRNA sequence
ctgatcactctcctgaaaaa

SEQ ID NO: 174856 - DNA, 20 bp, Artificial
  CRISPR gRNA sequence
atcactctcctgaaaaaagt

SEQ ID NO: 174857 - DNA, 20 bp, Artificial
  CRISPR gRNA sequence
tcctgaaaaaagtactccaa

SEQ ID NO: 174858 - DNA, 20 bp, Artificial
  CRISPR gRNA sequence
ctgaaaaaagtactccaaaa

SEQ ID NO: 174859 - DNA, 20 bp, Artificial
  CRISPR gRNA sequence
aaaaaagtactccaaaaaaa

SEQ ID NO: 174860 - DNA, 20 bp, Artificial
  CRISPR gRNA sequence
caaaaaaatcaagataccag

SEQ ID NO: 174861 - DNA, 20 bp, Artificial
  CRISPR gRNA sequence
ttaaacatttcaaagtagaa

SEQ ID NO: 174862 - DNA, 20 bp, Artificial
  CRISPR gRNA sequence
aaacatttcaaagtagaaag

SEQ ID NO: 174863 - DNA, 20 bp, Artificial
  CRISPR gRNA sequence
aacatttcaaagtagaaagc

SEQ ID NO: 174864 - DNA, 20 bp, Artificial
  CRISPR gRNA sequence
caaagtagaaagcttaaaca

SEQ ID NO: 174865 - DNA, 20 bp, Artificial
  CRISPR gRNA sequence
aaagtagaaagcttaaacaa

SEQ ID NO: 174866 - DNA, 20 bp, Artificial
  CRISPR gRNA sequence
aaacaagaaagcttaaggtt

SEQ ID NO: 174867 - DNA, 20 bp, Artificial
  CRISPR gRNA sequence
aacaagaaagcttaaggttt

SEQ ID NO: 174868 - DNA, 20 bp, Artificial
  CRISPR gRNA sequence
aaggttttcaagcttgctaa

SEQ ID NO: 174869 - DNA, 20 bp, Artificial
  CRISPR gRNA sequence
aggttttcaagcttgctaaa

SEQ ID NO: 174870 - DNA, 20 bp, Artificial
  CRISPR gRNA sequence
tcaagcttgctaaactgcag

SEQ ID NO: 174871 - DNA, 20 bp, Artificial
  CRISPR gRNA sequence
caagcttgctaaactgcagt

SEQ ID NO: 174872 - DNA, 20 bp, Artificial
  CRISPR gRNA sequence
aagcttgctaaactgcagtt

SEQ ID NO: 174873 - DNA, 20 bp, Artificial
  CRISPR gRNA sequence
gctaaactgcagttgcatca

SEQ ID NO: 174874 - DNA, 20 bp, Artificial
  CRISPR gRNA sequence
ctaaactgcagttgcatcaa

SEQ ID NO: 174875 - DNA, 20 bp, Artificial
  CRISPR gRNA sequence
aactgcagttgcatcaaagg

SEQ ID NO: 174876 - DNA, 20 bp, Artificial
  CRISPR gRNA sequence
cagttgcatcaaaggagtgg

SEQ ID NO: 174877 - DNA, 20 bp, Artificial
  CRISPR gRNA sequence
catcaaaggagtgggactag

SEQ ID NO: 174878 - DNA, 20 bp, Artificial
  CRISPR gRNA sequence
ggccatctagctaccaaaca

SEQ ID NO: 174879 - DNA, 20 bp, Artificial
  CRISPR gRNA sequence
gctaccaaacaaaagtggag

SEQ ID NO: 174880 - DNA, 20 bp, Artificial
  CRISPR gRNA sequence
ccaaacaaaagtggagatag

SEQ ID NO: 174881 - DNA, 20 bp, Artificial
  CRISPR gRNA sequence
actttctgggggcctggtga

SEQ ID NO: 174882 - DNA, 20 bp, Artificial
  CRISPR gRNA sequence
tctgggggcctggtgatggg

SEQ ID NO: 174883 - DNA, 20 bp, Artificial
  CRISPR gRNA sequence
ctgggggcctggtgatggga

SEQ ID NO: 174884 - DNA, 20 bp, Artificial
  CRISPR gRNA sequence
tgggggcctggtgatgggaa

SEQ ID NO: 174885 - DNA, 20 bp, Artificial
  CRISPR gRNA sequence
ggggcctggtgatgggaagt

SEQ ID NO: 174886 - DNA, 20 bp, Artificial
  CRISPR gRNA sequence
gtgatgggaagtcactctat

SEQ ID NO: 174887 - DNA, 20 bp, Artificial
  CRISPR gRNA sequence
tatcctttctctataattca

SEQ ID NO: 174888 - DNA, 20 bp, Artificial
  CRISPR gRNA sequence
tcctttctctataattcaga

SEQ ID NO: 174889 - DNA, 20 bp, Artificial
  CRISPR gRNA sequence
tctctataattcagaagaag

SEQ ID NO: 174890 - DNA, 20 bp, Artificial
  CRISPR gRNA sequence
ctctataattcagaagaaga

SEQ ID NO: 174891 - DNA, 20 bp, Artificial
  CRISPR gRNA sequence
tctataattcagaagaagag

SEQ ID NO: 174892 - DNA, 20 bp, Artificial
  CRISPR gRNA sequence
tataattcagaagaagagcc

SEQ ID NO: 174893 - DNA, 20 bp, Artificial
  CRISPR gRNA sequence
taattcagaagaagagcctt

SEQ ID NO: 174894 - DNA, 20 bp, Artificial
  CRISPR gRNA sequence
agaagaagagccttagccca

SEQ ID NO: 174895 - DNA, 20 bp, Artificial
  CRISPR gRNA sequence
agcccagcctcctatattgg

SEQ ID NO: 174896 - DNA, 20 bp, Artificial
  CRISPR gRNA sequence
gcccagcctcctatattgga

SEQ ID NO: 174897 - DNA, 20 bp, Artificial
  CRISPR gRNA sequence
ctatattggagatgttttca

SEQ ID NO: 174898 - DNA, 20 bp, Artificial
  CRISPR gRNA sequence
tattggagatgttttcatag

SEQ ID NO: 174899 - DNA, 20 bp, Artificial
  CRISPR gRNA sequence
gagatgttttcatagctgcc

SEQ ID NO: 174900 - DNA, 20 bp, Artificial
  CRISPR gRNA sequence
tcatagctgcccacttatag

SEQ ID NO: 174901 - DNA, 20 bp, Artificial
  CRISPR gRNA sequence
catagctgcccacttatagg

SEQ ID NO: 174902 - DNA, 20 bp, Artificial
  CRISPR gRNA sequence
atagctgcccacttatagga

SEQ ID NO: 174903 - DNA, 20 bp, Artificial
  CRISPR gRNA sequence
cccacttataggaggaatca

SEQ ID NO: 174904 - DNA, 20 bp, Artificial
  CRISPR gRNA sequence
ataggaggaatcacctggct

SEQ ID NO: 174905 - DNA, 20 bp, Artificial
  CRISPR gRNA sequence
taggaggaatcacctggcta

SEQ ID NO: 174906 - DNA, 20 bp, Artificial
  CRISPR gRNA sequence
gctaaattctatgcagtgtt

SEQ ID NO: 174907 - DNA, 20 bp, Artificial
  CRISPR gRNA sequence
aattctatgcagtgtttcaa

SEQ ID NO: 174908 - DNA, 20 bp, Artificial
  CRISPR gRNA sequence
tatgcagtgtttcaaaatta

SEQ ID NO: 174909 - DNA, 20 bp, Artificial
  CRISPR gRNA sequence
tgcagtgtttcaaaattata

SEQ ID NO: 174910 - DNA, 20 bp, Artificial
  CRISPR gRNA sequence
caaaattatagctatcgcta

SEQ ID NO: 174911 - DNA, 20 bp, Artificial
  CRISPR gRNA sequence
aaaattatagctatcgctac

SEQ ID NO: 174912 - DNA, 20 bp, Artificial
  CRISPR gRNA sequence
tagctatcgctacattgtga

SEQ ID NO: 174913 - DNA, 20 bp, Artificial
  CRISPR gRNA sequence
tcgctacattgtgaacatgg

SEQ ID NO: 174914 - DNA, 20 bp, Artificial
  CRISPR gRNA sequence
cattgtgaacatggtgataa

SEQ ID NO: 174915 - DNA, 20 bp, Artificial
  CRISPR gRNA sequence
tgaacatggtgataatgtta

SEQ ID NO: 174916 - DNA, 20 bp, Artificial
  CRISPR gRNA sequence
ttttaattatccagccattc

SEQ ID NO: 174917 - DNA, 20 bp, Artificial
  CRISPR gRNA sequence
taattatccagccattcctc

SEQ ID NO: 174918 - DNA, 20 bp, Artificial
  CRISPR gRNA sequence
aattatccagccattcctcc

SEQ ID NO: 174919 - DNA, 20 bp, Artificial
  CRISPR gRNA sequence
attatccagccattcctcca

SEQ ID NO: 174920 - DNA, 20 bp, Artificial
  CRISPR gRNA sequence
tccagccattcctccaagaa

SEQ ID NO: 174921 - DNA, 20 bp, Artificial
  CRISPR gRNA sequence
ctccaagaaatcagaattcc

SEQ ID NO: 174922 - DNA, 20 bp, Artificial
  CRISPR gRNA sequence
caagaaatcagaattccttt

SEQ ID NO: 174923 - DNA, 20 bp, Artificial
  CRISPR gRNA sequence
ctttgttccacctcactagg

SEQ ID NO: 174924 - DNA, 20 bp, Artificial
  CRISPR gRNA sequence
tgttccacctcactaggggt

SEQ ID NO: 174925 - DNA, 20 bp, Artificial
  CRISPR gRNA sequence
gttccacctcactaggggta

SEQ ID NO: 174926 - DNA, 20 bp, Artificial
  CRISPR gRNA sequence
ttccacctcactaggggtaa

SEQ ID NO: 174927 - DNA, 20 bp, Artificial
  CRISPR gRNA sequence
cacctcactaggggtaagca

SEQ ID NO: 174928 - DNA, 20 bp, Artificial
  CRISPR gRNA sequence
actaggggtaagcaaggatt

SEQ ID NO: 174929 - DNA, 20 bp, Artificial
  CRISPR gRNA sequence
ggggtaagcaaggattataa

SEQ ID NO: 174930 - DNA, 20 bp, Artificial
  CRISPR gRNA sequence
taaatcatagctaggaaatt

SEQ ID NO: 174931 - DNA, 20 bp, Artificial
  CRISPR gRNA sequence
ggaaatttaaagcaacggat

SEQ ID NO: 174932 - DNA, 20 bp, Artificial
  CRISPR gRNA sequence
aaagcaacggattatttaag

SEQ ID NO: 174933 - DNA, 20 bp, Artificial
  CRISPR gRNA sequence
aagcaacggattatttaaga

SEQ ID NO: 174934 - DNA, 20 bp, Artificial
  CRISPR gRNA sequence
tttaagaacaccatgggcca

SEQ ID NO: 174935 - DNA, 20 bp, Artificial
  CRISPR gRNA sequence
aagaacaccatgggccaggc

SEQ ID NO: 174936 - DNA, 20 bp, Artificial
  CRISPR gRNA sequence
agaacaccatgggccaggcg

SEQ ID NO: 174937 - DNA, 20 bp, Artificial
  CRISPR gRNA sequence
acgcctgtaatcccagcact

SEQ ID NO: 174938 - DNA, 20 bp, Artificial
  CRISPR gRNA sequence
taatcccagcactttgggag

SEQ ID NO: 174939 - DNA, 20 bp, Artificial
  CRISPR gRNA sequence
tgggaggctgaggcgggcag

SEQ ID NO: 174940 - DNA, 20 bp, Artificial
  CRISPR gRNA sequence
gggaggctgaggcgggcaga

SEQ ID NO: 174941 - DNA, 20 bp, Artificial
  CRISPR gRNA sequence
ggaggctgaggcgggcagat

SEQ ID NO: 174942 - DNA, 20 bp, Artificial
  CRISPR gRNA sequence
aggcgggcagatcacgaggt

SEQ ID NO: 174943 - DNA, 20 bp, Artificial
  CRISPR gRNA sequence
gccaacatggtgaaaccccg

SEQ ID NO: 174944 - DNA, 20 bp, Artificial
  CRISPR gRNA sequence
tactaaaaatacaaaaatta

SEQ ID NO: 174945 - DNA, 20 bp, Artificial
  CRISPR gRNA sequence
ctaaaaatacaaaaattagc

SEQ ID NO: 174946 - DNA, 20 bp, Artificial
  CRISPR gRNA sequence
aaaatacaaaaattagctgg

SEQ ID NO: 174947 - DNA, 20 bp, Artificial
  CRISPR gRNA sequence
gctgggcgtggtggcgcaca

SEQ ID NO: 174948 - DNA, 20 bp, Artificial
  CRISPR gRNA sequence
ggcgtggtggcgcacatctg

SEQ ID NO: 174949 - DNA, 20 bp, Artificial
  CRISPR gRNA sequence
tagtcccagctactcgggag

SEQ ID NO: 174950 - DNA, 20 bp, Artificial
  CRISPR gRNA sequence
ctcgggaggctgaggcagga

SEQ ID NO: 174951 - DNA, 20 bp, Artificial
  CRISPR gRNA sequence
gggaggctgaggcaggagaa

SEQ ID NO: 174952 - DNA, 20 bp, Artificial
  CRISPR gRNA sequence
aggcaggagaatcgcttgaa

SEQ ID NO: 174953 - DNA, 20 bp, Artificial
  CRISPR gRNA sequence
gaacctgggaggcagaggtt

SEQ ID NO: 174954 - DNA, 20 bp, Artificial
  CRISPR gRNA sequence
aacctgggaggcagaggttg

SEQ ID NO: 174955 - DNA, 20 bp, Artificial
  CRISPR gRNA sequence
ggaggcagaggttgcagtga

SEQ ID NO: 174956 - DNA, 20 bp, Artificial
  CRISPR gRNA sequence
cagtgagccaagatcgtgcc

SEQ ID NO: 174957 - DNA, 20 bp, Artificial
  CRISPR gRNA sequence
cactccagcctggcgacaga

SEQ ID NO: 174958 - DNA, 20 bp, Artificial
  CRISPR gRNA sequence
cagcctggcgacagagcaag

SEQ ID NO: 174959 - DNA, 20 bp, Artificial
  CRISPR gRNA sequence
gcgacagagcaagactccgt

SEQ ID NO: 174960 - DNA, 20 bp, Artificial
  CRISPR gRNA sequence
cgtctcaaaaacaaaacaaa

SEQ ID NO: 174961 - DNA, 20 bp, Artificial
  CRISPR gRNA sequence
aaaaacaaaacaaaacaaaa

SEQ ID NO: 174962 - DNA, 20 bp, Artificial
  CRISPR gRNA sequence
atctaaaaatatcgatctct

SEQ ID NO: 174963 - DNA, 20 bp, Artificial
  CRISPR gRNA sequence
aaaatatcgatctctatgtt

SEQ ID NO: 174964 - DNA, 20 bp, Artificial
  CRISPR gRNA sequence
tatgtttcaagatgagaacc

SEQ ID NO: 174965 - DNA, 20 bp, Artificial
  CRISPR gRNA sequence
tgtttcaagatgagaaccca

SEQ ID NO: 174966 - DNA, 20 bp, Artificial
  CRISPR gRNA sequence
caagatgagaacccaaatgt

SEQ ID NO: 174967 - DNA, 20 bp, Artificial
  CRISPR gRNA sequence
aagatgagaacccaaatgtg

SEQ ID NO: 174968 - DNA, 20 bp, Artificial
  CRISPR gRNA sequence
cctcaatacataccacaaag

SEQ ID NO: 174969 - DNA, 20 bp, Artificial
  CRISPR gRNA sequence
aatacataccacaaagtatg

SEQ ID NO: 174970 - DNA, 20 bp, Artificial
  CRISPR gRNA sequence
catagctaaggaataccata

SEQ ID NO: 174971 - DNA, 20 bp, Artificial
  CRISPR gRNA sequence
aggaataccatagaatacct

SEQ ID NO: 174972 - DNA, 20 bp, Artificial
  CRISPR gRNA sequence
atacaattctaaccacatat

SEQ ID NO: 174973 - DNA, 20 bp, Artificial
  CRISPR gRNA sequence
taaccacatatctatttgga

SEQ ID NO: 174974 - DNA, 20 bp, Artificial
  CRISPR gRNA sequence
accacatatctatttggaaa

SEQ ID NO: 174975 - DNA, 20 bp, Artificial
  CRISPR gRNA sequence
tttggaaaaaatccttcaac

SEQ ID NO: 174976 - DNA, 20 bp, Artificial
  CRISPR gRNA sequence
ggaaaaaatccttcaactac

SEQ ID NO: 174977 - DNA, 20 bp, Artificial
  CRISPR gRNA sequence
gaaaaaatccttcaactact

SEQ ID NO: 174978 - DNA, 20 bp, Artificial
  CRISPR gRNA sequence
caactacttacctgacctta

SEQ ID NO: 174979 - DNA, 20 bp, Artificial
  CRISPR gRNA sequence
aactacttacctgaccttag

SEQ ID NO: 174980 - DNA, 20 bp, Artificial
  CRISPR gRNA sequence
cttacctgaccttagtgaat

SEQ ID NO: 174981 - DNA, 20 bp, Artificial
  CRISPR gRNA sequence
acctgaccttagtgaattta

SEQ ID NO: 174982 - DNA, 20 bp, Artificial
  CRISPR gRNA sequence
cctgaccttagtgaatttag

SEQ ID NO: 174983 - DNA, 20 bp, Artificial
  CRISPR gRNA sequence
accttagtgaatttaggatt

SEQ ID NO: 174984 - DNA, 20 bp, Artificial
  CRISPR gRNA sequence
agtgaatttaggattcatta

SEQ ID NO: 174985 - DNA, 20 bp, Artificial
  CRISPR gRNA sequence
gtgaatttaggattcattaa

SEQ ID NO: 174986 - DNA, 20 bp, Artificial
  CRISPR gRNA sequence
aggattcattaaagacaatt

SEQ ID NO: 174987 - DNA, 20 bp, Artificial
  CRISPR gRNA sequence
ggattcattaaagacaattt

SEQ ID NO: 174988 - DNA, 20 bp, Artificial
  CRISPR gRNA sequence
attaaagacaatttccaaaa

SEQ ID NO: 174989 - DNA, 20 bp, Artificial
  CRISPR gRNA sequence
aagacaatttccaaaatact

SEQ ID NO: 174990 - DNA, 20 bp, Artificial
  CRISPR gRNA sequence
ccaaaatactggtagtgctc

SEQ ID NO: 174991 - DNA, 20 bp, Artificial
  CRISPR gRNA sequence
caaaatactggtagtgctca

SEQ ID NO: 174992 - DNA, 20 bp, Artificial
  CRISPR gRNA sequence
gtagtgctcaattgttatct

SEQ ID NO: 174993 - DNA, 20 bp, Artificial
  CRISPR gRNA sequence
aattgttatctacttgtacc

SEQ ID NO: 174994 - DNA, 20 bp, Artificial
  CRISPR gRNA sequence
ttatctacttgtaccatgct

SEQ ID NO: 174995 - DNA, 20 bp, Artificial
  CRISPR gRNA sequence
tctacttgtaccatgctttg

SEQ ID NO: 174996 - DNA, 20 bp, Artificial
  CRISPR gRNA sequence
cttgtaccatgctttgttcc

SEQ ID NO: 174997 - DNA, 20 bp, Artificial
  CRISPR gRNA sequence
gtaccatgctttgttccaaa

SEQ ID NO: 174998 - DNA, 20 bp, Artificial
  CRISPR gRNA sequence
taccatgctttgttccaaaa

SEQ ID NO: 174999 - DNA, 20 bp, Artificial
  CRISPR gRNA sequence
tgttccaaaaagtgaccgtg

SEQ ID NO: 175000 - DNA, 20 bp, Artificial
  CRISPR gRNA sequence
gttccaaaaagtgaccgtgt

SEQ ID NO: 175001 - DNA, 20 bp, Artificial
  CRISPR gRNA sequence
ttccaaaaagtgaccgtgtt

SEQ ID NO: 175002 - DNA, 20 bp, Artificial
  CRISPR gRNA sequence
caaaaagtgaccgtgttcac

SEQ ID NO: 175003 - DNA, 20 bp, Artificial
  CRISPR gRNA sequence
acctattttaacaaacactt

SEQ ID NO: 175004 - DNA, 20 bp, Artificial
  CRISPR gRNA sequence
ttttaacaaacactttaaag

SEQ ID NO: 175005 - DNA, 20 bp, Artificial
  CRISPR gRNA sequence
taacaaacactttaaaggta

SEQ ID NO: 175006 - DNA, 20 bp, Artificial
  CRISPR gRNA sequence
aacaaacactttaaaggtaa

SEQ ID NO: 175007 - DNA, 20 bp, Artificial
  CRISPR gRNA sequence
acaaacactttaaaggtaat

SEQ ID NO: 175008 - DNA, 20 bp, Artificial
  CRISPR gRNA sequence
taaaggtaattcaatttgac

SEQ ID NO: 175009 - DNA, 20 bp, Artificial
  CRISPR gRNA sequence
aaaggtaattcaatttgact

SEQ ID NO: 175010 - DNA, 20 bp, Artificial
  CRISPR gRNA sequence
aaggtaattcaatttgactg

SEQ ID NO: 175011 - DNA, 20 bp, Artificial
  CRISPR gRNA sequence
aatttgactgtatgtttgtt

SEQ ID NO: 175012 - DNA, 20 bp, Artificial
  CRISPR gRNA sequence
gactgtatgtttgttccctt

SEQ ID NO: 175013 - DNA, 20 bp, Artificial
  CRISPR gRNA sequence
actgtatgtttgttcccttt

SEQ ID NO: 175014 - DNA, 20 bp, Artificial
  CRISPR gRNA sequence
tatgtttgttccctttacga

SEQ ID NO: 175015 - DNA, 20 bp, Artificial
  CRISPR gRNA sequence
gttccctttacgattagcct

SEQ ID NO: 175016 - DNA, 20 bp, Artificial
  CRISPR gRNA sequence
ttccctttacgattagcctg

SEQ ID NO: 175017 - DNA, 20 bp, Artificial
  CRISPR gRNA sequence
cctttacgattagcctgtta

SEQ ID NO: 175018 - DNA, 20 bp, Artificial
  CRISPR gRNA sequence
tacgattagcctgttaagca

SEQ ID NO: 175019 - DNA, 20 bp, Artificial
  CRISPR gRNA sequence
acgattagcctgttaagcag

SEQ ID NO: 175020 - DNA, 20 bp, Artificial
  CRISPR gRNA sequence
cgattagcctgttaagcagt

SEQ ID NO: 175021 - DNA, 20 bp, Artificial
  CRISPR gRNA sequence
gcctgttaagcagtctataa

SEQ ID NO: 175022 - DNA, 20 bp, Artificial
  CRISPR gRNA sequence
ttaagcagtctataatatga

SEQ ID NO: 175023 - DNA, 20 bp, Artificial
  CRISPR gRNA sequence
agcagtctataatatgagag

SEQ ID NO: 175024 - DNA, 20 bp, Artificial
  CRISPR gRNA sequence
taatatgagagttgatgaga

SEQ ID NO: 175025 - DNA, 20 bp, Artificial
  CRISPR gRNA sequence
atgagaactctgggaaagtt

SEQ ID NO: 175026 - DNA, 20 bp, Artificial
  CRISPR gRNA sequence
tgggaaagttctgtgccttt

SEQ ID NO: 175027 - DNA, 20 bp, Artificial
  CRISPR gRNA sequence
ggaaagttctgtgcctttca

SEQ ID NO: 175028 - DNA, 20 bp, Artificial
  CRISPR gRNA sequence
tgtgcctttcaggggagaag

SEQ ID NO: 175029 - DNA, 20 bp, Artificial
  CRISPR gRNA sequence
tgcctttcaggggagaagca

SEQ ID NO: 175030 - DNA, 20 bp, Artificial
  CRISPR gRNA sequence
tcaggggagaagcaagtatg

SEQ ID NO: 175031 - DNA, 20 bp, Artificial
  CRISPR gRNA sequence
caggggagaagcaagtatgg

SEQ ID NO: 175032 - DNA, 20 bp, Artificial
  CRISPR gRNA sequence
aggggagaagcaagtatgga

SEQ ID NO: 175033 - DNA, 20 bp, Artificial
  CRISPR gRNA sequence
gtccccgaagatggacacag

SEQ ID NO: 175034 - DNA, 20 bp, Artificial
  CRISPR gRNA sequence
tagactgtttttcatatatg

SEQ ID NO: 175035 - DNA, 20 bp, Artificial
  CRISPR gRNA sequence
tttttcatatatggtaagaa

SEQ ID NO: 175036 - DNA, 20 bp, Artificial
  CRISPR gRNA sequence
ttcatatatggtaagaaagt

SEQ ID NO: 175037 - DNA, 20 bp, Artificial
  CRISPR gRNA sequence
tcatatatggtaagaaagtg

SEQ ID NO: 175038 - DNA, 20 bp, Artificial
  CRISPR gRNA sequence
catatatggtaagaaagtgc

SEQ ID NO: 175039 - DNA, 20 bp, Artificial
  CRISPR gRNA sequence
atatatggtaagaaagtgca

SEQ ID NO: 175040 - DNA, 20 bp, Artificial
  CRISPR gRNA sequence
tgtcactaggctctgccttc

SEQ ID NO: 175041 - DNA, 20 bp, Artificial
  CRISPR gRNA sequence
gtcactaggctctgccttct

SEQ ID NO: 175042 - DNA, 20 bp, Artificial
  CRISPR gRNA sequence
tcactaggctctgccttcta

SEQ ID NO: 175043 - DNA, 20 bp, Artificial
  CRISPR gRNA sequence
ggctctgccttctattttct

SEQ ID NO: 175044 - DNA, 20 bp, Artificial
  CRISPR gRNA sequence
tgccttctattttctcaccc

SEQ ID NO: 175045 - DNA, 20 bp, Artificial
  CRISPR gRNA sequence
ccttctattttctcaccctc

SEQ ID NO: 175046 - DNA, 20 bp, Artificial
  CRISPR gRNA sequence
ctattttctcaccctcaaaa

SEQ ID NO: 175047 - DNA, 20 bp, Artificial
  CRISPR gRNA sequence
tattttctcaccctcaaaat

SEQ ID NO: 175048 - DNA, 20 bp, Artificial
  CRISPR gRNA sequence
ttttctcaccctcaaaatgg

SEQ ID NO: 175049 - DNA, 20 bp, Artificial
  CRISPR gRNA sequence
tctcaccctcaaaatggggg

SEQ ID NO: 175050 - DNA, 20 bp, Artificial
  CRISPR gRNA sequence
ctcaccctcaaaatggggga

SEQ ID NO: 175051 - DNA, 20 bp, Artificial
  CRISPR gRNA sequence
tcaccctcaaaatgggggat

SEQ ID NO: 175052 - DNA, 20 bp, Artificial
  CRISPR gRNA sequence
accctcaaaatgggggatga

SEQ ID NO: 175053 - DNA, 20 bp, Artificial
  CRISPR gRNA sequence
aaaatgggggatgataatcg

SEQ ID NO: 175054 - DNA, 20 bp, Artificial
  CRISPR gRNA sequence
tcctacttacattaggtaga

SEQ ID NO: 175055 - DNA, 20 bp, Artificial
  CRISPR gRNA sequence
cttacattaggtagatacca

SEQ ID NO: 175056 - DNA, 20 bp, Artificial
  CRISPR gRNA sequence
acattaggtagataccaaat

SEQ ID NO: 175057 - DNA, 20 bp, Artificial
  CRISPR gRNA sequence
cattaggtagataccaaata

SEQ ID NO: 175058 - DNA, 20 bp, Artificial
  CRISPR gRNA sequence
ggtagataccaaataagaga

SEQ ID NO: 175059 - DNA, 20 bp, Artificial
  CRISPR gRNA sequence
cactaactataaagtactat

SEQ ID NO: 175060 - DNA, 20 bp, Artificial
  CRISPR gRNA sequence
actaactataaagtactatt

SEQ ID NO: 175061 - DNA, 20 bp, Artificial
  CRISPR gRNA sequence
actataaagtactattcata

SEQ ID NO: 175062 - DNA, 20 bp, Artificial
  CRISPR gRNA sequence
taaagtactattcatataaa

SEQ ID NO: 175063 - DNA, 20 bp, Artificial
  CRISPR gRNA sequence
ttcatataaacactgcattc

SEQ ID NO: 175064 - DNA, 20 bp, Artificial
  CRISPR gRNA sequence
atataaacactgcattctat

SEQ ID NO: 175065 - DNA, 20 bp, Artificial
  CRISPR gRNA sequence
cattctattacattgcttaa

SEQ ID NO: 175066 - DNA, 20 bp, Artificial
  CRISPR gRNA sequence
tattacattgcttaaccacc

SEQ ID NO: 175067 - DNA, 20 bp, Artificial
  CRISPR gRNA sequence
ttacattgcttaaccacctt

SEQ ID NO: 175068 - DNA, 20 bp, Artificial
  CRISPR gRNA sequence
cattgcttaaccaccttcaa

SEQ ID NO: 175069 - DNA, 20 bp, Artificial
  CRISPR gRNA sequence
cttaaccaccttcaagggga

SEQ ID NO: 175070 - DNA, 20 bp, Artificial
  CRISPR gRNA sequence
aaccaccttcaaggggagct

SEQ ID NO: 175071 - DNA, 20 bp, Artificial
  CRISPR gRNA sequence
accaccttcaaggggagctt

SEQ ID NO: 175072 - DNA, 20 bp, Artificial
  CRISPR gRNA sequence
caaggggagcttcatgggca

SEQ ID NO: 175073 - DNA, 20 bp, Artificial
  CRISPR gRNA sequence
aaggggagcttcatgggcat

SEQ ID NO: 175074 - DNA, 20 bp, Artificial
  CRISPR gRNA sequence
catgggcatctggccaatga

SEQ ID NO: 175075 - DNA, 20 bp, Artificial
  CRISPR gRNA sequence
atgggcatctggccaatgaa

SEQ ID NO: 175076 - DNA, 20 bp, Artificial
  CRISPR gRNA sequence
gccaatgaatttccaagagg

SEQ ID NO: 175077 - DNA, 20 bp, Artificial
  CRISPR gRNA sequence
ccaagaggaaaataatcatg

SEQ ID NO: 175078 - DNA, 20 bp, Artificial
  CRISPR gRNA sequence
caagaggaaaataatcatgg

SEQ ID NO: 175079 - DNA, 20 bp, Artificial
  CRISPR gRNA sequence
agattataaataatgaggta

SEQ ID NO: 175080 - DNA, 20 bp, Artificial
  CRISPR gRNA sequence
gattataaataatgaggtaa

SEQ ID NO: 175081 - DNA, 20 bp, Artificial
  CRISPR gRNA sequence
taaataatgaggtaaaatgg

SEQ ID NO: 175082 - DNA, 20 bp, Artificial
  CRISPR gRNA sequence
gaaatttaccactatttctc

SEQ ID NO: 175083 - DNA, 20 bp, Artificial
  CRISPR gRNA sequence
accactatttctctagtgaa

SEQ ID NO: 175084 - DNA, 20 bp, Artificial
  CRISPR gRNA sequence
ccactatttctctagtgaaa

SEQ ID NO: 175085 - DNA, 20 bp, Artificial
  CRISPR gRNA sequence
tttctctagtgaaaagtttc

SEQ ID NO: 175086 - DNA, 20 bp, Artificial
  CRISPR gRNA sequence
ctctagtgaaaagtttctta

SEQ ID NO: 175087 - DNA, 20 bp, Artificial
  CRISPR gRNA sequence
tctagtgaaaagtttcttat

SEQ ID NO: 175088 - DNA, 20 bp, Artificial
  CRISPR gRNA sequence
tagtgaaaagtttcttattg

SEQ ID NO: 175089 - DNA, 20 bp, Artificial
  CRISPR gRNA sequence
gtgaaaagtttcttattgcc

SEQ ID NO: 175090 - DNA, 20 bp, Artificial
  CRISPR gRNA sequence
cttattgcctttattttaga

SEQ ID NO: 175091 - DNA, 20 bp, Artificial
  CRISPR gRNA sequence
ttattgcctttattttagat

SEQ ID NO: 175092 - DNA, 20 bp, Artificial
  CRISPR gRNA sequence
attgcctttattttagattg

SEQ ID NO: 175093 - DNA, 20 bp, Artificial
  CRISPR gRNA sequence
ttgcctttattttagattga

SEQ ID NO: 175094 - DNA, 20 bp, Artificial
  CRISPR gRNA sequence
cctttattttagattgagga

SEQ ID NO: 175095 - DNA, 20 bp, Artificial
  CRISPR gRNA sequence
tattttagattgaggataat

SEQ ID NO: 175096 - DNA, 20 bp, Artificial
  CRISPR gRNA sequence
attttagattgaggataatt

SEQ ID NO: 175097 - DNA, 20 bp, Artificial
  CRISPR gRNA sequence
ttttagattgaggataatta

SEQ ID NO: 175098 - DNA, 20 bp, Artificial
  CRISPR gRNA sequence
tagattgaggataattacaa

SEQ ID NO: 175099 - DNA, 20 bp, Artificial
  CRISPR gRNA sequence
agattgaggataattacaac

SEQ ID NO: 175100 - DNA, 20 bp, Artificial
  CRISPR gRNA sequence
gattgaggataattacaaca

SEQ ID NO: 175101 - DNA, 20 bp, Artificial
  CRISPR gRNA sequence
aggataattacaacatatat

SEQ ID NO: 175102 - DNA, 20 bp, Artificial
  CRISPR gRNA sequence
caacatatatagcctagaaa

SEQ ID NO: 175103 - DNA, 20 bp, Artificial
  CRISPR gRNA sequence
gaaactaaatataggtgtct

SEQ ID NO: 175104 - DNA, 20 bp, Artificial
  CRISPR gRNA sequence
aatataggtgtcttatatta

SEQ ID NO: 175105 - DNA, 20 bp, Artificial
  CRISPR gRNA sequence
atattaaaaattctgctaaa

SEQ ID NO: 175106 - DNA, 20 bp, Artificial
  CRISPR gRNA sequence
tattaaaaattctgctaaat

SEQ ID NO: 175107 - DNA, 20 bp, Artificial
  CRISPR gRNA sequence
aaaattctgctaaatcctac

SEQ ID NO: 175108 - DNA, 20 bp, Artificial
  CRISPR gRNA sequence
tgctaaatcctacagatgag

SEQ ID NO: 175109 - DNA, 20 bp, Artificial
  CRISPR gRNA sequence
ctaaatcctacagatgaggc

SEQ ID NO: 175110 - DNA, 20 bp, Artificial
  CRISPR gRNA sequence
aatcctacagatgaggctag

SEQ ID NO: 175111 - DNA, 20 bp, Artificial
  CRISPR gRNA sequence
cagatgaggctagtctcatt

SEQ ID NO: 175112 - DNA, 20 bp, Artificial
  CRISPR gRNA sequence
gtctcattcctggtaattaa

SEQ ID NO: 175113 - DNA, 20 bp, Artificial
  CRISPR gRNA sequence
attcctggtaattaattgtg

SEQ ID NO: 175114 - DNA, 20 bp, Artificial
  CRISPR gRNA sequence
ctggtaattaattgtgtgtg

SEQ ID NO: 175115 - DNA, 20 bp, Artificial
  CRISPR gRNA sequence
gtaattaattgtgtgtgctg

SEQ ID NO: 175116 - DNA, 20 bp, Artificial
  CRISPR gRNA sequence
attgtgtgtgctgctcattg

SEQ ID NO: 175117 - DNA, 20 bp, Artificial
  CRISPR gRNA sequence
tgtgtgctgctcattggtgc

SEQ ID NO: 175118 - DNA, 20 bp, Artificial
  CRISPR gRNA sequence
ctcattggtgctacaatgat

SEQ ID NO: 175119 - DNA, 20 bp, Artificial
  CRISPR gRNA sequence
attggtgctacaatgatcat

SEQ ID NO: 175120 - DNA, 20 bp, Artificial
  CRISPR gRNA sequence
gtgctacaatgatcatgtgg

SEQ ID NO: 175121 - DNA, 20 bp, Artificial
  CRISPR gRNA sequence
caatgatcatgtgggctata

SEQ ID NO: 175122 - DNA, 20 bp, Artificial
  CRISPR gRNA sequence
taaattacttgctcagcaaa

SEQ ID NO: 175123 - DNA, 20 bp, Artificial
  CRISPR gRNA sequence
cttgctcagcaaatgctgcc

SEQ ID NO: 175124 - DNA, 20 bp, Artificial
  CRISPR gRNA sequence
gctcagcaaatgctgccaaa

SEQ ID NO: 175125 - DNA, 20 bp, Artificial
  CRISPR gRNA sequence
ctcagcaaatgctgccaaat

SEQ ID NO: 175126 - DNA, 20 bp, Artificial
  CRISPR gRNA sequence
agcaaatgctgccaaattcc

SEQ ID NO: 175127 - DNA, 20 bp, Artificial
  CRISPR gRNA sequence
ccaaattcctacatatgtat

SEQ ID NO: 175128 - DNA, 20 bp, Artificial
  CRISPR gRNA sequence
ctacatatgtatttttggtc

SEQ ID NO: 175129 - DNA, 20 bp, Artificial
  CRISPR gRNA sequence
catatgtatttttggtcagc

SEQ ID NO: 175130 - DNA, 20 bp, Artificial
  CRISPR gRNA sequence
ttggtcagcttcatgcagga

SEQ ID NO: 175131 - DNA, 20 bp, Artificial
  CRISPR gRNA sequence
tggtcagcttcatgcaggat

SEQ ID NO: 175132 - DNA, 20 bp, Artificial
  CRISPR gRNA sequence
ggtcagcttcatgcaggatg

SEQ ID NO: 175133 - DNA, 20 bp, Artificial
  CRISPR gRNA sequence
gtcagcttcatgcaggatgc

SEQ ID NO: 175134 - DNA, 20 bp, Artificial
  CRISPR gRNA sequence
catgcaggatgctgccattt

SEQ ID NO: 175135 - DNA, 20 bp, Artificial
  CRISPR gRNA sequence
atgcaggatgctgccatttg

SEQ ID NO: 175136 - DNA, 20 bp, Artificial
  CRISPR gRNA sequence
ccatttgagattttacaaag

SEQ ID NO: 175137 - DNA, 20 bp, Artificial
  CRISPR gRNA sequence
gagattttacaaagctaaaa

SEQ ID NO: 175138 - DNA, 20 bp, Artificial
  CRISPR gRNA sequence
agattttacaaagctaaaat

SEQ ID NO: 175139 - DNA, 20 bp, Artificial
  CRISPR gRNA sequence
tacaaagctaaaatcagtaa

SEQ ID NO: 175140 - DNA, 20 bp, Artificial
  CRISPR gRNA sequence
acaaagctaaaatcagtaag

SEQ ID NO: 175141 - DNA, 20 bp, Artificial
  CRISPR gRNA sequence
caaagctaaaatcagtaaga

SEQ ID NO: 175142 - DNA, 20 bp, Artificial
  CRISPR gRNA sequence
aaatcagtaagattatgccc

SEQ ID NO: 175143 - DNA, 20 bp, Artificial
  CRISPR gRNA sequence
tgcccaaagcaactcaaaaa

SEQ ID NO: 175144 - DNA, 20 bp, Artificial
  CRISPR gRNA sequence
aaaaaataaaacctagtctt

SEQ ID NO: 175145 - DNA, 20 bp, Artificial
  CRISPR gRNA sequence
gtctttgtaccaaatggaga

SEQ ID NO: 175146 - DNA, 20 bp, Artificial
  CRISPR gRNA sequence
tgtaccaaatggagatatgg

SEQ ID NO: 175147 - DNA, 20 bp, Artificial
  CRISPR gRNA sequence
gtaccaaatggagatatggt

SEQ ID NO: 175148 - DNA, 20 bp, Artificial
  CRISPR gRNA sequence
taccaaatggagatatggta

SEQ ID NO: 175149 - DNA, 20 bp, Artificial
  CRISPR gRNA sequence
atctcaaggaaatatttgta

SEQ ID NO: 175150 - DNA, 20 bp, Artificial
  CRISPR gRNA sequence
aaggaaatatttgtacatct

SEQ ID NO: 175151 - DNA, 20 bp, Artificial
  CRISPR gRNA sequence
gtacatctttaaagcaagtg

SEQ ID NO: 175152 - DNA, 20 bp, Artificial
  CRISPR gRNA sequence
tacatctttaaagcaagtga

SEQ ID NO: 175153 - DNA, 20 bp, Artificial
  CRISPR gRNA sequence
taaagcaagtgaaggtcacc

SEQ ID NO: 175154 - DNA, 20 bp, Artificial
  CRISPR gRNA sequence
aaagcaagtgaaggtcacca

SEQ ID NO: 175155 - DNA, 20 bp, Artificial
  CRISPR gRNA sequence
aagcaagtgaaggtcaccag

SEQ ID NO: 175156 - DNA, 20 bp, Artificial
  CRISPR gRNA sequence
taaggaagtatttctagtct

SEQ ID NO: 175157 - DNA, 20 bp, Artificial
  CRISPR gRNA sequence
aggaagtatttctagtcttt

SEQ ID NO: 175158 - DNA, 20 bp, Artificial
  CRISPR gRNA sequence
ctagtcttttacttatcaag

SEQ ID NO: 175159 - DNA, 20 bp, Artificial
  CRISPR gRNA sequence
tagtcttttacttatcaagg

SEQ ID NO: 175160 - DNA, 20 bp, Artificial
  CRISPR gRNA sequence
gtcttttacttatcaaggca

SEQ ID NO: 175161 - DNA, 20 bp, Artificial
  CRISPR gRNA sequence
ttacttatcaaggcacacac

SEQ ID NO: 175162 - DNA, 20 bp, Artificial
  CRISPR gRNA sequence
tacttatcaaggcacacaca

SEQ ID NO: 175163 - DNA, 20 bp, Artificial
  CRISPR gRNA sequence
acttatcaaggcacacacag

SEQ ID NO: 175164 - DNA, 20 bp, Artificial
  CRISPR gRNA sequence
cttatcaaggcacacacaga

SEQ ID NO: 175165 - DNA, 20 bp, Artificial
  CRISPR gRNA sequence
atcaaggcacacacagaaag

SEQ ID NO: 175166 - DNA, 20 bp, Artificial
  CRISPR gRNA sequence
tcaaggcacacacagaaagt

SEQ ID NO: 175167 - DNA, 20 bp, Artificial
  CRISPR gRNA sequence
atattagcttttcaaatatt

SEQ ID NO: 175168 - DNA, 20 bp, Artificial
  CRISPR gRNA sequence
gcttttcaaatatttaacct

SEQ ID NO: 175169 - DNA, 20 bp, Artificial
  CRISPR gRNA sequence
ttcaaatatttaacctatga

SEQ ID NO: 175170 - DNA, 20 bp, Artificial
  CRISPR gRNA sequence
tcaaatatttaacctatgag

SEQ ID NO: 175171 - DNA, 20 bp, Artificial
  CRISPR gRNA sequence
caaatatttaacctatgagc

SEQ ID NO: 175172 - DNA, 20 bp, Artificial
  CRISPR gRNA sequence
aaatatttaacctatgagct

SEQ ID NO: 175173 - DNA, 20 bp, Artificial
  CRISPR gRNA sequence
aacctatgagctgataatga

SEQ ID NO: 175174 - DNA, 20 bp, Artificial
  CRISPR gRNA sequence
acctatgagctgataatgat

SEQ ID NO: 175175 - DNA, 20 bp, Artificial
  CRISPR gRNA sequence
tgagctgataatgatgccct

SEQ ID NO: 175176 - DNA, 20 bp, Artificial
  CRISPR gRNA sequence
ataatgatgccctcatttag

SEQ ID NO: 175177 - DNA, 20 bp, Artificial
  CRISPR gRNA sequence
atttagttgaacttgtcaga

SEQ ID NO: 175178 - DNA, 20 bp, Artificial
  CRISPR gRNA sequence
agttgaacttgtcagaagac

SEQ ID NO: 175179 - DNA, 20 bp, Artificial
  CRISPR gRNA sequence
gttgaacttgtcagaagacc

SEQ ID NO: 175180 - DNA, 20 bp, Artificial
  CRISPR gRNA sequence
aacttgtcagaagaccatgt

SEQ ID NO: 175181 - DNA, 20 bp, Artificial
  CRISPR gRNA sequence
gtcagaagaccatgtattac

SEQ ID NO: 175182 - DNA, 20 bp, Artificial
  CRISPR gRNA sequence
tcagaagaccatgtattaca

SEQ ID NO: 175183 - DNA, 20 bp, Artificial
  CRISPR gRNA sequence
catacggtgctccaaggact

SEQ ID NO: 175184 - DNA, 20 bp, Artificial
  CRISPR gRNA sequence
caaggactgcgaggaagatg

SEQ ID NO: 175185 - DNA, 20 bp, Artificial
  CRISPR gRNA sequence
cgaggaagatgtaggctaac

SEQ ID NO: 175186 - DNA, 20 bp, Artificial
  CRISPR gRNA sequence
acaatgaaacctttaccttg

SEQ ID NO: 175187 - DNA, 20 bp, Artificial
  CRISPR gRNA sequence
taccttgttgtacacgcctg

SEQ ID NO: 175188 - DNA, 20 bp, Artificial
  CRISPR gRNA sequence
accttgttgtacacgcctgg

SEQ ID NO: 175189 - DNA, 20 bp, Artificial
  CRISPR gRNA sequence
ccttgttgtacacgcctgga

SEQ ID NO: 175190 - DNA, 20 bp, Artificial
  CRISPR gRNA sequence
gttgtacacgcctggattaa

SEQ ID NO: 175191 - DNA, 20 bp, Artificial
  CRISPR gRNA sequence
ttgtacacgcctggattaag

SEQ ID NO: 175192 - DNA, 20 bp, Artificial
  CRISPR gRNA sequence
tacacgcctggattaagggg

SEQ ID NO: 175193 - DNA, 20 bp, Artificial
  CRISPR gRNA sequence
gattaaggggagttacagat

SEQ ID NO: 175194 - DNA, 20 bp, Artificial
  CRISPR gRNA sequence
aggggagttacagatattct

SEQ ID NO: 175195 - DNA, 20 bp, Artificial
  CRISPR gRNA sequence
cagatattctctatttttag

SEQ ID NO: 175196 - DNA, 20 bp, Artificial
  CRISPR gRNA sequence
tctatttttagtaaactaat

SEQ ID NO: 175197 - DNA, 20 bp, Artificial
  CRISPR gRNA sequence
tatttttagtaaactaatac

SEQ ID NO: 175198 - DNA, 20 bp, Artificial
  CRISPR gRNA sequence
tttttagtaaactaatacta

SEQ ID NO: 175199 - DNA, 20 bp, Artificial
  CRISPR gRNA sequence
ttagtaaactaatactaaaa

SEQ ID NO: 175200 - DNA, 20 bp, Artificial
  CRISPR gRNA sequence
tagtaaactaatactaaaaa

SEQ ID NO: 175201 - DNA, 20 bp, Artificial
  CRISPR gRNA sequence
agtaaactaatactaaaaaa

SEQ ID NO: 175202 - DNA, 20 bp, Artificial
  CRISPR gRNA sequence
gtaaactaatactaaaaaac

SEQ ID NO: 175203 - DNA, 20 bp, Artificial
  CRISPR gRNA sequence
atactaaaaaaccaagcaag

SEQ ID NO: 175204 - DNA, 20 bp, Artificial
  CRISPR gRNA sequence
aaaaaccaagcaagtaactt

SEQ ID NO: 175205 - DNA, 20 bp, Artificial
  CRISPR gRNA sequence
tttggaataaagaatattaa

SEQ ID NO: 175206 - DNA, 20 bp, Artificial
  CRISPR gRNA sequence
ttggaataaagaatattaat

SEQ ID NO: 175207 - DNA, 20 bp, Artificial
  CRISPR gRNA sequence
tggaataaagaatattaatt

SEQ ID NO: 175208 - DNA, 20 bp, Artificial
  CRISPR gRNA sequence
ggaataaagaatattaattc

SEQ ID NO: 175209 - DNA, 20 bp, Artificial
  CRISPR gRNA sequence
gaataaagaatattaattct

SEQ ID NO: 175210 - DNA, 20 bp, Artificial
  CRISPR gRNA sequence
attcttacatgggaaatgca

SEQ ID NO: 175211 - DNA, 20 bp, Artificial
  CRISPR gRNA sequence
ttacatgggaaatgcacact

SEQ ID NO: 175212 - DNA, 20 bp, Artificial
  CRISPR gRNA sequence
acatgggaaatgcacactca

SEQ ID NO: 175213 - DNA, 20 bp, Artificial
  CRISPR gRNA sequence
catgggaaatgcacactcag

SEQ ID NO: 175214 - DNA, 20 bp, Artificial
  CRISPR gRNA sequence
agaaaacaggggtgtgcaac

SEQ ID NO: 175215 - DNA, 20 bp, Artificial
  CRISPR gRNA sequence
agagagcactgacctagagg

SEQ ID NO: 175216 - DNA, 20 bp, Artificial
  CRISPR gRNA sequence
gagagcactgacctagagga

SEQ ID NO: 175217 - DNA, 20 bp, Artificial
  CRISPR gRNA sequence
acctagaggactctaccatg

SEQ ID NO: 175218 - DNA, 20 bp, Artificial
  CRISPR gRNA sequence
gaggactctaccatgctcat

SEQ ID NO: 175219 - DNA, 20 bp, Artificial
  CRISPR gRNA sequence
taccatgctcatttctggat

SEQ ID NO: 175220 - DNA, 20 bp, Artificial
  CRISPR gRNA sequence
ccatgctcatttctggattt

SEQ ID NO: 175221 - DNA, 20 bp, Artificial
  CRISPR gRNA sequence
atttctggatttctcaactt

SEQ ID NO: 175222 - DNA, 20 bp, Artificial
  CRISPR gRNA sequence
ctggatttctcaactttaga

SEQ ID NO: 175223 - DNA, 20 bp, Artificial
  CRISPR gRNA sequence
tggatttctcaactttagag

SEQ ID NO: 175224 - DNA, 20 bp, Artificial
  CRISPR gRNA sequence
gatttctcaactttagagtc

SEQ ID NO: 175225 - DNA, 20 bp, Artificial
  CRISPR gRNA sequence
ctcaactttagagtcagaca

SEQ ID NO: 175226 - DNA, 20 bp, Artificial
  CRISPR gRNA sequence
tcaactttagagtcagacat

SEQ ID NO: 175227 - DNA, 20 bp, Artificial
  CRISPR gRNA sequence
aactttagagtcagacattt

SEQ ID NO: 175228 - DNA, 20 bp, Artificial
  CRISPR gRNA sequence
tagagtcagacatttttggg

SEQ ID NO: 175229 - DNA, 20 bp, Artificial
  CRISPR gRNA sequence
agagtcagacatttttgggc

SEQ ID NO: 175230 - DNA, 20 bp, Artificial
  CRISPR gRNA sequence
gagtcagacatttttgggct

SEQ ID NO: 175231 - DNA, 20 bp, Artificial
  CRISPR gRNA sequence
ttgggcttccatgtttgaca

SEQ ID NO: 175232 - DNA, 20 bp, Artificial
  CRISPR gRNA sequence
tgggcttccatgtttgacat

SEQ ID NO: 175233 - DNA, 20 bp, Artificial
  CRISPR gRNA sequence
gggcttccatgtttgacatg

SEQ ID NO: 175234 - DNA, 20 bp, Artificial
  CRISPR gRNA sequence
ggcttccatgtttgacatgt

SEQ ID NO: 175235 - DNA, 20 bp, Artificial
  CRISPR gRNA sequence
ccatgtttgacatgtagcac

SEQ ID NO: 175236 - DNA, 20 bp, Artificial
  CRISPR gRNA sequence
catgtttgacatgtagcact

SEQ ID NO: 175237 - DNA, 20 bp, Artificial
  CRISPR gRNA sequence
gacatgtagcactagtcttc

SEQ ID NO: 175238 - DNA, 20 bp, Artificial
  CRISPR gRNA sequence
acatgtagcactagtcttct

SEQ ID NO: 175239 - DNA, 20 bp, Artificial
  CRISPR gRNA sequence
gtcttctgtcaattctcttt

SEQ ID NO: 175240 - DNA, 20 bp, Artificial
  CRISPR gRNA sequence
ctgtcaattctctttcttga

SEQ ID NO: 175241 - DNA, 20 bp, Artificial
  CRISPR gRNA sequence
tgtcaattctctttcttgat

SEQ ID NO: 175242 - DNA, 20 bp, Artificial
  CRISPR gRNA sequence
tcaattctctttcttgattc

SEQ ID NO: 175243 - DNA, 20 bp, Artificial
  CRISPR gRNA sequence
tctttcttgattctctcctg

SEQ ID NO: 175244 - DNA, 20 bp, Artificial
  CRISPR gRNA sequence
tttcttgattctctcctgtt

SEQ ID NO: 175245 - DNA, 20 bp, Artificial
  CRISPR gRNA sequence
tcttgattctctcctgtttg

SEQ ID NO: 175246 - DNA, 20 bp, Artificial
  CRISPR gRNA sequence
cttgattctctcctgtttgt

SEQ ID NO: 175247 - DNA, 20 bp, Artificial
  CRISPR gRNA sequence
ttgattctctcctgtttgtc

SEQ ID NO: 175248 - DNA, 20 bp, Artificial
  CRISPR gRNA sequence
gattctctcctgtttgtccc

SEQ ID NO: 175249 - DNA, 20 bp, Artificial
  CRISPR gRNA sequence
attctctcctgtttgtcccc

SEQ ID NO: 175250 - DNA, 20 bp, Artificial
  CRISPR gRNA sequence
tctcctgtttgtcccctagg

SEQ ID NO: 175251 - DNA, 20 bp, Artificial
  CRISPR gRNA sequence
tcctgtttgtcccctaggtt

SEQ ID NO: 175252 - DNA, 20 bp, Artificial
  CRISPR gRNA sequence
ctgtttgtcccctaggttca

SEQ ID NO: 175253 - DNA, 20 bp, Artificial
  CRISPR gRNA sequence
tttgtcccctaggttcagct

SEQ ID NO: 175254 - DNA, 20 bp, Artificial
  CRISPR gRNA sequence
gtcccctaggttcagctata

SEQ ID NO: 175255 - DNA, 20 bp, Artificial
  CRISPR gRNA sequence
tcccctaggttcagctataa

SEQ ID NO: 175256 - DNA, 20 bp, Artificial
  CRISPR gRNA sequence
ggttcagctataatctctat

SEQ ID NO: 175257 - DNA, 20 bp, Artificial
  CRISPR gRNA sequence
agctataatctctatgatcc

SEQ ID NO: 175258 - DNA, 20 bp, Artificial
  CRISPR gRNA sequence
taatctctatgatcctaaat

SEQ ID NO: 175259 - DNA, 20 bp, Artificial
  CRISPR gRNA sequence
tatgatcctaaattccaaat

SEQ ID NO: 175260 - DNA, 20 bp, Artificial
  CRISPR gRNA sequence
tgatcctaaattccaaatat

SEQ ID NO: 175261 - DNA, 20 bp, Artificial
  CRISPR gRNA sequence
aattccaaatatacattacc

SEQ ID NO: 175262 - DNA, 20 bp, Artificial
  CRISPR gRNA sequence
caaatatacattaccaattt

SEQ ID NO: 175263 - DNA, 20 bp, Artificial
  CRISPR gRNA sequence
ccaattttgatatttctcca

SEQ ID NO: 175264 - DNA, 20 bp, Artificial
  CRISPR gRNA sequence
tgatatttctccaaagcttc

SEQ ID NO: 175265 - DNA, 20 bp, Artificial
  CRISPR gRNA sequence
gatatttctccaaagcttca

SEQ ID NO: 175266 - DNA, 20 bp, Artificial
  CRISPR gRNA sequence
atatttctccaaagcttcag

SEQ ID NO: 175267 - DNA, 20 bp, Artificial
  CRISPR gRNA sequence
ctccaaagcttcagtccttc

SEQ ID NO: 175268 - DNA, 20 bp, Artificial
  CRISPR gRNA sequence
tccaaagcttcagtccttca

SEQ ID NO: 175269 - DNA, 20 bp, Artificial
  CRISPR gRNA sequence
caaagcttcagtccttcatg

SEQ ID NO: 175270 - DNA, 20 bp, Artificial
  CRISPR gRNA sequence
cagtccttcatgtacaagct

SEQ ID NO: 175271 - DNA, 20 bp, Artificial
  CRISPR gRNA sequence
agtccttcatgtacaagctg

SEQ ID NO: 175272 - DNA, 20 bp, Artificial
  CRISPR gRNA sequence
catgtacaagctgcctggct

SEQ ID NO: 175273 - DNA, 20 bp, Artificial
  CRISPR gRNA sequence
atgtacaagctgcctggctg

SEQ ID NO: 175274 - DNA, 20 bp, Artificial
  CRISPR gRNA sequence
cctggctggacatctacaac

SEQ ID NO: 175275 - DNA, 20 bp, Artificial
  CRISPR gRNA sequence
gctggacatctacaaccaga

SEQ ID NO: 175276 - DNA, 20 bp, Artificial
  CRISPR gRNA sequence
gacatctacaaccagaaagc

SEQ ID NO: 175277 - DNA, 20 bp, Artificial
  CRISPR gRNA sequence
caaccagaaagctacccaga

SEQ ID NO: 175278 - DNA, 20 bp, Artificial
  CRISPR gRNA sequence
cccagaactgaaattccacg

SEQ ID NO: 175279 - DNA, 20 bp, Artificial
  CRISPR gRNA sequence
aaattccacgtgccccaaat

SEQ ID NO: 175280 - DNA, 20 bp, Artificial
  CRISPR gRNA sequence
cacgtgccccaaatcaaatc

SEQ ID NO: 175281 - DNA, 20 bp, Artificial
  CRISPR gRNA sequence
tcttcttttccccccaaact

SEQ ID NO: 175282 - DNA, 20 bp, Artificial
  CRISPR gRNA sequence
cttttccccccaaacttgct

SEQ ID NO: 175283 - DNA, 20 bp, Artificial
  CRISPR gRNA sequence
ttttccccccaaacttgctc

SEQ ID NO: 175284 - DNA, 20 bp, Artificial
  CRISPR gRNA sequence
ttccccccaaacttgctctt

SEQ ID NO: 175285 - DNA, 20 bp, Artificial
  CRISPR gRNA sequence
tccccccaaacttgctcttc

SEQ ID NO: 175286 - DNA, 20 bp, Artificial
  CRISPR gRNA sequence
ccccccaaacttgctcttcc

SEQ ID NO: 175287 - DNA, 20 bp, Artificial
  CRISPR gRNA sequence
cccccaaacttgctcttcct

SEQ ID NO: 175288 - DNA, 20 bp, Artificial
  CRISPR gRNA sequence
gctcttcctaaatttctgtt

SEQ ID NO: 175289 - DNA, 20 bp, Artificial
  CRISPR gRNA sequence
ctcttcctaaatttctgttt

SEQ ID NO: 175290 - DNA, 20 bp, Artificial
  CRISPR gRNA sequence
ttcctaaatttctgtttcta

SEQ ID NO: 175291 - DNA, 20 bp, Artificial
  CRISPR gRNA sequence
cctaaatttctgtttctatc

SEQ ID NO: 175292 - DNA, 20 bp, Artificial
  CRISPR gRNA sequence
ctaaatttctgtttctatcc

SEQ ID NO: 175293 - DNA, 20 bp, Artificial
  CRISPR gRNA sequence
aatttctgtttctatcctcc

SEQ ID NO: 175294 - DNA, 20 bp, Artificial
  CRISPR gRNA sequence
ctgtttctatcctccagtca

SEQ ID NO: 175295 - DNA, 20 bp, Artificial
  CRISPR gRNA sequence
tgtttctatcctccagtcac

SEQ ID NO: 175296 - DNA, 20 bp, Artificial
  CRISPR gRNA sequence
tttctatcctccagtcaccc

SEQ ID NO: 175297 - DNA, 20 bp, Artificial
  CRISPR gRNA sequence
ctatcctccagtcacccaga

SEQ ID NO: 175298 - DNA, 20 bp, Artificial
  CRISPR gRNA sequence
tatcctccagtcacccagac

SEQ ID NO: 175299 - DNA, 20 bp, Artificial
  CRISPR gRNA sequence
tcctccagtcacccagactg

SEQ ID NO: 175300 - DNA, 20 bp, Artificial
  CRISPR gRNA sequence
cagtcacccagactggatag

SEQ ID NO: 175301 - DNA, 20 bp, Artificial
  CRISPR gRNA sequence
gatagaaatctcagtatcat

SEQ ID NO: 175302 - DNA, 20 bp, Artificial
  CRISPR gRNA sequence
agtatcattttgcacttttt

SEQ ID NO: 175303 - DNA, 20 bp, Artificial
  CRISPR gRNA sequence
tgcactttttctcctctgtt

SEQ ID NO: 175304 - DNA, 20 bp, Artificial
  CRISPR gRNA sequence
gcactttttctcctctgttc

SEQ ID NO: 175305 - DNA, 20 bp, Artificial
  CRISPR gRNA sequence
cactttttctcctctgttcc

SEQ ID NO: 175306 - DNA, 20 bp, Artificial
  CRISPR gRNA sequence
tttctcctctgttcctcaat

SEQ ID NO: 175307 - DNA, 20 bp, Artificial
  CRISPR gRNA sequence
ttctcctctgttcctcaatt

SEQ ID NO: 175308 - DNA, 20 bp, Artificial
  CRISPR gRNA sequence
tctcctctgttcctcaattc

SEQ ID NO: 175309 - DNA, 20 bp, Artificial
  CRISPR gRNA sequence
ctcctctgttcctcaattct

SEQ ID NO: 175310 - DNA, 20 bp, Artificial
  CRISPR gRNA sequence
tcctctgttcctcaattcta

SEQ ID NO: 175311 - DNA, 20 bp, Artificial
  CRISPR gRNA sequence
ctctgttcctcaattctaat

SEQ ID NO: 175312 - DNA, 20 bp, Artificial
  CRISPR gRNA sequence
tgttcctcaattctaatcag

SEQ ID NO: 175313 - DNA, 20 bp, Artificial
  CRISPR gRNA sequence
ttcctcaattctaatcagct

SEQ ID NO: 175314 - DNA, 20 bp, Artificial
  CRISPR gRNA sequence
ctcaattctaatcagctgct

SEQ ID NO: 175315 - DNA, 20 bp, Artificial
  CRISPR gRNA sequence
aattctaatcagctgctaaa

SEQ ID NO: 175316 - DNA, 20 bp, Artificial
  CRISPR gRNA sequence
taatcagctgctaaattcta

SEQ ID NO: 175317 - DNA, 20 bp, Artificial
  CRISPR gRNA sequence
atcagctgctaaattctata

SEQ ID NO: 175318 - DNA, 20 bp, Artificial
  CRISPR gRNA sequence
ctaaattctatagtaacagt

SEQ ID NO: 175319 - DNA, 20 bp, Artificial
  CRISPR gRNA sequence
aattctatagtaacagtgtc

SEQ ID NO: 175320 - DNA, 20 bp, Artificial
  CRISPR gRNA sequence
tatagtaacagtgtccaaca

SEQ ID NO: 175321 - DNA, 20 bp, Artificial
  CRISPR gRNA sequence
tagtaacagtgtccaacagt

SEQ ID NO: 175322 - DNA, 20 bp, Artificial
  CRISPR gRNA sequence
ctgacctttcttcatactac

SEQ ID NO: 175323 - DNA, 20 bp, Artificial
  CRISPR gRNA sequence
acctttcttcatactaccac

SEQ ID NO: 175324 - DNA, 20 bp, Artificial
  CRISPR gRNA sequence
tcttcatactaccactatct

SEQ ID NO: 175325 - DNA, 20 bp, Artificial
  CRISPR gRNA sequence
cttcatactaccactatctc

SEQ ID NO: 175326 - DNA, 20 bp, Artificial
  CRISPR gRNA sequence
ttcatactaccactatctct

SEQ ID NO: 175327 - DNA, 20 bp, Artificial
  CRISPR gRNA sequence
catactaccactatctctgt

SEQ ID NO: 175328 - DNA, 20 bp, Artificial
  CRISPR gRNA sequence
atactaccactatctctgtt

SEQ ID NO: 175329 - DNA, 20 bp, Artificial
  CRISPR gRNA sequence
ccactatctctgttcagacc

SEQ ID NO: 175330 - DNA, 20 bp, Artificial
  CRISPR gRNA sequence
tctctgttcagaccctcatt

SEQ ID NO: 175331 - DNA, 20 bp, Artificial
  CRISPR gRNA sequence
tgttcagaccctcattgcct

SEQ ID NO: 175332 - DNA, 20 bp, Artificial
  CRISPR gRNA sequence
ttcagaccctcattgcctcc

SEQ ID NO: 175333 - DNA, 20 bp, Artificial
  CRISPR gRNA sequence
agaccctcattgcctccatg

SEQ ID NO: 175334 - DNA, 20 bp, Artificial
  CRISPR gRNA sequence
attgcctccatgtaataaaa

SEQ ID NO: 175335 - DNA, 20 bp, Artificial
  CRISPR gRNA sequence
cctccatgtaataaaaacga

SEQ ID NO: 175336 - DNA, 20 bp, Artificial
  CRISPR gRNA sequence
catgtaataaaaacgatgat

SEQ ID NO: 175337 - DNA, 20 bp, Artificial
  CRISPR gRNA sequence
attaggagttactgtgtgcc

SEQ ID NO: 175338 - DNA, 20 bp, Artificial
  CRISPR gRNA sequence
ggagttactgtgtgccacgt

SEQ ID NO: 175339 - DNA, 20 bp, Artificial
  CRISPR gRNA sequence
ctgtgtgccacgtacaattc

SEQ ID NO: 175340 - DNA, 20 bp, Artificial
  CRISPR gRNA sequence
tgtgccacgtacaattctaa

SEQ ID NO: 175341 - DNA, 20 bp, Artificial
  CRISPR gRNA sequence
taagccctttatgttactac

SEQ ID NO: 175342 - DNA, 20 bp, Artificial
  CRISPR gRNA sequence
agccctttatgttactacct

SEQ ID NO: 175343 - DNA, 20 bp, Artificial
  CRISPR gRNA sequence
tatgttactacctattttaa

SEQ ID NO: 175344 - DNA, 20 bp, Artificial
  CRISPR gRNA sequence
atgttactacctattttaaa

SEQ ID NO: 175345 - DNA, 20 bp, Artificial
  CRISPR gRNA sequence
tgttactacctattttaaac

SEQ ID NO: 175346 - DNA, 20 bp, Artificial
  CRISPR gRNA sequence
ctacctattttaaacctcct

SEQ ID NO: 175347 - DNA, 20 bp, Artificial
  CRISPR gRNA sequence
cctattttaaacctcctaat

SEQ ID NO: 175348 - DNA, 20 bp, Artificial
  CRISPR gRNA sequence
ttttaaacctcctaataatc

SEQ ID NO: 175349 - DNA, 20 bp, Artificial
  CRISPR gRNA sequence
taaacctcctaataatccta

SEQ ID NO: 175350 - DNA, 20 bp, Artificial
  CRISPR gRNA sequence
aaacctcctaataatcctat

SEQ ID NO: 175351 - DNA, 20 bp, Artificial
  CRISPR gRNA sequence
aacctcctaataatcctata

SEQ ID NO: 175352 - DNA, 20 bp, Artificial
  CRISPR gRNA sequence
ctaataatcctataagggtt

SEQ ID NO: 175353 - DNA, 20 bp, Artificial
  CRISPR gRNA sequence
ataatcctataagggttgtg

SEQ ID NO: 175354 - DNA, 20 bp, Artificial
  CRISPR gRNA sequence
taagggttgtgaacctaaga

SEQ ID NO: 175355 - DNA, 20 bp, Artificial
  CRISPR gRNA sequence
tgaacctaagatgtataata

SEQ ID NO: 175356 - DNA, 20 bp, Artificial
  CRISPR gRNA sequence
agatgtataataaatcatat

SEQ ID NO: 175357 - DNA, 20 bp, Artificial
  CRISPR gRNA sequence
tcataatgccacatcactct

SEQ ID NO: 175358 - DNA, 20 bp, Artificial
  CRISPR gRNA sequence
ataatgccacatcactctac

SEQ ID NO: 175359 - DNA, 20 bp, Artificial
  CRISPR gRNA sequence
tactaccccagattttcaat

SEQ ID NO: 175360 - DNA, 20 bp, Artificial
  CRISPR gRNA sequence
ctaccccagattttcaatgg

SEQ ID NO: 175361 - DNA, 20 bp, Artificial
  CRISPR gRNA sequence
ccccagattttcaatggtca

SEQ ID NO: 175362 - DNA, 20 bp, Artificial
  CRISPR gRNA sequence
tcaatggtcaccaacgtcaa

SEQ ID NO: 175363 - DNA, 20 bp, Artificial
  CRISPR gRNA sequence
caatggtcaccaacgtcaag

SEQ ID NO: 175364 - DNA, 20 bp, Artificial
  CRISPR gRNA sequence
aatggtcaccaacgtcaagc

SEQ ID NO: 175365 - DNA, 20 bp, Artificial
  CRISPR gRNA sequence
ttcaaatttcttagcctagc

SEQ ID NO: 175366 - DNA, 20 bp, Artificial
  CRISPR gRNA sequence
aaatttcttagcctagcaaa

SEQ ID NO: 175367 - DNA, 20 bp, Artificial
  CRISPR gRNA sequence
cttagcctagcaaacaaggc

SEQ ID NO: 175368 - DNA, 20 bp, Artificial
  CRISPR gRNA sequence
ttagcctagcaaacaaggcc

SEQ ID NO: 175369 - DNA, 20 bp, Artificial
  CRISPR gRNA sequence
agcctagcaaacaaggccct

SEQ ID NO: 175370 - DNA, 20 bp, Artificial
  CRISPR gRNA sequence
gcctagcaaacaaggccctt

SEQ ID NO: 175371 - DNA, 20 bp, Artificial
  CRISPR gRNA sequence
gcaaacaaggcccttcaaca

SEQ ID NO: 175372 - DNA, 20 bp, Artificial
  CRISPR gRNA sequence
caacatctgacccaatctac

SEQ ID NO: 175373 - DNA, 20 bp, Artificial
  CRISPR gRNA sequence
aacatctgacccaatctact

SEQ ID NO: 175374 - DNA, 20 bp, Artificial
  CRISPR gRNA sequence
acccaatctacttctccata

SEQ ID NO: 175375 - DNA, 20 bp, Artificial
  CRISPR gRNA sequence
cttctccatacttctttctt

SEQ ID NO: 175376 - DNA, 20 bp, Artificial
  CRISPR gRNA sequence
ctccatacttctttctttta

SEQ ID NO: 175377 - DNA, 20 bp, Artificial
  CRISPR gRNA sequence
tccatacttctttcttttac

SEQ ID NO: 175378 - DNA, 20 bp, Artificial
  CRISPR gRNA sequence
catacttctttcttttacca

SEQ ID NO: 175379 - DNA, 20 bp, Artificial
  CRISPR gRNA sequence
ctttcttttaccactccttc

SEQ ID NO: 175380 - DNA, 20 bp, Artificial
  CRISPR gRNA sequence
tttcttttaccactccttcc

SEQ ID NO: 175381 - DNA, 20 bp, Artificial
  CRISPR gRNA sequence
tcttttaccactccttcctg

SEQ ID NO: 175382 - DNA, 20 bp, Artificial
  CRISPR gRNA sequence
cttttaccactccttcctgt

SEQ ID NO: 175383 - DNA, 20 bp, Artificial
  CRISPR gRNA sequence
ttttaccactccttcctgtc

SEQ ID NO: 175384 - DNA, 20 bp, Artificial
  CRISPR gRNA sequence
ttaccactccttcctgtcct

SEQ ID NO: 175385 - DNA, 20 bp, Artificial
  CRISPR gRNA sequence
taccactccttcctgtcctt

SEQ ID NO: 175386 - DNA, 20 bp, Artificial
  CRISPR gRNA sequence
accactccttcctgtcctta

SEQ ID NO: 175387 - DNA, 20 bp, Artificial
  CRISPR gRNA sequence
ccactccttcctgtccttaa

SEQ ID NO: 175388 - DNA, 20 bp, Artificial
  CRISPR gRNA sequence
cttcctgtccttaactcatc

SEQ ID NO: 175389 - DNA, 20 bp, Artificial
  CRISPR gRNA sequence
cctgtccttaactcatctcc

SEQ ID NO: 175390 - DNA, 20 bp, Artificial
  CRISPR gRNA sequence
ctgtccttaactcatctcct

SEQ ID NO: 175391 - DNA, 20 bp, Artificial
  CRISPR gRNA sequence
tccttaactcatctccttat

SEQ ID NO: 175392 - DNA, 20 bp, Artificial
  CRISPR gRNA sequence
aactcatctccttatgctct

SEQ ID NO: 175393 - DNA, 20 bp, Artificial
  CRISPR gRNA sequence
actcatctccttatgctcta

SEQ ID NO: 175394 - DNA, 20 bp, Artificial
  CRISPR gRNA sequence
atctccttatgctctaagca

SEQ ID NO: 175395 - DNA, 20 bp, Artificial
  CRISPR gRNA sequence
cttatgctctaagcagttga

SEQ ID NO: 175396 - DNA, 20 bp, Artificial
  CRISPR gRNA sequence
atgctctaagcagttgacca

SEQ ID NO: 175397 - DNA, 20 bp, Artificial
  CRISPR gRNA sequence
tgctctaagcagttgaccat

SEQ ID NO: 175398 - DNA, 20 bp, Artificial
  CRISPR gRNA sequence
taagcagttgaccatttact

SEQ ID NO: 175399 - DNA, 20 bp, Artificial
  CRISPR gRNA sequence
agcagttgaccatttactgc

SEQ ID NO: 175400 - DNA, 20 bp, Artificial
  CRISPR gRNA sequence
accatttactgctctcctta

SEQ ID NO: 175401 - DNA, 20 bp, Artificial
  CRISPR gRNA sequence
actgctctccttaacccaag

SEQ ID NO: 175402 - DNA, 20 bp, Artificial
  CRISPR gRNA sequence
ctgctctccttaacccaaga

SEQ ID NO: 175403 - DNA, 20 bp, Artificial
  CRISPR gRNA sequence
ctctccttaacccaagatgt

SEQ ID NO: 175404 - DNA, 20 bp, Artificial
  CRISPR gRNA sequence
tccttaacccaagatgtact

SEQ ID NO: 175405 - DNA, 20 bp, Artificial
  CRISPR gRNA sequence
cttaacccaagatgtacttt

SEQ ID NO: 175406 - DNA, 20 bp, Artificial
  CRISPR gRNA sequence
aacccaagatgtactttttg

SEQ ID NO: 175407 - DNA, 20 bp, Artificial
  CRISPR gRNA sequence
acccaagatgtactttttga

SEQ ID NO: 175408 - DNA, 20 bp, Artificial
  CRISPR gRNA sequence
tttgaatcatgatcttgctt

SEQ ID NO: 175409 - DNA, 20 bp, Artificial
  CRISPR gRNA sequence
ttgaatcatgatcttgcttg

SEQ ID NO: 175410 - DNA, 20 bp, Artificial
  CRISPR gRNA sequence
tgaatcatgatcttgcttgt

SEQ ID NO: 175411 - DNA, 20 bp, Artificial
  CRISPR gRNA sequence
gaatcatgatcttgcttgtt

SEQ ID NO: 175412 - DNA, 20 bp, Artificial
  CRISPR gRNA sequence
aatcatgatcttgcttgttg

SEQ ID NO: 175413 - DNA, 20 bp, Artificial
  CRISPR gRNA sequence
gcttgttgctcccaatgtct

SEQ ID NO: 175414 - DNA, 20 bp, Artificial
  CRISPR gRNA sequence
cttgttgctcccaatgtctg

SEQ ID NO: 175415 - DNA, 20 bp, Artificial
  CRISPR gRNA sequence
gttgctcccaatgtctggaa

SEQ ID NO: 175416 - DNA, 20 bp, Artificial
  CRISPR gRNA sequence
ttgctcccaatgtctggaat

SEQ ID NO: 175417 - DNA, 20 bp, Artificial
  CRISPR gRNA sequence
ctcccaatgtctggaatgcc

SEQ ID NO: 175418 - DNA, 20 bp, Artificial
  CRISPR gRNA sequence
ccaatgtctggaatgccctt

SEQ ID NO: 175419 - DNA, 20 bp, Artificial
  CRISPR gRNA sequence
gaatgcccttgtccctacct

SEQ ID NO: 175420 - DNA, 20 bp, Artificial
  CRISPR gRNA sequence
gtccctacctccctgagtct

SEQ ID NO: 175421 - DNA, 20 bp, Artificial
  CRISPR gRNA sequence
tccctacctccctgagtcta

SEQ ID NO: 175422 - DNA, 20 bp, Artificial
  CRISPR gRNA sequence
cctccctgagtctacaccca

SEQ ID NO: 175423 - DNA, 20 bp, Artificial
  CRISPR gRNA sequence
cctgagtctacacccagtta

SEQ ID NO: 175424 - DNA, 20 bp, Artificial
  CRISPR gRNA sequence
agtctacacccagttaaaca

SEQ ID NO: 175425 - DNA, 20 bp, Artificial
  CRISPR gRNA sequence
cacccagttaaacagcttgc

SEQ ID NO: 175426 - DNA, 20 bp, Artificial
  CRISPR gRNA sequence
aacagcttgccttcattcct

SEQ ID NO: 175427 - DNA, 20 bp, Artificial
  CRISPR gRNA sequence
gccttcattcctaagcgaac

SEQ ID NO: 175428 - DNA, 20 bp, Artificial
  CRISPR gRNA sequence
ccttcattcctaagcgaacg

SEQ ID NO: 175429 - DNA, 20 bp, Artificial
  CRISPR gRNA sequence
cattcctaagcgaacgtctc

SEQ ID NO: 175430 - DNA, 20 bp, Artificial
  CRISPR gRNA sequence
attcctaagcgaacgtctcc

SEQ ID NO: 175431 - DNA, 20 bp, Artificial
  CRISPR gRNA sequence
ctaagcgaacgtctcccctc

SEQ ID NO: 175432 - DNA, 20 bp, Artificial
  CRISPR gRNA sequence
agcgaacgtctcccctcctc

SEQ ID NO: 175433 - DNA, 20 bp, Artificial
  CRISPR gRNA sequence
ccctcctctgaattctgtgt

SEQ ID NO: 175434 - DNA, 20 bp, Artificial
  CRISPR gRNA sequence
ctctgaattctgtgtatttt

SEQ ID NO: 175435 - DNA, 20 bp, Artificial
  CRISPR gRNA sequence
tgaattctgtgtattttgct

SEQ ID NO: 175436 - DNA, 20 bp, Artificial
  CRISPR gRNA sequence
aattctgtgtattttgcttg

SEQ ID NO: 175437 - DNA, 20 bp, Artificial
  CRISPR gRNA sequence
tgtgtattttgcttgttctt

SEQ ID NO: 175438 - DNA, 20 bp, Artificial
  CRISPR gRNA sequence
tgtattttgcttgttctttc

SEQ ID NO: 175439 - DNA, 20 bp, Artificial
  CRISPR gRNA sequence
tgcttgttctttccatatca

SEQ ID NO: 175440 - DNA, 20 bp, Artificial
  CRISPR gRNA sequence
gcttgttctttccatatcag

SEQ ID NO: 175441 - DNA, 20 bp, Artificial
  CRISPR gRNA sequence
cttgttctttccatatcagt

SEQ ID NO: 175442 - DNA, 20 bp, Artificial
  CRISPR gRNA sequence
gttctttccatatcagtttc

SEQ ID NO: 175443 - DNA, 20 bp, Artificial
  CRISPR gRNA sequence
ttctttccatatcagtttct

SEQ ID NO: 175444 - DNA, 20 bp, Artificial
  CRISPR gRNA sequence
tttccatatcagtttctaat

SEQ ID NO: 175445 - DNA, 20 bp, Artificial
  CRISPR gRNA sequence
tccatatcagtttctaatac

SEQ ID NO: 175446 - DNA, 20 bp, Artificial
  CRISPR gRNA sequence
ccatatcagtttctaatact

SEQ ID NO: 175447 - DNA, 20 bp, Artificial
  CRISPR gRNA sequence
catatcagtttctaatactt

SEQ ID NO: 175448 - DNA, 20 bp, Artificial
  CRISPR gRNA sequence
ctaatacttgataaacatca

SEQ ID NO: 175449 - DNA, 20 bp, Artificial
  CRISPR gRNA sequence
taatacttgataaacatcat

SEQ ID NO: 175450 - DNA, 20 bp, Artificial
  CRISPR gRNA sequence
atacttgataaacatcatca

SEQ ID NO: 175451 - DNA, 20 bp, Artificial
  CRISPR gRNA sequence
gataaacatcatcagtctca

SEQ ID NO: 175452 - DNA, 20 bp, Artificial
  CRISPR gRNA sequence
ataaacatcatcagtctcag

SEQ ID NO: 175453 - DNA, 20 bp, Artificial
  CRISPR gRNA sequence
agagtaaaattttatttgta

SEQ ID NO: 175454 - DNA, 20 bp, Artificial
  CRISPR gRNA sequence
tatttgtatacatttttaaa

SEQ ID NO: 175455 - DNA, 20 bp, Artificial
  CRISPR gRNA sequence
atttgtatacatttttaaag

SEQ ID NO: 175456 - DNA, 20 bp, Artificial
  CRISPR gRNA sequence
tttgtatacatttttaaagt

SEQ ID NO: 175457 - DNA, 20 bp, Artificial
  CRISPR gRNA sequence
gtatacatttttaaagtctc

SEQ ID NO: 175458 - DNA, 20 bp, Artificial
  CRISPR gRNA sequence
tatacatttttaaagtctcc

SEQ ID NO: 175459 - DNA, 20 bp, Artificial
  CRISPR gRNA sequence
ttaaagtctccacaaaaaag

SEQ ID NO: 175460 - DNA, 20 bp, Artificial
  CRISPR gRNA sequence
taaagtctccacaaaaaaga

SEQ ID NO: 175461 - DNA, 20 bp, Artificial
  CRISPR gRNA sequence
aaagtctccacaaaaaagac

SEQ ID NO: 175462 - DNA, 20 bp, Artificial
  CRISPR gRNA sequence
aagtctccacaaaaaagaca

SEQ ID NO: 175463 - DNA, 20 bp, Artificial
  CRISPR gRNA sequence
cacaaaaaagacatgcatgc

SEQ ID NO: 175464 - DNA, 20 bp, Artificial
  CRISPR gRNA sequence
atgaaaggaagtgtaaaaag

SEQ ID NO: 175465 - DNA, 20 bp, Artificial
  CRISPR gRNA sequence
tagcatttccttgaaagtaa

SEQ ID NO: 175466 - DNA, 20 bp, Artificial
  CRISPR gRNA sequence
agcatttccttgaaagtaag

SEQ ID NO: 175467 - DNA, 20 bp, Artificial
  CRISPR gRNA sequence
gcatttccttgaaagtaaga

SEQ ID NO: 175468 - DNA, 20 bp, Artificial
  CRISPR gRNA sequence
ccttgaaagtaagaactata

SEQ ID NO: 175469 - DNA, 20 bp, Artificial
  CRISPR gRNA sequence
cttgaaagtaagaactatat

SEQ ID NO: 175470 - DNA, 20 bp, Artificial
  CRISPR gRNA sequence
gaaagtaagaactatatagc

SEQ ID NO: 175471 - DNA, 20 bp, Artificial
  CRISPR gRNA sequence
aaagtaagaactatatagct

SEQ ID NO: 175472 - DNA, 20 bp, Artificial
  CRISPR gRNA sequence
tatagcttaggtagacagaa

SEQ ID NO: 175473 - DNA, 20 bp, Artificial
  CRISPR gRNA sequence
aggtagacagaagaaaattt

SEQ ID NO: 175474 - DNA, 20 bp, Artificial
  CRISPR gRNA sequence
ggtagacagaagaaaatttc

SEQ ID NO: 175475 - DNA, 20 bp, Artificial
  CRISPR gRNA sequence
cattttatctggatattttc

SEQ ID NO: 175476 - DNA, 20 bp, Artificial
  CRISPR gRNA sequence
attttatctggatattttca

SEQ ID NO: 175477 - DNA, 20 bp, Artificial
  CRISPR gRNA sequence
tatctggatattttcaattg

SEQ ID NO: 175478 - DNA, 20 bp, Artificial
  CRISPR gRNA sequence
atctggatattttcaattga

SEQ ID NO: 175479 - DNA, 20 bp, Artificial
  CRISPR gRNA sequence
tctggatattttcaattgag

SEQ ID NO: 175480 - DNA, 20 bp, Artificial
  CRISPR gRNA sequence
gatattttcaattgagcagg

SEQ ID NO: 175481 - DNA, 20 bp, Artificial
  CRISPR gRNA sequence
tcaattgagcaggtcttccc

SEQ ID NO: 175482 - DNA, 20 bp, Artificial
  CRISPR gRNA sequence
caattgagcaggtcttccct

SEQ ID NO: 175483 - DNA, 20 bp, Artificial
  CRISPR gRNA sequence
aattgagcaggtcttccctt

SEQ ID NO: 175484 - DNA, 20 bp, Artificial
  CRISPR gRNA sequence
agcaggtcttccctttagtt

SEQ ID NO: 175485 - DNA, 20 bp, Artificial
  CRISPR gRNA sequence
ccctttagttttctatgtaa

SEQ ID NO: 175486 - DNA, 20 bp, Artificial
  CRISPR gRNA sequence
cctttagttttctatgtaat

SEQ ID NO: 175487 - DNA, 20 bp, Artificial
  CRISPR gRNA sequence
tagttttctatgtaattgaa

SEQ ID NO: 175488 - DNA, 20 bp, Artificial
  CRISPR gRNA sequence
agttttctatgtaattgaaa

SEQ ID NO: 175489 - DNA, 20 bp, Artificial
  CRISPR gRNA sequence
gttttctatgtaattgaaac

SEQ ID NO: 175490 - DNA, 20 bp, Artificial
  CRISPR gRNA sequence
tctatgtaattgaaactatg

SEQ ID NO: 175491 - DNA, 20 bp, Artificial
  CRISPR gRNA sequence
ctatgtaattgaaactatgg

SEQ ID NO: 175492 - DNA, 20 bp, Artificial
  CRISPR gRNA sequence
tatgtaattgaaactatgga

SEQ ID NO: 175493 - DNA, 20 bp, Artificial
  CRISPR gRNA sequence
tgtaattgaaactatggaaa

SEQ ID NO: 175494 - DNA, 20 bp, Artificial
  CRISPR gRNA sequence
aaactatggaaacagaccaa

SEQ ID NO: 175495 - DNA, 20 bp, Artificial
  CRISPR gRNA sequence
tggaaacagaccaaaacggt

SEQ ID NO: 175496 - DNA, 20 bp, Artificial
  CRISPR gRNA sequence
ccaagaagaaaggataacca

SEQ ID NO: 175497 - DNA, 20 bp, Artificial
  CRISPR gRNA sequence
caagaagaaaggataaccaa

SEQ ID NO: 175498 - DNA, 20 bp, Artificial
  CRISPR gRNA sequence
gcactgctatttgctgtagt

SEQ ID NO: 175499 - DNA, 20 bp, Artificial
  CRISPR gRNA sequence
ctatttgctgtagttatttt

SEQ ID NO: 175500 - DNA, 20 bp, Artificial
  CRISPR gRNA sequence
tttgctgtagttattttagt

SEQ ID NO: 175501 - DNA, 20 bp, Artificial
  CRISPR gRNA sequence
gctgtagttattttagtctt

SEQ ID NO: 175502 - DNA, 20 bp, Artificial
  CRISPR gRNA sequence
ctgtagttattttagtcttc

SEQ ID NO: 175503 - DNA, 20 bp, Artificial
  CRISPR gRNA sequence
tagttattttagtcttcttt

SEQ ID NO: 175504 - DNA, 20 bp, Artificial
  CRISPR gRNA sequence
ttttagtcttctttctttga

SEQ ID NO: 175505 - DNA, 20 bp, Artificial
  CRISPR gRNA sequence
tagtcttctttctttgaact

SEQ ID NO: 175506 - DNA, 20 bp, Artificial
  CRISPR gRNA sequence
agtcttctttctttgaacta

SEQ ID NO: 175507 - DNA, 20 bp, Artificial
  CRISPR gRNA sequence
gtcttctttctttgaactaa

SEQ ID NO: 175508 - DNA, 20 bp, Artificial
  CRISPR gRNA sequence
ctttctttgaactaaggaac

SEQ ID NO: 175509 - DNA, 20 bp, Artificial
  CRISPR gRNA sequence
tttctttgaactaaggaaca

SEQ ID NO: 175510 - DNA, 20 bp, Artificial
  CRISPR gRNA sequence
tctttgaactaaggaacaca

SEQ ID NO: 175511 - DNA, 20 bp, Artificial
  CRISPR gRNA sequence
ctttgaactaaggaacacaa

SEQ ID NO: 175512 - DNA, 20 bp, Artificial
  CRISPR gRNA sequence
tttgaactaaggaacacaag

SEQ ID NO: 175513 - DNA, 20 bp, Artificial
  CRISPR gRNA sequence
tgaactaaggaacacaaggt

SEQ ID NO: 175514 - DNA, 20 bp, Artificial
  CRISPR gRNA sequence
gaactaaggaacacaaggtc

SEQ ID NO: 175515 - DNA, 20 bp, Artificial
  CRISPR gRNA sequence
aactaaggaacacaaggtca

SEQ ID NO: 175516 - DNA, 20 bp, Artificial
  CRISPR gRNA sequence
aggaacacaaggtcacaatg

SEQ ID NO: 175517 - DNA, 20 bp, Artificial
  CRISPR gRNA sequence
tgccactttaaagttaaaca

SEQ ID NO: 175518 - DNA, 20 bp, Artificial
  CRISPR gRNA sequence
taaagttaaacatttactat

SEQ ID NO: 175519 - DNA, 20 bp, Artificial
  CRISPR gRNA sequence
aaagttaaacatttactatg

SEQ ID NO: 175520 - DNA, 20 bp, Artificial
  CRISPR gRNA sequence
aagttaaacatttactatgt

SEQ ID NO: 175521 - DNA, 20 bp, Artificial
  CRISPR gRNA sequence
aacatttactatgttttttt

SEQ ID NO: 175522 - DNA, 20 bp, Artificial
  CRISPR gRNA sequence
actatgtttttttttcttta

SEQ ID NO: 175523 - DNA, 20 bp, Artificial
  CRISPR gRNA sequence
ctatgtttttttttctttag

SEQ ID NO: 175524 - DNA, 20 bp, Artificial
  CRISPR gRNA sequence
tgtttttttttctttagttc

SEQ ID NO: 175525 - DNA, 20 bp, Artificial
  CRISPR gRNA sequence
ttttttctttagttcttcct

SEQ ID NO: 175526 - DNA, 20 bp, Artificial
  CRISPR gRNA sequence
tttttctttagttcttcctt

SEQ ID NO: 175527 - DNA, 20 bp, Artificial
  CRISPR gRNA sequence
ttttctttagttcttccttt

SEQ ID NO: 175528 - DNA, 20 bp, Artificial
  CRISPR gRNA sequence
tttctttagttcttccttta

SEQ ID NO: 175529 - DNA, 20 bp, Artificial
  CRISPR gRNA sequence
ttctttagttcttcctttat

SEQ ID NO: 175530 - DNA, 20 bp, Artificial
  CRISPR gRNA sequence
tctttagttcttcctttata

SEQ ID NO: 175531 - DNA, 20 bp, Artificial
  CRISPR gRNA sequence
ctttagttcttcctttatac

SEQ ID NO: 175532 - DNA, 20 bp, Artificial
  CRISPR gRNA sequence
tttagttcttcctttatact

SEQ ID NO: 175533 - DNA, 20 bp, Artificial
  CRISPR gRNA sequence
tagttcttcctttatactgg

SEQ ID NO: 175534 - DNA, 20 bp, Artificial
  CRISPR gRNA sequence
agttcttcctttatactgga

SEQ ID NO: 175535 - DNA, 20 bp, Artificial
  CRISPR gRNA sequence
gttcttcctttatactggaa

SEQ ID NO: 175536 - DNA, 20 bp, Artificial
  CRISPR gRNA sequence
ttcctttatactggaattta

SEQ ID NO: 175537 - DNA, 20 bp, Artificial
  CRISPR gRNA sequence
cctttatactggaatttacc

SEQ ID NO: 175538 - DNA, 20 bp, Artificial
  CRISPR gRNA sequence
ctttatactggaatttacct

SEQ ID NO: 175539 - DNA, 20 bp, Artificial
  CRISPR gRNA sequence
tatactggaatttaccttca

SEQ ID NO: 175540 - DNA, 20 bp, Artificial
  CRISPR gRNA sequence
atactggaatttaccttcat

SEQ ID NO: 175541 - DNA, 20 bp, Artificial
  CRISPR gRNA sequence
tactggaatttaccttcatt

SEQ ID NO: 175542 - DNA, 20 bp, Artificial
  CRISPR gRNA sequence
gaatttaccttcattcctta

SEQ ID NO: 175543 - DNA, 20 bp, Artificial
  CRISPR gRNA sequence
accttcattccttatccttc

SEQ ID NO: 175544 - DNA, 20 bp, Artificial
  CRISPR gRNA sequence
ccttcattccttatccttcg

SEQ ID NO: 175545 - DNA, 20 bp, Artificial
  CRISPR gRNA sequence
cattccttatccttcgattg

SEQ ID NO: 175546 - DNA, 20 bp, Artificial
  CRISPR gRNA sequence
attccttatccttcgattgc

SEQ ID NO: 175547 - DNA, 20 bp, Artificial
  CRISPR gRNA sequence
cttatccttcgattgcccat

SEQ ID NO: 175548 - DNA, 20 bp, Artificial
  CRISPR gRNA sequence
atccttcgattgcccatttt

SEQ ID NO: 175549 - DNA, 20 bp, Artificial
  CRISPR gRNA sequence
tccttcgattgcccattttc

SEQ ID NO: 175550 - DNA, 20 bp, Artificial
  CRISPR gRNA sequence
cgattgcccattttcactgc

SEQ ID NO: 175551 - DNA, 20 bp, Artificial
  CRISPR gRNA sequence
gattgcccattttcactgca

SEQ ID NO: 175552 - DNA, 20 bp, Artificial
  CRISPR gRNA sequence
cccattttcactgcaggtgc

SEQ ID NO: 175553 - DNA, 20 bp, Artificial
  CRISPR gRNA sequence
tcactgcaggtgctagactg

SEQ ID NO: 175554 - DNA, 20 bp, Artificial
  CRISPR gRNA sequence
cactgcaggtgctagactgt

SEQ ID NO: 175555 - DNA, 20 bp, Artificial
  CRISPR gRNA sequence
actgcaggtgctagactgta

SEQ ID NO: 175556 - DNA, 20 bp, Artificial
  CRISPR gRNA sequence
caggtgctagactgtaatct

SEQ ID NO: 175557 - DNA, 20 bp, Artificial
  CRISPR gRNA sequence
gactgtaatctaatttagaa

SEQ ID NO: 175558 - DNA, 20 bp, Artificial
  CRISPR gRNA sequence
taatctaatttagaaaaaat

SEQ ID NO: 175559 - DNA, 20 bp, Artificial
  CRISPR gRNA sequence
atttagaaaaaatactataa

SEQ ID NO: 175560 - DNA, 20 bp, Artificial
  CRISPR gRNA sequence
agaaaaaatactataagtag

SEQ ID NO: 175561 - DNA, 20 bp, Artificial
  CRISPR gRNA sequence
gaaaaaatactataagtaga

SEQ ID NO: 175562 - DNA, 20 bp, Artificial
  CRISPR gRNA sequence
taagtagagaaaaacttttg

SEQ ID NO: 175563 - DNA, 20 bp, Artificial
  CRISPR gRNA sequence
ttggtcaattattgaacagc

SEQ ID NO: 175564 - DNA, 20 bp, Artificial
  CRISPR gRNA sequence
tggtcaattattgaacagcg

SEQ ID NO: 175565 - DNA, 20 bp, Artificial
  CRISPR gRNA sequence
ggtcaattattgaacagcgg

SEQ ID NO: 175566 - DNA, 20 bp, Artificial
  CRISPR gRNA sequence
gtcaattattgaacagcggg

SEQ ID NO: 175567 - DNA, 20 bp, Artificial
  CRISPR gRNA sequence
ttgaacagcggggtctagct

SEQ ID NO: 175568 - DNA, 20 bp, Artificial
  CRISPR gRNA sequence
aacagcggggtctagctttg

SEQ ID NO: 175569 - DNA, 20 bp, Artificial
  CRISPR gRNA sequence
gctttgggatccctaaggga

SEQ ID NO: 175570 - DNA, 20 bp, Artificial
  CRISPR gRNA sequence
tgggatccctaagggagaga

SEQ ID NO: 175571 - DNA, 20 bp, Artificial
  CRISPR gRNA sequence
gggatccctaagggagagac

SEQ ID NO: 175572 - DNA, 20 bp, Artificial
  CRISPR gRNA sequence
ggatccctaagggagagaca

SEQ ID NO: 175573 - DNA, 20 bp, Artificial
  CRISPR gRNA sequence
agggagagacaagaagataa

SEQ ID NO: 175574 - DNA, 20 bp, Artificial
  CRISPR gRNA sequence
accacgttataaagaggtgg

SEQ ID NO: 175575 - DNA, 20 bp, Artificial
  CRISPR gRNA sequence
taaagaggtgggcccccata

SEQ ID NO: 175576 - DNA, 20 bp, Artificial
  CRISPR gRNA sequence
aaaagaaaactagccaggca

SEQ ID NO: 175577 - DNA, 20 bp, Artificial
  CRISPR gRNA sequence
gccaggcacagatgctcaca

SEQ ID NO: 175578 - DNA, 20 bp, Artificial
  CRISPR gRNA sequence
acacctgtaaatgccagtgc

SEQ ID NO: 175579 - DNA, 20 bp, Artificial
  CRISPR gRNA sequence
taaatgccagtgctttggga

SEQ ID NO: 175580 - DNA, 20 bp, Artificial
  CRISPR gRNA sequence
tgggaggctgaggtagaaag

SEQ ID NO: 175581 - DNA, 20 bp, Artificial
  CRISPR gRNA sequence
gggaggctgaggtagaaaga

SEQ ID NO: 175582 - DNA, 20 bp, Artificial
  CRISPR gRNA sequence
ggaggctgaggtagaaagat

SEQ ID NO: 175583 - DNA, 20 bp, Artificial
  CRISPR gRNA sequence
aggtagaaagatcctttgag

SEQ ID NO: 175584 - DNA, 20 bp, Artificial
  CRISPR gRNA sequence
tgaggccaggagttcgagac

SEQ ID NO: 175585 - DNA, 20 bp, Artificial
  CRISPR gRNA sequence
gaggccaggagttcgagacc

SEQ ID NO: 175586 - DNA, 20 bp, Artificial
  CRISPR gRNA sequence
aggccaggagttcgagacca

SEQ ID NO: 175587 - DNA, 20 bp, Artificial
  CRISPR gRNA sequence
gagaccagccagggaaaata

SEQ ID NO: 175588 - DNA, 20 bp, Artificial
  CRISPR gRNA sequence
catttctacaggaaaaaaaa

SEQ ID NO: 175589 - DNA, 20 bp, Artificial
  CRISPR gRNA sequence
ctacaggaaaaaaaaaaaaa

SEQ ID NO: 175590 - DNA, 20 bp, Artificial
  CRISPR gRNA sequence
tacaggaaaaaaaaaaaaag

SEQ ID NO: 175591 - DNA, 20 bp, Artificial
  CRISPR gRNA sequence
caggaaaaaaaaaaaaagtt

SEQ ID NO: 175592 - DNA, 20 bp, Artificial
  CRISPR gRNA sequence
ttgttttttgtttttttttc

SEQ ID NO: 175593 - DNA, 20 bp, Artificial
  CRISPR gRNA sequence
tgttttttgtttttttttct

SEQ ID NO: 175594 - DNA, 20 bp, Artificial
  CRISPR gRNA sequence
gttttttgtttttttttctt

SEQ ID NO: 175595 - DNA, 20 bp, Artificial
  CRISPR gRNA sequence
ttttttgtttttttttcttg

SEQ ID NO: 175596 - DNA, 20 bp, Artificial
  CRISPR gRNA sequence
tttgtttttttttcttgaga

SEQ ID NO: 175597 - DNA, 20 bp, Artificial
  CRISPR gRNA sequence
ttgtttttttttcttgagac

SEQ ID NO: 175598 - DNA, 20 bp, Artificial
  CRISPR gRNA sequence
tgtttttttttcttgagacg

SEQ ID NO: 175599 - DNA, 20 bp, Artificial
  CRISPR gRNA sequence
gtttttttttcttgagacgg

SEQ ID NO: 175600 - DNA, 20 bp, Artificial
  CRISPR gRNA sequence
tttttttttcttgagacgga

SEQ ID NO: 175601 - DNA, 20 bp, Artificial
  CRISPR gRNA sequence
ttttttcttgagacggaatc

SEQ ID NO: 175602 - DNA, 20 bp, Artificial
  CRISPR gRNA sequence
tttttcttgagacggaatct

SEQ ID NO: 175603 - DNA, 20 bp, Artificial
  CRISPR gRNA sequence
ttttcttgagacggaatctc

SEQ ID NO: 175604 - DNA, 20 bp, Artificial
  CRISPR gRNA sequence
tttcttgagacggaatctca

SEQ ID NO: 175605 - DNA, 20 bp, Artificial
  CRISPR gRNA sequence
ttcttgagacggaatctcac

SEQ ID NO: 175606 - DNA, 20 bp, Artificial
  CRISPR gRNA sequence
tcttgagacggaatctcact

SEQ ID NO: 175607 - DNA, 20 bp, Artificial
  CRISPR gRNA sequence
cttgagacggaatctcactc

SEQ ID NO: 175608 - DNA, 20 bp, Artificial
  CRISPR gRNA sequence
ttgagacggaatctcactct

SEQ ID NO: 175609 - DNA, 20 bp, Artificial
  CRISPR gRNA sequence
gagacggaatctcactctgt

SEQ ID NO: 175610 - DNA, 20 bp, Artificial
  CRISPR gRNA sequence
agacggaatctcactctgtt

SEQ ID NO: 175611 - DNA, 20 bp, Artificial
  CRISPR gRNA sequence
actctgttgcccaggctgga

SEQ ID NO: 175612 - DNA, 20 bp, Artificial
  CRISPR gRNA sequence
tgttgcccaggctggagtgc

SEQ ID NO: 175613 - DNA, 20 bp, Artificial
  CRISPR gRNA sequence
ttgcccaggctggagtgcag

SEQ ID NO: 175614 - DNA, 20 bp, Artificial
  CRISPR gRNA sequence
cccaggctggagtgcagtgg

SEQ ID NO: 175615 - DNA, 20 bp, Artificial
  CRISPR gRNA sequence
gagtgcagtggcactatcat

SEQ ID NO: 175616 - DNA, 20 bp, Artificial
  CRISPR gRNA sequence
tcatggctcactgcaacctc

SEQ ID NO: 175617 - DNA, 20 bp, Artificial
  CRISPR gRNA sequence
actgcaacctcccagttcaa

SEQ ID NO: 175618 - DNA, 20 bp, Artificial
  CRISPR gRNA sequence
caacctcccagttcaagcaa

SEQ ID NO: 175619 - DNA, 20 bp, Artificial
  CRISPR gRNA sequence
ccagttcaagcaattcttgt

SEQ ID NO: 175620 - DNA, 20 bp, Artificial
  CRISPR gRNA sequence
aagcaattcttgtgcctcag

SEQ ID NO: 175621 - DNA, 20 bp, Artificial
  CRISPR gRNA sequence
ttgtgcctcagcctcctgta

SEQ ID NO: 175622 - DNA, 20 bp, Artificial
  CRISPR gRNA sequence
gtgcctcagcctcctgtata

SEQ ID NO: 175623 - DNA, 20 bp, Artificial
  CRISPR gRNA sequence
tgcctcagcctcctgtatag

SEQ ID NO: 175624 - DNA, 20 bp, Artificial
  CRISPR gRNA sequence
agcctcctgtatagctggga

SEQ ID NO: 175625 - DNA, 20 bp, Artificial
  CRISPR gRNA sequence
ctgtatagctgggactacgc

SEQ ID NO: 175626 - DNA, 20 bp, Artificial
  CRISPR gRNA sequence
tatagctgggactacgcctg

SEQ ID NO: 175627 - DNA, 20 bp, Artificial
  CRISPR gRNA sequence
ggactacgcctggctaattt

SEQ ID NO: 175628 - DNA, 20 bp, Artificial
  CRISPR gRNA sequence
cgcctggctaatttcggtgt

SEQ ID NO: 175629 - DNA, 20 bp, Artificial
  CRISPR gRNA sequence
gctaatttcggtgttttttt

SEQ ID NO: 175630 - DNA, 20 bp, Artificial
  CRISPR gRNA sequence
atttcggtgtttttttagta

SEQ ID NO: 175631 - DNA, 20 bp, Artificial
  CRISPR gRNA sequence
cggtgtttttttagtaaagg

SEQ ID NO: 175632 - DNA, 20 bp, Artificial
  CRISPR gRNA sequence
ggtgtttttttagtaaaggc

SEQ ID NO: 175633 - DNA, 20 bp, Artificial
  CRISPR gRNA sequence
ttttagtaaaggctgggttt

SEQ ID NO: 175634 - DNA, 20 bp, Artificial
  CRISPR gRNA sequence
tttagtaaaggctgggtttc

SEQ ID NO: 175635 - DNA, 20 bp, Artificial
  CRISPR gRNA sequence
ttagtaaaggctgggtttca

SEQ ID NO: 175636 - DNA, 20 bp, Artificial
  CRISPR gRNA sequence
tagtaaaggctgggtttcac

SEQ ID NO: 175637 - DNA, 20 bp, Artificial
  CRISPR gRNA sequence
agtaaaggctgggtttcacc

SEQ ID NO: 175638 - DNA, 20 bp, Artificial
  CRISPR gRNA sequence
gtaaaggctgggtttcacca

SEQ ID NO: 175639 - DNA, 20 bp, Artificial
  CRISPR gRNA sequence
ggtttcaccatgttggccag

SEQ ID NO: 175640 - DNA, 20 bp, Artificial
  CRISPR gRNA sequence
caccatgttggccaggctgg

SEQ ID NO: 175641 - DNA, 20 bp, Artificial
  CRISPR gRNA sequence
accatgttggccaggctggt

SEQ ID NO: 175642 - DNA, 20 bp, Artificial
  CRISPR gRNA sequence
gccaggctggtctcaaactc

SEQ ID NO: 175643 - DNA, 20 bp, Artificial
  CRISPR gRNA sequence
gtctcaaactcctgacctca

SEQ ID NO: 175644 - DNA, 20 bp, Artificial
  CRISPR gRNA sequence
aaactcctgacctcaagtga

SEQ ID NO: 175645 - DNA, 20 bp, Artificial
  CRISPR gRNA sequence
ctgacctcaagtgatccgcc

SEQ ID NO: 175646 - DNA, 20 bp, Artificial
  CRISPR gRNA sequence
acctcaagtgatccgcccac

SEQ ID NO: 175647 - DNA, 20 bp, Artificial
  CRISPR gRNA sequence
aagtgatccgcccaccttgg

SEQ ID NO: 175648 - DNA, 20 bp, Artificial
  CRISPR gRNA sequence
ggcctcccaaagtgctggga

SEQ ID NO: 175649 - DNA, 20 bp, Artificial
  CRISPR gRNA sequence
gcctcccaaagtgctgggat

SEQ ID NO: 175650 - DNA, 20 bp, Artificial
  CRISPR gRNA sequence
ccaaagtgctgggattacag

SEQ ID NO: 175651 - DNA, 20 bp, Artificial
  CRISPR gRNA sequence
ggattacaggcatgatccac

SEQ ID NO: 175652 - DNA, 20 bp, Artificial
  CRISPR gRNA sequence
caggcatgatccaccacacc

SEQ ID NO: 175653 - DNA, 20 bp, Artificial
  CRISPR gRNA sequence
ttatttatttatttatttat

SEQ ID NO: 175654 - DNA, 20 bp, Artificial
  CRISPR gRNA sequence
tttatttatttatttattta

SEQ ID NO: 175655 - DNA, 20 bp, Artificial
  CRISPR gRNA sequence
atttatttatttatttattt

SEQ ID NO: 175656 - DNA, 20 bp, Artificial
  CRISPR gRNA sequence
tttatttatttatttattta

SEQ ID NO: 175657 - DNA, 20 bp, Artificial
  CRISPR gRNA sequence
atttatttatttatttattg

SEQ ID NO: 175658 - DNA, 20 bp, Artificial
  CRISPR gRNA sequence
tttatttatttatttattgt

SEQ ID NO: 175659 - DNA, 20 bp, Artificial
  CRISPR gRNA sequence
atttatttatttattgtttt

SEQ ID NO: 175660 - DNA, 20 bp, Artificial
  CRISPR gRNA sequence
tttatttatttattgttttg

SEQ ID NO: 175661 - DNA, 20 bp, Artificial
  CRISPR gRNA sequence
atttatttattgttttgaga

SEQ ID NO: 175662 - DNA, 20 bp, Artificial
  CRISPR gRNA sequence
tttatttattgttttgagac

SEQ ID NO: 175663 - DNA, 20 bp, Artificial
  CRISPR gRNA sequence
atttattgttttgagacatg

SEQ ID NO: 175664 - DNA, 20 bp, Artificial
  CRISPR gRNA sequence
tttattgttttgagacatgg

SEQ ID NO: 175665 - DNA, 20 bp, Artificial
  CRISPR gRNA sequence
attgttttgagacatggagt

SEQ ID NO: 175666 - DNA, 20 bp, Artificial
  CRISPR gRNA sequence
ttgttttgagacatggagtc

SEQ ID NO: 175667 - DNA, 20 bp, Artificial
  CRISPR gRNA sequence
ttttgagacatggagtctcg

SEQ ID NO: 175668 - DNA, 20 bp, Artificial
  CRISPR gRNA sequence
tgagacatggagtctcgatt

SEQ ID NO: 175669 - DNA, 20 bp, Artificial
  CRISPR gRNA sequence
gagacatggagtctcgattt

SEQ ID NO: 175670 - DNA, 20 bp, Artificial
  CRISPR gRNA sequence
agacatggagtctcgatttg

SEQ ID NO: 175671 - DNA, 20 bp, Artificial
  CRISPR gRNA sequence
gatttgttgcacaggctgga

SEQ ID NO: 175672 - DNA, 20 bp, Artificial
  CRISPR gRNA sequence
gttgcacaggctggagtgca

SEQ ID NO: 175673 - DNA, 20 bp, Artificial
  CRISPR gRNA sequence
ttgcacaggctggagtgcag

SEQ ID NO: 175674 - DNA, 20 bp, Artificial
  CRISPR gRNA sequence
cacaggctggagtgcagtgg

SEQ ID NO: 175675 - DNA, 20 bp, Artificial
  CRISPR gRNA sequence
gagtgcagtggcgccatgtc

SEQ ID NO: 175676 - DNA, 20 bp, Artificial
  CRISPR gRNA sequence
actgcaagctccgcctcccg

SEQ ID NO: 175677 - DNA, 20 bp, Artificial
  CRISPR gRNA sequence
caagctccgcctcccggatt

SEQ ID NO: 175678 - DNA, 20 bp, Artificial
  CRISPR gRNA sequence
cgcctcccggattcatgcca

SEQ ID NO: 175679 - DNA, 20 bp, Artificial
  CRISPR gRNA sequence
ccggattcatgccattctcc

SEQ ID NO: 175680 - DNA, 20 bp, Artificial
  CRISPR gRNA sequence
atgccattctcctgcctcag

SEQ ID NO: 175681 - DNA, 20 bp, Artificial
  CRISPR gRNA sequence
tcctgcctcagcctgccgag

SEQ ID NO: 175682 - DNA, 20 bp, Artificial
  CRISPR gRNA sequence
ctgcctcagcctgccgagta

SEQ ID NO: 175683 - DNA, 20 bp, Artificial
  CRISPR gRNA sequence
cctcagcctgccgagtagct

SEQ ID NO: 175684 - DNA, 20 bp, Artificial
  CRISPR gRNA sequence
agcctgccgagtagctggga

SEQ ID NO: 175685 - DNA, 20 bp, Artificial
  CRISPR gRNA sequence
ccgagtagctgggactacag

SEQ ID NO: 175686 - DNA, 20 bp, Artificial
  CRISPR gRNA sequence
ggactacaggcgcccgccac

SEQ ID NO: 175687 - DNA, 20 bp, Artificial
  CRISPR gRNA sequence
caggcgcccgccaccacacc

SEQ ID NO: 175688 - DNA, 20 bp, Artificial
  CRISPR gRNA sequence
attttttgtatttttagtag

SEQ ID NO: 175689 - DNA, 20 bp, Artificial
  CRISPR gRNA sequence
tttgtatttttagtagagat

SEQ ID NO: 175690 - DNA, 20 bp, Artificial
  CRISPR gRNA sequence
ttgtatttttagtagagatg

SEQ ID NO: 175691 - DNA, 20 bp, Artificial
  CRISPR gRNA sequence
tgtatttttagtagagatga

SEQ ID NO: 175692 - DNA, 20 bp, Artificial
  CRISPR gRNA sequence
gtatttttagtagagatgag

SEQ ID NO: 175693 - DNA, 20 bp, Artificial
  CRISPR gRNA sequence
tatttttagtagagatgagg

SEQ ID NO: 175694 - DNA, 20 bp, Artificial
  CRISPR gRNA sequence
ttagtagagatgaggtttaa

SEQ ID NO: 175695 - DNA, 20 bp, Artificial
  CRISPR gRNA sequence
tagtagagatgaggtttaac

SEQ ID NO: 175696 - DNA, 20 bp, Artificial
  CRISPR gRNA sequence
agtagagatgaggtttaacc

SEQ ID NO: 175697 - DNA, 20 bp, Artificial
  CRISPR gRNA sequence
gtagagatgaggtttaacca

SEQ ID NO: 175698 - DNA, 20 bp, Artificial
  CRISPR gRNA sequence
aaccatgttagccaggatgg

SEQ ID NO: 175699 - DNA, 20 bp, Artificial
  CRISPR gRNA sequence
accatgttagccaggatggt

SEQ ID NO: 175700 - DNA, 20 bp, Artificial
  CRISPR gRNA sequence
gccaggatggtcttgatctc

SEQ ID NO: 175701 - DNA, 20 bp, Artificial
  CRISPR gRNA sequence
gatctcctgacctcgtgatc

SEQ ID NO: 175702 - DNA, 20 bp, Artificial
  CRISPR gRNA sequence
atctcctgacctcgtgatct

SEQ ID NO: 175703 - DNA, 20 bp, Artificial
  CRISPR gRNA sequence
ctgacctcgtgatctgcctg

SEQ ID NO: 175704 - DNA, 20 bp, Artificial
  CRISPR gRNA sequence
acctcgtgatctgcctgcct

SEQ ID NO: 175705 - DNA, 20 bp, Artificial
  CRISPR gRNA sequence
gtgatctgcctgcctcggcc

SEQ ID NO: 175706 - DNA, 20 bp, Artificial
  CRISPR gRNA sequence
cctgcctcggcctcccaaag

SEQ ID NO: 175707 - DNA, 20 bp, Artificial
  CRISPR gRNA sequence
cctcggcctcccaaagtgct

SEQ ID NO: 175708 - DNA, 20 bp, Artificial
  CRISPR gRNA sequence
ggcctcccaaagtgctggga

SEQ ID NO: 175709 - DNA, 20 bp, Artificial
  CRISPR gRNA sequence
ccaaagtgctgggattacag

SEQ ID NO: 175710 - DNA, 20 bp, Artificial
  CRISPR gRNA sequence
ggattacaggcgtgagccac

SEQ ID NO: 175711 - DNA, 20 bp, Artificial
  CRISPR gRNA sequence
caggcgtgagccaccacgcc

SEQ ID NO: 175712 - DNA, 20 bp, Artificial
  CRISPR gRNA sequence
ccctcaaaatttttttttaa

SEQ ID NO: 175713 - DNA, 20 bp, Artificial
  CRISPR gRNA sequence
aaaatttttttttaattagc

SEQ ID NO: 175714 - DNA, 20 bp, Artificial
  CRISPR gRNA sequence
ttttttaattagccaggcct

SEQ ID NO: 175715 - DNA, 20 bp, Artificial
  CRISPR gRNA sequence
tttttaattagccaggccta

SEQ ID NO: 175716 - DNA, 20 bp, Artificial
  CRISPR gRNA sequence
ttttaattagccaggcctag

SEQ ID NO: 175717 - DNA, 20 bp, Artificial
  CRISPR gRNA sequence
tttaattagccaggcctagt

SEQ ID NO: 175718 - DNA, 20 bp, Artificial
  CRISPR gRNA sequence
ttaattagccaggcctagta

SEQ ID NO: 175719 - DNA, 20 bp, Artificial
  CRISPR gRNA sequence
taattagccaggcctagtag

SEQ ID NO: 175720 - DNA, 20 bp, Artificial
  CRISPR gRNA sequence
aattagccaggcctagtagc

SEQ ID NO: 175721 - DNA, 20 bp, Artificial
  CRISPR gRNA sequence
attagccaggcctagtagcg

SEQ ID NO: 175722 - DNA, 20 bp, Artificial
  CRISPR gRNA sequence
gccaggcctagtagcgtgca

SEQ ID NO: 175723 - DNA, 20 bp, Artificial
  CRISPR gRNA sequence
gtagcgtgcatctgtagtcc

SEQ ID NO: 175724 - DNA, 20 bp, Artificial
  CRISPR gRNA sequence
tagtcccaattactcggagg

SEQ ID NO: 175725 - DNA, 20 bp, Artificial
  CRISPR gRNA sequence
ctcggaggctgaggtgggag

SEQ ID NO: 175726 - DNA, 20 bp, Artificial
  CRISPR gRNA sequence
ggaggctgaggtgggaggac

SEQ ID NO: 175727 - DNA, 20 bp, Artificial
  CRISPR gRNA sequence
aggtgggaggactgcttgag

SEQ ID NO: 175728 - DNA, 20 bp, Artificial
  CRISPR gRNA sequence
cttgagcccaggagtttaag

SEQ ID NO: 175729 - DNA, 20 bp, Artificial
  CRISPR gRNA sequence
gagcccaggagtttaaggtt

SEQ ID NO: 175730 - DNA, 20 bp, Artificial
  CRISPR gRNA sequence
agcccaggagtttaaggttg

SEQ ID NO: 175731 - DNA, 20 bp, Artificial
  CRISPR gRNA sequence
aaggttgcagtgatctatga

SEQ ID NO: 175732 - DNA, 20 bp, Artificial
  CRISPR gRNA sequence
aggttgcagtgatctatgat

SEQ ID NO: 175733 - DNA, 20 bp, Artificial
  CRISPR gRNA sequence
cagtgatctatgattacacc

SEQ ID NO: 175734 - DNA, 20 bp, Artificial
  CRISPR gRNA sequence
tgattacaccactacactct

SEQ ID NO: 175735 - DNA, 20 bp, Artificial
  CRISPR gRNA sequence
caccactacactctagcctg

SEQ ID NO: 175736 - DNA, 20 bp, Artificial
  CRISPR gRNA sequence
cactctagcctgggtgacag

SEQ ID NO: 175737 - DNA, 20 bp, Artificial
  CRISPR gRNA sequence
tagcctgggtgacagagcaa

SEQ ID NO: 175738 - DNA, 20 bp, Artificial
  CRISPR gRNA sequence
gcctgggtgacagagcaaga

SEQ ID NO: 175739 - DNA, 20 bp, Artificial
  CRISPR gRNA sequence
ggtgacagagcaagaccttg

SEQ ID NO: 175740 - DNA, 20 bp, Artificial
  CRISPR gRNA sequence
gtctccaaaaaaaaggaaag

SEQ ID NO: 175741 - DNA, 20 bp, Artificial
  CRISPR gRNA sequence
tctccaaaaaaaaggaaaga

SEQ ID NO: 175742 - DNA, 20 bp, Artificial
  CRISPR gRNA sequence
caaaaaaaaggaaagaaaac

SEQ ID NO: 175743 - DNA, 20 bp, Artificial
  CRISPR gRNA sequence
aacttctgggaaatgtagac

SEQ ID NO: 175744 - DNA, 20 bp, Artificial
  CRISPR gRNA sequence
ctgggaaatgtagacatgaa

SEQ ID NO: 175745 - DNA, 20 bp, Artificial
  CRISPR gRNA sequence
tgggaaatgtagacatgaaa

SEQ ID NO: 175746 - DNA, 20 bp, Artificial
  CRISPR gRNA sequence
ggaaatgtagacatgaaata

SEQ ID NO: 175747 - DNA, 20 bp, Artificial
  CRISPR gRNA sequence
tatccagctatgtctattat

SEQ ID NO: 175748 - DNA, 20 bp, Artificial
  CRISPR gRNA sequence
tccagctatgtctattataa

SEQ ID NO: 175749 - DNA, 20 bp, Artificial
  CRISPR gRNA sequence
tgtctattataatcttcagt

SEQ ID NO: 175750 - DNA, 20 bp, Artificial
  CRISPR gRNA sequence
ttataatcttcagtcagtac

SEQ ID NO: 175751 - DNA, 20 bp, Artificial
  CRISPR gRNA sequence
taatcttcagtcagtacact

SEQ ID NO: 175752 - DNA, 20 bp, Artificial
  CRISPR gRNA sequence
cagtcagtacactttaggac

SEQ ID NO: 175753 - DNA, 20 bp, Artificial
  CRISPR gRNA sequence
agtcagtacactttaggact

SEQ ID NO: 175754 - DNA, 20 bp, Artificial
  CRISPR gRNA sequence
taggacttaaatattacata

SEQ ID NO: 175755 - DNA, 20 bp, Artificial
  CRISPR gRNA sequence
aggacttaaatattacataa

SEQ ID NO: 175756 - DNA, 20 bp, Artificial
  CRISPR gRNA sequence
ggacttaaatattacataac

SEQ ID NO: 175757 - DNA, 20 bp, Artificial
  CRISPR gRNA sequence
aaatattacataacttacat

SEQ ID NO: 175758 - DNA, 20 bp, Artificial
  CRISPR gRNA sequence
aatattacataacttacatc

SEQ ID NO: 175759 - DNA, 20 bp, Artificial
  CRISPR gRNA sequence
cataacttacatcgttcaag

SEQ ID NO: 175760 - DNA, 20 bp, Artificial
  CRISPR gRNA sequence
acatcgttcaagccctcatt

SEQ ID NO: 175761 - DNA, 20 bp, Artificial
  CRISPR gRNA sequence
catcgttcaagccctcattc

SEQ ID NO: 175762 - DNA, 20 bp, Artificial
  CRISPR gRNA sequence
aagccctcattctttcaatg

SEQ ID NO: 175763 - DNA, 20 bp, Artificial
  CRISPR gRNA sequence
attctttcaatggactataa

SEQ ID NO: 175764 - DNA, 20 bp, Artificial
  CRISPR gRNA sequence
tttcaatggactataacttt

SEQ ID NO: 175765 - DNA, 20 bp, Artificial
  CRISPR gRNA sequence
tcaatggactataacttttg

SEQ ID NO: 175766 - DNA, 20 bp, Artificial
  CRISPR gRNA sequence
caatggactataacttttgt

SEQ ID NO: 175767 - DNA, 20 bp, Artificial
  CRISPR gRNA sequence
aatggactataacttttgtc

SEQ ID NO: 175768 - DNA, 20 bp, Artificial
  CRISPR gRNA sequence
taacttttgtctaaatatat

SEQ ID NO: 175769 - DNA, 20 bp, Artificial
  CRISPR gRNA sequence
ttgtctaaatatatgaaggt

SEQ ID NO: 175770 - DNA, 20 bp, Artificial
  CRISPR gRNA sequence
tgtctaaatatatgaaggtc

SEQ ID NO: 175771 - DNA, 20 bp, Artificial
  CRISPR gRNA sequence
gtctaaatatatgaaggtca

SEQ ID NO: 175772 - DNA, 20 bp, Artificial
  CRISPR gRNA sequence
tctaaatatatgaaggtcat

SEQ ID NO: 175773 - DNA, 20 bp, Artificial
  CRISPR gRNA sequence
aatatatgaaggtcatcacc

SEQ ID NO: 175774 - DNA, 20 bp, Artificial
  CRISPR gRNA sequence
cagaaaaattaaaaatgtta

SEQ ID NO: 175775 - DNA, 20 bp, Artificial
  CRISPR gRNA sequence
agaaaaattaaaaatgttaa

SEQ ID NO: 175776 - DNA, 20 bp, Artificial
  CRISPR gRNA sequence
aaaatgttaaagtatatcat

SEQ ID NO: 175777 - DNA, 20 bp, Artificial
  CRISPR gRNA sequence
aagtatatcatggtctatca

SEQ ID NO: 175778 - DNA, 20 bp, Artificial
  CRISPR gRNA sequence
tcaaagaatataaagaacaa

SEQ ID NO: 175779 - DNA, 20 bp, Artificial
  CRISPR gRNA sequence
ctcaaacatacacaagcaca

SEQ ID NO: 175780 - DNA, 20 bp, Artificial
  CRISPR gRNA sequence
aaacatacacaagcacatac

SEQ ID NO: 175781 - DNA, 20 bp, Artificial
  CRISPR gRNA sequence
tgctgatgggaaacagtaaa

SEQ ID NO: 175782 - DNA, 20 bp, Artificial
  CRISPR gRNA sequence
gctgatgggaaacagtaaag

SEQ ID NO: 175783 - DNA, 20 bp, Artificial
  CRISPR gRNA sequence
ctgatgggaaacagtaaagt

SEQ ID NO: 175784 - DNA, 20 bp, Artificial
  CRISPR gRNA sequence
atgggaaacagtaaagtcag

SEQ ID NO: 175785 - DNA, 20 bp, Artificial
  CRISPR gRNA sequence
agatattattttgggtgtct

SEQ ID NO: 175786 - DNA, 20 bp, Artificial
  CRISPR gRNA sequence
ttttgggtgtctataaacaa

SEQ ID NO: 175787 - DNA, 20 bp, Artificial
  CRISPR gRNA sequence
tgggtgtctataaacaatga

SEQ ID NO: 175788 - DNA, 20 bp, Artificial
  CRISPR gRNA sequence
gggtgtctataaacaatgat

SEQ ID NO: 175789 - DNA, 20 bp, Artificial
  CRISPR gRNA sequence
ggtgtctataaacaatgatt

SEQ ID NO: 175790 - DNA, 20 bp, Artificial
  CRISPR gRNA sequence
taaacaatgattcctatttt

SEQ ID NO: 175791 - DNA, 20 bp, Artificial
  CRISPR gRNA sequence
ctattttagtcttgtcaaat

SEQ ID NO: 175792 - DNA, 20 bp, Artificial
  CRISPR gRNA sequence
ttttagtcttgtcaaatgct

SEQ ID NO: 175793 - DNA, 20 bp, Artificial
  CRISPR gRNA sequence
tagtcttgtcaaatgcttaa

SEQ ID NO: 175794 - DNA, 20 bp, Artificial
  CRISPR gRNA sequence
agtcttgtcaaatgcttaaa

SEQ ID NO: 175795 - DNA, 20 bp, Artificial
  CRISPR gRNA sequence
gtcttgtcaaatgcttaaaa

SEQ ID NO: 175796 - DNA, 20 bp, Artificial
  CRISPR gRNA sequence
gtcaaatgcttaaaatgacc

SEQ ID NO: 175797 - DNA, 20 bp, Artificial
  CRISPR gRNA sequence
tcaaatgcttaaaatgaccc

SEQ ID NO: 175798 - DNA, 20 bp, Artificial
  CRISPR gRNA sequence
aaaatgaccctggaatcttt

SEQ ID NO: 175799 - DNA, 20 bp, Artificial
  CRISPR gRNA sequence
aaatgaccctggaatctttg

SEQ ID NO: 175800 - DNA, 20 bp, Artificial
  CRISPR gRNA sequence
gaatctttgtttattaaata

SEQ ID NO: 175801 - DNA, 20 bp, Artificial
  CRISPR gRNA sequence
tgtttattaaatacaggtta

SEQ ID NO: 175802 - DNA, 20 bp, Artificial
  CRISPR gRNA sequence
gtttattaaatacaggttag

SEQ ID NO: 175803 - DNA, 20 bp, Artificial
  CRISPR gRNA sequence
tttattaaatacaggttagc

SEQ ID NO: 175804 - DNA, 20 bp, Artificial
  CRISPR gRNA sequence
attaaatacaggttagcttg

SEQ ID NO: 175805 - DNA, 20 bp, Artificial
  CRISPR gRNA sequence
ttaaatacaggttagcttgt

SEQ ID NO: 175806 - DNA, 20 bp, Artificial
  CRISPR gRNA sequence
aatacaggttagcttgtgga

SEQ ID NO: 175807 - DNA, 20 bp, Artificial
  CRISPR gRNA sequence
gcttgtggactcactttaag

SEQ ID NO: 175808 - DNA, 20 bp, Artificial
  CRISPR gRNA sequence
gtggactcactttaagagcc

SEQ ID NO: 175809 - DNA, 20 bp, Artificial
  CRISPR gRNA sequence
tggactcactttaagagcca

SEQ ID NO: 175810 - DNA, 20 bp, Artificial
  CRISPR gRNA sequence
actttaagagccaggtccaa

SEQ ID NO: 175811 - DNA, 20 bp, Artificial
  CRISPR gRNA sequence
taagagccaggtccaaactt

SEQ ID NO: 175812 - DNA, 20 bp, Artificial
  CRISPR gRNA sequence
aagagccaggtccaaacttt

SEQ ID NO: 175813 - DNA, 20 bp, Artificial
  CRISPR gRNA sequence
agagccaggtccaaactttt

SEQ ID NO: 175814 - DNA, 20 bp, Artificial
  CRISPR gRNA sequence
ttttgggaattagcttgttc

SEQ ID NO: 175815 - DNA, 20 bp, Artificial
  CRISPR gRNA sequence
tttgggaattagcttgttct

SEQ ID NO: 175816 - DNA, 20 bp, Artificial
  CRISPR gRNA sequence
ttgggaattagcttgttctt

SEQ ID NO: 175817 - DNA, 20 bp, Artificial
  CRISPR gRNA sequence
tgggaattagcttgttcttg

SEQ ID NO: 175818 - DNA, 20 bp, Artificial
  CRISPR gRNA sequence
gggaattagcttgttcttga

SEQ ID NO: 175819 - DNA, 20 bp, Artificial
  CRISPR gRNA sequence
ggaattagcttgttcttgaa

SEQ ID NO: 175820 - DNA, 20 bp, Artificial
  CRISPR gRNA sequence
gcttgttcttgaaatataat

SEQ ID NO: 175821 - DNA, 20 bp, Artificial
  CRISPR gRNA sequence
gttcttgaaatataataaca

SEQ ID NO: 175822 - DNA, 20 bp, Artificial
  CRISPR gRNA sequence
ttcttgaaatataataacaa

SEQ ID NO: 175823 - DNA, 20 bp, Artificial
  CRISPR gRNA sequence
ttgaaatataataacaaaaa

SEQ ID NO: 175824 - DNA, 20 bp, Artificial
  CRISPR gRNA sequence
gaaatataataacaaaaaaa

SEQ ID NO: 175825 - DNA, 20 bp, Artificial
  CRISPR gRNA sequence
aaatataataacaaaaaaac

SEQ ID NO: 175826 - DNA, 20 bp, Artificial
  CRISPR gRNA sequence
actggcttgcaggtgatgtg

SEQ ID NO: 175827 - DNA, 20 bp, Artificial
  CRISPR gRNA sequence
gcttgcaggtgatgtgtttg

SEQ ID NO: 175828 - DNA, 20 bp, Artificial
  CRISPR gRNA sequence
gcaggtgatgtgtttgtata

SEQ ID NO: 175829 - DNA, 20 bp, Artificial
  CRISPR gRNA sequence
caggtgatgtgtttgtatac

SEQ ID NO: 175830 - DNA, 20 bp, Artificial
  CRISPR gRNA sequence
gtataccctaaattcctcat

SEQ ID NO: 175831 - DNA, 20 bp, Artificial
  CRISPR gRNA sequence
tataccctaaattcctcata

SEQ ID NO: 175832 - DNA, 20 bp, Artificial
  CRISPR gRNA sequence
aattcctcataatgcataaa

SEQ ID NO: 175833 - DNA, 20 bp, Artificial
  CRISPR gRNA sequence
ctcataatgcataaaagtaa

SEQ ID NO: 175834 - DNA, 20 bp, Artificial
  CRISPR gRNA sequence
ataatgcataaaagtaacct

SEQ ID NO: 175835 - DNA, 20 bp, Artificial
  CRISPR gRNA sequence
gctttctggaatacctcaca

SEQ ID NO: 175836 - DNA, 20 bp, Artificial
  CRISPR gRNA sequence
tctggaatacctcacaggtg

SEQ ID NO: 175837 - DNA, 20 bp, Artificial
  CRISPR gRNA sequence
ctggaatacctcacaggtga

SEQ ID NO: 175838 - DNA, 20 bp, Artificial
  CRISPR gRNA sequence
tggaatacctcacaggtgaa

SEQ ID NO: 175839 - DNA, 20 bp, Artificial
  CRISPR gRNA sequence
gaatacctcacaggtgaaca

SEQ ID NO: 175840 - DNA, 20 bp, Artificial
  CRISPR gRNA sequence
acaggtgaacaccattagct

SEQ ID NO: 175841 - DNA, 20 bp, Artificial
  CRISPR gRNA sequence
gcttcctagctggttctcag

SEQ ID NO: 175842 - DNA, 20 bp, Artificial
  CRISPR gRNA sequence
cctagctggttctcagcttt

SEQ ID NO: 175843 - DNA, 20 bp, Artificial
  CRISPR gRNA sequence
ctagctggttctcagctttc

SEQ ID NO: 175844 - DNA, 20 bp, Artificial
  CRISPR gRNA sequence
gctggttctcagctttctga

SEQ ID NO: 175845 - DNA, 20 bp, Artificial
  CRISPR gRNA sequence
gttctcagctttctgaataa

SEQ ID NO: 175846 - DNA, 20 bp, Artificial
  CRISPR gRNA sequence
tcagctttctgaataagcaa

SEQ ID NO: 175847 - DNA, 20 bp, Artificial
  CRISPR gRNA sequence
agctttctgaataagcaact

SEQ ID NO: 175848 - DNA, 20 bp, Artificial
  CRISPR gRNA sequence
tctgaataagcaactaactg

SEQ ID NO: 175849 - DNA, 20 bp, Artificial
  CRISPR gRNA sequence
ctgaataagcaactaactgg

SEQ ID NO: 175850 - DNA, 20 bp, Artificial
  CRISPR gRNA sequence
tgaataagcaactaactggc

SEQ ID NO: 175851 - DNA, 20 bp, Artificial
  CRISPR gRNA sequence
aataagcaactaactggctg

SEQ ID NO: 175852 - DNA, 20 bp, Artificial
  CRISPR gRNA sequence
actggctgaggcaaggtatc

SEQ ID NO: 175853 - DNA, 20 bp, Artificial
  CRISPR gRNA sequence
gctgaggcaaggtatcttca

SEQ ID NO: 175854 - DNA, 20 bp, Artificial
  CRISPR gRNA sequence
aggcaaggtatcttcagatc

SEQ ID NO: 175855 - DNA, 20 bp, Artificial
  CRISPR gRNA sequence
cagatcccaaagggacacta

SEQ ID NO: 175856 - DNA, 20 bp, Artificial
  CRISPR gRNA sequence
agatcccaaagggacactaa

SEQ ID NO: 175857 - DNA, 20 bp, Artificial
  CRISPR gRNA sequence
aatctgctgcagcagacttt

SEQ ID NO: 175858 - DNA, 20 bp, Artificial
  CRISPR gRNA sequence
ctgcagcagactttctaacc

SEQ ID NO: 175859 - DNA, 20 bp, Artificial
  CRISPR gRNA sequence
cagcagactttctaaccaac

SEQ ID NO: 175860 - DNA, 20 bp, Artificial
  CRISPR gRNA sequence
tctaaccaacacacttcagg

SEQ ID NO: 175861 - DNA, 20 bp, Artificial
  CRISPR gRNA sequence
ctaaccaacacacttcaggt

SEQ ID NO: 175862 - DNA, 20 bp, Artificial
  CRISPR gRNA sequence
taaccaacacacttcaggta

SEQ ID NO: 175863 - DNA, 20 bp, Artificial
  CRISPR gRNA sequence
accaacacacttcaggtaaa

SEQ ID NO: 175864 - DNA, 20 bp, Artificial
  CRISPR gRNA sequence
caggtaaagacttctgaacc

SEQ ID NO: 175865 - DNA, 20 bp, Artificial
  CRISPR gRNA sequence
aggtaaagacttctgaacct

SEQ ID NO: 175866 - DNA, 20 bp, Artificial
  CRISPR gRNA sequence
ctgaacctcttccatggcac

SEQ ID NO: 175867 - DNA, 20 bp, Artificial
  CRISPR gRNA sequence
tgaacctcttccatggcaca

SEQ ID NO: 175868 - DNA, 20 bp, Artificial
  CRISPR gRNA sequence
aacctcttccatggcacatt

SEQ ID NO: 175869 - DNA, 20 bp, Artificial
  CRISPR gRNA sequence
ttccatggcacattttctct

SEQ ID NO: 175870 - DNA, 20 bp, Artificial
  CRISPR gRNA sequence
ccatggcacattttctctgt

SEQ ID NO: 175871 - DNA, 20 bp, Artificial
  CRISPR gRNA sequence
catggcacattttctctgtt

SEQ ID NO: 175872 - DNA, 20 bp, Artificial
  CRISPR gRNA sequence
tctctgttccttctataccc

SEQ ID NO: 175873 - DNA, 20 bp, Artificial
  CRISPR gRNA sequence
ctctgttccttctataccca

SEQ ID NO: 175874 - DNA, 20 bp, Artificial
  CRISPR gRNA sequence
tctgttccttctatacccaa

SEQ ID NO: 175875 - DNA, 20 bp, Artificial
  CRISPR gRNA sequence
tgttccttctatacccaaac

SEQ ID NO: 175876 - DNA, 20 bp, Artificial
  CRISPR gRNA sequence
ttccttctatacccaaacag

SEQ ID NO: 175877 - DNA, 20 bp, Artificial
  CRISPR gRNA sequence
cttctatacccaaacagcaa

SEQ ID NO: 175878 - DNA, 20 bp, Artificial
  CRISPR gRNA sequence
ctatacccaaacagcaagcc

SEQ ID NO: 175879 - DNA, 20 bp, Artificial
  CRISPR gRNA sequence
tatacccaaacagcaagcct

SEQ ID NO: 175880 - DNA, 20 bp, Artificial
  CRISPR gRNA sequence
tacccaaacagcaagcctat

SEQ ID NO: 175881 - DNA, 20 bp, Artificial
  CRISPR gRNA sequence
tacagaagtcccaaaaagaa

SEQ ID NO: 175882 - DNA, 20 bp, Artificial
  CRISPR gRNA sequence
gaggaataaaagaaacatgc

SEQ ID NO: 175883 - DNA, 20 bp, Artificial
  CRISPR gRNA sequence
agtgggagtcaaatctccaa

SEQ ID NO: 175884 - DNA, 20 bp, Artificial
  CRISPR gRNA sequence
caaacttgtacaagcctgtt

SEQ ID NO: 175885 - DNA, 20 bp, Artificial
  CRISPR gRNA sequence
gtacaagcctgttcctaaaa

SEQ ID NO: 175886 - DNA, 20 bp, Artificial
  CRISPR gRNA sequence
tacaagcctgttcctaaaaa

SEQ ID NO: 175887 - DNA, 20 bp, Artificial
  CRISPR gRNA sequence
ttcctaaaaagctgaaagac

SEQ ID NO: 175888 - DNA, 20 bp, Artificial
  CRISPR gRNA sequence
ctaaaaagctgaaagacttg

SEQ ID NO: 175889 - DNA, 20 bp, Artificial
  CRISPR gRNA sequence
aaaagctgaaagacttggat

SEQ ID NO: 175890 - DNA, 20 bp, Artificial
  CRISPR gRNA sequence
aaagacttggattagggcac

SEQ ID NO: 175891 - DNA, 20 bp, Artificial
  CRISPR gRNA sequence
ggattagggcacctgaactt

SEQ ID NO: 175892 - DNA, 20 bp, Artificial
  CRISPR gRNA sequence
gattagggcacctgaactta

SEQ ID NO: 175893 - DNA, 20 bp, Artificial
  CRISPR gRNA sequence
gggcacctgaacttactggg

SEQ ID NO: 175894 - DNA, 20 bp, Artificial
  CRISPR gRNA sequence
aacttactgggcctcaattt

SEQ ID NO: 175895 - DNA, 20 bp, Artificial
  CRISPR gRNA sequence
actgggcctcaatttcccca

SEQ ID NO: 175896 - DNA, 20 bp, Artificial
  CRISPR gRNA sequence
ctgggcctcaatttccccac

SEQ ID NO: 175897 - DNA, 20 bp, Artificial
  CRISPR gRNA sequence
ggcctcaatttccccacttt

SEQ ID NO: 175898 - DNA, 20 bp, Artificial
  CRISPR gRNA sequence
aatttccccactttacaaga

SEQ ID NO: 175899 - DNA, 20 bp, Artificial
  CRISPR gRNA sequence
ccccactttacaagaaggga

SEQ ID NO: 175900 - DNA, 20 bp, Artificial
  CRISPR gRNA sequence
cccactttacaagaagggaa

SEQ ID NO: 175901 - DNA, 20 bp, Artificial
  CRISPR gRNA sequence
tacaagaagggaactagact

SEQ ID NO: 175902 - DNA, 20 bp, Artificial
  CRISPR gRNA sequence
acaagaagggaactagacta

SEQ ID NO: 175903 - DNA, 20 bp, Artificial
  CRISPR gRNA sequence
caagaagggaactagactag

SEQ ID NO: 175904 - DNA, 20 bp, Artificial
  CRISPR gRNA sequence
gactagatccctaagtgatt

SEQ ID NO: 175905 - DNA, 20 bp, Artificial
  CRISPR gRNA sequence
gatccctaagtgattcccat

SEQ ID NO: 175906 - DNA, 20 bp, Artificial
  CRISPR gRNA sequence
agtgattcccatcagcctaa

SEQ ID NO: 175907 - DNA, 20 bp, Artificial
  CRISPR gRNA sequence
ccatcagcctaatttagatg

SEQ ID NO: 175908 - DNA, 20 bp, Artificial
  CRISPR gRNA sequence
atttagatgtattcaaactc

SEQ ID NO: 175909 - DNA, 20 bp, Artificial
  CRISPR gRNA sequence
agatgtattcaaactctgta

SEQ ID NO: 175910 - DNA, 20 bp, Artificial
  CRISPR gRNA sequence
gatgtattcaaactctgtat

SEQ ID NO: 175911 - DNA, 20 bp, Artificial
  CRISPR gRNA sequence
aaactctgtatgcatatatt

SEQ ID NO: 175912 - DNA, 20 bp, Artificial
  CRISPR gRNA sequence
tgtatgcatatattatcagt

SEQ ID NO: 175913 - DNA, 20 bp, Artificial
  CRISPR gRNA sequence
tatgcatatattatcagtaa

SEQ ID NO: 175914 - DNA, 20 bp, Artificial
  CRISPR gRNA sequence
tcagtaataaggataggcaa

SEQ ID NO: 175915 - DNA, 20 bp, Artificial
  CRISPR gRNA sequence
cattcatgaagacagccatg

SEQ ID NO: 175916 - DNA, 20 bp, Artificial
  CRISPR gRNA sequence
atgaagacagccatgttcaa

SEQ ID NO: 175917 - DNA, 20 bp, Artificial
  CRISPR gRNA sequence
aacttttaatacattttttg

SEQ ID NO: 175918 - DNA, 20 bp, Artificial
  CRISPR gRNA sequence
ttaatacattttttgggtta

SEQ ID NO: 175919 - DNA, 20 bp, Artificial
  CRISPR gRNA sequence
taatacattttttgggttac

SEQ ID NO: 175920 - DNA, 20 bp, Artificial
  CRISPR gRNA sequence
aatacattttttgggttact

SEQ ID NO: 175921 - DNA, 20 bp, Artificial
  CRISPR gRNA sequence
atacattttttgggttactg

SEQ ID NO: 175922 - DNA, 20 bp, Artificial
  CRISPR gRNA sequence
tttgggttactgaagctcct

SEQ ID NO: 175923 - DNA, 20 bp, Artificial
  CRISPR gRNA sequence
ttgggttactgaagctccta

SEQ ID NO: 175924 - DNA, 20 bp, Artificial
  CRISPR gRNA sequence
tgggttactgaagctcctac

SEQ ID NO: 175925 - DNA, 20 bp, Artificial
  CRISPR gRNA sequence
gggttactgaagctcctaca

SEQ ID NO: 175926 - DNA, 20 bp, Artificial
  CRISPR gRNA sequence
ggttactgaagctcctacaa

SEQ ID NO: 175927 - DNA, 20 bp, Artificial
  CRISPR gRNA sequence
ctgaagctcctacaaaagta

SEQ ID NO: 175928 - DNA, 20 bp, Artificial
  CRISPR gRNA sequence
aagctcctacaaaagtattt

SEQ ID NO: 175929 - DNA, 20 bp, Artificial
  CRISPR gRNA sequence
ctacaaaagtatttagcctc

SEQ ID NO: 175930 - DNA, 20 bp, Artificial
  CRISPR gRNA sequence
caaaagtatttagcctcttt

SEQ ID NO: 175931 - DNA, 20 bp, Artificial
  CRISPR gRNA sequence
agcctctttaaaagggagac

SEQ ID NO: 175932 - DNA, 20 bp, Artificial
  CRISPR gRNA sequence
gcctctttaaaagggagacc

SEQ ID NO: 175933 - DNA, 20 bp, Artificial
  CRISPR gRNA sequence
tttaaaagggagacctcatc

SEQ ID NO: 175934 - DNA, 20 bp, Artificial
  CRISPR gRNA sequence
taaaagggagacctcatctt

SEQ ID NO: 175935 - DNA, 20 bp, Artificial
  CRISPR gRNA sequence
aaaagggagacctcatcttg

SEQ ID NO: 175936 - DNA, 20 bp, Artificial
  CRISPR gRNA sequence
aaagggagacctcatcttgt

SEQ ID NO: 175937 - DNA, 20 bp, Artificial
  CRISPR gRNA sequence
atcttgttttaaaaacaaaa

SEQ ID NO: 175938 - DNA, 20 bp, Artificial
  CRISPR gRNA sequence
gttttaaaaacaaaagccca

SEQ ID NO: 175939 - DNA, 20 bp, Artificial
  CRISPR gRNA sequence
ttttaaaaacaaaagcccaa

SEQ ID NO: 175940 - DNA, 20 bp, Artificial
  CRISPR gRNA sequence
taaaaacaaaagcccaaagt

SEQ ID NO: 175941 - DNA, 20 bp, Artificial
  CRISPR gRNA sequence
aaaaacaaaagcccaaagtg

SEQ ID NO: 175942 - DNA, 20 bp, Artificial
  CRISPR gRNA sequence
aaaacaaaagcccaaagtga

SEQ ID NO: 175943 - DNA, 20 bp, Artificial
  CRISPR gRNA sequence
ctgtttttaaacctacacat

SEQ ID NO: 175944 - DNA, 20 bp, Artificial
  CRISPR gRNA sequence
tttttaaacctacacatccc

SEQ ID NO: 175945 - DNA, 20 bp, Artificial
  CRISPR gRNA sequence
ttaaacctacacatccctgg

SEQ ID NO: 175946 - DNA, 20 bp, Artificial
  CRISPR gRNA sequence
taaacctacacatccctgga

SEQ ID NO: 175947 - DNA, 20 bp, Artificial
  CRISPR gRNA sequence
aaacctacacatccctggaa

SEQ ID NO: 175948 - DNA, 20 bp, Artificial
  CRISPR gRNA sequence
aacctacacatccctggaac

SEQ ID NO: 175949 - DNA, 20 bp, Artificial
  CRISPR gRNA sequence
cacatccctggaactggaat

SEQ ID NO: 175950 - DNA, 20 bp, Artificial
  CRISPR gRNA sequence
gaactggaattttatttggt

SEQ ID NO: 175951 - DNA, 20 bp, Artificial
  CRISPR gRNA sequence
gaattttatttggtaaagtc

SEQ ID NO: 175952 - DNA, 20 bp, Artificial
  CRISPR gRNA sequence
tatttggtaaagtcagtatc

SEQ ID NO: 175953 - DNA, 20 bp, Artificial
  CRISPR gRNA sequence
atttggtaaagtcagtatca

SEQ ID NO: 175954 - DNA, 20 bp, Artificial
  CRISPR gRNA sequence
tttggtaaagtcagtatcaa

SEQ ID NO: 175955 - DNA, 20 bp, Artificial
  CRISPR gRNA sequence
ggtaaagtcagtatcaattt

SEQ ID NO: 175956 - DNA, 20 bp, Artificial
  CRISPR gRNA sequence
gtaaagtcagtatcaatttt

SEQ ID NO: 175957 - DNA, 20 bp, Artificial
  CRISPR gRNA sequence
tgccaaacctcattctgtct

SEQ ID NO: 175958 - DNA, 20 bp, Artificial
  CRISPR gRNA sequence
gccaaacctcattctgtctg

SEQ ID NO: 175959 - DNA, 20 bp, Artificial
  CRISPR gRNA sequence
ccaaacctcattctgtctga

SEQ ID NO: 175960 - DNA, 20 bp, Artificial
  CRISPR gRNA sequence
attctgtctgaatatgattc

SEQ ID NO: 175961 - DNA, 20 bp, Artificial
  CRISPR gRNA sequence
tgtctgaatatgattcttcc

SEQ ID NO: 175962 - DNA, 20 bp, Artificial
  CRISPR gRNA sequence
tctgaatatgattcttccaa

SEQ ID NO: 175963 - DNA, 20 bp, Artificial
  CRISPR gRNA sequence
aatatgattcttccaatgca

SEQ ID NO: 175964 - DNA, 20 bp, Artificial
  CRISPR gRNA sequence
ttccaatgcacagataggaa

SEQ ID NO: 175965 - DNA, 20 bp, Artificial
  CRISPR gRNA sequence
ccaatgcacagataggaagc

SEQ ID NO: 175966 - DNA, 20 bp, Artificial
  CRISPR gRNA sequence
caatgcacagataggaagca

SEQ ID NO: 175967 - DNA, 20 bp, Artificial
  CRISPR gRNA sequence
actgaccatgcctgagagga

SEQ ID NO: 175968 - DNA, 20 bp, Artificial
  CRISPR gRNA sequence
accatgcctgagaggaagtg

SEQ ID NO: 175969 - DNA, 20 bp, Artificial
  CRISPR gRNA sequence
agaggaagtgacttaatagg

SEQ ID NO: 175970 - DNA, 20 bp, Artificial
  CRISPR gRNA sequence
aataggacaggaaatcaaac

SEQ ID NO: 175971 - DNA, 20 bp, Artificial
  CRISPR gRNA sequence
ataggacaggaaatcaaaca

SEQ ID NO: 175972 - DNA, 20 bp, Artificial
  CRISPR gRNA sequence
ggggggaaaaaaggaagtcc

SEQ ID NO: 175973 - DNA, 20 bp, Artificial
  CRISPR gRNA sequence
aaaatagatgacactgggca

SEQ ID NO: 175974 - DNA, 20 bp, Artificial
  CRISPR gRNA sequence
ggcatgcagactagattaaa

SEQ ID NO: 175975 - DNA, 20 bp, Artificial
  CRISPR gRNA sequence
gattaaaagaaacccccatg

SEQ ID NO: 175976 - DNA, 20 bp, Artificial
  CRISPR gRNA sequence
aaagaaacccccatgagttt

SEQ ID NO: 175977 - DNA, 20 bp, Artificial
  CRISPR gRNA sequence
ccaccaattatgttagaaag

SEQ ID NO: 175978 - DNA, 20 bp, Artificial
  CRISPR gRNA sequence
caccaattatgttagaaagg

SEQ ID NO: 175979 - DNA, 20 bp, Artificial
  CRISPR gRNA sequence
tgttagaaaggtatctcata

SEQ ID NO: 175980 - DNA, 20 bp, Artificial
  CRISPR gRNA sequence
gaaaggtatctcatagtagg

SEQ ID NO: 175981 - DNA, 20 bp, Artificial
  CRISPR gRNA sequence
atagtaggtatcaactgtgt

SEQ ID NO: 175982 - DNA, 20 bp, Artificial
  CRISPR gRNA sequence
tgtgaaatttatgttagatt

SEQ ID NO: 175983 - DNA, 20 bp, Artificial
  CRISPR gRNA sequence
atgttagatttctgatgaga

SEQ ID NO: 175984 - DNA, 20 bp, Artificial
  CRISPR gRNA sequence
tgttagatttctgatgagag

SEQ ID NO: 175985 - DNA, 20 bp, Artificial
  CRISPR gRNA sequence
gatttctgatgagagatcaa

SEQ ID NO: 175986 - DNA, 20 bp, Artificial
  CRISPR gRNA sequence
ctgatgagagatcaattatt

SEQ ID NO: 175987 - DNA, 20 bp, Artificial
  CRISPR gRNA sequence
tgatgagagatcaattattt

SEQ ID NO: 175988 - DNA, 20 bp, Artificial
  CRISPR gRNA sequence
atgagagatcaattattttt

SEQ ID NO: 175989 - DNA, 20 bp, Artificial
  CRISPR gRNA sequence
tttttttttaaagtgttcat

SEQ ID NO: 175990 - DNA, 20 bp, Artificial
  CRISPR gRNA sequence
ttttttaaagtgttcatccc

SEQ ID NO: 175991 - DNA, 20 bp, Artificial
  CRISPR gRNA sequence
tttttaaagtgttcatccca

SEQ ID NO: 175992 - DNA, 20 bp, Artificial
  CRISPR gRNA sequence
ttttaaagtgttcatcccac

SEQ ID NO: 175993 - DNA, 20 bp, Artificial
  CRISPR gRNA sequence
tttaaagtgttcatcccaca

SEQ ID NO: 175994 - DNA, 20 bp, Artificial
  CRISPR gRNA sequence
ttaaagtgttcatcccacaa

SEQ ID NO: 175995 - DNA, 20 bp, Artificial
  CRISPR gRNA sequence
taaagtgttcatcccacaat

SEQ ID NO: 175996 - DNA, 20 bp, Artificial
  CRISPR gRNA sequence
aaagtgttcatcccacaatt

SEQ ID NO: 175997 - DNA, 20 bp, Artificial
  CRISPR gRNA sequence
aagtgttcatcccacaattg

SEQ ID NO: 175998 - DNA, 20 bp, Artificial
  CRISPR gRNA sequence
atcccacaattgggcacaat

SEQ ID NO: 175999 - DNA, 20 bp, Artificial
  CRISPR gRNA sequence
ggcacaatggctcatgcctg

SEQ ID NO: 176000 - DNA, 20 bp, Artificial
  CRISPR gRNA sequence
atgcctgtaatcccagtgct

SEQ ID NO: 176001 - DNA, 20 bp, Artificial
  CRISPR gRNA sequence
taatcccagtgcttgtaatc

SEQ ID NO: 176002 - DNA, 20 bp, Artificial
  CRISPR gRNA sequence
gtaatcccagcactttggga

SEQ ID NO: 176003 - DNA, 20 bp, Artificial
  CRISPR gRNA sequence
taatcccagcactttgggag

SEQ ID NO: 176004 - DNA, 20 bp, Artificial
  CRISPR gRNA sequence
tgggaggccaaggcaggagg

SEQ ID NO: 176005 - DNA, 20 bp, Artificial
  CRISPR gRNA sequence
gggaggccaaggcaggagga

SEQ ID NO: 176006 - DNA, 20 bp, Artificial
  CRISPR gRNA sequence
ggaggccaaggcaggaggat

SEQ ID NO: 176007 - DNA, 20 bp, Artificial
  CRISPR gRNA sequence
gagtccaggagtttgagatc

SEQ ID NO: 176008 - DNA, 20 bp, Artificial
  CRISPR gRNA sequence
agtccaggagtttgagatca

SEQ ID NO: 176009 - DNA, 20 bp, Artificial
  CRISPR gRNA sequence
gagatcagcctgggcaacaa

SEQ ID NO: 176010 - DNA, 20 bp, Artificial
  CRISPR gRNA sequence
agatcagcctgggcaacaaa

SEQ ID NO: 176011 - DNA, 20 bp, Artificial
  CRISPR gRNA sequence
ggcaacaaatcaagaccccg

SEQ ID NO: 176012 - DNA, 20 bp, Artificial
  CRISPR gRNA sequence
tatttaaaaataaaaataaa

SEQ ID NO: 176013 - DNA, 20 bp, Artificial
  CRISPR gRNA sequence
aaaaataaaaataaaaataa

SEQ ID NO: 176014 - DNA, 20 bp, Artificial
  CRISPR gRNA sequence
aaaataaaaataaaaataaa

SEQ ID NO: 176015 - DNA, 20 bp, Artificial
  CRISPR gRNA sequence
gttgggcacggtggcacatg

SEQ ID NO: 176016 - DNA, 20 bp, Artificial
  CRISPR gRNA sequence
ggcacggtggcacatgcctg

SEQ ID NO: 176017 - DNA, 20 bp, Artificial
  CRISPR gRNA sequence
tagtcccagctactcaggag

SEQ ID NO: 176018 - DNA, 20 bp, Artificial
  CRISPR gRNA sequence
ctcaggaggctgaagtagga

SEQ ID NO: 176019 - DNA, 20 bp, Artificial
  CRISPR gRNA sequence
aggaggctgaagtaggagga

SEQ ID NO: 176020 - DNA, 20 bp, Artificial
  CRISPR gRNA sequence
aagtaggaggattgcttgag

SEQ ID NO: 176021 - DNA, 20 bp, Artificial
  CRISPR gRNA sequence
cttgagcccaggaggtggag

SEQ ID NO: 176022 - DNA, 20 bp, Artificial
  CRISPR gRNA sequence
gagcccaggaggtggaggct

SEQ ID NO: 176023 - DNA, 20 bp, Artificial
  CRISPR gRNA sequence
agcccaggaggtggaggctg

SEQ ID NO: 176024 - DNA, 20 bp, Artificial
  CRISPR gRNA sequence
cagtgagtcatgatcatgcc

SEQ ID NO: 176025 - DNA, 20 bp, Artificial
  CRISPR gRNA sequence
cagcctggcacaccagcctt

SEQ ID NO: 176026 - DNA, 20 bp, Artificial
  CRISPR gRNA sequence
gcacaccagccttggcaaca

SEQ ID NO: 176027 - DNA, 20 bp, Artificial
  CRISPR gRNA sequence
ggcaacagagcgagacctcg

SEQ ID NO: 176028 - DNA, 20 bp, Artificial
  CRISPR gRNA sequence
gcaacagagcgagacctcgt

SEQ ID NO: 176029 - DNA, 20 bp, Artificial
  CRISPR gRNA sequence
gtctgcaaaaaaaaaaaaaa

SEQ ID NO: 176030 - DNA, 20 bp, Artificial
  CRISPR gRNA sequence
caaaaaaaaaaaaaaaaaaa

SEQ ID NO: 176031 - DNA, 20 bp, Artificial
  CRISPR gRNA sequence
atcccaacatttacttgctt

SEQ ID NO: 176032 - DNA, 20 bp, Artificial
  CRISPR gRNA sequence
acttgcttactatacagcag

SEQ ID NO: 176033 - DNA, 20 bp, Artificial
  CRISPR gRNA sequence
cttgcttactatacagcagg

SEQ ID NO: 176034 - DNA, 20 bp, Artificial
  CRISPR gRNA sequence
gcttactatacagcaggcta

SEQ ID NO: 176035 - DNA, 20 bp, Artificial
  CRISPR gRNA sequence
cttactatacagcaggctat

SEQ ID NO: 176036 - DNA, 20 bp, Artificial
  CRISPR gRNA sequence
actatacagcaggctataat

SEQ ID NO: 176037 - DNA, 20 bp, Artificial
  CRISPR gRNA sequence
ctatacagcaggctataatt

SEQ ID NO: 176038 - DNA, 20 bp, Artificial
  CRISPR gRNA sequence
tacagcaggctataattacc

SEQ ID NO: 176039 - DNA, 20 bp, Artificial
  CRISPR gRNA sequence
taattacctcccatgcttga

SEQ ID NO: 176040 - DNA, 20 bp, Artificial
  CRISPR gRNA sequence
cctcccatgcttgaaaattg

SEQ ID NO: 176041 - DNA, 20 bp, Artificial
  CRISPR gRNA sequence
ccatgcttgaaaattgacag

SEQ ID NO: 176042 - DNA, 20 bp, Artificial
  CRISPR gRNA sequence
gaaaattgacaggataatca

SEQ ID NO: 176043 - DNA, 20 bp, Artificial
  CRISPR gRNA sequence
aaaattgacaggataatcac

SEQ ID NO: 176044 - DNA, 20 bp, Artificial
  CRISPR gRNA sequence
acaggataatcacaaagcaa

SEQ ID NO: 176045 - DNA, 20 bp, Artificial
  CRISPR gRNA sequence
cagtttactttataaatatt

SEQ ID NO: 176046 - DNA, 20 bp, Artificial
  CRISPR gRNA sequence
actttataaatatttggtat

SEQ ID NO: 176047 - DNA, 20 bp, Artificial
  CRISPR gRNA sequence
ctttataaatatttggtata

SEQ ID NO: 176048 - DNA, 20 bp, Artificial
  CRISPR gRNA sequence
tataaatatttggtatacaa

SEQ ID NO: 176049 - DNA, 20 bp, Artificial
  CRISPR gRNA sequence
ataaatatttggtatacaaa

SEQ ID NO: 176050 - DNA, 20 bp, Artificial
  CRISPR gRNA sequence
taaatatttggtatacaaac

SEQ ID NO: 176051 - DNA, 20 bp, Artificial
  CRISPR gRNA sequence
ggtatacaaactaaatatgt

SEQ ID NO: 176052 - DNA, 20 bp, Artificial
  CRISPR gRNA sequence
gtatacaaactaaatatgta

SEQ ID NO: 176053 - DNA, 20 bp, Artificial
  CRISPR gRNA sequence
aatatgtaacctctgcttgg

SEQ ID NO: 176054 - DNA, 20 bp, Artificial
  CRISPR gRNA sequence
tgcttggtaaacatctgcaa

SEQ ID NO: 176055 - DNA, 20 bp, Artificial
  CRISPR gRNA sequence
cttggtaaacatctgcaacc

SEQ ID NO: 176056 - DNA, 20 bp, Artificial
  CRISPR gRNA sequence
ggtaaacatctgcaaccatt

SEQ ID NO: 176057 - DNA, 20 bp, Artificial
  CRISPR gRNA sequence
gtaaacatctgcaaccatta

SEQ ID NO: 176058 - DNA, 20 bp, Artificial
  CRISPR gRNA sequence
caaccattacaacttacctg

SEQ ID NO: 176059 - DNA, 20 bp, Artificial
  CRISPR gRNA sequence
caacttacctgcattgtaat

SEQ ID NO: 176060 - DNA, 20 bp, Artificial
  CRISPR gRNA sequence
acctgcattgtaatgcaaat

SEQ ID NO: 176061 - DNA, 20 bp, Artificial
  CRISPR gRNA sequence
cctgcattgtaatgcaaatc

SEQ ID NO: 176062 - DNA, 20 bp, Artificial
  CRISPR gRNA sequence
cattgtaatgcaaatctcat

SEQ ID NO: 176063 - DNA, 20 bp, Artificial
  CRISPR gRNA sequence
taatgcaaatctcataatgc

SEQ ID NO: 176064 - DNA, 20 bp, Artificial
  CRISPR gRNA sequence
ataatgcaaatggaacaggc

SEQ ID NO: 176065 - DNA, 20 bp, Artificial
  CRISPR gRNA sequence
ccagattttattctgagagg

SEQ ID NO: 176066 - DNA, 20 bp, Artificial
  CRISPR gRNA sequence
cagattttattctgagaggt

SEQ ID NO: 176067 - DNA, 20 bp, Artificial
  CRISPR gRNA sequence
tattctgagaggttcctaaa

SEQ ID NO: 176068 - DNA, 20 bp, Artificial
  CRISPR gRNA sequence
attctgagaggttcctaaat

SEQ ID NO: 176069 - DNA, 20 bp, Artificial
  CRISPR gRNA sequence
ttctgagaggttcctaaatc

SEQ ID NO: 176070 - DNA, 20 bp, Artificial
  CRISPR gRNA sequence
tgagaggttcctaaatctaa

SEQ ID NO: 176071 - DNA, 20 bp, Artificial
  CRISPR gRNA sequence
agaggttcctaaatctaaca

SEQ ID NO: 176072 - DNA, 20 bp, Artificial
  CRISPR gRNA sequence
ctaaatctaacaagagtttt

SEQ ID NO: 176073 - DNA, 20 bp, Artificial
  CRISPR gRNA sequence
aatctaacaagagtttttta

SEQ ID NO: 176074 - DNA, 20 bp, Artificial
  CRISPR gRNA sequence
acaagagttttttaaaaatc

SEQ ID NO: 176075 - DNA, 20 bp, Artificial
  CRISPR gRNA sequence
tttaaaaatcagcataccca

SEQ ID NO: 176076 - DNA, 20 bp, Artificial
  CRISPR gRNA sequence
ttaaaaatcagcatacccat

SEQ ID NO: 176077 - DNA, 20 bp, Artificial
  CRISPR gRNA sequence
taaaaatcagcatacccatt

SEQ ID NO: 176078 - DNA, 20 bp, Artificial
  CRISPR gRNA sequence
aaaaatcagcatacccattt

SEQ ID NO: 176079 - DNA, 20 bp, Artificial
  CRISPR gRNA sequence
aaaatcagcatacccatttc

SEQ ID NO: 176080 - DNA, 20 bp, Artificial
  CRISPR gRNA sequence
catcctattctgagaggtcc

SEQ ID NO: 176081 - DNA, 20 bp, Artificial
  CRISPR gRNA sequence
atcctattctgagaggtcct

SEQ ID NO: 176082 - DNA, 20 bp, Artificial
  CRISPR gRNA sequence
ttctgagaggtccttaaatt

SEQ ID NO: 176083 - DNA, 20 bp, Artificial
  CRISPR gRNA sequence
tgagaggtccttaaattttg

SEQ ID NO: 176084 - DNA, 20 bp, Artificial
  CRISPR gRNA sequence
agaggtccttaaattttgac

SEQ ID NO: 176085 - DNA, 20 bp, Artificial
  CRISPR gRNA sequence
aaattttgacaaaggggtta

SEQ ID NO: 176086 - DNA, 20 bp, Artificial
  CRISPR gRNA sequence
aattttgacaaaggggttaa

SEQ ID NO: 176087 - DNA, 20 bp, Artificial
  CRISPR gRNA sequence
tgacaaaggggttaaaattc

SEQ ID NO: 176088 - DNA, 20 bp, Artificial
  CRISPR gRNA sequence
gacaaaggggttaaaattct

SEQ ID NO: 176089 - DNA, 20 bp, Artificial
  CRISPR gRNA sequence
acaaaggggttaaaattctt

SEQ ID NO: 176090 - DNA, 20 bp, Artificial
  CRISPR gRNA sequence
aaattctttcacaaggatct

SEQ ID NO: 176091 - DNA, 20 bp, Artificial
  CRISPR gRNA sequence
tttcacaaggatcttgatga

SEQ ID NO: 176092 - DNA, 20 bp, Artificial
  CRISPR gRNA sequence
tcacaaggatcttgatgagt

SEQ ID NO: 176093 - DNA, 20 bp, Artificial
  CRISPR gRNA sequence
cacaaggatcttgatgagta

SEQ ID NO: 176094 - DNA, 20 bp, Artificial
  CRISPR gRNA sequence
acaaggatcttgatgagtaa

SEQ ID NO: 176095 - DNA, 20 bp, Artificial
  CRISPR gRNA sequence
gatgagtaaaggactggtgg

SEQ ID NO: 176096 - DNA, 20 bp, Artificial
  CRISPR gRNA sequence
atgagtaaaggactggtggt

SEQ ID NO: 176097 - DNA, 20 bp, Artificial
  CRISPR gRNA sequence
gtggtctcaacatatgcatt

SEQ ID NO: 176098 - DNA, 20 bp, Artificial
  CRISPR gRNA sequence
aacatatgcattaaataaat

SEQ ID NO: 176099 - DNA, 20 bp, Artificial
  CRISPR gRNA sequence
aataaatagggtcatgtcag

SEQ ID NO: 176100 - DNA, 20 bp, Artificial
  CRISPR gRNA sequence
aaaaagaaatgtgtcaggtt

SEQ ID NO: 176101 - DNA, 20 bp, Artificial
  CRISPR gRNA sequence
aaaagaaatgtgtcaggttt

SEQ ID NO: 176102 - DNA, 20 bp, Artificial
  CRISPR gRNA sequence
aaactaactcctttttacaa

SEQ ID NO: 176103 - DNA, 20 bp, Artificial
  CRISPR gRNA sequence
aactaactcctttttacaaa

SEQ ID NO: 176104 - DNA, 20 bp, Artificial
  CRISPR gRNA sequence
actcctttttacaaatatta

SEQ ID NO: 176105 - DNA, 20 bp, Artificial
  CRISPR gRNA sequence
ctttttacaaatattaaaat

SEQ ID NO: 176106 - DNA, 20 bp, Artificial
  CRISPR gRNA sequence
tttacaaatattaaaatact

SEQ ID NO: 176107 - DNA, 20 bp, Artificial
  CRISPR gRNA sequence
ttacaaatattaaaatactg

SEQ ID NO: 176108 - DNA, 20 bp, Artificial
  CRISPR gRNA sequence
tacaaatattaaaatactgg

SEQ ID NO: 176109 - DNA, 20 bp, Artificial
  CRISPR gRNA sequence
acaaatattaaaatactggc

SEQ ID NO: 176110 - DNA, 20 bp, Artificial
  CRISPR gRNA sequence
caaatattaaaatactggca

SEQ ID NO: 176111 - DNA, 20 bp, Artificial
  CRISPR gRNA sequence
aaatactggcatttttttct

SEQ ID NO: 176112 - DNA, 20 bp, Artificial
  CRISPR gRNA sequence
gcatttttttctttgatgcc

SEQ ID NO: 176113 - DNA, 20 bp, Artificial
  CRISPR gRNA sequence
ttttctttgatgccacacct

SEQ ID NO: 176114 - DNA, 20 bp, Artificial
  CRISPR gRNA sequence
tttctttgatgccacaccta

SEQ ID NO: 176115 - DNA, 20 bp, Artificial
  CRISPR gRNA sequence
ttctttgatgccacacctat

SEQ ID NO: 176116 - DNA, 20 bp, Artificial
  CRISPR gRNA sequence
tctttgatgccacacctatc

SEQ ID NO: 176117 - DNA, 20 bp, Artificial
  CRISPR gRNA sequence
ctttgatgccacacctatct

SEQ ID NO: 176118 - DNA, 20 bp, Artificial
  CRISPR gRNA sequence
tttgatgccacacctatctt

SEQ ID NO: 176119 - DNA, 20 bp, Artificial
  CRISPR gRNA sequence
tgatgccacacctatcttca

SEQ ID NO: 176120 - DNA, 20 bp, Artificial
  CRISPR gRNA sequence
gatgccacacctatcttcat

SEQ ID NO: 176121 - DNA, 20 bp, Artificial
  CRISPR gRNA sequence
atgccacacctatcttcata

SEQ ID NO: 176122 - DNA, 20 bp, Artificial
  CRISPR gRNA sequence
tcttcataaacgtttcatcc

SEQ ID NO: 176123 - DNA, 20 bp, Artificial
  CRISPR gRNA sequence
cataaacgtttcatccccca

SEQ ID NO: 176124 - DNA, 20 bp, Artificial
  CRISPR gRNA sequence
ataaacgtttcatcccccaa

SEQ ID NO: 176125 - DNA, 20 bp, Artificial
  CRISPR gRNA sequence
catcccccaaatagtctgga

SEQ ID NO: 176126 - DNA, 20 bp, Artificial
  CRISPR gRNA sequence
atcccccaaatagtctggat

SEQ ID NO: 176127 - DNA, 20 bp, Artificial
  CRISPR gRNA sequence
gattagtaacaactaatatt

SEQ ID NO: 176128 - DNA, 20 bp, Artificial
  CRISPR gRNA sequence
gtaacaactaatattatgta

SEQ ID NO: 176129 - DNA, 20 bp, Artificial
  CRISPR gRNA sequence
atattatgtagctcttcaca

SEQ ID NO: 176130 - DNA, 20 bp, Artificial
  CRISPR gRNA sequence
tgtagctcttcacaatttgc

SEQ ID NO: 176131 - DNA, 20 bp, Artificial
  CRISPR gRNA sequence
ttcacaatttgcaaagtact

SEQ ID NO: 176132 - DNA, 20 bp, Artificial
  CRISPR gRNA sequence
cacaatttgcaaagtacttt

SEQ ID NO: 176133 - DNA, 20 bp, Artificial
  CRISPR gRNA sequence
acaatttgcaaagtactttg

SEQ ID NO: 176134 - DNA, 20 bp, Artificial
  CRISPR gRNA sequence
gcaaagtactttgacacaca

SEQ ID NO: 176135 - DNA, 20 bp, Artificial
  CRISPR gRNA sequence
caaagtactttgacacacat

SEQ ID NO: 176136 - DNA, 20 bp, Artificial
  CRISPR gRNA sequence
tgacacacatgatctcattc

SEQ ID NO: 176137 - DNA, 20 bp, Artificial
  CRISPR gRNA sequence
gacacacatgatctcattca

SEQ ID NO: 176138 - DNA, 20 bp, Artificial
  CRISPR gRNA sequence
acacacatgatctcattcaa

SEQ ID NO: 176139 - DNA, 20 bp, Artificial
  CRISPR gRNA sequence
attcaagactcgccactaaa

SEQ ID NO: 176140 - DNA, 20 bp, Artificial
  CRISPR gRNA sequence
aagactcgccactaaatcag

SEQ ID NO: 176141 - DNA, 20 bp, Artificial
  CRISPR gRNA sequence
gccactaaatcagacactat

SEQ ID NO: 176142 - DNA, 20 bp, Artificial
  CRISPR gRNA sequence
aatcagacactatttttagg

SEQ ID NO: 176143 - DNA, 20 bp, Artificial
  CRISPR gRNA sequence
tttttaggttccatttttac

SEQ ID NO: 176144 - DNA, 20 bp, Artificial
  CRISPR gRNA sequence
ttaggttccatttttacatg

SEQ ID NO: 176145 - DNA, 20 bp, Artificial
  CRISPR gRNA sequence
taggttccatttttacatgt

SEQ ID NO: 176146 - DNA, 20 bp, Artificial
  CRISPR gRNA sequence
aggttccatttttacatgtg

SEQ ID NO: 176147 - DNA, 20 bp, Artificial
  CRISPR gRNA sequence
ggttccatttttacatgtga

SEQ ID NO: 176148 - DNA, 20 bp, Artificial
  CRISPR gRNA sequence
catttttacatgtgaggaag

SEQ ID NO: 176149 - DNA, 20 bp, Artificial
  CRISPR gRNA sequence
ttacatgtgaggaagctaac

SEQ ID NO: 176150 - DNA, 20 bp, Artificial
  CRISPR gRNA sequence
tacatgtgaggaagctaaca

SEQ ID NO: 176151 - DNA, 20 bp, Artificial
  CRISPR gRNA sequence
acatgtgaggaagctaacac

SEQ ID NO: 176152 - DNA, 20 bp, Artificial
  CRISPR gRNA sequence
catgtgaggaagctaacact

SEQ ID NO: 176153 - DNA, 20 bp, Artificial
  CRISPR gRNA sequence
acactaaatagctgacttgc

SEQ ID NO: 176154 - DNA, 20 bp, Artificial
  CRISPR gRNA sequence
aatagctgacttgcccaaac

SEQ ID NO: 176155 - DNA, 20 bp, Artificial
  CRISPR gRNA sequence
acttgcccaaacctacaaag

SEQ ID NO: 176156 - DNA, 20 bp, Artificial
  CRISPR gRNA sequence
gcccaaacctacaaagctgg

SEQ ID NO: 176157 - DNA, 20 bp, Artificial
  CRISPR gRNA sequence
cccaaacctacaaagctggt

SEQ ID NO: 176158 - DNA, 20 bp, Artificial
  CRISPR gRNA sequence
caaagctggtgataaaggtg

SEQ ID NO: 176159 - DNA, 20 bp, Artificial
  CRISPR gRNA sequence
gtgataaaggtgagtggggc

SEQ ID NO: 176160 - DNA, 20 bp, Artificial
  CRISPR gRNA sequence
gaacacagatctcttgactt

SEQ ID NO: 176161 - DNA, 20 bp, Artificial
  CRISPR gRNA sequence
aacacagatctcttgacttt

SEQ ID NO: 176162 - DNA, 20 bp, Artificial
  CRISPR gRNA sequence
ttgactttaaatggtctgta

SEQ ID NO: 176163 - DNA, 20 bp, Artificial
  CRISPR gRNA sequence
gactttaaatggtctgtacc

SEQ ID NO: 176164 - DNA, 20 bp, Artificial
  CRISPR gRNA sequence
actttaaatggtctgtacca

SEQ ID NO: 176165 - DNA, 20 bp, Artificial
  CRISPR gRNA sequence
taaatggtctgtaccatgct

SEQ ID NO: 176166 - DNA, 20 bp, Artificial
  CRISPR gRNA sequence
aaatggtctgtaccatgctg

SEQ ID NO: 176167 - DNA, 20 bp, Artificial
  CRISPR gRNA sequence
aatggtctgtaccatgctgc

SEQ ID NO: 176168 - DNA, 20 bp, Artificial
  CRISPR gRNA sequence
taccatgctgcctcaaatac

SEQ ID NO: 176169 - DNA, 20 bp, Artificial
  CRISPR gRNA sequence
cctcaaatactgtgatcaga

SEQ ID NO: 176170 - DNA, 20 bp, Artificial
  CRISPR gRNA sequence
aaatactgtgatcagagtaa

SEQ ID NO: 176171 - DNA, 20 bp, Artificial
  CRISPR gRNA sequence
tgatcagagtaaataaatgt

SEQ ID NO: 176172 - DNA, 20 bp, Artificial
  CRISPR gRNA sequence
tagaccccatctaagcctcc

SEQ ID NO: 176173 - DNA, 20 bp, Artificial
  CRISPR gRNA sequence
gaccccatctaagcctcccc

SEQ ID NO: 176174 - DNA, 20 bp, Artificial
  CRISPR gRNA sequence
agcctcccccacttacacac

SEQ ID NO: 176175 - DNA, 20 bp, Artificial
  CRISPR gRNA sequence
ccccacttacacacacagcc

SEQ ID NO: 176176 - DNA, 20 bp, Artificial
  CRISPR gRNA sequence
acacacacagccacccatgg

SEQ ID NO: 176177 - DNA, 20 bp, Artificial
  CRISPR gRNA sequence
cacacacagccacccatggc

SEQ ID NO: 176178 - DNA, 20 bp, Artificial
  CRISPR gRNA sequence
aattagagttagctctctag

SEQ ID NO: 176179 - DNA, 20 bp, Artificial
  CRISPR gRNA sequence
gagttagctctctagaaggt

SEQ ID NO: 176180 - DNA, 20 bp, Artificial
  CRISPR gRNA sequence
gctctctagaaggtctttgc

SEQ ID NO: 176181 - DNA, 20 bp, Artificial
  CRISPR gRNA sequence
tctagaaggtctttgctctt

SEQ ID NO: 176182 - DNA, 20 bp, Artificial
  CRISPR gRNA sequence
tagaaggtctttgctctttc

SEQ ID NO: 176183 - DNA, 20 bp, Artificial
  CRISPR gRNA sequence
gaaggtctttgctctttctg

SEQ ID NO: 176184 - DNA, 20 bp, Artificial
  CRISPR gRNA sequence
tgctctttctggaagcaaag

SEQ ID NO: 176185 - DNA, 20 bp, Artificial
  CRISPR gRNA sequence
gctctttctggaagcaaagt

SEQ ID NO: 176186 - DNA, 20 bp, Artificial
  CRISPR gRNA sequence
ctctttctggaagcaaagtt

SEQ ID NO: 176187 - DNA, 20 bp, Artificial
  CRISPR gRNA sequence
tttctggaagcaaagttttc

SEQ ID NO: 176188 - DNA, 20 bp, Artificial
  CRISPR gRNA sequence
tctggaagcaaagttttctt

SEQ ID NO: 176189 - DNA, 20 bp, Artificial
  CRISPR gRNA sequence
ctggaagcaaagttttcttc

SEQ ID NO: 176190 - DNA, 20 bp, Artificial
  CRISPR gRNA sequence
tggaagcaaagttttcttca

SEQ ID NO: 176191 - DNA, 20 bp, Artificial
  CRISPR gRNA sequence
gaagcaaagttttcttcatt

SEQ ID NO: 176192 - DNA, 20 bp, Artificial
  CRISPR gRNA sequence
tcttcatttgtctagtaaac

SEQ ID NO: 176193 - DNA, 20 bp, Artificial
  CRISPR gRNA sequence
cttcatttgtctagtaaaca

SEQ ID NO: 176194 - DNA, 20 bp, Artificial
  CRISPR gRNA sequence
ttcatttgtctagtaaacat

SEQ ID NO: 176195 - DNA, 20 bp, Artificial
  CRISPR gRNA sequence
catttgtctagtaaacattt

SEQ ID NO: 176196 - DNA, 20 bp, Artificial
  CRISPR gRNA sequence
atttgtctagtaaacattta

SEQ ID NO: 176197 - DNA, 20 bp, Artificial
  CRISPR gRNA sequence
gtctagtaaacatttatctg

SEQ ID NO: 176198 - DNA, 20 bp, Artificial
  CRISPR gRNA sequence
tctagtaaacatttatctgg

SEQ ID NO: 176199 - DNA, 20 bp, Artificial
  CRISPR gRNA sequence
gtaaacatttatctggctga

SEQ ID NO: 176200 - DNA, 20 bp, Artificial
  CRISPR gRNA sequence
atctggctgaagtgttaaat

SEQ ID NO: 176201 - DNA, 20 bp, Artificial
  CRISPR gRNA sequence
tctggctgaagtgttaaata

SEQ ID NO: 176202 - DNA, 20 bp, Artificial
  CRISPR gRNA sequence
gctgaagtgttaaataccat

SEQ ID NO: 176203 - DNA, 20 bp, Artificial
  CRISPR gRNA sequence
aagtgttaaataccatttga

SEQ ID NO: 176204 - DNA, 20 bp, Artificial
  CRISPR gRNA sequence
aataccatttgacatacact

SEQ ID NO: 176205 - DNA, 20 bp, Artificial
  CRISPR gRNA sequence
gacatacactaaaaaataac

SEQ ID NO: 176206 - DNA, 20 bp, Artificial
  CRISPR gRNA sequence
acatacactaaaaaataact

SEQ ID NO: 176207 - DNA, 20 bp, Artificial
  CRISPR gRNA sequence
aaaaataacttagtcatcaa

SEQ ID NO: 176208 - DNA, 20 bp, Artificial
  CRISPR gRNA sequence
agtcatcaaaggttttgtac

SEQ ID NO: 176209 - DNA, 20 bp, Artificial
  CRISPR gRNA sequence
gtcatcaaaggttttgtaca

SEQ ID NO: 176210 - DNA, 20 bp, Artificial
  CRISPR gRNA sequence
tgtacaggcatgcccatgtg

SEQ ID NO: 176211 - DNA, 20 bp, Artificial
  CRISPR gRNA sequence
gtacaggcatgcccatgtgc

SEQ ID NO: 176212 - DNA, 20 bp, Artificial
  CRISPR gRNA sequence
tacaggcatgcccatgtgca

SEQ ID NO: 176213 - DNA, 20 bp, Artificial
  CRISPR gRNA sequence
ttccaggtagtgggtcattc

SEQ ID NO: 176214 - DNA, 20 bp, Artificial
  CRISPR gRNA sequence
tccaggtagtgggtcattct

SEQ ID NO: 176215 - DNA, 20 bp, Artificial
  CRISPR gRNA sequence
ccaggtagtgggtcattctc

SEQ ID NO: 176216 - DNA, 20 bp, Artificial
  CRISPR gRNA sequence
caggtagtgggtcattctca

SEQ ID NO: 176217 - DNA, 20 bp, Artificial
  CRISPR gRNA sequence
tcaaagagaatggtgaagaa

SEQ ID NO: 176218 - DNA, 20 bp, Artificial
  CRISPR gRNA sequence
aaagagaatggtgaagaacc

SEQ ID NO: 176219 - DNA, 20 bp, Artificial
  CRISPR gRNA sequence
ggctagaggcagtgactggg

SEQ ID NO: 176220 - DNA, 20 bp, Artificial
  CRISPR gRNA sequence
gaggcagtgactgggcatct

SEQ ID NO: 176221 - DNA, 20 bp, Artificial
  CRISPR gRNA sequence
ggcatctttccaagaagcca

SEQ ID NO: 176222 - DNA, 20 bp, Artificial
  CRISPR gRNA sequence
tccaagaagccaaatccaca

SEQ ID NO: 176223 - DNA, 20 bp, Artificial
  CRISPR gRNA sequence
ccaagaagccaaatccacaa

SEQ ID NO: 176224 - DNA, 20 bp, Artificial
  CRISPR gRNA sequence
caagaagccaaatccacaaa

SEQ ID NO: 176225 - DNA, 20 bp, Artificial
  CRISPR gRNA sequence
tcaagtttatagtttacttc

SEQ ID NO: 176226 - DNA, 20 bp, Artificial
  CRISPR gRNA sequence
aagtttatagtttacttcat

SEQ ID NO: 176227 - DNA, 20 bp, Artificial
  CRISPR gRNA sequence
atagtttacttcatactgta

SEQ ID NO: 176228 - DNA, 20 bp, Artificial
  CRISPR gRNA sequence
tagtttacttcatactgtac

SEQ ID NO: 176229 - DNA, 20 bp, Artificial
  CRISPR gRNA sequence
acttcatactgtaccacacc

SEQ ID NO: 176230 - DNA, 20 bp, Artificial
  CRISPR gRNA sequence
cttcatactgtaccacacct

SEQ ID NO: 176231 - DNA, 20 bp, Artificial
  CRISPR gRNA sequence
catactgtaccacaccttca

SEQ ID NO: 176232 - DNA, 20 bp, Artificial
  CRISPR gRNA sequence
atactgtaccacaccttcac

SEQ ID NO: 176233 - DNA, 20 bp, Artificial
  CRISPR gRNA sequence
taccacaccttcacttttgc

SEQ ID NO: 176234 - DNA, 20 bp, Artificial
  CRISPR gRNA sequence
cacttttgcctcccctgctg

SEQ ID NO: 176235 - DNA, 20 bp, Artificial
  CRISPR gRNA sequence
acttttgcctcccctgctgc

SEQ ID NO: 176236 - DNA, 20 bp, Artificial
  CRISPR gRNA sequence
ttgcctcccctgctgcaggc

SEQ ID NO: 176237 - DNA, 20 bp, Artificial
  CRISPR gRNA sequence
tgcctcccctgctgcaggcc

SEQ ID NO: 176238 - DNA, 20 bp, Artificial
  CRISPR gRNA sequence
gcctcccctgctgcaggcct

SEQ ID NO: 176239 - DNA, 20 bp, Artificial
  CRISPR gRNA sequence
cctcccctgctgcaggcctt

SEQ ID NO: 176240 - DNA, 20 bp, Artificial
  CRISPR gRNA sequence
ccctgctgcaggccttctcc

SEQ ID NO: 176241 - DNA, 20 bp, Artificial
  CRISPR gRNA sequence
ctgcaggccttctcctaggg

SEQ ID NO: 176242 - DNA, 20 bp, Artificial
  CRISPR gRNA sequence
caggccttctcctagggcca

SEQ ID NO: 176243 - DNA, 20 bp, Artificial
  CRISPR gRNA sequence
ctcctagggccaacagggtc

SEQ ID NO: 176244 - DNA, 20 bp, Artificial
  CRISPR gRNA sequence
tcctagggccaacagggtca

SEQ ID NO: 176245 - DNA, 20 bp, Artificial
  CRISPR gRNA sequence
ctagggccaacagggtcaag

SEQ ID NO: 176246 - DNA, 20 bp, Artificial
  CRISPR gRNA sequence
gggccaacagggtcaagtca

SEQ ID NO: 176247 - DNA, 20 bp, Artificial
  CRISPR gRNA sequence
caactgtttttaaaatcata

SEQ ID NO: 176248 - DNA, 20 bp, Artificial
  CRISPR gRNA sequence
tttttaaaatcatatatata

SEQ ID NO: 176249 - DNA, 20 bp, Artificial
  CRISPR gRNA sequence
ttaaaatcatatatataatc

SEQ ID NO: 176250 - DNA, 20 bp, Artificial
  CRISPR gRNA sequence
taaaatcatatatataatct

SEQ ID NO: 176251 - DNA, 20 bp, Artificial
  CRISPR gRNA sequence
aaaatcatatatataatctg

SEQ ID NO: 176252 - DNA, 20 bp, Artificial
  CRISPR gRNA sequence
aaatcatatatataatctgg

SEQ ID NO: 176253 - DNA, 20 bp, Artificial
  CRISPR gRNA sequence
gaacaactgataacatataa

SEQ ID NO: 176254 - DNA, 20 bp, Artificial
  CRISPR gRNA sequence
ataacatataaataatcaat

SEQ ID NO: 176255 - DNA, 20 bp, Artificial
  CRISPR gRNA sequence
aaatcaaaataactacctct

SEQ ID NO: 176256 - DNA, 20 bp, Artificial
  CRISPR gRNA sequence
aatcaaaataactacctctt

SEQ ID NO: 176257 - DNA, 20 bp, Artificial
  CRISPR gRNA sequence
cctcttaaaatgtaatcctt

SEQ ID NO: 176258 - DNA, 20 bp, Artificial
  CRISPR gRNA sequence
ttaaaatgtaatccttaaca

SEQ ID NO: 176259 - DNA, 20 bp, Artificial
  CRISPR gRNA sequence
aaaatgtaatccttaacaca

SEQ ID NO: 176260 - DNA, 20 bp, Artificial
  CRISPR gRNA sequence
aaatgtaatccttaacacat

SEQ ID NO: 176261 - DNA, 20 bp, Artificial
  CRISPR gRNA sequence
aacacatacttcttcatctt

SEQ ID NO: 176262 - DNA, 20 bp, Artificial
  CRISPR gRNA sequence
acacatacttcttcatctta

SEQ ID NO: 176263 - DNA, 20 bp, Artificial
  CRISPR gRNA sequence
cttcatcttaggacttaaat

SEQ ID NO: 176264 - DNA, 20 bp, Artificial
  CRISPR gRNA sequence
ttcatcttaggacttaaatt

SEQ ID NO: 176265 - DNA, 20 bp, Artificial
  CRISPR gRNA sequence
catcttaggacttaaattcc

SEQ ID NO: 176266 - DNA, 20 bp, Artificial
  CRISPR gRNA sequence
atcttaggacttaaattccc

SEQ ID NO: 176267 - DNA, 20 bp, Artificial
  CRISPR gRNA sequence
aggacttaaattcccagaat

SEQ ID NO: 176268 - DNA, 20 bp, Artificial
  CRISPR gRNA sequence
ggacttaaattcccagaatg

SEQ ID NO: 176269 - DNA, 20 bp, Artificial
  CRISPR gRNA sequence
aaattcccagaatgaacatt

SEQ ID NO: 176270 - DNA, 20 bp, Artificial
  CRISPR gRNA sequence
aattcccagaatgaacattt

SEQ ID NO: 176271 - DNA, 20 bp, Artificial
  CRISPR gRNA sequence
ccagaatgaacattttctta

SEQ ID NO: 176272 - DNA, 20 bp, Artificial
  CRISPR gRNA sequence
tcttattataagcattctaa

SEQ ID NO: 176273 - DNA, 20 bp, Artificial
  CRISPR gRNA sequence
cttattataagcattctaat

SEQ ID NO: 176274 - DNA, 20 bp, Artificial
  CRISPR gRNA sequence
ttattataagcattctaatt

SEQ ID NO: 176275 - DNA, 20 bp, Artificial
  CRISPR gRNA sequence
attataagcattctaattcc

SEQ ID NO: 176276 - DNA, 20 bp, Artificial
  CRISPR gRNA sequence
ttataagcattctaattccc

SEQ ID NO: 176277 - DNA, 20 bp, Artificial
  CRISPR gRNA sequence
taagcattctaattccccaa

SEQ ID NO: 176278 - DNA, 20 bp, Artificial
  CRISPR gRNA sequence
taattccccaaaactttcac

SEQ ID NO: 176279 - DNA, 20 bp, Artificial
  CRISPR gRNA sequence
attccccaaaactttcacaa

SEQ ID NO: 176280 - DNA, 20 bp, Artificial
  CRISPR gRNA sequence
cccaaaactttcacaaatac

SEQ ID NO: 176281 - DNA, 20 bp, Artificial
  CRISPR gRNA sequence
tcacaaatacaactactctg

SEQ ID NO: 176282 - DNA, 20 bp, Artificial
  CRISPR gRNA sequence
cacaaatacaactactctga

SEQ ID NO: 176283 - DNA, 20 bp, Artificial
  CRISPR gRNA sequence
acaaatacaactactctgaa

SEQ ID NO: 176284 - DNA, 20 bp, Artificial
  CRISPR gRNA sequence
ctctgaactcctaaaatact

SEQ ID NO: 176285 - DNA, 20 bp, Artificial
  CRISPR gRNA sequence
tgaactcctaaaatactatc

SEQ ID NO: 176286 - DNA, 20 bp, Artificial
  CRISPR gRNA sequence
aactcctaaaatactatcta

SEQ ID NO: 176287 - DNA, 20 bp, Artificial
  CRISPR gRNA sequence
ctaaaatactatctatcccc

SEQ ID NO: 176288 - DNA, 20 bp, Artificial
  CRISPR gRNA sequence
aaatactatctatccccttc

SEQ ID NO: 176289 - DNA, 20 bp, Artificial
  CRISPR gRNA sequence
tctatccccttcactaagaa

SEQ ID NO: 176290 - DNA, 20 bp, Artificial
  CRISPR gRNA sequence
tccccttcactaagaaccct

SEQ ID NO: 176291 - DNA, 20 bp, Artificial
  CRISPR gRNA sequence
cactaagaaccctctagatt

SEQ ID NO: 176292 - DNA, 20 bp, Artificial
  CRISPR gRNA sequence
actaagaaccctctagatta

SEQ ID NO: 176293 - DNA, 20 bp, Artificial
  CRISPR gRNA sequence
agaaccctctagattacaaa

SEQ ID NO: 176294 - DNA, 20 bp, Artificial
  CRISPR gRNA sequence
tagattacaaagaagacaag

SEQ ID NO: 176295 - DNA, 20 bp, Artificial
  CRISPR gRNA sequence
gattacaaagaagacaaggt

SEQ ID NO: 176296 - DNA, 20 bp, Artificial
  CRISPR gRNA sequence
caaagaagacaaggtagcat

SEQ ID NO: 176297 - DNA, 20 bp, Artificial
  CRISPR gRNA sequence
tgaatctgttaggcagttca

SEQ ID NO: 176298 - DNA, 20 bp, Artificial
  CRISPR gRNA sequence
aatctgttaggcagttcact

SEQ ID NO: 176299 - DNA, 20 bp, Artificial
  CRISPR gRNA sequence
ttaggcagttcactcagcta

SEQ ID NO: 176300 - DNA, 20 bp, Artificial
  CRISPR gRNA sequence
ggcagttcactcagctatca

SEQ ID NO: 176301 - DNA, 20 bp, Artificial
  CRISPR gRNA sequence
actcagctatcataccaaaa

SEQ ID NO: 176302 - DNA, 20 bp, Artificial
  CRISPR gRNA sequence
agctatcataccaaaagaat

SEQ ID NO: 176303 - DNA, 20 bp, Artificial
  CRISPR gRNA sequence
tcataccaaaagaatttaga

SEQ ID NO: 176304 - DNA, 20 bp, Artificial
  CRISPR gRNA sequence
agaattttttgctgggggga

SEQ ID NO: 176305 - DNA, 20 bp, Artificial
  CRISPR gRNA sequence
gaattttttgctggggggag

SEQ ID NO: 176306 - DNA, 20 bp, Artificial
  CRISPR gRNA sequence
tttgctggggggagggaagt

SEQ ID NO: 176307 - DNA, 20 bp, Artificial
  CRISPR gRNA sequence
ttgctggggggagggaagta

SEQ ID NO: 176308 - DNA, 20 bp, Artificial
  CRISPR gRNA sequence
tgctggggggagggaagtaa

SEQ ID NO: 176309 - DNA, 20 bp, Artificial
  CRISPR gRNA sequence
gctggggggagggaagtaaa

SEQ ID NO: 176310 - DNA, 20 bp, Artificial
  CRISPR gRNA sequence
ctggggggagggaagtaaaa

SEQ ID NO: 176311 - DNA, 20 bp, Artificial
  CRISPR gRNA sequence
gggggagggaagtaaaaaga

SEQ ID NO: 176312 - DNA, 20 bp, Artificial
  CRISPR gRNA sequence
ttgtcttattccctgaaaat

SEQ ID NO: 176313 - DNA, 20 bp, Artificial
  CRISPR gRNA sequence
tcttattccctgaaaattcc

SEQ ID NO: 176314 - DNA, 20 bp, Artificial
  CRISPR gRNA sequence
attccctgaaaattcctaat

SEQ ID NO: 176315 - DNA, 20 bp, Artificial
  CRISPR gRNA sequence
ttccctgaaaattcctaatc

SEQ ID NO: 176316 - DNA, 20 bp, Artificial
  CRISPR gRNA sequence
cctgaaaattcctaatctga

SEQ ID NO: 176317 - DNA, 20 bp, Artificial
  CRISPR gRNA sequence
aaaattcctaatctgaatct

SEQ ID NO: 176318 - DNA, 20 bp, Artificial
  CRISPR gRNA sequence
ctaatctgaatctataacat

SEQ ID NO: 176319 - DNA, 20 bp, Artificial
  CRISPR gRNA sequence
atctgaatctataacatatt

SEQ ID NO: 176320 - DNA, 20 bp, Artificial
  CRISPR gRNA sequence
aatctataacatattcctac

SEQ ID NO: 176321 - DNA, 20 bp, Artificial
  CRISPR gRNA sequence
taacatattcctactaacca

SEQ ID NO: 176322 - DNA, 20 bp, Artificial
  CRISPR gRNA sequence
ctactaaccactcgacttga

SEQ ID NO: 176323 - DNA, 20 bp, Artificial
  CRISPR gRNA sequence
ctaaccactcgacttgaata

SEQ ID NO: 176324 - DNA, 20 bp, Artificial
  CRISPR gRNA sequence
accactcgacttgaatatca

SEQ ID NO: 176325 - DNA, 20 bp, Artificial
  CRISPR gRNA sequence
gacttgaatatcagaagtac

SEQ ID NO: 176326 - DNA, 20 bp, Artificial
  CRISPR gRNA sequence
gaatatcagaagtacagtct

SEQ ID NO: 176327 - DNA, 20 bp, Artificial
  CRISPR gRNA sequence
aatatcagaagtacagtctc

SEQ ID NO: 176328 - DNA, 20 bp, Artificial
  CRISPR gRNA sequence
ttttcatcttaaatagagct

SEQ ID NO: 176329 - DNA, 20 bp, Artificial
  CRISPR gRNA sequence
ttcatcttaaatagagcttt

SEQ ID NO: 176330 - DNA, 20 bp, Artificial
  CRISPR gRNA sequence
tcatcttaaatagagctttt

SEQ ID NO: 176331 - DNA, 20 bp, Artificial
  CRISPR gRNA sequence
catcttaaatagagcttttc

SEQ ID NO: 176332 - DNA, 20 bp, Artificial
  CRISPR gRNA sequence
atcttaaatagagcttttca

SEQ ID NO: 176333 - DNA, 20 bp, Artificial
  CRISPR gRNA sequence
aaatagagcttttcagtcca

SEQ ID NO: 176334 - DNA, 20 bp, Artificial
  CRISPR gRNA sequence
aatagagcttttcagtccaa

SEQ ID NO: 176335 - DNA, 20 bp, Artificial
  CRISPR gRNA sequence
ttcagtccaaatctgtataa

SEQ ID NO: 176336 - DNA, 20 bp, Artificial
  CRISPR gRNA sequence
tcagtccaaatctgtataaa

SEQ ID NO: 176337 - DNA, 20 bp, Artificial
  CRISPR gRNA sequence
cagtccaaatctgtataaac

SEQ ID NO: 176338 - DNA, 20 bp, Artificial
  CRISPR gRNA sequence
agtccaaatctgtataaaca

SEQ ID NO: 176339 - DNA, 20 bp, Artificial
  CRISPR gRNA sequence
tataaacaaactttgtcctt

SEQ ID NO: 176340 - DNA, 20 bp, Artificial
  CRISPR gRNA sequence
tgtccttcaatctttcaact

SEQ ID NO: 176341 - DNA, 20 bp, Artificial
  CRISPR gRNA sequence
gtccttcaatctttcaactc

SEQ ID NO: 176342 - DNA, 20 bp, Artificial
  CRISPR gRNA sequence
tccttcaatctttcaactcc

SEQ ID NO: 176343 - DNA, 20 bp, Artificial
  CRISPR gRNA sequence
caatctttcaactccccagc

SEQ ID NO: 176344 - DNA, 20 bp, Artificial
  CRISPR gRNA sequence
aatctttcaactccccagca

SEQ ID NO: 176345 - DNA, 20 bp, Artificial
  CRISPR gRNA sequence
tcaactccccagcagttttt

SEQ ID NO: 176346 - DNA, 20 bp, Artificial
  CRISPR gRNA sequence
caactccccagcagtttttc

SEQ ID NO: 176347 - DNA, 20 bp, Artificial
  CRISPR gRNA sequence
aactccccagcagtttttca

SEQ ID NO: 176348 - DNA, 20 bp, Artificial
  CRISPR gRNA sequence
cccagcagtttttcaaggtc

SEQ ID NO: 176349 - DNA, 20 bp, Artificial
  CRISPR gRNA sequence
ttcaaggtcacttttgcaag

SEQ ID NO: 176350 - DNA, 20 bp, Artificial
  CRISPR gRNA sequence
tcaaggtcacttttgcaagc

SEQ ID NO: 176351 - DNA, 20 bp, Artificial
  CRISPR gRNA sequence
caaggtcacttttgcaagca

SEQ ID NO: 176352 - DNA, 20 bp, Artificial
  CRISPR gRNA sequence
aaggtcacttttgcaagcaa

SEQ ID NO: 176353 - DNA, 20 bp, Artificial
  CRISPR gRNA sequence
ttgcaagcaacgacagaggc

SEQ ID NO: 176354 - DNA, 20 bp, Artificial
  CRISPR gRNA sequence
tgcaagcaacgacagaggcc

SEQ ID NO: 176355 - DNA, 20 bp, Artificial
  CRISPR gRNA sequence
gcaagcaacgacagaggcct

SEQ ID NO: 176356 - DNA, 20 bp, Artificial
  CRISPR gRNA sequence
caagcaacgacagaggcctg

SEQ ID NO: 176357 - DNA, 20 bp, Artificial
  CRISPR gRNA sequence
catccaggaactttgacttg

SEQ ID NO: 176358 - DNA, 20 bp, Artificial
  CRISPR gRNA sequence
tgacttgctatatcattaca

SEQ ID NO: 176359 - DNA, 20 bp, Artificial
  CRISPR gRNA sequence
gacttgctatatcattacaa

SEQ ID NO: 176360 - DNA, 20 bp, Artificial
  CRISPR gRNA sequence
acttgctatatcattacaac

SEQ ID NO: 176361 - DNA, 20 bp, Artificial
  CRISPR gRNA sequence
gctatatcattacaactcca

SEQ ID NO: 176362 - DNA, 20 bp, Artificial
  CRISPR gRNA sequence
ctatatcattacaactccaa

SEQ ID NO: 176363 - DNA, 20 bp, Artificial
  CRISPR gRNA sequence
tatcattacaactccaagag

SEQ ID NO: 176364 - DNA, 20 bp, Artificial
  CRISPR gRNA sequence
caactccaagagccccgaat

SEQ ID NO: 176365 - DNA, 20 bp, Artificial
  CRISPR gRNA sequence
caagagccccgaatctaaat

SEQ ID NO: 176366 - DNA, 20 bp, Artificial
  CRISPR gRNA sequence
aatcctatcagtcctctaag

SEQ ID NO: 176367 - DNA, 20 bp, Artificial
  CRISPR gRNA sequence
tcagtcctctaaggtaaatc

SEQ ID NO: 176368 - DNA, 20 bp, Artificial
  CRISPR gRNA sequence
taaggtaaatcctttattag

SEQ ID NO: 176369 - DNA, 20 bp, Artificial
  CRISPR gRNA sequence
aggtaaatcctttattagag

SEQ ID NO: 176370 - DNA, 20 bp, Artificial
  CRISPR gRNA sequence
tattagaggggaagctaggg

SEQ ID NO: 176371 - DNA, 20 bp, Artificial
  CRISPR gRNA sequence
attagaggggaagctaggga

SEQ ID NO: 176372 - DNA, 20 bp, Artificial
  CRISPR gRNA sequence
ttagaggggaagctagggaa

SEQ ID NO: 176373 - DNA, 20 bp, Artificial
  CRISPR gRNA sequence
gaggggaagctagggaaggc

SEQ ID NO: 176374 - DNA, 20 bp, Artificial
  CRISPR gRNA sequence
gggaaggcaaatcgacaccc

SEQ ID NO: 176375 - DNA, 20 bp, Artificial
  CRISPR gRNA sequence
gaaacttctcctctaatagg

SEQ ID NO: 176376 - DNA, 20 bp, Artificial
  CRISPR gRNA sequence
ctcctctaatagggcctgct

SEQ ID NO: 176377 - DNA, 20 bp, Artificial
  CRISPR gRNA sequence
tcctctaatagggcctgctc

SEQ ID NO: 176378 - DNA, 20 bp, Artificial
  CRISPR gRNA sequence
ctctaatagggcctgctcct

SEQ ID NO: 176379 - DNA, 20 bp, Artificial
  CRISPR gRNA sequence
taatagggcctgctcctttt

SEQ ID NO: 176380 - DNA, 20 bp, Artificial
  CRISPR gRNA sequence
atagggcctgctccttttcc

SEQ ID NO: 176381 - DNA, 20 bp, Artificial
  CRISPR gRNA sequence
ctccttttccgtacccagag

SEQ ID NO: 176382 - DNA, 20 bp, Artificial
  CRISPR gRNA sequence
cttttccgtacccagagact

SEQ ID NO: 176383 - DNA, 20 bp, Artificial
  CRISPR gRNA sequence
ttccgtacccagagactaag

SEQ ID NO: 176384 - DNA, 20 bp, Artificial
  CRISPR gRNA sequence
tccgtacccagagactaagt

SEQ ID NO: 176385 - DNA, 20 bp, Artificial
  CRISPR gRNA sequence
ccgtacccagagactaagtg

SEQ ID NO: 176386 - DNA, 20 bp, Artificial
  CRISPR gRNA sequence
cgtacccagagactaagtgc

SEQ ID NO: 176387 - DNA, 20 bp, Artificial
  CRISPR gRNA sequence
agtgctgctggctgacggct

SEQ ID NO: 176388 - DNA, 20 bp, Artificial
  CRISPR gRNA sequence
ctggctgacggctccacact

SEQ ID NO: 176389 - DNA, 20 bp, Artificial
  CRISPR gRNA sequence
gctgacggctccacactgag

SEQ ID NO: 176390 - DNA, 20 bp, Artificial
  CRISPR gRNA sequence
acggctccacactgagtctg

SEQ ID NO: 176391 - DNA, 20 bp, Artificial
  CRISPR gRNA sequence
cacactgagtctgctgcaga

SEQ ID NO: 176392 - DNA, 20 bp, Artificial
  CRISPR gRNA sequence
agtctgctgcagaaatgttc

SEQ ID NO: 176393 - DNA, 20 bp, Artificial
  CRISPR gRNA sequence
ctgcagaaatgttccaatga

SEQ ID NO: 176394 - DNA, 20 bp, Artificial
  CRISPR gRNA sequence
cagaaatgttccaatgacct

SEQ ID NO: 176395 - DNA, 20 bp, Artificial
  CRISPR gRNA sequence
caatgaccttcattccatat

SEQ ID NO: 176396 - DNA, 20 bp, Artificial
  CRISPR gRNA sequence
cattccatatttgcaaataa

SEQ ID NO: 176397 - DNA, 20 bp, Artificial
  CRISPR gRNA sequence
attccatatttgcaaataaa

SEQ ID NO: 176398 - DNA, 20 bp, Artificial
  CRISPR gRNA sequence
catatttgcaaataaaaaga

SEQ ID NO: 176399 - DNA, 20 bp, Artificial
  CRISPR gRNA sequence
gcaaataaaaagaaaacaaa

SEQ ID NO: 176400 - DNA, 20 bp, Artificial
  CRISPR gRNA sequence
caaataaaaagaaaacaaag

SEQ ID NO: 176401 - DNA, 20 bp, Artificial
  CRISPR gRNA sequence
cattttaaaatcaggtgtat

SEQ ID NO: 176402 - DNA, 20 bp, Artificial
  CRISPR gRNA sequence
taaaatcaggtgtattatag

SEQ ID NO: 176403 - DNA, 20 bp, Artificial
  CRISPR gRNA sequence
aaaatcaggtgtattataga

SEQ ID NO: 176404 - DNA, 20 bp, Artificial
  CRISPR gRNA sequence
aaatcaggtgtattatagat

SEQ ID NO: 176405 - DNA, 20 bp, Artificial
  CRISPR gRNA sequence
tagatcttagtatgtgggat

SEQ ID NO: 176406 - DNA, 20 bp, Artificial
  CRISPR gRNA sequence
agtatgtgggattgaagatt

SEQ ID NO: 176407 - DNA, 20 bp, Artificial
  CRISPR gRNA sequence
gtatgtgggattgaagattt

SEQ ID NO: 176408 - DNA, 20 bp, Artificial
  CRISPR gRNA sequence
aagatttcactgttcatgag

SEQ ID NO: 176409 - DNA, 20 bp, Artificial
  CRISPR gRNA sequence
cactgttcatgagaactggc

SEQ ID NO: 176410 - DNA, 20 bp, Artificial
  CRISPR gRNA sequence
actgttcatgagaactggct

SEQ ID NO: 176411 - DNA, 20 bp, Artificial
  CRISPR gRNA sequence
ttcatgagaactggctggtt

SEQ ID NO: 176412 - DNA, 20 bp, Artificial
  CRISPR gRNA sequence
atgagaactggctggttact

SEQ ID NO: 176413 - DNA, 20 bp, Artificial
  CRISPR gRNA sequence
gctggttactgattagcaac

SEQ ID NO: 176414 - DNA, 20 bp, Artificial
  CRISPR gRNA sequence
gttactgattagcaacctac

SEQ ID NO: 176415 - DNA, 20 bp, Artificial
  CRISPR gRNA sequence
ctgattagcaacctacatta

SEQ ID NO: 176416 - DNA, 20 bp, Artificial
  CRISPR gRNA sequence
attagcaacctacattagct

SEQ ID NO: 176417 - DNA, 20 bp, Artificial
  CRISPR gRNA sequence
gcaacctacattagctttat

SEQ ID NO: 176418 - DNA, 20 bp, Artificial
  CRISPR gRNA sequence
cattagctttatatccataa

SEQ ID NO: 176419 - DNA, 20 bp, Artificial
  CRISPR gRNA sequence
gctttatatccataaagaga

SEQ ID NO: 176420 - DNA, 20 bp, Artificial
  CRISPR gRNA sequence
tatatccataaagagaaaaa

SEQ ID NO: 176421 - DNA, 20 bp, Artificial
  CRISPR gRNA sequence
atatccataaagagaaaaat

SEQ ID NO: 176422 - DNA, 20 bp, Artificial
  CRISPR gRNA sequence
tatccataaagagaaaaata

SEQ ID NO: 176423 - DNA, 20 bp, Artificial
  CRISPR gRNA sequence
tactcttaactttcctattc

SEQ ID NO: 176424 - DNA, 20 bp, Artificial
  CRISPR gRNA sequence
ttaactttcctattcacaaa

SEQ ID NO: 176425 - DNA, 20 bp, Artificial
  CRISPR gRNA sequence
aactttcctattcacaaact

SEQ ID NO: 176426 - DNA, 20 bp, Artificial
  CRISPR gRNA sequence
actttcctattcacaaactg

SEQ ID NO: 176427 - DNA, 20 bp, Artificial
  CRISPR gRNA sequence
tcctattcacaaactgcagg

SEQ ID NO: 176428 - DNA, 20 bp, Artificial
  CRISPR gRNA sequence
cctattcacaaactgcagga

SEQ ID NO: 176429 - DNA, 20 bp, Artificial
  CRISPR gRNA sequence
ctattcacaaactgcaggat

SEQ ID NO: 176430 - DNA, 20 bp, Artificial
  CRISPR gRNA sequence
ttcacaaactgcaggatttt

SEQ ID NO: 176431 - DNA, 20 bp, Artificial
  CRISPR gRNA sequence
acaaactgcaggattttaaa

SEQ ID NO: 176432 - DNA, 20 bp, Artificial
  CRISPR gRNA sequence
caggattttaaatatttaat

SEQ ID NO: 176433 - DNA, 20 bp, Artificial
  CRISPR gRNA sequence
taaatatttaatacggaaaa

SEQ ID NO: 176434 - DNA, 20 bp, Artificial
  CRISPR gRNA sequence
aaatatttaatacggaaaaa

SEQ ID NO: 176435 - DNA, 20 bp, Artificial
  CRISPR gRNA sequence
aatatttaatacggaaaaat

SEQ ID NO: 176436 - DNA, 20 bp, Artificial
  CRISPR gRNA sequence
aatacggaaaaatggaaagc

SEQ ID NO: 176437 - DNA, 20 bp, Artificial
  CRISPR gRNA sequence
atacggaaaaatggaaagca

SEQ ID NO: 176438 - DNA, 20 bp, Artificial
  CRISPR gRNA sequence
tgctcacatcattttaaaga

SEQ ID NO: 176439 - DNA, 20 bp, Artificial
  CRISPR gRNA sequence
gctcacatcattttaaagaa

SEQ ID NO: 176440 - DNA, 20 bp, Artificial
  CRISPR gRNA sequence
ctcacatcattttaaagaac

SEQ ID NO: 176441 - DNA, 20 bp, Artificial
  CRISPR gRNA sequence
acatcattttaaagaactaa

SEQ ID NO: 176442 - DNA, 20 bp, Artificial
  CRISPR gRNA sequence
taaagaactaaatcaacacc

SEQ ID NO: 176443 - DNA, 20 bp, Artificial
  CRISPR gRNA sequence
aaagaactaaatcaacacct

SEQ ID NO: 176444 - DNA, 20 bp, Artificial
  CRISPR gRNA sequence
aagaactaaatcaacacctg

SEQ ID NO: 176445 - DNA, 20 bp, Artificial
  CRISPR gRNA sequence
aatcaacacctgacaaaatg

SEQ ID NO: 176446 - DNA, 20 bp, Artificial
  CRISPR gRNA sequence
acaaaatgtgtgaaatctgt

SEQ ID NO: 176447 - DNA, 20 bp, Artificial
  CRISPR gRNA sequence
tggaaaaatatttgctcatc

SEQ ID NO: 176448 - DNA, 20 bp, Artificial
  CRISPR gRNA sequence
gctcatcactgtcaatataa

SEQ ID NO: 176449 - DNA, 20 bp, Artificial
  CRISPR gRNA sequence
ctcatcactgtcaatataag

SEQ ID NO: 176450 - DNA, 20 bp, Artificial
  CRISPR gRNA sequence
atcactgtcaatataagtga

SEQ ID NO: 176451 - DNA, 20 bp, Artificial
  CRISPR gRNA sequence
tcaatataagtgaagatatt

SEQ ID NO: 176452 - DNA, 20 bp, Artificial
  CRISPR gRNA sequence
ctaaccagcattctaagcta

SEQ ID NO: 176453 - DNA, 20 bp, Artificial
  CRISPR gRNA sequence
taaccagcattctaagctaa

SEQ ID NO: 176454 - DNA, 20 bp, Artificial
  CRISPR gRNA sequence
accagcattctaagctaaaa

SEQ ID NO: 176455 - DNA, 20 bp, Artificial
  CRISPR gRNA sequence
taagctaaaatgtgcattaa

SEQ ID NO: 176456 - DNA, 20 bp, Artificial
  CRISPR gRNA sequence
agctaaaatgtgcattaaaa

SEQ ID NO: 176457 - DNA, 20 bp, Artificial
  CRISPR gRNA sequence
aaatgtgcattaaaaacaaa

SEQ ID NO: 176458 - DNA, 20 bp, Artificial
  CRISPR gRNA sequence
aaaacaaagattgttactac

SEQ ID NO: 176459 - DNA, 20 bp, Artificial
  CRISPR gRNA sequence
ttactacattaactactact

SEQ ID NO: 176460 - DNA, 20 bp, Artificial
  CRISPR gRNA sequence
ctacattaactactacttat

SEQ ID NO: 176461 - DNA, 20 bp, Artificial
  CRISPR gRNA sequence
cattaactactacttattag

SEQ ID NO: 176462 - DNA, 20 bp, Artificial
  CRISPR gRNA sequence
actactacttattagaatct

SEQ ID NO: 176463 - DNA, 20 bp, Artificial
  CRISPR gRNA sequence
ctacttattagaatctagag

SEQ ID NO: 176464 - DNA, 20 bp, Artificial
  CRISPR gRNA sequence
cttattagaatctagaggta

SEQ ID NO: 176465 - DNA, 20 bp, Artificial
  CRISPR gRNA sequence
attagaatctagaggtagac

SEQ ID NO: 176466 - DNA, 20 bp, Artificial
  CRISPR gRNA sequence
ttagaatctagaggtagact

SEQ ID NO: 176467 - DNA, 20 bp, Artificial
  CRISPR gRNA sequence
gaatctagaggtagactggt

SEQ ID NO: 176468 - DNA, 20 bp, Artificial
  CRISPR gRNA sequence
gaggtagactggtaaatcaa

SEQ ID NO: 176469 - DNA, 20 bp, Artificial
  CRISPR gRNA sequence
gtaaatcaagaaagttatgg

SEQ ID NO: 176470 - DNA, 20 bp, Artificial
  CRISPR gRNA sequence
tgggaaaatttcacactggc

SEQ ID NO: 176471 - DNA, 20 bp, Artificial
  CRISPR gRNA sequence
cacactggcatgtgggcctt

SEQ ID NO: 176472 - DNA, 20 bp, Artificial
  CRISPR gRNA sequence
acactggcatgtgggccttc

SEQ ID NO: 176473 - DNA, 20 bp, Artificial
  CRISPR gRNA sequence
gcatgtgggccttcaccatt

SEQ ID NO: 176474 - DNA, 20 bp, Artificial
  CRISPR gRNA sequence
caccattagaacctgcagca

SEQ ID NO: 176475 - DNA, 20 bp, Artificial
  CRISPR gRNA sequence
accattagaacctgcagcag

SEQ ID NO: 176476 - DNA, 20 bp, Artificial
  CRISPR gRNA sequence
gaacctgcagcagtgcaaat

SEQ ID NO: 176477 - DNA, 20 bp, Artificial
  CRISPR gRNA sequence
cagcagtgcaaatcgtattt

SEQ ID NO: 176478 - DNA, 20 bp, Artificial
  CRISPR gRNA sequence
tcacacaaatttctaacagc

SEQ ID NO: 176479 - DNA, 20 bp, Artificial
  CRISPR gRNA sequence
cacacaaatttctaacagca

SEQ ID NO: 176480 - DNA, 20 bp, Artificial
  CRISPR gRNA sequence
acacaaatttctaacagcaa

SEQ ID NO: 176481 - DNA, 20 bp, Artificial
  CRISPR gRNA sequence
ctaacagcaacagtgttgct

SEQ ID NO: 176482 - DNA, 20 bp, Artificial
  CRISPR gRNA sequence
taacagcaacagtgttgctt

SEQ ID NO: 176483 - DNA, 20 bp, Artificial
  CRISPR gRNA sequence
acagcaacagtgttgcttcc

SEQ ID NO: 176484 - DNA, 20 bp, Artificial
  CRISPR gRNA sequence
cttccatatctgaaaacaca

SEQ ID NO: 176485 - DNA, 20 bp, Artificial
  CRISPR gRNA sequence
ccatatctgaaaacacagat

SEQ ID NO: 176486 - DNA, 20 bp, Artificial
  CRISPR gRNA sequence
catatctgaaaacacagatg

SEQ ID NO: 176487 - DNA, 20 bp, Artificial
  CRISPR gRNA sequence
aaaacacagatgtcaacaaa

SEQ ID NO: 176488 - DNA, 20 bp, Artificial
  CRISPR gRNA sequence
tcacaacaacccagcttatt

SEQ ID NO: 176489 - DNA, 20 bp, Artificial
  CRISPR gRNA sequence
acaacaacccagcttattcc

SEQ ID NO: 176490 - DNA, 20 bp, Artificial
  CRISPR gRNA sequence
attccgtaggaaagcttcag

SEQ ID NO: 176491 - DNA, 20 bp, Artificial
  CRISPR gRNA sequence
ttccgtaggaaagcttcagg

SEQ ID NO: 176492 - DNA, 20 bp, Artificial
  CRISPR gRNA sequence
cgtaggaaagcttcagggca

SEQ ID NO: 176493 - DNA, 20 bp, Artificial
  CRISPR gRNA sequence
cagggcacttgaacaaagga

SEQ ID NO: 176494 - DNA, 20 bp, Artificial
  CRISPR gRNA sequence
agggcacttgaacaaaggaa

SEQ ID NO: 176495 - DNA, 20 bp, Artificial
  CRISPR gRNA sequence
gaacaaaggaaaattatttg

SEQ ID NO: 176496 - DNA, 20 bp, Artificial
  CRISPR gRNA sequence
aacaaaggaaaattatttgg

SEQ ID NO: 176497 - DNA, 20 bp, Artificial
  CRISPR gRNA sequence
tttggaaaacagttaagttt

SEQ ID NO: 176498 - DNA, 20 bp, Artificial
  CRISPR gRNA sequence
ggaaaacagttaagtttacc

SEQ ID NO: 176499 - DNA, 20 bp, Artificial
  CRISPR gRNA sequence
gaaaacagttaagtttaccc

SEQ ID NO: 176500 - DNA, 20 bp, Artificial
  CRISPR gRNA sequence
agtttacccaatgcaaagag

SEQ ID NO: 176501 - DNA, 20 bp, Artificial
  CRISPR gRNA sequence
acccaatgcaaagagaaaag

SEQ ID NO: 176502 - DNA, 20 bp, Artificial
  CRISPR gRNA sequence
cccaatgcaaagagaaaagt

SEQ ID NO: 176503 - DNA, 20 bp, Artificial
  CRISPR gRNA sequence
tgcttctgtgtgcccctgaa

SEQ ID NO: 176504 - DNA, 20 bp, Artificial
  CRISPR gRNA sequence
gcttctgtgtgcccctgaaa

SEQ ID NO: 176505 - DNA, 20 bp, Artificial
  CRISPR gRNA sequence
cttctgtgtgcccctgaaaa

SEQ ID NO: 176506 - DNA, 20 bp, Artificial
  CRISPR gRNA sequence
ctgtgtgcccctgaaaaatg

SEQ ID NO: 176507 - DNA, 20 bp, Artificial
  CRISPR gRNA sequence
tgtgtgcccctgaaaaatga

SEQ ID NO: 176508 - DNA, 20 bp, Artificial
  CRISPR gRNA sequence
tgtgcccctgaaaaatgatt

SEQ ID NO: 176509 - DNA, 20 bp, Artificial
  CRISPR gRNA sequence
aaaaatgattagcctttctc

SEQ ID NO: 176510 - DNA, 20 bp, Artificial
  CRISPR gRNA sequence
gcctttctccatgtacctga

SEQ ID NO: 176511 - DNA, 20 bp, Artificial
  CRISPR gRNA sequence
tctccatgtacctgatcttg

SEQ ID NO: 176512 - DNA, 20 bp, Artificial
  CRISPR gRNA sequence
ctccatgtacctgatcttgt

SEQ ID NO: 176513 - DNA, 20 bp, Artificial
  CRISPR gRNA sequence
tccatgtacctgatcttgtc

SEQ ID NO: 176514 - DNA, 20 bp, Artificial
  CRISPR gRNA sequence
catgtacctgatcttgtcga

SEQ ID NO: 176515 - DNA, 20 bp, Artificial
  CRISPR gRNA sequence
atcttgtcgatacccaacta

SEQ ID NO: 176516 - DNA, 20 bp, Artificial
  CRISPR gRNA sequence
gtcgatacccaactaggaaa

SEQ ID NO: 176517 - DNA, 20 bp, Artificial
  CRISPR gRNA sequence
tcgatacccaactaggaaag

SEQ ID NO: 176518 - DNA, 20 bp, Artificial
  CRISPR gRNA sequence
ggaaagaaatcctagttgaa

SEQ ID NO: 176519 - DNA, 20 bp, Artificial
  CRISPR gRNA sequence
gttgaaggacatgcaaaatc

SEQ ID NO: 176520 - DNA, 20 bp, Artificial
  CRISPR gRNA sequence
aaggacatgcaaaatctaaa

SEQ ID NO: 176521 - DNA, 20 bp, Artificial
  CRISPR gRNA sequence
aacacagcaaggtattctag

SEQ ID NO: 176522 - DNA, 20 bp, Artificial
  CRISPR gRNA sequence
taggtgcaccaaaaggtatg

SEQ ID NO: 176523 - DNA, 20 bp, Artificial
  CRISPR gRNA sequence
ggtgcaccaaaaggtatgca

SEQ ID NO: 176524 - DNA, 20 bp, Artificial
  CRISPR gRNA sequence
tctgaacagtgcaacttgtc

SEQ ID NO: 176525 - DNA, 20 bp, Artificial
  CRISPR gRNA sequence
ctgaacagtgcaacttgtct

SEQ ID NO: 176526 - DNA, 20 bp, Artificial
  CRISPR gRNA sequence
tgaacagtgcaacttgtcta

SEQ ID NO: 176527 - DNA, 20 bp, Artificial
  CRISPR gRNA sequence
aacagtgcaacttgtctaca

SEQ ID NO: 176528 - DNA, 20 bp, Artificial
  CRISPR gRNA sequence
gtctacactctctgaagcta

SEQ ID NO: 176529 - DNA, 20 bp, Artificial
  CRISPR gRNA sequence
tctacactctctgaagctaa

SEQ ID NO: 176530 - DNA, 20 bp, Artificial
  CRISPR gRNA sequence
cactctctgaagctaaacag

SEQ ID NO: 176531 - DNA, 20 bp, Artificial
  CRISPR gRNA sequence
tctgaagctaaacagtttct

SEQ ID NO: 176532 - DNA, 20 bp, Artificial
  CRISPR gRNA sequence
tgaagctaaacagtttctat

SEQ ID NO: 176533 - DNA, 20 bp, Artificial
  CRISPR gRNA sequence
aagctaaacagtttctatca

SEQ ID NO: 176534 - DNA, 20 bp, Artificial
  CRISPR gRNA sequence
aacagtttctatcatttcaa

SEQ ID NO: 176535 - DNA, 20 bp, Artificial
  CRISPR gRNA sequence
ctatcatttcaacacaaaac

SEQ ID NO: 176536 - DNA, 20 bp, Artificial
  CRISPR gRNA sequence
tatcatttcaacacaaaaca

SEQ ID NO: 176537 - DNA, 20 bp, Artificial
  CRISPR gRNA sequence
tcatttcaacacaaaacaaa

SEQ ID NO: 176538 - DNA, 20 bp, Artificial
  CRISPR gRNA sequence
caacacaaaacaaagaatta

SEQ ID NO: 176539 - DNA, 20 bp, Artificial
  CRISPR gRNA sequence
aacacaaaacaaagaattaa

SEQ ID NO: 176540 - DNA, 20 bp, Artificial
  CRISPR gRNA sequence
aacttaccgggaactgcatt

SEQ ID NO: 176541 - DNA, 20 bp, Artificial
  CRISPR gRNA sequence
accgggaactgcattaattt

SEQ ID NO: 176542 - DNA, 20 bp, Artificial
  CRISPR gRNA sequence
ccgggaactgcattaatttt

SEQ ID NO: 176543 - DNA, 20 bp, Artificial
  CRISPR gRNA sequence
cattaattttacatgtagtt

SEQ ID NO: 176544 - DNA, 20 bp, Artificial
  CRISPR gRNA sequence
attttacatgtagttattta

SEQ ID NO: 176545 - DNA, 20 bp, Artificial
  CRISPR gRNA sequence
tacatgtagttatttatacc

SEQ ID NO: 176546 - DNA, 20 bp, Artificial
  CRISPR gRNA sequence
acatgtagttatttatacct

SEQ ID NO: 176547 - DNA, 20 bp, Artificial
  CRISPR gRNA sequence
catgtagttatttatacctc

SEQ ID NO: 176548 - DNA, 20 bp, Artificial
  CRISPR gRNA sequence
tttatacctccaccgactgg

SEQ ID NO: 176549 - DNA, 20 bp, Artificial
  CRISPR gRNA sequence
atacctccaccgactgggag

SEQ ID NO: 176550 - DNA, 20 bp, Artificial
  CRISPR gRNA sequence
tacctccaccgactgggaga

SEQ ID NO: 176551 - DNA, 20 bp, Artificial
  CRISPR gRNA sequence
caccgactgggagaatttaa

SEQ ID NO: 176552 - DNA, 20 bp, Artificial
  CRISPR gRNA sequence
ggagaatttaagtcactcct

SEQ ID NO: 176553 - DNA, 20 bp, Artificial
  CRISPR gRNA sequence
aagtcactcctatccctacc

SEQ ID NO: 176554 - DNA, 20 bp, Artificial
  CRISPR gRNA sequence
agtcactcctatccctaccc

SEQ ID NO: 176555 - DNA, 20 bp, Artificial
  CRISPR gRNA sequence
ctatccctaccccccaaagg

SEQ ID NO: 176556 - DNA, 20 bp, Artificial
  CRISPR gRNA sequence
tccctaccccccaaaggacg

SEQ ID NO: 176557 - DNA, 20 bp, Artificial
  CRISPR gRNA sequence
ccccccaaaggacggaggaa

SEQ ID NO: 176558 - DNA, 20 bp, Artificial
  CRISPR gRNA sequence
gaatgtccactccactgaaa

SEQ ID NO: 176559 - DNA, 20 bp, Artificial
  CRISPR gRNA sequence
cactgaaaacccgaacagct

SEQ ID NO: 176560 - DNA, 20 bp, Artificial
  CRISPR gRNA sequence
aaaacccgaacagctgtcct

SEQ ID NO: 176561 - DNA, 20 bp, Artificial
  CRISPR gRNA sequence
tcctcccaccccccaacaaa

SEQ ID NO: 176562 - DNA, 20 bp, Artificial
  CRISPR gRNA sequence
ccaccccccaacaaactatt

SEQ ID NO: 176563 - DNA, 20 bp, Artificial
  CRISPR gRNA sequence
ttcgccatttttctttgtct

SEQ ID NO: 176564 - DNA, 20 bp, Artificial
  CRISPR gRNA sequence
gccatttttctttgtctttc

SEQ ID NO: 176565 - DNA, 20 bp, Artificial
  CRISPR gRNA sequence
ttctttgtctttcagctgac

SEQ ID NO: 176566 - DNA, 20 bp, Artificial
  CRISPR gRNA sequence
tctttgtctttcagctgacc

SEQ ID NO: 176567 - DNA, 20 bp, Artificial
  CRISPR gRNA sequence
ctttgtctttcagctgaccc

SEQ ID NO: 176568 - DNA, 20 bp, Artificial
  CRISPR gRNA sequence
tttgtctttcagctgacccc

SEQ ID NO: 176569 - DNA, 20 bp, Artificial
  CRISPR gRNA sequence
tgtctttcagctgacccctg

SEQ ID NO: 176570 - DNA, 20 bp, Artificial
  CRISPR gRNA sequence
gtctttcagctgacccctgc

SEQ ID NO: 176571 - DNA, 20 bp, Artificial
  CRISPR gRNA sequence
tctttcagctgacccctgcc

SEQ ID NO: 176572 - DNA, 20 bp, Artificial
  CRISPR gRNA sequence
tcagctgacccctgcctcag

SEQ ID NO: 176573 - DNA, 20 bp, Artificial
  CRISPR gRNA sequence
cagctgacccctgcctcagt

SEQ ID NO: 176574 - DNA, 20 bp, Artificial
  CRISPR gRNA sequence
agctgacccctgcctcagtg

SEQ ID NO: 176575 - DNA, 20 bp, Artificial
  CRISPR gRNA sequence
acccctgcctcagtgaaaaa

SEQ ID NO: 176576 - DNA, 20 bp, Artificial
  CRISPR gRNA sequence
cctcagtgaaaaactccgag

SEQ ID NO: 176577 - DNA, 20 bp, Artificial
  CRISPR gRNA sequence
agtgaaaaactccgaggctc

SEQ ID NO: 176578 - DNA, 20 bp, Artificial
  CRISPR gRNA sequence
cgaggctccaatgaagccct

SEQ ID NO: 176579 - DNA, 20 bp, Artificial
  CRISPR gRNA sequence
caatgaagccctgcagcctc

SEQ ID NO: 176580 - DNA, 20 bp, Artificial
  CRISPR gRNA sequence
cagcctccttccactttaac

SEQ ID NO: 176581 - DNA, 20 bp, Artificial
  CRISPR gRNA sequence
cttccactttaacagtcaaa

SEQ ID NO: 176582 - DNA, 20 bp, Artificial
  CRISPR gRNA sequence
ccactttaacagtcaaaggc

SEQ ID NO: 176583 - DNA, 20 bp, Artificial
  CRISPR gRNA sequence
cactttaacagtcaaaggca

SEQ ID NO: 176584 - DNA, 20 bp, Artificial
  CRISPR gRNA sequence
taacagtcaaaggcattcaa

SEQ ID NO: 176585 - DNA, 20 bp, Artificial
  CRISPR gRNA sequence
aacagtcaaaggcattcaat

SEQ ID NO: 176586 - DNA, 20 bp, Artificial
  CRISPR gRNA sequence
acagtcaaaggcattcaatc

SEQ ID NO: 176587 - DNA, 20 bp, Artificial
  CRISPR gRNA sequence
aatctagcatgctatttgac

SEQ ID NO: 176588 - DNA, 20 bp, Artificial
  CRISPR gRNA sequence
gcatgctatttgacaccaaa

SEQ ID NO: 176589 - DNA, 20 bp, Artificial
  CRISPR gRNA sequence
tttgacaccaaaccttgcct

SEQ ID NO: 176590 - DNA, 20 bp, Artificial
  CRISPR gRNA sequence
gacaccaaaccttgcctcca

SEQ ID NO: 176591 - DNA, 20 bp, Artificial
  CRISPR gRNA sequence
acaccaaaccttgcctccac

SEQ ID NO: 176592 - DNA, 20 bp, Artificial
  CRISPR gRNA sequence
gcctccacagtggtcccatt

SEQ ID NO: 176593 - DNA, 20 bp, Artificial
  CRISPR gRNA sequence
cctccacagtggtcccattg

SEQ ID NO: 176594 - DNA, 20 bp, Artificial
  CRISPR gRNA sequence
cacagtggtcccattggctg

SEQ ID NO: 176595 - DNA, 20 bp, Artificial
  CRISPR gRNA sequence
gctgaactgctttatcggct

SEQ ID NO: 176596 - DNA, 20 bp, Artificial
  CRISPR gRNA sequence
aactgctttatcggctaaga

SEQ ID NO: 176597 - DNA, 20 bp, Artificial
  CRISPR gRNA sequence
ctttatcggctaagaacaca

SEQ ID NO: 176598 - DNA, 20 bp, Artificial
  CRISPR gRNA sequence
tatcggctaagaacacaaag

SEQ ID NO: 176599 - DNA, 20 bp, Artificial
  CRISPR gRNA sequence
atcggctaagaacacaaagc

SEQ ID NO: 176600 - DNA, 20 bp, Artificial
  CRISPR gRNA sequence
tcggctaagaacacaaagcc

SEQ ID NO: 176601 - DNA, 20 bp, Artificial
  CRISPR gRNA sequence
agaacacaaagccacgattg

SEQ ID NO: 176602 - DNA, 20 bp, Artificial
  CRISPR gRNA sequence
ctactcaaacccctctccct

SEQ ID NO: 176603 - DNA, 20 bp, Artificial
  CRISPR gRNA sequence
ctctccctcagatctgcccc

SEQ ID NO: 176604 - DNA, 20 bp, Artificial
  CRISPR gRNA sequence
cctcagatctgcccccagtc

SEQ ID NO: 176605 - DNA, 20 bp, Artificial
  CRISPR gRNA sequence
tctacctgcactgttcaata

SEQ ID NO: 176606 - DNA, 20 bp, Artificial
  CRISPR gRNA sequence
cacatgtgactatttacata

SEQ ID NO: 176607 - DNA, 20 bp, Artificial
  CRISPR gRNA sequence
agtttattaaatgcaattaa

SEQ ID NO: 176608 - DNA, 20 bp, Artificial
  CRISPR gRNA sequence
agttcaattccttattgcac

SEQ ID NO: 176609 - DNA, 20 bp, Artificial
  CRISPR gRNA sequence
tattgcactggccacatttc

SEQ ID NO: 176610 - DNA, 20 bp, Artificial
  CRISPR gRNA sequence
ctggccacatttcaagtgct

SEQ ID NO: 176611 - DNA, 20 bp, Artificial
  CRISPR gRNA sequence
ccacatttcaagtgcttagc

SEQ ID NO: 176612 - DNA, 20 bp, Artificial
  CRISPR gRNA sequence
aagtgcttagctggcacatg

SEQ ID NO: 176613 - DNA, 20 bp, Artificial
  CRISPR gRNA sequence
gcttagctggcacatgtggc

SEQ ID NO: 176614 - DNA, 20 bp, Artificial
  CRISPR gRNA sequence
ctggcacatgtggctagtgc

SEQ ID NO: 176615 - DNA, 20 bp, Artificial
  CRISPR gRNA sequence
ccagtgcctactgtattgaa

SEQ ID NO: 176616 - DNA, 20 bp, Artificial
  CRISPR gRNA sequence
gcctactgtattgaacggta

SEQ ID NO: 176617 - DNA, 20 bp, Artificial
  CRISPR gRNA sequence
actgtattgaacggtacaga

SEQ ID NO: 176618 - DNA, 20 bp, Artificial
  CRISPR gRNA sequence
tgtattgaacggtacagaca

SEQ ID NO: 176619 - DNA, 20 bp, Artificial
  CRISPR gRNA sequence
gacagagcatttcatcactc

SEQ ID NO: 176620 - DNA, 20 bp, Artificial
  CRISPR gRNA sequence
catttcatcactctagaaac

SEQ ID NO: 176621 - DNA, 20 bp, Artificial
  CRISPR gRNA sequence
tcatcactctagaaactgga

SEQ ID NO: 176622 - DNA, 20 bp, Artificial
  CRISPR gRNA sequence
cactctagaaactggatggc

SEQ ID NO: 176623 - DNA, 20 bp, Artificial
  CRISPR gRNA sequence
actggatggcaagtgctacc

SEQ ID NO: 176624 - DNA, 20 bp, Artificial
  CRISPR gRNA sequence
atggcaagtgctacccagca

SEQ ID NO: 176625 - DNA, 20 bp, Artificial
  CRISPR gRNA sequence
gcaagtgctacccagcacag

SEQ ID NO: 176626 - DNA, 20 bp, Artificial
  CRISPR gRNA sequence
ctacccagcacagcagccgt

SEQ ID NO: 176627 - DNA, 20 bp, Artificial
  CRISPR gRNA sequence
tacccagcacagcagccgtg

SEQ ID NO: 176628 - DNA, 20 bp, Artificial
  CRISPR gRNA sequence
gcagccgtgaggacctttct

SEQ ID NO: 176629 - DNA, 20 bp, Artificial
  CRISPR gRNA sequence
cagccgtgaggacctttctt

SEQ ID NO: 176630 - DNA, 20 bp, Artificial
  CRISPR gRNA sequence
tgtcatatcaactgactttt

SEQ ID NO: 176631 - DNA, 20 bp, Artificial
  CRISPR gRNA sequence
tcatatcaactgactttttg

SEQ ID NO: 176632 - DNA, 20 bp, Artificial
  CRISPR gRNA sequence
tatcaactgactttttggag

SEQ ID NO: 176633 - DNA, 20 bp, Artificial
  CRISPR gRNA sequence
ttggagcagcatctgtgtgt

SEQ ID NO: 176634 - DNA, 20 bp, Artificial
  CRISPR gRNA sequence
gagcagcatctgtgtgttag

SEQ ID NO: 176635 - DNA, 20 bp, Artificial
  CRISPR gRNA sequence
agcagcatctgtgtgttagc

SEQ ID NO: 176636 - DNA, 20 bp, Artificial
  CRISPR gRNA sequence
ttagcaggacacatcaccta

SEQ ID NO: 176637 - DNA, 20 bp, Artificial
  CRISPR gRNA sequence
cctcaaaacttaacactcct

SEQ ID NO: 176638 - DNA, 20 bp, Artificial
  CRISPR gRNA sequence
ctcaaaacttaacactcctt

SEQ ID NO: 176639 - DNA, 20 bp, Artificial
  CRISPR gRNA sequence
acttaacactccttgggccc

SEQ ID NO: 176640 - DNA, 20 bp, Artificial
  CRISPR gRNA sequence
cttaacactccttgggcccc

SEQ ID NO: 176641 - DNA, 20 bp, Artificial
  CRISPR gRNA sequence
taacactccttgggccccag

SEQ ID NO: 176642 - DNA, 20 bp, Artificial
  CRISPR gRNA sequence
ctccttgggccccaggagcc

SEQ ID NO: 176643 - DNA, 20 bp, Artificial
  CRISPR gRNA sequence
aggagcccagaatcaactga

SEQ ID NO: 176644 - DNA, 20 bp, Artificial
  CRISPR gRNA sequence
ccagaatcaactgacagccc

SEQ ID NO: 176645 - DNA, 20 bp, Artificial
  CRISPR gRNA sequence
tcaactgacagccctggtga

SEQ ID NO: 176646 - DNA, 20 bp, Artificial
  CRISPR gRNA sequence
tgacagccctggtgatagtc

SEQ ID NO: 176647 - DNA, 20 bp, Artificial
  CRISPR gRNA sequence
gacagccctggtgatagtca

SEQ ID NO: 176648 - DNA, 20 bp, Artificial
  CRISPR gRNA sequence
gccctggtgatagtcaagga

SEQ ID NO: 176649 - DNA, 20 bp, Artificial
  CRISPR gRNA sequence
ccctggtgatagtcaaggac

SEQ ID NO: 176650 - DNA, 20 bp, Artificial
  CRISPR gRNA sequence
acaggtgactatgtttatat

SEQ ID NO: 176651 - DNA, 20 bp, Artificial
  CRISPR gRNA sequence
atataagcatgttcctatga

SEQ ID NO: 176652 - DNA, 20 bp, Artificial
  CRISPR gRNA sequence
tataagcatgttcctatgac

SEQ ID NO: 176653 - DNA, 20 bp, Artificial
  CRISPR gRNA sequence
gtctatgtgaacataaacaa

SEQ ID NO: 176654 - DNA, 20 bp, Artificial
  CRISPR gRNA sequence
tctatgtgaacataaacaaa

SEQ ID NO: 176655 - DNA, 20 bp, Artificial
  CRISPR gRNA sequence
aaaaggattttttttttttt

SEQ ID NO: 176656 - DNA, 20 bp, Artificial
  CRISPR gRNA sequence
atttttttttttttgagaca

SEQ ID NO: 176657 - DNA, 20 bp, Artificial
  CRISPR gRNA sequence
aaagtctcactcttgtcacc

SEQ ID NO: 176658 - DNA, 20 bp, Artificial
  CRISPR gRNA sequence
aagtctcactcttgtcaccc

SEQ ID NO: 176659 - DNA, 20 bp, Artificial
  CRISPR gRNA sequence
ctcactcttgtcacccaggc

SEQ ID NO: 176660 - DNA, 20 bp, Artificial
  CRISPR gRNA sequence
cactcttgtcacccaggctg

SEQ ID NO: 176661 - DNA, 20 bp, Artificial
  CRISPR gRNA sequence
ttgtcacccaggctggagtg

SEQ ID NO: 176662 - DNA, 20 bp, Artificial
  CRISPR gRNA sequence
tcacccaggctggagtgcag

SEQ ID NO: 176663 - DNA, 20 bp, Artificial
  CRISPR gRNA sequence
caggctggagtgcagtggca

SEQ ID NO: 176664 - DNA, 20 bp, Artificial
  CRISPR gRNA sequence
ggagtgcagtggcacagtct

SEQ ID NO: 176665 - DNA, 20 bp, Artificial
  CRISPR gRNA sequence
tcactgcaacctccatctcc

SEQ ID NO: 176666 - DNA, 20 bp, Artificial
  CRISPR gRNA sequence
cactgcaacctccatctccc

SEQ ID NO: 176667 - DNA, 20 bp, Artificial
  CRISPR gRNA sequence
aacctccatctcccgggttc

SEQ ID NO: 176668 - DNA, 20 bp, Artificial
  CRISPR gRNA sequence
ttcaagtgattcttgtgctt

SEQ ID NO: 176669 - DNA, 20 bp, Artificial
  CRISPR gRNA sequence
ttcttgtgcttcagcctcca

SEQ ID NO: 176670 - DNA, 20 bp, Artificial
  CRISPR gRNA sequence
ttgtgcttcagcctccacag

SEQ ID NO: 176671 - DNA, 20 bp, Artificial
  CRISPR gRNA sequence
gcttcagcctccacagtagc

SEQ ID NO: 176672 - DNA, 20 bp, Artificial
  CRISPR gRNA sequence
cttcagcctccacagtagct

SEQ ID NO: 176673 - DNA, 20 bp, Artificial
  CRISPR gRNA sequence
ctccacagtagctgggatta

SEQ ID NO: 176674 - DNA, 20 bp, Artificial
  CRISPR gRNA sequence
tccacagtagctgggattac

SEQ ID NO: 176675 - DNA, 20 bp, Artificial
  CRISPR gRNA sequence
ggattacaggcgcccgccac

SEQ ID NO: 176676 - DNA, 20 bp, Artificial
  CRISPR gRNA sequence
gattacaggcgcccgccacc

SEQ ID NO: 176677 - DNA, 20 bp, Artificial
  CRISPR gRNA sequence
caggcgcccgccaccaggcc

SEQ ID NO: 176678 - DNA, 20 bp, Artificial
  CRISPR gRNA sequence
taattttttttttttttttt

SEQ ID NO: 176679 - DNA, 20 bp, Artificial
  CRISPR gRNA sequence
ttttttttttttttttgaga

SEQ ID NO: 176680 - DNA, 20 bp, Artificial
  CRISPR gRNA sequence
ttttttttttttttgagacg

SEQ ID NO: 176681 - DNA, 20 bp, Artificial
  CRISPR gRNA sequence
cggagtctcgctctgtcgcc

SEQ ID NO: 176682 - DNA, 20 bp, Artificial
  CRISPR gRNA sequence
ggagtctcgctctgtcgccc

SEQ ID NO: 176683 - DNA, 20 bp, Artificial
  CRISPR gRNA sequence
tcgctctgtcgcccaggctg

SEQ ID NO: 176684 - DNA, 20 bp, Artificial
  CRISPR gRNA sequence
ctgtcgcccaggctgtagtg

SEQ ID NO: 176685 - DNA, 20 bp, Artificial
  CRISPR gRNA sequence
tcgcccaggctgtagtgcag

SEQ ID NO: 176686 - DNA, 20 bp, Artificial
  CRISPR gRNA sequence
gtagtgcagtggtgcaatct

SEQ ID NO: 176687 - DNA, 20 bp, Artificial
  CRISPR gRNA sequence
gtgcaatctcggctcactgc

SEQ ID NO: 176688 - DNA, 20 bp, Artificial
  CRISPR gRNA sequence
ctcactgcaagctctgcctc

SEQ ID NO: 176689 - DNA, 20 bp, Artificial
  CRISPR gRNA sequence
tcactgcaagctctgcctcc

SEQ ID NO: 176690 - DNA, 20 bp, Artificial
  CRISPR gRNA sequence
cactgcaagctctgcctccg

SEQ ID NO: 176691 - DNA, 20 bp, Artificial
  CRISPR gRNA sequence
ttcatgccattctcctgcct

SEQ ID NO: 176692 - DNA, 20 bp, Artificial
  CRISPR gRNA sequence
ttctcctgcctcagcctccc

SEQ ID NO: 176693 - DNA, 20 bp, Artificial
  CRISPR gRNA sequence
tcctgcctcagcctcccgag

SEQ ID NO: 176694 - DNA, 20 bp, Artificial
  CRISPR gRNA sequence
gcctcagcctcccgagtagc

SEQ ID NO: 176695 - DNA, 20 bp, Artificial
  CRISPR gRNA sequence
cctcagcctcccgagtagct

SEQ ID NO: 176696 - DNA, 20 bp, Artificial
  CRISPR gRNA sequence
ctcccgagtagctgggacta

SEQ ID NO: 176697 - DNA, 20 bp, Artificial
  CRISPR gRNA sequence
tcccgagtagctgggactac

SEQ ID NO: 176698 - DNA, 20 bp, Artificial
  CRISPR gRNA sequence
ggactacaggcacccgccac

SEQ ID NO: 176699 - DNA, 20 bp, Artificial
  CRISPR gRNA sequence
gactacaggcacccgccact

SEQ ID NO: 176700 - DNA, 20 bp, Artificial
  CRISPR gRNA sequence
caggcacccgccactaggcc

SEQ ID NO: 176701 - DNA, 20 bp, Artificial
  CRISPR gRNA sequence
cggctaattttttatatttt

SEQ ID NO: 176702 - DNA, 20 bp, Artificial
  CRISPR gRNA sequence
ctaattttttatatttttag

SEQ ID NO: 176703 - DNA, 20 bp, Artificial
  CRISPR gRNA sequence
aattttttatatttttagta

SEQ ID NO: 176704 - DNA, 20 bp, Artificial
  CRISPR gRNA sequence
ttttatatttttagtagaga

SEQ ID NO: 176705 - DNA, 20 bp, Artificial
  CRISPR gRNA sequence
tttatatttttagtagagac

SEQ ID NO: 176706 - DNA, 20 bp, Artificial
  CRISPR gRNA sequence
ttatatttttagtagagacg

SEQ ID NO: 176707 - DNA, 20 bp, Artificial
  CRISPR gRNA sequence
gagacggggtttcaccgtgt

SEQ ID NO: 176708 - DNA, 20 bp, Artificial
  CRISPR gRNA sequence
cggggtttcaccgtgttagc

SEQ ID NO: 176709 - DNA, 20 bp, Artificial
  CRISPR gRNA sequence
ggggtttcaccgtgttagcc

SEQ ID NO: 176710 - DNA, 20 bp, Artificial
  CRISPR gRNA sequence
tttcaccgtgttagccagga

SEQ ID NO: 176711 - DNA, 20 bp, Artificial
  CRISPR gRNA sequence
ccgcccgcctctgcctccca

SEQ ID NO: 176712 - DNA, 20 bp, Artificial
  CRISPR gRNA sequence
gcctctgcctcccaaagtgc

SEQ ID NO: 176713 - DNA, 20 bp, Artificial
  CRISPR gRNA sequence
cctctgcctcccaaagtgct

SEQ ID NO: 176714 - DNA, 20 bp, Artificial
  CRISPR gRNA sequence
ctcccaaagtgctgggatta

SEQ ID NO: 176715 - DNA, 20 bp, Artificial
  CRISPR gRNA sequence
tcccaaagtgctgggattac

SEQ ID NO: 176716 - DNA, 20 bp, Artificial
  CRISPR gRNA sequence
agtgctgggattacaggcgt

SEQ ID NO: 176717 - DNA, 20 bp, Artificial
  CRISPR gRNA sequence
caggcgtgagccaccgtgcc

SEQ ID NO: 176718 - DNA, 20 bp, Artificial
  CRISPR gRNA sequence
cggcctaatttttgtatttt

SEQ ID NO: 176719 - DNA, 20 bp, Artificial
  CRISPR gRNA sequence
cctaatttttgtatttttag

SEQ ID NO: 176720 - DNA, 20 bp, Artificial
  CRISPR gRNA sequence
taatttttgtatttttagta

SEQ ID NO: 176721 - DNA, 20 bp, Artificial
  CRISPR gRNA sequence
tttgtatttttagtagagat

SEQ ID NO: 176722 - DNA, 20 bp, Artificial
  CRISPR gRNA sequence
ttgtatttttagtagagatg

SEQ ID NO: 176723 - DNA, 20 bp, Artificial
  CRISPR gRNA sequence
gagatgaggtttcaccatgt

SEQ ID NO: 176724 - DNA, 20 bp, Artificial
  CRISPR gRNA sequence
tgaggtttcaccatgttggc

SEQ ID NO: 176725 - DNA, 20 bp, Artificial
  CRISPR gRNA sequence
gaggtttcaccatgttggcc

SEQ ID NO: 176726 - DNA, 20 bp, Artificial
  CRISPR gRNA sequence
tttcaccatgttggccaggc

SEQ ID NO: 176727 - DNA, 20 bp, Artificial
  CRISPR gRNA sequence
tggtctcaaactcctgacct

SEQ ID NO: 176728 - DNA, 20 bp, Artificial
  CRISPR gRNA sequence
ggtctcaaactcctgacctc

SEQ ID NO: 176729 - DNA, 20 bp, Artificial
  CRISPR gRNA sequence
ctcaggtgatctgcccacct

SEQ ID NO: 176730 - DNA, 20 bp, Artificial
  CRISPR gRNA sequence
ctgcccaccttggcctccca

SEQ ID NO: 176731 - DNA, 20 bp, Artificial
  CRISPR gRNA sequence
accttggcctcccaaagtgc

SEQ ID NO: 176732 - DNA, 20 bp, Artificial
  CRISPR gRNA sequence
ccttggcctcccaaagtgcc

SEQ ID NO: 176733 - DNA, 20 bp, Artificial
  CRISPR gRNA sequence
ctcccaaagtgccaggatta

SEQ ID NO: 176734 - DNA, 20 bp, Artificial
  CRISPR gRNA sequence
tcccaaagtgccaggattac

SEQ ID NO: 176735 - DNA, 20 bp, Artificial
  CRISPR gRNA sequence
agtgccaggattacaggcat

SEQ ID NO: 176736 - DNA, 20 bp, Artificial
  CRISPR gRNA sequence
caggcataagccaccatgcc

SEQ ID NO: 176737 - DNA, 20 bp, Artificial
  CRISPR gRNA sequence
caccatgcccggccaaatga

SEQ ID NO: 176738 - DNA, 20 bp, Artificial
  CRISPR gRNA sequence
accatgcccggccaaatgaa

SEQ ID NO: 176739 - DNA, 20 bp, Artificial
  CRISPR gRNA sequence
tttttttttttttttttttt

SEQ ID NO: 176740 - DNA, 20 bp, Artificial
  CRISPR gRNA sequence
ttttttttttttttggtgcc

SEQ ID NO: 176741 - DNA, 20 bp, Artificial
  CRISPR gRNA sequence
tttttttttttttggtgccc

SEQ ID NO: 176742 - DNA, 20 bp, Artificial
  CRISPR gRNA sequence
tttttttttggtgcccgggc

SEQ ID NO: 176743 - DNA, 20 bp, Artificial
  CRISPR gRNA sequence
tttttttggtgcccgggctg

SEQ ID NO: 176744 - DNA, 20 bp, Artificial
  CRISPR gRNA sequence
gtgcccgggctggagtgcaa

SEQ ID NO: 176745 - DNA, 20 bp, Artificial
  CRISPR gRNA sequence
ggagtgcaatggcatgttct

SEQ ID NO: 176746 - DNA, 20 bp, Artificial
  CRISPR gRNA sequence
tcactgcaacctccacctcc

SEQ ID NO: 176747 - DNA, 20 bp, Artificial
  CRISPR gRNA sequence
cactgcaacctccacctccc

SEQ ID NO: 176748 - DNA, 20 bp, Artificial
  CRISPR gRNA sequence
aacctccacctcccaggttc

SEQ ID NO: 176749 - DNA, 20 bp, Artificial
  CRISPR gRNA sequence
ttcaagcgattctcttgcct

SEQ ID NO: 176750 - DNA, 20 bp, Artificial
  CRISPR gRNA sequence
ttctcttgcctcagcctcct

SEQ ID NO: 176751 - DNA, 20 bp, Artificial
  CRISPR gRNA sequence
tcttgcctcagcctcctgag

SEQ ID NO: 176752 - DNA, 20 bp, Artificial
  CRISPR gRNA sequence
gcctcagcctcctgagtagc

SEQ ID NO: 176753 - DNA, 20 bp, Artificial
  CRISPR gRNA sequence
cctcagcctcctgagtagct

SEQ ID NO: 176754 - DNA, 20 bp, Artificial
  CRISPR gRNA sequence
tcctgagtagctgggattac

SEQ ID NO: 176755 - DNA, 20 bp, Artificial
  CRISPR gRNA sequence
caagcacccgcaaccacgcc

SEQ ID NO: 176756 - DNA, 20 bp, Artificial
  CRISPR gRNA sequence
ccagctaatttttgcatttt

SEQ ID NO: 176757 - DNA, 20 bp, Artificial
  CRISPR gRNA sequence
gctaatttttgcatttttag

SEQ ID NO: 176758 - DNA, 20 bp, Artificial
  CRISPR gRNA sequence
ttttgcatttttagtagaaa

SEQ ID NO: 176759 - DNA, 20 bp, Artificial
  CRISPR gRNA sequence
ttgcatttttagtagaaatg

SEQ ID NO: 176760 - DNA, 20 bp, Artificial
  CRISPR gRNA sequence
tagtagaaatggagtttcac

SEQ ID NO: 176761 - DNA, 20 bp, Artificial
  CRISPR gRNA sequence
agtagaaatggagtttcacc

SEQ ID NO: 176762 - DNA, 20 bp, Artificial
  CRISPR gRNA sequence
gaaatggagtttcaccaggc

SEQ ID NO: 176763 - DNA, 20 bp, Artificial
  CRISPR gRNA sequence
tggtctcgaactcctgacct

SEQ ID NO: 176764 - DNA, 20 bp, Artificial
  CRISPR gRNA sequence
ggtctcgaactcctgacctc

SEQ ID NO: 176765 - DNA, 20 bp, Artificial
  CRISPR gRNA sequence
ctcaggtgatccacccatct

SEQ ID NO: 176766 - DNA, 20 bp, Artificial
  CRISPR gRNA sequence
ccacccatctcggcctccca

SEQ ID NO: 176767 - DNA, 20 bp, Artificial
  CRISPR gRNA sequence
atctcggcctcccaaagtgc

SEQ ID NO: 176768 - DNA, 20 bp, Artificial
  CRISPR gRNA sequence
tctcggcctcccaaagtgct

SEQ ID NO: 176769 - DNA, 20 bp, Artificial
  CRISPR gRNA sequence
ctcccaaagtgctgggatta

SEQ ID NO: 176770 - DNA, 20 bp, Artificial
  CRISPR gRNA sequence
tcccaaagtgctgggattac

SEQ ID NO: 176771 - DNA, 20 bp, Artificial
  CRISPR gRNA sequence
agtgctgggattacaggtgt

SEQ ID NO: 176772 - DNA, 20 bp, Artificial
  CRISPR gRNA sequence
caggtgtgagccaccgcgcc

SEQ ID NO: 176773 - DNA, 20 bp, Artificial
  CRISPR gRNA sequence
gagccaccgcgcctggccga

SEQ ID NO: 176774 - DNA, 20 bp, Artificial
  CRISPR gRNA sequence
agccaccgcgcctggccgaa

SEQ ID NO: 176775 - DNA, 20 bp, Artificial
  CRISPR gRNA sequence
tggccgaaaggattttataa

SEQ ID NO: 176776 - DNA, 20 bp, Artificial
  CRISPR gRNA sequence
gcatgtccctgttcacccca

SEQ ID NO: 176777 - DNA, 20 bp, Artificial
  CRISPR gRNA sequence
tccctgttcaccccaaagtc

SEQ ID NO: 176778 - DNA, 20 bp, Artificial
  CRISPR gRNA sequence
gttcaccccaaagtcaagtt

SEQ ID NO: 176779 - DNA, 20 bp, Artificial
  CRISPR gRNA sequence
ttcaccccaaagtcaagttc

SEQ ID NO: 176780 - DNA, 20 bp, Artificial
  CRISPR gRNA sequence
accccaaagtcaagttcagg

SEQ ID NO: 176781 - DNA, 20 bp, Artificial
  CRISPR gRNA sequence
ccccaaagtcaagttcaggc

SEQ ID NO: 176782 - DNA, 20 bp, Artificial
  CRISPR gRNA sequence
tcaggcgggatgccaataat

SEQ ID NO: 176783 - DNA, 20 bp, Artificial
  CRISPR gRNA sequence
gatgccaataataagtccat

SEQ ID NO: 176784 - DNA, 20 bp, Artificial
  CRISPR gRNA sequence
tccatcagtgtttccataaa

SEQ ID NO: 176785 - DNA, 20 bp, Artificial
  CRISPR gRNA sequence
taaaaagtaaaatcatctac

SEQ ID NO: 176786 - DNA, 20 bp, Artificial
  CRISPR gRNA sequence
aagttaaatttctctctaaa

SEQ ID NO: 176787 - DNA, 20 bp, Artificial
  CRISPR gRNA sequence
agttaaatttctctctaaaa

SEQ ID NO: 176788 - DNA, 20 bp, Artificial
  CRISPR gRNA sequence
aacaatttactttttataaa

SEQ ID NO: 176789 - DNA, 20 bp, Artificial
  CRISPR gRNA sequence
tgtgttcacacatgacttaa

SEQ ID NO: 176790 - DNA, 20 bp, Artificial
  CRISPR gRNA sequence
ttcacacatgacttaatggt

SEQ ID NO: 176791 - DNA, 20 bp, Artificial
  CRISPR gRNA sequence
tagatgacatttccaatttt

SEQ ID NO: 176792 - DNA, 20 bp, Artificial
  CRISPR gRNA sequence
ttccaattttaagtcatacc

SEQ ID NO: 176793 - DNA, 20 bp, Artificial
  CRISPR gRNA sequence
tccaattttaagtcatacca

SEQ ID NO: 176794 - DNA, 20 bp, Artificial
  CRISPR gRNA sequence
ggcgctcacacttccctccc

SEQ ID NO: 176795 - DNA, 20 bp, Artificial
  CRISPR gRNA sequence
gcgctcacacttccctccct

SEQ ID NO: 176796 - DNA, 20 bp, Artificial
  CRISPR gRNA sequence
cttccctccctgggcctgtt

SEQ ID NO: 176797 - DNA, 20 bp, Artificial
  CRISPR gRNA sequence
ttccctccctgggcctgttg

SEQ ID NO: 176798 - DNA, 20 bp, Artificial
  CRISPR gRNA sequence
tccctccctgggcctgttga

SEQ ID NO: 176799 - DNA, 20 bp, Artificial
  CRISPR gRNA sequence
ctgggcctgttgagggctgc

SEQ ID NO: 176800 - DNA, 20 bp, Artificial
  CRISPR gRNA sequence
tgggcctgttgagggctgct

SEQ ID NO: 176801 - DNA, 20 bp, Artificial
  CRISPR gRNA sequence
gggcctgttgagggctgctg

SEQ ID NO: 176802 - DNA, 20 bp, Artificial
  CRISPR gRNA sequence
gttgagggctgctggggctt

SEQ ID NO: 176803 - DNA, 20 bp, Artificial
  CRISPR gRNA sequence
ttgagggctgctggggcttg

SEQ ID NO: 176804 - DNA, 20 bp, Artificial
  CRISPR gRNA sequence
tgagggctgctggggcttga

SEQ ID NO: 176805 - DNA, 20 bp, Artificial
  CRISPR gRNA sequence
gagggctgctggggcttgag

SEQ ID NO: 176806 - DNA, 20 bp, Artificial
  CRISPR gRNA sequence
agggctgctggggcttgagg

SEQ ID NO: 176807 - DNA, 20 bp, Artificial
  CRISPR gRNA sequence
gctgctggggcttgaggggg

SEQ ID NO: 176808 - DNA, 20 bp, Artificial
  CRISPR gRNA sequence
gctggggcttgagggggtgg

SEQ ID NO: 176809 - DNA, 20 bp, Artificial
  CRISPR gRNA sequence
ctggggcttgagggggtggt

SEQ ID NO: 176810 - DNA, 20 bp, Artificial
  CRISPR gRNA sequence
ttgagggggtggtgggcgcc

SEQ ID NO: 176811 - DNA, 20 bp, Artificial
  CRISPR gRNA sequence
gggggtggtgggcgccgagc

SEQ ID NO: 176812 - DNA, 20 bp, Artificial
  CRISPR gRNA sequence
ggggtggtgggcgccgagca

SEQ ID NO: 176813 - DNA, 20 bp, Artificial
  CRISPR gRNA sequence
gcactgtataaataaatgca

SEQ ID NO: 176814 - DNA, 20 bp, Artificial
  CRISPR gRNA sequence
cactgtataaataaatgcaa

SEQ ID NO: 176815 - DNA, 20 bp, Artificial
  CRISPR gRNA sequence
tataaataaatgcaaaggcc

SEQ ID NO: 176816 - DNA, 20 bp, Artificial
  CRISPR gRNA sequence
taaataaatgcaaaggccaa

SEQ ID NO: 176817 - DNA, 20 bp, Artificial
  CRISPR gRNA sequence
aaatgcaaaggccaagagct

SEQ ID NO: 176818 - DNA, 20 bp, Artificial
  CRISPR gRNA sequence
aatgcaaaggccaagagctc

SEQ ID NO: 176819 - DNA, 20 bp, Artificial
  CRISPR gRNA sequence
atgcaaaggccaagagctcg

SEQ ID NO: 176820 - DNA, 20 bp, Artificial
  CRISPR gRNA sequence
tgcaaaggccaagagctcgg

SEQ ID NO: 176821 - DNA, 20 bp, Artificial
  CRISPR gRNA sequence
caagagctcgggggaaatgt

SEQ ID NO: 176822 - DNA, 20 bp, Artificial
  CRISPR gRNA sequence
tgttagtgtacacctctgat

SEQ ID NO: 176823 - DNA, 20 bp, Artificial
  CRISPR gRNA sequence
tacacctctgatcagaaatg

SEQ ID NO: 176824 - DNA, 20 bp, Artificial
  CRISPR gRNA sequence
cctctgatcagaaatgtggc

SEQ ID NO: 176825 - DNA, 20 bp, Artificial
  CRISPR gRNA sequence
gtggcaagatccacacgaaa

SEQ ID NO: 176826 - DNA, 20 bp, Artificial
  CRISPR gRNA sequence
gatccacacgaaaaagtgcc

SEQ ID NO: 176827 - DNA, 20 bp, Artificial
  CRISPR gRNA sequence
aagtgccaagtttttttccc

SEQ ID NO: 176828 - DNA, 20 bp, Artificial
  CRISPR gRNA sequence
agtttttttcccaagcccct

SEQ ID NO: 176829 - DNA, 20 bp, Artificial
  CRISPR gRNA sequence
tttcccaagcccctcagcca

SEQ ID NO: 176830 - DNA, 20 bp, Artificial
  CRISPR gRNA sequence
cccaagcccctcagccaaag

SEQ ID NO: 176831 - DNA, 20 bp, Artificial
  CRISPR gRNA sequence
ccaagcccctcagccaaagc

SEQ ID NO: 176832 - DNA, 20 bp, Artificial
  CRISPR gRNA sequence
caagcccctcagccaaagca

SEQ ID NO: 176833 - DNA, 20 bp, Artificial
  CRISPR gRNA sequence
agcccctcagccaaagcagg

SEQ ID NO: 176834 - DNA, 20 bp, Artificial
  CRISPR gRNA sequence
ccctcagccaaagcagggag

SEQ ID NO: 176835 - DNA, 20 bp, Artificial
  CRISPR gRNA sequence
cctcagccaaagcagggagc

SEQ ID NO: 176836 - DNA, 20 bp, Artificial
  CRISPR gRNA sequence
ctcagccaaagcagggagca

SEQ ID NO: 176837 - DNA, 20 bp, Artificial
  CRISPR gRNA sequence
agccaaagcagggagcaggg

SEQ ID NO: 176838 - DNA, 20 bp, Artificial
  CRISPR gRNA sequence
ccaaagcagggagcagggta

SEQ ID NO: 176839 - DNA, 20 bp, Artificial
  CRISPR gRNA sequence
gagcagggtagagctcctct

SEQ ID NO: 176840 - DNA, 20 bp, Artificial
  CRISPR gRNA sequence
agcagggtagagctcctctg

SEQ ID NO: 176841 - DNA, 20 bp, Artificial
  CRISPR gRNA sequence
ggtagagctcctctgaggct

SEQ ID NO: 176842 - DNA, 20 bp, Artificial
  CRISPR gRNA sequence
gtagagctcctctgaggctg

SEQ ID NO: 176843 - DNA, 20 bp, Artificial
  CRISPR gRNA sequence
tagagctcctctgaggctga

SEQ ID NO: 176844 - DNA, 20 bp, Artificial
  CRISPR gRNA sequence
gagctcctctgaggctgagg

SEQ ID NO: 176845 - DNA, 20 bp, Artificial
  CRISPR gRNA sequence
gctgagggagcatcgccccg

SEQ ID NO: 176846 - DNA, 20 bp, Artificial
  CRISPR gRNA sequence
ctgagggagcatcgccccga

SEQ ID NO: 176847 - DNA, 20 bp, Artificial
  CRISPR gRNA sequence
cactttccttcacatttcac

SEQ ID NO: 176848 - DNA, 20 bp, Artificial
  CRISPR gRNA sequence
ccttcacatttcactggctt

SEQ ID NO: 176849 - DNA, 20 bp, Artificial
  CRISPR gRNA sequence
acatttcactggctttggaa

SEQ ID NO: 176850 - DNA, 20 bp, Artificial
  CRISPR gRNA sequence
actggctttggaacagtccc

SEQ ID NO: 176851 - DNA, 20 bp, Artificial
  CRISPR gRNA sequence
ctggctttggaacagtcccc

SEQ ID NO: 176852 - DNA, 20 bp, Artificial
  CRISPR gRNA sequence
tggctttggaacagtcccca

SEQ ID NO: 176853 - DNA, 20 bp, Artificial
  CRISPR gRNA sequence
ttggaacagtccccagggct

SEQ ID NO: 176854 - DNA, 20 bp, Artificial
  CRISPR gRNA sequence
gtccccagggctcagctgaa

SEQ ID NO: 176855 - DNA, 20 bp, Artificial
  CRISPR gRNA sequence
tccccagggctcagctgaaa

SEQ ID NO: 176856 - DNA, 20 bp, Artificial
  CRISPR gRNA sequence
ccccagggctcagctgaaaa

SEQ ID NO: 176857 - DNA, 20 bp, Artificial
  CRISPR gRNA sequence
cccagggctcagctgaaaag

SEQ ID NO: 176858 - DNA, 20 bp, Artificial
  CRISPR gRNA sequence
ccagggctcagctgaaaagg

SEQ ID NO: 176859 - DNA, 20 bp, Artificial
  CRISPR gRNA sequence
gggctcagctgaaaaggggg

SEQ ID NO: 176860 - DNA, 20 bp, Artificial
  CRISPR gRNA sequence
ctgaaaagggggtagttctt

SEQ ID NO: 176861 - DNA, 20 bp, Artificial
  CRISPR gRNA sequence
tgaaaagggggtagttcttt

SEQ ID NO: 176862 - DNA, 20 bp, Artificial
  CRISPR gRNA sequence
gggggtagttctttgggaac

SEQ ID NO: 176863 - DNA, 20 bp, Artificial
  CRISPR gRNA sequence
ctttgggaacgagattcatt

SEQ ID NO: 176864 - DNA, 20 bp, Artificial
  CRISPR gRNA sequence
catttagtgcaattttctct

SEQ ID NO: 176865 - DNA, 20 bp, Artificial
  CRISPR gRNA sequence
agtgcaattttctcttagtg

SEQ ID NO: 176866 - DNA, 20 bp, Artificial
  CRISPR gRNA sequence
tgcaattttctcttagtgca

SEQ ID NO: 176867 - DNA, 20 bp, Artificial
  CRISPR gRNA sequence
attttctcttagtgcagagc

SEQ ID NO: 176868 - DNA, 20 bp, Artificial
  CRISPR gRNA sequence
tcttagtgcagagccagccc

SEQ ID NO: 176869 - DNA, 20 bp, Artificial
  CRISPR gRNA sequence
cttagtgcagagccagccct

SEQ ID NO: 176870 - DNA, 20 bp, Artificial
  CRISPR gRNA sequence
tgcagagccagccctgggat

SEQ ID NO: 176871 - DNA, 20 bp, Artificial
  CRISPR gRNA sequence
ggattggtgttatgcttttc

SEQ ID NO: 176872 - DNA, 20 bp, Artificial
  CRISPR gRNA sequence
gattggtgttatgcttttct

SEQ ID NO: 176873 - DNA, 20 bp, Artificial
  CRISPR gRNA sequence
attggtgttatgcttttctg

SEQ ID NO: 176874 - DNA, 20 bp, Artificial
  CRISPR gRNA sequence
ttatgcttttctggggtcac

SEQ ID NO: 176875 - DNA, 20 bp, Artificial
  CRISPR gRNA sequence
gggtcactggtctgttcccc

SEQ ID NO: 176876 - DNA, 20 bp, Artificial
  CRISPR gRNA sequence
ggtcactggtctgttcccct

SEQ ID NO: 176877 - DNA, 20 bp, Artificial
  CRISPR gRNA sequence
tcactggtctgttcccctag

SEQ ID NO: 176878 - DNA, 20 bp, Artificial
  CRISPR gRNA sequence
tggtctgttcccctaggagc

SEQ ID NO: 176879 - DNA, 20 bp, Artificial
  CRISPR gRNA sequence
ctgttcccctaggagccagc

SEQ ID NO: 176880 - DNA, 20 bp, Artificial
  CRISPR gRNA sequence
ccctaggagccagccagtga

SEQ ID NO: 176881 - DNA, 20 bp, Artificial
  CRISPR gRNA sequence
aggagccagccagtgacagc

SEQ ID NO: 176882 - DNA, 20 bp, Artificial
  CRISPR gRNA sequence
agtgacagcgagaccctctc

SEQ ID NO: 176883 - DNA, 20 bp, Artificial
  CRISPR gRNA sequence
gtgacagcgagaccctctcc

SEQ ID NO: 176884 - DNA, 20 bp, Artificial
  CRISPR gRNA sequence
acagcgagaccctctccagg

SEQ ID NO: 176885 - DNA, 20 bp, Artificial
  CRISPR gRNA sequence
cgagaccctctccaggcagc

SEQ ID NO: 176886 - DNA, 20 bp, Artificial
  CRISPR gRNA sequence
gagaccctctccaggcagct

SEQ ID NO: 176887 - DNA, 20 bp, Artificial
  CRISPR gRNA sequence
cctctccaggcagctgggct

SEQ ID NO: 176888 - DNA, 20 bp, Artificial
  CRISPR gRNA sequence
tctccaggcagctgggctca

SEQ ID NO: 176889 - DNA, 20 bp, Artificial
  CRISPR gRNA sequence
ctccaggcagctgggctcag

SEQ ID NO: 176890 - DNA, 20 bp, Artificial
  CRISPR gRNA sequence
gcagctgggctcagaggaaa

SEQ ID NO: 176891 - DNA, 20 bp, Artificial
  CRISPR gRNA sequence
ctgggctcagaggaaaaagc

SEQ ID NO: 176892 - DNA, 20 bp, Artificial
  CRISPR gRNA sequence
ccagacactgactcctgtcc

SEQ ID NO: 176893 - DNA, 20 bp, Artificial
  CRISPR gRNA sequence
aagtccctgacctgatacac

SEQ ID NO: 176894 - DNA, 20 bp, Artificial
  CRISPR gRNA sequence
ctgacctgatacactggtct

SEQ ID NO: 176895 - DNA, 20 bp, Artificial
  CRISPR gRNA sequence
gtctcagaacctcatcttcc

SEQ ID NO: 176896 - DNA, 20 bp, Artificial
  CRISPR gRNA sequence
tctcagaacctcatcttccc

SEQ ID NO: 176897 - DNA, 20 bp, Artificial
  CRISPR gRNA sequence
tcagaacctcatcttcccag

SEQ ID NO: 176898 - DNA, 20 bp, Artificial
  CRISPR gRNA sequence
cagaacctcatcttcccagg

SEQ ID NO: 176899 - DNA, 20 bp, Artificial
  CRISPR gRNA sequence
aacctcatcttcccaggagg

SEQ ID NO: 176900 - DNA, 20 bp, Artificial
  CRISPR gRNA sequence
acctcatcttcccaggaggc

SEQ ID NO: 176901 - DNA, 20 bp, Artificial
  CRISPR gRNA sequence
cctcatcttcccaggaggca

SEQ ID NO: 176902 - DNA, 20 bp, Artificial
  CRISPR gRNA sequence
atcttcccaggaggcagggc

SEQ ID NO: 176903 - DNA, 20 bp, Artificial
  CRISPR gRNA sequence
cagggccagctttacaccac

SEQ ID NO: 176904 - DNA, 20 bp, Artificial
  CRISPR gRNA sequence
tttacaccacaagaaaaacc

SEQ ID NO: 176905 - DNA, 20 bp, Artificial
  CRISPR gRNA sequence
cacaagaaaaacccagacac

SEQ ID NO: 176906 - DNA, 20 bp, Artificial
  CRISPR gRNA sequence
aaacccagacactggcctgc

SEQ ID NO: 176907 - DNA, 20 bp, Artificial
  CRISPR gRNA sequence
aacccagacactggcctgcc

SEQ ID NO: 176908 - DNA, 20 bp, Artificial
  CRISPR gRNA sequence
acactggcctgccaggccct

SEQ ID NO: 176909 - DNA, 20 bp, Artificial
  CRISPR gRNA sequence
actggcctgccaggccctga

SEQ ID NO: 176910 - DNA, 20 bp, Artificial
  CRISPR gRNA sequence
ctggcctgccaggccctgag

SEQ ID NO: 176911 - DNA, 20 bp, Artificial
  CRISPR gRNA sequence
ccctgagaggtcaatgaccc

SEQ ID NO: 176912 - DNA, 20 bp, Artificial
  CRISPR gRNA sequence
cctgagaggtcaatgaccca

SEQ ID NO: 176913 - DNA, 20 bp, Artificial
  CRISPR gRNA sequence
tgagaggtcaatgacccaag

SEQ ID NO: 176914 - DNA, 20 bp, Artificial
  CRISPR gRNA sequence
gagaggtcaatgacccaagg

SEQ ID NO: 176915 - DNA, 20 bp, Artificial
  CRISPR gRNA sequence
agaggtcaatgacccaagga

SEQ ID NO: 176916 - DNA, 20 bp, Artificial
  CRISPR gRNA sequence
aggtcaatgacccaaggagg

SEQ ID NO: 176917 - DNA, 20 bp, Artificial
  CRISPR gRNA sequence
ggtcaatgacccaaggaggg

SEQ ID NO: 176918 - DNA, 20 bp, Artificial
  CRISPR gRNA sequence
agggaggccccatccccact

SEQ ID NO: 176919 - DNA, 20 bp, Artificial
  CRISPR gRNA sequence
gaggccccatccccacttgg

SEQ ID NO: 176920 - DNA, 20 bp, Artificial
  CRISPR gRNA sequence
gccccatccccacttggcag

SEQ ID NO: 176921 - DNA, 20 bp, Artificial
  CRISPR gRNA sequence
ccccatccccacttggcagt

SEQ ID NO: 176922 - DNA, 20 bp, Artificial
  CRISPR gRNA sequence
cccatccccacttggcagtg

SEQ ID NO: 176923 - DNA, 20 bp, Artificial
  CRISPR gRNA sequence
cttggcagtggggtcacact

SEQ ID NO: 176924 - DNA, 20 bp, Artificial
  CRISPR gRNA sequence
tggggtcacacttggctgtt

SEQ ID NO: 176925 - DNA, 20 bp, Artificial
  CRISPR gRNA sequence
ggggtcacacttggctgttg

SEQ ID NO: 176926 - DNA, 20 bp, Artificial
  CRISPR gRNA sequence
gggtcacacttggctgttga

SEQ ID NO: 176927 - DNA, 20 bp, Artificial
  CRISPR gRNA sequence
ggtcacacttggctgttgag

SEQ ID NO: 176928 - DNA, 20 bp, Artificial
  CRISPR gRNA sequence
cttggctgttgaggggccca

SEQ ID NO: 176929 - DNA, 20 bp, Artificial
  CRISPR gRNA sequence
ggctgttgaggggcccacag

SEQ ID NO: 176930 - DNA, 20 bp, Artificial
  CRISPR gRNA sequence
ttgaggggcccacagaagtc

SEQ ID NO: 176931 - DNA, 20 bp, Artificial
  CRISPR gRNA sequence
caccatatccaccatgatgc

SEQ ID NO: 176932 - DNA, 20 bp, Artificial
  CRISPR gRNA sequence
accatatccaccatgatgcc

SEQ ID NO: 176933 - DNA, 20 bp, Artificial
  CRISPR gRNA sequence
gatgccaggtcctgcttgcc

SEQ ID NO: 176934 - DNA, 20 bp, Artificial
  CRISPR gRNA sequence
tgccaggtcctgcttgccta

SEQ ID NO: 176935 - DNA, 20 bp, Artificial
  CRISPR gRNA sequence
gccaggtcctgcttgcctag

SEQ ID NO: 176936 - DNA, 20 bp, Artificial
  CRISPR gRNA sequence
tcctgcttgcctagaggaat

SEQ ID NO: 176937 - DNA, 20 bp, Artificial
  CRISPR gRNA sequence
ctgcttgcctagaggaataa

SEQ ID NO: 176938 - DNA, 20 bp, Artificial
  CRISPR gRNA sequence
tgcttgcctagaggaataag

SEQ ID NO: 176939 - DNA, 20 bp, Artificial
  CRISPR gRNA sequence
gcttgcctagaggaataaga

SEQ ID NO: 176940 - DNA, 20 bp, Artificial
  CRISPR gRNA sequence
cttgcctagaggaataagag

SEQ ID NO: 176941 - DNA, 20 bp, Artificial
  CRISPR gRNA sequence
ctagaggaataagaggggcc

SEQ ID NO: 176942 - DNA, 20 bp, Artificial
  CRISPR gRNA sequence
tagaggaataagaggggccc

SEQ ID NO: 176943 - DNA, 20 bp, Artificial
  CRISPR gRNA sequence
agaggaataagaggggccca

SEQ ID NO: 176944 - DNA, 20 bp, Artificial
  CRISPR gRNA sequence
gaggaataagaggggcccag

SEQ ID NO: 176945 - DNA, 20 bp, Artificial
  CRISPR gRNA sequence
ggggcccaggggccctgcta

SEQ ID NO: 176946 - DNA, 20 bp, Artificial
  CRISPR gRNA sequence
aggggccctgctacggtgca

SEQ ID NO: 176947 - DNA, 20 bp, Artificial
  CRISPR gRNA sequence
ggggccctgctacggtgcac

SEQ ID NO: 176948 - DNA, 20 bp, Artificial
  CRISPR gRNA sequence
gggccctgctacggtgcaca

SEQ ID NO: 176949 - DNA, 20 bp, Artificial
  CRISPR gRNA sequence
ctgctacggtgcacagggaa

SEQ ID NO: 176950 - DNA, 20 bp, Artificial
  CRISPR gRNA sequence
acggtgcacagggaatggcc

SEQ ID NO: 176951 - DNA, 20 bp, Artificial
  CRISPR gRNA sequence
tgcacagggaatggcctgga

SEQ ID NO: 176952 - DNA, 20 bp, Artificial
  CRISPR gRNA sequence
cacagggaatggcctggatg

SEQ ID NO: 176953 - DNA, 20 bp, Artificial
  CRISPR gRNA sequence
acagggaatggcctggatgg

SEQ ID NO: 176954 - DNA, 20 bp, Artificial
  CRISPR gRNA sequence
cagggaatggcctggatgga

SEQ ID NO: 176955 - DNA, 20 bp, Artificial
  CRISPR gRNA sequence
tggcctggatggagggcaac

SEQ ID NO: 176956 - DNA, 20 bp, Artificial
  CRISPR gRNA sequence
tggatggagggcaaccggac

SEQ ID NO: 176957 - DNA, 20 bp, Artificial
  CRISPR gRNA sequence
ggatggagggcaaccggact

SEQ ID NO: 176958 - DNA, 20 bp, Artificial
  CRISPR gRNA sequence
gatggagggcaaccggactg

SEQ ID NO: 176959 - DNA, 20 bp, Artificial
  CRISPR gRNA sequence
gagggcaaccggactggggt

SEQ ID NO: 176960 - DNA, 20 bp, Artificial
  CRISPR gRNA sequence
ggcaaccggactggggtcag

SEQ ID NO: 176961 - DNA, 20 bp, Artificial
  CRISPR gRNA sequence
gcaaccggactggggtcagc

SEQ ID NO: 176962 - DNA, 20 bp, Artificial
  CRISPR gRNA sequence
actggggtcagcaggctgtc

SEQ ID NO: 176963 - DNA, 20 bp, Artificial
  CRISPR gRNA sequence
gggtcagcaggctgtccagc

SEQ ID NO: 176964 - DNA, 20 bp, Artificial
  CRISPR gRNA sequence
ggtcagcaggctgtccagcc

SEQ ID NO: 176965 - DNA, 20 bp, Artificial
  CRISPR gRNA sequence
cagcaggctgtccagccagg

SEQ ID NO: 176966 - DNA, 20 bp, Artificial
  CRISPR gRNA sequence
caggtggcatccatgttctt

SEQ ID NO: 176967 - DNA, 20 bp, Artificial
  CRISPR gRNA sequence
ccatgttcttcagatctgtg

SEQ ID NO: 176968 - DNA, 20 bp, Artificial
  CRISPR gRNA sequence
agatctgtgaagacacgctg

SEQ ID NO: 176969 - DNA, 20 bp, Artificial
  CRISPR gRNA sequence
gtgaagacacgctgtagact

SEQ ID NO: 176970 - DNA, 20 bp, Artificial
  CRISPR gRNA sequence
agactcagcccaatatcccc

SEQ ID NO: 176971 - DNA, 20 bp, Artificial
  CRISPR gRNA sequence
ctcagcccaatatcccctag

SEQ ID NO: 176972 - DNA, 20 bp, Artificial
  CRISPR gRNA sequence
aatatcccctagaagatgtg

SEQ ID NO: 176973 - DNA, 20 bp, Artificial
  CRISPR gRNA sequence
atcccctagaagatgtgaag

SEQ ID NO: 176974 - DNA, 20 bp, Artificial
  CRISPR gRNA sequence
tcccctagaagatgtgaaga

SEQ ID NO: 176975 - DNA, 20 bp, Artificial
  CRISPR gRNA sequence
agatgtgaagaaggttgtat

SEQ ID NO: 176976 - DNA, 20 bp, Artificial
  CRISPR gRNA sequence
gatgtgaagaaggttgtatg

SEQ ID NO: 176977 - DNA, 20 bp, Artificial
  CRISPR gRNA sequence
atgtgaagaaggttgtatga

SEQ ID NO: 176978 - DNA, 20 bp, Artificial
  CRISPR gRNA sequence
tgaagaaggttgtatgaggg

SEQ ID NO: 176979 - DNA, 20 bp, Artificial
  CRISPR gRNA sequence
gaagaaggttgtatgagggt

SEQ ID NO: 176980 - DNA, 20 bp, Artificial
  CRISPR gRNA sequence
aagaaggttgtatgagggta

SEQ ID NO: 176981 - DNA, 20 bp, Artificial
  CRISPR gRNA sequence
agaaggttgtatgagggtag

SEQ ID NO: 176982 - DNA, 20 bp, Artificial
  CRISPR gRNA sequence
ggttgtatgagggtagggga

SEQ ID NO: 176983 - DNA, 20 bp, Artificial
  CRISPR gRNA sequence
tgtatgagggtaggggacgg

SEQ ID NO: 176984 - DNA, 20 bp, Artificial
  CRISPR gRNA sequence
agggtaggggacggtggcat

SEQ ID NO: 176985 - DNA, 20 bp, Artificial
  CRISPR gRNA sequence
gggtaggggacggtggcatc

SEQ ID NO: 176986 - DNA, 20 bp, Artificial
  CRISPR gRNA sequence
tgtgcttccccctacccctg

SEQ ID NO: 176987 - DNA, 20 bp, Artificial
  CRISPR gRNA sequence
gtgcttccccctacccctga

SEQ ID NO: 176988 - DNA, 20 bp, Artificial
  CRISPR gRNA sequence
ccccctacccctgaaggcca

SEQ ID NO: 176989 - DNA, 20 bp, Artificial
  CRISPR gRNA sequence
acccctgaaggccatagaca

SEQ ID NO: 176990 - DNA, 20 bp, Artificial
  CRISPR gRNA sequence
gacatggcctctgctcttcc

SEQ ID NO: 176991 - DNA, 20 bp, Artificial
  CRISPR gRNA sequence
ggcctctgctcttcccagca

SEQ ID NO: 176992 - DNA, 20 bp, Artificial
  CRISPR gRNA sequence
ctctgctcttcccagcacag

SEQ ID NO: 176993 - DNA, 20 bp, Artificial
  CRISPR gRNA sequence
cacagcagtaaacatccact

SEQ ID NO: 176994 - DNA, 20 bp, Artificial
  CRISPR gRNA sequence
agtaaacatccactcagctt

SEQ ID NO: 176995 - DNA, 20 bp, Artificial
  CRISPR gRNA sequence
gtaaacatccactcagcttc

SEQ ID NO: 176996 - DNA, 20 bp, Artificial
  CRISPR gRNA sequence
ctcagcttcaggcaaacctt

SEQ ID NO: 176997 - DNA, 20 bp, Artificial
  CRISPR gRNA sequence
tcagcttcaggcaaacctta

SEQ ID NO: 176998 - DNA, 20 bp, Artificial
  CRISPR gRNA sequence
ttcaggcaaaccttaaggca

SEQ ID NO: 176999 - DNA, 20 bp, Artificial
  CRISPR gRNA sequence
aggcaaaccttaaggcatgg

SEQ ID NO: 177000 - DNA, 20 bp, Artificial
  CRISPR gRNA sequence
accttaaggcatggcagccg

SEQ ID NO: 177001 - DNA, 20 bp, Artificial
  CRISPR gRNA sequence
gtagctaattcacaatgtgt

SEQ ID NO: 177002 - DNA, 20 bp, Artificial
  CRISPR gRNA sequence
ttcacaatgtgtcagtaccc

SEQ ID NO: 177003 - DNA, 20 bp, Artificial
  CRISPR gRNA sequence
tgctttaccgccctgctccc

SEQ ID NO: 177004 - DNA, 20 bp, Artificial
  CRISPR gRNA sequence
tgctccctggccctgccccc

SEQ ID NO: 177005 - DNA, 20 bp, Artificial
  CRISPR gRNA sequence
aagctttctccatccctacg

SEQ ID NO: 177006 - DNA, 20 bp, Artificial
  CRISPR gRNA sequence
tacgtggttctccctcatct

SEQ ID NO: 177007 - DNA, 20 bp, Artificial
  CRISPR gRNA sequence
gtggttctccctcatctaag

SEQ ID NO: 177008 - DNA, 20 bp, Artificial
  CRISPR gRNA sequence
tccctcatctaagaagccat

SEQ ID NO: 177009 - DNA, 20 bp, Artificial
  CRISPR gRNA sequence
ccctcatctaagaagccata

SEQ ID NO: 177010 - DNA, 20 bp, Artificial
  CRISPR gRNA sequence
tctaagaagccataaggatc

SEQ ID NO: 177011 - DNA, 20 bp, Artificial
  CRISPR gRNA sequence
ctaagaagccataaggatcc

SEQ ID NO: 177012 - DNA, 20 bp, Artificial
  CRISPR gRNA sequence
taagaagccataaggatcca

SEQ ID NO: 177013 - DNA, 20 bp, Artificial
  CRISPR gRNA sequence
tccagggccttcttaccccc

SEQ ID NO: 177014 - DNA, 20 bp, Artificial
  CRISPR gRNA sequence
ccagggccttcttaccccct

SEQ ID NO: 177015 - DNA, 20 bp, Artificial
  CRISPR gRNA sequence
ccccctgggctgtcaatttc

SEQ ID NO: 177016 - DNA, 20 bp, Artificial
  CRISPR gRNA sequence
caatttctggctcctcctta

SEQ ID NO: 177017 - DNA, 20 bp, Artificial
  CRISPR gRNA sequence
ctggctcctccttacagcta

SEQ ID NO: 177018 - DNA, 20 bp, Artificial
  CRISPR gRNA sequence
ccttacagctaaagtctcca

SEQ ID NO: 177019 - DNA, 20 bp, Artificial
  CRISPR gRNA sequence
acagctaaagtctccataga

SEQ ID NO: 177020 - DNA, 20 bp, Artificial
  CRISPR gRNA sequence
agctaaagtctccatagaca

SEQ ID NO: 177021 - DNA, 20 bp, Artificial
  CRISPR gRNA sequence
gctaaagtctccatagacag

SEQ ID NO: 177022 - DNA, 20 bp, Artificial
  CRISPR gRNA sequence
aaagtctccatagacagagg

SEQ ID NO: 177023 - DNA, 20 bp, Artificial
  CRISPR gRNA sequence
aagtctccatagacagaggt

SEQ ID NO: 177024 - DNA, 20 bp, Artificial
  CRISPR gRNA sequence
ctccatagacagaggtgggc

SEQ ID NO: 177025 - DNA, 20 bp, Artificial
  CRISPR gRNA sequence
gacagaggtgggctggactc

SEQ ID NO: 177026 - DNA, 20 bp, Artificial
  CRISPR gRNA sequence
acagaggtgggctggactcc

SEQ ID NO: 177027 - DNA, 20 bp, Artificial
  CRISPR gRNA sequence
ggctggactccaggttcatt

SEQ ID NO: 177028 - DNA, 20 bp, Artificial
  CRISPR gRNA sequence
tggactccaggttcattgag

SEQ ID NO: 177029 - DNA, 20 bp, Artificial
  CRISPR gRNA sequence
ggactccaggttcattgagt

SEQ ID NO: 177030 - DNA, 20 bp, Artificial
  CRISPR gRNA sequence
cccttcccatccacgtttgt

SEQ ID NO: 177031 - DNA, 20 bp, Artificial
  CRISPR gRNA sequence
gctgccactccgactgctcc

SEQ ID NO: 177032 - DNA, 20 bp, Artificial
  CRISPR gRNA sequence
tgccactccgactgctccaa

SEQ ID NO: 177033 - DNA, 20 bp, Artificial
  CRISPR gRNA sequence
actccgactgctccaagagc

SEQ ID NO: 177034 - DNA, 20 bp, Artificial
  CRISPR gRNA sequence
ctccgactgctccaagagct

SEQ ID NO: 177035 - DNA, 20 bp, Artificial
  CRISPR gRNA sequence
tccgactgctccaagagctg

SEQ ID NO: 177036 - DNA, 20 bp, Artificial
  CRISPR gRNA sequence
actgctccaagagctgggga

SEQ ID NO: 177037 - DNA, 20 bp, Artificial
  CRISPR gRNA sequence
gctccaagagctggggacag

SEQ ID NO: 177038 - DNA, 20 bp, Artificial
  CRISPR gRNA sequence
tccaagagctggggacagaa

SEQ ID NO: 177039 - DNA, 20 bp, Artificial
  CRISPR gRNA sequence
agagctggggacagaagagc

SEQ ID NO: 177040 - DNA, 20 bp, Artificial
  CRISPR gRNA sequence
agctggggacagaagagcaa

SEQ ID NO: 177041 - DNA, 20 bp, Artificial
  CRISPR gRNA sequence
gctggggacagaagagcaag

SEQ ID NO: 177042 - DNA, 20 bp, Artificial
  CRISPR gRNA sequence
agaggctatcaactcccttc

SEQ ID NO: 177043 - DNA, 20 bp, Artificial
  CRISPR gRNA sequence
ctatcaactcccttccagtg

SEQ ID NO: 177044 - DNA, 20 bp, Artificial
  CRISPR gRNA sequence
tccagtgcagactcaccctg

SEQ ID NO: 177045 - DNA, 20 bp, Artificial
  CRISPR gRNA sequence
cctgtggccctgccctcaat

SEQ ID NO: 177046 - DNA, 20 bp, Artificial
  CRISPR gRNA sequence
tggccctgccctcaatgagc

SEQ ID NO: 177047 - DNA, 20 bp, Artificial
  CRISPR gRNA sequence
ctcaatgagccagctcctct

SEQ ID NO: 177048 - DNA, 20 bp, Artificial
  CRISPR gRNA sequence
atgagccagctcctctcagc

SEQ ID NO: 177049 - DNA, 20 bp, Artificial
  CRISPR gRNA sequence
ctcagccagtatcacaccct

SEQ ID NO: 177050 - DNA, 20 bp, Artificial
  CRISPR gRNA sequence
cttggccattttcacaatct

SEQ ID NO: 177051 - DNA, 20 bp, Artificial
  CRISPR gRNA sequence
gccattttcacaatctcaga

SEQ ID NO: 177052 - DNA, 20 bp, Artificial
  CRISPR gRNA sequence
ccattttcacaatctcagat

SEQ ID NO: 177053 - DNA, 20 bp, Artificial
  CRISPR gRNA sequence
tcacaatctcagataggatg

SEQ ID NO: 177054 - DNA, 20 bp, Artificial
  CRISPR gRNA sequence
caatctcagataggatgcag

SEQ ID NO: 177055 - DNA, 20 bp, Artificial
  CRISPR gRNA sequence
taggatgcagaagtgcactg

SEQ ID NO: 177056 - DNA, 20 bp, Artificial
  CRISPR gRNA sequence
atgcagaagtgcactgcagt

SEQ ID NO: 177057 - DNA, 20 bp, Artificial
  CRISPR gRNA sequence
tgcagaagtgcactgcagtc

SEQ ID NO: 177058 - DNA, 20 bp, Artificial
  CRISPR gRNA sequence
aagtgcactgcagtcaggac

SEQ ID NO: 177059 - DNA, 20 bp, Artificial
  CRISPR gRNA sequence
agtgcactgcagtcaggaca

SEQ ID NO: 177060 - DNA, 20 bp, Artificial
  CRISPR gRNA sequence
gtgcactgcagtcaggacaa

SEQ ID NO: 177061 - DNA, 20 bp, Artificial
  CRISPR gRNA sequence
ctgcagtcaggacaagggcc

SEQ ID NO: 177062 - DNA, 20 bp, Artificial
  CRISPR gRNA sequence
tgcagtcaggacaagggccc

SEQ ID NO: 177063 - DNA, 20 bp, Artificial
  CRISPR gRNA sequence
cagtcaggacaagggcccgg

SEQ ID NO: 177064 - DNA, 20 bp, Artificial
  CRISPR gRNA sequence
agtcaggacaagggcccggg

SEQ ID NO: 177065 - DNA, 20 bp, Artificial
  CRISPR gRNA sequence
gtcaggacaagggcccggga

SEQ ID NO: 177066 - DNA, 20 bp, Artificial
  CRISPR gRNA sequence
caggacaagggcccgggagg

SEQ ID NO: 177067 - DNA, 20 bp, Artificial
  CRISPR gRNA sequence
aggacaagggcccgggaggg

SEQ ID NO: 177068 - DNA, 20 bp, Artificial
  CRISPR gRNA sequence
gacaagggcccgggagggag

SEQ ID NO: 177069 - DNA, 20 bp, Artificial
  CRISPR gRNA sequence
acaagggcccgggagggagg

SEQ ID NO: 177070 - DNA, 20 bp, Artificial
  CRISPR gRNA sequence
agggcccgggagggaggagg

SEQ ID NO: 177071 - DNA, 20 bp, Artificial
  CRISPR gRNA sequence
gaggaggcagaaatgcatgt

SEQ ID NO: 177072 - DNA, 20 bp, Artificial
  CRISPR gRNA sequence
gcagaaatgcatgttggcac

SEQ ID NO: 177073 - DNA, 20 bp, Artificial
  CRISPR gRNA sequence
cccctctcacacccactctc

SEQ ID NO: 177074 - DNA, 20 bp, Artificial
  CRISPR gRNA sequence
ctcacacccactctctggta

SEQ ID NO: 177075 - DNA, 20 bp, Artificial
  CRISPR gRNA sequence
gacttccctctcaactgtgt

SEQ ID NO: 177076 - DNA, 20 bp, Artificial
  CRISPR gRNA sequence
acttccctctcaactgtgta

SEQ ID NO: 177077 - DNA, 20 bp, Artificial
  CRISPR gRNA sequence
ctctcaactgtgtaaggaca

SEQ ID NO: 177078 - DNA, 20 bp, Artificial
  CRISPR gRNA sequence
caactgtgtaaggacatagt

SEQ ID NO: 177079 - DNA, 20 bp, Artificial
  CRISPR gRNA sequence
actgtgtaaggacatagtaa

SEQ ID NO: 177080 - DNA, 20 bp, Artificial
  CRISPR gRNA sequence
ctgtgtaaggacatagtaag

SEQ ID NO: 177081 - DNA, 20 bp, Artificial
  CRISPR gRNA sequence
tgtgtaaggacatagtaaga

SEQ ID NO: 177082 - DNA, 20 bp, Artificial
  CRISPR gRNA sequence
ggacatagtaagagggaatg

SEQ ID NO: 177083 - DNA, 20 bp, Artificial
  CRISPR gRNA sequence
agggaatgtggcttaaaaca

SEQ ID NO: 177084 - DNA, 20 bp, Artificial
  CRISPR gRNA sequence
gggaatgtggcttaaaacaa

SEQ ID NO: 177085 - DNA, 20 bp, Artificial
  CRISPR gRNA sequence
atgtggcttaaaacaaaggt

SEQ ID NO: 177086 - DNA, 20 bp, Artificial
  CRISPR gRNA sequence
aaaggttagcataataaatc

SEQ ID NO: 177087 - DNA, 20 bp, Artificial
  CRISPR gRNA sequence
ttagcataataaatcaagaa

SEQ ID NO: 177088 - DNA, 20 bp, Artificial
  CRISPR gRNA sequence
ataaatcaagaaaagatgac

SEQ ID NO: 177089 - DNA, 20 bp, Artificial
  CRISPR gRNA sequence
tcaagaaaagatgactagaa

SEQ ID NO: 177090 - DNA, 20 bp, Artificial
  CRISPR gRNA sequence
gaaaagatgactagaaaagc

SEQ ID NO: 177091 - DNA, 20 bp, Artificial
  CRISPR gRNA sequence
aaagatgactagaaaagcta

SEQ ID NO: 177092 - DNA, 20 bp, Artificial
  CRISPR gRNA sequence
tgactagaaaagctagagat

SEQ ID NO: 177093 - DNA, 20 bp, Artificial
  CRISPR gRNA sequence
gactagaaaagctagagata

SEQ ID NO: 177094 - DNA, 20 bp, Artificial
  CRISPR gRNA sequence
acatccatgtctcaattttt

SEQ ID NO: 177095 - DNA, 20 bp, Artificial
  CRISPR gRNA sequence
catccatgtctcaatttttt

SEQ ID NO: 177096 - DNA, 20 bp, Artificial
  CRISPR gRNA sequence
gtctcaattttttgggctaa

SEQ ID NO: 177097 - DNA, 20 bp, Artificial
  CRISPR gRNA sequence
aattttttgggctaatggaa

SEQ ID NO: 177098 - DNA, 20 bp, Artificial
  CRISPR gRNA sequence
ttttgggctaatggaacagc

SEQ ID NO: 177099 - DNA, 20 bp, Artificial
  CRISPR gRNA sequence
gcaaaaacttttttttgaaa

SEQ ID NO: 177100 - DNA, 20 bp, Artificial
  CRISPR gRNA sequence
aaaaacttttttttgaaatg

SEQ ID NO: 177101 - DNA, 20 bp, Artificial
  CRISPR gRNA sequence
ggagttttgctcttgttgcc

SEQ ID NO: 177102 - DNA, 20 bp, Artificial
  CRISPR gRNA sequence
gagttttgctcttgttgccc

SEQ ID NO: 177103 - DNA, 20 bp, Artificial
  CRISPR gRNA sequence
tttgctcttgttgcccaggc

SEQ ID NO: 177104 - DNA, 20 bp, Artificial
  CRISPR gRNA sequence
tgctcttgttgcccaggctg

SEQ ID NO: 177105 - DNA, 20 bp, Artificial
  CRISPR gRNA sequence
ggagtgcaatgacacaatct

SEQ ID NO: 177106 - DNA, 20 bp, Artificial
  CRISPR gRNA sequence
tcactgcaacctccgcctct

SEQ ID NO: 177107 - DNA, 20 bp, Artificial
  CRISPR gRNA sequence
cactgcaacctccgcctctc

SEQ ID NO: 177108 - DNA, 20 bp, Artificial
  CRISPR gRNA sequence
aacctccgcctctcaggttc

SEQ ID NO: 177109 - DNA, 20 bp, Artificial
  CRISPR gRNA sequence
ttcaagcgattctcctgcct

SEQ ID NO: 177110 - DNA, 20 bp, Artificial
  CRISPR gRNA sequence
gattctcctgcctcagcctt

SEQ ID NO: 177111 - DNA, 20 bp, Artificial
  CRISPR gRNA sequence
ttctcctgcctcagccttca

SEQ ID NO: 177112 - DNA, 20 bp, Artificial
  CRISPR gRNA sequence
tcctgcctcagccttcagag

SEQ ID NO: 177113 - DNA, 20 bp, Artificial
  CRISPR gRNA sequence
gcctcagccttcagagtagc

SEQ ID NO: 177114 - DNA, 20 bp, Artificial
  CRISPR gRNA sequence
cctcagccttcagagtagct

SEQ ID NO: 177115 - DNA, 20 bp, Artificial
  CRISPR gRNA sequence
cttcagagtagctgggatta

SEQ ID NO: 177116 - DNA, 20 bp, Artificial
  CRISPR gRNA sequence
ttcagagtagctgggattac

SEQ ID NO: 177117 - DNA, 20 bp, Artificial
  CRISPR gRNA sequence
ggattacaggcatgcgccac

SEQ ID NO: 177118 - DNA, 20 bp, Artificial
  CRISPR gRNA sequence
gattacaggcatgcgccacc

SEQ ID NO: 177119 - DNA, 20 bp, Artificial
  CRISPR gRNA sequence
caggcatgcgccaccaggcc

SEQ ID NO: 177120 - DNA, 20 bp, Artificial
  CRISPR gRNA sequence
ccagctaatttttatatttt

SEQ ID NO: 177121 - DNA, 20 bp, Artificial
  CRISPR gRNA sequence
gctaatttttatatttttgg

SEQ ID NO: 177122 - DNA, 20 bp, Artificial
  CRISPR gRNA sequence
taatttttatatttttggta

SEQ ID NO: 177123 - DNA, 20 bp, Artificial
  CRISPR gRNA sequence
ttttatatttttggtagaga

SEQ ID NO: 177124 - DNA, 20 bp, Artificial
  CRISPR gRNA sequence
tttatatttttggtagagat

SEQ ID NO: 177125 - DNA, 20 bp, Artificial
  CRISPR gRNA sequence
agagatgggtttcaccatgt

SEQ ID NO: 177126 - DNA, 20 bp, Artificial
  CRISPR gRNA sequence
atgggtttcaccatgttagt

SEQ ID NO: 177127 - DNA, 20 bp, Artificial
  CRISPR gRNA sequence
tgggtttcaccatgttagtc

SEQ ID NO: 177128 - DNA, 20 bp, Artificial
  CRISPR gRNA sequence
tttcaccatgttagtcaggc

SEQ ID NO: 177129 - DNA, 20 bp, Artificial
  CRISPR gRNA sequence
tggtctcaaactcctgacct

SEQ ID NO: 177130 - DNA, 20 bp, Artificial
  CRISPR gRNA sequence
ggtctcaaactcctgacctc

SEQ ID NO: 177131 - DNA, 20 bp, Artificial
  CRISPR gRNA sequence
ccacccaccttcgccttcca

SEQ ID NO: 177132 - DNA, 20 bp, Artificial
  CRISPR gRNA sequence
accttcgccttccaaagtgc

SEQ ID NO: 177133 - DNA, 20 bp, Artificial
  CRISPR gRNA sequence
ccttcgccttccaaagtgct

SEQ ID NO: 177134 - DNA, 20 bp, Artificial
  CRISPR gRNA sequence
cttccaaagtgctgggatta

SEQ ID NO: 177135 - DNA, 20 bp, Artificial
  CRISPR gRNA sequence
ttccaaagtgctgggattac

SEQ ID NO: 177136 - DNA, 20 bp, Artificial
  CRISPR gRNA sequence
agtgctgggattacaggcat

SEQ ID NO: 177137 - DNA, 20 bp, Artificial
  CRISPR gRNA sequence
caggcatgagccactgcccc

SEQ ID NO: 177138 - DNA, 20 bp, Artificial
  CRISPR gRNA sequence
tatattcactttcaaaactg

SEQ ID NO: 177139 - DNA, 20 bp, Artificial
  CRISPR gRNA sequence
attcactttcaaaactgaag

SEQ ID NO: 177140 - DNA, 20 bp, Artificial
  CRISPR gRNA sequence
ctgaagcagaaaaaaaaacc

SEQ ID NO: 177141 - DNA, 20 bp, Artificial
  CRISPR gRNA sequence
gaagcagaaaaaaaaacctg

SEQ ID NO: 177142 - DNA, 20 bp, Artificial
  CRISPR gRNA sequence
aagcagaaaaaaaaacctgg

SEQ ID NO: 177143 - DNA, 20 bp, Artificial
  CRISPR gRNA sequence
atttgctaactttttctata

SEQ ID NO: 177144 - DNA, 20 bp, Artificial
  CRISPR gRNA sequence
taaagccatcatcatattaa

SEQ ID NO: 177145 - DNA, 20 bp, Artificial
  CRISPR gRNA sequence
catcatattaacggatccta

SEQ ID NO: 177146 - DNA, 20 bp, Artificial
  CRISPR gRNA sequence
atcatattaacggatcctaa

SEQ ID NO: 177147 - DNA, 20 bp, Artificial
  CRISPR gRNA sequence
atcctaaaggctgattattg

SEQ ID NO: 177148 - DNA, 20 bp, Artificial
  CRISPR gRNA sequence
ctgatgtgcatttcccgaac

SEQ ID NO: 177149 - DNA, 20 bp, Artificial
  CRISPR gRNA sequence
atgtgcatttcccgaactag

SEQ ID NO: 177150 - DNA, 20 bp, Artificial
  CRISPR gRNA sequence
tgtgcatttcccgaactagc

SEQ ID NO: 177151 - DNA, 20 bp, Artificial
  CRISPR gRNA sequence
gtgcatttcccgaactagca

SEQ ID NO: 177152 - DNA, 20 bp, Artificial
  CRISPR gRNA sequence
atttcccgaactagcagggc

SEQ ID NO: 177153 - DNA, 20 bp, Artificial
  CRISPR gRNA sequence
tttcccgaactagcagggct

SEQ ID NO: 177154 - DNA, 20 bp, Artificial
  CRISPR gRNA sequence
ttcccgaactagcagggctg

SEQ ID NO: 177155 - DNA, 20 bp, Artificial
  CRISPR gRNA sequence
ctagcagggctggggcatgt

SEQ ID NO: 177156 - DNA, 20 bp, Artificial
  CRISPR gRNA sequence
tagcagggctggggcatgtt

SEQ ID NO: 177157 - DNA, 20 bp, Artificial
  CRISPR gRNA sequence
agcagggctggggcatgttg

SEQ ID NO: 177158 - DNA, 20 bp, Artificial
  CRISPR gRNA sequence
agggctggggcatgttgggg

SEQ ID NO: 177159 - DNA, 20 bp, Artificial
  CRISPR gRNA sequence
ggctggggcatgttggggca

SEQ ID NO: 177160 - DNA, 20 bp, Artificial
  CRISPR gRNA sequence
gctggggcatgttggggcag

SEQ ID NO: 177161 - DNA, 20 bp, Artificial
  CRISPR gRNA sequence
gcatgttggggcagaggatg

SEQ ID NO: 177162 - DNA, 20 bp, Artificial
  CRISPR gRNA sequence
catgttggggcagaggatgc

SEQ ID NO: 177163 - DNA, 20 bp, Artificial
  CRISPR gRNA sequence
ttggggcagaggatgcaggc

SEQ ID NO: 177164 - DNA, 20 bp, Artificial
  CRISPR gRNA sequence
tggggcagaggatgcaggcc

SEQ ID NO: 177165 - DNA, 20 bp, Artificial
  CRISPR gRNA sequence
ggggcagaggatgcaggcca

SEQ ID NO: 177166 - DNA, 20 bp, Artificial
  CRISPR gRNA sequence
ggccagggacccatcgctga

SEQ ID NO: 177167 - DNA, 20 bp, Artificial
  CRISPR gRNA sequence
cgctgatagtgcctgactca

SEQ ID NO: 177168 - DNA, 20 bp, Artificial
  CRISPR gRNA sequence
ctgatagtgcctgactcaca

SEQ ID NO: 177169 - DNA, 20 bp, Artificial
  CRISPR gRNA sequence
acagagctgtctgatgcccc

SEQ ID NO: 177170 - DNA, 20 bp, Artificial
  CRISPR gRNA sequence
cagagctgtctgatgcccca

SEQ ID NO: 177171 - DNA, 20 bp, Artificial
  CRISPR gRNA sequence
tgatgccccaaggcttgctt

SEQ ID NO: 177172 - DNA, 20 bp, Artificial
  CRISPR gRNA sequence
gatgccccaaggcttgcttc

SEQ ID NO: 177173 - DNA, 20 bp, Artificial
  CRISPR gRNA sequence
ccccaaggcttgcttcagga

SEQ ID NO: 177174 - DNA, 20 bp, Artificial
  CRISPR gRNA sequence
cttgcttcaggacggcctgt

SEQ ID NO: 177175 - DNA, 20 bp, Artificial
  CRISPR gRNA sequence
tgcttcaggacggcctgtca

SEQ ID NO: 177176 - DNA, 20 bp, Artificial
  CRISPR gRNA sequence
gcttcaggacggcctgtcag

SEQ ID NO: 177177 - DNA, 20 bp, Artificial
  CRISPR gRNA sequence
caggacggcctgtcagaggc

SEQ ID NO: 177178 - DNA, 20 bp, Artificial
  CRISPR gRNA sequence
aggacggcctgtcagaggcc

SEQ ID NO: 177179 - DNA, 20 bp, Artificial
  CRISPR gRNA sequence
ccacctgccttcccttccca

SEQ ID NO: 177180 - DNA, 20 bp, Artificial
  CRISPR gRNA sequence
cctgccttcccttcccatgg

SEQ ID NO: 177181 - DNA, 20 bp, Artificial
  CRISPR gRNA sequence
tcccatggtggctttcccac

SEQ ID NO: 177182 - DNA, 20 bp, Artificial
  CRISPR gRNA sequence
tggtggctttcccaccagtc

SEQ ID NO: 177183 - DNA, 20 bp, Artificial
  CRISPR gRNA sequence
ccagtcaagccacgtgaatg

SEQ ID NO: 177184 - DNA, 20 bp, Artificial
  CRISPR gRNA sequence
ccacgtgaatgtggcacttg

SEQ ID NO: 177185 - DNA, 20 bp, Artificial
  CRISPR gRNA sequence
cacgtgaatgtggcacttgt

SEQ ID NO: 177186 - DNA, 20 bp, Artificial
  CRISPR gRNA sequence
tggcacttgtgggacaatgc

SEQ ID NO: 177187 - DNA, 20 bp, Artificial
  CRISPR gRNA sequence
cacttgtgggacaatgcaag

SEQ ID NO: 177188 - DNA, 20 bp, Artificial
  CRISPR gRNA sequence
tgtgggacaatgcaagcagc

SEQ ID NO: 177189 - DNA, 20 bp, Artificial
  CRISPR gRNA sequence
gtgggacaatgcaagcagcc

SEQ ID NO: 177190 - DNA, 20 bp, Artificial
  CRISPR gRNA sequence
tgcaagcagccaggtgacaa

SEQ ID NO: 177191 - DNA, 20 bp, Artificial
  CRISPR gRNA sequence
aagcagccaggtgacaacag

SEQ ID NO: 177192 - DNA, 20 bp, Artificial
  CRISPR gRNA sequence
cagctacccatcctctgatt

SEQ ID NO: 177193 - DNA, 20 bp, Artificial
  CRISPR gRNA sequence
ctacccatcctctgatttgg

SEQ ID NO: 177194 - DNA, 20 bp, Artificial
  CRISPR gRNA sequence
ctctgatttggaagcttcac

SEQ ID NO: 177195 - DNA, 20 bp, Artificial
  CRISPR gRNA sequence
actggttctctctcctcact

SEQ ID NO: 177196 - DNA, 20 bp, Artificial
  CRISPR gRNA sequence
tctctctcctcactgagaaa

SEQ ID NO: 177197 - DNA, 20 bp, Artificial
  CRISPR gRNA sequence
cactgagaaacggtcacttc

SEQ ID NO: 177198 - DNA, 20 bp, Artificial
  CRISPR gRNA sequence
ctgagaaacggtcacttcaa

SEQ ID NO: 177199 - DNA, 20 bp, Artificial
  CRISPR gRNA sequence
acggtcacttcaagagtgcc

SEQ ID NO: 177200 - DNA, 20 bp, Artificial
  CRISPR gRNA sequence
cggtcacttcaagagtgccc

SEQ ID NO: 177201 - DNA, 20 bp, Artificial
  CRISPR gRNA sequence
tcacttcaagagtgcccagg

SEQ ID NO: 177202 - DNA, 20 bp, Artificial
  CRISPR gRNA sequence
cacttcaagagtgcccaggt

SEQ ID NO: 177203 - DNA, 20 bp, Artificial
  CRISPR gRNA sequence
ttcaagagtgcccaggtagg

SEQ ID NO: 177204 - DNA, 20 bp, Artificial
  CRISPR gRNA sequence
tcaagagtgcccaggtagga

SEQ ID NO: 177205 - DNA, 20 bp, Artificial
  CRISPR gRNA sequence
caagagtgcccaggtaggaa

SEQ ID NO: 177206 - DNA, 20 bp, Artificial
  CRISPR gRNA sequence
aagagtgcccaggtaggaag

SEQ ID NO: 177207 - DNA, 20 bp, Artificial
  CRISPR gRNA sequence
ctttaccttcatgatgtcct

SEQ ID NO: 177208 - DNA, 20 bp, Artificial
  CRISPR gRNA sequence
tttaccttcatgatgtcctc

SEQ ID NO: 177209 - DNA, 20 bp, Artificial
  CRISPR gRNA sequence
ttcctcatcctcatctgttg

SEQ ID NO: 177210 - DNA, 20 bp, Artificial
  CRISPR gRNA sequence
atcctcatctgttgtagctg

SEQ ID NO: 177211 - DNA, 20 bp, Artificial
  CRISPR gRNA sequence
tcatctgttgtagctgtgga

SEQ ID NO: 177212 - DNA, 20 bp, Artificial
  CRISPR gRNA sequence
catctgttgtagctgtggat

SEQ ID NO: 177213 - DNA, 20 bp, Artificial
  CRISPR gRNA sequence
atctgttgtagctgtggatg

SEQ ID NO: 177214 - DNA, 20 bp, Artificial
  CRISPR gRNA sequence
gttgtagctgtggatgggga

SEQ ID NO: 177215 - DNA, 20 bp, Artificial
  CRISPR gRNA sequence
gtagctgtggatggggaaag

SEQ ID NO: 177216 - DNA, 20 bp, Artificial
  CRISPR gRNA sequence
agctgtggatggggaaagca

SEQ ID NO: 177217 - DNA, 20 bp, Artificial
  CRISPR gRNA sequence
ctgtggatggggaaagcaga

SEQ ID NO: 177218 - DNA, 20 bp, Artificial
  CRISPR gRNA sequence
tgtggatggggaaagcagag

SEQ ID NO: 177219 - DNA, 20 bp, Artificial
  CRISPR gRNA sequence
gatggggaaagcagagaggt

SEQ ID NO: 177220 - DNA, 20 bp, Artificial
  CRISPR gRNA sequence
gggaaagcagagaggttggc

SEQ ID NO: 177221 - DNA, 20 bp, Artificial
  CRISPR gRNA sequence
aaagcagagaggttggctgg

SEQ ID NO: 177222 - DNA, 20 bp, Artificial
  CRISPR gRNA sequence
cagagaggttggctggcagt

SEQ ID NO: 177223 - DNA, 20 bp, Artificial
  CRISPR gRNA sequence
agtcagccacactcaccctg

SEQ ID NO: 177224 - DNA, 20 bp, Artificial
  CRISPR gRNA sequence
ccacactcaccctgcagttc

SEQ ID NO: 177225 - DNA, 20 bp, Artificial
  CRISPR gRNA sequence
tcaccctgcagttccagttc

SEQ ID NO: 177226 - DNA, 20 bp, Artificial
  CRISPR gRNA sequence
cagttccagttccagcccac

SEQ ID NO: 177227 - DNA, 20 bp, Artificial
  CRISPR gRNA sequence
cacacacacacacaccctcc

SEQ ID NO: 177228 - DNA, 20 bp, Artificial
  CRISPR gRNA sequence
acacacacacaccctcccgg

SEQ ID NO: 177229 - DNA, 20 bp, Artificial
  CRISPR gRNA sequence
cccggtggacctatctgcca

SEQ ID NO: 177230 - DNA, 20 bp, Artificial
  CRISPR gRNA sequence
cggtggacctatctgccata

SEQ ID NO: 177231 - DNA, 20 bp, Artificial
  CRISPR gRNA sequence
cctatctgccatagagattc

SEQ ID NO: 177232 - DNA, 20 bp, Artificial
  CRISPR gRNA sequence
ctgccatagagattccagaa

SEQ ID NO: 177233 - DNA, 20 bp, Artificial
  CRISPR gRNA sequence
tgccatagagattccagaac

SEQ ID NO: 177234 - DNA, 20 bp, Artificial
  CRISPR gRNA sequence
gagattccagaacaggaccc

SEQ ID NO: 177235 - DNA, 20 bp, Artificial
  CRISPR gRNA sequence
tccagaacaggaccctggcc

SEQ ID NO: 177236 - DNA, 20 bp, Artificial
  CRISPR gRNA sequence
aggaccctggcctggtgact

SEQ ID NO: 177237 - DNA, 20 bp, Artificial
  CRISPR gRNA sequence
actcagcctctcaaaccctg

SEQ ID NO: 177238 - DNA, 20 bp, Artificial
  CRISPR gRNA sequence
cctacttccttcctcaccct

SEQ ID NO: 177239 - DNA, 20 bp, Artificial
  CRISPR gRNA sequence
ccttcctcaccctcagatgc

SEQ ID NO: 177240 - DNA, 20 bp, Artificial
  CRISPR gRNA sequence
cttcctcaccctcagatgct

SEQ ID NO: 177241 - DNA, 20 bp, Artificial
  CRISPR gRNA sequence
caccctcagatgctgggcta

SEQ ID NO: 177242 - DNA, 20 bp, Artificial
  CRISPR gRNA sequence
ccctcagatgctgggctaca

SEQ ID NO: 177243 - DNA, 20 bp, Artificial
  CRISPR gRNA sequence
cctcagatgctgggctacag

SEQ ID NO: 177244 - DNA, 20 bp, Artificial
  CRISPR gRNA sequence
tcagatgctgggctacagag

SEQ ID NO: 177245 - DNA, 20 bp, Artificial
  CRISPR gRNA sequence
cagatgctgggctacagagg

SEQ ID NO: 177246 - DNA, 20 bp, Artificial
  CRISPR gRNA sequence
atgctgggctacagaggagg

SEQ ID NO: 177247 - DNA, 20 bp, Artificial
  CRISPR gRNA sequence
tgctgggctacagaggagga

SEQ ID NO: 177248 - DNA, 20 bp, Artificial
  CRISPR gRNA sequence
ctgggctacagaggaggaag

SEQ ID NO: 177249 - DNA, 20 bp, Artificial
  CRISPR gRNA sequence
tacagaggaggaaggagaac

SEQ ID NO: 177250 - DNA, 20 bp, Artificial
  CRISPR gRNA sequence
agaaccagcaccccaaaatg

SEQ ID NO: 177251 - DNA, 20 bp, Artificial
  CRISPR gRNA sequence
gcaccccaaaatgcagcccc

SEQ ID NO: 177252 - DNA, 20 bp, Artificial
  CRISPR gRNA sequence
gcccccttccctcctctcac

SEQ ID NO: 177253 - DNA, 20 bp, Artificial
  CRISPR gRNA sequence
caccagcccccactgtactg

SEQ ID NO: 177254 - DNA, 20 bp, Artificial
  CRISPR gRNA sequence
cccactctgaactgccttcc

SEQ ID NO: 177255 - DNA, 20 bp, Artificial
  CRISPR gRNA sequence
ccgtcgcttgcctcccccta

SEQ ID NO: 177256 - DNA, 20 bp, Artificial
  CRISPR gRNA sequence
tcgcttgcctccccctatgg

SEQ ID NO: 177257 - DNA, 20 bp, Artificial
  CRISPR gRNA sequence
tgcctccccctatggtggct

SEQ ID NO: 177258 - DNA, 20 bp, Artificial
  CRISPR gRNA sequence
ccccctatggtggctaagac

SEQ ID NO: 177259 - DNA, 20 bp, Artificial
  CRISPR gRNA sequence
cccctatggtggctaagact

SEQ ID NO: 177260 - DNA, 20 bp, Artificial
  CRISPR gRNA sequence
aatgcccaactcaatcaatt

SEQ ID NO: 177261 - DNA, 20 bp, Artificial
  CRISPR gRNA sequence
caactcaatcaattcagtgc

SEQ ID NO: 177262 - DNA, 20 bp, Artificial
  CRISPR gRNA sequence
aactcaatcaattcagtgcc

SEQ ID NO: 177263 - DNA, 20 bp, Artificial
  CRISPR gRNA sequence
tcaatcaattcagtgccagg

SEQ ID NO: 177264 - DNA, 20 bp, Artificial
  CRISPR gRNA sequence
aatcaattcagtgccaggtg

SEQ ID NO: 177265 - DNA, 20 bp, Artificial
  CRISPR gRNA sequence
tctgatcatcttttctctct

SEQ ID NO: 177266 - DNA, 20 bp, Artificial
  CRISPR gRNA sequence
ctgatcatcttttctctctc

SEQ ID NO: 177267 - DNA, 20 bp, Artificial
  CRISPR gRNA sequence
atcatcttttctctctcagg

SEQ ID NO: 177268 - DNA, 20 bp, Artificial
  CRISPR gRNA sequence
ctctctcaggaagcccttca

SEQ ID NO: 177269 - DNA, 20 bp, Artificial
  CRISPR gRNA sequence
tctctcaggaagcccttcac

SEQ ID NO: 177270 - DNA, 20 bp, Artificial
  CRISPR gRNA sequence
aggaagcccttcacaggacc

SEQ ID NO: 177271 - DNA, 20 bp, Artificial
  CRISPR gRNA sequence
agcccttcacaggacccaga

SEQ ID NO: 177272 - DNA, 20 bp, Artificial
  CRISPR gRNA sequence
ttcacaggacccagacagtc

SEQ ID NO: 177273 - DNA, 20 bp, Artificial
  CRISPR gRNA sequence
acaggacccagacagtcaag

SEQ ID NO: 177274 - DNA, 20 bp, Artificial
  CRISPR gRNA sequence
caggacccagacagtcaagc

SEQ ID NO: 177275 - DNA, 20 bp, Artificial
  CRISPR gRNA sequence
gacccagacagtcaagcagg

SEQ ID NO: 177276 - DNA, 20 bp, Artificial
  CRISPR gRNA sequence
acccagacagtcaagcaggc

SEQ ID NO: 177277 - DNA, 20 bp, Artificial
  CRISPR gRNA sequence
agacagtcaagcaggcaggc

SEQ ID NO: 177278 - DNA, 20 bp, Artificial
  CRISPR gRNA sequence
gacagtcaagcaggcaggcc

SEQ ID NO: 177279 - DNA, 20 bp, Artificial
  CRISPR gRNA sequence
caagcaggcaggccaggccc

SEQ ID NO: 177280 - DNA, 20 bp, Artificial
  CRISPR gRNA sequence
aagcaggcaggccaggcccc

SEQ ID NO: 177281 - DNA, 20 bp, Artificial
  CRISPR gRNA sequence
gcaggcaggccaggccccag

SEQ ID NO: 177282 - DNA, 20 bp, Artificial
  CRISPR gRNA sequence
gccccaggagcaccaacctt

SEQ ID NO: 177283 - DNA, 20 bp, Artificial
  CRISPR gRNA sequence
cccaggagcaccaaccttca

SEQ ID NO: 177284 - DNA, 20 bp, Artificial
  CRISPR gRNA sequence
ccaggagcaccaaccttcag

SEQ ID NO: 177285 - DNA, 20 bp, Artificial
  CRISPR gRNA sequence
ggagcaccaaccttcagagg

SEQ ID NO: 177286 - DNA, 20 bp, Artificial
  CRISPR gRNA sequence
agcaccaaccttcagaggtg

SEQ ID NO: 177287 - DNA, 20 bp, Artificial
  CRISPR gRNA sequence
gcaccaaccttcagaggtgg

SEQ ID NO: 177288 - DNA, 20 bp, Artificial
  CRISPR gRNA sequence
caccaaccttcagaggtgga

SEQ ID NO: 177289 - DNA, 20 bp, Artificial
  CRISPR gRNA sequence
accttcagaggtggagggca

SEQ ID NO: 177290 - DNA, 20 bp, Artificial
  CRISPR gRNA sequence
ccttcagaggtggagggcat

SEQ ID NO: 177291 - DNA, 20 bp, Artificial
  CRISPR gRNA sequence
tggagggcatgggtgacacc

SEQ ID NO: 177292 - DNA, 20 bp, Artificial
  CRISPR gRNA sequence
agggcatgggtgacacctgg

SEQ ID NO: 177293 - DNA, 20 bp, Artificial
  CRISPR gRNA sequence
ggtgacacctggaagttgta

SEQ ID NO: 177294 - DNA, 20 bp, Artificial
  CRISPR gRNA sequence
ctggaagttgtacagatcac

SEQ ID NO: 177295 - DNA, 20 bp, Artificial
  CRISPR gRNA sequence
tacagatcactggtgctgtc

SEQ ID NO: 177296 - DNA, 20 bp, Artificial
  CRISPR gRNA sequence
ctgtccggcacaacttccac

SEQ ID NO: 177297 - DNA, 20 bp, Artificial
  CRISPR gRNA sequence
tgtccggcacaacttccact

SEQ ID NO: 177298 - DNA, 20 bp, Artificial
  CRISPR gRNA sequence
caacttccactgggatgtgc

SEQ ID NO: 177299 - DNA, 20 bp, Artificial
  CRISPR gRNA sequence
ttccactgggatgtgccagt

SEQ ID NO: 177300 - DNA, 20 bp, Artificial
  CRISPR gRNA sequence
tccactgggatgtgccagtc

SEQ ID NO: 177301 - DNA, 20 bp, Artificial
  CRISPR gRNA sequence
ccactgggatgtgccagtcg

SEQ ID NO: 177302 - DNA, 20 bp, Artificial
  CRISPR gRNA sequence
actgggatgtgccagtcggg

SEQ ID NO: 177303 - DNA, 20 bp, Artificial
  CRISPR gRNA sequence
tgggatgtgccagtcgggga

SEQ ID NO: 177304 - DNA, 20 bp, Artificial
  CRISPR gRNA sequence
gtcggggagagtgctgctga

SEQ ID NO: 177305 - DNA, 20 bp, Artificial
  CRISPR gRNA sequence
agagtgctgctgacagcaca

SEQ ID NO: 177306 - DNA, 20 bp, Artificial
  CRISPR gRNA sequence
ctgctgacagcacatggcga

SEQ ID NO: 177307 - DNA, 20 bp, Artificial
  CRISPR gRNA sequence
acagcacatggcgacagtgc

SEQ ID NO: 177308 - DNA, 20 bp, Artificial
  CRISPR gRNA sequence
cagcacatggcgacagtgct

SEQ ID NO: 177309 - DNA, 20 bp, Artificial
  CRISPR gRNA sequence
agcacatggcgacagtgctg

SEQ ID NO: 177310 - DNA, 20 bp, Artificial
  CRISPR gRNA sequence
atggcgacagtgctggggaa

SEQ ID NO: 177311 - DNA, 20 bp, Artificial
  CRISPR gRNA sequence
gcgacagtgctggggaacag

SEQ ID NO: 177312 - DNA, 20 bp, Artificial
  CRISPR gRNA sequence
acagtgctggggaacagcag

SEQ ID NO: 177313 - DNA, 20 bp, Artificial
  CRISPR gRNA sequence
ctggggaacagcagaagcca

SEQ ID NO: 177314 - DNA, 20 bp, Artificial
  CRISPR gRNA sequence
tggggaacagcagaagccac

SEQ ID NO: 177315 - DNA, 20 bp, Artificial
  CRISPR gRNA sequence
aacagcagaagccacaggtc

SEQ ID NO: 177316 - DNA, 20 bp, Artificial
  CRISPR gRNA sequence
acagcagaagccacaggtca

SEQ ID NO: 177317 - DNA, 20 bp, Artificial
  CRISPR gRNA sequence
gtcaaggttgtgtgctttct

SEQ ID NO: 177318 - DNA, 20 bp, Artificial
  CRISPR gRNA sequence
tgtgtgctttcttagtttgc

SEQ ID NO: 177319 - DNA, 20 bp, Artificial
  CRISPR gRNA sequence
ttcttagtttgcaagacatc

SEQ ID NO: 177320 - DNA, 20 bp, Artificial
  CRISPR gRNA sequence
gcgccctccgaccaaccctg

SEQ ID NO: 177321 - DNA, 20 bp, Artificial
  CRISPR gRNA sequence
aaccctgcagcctgcactaa

SEQ ID NO: 177322 - DNA, 20 bp, Artificial
  CRISPR gRNA sequence
accctgcagcctgcactaat

SEQ ID NO: 177323 - DNA, 20 bp, Artificial
  CRISPR gRNA sequence
actaatgggccaccatgtgc

SEQ ID NO: 177324 - DNA, 20 bp, Artificial
  CRISPR gRNA sequence
tgtgccagcaccatgcctcc

SEQ ID NO: 177325 - DNA, 20 bp, Artificial
  CRISPR gRNA sequence
tgccagcaccatgcctccaa

SEQ ID NO: 177326 - DNA, 20 bp, Artificial
  CRISPR gRNA sequence
agcaccatgcctccaagaga

SEQ ID NO: 177327 - DNA, 20 bp, Artificial
  CRISPR gRNA sequence
caccatgcctccaagagaaa

SEQ ID NO: 177328 - DNA, 20 bp, Artificial
  CRISPR gRNA sequence
agagtcatcccactgacctg

SEQ ID NO: 177329 - DNA, 20 bp, Artificial
  CRISPR gRNA sequence
gagtcatcccactgacctgt

SEQ ID NO: 177330 - DNA, 20 bp, Artificial
  CRISPR gRNA sequence
agtcatcccactgacctgtg

SEQ ID NO: 177331 - DNA, 20 bp, Artificial
  CRISPR gRNA sequence
tgacctgtggggtctcctgc

SEQ ID NO: 177332 - DNA, 20 bp, Artificial
  CRISPR gRNA sequence
gtggggtctcctgccagacc

SEQ ID NO: 177333 - DNA, 20 bp, Artificial
  CRISPR gRNA sequence
gtctcctgccagacctggac

SEQ ID NO: 177334 - DNA, 20 bp, Artificial
  CRISPR gRNA sequence
cagacctggaccagctcacc

SEQ ID NO: 177335 - DNA, 20 bp, Artificial
  CRISPR gRNA sequence
gacctggaccagctcacctg

SEQ ID NO: 177336 - DNA, 20 bp, Artificial
  CRISPR gRNA sequence
tggaccagctcacctggagt

SEQ ID NO: 177337 - DNA, 20 bp, Artificial
  CRISPR gRNA sequence
ggaccagctcacctggagtc

SEQ ID NO: 177338 - DNA, 20 bp, Artificial
  CRISPR gRNA sequence
gaccagctcacctggagtca

SEQ ID NO: 177339 - DNA, 20 bp, Artificial
  CRISPR gRNA sequence
tcagggcctgctccacctcc

SEQ ID NO: 177340 - DNA, 20 bp, Artificial
  CRISPR gRNA sequence
ccacctccaagtcctgcatg

SEQ ID NO: 177341 - DNA, 20 bp, Artificial
  CRISPR gRNA sequence
tccaagtcctgcatgtagcc

SEQ ID NO: 177342 - DNA, 20 bp, Artificial
  CRISPR gRNA sequence
gcatgtagcctggaactgtg

SEQ ID NO: 177343 - DNA, 20 bp, Artificial
  CRISPR gRNA sequence
ctggaactgtgtagctgctg

SEQ ID NO: 177344 - DNA, 20 bp, Artificial
  CRISPR gRNA sequence
tgtgtagctgctgtggtcat

SEQ ID NO: 177345 - DNA, 20 bp, Artificial
  CRISPR gRNA sequence
gtgtagctgctgtggtcatc

SEQ ID NO: 177346 - DNA, 20 bp, Artificial
  CRISPR gRNA sequence
tagctgctgtggtcatcagg

SEQ ID NO: 177347 - DNA, 20 bp, Artificial
  CRISPR gRNA sequence
gctgctgtggtcatcaggca

SEQ ID NO: 177348 - DNA, 20 bp, Artificial
  CRISPR gRNA sequence
gctgtggtcatcaggcagag

SEQ ID NO: 177349 - DNA, 20 bp, Artificial
  CRISPR gRNA sequence
tgtggtcatcaggcagagtg

SEQ ID NO: 177350 - DNA, 20 bp, Artificial
  CRISPR gRNA sequence
tcaggcagagtggagctgct

SEQ ID NO: 177351 - DNA, 20 bp, Artificial
  CRISPR gRNA sequence
agtggagctgctgagtccat

SEQ ID NO: 177352 - DNA, 20 bp, Artificial
  CRISPR gRNA sequence
tggagctgctgagtccatca

SEQ ID NO: 177353 - DNA, 20 bp, Artificial
  CRISPR gRNA sequence
agctgctgagtccatcagag

SEQ ID NO: 177354 - DNA, 20 bp, Artificial
  CRISPR gRNA sequence
gctgctgagtccatcagaga

SEQ ID NO: 177355 - DNA, 20 bp, Artificial
  CRISPR gRNA sequence
gagtccatcagagaaggtat

SEQ ID NO: 177356 - DNA, 20 bp, Artificial
  CRISPR gRNA sequence
agtccatcagagaaggtatc

SEQ ID NO: 177357 - DNA, 20 bp, Artificial
  CRISPR gRNA sequence
gtccatcagagaaggtatca

SEQ ID NO: 177358 - DNA, 20 bp, Artificial
  CRISPR gRNA sequence
atcagagaaggtatcagggc

SEQ ID NO: 177359 - DNA, 20 bp, Artificial
  CRISPR gRNA sequence
ggaatccccacatgactgtc

SEQ ID NO: 177360 - DNA, 20 bp, Artificial
  CRISPR gRNA sequence
gaatccccacatgactgtcg

SEQ ID NO: 177361 - DNA, 20 bp, Artificial
  CRISPR gRNA sequence
aatccccacatgactgtcga

SEQ ID NO: 177362 - DNA, 20 bp, Artificial
  CRISPR gRNA sequence
tccccacatgactgtcgagg

SEQ ID NO: 177363 - DNA, 20 bp, Artificial
  CRISPR gRNA sequence
cacatgactgtcgagggaga

SEQ ID NO: 177364 - DNA, 20 bp, Artificial
  CRISPR gRNA sequence
atgactgtcgagggagaaag

SEQ ID NO: 177365 - DNA, 20 bp, Artificial
  CRISPR gRNA sequence
tgtcgagggagaaagcagct

SEQ ID NO: 177366 - DNA, 20 bp, Artificial
  CRISPR gRNA sequence
gtcgagggagaaagcagctt

SEQ ID NO: 177367 - DNA, 20 bp, Artificial
  CRISPR gRNA sequence
gggagaaagcagcttaggcc

SEQ ID NO: 177368 - DNA, 20 bp, Artificial
  CRISPR gRNA sequence
ggagaaagcagcttaggccc

SEQ ID NO: 177369 - DNA, 20 bp, Artificial
  CRISPR gRNA sequence
gcttaggcccaggcccacct

SEQ ID NO: 177370 - DNA, 20 bp, Artificial
  CRISPR gRNA sequence
atttcttccactgctcaccc

SEQ ID NO: 177371 - DNA, 20 bp, Artificial
  CRISPR gRNA sequence
ccactgctcaccctggccca

SEQ ID NO: 177372 - DNA, 20 bp, Artificial
  CRISPR gRNA sequence
cactgctcaccctggcccac

SEQ ID NO: 177373 - DNA, 20 bp, Artificial
  CRISPR gRNA sequence
ccctggcccacaggtgacca

SEQ ID NO: 177374 - DNA, 20 bp, Artificial
  CRISPR gRNA sequence
cctggcccacaggtgaccaa

SEQ ID NO: 177375 - DNA, 20 bp, Artificial
  CRISPR gRNA sequence
cccacaggtgaccaaaggcc

SEQ ID NO: 177376 - DNA, 20 bp, Artificial
  CRISPR gRNA sequence
tgaccaaaggcctggctgct

SEQ ID NO: 177377 - DNA, 20 bp, Artificial
  CRISPR gRNA sequence
gaccaaaggcctggctgctt

SEQ ID NO: 177378 - DNA, 20 bp, Artificial
  CRISPR gRNA sequence
gaccacactcaccttcctct

SEQ ID NO: 177379 - DNA, 20 bp, Artificial
  CRISPR gRNA sequence
cttcctcttggccttgctct

SEQ ID NO: 177380 - DNA, 20 bp, Artificial
  CRISPR gRNA sequence
tggccttgctcttagcatct

SEQ ID NO: 177381 - DNA, 20 bp, Artificial
  CRISPR gRNA sequence
cttgctcttagcatctcggc

SEQ ID NO: 177382 - DNA, 20 bp, Artificial
  CRISPR gRNA sequence
ggacttcgactttctttctg

SEQ ID NO: 177383 - DNA, 20 bp, Artificial
  CRISPR gRNA sequence
gacttcgactttctttctgt

SEQ ID NO: 177384 - DNA, 20 bp, Artificial
  CRISPR gRNA sequence
acttcgactttctttctgtg

SEQ ID NO: 177385 - DNA, 20 bp, Artificial
  CRISPR gRNA sequence
tcgactttctttctgtgggg

SEQ ID NO: 177386 - DNA, 20 bp, Artificial
  CRISPR gRNA sequence
ctttctttctgtggggcaga

SEQ ID NO: 177387 - DNA, 20 bp, Artificial
  CRISPR gRNA sequence
tttctttctgtggggcagac

SEQ ID NO: 177388 - DNA, 20 bp, Artificial
  CRISPR gRNA sequence
ctgtggggcagacgggctgt

SEQ ID NO: 177389 - DNA, 20 bp, Artificial
  CRISPR gRNA sequence
ggcagacgggctgtcagcct

SEQ ID NO: 177390 - DNA, 20 bp, Artificial
  CRISPR gRNA sequence
acgggctgtcagccttggtg

SEQ ID NO: 177391 - DNA, 20 bp, Artificial
  CRISPR gRNA sequence
cgggctgtcagccttggtgc

SEQ ID NO: 177392 - DNA, 20 bp, Artificial
  CRISPR gRNA sequence
cagccttggtgcaggctctc

SEQ ID NO: 177393 - DNA, 20 bp, Artificial
  CRISPR gRNA sequence
tggtgcaggctctccagccc

SEQ ID NO: 177394 - DNA, 20 bp, Artificial
  CRISPR gRNA sequence
tccttctaccctccctccct

SEQ ID NO: 177395 - DNA, 20 bp, Artificial
  CRISPR gRNA sequence
ccttctaccctccctccctg

SEQ ID NO: 177396 - DNA, 20 bp, Artificial
  CRISPR gRNA sequence
cttctaccctccctccctga

SEQ ID NO: 177397 - DNA, 20 bp, Artificial
  CRISPR gRNA sequence
tccctccctgagggcttccc

SEQ ID NO: 177398 - DNA, 20 bp, Artificial
  CRISPR gRNA sequence
ccctccctgagggcttccca

SEQ ID NO: 177399 - DNA, 20 bp, Artificial
  CRISPR gRNA sequence
ctgagggcttcccaaggacc

SEQ ID NO: 177400 - DNA, 20 bp, Artificial
  CRISPR gRNA sequence
gagggcttcccaaggaccca

SEQ ID NO: 177401 - DNA, 20 bp, Artificial
  CRISPR gRNA sequence
tcccaaggacccagagtcct

SEQ ID NO: 177402 - DNA, 20 bp, Artificial
  CRISPR gRNA sequence
gtccttggataccttttctc

SEQ ID NO: 177403 - DNA, 20 bp, Artificial
  CRISPR gRNA sequence
gataccttttctctggttct

SEQ ID NO: 177404 - DNA, 20 bp, Artificial
  CRISPR gRNA sequence
ccttttctctggttcttggt

SEQ ID NO: 177405 - DNA, 20 bp, Artificial
  CRISPR gRNA sequence
ttttctctggttcttggtga

SEQ ID NO: 177406 - DNA, 20 bp, Artificial
  CRISPR gRNA sequence
tttctctggttcttggtgag

SEQ ID NO: 177407 - DNA, 20 bp, Artificial
  CRISPR gRNA sequence
ctctggttcttggtgagagg

SEQ ID NO: 177408 - DNA, 20 bp, Artificial
  CRISPR gRNA sequence
tggttcttggtgagaggtgg

SEQ ID NO: 177409 - DNA, 20 bp, Artificial
  CRISPR gRNA sequence
tggtgagaggtggaagcatc

SEQ ID NO: 177410 - DNA, 20 bp, Artificial
  CRISPR gRNA sequence
aagcatccggtacactcgca

SEQ ID NO: 177411 - DNA, 20 bp, Artificial
  CRISPR gRNA sequence
tccggtacactcgcacagct

SEQ ID NO: 177412 - DNA, 20 bp, Artificial
  CRISPR gRNA sequence
agctgcccttgttcctgctc

SEQ ID NO: 177413 - DNA, 20 bp, Artificial
  CRISPR gRNA sequence
tctttcacctcctcgatatc

SEQ ID NO: 177414 - DNA, 20 bp, Artificial
  CRISPR gRNA sequence
ttcacctcctcgatatctgg

SEQ ID NO: 177415 - DNA, 20 bp, Artificial
  CRISPR gRNA sequence
tcacctcctcgatatctggc

SEQ ID NO: 177416 - DNA, 20 bp, Artificial
  CRISPR gRNA sequence
cacctcctcgatatctggca

SEQ ID NO: 177417 - DNA, 20 bp, Artificial
  CRISPR gRNA sequence
cctcctcgatatctggcagg

SEQ ID NO: 177418 - DNA, 20 bp, Artificial
  CRISPR gRNA sequence
gatatctggcagggagttca

SEQ ID NO: 177419 - DNA, 20 bp, Artificial
  CRISPR gRNA sequence
ctggcagggagttcatggca

SEQ ID NO: 177420 - DNA, 20 bp, Artificial
  CRISPR gRNA sequence
gggagttcatggcacagcga

SEQ ID NO: 177421 - DNA, 20 bp, Artificial
  CRISPR gRNA sequence
gttcatggcacagcgaaagt

SEQ ID NO: 177422 - DNA, 20 bp, Artificial
  CRISPR gRNA sequence
aaagttggccttccacgtct

SEQ ID NO: 177423 - DNA, 20 bp, Artificial
  CRISPR gRNA sequence
aagttggccttccacgtctt

SEQ ID NO: 177424 - DNA, 20 bp, Artificial
  CRISPR gRNA sequence
gccttccacgtcttgggatc

SEQ ID NO: 177425 - DNA, 20 bp, Artificial
  CRISPR gRNA sequence
ccttttcccctgctttgtat

SEQ ID NO: 177426 - DNA, 20 bp, Artificial
  CRISPR gRNA sequence
tcccctgctttgtatcggcc

SEQ ID NO: 177427 - DNA, 20 bp, Artificial
  CRISPR gRNA sequence
ccctgctttgtatcggccta

SEQ ID NO: 177428 - DNA, 20 bp, Artificial
  CRISPR gRNA sequence
cctgctttgtatcggcctag

SEQ ID NO: 177429 - DNA, 20 bp, Artificial
  CRISPR gRNA sequence
ctgctttgtatcggcctaga

SEQ ID NO: 177430 - DNA, 20 bp, Artificial
  CRISPR gRNA sequence
ctttgtatcggcctagaggg

SEQ ID NO: 177431 - DNA, 20 bp, Artificial
  CRISPR gRNA sequence
tttgtatcggcctagagggc

SEQ ID NO: 177432 - DNA, 20 bp, Artificial
  CRISPR gRNA sequence
tgtatcggcctagagggcag

SEQ ID NO: 177433 - DNA, 20 bp, Artificial
  CRISPR gRNA sequence
gcctagagggcaggagaaaa

SEQ ID NO: 177434 - DNA, 20 bp, Artificial
  CRISPR gRNA sequence
ctagagggcaggagaaaaaa

SEQ ID NO: 177435 - DNA, 20 bp, Artificial
  CRISPR gRNA sequence
tagagggcaggagaaaaaag

SEQ ID NO: 177436 - DNA, 20 bp, Artificial
  CRISPR gRNA sequence
aggagaaaaaagaggatcgt

SEQ ID NO: 177437 - DNA, 20 bp, Artificial
  CRISPR gRNA sequence
ggagaaaaaagaggatcgtc

SEQ ID NO: 177438 - DNA, 20 bp, Artificial
  CRISPR gRNA sequence
gagaaaaaagaggatcgtca

SEQ ID NO: 177439 - DNA, 20 bp, Artificial
  CRISPR gRNA sequence
aaagaggatcgtcagggcca

SEQ ID NO: 177440 - DNA, 20 bp, Artificial
  CRISPR gRNA sequence
aagaggatcgtcagggccat

SEQ ID NO: 177441 - DNA, 20 bp, Artificial
  CRISPR gRNA sequence
aggatcgtcagggccatggg

SEQ ID NO: 177442 - DNA, 20 bp, Artificial
  CRISPR gRNA sequence
ggatcgtcagggccatgggt

SEQ ID NO: 177443 - DNA, 20 bp, Artificial
  CRISPR gRNA sequence
gatcgtcagggccatgggta

SEQ ID NO: 177444 - DNA, 20 bp, Artificial
  CRISPR gRNA sequence
gggccatgggtagggatcct

SEQ ID NO: 177445 - DNA, 20 bp, Artificial
  CRISPR gRNA sequence
tagggatcctcagctgcccc

SEQ ID NO: 177446 - DNA, 20 bp, Artificial
  CRISPR gRNA sequence
cctcagctgcccctggcctg

SEQ ID NO: 177447 - DNA, 20 bp, Artificial
  CRISPR gRNA sequence
ctcagctgcccctggcctga

SEQ ID NO: 177448 - DNA, 20 bp, Artificial
  CRISPR gRNA sequence
cagctgcccctggcctgaag

SEQ ID NO: 177449 - DNA, 20 bp, Artificial
  CRISPR gRNA sequence
agctgcccctggcctgaagg

SEQ ID NO: 177450 - DNA, 20 bp, Artificial
  CRISPR gRNA sequence
tgcccctggcctgaaggagg

SEQ ID NO: 177451 - DNA, 20 bp, Artificial
  CRISPR gRNA sequence
gcccctggcctgaaggagga

SEQ ID NO: 177452 - DNA, 20 bp, Artificial
  CRISPR gRNA sequence
ctggcctgaaggaggaaggc

SEQ ID NO: 177453 - DNA, 20 bp, Artificial
  CRISPR gRNA sequence
tggcctgaaggaggaaggca

SEQ ID NO: 177454 - DNA, 20 bp, Artificial
  CRISPR gRNA sequence
cccctgacctcttatgctac

SEQ ID NO: 177455 - DNA, 20 bp, Artificial
  CRISPR gRNA sequence
cctgacctcttatgctacca

SEQ ID NO: 177456 - DNA, 20 bp, Artificial
  CRISPR gRNA sequence
tgacctcttatgctaccaga

SEQ ID NO: 177457 - DNA, 20 bp, Artificial
  CRISPR gRNA sequence
cttatgctaccagagagcca

SEQ ID NO: 177458 - DNA, 20 bp, Artificial
  CRISPR gRNA sequence
atgctaccagagagccacag

SEQ ID NO: 177459 - DNA, 20 bp, Artificial
  CRISPR gRNA sequence
gagagccacagtggtcaaac

SEQ ID NO: 177460 - DNA, 20 bp, Artificial
  CRISPR gRNA sequence
agccacagtggtcaaaccag

SEQ ID NO: 177461 - DNA, 20 bp, Artificial
  CRISPR gRNA sequence
gccacagtggtcaaaccagc

SEQ ID NO: 177462 - DNA, 20 bp, Artificial
  CRISPR gRNA sequence
gtcaaaccagcaggtactcc

SEQ ID NO: 177463 - DNA, 20 bp, Artificial
  CRISPR gRNA sequence
gtactcccggtgacactctg

SEQ ID NO: 177464 - DNA, 20 bp, Artificial
  CRISPR gRNA sequence
tactcccggtgacactctgc

SEQ ID NO: 177465 - DNA, 20 bp, Artificial
  CRISPR gRNA sequence
cggtgacactctgcaggtcc

SEQ ID NO: 177466 - DNA, 20 bp, Artificial
  CRISPR gRNA sequence
ggtgacactctgcaggtcct

SEQ ID NO: 177467 - DNA, 20 bp, Artificial
  CRISPR gRNA sequence
actctgcaggtcctaggccc

SEQ ID NO: 177468 - DNA, 20 bp, Artificial
  CRISPR gRNA sequence
ctctgcaggtcctaggccct

SEQ ID NO: 177469 - DNA, 20 bp, Artificial
  CRISPR gRNA sequence
cctgggccttctcaaatgcc

SEQ ID NO: 177470 - DNA, 20 bp, Artificial
  CRISPR gRNA sequence
ctgggccttctcaaatgccc

SEQ ID NO: 177471 - DNA, 20 bp, Artificial
  CRISPR gRNA sequence
ccttctcaaatgcccaggct

SEQ ID NO: 177472 - DNA, 20 bp, Artificial
  CRISPR gRNA sequence
aggcttggcttaaacacatc

SEQ ID NO: 177473 - DNA, 20 bp, Artificial
  CRISPR gRNA sequence
cttggcttaaacacatctag

SEQ ID NO: 177474 - DNA, 20 bp, Artificial
  CRISPR gRNA sequence
ttggcttaaacacatctagc

SEQ ID NO: 177475 - DNA, 20 bp, Artificial
  CRISPR gRNA sequence
taaacacatctagcgggcct

SEQ ID NO: 177476 - DNA, 20 bp, Artificial
  CRISPR gRNA sequence
acatctagcgggcctcagtg

SEQ ID NO: 177477 - DNA, 20 bp, Artificial
  CRISPR gRNA sequence
catctagcgggcctcagtga

SEQ ID NO: 177478 - DNA, 20 bp, Artificial
  CRISPR gRNA sequence
atctagcgggcctcagtgaa

SEQ ID NO: 177479 - DNA, 20 bp, Artificial
  CRISPR gRNA sequence
gcgggcctcagtgaagggcc

SEQ ID NO: 177480 - DNA, 20 bp, Artificial
  CRISPR gRNA sequence
gcctcagtgaagggcccagc

SEQ ID NO: 177481 - DNA, 20 bp, Artificial
  CRISPR gRNA sequence
tcagtgaagggcccagccag

SEQ ID NO: 177482 - DNA, 20 bp, Artificial
  CRISPR gRNA sequence
aagggcccagccagaagcac

SEQ ID NO: 177483 - DNA, 20 bp, Artificial
  CRISPR gRNA sequence
gggcccagccagaagcacta

SEQ ID NO: 177484 - DNA, 20 bp, Artificial
  CRISPR gRNA sequence
ctagagtccccatatcccca

SEQ ID NO: 177485 - DNA, 20 bp, Artificial
  CRISPR gRNA sequence
aaagtgtactatctgtgtct

SEQ ID NO: 177486 - DNA, 20 bp, Artificial
  CRISPR gRNA sequence
tctgtgtctcagactatgcc

SEQ ID NO: 177487 - DNA, 20 bp, Artificial
  CRISPR gRNA sequence
ctatgcccagtcttcctcct

SEQ ID NO: 177488 - DNA, 20 bp, Artificial
  CRISPR gRNA sequence
tatgcccagtcttcctcctt

SEQ ID NO: 177489 - DNA, 20 bp, Artificial
  CRISPR gRNA sequence
agtcttcctccttgggctat

SEQ ID NO: 177490 - DNA, 20 bp, Artificial
  CRISPR gRNA sequence
cttcctccttgggctatcag

SEQ ID NO: 177491 - DNA, 20 bp, Artificial
  CRISPR gRNA sequence
ctccttgggctatcagcagc

SEQ ID NO: 177492 - DNA, 20 bp, Artificial
  CRISPR gRNA sequence
ccttgggctatcagcagcca

SEQ ID NO: 177493 - DNA, 20 bp, Artificial
  CRISPR gRNA sequence
cttgggctatcagcagccag

SEQ ID NO: 177494 - DNA, 20 bp, Artificial
  CRISPR gRNA sequence
ttgggctatcagcagccaga

SEQ ID NO: 177495 - DNA, 20 bp, Artificial
  CRISPR gRNA sequence
ggctatcagcagccagaggg

SEQ ID NO: 177496 - DNA, 20 bp, Artificial
  CRISPR gRNA sequence
ctatcagcagccagagggta

SEQ ID NO: 177497 - DNA, 20 bp, Artificial
  CRISPR gRNA sequence
tcagcagccagagggtagag

SEQ ID NO: 177498 - DNA, 20 bp, Artificial
  CRISPR gRNA sequence
cagcagccagagggtagagt

SEQ ID NO: 177499 - DNA, 20 bp, Artificial
  CRISPR gRNA sequence
gccagagggtagagtgggca

SEQ ID NO: 177500 - DNA, 20 bp, Artificial
  CRISPR gRNA sequence
agggtagagtgggcacagac

SEQ ID NO: 177501 - DNA, 20 bp, Artificial
  CRISPR gRNA sequence
gggtagagtgggcacagact

SEQ ID NO: 177502 - DNA, 20 bp, Artificial
  CRISPR gRNA sequence
tagagtgggcacagactggg

SEQ ID NO: 177503 - DNA, 20 bp, Artificial
  CRISPR gRNA sequence
agtgggcacagactgggcag

SEQ ID NO: 177504 - DNA, 20 bp, Artificial
  CRISPR gRNA sequence
tgggcacagactgggcagca

SEQ ID NO: 177505 - DNA, 20 bp, Artificial
  CRISPR gRNA sequence
acagactgggcagcagagaa

SEQ ID NO: 177506 - DNA, 20 bp, Artificial
  CRISPR gRNA sequence
agcagagaacagttactaaa

SEQ ID NO: 177507 - DNA, 20 bp, Artificial
  CRISPR gRNA sequence
gcagagaacagttactaaat

SEQ ID NO: 177508 - DNA, 20 bp, Artificial
  CRISPR gRNA sequence
gagaacagttactaaatggg

SEQ ID NO: 177509 - DNA, 20 bp, Artificial
  CRISPR gRNA sequence
agaacagttactaaatgggt

SEQ ID NO: 177510 - DNA, 20 bp, Artificial
  CRISPR gRNA sequence
atgggtgggctgactgttct

SEQ ID NO: 177511 - DNA, 20 bp, Artificial
  CRISPR gRNA sequence
gtgggctgactgttctgaga

SEQ ID NO: 177512 - DNA, 20 bp, Artificial
  CRISPR gRNA sequence
tgggctgactgttctgagat

SEQ ID NO: 177513 - DNA, 20 bp, Artificial
  CRISPR gRNA sequence
tgactgttctgagatgggcc

SEQ ID NO: 177514 - DNA, 20 bp, Artificial
  CRISPR gRNA sequence
actgttctgagatgggccta

SEQ ID NO: 177515 - DNA, 20 bp, Artificial
  CRISPR gRNA sequence
ggcctagagctccatctctc

SEQ ID NO: 177516 - DNA, 20 bp, Artificial
  CRISPR gRNA sequence
gcctagagctccatctctca

SEQ ID NO: 177517 - DNA, 20 bp, Artificial
  CRISPR gRNA sequence
agctccatctctcaaggata

SEQ ID NO: 177518 - DNA, 20 bp, Artificial
  CRISPR gRNA sequence
gctccatctctcaaggataa

SEQ ID NO: 177519 - DNA, 20 bp, Artificial
  CRISPR gRNA sequence
tccatctctcaaggataaag

SEQ ID NO: 177520 - DNA, 20 bp, Artificial
  CRISPR gRNA sequence
ccatctctcaaggataaagg

SEQ ID NO: 177521 - DNA, 20 bp, Artificial
  CRISPR gRNA sequence
aaggaggccaccaaccacat

SEQ ID NO: 177522 - DNA, 20 bp, Artificial
  CRISPR gRNA sequence
aggaggccaccaaccacatg

SEQ ID NO: 177523 - DNA, 20 bp, Artificial
  CRISPR gRNA sequence
gccaccaaccacatgaggct

SEQ ID NO: 177524 - DNA, 20 bp, Artificial
  CRISPR gRNA sequence
aaccacatgaggcttggacc

SEQ ID NO: 177525 - DNA, 20 bp, Artificial
  CRISPR gRNA sequence
accacatgaggcttggacca

SEQ ID NO: 177526 - DNA, 20 bp, Artificial
  CRISPR gRNA sequence
ccacatgaggcttggaccaa

SEQ ID NO: 177527 - DNA, 20 bp, Artificial
  CRISPR gRNA sequence
gaggcttggaccaagggcct

SEQ ID NO: 177528 - DNA, 20 bp, Artificial
  CRISPR gRNA sequence
caagggccttggtcaacacg

SEQ ID NO: 177529 - DNA, 20 bp, Artificial
  CRISPR gRNA sequence
ccttggtcaacacgaagaaa

SEQ ID NO: 177530 - DNA, 20 bp, Artificial
  CRISPR gRNA sequence
cttggtcaacacgaagaaaa

SEQ ID NO: 177531 - DNA, 20 bp, Artificial
  CRISPR gRNA sequence
ggtcaacacgaagaaaaagg

SEQ ID NO: 177532 - DNA, 20 bp, Artificial
  CRISPR gRNA sequence
cacgaagaaaaaggcagacc

SEQ ID NO: 177533 - DNA, 20 bp, Artificial
  CRISPR gRNA sequence
acgaagaaaaaggcagacct

SEQ ID NO: 177534 - DNA, 20 bp, Artificial
  CRISPR gRNA sequence
aggcagacctgggtctcttt

SEQ ID NO: 177535 - DNA, 20 bp, Artificial
  CRISPR gRNA sequence
ctgggtctctttcagtgccc

SEQ ID NO: 177536 - DNA, 20 bp, Artificial
  CRISPR gRNA sequence
tctttcagtgccctggctta

SEQ ID NO: 177537 - DNA, 20 bp, Artificial
  CRISPR gRNA sequence
tggcttacagctgcttttca

SEQ ID NO: 177538 - DNA, 20 bp, Artificial
  CRISPR gRNA sequence
cttttcacagatgcttttgc

SEQ ID NO: 177539 - DNA, 20 bp, Artificial
  CRISPR gRNA sequence
ttttcacagatgcttttgcc

SEQ ID NO: 177540 - DNA, 20 bp, Artificial
  CRISPR gRNA sequence
tttcacagatgcttttgcca

SEQ ID NO: 177541 - DNA, 20 bp, Artificial
  CRISPR gRNA sequence
tcacagatgcttttgccagg

SEQ ID NO: 177542 - DNA, 20 bp, Artificial
  CRISPR gRNA sequence
tgccagggagaactttcatc

SEQ ID NO: 177543 - DNA, 20 bp, Artificial
  CRISPR gRNA sequence
atctagccacaaaccccctg

SEQ ID NO: 177544 - DNA, 20 bp, Artificial
  CRISPR gRNA sequence
cctgaagccacacactttct

SEQ ID NO: 177545 - DNA, 20 bp, Artificial
  CRISPR gRNA sequence
ccacacactttctaagatct

SEQ ID NO: 177546 - DNA, 20 bp, Artificial
  CRISPR gRNA sequence
agatcttggcttttcccttt

SEQ ID NO: 177547 - DNA, 20 bp, Artificial
  CRISPR gRNA sequence
tttccctttgagaatttgct

SEQ ID NO: 177548 - DNA, 20 bp, Artificial
  CRISPR gRNA sequence
agatgatcgactctcttctc

SEQ ID NO: 177549 - DNA, 20 bp, Artificial
  CRISPR gRNA sequence
actctcttctccagaaacac

SEQ ID NO: 177550 - DNA, 20 bp, Artificial
  CRISPR gRNA sequence
cagaaacacaagtctgccac

SEQ ID NO: 177551 - DNA, 20 bp, Artificial
  CRISPR gRNA sequence
ctgccaccagcccctcttcc

SEQ ID NO: 177552 - DNA, 20 bp, Artificial
  CRISPR gRNA sequence
agtaattctgcatgttgtct

SEQ ID NO: 177553 - DNA, 20 bp, Artificial
  CRISPR gRNA sequence
gtaattctgcatgttgtctc

SEQ ID NO: 177554 - DNA, 20 bp, Artificial
  CRISPR gRNA sequence
taattctgcatgttgtctca

SEQ ID NO: 177555 - DNA, 20 bp, Artificial
  CRISPR gRNA sequence
attctgcatgttgtctcagg

SEQ ID NO: 177556 - DNA, 20 bp, Artificial
  CRISPR gRNA sequence
gcatgttgtctcagggagct

SEQ ID NO: 177557 - DNA, 20 bp, Artificial
  CRISPR gRNA sequence
catgttgtctcagggagctc

SEQ ID NO: 177558 - DNA, 20 bp, Artificial
  CRISPR gRNA sequence
atgttgtctcagggagctca

SEQ ID NO: 177559 - DNA, 20 bp, Artificial
  CRISPR gRNA sequence
ctcagggagctcagggaccc

SEQ ID NO: 177560 - DNA, 20 bp, Artificial
  CRISPR gRNA sequence
ggagctcagggaccccagtg

SEQ ID NO: 177561 - DNA, 20 bp, Artificial
  CRISPR gRNA sequence
agctcagggaccccagtgaa

SEQ ID NO: 177562 - DNA, 20 bp, Artificial
  CRISPR gRNA sequence
aagagcctctgtgttaacgt

SEQ ID NO: 177563 - DNA, 20 bp, Artificial
  CRISPR gRNA sequence
gcctcctcttgtctctaccc

SEQ ID NO: 177564 - DNA, 20 bp, Artificial
  CRISPR gRNA sequence
cctcctcttgtctctaccct

SEQ ID NO: 177565 - DNA, 20 bp, Artificial
  CRISPR gRNA sequence
tgtctctaccctgggcttcc

SEQ ID NO: 177566 - DNA, 20 bp, Artificial
  CRISPR gRNA sequence
gtctctaccctgggcttcct

SEQ ID NO: 177567 - DNA, 20 bp, Artificial
  CRISPR gRNA sequence
accctgggcttcctaggcct

SEQ ID NO: 177568 - DNA, 20 bp, Artificial
  CRISPR gRNA sequence
ggcttcctaggcctgagtcc

SEQ ID NO: 177569 - DNA, 20 bp, Artificial
  CRISPR gRNA sequence
gcttcctaggcctgagtccc

SEQ ID NO: 177570 - DNA, 20 bp, Artificial
  CRISPR gRNA sequence
caggcacacacctgtgtgaa

SEQ ID NO: 177571 - DNA, 20 bp, Artificial
  CRISPR gRNA sequence
acacacctgtgtgaatggcc

SEQ ID NO: 177572 - DNA, 20 bp, Artificial
  CRISPR gRNA sequence
ctgtgtgaatggcccagctc

SEQ ID NO: 177573 - DNA, 20 bp, Artificial
  CRISPR gRNA sequence
tggcccagctccggaacaaa

SEQ ID NO: 177574 - DNA, 20 bp, Artificial
  CRISPR gRNA sequence
ggcccagctccggaacaaac

SEQ ID NO: 177575 - DNA, 20 bp, Artificial
  CRISPR gRNA sequence
aggcatccttgttgatgtcc

SEQ ID NO: 177576 - DNA, 20 bp, Artificial
  CRISPR gRNA sequence
gttgatgtcccagccatgct

SEQ ID NO: 177577 - DNA, 20 bp, Artificial
  CRISPR gRNA sequence
gatgtcccagccatgcttgg

SEQ ID NO: 177578 - DNA, 20 bp, Artificial
  CRISPR gRNA sequence
tgcttggcagcatgcttcca

SEQ ID NO: 177579 - DNA, 20 bp, Artificial
  CRISPR gRNA sequence
gcttggcagcatgcttccat

SEQ ID NO: 177580 - DNA, 20 bp, Artificial
  CRISPR gRNA sequence
cagcatgcttccatgggatc

SEQ ID NO: 177581 - DNA, 20 bp, Artificial
  CRISPR gRNA sequence
catgcttccatgggatctgg

SEQ ID NO: 177582 - DNA, 20 bp, Artificial
  CRISPR gRNA sequence
aacaatacacacatacacat

SEQ ID NO: 177583 - DNA, 20 bp, Artificial
  CRISPR gRNA sequence
acaatacacacatacacata

SEQ ID NO: 177584 - DNA, 20 bp, Artificial
  CRISPR gRNA sequence
acatacacataaggctgtgt

SEQ ID NO: 177585 - DNA, 20 bp, Artificial
  CRISPR gRNA sequence
catacacataaggctgtgtc

SEQ ID NO: 177586 - DNA, 20 bp, Artificial
  CRISPR gRNA sequence
cacataaggctgtgtcaggt

SEQ ID NO: 177587 - DNA, 20 bp, Artificial
  CRISPR gRNA sequence
cataaggctgtgtcaggtca

SEQ ID NO: 177588 - DNA, 20 bp, Artificial
  CRISPR gRNA sequence
ctgtgtcaggtcagagacca

SEQ ID NO: 177589 - DNA, 20 bp, Artificial
  CRISPR gRNA sequence
aggtcagagaccacagactt

SEQ ID NO: 177590 - DNA, 20 bp, Artificial
  CRISPR gRNA sequence
ggtcagagaccacagacttt

SEQ ID NO: 177591 - DNA, 20 bp, Artificial
  CRISPR gRNA sequence
gtcagagaccacagactttg

SEQ ID NO: 177592 - DNA, 20 bp, Artificial
  CRISPR gRNA sequence
agaccacagactttggggct

SEQ ID NO: 177593 - DNA, 20 bp, Artificial
  CRISPR gRNA sequence
cagactttggggctgagtct

SEQ ID NO: 177594 - DNA, 20 bp, Artificial
  CRISPR gRNA sequence
ttggggctgagtctgagacc

SEQ ID NO: 177595 - DNA, 20 bp, Artificial
  CRISPR gRNA sequence
tggggctgagtctgagaccc

SEQ ID NO: 177596 - DNA, 20 bp, Artificial
  CRISPR gRNA sequence
gtctgagacccaggcctgcc

SEQ ID NO: 177597 - DNA, 20 bp, Artificial
  CRISPR gRNA sequence
gagacccaggcctgcccagc

SEQ ID NO: 177598 - DNA, 20 bp, Artificial
  CRISPR gRNA sequence
cccaggcctgcccagccaga

SEQ ID NO: 177599 - DNA, 20 bp, Artificial
  CRISPR gRNA sequence
ccaggcctgcccagccagac

SEQ ID NO: 177600 - DNA, 20 bp, Artificial
  CRISPR gRNA sequence
ctgcccagccagacaggtct

SEQ ID NO: 177601 - DNA, 20 bp, Artificial
  CRISPR gRNA sequence
cagccagacaggtctgagaa

SEQ ID NO: 177602 - DNA, 20 bp, Artificial
  CRISPR gRNA sequence
agccagacaggtctgagaaa

SEQ ID NO: 177603 - DNA, 20 bp, Artificial
  CRISPR gRNA sequence
cccttttttcccctgacatc

SEQ ID NO: 177604 - DNA, 20 bp, Artificial
  CRISPR gRNA sequence
ttttcccctgacatctggct

SEQ ID NO: 177605 - DNA, 20 bp, Artificial
  CRISPR gRNA sequence
ctggcttggacacccatctt

SEQ ID NO: 177606 - DNA, 20 bp, Artificial
  CRISPR gRNA sequence
tggcttggacacccatcttg

SEQ ID NO: 177607 - DNA, 20 bp, Artificial
  CRISPR gRNA sequence
ttggacacccatcttgaggc

SEQ ID NO: 177608 - DNA, 20 bp, Artificial
  CRISPR gRNA sequence
catcttgaggctggcttaaa

SEQ ID NO: 177609 - DNA, 20 bp, Artificial
  CRISPR gRNA sequence
ctggcttaaacagaccactc

SEQ ID NO: 177610 - DNA, 20 bp, Artificial
  CRISPR gRNA sequence
acagaccactctggatctct

SEQ ID NO: 177611 - DNA, 20 bp, Artificial
  CRISPR gRNA sequence
cagaccactctggatctctc

SEQ ID NO: 177612 - DNA, 20 bp, Artificial
  CRISPR gRNA sequence
gaccactctggatctctcag

SEQ ID NO: 177613 - DNA, 20 bp, Artificial
  CRISPR gRNA sequence
accactctggatctctcagg

SEQ ID NO: 177614 - DNA, 20 bp, Artificial
  CRISPR gRNA sequence
ccactctggatctctcagga

SEQ ID NO: 177615 - DNA, 20 bp, Artificial
  CRISPR gRNA sequence
gatctctcaggagggacacc

SEQ ID NO: 177616 - DNA, 20 bp, Artificial
  CRISPR gRNA sequence
ctcaggagggacacctagtt

SEQ ID NO: 177617 - DNA, 20 bp, Artificial
  CRISPR gRNA sequence
gagggacacctagtttggat

SEQ ID NO: 177618 - DNA, 20 bp, Artificial
  CRISPR gRNA sequence
cacctagtttggatgagctg

SEQ ID NO: 177619 - DNA, 20 bp, Artificial
  CRISPR gRNA sequence
tggatgagctgcagcattat

SEQ ID NO: 177620 - DNA, 20 bp, Artificial
  CRISPR gRNA sequence
tgcagcattattagctcaca

SEQ ID NO: 177621 - DNA, 20 bp, Artificial
  CRISPR gRNA sequence
tctgcctgttacacatgtgc

SEQ ID NO: 177622 - DNA, 20 bp, Artificial
  CRISPR gRNA sequence
ctgcctgttacacatgtgct

SEQ ID NO: 177623 - DNA, 20 bp, Artificial
  CRISPR gRNA sequence
cacatgtgctaggacccaca

SEQ ID NO: 177624 - DNA, 20 bp, Artificial
  CRISPR gRNA sequence
acatgtgctaggacccacac

SEQ ID NO: 177625 - DNA, 20 bp, Artificial
  CRISPR gRNA sequence
catgtgctaggacccacaca

SEQ ID NO: 177626 - DNA, 20 bp, Artificial
  CRISPR gRNA sequence
acacagggcaccctccccca

SEQ ID NO: 177627 - DNA, 20 bp, Artificial
  CRISPR gRNA sequence
ggcaccctcccccaaagccc

SEQ ID NO: 177628 - DNA, 20 bp, Artificial
  CRISPR gRNA sequence
cccccaaagccctggttttg

SEQ ID NO: 177629 - DNA, 20 bp, Artificial
  CRISPR gRNA sequence
aagccctggttttgaagctc

SEQ ID NO: 177630 - DNA, 20 bp, Artificial
  CRISPR gRNA sequence
agccctggttttgaagctct

SEQ ID NO: 177631 - DNA, 20 bp, Artificial
  CRISPR gRNA sequence
agctctgggatgtttctctc

SEQ ID NO: 177632 - DNA, 20 bp, Artificial
  CRISPR gRNA sequence
gatgtttctctctggcttgt

SEQ ID NO: 177633 - DNA, 20 bp, Artificial
  CRISPR gRNA sequence
ctggcttgtaagcacccaca

SEQ ID NO: 177634 - DNA, 20 bp, Artificial
  CRISPR gRNA sequence
gcttgtaagcacccacatgg

SEQ ID NO: 177635 - DNA, 20 bp, Artificial
  CRISPR gRNA sequence
gtaagcacccacatggaagt

SEQ ID NO: 177636 - DNA, 20 bp, Artificial
  CRISPR gRNA sequence
gaagtaagaacttcttccat

SEQ ID NO: 177637 - DNA, 20 bp, Artificial
  CRISPR gRNA sequence
taagaacttcttccattaga

SEQ ID NO: 177638 - DNA, 20 bp, Artificial
  CRISPR gRNA sequence
aagaacttcttccattagaa

SEQ ID NO: 177639 - DNA, 20 bp, Artificial
  CRISPR gRNA sequence
ttccattagaaaggactcct

SEQ ID NO: 177640 - DNA, 20 bp, Artificial
  CRISPR gRNA sequence
tccattagaaaggactcctc

SEQ ID NO: 177641 - DNA, 20 bp, Artificial
  CRISPR gRNA sequence
aaaggactcctcaggacacc

SEQ ID NO: 177642 - DNA, 20 bp, Artificial
  CRISPR gRNA sequence
aaggactcctcaggacacct

SEQ ID NO: 177643 - DNA, 20 bp, Artificial
  CRISPR gRNA sequence
ggactcctcaggacacctgg

SEQ ID NO: 177644 - DNA, 20 bp, Artificial
  CRISPR gRNA sequence
cctcaggacacctgggagca

SEQ ID NO: 177645 - DNA, 20 bp, Artificial
  CRISPR gRNA sequence
ctcaggacacctgggagcat

SEQ ID NO: 177646 - DNA, 20 bp, Artificial
  CRISPR gRNA sequence
tgggagcatgggctcttaca

SEQ ID NO: 177647 - DNA, 20 bp, Artificial
  CRISPR gRNA sequence
gggagcatgggctcttacac

SEQ ID NO: 177648 - DNA, 20 bp, Artificial
  CRISPR gRNA sequence
ggagcatgggctcttacaca

SEQ ID NO: 177649 - DNA, 20 bp, Artificial
  CRISPR gRNA sequence
gagcatgggctcttacacag

SEQ ID NO: 177650 - DNA, 20 bp, Artificial
  CRISPR gRNA sequence
agcatgggctcttacacagg

SEQ ID NO: 177651 - DNA, 20 bp, Artificial
  CRISPR gRNA sequence
ggctcttacacagggggtcc

SEQ ID NO: 177652 - DNA, 20 bp, Artificial
  CRISPR gRNA sequence
ggggtcctggtcataccact

SEQ ID NO: 177653 - DNA, 20 bp, Artificial
  CRISPR gRNA sequence
gggtcctggtcataccactg

SEQ ID NO: 177654 - DNA, 20 bp, Artificial
  CRISPR gRNA sequence
ggtcctggtcataccactga

SEQ ID NO: 177655 - DNA, 20 bp, Artificial
  CRISPR gRNA sequence
tcctggtcataccactgagg

SEQ ID NO: 177656 - DNA, 20 bp, Artificial
  CRISPR gRNA sequence
tcataccactgagggagctc

SEQ ID NO: 177657 - DNA, 20 bp, Artificial
  CRISPR gRNA sequence
cataccactgagggagctct

SEQ ID NO: 177658 - DNA, 20 bp, Artificial
  CRISPR gRNA sequence
ccactgagggagctctgggc

SEQ ID NO: 177659 - DNA, 20 bp, Artificial
  CRISPR gRNA sequence
agggagctctgggctagact

SEQ ID NO: 177660 - DNA, 20 bp, Artificial
  CRISPR gRNA sequence
agctctgggctagacttgga

SEQ ID NO: 177661 - DNA, 20 bp, Artificial
  CRISPR gRNA sequence
tggtgaacactgtgtaaccc

SEQ ID NO: 177662 - DNA, 20 bp, Artificial
  CRISPR gRNA sequence
cactgtatctctttgcccct

SEQ ID NO: 177663 - DNA, 20 bp, Artificial
  CRISPR gRNA sequence
gcccctcagttttctcttct

SEQ ID NO: 177664 - DNA, 20 bp, Artificial
  CRISPR gRNA sequence
agttttctcttctcggaaat

SEQ ID NO: 177665 - DNA, 20 bp, Artificial
  CRISPR gRNA sequence
aacatatccaacaaaatttt

SEQ ID NO: 177666 - DNA, 20 bp, Artificial
  CRISPR gRNA sequence
acatatccaacaaaattttg

SEQ ID NO: 177667 - DNA, 20 bp, Artificial
  CRISPR gRNA sequence
aaattttgaggattaaaaac

SEQ ID NO: 177668 - DNA, 20 bp, Artificial
  CRISPR gRNA sequence
attttgaggattaaaaacca

SEQ ID NO: 177669 - DNA, 20 bp, Artificial
  CRISPR gRNA sequence
ttttgaggattaaaaaccag

SEQ ID NO: 177670 - DNA, 20 bp, Artificial
  CRISPR gRNA sequence
attaaaaaccagaggatgtg

SEQ ID NO: 177671 - DNA, 20 bp, Artificial
  CRISPR gRNA sequence
ttaaaaaccagaggatgtgt

SEQ ID NO: 177672 - DNA, 20 bp, Artificial
  CRISPR gRNA sequence
taaaaaccagaggatgtgta

SEQ ID NO: 177673 - DNA, 20 bp, Artificial
  CRISPR gRNA sequence
ccagaggatgtgtagggaca

SEQ ID NO: 177674 - DNA, 20 bp, Artificial
  CRISPR gRNA sequence
gggacacagtgacaaatatg

SEQ ID NO: 177675 - DNA, 20 bp, Artificial
  CRISPR gRNA sequence
cagtgacaaatatgaagtct

SEQ ID NO: 177676 - DNA, 20 bp, Artificial
  CRISPR gRNA sequence
agtgacaaatatgaagtcta

SEQ ID NO: 177677 - DNA, 20 bp, Artificial
  CRISPR gRNA sequence
tactgttattatatcactta

SEQ ID NO: 177678 - DNA, 20 bp, Artificial
  CRISPR gRNA sequence
attatatcacttatggttaa

SEQ ID NO: 177679 - DNA, 20 bp, Artificial
  CRISPR gRNA sequence
atcacttatggttaacagta

SEQ ID NO: 177680 - DNA, 20 bp, Artificial
  CRISPR gRNA sequence
ggttaacagtaaagatttct

SEQ ID NO: 177681 - DNA, 20 bp, Artificial
  CRISPR gRNA sequence
aacagtaaagatttctgagt

SEQ ID NO: 177682 - DNA, 20 bp, Artificial
  CRISPR gRNA sequence
atttctgagtcagaccgttc

SEQ ID NO: 177683 - DNA, 20 bp, Artificial
  CRISPR gRNA sequence
gaccgttcaagttcaaatct

SEQ ID NO: 177684 - DNA, 20 bp, Artificial
  CRISPR gRNA sequence
tgatcttatgatctacctct

SEQ ID NO: 177685 - DNA, 20 bp, Artificial
  CRISPR gRNA sequence
ttatctgaaaatgatgacat

SEQ ID NO: 177686 - DNA, 20 bp, Artificial
  CRISPR gRNA sequence
ctgaaaatgatgacattagt

SEQ ID NO: 177687 - DNA, 20 bp, Artificial
  CRISPR gRNA sequence
cattagtaagatctaaccca

SEQ ID NO: 177688 - DNA, 20 bp, Artificial
  CRISPR gRNA sequence
attagtaagatctaacccac

SEQ ID NO: 177689 - DNA, 20 bp, Artificial
  CRISPR gRNA sequence
ctaacccacaggactactgc

SEQ ID NO: 177690 - DNA, 20 bp, Artificial
  CRISPR gRNA sequence
taacccacaggactactgcg

SEQ ID NO: 177691 - DNA, 20 bp, Artificial
  CRISPR gRNA sequence
cacaatgtaaataacatact

SEQ ID NO: 177692 - DNA, 20 bp, Artificial
  CRISPR gRNA sequence
aatgtaaataacatacttag

SEQ ID NO: 177693 - DNA, 20 bp, Artificial
  CRISPR gRNA sequence
atgtaaataacatacttagc

SEQ ID NO: 177694 - DNA, 20 bp, Artificial
  CRISPR gRNA sequence
ataacatacttagcaggtgc

SEQ ID NO: 177695 - DNA, 20 bp, Artificial
  CRISPR gRNA sequence
taacatacttagcaggtgcc

SEQ ID NO: 177696 - DNA, 20 bp, Artificial
  CRISPR gRNA sequence
cttagcaggtgccaggcaca

SEQ ID NO: 177697 - DNA, 20 bp, Artificial
  CRISPR gRNA sequence
ttagcaggtgccaggcacac

SEQ ID NO: 177698 - DNA, 20 bp, Artificial
  CRISPR gRNA sequence
tagcaggtgccaggcacaca

SEQ ID NO: 177699 - DNA, 20 bp, Artificial
  CRISPR gRNA sequence
gcaggtgccaggcacacagg

SEQ ID NO: 177700 - DNA, 20 bp, Artificial
  CRISPR gRNA sequence
ccaggcacacagggagtgtt

SEQ ID NO: 177701 - DNA, 20 bp, Artificial
  CRISPR gRNA sequence
gcacacagggagtgttcagt

SEQ ID NO: 177702 - DNA, 20 bp, Artificial
  CRISPR gRNA sequence
agggagtgttcagtaagcat

SEQ ID NO: 177703 - DNA, 20 bp, Artificial
  CRISPR gRNA sequence
tgaatactatcattgctact

SEQ ID NO: 177704 - DNA, 20 bp, Artificial
  CRISPR gRNA sequence
tatcattgctactaagtcta

SEQ ID NO: 177705 - DNA, 20 bp, Artificial
  CRISPR gRNA sequence
atcattgctactaagtctat

SEQ ID NO: 177706 - DNA, 20 bp, Artificial
  CRISPR gRNA sequence
tcattgctactaagtctata

SEQ ID NO: 177707 - DNA, 20 bp, Artificial
  CRISPR gRNA sequence
tatagggtctatgttgcccc

SEQ ID NO: 177708 - DNA, 20 bp, Artificial
  CRISPR gRNA sequence
ctatgttgccccaagtgcac

SEQ ID NO: 177709 - DNA, 20 bp, Artificial
  CRISPR gRNA sequence
tgccccaagtgcaccagcta

SEQ ID NO: 177710 - DNA, 20 bp, Artificial
  CRISPR gRNA sequence
gccccaagtgcaccagctat

SEQ ID NO: 177711 - DNA, 20 bp, Artificial
  CRISPR gRNA sequence
tgcaccagctataggcttct

SEQ ID NO: 177712 - DNA, 20 bp, Artificial
  CRISPR gRNA sequence
gcaccagctataggcttctt

SEQ ID NO: 177713 - DNA, 20 bp, Artificial
  CRISPR gRNA sequence
cagctataggcttcttgggc

SEQ ID NO: 177714 - DNA, 20 bp, Artificial
  CRISPR gRNA sequence
gctataggcttcttgggcca

SEQ ID NO: 177715 - DNA, 20 bp, Artificial
  CRISPR gRNA sequence
gcttcttgggccagagtgac

SEQ ID NO: 177716 - DNA, 20 bp, Artificial
  CRISPR gRNA sequence
tgggccagagtgactggtgc

SEQ ID NO: 177717 - DNA, 20 bp, Artificial
  CRISPR gRNA sequence
taactcgtttgtcctctgct

SEQ ID NO: 177718 - DNA, 20 bp, Artificial
  CRISPR gRNA sequence
tcgtttgtcctctgctaagc

SEQ ID NO: 177719 - DNA, 20 bp, Artificial
  CRISPR gRNA sequence
cgtttgtcctctgctaagcc

SEQ ID NO: 177720 - DNA, 20 bp, Artificial
  CRISPR gRNA sequence
aagccaggcacgtttctgcc

SEQ ID NO: 177721 - DNA, 20 bp, Artificial
  CRISPR gRNA sequence
ccaggcacgtttctgcccag

SEQ ID NO: 177722 - DNA, 20 bp, Artificial
  CRISPR gRNA sequence
gcccagcagcatccacttct

SEQ ID NO: 177723 - DNA, 20 bp, Artificial
  CRISPR gRNA sequence
cagtcttctatttgttcgat

SEQ ID NO: 177724 - DNA, 20 bp, Artificial
  CRISPR gRNA sequence
gtcttctatttgttcgattg

SEQ ID NO: 177725 - DNA, 20 bp, Artificial
  CRISPR gRNA sequence
tttgttcgattggagccctg

SEQ ID NO: 177726 - DNA, 20 bp, Artificial
  CRISPR gRNA sequence
tgttcgattggagccctgca

SEQ ID NO: 177727 - DNA, 20 bp, Artificial
  CRISPR gRNA sequence
agagtgctgtgtatgtttgt

SEQ ID NO: 177728 - DNA, 20 bp, Artificial
  CRISPR gRNA sequence
gagtgctgtgtatgtttgta

SEQ ID NO: 177729 - DNA, 20 bp, Artificial
  CRISPR gRNA sequence
agtgctgtgtatgtttgtaa

SEQ ID NO: 177730 - DNA, 20 bp, Artificial
  CRISPR gRNA sequence
atgtttgtaagggtctcgct

SEQ ID NO: 177731 - DNA, 20 bp, Artificial
  CRISPR gRNA sequence
gtttgtaagggtctcgctta

SEQ ID NO: 177732 - DNA, 20 bp, Artificial
  CRISPR gRNA sequence
tttgtaagggtctcgcttag

SEQ ID NO: 177733 - DNA, 20 bp, Artificial
  CRISPR gRNA sequence
tgtaagggtctcgcttagag

SEQ ID NO: 177734 - DNA, 20 bp, Artificial
  CRISPR gRNA sequence
taagggtctcgcttagagga

SEQ ID NO: 177735 - DNA, 20 bp, Artificial
  CRISPR gRNA sequence
gggtctcgcttagaggagag

SEQ ID NO: 177736 - DNA, 20 bp, Artificial
  CRISPR gRNA sequence
cttagaggagagcagaactc

SEQ ID NO: 177737 - DNA, 20 bp, Artificial
  CRISPR gRNA sequence
agagcagaactccagctctg

SEQ ID NO: 177738 - DNA, 20 bp, Artificial
  CRISPR gRNA sequence
aactccagctctgcagatgc

SEQ ID NO: 177739 - DNA, 20 bp, Artificial
  CRISPR gRNA sequence
ccagctctgcagatgctgga

SEQ ID NO: 177740 - DNA, 20 bp, Artificial
  CRISPR gRNA sequence
atgctggaaagtcttgctgc

SEQ ID NO: 177741 - DNA, 20 bp, Artificial
  CRISPR gRNA sequence
aaagtcttgctgctggaaac

SEQ ID NO: 177742 - DNA, 20 bp, Artificial
  CRISPR gRNA sequence
gtcttgctgctggaaactgg

SEQ ID NO: 177743 - DNA, 20 bp, Artificial
  CRISPR gRNA sequence
ctggaaactggaagtgcctt

SEQ ID NO: 177744 - DNA, 20 bp, Artificial
  CRISPR gRNA sequence
tggaaactggaagtgccttc

SEQ ID NO: 177745 - DNA, 20 bp, Artificial
  CRISPR gRNA sequence
aaactggaagtgccttcagg

SEQ ID NO: 177746 - DNA, 20 bp, Artificial
  CRISPR gRNA sequence
aactggaagtgccttcaggt

SEQ ID NO: 177747 - DNA, 20 bp, Artificial
  CRISPR gRNA sequence
tcaggtgggtgccctacctc

SEQ ID NO: 177748 - DNA, 20 bp, Artificial
  CRISPR gRNA sequence
ggtgggtgccctacctcaag

SEQ ID NO: 177749 - DNA, 20 bp, Artificial
  CRISPR gRNA sequence
gtgggtgccctacctcaaga

SEQ ID NO: 177750 - DNA, 20 bp, Artificial
  CRISPR gRNA sequence
tgggtgccctacctcaagaa

SEQ ID NO: 177751 - DNA, 20 bp, Artificial
  CRISPR gRNA sequence
gtgccctacctcaagaaggg

SEQ ID NO: 177752 - DNA, 20 bp, Artificial
  CRISPR gRNA sequence
ccctacctcaagaagggaag

SEQ ID NO: 177753 - DNA, 20 bp, Artificial
  CRISPR gRNA sequence
cctacctcaagaagggaaga

SEQ ID NO: 177754 - DNA, 20 bp, Artificial
  CRISPR gRNA sequence
acctcaagaagggaagaagg

SEQ ID NO: 177755 - DNA, 20 bp, Artificial
  CRISPR gRNA sequence
cctcaagaagggaagaaggc

SEQ ID NO: 177756 - DNA, 20 bp, Artificial
  CRISPR gRNA sequence
tcaagaagggaagaaggcag

SEQ ID NO: 177757 - DNA, 20 bp, Artificial
  CRISPR gRNA sequence
gaagaaggcaggagtcatgc

SEQ ID NO: 177758 - DNA, 20 bp, Artificial
  CRISPR gRNA sequence
aaggcaggagtcatgcaagt

SEQ ID NO: 177759 - DNA, 20 bp, Artificial
  CRISPR gRNA sequence
aggcaggagtcatgcaagtg

SEQ ID NO: 177760 - DNA, 20 bp, Artificial
  CRISPR gRNA sequence
ggagtcatgcaagtgaggcc

SEQ ID NO: 177761 - DNA, 20 bp, Artificial
  CRISPR gRNA sequence
gagtcatgcaagtgaggccc

SEQ ID NO: 177762 - DNA, 20 bp, Artificial
  CRISPR gRNA sequence
catgcaagtgaggcccaggc

SEQ ID NO: 177763 - DNA, 20 bp, Artificial
  CRISPR gRNA sequence
atgcaagtgaggcccaggct

SEQ ID NO: 177764 - DNA, 20 bp, Artificial
  CRISPR gRNA sequence
ccgtgcacactccctgcatg

SEQ ID NO: 177765 - DNA, 20 bp, Artificial
  CRISPR gRNA sequence
cgtgcacactccctgcatgc

SEQ ID NO: 177766 - DNA, 20 bp, Artificial
  CRISPR gRNA sequence
tccctgcatgcaggacccac

SEQ ID NO: 177767 - DNA, 20 bp, Artificial
  CRISPR gRNA sequence
ccctgcatgcaggacccact

SEQ ID NO: 177768 - DNA, 20 bp, Artificial
  CRISPR gRNA sequence
ctgcatgcaggacccactgg

SEQ ID NO: 177769 - DNA, 20 bp, Artificial
  CRISPR gRNA sequence
ccgttatcacttcccttttt

SEQ ID NO: 177770 - DNA, 20 bp, Artificial
  CRISPR gRNA sequence
ccctttttgagctgcatctg

SEQ ID NO: 177771 - DNA, 20 bp, Artificial
  CRISPR gRNA sequence
ttgagctgcatctgaagctt

SEQ ID NO: 177772 - DNA, 20 bp, Artificial
  CRISPR gRNA sequence
atctgaagctttggtccctc

SEQ ID NO: 177773 - DNA, 20 bp, Artificial
  CRISPR gRNA sequence
tgaagctttggtccctccag

SEQ ID NO: 177774 - DNA, 20 bp, Artificial
  CRISPR gRNA sequence
ttggtccctccagaagtaca

SEQ ID NO: 177775 - DNA, 20 bp, Artificial
  CRISPR gRNA sequence
tggtccctccagaagtacat

SEQ ID NO: 177776 - DNA, 20 bp, Artificial
  CRISPR gRNA sequence
cagaagtacatgggttaaaa

SEQ ID NO: 177777 - DNA, 20 bp, Artificial
  CRISPR gRNA sequence
aagtacatgggttaaaacag

SEQ ID NO: 177778 - DNA, 20 bp, Artificial
  CRISPR gRNA sequence
tacatgggttaaaacagtgg

SEQ ID NO: 177779 - DNA, 20 bp, Artificial
  CRISPR gRNA sequence
acatgggttaaaacagtggc

SEQ ID NO: 177780 - DNA, 20 bp, Artificial
  CRISPR gRNA sequence
aacagtggcaggaaaaccca

SEQ ID NO: 177781 - DNA, 20 bp, Artificial
  CRISPR gRNA sequence
cagtggcaggaaaacccaaa

SEQ ID NO: 177782 - DNA, 20 bp, Artificial
  CRISPR gRNA sequence
ttacactcactttattaatc

SEQ ID NO: 177783 - DNA, 20 bp, Artificial
  CRISPR gRNA sequence
ctcactttattaatccagat

SEQ ID NO: 177784 - DNA, 20 bp, Artificial
  CRISPR gRNA sequence
ttattaatccagatgagccc

SEQ ID NO: 177785 - DNA, 20 bp, Artificial
  CRISPR gRNA sequence
tattaatccagatgagcccc

SEQ ID NO: 177786 - DNA, 20 bp, Artificial
  CRISPR gRNA sequence
tccagatgagccccgggatt

SEQ ID NO: 177787 - DNA, 20 bp, Artificial
  CRISPR gRNA sequence
gatgagccccgggatttggt

SEQ ID NO: 177788 - DNA, 20 bp, Artificial
  CRISPR gRNA sequence
ttggaattaatctgcatctc

SEQ ID NO: 177789 - DNA, 20 bp, Artificial
  CRISPR gRNA sequence
aattaatctgcatctctagc

SEQ ID NO: 177790 - DNA, 20 bp, Artificial
  CRISPR gRNA sequence
attaatctgcatctctagcc

SEQ ID NO: 177791 - DNA, 20 bp, Artificial
  CRISPR gRNA sequence
ttaatctgcatctctagcca

SEQ ID NO: 177792 - DNA, 20 bp, Artificial
  CRISPR gRNA sequence
ccagggtctcatgcgcatcc

SEQ ID NO: 177793 - DNA, 20 bp, Artificial
  CRISPR gRNA sequence
tctcatgcgcatccgagtga

SEQ ID NO: 177794 - DNA, 20 bp, Artificial
  CRISPR gRNA sequence
ctcatgcgcatccgagtgat

SEQ ID NO: 177795 - DNA, 20 bp, Artificial
  CRISPR gRNA sequence
catccgagtgatgggcatgt

SEQ ID NO: 177796 - DNA, 20 bp, Artificial
  CRISPR gRNA sequence
tgatgggcatgttggctgta

SEQ ID NO: 177797 - DNA, 20 bp, Artificial
  CRISPR gRNA sequence
atgggcatgttggctgtaaa

SEQ ID NO: 177798 - DNA, 20 bp, Artificial
  CRISPR gRNA sequence
tgttggctgtaaagagaaca

SEQ ID NO: 177799 - DNA, 20 bp, Artificial
  CRISPR gRNA sequence
ttggctgtaaagagaacaca

SEQ ID NO: 177800 - DNA, 20 bp, Artificial
  CRISPR gRNA sequence
tggctgtaaagagaacacag

SEQ ID NO: 177801 - DNA, 20 bp, Artificial
  CRISPR gRNA sequence
taaagagaacacagaggctc

SEQ ID NO: 177802 - DNA, 20 bp, Artificial
  CRISPR gRNA sequence
agaacacagaggctccagtc

SEQ ID NO: 177803 - DNA, 20 bp, Artificial
  CRISPR gRNA sequence
ccagtctggaatctgttgaa

SEQ ID NO: 177804 - DNA, 20 bp, Artificial
  CRISPR gRNA sequence
ggaatctgttgaacagtacc

SEQ ID NO: 177805 - DNA, 20 bp, Artificial
  CRISPR gRNA sequence
gaatctgttgaacagtacct

SEQ ID NO: 177806 - DNA, 20 bp, Artificial
  CRISPR gRNA sequence
tctgttgaacagtacctggg

SEQ ID NO: 177807 - DNA, 20 bp, Artificial
  CRISPR gRNA sequence
ggcagtgacctgccccaccc

SEQ ID NO: 177808 - DNA, 20 bp, Artificial
  CRISPR gRNA sequence
gcagtgacctgccccacccg

SEQ ID NO: 177809 - DNA, 20 bp, Artificial
  CRISPR gRNA sequence
ctgccccacccgaggtcact

SEQ ID NO: 177810 - DNA, 20 bp, Artificial
  CRISPR gRNA sequence
tagttaccctcccctcacct

SEQ ID NO: 177811 - DNA, 20 bp, Artificial
  CRISPR gRNA sequence
taccctcccctcacctcagc

SEQ ID NO: 177812 - DNA, 20 bp, Artificial
  CRISPR gRNA sequence
ccctcacctcagccagctgc

SEQ ID NO: 177813 - DNA, 20 bp, Artificial
  CRISPR gRNA sequence
cctcacctcagccagctgct

SEQ ID NO: 177814 - DNA, 20 bp, Artificial
  CRISPR gRNA sequence
cagctgctaggtactacact

SEQ ID NO: 177815 - DNA, 20 bp, Artificial
  CRISPR gRNA sequence
gctaggtactacactcagtg

SEQ ID NO: 177816 - DNA, 20 bp, Artificial
  CRISPR gRNA sequence
taggtactacactcagtgcg

SEQ ID NO: 177817 - DNA, 20 bp, Artificial
  CRISPR gRNA sequence
aggtactacactcagtgcgg

SEQ ID NO: 177818 - DNA, 20 bp, Artificial
  CRISPR gRNA sequence
ggtactacactcagtgcgga

SEQ ID NO: 177819 - DNA, 20 bp, Artificial
  CRISPR gRNA sequence
gtactacactcagtgcggag

SEQ ID NO: 177820 - DNA, 20 bp, Artificial
  CRISPR gRNA sequence
actacactcagtgcggaggg

SEQ ID NO: 177821 - DNA, 20 bp, Artificial
  CRISPR gRNA sequence
agtgcggaggggagctgcgc

SEQ ID NO: 177822 - DNA, 20 bp, Artificial
  CRISPR gRNA sequence
aactgctctccaaatttttt

SEQ ID NO: 177823 - DNA, 20 bp, Artificial
  CRISPR gRNA sequence
tccaaattttttcagcatct

SEQ ID NO: 177824 - DNA, 20 bp, Artificial
  CRISPR gRNA sequence
ccaaattttttcagcatctt

SEQ ID NO: 177825 - DNA, 20 bp, Artificial
  CRISPR gRNA sequence
aatgcttttgccccttcctt

SEQ ID NO: 177826 - DNA, 20 bp, Artificial
  CRISPR gRNA sequence
ccccttccttcagcccctcc

SEQ ID NO: 177827 - DNA, 20 bp, Artificial
  CRISPR gRNA sequence
ttccttcagcccctcccagc

SEQ ID NO: 177828 - DNA, 20 bp, Artificial
  CRISPR gRNA sequence
agcccctcccagccagtctc

SEQ ID NO: 177829 - DNA, 20 bp, Artificial
  CRISPR gRNA sequence
cccctcccagccagtctctg

SEQ ID NO: 177830 - DNA, 20 bp, Artificial
  CRISPR gRNA sequence
ccctcccagccagtctctgg

SEQ ID NO: 177831 - DNA, 20 bp, Artificial
  CRISPR gRNA sequence
ctcccagccagtctctggag

SEQ ID NO: 177832 - DNA, 20 bp, Artificial
  CRISPR gRNA sequence
cagccagtctctggaggaga

SEQ ID NO: 177833 - DNA, 20 bp, Artificial
  CRISPR gRNA sequence
agccagtctctggaggagac

SEQ ID NO: 177834 - DNA, 20 bp, Artificial
  CRISPR gRNA sequence
tctggaggagacaggcatgc

SEQ ID NO: 177835 - DNA, 20 bp, Artificial
  CRISPR gRNA sequence
ggagacaggcatgcaagtga

SEQ ID NO: 177836 - DNA, 20 bp, Artificial
  CRISPR gRNA sequence
aggcatgcaagtgatggctt

SEQ ID NO: 177837 - DNA, 20 bp, Artificial
  CRISPR gRNA sequence
ggcatgcaagtgatggcttc

SEQ ID NO: 177838 - DNA, 20 bp, Artificial
  CRISPR gRNA sequence
atggcttcaggattcatatg

SEQ ID NO: 177839 - DNA, 20 bp, Artificial
  CRISPR gRNA sequence
tggcttcaggattcatatgc

SEQ ID NO: 177840 - DNA, 20 bp, Artificial
  CRISPR gRNA sequence
tcaggattcatatgcaggaa

SEQ ID NO: 177841 - DNA, 20 bp, Artificial
  CRISPR gRNA sequence
aggattcatatgcaggaaaa

SEQ ID NO: 177842 - DNA, 20 bp, Artificial
  CRISPR gRNA sequence
aggaaaagagacaaaatgca

SEQ ID NO: 177843 - DNA, 20 bp, Artificial
  CRISPR gRNA sequence
atgcacagataccctaattt

SEQ ID NO: 177844 - DNA, 20 bp, Artificial
  CRISPR gRNA sequence
cgctcaaaattcaaatcctt

SEQ ID NO: 177845 - DNA, 20 bp, Artificial
  CRISPR gRNA sequence
gctcaaaattcaaatccttt

SEQ ID NO: 177846 - DNA, 20 bp, Artificial
  CRISPR gRNA sequence
caaaattcaaatcctttggg

SEQ ID NO: 177847 - DNA, 20 bp, Artificial
  CRISPR gRNA sequence
aaaattcaaatcctttggga

SEQ ID NO: 177848 - DNA, 20 bp, Artificial
  CRISPR gRNA sequence
aaattcaaatcctttgggaa

SEQ ID NO: 177849 - DNA, 20 bp, Artificial
  CRISPR gRNA sequence
attcaaatcctttgggaagg

SEQ ID NO: 177850 - DNA, 20 bp, Artificial
  CRISPR gRNA sequence
ttcaaatcctttgggaaggg

SEQ ID NO: 177851 - DNA, 20 bp, Artificial
  CRISPR gRNA sequence
tcaaatcctttgggaaggga

SEQ ID NO: 177852 - DNA, 20 bp, Artificial
  CRISPR gRNA sequence
gacttcttttgcttgatgcc

SEQ ID NO: 177853 - DNA, 20 bp, Artificial
  CRISPR gRNA sequence
ttcttttgcttgatgccaag

SEQ ID NO: 177854 - DNA, 20 bp, Artificial
  CRISPR gRNA sequence
agaagaaattcccttgactt

SEQ ID NO: 177855 - DNA, 20 bp, Artificial
  CRISPR gRNA sequence
ttgacttgagttgtaaccac

SEQ ID NO: 177856 - DNA, 20 bp, Artificial
  CRISPR gRNA sequence
cttgagttgtaaccactagc

SEQ ID NO: 177857 - DNA, 20 bp, Artificial
  CRISPR gRNA sequence
gttgtaaccactagctagca

SEQ ID NO: 177858 - DNA, 20 bp, Artificial
  CRISPR gRNA sequence
ttgtaaccactagctagcaa

SEQ ID NO: 177859 - DNA, 20 bp, Artificial
  CRISPR gRNA sequence
tgtaaccactagctagcaaa

SEQ ID NO: 177860 - DNA, 20 bp, Artificial
  CRISPR gRNA sequence
accactagctagcaaagggc

SEQ ID NO: 177861 - DNA, 20 bp, Artificial
  CRISPR gRNA sequence
gggctagccgtcaccctgaa

SEQ ID NO: 177862 - DNA, 20 bp, Artificial
  CRISPR gRNA sequence
tccattctacgccttcctga

SEQ ID NO: 177863 - DNA, 20 bp, Artificial
  CRISPR gRNA sequence
ctacgccttcctgacagcca

SEQ ID NO: 177864 - DNA, 20 bp, Artificial
  CRISPR gRNA sequence
gccacagcgcccacaacgct

SEQ ID NO: 177865 - DNA, 20 bp, Artificial
  CRISPR gRNA sequence
agcgcccacaacgctaagac

SEQ ID NO: 177866 - DNA, 20 bp, Artificial
  CRISPR gRNA sequence
gcgcccacaacgctaagacc

SEQ ID NO: 177867 - DNA, 20 bp, Artificial
  CRISPR gRNA sequence
gaccaggacgctaacccttc

SEQ ID NO: 177868 - DNA, 20 bp, Artificial
  CRISPR gRNA sequence
ggacgctaacccttccggcc

SEQ ID NO: 177869 - DNA, 20 bp, Artificial
  CRISPR gRNA sequence
cggcccggtttcccctcctc

SEQ ID NO: 177870 - DNA, 20 bp, Artificial
  CRISPR gRNA sequence
gcccggtttcccctcctctg

SEQ ID NO: 177871 - DNA, 20 bp, Artificial
  CRISPR gRNA sequence
cggtttcccctcctctggag

SEQ ID NO: 177872 - DNA, 20 bp, Artificial
  CRISPR gRNA sequence
tttcccctcctctggagaag

SEQ ID NO: 177873 - DNA, 20 bp, Artificial
  CRISPR gRNA sequence
ctcctctggagaagtggccc

SEQ ID NO: 177874 - DNA, 20 bp, Artificial
  CRISPR gRNA sequence
tcctctggagaagtggccca

SEQ ID NO: 177875 - DNA, 20 bp, Artificial
  CRISPR gRNA sequence
agtggcccaaggaacacctg

SEQ ID NO: 177876 - DNA, 20 bp, Artificial
  CRISPR gRNA sequence
acctgtggcgcctcttcccg

SEQ ID NO: 177877 - DNA, 20 bp, Artificial
  CRISPR gRNA sequence
gcctcttcccgcagtctccg

SEQ ID NO: 177878 - DNA, 20 bp, Artificial
  CRISPR gRNA sequence
cctcttcccgcagtctccgt

SEQ ID NO: 177879 - DNA, 20 bp, Artificial
  CRISPR gRNA sequence
ccgtaggtcacgattccctc

SEQ ID NO: 177880 - DNA, 20 bp, Artificial
  CRISPR gRNA sequence
cacgattccctccagccacc

SEQ ID NO: 177881 - DNA, 20 bp, Artificial
  CRISPR gRNA sequence
acgattccctccagccacct

SEQ ID NO: 177882 - DNA, 20 bp, Artificial
  CRISPR gRNA sequence
attccctccagccacctggg

SEQ ID NO: 177883 - DNA, 20 bp, Artificial
  CRISPR gRNA sequence
cctccagccacctgggcagt

SEQ ID NO: 177884 - DNA, 20 bp, Artificial
  CRISPR gRNA sequence
cagccacctgggcagtaagc

SEQ ID NO: 177885 - DNA, 20 bp, Artificial
  CRISPR gRNA sequence
agtaagccagcccttgccac

SEQ ID NO: 177886 - DNA, 20 bp, Artificial
  CRISPR gRNA sequence
gccagcccttgccaccagca

SEQ ID NO: 177887 - DNA, 20 bp, Artificial
  CRISPR gRNA sequence
ccagcccttgccaccagcac

SEQ ID NO: 177888 - DNA, 20 bp, Artificial
  CRISPR gRNA sequence
cagcccttgccaccagcaca

SEQ ID NO: 177889 - DNA, 20 bp, Artificial
  CRISPR gRNA sequence
gcccttgccaccagcacagg

SEQ ID NO: 177890 - DNA, 20 bp, Artificial
  CRISPR gRNA sequence
ggagcccaaaacctgtcgcc

SEQ ID NO: 177891 - DNA, 20 bp, Artificial
  CRISPR gRNA sequence
gagcccaaaacctgtcgcct

SEQ ID NO: 177892 - DNA, 20 bp, Artificial
  CRISPR gRNA sequence
caaaacctgtcgcctgggcg

SEQ ID NO: 177893 - DNA, 20 bp, Artificial
  CRISPR gRNA sequence
aaacctgtcgcctgggcgcg

SEQ ID NO: 177894 - DNA, 20 bp, Artificial
  CRISPR gRNA sequence
ctgtcgcctgggcgcggagc

SEQ ID NO: 177895 - DNA, 20 bp, Artificial
  CRISPR gRNA sequence
tgtcgcctgggcgcggagct

SEQ ID NO: 177896 - DNA, 20 bp, Artificial
  CRISPR gRNA sequence
cgcggagctgggaccgccga

SEQ ID NO: 177897 - DNA, 20 bp, Artificial
  CRISPR gRNA sequence
gagctgggaccgccgaaagc

SEQ ID NO: 177898 - DNA, 20 bp, Artificial
  CRISPR gRNA sequence
agctgggaccgccgaaagcc

SEQ ID NO: 177899 - DNA, 20 bp, Artificial
  CRISPR gRNA sequence
ctgggaccgccgaaagccgg

SEQ ID NO: 177900 - DNA, 20 bp, Artificial
  CRISPR gRNA sequence
ccgccgaaagccgggagcac

SEQ ID NO: 177901 - DNA, 20 bp, Artificial
  CRISPR gRNA sequence
cgccgaaagccgggagcact

SEQ ID NO: 177902 - DNA, 20 bp, Artificial
  CRISPR gRNA sequence
gagcactgggcgcccacgcg

SEQ ID NO: 177903 - DNA, 20 bp, Artificial
  CRISPR gRNA sequence
agcactgggcgcccacgcgt

SEQ ID NO: 177904 - DNA, 20 bp, Artificial
  CRISPR gRNA sequence
cccacgcgtgggctgacact

SEQ ID NO: 177905 - DNA, 20 bp, Artificial
  CRISPR gRNA sequence
gtgggctgacactcggtccc

SEQ ID NO: 177906 - DNA, 20 bp, Artificial
  CRISPR gRNA sequence
ctgacactcggtccccggca

SEQ ID NO: 177907 - DNA, 20 bp, Artificial
  CRISPR gRNA sequence
tcggtccccggcacggcgtg

SEQ ID NO: 177908 - DNA, 20 bp, Artificial
  CRISPR gRNA sequence
cggcacggcgtgtggatgcg

SEQ ID NO: 177909 - DNA, 20 bp, Artificial
  CRISPR gRNA sequence
ggcacggcgtgtggatgcgc

SEQ ID NO: 177910 - DNA, 20 bp, Artificial
  CRISPR gRNA sequence
gtggatgcgcgggacgaaca

SEQ ID NO: 177911 - DNA, 20 bp, Artificial
  CRISPR gRNA sequence
gatgcgcgggacgaacatag

SEQ ID NO: 177912 - DNA, 20 bp, Artificial
  CRISPR gRNA sequence
atgcgcgggacgaacatagc

SEQ ID NO: 177913 - DNA, 20 bp, Artificial
  CRISPR gRNA sequence
cgaacatagcgggccaccta

SEQ ID NO: 177914 - DNA, 20 bp, Artificial
  CRISPR gRNA sequence
gaacatagcgggccacctac

SEQ ID NO: 177915 - DNA, 20 bp, Artificial
  CRISPR gRNA sequence
gcgggccacctacaggcccc

SEQ ID NO: 177916 - DNA, 20 bp, Artificial
  CRISPR gRNA sequence
ggccacctacaggcccctgg

SEQ ID NO: 177917 - DNA, 20 bp, Artificial
  CRISPR gRNA sequence
ccctggcggctgcgcgcacg

SEQ ID NO: 177918 - DNA, 20 bp, Artificial
  CRISPR gRNA sequence
gcgcgcacgcagatctgcga

SEQ ID NO: 177919 - DNA, 20 bp, Artificial
  CRISPR gRNA sequence
cgcagatctgcgaaagctgc

SEQ ID NO: 177920 - DNA, 20 bp, Artificial
  CRISPR gRNA sequence
gcagatctgcgaaagctgcc

SEQ ID NO: 177921 - DNA, 20 bp, Artificial
  CRISPR gRNA sequence
ctgcgaaagctgccgggcgc

SEQ ID NO: 177922 - DNA, 20 bp, Artificial
  CRISPR gRNA sequence
cgaaagctgccgggcgccgg

SEQ ID NO: 177923 - DNA, 20 bp, Artificial
  CRISPR gRNA sequence
cgggcgccggcagcctcgtc

SEQ ID NO: 177924 - DNA, 20 bp, Artificial
  CRISPR gRNA sequence
gggcgccggcagcctcgtcc

SEQ ID NO: 177925 - DNA, 20 bp, Artificial
  CRISPR gRNA sequence
cgccggcagcctcgtccggg

SEQ ID NO: 177926 - DNA, 20 bp, Artificial
  CRISPR gRNA sequence
gccggcagcctcgtccgggt

SEQ ID NO: 177927 - DNA, 20 bp, Artificial
  CRISPR gRNA sequence
ggcagcctcgtccgggtggg

SEQ ID NO: 177928 - DNA, 20 bp, Artificial
  CRISPR gRNA sequence
gtcccgccctccccgcgccg

SEQ ID NO: 177929 - DNA, 20 bp, Artificial
  CRISPR gRNA sequence
cctccccgcgccgcggcccg

SEQ ID NO: 177930 - DNA, 20 bp, Artificial
  CRISPR gRNA sequence
gcgccgcggcccgcggctcg

SEQ ID NO: 177931 - DNA, 20 bp, Artificial
  CRISPR gRNA sequence
cccgcggctcgcagctcctc

SEQ ID NO: 177932 - DNA, 20 bp, Artificial
  CRISPR gRNA sequence
gcagctcctccggcgccccc

SEQ ID NO: 177933 - DNA, 20 bp, Artificial
  CRISPR gRNA sequence
agctcctccggcgccccccg

SEQ ID NO: 177934 - DNA, 20 bp, Artificial
  CRISPR gRNA sequence
ggcgccccccggagcccgcg

SEQ ID NO: 177935 - DNA, 20 bp, Artificial
  CRISPR gRNA sequence
cgccccccggagcccgcgcg

SEQ ID NO: 177936 - DNA, 20 bp, Artificial
  CRISPR gRNA sequence
gccccccggagcccgcgcgg

SEQ ID NO: 177937 - DNA, 20 bp, Artificial
  CRISPR gRNA sequence
ccggagcccgcgcggaggcc

SEQ ID NO: 177938 - DNA, 20 bp, Artificial
  CRISPR gRNA sequence
cggagcccgcgcggaggccc

SEQ ID NO: 177939 - DNA, 20 bp, Artificial
  CRISPR gRNA sequence
gcccgggcaacgccgcgcgc

SEQ ID NO: 177940 - DNA, 20 bp, Artificial
  CRISPR gRNA sequence
gggcaacgccgcgcgccggc

SEQ ID NO: 177941 - DNA, 20 bp, Artificial
  CRISPR gRNA sequence
gccgcgcgccggcgagtctc

SEQ ID NO: 177942 - DNA, 20 bp, Artificial
  CRISPR gRNA sequence
gcgccggcgagtctccagcc

SEQ ID NO: 177943 - DNA, 20 bp, Artificial
  CRISPR gRNA sequence
gccggcgagtctccagcctg

SEQ ID NO: 177944 - DNA, 20 bp, Artificial
  CRISPR gRNA sequence
gctttcgaccccccacttcc

SEQ ID NO: 177945 - DNA, 20 bp, Artificial
  CRISPR gRNA sequence
cgccttttattcgacgccgc

SEQ ID NO: 177946 - DNA, 20 bp, Artificial
  CRISPR gRNA sequence
cgccggtgccccgcgcctca

SEQ ID NO: 177947 - DNA, 20 bp, Artificial
  CRISPR gRNA sequence
gccggtgccccgcgcctcaa

SEQ ID NO: 177948 - DNA, 20 bp, Artificial
  CRISPR gRNA sequence
aggcgtactcacctctgctg

SEQ ID NO: 177949 - DNA, 20 bp, Artificial
  CRISPR gRNA sequence
ggcgtactcacctctgctgc

SEQ ID NO: 177950 - DNA, 20 bp, Artificial
  CRISPR gRNA sequence
cgtactcacctctgctgcag

SEQ ID NO: 177951 - DNA, 20 bp, Artificial
  CRISPR gRNA sequence
cctctgctgcaggagcgatt

SEQ ID NO: 177952 - DNA, 20 bp, Artificial
  CRISPR gRNA sequence
ctgctgcaggagcgattcgg

SEQ ID NO: 177953 - DNA, 20 bp, Artificial
  CRISPR gRNA sequence
gcgattcggcggtcgcgcgc

SEQ ID NO: 177954 - DNA, 20 bp, Artificial
  CRISPR gRNA sequence
cgattcggcggtcgcgcgcg

SEQ ID NO: 177955 - DNA, 20 bp, Artificial
  CRISPR gRNA sequence
gattcggcggtcgcgcgcga

SEQ ID NO: 177956 - DNA, 20 bp, Artificial
  CRISPR gRNA sequence
gcggtcgcgcgcgagggtcc

SEQ ID NO: 177957 - DNA, 20 bp, Artificial
  CRISPR gRNA sequence
gcgcgagggtcccggcgacg

SEQ ID NO: 177958 - DNA, 20 bp, Artificial
  CRISPR gRNA sequence
cgcgagggtcccggcgacgc

SEQ ID NO: 177959 - DNA, 20 bp, Artificial
  CRISPR gRNA sequence
gcgagggtcccggcgacgca

SEQ ID NO: 177960 - DNA, 20 bp, Artificial
  CRISPR gRNA sequence
cgagggtcccggcgacgcag

SEQ ID NO: 177961 - DNA, 20 bp, Artificial
  CRISPR gRNA sequence
tcccggcgacgcaggggctg

SEQ ID NO: 177962 - DNA, 20 bp, Artificial
  CRISPR gRNA sequence
ggcgacgcaggggctgcagt

SEQ ID NO: 177963 - DNA, 20 bp, Artificial
  CRISPR gRNA sequence
gcgacgcaggggctgcagtg

SEQ ID NO: 177964 - DNA, 20 bp, Artificial
  CRISPR gRNA sequence
cgacgcaggggctgcagtga

SEQ ID NO: 177965 - DNA, 20 bp, Artificial
  CRISPR gRNA sequence
ggggctgcagtgagggcgcg

SEQ ID NO: 177966 - DNA, 20 bp, Artificial
  CRISPR gRNA sequence
ggctgcagtgagggcgcgcg

SEQ ID NO: 177967 - DNA, 20 bp, Artificial
  CRISPR gRNA sequence
ggcgcgcggagcgcgactcc

SEQ ID NO: 177968 - DNA, 20 bp, Artificial
  CRISPR gRNA sequence
gcgcggagcgcgactccgag

SEQ ID NO: 177969 - DNA, 20 bp, Artificial
  CRISPR gRNA sequence
cggagcgcgactccgagtgg

SEQ ID NO: 177970 - DNA, 20 bp, Artificial
  CRISPR gRNA sequence
gagcgcgactccgagtggaa

SEQ ID NO: 177971 - DNA, 20 bp, Artificial
  CRISPR gRNA sequence
agcgcgactccgagtggaag

SEQ ID NO: 177972 - DNA, 20 bp, Artificial
  CRISPR gRNA sequence
gcgcgactccgagtggaaga

SEQ ID NO: 177973 - DNA, 20 bp, Artificial
  CRISPR gRNA sequence
cgactccgagtggaagaggg

SEQ ID NO: 177974 - DNA, 20 bp, Artificial
  CRISPR gRNA sequence
ctccgagtggaagagggaag

SEQ ID NO: 177975 - DNA, 20 bp, Artificial
  CRISPR gRNA sequence
tccgagtggaagagggaaga

SEQ ID NO: 177976 - DNA, 20 bp, Artificial
  CRISPR gRNA sequence
gagtggaagagggaagaagg

SEQ ID NO: 177977 - DNA, 20 bp, Artificial
  CRISPR gRNA sequence
gtggaagagggaagaaggca

SEQ ID NO: 177978 - DNA, 20 bp, Artificial
  CRISPR gRNA sequence
tggaagagggaagaaggcag

SEQ ID NO: 177979 - DNA, 20 bp, Artificial
  CRISPR gRNA sequence
gggaagaaggcagaggttgc

SEQ ID NO: 177980 - DNA, 20 bp, Artificial
  CRISPR gRNA sequence
ggaagaaggcagaggttgcc

SEQ ID NO: 177981 - DNA, 20 bp, Artificial
  CRISPR gRNA sequence
gcagaggttgccgggttctt

SEQ ID NO: 177982 - DNA, 20 bp, Artificial
  CRISPR gRNA sequence
cagaggttgccgggttctta

SEQ ID NO: 177983 - DNA, 20 bp, Artificial
  CRISPR gRNA sequence
tgccgggttcttaaggccgc

SEQ ID NO: 177984 - DNA, 20 bp, Artificial
  CRISPR gRNA sequence
gccgggttcttaaggccgcc

SEQ ID NO: 177985 - DNA, 20 bp, Artificial
  CRISPR gRNA sequence
gttcttaaggccgccgggca

SEQ ID NO: 177986 - DNA, 20 bp, Artificial
  CRISPR gRNA sequence
ttaaggccgccgggcacggc

SEQ ID NO: 177987 - DNA, 20 bp, Artificial
  CRISPR gRNA sequence
gccgccgggcacggccggcg

SEQ ID NO: 177988 - DNA, 20 bp, Artificial
  CRISPR gRNA sequence
cgggcacggccggcgtggac

SEQ ID NO: 177989 - DNA, 20 bp, Artificial
  CRISPR gRNA sequence
gggcacggccggcgtggact

SEQ ID NO: 177990 - DNA, 20 bp, Artificial
  CRISPR gRNA sequence
cggccggcgtggactgggca

SEQ ID NO: 177991 - DNA, 20 bp, Artificial
  CRISPR gRNA sequence
gcgtggactgggcacggctc

SEQ ID NO: 177992 - DNA, 20 bp, Artificial
  CRISPR gRNA sequence
cgtggactgggcacggctcc

SEQ ID NO: 177993 - DNA, 20 bp, Artificial
  CRISPR gRNA sequence
ggactgggcacggctccggg

SEQ ID NO: 177994 - DNA, 20 bp, Artificial
  CRISPR gRNA sequence
ggcacggctccgggtggcct

SEQ ID NO: 177995 - DNA, 20 bp, Artificial
  CRISPR gRNA sequence
ggctccgggtggcctcggtt

SEQ ID NO: 177996 - DNA, 20 bp, Artificial
  CRISPR gRNA sequence
tccgggtggcctcggttcgg

SEQ ID NO: 177997 - DNA, 20 bp, Artificial
  CRISPR gRNA sequence
ccgggtggcctcggttcggc

SEQ ID NO: 177998 - DNA, 20 bp, Artificial
  CRISPR gRNA sequence
cgggtggcctcggttcggcg

SEQ ID NO: 177999 - DNA, 20 bp, Artificial
  CRISPR gRNA sequence
ggcctcggttcggcggggct

SEQ ID NO: 178000 - DNA, 20 bp, Artificial
  CRISPR gRNA sequence
gcctcggttcggcggggctc

SEQ ID NO: 178001 - DNA, 20 bp, Artificial
  CRISPR gRNA sequence
gcgcacgtcttgcctcgact

SEQ ID NO: 178002 - DNA, 20 bp, Artificial
  CRISPR gRNA sequence
cgcacgtcttgcctcgacta

SEQ ID NO: 178003 - DNA, 20 bp, Artificial
  CRISPR gRNA sequence
cacgtcttgcctcgactaag

SEQ ID NO: 178004 - DNA, 20 bp, Artificial
  CRISPR gRNA sequence
gtcttgcctcgactaaggag

SEQ ID NO: 178005 - DNA, 20 bp, Artificial
  CRISPR gRNA sequence
tgcctcgactaaggagtggc

SEQ ID NO: 178006 - DNA, 20 bp, Artificial
  CRISPR gRNA sequence
taaggagtggcgagctctgc

SEQ ID NO: 178007 - DNA, 20 bp, Artificial
  CRISPR gRNA sequence
aaggagtggcgagctctgcc

SEQ ID NO: 178008 - DNA, 20 bp, Artificial
  CRISPR gRNA sequence
aggagtggcgagctctgcca

SEQ ID NO: 178009 - DNA, 20 bp, Artificial
  CRISPR gRNA sequence
agtggcgagctctgccaggg

SEQ ID NO: 178010 - DNA, 20 bp, Artificial
  CRISPR gRNA sequence
ggcgagctctgccagggcag

SEQ ID NO: 178011 - DNA, 20 bp, Artificial
  CRISPR gRNA sequence
gccagggcagcggcgccacc

SEQ ID NO: 178012 - DNA, 20 bp, Artificial
  CRISPR gRNA sequence
caccgagcaatccaaacact

SEQ ID NO: 178013 - DNA, 20 bp, Artificial
  CRISPR gRNA sequence
cgagcaatccaaacacttag

SEQ ID NO: 178014 - DNA, 20 bp, Artificial
  CRISPR gRNA sequence
gagcaatccaaacacttagc

SEQ ID NO: 178015 - DNA, 20 bp, Artificial
  CRISPR gRNA sequence
aaacacttagcgggattccc

SEQ ID NO: 178016 - DNA, 20 bp, Artificial
  CRISPR gRNA sequence
ttagcgggattccccagccc

SEQ ID NO: 178017 - DNA, 20 bp, Artificial
  CRISPR gRNA sequence
cgggattccccagccctggc

SEQ ID NO: 178018 - DNA, 20 bp, Artificial
  CRISPR gRNA sequence
gccctggccggccccgcccc

SEQ ID NO: 178019 - DNA, 20 bp, Artificial
  CRISPR gRNA sequence
tggccggccccgcccccgga

SEQ ID NO: 178020 - DNA, 20 bp, Artificial
  CRISPR gRNA sequence
cccgcccccggacagccgcg

SEQ ID NO: 178021 - DNA, 20 bp, Artificial
  CRISPR gRNA sequence
ccgcccccggacagccgcgc

SEQ ID NO: 178022 - DNA, 20 bp, Artificial
  CRISPR gRNA sequence
acagccgcgcgggcgcccat

SEQ ID NO: 178023 - DNA, 20 bp, Artificial
  CRISPR gRNA sequence
tgggcgcccgcgcggctgtc

SEQ ID NO: 178024 - DNA, 20 bp, Artificial
  CRISPR gRNA sequence
gggcgcccgcgcggctgtcc

SEQ ID NO: 178025 - DNA, 20 bp, Artificial
  CRISPR gRNA sequence
ggcgcccgcgcggctgtccg

SEQ ID NO: 178026 - DNA, 20 bp, Artificial
  CRISPR gRNA sequence
gcgcccgcgcggctgtccgg

SEQ ID NO: 178027 - DNA, 20 bp, Artificial
  CRISPR gRNA sequence
cccgcgcggctgtccggggg

SEQ ID NO: 178028 - DNA, 20 bp, Artificial
  CRISPR gRNA sequence
ccgcgcggctgtccgggggc

SEQ ID NO: 178029 - DNA, 20 bp, Artificial
  CRISPR gRNA sequence
cgcgcggctgtccgggggcg

SEQ ID NO: 178030 - DNA, 20 bp, Artificial
  CRISPR gRNA sequence
cggctgtccgggggcggggc

SEQ ID NO: 178031 - DNA, 20 bp, Artificial
  CRISPR gRNA sequence
tgtccgggggcggggccggc

SEQ ID NO: 178032 - DNA, 20 bp, Artificial
  CRISPR gRNA sequence
gtccgggggcggggccggcc

SEQ ID NO: 178033 - DNA, 20 bp, Artificial
  CRISPR gRNA sequence
tccgggggcggggccggcca

SEQ ID NO: 178034 - DNA, 20 bp, Artificial
  CRISPR gRNA sequence
ggggcggggccggccagggc

SEQ ID NO: 178035 - DNA, 20 bp, Artificial
  CRISPR gRNA sequence
gggcggggccggccagggct

SEQ ID NO: 178036 - DNA, 20 bp, Artificial
  CRISPR gRNA sequence
ggcggggccggccagggctg

SEQ ID NO: 178037 - DNA, 20 bp, Artificial
  CRISPR gRNA sequence
cagggctggggaatcccgct

SEQ ID NO: 178038 - DNA, 20 bp, Artificial
  CRISPR gRNA sequence
ggggaatcccgctaagtgtt

SEQ ID NO: 178039 - DNA, 20 bp, Artificial
  CRISPR gRNA sequence
cgctaagtgtttggattgct

SEQ ID NO: 178040 - DNA, 20 bp, Artificial
  CRISPR gRNA sequence
taagtgtttggattgctcgg

SEQ ID NO: 178041 - DNA, 20 bp, Artificial
  CRISPR gRNA sequence
gctcggtggcgccgctgccc

SEQ ID NO: 178042 - DNA, 20 bp, Artificial
  CRISPR gRNA sequence
cggtggcgccgctgccctgg

SEQ ID NO: 178043 - DNA, 20 bp, Artificial
  CRISPR gRNA sequence
gtggcgccgctgccctggca

SEQ ID NO: 178044 - DNA, 20 bp, Artificial
  CRISPR gRNA sequence
tggcagagctcgccactcct

SEQ ID NO: 178045 - DNA, 20 bp, Artificial
  CRISPR gRNA sequence
gagctcgccactccttagtc

SEQ ID NO: 178046 - DNA, 20 bp, Artificial
  CRISPR gRNA sequence
agctcgccactccttagtcg

SEQ ID NO: 178047 - DNA, 20 bp, Artificial
  CRISPR gRNA sequence
cgccactccttagtcgaggc

SEQ ID NO: 178048 - DNA, 20 bp, Artificial
  CRISPR gRNA sequence
tcgaggcaagacgtgcgccc

SEQ ID NO: 178049 - DNA, 20 bp, Artificial
  CRISPR gRNA sequence
cgcccgagccccgccgaacc

SEQ ID NO: 178050 - DNA, 20 bp, Artificial
  CRISPR gRNA sequence
gcccgagccccgccgaaccg

SEQ ID NO: 178051 - DNA, 20 bp, Artificial
  CRISPR gRNA sequence
cccgccgaaccgaggccacc

SEQ ID NO: 178052 - DNA, 20 bp, Artificial
  CRISPR gRNA sequence
cgccgaaccgaggccacccg

SEQ ID NO: 178053 - DNA, 20 bp, Artificial
  CRISPR gRNA sequence
aggccacccggagccgtgcc

SEQ ID NO: 178054 - DNA, 20 bp, Artificial
  CRISPR gRNA sequence
gagccgtgcccagtccacgc

SEQ ID NO: 178055 - DNA, 20 bp, Artificial
  CRISPR gRNA sequence
cagtccacgccggccgtgcc

SEQ ID NO: 178056 - DNA, 20 bp, Artificial
  CRISPR gRNA sequence
tccacgccggccgtgcccgg

SEQ ID NO: 178057 - DNA, 20 bp, Artificial
  CRISPR gRNA sequence
cggccgtgcccggcggcctt

SEQ ID NO: 178058 - DNA, 20 bp, Artificial
  CRISPR gRNA sequence
gcccggcggccttaagaacc

SEQ ID NO: 178059 - DNA, 20 bp, Artificial
  CRISPR gRNA sequence
gccttcttccctcttccact

SEQ ID NO: 178060 - DNA, 20 bp, Artificial
  CRISPR gRNA sequence
cttcttccctcttccactcg

SEQ ID NO: 178061 - DNA, 20 bp, Artificial
  CRISPR gRNA sequence
cgctccgcgcgccctcactg

SEQ ID NO: 178062 - DNA, 20 bp, Artificial
  CRISPR gRNA sequence
cactgcagcccctgcgtcgc

SEQ ID NO: 178063 - DNA, 20 bp, Artificial
  CRISPR gRNA sequence
actgcagcccctgcgtcgcc

SEQ ID NO: 178064 - DNA, 20 bp, Artificial
  CRISPR gRNA sequence
cgaccgccgaatcgctcctg

SEQ ID NO: 178065 - DNA, 20 bp, Artificial
  CRISPR gRNA sequence
ccgccgaatcgctcctgcag

SEQ ID NO: 178066 - DNA, 20 bp, Artificial
  CRISPR gRNA sequence
gccgaatcgctcctgcagca

SEQ ID NO: 178067 - DNA, 20 bp, Artificial
  CRISPR gRNA sequence
ccgaatcgctcctgcagcag

SEQ ID NO: 178068 - DNA, 20 bp, Artificial
  CRISPR gRNA sequence
atcgctcctgcagcagaggt

SEQ ID NO: 178069 - DNA, 20 bp, Artificial
  CRISPR gRNA sequence
gcagaggtgagtacgccttt

SEQ ID NO: 178070 - DNA, 20 bp, Artificial
  CRISPR gRNA sequence
cagaggtgagtacgcctttg

SEQ ID NO: 178071 - DNA, 20 bp, Artificial
  CRISPR gRNA sequence
gtgagtacgcctttgaggcg

SEQ ID NO: 178072 - DNA, 20 bp, Artificial
  CRISPR gRNA sequence
tgagtacgcctttgaggcgc

SEQ ID NO: 178073 - DNA, 20 bp, Artificial
  CRISPR gRNA sequence
gagtacgcctttgaggcgcg

SEQ ID NO: 178074 - DNA, 20 bp, Artificial
  CRISPR gRNA sequence
gcctttgaggcgcggggcac

SEQ ID NO: 178075 - DNA, 20 bp, Artificial
  CRISPR gRNA sequence
tttgaggcgcggggcaccgg

SEQ ID NO: 178076 - DNA, 20 bp, Artificial
  CRISPR gRNA sequence
gcaccggcggcgtcgaataa

SEQ ID NO: 178077 - DNA, 20 bp, Artificial
  CRISPR gRNA sequence
caccggcggcgtcgaataaa

SEQ ID NO: 178078 - DNA, 20 bp, Artificial
  CRISPR gRNA sequence
ggcgtcgaataaaaggcgcg

SEQ ID NO: 178079 - DNA, 20 bp, Artificial
  CRISPR gRNA sequence
gcgtcgaataaaaggcgcgc

SEQ ID NO: 178080 - DNA, 20 bp, Artificial
  CRISPR gRNA sequence
cgtcgaataaaaggcgcgcg

SEQ ID NO: 178081 - DNA, 20 bp, Artificial
  CRISPR gRNA sequence
ataaaaggcgcgcggggcac

SEQ ID NO: 178082 - DNA, 20 bp, Artificial
  CRISPR gRNA sequence
taaaaggcgcgcggggcacc

SEQ ID NO: 178083 - DNA, 20 bp, Artificial
  CRISPR gRNA sequence
aaggcgcgcggggcaccagg

SEQ ID NO: 178084 - DNA, 20 bp, Artificial
  CRISPR gRNA sequence
gcgcgcggggcaccaggaag

SEQ ID NO: 178085 - DNA, 20 bp, Artificial
  CRISPR gRNA sequence
cgcgcggggcaccaggaagt

SEQ ID NO: 178086 - DNA, 20 bp, Artificial
  CRISPR gRNA sequence
gcgcggggcaccaggaagtg

SEQ ID NO: 178087 - DNA, 20 bp, Artificial
  CRISPR gRNA sequence
cgcggggcaccaggaagtgg

SEQ ID NO: 178088 - DNA, 20 bp, Artificial
  CRISPR gRNA sequence
gcggggcaccaggaagtggg

SEQ ID NO: 178089 - DNA, 20 bp, Artificial
  CRISPR gRNA sequence
accaggaagtggggggtcga

SEQ ID NO: 178090 - DNA, 20 bp, Artificial
  CRISPR gRNA sequence
aagtggggggtcgaaagctc

SEQ ID NO: 178091 - DNA, 20 bp, Artificial
  CRISPR gRNA sequence
agtggggggtcgaaagctcc

SEQ ID NO: 178092 - DNA, 20 bp, Artificial
  CRISPR gRNA sequence
gggggtcgaaagctccaggc

SEQ ID NO: 178093 - DNA, 20 bp, Artificial
  CRISPR gRNA sequence
gggtcgaaagctccaggctg

SEQ ID NO: 178094 - DNA, 20 bp, Artificial
  CRISPR gRNA sequence
gctccaggctggagactcgc

SEQ ID NO: 178095 - DNA, 20 bp, Artificial
  CRISPR gRNA sequence
gctggagactcgccggcgcg

SEQ ID NO: 178096 - DNA, 20 bp, Artificial
  CRISPR gRNA sequence
cgccggcgcgcggcgttgcc

SEQ ID NO: 178097 - DNA, 20 bp, Artificial
  CRISPR gRNA sequence
gccggcgcgcggcgttgccc

SEQ ID NO: 178098 - DNA, 20 bp, Artificial
  CRISPR gRNA sequence
gcgttgcccgggcctccgcg

SEQ ID NO: 178099 - DNA, 20 bp, Artificial
  CRISPR gRNA sequence
cgttgcccgggcctccgcgc

SEQ ID NO: 178100 - DNA, 20 bp, Artificial
  CRISPR gRNA sequence
ccgggcctccgcgcgggctc

SEQ ID NO: 178101 - DNA, 20 bp, Artificial
  CRISPR gRNA sequence
cgggcctccgcgcgggctcc

SEQ ID NO: 178102 - DNA, 20 bp, Artificial
  CRISPR gRNA sequence
gggcctccgcgcgggctccg

SEQ ID NO: 178103 - DNA, 20 bp, Artificial
  CRISPR gRNA sequence
ggcctccgcgcgggctccgg

SEQ ID NO: 178104 - DNA, 20 bp, Artificial
  CRISPR gRNA sequence
gcctccgcgcgggctccggg

SEQ ID NO: 178105 - DNA, 20 bp, Artificial
  CRISPR gRNA sequence
gcgcgggctccggggggcgc

SEQ ID NO: 178106 - DNA, 20 bp, Artificial
  CRISPR gRNA sequence
gcgggctccggggggcgccg

SEQ ID NO: 178107 - DNA, 20 bp, Artificial
  CRISPR gRNA sequence
cgggctccggggggcgccgg

SEQ ID NO: 178108 - DNA, 20 bp, Artificial
  CRISPR gRNA sequence
ggctccggggggcgccggag

SEQ ID NO: 178109 - DNA, 20 bp, Artificial
  CRISPR gRNA sequence
gggggcgccggaggagctgc

SEQ ID NO: 178110 - DNA, 20 bp, Artificial
  CRISPR gRNA sequence
gccggaggagctgcgagccg

SEQ ID NO: 178111 - DNA, 20 bp, Artificial
  CRISPR gRNA sequence
ccggaggagctgcgagccgc

SEQ ID NO: 178112 - DNA, 20 bp, Artificial
  CRISPR gRNA sequence
gagctgcgagccgcgggccg

SEQ ID NO: 178113 - DNA, 20 bp, Artificial
  CRISPR gRNA sequence
gcgagccgcgggccgcggcg

SEQ ID NO: 178114 - DNA, 20 bp, Artificial
  CRISPR gRNA sequence
cgagccgcgggccgcggcgc

SEQ ID NO: 178115 - DNA, 20 bp, Artificial
  CRISPR gRNA sequence
gagccgcgggccgcggcgcg

SEQ ID NO: 178116 - DNA, 20 bp, Artificial
  CRISPR gRNA sequence
gccgcgggccgcggcgcggg

SEQ ID NO: 178117 - DNA, 20 bp, Artificial
  CRISPR gRNA sequence
ccgcgggccgcggcgcgggg

SEQ ID NO: 178118 - DNA, 20 bp, Artificial
  CRISPR gRNA sequence
cgcgggccgcggcgcgggga

SEQ ID NO: 178119 - DNA, 20 bp, Artificial
  CRISPR gRNA sequence
gggccgcggcgcggggaggg

SEQ ID NO: 178120 - DNA, 20 bp, Artificial
  CRISPR gRNA sequence
ggccgcggcgcggggagggc

SEQ ID NO: 178121 - DNA, 20 bp, Artificial
  CRISPR gRNA sequence
ggcgcggggagggcgggacg

SEQ ID NO: 178122 - DNA, 20 bp, Artificial
  CRISPR gRNA sequence
ggggagggcgggacgcggcg

SEQ ID NO: 178123 - DNA, 20 bp, Artificial
  CRISPR gRNA sequence
cgcggcgtggaccgcccacc

SEQ ID NO: 178124 - DNA, 20 bp, Artificial
  CRISPR gRNA sequence
cgtggaccgcccacccggac

SEQ ID NO: 178125 - DNA, 20 bp, Artificial
  CRISPR gRNA sequence
gtggaccgcccacccggacg

SEQ ID NO: 178126 - DNA, 20 bp, Artificial
  CRISPR gRNA sequence
gcccacccggacgaggctgc

SEQ ID NO: 178127 - DNA, 20 bp, Artificial
  CRISPR gRNA sequence
cggacgaggctgccggcgcc

SEQ ID NO: 178128 - DNA, 20 bp, Artificial
  CRISPR gRNA sequence
acgaggctgccggcgcccgg

SEQ ID NO: 178129 - DNA, 20 bp, Artificial
  CRISPR gRNA sequence
ccggcgcccggcagctttcg

SEQ ID NO: 178130 - DNA, 20 bp, Artificial
  CRISPR gRNA sequence
ttcgcagatctgcgtgcgcg

SEQ ID NO: 178131 - DNA, 20 bp, Artificial
  CRISPR gRNA sequence
atctgcgtgcgcgcagccgc

SEQ ID NO: 178132 - DNA, 20 bp, Artificial
  CRISPR gRNA sequence
tctgcgtgcgcgcagccgcc

SEQ ID NO: 178133 - DNA, 20 bp, Artificial
  CRISPR gRNA sequence
ctgcgtgcgcgcagccgcca

SEQ ID NO: 178134 - DNA, 20 bp, Artificial
  CRISPR gRNA sequence
tgcgtgcgcgcagccgccag

SEQ ID NO: 178135 - DNA, 20 bp, Artificial
  CRISPR gRNA sequence
gcgcagccgccaggggcctg

SEQ ID NO: 178136 - DNA, 20 bp, Artificial
  CRISPR gRNA sequence
cgcagccgccaggggcctgt

SEQ ID NO: 178137 - DNA, 20 bp, Artificial
  CRISPR gRNA sequence
agccgccaggggcctgtagg

SEQ ID NO: 178138 - DNA, 20 bp, Artificial
  CRISPR gRNA sequence
cgcgcatccacacgccgtgc

SEQ ID NO: 178139 - DNA, 20 bp, Artificial
  CRISPR gRNA sequence
gcgcatccacacgccgtgcc

SEQ ID NO: 178140 - DNA, 20 bp, Artificial
  CRISPR gRNA sequence
cgcatccacacgccgtgccg

SEQ ID NO: 178141 - DNA, 20 bp, Artificial
  CRISPR gRNA sequence
cacacgccgtgccggggacc

SEQ ID NO: 178142 - DNA, 20 bp, Artificial
  CRISPR gRNA sequence
ccgtgccggggaccgagtgt

SEQ ID NO: 178143 - DNA, 20 bp, Artificial
  CRISPR gRNA sequence
accgagtgtcagcccacgcg

SEQ ID NO: 178144 - DNA, 20 bp, Artificial
  CRISPR gRNA sequence
ccgagtgtcagcccacgcgt

SEQ ID NO: 178145 - DNA, 20 bp, Artificial
  CRISPR gRNA sequence
tcagcccacgcgtgggcgcc

SEQ ID NO: 178146 - DNA, 20 bp, Artificial
  CRISPR gRNA sequence
gcgtgggcgcccagtgctcc

SEQ ID NO: 178147 - DNA, 20 bp, Artificial
  CRISPR gRNA sequence
cgcccagtgctcccggcttt

SEQ ID NO: 178148 - DNA, 20 bp, Artificial
  CRISPR gRNA sequence
ccagtgctcccggctttcgg

SEQ ID NO: 178149 - DNA, 20 bp, Artificial
  CRISPR gRNA sequence
ctcccggctttcggcggtcc

SEQ ID NO: 178150 - DNA, 20 bp, Artificial
  CRISPR gRNA sequence
ggcggtcccagctccgcgcc

SEQ ID NO: 178151 - DNA, 20 bp, Artificial
  CRISPR gRNA sequence
gcggtcccagctccgcgccc

SEQ ID NO: 178152 - DNA, 20 bp, Artificial
  CRISPR gRNA sequence
ccagctccgcgcccaggcga

SEQ ID NO: 178153 - DNA, 20 bp, Artificial
  CRISPR gRNA sequence
cagctccgcgcccaggcgac

SEQ ID NO: 178154 - DNA, 20 bp, Artificial
  CRISPR gRNA sequence
cgcgcccaggcgacaggttt

SEQ ID NO: 178155 - DNA, 20 bp, Artificial
  CRISPR gRNA sequence
gcgcccaggcgacaggtttt

SEQ ID NO: 178156 - DNA, 20 bp, Artificial
  CRISPR gRNA sequence
aggttttgggctccctgtgc

SEQ ID NO: 178157 - DNA, 20 bp, Artificial
  CRISPR gRNA sequence
ttttgggctccctgtgctgg

SEQ ID NO: 178158 - DNA, 20 bp, Artificial
  CRISPR gRNA sequence
gggctccctgtgctggtggc

SEQ ID NO: 178159 - DNA, 20 bp, Artificial
  CRISPR gRNA sequence
ggctccctgtgctggtggca

SEQ ID NO: 178160 - DNA, 20 bp, Artificial
  CRISPR gRNA sequence
gctccctgtgctggtggcaa

SEQ ID NO: 178161 - DNA, 20 bp, Artificial
  CRISPR gRNA sequence
cctgtgctggtggcaagggc

SEQ ID NO: 178162 - DNA, 20 bp, Artificial
  CRISPR gRNA sequence
gcaagggctggcttactgcc

SEQ ID NO: 178163 - DNA, 20 bp, Artificial
  CRISPR gRNA sequence
caagggctggcttactgccc

SEQ ID NO: 178164 - DNA, 20 bp, Artificial
  CRISPR gRNA sequence
gggctggcttactgcccagg

SEQ ID NO: 178165 - DNA, 20 bp, Artificial
  CRISPR gRNA sequence
tggcttactgcccaggtggc

SEQ ID NO: 178166 - DNA, 20 bp, Artificial
  CRISPR gRNA sequence
gcttactgcccaggtggctg

SEQ ID NO: 178167 - DNA, 20 bp, Artificial
  CRISPR gRNA sequence
cttactgcccaggtggctgg

SEQ ID NO: 178168 - DNA, 20 bp, Artificial
  CRISPR gRNA sequence
ttactgcccaggtggctgga

SEQ ID NO: 178169 - DNA, 20 bp, Artificial
  CRISPR gRNA sequence
ctggagggaatcgtgaccta

SEQ ID NO: 178170 - DNA, 20 bp, Artificial
  CRISPR gRNA sequence
ggagggaatcgtgacctacg

SEQ ID NO: 178171 - DNA, 20 bp, Artificial
  CRISPR gRNA sequence
atcgtgacctacggagactg

SEQ ID NO: 178172 - DNA, 20 bp, Artificial
  CRISPR gRNA sequence
tcgtgacctacggagactgc

SEQ ID NO: 178173 - DNA, 20 bp, Artificial
  CRISPR gRNA sequence
tgacctacggagactgcggg

SEQ ID NO: 178174 - DNA, 20 bp, Artificial
  CRISPR gRNA sequence
acctacggagactgcgggaa

SEQ ID NO: 178175 - DNA, 20 bp, Artificial
  CRISPR gRNA sequence
cctacggagactgcgggaag

SEQ ID NO: 178176 - DNA, 20 bp, Artificial
  CRISPR gRNA sequence
gactgcgggaagaggcgcca

SEQ ID NO: 178177 - DNA, 20 bp, Artificial
  CRISPR gRNA sequence
actgcgggaagaggcgccac

SEQ ID NO: 178178 - DNA, 20 bp, Artificial
  CRISPR gRNA sequence
gaggcgccacaggtgttcct

SEQ ID NO: 178179 - DNA, 20 bp, Artificial
  CRISPR gRNA sequence
aggcgccacaggtgttcctt

SEQ ID NO: 178180 - DNA, 20 bp, Artificial
  CRISPR gRNA sequence
tgttccttgggccacttctc

SEQ ID NO: 178181 - DNA, 20 bp, Artificial
  CRISPR gRNA sequence
ttccttgggccacttctcca

SEQ ID NO: 178182 - DNA, 20 bp, Artificial
  CRISPR gRNA sequence
tccttgggccacttctccag

SEQ ID NO: 178183 - DNA, 20 bp, Artificial
  CRISPR gRNA sequence
cttgggccacttctccagag

SEQ ID NO: 178184 - DNA, 20 bp, Artificial
  CRISPR gRNA sequence
ttgggccacttctccagagg

SEQ ID NO: 178185 - DNA, 20 bp, Artificial
  CRISPR gRNA sequence
tgggccacttctccagagga

SEQ ID NO: 178186 - DNA, 20 bp, Artificial
  CRISPR gRNA sequence
gggccacttctccagaggag

SEQ ID NO: 178187 - DNA, 20 bp, Artificial
  CRISPR gRNA sequence
ttctccagaggaggggaaac

SEQ ID NO: 178188 - DNA, 20 bp, Artificial
  CRISPR gRNA sequence
tctccagaggaggggaaacc

SEQ ID NO: 178189 - DNA, 20 bp, Artificial
  CRISPR gRNA sequence
cagaggaggggaaaccgggc

SEQ ID NO: 178190 - DNA, 20 bp, Artificial
  CRISPR gRNA sequence
aggaggggaaaccgggccgg

SEQ ID NO: 178191 - DNA, 20 bp, Artificial
  CRISPR gRNA sequence
ggaggggaaaccgggccgga

SEQ ID NO: 178192 - DNA, 20 bp, Artificial
  CRISPR gRNA sequence
gaggggaaaccgggccggaa

SEQ ID NO: 178193 - DNA, 20 bp, Artificial
  CRISPR gRNA sequence
ggaaaccgggccggaagggt

SEQ ID NO: 178194 - DNA, 20 bp, Artificial
  CRISPR gRNA sequence
ggccggaagggttagcgtcc

SEQ ID NO: 178195 - DNA, 20 bp, Artificial
  CRISPR gRNA sequence
aagggttagcgtcctggtct

SEQ ID NO: 178196 - DNA, 20 bp, Artificial
  CRISPR gRNA sequence
gcgtcctggtcttagcgttg

SEQ ID NO: 178197 - DNA, 20 bp, Artificial
  CRISPR gRNA sequence
cgtcctggtcttagcgttgt

SEQ ID NO: 178198 - DNA, 20 bp, Artificial
  CRISPR gRNA sequence
tcttagcgttgtgggcgctg

SEQ ID NO: 178199 - DNA, 20 bp, Artificial
  CRISPR gRNA sequence
gttgtgggcgctgtggctgt

SEQ ID NO: 178200 - DNA, 20 bp, Artificial
  CRISPR gRNA sequence
ttgtgggcgctgtggctgtc

SEQ ID NO: 178201 - DNA, 20 bp, Artificial
  CRISPR gRNA sequence
tgggcgctgtggctgtcagg

SEQ ID NO: 178202 - DNA, 20 bp, Artificial
  CRISPR gRNA sequence
gggcgctgtggctgtcagga

SEQ ID NO: 178203 - DNA, 20 bp, Artificial
  CRISPR gRNA sequence
ctgtggctgtcaggaaggcg

SEQ ID NO: 178204 - DNA, 20 bp, Artificial
  CRISPR gRNA sequence
gctgtcaggaaggcgtagaa

SEQ ID NO: 178205 - DNA, 20 bp, Artificial
  CRISPR gRNA sequence
aggaaggcgtagaatggatt

SEQ ID NO: 178206 - DNA, 20 bp, Artificial
  CRISPR gRNA sequence
ggaaggcgtagaatggattc

SEQ ID NO: 178207 - DNA, 20 bp, Artificial
  CRISPR gRNA sequence
gaaggcgtagaatggattca

SEQ ID NO: 178208 - DNA, 20 bp, Artificial
  CRISPR gRNA sequence
aaggcgtagaatggattcag

SEQ ID NO: 178209 - DNA, 20 bp, Artificial
  CRISPR gRNA sequence
aggcgtagaatggattcagg

SEQ ID NO: 178210 - DNA, 20 bp, Artificial
  CRISPR gRNA sequence
ggcgtagaatggattcaggg

SEQ ID NO: 178211 - DNA, 20 bp, Artificial
  CRISPR gRNA sequence
gtagaatggattcagggggg

SEQ ID NO: 178212 - DNA, 20 bp, Artificial
  CRISPR gRNA sequence
tagaatggattcaggggggc

SEQ ID NO: 178213 - DNA, 20 bp, Artificial
  CRISPR gRNA sequence
gaatggattcaggggggcgg

SEQ ID NO: 178214 - DNA, 20 bp, Artificial
  CRISPR gRNA sequence
aatggattcaggggggcggg

SEQ ID NO: 178215 - DNA, 20 bp, Artificial
  CRISPR gRNA sequence
atggattcaggggggcggga

SEQ ID NO: 178216 - DNA, 20 bp, Artificial
  CRISPR gRNA sequence
tggattcaggggggcgggag

SEQ ID NO: 178217 - DNA, 20 bp, Artificial
  CRISPR gRNA sequence
ggattcaggggggcgggagg

SEQ ID NO: 178218 - DNA, 20 bp, Artificial
  CRISPR gRNA sequence
gggggcgggagggggctgtt

SEQ ID NO: 178219 - DNA, 20 bp, Artificial
  CRISPR gRNA sequence
ggggcgggagggggctgttc

SEQ ID NO: 178220 - DNA, 20 bp, Artificial
  CRISPR gRNA sequence
gggcgggagggggctgttca

SEQ ID NO: 178221 - DNA, 20 bp, Artificial
  CRISPR gRNA sequence
gagggggctgttcagggtga

SEQ ID NO: 178222 - DNA, 20 bp, Artificial
  CRISPR gRNA sequence
gggctgttcagggtgacggc

SEQ ID NO: 178223 - DNA, 20 bp, Artificial
  CRISPR gRNA sequence
ggtgacggctagccctttgc

SEQ ID NO: 178224 - DNA, 20 bp, Artificial
  CRISPR gRNA sequence
acggctagccctttgctagc

SEQ ID NO: 178225 - DNA, 20 bp, Artificial
  CRISPR gRNA sequence
gctagccctttgctagctag

SEQ ID NO: 178226 - DNA, 20 bp, Artificial
  CRISPR gRNA sequence
ctagctagtggttacaactc

SEQ ID NO: 178227 - DNA, 20 bp, Artificial
  CRISPR gRNA sequence
tagtggttacaactcaagtc

SEQ ID NO: 178228 - DNA, 20 bp, Artificial
  CRISPR gRNA sequence
agtggttacaactcaagtca

SEQ ID NO: 178229 - DNA, 20 bp, Artificial
  CRISPR gRNA sequence
gtggttacaactcaagtcaa

SEQ ID NO: 178230 - DNA, 20 bp, Artificial
  CRISPR gRNA sequence
aagtcaagggaatttcttct

SEQ ID NO: 178231 - DNA, 20 bp, Artificial
  CRISPR gRNA sequence
gggaatttcttcttggcatc

SEQ ID NO: 178232 - DNA, 20 bp, Artificial
  CRISPR gRNA sequence
ttcttcttggcatcaagcaa

SEQ ID NO: 178233 - DNA, 20 bp, Artificial
  CRISPR gRNA sequence
ttcttggcatcaagcaaaag

SEQ ID NO: 178234 - DNA, 20 bp, Artificial
  CRISPR gRNA sequence
aagaagtccctcccttccca

SEQ ID NO: 178235 - DNA, 20 bp, Artificial
  CRISPR gRNA sequence
agaagtccctcccttcccaa

SEQ ID NO: 178236 - DNA, 20 bp, Artificial
  CRISPR gRNA sequence
tcccaaaggatttgaatttt

SEQ ID NO: 178237 - DNA, 20 bp, Artificial
  CRISPR gRNA sequence
ggatttgaattttgagcgaa

SEQ ID NO: 178238 - DNA, 20 bp, Artificial
  CRISPR gRNA sequence
tgagcgaaaagttctgaaat

SEQ ID NO: 178239 - DNA, 20 bp, Artificial
  CRISPR gRNA sequence
gagcgaaaagttctgaaatt

SEQ ID NO: 178240 - DNA, 20 bp, Artificial
  CRISPR gRNA sequence
agcgaaaagttctgaaatta

SEQ ID NO: 178241 - DNA, 20 bp, Artificial
  CRISPR gRNA sequence
tttcctgcatatgaatcctg

SEQ ID NO: 178242 - DNA, 20 bp, Artificial
  CRISPR gRNA sequence
acttgcatgcctgtctcctc

SEQ ID NO: 178243 - DNA, 20 bp, Artificial
  CRISPR gRNA sequence
ttgcatgcctgtctcctcca

SEQ ID NO: 178244 - DNA, 20 bp, Artificial
  CRISPR gRNA sequence
tgcctgtctcctccagagac

SEQ ID NO: 178245 - DNA, 20 bp, Artificial
  CRISPR gRNA sequence
tgtctcctccagagactggc

SEQ ID NO: 178246 - DNA, 20 bp, Artificial
  CRISPR gRNA sequence
gtctcctccagagactggct

SEQ ID NO: 178247 - DNA, 20 bp, Artificial
  CRISPR gRNA sequence
ctcctccagagactggctgg

SEQ ID NO: 178248 - DNA, 20 bp, Artificial
  CRISPR gRNA sequence
tcctccagagactggctggg

SEQ ID NO: 178249 - DNA, 20 bp, Artificial
  CRISPR gRNA sequence
cctccagagactggctggga

SEQ ID NO: 178250 - DNA, 20 bp, Artificial
  CRISPR gRNA sequence
ctccagagactggctgggag

SEQ ID NO: 178251 - DNA, 20 bp, Artificial
  CRISPR gRNA sequence
agactggctgggaggggctg

SEQ ID NO: 178252 - DNA, 20 bp, Artificial
  CRISPR gRNA sequence
gactggctgggaggggctga

SEQ ID NO: 178253 - DNA, 20 bp, Artificial
  CRISPR gRNA sequence
tggctgggaggggctgaagg

SEQ ID NO: 178254 - DNA, 20 bp, Artificial
  CRISPR gRNA sequence
ggctgggaggggctgaagga

SEQ ID NO: 178255 - DNA, 20 bp, Artificial
  CRISPR gRNA sequence
gctgggaggggctgaaggaa

SEQ ID NO: 178256 - DNA, 20 bp, Artificial
  CRISPR gRNA sequence
ctgggaggggctgaaggaag

SEQ ID NO: 178257 - DNA, 20 bp, Artificial
  CRISPR gRNA sequence
ggggctgaaggaaggggcaa

SEQ ID NO: 178258 - DNA, 20 bp, Artificial
  CRISPR gRNA sequence
gggcaaaagcatttttgcct

SEQ ID NO: 178259 - DNA, 20 bp, Artificial
  CRISPR gRNA sequence
cctaagatgctgaaaaaatt

SEQ ID NO: 178260 - DNA, 20 bp, Artificial
  CRISPR gRNA sequence
taagatgctgaaaaaatttg

SEQ ID NO: 178261 - DNA, 20 bp, Artificial
  CRISPR gRNA sequence
agatgctgaaaaaatttgga

SEQ ID NO: 178262 - DNA, 20 bp, Artificial
  CRISPR gRNA sequence
tgctgaaaaaatttggagag

SEQ ID NO: 178263 - DNA, 20 bp, Artificial
  CRISPR gRNA sequence
tttggagagcagttttattc

SEQ ID NO: 178264 - DNA, 20 bp, Artificial
  CRISPR gRNA sequence
agagcagttttattccagcg

SEQ ID NO: 178265 - DNA, 20 bp, Artificial
  CRISPR gRNA sequence
gcgcagctcccctccgcact

SEQ ID NO: 178266 - DNA, 20 bp, Artificial
  CRISPR gRNA sequence
gctcccctccgcactgagtg

SEQ ID NO: 178267 - DNA, 20 bp, Artificial
  CRISPR gRNA sequence
tccgcactgagtgtagtacc

SEQ ID NO: 178268 - DNA, 20 bp, Artificial
  CRISPR gRNA sequence
gcactgagtgtagtacctag

SEQ ID NO: 178269 - DNA, 20 bp, Artificial
  CRISPR gRNA sequence
tgagtgtagtacctagcagc

SEQ ID NO: 178270 - DNA, 20 bp, Artificial
  CRISPR gRNA sequence
gtagtacctagcagctggct

SEQ ID NO: 178271 - DNA, 20 bp, Artificial
  CRISPR gRNA sequence
tagtacctagcagctggctg

SEQ ID NO: 178272 - DNA, 20 bp, Artificial
  CRISPR gRNA sequence
acctagcagctggctgaggt

SEQ ID NO: 178273 - DNA, 20 bp, Artificial
  CRISPR gRNA sequence
cctagcagctggctgaggtg

SEQ ID NO: 178274 - DNA, 20 bp, Artificial
  CRISPR gRNA sequence
ctagcagctggctgaggtga

SEQ ID NO: 178275 - DNA, 20 bp, Artificial
  CRISPR gRNA sequence
tagcagctggctgaggtgag

SEQ ID NO: 178276 - DNA, 20 bp, Artificial
  CRISPR gRNA sequence
gcagctggctgaggtgaggg

SEQ ID NO: 178277 - DNA, 20 bp, Artificial
  CRISPR gRNA sequence
cagctggctgaggtgagggg

SEQ ID NO: 178278 - DNA, 20 bp, Artificial
  CRISPR gRNA sequence
agctggctgaggtgagggga

SEQ ID NO: 178279 - DNA, 20 bp, Artificial
  CRISPR gRNA sequence
gaggtgaggggagggtaact

SEQ ID NO: 178280 - DNA, 20 bp, Artificial
  CRISPR gRNA sequence
ggagggtaactaagtgacct

SEQ ID NO: 178281 - DNA, 20 bp, Artificial
  CRISPR gRNA sequence
gagggtaactaagtgacctc

SEQ ID NO: 178282 - DNA, 20 bp, Artificial
  CRISPR gRNA sequence
ggtaactaagtgacctcggg

SEQ ID NO: 178283 - DNA, 20 bp, Artificial
  CRISPR gRNA sequence
gtaactaagtgacctcgggt

SEQ ID NO: 178284 - DNA, 20 bp, Artificial
  CRISPR gRNA sequence
taactaagtgacctcgggtg

SEQ ID NO: 178285 - DNA, 20 bp, Artificial
  CRISPR gRNA sequence
ctaagtgacctcgggtgggg

SEQ ID NO: 178286 - DNA, 20 bp, Artificial
  CRISPR gRNA sequence
taagtgacctcgggtggggc

SEQ ID NO: 178287 - DNA, 20 bp, Artificial
  CRISPR gRNA sequence
gggtggggcaggtcactgcc

SEQ ID NO: 178288 - DNA, 20 bp, Artificial
  CRISPR gRNA sequence
ggtggggcaggtcactgccc

SEQ ID NO: 178289 - DNA, 20 bp, Artificial
  CRISPR gRNA sequence
actgcccaggtactgttcaa

SEQ ID NO: 178290 - DNA, 20 bp, Artificial
  CRISPR gRNA sequence
aggtactgttcaacagattc

SEQ ID NO: 178291 - DNA, 20 bp, Artificial
  CRISPR gRNA sequence
ctgttcaacagattccagac

SEQ ID NO: 178292 - DNA, 20 bp, Artificial
  CRISPR gRNA sequence
gttcaacagattccagactg

SEQ ID NO: 178293 - DNA, 20 bp, Artificial
  CRISPR gRNA sequence
gagcctctgtgttctcttta

SEQ ID NO: 178294 - DNA, 20 bp, Artificial
  CRISPR gRNA sequence
cagccaacatgcccatcact

SEQ ID NO: 178295 - DNA, 20 bp, Artificial
  CRISPR gRNA sequence
cccatcactcggatgcgcat

SEQ ID NO: 178296 - DNA, 20 bp, Artificial
  CRISPR gRNA sequence
ctcggatgcgcatgagaccc

SEQ ID NO: 178297 - DNA, 20 bp, Artificial
  CRISPR gRNA sequence
gatgcgcatgagaccctggc

SEQ ID NO: 178298 - DNA, 20 bp, Artificial
  CRISPR gRNA sequence
tgcgcatgagaccctggcta

SEQ ID NO: 178299 - DNA, 20 bp, Artificial
  CRISPR gRNA sequence
tgagaccctggctagagatg

SEQ ID NO: 178300 - DNA, 20 bp, Artificial
  CRISPR gRNA sequence
gattaattccaaccaaatcc

SEQ ID NO: 178301 - DNA, 20 bp, Artificial
  CRISPR gRNA sequence
attaattccaaccaaatccc

SEQ ID NO: 178302 - DNA, 20 bp, Artificial
  CRISPR gRNA sequence
ttaattccaaccaaatcccg

SEQ ID NO: 178303 - DNA, 20 bp, Artificial
  CRISPR gRNA sequence
accaaatcccggggctcatc

SEQ ID NO: 178304 - DNA, 20 bp, Artificial
  CRISPR gRNA sequence
ggggctcatctggattaata

SEQ ID NO: 178305 - DNA, 20 bp, Artificial
  CRISPR gRNA sequence
ctcatctggattaataaagt

SEQ ID NO: 178306 - DNA, 20 bp, Artificial
  CRISPR gRNA sequence
ataaagtgagtgtaactctt

SEQ ID NO: 178307 - DNA, 20 bp, Artificial
  CRISPR gRNA sequence
taaagtgagtgtaactcttt

SEQ ID NO: 178308 - DNA, 20 bp, Artificial
  CRISPR gRNA sequence
tgttttaacccatgtacttc

SEQ ID NO: 178309 - DNA, 20 bp, Artificial
  CRISPR gRNA sequence
ttttaacccatgtacttctg

SEQ ID NO: 178310 - DNA, 20 bp, Artificial
  CRISPR gRNA sequence
tttaacccatgtacttctgg

SEQ ID NO: 178311 - DNA, 20 bp, Artificial
  CRISPR gRNA sequence
ttaacccatgtacttctgga

SEQ ID NO: 178312 - DNA, 20 bp, Artificial
  CRISPR gRNA sequence
atgtacttctggagggacca

SEQ ID NO: 178313 - DNA, 20 bp, Artificial
  CRISPR gRNA sequence
ttctggagggaccaaagctt

SEQ ID NO: 178314 - DNA, 20 bp, Artificial
  CRISPR gRNA sequence
agggaccaaagcttcagatg

SEQ ID NO: 178315 - DNA, 20 bp, Artificial
  CRISPR gRNA sequence
agcttcagatgcagctcaaa

SEQ ID NO: 178316 - DNA, 20 bp, Artificial
  CRISPR gRNA sequence
gcttcagatgcagctcaaaa

SEQ ID NO: 178317 - DNA, 20 bp, Artificial
  CRISPR gRNA sequence
cttcagatgcagctcaaaaa

SEQ ID NO: 178318 - DNA, 20 bp, Artificial
  CRISPR gRNA sequence
cagatgcagctcaaaaaggg

SEQ ID NO: 178319 - DNA, 20 bp, Artificial
  CRISPR gRNA sequence
ctcaaaaagggaagtgataa

SEQ ID NO: 178320 - DNA, 20 bp, Artificial
  CRISPR gRNA sequence
tcaaaaagggaagtgataac

SEQ ID NO: 178321 - DNA, 20 bp, Artificial
  CRISPR gRNA sequence
aagggaagtgataacgggac

SEQ ID NO: 178322 - DNA, 20 bp, Artificial
  CRISPR gRNA sequence
ggaagtgataacgggacaag

SEQ ID NO: 178323 - DNA, 20 bp, Artificial
  CRISPR gRNA sequence
gaagtgataacgggacaagc

SEQ ID NO: 178324 - DNA, 20 bp, Artificial
  CRISPR gRNA sequence
ggacaagcaggtgtttctcc

SEQ ID NO: 178325 - DNA, 20 bp, Artificial
  CRISPR gRNA sequence
caagcaggtgtttctcccag

SEQ ID NO: 178326 - DNA, 20 bp, Artificial
  CRISPR gRNA sequence
aagcaggtgtttctcccagt

SEQ ID NO: 178327 - DNA, 20 bp, Artificial
  CRISPR gRNA sequence
ctcccagtgggtcctgcatg

SEQ ID NO: 178328 - DNA, 20 bp, Artificial
  CRISPR gRNA sequence
tcccagtgggtcctgcatgc

SEQ ID NO: 178329 - DNA, 20 bp, Artificial
  CRISPR gRNA sequence
cccagtgggtcctgcatgca

SEQ ID NO: 178330 - DNA, 20 bp, Artificial
  CRISPR gRNA sequence
cagtgggtcctgcatgcagg

SEQ ID NO: 178331 - DNA, 20 bp, Artificial
  CRISPR gRNA sequence
ctgcatgcagggagtgtgca

SEQ ID NO: 178332 - DNA, 20 bp, Artificial
  CRISPR gRNA sequence
tgcagggagtgtgcacggcc

SEQ ID NO: 178333 - DNA, 20 bp, Artificial
  CRISPR gRNA sequence
ggagtgtgcacggcccagcc

SEQ ID NO: 178334 - DNA, 20 bp, Artificial
  CRISPR gRNA sequence
gagtgtgcacggcccagcct

SEQ ID NO: 178335 - DNA, 20 bp, Artificial
  CRISPR gRNA sequence
tcctgccttcttcccttctt

SEQ ID NO: 178336 - DNA, 20 bp, Artificial
  CRISPR gRNA sequence
cctgccttcttcccttcttg

SEQ ID NO: 178337 - DNA, 20 bp, Artificial
  CRISPR gRNA sequence
gccttcttcccttcttgagg

SEQ ID NO: 178338 - DNA, 20 bp, Artificial
  CRISPR gRNA sequence
ccttcttcccttcttgaggt

SEQ ID NO: 178339 - DNA, 20 bp, Artificial
  CRISPR gRNA sequence
cttcttcccttcttgaggta

SEQ ID NO: 178340 - DNA, 20 bp, Artificial
  CRISPR gRNA sequence
tgaggtagggcacccacctg

SEQ ID NO: 178341 - DNA, 20 bp, Artificial
  CRISPR gRNA sequence
gaggtagggcacccacctga

SEQ ID NO: 178342 - DNA, 20 bp, Artificial
  CRISPR gRNA sequence
cacccacctgaaggcacttc

SEQ ID NO: 178343 - DNA, 20 bp, Artificial
  CRISPR gRNA sequence
ctgaaggcacttccagtttc

SEQ ID NO: 178344 - DNA, 20 bp, Artificial
  CRISPR gRNA sequence
aaggcacttccagtttccag

SEQ ID NO: 178345 - DNA, 20 bp, Artificial
  CRISPR gRNA sequence
cacttccagtttccagcagc

SEQ ID NO: 178346 - DNA, 20 bp, Artificial
  CRISPR gRNA sequence
tttccagcagcaagactttc

SEQ ID NO: 178347 - DNA, 20 bp, Artificial
  CRISPR gRNA sequence
gcaagactttccagcatctg

SEQ ID NO: 178348 - DNA, 20 bp, Artificial
  CRISPR gRNA sequence
aagactttccagcatctgca

SEQ ID NO: 178349 - DNA, 20 bp, Artificial
  CRISPR gRNA sequence
ctttccagcatctgcagagc

SEQ ID NO: 178350 - DNA, 20 bp, Artificial
  CRISPR gRNA sequence
ttccagcatctgcagagctg

SEQ ID NO: 178351 - DNA, 20 bp, Artificial
  CRISPR gRNA sequence
ctggagttctgctctcctct

SEQ ID NO: 178352 - DNA, 20 bp, Artificial
  CRISPR gRNA sequence
agttctgctctcctctaagc

SEQ ID NO: 178353 - DNA, 20 bp, Artificial
  CRISPR gRNA sequence
gagacccttacaaacataca

SEQ ID NO: 178354 - DNA, 20 bp, Artificial
  CRISPR gRNA sequence
caaacatacacagcactctg

SEQ ID NO: 178355 - DNA, 20 bp, Artificial
  CRISPR gRNA sequence
aaacatacacagcactctgc

SEQ ID NO: 178356 - DNA, 20 bp, Artificial
  CRISPR gRNA sequence
aacatacacagcactctgca

SEQ ID NO: 178357 - DNA, 20 bp, Artificial
  CRISPR gRNA sequence
cagggctccaatcgaacaaa

SEQ ID NO: 178358 - DNA, 20 bp, Artificial
  CRISPR gRNA sequence
ggctccaatcgaacaaatag

SEQ ID NO: 178359 - DNA, 20 bp, Artificial
  CRISPR gRNA sequence
aatcgaacaaatagaagact

SEQ ID NO: 178360 - DNA, 20 bp, Artificial
  CRISPR gRNA sequence
cgaacaaatagaagactgag

SEQ ID NO: 178361 - DNA, 20 bp, Artificial
  CRISPR gRNA sequence
acaaatagaagactgagaag

SEQ ID NO: 178362 - DNA, 20 bp, Artificial
  CRISPR gRNA sequence
gactgagaagtggatgctgc

SEQ ID NO: 178363 - DNA, 20 bp, Artificial
  CRISPR gRNA sequence
actgagaagtggatgctgct

SEQ ID NO: 178364 - DNA, 20 bp, Artificial
  CRISPR gRNA sequence
gagaagtggatgctgctggg

SEQ ID NO: 178365 - DNA, 20 bp, Artificial
  CRISPR gRNA sequence
ctgctgggcagaaacgtgcc

SEQ ID NO: 178366 - DNA, 20 bp, Artificial
  CRISPR gRNA sequence
gggcagaaacgtgcctggct

SEQ ID NO: 178367 - DNA, 20 bp, Artificial
  CRISPR gRNA sequence
cagaaacgtgcctggcttag

SEQ ID NO: 178368 - DNA, 20 bp, Artificial
  CRISPR gRNA sequence
gaaacgtgcctggcttagca

SEQ ID NO: 178369 - DNA, 20 bp, Artificial
  CRISPR gRNA sequence
aaacgtgcctggcttagcag

SEQ ID NO: 178370 - DNA, 20 bp, Artificial
  CRISPR gRNA sequence
tggcttagcagaggacaaac

SEQ ID NO: 178371 - DNA, 20 bp, Artificial
  CRISPR gRNA sequence
caaacgagttaatcttgcac

SEQ ID NO: 178372 - DNA, 20 bp, Artificial
  CRISPR gRNA sequence
taatcttgcaccagtcactc

SEQ ID NO: 178373 - DNA, 20 bp, Artificial
  CRISPR gRNA sequence
tgcaccagtcactctggccc

SEQ ID NO: 178374 - DNA, 20 bp, Artificial
  CRISPR gRNA sequence
accagtcactctggcccaag

SEQ ID NO: 178375 - DNA, 20 bp, Artificial
  CRISPR gRNA sequence
actctggcccaagaagccta

SEQ ID NO: 178376 - DNA, 20 bp, Artificial
  CRISPR gRNA sequence
tggcccaagaagcctatagc

SEQ ID NO: 178377 - DNA, 20 bp, Artificial
  CRISPR gRNA sequence
aagcctatagctggtgcact

SEQ ID NO: 178378 - DNA, 20 bp, Artificial
  CRISPR gRNA sequence
agcctatagctggtgcactt

SEQ ID NO: 178379 - DNA, 20 bp, Artificial
  CRISPR gRNA sequence
gcctatagctggtgcacttg

SEQ ID NO: 178380 - DNA, 20 bp, Artificial
  CRISPR gRNA sequence
ctggtgcacttggggcaaca

SEQ ID NO: 178381 - DNA, 20 bp, Artificial
  CRISPR gRNA sequence
ttggggcaacatagacccta

SEQ ID NO: 178382 - DNA, 20 bp, Artificial
  CRISPR gRNA sequence
caacatagaccctatagact

SEQ ID NO: 178383 - DNA, 20 bp, Artificial
  CRISPR gRNA sequence
catagaccctatagacttag

SEQ ID NO: 178384 - DNA, 20 bp, Artificial
  CRISPR gRNA sequence
tatagacttagtagcaatga

SEQ ID NO: 178385 - DNA, 20 bp, Artificial
  CRISPR gRNA sequence
aatgatagtattcataataa

SEQ ID NO: 178386 - DNA, 20 bp, Artificial
  CRISPR gRNA sequence
ctgaacactccctgtgtgcc

SEQ ID NO: 178387 - DNA, 20 bp, Artificial
  CRISPR gRNA sequence
ctgtgtgcctggcacctgct

SEQ ID NO: 178388 - DNA, 20 bp, Artificial
  CRISPR gRNA sequence
attgtgtcatttaatcctcg

SEQ ID NO: 178389 - DNA, 20 bp, Artificial
  CRISPR gRNA sequence
gtgtcatttaatcctcgcag

SEQ ID NO: 178390 - DNA, 20 bp, Artificial
  CRISPR gRNA sequence
taatcctcgcagtagtcctg

SEQ ID NO: 178391 - DNA, 20 bp, Artificial
  CRISPR gRNA sequence
aatcctcgcagtagtcctgt

SEQ ID NO: 178392 - DNA, 20 bp, Artificial
  CRISPR gRNA sequence
ctcgcagtagtcctgtgggt

SEQ ID NO: 178393 - DNA, 20 bp, Artificial
  CRISPR gRNA sequence
cttactaatgtcatcatttt

SEQ ID NO: 178394 - DNA, 20 bp, Artificial
  CRISPR gRNA sequence
taatgtcatcattttcagat

SEQ ID NO: 178395 - DNA, 20 bp, Artificial
  CRISPR gRNA sequence
atcattttcagataagtaaa

SEQ ID NO: 178396 - DNA, 20 bp, Artificial
  CRISPR gRNA sequence
cattttcagataagtaaaca

SEQ ID NO: 178397 - DNA, 20 bp, Artificial
  CRISPR gRNA sequence
attttcagataagtaaacag

SEQ ID NO: 178398 - DNA, 20 bp, Artificial
  CRISPR gRNA sequence
gataagtaaacagaggcact

SEQ ID NO: 178399 - DNA, 20 bp, Artificial
  CRISPR gRNA sequence
taagtaaacagaggcactga

SEQ ID NO: 178400 - DNA, 20 bp, Artificial
  CRISPR gRNA sequence
aagtaaacagaggcactgag

SEQ ID NO: 178401 - DNA, 20 bp, Artificial
  CRISPR gRNA sequence
taaacagaggcactgagagg

SEQ ID NO: 178402 - DNA, 20 bp, Artificial
  CRISPR gRNA sequence
ggcactgagaggtagatcat

SEQ ID NO: 178403 - DNA, 20 bp, Artificial
  CRISPR gRNA sequence
agatcataagatcacacaaa

SEQ ID NO: 178404 - DNA, 20 bp, Artificial
  CRISPR gRNA sequence
agatcacacaaaaagtgatg

SEQ ID NO: 178405 - DNA, 20 bp, Artificial
  CRISPR gRNA sequence
acacaaaaagtgatgaagcc

SEQ ID NO: 178406 - DNA, 20 bp, Artificial
  CRISPR gRNA sequence
agccaagatttgaacttgaa

SEQ ID NO: 178407 - DNA, 20 bp, Artificial
  CRISPR gRNA sequence
tgaacttgaacggtctgact

SEQ ID NO: 178408 - DNA, 20 bp, Artificial
  CRISPR gRNA sequence
aaatctttactgttaaccat

SEQ ID NO: 178409 - DNA, 20 bp, Artificial
  CRISPR gRNA sequence
aaccataagtgatataataa

SEQ ID NO: 178410 - DNA, 20 bp, Artificial
  CRISPR gRNA sequence
ataagtgatataataacagt

SEQ ID NO: 178411 - DNA, 20 bp, Artificial
  CRISPR gRNA sequence
atataataacagtaagacct

SEQ ID NO: 178412 - DNA, 20 bp, Artificial
  CRISPR gRNA sequence
ctgtgtccctacacatcctc

SEQ ID NO: 178413 - DNA, 20 bp, Artificial
  CRISPR gRNA sequence
tttaatcctcaaaattttgt

SEQ ID NO: 178414 - DNA, 20 bp, Artificial
  CRISPR gRNA sequence
ggatatgttttctcatttcc

SEQ ID NO: 178415 - DNA, 20 bp, Artificial
  CRISPR gRNA sequence
tatgttttctcatttccgag

SEQ ID NO: 178416 - DNA, 20 bp, Artificial
  CRISPR gRNA sequence
tgttttctcatttccgagaa

SEQ ID NO: 178417 - DNA, 20 bp, Artificial
  CRISPR gRNA sequence
atttccgagaagagaaaact

SEQ ID NO: 178418 - DNA, 20 bp, Artificial
  CRISPR gRNA sequence
tttccgagaagagaaaactg

SEQ ID NO: 178419 - DNA, 20 bp, Artificial
  CRISPR gRNA sequence
ttccgagaagagaaaactga

SEQ ID NO: 178420 - DNA, 20 bp, Artificial
  CRISPR gRNA sequence
tccgagaagagaaaactgag

SEQ ID NO: 178421 - DNA, 20 bp, Artificial
  CRISPR gRNA sequence
gaagagaaaactgaggggca

SEQ ID NO: 178422 - DNA, 20 bp, Artificial
  CRISPR gRNA sequence
agagaaaactgaggggcaaa

SEQ ID NO: 178423 - DNA, 20 bp, Artificial
  CRISPR gRNA sequence
aactgaggggcaaagagata

SEQ ID NO: 178424 - DNA, 20 bp, Artificial
  CRISPR gRNA sequence
aagagatacagtgacaatgc

SEQ ID NO: 178425 - DNA, 20 bp, Artificial
  CRISPR gRNA sequence
agagatacagtgacaatgcc

SEQ ID NO: 178426 - DNA, 20 bp, Artificial
  CRISPR gRNA sequence
gagatacagtgacaatgcca

SEQ ID NO: 178427 - DNA, 20 bp, Artificial
  CRISPR gRNA sequence
gtgacaatgccagggttaca

SEQ ID NO: 178428 - DNA, 20 bp, Artificial
  CRISPR gRNA sequence
ttacacagtgttcaccatcc

SEQ ID NO: 178429 - DNA, 20 bp, Artificial
  CRISPR gRNA sequence
cagtgttcaccatccaagtc

SEQ ID NO: 178430 - DNA, 20 bp, Artificial
  CRISPR gRNA sequence
ttcaccatccaagtctagcc

SEQ ID NO: 178431 - DNA, 20 bp, Artificial
  CRISPR gRNA sequence
caccatccaagtctagccca

SEQ ID NO: 178432 - DNA, 20 bp, Artificial
  CRISPR gRNA sequence
agtctagcccagagctccct

SEQ ID NO: 178433 - DNA, 20 bp, Artificial
  CRISPR gRNA sequence
ctagcccagagctccctcag

SEQ ID NO: 178434 - DNA, 20 bp, Artificial
  CRISPR gRNA sequence
agctccctcagtggtatgac

SEQ ID NO: 178435 - DNA, 20 bp, Artificial
  CRISPR gRNA sequence
gctccctcagtggtatgacc

SEQ ID NO: 178436 - DNA, 20 bp, Artificial
  CRISPR gRNA sequence
atgaccaggaccccctgtgt

SEQ ID NO: 178437 - DNA, 20 bp, Artificial
  CRISPR gRNA sequence
gaccaggaccccctgtgtaa

SEQ ID NO: 178438 - DNA, 20 bp, Artificial
  CRISPR gRNA sequence
tgtgtaagagcccatgctcc

SEQ ID NO: 178439 - DNA, 20 bp, Artificial
  CRISPR gRNA sequence
gtgtaagagcccatgctccc

SEQ ID NO: 178440 - DNA, 20 bp, Artificial
  CRISPR gRNA sequence
cccatgctcccaggtgtcct

SEQ ID NO: 178441 - DNA, 20 bp, Artificial
  CRISPR gRNA sequence
ccatgctcccaggtgtcctg

SEQ ID NO: 178442 - DNA, 20 bp, Artificial
  CRISPR gRNA sequence
atgctcccaggtgtcctgag

SEQ ID NO: 178443 - DNA, 20 bp, Artificial
  CRISPR gRNA sequence
tcctgaggagtcctttctaa

SEQ ID NO: 178444 - DNA, 20 bp, Artificial
  CRISPR gRNA sequence
tgaggagtcctttctaatgg

SEQ ID NO: 178445 - DNA, 20 bp, Artificial
  CRISPR gRNA sequence
ggagtcctttctaatggaag

SEQ ID NO: 178446 - DNA, 20 bp, Artificial
  CRISPR gRNA sequence
aagaagttcttacttccatg

SEQ ID NO: 178447 - DNA, 20 bp, Artificial
  CRISPR gRNA sequence
agaagttcttacttccatgt

SEQ ID NO: 178448 - DNA, 20 bp, Artificial
  CRISPR gRNA sequence
acttccatgtgggtgcttac

SEQ ID NO: 178449 - DNA, 20 bp, Artificial
  CRISPR gRNA sequence
ccatgtgggtgcttacaagc

SEQ ID NO: 178450 - DNA, 20 bp, Artificial
  CRISPR gRNA sequence
atgtgggtgcttacaagcca

SEQ ID NO: 178451 - DNA, 20 bp, Artificial
  CRISPR gRNA sequence
gtgggtgcttacaagccaga

SEQ ID NO: 178452 - DNA, 20 bp, Artificial
  CRISPR gRNA sequence
caagccagagagaaacatcc

SEQ ID NO: 178453 - DNA, 20 bp, Artificial
  CRISPR gRNA sequence
agccagagagaaacatccca

SEQ ID NO: 178454 - DNA, 20 bp, Artificial
  CRISPR gRNA sequence
acatcccagagcttcaaaac

SEQ ID NO: 178455 - DNA, 20 bp, Artificial
  CRISPR gRNA sequence
catcccagagcttcaaaacc

SEQ ID NO: 178456 - DNA, 20 bp, Artificial
  CRISPR gRNA sequence
atcccagagcttcaaaacca

SEQ ID NO: 178457 - DNA, 20 bp, Artificial
  CRISPR gRNA sequence
gagcttcaaaaccagggctt

SEQ ID NO: 178458 - DNA, 20 bp, Artificial
  CRISPR gRNA sequence
agcttcaaaaccagggcttt

SEQ ID NO: 178459 - DNA, 20 bp, Artificial
  CRISPR gRNA sequence
gcttcaaaaccagggctttg

SEQ ID NO: 178460 - DNA, 20 bp, Artificial
  CRISPR gRNA sequence
cttcaaaaccagggctttgg

SEQ ID NO: 178461 - DNA, 20 bp, Artificial
  CRISPR gRNA sequence
tcaaaaccagggctttgggg

SEQ ID NO: 178462 - DNA, 20 bp, Artificial
  CRISPR gRNA sequence
caaaaccagggctttggggg

SEQ ID NO: 178463 - DNA, 20 bp, Artificial
  CRISPR gRNA sequence
aaaaccagggctttggggga

SEQ ID NO: 178464 - DNA, 20 bp, Artificial
  CRISPR gRNA sequence
ttgggggagggtgccctgtg

SEQ ID NO: 178465 - DNA, 20 bp, Artificial
  CRISPR gRNA sequence
tgggggagggtgccctgtgt

SEQ ID NO: 178466 - DNA, 20 bp, Artificial
  CRISPR gRNA sequence
agggtgccctgtgtgggtcc

SEQ ID NO: 178467 - DNA, 20 bp, Artificial
  CRISPR gRNA sequence
gggtcctagcacatgtgtaa

SEQ ID NO: 178468 - DNA, 20 bp, Artificial
  CRISPR gRNA sequence
ggtcctagcacatgtgtaac

SEQ ID NO: 178469 - DNA, 20 bp, Artificial
  CRISPR gRNA sequence
cctagcacatgtgtaacagg

SEQ ID NO: 178470 - DNA, 20 bp, Artificial
  CRISPR gRNA sequence
tagcacatgtgtaacaggca

SEQ ID NO: 178471 - DNA, 20 bp, Artificial
  CRISPR gRNA sequence
agcacatgtgtaacaggcag

SEQ ID NO: 178472 - DNA, 20 bp, Artificial
  CRISPR gRNA sequence
gcacatgtgtaacaggcaga

SEQ ID NO: 178473 - DNA, 20 bp, Artificial
  CRISPR gRNA sequence
acatgtgtaacaggcagagg

SEQ ID NO: 178474 - DNA, 20 bp, Artificial
  CRISPR gRNA sequence
catgtgtaacaggcagaggg

SEQ ID NO: 178475 - DNA, 20 bp, Artificial
  CRISPR gRNA sequence
aggcagagggaggtctttgt

SEQ ID NO: 178476 - DNA, 20 bp, Artificial
  CRISPR gRNA sequence
tttgtgagctaataatgctg

SEQ ID NO: 178477 - DNA, 20 bp, Artificial
  CRISPR gRNA sequence
atgctgcagctcatccaaac

SEQ ID NO: 178478 - DNA, 20 bp, Artificial
  CRISPR gRNA sequence
tgctgcagctcatccaaact

SEQ ID NO: 178479 - DNA, 20 bp, Artificial
  CRISPR gRNA sequence
ccaaactaggtgtccctcct

SEQ ID NO: 178480 - DNA, 20 bp, Artificial
  CRISPR gRNA sequence
aaactaggtgtccctcctga

SEQ ID NO: 178481 - DNA, 20 bp, Artificial
  CRISPR gRNA sequence
ggtgtccctcctgagagatc

SEQ ID NO: 178482 - DNA, 20 bp, Artificial
  CRISPR gRNA sequence
tgtccctcctgagagatcca

SEQ ID NO: 178483 - DNA, 20 bp, Artificial
  CRISPR gRNA sequence
ccctcctgagagatccagag

SEQ ID NO: 178484 - DNA, 20 bp, Artificial
  CRISPR gRNA sequence
agatccagagtggtctgttt

SEQ ID NO: 178485 - DNA, 20 bp, Artificial
  CRISPR gRNA sequence
ccagagtggtctgtttaagc

SEQ ID NO: 178486 - DNA, 20 bp, Artificial
  CRISPR gRNA sequence
ggtctgtttaagccagcctc

SEQ ID NO: 178487 - DNA, 20 bp, Artificial
  CRISPR gRNA sequence
tgtttaagccagcctcaaga

SEQ ID NO: 178488 - DNA, 20 bp, Artificial
  CRISPR gRNA sequence
gtttaagccagcctcaagat

SEQ ID NO: 178489 - DNA, 20 bp, Artificial
  CRISPR gRNA sequence
cagcctcaagatgggtgtcc

SEQ ID NO: 178490 - DNA, 20 bp, Artificial
  CRISPR gRNA sequence
ctcaagatgggtgtccaagc

SEQ ID NO: 178491 - DNA, 20 bp, Artificial
  CRISPR gRNA sequence
tgggtgtccaagccagatgt

SEQ ID NO: 178492 - DNA, 20 bp, Artificial
  CRISPR gRNA sequence
gggtgtccaagccagatgtc

SEQ ID NO: 178493 - DNA, 20 bp, Artificial
  CRISPR gRNA sequence
ggtgtccaagccagatgtca

SEQ ID NO: 178494 - DNA, 20 bp, Artificial
  CRISPR gRNA sequence
gtgtccaagccagatgtcag

SEQ ID NO: 178495 - DNA, 20 bp, Artificial
  CRISPR gRNA sequence
agccagatgtcaggggaaaa

SEQ ID NO: 178496 - DNA, 20 bp, Artificial
  CRISPR gRNA sequence
gccagatgtcaggggaaaaa

SEQ ID NO: 178497 - DNA, 20 bp, Artificial
  CRISPR gRNA sequence
ccagatgtcaggggaaaaaa

SEQ ID NO: 178498 - DNA, 20 bp, Artificial
  CRISPR gRNA sequence
cagatgtcaggggaaaaaag

SEQ ID NO: 178499 - DNA, 20 bp, Artificial
  CRISPR gRNA sequence
atgtcaggggaaaaaagggg

SEQ ID NO: 178500 - DNA, 20 bp, Artificial
  CRISPR gRNA sequence
caggggaaaaaaggggaagt

SEQ ID NO: 178501 - DNA, 20 bp, Artificial
  CRISPR gRNA sequence
aggggaagtcagccttttct

SEQ ID NO: 178502 - DNA, 20 bp, Artificial
  CRISPR gRNA sequence
agccttttctcagacctgtc

SEQ ID NO: 178503 - DNA, 20 bp, Artificial
  CRISPR gRNA sequence
ttttctcagacctgtctggc

SEQ ID NO: 178504 - DNA, 20 bp, Artificial
  CRISPR gRNA sequence
tttctcagacctgtctggct

SEQ ID NO: 178505 - DNA, 20 bp, Artificial
  CRISPR gRNA sequence
ctcagacctgtctggctggg

SEQ ID NO: 178506 - DNA, 20 bp, Artificial
  CRISPR gRNA sequence
tcagacctgtctggctgggc

SEQ ID NO: 178507 - DNA, 20 bp, Artificial
  CRISPR gRNA sequence
cctgtctggctgggcaggcc

SEQ ID NO: 178508 - DNA, 20 bp, Artificial
  CRISPR gRNA sequence
ctgtctggctgggcaggcct

SEQ ID NO: 178509 - DNA, 20 bp, Artificial
  CRISPR gRNA sequence
ggctgggcaggcctgggtct

SEQ ID NO: 178510 - DNA, 20 bp, Artificial
  CRISPR gRNA sequence
gcaggcctgggtctcagact

SEQ ID NO: 178511 - DNA, 20 bp, Artificial
  CRISPR gRNA sequence
gggtctcagactcagcccca

SEQ ID NO: 178512 - DNA, 20 bp, Artificial
  CRISPR gRNA sequence
agactcagccccaaagtctg

SEQ ID NO: 178513 - DNA, 20 bp, Artificial
  CRISPR gRNA sequence
ctgtggtctctgacctgaca

SEQ ID NO: 178514 - DNA, 20 bp, Artificial
  CRISPR gRNA sequence
atgtgtatgtgtgtattgtt

SEQ ID NO: 178515 - DNA, 20 bp, Artificial
  CRISPR gRNA sequence
tgtgtatgtgtgtattgttc

SEQ ID NO: 178516 - DNA, 20 bp, Artificial
  CRISPR gRNA sequence
tgtatgtgtgtattgttcag

SEQ ID NO: 178517 - DNA, 20 bp, Artificial
  CRISPR gRNA sequence
gtatgtgtgtattgttcagg

SEQ ID NO: 178518 - DNA, 20 bp, Artificial
  CRISPR gRNA sequence
atgtgtgtattgttcaggag

SEQ ID NO: 178519 - DNA, 20 bp, Artificial
  CRISPR gRNA sequence
ttcaggaggagatgatcttc

SEQ ID NO: 178520 - DNA, 20 bp, Artificial
  CRISPR gRNA sequence
agatgatcttccagatccca

SEQ ID NO: 178521 - DNA, 20 bp, Artificial
  CRISPR gRNA sequence
tgatcttccagatcccatgg

SEQ ID NO: 178522 - DNA, 20 bp, Artificial
  CRISPR gRNA sequence
tcccatggaagcatgctgcc

SEQ ID NO: 178523 - DNA, 20 bp, Artificial
  CRISPR gRNA sequence
tggaagcatgctgccaagca

SEQ ID NO: 178524 - DNA, 20 bp, Artificial
  CRISPR gRNA sequence
agcatgctgccaagcatggc

SEQ ID NO: 178525 - DNA, 20 bp, Artificial
  CRISPR gRNA sequence
gcatgctgccaagcatggct

SEQ ID NO: 178526 - DNA, 20 bp, Artificial
  CRISPR gRNA sequence
agcatggctgggacatcaac

SEQ ID NO: 178527 - DNA, 20 bp, Artificial
  CRISPR gRNA sequence
gcatggctgggacatcaaca

SEQ ID NO: 178528 - DNA, 20 bp, Artificial
  CRISPR gRNA sequence
acaaggatgcctgtttgttc

SEQ ID NO: 178529 - DNA, 20 bp, Artificial
  CRISPR gRNA sequence
aaggatgcctgtttgttccg

SEQ ID NO: 178530 - DNA, 20 bp, Artificial
  CRISPR gRNA sequence
atgcctgtttgttccggagc

SEQ ID NO: 178531 - DNA, 20 bp, Artificial
  CRISPR gRNA sequence
tgcctgtttgttccggagct

SEQ ID NO: 178532 - DNA, 20 bp, Artificial
  CRISPR gRNA sequence
ccggagctgggccattcaca

SEQ ID NO: 178533 - DNA, 20 bp, Artificial
  CRISPR gRNA sequence
cggagctgggccattcacac

SEQ ID NO: 178534 - DNA, 20 bp, Artificial
  CRISPR gRNA sequence
cattcacacaggtgtgtgcc

SEQ ID NO: 178535 - DNA, 20 bp, Artificial
  CRISPR gRNA sequence
attcacacaggtgtgtgcct

SEQ ID NO: 178536 - DNA, 20 bp, Artificial
  CRISPR gRNA sequence
acaggtgtgtgcctgggact

SEQ ID NO: 178537 - DNA, 20 bp, Artificial
  CRISPR gRNA sequence
caggtgtgtgcctgggactc

SEQ ID NO: 178538 - DNA, 20 bp, Artificial
  CRISPR gRNA sequence
gtgtgcctgggactcaggcc

SEQ ID NO: 178539 - DNA, 20 bp, Artificial
  CRISPR gRNA sequence
tgtgcctgggactcaggcct

SEQ ID NO: 178540 - DNA, 20 bp, Artificial
  CRISPR gRNA sequence
gcctgggactcaggcctagg

SEQ ID NO: 178541 - DNA, 20 bp, Artificial
  CRISPR gRNA sequence
ggactcaggcctaggaagcc

SEQ ID NO: 178542 - DNA, 20 bp, Artificial
  CRISPR gRNA sequence
gactcaggcctaggaagccc

SEQ ID NO: 178543 - DNA, 20 bp, Artificial
  CRISPR gRNA sequence
actcaggcctaggaagccca

SEQ ID NO: 178544 - DNA, 20 bp, Artificial
  CRISPR gRNA sequence
caggcctaggaagcccaggg

SEQ ID NO: 178545 - DNA, 20 bp, Artificial
  CRISPR gRNA sequence
ggcctaggaagcccagggta

SEQ ID NO: 178546 - DNA, 20 bp, Artificial
  CRISPR gRNA sequence
aggaagcccagggtagagac

SEQ ID NO: 178547 - DNA, 20 bp, Artificial
  CRISPR gRNA sequence
gaagcccagggtagagacaa

SEQ ID NO: 178548 - DNA, 20 bp, Artificial
  CRISPR gRNA sequence
aagcccagggtagagacaag

SEQ ID NO: 178549 - DNA, 20 bp, Artificial
  CRISPR gRNA sequence
gcccagggtagagacaagag

SEQ ID NO: 178550 - DNA, 20 bp, Artificial
  CRISPR gRNA sequence
cccagggtagagacaagagg

SEQ ID NO: 178551 - DNA, 20 bp, Artificial
  CRISPR gRNA sequence
aggaggcactcacgttaaca

SEQ ID NO: 178552 - DNA, 20 bp, Artificial
  CRISPR gRNA sequence
gaggcactcacgttaacaca

SEQ ID NO: 178553 - DNA, 20 bp, Artificial
  CRISPR gRNA sequence
aggcactcacgttaacacag

SEQ ID NO: 178554 - DNA, 20 bp, Artificial
  CRISPR gRNA sequence
ttaacacagaggctcttcac

SEQ ID NO: 178555 - DNA, 20 bp, Artificial
  CRISPR gRNA sequence
taacacagaggctcttcact

SEQ ID NO: 178556 - DNA, 20 bp, Artificial
  CRISPR gRNA sequence
aacacagaggctcttcactg

SEQ ID NO: 178557 - DNA, 20 bp, Artificial
  CRISPR gRNA sequence
ggctcttcactggggtccct

SEQ ID NO: 178558 - DNA, 20 bp, Artificial
  CRISPR gRNA sequence
ctggggtccctgagctccct

SEQ ID NO: 178559 - DNA, 20 bp, Artificial
  CRISPR gRNA sequence
gagctccctgagacaacatg

SEQ ID NO: 178560 - DNA, 20 bp, Artificial
  CRISPR gRNA sequence
gagacaacatgcagaattac

SEQ ID NO: 178561 - DNA, 20 bp, Artificial
  CRISPR gRNA sequence
agacaacatgcagaattact

SEQ ID NO: 178562 - DNA, 20 bp, Artificial
  CRISPR gRNA sequence
caacatgcagaattactggg

SEQ ID NO: 178563 - DNA, 20 bp, Artificial
  CRISPR gRNA sequence
acatgcagaattactgggaa

SEQ ID NO: 178564 - DNA, 20 bp, Artificial
  CRISPR gRNA sequence
catgcagaattactgggaag

SEQ ID NO: 178565 - DNA, 20 bp, Artificial
  CRISPR gRNA sequence
atgcagaattactgggaaga

SEQ ID NO: 178566 - DNA, 20 bp, Artificial
  CRISPR gRNA sequence
tgcagaattactgggaagag

SEQ ID NO: 178567 - DNA, 20 bp, Artificial
  CRISPR gRNA sequence
gaattactgggaagaggggc

SEQ ID NO: 178568 - DNA, 20 bp, Artificial
  CRISPR gRNA sequence
ttactgggaagaggggctgg

SEQ ID NO: 178569 - DNA, 20 bp, Artificial
  CRISPR gRNA sequence
ctgggaagaggggctggtgg

SEQ ID NO: 178570 - DNA, 20 bp, Artificial
  CRISPR gRNA sequence
tggtggcagacttgtgtttc

SEQ ID NO: 178571 - DNA, 20 bp, Artificial
  CRISPR gRNA sequence
gtggcagacttgtgtttctg

SEQ ID NO: 178572 - DNA, 20 bp, Artificial
  CRISPR gRNA sequence
gcagacttgtgtttctggag

SEQ ID NO: 178573 - DNA, 20 bp, Artificial
  CRISPR gRNA sequence
agacttgtgtttctggagaa

SEQ ID NO: 178574 - DNA, 20 bp, Artificial
  CRISPR gRNA sequence
acttgtgtttctggagaaga

SEQ ID NO: 178575 - DNA, 20 bp, Artificial
  CRISPR gRNA sequence
gagaagagagtcgatcatct

SEQ ID NO: 178576 - DNA, 20 bp, Artificial
  CRISPR gRNA sequence
atcatctcagcaaattctca

SEQ ID NO: 178577 - DNA, 20 bp, Artificial
  CRISPR gRNA sequence
tcatctcagcaaattctcaa

SEQ ID NO: 178578 - DNA, 20 bp, Artificial
  CRISPR gRNA sequence
catctcagcaaattctcaaa

SEQ ID NO: 178579 - DNA, 20 bp, Artificial
  CRISPR gRNA sequence
cagcaaattctcaaagggaa

SEQ ID NO: 178580 - DNA, 20 bp, Artificial
  CRISPR gRNA sequence
aattctcaaagggaaaagcc

SEQ ID NO: 178581 - DNA, 20 bp, Artificial
  CRISPR gRNA sequence
aaagggaaaagccaagatct

SEQ ID NO: 178582 - DNA, 20 bp, Artificial
  CRISPR gRNA sequence
ggaaaagccaagatcttaga

SEQ ID NO: 178583 - DNA, 20 bp, Artificial
  CRISPR gRNA sequence
ccaagatcttagaaagtgtg

SEQ ID NO: 178584 - DNA, 20 bp, Artificial
  CRISPR gRNA sequence
tcttagaaagtgtgtggctt

SEQ ID NO: 178585 - DNA, 20 bp, Artificial
  CRISPR gRNA sequence
cttagaaagtgtgtggcttc

SEQ ID NO: 178586 - DNA, 20 bp, Artificial
  CRISPR gRNA sequence
ttagaaagtgtgtggcttca

SEQ ID NO: 178587 - DNA, 20 bp, Artificial
  CRISPR gRNA sequence
tagaaagtgtgtggcttcag

SEQ ID NO: 178588 - DNA, 20 bp, Artificial
  CRISPR gRNA sequence
agaaagtgtgtggcttcagg

SEQ ID NO: 178589 - DNA, 20 bp, Artificial
  CRISPR gRNA sequence
gtgtggcttcagggggtttg

SEQ ID NO: 178590 - DNA, 20 bp, Artificial
  CRISPR gRNA sequence
ggcttcagggggtttgtggc

SEQ ID NO: 178591 - DNA, 20 bp, Artificial
  CRISPR gRNA sequence
gggggtttgtggctagatga

SEQ ID NO: 178592 - DNA, 20 bp, Artificial
  CRISPR gRNA sequence
ggctagatgaaagttctccc

SEQ ID NO: 178593 - DNA, 20 bp, Artificial
  CRISPR gRNA sequence
atgaaagttctccctggcaa

SEQ ID NO: 178594 - DNA, 20 bp, Artificial
  CRISPR gRNA sequence
ctggcaaaagcatctgtgaa

SEQ ID NO: 178595 - DNA, 20 bp, Artificial
  CRISPR gRNA sequence
gcaaaagcatctgtgaaaag

SEQ ID NO: 178596 - DNA, 20 bp, Artificial
  CRISPR gRNA sequence
catctgtgaaaagcagctgt

SEQ ID NO: 178597 - DNA, 20 bp, Artificial
  CRISPR gRNA sequence
tgtgaaaagcagctgtaagc

SEQ ID NO: 178598 - DNA, 20 bp, Artificial
  CRISPR gRNA sequence
gtgaaaagcagctgtaagcc

SEQ ID NO: 178599 - DNA, 20 bp, Artificial
  CRISPR gRNA sequence
tgaaaagcagctgtaagcca

SEQ ID NO: 178600 - DNA, 20 bp, Artificial
  CRISPR gRNA sequence
gctgtaagccagggcactga

SEQ ID NO: 178601 - DNA, 20 bp, Artificial
  CRISPR gRNA sequence
tgtaagccagggcactgaaa

SEQ ID NO: 178602 - DNA, 20 bp, Artificial
  CRISPR gRNA sequence
ccagggcactgaaagagacc

SEQ ID NO: 178603 - DNA, 20 bp, Artificial
  CRISPR gRNA sequence
cagggcactgaaagagaccc

SEQ ID NO: 178604 - DNA, 20 bp, Artificial
  CRISPR gRNA sequence
cctttttcttcgtgttgacc

SEQ ID NO: 178605 - DNA, 20 bp, Artificial
  CRISPR gRNA sequence
ctttttcttcgtgttgacca

SEQ ID NO: 178606 - DNA, 20 bp, Artificial
  CRISPR gRNA sequence
ttcgtgttgaccaaggccct

SEQ ID NO: 178607 - DNA, 20 bp, Artificial
  CRISPR gRNA sequence
ttgaccaaggcccttggtcc

SEQ ID NO: 178608 - DNA, 20 bp, Artificial
  CRISPR gRNA sequence
cccttggtccaagcctcatg

SEQ ID NO: 178609 - DNA, 20 bp, Artificial
  CRISPR gRNA sequence
tggtccaagcctcatgtggt

SEQ ID NO: 178610 - DNA, 20 bp, Artificial
  CRISPR gRNA sequence
tccaagcctcatgtggttgg

SEQ ID NO: 178611 - DNA, 20 bp, Artificial
  CRISPR gRNA sequence
tggtggcctcctttatcctt

SEQ ID NO: 178612 - DNA, 20 bp, Artificial
  CRISPR gRNA sequence
gtggcctcctttatccttga

SEQ ID NO: 178613 - DNA, 20 bp, Artificial
  CRISPR gRNA sequence
cctcctttatccttgagaga

SEQ ID NO: 178614 - DNA, 20 bp, Artificial
  CRISPR gRNA sequence
tcctttatccttgagagatg

SEQ ID NO: 178615 - DNA, 20 bp, Artificial
  CRISPR gRNA sequence
atccttgagagatggagctc

SEQ ID NO: 178616 - DNA, 20 bp, Artificial
  CRISPR gRNA sequence
tccttgagagatggagctct

SEQ ID NO: 178617 - DNA, 20 bp, Artificial
  CRISPR gRNA sequence
atggagctctaggcccatct

SEQ ID NO: 178618 - DNA, 20 bp, Artificial
  CRISPR gRNA sequence
gctctaggcccatctcagaa

SEQ ID NO: 178619 - DNA, 20 bp, Artificial
  CRISPR gRNA sequence
taggcccatctcagaacagt

SEQ ID NO: 178620 - DNA, 20 bp, Artificial
  CRISPR gRNA sequence
gaacagtcagcccacccatt

SEQ ID NO: 178621 - DNA, 20 bp, Artificial
  CRISPR gRNA sequence
agtaactgttctctgctgcc

SEQ ID NO: 178622 - DNA, 20 bp, Artificial
  CRISPR gRNA sequence
tctgtgcccactctaccctc

SEQ ID NO: 178623 - DNA, 20 bp, Artificial
  CRISPR gRNA sequence
ctctaccctctggctgctga

SEQ ID NO: 178624 - DNA, 20 bp, Artificial
  CRISPR gRNA sequence
cctctggctgctgatagccc

SEQ ID NO: 178625 - DNA, 20 bp, Artificial
  CRISPR gRNA sequence
ctctggctgctgatagccca

SEQ ID NO: 178626 - DNA, 20 bp, Artificial
  CRISPR gRNA sequence
ctggctgctgatagcccaag

SEQ ID NO: 178627 - DNA, 20 bp, Artificial
  CRISPR gRNA sequence
tggctgctgatagcccaagg

SEQ ID NO: 178628 - DNA, 20 bp, Artificial
  CRISPR gRNA sequence
ctgctgatagcccaaggagg

SEQ ID NO: 178629 - DNA, 20 bp, Artificial
  CRISPR gRNA sequence
gatagcccaaggaggaagac

SEQ ID NO: 178630 - DNA, 20 bp, Artificial
  CRISPR gRNA sequence
atagcccaaggaggaagact

SEQ ID NO: 178631 - DNA, 20 bp, Artificial
  CRISPR gRNA sequence
ccaaggaggaagactgggca

SEQ ID NO: 178632 - DNA, 20 bp, Artificial
  CRISPR gRNA sequence
aggaagactgggcatagtct

SEQ ID NO: 178633 - DNA, 20 bp, Artificial
  CRISPR gRNA sequence
actgggcatagtctgagaca

SEQ ID NO: 178634 - DNA, 20 bp, Artificial
  CRISPR gRNA sequence
ggcatagtctgagacacaga

SEQ ID NO: 178635 - DNA, 20 bp, Artificial
  CRISPR gRNA sequence
gagacacagatagtacactt

SEQ ID NO: 178636 - DNA, 20 bp, Artificial
  CRISPR gRNA sequence
agacacagatagtacacttt

SEQ ID NO: 178637 - DNA, 20 bp, Artificial
  CRISPR gRNA sequence
gacacagatagtacactttg

SEQ ID NO: 178638 - DNA, 20 bp, Artificial
  CRISPR gRNA sequence
gatagtacactttggggata

SEQ ID NO: 178639 - DNA, 20 bp, Artificial
  CRISPR gRNA sequence
atagtacactttggggatat

SEQ ID NO: 178640 - DNA, 20 bp, Artificial
  CRISPR gRNA sequence
tagtacactttggggatatg

SEQ ID NO: 178641 - DNA, 20 bp, Artificial
  CRISPR gRNA sequence
ctttggggatatggggactc

SEQ ID NO: 178642 - DNA, 20 bp, Artificial
  CRISPR gRNA sequence
tatggggactctagtgcttc

SEQ ID NO: 178643 - DNA, 20 bp, Artificial
  CRISPR gRNA sequence
gggactctagtgcttctggc

SEQ ID NO: 178644 - DNA, 20 bp, Artificial
  CRISPR gRNA sequence
ggactctagtgcttctggct

SEQ ID NO: 178645 - DNA, 20 bp, Artificial
  CRISPR gRNA sequence
ttctggctgggcccttcact

SEQ ID NO: 178646 - DNA, 20 bp, Artificial
  CRISPR gRNA sequence
tctggctgggcccttcactg

SEQ ID NO: 178647 - DNA, 20 bp, Artificial
  CRISPR gRNA sequence
ggcccttcactgaggcccgc

SEQ ID NO: 178648 - DNA, 20 bp, Artificial
  CRISPR gRNA sequence
gaggcccgctagatgtgttt

SEQ ID NO: 178649 - DNA, 20 bp, Artificial
  CRISPR gRNA sequence
ccgctagatgtgtttaagcc

SEQ ID NO: 178650 - DNA, 20 bp, Artificial
  CRISPR gRNA sequence
agatgtgtttaagccaagcc

SEQ ID NO: 178651 - DNA, 20 bp, Artificial
  CRISPR gRNA sequence
gatgtgtttaagccaagcct

SEQ ID NO: 178652 - DNA, 20 bp, Artificial
  CRISPR gRNA sequence
taagccaagcctgggcattt

SEQ ID NO: 178653 - DNA, 20 bp, Artificial
  CRISPR gRNA sequence
gccaagcctgggcatttgag

SEQ ID NO: 178654 - DNA, 20 bp, Artificial
  CRISPR gRNA sequence
ccaagcctgggcatttgaga

SEQ ID NO: 178655 - DNA, 20 bp, Artificial
  CRISPR gRNA sequence
cctgggcatttgagaaggcc

SEQ ID NO: 178656 - DNA, 20 bp, Artificial
  CRISPR gRNA sequence
ctgggcatttgagaaggccc

SEQ ID NO: 178657 - DNA, 20 bp, Artificial
  CRISPR gRNA sequence
tgggcatttgagaaggccca

SEQ ID NO: 178658 - DNA, 20 bp, Artificial
  CRISPR gRNA sequence
atttgagaaggcccagggcc

SEQ ID NO: 178659 - DNA, 20 bp, Artificial
  CRISPR gRNA sequence
tttgagaaggcccagggcct

SEQ ID NO: 178660 - DNA, 20 bp, Artificial
  CRISPR gRNA sequence
ggcccagggcctaggacctg

SEQ ID NO: 178661 - DNA, 20 bp, Artificial
  CRISPR gRNA sequence
cccagggcctaggacctgca

SEQ ID NO: 178662 - DNA, 20 bp, Artificial
  CRISPR gRNA sequence
taggacctgcagagtgtcac

SEQ ID NO: 178663 - DNA, 20 bp, Artificial
  CRISPR gRNA sequence
aggacctgcagagtgtcacc

SEQ ID NO: 178664 - DNA, 20 bp, Artificial
  CRISPR gRNA sequence
gacctgcagagtgtcaccgg

SEQ ID NO: 178665 - DNA, 20 bp, Artificial
  CRISPR gRNA sequence
gtgtcaccgggagtacctgc

SEQ ID NO: 178666 - DNA, 20 bp, Artificial
  CRISPR gRNA sequence
acctgctggtttgaccactg

SEQ ID NO: 178667 - DNA, 20 bp, Artificial
  CRISPR gRNA sequence
gtttgaccactgtggctctc

SEQ ID NO: 178668 - DNA, 20 bp, Artificial
  CRISPR gRNA sequence
tgaccactgtggctctctgg

SEQ ID NO: 178669 - DNA, 20 bp, Artificial
  CRISPR gRNA sequence
ctgtggctctctggtagcat

SEQ ID NO: 178670 - DNA, 20 bp, Artificial
  CRISPR gRNA sequence
gtggctctctggtagcataa

SEQ ID NO: 178671 - DNA, 20 bp, Artificial
  CRISPR gRNA sequence
tggctctctggtagcataag

SEQ ID NO: 178672 - DNA, 20 bp, Artificial
  CRISPR gRNA sequence
tctctggtagcataagaggt

SEQ ID NO: 178673 - DNA, 20 bp, Artificial
  CRISPR gRNA sequence
ctctggtagcataagaggtc

SEQ ID NO: 178674 - DNA, 20 bp, Artificial
  CRISPR gRNA sequence
tctggtagcataagaggtca

SEQ ID NO: 178675 - DNA, 20 bp, Artificial
  CRISPR gRNA sequence
ctggtagcataagaggtcag

SEQ ID NO: 178676 - DNA, 20 bp, Artificial
  CRISPR gRNA sequence
ggtaccttgccttcctcctt

SEQ ID NO: 178677 - DNA, 20 bp, Artificial
  CRISPR gRNA sequence
gtaccttgccttcctccttc

SEQ ID NO: 178678 - DNA, 20 bp, Artificial
  CRISPR gRNA sequence
cttgccttcctccttcaggc

SEQ ID NO: 178679 - DNA, 20 bp, Artificial
  CRISPR gRNA sequence
ttgccttcctccttcaggcc

SEQ ID NO: 178680 - DNA, 20 bp, Artificial
  CRISPR gRNA sequence
tgccttcctccttcaggcca

SEQ ID NO: 178681 - DNA, 20 bp, Artificial
  CRISPR gRNA sequence
gccttcctccttcaggccag

SEQ ID NO: 178682 - DNA, 20 bp, Artificial
  CRISPR gRNA sequence
ttcctccttcaggccagggg

SEQ ID NO: 178683 - DNA, 20 bp, Artificial
  CRISPR gRNA sequence
ccttcaggccaggggcagct

SEQ ID NO: 178684 - DNA, 20 bp, Artificial
  CRISPR gRNA sequence
cttcaggccaggggcagctg

SEQ ID NO: 178685 - DNA, 20 bp, Artificial
  CRISPR gRNA sequence
cagctgaggatccctaccca

SEQ ID NO: 178686 - DNA, 20 bp, Artificial
  CRISPR gRNA sequence
ctcttttttctcctgccctc

SEQ ID NO: 178687 - DNA, 20 bp, Artificial
  CRISPR gRNA sequence
tcttttttctcctgccctct

SEQ ID NO: 178688 - DNA, 20 bp, Artificial
  CRISPR gRNA sequence
ctgccctctaggccgataca

SEQ ID NO: 178689 - DNA, 20 bp, Artificial
  CRISPR gRNA sequence
ccctctaggccgatacaaag

SEQ ID NO: 178690 - DNA, 20 bp, Artificial
  CRISPR gRNA sequence
cctctaggccgatacaaagc

SEQ ID NO: 178691 - DNA, 20 bp, Artificial
  CRISPR gRNA sequence
ctctaggccgatacaaagca

SEQ ID NO: 178692 - DNA, 20 bp, Artificial
  CRISPR gRNA sequence
tctaggccgatacaaagcag

SEQ ID NO: 178693 - DNA, 20 bp, Artificial
  CRISPR gRNA sequence
gccgatacaaagcaggggaa

SEQ ID NO: 178694 - DNA, 20 bp, Artificial
  CRISPR gRNA sequence
ccgatacaaagcaggggaaa

SEQ ID NO: 178695 - DNA, 20 bp, Artificial
  CRISPR gRNA sequence
gatacaaagcaggggaaaag

SEQ ID NO: 178696 - DNA, 20 bp, Artificial
  CRISPR gRNA sequence
caaagcaggggaaaaggagc

SEQ ID NO: 178697 - DNA, 20 bp, Artificial
  CRISPR gRNA sequence
gggaaaaggagccagatccc

SEQ ID NO: 178698 - DNA, 20 bp, Artificial
  CRISPR gRNA sequence
aggagccagatcccaagacg

SEQ ID NO: 178699 - DNA, 20 bp, Artificial
  CRISPR gRNA sequence
agccagatcccaagacgtgg

SEQ ID NO: 178700 - DNA, 20 bp, Artificial
  CRISPR gRNA sequence
gccagatcccaagacgtgga

SEQ ID NO: 178701 - DNA, 20 bp, Artificial
  CRISPR gRNA sequence
ctgtgccatgaactccctgc

SEQ ID NO: 178702 - DNA, 20 bp, Artificial
  CRISPR gRNA sequence
tgaactccctgccagatatc

SEQ ID NO: 178703 - DNA, 20 bp, Artificial
  CRISPR gRNA sequence
gaactccctgccagatatcg

SEQ ID NO: 178704 - DNA, 20 bp, Artificial
  CRISPR gRNA sequence
actccctgccagatatcgag

SEQ ID NO: 178705 - DNA, 20 bp, Artificial
  CRISPR gRNA sequence
ctccctgccagatatcgagg

SEQ ID NO: 178706 - DNA, 20 bp, Artificial
  CRISPR gRNA sequence
gccagatatcgaggaggtga

SEQ ID NO: 178707 - DNA, 20 bp, Artificial
  CRISPR gRNA sequence
atatcgaggaggtgaaagac

SEQ ID NO: 178708 - DNA, 20 bp, Artificial
  CRISPR gRNA sequence
atcgaggaggtgaaagacca

SEQ ID NO: 178709 - DNA, 20 bp, Artificial
  CRISPR gRNA sequence
gaggaggtgaaagaccagag

SEQ ID NO: 178710 - DNA, 20 bp, Artificial
  CRISPR gRNA sequence
aggaggtgaaagaccagagc

SEQ ID NO: 178711 - DNA, 20 bp, Artificial
  CRISPR gRNA sequence
tgaaagaccagagcaggaac

SEQ ID NO: 178712 - DNA, 20 bp, Artificial
  CRISPR gRNA sequence
gaaagaccagagcaggaaca

SEQ ID NO: 178713 - DNA, 20 bp, Artificial
  CRISPR gRNA sequence
aaagaccagagcaggaacaa

SEQ ID NO: 178714 - DNA, 20 bp, Artificial
  CRISPR gRNA sequence
gaccagagcaggaacaaggg

SEQ ID NO: 178715 - DNA, 20 bp, Artificial
  CRISPR gRNA sequence
gagcaggaacaagggcagct

SEQ ID NO: 178716 - DNA, 20 bp, Artificial
  CRISPR gRNA sequence
caagggcagctcagctgtgc

SEQ ID NO: 178717 - DNA, 20 bp, Artificial
  CRISPR gRNA sequence
gctcagctgtgcgagtgtac

SEQ ID NO: 178718 - DNA, 20 bp, Artificial
  CRISPR gRNA sequence
ggatgcttccacctctcacc

SEQ ID NO: 178719 - DNA, 20 bp, Artificial
  CRISPR gRNA sequence
ttccacctctcaccaagaac

SEQ ID NO: 178720 - DNA, 20 bp, Artificial
  CRISPR gRNA sequence
ccacctctcaccaagaacca

SEQ ID NO: 178721 - DNA, 20 bp, Artificial
  CRISPR gRNA sequence
tctcaccaagaaccagagaa

SEQ ID NO: 178722 - DNA, 20 bp, Artificial
  CRISPR gRNA sequence
ctcaccaagaaccagagaaa

SEQ ID NO: 178723 - DNA, 20 bp, Artificial
  CRISPR gRNA sequence
gaaccagagaaaaggtatcc

SEQ ID NO: 178724 - DNA, 20 bp, Artificial
  CRISPR gRNA sequence
aaccagagaaaaggtatcca

SEQ ID NO: 178725 - DNA, 20 bp, Artificial
  CRISPR gRNA sequence
gaaaaggtatccaaggactc

SEQ ID NO: 178726 - DNA, 20 bp, Artificial
  CRISPR gRNA sequence
aaaaggtatccaaggactct

SEQ ID NO: 178727 - DNA, 20 bp, Artificial
  CRISPR gRNA sequence
atccaaggactctgggtcct

SEQ ID NO: 178728 - DNA, 20 bp, Artificial
  CRISPR gRNA sequence
tccaaggactctgggtcctt

SEQ ID NO: 178729 - DNA, 20 bp, Artificial
  CRISPR gRNA sequence
aaggactctgggtccttggg

SEQ ID NO: 178730 - DNA, 20 bp, Artificial
  CRISPR gRNA sequence
ctgggtccttgggaagccct

SEQ ID NO: 178731 - DNA, 20 bp, Artificial
  CRISPR gRNA sequence
tgggtccttgggaagccctc

SEQ ID NO: 178732 - DNA, 20 bp, Artificial
  CRISPR gRNA sequence
gggtccttgggaagccctca

SEQ ID NO: 178733 - DNA, 20 bp, Artificial
  CRISPR gRNA sequence
gtccttgggaagccctcagg

SEQ ID NO: 178734 - DNA, 20 bp, Artificial
  CRISPR gRNA sequence
tccttgggaagccctcaggg

SEQ ID NO: 178735 - DNA, 20 bp, Artificial
  CRISPR gRNA sequence
ccttgggaagccctcaggga

SEQ ID NO: 178736 - DNA, 20 bp, Artificial
  CRISPR gRNA sequence
ttgggaagccctcagggagg

SEQ ID NO: 178737 - DNA, 20 bp, Artificial
  CRISPR gRNA sequence
tgggaagccctcagggaggg

SEQ ID NO: 178738 - DNA, 20 bp, Artificial
  CRISPR gRNA sequence
gggaagccctcagggaggga

SEQ ID NO: 178739 - DNA, 20 bp, Artificial
  CRISPR gRNA sequence
aagccctcagggagggaggg

SEQ ID NO: 178740 - DNA, 20 bp, Artificial
  CRISPR gRNA sequence
ccctcagggagggagggtag

SEQ ID NO: 178741 - DNA, 20 bp, Artificial
  CRISPR gRNA sequence
cctcagggagggagggtaga

SEQ ID NO: 178742 - DNA, 20 bp, Artificial
  CRISPR gRNA sequence
tcagggagggagggtagaag

SEQ ID NO: 178743 - DNA, 20 bp, Artificial
  CRISPR gRNA sequence
cagggagggagggtagaagg

SEQ ID NO: 178744 - DNA, 20 bp, Artificial
  CRISPR gRNA sequence
gagggagggtagaaggaggt

SEQ ID NO: 178745 - DNA, 20 bp, Artificial
  CRISPR gRNA sequence
gagggtagaaggaggtcagc

SEQ ID NO: 178746 - DNA, 20 bp, Artificial
  CRISPR gRNA sequence
agggtagaaggaggtcagct

SEQ ID NO: 178747 - DNA, 20 bp, Artificial
  CRISPR gRNA sequence
gggtagaaggaggtcagctg

SEQ ID NO: 178748 - DNA, 20 bp, Artificial
  CRISPR gRNA sequence
agaaggaggtcagctggggc

SEQ ID NO: 178749 - DNA, 20 bp, Artificial
  CRISPR gRNA sequence
aaggaggtcagctggggctg

SEQ ID NO: 178750 - DNA, 20 bp, Artificial
  CRISPR gRNA sequence
ggaggtcagctggggctgga

SEQ ID NO: 178751 - DNA, 20 bp, Artificial
  CRISPR gRNA sequence
ggggctggagagcctgcacc

SEQ ID NO: 178752 - DNA, 20 bp, Artificial
  CRISPR gRNA sequence
gggctggagagcctgcacca

SEQ ID NO: 178753 - DNA, 20 bp, Artificial
  CRISPR gRNA sequence
agagcctgcaccaaggctga

SEQ ID NO: 178754 - DNA, 20 bp, Artificial
  CRISPR gRNA sequence
ctgacagcccgtctgcccca

SEQ ID NO: 178755 - DNA, 20 bp, Artificial
  CRISPR gRNA sequence
cagcccgtctgccccacaga

SEQ ID NO: 178756 - DNA, 20 bp, Artificial
  CRISPR gRNA sequence
ccgtctgccccacagaaaga

SEQ ID NO: 178757 - DNA, 20 bp, Artificial
  CRISPR gRNA sequence
gccccacagaaagaaagtcg

SEQ ID NO: 178758 - DNA, 20 bp, Artificial
  CRISPR gRNA sequence
acagaaagaaagtcgaagtc

SEQ ID NO: 178759 - DNA, 20 bp, Artificial
  CRISPR gRNA sequence
aagaaagtcgaagtccagcc

SEQ ID NO: 178760 - DNA, 20 bp, Artificial
  CRISPR gRNA sequence
cgaagtccagccgagatgct

SEQ ID NO: 178761 - DNA, 20 bp, Artificial
  CRISPR gRNA sequence
aagtccagccgagatgctaa

SEQ ID NO: 178762 - DNA, 20 bp, Artificial
  CRISPR gRNA sequence
ccagccgagatgctaagagc

SEQ ID NO: 178763 - DNA, 20 bp, Artificial
  CRISPR gRNA sequence
cagccgagatgctaagagca

SEQ ID NO: 178764 - DNA, 20 bp, Artificial
  CRISPR gRNA sequence
gagatgctaagagcaaggcc

SEQ ID NO: 178765 - DNA, 20 bp, Artificial
  CRISPR gRNA sequence
gatgctaagagcaaggccaa

SEQ ID NO: 178766 - DNA, 20 bp, Artificial
  CRISPR gRNA sequence
atgctaagagcaaggccaag

SEQ ID NO: 178767 - DNA, 20 bp, Artificial
  CRISPR gRNA sequence
ctaagagcaaggccaagagg

SEQ ID NO: 178768 - DNA, 20 bp, Artificial
  CRISPR gRNA sequence
taagagcaaggccaagagga

SEQ ID NO: 178769 - DNA, 20 bp, Artificial
  CRISPR gRNA sequence
agcaaggccaagaggaaggt

SEQ ID NO: 178770 - DNA, 20 bp, Artificial
  CRISPR gRNA sequence
ggccaagaggaaggtgagtg

SEQ ID NO: 178771 - DNA, 20 bp, Artificial
  CRISPR gRNA sequence
aggaaggtgagtgtggtcct

SEQ ID NO: 178772 - DNA, 20 bp, Artificial
  CRISPR gRNA sequence
aaggtgagtgtggtcctaag

SEQ ID NO: 178773 - DNA, 20 bp, Artificial
  CRISPR gRNA sequence
tgagtgtggtcctaagcagc

SEQ ID NO: 178774 - DNA, 20 bp, Artificial
  CRISPR gRNA sequence
gagtgtggtcctaagcagcc

SEQ ID NO: 178775 - DNA, 20 bp, Artificial
  CRISPR gRNA sequence
gtcctaagcagccaggcctt

SEQ ID NO: 178776 - DNA, 20 bp, Artificial
  CRISPR gRNA sequence
gccaggcctttggtcacctg

SEQ ID NO: 178777 - DNA, 20 bp, Artificial
  CRISPR gRNA sequence
ccaggcctttggtcacctgt

SEQ ID NO: 178778 - DNA, 20 bp, Artificial
  CRISPR gRNA sequence
gcctttggtcacctgtgggc

SEQ ID NO: 178779 - DNA, 20 bp, Artificial
  CRISPR gRNA sequence
cctttggtcacctgtgggcc

SEQ ID NO: 178780 - DNA, 20 bp, Artificial
  CRISPR gRNA sequence
ctttggtcacctgtgggcca

SEQ ID NO: 178781 - DNA, 20 bp, Artificial
  CRISPR gRNA sequence
ggtcacctgtgggccagggt

SEQ ID NO: 178782 - DNA, 20 bp, Artificial
  CRISPR gRNA sequence
cacctgtgggccagggtgag

SEQ ID NO: 178783 - DNA, 20 bp, Artificial
  CRISPR gRNA sequence
ctgtgggccagggtgagcag

SEQ ID NO: 178784 - DNA, 20 bp, Artificial
  CRISPR gRNA sequence
tgggccagggtgagcagtgg

SEQ ID NO: 178785 - DNA, 20 bp, Artificial
  CRISPR gRNA sequence
tgagcagtggaagaaatgct

SEQ ID NO: 178786 - DNA, 20 bp, Artificial
  CRISPR gRNA sequence
gagcagtggaagaaatgcta

SEQ ID NO: 178787 - DNA, 20 bp, Artificial
  CRISPR gRNA sequence
cagtggaagaaatgctaagg

SEQ ID NO: 178788 - DNA, 20 bp, Artificial
  CRISPR gRNA sequence
agtggaagaaatgctaaggt

SEQ ID NO: 178789 - DNA, 20 bp, Artificial
  CRISPR gRNA sequence
aagaaatgctaaggtgggcc

SEQ ID NO: 178790 - DNA, 20 bp, Artificial
  CRISPR gRNA sequence
agaaatgctaaggtgggcct

SEQ ID NO: 178791 - DNA, 20 bp, Artificial
  CRISPR gRNA sequence
gctaaggtgggcctgggcct

SEQ ID NO: 178792 - DNA, 20 bp, Artificial
  CRISPR gRNA sequence
taagctgctttctccctcga

SEQ ID NO: 178793 - DNA, 20 bp, Artificial
  CRISPR gRNA sequence
tttctccctcgacagtcatg

SEQ ID NO: 178794 - DNA, 20 bp, Artificial
  CRISPR gRNA sequence
ttctccctcgacagtcatgt

SEQ ID NO: 178795 - DNA, 20 bp, Artificial
  CRISPR gRNA sequence
tctccctcgacagtcatgtg

SEQ ID NO: 178796 - DNA, 20 bp, Artificial
  CRISPR gRNA sequence
cgacagtcatgtggggattc

SEQ ID NO: 178797 - DNA, 20 bp, Artificial
  CRISPR gRNA sequence
agccctgataccttctctga

SEQ ID NO: 178798 - DNA, 20 bp, Artificial
  CRISPR gRNA sequence
gataccttctctgatggact

SEQ ID NO: 178799 - DNA, 20 bp, Artificial
  CRISPR gRNA sequence
accttctctgatggactcag

SEQ ID NO: 178800 - DNA, 20 bp, Artificial
  CRISPR gRNA sequence
tccactctgcctgatgacca

SEQ ID NO: 178801 - DNA, 20 bp, Artificial
  CRISPR gRNA sequence
actctgcctgatgaccacag

SEQ ID NO: 178802 - DNA, 20 bp, Artificial
  CRISPR gRNA sequence
tgatgaccacagcagctaca

SEQ ID NO: 178803 - DNA, 20 bp, Artificial
  CRISPR gRNA sequence
ccacagcagctacacagttc

SEQ ID NO: 178804 - DNA, 20 bp, Artificial
  CRISPR gRNA sequence
cacagcagctacacagttcc

SEQ ID NO: 178805 - DNA, 20 bp, Artificial
  CRISPR gRNA sequence
acacagttccaggctacatg

SEQ ID NO: 178806 - DNA, 20 bp, Artificial
  CRISPR gRNA sequence
cacagttccaggctacatgc

SEQ ID NO: 178807 - DNA, 20 bp, Artificial
  CRISPR gRNA sequence
tccaggctacatgcaggact

SEQ ID NO: 178808 - DNA, 20 bp, Artificial
  CRISPR gRNA sequence
caggctacatgcaggacttg

SEQ ID NO: 178809 - DNA, 20 bp, Artificial
  CRISPR gRNA sequence
aggctacatgcaggacttgg

SEQ ID NO: 178810 - DNA, 20 bp, Artificial
  CRISPR gRNA sequence
ctacatgcaggacttggagg

SEQ ID NO: 178811 - DNA, 20 bp, Artificial
  CRISPR gRNA sequence
acatgcaggacttggaggtg

SEQ ID NO: 178812 - DNA, 20 bp, Artificial
  CRISPR gRNA sequence
tgcaggacttggaggtggag

SEQ ID NO: 178813 - DNA, 20 bp, Artificial
  CRISPR gRNA sequence
gcaggacttggaggtggagc

SEQ ID NO: 178814 - DNA, 20 bp, Artificial
  CRISPR gRNA sequence
ggtggagcaggccctgactc

SEQ ID NO: 178815 - DNA, 20 bp, Artificial
  CRISPR gRNA sequence
gtggagcaggccctgactcc

SEQ ID NO: 178816 - DNA, 20 bp, Artificial
  CRISPR gRNA sequence
agcaggccctgactccaggt

SEQ ID NO: 178817 - DNA, 20 bp, Artificial
  CRISPR gRNA sequence
ggccctgactccaggtgagc

SEQ ID NO: 178818 - DNA, 20 bp, Artificial
  CRISPR gRNA sequence
tgactccaggtgagctggtc

SEQ ID NO: 178819 - DNA, 20 bp, Artificial
  CRISPR gRNA sequence
gactccaggtgagctggtcc

SEQ ID NO: 178820 - DNA, 20 bp, Artificial
  CRISPR gRNA sequence
caggtgagctggtccaggtc

SEQ ID NO: 178821 - DNA, 20 bp, Artificial
  CRISPR gRNA sequence
gtgagctggtccaggtctgg

SEQ ID NO: 178822 - DNA, 20 bp, Artificial
  CRISPR gRNA sequence
tgagctggtccaggtctggc

SEQ ID NO: 178823 - DNA, 20 bp, Artificial
  CRISPR gRNA sequence
agctggtccaggtctggcag

SEQ ID NO: 178824 - DNA, 20 bp, Artificial
  CRISPR gRNA sequence
aggtctggcaggagacccca

SEQ ID NO: 178825 - DNA, 20 bp, Artificial
  CRISPR gRNA sequence
ggtctggcaggagaccccac

SEQ ID NO: 178826 - DNA, 20 bp, Artificial
  CRISPR gRNA sequence
tggcaggagaccccacaggt

SEQ ID NO: 178827 - DNA, 20 bp, Artificial
  CRISPR gRNA sequence
caggagaccccacaggtcag

SEQ ID NO: 178828 - DNA, 20 bp, Artificial
  CRISPR gRNA sequence
aggagaccccacaggtcagt

SEQ ID NO: 178829 - DNA, 20 bp, Artificial
  CRISPR gRNA sequence
agtgggatgactctttctct

SEQ ID NO: 178830 - DNA, 20 bp, Artificial
  CRISPR gRNA sequence
tgggatgactctttctcttg

SEQ ID NO: 178831 - DNA, 20 bp, Artificial
  CRISPR gRNA sequence
gggatgactctttctcttgg

SEQ ID NO: 178832 - DNA, 20 bp, Artificial
  CRISPR gRNA sequence
gactctttctcttggaggca

SEQ ID NO: 178833 - DNA, 20 bp, Artificial
  CRISPR gRNA sequence
ttctcttggaggcatggtgc

SEQ ID NO: 178834 - DNA, 20 bp, Artificial
  CRISPR gRNA sequence
ggaggcatggtgctggcaca

SEQ ID NO: 178835 - DNA, 20 bp, Artificial
  CRISPR gRNA sequence
ggcatggtgctggcacatgg

SEQ ID NO: 178836 - DNA, 20 bp, Artificial
  CRISPR gRNA sequence
gctggcacatggtggcccat

SEQ ID NO: 178837 - DNA, 20 bp, Artificial
  CRISPR gRNA sequence
cacatggtggcccattagtg

SEQ ID NO: 178838 - DNA, 20 bp, Artificial
  CRISPR gRNA sequence
acatggtggcccattagtgc

SEQ ID NO: 178839 - DNA, 20 bp, Artificial
  CRISPR gRNA sequence
tggcccattagtgcaggctg

SEQ ID NO: 178840 - DNA, 20 bp, Artificial
  CRISPR gRNA sequence
ggcccattagtgcaggctgc

SEQ ID NO: 178841 - DNA, 20 bp, Artificial
  CRISPR gRNA sequence
gcccattagtgcaggctgca

SEQ ID NO: 178842 - DNA, 20 bp, Artificial
  CRISPR gRNA sequence
attagtgcaggctgcagggt

SEQ ID NO: 178843 - DNA, 20 bp, Artificial
  CRISPR gRNA sequence
gtgcaggctgcagggttggt

SEQ ID NO: 178844 - DNA, 20 bp, Artificial
  CRISPR gRNA sequence
gcaggctgcagggttggtcg

SEQ ID NO: 178845 - DNA, 20 bp, Artificial
  CRISPR gRNA sequence
caggctgcagggttggtcgg

SEQ ID NO: 178846 - DNA, 20 bp, Artificial
  CRISPR gRNA sequence
aggctgcagggttggtcgga

SEQ ID NO: 178847 - DNA, 20 bp, Artificial
  CRISPR gRNA sequence
cgctcgatgtcttgcaaact

SEQ ID NO: 178848 - DNA, 20 bp, Artificial
  CRISPR gRNA sequence
cgatgtcttgcaaactaaga

SEQ ID NO: 178849 - DNA, 20 bp, Artificial
  CRISPR gRNA sequence
aagcacacaaccttgacctg

SEQ ID NO: 178850 - DNA, 20 bp, Artificial
  CRISPR gRNA sequence
ctgtggcttctgctgttccc

SEQ ID NO: 178851 - DNA, 20 bp, Artificial
  CRISPR gRNA sequence
gcactgtcgccatgtgctgt

SEQ ID NO: 178852 - DNA, 20 bp, Artificial
  CRISPR gRNA sequence
ctgtcgccatgtgctgtcag

SEQ ID NO: 178853 - DNA, 20 bp, Artificial
  CRISPR gRNA sequence
tcagcagcactctccccgac

SEQ ID NO: 178854 - DNA, 20 bp, Artificial
  CRISPR gRNA sequence
tctccccgactggcacatcc

SEQ ID NO: 178855 - DNA, 20 bp, Artificial
  CRISPR gRNA sequence
ccccgactggcacatcccag

SEQ ID NO: 178856 - DNA, 20 bp, Artificial
  CRISPR gRNA sequence
cgactggcacatcccagtgg

SEQ ID NO: 178857 - DNA, 20 bp, Artificial
  CRISPR gRNA sequence
catcccagtggaagttgtgc

SEQ ID NO: 178858 - DNA, 20 bp, Artificial
  CRISPR gRNA sequence
ccagtggaagttgtgccgga

SEQ ID NO: 178859 - DNA, 20 bp, Artificial
  CRISPR gRNA sequence
gaagttgtgccggacagcac

SEQ ID NO: 178860 - DNA, 20 bp, Artificial
  CRISPR gRNA sequence
ccagtgatctgtacaacttc

SEQ ID NO: 178861 - DNA, 20 bp, Artificial
  CRISPR gRNA sequence
cagtgatctgtacaacttcc

SEQ ID NO: 178862 - DNA, 20 bp, Artificial
  CRISPR gRNA sequence
acccatgccctccacctctg

SEQ ID NO: 178863 - DNA, 20 bp, Artificial
  CRISPR gRNA sequence
cccatgccctccacctctga

SEQ ID NO: 178864 - DNA, 20 bp, Artificial
  CRISPR gRNA sequence
tgccctccacctctgaaggt

SEQ ID NO: 178865 - DNA, 20 bp, Artificial
  CRISPR gRNA sequence
cctctgaaggttggtgctcc

SEQ ID NO: 178866 - DNA, 20 bp, Artificial
  CRISPR gRNA sequence
ctctgaaggttggtgctcct

SEQ ID NO: 178867 - DNA, 20 bp, Artificial
  CRISPR gRNA sequence
tctgaaggttggtgctcctg

SEQ ID NO: 178868 - DNA, 20 bp, Artificial
  CRISPR gRNA sequence
aggttggtgctcctggggcc

SEQ ID NO: 178869 - DNA, 20 bp, Artificial
  CRISPR gRNA sequence
ggcctgcctgcttgactgtc

SEQ ID NO: 178870 - DNA, 20 bp, Artificial
  CRISPR gRNA sequence
gcctgcctgcttgactgtct

SEQ ID NO: 178871 - DNA, 20 bp, Artificial
  CRISPR gRNA sequence
ttgactgtctgggtcctgtg

SEQ ID NO: 178872 - DNA, 20 bp, Artificial
  CRISPR gRNA sequence
tgactgtctgggtcctgtga

SEQ ID NO: 178873 - DNA, 20 bp, Artificial
  CRISPR gRNA sequence
gactgtctgggtcctgtgaa

SEQ ID NO: 178874 - DNA, 20 bp, Artificial
  CRISPR gRNA sequence
ggtcctgtgaagggcttcct

SEQ ID NO: 178875 - DNA, 20 bp, Artificial
  CRISPR gRNA sequence
tcctgtgaagggcttcctga

SEQ ID NO: 178876 - DNA, 20 bp, Artificial
  CRISPR gRNA sequence
ctgtgaagggcttcctgaga

SEQ ID NO: 178877 - DNA, 20 bp, Artificial
  CRISPR gRNA sequence
aagggcttcctgagagagaa

SEQ ID NO: 178878 - DNA, 20 bp, Artificial
  CRISPR gRNA sequence
cctgagagagaaaagatgat

SEQ ID NO: 178879 - DNA, 20 bp, Artificial
  CRISPR gRNA sequence
aagatgatcagaactccacc

SEQ ID NO: 178880 - DNA, 20 bp, Artificial
  CRISPR gRNA sequence
cacctggcactgaattgatt

SEQ ID NO: 178881 - DNA, 20 bp, Artificial
  CRISPR gRNA sequence
tggcactgaattgattgagt

SEQ ID NO: 178882 - DNA, 20 bp, Artificial
  CRISPR gRNA sequence
ggcactgaattgattgagtt

SEQ ID NO: 178883 - DNA, 20 bp, Artificial
  CRISPR gRNA sequence
tgattgagttgggcattgcc

SEQ ID NO: 178884 - DNA, 20 bp, Artificial
  CRISPR gRNA sequence
agttgggcattgcccagtct

SEQ ID NO: 178885 - DNA, 20 bp, Artificial
  CRISPR gRNA sequence
ttgcccagtcttagccacca

SEQ ID NO: 178886 - DNA, 20 bp, Artificial
  CRISPR gRNA sequence
tgcccagtcttagccaccat

SEQ ID NO: 178887 - DNA, 20 bp, Artificial
  CRISPR gRNA sequence
gcccagtcttagccaccata

SEQ ID NO: 178888 - DNA, 20 bp, Artificial
  CRISPR gRNA sequence
cccagtcttagccaccatag

SEQ ID NO: 178889 - DNA, 20 bp, Artificial
  CRISPR gRNA sequence
ccagtcttagccaccatagg

SEQ ID NO: 178890 - DNA, 20 bp, Artificial
  CRISPR gRNA sequence
agtcttagccaccatagggg

SEQ ID NO: 178891 - DNA, 20 bp, Artificial
  CRISPR gRNA sequence
gtcttagccaccataggggg

SEQ ID NO: 178892 - DNA, 20 bp, Artificial
  CRISPR gRNA sequence
tagccaccatagggggaggc

SEQ ID NO: 178893 - DNA, 20 bp, Artificial
  CRISPR gRNA sequence
ccatagggggaggcaagcga

SEQ ID NO: 178894 - DNA, 20 bp, Artificial
  CRISPR gRNA sequence
catagggggaggcaagcgac

SEQ ID NO: 178895 - DNA, 20 bp, Artificial
  CRISPR gRNA sequence
atagggggaggcaagcgacg

SEQ ID NO: 178896 - DNA, 20 bp, Artificial
  CRISPR gRNA sequence
gaggcaagcgacggggacac

SEQ ID NO: 178897 - DNA, 20 bp, Artificial
  CRISPR gRNA sequence
aggcaagcgacggggacact

SEQ ID NO: 178898 - DNA, 20 bp, Artificial
  CRISPR gRNA sequence
caagcgacggggacactagg

SEQ ID NO: 178899 - DNA, 20 bp, Artificial
  CRISPR gRNA sequence
aagcgacggggacactagga

SEQ ID NO: 178900 - DNA, 20 bp, Artificial
  CRISPR gRNA sequence
cgacggggacactaggaagg

SEQ ID NO: 178901 - DNA, 20 bp, Artificial
  CRISPR gRNA sequence
gggacactaggaaggcagtt

SEQ ID NO: 178902 - DNA, 20 bp, Artificial
  CRISPR gRNA sequence
gacactaggaaggcagttca

SEQ ID NO: 178903 - DNA, 20 bp, Artificial
  CRISPR gRNA sequence
actaggaaggcagttcagag

SEQ ID NO: 178904 - DNA, 20 bp, Artificial
  CRISPR gRNA sequence
ctaggaaggcagttcagagt

SEQ ID NO: 178905 - DNA, 20 bp, Artificial
  CRISPR gRNA sequence
aggcagttcagagtgggctg

SEQ ID NO: 178906 - DNA, 20 bp, Artificial
  CRISPR gRNA sequence
gttcagagtgggctgcagta

SEQ ID NO: 178907 - DNA, 20 bp, Artificial
  CRISPR gRNA sequence
cagagtgggctgcagtacag

SEQ ID NO: 178908 - DNA, 20 bp, Artificial
  CRISPR gRNA sequence
agagtgggctgcagtacagt

SEQ ID NO: 178909 - DNA, 20 bp, Artificial
  CRISPR gRNA sequence
gagtgggctgcagtacagtg

SEQ ID NO: 178910 - DNA, 20 bp, Artificial
  CRISPR gRNA sequence
agtgggctgcagtacagtgg

SEQ ID NO: 178911 - DNA, 20 bp, Artificial
  CRISPR gRNA sequence
ggctgcagtacagtgggggc

SEQ ID NO: 178912 - DNA, 20 bp, Artificial
  CRISPR gRNA sequence
gcagtacagtgggggctggt

SEQ ID NO: 178913 - DNA, 20 bp, Artificial
  CRISPR gRNA sequence
agtacagtgggggctggtga

SEQ ID NO: 178914 - DNA, 20 bp, Artificial
  CRISPR gRNA sequence
gtacagtgggggctggtgag

SEQ ID NO: 178915 - DNA, 20 bp, Artificial
  CRISPR gRNA sequence
acagtgggggctggtgagag

SEQ ID NO: 178916 - DNA, 20 bp, Artificial
  CRISPR gRNA sequence
cagtgggggctggtgagagg

SEQ ID NO: 178917 - DNA, 20 bp, Artificial
  CRISPR gRNA sequence
agtgggggctggtgagagga

SEQ ID NO: 178918 - DNA, 20 bp, Artificial
  CRISPR gRNA sequence
gggggctggtgagaggaggg

SEQ ID NO: 178919 - DNA, 20 bp, Artificial
  CRISPR gRNA sequence
ggggctggtgagaggaggga

SEQ ID NO: 178920 - DNA, 20 bp, Artificial
  CRISPR gRNA sequence
gggctggtgagaggagggaa

SEQ ID NO: 178921 - DNA, 20 bp, Artificial
  CRISPR gRNA sequence
ggctggtgagaggagggaag

SEQ ID NO: 178922 - DNA, 20 bp, Artificial
  CRISPR gRNA sequence
gctggtgagaggagggaagg

SEQ ID NO: 178923 - DNA, 20 bp, Artificial
  CRISPR gRNA sequence
gtgagaggagggaagggggc

SEQ ID NO: 178924 - DNA, 20 bp, Artificial
  CRISPR gRNA sequence
tgagaggagggaagggggcc

SEQ ID NO: 178925 - DNA, 20 bp, Artificial
  CRISPR gRNA sequence
gagaggagggaagggggcca

SEQ ID NO: 178926 - DNA, 20 bp, Artificial
  CRISPR gRNA sequence
agaggagggaagggggccag

SEQ ID NO: 178927 - DNA, 20 bp, Artificial
  CRISPR gRNA sequence
gggggccaggggctgcattt

SEQ ID NO: 178928 - DNA, 20 bp, Artificial
  CRISPR gRNA sequence
ggggccaggggctgcatttt

SEQ ID NO: 178929 - DNA, 20 bp, Artificial
  CRISPR gRNA sequence
gggccaggggctgcattttg

SEQ ID NO: 178930 - DNA, 20 bp, Artificial
  CRISPR gRNA sequence
ggggctgcattttggggtgc

SEQ ID NO: 178931 - DNA, 20 bp, Artificial
  CRISPR gRNA sequence
tggttctccttcctcctctg

SEQ ID NO: 178932 - DNA, 20 bp, Artificial
  CRISPR gRNA sequence
ctccttcctcctctgtagcc

SEQ ID NO: 178933 - DNA, 20 bp, Artificial
  CRISPR gRNA sequence
tcctctgtagcccagcatct

SEQ ID NO: 178934 - DNA, 20 bp, Artificial
  CRISPR gRNA sequence
cctctgtagcccagcatctg

SEQ ID NO: 178935 - DNA, 20 bp, Artificial
  CRISPR gRNA sequence
ctctgtagcccagcatctga

SEQ ID NO: 178936 - DNA, 20 bp, Artificial
  CRISPR gRNA sequence
gtagcccagcatctgagggt

SEQ ID NO: 178937 - DNA, 20 bp, Artificial
  CRISPR gRNA sequence
tagcccagcatctgagggtg

SEQ ID NO: 178938 - DNA, 20 bp, Artificial
  CRISPR gRNA sequence
cccagcatctgagggtgagg

SEQ ID NO: 178939 - DNA, 20 bp, Artificial
  CRISPR gRNA sequence
ccagcatctgagggtgagga

SEQ ID NO: 178940 - DNA, 20 bp, Artificial
  CRISPR gRNA sequence
gcatctgagggtgaggaagg

SEQ ID NO: 178941 - DNA, 20 bp, Artificial
  CRISPR gRNA sequence
tctgagggtgaggaaggaag

SEQ ID NO: 178942 - DNA, 20 bp, Artificial
  CRISPR gRNA sequence
ctgagggtgaggaaggaagt

SEQ ID NO: 178943 - DNA, 20 bp, Artificial
  CRISPR gRNA sequence
tgagggtgaggaaggaagta

SEQ ID NO: 178944 - DNA, 20 bp, Artificial
  CRISPR gRNA sequence
gggtgaggaaggaagtaggg

SEQ ID NO: 178945 - DNA, 20 bp, Artificial
  CRISPR gRNA sequence
ggtgaggaaggaagtagggt

SEQ ID NO: 178946 - DNA, 20 bp, Artificial
  CRISPR gRNA sequence
gtgaggaaggaagtagggta

SEQ ID NO: 178947 - DNA, 20 bp, Artificial
  CRISPR gRNA sequence
tgaggaaggaagtagggtag

SEQ ID NO: 178948 - DNA, 20 bp, Artificial
  CRISPR gRNA sequence
ggaaggaagtagggtagggg

SEQ ID NO: 178949 - DNA, 20 bp, Artificial
  CRISPR gRNA sequence
gaaggaagtagggtaggggt

SEQ ID NO: 178950 - DNA, 20 bp, Artificial
  CRISPR gRNA sequence
ggaagtagggtaggggtggg

SEQ ID NO: 178951 - DNA, 20 bp, Artificial
  CRISPR gRNA sequence
agtagggtaggggtgggaag

SEQ ID NO: 178952 - DNA, 20 bp, Artificial
  CRISPR gRNA sequence
ggtaggggtgggaagcggcg

SEQ ID NO: 178953 - DNA, 20 bp, Artificial
  CRISPR gRNA sequence
ggtgggaagcggcgtggctt

SEQ ID NO: 178954 - DNA, 20 bp, Artificial
  CRISPR gRNA sequence
gtgggaagcggcgtggcttc

SEQ ID NO: 178955 - DNA, 20 bp, Artificial
  CRISPR gRNA sequence
tgggaagcggcgtggcttca

SEQ ID NO: 178956 - DNA, 20 bp, Artificial
  CRISPR gRNA sequence
gcggcgtggcttcagggttt

SEQ ID NO: 178957 - DNA, 20 bp, Artificial
  CRISPR gRNA sequence
ggcgtggcttcagggtttga

SEQ ID NO: 178958 - DNA, 20 bp, Artificial
  CRISPR gRNA sequence
gcgtggcttcagggtttgag

SEQ ID NO: 178959 - DNA, 20 bp, Artificial
  CRISPR gRNA sequence
gcttcagggtttgagaggct

SEQ ID NO: 178960 - DNA, 20 bp, Artificial
  CRISPR gRNA sequence
ggtttgagaggctgagtcac

SEQ ID NO: 178961 - DNA, 20 bp, Artificial
  CRISPR gRNA sequence
gtttgagaggctgagtcacc

SEQ ID NO: 178962 - DNA, 20 bp, Artificial
  CRISPR gRNA sequence
gagaggctgagtcaccaggc

SEQ ID NO: 178963 - DNA, 20 bp, Artificial
  CRISPR gRNA sequence
agaggctgagtcaccaggcc

SEQ ID NO: 178964 - DNA, 20 bp, Artificial
  CRISPR gRNA sequence
gaggctgagtcaccaggcca

SEQ ID NO: 178965 - DNA, 20 bp, Artificial
  CRISPR gRNA sequence
accaggccagggtcctgttc

SEQ ID NO: 178966 - DNA, 20 bp, Artificial
  CRISPR gRNA sequence
gtcctgttctggaatctcta

SEQ ID NO: 178967 - DNA, 20 bp, Artificial
  CRISPR gRNA sequence
ctgttctggaatctctatgg

SEQ ID NO: 178968 - DNA, 20 bp, Artificial
  CRISPR gRNA sequence
tctggaatctctatggcaga

SEQ ID NO: 178969 - DNA, 20 bp, Artificial
  CRISPR gRNA sequence
ctggaatctctatggcagat

SEQ ID NO: 178970 - DNA, 20 bp, Artificial
  CRISPR gRNA sequence
tctatggcagataggtccac

SEQ ID NO: 178971 - DNA, 20 bp, Artificial
  CRISPR gRNA sequence
ctatggcagataggtccacc

SEQ ID NO: 178972 - DNA, 20 bp, Artificial
  CRISPR gRNA sequence
atggcagataggtccaccgg

SEQ ID NO: 178973 - DNA, 20 bp, Artificial
  CRISPR gRNA sequence
tggcagataggtccaccggg

SEQ ID NO: 178974 - DNA, 20 bp, Artificial
  CRISPR gRNA sequence
ggcagataggtccaccggga

SEQ ID NO: 178975 - DNA, 20 bp, Artificial
  CRISPR gRNA sequence
gtgtgtgtgtgtgtgtgtgt

SEQ ID NO: 178976 - DNA, 20 bp, Artificial
  CRISPR gRNA sequence
gtgtgtgtgtgtgtgtgtca

SEQ ID NO: 178977 - DNA, 20 bp, Artificial
  CRISPR gRNA sequence
gtgtgtgtgtgtgtgtcaga

SEQ ID NO: 178978 - DNA, 20 bp, Artificial
  CRISPR gRNA sequence
gtgtgtgtgtgtcagagaga

SEQ ID NO: 178979 - DNA, 20 bp, Artificial
  CRISPR gRNA sequence
gtgtgtgtgtcagagagaca

SEQ ID NO: 178980 - DNA, 20 bp, Artificial
  CRISPR gRNA sequence
gtgtgtgtcagagagacaga

SEQ ID NO: 178981 - DNA, 20 bp, Artificial
  CRISPR gRNA sequence
gtgtcagagagacagagaga

SEQ ID NO: 178982 - DNA, 20 bp, Artificial
  CRISPR gRNA sequence
gtcagagagacagagagaca

SEQ ID NO: 178983 - DNA, 20 bp, Artificial
  CRISPR gRNA sequence
gagagacagagagacagaga

SEQ ID NO: 178984 - DNA, 20 bp, Artificial
  CRISPR gRNA sequence
agagacagagagacagagaa

SEQ ID NO: 178985 - DNA, 20 bp, Artificial
  CRISPR gRNA sequence
gagacagagagacagagaaa

SEQ ID NO: 178986 - DNA, 20 bp, Artificial
  CRISPR gRNA sequence
acagagagacagagaaaggg

SEQ ID NO: 178987 - DNA, 20 bp, Artificial
  CRISPR gRNA sequence
cagagagacagagaaagggc

SEQ ID NO: 178988 - DNA, 20 bp, Artificial
  CRISPR gRNA sequence
agagagacagagaaagggca

SEQ ID NO: 178989 - DNA, 20 bp, Artificial
  CRISPR gRNA sequence
gagagacagagaaagggcag

SEQ ID NO: 178990 - DNA, 20 bp, Artificial
  CRISPR gRNA sequence
agagacagagaaagggcagg

SEQ ID NO: 178991 - DNA, 20 bp, Artificial
  CRISPR gRNA sequence
agagaaagggcagggggatc

SEQ ID NO: 178992 - DNA, 20 bp, Artificial
  CRISPR gRNA sequence
gaaagggcagggggatctgg

SEQ ID NO: 178993 - DNA, 20 bp, Artificial
  CRISPR gRNA sequence
aaagggcagggggatctggt

SEQ ID NO: 178994 - DNA, 20 bp, Artificial
  CRISPR gRNA sequence
ggcagggggatctggtgggc

SEQ ID NO: 178995 - DNA, 20 bp, Artificial
  CRISPR gRNA sequence
gggatctggtgggctggaac

SEQ ID NO: 178996 - DNA, 20 bp, Artificial
  CRISPR gRNA sequence
gtgggctggaactggaactg

SEQ ID NO: 178997 - DNA, 20 bp, Artificial
  CRISPR gRNA sequence
tgggctggaactggaactgc

SEQ ID NO: 178998 - DNA, 20 bp, Artificial
  CRISPR gRNA sequence
gggctggaactggaactgca

SEQ ID NO: 178999 - DNA, 20 bp, Artificial
  CRISPR gRNA sequence
tggaactggaactgcagggt

SEQ ID NO: 179000 - DNA, 20 bp, Artificial
  CRISPR gRNA sequence
ctggaactgcagggtgagtg

SEQ ID NO: 179001 - DNA, 20 bp, Artificial
  CRISPR gRNA sequence
gggtgagtgtggctgactgc

SEQ ID NO: 179002 - DNA, 20 bp, Artificial
  CRISPR gRNA sequence
ctctctgctttccccatcca

SEQ ID NO: 179003 - DNA, 20 bp, Artificial
  CRISPR gRNA sequence
ttccccatccacagctacaa

SEQ ID NO: 179004 - DNA, 20 bp, Artificial
  CRISPR gRNA sequence
catccacagctacaacagat

SEQ ID NO: 179005 - DNA, 20 bp, Artificial
  CRISPR gRNA sequence
atccacagctacaacagatg

SEQ ID NO: 179006 - DNA, 20 bp, Artificial
  CRISPR gRNA sequence
cagctacaacagatgaggat

SEQ ID NO: 179007 - DNA, 20 bp, Artificial
  CRISPR gRNA sequence
agctacaacagatgaggatg

SEQ ID NO: 179008 - DNA, 20 bp, Artificial
  CRISPR gRNA sequence
tacaacagatgaggatgagg

SEQ ID NO: 179009 - DNA, 20 bp, Artificial
  CRISPR gRNA sequence
acaacagatgaggatgagga

SEQ ID NO: 179010 - DNA, 20 bp, Artificial
  CRISPR gRNA sequence
caacagatgaggatgaggaa

SEQ ID NO: 179011 - DNA, 20 bp, Artificial
  CRISPR gRNA sequence
atgaggaagggaaattacct

SEQ ID NO: 179012 - DNA, 20 bp, Artificial
  CRISPR gRNA sequence
tgaggaagggaaattacctg

SEQ ID NO: 179013 - DNA, 20 bp, Artificial
  CRISPR gRNA sequence
aattacctgaggacatcatg

SEQ ID NO: 179014 - DNA, 20 bp, Artificial
  CRISPR gRNA sequence
attacctgaggacatcatga

SEQ ID NO: 179015 - DNA, 20 bp, Artificial
  CRISPR gRNA sequence
ctgaggacatcatgaaggta

SEQ ID NO: 179016 - DNA, 20 bp, Artificial
  CRISPR gRNA sequence
aggtaaagccccttcctacc

SEQ ID NO: 179017 - DNA, 20 bp, Artificial
  CRISPR gRNA sequence
ggtaaagccccttcctacct

SEQ ID NO: 179018 - DNA, 20 bp, Artificial
  CRISPR gRNA sequence
ttcctacctgggcactcttg

SEQ ID NO: 179019 - DNA, 20 bp, Artificial
  CRISPR gRNA sequence
ctcttgaagtgaccgtttct

SEQ ID NO: 179020 - DNA, 20 bp, Artificial
  CRISPR gRNA sequence
tgaagtgaccgtttctcagt

SEQ ID NO: 179021 - DNA, 20 bp, Artificial
  CRISPR gRNA sequence
gaagtgaccgtttctcagtg

SEQ ID NO: 179022 - DNA, 20 bp, Artificial
  CRISPR gRNA sequence
agtgaccgtttctcagtgag

SEQ ID NO: 179023 - DNA, 20 bp, Artificial
  CRISPR gRNA sequence
tgaccgtttctcagtgagga

SEQ ID NO: 179024 - DNA, 20 bp, Artificial
  CRISPR gRNA sequence
accgtttctcagtgaggaga

SEQ ID NO: 179025 - DNA, 20 bp, Artificial
  CRISPR gRNA sequence
tctcagtgaggagagagaac

SEQ ID NO: 179026 - DNA, 20 bp, Artificial
  CRISPR gRNA sequence
gtgaggagagagaaccagtg

SEQ ID NO: 179027 - DNA, 20 bp, Artificial
  CRISPR gRNA sequence
aaccagtgaagcttccaaat

SEQ ID NO: 179028 - DNA, 20 bp, Artificial
  CRISPR gRNA sequence
ccagtgaagcttccaaatca

SEQ ID NO: 179029 - DNA, 20 bp, Artificial
  CRISPR gRNA sequence
cagtgaagcttccaaatcag

SEQ ID NO: 179030 - DNA, 20 bp, Artificial
  CRISPR gRNA sequence
gaagcttccaaatcagagga

SEQ ID NO: 179031 - DNA, 20 bp, Artificial
  CRISPR gRNA sequence
aagcttccaaatcagaggat

SEQ ID NO: 179032 - DNA, 20 bp, Artificial
  CRISPR gRNA sequence
cttccaaatcagaggatggg

SEQ ID NO: 179033 - DNA, 20 bp, Artificial
  CRISPR gRNA sequence
gggtagctgctgttgtcacc

SEQ ID NO: 179034 - DNA, 20 bp, Artificial
  CRISPR gRNA sequence
ggctgcttgcattgtcccac

SEQ ID NO: 179035 - DNA, 20 bp, Artificial
  CRISPR gRNA sequence
ccacaagtgccacattcacg

SEQ ID NO: 179036 - DNA, 20 bp, Artificial
  CRISPR gRNA sequence
ccacattcacgtggcttgac

SEQ ID NO: 179037 - DNA, 20 bp, Artificial
  CRISPR gRNA sequence
cattcacgtggcttgactgg

SEQ ID NO: 179038 - DNA, 20 bp, Artificial
  CRISPR gRNA sequence
attcacgtggcttgactggt

SEQ ID NO: 179039 - DNA, 20 bp, Artificial
  CRISPR gRNA sequence
acgtggcttgactggtggga

SEQ ID NO: 179040 - DNA, 20 bp, Artificial
  CRISPR gRNA sequence
gactggtgggaaagccacca

SEQ ID NO: 179041 - DNA, 20 bp, Artificial
  CRISPR gRNA sequence
actggtgggaaagccaccat

SEQ ID NO: 179042 - DNA, 20 bp, Artificial
  CRISPR gRNA sequence
ggtgggaaagccaccatggg

SEQ ID NO: 179043 - DNA, 20 bp, Artificial
  CRISPR gRNA sequence
gtgggaaagccaccatggga

SEQ ID NO: 179044 - DNA, 20 bp, Artificial
  CRISPR gRNA sequence
tgggaaagccaccatgggaa

SEQ ID NO: 179045 - DNA, 20 bp, Artificial
  CRISPR gRNA sequence
gaaagccaccatgggaaggg

SEQ ID NO: 179046 - DNA, 20 bp, Artificial
  CRISPR gRNA sequence
aaagccaccatgggaaggga

SEQ ID NO: 179047 - DNA, 20 bp, Artificial
  CRISPR gRNA sequence
gccaccatgggaagggaagg

SEQ ID NO: 179048 - DNA, 20 bp, Artificial
  CRISPR gRNA sequence
ccaccatgggaagggaaggc

SEQ ID NO: 179049 - DNA, 20 bp, Artificial
  CRISPR gRNA sequence
ccatgggaagggaaggcagg

SEQ ID NO: 179050 - DNA, 20 bp, Artificial
  CRISPR gRNA sequence
catgggaagggaaggcaggt

SEQ ID NO: 179051 - DNA, 20 bp, Artificial
  CRISPR gRNA sequence
tgggaagggaaggcaggtgg

SEQ ID NO: 179052 - DNA, 20 bp, Artificial
  CRISPR gRNA sequence
gggaagggaaggcaggtggg

SEQ ID NO: 179053 - DNA, 20 bp, Artificial
  CRISPR gRNA sequence
gggaaggcaggtgggaggcc

SEQ ID NO: 179054 - DNA, 20 bp, Artificial
  CRISPR gRNA sequence
gtgggaggcctggcctctga

SEQ ID NO: 179055 - DNA, 20 bp, Artificial
  CRISPR gRNA sequence
tgggaggcctggcctctgac

SEQ ID NO: 179056 - DNA, 20 bp, Artificial
  CRISPR gRNA sequence
gcctctgacaggccgtcctg

SEQ ID NO: 179057 - DNA, 20 bp, Artificial
  CRISPR gRNA sequence
ctgacaggccgtcctgaagc

SEQ ID NO: 179058 - DNA, 20 bp, Artificial
  CRISPR gRNA sequence
ggccgtcctgaagcaagcct

SEQ ID NO: 179059 - DNA, 20 bp, Artificial
  CRISPR gRNA sequence
gccgtcctgaagcaagcctt

SEQ ID NO: 179060 - DNA, 20 bp, Artificial
  CRISPR gRNA sequence
ccgtcctgaagcaagccttg

SEQ ID NO: 179061 - DNA, 20 bp, Artificial
  CRISPR gRNA sequence
tgaagcaagccttggggcat

SEQ ID NO: 179062 - DNA, 20 bp, Artificial
  CRISPR gRNA sequence
gcaagccttggggcatcaga

SEQ ID NO: 179063 - DNA, 20 bp, Artificial
  CRISPR gRNA sequence
ggggcatcagacagctctgt

SEQ ID NO: 179064 - DNA, 20 bp, Artificial
  CRISPR gRNA sequence
catcagacagctctgtgagt

SEQ ID NO: 179065 - DNA, 20 bp, Artificial
  CRISPR gRNA sequence
atcagacagctctgtgagtc

SEQ ID NO: 179066 - DNA, 20 bp, Artificial
  CRISPR gRNA sequence
ctctgtgagtcaggcactat

SEQ ID NO: 179067 - DNA, 20 bp, Artificial
  CRISPR gRNA sequence
gagtcaggcactatcagcga

SEQ ID NO: 179068 - DNA, 20 bp, Artificial
  CRISPR gRNA sequence
agtcaggcactatcagcgat

SEQ ID NO: 179069 - DNA, 20 bp, Artificial
  CRISPR gRNA sequence
cactatcagcgatgggtccc

SEQ ID NO: 179070 - DNA, 20 bp, Artificial
  CRISPR gRNA sequence
tcctctgccccaacatgccc

SEQ ID NO: 179071 - DNA, 20 bp, Artificial
  CRISPR gRNA sequence
ccaacatgccccagccctgc

SEQ ID NO: 179072 - DNA, 20 bp, Artificial
  CRISPR gRNA sequence
atgccccagccctgctagtt

SEQ ID NO: 179073 - DNA, 20 bp, Artificial
  CRISPR gRNA sequence
tgccccagccctgctagttc

SEQ ID NO: 179074 - DNA, 20 bp, Artificial
  CRISPR gRNA sequence
ctagttcgggaaatgcacat

SEQ ID NO: 179075 - DNA, 20 bp, Artificial
  CRISPR gRNA sequence
tagttcgggaaatgcacatc

SEQ ID NO: 179076 - DNA, 20 bp, Artificial
  CRISPR gRNA sequence
gcacatcaggcttcaataat

SEQ ID NO: 179077 - DNA, 20 bp, Artificial
  CRISPR gRNA sequence
aggcttcaataatcagcctt

SEQ ID NO: 179078 - DNA, 20 bp, Artificial
  CRISPR gRNA sequence
ggcttcaataatcagccttt

SEQ ID NO: 179079 - DNA, 20 bp, Artificial
  CRISPR gRNA sequence
aggatccgttaatatgatga

SEQ ID NO: 179080 - DNA, 20 bp, Artificial
  CRISPR gRNA sequence
ttaatatgatgatggcttta

SEQ ID NO: 179081 - DNA, 20 bp, Artificial
  CRISPR gRNA sequence
tgatgatggctttatagaaa

SEQ ID NO: 179082 - DNA, 20 bp, Artificial
  CRISPR gRNA sequence
gatggctttatagaaaaagt

SEQ ID NO: 179083 - DNA, 20 bp, Artificial
  CRISPR gRNA sequence
aaagttagcaaattatcctc

SEQ ID NO: 179084 - DNA, 20 bp, Artificial
  CRISPR gRNA sequence
aagttagcaaattatcctcc

SEQ ID NO: 179085 - DNA, 20 bp, Artificial
  CRISPR gRNA sequence
ccaggtttttttttctgctt

SEQ ID NO: 179086 - DNA, 20 bp, Artificial
  CRISPR gRNA sequence
tttttctgcttcagttttga

SEQ ID NO: 179087 - DNA, 20 bp, Artificial
  CRISPR gRNA sequence
ttcagttttgaaagtgaata

SEQ ID NO: 179088 - DNA, 20 bp, Artificial
  CRISPR gRNA sequence
gaaagtgaatatagtttttg

SEQ ID NO: 179089 - DNA, 20 bp, Artificial
  CRISPR gRNA sequence
gtgaatatagtttttgcagc

SEQ ID NO: 179090 - DNA, 20 bp, Artificial
  CRISPR gRNA sequence
tgaatatagtttttgcagcc

SEQ ID NO: 179091 - DNA, 20 bp, Artificial
  CRISPR gRNA sequence
gaatatagtttttgcagccg

SEQ ID NO: 179092 - DNA, 20 bp, Artificial
  CRISPR gRNA sequence
aatatagtttttgcagccgg

SEQ ID NO: 179093 - DNA, 20 bp, Artificial
  CRISPR gRNA sequence
atagtttttgcagccggggg

SEQ ID NO: 179094 - DNA, 20 bp, Artificial
  CRISPR gRNA sequence
gtttttgcagccgggggcag

SEQ ID NO: 179095 - DNA, 20 bp, Artificial
  CRISPR gRNA sequence
gtggctcatgcctgtaatcc

SEQ ID NO: 179096 - DNA, 20 bp, Artificial
  CRISPR gRNA sequence
tgcctgtaatcccagcactt

SEQ ID NO: 179097 - DNA, 20 bp, Artificial
  CRISPR gRNA sequence
ctgtaatcccagcactttgg

SEQ ID NO: 179098 - DNA, 20 bp, Artificial
  CRISPR gRNA sequence
tgtaatcccagcactttgga

SEQ ID NO: 179099 - DNA, 20 bp, Artificial
  CRISPR gRNA sequence
tcccagcactttggaaggcg

SEQ ID NO: 179100 - DNA, 20 bp, Artificial
  CRISPR gRNA sequence
cccagcactttggaaggcga

SEQ ID NO: 179101 - DNA, 20 bp, Artificial
  CRISPR gRNA sequence
agcactttggaaggcgaagg

SEQ ID NO: 179102 - DNA, 20 bp, Artificial
  CRISPR gRNA sequence
gcactttggaaggcgaaggt

SEQ ID NO: 179103 - DNA, 20 bp, Artificial
  CRISPR gRNA sequence
ctttggaaggcgaaggtggg

SEQ ID NO: 179104 - DNA, 20 bp, Artificial
  CRISPR gRNA sequence
cgaaggtgggtggatcacct

SEQ ID NO: 179105 - DNA, 20 bp, Artificial
  CRISPR gRNA sequence
gaaggtgggtggatcacctg

SEQ ID NO: 179106 - DNA, 20 bp, Artificial
  CRISPR gRNA sequence
gtgggtggatcacctgaggt

SEQ ID NO: 179107 - DNA, 20 bp, Artificial
  CRISPR gRNA sequence
tgggtggatcacctgaggtc

SEQ ID NO: 179108 - DNA, 20 bp, Artificial
  CRISPR gRNA sequence
ggtggatcacctgaggtcag

SEQ ID NO: 179109 - DNA, 20 bp, Artificial
  CRISPR gRNA sequence
tcacctgaggtcaggagttt

SEQ ID NO: 179110 - DNA, 20 bp, Artificial
  CRISPR gRNA sequence
tgaggtcaggagtttgagac

SEQ ID NO: 179111 - DNA, 20 bp, Artificial
  CRISPR gRNA sequence
tgagaccagcctgactaaca

SEQ ID NO: 179112 - DNA, 20 bp, Artificial
  CRISPR gRNA sequence
tctaccaaaaatataaaaat

SEQ ID NO: 179113 - DNA, 20 bp, Artificial
  CRISPR gRNA sequence
ccaaaaatataaaaattagc

SEQ ID NO: 179114 - DNA, 20 bp, Artificial
  CRISPR gRNA sequence
caaaaatataaaaattagct

SEQ ID NO: 179115 - DNA, 20 bp, Artificial
  CRISPR gRNA sequence
atataaaaattagctgggcc

SEQ ID NO: 179116 - DNA, 20 bp, Artificial
  CRISPR gRNA sequence
taaaaattagctgggcctgg

SEQ ID NO: 179117 - DNA, 20 bp, Artificial
  CRISPR gRNA sequence
gtggcgcatgcctgtaatcc

SEQ ID NO: 179118 - DNA, 20 bp, Artificial
  CRISPR gRNA sequence
ctgtaatcccagctactctg

SEQ ID NO: 179119 - DNA, 20 bp, Artificial
  CRISPR gRNA sequence
tgtaatcccagctactctga

SEQ ID NO: 179120 - DNA, 20 bp, Artificial
  CRISPR gRNA sequence
tcccagctactctgaaggct

SEQ ID NO: 179121 - DNA, 20 bp, Artificial
  CRISPR gRNA sequence
cccagctactctgaaggctg

SEQ ID NO: 179122 - DNA, 20 bp, Artificial
  CRISPR gRNA sequence
agctactctgaaggctgagg

SEQ ID NO: 179123 - DNA, 20 bp, Artificial
  CRISPR gRNA sequence
gctactctgaaggctgaggc

SEQ ID NO: 179124 - DNA, 20 bp, Artificial
  CRISPR gRNA sequence
tactctgaaggctgaggcag

SEQ ID NO: 179125 - DNA, 20 bp, Artificial
  CRISPR gRNA sequence
caggagaatcgcttgaacct

SEQ ID NO: 179126 - DNA, 20 bp, Artificial
  CRISPR gRNA sequence
ggagaatcgcttgaacctga

SEQ ID NO: 179127 - DNA, 20 bp, Artificial
  CRISPR gRNA sequence
gagaatcgcttgaacctgag

SEQ ID NO: 179128 - DNA, 20 bp, Artificial
  CRISPR gRNA sequence
aatcgcttgaacctgagagg

SEQ ID NO: 179129 - DNA, 20 bp, Artificial
  CRISPR gRNA sequence
tcgcttgaacctgagaggcg

SEQ ID NO: 179130 - DNA, 20 bp, Artificial
  CRISPR gRNA sequence
cgcttgaacctgagaggcgg

SEQ ID NO: 179131 - DNA, 20 bp, Artificial
  CRISPR gRNA sequence
aacctgagaggcggaggttg

SEQ ID NO: 179132 - DNA, 20 bp, Artificial
  CRISPR gRNA sequence
tgagaggcggaggttgcagt

SEQ ID NO: 179133 - DNA, 20 bp, Artificial
  CRISPR gRNA sequence
ggcggaggttgcagtgagct

SEQ ID NO: 179134 - DNA, 20 bp, Artificial
  CRISPR gRNA sequence
gagattgtgtcattgcactc

SEQ ID NO: 179135 - DNA, 20 bp, Artificial
  CRISPR gRNA sequence
tgtgtcattgcactccagcc

SEQ ID NO: 179136 - DNA, 20 bp, Artificial
  CRISPR gRNA sequence
gtgtcattgcactccagcct

SEQ ID NO: 179137 - DNA, 20 bp, Artificial
  CRISPR gRNA sequence
tgcactccagcctgggcaac

SEQ ID NO: 179138 - DNA, 20 bp, Artificial
  CRISPR gRNA sequence
cactccagcctgggcaacaa

SEQ ID NO: 179139 - DNA, 20 bp, Artificial
  CRISPR gRNA sequence
caaaactccatttcaaaaaa

SEQ ID NO: 179140 - DNA, 20 bp, Artificial
  CRISPR gRNA sequence
atttcaaaaaaaagtttttg

SEQ ID NO: 179141 - DNA, 20 bp, Artificial
  CRISPR gRNA sequence
tcaaaaaaaagtttttgcag

SEQ ID NO: 179142 - DNA, 20 bp, Artificial
  CRISPR gRNA sequence
tttttgcagtagttgtacgc

SEQ ID NO: 179143 - DNA, 20 bp, Artificial
  CRISPR gRNA sequence
ttgtacgccagctgttccat

SEQ ID NO: 179144 - DNA, 20 bp, Artificial
  CRISPR gRNA sequence
ttccattagcccaaaaaatt

SEQ ID NO: 179145 - DNA, 20 bp, Artificial
  CRISPR gRNA sequence
tagcccaaaaaattgagaca

SEQ ID NO: 179146 - DNA, 20 bp, Artificial
  CRISPR gRNA sequence
tggatgtcgttccttatctc

SEQ ID NO: 179147 - DNA, 20 bp, Artificial
  CRISPR gRNA sequence
ttccttatctctagcttttc

SEQ ID NO: 179148 - DNA, 20 bp, Artificial
  CRISPR gRNA sequence
attatgctaacctttgtttt

SEQ ID NO: 179149 - DNA, 20 bp, Artificial
  CRISPR gRNA sequence
cctcttactatgtccttaca

SEQ ID NO: 179150 - DNA, 20 bp, Artificial
  CRISPR gRNA sequence
tactatgtccttacacagtt

SEQ ID NO: 179151 - DNA, 20 bp, Artificial
  CRISPR gRNA sequence
ctatgtccttacacagttga

SEQ ID NO: 179152 - DNA, 20 bp, Artificial
  CRISPR gRNA sequence
tatgtccttacacagttgag

SEQ ID NO: 179153 - DNA, 20 bp, Artificial
  CRISPR gRNA sequence
atgtccttacacagttgaga

SEQ ID NO: 179154 - DNA, 20 bp, Artificial
  CRISPR gRNA sequence
tccttacacagttgagaggg

SEQ ID NO: 179155 - DNA, 20 bp, Artificial
  CRISPR gRNA sequence
cacagttgagagggaagtcg

SEQ ID NO: 179156 - DNA, 20 bp, Artificial
  CRISPR gRNA sequence
cagttgagagggaagtcgtg

SEQ ID NO: 179157 - DNA, 20 bp, Artificial
  CRISPR gRNA sequence
aagtcgtggagatgctatac

SEQ ID NO: 179158 - DNA, 20 bp, Artificial
  CRISPR gRNA sequence
gtcgtggagatgctatacca

SEQ ID NO: 179159 - DNA, 20 bp, Artificial
  CRISPR gRNA sequence
cgtggagatgctataccaga

SEQ ID NO: 179160 - DNA, 20 bp, Artificial
  CRISPR gRNA sequence
ggagatgctataccagagag

SEQ ID NO: 179161 - DNA, 20 bp, Artificial
  CRISPR gRNA sequence
gagatgctataccagagagt

SEQ ID NO: 179162 - DNA, 20 bp, Artificial
  CRISPR gRNA sequence
ctataccagagagtgggtgt

SEQ ID NO: 179163 - DNA, 20 bp, Artificial
  CRISPR gRNA sequence
ataccagagagtgggtgtga

SEQ ID NO: 179164 - DNA, 20 bp, Artificial
  CRISPR gRNA sequence
taccagagagtgggtgtgag

SEQ ID NO: 179165 - DNA, 20 bp, Artificial
  CRISPR gRNA sequence
accagagagtgggtgtgaga

SEQ ID NO: 179166 - DNA, 20 bp, Artificial
  CRISPR gRNA sequence
ccagagagtgggtgtgagag

SEQ ID NO: 179167 - DNA, 20 bp, Artificial
  CRISPR gRNA sequence
gagagtgggtgtgagagggg

SEQ ID NO: 179168 - DNA, 20 bp, Artificial
  CRISPR gRNA sequence
agagtgggtgtgagaggggt

SEQ ID NO: 179169 - DNA, 20 bp, Artificial
  CRISPR gRNA sequence
gaggggtgggaaaatgaatt

SEQ ID NO: 179170 - DNA, 20 bp, Artificial
  CRISPR gRNA sequence
aggggtgggaaaatgaattg

SEQ ID NO: 179171 - DNA, 20 bp, Artificial
  CRISPR gRNA sequence
tgggaaaatgaattgaggac

SEQ ID NO: 179172 - DNA, 20 bp, Artificial
  CRISPR gRNA sequence
catttctgcctcctccctcc

SEQ ID NO: 179173 - DNA, 20 bp, Artificial
  CRISPR gRNA sequence
atttctgcctcctccctccc

SEQ ID NO: 179174 - DNA, 20 bp, Artificial
  CRISPR gRNA sequence
ccgggcccttgtcctgactg

SEQ ID NO: 179175 - DNA, 20 bp, Artificial
  CRISPR gRNA sequence
tgcacttctgcatcctatct

SEQ ID NO: 179176 - DNA, 20 bp, Artificial
  CRISPR gRNA sequence
cctatctgagattgtgaaaa

SEQ ID NO: 179177 - DNA, 20 bp, Artificial
  CRISPR gRNA sequence
ctgagattgtgaaaatggcc

SEQ ID NO: 179178 - DNA, 20 bp, Artificial
  CRISPR gRNA sequence
tgagattgtgaaaatggcca

SEQ ID NO: 179179 - DNA, 20 bp, Artificial
  CRISPR gRNA sequence
gagattgtgaaaatggccaa

SEQ ID NO: 179180 - DNA, 20 bp, Artificial
  CRISPR gRNA sequence
aatggccaagggtgtgatac

SEQ ID NO: 179181 - DNA, 20 bp, Artificial
  CRISPR gRNA sequence
ccaagggtgtgatactggct

SEQ ID NO: 179182 - DNA, 20 bp, Artificial
  CRISPR gRNA sequence
aagggtgtgatactggctga

SEQ ID NO: 179183 - DNA, 20 bp, Artificial
  CRISPR gRNA sequence
agggtgtgatactggctgag

SEQ ID NO: 179184 - DNA, 20 bp, Artificial
  CRISPR gRNA sequence
ggtgtgatactggctgagag

SEQ ID NO: 179185 - DNA, 20 bp, Artificial
  CRISPR gRNA sequence
tgatactggctgagaggagc

SEQ ID NO: 179186 - DNA, 20 bp, Artificial
  CRISPR gRNA sequence
ctgagaggagctggctcatt

SEQ ID NO: 179187 - DNA, 20 bp, Artificial
  CRISPR gRNA sequence
tgagaggagctggctcattg

SEQ ID NO: 179188 - DNA, 20 bp, Artificial
  CRISPR gRNA sequence
gagaggagctggctcattga

SEQ ID NO: 179189 - DNA, 20 bp, Artificial
  CRISPR gRNA sequence
aggagctggctcattgaggg

SEQ ID NO: 179190 - DNA, 20 bp, Artificial
  CRISPR gRNA sequence
ggagctggctcattgagggc

SEQ ID NO: 179191 - DNA, 20 bp, Artificial
  CRISPR gRNA sequence
gagctggctcattgagggca

SEQ ID NO: 179192 - DNA, 20 bp, Artificial
  CRISPR gRNA sequence
gctcattgagggcagggcca

SEQ ID NO: 179193 - DNA, 20 bp, Artificial
  CRISPR gRNA sequence
ctcattgagggcagggccac

SEQ ID NO: 179194 - DNA, 20 bp, Artificial
  CRISPR gRNA sequence
tcattgagggcagggccaca

SEQ ID NO: 179195 - DNA, 20 bp, Artificial
  CRISPR gRNA sequence
tgagggcagggccacagggt

SEQ ID NO: 179196 - DNA, 20 bp, Artificial
  CRISPR gRNA sequence
gccacagggtgagtctgcac

SEQ ID NO: 179197 - DNA, 20 bp, Artificial
  CRISPR gRNA sequence
acagggtgagtctgcactgg

SEQ ID NO: 179198 - DNA, 20 bp, Artificial
  CRISPR gRNA sequence
cagggtgagtctgcactgga

SEQ ID NO: 179199 - DNA, 20 bp, Artificial
  CRISPR gRNA sequence
agggtgagtctgcactggaa

SEQ ID NO: 179200 - DNA, 20 bp, Artificial
  CRISPR gRNA sequence
ggtgagtctgcactggaagg

SEQ ID NO: 179201 - DNA, 20 bp, Artificial
  CRISPR gRNA sequence
ctgcactggaagggagttga

SEQ ID NO: 179202 - DNA, 20 bp, Artificial
  CRISPR gRNA sequence
gcctcttgctcttctgtccc

SEQ ID NO: 179203 - DNA, 20 bp, Artificial
  CRISPR gRNA sequence
gctcttctgtccccagctct

SEQ ID NO: 179204 - DNA, 20 bp, Artificial
  CRISPR gRNA sequence
tcttctgtccccagctcttg

SEQ ID NO: 179205 - DNA, 20 bp, Artificial
  CRISPR gRNA sequence
tctgtccccagctcttggag

SEQ ID NO: 179206 - DNA, 20 bp, Artificial
  CRISPR gRNA sequence
tccccagctcttggagcagt

SEQ ID NO: 179207 - DNA, 20 bp, Artificial
  CRISPR gRNA sequence
cccagctcttggagcagtcg

SEQ ID NO: 179208 - DNA, 20 bp, Artificial
  CRISPR gRNA sequence
agctcttggagcagtcggag

SEQ ID NO: 179209 - DNA, 20 bp, Artificial
  CRISPR gRNA sequence
tcttggagcagtcggagtgg

SEQ ID NO: 179210 - DNA, 20 bp, Artificial
  CRISPR gRNA sequence
ggagtggcagccaacaaacg

SEQ ID NO: 179211 - DNA, 20 bp, Artificial
  CRISPR gRNA sequence
tggcagccaacaaacgtgga

SEQ ID NO: 179212 - DNA, 20 bp, Artificial
  CRISPR gRNA sequence
ggcagccaacaaacgtggat

SEQ ID NO: 179213 - DNA, 20 bp, Artificial
  CRISPR gRNA sequence
agccaacaaacgtggatggg

SEQ ID NO: 179214 - DNA, 20 bp, Artificial
  CRISPR gRNA sequence
gccaacaaacgtggatggga

SEQ ID NO: 179215 - DNA, 20 bp, Artificial
  CRISPR gRNA sequence
ccaacaaacgtggatgggaa

SEQ ID NO: 179216 - DNA, 20 bp, Artificial
  CRISPR gRNA sequence
caacaaacgtggatgggaag

SEQ ID NO: 179217 - DNA, 20 bp, Artificial
  CRISPR gRNA sequence
gggtacctactcaatgaacc

SEQ ID NO: 179218 - DNA, 20 bp, Artificial
  CRISPR gRNA sequence
gtacctactcaatgaacctg

SEQ ID NO: 179219 - DNA, 20 bp, Artificial
  CRISPR gRNA sequence
tactcaatgaacctggagtc

SEQ ID NO: 179220 - DNA, 20 bp, Artificial
  CRISPR gRNA sequence
gtccagcccacctctgtcta

SEQ ID NO: 179221 - DNA, 20 bp, Artificial
  CRISPR gRNA sequence
ccagcccacctctgtctatg

SEQ ID NO: 179222 - DNA, 20 bp, Artificial
  CRISPR gRNA sequence
acctctgtctatggagactt

SEQ ID NO: 179223 - DNA, 20 bp, Artificial
  CRISPR gRNA sequence
tctatggagactttagctgt

SEQ ID NO: 179224 - DNA, 20 bp, Artificial
  CRISPR gRNA sequence
ctatggagactttagctgta

SEQ ID NO: 179225 - DNA, 20 bp, Artificial
  CRISPR gRNA sequence
atggagactttagctgtaag

SEQ ID NO: 179226 - DNA, 20 bp, Artificial
  CRISPR gRNA sequence
tggagactttagctgtaagg

SEQ ID NO: 179227 - DNA, 20 bp, Artificial
  CRISPR gRNA sequence
gagactttagctgtaaggag

SEQ ID NO: 179228 - DNA, 20 bp, Artificial
  CRISPR gRNA sequence
ctttagctgtaaggaggagc

SEQ ID NO: 179229 - DNA, 20 bp, Artificial
  CRISPR gRNA sequence
aaggaggagccagaaattga

SEQ ID NO: 179230 - DNA, 20 bp, Artificial
  CRISPR gRNA sequence
ggagccagaaattgacagcc

SEQ ID NO: 179231 - DNA, 20 bp, Artificial
  CRISPR gRNA sequence
gagccagaaattgacagccc

SEQ ID NO: 179232 - DNA, 20 bp, Artificial
  CRISPR gRNA sequence
agccagaaattgacagccca

SEQ ID NO: 179233 - DNA, 20 bp, Artificial
  CRISPR gRNA sequence
gccagaaattgacagcccag

SEQ ID NO: 179234 - DNA, 20 bp, Artificial
  CRISPR gRNA sequence
ccagaaattgacagcccagg

SEQ ID NO: 179235 - DNA, 20 bp, Artificial
  CRISPR gRNA sequence
aaattgacagcccagggggt

SEQ ID NO: 179236 - DNA, 20 bp, Artificial
  CRISPR gRNA sequence
ttgacagcccagggggtaag

SEQ ID NO: 179237 - DNA, 20 bp, Artificial
  CRISPR gRNA sequence
tgacagcccagggggtaaga

SEQ ID NO: 179238 - DNA, 20 bp, Artificial
  CRISPR gRNA sequence
cccagggggtaagaaggccc

SEQ ID NO: 179239 - DNA, 20 bp, Artificial
  CRISPR gRNA sequence
aagaaggccctggatcctta

SEQ ID NO: 179240 - DNA, 20 bp, Artificial
  CRISPR gRNA sequence
cctggatccttatggcttct

SEQ ID NO: 179241 - DNA, 20 bp, Artificial
  CRISPR gRNA sequence
atccttatggcttcttagat

SEQ ID NO: 179242 - DNA, 20 bp, Artificial
  CRISPR gRNA sequence
tccttatggcttcttagatg

SEQ ID NO: 179243 - DNA, 20 bp, Artificial
  CRISPR gRNA sequence
ccttatggcttcttagatga

SEQ ID NO: 179244 - DNA, 20 bp, Artificial
  CRISPR gRNA sequence
ttatggcttcttagatgagg

SEQ ID NO: 179245 - DNA, 20 bp, Artificial
  CRISPR gRNA sequence
ttagatgagggagaaccacg

SEQ ID NO: 179246 - DNA, 20 bp, Artificial
  CRISPR gRNA sequence
tagatgagggagaaccacgt

SEQ ID NO: 179247 - DNA, 20 bp, Artificial
  CRISPR gRNA sequence
agatgagggagaaccacgta

SEQ ID NO: 179248 - DNA, 20 bp, Artificial
  CRISPR gRNA sequence
gagggagaaccacgtaggga

SEQ ID NO: 179249 - DNA, 20 bp, Artificial
  CRISPR gRNA sequence
gggagaaccacgtagggatg

SEQ ID NO: 179250 - DNA, 20 bp, Artificial
  CRISPR gRNA sequence
gaaccacgtagggatggaga

SEQ ID NO: 179251 - DNA, 20 bp, Artificial
  CRISPR gRNA sequence
acgtagggatggagaaagct

SEQ ID NO: 179252 - DNA, 20 bp, Artificial
  CRISPR gRNA sequence
cgtagggatggagaaagctt

SEQ ID NO: 179253 - DNA, 20 bp, Artificial
  CRISPR gRNA sequence
gtagggatggagaaagcttg

SEQ ID NO: 179254 - DNA, 20 bp, Artificial
  CRISPR gRNA sequence
tagggatggagaaagcttgg

SEQ ID NO: 179255 - DNA, 20 bp, Artificial
  CRISPR gRNA sequence
ggatggagaaagcttggggg

SEQ ID NO: 179256 - DNA, 20 bp, Artificial
  CRISPR gRNA sequence
gatggagaaagcttgggggc

SEQ ID NO: 179257 - DNA, 20 bp, Artificial
  CRISPR gRNA sequence
atggagaaagcttgggggca

SEQ ID NO: 179258 - DNA, 20 bp, Artificial
  CRISPR gRNA sequence
agaaagcttgggggcagggc

SEQ ID NO: 179259 - DNA, 20 bp, Artificial
  CRISPR gRNA sequence
gaaagcttgggggcagggcc

SEQ ID NO: 179260 - DNA, 20 bp, Artificial
  CRISPR gRNA sequence
aaagcttgggggcagggcca

SEQ ID NO: 179261 - DNA, 20 bp, Artificial
  CRISPR gRNA sequence
agcttgggggcagggccagg

SEQ ID NO: 179262 - DNA, 20 bp, Artificial
  CRISPR gRNA sequence
ttgggggcagggccagggag

SEQ ID NO: 179263 - DNA, 20 bp, Artificial
  CRISPR gRNA sequence
tgggggcagggccagggagc

SEQ ID NO: 179264 - DNA, 20 bp, Artificial
  CRISPR gRNA sequence
gggggcagggccagggagca

SEQ ID NO: 179265 - DNA, 20 bp, Artificial
  CRISPR gRNA sequence
ggcagggccagggagcaggg

SEQ ID NO: 179266 - DNA, 20 bp, Artificial
  CRISPR gRNA sequence
ggccagggagcagggcggta

SEQ ID NO: 179267 - DNA, 20 bp, Artificial
  CRISPR gRNA sequence
gagcagggcggtaaagcatc

SEQ ID NO: 179268 - DNA, 20 bp, Artificial
  CRISPR gRNA sequence
agcagggcggtaaagcatct

SEQ ID NO: 179269 - DNA, 20 bp, Artificial
  CRISPR gRNA sequence
gcagggcggtaaagcatctg

SEQ ID NO: 179270 - DNA, 20 bp, Artificial
  CRISPR gRNA sequence
ggtactgacacattgtgaat

SEQ ID NO: 179271 - DNA, 20 bp, Artificial
  CRISPR gRNA sequence
gacacattgtgaattagcta

SEQ ID NO: 179272 - DNA, 20 bp, Artificial
  CRISPR gRNA sequence
agctacggctgccatgcctt

SEQ ID NO: 179273 - DNA, 20 bp, Artificial
  CRISPR gRNA sequence
gctacggctgccatgcctta

SEQ ID NO: 179274 - DNA, 20 bp, Artificial
  CRISPR gRNA sequence
catgccttaaggtttgcctg

SEQ ID NO: 179275 - DNA, 20 bp, Artificial
  CRISPR gRNA sequence
cttaaggtttgcctgaagct

SEQ ID NO: 179276 - DNA, 20 bp, Artificial
  CRISPR gRNA sequence
aaggtttgcctgaagctgag

SEQ ID NO: 179277 - DNA, 20 bp, Artificial
  CRISPR gRNA sequence
gtggatgtttactgctgtgc

SEQ ID NO: 179278 - DNA, 20 bp, Artificial
  CRISPR gRNA sequence
tggatgtttactgctgtgct

SEQ ID NO: 179279 - DNA, 20 bp, Artificial
  CRISPR gRNA sequence
atgtttactgctgtgctggg

SEQ ID NO: 179280 - DNA, 20 bp, Artificial
  CRISPR gRNA sequence
gtttactgctgtgctgggaa

SEQ ID NO: 179281 - DNA, 20 bp, Artificial
  CRISPR gRNA sequence
tactgctgtgctgggaagag

SEQ ID NO: 179282 - DNA, 20 bp, Artificial
  CRISPR gRNA sequence
ctgctgtgctgggaagagca

SEQ ID NO: 179283 - DNA, 20 bp, Artificial
  CRISPR gRNA sequence
tgctgtgctgggaagagcag

SEQ ID NO: 179284 - DNA, 20 bp, Artificial
  CRISPR gRNA sequence
aagagcagaggccatgtcta

SEQ ID NO: 179285 - DNA, 20 bp, Artificial
  CRISPR gRNA sequence
gaggccatgtctatggcctt

SEQ ID NO: 179286 - DNA, 20 bp, Artificial
  CRISPR gRNA sequence
aggccatgtctatggccttc

SEQ ID NO: 179287 - DNA, 20 bp, Artificial
  CRISPR gRNA sequence
ggccatgtctatggccttca

SEQ ID NO: 179288 - DNA, 20 bp, Artificial
  CRISPR gRNA sequence
gccatgtctatggccttcag

SEQ ID NO: 179289 - DNA, 20 bp, Artificial
  CRISPR gRNA sequence
atgtctatggccttcagggg

SEQ ID NO: 179290 - DNA, 20 bp, Artificial
  CRISPR gRNA sequence
tgtctatggccttcaggggt

SEQ ID NO: 179291 - DNA, 20 bp, Artificial
  CRISPR gRNA sequence
gtctatggccttcaggggta

SEQ ID NO: 179292 - DNA, 20 bp, Artificial
  CRISPR gRNA sequence
tctatggccttcaggggtag

SEQ ID NO: 179293 - DNA, 20 bp, Artificial
  CRISPR gRNA sequence
ctatggccttcaggggtagg

SEQ ID NO: 179294 - DNA, 20 bp, Artificial
  CRISPR gRNA sequence
tggccttcaggggtaggggg

SEQ ID NO: 179295 - DNA, 20 bp, Artificial
  CRISPR gRNA sequence
acaaccttcttcacatcttc

SEQ ID NO: 179296 - DNA, 20 bp, Artificial
  CRISPR gRNA sequence
caaccttcttcacatcttct

SEQ ID NO: 179297 - DNA, 20 bp, Artificial
  CRISPR gRNA sequence
aaccttcttcacatcttcta

SEQ ID NO: 179298 - DNA, 20 bp, Artificial
  CRISPR gRNA sequence
accttcttcacatcttctag

SEQ ID NO: 179299 - DNA, 20 bp, Artificial
  CRISPR gRNA sequence
tcacatcttctaggggatat

SEQ ID NO: 179300 - DNA, 20 bp, Artificial
  CRISPR gRNA sequence
cacatcttctaggggatatt

SEQ ID NO: 179301 - DNA, 20 bp, Artificial
  CRISPR gRNA sequence
cttctaggggatattgggct

SEQ ID NO: 179302 - DNA, 20 bp, Artificial
  CRISPR gRNA sequence
gggatattgggctgagtcta

SEQ ID NO: 179303 - DNA, 20 bp, Artificial
  CRISPR gRNA sequence
gagtctacagcgtgtcttca

SEQ ID NO: 179304 - DNA, 20 bp, Artificial
  CRISPR gRNA sequence
agcgtgtcttcacagatctg

SEQ ID NO: 179305 - DNA, 20 bp, Artificial
  CRISPR gRNA sequence
cttcacagatctgaagaaca

SEQ ID NO: 179306 - DNA, 20 bp, Artificial
  CRISPR gRNA sequence
tgaagaacatggatgccacc

SEQ ID NO: 179307 - DNA, 20 bp, Artificial
  CRISPR gRNA sequence
gaacatggatgccacctggc

SEQ ID NO: 179308 - DNA, 20 bp, Artificial
  CRISPR gRNA sequence
atggatgccacctggctgga

SEQ ID NO: 179309 - DNA, 20 bp, Artificial
  CRISPR gRNA sequence
gctggacagcctgctgaccc

SEQ ID NO: 179310 - DNA, 20 bp, Artificial
  CRISPR gRNA sequence
acagcctgctgaccccagtc

SEQ ID NO: 179311 - DNA, 20 bp, Artificial
  CRISPR gRNA sequence
cagtccggttgccctccatc

SEQ ID NO: 179312 - DNA, 20 bp, Artificial
  CRISPR gRNA sequence
agtccggttgccctccatcc

SEQ ID NO: 179313 - DNA, 20 bp, Artificial
  CRISPR gRNA sequence
aggccattccctgtgcaccg

SEQ ID NO: 179314 - DNA, 20 bp, Artificial
  CRISPR gRNA sequence
ccattccctgtgcaccgtag

SEQ ID NO: 179315 - DNA, 20 bp, Artificial
  CRISPR gRNA sequence
cattccctgtgcaccgtagc

SEQ ID NO: 179316 - DNA, 20 bp, Artificial
  CRISPR gRNA sequence
attccctgtgcaccgtagca

SEQ ID NO: 179317 - DNA, 20 bp, Artificial
  CRISPR gRNA sequence
gtgcaccgtagcagggcccc

SEQ ID NO: 179318 - DNA, 20 bp, Artificial
  CRISPR gRNA sequence
tgcaccgtagcagggcccct

SEQ ID NO: 179319 - DNA, 20 bp, Artificial
  CRISPR gRNA sequence
ctgggcccctcttattcctc

SEQ ID NO: 179320 - DNA, 20 bp, Artificial
  CRISPR gRNA sequence
tgggcccctcttattcctct

SEQ ID NO: 179321 - DNA, 20 bp, Artificial
  CRISPR gRNA sequence
cccctcttattcctctaggc

SEQ ID NO: 179322 - DNA, 20 bp, Artificial
  CRISPR gRNA sequence
ctcttattcctctaggcaag

SEQ ID NO: 179323 - DNA, 20 bp, Artificial
  CRISPR gRNA sequence
tcttattcctctaggcaagc

SEQ ID NO: 179324 - DNA, 20 bp, Artificial
  CRISPR gRNA sequence
tcctctaggcaagcaggacc

SEQ ID NO: 179325 - DNA, 20 bp, Artificial
  CRISPR gRNA sequence
gcaagcaggacctggcatca

SEQ ID NO: 179326 - DNA, 20 bp, Artificial
  CRISPR gRNA sequence
agcaggacctggcatcatgg

SEQ ID NO: 179327 - DNA, 20 bp, Artificial
  CRISPR gRNA sequence
acctggcatcatggtggata

SEQ ID NO: 179328 - DNA, 20 bp, Artificial
  CRISPR gRNA sequence
gcatcatggtggatatggtg

SEQ ID NO: 179329 - DNA, 20 bp, Artificial
  CRISPR gRNA sequence
atcatggtggatatggtgca

SEQ ID NO: 179330 - DNA, 20 bp, Artificial
  CRISPR gRNA sequence
atggtggatatggtgcagag

SEQ ID NO: 179331 - DNA, 20 bp, Artificial
  CRISPR gRNA sequence
tggatatggtgcagagaagc

SEQ ID NO: 179332 - DNA, 20 bp, Artificial
  CRISPR gRNA sequence
gcagagaagctggacttctg

SEQ ID NO: 179333 - DNA, 20 bp, Artificial
  CRISPR gRNA sequence
cagagaagctggacttctgt

SEQ ID NO: 179334 - DNA, 20 bp, Artificial
  CRISPR gRNA sequence
gacttctgtgggcccctcaa

SEQ ID NO: 179335 - DNA, 20 bp, Artificial
  CRISPR gRNA sequence
ctgtgggcccctcaacagcc

SEQ ID NO: 179336 - DNA, 20 bp, Artificial
  CRISPR gRNA sequence
ccaagtgtgaccccactgcc

SEQ ID NO: 179337 - DNA, 20 bp, Artificial
  CRISPR gRNA sequence
agtgtgaccccactgccaag

SEQ ID NO: 179338 - DNA, 20 bp, Artificial
  CRISPR gRNA sequence
gtgtgaccccactgccaagt

SEQ ID NO: 179339 - DNA, 20 bp, Artificial
  CRISPR gRNA sequence
tgtgaccccactgccaagtg

SEQ ID NO: 179340 - DNA, 20 bp, Artificial
  CRISPR gRNA sequence
accccactgccaagtgggga

SEQ ID NO: 179341 - DNA, 20 bp, Artificial
  CRISPR gRNA sequence
ccccactgccaagtggggat

SEQ ID NO: 179342 - DNA, 20 bp, Artificial
  CRISPR gRNA sequence
cccactgccaagtggggatg

SEQ ID NO: 179343 - DNA, 20 bp, Artificial
  CRISPR gRNA sequence
ggggatggggcctccctcct

SEQ ID NO: 179344 - DNA, 20 bp, Artificial
  CRISPR gRNA sequence
gggatggggcctccctcctt

SEQ ID NO: 179345 - DNA, 20 bp, Artificial
  CRISPR gRNA sequence
tccttgggtcattgacctct

SEQ ID NO: 179346 - DNA, 20 bp, Artificial
  CRISPR gRNA sequence
ccttgggtcattgacctctc

SEQ ID NO: 179347 - DNA, 20 bp, Artificial
  CRISPR gRNA sequence
cttgggtcattgacctctca

SEQ ID NO: 179348 - DNA, 20 bp, Artificial
  CRISPR gRNA sequence
gtcattgacctctcagggcc

SEQ ID NO: 179349 - DNA, 20 bp, Artificial
  CRISPR gRNA sequence
attgacctctcagggcctgg

SEQ ID NO: 179350 - DNA, 20 bp, Artificial
  CRISPR gRNA sequence
ttgacctctcagggcctggc

SEQ ID NO: 179351 - DNA, 20 bp, Artificial
  CRISPR gRNA sequence
cctctcagggcctggcaggc

SEQ ID NO: 179352 - DNA, 20 bp, Artificial
  CRISPR gRNA sequence
gggcctggcaggccagtgtc

SEQ ID NO: 179353 - DNA, 20 bp, Artificial
  CRISPR gRNA sequence
ggcctggcaggccagtgtct

SEQ ID NO: 179354 - DNA, 20 bp, Artificial
  CRISPR gRNA sequence
cagtgtctgggtttttcttg

SEQ ID NO: 179355 - DNA, 20 bp, Artificial
  CRISPR gRNA sequence
tgggtttttcttgtggtgta

SEQ ID NO: 179356 - DNA, 20 bp, Artificial
  CRISPR gRNA sequence
tttttcttgtggtgtaaagc

SEQ ID NO: 179357 - DNA, 20 bp, Artificial
  CRISPR gRNA sequence
gtaaagctggccctgcctcc

SEQ ID NO: 179358 - DNA, 20 bp, Artificial
  CRISPR gRNA sequence
taaagctggccctgcctcct

SEQ ID NO: 179359 - DNA, 20 bp, Artificial
  CRISPR gRNA sequence
agctggccctgcctcctggg

SEQ ID NO: 179360 - DNA, 20 bp, Artificial
  CRISPR gRNA sequence
gccctgcctcctgggaagat

SEQ ID NO: 179361 - DNA, 20 bp, Artificial
  CRISPR gRNA sequence
ccctgcctcctgggaagatg

SEQ ID NO: 179362 - DNA, 20 bp, Artificial
  CRISPR gRNA sequence
tcctgggaagatgaggttct

SEQ ID NO: 179363 - DNA, 20 bp, Artificial
  CRISPR gRNA sequence
ggaagatgaggttctgagac

SEQ ID NO: 179364 - DNA, 20 bp, Artificial
  CRISPR gRNA sequence
aggttctgagaccagtgtat

SEQ ID NO: 179365 - DNA, 20 bp, Artificial
  CRISPR gRNA sequence
ggttctgagaccagtgtatc

SEQ ID NO: 179366 - DNA, 20 bp, Artificial
  CRISPR gRNA sequence
ctgagaccagtgtatcaggt

SEQ ID NO: 179367 - DNA, 20 bp, Artificial
  CRISPR gRNA sequence
tgagaccagtgtatcaggtc

SEQ ID NO: 179368 - DNA, 20 bp, Artificial
  CRISPR gRNA sequence
gagaccagtgtatcaggtca

SEQ ID NO: 179369 - DNA, 20 bp, Artificial
  CRISPR gRNA sequence
agtgtatcaggtcagggact

SEQ ID NO: 179370 - DNA, 20 bp, Artificial
  CRISPR gRNA sequence
tatcaggtcagggacttgga

SEQ ID NO: 179371 - DNA, 20 bp, Artificial
  CRISPR gRNA sequence
atcaggtcagggacttggac

SEQ ID NO: 179372 - DNA, 20 bp, Artificial
  CRISPR gRNA sequence
caggtcagggacttggacag

SEQ ID NO: 179373 - DNA, 20 bp, Artificial
  CRISPR gRNA sequence
tcagggacttggacaggagt

SEQ ID NO: 179374 - DNA, 20 bp, Artificial
  CRISPR gRNA sequence
cttggacaggagtcagtgtc

SEQ ID NO: 179375 - DNA, 20 bp, Artificial
  CRISPR gRNA sequence
agtgtctggctttttcctct

SEQ ID NO: 179376 - DNA, 20 bp, Artificial
  CRISPR gRNA sequence
ctggctttttcctctgagcc

SEQ ID NO: 179377 - DNA, 20 bp, Artificial
  CRISPR gRNA sequence
ttcctctgagcccagctgcc

SEQ ID NO: 179378 - DNA, 20 bp, Artificial
  CRISPR gRNA sequence
cctctgagcccagctgcctg

SEQ ID NO: 179379 - DNA, 20 bp, Artificial
  CRISPR gRNA sequence
tctgagcccagctgcctgga

SEQ ID NO: 179380 - DNA, 20 bp, Artificial
  CRISPR gRNA sequence
ctgagcccagctgcctggag

SEQ ID NO: 179381 - DNA, 20 bp, Artificial
  CRISPR gRNA sequence
tgagcccagctgcctggaga

SEQ ID NO: 179382 - DNA, 20 bp, Artificial
  CRISPR gRNA sequence
ggagagggtctcgctgtcac

SEQ ID NO: 179383 - DNA, 20 bp, Artificial
  CRISPR gRNA sequence
agggtctcgctgtcactggc

SEQ ID NO: 179384 - DNA, 20 bp, Artificial
  CRISPR gRNA sequence
cgctgtcactggctggctcc

SEQ ID NO: 179385 - DNA, 20 bp, Artificial
  CRISPR gRNA sequence
gctgtcactggctggctcct

SEQ ID NO: 179386 - DNA, 20 bp, Artificial
  CRISPR gRNA sequence
ctgtcactggctggctccta

SEQ ID NO: 179387 - DNA, 20 bp, Artificial
  CRISPR gRNA sequence
tgtcactggctggctcctag

SEQ ID NO: 179388 - DNA, 20 bp, Artificial
  CRISPR gRNA sequence
ctggctggctcctaggggaa

SEQ ID NO: 179389 - DNA, 20 bp, Artificial
  CRISPR gRNA sequence
tggctcctaggggaacagac

SEQ ID NO: 179390 - DNA, 20 bp, Artificial
  CRISPR gRNA sequence
ggggaacagaccagtgaccc

SEQ ID NO: 179391 - DNA, 20 bp, Artificial
  CRISPR gRNA sequence
acagaccagtgaccccagaa

SEQ ID NO: 179392 - DNA, 20 bp, Artificial
  CRISPR gRNA sequence
gaaaagcataacaccaatcc

SEQ ID NO: 179393 - DNA, 20 bp, Artificial
  CRISPR gRNA sequence
aaaagcataacaccaatccc

SEQ ID NO: 179394 - DNA, 20 bp, Artificial
  CRISPR gRNA sequence
aaagcataacaccaatccca

SEQ ID NO: 179395 - DNA, 20 bp, Artificial
  CRISPR gRNA sequence
cataacaccaatcccagggc

SEQ ID NO: 179396 - DNA, 20 bp, Artificial
  CRISPR gRNA sequence
cccagggctggctctgcact

SEQ ID NO: 179397 - DNA, 20 bp, Artificial
  CRISPR gRNA sequence
cagggctggctctgcactaa

SEQ ID NO: 179398 - DNA, 20 bp, Artificial
  CRISPR gRNA sequence
ctaaatgaatctcgttccca

SEQ ID NO: 179399 - DNA, 20 bp, Artificial
  CRISPR gRNA sequence
ccaaagaactaccccctttt

SEQ ID NO: 179400 - DNA, 20 bp, Artificial
  CRISPR gRNA sequence
gaactacccccttttcagct

SEQ ID NO: 179401 - DNA, 20 bp, Artificial
  CRISPR gRNA sequence
cccccttttcagctgagccc

SEQ ID NO: 179402 - DNA, 20 bp, Artificial
  CRISPR gRNA sequence
ccccttttcagctgagccct

SEQ ID NO: 179403 - DNA, 20 bp, Artificial
  CRISPR gRNA sequence
cccttttcagctgagccctg

SEQ ID NO: 179404 - DNA, 20 bp, Artificial
  CRISPR gRNA sequence
gagccctggggactgttcca

SEQ ID NO: 179405 - DNA, 20 bp, Artificial
  CRISPR gRNA sequence
cctggggactgttccaaagc

SEQ ID NO: 179406 - DNA, 20 bp, Artificial
  CRISPR gRNA sequence
tccaaagccagtgaaatgtg

SEQ ID NO: 179407 - DNA, 20 bp, Artificial
  CRISPR gRNA sequence
ccaaagccagtgaaatgtga

SEQ ID NO: 179408 - DNA, 20 bp, Artificial
  CRISPR gRNA sequence
agccagtgaaatgtgaagga

SEQ ID NO: 179409 - DNA, 20 bp, Artificial
  CRISPR gRNA sequence
cagtgaaatgtgaaggaaag

SEQ ID NO: 179410 - DNA, 20 bp, Artificial
  CRISPR gRNA sequence
agtgaaatgtgaaggaaagt

SEQ ID NO: 179411 - DNA, 20 bp, Artificial
  CRISPR gRNA sequence
gtgaaatgtgaaggaaagtg

SEQ ID NO: 179412 - DNA, 20 bp, Artificial
  CRISPR gRNA sequence
tgaaggaaagtggggtcctt

SEQ ID NO: 179413 - DNA, 20 bp, Artificial
  CRISPR gRNA sequence
gaaggaaagtggggtccttc

SEQ ID NO: 179414 - DNA, 20 bp, Artificial
  CRISPR gRNA sequence
aaggaaagtggggtccttcg

SEQ ID NO: 179415 - DNA, 20 bp, Artificial
  CRISPR gRNA sequence
ccttcggggcgatgctccct

SEQ ID NO: 179416 - DNA, 20 bp, Artificial
  CRISPR gRNA sequence
gggcgatgctccctcagcct

SEQ ID NO: 179417 - DNA, 20 bp, Artificial
  CRISPR gRNA sequence
gcgatgctccctcagcctca

SEQ ID NO: 179418 - DNA, 20 bp, Artificial
  CRISPR gRNA sequence
cgatgctccctcagcctcag

SEQ ID NO: 179419 - DNA, 20 bp, Artificial
  CRISPR gRNA sequence
atgctccctcagcctcagag

SEQ ID NO: 179420 - DNA, 20 bp, Artificial
  CRISPR gRNA sequence
ctctaccctgctccctgctt

SEQ ID NO: 179421 - DNA, 20 bp, Artificial
  CRISPR gRNA sequence
ccctgctccctgctttggct

SEQ ID NO: 179422 - DNA, 20 bp, Artificial
  CRISPR gRNA sequence
cctgctccctgctttggctg

SEQ ID NO: 179423 - DNA, 20 bp, Artificial
  CRISPR gRNA sequence
ctgctccctgctttggctga

SEQ ID NO: 179424 - DNA, 20 bp, Artificial
  CRISPR gRNA sequence
tgctccctgctttggctgag

SEQ ID NO: 179425 - DNA, 20 bp, Artificial
  CRISPR gRNA sequence
cctgctttggctgaggggct

SEQ ID NO: 179426 - DNA, 20 bp, Artificial
  CRISPR gRNA sequence
ctgctttggctgaggggctt

SEQ ID NO: 179427 - DNA, 20 bp, Artificial
  CRISPR gRNA sequence
aggggcttgggaaaaaaact

SEQ ID NO: 179428 - DNA, 20 bp, Artificial
  CRISPR gRNA sequence
aaacttggcactttttcgtg

SEQ ID NO: 179429 - DNA, 20 bp, Artificial
  CRISPR gRNA sequence
gatcttgccacatttctgat

SEQ ID NO: 179430 - DNA, 20 bp, Artificial
  CRISPR gRNA sequence
tcttgccacatttctgatca

SEQ ID NO: 179431 - DNA, 20 bp, Artificial
  CRISPR gRNA sequence
cttgccacatttctgatcag

SEQ ID NO: 179432 - DNA, 20 bp, Artificial
  CRISPR gRNA sequence
tgtacactaacatttccccc

SEQ ID NO: 179433 - DNA, 20 bp, Artificial
  CRISPR gRNA sequence
taacatttcccccgagctct

SEQ ID NO: 179434 - DNA, 20 bp, Artificial
  CRISPR gRNA sequence
ggcctttgcatttatttata

SEQ ID NO: 179435 - DNA, 20 bp, Artificial
  CRISPR gRNA sequence
tatttatacagtgccttgct

SEQ ID NO: 179436 - DNA, 20 bp, Artificial
  CRISPR gRNA sequence
tcggcgcccaccaccccctc

SEQ ID NO: 179437 - DNA, 20 bp, Artificial
  CRISPR gRNA sequence
cccaccaccccctcaagccc

SEQ ID NO: 179438 - DNA, 20 bp, Artificial
  CRISPR gRNA sequence
accaccccctcaagccccag

SEQ ID NO: 179439 - DNA, 20 bp, Artificial
  CRISPR gRNA sequence
caagccccagcagccctcaa

SEQ ID NO: 179440 - DNA, 20 bp, Artificial
  CRISPR gRNA sequence
aagccccagcagccctcaac

SEQ ID NO: 179441 - DNA, 20 bp, Artificial
  CRISPR gRNA sequence
ccagcagccctcaacaggcc

SEQ ID NO: 179442 - DNA, 20 bp, Artificial
  CRISPR gRNA sequence
cagcagccctcaacaggccc

SEQ ID NO: 179443 - DNA, 20 bp, Artificial
  CRISPR gRNA sequence
agcagccctcaacaggccca

SEQ ID NO: 179444 - DNA, 20 bp, Artificial
  CRISPR gRNA sequence
cagccctcaacaggcccagg

SEQ ID NO: 179445 - DNA, 20 bp, Artificial
  CRISPR gRNA sequence
agccctcaacaggcccaggg

SEQ ID NO: 179446 - DNA, 20 bp, Artificial
  CRISPR gRNA sequence
gccctcaacaggcccaggga

SEQ ID NO: 179447 - DNA, 20 bp, Artificial
  CRISPR gRNA sequence
ctcaacaggcccagggaggg

SEQ ID NO: 179448 - DNA, 20 bp, Artificial
  CRISPR gRNA sequence
aggcccagggagggaagtgt

SEQ ID NO: 179449 - DNA, 20 bp, Artificial
  CRISPR gRNA sequence
ggagggaagtgtgagcgcct

SEQ ID NO: 179450 - DNA, 20 bp, Artificial
  CRISPR gRNA sequence
gccttggtatgacttaaaat

SEQ ID NO: 179451 - DNA, 20 bp, Artificial
  CRISPR gRNA sequence
ggaaatgtcatctaaccatt

SEQ ID NO: 179452 - DNA, 20 bp, Artificial
  CRISPR gRNA sequence
taagtcatgtgtgaacacat

SEQ ID NO: 179453 - DNA, 20 bp, Artificial
  CRISPR gRNA sequence
aagtcatgtgtgaacacata

SEQ ID NO: 179454 - DNA, 20 bp, Artificial
  CRISPR gRNA sequence
tacatttgtctttttataaa

SEQ ID NO: 179455 - DNA, 20 bp, Artificial
  CRISPR gRNA sequence
ataaaaagtaaattgtttat

SEQ ID NO: 179456 - DNA, 20 bp, Artificial
  CRISPR gRNA sequence
taaaaagtaaattgtttata

SEQ ID NO: 179457 - DNA, 20 bp, Artificial
  CRISPR gRNA sequence
aaaaagtaaattgtttataa

SEQ ID NO: 179458 - DNA, 20 bp, Artificial
  CRISPR gRNA sequence
aaaagtaaattgtttataag

SEQ ID NO: 179459 - DNA, 20 bp, Artificial
  CRISPR gRNA sequence
taaattgtttataaggggtg

SEQ ID NO: 179460 - DNA, 20 bp, Artificial
  CRISPR gRNA sequence
tataaggggtgtggcctttt

SEQ ID NO: 179461 - DNA, 20 bp, Artificial
  CRISPR gRNA sequence
taaggggtgtggccttttta

SEQ ID NO: 179462 - DNA, 20 bp, Artificial
  CRISPR gRNA sequence
aggggtgtggcctttttaga

SEQ ID NO: 179463 - DNA, 20 bp, Artificial
  CRISPR gRNA sequence
ttagagagaaatttaacttg

SEQ ID NO: 179464 - DNA, 20 bp, Artificial
  CRISPR gRNA sequence
gtagatgattttacttttta

SEQ ID NO: 179465 - DNA, 20 bp, Artificial
  CRISPR gRNA sequence
actttttatggaaacactga

SEQ ID NO: 179466 - DNA, 20 bp, Artificial
  CRISPR gRNA sequence
aacactgatggacttattat

SEQ ID NO: 179467 - DNA, 20 bp, Artificial
  CRISPR gRNA sequence
atcccgcctgaacttgactt

SEQ ID NO: 179468 - DNA, 20 bp, Artificial
  CRISPR gRNA sequence
tcccgcctgaacttgacttt

SEQ ID NO: 179469 - DNA, 20 bp, Artificial
  CRISPR gRNA sequence
cccgcctgaacttgactttg

SEQ ID NO: 179470 - DNA, 20 bp, Artificial
  CRISPR gRNA sequence
gaacttgactttggggtgaa

SEQ ID NO: 179471 - DNA, 20 bp, Artificial
  CRISPR gRNA sequence
aacttgactttggggtgaac

SEQ ID NO: 179472 - DNA, 20 bp, Artificial
  CRISPR gRNA sequence
acttgactttggggtgaaca

SEQ ID NO: 179473 - DNA, 20 bp, Artificial
  CRISPR gRNA sequence
catctattataaaatccttt

SEQ ID NO: 179474 - DNA, 20 bp, Artificial
  CRISPR gRNA sequence
tattataaaatcctttcggc

SEQ ID NO: 179475 - DNA, 20 bp, Artificial
  CRISPR gRNA sequence
attataaaatcctttcggcc

SEQ ID NO: 179476 - DNA, 20 bp, Artificial
  CRISPR gRNA sequence
aaaatcctttcggccaggcg

SEQ ID NO: 179477 - DNA, 20 bp, Artificial
  CRISPR gRNA sequence
atcctttcggccaggcgcgg

SEQ ID NO: 179478 - DNA, 20 bp, Artificial
  CRISPR gRNA sequence
gtggctcacacctgtaatcc

SEQ ID NO: 179479 - DNA, 20 bp, Artificial
  CRISPR gRNA sequence
cacctgtaatcccagcactt

SEQ ID NO: 179480 - DNA, 20 bp, Artificial
  CRISPR gRNA sequence
acctgtaatcccagcacttt

SEQ ID NO: 179481 - DNA, 20 bp, Artificial
  CRISPR gRNA sequence
ctgtaatcccagcactttgg

SEQ ID NO: 179482 - DNA, 20 bp, Artificial
  CRISPR gRNA sequence
tgtaatcccagcactttggg

SEQ ID NO: 179483 - DNA, 20 bp, Artificial
  CRISPR gRNA sequence
tcccagcactttgggaggcc

SEQ ID NO: 179484 - DNA, 20 bp, Artificial
  CRISPR gRNA sequence
agcactttgggaggccgaga

SEQ ID NO: 179485 - DNA, 20 bp, Artificial
  CRISPR gRNA sequence
gcactttgggaggccgagat

SEQ ID NO: 179486 - DNA, 20 bp, Artificial
  CRISPR gRNA sequence
ctttgggaggccgagatggg

SEQ ID NO: 179487 - DNA, 20 bp, Artificial
  CRISPR gRNA sequence
ccgagatgggtggatcacct

SEQ ID NO: 179488 - DNA, 20 bp, Artificial
  CRISPR gRNA sequence
cgagatgggtggatcacctg

SEQ ID NO: 179489 - DNA, 20 bp, Artificial
  CRISPR gRNA sequence
atgggtggatcacctgaggt

SEQ ID NO: 179490 - DNA, 20 bp, Artificial
  CRISPR gRNA sequence
tgggtggatcacctgaggtc

SEQ ID NO: 179491 - DNA, 20 bp, Artificial
  CRISPR gRNA sequence
ggtggatcacctgaggtcag

SEQ ID NO: 179492 - DNA, 20 bp, Artificial
  CRISPR gRNA sequence
tcacctgaggtcaggagttc

SEQ ID NO: 179493 - DNA, 20 bp, Artificial
  CRISPR gRNA sequence
tgaggtcaggagttcgagac

SEQ ID NO: 179494 - DNA, 20 bp, Artificial
  CRISPR gRNA sequence
tcaggagttcgagaccagcc

SEQ ID NO: 179495 - DNA, 20 bp, Artificial
  CRISPR gRNA sequence
tctactaaaaatgcaaaaat

SEQ ID NO: 179496 - DNA, 20 bp, Artificial
  CRISPR gRNA sequence
ctaaaaatgcaaaaattagc

SEQ ID NO: 179497 - DNA, 20 bp, Artificial
  CRISPR gRNA sequence
taaaaatgcaaaaattagct

SEQ ID NO: 179498 - DNA, 20 bp, Artificial
  CRISPR gRNA sequence
atgcaaaaattagctgggcg

SEQ ID NO: 179499 - DNA, 20 bp, Artificial
  CRISPR gRNA sequence
aaattagctgggcgtggttg

SEQ ID NO: 179500 - DNA, 20 bp, Artificial
  CRISPR gRNA sequence
aattagctgggcgtggttgc

SEQ ID NO: 179501 - DNA, 20 bp, Artificial
  CRISPR gRNA sequence
gttgcgggtgcttgtaatcc

SEQ ID NO: 179502 - DNA, 20 bp, Artificial
  CRISPR gRNA sequence
tgcttgtaatcccagctact

SEQ ID NO: 179503 - DNA, 20 bp, Artificial
  CRISPR gRNA sequence
gcttgtaatcccagctactc

SEQ ID NO: 179504 - DNA, 20 bp, Artificial
  CRISPR gRNA sequence
ttgtaatcccagctactcag

SEQ ID NO: 179505 - DNA, 20 bp, Artificial
  CRISPR gRNA sequence
tgtaatcccagctactcagg

SEQ ID NO: 179506 - DNA, 20 bp, Artificial
  CRISPR gRNA sequence
tcccagctactcaggaggct

SEQ ID NO: 179507 - DNA, 20 bp, Artificial
  CRISPR gRNA sequence
cccagctactcaggaggctg

SEQ ID NO: 179508 - DNA, 20 bp, Artificial
  CRISPR gRNA sequence
gctactcaggaggctgaggc

SEQ ID NO: 179509 - DNA, 20 bp, Artificial
  CRISPR gRNA sequence
tactcaggaggctgaggcaa

SEQ ID NO: 179510 - DNA, 20 bp, Artificial
  CRISPR gRNA sequence
gcaagagaatcgcttgaacc

SEQ ID NO: 179511 - DNA, 20 bp, Artificial
  CRISPR gRNA sequence
caagagaatcgcttgaacct

SEQ ID NO: 179512 - DNA, 20 bp, Artificial
  CRISPR gRNA sequence
agagaatcgcttgaacctgg

SEQ ID NO: 179513 - DNA, 20 bp, Artificial
  CRISPR gRNA sequence
gagaatcgcttgaacctggg

SEQ ID NO: 179514 - DNA, 20 bp, Artificial
  CRISPR gRNA sequence
aatcgcttgaacctgggagg

SEQ ID NO: 179515 - DNA, 20 bp, Artificial
  CRISPR gRNA sequence
tcgcttgaacctgggaggtg

SEQ ID NO: 179516 - DNA, 20 bp, Artificial
  CRISPR gRNA sequence
cgcttgaacctgggaggtgg

SEQ ID NO: 179517 - DNA, 20 bp, Artificial
  CRISPR gRNA sequence
aacctgggaggtggaggttg

SEQ ID NO: 179518 - DNA, 20 bp, Artificial
  CRISPR gRNA sequence
tgggaggtggaggttgcagt

SEQ ID NO: 179519 - DNA, 20 bp, Artificial
  CRISPR gRNA sequence
ggtggaggttgcagtgagcc

SEQ ID NO: 179520 - DNA, 20 bp, Artificial
  CRISPR gRNA sequence
gagaacatgccattgcactc

SEQ ID NO: 179521 - DNA, 20 bp, Artificial
  CRISPR gRNA sequence
catgccattgcactccagcc

SEQ ID NO: 179522 - DNA, 20 bp, Artificial
  CRISPR gRNA sequence
atgccattgcactccagccc

SEQ ID NO: 179523 - DNA, 20 bp, Artificial
  CRISPR gRNA sequence
aaaaaaaaaaacctttcatt

SEQ ID NO: 179524 - DNA, 20 bp, Artificial
  CRISPR gRNA sequence
aaaaaaacctttcatttggc

SEQ ID NO: 179525 - DNA, 20 bp, Artificial
  CRISPR gRNA sequence
aaaaaacctttcatttggcc

SEQ ID NO: 179526 - DNA, 20 bp, Artificial
  CRISPR gRNA sequence
acctttcatttggccgggca

SEQ ID NO: 179527 - DNA, 20 bp, Artificial
  CRISPR gRNA sequence
tttcatttggccgggcatgg

SEQ ID NO: 179528 - DNA, 20 bp, Artificial
  CRISPR gRNA sequence
gtggcttatgcctgtaatcc

SEQ ID NO: 179529 - DNA, 20 bp, Artificial
  CRISPR gRNA sequence
tgcctgtaatcctggcactt

SEQ ID NO: 179530 - DNA, 20 bp, Artificial
  CRISPR gRNA sequence
gcctgtaatcctggcacttt

SEQ ID NO: 179531 - DNA, 20 bp, Artificial
  CRISPR gRNA sequence
ctgtaatcctggcactttgg

SEQ ID NO: 179532 - DNA, 20 bp, Artificial
  CRISPR gRNA sequence
tgtaatcctggcactttggg

SEQ ID NO: 179533 - DNA, 20 bp, Artificial
  CRISPR gRNA sequence
tcctggcactttgggaggcc

SEQ ID NO: 179534 - DNA, 20 bp, Artificial
  CRISPR gRNA sequence
cctggcactttgggaggcca

SEQ ID NO: 179535 - DNA, 20 bp, Artificial
  CRISPR gRNA sequence
ggcactttgggaggccaagg

SEQ ID NO: 179536 - DNA, 20 bp, Artificial
  CRISPR gRNA sequence
gcactttgggaggccaaggt

SEQ ID NO: 179537 - DNA, 20 bp, Artificial
  CRISPR gRNA sequence
ctttgggaggccaaggtggg

SEQ ID NO: 179538 - DNA, 20 bp, Artificial
  CRISPR gRNA sequence
ccaaggtgggcagatcacct

SEQ ID NO: 179539 - DNA, 20 bp, Artificial
  CRISPR gRNA sequence
caaggtgggcagatcacctg

SEQ ID NO: 179540 - DNA, 20 bp, Artificial
  CRISPR gRNA sequence
gtgggcagatcacctgaggt

SEQ ID NO: 179541 - DNA, 20 bp, Artificial
  CRISPR gRNA sequence
tgggcagatcacctgaggtc

SEQ ID NO: 179542 - DNA, 20 bp, Artificial
  CRISPR gRNA sequence
ggcagatcacctgaggtcag

SEQ ID NO: 179543 - DNA, 20 bp, Artificial
  CRISPR gRNA sequence
tcacctgaggtcaggagttt

SEQ ID NO: 179544 - DNA, 20 bp, Artificial
  CRISPR gRNA sequence
tgaggtcaggagtttgagac

SEQ ID NO: 179545 - DNA, 20 bp, Artificial
  CRISPR gRNA sequence
tcaggagtttgagaccagcc

SEQ ID NO: 179546 - DNA, 20 bp, Artificial
  CRISPR gRNA sequence
tgagaccagcctggccaaca

SEQ ID NO: 179547 - DNA, 20 bp, Artificial
  CRISPR gRNA sequence
tctactaaaaatacaaaaat

SEQ ID NO: 179548 - DNA, 20 bp, Artificial
  CRISPR gRNA sequence
ctactaaaaatacaaaaatt

SEQ ID NO: 179549 - DNA, 20 bp, Artificial
  CRISPR gRNA sequence
taaaaatacaaaaattaggc

SEQ ID NO: 179550 - DNA, 20 bp, Artificial
  CRISPR gRNA sequence
aaaaatacaaaaattaggcc

SEQ ID NO: 179551 - DNA, 20 bp, Artificial
  CRISPR gRNA sequence
tacaaaaattaggccgggca

SEQ ID NO: 179552 - DNA, 20 bp, Artificial
  CRISPR gRNA sequence
aaaaattaggccgggcacgg

SEQ ID NO: 179553 - DNA, 20 bp, Artificial
  CRISPR gRNA sequence
gtggctcacgcctgtaatcc

SEQ ID NO: 179554 - DNA, 20 bp, Artificial
  CRISPR gRNA sequence
cgcctgtaatcccagcactt

SEQ ID NO: 179555 - DNA, 20 bp, Artificial
  CRISPR gRNA sequence
gcctgtaatcccagcacttt

SEQ ID NO: 179556 - DNA, 20 bp, Artificial
  CRISPR gRNA sequence
ctgtaatcccagcactttgg

SEQ ID NO: 179557 - DNA, 20 bp, Artificial
  CRISPR gRNA sequence
tgtaatcccagcactttggg

SEQ ID NO: 179558 - DNA, 20 bp, Artificial
  CRISPR gRNA sequence
aatcccagcactttgggagg

SEQ ID NO: 179559 - DNA, 20 bp, Artificial
  CRISPR gRNA sequence
tcccagcactttgggaggca

SEQ ID NO: 179560 - DNA, 20 bp, Artificial
  CRISPR gRNA sequence
cccagcactttgggaggcag

SEQ ID NO: 179561 - DNA, 20 bp, Artificial
  CRISPR gRNA sequence
agcactttgggaggcagagg

SEQ ID NO: 179562 - DNA, 20 bp, Artificial
  CRISPR gRNA sequence
gcactttgggaggcagaggc

SEQ ID NO: 179563 - DNA, 20 bp, Artificial
  CRISPR gRNA sequence
ctttgggaggcagaggcggg

SEQ ID NO: 179564 - DNA, 20 bp, Artificial
  CRISPR gRNA sequence
ggcagaggcgggcggatcac

SEQ ID NO: 179565 - DNA, 20 bp, Artificial
  CRISPR gRNA sequence
gcagaggcgggcggatcacg

SEQ ID NO: 179566 - DNA, 20 bp, Artificial
  CRISPR gRNA sequence
aggcgggcggatcacgaggt

SEQ ID NO: 179567 - DNA, 20 bp, Artificial
  CRISPR gRNA sequence
ggcgggcggatcacgaggtc

SEQ ID NO: 179568 - DNA, 20 bp, Artificial
  CRISPR gRNA sequence
cgggcggatcacgaggtcag

SEQ ID NO: 179569 - DNA, 20 bp, Artificial
  CRISPR gRNA sequence
gatcacgaggtcaggagatc

SEQ ID NO: 179570 - DNA, 20 bp, Artificial
  CRISPR gRNA sequence
tcaggagatcaagaccatcc

SEQ ID NO: 179571 - DNA, 20 bp, Artificial
  CRISPR gRNA sequence
caagaccatcctggctaaca

SEQ ID NO: 179572 - DNA, 20 bp, Artificial
  CRISPR gRNA sequence
ctactaaaaatataaaaaat

SEQ ID NO: 179573 - DNA, 20 bp, Artificial
  CRISPR gRNA sequence
taaaaatataaaaaattagc

SEQ ID NO: 179574 - DNA, 20 bp, Artificial
  CRISPR gRNA sequence
aaaaatataaaaaattagcc

SEQ ID NO: 179575 - DNA, 20 bp, Artificial
  CRISPR gRNA sequence
tataaaaaattagccgggcc

SEQ ID NO: 179576 - DNA, 20 bp, Artificial
  CRISPR gRNA sequence
aaaaaattagccgggcctag

SEQ ID NO: 179577 - DNA, 20 bp, Artificial
  CRISPR gRNA sequence
aaattagccgggcctagtgg

SEQ ID NO: 179578 - DNA, 20 bp, Artificial
  CRISPR gRNA sequence
aattagccgggcctagtggc

SEQ ID NO: 179579 - DNA, 20 bp, Artificial
  CRISPR gRNA sequence
ggcctagtggcgggtgcctg

SEQ ID NO: 179580 - DNA, 20 bp, Artificial
  CRISPR gRNA sequence
gtggcgggtgcctgtagtcc

SEQ ID NO: 179581 - DNA, 20 bp, Artificial
  CRISPR gRNA sequence
tgcctgtagtcccagctact

SEQ ID NO: 179582 - DNA, 20 bp, Artificial
  CRISPR gRNA sequence
gcctgtagtcccagctactc

SEQ ID NO: 179583 - DNA, 20 bp, Artificial
  CRISPR gRNA sequence
ctgtagtcccagctactcgg

SEQ ID NO: 179584 - DNA, 20 bp, Artificial
  CRISPR gRNA sequence
tgtagtcccagctactcggg

SEQ ID NO: 179585 - DNA, 20 bp, Artificial
  CRISPR gRNA sequence
tcccagctactcgggaggct

SEQ ID NO: 179586 - DNA, 20 bp, Artificial
  CRISPR gRNA sequence
cccagctactcgggaggctg

SEQ ID NO: 179587 - DNA, 20 bp, Artificial
  CRISPR gRNA sequence
agctactcgggaggctgagg

SEQ ID NO: 179588 - DNA, 20 bp, Artificial
  CRISPR gRNA sequence
gctactcgggaggctgaggc

SEQ ID NO: 179589 - DNA, 20 bp, Artificial
  CRISPR gRNA sequence
tactcgggaggctgaggcag

SEQ ID NO: 179590 - DNA, 20 bp, Artificial
  CRISPR gRNA sequence
gggaggctgaggcaggagaa

SEQ ID NO: 179591 - DNA, 20 bp, Artificial
  CRISPR gRNA sequence
caggagaatggcatgaaccc

SEQ ID NO: 179592 - DNA, 20 bp, Artificial
  CRISPR gRNA sequence
ggagaatggcatgaaccccg

SEQ ID NO: 179593 - DNA, 20 bp, Artificial
  CRISPR gRNA sequence
gagaatggcatgaaccccgg

SEQ ID NO: 179594 - DNA, 20 bp, Artificial
  CRISPR gRNA sequence
aatggcatgaaccccggagg

SEQ ID NO: 179595 - DNA, 20 bp, Artificial
  CRISPR gRNA sequence
tggcatgaaccccggaggca

SEQ ID NO: 179596 - DNA, 20 bp, Artificial
  CRISPR gRNA sequence
aaccccggaggcagagcttg

SEQ ID NO: 179597 - DNA, 20 bp, Artificial
  CRISPR gRNA sequence
ccggaggcagagcttgcagt

SEQ ID NO: 179598 - DNA, 20 bp, Artificial
  CRISPR gRNA sequence
ggcagagcttgcagtgagcc

SEQ ID NO: 179599 - DNA, 20 bp, Artificial
  CRISPR gRNA sequence
gagattgcaccactgcacta

SEQ ID NO: 179600 - DNA, 20 bp, Artificial
  CRISPR gRNA sequence
tgcaccactgcactacagcc

SEQ ID NO: 179601 - DNA, 20 bp, Artificial
  CRISPR gRNA sequence
gcaccactgcactacagcct

SEQ ID NO: 179602 - DNA, 20 bp, Artificial
  CRISPR gRNA sequence
ctgcactacagcctgggcga

SEQ ID NO: 179603 - DNA, 20 bp, Artificial
  CRISPR gRNA sequence
gcactacagcctgggcgaca

SEQ ID NO: 179604 - DNA, 20 bp, Artificial
  CRISPR gRNA sequence
tacagcctgggcgacagagc

SEQ ID NO: 179605 - DNA, 20 bp, Artificial
  CRISPR gRNA sequence
tcaaaaaaaaaaaaaaaaat

SEQ ID NO: 179606 - DNA, 20 bp, Artificial
  CRISPR gRNA sequence
aaaaaaaaaaaaaaattagc

SEQ ID NO: 179607 - DNA, 20 bp, Artificial
  CRISPR gRNA sequence
aaaaaaaaaaaaaattagcc

SEQ ID NO: 179608 - DNA, 20 bp, Artificial
  CRISPR gRNA sequence
aaaaaaaaattagccgggcc

SEQ ID NO: 179609 - DNA, 20 bp, Artificial
  CRISPR gRNA sequence
aaaaaattagccgggcctgg

SEQ ID NO: 179610 - DNA, 20 bp, Artificial
  CRISPR gRNA sequence
aaattagccgggcctggtgg

SEQ ID NO: 179611 - DNA, 20 bp, Artificial
  CRISPR gRNA sequence
aattagccgggcctggtggc

SEQ ID NO: 179612 - DNA, 20 bp, Artificial
  CRISPR gRNA sequence
gtggcgggcgcctgtaatcc

SEQ ID NO: 179613 - DNA, 20 bp, Artificial
  CRISPR gRNA sequence
gcctgtaatcccagctactg

SEQ ID NO: 179614 - DNA, 20 bp, Artificial
  CRISPR gRNA sequence
ctgtaatcccagctactgtg

SEQ ID NO: 179615 - DNA, 20 bp, Artificial
  CRISPR gRNA sequence
tgtaatcccagctactgtgg

SEQ ID NO: 179616 - DNA, 20 bp, Artificial
  CRISPR gRNA sequence
cccagctactgtggaggctg

SEQ ID NO: 179617 - DNA, 20 bp, Artificial
  CRISPR gRNA sequence
tactgtggaggctgaagcac

SEQ ID NO: 179618 - DNA, 20 bp, Artificial
  CRISPR gRNA sequence
gcacaagaatcacttgaacc

SEQ ID NO: 179619 - DNA, 20 bp, Artificial
  CRISPR gRNA sequence
cacaagaatcacttgaaccc

SEQ ID NO: 179620 - DNA, 20 bp, Artificial
  CRISPR gRNA sequence
caagaatcacttgaacccgg

SEQ ID NO: 179621 - DNA, 20 bp, Artificial
  CRISPR gRNA sequence
aatcacttgaacccgggaga

SEQ ID NO: 179622 - DNA, 20 bp, Artificial
  CRISPR gRNA sequence
tcacttgaacccgggagatg

SEQ ID NO: 179623 - DNA, 20 bp, Artificial
  CRISPR gRNA sequence
cacttgaacccgggagatgg

SEQ ID NO: 179624 - DNA, 20 bp, Artificial
  CRISPR gRNA sequence
aacccgggagatggaggttg

SEQ ID NO: 179625 - DNA, 20 bp, Artificial
  CRISPR gRNA sequence
cgggagatggaggttgcagt

SEQ ID NO: 179626 - DNA, 20 bp, Artificial
  CRISPR gRNA sequence
gatggaggttgcagtgagct

SEQ ID NO: 179627 - DNA, 20 bp, Artificial
  CRISPR gRNA sequence
gagactgtgccactgcactc

SEQ ID NO: 179628 - DNA, 20 bp, Artificial
  CRISPR gRNA sequence
tgtgccactgcactccagcc

SEQ ID NO: 179629 - DNA, 20 bp, Artificial
  CRISPR gRNA sequence
gtgccactgcactccagcct

SEQ ID NO: 179630 - DNA, 20 bp, Artificial
  CRISPR gRNA sequence
tgcactccagcctgggtgac

SEQ ID NO: 179631 - DNA, 20 bp, Artificial
  CRISPR gRNA sequence
cactccagcctgggtgacaa

SEQ ID NO: 179632 - DNA, 20 bp, Artificial
  CRISPR gRNA sequence
ccagcctgggtgacaagagt

SEQ ID NO: 179633 - DNA, 20 bp, Artificial
  CRISPR gRNA sequence
tccttttgtttatgttcaca

SEQ ID NO: 179634 - DNA, 20 bp, Artificial
  CRISPR gRNA sequence
gtttatgttcacatagacaa

SEQ ID NO: 179635 - DNA, 20 bp, Artificial
  CRISPR gRNA sequence
tatgttcacatagacaatgg

SEQ ID NO: 179636 - DNA, 20 bp, Artificial
  CRISPR gRNA sequence
gttcacatagacaatggcag

SEQ ID NO: 179637 - DNA, 20 bp, Artificial
  CRISPR gRNA sequence
ttcacatagacaatggcaga

SEQ ID NO: 179638 - DNA, 20 bp, Artificial
  CRISPR gRNA sequence
cacatagacaatggcagaag

SEQ ID NO: 179639 - DNA, 20 bp, Artificial
  CRISPR gRNA sequence
acatagacaatggcagaagg

SEQ ID NO: 179640 - DNA, 20 bp, Artificial
  CRISPR gRNA sequence
catagacaatggcagaagga

SEQ ID NO: 179641 - DNA, 20 bp, Artificial
  CRISPR gRNA sequence
atagacaatggcagaaggag

SEQ ID NO: 179642 - DNA, 20 bp, Artificial
  CRISPR gRNA sequence
aggaggggacattcctgtca

SEQ ID NO: 179643 - DNA, 20 bp, Artificial
  CRISPR gRNA sequence
ggaggggacattcctgtcat

SEQ ID NO: 179644 - DNA, 20 bp, Artificial
  CRISPR gRNA sequence
ggaacatgcttatataaaca

SEQ ID NO: 179645 - DNA, 20 bp, Artificial
  CRISPR gRNA sequence
cacctgtccttgactatcac

SEQ ID NO: 179646 - DNA, 20 bp, Artificial
  CRISPR gRNA sequence
acctgtccttgactatcacc

SEQ ID NO: 179647 - DNA, 20 bp, Artificial
  CRISPR gRNA sequence
cctgtccttgactatcacca

SEQ ID NO: 179648 - DNA, 20 bp, Artificial
  CRISPR gRNA sequence
ttgactatcaccagggctgt

SEQ ID NO: 179649 - DNA, 20 bp, Artificial
  CRISPR gRNA sequence
ccagggctgtcagttgattc

SEQ ID NO: 179650 - DNA, 20 bp, Artificial
  CRISPR gRNA sequence
cagggctgtcagttgattct

SEQ ID NO: 179651 - DNA, 20 bp, Artificial
  CRISPR gRNA sequence
gtcagttgattctgggctcc

SEQ ID NO: 179652 - DNA, 20 bp, Artificial
  CRISPR gRNA sequence
tcagttgattctgggctcct

SEQ ID NO: 179653 - DNA, 20 bp, Artificial
  CRISPR gRNA sequence
cagttgattctgggctcctg

SEQ ID NO: 179654 - DNA, 20 bp, Artificial
  CRISPR gRNA sequence
attctgggctcctggggccc

SEQ ID NO: 179655 - DNA, 20 bp, Artificial
  CRISPR gRNA sequence
ttctgggctcctggggccca

SEQ ID NO: 179656 - DNA, 20 bp, Artificial
  CRISPR gRNA sequence
ctgggctcctggggcccaag

SEQ ID NO: 179657 - DNA, 20 bp, Artificial
  CRISPR gRNA sequence
cctggggcccaaggagtgtt

SEQ ID NO: 179658 - DNA, 20 bp, Artificial
  CRISPR gRNA sequence
cccaaggagtgttaagtttt

SEQ ID NO: 179659 - DNA, 20 bp, Artificial
  CRISPR gRNA sequence
ccaaggagtgttaagttttg

SEQ ID NO: 179660 - DNA, 20 bp, Artificial
  CRISPR gRNA sequence
aagttttgaggcatgtgcca

SEQ ID NO: 179661 - DNA, 20 bp, Artificial
  CRISPR gRNA sequence
agttttgaggcatgtgccat

SEQ ID NO: 179662 - DNA, 20 bp, Artificial
  CRISPR gRNA sequence
tgatgtgtcctgctaacaca

SEQ ID NO: 179663 - DNA, 20 bp, Artificial
  CRISPR gRNA sequence
cacacagatgctgctccaaa

SEQ ID NO: 179664 - DNA, 20 bp, Artificial
  CRISPR gRNA sequence
cagatgctgctccaaaaagt

SEQ ID NO: 179665 - DNA, 20 bp, Artificial
  CRISPR gRNA sequence
aaaagtcagttgatatgaca

SEQ ID NO: 179666 - DNA, 20 bp, Artificial
  CRISPR gRNA sequence
cagttgatatgacacagtca

SEQ ID NO: 179667 - DNA, 20 bp, Artificial
  CRISPR gRNA sequence
tgatatgacacagtcacaga

SEQ ID NO: 179668 - DNA, 20 bp, Artificial
  CRISPR gRNA sequence
tgacacagtcacagacagaa

SEQ ID NO: 179669 - DNA, 20 bp, Artificial
  CRISPR gRNA sequence
acagtcacagacagaacagt

SEQ ID NO: 179670 - DNA, 20 bp, Artificial
  CRISPR gRNA sequence
gtcacagacagaacagtcag

SEQ ID NO: 179671 - DNA, 20 bp, Artificial
  CRISPR gRNA sequence
gacagaacagtcagcagccc

SEQ ID NO: 179672 - DNA, 20 bp, Artificial
  CRISPR gRNA sequence
gaacagtcagcagcccaaga

SEQ ID NO: 179673 - DNA, 20 bp, Artificial
  CRISPR gRNA sequence
aacagtcagcagcccaagaa

SEQ ID NO: 179674 - DNA, 20 bp, Artificial
  CRISPR gRNA sequence
cagcccaagaaaggtcctca

SEQ ID NO: 179675 - DNA, 20 bp, Artificial
  CRISPR gRNA sequence
ggtcctcacggctgctgtgc

SEQ ID NO: 179676 - DNA, 20 bp, Artificial
  CRISPR gRNA sequence
gtcctcacggctgctgtgct

SEQ ID NO: 179677 - DNA, 20 bp, Artificial
  CRISPR gRNA sequence
ctcacggctgctgtgctggg

SEQ ID NO: 179678 - DNA, 20 bp, Artificial
  CRISPR gRNA sequence
gctgggtagcacttgccatc

SEQ ID NO: 179679 - DNA, 20 bp, Artificial
  CRISPR gRNA sequence
agcacttgccatccagtttc

SEQ ID NO: 179680 - DNA, 20 bp, Artificial
  CRISPR gRNA sequence
cacttgccatccagtttcta

SEQ ID NO: 179681 - DNA, 20 bp, Artificial
  CRISPR gRNA sequence
tctgtctgtaccgttcaata

SEQ ID NO: 179682 - DNA, 20 bp, Artificial
  CRISPR gRNA sequence
gtctgtaccgttcaatacag

SEQ ID NO: 179683 - DNA, 20 bp, Artificial
  CRISPR gRNA sequence
tctgtaccgttcaatacagt

SEQ ID NO: 179684 - DNA, 20 bp, Artificial
  CRISPR gRNA sequence
ccgttcaatacagtaggcac

SEQ ID NO: 179685 - DNA, 20 bp, Artificial
  CRISPR gRNA sequence
aatacagtaggcactggcac

SEQ ID NO: 179686 - DNA, 20 bp, Artificial
  CRISPR gRNA sequence
ctggcactagccacatgtgc

SEQ ID NO: 179687 - DNA, 20 bp, Artificial
  CRISPR gRNA sequence
actagccacatgtgccagct

SEQ ID NO: 179688 - DNA, 20 bp, Artificial
  CRISPR gRNA sequence
ccagctaagcacttgaaatg

SEQ ID NO: 179689 - DNA, 20 bp, Artificial
  CRISPR gRNA sequence
ctaagcacttgaaatgtggc

SEQ ID NO: 179690 - DNA, 20 bp, Artificial
  CRISPR gRNA sequence
tgaaatgtggccagtgcaat

SEQ ID NO: 179691 - DNA, 20 bp, Artificial
  CRISPR gRNA sequence
gaaatgtggccagtgcaata

SEQ ID NO: 179692 - DNA, 20 bp, Artificial
  CRISPR gRNA sequence
tttaataaactgtatgtaaa

SEQ ID NO: 179693 - DNA, 20 bp, Artificial
  CRISPR gRNA sequence
tgtatgtaaatagtcacatg

SEQ ID NO: 179694 - DNA, 20 bp, Artificial
  CRISPR gRNA sequence
tgtaaatagtcacatgtggt

SEQ ID NO: 179695 - DNA, 20 bp, Artificial
  CRISPR gRNA sequence
aaatagtcacatgtggtcag

SEQ ID NO: 179696 - DNA, 20 bp, Artificial
  CRISPR gRNA sequence
tcagtggttaccatattgaa

SEQ ID NO: 179697 - DNA, 20 bp, Artificial
  CRISPR gRNA sequence
ggttaccatattgaacagtg

SEQ ID NO: 179698 - DNA, 20 bp, Artificial
  CRISPR gRNA sequence
gttaccatattgaacagtgc

SEQ ID NO: 179699 - DNA, 20 bp, Artificial
  CRISPR gRNA sequence
accatattgaacagtgcagg

SEQ ID NO: 179700 - DNA, 20 bp, Artificial
  CRISPR gRNA sequence
tgaacagtgcaggtagatac

SEQ ID NO: 179701 - DNA, 20 bp, Artificial
  CRISPR gRNA sequence
agtgcaggtagatactggac

SEQ ID NO: 179702 - DNA, 20 bp, Artificial
  CRISPR gRNA sequence
gtgcaggtagatactggact

SEQ ID NO: 179703 - DNA, 20 bp, Artificial
  CRISPR gRNA sequence
tgcaggtagatactggactg

SEQ ID NO: 179704 - DNA, 20 bp, Artificial
  CRISPR gRNA sequence
gcaggtagatactggactgg

SEQ ID NO: 179705 - DNA, 20 bp, Artificial
  CRISPR gRNA sequence
ggtagatactggactggggg

SEQ ID NO: 179706 - DNA, 20 bp, Artificial
  CRISPR gRNA sequence
actggactgggggcagatct

SEQ ID NO: 179707 - DNA, 20 bp, Artificial
  CRISPR gRNA sequence
ctggactgggggcagatctg

SEQ ID NO: 179708 - DNA, 20 bp, Artificial
  CRISPR gRNA sequence
tggactgggggcagatctga

SEQ ID NO: 179709 - DNA, 20 bp, Artificial
  CRISPR gRNA sequence
gactgggggcagatctgagg

SEQ ID NO: 179710 - DNA, 20 bp, Artificial
  CRISPR gRNA sequence
ctgggggcagatctgaggga

SEQ ID NO: 179711 - DNA, 20 bp, Artificial
  CRISPR gRNA sequence
tgggggcagatctgagggag

SEQ ID NO: 179712 - DNA, 20 bp, Artificial
  CRISPR gRNA sequence
gggggcagatctgagggaga

SEQ ID NO: 179713 - DNA, 20 bp, Artificial
  CRISPR gRNA sequence
ggggcagatctgagggagag

SEQ ID NO: 179714 - DNA, 20 bp, Artificial
  CRISPR gRNA sequence
gatctgagggagaggggttt

SEQ ID NO: 179715 - DNA, 20 bp, Artificial
  CRISPR gRNA sequence
ctgagggagaggggtttgag

SEQ ID NO: 179716 - DNA, 20 bp, Artificial
  CRISPR gRNA sequence
agggagaggggtttgagtag

SEQ ID NO: 179717 - DNA, 20 bp, Artificial
  CRISPR gRNA sequence
gggagaggggtttgagtagt

SEQ ID NO: 179718 - DNA, 20 bp, Artificial
  CRISPR gRNA sequence
gagaggggtttgagtagtgg

SEQ ID NO: 179719 - DNA, 20 bp, Artificial
  CRISPR gRNA sequence
agaggggtttgagtagtggg

SEQ ID NO: 179720 - DNA, 20 bp, Artificial
  CRISPR gRNA sequence
tttgagtagtgggaggacac

SEQ ID NO: 179721 - DNA, 20 bp, Artificial
  CRISPR gRNA sequence
ttgagtagtgggaggacact

SEQ ID NO: 179722 - DNA, 20 bp, Artificial
  CRISPR gRNA sequence
tgagtagtgggaggacactg

SEQ ID NO: 179723 - DNA, 20 bp, Artificial
  CRISPR gRNA sequence
gcatttcatcactctagaaa

SEQ ID NO: 179724 - DNA, 20 bp, Artificial
  CRISPR gRNA sequence
ctccttgggccccaggagcc

SEQ ID NO: 179725 - DNA, 20 bp, Artificial
  CRISPR gRNA sequence
tataagcatgttcctatgac

SEQ ID NO: 179726 - DNA, 20 bp, Artificial
  CRISPR gRNA sequence
gtctatgtgaacataaacaa

SEQ ID NO: 179727 - DNA, 20 bp, Artificial
  CRISPR gRNA sequence
ctcactcttgtcacccaggc

SEQ ID NO: 179728 - DNA, 20 bp, Artificial
  CRISPR gRNA sequence
ctcactgcaacctccatctc

SEQ ID NO: 179729 - DNA, 20 bp, Artificial
  CRISPR gRNA sequence
gcttcagcctccacagtagc

SEQ ID NO: 179730 - DNA, 20 bp, Artificial
  CRISPR gRNA sequence
ttttttttttttttttgaga

SEQ ID NO: 179731 - DNA, 20 bp, Artificial
  CRISPR gRNA sequence
ctcactgcaagctctgcctc

SEQ ID NO: 179732 - DNA, 20 bp, Artificial
  CRISPR gRNA sequence
cattctcctgcctcagcctc

SEQ ID NO: 179733 - DNA, 20 bp, Artificial
  CRISPR gRNA sequence
ttttatatttttagtagaga

SEQ ID NO: 179734 - DNA, 20 bp, Artificial
  CRISPR gRNA sequence
cggggtttcaccgtgttagc

SEQ ID NO: 179735 - DNA, 20 bp, Artificial
  CRISPR gRNA sequence
gcctctgcctcccaaagtgc

SEQ ID NO: 179736 - DNA, 20 bp, Artificial
  CRISPR gRNA sequence
accttggcctcccaaagtgc

SEQ ID NO: 179737 - DNA, 20 bp, Artificial
  CRISPR gRNA sequence
tttttttttggtgcccgggc

SEQ ID NO: 179738 - DNA, 20 bp, Artificial
  CRISPR gRNA sequence
gattctcttgcctcagcctc

SEQ ID NO: 179739 - DNA, 20 bp, Artificial
  CRISPR gRNA sequence
gcctcagcctcctgagtagc

SEQ ID NO: 179740 - DNA, 20 bp, Artificial
  CRISPR gRNA sequence
ttttgcatttttagtagaaa

SEQ ID NO: 179741 - DNA, 20 bp, Artificial
  CRISPR gRNA sequence
atctcggcctcccaaagtgc

SEQ ID NO: 179742 - DNA, 20 bp, Artificial
  CRISPR gRNA sequence
gagccaccgcgcctggccga

SEQ ID NO: 179743 - DNA, 20 bp, Artificial
  CRISPR gRNA sequence
accccaaagtcaagttcagg

SEQ ID NO: 179744 - DNA, 20 bp, Artificial
  CRISPR gRNA sequence
tgagggctgctggggcttga

SEQ ID NO: 179745 - DNA, 20 bp, Artificial
  CRISPR gRNA sequence
ccctcagccaaagcagggag

SEQ ID NO: 179746 - DNA, 20 bp, Artificial
  CRISPR gRNA sequence
ccccagggctcagctgaaaa

SEQ ID NO: 179747 - DNA, 20 bp, Artificial
  CRISPR gRNA sequence
tcttagtgcagagccagccc

SEQ ID NO: 179748 - DNA, 20 bp, Artificial
  CRISPR gRNA sequence
ggattggtgttatgcttttc

SEQ ID NO: 179749 - DNA, 20 bp, Artificial
  CRISPR gRNA sequence
gccccatccccacttggcag

SEQ ID NO: 179750 - DNA, 20 bp, Artificial
  CRISPR gRNA sequence
gccaggtcctgcttgcctag

SEQ ID NO: 179751 - DNA, 20 bp, Artificial
  CRISPR gRNA sequence
gggccctgctacggtgcaca

SEQ ID NO: 179752 - DNA, 20 bp, Artificial
  CRISPR gRNA sequence
tacggtgcacagggaatggc

SEQ ID NO: 179753 - DNA, 20 bp, Artificial
  CRISPR gRNA sequence
tggatggagggcaaccggac

SEQ ID NO: 179754 - DNA, 20 bp, Artificial
  CRISPR gRNA sequence
agatgtgaagaaggttgtat

SEQ ID NO: 179755 - DNA, 20 bp, Artificial
  CRISPR gRNA sequence
tccctcatctaagaagccat

SEQ ID NO: 179756 - DNA, 20 bp, Artificial
  CRISPR gRNA sequence
tgggctggactccaggttca

SEQ ID NO: 179757 - DNA, 20 bp, Artificial
  CRISPR gRNA sequence
gccattttcacaatctcaga

SEQ ID NO: 179758 - DNA, 20 bp, Artificial
  CRISPR gRNA sequence
tgtgtaaggacatagtaaga

SEQ ID NO: 179759 - DNA, 20 bp, Artificial
  CRISPR gRNA sequence
gcaaaaacttttttttgaaa

SEQ ID NO: 179760 - DNA, 20 bp, Artificial
  CRISPR gRNA sequence
tttgctcttgttgcccaggc

SEQ ID NO: 179761 - DNA, 20 bp, Artificial
  CRISPR gRNA sequence
gattctcctgcctcagcctt

SEQ ID NO: 179762 - DNA, 20 bp, Artificial
  CRISPR gRNA sequence
gcctcagccttcagagtagc

SEQ ID NO: 179763 - DNA, 20 bp, Artificial
  CRISPR gRNA sequence
tttttatatttttggtagag

SEQ ID NO: 179764 - DNA, 20 bp, Artificial
  CRISPR gRNA sequence
accttcgccttccaaagtgc

SEQ ID NO: 179765 - DNA, 20 bp, Artificial
  CRISPR gRNA sequence
gaagcagaaaaaaaaacctg

SEQ ID NO: 179766 - DNA, 20 bp, Artificial
  CRISPR gRNA sequence
ataaagccatcatcatatta

SEQ ID NO: 179767 - DNA, 20 bp, Artificial
  CRISPR gRNA sequence
ggctggggcatgttggggca

SEQ ID NO: 179768 - DNA, 20 bp, Artificial
  CRISPR gRNA sequence
tttcccaccagtcaagccac

SEQ ID NO: 179769 - DNA, 20 bp, Artificial
  CRISPR gRNA sequence
cactgagaaacggtcacttc

SEQ ID NO: 179770 - DNA, 20 bp, Artificial
  CRISPR gRNA sequence
catcctcatctgttgtagct

SEQ ID NO: 179771 - DNA, 20 bp, Artificial
  CRISPR gRNA sequence
tcaatcaattcagtgccagg

SEQ ID NO: 179772 - DNA, 20 bp, Artificial
  CRISPR gRNA sequence
aaccttcagaggtggagggc

SEQ ID NO: 179773 - DNA, 20 bp, Artificial
  CRISPR gRNA sequence
ctgtccggcacaacttccac

SEQ ID NO: 179774 - DNA, 20 bp, Artificial
  CRISPR gRNA sequence
actgggatgtgccagtcggg

SEQ ID NO: 179775 - DNA, 20 bp, Artificial
  CRISPR gRNA sequence
agcaccatgcctccaagaga

SEQ ID NO: 179776 - DNA, 20 bp, Artificial
  CRISPR gRNA sequence
agagtcatcccactgacctg

SEQ ID NO: 179777 - DNA, 20 bp, Artificial
  CRISPR gRNA sequence
cagacctggaccagctcacc

SEQ ID NO: 179778 - DNA, 20 bp, Artificial
  CRISPR gRNA sequence
tagctgctgtggtcatcagg

SEQ ID NO: 179779 - DNA, 20 bp, Artificial
  CRISPR gRNA sequence
catcaggcagagtggagctg

SEQ ID NO: 179780 - DNA, 20 bp, Artificial
  CRISPR gRNA sequence
atcagagaaggtatcagggc

SEQ ID NO: 179781 - DNA, 20 bp, Artificial
  CRISPR gRNA sequence
ctgagggcttcccaaggacc

SEQ ID NO: 179782 - DNA, 20 bp, Artificial
  CRISPR gRNA sequence
ttcccaaggacccagagtcc

SEQ ID NO: 179783 - DNA, 20 bp, Artificial
  CRISPR gRNA sequence
cacctcctcgatatctggca

SEQ ID NO: 179784 - DNA, 20 bp, Artificial
  CRISPR gRNA sequence
aaagttggccttccacgtct

SEQ ID NO: 179785 - DNA, 20 bp, Artificial
  CRISPR gRNA sequence
ctagagggcaggagaaaaaa

SEQ ID NO: 179786 - DNA, 20 bp, Artificial
  CRISPR gRNA sequence
aaaagaggatcgtcagggcc

SEQ ID NO: 179787 - DNA, 20 bp, Artificial
  CRISPR gRNA sequence
ggatcgtcagggccatgggt

SEQ ID NO: 179788 - DNA, 20 bp, Artificial
  CRISPR gRNA sequence
aagggcccagccagaagcac

SEQ ID NO: 179789 - DNA, 20 bp, Artificial
  CRISPR gRNA sequence
ccttgggctatcagcagcca

SEQ ID NO: 179790 - DNA, 20 bp, Artificial
  CRISPR gRNA sequence
ggctatcagcagccagaggg

SEQ ID NO: 179791 - DNA, 20 bp, Artificial
  CRISPR gRNA sequence
cagcagagaacagttactaa

SEQ ID NO: 179792 - DNA, 20 bp, Artificial
  CRISPR gRNA sequence
ggcctagagctccatctctc

SEQ ID NO: 179793 - DNA, 20 bp, Artificial
  CRISPR gRNA sequence
acacgaagaaaaaggcagac

SEQ ID NO: 179794 - DNA, 20 bp, Artificial
  CRISPR gRNA sequence
agatcttggcttttcccttt

SEQ ID NO: 179795 - DNA, 20 bp, Artificial
  CRISPR gRNA sequence
tgaagagcctctgtgttaac

SEQ ID NO: 179796 - DNA, 20 bp, Artificial
  CRISPR gRNA sequence
ctaccctgggcttcctaggc

SEQ ID NO: 179797 - DNA, 20 bp, Artificial
  CRISPR gRNA sequence
agtcccaggcacacacctgt

SEQ ID NO: 179798 - DNA, 20 bp, Artificial
  CRISPR gRNA sequence
tgcttggcagcatgcttcca

SEQ ID NO: 179799 - DNA, 20 bp, Artificial
  CRISPR gRNA sequence
agagaccacagactttgggg

SEQ ID NO: 179800 - DNA, 20 bp, Artificial
  CRISPR gRNA sequence
gctggcttaaacagaccact

SEQ ID NO: 179801 - DNA, 20 bp, Artificial
  CRISPR gRNA sequence
tctcaggagggacacctagt

SEQ ID NO: 179802 - DNA, 20 bp, Artificial
  CRISPR gRNA sequence
aagccctggttttgaagctc

SEQ ID NO: 179803 - DNA, 20 bp, Artificial
  CRISPR gRNA sequence
ggagcatgggctcttacaca

SEQ ID NO: 179804 - DNA, 20 bp, Artificial
  CRISPR gRNA sequence
gagggagctctgggctagac

SEQ ID NO: 179805 - DNA, 20 bp, Artificial
  CRISPR gRNA sequence
aacatatccaacaaaatttt

SEQ ID NO: 179806 - DNA, 20 bp, Artificial
  CRISPR gRNA sequence
attttgaggattaaaaacca

SEQ ID NO: 179807 - DNA, 20 bp, Artificial
  CRISPR gRNA sequence
atggttaacagtaaagattt

SEQ ID NO: 179808 - DNA, 20 bp, Artificial
  CRISPR gRNA sequence
ctaacccacaggactactgc

SEQ ID NO: 179809 - DNA, 20 bp, Artificial
  CRISPR gRNA sequence
tagcaggtgccaggcacaca

SEQ ID NO: 179810 - DNA, 20 bp, Artificial
  CRISPR gRNA sequence
agtaagcattagctattatt

SEQ ID NO: 179811 - DNA, 20 bp, Artificial
  CRISPR gRNA sequence
tatcattgctactaagtcta

SEQ ID NO: 179812 - DNA, 20 bp, Artificial
  CRISPR gRNA sequence
cagctataggcttcttgggc

SEQ ID NO: 179813 - DNA, 20 bp, Artificial
  CRISPR gRNA sequence
tttgttcgattggagccctg

SEQ ID NO: 179814 - DNA, 20 bp, Artificial
  CRISPR gRNA sequence
agagtgctgtgtatgtttgt

SEQ ID NO: 179815 - DNA, 20 bp, Artificial
  CRISPR gRNA sequence
gaaactggaagtgccttcag

SEQ ID NO: 179816 - DNA, 20 bp, Artificial
  CRISPR gRNA sequence
cctcaagaagggaagaaggc

SEQ ID NO: 179817 - DNA, 20 bp, Artificial
  CRISPR gRNA sequence
tttggtccctccagaagtac

SEQ ID NO: 179818 - DNA, 20 bp, Artificial
  CRISPR gRNA sequence
aacagtggcaggaaaaccca

SEQ ID NO: 179819 - DNA, 20 bp, Artificial
  CRISPR gRNA sequence
ttattaatccagatgagccc

SEQ ID NO: 179820 - DNA, 20 bp, Artificial
  CRISPR gRNA sequence
gatgagccccgggatttggt

SEQ ID NO: 179821 - DNA, 20 bp, Artificial
  CRISPR gRNA sequence
aattaatctgcatctctagc

SEQ ID NO: 179822 - DNA, 20 bp, Artificial
  CRISPR gRNA sequence
agccagggtctcatgcgcat

SEQ ID NO: 179823 - DNA, 20 bp, Artificial
  CRISPR gRNA sequence
agaacacagaggctccagtc

SEQ ID NO: 179824 - DNA, 20 bp, Artificial
  CRISPR gRNA sequence
agtgcggaggggagctgcgc

SEQ ID NO: 179825 - DNA, 20 bp, Artificial
  CRISPR gRNA sequence
aggcatgcaagtgatggctt

SEQ ID NO: 179826 - DNA, 20 bp, Artificial
  CRISPR gRNA sequence
caagaagaaattcccttgac

SEQ ID NO: 179827 - DNA, 20 bp, Artificial
  CRISPR gRNA sequence
aacagccccctcccgccccc

SEQ ID NO: 179828 - DNA, 20 bp, Artificial
  CRISPR gRNA sequence
ctcggtccccggcacggcgt

SEQ ID NO: 179829 - DNA, 20 bp, Artificial
  CRISPR gRNA sequence
ccgggcgccggcagcctcgt

SEQ ID NO: 179830 - DNA, 20 bp, Artificial
  CRISPR gRNA sequence
ccgggcaacgccgcgcgccg

SEQ ID NO: 179831 - DNA, 20 bp, Artificial
  CRISPR gRNA sequence
gcgattcggcggtcgcgcgc

SEQ ID NO: 179832 - DNA, 20 bp, Artificial
  CRISPR gRNA sequence
agggcgcgcggagcgcgact

SEQ ID NO: 179833 - DNA, 20 bp, Artificial
  CRISPR gRNA sequence
agggaagaaggcagaggttg

SEQ ID NO: 179834 - DNA, 20 bp, Artificial
  CRISPR gRNA sequence
ggcgtggactgggcacggct

SEQ ID NO: 179835 - DNA, 20 bp, Artificial
  CRISPR gRNA sequence
cgcacgtcttgcctcgacta

SEQ ID NO: 179836 - DNA, 20 bp, Artificial
  CRISPR gRNA sequence
cgagcaatccaaacacttag

SEQ ID NO: 179837 - DNA, 20 bp, Artificial
  CRISPR gRNA sequence
ggcggggccggccagggctg

SEQ ID NO: 179838 - DNA, 20 bp, Artificial
  CRISPR gRNA sequence
tggggaatcccgctaagtgt

SEQ ID NO: 179839 - DNA, 20 bp, Artificial
  CRISPR gRNA sequence
gccttcttccctcttccact

SEQ ID NO: 179840 - DNA, 20 bp, Artificial
  CRISPR gRNA sequence
gggaccctcgcgcgcgaccg

SEQ ID NO: 179841 - DNA, 20 bp, Artificial
  CRISPR gRNA sequence
gaatcgctcctgcagcagag

SEQ ID NO: 179842 - DNA, 20 bp, Artificial
  CRISPR gRNA sequence
ggcgcggggcaccggcggcg

SEQ ID NO: 179843 - DNA, 20 bp, Artificial
  CRISPR gRNA sequence
gcgcggggcaccaggaagtg

SEQ ID NO: 179844 - DNA, 20 bp, Artificial
  CRISPR gRNA sequence
tccacacgccgtgccgggga

SEQ ID NO: 179845 - DNA, 20 bp, Artificial
  CRISPR gRNA sequence
ttactgcccaggtggctgga

SEQ ID NO: 179846 - DNA, 20 bp, Artificial
  CRISPR gRNA sequence
aggaggggaaaccgggccgg

SEQ ID NO: 179847 - DNA, 20 bp, Artificial
  CRISPR gRNA sequence
ctgtggctgtcaggaaggcg

SEQ ID NO: 179848 - DNA, 20 bp, Artificial
  CRISPR gRNA sequence
ggctgtcaggaaggcgtaga

SEQ ID NO: 179849 - DNA, 20 bp, Artificial
  CRISPR gRNA sequence
gggggcgggagggggctgtt

SEQ ID NO: 179850 - DNA, 20 bp, Artificial
  CRISPR gRNA sequence
gtggttacaactcaagtcaa

SEQ ID NO: 179851 - DNA, 20 bp, Artificial
  CRISPR gRNA sequence
aagaagtccctcccttccca

SEQ ID NO: 179852 - DNA, 20 bp, Artificial
  CRISPR gRNA sequence
tccctcccttcccaaaggat

SEQ ID NO: 179853 - DNA, 20 bp, Artificial
  CRISPR gRNA sequence
tgagcgaaaagttctgaaat

SEQ ID NO: 179854 - DNA, 20 bp, Artificial
  CRISPR gRNA sequence
ttttgtctcttttcctgcat

SEQ ID NO: 179855 - DNA, 20 bp, Artificial
  CRISPR gRNA sequence
cagcgcagctcccctccgca

SEQ ID NO: 179856 - DNA, 20 bp, Artificial
  CRISPR gRNA sequence
gcagctggctgaggtgaggg

SEQ ID NO: 179857 - DNA, 20 bp, Artificial
  CRISPR gRNA sequence
gggagggtaactaagtgacc

SEQ ID NO: 179858 - DNA, 20 bp, Artificial
  CRISPR gRNA sequence
acagccaacatgcccatcac

SEQ ID NO: 179859 - DNA, 20 bp, Artificial
  CRISPR gRNA sequence
aaccaaatcccggggctcat

SEQ ID NO: 179860 - DNA, 20 bp, Artificial
  CRISPR gRNA sequence
ggctcatctggattaataaa

SEQ ID NO: 179861 - DNA, 20 bp, Artificial
  CRISPR gRNA sequence
aataaagtgagtgtaactct

SEQ ID NO: 179862 - DNA, 20 bp, Artificial
  CRISPR gRNA sequence
acaagcaggtgtttctccca

SEQ ID NO: 179863 - DNA, 20 bp, Artificial
  CRISPR gRNA sequence
cccagtgggtcctgcatgca

SEQ ID NO: 179864 - DNA, 20 bp, Artificial
  CRISPR gRNA sequence
ctttccagcatctgcagagc

SEQ ID NO: 179865 - DNA, 20 bp, Artificial
  CRISPR gRNA sequence
aacaaatagaagactgagaa

SEQ ID NO: 179866 - DNA, 20 bp, Artificial
  CRISPR gRNA sequence
cctggcttagcagaggacaa

SEQ ID NO: 179867 - DNA, 20 bp, Artificial
  CRISPR gRNA sequence
ttaatcctcgcagtagtcct

SEQ ID NO: 179868 - DNA, 20 bp, Artificial
  CRISPR gRNA sequence
ttttaatcctcaaaattttg

SEQ ID NO: 179869 - DNA, 20 bp, Artificial
  CRISPR gRNA sequence
aagagatacagtgacaatgc

SEQ ID NO: 179870 - DNA, 20 bp, Artificial
  CRISPR gRNA sequence
ccatgctcccaggtgtcctg

SEQ ID NO: 179871 - DNA, 20 bp, Artificial
  CRISPR gRNA sequence
gaagaagttcttacttccat

SEQ ID NO: 179872 - DNA, 20 bp, Artificial
  CRISPR gRNA sequence
tcaaaaccagggctttgggg

SEQ ID NO: 179873 - DNA, 20 bp, Artificial
  CRISPR gRNA sequence
tttgggggagggtgccctgt

SEQ ID NO: 179874 - DNA, 20 bp, Artificial
  CRISPR gRNA sequence
ggtgtccctcctgagagatc

SEQ ID NO: 179875 - DNA, 20 bp, Artificial
  CRISPR gRNA sequence
ctgtttaagccagcctcaag

SEQ ID NO: 179876 - DNA, 20 bp, Artificial
  CRISPR gRNA sequence
acctgtctggctgggcaggc

SEQ ID NO: 179877 - DNA, 20 bp, Artificial
  CRISPR gRNA sequence
agcatggctgggacatcaac

SEQ ID NO: 179878 - DNA, 20 bp, Artificial
  CRISPR gRNA sequence
ggactcaggcctaggaagcc

SEQ ID NO: 179879 - DNA, 20 bp, Artificial
  CRISPR gRNA sequence
ttaacacagaggctcttcac

SEQ ID NO: 179880 - DNA, 20 bp, Artificial
  CRISPR gRNA sequence
gagctccctgagacaacatg

SEQ ID NO: 179881 - DNA, 20 bp, Artificial
  CRISPR gRNA sequence
agacttgtgtttctggagaa

SEQ ID NO: 179882 - DNA, 20 bp, Artificial
  CRISPR gRNA sequence
ttagaaagtgtgtggcttca

SEQ ID NO: 179883 - DNA, 20 bp, Artificial
  CRISPR gRNA sequence
agacacagatagtacacttt

SEQ ID NO: 179884 - DNA, 20 bp, Artificial
  CRISPR gRNA sequence
ggcccagggcctaggacctg

SEQ ID NO: 179885 - DNA, 20 bp, Artificial
  CRISPR gRNA sequence
aggacctgcagagtgtcacc

SEQ ID NO: 179886 - DNA, 20 bp, Artificial
  CRISPR gRNA sequence
ctctggtagcataagaggtc

SEQ ID NO: 179887 - DNA, 20 bp, Artificial
  CRISPR gRNA sequence
ccttcaggccaggggcagct

SEQ ID NO: 179888 - DNA, 20 bp, Artificial
  CRISPR gRNA sequence
aacaagggcagctcagctgt

SEQ ID NO: 179889 - DNA, 20 bp, Artificial
  CRISPR gRNA sequence
agctcagctgtgcgagtgta

SEQ ID NO: 179890 - DNA, 20 bp, Artificial
  CRISPR gRNA sequence
agaaaaggtatccaaggact

SEQ ID NO: 179891 - DNA, 20 bp, Artificial
  CRISPR gRNA sequence
ttgggaagccctcagggagg

SEQ ID NO: 179892 - DNA, 20 bp, Artificial
  CRISPR gRNA sequence
agagcaaggccaagaggaag

SEQ ID NO: 179893 - DNA, 20 bp, Artificial
  CRISPR gRNA sequence
gcctttggtcacctgtgggc

SEQ ID NO: 179894 - DNA, 20 bp, Artificial
  CRISPR gRNA sequence
ttctccctcgacagtcatgt

SEQ ID NO: 179895 - DNA, 20 bp, Artificial
  CRISPR gRNA sequence
caggagaccccacaggtcag

SEQ ID NO: 179896 - DNA, 20 bp, Artificial
  CRISPR gRNA sequence
tggcccattagtgcaggctg

SEQ ID NO: 179897 - DNA, 20 bp, Artificial
  CRISPR gRNA sequence
tggcctgcctgcttgactgt

SEQ ID NO: 179898 - DNA, 20 bp, Artificial
  CRISPR gRNA sequence
gatcagaactccacctggca

SEQ ID NO: 179899 - DNA, 20 bp, Artificial
  CRISPR gRNA sequence
tccacctggcactgaattga

SEQ ID NO: 179900 - DNA, 20 bp, Artificial
  CRISPR gRNA sequence
gggacactaggaaggcagtt

SEQ ID NO: 179901 - DNA, 20 bp, Artificial
  CRISPR gRNA sequence
gggggccaggggctgcattt

SEQ ID NO: 179902 - DNA, 20 bp, Artificial
  CRISPR gRNA sequence
tcctctgtagcccagcatct

SEQ ID NO: 179903 - DNA, 20 bp, Artificial
  CRISPR gRNA sequence
tctgagggtgaggaaggaag

SEQ ID NO: 179904 - DNA, 20 bp, Artificial
  CRISPR gRNA sequence
ggtgaggaaggaagtagggt

SEQ ID NO: 179905 - DNA, 20 bp, Artificial
  CRISPR gRNA sequence
ggtgggaagcggcgtggctt

SEQ ID NO: 179906 - DNA, 20 bp, Artificial
  CRISPR gRNA sequence
tggcttcagggtttgagagg

SEQ ID NO: 179907 - DNA, 20 bp, Artificial
  CRISPR gRNA sequence
gagaggctgagtcaccaggc

SEQ ID NO: 179908 - DNA, 20 bp, Artificial
  CRISPR gRNA sequence
accaggccagggtcctgttc

SEQ ID NO: 179909 - DNA, 20 bp, Artificial
  CRISPR gRNA sequence
atggcagataggtccaccgg

SEQ ID NO: 179910 - DNA, 20 bp, Artificial
  CRISPR gRNA sequence
gagagacagagaaagggcag

SEQ ID NO: 179911 - DNA, 20 bp, Artificial
  CRISPR gRNA sequence
gtgggctggaactggaactg

SEQ ID NO: 179912 - DNA, 20 bp, Artificial
  CRISPR gRNA sequence
gctggaactggaactgcagg

SEQ ID NO: 179913 - DNA, 20 bp, Artificial
  CRISPR gRNA sequence
catccacagctacaacagat

SEQ ID NO: 179914 - DNA, 20 bp, Artificial
  CRISPR gRNA sequence
ccagtgaagcttccaaatca

SEQ ID NO: 179915 - DNA, 20 bp, Artificial
  CRISPR gRNA sequence
tgaagcttccaaatcagagg

SEQ ID NO: 179916 - DNA, 20 bp, Artificial
  CRISPR gRNA sequence
ttggggcatcagacagctct

SEQ ID NO: 179917 - DNA, 20 bp, Artificial
  CRISPR gRNA sequence
tgagtcaggcactatcagcg

SEQ ID NO: 179918 - DNA, 20 bp, Artificial
  CRISPR gRNA sequence
aggcttcaataatcagcctt

SEQ ID NO: 179919 - DNA, 20 bp, Artificial
  CRISPR gRNA sequence
tttctgcttcagttttgaaa

SEQ ID NO: 179920 - DNA, 20 bp, Artificial
  CRISPR gRNA sequence
cagcactttggaaggcgaag

SEQ ID NO: 179921 - DNA, 20 bp, Artificial
  CRISPR gRNA sequence
actttggaaggcgaaggtgg

SEQ ID NO: 179922 - DNA, 20 bp, Artificial
  CRISPR gRNA sequence
tgggtggatcacctgaggtc

SEQ ID NO: 179923 - DNA, 20 bp, Artificial
  CRISPR gRNA sequence
tactctgaaggctgaggcag

SEQ ID NO: 179924 - DNA, 20 bp, Artificial
  CRISPR gRNA sequence
ttagcccaaaaaattgagac

SEQ ID NO: 179925 - DNA, 20 bp, Artificial
  CRISPR gRNA sequence
gtcgtggagatgctatacca

SEQ ID NO: 179926 - DNA, 20 bp, Artificial
  CRISPR gRNA sequence
tggagatgctataccagaga

SEQ ID NO: 179927 - DNA, 20 bp, Artificial
  CRISPR gRNA sequence
taccagagagtgggtgtgag

SEQ ID NO: 179928 - DNA, 20 bp, Artificial
  CRISPR gRNA sequence
ggtgtgagaggggtgggaaa

SEQ ID NO: 179929 - DNA, 20 bp, Artificial
  CRISPR gRNA sequence
ctgagattgtgaaaatggcc

SEQ ID NO: 179930 - DNA, 20 bp, Artificial
  CRISPR gRNA sequence
gctcattgagggcagggcca

SEQ ID NO: 179931 - DNA, 20 bp, Artificial
  CRISPR gRNA sequence
attgagggcagggccacagg

SEQ ID NO: 179932 - DNA, 20 bp, Artificial
  CRISPR gRNA sequence
agggtgagtctgcactggaa

SEQ ID NO: 179933 - DNA, 20 bp, Artificial
  CRISPR gRNA sequence
tccccagctcttggagcagt

SEQ ID NO: 179934 - DNA, 20 bp, Artificial
  CRISPR gRNA sequence
cggagtggcagccaacaaac

SEQ ID NO: 179935 - DNA, 20 bp, Artificial
  CRISPR gRNA sequence
gccaacaaacgtggatggga

SEQ ID NO: 179936 - DNA, 20 bp, Artificial
  CRISPR gRNA sequence
gggtacctactcaatgaacc

SEQ ID NO: 179937 - DNA, 20 bp, Artificial
  CRISPR gRNA sequence
agccagaaattgacagccca

SEQ ID NO: 179938 - DNA, 20 bp, Artificial
  CRISPR gRNA sequence
gcccagggggtaagaaggcc

SEQ ID NO: 179939 - DNA, 20 bp, Artificial
  CRISPR gRNA sequence
tagatgagggagaaccacgt

SEQ ID NO: 179940 - DNA, 20 bp, Artificial
  CRISPR gRNA sequence
gagcagggcggtaaagcatc

SEQ ID NO: 179941 - DNA, 20 bp, Artificial
  CRISPR gRNA sequence
atctggggtactgacacatt

SEQ ID NO: 179942 - DNA, 20 bp, Artificial
  CRISPR gRNA sequence
gccttaaggtttgcctgaag

SEQ ID NO: 179943 - DNA, 20 bp, Artificial
  CRISPR gRNA sequence
taaggtttgcctgaagctga

SEQ ID NO: 179944 - DNA, 20 bp, Artificial
  CRISPR gRNA sequence
aggccatgtctatggccttc

SEQ ID NO: 179945 - DNA, 20 bp, Artificial
  CRISPR gRNA sequence
aaccttcttcacatcttcta

SEQ ID NO: 179946 - DNA, 20 bp, Artificial
  CRISPR gRNA sequence
atcttctaggggatattggg

SEQ ID NO: 179947 - DNA, 20 bp, Artificial
  CRISPR gRNA sequence
tcttcacagatctgaagaac

SEQ ID NO: 179948 - DNA, 20 bp, Artificial
  CRISPR gRNA sequence
aagcaggacctggcatcatg

SEQ ID NO: 179949 - DNA, 20 bp, Artificial
  CRISPR gRNA sequence
gtgtgaccccactgccaagt

SEQ ID NO: 179950 - DNA, 20 bp, Artificial
  CRISPR gRNA sequence
tggggatggggcctccctcc

SEQ ID NO: 179951 - DNA, 20 bp, Artificial
  CRISPR gRNA sequence
agggcctggcaggccagtgt

SEQ ID NO: 179952 - DNA, 20 bp, Artificial
  CRISPR gRNA sequence
atcaggtcagggacttggac

SEQ ID NO: 179953 - DNA, 20 bp, Artificial
  CRISPR gRNA sequence
tctgagcccagctgcctgga

SEQ ID NO: 179954 - DNA, 20 bp, Artificial
  CRISPR gRNA sequence
ctaagagaaaattgcactaa

SEQ ID NO: 179955 - DNA, 20 bp, Artificial
  CRISPR gRNA sequence
cagtgaaatgtgaaggaaag

SEQ ID NO: 179956 - DNA, 20 bp, Artificial
  CRISPR gRNA sequence
aaaacttggcactttttcgt

SEQ ID NO: 179957 - DNA, 20 bp, Artificial
  CRISPR gRNA sequence
taaaaagtaaattgtttata

SEQ ID NO: 179958 - DNA, 20 bp, Artificial
  CRISPR gRNA sequence
atcccgcctgaacttgactt

SEQ ID NO: 179959 - DNA, 20 bp, Artificial
  CRISPR gRNA sequence
cagcactttgggaggccgag

SEQ ID NO: 179960 - DNA, 20 bp, Artificial
  CRISPR gRNA sequence
actttgggaggccgagatgg

SEQ ID NO: 179961 - DNA, 20 bp, Artificial
  CRISPR gRNA sequence
tgggtggatcacctgaggtc

SEQ ID NO: 179962 - DNA, 20 bp, Artificial
  CRISPR gRNA sequence
aaaattagctgggcgtggtt

SEQ ID NO: 179963 - DNA, 20 bp, Artificial
  CRISPR gRNA sequence
tactcaggaggctgaggcaa

SEQ ID NO: 179964 - DNA, 20 bp, Artificial
  CRISPR gRNA sequence
tgggcagatcacctgaggtc

SEQ ID NO: 179965 - DNA, 20 bp, Artificial
  CRISPR gRNA sequence
actttgggaggcagaggcgg

SEQ ID NO: 179966 - DNA, 20 bp, Artificial
  CRISPR gRNA sequence
aaaattagccgggcctagtg

SEQ ID NO: 179967 - DNA, 20 bp, Artificial
  CRISPR gRNA sequence
tactcgggaggctgaggcag

SEQ ID NO: 179968 - DNA, 20 bp, Artificial
  CRISPR gRNA sequence
tactgtggaggctgaagcac

SEQ ID NO: 179969 - DNA, 20 bp, Artificial
  CRISPR gRNA sequence
ctgtgccactgcactccagc

SEQ ID NO: 179970 - DNA, 20 bp, Artificial
  CRISPR gRNA sequence
tgcactccagcctgggtgac

SEQ ID NO: 179971 - DNA, 20 bp, Artificial
  CRISPR gRNA sequence
ttctgggctcctggggccca

SEQ ID NO: 179972 - DNA, 20 bp, Artificial
  CRISPR gRNA sequence
aggtcctcacggctgctgtg

SEQ ID NO: 179973 - DNA, 20 bp, Artificial
  CRISPR gRNA sequence
agcacttgccatccagtttc

SEQ ID NO: 179974 - DNA, 20 bp, Artificial
  CRISPR gRNA sequence
gaaatgtggccagtgcaata

SEQ ID NO: 179975 - DNA, 20 bp, Artificial
  CRISPR gRNA sequence
tgggggcagatctgagggag

SEQ ID NO: 179976 - DNA, 20 bp, Artificial
  CRISPR gRNA sequence
cagatctgagggagaggggt

SEQ ID NO: 179977 - DNA, 20 bp, Artificial
  CRISPR gRNA sequence
ttgagtagtgggaggacact

SEQ ID NO: 179978 - DNA, 20 bp, Artificial
  CRISPR gRNA sequence
accacatgtgactatttaca

SEQ ID NO: 179979 - DNA, 20 bp, Artificial
  CRISPR gRNA sequence
tattgcactggccacatttc

SEQ ID NO: 179980 - DNA, 20 bp, Artificial
  CRISPR gRNA sequence
tgatagtcaaggacaggtga

SEQ ID NO: 179981 - DNA, 20 bp, Artificial
  CRISPR gRNA sequence
tgtctatgtgaacataaaca

SEQ ID NO: 179982 - DNA, 20 bp, Artificial
  CRISPR gRNA sequence
aacctccatctcccgggttc

SEQ ID NO: 179983 - DNA, 20 bp, Artificial
  CRISPR gRNA sequence
ctcccgggttcaagtgattc

SEQ ID NO: 179984 - DNA, 20 bp, Artificial
  CRISPR gRNA sequence
tgcttcagcctccacagtag

SEQ ID NO: 179985 - DNA, 20 bp, Artificial
  CRISPR gRNA sequence
ttttatatttttagtagaga

SEQ ID NO: 179986 - DNA, 20 bp, Artificial
  CRISPR gRNA sequence
cgcctctgcctcccaaagtg

SEQ ID NO: 179987 - DNA, 20 bp, Artificial
  CRISPR gRNA sequence
ttttgtatttttagtagaga

SEQ ID NO: 179988 - DNA, 20 bp, Artificial
  CRISPR gRNA sequence
caccttggcctcccaaagtg

SEQ ID NO: 179989 - DNA, 20 bp, Artificial
  CRISPR gRNA sequence
ccaccatgcccggccaaatg

SEQ ID NO: 179990 - DNA, 20 bp, Artificial
  CRISPR gRNA sequence
aacctccacctcccaggttc

SEQ ID NO: 179991 - DNA, 20 bp, Artificial
  CRISPR gRNA sequence
tgcctcagcctcctgagtag

SEQ ID NO: 179992 - DNA, 20 bp, Artificial
  CRISPR gRNA sequence
ttttgcatttttagtagaaa

SEQ ID NO: 179993 - DNA, 20 bp, Artificial
  CRISPR gRNA sequence
catctcggcctcccaaagtg

SEQ ID NO: 179994 - DNA, 20 bp, Artificial
  CRISPR gRNA sequence
tgagccaccgcgcctggccg

SEQ ID NO: 179995 - DNA, 20 bp, Artificial
  CRISPR gRNA sequence
gatgccaataataagtccat

SEQ ID NO: 179996 - DNA, 20 bp, Artificial
  CRISPR gRNA sequence
ctgggcctgttgagggctgc

SEQ ID NO: 179997 - DNA, 20 bp, Artificial
  CRISPR gRNA sequence
aagatccacacgaaaaagtg

SEQ ID NO: 179998 - DNA, 20 bp, Artificial
  CRISPR gRNA sequence
cccactttccttcacatttc

SEQ ID NO: 179999 - DNA, 20 bp, Artificial
  CRISPR gRNA sequence
aagggggtagttctttggga

SEQ ID NO: 180000 - DNA, 20 bp, Artificial
  CRISPR gRNA sequence
ctcttagtgcagagccagcc

SEQ ID NO: 180001 - DNA, 20 bp, Artificial
  CRISPR gRNA sequence
agccagccctgggattggtg

SEQ ID NO: 180002 - DNA, 20 bp, Artificial
  CRISPR gRNA sequence
tcatcttcccaggaggcagg

SEQ ID NO: 180003 - DNA, 20 bp, Artificial
  CRISPR gRNA sequence
tgttgaggggcccacagaag

SEQ ID NO: 180004 - DNA, 20 bp, Artificial
  CRISPR gRNA sequence
atatccaccatgatgccagg

SEQ ID NO: 180005 - DNA, 20 bp, Artificial
  CRISPR gRNA sequence
gtaggggacggtggcatcag

SEQ ID NO: 180006 - DNA, 20 bp, Artificial
  CRISPR gRNA sequence
agcacagcagtaaacatcca

SEQ ID NO: 180007 - DNA, 20 bp, Artificial
  CRISPR gRNA sequence
tcacaatgtgtcagtacccc

SEQ ID NO: 180008 - DNA, 20 bp, Artificial
  CRISPR gRNA sequence
cctgctccctggccctgccc

SEQ ID NO: 180009 - DNA, 20 bp, Artificial
  CRISPR gRNA sequence
gagtaggtaccccttcccat

SEQ ID NO: 180010 - DNA, 20 bp, Artificial
  CRISPR gRNA sequence
aaggacatagtaagagggaa

SEQ ID NO: 180011 - DNA, 20 bp, Artificial
  CRISPR gRNA sequence
gcaaaaacttttttttgaaa

SEQ ID NO: 180012 - DNA, 20 bp, Artificial
  CRISPR gRNA sequence
aacctccgcctctcaggttc

SEQ ID NO: 180013 - DNA, 20 bp, Artificial
  CRISPR gRNA sequence
tgcctcagccttcagagtag

SEQ ID NO: 180014 - DNA, 20 bp, Artificial
  CRISPR gRNA sequence
tttttatatttttggtagag

SEQ ID NO: 180015 - DNA, 20 bp, Artificial
  CRISPR gRNA sequence
caccttcgccttccaaagtg

SEQ ID NO: 180016 - DNA, 20 bp, Artificial
  CRISPR gRNA sequence
tcatattaacggatcctaaa

SEQ ID NO: 180017 - DNA, 20 bp, Artificial
  CRISPR gRNA sequence
cacagagctgtctgatgccc

SEQ ID NO: 180018 - DNA, 20 bp, Artificial
  CRISPR gRNA sequence
gagctgtctgatgccccaag

SEQ ID NO: 180019 - DNA, 20 bp, Artificial
  CRISPR gRNA sequence
cacctgccttcccttcccat

SEQ ID NO: 180020 - DNA, 20 bp, Artificial
  CRISPR gRNA sequence
gacaacagcagctacccatc

SEQ ID NO: 180021 - DNA, 20 bp, Artificial
  CRISPR gRNA sequence
agctacccatcctctgattt

SEQ ID NO: 180022 - DNA, 20 bp, Artificial
  CRISPR gRNA sequence
tcaagagtgcccaggtagga

SEQ ID NO: 180023 - DNA, 20 bp, Artificial
  CRISPR gRNA sequence
cccggtggacctatctgcca

SEQ ID NO: 180024 - DNA, 20 bp, Artificial
  CRISPR gRNA sequence
cctctcaaaccctgaagcca

SEQ ID NO: 180025 - DNA, 20 bp, Artificial
  CRISPR gRNA sequence
aactgccttcctagtgtccc

SEQ ID NO: 180026 - DNA, 20 bp, Artificial
  CRISPR gRNA sequence
agaagccacaggtcaaggtt

SEQ ID NO: 180027 - DNA, 20 bp, Artificial
  CRISPR gRNA sequence
aggtcaaggttgtgtgcttt

SEQ ID NO: 180028 - DNA, 20 bp, Artificial
  CRISPR gRNA sequence
acatgactgtcgagggagaa

SEQ ID NO: 180029 - DNA, 20 bp, Artificial
  CRISPR gRNA sequence
ccacaggtgaccaaaggcct

SEQ ID NO: 180030 - DNA, 20 bp, Artificial
  CRISPR gRNA sequence
tccttctaccctccctccct

SEQ ID NO: 180031 - DNA, 20 bp, Artificial
  CRISPR gRNA sequence
ttgggatctggctccttttc

SEQ ID NO: 180032 - DNA, 20 bp, Artificial
  CRISPR gRNA sequence
ccctgggccttctcaaatgc

SEQ ID NO: 180033 - DNA, 20 bp, Artificial
  CRISPR gRNA sequence
ggccttctcaaatgcccagg

SEQ ID NO: 180034 - DNA, 20 bp, Artificial
  CRISPR gRNA sequence
aaaggaggccaccaaccaca

SEQ ID NO: 180035 - DNA, 20 bp, Artificial
  CRISPR gRNA sequence
acctgggtctctttcagtgc

SEQ ID NO: 180036 - DNA, 20 bp, Artificial
  CRISPR gRNA sequence
ctttcagtgccctggcttac

SEQ ID NO: 180037 - DNA, 20 bp, Artificial
  CRISPR gRNA sequence
ggcttacagctgcttttcac

SEQ ID NO: 180038 - DNA, 20 bp, Artificial
  CRISPR gRNA sequence
agccacacactttctaagat

SEQ ID NO: 180039 - DNA, 20 bp, Artificial
  CRISPR gRNA sequence
tgcctcctcttgtctctacc

SEQ ID NO: 180040 - DNA, 20 bp, Artificial
  CRISPR gRNA sequence
catccttgttgatgtcccag

SEQ ID NO: 180041 - DNA, 20 bp, Artificial
  CRISPR gRNA sequence
tgtcccagccatgcttggca

SEQ ID NO: 180042 - DNA, 20 bp, Artificial
  CRISPR gRNA sequence
tccccttttttcccctgaca

SEQ ID NO: 180043 - DNA, 20 bp, Artificial
  CRISPR gRNA sequence
gcttggacacccatcttgag

SEQ ID NO: 180044 - DNA, 20 bp, Artificial
  CRISPR gRNA sequence
tggatctctcaggagggaca

SEQ ID NO: 180045 - DNA, 20 bp, Artificial
  CRISPR gRNA sequence
agggcaccctcccccaaagc

SEQ ID NO: 180046 - DNA, 20 bp, Artificial
  CRISPR gRNA sequence
gccctggttttgaagctctg

SEQ ID NO: 180047 - DNA, 20 bp, Artificial
  CRISPR gRNA sequence
gaagctctgggatgtttctc

SEQ ID NO: 180048 - DNA, 20 bp, Artificial
  CRISPR gRNA sequence
gtcactgtatctctttgccc

SEQ ID NO: 180049 - DNA, 20 bp, Artificial
  CRISPR gRNA sequence
aaacatatccaacaaaattt

SEQ ID NO: 180050 - DNA, 20 bp, Artificial
  CRISPR gRNA sequence
atatcacttatggttaacag

SEQ ID NO: 180051 - DNA, 20 bp, Artificial
  CRISPR gRNA sequence
cagaccgttcaagttcaaat

SEQ ID NO: 180052 - DNA, 20 bp, Artificial
  CRISPR gRNA sequence
tatgatctacctctcagtgc

SEQ ID NO: 180053 - DNA, 20 bp, Artificial
  CRISPR gRNA sequence
tctaacccacaggactactg

SEQ ID NO: 180054 - DNA, 20 bp, Artificial
  CRISPR gRNA sequence
ttgccccaagtgcaccagct

SEQ ID NO: 180055 - DNA, 20 bp, Artificial
  CRISPR gRNA sequence
cttgggccagagtgactggt

SEQ ID NO: 180056 - DNA, 20 bp, Artificial
  CRISPR gRNA sequence
gagtgactggtgcaagatta

SEQ ID NO: 180057 - DNA, 20 bp, Artificial
  CRISPR gRNA sequence
tttgtcctctgctaagccag

SEQ ID NO: 180058 - DNA, 20 bp, Artificial
  CRISPR gRNA sequence
cacttctcagtcttctattt

SEQ ID NO: 180059 - DNA, 20 bp, Artificial
  CRISPR gRNA sequence
ggagccctgcagagtgctgt

SEQ ID NO: 180060 - DNA, 20 bp, Artificial
  CRISPR gRNA sequence
gctgtgtatgtttgtaaggg

SEQ ID NO: 180061 - DNA, 20 bp, Artificial
  CRISPR gRNA sequence
caggacccactgggagaaac

SEQ ID NO: 180062 - DNA, 20 bp, Artificial
  CRISPR gRNA sequence
ttccctttttgagctgcatc

SEQ ID NO: 180063 - DNA, 20 bp, Artificial
  CRISPR gRNA sequence
tttattaatccagatgagcc

SEQ ID NO: 180064 - DNA, 20 bp, Artificial
  CRISPR gRNA sequence
tttttcagcatcttaggcaa

SEQ ID NO: 180065 - DNA, 20 bp, Artificial
  CRISPR gRNA sequence
gaggagacaggcatgcaagt

SEQ ID NO: 180066 - DNA, 20 bp, Artificial
  CRISPR gRNA sequence
caggcatgcaagtgatggct

SEQ ID NO: 180067 - DNA, 20 bp, Artificial
  CRISPR gRNA sequence
tttgggaagggagggacttc

SEQ ID NO: 180068 - DNA, 20 bp, Artificial
  CRISPR gRNA sequence
caggacgctaacccttccgg

SEQ ID NO: 180069 - DNA, 20 bp, Artificial
  CRISPR gRNA sequence
cttcccgcagtctccgtagg

SEQ ID NO: 180070 - DNA, 20 bp, Artificial
  CRISPR gRNA sequence
gcgccggcgagtctccagcc

SEQ ID NO: 180071 - DNA, 20 bp, Artificial
  CRISPR gRNA sequence
cgtactcacctctgctgcag

SEQ ID NO: 180072 - DNA, 20 bp, Artificial
  CRISPR gRNA sequence
ccgagcaatccaaacactta

SEQ ID NO: 180073 - DNA, 20 bp, Artificial
  CRISPR gRNA sequence
cagggctggggaatcccgct

SEQ ID NO: 180074 - DNA, 20 bp, Artificial
  CRISPR gRNA sequence
ctggggaatcccgctaagtg

SEQ ID NO: 180075 - DNA, 20 bp, Artificial
  CRISPR gRNA sequence
ggacgaggctgccggcgccc

SEQ ID NO: 180076 - DNA, 20 bp, Artificial
  CRISPR gRNA sequence
acgcgtgggcgcccagtgct

SEQ ID NO: 180077 - DNA, 20 bp, Artificial
  CRISPR gRNA sequence
cccagctccgcgcccaggcg

SEQ ID NO: 180078 - DNA, 20 bp, Artificial
  CRISPR gRNA sequence
tccctgtgctggtggcaagg

SEQ ID NO: 180079 - DNA, 20 bp, Artificial
  CRISPR gRNA sequence
tggctgtcaggaaggcgtag

SEQ ID NO: 180080 - DNA, 20 bp, Artificial
  CRISPR gRNA sequence
aaagaagtccctcccttccc

SEQ ID NO: 180081 - DNA, 20 bp, Artificial
  CRISPR gRNA sequence
gatgctgaaaaaatttggag

SEQ ID NO: 180082 - DNA, 20 bp, Artificial
  CRISPR gRNA sequence
tcactgcccaggtactgttc

SEQ ID NO: 180083 - DNA, 20 bp, Artificial
  CRISPR gRNA sequence
catgagaccctggctagaga

SEQ ID NO: 180084 - DNA, 20 bp, Artificial
  CRISPR gRNA sequence
caaccaaatcccggggctca

SEQ ID NO: 180085 - DNA, 20 bp, Artificial
  CRISPR gRNA sequence
aataaagtgagtgtaactct

SEQ ID NO: 180086 - DNA, 20 bp, Artificial
  CRISPR gRNA sequence
aactctttgggttttcctgc

SEQ ID NO: 180087 - DNA, 20 bp, Artificial
  CRISPR gRNA sequence
ccatgtacttctggagggac

SEQ ID NO: 180088 - DNA, 20 bp, Artificial
  CRISPR gRNA sequence
gaagtgataacgggacaagc

SEQ ID NO: 180089 - DNA, 20 bp, Artificial
  CRISPR gRNA sequence
ggcacccacctgaaggcact

SEQ ID NO: 180090 - DNA, 20 bp, Artificial
  CRISPR gRNA sequence
tgctgctgggcagaaacgtg

SEQ ID NO: 180091 - DNA, 20 bp, Artificial
  CRISPR gRNA sequence
atagtattcataataatagc

SEQ ID NO: 180092 - DNA, 20 bp, Artificial
  CRISPR gRNA sequence
tcacacaaaaagtgatgaag

SEQ ID NO: 180093 - DNA, 20 bp, Artificial
  CRISPR gRNA sequence
cactgtgtccctacacatcc

SEQ ID NO: 180094 - DNA, 20 bp, Artificial
  CRISPR gRNA sequence
aatcctcaaaattttgttgg

SEQ ID NO: 180095 - DNA, 20 bp, Artificial
  CRISPR gRNA sequence
agaagttcttacttccatgt

SEQ ID NO: 180096 - DNA, 20 bp, Artificial
  CRISPR gRNA sequence
caagccagagagaaacatcc

SEQ ID NO: 180097 - DNA, 20 bp, Artificial
  CRISPR gRNA sequence
acatcccagagcttcaaaac

SEQ ID NO: 180098 - DNA, 20 bp, Artificial
  CRISPR gRNA sequence
ctcctgagagatccagagtg

SEQ ID NO: 180099 - DNA, 20 bp, Artificial
  CRISPR gRNA sequence
gctgggacatcaacaaggat

SEQ ID NO: 180100 - DNA, 20 bp, Artificial
  CRISPR gRNA sequence
aagaggggctggtggcagac

SEQ ID NO: 180101 - DNA, 20 bp, Artificial
  CRISPR gRNA sequence
agccaagatcttagaaagtg

SEQ ID NO: 180102 - DNA, 20 bp, Artificial
  CRISPR gRNA sequence
ttagaaagtgtgtggcttca

SEQ ID NO: 180103 - DNA, 20 bp, Artificial
  CRISPR gRNA sequence
ctttggggatatggggactc

SEQ ID NO: 180104 - DNA, 20 bp, Artificial
  CRISPR gRNA sequence
ccttcactgaggcccgctag

SEQ ID NO: 180105 - DNA, 20 bp, Artificial
  CRISPR gRNA sequence
gagtgtcaccgggagtacct

SEQ ID NO: 180106 - DNA, 20 bp, Artificial
  CRISPR gRNA sequence
ctcagctgtgcgagtgtacc

SEQ ID NO: 180107 - DNA, 20 bp, Artificial
  CRISPR gRNA sequence
ctaaggtgggcctgggccta

SEQ ID NO: 180108 - DNA, 20 bp, Artificial
  CRISPR gRNA sequence
tttctccctcgacagtcatg

SEQ ID NO: 180109 - DNA, 20 bp, Artificial
  CRISPR gRNA sequence
gaaagcacacaaccttgacc

SEQ ID NO: 180110 - DNA, 20 bp, Artificial
  CRISPR gRNA sequence
gtgctcctggggcctggcct

SEQ ID NO: 180111 - DNA, 20 bp, Artificial
  CRISPR gRNA sequence
ttgactgtctgggtcctgtg

SEQ ID NO: 180112 - DNA, 20 bp, Artificial
  CRISPR gRNA sequence
cagaactccacctggcactg

SEQ ID NO: 180113 - DNA, 20 bp, Artificial
  CRISPR gRNA sequence
agggtaggggtgggaagcgg

SEQ ID NO: 180114 - DNA, 20 bp, Artificial
  CRISPR gRNA sequence
ggtgggaagcggcgtggctt

SEQ ID NO: 180115 - DNA, 20 bp, Artificial
  CRISPR gRNA sequence
ggctgactgccagccaacct

SEQ ID NO: 180116 - DNA, 20 bp, Artificial
  CRISPR gRNA sequence
tacctgggcactcttgaagt

SEQ ID NO: 180117 - DNA, 20 bp, Artificial
  CRISPR gRNA sequence
cagtgaggagagagaaccag

SEQ ID NO: 180118 - DNA, 20 bp, Artificial
  CRISPR gRNA sequence
ggtagctgctgttgtcacct

SEQ ID NO: 180119 - DNA, 20 bp, Artificial
  CRISPR gRNA sequence
tcccacaagtgccacattca

SEQ ID NO: 180120 - DNA, 20 bp, Artificial
  CRISPR gRNA sequence
gctagttcgggaaatgcaca

SEQ ID NO: 180121 - DNA, 20 bp, Artificial
  CRISPR gRNA sequence
ttaggatccgttaatatgat

SEQ ID NO: 180122 - DNA, 20 bp, Artificial
  CRISPR gRNA sequence
aaaagttagcaaattatcct

SEQ ID NO: 180123 - DNA, 20 bp, Artificial
  CRISPR gRNA sequence
attatcctccaggttttttt

SEQ ID NO: 180124 - DNA, 20 bp, Artificial
  CRISPR gRNA sequence
ctccaggtttttttttctgc

SEQ ID NO: 180125 - DNA, 20 bp, Artificial
  CRISPR gRNA sequence
gcttcagttttgaaagtgaa

SEQ ID NO: 180126 - DNA, 20 bp, Artificial
  CRISPR gRNA sequence
tgggtggatcacctgaggtc

SEQ ID NO: 180127 - DNA, 20 bp, Artificial
  CRISPR gRNA sequence
tctgaaggctgaggcaggag

SEQ ID NO: 180128 - DNA, 20 bp, Artificial
  CRISPR gRNA sequence
gaggcggaggttgcagtgag

SEQ ID NO: 180129 - DNA, 20 bp, Artificial
  CRISPR gRNA sequence
agcaaaactccatttcaaaa

SEQ ID NO: 180130 - DNA, 20 bp, Artificial
  CRISPR gRNA sequence
catggatgtcgttccttatc

SEQ ID NO: 180131 - DNA, 20 bp, Artificial
  CRISPR gRNA sequence
tagcttttctagtcatcttt

SEQ ID NO: 180132 - DNA, 20 bp, Artificial
  CRISPR gRNA sequence
tcttgatttattatgctaac

SEQ ID NO: 180133 - DNA, 20 bp, Artificial
  CRISPR gRNA sequence
agtgcacttctgcatcctat

SEQ ID NO: 180134 - DNA, 20 bp, Artificial
  CRISPR gRNA sequence
gtaagaaggccctggatcct

SEQ ID NO: 180135 - DNA, 20 bp, Artificial
  CRISPR gRNA sequence
gagaaccacgtagggatgga

SEQ ID NO: 180136 - DNA, 20 bp, Artificial
  CRISPR gRNA sequence
tagctacggctgccatgcct

SEQ ID NO: 180137 - DNA, 20 bp, Artificial
  CRISPR gRNA sequence
aggtttgcctgaagctgagt

SEQ ID NO: 180138 - DNA, 20 bp, Artificial
  CRISPR gRNA sequence
agggcctggcaggccagtgt

SEQ ID NO: 180139 - DNA, 20 bp, Artificial
  CRISPR gRNA sequence
gacttggacaggagtcagtg

SEQ ID NO: 180140 - DNA, 20 bp, Artificial
  CRISPR gRNA sequence
cagaggagctctaccctgct

SEQ ID NO: 180141 - DNA, 20 bp, Artificial
  CRISPR gRNA sequence
cctgctccctgctttggctg

SEQ ID NO: 180142 - DNA, 20 bp, Artificial
  CRISPR gRNA sequence
ttgtctttttataaaaagta

SEQ ID NO: 180143 - DNA, 20 bp, Artificial
  CRISPR gRNA sequence
tagagagaaatttaacttgt

SEQ ID NO: 180144 - DNA, 20 bp, Artificial
  CRISPR gRNA sequence
aattagctgggcgtggttgc

SEQ ID NO: 180145 - DNA, 20 bp, Artificial
  CRISPR gRNA sequence
tcaggaggctgaggcaagag

SEQ ID NO: 180146 - DNA, 20 bp, Artificial
  CRISPR gRNA sequence
cctttcatttggccgggcat

SEQ ID NO: 180147 - DNA, 20 bp, Artificial
  CRISPR gRNA sequence
tgggcagatcacctgaggtc

SEQ ID NO: 180148 - DNA, 20 bp, Artificial
  CRISPR gRNA sequence
aatggcatgaaccccggagg

SEQ ID NO: 180149 - DNA, 20 bp, Artificial
  CRISPR gRNA sequence
gaggcagagcttgcagtgag

SEQ ID NO: 180150 - DNA, 20 bp, Artificial
  CRISPR gRNA sequence
tctcaaaaaaaaaaaaatcc

SEQ ID NO: 180151 - DNA, 20 bp, Artificial
  CRISPR gRNA sequence
gggacattcctgtcatagga

SEQ ID NO: 180152 - DNA, 20 bp, Artificial
  CRISPR gRNA sequence
tgactatcaccagggctgtc

SEQ ID NO: 180153 - DNA, 20 bp, Artificial
  CRISPR gRNA sequence
ctcctggggcccaaggagtg

SEQ ID NO: 180154 - DNA, 20 bp, Artificial
  CRISPR gRNA sequence
gtgctgggtagcacttgcca

SEQ ID NO: 180155 - DNA, 20 bp, Artificial
  CRISPR gRNA sequence
tgggggcagatctgagggag

SEQ ID NO: 180156 - DNA, 20 bp, Artificial
  CRISPR gRNA sequence
agacagagcatttcatcact

SEQ ID NO: 180157 - DNA, 20 bp, Artificial
  CRISPR gRNA sequence
actccttgggccccaggagc

SEQ ID NO: 180158 - DNA, 20 bp, Artificial
  CRISPR gRNA sequence
agctaatttttgcattttta

SEQ ID NO: 180159 - DNA, 20 bp, Artificial
  CRISPR gRNA sequence
atgttagtgtacacctctga

SEQ ID NO: 180160 - DNA, 20 bp, Artificial
  CRISPR gRNA sequence
gcagggccagctttacacca

SEQ ID NO: 180161 - DNA, 20 bp, Artificial
  CRISPR gRNA sequence
aagggcccgggagggaggag

SEQ ID NO: 180162 - DNA, 20 bp, Artificial
  CRISPR gRNA sequence
caaaggttagcataataaat

SEQ ID NO: 180163 - DNA, 20 bp, Artificial
  CRISPR gRNA sequence
aataaatcaagaaaagatga

SEQ ID NO: 180164 - DNA, 20 bp, Artificial
  CRISPR gRNA sequence
tattcactttcaaaactgaa

SEQ ID NO: 180165 - DNA, 20 bp, Artificial
  CRISPR gRNA sequence
cactggttctctctcctcac

SEQ ID NO: 180166 - DNA, 20 bp, Artificial
  CRISPR gRNA sequence
gtgccagcaccatgcctcca

SEQ ID NO: 180167 - DNA, 20 bp, Artificial
  CRISPR gRNA sequence
atccccacatgactgtcgag

SEQ ID NO: 180168 - DNA, 20 bp, Artificial
  CRISPR gRNA sequence
ttgtatcggcctagagggca

SEQ ID NO: 180169 - DNA, 20 bp, Artificial
  CRISPR gRNA sequence
ccaagggccttggtcaacac

SEQ ID NO: 180170 - DNA, 20 bp, Artificial
  CRISPR gRNA sequence
aagatcttggcttttccctt

SEQ ID NO: 180171 - DNA, 20 bp, Artificial
  CRISPR gRNA sequence
gagatgatcgactctcttct

SEQ ID NO: 180172 - DNA, 20 bp, Artificial
  CRISPR gRNA sequence
cctgcccagccagacaggtc

SEQ ID NO: 180173 - DNA, 20 bp, Artificial
  CRISPR gRNA sequence
ggaagtaagaacttcttcca

SEQ ID NO: 180174 - DNA, 20 bp, Artificial
  CRISPR gRNA sequence
cagttttctcttctcggaaa

SEQ ID NO: 180175 - DNA, 20 bp, Artificial
  CRISPR gRNA sequence
cctgcatgcaggacccactg

SEQ ID NO: 180176 - DNA, 20 bp, Artificial
  CRISPR gRNA sequence
cttcttttgcttgatgccaa

SEQ ID NO: 180177 - DNA, 20 bp, Artificial
  CRISPR gRNA sequence
gctgtggctgtcaggaaggc

SEQ ID NO: 180178 - DNA, 20 bp, Artificial
  CRISPR gRNA sequence
tgagaagtggatgctgctgg

SEQ ID NO: 180179 - DNA, 20 bp, Artificial
  CRISPR gRNA sequence
ttgaacttgaacggtctgac

SEQ ID NO: 180180 - DNA, 20 bp, Artificial
  CRISPR gRNA sequence
atgttttctcatttccgaga

SEQ ID NO: 180181 - DNA, 20 bp, Artificial
  CRISPR gRNA sequence
tgtgggtgcttacaagccag

SEQ ID NO: 180182 - DNA, 20 bp, Artificial
  CRISPR gRNA sequence
tgagctccctgagacaacat

SEQ ID NO: 180183 - DNA, 20 bp, Artificial
  CRISPR gRNA sequence
caaagggaaaagccaagatc

SEQ ID NO: 180184 - DNA, 20 bp, Artificial
  CRISPR gRNA sequence
tccacctctcaccaagaacc

SEQ ID NO: 180185 - DNA, 20 bp, Artificial
  CRISPR gRNA sequence
gctgacagcccgtctgcccc

SEQ ID NO: 180186 - DNA, 20 bp, Artificial
  CRISPR gRNA sequence
acagcccgtctgccccacag

SEQ ID NO: 180187 - DNA, 20 bp, Artificial
  CRISPR gRNA sequence
gtgggccagggtgagcagtg

SEQ ID NO: 180188 - DNA, 20 bp, Artificial
  CRISPR gRNA sequence
gcgctcgatgtcttgcaaac

SEQ ID NO: 180189 - DNA, 20 bp, Artificial
  CRISPR gRNA sequence
cctgtgaagggcttcctgag

SEQ ID NO: 180190 - DNA, 20 bp, Artificial
  CRISPR gRNA sequence
tgtcagagagacagagagac

SEQ ID NO: 180191 - DNA, 20 bp, Artificial
  CRISPR gRNA sequence
gttaatatgatgatggcttt

SEQ ID NO: 180192 - DNA, 20 bp, Artificial
  CRISPR gRNA sequence
ctactctgaaggctgaggca

SEQ ID NO: 180193 - DNA, 20 bp, Artificial
  CRISPR gRNA sequence
actttagctgtaaggaggag

SEQ ID NO: 180194 - DNA, 20 bp, Artificial
  CRISPR gRNA sequence
agggagaaccacgtagggat

SEQ ID NO: 180195 - DNA, 20 bp, Artificial
  CRISPR gRNA sequence
aggggaacagaccagtgacc

SEQ ID NO: 180196 - DNA, 20 bp, Artificial
  CRISPR gRNA sequence
ccagggctggctctgcacta

SEQ ID NO: 180197 - DNA, 20 bp, Artificial
  CRISPR gRNA sequence
aaggggtgtggcctttttag

SEQ ID NO: 180198 - DNA, 20 bp, Artificial
  CRISPR gRNA sequence
ctactcaggaggctgaggca

SEQ ID NO: 180199 - DNA, 20 bp, Artificial
  CRISPR gRNA sequence
ctactcgggaggctgaggca

SEQ ID NO: 180200 - DNA, 20 bp, Artificial
  CRISPR gRNA sequence
ctactgtggaggctgaagca

SEQ ID NO: 180201 - DNA, 20 bp, Artificial
  CRISPR gRNA sequence
agacagaacagtcagcagcc

SEQ ID NO: 180202 - DNA, 20 bp, Artificial
  CRISPR gRNA sequence
atcacctatggcacatgcct

SEQ ID NO: 180203 - DNA, 20 bp, Artificial
  CRISPR gRNA sequence
ggccagctttacaccacaag

SEQ ID NO: 180204 - DNA, 20 bp, Artificial
  CRISPR gRNA sequence
tagtaagagggaatgtggct

SEQ ID NO: 180205 - DNA, 20 bp, Artificial
  CRISPR gRNA sequence
agctggcgtacaactactgc

SEQ ID NO: 180206 - DNA, 20 bp, Artificial
  CRISPR gRNA sequence
gagccactgcccccggctgc

SEQ ID NO: 180207 - DNA, 20 bp, Artificial
  CRISPR gRNA sequence
gcaaaaactatattcacttt

SEQ ID NO: 180208 - DNA, 20 bp, Artificial
  CRISPR gRNA sequence
ttcaaaactgaagcagaaaa

SEQ ID NO: 180209 - DNA, 20 bp, Artificial
  CRISPR gRNA sequence
ttttctcttctcggaaatga

SEQ ID NO: 180210 - DNA, 20 bp, Artificial
  CRISPR gRNA sequence
ccaacaaaattttgaggatt

SEQ ID NO: 180211 - DNA, 20 bp, Artificial
  CRISPR gRNA sequence
ccctccagaagtacatgggt

SEQ ID NO: 180212 - DNA, 20 bp, Artificial
  CRISPR gRNA sequence
atgggttaaaacagtggcag

SEQ ID NO: 180213 - DNA, 20 bp, Artificial
  CRISPR gRNA sequence
ggaggggagctgcgctggaa

SEQ ID NO: 180214 - DNA, 20 bp, Artificial
  CRISPR gRNA sequence
tgccaccagcacagggagcc

SEQ ID NO: 180215 - DNA, 20 bp, Artificial
  CRISPR gRNA sequence
ttttctcatttccgagaaga

SEQ ID NO: 180216 - DNA, 20 bp, Artificial
  CRISPR gRNA sequence
agagaaacatcccagagctt

SEQ ID NO: 180217 - DNA, 20 bp, Artificial
  CRISPR gRNA sequence
tccagcctgggcaacaagag

SEQ ID NO: 180218 - DNA, 20 bp, Artificial
  CRISPR gRNA sequence
ttggctgaggggcttgggaa

SEQ ID NO: 180219 - DNA, 20 bp, Artificial
  CRISPR gRNA sequence
ccaaaaaaaaaaaaaaaaaa

SEQ ID NO: 180220 - DNA, 20 bp, Artificial
  CRISPR gRNA sequence
ccactactcaaacccctctc

SEQ ID NO: 180221 - DNA, 20 bp, Artificial
  CRISPR gRNA sequence
ctcaaacccctctccctcag

SEQ ID NO: 180222 - DNA, 20 bp, Artificial
  CRISPR gRNA sequence
aaacccctctccctcagatc

SEQ ID NO: 180223 - DNA, 20 bp, Artificial
  CRISPR gRNA sequence
tccctcagatctgcccccag

SEQ ID NO: 180224 - DNA, 20 bp, Artificial
  CRISPR gRNA sequence
cctcagatctgcccccagtc

SEQ ID NO: 180225 - DNA, 20 bp, Artificial
  CRISPR gRNA sequence
agatctgcccccagtccagt

SEQ ID NO: 180226 - DNA, 20 bp, Artificial
  CRISPR gRNA sequence
cccccagtccagtatctacc

SEQ ID NO: 180227 - DNA, 20 bp, Artificial
  CRISPR gRNA sequence
cctgcactgttcaatatggt

SEQ ID NO: 180228 - DNA, 20 bp, Artificial
  CRISPR gRNA sequence
cactgttcaatatggtaacc

SEQ ID NO: 180229 - DNA, 20 bp, Artificial
  CRISPR gRNA sequence
ttcaatatggtaaccactga

SEQ ID NO: 180230 - DNA, 20 bp, Artificial
  CRISPR gRNA sequence
aatatggtaaccactgacca

SEQ ID NO: 180231 - DNA, 20 bp, Artificial
  CRISPR gRNA sequence
accacatgtgactatttaca

SEQ ID NO: 180232 - DNA, 20 bp, Artificial
  CRISPR gRNA sequence
tttacatacagtttattaaa

SEQ ID NO: 180233 - DNA, 20 bp, Artificial
  CRISPR gRNA sequence
acatacagtttattaaatgc

SEQ ID NO: 180234 - DNA, 20 bp, Artificial
  CRISPR gRNA sequence
catacagtttattaaatgca

SEQ ID NO: 180235 - DNA, 20 bp, Artificial
  CRISPR gRNA sequence
attaaatgcaattaaaagtt

SEQ ID NO: 180236 - DNA, 20 bp, Artificial
  CRISPR gRNA sequence
ttaaatgcaattaaaagttc

SEQ ID NO: 180237 - DNA, 20 bp, Artificial
  CRISPR gRNA sequence
aatgcaattaaaagttcaat

SEQ ID NO: 180238 - DNA, 20 bp, Artificial
  CRISPR gRNA sequence
aaagttcaattccttattgc

SEQ ID NO: 180239 - DNA, 20 bp, Artificial
  CRISPR gRNA sequence
aattccttattgcactggcc

SEQ ID NO: 180240 - DNA, 20 bp, Artificial
  CRISPR gRNA sequence
cttattgcactggccacatt

SEQ ID NO: 180241 - DNA, 20 bp, Artificial
  CRISPR gRNA sequence
attgcactggccacatttca

SEQ ID NO: 180242 - DNA, 20 bp, Artificial
  CRISPR gRNA sequence
ttgcactggccacatttcaa

SEQ ID NO: 180243 - DNA, 20 bp, Artificial
  CRISPR gRNA sequence
cactggccacatttcaagtg

SEQ ID NO: 180244 - DNA, 20 bp, Artificial
  CRISPR gRNA sequence
gccacatttcaagtgcttag

SEQ ID NO: 180245 - DNA, 20 bp, Artificial
  CRISPR gRNA sequence
caagtgcttagctggcacat

SEQ ID NO: 180246 - DNA, 20 bp, Artificial
  CRISPR gRNA sequence
aagtgcttagctggcacatg

SEQ ID NO: 180247 - DNA, 20 bp, Artificial
  CRISPR gRNA sequence
agctggcacatgtggctagt

SEQ ID NO: 180248 - DNA, 20 bp, Artificial
  CRISPR gRNA sequence
gctggcacatgtggctagtg

SEQ ID NO: 180249 - DNA, 20 bp, Artificial
  CRISPR gRNA sequence
gcacatgtggctagtgccag

SEQ ID NO: 180250 - DNA, 20 bp, Artificial
  CRISPR gRNA sequence
gtgccagtgcctactgtatt

SEQ ID NO: 180251 - DNA, 20 bp, Artificial
  CRISPR gRNA sequence
ctgtattgaacggtacagac

SEQ ID NO: 180252 - DNA, 20 bp, Artificial
  CRISPR gRNA sequence
tattgaacggtacagacaga

SEQ ID NO: 180253 - DNA, 20 bp, Artificial
  CRISPR gRNA sequence
aacggtacagacagagcatt

SEQ ID NO: 180254 - DNA, 20 bp, Artificial
  CRISPR gRNA sequence
catcactctagaaactggat

SEQ ID NO: 180255 - DNA, 20 bp, Artificial
  CRISPR gRNA sequence
atcactctagaaactggatg

SEQ ID NO: 180256 - DNA, 20 bp, Artificial
  CRISPR gRNA sequence
tagaaactggatggcaagtg

SEQ ID NO: 180257 - DNA, 20 bp, Artificial
  CRISPR gRNA sequence
gaaactggatggcaagtgct

SEQ ID NO: 180258 - DNA, 20 bp, Artificial
  CRISPR gRNA sequence
gatggcaagtgctacccagc

SEQ ID NO: 180259 - DNA, 20 bp, Artificial
  CRISPR gRNA sequence
cccagcacagcagccgtgag

SEQ ID NO: 180260 - DNA, 20 bp, Artificial
  CRISPR gRNA sequence
tcttgggctgctgactgttc

SEQ ID NO: 180261 - DNA, 20 bp, Artificial
  CRISPR gRNA sequence
cttgggctgctgactgttct

SEQ ID NO: 180262 - DNA, 20 bp, Artificial
  CRISPR gRNA sequence
ttgggctgctgactgttctg

SEQ ID NO: 180263 - DNA, 20 bp, Artificial
  CRISPR gRNA sequence
gggctgctgactgttctgtc

SEQ ID NO: 180264 - DNA, 20 bp, Artificial
  CRISPR gRNA sequence
ggctgctgactgttctgtct

SEQ ID NO: 180265 - DNA, 20 bp, Artificial
  CRISPR gRNA sequence
ctgactgttctgtctgtgac

SEQ ID NO: 180266 - DNA, 20 bp, Artificial
  CRISPR gRNA sequence
actgttctgtctgtgactgt

SEQ ID NO: 180267 - DNA, 20 bp, Artificial
  CRISPR gRNA sequence
ttctgtctgtgactgtgtca

SEQ ID NO: 180268 - DNA, 20 bp, Artificial
  CRISPR gRNA sequence
tgtctgtgactgtgtcatat

SEQ ID NO: 180269 - DNA, 20 bp, Artificial
  CRISPR gRNA sequence
tctgtgactgtgtcatatca

SEQ ID NO: 180270 - DNA, 20 bp, Artificial
  CRISPR gRNA sequence
tgactgtgtcatatcaactg

SEQ ID NO: 180271 - DNA, 20 bp, Artificial
  CRISPR gRNA sequence
tgtcatatcaactgactttt

SEQ ID NO: 180272 - DNA, 20 bp, Artificial
  CRISPR gRNA sequence
actttttggagcagcatctg

SEQ ID NO: 180273 - DNA, 20 bp, Artificial
  CRISPR gRNA sequence
tttggagcagcatctgtgtg

SEQ ID NO: 180274 - DNA, 20 bp, Artificial
  CRISPR gRNA sequence
ttggagcagcatctgtgtgt

SEQ ID NO: 180275 - DNA, 20 bp, Artificial
  CRISPR gRNA sequence
tggagcagcatctgtgtgtt

SEQ ID NO: 180276 - DNA, 20 bp, Artificial
  CRISPR gRNA sequence
ggagcagcatctgtgtgtta

SEQ ID NO: 180277 - DNA, 20 bp, Artificial
  CRISPR gRNA sequence
gagcagcatctgtgtgttag

SEQ ID NO: 180278 - DNA, 20 bp, Artificial
  CRISPR gRNA sequence
tgtgttagcaggacacatca

SEQ ID NO: 180279 - DNA, 20 bp, Artificial
  CRISPR gRNA sequence
gcaggacacatcacctatgg

SEQ ID NO: 180280 - DNA, 20 bp, Artificial
  CRISPR gRNA sequence
tggcacatgcctcaaaactt

SEQ ID NO: 180281 - DNA, 20 bp, Artificial
  CRISPR gRNA sequence
aaaacttaacactccttggg

SEQ ID NO: 180282 - DNA, 20 bp, Artificial
  CRISPR gRNA sequence
aacactccttgggccccagg

SEQ ID NO: 180283 - DNA, 20 bp, Artificial
  CRISPR gRNA sequence
acactccttgggccccagga

SEQ ID NO: 180284 - DNA, 20 bp, Artificial
  CRISPR gRNA sequence
cttgggccccaggagcccag

SEQ ID NO: 180285 - DNA, 20 bp, Artificial
  CRISPR gRNA sequence
gggccccaggagcccagaat

SEQ ID NO: 180286 - DNA, 20 bp, Artificial
  CRISPR gRNA sequence
ggccccaggagcccagaatc

SEQ ID NO: 180287 - DNA, 20 bp, Artificial
  CRISPR gRNA sequence
acagccctggtgatagtcaa

SEQ ID NO: 180288 - DNA, 20 bp, Artificial
  CRISPR gRNA sequence
gtgatagtcaaggacaggtg

SEQ ID NO: 180289 - DNA, 20 bp, Artificial
  CRISPR gRNA sequence
tgtttatataagcatgttcc

SEQ ID NO: 180290 - DNA, 20 bp, Artificial
  CRISPR gRNA sequence
atataagcatgttcctatga

SEQ ID NO: 180291 - DNA, 20 bp, Artificial
  CRISPR gRNA sequence
tataagcatgttcctatgac

SEQ ID NO: 180292 - DNA, 20 bp, Artificial
  CRISPR gRNA sequence
ctatgacaggaatgtcccct

SEQ ID NO: 180293 - DNA, 20 bp, Artificial
  CRISPR gRNA sequence
tgacaggaatgtcccctcct

SEQ ID NO: 180294 - DNA, 20 bp, Artificial
  CRISPR gRNA sequence
cttctgccattgtctatgtg

SEQ ID NO: 180295 - DNA, 20 bp, Artificial
  CRISPR gRNA sequence
ctgccattgtctatgtgaac

SEQ ID NO: 180296 - DNA, 20 bp, Artificial
  CRISPR gRNA sequence
tgccattgtctatgtgaaca

SEQ ID NO: 180297 - DNA, 20 bp, Artificial
  CRISPR gRNA sequence
ccattgtctatgtgaacata

SEQ ID NO: 180298 - DNA, 20 bp, Artificial
  CRISPR gRNA sequence
tctatgtgaacataaacaaa

SEQ ID NO: 180299 - DNA, 20 bp, Artificial
  CRISPR gRNA sequence
tgtgaacataaacaaaagga

SEQ ID NO: 180300 - DNA, 20 bp, Artificial
  CRISPR gRNA sequence
ttttttttttgagacaaagt

SEQ ID NO: 180301 - DNA, 20 bp, Artificial
  CRISPR gRNA sequence
tttttttttgagacaaagtc

SEQ ID NO: 180302 - DNA, 20 bp, Artificial
  CRISPR gRNA sequence
ttttttttgagacaaagtct

SEQ ID NO: 180303 - DNA, 20 bp, Artificial
  CRISPR gRNA sequence
tttttttgagacaaagtctc

SEQ ID NO: 180304 - DNA, 20 bp, Artificial
  CRISPR gRNA sequence
ttttttgagacaaagtctca

SEQ ID NO: 180305 - DNA, 20 bp, Artificial
  CRISPR gRNA sequence
tttttgagacaaagtctcac

SEQ ID NO: 180306 - DNA, 20 bp, Artificial
  CRISPR gRNA sequence
ttttgagacaaagtctcact

SEQ ID NO: 180307 - DNA, 20 bp, Artificial
  CRISPR gRNA sequence
tttgagacaaagtctcactc

SEQ ID NO: 180308 - DNA, 20 bp, Artificial
  CRISPR gRNA sequence
ttgagacaaagtctcactct

SEQ ID NO: 180309 - DNA, 20 bp, Artificial
  CRISPR gRNA sequence
tgagacaaagtctcactctt

SEQ ID NO: 180310 - DNA, 20 bp, Artificial
  CRISPR gRNA sequence
gagacaaagtctcactcttg

SEQ ID NO: 180311 - DNA, 20 bp, Artificial
  CRISPR gRNA sequence
agacaaagtctcactcttgt

SEQ ID NO: 180312 - DNA, 20 bp, Artificial
  CRISPR gRNA sequence
actcttgtcacccaggctgg

SEQ ID NO: 180313 - DNA, 20 bp, Artificial
  CRISPR gRNA sequence
ttgtcacccaggctggagtg

SEQ ID NO: 180314 - DNA, 20 bp, Artificial
  CRISPR gRNA sequence
gtcacccaggctggagtgca

SEQ ID NO: 180315 - DNA, 20 bp, Artificial
  CRISPR gRNA sequence
tcacccaggctggagtgcag

SEQ ID NO: 180316 - DNA, 20 bp, Artificial
  CRISPR gRNA sequence
gagtgcagtggcacagtctc

SEQ ID NO: 180317 - DNA, 20 bp, Artificial
  CRISPR gRNA sequence
agctcactgcaacctccatc

SEQ ID NO: 180318 - DNA, 20 bp, Artificial
  CRISPR gRNA sequence
actgcaacctccatctcccg

SEQ ID NO: 180319 - DNA, 20 bp, Artificial
  CRISPR gRNA sequence
caacctccatctcccgggtt

SEQ ID NO: 180320 - DNA, 20 bp, Artificial
  CRISPR gRNA sequence
catctcccgggttcaagtga

SEQ ID NO: 180321 - DNA, 20 bp, Artificial
  CRISPR gRNA sequence
ccgggttcaagtgattcttg

SEQ ID NO: 180322 - DNA, 20 bp, Artificial
  CRISPR gRNA sequence
aagtgattcttgtgcttcag

SEQ ID NO: 180323 - DNA, 20 bp, Artificial
  CRISPR gRNA sequence
ttgtgcttcagcctccacag

SEQ ID NO: 180324 - DNA, 20 bp, Artificial
  CRISPR gRNA sequence
gtgcttcagcctccacagta

SEQ ID NO: 180325 - DNA, 20 bp, Artificial
  CRISPR gRNA sequence
tgcttcagcctccacagtag

SEQ ID NO: 180326 - DNA, 20 bp, Artificial
  CRISPR gRNA sequence
cagcctccacagtagctggg

SEQ ID NO: 180327 - DNA, 20 bp, Artificial
  CRISPR gRNA sequence
agcctccacagtagctggga

SEQ ID NO: 180328 - DNA, 20 bp, Artificial
  CRISPR gRNA sequence
cacagtagctgggattacag

SEQ ID NO: 180329 - DNA, 20 bp, Artificial
  CRISPR gRNA sequence
ggattacaggcgcccgccac

SEQ ID NO: 180330 - DNA, 20 bp, Artificial
  CRISPR gRNA sequence
caggcgcccgccaccaggcc

SEQ ID NO: 180331 - DNA, 20 bp, Artificial
  CRISPR gRNA sequence
atttttttttttttttttga

SEQ ID NO: 180332 - DNA, 20 bp, Artificial
  CRISPR gRNA sequence
ttttttttttttttgagacg

SEQ ID NO: 180333 - DNA, 20 bp, Artificial
  CRISPR gRNA sequence
tttttttttttttgagacgg

SEQ ID NO: 180334 - DNA, 20 bp, Artificial
  CRISPR gRNA sequence
ttttttttttttgagacgga

SEQ ID NO: 180335 - DNA, 20 bp, Artificial
  CRISPR gRNA sequence
tttttttttttgagacggag

SEQ ID NO: 180336 - DNA, 20 bp, Artificial
  CRISPR gRNA sequence
ttttttttttgagacggagt

SEQ ID NO: 180337 - DNA, 20 bp, Artificial
  CRISPR gRNA sequence
tttttttttgagacggagtc

SEQ ID NO: 180338 - DNA, 20 bp, Artificial
  CRISPR gRNA sequence
ttttttttgagacggagtct

SEQ ID NO: 180339 - DNA, 20 bp, Artificial
  CRISPR gRNA sequence
tttttttgagacggagtctc

SEQ ID NO: 180340 - DNA, 20 bp, Artificial
  CRISPR gRNA sequence
ttttttgagacggagtctcg

SEQ ID NO: 180341 - DNA, 20 bp, Artificial
  CRISPR gRNA sequence
tttttgagacggagtctcgc

SEQ ID NO: 180342 - DNA, 20 bp, Artificial
  CRISPR gRNA sequence
ttttgagacggagtctcgct

SEQ ID NO: 180343 - DNA, 20 bp, Artificial
  CRISPR gRNA sequence
tttgagacggagtctcgctc

SEQ ID NO: 180344 - DNA, 20 bp, Artificial
  CRISPR gRNA sequence
ttgagacggagtctcgctct

SEQ ID NO: 180345 - DNA, 20 bp, Artificial
  CRISPR gRNA sequence
tgagacggagtctcgctctg

SEQ ID NO: 180346 - DNA, 20 bp, Artificial
  CRISPR gRNA sequence
gagacggagtctcgctctgt

SEQ ID NO: 180347 - DNA, 20 bp, Artificial
  CRISPR gRNA sequence
agacggagtctcgctctgtc

SEQ ID NO: 180348 - DNA, 20 bp, Artificial
  CRISPR gRNA sequence
gctctgtcgcccaggctgta

SEQ ID NO: 180349 - DNA, 20 bp, Artificial
  CRISPR gRNA sequence
tgtcgcccaggctgtagtgc

SEQ ID NO: 180350 - DNA, 20 bp, Artificial
  CRISPR gRNA sequence
tcgcccaggctgtagtgcag

SEQ ID NO: 180351 - DNA, 20 bp, Artificial
  CRISPR gRNA sequence
tagtgcagtggtgcaatctc

SEQ ID NO: 180352 - DNA, 20 bp, Artificial
  CRISPR gRNA sequence
ggctcactgcaagctctgcc

SEQ ID NO: 180353 - DNA, 20 bp, Artificial
  CRISPR gRNA sequence
actgcaagctctgcctccgg

SEQ ID NO: 180354 - DNA, 20 bp, Artificial
  CRISPR gRNA sequence
caagctctgcctccggggtt

SEQ ID NO: 180355 - DNA, 20 bp, Artificial
  CRISPR gRNA sequence
tgcctccggggttcatgcca

SEQ ID NO: 180356 - DNA, 20 bp, Artificial
  CRISPR gRNA sequence
cctccggggttcatgccatt

SEQ ID NO: 180357 - DNA, 20 bp, Artificial
  CRISPR gRNA sequence
cggggttcatgccattctcc

SEQ ID NO: 180358 - DNA, 20 bp, Artificial
  CRISPR gRNA sequence
atgccattctcctgcctcag

SEQ ID NO: 180359 - DNA, 20 bp, Artificial
  CRISPR gRNA sequence
tcctgcctcagcctcccgag

SEQ ID NO: 180360 - DNA, 20 bp, Artificial
  CRISPR gRNA sequence
ctgcctcagcctcccgagta

SEQ ID NO: 180361 - DNA, 20 bp, Artificial
  CRISPR gRNA sequence
cctcagcctcccgagtagct

SEQ ID NO: 180362 - DNA, 20 bp, Artificial
  CRISPR gRNA sequence
agcctcccgagtagctggga

SEQ ID NO: 180363 - DNA, 20 bp, Artificial
  CRISPR gRNA sequence
ccgagtagctgggactacag

SEQ ID NO: 180364 - DNA, 20 bp, Artificial
  CRISPR gRNA sequence
ggactacaggcacccgccac

SEQ ID NO: 180365 - DNA, 20 bp, Artificial
  CRISPR gRNA sequence
caggcacccgccactaggcc

SEQ ID NO: 180366 - DNA, 20 bp, Artificial
  CRISPR gRNA sequence
ggcccggctaattttttata

SEQ ID NO: 180367 - DNA, 20 bp, Artificial
  CRISPR gRNA sequence
attttttatatttttagtag

SEQ ID NO: 180368 - DNA, 20 bp, Artificial
  CRISPR gRNA sequence
tttatatttttagtagagac

SEQ ID NO: 180369 - DNA, 20 bp, Artificial
  CRISPR gRNA sequence
ttatatttttagtagagacg

SEQ ID NO: 180370 - DNA, 20 bp, Artificial
  CRISPR gRNA sequence
tatatttttagtagagacgg

SEQ ID NO: 180371 - DNA, 20 bp, Artificial
  CRISPR gRNA sequence
atatttttagtagagacggg

SEQ ID NO: 180372 - DNA, 20 bp, Artificial
  CRISPR gRNA sequence
tatttttagtagagacgggg

SEQ ID NO: 180373 - DNA, 20 bp, Artificial
  CRISPR gRNA sequence
ttagtagagacggggtttca

SEQ ID NO: 180374 - DNA, 20 bp, Artificial
  CRISPR gRNA sequence
tagtagagacggggtttcac

SEQ ID NO: 180375 - DNA, 20 bp, Artificial
  CRISPR gRNA sequence
agtagagacggggtttcacc

SEQ ID NO: 180376 - DNA, 20 bp, Artificial
  CRISPR gRNA sequence
gtagagacggggtttcaccg

SEQ ID NO: 180377 - DNA, 20 bp, Artificial
  CRISPR gRNA sequence
caccgtgttagccaggatgg

SEQ ID NO: 180378 - DNA, 20 bp, Artificial
  CRISPR gRNA sequence
accgtgttagccaggatggt

SEQ ID NO: 180379 - DNA, 20 bp, Artificial
  CRISPR gRNA sequence
gccaggatggtcttgatctc

SEQ ID NO: 180380 - DNA, 20 bp, Artificial
  CRISPR gRNA sequence
gatctcctgacctcgtgatc

SEQ ID NO: 180381 - DNA, 20 bp, Artificial
  CRISPR gRNA sequence
atctcctgacctcgtgatcc

SEQ ID NO: 180382 - DNA, 20 bp, Artificial
  CRISPR gRNA sequence
ctgacctcgtgatccgcccg

SEQ ID NO: 180383 - DNA, 20 bp, Artificial
  CRISPR gRNA sequence
acctcgtgatccgcccgcct

SEQ ID NO: 180384 - DNA, 20 bp, Artificial
  CRISPR gRNA sequence
gtgatccgcccgcctctgcc

SEQ ID NO: 180385 - DNA, 20 bp, Artificial
  CRISPR gRNA sequence
tgcctcccaaagtgctggga

SEQ ID NO: 180386 - DNA, 20 bp, Artificial
  CRISPR gRNA sequence
cctcccaaagtgctgggatt

SEQ ID NO: 180387 - DNA, 20 bp, Artificial
  CRISPR gRNA sequence
ccaaagtgctgggattacag

SEQ ID NO: 180388 - DNA, 20 bp, Artificial
  CRISPR gRNA sequence
ggattacaggcgtgagccac

SEQ ID NO: 180389 - DNA, 20 bp, Artificial
  CRISPR gRNA sequence
caggcgtgagccaccgtgcc

SEQ ID NO: 180390 - DNA, 20 bp, Artificial
  CRISPR gRNA sequence
atttttgtatttttagtaga

SEQ ID NO: 180391 - DNA, 20 bp, Artificial
  CRISPR gRNA sequence
ttgtatttttagtagagatg

SEQ ID NO: 180392 - DNA, 20 bp, Artificial
  CRISPR gRNA sequence
tgtatttttagtagagatga

SEQ ID NO: 180393 - DNA, 20 bp, Artificial
  CRISPR gRNA sequence
gtatttttagtagagatgag

SEQ ID NO: 180394 - DNA, 20 bp, Artificial
  CRISPR gRNA sequence
tatttttagtagagatgagg

SEQ ID NO: 180395 - DNA, 20 bp, Artificial
  CRISPR gRNA sequence
ttagtagagatgaggtttca

SEQ ID NO: 180396 - DNA, 20 bp, Artificial
  CRISPR gRNA sequence
tagtagagatgaggtttcac

SEQ ID NO: 180397 - DNA, 20 bp, Artificial
  CRISPR gRNA sequence
agtagagatgaggtttcacc

SEQ ID NO: 180398 - DNA, 20 bp, Artificial
  CRISPR gRNA sequence
gtagagatgaggtttcacca

SEQ ID NO: 180399 - DNA, 20 bp, Artificial
  CRISPR gRNA sequence
caccatgttggccaggctgg

SEQ ID NO: 180400 - DNA, 20 bp, Artificial
  CRISPR gRNA sequence
accatgttggccaggctggt

SEQ ID NO: 180401 - DNA, 20 bp, Artificial
  CRISPR gRNA sequence
gccaggctggtctcaaactc

SEQ ID NO: 180402 - DNA, 20 bp, Artificial
  CRISPR gRNA sequence
gtctcaaactcctgacctca

SEQ ID NO: 180403 - DNA, 20 bp, Artificial
  CRISPR gRNA sequence
aaactcctgacctcaggtga

SEQ ID NO: 180404 - DNA, 20 bp, Artificial
  CRISPR gRNA sequence
ctgacctcaggtgatctgcc

SEQ ID NO: 180405 - DNA, 20 bp, Artificial
  CRISPR gRNA sequence
acctcaggtgatctgcccac

SEQ ID NO: 180406 - DNA, 20 bp, Artificial
  CRISPR gRNA sequence
aggtgatctgcccaccttgg

SEQ ID NO: 180407 - DNA, 20 bp, Artificial
  CRISPR gRNA sequence
cccaccttggcctcccaaag

SEQ ID NO: 180408 - DNA, 20 bp, Artificial
  CRISPR gRNA sequence
ggcctcccaaagtgccagga

SEQ ID NO: 180409 - DNA, 20 bp, Artificial
  CRISPR gRNA sequence
gcctcccaaagtgccaggat

SEQ ID NO: 180410 - DNA, 20 bp, Artificial
  CRISPR gRNA sequence
ccaaagtgccaggattacag

SEQ ID NO: 180411 - DNA, 20 bp, Artificial
  CRISPR gRNA sequence
caggcataagccaccatgcc

SEQ ID NO: 180412 - DNA, 20 bp, Artificial
  CRISPR gRNA sequence
tttttttttttttttttttt

SEQ ID NO: 180413 - DNA, 20 bp, Artificial
  CRISPR gRNA sequence
tttttttttttttttttttg

SEQ ID NO: 180414 - DNA, 20 bp, Artificial
  CRISPR gRNA sequence
ttttttttttttttttttgg

SEQ ID NO: 180415 - DNA, 20 bp, Artificial
  CRISPR gRNA sequence
tttttttttttttttttggt

SEQ ID NO: 180416 - DNA, 20 bp, Artificial
  CRISPR gRNA sequence
ttttttttttttttttggtg

SEQ ID NO: 180417 - DNA, 20 bp, Artificial
  CRISPR gRNA sequence
tttttttttttttttggtgc

SEQ ID NO: 180418 - DNA, 20 bp, Artificial
  CRISPR gRNA sequence
ttttttttttttttggtgcc

SEQ ID NO: 180419 - DNA, 20 bp, Artificial
  CRISPR gRNA sequence
tttttttttttttggtgccc

SEQ ID NO: 180420 - DNA, 20 bp, Artificial
  CRISPR gRNA sequence
ttttttttttttggtgcccg

SEQ ID NO: 180421 - DNA, 20 bp, Artificial
  CRISPR gRNA sequence
tttttttttttggtgcccgg

SEQ ID NO: 180422 - DNA, 20 bp, Artificial
  CRISPR gRNA sequence
ttttttttttggtgcccggg

SEQ ID NO: 180423 - DNA, 20 bp, Artificial
  CRISPR gRNA sequence
tttttttttggtgcccgggc

SEQ ID NO: 180424 - DNA, 20 bp, Artificial
  CRISPR gRNA sequence
ttttttttggtgcccgggct

SEQ ID NO: 180425 - DNA, 20 bp, Artificial
  CRISPR gRNA sequence
tttttttggtgcccgggctg

SEQ ID NO: 180426 - DNA, 20 bp, Artificial
  CRISPR gRNA sequence
ttttttggtgcccgggctgg

SEQ ID NO: 180427 - DNA, 20 bp, Artificial
  CRISPR gRNA sequence
tttttggtgcccgggctgga

SEQ ID NO: 180428 - DNA, 20 bp, Artificial
  CRISPR gRNA sequence
ttttggtgcccgggctggag

SEQ ID NO: 180429 - DNA, 20 bp, Artificial
  CRISPR gRNA sequence
tttggtgcccgggctggagt

SEQ ID NO: 180430 - DNA, 20 bp, Artificial
  CRISPR gRNA sequence
ttggtgcccgggctggagtg

SEQ ID NO: 180431 - DNA, 20 bp, Artificial
  CRISPR gRNA sequence
tggtgcccgggctggagtgc

SEQ ID NO: 180432 - DNA, 20 bp, Artificial
  CRISPR gRNA sequence
ggtgcccgggctggagtgca

SEQ ID NO: 180433 - DNA, 20 bp, Artificial
  CRISPR gRNA sequence
gtgcccgggctggagtgcaa

SEQ ID NO: 180434 - DNA, 20 bp, Artificial
  CRISPR gRNA sequence
gagtgcaatggcatgttctc

SEQ ID NO: 180435 - DNA, 20 bp, Artificial
  CRISPR gRNA sequence
tcggctcactgcaacctcca

SEQ ID NO: 180436 - DNA, 20 bp, Artificial
  CRISPR gRNA sequence
ggctcactgcaacctccacc

SEQ ID NO: 180437 - DNA, 20 bp, Artificial
  CRISPR gRNA sequence
actgcaacctccacctccca

SEQ ID NO: 180438 - DNA, 20 bp, Artificial
  CRISPR gRNA sequence
caacctccacctcccaggtt

SEQ ID NO: 180439 - DNA, 20 bp, Artificial
  CRISPR gRNA sequence
cacctcccaggttcaagcga

SEQ ID NO: 180440 - DNA, 20 bp, Artificial
  CRISPR gRNA sequence
ccaggttcaagcgattctct

SEQ ID NO: 180441 - DNA, 20 bp, Artificial
  CRISPR gRNA sequence
aagcgattctcttgcctcag

SEQ ID NO: 180442 - DNA, 20 bp, Artificial
  CRISPR gRNA sequence
tcttgcctcagcctcctgag

SEQ ID NO: 180443 - DNA, 20 bp, Artificial
  CRISPR gRNA sequence
ttgcctcagcctcctgagta

SEQ ID NO: 180444 - DNA, 20 bp, Artificial
  CRISPR gRNA sequence
gcctcagcctcctgagtagc

SEQ ID NO: 180445 - DNA, 20 bp, Artificial
  CRISPR gRNA sequence
cctcagcctcctgagtagct

SEQ ID NO: 180446 - DNA, 20 bp, Artificial
  CRISPR gRNA sequence
agcctcctgagtagctggga

SEQ ID NO: 180447 - DNA, 20 bp, Artificial
  CRISPR gRNA sequence
ctgagtagctgggattacaa

SEQ ID NO: 180448 - DNA, 20 bp, Artificial
  CRISPR gRNA sequence
agtagctgggattacaagca

SEQ ID NO: 180449 - DNA, 20 bp, Artificial
  CRISPR gRNA sequence
ggattacaagcacccgcaac

SEQ ID NO: 180450 - DNA, 20 bp, Artificial
  CRISPR gRNA sequence
caagcacccgcaaccacgcc

SEQ ID NO: 180451 - DNA, 20 bp, Artificial
  CRISPR gRNA sequence
atttttgcatttttagtaga

SEQ ID NO: 180452 - DNA, 20 bp, Artificial
  CRISPR gRNA sequence
ttgcatttttagtagaaatg

SEQ ID NO: 180453 - DNA, 20 bp, Artificial
  CRISPR gRNA sequence
tgcatttttagtagaaatgg

SEQ ID NO: 180454 - DNA, 20 bp, Artificial
  CRISPR gRNA sequence
gcatttttagtagaaatgga

SEQ ID NO: 180455 - DNA, 20 bp, Artificial
  CRISPR gRNA sequence
catttttagtagaaatggag

SEQ ID NO: 180456 - DNA, 20 bp, Artificial
  CRISPR gRNA sequence
ttagtagaaatggagtttca

SEQ ID NO: 180457 - DNA, 20 bp, Artificial
  CRISPR gRNA sequence
tagtagaaatggagtttcac

SEQ ID NO: 180458 - DNA, 20 bp, Artificial
  CRISPR gRNA sequence
agtagaaatggagtttcacc

SEQ ID NO: 180459 - DNA, 20 bp, Artificial
  CRISPR gRNA sequence
gtagaaatggagtttcacca

SEQ ID NO: 180460 - DNA, 20 bp, Artificial
  CRISPR gRNA sequence
caccaggctggtctcgaact

SEQ ID NO: 180461 - DNA, 20 bp, Artificial
  CRISPR gRNA sequence
accaggctggtctcgaactc

SEQ ID NO: 180462 - DNA, 20 bp, Artificial
  CRISPR gRNA sequence
gtctcgaactcctgacctca

SEQ ID NO: 180463 - DNA, 20 bp, Artificial
  CRISPR gRNA sequence
gaactcctgacctcaggtga

SEQ ID NO: 180464 - DNA, 20 bp, Artificial
  CRISPR gRNA sequence
ctgacctcaggtgatccacc

SEQ ID NO: 180465 - DNA, 20 bp, Artificial
  CRISPR gRNA sequence
acctcaggtgatccacccat

SEQ ID NO: 180466 - DNA, 20 bp, Artificial
  CRISPR gRNA sequence
aggtgatccacccatctcgg

SEQ ID NO: 180467 - DNA, 20 bp, Artificial
  CRISPR gRNA sequence
ggcctcccaaagtgctggga

SEQ ID NO: 180468 - DNA, 20 bp, Artificial
  CRISPR gRNA sequence
ccaaagtgctgggattacag

SEQ ID NO: 180469 - DNA, 20 bp, Artificial
  CRISPR gRNA sequence
ggattacaggtgtgagccac

SEQ ID NO: 180470 - DNA, 20 bp, Artificial
  CRISPR gRNA sequence
caggtgtgagccaccgcgcc

SEQ ID NO: 180471 - DNA, 20 bp, Artificial
  CRISPR gRNA sequence
gccgaaaggattttataata

SEQ ID NO: 180472 - DNA, 20 bp, Artificial
  CRISPR gRNA sequence
tataatagatgcatgtccct

SEQ ID NO: 180473 - DNA, 20 bp, Artificial
  CRISPR gRNA sequence
ataatagatgcatgtccctg

SEQ ID NO: 180474 - DNA, 20 bp, Artificial
  CRISPR gRNA sequence
taatagatgcatgtccctgt

SEQ ID NO: 180475 - DNA, 20 bp, Artificial
  CRISPR gRNA sequence
ttcaccccaaagtcaagttc

SEQ ID NO: 180476 - DNA, 20 bp, Artificial
  CRISPR gRNA sequence
accccaaagtcaagttcagg

SEQ ID NO: 180477 - DNA, 20 bp, Artificial
  CRISPR gRNA sequence
aggcgggatgccaataataa

SEQ ID NO: 180478 - DNA, 20 bp, Artificial
  CRISPR gRNA sequence
ccataaaaagtaaaatcatc

SEQ ID NO: 180479 - DNA, 20 bp, Artificial
  CRISPR gRNA sequence
cataaaaagtaaaatcatct

SEQ ID NO: 180480 - DNA, 20 bp, Artificial
  CRISPR gRNA sequence
caagttaaatttctctctaa

SEQ ID NO: 180481 - DNA, 20 bp, Artificial
  CRISPR gRNA sequence
aatttctctctaaaaaggcc

SEQ ID NO: 180482 - DNA, 20 bp, Artificial
  CRISPR gRNA sequence
ctctctaaaaaggccacacc

SEQ ID NO: 180483 - DNA, 20 bp, Artificial
  CRISPR gRNA sequence
tctctaaaaaggccacaccc

SEQ ID NO: 180484 - DNA, 20 bp, Artificial
  CRISPR gRNA sequence
tctaaaaaggccacacccct

SEQ ID NO: 180485 - DNA, 20 bp, Artificial
  CRISPR gRNA sequence
taaaaaggccacacccctta

SEQ ID NO: 180486 - DNA, 20 bp, Artificial
  CRISPR gRNA sequence
aaaaggccacaccccttata

SEQ ID NO: 180487 - DNA, 20 bp, Artificial
  CRISPR gRNA sequence
ataaacaatttactttttat

SEQ ID NO: 180488 - DNA, 20 bp, Artificial
  CRISPR gRNA sequence
taaacaatttactttttata

SEQ ID NO: 180489 - DNA, 20 bp, Artificial
  CRISPR gRNA sequence
actttttataaaaagacaaa

SEQ ID NO: 180490 - DNA, 20 bp, Artificial
  CRISPR gRNA sequence
ctttttataaaaagacaaat

SEQ ID NO: 180491 - DNA, 20 bp, Artificial
  CRISPR gRNA sequence
tttataaaaagacaaatgta

SEQ ID NO: 180492 - DNA, 20 bp, Artificial
  CRISPR gRNA sequence
ttataaaaagacaaatgtac

SEQ ID NO: 180493 - DNA, 20 bp, Artificial
  CRISPR gRNA sequence
tataaaaagacaaatgtaca

SEQ ID NO: 180494 - DNA, 20 bp, Artificial
  CRISPR gRNA sequence
ataaaaagacaaatgtacat

SEQ ID NO: 180495 - DNA, 20 bp, Artificial
  CRISPR gRNA sequence
taaaaagacaaatgtacata

SEQ ID NO: 180496 - DNA, 20 bp, Artificial
  CRISPR gRNA sequence
acacacgtccttatgtgttc

SEQ ID NO: 180497 - DNA, 20 bp, Artificial
  CRISPR gRNA sequence
cacacgtccttatgtgttca

SEQ ID NO: 180498 - DNA, 20 bp, Artificial
  CRISPR gRNA sequence
atgtgttcacacatgactta

SEQ ID NO: 180499 - DNA, 20 bp, Artificial
  CRISPR gRNA sequence
tgtgttcacacatgacttaa

SEQ ID NO: 180500 - DNA, 20 bp, Artificial
  CRISPR gRNA sequence
acacatgacttaatggttag

SEQ ID NO: 180501 - DNA, 20 bp, Artificial
  CRISPR gRNA sequence
aatggttagatgacatttcc

SEQ ID NO: 180502 - DNA, 20 bp, Artificial
  CRISPR gRNA sequence
atggttagatgacatttcca

SEQ ID NO: 180503 - DNA, 20 bp, Artificial
  CRISPR gRNA sequence
gatgacatttccaattttaa

SEQ ID NO: 180504 - DNA, 20 bp, Artificial
  CRISPR gRNA sequence
ccaattttaagtcataccaa

SEQ ID NO: 180505 - DNA, 20 bp, Artificial
  CRISPR gRNA sequence
caattttaagtcataccaag

SEQ ID NO: 180506 - DNA, 20 bp, Artificial
  CRISPR gRNA sequence
taagtcataccaaggcgctc

SEQ ID NO: 180507 - DNA, 20 bp, Artificial
  CRISPR gRNA sequence
aagtcataccaaggcgctca

SEQ ID NO: 180508 - DNA, 20 bp, Artificial
  CRISPR gRNA sequence
agtcataccaaggcgctcac

SEQ ID NO: 180509 - DNA, 20 bp, Artificial
  CRISPR gRNA sequence
acacttccctccctgggcct

SEQ ID NO: 180510 - DNA, 20 bp, Artificial
  CRISPR gRNA sequence
ccctccctgggcctgttgag

SEQ ID NO: 180511 - DNA, 20 bp, Artificial
  CRISPR gRNA sequence
cctccctgggcctgttgagg

SEQ ID NO: 180512 - DNA, 20 bp, Artificial
  CRISPR gRNA sequence
cctgggcctgttgagggctg

SEQ ID NO: 180513 - DNA, 20 bp, Artificial
  CRISPR gRNA sequence
ggcctgttgagggctgctgg

SEQ ID NO: 180514 - DNA, 20 bp, Artificial
  CRISPR gRNA sequence
ttgagggctgctggggcttg

SEQ ID NO: 180515 - DNA, 20 bp, Artificial
  CRISPR gRNA sequence
agggctgctggggcttgagg

SEQ ID NO: 180516 - DNA, 20 bp, Artificial
  CRISPR gRNA sequence
ctggggcttgagggggtggt

SEQ ID NO: 180517 - DNA, 20 bp, Artificial
  CRISPR gRNA sequence
gggcttgagggggtggtggg

SEQ ID NO: 180518 - DNA, 20 bp, Artificial
  CRISPR gRNA sequence
gagggggtggtgggcgccga

SEQ ID NO: 180519 - DNA, 20 bp, Artificial
  CRISPR gRNA sequence
agggggtggtgggcgccgag

SEQ ID NO: 180520 - DNA, 20 bp, Artificial
  CRISPR gRNA sequence
tataaataaatgcaaaggcc

SEQ ID NO: 180521 - DNA, 20 bp, Artificial
  CRISPR gRNA sequence
gggggaaatgttagtgtaca

SEQ ID NO: 180522 - DNA, 20 bp, Artificial
  CRISPR gRNA sequence
gtgtacacctctgatcagaa

SEQ ID NO: 180523 - DNA, 20 bp, Artificial
  CRISPR gRNA sequence
tgatcagaaatgtggcaaga

SEQ ID NO: 180524 - DNA, 20 bp, Artificial
  CRISPR gRNA sequence
atcagaaatgtggcaagatc

SEQ ID NO: 180525 - DNA, 20 bp, Artificial
  CRISPR gRNA sequence
ttttcccaagcccctcagcc

SEQ ID NO: 180526 - DNA, 20 bp, Artificial
  CRISPR gRNA sequence
tttcccaagcccctcagcca

SEQ ID NO: 180527 - DNA, 20 bp, Artificial
  CRISPR gRNA sequence
ttcccaagcccctcagccaa

SEQ ID NO: 180528 - DNA, 20 bp, Artificial
  CRISPR gRNA sequence
tcccaagcccctcagccaaa

SEQ ID NO: 180529 - DNA, 20 bp, Artificial
  CRISPR gRNA sequence
cccaagcccctcagccaaag

SEQ ID NO: 180530 - DNA, 20 bp, Artificial
  CRISPR gRNA sequence
ccaagcccctcagccaaagc

SEQ ID NO: 180531 - DNA, 20 bp, Artificial
  CRISPR gRNA sequence
agccaaagcagggagcaggg

SEQ ID NO: 180532 - DNA, 20 bp, Artificial
  CRISPR gRNA sequence
ctctgaggctgagggagcat

SEQ ID NO: 180533 - DNA, 20 bp, Artificial
  CRISPR gRNA sequence
tgaggctgagggagcatcgc

SEQ ID NO: 180534 - DNA, 20 bp, Artificial
  CRISPR gRNA sequence
aggctgagggagcatcgccc

SEQ ID NO: 180535 - DNA, 20 bp, Artificial
  CRISPR gRNA sequence
agggagcatcgccccgaagg

SEQ ID NO: 180536 - DNA, 20 bp, Artificial
  CRISPR gRNA sequence
tccttcacatttcactggct

SEQ ID NO: 180537 - DNA, 20 bp, Artificial
  CRISPR gRNA sequence
ccttcacatttcactggctt

SEQ ID NO: 180538 - DNA, 20 bp, Artificial
  CRISPR gRNA sequence
cttcacatttcactggcttt

SEQ ID NO: 180539 - DNA, 20 bp, Artificial
  CRISPR gRNA sequence
cacatttcactggctttgga

SEQ ID NO: 180540 - DNA, 20 bp, Artificial
  CRISPR gRNA sequence
acatttcactggctttggaa

SEQ ID NO: 180541 - DNA, 20 bp, Artificial
  CRISPR gRNA sequence
cactggctttggaacagtcc

SEQ ID NO: 180542 - DNA, 20 bp, Artificial
  CRISPR gRNA sequence
actggctttggaacagtccc

SEQ ID NO: 180543 - DNA, 20 bp, Artificial
  CRISPR gRNA sequence
gctttggaacagtccccagg

SEQ ID NO: 180544 - DNA, 20 bp, Artificial
  CRISPR gRNA sequence
tggaacagtccccagggctc

SEQ ID NO: 180545 - DNA, 20 bp, Artificial
  CRISPR gRNA sequence
ggaacagtccccagggctca

SEQ ID NO: 180546 - DNA, 20 bp, Artificial
  CRISPR gRNA sequence
gaacagtccccagggctcag

SEQ ID NO: 180547 - DNA, 20 bp, Artificial
  CRISPR gRNA sequence
agctgaaaagggggtagttc

SEQ ID NO: 180548 - DNA, 20 bp, Artificial
  CRISPR gRNA sequence
aaaagggggtagttctttgg

SEQ ID NO: 180549 - DNA, 20 bp, Artificial
  CRISPR gRNA sequence
tttgggaacgagattcattt

SEQ ID NO: 180550 - DNA, 20 bp, Artificial
  CRISPR gRNA sequence
tgggaacgagattcatttag

SEQ ID NO: 180551 - DNA, 20 bp, Artificial
  CRISPR gRNA sequence
gggaacgagattcatttagt

SEQ ID NO: 180552 - DNA, 20 bp, Artificial
  CRISPR gRNA sequence
ggaacgagattcatttagtg

SEQ ID NO: 180553 - DNA, 20 bp, Artificial
  CRISPR gRNA sequence
atttagtgcaattttctctt

SEQ ID NO: 180554 - DNA, 20 bp, Artificial
  CRISPR gRNA sequence
agtgcaattttctcttagtg

SEQ ID NO: 180555 - DNA, 20 bp, Artificial
  CRISPR gRNA sequence
gtgcaattttctcttagtgc

SEQ ID NO: 180556 - DNA, 20 bp, Artificial
  CRISPR gRNA sequence
tctcttagtgcagagccagc

SEQ ID NO: 180557 - DNA, 20 bp, Artificial
  CRISPR gRNA sequence
ctcttagtgcagagccagcc

SEQ ID NO: 180558 - DNA, 20 bp, Artificial
  CRISPR gRNA sequence
tcttagtgcagagccagccc

SEQ ID NO: 180559 - DNA, 20 bp, Artificial
  CRISPR gRNA sequence
ttagtgcagagccagccctg

SEQ ID NO: 180560 - DNA, 20 bp, Artificial
  CRISPR gRNA sequence
agtgcagagccagccctggg

SEQ ID NO: 180561 - DNA, 20 bp, Artificial
  CRISPR gRNA sequence
gtgcagagccagccctggga

SEQ ID NO: 180562 - DNA, 20 bp, Artificial
  CRISPR gRNA sequence
ggattggtgttatgcttttc

SEQ ID NO: 180563 - DNA, 20 bp, Artificial
  CRISPR gRNA sequence
gtgttatgcttttctggggt

SEQ ID NO: 180564 - DNA, 20 bp, Artificial
  CRISPR gRNA sequence
tgcttttctggggtcactgg

SEQ ID NO: 180565 - DNA, 20 bp, Artificial
  CRISPR gRNA sequence
ttctggggtcactggtctgt

SEQ ID NO: 180566 - DNA, 20 bp, Artificial
  CRISPR gRNA sequence
tctggggtcactggtctgtt

SEQ ID NO: 180567 - DNA, 20 bp, Artificial
  CRISPR gRNA sequence
ctggggtcactggtctgttc

SEQ ID NO: 180568 - DNA, 20 bp, Artificial
  CRISPR gRNA sequence
tggggtcactggtctgttcc

SEQ ID NO: 180569 - DNA, 20 bp, Artificial
  CRISPR gRNA sequence
gggtcactggtctgttcccc

SEQ ID NO: 180570 - DNA, 20 bp, Artificial
  CRISPR gRNA sequence
gtctgttcccctaggagcca

SEQ ID NO: 180571 - DNA, 20 bp, Artificial
  CRISPR gRNA sequence
ttcccctaggagccagccag

SEQ ID NO: 180572 - DNA, 20 bp, Artificial
  CRISPR gRNA sequence
ccctaggagccagccagtga

SEQ ID NO: 180573 - DNA, 20 bp, Artificial
  CRISPR gRNA sequence
ggagccagccagtgacagcg

SEQ ID NO: 180574 - DNA, 20 bp, Artificial
  CRISPR gRNA sequence
tccaggcagctgggctcaga

SEQ ID NO: 180575 - DNA, 20 bp, Artificial
  CRISPR gRNA sequence
caggcagctgggctcagagg

SEQ ID NO: 180576 - DNA, 20 bp, Artificial
  CRISPR gRNA sequence
ggctcagaggaaaaagccag

SEQ ID NO: 180577 - DNA, 20 bp, Artificial
  CRISPR gRNA sequence
agaggaaaaagccagacact

SEQ ID NO: 180578 - DNA, 20 bp, Artificial
  CRISPR gRNA sequence
actcctgtccaagtccctga

SEQ ID NO: 180579 - DNA, 20 bp, Artificial
  CRISPR gRNA sequence
ctgtccaagtccctgacctg

SEQ ID NO: 180580 - DNA, 20 bp, Artificial
  CRISPR gRNA sequence
tccaagtccctgacctgata

SEQ ID NO: 180581 - DNA, 20 bp, Artificial
  CRISPR gRNA sequence
acctgatacactggtctcag

SEQ ID NO: 180582 - DNA, 20 bp, Artificial
  CRISPR gRNA sequence
atacactggtctcagaacct

SEQ ID NO: 180583 - DNA, 20 bp, Artificial
  CRISPR gRNA sequence
gtctcagaacctcatcttcc

SEQ ID NO: 180584 - DNA, 20 bp, Artificial
  CRISPR gRNA sequence
agaacctcatcttcccagga

SEQ ID NO: 180585 - DNA, 20 bp, Artificial
  CRISPR gRNA sequence
atcttcccaggaggcagggc

SEQ ID NO: 180586 - DNA, 20 bp, Artificial
  CRISPR gRNA sequence
cccaggaggcagggccagct

SEQ ID NO: 180587 - DNA, 20 bp, Artificial
  CRISPR gRNA sequence
ccaggaggcagggccagctt

SEQ ID NO: 180588 - DNA, 20 bp, Artificial
  CRISPR gRNA sequence
tacaccacaagaaaaaccca

SEQ ID NO: 180589 - DNA, 20 bp, Artificial
  CRISPR gRNA sequence
acaccacaagaaaaacccag

SEQ ID NO: 180590 - DNA, 20 bp, Artificial
  CRISPR gRNA sequence
caccacaagaaaaacccaga

SEQ ID NO: 180591 - DNA, 20 bp, Artificial
  CRISPR gRNA sequence
gcctgccaggccctgagagg

SEQ ID NO: 180592 - DNA, 20 bp, Artificial
  CRISPR gRNA sequence
ccaggccctgagaggtcaat

SEQ ID NO: 180593 - DNA, 20 bp, Artificial
  CRISPR gRNA sequence
agaggtcaatgacccaagga

SEQ ID NO: 180594 - DNA, 20 bp, Artificial
  CRISPR gRNA sequence
ggcagtggggtcacacttgg

SEQ ID NO: 180595 - DNA, 20 bp, Artificial
  CRISPR gRNA sequence
gcagtggggtcacacttggc

SEQ ID NO: 180596 - DNA, 20 bp, Artificial
  CRISPR gRNA sequence
ggctgttgaggggcccacag

SEQ ID NO: 180597 - DNA, 20 bp, Artificial
  CRISPR gRNA sequence
gctgttgaggggcccacaga

SEQ ID NO: 180598 - DNA, 20 bp, Artificial
  CRISPR gRNA sequence
ttgaggggcccacagaagtc

SEQ ID NO: 180599 - DNA, 20 bp, Artificial
  CRISPR gRNA sequence
aggggcccacagaagtccag

SEQ ID NO: 180600 - DNA, 20 bp, Artificial
  CRISPR gRNA sequence
ctctgcaccatatccaccat

SEQ ID NO: 180601 - DNA, 20 bp, Artificial
  CRISPR gRNA sequence
tctgcaccatatccaccatg

SEQ ID NO: 180602 - DNA, 20 bp, Artificial
  CRISPR gRNA sequence
tgcaccatatccaccatgat

SEQ ID NO: 180603 - DNA, 20 bp, Artificial
  CRISPR gRNA sequence
caccatatccaccatgatgc

SEQ ID NO: 180604 - DNA, 20 bp, Artificial
  CRISPR gRNA sequence
cttgcctagaggaataagag

SEQ ID NO: 180605 - DNA, 20 bp, Artificial
  CRISPR gRNA sequence
gcctagaggaataagagggg

SEQ ID NO: 180606 - DNA, 20 bp, Artificial
  CRISPR gRNA sequence
cctagaggaataagaggggc

SEQ ID NO: 180607 - DNA, 20 bp, Artificial
  CRISPR gRNA sequence
gaggaataagaggggcccag

SEQ ID NO: 180608 - DNA, 20 bp, Artificial
  CRISPR gRNA sequence
ctacggtgcacagggaatgg

SEQ ID NO: 180609 - DNA, 20 bp, Artificial
  CRISPR gRNA sequence
cggtgcacagggaatggcct

SEQ ID NO: 180610 - DNA, 20 bp, Artificial
  CRISPR gRNA sequence
gatggagggcaaccggactg

SEQ ID NO: 180611 - DNA, 20 bp, Artificial
  CRISPR gRNA sequence
gggtcagcaggctgtccagc

SEQ ID NO: 180612 - DNA, 20 bp, Artificial
  CRISPR gRNA sequence
tccagccaggtggcatccat

SEQ ID NO: 180613 - DNA, 20 bp, Artificial
  CRISPR gRNA sequence
ttcagatctgtgaagacacg

SEQ ID NO: 180614 - DNA, 20 bp, Artificial
  CRISPR gRNA sequence
cagatctgtgaagacacgct

SEQ ID NO: 180615 - DNA, 20 bp, Artificial
  CRISPR gRNA sequence
agatctgtgaagacacgctg

SEQ ID NO: 180616 - DNA, 20 bp, Artificial
  CRISPR gRNA sequence
tgaagacacgctgtagactc

SEQ ID NO: 180617 - DNA, 20 bp, Artificial
  CRISPR gRNA sequence
tagactcagcccaatatccc

SEQ ID NO: 180618 - DNA, 20 bp, Artificial
  CRISPR gRNA sequence
agcccaatatcccctagaag

SEQ ID NO: 180619 - DNA, 20 bp, Artificial
  CRISPR gRNA sequence
gaagatgtgaagaaggttgt

SEQ ID NO: 180620 - DNA, 20 bp, Artificial
  CRISPR gRNA sequence
tatgagggtaggggacggtg

SEQ ID NO: 180621 - DNA, 20 bp, Artificial
  CRISPR gRNA sequence
ccccctacccctgaaggcca

SEQ ID NO: 180622 - DNA, 20 bp, Artificial
  CRISPR gRNA sequence
cccctacccctgaaggccat

SEQ ID NO: 180623 - DNA, 20 bp, Artificial
  CRISPR gRNA sequence
cccctgaaggccatagacat

SEQ ID NO: 180624 - DNA, 20 bp, Artificial
  CRISPR gRNA sequence
aaggccatagacatggcctc

SEQ ID NO: 180625 - DNA, 20 bp, Artificial
  CRISPR gRNA sequence
tgctcttcccagcacagcag

SEQ ID NO: 180626 - DNA, 20 bp, Artificial
  CRISPR gRNA sequence
ctcttcccagcacagcagta

SEQ ID NO: 180627 - DNA, 20 bp, Artificial
  CRISPR gRNA sequence
ttcccagcacagcagtaaac

SEQ ID NO: 180628 - DNA, 20 bp, Artificial
  CRISPR gRNA sequence
cccagcacagcagtaaacat

SEQ ID NO: 180629 - DNA, 20 bp, Artificial
  CRISPR gRNA sequence
ccagcacagcagtaaacatc

SEQ ID NO: 180630 - DNA, 20 bp, Artificial
  CRISPR gRNA sequence
agcttcaggcaaaccttaag

SEQ ID NO: 180631 - DNA, 20 bp, Artificial
  CRISPR gRNA sequence
caggcaaaccttaaggcatg

SEQ ID NO: 180632 - DNA, 20 bp, Artificial
  CRISPR gRNA sequence
aggcaaaccttaaggcatgg

SEQ ID NO: 180633 - DNA, 20 bp, Artificial
  CRISPR gRNA sequence
aaggcatggcagccgtagct

SEQ ID NO: 180634 - DNA, 20 bp, Artificial
  CRISPR gRNA sequence
aggcatggcagccgtagcta

SEQ ID NO: 180635 - DNA, 20 bp, Artificial
  CRISPR gRNA sequence
attcacaatgtgtcagtacc

SEQ ID NO: 180636 - DNA, 20 bp, Artificial
  CRISPR gRNA sequence
acaatgtgtcagtaccccag

SEQ ID NO: 180637 - DNA, 20 bp, Artificial
  CRISPR gRNA sequence
taccgccctgctccctggcc

SEQ ID NO: 180638 - DNA, 20 bp, Artificial
  CRISPR gRNA sequence
accgccctgctccctggccc

SEQ ID NO: 180639 - DNA, 20 bp, Artificial
  CRISPR gRNA sequence
ccgccctgctccctggccct

SEQ ID NO: 180640 - DNA, 20 bp, Artificial
  CRISPR gRNA sequence
ctccctggccctgcccccaa

SEQ ID NO: 180641 - DNA, 20 bp, Artificial
  CRISPR gRNA sequence
cctggccctgcccccaagct

SEQ ID NO: 180642 - DNA, 20 bp, Artificial
  CRISPR gRNA sequence
gccctgcccccaagctttct

SEQ ID NO: 180643 - DNA, 20 bp, Artificial
  CRISPR gRNA sequence
cccccaagctttctccatcc

SEQ ID NO: 180644 - DNA, 20 bp, Artificial
  CRISPR gRNA sequence
tctccatccctacgtggttc

SEQ ID NO: 180645 - DNA, 20 bp, Artificial
  CRISPR gRNA sequence
ctccatccctacgtggttct

SEQ ID NO: 180646 - DNA, 20 bp, Artificial
  CRISPR gRNA sequence
tccatccctacgtggttctc

SEQ ID NO: 180647 - DNA, 20 bp, Artificial
  CRISPR gRNA sequence
catccctacgtggttctccc

SEQ ID NO: 180648 - DNA, 20 bp, Artificial
  CRISPR gRNA sequence
cgtggttctccctcatctaa

SEQ ID NO: 180649 - DNA, 20 bp, Artificial
  CRISPR gRNA sequence
tccctcatctaagaagccat

SEQ ID NO: 180650 - DNA, 20 bp, Artificial
  CRISPR gRNA sequence
cctcatctaagaagccataa

SEQ ID NO: 180651 - DNA, 20 bp, Artificial
  CRISPR gRNA sequence
atctaagaagccataaggat

SEQ ID NO: 180652 - DNA, 20 bp, Artificial
  CRISPR gRNA sequence
agaagccataaggatccagg

SEQ ID NO: 180653 - DNA, 20 bp, Artificial
  CRISPR gRNA sequence
cttaccccctgggctgtcaa

SEQ ID NO: 180654 - DNA, 20 bp, Artificial
  CRISPR gRNA sequence
ttaccccctgggctgtcaat

SEQ ID NO: 180655 - DNA, 20 bp, Artificial
  CRISPR gRNA sequence
accccctgggctgtcaattt

SEQ ID NO: 180656 - DNA, 20 bp, Artificial
  CRISPR gRNA sequence
ccccctgggctgtcaatttc

SEQ ID NO: 180657 - DNA, 20 bp, Artificial
  CRISPR gRNA sequence
ggctgtcaatttctggctcc

SEQ ID NO: 180658 - DNA, 20 bp, Artificial
  CRISPR gRNA sequence
tcaatttctggctcctcctt

SEQ ID NO: 180659 - DNA, 20 bp, Artificial
  CRISPR gRNA sequence
ctggctcctccttacagcta

SEQ ID NO: 180660 - DNA, 20 bp, Artificial
  CRISPR gRNA sequence
tggctcctccttacagctaa

SEQ ID NO: 180661 - DNA, 20 bp, Artificial
  CRISPR gRNA sequence
gctcctccttacagctaaag

SEQ ID NO: 180662 - DNA, 20 bp, Artificial
  CRISPR gRNA sequence
ctccttacagctaaagtctc

SEQ ID NO: 180663 - DNA, 20 bp, Artificial
  CRISPR gRNA sequence
cttacagctaaagtctccat

SEQ ID NO: 180664 - DNA, 20 bp, Artificial
  CRISPR gRNA sequence
acagctaaagtctccataga

SEQ ID NO: 180665 - DNA, 20 bp, Artificial
  CRISPR gRNA sequence
cagctaaagtctccatagac

SEQ ID NO: 180666 - DNA, 20 bp, Artificial
  CRISPR gRNA sequence
aagtctccatagacagaggt

SEQ ID NO: 180667 - DNA, 20 bp, Artificial
  CRISPR gRNA sequence
catagacagaggtgggctgg

SEQ ID NO: 180668 - DNA, 20 bp, Artificial
  CRISPR gRNA sequence
gactccaggttcattgagta

SEQ ID NO: 180669 - DNA, 20 bp, Artificial
  CRISPR gRNA sequence
caggttcattgagtaggtac

SEQ ID NO: 180670 - DNA, 20 bp, Artificial
  CRISPR gRNA sequence
attgagtaggtaccccttcc

SEQ ID NO: 180671 - DNA, 20 bp, Artificial
  CRISPR gRNA sequence
agtaggtaccccttcccatc

SEQ ID NO: 180672 - DNA, 20 bp, Artificial
  CRISPR gRNA sequence
cccatccacgtttgttggct

SEQ ID NO: 180673 - DNA, 20 bp, Artificial
  CRISPR gRNA sequence
ccatccacgtttgttggctg

SEQ ID NO: 180674 - DNA, 20 bp, Artificial
  CRISPR gRNA sequence
gttggctgccactccgactg

SEQ ID NO: 180675 - DNA, 20 bp, Artificial
  CRISPR gRNA sequence
ttggctgccactccgactgc

SEQ ID NO: 180676 - DNA, 20 bp, Artificial
  CRISPR gRNA sequence
gctgccactccgactgctcc

SEQ ID NO: 180677 - DNA, 20 bp, Artificial
  CRISPR gRNA sequence
ccactccgactgctccaaga

SEQ ID NO: 180678 - DNA, 20 bp, Artificial
  CRISPR gRNA sequence
cgactgctccaagagctggg

SEQ ID NO: 180679 - DNA, 20 bp, Artificial
  CRISPR gRNA sequence
ctccaagagctggggacaga

SEQ ID NO: 180680 - DNA, 20 bp, Artificial
  CRISPR gRNA sequence
caagagctggggacagaaga

SEQ ID NO: 180681 - DNA, 20 bp, Artificial
  CRISPR gRNA sequence
gggacagaagagcaagaggc

SEQ ID NO: 180682 - DNA, 20 bp, Artificial
  CRISPR gRNA sequence
tcaactcccttccagtgcag

SEQ ID NO: 180683 - DNA, 20 bp, Artificial
  CRISPR gRNA sequence
ccttccagtgcagactcacc

SEQ ID NO: 180684 - DNA, 20 bp, Artificial
  CRISPR gRNA sequence
ccagtgcagactcaccctgt

SEQ ID NO: 180685 - DNA, 20 bp, Artificial
  CRISPR gRNA sequence
cagtgcagactcaccctgtg

SEQ ID NO: 180686 - DNA, 20 bp, Artificial
  CRISPR gRNA sequence
accctgtggccctgccctca

SEQ ID NO: 180687 - DNA, 20 bp, Artificial
  CRISPR gRNA sequence
tggccctgccctcaatgagc

SEQ ID NO: 180688 - DNA, 20 bp, Artificial
  CRISPR gRNA sequence
ccctcaatgagccagctcct

SEQ ID NO: 180689 - DNA, 20 bp, Artificial
  CRISPR gRNA sequence
aatgagccagctcctctcag

SEQ ID NO: 180690 - DNA, 20 bp, Artificial
  CRISPR gRNA sequence
ctctcagccagtatcacacc

SEQ ID NO: 180691 - DNA, 20 bp, Artificial
  CRISPR gRNA sequence
tcagccagtatcacaccctt

SEQ ID NO: 180692 - DNA, 20 bp, Artificial
  CRISPR gRNA sequence
agccagtatcacacccttgg

SEQ ID NO: 180693 - DNA, 20 bp, Artificial
  CRISPR gRNA sequence
ggccattttcacaatctcag

SEQ ID NO: 180694 - DNA, 20 bp, Artificial
  CRISPR gRNA sequence
gccattttcacaatctcaga

SEQ ID NO: 180695 - DNA, 20 bp, Artificial
  CRISPR gRNA sequence
tcacaatctcagataggatg

SEQ ID NO: 180696 - DNA, 20 bp, Artificial
  CRISPR gRNA sequence
cacaatctcagataggatgc

SEQ ID NO: 180697 - DNA, 20 bp, Artificial
  CRISPR gRNA sequence
acaatctcagataggatgca

SEQ ID NO: 180698 - DNA, 20 bp, Artificial
  CRISPR gRNA sequence
agataggatgcagaagtgca

SEQ ID NO: 180699 - DNA, 20 bp, Artificial
  CRISPR gRNA sequence
cagtcaggacaagggcccgg

SEQ ID NO: 180700 - DNA, 20 bp, Artificial
  CRISPR gRNA sequence
gcactggtcctcaattcatt

SEQ ID NO: 180701 - DNA, 20 bp, Artificial
  CRISPR gRNA sequence
gtcctcaattcattttccca

SEQ ID NO: 180702 - DNA, 20 bp, Artificial
  CRISPR gRNA sequence
aattcattttcccacccctc

SEQ ID NO: 180703 - DNA, 20 bp, Artificial
  CRISPR gRNA sequence
attttcccacccctctcaca

SEQ ID NO: 180704 - DNA, 20 bp, Artificial
  CRISPR gRNA sequence
tcccacccctctcacaccca

SEQ ID NO: 180705 - DNA, 20 bp, Artificial
  CRISPR gRNA sequence
cccacccctctcacacccac

SEQ ID NO: 180706 - DNA, 20 bp, Artificial
  CRISPR gRNA sequence
ccacccctctcacacccact

SEQ ID NO: 180707 - DNA, 20 bp, Artificial
  CRISPR gRNA sequence
tcacacccactctctggtat

SEQ ID NO: 180708 - DNA, 20 bp, Artificial
  CRISPR gRNA sequence
acacccactctctggtatag

SEQ ID NO: 180709 - DNA, 20 bp, Artificial
  CRISPR gRNA sequence
tctggtatagcatctccacg

SEQ ID NO: 180710 - DNA, 20 bp, Artificial
  CRISPR gRNA sequence
tggtatagcatctccacgac

SEQ ID NO: 180711 - DNA, 20 bp, Artificial
  CRISPR gRNA sequence
gtatagcatctccacgactt

SEQ ID NO: 180712 - DNA, 20 bp, Artificial
  CRISPR gRNA sequence
cacgacttccctctcaactg

SEQ ID NO: 180713 - DNA, 20 bp, Artificial
  CRISPR gRNA sequence
ccctctcaactgtgtaagga

SEQ ID NO: 180714 - DNA, 20 bp, Artificial
  CRISPR gRNA sequence
cctctcaactgtgtaaggac

SEQ ID NO: 180715 - DNA, 20 bp, Artificial
  CRISPR gRNA sequence
tcaactgtgtaaggacatag

SEQ ID NO: 180716 - DNA, 20 bp, Artificial
  CRISPR gRNA sequence
aactgtgtaaggacatagta

SEQ ID NO: 180717 - DNA, 20 bp, Artificial
  CRISPR gRNA sequence
tgtaaggacatagtaagagg

SEQ ID NO: 180718 - DNA, 20 bp, Artificial
  CRISPR gRNA sequence
aaaacaaaggttagcataat

SEQ ID NO: 180719 - DNA, 20 bp, Artificial
  CRISPR gRNA sequence
aaacaaaggttagcataata

SEQ ID NO: 180720 - DNA, 20 bp, Artificial
  CRISPR gRNA sequence
gcataataaatcaagaaaag

SEQ ID NO: 180721 - DNA, 20 bp, Artificial
  CRISPR gRNA sequence
gaaaagctagagataaggaa

SEQ ID NO: 180722 - DNA, 20 bp, Artificial
  CRISPR gRNA sequence
gagataaggaacgacatcca

SEQ ID NO: 180723 - DNA, 20 bp, Artificial
  CRISPR gRNA sequence
aattttttgggctaatggaa

SEQ ID NO: 180724 - DNA, 20 bp, Artificial
  CRISPR gRNA sequence
tttgggctaatggaacagct

SEQ ID NO: 180725 - DNA, 20 bp, Artificial
  CRISPR gRNA sequence
ttgggctaatggaacagctg

SEQ ID NO: 180726 - DNA, 20 bp, Artificial
  CRISPR gRNA sequence
tgggctaatggaacagctgg

SEQ ID NO: 180727 - DNA, 20 bp, Artificial
  CRISPR gRNA sequence
gggctaatggaacagctggc

SEQ ID NO: 180728 - DNA, 20 bp, Artificial
  CRISPR gRNA sequence
ggctaatggaacagctggcg

SEQ ID NO: 180729 - DNA, 20 bp, Artificial
  CRISPR gRNA sequence
atggaacagctggcgtacaa

SEQ ID NO: 180730 - DNA, 20 bp, Artificial
  CRISPR gRNA sequence
gcgtacaactactgcaaaaa

SEQ ID NO: 180731 - DNA, 20 bp, Artificial
  CRISPR gRNA sequence
ctgcaaaaacttttttttga

SEQ ID NO: 180732 - DNA, 20 bp, Artificial
  CRISPR gRNA sequence
caaaaacttttttttgaaat

SEQ ID NO: 180733 - DNA, 20 bp, Artificial
  CRISPR gRNA sequence
ttttttgaaatggagttttg

SEQ ID NO: 180734 - DNA, 20 bp, Artificial
  CRISPR gRNA sequence
tttttgaaatggagttttgc

SEQ ID NO: 180735 - DNA, 20 bp, Artificial
  CRISPR gRNA sequence
ttttgaaatggagttttgct

SEQ ID NO: 180736 - DNA, 20 bp, Artificial
  CRISPR gRNA sequence
tttgaaatggagttttgctc

SEQ ID NO: 180737 - DNA, 20 bp, Artificial
  CRISPR gRNA sequence
ttgaaatggagttttgctct

SEQ ID NO: 180738 - DNA, 20 bp, Artificial
  CRISPR gRNA sequence
tgaaatggagttttgctctt

SEQ ID NO: 180739 - DNA, 20 bp, Artificial
  CRISPR gRNA sequence
gaaatggagttttgctcttg

SEQ ID NO: 180740 - DNA, 20 bp, Artificial
  CRISPR gRNA sequence
aaatggagttttgctcttgt

SEQ ID NO: 180741 - DNA, 20 bp, Artificial
  CRISPR gRNA sequence
tgctcttgttgcccaggctg

SEQ ID NO: 180742 - DNA, 20 bp, Artificial
  CRISPR gRNA sequence
gctcttgttgcccaggctgg

SEQ ID NO: 180743 - DNA, 20 bp, Artificial
  CRISPR gRNA sequence
ctcttgttgcccaggctgga

SEQ ID NO: 180744 - DNA, 20 bp, Artificial
  CRISPR gRNA sequence
ttgttgcccaggctggagtg

SEQ ID NO: 180745 - DNA, 20 bp, Artificial
  CRISPR gRNA sequence
gttgcccaggctggagtgca

SEQ ID NO: 180746 - DNA, 20 bp, Artificial
  CRISPR gRNA sequence
ttgcccaggctggagtgcaa

SEQ ID NO: 180747 - DNA, 20 bp, Artificial
  CRISPR gRNA sequence
cccaggctggagtgcaatga

SEQ ID NO: 180748 - DNA, 20 bp, Artificial
  CRISPR gRNA sequence
gagtgcaatgacacaatctc

SEQ ID NO: 180749 - DNA, 20 bp, Artificial
  CRISPR gRNA sequence
agctcactgcaacctccgcc

SEQ ID NO: 180750 - DNA, 20 bp, Artificial
  CRISPR gRNA sequence
actgcaacctccgcctctca

SEQ ID NO: 180751 - DNA, 20 bp, Artificial
  CRISPR gRNA sequence
caacctccgcctctcaggtt

SEQ ID NO: 180752 - DNA, 20 bp, Artificial
  CRISPR gRNA sequence
cgcctctcaggttcaagcga

SEQ ID NO: 180753 - DNA, 20 bp, Artificial
  CRISPR gRNA sequence
tcaggttcaagcgattctcc

SEQ ID NO: 180754 - DNA, 20 bp, Artificial
  CRISPR gRNA sequence
aggttcaagcgattctcctg

SEQ ID NO: 180755 - DNA, 20 bp, Artificial
  CRISPR gRNA sequence
aagcgattctcctgcctcag

SEQ ID NO: 180756 - DNA, 20 bp, Artificial
  CRISPR gRNA sequence
tcctgcctcagccttcagag

SEQ ID NO: 180757 - DNA, 20 bp, Artificial
  CRISPR gRNA sequence
ctgcctcagccttcagagta

SEQ ID NO: 180758 - DNA, 20 bp, Artificial
  CRISPR gRNA sequence
cctcagccttcagagtagct

SEQ ID NO: 180759 - DNA, 20 bp, Artificial
  CRISPR gRNA sequence
agccttcagagtagctggga

SEQ ID NO: 180760 - DNA, 20 bp, Artificial
  CRISPR gRNA sequence
cagagtagctgggattacag

SEQ ID NO: 180761 - DNA, 20 bp, Artificial
  CRISPR gRNA sequence
agagtagctgggattacagg

SEQ ID NO: 180762 - DNA, 20 bp, Artificial
  CRISPR gRNA sequence
ggattacaggcatgcgccac

SEQ ID NO: 180763 - DNA, 20 bp, Artificial
  CRISPR gRNA sequence
caggcatgcgccaccaggcc

SEQ ID NO: 180764 - DNA, 20 bp, Artificial
  CRISPR gRNA sequence
atttttatatttttggtaga

SEQ ID NO: 180765 - DNA, 20 bp, Artificial
  CRISPR gRNA sequence
ttatatttttggtagagatg

SEQ ID NO: 180766 - DNA, 20 bp, Artificial
  CRISPR gRNA sequence
tatatttttggtagagatgg

SEQ ID NO: 180767 - DNA, 20 bp, Artificial
  CRISPR gRNA sequence
atatttttggtagagatggg

SEQ ID NO: 180768 - DNA, 20 bp, Artificial
  CRISPR gRNA sequence
tatttttggtagagatgggt

SEQ ID NO: 180769 - DNA, 20 bp, Artificial
  CRISPR gRNA sequence
ttggtagagatgggtttcac

SEQ ID NO: 180770 - DNA, 20 bp, Artificial
  CRISPR gRNA sequence
tggtagagatgggtttcacc

SEQ ID NO: 180771 - DNA, 20 bp, Artificial
  CRISPR gRNA sequence
ggtagagatgggtttcacca

SEQ ID NO: 180772 - DNA, 20 bp, Artificial
  CRISPR gRNA sequence
gtagagatgggtttcaccat

SEQ ID NO: 180773 - DNA, 20 bp, Artificial
  CRISPR gRNA sequence
caccatgttagtcaggctgg

SEQ ID NO: 180774 - DNA, 20 bp, Artificial
  CRISPR gRNA sequence
accatgttagtcaggctggt

SEQ ID NO: 180775 - DNA, 20 bp, Artificial
  CRISPR gRNA sequence
gtcaggctggtctcaaactc

SEQ ID NO: 180776 - DNA, 20 bp, Artificial
  CRISPR gRNA sequence
gtctcaaactcctgacctca

SEQ ID NO: 180777 - DNA, 20 bp, Artificial
  CRISPR gRNA sequence
aaactcctgacctcaggtga

SEQ ID NO: 180778 - DNA, 20 bp, Artificial
  CRISPR gRNA sequence
ctgacctcaggtgatccacc

SEQ ID NO: 180779 - DNA, 20 bp, Artificial
  CRISPR gRNA sequence
acctcaggtgatccacccac

SEQ ID NO: 180780 - DNA, 20 bp, Artificial
  CRISPR gRNA sequence
aggtgatccacccaccttcg

SEQ ID NO: 180781 - DNA, 20 bp, Artificial
  CRISPR gRNA sequence
cgccttccaaagtgctggga

SEQ ID NO: 180782 - DNA, 20 bp, Artificial
  CRISPR gRNA sequence
gccttccaaagtgctgggat

SEQ ID NO: 180783 - DNA, 20 bp, Artificial
  CRISPR gRNA sequence
ccaaagtgctgggattacag

SEQ ID NO: 180784 - DNA, 20 bp, Artificial
  CRISPR gRNA sequence
caaagtgctgggattacagg

SEQ ID NO: 180785 - DNA, 20 bp, Artificial
  CRISPR gRNA sequence
ggattacaggcatgagccac

SEQ ID NO: 180786 - DNA, 20 bp, Artificial
  CRISPR gRNA sequence
caggcatgagccactgcccc

SEQ ID NO: 180787 - DNA, 20 bp, Artificial
  CRISPR gRNA sequence
cccccggctgcaaaaactat

SEQ ID NO: 180788 - DNA, 20 bp, Artificial
  CRISPR gRNA sequence
caaaaactatattcactttc

SEQ ID NO: 180789 - DNA, 20 bp, Artificial
  CRISPR gRNA sequence
tattcactttcaaaactgaa

SEQ ID NO: 180790 - DNA, 20 bp, Artificial
  CRISPR gRNA sequence
actttcaaaactgaagcaga

SEQ ID NO: 180791 - DNA, 20 bp, Artificial
  CRISPR gRNA sequence
tcaaaactgaagcagaaaaa

SEQ ID NO: 180792 - DNA, 20 bp, Artificial
  CRISPR gRNA sequence
caaaactgaagcagaaaaaa

SEQ ID NO: 180793 - DNA, 20 bp, Artificial
  CRISPR gRNA sequence
aaaactgaagcagaaaaaaa

SEQ ID NO: 180794 - DNA, 20 bp, Artificial
  CRISPR gRNA sequence
aagcagaaaaaaaaacctgg

SEQ ID NO: 180795 - DNA, 20 bp, Artificial
  CRISPR gRNA sequence
gaggataatttgctaacttt

SEQ ID NO: 180796 - DNA, 20 bp, Artificial
  CRISPR gRNA sequence
gctaactttttctataaagc

SEQ ID NO: 180797 - DNA, 20 bp, Artificial
  CRISPR gRNA sequence
ctaactttttctataaagcc

SEQ ID NO: 180798 - DNA, 20 bp, Artificial
  CRISPR gRNA sequence
actttttctataaagccatc

SEQ ID NO: 180799 - DNA, 20 bp, Artificial
  CRISPR gRNA sequence
tttctataaagccatcatca

SEQ ID NO: 180800 - DNA, 20 bp, Artificial
  CRISPR gRNA sequence
ttctataaagccatcatcat

SEQ ID NO: 180801 - DNA, 20 bp, Artificial
  CRISPR gRNA sequence
tctataaagccatcatcata

SEQ ID NO: 180802 - DNA, 20 bp, Artificial
  CRISPR gRNA sequence
ctataaagccatcatcatat

SEQ ID NO: 180803 - DNA, 20 bp, Artificial
  CRISPR gRNA sequence
tataaagccatcatcatatt

SEQ ID NO: 180804 - DNA, 20 bp, Artificial
  CRISPR gRNA sequence
taaagccatcatcatattaa

SEQ ID NO: 180805 - DNA, 20 bp, Artificial
  CRISPR gRNA sequence
acggatcctaaaggctgatt

SEQ ID NO: 180806 - DNA, 20 bp, Artificial
  CRISPR gRNA sequence
aaggctgattattgaagcct

SEQ ID NO: 180807 - DNA, 20 bp, Artificial
  CRISPR gRNA sequence
attattgaagcctgatgtgc

SEQ ID NO: 180808 - DNA, 20 bp, Artificial
  CRISPR gRNA sequence
ttgaagcctgatgtgcattt

SEQ ID NO: 180809 - DNA, 20 bp, Artificial
  CRISPR gRNA sequence
aagcctgatgtgcatttccc

SEQ ID NO: 180810 - DNA, 20 bp, Artificial
  CRISPR gRNA sequence
atgtgcatttcccgaactag

SEQ ID NO: 180811 - DNA, 20 bp, Artificial
  CRISPR gRNA sequence
cccgaactagcagggctggg

SEQ ID NO: 180812 - DNA, 20 bp, Artificial
  CRISPR gRNA sequence
ccgaactagcagggctgggg

SEQ ID NO: 180813 - DNA, 20 bp, Artificial
  CRISPR gRNA sequence
gcagggctggggcatgttgg

SEQ ID NO: 180814 - DNA, 20 bp, Artificial
  CRISPR gRNA sequence
gggcatgttggggcagagga

SEQ ID NO: 180815 - DNA, 20 bp, Artificial
  CRISPR gRNA sequence
gggcagaggatgcaggccag

SEQ ID NO: 180816 - DNA, 20 bp, Artificial
  CRISPR gRNA sequence
atagtgcctgactcacagag

SEQ ID NO: 180817 - DNA, 20 bp, Artificial
  CRISPR gRNA sequence
actcacagagctgtctgatg

SEQ ID NO: 180818 - DNA, 20 bp, Artificial
  CRISPR gRNA sequence
acagagctgtctgatgcccc

SEQ ID NO: 180819 - DNA, 20 bp, Artificial
  CRISPR gRNA sequence
tctgatgccccaaggcttgc

SEQ ID NO: 180820 - DNA, 20 bp, Artificial
  CRISPR gRNA sequence
atgccccaaggcttgcttca

SEQ ID NO: 180821 - DNA, 20 bp, Artificial
  CRISPR gRNA sequence
gcttcaggacggcctgtcag

SEQ ID NO: 180822 - DNA, 20 bp, Artificial
  CRISPR gRNA sequence
cttcaggacggcctgtcaga

SEQ ID NO: 180823 - DNA, 20 bp, Artificial
  CRISPR gRNA sequence
caggacggcctgtcagaggc

SEQ ID NO: 180824 - DNA, 20 bp, Artificial
  CRISPR gRNA sequence
aggacggcctgtcagaggcc

SEQ ID NO: 180825 - DNA, 20 bp, Artificial
  CRISPR gRNA sequence
tcagaggccaggcctcccac

SEQ ID NO: 180826 - DNA, 20 bp, Artificial
  CRISPR gRNA sequence
ccacctgccttcccttccca

SEQ ID NO: 180827 - DNA, 20 bp, Artificial
  CRISPR gRNA sequence
ccttcccttcccatggtggc

SEQ ID NO: 180828 - DNA, 20 bp, Artificial
  CRISPR gRNA sequence
cccttcccatggtggctttc

SEQ ID NO: 180829 - DNA, 20 bp, Artificial
  CRISPR gRNA sequence
ccttcccatggtggctttcc

SEQ ID NO: 180830 - DNA, 20 bp, Artificial
  CRISPR gRNA sequence
cccatggtggctttcccacc

SEQ ID NO: 180831 - DNA, 20 bp, Artificial
  CRISPR gRNA sequence
ccatggtggctttcccacca

SEQ ID NO: 180832 - DNA, 20 bp, Artificial
  CRISPR gRNA sequence
tcccaccagtcaagccacgt

SEQ ID NO: 180833 - DNA, 20 bp, Artificial
  CRISPR gRNA sequence
cccaccagtcaagccacgtg

SEQ ID NO: 180834 - DNA, 20 bp, Artificial
  CRISPR gRNA sequence
ccaccagtcaagccacgtga

SEQ ID NO: 180835 - DNA, 20 bp, Artificial
  CRISPR gRNA sequence
gtgggacaatgcaagcagcc

SEQ ID NO: 180836 - DNA, 20 bp, Artificial
  CRISPR gRNA sequence
tgggacaatgcaagcagcca

SEQ ID NO: 180837 - DNA, 20 bp, Artificial
  CRISPR gRNA sequence
cccatcctctgatttggaag

SEQ ID NO: 180838 - DNA, 20 bp, Artificial
  CRISPR gRNA sequence
tgatttggaagcttcactgg

SEQ ID NO: 180839 - DNA, 20 bp, Artificial
  CRISPR gRNA sequence
atttggaagcttcactggtt

SEQ ID NO: 180840 - DNA, 20 bp, Artificial
  CRISPR gRNA sequence
ggaagcttcactggttctct

SEQ ID NO: 180841 - DNA, 20 bp, Artificial
  CRISPR gRNA sequence
gaagcttcactggttctctc

SEQ ID NO: 180842 - DNA, 20 bp, Artificial
  CRISPR gRNA sequence
cactggttctctctcctcac

SEQ ID NO: 180843 - DNA, 20 bp, Artificial
  CRISPR gRNA sequence
actggttctctctcctcact

SEQ ID NO: 180844 - DNA, 20 bp, Artificial
  CRISPR gRNA sequence
gttctctctcctcactgaga

SEQ ID NO: 180845 - DNA, 20 bp, Artificial
  CRISPR gRNA sequence
tctctcctcactgagaaacg

SEQ ID NO: 180846 - DNA, 20 bp, Artificial
  CRISPR gRNA sequence
tctcctcactgagaaacggt

SEQ ID NO: 180847 - DNA, 20 bp, Artificial
  CRISPR gRNA sequence
tcctcactgagaaacggtca

SEQ ID NO: 180848 - DNA, 20 bp, Artificial
  CRISPR gRNA sequence
ctcactgagaaacggtcact

SEQ ID NO: 180849 - DNA, 20 bp, Artificial
  CRISPR gRNA sequence
actgagaaacggtcacttca

SEQ ID NO: 180850 - DNA, 20 bp, Artificial
  CRISPR gRNA sequence
agaaacggtcacttcaagag

SEQ ID NO: 180851 - DNA, 20 bp, Artificial
  CRISPR gRNA sequence
caagagtgcccaggtaggaa

SEQ ID NO: 180852 - DNA, 20 bp, Artificial
  CRISPR gRNA sequence
aagagtgcccaggtaggaag

SEQ ID NO: 180853 - DNA, 20 bp, Artificial
  CRISPR gRNA sequence
taccttcatgatgtcctcag

SEQ ID NO: 180854 - DNA, 20 bp, Artificial
  CRISPR gRNA sequence
accttcatgatgtcctcagg

SEQ ID NO: 180855 - DNA, 20 bp, Artificial
  CRISPR gRNA sequence
ccttcatgatgtcctcaggt

SEQ ID NO: 180856 - DNA, 20 bp, Artificial
  CRISPR gRNA sequence
catgatgtcctcaggtaatt

SEQ ID NO: 180857 - DNA, 20 bp, Artificial
  CRISPR gRNA sequence
atgatgtcctcaggtaattt

SEQ ID NO: 180858 - DNA, 20 bp, Artificial
  CRISPR gRNA sequence
aggtaatttcccttcctcat

SEQ ID NO: 180859 - DNA, 20 bp, Artificial
  CRISPR gRNA sequence
cccttcctcatcctcatctg

SEQ ID NO: 180860 - DNA, 20 bp, Artificial
  CRISPR gRNA sequence
ccttcctcatcctcatctgt

SEQ ID NO: 180861 - DNA, 20 bp, Artificial
  CRISPR gRNA sequence
cctcatcctcatctgttgta

SEQ ID NO: 180862 - DNA, 20 bp, Artificial
  CRISPR gRNA sequence
ctcatcctcatctgttgtag

SEQ ID NO: 180863 - DNA, 20 bp, Artificial
  CRISPR gRNA sequence
atcctcatctgttgtagctg

SEQ ID NO: 180864 - DNA, 20 bp, Artificial
  CRISPR gRNA sequence
atctgttgtagctgtggatg

SEQ ID NO: 180865 - DNA, 20 bp, Artificial
  CRISPR gRNA sequence
ttgtagctgtggatggggaa

SEQ ID NO: 180866 - DNA, 20 bp, Artificial
  CRISPR gRNA sequence
tagctgtggatggggaaagc

SEQ ID NO: 180867 - DNA, 20 bp, Artificial
  CRISPR gRNA sequence
tggatggggaaagcagagag

SEQ ID NO: 180868 - DNA, 20 bp, Artificial
  CRISPR gRNA sequence
gctggcagtcagccacactc

SEQ ID NO: 180869 - DNA, 20 bp, Artificial
  CRISPR gRNA sequence
gcagtcagccacactcaccc

SEQ ID NO: 180870 - DNA, 20 bp, Artificial
  CRISPR gRNA sequence
accctgcagttccagttcca

SEQ ID NO: 180871 - DNA, 20 bp, Artificial
  CRISPR gRNA sequence
cagttccagttccagcccac

SEQ ID NO: 180872 - DNA, 20 bp, Artificial
  CRISPR gRNA sequence
cagttccagcccaccagatc

SEQ ID NO: 180873 - DNA, 20 bp, Artificial
  CRISPR gRNA sequence
cagcccaccagatccccctg

SEQ ID NO: 180874 - DNA, 20 bp, Artificial
  CRISPR gRNA sequence
ccctttctctgtctctctgt

SEQ ID NO: 180875 - DNA, 20 bp, Artificial
  CRISPR gRNA sequence
tctctgtctctctgtctctc

SEQ ID NO: 180876 - DNA, 20 bp, Artificial
  CRISPR gRNA sequence
ctctgtctctctgtctctct

SEQ ID NO: 180877 - DNA, 20 bp, Artificial
  CRISPR gRNA sequence
tctgtctctctgtctctctg

SEQ ID NO: 180878 - DNA, 20 bp, Artificial
  CRISPR gRNA sequence
tgtctctctgtctctctgac

SEQ ID NO: 180879 - DNA, 20 bp, Artificial
  CRISPR gRNA sequence
tctctctgtctctctgacac

SEQ ID NO: 180880 - DNA, 20 bp, Artificial
  CRISPR gRNA sequence
tctgtctctctgacacacac

SEQ ID NO: 180881 - DNA, 20 bp, Artificial
  CRISPR gRNA sequence
tgtctctctgacacacacac

SEQ ID NO: 180882 - DNA, 20 bp, Artificial
  CRISPR gRNA sequence
tctctctgacacacacacac

SEQ ID NO: 180883 - DNA, 20 bp, Artificial
  CRISPR gRNA sequence
tctgacacacacacacacac

SEQ ID NO: 180884 - DNA, 20 bp, Artificial
  CRISPR gRNA sequence
tgacacacacacacacacac

SEQ ID NO: 180885 - DNA, 20 bp, Artificial
  CRISPR gRNA sequence
acacacacacacacacacac

SEQ ID NO: 180886 - DNA, 20 bp, Artificial
  CRISPR gRNA sequence
ccggtggacctatctgccat

SEQ ID NO: 180887 - DNA, 20 bp, Artificial
  CRISPR gRNA sequence
tctgccatagagattccaga

SEQ ID NO: 180888 - DNA, 20 bp, Artificial
  CRISPR gRNA sequence
ccatagagattccagaacag

SEQ ID NO: 180889 - DNA, 20 bp, Artificial
  CRISPR gRNA sequence
cagaacaggaccctggcctg

SEQ ID NO: 180890 - DNA, 20 bp, Artificial
  CRISPR gRNA sequence
gcctggtgactcagcctctc

SEQ ID NO: 180891 - DNA, 20 bp, Artificial
  CRISPR gRNA sequence
gtgactcagcctctcaaacc

SEQ ID NO: 180892 - DNA, 20 bp, Artificial
  CRISPR gRNA sequence
agcctctcaaaccctgaagc

SEQ ID NO: 180893 - DNA, 20 bp, Artificial
  CRISPR gRNA sequence
tcaaaccctgaagccacgcc

SEQ ID NO: 180894 - DNA, 20 bp, Artificial
  CRISPR gRNA sequence
aaaccctgaagccacgccgc

SEQ ID NO: 180895 - DNA, 20 bp, Artificial
  CRISPR gRNA sequence
aagccacgccgcttcccacc

SEQ ID NO: 180896 - DNA, 20 bp, Artificial
  CRISPR gRNA sequence
cccacccctaccctacttcc

SEQ ID NO: 180897 - DNA, 20 bp, Artificial
  CRISPR gRNA sequence
ccacccctaccctacttcct

SEQ ID NO: 180898 - DNA, 20 bp, Artificial
  CRISPR gRNA sequence
ccctacttccttcctcaccc

SEQ ID NO: 180899 - DNA, 20 bp, Artificial
  CRISPR gRNA sequence
cttccttcctcaccctcaga

SEQ ID NO: 180900 - DNA, 20 bp, Artificial
  CRISPR gRNA sequence
ccttcctcaccctcagatgc

SEQ ID NO: 180901 - DNA, 20 bp, Artificial
  CRISPR gRNA sequence
cttcctcaccctcagatgct

SEQ ID NO: 180902 - DNA, 20 bp, Artificial
  CRISPR gRNA sequence
cctcaccctcagatgctggg

SEQ ID NO: 180903 - DNA, 20 bp, Artificial
  CRISPR gRNA sequence
ctcaccctcagatgctgggc

SEQ ID NO: 180904 - DNA, 20 bp, Artificial
  CRISPR gRNA sequence
accctcagatgctgggctac

SEQ ID NO: 180905 - DNA, 20 bp, Artificial
  CRISPR gRNA sequence
agatgctgggctacagagga

SEQ ID NO: 180906 - DNA, 20 bp, Artificial
  CRISPR gRNA sequence
ggctacagaggaggaaggag

SEQ ID NO: 180907 - DNA, 20 bp, Artificial
  CRISPR gRNA sequence
cagaggaggaaggagaacca

SEQ ID NO: 180908 - DNA, 20 bp, Artificial
  CRISPR gRNA sequence
gcccccttccctcctctcac

SEQ ID NO: 180909 - DNA, 20 bp, Artificial
  CRISPR gRNA sequence
ccctcctctcaccagccccc

SEQ ID NO: 180910 - DNA, 20 bp, Artificial
  CRISPR gRNA sequence
cctcctctcaccagccccca

SEQ ID NO: 180911 - DNA, 20 bp, Artificial
  CRISPR gRNA sequence
ctctcaccagcccccactgt

SEQ ID NO: 180912 - DNA, 20 bp, Artificial
  CRISPR gRNA sequence
tcaccagcccccactgtact

SEQ ID NO: 180913 - DNA, 20 bp, Artificial
  CRISPR gRNA sequence
accagcccccactgtactgc

SEQ ID NO: 180914 - DNA, 20 bp, Artificial
  CRISPR gRNA sequence
tactgcagcccactctgaac

SEQ ID NO: 180915 - DNA, 20 bp, Artificial
  CRISPR gRNA sequence
cagcccactctgaactgcct

SEQ ID NO: 180916 - DNA, 20 bp, Artificial
  CRISPR gRNA sequence
tgaactgccttcctagtgtc

SEQ ID NO: 180917 - DNA, 20 bp, Artificial
  CRISPR gRNA sequence
aactgccttcctagtgtccc

SEQ ID NO: 180918 - DNA, 20 bp, Artificial
  CRISPR gRNA sequence
ccttcctagtgtccccgtcg

SEQ ID NO: 180919 - DNA, 20 bp, Artificial
  CRISPR gRNA sequence
cctagtgtccccgtcgcttg

SEQ ID NO: 180920 - DNA, 20 bp, Artificial
  CRISPR gRNA sequence
ctagtgtccccgtcgcttgc

SEQ ID NO: 180921 - DNA, 20 bp, Artificial
  CRISPR gRNA sequence
gtgtccccgtcgcttgcctc

SEQ ID NO: 180922 - DNA, 20 bp, Artificial
  CRISPR gRNA sequence
gcctccccctatggtggcta

SEQ ID NO: 180923 - DNA, 20 bp, Artificial
  CRISPR gRNA sequence
cctccccctatggtggctaa

SEQ ID NO: 180924 - DNA, 20 bp, Artificial
  CRISPR gRNA sequence
cccctatggtggctaagact

SEQ ID NO: 180925 - DNA, 20 bp, Artificial
  CRISPR gRNA sequence
tggtggctaagactgggcaa

SEQ ID NO: 180926 - DNA, 20 bp, Artificial
  CRISPR gRNA sequence
agactgggcaatgcccaact

SEQ ID NO: 180927 - DNA, 20 bp, Artificial
  CRISPR gRNA sequence
ggcaatgcccaactcaatca

SEQ ID NO: 180928 - DNA, 20 bp, Artificial
  CRISPR gRNA sequence
aatcaattcagtgccaggtg

SEQ ID NO: 180929 - DNA, 20 bp, Artificial
  CRISPR gRNA sequence
agtgccaggtggagttctga

SEQ ID NO: 180930 - DNA, 20 bp, Artificial
  CRISPR gRNA sequence
tgatcatcttttctctctca

SEQ ID NO: 180931 - DNA, 20 bp, Artificial
  CRISPR gRNA sequence
atcatcttttctctctcagg

SEQ ID NO: 180932 - DNA, 20 bp, Artificial
  CRISPR gRNA sequence
ttctctctcaggaagccctt

SEQ ID NO: 180933 - DNA, 20 bp, Artificial
  CRISPR gRNA sequence
tctctctcaggaagcccttc

SEQ ID NO: 180934 - DNA, 20 bp, Artificial
  CRISPR gRNA sequence
ctctctcaggaagcccttca

SEQ ID NO: 180935 - DNA, 20 bp, Artificial
  CRISPR gRNA sequence
tctctcaggaagcccttcac

SEQ ID NO: 180936 - DNA, 20 bp, Artificial
  CRISPR gRNA sequence
tctcaggaagcccttcacag

SEQ ID NO: 180937 - DNA, 20 bp, Artificial
  CRISPR gRNA sequence
tcaggaagcccttcacagga

SEQ ID NO: 180938 - DNA, 20 bp, Artificial
  CRISPR gRNA sequence
aggaagcccttcacaggacc

SEQ ID NO: 180939 - DNA, 20 bp, Artificial
  CRISPR gRNA sequence
cacaggacccagacagtcaa

SEQ ID NO: 180940 - DNA, 20 bp, Artificial
  CRISPR gRNA sequence
acaggacccagacagtcaag

SEQ ID NO: 180941 - DNA, 20 bp, Artificial
  CRISPR gRNA sequence
cagaggtggagggcatgggt

SEQ ID NO: 180942 - DNA, 20 bp, Artificial
  CRISPR gRNA sequence
agaggtggagggcatgggtg

SEQ ID NO: 180943 - DNA, 20 bp, Artificial
  CRISPR gRNA sequence
gaagttgtacagatcactgg

SEQ ID NO: 180944 - DNA, 20 bp, Artificial
  CRISPR gRNA sequence
tacagatcactggtgctgtc

SEQ ID NO: 180945 - DNA, 20 bp, Artificial
  CRISPR gRNA sequence
gtgctgtccggcacaacttc

SEQ ID NO: 180946 - DNA, 20 bp, Artificial
  CRISPR gRNA sequence
tccggcacaacttccactgg

SEQ ID NO: 180947 - DNA, 20 bp, Artificial
  CRISPR gRNA sequence
ccactgggatgtgccagtcg

SEQ ID NO: 180948 - DNA, 20 bp, Artificial
  CRISPR gRNA sequence
cactgggatgtgccagtcgg

SEQ ID NO: 180949 - DNA, 20 bp, Artificial
  CRISPR gRNA sequence
ggatgtgccagtcggggaga

SEQ ID NO: 180950 - DNA, 20 bp, Artificial
  CRISPR gRNA sequence
ctgacagcacatggcgacag

SEQ ID NO: 180951 - DNA, 20 bp, Artificial
  CRISPR gRNA sequence
acagcacatggcgacagtgc

SEQ ID NO: 180952 - DNA, 20 bp, Artificial
  CRISPR gRNA sequence
gggaacagcagaagccacag

SEQ ID NO: 180953 - DNA, 20 bp, Artificial
  CRISPR gRNA sequence
tgtgctttcttagtttgcaa

SEQ ID NO: 180954 - DNA, 20 bp, Artificial
  CRISPR gRNA sequence
tcttagtttgcaagacatcg

SEQ ID NO: 180955 - DNA, 20 bp, Artificial
  CRISPR gRNA sequence
cttagtttgcaagacatcga

SEQ ID NO: 180956 - DNA, 20 bp, Artificial
  CRISPR gRNA sequence
ttagtttgcaagacatcgag

SEQ ID NO: 180957 - DNA, 20 bp, Artificial
  CRISPR gRNA sequence
agtttgcaagacatcgagcg

SEQ ID NO: 180958 - DNA, 20 bp, Artificial
  CRISPR gRNA sequence
gtttgcaagacatcgagcgc

SEQ ID NO: 180959 - DNA, 20 bp, Artificial
  CRISPR gRNA sequence
gcaagacatcgagcgccctc

SEQ ID NO: 180960 - DNA, 20 bp, Artificial
  CRISPR gRNA sequence
caagacatcgagcgccctcc

SEQ ID NO: 180961 - DNA, 20 bp, Artificial
  CRISPR gRNA sequence
cgaccaaccctgcagcctgc

SEQ ID NO: 180962 - DNA, 20 bp, Artificial
  CRISPR gRNA sequence
cagcctgcactaatgggcca

SEQ ID NO: 180963 - DNA, 20 bp, Artificial
  CRISPR gRNA sequence
cactaatgggccaccatgtg

SEQ ID NO: 180964 - DNA, 20 bp, Artificial
  CRISPR gRNA sequence
atgggccaccatgtgccagc

SEQ ID NO: 180965 - DNA, 20 bp, Artificial
  CRISPR gRNA sequence
caagagaaagagtcatccca

SEQ ID NO: 180966 - DNA, 20 bp, Artificial
  CRISPR gRNA sequence
acctgtggggtctcctgcca

SEQ ID NO: 180967 - DNA, 20 bp, Artificial
  CRISPR gRNA sequence
tggggtctcctgccagacct

SEQ ID NO: 180968 - DNA, 20 bp, Artificial
  CRISPR gRNA sequence
ctgccagacctggaccagct

SEQ ID NO: 180969 - DNA, 20 bp, Artificial
  CRISPR gRNA sequence
ccagacctggaccagctcac

SEQ ID NO: 180970 - DNA, 20 bp, Artificial
  CRISPR gRNA sequence
gaccagctcacctggagtca

SEQ ID NO: 180971 - DNA, 20 bp, Artificial
  CRISPR gRNA sequence
acctggagtcagggcctgct

SEQ ID NO: 180972 - DNA, 20 bp, Artificial
  CRISPR gRNA sequence
gagtcagggcctgctccacc

SEQ ID NO: 180973 - DNA, 20 bp, Artificial
  CRISPR gRNA sequence
ctccacctccaagtcctgca

SEQ ID NO: 180974 - DNA, 20 bp, Artificial
  CRISPR gRNA sequence
cacctccaagtcctgcatgt

SEQ ID NO: 180975 - DNA, 20 bp, Artificial
  CRISPR gRNA sequence
caagtcctgcatgtagcctg

SEQ ID NO: 180976 - DNA, 20 bp, Artificial
  CRISPR gRNA sequence
catgtagcctggaactgtgt

SEQ ID NO: 180977 - DNA, 20 bp, Artificial
  CRISPR gRNA sequence
gaactgtgtagctgctgtgg

SEQ ID NO: 180978 - DNA, 20 bp, Artificial
  CRISPR gRNA sequence
tgtagctgctgtggtcatca

SEQ ID NO: 180979 - DNA, 20 bp, Artificial
  CRISPR gRNA sequence
ctgtggtcatcaggcagagt

SEQ ID NO: 180980 - DNA, 20 bp, Artificial
  CRISPR gRNA sequence
tggtcatcaggcagagtgga

SEQ ID NO: 180981 - DNA, 20 bp, Artificial
  CRISPR gRNA sequence
ctgagtccatcagagaaggt

SEQ ID NO: 180982 - DNA, 20 bp, Artificial
  CRISPR gRNA sequence
agtccatcagagaaggtatc

SEQ ID NO: 180983 - DNA, 20 bp, Artificial
  CRISPR gRNA sequence
gaatccccacatgactgtcg

SEQ ID NO: 180984 - DNA, 20 bp, Artificial
  CRISPR gRNA sequence
tcgagggagaaagcagctta

SEQ ID NO: 180985 - DNA, 20 bp, Artificial
  CRISPR gRNA sequence
aggcccaggcccaccttagc

SEQ ID NO: 180986 - DNA, 20 bp, Artificial
  CRISPR gRNA sequence
ggcccaggcccaccttagca

SEQ ID NO: 180987 - DNA, 20 bp, Artificial
  CRISPR gRNA sequence
agcatttcttccactgctca

SEQ ID NO: 180988 - DNA, 20 bp, Artificial
  CRISPR gRNA sequence
gcatttcttccactgctcac

SEQ ID NO: 180989 - DNA, 20 bp, Artificial
  CRISPR gRNA sequence
cttccactgctcaccctggc

SEQ ID NO: 180990 - DNA, 20 bp, Artificial
  CRISPR gRNA sequence
ttccactgctcaccctggcc

SEQ ID NO: 180991 - DNA, 20 bp, Artificial
  CRISPR gRNA sequence
ccactgctcaccctggccca

SEQ ID NO: 180992 - DNA, 20 bp, Artificial
  CRISPR gRNA sequence
cactgctcaccctggcccac

SEQ ID NO: 180993 - DNA, 20 bp, Artificial
  CRISPR gRNA sequence
ctcaccctggcccacaggtg

SEQ ID NO: 180994 - DNA, 20 bp, Artificial
  CRISPR gRNA sequence
accctggcccacaggtgacc

SEQ ID NO: 180995 - DNA, 20 bp, Artificial
  CRISPR gRNA sequence
gcccacaggtgaccaaaggc

SEQ ID NO: 180996 - DNA, 20 bp, Artificial
  CRISPR gRNA sequence
gctgcttaggaccacactca

SEQ ID NO: 180997 - DNA, 20 bp, Artificial
  CRISPR gRNA sequence
cttaggaccacactcacctt

SEQ ID NO: 180998 - DNA, 20 bp, Artificial
  CRISPR gRNA sequence
aggaccacactcaccttcct

SEQ ID NO: 180999 - DNA, 20 bp, Artificial
  CRISPR gRNA sequence
ggaccacactcaccttcctc

SEQ ID NO: 181000 - DNA, 20 bp, Artificial
  CRISPR gRNA sequence
accttcctcttggccttgct

SEQ ID NO: 181001 - DNA, 20 bp, Artificial
  CRISPR gRNA sequence
cctcttggccttgctcttag

SEQ ID NO: 181002 - DNA, 20 bp, Artificial
  CRISPR gRNA sequence
ctcttggccttgctcttagc

SEQ ID NO: 181003 - DNA, 20 bp, Artificial
  CRISPR gRNA sequence
ttggccttgctcttagcatc

SEQ ID NO: 181004 - DNA, 20 bp, Artificial
  CRISPR gRNA sequence
ggccttgctcttagcatctc

SEQ ID NO: 181005 - DNA, 20 bp, Artificial
  CRISPR gRNA sequence
gccttgctcttagcatctcg

SEQ ID NO: 181006 - DNA, 20 bp, Artificial
  CRISPR gRNA sequence
gctcttagcatctcggctgg

SEQ ID NO: 181007 - DNA, 20 bp, Artificial
  CRISPR gRNA sequence
ctcttagcatctcggctgga

SEQ ID NO: 181008 - DNA, 20 bp, Artificial
  CRISPR gRNA sequence
ttagcatctcggctggactt

SEQ ID NO: 181009 - DNA, 20 bp, Artificial
  CRISPR gRNA sequence
agcatctcggctggacttcg

SEQ ID NO: 181010 - DNA, 20 bp, Artificial
  CRISPR gRNA sequence
gcatctcggctggacttcga

SEQ ID NO: 181011 - DNA, 20 bp, Artificial
  CRISPR gRNA sequence
ggctggacttcgactttctt

SEQ ID NO: 181012 - DNA, 20 bp, Artificial
  CRISPR gRNA sequence
gacttcgactttctttctgt

SEQ ID NO: 181013 - DNA, 20 bp, Artificial
  CRISPR gRNA sequence
cgactttctttctgtggggc

SEQ ID NO: 181014 - DNA, 20 bp, Artificial
  CRISPR gRNA sequence
gactttctttctgtggggca

SEQ ID NO: 181015 - DNA, 20 bp, Artificial
  CRISPR gRNA sequence
tctttctgtggggcagacgg

SEQ ID NO: 181016 - DNA, 20 bp, Artificial
  CRISPR gRNA sequence
ctttctgtggggcagacggg

SEQ ID NO: 181017 - DNA, 20 bp, Artificial
  CRISPR gRNA sequence
tttctgtggggcagacgggc

SEQ ID NO: 181018 - DNA, 20 bp, Artificial
  CRISPR gRNA sequence
tctgtggggcagacgggctg

SEQ ID NO: 181019 - DNA, 20 bp, Artificial
  CRISPR gRNA sequence
ctgtggggcagacgggctgt

SEQ ID NO: 181020 - DNA, 20 bp, Artificial
  CRISPR gRNA sequence
tgtggggcagacgggctgtc

SEQ ID NO: 181021 - DNA, 20 bp, Artificial
  CRISPR gRNA sequence
tggggcagacgggctgtcag

SEQ ID NO: 181022 - DNA, 20 bp, Artificial
  CRISPR gRNA sequence
tcagccttggtgcaggctct

SEQ ID NO: 181023 - DNA, 20 bp, Artificial
  CRISPR gRNA sequence
ggtgcaggctctccagcccc

SEQ ID NO: 181024 - DNA, 20 bp, Artificial
  CRISPR gRNA sequence
gtgcaggctctccagcccca

SEQ ID NO: 181025 - DNA, 20 bp, Artificial
  CRISPR gRNA sequence
tccagccccagctgacctcc

SEQ ID NO: 181026 - DNA, 20 bp, Artificial
  CRISPR gRNA sequence
cagccccagctgacctcctt

SEQ ID NO: 181027 - DNA, 20 bp, Artificial
  CRISPR gRNA sequence
acctccttctaccctccctc

SEQ ID NO: 181028 - DNA, 20 bp, Artificial
  CRISPR gRNA sequence
cttctaccctccctccctga

SEQ ID NO: 181029 - DNA, 20 bp, Artificial
  CRISPR gRNA sequence
ctaccctccctccctgaggg

SEQ ID NO: 181030 - DNA, 20 bp, Artificial
  CRISPR gRNA sequence
taccctccctccctgagggc

SEQ ID NO: 181031 - DNA, 20 bp, Artificial
  CRISPR gRNA sequence
ccctccctccctgagggctt

SEQ ID NO: 181032 - DNA, 20 bp, Artificial
  CRISPR gRNA sequence
cctccctgagggcttcccaa

SEQ ID NO: 181033 - DNA, 20 bp, Artificial
  CRISPR gRNA sequence
cctgagggcttcccaaggac

SEQ ID NO: 181034 - DNA, 20 bp, Artificial
  CRISPR gRNA sequence
agggcttcccaaggacccag

SEQ ID NO: 181035 - DNA, 20 bp, Artificial
  CRISPR gRNA sequence
cccaaggacccagagtcctt

SEQ ID NO: 181036 - DNA, 20 bp, Artificial
  CRISPR gRNA sequence
ccaaggacccagagtccttg

SEQ ID NO: 181037 - DNA, 20 bp, Artificial
  CRISPR gRNA sequence
ggataccttttctctggttc

SEQ ID NO: 181038 - DNA, 20 bp, Artificial
  CRISPR gRNA sequence
gataccttttctctggttct

SEQ ID NO: 181039 - DNA, 20 bp, Artificial
  CRISPR gRNA sequence
ttctctggttcttggtgaga

SEQ ID NO: 181040 - DNA, 20 bp, Artificial
  CRISPR gRNA sequence
tctctggttcttggtgagag

SEQ ID NO: 181041 - DNA, 20 bp, Artificial
  CRISPR gRNA sequence
ctctggttcttggtgagagg

SEQ ID NO: 181042 - DNA, 20 bp, Artificial
  CRISPR gRNA sequence
tctggttcttggtgagaggt

SEQ ID NO: 181043 - DNA, 20 bp, Artificial
  CRISPR gRNA sequence
tggttcttggtgagaggtgg

SEQ ID NO: 181044 - DNA, 20 bp, Artificial
  CRISPR gRNA sequence
gttcttggtgagaggtggaa

SEQ ID NO: 181045 - DNA, 20 bp, Artificial
  CRISPR gRNA sequence
ttggtgagaggtggaagcat

SEQ ID NO: 181046 - DNA, 20 bp, Artificial
  CRISPR gRNA sequence
ggtgagaggtggaagcatcc

SEQ ID NO: 181047 - DNA, 20 bp, Artificial
  CRISPR gRNA sequence
gtgagaggtggaagcatccg

SEQ ID NO: 181048 - DNA, 20 bp, Artificial
  CRISPR gRNA sequence
gcacagctgagctgcccttg

SEQ ID NO: 181049 - DNA, 20 bp, Artificial
  CRISPR gRNA sequence
agctgcccttgttcctgctc

SEQ ID NO: 181050 - DNA, 20 bp, Artificial
  CRISPR gRNA sequence
cccttgttcctgctctggtc

SEQ ID NO: 181051 - DNA, 20 bp, Artificial
  CRISPR gRNA sequence
gttcctgctctggtctttca

SEQ ID NO: 181052 - DNA, 20 bp, Artificial
  CRISPR gRNA sequence
ttcctgctctggtctttcac

SEQ ID NO: 181053 - DNA, 20 bp, Artificial
  CRISPR gRNA sequence
ctgctctggtctttcacctc

SEQ ID NO: 181054 - DNA, 20 bp, Artificial
  CRISPR gRNA sequence
ctctggtctttcacctcctc

SEQ ID NO: 181055 - DNA, 20 bp, Artificial
  CRISPR gRNA sequence
tggtctttcacctcctcgat

SEQ ID NO: 181056 - DNA, 20 bp, Artificial
  CRISPR gRNA sequence
gtctttcacctcctcgatat

SEQ ID NO: 181057 - DNA, 20 bp, Artificial
  CRISPR gRNA sequence
tcacctcctcgatatctggc

SEQ ID NO: 181058 - DNA, 20 bp, Artificial
  CRISPR gRNA sequence
cacctcctcgatatctggca

SEQ ID NO: 181059 - DNA, 20 bp, Artificial
  CRISPR gRNA sequence
acctcctcgatatctggcag

SEQ ID NO: 181060 - DNA, 20 bp, Artificial
  CRISPR gRNA sequence
ctcgatatctggcagggagt

SEQ ID NO: 181061 - DNA, 20 bp, Artificial
  CRISPR gRNA sequence
gatatctggcagggagttca

SEQ ID NO: 181062 - DNA, 20 bp, Artificial
  CRISPR gRNA sequence
gcagggagttcatggcacag

SEQ ID NO: 181063 - DNA, 20 bp, Artificial
  CRISPR gRNA sequence
atggcacagcgaaagttggc

SEQ ID NO: 181064 - DNA, 20 bp, Artificial
  CRISPR gRNA sequence
gccttccacgtcttgggatc

SEQ ID NO: 181065 - DNA, 20 bp, Artificial
  CRISPR gRNA sequence
ccacgtcttgggatctggct

SEQ ID NO: 181066 - DNA, 20 bp, Artificial
  CRISPR gRNA sequence
cacgtcttgggatctggctc

SEQ ID NO: 181067 - DNA, 20 bp, Artificial
  CRISPR gRNA sequence
gggatctggctccttttccc

SEQ ID NO: 181068 - DNA, 20 bp, Artificial
  CRISPR gRNA sequence
ggatctggctccttttcccc

SEQ ID NO: 181069 - DNA, 20 bp, Artificial
  CRISPR gRNA sequence
gctccttttcccctgctttg

SEQ ID NO: 181070 - DNA, 20 bp, Artificial
  CRISPR gRNA sequence
cttttcccctgctttgtatc

SEQ ID NO: 181071 - DNA, 20 bp, Artificial
  CRISPR gRNA sequence
ttcccctgctttgtatcggc

SEQ ID NO: 181072 - DNA, 20 bp, Artificial
  CRISPR gRNA sequence
tcccctgctttgtatcggcc

SEQ ID NO: 181073 - DNA, 20 bp, Artificial
  CRISPR gRNA sequence
cccctgctttgtatcggcct

SEQ ID NO: 181074 - DNA, 20 bp, Artificial
  CRISPR gRNA sequence
ccctgctttgtatcggccta

SEQ ID NO: 181075 - DNA, 20 bp, Artificial
  CRISPR gRNA sequence
ctttgtatcggcctagaggg

SEQ ID NO: 181076 - DNA, 20 bp, Artificial
  CRISPR gRNA sequence
tgtatcggcctagagggcag

SEQ ID NO: 181077 - DNA, 20 bp, Artificial
  CRISPR gRNA sequence
gtatcggcctagagggcagg

SEQ ID NO: 181078 - DNA, 20 bp, Artificial
  CRISPR gRNA sequence
tatcggcctagagggcagga

SEQ ID NO: 181079 - DNA, 20 bp, Artificial
  CRISPR gRNA sequence
gagggcaggagaaaaaagag

SEQ ID NO: 181080 - DNA, 20 bp, Artificial
  CRISPR gRNA sequence
agctgcccctggcctgaagg

SEQ ID NO: 181081 - DNA, 20 bp, Artificial
  CRISPR gRNA sequence
cccctggcctgaaggaggaa

SEQ ID NO: 181082 - DNA, 20 bp, Artificial
  CRISPR gRNA sequence
gcctgaaggaggaaggcaag

SEQ ID NO: 181083 - DNA, 20 bp, Artificial
  CRISPR gRNA sequence
aaggaggaaggcaaggtacc

SEQ ID NO: 181084 - DNA, 20 bp, Artificial
  CRISPR gRNA sequence
acctcttatgctaccagaga

SEQ ID NO: 181085 - DNA, 20 bp, Artificial
  CRISPR gRNA sequence
ttatgctaccagagagccac

SEQ ID NO: 181086 - DNA, 20 bp, Artificial
  CRISPR gRNA sequence
atgctaccagagagccacag

SEQ ID NO: 181087 - DNA, 20 bp, Artificial
  CRISPR gRNA sequence
tgctaccagagagccacagt

SEQ ID NO: 181088 - DNA, 20 bp, Artificial
  CRISPR gRNA sequence
ccagagagccacagtggtca

SEQ ID NO: 181089 - DNA, 20 bp, Artificial
  CRISPR gRNA sequence
ccggtgacactctgcaggtc

SEQ ID NO: 181090 - DNA, 20 bp, Artificial
  CRISPR gRNA sequence
tgcaggtcctaggccctggg

SEQ ID NO: 181091 - DNA, 20 bp, Artificial
  CRISPR gRNA sequence
caggtcctaggccctgggcc

SEQ ID NO: 181092 - DNA, 20 bp, Artificial
  CRISPR gRNA sequence
ggccctgggccttctcaaat

SEQ ID NO: 181093 - DNA, 20 bp, Artificial
  CRISPR gRNA sequence
ggccttctcaaatgcccagg

SEQ ID NO: 181094 - DNA, 20 bp, Artificial
  CRISPR gRNA sequence
ctcaaatgcccaggcttggc

SEQ ID NO: 181095 - DNA, 20 bp, Artificial
  CRISPR gRNA sequence
tcaaatgcccaggcttggct

SEQ ID NO: 181096 - DNA, 20 bp, Artificial
  CRISPR gRNA sequence
aaatgcccaggcttggctta

SEQ ID NO: 181097 - DNA, 20 bp, Artificial
  CRISPR gRNA sequence
ggcttaaacacatctagcgg

SEQ ID NO: 181098 - DNA, 20 bp, Artificial
  CRISPR gRNA sequence
gcttaaacacatctagcggg

SEQ ID NO: 181099 - DNA, 20 bp, Artificial
  CRISPR gRNA sequence
aaacacatctagcgggcctc

SEQ ID NO: 181100 - DNA, 20 bp, Artificial
  CRISPR gRNA sequence
aacacatctagcgggcctca

SEQ ID NO: 181101 - DNA, 20 bp, Artificial
  CRISPR gRNA sequence
gcgggcctcagtgaagggcc

SEQ ID NO: 181102 - DNA, 20 bp, Artificial
  CRISPR gRNA sequence
agtgaagggcccagccagaa

SEQ ID NO: 181103 - DNA, 20 bp, Artificial
  CRISPR gRNA sequence
gagtccccatatccccaaag

SEQ ID NO: 181104 - DNA, 20 bp, Artificial
  CRISPR gRNA sequence
tctgtgtctcagactatgcc

SEQ ID NO: 181105 - DNA, 20 bp, Artificial
  CRISPR gRNA sequence
tgtctcagactatgcccagt

SEQ ID NO: 181106 - DNA, 20 bp, Artificial
  CRISPR gRNA sequence
agactatgcccagtcttcct

SEQ ID NO: 181107 - DNA, 20 bp, Artificial
  CRISPR gRNA sequence
tgcccagtcttcctccttgg

SEQ ID NO: 181108 - DNA, 20 bp, Artificial
  CRISPR gRNA sequence
cctccttgggctatcagcag

SEQ ID NO: 181109 - DNA, 20 bp, Artificial
  CRISPR gRNA sequence
ctccttgggctatcagcagc

SEQ ID NO: 181110 - DNA, 20 bp, Artificial
  CRISPR gRNA sequence
cttgggctatcagcagccag

SEQ ID NO: 181111 - DNA, 20 bp, Artificial
  CRISPR gRNA sequence
gggctatcagcagccagagg

SEQ ID NO: 181112 - DNA, 20 bp, Artificial
  CRISPR gRNA sequence
ggctatcagcagccagaggg

SEQ ID NO: 181113 - DNA, 20 bp, Artificial
  CRISPR gRNA sequence
tcagcagccagagggtagag

SEQ ID NO: 181114 - DNA, 20 bp, Artificial
  CRISPR gRNA sequence
ggcagcagagaacagttact

SEQ ID NO: 181115 - DNA, 20 bp, Artificial
  CRISPR gRNA sequence
ctaaatgggtgggctgactg

SEQ ID NO: 181116 - DNA, 20 bp, Artificial
  CRISPR gRNA sequence
aatgggtgggctgactgttc

SEQ ID NO: 181117 - DNA, 20 bp, Artificial
  CRISPR gRNA sequence
actgttctgagatgggccta

SEQ ID NO: 181118 - DNA, 20 bp, Artificial
  CRISPR gRNA sequence
ttctgagatgggcctagagc

SEQ ID NO: 181119 - DNA, 20 bp, Artificial
  CRISPR gRNA sequence
tgagatgggcctagagctcc

SEQ ID NO: 181120 - DNA, 20 bp, Artificial
  CRISPR gRNA sequence
agatgggcctagagctccat

SEQ ID NO: 181121 - DNA, 20 bp, Artificial
  CRISPR gRNA sequence
gagctccatctctcaaggat

SEQ ID NO: 181122 - DNA, 20 bp, Artificial
  CRISPR gRNA sequence
catctctcaaggataaagga

SEQ ID NO: 181123 - DNA, 20 bp, Artificial
  CRISPR gRNA sequence
tcaaggataaaggaggccac

SEQ ID NO: 181124 - DNA, 20 bp, Artificial
  CRISPR gRNA sequence
aaggataaaggaggccacca

SEQ ID NO: 181125 - DNA, 20 bp, Artificial
  CRISPR gRNA sequence
ggaccaagggccttggtcaa

SEQ ID NO: 181126 - DNA, 20 bp, Artificial
  CRISPR gRNA sequence
gaccaagggccttggtcaac

SEQ ID NO: 181127 - DNA, 20 bp, Artificial
  CRISPR gRNA sequence
ggtcaacacgaagaaaaagg

SEQ ID NO: 181128 - DNA, 20 bp, Artificial
  CRISPR gRNA sequence
gtcaacacgaagaaaaaggc

SEQ ID NO: 181129 - DNA, 20 bp, Artificial
  CRISPR gRNA sequence
ggtctctttcagtgccctgg

SEQ ID NO: 181130 - DNA, 20 bp, Artificial
  CRISPR gRNA sequence
tttcagtgccctggcttaca

SEQ ID NO: 181131 - DNA, 20 bp, Artificial
  CRISPR gRNA sequence
tcagtgccctggcttacagc

SEQ ID NO: 181132 - DNA, 20 bp, Artificial
  CRISPR gRNA sequence
cagtgccctggcttacagct

SEQ ID NO: 181133 - DNA, 20 bp, Artificial
  CRISPR gRNA sequence
agtgccctggcttacagctg

SEQ ID NO: 181134 - DNA, 20 bp, Artificial
  CRISPR gRNA sequence
gcttacagctgcttttcaca

SEQ ID NO: 181135 - DNA, 20 bp, Artificial
  CRISPR gRNA sequence
acagctgcttttcacagatg

SEQ ID NO: 181136 - DNA, 20 bp, Artificial
  CRISPR gRNA sequence
cagctgcttttcacagatgc

SEQ ID NO: 181137 - DNA, 20 bp, Artificial
  CRISPR gRNA sequence
cttttcacagatgcttttgc

SEQ ID NO: 181138 - DNA, 20 bp, Artificial
  CRISPR gRNA sequence
ttcacagatgcttttgccag

SEQ ID NO: 181139 - DNA, 20 bp, Artificial
  CRISPR gRNA sequence
tcacagatgcttttgccagg

SEQ ID NO: 181140 - DNA, 20 bp, Artificial
  CRISPR gRNA sequence
cacagatgcttttgccaggg

SEQ ID NO: 181141 - DNA, 20 bp, Artificial
  CRISPR gRNA sequence
acagatgcttttgccaggga

SEQ ID NO: 181142 - DNA, 20 bp, Artificial
  CRISPR gRNA sequence
ttgccagggagaactttcat

SEQ ID NO: 181143 - DNA, 20 bp, Artificial
  CRISPR gRNA sequence
tgccagggagaactttcatc

SEQ ID NO: 181144 - DNA, 20 bp, Artificial
  CRISPR gRNA sequence
gccagggagaactttcatct

SEQ ID NO: 181145 - DNA, 20 bp, Artificial
  CRISPR gRNA sequence
ccagggagaactttcatcta

SEQ ID NO: 181146 - DNA, 20 bp, Artificial
  CRISPR gRNA sequence
tcatctagccacaaaccccc

SEQ ID NO: 181147 - DNA, 20 bp, Artificial
  CRISPR gRNA sequence
catctagccacaaaccccct

SEQ ID NO: 181148 - DNA, 20 bp, Artificial
  CRISPR gRNA sequence
atctagccacaaaccccctg

SEQ ID NO: 181149 - DNA, 20 bp, Artificial
  CRISPR gRNA sequence
gccacaaaccccctgaagcc

SEQ ID NO: 181150 - DNA, 20 bp, Artificial
  CRISPR gRNA sequence
aagccacacactttctaaga

SEQ ID NO: 181151 - DNA, 20 bp, Artificial
  CRISPR gRNA sequence
tctaagatcttggcttttcc

SEQ ID NO: 181152 - DNA, 20 bp, Artificial
  CRISPR gRNA sequence
ctaagatcttggcttttccc

SEQ ID NO: 181153 - DNA, 20 bp, Artificial
  CRISPR gRNA sequence
taagatcttggcttttccct

SEQ ID NO: 181154 - DNA, 20 bp, Artificial
  CRISPR gRNA sequence
agatcttggcttttcccttt

SEQ ID NO: 181155 - DNA, 20 bp, Artificial
  CRISPR gRNA sequence
ggcttttccctttgagaatt

SEQ ID NO: 181156 - DNA, 20 bp, Artificial
  CRISPR gRNA sequence
gcttttccctttgagaattt

SEQ ID NO: 181157 - DNA, 20 bp, Artificial
  CRISPR gRNA sequence
ttccctttgagaatttgctg

SEQ ID NO: 181158 - DNA, 20 bp, Artificial
  CRISPR gRNA sequence
tccctttgagaatttgctga

SEQ ID NO: 181159 - DNA, 20 bp, Artificial
  CRISPR gRNA sequence
ccctttgagaatttgctgag

SEQ ID NO: 181160 - DNA, 20 bp, Artificial
  CRISPR gRNA sequence
cctttgagaatttgctgaga

SEQ ID NO: 181161 - DNA, 20 bp, Artificial
  CRISPR gRNA sequence
tgagaatttgctgagatgat

SEQ ID NO: 181162 - DNA, 20 bp, Artificial
  CRISPR gRNA sequence
gagaatttgctgagatgatc

SEQ ID NO: 181163 - DNA, 20 bp, Artificial
  CRISPR gRNA sequence
agaatttgctgagatgatcg

SEQ ID NO: 181164 - DNA, 20 bp, Artificial
  CRISPR gRNA sequence
gctgagatgatcgactctct

SEQ ID NO: 181165 - DNA, 20 bp, Artificial
  CRISPR gRNA sequence
ctgagatgatcgactctctt

SEQ ID NO: 181166 - DNA, 20 bp, Artificial
  CRISPR gRNA sequence
agatgatcgactctcttctc

SEQ ID NO: 181167 - DNA, 20 bp, Artificial
  CRISPR gRNA sequence
tcttctccagaaacacaagt

SEQ ID NO: 181168 - DNA, 20 bp, Artificial
  CRISPR gRNA sequence
ttctccagaaacacaagtct

SEQ ID NO: 181169 - DNA, 20 bp, Artificial
  CRISPR gRNA sequence
ctccagaaacacaagtctgc

SEQ ID NO: 181170 - DNA, 20 bp, Artificial
  CRISPR gRNA sequence
tccagaaacacaagtctgcc

SEQ ID NO: 181171 - DNA, 20 bp, Artificial
  CRISPR gRNA sequence
cagaaacacaagtctgccac

SEQ ID NO: 181172 - DNA, 20 bp, Artificial
  CRISPR gRNA sequence
ccaccagcccctcttcccag

SEQ ID NO: 181173 - DNA, 20 bp, Artificial
  CRISPR gRNA sequence
ttcccagtaattctgcatgt

SEQ ID NO: 181174 - DNA, 20 bp, Artificial
  CRISPR gRNA sequence
cccagtaattctgcatgttg

SEQ ID NO: 181175 - DNA, 20 bp, Artificial
  CRISPR gRNA sequence
ccagtaattctgcatgttgt

SEQ ID NO: 181176 - DNA, 20 bp, Artificial
  CRISPR gRNA sequence
tgcatgttgtctcagggagc

SEQ ID NO: 181177 - DNA, 20 bp, Artificial
  CRISPR gRNA sequence
catgttgtctcagggagctc

SEQ ID NO: 181178 - DNA, 20 bp, Artificial
  CRISPR gRNA sequence
tctcagggagctcagggacc

SEQ ID NO: 181179 - DNA, 20 bp, Artificial
  CRISPR gRNA sequence
agggagctcagggaccccag

SEQ ID NO: 181180 - DNA, 20 bp, Artificial
  CRISPR gRNA sequence
agggaccccagtgaagagcc

SEQ ID NO: 181181 - DNA, 20 bp, Artificial
  CRISPR gRNA sequence
tgtgttaacgtgagtgcctc

SEQ ID NO: 181182 - DNA, 20 bp, Artificial
  CRISPR gRNA sequence
tgttaacgtgagtgcctcct

SEQ ID NO: 181183 - DNA, 20 bp, Artificial
  CRISPR gRNA sequence
acgtgagtgcctcctcttgt

SEQ ID NO: 181184 - DNA, 20 bp, Artificial
  CRISPR gRNA sequence
ctcttgtctctaccctgggc

SEQ ID NO: 181185 - DNA, 20 bp, Artificial
  CRISPR gRNA sequence
ttgtctctaccctgggcttc

SEQ ID NO: 181186 - DNA, 20 bp, Artificial
  CRISPR gRNA sequence
gtctctaccctgggcttcct

SEQ ID NO: 181187 - DNA, 20 bp, Artificial
  CRISPR gRNA sequence
tctctaccctgggcttccta

SEQ ID NO: 181188 - DNA, 20 bp, Artificial
  CRISPR gRNA sequence
taccctgggcttcctaggcc

SEQ ID NO: 181189 - DNA, 20 bp, Artificial
  CRISPR gRNA sequence
ccctgggcttcctaggcctg

SEQ ID NO: 181190 - DNA, 20 bp, Artificial
  CRISPR gRNA sequence
ggcttcctaggcctgagtcc

SEQ ID NO: 181191 - DNA, 20 bp, Artificial
  CRISPR gRNA sequence
cctaggcctgagtcccaggc

SEQ ID NO: 181192 - DNA, 20 bp, Artificial
  CRISPR gRNA sequence
ctaggcctgagtcccaggca

SEQ ID NO: 181193 - DNA, 20 bp, Artificial
  CRISPR gRNA sequence
ggcctgagtcccaggcacac

SEQ ID NO: 181194 - DNA, 20 bp, Artificial
  CRISPR gRNA sequence
agtcccaggcacacacctgt

SEQ ID NO: 181195 - DNA, 20 bp, Artificial
  CRISPR gRNA sequence
tgtgaatggcccagctccgg

SEQ ID NO: 181196 - DNA, 20 bp, Artificial
  CRISPR gRNA sequence
cggaacaaacaggcatcctt

SEQ ID NO: 181197 - DNA, 20 bp, Artificial
  CRISPR gRNA sequence
gttgatgtcccagccatgct

SEQ ID NO: 181198 - DNA, 20 bp, Artificial
  CRISPR gRNA sequence
ttgatgtcccagccatgctt

SEQ ID NO: 181199 - DNA, 20 bp, Artificial
  CRISPR gRNA sequence
atgtcccagccatgcttggc

SEQ ID NO: 181200 - DNA, 20 bp, Artificial
  CRISPR gRNA sequence
ggcagcatgcttccatggga

SEQ ID NO: 181201 - DNA, 20 bp, Artificial
  CRISPR gRNA sequence
gcagcatgcttccatgggat

SEQ ID NO: 181202 - DNA, 20 bp, Artificial
  CRISPR gRNA sequence
ccatgggatctggaagatca

SEQ ID NO: 181203 - DNA, 20 bp, Artificial
  CRISPR gRNA sequence
catgggatctggaagatcat

SEQ ID NO: 181204 - DNA, 20 bp, Artificial
  CRISPR gRNA sequence
gaagatcatctcctcctgaa

SEQ ID NO: 181205 - DNA, 20 bp, Artificial
  CRISPR gRNA sequence
ctcctgaacaatacacacat

SEQ ID NO: 181206 - DNA, 20 bp, Artificial
  CRISPR gRNA sequence
ctgaacaatacacacataca

SEQ ID NO: 181207 - DNA, 20 bp, Artificial
  CRISPR gRNA sequence
aacaatacacacatacacat

SEQ ID NO: 181208 - DNA, 20 bp, Artificial
  CRISPR gRNA sequence
tgtcaggtcagagaccacag

SEQ ID NO: 181209 - DNA, 20 bp, Artificial
  CRISPR gRNA sequence
tggggctgagtctgagaccc

SEQ ID NO: 181210 - DNA, 20 bp, Artificial
  CRISPR gRNA sequence
ggggctgagtctgagaccca

SEQ ID NO: 181211 - DNA, 20 bp, Artificial
  CRISPR gRNA sequence
gggctgagtctgagacccag

SEQ ID NO: 181212 - DNA, 20 bp, Artificial
  CRISPR gRNA sequence
agtctgagacccaggcctgc

SEQ ID NO: 181213 - DNA, 20 bp, Artificial
  CRISPR gRNA sequence
agacccaggcctgcccagcc

SEQ ID NO: 181214 - DNA, 20 bp, Artificial
  CRISPR gRNA sequence
cccagccagacaggtctgag

SEQ ID NO: 181215 - DNA, 20 bp, Artificial
  CRISPR gRNA sequence
agaaaaggctgacttcccct

SEQ ID NO: 181216 - DNA, 20 bp, Artificial
  CRISPR gRNA sequence
acttccccttttttcccctg

SEQ ID NO: 181217 - DNA, 20 bp, Artificial
  CRISPR gRNA sequence
ccccttttttcccctgacat

SEQ ID NO: 181218 - DNA, 20 bp, Artificial
  CRISPR gRNA sequence
cccttttttcccctgacatc

SEQ ID NO: 181219 - DNA, 20 bp, Artificial
  CRISPR gRNA sequence
ttttcccctgacatctggct

SEQ ID NO: 181220 - DNA, 20 bp, Artificial
  CRISPR gRNA sequence
tttcccctgacatctggctt

SEQ ID NO: 181221 - DNA, 20 bp, Artificial
  CRISPR gRNA sequence
ttcccctgacatctggcttg

SEQ ID NO: 181222 - DNA, 20 bp, Artificial
  CRISPR gRNA sequence
tcccctgacatctggcttgg

SEQ ID NO: 181223 - DNA, 20 bp, Artificial
  CRISPR gRNA sequence
cccctgacatctggcttgga

SEQ ID NO: 181224 - DNA, 20 bp, Artificial
  CRISPR gRNA sequence
ccctgacatctggcttggac

SEQ ID NO: 181225 - DNA, 20 bp, Artificial
  CRISPR gRNA sequence
acatctggcttggacaccca

SEQ ID NO: 181226 - DNA, 20 bp, Artificial
  CRISPR gRNA sequence
gcttggacacccatcttgag

SEQ ID NO: 181227 - DNA, 20 bp, Artificial
  CRISPR gRNA sequence
ggacacccatcttgaggctg

SEQ ID NO: 181228 - DNA, 20 bp, Artificial
  CRISPR gRNA sequence
gacacccatcttgaggctgg

SEQ ID NO: 181229 - DNA, 20 bp, Artificial
  CRISPR gRNA sequence
gaggctggcttaaacagacc

SEQ ID NO: 181230 - DNA, 20 bp, Artificial
  CRISPR gRNA sequence
aggctggcttaaacagacca

SEQ ID NO: 181231 - DNA, 20 bp, Artificial
  CRISPR gRNA sequence
gcttaaacagaccactctgg

SEQ ID NO: 181232 - DNA, 20 bp, Artificial
  CRISPR gRNA sequence
aaacagaccactctggatct

SEQ ID NO: 181233 - DNA, 20 bp, Artificial
  CRISPR gRNA sequence
aacagaccactctggatctc

SEQ ID NO: 181234 - DNA, 20 bp, Artificial
  CRISPR gRNA sequence
tggatctctcaggagggaca

SEQ ID NO: 181235 - DNA, 20 bp, Artificial
  CRISPR gRNA sequence
gatctctcaggagggacacc

SEQ ID NO: 181236 - DNA, 20 bp, Artificial
  CRISPR gRNA sequence
tcaggagggacacctagttt

SEQ ID NO: 181237 - DNA, 20 bp, Artificial
  CRISPR gRNA sequence
aggagggacacctagtttgg

SEQ ID NO: 181238 - DNA, 20 bp, Artificial
  CRISPR gRNA sequence
gtttggatgagctgcagcat

SEQ ID NO: 181239 - DNA, 20 bp, Artificial
  CRISPR gRNA sequence
ggatgagctgcagcattatt

SEQ ID NO: 181240 - DNA, 20 bp, Artificial
  CRISPR gRNA sequence
gatgagctgcagcattatta

SEQ ID NO: 181241 - DNA, 20 bp, Artificial
  CRISPR gRNA sequence
cagcattattagctcacaaa

SEQ ID NO: 181242 - DNA, 20 bp, Artificial
  CRISPR gRNA sequence
ttagctcacaaagacctccc

SEQ ID NO: 181243 - DNA, 20 bp, Artificial
  CRISPR gRNA sequence
gctcacaaagacctccctct

SEQ ID NO: 181244 - DNA, 20 bp, Artificial
  CRISPR gRNA sequence
acaaagacctccctctgcct

SEQ ID NO: 181245 - DNA, 20 bp, Artificial
  CRISPR gRNA sequence
cctctgcctgttacacatgt

SEQ ID NO: 181246 - DNA, 20 bp, Artificial
  CRISPR gRNA sequence
tgcctgttacacatgtgcta

SEQ ID NO: 181247 - DNA, 20 bp, Artificial
  CRISPR gRNA sequence
cctgttacacatgtgctagg

SEQ ID NO: 181248 - DNA, 20 bp, Artificial
  CRISPR gRNA sequence
ttacacatgtgctaggaccc

SEQ ID NO: 181249 - DNA, 20 bp, Artificial
  CRISPR gRNA sequence
cacatgtgctaggacccaca

SEQ ID NO: 181250 - DNA, 20 bp, Artificial
  CRISPR gRNA sequence
ggacccacacagggcaccct

SEQ ID NO: 181251 - DNA, 20 bp, Artificial
  CRISPR gRNA sequence
ccccaaagccctggttttga

SEQ ID NO: 181252 - DNA, 20 bp, Artificial
  CRISPR gRNA sequence
gttttgaagctctgggatgt

SEQ ID NO: 181253 - DNA, 20 bp, Artificial
  CRISPR gRNA sequence
tgaagctctgggatgtttct

SEQ ID NO: 181254 - DNA, 20 bp, Artificial
  CRISPR gRNA sequence
gaagctctgggatgtttctc

SEQ ID NO: 181255 - DNA, 20 bp, Artificial
  CRISPR gRNA sequence
aagctctgggatgtttctct

SEQ ID NO: 181256 - DNA, 20 bp, Artificial
  CRISPR gRNA sequence
tgggatgtttctctctggct

SEQ ID NO: 181257 - DNA, 20 bp, Artificial
  CRISPR gRNA sequence
ggatgtttctctctggcttg

SEQ ID NO: 181258 - DNA, 20 bp, Artificial
  CRISPR gRNA sequence
ctctctggcttgtaagcacc

SEQ ID NO: 181259 - DNA, 20 bp, Artificial
  CRISPR gRNA sequence
tctctggcttgtaagcaccc

SEQ ID NO: 181260 - DNA, 20 bp, Artificial
  CRISPR gRNA sequence
tctggcttgtaagcacccac

SEQ ID NO: 181261 - DNA, 20 bp, Artificial
  CRISPR gRNA sequence
tggcttgtaagcacccacat

SEQ ID NO: 181262 - DNA, 20 bp, Artificial
  CRISPR gRNA sequence
gcttgtaagcacccacatgg

SEQ ID NO: 181263 - DNA, 20 bp, Artificial
  CRISPR gRNA sequence
gtaagcacccacatggaagt

SEQ ID NO: 181264 - DNA, 20 bp, Artificial
  CRISPR gRNA sequence
taagcacccacatggaagta

SEQ ID NO: 181265 - DNA, 20 bp, Artificial
  CRISPR gRNA sequence
cttccattagaaaggactcc

SEQ ID NO: 181266 - DNA, 20 bp, Artificial
  CRISPR gRNA sequence
ttccattagaaaggactcct

SEQ ID NO: 181267 - DNA, 20 bp, Artificial
  CRISPR gRNA sequence
ccattagaaaggactcctca

SEQ ID NO: 181268 - DNA, 20 bp, Artificial
  CRISPR gRNA sequence
cattagaaaggactcctcag

SEQ ID NO: 181269 - DNA, 20 bp, Artificial
  CRISPR gRNA sequence
gaaaggactcctcaggacac

SEQ ID NO: 181270 - DNA, 20 bp, Artificial
  CRISPR gRNA sequence
ctcaggacacctgggagcat

SEQ ID NO: 181271 - DNA, 20 bp, Artificial
  CRISPR gRNA sequence
aggacacctgggagcatggg

SEQ ID NO: 181272 - DNA, 20 bp, Artificial
  CRISPR gRNA sequence
ggagcatgggctcttacaca

SEQ ID NO: 181273 - DNA, 20 bp, Artificial
  CRISPR gRNA sequence
ttacacagggggtcctggtc

SEQ ID NO: 181274 - DNA, 20 bp, Artificial
  CRISPR gRNA sequence
acacagggggtcctggtcat

SEQ ID NO: 181275 - DNA, 20 bp, Artificial
  CRISPR gRNA sequence
cacagggggtcctggtcata

SEQ ID NO: 181276 - DNA, 20 bp, Artificial
  CRISPR gRNA sequence
gtcataccactgagggagct

SEQ ID NO: 181277 - DNA, 20 bp, Artificial
  CRISPR gRNA sequence
agggagctctgggctagact

SEQ ID NO: 181278 - DNA, 20 bp, Artificial
  CRISPR gRNA sequence
tgggctagacttggatggtg

SEQ ID NO: 181279 - DNA, 20 bp, Artificial
  CRISPR gRNA sequence
ggctagacttggatggtgaa

SEQ ID NO: 181280 - DNA, 20 bp, Artificial
  CRISPR gRNA sequence
gacttggatggtgaacactg

SEQ ID NO: 181281 - DNA, 20 bp, Artificial
  CRISPR gRNA sequence
ggatggtgaacactgtgtaa

SEQ ID NO: 181282 - DNA, 20 bp, Artificial
  CRISPR gRNA sequence
gatggtgaacactgtgtaac

SEQ ID NO: 181283 - DNA, 20 bp, Artificial
  CRISPR gRNA sequence
tgtaaccctggcattgtcac

SEQ ID NO: 181284 - DNA, 20 bp, Artificial
  CRISPR gRNA sequence
gcattgtcactgtatctctt

SEQ ID NO: 181285 - DNA, 20 bp, Artificial
  CRISPR gRNA sequence
tcactgtatctctttgcccc

SEQ ID NO: 181286 - DNA, 20 bp, Artificial
  CRISPR gRNA sequence
tatctctttgcccctcagtt

SEQ ID NO: 181287 - DNA, 20 bp, Artificial
  CRISPR gRNA sequence
tttgcccctcagttttctct

SEQ ID NO: 181288 - DNA, 20 bp, Artificial
  CRISPR gRNA sequence
tgcccctcagttttctcttc

SEQ ID NO: 181289 - DNA, 20 bp, Artificial
  CRISPR gRNA sequence
gcccctcagttttctcttct

SEQ ID NO: 181290 - DNA, 20 bp, Artificial
  CRISPR gRNA sequence
cccctcagttttctcttctc

SEQ ID NO: 181291 - DNA, 20 bp, Artificial
  CRISPR gRNA sequence
agttttctcttctcggaaat

SEQ ID NO: 181292 - DNA, 20 bp, Artificial
  CRISPR gRNA sequence
tctcttctcggaaatgagaa

SEQ ID NO: 181293 - DNA, 20 bp, Artificial
  CRISPR gRNA sequence
ctcttctcggaaatgagaaa

SEQ ID NO: 181294 - DNA, 20 bp, Artificial
  CRISPR gRNA sequence
tcttctcggaaatgagaaaa

SEQ ID NO: 181295 - DNA, 20 bp, Artificial
  CRISPR gRNA sequence
ttctcggaaatgagaaaaca

SEQ ID NO: 181296 - DNA, 20 bp, Artificial
  CRISPR gRNA sequence
ctcggaaatgagaaaacata

SEQ ID NO: 181297 - DNA, 20 bp, Artificial
  CRISPR gRNA sequence
tcggaaatgagaaaacatat

SEQ ID NO: 181298 - DNA, 20 bp, Artificial
  CRISPR gRNA sequence
ggaaatgagaaaacatatcc

SEQ ID NO: 181299 - DNA, 20 bp, Artificial
  CRISPR gRNA sequence
tgaggattaaaaaccagagg

SEQ ID NO: 181300 - DNA, 20 bp, Artificial
  CRISPR gRNA sequence
gaggattaaaaaccagagga

SEQ ID NO: 181301 - DNA, 20 bp, Artificial
  CRISPR gRNA sequence
aggattaaaaaccagaggat

SEQ ID NO: 181302 - DNA, 20 bp, Artificial
  CRISPR gRNA sequence
aaaaccagaggatgtgtagg

SEQ ID NO: 181303 - DNA, 20 bp, Artificial
  CRISPR gRNA sequence
aggtcttactgttattatat

SEQ ID NO: 181304 - DNA, 20 bp, Artificial
  CRISPR gRNA sequence
actgttattatatcacttat

SEQ ID NO: 181305 - DNA, 20 bp, Artificial
  CRISPR gRNA sequence
ctgttattatatcacttatg

SEQ ID NO: 181306 - DNA, 20 bp, Artificial
  CRISPR gRNA sequence
ttattatatcacttatggtt

SEQ ID NO: 181307 - DNA, 20 bp, Artificial
  CRISPR gRNA sequence
ttatatcacttatggttaac

SEQ ID NO: 181308 - DNA, 20 bp, Artificial
  CRISPR gRNA sequence
tatcacttatggttaacagt

SEQ ID NO: 181309 - DNA, 20 bp, Artificial
  CRISPR gRNA sequence
atggttaacagtaaagattt

SEQ ID NO: 181310 - DNA, 20 bp, Artificial
  CRISPR gRNA sequence
tggttaacagtaaagatttc

SEQ ID NO: 181311 - DNA, 20 bp, Artificial
  CRISPR gRNA sequence
acagtaaagatttctgagtc

SEQ ID NO: 181312 - DNA, 20 bp, Artificial
  CRISPR gRNA sequence
ctgagtcagaccgttcaagt

SEQ ID NO: 181313 - DNA, 20 bp, Artificial
  CRISPR gRNA sequence
tgagtcagaccgttcaagtt

SEQ ID NO: 181314 - DNA, 20 bp, Artificial
  CRISPR gRNA sequence
agtcagaccgttcaagttca

SEQ ID NO: 181315 - DNA, 20 bp, Artificial
  CRISPR gRNA sequence
aagttcaaatcttggcttca

SEQ ID NO: 181316 - DNA, 20 bp, Artificial
  CRISPR gRNA sequence
aaatcttggcttcatcactt

SEQ ID NO: 181317 - DNA, 20 bp, Artificial
  CRISPR gRNA sequence
ggcttcatcactttttgtgt

SEQ ID NO: 181318 - DNA, 20 bp, Artificial
  CRISPR gRNA sequence
gcttcatcactttttgtgtg

SEQ ID NO: 181319 - DNA, 20 bp, Artificial
  CRISPR gRNA sequence
catcactttttgtgtgatct

SEQ ID NO: 181320 - DNA, 20 bp, Artificial
  CRISPR gRNA sequence
atcactttttgtgtgatctt

SEQ ID NO: 181321 - DNA, 20 bp, Artificial
  CRISPR gRNA sequence
tttgtgtgatcttatgatct

SEQ ID NO: 181322 - DNA, 20 bp, Artificial
  CRISPR gRNA sequence
ttgtgtgatcttatgatcta

SEQ ID NO: 181323 - DNA, 20 bp, Artificial
  CRISPR gRNA sequence
tgtgtgatcttatgatctac

SEQ ID NO: 181324 - DNA, 20 bp, Artificial
  CRISPR gRNA sequence
gtgtgatcttatgatctacc

SEQ ID NO: 181325 - DNA, 20 bp, Artificial
  CRISPR gRNA sequence
tgtgatcttatgatctacct

SEQ ID NO: 181326 - DNA, 20 bp, Artificial
  CRISPR gRNA sequence
atgatctacctctcagtgcc

SEQ ID NO: 181327 - DNA, 20 bp, Artificial
  CRISPR gRNA sequence
tgatctacctctcagtgcct

SEQ ID NO: 181328 - DNA, 20 bp, Artificial
  CRISPR gRNA sequence
cctctcagtgcctctgttta

SEQ ID NO: 181329 - DNA, 20 bp, Artificial
  CRISPR gRNA sequence
tcagtgcctctgtttactta

SEQ ID NO: 181330 - DNA, 20 bp, Artificial
  CRISPR gRNA sequence
agtgcctctgtttacttatc

SEQ ID NO: 181331 - DNA, 20 bp, Artificial
  CRISPR gRNA sequence
tgtttacttatctgaaaatg

SEQ ID NO: 181332 - DNA, 20 bp, Artificial
  CRISPR gRNA sequence
tttacttatctgaaaatgat

SEQ ID NO: 181333 - DNA, 20 bp, Artificial
  CRISPR gRNA sequence
acttatctgaaaatgatgac

SEQ ID NO: 181334 - DNA, 20 bp, Artificial
  CRISPR gRNA sequence
cttatctgaaaatgatgaca

SEQ ID NO: 181335 - DNA, 20 bp, Artificial
  CRISPR gRNA sequence
atctgaaaatgatgacatta

SEQ ID NO: 181336 - DNA, 20 bp, Artificial
  CRISPR gRNA sequence
tctgaaaatgatgacattag

SEQ ID NO: 181337 - DNA, 20 bp, Artificial
  CRISPR gRNA sequence
aaaatgatgacattagtaag

SEQ ID NO: 181338 - DNA, 20 bp, Artificial
  CRISPR gRNA sequence
gtaagatctaacccacagga

SEQ ID NO: 181339 - DNA, 20 bp, Artificial
  CRISPR gRNA sequence
acccacaggactactgcgag

SEQ ID NO: 181340 - DNA, 20 bp, Artificial
  CRISPR gRNA sequence
ctgcgaggattaaatgacac

SEQ ID NO: 181341 - DNA, 20 bp, Artificial
  CRISPR gRNA sequence
cgaggattaaatgacacaat

SEQ ID NO: 181342 - DNA, 20 bp, Artificial
  CRISPR gRNA sequence
aatgacacaatgtaaataac

SEQ ID NO: 181343 - DNA, 20 bp, Artificial
  CRISPR gRNA sequence
agcaggtgccaggcacacag

SEQ ID NO: 181344 - DNA, 20 bp, Artificial
  CRISPR gRNA sequence
gcaggtgccaggcacacagg

SEQ ID NO: 181345 - DNA, 20 bp, Artificial
  CRISPR gRNA sequence
agtaagcattagctattatt

SEQ ID NO: 181346 - DNA, 20 bp, Artificial
  CRISPR gRNA sequence
gctattattatgaatactat

SEQ ID NO: 181347 - DNA, 20 bp, Artificial
  CRISPR gRNA sequence
ttattatgaatactatcatt

SEQ ID NO: 181348 - DNA, 20 bp, Artificial
  CRISPR gRNA sequence
ttatgaatactatcattgct

SEQ ID NO: 181349 - DNA, 20 bp, Artificial
  CRISPR gRNA sequence
tgaatactatcattgctact

SEQ ID NO: 181350 - DNA, 20 bp, Artificial
  CRISPR gRNA sequence
tcattgctactaagtctata

SEQ ID NO: 181351 - DNA, 20 bp, Artificial
  CRISPR gRNA sequence
ctactaagtctatagggtct

SEQ ID NO: 181352 - DNA, 20 bp, Artificial
  CRISPR gRNA sequence
ctaagtctatagggtctatg

SEQ ID NO: 181353 - DNA, 20 bp, Artificial
  CRISPR gRNA sequence
agtctatagggtctatgttg

SEQ ID NO: 181354 - DNA, 20 bp, Artificial
  CRISPR gRNA sequence
tagggtctatgttgccccaa

SEQ ID NO: 181355 - DNA, 20 bp, Artificial
  CRISPR gRNA sequence
tgttgccccaagtgcaccag

SEQ ID NO: 181356 - DNA, 20 bp, Artificial
  CRISPR gRNA sequence
ccccaagtgcaccagctata

SEQ ID NO: 181357 - DNA, 20 bp, Artificial
  CRISPR gRNA sequence
taggcttcttgggccagagt

SEQ ID NO: 181358 - DNA, 20 bp, Artificial
  CRISPR gRNA sequence
cttgggccagagtgactggt

SEQ ID NO: 181359 - DNA, 20 bp, Artificial
  CRISPR gRNA sequence
ttgggccagagtgactggtg

SEQ ID NO: 181360 - DNA, 20 bp, Artificial
  CRISPR gRNA sequence
gggccagagtgactggtgca

SEQ ID NO: 181361 - DNA, 20 bp, Artificial
  CRISPR gRNA sequence
ggccagagtgactggtgcaa

SEQ ID NO: 181362 - DNA, 20 bp, Artificial
  CRISPR gRNA sequence
gtgcaagattaactcgtttg

SEQ ID NO: 181363 - DNA, 20 bp, Artificial
  CRISPR gRNA sequence
actcgtttgtcctctgctaa

SEQ ID NO: 181364 - DNA, 20 bp, Artificial
  CRISPR gRNA sequence
gtttgtcctctgctaagcca

SEQ ID NO: 181365 - DNA, 20 bp, Artificial
  CRISPR gRNA sequence
gtcctctgctaagccaggca

SEQ ID NO: 181366 - DNA, 20 bp, Artificial
  CRISPR gRNA sequence
tcctctgctaagccaggcac

SEQ ID NO: 181367 - DNA, 20 bp, Artificial
  CRISPR gRNA sequence
tgctaagccaggcacgtttc

SEQ ID NO: 181368 - DNA, 20 bp, Artificial
  CRISPR gRNA sequence
ctaagccaggcacgtttctg

SEQ ID NO: 181369 - DNA, 20 bp, Artificial
  CRISPR gRNA sequence
agccaggcacgtttctgccc

SEQ ID NO: 181370 - DNA, 20 bp, Artificial
  CRISPR gRNA sequence
ctgcccagcagcatccactt

SEQ ID NO: 181371 - DNA, 20 bp, Artificial
  CRISPR gRNA sequence
tgcccagcagcatccacttc

SEQ ID NO: 181372 - DNA, 20 bp, Artificial
  CRISPR gRNA sequence
cccagcagcatccacttctc

SEQ ID NO: 181373 - DNA, 20 bp, Artificial
  CRISPR gRNA sequence
ctcagtcttctatttgttcg

SEQ ID NO: 181374 - DNA, 20 bp, Artificial
  CRISPR gRNA sequence
tcagtcttctatttgttcga

SEQ ID NO: 181375 - DNA, 20 bp, Artificial
  CRISPR gRNA sequence
agtcttctatttgttcgatt

SEQ ID NO: 181376 - DNA, 20 bp, Artificial
  CRISPR gRNA sequence
ctatttgttcgattggagcc

SEQ ID NO: 181377 - DNA, 20 bp, Artificial
  CRISPR gRNA sequence
tatttgttcgattggagccc

SEQ ID NO: 181378 - DNA, 20 bp, Artificial
  CRISPR gRNA sequence
tttgttcgattggagccctg

SEQ ID NO: 181379 - DNA, 20 bp, Artificial
  CRISPR gRNA sequence
gttcgattggagccctgcag

SEQ ID NO: 181380 - DNA, 20 bp, Artificial
  CRISPR gRNA sequence
ttcgattggagccctgcaga

SEQ ID NO: 181381 - DNA, 20 bp, Artificial
  CRISPR gRNA sequence
gattggagccctgcagagtg

SEQ ID NO: 181382 - DNA, 20 bp, Artificial
  CRISPR gRNA sequence
gagccctgcagagtgctgtg

SEQ ID NO: 181383 - DNA, 20 bp, Artificial
  CRISPR gRNA sequence
cagagtgctgtgtatgtttg

SEQ ID NO: 181384 - DNA, 20 bp, Artificial
  CRISPR gRNA sequence
tgtatgtttgtaagggtctc

SEQ ID NO: 181385 - DNA, 20 bp, Artificial
  CRISPR gRNA sequence
gtaagggtctcgcttagagg

SEQ ID NO: 181386 - DNA, 20 bp, Artificial
  CRISPR gRNA sequence
taagggtctcgcttagagga

SEQ ID NO: 181387 - DNA, 20 bp, Artificial
  CRISPR gRNA sequence
gcttagaggagagcagaact

SEQ ID NO: 181388 - DNA, 20 bp, Artificial
  CRISPR gRNA sequence
agaggagagcagaactccag

SEQ ID NO: 181389 - DNA, 20 bp, Artificial
  CRISPR gRNA sequence
gaggagagcagaactccagc

SEQ ID NO: 181390 - DNA, 20 bp, Artificial
  CRISPR gRNA sequence
cagctctgcagatgctggaa

SEQ ID NO: 181391 - DNA, 20 bp, Artificial
  CRISPR gRNA sequence
tgcagatgctggaaagtctt

SEQ ID NO: 181392 - DNA, 20 bp, Artificial
  CRISPR gRNA sequence
cagatgctggaaagtcttgc

SEQ ID NO: 181393 - DNA, 20 bp, Artificial
  CRISPR gRNA sequence
gaaagtcttgctgctggaaa

SEQ ID NO: 181394 - DNA, 20 bp, Artificial
  CRISPR gRNA sequence
gctgctggaaactggaagtg

SEQ ID NO: 181395 - DNA, 20 bp, Artificial
  CRISPR gRNA sequence
ctgctggaaactggaagtgc

SEQ ID NO: 181396 - DNA, 20 bp, Artificial
  CRISPR gRNA sequence
ctggaaactggaagtgcctt

SEQ ID NO: 181397 - DNA, 20 bp, Artificial
  CRISPR gRNA sequence
gaaactggaagtgccttcag

SEQ ID NO: 181398 - DNA, 20 bp, Artificial
  CRISPR gRNA sequence
gaagtgccttcaggtgggtg

SEQ ID NO: 181399 - DNA, 20 bp, Artificial
  CRISPR gRNA sequence
caggtgggtgccctacctca

SEQ ID NO: 181400 - DNA, 20 bp, Artificial
  CRISPR gRNA sequence
aggtgggtgccctacctcaa

SEQ ID NO: 181401 - DNA, 20 bp, Artificial
  CRISPR gRNA sequence
cctcaagaagggaagaaggc

SEQ ID NO: 181402 - DNA, 20 bp, Artificial
  CRISPR gRNA sequence
aagaagggaagaaggcagga

SEQ ID NO: 181403 - DNA, 20 bp, Artificial
  CRISPR gRNA sequence
ggccgtgcacactccctgca

SEQ ID NO: 181404 - DNA, 20 bp, Artificial
  CRISPR gRNA sequence
cctgcatgcaggacccactg

SEQ ID NO: 181405 - DNA, 20 bp, Artificial
  CRISPR gRNA sequence
catgcaggacccactgggag

SEQ ID NO: 181406 - DNA, 20 bp, Artificial
  CRISPR gRNA sequence
ggagaaacacctgcttgtcc

SEQ ID NO: 181407 - DNA, 20 bp, Artificial
  CRISPR gRNA sequence
cttgtcccgttatcacttcc

SEQ ID NO: 181408 - DNA, 20 bp, Artificial
  CRISPR gRNA sequence
gtcccgttatcacttccctt

SEQ ID NO: 181409 - DNA, 20 bp, Artificial
  CRISPR gRNA sequence
tcccgttatcacttcccttt

SEQ ID NO: 181410 - DNA, 20 bp, Artificial
  CRISPR gRNA sequence
tcacttccctttttgagctg

SEQ ID NO: 181411 - DNA, 20 bp, Artificial
  CRISPR gRNA sequence
ccctttttgagctgcatctg

SEQ ID NO: 181412 - DNA, 20 bp, Artificial
  CRISPR gRNA sequence
cctttttgagctgcatctga

SEQ ID NO: 181413 - DNA, 20 bp, Artificial
  CRISPR gRNA sequence
tttgagctgcatctgaagct

SEQ ID NO: 181414 - DNA, 20 bp, Artificial
  CRISPR gRNA sequence
ttgagctgcatctgaagctt

SEQ ID NO: 181415 - DNA, 20 bp, Artificial
  CRISPR gRNA sequence
tgagctgcatctgaagcttt

SEQ ID NO: 181416 - DNA, 20 bp, Artificial
  CRISPR gRNA sequence
gagctgcatctgaagctttg

SEQ ID NO: 181417 - DNA, 20 bp, Artificial
  CRISPR gRNA sequence
agctgcatctgaagctttgg

SEQ ID NO: 181418 - DNA, 20 bp, Artificial
  CRISPR gRNA sequence
catctgaagctttggtccct

SEQ ID NO: 181419 - DNA, 20 bp, Artificial
  CRISPR gRNA sequence
aagctttggtccctccagaa

SEQ ID NO: 181420 - DNA, 20 bp, Artificial
  CRISPR gRNA sequence
tggtccctccagaagtacat

SEQ ID NO: 181421 - DNA, 20 bp, Artificial
  CRISPR gRNA sequence
ggtccctccagaagtacatg

SEQ ID NO: 181422 - DNA, 20 bp, Artificial
  CRISPR gRNA sequence
gtccctccagaagtacatgg

SEQ ID NO: 181423 - DNA, 20 bp, Artificial
  CRISPR gRNA sequence
cagaagtacatgggttaaaa

SEQ ID NO: 181424 - DNA, 20 bp, Artificial
  CRISPR gRNA sequence
aaacagtggcaggaaaaccc

SEQ ID NO: 181425 - DNA, 20 bp, Artificial
  CRISPR gRNA sequence
cactcactttattaatccag

SEQ ID NO: 181426 - DNA, 20 bp, Artificial
  CRISPR gRNA sequence
actttattaatccagatgag

SEQ ID NO: 181427 - DNA, 20 bp, Artificial
  CRISPR gRNA sequence
tattaatccagatgagcccc

SEQ ID NO: 181428 - DNA, 20 bp, Artificial
  CRISPR gRNA sequence
attaatccagatgagccccg

SEQ ID NO: 181429 - DNA, 20 bp, Artificial
  CRISPR gRNA sequence
ttaatccagatgagccccgg

SEQ ID NO: 181430 - DNA, 20 bp, Artificial
  CRISPR gRNA sequence
atccagatgagccccgggat

SEQ ID NO: 181431 - DNA, 20 bp, Artificial
  CRISPR gRNA sequence
ggttggaattaatctgcatc

SEQ ID NO: 181432 - DNA, 20 bp, Artificial
  CRISPR gRNA sequence
gttggaattaatctgcatct

SEQ ID NO: 181433 - DNA, 20 bp, Artificial
  CRISPR gRNA sequence
gaattaatctgcatctctag

SEQ ID NO: 181434 - DNA, 20 bp, Artificial
  CRISPR gRNA sequence
atctgcatctctagccaggg

SEQ ID NO: 181435 - DNA, 20 bp, Artificial
  CRISPR gRNA sequence
catctctagccagggtctca

SEQ ID NO: 181436 - DNA, 20 bp, Artificial
  CRISPR gRNA sequence
tagccagggtctcatgcgca

SEQ ID NO: 181437 - DNA, 20 bp, Artificial
  CRISPR gRNA sequence
gccagggtctcatgcgcatc

SEQ ID NO: 181438 - DNA, 20 bp, Artificial
  CRISPR gRNA sequence
atgcgcatccgagtgatggg

SEQ ID NO: 181439 - DNA, 20 bp, Artificial
  CRISPR gRNA sequence
gctgtaaagagaacacagag

SEQ ID NO: 181440 - DNA, 20 bp, Artificial
  CRISPR gRNA sequence
taaagagaacacagaggctc

SEQ ID NO: 181441 - DNA, 20 bp, Artificial
  CRISPR gRNA sequence
cagtctggaatctgttgaac

SEQ ID NO: 181442 - DNA, 20 bp, Artificial
  CRISPR gRNA sequence
gaatctgttgaacagtacct

SEQ ID NO: 181443 - DNA, 20 bp, Artificial
  CRISPR gRNA sequence
ttgaacagtacctgggcagt

SEQ ID NO: 181444 - DNA, 20 bp, Artificial
  CRISPR gRNA sequence
aacagtacctgggcagtgac

SEQ ID NO: 181445 - DNA, 20 bp, Artificial
  CRISPR gRNA sequence
ggcagtgacctgccccaccc

SEQ ID NO: 181446 - DNA, 20 bp, Artificial
  CRISPR gRNA sequence
ccccacccgaggtcacttag

SEQ ID NO: 181447 - DNA, 20 bp, Artificial
  CRISPR gRNA sequence
agttaccctcccctcacctc

SEQ ID NO: 181448 - DNA, 20 bp, Artificial
  CRISPR gRNA sequence
gttaccctcccctcacctca

SEQ ID NO: 181449 - DNA, 20 bp, Artificial
  CRISPR gRNA sequence
ccctcccctcacctcagcca

SEQ ID NO: 181450 - DNA, 20 bp, Artificial
  CRISPR gRNA sequence
ccctcacctcagccagctgc

SEQ ID NO: 181451 - DNA, 20 bp, Artificial
  CRISPR gRNA sequence
acctcagccagctgctaggt

SEQ ID NO: 181452 - DNA, 20 bp, Artificial
  CRISPR gRNA sequence
agccagctgctaggtactac

SEQ ID NO: 181453 - DNA, 20 bp, Artificial
  CRISPR gRNA sequence
ctaggtactacactcagtgc

SEQ ID NO: 181454 - DNA, 20 bp, Artificial
  CRISPR gRNA sequence
ggtactacactcagtgcgga

SEQ ID NO: 181455 - DNA, 20 bp, Artificial
  CRISPR gRNA sequence
cactcagtgcggaggggagc

SEQ ID NO: 181456 - DNA, 20 bp, Artificial
  CRISPR gRNA sequence
agtgcggaggggagctgcgc

SEQ ID NO: 181457 - DNA, 20 bp, Artificial
  CRISPR gRNA sequence
cgctggaataaaactgctct

SEQ ID NO: 181458 - DNA, 20 bp, Artificial
  CRISPR gRNA sequence
gaataaaactgctctccaaa

SEQ ID NO: 181459 - DNA, 20 bp, Artificial
  CRISPR gRNA sequence
ctctccaaattttttcagca

SEQ ID NO: 181460 - DNA, 20 bp, Artificial
  CRISPR gRNA sequence
tccaaattttttcagcatct

SEQ ID NO: 181461 - DNA, 20 bp, Artificial
  CRISPR gRNA sequence
caaattttttcagcatctta

SEQ ID NO: 181462 - DNA, 20 bp, Artificial
  CRISPR gRNA sequence
tttcagcatcttaggcaaaa

SEQ ID NO: 181463 - DNA, 20 bp, Artificial
  CRISPR gRNA sequence
ttcagcatcttaggcaaaaa

SEQ ID NO: 181464 - DNA, 20 bp, Artificial
  CRISPR gRNA sequence
tcagcatcttaggcaaaaat

SEQ ID NO: 181465 - DNA, 20 bp, Artificial
  CRISPR gRNA sequence
cagcatcttaggcaaaaatg

SEQ ID NO: 181466 - DNA, 20 bp, Artificial
  CRISPR gRNA sequence
agcatcttaggcaaaaatgc

SEQ ID NO: 181467 - DNA, 20 bp, Artificial
  CRISPR gRNA sequence
aggcaaaaatgcttttgccc

SEQ ID NO: 181468 - DNA, 20 bp, Artificial
  CRISPR gRNA sequence
ggcaaaaatgcttttgcccc

SEQ ID NO: 181469 - DNA, 20 bp, Artificial
  CRISPR gRNA sequence
ttgccccttccttcagcccc

SEQ ID NO: 181470 - DNA, 20 bp, Artificial
  CRISPR gRNA sequence
tgccccttccttcagcccct

SEQ ID NO: 181471 - DNA, 20 bp, Artificial
  CRISPR gRNA sequence
gccccttccttcagcccctc

SEQ ID NO: 181472 - DNA, 20 bp, Artificial
  CRISPR gRNA sequence
ccccttccttcagcccctcc

SEQ ID NO: 181473 - DNA, 20 bp, Artificial
  CRISPR gRNA sequence
ccttcagcccctcccagcca

SEQ ID NO: 181474 - DNA, 20 bp, Artificial
  CRISPR gRNA sequence
cttcagcccctcccagccag

SEQ ID NO: 181475 - DNA, 20 bp, Artificial
  CRISPR gRNA sequence
cagcccctcccagccagtct

SEQ ID NO: 181476 - DNA, 20 bp, Artificial
  CRISPR gRNA sequence
agcccctcccagccagtctc

SEQ ID NO: 181477 - DNA, 20 bp, Artificial
  CRISPR gRNA sequence
ccagccagtctctggaggag

SEQ ID NO: 181478 - DNA, 20 bp, Artificial
  CRISPR gRNA sequence
tggaggagacaggcatgcaa

SEQ ID NO: 181479 - DNA, 20 bp, Artificial
  CRISPR gRNA sequence
gaggagacaggcatgcaagt

SEQ ID NO: 181480 - DNA, 20 bp, Artificial
  CRISPR gRNA sequence
caggattcatatgcaggaaa

SEQ ID NO: 181481 - DNA, 20 bp, Artificial
  CRISPR gRNA sequence
aggattcatatgcaggaaaa

SEQ ID NO: 181482 - DNA, 20 bp, Artificial
  CRISPR gRNA sequence
atatgcaggaaaagagacaa

SEQ ID NO: 181483 - DNA, 20 bp, Artificial
  CRISPR gRNA sequence
atttcagaacttttcgctca

SEQ ID NO: 181484 - DNA, 20 bp, Artificial
  CRISPR gRNA sequence
cagaacttttcgctcaaaat

SEQ ID NO: 181485 - DNA, 20 bp, Artificial
  CRISPR gRNA sequence
agaacttttcgctcaaaatt

SEQ ID NO: 181486 - DNA, 20 bp, Artificial
  CRISPR gRNA sequence
ttcgctcaaaattcaaatcc

SEQ ID NO: 181487 - DNA, 20 bp, Artificial
  CRISPR gRNA sequence
tcgctcaaaattcaaatcct

SEQ ID NO: 181488 - DNA, 20 bp, Artificial
  CRISPR gRNA sequence
cgctcaaaattcaaatcctt

SEQ ID NO: 181489 - DNA, 20 bp, Artificial
  CRISPR gRNA sequence
gctcaaaattcaaatccttt

SEQ ID NO: 181490 - DNA, 20 bp, Artificial
  CRISPR gRNA sequence
aaaattcaaatcctttggga

SEQ ID NO: 181491 - DNA, 20 bp, Artificial
  CRISPR gRNA sequence
aaatcctttgggaagggagg

SEQ ID NO: 181492 - DNA, 20 bp, Artificial
  CRISPR gRNA sequence
tgggaagggagggacttctt

SEQ ID NO: 181493 - DNA, 20 bp, Artificial
  CRISPR gRNA sequence
gggaagggagggacttcttt

SEQ ID NO: 181494 - DNA, 20 bp, Artificial
  CRISPR gRNA sequence
ggaagggagggacttctttt

SEQ ID NO: 181495 - DNA, 20 bp, Artificial
  CRISPR gRNA sequence
cttttgcttgatgccaagaa

SEQ ID NO: 181496 - DNA, 20 bp, Artificial
  CRISPR gRNA sequence
ttttgcttgatgccaagaag

SEQ ID NO: 181497 - DNA, 20 bp, Artificial
  CRISPR gRNA sequence
ttgcttgatgccaagaagaa

SEQ ID NO: 181498 - DNA, 20 bp, Artificial
  CRISPR gRNA sequence
tgcttgatgccaagaagaaa

SEQ ID NO: 181499 - DNA, 20 bp, Artificial
  CRISPR gRNA sequence
gcttgatgccaagaagaaat

SEQ ID NO: 181500 - DNA, 20 bp, Artificial
  CRISPR gRNA sequence
cttgatgccaagaagaaatt

SEQ ID NO: 181501 - DNA, 20 bp, Artificial
  CRISPR gRNA sequence
gatgccaagaagaaattccc

SEQ ID NO: 181502 - DNA, 20 bp, Artificial
  CRISPR gRNA sequence
atgccaagaagaaattccct

SEQ ID NO: 181503 - DNA, 20 bp, Artificial
  CRISPR gRNA sequence
ccttgacttgagttgtaacc

SEQ ID NO: 181504 - DNA, 20 bp, Artificial
  CRISPR gRNA sequence
gacttgagttgtaaccacta

SEQ ID NO: 181505 - DNA, 20 bp, Artificial
  CRISPR gRNA sequence
acttgagttgtaaccactag

SEQ ID NO: 181506 - DNA, 20 bp, Artificial
  CRISPR gRNA sequence
gagttgtaaccactagctag

SEQ ID NO: 181507 - DNA, 20 bp, Artificial
  CRISPR gRNA sequence
agttgtaaccactagctagc

SEQ ID NO: 181508 - DNA, 20 bp, Artificial
  CRISPR gRNA sequence
taaccactagctagcaaagg

SEQ ID NO: 181509 - DNA, 20 bp, Artificial
  CRISPR gRNA sequence
gctagcaaagggctagccgt

SEQ ID NO: 181510 - DNA, 20 bp, Artificial
  CRISPR gRNA sequence
gcaaagggctagccgtcacc

SEQ ID NO: 181511 - DNA, 20 bp, Artificial
  CRISPR gRNA sequence
gccgtcaccctgaacagccc

SEQ ID NO: 181512 - DNA, 20 bp, Artificial
  CRISPR gRNA sequence
aacagccccctcccgccccc

SEQ ID NO: 181513 - DNA, 20 bp, Artificial
  CRISPR gRNA sequence
ccgcccccctgaatccattc

SEQ ID NO: 181514 - DNA, 20 bp, Artificial
  CRISPR gRNA sequence
aatccattctacgccttcct

SEQ ID NO: 181515 - DNA, 20 bp, Artificial
  CRISPR gRNA sequence
tacgccttcctgacagccac

SEQ ID NO: 181516 - DNA, 20 bp, Artificial
  CRISPR gRNA sequence
cgccttcctgacagccacag

SEQ ID NO: 181517 - DNA, 20 bp, Artificial
  CRISPR gRNA sequence
cctgacagccacagcgccca

SEQ ID NO: 181518 - DNA, 20 bp, Artificial
  CRISPR gRNA sequence
ctgacagccacagcgcccac

SEQ ID NO: 181519 - DNA, 20 bp, Artificial
  CRISPR gRNA sequence
acagccacagcgcccacaac

SEQ ID NO: 181520 - DNA, 20 bp, Artificial
  CRISPR gRNA sequence
agaccaggacgctaaccctt

SEQ ID NO: 181521 - DNA, 20 bp, Artificial
  CRISPR gRNA sequence
acccttccggcccggtttcc

SEQ ID NO: 181522 - DNA, 20 bp, Artificial
  CRISPR gRNA sequence
ccggcccggtttcccctcct

SEQ ID NO: 181523 - DNA, 20 bp, Artificial
  CRISPR gRNA sequence
cggcccggtttcccctcctc

SEQ ID NO: 181524 - DNA, 20 bp, Artificial
  CRISPR gRNA sequence
cccctcctctggagaagtgg

SEQ ID NO: 181525 - DNA, 20 bp, Artificial
  CRISPR gRNA sequence
ccctcctctggagaagtggc

SEQ ID NO: 181526 - DNA, 20 bp, Artificial
  CRISPR gRNA sequence
ctctggagaagtggcccaag

SEQ ID NO: 181527 - DNA, 20 bp, Artificial
  CRISPR gRNA sequence
tggagaagtggcccaaggaa

SEQ ID NO: 181528 - DNA, 20 bp, Artificial
  CRISPR gRNA sequence
gagaagtggcccaaggaaca

SEQ ID NO: 181529 - DNA, 20 bp, Artificial
  CRISPR gRNA sequence
tggcgcctcttcccgcagtc

SEQ ID NO: 181530 - DNA, 20 bp, Artificial
  CRISPR gRNA sequence
ttcccgcagtctccgtaggt

SEQ ID NO: 181531 - DNA, 20 bp, Artificial
  CRISPR gRNA sequence
cccgcagtctccgtaggtca

SEQ ID NO: 181532 - DNA, 20 bp, Artificial
  CRISPR gRNA sequence
ccgcagtctccgtaggtcac

SEQ ID NO: 181533 - DNA, 20 bp, Artificial
  CRISPR gRNA sequence
cgtaggtcacgattccctcc

SEQ ID NO: 181534 - DNA, 20 bp, Artificial
  CRISPR gRNA sequence
cctccagccacctgggcagt

SEQ ID NO: 181535 - DNA, 20 bp, Artificial
  CRISPR gRNA sequence
cagccacctgggcagtaagc

SEQ ID NO: 181536 - DNA, 20 bp, Artificial
  CRISPR gRNA sequence
ggcagtaagccagcccttgc

SEQ ID NO: 181537 - DNA, 20 bp, Artificial
  CRISPR gRNA sequence
gccaccagcacagggagccc

SEQ ID NO: 181538 - DNA, 20 bp, Artificial
  CRISPR gRNA sequence
ccaccagcacagggagccca

SEQ ID NO: 181539 - DNA, 20 bp, Artificial
  CRISPR gRNA sequence
tcgcctgggcgcggagctgg

SEQ ID NO: 181540 - DNA, 20 bp, Artificial
  CRISPR gRNA sequence
ggcgcggagctgggaccgcc

SEQ ID NO: 181541 - DNA, 20 bp, Artificial
  CRISPR gRNA sequence
ggaccgccgaaagccgggag

SEQ ID NO: 181542 - DNA, 20 bp, Artificial
  CRISPR gRNA sequence
ggcgcccacgcgtgggctga

SEQ ID NO: 181543 - DNA, 20 bp, Artificial
  CRISPR gRNA sequence
acactcggtccccggcacgg

SEQ ID NO: 181544 - DNA, 20 bp, Artificial
  CRISPR gRNA sequence
ggtccccggcacggcgtgtg

SEQ ID NO: 181545 - DNA, 20 bp, Artificial
  CRISPR gRNA sequence
caggcccctggcggctgcgc

SEQ ID NO: 181546 - DNA, 20 bp, Artificial
  CRISPR gRNA sequence
gcggctgcgcgcacgcagat

SEQ ID NO: 181547 - DNA, 20 bp, Artificial
  CRISPR gRNA sequence
cgcgcacgcagatctgcgaa

SEQ ID NO: 181548 - DNA, 20 bp, Artificial
  CRISPR gRNA sequence
cgaaagctgccgggcgccgg

SEQ ID NO: 181549 - DNA, 20 bp, Artificial
  CRISPR gRNA sequence
ccgggcgccggcagcctcgt

SEQ ID NO: 181550 - DNA, 20 bp, Artificial
  CRISPR gRNA sequence
gtccgggtgggcggtccacg

SEQ ID NO: 181551 - DNA, 20 bp, Artificial
  CRISPR gRNA sequence
cccgcgccgcggcccgcggc

SEQ ID NO: 181552 - DNA, 20 bp, Artificial
  CRISPR gRNA sequence
gcagctcctccggcgccccc

SEQ ID NO: 181553 - DNA, 20 bp, Artificial
  CRISPR gRNA sequence
ctccggcgccccccggagcc

SEQ ID NO: 181554 - DNA, 20 bp, Artificial
  CRISPR gRNA sequence
cggcgccccccggagcccgc

SEQ ID NO: 181555 - DNA, 20 bp, Artificial
  CRISPR gRNA sequence
cagcctggagctttcgaccc

SEQ ID NO: 181556 - DNA, 20 bp, Artificial
  CRISPR gRNA sequence
gagctttcgaccccccactt

SEQ ID NO: 181557 - DNA, 20 bp, Artificial
  CRISPR gRNA sequence
tcgaccccccacttcctggt

SEQ ID NO: 181558 - DNA, 20 bp, Artificial
  CRISPR gRNA sequence
cgaccccccacttcctggtg

SEQ ID NO: 181559 - DNA, 20 bp, Artificial
  CRISPR gRNA sequence
gaccccccacttcctggtgc

SEQ ID NO: 181560 - DNA, 20 bp, Artificial
  CRISPR gRNA sequence
cctggtgccccgcgcgcctt

SEQ ID NO: 181561 - DNA, 20 bp, Artificial
  CRISPR gRNA sequence
ctggtgccccgcgcgccttt

SEQ ID NO: 181562 - DNA, 20 bp, Artificial
  CRISPR gRNA sequence
gtgccccgcgcgccttttat

SEQ ID NO: 181563 - DNA, 20 bp, Artificial
  CRISPR gRNA sequence
ttattcgacgccgccggtgc

SEQ ID NO: 181564 - DNA, 20 bp, Artificial
  CRISPR gRNA sequence
tattcgacgccgccggtgcc

SEQ ID NO: 181565 - DNA, 20 bp, Artificial
  CRISPR gRNA sequence
attcgacgccgccggtgccc

SEQ ID NO: 181566 - DNA, 20 bp, Artificial
  CRISPR gRNA sequence
ttcgacgccgccggtgcccc

SEQ ID NO: 181567 - DNA, 20 bp, Artificial
  CRISPR gRNA sequence
gacgccgccggtgccccgcg

SEQ ID NO: 181568 - DNA, 20 bp, Artificial
  CRISPR gRNA sequence
aaaggcgtactcacctctgc

SEQ ID NO: 181569 - DNA, 20 bp, Artificial
  CRISPR gRNA sequence
acctctgctgcaggagcgat

SEQ ID NO: 181570 - DNA, 20 bp, Artificial
  CRISPR gRNA sequence
tgctgcaggagcgattcggc

SEQ ID NO: 181571 - DNA, 20 bp, Artificial
  CRISPR gRNA sequence
ctgcaggagcgattcggcgg

SEQ ID NO: 181572 - DNA, 20 bp, Artificial
  CRISPR gRNA sequence
caggagcgattcggcggtcg

SEQ ID NO: 181573 - DNA, 20 bp, Artificial
  CRISPR gRNA sequence
ggcggtcgcgcgcgagggtc

SEQ ID NO: 181574 - DNA, 20 bp, Artificial
  CRISPR gRNA sequence
cagtgagggcgcgcggagcg

SEQ ID NO: 181575 - DNA, 20 bp, Artificial
  CRISPR gRNA sequence
cgagtggaagagggaagaag

SEQ ID NO: 181576 - DNA, 20 bp, Artificial
  CRISPR gRNA sequence
ccgggttcttaaggccgccg

SEQ ID NO: 181577 - DNA, 20 bp, Artificial
  CRISPR gRNA sequence
ttaaggccgccgggcacggc

SEQ ID NO: 181578 - DNA, 20 bp, Artificial
  CRISPR gRNA sequence
aaggccgccgggcacggccg

SEQ ID NO: 181579 - DNA, 20 bp, Artificial
  CRISPR gRNA sequence
aggccgccgggcacggccgg

SEQ ID NO: 181580 - DNA, 20 bp, Artificial
  CRISPR gRNA sequence
ggcacggctccgggtggcct

SEQ ID NO: 181581 - DNA, 20 bp, Artificial
  CRISPR gRNA sequence
cgggtggcctcggttcggcg

SEQ ID NO: 181582 - DNA, 20 bp, Artificial
  CRISPR gRNA sequence
ggttcggcggggctcgggcg

SEQ ID NO: 181583 - DNA, 20 bp, Artificial
  CRISPR gRNA sequence
ggcggggctcgggcgcacgt

SEQ ID NO: 181584 - DNA, 20 bp, Artificial
  CRISPR gRNA sequence
gggcgcacgtcttgcctcga

SEQ ID NO: 181585 - DNA, 20 bp, Artificial
  CRISPR gRNA sequence
gcctcgactaaggagtggcg

SEQ ID NO: 181586 - DNA, 20 bp, Artificial
  CRISPR gRNA sequence
cctcgactaaggagtggcga

SEQ ID NO: 181587 - DNA, 20 bp, Artificial
  CRISPR gRNA sequence
gactaaggagtggcgagctc

SEQ ID NO: 181588 - DNA, 20 bp, Artificial
  CRISPR gRNA sequence
aggagtggcgagctctgcca

SEQ ID NO: 181589 - DNA, 20 bp, Artificial
  CRISPR gRNA sequence
tgccagggcagcggcgccac

SEQ ID NO: 181590 - DNA, 20 bp, Artificial
  CRISPR gRNA sequence
ccagggcagcggcgccaccg

SEQ ID NO: 181591 - DNA, 20 bp, Artificial
  CRISPR gRNA sequence
agcgggattccccagccctg

SEQ ID NO: 181592 - DNA, 20 bp, Artificial
  CRISPR gRNA sequence
gcgggattccccagccctgg

SEQ ID NO: 181593 - DNA, 20 bp, Artificial
  CRISPR gRNA sequence
cccagccctggccggccccg

SEQ ID NO: 181594 - DNA, 20 bp, Artificial
  CRISPR gRNA sequence
gccggccccgcccccggaca

SEQ ID NO: 181595 - DNA, 20 bp, Artificial
  CRISPR gRNA sequence
tccgggggcggggccggcca

SEQ ID NO: 181596 - DNA, 20 bp, Artificial
  CRISPR gRNA sequence
gggaatcccgctaagtgttt

SEQ ID NO: 181597 - DNA, 20 bp, Artificial
  CRISPR gRNA sequence
agtgtttggattgctcggtg

SEQ ID NO: 181598 - DNA, 20 bp, Artificial
  CRISPR gRNA sequence
ggattgctcggtggcgccgc

SEQ ID NO: 181599 - DNA, 20 bp, Artificial
  CRISPR gRNA sequence
gattgctcggtggcgccgct

SEQ ID NO: 181600 - DNA, 20 bp, Artificial
  CRISPR gRNA sequence
ctcggtggcgccgctgccct

SEQ ID NO: 181601 - DNA, 20 bp, Artificial
  CRISPR gRNA sequence
ggtggcgccgctgccctggc

SEQ ID NO: 181602 - DNA, 20 bp, Artificial
  CRISPR gRNA sequence
ccctggcagagctcgccact

SEQ ID NO: 181603 - DNA, 20 bp, Artificial
  CRISPR gRNA sequence
gcagagctcgccactcctta

SEQ ID NO: 181604 - DNA, 20 bp, Artificial
  CRISPR gRNA sequence
gccactccttagtcgaggca

SEQ ID NO: 181605 - DNA, 20 bp, Artificial
  CRISPR gRNA sequence
cttagtcgaggcaagacgtg

SEQ ID NO: 181606 - DNA, 20 bp, Artificial
  CRISPR gRNA sequence
agtcgaggcaagacgtgcgc

SEQ ID NO: 181607 - DNA, 20 bp, Artificial
  CRISPR gRNA sequence
gtcgaggcaagacgtgcgcc

SEQ ID NO: 181608 - DNA, 20 bp, Artificial
  CRISPR gRNA sequence
aagaacccggcaacctctgc

SEQ ID NO: 181609 - DNA, 20 bp, Artificial
  CRISPR gRNA sequence
agaacccggcaacctctgcc

SEQ ID NO: 181610 - DNA, 20 bp, Artificial
  CRISPR gRNA sequence
tgccttcttccctcttccac

SEQ ID NO: 181611 - DNA, 20 bp, Artificial
  CRISPR gRNA sequence
ccttcttccctcttccactc

SEQ ID NO: 181612 - DNA, 20 bp, Artificial
  CRISPR gRNA sequence
cttccctcttccactcggag

SEQ ID NO: 181613 - DNA, 20 bp, Artificial
  CRISPR gRNA sequence
ttccctcttccactcggagt

SEQ ID NO: 181614 - DNA, 20 bp, Artificial
  CRISPR gRNA sequence
ccctcttccactcggagtcg

SEQ ID NO: 181615 - DNA, 20 bp, Artificial
  CRISPR gRNA sequence
cctcttccactcggagtcgc

SEQ ID NO: 181616 - DNA, 20 bp, Artificial
  CRISPR gRNA sequence
ttccactcggagtcgcgctc

SEQ ID NO: 181617 - DNA, 20 bp, Artificial
  CRISPR gRNA sequence
ccactcggagtcgcgctccg

SEQ ID NO: 181618 - DNA, 20 bp, Artificial
  CRISPR gRNA sequence
cactcggagtcgcgctccgc

SEQ ID NO: 181619 - DNA, 20 bp, Artificial
  CRISPR gRNA sequence
ggagtcgcgctccgcgcgcc

SEQ ID NO: 181620 - DNA, 20 bp, Artificial
  CRISPR gRNA sequence
cgcgcgccctcactgcagcc

SEQ ID NO: 181621 - DNA, 20 bp, Artificial
  CRISPR gRNA sequence
actgcagcccctgcgtcgcc

SEQ ID NO: 181622 - DNA, 20 bp, Artificial
  CRISPR gRNA sequence
cagcccctgcgtcgccggga

SEQ ID NO: 181623 - DNA, 20 bp, Artificial
  CRISPR gRNA sequence
cgtcgccgggaccctcgcgc

SEQ ID NO: 181624 - DNA, 20 bp, Artificial
  CRISPR gRNA sequence
gcgcgcgaccgccgaatcgc

SEQ ID NO: 181625 - DNA, 20 bp, Artificial
  CRISPR gRNA sequence
ctgcagcagaggtgagtacg

SEQ ID NO: 181626 - DNA, 20 bp, Artificial
  CRISPR gRNA sequence
cagcagaggtgagtacgcct

SEQ ID NO: 181627 - DNA, 20 bp, Artificial
  CRISPR gRNA sequence
tgaggcgcggggcaccggcg

SEQ ID NO: 181628 - DNA, 20 bp, Artificial
  CRISPR gRNA sequence
gaggcgcggggcaccggcgg

SEQ ID NO: 181629 - DNA, 20 bp, Artificial
  CRISPR gRNA sequence
aggcgcggggcaccggcggc

SEQ ID NO: 181630 - DNA, 20 bp, Artificial
  CRISPR gRNA sequence
caggctggagactcgccggc

SEQ ID NO: 181631 - DNA, 20 bp, Artificial
  CRISPR gRNA sequence
gagactcgccggcgcgcggc

SEQ ID NO: 181632 - DNA, 20 bp, Artificial
  CRISPR gRNA sequence
gccggcgcgcggcgttgccc

SEQ ID NO: 181633 - DNA, 20 bp, Artificial
  CRISPR gRNA sequence
cccgggcctccgcgcgggct

SEQ ID NO: 181634 - DNA, 20 bp, Artificial
  CRISPR gRNA sequence
cgcgcgggctccggggggcg

SEQ ID NO: 181635 - DNA, 20 bp, Artificial
  CRISPR gRNA sequence
cggggggcgccggaggagct

SEQ ID NO: 181636 - DNA, 20 bp, Artificial
  CRISPR gRNA sequence
cgagccgcgggccgcggcgc

SEQ ID NO: 181637 - DNA, 20 bp, Artificial
  CRISPR gRNA sequence
ccggcgcccggcagctttcg

SEQ ID NO: 181638 - DNA, 20 bp, Artificial
  CRISPR gRNA sequence
tcgcagatctgcgtgcgcgc

SEQ ID NO: 181639 - DNA, 20 bp, Artificial
  CRISPR gRNA sequence
cgcagatctgcgtgcgcgca

SEQ ID NO: 181640 - DNA, 20 bp, Artificial
  CRISPR gRNA sequence
gcagatctgcgtgcgcgcag

SEQ ID NO: 181641 - DNA, 20 bp, Artificial
  CRISPR gRNA sequence
cgtgcgcgcagccgccaggg

SEQ ID NO: 181642 - DNA, 20 bp, Artificial
  CRISPR gRNA sequence
taggtggcccgctatgttcg

SEQ ID NO: 181643 - DNA, 20 bp, Artificial
  CRISPR gRNA sequence
tgttcgtcccgcgcatccac

SEQ ID NO: 181644 - DNA, 20 bp, Artificial
  CRISPR gRNA sequence
gtcccgcgcatccacacgcc

SEQ ID NO: 181645 - DNA, 20 bp, Artificial
  CRISPR gRNA sequence
ccggctttcggcggtcccag

SEQ ID NO: 181646 - DNA, 20 bp, Artificial
  CRISPR gRNA sequence
tcggcggtcccagctccgcg

SEQ ID NO: 181647 - DNA, 20 bp, Artificial
  CRISPR gRNA sequence
cggcggtcccagctccgcgc

SEQ ID NO: 181648 - DNA, 20 bp, Artificial
  CRISPR gRNA sequence
ggcggtcccagctccgcgcc

SEQ ID NO: 181649 - DNA, 20 bp, Artificial
  CRISPR gRNA sequence
cgcgcccaggcgacaggttt

SEQ ID NO: 181650 - DNA, 20 bp, Artificial
  CRISPR gRNA sequence
tgggctccctgtgctggtgg

SEQ ID NO: 181651 - DNA, 20 bp, Artificial
  CRISPR gRNA sequence
gggctccctgtgctggtggc

SEQ ID NO: 181652 - DNA, 20 bp, Artificial
  CRISPR gRNA sequence
ggctccctgtgctggtggca

SEQ ID NO: 181653 - DNA, 20 bp, Artificial
  CRISPR gRNA sequence
cctgtgctggtggcaagggc

SEQ ID NO: 181654 - DNA, 20 bp, Artificial
  CRISPR gRNA sequence
tgctggtggcaagggctggc

SEQ ID NO: 181655 - DNA, 20 bp, Artificial
  CRISPR gRNA sequence
gtggcaagggctggcttact

SEQ ID NO: 181656 - DNA, 20 bp, Artificial
  CRISPR gRNA sequence
gcttactgcccaggtggctg

SEQ ID NO: 181657 - DNA, 20 bp, Artificial
  CRISPR gRNA sequence
actgcccaggtggctggagg

SEQ ID NO: 181658 - DNA, 20 bp, Artificial
  CRISPR gRNA sequence
ctgcccaggtggctggaggg

SEQ ID NO: 181659 - DNA, 20 bp, Artificial
  CRISPR gRNA sequence
cccaggtggctggagggaat

SEQ ID NO: 181660 - DNA, 20 bp, Artificial
  CRISPR gRNA sequence
gagggaatcgtgacctacgg

SEQ ID NO: 181661 - DNA, 20 bp, Artificial
  CRISPR gRNA sequence
cggagactgcgggaagaggc

SEQ ID NO: 181662 - DNA, 20 bp, Artificial
  CRISPR gRNA sequence
cgggaagaggcgccacaggt

SEQ ID NO: 181663 - DNA, 20 bp, Artificial
  CRISPR gRNA sequence
cttgggccacttctccagag

SEQ ID NO: 181664 - DNA, 20 bp, Artificial
  CRISPR gRNA sequence
gggccacttctccagaggag

SEQ ID NO: 181665 - DNA, 20 bp, Artificial
  CRISPR gRNA sequence
ggccacttctccagaggagg

SEQ ID NO: 181666 - DNA, 20 bp, Artificial
  CRISPR gRNA sequence
ctccagaggaggggaaaccg

SEQ ID NO: 181667 - DNA, 20 bp, Artificial
  CRISPR gRNA sequence
tccagaggaggggaaaccgg

SEQ ID NO: 181668 - DNA, 20 bp, Artificial
  CRISPR gRNA sequence
cagaggaggggaaaccgggc

SEQ ID NO: 181669 - DNA, 20 bp, Artificial
  CRISPR gRNA sequence
gcgtcctggtcttagcgttg

SEQ ID NO: 181670 - DNA, 20 bp, Artificial
  CRISPR gRNA sequence
gtcttagcgttgtgggcgct

SEQ ID NO: 181671 - DNA, 20 bp, Artificial
  CRISPR gRNA sequence
agcgttgtgggcgctgtggc

SEQ ID NO: 181672 - DNA, 20 bp, Artificial
  CRISPR gRNA sequence
gcgttgtgggcgctgtggct

SEQ ID NO: 181673 - DNA, 20 bp, Artificial
  CRISPR gRNA sequence
tgggcgctgtggctgtcagg

SEQ ID NO: 181674 - DNA, 20 bp, Artificial
  CRISPR gRNA sequence
tggctgtcaggaaggcgtag

SEQ ID NO: 181675 - DNA, 20 bp, Artificial
  CRISPR gRNA sequence
tcaggaaggcgtagaatgga

SEQ ID NO: 181676 - DNA, 20 bp, Artificial
  CRISPR gRNA sequence
aggggggcgggagggggctg

SEQ ID NO: 181677 - DNA, 20 bp, Artificial
  CRISPR gRNA sequence
ttcagggtgacggctagccc

SEQ ID NO: 181678 - DNA, 20 bp, Artificial
  CRISPR gRNA sequence
agggtgacggctagcccttt

SEQ ID NO: 181679 - DNA, 20 bp, Artificial
  CRISPR gRNA sequence
gccctttgctagctagtggt

SEQ ID NO: 181680 - DNA, 20 bp, Artificial
  CRISPR gRNA sequence
tgctagctagtggttacaac

SEQ ID NO: 181681 - DNA, 20 bp, Artificial
  CRISPR gRNA sequence
gctagctagtggttacaact

SEQ ID NO: 181682 - DNA, 20 bp, Artificial
  CRISPR gRNA sequence
ctagctagtggttacaactc

SEQ ID NO: 181683 - DNA, 20 bp, Artificial
  CRISPR gRNA sequence
gctagtggttacaactcaag

SEQ ID NO: 181684 - DNA, 20 bp, Artificial
  CRISPR gRNA sequence
gtggttacaactcaagtcaa

SEQ ID NO: 181685 - DNA, 20 bp, Artificial
  CRISPR gRNA sequence
caactcaagtcaagggaatt

SEQ ID NO: 181686 - DNA, 20 bp, Artificial
  CRISPR gRNA sequence
aagtcaagggaatttcttct

SEQ ID NO: 181687 - DNA, 20 bp, Artificial
  CRISPR gRNA sequence
cttcttggcatcaagcaaaa

SEQ ID NO: 181688 - DNA, 20 bp, Artificial
  CRISPR gRNA sequence
ttcttggcatcaagcaaaag

SEQ ID NO: 181689 - DNA, 20 bp, Artificial
  CRISPR gRNA sequence
cttggcatcaagcaaaagaa

SEQ ID NO: 181690 - DNA, 20 bp, Artificial
  CRISPR gRNA sequence
ttggcatcaagcaaaagaag

SEQ ID NO: 181691 - DNA, 20 bp, Artificial
  CRISPR gRNA sequence
ggcatcaagcaaaagaagtc

SEQ ID NO: 181692 - DNA, 20 bp, Artificial
  CRISPR gRNA sequence
gcatcaagcaaaagaagtcc

SEQ ID NO: 181693 - DNA, 20 bp, Artificial
  CRISPR gRNA sequence
ccttcccaaaggatttgaat

SEQ ID NO: 181694 - DNA, 20 bp, Artificial
  CRISPR gRNA sequence
cccaaaggatttgaattttg

SEQ ID NO: 181695 - DNA, 20 bp, Artificial
  CRISPR gRNA sequence
ccaaaggatttgaattttga

SEQ ID NO: 181696 - DNA, 20 bp, Artificial
  CRISPR gRNA sequence
gaattttgagcgaaaagttc

SEQ ID NO: 181697 - DNA, 20 bp, Artificial
  CRISPR gRNA sequence
aattttgagcgaaaagttct

SEQ ID NO: 181698 - DNA, 20 bp, Artificial
  CRISPR gRNA sequence
tgagcgaaaagttctgaaat

SEQ ID NO: 181699 - DNA, 20 bp, Artificial
  CRISPR gRNA sequence
gagcgaaaagttctgaaatt

SEQ ID NO: 181700 - DNA, 20 bp, Artificial
  CRISPR gRNA sequence
agcgaaaagttctgaaatta

SEQ ID NO: 181701 - DNA, 20 bp, Artificial
  CRISPR gRNA sequence
tgaaattagggtatctgtgc

SEQ ID NO: 181702 - DNA, 20 bp, Artificial
  CRISPR gRNA sequence
aaattagggtatctgtgcat

SEQ ID NO: 181703 - DNA, 20 bp, Artificial
  CRISPR gRNA sequence
gggtatctgtgcattttgtc

SEQ ID NO: 181704 - DNA, 20 bp, Artificial
  CRISPR gRNA sequence
tgcattttgtctcttttcct

SEQ ID NO: 181705 - DNA, 20 bp, Artificial
  CRISPR gRNA sequence
tgtctcttttcctgcatatg

SEQ ID NO: 181706 - DNA, 20 bp, Artificial
  CRISPR gRNA sequence
gtctcttttcctgcatatga

SEQ ID NO: 181707 - DNA, 20 bp, Artificial
  CRISPR gRNA sequence
tctcttttcctgcatatgaa

SEQ ID NO: 181708 - DNA, 20 bp, Artificial
  CRISPR gRNA sequence
ttttcctgcatatgaatcct

SEQ ID NO: 181709 - DNA, 20 bp, Artificial
  CRISPR gRNA sequence
ttcctgcatatgaatcctga

SEQ ID NO: 181710 - DNA, 20 bp, Artificial
  CRISPR gRNA sequence
tcctgcatatgaatcctgaa

SEQ ID NO: 181711 - DNA, 20 bp, Artificial
  CRISPR gRNA sequence
cctgcatatgaatcctgaag

SEQ ID NO: 181712 - DNA, 20 bp, Artificial
  CRISPR gRNA sequence
ctgcatatgaatcctgaagc

SEQ ID NO: 181713 - DNA, 20 bp, Artificial
  CRISPR gRNA sequence
catatgaatcctgaagccat

SEQ ID NO: 181714 - DNA, 20 bp, Artificial
  CRISPR gRNA sequence
aagccatcacttgcatgcct

SEQ ID NO: 181715 - DNA, 20 bp, Artificial
  CRISPR gRNA sequence
gcatgcctgtctcctccaga

SEQ ID NO: 181716 - DNA, 20 bp, Artificial
  CRISPR gRNA sequence
catgcctgtctcctccagag

SEQ ID NO: 181717 - DNA, 20 bp, Artificial
  CRISPR gRNA sequence
tctcctccagagactggctg

SEQ ID NO: 181718 - DNA, 20 bp, Artificial
  CRISPR gRNA sequence
ctccagagactggctgggag

SEQ ID NO: 181719 - DNA, 20 bp, Artificial
  CRISPR gRNA sequence
cagagactggctgggagggg

SEQ ID NO: 181720 - DNA, 20 bp, Artificial
  CRISPR gRNA sequence
gctgggaggggctgaaggaa

SEQ ID NO: 181721 - DNA, 20 bp, Artificial
  CRISPR gRNA sequence
ggaggggctgaaggaagggg

SEQ ID NO: 181722 - DNA, 20 bp, Artificial
  CRISPR gRNA sequence
aaggaaggggcaaaagcatt

SEQ ID NO: 181723 - DNA, 20 bp, Artificial
  CRISPR gRNA sequence
ttgcctaagatgctgaaaaa

SEQ ID NO: 181724 - DNA, 20 bp, Artificial
  CRISPR gRNA sequence
tgcctaagatgctgaaaaaa

SEQ ID NO: 181725 - DNA, 20 bp, Artificial
  CRISPR gRNA sequence
gcctaagatgctgaaaaaat

SEQ ID NO: 181726 - DNA, 20 bp, Artificial
  CRISPR gRNA sequence
cctaagatgctgaaaaaatt

SEQ ID NO: 181727 - DNA, 20 bp, Artificial
  CRISPR gRNA sequence
agatgctgaaaaaatttgga

SEQ ID NO: 181728 - DNA, 20 bp, Artificial
  CRISPR gRNA sequence
aaaaaatttggagagcagtt

SEQ ID NO: 181729 - DNA, 20 bp, Artificial
  CRISPR gRNA sequence
ggagagcagttttattccag

SEQ ID NO: 181730 - DNA, 20 bp, Artificial
  CRISPR gRNA sequence
gagagcagttttattccagc

SEQ ID NO: 181731 - DNA, 20 bp, Artificial
  CRISPR gRNA sequence
tattccagcgcagctcccct

SEQ ID NO: 181732 - DNA, 20 bp, Artificial
  CRISPR gRNA sequence
attccagcgcagctcccctc

SEQ ID NO: 181733 - DNA, 20 bp, Artificial
  CRISPR gRNA sequence
ttccagcgcagctcccctcc

SEQ ID NO: 181734 - DNA, 20 bp, Artificial
  CRISPR gRNA sequence
cagcgcagctcccctccgca

SEQ ID NO: 181735 - DNA, 20 bp, Artificial
  CRISPR gRNA sequence
ccctccgcactgagtgtagt

SEQ ID NO: 181736 - DNA, 20 bp, Artificial
  CRISPR gRNA sequence
cgcactgagtgtagtaccta

SEQ ID NO: 181737 - DNA, 20 bp, Artificial
  CRISPR gRNA sequence
agtgtagtacctagcagctg

SEQ ID NO: 181738 - DNA, 20 bp, Artificial
  CRISPR gRNA sequence
gcagctggctgaggtgaggg

SEQ ID NO: 181739 - DNA, 20 bp, Artificial
  CRISPR gRNA sequence
gctgaggtgaggggagggta

SEQ ID NO: 181740 - DNA, 20 bp, Artificial
  CRISPR gRNA sequence
aggtgaggggagggtaacta

SEQ ID NO: 181741 - DNA, 20 bp, Artificial
  CRISPR gRNA sequence
agtgacctcgggtggggcag

SEQ ID NO: 181742 - DNA, 20 bp, Artificial
  CRISPR gRNA sequence
gggtggggcaggtcactgcc

SEQ ID NO: 181743 - DNA, 20 bp, Artificial
  CRISPR gRNA sequence
cccaggtactgttcaacaga

SEQ ID NO: 181744 - DNA, 20 bp, Artificial
  CRISPR gRNA sequence
ttcaacagattccagactgg

SEQ ID NO: 181745 - DNA, 20 bp, Artificial
  CRISPR gRNA sequence
aacagattccagactggagc

SEQ ID NO: 181746 - DNA, 20 bp, Artificial
  CRISPR gRNA sequence
cagactggagcctctgtgtt

SEQ ID NO: 181747 - DNA, 20 bp, Artificial
  CRISPR gRNA sequence
gagcctctgtgttctcttta

SEQ ID NO: 181748 - DNA, 20 bp, Artificial
  CRISPR gRNA sequence
tgtgttctctttacagccaa

SEQ ID NO: 181749 - DNA, 20 bp, Artificial
  CRISPR gRNA sequence
tgttctctttacagccaaca

SEQ ID NO: 181750 - DNA, 20 bp, Artificial
  CRISPR gRNA sequence
tctttacagccaacatgccc

SEQ ID NO: 181751 - DNA, 20 bp, Artificial
  CRISPR gRNA sequence
tttacagccaacatgcccat

SEQ ID NO: 181752 - DNA, 20 bp, Artificial
  CRISPR gRNA sequence
tacagccaacatgcccatca

SEQ ID NO: 181753 - DNA, 20 bp, Artificial
  CRISPR gRNA sequence
acagccaacatgcccatcac

SEQ ID NO: 181754 - DNA, 20 bp, Artificial
  CRISPR gRNA sequence
cagccaacatgcccatcact

SEQ ID NO: 181755 - DNA, 20 bp, Artificial
  CRISPR gRNA sequence
ggatgcgcatgagaccctgg

SEQ ID NO: 181756 - DNA, 20 bp, Artificial
  CRISPR gRNA sequence
gctagagatgcagattaatt

SEQ ID NO: 181757 - DNA, 20 bp, Artificial
  CRISPR gRNA sequence
gagatgcagattaattccaa

SEQ ID NO: 181758 - DNA, 20 bp, Artificial
  CRISPR gRNA sequence
attccaaccaaatcccgggg

SEQ ID NO: 181759 - DNA, 20 bp, Artificial
  CRISPR gRNA sequence
caaccaaatcccggggctca

SEQ ID NO: 181760 - DNA, 20 bp, Artificial
  CRISPR gRNA sequence
atctggattaataaagtgag

SEQ ID NO: 181761 - DNA, 20 bp, Artificial
  CRISPR gRNA sequence
gattaataaagtgagtgtaa

SEQ ID NO: 181762 - DNA, 20 bp, Artificial
  CRISPR gRNA sequence
ataaagtgagtgtaactctt

SEQ ID NO: 181763 - DNA, 20 bp, Artificial
  CRISPR gRNA sequence
tttgggttttcctgccactg

SEQ ID NO: 181764 - DNA, 20 bp, Artificial
  CRISPR gRNA sequence
tgggttttcctgccactgtt

SEQ ID NO: 181765 - DNA, 20 bp, Artificial
  CRISPR gRNA sequence
gggttttcctgccactgttt

SEQ ID NO: 181766 - DNA, 20 bp, Artificial
  CRISPR gRNA sequence
ggttttcctgccactgtttt

SEQ ID NO: 181767 - DNA, 20 bp, Artificial
  CRISPR gRNA sequence
tcctgccactgttttaaccc

SEQ ID NO: 181768 - DNA, 20 bp, Artificial
  CRISPR gRNA sequence
cctgccactgttttaaccca

SEQ ID NO: 181769 - DNA, 20 bp, Artificial
  CRISPR gRNA sequence
ctgccactgttttaacccat

SEQ ID NO: 181770 - DNA, 20 bp, Artificial
  CRISPR gRNA sequence
ccactgttttaacccatgta

SEQ ID NO: 181771 - DNA, 20 bp, Artificial
  CRISPR gRNA sequence
ttttaacccatgtacttctg

SEQ ID NO: 181772 - DNA, 20 bp, Artificial
  CRISPR gRNA sequence
taacccatgtacttctggag

SEQ ID NO: 181773 - DNA, 20 bp, Artificial
  CRISPR gRNA sequence
aacccatgtacttctggagg

SEQ ID NO: 181774 - DNA, 20 bp, Artificial
  CRISPR gRNA sequence
acccatgtacttctggaggg

SEQ ID NO: 181775 - DNA, 20 bp, Artificial
  CRISPR gRNA sequence
ctggagggaccaaagcttca

SEQ ID NO: 181776 - DNA, 20 bp, Artificial
  CRISPR gRNA sequence
tggagggaccaaagcttcag

SEQ ID NO: 181777 - DNA, 20 bp, Artificial
  CRISPR gRNA sequence
gagggaccaaagcttcagat

SEQ ID NO: 181778 - DNA, 20 bp, Artificial
  CRISPR gRNA sequence
cagatgcagctcaaaaaggg

SEQ ID NO: 181779 - DNA, 20 bp, Artificial
  CRISPR gRNA sequence
agatgcagctcaaaaaggga

SEQ ID NO: 181780 - DNA, 20 bp, Artificial
  CRISPR gRNA sequence
aaaaagggaagtgataacgg

SEQ ID NO: 181781 - DNA, 20 bp, Artificial
  CRISPR gRNA sequence
ctcccagtgggtcctgcatg

SEQ ID NO: 181782 - DNA, 20 bp, Artificial
  CRISPR gRNA sequence
tcccagtgggtcctgcatgc

SEQ ID NO: 181783 - DNA, 20 bp, Artificial
  CRISPR gRNA sequence
ccagtgggtcctgcatgcag

SEQ ID NO: 181784 - DNA, 20 bp, Artificial
  CRISPR gRNA sequence
catgcagggagtgtgcacgg

SEQ ID NO: 181785 - DNA, 20 bp, Artificial
  CRISPR gRNA sequence
ggcctcacttgcatgactcc

SEQ ID NO: 181786 - DNA, 20 bp, Artificial
  CRISPR gRNA sequence
acttgcatgactcctgcctt

SEQ ID NO: 181787 - DNA, 20 bp, Artificial
  CRISPR gRNA sequence
gcatgactcctgccttcttc

SEQ ID NO: 181788 - DNA, 20 bp, Artificial
  CRISPR gRNA sequence
catgactcctgccttcttcc

SEQ ID NO: 181789 - DNA, 20 bp, Artificial
  CRISPR gRNA sequence
ctgccttcttcccttcttga

SEQ ID NO: 181790 - DNA, 20 bp, Artificial
  CRISPR gRNA sequence
ccttcttcccttcttgaggt

SEQ ID NO: 181791 - DNA, 20 bp, Artificial
  CRISPR gRNA sequence
cttcccttcttgaggtaggg

SEQ ID NO: 181792 - DNA, 20 bp, Artificial
  CRISPR gRNA sequence
ttcccttcttgaggtagggc

SEQ ID NO: 181793 - DNA, 20 bp, Artificial
  CRISPR gRNA sequence
cccttcttgaggtagggcac

SEQ ID NO: 181794 - DNA, 20 bp, Artificial
  CRISPR gRNA sequence
ccttcttgaggtagggcacc

SEQ ID NO: 181795 - DNA, 20 bp, Artificial
  CRISPR gRNA sequence
cttgaggtagggcacccacc

SEQ ID NO: 181796 - DNA, 20 bp, Artificial
  CRISPR gRNA sequence
ttgaggtagggcacccacct

SEQ ID NO: 181797 - DNA, 20 bp, Artificial
  CRISPR gRNA sequence
gaggtagggcacccacctga

SEQ ID NO: 181798 - DNA, 20 bp, Artificial
  CRISPR gRNA sequence
aggtagggcacccacctgaa

SEQ ID NO: 181799 - DNA, 20 bp, Artificial
  CRISPR gRNA sequence
aaggcacttccagtttccag

SEQ ID NO: 181800 - DNA, 20 bp, Artificial
  CRISPR gRNA sequence
ccagtttccagcagcaagac

SEQ ID NO: 181801 - DNA, 20 bp, Artificial
  CRISPR gRNA sequence
cagtttccagcagcaagact

SEQ ID NO: 181802 - DNA, 20 bp, Artificial
  CRISPR gRNA sequence
ccagcagcaagactttccag

SEQ ID NO: 181803 - DNA, 20 bp, Artificial
  CRISPR gRNA sequence
cagcagcaagactttccagc

SEQ ID NO: 181804 - DNA, 20 bp, Artificial
  CRISPR gRNA sequence
tccagcatctgcagagctgg

SEQ ID NO: 181805 - DNA, 20 bp, Artificial
  CRISPR gRNA sequence
ccagcatctgcagagctgga

SEQ ID NO: 181806 - DNA, 20 bp, Artificial
  CRISPR gRNA sequence
cagcatctgcagagctggag

SEQ ID NO: 181807 - DNA, 20 bp, Artificial
  CRISPR gRNA sequence
cagagctggagttctgctct

SEQ ID NO: 181808 - DNA, 20 bp, Artificial
  CRISPR gRNA sequence
gagttctgctctcctctaag

SEQ ID NO: 181809 - DNA, 20 bp, Artificial
  CRISPR gRNA sequence
tgctctcctctaagcgagac

SEQ ID NO: 181810 - DNA, 20 bp, Artificial
  CRISPR gRNA sequence
ctctcctctaagcgagaccc

SEQ ID NO: 181811 - DNA, 20 bp, Artificial
  CRISPR gRNA sequence
tcctctaagcgagaccctta

SEQ ID NO: 181812 - DNA, 20 bp, Artificial
  CRISPR gRNA sequence
ctctaagcgagacccttaca

SEQ ID NO: 181813 - DNA, 20 bp, Artificial
  CRISPR gRNA sequence
taagcgagacccttacaaac

SEQ ID NO: 181814 - DNA, 20 bp, Artificial
  CRISPR gRNA sequence
agcgagacccttacaaacat

SEQ ID NO: 181815 - DNA, 20 bp, Artificial
  CRISPR gRNA sequence
acaaacatacacagcactct

SEQ ID NO: 181816 - DNA, 20 bp, Artificial
  CRISPR gRNA sequence
caaacatacacagcactctg

SEQ ID NO: 181817 - DNA, 20 bp, Artificial
  CRISPR gRNA sequence
tgcagggctccaatcgaaca

SEQ ID NO: 181818 - DNA, 20 bp, Artificial
  CRISPR gRNA sequence
cagggctccaatcgaacaaa

SEQ ID NO: 181819 - DNA, 20 bp, Artificial
  CRISPR gRNA sequence
caatcgaacaaatagaagac

SEQ ID NO: 181820 - DNA, 20 bp, Artificial
  CRISPR gRNA sequence
agaagtggatgctgctgggc

SEQ ID NO: 181821 - DNA, 20 bp, Artificial
  CRISPR gRNA sequence
ctgggcagaaacgtgcctgg

SEQ ID NO: 181822 - DNA, 20 bp, Artificial
  CRISPR gRNA sequence
ggcagaaacgtgcctggctt

SEQ ID NO: 181823 - DNA, 20 bp, Artificial
  CRISPR gRNA sequence
gcttagcagaggacaaacga

SEQ ID NO: 181824 - DNA, 20 bp, Artificial
  CRISPR gRNA sequence
agcagaggacaaacgagtta

SEQ ID NO: 181825 - DNA, 20 bp, Artificial
  CRISPR gRNA sequence
gcagaggacaaacgagttaa

SEQ ID NO: 181826 - DNA, 20 bp, Artificial
  CRISPR gRNA sequence
atcttgcaccagtcactctg

SEQ ID NO: 181827 - DNA, 20 bp, Artificial
  CRISPR gRNA sequence
gcaccagtcactctggccca

SEQ ID NO: 181828 - DNA, 20 bp, Artificial
  CRISPR gRNA sequence
caccagtcactctggcccaa

SEQ ID NO: 181829 - DNA, 20 bp, Artificial
  CRISPR gRNA sequence
tggcccaagaagcctatagc

SEQ ID NO: 181830 - DNA, 20 bp, Artificial
  CRISPR gRNA sequence
gcccaagaagcctatagctg

SEQ ID NO: 181831 - DNA, 20 bp, Artificial
  CRISPR gRNA sequence
tagctggtgcacttggggca

SEQ ID NO: 181832 - DNA, 20 bp, Artificial
  CRISPR gRNA sequence
gtgcacttggggcaacatag

SEQ ID NO: 181833 - DNA, 20 bp, Artificial
  CRISPR gRNA sequence
ggggcaacatagaccctata

SEQ ID NO: 181834 - DNA, 20 bp, Artificial
  CRISPR gRNA sequence
gggcaacatagaccctatag

SEQ ID NO: 181835 - DNA, 20 bp, Artificial
  CRISPR gRNA sequence
tagacttagtagcaatgata

SEQ ID NO: 181836 - DNA, 20 bp, Artificial
  CRISPR gRNA sequence
agtagcaatgatagtattca

SEQ ID NO: 181837 - DNA, 20 bp, Artificial
  CRISPR gRNA sequence
gtagcaatgatagtattcat

SEQ ID NO: 181838 - DNA, 20 bp, Artificial
  CRISPR gRNA sequence
ataataatagctaatgctta

SEQ ID NO: 181839 - DNA, 20 bp, Artificial
  CRISPR gRNA sequence
atgcttactgaacactccct

SEQ ID NO: 181840 - DNA, 20 bp, Artificial
  CRISPR gRNA sequence
actgaacactccctgtgtgc

SEQ ID NO: 181841 - DNA, 20 bp, Artificial
  CRISPR gRNA sequence
ctgaacactccctgtgtgcc

SEQ ID NO: 181842 - DNA, 20 bp, Artificial
  CRISPR gRNA sequence
aacactccctgtgtgcctgg

SEQ ID NO: 181843 - DNA, 20 bp, Artificial
  CRISPR gRNA sequence
cctgtgtgcctggcacctgc

SEQ ID NO: 181844 - DNA, 20 bp, Artificial
  CRISPR gRNA sequence
tgtgcctggcacctgctaag

SEQ ID NO: 181845 - DNA, 20 bp, Artificial
  CRISPR gRNA sequence
gcacctgctaagtatgttat

SEQ ID NO: 181846 - DNA, 20 bp, Artificial
  CRISPR gRNA sequence
ctaagtatgttatttacatt

SEQ ID NO: 181847 - DNA, 20 bp, Artificial
  CRISPR gRNA sequence
agtatgttatttacattgtg

SEQ ID NO: 181848 - DNA, 20 bp, Artificial
  CRISPR gRNA sequence
tttacattgtgtcatttaat

SEQ ID NO: 181849 - DNA, 20 bp, Artificial
  CRISPR gRNA sequence
acattgtgtcatttaatcct

SEQ ID NO: 181850 - DNA, 20 bp, Artificial
  CRISPR gRNA sequence
cattgtgtcatttaatcctc

SEQ ID NO: 181851 - DNA, 20 bp, Artificial
  CRISPR gRNA sequence
tgtcatttaatcctcgcagt

SEQ ID NO: 181852 - DNA, 20 bp, Artificial
  CRISPR gRNA sequence
aatcctcgcagtagtcctgt

SEQ ID NO: 181853 - DNA, 20 bp, Artificial
  CRISPR gRNA sequence
atcctcgcagtagtcctgtg

SEQ ID NO: 181854 - DNA, 20 bp, Artificial
  CRISPR gRNA sequence
gcagtagtcctgtgggttag

SEQ ID NO: 181855 - DNA, 20 bp, Artificial
  CRISPR gRNA sequence
tgggttagatcttactaatg

SEQ ID NO: 181856 - DNA, 20 bp, Artificial
  CRISPR gRNA sequence
gatcttactaatgtcatcat

SEQ ID NO: 181857 - DNA, 20 bp, Artificial
  CRISPR gRNA sequence
actaatgtcatcattttcag

SEQ ID NO: 181858 - DNA, 20 bp, Artificial
  CRISPR gRNA sequence
ctaatgtcatcattttcaga

SEQ ID NO: 181859 - DNA, 20 bp, Artificial
  CRISPR gRNA sequence
atgtcatcattttcagataa

SEQ ID NO: 181860 - DNA, 20 bp, Artificial
  CRISPR gRNA sequence
tcagataagtaaacagaggc

SEQ ID NO: 181861 - DNA, 20 bp, Artificial
  CRISPR gRNA sequence
cagataagtaaacagaggca

SEQ ID NO: 181862 - DNA, 20 bp, Artificial
  CRISPR gRNA sequence
agataagtaaacagaggcac

SEQ ID NO: 181863 - DNA, 20 bp, Artificial
  CRISPR gRNA sequence
agaggtagatcataagatca

SEQ ID NO: 181864 - DNA, 20 bp, Artificial
  CRISPR gRNA sequence
gaacttgaacggtctgactc

SEQ ID NO: 181865 - DNA, 20 bp, Artificial
  CRISPR gRNA sequence
aacttgaacggtctgactca

SEQ ID NO: 181866 - DNA, 20 bp, Artificial
  CRISPR gRNA sequence
gaacggtctgactcagaaat

SEQ ID NO: 181867 - DNA, 20 bp, Artificial
  CRISPR gRNA sequence
aacggtctgactcagaaatc

SEQ ID NO: 181868 - DNA, 20 bp, Artificial
  CRISPR gRNA sequence
actcagaaatctttactgtt

SEQ ID NO: 181869 - DNA, 20 bp, Artificial
  CRISPR gRNA sequence
agaaatctttactgttaacc

SEQ ID NO: 181870 - DNA, 20 bp, Artificial
  CRISPR gRNA sequence
tactgttaaccataagtgat

SEQ ID NO: 181871 - DNA, 20 bp, Artificial
  CRISPR gRNA sequence
actgttaaccataagtgata

SEQ ID NO: 181872 - DNA, 20 bp, Artificial
  CRISPR gRNA sequence
ctgttaaccataagtgatat

SEQ ID NO: 181873 - DNA, 20 bp, Artificial
  CRISPR gRNA sequence
ttaaccataagtgatataat

SEQ ID NO: 181874 - DNA, 20 bp, Artificial
  CRISPR gRNA sequence
accataagtgatataataac

SEQ ID NO: 181875 - DNA, 20 bp, Artificial
  CRISPR gRNA sequence
agacttcatatttgtcactg

SEQ ID NO: 181876 - DNA, 20 bp, Artificial
  CRISPR gRNA sequence
gacttcatatttgtcactgt

SEQ ID NO: 181877 - DNA, 20 bp, Artificial
  CRISPR gRNA sequence
catatttgtcactgtgtccc

SEQ ID NO: 181878 - DNA, 20 bp, Artificial
  CRISPR gRNA sequence
atatttgtcactgtgtccct

SEQ ID NO: 181879 - DNA, 20 bp, Artificial
  CRISPR gRNA sequence
gtcactgtgtccctacacat

SEQ ID NO: 181880 - DNA, 20 bp, Artificial
  CRISPR gRNA sequence
tcactgtgtccctacacatc

SEQ ID NO: 181881 - DNA, 20 bp, Artificial
  CRISPR gRNA sequence
tgtccctacacatcctctgg

SEQ ID NO: 181882 - DNA, 20 bp, Artificial
  CRISPR gRNA sequence
cacatcctctggtttttaat

SEQ ID NO: 181883 - DNA, 20 bp, Artificial
  CRISPR gRNA sequence
tggtttttaatcctcaaaat

SEQ ID NO: 181884 - DNA, 20 bp, Artificial
  CRISPR gRNA sequence
gtttttaatcctcaaaattt

SEQ ID NO: 181885 - DNA, 20 bp, Artificial
  CRISPR gRNA sequence
ttaatcctcaaaattttgtt

SEQ ID NO: 181886 - DNA, 20 bp, Artificial
  CRISPR gRNA sequence
taatcctcaaaattttgttg

SEQ ID NO: 181887 - DNA, 20 bp, Artificial
  CRISPR gRNA sequence
aatcctcaaaattttgttgg

SEQ ID NO: 181888 - DNA, 20 bp, Artificial
  CRISPR gRNA sequence
atcctcaaaattttgttgga

SEQ ID NO: 181889 - DNA, 20 bp, Artificial
  CRISPR gRNA sequence
aaaattttgttggatatgtt

SEQ ID NO: 181890 - DNA, 20 bp, Artificial
  CRISPR gRNA sequence
tgttggatatgttttctcat

SEQ ID NO: 181891 - DNA, 20 bp, Artificial
  CRISPR gRNA sequence
gttggatatgttttctcatt

SEQ ID NO: 181892 - DNA, 20 bp, Artificial
  CRISPR gRNA sequence
ttggatatgttttctcattt

SEQ ID NO: 181893 - DNA, 20 bp, Artificial
  CRISPR gRNA sequence
gatatgttttctcatttccg

SEQ ID NO: 181894 - DNA, 20 bp, Artificial
  CRISPR gRNA sequence
tctcatttccgagaagagaa

SEQ ID NO: 181895 - DNA, 20 bp, Artificial
  CRISPR gRNA sequence
ctcatttccgagaagagaaa

SEQ ID NO: 181896 - DNA, 20 bp, Artificial
  CRISPR gRNA sequence
tcatttccgagaagagaaaa

SEQ ID NO: 181897 - DNA, 20 bp, Artificial
  CRISPR gRNA sequence
atttccgagaagagaaaact

SEQ ID NO: 181898 - DNA, 20 bp, Artificial
  CRISPR gRNA sequence
ccgagaagagaaaactgagg

SEQ ID NO: 181899 - DNA, 20 bp, Artificial
  CRISPR gRNA sequence
cgagaagagaaaactgaggg

SEQ ID NO: 181900 - DNA, 20 bp, Artificial
  CRISPR gRNA sequence
aggggcaaagagatacagtg

SEQ ID NO: 181901 - DNA, 20 bp, Artificial
  CRISPR gRNA sequence
cacagtgttcaccatccaag

SEQ ID NO: 181902 - DNA, 20 bp, Artificial
  CRISPR gRNA sequence
accatccaagtctagcccag

SEQ ID NO: 181903 - DNA, 20 bp, Artificial
  CRISPR gRNA sequence
gcccagagctccctcagtgg

SEQ ID NO: 181904 - DNA, 20 bp, Artificial
  CRISPR gRNA sequence
cctcagtggtatgaccagga

SEQ ID NO: 181905 - DNA, 20 bp, Artificial
  CRISPR gRNA sequence
agtggtatgaccaggacccc

SEQ ID NO: 181906 - DNA, 20 bp, Artificial
  CRISPR gRNA sequence
tgtaagagcccatgctccca

SEQ ID NO: 181907 - DNA, 20 bp, Artificial
  CRISPR gRNA sequence
ccaggtgtcctgaggagtcc

SEQ ID NO: 181908 - DNA, 20 bp, Artificial
  CRISPR gRNA sequence
aggagtcctttctaatggaa

SEQ ID NO: 181909 - DNA, 20 bp, Artificial
  CRISPR gRNA sequence
tctaatggaagaagttctta

SEQ ID NO: 181910 - DNA, 20 bp, Artificial
  CRISPR gRNA sequence
ctaatggaagaagttcttac

SEQ ID NO: 181911 - DNA, 20 bp, Artificial
  CRISPR gRNA sequence
taatggaagaagttcttact

SEQ ID NO: 181912 - DNA, 20 bp, Artificial
  CRISPR gRNA sequence
atggaagaagttcttacttc

SEQ ID NO: 181913 - DNA, 20 bp, Artificial
  CRISPR gRNA sequence
ttacttccatgtgggtgctt

SEQ ID NO: 181914 - DNA, 20 bp, Artificial
  CRISPR gRNA sequence
acttccatgtgggtgcttac

SEQ ID NO: 181915 - DNA, 20 bp, Artificial
  CRISPR gRNA sequence
cttccatgtgggtgcttaca

SEQ ID NO: 181916 - DNA, 20 bp, Artificial
  CRISPR gRNA sequence
ccatgtgggtgcttacaagc

SEQ ID NO: 181917 - DNA, 20 bp, Artificial
  CRISPR gRNA sequence
catgtgggtgcttacaagcc

SEQ ID NO: 181918 - DNA, 20 bp, Artificial
  CRISPR gRNA sequence
acaagccagagagaaacatc

SEQ ID NO: 181919 - DNA, 20 bp, Artificial
  CRISPR gRNA sequence
caagccagagagaaacatcc

SEQ ID NO: 181920 - DNA, 20 bp, Artificial
  CRISPR gRNA sequence
caaaaccagggctttggggg

SEQ ID NO: 181921 - DNA, 20 bp, Artificial
  CRISPR gRNA sequence
aaaaccagggctttggggga

SEQ ID NO: 181922 - DNA, 20 bp, Artificial
  CRISPR gRNA sequence
tgggggagggtgccctgtgt

SEQ ID NO: 181923 - DNA, 20 bp, Artificial
  CRISPR gRNA sequence
gggggagggtgccctgtgtg

SEQ ID NO: 181924 - DNA, 20 bp, Artificial
  CRISPR gRNA sequence
ggggagggtgccctgtgtgg

SEQ ID NO: 181925 - DNA, 20 bp, Artificial
  CRISPR gRNA sequence
tgtgggtcctagcacatgtg

SEQ ID NO: 181926 - DNA, 20 bp, Artificial
  CRISPR gRNA sequence
gcacatgtgtaacaggcaga

SEQ ID NO: 181927 - DNA, 20 bp, Artificial
  CRISPR gRNA sequence
tgtgagctaataatgctgca

SEQ ID NO: 181928 - DNA, 20 bp, Artificial
  CRISPR gRNA sequence
gtgagctaataatgctgcag

SEQ ID NO: 181929 - DNA, 20 bp, Artificial
  CRISPR gRNA sequence
tgagctaataatgctgcagc

SEQ ID NO: 181930 - DNA, 20 bp, Artificial
  CRISPR gRNA sequence
ataatgctgcagctcatcca

SEQ ID NO: 181931 - DNA, 20 bp, Artificial
  CRISPR gRNA sequence
cagctcatccaaactaggtg

SEQ ID NO: 181932 - DNA, 20 bp, Artificial
  CRISPR gRNA sequence
atccaaactaggtgtccctc

SEQ ID NO: 181933 - DNA, 20 bp, Artificial
  CRISPR gRNA sequence
ggtgtccctcctgagagatc

SEQ ID NO: 181934 - DNA, 20 bp, Artificial
  CRISPR gRNA sequence
ctgagagatccagagtggtc

SEQ ID NO: 181935 - DNA, 20 bp, Artificial
  CRISPR gRNA sequence
agagatccagagtggtctgt

SEQ ID NO: 181936 - DNA, 20 bp, Artificial
  CRISPR gRNA sequence
tttaagccagcctcaagatg

SEQ ID NO: 181937 - DNA, 20 bp, Artificial
  CRISPR gRNA sequence
aagccagcctcaagatgggt

SEQ ID NO: 181938 - DNA, 20 bp, Artificial
  CRISPR gRNA sequence
agccagcctcaagatgggtg

SEQ ID NO: 181939 - DNA, 20 bp, Artificial
  CRISPR gRNA sequence
aagatgggtgtccaagccag

SEQ ID NO: 181940 - DNA, 20 bp, Artificial
  CRISPR gRNA sequence
ttctcagacctgtctggctg

SEQ ID NO: 181941 - DNA, 20 bp, Artificial
  CRISPR gRNA sequence
tctcagacctgtctggctgg

SEQ ID NO: 181942 - DNA, 20 bp, Artificial
  CRISPR gRNA sequence
ctcagacctgtctggctggg

SEQ ID NO: 181943 - DNA, 20 bp, Artificial
  CRISPR gRNA sequence
tcagacctgtctggctgggc

SEQ ID NO: 181944 - DNA, 20 bp, Artificial
  CRISPR gRNA sequence
agacctgtctggctgggcag

SEQ ID NO: 181945 - DNA, 20 bp, Artificial
  CRISPR gRNA sequence
tctggctgggcaggcctggg

SEQ ID NO: 181946 - DNA, 20 bp, Artificial
  CRISPR gRNA sequence
gctgggcaggcctgggtctc

SEQ ID NO: 181947 - DNA, 20 bp, Artificial
  CRISPR gRNA sequence
ggcaggcctgggtctcagac

SEQ ID NO: 181948 - DNA, 20 bp, Artificial
  CRISPR gRNA sequence
ggtctcagactcagccccaa

SEQ ID NO: 181949 - DNA, 20 bp, Artificial
  CRISPR gRNA sequence
agactcagccccaaagtctg

SEQ ID NO: 181950 - DNA, 20 bp, Artificial
  CRISPR gRNA sequence
agccccaaagtctgtggtct

SEQ ID NO: 181951 - DNA, 20 bp, Artificial
  CRISPR gRNA sequence
tggtctctgacctgacacag

SEQ ID NO: 181952 - DNA, 20 bp, Artificial
  CRISPR gRNA sequence
tgacctgacacagccttatg

SEQ ID NO: 181953 - DNA, 20 bp, Artificial
  CRISPR gRNA sequence
acctgacacagccttatgtg

SEQ ID NO: 181954 - DNA, 20 bp, Artificial
  CRISPR gRNA sequence
acacagccttatgtgtatgt

SEQ ID NO: 181955 - DNA, 20 bp, Artificial
  CRISPR gRNA sequence
atgtgtatgtgtgtattgtt

SEQ ID NO: 181956 - DNA, 20 bp, Artificial
  CRISPR gRNA sequence
tgtgtatgtgtgtattgttc

SEQ ID NO: 181957 - DNA, 20 bp, Artificial
  CRISPR gRNA sequence
ttcaggaggagatgatcttc

SEQ ID NO: 181958 - DNA, 20 bp, Artificial
  CRISPR gRNA sequence
aggaggagatgatcttccag

SEQ ID NO: 181959 - DNA, 20 bp, Artificial
  CRISPR gRNA sequence
ccagatcccatggaagcatg

SEQ ID NO: 181960 - DNA, 20 bp, Artificial
  CRISPR gRNA sequence
cagatcccatggaagcatgc

SEQ ID NO: 181961 - DNA, 20 bp, Artificial
  CRISPR gRNA sequence
ccaagcatggctgggacatc

SEQ ID NO: 181962 - DNA, 20 bp, Artificial
  CRISPR gRNA sequence
ggacatcaacaaggatgcct

SEQ ID NO: 181963 - DNA, 20 bp, Artificial
  CRISPR gRNA sequence
tttgttccggagctgggcca

SEQ ID NO: 181964 - DNA, 20 bp, Artificial
  CRISPR gRNA sequence
gttccggagctgggccattc

SEQ ID NO: 181965 - DNA, 20 bp, Artificial
  CRISPR gRNA sequence
ttccggagctgggccattca

SEQ ID NO: 181966 - DNA, 20 bp, Artificial
  CRISPR gRNA sequence
cggagctgggccattcacac

SEQ ID NO: 181967 - DNA, 20 bp, Artificial
  CRISPR gRNA sequence
ggccattcacacaggtgtgt

SEQ ID NO: 181968 - DNA, 20 bp, Artificial
  CRISPR gRNA sequence
acacaggtgtgtgcctggga

SEQ ID NO: 181969 - DNA, 20 bp, Artificial
  CRISPR gRNA sequence
ggactcaggcctaggaagcc

SEQ ID NO: 181970 - DNA, 20 bp, Artificial
  CRISPR gRNA sequence
aggcctaggaagcccagggt

SEQ ID NO: 181971 - DNA, 20 bp, Artificial
  CRISPR gRNA sequence
ggaagcccagggtagagaca

SEQ ID NO: 181972 - DNA, 20 bp, Artificial
  CRISPR gRNA sequence
acgttaacacagaggctctt

SEQ ID NO: 181973 - DNA, 20 bp, Artificial
  CRISPR gRNA sequence
acacagaggctcttcactgg

SEQ ID NO: 181974 - DNA, 20 bp, Artificial
  CRISPR gRNA sequence
ttcactggggtccctgagct

SEQ ID NO: 181975 - DNA, 20 bp, Artificial
  CRISPR gRNA sequence
cactggggtccctgagctcc

SEQ ID NO: 181976 - DNA, 20 bp, Artificial
  CRISPR gRNA sequence
actggggtccctgagctccc

SEQ ID NO: 181977 - DNA, 20 bp, Artificial
  CRISPR gRNA sequence
gggtccctgagctccctgag

SEQ ID NO: 181978 - DNA, 20 bp, Artificial
  CRISPR gRNA sequence
agctccctgagacaacatgc

SEQ ID NO: 181979 - DNA, 20 bp, Artificial
  CRISPR gRNA sequence
cctgagacaacatgcagaat

SEQ ID NO: 181980 - DNA, 20 bp, Artificial
  CRISPR gRNA sequence
agacaacatgcagaattact

SEQ ID NO: 181981 - DNA, 20 bp, Artificial
  CRISPR gRNA sequence
ctgggaagaggggctggtgg

SEQ ID NO: 181982 - DNA, 20 bp, Artificial
  CRISPR gRNA sequence
ggaagaggggctggtggcag

SEQ ID NO: 181983 - DNA, 20 bp, Artificial
  CRISPR gRNA sequence
gtggcagacttgtgtttctg

SEQ ID NO: 181984 - DNA, 20 bp, Artificial
  CRISPR gRNA sequence
gtgtttctggagaagagagt

SEQ ID NO: 181985 - DNA, 20 bp, Artificial
  CRISPR gRNA sequence
tgtttctggagaagagagtc

SEQ ID NO: 181986 - DNA, 20 bp, Artificial
  CRISPR gRNA sequence
ctggagaagagagtcgatca

SEQ ID NO: 181987 - DNA, 20 bp, Artificial
  CRISPR gRNA sequence
tggagaagagagtcgatcat

SEQ ID NO: 181988 - DNA, 20 bp, Artificial
  CRISPR gRNA sequence
gagaagagagtcgatcatct

SEQ ID NO: 181989 - DNA, 20 bp, Artificial
  CRISPR gRNA sequence
agcaaattctcaaagggaaa

SEQ ID NO: 181990 - DNA, 20 bp, Artificial
  CRISPR gRNA sequence
tcaaagggaaaagccaagat

SEQ ID NO: 181991 - DNA, 20 bp, Artificial
  CRISPR gRNA sequence
aaagggaaaagccaagatct

SEQ ID NO: 181992 - DNA, 20 bp, Artificial
  CRISPR gRNA sequence
agaaagtgtgtggcttcagg

SEQ ID NO: 181993 - DNA, 20 bp, Artificial
  CRISPR gRNA sequence
gaaagtgtgtggcttcaggg

SEQ ID NO: 181994 - DNA, 20 bp, Artificial
  CRISPR gRNA sequence
cagggggtttgtggctagat

SEQ ID NO: 181995 - DNA, 20 bp, Artificial
  CRISPR gRNA sequence
agggggtttgtggctagatg

SEQ ID NO: 181996 - DNA, 20 bp, Artificial
  CRISPR gRNA sequence
gtggctagatgaaagttctc

SEQ ID NO: 181997 - DNA, 20 bp, Artificial
  CRISPR gRNA sequence
tggctagatgaaagttctcc

SEQ ID NO: 181998 - DNA, 20 bp, Artificial
  CRISPR gRNA sequence
gatgaaagttctccctggca

SEQ ID NO: 181999 - DNA, 20 bp, Artificial
  CRISPR gRNA sequence
tccctggcaaaagcatctgt

SEQ ID NO: 182000 - DNA, 20 bp, Artificial
  CRISPR gRNA sequence
cctggcaaaagcatctgtga

SEQ ID NO: 182001 - DNA, 20 bp, Artificial
  CRISPR gRNA sequence
gcaaaagcatctgtgaaaag

SEQ ID NO: 182002 - DNA, 20 bp, Artificial
  CRISPR gRNA sequence
tgaaaagcagctgtaagcca

SEQ ID NO: 182003 - DNA, 20 bp, Artificial
  CRISPR gRNA sequence
taagccagggcactgaaaga

SEQ ID NO: 182004 - DNA, 20 bp, Artificial
  CRISPR gRNA sequence
aaagagacccaggtctgcct

SEQ ID NO: 182005 - DNA, 20 bp, Artificial
  CRISPR gRNA sequence
cctttttcttcgtgttgacc

SEQ ID NO: 182006 - DNA, 20 bp, Artificial
  CRISPR gRNA sequence
tttcttcgtgttgaccaagg

SEQ ID NO: 182007 - DNA, 20 bp, Artificial
  CRISPR gRNA sequence
ttcttcgtgttgaccaaggc

SEQ ID NO: 182008 - DNA, 20 bp, Artificial
  CRISPR gRNA sequence
tcttcgtgttgaccaaggcc

SEQ ID NO: 182009 - DNA, 20 bp, Artificial
  CRISPR gRNA sequence
cttcgtgttgaccaaggccc

SEQ ID NO: 182010 - DNA, 20 bp, Artificial
  CRISPR gRNA sequence
ttcgtgttgaccaaggccct

SEQ ID NO: 182011 - DNA, 20 bp, Artificial
  CRISPR gRNA sequence
cgtgttgaccaaggcccttg

SEQ ID NO: 182012 - DNA, 20 bp, Artificial
  CRISPR gRNA sequence
gtgttgaccaaggcccttgg

SEQ ID NO: 182013 - DNA, 20 bp, Artificial
  CRISPR gRNA sequence
accaaggcccttggtccaag

SEQ ID NO: 182014 - DNA, 20 bp, Artificial
  CRISPR gRNA sequence
ggtccaagcctcatgtggtt

SEQ ID NO: 182015 - DNA, 20 bp, Artificial
  CRISPR gRNA sequence
gtccaagcctcatgtggttg

SEQ ID NO: 182016 - DNA, 20 bp, Artificial
  CRISPR gRNA sequence
atgtggttggtggcctcctt

SEQ ID NO: 182017 - DNA, 20 bp, Artificial
  CRISPR gRNA sequence
gtggcctcctttatccttga

SEQ ID NO: 182018 - DNA, 20 bp, Artificial
  CRISPR gRNA sequence
ctttatccttgagagatgga

SEQ ID NO: 182019 - DNA, 20 bp, Artificial
  CRISPR gRNA sequence
tatccttgagagatggagct

SEQ ID NO: 182020 - DNA, 20 bp, Artificial
  CRISPR gRNA sequence
atccttgagagatggagctc

SEQ ID NO: 182021 - DNA, 20 bp, Artificial
  CRISPR gRNA sequence
tccttgagagatggagctct

SEQ ID NO: 182022 - DNA, 20 bp, Artificial
  CRISPR gRNA sequence
gagagatggagctctaggcc

SEQ ID NO: 182023 - DNA, 20 bp, Artificial
  CRISPR gRNA sequence
agagatggagctctaggccc

SEQ ID NO: 182024 - DNA, 20 bp, Artificial
  CRISPR gRNA sequence
taggcccatctcagaacagt

SEQ ID NO: 182025 - DNA, 20 bp, Artificial
  CRISPR gRNA sequence
ggcccatctcagaacagtca

SEQ ID NO: 182026 - DNA, 20 bp, Artificial
  CRISPR gRNA sequence
agaacagtcagcccacccat

SEQ ID NO: 182027 - DNA, 20 bp, Artificial
  CRISPR gRNA sequence
agtaactgttctctgctgcc

SEQ ID NO: 182028 - DNA, 20 bp, Artificial
  CRISPR gRNA sequence
gtaactgttctctgctgccc

SEQ ID NO: 182029 - DNA, 20 bp, Artificial
  CRISPR gRNA sequence
ttctctgctgcccagtctgt

SEQ ID NO: 182030 - DNA, 20 bp, Artificial
  CRISPR gRNA sequence
tctgctgcccagtctgtgcc

SEQ ID NO: 182031 - DNA, 20 bp, Artificial
  CRISPR gRNA sequence
tgctgcccagtctgtgccca

SEQ ID NO: 182032 - DNA, 20 bp, Artificial
  CRISPR gRNA sequence
ctgcccagtctgtgcccact

SEQ ID NO: 182033 - DNA, 20 bp, Artificial
  CRISPR gRNA sequence
cccagtctgtgcccactcta

SEQ ID NO: 182034 - DNA, 20 bp, Artificial
  CRISPR gRNA sequence
tgcccactctaccctctggc

SEQ ID NO: 182035 - DNA, 20 bp, Artificial
  CRISPR gRNA sequence
taccctctggctgctgatag

SEQ ID NO: 182036 - DNA, 20 bp, Artificial
  CRISPR gRNA sequence
ccctctggctgctgatagcc

SEQ ID NO: 182037 - DNA, 20 bp, Artificial
  CRISPR gRNA sequence
tggctgctgatagcccaagg

SEQ ID NO: 182038 - DNA, 20 bp, Artificial
  CRISPR gRNA sequence
gctgctgatagcccaaggag

SEQ ID NO: 182039 - DNA, 20 bp, Artificial
  CRISPR gRNA sequence
ctgatagcccaaggaggaag

SEQ ID NO: 182040 - DNA, 20 bp, Artificial
  CRISPR gRNA sequence
atagcccaaggaggaagact

SEQ ID NO: 182041 - DNA, 20 bp, Artificial
  CRISPR gRNA sequence
ggcatagtctgagacacaga

SEQ ID NO: 182042 - DNA, 20 bp, Artificial
  CRISPR gRNA sequence
agacacagatagtacacttt

SEQ ID NO: 182043 - DNA, 20 bp, Artificial
  CRISPR gRNA sequence
tggggatatggggactctag

SEQ ID NO: 182044 - DNA, 20 bp, Artificial
  CRISPR gRNA sequence
ggggatatggggactctagt

SEQ ID NO: 182045 - DNA, 20 bp, Artificial
  CRISPR gRNA sequence
gggatatggggactctagtg

SEQ ID NO: 182046 - DNA, 20 bp, Artificial
  CRISPR gRNA sequence
tagtgcttctggctgggccc

SEQ ID NO: 182047 - DNA, 20 bp, Artificial
  CRISPR gRNA sequence
gtgcttctggctgggccctt

SEQ ID NO: 182048 - DNA, 20 bp, Artificial
  CRISPR gRNA sequence
ctggctgggcccttcactga

SEQ ID NO: 182049 - DNA, 20 bp, Artificial
  CRISPR gRNA sequence
tggctgggcccttcactgag

SEQ ID NO: 182050 - DNA, 20 bp, Artificial
  CRISPR gRNA sequence
gctgggcccttcactgaggc

SEQ ID NO: 182051 - DNA, 20 bp, Artificial
  CRISPR gRNA sequence
ggcccttcactgaggcccgc

SEQ ID NO: 182052 - DNA, 20 bp, Artificial
  CRISPR gRNA sequence
cactgaggcccgctagatgt

SEQ ID NO: 182053 - DNA, 20 bp, Artificial
  CRISPR gRNA sequence
actgaggcccgctagatgtg

SEQ ID NO: 182054 - DNA, 20 bp, Artificial
  CRISPR gRNA sequence
aggcccgctagatgtgttta

SEQ ID NO: 182055 - DNA, 20 bp, Artificial
  CRISPR gRNA sequence
gatgtgtttaagccaagcct

SEQ ID NO: 182056 - DNA, 20 bp, Artificial
  CRISPR gRNA sequence
aagccaagcctgggcatttg

SEQ ID NO: 182057 - DNA, 20 bp, Artificial
  CRISPR gRNA sequence
agccaagcctgggcatttga

SEQ ID NO: 182058 - DNA, 20 bp, Artificial
  CRISPR gRNA sequence
ggcatttgagaaggcccagg

SEQ ID NO: 182059 - DNA, 20 bp, Artificial
  CRISPR gRNA sequence
gagaaggcccagggcctagg

SEQ ID NO: 182060 - DNA, 20 bp, Artificial
  CRISPR gRNA sequence
agaaggcccagggcctagga

SEQ ID NO: 182061 - DNA, 20 bp, Artificial
  CRISPR gRNA sequence
ggacctgcagagtgtcaccg

SEQ ID NO: 182062 - DNA, 20 bp, Artificial
  CRISPR gRNA sequence
cagagtgtcaccgggagtac

SEQ ID NO: 182063 - DNA, 20 bp, Artificial
  CRISPR gRNA sequence
ctggtttgaccactgtggct

SEQ ID NO: 182064 - DNA, 20 bp, Artificial
  CRISPR gRNA sequence
gtttgaccactgtggctctc

SEQ ID NO: 182065 - DNA, 20 bp, Artificial
  CRISPR gRNA sequence
gaccactgtggctctctggt

SEQ ID NO: 182066 - DNA, 20 bp, Artificial
  CRISPR gRNA sequence
accactgtggctctctggta

SEQ ID NO: 182067 - DNA, 20 bp, Artificial
  CRISPR gRNA sequence
tggctctctggtagcataag

SEQ ID NO: 182068 - DNA, 20 bp, Artificial
  CRISPR gRNA sequence
tctggtagcataagaggtca

SEQ ID NO: 182069 - DNA, 20 bp, Artificial
  CRISPR gRNA sequence
tggtagcataagaggtcagg

SEQ ID NO: 182070 - DNA, 20 bp, Artificial
  CRISPR gRNA sequence
gtagcataagaggtcagggg

SEQ ID NO: 182071 - DNA, 20 bp, Artificial
  CRISPR gRNA sequence
gccttcctccttcaggccag

SEQ ID NO: 182072 - DNA, 20 bp, Artificial
  CRISPR gRNA sequence
ccttcctccttcaggccagg

SEQ ID NO: 182073 - DNA, 20 bp, Artificial
  CRISPR gRNA sequence
cctccttcaggccaggggca

SEQ ID NO: 182074 - DNA, 20 bp, Artificial
  CRISPR gRNA sequence
ctccttcaggccaggggcag

SEQ ID NO: 182075 - DNA, 20 bp, Artificial
  CRISPR gRNA sequence
cttcaggccaggggcagctg

SEQ ID NO: 182076 - DNA, 20 bp, Artificial
  CRISPR gRNA sequence
caggccaggggcagctgagg

SEQ ID NO: 182077 - DNA, 20 bp, Artificial
  CRISPR gRNA sequence
aggccaggggcagctgagga

SEQ ID NO: 182078 - DNA, 20 bp, Artificial
  CRISPR gRNA sequence
aggatccctacccatggccc

SEQ ID NO: 182079 - DNA, 20 bp, Artificial
  CRISPR gRNA sequence
cccatggccctgacgatcct

SEQ ID NO: 182080 - DNA, 20 bp, Artificial
  CRISPR gRNA sequence
acgatcctcttttttctcct

SEQ ID NO: 182081 - DNA, 20 bp, Artificial
  CRISPR gRNA sequence
ttttttctcctgccctctag

SEQ ID NO: 182082 - DNA, 20 bp, Artificial
  CRISPR gRNA sequence
ttttctcctgccctctaggc

SEQ ID NO: 182083 - DNA, 20 bp, Artificial
  CRISPR gRNA sequence
tttctcctgccctctaggcc

SEQ ID NO: 182084 - DNA, 20 bp, Artificial
  CRISPR gRNA sequence
ttctcctgccctctaggccg

SEQ ID NO: 182085 - DNA, 20 bp, Artificial
  CRISPR gRNA sequence
tctcctgccctctaggccga

SEQ ID NO: 182086 - DNA, 20 bp, Artificial
  CRISPR gRNA sequence
ctcctgccctctaggccgat

SEQ ID NO: 182087 - DNA, 20 bp, Artificial
  CRISPR gRNA sequence
tcctgccctctaggccgata

SEQ ID NO: 182088 - DNA, 20 bp, Artificial
  CRISPR gRNA sequence
ctgccctctaggccgataca

SEQ ID NO: 182089 - DNA, 20 bp, Artificial
  CRISPR gRNA sequence
ccctctaggccgatacaaag

SEQ ID NO: 182090 - DNA, 20 bp, Artificial
  CRISPR gRNA sequence
taggccgatacaaagcaggg

SEQ ID NO: 182091 - DNA, 20 bp, Artificial
  CRISPR gRNA sequence
ggccgatacaaagcagggga

SEQ ID NO: 182092 - DNA, 20 bp, Artificial
  CRISPR gRNA sequence
tcgctgtgccatgaactccc

SEQ ID NO: 182093 - DNA, 20 bp, Artificial
  CRISPR gRNA sequence
cgctgtgccatgaactccct

SEQ ID NO: 182094 - DNA, 20 bp, Artificial
  CRISPR gRNA sequence
gctgtgccatgaactccctg

SEQ ID NO: 182095 - DNA, 20 bp, Artificial
  CRISPR gRNA sequence
tgccatgaactccctgccag

SEQ ID NO: 182096 - DNA, 20 bp, Artificial
  CRISPR gRNA sequence
cctgccagatatcgaggagg

SEQ ID NO: 182097 - DNA, 20 bp, Artificial
  CRISPR gRNA sequence
ccagatatcgaggaggtgaa

SEQ ID NO: 182098 - DNA, 20 bp, Artificial
  CRISPR gRNA sequence
agctgtgcgagtgtaccgga

SEQ ID NO: 182099 - DNA, 20 bp, Artificial
  CRISPR gRNA sequence
tgcgagtgtaccggatgctt

SEQ ID NO: 182100 - DNA, 20 bp, Artificial
  CRISPR gRNA sequence
ccacctctcaccaagaacca

SEQ ID NO: 182101 - DNA, 20 bp, Artificial
  CRISPR gRNA sequence
cacctctcaccaagaaccag

SEQ ID NO: 182102 - DNA, 20 bp, Artificial
  CRISPR gRNA sequence
tcaccaagaaccagagaaaa

SEQ ID NO: 182103 - DNA, 20 bp, Artificial
  CRISPR gRNA sequence
accaagaaccagagaaaagg

SEQ ID NO: 182104 - DNA, 20 bp, Artificial
  CRISPR gRNA sequence
tgggtccttgggaagccctc

SEQ ID NO: 182105 - DNA, 20 bp, Artificial
  CRISPR gRNA sequence
ggtccttgggaagccctcag

SEQ ID NO: 182106 - DNA, 20 bp, Artificial
  CRISPR gRNA sequence
gggaagccctcagggaggga

SEQ ID NO: 182107 - DNA, 20 bp, Artificial
  CRISPR gRNA sequence
ggaagccctcagggagggag

SEQ ID NO: 182108 - DNA, 20 bp, Artificial
  CRISPR gRNA sequence
agggagggagggtagaagga

SEQ ID NO: 182109 - DNA, 20 bp, Artificial
  CRISPR gRNA sequence
gggctggagagcctgcacca

SEQ ID NO: 182110 - DNA, 20 bp, Artificial
  CRISPR gRNA sequence
gagagcctgcaccaaggctg

SEQ ID NO: 182111 - DNA, 20 bp, Artificial
  CRISPR gRNA sequence
caccaaggctgacagcccgt

SEQ ID NO: 182112 - DNA, 20 bp, Artificial
  CRISPR gRNA sequence
acagcccgtctgccccacag

SEQ ID NO: 182113 - DNA, 20 bp, Artificial
  CRISPR gRNA sequence
ccccacagaaagaaagtcga

SEQ ID NO: 182114 - DNA, 20 bp, Artificial
  CRISPR gRNA sequence
agagcaaggccaagaggaag

SEQ ID NO: 182115 - DNA, 20 bp, Artificial
  CRISPR gRNA sequence
agcagccaggcctttggtca

SEQ ID NO: 182116 - DNA, 20 bp, Artificial
  CRISPR gRNA sequence
tggtcacctgtgggccaggg

SEQ ID NO: 182117 - DNA, 20 bp, Artificial
  CRISPR gRNA sequence
ggtcacctgtgggccagggt

SEQ ID NO: 182118 - DNA, 20 bp, Artificial
  CRISPR gRNA sequence
gtcacctgtgggccagggtg

SEQ ID NO: 182119 - DNA, 20 bp, Artificial
  CRISPR gRNA sequence
tgggccagggtgagcagtgg

SEQ ID NO: 182120 - DNA, 20 bp, Artificial
  CRISPR gRNA sequence
aggtgggcctgggcctaagc

SEQ ID NO: 182121 - DNA, 20 bp, Artificial
  CRISPR gRNA sequence
ggcctaagctgctttctccc

SEQ ID NO: 182122 - DNA, 20 bp, Artificial
  CRISPR gRNA sequence
agctgctttctccctcgaca

SEQ ID NO: 182123 - DNA, 20 bp, Artificial
  CRISPR gRNA sequence
ctttctccctcgacagtcat

SEQ ID NO: 182124 - DNA, 20 bp, Artificial
  CRISPR gRNA sequence
tctccctcgacagtcatgtg

SEQ ID NO: 182125 - DNA, 20 bp, Artificial
  CRISPR gRNA sequence
ctccctcgacagtcatgtgg

SEQ ID NO: 182126 - DNA, 20 bp, Artificial
  CRISPR gRNA sequence
tccctcgacagtcatgtggg

SEQ ID NO: 182127 - DNA, 20 bp, Artificial
  CRISPR gRNA sequence
cctcgacagtcatgtgggga

SEQ ID NO: 182128 - DNA, 20 bp, Artificial
  CRISPR gRNA sequence
gacagtcatgtggggattcc

SEQ ID NO: 182129 - DNA, 20 bp, Artificial
  CRISPR gRNA sequence
cagccctgataccttctctg

SEQ ID NO: 182130 - DNA, 20 bp, Artificial
  CRISPR gRNA sequence
ataccttctctgatggactc

SEQ ID NO: 182131 - DNA, 20 bp, Artificial
  CRISPR gRNA sequence
ctctgatggactcagcagct

SEQ ID NO: 182132 - DNA, 20 bp, Artificial
  CRISPR gRNA sequence
tctgatggactcagcagctc

SEQ ID NO: 182133 - DNA, 20 bp, Artificial
  CRISPR gRNA sequence
tgatggactcagcagctcca

SEQ ID NO: 182134 - DNA, 20 bp, Artificial
  CRISPR gRNA sequence
atggactcagcagctccact

SEQ ID NO: 182135 - DNA, 20 bp, Artificial
  CRISPR gRNA sequence
agcagctccactctgcctga

SEQ ID NO: 182136 - DNA, 20 bp, Artificial
  CRISPR gRNA sequence
cactctgcctgatgaccaca

SEQ ID NO: 182137 - DNA, 20 bp, Artificial
  CRISPR gRNA sequence
tgcctgatgaccacagcagc

SEQ ID NO: 182138 - DNA, 20 bp, Artificial
  CRISPR gRNA sequence
cctgatgaccacagcagcta

SEQ ID NO: 182139 - DNA, 20 bp, Artificial
  CRISPR gRNA sequence
atgaccacagcagctacaca

SEQ ID NO: 182140 - DNA, 20 bp, Artificial
  CRISPR gRNA sequence
cacagttccaggctacatgc

SEQ ID NO: 182141 - DNA, 20 bp, Artificial
  CRISPR gRNA sequence
caggctacatgcaggacttg

SEQ ID NO: 182142 - DNA, 20 bp, Artificial
  CRISPR gRNA sequence
catgcaggacttggaggtgg

SEQ ID NO: 182143 - DNA, 20 bp, Artificial
  CRISPR gRNA sequence
ggaggtggagcaggccctga

SEQ ID NO: 182144 - DNA, 20 bp, Artificial
  CRISPR gRNA sequence
gaggtggagcaggccctgac

SEQ ID NO: 182145 - DNA, 20 bp, Artificial
  CRISPR gRNA sequence
actccaggtgagctggtcca

SEQ ID NO: 182146 - DNA, 20 bp, Artificial
  CRISPR gRNA sequence
caggtgagctggtccaggtc

SEQ ID NO: 182147 - DNA, 20 bp, Artificial
  CRISPR gRNA sequence
gtccaggtctggcaggagac

SEQ ID NO: 182148 - DNA, 20 bp, Artificial
  CRISPR gRNA sequence
gcaggagaccccacaggtca

SEQ ID NO: 182149 - DNA, 20 bp, Artificial
  CRISPR gRNA sequence
tttctcttggaggcatggtg

SEQ ID NO: 182150 - DNA, 20 bp, Artificial
  CRISPR gRNA sequence
tctcttggaggcatggtgct

SEQ ID NO: 182151 - DNA, 20 bp, Artificial
  CRISPR gRNA sequence
ctcttggaggcatggtgctg

SEQ ID NO: 182152 - DNA, 20 bp, Artificial
  CRISPR gRNA sequence
tcttggaggcatggtgctgg

SEQ ID NO: 182153 - DNA, 20 bp, Artificial
  CRISPR gRNA sequence
ttggaggcatggtgctggca

SEQ ID NO: 182154 - DNA, 20 bp, Artificial
  CRISPR gRNA sequence
ggaggcatggtgctggcaca

SEQ ID NO: 182155 - DNA, 20 bp, Artificial
  CRISPR gRNA sequence
gaggcatggtgctggcacat

SEQ ID NO: 182156 - DNA, 20 bp, Artificial
  CRISPR gRNA sequence
gcacatggtggcccattagt

SEQ ID NO: 182157 - DNA, 20 bp, Artificial
  CRISPR gRNA sequence
gtgcaggctgcagggttggt

SEQ ID NO: 182158 - DNA, 20 bp, Artificial
  CRISPR gRNA sequence
cagggttggtcggagggcgc

SEQ ID NO: 182159 - DNA, 20 bp, Artificial
  CRISPR gRNA sequence
gtcggagggcgctcgatgtc

SEQ ID NO: 182160 - DNA, 20 bp, Artificial
  CRISPR gRNA sequence
gatgtcttgcaaactaagaa

SEQ ID NO: 182161 - DNA, 20 bp, Artificial
  CRISPR gRNA sequence
gcaaactaagaaagcacaca

SEQ ID NO: 182162 - DNA, 20 bp, Artificial
  CRISPR gRNA sequence
caaactaagaaagcacacaa

SEQ ID NO: 182163 - DNA, 20 bp, Artificial
  CRISPR gRNA sequence
agaaagcacacaaccttgac

SEQ ID NO: 182164 - DNA, 20 bp, Artificial
  CRISPR gRNA sequence
gacctgtggcttctgctgtt

SEQ ID NO: 182165 - DNA, 20 bp, Artificial
  CRISPR gRNA sequence
acctgtggcttctgctgttc

SEQ ID NO: 182166 - DNA, 20 bp, Artificial
  CRISPR gRNA sequence
tggcttctgctgttccccag

SEQ ID NO: 182167 - DNA, 20 bp, Artificial
  CRISPR gRNA sequence
ctgctgttccccagcactgt

SEQ ID NO: 182168 - DNA, 20 bp, Artificial
  CRISPR gRNA sequence
tgctgttccccagcactgtc

SEQ ID NO: 182169 - DNA, 20 bp, Artificial
  CRISPR gRNA sequence
ctgttccccagcactgtcgc

SEQ ID NO: 182170 - DNA, 20 bp, Artificial
  CRISPR gRNA sequence
ttccccagcactgtcgccat

SEQ ID NO: 182171 - DNA, 20 bp, Artificial
  CRISPR gRNA sequence
cccagcactgtcgccatgtg

SEQ ID NO: 182172 - DNA, 20 bp, Artificial
  CRISPR gRNA sequence
tcgccatgtgctgtcagcag

SEQ ID NO: 182173 - DNA, 20 bp, Artificial
  CRISPR gRNA sequence
tcagcagcactctccccgac

SEQ ID NO: 182174 - DNA, 20 bp, Artificial
  CRISPR gRNA sequence
tccccgactggcacatccca

SEQ ID NO: 182175 - DNA, 20 bp, Artificial
  CRISPR gRNA sequence
cccgactggcacatcccagt

SEQ ID NO: 182176 - DNA, 20 bp, Artificial
  CRISPR gRNA sequence
gcacatcccagtggaagttg

SEQ ID NO: 182177 - DNA, 20 bp, Artificial
  CRISPR gRNA sequence
tgccggacagcaccagtgat

SEQ ID NO: 182178 - DNA, 20 bp, Artificial
  CRISPR gRNA sequence
tacaacttccaggtgtcacc

SEQ ID NO: 182179 - DNA, 20 bp, Artificial
  CRISPR gRNA sequence
ccaggtgtcacccatgccct

SEQ ID NO: 182180 - DNA, 20 bp, Artificial
  CRISPR gRNA sequence
caggtgtcacccatgccctc

SEQ ID NO: 182181 - DNA, 20 bp, Artificial
  CRISPR gRNA sequence
cacctctgaaggttggtgct

SEQ ID NO: 182182 - DNA, 20 bp, Artificial
  CRISPR gRNA sequence
tgaaggttggtgctcctggg

SEQ ID NO: 182183 - DNA, 20 bp, Artificial
  CRISPR gRNA sequence
aaggttggtgctcctggggc

SEQ ID NO: 182184 - DNA, 20 bp, Artificial
  CRISPR gRNA sequence
gtgctcctggggcctggcct

SEQ ID NO: 182185 - DNA, 20 bp, Artificial
  CRISPR gRNA sequence
ctggggcctggcctgcctgc

SEQ ID NO: 182186 - DNA, 20 bp, Artificial
  CRISPR gRNA sequence
gggcctggcctgcctgcttg

SEQ ID NO: 182187 - DNA, 20 bp, Artificial
  CRISPR gRNA sequence
gcctgcctgcttgactgtct

SEQ ID NO: 182188 - DNA, 20 bp, Artificial
  CRISPR gRNA sequence
cctgcttgactgtctgggtc

SEQ ID NO: 182189 - DNA, 20 bp, Artificial
  CRISPR gRNA sequence
cttgactgtctgggtcctgt

SEQ ID NO: 182190 - DNA, 20 bp, Artificial
  CRISPR gRNA sequence
gactgtctgggtcctgtgaa

SEQ ID NO: 182191 - DNA, 20 bp, Artificial
  CRISPR gRNA sequence
actgtctgggtcctgtgaag

SEQ ID NO: 182192 - DNA, 20 bp, Artificial
  CRISPR gRNA sequence
tctgggtcctgtgaagggct

SEQ ID NO: 182193 - DNA, 20 bp, Artificial
  CRISPR gRNA sequence
ggtcctgtgaagggcttcct

SEQ ID NO: 182194 - DNA, 20 bp, Artificial
  CRISPR gRNA sequence
tgaagggcttcctgagagag

SEQ ID NO: 182195 - DNA, 20 bp, Artificial
  CRISPR gRNA sequence
cctgagagagaaaagatgat

SEQ ID NO: 182196 - DNA, 20 bp, Artificial
  CRISPR gRNA sequence
ctgagagagaaaagatgatc

SEQ ID NO: 182197 - DNA, 20 bp, Artificial
  CRISPR gRNA sequence
agagagaaaagatgatcaga

SEQ ID NO: 182198 - DNA, 20 bp, Artificial
  CRISPR gRNA sequence
cacctggcactgaattgatt

SEQ ID NO: 182199 - DNA, 20 bp, Artificial
  CRISPR gRNA sequence
gcactgaattgattgagttg

SEQ ID NO: 182200 - DNA, 20 bp, Artificial
  CRISPR gRNA sequence
aattgattgagttgggcatt

SEQ ID NO: 182201 - DNA, 20 bp, Artificial
  CRISPR gRNA sequence
attgagttgggcattgccca

SEQ ID NO: 182202 - DNA, 20 bp, Artificial
  CRISPR gRNA sequence
agttgggcattgcccagtct

SEQ ID NO: 182203 - DNA, 20 bp, Artificial
  CRISPR gRNA sequence
ggcattgcccagtcttagcc

SEQ ID NO: 182204 - DNA, 20 bp, Artificial
  CRISPR gRNA sequence
cccagtcttagccaccatag

SEQ ID NO: 182205 - DNA, 20 bp, Artificial
  CRISPR gRNA sequence
agccaccatagggggaggca

SEQ ID NO: 182206 - DNA, 20 bp, Artificial
  CRISPR gRNA sequence
gccaccatagggggaggcaa

SEQ ID NO: 182207 - DNA, 20 bp, Artificial
  CRISPR gRNA sequence
ggaaggcagttcagagtggg

SEQ ID NO: 182208 - DNA, 20 bp, Artificial
  CRISPR gRNA sequence
agagtgggctgcagtacagt

SEQ ID NO: 182209 - DNA, 20 bp, Artificial
  CRISPR gRNA sequence
cagtacagtgggggctggtg

SEQ ID NO: 182210 - DNA, 20 bp, Artificial
  CRISPR gRNA sequence
gtgagaggagggaagggggc

SEQ ID NO: 182211 - DNA, 20 bp, Artificial
  CRISPR gRNA sequence
cattttggggtgctggttct

SEQ ID NO: 182212 - DNA, 20 bp, Artificial
  CRISPR gRNA sequence
tggggtgctggttctccttc

SEQ ID NO: 182213 - DNA, 20 bp, Artificial
  CRISPR gRNA sequence
ggggtgctggttctccttcc

SEQ ID NO: 182214 - DNA, 20 bp, Artificial
  CRISPR gRNA sequence
gggtgctggttctccttcct

SEQ ID NO: 182215 - DNA, 20 bp, Artificial
  CRISPR gRNA sequence
gttctccttcctcctctgta

SEQ ID NO: 182216 - DNA, 20 bp, Artificial
  CRISPR gRNA sequence
tccttcctcctctgtagccc

SEQ ID NO: 182217 - DNA, 20 bp, Artificial
  CRISPR gRNA sequence
cttcctcctctgtagcccag

SEQ ID NO: 182218 - DNA, 20 bp, Artificial
  CRISPR gRNA sequence
cctcctctgtagcccagcat

SEQ ID NO: 182219 - DNA, 20 bp, Artificial
  CRISPR gRNA sequence
ctcctctgtagcccagcatc

SEQ ID NO: 182220 - DNA, 20 bp, Artificial
  CRISPR gRNA sequence
ctctgtagcccagcatctga

SEQ ID NO: 182221 - DNA, 20 bp, Artificial
  CRISPR gRNA sequence
tgtagcccagcatctgaggg

SEQ ID NO: 182222 - DNA, 20 bp, Artificial
  CRISPR gRNA sequence
tagcccagcatctgagggtg

SEQ ID NO: 182223 - DNA, 20 bp, Artificial
  CRISPR gRNA sequence
agggtgaggaaggaagtagg

SEQ ID NO: 182224 - DNA, 20 bp, Artificial
  CRISPR gRNA sequence
cagggtttgagaggctgagt

SEQ ID NO: 182225 - DNA, 20 bp, Artificial
  CRISPR gRNA sequence
agggtttgagaggctgagtc

SEQ ID NO: 182226 - DNA, 20 bp, Artificial
  CRISPR gRNA sequence
gagaggctgagtcaccaggc

SEQ ID NO: 182227 - DNA, 20 bp, Artificial
  CRISPR gRNA sequence
agaggctgagtcaccaggcc

SEQ ID NO: 182228 - DNA, 20 bp, Artificial
  CRISPR gRNA sequence
agtcaccaggccagggtcct

SEQ ID NO: 182229 - DNA, 20 bp, Artificial
  CRISPR gRNA sequence
ttctggaatctctatggcag

SEQ ID NO: 182230 - DNA, 20 bp, Artificial
  CRISPR gRNA sequence
tggaatctctatggcagata

SEQ ID NO: 182231 - DNA, 20 bp, Artificial
  CRISPR gRNA sequence
gaatctctatggcagatagg

SEQ ID NO: 182232 - DNA, 20 bp, Artificial
  CRISPR gRNA sequence
tatggcagataggtccaccg

SEQ ID NO: 182233 - DNA, 20 bp, Artificial
  CRISPR gRNA sequence
tggcagataggtccaccggg

SEQ ID NO: 182234 - DNA, 20 bp, Artificial
  CRISPR gRNA sequence
gtgggctggaactggaactg

SEQ ID NO: 182235 - DNA, 20 bp, Artificial
  CRISPR gRNA sequence
gaactggaactgcagggtga

SEQ ID NO: 182236 - DNA, 20 bp, Artificial
  CRISPR gRNA sequence
gaactgcagggtgagtgtgg

SEQ ID NO: 182237 - DNA, 20 bp, Artificial
  CRISPR gRNA sequence
cagggtgagtgtggctgact

SEQ ID NO: 182238 - DNA, 20 bp, Artificial
  CRISPR gRNA sequence
actgccagccaacctctctg

SEQ ID NO: 182239 - DNA, 20 bp, Artificial
  CRISPR gRNA sequence
ccagccaacctctctgcttt

SEQ ID NO: 182240 - DNA, 20 bp, Artificial
  CRISPR gRNA sequence
tctgctttccccatccacag

SEQ ID NO: 182241 - DNA, 20 bp, Artificial
  CRISPR gRNA sequence
tgctttccccatccacagct

SEQ ID NO: 182242 - DNA, 20 bp, Artificial
  CRISPR gRNA sequence
ctttccccatccacagctac

SEQ ID NO: 182243 - DNA, 20 bp, Artificial
  CRISPR gRNA sequence
tccccatccacagctacaac

SEQ ID NO: 182244 - DNA, 20 bp, Artificial
  CRISPR gRNA sequence
ccccatccacagctacaaca

SEQ ID NO: 182245 - DNA, 20 bp, Artificial
  CRISPR gRNA sequence
cccatccacagctacaacag

SEQ ID NO: 182246 - DNA, 20 bp, Artificial
  CRISPR gRNA sequence
caacagatgaggatgaggaa

SEQ ID NO: 182247 - DNA, 20 bp, Artificial
  CRISPR gRNA sequence
cctgaggacatcatgaaggt

SEQ ID NO: 182248 - DNA, 20 bp, Artificial
  CRISPR gRNA sequence
aggacatcatgaaggtaaag

SEQ ID NO: 182249 - DNA, 20 bp, Artificial
  CRISPR gRNA sequence
cctacctgggcactcttgaa

SEQ ID NO: 182250 - DNA, 20 bp, Artificial
  CRISPR gRNA sequence
ctacctgggcactcttgaag

SEQ ID NO: 182251 - DNA, 20 bp, Artificial
  CRISPR gRNA sequence
cctgggcactcttgaagtga

SEQ ID NO: 182252 - DNA, 20 bp, Artificial
  CRISPR gRNA sequence
ggcactcttgaagtgaccgt

SEQ ID NO: 182253 - DNA, 20 bp, Artificial
  CRISPR gRNA sequence
ttgaagtgaccgtttctcag

SEQ ID NO: 182254 - DNA, 20 bp, Artificial
  CRISPR gRNA sequence
gaagtgaccgtttctcagtg

SEQ ID NO: 182255 - DNA, 20 bp, Artificial
  CRISPR gRNA sequence
aagtgaccgtttctcagtga

SEQ ID NO: 182256 - DNA, 20 bp, Artificial
  CRISPR gRNA sequence
ctcagtgaggagagagaacc

SEQ ID NO: 182257 - DNA, 20 bp, Artificial
  CRISPR gRNA sequence
tcagtgaggagagagaacca

SEQ ID NO: 182258 - DNA, 20 bp, Artificial
  CRISPR gRNA sequence
agtgaggagagagaaccagt

SEQ ID NO: 182259 - DNA, 20 bp, Artificial
  CRISPR gRNA sequence
ccaaatcagaggatgggtag

SEQ ID NO: 182260 - DNA, 20 bp, Artificial
  CRISPR gRNA sequence
caaatcagaggatgggtagc

SEQ ID NO: 182261 - DNA, 20 bp, Artificial
  CRISPR gRNA sequence
ctgttgtcacctggctgctt

SEQ ID NO: 182262 - DNA, 20 bp, Artificial
  CRISPR gRNA sequence
ttgtcacctggctgcttgca

SEQ ID NO: 182263 - DNA, 20 bp, Artificial
  CRISPR gRNA sequence
tcacctggctgcttgcattg

SEQ ID NO: 182264 - DNA, 20 bp, Artificial
  CRISPR gRNA sequence
gctgcttgcattgtcccaca

SEQ ID NO: 182265 - DNA, 20 bp, Artificial
  CRISPR gRNA sequence
cttgcattgtcccacaagtg

SEQ ID NO: 182266 - DNA, 20 bp, Artificial
  CRISPR gRNA sequence
gcattgtcccacaagtgcca

SEQ ID NO: 182267 - DNA, 20 bp, Artificial
  CRISPR gRNA sequence
cattgtcccacaagtgccac

SEQ ID NO: 182268 - DNA, 20 bp, Artificial
  CRISPR gRNA sequence
tcccacaagtgccacattca

SEQ ID NO: 182269 - DNA, 20 bp, Artificial
  CRISPR gRNA sequence
acgtggcttgactggtggga

SEQ ID NO: 182270 - DNA, 20 bp, Artificial
  CRISPR gRNA sequence
gactggtgggaaagccacca

SEQ ID NO: 182271 - DNA, 20 bp, Artificial
  CRISPR gRNA sequence
actggtgggaaagccaccat

SEQ ID NO: 182272 - DNA, 20 bp, Artificial
  CRISPR gRNA sequence
gtgggaaagccaccatggga

SEQ ID NO: 182273 - DNA, 20 bp, Artificial
  CRISPR gRNA sequence
gcctctgacaggccgtcctg

SEQ ID NO: 182274 - DNA, 20 bp, Artificial
  CRISPR gRNA sequence
tgacaggccgtcctgaagca

SEQ ID NO: 182275 - DNA, 20 bp, Artificial
  CRISPR gRNA sequence
acaggccgtcctgaagcaag

SEQ ID NO: 182276 - DNA, 20 bp, Artificial
  CRISPR gRNA sequence
aagcaagccttggggcatca

SEQ ID NO: 182277 - DNA, 20 bp, Artificial
  CRISPR gRNA sequence
ggggcatcagacagctctgt

SEQ ID NO: 182278 - DNA, 20 bp, Artificial
  CRISPR gRNA sequence
gggcatcagacagctctgtg

SEQ ID NO: 182279 - DNA, 20 bp, Artificial
  CRISPR gRNA sequence
tgtgagtcaggcactatcag

SEQ ID NO: 182280 - DNA, 20 bp, Artificial
  CRISPR gRNA sequence
tgagtcaggcactatcagcg

SEQ ID NO: 182281 - DNA, 20 bp, Artificial
  CRISPR gRNA sequence
tcagcgatgggtccctggcc

SEQ ID NO: 182282 - DNA, 20 bp, Artificial
  CRISPR gRNA sequence
gcctgcatcctctgccccaa

SEQ ID NO: 182283 - DNA, 20 bp, Artificial
  CRISPR gRNA sequence
catcctctgccccaacatgc

SEQ ID NO: 182284 - DNA, 20 bp, Artificial
  CRISPR gRNA sequence
tgccccaacatgccccagcc

SEQ ID NO: 182285 - DNA, 20 bp, Artificial
  CRISPR gRNA sequence
ccccaacatgccccagccct

SEQ ID NO: 182286 - DNA, 20 bp, Artificial
  CRISPR gRNA sequence
ctagttcgggaaatgcacat

SEQ ID NO: 182287 - DNA, 20 bp, Artificial
  CRISPR gRNA sequence
gttcgggaaatgcacatcag

SEQ ID NO: 182288 - DNA, 20 bp, Artificial
  CRISPR gRNA sequence
gggaaatgcacatcaggctt

SEQ ID NO: 182289 - DNA, 20 bp, Artificial
  CRISPR gRNA sequence
caataatcagcctttaggat

SEQ ID NO: 182290 - DNA, 20 bp, Artificial
  CRISPR gRNA sequence
aataatcagcctttaggatc

SEQ ID NO: 182291 - DNA, 20 bp, Artificial
  CRISPR gRNA sequence
taggatccgttaatatgatg

SEQ ID NO: 182292 - DNA, 20 bp, Artificial
  CRISPR gRNA sequence
aggatccgttaatatgatga

SEQ ID NO: 182293 - DNA, 20 bp, Artificial
  CRISPR gRNA sequence
ggatccgttaatatgatgat

SEQ ID NO: 182294 - DNA, 20 bp, Artificial
  CRISPR gRNA sequence
atatgatgatggctttatag

SEQ ID NO: 182295 - DNA, 20 bp, Artificial
  CRISPR gRNA sequence
tatagaaaaagttagcaaat

SEQ ID NO: 182296 - DNA, 20 bp, Artificial
  CRISPR gRNA sequence
atagaaaaagttagcaaatt

SEQ ID NO: 182297 - DNA, 20 bp, Artificial
  CRISPR gRNA sequence
tagaaaaagttagcaaatta

SEQ ID NO: 182298 - DNA, 20 bp, Artificial
  CRISPR gRNA sequence
gcaaattatcctccaggttt

SEQ ID NO: 182299 - DNA, 20 bp, Artificial
  CRISPR gRNA sequence
tcctccaggtttttttttct

SEQ ID NO: 182300 - DNA, 20 bp, Artificial
  CRISPR gRNA sequence
caggtttttttttctgcttc

SEQ ID NO: 182301 - DNA, 20 bp, Artificial
  CRISPR gRNA sequence
ttttttctgcttcagttttg

SEQ ID NO: 182302 - DNA, 20 bp, Artificial
  CRISPR gRNA sequence
tttttctgcttcagttttga

SEQ ID NO: 182303 - DNA, 20 bp, Artificial
  CRISPR gRNA sequence
ttttctgcttcagttttgaa

SEQ ID NO: 182304 - DNA, 20 bp, Artificial
  CRISPR gRNA sequence
tttctgcttcagttttgaaa

SEQ ID NO: 182305 - DNA, 20 bp, Artificial
  CRISPR gRNA sequence
ttctgcttcagttttgaaag

SEQ ID NO: 182306 - DNA, 20 bp, Artificial
  CRISPR gRNA sequence
tctgcttcagttttgaaagt

SEQ ID NO: 182307 - DNA, 20 bp, Artificial
  CRISPR gRNA sequence
ctgcttcagttttgaaagtg

SEQ ID NO: 182308 - DNA, 20 bp, Artificial
  CRISPR gRNA sequence
tgcttcagttttgaaagtga

SEQ ID NO: 182309 - DNA, 20 bp, Artificial
  CRISPR gRNA sequence
cttcagttttgaaagtgaat

SEQ ID NO: 182310 - DNA, 20 bp, Artificial
  CRISPR gRNA sequence
cagttttgaaagtgaatata

SEQ ID NO: 182311 - DNA, 20 bp, Artificial
  CRISPR gRNA sequence
agttttgaaagtgaatatag

SEQ ID NO: 182312 - DNA, 20 bp, Artificial
  CRISPR gRNA sequence
tgaaagtgaatatagttttt

SEQ ID NO: 182313 - DNA, 20 bp, Artificial
  CRISPR gRNA sequence
gaaagtgaatatagtttttg

SEQ ID NO: 182314 - DNA, 20 bp, Artificial
  CRISPR gRNA sequence
aaagtgaatatagtttttgc

SEQ ID NO: 182315 - DNA, 20 bp, Artificial
  CRISPR gRNA sequence
ttgcagccgggggcagtggc

SEQ ID NO: 182316 - DNA, 20 bp, Artificial
  CRISPR gRNA sequence
tgcagccgggggcagtggct

SEQ ID NO: 182317 - DNA, 20 bp, Artificial
  CRISPR gRNA sequence
gcagccgggggcagtggctc

SEQ ID NO: 182318 - DNA, 20 bp, Artificial
  CRISPR gRNA sequence
cagccgggggcagtggctca

SEQ ID NO: 182319 - DNA, 20 bp, Artificial
  CRISPR gRNA sequence
atgcctgtaatcccagcact

SEQ ID NO: 182320 - DNA, 20 bp, Artificial
  CRISPR gRNA sequence
taatcccagcactttggaag

SEQ ID NO: 182321 - DNA, 20 bp, Artificial
  CRISPR gRNA sequence
tggaaggcgaaggtgggtgg

SEQ ID NO: 182322 - DNA, 20 bp, Artificial
  CRISPR gRNA sequence
ggaaggcgaaggtgggtgga

SEQ ID NO: 182323 - DNA, 20 bp, Artificial
  CRISPR gRNA sequence
gaaggcgaaggtgggtggat

SEQ ID NO: 182324 - DNA, 20 bp, Artificial
  CRISPR gRNA sequence
aggtcaggagtttgagacca

SEQ ID NO: 182325 - DNA, 20 bp, Artificial
  CRISPR gRNA sequence
gagaccagcctgactaacat

SEQ ID NO: 182326 - DNA, 20 bp, Artificial
  CRISPR gRNA sequence
agaccagcctgactaacatg

SEQ ID NO: 182327 - DNA, 20 bp, Artificial
  CRISPR gRNA sequence
actaacatggtgaaacccat

SEQ ID NO: 182328 - DNA, 20 bp, Artificial
  CRISPR gRNA sequence
acatggtgaaacccatctct

SEQ ID NO: 182329 - DNA, 20 bp, Artificial
  CRISPR gRNA sequence
taccaaaaatataaaaatta

SEQ ID NO: 182330 - DNA, 20 bp, Artificial
  CRISPR gRNA sequence
ccaaaaatataaaaattagc

SEQ ID NO: 182331 - DNA, 20 bp, Artificial
  CRISPR gRNA sequence
gctgggcctggtggcgcatg

SEQ ID NO: 182332 - DNA, 20 bp, Artificial
  CRISPR gRNA sequence
ggcctggtggcgcatgcctg

SEQ ID NO: 182333 - DNA, 20 bp, Artificial
  CRISPR gRNA sequence
gtggcgcatgcctgtaatcc

SEQ ID NO: 182334 - DNA, 20 bp, Artificial
  CRISPR gRNA sequence
taatcccagctactctgaag

SEQ ID NO: 182335 - DNA, 20 bp, Artificial
  CRISPR gRNA sequence
ctctgaaggctgaggcagga

SEQ ID NO: 182336 - DNA, 20 bp, Artificial
  CRISPR gRNA sequence
tgaaggctgaggcaggagaa

SEQ ID NO: 182337 - DNA, 20 bp, Artificial
  CRISPR gRNA sequence
aaggctgaggcaggagaatc

SEQ ID NO: 182338 - DNA, 20 bp, Artificial
  CRISPR gRNA sequence
aggcaggagaatcgcttgaa

SEQ ID NO: 182339 - DNA, 20 bp, Artificial
  CRISPR gRNA sequence
gaacctgagaggcggaggtt

SEQ ID NO: 182340 - DNA, 20 bp, Artificial
  CRISPR gRNA sequence
aacctgagaggcggaggttg

SEQ ID NO: 182341 - DNA, 20 bp, Artificial
  CRISPR gRNA sequence
agaggcggaggttgcagtga

SEQ ID NO: 182342 - DNA, 20 bp, Artificial
  CRISPR gRNA sequence
cagtgagctgagattgtgtc

SEQ ID NO: 182343 - DNA, 20 bp, Artificial
  CRISPR gRNA sequence
agattgtgtcattgcactcc

SEQ ID NO: 182344 - DNA, 20 bp, Artificial
  CRISPR gRNA sequence
tgtcattgcactccagcctg

SEQ ID NO: 182345 - DNA, 20 bp, Artificial
  CRISPR gRNA sequence
cactccagcctgggcaacaa

SEQ ID NO: 182346 - DNA, 20 bp, Artificial
  CRISPR gRNA sequence
cagcctgggcaacaagagca

SEQ ID NO: 182347 - DNA, 20 bp, Artificial
  CRISPR gRNA sequence
ggcaacaagagcaaaactcc

SEQ ID NO: 182348 - DNA, 20 bp, Artificial
  CRISPR gRNA sequence
catttcaaaaaaaagttttt

SEQ ID NO: 182349 - DNA, 20 bp, Artificial
  CRISPR gRNA sequence
caaaaaaaagtttttgcagt

SEQ ID NO: 182350 - DNA, 20 bp, Artificial
  CRISPR gRNA sequence
aaaaaaaagtttttgcagta

SEQ ID NO: 182351 - DNA, 20 bp, Artificial
  CRISPR gRNA sequence
ttgcagtagttgtacgccag

SEQ ID NO: 182352 - DNA, 20 bp, Artificial
  CRISPR gRNA sequence
tgcagtagttgtacgccagc

SEQ ID NO: 182353 - DNA, 20 bp, Artificial
  CRISPR gRNA sequence
gcagtagttgtacgccagct

SEQ ID NO: 182354 - DNA, 20 bp, Artificial
  CRISPR gRNA sequence
cagtagttgtacgccagctg

SEQ ID NO: 182355 - DNA, 20 bp, Artificial
  CRISPR gRNA sequence
tacgccagctgttccattag

SEQ ID NO: 182356 - DNA, 20 bp, Artificial
  CRISPR gRNA sequence
ttccattagcccaaaaaatt

SEQ ID NO: 182357 - DNA, 20 bp, Artificial
  CRISPR gRNA sequence
cattagcccaaaaaattgag

SEQ ID NO: 182358 - DNA, 20 bp, Artificial
  CRISPR gRNA sequence
gcccaaaaaattgagacatg

SEQ ID NO: 182359 - DNA, 20 bp, Artificial
  CRISPR gRNA sequence
agacatggatgtcgttcctt

SEQ ID NO: 182360 - DNA, 20 bp, Artificial
  CRISPR gRNA sequence
cttatctctagcttttctag

SEQ ID NO: 182361 - DNA, 20 bp, Artificial
  CRISPR gRNA sequence
atctctagcttttctagtca

SEQ ID NO: 182362 - DNA, 20 bp, Artificial
  CRISPR gRNA sequence
tctctagcttttctagtcat

SEQ ID NO: 182363 - DNA, 20 bp, Artificial
  CRISPR gRNA sequence
tagcttttctagtcatcttt

SEQ ID NO: 182364 - DNA, 20 bp, Artificial
  CRISPR gRNA sequence
gcttttctagtcatcttttc

SEQ ID NO: 182365 - DNA, 20 bp, Artificial
  CRISPR gRNA sequence
ttctagtcatcttttcttga

SEQ ID NO: 182366 - DNA, 20 bp, Artificial
  CRISPR gRNA sequence
tctagtcatcttttcttgat

SEQ ID NO: 182367 - DNA, 20 bp, Artificial
  CRISPR gRNA sequence
ctagtcatcttttcttgatt

SEQ ID NO: 182368 - DNA, 20 bp, Artificial
  CRISPR gRNA sequence
tagtcatcttttcttgattt

SEQ ID NO: 182369 - DNA, 20 bp, Artificial
  CRISPR gRNA sequence
gtcatcttttcttgatttat

SEQ ID NO: 182370 - DNA, 20 bp, Artificial
  CRISPR gRNA sequence
ttcttgatttattatgctaa

SEQ ID NO: 182371 - DNA, 20 bp, Artificial
  CRISPR gRNA sequence
tcttgatttattatgctaac

SEQ ID NO: 182372 - DNA, 20 bp, Artificial
  CRISPR gRNA sequence
cttgatttattatgctaacc

SEQ ID NO: 182373 - DNA, 20 bp, Artificial
  CRISPR gRNA sequence
ttgatttattatgctaacct

SEQ ID NO: 182374 - DNA, 20 bp, Artificial
  CRISPR gRNA sequence
gatttattatgctaaccttt

SEQ ID NO: 182375 - DNA, 20 bp, Artificial
  CRISPR gRNA sequence
atttattatgctaacctttg

SEQ ID NO: 182376 - DNA, 20 bp, Artificial
  CRISPR gRNA sequence
attatgctaacctttgtttt

SEQ ID NO: 182377 - DNA, 20 bp, Artificial
  CRISPR gRNA sequence
ttatgctaacctttgtttta

SEQ ID NO: 182378 - DNA, 20 bp, Artificial
  CRISPR gRNA sequence
tgctaacctttgttttaagc

SEQ ID NO: 182379 - DNA, 20 bp, Artificial
  CRISPR gRNA sequence
acctttgttttaagccacat

SEQ ID NO: 182380 - DNA, 20 bp, Artificial
  CRISPR gRNA sequence
tgttttaagccacattccct

SEQ ID NO: 182381 - DNA, 20 bp, Artificial
  CRISPR gRNA sequence
gttttaagccacattccctc

SEQ ID NO: 182382 - DNA, 20 bp, Artificial
  CRISPR gRNA sequence
ttttaagccacattccctct

SEQ ID NO: 182383 - DNA, 20 bp, Artificial
  CRISPR gRNA sequence
taagccacattccctcttac

SEQ ID NO: 182384 - DNA, 20 bp, Artificial
  CRISPR gRNA sequence
aagccacattccctcttact

SEQ ID NO: 182385 - DNA, 20 bp, Artificial
  CRISPR gRNA sequence
agccacattccctcttacta

SEQ ID NO: 182386 - DNA, 20 bp, Artificial
  CRISPR gRNA sequence
cctcttactatgtccttaca

SEQ ID NO: 182387 - DNA, 20 bp, Artificial
  CRISPR gRNA sequence
ttactatgtccttacacagt

SEQ ID NO: 182388 - DNA, 20 bp, Artificial
  CRISPR gRNA sequence
actatgtccttacacagttg

SEQ ID NO: 182389 - DNA, 20 bp, Artificial
  CRISPR gRNA sequence
ctatgtccttacacagttga

SEQ ID NO: 182390 - DNA, 20 bp, Artificial
  CRISPR gRNA sequence
tgtccttacacagttgagag

SEQ ID NO: 182391 - DNA, 20 bp, Artificial
  CRISPR gRNA sequence
acacagttgagagggaagtc

SEQ ID NO: 182392 - DNA, 20 bp, Artificial
  CRISPR gRNA sequence
cacagttgagagggaagtcg

SEQ ID NO: 182393 - DNA, 20 bp, Artificial
  CRISPR gRNA sequence
agagggaagtcgtggagatg

SEQ ID NO: 182394 - DNA, 20 bp, Artificial
  CRISPR gRNA sequence
taccagagagtgggtgtgag

SEQ ID NO: 182395 - DNA, 20 bp, Artificial
  CRISPR gRNA sequence
aggaccagtgccaacatgca

SEQ ID NO: 182396 - DNA, 20 bp, Artificial
  CRISPR gRNA sequence
ctgcctcctccctcccgggc

SEQ ID NO: 182397 - DNA, 20 bp, Artificial
  CRISPR gRNA sequence
tgcctcctccctcccgggcc

SEQ ID NO: 182398 - DNA, 20 bp, Artificial
  CRISPR gRNA sequence
cctcctccctcccgggccct

SEQ ID NO: 182399 - DNA, 20 bp, Artificial
  CRISPR gRNA sequence
ctccctcccgggcccttgtc

SEQ ID NO: 182400 - DNA, 20 bp, Artificial
  CRISPR gRNA sequence
cctcccgggcccttgtcctg

SEQ ID NO: 182401 - DNA, 20 bp, Artificial
  CRISPR gRNA sequence
ccgggcccttgtcctgactg

SEQ ID NO: 182402 - DNA, 20 bp, Artificial
  CRISPR gRNA sequence
gtcctgactgcagtgcactt

SEQ ID NO: 182403 - DNA, 20 bp, Artificial
  CRISPR gRNA sequence
tcctgactgcagtgcacttc

SEQ ID NO: 182404 - DNA, 20 bp, Artificial
  CRISPR gRNA sequence
actgcagtgcacttctgcat

SEQ ID NO: 182405 - DNA, 20 bp, Artificial
  CRISPR gRNA sequence
cagtgcacttctgcatccta

SEQ ID NO: 182406 - DNA, 20 bp, Artificial
  CRISPR gRNA sequence
ctgcatcctatctgagattg

SEQ ID NO: 182407 - DNA, 20 bp, Artificial
  CRISPR gRNA sequence
tgcatcctatctgagattgt

SEQ ID NO: 182408 - DNA, 20 bp, Artificial
  CRISPR gRNA sequence
catcctatctgagattgtga

SEQ ID NO: 182409 - DNA, 20 bp, Artificial
  CRISPR gRNA sequence
tctgagattgtgaaaatggc

SEQ ID NO: 182410 - DNA, 20 bp, Artificial
  CRISPR gRNA sequence
agattgtgaaaatggccaag

SEQ ID NO: 182411 - DNA, 20 bp, Artificial
  CRISPR gRNA sequence
tgaaaatggccaagggtgtg

SEQ ID NO: 182412 - DNA, 20 bp, Artificial
  CRISPR gRNA sequence
gctgagaggagctggctcat

SEQ ID NO: 182413 - DNA, 20 bp, Artificial
  CRISPR gRNA sequence
agaggagctggctcattgag

SEQ ID NO: 182414 - DNA, 20 bp, Artificial
  CRISPR gRNA sequence
gctcattgagggcagggcca

SEQ ID NO: 182415 - DNA, 20 bp, Artificial
  CRISPR gRNA sequence
attgagggcagggccacagg

SEQ ID NO: 182416 - DNA, 20 bp, Artificial
  CRISPR gRNA sequence
agggcagggccacagggtga

SEQ ID NO: 182417 - DNA, 20 bp, Artificial
  CRISPR gRNA sequence
cactggaagggagttgatag

SEQ ID NO: 182418 - DNA, 20 bp, Artificial
  CRISPR gRNA sequence
gaagggagttgatagcctct

SEQ ID NO: 182419 - DNA, 20 bp, Artificial
  CRISPR gRNA sequence
atagcctcttgctcttctgt

SEQ ID NO: 182420 - DNA, 20 bp, Artificial
  CRISPR gRNA sequence
ttgctcttctgtccccagct

SEQ ID NO: 182421 - DNA, 20 bp, Artificial
  CRISPR gRNA sequence
gctcttctgtccccagctct

SEQ ID NO: 182422 - DNA, 20 bp, Artificial
  CRISPR gRNA sequence
ctcttctgtccccagctctt

SEQ ID NO: 182423 - DNA, 20 bp, Artificial
  CRISPR gRNA sequence
ttctgtccccagctcttgga

SEQ ID NO: 182424 - DNA, 20 bp, Artificial
  CRISPR gRNA sequence
ctgtccccagctcttggagc

SEQ ID NO: 182425 - DNA, 20 bp, Artificial
  CRISPR gRNA sequence
tgtccccagctcttggagca

SEQ ID NO: 182426 - DNA, 20 bp, Artificial
  CRISPR gRNA sequence
tccccagctcttggagcagt

SEQ ID NO: 182427 - DNA, 20 bp, Artificial
  CRISPR gRNA sequence
ttggagcagtcggagtggca

SEQ ID NO: 182428 - DNA, 20 bp, Artificial
  CRISPR gRNA sequence
ggagcagtcggagtggcagc

SEQ ID NO: 182429 - DNA, 20 bp, Artificial
  CRISPR gRNA sequence
gagcagtcggagtggcagcc

SEQ ID NO: 182430 - DNA, 20 bp, Artificial
  CRISPR gRNA sequence
ctcaatgaacctggagtcca

SEQ ID NO: 182431 - DNA, 20 bp, Artificial
  CRISPR gRNA sequence
aatgaacctggagtccagcc

SEQ ID NO: 182432 - DNA, 20 bp, Artificial
  CRISPR gRNA sequence
gagtccagcccacctctgtc

SEQ ID NO: 182433 - DNA, 20 bp, Artificial
  CRISPR gRNA sequence
tgtctatggagactttagct

SEQ ID NO: 182434 - DNA, 20 bp, Artificial
  CRISPR gRNA sequence
tctatggagactttagctgt

SEQ ID NO: 182435 - DNA, 20 bp, Artificial
  CRISPR gRNA sequence
tggagactttagctgtaagg

SEQ ID NO: 182436 - DNA, 20 bp, Artificial
  CRISPR gRNA sequence
tagctgtaaggaggagccag

SEQ ID NO: 182437 - DNA, 20 bp, Artificial
  CRISPR gRNA sequence
agctgtaaggaggagccaga

SEQ ID NO: 182438 - DNA, 20 bp, Artificial
  CRISPR gRNA sequence
gctgtaaggaggagccagaa

SEQ ID NO: 182439 - DNA, 20 bp, Artificial
  CRISPR gRNA sequence
taaggaggagccagaaattg

SEQ ID NO: 182440 - DNA, 20 bp, Artificial
  CRISPR gRNA sequence
acagcccagggggtaagaag

SEQ ID NO: 182441 - DNA, 20 bp, Artificial
  CRISPR gRNA sequence
gatccttatggcttcttaga

SEQ ID NO: 182442 - DNA, 20 bp, Artificial
  CRISPR gRNA sequence
atggcttcttagatgaggga

SEQ ID NO: 182443 - DNA, 20 bp, Artificial
  CRISPR gRNA sequence
tggcttcttagatgagggag

SEQ ID NO: 182444 - DNA, 20 bp, Artificial
  CRISPR gRNA sequence
cttagatgagggagaaccac

SEQ ID NO: 182445 - DNA, 20 bp, Artificial
  CRISPR gRNA sequence
ttagatgagggagaaccacg

SEQ ID NO: 182446 - DNA, 20 bp, Artificial
  CRISPR gRNA sequence
agatgagggagaaccacgta

SEQ ID NO: 182447 - DNA, 20 bp, Artificial
  CRISPR gRNA sequence
gatgagggagaaccacgtag

SEQ ID NO: 182448 - DNA, 20 bp, Artificial
  CRISPR gRNA sequence
gggggcagggccagggagca

SEQ ID NO: 182449 - DNA, 20 bp, Artificial
  CRISPR gRNA sequence
ggggcagggccagggagcag

SEQ ID NO: 182450 - DNA, 20 bp, Artificial
  CRISPR gRNA sequence
gggtactgacacattgtgaa

SEQ ID NO: 182451 - DNA, 20 bp, Artificial
  CRISPR gRNA sequence
acacattgtgaattagctac

SEQ ID NO: 182452 - DNA, 20 bp, Artificial
  CRISPR gRNA sequence
tgaattagctacggctgcca

SEQ ID NO: 182453 - DNA, 20 bp, Artificial
  CRISPR gRNA sequence
gctacggctgccatgcctta

SEQ ID NO: 182454 - DNA, 20 bp, Artificial
  CRISPR gRNA sequence
cggctgccatgccttaaggt

SEQ ID NO: 182455 - DNA, 20 bp, Artificial
  CRISPR gRNA sequence
ccatgccttaaggtttgcct

SEQ ID NO: 182456 - DNA, 20 bp, Artificial
  CRISPR gRNA sequence
aaggtttgcctgaagctgag

SEQ ID NO: 182457 - DNA, 20 bp, Artificial
  CRISPR gRNA sequence
aggtttgcctgaagctgagt

SEQ ID NO: 182458 - DNA, 20 bp, Artificial
  CRISPR gRNA sequence
gcctgaagctgagtggatgt

SEQ ID NO: 182459 - DNA, 20 bp, Artificial
  CRISPR gRNA sequence
cctgaagctgagtggatgtt

SEQ ID NO: 182460 - DNA, 20 bp, Artificial
  CRISPR gRNA sequence
aagctgagtggatgtttact

SEQ ID NO: 182461 - DNA, 20 bp, Artificial
  CRISPR gRNA sequence
agtggatgtttactgctgtg

SEQ ID NO: 182462 - DNA, 20 bp, Artificial
  CRISPR gRNA sequence
actgctgtgctgggaagagc

SEQ ID NO: 182463 - DNA, 20 bp, Artificial
  CRISPR gRNA sequence
ctgctgtgctgggaagagca

SEQ ID NO: 182464 - DNA, 20 bp, Artificial
  CRISPR gRNA sequence
ctgtgctgggaagagcagag

SEQ ID NO: 182465 - DNA, 20 bp, Artificial
  CRISPR gRNA sequence
tgctgggaagagcagaggcc

SEQ ID NO: 182466 - DNA, 20 bp, Artificial
  CRISPR gRNA sequence
ggaagagcagaggccatgtc

SEQ ID NO: 182467 - DNA, 20 bp, Artificial
  CRISPR gRNA sequence
tggccttcaggggtaggggg

SEQ ID NO: 182468 - DNA, 20 bp, Artificial
  CRISPR gRNA sequence
caggggtagggggaagcaca

SEQ ID NO: 182469 - DNA, 20 bp, Artificial
  CRISPR gRNA sequence
aggggtagggggaagcacac

SEQ ID NO: 182470 - DNA, 20 bp, Artificial
  CRISPR gRNA sequence
atgccaccgtcccctaccct

SEQ ID NO: 182471 - DNA, 20 bp, Artificial
  CRISPR gRNA sequence
ccctcatacaaccttcttca

SEQ ID NO: 182472 - DNA, 20 bp, Artificial
  CRISPR gRNA sequence
atacaaccttcttcacatct

SEQ ID NO: 182473 - DNA, 20 bp, Artificial
  CRISPR gRNA sequence
cttcacatcttctaggggat

SEQ ID NO: 182474 - DNA, 20 bp, Artificial
  CRISPR gRNA sequence
ttcacatcttctaggggata

SEQ ID NO: 182475 - DNA, 20 bp, Artificial
  CRISPR gRNA sequence
cacatcttctaggggatatt

SEQ ID NO: 182476 - DNA, 20 bp, Artificial
  CRISPR gRNA sequence
acatcttctaggggatattg

SEQ ID NO: 182477 - DNA, 20 bp, Artificial
  CRISPR gRNA sequence
ctaggggatattgggctgag

SEQ ID NO: 182478 - DNA, 20 bp, Artificial
  CRISPR gRNA sequence
taggggatattgggctgagt

SEQ ID NO: 182479 - DNA, 20 bp, Artificial
  CRISPR gRNA sequence
ggggatattgggctgagtct

SEQ ID NO: 182480 - DNA, 20 bp, Artificial
  CRISPR gRNA sequence
ggctgagtctacagcgtgtc

SEQ ID NO: 182481 - DNA, 20 bp, Artificial
  CRISPR gRNA sequence
agtctacagcgtgtcttcac

SEQ ID NO: 182482 - DNA, 20 bp, Artificial
  CRISPR gRNA sequence
cagcgtgtcttcacagatct

SEQ ID NO: 182483 - DNA, 20 bp, Artificial
  CRISPR gRNA sequence
cacagatctgaagaacatgg

SEQ ID NO: 182484 - DNA, 20 bp, Artificial
  CRISPR gRNA sequence
acagatctgaagaacatgga

SEQ ID NO: 182485 - DNA, 20 bp, Artificial
  CRISPR gRNA sequence
aagaacatggatgccacctg

SEQ ID NO: 182486 - DNA, 20 bp, Artificial
  CRISPR gRNA sequence
gctggacagcctgctgaccc

SEQ ID NO: 182487 - DNA, 20 bp, Artificial
  CRISPR gRNA sequence
gacagcctgctgaccccagt

SEQ ID NO: 182488 - DNA, 20 bp, Artificial
  CRISPR gRNA sequence
ctgaccccagtccggttgcc

SEQ ID NO: 182489 - DNA, 20 bp, Artificial
  CRISPR gRNA sequence
accccagtccggttgccctc

SEQ ID NO: 182490 - DNA, 20 bp, Artificial
  CRISPR gRNA sequence
ccctccatccaggccattcc

SEQ ID NO: 182491 - DNA, 20 bp, Artificial
  CRISPR gRNA sequence
catccaggccattccctgtg

SEQ ID NO: 182492 - DNA, 20 bp, Artificial
  CRISPR gRNA sequence
cctgtgcaccgtagcagggc

SEQ ID NO: 182493 - DNA, 20 bp, Artificial
  CRISPR gRNA sequence
tgcaccgtagcagggcccct

SEQ ID NO: 182494 - DNA, 20 bp, Artificial
  CRISPR gRNA sequence
ggcccctcttattcctctag

SEQ ID NO: 182495 - DNA, 20 bp, Artificial
  CRISPR gRNA sequence
ttattcctctaggcaagcag

SEQ ID NO: 182496 - DNA, 20 bp, Artificial
  CRISPR gRNA sequence
attcctctaggcaagcagga

SEQ ID NO: 182497 - DNA, 20 bp, Artificial
  CRISPR gRNA sequence
ttcctctaggcaagcaggac

SEQ ID NO: 182498 - DNA, 20 bp, Artificial
  CRISPR gRNA sequence
ctctaggcaagcaggacctg

SEQ ID NO: 182499 - DNA, 20 bp, Artificial
  CRISPR gRNA sequence
taggcaagcaggacctggca

SEQ ID NO: 182500 - DNA, 20 bp, Artificial
  CRISPR gRNA sequence
ggcaagcaggacctggcatc

SEQ ID NO: 182501 - DNA, 20 bp, Artificial
  CRISPR gRNA sequence
gcatcatggtggatatggtg

SEQ ID NO: 182502 - DNA, 20 bp, Artificial
  CRISPR gRNA sequence
gacttctgtgggcccctcaa

SEQ ID NO: 182503 - DNA, 20 bp, Artificial
  CRISPR gRNA sequence
ctgtgggcccctcaacagcc

SEQ ID NO: 182504 - DNA, 20 bp, Artificial
  CRISPR gRNA sequence
tgtgggcccctcaacagcca

SEQ ID NO: 182505 - DNA, 20 bp, Artificial
  CRISPR gRNA sequence
tgggcccctcaacagccaag

SEQ ID NO: 182506 - DNA, 20 bp, Artificial
  CRISPR gRNA sequence
aacagccaagtgtgacccca

SEQ ID NO: 182507 - DNA, 20 bp, Artificial
  CRISPR gRNA sequence
ccaagtggggatggggcctc

SEQ ID NO: 182508 - DNA, 20 bp, Artificial
  CRISPR gRNA sequence
cctccttgggtcattgacct

SEQ ID NO: 182509 - DNA, 20 bp, Artificial
  CRISPR gRNA sequence
cttgggtcattgacctctca

SEQ ID NO: 182510 - DNA, 20 bp, Artificial
  CRISPR gRNA sequence
gggtcattgacctctcaggg

SEQ ID NO: 182511 - DNA, 20 bp, Artificial
  CRISPR gRNA sequence
ggtcattgacctctcagggc

SEQ ID NO: 182512 - DNA, 20 bp, Artificial
  CRISPR gRNA sequence
acctctcagggcctggcagg

SEQ ID NO: 182513 - DNA, 20 bp, Artificial
  CRISPR gRNA sequence
tcagggcctggcaggccagt

SEQ ID NO: 182514 - DNA, 20 bp, Artificial
  CRISPR gRNA sequence
agggcctggcaggccagtgt

SEQ ID NO: 182515 - DNA, 20 bp, Artificial
  CRISPR gRNA sequence
gcaggccagtgtctgggttt

SEQ ID NO: 182516 - DNA, 20 bp, Artificial
  CRISPR gRNA sequence
ggtttttcttgtggtgtaaa

SEQ ID NO: 182517 - DNA, 20 bp, Artificial
  CRISPR gRNA sequence
ttcttgtggtgtaaagctgg

SEQ ID NO: 182518 - DNA, 20 bp, Artificial
  CRISPR gRNA sequence
tcttgtggtgtaaagctggc

SEQ ID NO: 182519 - DNA, 20 bp, Artificial
  CRISPR gRNA sequence
cttgtggtgtaaagctggcc

SEQ ID NO: 182520 - DNA, 20 bp, Artificial
  CRISPR gRNA sequence
ttgtggtgtaaagctggccc

SEQ ID NO: 182521 - DNA, 20 bp, Artificial
  CRISPR gRNA sequence
gtggtgtaaagctggccctg

SEQ ID NO: 182522 - DNA, 20 bp, Artificial
  CRISPR gRNA sequence
tggtgtaaagctggccctgc

SEQ ID NO: 182523 - DNA, 20 bp, Artificial
  CRISPR gRNA sequence
gccctgcctcctgggaagat

SEQ ID NO: 182524 - DNA, 20 bp, Artificial
  CRISPR gRNA sequence
cctcctgggaagatgaggtt

SEQ ID NO: 182525 - DNA, 20 bp, Artificial
  CRISPR gRNA sequence
ctgggaagatgaggttctga

SEQ ID NO: 182526 - DNA, 20 bp, Artificial
  CRISPR gRNA sequence
ggaagatgaggttctgagac

SEQ ID NO: 182527 - DNA, 20 bp, Artificial
  CRISPR gRNA sequence
tgagaccagtgtatcaggtc

SEQ ID NO: 182528 - DNA, 20 bp, Artificial
  CRISPR gRNA sequence
agaccagtgtatcaggtcag

SEQ ID NO: 182529 - DNA, 20 bp, Artificial
  CRISPR gRNA sequence
ggacaggagtcagtgtctgg

SEQ ID NO: 182530 - DNA, 20 bp, Artificial
  CRISPR gRNA sequence
gacaggagtcagtgtctggc

SEQ ID NO: 182531 - DNA, 20 bp, Artificial
  CRISPR gRNA sequence
gctttttcctctgagcccag

SEQ ID NO: 182532 - DNA, 20 bp, Artificial
  CRISPR gRNA sequence
tttcctctgagcccagctgc

SEQ ID NO: 182533 - DNA, 20 bp, Artificial
  CRISPR gRNA sequence
ttcctctgagcccagctgcc

SEQ ID NO: 182534 - DNA, 20 bp, Artificial
  CRISPR gRNA sequence
tcctctgagcccagctgcct

SEQ ID NO: 182535 - DNA, 20 bp, Artificial
  CRISPR gRNA sequence
cctctgagcccagctgcctg

SEQ ID NO: 182536 - DNA, 20 bp, Artificial
  CRISPR gRNA sequence
ctctgagcccagctgcctgg

SEQ ID NO: 182537 - DNA, 20 bp, Artificial
  CRISPR gRNA sequence
tgagcccagctgcctggaga

SEQ ID NO: 182538 - DNA, 20 bp, Artificial
  CRISPR gRNA sequence
agcccagctgcctggagagg

SEQ ID NO: 182539 - DNA, 20 bp, Artificial
  CRISPR gRNA sequence
cctggagagggtctcgctgt

SEQ ID NO: 182540 - DNA, 20 bp, Artificial
  CRISPR gRNA sequence
gagagggtctcgctgtcact

SEQ ID NO: 182541 - DNA, 20 bp, Artificial
  CRISPR gRNA sequence
gctgtcactggctggctcct

SEQ ID NO: 182542 - DNA, 20 bp, Artificial
  CRISPR gRNA sequence
tcactggctggctcctaggg

SEQ ID NO: 182543 - DNA, 20 bp, Artificial
  CRISPR gRNA sequence
gctggctcctaggggaacag

SEQ ID NO: 182544 - DNA, 20 bp, Artificial
  CRISPR gRNA sequence
gctcctaggggaacagacca

SEQ ID NO: 182545 - DNA, 20 bp, Artificial
  CRISPR gRNA sequence
ctaggggaacagaccagtga

SEQ ID NO: 182546 - DNA, 20 bp, Artificial
  CRISPR gRNA sequence
ggggaacagaccagtgaccc

SEQ ID NO: 182547 - DNA, 20 bp, Artificial
  CRISPR gRNA sequence
gctctgcactaagagaaaat

SEQ ID NO: 182548 - DNA, 20 bp, Artificial
  CRISPR gRNA sequence
tgcactaagagaaaattgca

SEQ ID NO: 182549 - DNA, 20 bp, Artificial
  CRISPR gRNA sequence
cactaagagaaaattgcact

SEQ ID NO: 182550 - DNA, 20 bp, Artificial
  CRISPR gRNA sequence
agagaaaattgcactaaatg

SEQ ID NO: 182551 - DNA, 20 bp, Artificial
  CRISPR gRNA sequence
cactaaatgaatctcgttcc

SEQ ID NO: 182552 - DNA, 20 bp, Artificial
  CRISPR gRNA sequence
aatgaatctcgttcccaaag

SEQ ID NO: 182553 - DNA, 20 bp, Artificial
  CRISPR gRNA sequence
gttcccaaagaactaccccc

SEQ ID NO: 182554 - DNA, 20 bp, Artificial
  CRISPR gRNA sequence
ccaaagaactaccccctttt

SEQ ID NO: 182555 - DNA, 20 bp, Artificial
  CRISPR gRNA sequence
cccccttttcagctgagccc

SEQ ID NO: 182556 - DNA, 20 bp, Artificial
  CRISPR gRNA sequence
ttcagctgagccctggggac

SEQ ID NO: 182557 - DNA, 20 bp, Artificial
  CRISPR gRNA sequence
tcagctgagccctggggact

SEQ ID NO: 182558 - DNA, 20 bp, Artificial
  CRISPR gRNA sequence
cagctgagccctggggactg

SEQ ID NO: 182559 - DNA, 20 bp, Artificial
  CRISPR gRNA sequence
agctgagccctggggactgt

SEQ ID NO: 182560 - DNA, 20 bp, Artificial
  CRISPR gRNA sequence
agccctggggactgttccaa

SEQ ID NO: 182561 - DNA, 20 bp, Artificial
  CRISPR gRNA sequence
gggactgttccaaagccagt

SEQ ID NO: 182562 - DNA, 20 bp, Artificial
  CRISPR gRNA sequence
ttccaaagccagtgaaatgt

SEQ ID NO: 182563 - DNA, 20 bp, Artificial
  CRISPR gRNA sequence
caaagccagtgaaatgtgaa

SEQ ID NO: 182564 - DNA, 20 bp, Artificial
  CRISPR gRNA sequence
cggggcgatgctccctcagc

SEQ ID NO: 182565 - DNA, 20 bp, Artificial
  CRISPR gRNA sequence
ggggcgatgctccctcagcc

SEQ ID NO: 182566 - DNA, 20 bp, Artificial
  CRISPR gRNA sequence
cctcagcctcagaggagctc

SEQ ID NO: 182567 - DNA, 20 bp, Artificial
  CRISPR gRNA sequence
agcctcagaggagctctacc

SEQ ID NO: 182568 - DNA, 20 bp, Artificial
  CRISPR gRNA sequence
agaggagctctaccctgctc

SEQ ID NO: 182569 - DNA, 20 bp, Artificial
  CRISPR gRNA sequence
taccctgctccctgctttgg

SEQ ID NO: 182570 - DNA, 20 bp, Artificial
  CRISPR gRNA sequence
ccctgctccctgctttggct

SEQ ID NO: 182571 - DNA, 20 bp, Artificial
  CRISPR gRNA sequence
ctccctgctttggctgaggg

SEQ ID NO: 182572 - DNA, 20 bp, Artificial
  CRISPR gRNA sequence
cctgctttggctgaggggct

SEQ ID NO: 182573 - DNA, 20 bp, Artificial
  CRISPR gRNA sequence
ctttggctgaggggcttggg

SEQ ID NO: 182574 - DNA, 20 bp, Artificial
  CRISPR gRNA sequence
tggctgaggggcttgggaaa

SEQ ID NO: 182575 - DNA, 20 bp, Artificial
  CRISPR gRNA sequence
ggctgaggggcttgggaaaa

SEQ ID NO: 182576 - DNA, 20 bp, Artificial
  CRISPR gRNA sequence
gctgaggggcttgggaaaaa

SEQ ID NO: 182577 - DNA, 20 bp, Artificial
  CRISPR gRNA sequence
aggggcttgggaaaaaaact

SEQ ID NO: 182578 - DNA, 20 bp, Artificial
  CRISPR gRNA sequence
gggaaaaaaacttggcactt

SEQ ID NO: 182579 - DNA, 20 bp, Artificial
  CRISPR gRNA sequence
ggaaaaaaacttggcacttt

SEQ ID NO: 182580 - DNA, 20 bp, Artificial
  CRISPR gRNA sequence
ggcactttttcgtgtggatc

SEQ ID NO: 182581 - DNA, 20 bp, Artificial
  CRISPR gRNA sequence
gcactttttcgtgtggatct

SEQ ID NO: 182582 - DNA, 20 bp, Artificial
  CRISPR gRNA sequence
tttcgtgtggatcttgccac

SEQ ID NO: 182583 - DNA, 20 bp, Artificial
  CRISPR gRNA sequence
ttcgtgtggatcttgccaca

SEQ ID NO: 182584 - DNA, 20 bp, Artificial
  CRISPR gRNA sequence
tcgtgtggatcttgccacat

SEQ ID NO: 182585 - DNA, 20 bp, Artificial
  CRISPR gRNA sequence
cgtgtggatcttgccacatt

SEQ ID NO: 182586 - DNA, 20 bp, Artificial
  CRISPR gRNA sequence
gtgtggatcttgccacattt

SEQ ID NO: 182587 - DNA, 20 bp, Artificial
  CRISPR gRNA sequence
gccacatttctgatcagagg

SEQ ID NO: 182588 - DNA, 20 bp, Artificial
  CRISPR gRNA sequence
ccacatttctgatcagaggt

SEQ ID NO: 182589 - DNA, 20 bp, Artificial
  CRISPR gRNA sequence
ctgatcagaggtgtacacta

SEQ ID NO: 182590 - DNA, 20 bp, Artificial
  CRISPR gRNA sequence
tgatcagaggtgtacactaa

SEQ ID NO: 182591 - DNA, 20 bp, Artificial
  CRISPR gRNA sequence
atcagaggtgtacactaaca

SEQ ID NO: 182592 - DNA, 20 bp, Artificial
  CRISPR gRNA sequence
acatttcccccgagctcttg

SEQ ID NO: 182593 - DNA, 20 bp, Artificial
  CRISPR gRNA sequence
cccccgagctcttggccttt

SEQ ID NO: 182594 - DNA, 20 bp, Artificial
  CRISPR gRNA sequence
ccccgagctcttggcctttg

SEQ ID NO: 182595 - DNA, 20 bp, Artificial
  CRISPR gRNA sequence
ttggcctttgcatttattta

SEQ ID NO: 182596 - DNA, 20 bp, Artificial
  CRISPR gRNA sequence
ggcctttgcatttatttata

SEQ ID NO: 182597 - DNA, 20 bp, Artificial
  CRISPR gRNA sequence
gcctttgcatttatttatac

SEQ ID NO: 182598 - DNA, 20 bp, Artificial
  CRISPR gRNA sequence
tgcatttatttatacagtgc

SEQ ID NO: 182599 - DNA, 20 bp, Artificial
  CRISPR gRNA sequence
gcatttatttatacagtgcc

SEQ ID NO: 182600 - DNA, 20 bp, Artificial
  CRISPR gRNA sequence
catttatttatacagtgcct

SEQ ID NO: 182601 - DNA, 20 bp, Artificial
  CRISPR gRNA sequence
atttatacagtgccttgctc

SEQ ID NO: 182602 - DNA, 20 bp, Artificial
  CRISPR gRNA sequence
tttatacagtgccttgctcg

SEQ ID NO: 182603 - DNA, 20 bp, Artificial
  CRISPR gRNA sequence
atacagtgccttgctcggcg

SEQ ID NO: 182604 - DNA, 20 bp, Artificial
  CRISPR gRNA sequence
tacagtgccttgctcggcgc

SEQ ID NO: 182605 - DNA, 20 bp, Artificial
  CRISPR gRNA sequence
gctcggcgcccaccaccccc

SEQ ID NO: 182606 - DNA, 20 bp, Artificial
  CRISPR gRNA sequence
ctcggcgcccaccaccccct

SEQ ID NO: 182607 - DNA, 20 bp, Artificial
  CRISPR gRNA sequence
ggcgcccaccaccccctcaa

SEQ ID NO: 182608 - DNA, 20 bp, Artificial
  CRISPR gRNA sequence
aagccccagcagccctcaac

SEQ ID NO: 182609 - DNA, 20 bp, Artificial
  CRISPR gRNA sequence
aacaggcccagggagggaag

SEQ ID NO: 182610 - DNA, 20 bp, Artificial
  CRISPR gRNA sequence
ggtatgacttaaaattggaa

SEQ ID NO: 182611 - DNA, 20 bp, Artificial
  CRISPR gRNA sequence
gtatgacttaaaattggaaa

SEQ ID NO: 182612 - DNA, 20 bp, Artificial
  CRISPR gRNA sequence
aaaattggaaatgtcatcta

SEQ ID NO: 182613 - DNA, 20 bp, Artificial
  CRISPR gRNA sequence
aaattggaaatgtcatctaa

SEQ ID NO: 182614 - DNA, 20 bp, Artificial
  CRISPR gRNA sequence
gaaatgtcatctaaccatta

SEQ ID NO: 182615 - DNA, 20 bp, Artificial
  CRISPR gRNA sequence
accattaagtcatgtgtgaa

SEQ ID NO: 182616 - DNA, 20 bp, Artificial
  CRISPR gRNA sequence
agtcatgtgtgaacacataa

SEQ ID NO: 182617 - DNA, 20 bp, Artificial
  CRISPR gRNA sequence
gtctttttataaaaagtaaa

SEQ ID NO: 182618 - DNA, 20 bp, Artificial
  CRISPR gRNA sequence
tctttttataaaaagtaaat

SEQ ID NO: 182619 - DNA, 20 bp, Artificial
  CRISPR gRNA sequence
tttataaaaagtaaattgtt

SEQ ID NO: 182620 - DNA, 20 bp, Artificial
  CRISPR gRNA sequence
ttataaaaagtaaattgttt

SEQ ID NO: 182621 - DNA, 20 bp, Artificial
  CRISPR gRNA sequence
tataaaaagtaaattgttta

SEQ ID NO: 182622 - DNA, 20 bp, Artificial
  CRISPR gRNA sequence
ataaaaagtaaattgtttat

SEQ ID NO: 182623 - DNA, 20 bp, Artificial
  CRISPR gRNA sequence
taaaaagtaaattgtttata

SEQ ID NO: 182624 - DNA, 20 bp, Artificial
  CRISPR gRNA sequence
tttataaggggtgtggcctt

SEQ ID NO: 182625 - DNA, 20 bp, Artificial
  CRISPR gRNA sequence
ataaggggtgtggccttttt

SEQ ID NO: 182626 - DNA, 20 bp, Artificial
  CRISPR gRNA sequence
taaggggtgtggccttttta

SEQ ID NO: 182627 - DNA, 20 bp, Artificial
  CRISPR gRNA sequence
tttagagagaaatttaactt

SEQ ID NO: 182628 - DNA, 20 bp, Artificial
  CRISPR gRNA sequence
ttagagagaaatttaacttg

SEQ ID NO: 182629 - DNA, 20 bp, Artificial
  CRISPR gRNA sequence
tagagagaaatttaacttgt

SEQ ID NO: 182630 - DNA, 20 bp, Artificial
  CRISPR gRNA sequence
agagagaaatttaacttgta

SEQ ID NO: 182631 - DNA, 20 bp, Artificial
  CRISPR gRNA sequence
gagagaaatttaacttgtag

SEQ ID NO: 182632 - DNA, 20 bp, Artificial
  CRISPR gRNA sequence
aacttgtagatgattttact

SEQ ID NO: 182633 - DNA, 20 bp, Artificial
  CRISPR gRNA sequence
acttgtagatgattttactt

SEQ ID NO: 182634 - DNA, 20 bp, Artificial
  CRISPR gRNA sequence
gtagatgattttacttttta

SEQ ID NO: 182635 - DNA, 20 bp, Artificial
  CRISPR gRNA sequence
tagatgattttactttttat

SEQ ID NO: 182636 - DNA, 20 bp, Artificial
  CRISPR gRNA sequence
tactttttatggaaacactg

SEQ ID NO: 182637 - DNA, 20 bp, Artificial
  CRISPR gRNA sequence
actttttatggaaacactga

SEQ ID NO: 182638 - DNA, 20 bp, Artificial
  CRISPR gRNA sequence
ctttttatggaaacactgat

SEQ ID NO: 182639 - DNA, 20 bp, Artificial
  CRISPR gRNA sequence
tttatggaaacactgatgga

SEQ ID NO: 182640 - DNA, 20 bp, Artificial
  CRISPR gRNA sequence
ttatggaaacactgatggac

SEQ ID NO: 182641 - DNA, 20 bp, Artificial
  CRISPR gRNA sequence
tatggaaacactgatggact

SEQ ID NO: 182642 - DNA, 20 bp, Artificial
  CRISPR gRNA sequence
atggaaacactgatggactt

SEQ ID NO: 182643 - DNA, 20 bp, Artificial
  CRISPR gRNA sequence
tggaaacactgatggactta

SEQ ID NO: 182644 - DNA, 20 bp, Artificial
  CRISPR gRNA sequence
atggacttattattggcatc

SEQ ID NO: 182645 - DNA, 20 bp, Artificial
  CRISPR gRNA sequence
attattggcatcccgcctga

SEQ ID NO: 182646 - DNA, 20 bp, Artificial
  CRISPR gRNA sequence
ttattggcatcccgcctgaa

SEQ ID NO: 182647 - DNA, 20 bp, Artificial
  CRISPR gRNA sequence
ttggcatcccgcctgaactt

SEQ ID NO: 182648 - DNA, 20 bp, Artificial
  CRISPR gRNA sequence
gcatcccgcctgaacttgac

SEQ ID NO: 182649 - DNA, 20 bp, Artificial
  CRISPR gRNA sequence
aacttgactttggggtgaac

SEQ ID NO: 182650 - DNA, 20 bp, Artificial
  CRISPR gRNA sequence
gactttggggtgaacaggga

SEQ ID NO: 182651 - DNA, 20 bp, Artificial
  CRISPR gRNA sequence
actttggggtgaacagggac

SEQ ID NO: 182652 - DNA, 20 bp, Artificial
  CRISPR gRNA sequence
tggggtgaacagggacatgc

SEQ ID NO: 182653 - DNA, 20 bp, Artificial
  CRISPR gRNA sequence
ggggtgaacagggacatgca

SEQ ID NO: 182654 - DNA, 20 bp, Artificial
  CRISPR gRNA sequence
gggtgaacagggacatgcat

SEQ ID NO: 182655 - DNA, 20 bp, Artificial
  CRISPR gRNA sequence
ttataaaatcctttcggcca

SEQ ID NO: 182656 - DNA, 20 bp, Artificial
  CRISPR gRNA sequence
taaaatcctttcggccaggc

SEQ ID NO: 182657 - DNA, 20 bp, Artificial
  CRISPR gRNA sequence
tcggccaggcgcggtggctc

SEQ ID NO: 182658 - DNA, 20 bp, Artificial
  CRISPR gRNA sequence
cggccaggcgcggtggctca

SEQ ID NO: 182659 - DNA, 20 bp, Artificial
  CRISPR gRNA sequence
ggccaggcgcggtggctcac

SEQ ID NO: 182660 - DNA, 20 bp, Artificial
  CRISPR gRNA sequence
acacctgtaatcccagcact

SEQ ID NO: 182661 - DNA, 20 bp, Artificial
  CRISPR gRNA sequence
taatcccagcactttgggag

SEQ ID NO: 182662 - DNA, 20 bp, Artificial
  CRISPR gRNA sequence
tgggaggccgagatgggtgg

SEQ ID NO: 182663 - DNA, 20 bp, Artificial
  CRISPR gRNA sequence
gggaggccgagatgggtgga

SEQ ID NO: 182664 - DNA, 20 bp, Artificial
  CRISPR gRNA sequence
ggaggccgagatgggtggat

SEQ ID NO: 182665 - DNA, 20 bp, Artificial
  CRISPR gRNA sequence
aggtcaggagttcgagacca

SEQ ID NO: 182666 - DNA, 20 bp, Artificial
  CRISPR gRNA sequence
gagaccagcctggtgaaact

SEQ ID NO: 182667 - DNA, 20 bp, Artificial
  CRISPR gRNA sequence
gtgaaactccatttctacta

SEQ ID NO: 182668 - DNA, 20 bp, Artificial
  CRISPR gRNA sequence
catttctactaaaaatgcaa

SEQ ID NO: 182669 - DNA, 20 bp, Artificial
  CRISPR gRNA sequence
ctactaaaaatgcaaaaatt

SEQ ID NO: 182670 - DNA, 20 bp, Artificial
  CRISPR gRNA sequence
tactaaaaatgcaaaaatta

SEQ ID NO: 182671 - DNA, 20 bp, Artificial
  CRISPR gRNA sequence
ctaaaaatgcaaaaattagc

SEQ ID NO: 182672 - DNA, 20 bp, Artificial
  CRISPR gRNA sequence
aaaatgcaaaaattagctgg

SEQ ID NO: 182673 - DNA, 20 bp, Artificial
  CRISPR gRNA sequence
gctgggcgtggttgcgggtg

SEQ ID NO: 182674 - DNA, 20 bp, Artificial
  CRISPR gRNA sequence
ggcgtggttgcgggtgcttg

SEQ ID NO: 182675 - DNA, 20 bp, Artificial
  CRISPR gRNA sequence
cgggtgcttgtaatcccagc

SEQ ID NO: 182676 - DNA, 20 bp, Artificial
  CRISPR gRNA sequence
gtaatcccagctactcagga

SEQ ID NO: 182677 - DNA, 20 bp, Artificial
  CRISPR gRNA sequence
taatcccagctactcaggag

SEQ ID NO: 182678 - DNA, 20 bp, Artificial
  CRISPR gRNA sequence
ctcaggaggctgaggcaaga

SEQ ID NO: 182679 - DNA, 20 bp, Artificial
  CRISPR gRNA sequence
aggaggctgaggcaagagaa

SEQ ID NO: 182680 - DNA, 20 bp, Artificial
  CRISPR gRNA sequence
aggcaagagaatcgcttgaa

SEQ ID NO: 182681 - DNA, 20 bp, Artificial
  CRISPR gRNA sequence
gaacctgggaggtggaggtt

SEQ ID NO: 182682 - DNA, 20 bp, Artificial
  CRISPR gRNA sequence
aacctgggaggtggaggttg

SEQ ID NO: 182683 - DNA, 20 bp, Artificial
  CRISPR gRNA sequence
ggaggtggaggttgcagtga

SEQ ID NO: 182684 - DNA, 20 bp, Artificial
  CRISPR gRNA sequence
cagtgagccgagaacatgcc

SEQ ID NO: 182685 - DNA, 20 bp, Artificial
  CRISPR gRNA sequence
cactccagcccgggcaccaa

SEQ ID NO: 182686 - DNA, 20 bp, Artificial
  CRISPR gRNA sequence
cagcccgggcaccaaaaaaa

SEQ ID NO: 182687 - DNA, 20 bp, Artificial
  CRISPR gRNA sequence
tcatttggccgggcatggtg

SEQ ID NO: 182688 - DNA, 20 bp, Artificial
  CRISPR gRNA sequence
catttggccgggcatggtgg

SEQ ID NO: 182689 - DNA, 20 bp, Artificial
  CRISPR gRNA sequence
atttggccgggcatggtggc

SEQ ID NO: 182690 - DNA, 20 bp, Artificial
  CRISPR gRNA sequence
ggccgggcatggtggcttat

SEQ ID NO: 182691 - DNA, 20 bp, Artificial
  CRISPR gRNA sequence
gccgggcatggtggcttatg

SEQ ID NO: 182692 - DNA, 20 bp, Artificial
  CRISPR gRNA sequence
atgcctgtaatcctggcact

SEQ ID NO: 182693 - DNA, 20 bp, Artificial
  CRISPR gRNA sequence
tgcctgtaatcctggcactt

SEQ ID NO: 182694 - DNA, 20 bp, Artificial
  CRISPR gRNA sequence
taatcctggcactttgggag

SEQ ID NO: 182695 - DNA, 20 bp, Artificial
  CRISPR gRNA sequence
gcactttgggaggccaaggt

SEQ ID NO: 182696 - DNA, 20 bp, Artificial
  CRISPR gRNA sequence
tgggaggccaaggtgggcag

SEQ ID NO: 182697 - DNA, 20 bp, Artificial
  CRISPR gRNA sequence
gggaggccaaggtgggcaga

SEQ ID NO: 182698 - DNA, 20 bp, Artificial
  CRISPR gRNA sequence
ggaggccaaggtgggcagat

SEQ ID NO: 182699 - DNA, 20 bp, Artificial
  CRISPR gRNA sequence
aggtcaggagtttgagacca

SEQ ID NO: 182700 - DNA, 20 bp, Artificial
  CRISPR gRNA sequence
gagaccagcctggccaacat

SEQ ID NO: 182701 - DNA, 20 bp, Artificial
  CRISPR gRNA sequence
agaccagcctggccaacatg

SEQ ID NO: 182702 - DNA, 20 bp, Artificial
  CRISPR gRNA sequence
gccaacatggtgaaacctca

SEQ ID NO: 182703 - DNA, 20 bp, Artificial
  CRISPR gRNA sequence
atctctactaaaaatacaaa

SEQ ID NO: 182704 - DNA, 20 bp, Artificial
  CRISPR gRNA sequence
tactaaaaatacaaaaatta

SEQ ID NO: 182705 - DNA, 20 bp, Artificial
  CRISPR gRNA sequence
ctaaaaatacaaaaattagg

SEQ ID NO: 182706 - DNA, 20 bp, Artificial
  CRISPR gRNA sequence
aaaatacaaaaattaggccg

SEQ ID NO: 182707 - DNA, 20 bp, Artificial
  CRISPR gRNA sequence
ggccgggcacggtggctcac

SEQ ID NO: 182708 - DNA, 20 bp, Artificial
  CRISPR gRNA sequence
acgcctgtaatcccagcact

SEQ ID NO: 182709 - DNA, 20 bp, Artificial
  CRISPR gRNA sequence
taatcccagcactttgggag

SEQ ID NO: 182710 - DNA, 20 bp, Artificial
  CRISPR gRNA sequence
tgggaggcagaggcgggcgg

SEQ ID NO: 182711 - DNA, 20 bp, Artificial
  CRISPR gRNA sequence
gggaggcagaggcgggcgga

SEQ ID NO: 182712 - DNA, 20 bp, Artificial
  CRISPR gRNA sequence
ggaggcagaggcgggcggat

SEQ ID NO: 182713 - DNA, 20 bp, Artificial
  CRISPR gRNA sequence
gctaacacggtgaaaccccg

SEQ ID NO: 182714 - DNA, 20 bp, Artificial
  CRISPR gRNA sequence
acacggtgaaaccccgtctc

SEQ ID NO: 182715 - DNA, 20 bp, Artificial
  CRISPR gRNA sequence
tactaaaaatataaaaaatt

SEQ ID NO: 182716 - DNA, 20 bp, Artificial
  CRISPR gRNA sequence
ctaaaaatataaaaaattag

SEQ ID NO: 182717 - DNA, 20 bp, Artificial
  CRISPR gRNA sequence
aaaatataaaaaattagccg

SEQ ID NO: 182718 - DNA, 20 bp, Artificial
  CRISPR gRNA sequence
gccgggcctagtggcgggtg

SEQ ID NO: 182719 - DNA, 20 bp, Artificial
  CRISPR gRNA sequence
gtggcgggtgcctgtagtcc

SEQ ID NO: 182720 - DNA, 20 bp, Artificial
  CRISPR gRNA sequence
tagtcccagctactcgggag

SEQ ID NO: 182721 - DNA, 20 bp, Artificial
  CRISPR gRNA sequence
ctcgggaggctgaggcagga

SEQ ID NO: 182722 - DNA, 20 bp, Artificial
  CRISPR gRNA sequence
gggaggctgaggcaggagaa

SEQ ID NO: 182723 - DNA, 20 bp, Artificial
  CRISPR gRNA sequence
aggcaggagaatggcatgaa

SEQ ID NO: 182724 - DNA, 20 bp, Artificial
  CRISPR gRNA sequence
gcagtgagccgagattgcac

SEQ ID NO: 182725 - DNA, 20 bp, Artificial
  CRISPR gRNA sequence
cagtgagccgagattgcacc

SEQ ID NO: 182726 - DNA, 20 bp, Artificial
  CRISPR gRNA sequence
caccactgcactacagcctg

SEQ ID NO: 182727 - DNA, 20 bp, Artificial
  CRISPR gRNA sequence
cactacagcctgggcgacag

SEQ ID NO: 182728 - DNA, 20 bp, Artificial
  CRISPR gRNA sequence
cagcctgggcgacagagcga

SEQ ID NO: 182729 - DNA, 20 bp, Artificial
  CRISPR gRNA sequence
ggcgacagagcgagactccg

SEQ ID NO: 182730 - DNA, 20 bp, Artificial
  CRISPR gRNA sequence
cgtctcaaaaaaaaaaaaaa

SEQ ID NO: 182731 - DNA, 20 bp, Artificial
  CRISPR gRNA sequence
aaaaaaaaaaaaaaaaatta

SEQ ID NO: 182732 - DNA, 20 bp, Artificial
  CRISPR gRNA sequence
gccgggcctggtggcgggcg

SEQ ID NO: 182733 - DNA, 20 bp, Artificial
  CRISPR gRNA sequence
gtggcgggcgcctgtaatcc

SEQ ID NO: 182734 - DNA, 20 bp, Artificial
  CRISPR gRNA sequence
taatcccagctactgtggag

SEQ ID NO: 182735 - DNA, 20 bp, Artificial
  CRISPR gRNA sequence
ctgtggaggctgaagcacaa

SEQ ID NO: 182736 - DNA, 20 bp, Artificial
  CRISPR gRNA sequence
tggaggctgaagcacaagaa

SEQ ID NO: 182737 - DNA, 20 bp, Artificial
  CRISPR gRNA sequence
aagcacaagaatcacttgaa

SEQ ID NO: 182738 - DNA, 20 bp, Artificial
  CRISPR gRNA sequence
gaacccgggagatggaggtt

SEQ ID NO: 182739 - DNA, 20 bp, Artificial
  CRISPR gRNA sequence
aacccgggagatggaggttg

SEQ ID NO: 182740 - DNA, 20 bp, Artificial
  CRISPR gRNA sequence
cagtgagctgagactgtgcc

SEQ ID NO: 182741 - DNA, 20 bp, Artificial
  CRISPR gRNA sequence
agactgtgccactgcactcc

SEQ ID NO: 182742 - DNA, 20 bp, Artificial
  CRISPR gRNA sequence
tgccactgcactccagcctg

SEQ ID NO: 182743 - DNA, 20 bp, Artificial
  CRISPR gRNA sequence
cactccagcctgggtgacaa

SEQ ID NO: 182744 - DNA, 20 bp, Artificial
  CRISPR gRNA sequence
cagcctgggtgacaagagtg

SEQ ID NO: 182745 - DNA, 20 bp, Artificial
  CRISPR gRNA sequence
ggtgacaagagtgagacttt

SEQ ID NO: 182746 - DNA, 20 bp, Artificial
  CRISPR gRNA sequence
tgtctcaaaaaaaaaaaaat

SEQ ID NO: 182747 - DNA, 20 bp, Artificial
  CRISPR gRNA sequence
gtctcaaaaaaaaaaaaatc

SEQ ID NO: 182748 - DNA, 20 bp, Artificial
  CRISPR gRNA sequence
tctcaaaaaaaaaaaaatcc

SEQ ID NO: 182749 - DNA, 20 bp, Artificial
  CRISPR gRNA sequence
aaaaaaaaaaaaatcctttt

SEQ ID NO: 182750 - DNA, 20 bp, Artificial
  CRISPR gRNA sequence
ttgtttatgttcacatagac

SEQ ID NO: 182751 - DNA, 20 bp, Artificial
  CRISPR gRNA sequence
tgtttatgttcacatagaca

SEQ ID NO: 182752 - DNA, 20 bp, Artificial
  CRISPR gRNA sequence
gtttatgttcacatagacaa

SEQ ID NO: 182753 - DNA, 20 bp, Artificial
  CRISPR gRNA sequence
tttatgttcacatagacaat

SEQ ID NO: 182754 - DNA, 20 bp, Artificial
  CRISPR gRNA sequence
atgttcacatagacaatggc

SEQ ID NO: 182755 - DNA, 20 bp, Artificial
  CRISPR gRNA sequence
tgttcacatagacaatggca

SEQ ID NO: 182756 - DNA, 20 bp, Artificial
  CRISPR gRNA sequence
acatagacaatggcagaagg

SEQ ID NO: 182757 - DNA, 20 bp, Artificial
  CRISPR gRNA sequence
ctgtcataggaacatgctta

SEQ ID NO: 182758 - DNA, 20 bp, Artificial
  CRISPR gRNA sequence
tcataggaacatgcttatat

SEQ ID NO: 182759 - DNA, 20 bp, Artificial
  CRISPR gRNA sequence
atataaacatagtcacctgt

SEQ ID NO: 182760 - DNA, 20 bp, Artificial
  CRISPR gRNA sequence
tataaacatagtcacctgtc

SEQ ID NO: 182761 - DNA, 20 bp, Artificial
  CRISPR gRNA sequence
tccttgactatcaccagggc

SEQ ID NO: 182762 - DNA, 20 bp, Artificial
  CRISPR gRNA sequence
gactatcaccagggctgtca

SEQ ID NO: 182763 - DNA, 20 bp, Artificial
  CRISPR gRNA sequence
actatcaccagggctgtcag

SEQ ID NO: 182764 - DNA, 20 bp, Artificial
  CRISPR gRNA sequence
tcaccagggctgtcagttga

SEQ ID NO: 182765 - DNA, 20 bp, Artificial
  CRISPR gRNA sequence
tcagttgattctgggctcct

SEQ ID NO: 182766 - DNA, 20 bp, Artificial
  CRISPR gRNA sequence
attctgggctcctggggccc

SEQ ID NO: 182767 - DNA, 20 bp, Artificial
  CRISPR gRNA sequence
tgggctcctggggcccaagg

SEQ ID NO: 182768 - DNA, 20 bp, Artificial
  CRISPR gRNA sequence
ggctcctggggcccaaggag

SEQ ID NO: 182769 - DNA, 20 bp, Artificial
  CRISPR gRNA sequence
ctggggcccaaggagtgtta

SEQ ID NO: 182770 - DNA, 20 bp, Artificial
  CRISPR gRNA sequence
gggcccaaggagtgttaagt

SEQ ID NO: 182771 - DNA, 20 bp, Artificial
  CRISPR gRNA sequence
agttttgaggcatgtgccat

SEQ ID NO: 182772 - DNA, 20 bp, Artificial
  CRISPR gRNA sequence
tgaggcatgtgccataggtg

SEQ ID NO: 182773 - DNA, 20 bp, Artificial
  CRISPR gRNA sequence
gaggcatgtgccataggtga

SEQ ID NO: 182774 - DNA, 20 bp, Artificial
  CRISPR gRNA sequence
aggcatgtgccataggtgat

SEQ ID NO: 182775 - DNA, 20 bp, Artificial
  CRISPR gRNA sequence
ctaacacacagatgctgctc

SEQ ID NO: 182776 - DNA, 20 bp, Artificial
  CRISPR gRNA sequence
acacacagatgctgctccaa

SEQ ID NO: 182777 - DNA, 20 bp, Artificial
  CRISPR gRNA sequence
ctccaaaaagtcagttgata

SEQ ID NO: 182778 - DNA, 20 bp, Artificial
  CRISPR gRNA sequence
caaaaagtcagttgatatga

SEQ ID NO: 182779 - DNA, 20 bp, Artificial
  CRISPR gRNA sequence
atatgacacagtcacagaca

SEQ ID NO: 182780 - DNA, 20 bp, Artificial
  CRISPR gRNA sequence
acggctgctgtgctgggtag

SEQ ID NO: 182781 - DNA, 20 bp, Artificial
  CRISPR gRNA sequence
ctgtgctgggtagcacttgc

SEQ ID NO: 182782 - DNA, 20 bp, Artificial
  CRISPR gRNA sequence
tgctgggtagcacttgccat

SEQ ID NO: 182783 - DNA, 20 bp, Artificial
  CRISPR gRNA sequence
ggtagcacttgccatccagt

SEQ ID NO: 182784 - DNA, 20 bp, Artificial
  CRISPR gRNA sequence
gccatccagtttctagagtg

SEQ ID NO: 182785 - DNA, 20 bp, Artificial
  CRISPR gRNA sequence
ccatccagtttctagagtga

SEQ ID NO: 182786 - DNA, 20 bp, Artificial
  CRISPR gRNA sequence
ctagagtgatgaaatgctct

SEQ ID NO: 182787 - DNA, 20 bp, Artificial
  CRISPR gRNA sequence
tagagtgatgaaatgctctg

SEQ ID NO: 182788 - DNA, 20 bp, Artificial
  CRISPR gRNA sequence
gagtgatgaaatgctctgtc

SEQ ID NO: 182789 - DNA, 20 bp, Artificial
  CRISPR gRNA sequence
tgtctgtaccgttcaataca

SEQ ID NO: 182790 - DNA, 20 bp, Artificial
  CRISPR gRNA sequence
tctgtaccgttcaatacagt

SEQ ID NO: 182791 - DNA, 20 bp, Artificial
  CRISPR gRNA sequence
taccgttcaatacagtaggc

SEQ ID NO: 182792 - DNA, 20 bp, Artificial
  CRISPR gRNA sequence
aatacagtaggcactggcac

SEQ ID NO: 182793 - DNA, 20 bp, Artificial
  CRISPR gRNA sequence
gcactagccacatgtgccag

SEQ ID NO: 182794 - DNA, 20 bp, Artificial
  CRISPR gRNA sequence
gccacatgtgccagctaagc

SEQ ID NO: 182795 - DNA, 20 bp, Artificial
  CRISPR gRNA sequence
agcacttgaaatgtggccag

SEQ ID NO: 182796 - DNA, 20 bp, Artificial
  CRISPR gRNA sequence
gaaatgtggccagtgcaata

SEQ ID NO: 182797 - DNA, 20 bp, Artificial
  CRISPR gRNA sequence
aaatgtggccagtgcaataa

SEQ ID NO: 182798 - DNA, 20 bp, Artificial
  CRISPR gRNA sequence
aacttttaattgcatttaat

SEQ ID NO: 182799 - DNA, 20 bp, Artificial
  CRISPR gRNA sequence
ttaattgcatttaataaact

SEQ ID NO: 182800 - DNA, 20 bp, Artificial
  CRISPR gRNA sequence
taattgcatttaataaactg

SEQ ID NO: 182801 - DNA, 20 bp, Artificial
  CRISPR gRNA sequence
aattgcatttaataaactgt

SEQ ID NO: 182802 - DNA, 20 bp, Artificial
  CRISPR gRNA sequence
attgcatttaataaactgta

SEQ ID NO: 182803 - DNA, 20 bp, Artificial
  CRISPR gRNA sequence
catttaataaactgtatgta

SEQ ID NO: 182804 - DNA, 20 bp, Artificial
  CRISPR gRNA sequence
aataaactgtatgtaaatag

SEQ ID NO: 182805 - DNA, 20 bp, Artificial
  CRISPR gRNA sequence
ataaactgtatgtaaatagt

SEQ ID NO: 182806 - DNA, 20 bp, Artificial
  CRISPR gRNA sequence
tatgtaaatagtcacatgtg

SEQ ID NO: 182807 - DNA, 20 bp, Artificial
  CRISPR gRNA sequence
ccatattgaacagtgcaggt

SEQ ID NO: 182808 - DNA, 20 bp, Artificial
  CRISPR gRNA sequence
aacagtgcaggtagatactg

SEQ ID NO: 182809 - DNA, 20 bp, Artificial
  CRISPR gRNA sequence
gactgggggcagatctgagg

SEQ ID NO: 182810 - DNA, 20 bp, Artificial
  CRISPR gRNA sequence
ggggcagatctgagggagag

SEQ ID NO: 182811 - DNA, 20 bp, Artificial
  CRISPR gRNA sequence
agggagaggggtttgagtag

SEQ ID NO: 182812 - DNA, 20 bp, Artificial
  CRISPR gRNA sequence
gagtagtgggaggacactgg

SEQ ID NO: 182813 - DNA, 20 bp, Artificial
  CRISPR gRNA sequence
agtagtgggaggacactggg

SEQ ID NO: 182814 - DNA, 20 bp, Artificial
  CRISPR gRNA sequence
ggaggcagctgcctactctg

SEQ ID NO: 182815 - DNA, 20 bp, Artificial
  CRISPR gRNA sequence
agctgcctactctgcagctg

SEQ ID NO: 182816 - DNA, 20 bp, Artificial
  CRISPR gRNA sequence
gcagctgtggttctccacca

SEQ ID NO: 182817 - DNA, 20 bp, Artificial
  CRISPR gRNA sequence
agctgtggttctccaccaca

SEQ ID NO: 182818 - DNA, 20 bp, Artificial
  CRISPR gRNA sequence
ctgtggttctccaccacaga

SEQ ID NO: 182819 - DNA, 20 bp, Artificial
  CRISPR gRNA sequence
tggttctccaccacagagag

SEQ ID NO: 182820 - DNA, 20 bp, Artificial
  CRISPR gRNA sequence
ctccaccacagagagaagaa

SEQ ID NO: 182821 - DNA, 20 bp, Artificial
  CRISPR gRNA sequence
tccaccacagagagaagaaa

SEQ ID NO: 182822 - DNA, 20 bp, Artificial
  CRISPR gRNA sequence
ccaccacagagagaagaaaa

SEQ ID NO: 182823 - DNA, 20 bp, Artificial
  CRISPR gRNA sequence
accacagagagaagaaaagg

SEQ ID NO: 182824 - DNA, 20 bp, Artificial
  CRISPR gRNA sequence
ccacagagagaagaaaaggg

SEQ ID NO: 182825 - DNA, 20 bp, Artificial
  CRISPR gRNA sequence
cacagagagaagaaaaggga

SEQ ID NO: 182826 - DNA, 20 bp, Artificial
  CRISPR gRNA sequence
cagagagaagaaaagggagg

SEQ ID NO: 182827 - DNA, 20 bp, Artificial
  CRISPR gRNA sequence
gagaagaaaagggagggaga

SEQ ID NO: 182828 - DNA, 20 bp, Artificial
  CRISPR gRNA sequence
gaagaaaagggagggagatg

SEQ ID NO: 182829 - DNA, 20 bp, Artificial
  CRISPR gRNA sequence
agggagggagatggagtgcg

SEQ ID NO: 182830 - DNA, 20 bp, Artificial
  CRISPR gRNA sequence
gggagggagatggagtgcgc

SEQ ID NO: 182831 - DNA, 20 bp, Artificial
  CRISPR gRNA sequence
gagatggagtgcgcaggtct

SEQ ID NO: 182832 - DNA, 20 bp, Artificial
  CRISPR gRNA sequence
atggagtgcgcaggtctgag

SEQ ID NO: 182833 - DNA, 20 bp, Artificial
  CRISPR gRNA sequence
tggagtgcgcaggtctgaga

SEQ ID NO: 182834 - DNA, 20 bp, Artificial
  CRISPR gRNA sequence
gtctgagaaggctttcattc

SEQ ID NO: 182835 - DNA, 20 bp, Artificial
  CRISPR gRNA sequence
ctgagaaggctttcattctg

SEQ ID NO: 182836 - DNA, 20 bp, Artificial
  CRISPR gRNA sequence
ctttcattctggagcatctg

SEQ ID NO: 182837 - DNA, 20 bp, Artificial
  CRISPR gRNA sequence
tttcattctggagcatctgc

SEQ ID NO: 182838 - DNA, 20 bp, Artificial
  CRISPR gRNA sequence
tcattctggagcatctgcag

SEQ ID NO: 182839 - DNA, 20 bp, Artificial
  CRISPR gRNA sequence
atctgcaggagcctgcacca

SEQ ID NO: 182840 - DNA, 20 bp, Artificial
  CRISPR gRNA sequence
caggagcctgcaccatggcc

SEQ ID NO: 182841 - DNA, 20 bp, Artificial
  CRISPR gRNA sequence
gagcctgcaccatggcccag

SEQ ID NO: 182842 - DNA, 20 bp, Artificial
  CRISPR gRNA sequence
tagcacccctttttctccat

SEQ ID NO: 182843 - DNA, 20 bp, Artificial
  CRISPR gRNA sequence
cctttttctccatgagctgc

SEQ ID NO: 182844 - DNA, 20 bp, Artificial
  CRISPR gRNA sequence
ttttctccatgagctgctgg

SEQ ID NO: 182845 - DNA, 20 bp, Artificial
  CRISPR gRNA sequence
tttctccatgagctgctggt

SEQ ID NO: 182846 - DNA, 20 bp, Artificial
  CRISPR gRNA sequence
gctggtgggttcccccctcc

SEQ ID NO: 182847 - DNA, 20 bp, Artificial
  CRISPR gRNA sequence
gtgggttcccccctcccgga

SEQ ID NO: 182848 - DNA, 20 bp, Artificial
  CRISPR gRNA sequence
tcccggatagcgcctccttc

SEQ ID NO: 182849 - DNA, 20 bp, Artificial
  CRISPR gRNA sequence
ggatagcgcctccttccaga

SEQ ID NO: 182850 - DNA, 20 bp, Artificial
  CRISPR gRNA sequence
atagcgcctccttccagaaa

SEQ ID NO: 182851 - DNA, 20 bp, Artificial
  CRISPR gRNA sequence
tagcgcctccttccagaaag

SEQ ID NO: 182852 - DNA, 20 bp, Artificial
  CRISPR gRNA sequence
ctccttccagaaagaggatg

SEQ ID NO: 182853 - DNA, 20 bp, Artificial
  CRISPR gRNA sequence
ttccagaaagaggatgtggt

SEQ ID NO: 182854 - DNA, 20 bp, Artificial
  CRISPR gRNA sequence
atgtggtcagcctgctccac

SEQ ID NO: 182855 - DNA, 20 bp, Artificial
  CRISPR gRNA sequence
tgtggtcagcctgctccacc

SEQ ID NO: 182856 - DNA, 20 bp, Artificial
  CRISPR gRNA sequence
tcagcctgctccaccaggct

SEQ ID NO: 182857 - DNA, 20 bp, Artificial
  CRISPR gRNA sequence
cagcctgctccaccaggctg

SEQ ID NO: 182858 - DNA, 20 bp, Artificial
  CRISPR gRNA sequence
gctccaccaggctgaggtgc

SEQ ID NO: 182859 - DNA, 20 bp, Artificial
  CRISPR gRNA sequence
ctccaccaggctgaggtgct

SEQ ID NO: 182860 - DNA, 20 bp, Artificial
  CRISPR gRNA sequence
aggctgaggtgctgggtgat

SEQ ID NO: 182861 - DNA, 20 bp, Artificial
  CRISPR gRNA sequence
ctgaggtgctgggtgatgag

SEQ ID NO: 182862 - DNA, 20 bp, Artificial
  CRISPR gRNA sequence
gctgggtgatgagaagcact

SEQ ID NO: 182863 - DNA, 20 bp, Artificial
  CRISPR gRNA sequence
gggtgatgagaagcactgag

SEQ ID NO: 182864 - DNA, 20 bp, Artificial
  CRISPR gRNA sequence
ggtgatgagaagcactgagc

SEQ ID NO: 182865 - DNA, 20 bp, Artificial
  CRISPR gRNA sequence
tgatgagaagcactgagcgg

SEQ ID NO: 182866 - DNA, 20 bp, Artificial
  CRISPR gRNA sequence
cactgagcgggagtaccgct

SEQ ID NO: 182867 - DNA, 20 bp, Artificial
  CRISPR gRNA sequence
actgagcgggagtaccgctc

SEQ ID NO: 182868 - DNA, 20 bp, Artificial
  CRISPR gRNA sequence
ctgagcgggagtaccgctca

SEQ ID NO: 182869 - DNA, 20 bp, Artificial
  CRISPR gRNA sequence
taccgctcagggctttcgta

SEQ ID NO: 182870 - DNA, 20 bp, Artificial
  CRISPR gRNA sequence
accgctcagggctttcgtac

SEQ ID NO: 182871 - DNA, 20 bp, Artificial
  CRISPR gRNA sequence
cgctcagggctttcgtacag

SEQ ID NO: 182872 - DNA, 20 bp, Artificial
  CRISPR gRNA sequence
gtacaggagctgctccacct

SEQ ID NO: 182873 - DNA, 20 bp, Artificial
  CRISPR gRNA sequence
tacaggagctgctccacctg

SEQ ID NO: 182874 - DNA, 20 bp, Artificial
  CRISPR gRNA sequence
ggagctgctccacctgagga

SEQ ID NO: 182875 - DNA, 20 bp, Artificial
  CRISPR gRNA sequence
ctccacctgaggaaagacat

SEQ ID NO: 182876 - DNA, 20 bp, Artificial
  CRISPR gRNA sequence
gaggaaagacatcggaccgt

SEQ ID NO: 182877 - DNA, 20 bp, Artificial
  CRISPR gRNA sequence
ggaaagacatcggaccgtca

SEQ ID NO: 182878 - DNA, 20 bp, Artificial
  CRISPR gRNA sequence
agacatcggaccgtcagagc

SEQ ID NO: 182879 - DNA, 20 bp, Artificial
  CRISPR gRNA sequence
gacatcggaccgtcagagcc

SEQ ID NO: 182880 - DNA, 20 bp, Artificial
  CRISPR gRNA sequence
acatcggaccgtcagagccg

SEQ ID NO: 182881 - DNA, 20 bp, Artificial
  CRISPR gRNA sequence
tcagagccggggactaccct

SEQ ID NO: 182882 - DNA, 20 bp, Artificial
  CRISPR gRNA sequence
gccggggactaccctcagcc

SEQ ID NO: 182883 - DNA, 20 bp, Artificial
  CRISPR gRNA sequence
ccggggactaccctcagccc

SEQ ID NO: 182884 - DNA, 20 bp, Artificial
  CRISPR gRNA sequence
cggggactaccctcagccca

SEQ ID NO: 182885 - DNA, 20 bp, Artificial
  CRISPR gRNA sequence
gggactaccctcagcccagg

SEQ ID NO: 182886 - DNA, 20 bp, Artificial
  CRISPR gRNA sequence
cagggagacacctgtgtttc

SEQ ID NO: 182887 - DNA, 20 bp, Artificial
  CRISPR gRNA sequence
agggagacacctgtgtttcc

SEQ ID NO: 182888 - DNA, 20 bp, Artificial
  CRISPR gRNA sequence
gggagacacctgtgtttcca

SEQ ID NO: 182889 - DNA, 20 bp, Artificial
  CRISPR gRNA sequence
gacacctgtgtttccagggc

SEQ ID NO: 182890 - DNA, 20 bp, Artificial
  CRISPR gRNA sequence
acacctgtgtttccagggct

SEQ ID NO: 182891 - DNA, 20 bp, Artificial
  CRISPR gRNA sequence
cagggctgggactgacctca

SEQ ID NO: 182892 - DNA, 20 bp, Artificial
  CRISPR gRNA sequence
agggctgggactgacctcac

SEQ ID NO: 182893 - DNA, 20 bp, Artificial
  CRISPR gRNA sequence
tgacctcacaggatcactgc

SEQ ID NO: 182894 - DNA, 20 bp, Artificial
  CRISPR gRNA sequence
ctggctctgctaacaacccc

SEQ ID NO: 182895 - DNA, 20 bp, Artificial
  CRISPR gRNA sequence
tggctctgctaacaacccca

SEQ ID NO: 182896 - DNA, 20 bp, Artificial
  CRISPR gRNA sequence
acaccaacgtttcccattct

SEQ ID NO: 182897 - DNA, 20 bp, Artificial
  CRISPR gRNA sequence
cgcaaaccctttgtttcatt

SEQ ID NO: 182898 - DNA, 20 bp, Artificial
  CRISPR gRNA sequence
gcaaaccctttgtttcatta

SEQ ID NO: 182899 - DNA, 20 bp, Artificial
  CRISPR gRNA sequence
attaaggactgttttacatg

SEQ ID NO: 182900 - DNA, 20 bp, Artificial
  CRISPR gRNA sequence
ttaaggactgttttacatga

SEQ ID NO: 182901 - DNA, 20 bp, Artificial
  CRISPR gRNA sequence
taaggactgttttacatgaa

SEQ ID NO: 182902 - DNA, 20 bp, Artificial
  CRISPR gRNA sequence
gttttacatgaagggtgcaa

SEQ ID NO: 182903 - DNA, 20 bp, Artificial
  CRISPR gRNA sequence
ttacatgaagggtgcaaaag

SEQ ID NO: 182904 - DNA, 20 bp, Artificial
  CRISPR gRNA sequence
tacatgaagggtgcaaaagt

SEQ ID NO: 182905 - DNA, 20 bp, Artificial
  CRISPR gRNA sequence
tgcaaaagtaggataaaaat

SEQ ID NO: 182906 - DNA, 20 bp, Artificial
  CRISPR gRNA sequence
taggataaaaatgagaaccc

SEQ ID NO: 182907 - DNA, 20 bp, Artificial
  CRISPR gRNA sequence
aggataaaaatgagaaccct

SEQ ID NO: 182908 - DNA, 20 bp, Artificial
  CRISPR gRNA sequence
ggataaaaatgagaacccta

SEQ ID NO: 182909 - DNA, 20 bp, Artificial
  CRISPR gRNA sequence
ccctagggtgaaacacgtga

SEQ ID NO: 182910 - DNA, 20 bp, Artificial
  CRISPR gRNA sequence
tagggtgaaacacgtgacag

SEQ ID NO: 182911 - DNA, 20 bp, Artificial
  CRISPR gRNA sequence
aaacacgtgacagaagaata

SEQ ID NO: 182912 - DNA, 20 bp, Artificial
  CRISPR gRNA sequence
gaagaataaagactattgaa

SEQ ID NO: 182913 - DNA, 20 bp, Artificial
  CRISPR gRNA sequence
atagtcctcttctctaccca

SEQ ID NO: 182914 - DNA, 20 bp, Artificial
  CRISPR gRNA sequence
ctcttctctacccatggact

SEQ ID NO: 182915 - DNA, 20 bp, Artificial
  CRISPR gRNA sequence
gcatttttatattcgatttt

SEQ ID NO: 182916 - DNA, 20 bp, Artificial
  CRISPR gRNA sequence
catttttatattcgatttta

SEQ ID NO: 182917 - DNA, 20 bp, Artificial
  CRISPR gRNA sequence
gattttaaggaaatataact

SEQ ID NO: 182918 - DNA, 20 bp, Artificial
  CRISPR gRNA sequence
tttaaggaaatataacttag

SEQ ID NO: 182919 - DNA, 20 bp, Artificial
  CRISPR gRNA sequence
ggaaatataacttagtagta

SEQ ID NO: 182920 - DNA, 20 bp, Artificial
  CRISPR gRNA sequence
aaatataacttagtagtaaa

SEQ ID NO: 182921 - DNA, 20 bp, Artificial
  CRISPR gRNA sequence
taacttagtagtaaagagat

SEQ ID NO: 182922 - DNA, 20 bp, Artificial
  CRISPR gRNA sequence
tagtaaagagatgagcattc

SEQ ID NO: 182923 - DNA, 20 bp, Artificial
  CRISPR gRNA sequence
aaagagatgagcattcaagt

SEQ ID NO: 182924 - DNA, 20 bp, Artificial
  CRISPR gRNA sequence
aagagatgagcattcaagtc

SEQ ID NO: 182925 - DNA, 20 bp, Artificial
  CRISPR gRNA sequence
agatgagcattcaagtcagg

SEQ ID NO: 182926 - DNA, 20 bp, Artificial
  CRISPR gRNA sequence
aagtcaggcagacctgaatt

SEQ ID NO: 182927 - DNA, 20 bp, Artificial
  CRISPR gRNA sequence
agtcaggcagacctgaattt

SEQ ID NO: 182928 - DNA, 20 bp, Artificial
  CRISPR gRNA sequence
ggcagacctgaatttgggtc

SEQ ID NO: 182929 - DNA, 20 bp, Artificial
  CRISPR gRNA sequence
gcagacctgaatttgggtca

SEQ ID NO: 182930 - DNA, 20 bp, Artificial
  CRISPR gRNA sequence
gtcaaggctgcgccactcaa

SEQ ID NO: 182931 - DNA, 20 bp, Artificial
  CRISPR gRNA sequence
aagctatatgacctctatat

SEQ ID NO: 182932 - DNA, 20 bp, Artificial
  CRISPR gRNA sequence
ctatatgacctctatatgag

SEQ ID NO: 182933 - DNA, 20 bp, Artificial
  CRISPR gRNA sequence
aacctccattttgtcatctg

SEQ ID NO: 182934 - DNA, 20 bp, Artificial
  CRISPR gRNA sequence
gtagaatgatgataaatgcc

SEQ ID NO: 182935 - DNA, 20 bp, Artificial
  CRISPR gRNA sequence
atgatgataaatgcctagct

SEQ ID NO: 182936 - DNA, 20 bp, Artificial
  CRISPR gRNA sequence
atgataaatgcctagctcag

SEQ ID NO: 182937 - DNA, 20 bp, Artificial
  CRISPR gRNA sequence
tgataaatgcctagctcaga

SEQ ID NO: 182938 - DNA, 20 bp, Artificial
  CRISPR gRNA sequence
aggattcctaatgaataaat

SEQ ID NO: 182939 - DNA, 20 bp, Artificial
  CRISPR gRNA sequence
cctaatgaataaatgagtga

SEQ ID NO: 182940 - DNA, 20 bp, Artificial
  CRISPR gRNA sequence
tgagtgacagtgcatgtaaa

SEQ ID NO: 182941 - DNA, 20 bp, Artificial
  CRISPR gRNA sequence
gacagtgcatgtaaacagac

SEQ ID NO: 182942 - DNA, 20 bp, Artificial
  CRISPR gRNA sequence
ttaattaatattaatatgat

SEQ ID NO: 182943 - DNA, 20 bp, Artificial
  CRISPR gRNA sequence
taattaatattaatatgatt

SEQ ID NO: 182944 - DNA, 20 bp, Artificial
  CRISPR gRNA sequence
taatattaatatgattagga

SEQ ID NO: 182945 - DNA, 20 bp, Artificial
  CRISPR gRNA sequence
aatattaatatgattaggat

SEQ ID NO: 182946 - DNA, 20 bp, Artificial
  CRISPR gRNA sequence
ttaatatgattaggatgggc

SEQ ID NO: 182947 - DNA, 20 bp, Artificial
  CRISPR gRNA sequence
taatatgattaggatgggct

SEQ ID NO: 182948 - DNA, 20 bp, Artificial
  CRISPR gRNA sequence
tgattaggatgggctgggcc

SEQ ID NO: 182949 - DNA, 20 bp, Artificial
  CRISPR gRNA sequence
ttaggatgggctgggcccgg

SEQ ID NO: 182950 - DNA, 20 bp, Artificial
  CRISPR gRNA sequence
gtggctcatgcctataatcc

SEQ ID NO: 182951 - DNA, 20 bp, Artificial
  CRISPR gRNA sequence
tgcctataatcctagcactt

SEQ ID NO: 182952 - DNA, 20 bp, Artificial
  CRISPR gRNA sequence
gcctataatcctagcacttt

SEQ ID NO: 182953 - DNA, 20 bp, Artificial
  CRISPR gRNA sequence
ctataatcctagcactttgg

SEQ ID NO: 182954 - DNA, 20 bp, Artificial
  CRISPR gRNA sequence
tataatcctagcactttggg

SEQ ID NO: 182955 - DNA, 20 bp, Artificial
  CRISPR gRNA sequence
tcctagcactttgggaggtc

SEQ ID NO: 182956 - DNA, 20 bp, Artificial
  CRISPR gRNA sequence
cctagcactttgggaggtca

SEQ ID NO: 182957 - DNA, 20 bp, Artificial
  CRISPR gRNA sequence
tagcactttgggaggtcaag

SEQ ID NO: 182958 - DNA, 20 bp, Artificial
  CRISPR gRNA sequence
agcactttgggaggtcaagg

SEQ ID NO: 182959 - DNA, 20 bp, Artificial
  CRISPR gRNA sequence
gcactttgggaggtcaagga

SEQ ID NO: 182960 - DNA, 20 bp, Artificial
  CRISPR gRNA sequence
actttgggaggtcaaggagg

SEQ ID NO: 182961 - DNA, 20 bp, Artificial
  CRISPR gRNA sequence
ctttgggaggtcaaggaggg

SEQ ID NO: 182962 - DNA, 20 bp, Artificial
  CRISPR gRNA sequence
gtcaaggagggaggatcact

SEQ ID NO: 182963 - DNA, 20 bp, Artificial
  CRISPR gRNA sequence
tcaaggagggaggatcactt

SEQ ID NO: 182964 - DNA, 20 bp, Artificial
  CRISPR gRNA sequence
gagggaggatcacttgggcc

SEQ ID NO: 182965 - DNA, 20 bp, Artificial
  CRISPR gRNA sequence
agggaggatcacttgggccc

SEQ ID NO: 182966 - DNA, 20 bp, Artificial
  CRISPR gRNA sequence
ggaggatcacttgggcccag

SEQ ID NO: 182967 - DNA, 20 bp, Artificial
  CRISPR gRNA sequence
tcacttgggcccaggagttc

SEQ ID NO: 182968 - DNA, 20 bp, Artificial
  CRISPR gRNA sequence
cacttgggcccaggagttca

SEQ ID NO: 182969 - DNA, 20 bp, Artificial
  CRISPR gRNA sequence
tgggcccaggagttcaaggc

SEQ ID NO: 182970 - DNA, 20 bp, Artificial
  CRISPR gRNA sequence
ccaggagttcaaggccagcc

SEQ ID NO: 182971 - DNA, 20 bp, Artificial
  CRISPR gRNA sequence
caggagttcaaggccagcct

SEQ ID NO: 182972 - DNA, 20 bp, Artificial
  CRISPR gRNA sequence
caaggccagcctgggcaaca

SEQ ID NO: 182973 - DNA, 20 bp, Artificial
  CRISPR gRNA sequence
ggccagcctgggcaacatag

SEQ ID NO: 182974 - DNA, 20 bp, Artificial
  CRISPR gRNA sequence
gccagcctgggcaacatagc

SEQ ID NO: 182975 - DNA, 20 bp, Artificial
  CRISPR gRNA sequence
ttttaaataaacgatattat

SEQ ID NO: 182976 - DNA, 20 bp, Artificial
  CRISPR gRNA sequence
tttaaataaacgatattatg

SEQ ID NO: 182977 - DNA, 20 bp, Artificial
  CRISPR gRNA sequence
aataaacgatattatgagga

SEQ ID NO: 182978 - DNA, 20 bp, Artificial
  CRISPR gRNA sequence
cttttccttatgtttcgctt

SEQ ID NO: 182979 - DNA, 20 bp, Artificial
  CRISPR gRNA sequence
tatgtttcgctttagaaatt

SEQ ID NO: 182980 - DNA, 20 bp, Artificial
  CRISPR gRNA sequence
cgctttagaaattcagtcta

SEQ ID NO: 182981 - DNA, 20 bp, Artificial
  CRISPR gRNA sequence
gctttagaaattcagtctat

SEQ ID NO: 182982 - DNA, 20 bp, Artificial
  CRISPR gRNA sequence
agaaattcagtctataggac

SEQ ID NO: 182983 - DNA, 20 bp, Artificial
  CRISPR gRNA sequence
gaaattcagtctataggact

SEQ ID NO: 182984 - DNA, 20 bp, Artificial
  CRISPR gRNA sequence
tcagtctataggactgggcg

SEQ ID NO: 182985 - DNA, 20 bp, Artificial
  CRISPR gRNA sequence
gtctataggactgggcgcag

SEQ ID NO: 182986 - DNA, 20 bp, Artificial
  CRISPR gRNA sequence
gtggctcacacctataaccc

SEQ ID NO: 182987 - DNA, 20 bp, Artificial
  CRISPR gRNA sequence
cacctataaccccagccctt

SEQ ID NO: 182988 - DNA, 20 bp, Artificial
  CRISPR gRNA sequence
acctataaccccagcccttt

SEQ ID NO: 182989 - DNA, 20 bp, Artificial
  CRISPR gRNA sequence
ctataaccccagccctttgg

SEQ ID NO: 182990 - DNA, 20 bp, Artificial
  CRISPR gRNA sequence
tataaccccagccctttggg

SEQ ID NO: 182991 - DNA, 20 bp, Artificial
  CRISPR gRNA sequence
ccccagccctttgggaggct

SEQ ID NO: 182992 - DNA, 20 bp, Artificial
  CRISPR gRNA sequence
cccagccctttgggaggctg

SEQ ID NO: 182993 - DNA, 20 bp, Artificial
  CRISPR gRNA sequence
ccagccctttgggaggctga

SEQ ID NO: 182994 - DNA, 20 bp, Artificial
  CRISPR gRNA sequence
cagccctttgggaggctgag

SEQ ID NO: 182995 - DNA, 20 bp, Artificial
  CRISPR gRNA sequence
agccctttgggaggctgagg

SEQ ID NO: 182996 - DNA, 20 bp, Artificial
  CRISPR gRNA sequence
gccctttgggaggctgaggg

SEQ ID NO: 182997 - DNA, 20 bp, Artificial
  CRISPR gRNA sequence
ctttgggaggctgagggggg

SEQ ID NO: 182998 - DNA, 20 bp, Artificial
  CRISPR gRNA sequence
ctgaggggggcagattacct

SEQ ID NO: 182999 - DNA, 20 bp, Artificial
  CRISPR gRNA sequence
gggggcagattacctgagct

SEQ ID NO: 183000 - DNA, 20 bp, Artificial
  CRISPR gRNA sequence
ggggcagattacctgagctc

SEQ ID NO: 183001 - DNA, 20 bp, Artificial
  CRISPR gRNA sequence
ttacctgagctcaggaattc

SEQ ID NO: 183002 - DNA, 20 bp, Artificial
  CRISPR gRNA sequence
tacctgagctcaggaattca

SEQ ID NO: 183003 - DNA, 20 bp, Artificial
  CRISPR gRNA sequence
tgagctcaggaattcaaggc

SEQ ID NO: 183004 - DNA, 20 bp, Artificial
  CRISPR gRNA sequence
tcaggaattcaaggccagcc

SEQ ID NO: 183005 - DNA, 20 bp, Artificial
  CRISPR gRNA sequence
caggaattcaaggccagcct

SEQ ID NO: 183006 - DNA, 20 bp, Artificial
  CRISPR gRNA sequence
caaggccagcctgggcaaca

SEQ ID NO: 183007 - DNA, 20 bp, Artificial
  CRISPR gRNA sequence
catctctactaaaaatataa

SEQ ID NO: 183008 - DNA, 20 bp, Artificial
  CRISPR gRNA sequence
ctaaaaatataaaagtcaac

SEQ ID NO: 183009 - DNA, 20 bp, Artificial
  CRISPR gRNA sequence
taaaaatataaaagtcaacc

SEQ ID NO: 183010 - DNA, 20 bp, Artificial
  CRISPR gRNA sequence
atataaaagtcaaccaggca

SEQ ID NO: 183011 - DNA, 20 bp, Artificial
  CRISPR gRNA sequence
taaaagtcaaccaggcatag

SEQ ID NO: 183012 - DNA, 20 bp, Artificial
  CRISPR gRNA sequence
ggcatagtggtgtacacctg

SEQ ID NO: 183013 - DNA, 20 bp, Artificial
  CRISPR gRNA sequence
gtggtgtacacctgtagtcc

SEQ ID NO: 183014 - DNA, 20 bp, Artificial
  CRISPR gRNA sequence
cacctgtagtcccagctact

SEQ ID NO: 183015 - DNA, 20 bp, Artificial
  CRISPR gRNA sequence
acctgtagtcccagctactc

SEQ ID NO: 183016 - DNA, 20 bp, Artificial
  CRISPR gRNA sequence
ctgtagtcccagctactcgg

SEQ ID NO: 183017 - DNA, 20 bp, Artificial
  CRISPR gRNA sequence
tgtagtcccagctactcggg

SEQ ID NO: 183018 - DNA, 20 bp, Artificial
  CRISPR gRNA sequence
tcccagctactcgggaggct

SEQ ID NO: 183019 - DNA, 20 bp, Artificial
  CRISPR gRNA sequence
cccagctactcgggaggctg

SEQ ID NO: 183020 - DNA, 20 bp, Artificial
  CRISPR gRNA sequence
ccagctactcgggaggctga

SEQ ID NO: 183021 - DNA, 20 bp, Artificial
  CRISPR gRNA sequence
cagctactcgggaggctgag

SEQ ID NO: 183022 - DNA, 20 bp, Artificial
  CRISPR gRNA sequence
gctactcgggaggctgaggg

SEQ ID NO: 183023 - DNA, 20 bp, Artificial
  CRISPR gRNA sequence
ggctgaggggagaatcgctt

SEQ ID NO: 183024 - DNA, 20 bp, Artificial
  CRISPR gRNA sequence
aggggagaatcgcttgagcc

SEQ ID NO: 183025 - DNA, 20 bp, Artificial
  CRISPR gRNA sequence
ggagaatcgcttgagcccag

SEQ ID NO: 183026 - DNA, 20 bp, Artificial
  CRISPR gRNA sequence
gagaatcgcttgagcccagc

SEQ ID NO: 183027 - DNA, 20 bp, Artificial
  CRISPR gRNA sequence
cgcttgagcccagcaggttg

SEQ ID NO: 183028 - DNA, 20 bp, Artificial
  CRISPR gRNA sequence
agcccagcaggttgaagctg

SEQ ID NO: 183029 - DNA, 20 bp, Artificial
  CRISPR gRNA sequence
cagcaggttgaagctgcagt

SEQ ID NO: 183030 - DNA, 20 bp, Artificial
  CRISPR gRNA sequence
ggttgaagctgcagtgagcc

SEQ ID NO: 183031 - DNA, 20 bp, Artificial
  CRISPR gRNA sequence
aagattgtgccactgcgctc

SEQ ID NO: 183032 - DNA, 20 bp, Artificial
  CRISPR gRNA sequence
tgtgccactgcgctccagcc

SEQ ID NO: 183033 - DNA, 20 bp, Artificial
  CRISPR gRNA sequence
gtgccactgcgctccagcct

SEQ ID NO: 183034 - DNA, 20 bp, Artificial
  CRISPR gRNA sequence
gcgctccagcctgggcaact

SEQ ID NO: 183035 - DNA, 20 bp, Artificial
  CRISPR gRNA sequence
tccagcctgggcaactgagt

SEQ ID NO: 183036 - DNA, 20 bp, Artificial
  CRISPR gRNA sequence
acactgtcttaaaaaaaaaa

SEQ ID NO: 183037 - DNA, 20 bp, Artificial
  CRISPR gRNA sequence
cactgtcttaaaaaaaaaaa

SEQ ID NO: 183038 - DNA, 20 bp, Artificial
  CRISPR gRNA sequence
gtcttaaaaaaaaaaaagga

SEQ ID NO: 183039 - DNA, 20 bp, Artificial
  CRISPR gRNA sequence
taaaaaaaaaaaaggaaaga

SEQ ID NO: 183040 - DNA, 20 bp, Artificial
  CRISPR gRNA sequence
aaaaaaaaaggaaagaaaga

SEQ ID NO: 183041 - DNA, 20 bp, Artificial
  CRISPR gRNA sequence
aggaaagaaagaaagaaatt

SEQ ID NO: 183042 - DNA, 20 bp, Artificial
  CRISPR gRNA sequence
aaagaaagaaattcagtctg

SEQ ID NO: 183043 - DNA, 20 bp, Artificial
  CRISPR gRNA sequence
gaaattcagtctgtagtttg

SEQ ID NO: 183044 - DNA, 20 bp, Artificial
  CRISPR gRNA sequence
ttcagtctgtagtttgtaga

SEQ ID NO: 183045 - DNA, 20 bp, Artificial
  CRISPR gRNA sequence
tagtctcttttaactgattc

SEQ ID NO: 183046 - DNA, 20 bp, Artificial
  CRISPR gRNA sequence
agtctcttttaactgattct

SEQ ID NO: 183047 - DNA, 20 bp, Artificial
  CRISPR gRNA sequence
cgtcttctatctctactcct

SEQ ID NO: 183048 - DNA, 20 bp, Artificial
  CRISPR gRNA sequence
gtcttctatctctactcctt

SEQ ID NO: 183049 - DNA, 20 bp, Artificial
  CRISPR gRNA sequence
tcttctatctctactccttg

SEQ ID NO: 183050 - DNA, 20 bp, Artificial
  CRISPR gRNA sequence
ttctatctctactccttggg

SEQ ID NO: 183051 - DNA, 20 bp, Artificial
  CRISPR gRNA sequence
tctatctctactccttgggg

SEQ ID NO: 183052 - DNA, 20 bp, Artificial
  CRISPR gRNA sequence
ctccttggggaggcatccaa

SEQ ID NO: 183053 - DNA, 20 bp, Artificial
  CRISPR gRNA sequence
ggggaggcatccaatggaac

SEQ ID NO: 183054 - DNA, 20 bp, Artificial
  CRISPR gRNA sequence
gcatccaatggaactggatt

SEQ ID NO: 183055 - DNA, 20 bp, Artificial
  CRISPR gRNA sequence
catccaatggaactggattt

SEQ ID NO: 183056 - DNA, 20 bp, Artificial
  CRISPR gRNA sequence
tggaactggatttgggaact

SEQ ID NO: 183057 - DNA, 20 bp, Artificial
  CRISPR gRNA sequence
atttgggaactgagaactgc

SEQ ID NO: 183058 - DNA, 20 bp, Artificial
  CRISPR gRNA sequence
tttgggaactgagaactgca

SEQ ID NO: 183059 - DNA, 20 bp, Artificial
  CRISPR gRNA sequence
gaactgagaactgcaaggac

SEQ ID NO: 183060 - DNA, 20 bp, Artificial
  CRISPR gRNA sequence
ggtttgtataattatgatgt

SEQ ID NO: 183061 - DNA, 20 bp, Artificial
  CRISPR gRNA sequence
tatgatgttagtaaaactaa

SEQ ID NO: 183062 - DNA, 20 bp, Artificial
  CRISPR gRNA sequence
gatgttagtaaaactaacag

SEQ ID NO: 183063 - DNA, 20 bp, Artificial
  CRISPR gRNA sequence
aactaacagaagatgtataa

SEQ ID NO: 183064 - DNA, 20 bp, Artificial
  CRISPR gRNA sequence
taacagaagatgtataaaag

SEQ ID NO: 183065 - DNA, 20 bp, Artificial
  CRISPR gRNA sequence
agaagatgtataaaagaagc

SEQ ID NO: 183066 - DNA, 20 bp, Artificial
  CRISPR gRNA sequence
atgtataaaagaagcaagat

SEQ ID NO: 183067 - DNA, 20 bp, Artificial
  CRISPR gRNA sequence
tgtataaaagaagcaagatt

SEQ ID NO: 183068 - DNA, 20 bp, Artificial
  CRISPR gRNA sequence
ataaaagaagcaagattggg

SEQ ID NO: 183069 - DNA, 20 bp, Artificial
  CRISPR gRNA sequence
taaaagaagcaagattgggt

SEQ ID NO: 183070 - DNA, 20 bp, Artificial
  CRISPR gRNA sequence
aagcaagattgggtgggata

SEQ ID NO: 183071 - DNA, 20 bp, Artificial
  CRISPR gRNA sequence
ttgggtgggatatagccatt

SEQ ID NO: 183072 - DNA, 20 bp, Artificial
  CRISPR gRNA sequence
ggtgggatatagccattaag

SEQ ID NO: 183073 - DNA, 20 bp, Artificial
  CRISPR gRNA sequence
atgactgcctcacctgtaac

SEQ ID NO: 183074 - DNA, 20 bp, Artificial
  CRISPR gRNA sequence
tgtaactggctgtttgcatc

SEQ ID NO: 183075 - DNA, 20 bp, Artificial
  CRISPR gRNA sequence
gtaactggctgtttgcatcc

SEQ ID NO: 183076 - DNA, 20 bp, Artificial
  CRISPR gRNA sequence
taactggctgtttgcatcca

SEQ ID NO: 183077 - DNA, 20 bp, Artificial
  CRISPR gRNA sequence
gctgtttgcatccagggcac

SEQ ID NO: 183078 - DNA, 20 bp, Artificial
  CRISPR gRNA sequence
gtttgcatccagggcactgg

SEQ ID NO: 183079 - DNA, 20 bp, Artificial
  CRISPR gRNA sequence
agggcactggtggcatcatc

SEQ ID NO: 183080 - DNA, 20 bp, Artificial
  CRISPR gRNA sequence
gggcactggtggcatcatcc

SEQ ID NO: 183081 - DNA, 20 bp, Artificial
  CRISPR gRNA sequence
ctggtggcatcatccaggat

SEQ ID NO: 183082 - DNA, 20 bp, Artificial
  CRISPR gRNA sequence
tcatccaggataagtacaca

SEQ ID NO: 183083 - DNA, 20 bp, Artificial
  CRISPR gRNA sequence
ggataagtacacacggtttc

SEQ ID NO: 183084 - DNA, 20 bp, Artificial
  CRISPR gRNA sequence
acggtttccggatcaatgct

SEQ ID NO: 183085 - DNA, 20 bp, Artificial
  CRISPR gRNA sequence
cggtttccggatcaatgctc

SEQ ID NO: 183086 - DNA, 20 bp, Artificial
  CRISPR gRNA sequence
gcctgtcgctgaccccctga

SEQ ID NO: 183087 - DNA, 20 bp, Artificial
  CRISPR gRNA sequence
gtcgctgaccccctgacagc

SEQ ID NO: 183088 - DNA, 20 bp, Artificial
  CRISPR gRNA sequence
accccctgacagctggctcc

SEQ ID NO: 183089 - DNA, 20 bp, Artificial
  CRISPR gRNA sequence
cccagcctcgtctacctctg

SEQ ID NO: 183090 - DNA, 20 bp, Artificial
  CRISPR gRNA sequence
cagcctcgtctacctctgca

SEQ ID NO: 183091 - DNA, 20 bp, Artificial
  CRISPR gRNA sequence
tcgtctacctctgcagagca

SEQ ID NO: 183092 - DNA, 20 bp, Artificial
  CRISPR gRNA sequence
cgtctacctctgcagagcaa

SEQ ID NO: 183093 - DNA, 20 bp, Artificial
  CRISPR gRNA sequence
gtctacctctgcagagcaaa

SEQ ID NO: 183094 - DNA, 20 bp, Artificial
  CRISPR gRNA sequence
cctctgcagagcaaagggcc

SEQ ID NO: 183095 - DNA, 20 bp, Artificial
  CRISPR gRNA sequence
gcagagcaaagggccaagat

SEQ ID NO: 183096 - DNA, 20 bp, Artificial
  CRISPR gRNA sequence
gcaaagggccaagatgagaa

SEQ ID NO: 183097 - DNA, 20 bp, Artificial
  CRISPR gRNA sequence
gggccaagatgagaacggta

SEQ ID NO: 183098 - DNA, 20 bp, Artificial
  CRISPR gRNA sequence
tgcacgcatgtacatgcaca

SEQ ID NO: 183099 - DNA, 20 bp, Artificial
  CRISPR gRNA sequence
ttcacgcactcacacacacc

SEQ ID NO: 183100 - DNA, 20 bp, Artificial
  CRISPR gRNA sequence
tcacacacaccaagatctga

SEQ ID NO: 183101 - DNA, 20 bp, Artificial
  CRISPR gRNA sequence
acaccaagatctgacggttg

SEQ ID NO: 183102 - DNA, 20 bp, Artificial
  CRISPR gRNA sequence
caagatctgacggttgtagc

SEQ ID NO: 183103 - DNA, 20 bp, Artificial
  CRISPR gRNA sequence
atctgacggttgtagctgga

SEQ ID NO: 183104 - DNA, 20 bp, Artificial
  CRISPR gRNA sequence
tctgacggttgtagctggat

SEQ ID NO: 183105 - DNA, 20 bp, Artificial
  CRISPR gRNA sequence
ctgacggttgtagctggata

SEQ ID NO: 183106 - DNA, 20 bp, Artificial
  CRISPR gRNA sequence
tgacggttgtagctggatag

SEQ ID NO: 183107 - DNA, 20 bp, Artificial
  CRISPR gRNA sequence
acggttgtagctggataggg

SEQ ID NO: 183108 - DNA, 20 bp, Artificial
  CRISPR gRNA sequence
tagctggataggggagattc

SEQ ID NO: 183109 - DNA, 20 bp, Artificial
  CRISPR gRNA sequence
agctggataggggagattct

SEQ ID NO: 183110 - DNA, 20 bp, Artificial
  CRISPR gRNA sequence
tggataggggagattctggg

SEQ ID NO: 183111 - DNA, 20 bp, Artificial
  CRISPR gRNA sequence
ggagattctgggaagatgaa

SEQ ID NO: 183112 - DNA, 20 bp, Artificial
  CRISPR gRNA sequence
gggaagatgaacagaatcct

SEQ ID NO: 183113 - DNA, 20 bp, Artificial
  CRISPR gRNA sequence
ggaagatgaacagaatcctg

SEQ ID NO: 183114 - DNA, 20 bp, Artificial
  CRISPR gRNA sequence
gaacagaatcctgaggatgt

SEQ ID NO: 183115 - DNA, 20 bp, Artificial
  CRISPR gRNA sequence
aacagaatcctgaggatgtc

SEQ ID NO: 183116 - DNA, 20 bp, Artificial
  CRISPR gRNA sequence
atcctgaggatgtcaggatg

SEQ ID NO: 183117 - DNA, 20 bp, Artificial
  CRISPR gRNA sequence
ctgaggatgtcaggatgaag

SEQ ID NO: 183118 - DNA, 20 bp, Artificial
  CRISPR gRNA sequence
atgtcaggatgaagaagcca

SEQ ID NO: 183119 - DNA, 20 bp, Artificial
  CRISPR gRNA sequence
tgtcaggatgaagaagccat

SEQ ID NO: 183120 - DNA, 20 bp, Artificial
  CRISPR gRNA sequence
tcaggatgaagaagccatag

SEQ ID NO: 183121 - DNA, 20 bp, Artificial
  CRISPR gRNA sequence
aacttcaaattgatgtccat

SEQ ID NO: 183122 - DNA, 20 bp, Artificial
  CRISPR gRNA sequence
tcaaattgatgtccatgagt

SEQ ID NO: 183123 - DNA, 20 bp, Artificial
  CRISPR gRNA sequence
caaattgatgtccatgagta

SEQ ID NO: 183124 - DNA, 20 bp, Artificial
  CRISPR gRNA sequence
aattgatgtccatgagtaag

SEQ ID NO: 183125 - DNA, 20 bp, Artificial
  CRISPR gRNA sequence
attgatgtccatgagtaagg

SEQ ID NO: 183126 - DNA, 20 bp, Artificial
  CRISPR gRNA sequence
ccatgagtaaggaggaactg

SEQ ID NO: 183127 - DNA, 20 bp, Artificial
  CRISPR gRNA sequence
catgagtaaggaggaactga

SEQ ID NO: 183128 - DNA, 20 bp, Artificial
  CRISPR gRNA sequence
taaggaggaactgaaggata

SEQ ID NO: 183129 - DNA, 20 bp, Artificial
  CRISPR gRNA sequence
aaggaggaactgaaggataa

SEQ ID NO: 183130 - DNA, 20 bp, Artificial
  CRISPR gRNA sequence
aggaactgaaggataaaggc

SEQ ID NO: 183131 - DNA, 20 bp, Artificial
  CRISPR gRNA sequence
aaggataaaggcaagactac

SEQ ID NO: 183132 - DNA, 20 bp, Artificial
  CRISPR gRNA sequence
aggataaaggcaagactact

SEQ ID NO: 183133 - DNA, 20 bp, Artificial
  CRISPR gRNA sequence
ggataaaggcaagactactg

SEQ ID NO: 183134 - DNA, 20 bp, Artificial
  CRISPR gRNA sequence
aggcaagactactggggttt

SEQ ID NO: 183135 - DNA, 20 bp, Artificial
  CRISPR gRNA sequence
agactactggggtttcagca

SEQ ID NO: 183136 - DNA, 20 bp, Artificial
  CRISPR gRNA sequence
gactactggggtttcagcaa

SEQ ID NO: 183137 - DNA, 20 bp, Artificial
  CRISPR gRNA sequence
ctggggtttcagcaaaggta

SEQ ID NO: 183138 - DNA, 20 bp, Artificial
  CRISPR gRNA sequence
ggtttcagcaaaggtaaaga

SEQ ID NO: 183139 - DNA, 20 bp, Artificial
  CRISPR gRNA sequence
tcagcaaaggtaaagatggc

SEQ ID NO: 183140 - DNA, 20 bp, Artificial
  CRISPR gRNA sequence
cagcaaaggtaaagatggct

SEQ ID NO: 183141 - DNA, 20 bp, Artificial
  CRISPR gRNA sequence
caaaggtaaagatggctggg

SEQ ID NO: 183142 - DNA, 20 bp, Artificial
  CRISPR gRNA sequence
ggtaaagatggctgggtggt

SEQ ID NO: 183143 - DNA, 20 bp, Artificial
  CRISPR gRNA sequence
agatggctgggtggtgagat

SEQ ID NO: 183144 - DNA, 20 bp, Artificial
  CRISPR gRNA sequence
tggctgggtggtgagatgag

SEQ ID NO: 183145 - DNA, 20 bp, Artificial
  CRISPR gRNA sequence
gctgggtggtgagatgagtg

SEQ ID NO: 183146 - DNA, 20 bp, Artificial
  CRISPR gRNA sequence
tgggtggtgagatgagtgga

SEQ ID NO: 183147 - DNA, 20 bp, Artificial
  CRISPR gRNA sequence
ggtggtgagatgagtggaga

SEQ ID NO: 183148 - DNA, 20 bp, Artificial
  CRISPR gRNA sequence
tggagagagtacctgtgtca

SEQ ID NO: 183149 - DNA, 20 bp, Artificial
  CRISPR gRNA sequence
agtacctgtgtcatagccct

SEQ ID NO: 183150 - DNA, 20 bp, Artificial
  CRISPR gRNA sequence
gtacctgtgtcatagccctg

SEQ ID NO: 183151 - DNA, 20 bp, Artificial
  CRISPR gRNA sequence
tacctgtgtcatagccctga

SEQ ID NO: 183152 - DNA, 20 bp, Artificial
  CRISPR gRNA sequence
cctgtgtcatagccctgagg

SEQ ID NO: 183153 - DNA, 20 bp, Artificial
  CRISPR gRNA sequence
gtcatagccctgagggagtc

SEQ ID NO: 183154 - DNA, 20 bp, Artificial
  CRISPR gRNA sequence
catagccctgagggagtcca

SEQ ID NO: 183155 - DNA, 20 bp, Artificial
  CRISPR gRNA sequence
ggagtccagagatgaaacta

SEQ ID NO: 183156 - DNA, 20 bp, Artificial
  CRISPR gRNA sequence
gagtccagagatgaaactat

SEQ ID NO: 183157 - DNA, 20 bp, Artificial
  CRISPR gRNA sequence
agagatgaaactatgggccc

SEQ ID NO: 183158 - DNA, 20 bp, Artificial
  CRISPR gRNA sequence
atgggccccagactttactg

SEQ ID NO: 183159 - DNA, 20 bp, Artificial
  CRISPR gRNA sequence
ggccccagactttactgcag

SEQ ID NO: 183160 - DNA, 20 bp, Artificial
  CRISPR gRNA sequence
agcagctgtgatttcctcca

SEQ ID NO: 183161 - DNA, 20 bp, Artificial
  CRISPR gRNA sequence
gctgtgatttcctccatagt

SEQ ID NO: 183162 - DNA, 20 bp, Artificial
  CRISPR gRNA sequence
tttcctccatagttggcttc

SEQ ID NO: 183163 - DNA, 20 bp, Artificial
  CRISPR gRNA sequence
ttcctccatagttggcttct

SEQ ID NO: 183164 - DNA, 20 bp, Artificial
  CRISPR gRNA sequence
tccatagttggcttctgggt

SEQ ID NO: 183165 - DNA, 20 bp, Artificial
  CRISPR gRNA sequence
ccatagttggcttctgggtc

SEQ ID NO: 183166 - DNA, 20 bp, Artificial
  CRISPR gRNA sequence
ttggcttctgggtcaggcca

SEQ ID NO: 183167 - DNA, 20 bp, Artificial
  CRISPR gRNA sequence
tggcttctgggtcaggccat

SEQ ID NO: 183168 - DNA, 20 bp, Artificial
  CRISPR gRNA sequence
ccataggcaatattttcttg

SEQ ID NO: 183169 - DNA, 20 bp, Artificial
  CRISPR gRNA sequence
agacttcttccaaatacctg

SEQ ID NO: 183170 - DNA, 20 bp, Artificial
  CRISPR gRNA sequence
ctgtggctcttgtcccactg

SEQ ID NO: 183171 - DNA, 20 bp, Artificial
  CRISPR gRNA sequence
ttgtcccactgcagccacct

SEQ ID NO: 183172 - DNA, 20 bp, Artificial
  CRISPR gRNA sequence
acctgagatgaaatatgatg

SEQ ID NO: 183173 - DNA, 20 bp, Artificial
  CRISPR gRNA sequence
ctgagatgaaatatgatgaa

SEQ ID NO: 183174 - DNA, 20 bp, Artificial
  CRISPR gRNA sequence
tgaaatatgatgaagagtca

SEQ ID NO: 183175 - DNA, 20 bp, Artificial
  CRISPR gRNA sequence
atgatgaagagtcatagaac

SEQ ID NO: 183176 - DNA, 20 bp, Artificial
  CRISPR gRNA sequence
tgatgaagagtcatagaaca

SEQ ID NO: 183177 - DNA, 20 bp, Artificial
  CRISPR gRNA sequence
gagtcatagaacaaggcaca

SEQ ID NO: 183178 - DNA, 20 bp, Artificial
  CRISPR gRNA sequence
agtcatagaacaaggcacat

SEQ ID NO: 183179 - DNA, 20 bp, Artificial
  CRISPR gRNA sequence
tcatagaacaaggcacatgg

SEQ ID NO: 183180 - DNA, 20 bp, Artificial
  CRISPR gRNA sequence
gaacaaggcacatgggagta

SEQ ID NO: 183181 - DNA, 20 bp, Artificial
  CRISPR gRNA sequence
cacatgggagtatggttatc

SEQ ID NO: 183182 - DNA, 20 bp, Artificial
  CRISPR gRNA sequence
catgggagtatggttatcta

SEQ ID NO: 183183 - DNA, 20 bp, Artificial
  CRISPR gRNA sequence
gtatggttatctagagatcg

SEQ ID NO: 183184 - DNA, 20 bp, Artificial
  CRISPR gRNA sequence
gaagactcaaaatctttatt

SEQ ID NO: 183185 - DNA, 20 bp, Artificial
  CRISPR gRNA sequence
ctacaccaccatctccaccc

SEQ ID NO: 183186 - DNA, 20 bp, Artificial
  CRISPR gRNA sequence
tacaccaccatctccaccca

SEQ ID NO: 183187 - DNA, 20 bp, Artificial
  CRISPR gRNA sequence
tcattccctaacccctcttt

SEQ ID NO: 183188 - DNA, 20 bp, Artificial
  CRISPR gRNA sequence
attccctaacccctctttca

SEQ ID NO: 183189 - DNA, 20 bp, Artificial
  CRISPR gRNA sequence
aacccctctttcagagtgct

SEQ ID NO: 183190 - DNA, 20 bp, Artificial
  CRISPR gRNA sequence
cctctttcagagtgctcagt

SEQ ID NO: 183191 - DNA, 20 bp, Artificial
  CRISPR gRNA sequence
gatgctccctgccctccttc

SEQ ID NO: 183192 - DNA, 20 bp, Artificial
  CRISPR gRNA sequence
tgcttccatacctgcctgtg

SEQ ID NO: 183193 - DNA, 20 bp, Artificial
  CRISPR gRNA sequence
gcttccatacctgcctgtgc

SEQ ID NO: 183194 - DNA, 20 bp, Artificial
  CRISPR gRNA sequence
tccatacctgcctgtgcagg

SEQ ID NO: 183195 - DNA, 20 bp, Artificial
  CRISPR gRNA sequence
atacctgcctgtgcaggtag

SEQ ID NO: 183196 - DNA, 20 bp, Artificial
  CRISPR gRNA sequence
gcaggtagcggtgctcatat

SEQ ID NO: 183197 - DNA, 20 bp, Artificial
  CRISPR gRNA sequence
caggtagcggtgctcatatt

SEQ ID NO: 183198 - DNA, 20 bp, Artificial
  CRISPR gRNA sequence
aggtagcggtgctcatattg

SEQ ID NO: 183199 - DNA, 20 bp, Artificial
  CRISPR gRNA sequence
tagcggtgctcatattgggg

SEQ ID NO: 183200 - DNA, 20 bp, Artificial
  CRISPR gRNA sequence
agcggtgctcatattgggga

SEQ ID NO: 183201 - DNA, 20 bp, Artificial
  CRISPR gRNA sequence
gcggtgctcatattggggaa

SEQ ID NO: 183202 - DNA, 20 bp, Artificial
  CRISPR gRNA sequence
cggtgctcatattggggaag

SEQ ID NO: 183203 - DNA, 20 bp, Artificial
  CRISPR gRNA sequence
ggaaggggcttcccatccaa

SEQ ID NO: 183204 - DNA, 20 bp, Artificial
  CRISPR gRNA sequence
aggggcttcccatccaacag

SEQ ID NO: 183205 - DNA, 20 bp, Artificial
  CRISPR gRNA sequence
atccaacagcagctgtcccc

SEQ ID NO: 183206 - DNA, 20 bp, Artificial
  CRISPR gRNA sequence
caacagcagctgtcccccgg

SEQ ID NO: 183207 - DNA, 20 bp, Artificial
  CRISPR gRNA sequence
aacagcagctgtcccccggt

SEQ ID NO: 183208 - DNA, 20 bp, Artificial
  CRISPR gRNA sequence
gcagctgtcccccggtgggc

SEQ ID NO: 183209 - DNA, 20 bp, Artificial
  CRISPR gRNA sequence
tgtcccccggtgggctggta

SEQ ID NO: 183210 - DNA, 20 bp, Artificial
  CRISPR gRNA sequence
gtgggctggtacagattctg

SEQ ID NO: 183211 - DNA, 20 bp, Artificial
  CRISPR gRNA sequence
ggctggtacagattctgcag

SEQ ID NO: 183212 - DNA, 20 bp, Artificial
  CRISPR gRNA sequence
gctggtacagattctgcagc

SEQ ID NO: 183213 - DNA, 20 bp, Artificial
  CRISPR gRNA sequence
ctggtacagattctgcagca

SEQ ID NO: 183214 - DNA, 20 bp, Artificial
  CRISPR gRNA sequence
gtacagattctgcagcaggg

SEQ ID NO: 183215 - DNA, 20 bp, Artificial
  CRISPR gRNA sequence
ggcagccactgtgctcttcc

SEQ ID NO: 183216 - DNA, 20 bp, Artificial
  CRISPR gRNA sequence
tgtgctcttcccagacccat

SEQ ID NO: 183217 - DNA, 20 bp, Artificial
  CRISPR gRNA sequence
gtgctcttcccagacccatt

SEQ ID NO: 183218 - DNA, 20 bp, Artificial
  CRISPR gRNA sequence
ccagacccattgggtcccac

SEQ ID NO: 183219 - DNA, 20 bp, Artificial
  CRISPR gRNA sequence
caccagcgccgtcacctcgc

SEQ ID NO: 183220 - DNA, 20 bp, Artificial
  CRISPR gRNA sequence
accagcgccgtcacctcgcc

SEQ ID NO: 183221 - DNA, 20 bp, Artificial
  CRISPR gRNA sequence
ccagcgccgtcacctcgcca

SEQ ID NO: 183222 - DNA, 20 bp, Artificial
  CRISPR gRNA sequence
gccgtcacctcgccagggcg

SEQ ID NO: 183223 - DNA, 20 bp, Artificial
  CRISPR gRNA sequence
ccgtcacctcgccagggcgt

SEQ ID NO: 183224 - DNA, 20 bp, Artificial
  CRISPR gRNA sequence
cgtcacctcgccagggcgta

SEQ ID NO: 183225 - DNA, 20 bp, Artificial
  CRISPR gRNA sequence
ccagggcgtagggtgaatgt

SEQ ID NO: 183226 - DNA, 20 bp, Artificial
  CRISPR gRNA sequence
gtagggtgaatgtcagcccc

SEQ ID NO: 183227 - DNA, 20 bp, Artificial
  CRISPR gRNA sequence
agggtgaatgtcagccccta

SEQ ID NO: 183228 - DNA, 20 bp, Artificial
  CRISPR gRNA sequence
gggtgaatgtcagcccctag

SEQ ID NO: 183229 - DNA, 20 bp, Artificial
  CRISPR gRNA sequence
gaatgtcagcccctagaggc

SEQ ID NO: 183230 - DNA, 20 bp, Artificial
  CRISPR gRNA sequence
atgtcagcccctagaggcca

SEQ ID NO: 183231 - DNA, 20 bp, Artificial
  CRISPR gRNA sequence
tcagcccctagaggccagag

SEQ ID NO: 183232 - DNA, 20 bp, Artificial
  CRISPR gRNA sequence
aggccagagaagcacacgat

SEQ ID NO: 183233 - DNA, 20 bp, Artificial
  CRISPR gRNA sequence
gccagagaagcacacgataa

SEQ ID NO: 183234 - DNA, 20 bp, Artificial
  CRISPR gRNA sequence
ccagagaagcacacgataag

SEQ ID NO: 183235 - DNA, 20 bp, Artificial
  CRISPR gRNA sequence
gcacacgataagaggctacc

SEQ ID NO: 183236 - DNA, 20 bp, Artificial
  CRISPR gRNA sequence
cacacgataagaggctacca

SEQ ID NO: 183237 - DNA, 20 bp, Artificial
  CRISPR gRNA sequence
ctaccaaggcctctaacctt

SEQ ID NO: 183238 - DNA, 20 bp, Artificial
  CRISPR gRNA sequence
accaaggcctctaaccttga

SEQ ID NO: 183239 - DNA, 20 bp, Artificial
  CRISPR gRNA sequence
agtgtcattgccttgttaca

SEQ ID NO: 183240 - DNA, 20 bp, Artificial
  CRISPR gRNA sequence
catagcatgatgtcttaccc

SEQ ID NO: 183241 - DNA, 20 bp, Artificial
  CRISPR gRNA sequence
agcatgatgtcttaccccag

SEQ ID NO: 183242 - DNA, 20 bp, Artificial
  CRISPR gRNA sequence
gtcttaccccagaagaaaaa

SEQ ID NO: 183243 - DNA, 20 bp, Artificial
  CRISPR gRNA sequence
tcttaccccagaagaaaaac

SEQ ID NO: 183244 - DNA, 20 bp, Artificial
  CRISPR gRNA sequence
cttaccccagaagaaaaaca

SEQ ID NO: 183245 - DNA, 20 bp, Artificial
  CRISPR gRNA sequence
agaagaaaaacagggaaata

SEQ ID NO: 183246 - DNA, 20 bp, Artificial
  CRISPR gRNA sequence
ctcctaccctcccacatgca

SEQ ID NO: 183247 - DNA, 20 bp, Artificial
  CRISPR gRNA sequence
ctcccacatgcacagatttc

SEQ ID NO: 183248 - DNA, 20 bp, Artificial
  CRISPR gRNA sequence
tcccacatgcacagatttct

SEQ ID NO: 183249 - DNA, 20 bp, Artificial
  CRISPR gRNA sequence
tttctgggtgatgcctcccc

SEQ ID NO: 183250 - DNA, 20 bp, Artificial
  CRISPR gRNA sequence
ttctgggtgatgcctcccca

SEQ ID NO: 183251 - DNA, 20 bp, Artificial
  CRISPR gRNA sequence
ctgggtgatgcctccccaag

SEQ ID NO: 183252 - DNA, 20 bp, Artificial
  CRISPR gRNA sequence
ggtgatgcctccccaaggag

SEQ ID NO: 183253 - DNA, 20 bp, Artificial
  CRISPR gRNA sequence
tgatgcctccccaaggagta

SEQ ID NO: 183254 - DNA, 20 bp, Artificial
  CRISPR gRNA sequence
gcctccccaaggagtagaga

SEQ ID NO: 183255 - DNA, 20 bp, Artificial
  CRISPR gRNA sequence
tccccaaggagtagagatag

SEQ ID NO: 183256 - DNA, 20 bp, Artificial
  CRISPR gRNA sequence
ccaaggagtagagatagaag

SEQ ID NO: 183257 - DNA, 20 bp, Artificial
  CRISPR gRNA sequence
aggagtagagatagaagaag

SEQ ID NO: 183258 - DNA, 20 bp, Artificial
  CRISPR gRNA sequence
tagagatagaagaagcggca

SEQ ID NO: 183259 - DNA, 20 bp, Artificial
  CRISPR gRNA sequence
atagaagaagcggcaaagac

SEQ ID NO: 183260 - DNA, 20 bp, Artificial
  CRISPR gRNA sequence
tagaagaagcggcaaagaca

SEQ ID NO: 183261 - DNA, 20 bp, Artificial
  CRISPR gRNA sequence
agaagaagcggcaaagacaa

SEQ ID NO: 183262 - DNA, 20 bp, Artificial
  CRISPR gRNA sequence
agaagcggcaaagacaaggg

SEQ ID NO: 183263 - DNA, 20 bp, Artificial
  CRISPR gRNA sequence
aagcggcaaagacaagggca

SEQ ID NO: 183264 - DNA, 20 bp, Artificial
  CRISPR gRNA sequence
caaagacaagggcagagacc

SEQ ID NO: 183265 - DNA, 20 bp, Artificial
  CRISPR gRNA sequence
ctatgccacacacttgatgt

SEQ ID NO: 183266 - DNA, 20 bp, Artificial
  CRISPR gRNA sequence
cacttgatgtcagataccac

SEQ ID NO: 183267 - DNA, 20 bp, Artificial
  CRISPR gRNA sequence
acttgatgtcagataccacc

SEQ ID NO: 183268 - DNA, 20 bp, Artificial
  CRISPR gRNA sequence
gatgtcagataccaccagga

SEQ ID NO: 183269 - DNA, 20 bp, Artificial
  CRISPR gRNA sequence
atgtcagataccaccaggaa

SEQ ID NO: 183270 - DNA, 20 bp, Artificial
  CRISPR gRNA sequence
tgtcagataccaccaggaaa

SEQ ID NO: 183271 - DNA, 20 bp, Artificial
  CRISPR gRNA sequence
aaatcacattccaaattaca

SEQ ID NO: 183272 - DNA, 20 bp, Artificial
  CRISPR gRNA sequence
aatcacattccaaattacaa

SEQ ID NO: 183273 - DNA, 20 bp, Artificial
  CRISPR gRNA sequence
cattccaaattacaaaggaa

SEQ ID NO: 183274 - DNA, 20 bp, Artificial
  CRISPR gRNA sequence
attccaaattacaaaggaaa

SEQ ID NO: 183275 - DNA, 20 bp, Artificial
  CRISPR gRNA sequence
caaattacaaaggaaaagga

SEQ ID NO: 183276 - DNA, 20 bp, Artificial
  CRISPR gRNA sequence
ttacaaaggaaaaggaaaga

SEQ ID NO: 183277 - DNA, 20 bp, Artificial
  CRISPR gRNA sequence
caaaggaaaaggaaagatgg

SEQ ID NO: 183278 - DNA, 20 bp, Artificial
  CRISPR gRNA sequence
aaaggaaagatggaagaccg

SEQ ID NO: 183279 - DNA, 20 bp, Artificial
  CRISPR gRNA sequence
aagatggaagaccgaagaca

SEQ ID NO: 183280 - DNA, 20 bp, Artificial
  CRISPR gRNA sequence
cgaagacacagattttgctg

SEQ ID NO: 183281 - DNA, 20 bp, Artificial
  CRISPR gRNA sequence
attttgctgcagcaattcct

SEQ ID NO: 183282 - DNA, 20 bp, Artificial
  CRISPR gRNA sequence
gcagcaattccttggaacgt

SEQ ID NO: 183283 - DNA, 20 bp, Artificial
  CRISPR gRNA sequence
agcaattccttggaacgtga

SEQ ID NO: 183284 - DNA, 20 bp, Artificial
  CRISPR gRNA sequence
acctcttctctcattctctt

SEQ ID NO: 183285 - DNA, 20 bp, Artificial
  CRISPR gRNA sequence
tcttctctcattctctttgg

SEQ ID NO: 183286 - DNA, 20 bp, Artificial
  CRISPR gRNA sequence
ttctctttggaagcccaaac

SEQ ID NO: 183287 - DNA, 20 bp, Artificial
  CRISPR gRNA sequence
tctctttggaagcccaaact

SEQ ID NO: 183288 - DNA, 20 bp, Artificial
  CRISPR gRNA sequence
gaagcccaaactgggttctt

SEQ ID NO: 183289 - DNA, 20 bp, Artificial
  CRISPR gRNA sequence
ccaaactgggttcttgagtt

SEQ ID NO: 183290 - DNA, 20 bp, Artificial
  CRISPR gRNA sequence
caaactgggttcttgagttt

SEQ ID NO: 183291 - DNA, 20 bp, Artificial
  CRISPR gRNA sequence
aaactgggttcttgagtttg

SEQ ID NO: 183292 - DNA, 20 bp, Artificial
  CRISPR gRNA sequence
ctgggttcttgagtttgggg

SEQ ID NO: 183293 - DNA, 20 bp, Artificial
  CRISPR gRNA sequence
ttgagtttggggaagattta

SEQ ID NO: 183294 - DNA, 20 bp, Artificial
  CRISPR gRNA sequence
tttggggaagatttatggaa

SEQ ID NO: 183295 - DNA, 20 bp, Artificial
  CRISPR gRNA sequence
gatgcctaccattgccttta

SEQ ID NO: 183296 - DNA, 20 bp, Artificial
  CRISPR gRNA sequence
atgcctaccattgcctttaa

SEQ ID NO: 183297 - DNA, 20 bp, Artificial
  CRISPR gRNA sequence
tgcctaccattgcctttaaa

SEQ ID NO: 183298 - DNA, 20 bp, Artificial
  CRISPR gRNA sequence
taccattgcctttaaagggt

SEQ ID NO: 183299 - DNA, 20 bp, Artificial
  CRISPR gRNA sequence
accattgcctttaaagggtt

SEQ ID NO: 183300 - DNA, 20 bp, Artificial
  CRISPR gRNA sequence
ccattgcctttaaagggtta

SEQ ID NO: 183301 - DNA, 20 bp, Artificial
  CRISPR gRNA sequence
attgcctttaaagggttagg

SEQ ID NO: 183302 - DNA, 20 bp, Artificial
  CRISPR gRNA sequence
ttgcctttaaagggttaggg

SEQ ID NO: 183303 - DNA, 20 bp, Artificial
  CRISPR gRNA sequence
ggttagggaggatatatgct

SEQ ID NO: 183304 - DNA, 20 bp, Artificial
  CRISPR gRNA sequence
tagggaggatatatgcttgg

SEQ ID NO: 183305 - DNA, 20 bp, Artificial
  CRISPR gRNA sequence
gaggatatatgcttggcagt

SEQ ID NO: 183306 - DNA, 20 bp, Artificial
  CRISPR gRNA sequence
gatatatgcttggcagtaag

SEQ ID NO: 183307 - DNA, 20 bp, Artificial
  CRISPR gRNA sequence
atatatgcttggcagtaagc

SEQ ID NO: 183308 - DNA, 20 bp, Artificial
  CRISPR gRNA sequence
gcttggcagtaagcaggctg

SEQ ID NO: 183309 - DNA, 20 bp, Artificial
  CRISPR gRNA sequence
cttggcagtaagcaggctga

SEQ ID NO: 183310 - DNA, 20 bp, Artificial
  CRISPR gRNA sequence
ggcagtaagcaggctgaagg

SEQ ID NO: 183311 - DNA, 20 bp, Artificial
  CRISPR gRNA sequence
gcagtaagcaggctgaaggc

SEQ ID NO: 183312 - DNA, 20 bp, Artificial
  CRISPR gRNA sequence
gtaagcaggctgaaggcagg

SEQ ID NO: 183313 - DNA, 20 bp, Artificial
  CRISPR gRNA sequence
ctgaaggcaggaagaaaatt

SEQ ID NO: 183314 - DNA, 20 bp, Artificial
  CRISPR gRNA sequence
tgaaggcaggaagaaaattt

SEQ ID NO: 183315 - DNA, 20 bp, Artificial
  CRISPR gRNA sequence
ggcaggaagaaaatttagga

SEQ ID NO: 183316 - DNA, 20 bp, Artificial
  CRISPR gRNA sequence
aggaagaaaatttaggatgg

SEQ ID NO: 183317 - DNA, 20 bp, Artificial
  CRISPR gRNA sequence
aatttaggatggcagaattg

SEQ ID NO: 183318 - DNA, 20 bp, Artificial
  CRISPR gRNA sequence
taggatggcagaattgcagt

SEQ ID NO: 183319 - DNA, 20 bp, Artificial
  CRISPR gRNA sequence
aggatggcagaattgcagtt

SEQ ID NO: 183320 - DNA, 20 bp, Artificial
  CRISPR gRNA sequence
ggatggcagaattgcagttg

SEQ ID NO: 183321 - DNA, 20 bp, Artificial
  CRISPR gRNA sequence
ggcagaattgcagttggggc

SEQ ID NO: 183322 - DNA, 20 bp, Artificial
  CRISPR gRNA sequence
agaattgcagttggggccag

SEQ ID NO: 183323 - DNA, 20 bp, Artificial
  CRISPR gRNA sequence
cagttggggccagtggaata

SEQ ID NO: 183324 - DNA, 20 bp, Artificial
  CRISPR gRNA sequence
agttggggccagtggaatac

SEQ ID NO: 183325 - DNA, 20 bp, Artificial
  CRISPR gRNA sequence
gttggggccagtggaataca

SEQ ID NO: 183326 - DNA, 20 bp, Artificial
  CRISPR gRNA sequence
tggggccagtggaatacagg

SEQ ID NO: 183327 - DNA, 20 bp, Artificial
  CRISPR gRNA sequence
ggccagtggaatacagggag

SEQ ID NO: 183328 - DNA, 20 bp, Artificial
  CRISPR gRNA sequence
cagtggaatacagggagtgg

SEQ ID NO: 183329 - DNA, 20 bp, Artificial
  CRISPR gRNA sequence
agtggaatacagggagtggt

SEQ ID NO: 183330 - DNA, 20 bp, Artificial
  CRISPR gRNA sequence
ggagtggtaggttgtacctg

SEQ ID NO: 183331 - DNA, 20 bp, Artificial
  CRISPR gRNA sequence
taggttgtacctgtagcact

SEQ ID NO: 183332 - DNA, 20 bp, Artificial
  CRISPR gRNA sequence
acctgtagcactaagacatc

SEQ ID NO: 183333 - DNA, 20 bp, Artificial
  CRISPR gRNA sequence
cctgtagcactaagacatct

SEQ ID NO: 183334 - DNA, 20 bp, Artificial
  CRISPR gRNA sequence
gtagcactaagacatctggg

SEQ ID NO: 183335 - DNA, 20 bp, Artificial
  CRISPR gRNA sequence
actaagacatctgggcggtt

SEQ ID NO: 183336 - DNA, 20 bp, Artificial
  CRISPR gRNA sequence
ctaagacatctgggcggttt

SEQ ID NO: 183337 - DNA, 20 bp, Artificial
  CRISPR gRNA sequence
agacatctgggcggtttggg

SEQ ID NO: 183338 - DNA, 20 bp, Artificial
  CRISPR gRNA sequence
gacatctgggcggtttgggt

SEQ ID NO: 183339 - DNA, 20 bp, Artificial
  CRISPR gRNA sequence
ctgggcggtttgggtaggca

SEQ ID NO: 183340 - DNA, 20 bp, Artificial
  CRISPR gRNA sequence
tgggcggtttgggtaggcaa

SEQ ID NO: 183341 - DNA, 20 bp, Artificial
  CRISPR gRNA sequence
ggcggtttgggtaggcaaag

SEQ ID NO: 183342 - DNA, 20 bp, Artificial
  CRISPR gRNA sequence
ggtaggcaaaggagacatct

SEQ ID NO: 183343 - DNA, 20 bp, Artificial
  CRISPR gRNA sequence
caaaggagacatcttggaac

SEQ ID NO: 183344 - DNA, 20 bp, Artificial
  CRISPR gRNA sequence
gagacatcttggaactggac

SEQ ID NO: 183345 - DNA, 20 bp, Artificial
  CRISPR gRNA sequence
agacatcttggaactggaca

SEQ ID NO: 183346 - DNA, 20 bp, Artificial
  CRISPR gRNA sequence
ggaactggacaaggccctcc

SEQ ID NO: 183347 - DNA, 20 bp, Artificial
  CRISPR gRNA sequence
ggacaaggccctccaagtgt

SEQ ID NO: 183348 - DNA, 20 bp, Artificial
  CRISPR gRNA sequence
gacaaggccctccaagtgta

SEQ ID NO: 183349 - DNA, 20 bp, Artificial
  CRISPR gRNA sequence
acaaggccctccaagtgtaa

SEQ ID NO: 183350 - DNA, 20 bp, Artificial
  CRISPR gRNA sequence
aaggccctccaagtgtaagg

SEQ ID NO: 183351 - DNA, 20 bp, Artificial
  CRISPR gRNA sequence
tccaagtgtaagggagtcaa

SEQ ID NO: 183352 - DNA, 20 bp, Artificial
  CRISPR gRNA sequence
taagggagtcaacagaccac

SEQ ID NO: 183353 - DNA, 20 bp, Artificial
  CRISPR gRNA sequence
aagggagtcaacagaccact

SEQ ID NO: 183354 - DNA, 20 bp, Artificial
  CRISPR gRNA sequence
ggagtcaacagaccactggg

SEQ ID NO: 183355 - DNA, 20 bp, Artificial
  CRISPR gRNA sequence
gagtcaacagaccactgggt

SEQ ID NO: 183356 - DNA, 20 bp, Artificial
  CRISPR gRNA sequence
tcaacagaccactgggtggg

SEQ ID NO: 183357 - DNA, 20 bp, Artificial
  CRISPR gRNA sequence
cagaccactgggtgggcagc

SEQ ID NO: 183358 - DNA, 20 bp, Artificial
  CRISPR gRNA sequence
agaccactgggtgggcagcg

SEQ ID NO: 183359 - DNA, 20 bp, Artificial
  CRISPR gRNA sequence
gaccactgggtgggcagcga

SEQ ID NO: 183360 - DNA, 20 bp, Artificial
  CRISPR gRNA sequence
accactgggtgggcagcgag

SEQ ID NO: 183361 - DNA, 20 bp, Artificial
  CRISPR gRNA sequence
tgggtgggcagcgaggggtg

SEQ ID NO: 183362 - DNA, 20 bp, Artificial
  CRISPR gRNA sequence
gggcagcgaggggtgcggtc

SEQ ID NO: 183363 - DNA, 20 bp, Artificial
  CRISPR gRNA sequence
ggcagcgaggggtgcggtcc

SEQ ID NO: 183364 - DNA, 20 bp, Artificial
  CRISPR gRNA sequence
ggtactcaaatattttctct

SEQ ID NO: 183365 - DNA, 20 bp, Artificial
  CRISPR gRNA sequence
gtactcaaatattttctctg

SEQ ID NO: 183366 - DNA, 20 bp, Artificial
  CRISPR gRNA sequence
actcaaatattttctctgag

SEQ ID NO: 183367 - DNA, 20 bp, Artificial
  CRISPR gRNA sequence
tattttctctgaggagccca

SEQ ID NO: 183368 - DNA, 20 bp, Artificial
  CRISPR gRNA sequence
gcccacagccttctgtactc

SEQ ID NO: 183369 - DNA, 20 bp, Artificial
  CRISPR gRNA sequence
cccacagccttctgtactct

SEQ ID NO: 183370 - DNA, 20 bp, Artificial
  CRISPR gRNA sequence
ccacagccttctgtactctg

SEQ ID NO: 183371 - DNA, 20 bp, Artificial
  CRISPR gRNA sequence
cagccttctgtactctgggg

SEQ ID NO: 183372 - DNA, 20 bp, Artificial
  CRISPR gRNA sequence
cttctgtactctggggtaga

SEQ ID NO: 183373 - DNA, 20 bp, Artificial
  CRISPR gRNA sequence
tctgtactctggggtagatg

SEQ ID NO: 183374 - DNA, 20 bp, Artificial
  CRISPR gRNA sequence
tgtactctggggtagatgga

SEQ ID NO: 183375 - DNA, 20 bp, Artificial
  CRISPR gRNA sequence
actctggggtagatggagag

SEQ ID NO: 183376 - DNA, 20 bp, Artificial
  CRISPR gRNA sequence
ggtagatggagagcagtacc

SEQ ID NO: 183377 - DNA, 20 bp, Artificial
  CRISPR gRNA sequence
tagatggagagcagtaccta

SEQ ID NO: 183378 - DNA, 20 bp, Artificial
  CRISPR gRNA sequence
agatggagagcagtacctag

SEQ ID NO: 183379 - DNA, 20 bp, Artificial
  CRISPR gRNA sequence
gatggagagcagtacctaga

SEQ ID NO: 183380 - DNA, 20 bp, Artificial
  CRISPR gRNA sequence
tggagagcagtacctagagg

SEQ ID NO: 183381 - DNA, 20 bp, Artificial
  CRISPR gRNA sequence
ggagagcagtacctagaggg

SEQ ID NO: 183382 - DNA, 20 bp, Artificial
  CRISPR gRNA sequence
agcagtacctagagggaggt

SEQ ID NO: 183383 - DNA, 20 bp, Artificial
  CRISPR gRNA sequence
tacctagagggaggtaagaa

SEQ ID NO: 183384 - DNA, 20 bp, Artificial
  CRISPR gRNA sequence
gagggaggtaagaatagtga

SEQ ID NO: 183385 - DNA, 20 bp, Artificial
  CRISPR gRNA sequence
gaggtaagaatagtgaaagt

SEQ ID NO: 183386 - DNA, 20 bp, Artificial
  CRISPR gRNA sequence
aggtaagaatagtgaaagtg

SEQ ID NO: 183387 - DNA, 20 bp, Artificial
  CRISPR gRNA sequence
taagaatagtgaaagtgagg

SEQ ID NO: 183388 - DNA, 20 bp, Artificial
  CRISPR gRNA sequence
aagtgaggtagtctgcttgc

SEQ ID NO: 183389 - DNA, 20 bp, Artificial
  CRISPR gRNA sequence
ctgcttgccagcattatgtg

SEQ ID NO: 183390 - DNA, 20 bp, Artificial
  CRISPR gRNA sequence
ttgccagcattatgtgaagc

SEQ ID NO: 183391 - DNA, 20 bp, Artificial
  CRISPR gRNA sequence
ccagcattatgtgaagcaag

SEQ ID NO: 183392 - DNA, 20 bp, Artificial
  CRISPR gRNA sequence
cagcattatgtgaagcaaga

SEQ ID NO: 183393 - DNA, 20 bp, Artificial
  CRISPR gRNA sequence
agcattatgtgaagcaagaa

SEQ ID NO: 183394 - DNA, 20 bp, Artificial
  CRISPR gRNA sequence
tatgtgaagcaagaagggta

SEQ ID NO: 183395 - DNA, 20 bp, Artificial
  CRISPR gRNA sequence
gaagcaagaagggtaaagaa

SEQ ID NO: 183396 - DNA, 20 bp, Artificial
  CRISPR gRNA sequence
gcaagaagggtaaagaatgg

SEQ ID NO: 183397 - DNA, 20 bp, Artificial
  CRISPR gRNA sequence
caagaagggtaaagaatgga

SEQ ID NO: 183398 - DNA, 20 bp, Artificial
  CRISPR gRNA sequence
aagaatggaaggacatcaca

SEQ ID NO: 183399 - DNA, 20 bp, Artificial
  CRISPR gRNA sequence
atggaaggacatcacacaga

SEQ ID NO: 183400 - DNA, 20 bp, Artificial
  CRISPR gRNA sequence
ggacatcacacagatggtgc

SEQ ID NO: 183401 - DNA, 20 bp, Artificial
  CRISPR gRNA sequence
gacatcacacagatggtgct

SEQ ID NO: 183402 - DNA, 20 bp, Artificial
  CRISPR gRNA sequence
tcacacagatggtgctgggc

SEQ ID NO: 183403 - DNA, 20 bp, Artificial
  CRISPR gRNA sequence
acacagatggtgctgggcca

SEQ ID NO: 183404 - DNA, 20 bp, Artificial
  CRISPR gRNA sequence
cacagatggtgctgggccag

SEQ ID NO: 183405 - DNA, 20 bp, Artificial
  CRISPR gRNA sequence
agatggtgctgggccagagg

SEQ ID NO: 183406 - DNA, 20 bp, Artificial
  CRISPR gRNA sequence
gatggtgctgggccagagga

SEQ ID NO: 183407 - DNA, 20 bp, Artificial
  CRISPR gRNA sequence
gccagaggaaggaatcacac

SEQ ID NO: 183408 - DNA, 20 bp, Artificial
  CRISPR gRNA sequence
ccagaggaaggaatcacact

SEQ ID NO: 183409 - DNA, 20 bp, Artificial
  CRISPR gRNA sequence
cagaggaaggaatcacactg

SEQ ID NO: 183410 - DNA, 20 bp, Artificial
  CRISPR gRNA sequence
gaggaaggaatcacactggg

SEQ ID NO: 183411 - DNA, 20 bp, Artificial
  CRISPR gRNA sequence
aggaatcacactggggagtg

SEQ ID NO: 183412 - DNA, 20 bp, Artificial
  CRISPR gRNA sequence
ggaatcacactggggagtga

SEQ ID NO: 183413 - DNA, 20 bp, Artificial
  CRISPR gRNA sequence
atcacactggggagtgaagg

SEQ ID NO: 183414 - DNA, 20 bp, Artificial
  CRISPR gRNA sequence
cacactggggagtgaaggtg

SEQ ID NO: 183415 - DNA, 20 bp, Artificial
  CRISPR gRNA sequence
acactggggagtgaaggtgg

SEQ ID NO: 183416 - DNA, 20 bp, Artificial
  CRISPR gRNA sequence
cactggggagtgaaggtgga

SEQ ID NO: 183417 - DNA, 20 bp, Artificial
  CRISPR gRNA sequence
gtggagggacctcacctcca

SEQ ID NO: 183418 - DNA, 20 bp, Artificial
  CRISPR gRNA sequence
gggacctcacctccacagcc

SEQ ID NO: 183419 - DNA, 20 bp, Artificial
  CRISPR gRNA sequence
ggacctcacctccacagcct

SEQ ID NO: 183420 - DNA, 20 bp, Artificial
  CRISPR gRNA sequence
cagcctgggtgaactgcatc

SEQ ID NO: 183421 - DNA, 20 bp, Artificial
  CRISPR gRNA sequence
cctgggtgaactgcatctgg

SEQ ID NO: 183422 - DNA, 20 bp, Artificial
  CRISPR gRNA sequence
tgggtgaactgcatctggta

SEQ ID NO: 183423 - DNA, 20 bp, Artificial
  CRISPR gRNA sequence
tggtagagaacaaatgtgac

SEQ ID NO: 183424 - DNA, 20 bp, Artificial
  CRISPR gRNA sequence
ggtagagaacaaatgtgaca

SEQ ID NO: 183425 - DNA, 20 bp, Artificial
  CRISPR gRNA sequence
gacaaggttcccactgctta

SEQ ID NO: 183426 - DNA, 20 bp, Artificial
  CRISPR gRNA sequence
cccactgcttacagccccac

SEQ ID NO: 183427 - DNA, 20 bp, Artificial
  CRISPR gRNA sequence
cttacagccccactggtcac

SEQ ID NO: 183428 - DNA, 20 bp, Artificial
  CRISPR gRNA sequence
tcaccagctgcccaccaatg

SEQ ID NO: 183429 - DNA, 20 bp, Artificial
  CRISPR gRNA sequence
accagctgcccaccaatgta

SEQ ID NO: 183430 - DNA, 20 bp, Artificial
  CRISPR gRNA sequence
ccagctgcccaccaatgtag

SEQ ID NO: 183431 - DNA, 20 bp, Artificial
  CRISPR gRNA sequence
atgtagaggattcccacttt

SEQ ID NO: 183432 - DNA, 20 bp, Artificial
  CRISPR gRNA sequence
tagaggattcccactttcag

SEQ ID NO: 183433 - DNA, 20 bp, Artificial
  CRISPR gRNA sequence
cagcatacctgaaatctata

SEQ ID NO: 183434 - DNA, 20 bp, Artificial
  CRISPR gRNA sequence
gcatacctgaaatctataaa

SEQ ID NO: 183435 - DNA, 20 bp, Artificial
  CRISPR gRNA sequence
ctataaagagaccacaaaaa

SEQ ID NO: 183436 - DNA, 20 bp, Artificial
  CRISPR gRNA sequence
tataaagagaccacaaaaaa

SEQ ID NO: 183437 - DNA, 20 bp, Artificial
  CRISPR gRNA sequence
ataaagagaccacaaaaaaa

SEQ ID NO: 183438 - DNA, 20 bp, Artificial
  CRISPR gRNA sequence
agaccacaaaaaaagggact

SEQ ID NO: 183439 - DNA, 20 bp, Artificial
  CRISPR gRNA sequence
gaccacaaaaaaagggactg

SEQ ID NO: 183440 - DNA, 20 bp, Artificial
  CRISPR gRNA sequence
cacaaaaaaagggactgagg

SEQ ID NO: 183441 - DNA, 20 bp, Artificial
  CRISPR gRNA sequence
caaaaaaagggactgaggta

SEQ ID NO: 183442 - DNA, 20 bp, Artificial
  CRISPR gRNA sequence
gggactgaggtagagaaatc

SEQ ID NO: 183443 - DNA, 20 bp, Artificial
  CRISPR gRNA sequence
gactgaggtagagaaatctg

SEQ ID NO: 183444 - DNA, 20 bp, Artificial
  CRISPR gRNA sequence
actgaggtagagaaatctgg

SEQ ID NO: 183445 - DNA, 20 bp, Artificial
  CRISPR gRNA sequence
ctgaggtagagaaatctgga

SEQ ID NO: 183446 - DNA, 20 bp, Artificial
  CRISPR gRNA sequence
tgaggtagagaaatctggag

SEQ ID NO: 183447 - DNA, 20 bp, Artificial
  CRISPR gRNA sequence
agaaatctggaggggacaca

SEQ ID NO: 183448 - DNA, 20 bp, Artificial
  CRISPR gRNA sequence
ggaggggacacaaagaacca

SEQ ID NO: 183449 - DNA, 20 bp, Artificial
  CRISPR gRNA sequence
gaaccacagtcattaacctg

SEQ ID NO: 183450 - DNA, 20 bp, Artificial
  CRISPR gRNA sequence
aaccacagtcattaacctga

SEQ ID NO: 183451 - DNA, 20 bp, Artificial
  CRISPR gRNA sequence
attaacctgaaggaaatatc

SEQ ID NO: 183452 - DNA, 20 bp, Artificial
  CRISPR gRNA sequence
atatcaagtccctgtctcct

SEQ ID NO: 183453 - DNA, 20 bp, Artificial
  CRISPR gRNA sequence
ccctgtctcctaagtgacat

SEQ ID NO: 183454 - DNA, 20 bp, Artificial
  CRISPR gRNA sequence
tgtctcctaagtgacatcgg

SEQ ID NO: 183455 - DNA, 20 bp, Artificial
  CRISPR gRNA sequence
gtctcctaagtgacatcggc

SEQ ID NO: 183456 - DNA, 20 bp, Artificial
  CRISPR gRNA sequence
agtgacatcggcaggctcaa

SEQ ID NO: 183457 - DNA, 20 bp, Artificial
  CRISPR gRNA sequence
gtgacatcggcaggctcaat

SEQ ID NO: 183458 - DNA, 20 bp, Artificial
  CRISPR gRNA sequence
acatcggcaggctcaatagg

SEQ ID NO: 183459 - DNA, 20 bp, Artificial
  CRISPR gRNA sequence
cggcaggctcaataggcaga

SEQ ID NO: 183460 - DNA, 20 bp, Artificial
  CRISPR gRNA sequence
ggcaggctcaataggcagac

SEQ ID NO: 183461 - DNA, 20 bp, Artificial
  CRISPR gRNA sequence
caggctcaataggcagacag

SEQ ID NO: 183462 - DNA, 20 bp, Artificial
  CRISPR gRNA sequence
aggcagacaggagaatgaac

SEQ ID NO: 183463 - DNA, 20 bp, Artificial
  CRISPR gRNA sequence
gcagacaggagaatgaacca

SEQ ID NO: 183464 - DNA, 20 bp, Artificial
  CRISPR gRNA sequence
agaatgaaccagagacccca

SEQ ID NO: 183465 - DNA, 20 bp, Artificial
  CRISPR gRNA sequence
aatgaaccagagaccccatg

SEQ ID NO: 183466 - DNA, 20 bp, Artificial
  CRISPR gRNA sequence
tgactcaatgcacatcatgc

SEQ ID NO: 183467 - DNA, 20 bp, Artificial
  CRISPR gRNA sequence
aatgcacatcatgcaagtca

SEQ ID NO: 183468 - DNA, 20 bp, Artificial
  CRISPR gRNA sequence
atcaccactatcaccttgtc

SEQ ID NO: 183469 - DNA, 20 bp, Artificial
  CRISPR gRNA sequence
tcaccactatcaccttgtct

SEQ ID NO: 183470 - DNA, 20 bp, Artificial
  CRISPR gRNA sequence
caccactatcaccttgtctg

SEQ ID NO: 183471 - DNA, 20 bp, Artificial
  CRISPR gRNA sequence
ccactatcaccttgtctggg

SEQ ID NO: 183472 - DNA, 20 bp, Artificial
  CRISPR gRNA sequence
gagcattttactcttcacaa

SEQ ID NO: 183473 - DNA, 20 bp, Artificial
  CRISPR gRNA sequence
agcattttactcttcacaaa

SEQ ID NO: 183474 - DNA, 20 bp, Artificial
  CRISPR gRNA sequence
ggctttcattcatgtgatgt

SEQ ID NO: 183475 - DNA, 20 bp, Artificial
  CRISPR gRNA sequence
gtgatgtcagctaatacatg

SEQ ID NO: 183476 - DNA, 20 bp, Artificial
  CRISPR gRNA sequence
gatgtcagctaatacatgaa

SEQ ID NO: 183477 - DNA, 20 bp, Artificial
  CRISPR gRNA sequence
aatacatgaagagccttata

SEQ ID NO: 183478 - DNA, 20 bp, Artificial
  CRISPR gRNA sequence
acatgaagagccttataaag

SEQ ID NO: 183479 - DNA, 20 bp, Artificial
  CRISPR gRNA sequence
catgaagagccttataaaga

SEQ ID NO: 183480 - DNA, 20 bp, Artificial
  CRISPR gRNA sequence
tcactccatttttgaaaaat

SEQ ID NO: 183481 - DNA, 20 bp, Artificial
  CRISPR gRNA sequence
cactccatttttgaaaaatg

SEQ ID NO: 183482 - DNA, 20 bp, Artificial
  CRISPR gRNA sequence
ttgaaaaatgaggaaacaac

SEQ ID NO: 183483 - DNA, 20 bp, Artificial
  CRISPR gRNA sequence
aaaatgaggaaacaaccagt

SEQ ID NO: 183484 - DNA, 20 bp, Artificial
  CRISPR gRNA sequence
aaatgaggaaacaaccagtc

SEQ ID NO: 183485 - DNA, 20 bp, Artificial
  CRISPR gRNA sequence
aggaaacaaccagtcgggcg

SEQ ID NO: 183486 - DNA, 20 bp, Artificial
  CRISPR gRNA sequence
aaacaaccagtcgggcgcag

SEQ ID NO: 183487 - DNA, 20 bp, Artificial
  CRISPR gRNA sequence
gtggctcatgcctgcaattc

SEQ ID NO: 183488 - DNA, 20 bp, Artificial
  CRISPR gRNA sequence
tgcctgcaattccagcactt

SEQ ID NO: 183489 - DNA, 20 bp, Artificial
  CRISPR gRNA sequence
gcctgcaattccagcacttt

SEQ ID NO: 183490 - DNA, 20 bp, Artificial
  CRISPR gRNA sequence
ctgcaattccagcactttgg

SEQ ID NO: 183491 - DNA, 20 bp, Artificial
  CRISPR gRNA sequence
tgcaattccagcactttggg

SEQ ID NO: 183492 - DNA, 20 bp, Artificial
  CRISPR gRNA sequence
tccagcactttgggaggccg

SEQ ID NO: 183493 - DNA, 20 bp, Artificial
  CRISPR gRNA sequence
agcactttgggaggccgaag

SEQ ID NO: 183494 - DNA, 20 bp, Artificial
  CRISPR gRNA sequence
gcactttgggaggccgaagt

SEQ ID NO: 183495 - DNA, 20 bp, Artificial
  CRISPR gRNA sequence
ctttgggaggccgaagtggg

SEQ ID NO: 183496 - DNA, 20 bp, Artificial
  CRISPR gRNA sequence
ggccgaagtgggcggatcac

SEQ ID NO: 183497 - DNA, 20 bp, Artificial
  CRISPR gRNA sequence
gccgaagtgggcggatcaca

SEQ ID NO: 183498 - DNA, 20 bp, Artificial
  CRISPR gRNA sequence
aagtgggcggatcacaaggt

SEQ ID NO: 183499 - DNA, 20 bp, Artificial
  CRISPR gRNA sequence
agtgggcggatcacaaggtc

SEQ ID NO: 183500 - DNA, 20 bp, Artificial
  CRISPR gRNA sequence
tgggcggatcacaaggtcag

SEQ ID NO: 183501 - DNA, 20 bp, Artificial
  CRISPR gRNA sequence
gatcacaaggtcaggagatt

SEQ ID NO: 183502 - DNA, 20 bp, Artificial
  CRISPR gRNA sequence
tcaggagattgagaccatcc

SEQ ID NO: 183503 - DNA, 20 bp, Artificial
  CRISPR gRNA sequence
tgagaccatcctggctaaca

SEQ ID NO: 183504 - DNA, 20 bp, Artificial
  CRISPR gRNA sequence
agaccatcctggctaacacg

SEQ ID NO: 183505 - DNA, 20 bp, Artificial
  CRISPR gRNA sequence
tacaaaaaaaaaaaaaaaat

SEQ ID NO: 183506 - DNA, 20 bp, Artificial
  CRISPR gRNA sequence
aaaaaaaaaaaaaaattagc

SEQ ID NO: 183507 - DNA, 20 bp, Artificial
  CRISPR gRNA sequence
aaaaaaaaaaaaaattagcc

SEQ ID NO: 183508 - DNA, 20 bp, Artificial
  CRISPR gRNA sequence
aaaaaaaaattagccgggcg

SEQ ID NO: 183509 - DNA, 20 bp, Artificial
  CRISPR gRNA sequence
aaaaaattagccgggcgtgg

SEQ ID NO: 183510 - DNA, 20 bp, Artificial
  CRISPR gRNA sequence
aaattagccgggcgtggtgg

SEQ ID NO: 183511 - DNA, 20 bp, Artificial
  CRISPR gRNA sequence
aattagccgggcgtggtggc

SEQ ID NO: 183512 - DNA, 20 bp, Artificial
  CRISPR gRNA sequence
ggcgtggtggcgggtgcctg

SEQ ID NO: 183513 - DNA, 20 bp, Artificial
  CRISPR gRNA sequence
gtggcgggtgcctgtagtcc

SEQ ID NO: 183514 - DNA, 20 bp, Artificial
  CRISPR gRNA sequence
tgcctgtagtcccagctact

SEQ ID NO: 183515 - DNA, 20 bp, Artificial
  CRISPR gRNA sequence
gcctgtagtcccagctactc

SEQ ID NO: 183516 - DNA, 20 bp, Artificial
  CRISPR gRNA sequence
ctgtagtcccagctactcag

SEQ ID NO: 183517 - DNA, 20 bp, Artificial
  CRISPR gRNA sequence
tgtagtcccagctactcagg

SEQ ID NO: 183518 - DNA, 20 bp, Artificial
  CRISPR gRNA sequence
tcccagctactcaggaggct

SEQ ID NO: 183519 - DNA, 20 bp, Artificial
  CRISPR gRNA sequence
cccagctactcaggaggctg

SEQ ID NO: 183520 - DNA, 20 bp, Artificial
  CRISPR gRNA sequence
agctactcaggaggctgagg

SEQ ID NO: 183521 - DNA, 20 bp, Artificial
  CRISPR gRNA sequence
gctactcaggaggctgaggc

SEQ ID NO: 183522 - DNA, 20 bp, Artificial
  CRISPR gRNA sequence
tactcaggaggctgaggcgg

SEQ ID NO: 183523 - DNA, 20 bp, Artificial
  CRISPR gRNA sequence
aggaggctgaggcgggagaa

SEQ ID NO: 183524 - DNA, 20 bp, Artificial
  CRISPR gRNA sequence
gcgggagaacggcgtgaacc

SEQ ID NO: 183525 - DNA, 20 bp, Artificial
  CRISPR gRNA sequence
cgggagaacggcgtgaaccc

SEQ ID NO: 183526 - DNA, 20 bp, Artificial
  CRISPR gRNA sequence
ggagaacggcgtgaacccgg

SEQ ID NO: 183527 - DNA, 20 bp, Artificial
  CRISPR gRNA sequence
gagaacggcgtgaacccggg

SEQ ID NO: 183528 - DNA, 20 bp, Artificial
  CRISPR gRNA sequence
aacggcgtgaacccgggagg

SEQ ID NO: 183529 - DNA, 20 bp, Artificial
  CRISPR gRNA sequence
cggcgtgaacccgggaggcg

SEQ ID NO: 183530 - DNA, 20 bp, Artificial
  CRISPR gRNA sequence
aacccgggaggcggagcttg

SEQ ID NO: 183531 - DNA, 20 bp, Artificial
  CRISPR gRNA sequence
cgggaggcggagcttgcagt

SEQ ID NO: 183532 - DNA, 20 bp, Artificial
  CRISPR gRNA sequence
ggcggagcttgcagtgagcc

SEQ ID NO: 183533 - DNA, 20 bp, Artificial
  CRISPR gRNA sequence
cagatcgcgccactgcactc

SEQ ID NO: 183534 - DNA, 20 bp, Artificial
  CRISPR gRNA sequence
cgcgccactgcactccagcc

SEQ ID NO: 183535 - DNA, 20 bp, Artificial
  CRISPR gRNA sequence
gcgccactgcactccagcct

SEQ ID NO: 183536 - DNA, 20 bp, Artificial
  CRISPR gRNA sequence
gcactccagcctgggcgaca

SEQ ID NO: 183537 - DNA, 20 bp, Artificial
  CRISPR gRNA sequence
tccagcctgggcgacaaagc

SEQ ID NO: 183538 - DNA, 20 bp, Artificial
  CRISPR gRNA sequence
tgggcgacaaagcgagactc

SEQ ID NO: 183539 - DNA, 20 bp, Artificial
  CRISPR gRNA sequence
agctcaaaaataataataat

SEQ ID NO: 183540 - DNA, 20 bp, Artificial
  CRISPR gRNA sequence
aacaaacaaataaataaata

SEQ ID NO: 183541 - DNA, 20 bp, Artificial
  CRISPR gRNA sequence
caaacaaataaataaataaa

SEQ ID NO: 183542 - DNA, 20 bp, Artificial
  CRISPR gRNA sequence
aaacaaataaataaataaag

SEQ ID NO: 183543 - DNA, 20 bp, Artificial
  CRISPR gRNA sequence
ataaataaataaagaggaaa

SEQ ID NO: 183544 - DNA, 20 bp, Artificial
  CRISPR gRNA sequence
aaataaagaggaaacagtct

SEQ ID NO: 183545 - DNA, 20 bp, Artificial
  CRISPR gRNA sequence
ataaagaggaaacagtctca

SEQ ID NO: 183546 - DNA, 20 bp, Artificial
  CRISPR gRNA sequence
aagaggaaacagtctcagag

SEQ ID NO: 183547 - DNA, 20 bp, Artificial
  CRISPR gRNA sequence
agaggaaacagtctcagaga

SEQ ID NO: 183548 - DNA, 20 bp, Artificial
  CRISPR gRNA sequence
aaatttgttgtcatgatcac

SEQ ID NO: 183549 - DNA, 20 bp, Artificial
  CRISPR gRNA sequence
tgttgtcatgatcacaagac

SEQ ID NO: 183550 - DNA, 20 bp, Artificial
  CRISPR gRNA sequence
gacaagtaaattgcatcatc

SEQ ID NO: 183551 - DNA, 20 bp, Artificial
  CRISPR gRNA sequence
agtaaattgcatcatcaagc

SEQ ID NO: 183552 - DNA, 20 bp, Artificial
  CRISPR gRNA sequence
gtaaattgcatcatcaagcc

SEQ ID NO: 183553 - DNA, 20 bp, Artificial
  CRISPR gRNA sequence
catcatcaagccaggatctt

SEQ ID NO: 183554 - DNA, 20 bp, Artificial
  CRISPR gRNA sequence
agccaggatcttcggatcac

SEQ ID NO: 183555 - DNA, 20 bp, Artificial
  CRISPR gRNA sequence
ggatcttcggatcactggcg

SEQ ID NO: 183556 - DNA, 20 bp, Artificial
  CRISPR gRNA sequence
cactggcgtagctctctttc

SEQ ID NO: 183557 - DNA, 20 bp, Artificial
  CRISPR gRNA sequence
gctctctttccagtgcatca

SEQ ID NO: 183558 - DNA, 20 bp, Artificial
  CRISPR gRNA sequence
tcacagatgtccctcatccc

SEQ ID NO: 183559 - DNA, 20 bp, Artificial
  CRISPR gRNA sequence
actctcactaacaaatctac

SEQ ID NO: 183560 - DNA, 20 bp, Artificial
  CRISPR gRNA sequence
ctctcactaacaaatctaca

SEQ ID NO: 183561 - DNA, 20 bp, Artificial
  CRISPR gRNA sequence
ctaacaaatctacaaggtac

SEQ ID NO: 183562 - DNA, 20 bp, Artificial
  CRISPR gRNA sequence
atctacaaggtaccagcatg

SEQ ID NO: 183563 - DNA, 20 bp, Artificial
  CRISPR gRNA sequence
tacaaggtaccagcatgaag

SEQ ID NO: 183564 - DNA, 20 bp, Artificial
  CRISPR gRNA sequence
gtaccagcatgaagcagtcc

SEQ ID NO: 183565 - DNA, 20 bp, Artificial
  CRISPR gRNA sequence
taccagcatgaagcagtccc

SEQ ID NO: 183566 - DNA, 20 bp, Artificial
  CRISPR gRNA sequence
catgaagcagtcccaggtgc

SEQ ID NO: 183567 - DNA, 20 bp, Artificial
  CRISPR gRNA sequence
gtcccaggtgcaagaattta

SEQ ID NO: 183568 - DNA, 20 bp, Artificial
  CRISPR gRNA sequence
tggcgccctgcacttcccct

SEQ ID NO: 183569 - DNA, 20 bp, Artificial
  CRISPR gRNA sequence
gcgccctgcacttcccctga

SEQ ID NO: 183570 - DNA, 20 bp, Artificial
  CRISPR gRNA sequence
cgccctgcacttcccctgag

SEQ ID NO: 183571 - DNA, 20 bp, Artificial
  CRISPR gRNA sequence
tgcacttcccctgagaggca

SEQ ID NO: 183572 - DNA, 20 bp, Artificial
  CRISPR gRNA sequence
gcacttcccctgagaggcaa

SEQ ID NO: 183573 - DNA, 20 bp, Artificial
  CRISPR gRNA sequence
cttcccctgagaggcaaagg

SEQ ID NO: 183574 - DNA, 20 bp, Artificial
  CRISPR gRNA sequence
ttcccctgagaggcaaagga

SEQ ID NO: 183575 - DNA, 20 bp, Artificial
  CRISPR gRNA sequence
tgagaggcaaaggaaggccc

SEQ ID NO: 183576 - DNA, 20 bp, Artificial
  CRISPR gRNA sequence
gagaggcaaaggaaggccct

SEQ ID NO: 183577 - DNA, 20 bp, Artificial
  CRISPR gRNA sequence
gcaaaggaaggccctaggac

SEQ ID NO: 183578 - DNA, 20 bp, Artificial
  CRISPR gRNA sequence
aaggaaggccctaggactgg

SEQ ID NO: 183579 - DNA, 20 bp, Artificial
  CRISPR gRNA sequence
acgcatctctccaatccaca

SEQ ID NO: 183580 - DNA, 20 bp, Artificial
  CRISPR gRNA sequence
atctctccaatccacatggt

SEQ ID NO: 183581 - DNA, 20 bp, Artificial
  CRISPR gRNA sequence
tctctccaatccacatggtt

SEQ ID NO: 183582 - DNA, 20 bp, Artificial
  CRISPR gRNA sequence
ctccaatccacatggttggg

SEQ ID NO: 183583 - DNA, 20 bp, Artificial
  CRISPR gRNA sequence
gattttatgtaccatactga

SEQ ID NO: 183584 - DNA, 20 bp, Artificial
  CRISPR gRNA sequence
attttatgtaccatactgaa

SEQ ID NO: 183585 - DNA, 20 bp, Artificial
  CRISPR gRNA sequence
ttatgtaccatactgaaagg

SEQ ID NO: 183586 - DNA, 20 bp, Artificial
  CRISPR gRNA sequence
catactgaaaggaagccacc

SEQ ID NO: 183587 - DNA, 20 bp, Artificial
  CRISPR gRNA sequence
gaagccacctagcatcttta

SEQ ID NO: 183588 - DNA, 20 bp, Artificial
  CRISPR gRNA sequence
agccacctagcatctttaaa

SEQ ID NO: 183589 - DNA, 20 bp, Artificial
  CRISPR gRNA sequence
ccacctagcatctttaaaga

SEQ ID NO: 183590 - DNA, 20 bp, Artificial
  CRISPR gRNA sequence
cacctagcatctttaaagag

SEQ ID NO: 183591 - DNA, 20 bp, Artificial
  CRISPR gRNA sequence
acctagcatctttaaagaga

SEQ ID NO: 183592 - DNA, 20 bp, Artificial
  CRISPR gRNA sequence
ctagcatctttaaagagagg

SEQ ID NO: 183593 - DNA, 20 bp, Artificial
  CRISPR gRNA sequence
tagcatctttaaagagaggg

SEQ ID NO: 183594 - DNA, 20 bp, Artificial
  CRISPR gRNA sequence
agcatctttaaagagaggga

SEQ ID NO: 183595 - DNA, 20 bp, Artificial
  CRISPR gRNA sequence
gcatctttaaagagagggag

SEQ ID NO: 183596 - DNA, 20 bp, Artificial
  CRISPR gRNA sequence
catctttaaagagagggagg

SEQ ID NO: 183597 - DNA, 20 bp, Artificial
  CRISPR gRNA sequence
tttaaagagagggagggggc

SEQ ID NO: 183598 - DNA, 20 bp, Artificial
  CRISPR gRNA sequence
ttaaagagagggagggggct

SEQ ID NO: 183599 - DNA, 20 bp, Artificial
  CRISPR gRNA sequence
taaagagagggagggggcta

SEQ ID NO: 183600 - DNA, 20 bp, Artificial
  CRISPR gRNA sequence
gggagggggctagggacact

SEQ ID NO: 183601 - DNA, 20 bp, Artificial
  CRISPR gRNA sequence
agggggctagggacactgag

SEQ ID NO: 183602 - DNA, 20 bp, Artificial
  CRISPR gRNA sequence
ggggctagggacactgagta

SEQ ID NO: 183603 - DNA, 20 bp, Artificial
  CRISPR gRNA sequence
ggacactgagtagagtcatt

SEQ ID NO: 183604 - DNA, 20 bp, Artificial
  CRISPR gRNA sequence
tgagtagagtcattgagcct

SEQ ID NO: 183605 - DNA, 20 bp, Artificial
  CRISPR gRNA sequence
gagtagagtcattgagcctc

SEQ ID NO: 183606 - DNA, 20 bp, Artificial
  CRISPR gRNA sequence
gtcattgagcctcaggttgc

SEQ ID NO: 183607 - DNA, 20 bp, Artificial
  CRISPR gRNA sequence
tcattgagcctcaggttgct

SEQ ID NO: 183608 - DNA, 20 bp, Artificial
  CRISPR gRNA sequence
atactgaaccaaccatttcc

SEQ ID NO: 183609 - DNA, 20 bp, Artificial
  CRISPR gRNA sequence
gaaccaaccatttcccagta

SEQ ID NO: 183610 - DNA, 20 bp, Artificial
  CRISPR gRNA sequence
ccaaccatttcccagtaaag

SEQ ID NO: 183611 - DNA, 20 bp, Artificial
  CRISPR gRNA sequence
caaccatttcccagtaaaga

SEQ ID NO: 183612 - DNA, 20 bp, Artificial
  CRISPR gRNA sequence
accatttcccagtaaagaag

SEQ ID NO: 183613 - DNA, 20 bp, Artificial
  CRISPR gRNA sequence
atttcccagtaaagaaggag

SEQ ID NO: 183614 - DNA, 20 bp, Artificial
  CRISPR gRNA sequence
tttcccagtaaagaaggagt

SEQ ID NO: 183615 - DNA, 20 bp, Artificial
  CRISPR gRNA sequence
tcccagtaaagaaggagtgg

SEQ ID NO: 183616 - DNA, 20 bp, Artificial
  CRISPR gRNA sequence
cagtaaagaaggagtgggag

SEQ ID NO: 183617 - DNA, 20 bp, Artificial
  CRISPR gRNA sequence
agtaaagaaggagtgggagc

SEQ ID NO: 183618 - DNA, 20 bp, Artificial
  CRISPR gRNA sequence
gtaaagaaggagtgggagca

SEQ ID NO: 183619 - DNA, 20 bp, Artificial
  CRISPR gRNA sequence
aaggagtgggagcagggtca

SEQ ID NO: 183620 - DNA, 20 bp, Artificial
  CRISPR gRNA sequence
aggagtgggagcagggtcat

SEQ ID NO: 183621 - DNA, 20 bp, Artificial
  CRISPR gRNA sequence
tgggagcagggtcataggaa

SEQ ID NO: 183622 - DNA, 20 bp, Artificial
  CRISPR gRNA sequence
gggagcagggtcataggaat

SEQ ID NO: 183623 - DNA, 20 bp, Artificial
  CRISPR gRNA sequence
cagggtcataggaatgggaa

SEQ ID NO: 183624 - DNA, 20 bp, Artificial
  CRISPR gRNA sequence
gggtcataggaatgggaatg

SEQ ID NO: 183625 - DNA, 20 bp, Artificial
  CRISPR gRNA sequence
taggaatgggaatggagtca

SEQ ID NO: 183626 - DNA, 20 bp, Artificial
  CRISPR gRNA sequence
gaatggagtcacggcatctt

SEQ ID NO: 183627 - DNA, 20 bp, Artificial
  CRISPR gRNA sequence
aatggagtcacggcatctta

SEQ ID NO: 183628 - DNA, 20 bp, Artificial
  CRISPR gRNA sequence
agtcacggcatcttaaggac

SEQ ID NO: 183629 - DNA, 20 bp, Artificial
  CRISPR gRNA sequence
gtcacggcatcttaaggaca

SEQ ID NO: 183630 - DNA, 20 bp, Artificial
  CRISPR gRNA sequence
tcacggcatcttaaggacaa

SEQ ID NO: 183631 - DNA, 20 bp, Artificial
  CRISPR gRNA sequence
gcatcttaaggacaagggaa

SEQ ID NO: 183632 - DNA, 20 bp, Artificial
  CRISPR gRNA sequence
catcttaaggacaagggaat

SEQ ID NO: 183633 - DNA, 20 bp, Artificial
  CRISPR gRNA sequence
agggaatgggtattcatctt

SEQ ID NO: 183634 - DNA, 20 bp, Artificial
  CRISPR gRNA sequence
gggaatgggtattcatcttc

SEQ ID NO: 183635 - DNA, 20 bp, Artificial
  CRISPR gRNA sequence
tcatcttcaggtgctcacac

SEQ ID NO: 183636 - DNA, 20 bp, Artificial
  CRISPR gRNA sequence
tcttcaggtgctcacactag

SEQ ID NO: 183637 - DNA, 20 bp, Artificial
  CRISPR gRNA sequence
aggtgctcacactagtggtc

SEQ ID NO: 183638 - DNA, 20 bp, Artificial
  CRISPR gRNA sequence
ggtgctcacactagtggtcc

SEQ ID NO: 183639 - DNA, 20 bp, Artificial
  CRISPR gRNA sequence
tgctcacactagtggtccag

SEQ ID NO: 183640 - DNA, 20 bp, Artificial
  CRISPR gRNA sequence
tggtccaggagttgactgca

SEQ ID NO: 183641 - DNA, 20 bp, Artificial
  CRISPR gRNA sequence
ggtccaggagttgactgcat

SEQ ID NO: 183642 - DNA, 20 bp, Artificial
  CRISPR gRNA sequence
ggagttgactgcataggcca

SEQ ID NO: 183643 - DNA, 20 bp, Artificial
  CRISPR gRNA sequence
cataggccacagcctccttc

SEQ ID NO: 183644 - DNA, 20 bp, Artificial
  CRISPR gRNA sequence
gccacagcctccttctggtt

SEQ ID NO: 183645 - DNA, 20 bp, Artificial
  CRISPR gRNA sequence
ttgagtgtctttatttcttg

SEQ ID NO: 183646 - DNA, 20 bp, Artificial
  CRISPR gRNA sequence
gcagcttttccctaaacttc

SEQ ID NO: 183647 - DNA, 20 bp, Artificial
  CRISPR gRNA sequence
cagcttttccctaaacttct

SEQ ID NO: 183648 - DNA, 20 bp, Artificial
  CRISPR gRNA sequence
ctgggcttcgccctcctcgt

SEQ ID NO: 183649 - DNA, 20 bp, Artificial
  CRISPR gRNA sequence
cttcgccctcctcgttggca

SEQ ID NO: 183650 - DNA, 20 bp, Artificial
  CRISPR gRNA sequence
gttggcaaagcttcgaactg

SEQ ID NO: 183651 - DNA, 20 bp, Artificial
  CRISPR gRNA sequence
ttggcaaagcttcgaactgt

SEQ ID NO: 183652 - DNA, 20 bp, Artificial
  CRISPR gRNA sequence
aaagcttcgaactgtaggca

SEQ ID NO: 183653 - DNA, 20 bp, Artificial
  CRISPR gRNA sequence
cgaactgtaggcatggccga

SEQ ID NO: 183654 - DNA, 20 bp, Artificial
  CRISPR gRNA sequence
aactgtaggcatggccgaca

SEQ ID NO: 183655 - DNA, 20 bp, Artificial
  CRISPR gRNA sequence
catggccgacagagcctcaa

SEQ ID NO: 183656 - DNA, 20 bp, Artificial
  CRISPR gRNA sequence
acagagcctcaatggccacc

SEQ ID NO: 183657 - DNA, 20 bp, Artificial
  CRISPR gRNA sequence
agcctcaatggccacctggc

SEQ ID NO: 183658 - DNA, 20 bp, Artificial
  CRISPR gRNA sequence
gccacctggctggactttgc

SEQ ID NO: 183659 - DNA, 20 bp, Artificial
  CRISPR gRNA sequence
cacctggctggactttgcca

SEQ ID NO: 183660 - DNA, 20 bp, Artificial
  CRISPR gRNA sequence
gattcccgcacctgcacttc

SEQ ID NO: 183661 - DNA, 20 bp, Artificial
  CRISPR gRNA sequence
acctgcacttccagcaactg

SEQ ID NO: 183662 - DNA, 20 bp, Artificial
  CRISPR gRNA sequence
ttccagcaactgtggataca

SEQ ID NO: 183663 - DNA, 20 bp, Artificial
  CRISPR gRNA sequence
gcaactgtggatacatggac

SEQ ID NO: 183664 - DNA, 20 bp, Artificial
  CRISPR gRNA sequence
aactgtggatacatggacaa

SEQ ID NO: 183665 - DNA, 20 bp, Artificial
  CRISPR gRNA sequence
catggacaagagatgtcaca

SEQ ID NO: 183666 - DNA, 20 bp, Artificial
  CRISPR gRNA sequence
atggacaagagatgtcacac

SEQ ID NO: 183667 - DNA, 20 bp, Artificial
  CRISPR gRNA sequence
acaagagatgtcacacgggt

SEQ ID NO: 183668 - DNA, 20 bp, Artificial
  CRISPR gRNA sequence
cacacgggttggcaaaccat

SEQ ID NO: 183669 - DNA, 20 bp, Artificial
  CRISPR gRNA sequence
acacgggttggcaaaccatc

SEQ ID NO: 183670 - DNA, 20 bp, Artificial
  CRISPR gRNA sequence
cacgggttggcaaaccatca

SEQ ID NO: 183671 - DNA, 20 bp, Artificial
  CRISPR gRNA sequence
catcagggacactaatacct

SEQ ID NO: 183672 - DNA, 20 bp, Artificial
  CRISPR gRNA sequence
taatacctgagttacctatt

SEQ ID NO: 183673 - DNA, 20 bp, Artificial
  CRISPR gRNA sequence
agttacctatttggaaatta

SEQ ID NO: 183674 - DNA, 20 bp, Artificial
  CRISPR gRNA sequence
gttacctatttggaaattaa

SEQ ID NO: 183675 - DNA, 20 bp, Artificial
  CRISPR gRNA sequence
cctatttggaaattaaaggt

SEQ ID NO: 183676 - DNA, 20 bp, Artificial
  CRISPR gRNA sequence
atttggaaattaaaggtgag

SEQ ID NO: 183677 - DNA, 20 bp, Artificial
  CRISPR gRNA sequence
ttggaaattaaaggtgagaa

SEQ ID NO: 183678 - DNA, 20 bp, Artificial
  CRISPR gRNA sequence
aaattaaaggtgagaagaga

SEQ ID NO: 183679 - DNA, 20 bp, Artificial
  CRISPR gRNA sequence
attaaaggtgagaagagaca

SEQ ID NO: 183680 - DNA, 20 bp, Artificial
  CRISPR gRNA sequence
ttaaaggtgagaagagacag

SEQ ID NO: 183681 - DNA, 20 bp, Artificial
  CRISPR gRNA sequence
ggtgagaagagacagaggaa

SEQ ID NO: 183682 - DNA, 20 bp, Artificial
  CRISPR gRNA sequence
gtgagaagagacagaggaaa

SEQ ID NO: 183683 - DNA, 20 bp, Artificial
  CRISPR gRNA sequence
gagaagagacagaggaaaag

SEQ ID NO: 183684 - DNA, 20 bp, Artificial
  CRISPR gRNA sequence
gagacagaggaaaaggagaa

SEQ ID NO: 183685 - DNA, 20 bp, Artificial
  CRISPR gRNA sequence
gacagaggaaaaggagaaaa

SEQ ID NO: 183686 - DNA, 20 bp, Artificial
  CRISPR gRNA sequence
gaggaaaaggagaaaagaga

SEQ ID NO: 183687 - DNA, 20 bp, Artificial
  CRISPR gRNA sequence
ggaaaaggagaaaagagaaa

SEQ ID NO: 183688 - DNA, 20 bp, Artificial
  CRISPR gRNA sequence
ggagaaaagagaaagagaca

SEQ ID NO: 183689 - DNA, 20 bp, Artificial
  CRISPR gRNA sequence
agagacacagctatgcccct

SEQ ID NO: 183690 - DNA, 20 bp, Artificial
  CRISPR gRNA sequence
gctatgccccttggatgcta

SEQ ID NO: 183691 - DNA, 20 bp, Artificial
  CRISPR gRNA sequence
cttggatgctaaagaaatac

SEQ ID NO: 183692 - DNA, 20 bp, Artificial
  CRISPR gRNA sequence
ttggatgctaaagaaatacg

SEQ ID NO: 183693 - DNA, 20 bp, Artificial
  CRISPR gRNA sequence
gatgctaaagaaatacgagg

SEQ ID NO: 183694 - DNA, 20 bp, Artificial
  CRISPR gRNA sequence
tgctaaagaaatacgaggaa

SEQ ID NO: 183695 - DNA, 20 bp, Artificial
  CRISPR gRNA sequence
gctaaagaaatacgaggaag

SEQ ID NO: 183696 - DNA, 20 bp, Artificial
  CRISPR gRNA sequence
cgaggaagaggaaaatgact

SEQ ID NO: 183697 - DNA, 20 bp, Artificial
  CRISPR gRNA sequence
aagaggaaaatgactcagaa

SEQ ID NO: 183698 - DNA, 20 bp, Artificial
  CRISPR gRNA sequence
agaggaaaatgactcagaac

SEQ ID NO: 183699 - DNA, 20 bp, Artificial
  CRISPR gRNA sequence
gaaaatgactcagaacgggt

SEQ ID NO: 183700 - DNA, 20 bp, Artificial
  CRISPR gRNA sequence
aaaatgactcagaacgggtt

SEQ ID NO: 183701 - DNA, 20 bp, Artificial
  CRISPR gRNA sequence
aaatgactcagaacgggttg

SEQ ID NO: 183702 - DNA, 20 bp, Artificial
  CRISPR gRNA sequence
ggttggggatcaaattctta

SEQ ID NO: 183703 - DNA, 20 bp, Artificial
  CRISPR gRNA sequence
ggggatcaaattcttaaaga

SEQ ID NO: 183704 - DNA, 20 bp, Artificial
  CRISPR gRNA sequence
aaattcttaaagacagattg

SEQ ID NO: 183705 - DNA, 20 bp, Artificial
  CRISPR gRNA sequence
aattcttaaagacagattgt

SEQ ID NO: 183706 - DNA, 20 bp, Artificial
  CRISPR gRNA sequence
attcttaaagacagattgtg

SEQ ID NO: 183707 - DNA, 20 bp, Artificial
  CRISPR gRNA sequence
tcttaaagacagattgtggg

SEQ ID NO: 183708 - DNA, 20 bp, Artificial
  CRISPR gRNA sequence
taaagacagattgtggggag

SEQ ID NO: 183709 - DNA, 20 bp, Artificial
  CRISPR gRNA sequence
gacagattgtggggagaagc

SEQ ID NO: 183710 - DNA, 20 bp, Artificial
  CRISPR gRNA sequence
attgtggggagaagctagaa

SEQ ID NO: 183711 - DNA, 20 bp, Artificial
  CRISPR gRNA sequence
gtggggagaagctagaaaag

SEQ ID NO: 183712 - DNA, 20 bp, Artificial
  CRISPR gRNA sequence
agaagctagaaaagaagacc

SEQ ID NO: 183713 - DNA, 20 bp, Artificial
  CRISPR gRNA sequence
aagctagaaaagaagaccca

SEQ ID NO: 183714 - DNA, 20 bp, Artificial
  CRISPR gRNA sequence
gctagaaaagaagacccaga

SEQ ID NO: 183715 - DNA, 20 bp, Artificial
  CRISPR gRNA sequence
aaaagaagacccagagagta

SEQ ID NO: 183716 - DNA, 20 bp, Artificial
  CRISPR gRNA sequence
aagaagacccagagagtatg

SEQ ID NO: 183717 - DNA, 20 bp, Artificial
  CRISPR gRNA sequence
agaagacccagagagtatgg

SEQ ID NO: 183718 - DNA, 20 bp, Artificial
  CRISPR gRNA sequence
agagtatggaggttaatgtt

SEQ ID NO: 183719 - DNA, 20 bp, Artificial
  CRISPR gRNA sequence
gaggttaatgttgagcaacc

SEQ ID NO: 183720 - DNA, 20 bp, Artificial
  CRISPR gRNA sequence
aggttaatgttgagcaacct

SEQ ID NO: 183721 - DNA, 20 bp, Artificial
  CRISPR gRNA sequence
tgttgagcaacctgggaaca

SEQ ID NO: 183722 - DNA, 20 bp, Artificial
  CRISPR gRNA sequence
caacctgggaacatggacca

SEQ ID NO: 183723 - DNA, 20 bp, Artificial
  CRISPR gRNA sequence
aacctgggaacatggaccac

SEQ ID NO: 183724 - DNA, 20 bp, Artificial
  CRISPR gRNA sequence
acctgggaacatggaccaca

SEQ ID NO: 183725 - DNA, 20 bp, Artificial
  CRISPR gRNA sequence
gggaacatggaccacaggga

SEQ ID NO: 183726 - DNA, 20 bp, Artificial
  CRISPR gRNA sequence
ggaacatggaccacagggac

SEQ ID NO: 183727 - DNA, 20 bp, Artificial
  CRISPR gRNA sequence
gaacatggaccacagggaca

SEQ ID NO: 183728 - DNA, 20 bp, Artificial
  CRISPR gRNA sequence
cagggacagggtgttccatg

SEQ ID NO: 183729 - DNA, 20 bp, Artificial
  CRISPR gRNA sequence
gacagggtgttccatgaaga

SEQ ID NO: 183730 - DNA, 20 bp, Artificial
  CRISPR gRNA sequence
cagggtgttccatgaagatg

SEQ ID NO: 183731 - DNA, 20 bp, Artificial
  CRISPR gRNA sequence
gttccatgaagatggagaat

SEQ ID NO: 183732 - DNA, 20 bp, Artificial
  CRISPR gRNA sequence
catgaagatggagaatcagt

SEQ ID NO: 183733 - DNA, 20 bp, Artificial
  CRISPR gRNA sequence
atgaagatggagaatcagta

SEQ ID NO: 183734 - DNA, 20 bp, Artificial
  CRISPR gRNA sequence
tgaagatggagaatcagtaa

SEQ ID NO: 183735 - DNA, 20 bp, Artificial
  CRISPR gRNA sequence
tggagaatcagtaagggtgc

SEQ ID NO: 183736 - DNA, 20 bp, Artificial
  CRISPR gRNA sequence
ggagaatcagtaagggtgcc

SEQ ID NO: 183737 - DNA, 20 bp, Artificial
  CRISPR gRNA sequence
aatcagtaagggtgccagga

SEQ ID NO: 183738 - DNA, 20 bp, Artificial
  CRISPR gRNA sequence
agtaagggtgccaggaaagc

SEQ ID NO: 183739 - DNA, 20 bp, Artificial
  CRISPR gRNA sequence
tgccaggaaagctggactga

SEQ ID NO: 183740 - DNA, 20 bp, Artificial
  CRISPR gRNA sequence
agctggactgaaagcaatgt

SEQ ID NO: 183741 - DNA, 20 bp, Artificial
  CRISPR gRNA sequence
ctggactgaaagcaatgtga

SEQ ID NO: 183742 - DNA, 20 bp, Artificial
  CRISPR gRNA sequence
tggactgaaagcaatgtgag

SEQ ID NO: 183743 - DNA, 20 bp, Artificial
  CRISPR gRNA sequence
aaagcaatgtgagaggaact

SEQ ID NO: 183744 - DNA, 20 bp, Artificial
  CRISPR gRNA sequence
tgagaggaactgagtctgcc

SEQ ID NO: 183745 - DNA, 20 bp, Artificial
  CRISPR gRNA sequence
ggaactgagtctgccaagtc

SEQ ID NO: 183746 - DNA, 20 bp, Artificial
  CRISPR gRNA sequence
gaactgagtctgccaagtct

SEQ ID NO: 183747 - DNA, 20 bp, Artificial
  CRISPR gRNA sequence
actgagtctgccaagtctgg

SEQ ID NO: 183748 - DNA, 20 bp, Artificial
  CRISPR gRNA sequence
gtctgccaagtctgggagat

SEQ ID NO: 183749 - DNA, 20 bp, Artificial
  CRISPR gRNA sequence
tctgccaagtctgggagatg

SEQ ID NO: 183750 - DNA, 20 bp, Artificial
  CRISPR gRNA sequence
ctgccaagtctgggagatga

SEQ ID NO: 183751 - DNA, 20 bp, Artificial
  CRISPR gRNA sequence
ctgggagatgagggtctgtg

SEQ ID NO: 183752 - DNA, 20 bp, Artificial
  CRISPR gRNA sequence
gggagatgagggtctgtgta

SEQ ID NO: 183753 - DNA, 20 bp, Artificial
  CRISPR gRNA sequence
agatgagggtctgtgtagag

SEQ ID NO: 183754 - DNA, 20 bp, Artificial
  CRISPR gRNA sequence
gatgagggtctgtgtagagc

SEQ ID NO: 183755 - DNA, 20 bp, Artificial
  CRISPR gRNA sequence
gccaactccatgaacatacc

SEQ ID NO: 183756 - DNA, 20 bp, Artificial
  CRISPR gRNA sequence
gtaccattttcccaccttct

SEQ ID NO: 183757 - DNA, 20 bp, Artificial
  CRISPR gRNA sequence
taccattttcccaccttctt

SEQ ID NO: 183758 - DNA, 20 bp, Artificial
  CRISPR gRNA sequence
cattttcccaccttcttggg

SEQ ID NO: 183759 - DNA, 20 bp, Artificial
  CRISPR gRNA sequence
tttcccaccttcttgggcag

SEQ ID NO: 183760 - DNA, 20 bp, Artificial
  CRISPR gRNA sequence
ttcccaccttcttgggcaga

SEQ ID NO: 183761 - DNA, 20 bp, Artificial
  CRISPR gRNA sequence
accttcttgggcagaaggaa

SEQ ID NO: 183762 - DNA, 20 bp, Artificial
  CRISPR gRNA sequence
ttcttgggcagaaggaaaag

SEQ ID NO: 183763 - DNA, 20 bp, Artificial
  CRISPR gRNA sequence
cttgggcagaaggaaaagca

SEQ ID NO: 183764 - DNA, 20 bp, Artificial
  CRISPR gRNA sequence
ttgggcagaaggaaaagcag

SEQ ID NO: 183765 - DNA, 20 bp, Artificial
  CRISPR gRNA sequence
ggcagaaggaaaagcagagg

SEQ ID NO: 183766 - DNA, 20 bp, Artificial
  CRISPR gRNA sequence
gcagaaggaaaagcagaggc

SEQ ID NO: 183767 - DNA, 20 bp, Artificial
  CRISPR gRNA sequence
cagaaggaaaagcagaggca

SEQ ID NO: 183768 - DNA, 20 bp, Artificial
  CRISPR gRNA sequence
aaaagcagaggcagggtgat

SEQ ID NO: 183769 - DNA, 20 bp, Artificial
  CRISPR gRNA sequence
aaagcagaggcagggtgatc

SEQ ID NO: 183770 - DNA, 20 bp, Artificial
  CRISPR gRNA sequence
aagcagaggcagggtgatca

SEQ ID NO: 183771 - DNA, 20 bp, Artificial
  CRISPR gRNA sequence
cagggtgatcagggtgacca

SEQ ID NO: 183772 - DNA, 20 bp, Artificial
  CRISPR gRNA sequence
gtgatcagggtgaccatggt

SEQ ID NO: 183773 - DNA, 20 bp, Artificial
  CRISPR gRNA sequence
tgatcagggtgaccatggtg

SEQ ID NO: 183774 - DNA, 20 bp, Artificial
  CRISPR gRNA sequence
gatcagggtgaccatggtga

SEQ ID NO: 183775 - DNA, 20 bp, Artificial
  CRISPR gRNA sequence
tggtgagggacactgatccc

SEQ ID NO: 183776 - DNA, 20 bp, Artificial
  CRISPR gRNA sequence
gtgagggacactgatcccca

SEQ ID NO: 183777 - DNA, 20 bp, Artificial
  CRISPR gRNA sequence
atccccagagcatgatcccc

SEQ ID NO: 183778 - DNA, 20 bp, Artificial
  CRISPR gRNA sequence
ccccagagcatgatccccaa

SEQ ID NO: 183779 - DNA, 20 bp, Artificial
  CRISPR gRNA sequence
agcatgatccccaagagaca

SEQ ID NO: 183780 - DNA, 20 bp, Artificial
  CRISPR gRNA sequence
gcatgatccccaagagacat

SEQ ID NO: 183781 - DNA, 20 bp, Artificial
  CRISPR gRNA sequence
aagagacataggcctcgcac

SEQ ID NO: 183782 - DNA, 20 bp, Artificial
  CRISPR gRNA sequence
agagacataggcctcgcacc

SEQ ID NO: 183783 - DNA, 20 bp, Artificial
  CRISPR gRNA sequence
aggcctcgcaccaggtacca

SEQ ID NO: 183784 - DNA, 20 bp, Artificial
  CRISPR gRNA sequence
gcaccaggtaccacagaaat

SEQ ID NO: 183785 - DNA, 20 bp, Artificial
  CRISPR gRNA sequence
aggtaccacagaaataagct

SEQ ID NO: 183786 - DNA, 20 bp, Artificial
  CRISPR gRNA sequence
aataagctcagattctcact

SEQ ID NO: 183787 - DNA, 20 bp, Artificial
  CRISPR gRNA sequence
taagctcagattctcactca

SEQ ID NO: 183788 - DNA, 20 bp, Artificial
  CRISPR gRNA sequence
ttctcactcagagaatcact

SEQ ID NO: 183789 - DNA, 20 bp, Artificial
  CRISPR gRNA sequence
tctcactcagagaatcactc

SEQ ID NO: 183790 - DNA, 20 bp, Artificial
  CRISPR gRNA sequence
ctcactcagagaatcactca

SEQ ID NO: 183791 - DNA, 20 bp, Artificial
  CRISPR gRNA sequence
actcagagaatcactcaggg

SEQ ID NO: 183792 - DNA, 20 bp, Artificial
  CRISPR gRNA sequence
ggacgtgtcctctgttaccc

SEQ ID NO: 183793 - DNA, 20 bp, Artificial
  CRISPR gRNA sequence
ccgagacatgatgttacctg

SEQ ID NO: 183794 - DNA, 20 bp, Artificial
  CRISPR gRNA sequence
cgagacatgatgttacctgc

SEQ ID NO: 183795 - DNA, 20 bp, Artificial
  CRISPR gRNA sequence
gagacatgatgttacctgca

SEQ ID NO: 183796 - DNA, 20 bp, Artificial
  CRISPR gRNA sequence
catgatgttacctgcagggt

SEQ ID NO: 183797 - DNA, 20 bp, Artificial
  CRISPR gRNA sequence
atgatgttacctgcagggtt

SEQ ID NO: 183798 - DNA, 20 bp, Artificial
  CRISPR gRNA sequence
tgatgttacctgcagggttg

SEQ ID NO: 183799 - DNA, 20 bp, Artificial
  CRISPR gRNA sequence
atgttacctgcagggttggg

SEQ ID NO: 183800 - DNA, 20 bp, Artificial
  CRISPR gRNA sequence
ttacctgcagggttggggag

SEQ ID NO: 183801 - DNA, 20 bp, Artificial
  CRISPR gRNA sequence
acctgcagggttggggagaa

SEQ ID NO: 183802 - DNA, 20 bp, Artificial
  CRISPR gRNA sequence
ctgcagggttggggagaaga

SEQ ID NO: 183803 - DNA, 20 bp, Artificial
  CRISPR gRNA sequence
agggttggggagaagagagt

SEQ ID NO: 183804 - DNA, 20 bp, Artificial
  CRISPR gRNA sequence
gggttggggagaagagagtg

SEQ ID NO: 183805 - DNA, 20 bp, Artificial
  CRISPR gRNA sequence
gagaagagagtgaggtgaat

SEQ ID NO: 183806 - DNA, 20 bp, Artificial
  CRISPR gRNA sequence
agagagtgaggtgaatcaga

SEQ ID NO: 183807 - DNA, 20 bp, Artificial
  CRISPR gRNA sequence
gagagtgaggtgaatcagac

SEQ ID NO: 183808 - DNA, 20 bp, Artificial
  CRISPR gRNA sequence
aggtgaatcagacaggttcc

SEQ ID NO: 183809 - DNA, 20 bp, Artificial
  CRISPR gRNA sequence
tcagacaggttccaagtgat

SEQ ID NO: 183810 - DNA, 20 bp, Artificial
  CRISPR gRNA sequence
tgatgagacgaactaacaat

SEQ ID NO: 183811 - DNA, 20 bp, Artificial
  CRISPR gRNA sequence
gagacgaactaacaatgagc

SEQ ID NO: 183812 - DNA, 20 bp, Artificial
  CRISPR gRNA sequence
agacgaactaacaatgagcc

SEQ ID NO: 183813 - DNA, 20 bp, Artificial
  CRISPR gRNA sequence
ctaacaatgagccaggatgc

SEQ ID NO: 183814 - DNA, 20 bp, Artificial
  CRISPR gRNA sequence
taacaatgagccaggatgcc

SEQ ID NO: 183815 - DNA, 20 bp, Artificial
  CRISPR gRNA sequence
aacaatgagccaggatgcca

SEQ ID NO: 183816 - DNA, 20 bp, Artificial
  CRISPR gRNA sequence
atgagccaggatgccagggt

SEQ ID NO: 183817 - DNA, 20 bp, Artificial
  CRISPR gRNA sequence
tgagccaggatgccagggtc

SEQ ID NO: 183818 - DNA, 20 bp, Artificial
  CRISPR gRNA sequence
gagccaggatgccagggtca

SEQ ID NO: 183819 - DNA, 20 bp, Artificial
  CRISPR gRNA sequence
agccaggatgccagggtcag

SEQ ID NO: 183820 - DNA, 20 bp, Artificial
  CRISPR gRNA sequence
cagggtcaggggtgtcaaca

SEQ ID NO: 183821 - DNA, 20 bp, Artificial
  CRISPR gRNA sequence
agggtcaggggtgtcaacat

SEQ ID NO: 183822 - DNA, 20 bp, Artificial
  CRISPR gRNA sequence
gggtcaggggtgtcaacatg

SEQ ID NO: 183823 - DNA, 20 bp, Artificial
  CRISPR gRNA sequence
gggtgtcaacatggggttct

SEQ ID NO: 183824 - DNA, 20 bp, Artificial
  CRISPR gRNA sequence
ggtgtcaacatggggttcta

SEQ ID NO: 183825 - DNA, 20 bp, Artificial
  CRISPR gRNA sequence
tgtcaacatggggttctaag

SEQ ID NO: 183826 - DNA, 20 bp, Artificial
  CRISPR gRNA sequence
gtcaacatggggttctaagg

SEQ ID NO: 183827 - DNA, 20 bp, Artificial
  CRISPR gRNA sequence
atggggttctaaggaggctg

SEQ ID NO: 183828 - DNA, 20 bp, Artificial
  CRISPR gRNA sequence
tggggttctaaggaggctgc

SEQ ID NO: 183829 - DNA, 20 bp, Artificial
  CRISPR gRNA sequence
ctaaggaggctgcaggaaac

SEQ ID NO: 183830 - DNA, 20 bp, Artificial
  CRISPR gRNA sequence
taaggaggctgcaggaaaca

SEQ ID NO: 183831 - DNA, 20 bp, Artificial
  CRISPR gRNA sequence
gaggctgcaggaaacaaggt

SEQ ID NO: 183832 - DNA, 20 bp, Artificial
  CRISPR gRNA sequence
aggctgcaggaaacaaggtt

SEQ ID NO: 183833 - DNA, 20 bp, Artificial
  CRISPR gRNA sequence
ggctgcaggaaacaaggtta

SEQ ID NO: 183834 - DNA, 20 bp, Artificial
  CRISPR gRNA sequence
gaaacaaggttagggttctc

SEQ ID NO: 183835 - DNA, 20 bp, Artificial
  CRISPR gRNA sequence
aacaaggttagggttctcca

SEQ ID NO: 183836 - DNA, 20 bp, Artificial
  CRISPR gRNA sequence
acaaggttagggttctccag

SEQ ID NO: 183837 - DNA, 20 bp, Artificial
  CRISPR gRNA sequence
ctccagaggtctgcaaatct

SEQ ID NO: 183838 - DNA, 20 bp, Artificial
  CRISPR gRNA sequence
gaggtctgcaaatctcagtg

SEQ ID NO: 183839 - DNA, 20 bp, Artificial
  CRISPR gRNA sequence
aggtctgcaaatctcagtgc

SEQ ID NO: 183840 - DNA, 20 bp, Artificial
  CRISPR gRNA sequence
ggtctgcaaatctcagtgca

SEQ ID NO: 183841 - DNA, 20 bp, Artificial
  CRISPR gRNA sequence
ctgcaaatctcagtgcaggg

SEQ ID NO: 183842 - DNA, 20 bp, Artificial
  CRISPR gRNA sequence
aatctcagtgcagggaagat

SEQ ID NO: 183843 - DNA, 20 bp, Artificial
  CRISPR gRNA sequence
tgcagggaagatgagtgtta

SEQ ID NO: 183844 - DNA, 20 bp, Artificial
  CRISPR gRNA sequence
cagggaagatgagtgttaaa

SEQ ID NO: 183845 - DNA, 20 bp, Artificial
  CRISPR gRNA sequence
agggaagatgagtgttaaag

SEQ ID NO: 183846 - DNA, 20 bp, Artificial
  CRISPR gRNA sequence
aagatgagtgttaaagagga

SEQ ID NO: 183847 - DNA, 20 bp, Artificial
  CRISPR gRNA sequence
agatgagtgttaaagaggaa

SEQ ID NO: 183848 - DNA, 20 bp, Artificial
  CRISPR gRNA sequence
tgaccttcattttaattata

SEQ ID NO: 183849 - DNA, 20 bp, Artificial
  CRISPR gRNA sequence
gtgaatttccattttcctga

SEQ ID NO: 183850 - DNA, 20 bp, Artificial
  CRISPR gRNA sequence
cctgaaagctttctgttccc

SEQ ID NO: 183851 - DNA, 20 bp, Artificial
  CRISPR gRNA sequence
tgaaagctttctgttcccta

SEQ ID NO: 183852 - DNA, 20 bp, Artificial
  CRISPR gRNA sequence
tatgtcccatgctatacaca

SEQ ID NO: 183853 - DNA, 20 bp, Artificial
  CRISPR gRNA sequence
atgtcccatgctatacacac

SEQ ID NO: 183854 - DNA, 20 bp, Artificial
  CRISPR gRNA sequence
tcccatgctatacacacagg

SEQ ID NO: 183855 - DNA, 20 bp, Artificial
  CRISPR gRNA sequence
cccatgctatacacacaggc

SEQ ID NO: 183856 - DNA, 20 bp, Artificial
  CRISPR gRNA sequence
atgctatacacacaggcagg

SEQ ID NO: 183857 - DNA, 20 bp, Artificial
  CRISPR gRNA sequence
gctatacacacaggcaggaa

SEQ ID NO: 183858 - DNA, 20 bp, Artificial
  CRISPR gRNA sequence
caggcaggaagagcttaaac

SEQ ID NO: 183859 - DNA, 20 bp, Artificial
  CRISPR gRNA sequence
agcttaaactggtcacataa

SEQ ID NO: 183860 - DNA, 20 bp, Artificial
  CRISPR gRNA sequence
cttaaactggtcacataaca

SEQ ID NO: 183861 - DNA, 20 bp, Artificial
  CRISPR gRNA sequence
aactggtcacataacagaga

SEQ ID NO: 183862 - DNA, 20 bp, Artificial
  CRISPR gRNA sequence
ctggtcacataacagagatg

SEQ ID NO: 183863 - DNA, 20 bp, Artificial
  CRISPR gRNA sequence
tggtcacataacagagatgg

SEQ ID NO: 183864 - DNA, 20 bp, Artificial
  CRISPR gRNA sequence
gtcacataacagagatggag

SEQ ID NO: 183865 - DNA, 20 bp, Artificial
  CRISPR gRNA sequence
tcacataacagagatggagg

SEQ ID NO: 183866 - DNA, 20 bp, Artificial
  CRISPR gRNA sequence
acataacagagatggaggag

SEQ ID NO: 183867 - DNA, 20 bp, Artificial
  CRISPR gRNA sequence
cataacagagatggaggagg

SEQ ID NO: 183868 - DNA, 20 bp, Artificial
  CRISPR gRNA sequence
ataacagagatggaggagga

SEQ ID NO: 183869 - DNA, 20 bp, Artificial
  CRISPR gRNA sequence
atggaggaggagggtgctgc

SEQ ID NO: 183870 - DNA, 20 bp, Artificial
  CRISPR gRNA sequence
tggaggaggagggtgctgct

SEQ ID NO: 183871 - DNA, 20 bp, Artificial
  CRISPR gRNA sequence
aggaggagggtgctgctagg

SEQ ID NO: 183872 - DNA, 20 bp, Artificial
  CRISPR gRNA sequence
tgctgctaggaagcatgcca

SEQ ID NO: 183873 - DNA, 20 bp, Artificial
  CRISPR gRNA sequence
aggaagcatgccaaagtctg

SEQ ID NO: 183874 - DNA, 20 bp, Artificial
  CRISPR gRNA sequence
gaagcatgccaaagtctgtg

SEQ ID NO: 183875 - DNA, 20 bp, Artificial
  CRISPR gRNA sequence
aaagtctgtggagcactcac

SEQ ID NO: 183876 - DNA, 20 bp, Artificial
  CRISPR gRNA sequence
aagtctgtggagcactcact

SEQ ID NO: 183877 - DNA, 20 bp, Artificial
  CRISPR gRNA sequence
tgtggagcactcactgggac

SEQ ID NO: 183878 - DNA, 20 bp, Artificial
  CRISPR gRNA sequence
gtggagcactcactgggact

SEQ ID NO: 183879 - DNA, 20 bp, Artificial
  CRISPR gRNA sequence
tggagcactcactgggacta

SEQ ID NO: 183880 - DNA, 20 bp, Artificial
  CRISPR gRNA sequence
tgggactagggttctaaccc

SEQ ID NO: 183881 - DNA, 20 bp, Artificial
  CRISPR gRNA sequence
gggactagggttctaacccc

SEQ ID NO: 183882 - DNA, 20 bp, Artificial
  CRISPR gRNA sequence
tctaaccccaggtctatctc

SEQ ID NO: 183883 - DNA, 20 bp, Artificial
  CRISPR gRNA sequence
tctagccatatgtaactgta

SEQ ID NO: 183884 - DNA, 20 bp, Artificial
  CRISPR gRNA sequence
atatgtaactgtacagcttc

SEQ ID NO: 183885 - DNA, 20 bp, Artificial
  CRISPR gRNA sequence
tgtacagcttctagtgctgc

SEQ ID NO: 183886 - DNA, 20 bp, Artificial
  CRISPR gRNA sequence
cagcttctagtgctgctaga

SEQ ID NO: 183887 - DNA, 20 bp, Artificial
  CRISPR gRNA sequence
tgctgctagaaagcatgccg

SEQ ID NO: 183888 - DNA, 20 bp, Artificial
  CRISPR gRNA sequence
agaaagcatgccgaagtctg

SEQ ID NO: 183889 - DNA, 20 bp, Artificial
  CRISPR gRNA sequence
aaagcatgccgaagtctgtg

SEQ ID NO: 183890 - DNA, 20 bp, Artificial
  CRISPR gRNA sequence
ccgaagtctgtggagcactc

SEQ ID NO: 183891 - DNA, 20 bp, Artificial
  CRISPR gRNA sequence
gaagtctgtggagcactcaa

SEQ ID NO: 183892 - DNA, 20 bp, Artificial
  CRISPR gRNA sequence
ctgtggagcactcaagagac

SEQ ID NO: 183893 - DNA, 20 bp, Artificial
  CRISPR gRNA sequence
tgtggagcactcaagagacc

SEQ ID NO: 183894 - DNA, 20 bp, Artificial
  CRISPR gRNA sequence
gtggagcactcaagagacca

SEQ ID NO: 183895 - DNA, 20 bp, Artificial
  CRISPR gRNA sequence
gagaccagggttctaacccc

SEQ ID NO: 183896 - DNA, 20 bp, Artificial
  CRISPR gRNA sequence
tctaaccccaagtgtgtctc

SEQ ID NO: 183897 - DNA, 20 bp, Artificial
  CRISPR gRNA sequence
tctagccatatgtaactgtg

SEQ ID NO: 183898 - DNA, 20 bp, Artificial
  CRISPR gRNA sequence
catatgtaactgtgcagttt

SEQ ID NO: 183899 - DNA, 20 bp, Artificial
  CRISPR gRNA sequence
aactgtgcagtttcagcatt

SEQ ID NO: 183900 - DNA, 20 bp, Artificial
  CRISPR gRNA sequence
actgtgcagtttcagcattt

SEQ ID NO: 183901 - DNA, 20 bp, Artificial
  CRISPR gRNA sequence
ctgtgcagtttcagcattta

SEQ ID NO: 183902 - DNA, 20 bp, Artificial
  CRISPR gRNA sequence
agtttcagcatttagggtct

SEQ ID NO: 183903 - DNA, 20 bp, Artificial
  CRISPR gRNA sequence
agcatttagggtcttggcct

SEQ ID NO: 183904 - DNA, 20 bp, Artificial
  CRISPR gRNA sequence
gcctcagtttccttctctgt

SEQ ID NO: 183905 - DNA, 20 bp, Artificial
  CRISPR gRNA sequence
agtttccttctctgtcagat

SEQ ID NO: 183906 - DNA, 20 bp, Artificial
  CRISPR gRNA sequence
gtttccttctctgtcagatg

SEQ ID NO: 183907 - DNA, 20 bp, Artificial
  CRISPR gRNA sequence
tccttctctgtcagatgagg

SEQ ID NO: 183908 - DNA, 20 bp, Artificial
  CRISPR gRNA sequence
tctctgtcagatgaggcagt

SEQ ID NO: 183909 - DNA, 20 bp, Artificial
  CRISPR gRNA sequence
atgaggcagttggtctctat

SEQ ID NO: 183910 - DNA, 20 bp, Artificial
  CRISPR gRNA sequence
ctctatgagctcaaaatttc

SEQ ID NO: 183911 - DNA, 20 bp, Artificial
  CRISPR gRNA sequence
tctatgagctcaaaatttcc

SEQ ID NO: 183912 - DNA, 20 bp, Artificial
  CRISPR gRNA sequence
tttccaggtttgaaattcta

SEQ ID NO: 183913 - DNA, 20 bp, Artificial
  CRISPR gRNA sequence
aaattctatggtttctatct

SEQ ID NO: 183914 - DNA, 20 bp, Artificial
  CRISPR gRNA sequence
aattctatggtttctatcta

SEQ ID NO: 183915 - DNA, 20 bp, Artificial
  CRISPR gRNA sequence
ggtttctatctaaggataca

SEQ ID NO: 183916 - DNA, 20 bp, Artificial
  CRISPR gRNA sequence
gtttctatctaaggatacat

SEQ ID NO: 183917 - DNA, 20 bp, Artificial
  CRISPR gRNA sequence
tatctaaggatacataggaa

SEQ ID NO: 183918 - DNA, 20 bp, Artificial
  CRISPR gRNA sequence
atacataggaatagatttat

SEQ ID NO: 183919 - DNA, 20 bp, Artificial
  CRISPR gRNA sequence
atagatttataagaaaatgc

SEQ ID NO: 183920 - DNA, 20 bp, Artificial
  CRISPR gRNA sequence
aaaatgctagatgaaaactc

SEQ ID NO: 183921 - DNA, 20 bp, Artificial
  CRISPR gRNA sequence
aaatgctagatgaaaactct

SEQ ID NO: 183922 - DNA, 20 bp, Artificial
  CRISPR gRNA sequence
gaaaactctaggtttttctt

SEQ ID NO: 183923 - DNA, 20 bp, Artificial
  CRISPR gRNA sequence
aaaactctaggtttttctta

SEQ ID NO: 183924 - DNA, 20 bp, Artificial
  CRISPR gRNA sequence
ctctaggtttttcttaaggt

SEQ ID NO: 183925 - DNA, 20 bp, Artificial
  CRISPR gRNA sequence
tctaggtttttcttaaggta

SEQ ID NO: 183926 - DNA, 20 bp, Artificial
  CRISPR gRNA sequence
taggtttttcttaaggtaag

SEQ ID NO: 183927 - DNA, 20 bp, Artificial
  CRISPR gRNA sequence
aggtttttcttaaggtaagg

SEQ ID NO: 183928 - DNA, 20 bp, Artificial
  CRISPR gRNA sequence
gaggacaatattttgctcct

SEQ ID NO: 183929 - DNA, 20 bp, Artificial
  CRISPR gRNA sequence
aggacaatattttgctcctg

SEQ ID NO: 183930 - DNA, 20 bp, Artificial
  CRISPR gRNA sequence
ttttgctcctgaggtatatc

SEQ ID NO: 183931 - DNA, 20 bp, Artificial
  CRISPR gRNA sequence
tcctgaggtatatcaagaat

SEQ ID NO: 183932 - DNA, 20 bp, Artificial
  CRISPR gRNA sequence
aattgtgtgtgtgtgtgtgt

SEQ ID NO: 183933 - DNA, 20 bp, Artificial
  CRISPR gRNA sequence
ttgtgtgtgtgtgtgtgtga

SEQ ID NO: 183934 - DNA, 20 bp, Artificial
  CRISPR gRNA sequence
gtgtgtgtgtgtgtgtgaga

SEQ ID NO: 183935 - DNA, 20 bp, Artificial
  CRISPR gRNA sequence
gtgtgtgtgtgtgtgagaga

SEQ ID NO: 183936 - DNA, 20 bp, Artificial
  CRISPR gRNA sequence
gtgtgtgtgtgtgagagaga

SEQ ID NO: 183937 - DNA, 20 bp, Artificial
  CRISPR gRNA sequence
gtgtgtgtgtgagagagaga

SEQ ID NO: 183938 - DNA, 20 bp, Artificial
  CRISPR gRNA sequence
gtgtgtgtgagagagagaga

SEQ ID NO: 183939 - DNA, 20 bp, Artificial
  CRISPR gRNA sequence
gtgtgtgagagagagagaga

SEQ ID NO: 183940 - DNA, 20 bp, Artificial
  CRISPR gRNA sequence
gtgtgagagagagagagaga

SEQ ID NO: 183941 - DNA, 20 bp, Artificial
  CRISPR gRNA sequence
gagagagagagagagagaga

SEQ ID NO: 183942 - DNA, 20 bp, Artificial
  CRISPR gRNA sequence
gagagagagagagagagaca

SEQ ID NO: 183943 - DNA, 20 bp, Artificial
  CRISPR gRNA sequence
gagagagagagagacagaga

SEQ ID NO: 183944 - DNA, 20 bp, Artificial
  CRISPR gRNA sequence
gagagagagagacagagaca

SEQ ID NO: 183945 - DNA, 20 bp, Artificial
  CRISPR gRNA sequence
gagagagagacagagacaga

SEQ ID NO: 183946 - DNA, 20 bp, Artificial
  CRISPR gRNA sequence
gagagagacagagacagaga

SEQ ID NO: 183947 - DNA, 20 bp, Artificial
  CRISPR gRNA sequence
gagagacagagacagagaga

SEQ ID NO: 183948 - DNA, 20 bp, Artificial
  CRISPR gRNA sequence
gagacagagacagagagaga

SEQ ID NO: 183949 - DNA, 20 bp, Artificial
  CRISPR gRNA sequence
cagagacagagagagagaga

SEQ ID NO: 183950 - DNA, 20 bp, Artificial
  CRISPR gRNA sequence
agagacagagagagagagac

SEQ ID NO: 183951 - DNA, 20 bp, Artificial
  CRISPR gRNA sequence
gagacagagagagagagaca

SEQ ID NO: 183952 - DNA, 20 bp, Artificial
  CRISPR gRNA sequence
gacagagagagagagacagg

SEQ ID NO: 183953 - DNA, 20 bp, Artificial
  CRISPR gRNA sequence
cagagagagagagacaggga

SEQ ID NO: 183954 - DNA, 20 bp, Artificial
  CRISPR gRNA sequence
agagagagagagacagggag

SEQ ID NO: 183955 - DNA, 20 bp, Artificial
  CRISPR gRNA sequence
gagagagagagacagggaga

SEQ ID NO: 183956 - DNA, 20 bp, Artificial
  CRISPR gRNA sequence
agacagggagagggtatatc

SEQ ID NO: 183957 - DNA, 20 bp, Artificial
  CRISPR gRNA sequence
ggagagggtatatcaagaat

SEQ ID NO: 183958 - DNA, 20 bp, Artificial
  CRISPR gRNA sequence
gagggtatatcaagaatgag

SEQ ID NO: 183959 - DNA, 20 bp, Artificial
  CRISPR gRNA sequence
agggtatatcaagaatgaga

SEQ ID NO: 183960 - DNA, 20 bp, Artificial
  CRISPR gRNA sequence
caatgtgtgtatgtgtgtgt

SEQ ID NO: 183961 - DNA, 20 bp, Artificial
  CRISPR gRNA sequence
atgtgtgtatgtgtgtgtga

SEQ ID NO: 183962 - DNA, 20 bp, Artificial
  CRISPR gRNA sequence
gtgtgtatgtgtgtgtgaga

SEQ ID NO: 183963 - DNA, 20 bp, Artificial
  CRISPR gRNA sequence
gtgtatgtgtgtgtgagaga

SEQ ID NO: 183964 - DNA, 20 bp, Artificial
  CRISPR gRNA sequence
gtatgtgtgtgtgagagaga

SEQ ID NO: 183965 - DNA, 20 bp, Artificial
  CRISPR gRNA sequence
atgtgtgtgtgagagagaga

SEQ ID NO: 183966 - DNA, 20 bp, Artificial
  CRISPR gRNA sequence
tgtgtgtgagagagagagag

SEQ ID NO: 183967 - DNA, 20 bp, Artificial
  CRISPR gRNA sequence
gtgtgtgagagagagagagc

SEQ ID NO: 183968 - DNA, 20 bp, Artificial
  CRISPR gRNA sequence
tgtgtgagagagagagagcg

SEQ ID NO: 183969 - DNA, 20 bp, Artificial
  CRISPR gRNA sequence
tgtgagagagagagagcggg

SEQ ID NO: 183970 - DNA, 20 bp, Artificial
  CRISPR gRNA sequence
gtgagagagagagagcgggg

SEQ ID NO: 183971 - DNA, 20 bp, Artificial
  CRISPR gRNA sequence
tgagagagagagagcgggga

SEQ ID NO: 183972 - DNA, 20 bp, Artificial
  CRISPR gRNA sequence
gagagagagagagcggggag

SEQ ID NO: 183973 - DNA, 20 bp, Artificial
  CRISPR gRNA sequence
agagagagagagcggggagg

SEQ ID NO: 183974 - DNA, 20 bp, Artificial
  CRISPR gRNA sequence
gagagagagagcggggaggg

SEQ ID NO: 183975 - DNA, 20 bp, Artificial
  CRISPR gRNA sequence
gagagagagcggggaggggg

SEQ ID NO: 183976 - DNA, 20 bp, Artificial
  CRISPR gRNA sequence
agcggggaggggggagatca

SEQ ID NO: 183977 - DNA, 20 bp, Artificial
  CRISPR gRNA sequence
ggggaggggggagatcaaag

SEQ ID NO: 183978 - DNA, 20 bp, Artificial
  CRISPR gRNA sequence
ggagatcaaagcagatgtat

SEQ ID NO: 183979 - DNA, 20 bp, Artificial
  CRISPR gRNA sequence
gagatcaaagcagatgtatg

SEQ ID NO: 183980 - DNA, 20 bp, Artificial
  CRISPR gRNA sequence
cagatgtatgaggatatgaa

SEQ ID NO: 183981 - DNA, 20 bp, Artificial
  CRISPR gRNA sequence
atgaggatatgaacagtaca

SEQ ID NO: 183982 - DNA, 20 bp, Artificial
  CRISPR gRNA sequence
cagtacatggcgtataatga

SEQ ID NO: 183983 - DNA, 20 bp, Artificial
  CRISPR gRNA sequence
gtacatggcgtataatgaaa

SEQ ID NO: 183984 - DNA, 20 bp, Artificial
  CRISPR gRNA sequence
ggcgtataatgaaagagttt

SEQ ID NO: 183985 - DNA, 20 bp, Artificial
  CRISPR gRNA sequence
gcgtataatgaaagagtttc

SEQ ID NO: 183986 - DNA, 20 bp, Artificial
  CRISPR gRNA sequence
gtataatgaaagagtttcag

SEQ ID NO: 183987 - DNA, 20 bp, Artificial
  CRISPR gRNA sequence
agtttcaggagaaacctgtc

SEQ ID NO: 183988 - DNA, 20 bp, Artificial
  CRISPR gRNA sequence
agaaacctgtctggttctgt

SEQ ID NO: 183989 - DNA, 20 bp, Artificial
  CRISPR gRNA sequence
gttggaaaaactccgtctcc

SEQ ID NO: 183990 - DNA, 20 bp, Artificial
  CRISPR gRNA sequence
aaaaactccgtctcctggcg

SEQ ID NO: 183991 - DNA, 20 bp, Artificial
  CRISPR gRNA sequence
aaaactccgtctcctggcgc

SEQ ID NO: 183992 - DNA, 20 bp, Artificial
  CRISPR gRNA sequence
ctccgtctcctggcgcagga

SEQ ID NO: 183993 - DNA, 20 bp, Artificial
  CRISPR gRNA sequence
ccccaaacacctctccctgc

SEQ ID NO: 183994 - DNA, 20 bp, Artificial
  CRISPR gRNA sequence
caaacacctctccctgcaag

SEQ ID NO: 183995 - DNA, 20 bp, Artificial
  CRISPR gRNA sequence
cctgcaagtggctgtgcacg

SEQ ID NO: 183996 - DNA, 20 bp, Artificial
  CRISPR gRNA sequence
gtggctgtgcacgtggccca

SEQ ID NO: 183997 - DNA, 20 bp, Artificial
  CRISPR gRNA sequence
cgtggcccatggtgttgtta

SEQ ID NO: 183998 - DNA, 20 bp, Artificial
  CRISPR gRNA sequence
atcccgtcacccacgaactc

SEQ ID NO: 183999 - DNA, 20 bp, Artificial
  CRISPR gRNA sequence
aactccagcactgcactata

SEQ ID NO: 184000 - DNA, 20 bp, Artificial
  CRISPR gRNA sequence
gcactgcactataaagaacc

SEQ ID NO: 184001 - DNA, 20 bp, Artificial
  CRISPR gRNA sequence
ctataaagaacccggaaaaa

SEQ ID NO: 184002 - DNA, 20 bp, Artificial
  CRISPR gRNA sequence
tataaagaacccggaaaaaa

SEQ ID NO: 184003 - DNA, 20 bp, Artificial
  CRISPR gRNA sequence
ataaagaacccggaaaaaaa

SEQ ID NO: 184004 - DNA, 20 bp, Artificial
  CRISPR gRNA sequence
taaagaacccggaaaaaaag

SEQ ID NO: 184005 - DNA, 20 bp, Artificial
  CRISPR gRNA sequence
aacccggaaaaaaaggggat

SEQ ID NO: 184006 - DNA, 20 bp, Artificial
  CRISPR gRNA sequence
acccggaaaaaaaggggatc

SEQ ID NO: 184007 - DNA, 20 bp, Artificial
  CRISPR gRNA sequence
cccggaaaaaaaggggatca

SEQ ID NO: 184008 - DNA, 20 bp, Artificial
  CRISPR gRNA sequence
aaaggggatcagggtgtgtt

SEQ ID NO: 184009 - DNA, 20 bp, Artificial
  CRISPR gRNA sequence
aaggggatcagggtgtgttc

SEQ ID NO: 184010 - DNA, 20 bp, Artificial
  CRISPR gRNA sequence
aggggatcagggtgtgttca

SEQ ID NO: 184011 - DNA, 20 bp, Artificial
  CRISPR gRNA sequence
atcagggtgtgttcagggaa

SEQ ID NO: 184012 - DNA, 20 bp, Artificial
  CRISPR gRNA sequence
tgtgttcagggaacagactg

SEQ ID NO: 184013 - DNA, 20 bp, Artificial
  CRISPR gRNA sequence
gtgttcagggaacagactga

SEQ ID NO: 184014 - DNA, 20 bp, Artificial
  CRISPR gRNA sequence
agggaacagactgaaggtcc

SEQ ID NO: 184015 - DNA, 20 bp, Artificial
  CRISPR gRNA sequence
gggaacagactgaaggtccc

SEQ ID NO: 184016 - DNA, 20 bp, Artificial
  CRISPR gRNA sequence
ggtcccaggtatccccatat

SEQ ID NO: 184017 - DNA, 20 bp, Artificial
  CRISPR gRNA sequence
atccccatataagtgcattt

SEQ ID NO: 184018 - DNA, 20 bp, Artificial
  CRISPR gRNA sequence
ccatataagtgcatttcgga

SEQ ID NO: 184019 - DNA, 20 bp, Artificial
  CRISPR gRNA sequence
tataagtgcatttcggacag

SEQ ID NO: 184020 - DNA, 20 bp, Artificial
  CRISPR gRNA sequence
acttccaactccctcatttg

SEQ ID NO: 184021 - DNA, 20 bp, Artificial
  CRISPR gRNA sequence
cttccaactccctcatttgc

SEQ ID NO: 184022 - DNA, 20 bp, Artificial
  CRISPR gRNA sequence
ttccaactccctcatttgca

SEQ ID NO: 184023 - DNA, 20 bp, Artificial
  CRISPR gRNA sequence
tttgcagggtgccccatttt

SEQ ID NO: 184024 - DNA, 20 bp, Artificial
  CRISPR gRNA sequence
ggtgccccattttcagcccc

SEQ ID NO: 184025 - DNA, 20 bp, Artificial
  CRISPR gRNA sequence
ccattttcagcccccagacc

SEQ ID NO: 184026 - DNA, 20 bp, Artificial
  CRISPR gRNA sequence
tcagcccccagacctggcta

SEQ ID NO: 184027 - DNA, 20 bp, Artificial
  CRISPR gRNA sequence
cccccagacctggctatggt

SEQ ID NO: 184028 - DNA, 20 bp, Artificial
  CRISPR gRNA sequence
agacctggctatggtgagaa

SEQ ID NO: 184029 - DNA, 20 bp, Artificial
  CRISPR gRNA sequence
gctatggtgagaatggacat

SEQ ID NO: 184030 - DNA, 20 bp, Artificial
  CRISPR gRNA sequence
tatggtgagaatggacatga

SEQ ID NO: 184031 - DNA, 20 bp, Artificial
  CRISPR gRNA sequence
tgagaatggacatgagagtt

SEQ ID NO: 184032 - DNA, 20 bp, Artificial
  CRISPR gRNA sequence
ggacatgagagttaagtttc

SEQ ID NO: 184033 - DNA, 20 bp, Artificial
  CRISPR gRNA sequence
tgagagttaagtttcgagtg

SEQ ID NO: 184034 - DNA, 20 bp, Artificial
  CRISPR gRNA sequence
gagagttaagtttcgagtga

SEQ ID NO: 184035 - DNA, 20 bp, Artificial
  CRISPR gRNA sequence
taagtttcgagtgaaggtat

SEQ ID NO: 184036 - DNA, 20 bp, Artificial
  CRISPR gRNA sequence
ttcgagtgaaggtatcggct

SEQ ID NO: 184037 - DNA, 20 bp, Artificial
  CRISPR gRNA sequence
gtatcggctgagccatcttg

SEQ ID NO: 184038 - DNA, 20 bp, Artificial
  CRISPR gRNA sequence
ctgagccatcttgtagaatc

SEQ ID NO: 184039 - DNA, 20 bp, Artificial
  CRISPR gRNA sequence
gccatcttgtagaatccagt

SEQ ID NO: 184040 - DNA, 20 bp, Artificial
  CRISPR gRNA sequence
tcttgtagaatccagtcagt

SEQ ID NO: 184041 - DNA, 20 bp, Artificial
  CRISPR gRNA sequence
cttgtagaatccagtcagtg

SEQ ID NO: 184042 - DNA, 20 bp, Artificial
  CRISPR gRNA sequence
gtagaatccagtcagtgagg

SEQ ID NO: 184043 - DNA, 20 bp, Artificial
  CRISPR gRNA sequence
agtcagtgaggcggcccgta

SEQ ID NO: 184044 - DNA, 20 bp, Artificial
  CRISPR gRNA sequence
gtgaggcggcccgtaaagaa

SEQ ID NO: 184045 - DNA, 20 bp, Artificial
  CRISPR gRNA sequence
gcggcccgtaaagaatggaa

SEQ ID NO: 184046 - DNA, 20 bp, Artificial
  CRISPR gRNA sequence
aatggaatggccatctcccc

SEQ ID NO: 184047 - DNA, 20 bp, Artificial
  CRISPR gRNA sequence
tggaatggccatctcccctg

SEQ ID NO: 184048 - DNA, 20 bp, Artificial
  CRISPR gRNA sequence
atggccatctcccctggaga

SEQ ID NO: 184049 - DNA, 20 bp, Artificial
  CRISPR gRNA sequence
ggccatctcccctggagaaa

SEQ ID NO: 184050 - DNA, 20 bp, Artificial
  CRISPR gRNA sequence
catctcccctggagaaagag

SEQ ID NO: 184051 - DNA, 20 bp, Artificial
  CRISPR gRNA sequence
tctcccctggagaaagagaa

SEQ ID NO: 184052 - DNA, 20 bp, Artificial
  CRISPR gRNA sequence
tcccctggagaaagagaaga

SEQ ID NO: 184053 - DNA, 20 bp, Artificial
  CRISPR gRNA sequence
cccctggagaaagagaagag

SEQ ID NO: 184054 - DNA, 20 bp, Artificial
  CRISPR gRNA sequence
agaggtcacgcacaaatatt

SEQ ID NO: 184055 - DNA, 20 bp, Artificial
  CRISPR gRNA sequence
cacgcacaaatattaagtct

SEQ ID NO: 184056 - DNA, 20 bp, Artificial
  CRISPR gRNA sequence
gcacaaatattaagtctaag

SEQ ID NO: 184057 - DNA, 20 bp, Artificial
  CRISPR gRNA sequence
cacaaatattaagtctaagt

SEQ ID NO: 184058 - DNA, 20 bp, Artificial
  CRISPR gRNA sequence
aatattaagtctaagtaggt

SEQ ID NO: 184059 - DNA, 20 bp, Artificial
  CRISPR gRNA sequence
aagtctaagtaggtcagttc

SEQ ID NO: 184060 - DNA, 20 bp, Artificial
  CRISPR gRNA sequence
ctaagtaggtcagttccagt

SEQ ID NO: 184061 - DNA, 20 bp, Artificial
  CRISPR gRNA sequence
taggtcagttccagtcagac

SEQ ID NO: 184062 - DNA, 20 bp, Artificial
  CRISPR gRNA sequence
cctccccctcaccattatcc

SEQ ID NO: 184063 - DNA, 20 bp, Artificial
  CRISPR gRNA sequence
tccccctcaccattatcctg

SEQ ID NO: 184064 - DNA, 20 bp, Artificial
  CRISPR gRNA sequence
ccccctcaccattatcctgg

SEQ ID NO: 184065 - DNA, 20 bp, Artificial
  CRISPR gRNA sequence
cccctcaccattatcctgga

SEQ ID NO: 184066 - DNA, 20 bp, Artificial
  CRISPR gRNA sequence
accattatcctggagggcat

SEQ ID NO: 184067 - DNA, 20 bp, Artificial
  CRISPR gRNA sequence
attatcctggagggcatcag

SEQ ID NO: 184068 - DNA, 20 bp, Artificial
  CRISPR gRNA sequence
tcctggagggcatcagcaga

SEQ ID NO: 184069 - DNA, 20 bp, Artificial
  CRISPR gRNA sequence
cctggagggcatcagcagaa

SEQ ID NO: 184070 - DNA, 20 bp, Artificial
  CRISPR gRNA sequence
gtctcaatcccgaacctaaa

SEQ ID NO: 184071 - DNA, 20 bp, Artificial
  CRISPR gRNA sequence
tctcaatcccgaacctaaat

SEQ ID NO: 184072 - DNA, 20 bp, Artificial
  CRISPR gRNA sequence
cgaacctaaataggctgccc

SEQ ID NO: 184073 - DNA, 20 bp, Artificial
  CRISPR gRNA sequence
ccctggaactcactaccctg

SEQ ID NO: 184074 - DNA, 20 bp, Artificial
  CRISPR gRNA sequence
ctaccctgtggttgctctac

SEQ ID NO: 184075 - DNA, 20 bp, Artificial
  CRISPR gRNA sequence
ggttgctctaccagaacttt

SEQ ID NO: 184076 - DNA, 20 bp, Artificial
  CRISPR gRNA sequence
gttgctctaccagaactttc

SEQ ID NO: 184077 - DNA, 20 bp, Artificial
  CRISPR gRNA sequence
cagaactttcaggattttat

SEQ ID NO: 184078 - DNA, 20 bp, Artificial
  CRISPR gRNA sequence
agaactttcaggattttatt

SEQ ID NO: 184079 - DNA, 20 bp, Artificial
  CRISPR gRNA sequence
actttcaggattttattagg

SEQ ID NO: 184080 - DNA, 20 bp, Artificial
  CRISPR gRNA sequence
ctttcaggattttattagga

SEQ ID NO: 184081 - DNA, 20 bp, Artificial
  CRISPR gRNA sequence
caggattttattaggaaggc

SEQ ID NO: 184082 - DNA, 20 bp, Artificial
  CRISPR gRNA sequence
ggattttattaggaaggctg

SEQ ID NO: 184083 - DNA, 20 bp, Artificial
  CRISPR gRNA sequence
taggaaggctggagatcatg

SEQ ID NO: 184084 - DNA, 20 bp, Artificial
  CRISPR gRNA sequence
gaaggctggagatcatgaag

SEQ ID NO: 184085 - DNA, 20 bp, Artificial
  CRISPR gRNA sequence
ctggagatcatgaagtagaa

SEQ ID NO: 184086 - DNA, 20 bp, Artificial
  CRISPR gRNA sequence
gaagtagaaaagcctcctgt

SEQ ID NO: 184087 - DNA, 20 bp, Artificial
  CRISPR gRNA sequence
agtagaaaagcctcctgtta

SEQ ID NO: 184088 - DNA, 20 bp, Artificial
  CRISPR gRNA sequence
aaaagcctcctgttagagat

SEQ ID NO: 184089 - DNA, 20 bp, Artificial
  CRISPR gRNA sequence
aaagcctcctgttagagatg

SEQ ID NO: 184090 - DNA, 20 bp, Artificial
  CRISPR gRNA sequence
gatgaggatgccccgccctt

SEQ ID NO: 184091 - DNA, 20 bp, Artificial
  CRISPR gRNA sequence
gatgccccgcccttcggccc

SEQ ID NO: 184092 - DNA, 20 bp, Artificial
  CRISPR gRNA sequence
tgccccgcccttcggcccca

SEQ ID NO: 184093 - DNA, 20 bp, Artificial
  CRISPR gRNA sequence
cgcccttcggccccagagca

SEQ ID NO: 184094 - DNA, 20 bp, Artificial
  CRISPR gRNA sequence
gcccttcggccccagagcaa

SEQ ID NO: 184095 - DNA, 20 bp, Artificial
  CRISPR gRNA sequence
gcaaaggatttccccgcttc

SEQ ID NO: 184096 - DNA, 20 bp, Artificial
  CRISPR gRNA sequence
ggatttccccgcttccggcg

SEQ ID NO: 184097 - DNA, 20 bp, Artificial
  CRISPR gRNA sequence
cccgcttccggcgtggccca

SEQ ID NO: 184098 - DNA, 20 bp, Artificial
  CRISPR gRNA sequence
ccggcgtggcccaaagaatc

SEQ ID NO: 184099 - DNA, 20 bp, Artificial
  CRISPR gRNA sequence
tggcccaaagaatcaagacc

SEQ ID NO: 184100 - DNA, 20 bp, Artificial
  CRISPR gRNA sequence
ccaaagaatcaagacccggt

SEQ ID NO: 184101 - DNA, 20 bp, Artificial
  CRISPR gRNA sequence
aatcaagacccggtcagcaa

SEQ ID NO: 184102 - DNA, 20 bp, Artificial
  CRISPR gRNA sequence
tcaagacccggtcagcaatg

SEQ ID NO: 184103 - DNA, 20 bp, Artificial
  CRISPR gRNA sequence
acccggtcagcaatggagcc

SEQ ID NO: 184104 - DNA, 20 bp, Artificial
  CRISPR gRNA sequence
gcaatggagcccagaacctc

SEQ ID NO: 184105 - DNA, 20 bp, Artificial
  CRISPR gRNA sequence
ccagaacctctggcccccgc

SEQ ID NO: 184106 - DNA, 20 bp, Artificial
  CRISPR gRNA sequence
acctctggcccccgccagtc

SEQ ID NO: 184107 - DNA, 20 bp, Artificial
  CRISPR gRNA sequence
gtgccgtttcttctacaccg

SEQ ID NO: 184108 - DNA, 20 bp, Artificial
  CRISPR gRNA sequence
ccgtttcttctacaccgaag

SEQ ID NO: 184109 - DNA, 20 bp, Artificial
  CRISPR gRNA sequence
ctacaccgaagtggtgttcc

SEQ ID NO: 184110 - DNA, 20 bp, Artificial
  CRISPR gRNA sequence
tggtgttccaagacccacgc

SEQ ID NO: 184111 - DNA, 20 bp, Artificial
  CRISPR gRNA sequence
ggtgttccaagacccacgct

SEQ ID NO: 184112 - DNA, 20 bp, Artificial
  CRISPR gRNA sequence
tgttccaagacccacgctag

SEQ ID NO: 184113 - DNA, 20 bp, Artificial
  CRISPR gRNA sequence
ttctcctgctccacatttcc

SEQ ID NO: 184114 - DNA, 20 bp, Artificial
  CRISPR gRNA sequence
attacctttgattcctgtcc

SEQ ID NO: 184115 - DNA, 20 bp, Artificial
  CRISPR gRNA sequence
tgccctgcgttccccttacc

SEQ ID NO: 184116 - DNA, 20 bp, Artificial
  CRISPR gRNA sequence
ccctgcgttccccttaccaa

SEQ ID NO: 184117 - DNA, 20 bp, Artificial
  CRISPR gRNA sequence
ctgcgttccccttaccaaga

SEQ ID NO: 184118 - DNA, 20 bp, Artificial
  CRISPR gRNA sequence
tgcgttccccttaccaagag

SEQ ID NO: 184119 - DNA, 20 bp, Artificial
  CRISPR gRNA sequence
cgttccccttaccaagagag

SEQ ID NO: 184120 - DNA, 20 bp, Artificial
  CRISPR gRNA sequence
ttccccttaccaagagagga

SEQ ID NO: 184121 - DNA, 20 bp, Artificial
  CRISPR gRNA sequence
tccccttaccaagagaggag

SEQ ID NO: 184122 - DNA, 20 bp, Artificial
  CRISPR gRNA sequence
ccaagagaggagaggaccac

SEQ ID NO: 184123 - DNA, 20 bp, Artificial
  CRISPR gRNA sequence
caagagaggagaggaccacc

SEQ ID NO: 184124 - DNA, 20 bp, Artificial
  CRISPR gRNA sequence
gaggagaggaccaccaggac

SEQ ID NO: 184125 - DNA, 20 bp, Artificial
  CRISPR gRNA sequence
aggagaggaccaccaggacc

SEQ ID NO: 184126 - DNA, 20 bp, Artificial
  CRISPR gRNA sequence
aggaccaccaggaccaggaa

SEQ ID NO: 184127 - DNA, 20 bp, Artificial
  CRISPR gRNA sequence
ccaccaggaccaggaacagc

SEQ ID NO: 184128 - DNA, 20 bp, Artificial
  CRISPR gRNA sequence
accaggaccaggaacagcga

SEQ ID NO: 184129 - DNA, 20 bp, Artificial
  CRISPR gRNA sequence
ccaggaccaggaacagcgag

SEQ ID NO: 184130 - DNA, 20 bp, Artificial
  CRISPR gRNA sequence
ggaccaggaacagcgagagg

SEQ ID NO: 184131 - DNA, 20 bp, Artificial
  CRISPR gRNA sequence
gcgagaggcggcgcgtctcc

SEQ ID NO: 184132 - DNA, 20 bp, Artificial
  CRISPR gRNA sequence
aggcggcgcgtctccgagcc

SEQ ID NO: 184133 - DNA, 20 bp, Artificial
  CRISPR gRNA sequence
ggcggcgcgtctccgagccc

SEQ ID NO: 184134 - DNA, 20 bp, Artificial
  CRISPR gRNA sequence
ggcgcgtctccgagcccagg

SEQ ID NO: 184135 - DNA, 20 bp, Artificial
  CRISPR gRNA sequence
gtctccgagcccaggcagcc

SEQ ID NO: 184136 - DNA, 20 bp, Artificial
  CRISPR gRNA sequence
tccgagcccaggcagcctag

SEQ ID NO: 184137 - DNA, 20 bp, Artificial
  CRISPR gRNA sequence
gcagcctagaagccgacgca

SEQ ID NO: 184138 - DNA, 20 bp, Artificial
  CRISPR gRNA sequence
cagcctagaagccgacgcac

SEQ ID NO: 184139 - DNA, 20 bp, Artificial
  CRISPR gRNA sequence
agcctagaagccgacgcaca

SEQ ID NO: 184140 - DNA, 20 bp, Artificial
  CRISPR gRNA sequence
aagccgacgcacagggtttc

SEQ ID NO: 184141 - DNA, 20 bp, Artificial
  CRISPR gRNA sequence
gccgacgcacagggtttcca

SEQ ID NO: 184142 - DNA, 20 bp, Artificial
  CRISPR gRNA sequence
tccagagccgccctgaccgc

SEQ ID NO: 184143 - DNA, 20 bp, Artificial
  CRISPR gRNA sequence
ccagagccgccctgaccgcc

SEQ ID NO: 184144 - DNA, 20 bp, Artificial
  CRISPR gRNA sequence
cgccctgaccgccgggcacc

SEQ ID NO: 184145 - DNA, 20 bp, Artificial
  CRISPR gRNA sequence
ccctgaccgccgggcaccca

SEQ ID NO: 184146 - DNA, 20 bp, Artificial
  CRISPR gRNA sequence
cctgaccgccgggcacccag

SEQ ID NO: 184147 - DNA, 20 bp, Artificial
  CRISPR gRNA sequence
ccgggcacccagaggctccc

SEQ ID NO: 184148 - DNA, 20 bp, Artificial
  CRISPR gRNA sequence
aggctcccgagtttgtgcca

SEQ ID NO: 184149 - DNA, 20 bp, Artificial
  CRISPR gRNA sequence
ggctcccgagtttgtgccac

SEQ ID NO: 184150 - DNA, 20 bp, Artificial
  CRISPR gRNA sequence
gctcccgagtttgtgccaca

SEQ ID NO: 184151 - DNA, 20 bp, Artificial
  CRISPR gRNA sequence
tttgtgccacagggctgctg

SEQ ID NO: 184152 - DNA, 20 bp, Artificial
  CRISPR gRNA sequence
ttgtgccacagggctgctgc

SEQ ID NO: 184153 - DNA, 20 bp, Artificial
  CRISPR gRNA sequence
tgccacagggctgctgcggg

SEQ ID NO: 184154 - DNA, 20 bp, Artificial
  CRISPR gRNA sequence
ccgctgcataactgacaacg

SEQ ID NO: 184155 - DNA, 20 bp, Artificial
  CRISPR gRNA sequence
cgctgcataactgacaacga

SEQ ID NO: 184156 - DNA, 20 bp, Artificial
  CRISPR gRNA sequence
tgcataactgacaacgaagg

SEQ ID NO: 184157 - DNA, 20 bp, Artificial
  CRISPR gRNA sequence
ataactgacaacgaaggcgg

SEQ ID NO: 184158 - DNA, 20 bp, Artificial
  CRISPR gRNA sequence
taactgacaacgaaggcggt

SEQ ID NO: 184159 - DNA, 20 bp, Artificial
  CRISPR gRNA sequence
aactgacaacgaaggcggta

SEQ ID NO: 184160 - DNA, 20 bp, Artificial
  CRISPR gRNA sequence
aggcggtagggtgacttccc

SEQ ID NO: 184161 - DNA, 20 bp, Artificial
  CRISPR gRNA sequence
gtagggtgacttccccagtg

SEQ ID NO: 184162 - DNA, 20 bp, Artificial
  CRISPR gRNA sequence
gggtgacttccccagtgcag

SEQ ID NO: 184163 - DNA, 20 bp, Artificial
  CRISPR gRNA sequence
acttccccagtgcagtagcc

SEQ ID NO: 184164 - DNA, 20 bp, Artificial
  CRISPR gRNA sequence
cagtagcctggtgctatccg

SEQ ID NO: 184165 - DNA, 20 bp, Artificial
  CRISPR gRNA sequence
cctggtgctatccgcggacc

SEQ ID NO: 184166 - DNA, 20 bp, Artificial
  CRISPR gRNA sequence
ctggtgctatccgcggaccc

SEQ ID NO: 184167 - DNA, 20 bp, Artificial
  CRISPR gRNA sequence
tggtgctatccgcggacccg

SEQ ID NO: 184168 - DNA, 20 bp, Artificial
  CRISPR gRNA sequence
ggtgctatccgcggacccgg

SEQ ID NO: 184169 - DNA, 20 bp, Artificial
  CRISPR gRNA sequence
cggacccgggggctccccat

SEQ ID NO: 184170 - DNA, 20 bp, Artificial
  CRISPR gRNA sequence
ccgggggctccccatgagat

SEQ ID NO: 184171 - DNA, 20 bp, Artificial
  CRISPR gRNA sequence
ctccccatgagatcagctct

SEQ ID NO: 184172 - DNA, 20 bp, Artificial
  CRISPR gRNA sequence
atgagatcagctctcggaac

SEQ ID NO: 184173 - DNA, 20 bp, Artificial
  CRISPR gRNA sequence
tgagatcagctctcggaaca

SEQ ID NO: 184174 - DNA, 20 bp, Artificial
  CRISPR gRNA sequence
atcagctctcggaacaaggc

SEQ ID NO: 184175 - DNA, 20 bp, Artificial
  CRISPR gRNA sequence
tctcggaacaaggcaagtcc

SEQ ID NO: 184176 - DNA, 20 bp, Artificial
  CRISPR gRNA sequence
cggaacaaggcaagtcccgg

SEQ ID NO: 184177 - DNA, 20 bp, Artificial
  CRISPR gRNA sequence
ggaacaaggcaagtcccggc

SEQ ID NO: 184178 - DNA, 20 bp, Artificial
  CRISPR gRNA sequence
gaacaaggcaagtcccggca

SEQ ID NO: 184179 - DNA, 20 bp, Artificial
  CRISPR gRNA sequence
aggcaagtcccggcagggcc

SEQ ID NO: 184180 - DNA, 20 bp, Artificial
  CRISPR gRNA sequence
agtcccggcagggccaagcc

SEQ ID NO: 184181 - DNA, 20 bp, Artificial
  CRISPR gRNA sequence
cagggccaagcccagtgccg

SEQ ID NO: 184182 - DNA, 20 bp, Artificial
  CRISPR gRNA sequence
aagcccagtgccgcagctaa

SEQ ID NO: 184183 - DNA, 20 bp, Artificial
  CRISPR gRNA sequence
tgccgcagctaatggcttca

SEQ ID NO: 184184 - DNA, 20 bp, Artificial
  CRISPR gRNA sequence
cgcagctaatggcttcaaag

SEQ ID NO: 184185 - DNA, 20 bp, Artificial
  CRISPR gRNA sequence
gctaatggcttcaaagcagc

SEQ ID NO: 184186 - DNA, 20 bp, Artificial
  CRISPR gRNA sequence
atggcttcaaagcagccagc

SEQ ID NO: 184187 - DNA, 20 bp, Artificial
  CRISPR gRNA sequence
tcaaagcagccagccagccc

SEQ ID NO: 184188 - DNA, 20 bp, Artificial
  CRISPR gRNA sequence
caaagcagccagccagccct

SEQ ID NO: 184189 - DNA, 20 bp, Artificial
  CRISPR gRNA sequence
ggcacctgcgttttcgctct

SEQ ID NO: 184190 - DNA, 20 bp, Artificial
  CRISPR gRNA sequence
cacctgcgttttcgctcttg

SEQ ID NO: 184191 - DNA, 20 bp, Artificial
  CRISPR gRNA sequence
ttggagccaaccgttgccct

SEQ ID NO: 184192 - DNA, 20 bp, Artificial
  CRISPR gRNA sequence
tggagccaaccgttgccctg

SEQ ID NO: 184193 - DNA, 20 bp, Artificial
  CRISPR gRNA sequence
ccgttgccctgaggaccccg

SEQ ID NO: 184194 - DNA, 20 bp, Artificial
  CRISPR gRNA sequence
cgttgccctgaggaccccgc

SEQ ID NO: 184195 - DNA, 20 bp, Artificial
  CRISPR gRNA sequence
ctgaggaccccgcaggcccc

SEQ ID NO: 184196 - DNA, 20 bp, Artificial
  CRISPR gRNA sequence
ggaccccgcaggcccccagc

SEQ ID NO: 184197 - DNA, 20 bp, Artificial
  CRISPR gRNA sequence
accccgcaggcccccagcca

SEQ ID NO: 184198 - DNA, 20 bp, Artificial
  CRISPR gRNA sequence
gcaggcccccagccagagca

SEQ ID NO: 184199 - DNA, 20 bp, Artificial
  CRISPR gRNA sequence
cccccagccagagcacggcc

SEQ ID NO: 184200 - DNA, 20 bp, Artificial
  CRISPR gRNA sequence
ccagccagagcacggcccag

SEQ ID NO: 184201 - DNA, 20 bp, Artificial
  CRISPR gRNA sequence
cagagcacggcccagcggct

SEQ ID NO: 184202 - DNA, 20 bp, Artificial
  CRISPR gRNA sequence
agagcacggcccagcggctc

SEQ ID NO: 184203 - DNA, 20 bp, Artificial
  CRISPR gRNA sequence
agcggctcaggcccaccgcc

SEQ ID NO: 184204 - DNA, 20 bp, Artificial
  CRISPR gRNA sequence
tcaggcccaccgcccagacc

SEQ ID NO: 184205 - DNA, 20 bp, Artificial
  CRISPR gRNA sequence
aggcccaccgcccagacccg

SEQ ID NO: 184206 - DNA, 20 bp, Artificial
  CRISPR gRNA sequence
cccaccgcccagacccggag

SEQ ID NO: 184207 - DNA, 20 bp, Artificial
  CRISPR gRNA sequence
accgcccagacccggagcag

SEQ ID NO: 184208 - DNA, 20 bp, Artificial
  CRISPR gRNA sequence
gcccagacccggagcagtgg

SEQ ID NO: 184209 - DNA, 20 bp, Artificial
  CRISPR gRNA sequence
gacccggagcagtggcagcg

SEQ ID NO: 184210 - DNA, 20 bp, Artificial
  CRISPR gRNA sequence
ccggagcagtggcagcgcgg

SEQ ID NO: 184211 - DNA, 20 bp, Artificial
  CRISPR gRNA sequence
cggagcagtggcagcgcggt

SEQ ID NO: 184212 - DNA, 20 bp, Artificial
  CRISPR gRNA sequence
agtggcagcgcggtgggcac

SEQ ID NO: 184213 - DNA, 20 bp, Artificial
  CRISPR gRNA sequence
ggcagcgcggtgggcaccag

SEQ ID NO: 184214 - DNA, 20 bp, Artificial
  CRISPR gRNA sequence
gcagcgcggtgggcaccagc

SEQ ID NO: 184215 - DNA, 20 bp, Artificial
  CRISPR gRNA sequence
cagcgcggtgggcaccagca

SEQ ID NO: 184216 - DNA, 20 bp, Artificial
  CRISPR gRNA sequence
gcgcggtgggcaccagcagg

SEQ ID NO: 184217 - DNA, 20 bp, Artificial
  CRISPR gRNA sequence
gcaccagcagggagaatatg

SEQ ID NO: 184218 - DNA, 20 bp, Artificial
  CRISPR gRNA sequence
caccagcagggagaatatgc

SEQ ID NO: 184219 - DNA, 20 bp, Artificial
  CRISPR gRNA sequence
accagcagggagaatatgcg

SEQ ID NO: 184220 - DNA, 20 bp, Artificial
  CRISPR gRNA sequence
agcagggagaatatgcgggg

SEQ ID NO: 184221 - DNA, 20 bp, Artificial
  CRISPR gRNA sequence
ggagaatatgcggggcagcg

SEQ ID NO: 184222 - DNA, 20 bp, Artificial
  CRISPR gRNA sequence
atatgcggggcagcgcggtc

SEQ ID NO: 184223 - DNA, 20 bp, Artificial
  CRISPR gRNA sequence
atgcggggcagcgcggtccg

SEQ ID NO: 184224 - DNA, 20 bp, Artificial
  CRISPR gRNA sequence
cggggcagcgcggtccggag

SEQ ID NO: 184225 - DNA, 20 bp, Artificial
  CRISPR gRNA sequence
gcgcggtccggagcagcacc

SEQ ID NO: 184226 - DNA, 20 bp, Artificial
  CRISPR gRNA sequence
ggtccggagcagcacccagt

SEQ ID NO: 184227 - DNA, 20 bp, Artificial
  CRISPR gRNA sequence
cggagcagcacccagtcggc

SEQ ID NO: 184228 - DNA, 20 bp, Artificial
  CRISPR gRNA sequence
agcagcacccagtcggcgag

SEQ ID NO: 184229 - DNA, 20 bp, Artificial
  CRISPR gRNA sequence
agcacccagtcggcgagaag

SEQ ID NO: 184230 - DNA, 20 bp, Artificial
  CRISPR gRNA sequence
acccagtcggcgagaagtag

SEQ ID NO: 184231 - DNA, 20 bp, Artificial
  CRISPR gRNA sequence
agaagtagcagtactgtccc

SEQ ID NO: 184232 - DNA, 20 bp, Artificial
  CRISPR gRNA sequence
agtactgtccccagccatgc

SEQ ID NO: 184233 - DNA, 20 bp, Artificial
  CRISPR gRNA sequence
tactgtccccagccatgcga

SEQ ID NO: 184234 - DNA, 20 bp, Artificial
  CRISPR gRNA sequence
tgtccccagccatgcgagag

SEQ ID NO: 184235 - DNA, 20 bp, Artificial
  CRISPR gRNA sequence
cagccatgcgagagaagctc

SEQ ID NO: 184236 - DNA, 20 bp, Artificial
  CRISPR gRNA sequence
agccatgcgagagaagctcc

SEQ ID NO: 184237 - DNA, 20 bp, Artificial
  CRISPR gRNA sequence
gccatgcgagagaagctccg

SEQ ID NO: 184238 - DNA, 20 bp, Artificial
  CRISPR gRNA sequence
catgcgagagaagctccggg

SEQ ID NO: 184239 - DNA, 20 bp, Artificial
  CRISPR gRNA sequence
atgcgagagaagctccgggg

SEQ ID NO: 184240 - DNA, 20 bp, Artificial
  CRISPR gRNA sequence
cgagagaagctccggggagg

SEQ ID NO: 184241 - DNA, 20 bp, Artificial
  CRISPR gRNA sequence
gagaagctccggggaggcag

SEQ ID NO: 184242 - DNA, 20 bp, Artificial
  CRISPR gRNA sequence
cggggaggcagcggcacccg

SEQ ID NO: 184243 - DNA, 20 bp, Artificial
  CRISPR gRNA sequence
ggggaggcagcggcacccgc

SEQ ID NO: 184244 - DNA, 20 bp, Artificial
  CRISPR gRNA sequence
gggaggcagcggcacccgcg

SEQ ID NO: 184245 - DNA, 20 bp, Artificial
  CRISPR gRNA sequence
gaggcagcggcacccgcggg

SEQ ID NO: 184246 - DNA, 20 bp, Artificial
  CRISPR gRNA sequence
gcagcggcacccgcggggag

SEQ ID NO: 184247 - DNA, 20 bp, Artificial
  CRISPR gRNA sequence
cagcggcacccgcggggagc

SEQ ID NO: 184248 - DNA, 20 bp, Artificial
  CRISPR gRNA sequence
cccgcggggagcgggacacc

SEQ ID NO: 184249 - DNA, 20 bp, Artificial
  CRISPR gRNA sequence
cgcggggagcgggacaccta

SEQ ID NO: 184250 - DNA, 20 bp, Artificial
  CRISPR gRNA sequence
gggagcgggacacctagagc

SEQ ID NO: 184251 - DNA, 20 bp, Artificial
  CRISPR gRNA sequence
ggacacctagagctagccat

SEQ ID NO: 184252 - DNA, 20 bp, Artificial
  CRISPR gRNA sequence
tagagctagccattggcact

SEQ ID NO: 184253 - DNA, 20 bp, Artificial
  CRISPR gRNA sequence
ttggcactcggacgccgtcc

SEQ ID NO: 184254 - DNA, 20 bp, Artificial
  CRISPR gRNA sequence
ctcggacgccgtcccggtcc

SEQ ID NO: 184255 - DNA, 20 bp, Artificial
  CRISPR gRNA sequence
gacgccgtcccggtcccggc

SEQ ID NO: 184256 - DNA, 20 bp, Artificial
  CRISPR gRNA sequence
acgccgtcccggtcccggcc

SEQ ID NO: 184257 - DNA, 20 bp, Artificial
  CRISPR gRNA sequence
gtcccggtcccggccgggcc

SEQ ID NO: 184258 - DNA, 20 bp, Artificial
  CRISPR gRNA sequence
tcccggtcccggccgggcct

SEQ ID NO: 184259 - DNA, 20 bp, Artificial
  CRISPR gRNA sequence
gcctgggactctccgcgccc

SEQ ID NO: 184260 - DNA, 20 bp, Artificial
  CRISPR gRNA sequence
tgggactctccgcgccccgg

SEQ ID NO: 184261 - DNA, 20 bp, Artificial
  CRISPR gRNA sequence
gggactctccgcgccccggt

SEQ ID NO: 184262 - DNA, 20 bp, Artificial
  CRISPR gRNA sequence
ggactctccgcgccccggtg

SEQ ID NO: 184263 - DNA, 20 bp, Artificial
  CRISPR gRNA sequence
ccgcgccccggtggggcctg

SEQ ID NO: 184264 - DNA, 20 bp, Artificial
  CRISPR gRNA sequence
cccggtggggcctgaagctc

SEQ ID NO: 184265 - DNA, 20 bp, Artificial
  CRISPR gRNA sequence
ccggtggggcctgaagctcc

SEQ ID NO: 184266 - DNA, 20 bp, Artificial
  CRISPR gRNA sequence
ctgaagctccgggtaccgcc

SEQ ID NO: 184267 - DNA, 20 bp, Artificial
  CRISPR gRNA sequence
accgccgagtcctcccctac

SEQ ID NO: 184268 - DNA, 20 bp, Artificial
  CRISPR gRNA sequence
gccgagtcctcccctactgg

SEQ ID NO: 184269 - DNA, 20 bp, Artificial
  CRISPR gRNA sequence
agtcctcccctactggcggc

SEQ ID NO: 184270 - DNA, 20 bp, Artificial
  CRISPR gRNA sequence
gtcctcccctactggcggct

SEQ ID NO: 184271 - DNA, 20 bp, Artificial
  CRISPR gRNA sequence
tcctcccctactggcggctg

SEQ ID NO: 184272 - DNA, 20 bp, Artificial
  CRISPR gRNA sequence
cctcccctactggcggctgg

SEQ ID NO: 184273 - DNA, 20 bp, Artificial
  CRISPR gRNA sequence
tcccctactggcggctgggg

SEQ ID NO: 184274 - DNA, 20 bp, Artificial
  CRISPR gRNA sequence
cccctactggcggctggggg

SEQ ID NO: 184275 - DNA, 20 bp, Artificial
  CRISPR gRNA sequence
ccctactggcggctggggga

SEQ ID NO: 184276 - DNA, 20 bp, Artificial
  CRISPR gRNA sequence
tggcggctgggggagggaac

SEQ ID NO: 184277 - DNA, 20 bp, Artificial
  CRISPR gRNA sequence
ggcggctgggggagggaacg

SEQ ID NO: 184278 - DNA, 20 bp, Artificial
  CRISPR gRNA sequence
gcggctgggggagggaacga

SEQ ID NO: 184279 - DNA, 20 bp, Artificial
  CRISPR gRNA sequence
gctgggggagggaacgaggg

SEQ ID NO: 184280 - DNA, 20 bp, Artificial
  CRISPR gRNA sequence
ctgggggagggaacgagggc

SEQ ID NO: 184281 - DNA, 20 bp, Artificial
  CRISPR gRNA sequence
tgggggagggaacgagggcg

SEQ ID NO: 184282 - DNA, 20 bp, Artificial
  CRISPR gRNA sequence
gggaacgagggcggggctct

SEQ ID NO: 184283 - DNA, 20 bp, Artificial
  CRISPR gRNA sequence
acgagggcggggctctcgga

SEQ ID NO: 184284 - DNA, 20 bp, Artificial
  CRISPR gRNA sequence
gcggggctctcggaaagtcc

SEQ ID NO: 184285 - DNA, 20 bp, Artificial
  CRISPR gRNA sequence
cggggctctcggaaagtccc

SEQ ID NO: 184286 - DNA, 20 bp, Artificial
  CRISPR gRNA sequence
ctctcggaaagtcccaggaa

SEQ ID NO: 184287 - DNA, 20 bp, Artificial
  CRISPR gRNA sequence
tctcggaaagtcccaggaac

SEQ ID NO: 184288 - DNA, 20 bp, Artificial
  CRISPR gRNA sequence
ggaacaggctgatcctgcgc

SEQ ID NO: 184289 - DNA, 20 bp, Artificial
  CRISPR gRNA sequence
caggctgatcctgcgctggc

SEQ ID NO: 184290 - DNA, 20 bp, Artificial
  CRISPR gRNA sequence
gctgatcctgcgctggcgag

SEQ ID NO: 184291 - DNA, 20 bp, Artificial
  CRISPR gRNA sequence
tcctgcgctggcgagaagct

SEQ ID NO: 184292 - DNA, 20 bp, Artificial
  CRISPR gRNA sequence
tggcgagaagctcagccatt

SEQ ID NO: 184293 - DNA, 20 bp, Artificial
  CRISPR gRNA sequence
ggcgagaagctcagccattt

SEQ ID NO: 184294 - DNA, 20 bp, Artificial
  CRISPR gRNA sequence
gcgagaagctcagccattta

SEQ ID NO: 184295 - DNA, 20 bp, Artificial
  CRISPR gRNA sequence
cgagaagctcagccatttag

SEQ ID NO: 184296 - DNA, 20 bp, Artificial
  CRISPR gRNA sequence
aagctcagccatttagggga

SEQ ID NO: 184297 - DNA, 20 bp, Artificial
  CRISPR gRNA sequence
ttaggggaaagcgaaatcga

SEQ ID NO: 184298 - DNA, 20 bp, Artificial
  CRISPR gRNA sequence
ggggaaagcgaaatcgaaag

SEQ ID NO: 184299 - DNA, 20 bp, Artificial
  CRISPR gRNA sequence
gaaagcggccgcctgctcac

SEQ ID NO: 184300 - DNA, 20 bp, Artificial
  CRISPR gRNA sequence
tagataacgcctacttccaa

SEQ ID NO: 184301 - DNA, 20 bp, Artificial
  CRISPR gRNA sequence
ataacgcctacttccaaaag

SEQ ID NO: 184302 - DNA, 20 bp, Artificial
  CRISPR gRNA sequence
acttccaaaagtggcctgcc

SEQ ID NO: 184303 - DNA, 20 bp, Artificial
  CRISPR gRNA sequence
gtggcctgcccagactattt

SEQ ID NO: 184304 - DNA, 20 bp, Artificial
  CRISPR gRNA sequence
gcctgcccagactattttgg

SEQ ID NO: 184305 - DNA, 20 bp, Artificial
  CRISPR gRNA sequence
gcccagactattttggtagc

SEQ ID NO: 184306 - DNA, 20 bp, Artificial
  CRISPR gRNA sequence
gactattttggtagcaagcg

SEQ ID NO: 184307 - DNA, 20 bp, Artificial
  CRISPR gRNA sequence
ttccacgcttgctaccaaaa

SEQ ID NO: 184308 - DNA, 20 bp, Artificial
  CRISPR gRNA sequence
cgcttgctaccaaaatagtc

SEQ ID NO: 184309 - DNA, 20 bp, Artificial
  CRISPR gRNA sequence
gcttgctaccaaaatagtct

SEQ ID NO: 184310 - DNA, 20 bp, Artificial
  CRISPR gRNA sequence
tgctaccaaaatagtctggg

SEQ ID NO: 184311 - DNA, 20 bp, Artificial
  CRISPR gRNA sequence
gctaccaaaatagtctgggc

SEQ ID NO: 184312 - DNA, 20 bp, Artificial
  CRISPR gRNA sequence
tagtctgggcaggccacttt

SEQ ID NO: 184313 - DNA, 20 bp, Artificial
  CRISPR gRNA sequence
tctgggcaggccacttttgg

SEQ ID NO: 184314 - DNA, 20 bp, Artificial
  CRISPR gRNA sequence
gggcaggccacttttggaag

SEQ ID NO: 184315 - DNA, 20 bp, Artificial
  CRISPR gRNA sequence
ggcaggccacttttggaagt

SEQ ID NO: 184316 - DNA, 20 bp, Artificial
  CRISPR gRNA sequence
ttttggaagtaggcgttatc

SEQ ID NO: 184317 - DNA, 20 bp, Artificial
  CRISPR gRNA sequence
ggaagtaggcgttatctagt

SEQ ID NO: 184318 - DNA, 20 bp, Artificial
  CRISPR gRNA sequence
agtaggcgttatctagtgag

SEQ ID NO: 184319 - DNA, 20 bp, Artificial
  CRISPR gRNA sequence
gtaggcgttatctagtgagc

SEQ ID NO: 184320 - DNA, 20 bp, Artificial
  CRISPR gRNA sequence
ggcgttatctagtgagcagg

SEQ ID NO: 184321 - DNA, 20 bp, Artificial
  CRISPR gRNA sequence
cgatttcgctttcccctaaa

SEQ ID NO: 184322 - DNA, 20 bp, Artificial
  CRISPR gRNA sequence
tcgctttcccctaaatggct

SEQ ID NO: 184323 - DNA, 20 bp, Artificial
  CRISPR gRNA sequence
taaatggctgagcttctcgc

SEQ ID NO: 184324 - DNA, 20 bp, Artificial
  CRISPR gRNA sequence
ggctgagcttctcgccagcg

SEQ ID NO: 184325 - DNA, 20 bp, Artificial
  CRISPR gRNA sequence
gctgagcttctcgccagcgc

SEQ ID NO: 184326 - DNA, 20 bp, Artificial
  CRISPR gRNA sequence
gcttctcgccagcgcaggat

SEQ ID NO: 184327 - DNA, 20 bp, Artificial
  CRISPR gRNA sequence
gcgcaggatcagcctgttcc

SEQ ID NO: 184328 - DNA, 20 bp, Artificial
  CRISPR gRNA sequence
cgcaggatcagcctgttcct

SEQ ID NO: 184329 - DNA, 20 bp, Artificial
  CRISPR gRNA sequence
gcctgttcctgggactttcc

SEQ ID NO: 184330 - DNA, 20 bp, Artificial
  CRISPR gRNA sequence
ctgttcctgggactttccga

SEQ ID NO: 184331 - DNA, 20 bp, Artificial
  CRISPR gRNA sequence
cccgccctcgttccctcccc

SEQ ID NO: 184332 - DNA, 20 bp, Artificial
  CRISPR gRNA sequence
tcgttccctcccccagccgc

SEQ ID NO: 184333 - DNA, 20 bp, Artificial
  CRISPR gRNA sequence
ttccctcccccagccgccag

SEQ ID NO: 184334 - DNA, 20 bp, Artificial
  CRISPR gRNA sequence
tccctcccccagccgccagt

SEQ ID NO: 184335 - DNA, 20 bp, Artificial
  CRISPR gRNA sequence
ccctcccccagccgccagta

SEQ ID NO: 184336 - DNA, 20 bp, Artificial
  CRISPR gRNA sequence
cctcccccagccgccagtag

SEQ ID NO: 184337 - DNA, 20 bp, Artificial
  CRISPR gRNA sequence
tcccccagccgccagtaggg

SEQ ID NO: 184338 - DNA, 20 bp, Artificial
  CRISPR gRNA sequence
cccccagccgccagtagggg

SEQ ID NO: 184339 - DNA, 20 bp, Artificial
  CRISPR gRNA sequence
gccgccagtaggggaggact

SEQ ID NO: 184340 - DNA, 20 bp, Artificial
  CRISPR gRNA sequence
gccagtaggggaggactcgg

SEQ ID NO: 184341 - DNA, 20 bp, Artificial
  CRISPR gRNA sequence
ggggaggactcggcggtacc

SEQ ID NO: 184342 - DNA, 20 bp, Artificial
  CRISPR gRNA sequence
ggaggactcggcggtacccg

SEQ ID NO: 184343 - DNA, 20 bp, Artificial
  CRISPR gRNA sequence
ctcggcggtacccggagctt

SEQ ID NO: 184344 - DNA, 20 bp, Artificial
  CRISPR gRNA sequence
tcggcggtacccggagcttc

SEQ ID NO: 184345 - DNA, 20 bp, Artificial
  CRISPR gRNA sequence
cccggagcttcaggccccac

SEQ ID NO: 184346 - DNA, 20 bp, Artificial
  CRISPR gRNA sequence
ccggagcttcaggccccacc

SEQ ID NO: 184347 - DNA, 20 bp, Artificial
  CRISPR gRNA sequence
cggagcttcaggccccaccg

SEQ ID NO: 184348 - DNA, 20 bp, Artificial
  CRISPR gRNA sequence
cttcaggccccaccggggcg

SEQ ID NO: 184349 - DNA, 20 bp, Artificial
  CRISPR gRNA sequence
tcaggccccaccggggcgcg

SEQ ID NO: 184350 - DNA, 20 bp, Artificial
  CRISPR gRNA sequence
aggccccaccggggcgcgga

SEQ ID NO: 184351 - DNA, 20 bp, Artificial
  CRISPR gRNA sequence
caccggggcgcggagagtcc

SEQ ID NO: 184352 - DNA, 20 bp, Artificial
  CRISPR gRNA sequence
accggggcgcggagagtccc

SEQ ID NO: 184353 - DNA, 20 bp, Artificial
  CRISPR gRNA sequence
ggcgcggagagtcccaggcc

SEQ ID NO: 184354 - DNA, 20 bp, Artificial
  CRISPR gRNA sequence
cggagagtcccaggcccggc

SEQ ID NO: 184355 - DNA, 20 bp, Artificial
  CRISPR gRNA sequence
ggagagtcccaggcccggcc

SEQ ID NO: 184356 - DNA, 20 bp, Artificial
  CRISPR gRNA sequence
gtcccaggcccggccgggac

SEQ ID NO: 184357 - DNA, 20 bp, Artificial
  CRISPR gRNA sequence
tcccaggcccggccgggacc

SEQ ID NO: 184358 - DNA, 20 bp, Artificial
  CRISPR gRNA sequence
aggcccggccgggaccggga

SEQ ID NO: 184359 - DNA, 20 bp, Artificial
  CRISPR gRNA sequence
ccgggaccgggacggcgtcc

SEQ ID NO: 184360 - DNA, 20 bp, Artificial
  CRISPR gRNA sequence
ggacggcgtccgagtgccaa

SEQ ID NO: 184361 - DNA, 20 bp, Artificial
  CRISPR gRNA sequence
ggcgtccgagtgccaatggc

SEQ ID NO: 184362 - DNA, 20 bp, Artificial
  CRISPR gRNA sequence
cgagtgccaatggctagctc

SEQ ID NO: 184363 - DNA, 20 bp, Artificial
  CRISPR gRNA sequence
gagtgccaatggctagctct

SEQ ID NO: 184364 - DNA, 20 bp, Artificial
  CRISPR gRNA sequence
tctaggtgtcccgctccccg

SEQ ID NO: 184365 - DNA, 20 bp, Artificial
  CRISPR gRNA sequence
ctaggtgtcccgctccccgc

SEQ ID NO: 184366 - DNA, 20 bp, Artificial
  CRISPR gRNA sequence
cgcgggtgccgctgcctccc

SEQ ID NO: 184367 - DNA, 20 bp, Artificial
  CRISPR gRNA sequence
cgggtgccgctgcctccccg

SEQ ID NO: 184368 - DNA, 20 bp, Artificial
  CRISPR gRNA sequence
tccccggagcttctctcgca

SEQ ID NO: 184369 - DNA, 20 bp, Artificial
  CRISPR gRNA sequence
cggagcttctctcgcatggc

SEQ ID NO: 184370 - DNA, 20 bp, Artificial
  CRISPR gRNA sequence
ggagcttctctcgcatggct

SEQ ID NO: 184371 - DNA, 20 bp, Artificial
  CRISPR gRNA sequence
gagcttctctcgcatggctg

SEQ ID NO: 184372 - DNA, 20 bp, Artificial
  CRISPR gRNA sequence
ttctctcgcatggctgggga

SEQ ID NO: 184373 - DNA, 20 bp, Artificial
  CRISPR gRNA sequence
tactgctacttctcgccgac

SEQ ID NO: 184374 - DNA, 20 bp, Artificial
  CRISPR gRNA sequence
actgctacttctcgccgact

SEQ ID NO: 184375 - DNA, 20 bp, Artificial
  CRISPR gRNA sequence
tcgccgactgggtgctgctc

SEQ ID NO: 184376 - DNA, 20 bp, Artificial
  CRISPR gRNA sequence
gccccgcatattctccctgc

SEQ ID NO: 184377 - DNA, 20 bp, Artificial
  CRISPR gRNA sequence
ccaccgcgctgccactgctc

SEQ ID NO: 184378 - DNA, 20 bp, Artificial
  CRISPR gRNA sequence
caccgcgctgccactgctcc

SEQ ID NO: 184379 - DNA, 20 bp, Artificial
  CRISPR gRNA sequence
cgctgccactgctccgggtc

SEQ ID NO: 184380 - DNA, 20 bp, Artificial
  CRISPR gRNA sequence
gctgccactgctccgggtct

SEQ ID NO: 184381 - DNA, 20 bp, Artificial
  CRISPR gRNA sequence
gccactgctccgggtctggg

SEQ ID NO: 184382 - DNA, 20 bp, Artificial
  CRISPR gRNA sequence
actgctccgggtctgggcgg

SEQ ID NO: 184383 - DNA, 20 bp, Artificial
  CRISPR gRNA sequence
ctgctccgggtctgggcggt

SEQ ID NO: 184384 - DNA, 20 bp, Artificial
  CRISPR gRNA sequence
cgggtctgggcggtgggcct

SEQ ID NO: 184385 - DNA, 20 bp, Artificial
  CRISPR gRNA sequence
gggcggtgggcctgagccgc

SEQ ID NO: 184386 - DNA, 20 bp, Artificial
  CRISPR gRNA sequence
ggcggtgggcctgagccgct

SEQ ID NO: 184387 - DNA, 20 bp, Artificial
  CRISPR gRNA sequence
tgagccgctgggccgtgctc

SEQ ID NO: 184388 - DNA, 20 bp, Artificial
  CRISPR gRNA sequence
ccgctgggccgtgctctggc

SEQ ID NO: 184389 - DNA, 20 bp, Artificial
  CRISPR gRNA sequence
cgctgggccgtgctctggct

SEQ ID NO: 184390 - DNA, 20 bp, Artificial
  CRISPR gRNA sequence
gctgggccgtgctctggctg

SEQ ID NO: 184391 - DNA, 20 bp, Artificial
  CRISPR gRNA sequence
ctgggccgtgctctggctgg

SEQ ID NO: 184392 - DNA, 20 bp, Artificial
  CRISPR gRNA sequence
gtgctctggctgggggcctg

SEQ ID NO: 184393 - DNA, 20 bp, Artificial
  CRISPR gRNA sequence
tgctctggctgggggcctgc

SEQ ID NO: 184394 - DNA, 20 bp, Artificial
  CRISPR gRNA sequence
gctctggctgggggcctgcg

SEQ ID NO: 184395 - DNA, 20 bp, Artificial
  CRISPR gRNA sequence
ctgggggcctgcggggtcct

SEQ ID NO: 184396 - DNA, 20 bp, Artificial
  CRISPR gRNA sequence
tgggggcctgcggggtcctc

SEQ ID NO: 184397 - DNA, 20 bp, Artificial
  CRISPR gRNA sequence
gggggcctgcggggtcctca

SEQ ID NO: 184398 - DNA, 20 bp, Artificial
  CRISPR gRNA sequence
ctgcggggtcctcagggcaa

SEQ ID NO: 184399 - DNA, 20 bp, Artificial
  CRISPR gRNA sequence
ggggtcctcagggcaacggt

SEQ ID NO: 184400 - DNA, 20 bp, Artificial
  CRISPR gRNA sequence
tcagggcaacggttggctcc

SEQ ID NO: 184401 - DNA, 20 bp, Artificial
  CRISPR gRNA sequence
agggcaacggttggctccaa

SEQ ID NO: 184402 - DNA, 20 bp, Artificial
  CRISPR gRNA sequence
tggctccaagagcgaaaacg

SEQ ID NO: 184403 - DNA, 20 bp, Artificial
  CRISPR gRNA sequence
ggctccaagagcgaaaacgc

SEQ ID NO: 184404 - DNA, 20 bp, Artificial
  CRISPR gRNA sequence
agagcgaaaacgcaggtgcc

SEQ ID NO: 184405 - DNA, 20 bp, Artificial
  CRISPR gRNA sequence
gagcgaaaacgcaggtgccc

SEQ ID NO: 184406 - DNA, 20 bp, Artificial
  CRISPR gRNA sequence
agcgaaaacgcaggtgccca

SEQ ID NO: 184407 - DNA, 20 bp, Artificial
  CRISPR gRNA sequence
aaaacgcaggtgcccagggc

SEQ ID NO: 184408 - DNA, 20 bp, Artificial
  CRISPR gRNA sequence
cgcaggtgcccagggctggc

SEQ ID NO: 184409 - DNA, 20 bp, Artificial
  CRISPR gRNA sequence
agggctggctggctgctttg

SEQ ID NO: 184410 - DNA, 20 bp, Artificial
  CRISPR gRNA sequence
gctggctgctttgaagccat

SEQ ID NO: 184411 - DNA, 20 bp, Artificial
  CRISPR gRNA sequence
tgctttgaagccattagctg

SEQ ID NO: 184412 - DNA, 20 bp, Artificial
  CRISPR gRNA sequence
gaagccattagctgcggcac

SEQ ID NO: 184413 - DNA, 20 bp, Artificial
  CRISPR gRNA sequence
aagccattagctgcggcact

SEQ ID NO: 184414 - DNA, 20 bp, Artificial
  CRISPR gRNA sequence
attagctgcggcactgggct

SEQ ID NO: 184415 - DNA, 20 bp, Artificial
  CRISPR gRNA sequence
ggcactgggcttggccctgc

SEQ ID NO: 184416 - DNA, 20 bp, Artificial
  CRISPR gRNA sequence
gcactgggcttggccctgcc

SEQ ID NO: 184417 - DNA, 20 bp, Artificial
  CRISPR gRNA sequence
gccgggacttgccttgttcc

SEQ ID NO: 184418 - DNA, 20 bp, Artificial
  CRISPR gRNA sequence
cgggacttgccttgttccga

SEQ ID NO: 184419 - DNA, 20 bp, Artificial
  CRISPR gRNA sequence
tgttccgagagctgatctca

SEQ ID NO: 184420 - DNA, 20 bp, Artificial
  CRISPR gRNA sequence
gttccgagagctgatctcat

SEQ ID NO: 184421 - DNA, 20 bp, Artificial
  CRISPR gRNA sequence
ttccgagagctgatctcatg

SEQ ID NO: 184422 - DNA, 20 bp, Artificial
  CRISPR gRNA sequence
ccgagagctgatctcatggg

SEQ ID NO: 184423 - DNA, 20 bp, Artificial
  CRISPR gRNA sequence
ctgatctcatggggagcccc

SEQ ID NO: 184424 - DNA, 20 bp, Artificial
  CRISPR gRNA sequence
tgatctcatggggagccccc

SEQ ID NO: 184425 - DNA, 20 bp, Artificial
  CRISPR gRNA sequence
atggggagcccccgggtccg

SEQ ID NO: 184426 - DNA, 20 bp, Artificial
  CRISPR gRNA sequence
ggagcccccgggtccgcgga

SEQ ID NO: 184427 - DNA, 20 bp, Artificial
  CRISPR gRNA sequence
cccgggtccgcggatagcac

SEQ ID NO: 184428 - DNA, 20 bp, Artificial
  CRISPR gRNA sequence
ccgggtccgcggatagcacc

SEQ ID NO: 184429 - DNA, 20 bp, Artificial
  CRISPR gRNA sequence
atagcaccaggctactgcac

SEQ ID NO: 184430 - DNA, 20 bp, Artificial
  CRISPR gRNA sequence
tagcaccaggctactgcact

SEQ ID NO: 184431 - DNA, 20 bp, Artificial
  CRISPR gRNA sequence
agcaccaggctactgcactg

SEQ ID NO: 184432 - DNA, 20 bp, Artificial
  CRISPR gRNA sequence
accaggctactgcactgggg

SEQ ID NO: 184433 - DNA, 20 bp, Artificial
  CRISPR gRNA sequence
caccctaccgccttcgttgt

SEQ ID NO: 184434 - DNA, 20 bp, Artificial
  CRISPR gRNA sequence
cgccttcgttgtcagttatg

SEQ ID NO: 184435 - DNA, 20 bp, Artificial
  CRISPR gRNA sequence
cttcgttgtcagttatgcag

SEQ ID NO: 184436 - DNA, 20 bp, Artificial
  CRISPR gRNA sequence
ttatgcagcggcactgcccg

SEQ ID NO: 184437 - DNA, 20 bp, Artificial
  CRISPR gRNA sequence
tgcagcggcactgcccgcag

SEQ ID NO: 184438 - DNA, 20 bp, Artificial
  CRISPR gRNA sequence
cactgcccgcagcagccctg

SEQ ID NO: 184439 - DNA, 20 bp, Artificial
  CRISPR gRNA sequence
gcagccctgtggcacaaact

SEQ ID NO: 184440 - DNA, 20 bp, Artificial
  CRISPR gRNA sequence
cagccctgtggcacaaactc

SEQ ID NO: 184441 - DNA, 20 bp, Artificial
  CRISPR gRNA sequence
gccctgtggcacaaactcgg

SEQ ID NO: 184442 - DNA, 20 bp, Artificial
  CRISPR gRNA sequence
ggcacaaactcgggagcctc

SEQ ID NO: 184443 - DNA, 20 bp, Artificial
  CRISPR gRNA sequence
gcacaaactcgggagcctct

SEQ ID NO: 184444 - DNA, 20 bp, Artificial
  CRISPR gRNA sequence
ctcgggagcctctgggtgcc

SEQ ID NO: 184445 - DNA, 20 bp, Artificial
  CRISPR gRNA sequence
gggagcctctgggtgcccgg

SEQ ID NO: 184446 - DNA, 20 bp, Artificial
  CRISPR gRNA sequence
gcctctgggtgcccggcggt

SEQ ID NO: 184447 - DNA, 20 bp, Artificial
  CRISPR gRNA sequence
cctctgggtgcccggcggtc

SEQ ID NO: 184448 - DNA, 20 bp, Artificial
  CRISPR gRNA sequence
ctctgggtgcccggcggtca

SEQ ID NO: 184449 - DNA, 20 bp, Artificial
  CRISPR gRNA sequence
tgggtgcccggcggtcaggg

SEQ ID NO: 184450 - DNA, 20 bp, Artificial
  CRISPR gRNA sequence
cccggcggtcagggcggctc

SEQ ID NO: 184451 - DNA, 20 bp, Artificial
  CRISPR gRNA sequence
gctctggaaaccctgtgcgt

SEQ ID NO: 184452 - DNA, 20 bp, Artificial
  CRISPR gRNA sequence
aaaccctgtgcgtcggcttc

SEQ ID NO: 184453 - DNA, 20 bp, Artificial
  CRISPR gRNA sequence
aaccctgtgcgtcggcttct

SEQ ID NO: 184454 - DNA, 20 bp, Artificial
  CRISPR gRNA sequence
gcgtcggcttctaggctgcc

SEQ ID NO: 184455 - DNA, 20 bp, Artificial
  CRISPR gRNA sequence
cgtcggcttctaggctgcct

SEQ ID NO: 184456 - DNA, 20 bp, Artificial
  CRISPR gRNA sequence
gcttctaggctgcctgggct

SEQ ID NO: 184457 - DNA, 20 bp, Artificial
  CRISPR gRNA sequence
ttctaggctgcctgggctcg

SEQ ID NO: 184458 - DNA, 20 bp, Artificial
  CRISPR gRNA sequence
gcgccgcctctcgctgttcc

SEQ ID NO: 184459 - DNA, 20 bp, Artificial
  CRISPR gRNA sequence
cctctcgctgttcctggtcc

SEQ ID NO: 184460 - DNA, 20 bp, Artificial
  CRISPR gRNA sequence
ctcgctgttcctggtcctgg

SEQ ID NO: 184461 - DNA, 20 bp, Artificial
  CRISPR gRNA sequence
ctggtggtcctctcctctct

SEQ ID NO: 184462 - DNA, 20 bp, Artificial
  CRISPR gRNA sequence
tggtcctctcctctcttggt

SEQ ID NO: 184463 - DNA, 20 bp, Artificial
  CRISPR gRNA sequence
ggtcctctcctctcttggta

SEQ ID NO: 184464 - DNA, 20 bp, Artificial
  CRISPR gRNA sequence
gtcctctcctctcttggtaa

SEQ ID NO: 184465 - DNA, 20 bp, Artificial
  CRISPR gRNA sequence
tcctctcctctcttggtaag

SEQ ID NO: 184466 - DNA, 20 bp, Artificial
  CRISPR gRNA sequence
ctctcttggtaaggggaacg

SEQ ID NO: 184467 - DNA, 20 bp, Artificial
  CRISPR gRNA sequence
tctcttggtaaggggaacgc

SEQ ID NO: 184468 - DNA, 20 bp, Artificial
  CRISPR gRNA sequence
ctcttggtaaggggaacgca

SEQ ID NO: 184469 - DNA, 20 bp, Artificial
  CRISPR gRNA sequence
tggtaaggggaacgcagggc

SEQ ID NO: 184470 - DNA, 20 bp, Artificial
  CRISPR gRNA sequence
gtaaggggaacgcagggcaa

SEQ ID NO: 184471 - DNA, 20 bp, Artificial
  CRISPR gRNA sequence
taaggggaacgcagggcaag

SEQ ID NO: 184472 - DNA, 20 bp, Artificial
  CRISPR gRNA sequence
aaggggaacgcagggcaaga

SEQ ID NO: 184473 - DNA, 20 bp, Artificial
  CRISPR gRNA sequence
aggggaacgcagggcaagag

SEQ ID NO: 184474 - DNA, 20 bp, Artificial
  CRISPR gRNA sequence
gggaacgcagggcaagaggg

SEQ ID NO: 184475 - DNA, 20 bp, Artificial
  CRISPR gRNA sequence
ggaacgcagggcaagagggg

SEQ ID NO: 184476 - DNA, 20 bp, Artificial
  CRISPR gRNA sequence
agggcaagaggggaggacac

SEQ ID NO: 184477 - DNA, 20 bp, Artificial
  CRISPR gRNA sequence
gggcaagaggggaggacaca

SEQ ID NO: 184478 - DNA, 20 bp, Artificial
  CRISPR gRNA sequence
ggcaagaggggaggacacaa

SEQ ID NO: 184479 - DNA, 20 bp, Artificial
  CRISPR gRNA sequence
gcaagaggggaggacacaag

SEQ ID NO: 184480 - DNA, 20 bp, Artificial
  CRISPR gRNA sequence
aggggaggacacaaggggac

SEQ ID NO: 184481 - DNA, 20 bp, Artificial
  CRISPR gRNA sequence
ggggaggacacaaggggact

SEQ ID NO: 184482 - DNA, 20 bp, Artificial
  CRISPR gRNA sequence
aggacacaaggggactggga

SEQ ID NO: 184483 - DNA, 20 bp, Artificial
  CRISPR gRNA sequence
ggacacaaggggactgggac

SEQ ID NO: 184484 - DNA, 20 bp, Artificial
  CRISPR gRNA sequence
ggggactgggacaggaatca

SEQ ID NO: 184485 - DNA, 20 bp, Artificial
  CRISPR gRNA sequence
gggactgggacaggaatcaa

SEQ ID NO: 184486 - DNA, 20 bp, Artificial
  CRISPR gRNA sequence
caggaatcaaaggtaattgt

SEQ ID NO: 184487 - DNA, 20 bp, Artificial
  CRISPR gRNA sequence
aatcaaaggtaattgtcagt

SEQ ID NO: 184488 - DNA, 20 bp, Artificial
  CRISPR gRNA sequence
atcaaaggtaattgtcagta

SEQ ID NO: 184489 - DNA, 20 bp, Artificial
  CRISPR gRNA sequence
aaaggtaattgtcagtaagg

SEQ ID NO: 184490 - DNA, 20 bp, Artificial
  CRISPR gRNA sequence
aggtaattgtcagtaaggta

SEQ ID NO: 184491 - DNA, 20 bp, Artificial
  CRISPR gRNA sequence
taattgtcagtaaggtagag

SEQ ID NO: 184492 - DNA, 20 bp, Artificial
  CRISPR gRNA sequence
gtcagtaaggtagagtagcg

SEQ ID NO: 184493 - DNA, 20 bp, Artificial
  CRISPR gRNA sequence
tcagtaaggtagagtagcgt

SEQ ID NO: 184494 - DNA, 20 bp, Artificial
  CRISPR gRNA sequence
aggtagagtagcgtgggttc

SEQ ID NO: 184495 - DNA, 20 bp, Artificial
  CRISPR gRNA sequence
ggtagagtagcgtgggttct

SEQ ID NO: 184496 - DNA, 20 bp, Artificial
  CRISPR gRNA sequence
agcgtgggttctgggaaatg

SEQ ID NO: 184497 - DNA, 20 bp, Artificial
  CRISPR gRNA sequence
cgtgggttctgggaaatgtg

SEQ ID NO: 184498 - DNA, 20 bp, Artificial
  CRISPR gRNA sequence
gggttctgggaaatgtggag

SEQ ID NO: 184499 - DNA, 20 bp, Artificial
  CRISPR gRNA sequence
ggttctgggaaatgtggagc

SEQ ID NO: 184500 - DNA, 20 bp, Artificial
  CRISPR gRNA sequence
ttctgggaaatgtggagcag

SEQ ID NO: 184501 - DNA, 20 bp, Artificial
  CRISPR gRNA sequence
tgggaaatgtggagcaggag

SEQ ID NO: 184502 - DNA, 20 bp, Artificial
  CRISPR gRNA sequence
gggaaatgtggagcaggaga

SEQ ID NO: 184503 - DNA, 20 bp, Artificial
  CRISPR gRNA sequence
tggagcaggagaaggactcc

SEQ ID NO: 184504 - DNA, 20 bp, Artificial
  CRISPR gRNA sequence
caggagaaggactcctagcg

SEQ ID NO: 184505 - DNA, 20 bp, Artificial
  CRISPR gRNA sequence
aggagaaggactcctagcgt

SEQ ID NO: 184506 - DNA, 20 bp, Artificial
  CRISPR gRNA sequence
aggactcctagcgtgggtct

SEQ ID NO: 184507 - DNA, 20 bp, Artificial
  CRISPR gRNA sequence
tgggtcttggaacaccactt

SEQ ID NO: 184508 - DNA, 20 bp, Artificial
  CRISPR gRNA sequence
cttggaacaccacttcggtg

SEQ ID NO: 184509 - DNA, 20 bp, Artificial
  CRISPR gRNA sequence
ggaacaccacttcggtgtag

SEQ ID NO: 184510 - DNA, 20 bp, Artificial
  CRISPR gRNA sequence
ccacttcggtgtagaagaaa

SEQ ID NO: 184511 - DNA, 20 bp, Artificial
  CRISPR gRNA sequence
cggtgtagaagaaacggcac

SEQ ID NO: 184512 - DNA, 20 bp, Artificial
  CRISPR gRNA sequence
tagaagaaacggcactggac

SEQ ID NO: 184513 - DNA, 20 bp, Artificial
  CRISPR gRNA sequence
aagaaacggcactggactgg

SEQ ID NO: 184514 - DNA, 20 bp, Artificial
  CRISPR gRNA sequence
agaaacggcactggactggc

SEQ ID NO: 184515 - DNA, 20 bp, Artificial
  CRISPR gRNA sequence
gaaacggcactggactggcg

SEQ ID NO: 184516 - DNA, 20 bp, Artificial
  CRISPR gRNA sequence
aaacggcactggactggcgg

SEQ ID NO: 184517 - DNA, 20 bp, Artificial
  CRISPR gRNA sequence
ggcactggactggcgggggc

SEQ ID NO: 184518 - DNA, 20 bp, Artificial
  CRISPR gRNA sequence
cactggactggcgggggcca

SEQ ID NO: 184519 - DNA, 20 bp, Artificial
  CRISPR gRNA sequence
actggactggcgggggccag

SEQ ID NO: 184520 - DNA, 20 bp, Artificial
  CRISPR gRNA sequence
ctggcgggggccagaggttc

SEQ ID NO: 184521 - DNA, 20 bp, Artificial
  CRISPR gRNA sequence
tggcgggggccagaggttct

SEQ ID NO: 184522 - DNA, 20 bp, Artificial
  CRISPR gRNA sequence
ttctgggctccattgctgac

SEQ ID NO: 184523 - DNA, 20 bp, Artificial
  CRISPR gRNA sequence
tctgggctccattgctgacc

SEQ ID NO: 184524 - DNA, 20 bp, Artificial
  CRISPR gRNA sequence
ctgaccgggtcttgattctt

SEQ ID NO: 184525 - DNA, 20 bp, Artificial
  CRISPR gRNA sequence
tgaccgggtcttgattcttt

SEQ ID NO: 184526 - DNA, 20 bp, Artificial
  CRISPR gRNA sequence
cttgattctttgggccacgc

SEQ ID NO: 184527 - DNA, 20 bp, Artificial
  CRISPR gRNA sequence
gattctttgggccacgccgg

SEQ ID NO: 184528 - DNA, 20 bp, Artificial
  CRISPR gRNA sequence
tctttgggccacgccggaag

SEQ ID NO: 184529 - DNA, 20 bp, Artificial
  CRISPR gRNA sequence
ctttgggccacgccggaagc

SEQ ID NO: 184530 - DNA, 20 bp, Artificial
  CRISPR gRNA sequence
tttgggccacgccggaagcg

SEQ ID NO: 184531 - DNA, 20 bp, Artificial
  CRISPR gRNA sequence
agcggggaaatcctttgctc

SEQ ID NO: 184532 - DNA, 20 bp, Artificial
  CRISPR gRNA sequence
gcggggaaatcctttgctct

SEQ ID NO: 184533 - DNA, 20 bp, Artificial
  CRISPR gRNA sequence
cggggaaatcctttgctctg

SEQ ID NO: 184534 - DNA, 20 bp, Artificial
  CRISPR gRNA sequence
aatcctttgctctggggccg

SEQ ID NO: 184535 - DNA, 20 bp, Artificial
  CRISPR gRNA sequence
atcctttgctctggggccga

SEQ ID NO: 184536 - DNA, 20 bp, Artificial
  CRISPR gRNA sequence
tcctttgctctggggccgaa

SEQ ID NO: 184537 - DNA, 20 bp, Artificial
  CRISPR gRNA sequence
tttgctctggggccgaaggg

SEQ ID NO: 184538 - DNA, 20 bp, Artificial
  CRISPR gRNA sequence
ttgctctggggccgaagggc

SEQ ID NO: 184539 - DNA, 20 bp, Artificial
  CRISPR gRNA sequence
tgctctggggccgaagggcg

SEQ ID NO: 184540 - DNA, 20 bp, Artificial
  CRISPR gRNA sequence
cggggcatcctcatctctaa

SEQ ID NO: 184541 - DNA, 20 bp, Artificial
  CRISPR gRNA sequence
ggggcatcctcatctctaac

SEQ ID NO: 184542 - DNA, 20 bp, Artificial
  CRISPR gRNA sequence
ggcatcctcatctctaacag

SEQ ID NO: 184543 - DNA, 20 bp, Artificial
  CRISPR gRNA sequence
gcatcctcatctctaacagg

SEQ ID NO: 184544 - DNA, 20 bp, Artificial
  CRISPR gRNA sequence
cttttctacttcatgatctc

SEQ ID NO: 184545 - DNA, 20 bp, Artificial
  CRISPR gRNA sequence
ccttcctaataaaatcctga

SEQ ID NO: 184546 - DNA, 20 bp, Artificial
  CRISPR gRNA sequence
taataaaatcctgaaagttc

SEQ ID NO: 184547 - DNA, 20 bp, Artificial
  CRISPR gRNA sequence
taaaatcctgaaagttctgg

SEQ ID NO: 184548 - DNA, 20 bp, Artificial
  CRISPR gRNA sequence
aaatcctgaaagttctggta

SEQ ID NO: 184549 - DNA, 20 bp, Artificial
  CRISPR gRNA sequence
aagttctggtagagcaacca

SEQ ID NO: 184550 - DNA, 20 bp, Artificial
  CRISPR gRNA sequence
agttctggtagagcaaccac

SEQ ID NO: 184551 - DNA, 20 bp, Artificial
  CRISPR gRNA sequence
gttctggtagagcaaccaca

SEQ ID NO: 184552 - DNA, 20 bp, Artificial
  CRISPR gRNA sequence
ctggtagagcaaccacaggg

SEQ ID NO: 184553 - DNA, 20 bp, Artificial
  CRISPR gRNA sequence
tagagcaaccacagggtagt

SEQ ID NO: 184554 - DNA, 20 bp, Artificial
  CRISPR gRNA sequence
aaccacagggtagtgagttc

SEQ ID NO: 184555 - DNA, 20 bp, Artificial
  CRISPR gRNA sequence
accacagggtagtgagttcc

SEQ ID NO: 184556 - DNA, 20 bp, Artificial
  CRISPR gRNA sequence
ccacagggtagtgagttcca

SEQ ID NO: 184557 - DNA, 20 bp, Artificial
  CRISPR gRNA sequence
cagggtagtgagttccaggg

SEQ ID NO: 184558 - DNA, 20 bp, Artificial
  CRISPR gRNA sequence
gagttccagggcagcctatt

SEQ ID NO: 184559 - DNA, 20 bp, Artificial
  CRISPR gRNA sequence
agttccagggcagcctattt

SEQ ID NO: 184560 - DNA, 20 bp, Artificial
  CRISPR gRNA sequence
cagggcagcctatttaggtt

SEQ ID NO: 184561 - DNA, 20 bp, Artificial
  CRISPR gRNA sequence
agggcagcctatttaggttc

SEQ ID NO: 184562 - DNA, 20 bp, Artificial
  CRISPR gRNA sequence
gcctatttaggttcgggatt

SEQ ID NO: 184563 - DNA, 20 bp, Artificial
  CRISPR gRNA sequence
taggttcgggattgagacgt

SEQ ID NO: 184564 - DNA, 20 bp, Artificial
  CRISPR gRNA sequence
tcctttctgctgatgccctc

SEQ ID NO: 184565 - DNA, 20 bp, Artificial
  CRISPR gRNA sequence
cctttctgctgatgccctcc

SEQ ID NO: 184566 - DNA, 20 bp, Artificial
  CRISPR gRNA sequence
gctgatgccctccaggataa

SEQ ID NO: 184567 - DNA, 20 bp, Artificial
  CRISPR gRNA sequence
atgccctccaggataatggt

SEQ ID NO: 184568 - DNA, 20 bp, Artificial
  CRISPR gRNA sequence
tgccctccaggataatggtg

SEQ ID NO: 184569 - DNA, 20 bp, Artificial
  CRISPR gRNA sequence
gccctccaggataatggtga

SEQ ID NO: 184570 - DNA, 20 bp, Artificial
  CRISPR gRNA sequence
ccctccaggataatggtgag

SEQ ID NO: 184571 - DNA, 20 bp, Artificial
  CRISPR gRNA sequence
cctccaggataatggtgagg

SEQ ID NO: 184572 - DNA, 20 bp, Artificial
  CRISPR gRNA sequence
tccaggataatggtgagggg

SEQ ID NO: 184573 - DNA, 20 bp, Artificial
  CRISPR gRNA sequence
ccaggataatggtgaggggg

SEQ ID NO: 184574 - DNA, 20 bp, Artificial
  CRISPR gRNA sequence
aggataatggtgagggggag

SEQ ID NO: 184575 - DNA, 20 bp, Artificial
  CRISPR gRNA sequence
ggataatggtgagggggagg

SEQ ID NO: 184576 - DNA, 20 bp, Artificial
  CRISPR gRNA sequence
atggtgagggggaggaggcg

SEQ ID NO: 184577 - DNA, 20 bp, Artificial
  CRISPR gRNA sequence
gtgagggggaggaggcgtgg

SEQ ID NO: 184578 - DNA, 20 bp, Artificial
  CRISPR gRNA sequence
tgagggggaggaggcgtggt

SEQ ID NO: 184579 - DNA, 20 bp, Artificial
  CRISPR gRNA sequence
gagggggaggaggcgtggtg

SEQ ID NO: 184580 - DNA, 20 bp, Artificial
  CRISPR gRNA sequence
gggaggaggcgtggtggggc

SEQ ID NO: 184581 - DNA, 20 bp, Artificial
  CRISPR gRNA sequence
cgtggtggggccagtctgac

SEQ ID NO: 184582 - DNA, 20 bp, Artificial
  CRISPR gRNA sequence
ctgactggaactgacctact

SEQ ID NO: 184583 - DNA, 20 bp, Artificial
  CRISPR gRNA sequence
tgacctctcttctctttctc

SEQ ID NO: 184584 - DNA, 20 bp, Artificial
  CRISPR gRNA sequence
gacctctcttctctttctcc

SEQ ID NO: 184585 - DNA, 20 bp, Artificial
  CRISPR gRNA sequence
acctctcttctctttctcca

SEQ ID NO: 184586 - DNA, 20 bp, Artificial
  CRISPR gRNA sequence
cctctcttctctttctccag

SEQ ID NO: 184587 - DNA, 20 bp, Artificial
  CRISPR gRNA sequence
tctcttctctttctccaggg

SEQ ID NO: 184588 - DNA, 20 bp, Artificial
  CRISPR gRNA sequence
ttctctttctccaggggaga

SEQ ID NO: 184589 - DNA, 20 bp, Artificial
  CRISPR gRNA sequence
gatggccattccattcttta

SEQ ID NO: 184590 - DNA, 20 bp, Artificial
  CRISPR gRNA sequence
atggccattccattctttac

SEQ ID NO: 184591 - DNA, 20 bp, Artificial
  CRISPR gRNA sequence
ttacgggccgcctcactgac

SEQ ID NO: 184592 - DNA, 20 bp, Artificial
  CRISPR gRNA sequence
cctcactgactggattctac

SEQ ID NO: 184593 - DNA, 20 bp, Artificial
  CRISPR gRNA sequence
actgactggattctacaaga

SEQ ID NO: 184594 - DNA, 20 bp, Artificial
  CRISPR gRNA sequence
ctggattctacaagatggct

SEQ ID NO: 184595 - DNA, 20 bp, Artificial
  CRISPR gRNA sequence
tctcatgtccattctcacca

SEQ ID NO: 184596 - DNA, 20 bp, Artificial
  CRISPR gRNA sequence
atgtccattctcaccatagc

SEQ ID NO: 184597 - DNA, 20 bp, Artificial
  CRISPR gRNA sequence
tgtccattctcaccatagcc

SEQ ID NO: 184598 - DNA, 20 bp, Artificial
  CRISPR gRNA sequence
attctcaccatagccaggtc

SEQ ID NO: 184599 - DNA, 20 bp, Artificial
  CRISPR gRNA sequence
ttctcaccatagccaggtct

SEQ ID NO: 184600 - DNA, 20 bp, Artificial
  CRISPR gRNA sequence
tctcaccatagccaggtctg

SEQ ID NO: 184601 - DNA, 20 bp, Artificial
  CRISPR gRNA sequence
ctcaccatagccaggtctgg

SEQ ID NO: 184602 - DNA, 20 bp, Artificial
  CRISPR gRNA sequence
ccaggtctgggggctgaaaa

SEQ ID NO: 184603 - DNA, 20 bp, Artificial
  CRISPR gRNA sequence
caggtctgggggctgaaaat

SEQ ID NO: 184604 - DNA, 20 bp, Artificial
  CRISPR gRNA sequence
aggtctgggggctgaaaatg

SEQ ID NO: 184605 - DNA, 20 bp, Artificial
  CRISPR gRNA sequence
aaatggggcaccctgcaaat

SEQ ID NO: 184606 - DNA, 20 bp, Artificial
  CRISPR gRNA sequence
aatggggcaccctgcaaatg

SEQ ID NO: 184607 - DNA, 20 bp, Artificial
  CRISPR gRNA sequence
atggggcaccctgcaaatga

SEQ ID NO: 184608 - DNA, 20 bp, Artificial
  CRISPR gRNA sequence
ggggcaccctgcaaatgagg

SEQ ID NO: 184609 - DNA, 20 bp, Artificial
  CRISPR gRNA sequence
caccctgcaaatgagggagt

SEQ ID NO: 184610 - DNA, 20 bp, Artificial
  CRISPR gRNA sequence
cctgcaaatgagggagttgg

SEQ ID NO: 184611 - DNA, 20 bp, Artificial
  CRISPR gRNA sequence
caaatgagggagttggaagt

SEQ ID NO: 184612 - DNA, 20 bp, Artificial
  CRISPR gRNA sequence
aaatgagggagttggaagtt

SEQ ID NO: 184613 - DNA, 20 bp, Artificial
  CRISPR gRNA sequence
aatgagggagttggaagttg

SEQ ID NO: 184614 - DNA, 20 bp, Artificial
  CRISPR gRNA sequence
ctgtccgaaatgcacttata

SEQ ID NO: 184615 - DNA, 20 bp, Artificial
  CRISPR gRNA sequence
tgtccgaaatgcacttatat

SEQ ID NO: 184616 - DNA, 20 bp, Artificial
  CRISPR gRNA sequence
gtccgaaatgcacttatatg

SEQ ID NO: 184617 - DNA, 20 bp, Artificial
  CRISPR gRNA sequence
tgcacttatatggggatacc

SEQ ID NO: 184618 - DNA, 20 bp, Artificial
  CRISPR gRNA sequence
gcacttatatggggatacct

SEQ ID NO: 184619 - DNA, 20 bp, Artificial
  CRISPR gRNA sequence
atggggatacctgggacctt

SEQ ID NO: 184620 - DNA, 20 bp, Artificial
  CRISPR gRNA sequence
accctgatcccctttttttc

SEQ ID NO: 184621 - DNA, 20 bp, Artificial
  CRISPR gRNA sequence
ccctgatcccctttttttcc

SEQ ID NO: 184622 - DNA, 20 bp, Artificial
  CRISPR gRNA sequence
ctttttttccgggttcttta

SEQ ID NO: 184623 - DNA, 20 bp, Artificial
  CRISPR gRNA sequence
tttccgggttctttatagtg

SEQ ID NO: 184624 - DNA, 20 bp, Artificial
  CRISPR gRNA sequence
ggttctttatagtgcagtgc

SEQ ID NO: 184625 - DNA, 20 bp, Artificial
  CRISPR gRNA sequence
ttctttatagtgcagtgctg

SEQ ID NO: 184626 - DNA, 20 bp, Artificial
  CRISPR gRNA sequence
tagtgcagtgctggagttcg

SEQ ID NO: 184627 - DNA, 20 bp, Artificial
  CRISPR gRNA sequence
agtgcagtgctggagttcgt

SEQ ID NO: 184628 - DNA, 20 bp, Artificial
  CRISPR gRNA sequence
gtgctggagttcgtgggtga

SEQ ID NO: 184629 - DNA, 20 bp, Artificial
  CRISPR gRNA sequence
tgctggagttcgtgggtgac

SEQ ID NO: 184630 - DNA, 20 bp, Artificial
  CRISPR gRNA sequence
cgggatctataacaacacca

SEQ ID NO: 184631 - DNA, 20 bp, Artificial
  CRISPR gRNA sequence
gggatctataacaacaccat

SEQ ID NO: 184632 - DNA, 20 bp, Artificial
  CRISPR gRNA sequence
aacaccatgggccacgtgca

SEQ ID NO: 184633 - DNA, 20 bp, Artificial
  CRISPR gRNA sequence
gccacgtgcacagccacttg

SEQ ID NO: 184634 - DNA, 20 bp, Artificial
  CRISPR gRNA sequence
ccacgtgcacagccacttgc

SEQ ID NO: 184635 - DNA, 20 bp, Artificial
  CRISPR gRNA sequence
cacgtgcacagccacttgca

SEQ ID NO: 184636 - DNA, 20 bp, Artificial
  CRISPR gRNA sequence
cgtgcacagccacttgcagg

SEQ ID NO: 184637 - DNA, 20 bp, Artificial
  CRISPR gRNA sequence
tgcacagccacttgcaggga

SEQ ID NO: 184638 - DNA, 20 bp, Artificial
  CRISPR gRNA sequence
gcacagccacttgcagggag

SEQ ID NO: 184639 - DNA, 20 bp, Artificial
  CRISPR gRNA sequence
cacttgcagggagaggtgtt

SEQ ID NO: 184640 - DNA, 20 bp, Artificial
  CRISPR gRNA sequence
acttgcagggagaggtgttt

SEQ ID NO: 184641 - DNA, 20 bp, Artificial
  CRISPR gRNA sequence
cttgcagggagaggtgtttg

SEQ ID NO: 184642 - DNA, 20 bp, Artificial
  CRISPR gRNA sequence
tgtttggggctgtcctgcgc

SEQ ID NO: 184643 - DNA, 20 bp, Artificial
  CRISPR gRNA sequence
gtttggggctgtcctgcgcc

SEQ ID NO: 184644 - DNA, 20 bp, Artificial
  CRISPR gRNA sequence
ttggggctgtcctgcgccag

SEQ ID NO: 184645 - DNA, 20 bp, Artificial
  CRISPR gRNA sequence
ggctgtcctgcgccaggaga

SEQ ID NO: 184646 - DNA, 20 bp, Artificial
  CRISPR gRNA sequence
ctgtcctgcgccaggagacg

SEQ ID NO: 184647 - DNA, 20 bp, Artificial
  CRISPR gRNA sequence
aggagacggagtttttccaa

SEQ ID NO: 184648 - DNA, 20 bp, Artificial
  CRISPR gRNA sequence
cggagtttttccaacagaac

SEQ ID NO: 184649 - DNA, 20 bp, Artificial
  CRISPR gRNA sequence
gtttttccaacagaaccaga

SEQ ID NO: 184650 - DNA, 20 bp, Artificial
  CRISPR gRNA sequence
tttttccaacagaaccagac

SEQ ID NO: 184651 - DNA, 20 bp, Artificial
  CRISPR gRNA sequence
ttctcattcttgatatacct

SEQ ID NO: 184652 - DNA, 20 bp, Artificial
  CRISPR gRNA sequence
tctcattcttgatatacctc

SEQ ID NO: 184653 - DNA, 20 bp, Artificial
  CRISPR gRNA sequence
tcattcttgatatacctcag

SEQ ID NO: 184654 - DNA, 20 bp, Artificial
  CRISPR gRNA sequence
aatattgtcctccttacctt

SEQ ID NO: 184655 - DNA, 20 bp, Artificial
  CRISPR gRNA sequence
tccttaccttaagaaaaacc

SEQ ID NO: 184656 - DNA, 20 bp, Artificial
  CRISPR gRNA sequence
cttaccttaagaaaaaccta

SEQ ID NO: 184657 - DNA, 20 bp, Artificial
  CRISPR gRNA sequence
aaaaacctagagttttcatc

SEQ ID NO: 184658 - DNA, 20 bp, Artificial
  CRISPR gRNA sequence
aatctattcctatgtatcct

SEQ ID NO: 184659 - DNA, 20 bp, Artificial
  CRISPR gRNA sequence
tattcctatgtatccttaga

SEQ ID NO: 184660 - DNA, 20 bp, Artificial
  CRISPR gRNA sequence
gtatccttagatagaaacca

SEQ ID NO: 184661 - DNA, 20 bp, Artificial
  CRISPR gRNA sequence
aaaccatagaatttcaaacc

SEQ ID NO: 184662 - DNA, 20 bp, Artificial
  CRISPR gRNA sequence
atttcaaacctggaaatttt

SEQ ID NO: 184663 - DNA, 20 bp, Artificial
  CRISPR gRNA sequence
acctggaaattttgagctca

SEQ ID NO: 184664 - DNA, 20 bp, Artificial
  CRISPR gRNA sequence
ctggaaattttgagctcata

SEQ ID NO: 184665 - DNA, 20 bp, Artificial
  CRISPR gRNA sequence
agaccaactgcctcatctga

SEQ ID NO: 184666 - DNA, 20 bp, Artificial
  CRISPR gRNA sequence
accaactgcctcatctgaca

SEQ ID NO: 184667 - DNA, 20 bp, Artificial
  CRISPR gRNA sequence
aactgcctcatctgacagag

SEQ ID NO: 184668 - DNA, 20 bp, Artificial
  CRISPR gRNA sequence
actgcctcatctgacagaga

SEQ ID NO: 184669 - DNA, 20 bp, Artificial
  CRISPR gRNA sequence
atctgacagagaaggaaact

SEQ ID NO: 184670 - DNA, 20 bp, Artificial
  CRISPR gRNA sequence
tctgacagagaaggaaactg

SEQ ID NO: 184671 - DNA, 20 bp, Artificial
  CRISPR gRNA sequence
cagagaaggaaactgaggcc

SEQ ID NO: 184672 - DNA, 20 bp, Artificial
  CRISPR gRNA sequence
ccctaaatgctgaaactgca

SEQ ID NO: 184673 - DNA, 20 bp, Artificial
  CRISPR gRNA sequence
tgaaactgcacagttacata

SEQ ID NO: 184674 - DNA, 20 bp, Artificial
  CRISPR gRNA sequence
actgcacagttacatatggc

SEQ ID NO: 184675 - DNA, 20 bp, Artificial
  CRISPR gRNA sequence
tgcacagttacatatggcta

SEQ ID NO: 184676 - DNA, 20 bp, Artificial
  CRISPR gRNA sequence
catatggctagagacacact

SEQ ID NO: 184677 - DNA, 20 bp, Artificial
  CRISPR gRNA sequence
atatggctagagacacactt

SEQ ID NO: 184678 - DNA, 20 bp, Artificial
  CRISPR gRNA sequence
tatggctagagacacacttg

SEQ ID NO: 184679 - DNA, 20 bp, Artificial
  CRISPR gRNA sequence
gctagagacacacttggggt

SEQ ID NO: 184680 - DNA, 20 bp, Artificial
  CRISPR gRNA sequence
cacacttggggttagaaccc

SEQ ID NO: 184681 - DNA, 20 bp, Artificial
  CRISPR gRNA sequence
ggttagaaccctggtctctt

SEQ ID NO: 184682 - DNA, 20 bp, Artificial
  CRISPR gRNA sequence
ctggtctcttgagtgctcca

SEQ ID NO: 184683 - DNA, 20 bp, Artificial
  CRISPR gRNA sequence
cttgagtgctccacagactt

SEQ ID NO: 184684 - DNA, 20 bp, Artificial
  CRISPR gRNA sequence
acagacttcggcatgctttc

SEQ ID NO: 184685 - DNA, 20 bp, Artificial
  CRISPR gRNA sequence
gacttcggcatgctttctag

SEQ ID NO: 184686 - DNA, 20 bp, Artificial
  CRISPR gRNA sequence
ggcatgctttctagcagcac

SEQ ID NO: 184687 - DNA, 20 bp, Artificial
  CRISPR gRNA sequence
atgctttctagcagcactag

SEQ ID NO: 184688 - DNA, 20 bp, Artificial
  CRISPR gRNA sequence
tagcagcactagaagctgta

SEQ ID NO: 184689 - DNA, 20 bp, Artificial
  CRISPR gRNA sequence
agaagctgtacagttacata

SEQ ID NO: 184690 - DNA, 20 bp, Artificial
  CRISPR gRNA sequence
gctgtacagttacatatggc

SEQ ID NO: 184691 - DNA, 20 bp, Artificial
  CRISPR gRNA sequence
tgtacagttacatatggcta

SEQ ID NO: 184692 - DNA, 20 bp, Artificial
  CRISPR gRNA sequence
cagttacatatggctagaga

SEQ ID NO: 184693 - DNA, 20 bp, Artificial
  CRISPR gRNA sequence
catatggctagagatagacc

SEQ ID NO: 184694 - DNA, 20 bp, Artificial
  CRISPR gRNA sequence
atatggctagagatagacct

SEQ ID NO: 184695 - DNA, 20 bp, Artificial
  CRISPR gRNA sequence
tatggctagagatagacctg

SEQ ID NO: 184696 - DNA, 20 bp, Artificial
  CRISPR gRNA sequence
gctagagatagacctggggt

SEQ ID NO: 184697 - DNA, 20 bp, Artificial
  CRISPR gRNA sequence
tagacctggggttagaaccc

SEQ ID NO: 184698 - DNA, 20 bp, Artificial
  CRISPR gRNA sequence
tggggttagaaccctagtcc

SEQ ID NO: 184699 - DNA, 20 bp, Artificial
  CRISPR gRNA sequence
gttagaaccctagtcccagt

SEQ ID NO: 184700 - DNA, 20 bp, Artificial
  CRISPR gRNA sequence
tagtcccagtgagtgctcca

SEQ ID NO: 184701 - DNA, 20 bp, Artificial
  CRISPR gRNA sequence
agtgagtgctccacagactt

SEQ ID NO: 184702 - DNA, 20 bp, Artificial
  CRISPR gRNA sequence
acagactttggcatgcttcc

SEQ ID NO: 184703 - DNA, 20 bp, Artificial
  CRISPR gRNA sequence
gactttggcatgcttcctag

SEQ ID NO: 184704 - DNA, 20 bp, Artificial
  CRISPR gRNA sequence
ctccatctctgttatgtgac

SEQ ID NO: 184705 - DNA, 20 bp, Artificial
  CRISPR gRNA sequence
ctctgttatgtgaccagttt

SEQ ID NO: 184706 - DNA, 20 bp, Artificial
  CRISPR gRNA sequence
gctcttcctgcctgtgtgta

SEQ ID NO: 184707 - DNA, 20 bp, Artificial
  CRISPR gRNA sequence
tcctgcctgtgtgtatagca

SEQ ID NO: 184708 - DNA, 20 bp, Artificial
  CRISPR gRNA sequence
cctgcctgtgtgtatagcat

SEQ ID NO: 184709 - DNA, 20 bp, Artificial
  CRISPR gRNA sequence
tgtgtatagcatgggacata

SEQ ID NO: 184710 - DNA, 20 bp, Artificial
  CRISPR gRNA sequence
gtgtatagcatgggacatac

SEQ ID NO: 184711 - DNA, 20 bp, Artificial
  CRISPR gRNA sequence
catgggacatacaggttctc

SEQ ID NO: 184712 - DNA, 20 bp, Artificial
  CRISPR gRNA sequence
atgggacatacaggttctct

SEQ ID NO: 184713 - DNA, 20 bp, Artificial
  CRISPR gRNA sequence
tgggacatacaggttctcta

SEQ ID NO: 184714 - DNA, 20 bp, Artificial
  CRISPR gRNA sequence
catacaggttctctagggaa

SEQ ID NO: 184715 - DNA, 20 bp, Artificial
  CRISPR gRNA sequence
caggttctctagggaacaga

SEQ ID NO: 184716 - DNA, 20 bp, Artificial
  CRISPR gRNA sequence
tctagggaacagaaagcttt

SEQ ID NO: 184717 - DNA, 20 bp, Artificial
  CRISPR gRNA sequence
ctagggaacagaaagctttc

SEQ ID NO: 184718 - DNA, 20 bp, Artificial
  CRISPR gRNA sequence
acagaaagctttcaggaaaa

SEQ ID NO: 184719 - DNA, 20 bp, Artificial
  CRISPR gRNA sequence
atgactttataattaaaatg

SEQ ID NO: 184720 - DNA, 20 bp, Artificial
  CRISPR gRNA sequence
tgactttataattaaaatga

SEQ ID NO: 184721 - DNA, 20 bp, Artificial
  CRISPR gRNA sequence
tttataattaaaatgaaggt

SEQ ID NO: 184722 - DNA, 20 bp, Artificial
  CRISPR gRNA sequence
ttataattaaaatgaaggtc

SEQ ID NO: 184723 - DNA, 20 bp, Artificial
  CRISPR gRNA sequence
acactcatcttccctgcact

SEQ ID NO: 184724 - DNA, 20 bp, Artificial
  CRISPR gRNA sequence
cttccctgcactgagatttg

SEQ ID NO: 184725 - DNA, 20 bp, Artificial
  CRISPR gRNA sequence
cactgagatttgcagacctc

SEQ ID NO: 184726 - DNA, 20 bp, Artificial
  CRISPR gRNA sequence
ctgagatttgcagacctctg

SEQ ID NO: 184727 - DNA, 20 bp, Artificial
  CRISPR gRNA sequence
aaccctaaccttgtttcctg

SEQ ID NO: 184728 - DNA, 20 bp, Artificial
  CRISPR gRNA sequence
cttgtttcctgcagcctcct

SEQ ID NO: 184729 - DNA, 20 bp, Artificial
  CRISPR gRNA sequence
catgttgacacccctgaccc

SEQ ID NO: 184730 - DNA, 20 bp, Artificial
  CRISPR gRNA sequence
cacccctgaccctggcatcc

SEQ ID NO: 184731 - DNA, 20 bp, Artificial
  CRISPR gRNA sequence
ctggcatcctggctcattgt

SEQ ID NO: 184732 - DNA, 20 bp, Artificial
  CRISPR gRNA sequence
tgttagttcgtctcatcact

SEQ ID NO: 184733 - DNA, 20 bp, Artificial
  CRISPR gRNA sequence
ctctcttctccccaaccctg

SEQ ID NO: 184734 - DNA, 20 bp, Artificial
  CRISPR gRNA sequence
tctcttctccccaaccctgc

SEQ ID NO: 184735 - DNA, 20 bp, Artificial
  CRISPR gRNA sequence
ctgcaggtaacatcatgtct

SEQ ID NO: 184736 - DNA, 20 bp, Artificial
  CRISPR gRNA sequence
tgcaggtaacatcatgtctc

SEQ ID NO: 184737 - DNA, 20 bp, Artificial
  CRISPR gRNA sequence
taacatcatgtctcgggtaa

SEQ ID NO: 184738 - DNA, 20 bp, Artificial
  CRISPR gRNA sequence
acatcatgtctcgggtaaca

SEQ ID NO: 184739 - DNA, 20 bp, Artificial
  CRISPR gRNA sequence
catcatgtctcgggtaacag

SEQ ID NO: 184740 - DNA, 20 bp, Artificial
  CRISPR gRNA sequence
acagaggacacgtccaccct

SEQ ID NO: 184741 - DNA, 20 bp, Artificial
  CRISPR gRNA sequence
tccaccctgagtgattctct

SEQ ID NO: 184742 - DNA, 20 bp, Artificial
  CRISPR gRNA sequence
ccctgagtgattctctgagt

SEQ ID NO: 184743 - DNA, 20 bp, Artificial
  CRISPR gRNA sequence
gattctctgagtgagaatct

SEQ ID NO: 184744 - DNA, 20 bp, Artificial
  CRISPR gRNA sequence
agaatctgagcttatttctg

SEQ ID NO: 184745 - DNA, 20 bp, Artificial
  CRISPR gRNA sequence
gagcttatttctgtggtacc

SEQ ID NO: 184746 - DNA, 20 bp, Artificial
  CRISPR gRNA sequence
atttctgtggtacctggtgc

SEQ ID NO: 184747 - DNA, 20 bp, Artificial
  CRISPR gRNA sequence
tttctgtggtacctggtgcg

SEQ ID NO: 184748 - DNA, 20 bp, Artificial
  CRISPR gRNA sequence
ggtgcgaggcctatgtctct

SEQ ID NO: 184749 - DNA, 20 bp, Artificial
  CRISPR gRNA sequence
gtgcgaggcctatgtctctt

SEQ ID NO: 184750 - DNA, 20 bp, Artificial
  CRISPR gRNA sequence
tgcgaggcctatgtctcttg

SEQ ID NO: 184751 - DNA, 20 bp, Artificial
  CRISPR gRNA sequence
gtctcttggggatcatgctc

SEQ ID NO: 184752 - DNA, 20 bp, Artificial
  CRISPR gRNA sequence
tctcttggggatcatgctct

SEQ ID NO: 184753 - DNA, 20 bp, Artificial
  CRISPR gRNA sequence
ctcttggggatcatgctctg

SEQ ID NO: 184754 - DNA, 20 bp, Artificial
  CRISPR gRNA sequence
ggggatcatgctctggggat

SEQ ID NO: 184755 - DNA, 20 bp, Artificial
  CRISPR gRNA sequence
gggatcagtgtccctcacca

SEQ ID NO: 184756 - DNA, 20 bp, Artificial
  CRISPR gRNA sequence
ctctgcttttccttctgccc

SEQ ID NO: 184757 - DNA, 20 bp, Artificial
  CRISPR gRNA sequence
tgcttttccttctgcccaag

SEQ ID NO: 184758 - DNA, 20 bp, Artificial
  CRISPR gRNA sequence
gcttttccttctgcccaaga

SEQ ID NO: 184759 - DNA, 20 bp, Artificial
  CRISPR gRNA sequence
tttccttctgcccaagaagg

SEQ ID NO: 184760 - DNA, 20 bp, Artificial
  CRISPR gRNA sequence
ttccttctgcccaagaaggt

SEQ ID NO: 184761 - DNA, 20 bp, Artificial
  CRISPR gRNA sequence
tgcccaagaaggtgggaaaa

SEQ ID NO: 184762 - DNA, 20 bp, Artificial
  CRISPR gRNA sequence
agaaggtgggaaaatggtac

SEQ ID NO: 184763 - DNA, 20 bp, Artificial
  CRISPR gRNA sequence
gaaggtgggaaaatggtacc

SEQ ID NO: 184764 - DNA, 20 bp, Artificial
  CRISPR gRNA sequence
aatggtaccaggtatgttca

SEQ ID NO: 184765 - DNA, 20 bp, Artificial
  CRISPR gRNA sequence
tggtaccaggtatgttcatg

SEQ ID NO: 184766 - DNA, 20 bp, Artificial
  CRISPR gRNA sequence
accaggtatgttcatggagt

SEQ ID NO: 184767 - DNA, 20 bp, Artificial
  CRISPR gRNA sequence
tggagttggcccgctctaca

SEQ ID NO: 184768 - DNA, 20 bp, Artificial
  CRISPR gRNA sequence
ctacacagaccctcatctcc

SEQ ID NO: 184769 - DNA, 20 bp, Artificial
  CRISPR gRNA sequence
agaccctcatctcccagact

SEQ ID NO: 184770 - DNA, 20 bp, Artificial
  CRISPR gRNA sequence
ccctcatctcccagacttgg

SEQ ID NO: 184771 - DNA, 20 bp, Artificial
  CRISPR gRNA sequence
tctcccagacttggcagact

SEQ ID NO: 184772 - DNA, 20 bp, Artificial
  CRISPR gRNA sequence
agttcctctcacattgcttt

SEQ ID NO: 184773 - DNA, 20 bp, Artificial
  CRISPR gRNA sequence
ctctcacattgctttcagtc

SEQ ID NO: 184774 - DNA, 20 bp, Artificial
  CRISPR gRNA sequence
tgctttcagtccagctttcc

SEQ ID NO: 184775 - DNA, 20 bp, Artificial
  CRISPR gRNA sequence
ttactgattctccatcttca

SEQ ID NO: 184776 - DNA, 20 bp, Artificial
  CRISPR gRNA sequence
catggaacaccctgtccctg

SEQ ID NO: 184777 - DNA, 20 bp, Artificial
  CRISPR gRNA sequence
gtccctgtggtccatgttcc

SEQ ID NO: 184778 - DNA, 20 bp, Artificial
  CRISPR gRNA sequence
tccctgtggtccatgttccc

SEQ ID NO: 184779 - DNA, 20 bp, Artificial
  CRISPR gRNA sequence
acattaacctccatactctc

SEQ ID NO: 184780 - DNA, 20 bp, Artificial
  CRISPR gRNA sequence
cattaacctccatactctct

SEQ ID NO: 184781 - DNA, 20 bp, Artificial
  CRISPR gRNA sequence
actctctgggtcttcttttc

SEQ ID NO: 184782 - DNA, 20 bp, Artificial
  CRISPR gRNA sequence
tctccccacaatctgtcttt

SEQ ID NO: 184783 - DNA, 20 bp, Artificial
  CRISPR gRNA sequence
tttgatccccaacccgttct

SEQ ID NO: 184784 - DNA, 20 bp, Artificial
  CRISPR gRNA sequence
tcctcttcctcgtatttctt

SEQ ID NO: 184785 - DNA, 20 bp, Artificial
  CRISPR gRNA sequence
ctcgtatttctttagcatcc

SEQ ID NO: 184786 - DNA, 20 bp, Artificial
  CRISPR gRNA sequence
tcgtatttctttagcatcca

SEQ ID NO: 184787 - DNA, 20 bp, Artificial
  CRISPR gRNA sequence
cgtatttctttagcatccaa

SEQ ID NO: 184788 - DNA, 20 bp, Artificial
  CRISPR gRNA sequence
gtatttctttagcatccaag

SEQ ID NO: 184789 - DNA, 20 bp, Artificial
  CRISPR gRNA sequence
tctttagcatccaaggggca

SEQ ID NO: 184790 - DNA, 20 bp, Artificial
  CRISPR gRNA sequence
tctcacctttaatttccaaa

SEQ ID NO: 184791 - DNA, 20 bp, Artificial
  CRISPR gRNA sequence
ctcacctttaatttccaaat

SEQ ID NO: 184792 - DNA, 20 bp, Artificial
  CRISPR gRNA sequence
taatttccaaataggtaact

SEQ ID NO: 184793 - DNA, 20 bp, Artificial
  CRISPR gRNA sequence
aatttccaaataggtaactc

SEQ ID NO: 184794 - DNA, 20 bp, Artificial
  CRISPR gRNA sequence
caaataggtaactcaggtat

SEQ ID NO: 184795 - DNA, 20 bp, Artificial
  CRISPR gRNA sequence
tcaggtattagtgtccctga

SEQ ID NO: 184796 - DNA, 20 bp, Artificial
  CRISPR gRNA sequence
atctcttgtccatgtatcca

SEQ ID NO: 184797 - DNA, 20 bp, Artificial
  CRISPR gRNA sequence
gtccatgtatccacagttgc

SEQ ID NO: 184798 - DNA, 20 bp, Artificial
  CRISPR gRNA sequence
catgtatccacagttgctgg

SEQ ID NO: 184799 - DNA, 20 bp, Artificial
  CRISPR gRNA sequence
atccacagttgctggaagtg

SEQ ID NO: 184800 - DNA, 20 bp, Artificial
  CRISPR gRNA sequence
tccacagttgctggaagtgc

SEQ ID NO: 184801 - DNA, 20 bp, Artificial
  CRISPR gRNA sequence
agttgctggaagtgcaggtg

SEQ ID NO: 184802 - DNA, 20 bp, Artificial
  CRISPR gRNA sequence
gttgctggaagtgcaggtgc

SEQ ID NO: 184803 - DNA, 20 bp, Artificial
  CRISPR gRNA sequence
agtgcaggtgcgggaatctc

SEQ ID NO: 184804 - DNA, 20 bp, Artificial
  CRISPR gRNA sequence
aggtgcgggaatctctggca

SEQ ID NO: 184805 - DNA, 20 bp, Artificial
  CRISPR gRNA sequence
cgggaatctctggcaaagtc

SEQ ID NO: 184806 - DNA, 20 bp, Artificial
  CRISPR gRNA sequence
aatctctggcaaagtccagc

SEQ ID NO: 184807 - DNA, 20 bp, Artificial
  CRISPR gRNA sequence
atctctggcaaagtccagcc

SEQ ID NO: 184808 - DNA, 20 bp, Artificial
  CRISPR gRNA sequence
tctggcaaagtccagccagg

SEQ ID NO: 184809 - DNA, 20 bp, Artificial
  CRISPR gRNA sequence
agtccagccaggtggccatt

SEQ ID NO: 184810 - DNA, 20 bp, Artificial
  CRISPR gRNA sequence
gtccagccaggtggccattg

SEQ ID NO: 184811 - DNA, 20 bp, Artificial
  CRISPR gRNA sequence
ggtggccattgaggctctgt

SEQ ID NO: 184812 - DNA, 20 bp, Artificial
  CRISPR gRNA sequence
ggctctgtcggccatgccta

SEQ ID NO: 184813 - DNA, 20 bp, Artificial
  CRISPR gRNA sequence
tcggccatgcctacagttcg

SEQ ID NO: 184814 - DNA, 20 bp, Artificial
  CRISPR gRNA sequence
cagttcgaagctttgccaac

SEQ ID NO: 184815 - DNA, 20 bp, Artificial
  CRISPR gRNA sequence
agttcgaagctttgccaacg

SEQ ID NO: 184816 - DNA, 20 bp, Artificial
  CRISPR gRNA sequence
ttcgaagctttgccaacgag

SEQ ID NO: 184817 - DNA, 20 bp, Artificial
  CRISPR gRNA sequence
tcgaagctttgccaacgagg

SEQ ID NO: 184818 - DNA, 20 bp, Artificial
  CRISPR gRNA sequence
cgaagctttgccaacgagga

SEQ ID NO: 184819 - DNA, 20 bp, Artificial
  CRISPR gRNA sequence
ctttgccaacgaggagggcg

SEQ ID NO: 184820 - DNA, 20 bp, Artificial
  CRISPR gRNA sequence
ccaacgaggagggcgaagcc

SEQ ID NO: 184821 - DNA, 20 bp, Artificial
  CRISPR gRNA sequence
acgaggagggcgaagcccag

SEQ ID NO: 184822 - DNA, 20 bp, Artificial
  CRISPR gRNA sequence
gagggcgaagcccagaagtt

SEQ ID NO: 184823 - DNA, 20 bp, Artificial
  CRISPR gRNA sequence
agggcgaagcccagaagttt

SEQ ID NO: 184824 - DNA, 20 bp, Artificial
  CRISPR gRNA sequence
gggcgaagcccagaagttta

SEQ ID NO: 184825 - DNA, 20 bp, Artificial
  CRISPR gRNA sequence
aagcccagaagtttagggaa

SEQ ID NO: 184826 - DNA, 20 bp, Artificial
  CRISPR gRNA sequence
gaagtttagggaaaagctgc

SEQ ID NO: 184827 - DNA, 20 bp, Artificial
  CRISPR gRNA sequence
gggaaaagctgcaagaaata

SEQ ID NO: 184828 - DNA, 20 bp, Artificial
  CRISPR gRNA sequence
aagaaataaagacactcaac

SEQ ID NO: 184829 - DNA, 20 bp, Artificial
  CRISPR gRNA sequence
aaataaagacactcaaccag

SEQ ID NO: 184830 - DNA, 20 bp, Artificial
  CRISPR gRNA sequence
aataaagacactcaaccaga

SEQ ID NO: 184831 - DNA, 20 bp, Artificial
  CRISPR gRNA sequence
taaagacactcaaccagaag

SEQ ID NO: 184832 - DNA, 20 bp, Artificial
  CRISPR gRNA sequence
aaagacactcaaccagaagg

SEQ ID NO: 184833 - DNA, 20 bp, Artificial
  CRISPR gRNA sequence
actcaaccagaaggaggctg

SEQ ID NO: 184834 - DNA, 20 bp, Artificial
  CRISPR gRNA sequence
gaaggaggctgtggcctatg

SEQ ID NO: 184835 - DNA, 20 bp, Artificial
  CRISPR gRNA sequence
tggcctatgcagtcaactcc

SEQ ID NO: 184836 - DNA, 20 bp, Artificial
  CRISPR gRNA sequence
gcagtcaactcctggaccac

SEQ ID NO: 184837 - DNA, 20 bp, Artificial
  CRISPR gRNA sequence
aactcctggaccactagtgt

SEQ ID NO: 184838 - DNA, 20 bp, Artificial
  CRISPR gRNA sequence
accactagtgtgagcacctg

SEQ ID NO: 184839 - DNA, 20 bp, Artificial
  CRISPR gRNA sequence
atacccattcccttgtcctt

SEQ ID NO: 184840 - DNA, 20 bp, Artificial
  CRISPR gRNA sequence
tgctcccactccttctttac

SEQ ID NO: 184841 - DNA, 20 bp, Artificial
  CRISPR gRNA sequence
gctcccactccttctttact

SEQ ID NO: 184842 - DNA, 20 bp, Artificial
  CRISPR gRNA sequence
actccttctttactgggaaa

SEQ ID NO: 184843 - DNA, 20 bp, Artificial
  CRISPR gRNA sequence
cttctttactgggaaatggt

SEQ ID NO: 184844 - DNA, 20 bp, Artificial
  CRISPR gRNA sequence
ttactgggaaatggttggtt

SEQ ID NO: 184845 - DNA, 20 bp, Artificial
  CRISPR gRNA sequence
ttggttcagtattttcgtcc

SEQ ID NO: 184846 - DNA, 20 bp, Artificial
  CRISPR gRNA sequence
tattttcgtcctagcaacct

SEQ ID NO: 184847 - DNA, 20 bp, Artificial
  CRISPR gRNA sequence
attttcgtcctagcaacctg

SEQ ID NO: 184848 - DNA, 20 bp, Artificial
  CRISPR gRNA sequence
tgaggctcaatgactctact

SEQ ID NO: 184849 - DNA, 20 bp, Artificial
  CRISPR gRNA sequence
atgactctactcagtgtccc

SEQ ID NO: 184850 - DNA, 20 bp, Artificial
  CRISPR gRNA sequence
tagccccctccctctcttta

SEQ ID NO: 184851 - DNA, 20 bp, Artificial
  CRISPR gRNA sequence
ctccctctctttaaagatgc

SEQ ID NO: 184852 - DNA, 20 bp, Artificial
  CRISPR gRNA sequence
tccctctctttaaagatgct

SEQ ID NO: 184853 - DNA, 20 bp, Artificial
  CRISPR gRNA sequence
ctctctttaaagatgctagg

SEQ ID NO: 184854 - DNA, 20 bp, Artificial
  CRISPR gRNA sequence
gatgctaggtggcttccttt

SEQ ID NO: 184855 - DNA, 20 bp, Artificial
  CRISPR gRNA sequence
taggtggcttcctttcagta

SEQ ID NO: 184856 - DNA, 20 bp, Artificial
  CRISPR gRNA sequence
ataaaatccacccaaccatg

SEQ ID NO: 184857 - DNA, 20 bp, Artificial
  CRISPR gRNA sequence
atccacccaaccatgtggat

SEQ ID NO: 184858 - DNA, 20 bp, Artificial
  CRISPR gRNA sequence
ccacccaaccatgtggattg

SEQ ID NO: 184859 - DNA, 20 bp, Artificial
  CRISPR gRNA sequence
acccaaccatgtggattgga

SEQ ID NO: 184860 - DNA, 20 bp, Artificial
  CRISPR gRNA sequence
ttggagagatgcgtgtcttc

SEQ ID NO: 184861 - DNA, 20 bp, Artificial
  CRISPR gRNA sequence
agatgcgtgtcttccagtcc

SEQ ID NO: 184862 - DNA, 20 bp, Artificial
  CRISPR gRNA sequence
gatgcgtgtcttccagtcct

SEQ ID NO: 184863 - DNA, 20 bp, Artificial
  CRISPR gRNA sequence
atgcgtgtcttccagtccta

SEQ ID NO: 184864 - DNA, 20 bp, Artificial
  CRISPR gRNA sequence
tagggccttcctttgcctct

SEQ ID NO: 184865 - DNA, 20 bp, Artificial
  CRISPR gRNA sequence
agggccttcctttgcctctc

SEQ ID NO: 184866 - DNA, 20 bp, Artificial
  CRISPR gRNA sequence
gggccttcctttgcctctca

SEQ ID NO: 184867 - DNA, 20 bp, Artificial
  CRISPR gRNA sequence
ggccttcctttgcctctcag

SEQ ID NO: 184868 - DNA, 20 bp, Artificial
  CRISPR gRNA sequence
cttcctttgcctctcagggg

SEQ ID NO: 184869 - DNA, 20 bp, Artificial
  CRISPR gRNA sequence
tttgcctctcaggggaagtg

SEQ ID NO: 184870 - DNA, 20 bp, Artificial
  CRISPR gRNA sequence
ttgcctctcaggggaagtgc

SEQ ID NO: 184871 - DNA, 20 bp, Artificial
  CRISPR gRNA sequence
tgcctctcaggggaagtgca

SEQ ID NO: 184872 - DNA, 20 bp, Artificial
  CRISPR gRNA sequence
gcgccataaattcttgcacc

SEQ ID NO: 184873 - DNA, 20 bp, Artificial
  CRISPR gRNA sequence
cgccataaattcttgcacct

SEQ ID NO: 184874 - DNA, 20 bp, Artificial
  CRISPR gRNA sequence
cacctgggactgcttcatgc

SEQ ID NO: 184875 - DNA, 20 bp, Artificial
  CRISPR gRNA sequence
tgcttcatgctggtaccttg

SEQ ID NO: 184876 - DNA, 20 bp, Artificial
  CRISPR gRNA sequence
ctggtaccttgtagatttgt

SEQ ID NO: 184877 - DNA, 20 bp, Artificial
  CRISPR gRNA sequence
taccttgtagatttgttagt

SEQ ID NO: 184878 - DNA, 20 bp, Artificial
  CRISPR gRNA sequence
ccttgtagatttgttagtga

SEQ ID NO: 184879 - DNA, 20 bp, Artificial
  CRISPR gRNA sequence
agatttgttagtgagagtga

SEQ ID NO: 184880 - DNA, 20 bp, Artificial
  CRISPR gRNA sequence
gatttgttagtgagagtgat

SEQ ID NO: 184881 - DNA, 20 bp, Artificial
  CRISPR gRNA sequence
gttagtgagagtgatgggaa

SEQ ID NO: 184882 - DNA, 20 bp, Artificial
  CRISPR gRNA sequence
agtgagagtgatgggaatag

SEQ ID NO: 184883 - DNA, 20 bp, Artificial
  CRISPR gRNA sequence
gagagtgatgggaatagtgg

SEQ ID NO: 184884 - DNA, 20 bp, Artificial
  CRISPR gRNA sequence
gtgatgggaatagtggaagc

SEQ ID NO: 184885 - DNA, 20 bp, Artificial
  CRISPR gRNA sequence
tgatgggaatagtggaagcc

SEQ ID NO: 184886 - DNA, 20 bp, Artificial
  CRISPR gRNA sequence
gatgggaatagtggaagcca

SEQ ID NO: 184887 - DNA, 20 bp, Artificial
  CRISPR gRNA sequence
gaatagtggaagccagggat

SEQ ID NO: 184888 - DNA, 20 bp, Artificial
  CRISPR gRNA sequence
aatagtggaagccagggatg

SEQ ID NO: 184889 - DNA, 20 bp, Artificial
  CRISPR gRNA sequence
atagtggaagccagggatga

SEQ ID NO: 184890 - DNA, 20 bp, Artificial
  CRISPR gRNA sequence
gagggacatctgtgatgcac

SEQ ID NO: 184891 - DNA, 20 bp, Artificial
  CRISPR gRNA sequence
gacatctgtgatgcactgga

SEQ ID NO: 184892 - DNA, 20 bp, Artificial
  CRISPR gRNA sequence
catctgtgatgcactggaaa

SEQ ID NO: 184893 - DNA, 20 bp, Artificial
  CRISPR gRNA sequence
tctgtgatgcactggaaaga

SEQ ID NO: 184894 - DNA, 20 bp, Artificial
  CRISPR gRNA sequence
cactggaaagagagctacgc

SEQ ID NO: 184895 - DNA, 20 bp, Artificial
  CRISPR gRNA sequence
agagctacgccagtgatccg

SEQ ID NO: 184896 - DNA, 20 bp, Artificial
  CRISPR gRNA sequence
cgccagtgatccgaagatcc

SEQ ID NO: 184897 - DNA, 20 bp, Artificial
  CRISPR gRNA sequence
acaacaaatttaccttctct

SEQ ID NO: 184898 - DNA, 20 bp, Artificial
  CRISPR gRNA sequence
tacttattattattattttt

SEQ ID NO: 184899 - DNA, 20 bp, Artificial
  CRISPR gRNA sequence
tattattattatttttgagc

SEQ ID NO: 184900 - DNA, 20 bp, Artificial
  CRISPR gRNA sequence
ttattattatttttgagctg

SEQ ID NO: 184901 - DNA, 20 bp, Artificial
  CRISPR gRNA sequence
tggagtctcgctttgtcgcc

SEQ ID NO: 184902 - DNA, 20 bp, Artificial
  CRISPR gRNA sequence
ggagtctcgctttgtcgccc

SEQ ID NO: 184903 - DNA, 20 bp, Artificial
  CRISPR gRNA sequence
tctcgctttgtcgcccaggc

SEQ ID NO: 184904 - DNA, 20 bp, Artificial
  CRISPR gRNA sequence
tcgctttgtcgcccaggctg

SEQ ID NO: 184905 - DNA, 20 bp, Artificial
  CRISPR gRNA sequence
ttgtcgcccaggctggagtg

SEQ ID NO: 184906 - DNA, 20 bp, Artificial
  CRISPR gRNA sequence
tcgcccaggctggagtgcag

SEQ ID NO: 184907 - DNA, 20 bp, Artificial
  CRISPR gRNA sequence
tggagtgcagtggcgcgatc

SEQ ID NO: 184908 - DNA, 20 bp, Artificial
  CRISPR gRNA sequence
ggagtgcagtggcgcgatct

SEQ ID NO: 184909 - DNA, 20 bp, Artificial
  CRISPR gRNA sequence
gcgcgatctgggctcactgc

SEQ ID NO: 184910 - DNA, 20 bp, Artificial
  CRISPR gRNA sequence
tcactgcaagctccgcctcc

SEQ ID NO: 184911 - DNA, 20 bp, Artificial
  CRISPR gRNA sequence
cactgcaagctccgcctccc

SEQ ID NO: 184912 - DNA, 20 bp, Artificial
  CRISPR gRNA sequence
ttcacgccgttctcccgcct

SEQ ID NO: 184913 - DNA, 20 bp, Artificial
  CRISPR gRNA sequence
ttctcccgcctcagcctcct

SEQ ID NO: 184914 - DNA, 20 bp, Artificial
  CRISPR gRNA sequence
tcccgcctcagcctcctgag

SEQ ID NO: 184915 - DNA, 20 bp, Artificial
  CRISPR gRNA sequence
gcctcagcctcctgagtagc

SEQ ID NO: 184916 - DNA, 20 bp, Artificial
  CRISPR gRNA sequence
cctcagcctcctgagtagct

SEQ ID NO: 184917 - DNA, 20 bp, Artificial
  CRISPR gRNA sequence
ctcctgagtagctgggacta

SEQ ID NO: 184918 - DNA, 20 bp, Artificial
  CRISPR gRNA sequence
tcctgagtagctgggactac

SEQ ID NO: 184919 - DNA, 20 bp, Artificial
  CRISPR gRNA sequence
caggcacccgccaccacgcc

SEQ ID NO: 184920 - DNA, 20 bp, Artificial
  CRISPR gRNA sequence
tttttttttttttgtatttt

SEQ ID NO: 184921 - DNA, 20 bp, Artificial
  CRISPR gRNA sequence
ttttttttttgtatttttag

SEQ ID NO: 184922 - DNA, 20 bp, Artificial
  CRISPR gRNA sequence
ttttttttgtatttttagta

SEQ ID NO: 184923 - DNA, 20 bp, Artificial
  CRISPR gRNA sequence
tttgtatttttagtagagac

SEQ ID NO: 184924 - DNA, 20 bp, Artificial
  CRISPR gRNA sequence
ttgtatttttagtagagacg

SEQ ID NO: 184925 - DNA, 20 bp, Artificial
  CRISPR gRNA sequence
gagacgaggtttctccgtgt

SEQ ID NO: 184926 - DNA, 20 bp, Artificial
  CRISPR gRNA sequence
cgaggtttctccgtgttagc

SEQ ID NO: 184927 - DNA, 20 bp, Artificial
  CRISPR gRNA sequence
gaggtttctccgtgttagcc

SEQ ID NO: 184928 - DNA, 20 bp, Artificial
  CRISPR gRNA sequence
tttctccgtgttagccagga

SEQ ID NO: 184929 - DNA, 20 bp, Artificial
  CRISPR gRNA sequence
accttgtgatccgcccactt

SEQ ID NO: 184930 - DNA, 20 bp, Artificial
  CRISPR gRNA sequence
ccgcccacttcggcctccca

SEQ ID NO: 184931 - DNA, 20 bp, Artificial
  CRISPR gRNA sequence
acttcggcctcccaaagtgc

SEQ ID NO: 184932 - DNA, 20 bp, Artificial
  CRISPR gRNA sequence
ctcccaaagtgctggaattg

SEQ ID NO: 184933 - DNA, 20 bp, Artificial
  CRISPR gRNA sequence
tcccaaagtgctggaattgc

SEQ ID NO: 184934 - DNA, 20 bp, Artificial
  CRISPR gRNA sequence
agtgctggaattgcaggcat

SEQ ID NO: 184935 - DNA, 20 bp, Artificial
  CRISPR gRNA sequence
catgagccactgcgcccgac

SEQ ID NO: 184936 - DNA, 20 bp, Artificial
  CRISPR gRNA sequence
gtttcctcatttttcaaaaa

SEQ ID NO: 184937 - DNA, 20 bp, Artificial
  CRISPR gRNA sequence
ttcctcatttttcaaaaatg

SEQ ID NO: 184938 - DNA, 20 bp, Artificial
  CRISPR gRNA sequence
agtgatataaccttctttat

SEQ ID NO: 184939 - DNA, 20 bp, Artificial
  CRISPR gRNA sequence
gtgatataaccttctttata

SEQ ID NO: 184940 - DNA, 20 bp, Artificial
  CRISPR gRNA sequence
ttataaggctcttcatgtat

SEQ ID NO: 184941 - DNA, 20 bp, Artificial
  CRISPR gRNA sequence
agctgacatcacatgaatga

SEQ ID NO: 184942 - DNA, 20 bp, Artificial
  CRISPR gRNA sequence
atgaatgaaagccttttgtg

SEQ ID NO: 184943 - DNA, 20 bp, Artificial
  CRISPR gRNA sequence
gaatgaaagccttttgtgaa

SEQ ID NO: 184944 - DNA, 20 bp, Artificial
  CRISPR gRNA sequence
gtgaagagtaaaatgctccc

SEQ ID NO: 184945 - DNA, 20 bp, Artificial
  CRISPR gRNA sequence
gagtaaaatgctccccagac

SEQ ID NO: 184946 - DNA, 20 bp, Artificial
  CRISPR gRNA sequence
agtaaaatgctccccagaca

SEQ ID NO: 184947 - DNA, 20 bp, Artificial
  CRISPR gRNA sequence
atgctccccagacaaggtga

SEQ ID NO: 184948 - DNA, 20 bp, Artificial
  CRISPR gRNA sequence
ctccccagacaaggtgatag

SEQ ID NO: 184949 - DNA, 20 bp, Artificial
  CRISPR gRNA sequence
agacaaggtgatagtggtga

SEQ ID NO: 184950 - DNA, 20 bp, Artificial
  CRISPR gRNA sequence
caaggtgatagtggtgatgg

SEQ ID NO: 184951 - DNA, 20 bp, Artificial
  CRISPR gRNA sequence
tgatagtggtgatggtggtg

SEQ ID NO: 184952 - DNA, 20 bp, Artificial
  CRISPR gRNA sequence
tgacttgcatgatgtgcatt

SEQ ID NO: 184953 - DNA, 20 bp, Artificial
  CRISPR gRNA sequence
ttgcatgatgtgcattgagt

SEQ ID NO: 184954 - DNA, 20 bp, Artificial
  CRISPR gRNA sequence
gtgcattgagtcagactcca

SEQ ID NO: 184955 - DNA, 20 bp, Artificial
  CRISPR gRNA sequence
tgcattgagtcagactccat

SEQ ID NO: 184956 - DNA, 20 bp, Artificial
  CRISPR gRNA sequence
gcattgagtcagactccatg

SEQ ID NO: 184957 - DNA, 20 bp, Artificial
  CRISPR gRNA sequence
gtcagactccatggggtctc

SEQ ID NO: 184958 - DNA, 20 bp, Artificial
  CRISPR gRNA sequence
cattctcctgtctgcctatt

SEQ ID NO: 184959 - DNA, 20 bp, Artificial
  CRISPR gRNA sequence
ttgagcctgccgatgtcact

SEQ ID NO: 184960 - DNA, 20 bp, Artificial
  CRISPR gRNA sequence
tgagcctgccgatgtcactt

SEQ ID NO: 184961 - DNA, 20 bp, Artificial
  CRISPR gRNA sequence
agcctgccgatgtcacttag

SEQ ID NO: 184962 - DNA, 20 bp, Artificial
  CRISPR gRNA sequence
tgccgatgtcacttaggaga

SEQ ID NO: 184963 - DNA, 20 bp, Artificial
  CRISPR gRNA sequence
gccgatgtcacttaggagac

SEQ ID NO: 184964 - DNA, 20 bp, Artificial
  CRISPR gRNA sequence
ccgatgtcacttaggagaca

SEQ ID NO: 184965 - DNA, 20 bp, Artificial
  CRISPR gRNA sequence
cagggacttgatatttcctt

SEQ ID NO: 184966 - DNA, 20 bp, Artificial
  CRISPR gRNA sequence
agggacttgatatttccttc

SEQ ID NO: 184967 - DNA, 20 bp, Artificial
  CRISPR gRNA sequence
ttccttcaggttaatgactg

SEQ ID NO: 184968 - DNA, 20 bp, Artificial
  CRISPR gRNA sequence
gtggttctttgtgtcccctc

SEQ ID NO: 184969 - DNA, 20 bp, Artificial
  CRISPR gRNA sequence
ccctccagatttctctacct

SEQ ID NO: 184970 - DNA, 20 bp, Artificial
  CRISPR gRNA sequence
tacctcagtccctttttttg

SEQ ID NO: 184971 - DNA, 20 bp, Artificial
  CRISPR gRNA sequence
ctttttttgtggtctcttta

SEQ ID NO: 184972 - DNA, 20 bp, Artificial
  CRISPR gRNA sequence
tgtggtctctttatagattt

SEQ ID NO: 184973 - DNA, 20 bp, Artificial
  CRISPR gRNA sequence
gtggtctctttatagatttc

SEQ ID NO: 184974 - DNA, 20 bp, Artificial
  CRISPR gRNA sequence
gatttcaggtatgctgctga

SEQ ID NO: 184975 - DNA, 20 bp, Artificial
  CRISPR gRNA sequence
ttcaggtatgctgctgaaag

SEQ ID NO: 184976 - DNA, 20 bp, Artificial
  CRISPR gRNA sequence
tcaggtatgctgctgaaagt

SEQ ID NO: 184977 - DNA, 20 bp, Artificial
  CRISPR gRNA sequence
aaagtgggaatcctctacat

SEQ ID NO: 184978 - DNA, 20 bp, Artificial
  CRISPR gRNA sequence
gtgggaatcctctacattgg

SEQ ID NO: 184979 - DNA, 20 bp, Artificial
  CRISPR gRNA sequence
tgggaatcctctacattggt

SEQ ID NO: 184980 - DNA, 20 bp, Artificial
  CRISPR gRNA sequence
gaatcctctacattggtggg

SEQ ID NO: 184981 - DNA, 20 bp, Artificial
  CRISPR gRNA sequence
cctctacattggtgggcagc

SEQ ID NO: 184982 - DNA, 20 bp, Artificial
  CRISPR gRNA sequence
attggtgggcagctggtgac

SEQ ID NO: 184983 - DNA, 20 bp, Artificial
  CRISPR gRNA sequence
ggtgggcagctggtgaccag

SEQ ID NO: 184984 - DNA, 20 bp, Artificial
  CRISPR gRNA sequence
gtgggcagctggtgaccagt

SEQ ID NO: 184985 - DNA, 20 bp, Artificial
  CRISPR gRNA sequence
tgggcagctggtgaccagtg

SEQ ID NO: 184986 - DNA, 20 bp, Artificial
  CRISPR gRNA sequence
ctggtgaccagtggggctgt

SEQ ID NO: 184987 - DNA, 20 bp, Artificial
  CRISPR gRNA sequence
gtgaccagtggggctgtaag

SEQ ID NO: 184988 - DNA, 20 bp, Artificial
  CRISPR gRNA sequence
accagtggggctgtaagcag

SEQ ID NO: 184989 - DNA, 20 bp, Artificial
  CRISPR gRNA sequence
ccagtggggctgtaagcagt

SEQ ID NO: 184990 - DNA, 20 bp, Artificial
  CRISPR gRNA sequence
ttgtcacatttgttctctac

SEQ ID NO: 184991 - DNA, 20 bp, Artificial
  CRISPR gRNA sequence
catttgttctctaccagatg

SEQ ID NO: 184992 - DNA, 20 bp, Artificial
  CRISPR gRNA sequence
tctaccagatgcagttcacc

SEQ ID NO: 184993 - DNA, 20 bp, Artificial
  CRISPR gRNA sequence
ctaccagatgcagttcaccc

SEQ ID NO: 184994 - DNA, 20 bp, Artificial
  CRISPR gRNA sequence
gatgcagttcacccaggctg

SEQ ID NO: 184995 - DNA, 20 bp, Artificial
  CRISPR gRNA sequence
tgcagttcacccaggctgtg

SEQ ID NO: 184996 - DNA, 20 bp, Artificial
  CRISPR gRNA sequence
gcagttcacccaggctgtgg

SEQ ID NO: 184997 - DNA, 20 bp, Artificial
  CRISPR gRNA sequence
ttcacccaggctgtggaggt

SEQ ID NO: 184998 - DNA, 20 bp, Artificial
  CRISPR gRNA sequence
tcacccaggctgtggaggtg

SEQ ID NO: 184999 - DNA, 20 bp, Artificial
  CRISPR gRNA sequence
gtccctccaccttcactccc

SEQ ID NO: 185000 - DNA, 20 bp, Artificial
  CRISPR gRNA sequence
cccagtgtgattccttcctc

SEQ ID NO: 185001 - DNA, 20 bp, Artificial
  CRISPR gRNA sequence
tgtgattccttcctctggcc

SEQ ID NO: 185002 - DNA, 20 bp, Artificial
  CRISPR gRNA sequence
cttcttgcttcacataatgc

SEQ ID NO: 185003 - DNA, 20 bp, Artificial
  CRISPR gRNA sequence
ttgcttcacataatgctggc

SEQ ID NO: 185004 - DNA, 20 bp, Artificial
  CRISPR gRNA sequence
cttcacataatgctggcaag

SEQ ID NO: 185005 - DNA, 20 bp, Artificial
  CRISPR gRNA sequence
tcactattcttacctccctc

SEQ ID NO: 185006 - DNA, 20 bp, Artificial
  CRISPR gRNA sequence
cactattcttacctccctct

SEQ ID NO: 185007 - DNA, 20 bp, Artificial
  CRISPR gRNA sequence
gtactgctctccatctaccc

SEQ ID NO: 185008 - DNA, 20 bp, Artificial
  CRISPR gRNA sequence
actgctctccatctacccca

SEQ ID NO: 185009 - DNA, 20 bp, Artificial
  CRISPR gRNA sequence
tctccatctaccccagagta

SEQ ID NO: 185010 - DNA, 20 bp, Artificial
  CRISPR gRNA sequence
ccatctaccccagagtacag

SEQ ID NO: 185011 - DNA, 20 bp, Artificial
  CRISPR gRNA sequence
catctaccccagagtacaga

SEQ ID NO: 185012 - DNA, 20 bp, Artificial
  CRISPR gRNA sequence
ccccagagtacagaaggctg

SEQ ID NO: 185013 - DNA, 20 bp, Artificial
  CRISPR gRNA sequence
cccagagtacagaaggctgt

SEQ ID NO: 185014 - DNA, 20 bp, Artificial
  CRISPR gRNA sequence
acagaaggctgtgggctcct

SEQ ID NO: 185015 - DNA, 20 bp, Artificial
  CRISPR gRNA sequence
agaaggctgtgggctcctca

SEQ ID NO: 185016 - DNA, 20 bp, Artificial
  CRISPR gRNA sequence
gctcctcagagaaaatattt

SEQ ID NO: 185017 - DNA, 20 bp, Artificial
  CRISPR gRNA sequence
agagaaaatatttgagtacc

SEQ ID NO: 185018 - DNA, 20 bp, Artificial
  CRISPR gRNA sequence
cgcacccctcgctgcccacc

SEQ ID NO: 185019 - DNA, 20 bp, Artificial
  CRISPR gRNA sequence
acccctcgctgcccacccag

SEQ ID NO: 185020 - DNA, 20 bp, Artificial
  CRISPR gRNA sequence
tctgttgactcccttacact

SEQ ID NO: 185021 - DNA, 20 bp, Artificial
  CRISPR gRNA sequence
tgttgactcccttacacttg

SEQ ID NO: 185022 - DNA, 20 bp, Artificial
  CRISPR gRNA sequence
gttgactcccttacacttgg

SEQ ID NO: 185023 - DNA, 20 bp, Artificial
  CRISPR gRNA sequence
ttgactcccttacacttgga

SEQ ID NO: 185024 - DNA, 20 bp, Artificial
  CRISPR gRNA sequence
tacacttggagggccttgtc

SEQ ID NO: 185025 - DNA, 20 bp, Artificial
  CRISPR gRNA sequence
ggagggccttgtccagttcc

SEQ ID NO: 185026 - DNA, 20 bp, Artificial
  CRISPR gRNA sequence
ctttgcctacccaaaccgcc

SEQ ID NO: 185027 - DNA, 20 bp, Artificial
  CRISPR gRNA sequence
cccaaaccgcccagatgtct

SEQ ID NO: 185028 - DNA, 20 bp, Artificial
  CRISPR gRNA sequence
gcccagatgtcttagtgcta

SEQ ID NO: 185029 - DNA, 20 bp, Artificial
  CRISPR gRNA sequence
cccagatgtcttagtgctac

SEQ ID NO: 185030 - DNA, 20 bp, Artificial
  CRISPR gRNA sequence
taccactccctgtattccac

SEQ ID NO: 185031 - DNA, 20 bp, Artificial
  CRISPR gRNA sequence
ctaaattttcttcctgcctt

SEQ ID NO: 185032 - DNA, 20 bp, Artificial
  CRISPR gRNA sequence
ccttcagcctgcttactgcc

SEQ ID NO: 185033 - DNA, 20 bp, Artificial
  CRISPR gRNA sequence
atatcctccctaacccttta

SEQ ID NO: 185034 - DNA, 20 bp, Artificial
  CRISPR gRNA sequence
tatcctccctaaccctttaa

SEQ ID NO: 185035 - DNA, 20 bp, Artificial
  CRISPR gRNA sequence
ccctaaccctttaaaggcaa

SEQ ID NO: 185036 - DNA, 20 bp, Artificial
  CRISPR gRNA sequence
taaccctttaaaggcaatgg

SEQ ID NO: 185037 - DNA, 20 bp, Artificial
  CRISPR gRNA sequence
aaccctttaaaggcaatggt

SEQ ID NO: 185038 - DNA, 20 bp, Artificial
  CRISPR gRNA sequence
cataaatcttccccaaactc

SEQ ID NO: 185039 - DNA, 20 bp, Artificial
  CRISPR gRNA sequence
cttccccaaactcaagaacc

SEQ ID NO: 185040 - DNA, 20 bp, Artificial
  CRISPR gRNA sequence
ccaaactcaagaacccagtt

SEQ ID NO: 185041 - DNA, 20 bp, Artificial
  CRISPR gRNA sequence
caaactcaagaacccagttt

SEQ ID NO: 185042 - DNA, 20 bp, Artificial
  CRISPR gRNA sequence
gaacccagtttgggcttcca

SEQ ID NO: 185043 - DNA, 20 bp, Artificial
  CRISPR gRNA sequence
acccagtttgggcttccaaa

SEQ ID NO: 185044 - DNA, 20 bp, Artificial
  CRISPR gRNA sequence
tttgggcttccaaagagaat

SEQ ID NO: 185045 - DNA, 20 bp, Artificial
  CRISPR gRNA sequence
tgggcttccaaagagaatga

SEQ ID NO: 185046 - DNA, 20 bp, Artificial
  CRISPR gRNA sequence
gcttccaaagagaatgagag

SEQ ID NO: 185047 - DNA, 20 bp, Artificial
  CRISPR gRNA sequence
ttccaaagagaatgagagaa

SEQ ID NO: 185048 - DNA, 20 bp, Artificial
  CRISPR gRNA sequence
tccaaagagaatgagagaag

SEQ ID NO: 185049 - DNA, 20 bp, Artificial
  CRISPR gRNA sequence
gaatgagagaagaggtttcg

SEQ ID NO: 185050 - DNA, 20 bp, Artificial
  CRISPR gRNA sequence
atgagagaagaggtttcgaa

SEQ ID NO: 185051 - DNA, 20 bp, Artificial
  CRISPR gRNA sequence
gagagaagaggtttcgaaga

SEQ ID NO: 185052 - DNA, 20 bp, Artificial
  CRISPR gRNA sequence
agagagtgctctcacgttcc

SEQ ID NO: 185053 - DNA, 20 bp, Artificial
  CRISPR gRNA sequence
gagagtgctctcacgttcca

SEQ ID NO: 185054 - DNA, 20 bp, Artificial
  CRISPR gRNA sequence
cacgttccaaggaattgctg

SEQ ID NO: 185055 - DNA, 20 bp, Artificial
  CRISPR gRNA sequence
tgcagcaaaatctgtgtctt

SEQ ID NO: 185056 - DNA, 20 bp, Artificial
  CRISPR gRNA sequence
tttccttttcctttgtaatt

SEQ ID NO: 185057 - DNA, 20 bp, Artificial
  CRISPR gRNA sequence
aatgtgatttttccctttcc

SEQ ID NO: 185058 - DNA, 20 bp, Artificial
  CRISPR gRNA sequence
gtgatttttccctttcctgg

SEQ ID NO: 185059 - DNA, 20 bp, Artificial
  CRISPR gRNA sequence
tcctggtggtatctgacatc

SEQ ID NO: 185060 - DNA, 20 bp, Artificial
  CRISPR gRNA sequence
ggtatctgacatcaagtgtg

SEQ ID NO: 185061 - DNA, 20 bp, Artificial
  CRISPR gRNA sequence
ctgacatcaagtgtgtggca

SEQ ID NO: 185062 - DNA, 20 bp, Artificial
  CRISPR gRNA sequence
acatcaagtgtgtggcatag

SEQ ID NO: 185063 - DNA, 20 bp, Artificial
  CRISPR gRNA sequence
agtgtgtggcatagtggtgc

SEQ ID NO: 185064 - DNA, 20 bp, Artificial
  CRISPR gRNA sequence
gtgtgtggcatagtggtgct

SEQ ID NO: 185065 - DNA, 20 bp, Artificial
  CRISPR gRNA sequence
cttcttctatctctactcct

SEQ ID NO: 185066 - DNA, 20 bp, Artificial
  CRISPR gRNA sequence
ttcttctatctctactcctt

SEQ ID NO: 185067 - DNA, 20 bp, Artificial
  CRISPR gRNA sequence
tcttctatctctactccttg

SEQ ID NO: 185068 - DNA, 20 bp, Artificial
  CRISPR gRNA sequence
ttctatctctactccttggg

SEQ ID NO: 185069 - DNA, 20 bp, Artificial
  CRISPR gRNA sequence
tctatctctactccttgggg

SEQ ID NO: 185070 - DNA, 20 bp, Artificial
  CRISPR gRNA sequence
ctccttggggaggcatcacc

SEQ ID NO: 185071 - DNA, 20 bp, Artificial
  CRISPR gRNA sequence
cacccagaaatctgtgcatg

SEQ ID NO: 185072 - DNA, 20 bp, Artificial
  CRISPR gRNA sequence
acccagaaatctgtgcatgt

SEQ ID NO: 185073 - DNA, 20 bp, Artificial
  CRISPR gRNA sequence
ccagaaatctgtgcatgtgg

SEQ ID NO: 185074 - DNA, 20 bp, Artificial
  CRISPR gRNA sequence
cagaaatctgtgcatgtggg

SEQ ID NO: 185075 - DNA, 20 bp, Artificial
  CRISPR gRNA sequence
agaaatctgtgcatgtggga

SEQ ID NO: 185076 - DNA, 20 bp, Artificial
  CRISPR gRNA sequence
aatctgtgcatgtgggaggg

SEQ ID NO: 185077 - DNA, 20 bp, Artificial
  CRISPR gRNA sequence
atctgtgcatgtgggagggt

SEQ ID NO: 185078 - DNA, 20 bp, Artificial
  CRISPR gRNA sequence
ctgtgcatgtgggagggtag

SEQ ID NO: 185079 - DNA, 20 bp, Artificial
  CRISPR gRNA sequence
atatttccctgtttttcttc

SEQ ID NO: 185080 - DNA, 20 bp, Artificial
  CRISPR gRNA sequence
tatttccctgtttttcttct

SEQ ID NO: 185081 - DNA, 20 bp, Artificial
  CRISPR gRNA sequence
atttccctgtttttcttctg

SEQ ID NO: 185082 - DNA, 20 bp, Artificial
  CRISPR gRNA sequence
ccctgtttttcttctggggt

SEQ ID NO: 185083 - DNA, 20 bp, Artificial
  CRISPR gRNA sequence
aagacatcatgctatgtaac

SEQ ID NO: 185084 - DNA, 20 bp, Artificial
  CRISPR gRNA sequence
agacatcatgctatgtaaca

SEQ ID NO: 185085 - DNA, 20 bp, Artificial
  CRISPR gRNA sequence
aacaaggcaatgacactctc

SEQ ID NO: 185086 - DNA, 20 bp, Artificial
  CRISPR gRNA sequence
acaaggcaatgacactctca

SEQ ID NO: 185087 - DNA, 20 bp, Artificial
  CRISPR gRNA sequence
ggcaatgacactctcaaggt

SEQ ID NO: 185088 - DNA, 20 bp, Artificial
  CRISPR gRNA sequence
caatgacactctcaaggtta

SEQ ID NO: 185089 - DNA, 20 bp, Artificial
  CRISPR gRNA sequence
aatgacactctcaaggttag

SEQ ID NO: 185090 - DNA, 20 bp, Artificial
  CRISPR gRNA sequence
actctcaaggttagaggcct

SEQ ID NO: 185091 - DNA, 20 bp, Artificial
  CRISPR gRNA sequence
ctcaaggttagaggccttgg

SEQ ID NO: 185092 - DNA, 20 bp, Artificial
  CRISPR gRNA sequence
cctcttatcgtgtgcttctc

SEQ ID NO: 185093 - DNA, 20 bp, Artificial
  CRISPR gRNA sequence
tcgtgtgcttctctggcctc

SEQ ID NO: 185094 - DNA, 20 bp, Artificial
  CRISPR gRNA sequence
cgtgtgcttctctggcctct

SEQ ID NO: 185095 - DNA, 20 bp, Artificial
  CRISPR gRNA sequence
gtgtgcttctctggcctcta

SEQ ID NO: 185096 - DNA, 20 bp, Artificial
  CRISPR gRNA sequence
tgtgcttctctggcctctag

SEQ ID NO: 185097 - DNA, 20 bp, Artificial
  CRISPR gRNA sequence
ctgacattcaccctacgccc

SEQ ID NO: 185098 - DNA, 20 bp, Artificial
  CRISPR gRNA sequence
cattcaccctacgccctggc

SEQ ID NO: 185099 - DNA, 20 bp, Artificial
  CRISPR gRNA sequence
attcaccctacgccctggcg

SEQ ID NO: 185100 - DNA, 20 bp, Artificial
  CRISPR gRNA sequence
cctacgccctggcgaggtga

SEQ ID NO: 185101 - DNA, 20 bp, Artificial
  CRISPR gRNA sequence
ccctggcgaggtgacggcgc

SEQ ID NO: 185102 - DNA, 20 bp, Artificial
  CRISPR gRNA sequence
tggcgaggtgacggcgctgg

SEQ ID NO: 185103 - DNA, 20 bp, Artificial
  CRISPR gRNA sequence
ggcgaggtgacggcgctggt

SEQ ID NO: 185104 - DNA, 20 bp, Artificial
  CRISPR gRNA sequence
acggcgctggtgggacccaa

SEQ ID NO: 185105 - DNA, 20 bp, Artificial
  CRISPR gRNA sequence
cggcgctggtgggacccaat

SEQ ID NO: 185106 - DNA, 20 bp, Artificial
  CRISPR gRNA sequence
ctggtgggacccaatgggtc

SEQ ID NO: 185107 - DNA, 20 bp, Artificial
  CRISPR gRNA sequence
tggtgggacccaatgggtct

SEQ ID NO: 185108 - DNA, 20 bp, Artificial
  CRISPR gRNA sequence
tgggacccaatgggtctggg

SEQ ID NO: 185109 - DNA, 20 bp, Artificial
  CRISPR gRNA sequence
ggacccaatgggtctgggaa

SEQ ID NO: 185110 - DNA, 20 bp, Artificial
  CRISPR gRNA sequence
caatgggtctgggaagagca

SEQ ID NO: 185111 - DNA, 20 bp, Artificial
  CRISPR gRNA sequence
tgggtctgggaagagcacag

SEQ ID NO: 185112 - DNA, 20 bp, Artificial
  CRISPR gRNA sequence
gcacagtggctgccctgctg

SEQ ID NO: 185113 - DNA, 20 bp, Artificial
  CRISPR gRNA sequence
ccctgctgcagaatctgtac

SEQ ID NO: 185114 - DNA, 20 bp, Artificial
  CRISPR gRNA sequence
cagaatctgtaccagcccac

SEQ ID NO: 185115 - DNA, 20 bp, Artificial
  CRISPR gRNA sequence
agaatctgtaccagcccacc

SEQ ID NO: 185116 - DNA, 20 bp, Artificial
  CRISPR gRNA sequence
gaatctgtaccagcccaccg

SEQ ID NO: 185117 - DNA, 20 bp, Artificial
  CRISPR gRNA sequence
aatctgtaccagcccaccgg

SEQ ID NO: 185118 - DNA, 20 bp, Artificial
  CRISPR gRNA sequence
tgtaccagcccaccggggga

SEQ ID NO: 185119 - DNA, 20 bp, Artificial
  CRISPR gRNA sequence
caccgggggacagctgctgt

SEQ ID NO: 185120 - DNA, 20 bp, Artificial
  CRISPR gRNA sequence
gggggacagctgctgttgga

SEQ ID NO: 185121 - DNA, 20 bp, Artificial
  CRISPR gRNA sequence
ggggacagctgctgttggat

SEQ ID NO: 185122 - DNA, 20 bp, Artificial
  CRISPR gRNA sequence
gacagctgctgttggatggg

SEQ ID NO: 185123 - DNA, 20 bp, Artificial
  CRISPR gRNA sequence
ggaagccccttccccaatat

SEQ ID NO: 185124 - DNA, 20 bp, Artificial
  CRISPR gRNA sequence
tatgagcaccgctacctgca

SEQ ID NO: 185125 - DNA, 20 bp, Artificial
  CRISPR gRNA sequence
atgagcaccgctacctgcac

SEQ ID NO: 185126 - DNA, 20 bp, Artificial
  CRISPR gRNA sequence
agcaccgctacctgcacagg

SEQ ID NO: 185127 - DNA, 20 bp, Artificial
  CRISPR gRNA sequence
gcaccgctacctgcacaggc

SEQ ID NO: 185128 - DNA, 20 bp, Artificial
  CRISPR gRNA sequence
gctacctgcacaggcaggta

SEQ ID NO: 185129 - DNA, 20 bp, Artificial
  CRISPR gRNA sequence
acctgcacaggcaggtatgg

SEQ ID NO: 185130 - DNA, 20 bp, Artificial
  CRISPR gRNA sequence
tgcacaggcaggtatggaag

SEQ ID NO: 185131 - DNA, 20 bp, Artificial
  CRISPR gRNA sequence
gcacaggcaggtatggaagc

SEQ ID NO: 185132 - DNA, 20 bp, Artificial
  CRISPR gRNA sequence
caggcaggtatggaagcagg

SEQ ID NO: 185133 - DNA, 20 bp, Artificial
  CRISPR gRNA sequence
gtatggaagcaggtggcttg

SEQ ID NO: 185134 - DNA, 20 bp, Artificial
  CRISPR gRNA sequence
tatggaagcaggtggcttga

SEQ ID NO: 185135 - DNA, 20 bp, Artificial
  CRISPR gRNA sequence
tggaagcaggtggcttgaag

SEQ ID NO: 185136 - DNA, 20 bp, Artificial
  CRISPR gRNA sequence
ggaagcaggtggcttgaagg

SEQ ID NO: 185137 - DNA, 20 bp, Artificial
  CRISPR gRNA sequence
gaagcaggtggcttgaagga

SEQ ID NO: 185138 - DNA, 20 bp, Artificial
  CRISPR gRNA sequence
gcaggtggcttgaaggaggg

SEQ ID NO: 185139 - DNA, 20 bp, Artificial
  CRISPR gRNA sequence
caggtggcttgaaggagggc

SEQ ID NO: 185140 - DNA, 20 bp, Artificial
  CRISPR gRNA sequence
aggtggcttgaaggagggca

SEQ ID NO: 185141 - DNA, 20 bp, Artificial
  CRISPR gRNA sequence
gtggcttgaaggagggcagg

SEQ ID NO: 185142 - DNA, 20 bp, Artificial
  CRISPR gRNA sequence
ggcagggagcatcaaatacg

SEQ ID NO: 185143 - DNA, 20 bp, Artificial
  CRISPR gRNA sequence
cagggagcatcaaatacgaa

SEQ ID NO: 185144 - DNA, 20 bp, Artificial
  CRISPR gRNA sequence
atacgaagagcattcttact

SEQ ID NO: 185145 - DNA, 20 bp, Artificial
  CRISPR gRNA sequence
attcttactgagcactctga

SEQ ID NO: 185146 - DNA, 20 bp, Artificial
  CRISPR gRNA sequence
tcttactgagcactctgaaa

SEQ ID NO: 185147 - DNA, 20 bp, Artificial
  CRISPR gRNA sequence
cttactgagcactctgaaag

SEQ ID NO: 185148 - DNA, 20 bp, Artificial
  CRISPR gRNA sequence
ttactgagcactctgaaaga

SEQ ID NO: 185149 - DNA, 20 bp, Artificial
  CRISPR gRNA sequence
tactgagcactctgaaagag

SEQ ID NO: 185150 - DNA, 20 bp, Artificial
  CRISPR gRNA sequence
gagcactctgaaagaggggt

SEQ ID NO: 185151 - DNA, 20 bp, Artificial
  CRISPR gRNA sequence
agcactctgaaagaggggtt

SEQ ID NO: 185152 - DNA, 20 bp, Artificial
  CRISPR gRNA sequence
gcactctgaaagaggggtta

SEQ ID NO: 185153 - DNA, 20 bp, Artificial
  CRISPR gRNA sequence
aagaggggttagggaatgat

SEQ ID NO: 185154 - DNA, 20 bp, Artificial
  CRISPR gRNA sequence
gaggggttagggaatgataa

SEQ ID NO: 185155 - DNA, 20 bp, Artificial
  CRISPR gRNA sequence
tagggaatgataagagacct

SEQ ID NO: 185156 - DNA, 20 bp, Artificial
  CRISPR gRNA sequence
agggaatgataagagacctt

SEQ ID NO: 185157 - DNA, 20 bp, Artificial
  CRISPR gRNA sequence
gaatgataagagaccttggg

SEQ ID NO: 185158 - DNA, 20 bp, Artificial
  CRISPR gRNA sequence
atgataagagaccttgggtg

SEQ ID NO: 185159 - DNA, 20 bp, Artificial
  CRISPR gRNA sequence
taagagaccttgggtggaga

SEQ ID NO: 185160 - DNA, 20 bp, Artificial
  CRISPR gRNA sequence
gagaccttgggtggagatgg

SEQ ID NO: 185161 - DNA, 20 bp, Artificial
  CRISPR gRNA sequence
cttgggtggagatggtggtg

SEQ ID NO: 185162 - DNA, 20 bp, Artificial
  CRISPR gRNA sequence
ggtggagatggtggtgtagt

SEQ ID NO: 185163 - DNA, 20 bp, Artificial
  CRISPR gRNA sequence
gtggagatggtggtgtagtc

SEQ ID NO: 185164 - DNA, 20 bp, Artificial
  CRISPR gRNA sequence
ggagatggtggtgtagtcag

SEQ ID NO: 185165 - DNA, 20 bp, Artificial
  CRISPR gRNA sequence
gagatggtggtgtagtcagg

SEQ ID NO: 185166 - DNA, 20 bp, Artificial
  CRISPR gRNA sequence
agatggtggtgtagtcagga

SEQ ID NO: 185167 - DNA, 20 bp, Artificial
  CRISPR gRNA sequence
atggtggtgtagtcaggagg

SEQ ID NO: 185168 - DNA, 20 bp, Artificial
  CRISPR gRNA sequence
tggtggtgtagtcaggaggg

SEQ ID NO: 185169 - DNA, 20 bp, Artificial
  CRISPR gRNA sequence
tggtgtagtcaggagggagg

SEQ ID NO: 185170 - DNA, 20 bp, Artificial
  CRISPR gRNA sequence
tttgtgacatgttctcaata

SEQ ID NO: 185171 - DNA, 20 bp, Artificial
  CRISPR gRNA sequence
atgttctcaataaagatttt

SEQ ID NO: 185172 - DNA, 20 bp, Artificial
  CRISPR gRNA sequence
gattttgagtcttcgatctc

SEQ ID NO: 185173 - DNA, 20 bp, Artificial
  CRISPR gRNA sequence
ctcttcatcatatttcatct

SEQ ID NO: 185174 - DNA, 20 bp, Artificial
  CRISPR gRNA sequence
tcttcatcatatttcatctc

SEQ ID NO: 185175 - DNA, 20 bp, Artificial
  CRISPR gRNA sequence
tcatcatatttcatctcagg

SEQ ID NO: 185176 - DNA, 20 bp, Artificial
  CRISPR gRNA sequence
tatttcatctcaggtggctg

SEQ ID NO: 185177 - DNA, 20 bp, Artificial
  CRISPR gRNA sequence
ttcatctcaggtggctgcag

SEQ ID NO: 185178 - DNA, 20 bp, Artificial
  CRISPR gRNA sequence
tcatctcaggtggctgcagt

SEQ ID NO: 185179 - DNA, 20 bp, Artificial
  CRISPR gRNA sequence
tcaggtggctgcagtgggac

SEQ ID NO: 185180 - DNA, 20 bp, Artificial
  CRISPR gRNA sequence
aggtggctgcagtgggacaa

SEQ ID NO: 185181 - DNA, 20 bp, Artificial
  CRISPR gRNA sequence
ctgcagtgggacaagagcca

SEQ ID NO: 185182 - DNA, 20 bp, Artificial
  CRISPR gRNA sequence
tgcagtgggacaagagccac

SEQ ID NO: 185183 - DNA, 20 bp, Artificial
  CRISPR gRNA sequence
ggacaagagccacaggtatt

SEQ ID NO: 185184 - DNA, 20 bp, Artificial
  CRISPR gRNA sequence
caagagccacaggtatttgg

SEQ ID NO: 185185 - DNA, 20 bp, Artificial
  CRISPR gRNA sequence
gagccacaggtatttggaag

SEQ ID NO: 185186 - DNA, 20 bp, Artificial
  CRISPR gRNA sequence
ggtatttggaagaagtcttc

SEQ ID NO: 185187 - DNA, 20 bp, Artificial
  CRISPR gRNA sequence
cttcaagaaaatattgccta

SEQ ID NO: 185188 - DNA, 20 bp, Artificial
  CRISPR gRNA sequence
atattgcctatggcctgacc

SEQ ID NO: 185189 - DNA, 20 bp, Artificial
  CRISPR gRNA sequence
ttgcctatggcctgacccag

SEQ ID NO: 185190 - DNA, 20 bp, Artificial
  CRISPR gRNA sequence
cctgacccagaagccaacta

SEQ ID NO: 185191 - DNA, 20 bp, Artificial
  CRISPR gRNA sequence
tgacccagaagccaactatg

SEQ ID NO: 185192 - DNA, 20 bp, Artificial
  CRISPR gRNA sequence
gacccagaagccaactatgg

SEQ ID NO: 185193 - DNA, 20 bp, Artificial
  CRISPR gRNA sequence
gccaactatggaggaaatca

SEQ ID NO: 185194 - DNA, 20 bp, Artificial
  CRISPR gRNA sequence
ggaggaaatcacagctgctg

SEQ ID NO: 185195 - DNA, 20 bp, Artificial
  CRISPR gRNA sequence
aaatcacagctgctgcagta

SEQ ID NO: 185196 - DNA, 20 bp, Artificial
  CRISPR gRNA sequence
acagctgctgcagtaaagtc

SEQ ID NO: 185197 - DNA, 20 bp, Artificial
  CRISPR gRNA sequence
cagctgctgcagtaaagtct

SEQ ID NO: 185198 - DNA, 20 bp, Artificial
  CRISPR gRNA sequence
agctgctgcagtaaagtctg

SEQ ID NO: 185199 - DNA, 20 bp, Artificial
  CRISPR gRNA sequence
gcagtaaagtctggggccca

SEQ ID NO: 185200 - DNA, 20 bp, Artificial
  CRISPR gRNA sequence
ggggcccatagtttcatctc

SEQ ID NO: 185201 - DNA, 20 bp, Artificial
  CRISPR gRNA sequence
gtttcatctctggactccct

SEQ ID NO: 185202 - DNA, 20 bp, Artificial
  CRISPR gRNA sequence
tttcatctctggactccctc

SEQ ID NO: 185203 - DNA, 20 bp, Artificial
  CRISPR gRNA sequence
ttcatctctggactccctca

SEQ ID NO: 185204 - DNA, 20 bp, Artificial
  CRISPR gRNA sequence
actccctcagggctatgaca

SEQ ID NO: 185205 - DNA, 20 bp, Artificial
  CRISPR gRNA sequence
ctccctcagggctatgacac

SEQ ID NO: 185206 - DNA, 20 bp, Artificial
  CRISPR gRNA sequence
tctccactcatctcaccacc

SEQ ID NO: 185207 - DNA, 20 bp, Artificial
  CRISPR gRNA sequence
ctttacctttgctgaaaccc

SEQ ID NO: 185208 - DNA, 20 bp, Artificial
  CRISPR gRNA sequence
tacctttgctgaaaccccag

SEQ ID NO: 185209 - DNA, 20 bp, Artificial
  CRISPR gRNA sequence
gtagtcttgcctttatcctt

SEQ ID NO: 185210 - DNA, 20 bp, Artificial
  CRISPR gRNA sequence
cttcagttcctccttactca

SEQ ID NO: 185211 - DNA, 20 bp, Artificial
  CRISPR gRNA sequence
tactcatggacatcaatttg

SEQ ID NO: 185212 - DNA, 20 bp, Artificial
  CRISPR gRNA sequence
ggacatcaatttgaagttgt

SEQ ID NO: 185213 - DNA, 20 bp, Artificial
  CRISPR gRNA sequence
gttgtaagatcatgctccta

SEQ ID NO: 185214 - DNA, 20 bp, Artificial
  CRISPR gRNA sequence
cttcttcatcctgacatcct

SEQ ID NO: 185215 - DNA, 20 bp, Artificial
  CRISPR gRNA sequence
ttcttcatcctgacatcctc

SEQ ID NO: 185216 - DNA, 20 bp, Artificial
  CRISPR gRNA sequence
caggattctgttcatcttcc

SEQ ID NO: 185217 - DNA, 20 bp, Artificial
  CRISPR gRNA sequence
ttcccagaatctcccctatc

SEQ ID NO: 185218 - DNA, 20 bp, Artificial
  CRISPR gRNA sequence
ccctatccagctacaaccgt

SEQ ID NO: 185219 - DNA, 20 bp, Artificial
  CRISPR gRNA sequence
cagctacaaccgtcagatct

SEQ ID NO: 185220 - DNA, 20 bp, Artificial
  CRISPR gRNA sequence
cgtcagatcttggtgtgtgt

SEQ ID NO: 185221 - DNA, 20 bp, Artificial
  CRISPR gRNA sequence
gtgtgagtgcgtgaatgcat

SEQ ID NO: 185222 - DNA, 20 bp, Artificial
  CRISPR gRNA sequence
tgtacatgcgtgcacacatg

SEQ ID NO: 185223 - DNA, 20 bp, Artificial
  CRISPR gRNA sequence
tggctataccgttctcatct

SEQ ID NO: 185224 - DNA, 20 bp, Artificial
  CRISPR gRNA sequence
catcttggccctttgctctg

SEQ ID NO: 185225 - DNA, 20 bp, Artificial
  CRISPR gRNA sequence
tcttggccctttgctctgca

SEQ ID NO: 185226 - DNA, 20 bp, Artificial
  CRISPR gRNA sequence
cttggccctttgctctgcag

SEQ ID NO: 185227 - DNA, 20 bp, Artificial
  CRISPR gRNA sequence
ggccctttgctctgcagagg

SEQ ID NO: 185228 - DNA, 20 bp, Artificial
  CRISPR gRNA sequence
tttgctctgcagaggtagac

SEQ ID NO: 185229 - DNA, 20 bp, Artificial
  CRISPR gRNA sequence
ttgctctgcagaggtagacg

SEQ ID NO: 185230 - DNA, 20 bp, Artificial
  CRISPR gRNA sequence
tctgcagaggtagacgaggc

SEQ ID NO: 185231 - DNA, 20 bp, Artificial
  CRISPR gRNA sequence
ctgcagaggtagacgaggct

SEQ ID NO: 185232 - DNA, 20 bp, Artificial
  CRISPR gRNA sequence
gcagaggtagacgaggctgg

SEQ ID NO: 185233 - DNA, 20 bp, Artificial
  CRISPR gRNA sequence
aggtagacgaggctgggagc

SEQ ID NO: 185234 - DNA, 20 bp, Artificial
  CRISPR gRNA sequence
cgaggctgggagccagctgt

SEQ ID NO: 185235 - DNA, 20 bp, Artificial
  CRISPR gRNA sequence
gaggctgggagccagctgtc

SEQ ID NO: 185236 - DNA, 20 bp, Artificial
  CRISPR gRNA sequence
aggctgggagccagctgtca

SEQ ID NO: 185237 - DNA, 20 bp, Artificial
  CRISPR gRNA sequence
ggctgggagccagctgtcag

SEQ ID NO: 185238 - DNA, 20 bp, Artificial
  CRISPR gRNA sequence
gctgggagccagctgtcagg

SEQ ID NO: 185239 - DNA, 20 bp, Artificial
  CRISPR gRNA sequence
ggagccagctgtcagggggt

SEQ ID NO: 185240 - DNA, 20 bp, Artificial
  CRISPR gRNA sequence
agctgtcagggggtcagcga

SEQ ID NO: 185241 - DNA, 20 bp, Artificial
  CRISPR gRNA sequence
gctgtcagggggtcagcgac

SEQ ID NO: 185242 - DNA, 20 bp, Artificial
  CRISPR gRNA sequence
gtcagggggtcagcgacagg

SEQ ID NO: 185243 - DNA, 20 bp, Artificial
  CRISPR gRNA sequence
agggggtcagcgacaggcag

SEQ ID NO: 185244 - DNA, 20 bp, Artificial
  CRISPR gRNA sequence
tcagcgacaggcagtggcgt

SEQ ID NO: 185245 - DNA, 20 bp, Artificial
  CRISPR gRNA sequence
acaggcagtggcgttggccc

SEQ ID NO: 185246 - DNA, 20 bp, Artificial
  CRISPR gRNA sequence
cgttggcccgagcattgatc

SEQ ID NO: 185247 - DNA, 20 bp, Artificial
  CRISPR gRNA sequence
gaaaccgtgtgtacttatcc

SEQ ID NO: 185248 - DNA, 20 bp, Artificial
  CRISPR gRNA sequence
cttatcctggatgatgccac

SEQ ID NO: 185249 - DNA, 20 bp, Artificial
  CRISPR gRNA sequence
ggatgatgccaccagtgccc

SEQ ID NO: 185250 - DNA, 20 bp, Artificial
  CRISPR gRNA sequence
accagtgccctggatgcaaa

SEQ ID NO: 185251 - DNA, 20 bp, Artificial
  CRISPR gRNA sequence
gtgccctggatgcaaacagc

SEQ ID NO: 185252 - DNA, 20 bp, Artificial
  CRISPR gRNA sequence
tggatgcaaacagccagtta

SEQ ID NO: 185253 - DNA, 20 bp, Artificial
  CRISPR gRNA sequence
ggatgcaaacagccagttac

SEQ ID NO: 185254 - DNA, 20 bp, Artificial
  CRISPR gRNA sequence
gcaaacagccagttacaggt

SEQ ID NO: 185255 - DNA, 20 bp, Artificial
  CRISPR gRNA sequence
caaacagccagttacaggtg

SEQ ID NO: 185256 - DNA, 20 bp, Artificial
  CRISPR gRNA sequence
acagccagttacaggtgagg

SEQ ID NO: 185257 - DNA, 20 bp, Artificial
  CRISPR gRNA sequence
tgaggcagtcatcttcttaa

SEQ ID NO: 185258 - DNA, 20 bp, Artificial
  CRISPR gRNA sequence
ttcttttatacatcttctgt

SEQ ID NO: 185259 - DNA, 20 bp, Artificial
  CRISPR gRNA sequence
aacatcataattatacaaac

SEQ ID NO: 185260 - DNA, 20 bp, Artificial
  CRISPR gRNA sequence
attatacaaaccagtccttg

SEQ ID NO: 185261 - DNA, 20 bp, Artificial
  CRISPR gRNA sequence
aaaccagtccttgcagttct

SEQ ID NO: 185262 - DNA, 20 bp, Artificial
  CRISPR gRNA sequence
cagttctcagttcccaaatc

SEQ ID NO: 185263 - DNA, 20 bp, Artificial
  CRISPR gRNA sequence
gttcccaaatccagttccat

SEQ ID NO: 185264 - DNA, 20 bp, Artificial
  CRISPR gRNA sequence
gttccattggatgcctcccc

SEQ ID NO: 185265 - DNA, 20 bp, Artificial
  CRISPR gRNA sequence
ttccattggatgcctcccca

SEQ ID NO: 185266 - DNA, 20 bp, Artificial
  CRISPR gRNA sequence
ccattggatgcctccccaag

SEQ ID NO: 185267 - DNA, 20 bp, Artificial
  CRISPR gRNA sequence
ttggatgcctccccaaggag

SEQ ID NO: 185268 - DNA, 20 bp, Artificial
  CRISPR gRNA sequence
ggatgcctccccaaggagta

SEQ ID NO: 185269 - DNA, 20 bp, Artificial
  CRISPR gRNA sequence
gcctccccaaggagtagaga

SEQ ID NO: 185270 - DNA, 20 bp, Artificial
  CRISPR gRNA sequence
tccccaaggagtagagatag

SEQ ID NO: 185271 - DNA, 20 bp, Artificial
  CRISPR gRNA sequence
aaggagtagagatagaagac

SEQ ID NO: 185272 - DNA, 20 bp, Artificial
  CRISPR gRNA sequence
aggagtagagatagaagacg

SEQ ID NO: 185273 - DNA, 20 bp, Artificial
  CRISPR gRNA sequence
tagagatagaagacgaggca

SEQ ID NO: 185274 - DNA, 20 bp, Artificial
  CRISPR gRNA sequence
gaagacgaggcaaagacacc

SEQ ID NO: 185275 - DNA, 20 bp, Artificial
  CRISPR gRNA sequence
gaggcaaagacacctagaat

SEQ ID NO: 185276 - DNA, 20 bp, Artificial
  CRISPR gRNA sequence
agacacctagaatcagttaa

SEQ ID NO: 185277 - DNA, 20 bp, Artificial
  CRISPR gRNA sequence
acacctagaatcagttaaaa

SEQ ID NO: 185278 - DNA, 20 bp, Artificial
  CRISPR gRNA sequence
aagagactatctacaaacta

SEQ ID NO: 185279 - DNA, 20 bp, Artificial
  CRISPR gRNA sequence
ttctttcctttttttttttt

SEQ ID NO: 185280 - DNA, 20 bp, Artificial
  CRISPR gRNA sequence
ttccttttttttttttaaga

SEQ ID NO: 185281 - DNA, 20 bp, Artificial
  CRISPR gRNA sequence
ttttaagacagtgtctcact

SEQ ID NO: 185282 - DNA, 20 bp, Artificial
  CRISPR gRNA sequence
cagtgtctcactcagttgcc

SEQ ID NO: 185283 - DNA, 20 bp, Artificial
  CRISPR gRNA sequence
agtgtctcactcagttgccc

SEQ ID NO: 185284 - DNA, 20 bp, Artificial
  CRISPR gRNA sequence
tctcactcagttgcccaggc

SEQ ID NO: 185285 - DNA, 20 bp, Artificial
  CRISPR gRNA sequence
tcactcagttgcccaggctg

SEQ ID NO: 185286 - DNA, 20 bp, Artificial
  CRISPR gRNA sequence
cagttgcccaggctggagcg

SEQ ID NO: 185287 - DNA, 20 bp, Artificial
  CRISPR gRNA sequence
ttgcccaggctggagcgcag

SEQ ID NO: 185288 - DNA, 20 bp, Artificial
  CRISPR gRNA sequence
ggagcgcagtggcacaatct

SEQ ID NO: 185289 - DNA, 20 bp, Artificial
  CRISPR gRNA sequence
ggcacaatcttggctcactg

SEQ ID NO: 185290 - DNA, 20 bp, Artificial
  CRISPR gRNA sequence
tcactgcagcttcaacctgc

SEQ ID NO: 185291 - DNA, 20 bp, Artificial
  CRISPR gRNA sequence
cactgcagcttcaacctgct

SEQ ID NO: 185292 - DNA, 20 bp, Artificial
  CRISPR gRNA sequence
agcttcaacctgctgggctc

SEQ ID NO: 185293 - DNA, 20 bp, Artificial
  CRISPR gRNA sequence
ggctcaagcgattctcccct

SEQ ID NO: 185294 - DNA, 20 bp, Artificial
  CRISPR gRNA sequence
gattctcccctcagcctccc

SEQ ID NO: 185295 - DNA, 20 bp, Artificial
  CRISPR gRNA sequence
tctcccctcagcctcccgag

SEQ ID NO: 185296 - DNA, 20 bp, Artificial
  CRISPR gRNA sequence
ccctcagcctcccgagtagc

SEQ ID NO: 185297 - DNA, 20 bp, Artificial
  CRISPR gRNA sequence
cctcagcctcccgagtagct

SEQ ID NO: 185298 - DNA, 20 bp, Artificial
  CRISPR gRNA sequence
ctcccgagtagctgggacta

SEQ ID NO: 185299 - DNA, 20 bp, Artificial
  CRISPR gRNA sequence
tcccgagtagctgggactac

SEQ ID NO: 185300 - DNA, 20 bp, Artificial
  CRISPR gRNA sequence
caggtgtacaccactatgcc

SEQ ID NO: 185301 - DNA, 20 bp, Artificial
  CRISPR gRNA sequence
ctggttgacttttatatttt

SEQ ID NO: 185302 - DNA, 20 bp, Artificial
  CRISPR gRNA sequence
gttgacttttatatttttag

SEQ ID NO: 185303 - DNA, 20 bp, Artificial
  CRISPR gRNA sequence
tgacttttatatttttagta

SEQ ID NO: 185304 - DNA, 20 bp, Artificial
  CRISPR gRNA sequence
ttttatatttttagtagaga

SEQ ID NO: 185305 - DNA, 20 bp, Artificial
  CRISPR gRNA sequence
tttatatttttagtagagat

SEQ ID NO: 185306 - DNA, 20 bp, Artificial
  CRISPR gRNA sequence
atgggtttcaccatgttgcc

SEQ ID NO: 185307 - DNA, 20 bp, Artificial
  CRISPR gRNA sequence
tgggtttcaccatgttgccc

SEQ ID NO: 185308 - DNA, 20 bp, Artificial
  CRISPR gRNA sequence
tttcaccatgttgcccaggc

SEQ ID NO: 185309 - DNA, 20 bp, Artificial
  CRISPR gRNA sequence
caggctggccttgaattcct

SEQ ID NO: 185310 - DNA, 20 bp, Artificial
  CRISPR gRNA sequence
tggccttgaattcctgagct

SEQ ID NO: 185311 - DNA, 20 bp, Artificial
  CRISPR gRNA sequence
ggccttgaattcctgagctc

SEQ ID NO: 185312 - DNA, 20 bp, Artificial
  CRISPR gRNA sequence
ctcaggtaatctgcccccct

SEQ ID NO: 185313 - DNA, 20 bp, Artificial
  CRISPR gRNA sequence
ctgcccccctcagcctccca

SEQ ID NO: 185314 - DNA, 20 bp, Artificial
  CRISPR gRNA sequence
tgcccccctcagcctcccaa

SEQ ID NO: 185315 - DNA, 20 bp, Artificial
  CRISPR gRNA sequence
gcccccctcagcctcccaaa

SEQ ID NO: 185316 - DNA, 20 bp, Artificial
  CRISPR gRNA sequence
ccctcagcctcccaaagggc

SEQ ID NO: 185317 - DNA, 20 bp, Artificial
  CRISPR gRNA sequence
cctcagcctcccaaagggct

SEQ ID NO: 185318 - DNA, 20 bp, Artificial
  CRISPR gRNA sequence
ctcagcctcccaaagggctg

SEQ ID NO: 185319 - DNA, 20 bp, Artificial
  CRISPR gRNA sequence
ctcccaaagggctggggtta

SEQ ID NO: 185320 - DNA, 20 bp, Artificial
  CRISPR gRNA sequence
tcccaaagggctggggttat

SEQ ID NO: 185321 - DNA, 20 bp, Artificial
  CRISPR gRNA sequence
agggctggggttataggtgt

SEQ ID NO: 185322 - DNA, 20 bp, Artificial
  CRISPR gRNA sequence
taggtgtgagccactgcgcc

SEQ ID NO: 185323 - DNA, 20 bp, Artificial
  CRISPR gRNA sequence
agccactgcgcccagtccta

SEQ ID NO: 185324 - DNA, 20 bp, Artificial
  CRISPR gRNA sequence
tcctatagactgaatttcta

SEQ ID NO: 185325 - DNA, 20 bp, Artificial
  CRISPR gRNA sequence
gaatttctaaagcgaaacat

SEQ ID NO: 185326 - DNA, 20 bp, Artificial
  CRISPR gRNA sequence
aatttctaaagcgaaacata

SEQ ID NO: 185327 - DNA, 20 bp, Artificial
  CRISPR gRNA sequence
ctaaagcgaaacataaggaa

SEQ ID NO: 185328 - DNA, 20 bp, Artificial
  CRISPR gRNA sequence
taaaaaaattattttttgta

SEQ ID NO: 185329 - DNA, 20 bp, Artificial
  CRISPR gRNA sequence
aaaattattttttgtacaga

SEQ ID NO: 185330 - DNA, 20 bp, Artificial
  CRISPR gRNA sequence
cagcgtcccgctatgttgcc

SEQ ID NO: 185331 - DNA, 20 bp, Artificial
  CRISPR gRNA sequence
agcgtcccgctatgttgccc

SEQ ID NO: 185332 - DNA, 20 bp, Artificial
  CRISPR gRNA sequence
tcccgctatgttgcccaggc

SEQ ID NO: 185333 - DNA, 20 bp, Artificial
  CRISPR gRNA sequence
ccaggctggccttgaactcc

SEQ ID NO: 185334 - DNA, 20 bp, Artificial
  CRISPR gRNA sequence
caggctggccttgaactcct

SEQ ID NO: 185335 - DNA, 20 bp, Artificial
  CRISPR gRNA sequence
ggccttgaactcctgggccc

SEQ ID NO: 185336 - DNA, 20 bp, Artificial
  CRISPR gRNA sequence
cctccctccttgacctccca

SEQ ID NO: 185337 - DNA, 20 bp, Artificial
  CRISPR gRNA sequence
tccttgacctcccaaagtgc

SEQ ID NO: 185338 - DNA, 20 bp, Artificial
  CRISPR gRNA sequence
ccttgacctcccaaagtgct

SEQ ID NO: 185339 - DNA, 20 bp, Artificial
  CRISPR gRNA sequence
ctcccaaagtgctaggatta

SEQ ID NO: 185340 - DNA, 20 bp, Artificial
  CRISPR gRNA sequence
tcccaaagtgctaggattat

SEQ ID NO: 185341 - DNA, 20 bp, Artificial
  CRISPR gRNA sequence
agtgctaggattataggcat

SEQ ID NO: 185342 - DNA, 20 bp, Artificial
  CRISPR gRNA sequence
ggattataggcatgagccac

SEQ ID NO: 185343 - DNA, 20 bp, Artificial
  CRISPR gRNA sequence
gattataggcatgagccacc

SEQ ID NO: 185344 - DNA, 20 bp, Artificial
  CRISPR gRNA sequence
taggcatgagccaccgggcc

SEQ ID NO: 185345 - DNA, 20 bp, Artificial
  CRISPR gRNA sequence
taatcatattaatattaatt

SEQ ID NO: 185346 - DNA, 20 bp, Artificial
  CRISPR gRNA sequence
catattaatattaattaagc

SEQ ID NO: 185347 - DNA, 20 bp, Artificial
  CRISPR gRNA sequence
actgtcactcatttattcat

SEQ ID NO: 185348 - DNA, 20 bp, Artificial
  CRISPR gRNA sequence
ctgtcactcatttattcatt

SEQ ID NO: 185349 - DNA, 20 bp, Artificial
  CRISPR gRNA sequence
tattcattaggaatccttct

SEQ ID NO: 185350 - DNA, 20 bp, Artificial
  CRISPR gRNA sequence
cattaggaatccttctgagc

SEQ ID NO: 185351 - DNA, 20 bp, Artificial
  CRISPR gRNA sequence
attaggaatccttctgagct

SEQ ID NO: 185352 - DNA, 20 bp, Artificial
  CRISPR gRNA sequence
aggcatttatcatcattcta

SEQ ID NO: 185353 - DNA, 20 bp, Artificial
  CRISPR gRNA sequence
tcattctacagatgacaaaa

SEQ ID NO: 185354 - DNA, 20 bp, Artificial
  CRISPR gRNA sequence
attctacagatgacaaaatg

SEQ ID NO: 185355 - DNA, 20 bp, Artificial
  CRISPR gRNA sequence
ttctacagatgacaaaatgg

SEQ ID NO: 185356 - DNA, 20 bp, Artificial
  CRISPR gRNA sequence
gatgacaaaatggaggttaa

SEQ ID NO: 185357 - DNA, 20 bp, Artificial
  CRISPR gRNA sequence
tgacaaaatggaggttaaaa

SEQ ID NO: 185358 - DNA, 20 bp, Artificial
  CRISPR gRNA sequence
gacaaaatggaggttaaaag

SEQ ID NO: 185359 - DNA, 20 bp, Artificial
  CRISPR gRNA sequence
gaggttaaaagaggttgaat

SEQ ID NO: 185360 - DNA, 20 bp, Artificial
  CRISPR gRNA sequence
ggttgaataagctgctcata

SEQ ID NO: 185361 - DNA, 20 bp, Artificial
  CRISPR gRNA sequence
ttgaataagctgctcatata

SEQ ID NO: 185362 - DNA, 20 bp, Artificial
  CRISPR gRNA sequence
tgaataagctgctcatatag

SEQ ID NO: 185363 - DNA, 20 bp, Artificial
  CRISPR gRNA sequence
ctgctcatatagaggtcata

SEQ ID NO: 185364 - DNA, 20 bp, Artificial
  CRISPR gRNA sequence
atagaggtcatatagctttt

SEQ ID NO: 185365 - DNA, 20 bp, Artificial
  CRISPR gRNA sequence
gaggtcatatagcttttgag

SEQ ID NO: 185366 - DNA, 20 bp, Artificial
  CRISPR gRNA sequence
catatagcttttgagtggcg

SEQ ID NO: 185367 - DNA, 20 bp, Artificial
  CRISPR gRNA sequence
gcgcagccttgacccaaatt

SEQ ID NO: 185368 - DNA, 20 bp, Artificial
  CRISPR gRNA sequence
cgcagccttgacccaaattc

SEQ ID NO: 185369 - DNA, 20 bp, Artificial
  CRISPR gRNA sequence
atgctcatctctttactact

SEQ ID NO: 185370 - DNA, 20 bp, Artificial
  CRISPR gRNA sequence
aaatcgaatataaaaatgcc

SEQ ID NO: 185371 - DNA, 20 bp, Artificial
  CRISPR gRNA sequence
atataaaaatgccaagtcca

SEQ ID NO: 185372 - DNA, 20 bp, Artificial
  CRISPR gRNA sequence
tataaaaatgccaagtccat

SEQ ID NO: 185373 - DNA, 20 bp, Artificial
  CRISPR gRNA sequence
aaaaatgccaagtccatggg

SEQ ID NO: 185374 - DNA, 20 bp, Artificial
  CRISPR gRNA sequence
aaatgccaagtccatgggta

SEQ ID NO: 185375 - DNA, 20 bp, Artificial
  CRISPR gRNA sequence
tgccaagtccatgggtagag

SEQ ID NO: 185376 - DNA, 20 bp, Artificial
  CRISPR gRNA sequence
ccaagtccatgggtagagaa

SEQ ID NO: 185377 - DNA, 20 bp, Artificial
  CRISPR gRNA sequence
caagtccatgggtagagaag

SEQ ID NO: 185378 - DNA, 20 bp, Artificial
  CRISPR gRNA sequence
tagagaagaggactattcaa

SEQ ID NO: 185379 - DNA, 20 bp, Artificial
  CRISPR gRNA sequence
ttctgtcacgtgtttcaccc

SEQ ID NO: 185380 - DNA, 20 bp, Artificial
  CRISPR gRNA sequence
tctgtcacgtgtttcaccct

SEQ ID NO: 185381 - DNA, 20 bp, Artificial
  CRISPR gRNA sequence
ctgtcacgtgtttcacccta

SEQ ID NO: 185382 - DNA, 20 bp, Artificial
  CRISPR gRNA sequence
tttgcacccttcatgtaaaa

SEQ ID NO: 185383 - DNA, 20 bp, Artificial
  CRISPR gRNA sequence
aaacagtccttaatgaaaca

SEQ ID NO: 185384 - DNA, 20 bp, Artificial
  CRISPR gRNA sequence
aacagtccttaatgaaacaa

SEQ ID NO: 185385 - DNA, 20 bp, Artificial
  CRISPR gRNA sequence
acagtccttaatgaaacaaa

SEQ ID NO: 185386 - DNA, 20 bp, Artificial
  CRISPR gRNA sequence
ttaatgaaacaaagggtttg

SEQ ID NO: 185387 - DNA, 20 bp, Artificial
  CRISPR gRNA sequence
aatgaaacaaagggtttgcg

SEQ ID NO: 185388 - DNA, 20 bp, Artificial
  CRISPR gRNA sequence
gaaacaaagggtttgcggag

SEQ ID NO: 185389 - DNA, 20 bp, Artificial
  CRISPR gRNA sequence
agggtttgcggagaagtact

SEQ ID NO: 185390 - DNA, 20 bp, Artificial
  CRISPR gRNA sequence
ttgcggagaagtactcagaa

SEQ ID NO: 185391 - DNA, 20 bp, Artificial
  CRISPR gRNA sequence
tgcggagaagtactcagaat

SEQ ID NO: 185392 - DNA, 20 bp, Artificial
  CRISPR gRNA sequence
gtactcagaatgggaaacgt

SEQ ID NO: 185393 - DNA, 20 bp, Artificial
  CRISPR gRNA sequence
atgggaaacgttggtgtcct

SEQ ID NO: 185394 - DNA, 20 bp, Artificial
  CRISPR gRNA sequence
tgggaaacgttggtgtcctt

SEQ ID NO: 185395 - DNA, 20 bp, Artificial
  CRISPR gRNA sequence
gggaaacgttggtgtccttg

SEQ ID NO: 185396 - DNA, 20 bp, Artificial
  CRISPR gRNA sequence
gttggtgtccttggggttgt

SEQ ID NO: 185397 - DNA, 20 bp, Artificial
  CRISPR gRNA sequence
ggtgtccttggggttgttag

SEQ ID NO: 185398 - DNA, 20 bp, Artificial
  CRISPR gRNA sequence
tgtccttggggttgttagca

SEQ ID NO: 185399 - DNA, 20 bp, Artificial
  CRISPR gRNA sequence
cttggggttgttagcagagc

SEQ ID NO: 185400 - DNA, 20 bp, Artificial
  CRISPR gRNA sequence
ggggttgttagcagagccag

SEQ ID NO: 185401 - DNA, 20 bp, Artificial
  CRISPR gRNA sequence
agagccagcagtgatcctgt

SEQ ID NO: 185402 - DNA, 20 bp, Artificial
  CRISPR gRNA sequence
gagccagcagtgatcctgtg

SEQ ID NO: 185403 - DNA, 20 bp, Artificial
  CRISPR gRNA sequence
cagcagtgatcctgtgaggt

SEQ ID NO: 185404 - DNA, 20 bp, Artificial
  CRISPR gRNA sequence
tgatcctgtgaggtcagtcc

SEQ ID NO: 185405 - DNA, 20 bp, Artificial
  CRISPR gRNA sequence
tgtgaggtcagtcccagccc

SEQ ID NO: 185406 - DNA, 20 bp, Artificial
  CRISPR gRNA sequence
cagtcccagccctggaaaca

SEQ ID NO: 185407 - DNA, 20 bp, Artificial
  CRISPR gRNA sequence
agtcccagccctggaaacac

SEQ ID NO: 185408 - DNA, 20 bp, Artificial
  CRISPR gRNA sequence
tggaaacacaggtgtctccc

SEQ ID NO: 185409 - DNA, 20 bp, Artificial
  CRISPR gRNA sequence
ggaaacacaggtgtctccct

SEQ ID NO: 185410 - DNA, 20 bp, Artificial
  CRISPR gRNA sequence
cacaggtgtctccctgggct

SEQ ID NO: 185411 - DNA, 20 bp, Artificial
  CRISPR gRNA sequence
acaggtgtctccctgggctg

SEQ ID NO: 185412 - DNA, 20 bp, Artificial
  CRISPR gRNA sequence
caggtgtctccctgggctga

SEQ ID NO: 185413 - DNA, 20 bp, Artificial
  CRISPR gRNA sequence
gtgtctccctgggctgaggg

SEQ ID NO: 185414 - DNA, 20 bp, Artificial
  CRISPR gRNA sequence
cctgggctgagggtagtccc

SEQ ID NO: 185415 - DNA, 20 bp, Artificial
  CRISPR gRNA sequence
agggtagtccccggctctga

SEQ ID NO: 185416 - DNA, 20 bp, Artificial
  CRISPR gRNA sequence
gacggtccgatgtctttcct

SEQ ID NO: 185417 - DNA, 20 bp, Artificial
  CRISPR gRNA sequence
acggtccgatgtctttcctc

SEQ ID NO: 185418 - DNA, 20 bp, Artificial
  CRISPR gRNA sequence
gtccgatgtctttcctcagg

SEQ ID NO: 185419 - DNA, 20 bp, Artificial
  CRISPR gRNA sequence
ccgatgtctttcctcaggtg

SEQ ID NO: 185420 - DNA, 20 bp, Artificial
  CRISPR gRNA sequence
atgtctttcctcaggtggag

SEQ ID NO: 185421 - DNA, 20 bp, Artificial
  CRISPR gRNA sequence
gtggagcagctcctgtacga

SEQ ID NO: 185422 - DNA, 20 bp, Artificial
  CRISPR gRNA sequence
agctcctgtacgaaagccct

SEQ ID NO: 185423 - DNA, 20 bp, Artificial
  CRISPR gRNA sequence
tcctgtacgaaagccctgag

SEQ ID NO: 185424 - DNA, 20 bp, Artificial
  CRISPR gRNA sequence
ccctgagcggtactcccgct

SEQ ID NO: 185425 - DNA, 20 bp, Artificial
  CRISPR gRNA sequence
gctcagtgcttctcatcacc

SEQ ID NO: 185426 - DNA, 20 bp, Artificial
  CRISPR gRNA sequence
cttctcatcacccagcacct

SEQ ID NO: 185427 - DNA, 20 bp, Artificial
  CRISPR gRNA sequence
catcacccagcacctcagcc

SEQ ID NO: 185428 - DNA, 20 bp, Artificial
  CRISPR gRNA sequence
cacccagcacctcagcctgg

SEQ ID NO: 185429 - DNA, 20 bp, Artificial
  CRISPR gRNA sequence
cccagcacctcagcctggtg

SEQ ID NO: 185430 - DNA, 20 bp, Artificial
  CRISPR gRNA sequence
agcacctcagcctggtggag

SEQ ID NO: 185431 - DNA, 20 bp, Artificial
  CRISPR gRNA sequence
gcacctcagcctggtggagc

SEQ ID NO: 185432 - DNA, 20 bp, Artificial
  CRISPR gRNA sequence
ggctgaccacatcctctttc

SEQ ID NO: 185433 - DNA, 20 bp, Artificial
  CRISPR gRNA sequence
tgaccacatcctctttctgg

SEQ ID NO: 185434 - DNA, 20 bp, Artificial
  CRISPR gRNA sequence
gaccacatcctctttctgga

SEQ ID NO: 185435 - DNA, 20 bp, Artificial
  CRISPR gRNA sequence
ccacatcctctttctggaag

SEQ ID NO: 185436 - DNA, 20 bp, Artificial
  CRISPR gRNA sequence
cacatcctctttctggaagg

SEQ ID NO: 185437 - DNA, 20 bp, Artificial
  CRISPR gRNA sequence
ttctggaaggaggcgctatc

SEQ ID NO: 185438 - DNA, 20 bp, Artificial
  CRISPR gRNA sequence
tctggaaggaggcgctatcc

SEQ ID NO: 185439 - DNA, 20 bp, Artificial
  CRISPR gRNA sequence
tggaaggaggcgctatccgg

SEQ ID NO: 185440 - DNA, 20 bp, Artificial
  CRISPR gRNA sequence
ggaaggaggcgctatccggg

SEQ ID NO: 185441 - DNA, 20 bp, Artificial
  CRISPR gRNA sequence
gaaggaggcgctatccggga

SEQ ID NO: 185442 - DNA, 20 bp, Artificial
  CRISPR gRNA sequence
aaggaggcgctatccgggag

SEQ ID NO: 185443 - DNA, 20 bp, Artificial
  CRISPR gRNA sequence
aggaggcgctatccgggagg

SEQ ID NO: 185444 - DNA, 20 bp, Artificial
  CRISPR gRNA sequence
ggaggcgctatccgggaggg

SEQ ID NO: 185445 - DNA, 20 bp, Artificial
  CRISPR gRNA sequence
tccgggaggggggaacccac

SEQ ID NO: 185446 - DNA, 20 bp, Artificial
  CRISPR gRNA sequence
gggaggggggaacccaccag

SEQ ID NO: 185447 - DNA, 20 bp, Artificial
  CRISPR gRNA sequence
gggaacccaccagcagctca

SEQ ID NO: 185448 - DNA, 20 bp, Artificial
  CRISPR gRNA sequence
gaacccaccagcagctcatg

SEQ ID NO: 185449 - DNA, 20 bp, Artificial
  CRISPR gRNA sequence
accagcagctcatggagaaa

SEQ ID NO: 185450 - DNA, 20 bp, Artificial
  CRISPR gRNA sequence
ccagcagctcatggagaaaa

SEQ ID NO: 185451 - DNA, 20 bp, Artificial
  CRISPR gRNA sequence
cagcagctcatggagaaaaa

SEQ ID NO: 185452 - DNA, 20 bp, Artificial
  CRISPR gRNA sequence
agcagctcatggagaaaaag

SEQ ID NO: 185453 - DNA, 20 bp, Artificial
  CRISPR gRNA sequence
tggagaaaaaggggtgctac

SEQ ID NO: 185454 - DNA, 20 bp, Artificial
  CRISPR gRNA sequence
ggagaaaaaggggtgctact

SEQ ID NO: 185455 - DNA, 20 bp, Artificial
  CRISPR gRNA sequence
aaaggggtgctactgggcca

SEQ ID NO: 185456 - DNA, 20 bp, Artificial
  CRISPR gRNA sequence
ggtgctactgggccatggtg

SEQ ID NO: 185457 - DNA, 20 bp, Artificial
  CRISPR gRNA sequence
gtgctactgggccatggtgc

SEQ ID NO: 185458 - DNA, 20 bp, Artificial
  CRISPR gRNA sequence
ggccatggtgcaggctcctg

SEQ ID NO: 185459 - DNA, 20 bp, Artificial
  CRISPR gRNA sequence
gcaggctcctgcagatgctc

SEQ ID NO: 185460 - DNA, 20 bp, Artificial
  CRISPR gRNA sequence
ctgcagatgctccagaatga

SEQ ID NO: 185461 - DNA, 20 bp, Artificial
  CRISPR gRNA sequence
ctccagaatgaaagccttct

SEQ ID NO: 185462 - DNA, 20 bp, Artificial
  CRISPR gRNA sequence
cctcccttttcttctctctg

SEQ ID NO: 185463 - DNA, 20 bp, Artificial
  CRISPR gRNA sequence
cccttttcttctctctgtgg

SEQ ID NO: 185464 - DNA, 20 bp, Artificial
  CRISPR gRNA sequence
cttttcttctctctgtggtg

SEQ ID NO: 185465 - DNA, 20 bp, Artificial
  CRISPR gRNA sequence
ctctctgtggtggagaacca

SEQ ID NO: 185466 - DNA, 20 bp, Artificial
  CRISPR gRNA sequence
gtggtggagaaccacagctg

SEQ ID NO: 185467 - DNA, 20 bp, Artificial
  CRISPR gRNA sequence
ggtggagaaccacagctgca

SEQ ID NO: 185468 - DNA, 20 bp, Artificial
  CRISPR gRNA sequence
ggagaaccacagctgcagag

SEQ ID NO: 185469 - DNA, 20 bp, Artificial
  CRISPR gRNA sequence
gagaaccacagctgcagagt

SEQ ID NO: 185470 - DNA, 20 bp, Artificial
  CRISPR gRNA sequence
aaccacagctgcagagtagg

SEQ ID NO: 185471 - DNA, 20 bp, Artificial
  CRISPR gRNA sequence
gcagagtaggcagctgcctc

SEQ ID NO: 185472 - DNA, 20 bp, Artificial
  CRISPR gRNA sequence
cagagtaggcagctgcctcc

SEQ ID NO: 185473 - DNA, 20 bp, Artificial
  CRISPR gRNA sequence
taggcagctgcctccaggat

SEQ ID NO: 185474 - DNA, 20 bp, Artificial
  CRISPR gRNA sequence
gagaagaaaagggagggaga

SEQ ID NO: 185475 - DNA, 20 bp, Artificial
  CRISPR gRNA sequence
tttttctccatgagctgctg

SEQ ID NO: 185476 - DNA, 20 bp, Artificial
  CRISPR gRNA sequence
tgctggtgggttcccccctc

SEQ ID NO: 185477 - DNA, 20 bp, Artificial
  CRISPR gRNA sequence
atagcgcctccttccagaaa

SEQ ID NO: 185478 - DNA, 20 bp, Artificial
  CRISPR gRNA sequence
tgctccaccaggctgaggtg

SEQ ID NO: 185479 - DNA, 20 bp, Artificial
  CRISPR gRNA sequence
ggtgatgagaagcactgagc

SEQ ID NO: 185480 - DNA, 20 bp, Artificial
  CRISPR gRNA sequence
cagggctgggactgacctca

SEQ ID NO: 185481 - DNA, 20 bp, Artificial
  CRISPR gRNA sequence
ggacaccaacgtttcccatt

SEQ ID NO: 185482 - DNA, 20 bp, Artificial
  CRISPR gRNA sequence
attaaggactgttttacatg

SEQ ID NO: 185483 - DNA, 20 bp, Artificial
  CRISPR gRNA sequence
ttacatgaagggtgcaaaag

SEQ ID NO: 185484 - DNA, 20 bp, Artificial
  CRISPR gRNA sequence
taggataaaaatgagaaccc

SEQ ID NO: 185485 - DNA, 20 bp, Artificial
  CRISPR gRNA sequence
tagggtgaaacacgtgacag

SEQ ID NO: 185486 - DNA, 20 bp, Artificial
  CRISPR gRNA sequence
tgacagaagaataaagacta

SEQ ID NO: 185487 - DNA, 20 bp, Artificial
  CRISPR gRNA sequence
agcattcaagtcaggcagac

SEQ ID NO: 185488 - DNA, 20 bp, Artificial
  CRISPR gRNA sequence
caagtcaggcagacctgaat

SEQ ID NO: 185489 - DNA, 20 bp, Artificial
  CRISPR gRNA sequence
aacctccattttgtcatctg

SEQ ID NO: 185490 - DNA, 20 bp, Artificial
  CRISPR gRNA sequence
atgataaatgcctagctcag

SEQ ID NO: 185491 - DNA, 20 bp, Artificial
  CRISPR gRNA sequence
ctagctcagaaggattccta

SEQ ID NO: 185492 - DNA, 20 bp, Artificial
  CRISPR gRNA sequence
gaaggattcctaatgaataa

SEQ ID NO: 185493 - DNA, 20 bp, Artificial
  CRISPR gRNA sequence
ttaattaatattaatatgat

SEQ ID NO: 185494 - DNA, 20 bp, Artificial
  CRISPR gRNA sequence
actttgggaggtcaaggagg

SEQ ID NO: 185495 - DNA, 20 bp, Artificial
  CRISPR gRNA sequence
agggaggatcacttgggccc

SEQ ID NO: 185496 - DNA, 20 bp, Artificial
  CRISPR gRNA sequence
ttttaaataaacgatattat

SEQ ID NO: 185497 - DNA, 20 bp, Artificial
  CRISPR gRNA sequence
ggggcagattacctgagctc

SEQ ID NO: 185498 - DNA, 20 bp, Artificial
  CRISPR gRNA sequence
gctactcgggaggctgaggg

SEQ ID NO: 185499 - DNA, 20 bp, Artificial
  CRISPR gRNA sequence
ctgcgctccagcctgggcaa

SEQ ID NO: 185500 - DNA, 20 bp, Artificial
  CRISPR gRNA sequence
tggggaggcatccaatggaa

SEQ ID NO: 185501 - DNA, 20 bp, Artificial
  CRISPR gRNA sequence
gatgtataaaagaagcaaga

SEQ ID NO: 185502 - DNA, 20 bp, Artificial
  CRISPR gRNA sequence
ataaaagaagcaagattggg

SEQ ID NO: 185503 - DNA, 20 bp, Artificial
  CRISPR gRNA sequence
agggcactggtggcatcatc

SEQ ID NO: 185504 - DNA, 20 bp, Artificial
  CRISPR gRNA sequence
aggataagtacacacggttt

SEQ ID NO: 185505 - DNA, 20 bp, Artificial
  CRISPR gRNA sequence
ccaagatctgacggttgtag

SEQ ID NO: 185506 - DNA, 20 bp, Artificial
  CRISPR gRNA sequence
ggagattctgggaagatgaa

SEQ ID NO: 185507 - DNA, 20 bp, Artificial
  CRISPR gRNA sequence
gggaagatgaacagaatcct

SEQ ID NO: 185508 - DNA, 20 bp, Artificial
  CRISPR gRNA sequence
gaacagaatcctgaggatgt

SEQ ID NO: 185509 - DNA, 20 bp, Artificial
  CRISPR gRNA sequence
acaacttcaaattgatgtcc

SEQ ID NO: 185510 - DNA, 20 bp, Artificial
  CRISPR gRNA sequence
ccatgagtaaggaggaactg

SEQ ID NO: 185511 - DNA, 20 bp, Artificial
  CRISPR gRNA sequence
aaggataaaggcaagactac

SEQ ID NO: 185512 - DNA, 20 bp, Artificial
  CRISPR gRNA sequence
ttcagcaaaggtaaagatgg

SEQ ID NO: 185513 - DNA, 20 bp, Artificial
  CRISPR gRNA sequence
aaagatggctgggtggtgag

SEQ ID NO: 185514 - DNA, 20 bp, Artificial
  CRISPR gRNA sequence
tgggtggtgagatgagtgga

SEQ ID NO: 185515 - DNA, 20 bp, Artificial
  CRISPR gRNA sequence
tacctgtgtcatagccctga

SEQ ID NO: 185516 - DNA, 20 bp, Artificial
  CRISPR gRNA sequence
atttcctccatagttggctt

SEQ ID NO: 185517 - DNA, 20 bp, Artificial
  CRISPR gRNA sequence
acctgagatgaaatatgatg

SEQ ID NO: 185518 - DNA, 20 bp, Artificial
  CRISPR gRNA sequence
agtcatagaacaaggcacat

SEQ ID NO: 185519 - DNA, 20 bp, Artificial
  CRISPR gRNA sequence
tcattccctaacccctcttt

SEQ ID NO: 185520 - DNA, 20 bp, Artificial
  CRISPR gRNA sequence
cctctttcagagtgctcagt

SEQ ID NO: 185521 - DNA, 20 bp, Artificial
  CRISPR gRNA sequence
ctgtgctcttcccagaccca

SEQ ID NO: 185522 - DNA, 20 bp, Artificial
  CRISPR gRNA sequence
gccgtcacctcgccagggcg

SEQ ID NO: 185523 - DNA, 20 bp, Artificial
  CRISPR gRNA sequence
tcacctcgccagggcgtagg

SEQ ID NO: 185524 - DNA, 20 bp, Artificial
  CRISPR gRNA sequence
ctaccaaggcctctaacctt

SEQ ID NO: 185525 - DNA, 20 bp, Artificial
  CRISPR gRNA sequence
cctcccacatgcacagattt

SEQ ID NO: 185526 - DNA, 20 bp, Artificial
  CRISPR gRNA sequence
ttctgggtgatgcctcccca

SEQ ID NO: 185527 - DNA, 20 bp, Artificial
  CRISPR gRNA sequence
attctctttggaagcccaaa

SEQ ID NO: 185528 - DNA, 20 bp, Artificial
  CRISPR gRNA sequence
tggaagcccaaactgggttc

SEQ ID NO: 185529 - DNA, 20 bp, Artificial
  CRISPR gRNA sequence
gatgcctaccattgccttta

SEQ ID NO: 185530 - DNA, 20 bp, Artificial
  CRISPR gRNA sequence
attgcctttaaagggttagg

SEQ ID NO: 185531 - DNA, 20 bp, Artificial
  CRISPR gRNA sequence
ctgaaggcaggaagaaaatt

SEQ ID NO: 185532 - DNA, 20 bp, Artificial
  CRISPR gRNA sequence
aggaagaaaatttaggatgg

SEQ ID NO: 185533 - DNA, 20 bp, Artificial
  CRISPR gRNA sequence
agaattgcagttggggccag

SEQ ID NO: 185534 - DNA, 20 bp, Artificial
  CRISPR gRNA sequence
gttggggccagtggaataca

SEQ ID NO: 185535 - DNA, 20 bp, Artificial
  CRISPR gRNA sequence
cactaagacatctgggcggt

SEQ ID NO: 185536 - DNA, 20 bp, Artificial
  CRISPR gRNA sequence
acaaggccctccaagtgtaa

SEQ ID NO: 185537 - DNA, 20 bp, Artificial
  CRISPR gRNA sequence
gtaagggagtcaacagacca

SEQ ID NO: 185538 - DNA, 20 bp, Artificial
  CRISPR gRNA sequence
agaccactgggtgggcagcg

SEQ ID NO: 185539 - DNA, 20 bp, Artificial
  CRISPR gRNA sequence
gcccacagccttctgtactc

SEQ ID NO: 185540 - DNA, 20 bp, Artificial
  CRISPR gRNA sequence
agcagtacctagagggaggt

SEQ ID NO: 185541 - DNA, 20 bp, Artificial
  CRISPR gRNA sequence
ccagcattatgtgaagcaag

SEQ ID NO: 185542 - DNA, 20 bp, Artificial
  CRISPR gRNA sequence
tatgtgaagcaagaagggta

SEQ ID NO: 185543 - DNA, 20 bp, Artificial
  CRISPR gRNA sequence
gatggtgctgggccagagga

SEQ ID NO: 185544 - DNA, 20 bp, Artificial
  CRISPR gRNA sequence
cagaggaaggaatcacactg

SEQ ID NO: 185545 - DNA, 20 bp, Artificial
  CRISPR gRNA sequence
agggacctcacctccacagc

SEQ ID NO: 185546 - DNA, 20 bp, Artificial
  CRISPR gRNA sequence
accagctgcccaccaatgta

SEQ ID NO: 185547 - DNA, 20 bp, Artificial
  CRISPR gRNA sequence
caggctcaataggcagacag

SEQ ID NO: 185548 - DNA, 20 bp, Artificial
  CRISPR gRNA sequence
agaatgaaccagagacccca

SEQ ID NO: 185549 - DNA, 20 bp, Artificial
  CRISPR gRNA sequence
actttgggaggccgaagtgg

SEQ ID NO: 185550 - DNA, 20 bp, Artificial
  CRISPR gRNA sequence
aaaattagccgggcgtggtg

SEQ ID NO: 185551 - DNA, 20 bp, Artificial
  CRISPR gRNA sequence
agtaaattgcatcatcaagc

SEQ ID NO: 185552 - DNA, 20 bp, Artificial
  CRISPR gRNA sequence
gcatcatcaagccaggatct

SEQ ID NO: 185553 - DNA, 20 bp, Artificial
  CRISPR gRNA sequence
catgaagcagtcccaggtgc

SEQ ID NO: 185554 - DNA, 20 bp, Artificial
  CRISPR gRNA sequence
catctctccaatccacatgg

SEQ ID NO: 185555 - DNA, 20 bp, Artificial
  CRISPR gRNA sequence
tctccaatccacatggttgg

SEQ ID NO: 185556 - DNA, 20 bp, Artificial
  CRISPR gRNA sequence
gagggagggggctagggaca

SEQ ID NO: 185557 - DNA, 20 bp, Artificial
  CRISPR gRNA sequence
agggggctagggacactgag

SEQ ID NO: 185558 - DNA, 20 bp, Artificial
  CRISPR gRNA sequence
caaccatttcccagtaaaga

SEQ ID NO: 185559 - DNA, 20 bp, Artificial
  CRISPR gRNA sequence
cagtaaagaaggagtgggag

SEQ ID NO: 185560 - DNA, 20 bp, Artificial
  CRISPR gRNA sequence
aggagtgggagcagggtcat

SEQ ID NO: 185561 - DNA, 20 bp, Artificial
  CRISPR gRNA sequence
gggagcagggtcataggaat

SEQ ID NO: 185562 - DNA, 20 bp, Artificial
  CRISPR gRNA sequence
cagggtcataggaatgggaa

SEQ ID NO: 185563 - DNA, 20 bp, Artificial
  CRISPR gRNA sequence
tcacggcatcttaaggacaa

SEQ ID NO: 185564 - DNA, 20 bp, Artificial
  CRISPR gRNA sequence
ggcatcttaaggacaaggga

SEQ ID NO: 185565 - DNA, 20 bp, Artificial
  CRISPR gRNA sequence
ggtgctcacactagtggtcc

SEQ ID NO: 185566 - DNA, 20 bp, Artificial
  CRISPR gRNA sequence
aggccacagcctccttctgg

SEQ ID NO: 185567 - DNA, 20 bp, Artificial
  CRISPR gRNA sequence
cacctgcacttccagcaact

SEQ ID NO: 185568 - DNA, 20 bp, Artificial
  CRISPR gRNA sequence
acatggacaagagatgtcac

SEQ ID NO: 185569 - DNA, 20 bp, Artificial
  CRISPR gRNA sequence
accatcagggacactaatac

SEQ ID NO: 185570 - DNA, 20 bp, Artificial
  CRISPR gRNA sequence
aagagacacagctatgcccc

SEQ ID NO: 185571 - DNA, 20 bp, Artificial
  CRISPR gRNA sequence
gaagaggaaaatgactcaga

SEQ ID NO: 185572 - DNA, 20 bp, Artificial
  CRISPR gRNA sequence
aaaatgactcagaacgggtt

SEQ ID NO: 185573 - DNA, 20 bp, Artificial
  CRISPR gRNA sequence
aagctagaaaagaagaccca

SEQ ID NO: 185574 - DNA, 20 bp, Artificial
  CRISPR gRNA sequence
gggaacatggaccacaggga

SEQ ID NO: 185575 - DNA, 20 bp, Artificial
  CRISPR gRNA sequence
cagggtgttccatgaagatg

SEQ ID NO: 185576 - DNA, 20 bp, Artificial
  CRISPR gRNA sequence
catgaagatggagaatcagt

SEQ ID NO: 185577 - DNA, 20 bp, Artificial
  CRISPR gRNA sequence
tgaaagcaatgtgagaggaa

SEQ ID NO: 185578 - DNA, 20 bp, Artificial
  CRISPR gRNA sequence
gtctgccaagtctgggagat

SEQ ID NO: 185579 - DNA, 20 bp, Artificial
  CRISPR gRNA sequence
ggcagaaggaaaagcagagg

SEQ ID NO: 185580 - DNA, 20 bp, Artificial
  CRISPR gRNA sequence
aaaagcagaggcagggtgat

SEQ ID NO: 185581 - DNA, 20 bp, Artificial
  CRISPR gRNA sequence
taagctcagattctcactca

SEQ ID NO: 185582 - DNA, 20 bp, Artificial
  CRISPR gRNA sequence
ttctcactcagagaatcact

SEQ ID NO: 185583 - DNA, 20 bp, Artificial
  CRISPR gRNA sequence
ccgagacatgatgttacctg

SEQ ID NO: 185584 - DNA, 20 bp, Artificial
  CRISPR gRNA sequence
acctgcagggttggggagaa

SEQ ID NO: 185585 - DNA, 20 bp, Artificial
  CRISPR gRNA sequence
gttggggagaagagagtgag

SEQ ID NO: 185586 - DNA, 20 bp, Artificial
  CRISPR gRNA sequence
gagacgaactaacaatgagc

SEQ ID NO: 185587 - DNA, 20 bp, Artificial
  CRISPR gRNA sequence
ctaacaatgagccaggatgc

SEQ ID NO: 185588 - DNA, 20 bp, Artificial
  CRISPR gRNA sequence
tgagccaggatgccagggtc

SEQ ID NO: 185589 - DNA, 20 bp, Artificial
  CRISPR gRNA sequence
cagggtcaggggtgtcaaca

SEQ ID NO: 185590 - DNA, 20 bp, Artificial
  CRISPR gRNA sequence
gaggctgcaggaaacaaggt

SEQ ID NO: 185591 - DNA, 20 bp, Artificial
  CRISPR gRNA sequence
caaatctcagtgcagggaag

SEQ ID NO: 185592 - DNA, 20 bp, Artificial
  CRISPR gRNA sequence
ataaagtcattaatgcacat

SEQ ID NO: 185593 - DNA, 20 bp, Artificial
  CRISPR gRNA sequence
acataacagagatggaggag

SEQ ID NO: 185594 - DNA, 20 bp, Artificial
  CRISPR gRNA sequence
tgtggagcactcactgggac

SEQ ID NO: 185595 - DNA, 20 bp, Artificial
  CRISPR gRNA sequence
ctgtggagcactcaagagac

SEQ ID NO: 185596 - DNA, 20 bp, Artificial
  CRISPR gRNA sequence
aactgtgcagtttcagcatt

SEQ ID NO: 185597 - DNA, 20 bp, Artificial
  CRISPR gRNA sequence
aaattctatggtttctatct

SEQ ID NO: 185598 - DNA, 20 bp, Artificial
  CRISPR gRNA sequence
gtttctatctaaggatacat

SEQ ID NO: 185599 - DNA, 20 bp, Artificial
  CRISPR gRNA sequence
ttttgctcctgaggtatatc

SEQ ID NO: 185600 - DNA, 20 bp, Artificial
  CRISPR gRNA sequence
cagagagagagagacaggga

SEQ ID NO: 185601 - DNA, 20 bp, Artificial
  CRISPR gRNA sequence
agacagggagagggtatatc

SEQ ID NO: 185602 - DNA, 20 bp, Artificial
  CRISPR gRNA sequence
ggagatcaaagcagatgtat

SEQ ID NO: 185603 - DNA, 20 bp, Artificial
  CRISPR gRNA sequence
cagtacatggcgtataatga

SEQ ID NO: 185604 - DNA, 20 bp, Artificial
  CRISPR gRNA sequence
ataaagaacccggaaaaaaa

SEQ ID NO: 185605 - DNA, 20 bp, Artificial
  CRISPR gRNA sequence
aacccggaaaaaaaggggat

SEQ ID NO: 185606 - DNA, 20 bp, Artificial
  CRISPR gRNA sequence
acttccaactccctcatttg

SEQ ID NO: 185607 - DNA, 20 bp, Artificial
  CRISPR gRNA sequence
cccccagacctggctatggt

SEQ ID NO: 185608 - DNA, 20 bp, Artificial
  CRISPR gRNA sequence
gctatggtgagaatggacat

SEQ ID NO: 185609 - DNA, 20 bp, Artificial
  CRISPR gRNA sequence
atggacatgagagttaagtt

SEQ ID NO: 185610 - DNA, 20 bp, Artificial
  CRISPR gRNA sequence
gtatcggctgagccatcttg

SEQ ID NO: 185611 - DNA, 20 bp, Artificial
  CRISPR gRNA sequence
agtcagtgaggcggcccgta

SEQ ID NO: 185612 - DNA, 20 bp, Artificial
  CRISPR gRNA sequence
gtgaggcggcccgtaaagaa

SEQ ID NO: 185613 - DNA, 20 bp, Artificial
  CRISPR gRNA sequence
ggttgctctaccagaacttt

SEQ ID NO: 185614 - DNA, 20 bp, Artificial
  CRISPR gRNA sequence
aaaagcctcctgttagagat

SEQ ID NO: 185615 - DNA, 20 bp, Artificial
  CRISPR gRNA sequence
cgcccttcggccccagagca

SEQ ID NO: 185616 - DNA, 20 bp, Artificial
  CRISPR gRNA sequence
cccgcttccggcgtggccca

SEQ ID NO: 185617 - DNA, 20 bp, Artificial
  CRISPR gRNA sequence
ggtgttccaagacccacgct

SEQ ID NO: 185618 - DNA, 20 bp, Artificial
  CRISPR gRNA sequence
gcagcctagaagccgacgca

SEQ ID NO: 185619 - DNA, 20 bp, Artificial
  CRISPR gRNA sequence
cgccgggcacccagaggctc

SEQ ID NO: 185620 - DNA, 20 bp, Artificial
  CRISPR gRNA sequence
ataactgacaacgaaggcgg

SEQ ID NO: 185621 - DNA, 20 bp, Artificial
  CRISPR gRNA sequence
gcgcggtgggcaccagcagg

SEQ ID NO: 185622 - DNA, 20 bp, Artificial
  CRISPR gRNA sequence
ccccggtggggcctgaagct

SEQ ID NO: 185623 - DNA, 20 bp, Artificial
  CRISPR gRNA sequence
gcctgaagctccgggtaccg

SEQ ID NO: 185624 - DNA, 20 bp, Artificial
  CRISPR gRNA sequence
ggctgagcttctcgccagcg

SEQ ID NO: 185625 - DNA, 20 bp, Artificial
  CRISPR gRNA sequence
tcaggccccaccggggcgcg

SEQ ID NO: 185626 - DNA, 20 bp, Artificial
  CRISPR gRNA sequence
ggccgggaccgggacggcgt

SEQ ID NO: 185627 - DNA, 20 bp, Artificial
  CRISPR gRNA sequence
ctctaggtgtcccgctcccc

SEQ ID NO: 185628 - DNA, 20 bp, Artificial
  CRISPR gRNA sequence
gtactgctacttctcgccga

SEQ ID NO: 185629 - DNA, 20 bp, Artificial
  CRISPR gRNA sequence
cccaccgcgctgccactgct

SEQ ID NO: 185630 - DNA, 20 bp, Artificial
  CRISPR gRNA sequence
gtgctctggctgggggcctg

SEQ ID NO: 185631 - DNA, 20 bp, Artificial
  CRISPR gRNA sequence
gctgatctcatggggagccc

SEQ ID NO: 185632 - DNA, 20 bp, Artificial
  CRISPR gRNA sequence
catggggagcccccgggtcc

SEQ ID NO: 185633 - DNA, 20 bp, Artificial
  CRISPR gRNA sequence
tggcacaaactcgggagcct

SEQ ID NO: 185634 - DNA, 20 bp, Artificial
  CRISPR gRNA sequence
ggacacaaggggactgggac

SEQ ID NO: 185635 - DNA, 20 bp, Artificial
  CRISPR gRNA sequence
aaaggtaattgtcagtaagg

SEQ ID NO: 185636 - DNA, 20 bp, Artificial
  CRISPR gRNA sequence
tgtcagtaaggtagagtagc

SEQ ID NO: 185637 - DNA, 20 bp, Artificial
  CRISPR gRNA sequence
gcaggagaaggactcctagc

SEQ ID NO: 185638 - DNA, 20 bp, Artificial
  CRISPR gRNA sequence
gttctgggctccattgctga

SEQ ID NO: 185639 - DNA, 20 bp, Artificial
  CRISPR gRNA sequence
aagttctggtagagcaacca

SEQ ID NO: 185640 - DNA, 20 bp, Artificial
  CRISPR gRNA sequence
ggtagagcaaccacagggta

SEQ ID NO: 185641 - DNA, 20 bp, Artificial
  CRISPR gRNA sequence
cagggcagcctatttaggtt

SEQ ID NO: 185642 - DNA, 20 bp, Artificial
  CRISPR gRNA sequence
tcctttctgctgatgccctc

SEQ ID NO: 185643 - DNA, 20 bp, Artificial
  CRISPR gRNA sequence
tttacgggccgcctcactga

SEQ ID NO: 185644 - DNA, 20 bp, Artificial
  CRISPR gRNA sequence
atggggcaccctgcaaatga

SEQ ID NO: 185645 - DNA, 20 bp, Artificial
  CRISPR gRNA sequence
tgtccgaaatgcacttatat

SEQ ID NO: 185646 - DNA, 20 bp, Artificial
  CRISPR gRNA sequence
caccctgatccccttttttt

SEQ ID NO: 185647 - DNA, 20 bp, Artificial
  CRISPR gRNA sequence
ggttctttatagtgcagtgc

SEQ ID NO: 185648 - DNA, 20 bp, Artificial
  CRISPR gRNA sequence
atagtgcagtgctggagttc

SEQ ID NO: 185649 - DNA, 20 bp, Artificial
  CRISPR gRNA sequence
gtgctggagttcgtgggtga

SEQ ID NO: 185650 - DNA, 20 bp, Artificial
  CRISPR gRNA sequence
ggctgtcctgcgccaggaga

SEQ ID NO: 185651 - DNA, 20 bp, Artificial
  CRISPR gRNA sequence
tccttaccttaagaaaaacc

SEQ ID NO: 185652 - DNA, 20 bp, Artificial
  CRISPR gRNA sequence
gtatccttagatagaaacca

SEQ ID NO: 185653 - DNA, 20 bp, Artificial
  CRISPR gRNA sequence
catatggctagagacacact

SEQ ID NO: 185654 - DNA, 20 bp, Artificial
  CRISPR gRNA sequence
ggggttagaaccctggtctc

SEQ ID NO: 185655 - DNA, 20 bp, Artificial
  CRISPR gRNA sequence
catatggctagagatagacc

SEQ ID NO: 185656 - DNA, 20 bp, Artificial
  CRISPR gRNA sequence
gggttagaaccctagtccca

SEQ ID NO: 185657 - DNA, 20 bp, Artificial
  CRISPR gRNA sequence
cctgcaggtaacatcatgtc

SEQ ID NO: 185658 - DNA, 20 bp, Artificial
  CRISPR gRNA sequence
taacagaggacacgtccacc

SEQ ID NO: 185659 - DNA, 20 bp, Artificial
  CRISPR gRNA sequence
cgtccaccctgagtgattct

SEQ ID NO: 185660 - DNA, 20 bp, Artificial
  CRISPR gRNA sequence
ccctgagtgattctctgagt

SEQ ID NO: 185661 - DNA, 20 bp, Artificial
  CRISPR gRNA sequence
gtgcgaggcctatgtctctt

SEQ ID NO: 185662 - DNA, 20 bp, Artificial
  CRISPR gRNA sequence
tctcttggggatcatgctct

SEQ ID NO: 185663 - DNA, 20 bp, Artificial
  CRISPR gRNA sequence
aatggtaccaggtatgttca

SEQ ID NO: 185664 - DNA, 20 bp, Artificial
  CRISPR gRNA sequence
aacattaacctccatactct

SEQ ID NO: 185665 - DNA, 20 bp, Artificial
  CRISPR gRNA sequence
tctccccacaatctgtcttt

SEQ ID NO: 185666 - DNA, 20 bp, Artificial
  CRISPR gRNA sequence
aatttgatccccaacccgtt

SEQ ID NO: 185667 - DNA, 20 bp, Artificial
  CRISPR gRNA sequence
gttgctggaagtgcaggtgc

SEQ ID NO: 185668 - DNA, 20 bp, Artificial
  CRISPR gRNA sequence
actagtgtgagcacctgaag

SEQ ID NO: 185669 - DNA, 20 bp, Artificial
  CRISPR gRNA sequence
cataaaatccacccaaccat

SEQ ID NO: 185670 - DNA, 20 bp, Artificial
  CRISPR gRNA sequence
taccttgtagatttgttagt

SEQ ID NO: 185671 - DNA, 20 bp, Artificial
  CRISPR gRNA sequence
gatttgttagtgagagtgat

SEQ ID NO: 185672 - DNA, 20 bp, Artificial
  CRISPR gRNA sequence
tgatgggaatagtggaagcc

SEQ ID NO: 185673 - DNA, 20 bp, Artificial
  CRISPR gRNA sequence
tattattattatttttgagc

SEQ ID NO: 185674 - DNA, 20 bp, Artificial
  CRISPR gRNA sequence
tctcgctttgtcgcccaggc

SEQ ID NO: 185675 - DNA, 20 bp, Artificial
  CRISPR gRNA sequence
ctcactgcaagctccgcctc

SEQ ID NO: 185676 - DNA, 20 bp, Artificial
  CRISPR gRNA sequence
cgttctcccgcctcagcctc

SEQ ID NO: 185677 - DNA, 20 bp, Artificial
  CRISPR gRNA sequence
cgaggtttctccgtgttagc

SEQ ID NO: 185678 - DNA, 20 bp, Artificial
  CRISPR gRNA sequence
acttcggcctcccaaagtgc

SEQ ID NO: 185679 - DNA, 20 bp, Artificial
  CRISPR gRNA sequence
gtttcctcatttttcaaaaa

SEQ ID NO: 185680 - DNA, 20 bp, Artificial
  CRISPR gRNA sequence
catgtattagctgacatcac

SEQ ID NO: 185681 - DNA, 20 bp, Artificial
  CRISPR gRNA sequence
atgaatgaaagccttttgtg

SEQ ID NO: 185682 - DNA, 20 bp, Artificial
  CRISPR gRNA sequence
tgtgacttgcatgatgtgca

SEQ ID NO: 185683 - DNA, 20 bp, Artificial
  CRISPR gRNA sequence
gtgcattgagtcagactcca

SEQ ID NO: 185684 - DNA, 20 bp, Artificial
  CRISPR gRNA sequence
tcaggtatgctgctgaaagt

SEQ ID NO: 185685 - DNA, 20 bp, Artificial
  CRISPR gRNA sequence
gtactgctctccatctaccc

SEQ ID NO: 185686 - DNA, 20 bp, Artificial
  CRISPR gRNA sequence
gggctcctcagagaaaatat

SEQ ID NO: 185687 - DNA, 20 bp, Artificial
  CRISPR gRNA sequence
acccagtttgggcttccaaa

SEQ ID NO: 185688 - DNA, 20 bp, Artificial
  CRISPR gRNA sequence
atgagagaagaggtttcgaa

SEQ ID NO: 185689 - DNA, 20 bp, Artificial
  CRISPR gRNA sequence
gagagtgctctcacgttcca

SEQ ID NO: 185690 - DNA, 20 bp, Artificial
  CRISPR gRNA sequence
tttccttttcctttgtaatt

SEQ ID NO: 185691 - DNA, 20 bp, Artificial
  CRISPR gRNA sequence
aagtgtgtggcatagtggtg

SEQ ID NO: 185692 - DNA, 20 bp, Artificial
  CRISPR gRNA sequence
ccagaaatctgtgcatgtgg

SEQ ID NO: 185693 - DNA, 20 bp, Artificial
  CRISPR gRNA sequence
atctgtgcatgtgggagggt

SEQ ID NO: 185694 - DNA, 20 bp, Artificial
  CRISPR gRNA sequence
atatttccctgtttttcttc

SEQ ID NO: 185695 - DNA, 20 bp, Artificial
  CRISPR gRNA sequence
gacggcgctggtgggaccca

SEQ ID NO: 185696 - DNA, 20 bp, Artificial
  CRISPR gRNA sequence
gcacagtggctgccctgctg

SEQ ID NO: 185697 - DNA, 20 bp, Artificial
  CRISPR gRNA sequence
ccaccgggggacagctgctg

SEQ ID NO: 185698 - DNA, 20 bp, Artificial
  CRISPR gRNA sequence
cttactgagcactctgaaag

SEQ ID NO: 185699 - DNA, 20 bp, Artificial
  CRISPR gRNA sequence
gcactctgaaagaggggtta

SEQ ID NO: 185700 - DNA, 20 bp, Artificial
  CRISPR gRNA sequence
ttagggaatgataagagacc

SEQ ID NO: 185701 - DNA, 20 bp, Artificial
  CRISPR gRNA sequence
acatgttctcaataaagatt

SEQ ID NO: 185702 - DNA, 20 bp, Artificial
  CRISPR gRNA sequence
cttcttcatcctgacatcct

SEQ ID NO: 185703 - DNA, 20 bp, Artificial
  CRISPR gRNA sequence
caggattctgttcatcttcc

SEQ ID NO: 185704 - DNA, 20 bp, Artificial
  CRISPR gRNA sequence
accgtcagatcttggtgtgt

SEQ ID NO: 185705 - DNA, 20 bp, Artificial
  CRISPR gRNA sequence
atcttggtgtgtgtgagtgc

SEQ ID NO: 185706 - DNA, 20 bp, Artificial
  CRISPR gRNA sequence
gtgtgtgagtgcgtgaatgc

SEQ ID NO: 185707 - DNA, 20 bp, Artificial
  CRISPR gRNA sequence
aggctgggagccagctgtca

SEQ ID NO: 185708 - DNA, 20 bp, Artificial
  CRISPR gRNA sequence
ggaaaccgtgtgtacttatc

SEQ ID NO: 185709 - DNA, 20 bp, Artificial
  CRISPR gRNA sequence
tggatgatgccaccagtgcc

SEQ ID NO: 185710 - DNA, 20 bp, Artificial
  CRISPR gRNA sequence
agttcccaaatccagttcca

SEQ ID NO: 185711 - DNA, 20 bp, Artificial
  CRISPR gRNA sequence
ttccattggatgcctcccca

SEQ ID NO: 185712 - DNA, 20 bp, Artificial
  CRISPR gRNA sequence
gaagacgaggcaaagacacc

SEQ ID NO: 185713 - DNA, 20 bp, Artificial
  CRISPR gRNA sequence
gactatctacaaactacaga

SEQ ID NO: 185714 - DNA, 20 bp, Artificial
  CRISPR gRNA sequence
gcgattctcccctcagcctc

SEQ ID NO: 185715 - DNA, 20 bp, Artificial
  CRISPR gRNA sequence
cttttatatttttagtagag

SEQ ID NO: 185716 - DNA, 20 bp, Artificial
  CRISPR gRNA sequence
ccatgttgcccaggctggcc

SEQ ID NO: 185717 - DNA, 20 bp, Artificial
  CRISPR gRNA sequence
ccctcagcctcccaaagggc

SEQ ID NO: 185718 - DNA, 20 bp, Artificial
  CRISPR gRNA sequence
actgcgcccagtcctataga

SEQ ID NO: 185719 - DNA, 20 bp, Artificial
  CRISPR gRNA sequence
tccttgacctcccaaagtgc

SEQ ID NO: 185720 - DNA, 20 bp, Artificial
  CRISPR gRNA sequence
ctgtcactcatttattcatt

SEQ ID NO: 185721 - DNA, 20 bp, Artificial
  CRISPR gRNA sequence
aaaatggaggttaaaagagg

SEQ ID NO: 185722 - DNA, 20 bp, Artificial
  CRISPR gRNA sequence
atatagaggtcatatagctt

SEQ ID NO: 185723 - DNA, 20 bp, Artificial
  CRISPR gRNA sequence
caaattcaggtctgcctgac

SEQ ID NO: 185724 - DNA, 20 bp, Artificial
  CRISPR gRNA sequence
taagttatatttccttaaaa

SEQ ID NO: 185725 - DNA, 20 bp, Artificial
  CRISPR gRNA sequence
aatataaaaatgccaagtcc

SEQ ID NO: 185726 - DNA, 20 bp, Artificial
  CRISPR gRNA sequence
ttctgtcacgtgtttcaccc

SEQ ID NO: 185727 - DNA, 20 bp, Artificial
  CRISPR gRNA sequence
aaacagtccttaatgaaaca

SEQ ID NO: 185728 - DNA, 20 bp, Artificial
  CRISPR gRNA sequence
agggtttgcggagaagtact

SEQ ID NO: 185729 - DNA, 20 bp, Artificial
  CRISPR gRNA sequence
atgggaaacgttggtgtcct

SEQ ID NO: 185730 - DNA, 20 bp, Artificial
  CRISPR gRNA sequence
cacaggtgtctccctgggct

SEQ ID NO: 185731 - DNA, 20 bp, Artificial
  CRISPR gRNA sequence
ccagcagctcatggagaaaa

SEQ ID NO: 185732 - DNA, 20 bp, Artificial
  CRISPR gRNA sequence
gcaggctcctgcagatgctc

SEQ ID NO: 185733 - DNA, 20 bp, Artificial
  CRISPR gRNA sequence
gtggtggagaaccacagctg

SEQ ID NO: 185734 - DNA, 20 bp, Artificial
  CRISPR gRNA sequence
gcagagtaggcagctgcctc

SEQ ID NO: 185735 - DNA, 20 bp, Artificial
  CRISPR gRNA sequence
agtaggcagctgcctccagg

SEQ ID NO: 185736 - DNA, 20 bp, Artificial
  CRISPR gRNA sequence
gatggagtgcgcaggtctga

SEQ ID NO: 185737 - DNA, 20 bp, Artificial
  CRISPR gRNA sequence
cactgagcgggagtaccgct

SEQ ID NO: 185738 - DNA, 20 bp, Artificial
  CRISPR gRNA sequence
ccctcagcccagggagacac

SEQ ID NO: 185739 - DNA, 20 bp, Artificial
  CRISPR gRNA sequence
gctaacaaccccaaggacac

SEQ ID NO: 185740 - DNA, 20 bp, Artificial
  CRISPR gRNA sequence
tgagtacttctccgcaaacc

SEQ ID NO: 185741 - DNA, 20 bp, Artificial
  CRISPR gRNA sequence
aaaccctttgtttcattaag

SEQ ID NO: 185742 - DNA, 20 bp, Artificial
  CRISPR gRNA sequence
catggacttggcatttttat

SEQ ID NO: 185743 - DNA, 20 bp, Artificial
  CRISPR gRNA sequence
agctatatgacctctatatg

SEQ ID NO: 185744 - DNA, 20 bp, Artificial
  CRISPR gRNA sequence
gatgataaatgcctagctca

SEQ ID NO: 185745 - DNA, 20 bp, Artificial
  CRISPR gRNA sequence
gtgacagtgcatgtaaacag

SEQ ID NO: 185746 - DNA, 20 bp, Artificial
  CRISPR gRNA sequence
gactagcttaattaatatta

SEQ ID NO: 185747 - DNA, 20 bp, Artificial
  CRISPR gRNA sequence
ttatgaggatggtcttttcc

SEQ ID NO: 185748 - DNA, 20 bp, Artificial
  CRISPR gRNA sequence
aggatggtcttttccttatg

SEQ ID NO: 185749 - DNA, 20 bp, Artificial
  CRISPR gRNA sequence
ccctttgggaggctgagggg

SEQ ID NO: 185750 - DNA, 20 bp, Artificial
  CRISPR gRNA sequence
actcgggaggctgaggggag

SEQ ID NO: 185751 - DNA, 20 bp, Artificial
  CRISPR gRNA sequence
caggttgaagctgcagtgag

SEQ ID NO: 185752 - DNA, 20 bp, Artificial
  CRISPR gRNA sequence
agaaagaaagaaattcagtc

SEQ ID NO: 185753 - DNA, 20 bp, Artificial
  CRISPR gRNA sequence
gtttgtagatagtctctttt

SEQ ID NO: 185754 - DNA, 20 bp, Artificial
  CRISPR gRNA sequence
ttggggaggcatccaatgga

SEQ ID NO: 185755 - DNA, 20 bp, Artificial
  CRISPR gRNA sequence
gggaactgagaactgcaagg

SEQ ID NO: 185756 - DNA, 20 bp, Artificial
  CRISPR gRNA sequence
acagaagatgtataaaagaa

SEQ ID NO: 185757 - DNA, 20 bp, Artificial
  CRISPR gRNA sequence
tgactgcctcacctgtaact

SEQ ID NO: 185758 - DNA, 20 bp, Artificial
  CRISPR gRNA sequence
catcatccaggataagtaca

SEQ ID NO: 185759 - DNA, 20 bp, Artificial
  CRISPR gRNA sequence
tgacggttgtagctggatag

SEQ ID NO: 185760 - DNA, 20 bp, Artificial
  CRISPR gRNA sequence
aaggataaaggcaagactac

SEQ ID NO: 185761 - DNA, 20 bp, Artificial
  CRISPR gRNA sequence
cccagactttactgcagcag

SEQ ID NO: 185762 - DNA, 20 bp, Artificial
  CRISPR gRNA sequence
cagctgtgatttcctccata

SEQ ID NO: 185763 - DNA, 20 bp, Artificial
  CRISPR gRNA sequence
tccctgccctccttcaagcc

SEQ ID NO: 185764 - DNA, 20 bp, Artificial
  CRISPR gRNA sequence
agcggtgctcatattgggga

SEQ ID NO: 185765 - DNA, 20 bp, Artificial
  CRISPR gRNA sequence
gctgtcccccggtgggctgg

SEQ ID NO: 185766 - DNA, 20 bp, Artificial
  CRISPR gRNA sequence
aactcctaccctcccacatg

SEQ ID NO: 185767 - DNA, 20 bp, Artificial
  CRISPR gRNA sequence
gaaagatggaagaccgaaga

SEQ ID NO: 185768 - DNA, 20 bp, Artificial
  CRISPR gRNA sequence
tggaagcccaaactgggttc

SEQ ID NO: 185769 - DNA, 20 bp, Artificial
  CRISPR gRNA sequence
aactgggttcttgagtttgg

SEQ ID NO: 185770 - DNA, 20 bp, Artificial
  CRISPR gRNA sequence
tttaaagggttagggaggat

SEQ ID NO: 185771 - DNA, 20 bp, Artificial
  CRISPR gRNA sequence
ctgtagcactaagacatctg

SEQ ID NO: 185772 - DNA, 20 bp, Artificial
  CRISPR gRNA sequence
agaatagtgaaagtgaggta

SEQ ID NO: 185773 - DNA, 20 bp, Artificial
  CRISPR gRNA sequence
aacaaatgtgacaaggttcc

SEQ ID NO: 185774 - DNA, 20 bp, Artificial
  CRISPR gRNA sequence
caccagctgcccaccaatgt

SEQ ID NO: 185775 - DNA, 20 bp, Artificial
  CRISPR gRNA sequence
ggagcattttactcttcaca

SEQ ID NO: 185776 - DNA, 20 bp, Artificial
  CRISPR gRNA sequence
agtgggcggatcacaaggtc

SEQ ID NO: 185777 - DNA, 20 bp, Artificial
  CRISPR gRNA sequence
aacggcgtgaacccgggagg

SEQ ID NO: 185778 - DNA, 20 bp, Artificial
  CRISPR gRNA sequence
catcacagatgtccctcatc

SEQ ID NO: 185779 - DNA, 20 bp, Artificial
  CRISPR gRNA sequence
ctctccaatccacatggttg

SEQ ID NO: 185780 - DNA, 20 bp, Artificial
  CRISPR gRNA sequence
ggttgagtgtctttatttct

SEQ ID NO: 185781 - DNA, 20 bp, Artificial
  CRISPR gRNA sequence
tgcagcttttccctaaactt

SEQ ID NO: 185782 - DNA, 20 bp, Artificial
  CRISPR gRNA sequence
ggcttcgccctcctcgttgg

SEQ ID NO: 185783 - DNA, 20 bp, Artificial
  CRISPR gRNA sequence
gccacctggctggactttgc

SEQ ID NO: 185784 - DNA, 20 bp, Artificial
  CRISPR gRNA sequence
ttggggatcaaattcttaaa

SEQ ID NO: 185785 - DNA, 20 bp, Artificial
  CRISPR gRNA sequence
ccaggtaccacagaaataag

SEQ ID NO: 185786 - DNA, 20 bp, Artificial
  CRISPR gRNA sequence
atgtgaatttccattttcct

SEQ ID NO: 185787 - DNA, 20 bp, Artificial
  CRISPR gRNA sequence
atgctatacacacaggcagg

SEQ ID NO: 185788 - DNA, 20 bp, Artificial
  CRISPR gRNA sequence
tctctagccatatgtaactg

SEQ ID NO: 185789 - DNA, 20 bp, Artificial
  CRISPR gRNA sequence
tctctagccatatgtaactg

SEQ ID NO: 185790 - DNA, 20 bp, Artificial
  CRISPR gRNA sequence
tcagcatttagggtcttggc

SEQ ID NO: 185791 - DNA, 20 bp, Artificial
  CRISPR gRNA sequence
tctctatgagctcaaaattt

SEQ ID NO: 185792 - DNA, 20 bp, Artificial
  CRISPR gRNA sequence
aatttccaggtttgaaattc

SEQ ID NO: 185793 - DNA, 20 bp, Artificial
  CRISPR gRNA sequence
tctatctaaggatacatagg

SEQ ID NO: 185794 - DNA, 20 bp, Artificial
  CRISPR gRNA sequence
gaaaatgctagatgaaaact

SEQ ID NO: 185795 - DNA, 20 bp, Artificial
  CRISPR gRNA sequence
cagtacatggcgtataatga

SEQ ID NO: 185796 - DNA, 20 bp, Artificial
  CRISPR gRNA sequence
ggtgagaatggacatgagag

SEQ ID NO: 185797 - DNA, 20 bp, Artificial
  CRISPR gRNA sequence
tggttgctctaccagaactt

SEQ ID NO: 185798 - DNA, 20 bp, Artificial
  CRISPR gRNA sequence
ccgcccttcggccccagagc

SEQ ID NO: 185799 - DNA, 20 bp, Artificial
  CRISPR gRNA sequence
ggccccagagcaaaggattt

SEQ ID NO: 185800 - DNA, 20 bp, Artificial
  CRISPR gRNA sequence
tctggcccccgccagtccag

SEQ ID NO: 185801 - DNA, 20 bp, Artificial
  CRISPR gRNA sequence
tctaccttactgacaattac

SEQ ID NO: 185802 - DNA, 20 bp, Artificial
  CRISPR gRNA sequence
gcagcctagaagccgacgca

SEQ ID NO: 185803 - DNA, 20 bp, Artificial
  CRISPR gRNA sequence
cgccgggcacccagaggctc

SEQ ID NO: 185804 - DNA, 20 bp, Artificial
  CRISPR gRNA sequence
ccaagcccagtgccgcagct

SEQ ID NO: 185805 - DNA, 20 bp, Artificial
  CRISPR gRNA sequence
agccagccagccctgggcac

SEQ ID NO: 185806 - DNA, 20 bp, Artificial
  CRISPR gRNA sequence
gcgttatctagtgagcaggc

SEQ ID NO: 185807 - DNA, 20 bp, Artificial
  CRISPR gRNA sequence
tctagtgagcaggcggccgc

SEQ ID NO: 185808 - DNA, 20 bp, Artificial
  CRISPR gRNA sequence
gagcaggcggccgctttcga

SEQ ID NO: 185809 - DNA, 20 bp, Artificial
  CRISPR gRNA sequence
tttcgctttcccctaaatgg

SEQ ID NO: 185810 - DNA, 20 bp, Artificial
  CRISPR gRNA sequence
ggggaggactcggcggtacc

SEQ ID NO: 185811 - DNA, 20 bp, Artificial
  CRISPR gRNA sequence
cgcgggtgccgctgcctccc

SEQ ID NO: 185812 - DNA, 20 bp, Artificial
  CRISPR gRNA sequence
gcaggtgcccagggctggct

SEQ ID NO: 185813 - DNA, 20 bp, Artificial
  CRISPR gRNA sequence
tgaagccattagctgcggca

SEQ ID NO: 185814 - DNA, 20 bp, Artificial
  CRISPR gRNA sequence
cggctctggaaaccctgtgc

SEQ ID NO: 185815 - DNA, 20 bp, Artificial
  CRISPR gRNA sequence
gggctccattgctgaccggg

SEQ ID NO: 185816 - DNA, 20 bp, Artificial
  CRISPR gRNA sequence
gggcatcctcatctctaaca

SEQ ID NO: 185817 - DNA, 20 bp, Artificial
  CRISPR gRNA sequence
ccagggcagcctatttaggt

SEQ ID NO: 185818 - DNA, 20 bp, Artificial
  CRISPR gRNA sequence
taggttcgggattgagacgt

SEQ ID NO: 185819 - DNA, 20 bp, Artificial
  CRISPR gRNA sequence
ctttacgggccgcctcactg

SEQ ID NO: 185820 - DNA, 20 bp, Artificial
  CRISPR gRNA sequence
gcacagccacttgcagggag

SEQ ID NO: 185821 - DNA, 20 bp, Artificial
  CRISPR gRNA sequence
ggctgtcctgcgccaggaga

SEQ ID NO: 185822 - DNA, 20 bp, Artificial
  CRISPR gRNA sequence
agtttttccaacagaaccag

SEQ ID NO: 185823 - DNA, 20 bp, Artificial
  CRISPR gRNA sequence
tactgttcatatcctcatac

SEQ ID NO: 185824 - DNA, 20 bp, Artificial
  CRISPR gRNA sequence
tctcacacacacacacacac

SEQ ID NO: 185825 - DNA, 20 bp, Artificial
  CRISPR gRNA sequence
tccttaccttaagaaaaacc

SEQ ID NO: 185826 - DNA, 20 bp, Artificial
  CRISPR gRNA sequence
tgagtgctccacagacttcg

SEQ ID NO: 185827 - DNA, 20 bp, Artificial
  CRISPR gRNA sequence
tgagtgctccacagactttg

SEQ ID NO: 185828 - DNA, 20 bp, Artificial
  CRISPR gRNA sequence
tcctccatctctgttatgtg

SEQ ID NO: 185829 - DNA, 20 bp, Artificial
  CRISPR gRNA sequence
tacaggttctctagggaaca

SEQ ID NO: 185830 - DNA, 20 bp, Artificial
  CRISPR gRNA sequence
taacactcatcttccctgca

SEQ ID NO: 185831 - DNA, 20 bp, Artificial
  CRISPR gRNA sequence
agacctctggagaaccctaa

SEQ ID NO: 185832 - DNA, 20 bp, Artificial
  CRISPR gRNA sequence
cgtctcatcacttggaacct

SEQ ID NO: 185833 - DNA, 20 bp, Artificial
  CRISPR gRNA sequence
acagaggacacgtccaccct

SEQ ID NO: 185834 - DNA, 20 bp, Artificial
  CRISPR gRNA sequence
gtgattctctgagtgagaat

SEQ ID NO: 185835 - DNA, 20 bp, Artificial
  CRISPR gRNA sequence
ggtcaccctgatcaccctgc

SEQ ID NO: 185836 - DNA, 20 bp, Artificial
  CRISPR gRNA sequence
ggcagactcagttcctctca

SEQ ID NO: 185837 - DNA, 20 bp, Artificial
  CRISPR gRNA sequence
tcctctcacattgctttcag

SEQ ID NO: 185838 - DNA, 20 bp, Artificial
  CRISPR gRNA sequence
tccagctttcctggcaccct

SEQ ID NO: 185839 - DNA, 20 bp, Artificial
  CRISPR gRNA sequence
atactctctgggtcttcttt

SEQ ID NO: 185840 - DNA, 20 bp, Artificial
  CRISPR gRNA sequence
actcaggtattagtgtccct

SEQ ID NO: 185841 - DNA, 20 bp, Artificial
  CRISPR gRNA sequence
tgtcggccatgcctacagtt

SEQ ID NO: 185842 - DNA, 20 bp, Artificial
  CRISPR gRNA sequence
caacgaggagggcgaagccc

SEQ ID NO: 185843 - DNA, 20 bp, Artificial
  CRISPR gRNA sequence
ccctctctttaaagatgcta

SEQ ID NO: 185844 - DNA, 20 bp, Artificial
  CRISPR gRNA sequence
acataaaatccacccaacca

SEQ ID NO: 185845 - DNA, 20 bp, Artificial
  CRISPR gRNA sequence
ccataaattcttgcacctgg

SEQ ID NO: 185846 - DNA, 20 bp, Artificial
  CRISPR gRNA sequence
actgcttcatgctggtacct

SEQ ID NO: 185847 - DNA, 20 bp, Artificial
  CRISPR gRNA sequence
tacgccagtgatccgaagat

SEQ ID NO: 185848 - DNA, 20 bp, Artificial
  CRISPR gRNA sequence
aacaaatttaccttctctga

SEQ ID NO: 185849 - DNA, 20 bp, Artificial
  CRISPR gRNA sequence
tgtttcctctttatttattt

SEQ ID NO: 185850 - DNA, 20 bp, Artificial
  CRISPR gRNA sequence
tcctctttatttatttattt

SEQ ID NO: 185851 - DNA, 20 bp, Artificial
  CRISPR gRNA sequence
ctttatttatttatttgttt

SEQ ID NO: 185852 - DNA, 20 bp, Artificial
  CRISPR gRNA sequence
atttatttatttgtttgttt

SEQ ID NO: 185853 - DNA, 20 bp, Artificial
  CRISPR gRNA sequence
ttattatttttgagctggag

SEQ ID NO: 185854 - DNA, 20 bp, Artificial
  CRISPR gRNA sequence
ttttgtatttttagtagaga

SEQ ID NO: 185855 - DNA, 20 bp, Artificial
  CRISPR gRNA sequence
atgagccactgcgcccgact

SEQ ID NO: 185856 - DNA, 20 bp, Artificial
  CRISPR gRNA sequence
ctgtggttctttgtgtcccc

SEQ ID NO: 185857 - DNA, 20 bp, Artificial
  CRISPR gRNA sequence
ccctttttttgtggtctctt

SEQ ID NO: 185858 - DNA, 20 bp, Artificial
  CRISPR gRNA sequence
ccctccaccttcactcccca

SEQ ID NO: 185859 - DNA, 20 bp, Artificial
  CRISPR gRNA sequence
gtccttccattctttaccct

SEQ ID NO: 185860 - DNA, 20 bp, Artificial
  CRISPR gRNA sequence
aaattttcttcctgccttca

SEQ ID NO: 185861 - DNA, 20 bp, Artificial
  CRISPR gRNA sequence
atcttccccaaactcaagaa

SEQ ID NO: 185862 - DNA, 20 bp, Artificial
  CRISPR gRNA sequence
cccaaactcaagaacccagt

SEQ ID NO: 185863 - DNA, 20 bp, Artificial
  CRISPR gRNA sequence
cttccaaagagaatgagaga

SEQ ID NO: 185864 - DNA, 20 bp, Artificial
  CRISPR gRNA sequence
cttttcctttgtaatttgga

SEQ ID NO: 185865 - DNA, 20 bp, Artificial
  CRISPR gRNA sequence
tgggtctctgcccttgtctt

SEQ ID NO: 185866 - DNA, 20 bp, Artificial
  CRISPR gRNA sequence
atctgtgcatgtgggagggt

SEQ ID NO: 185867 - DNA, 20 bp, Artificial
  CRISPR gRNA sequence
gggtaggagtttctatattt

SEQ ID NO: 185868 - DNA, 20 bp, Artificial
  CRISPR gRNA sequence
ggccttggtagcctcttatc

SEQ ID NO: 185869 - DNA, 20 bp, Artificial
  CRISPR gRNA sequence
cacaggcaggtatggaagca

SEQ ID NO: 185870 - DNA, 20 bp, Artificial
  CRISPR gRNA sequence
gtgtagtcaggagggaggta

SEQ ID NO: 185871 - DNA, 20 bp, Artificial
  CRISPR gRNA sequence
attttgtgacatgttctcaa

SEQ ID NO: 185872 - DNA, 20 bp, Artificial
  CRISPR gRNA sequence
ctgcagtaaagtctggggcc

SEQ ID NO: 185873 - DNA, 20 bp, Artificial
  CRISPR gRNA sequence
aagttgtaagatcatgctcc

SEQ ID NO: 185874 - DNA, 20 bp, Artificial
  CRISPR gRNA sequence
gcttcttcatcctgacatcc

SEQ ID NO: 185875 - DNA, 20 bp, Artificial
  CRISPR gRNA sequence
aatggctatatcccacccaa

SEQ ID NO: 185876 - DNA, 20 bp, Artificial
  CRISPR gRNA sequence
gcttcttttatacatcttct

SEQ ID NO: 185877 - DNA, 20 bp, Artificial
  CRISPR gRNA sequence
gtggcacaatcttggctcac

SEQ ID NO: 185878 - DNA, 20 bp, Artificial
  CRISPR gRNA sequence
agcttcaacctgctgggctc

SEQ ID NO: 185879 - DNA, 20 bp, Artificial
  CRISPR gRNA sequence
cttttatatttttagtagag

SEQ ID NO: 185880 - DNA, 20 bp, Artificial
  CRISPR gRNA sequence
ggaaaagaccatcctcataa

SEQ ID NO: 185881 - DNA, 20 bp, Artificial
  CRISPR gRNA sequence
ctccttgacctcccaaagtg

SEQ ID NO: 185882 - DNA, 20 bp, Artificial
  CRISPR gRNA sequence
tattaatattaattaagcta

SEQ ID NO: 185883 - DNA, 20 bp, Artificial
  CRISPR gRNA sequence
agctgctcatatagaggtca

SEQ ID NO: 185884 - DNA, 20 bp, Artificial
  CRISPR gRNA sequence
atagtctttattcttctgtc

SEQ ID NO: 185885 - DNA, 20 bp, Artificial
  CRISPR gRNA sequence
aaacagtccttaatgaaaca

SEQ ID NO: 185886 - DNA, 20 bp, Artificial
  CRISPR gRNA sequence
ccctgagcggtactcccgct

SEQ ID NO: 185887 - DNA, 20 bp, Artificial
  CRISPR gRNA sequence
gtggttctccaccacagaga

SEQ ID NO: 185888 - DNA, 20 bp, Artificial
  CRISPR gRNA sequence
ctcccggatagcgcctcctt

SEQ ID NO: 185889 - DNA, 20 bp, Artificial
  CRISPR gRNA sequence
ctagggtgaaacacgtgaca

SEQ ID NO: 185890 - DNA, 20 bp, Artificial
  CRISPR gRNA sequence
taacctccattttgtcatct

SEQ ID NO: 185891 - DNA, 20 bp, Artificial
  CRISPR gRNA sequence
tcttttccttatgtttcgct

SEQ ID NO: 185892 - DNA, 20 bp, Artificial
  CRISPR gRNA sequence
agctactcgggaggctgagg

SEQ ID NO: 185893 - DNA, 20 bp, Artificial
  CRISPR gRNA sequence
tgtcttaaaaaaaaaaaagg

SEQ ID NO: 185894 - DNA, 20 bp, Artificial
  CRISPR gRNA sequence
ttaaaaaaaaaaaaggaaag

SEQ ID NO: 185895 - DNA, 20 bp, Artificial
  CRISPR gRNA sequence
aaaaaaaaaaggaaagaaag

SEQ ID NO: 185896 - DNA, 20 bp, Artificial
  CRISPR gRNA sequence
gggagattctgggaagatga

SEQ ID NO: 185897 - DNA, 20 bp, Artificial
  CRISPR gRNA sequence
ccctctttcagagtgctcag

SEQ ID NO: 185898 - DNA, 20 bp, Artificial
  CRISPR gRNA sequence
tagcatgatgtcttacccca

SEQ ID NO: 185899 - DNA, 20 bp, Artificial
  CRISPR gRNA sequence
cagaagaaaaacagggaaat

SEQ ID NO: 185900 - DNA, 20 bp, Artificial
  CRISPR gRNA sequence
agtaagcaggctgaaggcag

SEQ ID NO: 185901 - DNA, 20 bp, Artificial
  CRISPR gRNA sequence
caggaagaaaatttaggatg

SEQ ID NO: 185902 - DNA, 20 bp, Artificial
  CRISPR gRNA sequence
gagcagtacctagagggagg

SEQ ID NO: 185903 - DNA, 20 bp, Artificial
  CRISPR gRNA sequence
ttatgtgaagcaagaagggt

SEQ ID NO: 185904 - DNA, 20 bp, Artificial
  CRISPR gRNA sequence
acaaaaaaagggactgaggt

SEQ ID NO: 185905 - DNA, 20 bp, Artificial
  CRISPR gRNA sequence
gcaggctcaataggcagaca

SEQ ID NO: 185906 - DNA, 20 bp, Artificial
  CRISPR gRNA sequence
gagaccatcctggctaacac

SEQ ID NO: 185907 - DNA, 20 bp, Artificial
  CRISPR gRNA sequence
gcatgaagcagtcccaggtg

SEQ ID NO: 185908 - DNA, 20 bp, Artificial
  CRISPR gRNA sequence
tgagaagagacagaggaaaa

SEQ ID NO: 185909 - DNA, 20 bp, Artificial
  CRISPR gRNA sequence
agacagaggaaaaggagaaa

SEQ ID NO: 185910 - DNA, 20 bp, Artificial
  CRISPR gRNA sequence
agctatgccccttggatgct

SEQ ID NO: 185911 - DNA, 20 bp, Artificial
  CRISPR gRNA sequence
agacagattgtggggagaag

SEQ ID NO: 185912 - DNA, 20 bp, Artificial
  CRISPR gRNA sequence
acagggtgttccatgaagat

SEQ ID NO: 185913 - DNA, 20 bp, Artificial
  CRISPR gRNA sequence
taggcctcgcaccaggtacc

SEQ ID NO: 185914 - DNA, 20 bp, Artificial
  CRISPR gRNA sequence
ataagctcagattctcactc

SEQ ID NO: 185915 - DNA, 20 bp, Artificial
  CRISPR gRNA sequence
ctgtacagcttctagtgctg

SEQ ID NO: 185916 - DNA, 20 bp, Artificial
  CRISPR gRNA sequence
gatacataggaatagattta

SEQ ID NO: 185917 - DNA, 20 bp, Artificial
  CRISPR gRNA sequence
attttgctcctgaggtatat

SEQ ID NO: 185918 - DNA, 20 bp, Artificial
  CRISPR gRNA sequence
ctcctgaggtatatcaagaa

SEQ ID NO: 185919 - DNA, 20 bp, Artificial
  CRISPR gRNA sequence
gagacagggagagggtatat

SEQ ID NO: 185920 - DNA, 20 bp, Artificial
  CRISPR gRNA sequence
cgtataatgaaagagtttca

SEQ ID NO: 185921 - DNA, 20 bp, Artificial
  CRISPR gRNA sequence
gcccccagacctggctatgg

SEQ ID NO: 185922 - DNA, 20 bp, Artificial
  CRISPR gRNA sequence
ggtatcggctgagccatctt

SEQ ID NO: 185923 - DNA, 20 bp, Artificial
  CRISPR gRNA sequence
cagtcagtgaggcggcccgt

SEQ ID NO: 185924 - DNA, 20 bp, Artificial
  CRISPR gRNA sequence
atggaatggccatctcccct

SEQ ID NO: 185925 - DNA, 20 bp, Artificial
  CRISPR gRNA sequence
cattatcctggagggcatca

SEQ ID NO: 185926 - DNA, 20 bp, Artificial
  CRISPR gRNA sequence
ggaaggctggagatcatgaa

SEQ ID NO: 185927 - DNA, 20 bp, Artificial
  CRISPR gRNA sequence
ccccgcttccggcgtggccc

SEQ ID NO: 185928 - DNA, 20 bp, Artificial
  CRISPR gRNA sequence
agcgcggtgggcaccagcag

SEQ ID NO: 185929 - DNA, 20 bp, Artificial
  CRISPR gRNA sequence
tggaacaccacttcggtgta

SEQ ID NO: 185930 - DNA, 20 bp, Artificial
  CRISPR gRNA sequence
aaatattgtcctccttacct

SEQ ID NO: 185931 - DNA, 20 bp, Artificial
  CRISPR gRNA sequence
ctattcctatgtatccttag

SEQ ID NO: 185932 - DNA, 20 bp, Artificial
  CRISPR gRNA sequence
tgtatccttagatagaaacc

SEQ ID NO: 185933 - DNA, 20 bp, Artificial
  CRISPR gRNA sequence
acatacaggttctctaggga

SEQ ID NO: 185934 - DNA, 20 bp, Artificial
  CRISPR gRNA sequence
accctgagtgattctctgag

SEQ ID NO: 185935 - DNA, 20 bp, Artificial
  CRISPR gRNA sequence
ttctccccacaatctgtctt

SEQ ID NO: 185936 - DNA, 20 bp, Artificial
  CRISPR gRNA sequence
agaagtttagggaaaagctg

SEQ ID NO: 185937 - DNA, 20 bp, Artificial
  CRISPR gRNA sequence
cagaaggctgtgggctcctc

SEQ ID NO: 185938 - DNA, 20 bp, Artificial
  CRISPR gRNA sequence
aacccagtttgggcttccaa

SEQ ID NO: 185939 - DNA, 20 bp, Artificial
  CRISPR gRNA sequence
actccttggggaggcatcac

SEQ ID NO: 185940 - DNA, 20 bp, Artificial
  CRISPR gRNA sequence
agcacagtggctgccctgct

SEQ ID NO: 185941 - DNA, 20 bp, Artificial
  CRISPR gRNA sequence
aggtatttggaagaagtctt

SEQ ID NO: 185942 - DNA, 20 bp, Artificial
  CRISPR gRNA sequence
tcaggattctgttcatcttc

SEQ ID NO: 185943 - DNA, 20 bp, Artificial
  CRISPR gRNA sequence
agaagacgaggcaaagacac

SEQ ID NO: 185944 - DNA, 20 bp, Artificial
  CRISPR gRNA sequence
aagggtttgcggagaagtac

SEQ ID NO: 185945 - DNA, 20 bp, Artificial
  CRISPR gRNA sequence
ggaacccaccagcagctcat

SEQ ID NO: 185946 - DNA, 20 bp, Artificial
  CRISPR gRNA sequence
tgcaggctcctgcagatgct

SEQ ID NO: 185947 - DNA, 20 bp, Artificial
  CRISPR gRNA sequence
ttgtataattatgatgttag

SEQ ID NO: 185948 - DNA, 20 bp, Artificial
  CRISPR gRNA sequence
atgatgtcttaccccagaag

SEQ ID NO: 185949 - DNA, 20 bp, Artificial
  CRISPR gRNA sequence
tttataagaaaatgctagat

SEQ ID NO: 185950 - DNA, 20 bp, Artificial
  CRISPR gRNA sequence
tgaggtatatcaagaatgag

SEQ ID NO: 185951 - DNA, 20 bp, Artificial
  CRISPR gRNA sequence
aacctgtctggttctgttgg

SEQ ID NO: 185952 - DNA, 20 bp, Artificial
  CRISPR gRNA sequence
caacggttggctccaagagc

SEQ ID NO: 185953 - DNA, 20 bp, Artificial
  CRISPR gRNA sequence
attgtcctccttaccttaag

SEQ ID NO: 185954 - DNA, 20 bp, Artificial
  CRISPR gRNA sequence
ctacttttgcacccttcatg

SEQ ID NO: 185955 - DNA, 20 bp, Artificial
  CRISPR gRNA sequence
atcctggaggcagctgccta

SEQ ID NO: 185956 - DNA, 20 bp, Artificial
  CRISPR gRNA sequence
gaggcagctgcctactctgc

SEQ ID NO: 185957 - DNA, 20 bp, Artificial
  CRISPR gRNA sequence
cctactctgcagctgtggtt

SEQ ID NO: 185958 - DNA, 20 bp, Artificial
  CRISPR gRNA sequence
ctctgcagctgtggttctcc

SEQ ID NO: 185959 - DNA, 20 bp, Artificial
  CRISPR gRNA sequence
tgcagctgtggttctccacc

SEQ ID NO: 185960 - DNA, 20 bp, Artificial
  CRISPR gRNA sequence
cagctgtggttctccaccac

SEQ ID NO: 185961 - DNA, 20 bp, Artificial
  CRISPR gRNA sequence
tggttctccaccacagagag

SEQ ID NO: 185962 - DNA, 20 bp, Artificial
  CRISPR gRNA sequence
tccaccacagagagaagaaa

SEQ ID NO: 185963 - DNA, 20 bp, Artificial
  CRISPR gRNA sequence
caccacagagagaagaaaag

SEQ ID NO: 185964 - DNA, 20 bp, Artificial
  CRISPR gRNA sequence
agaaggctttcattctggag

SEQ ID NO: 185965 - DNA, 20 bp, Artificial
  CRISPR gRNA sequence
tcattctggagcatctgcag

SEQ ID NO: 185966 - DNA, 20 bp, Artificial
  CRISPR gRNA sequence
cattctggagcatctgcagg

SEQ ID NO: 185967 - DNA, 20 bp, Artificial
  CRISPR gRNA sequence
attctggagcatctgcagga

SEQ ID NO: 185968 - DNA, 20 bp, Artificial
  CRISPR gRNA sequence
tggagcatctgcaggagcct

SEQ ID NO: 185969 - DNA, 20 bp, Artificial
  CRISPR gRNA sequence
gagcatctgcaggagcctgc

SEQ ID NO: 185970 - DNA, 20 bp, Artificial
  CRISPR gRNA sequence
caggagcctgcaccatggcc

SEQ ID NO: 185971 - DNA, 20 bp, Artificial
  CRISPR gRNA sequence
caccatggcccagtagcacc

SEQ ID NO: 185972 - DNA, 20 bp, Artificial
  CRISPR gRNA sequence
tttctccatgagctgctggt

SEQ ID NO: 185973 - DNA, 20 bp, Artificial
  CRISPR gRNA sequence
ttctccatgagctgctggtg

SEQ ID NO: 185974 - DNA, 20 bp, Artificial
  CRISPR gRNA sequence
tctccatgagctgctggtgg

SEQ ID NO: 185975 - DNA, 20 bp, Artificial
  CRISPR gRNA sequence
ctccatgagctgctggtggg

SEQ ID NO: 185976 - DNA, 20 bp, Artificial
  CRISPR gRNA sequence
tccatgagctgctggtgggt

SEQ ID NO: 185977 - DNA, 20 bp, Artificial
  CRISPR gRNA sequence
catgagctgctggtgggttc

SEQ ID NO: 185978 - DNA, 20 bp, Artificial
  CRISPR gRNA sequence
ctggtgggttcccccctccc

SEQ ID NO: 185979 - DNA, 20 bp, Artificial
  CRISPR gRNA sequence
gtgggttcccccctcccgga

SEQ ID NO: 185980 - DNA, 20 bp, Artificial
  CRISPR gRNA sequence
ccccctcccggatagcgcct

SEQ ID NO: 185981 - DNA, 20 bp, Artificial
  CRISPR gRNA sequence
ccggatagcgcctccttcca

SEQ ID NO: 185982 - DNA, 20 bp, Artificial
  CRISPR gRNA sequence
cttccagaaagaggatgtgg

SEQ ID NO: 185983 - DNA, 20 bp, Artificial
  CRISPR gRNA sequence
ccagaaagaggatgtggtca

SEQ ID NO: 185984 - DNA, 20 bp, Artificial
  CRISPR gRNA sequence
cagaaagaggatgtggtcag

SEQ ID NO: 185985 - DNA, 20 bp, Artificial
  CRISPR gRNA sequence
ctccaccaggctgaggtgct

SEQ ID NO: 185986 - DNA, 20 bp, Artificial
  CRISPR gRNA sequence
caccaggctgaggtgctggg

SEQ ID NO: 185987 - DNA, 20 bp, Artificial
  CRISPR gRNA sequence
aggtgctgggtgatgagaag

SEQ ID NO: 185988 - DNA, 20 bp, Artificial
  CRISPR gRNA sequence
ggtgatgagaagcactgagc

SEQ ID NO: 185989 - DNA, 20 bp, Artificial
  CRISPR gRNA sequence
agcgggagtaccgctcaggg

SEQ ID NO: 185990 - DNA, 20 bp, Artificial
  CRISPR gRNA sequence
agggctttcgtacaggagct

SEQ ID NO: 185991 - DNA, 20 bp, Artificial
  CRISPR gRNA sequence
tcgtacaggagctgctccac

SEQ ID NO: 185992 - DNA, 20 bp, Artificial
  CRISPR gRNA sequence
cgtacaggagctgctccacc

SEQ ID NO: 185993 - DNA, 20 bp, Artificial
  CRISPR gRNA sequence
gtacaggagctgctccacct

SEQ ID NO: 185994 - DNA, 20 bp, Artificial
  CRISPR gRNA sequence
ctccacctgaggaaagacat

SEQ ID NO: 185995 - DNA, 20 bp, Artificial
  CRISPR gRNA sequence
cacctgaggaaagacatcgg

SEQ ID NO: 185996 - DNA, 20 bp, Artificial
  CRISPR gRNA sequence
aggaaagacatcggaccgtc

SEQ ID NO: 185997 - DNA, 20 bp, Artificial
  CRISPR gRNA sequence
ccctcagcccagggagacac

SEQ ID NO: 185998 - DNA, 20 bp, Artificial
  CRISPR gRNA sequence
agcccagggagacacctgtg

SEQ ID NO: 185999 - DNA, 20 bp, Artificial
  CRISPR gRNA sequence
tgtttccagggctgggactg

SEQ ID NO: 186000 - DNA, 20 bp, Artificial
  CRISPR gRNA sequence
ccagggctgggactgacctc

SEQ ID NO: 186001 - DNA, 20 bp, Artificial
  CRISPR gRNA sequence
cagggctgggactgacctca

SEQ ID NO: 186002 - DNA, 20 bp, Artificial
  CRISPR gRNA sequence
ggactgacctcacaggatca

SEQ ID NO: 186003 - DNA, 20 bp, Artificial
  CRISPR gRNA sequence
acctcacaggatcactgctg

SEQ ID NO: 186004 - DNA, 20 bp, Artificial
  CRISPR gRNA sequence
acaggatcactgctggctct

SEQ ID NO: 186005 - DNA, 20 bp, Artificial
  CRISPR gRNA sequence
ctggctctgctaacaacccc

SEQ ID NO: 186006 - DNA, 20 bp, Artificial
  CRISPR gRNA sequence
gctctgctaacaaccccaag

SEQ ID NO: 186007 - DNA, 20 bp, Artificial
  CRISPR gRNA sequence
tgctaacaaccccaaggaca

SEQ ID NO: 186008 - DNA, 20 bp, Artificial
  CRISPR gRNA sequence
ctaacaaccccaaggacacc

SEQ ID NO: 186009 - DNA, 20 bp, Artificial
  CRISPR gRNA sequence
acaaccccaaggacaccaac

SEQ ID NO: 186010 - DNA, 20 bp, Artificial
  CRISPR gRNA sequence
cccattctgagtacttctcc

SEQ ID NO: 186011 - DNA, 20 bp, Artificial
  CRISPR gRNA sequence
ccattctgagtacttctccg

SEQ ID NO: 186012 - DNA, 20 bp, Artificial
  CRISPR gRNA sequence
tgagtacttctccgcaaacc

SEQ ID NO: 186013 - DNA, 20 bp, Artificial
  CRISPR gRNA sequence
agtacttctccgcaaaccct

SEQ ID NO: 186014 - DNA, 20 bp, Artificial
  CRISPR gRNA sequence
ctccgcaaaccctttgtttc

SEQ ID NO: 186015 - DNA, 20 bp, Artificial
  CRISPR gRNA sequence
tccgcaaaccctttgtttca

SEQ ID NO: 186016 - DNA, 20 bp, Artificial
  CRISPR gRNA sequence
cgcaaaccctttgtttcatt

SEQ ID NO: 186017 - DNA, 20 bp, Artificial
  CRISPR gRNA sequence
tgtttcattaaggactgttt

SEQ ID NO: 186018 - DNA, 20 bp, Artificial
  CRISPR gRNA sequence
gtttcattaaggactgtttt

SEQ ID NO: 186019 - DNA, 20 bp, Artificial
  CRISPR gRNA sequence
tttcattaaggactgtttta

SEQ ID NO: 186020 - DNA, 20 bp, Artificial
  CRISPR gRNA sequence
cattaaggactgttttacat

SEQ ID NO: 186021 - DNA, 20 bp, Artificial
  CRISPR gRNA sequence
attaaggactgttttacatg

SEQ ID NO: 186022 - DNA, 20 bp, Artificial
  CRISPR gRNA sequence
aggactgttttacatgaagg

SEQ ID NO: 186023 - DNA, 20 bp, Artificial
  CRISPR gRNA sequence
ttttacatgaagggtgcaaa

SEQ ID NO: 186024 - DNA, 20 bp, Artificial
  CRISPR gRNA sequence
tacatgaagggtgcaaaagt

SEQ ID NO: 186025 - DNA, 20 bp, Artificial
  CRISPR gRNA sequence
acatgaagggtgcaaaagta

SEQ ID NO: 186026 - DNA, 20 bp, Artificial
  CRISPR gRNA sequence
catgaagggtgcaaaagtag

SEQ ID NO: 186027 - DNA, 20 bp, Artificial
  CRISPR gRNA sequence
gggtgaaacacgtgacagaa

SEQ ID NO: 186028 - DNA, 20 bp, Artificial
  CRISPR gRNA sequence
ttgaatagtcctcttctcta

SEQ ID NO: 186029 - DNA, 20 bp, Artificial
  CRISPR gRNA sequence
aatagtcctcttctctaccc

SEQ ID NO: 186030 - DNA, 20 bp, Artificial
  CRISPR gRNA sequence
ttctctacccatggacttgg

SEQ ID NO: 186031 - DNA, 20 bp, Artificial
  CRISPR gRNA sequence
ctctacccatggacttggca

SEQ ID NO: 186032 - DNA, 20 bp, Artificial
  CRISPR gRNA sequence
tctacccatggacttggcat

SEQ ID NO: 186033 - DNA, 20 bp, Artificial
  CRISPR gRNA sequence
tacccatggacttggcattt

SEQ ID NO: 186034 - DNA, 20 bp, Artificial
  CRISPR gRNA sequence
cccatggacttggcattttt

SEQ ID NO: 186035 - DNA, 20 bp, Artificial
  CRISPR gRNA sequence
ggcatttttatattcgattt

SEQ ID NO: 186036 - DNA, 20 bp, Artificial
  CRISPR gRNA sequence
gcatttttatattcgatttt

SEQ ID NO: 186037 - DNA, 20 bp, Artificial
  CRISPR gRNA sequence
ttatattcgattttaaggaa

SEQ ID NO: 186038 - DNA, 20 bp, Artificial
  CRISPR gRNA sequence
tatattcgattttaaggaaa

SEQ ID NO: 186039 - DNA, 20 bp, Artificial
  CRISPR gRNA sequence
atattcgattttaaggaaat

SEQ ID NO: 186040 - DNA, 20 bp, Artificial
  CRISPR gRNA sequence
tattcgattttaaggaaata

SEQ ID NO: 186041 - DNA, 20 bp, Artificial
  CRISPR gRNA sequence
gattttaaggaaatataact

SEQ ID NO: 186042 - DNA, 20 bp, Artificial
  CRISPR gRNA sequence
taaggaaatataacttagta

SEQ ID NO: 186043 - DNA, 20 bp, Artificial
  CRISPR gRNA sequence
aaggaaatataacttagtag

SEQ ID NO: 186044 - DNA, 20 bp, Artificial
  CRISPR gRNA sequence
aggaaatataacttagtagt

SEQ ID NO: 186045 - DNA, 20 bp, Artificial
  CRISPR gRNA sequence
agtagtaaagagatgagcat

SEQ ID NO: 186046 - DNA, 20 bp, Artificial
  CRISPR gRNA sequence
gtagtaaagagatgagcatt

SEQ ID NO: 186047 - DNA, 20 bp, Artificial
  CRISPR gRNA sequence
aagtcaggcagacctgaatt

SEQ ID NO: 186048 - DNA, 20 bp, Artificial
  CRISPR gRNA sequence
aatttgggtcaaggctgcgc

SEQ ID NO: 186049 - DNA, 20 bp, Artificial
  CRISPR gRNA sequence
gggtcaaggctgcgccactc

SEQ ID NO: 186050 - DNA, 20 bp, Artificial
  CRISPR gRNA sequence
ggtcaaggctgcgccactca

SEQ ID NO: 186051 - DNA, 20 bp, Artificial
  CRISPR gRNA sequence
cgccactcaaaagctatatg

SEQ ID NO: 186052 - DNA, 20 bp, Artificial
  CRISPR gRNA sequence
aaaagctatatgacctctat

SEQ ID NO: 186053 - DNA, 20 bp, Artificial
  CRISPR gRNA sequence
tatgacctctatatgagcag

SEQ ID NO: 186054 - DNA, 20 bp, Artificial
  CRISPR gRNA sequence
tatatgagcagcttattcaa

SEQ ID NO: 186055 - DNA, 20 bp, Artificial
  CRISPR gRNA sequence
tatgagcagcttattcaacc

SEQ ID NO: 186056 - DNA, 20 bp, Artificial
  CRISPR gRNA sequence
attcaacctcttttaacctc

SEQ ID NO: 186057 - DNA, 20 bp, Artificial
  CRISPR gRNA sequence
ttcaacctcttttaacctcc

SEQ ID NO: 186058 - DNA, 20 bp, Artificial
  CRISPR gRNA sequence
aacctcttttaacctccatt

SEQ ID NO: 186059 - DNA, 20 bp, Artificial
  CRISPR gRNA sequence
ttttaacctccattttgtca

SEQ ID NO: 186060 - DNA, 20 bp, Artificial
  CRISPR gRNA sequence
ttaacctccattttgtcatc

SEQ ID NO: 186061 - DNA, 20 bp, Artificial
  CRISPR gRNA sequence
taacctccattttgtcatct

SEQ ID NO: 186062 - DNA, 20 bp, Artificial
  CRISPR gRNA sequence
aacctccattttgtcatctg

SEQ ID NO: 186063 - DNA, 20 bp, Artificial
  CRISPR gRNA sequence
acctccattttgtcatctgt

SEQ ID NO: 186064 - DNA, 20 bp, Artificial
  CRISPR gRNA sequence
cattttgtcatctgtagaat

SEQ ID NO: 186065 - DNA, 20 bp, Artificial
  CRISPR gRNA sequence
tgtcatctgtagaatgatga

SEQ ID NO: 186066 - DNA, 20 bp, Artificial
  CRISPR gRNA sequence
gtcatctgtagaatgatgat

SEQ ID NO: 186067 - DNA, 20 bp, Artificial
  CRISPR gRNA sequence
tcatctgtagaatgatgata

SEQ ID NO: 186068 - DNA, 20 bp, Artificial
  CRISPR gRNA sequence
tagaatgatgataaatgcct

SEQ ID NO: 186069 - DNA, 20 bp, Artificial
  CRISPR gRNA sequence
gctcagaaggattcctaatg

SEQ ID NO: 186070 - DNA, 20 bp, Artificial
  CRISPR gRNA sequence
agaaggattcctaatgaata

SEQ ID NO: 186071 - DNA, 20 bp, Artificial
  CRISPR gRNA sequence
ctaatgaataaatgagtgac

SEQ ID NO: 186072 - DNA, 20 bp, Artificial
  CRISPR gRNA sequence
atgaataaatgagtgacagt

SEQ ID NO: 186073 - DNA, 20 bp, Artificial
  CRISPR gRNA sequence
gcttaattaatattaatatg

SEQ ID NO: 186074 - DNA, 20 bp, Artificial
  CRISPR gRNA sequence
aattaatattaatatgatta

SEQ ID NO: 186075 - DNA, 20 bp, Artificial
  CRISPR gRNA sequence
attaatattaatatgattag

SEQ ID NO: 186076 - DNA, 20 bp, Artificial
  CRISPR gRNA sequence
atattaatatgattaggatg

SEQ ID NO: 186077 - DNA, 20 bp, Artificial
  CRISPR gRNA sequence
atatgattaggatgggctgg

SEQ ID NO: 186078 - DNA, 20 bp, Artificial
  CRISPR gRNA sequence
ggatgggctgggcccggtgg

SEQ ID NO: 186079 - DNA, 20 bp, Artificial
  CRISPR gRNA sequence
ggcccggtggctcatgccta

SEQ ID NO: 186080 - DNA, 20 bp, Artificial
  CRISPR gRNA sequence
atgcctataatcctagcact

SEQ ID NO: 186081 - DNA, 20 bp, Artificial
  CRISPR gRNA sequence
taatcctagcactttgggag

SEQ ID NO: 186082 - DNA, 20 bp, Artificial
  CRISPR gRNA sequence
gcactttgggaggtcaagga

SEQ ID NO: 186083 - DNA, 20 bp, Artificial
  CRISPR gRNA sequence
tgggaggtcaaggagggagg

SEQ ID NO: 186084 - DNA, 20 bp, Artificial
  CRISPR gRNA sequence
gggaggtcaaggagggagga

SEQ ID NO: 186085 - DNA, 20 bp, Artificial
  CRISPR gRNA sequence
ggaggtcaaggagggaggat

SEQ ID NO: 186086 - DNA, 20 bp, Artificial
  CRISPR gRNA sequence
gggcccaggagttcaaggcc

SEQ ID NO: 186087 - DNA, 20 bp, Artificial
  CRISPR gRNA sequence
ggcccaggagttcaaggcca

SEQ ID NO: 186088 - DNA, 20 bp, Artificial
  CRISPR gRNA sequence
aaggccagcctgggcaacat

SEQ ID NO: 186089 - DNA, 20 bp, Artificial
  CRISPR gRNA sequence
ggcaacatagcgggacgctg

SEQ ID NO: 186090 - DNA, 20 bp, Artificial
  CRISPR gRNA sequence
tctgtacaaaaaataatttt

SEQ ID NO: 186091 - DNA, 20 bp, Artificial
  CRISPR gRNA sequence
tacaaaaaataattttttta

SEQ ID NO: 186092 - DNA, 20 bp, Artificial
  CRISPR gRNA sequence
ttttaaataaacgatattat

SEQ ID NO: 186093 - DNA, 20 bp, Artificial
  CRISPR gRNA sequence
tttaaataaacgatattatg

SEQ ID NO: 186094 - DNA, 20 bp, Artificial
  CRISPR gRNA sequence
ttaaataaacgatattatga

SEQ ID NO: 186095 - DNA, 20 bp, Artificial
  CRISPR gRNA sequence
taaataaacgatattatgag

SEQ ID NO: 186096 - DNA, 20 bp, Artificial
  CRISPR gRNA sequence
aaataaacgatattatgagg

SEQ ID NO: 186097 - DNA, 20 bp, Artificial
  CRISPR gRNA sequence
aataaacgatattatgagga

SEQ ID NO: 186098 - DNA, 20 bp, Artificial
  CRISPR gRNA sequence
tgaggatggtcttttcctta

SEQ ID NO: 186099 - DNA, 20 bp, Artificial
  CRISPR gRNA sequence
ttccttatgtttcgctttag

SEQ ID NO: 186100 - DNA, 20 bp, Artificial
  CRISPR gRNA sequence
tccttatgtttcgctttaga

SEQ ID NO: 186101 - DNA, 20 bp, Artificial
  CRISPR gRNA sequence
ccttatgtttcgctttagaa

SEQ ID NO: 186102 - DNA, 20 bp, Artificial
  CRISPR gRNA sequence
cttatgtttcgctttagaaa

SEQ ID NO: 186103 - DNA, 20 bp, Artificial
  CRISPR gRNA sequence
atgtttcgctttagaaattc

SEQ ID NO: 186104 - DNA, 20 bp, Artificial
  CRISPR gRNA sequence
tgtttcgctttagaaattca

SEQ ID NO: 186105 - DNA, 20 bp, Artificial
  CRISPR gRNA sequence
cgctttagaaattcagtcta

SEQ ID NO: 186106 - DNA, 20 bp, Artificial
  CRISPR gRNA sequence
gctttagaaattcagtctat

SEQ ID NO: 186107 - DNA, 20 bp, Artificial
  CRISPR gRNA sequence
tagaaattcagtctatagga

SEQ ID NO: 186108 - DNA, 20 bp, Artificial
  CRISPR gRNA sequence
agaaattcagtctataggac

SEQ ID NO: 186109 - DNA, 20 bp, Artificial
  CRISPR gRNA sequence
gaaattcagtctataggact

SEQ ID NO: 186110 - DNA, 20 bp, Artificial
  CRISPR gRNA sequence
agtctataggactgggcgca

SEQ ID NO: 186111 - DNA, 20 bp, Artificial
  CRISPR gRNA sequence
taggactgggcgcagtggct

SEQ ID NO: 186112 - DNA, 20 bp, Artificial
  CRISPR gRNA sequence
ggcgcagtggctcacaccta

SEQ ID NO: 186113 - DNA, 20 bp, Artificial
  CRISPR gRNA sequence
acacctataaccccagccct

SEQ ID NO: 186114 - DNA, 20 bp, Artificial
  CRISPR gRNA sequence
taaccccagccctttgggag

SEQ ID NO: 186115 - DNA, 20 bp, Artificial
  CRISPR gRNA sequence
tgggaggctgaggggggcag

SEQ ID NO: 186116 - DNA, 20 bp, Artificial
  CRISPR gRNA sequence
gggaggctgaggggggcaga

SEQ ID NO: 186117 - DNA, 20 bp, Artificial
  CRISPR gRNA sequence
ggaggctgaggggggcagat

SEQ ID NO: 186118 - DNA, 20 bp, Artificial
  CRISPR gRNA sequence
aggggggcagattacctgag

SEQ ID NO: 186119 - DNA, 20 bp, Artificial
  CRISPR gRNA sequence
cctgagctcaggaattcaag

SEQ ID NO: 186120 - DNA, 20 bp, Artificial
  CRISPR gRNA sequence
agctcaggaattcaaggcca

SEQ ID NO: 186121 - DNA, 20 bp, Artificial
  CRISPR gRNA sequence
aggaattcaaggccagcctg

SEQ ID NO: 186122 - DNA, 20 bp, Artificial
  CRISPR gRNA sequence
aaggccagcctgggcaacat

SEQ ID NO: 186123 - DNA, 20 bp, Artificial
  CRISPR gRNA sequence
ggcaacatggtgaaacccat

SEQ ID NO: 186124 - DNA, 20 bp, Artificial
  CRISPR gRNA sequence
tactaaaaatataaaagtca

SEQ ID NO: 186125 - DNA, 20 bp, Artificial
  CRISPR gRNA sequence
ctaaaaatataaaagtcaac

SEQ ID NO: 186126 - DNA, 20 bp, Artificial
  CRISPR gRNA sequence
aaaatataaaagtcaaccag

SEQ ID NO: 186127 - DNA, 20 bp, Artificial
  CRISPR gRNA sequence
tagtcccagctactcgggag

SEQ ID NO: 186128 - DNA, 20 bp, Artificial
  CRISPR gRNA sequence
ctcgggaggctgaggggaga

SEQ ID NO: 186129 - DNA, 20 bp, Artificial
  CRISPR gRNA sequence
gggaggctgaggggagaatc

SEQ ID NO: 186130 - DNA, 20 bp, Artificial
  CRISPR gRNA sequence
aggggagaatcgcttgagcc

SEQ ID NO: 186131 - DNA, 20 bp, Artificial
  CRISPR gRNA sequence
gagcccagcaggttgaagct

SEQ ID NO: 186132 - DNA, 20 bp, Artificial
  CRISPR gRNA sequence
agcccagcaggttgaagctg

SEQ ID NO: 186133 - DNA, 20 bp, Artificial
  CRISPR gRNA sequence
aagctgcagtgagccaagat

SEQ ID NO: 186134 - DNA, 20 bp, Artificial
  CRISPR gRNA sequence
cagtgagccaagattgtgcc

SEQ ID NO: 186135 - DNA, 20 bp, Artificial
  CRISPR gRNA sequence
tgccactgcgctccagcctg

SEQ ID NO: 186136 - DNA, 20 bp, Artificial
  CRISPR gRNA sequence
cgctccagcctgggcaactg

SEQ ID NO: 186137 - DNA, 20 bp, Artificial
  CRISPR gRNA sequence
cagcctgggcaactgagtga

SEQ ID NO: 186138 - DNA, 20 bp, Artificial
  CRISPR gRNA sequence
ggcaactgagtgagacactg

SEQ ID NO: 186139 - DNA, 20 bp, Artificial
  CRISPR gRNA sequence
agtgagacactgtcttaaaa

SEQ ID NO: 186140 - DNA, 20 bp, Artificial
  CRISPR gRNA sequence
tcttaaaaaaaaaaaaggaa

SEQ ID NO: 186141 - DNA, 20 bp, Artificial
  CRISPR gRNA sequence
aaaaaaaaaaaaggaaagaa

SEQ ID NO: 186142 - DNA, 20 bp, Artificial
  CRISPR gRNA sequence
aaaaaaaaaaaggaaagaaa

SEQ ID NO: 186143 - DNA, 20 bp, Artificial
  CRISPR gRNA sequence
agtctgtagtttgtagatag

SEQ ID NO: 186144 - DNA, 20 bp, Artificial
  CRISPR gRNA sequence
tagtttgtagatagtctctt

SEQ ID NO: 186145 - DNA, 20 bp, Artificial
  CRISPR gRNA sequence
gtagatagtctcttttaact

SEQ ID NO: 186146 - DNA, 20 bp, Artificial
  CRISPR gRNA sequence
tagatagtctcttttaactg

SEQ ID NO: 186147 - DNA, 20 bp, Artificial
  CRISPR gRNA sequence
ttttaactgattctaggtgt

SEQ ID NO: 186148 - DNA, 20 bp, Artificial
  CRISPR gRNA sequence
ttaactgattctaggtgtct

SEQ ID NO: 186149 - DNA, 20 bp, Artificial
  CRISPR gRNA sequence
taactgattctaggtgtctt

SEQ ID NO: 186150 - DNA, 20 bp, Artificial
  CRISPR gRNA sequence
aactgattctaggtgtcttt

SEQ ID NO: 186151 - DNA, 20 bp, Artificial
  CRISPR gRNA sequence
actgattctaggtgtctttg

SEQ ID NO: 186152 - DNA, 20 bp, Artificial
  CRISPR gRNA sequence
attctaggtgtctttgcctc

SEQ ID NO: 186153 - DNA, 20 bp, Artificial
  CRISPR gRNA sequence
taggtgtctttgcctcgtct

SEQ ID NO: 186154 - DNA, 20 bp, Artificial
  CRISPR gRNA sequence
ggtgtctttgcctcgtcttc

SEQ ID NO: 186155 - DNA, 20 bp, Artificial
  CRISPR gRNA sequence
tgcctcgtcttctatctcta

SEQ ID NO: 186156 - DNA, 20 bp, Artificial
  CRISPR gRNA sequence
gcctcgtcttctatctctac

SEQ ID NO: 186157 - DNA, 20 bp, Artificial
  CRISPR gRNA sequence
cctcgtcttctatctctact

SEQ ID NO: 186158 - DNA, 20 bp, Artificial
  CRISPR gRNA sequence
gtcttctatctctactcctt

SEQ ID NO: 186159 - DNA, 20 bp, Artificial
  CRISPR gRNA sequence
ctatctctactccttgggga

SEQ ID NO: 186160 - DNA, 20 bp, Artificial
  CRISPR gRNA sequence
tatctctactccttggggag

SEQ ID NO: 186161 - DNA, 20 bp, Artificial
  CRISPR gRNA sequence
tctctactccttggggaggc

SEQ ID NO: 186162 - DNA, 20 bp, Artificial
  CRISPR gRNA sequence
tactccttggggaggcatcc

SEQ ID NO: 186163 - DNA, 20 bp, Artificial
  CRISPR gRNA sequence
ctccttggggaggcatccaa

SEQ ID NO: 186164 - DNA, 20 bp, Artificial
  CRISPR gRNA sequence
cttggggaggcatccaatgg

SEQ ID NO: 186165 - DNA, 20 bp, Artificial
  CRISPR gRNA sequence
ggggaggcatccaatggaac

SEQ ID NO: 186166 - DNA, 20 bp, Artificial
  CRISPR gRNA sequence
gggaggcatccaatggaact

SEQ ID NO: 186167 - DNA, 20 bp, Artificial
  CRISPR gRNA sequence
gatttgggaactgagaactg

SEQ ID NO: 186168 - DNA, 20 bp, Artificial
  CRISPR gRNA sequence
gggaactgagaactgcaagg

SEQ ID NO: 186169 - DNA, 20 bp, Artificial
  CRISPR gRNA sequence
ggaactgagaactgcaagga

SEQ ID NO: 186170 - DNA, 20 bp, Artificial
  CRISPR gRNA sequence
agaactgcaaggactggttt

SEQ ID NO: 186171 - DNA, 20 bp, Artificial
  CRISPR gRNA sequence
caaggactggtttgtataat

SEQ ID NO: 186172 - DNA, 20 bp, Artificial
  CRISPR gRNA sequence
gtttgtataattatgatgtt

SEQ ID NO: 186173 - DNA, 20 bp, Artificial
  CRISPR gRNA sequence
gtataattatgatgttagta

SEQ ID NO: 186174 - DNA, 20 bp, Artificial
  CRISPR gRNA sequence
tataattatgatgttagtaa

SEQ ID NO: 186175 - DNA, 20 bp, Artificial
  CRISPR gRNA sequence
tgatgttagtaaaactaaca

SEQ ID NO: 186176 - DNA, 20 bp, Artificial
  CRISPR gRNA sequence
gtaaaactaacagaagatgt

SEQ ID NO: 186177 - DNA, 20 bp, Artificial
  CRISPR gRNA sequence
acagaagatgtataaaagaa

SEQ ID NO: 186178 - DNA, 20 bp, Artificial
  CRISPR gRNA sequence
ggtgggatatagccattaag

SEQ ID NO: 186179 - DNA, 20 bp, Artificial
  CRISPR gRNA sequence
agaagatgactgcctcacct

SEQ ID NO: 186180 - DNA, 20 bp, Artificial
  CRISPR gRNA sequence
cctcacctgtaactggctgt

SEQ ID NO: 186181 - DNA, 20 bp, Artificial
  CRISPR gRNA sequence
acctgtaactggctgtttgc

SEQ ID NO: 186182 - DNA, 20 bp, Artificial
  CRISPR gRNA sequence
taactggctgtttgcatcca

SEQ ID NO: 186183 - DNA, 20 bp, Artificial
  CRISPR gRNA sequence
gctgtttgcatccagggcac

SEQ ID NO: 186184 - DNA, 20 bp, Artificial
  CRISPR gRNA sequence
tttgcatccagggcactggt

SEQ ID NO: 186185 - DNA, 20 bp, Artificial
  CRISPR gRNA sequence
gcatccagggcactggtggc

SEQ ID NO: 186186 - DNA, 20 bp, Artificial
  CRISPR gRNA sequence
catccagggcactggtggca

SEQ ID NO: 186187 - DNA, 20 bp, Artificial
  CRISPR gRNA sequence
gtggcatcatccaggataag

SEQ ID NO: 186188 - DNA, 20 bp, Artificial
  CRISPR gRNA sequence
ccggatcaatgctcgggcca

SEQ ID NO: 186189 - DNA, 20 bp, Artificial
  CRISPR gRNA sequence
cggatcaatgctcgggccaa

SEQ ID NO: 186190 - DNA, 20 bp, Artificial
  CRISPR gRNA sequence
gggccaacgccactgcctgt

SEQ ID NO: 186191 - DNA, 20 bp, Artificial
  CRISPR gRNA sequence
cctgtcgctgaccccctgac

SEQ ID NO: 186192 - DNA, 20 bp, Artificial
  CRISPR gRNA sequence
tcgctgaccccctgacagct

SEQ ID NO: 186193 - DNA, 20 bp, Artificial
  CRISPR gRNA sequence
accccctgacagctggctcc

SEQ ID NO: 186194 - DNA, 20 bp, Artificial
  CRISPR gRNA sequence
acagctggctcccagcctcg

SEQ ID NO: 186195 - DNA, 20 bp, Artificial
  CRISPR gRNA sequence
gctcccagcctcgtctacct

SEQ ID NO: 186196 - DNA, 20 bp, Artificial
  CRISPR gRNA sequence
ccagcctcgtctacctctgc

SEQ ID NO: 186197 - DNA, 20 bp, Artificial
  CRISPR gRNA sequence
gtctacctctgcagagcaaa

SEQ ID NO: 186198 - DNA, 20 bp, Artificial
  CRISPR gRNA sequence
cctctgcagagcaaagggcc

SEQ ID NO: 186199 - DNA, 20 bp, Artificial
  CRISPR gRNA sequence
tgcagagcaaagggccaaga

SEQ ID NO: 186200 - DNA, 20 bp, Artificial
  CRISPR gRNA sequence
cagagcaaagggccaagatg

SEQ ID NO: 186201 - DNA, 20 bp, Artificial
  CRISPR gRNA sequence
atgcattcacgcactcacac

SEQ ID NO: 186202 - DNA, 20 bp, Artificial
  CRISPR gRNA sequence
acgcactcacacacaccaag

SEQ ID NO: 186203 - DNA, 20 bp, Artificial
  CRISPR gRNA sequence
acacacaccaagatctgacg

SEQ ID NO: 186204 - DNA, 20 bp, Artificial
  CRISPR gRNA sequence
acggttgtagctggataggg

SEQ ID NO: 186205 - DNA, 20 bp, Artificial
  CRISPR gRNA sequence
tagctggataggggagattc

SEQ ID NO: 186206 - DNA, 20 bp, Artificial
  CRISPR gRNA sequence
gataggggagattctgggaa

SEQ ID NO: 186207 - DNA, 20 bp, Artificial
  CRISPR gRNA sequence
tgggaagatgaacagaatcc

SEQ ID NO: 186208 - DNA, 20 bp, Artificial
  CRISPR gRNA sequence
ggaagatgaacagaatcctg

SEQ ID NO: 186209 - DNA, 20 bp, Artificial
  CRISPR gRNA sequence
aggatgtcaggatgaagaag

SEQ ID NO: 186210 - DNA, 20 bp, Artificial
  CRISPR gRNA sequence
acaacttcaaattgatgtcc

SEQ ID NO: 186211 - DNA, 20 bp, Artificial
  CRISPR gRNA sequence
caacttcaaattgatgtcca

SEQ ID NO: 186212 - DNA, 20 bp, Artificial
  CRISPR gRNA sequence
caaattgatgtccatgagta

SEQ ID NO: 186213 - DNA, 20 bp, Artificial
  CRISPR gRNA sequence
aaattgatgtccatgagtaa

SEQ ID NO: 186214 - DNA, 20 bp, Artificial
  CRISPR gRNA sequence
atgtccatgagtaaggagga

SEQ ID NO: 186215 - DNA, 20 bp, Artificial
  CRISPR gRNA sequence
aaggataaaggcaagactac

SEQ ID NO: 186216 - DNA, 20 bp, Artificial
  CRISPR gRNA sequence
ctggggtttcagcaaaggta

SEQ ID NO: 186217 - DNA, 20 bp, Artificial
  CRISPR gRNA sequence
gggtttcagcaaaggtaaag

SEQ ID NO: 186218 - DNA, 20 bp, Artificial
  CRISPR gRNA sequence
cagcaaaggtaaagatggct

SEQ ID NO: 186219 - DNA, 20 bp, Artificial
  CRISPR gRNA sequence
agcaaaggtaaagatggctg

SEQ ID NO: 186220 - DNA, 20 bp, Artificial
  CRISPR gRNA sequence
ggtggtgagatgagtggaga

SEQ ID NO: 186221 - DNA, 20 bp, Artificial
  CRISPR gRNA sequence
tgtcatagccctgagggagt

SEQ ID NO: 186222 - DNA, 20 bp, Artificial
  CRISPR gRNA sequence
agggagtccagagatgaaac

SEQ ID NO: 186223 - DNA, 20 bp, Artificial
  CRISPR gRNA sequence
tgggccccagactttactgc

SEQ ID NO: 186224 - DNA, 20 bp, Artificial
  CRISPR gRNA sequence
tactgcagcagctgtgattt

SEQ ID NO: 186225 - DNA, 20 bp, Artificial
  CRISPR gRNA sequence
actgcagcagctgtgatttc

SEQ ID NO: 186226 - DNA, 20 bp, Artificial
  CRISPR gRNA sequence
ctgcagcagctgtgatttcc

SEQ ID NO: 186227 - DNA, 20 bp, Artificial
  CRISPR gRNA sequence
cagcagctgtgatttcctcc

SEQ ID NO: 186228 - DNA, 20 bp, Artificial
  CRISPR gRNA sequence
tgatttcctccatagttggc

SEQ ID NO: 186229 - DNA, 20 bp, Artificial
  CRISPR gRNA sequence
cctccatagttggcttctgg

SEQ ID NO: 186230 - DNA, 20 bp, Artificial
  CRISPR gRNA sequence
ctccatagttggcttctggg

SEQ ID NO: 186231 - DNA, 20 bp, Artificial
  CRISPR gRNA sequence
catagttggcttctgggtca

SEQ ID NO: 186232 - DNA, 20 bp, Artificial
  CRISPR gRNA sequence
gcttctgggtcaggccatag

SEQ ID NO: 186233 - DNA, 20 bp, Artificial
  CRISPR gRNA sequence
ctgggtcaggccataggcaa

SEQ ID NO: 186234 - DNA, 20 bp, Artificial
  CRISPR gRNA sequence
tgggtcaggccataggcaat

SEQ ID NO: 186235 - DNA, 20 bp, Artificial
  CRISPR gRNA sequence
ggtcaggccataggcaatat

SEQ ID NO: 186236 - DNA, 20 bp, Artificial
  CRISPR gRNA sequence
tcttgaagacttcttccaaa

SEQ ID NO: 186237 - DNA, 20 bp, Artificial
  CRISPR gRNA sequence
cttgaagacttcttccaaat

SEQ ID NO: 186238 - DNA, 20 bp, Artificial
  CRISPR gRNA sequence
ttgaagacttcttccaaata

SEQ ID NO: 186239 - DNA, 20 bp, Artificial
  CRISPR gRNA sequence
gaagacttcttccaaatacc

SEQ ID NO: 186240 - DNA, 20 bp, Artificial
  CRISPR gRNA sequence
aagacttcttccaaatacct

SEQ ID NO: 186241 - DNA, 20 bp, Artificial
  CRISPR gRNA sequence
cttccaaatacctgtggctc

SEQ ID NO: 186242 - DNA, 20 bp, Artificial
  CRISPR gRNA sequence
ttccaaatacctgtggctct

SEQ ID NO: 186243 - DNA, 20 bp, Artificial
  CRISPR gRNA sequence
ccaaatacctgtggctcttg

SEQ ID NO: 186244 - DNA, 20 bp, Artificial
  CRISPR gRNA sequence
caaatacctgtggctcttgt

SEQ ID NO: 186245 - DNA, 20 bp, Artificial
  CRISPR gRNA sequence
tggctcttgtcccactgcag

SEQ ID NO: 186246 - DNA, 20 bp, Artificial
  CRISPR gRNA sequence
ttgtcccactgcagccacct

SEQ ID NO: 186247 - DNA, 20 bp, Artificial
  CRISPR gRNA sequence
gtcccactgcagccacctga

SEQ ID NO: 186248 - DNA, 20 bp, Artificial
  CRISPR gRNA sequence
tcccactgcagccacctgag

SEQ ID NO: 186249 - DNA, 20 bp, Artificial
  CRISPR gRNA sequence
cagccacctgagatgaaata

SEQ ID NO: 186250 - DNA, 20 bp, Artificial
  CRISPR gRNA sequence
agatgaaatatgatgaagag

SEQ ID NO: 186251 - DNA, 20 bp, Artificial
  CRISPR gRNA sequence
tctagagatcgaagactcaa

SEQ ID NO: 186252 - DNA, 20 bp, Artificial
  CRISPR gRNA sequence
gagatcgaagactcaaaatc

SEQ ID NO: 186253 - DNA, 20 bp, Artificial
  CRISPR gRNA sequence
aaaatctttattgagaacat

SEQ ID NO: 186254 - DNA, 20 bp, Artificial
  CRISPR gRNA sequence
tattgagaacatgtcacaaa

SEQ ID NO: 186255 - DNA, 20 bp, Artificial
  CRISPR gRNA sequence
attgagaacatgtcacaaaa

SEQ ID NO: 186256 - DNA, 20 bp, Artificial
  CRISPR gRNA sequence
ttgagaacatgtcacaaaat

SEQ ID NO: 186257 - DNA, 20 bp, Artificial
  CRISPR gRNA sequence
agaacatgtcacaaaatcat

SEQ ID NO: 186258 - DNA, 20 bp, Artificial
  CRISPR gRNA sequence
cctccctcctgactacacca

SEQ ID NO: 186259 - DNA, 20 bp, Artificial
  CRISPR gRNA sequence
cctcctgactacaccaccat

SEQ ID NO: 186260 - DNA, 20 bp, Artificial
  CRISPR gRNA sequence
ctgactacaccaccatctcc

SEQ ID NO: 186261 - DNA, 20 bp, Artificial
  CRISPR gRNA sequence
actacaccaccatctccacc

SEQ ID NO: 186262 - DNA, 20 bp, Artificial
  CRISPR gRNA sequence
caccaccatctccacccaag

SEQ ID NO: 186263 - DNA, 20 bp, Artificial
  CRISPR gRNA sequence
cacccaaggtctcttatcat

SEQ ID NO: 186264 - DNA, 20 bp, Artificial
  CRISPR gRNA sequence
ttatcattccctaacccctc

SEQ ID NO: 186265 - DNA, 20 bp, Artificial
  CRISPR gRNA sequence
atcattccctaacccctctt

SEQ ID NO: 186266 - DNA, 20 bp, Artificial
  CRISPR gRNA sequence
tcattccctaacccctcttt

SEQ ID NO: 186267 - DNA, 20 bp, Artificial
  CRISPR gRNA sequence
cctaacccctctttcagagt

SEQ ID NO: 186268 - DNA, 20 bp, Artificial
  CRISPR gRNA sequence
acccctctttcagagtgctc

SEQ ID NO: 186269 - DNA, 20 bp, Artificial
  CRISPR gRNA sequence
tttcagagtgctcagtaaga

SEQ ID NO: 186270 - DNA, 20 bp, Artificial
  CRISPR gRNA sequence
tcagagtgctcagtaagaat

SEQ ID NO: 186271 - DNA, 20 bp, Artificial
  CRISPR gRNA sequence
cagagtgctcagtaagaatg

SEQ ID NO: 186272 - DNA, 20 bp, Artificial
  CRISPR gRNA sequence
agagtgctcagtaagaatgc

SEQ ID NO: 186273 - DNA, 20 bp, Artificial
  CRISPR gRNA sequence
agtaagaatgctcttcgtat

SEQ ID NO: 186274 - DNA, 20 bp, Artificial
  CRISPR gRNA sequence
ttcgtatttgatgctccctg

SEQ ID NO: 186275 - DNA, 20 bp, Artificial
  CRISPR gRNA sequence
cgtatttgatgctccctgcc

SEQ ID NO: 186276 - DNA, 20 bp, Artificial
  CRISPR gRNA sequence
gtatttgatgctccctgccc

SEQ ID NO: 186277 - DNA, 20 bp, Artificial
  CRISPR gRNA sequence
gatgctccctgccctccttc

SEQ ID NO: 186278 - DNA, 20 bp, Artificial
  CRISPR gRNA sequence
atgctccctgccctccttca

SEQ ID NO: 186279 - DNA, 20 bp, Artificial
  CRISPR gRNA sequence
cctgccctccttcaagccac

SEQ ID NO: 186280 - DNA, 20 bp, Artificial
  CRISPR gRNA sequence
ccctccttcaagccacctgc

SEQ ID NO: 186281 - DNA, 20 bp, Artificial
  CRISPR gRNA sequence
cttcaagccacctgcttcca

SEQ ID NO: 186282 - DNA, 20 bp, Artificial
  CRISPR gRNA sequence
caagccacctgcttccatac

SEQ ID NO: 186283 - DNA, 20 bp, Artificial
  CRISPR gRNA sequence
aagccacctgcttccatacc

SEQ ID NO: 186284 - DNA, 20 bp, Artificial
  CRISPR gRNA sequence
cttccatacctgcctgtgca

SEQ ID NO: 186285 - DNA, 20 bp, Artificial
  CRISPR gRNA sequence
ccatacctgcctgtgcaggt

SEQ ID NO: 186286 - DNA, 20 bp, Artificial
  CRISPR gRNA sequence
catacctgcctgtgcaggta

SEQ ID NO: 186287 - DNA, 20 bp, Artificial
  CRISPR gRNA sequence
cctgtgcaggtagcggtgct

SEQ ID NO: 186288 - DNA, 20 bp, Artificial
  CRISPR gRNA sequence
tgcaggtagcggtgctcata

SEQ ID NO: 186289 - DNA, 20 bp, Artificial
  CRISPR gRNA sequence
atattggggaaggggcttcc

SEQ ID NO: 186290 - DNA, 20 bp, Artificial
  CRISPR gRNA sequence
gggaaggggcttcccatcca

SEQ ID NO: 186291 - DNA, 20 bp, Artificial
  CRISPR gRNA sequence
cccatccaacagcagctgtc

SEQ ID NO: 186292 - DNA, 20 bp, Artificial
  CRISPR gRNA sequence
ccatccaacagcagctgtcc

SEQ ID NO: 186293 - DNA, 20 bp, Artificial
  CRISPR gRNA sequence
tcccccggtgggctggtaca

SEQ ID NO: 186294 - DNA, 20 bp, Artificial
  CRISPR gRNA sequence
gtacagattctgcagcaggg

SEQ ID NO: 186295 - DNA, 20 bp, Artificial
  CRISPR gRNA sequence
tgcagcagggcagccactgt

SEQ ID NO: 186296 - DNA, 20 bp, Artificial
  CRISPR gRNA sequence
cagcagggcagccactgtgc

SEQ ID NO: 186297 - DNA, 20 bp, Artificial
  CRISPR gRNA sequence
tgctcttcccagacccattg

SEQ ID NO: 186298 - DNA, 20 bp, Artificial
  CRISPR gRNA sequence
ttcccagacccattgggtcc

SEQ ID NO: 186299 - DNA, 20 bp, Artificial
  CRISPR gRNA sequence
cccagacccattgggtccca

SEQ ID NO: 186300 - DNA, 20 bp, Artificial
  CRISPR gRNA sequence
ccagacccattgggtcccac

SEQ ID NO: 186301 - DNA, 20 bp, Artificial
  CRISPR gRNA sequence
ggtcccaccagcgccgtcac

SEQ ID NO: 186302 - DNA, 20 bp, Artificial
  CRISPR gRNA sequence
gccagggcgtagggtgaatg

SEQ ID NO: 186303 - DNA, 20 bp, Artificial
  CRISPR gRNA sequence
gaggccagagaagcacacga

SEQ ID NO: 186304 - DNA, 20 bp, Artificial
  CRISPR gRNA sequence
ccaaggcctctaaccttgag

SEQ ID NO: 186305 - DNA, 20 bp, Artificial
  CRISPR gRNA sequence
taaccttgagagtgtcattg

SEQ ID NO: 186306 - DNA, 20 bp, Artificial
  CRISPR gRNA sequence
accttgagagtgtcattgcc

SEQ ID NO: 186307 - DNA, 20 bp, Artificial
  CRISPR gRNA sequence
gagagtgtcattgccttgtt

SEQ ID NO: 186308 - DNA, 20 bp, Artificial
  CRISPR gRNA sequence
agagtgtcattgccttgtta

SEQ ID NO: 186309 - DNA, 20 bp, Artificial
  CRISPR gRNA sequence
ccttgttacatagcatgatg

SEQ ID NO: 186310 - DNA, 20 bp, Artificial
  CRISPR gRNA sequence
gttacatagcatgatgtctt

SEQ ID NO: 186311 - DNA, 20 bp, Artificial
  CRISPR gRNA sequence
ttacatagcatgatgtctta

SEQ ID NO: 186312 - DNA, 20 bp, Artificial
  CRISPR gRNA sequence
catagcatgatgtcttaccc

SEQ ID NO: 186313 - DNA, 20 bp, Artificial
  CRISPR gRNA sequence
accccagaagaaaaacaggg

SEQ ID NO: 186314 - DNA, 20 bp, Artificial
  CRISPR gRNA sequence
ccccagaagaaaaacaggga

SEQ ID NO: 186315 - DNA, 20 bp, Artificial
  CRISPR gRNA sequence
ctaccctcccacatgcacag

SEQ ID NO: 186316 - DNA, 20 bp, Artificial
  CRISPR gRNA sequence
ccctcccacatgcacagatt

SEQ ID NO: 186317 - DNA, 20 bp, Artificial
  CRISPR gRNA sequence
ccacatgcacagatttctgg

SEQ ID NO: 186318 - DNA, 20 bp, Artificial
  CRISPR gRNA sequence
ctgggtgatgcctccccaag

SEQ ID NO: 186319 - DNA, 20 bp, Artificial
  CRISPR gRNA sequence
tgggtgatgcctccccaagg

SEQ ID NO: 186320 - DNA, 20 bp, Artificial
  CRISPR gRNA sequence
ggtgatgcctccccaaggag

SEQ ID NO: 186321 - DNA, 20 bp, Artificial
  CRISPR gRNA sequence
cccaaggagtagagatagaa

SEQ ID NO: 186322 - DNA, 20 bp, Artificial
  CRISPR gRNA sequence
tgccacacacttgatgtcag

SEQ ID NO: 186323 - DNA, 20 bp, Artificial
  CRISPR gRNA sequence
gatgtcagataccaccagga

SEQ ID NO: 186324 - DNA, 20 bp, Artificial
  CRISPR gRNA sequence
atgtcagataccaccaggaa

SEQ ID NO: 186325 - DNA, 20 bp, Artificial
  CRISPR gRNA sequence
caaattacaaaggaaaagga

SEQ ID NO: 186326 - DNA, 20 bp, Artificial
  CRISPR gRNA sequence
caaaggaaaaggaaagatgg

SEQ ID NO: 186327 - DNA, 20 bp, Artificial
  CRISPR gRNA sequence
tgctgcagcaattccttgga

SEQ ID NO: 186328 - DNA, 20 bp, Artificial
  CRISPR gRNA sequence
gctgcagcaattccttggaa

SEQ ID NO: 186329 - DNA, 20 bp, Artificial
  CRISPR gRNA sequence
ctgcagcaattccttggaac

SEQ ID NO: 186330 - DNA, 20 bp, Artificial
  CRISPR gRNA sequence
cagcaattccttggaacgtg

SEQ ID NO: 186331 - DNA, 20 bp, Artificial
  CRISPR gRNA sequence
cttggaacgtgagagcactc

SEQ ID NO: 186332 - DNA, 20 bp, Artificial
  CRISPR gRNA sequence
ggaacgtgagagcactctct

SEQ ID NO: 186333 - DNA, 20 bp, Artificial
  CRISPR gRNA sequence
gaacgtgagagcactctctt

SEQ ID NO: 186334 - DNA, 20 bp, Artificial
  CRISPR gRNA sequence
tcttcgaaacctcttctctc

SEQ ID NO: 186335 - DNA, 20 bp, Artificial
  CRISPR gRNA sequence
ttcgaaacctcttctctcat

SEQ ID NO: 186336 - DNA, 20 bp, Artificial
  CRISPR gRNA sequence
cgaaacctcttctctcattc

SEQ ID NO: 186337 - DNA, 20 bp, Artificial
  CRISPR gRNA sequence
gaaacctcttctctcattct

SEQ ID NO: 186338 - DNA, 20 bp, Artificial
  CRISPR gRNA sequence
ttctctcattctctttggaa

SEQ ID NO: 186339 - DNA, 20 bp, Artificial
  CRISPR gRNA sequence
ctctcattctctttggaagc

SEQ ID NO: 186340 - DNA, 20 bp, Artificial
  CRISPR gRNA sequence
tctcattctctttggaagcc

SEQ ID NO: 186341 - DNA, 20 bp, Artificial
  CRISPR gRNA sequence
tcattctctttggaagccca

SEQ ID NO: 186342 - DNA, 20 bp, Artificial
  CRISPR gRNA sequence
attctctttggaagcccaaa

SEQ ID NO: 186343 - DNA, 20 bp, Artificial
  CRISPR gRNA sequence
tctttggaagcccaaactgg

SEQ ID NO: 186344 - DNA, 20 bp, Artificial
  CRISPR gRNA sequence
tttggaagcccaaactgggt

SEQ ID NO: 186345 - DNA, 20 bp, Artificial
  CRISPR gRNA sequence
tggaagcccaaactgggttc

SEQ ID NO: 186346 - DNA, 20 bp, Artificial
  CRISPR gRNA sequence
ggaagcccaaactgggttct

SEQ ID NO: 186347 - DNA, 20 bp, Artificial
  CRISPR gRNA sequence
gaagcccaaactgggttctt

SEQ ID NO: 186348 - DNA, 20 bp, Artificial
  CRISPR gRNA sequence
ggttcttgagtttggggaag

SEQ ID NO: 186349 - DNA, 20 bp, Artificial
  CRISPR gRNA sequence
ttgagtttggggaagattta

SEQ ID NO: 186350 - DNA, 20 bp, Artificial
  CRISPR gRNA sequence
gagtttggggaagatttatg

SEQ ID NO: 186351 - DNA, 20 bp, Artificial
  CRISPR gRNA sequence
agtttggggaagatttatgg

SEQ ID NO: 186352 - DNA, 20 bp, Artificial
  CRISPR gRNA sequence
ggggaagatttatggaacag

SEQ ID NO: 186353 - DNA, 20 bp, Artificial
  CRISPR gRNA sequence
gggaagatttatggaacaga

SEQ ID NO: 186354 - DNA, 20 bp, Artificial
  CRISPR gRNA sequence
atggaacagatgatgcctac

SEQ ID NO: 186355 - DNA, 20 bp, Artificial
  CRISPR gRNA sequence
tggaacagatgatgcctacc

SEQ ID NO: 186356 - DNA, 20 bp, Artificial
  CRISPR gRNA sequence
ccattgcctttaaagggtta

SEQ ID NO: 186357 - DNA, 20 bp, Artificial
  CRISPR gRNA sequence
cctttaaagggttagggagg

SEQ ID NO: 186358 - DNA, 20 bp, Artificial
  CRISPR gRNA sequence
taaagggttagggaggatat

SEQ ID NO: 186359 - DNA, 20 bp, Artificial
  CRISPR gRNA sequence
aaagggttagggaggatata

SEQ ID NO: 186360 - DNA, 20 bp, Artificial
  CRISPR gRNA sequence
aagggttagggaggatatat

SEQ ID NO: 186361 - DNA, 20 bp, Artificial
  CRISPR gRNA sequence
gggaggatatatgcttggca

SEQ ID NO: 186362 - DNA, 20 bp, Artificial
  CRISPR gRNA sequence
ggcagtaagcaggctgaagg

SEQ ID NO: 186363 - DNA, 20 bp, Artificial
  CRISPR gRNA sequence
gcagtaagcaggctgaaggc

SEQ ID NO: 186364 - DNA, 20 bp, Artificial
  CRISPR gRNA sequence
aaggcaggaagaaaatttag

SEQ ID NO: 186365 - DNA, 20 bp, Artificial
  CRISPR gRNA sequence
aggatggcagaattgcagtt

SEQ ID NO: 186366 - DNA, 20 bp, Artificial
  CRISPR gRNA sequence
ggatggcagaattgcagttg

SEQ ID NO: 186367 - DNA, 20 bp, Artificial
  CRISPR gRNA sequence
cagttggggccagtggaata

SEQ ID NO: 186368 - DNA, 20 bp, Artificial
  CRISPR gRNA sequence
gggccagtggaatacaggga

SEQ ID NO: 186369 - DNA, 20 bp, Artificial
  CRISPR gRNA sequence
tacctgtagcactaagacat

SEQ ID NO: 186370 - DNA, 20 bp, Artificial
  CRISPR gRNA sequence
tagcactaagacatctgggc

SEQ ID NO: 186371 - DNA, 20 bp, Artificial
  CRISPR gRNA sequence
agacatctgggcggtttggg

SEQ ID NO: 186372 - DNA, 20 bp, Artificial
  CRISPR gRNA sequence
ggcggtttgggtaggcaaag

SEQ ID NO: 186373 - DNA, 20 bp, Artificial
  CRISPR gRNA sequence
gggtaggcaaaggagacatc

SEQ ID NO: 186374 - DNA, 20 bp, Artificial
  CRISPR gRNA sequence
ggtaggcaaaggagacatct

SEQ ID NO: 186375 - DNA, 20 bp, Artificial
  CRISPR gRNA sequence
ggaactggacaaggccctcc

SEQ ID NO: 186376 - DNA, 20 bp, Artificial
  CRISPR gRNA sequence
gaactggacaaggccctcca

SEQ ID NO: 186377 - DNA, 20 bp, Artificial
  CRISPR gRNA sequence
gacaaggccctccaagtgta

SEQ ID NO: 186378 - DNA, 20 bp, Artificial
  CRISPR gRNA sequence
caagtgtaagggagtcaaca

SEQ ID NO: 186379 - DNA, 20 bp, Artificial
  CRISPR gRNA sequence
ggtgggcagcgaggggtgcg

SEQ ID NO: 186380 - DNA, 20 bp, Artificial
  CRISPR gRNA sequence
aaatattttctctgaggagc

SEQ ID NO: 186381 - DNA, 20 bp, Artificial
  CRISPR gRNA sequence
tctctgaggagcccacagcc

SEQ ID NO: 186382 - DNA, 20 bp, Artificial
  CRISPR gRNA sequence
ctctgaggagcccacagcct

SEQ ID NO: 186383 - DNA, 20 bp, Artificial
  CRISPR gRNA sequence
tctgaggagcccacagcctt

SEQ ID NO: 186384 - DNA, 20 bp, Artificial
  CRISPR gRNA sequence
tgaggagcccacagccttct

SEQ ID NO: 186385 - DNA, 20 bp, Artificial
  CRISPR gRNA sequence
aggagcccacagccttctgt

SEQ ID NO: 186386 - DNA, 20 bp, Artificial
  CRISPR gRNA sequence
ctgtactctggggtagatgg

SEQ ID NO: 186387 - DNA, 20 bp, Artificial
  CRISPR gRNA sequence
tgtactctggggtagatgga

SEQ ID NO: 186388 - DNA, 20 bp, Artificial
  CRISPR gRNA sequence
tactctggggtagatggaga

SEQ ID NO: 186389 - DNA, 20 bp, Artificial
  CRISPR gRNA sequence
tggggtagatggagagcagt

SEQ ID NO: 186390 - DNA, 20 bp, Artificial
  CRISPR gRNA sequence
gggtagatggagagcagtac

SEQ ID NO: 186391 - DNA, 20 bp, Artificial
  CRISPR gRNA sequence
gagggaggtaagaatagtga

SEQ ID NO: 186392 - DNA, 20 bp, Artificial
  CRISPR gRNA sequence
cttgccagcattatgtgaag

SEQ ID NO: 186393 - DNA, 20 bp, Artificial
  CRISPR gRNA sequence
gccagcattatgtgaagcaa

SEQ ID NO: 186394 - DNA, 20 bp, Artificial
  CRISPR gRNA sequence
ccagcattatgtgaagcaag

SEQ ID NO: 186395 - DNA, 20 bp, Artificial
  CRISPR gRNA sequence
tgtgaagcaagaagggtaaa

SEQ ID NO: 186396 - DNA, 20 bp, Artificial
  CRISPR gRNA sequence
ggccagaggaaggaatcaca

SEQ ID NO: 186397 - DNA, 20 bp, Artificial
  CRISPR gRNA sequence
gggagtgaaggtggagggac

SEQ ID NO: 186398 - DNA, 20 bp, Artificial
  CRISPR gRNA sequence
acctccacagcctgggtgaa

SEQ ID NO: 186399 - DNA, 20 bp, Artificial
  CRISPR gRNA sequence
cacagcctgggtgaactgca

SEQ ID NO: 186400 - DNA, 20 bp, Artificial
  CRISPR gRNA sequence
ggtgaactgcatctggtaga

SEQ ID NO: 186401 - DNA, 20 bp, Artificial
  CRISPR gRNA sequence
catctggtagagaacaaatg

SEQ ID NO: 186402 - DNA, 20 bp, Artificial
  CRISPR gRNA sequence
gtagagaacaaatgtgacaa

SEQ ID NO: 186403 - DNA, 20 bp, Artificial
  CRISPR gRNA sequence
ccactgcttacagccccact

SEQ ID NO: 186404 - DNA, 20 bp, Artificial
  CRISPR gRNA sequence
cttacagccccactggtcac

SEQ ID NO: 186405 - DNA, 20 bp, Artificial
  CRISPR gRNA sequence
acagccccactggtcaccag

SEQ ID NO: 186406 - DNA, 20 bp, Artificial
  CRISPR gRNA sequence
cagccccactggtcaccagc

SEQ ID NO: 186407 - DNA, 20 bp, Artificial
  CRISPR gRNA sequence
gtcaccagctgcccaccaat

SEQ ID NO: 186408 - DNA, 20 bp, Artificial
  CRISPR gRNA sequence
cccaccaatgtagaggattc

SEQ ID NO: 186409 - DNA, 20 bp, Artificial
  CRISPR gRNA sequence
ccactttcagcagcatacct

SEQ ID NO: 186410 - DNA, 20 bp, Artificial
  CRISPR gRNA sequence
tcagcagcatacctgaaatc

SEQ ID NO: 186411 - DNA, 20 bp, Artificial
  CRISPR gRNA sequence
cagcagcatacctgaaatct

SEQ ID NO: 186412 - DNA, 20 bp, Artificial
  CRISPR gRNA sequence
agcagcatacctgaaatcta

SEQ ID NO: 186413 - DNA, 20 bp, Artificial
  CRISPR gRNA sequence
aaatctataaagagaccaca

SEQ ID NO: 186414 - DNA, 20 bp, Artificial
  CRISPR gRNA sequence
taaagagaccacaaaaaaag

SEQ ID NO: 186415 - DNA, 20 bp, Artificial
  CRISPR gRNA sequence
aggtagagaaatctggaggg

SEQ ID NO: 186416 - DNA, 20 bp, Artificial
  CRISPR gRNA sequence
gaggggacacaaagaaccac

SEQ ID NO: 186417 - DNA, 20 bp, Artificial
  CRISPR gRNA sequence
acctgaaggaaatatcaagt

SEQ ID NO: 186418 - DNA, 20 bp, Artificial
  CRISPR gRNA sequence
aaggaaatatcaagtccctg

SEQ ID NO: 186419 - DNA, 20 bp, Artificial
  CRISPR gRNA sequence
tctcctaagtgacatcggca

SEQ ID NO: 186420 - DNA, 20 bp, Artificial
  CRISPR gRNA sequence
ctaagtgacatcggcaggct

SEQ ID NO: 186421 - DNA, 20 bp, Artificial
  CRISPR gRNA sequence
agtgacatcggcaggctcaa

SEQ ID NO: 186422 - DNA, 20 bp, Artificial
  CRISPR gRNA sequence
aataggcagacaggagaatg

SEQ ID NO: 186423 - DNA, 20 bp, Artificial
  CRISPR gRNA sequence
actcaatgcacatcatgcaa

SEQ ID NO: 186424 - DNA, 20 bp, Artificial
  CRISPR gRNA sequence
aatgcacatcatgcaagtca

SEQ ID NO: 186425 - DNA, 20 bp, Artificial
  CRISPR gRNA sequence
tcttcaccaccatcaccact

SEQ ID NO: 186426 - DNA, 20 bp, Artificial
  CRISPR gRNA sequence
caccaccatcaccactatca

SEQ ID NO: 186427 - DNA, 20 bp, Artificial
  CRISPR gRNA sequence
accaccatcaccactatcac

SEQ ID NO: 186428 - DNA, 20 bp, Artificial
  CRISPR gRNA sequence
tcaccttgtctggggagcat

SEQ ID NO: 186429 - DNA, 20 bp, Artificial
  CRISPR gRNA sequence
gtctggggagcattttactc

SEQ ID NO: 186430 - DNA, 20 bp, Artificial
  CRISPR gRNA sequence
tctggggagcattttactct

SEQ ID NO: 186431 - DNA, 20 bp, Artificial
  CRISPR gRNA sequence
gggagcattttactcttcac

SEQ ID NO: 186432 - DNA, 20 bp, Artificial
  CRISPR gRNA sequence
tactcttcacaaaaggcttt

SEQ ID NO: 186433 - DNA, 20 bp, Artificial
  CRISPR gRNA sequence
actcttcacaaaaggctttc

SEQ ID NO: 186434 - DNA, 20 bp, Artificial
  CRISPR gRNA sequence
ctcttcacaaaaggctttca

SEQ ID NO: 186435 - DNA, 20 bp, Artificial
  CRISPR gRNA sequence
ttcacaaaaggctttcattc

SEQ ID NO: 186436 - DNA, 20 bp, Artificial
  CRISPR gRNA sequence
cacaaaaggctttcattcat

SEQ ID NO: 186437 - DNA, 20 bp, Artificial
  CRISPR gRNA sequence
acaaaaggctttcattcatg

SEQ ID NO: 186438 - DNA, 20 bp, Artificial
  CRISPR gRNA sequence
tcattcatgtgatgtcagct

SEQ ID NO: 186439 - DNA, 20 bp, Artificial
  CRISPR gRNA sequence
cattcatgtgatgtcagcta

SEQ ID NO: 186440 - DNA, 20 bp, Artificial
  CRISPR gRNA sequence
attcatgtgatgtcagctaa

SEQ ID NO: 186441 - DNA, 20 bp, Artificial
  CRISPR gRNA sequence
atgtgatgtcagctaataca

SEQ ID NO: 186442 - DNA, 20 bp, Artificial
  CRISPR gRNA sequence
atacatgaagagccttataa

SEQ ID NO: 186443 - DNA, 20 bp, Artificial
  CRISPR gRNA sequence
ataaagaaggttatatcact

SEQ ID NO: 186444 - DNA, 20 bp, Artificial
  CRISPR gRNA sequence
taaagaaggttatatcactc

SEQ ID NO: 186445 - DNA, 20 bp, Artificial
  CRISPR gRNA sequence
tatcactccatttttgaaaa

SEQ ID NO: 186446 - DNA, 20 bp, Artificial
  CRISPR gRNA sequence
catttttgaaaaatgaggaa

SEQ ID NO: 186447 - DNA, 20 bp, Artificial
  CRISPR gRNA sequence
ttgaaaaatgaggaaacaac

SEQ ID NO: 186448 - DNA, 20 bp, Artificial
  CRISPR gRNA sequence
tgaaaaatgaggaaacaacc

SEQ ID NO: 186449 - DNA, 20 bp, Artificial
  CRISPR gRNA sequence
gaaaaatgaggaaacaacca

SEQ ID NO: 186450 - DNA, 20 bp, Artificial
  CRISPR gRNA sequence
aaaaatgaggaaacaaccag

SEQ ID NO: 186451 - DNA, 20 bp, Artificial
  CRISPR gRNA sequence
atgcctgcaattccagcact

SEQ ID NO: 186452 - DNA, 20 bp, Artificial
  CRISPR gRNA sequence
caattccagcactttgggag

SEQ ID NO: 186453 - DNA, 20 bp, Artificial
  CRISPR gRNA sequence
cagcactttgggaggccgaa

SEQ ID NO: 186454 - DNA, 20 bp, Artificial
  CRISPR gRNA sequence
tgggaggccgaagtgggcgg

SEQ ID NO: 186455 - DNA, 20 bp, Artificial
  CRISPR gRNA sequence
gggaggccgaagtgggcgga

SEQ ID NO: 186456 - DNA, 20 bp, Artificial
  CRISPR gRNA sequence
ggaggccgaagtgggcggat

SEQ ID NO: 186457 - DNA, 20 bp, Artificial
  CRISPR gRNA sequence
agaccatcctggctaacacg

SEQ ID NO: 186458 - DNA, 20 bp, Artificial
  CRISPR gRNA sequence
gctaacacggagaaacctcg

SEQ ID NO: 186459 - DNA, 20 bp, Artificial
  CRISPR gRNA sequence
acacggagaaacctcgtctc

SEQ ID NO: 186460 - DNA, 20 bp, Artificial
  CRISPR gRNA sequence
gtctctactaaaaatacaaa

SEQ ID NO: 186461 - DNA, 20 bp, Artificial
  CRISPR gRNA sequence
tactaaaaatacaaaaaaaa

SEQ ID NO: 186462 - DNA, 20 bp, Artificial
  CRISPR gRNA sequence
ctaaaaatacaaaaaaaaaa

SEQ ID NO: 186463 - DNA, 20 bp, Artificial
  CRISPR gRNA sequence
aaaatacaaaaaaaaaaaaa

SEQ ID NO: 186464 - DNA, 20 bp, Artificial
  CRISPR gRNA sequence
gccgggcgtggtggcgggtg

SEQ ID NO: 186465 - DNA, 20 bp, Artificial
  CRISPR gRNA sequence
tagtcccagctactcaggag

SEQ ID NO: 186466 - DNA, 20 bp, Artificial
  CRISPR gRNA sequence
ctcaggaggctgaggcggga

SEQ ID NO: 186467 - DNA, 20 bp, Artificial
  CRISPR gRNA sequence
aggaggctgaggcgggagaa

SEQ ID NO: 186468 - DNA, 20 bp, Artificial
  CRISPR gRNA sequence
aggcgggagaacggcgtgaa

SEQ ID NO: 186469 - DNA, 20 bp, Artificial
  CRISPR gRNA sequence
gcagtgagcccagatcgcgc

SEQ ID NO: 186470 - DNA, 20 bp, Artificial
  CRISPR gRNA sequence
cagtgagcccagatcgcgcc

SEQ ID NO: 186471 - DNA, 20 bp, Artificial
  CRISPR gRNA sequence
cactccagcctgggcgacaa

SEQ ID NO: 186472 - DNA, 20 bp, Artificial
  CRISPR gRNA sequence
cagcctgggcgacaaagcga

SEQ ID NO: 186473 - DNA, 20 bp, Artificial
  CRISPR gRNA sequence
ggcgacaaagcgagactcca

SEQ ID NO: 186474 - DNA, 20 bp, Artificial
  CRISPR gRNA sequence
cagctcaaaaataataataa

SEQ ID NO: 186475 - DNA, 20 bp, Artificial
  CRISPR gRNA sequence
aaaaataataataataagta

SEQ ID NO: 186476 - DNA, 20 bp, Artificial
  CRISPR gRNA sequence
agagaaggtaaatttgttgt

SEQ ID NO: 186477 - DNA, 20 bp, Artificial
  CRISPR gRNA sequence
gttgtcatgatcacaagaca

SEQ ID NO: 186478 - DNA, 20 bp, Artificial
  CRISPR gRNA sequence
ttgtcatgatcacaagacaa

SEQ ID NO: 186479 - DNA, 20 bp, Artificial
  CRISPR gRNA sequence
tcatgatcacaagacaagta

SEQ ID NO: 186480 - DNA, 20 bp, Artificial
  CRISPR gRNA sequence
catcatcaagccaggatctt

SEQ ID NO: 186481 - DNA, 20 bp, Artificial
  CRISPR gRNA sequence
cggatcactggcgtagctct

SEQ ID NO: 186482 - DNA, 20 bp, Artificial
  CRISPR gRNA sequence
ggatcactggcgtagctctc

SEQ ID NO: 186483 - DNA, 20 bp, Artificial
  CRISPR gRNA sequence
gcgtagctctctttccagtg

SEQ ID NO: 186484 - DNA, 20 bp, Artificial
  CRISPR gRNA sequence
tctttccagtgcatcacaga

SEQ ID NO: 186485 - DNA, 20 bp, Artificial
  CRISPR gRNA sequence
tttccagtgcatcacagatg

SEQ ID NO: 186486 - DNA, 20 bp, Artificial
  CRISPR gRNA sequence
tccagtgcatcacagatgtc

SEQ ID NO: 186487 - DNA, 20 bp, Artificial
  CRISPR gRNA sequence
ccagtgcatcacagatgtcc

SEQ ID NO: 186488 - DNA, 20 bp, Artificial
  CRISPR gRNA sequence
cagtgcatcacagatgtccc

SEQ ID NO: 186489 - DNA, 20 bp, Artificial
  CRISPR gRNA sequence
atccctggcttccactattc

SEQ ID NO: 186490 - DNA, 20 bp, Artificial
  CRISPR gRNA sequence
gcttccactattcccatcac

SEQ ID NO: 186491 - DNA, 20 bp, Artificial
  CRISPR gRNA sequence
ccactattcccatcactctc

SEQ ID NO: 186492 - DNA, 20 bp, Artificial
  CRISPR gRNA sequence
cactattcccatcactctca

SEQ ID NO: 186493 - DNA, 20 bp, Artificial
  CRISPR gRNA sequence
ttcccatcactctcactaac

SEQ ID NO: 186494 - DNA, 20 bp, Artificial
  CRISPR gRNA sequence
ccatcactctcactaacaaa

SEQ ID NO: 186495 - DNA, 20 bp, Artificial
  CRISPR gRNA sequence
tcactaacaaatctacaagg

SEQ ID NO: 186496 - DNA, 20 bp, Artificial
  CRISPR gRNA sequence
actaacaaatctacaaggta

SEQ ID NO: 186497 - DNA, 20 bp, Artificial
  CRISPR gRNA sequence
acaaatctacaaggtaccag

SEQ ID NO: 186498 - DNA, 20 bp, Artificial
  CRISPR gRNA sequence
caaggtaccagcatgaagca

SEQ ID NO: 186499 - DNA, 20 bp, Artificial
  CRISPR gRNA sequence
atggcgccctgcacttcccc

SEQ ID NO: 186500 - DNA, 20 bp, Artificial
  CRISPR gRNA sequence
tggcgccctgcacttcccct

SEQ ID NO: 186501 - DNA, 20 bp, Artificial
  CRISPR gRNA sequence
cacttcccctgagaggcaaa

SEQ ID NO: 186502 - DNA, 20 bp, Artificial
  CRISPR gRNA sequence
cccctgagaggcaaaggaag

SEQ ID NO: 186503 - DNA, 20 bp, Artificial
  CRISPR gRNA sequence
ccctgagaggcaaaggaagg

SEQ ID NO: 186504 - DNA, 20 bp, Artificial
  CRISPR gRNA sequence
agaggcaaaggaaggcccta

SEQ ID NO: 186505 - DNA, 20 bp, Artificial
  CRISPR gRNA sequence
ggactggaagacacgcatct

SEQ ID NO: 186506 - DNA, 20 bp, Artificial
  CRISPR gRNA sequence
gaagacacgcatctctccaa

SEQ ID NO: 186507 - DNA, 20 bp, Artificial
  CRISPR gRNA sequence
tccaatccacatggttgggt

SEQ ID NO: 186508 - DNA, 20 bp, Artificial
  CRISPR gRNA sequence
caatccacatggttgggtgg

SEQ ID NO: 186509 - DNA, 20 bp, Artificial
  CRISPR gRNA sequence
ggtggattttatgtaccata

SEQ ID NO: 186510 - DNA, 20 bp, Artificial
  CRISPR gRNA sequence
tatgtaccatactgaaagga

SEQ ID NO: 186511 - DNA, 20 bp, Artificial
  CRISPR gRNA sequence
atgtaccatactgaaaggaa

SEQ ID NO: 186512 - DNA, 20 bp, Artificial
  CRISPR gRNA sequence
tgtaccatactgaaaggaag

SEQ ID NO: 186513 - DNA, 20 bp, Artificial
  CRISPR gRNA sequence
aaaggaagccacctagcatc

SEQ ID NO: 186514 - DNA, 20 bp, Artificial
  CRISPR gRNA sequence
gcatctttaaagagagggag

SEQ ID NO: 186515 - DNA, 20 bp, Artificial
  CRISPR gRNA sequence
taaagagagggagggggcta

SEQ ID NO: 186516 - DNA, 20 bp, Artificial
  CRISPR gRNA sequence
aaagagagggagggggctag

SEQ ID NO: 186517 - DNA, 20 bp, Artificial
  CRISPR gRNA sequence
aagagagggagggggctagg

SEQ ID NO: 186518 - DNA, 20 bp, Artificial
  CRISPR gRNA sequence
gggacactgagtagagtcat

SEQ ID NO: 186519 - DNA, 20 bp, Artificial
  CRISPR gRNA sequence
agtagagtcattgagcctca

SEQ ID NO: 186520 - DNA, 20 bp, Artificial
  CRISPR gRNA sequence
agcctcaggttgctaggacg

SEQ ID NO: 186521 - DNA, 20 bp, Artificial
  CRISPR gRNA sequence
aggttgctaggacgaaaata

SEQ ID NO: 186522 - DNA, 20 bp, Artificial
  CRISPR gRNA sequence
ctaggacgaaaatactgaac

SEQ ID NO: 186523 - DNA, 20 bp, Artificial
  CRISPR gRNA sequence
ggacgaaaatactgaaccaa

SEQ ID NO: 186524 - DNA, 20 bp, Artificial
  CRISPR gRNA sequence
aaccaaccatttcccagtaa

SEQ ID NO: 186525 - DNA, 20 bp, Artificial
  CRISPR gRNA sequence
cccagtaaagaaggagtggg

SEQ ID NO: 186526 - DNA, 20 bp, Artificial
  CRISPR gRNA sequence
ccagtaaagaaggagtggga

SEQ ID NO: 186527 - DNA, 20 bp, Artificial
  CRISPR gRNA sequence
aaggacaagggaatgggtat

SEQ ID NO: 186528 - DNA, 20 bp, Artificial
  CRISPR gRNA sequence
aggacaagggaatgggtatt

SEQ ID NO: 186529 - DNA, 20 bp, Artificial
  CRISPR gRNA sequence
atcttcaggtgctcacacta

SEQ ID NO: 186530 - DNA, 20 bp, Artificial
  CRISPR gRNA sequence
caggtgctcacactagtggt

SEQ ID NO: 186531 - DNA, 20 bp, Artificial
  CRISPR gRNA sequence
aggtgctcacactagtggtc

SEQ ID NO: 186532 - DNA, 20 bp, Artificial
  CRISPR gRNA sequence
acactagtggtccaggagtt

SEQ ID NO: 186533 - DNA, 20 bp, Artificial
  CRISPR gRNA sequence
gtggtccaggagttgactgc

SEQ ID NO: 186534 - DNA, 20 bp, Artificial
  CRISPR gRNA sequence
actgcataggccacagcctc

SEQ ID NO: 186535 - DNA, 20 bp, Artificial
  CRISPR gRNA sequence
cataggccacagcctccttc

SEQ ID NO: 186536 - DNA, 20 bp, Artificial
  CRISPR gRNA sequence
cttctggttgagtgtcttta

SEQ ID NO: 186537 - DNA, 20 bp, Artificial
  CRISPR gRNA sequence
ctggttgagtgtctttattt

SEQ ID NO: 186538 - DNA, 20 bp, Artificial
  CRISPR gRNA sequence
tggttgagtgtctttatttc

SEQ ID NO: 186539 - DNA, 20 bp, Artificial
  CRISPR gRNA sequence
gttgagtgtctttatttctt

SEQ ID NO: 186540 - DNA, 20 bp, Artificial
  CRISPR gRNA sequence
agtgtctttatttcttgcag

SEQ ID NO: 186541 - DNA, 20 bp, Artificial
  CRISPR gRNA sequence
tatttcttgcagcttttccc

SEQ ID NO: 186542 - DNA, 20 bp, Artificial
  CRISPR gRNA sequence
atttcttgcagcttttccct

SEQ ID NO: 186543 - DNA, 20 bp, Artificial
  CRISPR gRNA sequence
tttcttgcagcttttcccta

SEQ ID NO: 186544 - DNA, 20 bp, Artificial
  CRISPR gRNA sequence
cttgcagcttttccctaaac

SEQ ID NO: 186545 - DNA, 20 bp, Artificial
  CRISPR gRNA sequence
ttgcagcttttccctaaact

SEQ ID NO: 186546 - DNA, 20 bp, Artificial
  CRISPR gRNA sequence
gcagcttttccctaaacttc

SEQ ID NO: 186547 - DNA, 20 bp, Artificial
  CRISPR gRNA sequence
cagcttttccctaaacttct

SEQ ID NO: 186548 - DNA, 20 bp, Artificial
  CRISPR gRNA sequence
ttccctaaacttctgggctt

SEQ ID NO: 186549 - DNA, 20 bp, Artificial
  CRISPR gRNA sequence
tccctaaacttctgggcttc

SEQ ID NO: 186550 - DNA, 20 bp, Artificial
  CRISPR gRNA sequence
ccctaaacttctgggcttcg

SEQ ID NO: 186551 - DNA, 20 bp, Artificial
  CRISPR gRNA sequence
cctaaacttctgggcttcgc

SEQ ID NO: 186552 - DNA, 20 bp, Artificial
  CRISPR gRNA sequence
aacttctgggcttcgccctc

SEQ ID NO: 186553 - DNA, 20 bp, Artificial
  CRISPR gRNA sequence
ctgggcttcgccctcctcgt

SEQ ID NO: 186554 - DNA, 20 bp, Artificial
  CRISPR gRNA sequence
tgggcttcgccctcctcgtt

SEQ ID NO: 186555 - DNA, 20 bp, Artificial
  CRISPR gRNA sequence
ggcttcgccctcctcgttgg

SEQ ID NO: 186556 - DNA, 20 bp, Artificial
  CRISPR gRNA sequence
cgccctcctcgttggcaaag

SEQ ID NO: 186557 - DNA, 20 bp, Artificial
  CRISPR gRNA sequence
gccctcctcgttggcaaagc

SEQ ID NO: 186558 - DNA, 20 bp, Artificial
  CRISPR gRNA sequence
ctcgttggcaaagcttcgaa

SEQ ID NO: 186559 - DNA, 20 bp, Artificial
  CRISPR gRNA sequence
gttggcaaagcttcgaactg

SEQ ID NO: 186560 - DNA, 20 bp, Artificial
  CRISPR gRNA sequence
gcaaagcttcgaactgtagg

SEQ ID NO: 186561 - DNA, 20 bp, Artificial
  CRISPR gRNA sequence
cgaactgtaggcatggccga

SEQ ID NO: 186562 - DNA, 20 bp, Artificial
  CRISPR gRNA sequence
gaactgtaggcatggccgac

SEQ ID NO: 186563 - DNA, 20 bp, Artificial
  CRISPR gRNA sequence
taggcatggccgacagagcc

SEQ ID NO: 186564 - DNA, 20 bp, Artificial
  CRISPR gRNA sequence
aatggccacctggctggact

SEQ ID NO: 186565 - DNA, 20 bp, Artificial
  CRISPR gRNA sequence
gctggactttgccagagatt

SEQ ID NO: 186566 - DNA, 20 bp, Artificial
  CRISPR gRNA sequence
gactttgccagagattcccg

SEQ ID NO: 186567 - DNA, 20 bp, Artificial
  CRISPR gRNA sequence
tgccagagattcccgcacct

SEQ ID NO: 186568 - DNA, 20 bp, Artificial
  CRISPR gRNA sequence
gccagagattcccgcacctg

SEQ ID NO: 186569 - DNA, 20 bp, Artificial
  CRISPR gRNA sequence
ccagagattcccgcacctgc

SEQ ID NO: 186570 - DNA, 20 bp, Artificial
  CRISPR gRNA sequence
ccgcacctgcacttccagca

SEQ ID NO: 186571 - DNA, 20 bp, Artificial
  CRISPR gRNA sequence
cacttccagcaactgtggat

SEQ ID NO: 186572 - DNA, 20 bp, Artificial
  CRISPR gRNA sequence
ccagcaactgtggatacatg

SEQ ID NO: 186573 - DNA, 20 bp, Artificial
  CRISPR gRNA sequence
cagcaactgtggatacatgg

SEQ ID NO: 186574 - DNA, 20 bp, Artificial
  CRISPR gRNA sequence
tggatacatggacaagagat

SEQ ID NO: 186575 - DNA, 20 bp, Artificial
  CRISPR gRNA sequence
gcaaaccatcagggacacta

SEQ ID NO: 186576 - DNA, 20 bp, Artificial
  CRISPR gRNA sequence
atacctgagttacctatttg

SEQ ID NO: 186577 - DNA, 20 bp, Artificial
  CRISPR gRNA sequence
agttacctatttggaaatta

SEQ ID NO: 186578 - DNA, 20 bp, Artificial
  CRISPR gRNA sequence
cctatttggaaattaaaggt

SEQ ID NO: 186579 - DNA, 20 bp, Artificial
  CRISPR gRNA sequence
tttggaaattaaaggtgaga

SEQ ID NO: 186580 - DNA, 20 bp, Artificial
  CRISPR gRNA sequence
ggaaattaaaggtgagaaga

SEQ ID NO: 186581 - DNA, 20 bp, Artificial
  CRISPR gRNA sequence
gaaattaaaggtgagaagag

SEQ ID NO: 186582 - DNA, 20 bp, Artificial
  CRISPR gRNA sequence
aaggtgagaagagacagagg

SEQ ID NO: 186583 - DNA, 20 bp, Artificial
  CRISPR gRNA sequence
tgccccttggatgctaaaga

SEQ ID NO: 186584 - DNA, 20 bp, Artificial
  CRISPR gRNA sequence
ggatgctaaagaaatacgag

SEQ ID NO: 186585 - DNA, 20 bp, Artificial
  CRISPR gRNA sequence
gatgctaaagaaatacgagg

SEQ ID NO: 186586 - DNA, 20 bp, Artificial
  CRISPR gRNA sequence
aagaaatacgaggaagagga

SEQ ID NO: 186587 - DNA, 20 bp, Artificial
  CRISPR gRNA sequence
agaacgggttggggatcaaa

SEQ ID NO: 186588 - DNA, 20 bp, Artificial
  CRISPR gRNA sequence
gggatcaaattcttaaagac

SEQ ID NO: 186589 - DNA, 20 bp, Artificial
  CRISPR gRNA sequence
ttaaagacagattgtgggga

SEQ ID NO: 186590 - DNA, 20 bp, Artificial
  CRISPR gRNA sequence
aaagacagattgtggggaga

SEQ ID NO: 186591 - DNA, 20 bp, Artificial
  CRISPR gRNA sequence
aagacagattgtggggagaa

SEQ ID NO: 186592 - DNA, 20 bp, Artificial
  CRISPR gRNA sequence
tggggagaagctagaaaaga

SEQ ID NO: 186593 - DNA, 20 bp, Artificial
  CRISPR gRNA sequence
gaaaagaagacccagagagt

SEQ ID NO: 186594 - DNA, 20 bp, Artificial
  CRISPR gRNA sequence
atgttgagcaacctgggaac

SEQ ID NO: 186595 - DNA, 20 bp, Artificial
  CRISPR gRNA sequence
agcaacctgggaacatggac

SEQ ID NO: 186596 - DNA, 20 bp, Artificial
  CRISPR gRNA sequence
ggaacatggaccacagggac

SEQ ID NO: 186597 - DNA, 20 bp, Artificial
  CRISPR gRNA sequence
catgaagatggagaatcagt

SEQ ID NO: 186598 - DNA, 20 bp, Artificial
  CRISPR gRNA sequence
gactgaaagcaatgtgagag

SEQ ID NO: 186599 - DNA, 20 bp, Artificial
  CRISPR gRNA sequence
aaagcaatgtgagaggaact

SEQ ID NO: 186600 - DNA, 20 bp, Artificial
  CRISPR gRNA sequence
agtctgccaagtctgggaga

SEQ ID NO: 186601 - DNA, 20 bp, Artificial
  CRISPR gRNA sequence
ccaagtctgggagatgaggg

SEQ ID NO: 186602 - DNA, 20 bp, Artificial
  CRISPR gRNA sequence
ggagatgagggtctgtgtag

SEQ ID NO: 186603 - DNA, 20 bp, Artificial
  CRISPR gRNA sequence
tgtagagcgggccaactcca

SEQ ID NO: 186604 - DNA, 20 bp, Artificial
  CRISPR gRNA sequence
catgaacatacctggtacca

SEQ ID NO: 186605 - DNA, 20 bp, Artificial
  CRISPR gRNA sequence
gtaccattttcccaccttct

SEQ ID NO: 186606 - DNA, 20 bp, Artificial
  CRISPR gRNA sequence
tcccaccttcttgggcagaa

SEQ ID NO: 186607 - DNA, 20 bp, Artificial
  CRISPR gRNA sequence
cccaccttcttgggcagaag

SEQ ID NO: 186608 - DNA, 20 bp, Artificial
  CRISPR gRNA sequence
ccaccttcttgggcagaagg

SEQ ID NO: 186609 - DNA, 20 bp, Artificial
  CRISPR gRNA sequence
cttgggcagaaggaaaagca

SEQ ID NO: 186610 - DNA, 20 bp, Artificial
  CRISPR gRNA sequence
ttgggcagaaggaaaagcag

SEQ ID NO: 186611 - DNA, 20 bp, Artificial
  CRISPR gRNA sequence
gggcagaaggaaaagcagag

SEQ ID NO: 186612 - DNA, 20 bp, Artificial
  CRISPR gRNA sequence
ggcagaaggaaaagcagagg

SEQ ID NO: 186613 - DNA, 20 bp, Artificial
  CRISPR gRNA sequence
atccccagagcatgatcccc

SEQ ID NO: 186614 - DNA, 20 bp, Artificial
  CRISPR gRNA sequence
gcaccaggtaccacagaaat

SEQ ID NO: 186615 - DNA, 20 bp, Artificial
  CRISPR gRNA sequence
agattctcactcagagaatc

SEQ ID NO: 186616 - DNA, 20 bp, Artificial
  CRISPR gRNA sequence
tcactcagagaatcactcag

SEQ ID NO: 186617 - DNA, 20 bp, Artificial
  CRISPR gRNA sequence
actcagagaatcactcaggg

SEQ ID NO: 186618 - DNA, 20 bp, Artificial
  CRISPR gRNA sequence
agagaatcactcagggtgga

SEQ ID NO: 186619 - DNA, 20 bp, Artificial
  CRISPR gRNA sequence
agggtggacgtgtcctctgt

SEQ ID NO: 186620 - DNA, 20 bp, Artificial
  CRISPR gRNA sequence
tgttacccgagacatgatgt

SEQ ID NO: 186621 - DNA, 20 bp, Artificial
  CRISPR gRNA sequence
ttacccgagacatgatgtta

SEQ ID NO: 186622 - DNA, 20 bp, Artificial
  CRISPR gRNA sequence
cccgagacatgatgttacct

SEQ ID NO: 186623 - DNA, 20 bp, Artificial
  CRISPR gRNA sequence
cctgcagggttggggagaag

SEQ ID NO: 186624 - DNA, 20 bp, Artificial
  CRISPR gRNA sequence
cagggttggggagaagagag

SEQ ID NO: 186625 - DNA, 20 bp, Artificial
  CRISPR gRNA sequence
gggagaagagagtgaggtga

SEQ ID NO: 186626 - DNA, 20 bp, Artificial
  CRISPR gRNA sequence
caagtgatgagacgaactaa

SEQ ID NO: 186627 - DNA, 20 bp, Artificial
  CRISPR gRNA sequence
acaatgagccaggatgccag

SEQ ID NO: 186628 - DNA, 20 bp, Artificial
  CRISPR gRNA sequence
taaggaggctgcaggaaaca

SEQ ID NO: 186629 - DNA, 20 bp, Artificial
  CRISPR gRNA sequence
aggaggctgcaggaaacaag

SEQ ID NO: 186630 - DNA, 20 bp, Artificial
  CRISPR gRNA sequence
caggaaacaaggttagggtt

SEQ ID NO: 186631 - DNA, 20 bp, Artificial
  CRISPR gRNA sequence
gggttctccagaggtctgca

SEQ ID NO: 186632 - DNA, 20 bp, Artificial
  CRISPR gRNA sequence
tccagaggtctgcaaatctc

SEQ ID NO: 186633 - DNA, 20 bp, Artificial
  CRISPR gRNA sequence
cagaggtctgcaaatctcag

SEQ ID NO: 186634 - DNA, 20 bp, Artificial
  CRISPR gRNA sequence
caaatctcagtgcagggaag

SEQ ID NO: 186635 - DNA, 20 bp, Artificial
  CRISPR gRNA sequence
agtgcagggaagatgagtgt

SEQ ID NO: 186636 - DNA, 20 bp, Artificial
  CRISPR gRNA sequence
aagaggaaaggcctgacctt

SEQ ID NO: 186637 - DNA, 20 bp, Artificial
  CRISPR gRNA sequence
accttcattttaattataaa

SEQ ID NO: 186638 - DNA, 20 bp, Artificial
  CRISPR gRNA sequence
cattttaattataaagtcat

SEQ ID NO: 186639 - DNA, 20 bp, Artificial
  CRISPR gRNA sequence
attttaattataaagtcatt

SEQ ID NO: 186640 - DNA, 20 bp, Artificial
  CRISPR gRNA sequence
taattataaagtcattaatg

SEQ ID NO: 186641 - DNA, 20 bp, Artificial
  CRISPR gRNA sequence
aattataaagtcattaatgc

SEQ ID NO: 186642 - DNA, 20 bp, Artificial
  CRISPR gRNA sequence
attataaagtcattaatgca

SEQ ID NO: 186643 - DNA, 20 bp, Artificial
  CRISPR gRNA sequence
taaagtcattaatgcacatg

SEQ ID NO: 186644 - DNA, 20 bp, Artificial
  CRISPR gRNA sequence
atgcacatgtgaatttccat

SEQ ID NO: 186645 - DNA, 20 bp, Artificial
  CRISPR gRNA sequence
ccattttcctgaaagctttc

SEQ ID NO: 186646 - DNA, 20 bp, Artificial
  CRISPR gRNA sequence
cattttcctgaaagctttct

SEQ ID NO: 186647 - DNA, 20 bp, Artificial
  CRISPR gRNA sequence
tcctgaaagctttctgttcc

SEQ ID NO: 186648 - DNA, 20 bp, Artificial
  CRISPR gRNA sequence
cctgaaagctttctgttccc

SEQ ID NO: 186649 - DNA, 20 bp, Artificial
  CRISPR gRNA sequence
ctgaaagctttctgttccct

SEQ ID NO: 186650 - DNA, 20 bp, Artificial
  CRISPR gRNA sequence
aaagctttctgttccctaga

SEQ ID NO: 186651 - DNA, 20 bp, Artificial
  CRISPR gRNA sequence
tctgttccctagagaacctg

SEQ ID NO: 186652 - DNA, 20 bp, Artificial
  CRISPR gRNA sequence
ctgttccctagagaacctgt

SEQ ID NO: 186653 - DNA, 20 bp, Artificial
  CRISPR gRNA sequence
tgttccctagagaacctgta

SEQ ID NO: 186654 - DNA, 20 bp, Artificial
  CRISPR gRNA sequence
ttccctagagaacctgtatg

SEQ ID NO: 186655 - DNA, 20 bp, Artificial
  CRISPR gRNA sequence
cctagagaacctgtatgtcc

SEQ ID NO: 186656 - DNA, 20 bp, Artificial
  CRISPR gRNA sequence
gagaacctgtatgtcccatg

SEQ ID NO: 186657 - DNA, 20 bp, Artificial
  CRISPR gRNA sequence
tatgtcccatgctatacaca

SEQ ID NO: 186658 - DNA, 20 bp, Artificial
  CRISPR gRNA sequence
tacacacaggcaggaagagc

SEQ ID NO: 186659 - DNA, 20 bp, Artificial
  CRISPR gRNA sequence
aaactggtcacataacagag

SEQ ID NO: 186660 - DNA, 20 bp, Artificial
  CRISPR gRNA sequence
aactggtcacataacagaga

SEQ ID NO: 186661 - DNA, 20 bp, Artificial
  CRISPR gRNA sequence
gtcacataacagagatggag

SEQ ID NO: 186662 - DNA, 20 bp, Artificial
  CRISPR gRNA sequence
ctaggaagcatgccaaagtc

SEQ ID NO: 186663 - DNA, 20 bp, Artificial
  CRISPR gRNA sequence
ggaagcatgccaaagtctgt

SEQ ID NO: 186664 - DNA, 20 bp, Artificial
  CRISPR gRNA sequence
tggagcactcactgggacta

SEQ ID NO: 186665 - DNA, 20 bp, Artificial
  CRISPR gRNA sequence
actgggactagggttctaac

SEQ ID NO: 186666 - DNA, 20 bp, Artificial
  CRISPR gRNA sequence
ggactagggttctaacccca

SEQ ID NO: 186667 - DNA, 20 bp, Artificial
  CRISPR gRNA sequence
gggttctaaccccaggtcta

SEQ ID NO: 186668 - DNA, 20 bp, Artificial
  CRISPR gRNA sequence
taaccccaggtctatctcta

SEQ ID NO: 186669 - DNA, 20 bp, Artificial
  CRISPR gRNA sequence
accccaggtctatctctagc

SEQ ID NO: 186670 - DNA, 20 bp, Artificial
  CRISPR gRNA sequence
tctctagccatatgtaactg

SEQ ID NO: 186671 - DNA, 20 bp, Artificial
  CRISPR gRNA sequence
tagccatatgtaactgtaca

SEQ ID NO: 186672 - DNA, 20 bp, Artificial
  CRISPR gRNA sequence
gccatatgtaactgtacagc

SEQ ID NO: 186673 - DNA, 20 bp, Artificial
  CRISPR gRNA sequence
tacagcttctagtgctgcta

SEQ ID NO: 186674 - DNA, 20 bp, Artificial
  CRISPR gRNA sequence
ctagtgctgctagaaagcat

SEQ ID NO: 186675 - DNA, 20 bp, Artificial
  CRISPR gRNA sequence
tagtgctgctagaaagcatg

SEQ ID NO: 186676 - DNA, 20 bp, Artificial
  CRISPR gRNA sequence
gtgctgctagaaagcatgcc

SEQ ID NO: 186677 - DNA, 20 bp, Artificial
  CRISPR gRNA sequence
ctagaaagcatgccgaagtc

SEQ ID NO: 186678 - DNA, 20 bp, Artificial
  CRISPR gRNA sequence
gaaagcatgccgaagtctgt

SEQ ID NO: 186679 - DNA, 20 bp, Artificial
  CRISPR gRNA sequence
tggagcactcaagagaccag

SEQ ID NO: 186680 - DNA, 20 bp, Artificial
  CRISPR gRNA sequence
aagagaccagggttctaacc

SEQ ID NO: 186681 - DNA, 20 bp, Artificial
  CRISPR gRNA sequence
taaccccaagtgtgtctcta

SEQ ID NO: 186682 - DNA, 20 bp, Artificial
  CRISPR gRNA sequence
accccaagtgtgtctctagc

SEQ ID NO: 186683 - DNA, 20 bp, Artificial
  CRISPR gRNA sequence
tagccatatgtaactgtgca

SEQ ID NO: 186684 - DNA, 20 bp, Artificial
  CRISPR gRNA sequence
gccatatgtaactgtgcagt

SEQ ID NO: 186685 - DNA, 20 bp, Artificial
  CRISPR gRNA sequence
tgcagtttcagcatttaggg

SEQ ID NO: 186686 - DNA, 20 bp, Artificial
  CRISPR gRNA sequence
cagcatttagggtcttggcc

SEQ ID NO: 186687 - DNA, 20 bp, Artificial
  CRISPR gRNA sequence
agcatttagggtcttggcct

SEQ ID NO: 186688 - DNA, 20 bp, Artificial
  CRISPR gRNA sequence
agggtcttggcctcagtttc

SEQ ID NO: 186689 - DNA, 20 bp, Artificial
  CRISPR gRNA sequence
gggtcttggcctcagtttcc

SEQ ID NO: 186690 - DNA, 20 bp, Artificial
  CRISPR gRNA sequence
ggcctcagtttccttctctg

SEQ ID NO: 186691 - DNA, 20 bp, Artificial
  CRISPR gRNA sequence
gcctcagtttccttctctgt

SEQ ID NO: 186692 - DNA, 20 bp, Artificial
  CRISPR gRNA sequence
agtttccttctctgtcagat

SEQ ID NO: 186693 - DNA, 20 bp, Artificial
  CRISPR gRNA sequence
ccttctctgtcagatgaggc

SEQ ID NO: 186694 - DNA, 20 bp, Artificial
  CRISPR gRNA sequence
cttctctgtcagatgaggca

SEQ ID NO: 186695 - DNA, 20 bp, Artificial
  CRISPR gRNA sequence
ctctgtcagatgaggcagtt

SEQ ID NO: 186696 - DNA, 20 bp, Artificial
  CRISPR gRNA sequence
tctgtcagatgaggcagttg

SEQ ID NO: 186697 - DNA, 20 bp, Artificial
  CRISPR gRNA sequence
tgtcagatgaggcagttggt

SEQ ID NO: 186698 - DNA, 20 bp, Artificial
  CRISPR gRNA sequence
tcagatgaggcagttggtct

SEQ ID NO: 186699 - DNA, 20 bp, Artificial
  CRISPR gRNA sequence
gtctctatgagctcaaaatt

SEQ ID NO: 186700 - DNA, 20 bp, Artificial
  CRISPR gRNA sequence
tatgagctcaaaatttccag

SEQ ID NO: 186701 - DNA, 20 bp, Artificial
  CRISPR gRNA sequence
tgagctcaaaatttccaggt

SEQ ID NO: 186702 - DNA, 20 bp, Artificial
  CRISPR gRNA sequence
aaaatttccaggtttgaaat

SEQ ID NO: 186703 - DNA, 20 bp, Artificial
  CRISPR gRNA sequence
ccaggtttgaaattctatgg

SEQ ID NO: 186704 - DNA, 20 bp, Artificial
  CRISPR gRNA sequence
caggtttgaaattctatggt

SEQ ID NO: 186705 - DNA, 20 bp, Artificial
  CRISPR gRNA sequence
gaaattctatggtttctatc

SEQ ID NO: 186706 - DNA, 20 bp, Artificial
  CRISPR gRNA sequence
aaattctatggtttctatct

SEQ ID NO: 186707 - DNA, 20 bp, Artificial
  CRISPR gRNA sequence
tatggtttctatctaaggat

SEQ ID NO: 186708 - DNA, 20 bp, Artificial
  CRISPR gRNA sequence
tggtttctatctaaggatac

SEQ ID NO: 186709 - DNA, 20 bp, Artificial
  CRISPR gRNA sequence
ctatctaaggatacatagga

SEQ ID NO: 186710 - DNA, 20 bp, Artificial
  CRISPR gRNA sequence
tatctaaggatacataggaa

SEQ ID NO: 186711 - DNA, 20 bp, Artificial
  CRISPR gRNA sequence
tctaaggatacataggaata

SEQ ID NO: 186712 - DNA, 20 bp, Artificial
  CRISPR gRNA sequence
aggatacataggaatagatt

SEQ ID NO: 186713 - DNA, 20 bp, Artificial
  CRISPR gRNA sequence
ataagaaaatgctagatgaa

SEQ ID NO: 186714 - DNA, 20 bp, Artificial
  CRISPR gRNA sequence
taagaaaatgctagatgaaa

SEQ ID NO: 186715 - DNA, 20 bp, Artificial
  CRISPR gRNA sequence
gatgaaaactctaggttttt

SEQ ID NO: 186716 - DNA, 20 bp, Artificial
  CRISPR gRNA sequence
taggtttttcttaaggtaag

SEQ ID NO: 186717 - DNA, 20 bp, Artificial
  CRISPR gRNA sequence
ggtttttcttaaggtaagga

SEQ ID NO: 186718 - DNA, 20 bp, Artificial
  CRISPR gRNA sequence
ttcttaaggtaaggaggaca

SEQ ID NO: 186719 - DNA, 20 bp, Artificial
  CRISPR gRNA sequence
tcttaaggtaaggaggacaa

SEQ ID NO: 186720 - DNA, 20 bp, Artificial
  CRISPR gRNA sequence
cttaaggtaaggaggacaat

SEQ ID NO: 186721 - DNA, 20 bp, Artificial
  CRISPR gRNA sequence
ttaaggtaaggaggacaata

SEQ ID NO: 186722 - DNA, 20 bp, Artificial
  CRISPR gRNA sequence
aaggtaaggaggacaatatt

SEQ ID NO: 186723 - DNA, 20 bp, Artificial
  CRISPR gRNA sequence
aggtaaggaggacaatattt

SEQ ID NO: 186724 - DNA, 20 bp, Artificial
  CRISPR gRNA sequence
tgctcctgaggtatatcaag

SEQ ID NO: 186725 - DNA, 20 bp, Artificial
  CRISPR gRNA sequence
gctcctgaggtatatcaaga

SEQ ID NO: 186726 - DNA, 20 bp, Artificial
  CRISPR gRNA sequence
ctcctgaggtatatcaagaa

SEQ ID NO: 186727 - DNA, 20 bp, Artificial
  CRISPR gRNA sequence
ctgaggtatatcaagaatga

SEQ ID NO: 186728 - DNA, 20 bp, Artificial
  CRISPR gRNA sequence
aggtatatcaagaatgagaa

SEQ ID NO: 186729 - DNA, 20 bp, Artificial
  CRISPR gRNA sequence
tgtgtgtgtgtgtgtgagag

SEQ ID NO: 186730 - DNA, 20 bp, Artificial
  CRISPR gRNA sequence
caggagaaacctgtctggtt

SEQ ID NO: 186731 - DNA, 20 bp, Artificial
  CRISPR gRNA sequence
aggagaaacctgtctggttc

SEQ ID NO: 186732 - DNA, 20 bp, Artificial
  CRISPR gRNA sequence
tctggttctgttggaaaaac

SEQ ID NO: 186733 - DNA, 20 bp, Artificial
  CRISPR gRNA sequence
gttctgttggaaaaactccg

SEQ ID NO: 186734 - DNA, 20 bp, Artificial
  CRISPR gRNA sequence
tgttggaaaaactccgtctc

SEQ ID NO: 186735 - DNA, 20 bp, Artificial
  CRISPR gRNA sequence
ttggaaaaactccgtctcct

SEQ ID NO: 186736 - DNA, 20 bp, Artificial
  CRISPR gRNA sequence
gaaaaactccgtctcctggc

SEQ ID NO: 186737 - DNA, 20 bp, Artificial
  CRISPR gRNA sequence
cgtctcctggcgcaggacag

SEQ ID NO: 186738 - DNA, 20 bp, Artificial
  CRISPR gRNA sequence
ctggcgcaggacagccccaa

SEQ ID NO: 186739 - DNA, 20 bp, Artificial
  CRISPR gRNA sequence
gcgcaggacagccccaaaca

SEQ ID NO: 186740 - DNA, 20 bp, Artificial
  CRISPR gRNA sequence
tccctgcaagtggctgtgca

SEQ ID NO: 186741 - DNA, 20 bp, Artificial
  CRISPR gRNA sequence
cctgcaagtggctgtgcacg

SEQ ID NO: 186742 - DNA, 20 bp, Artificial
  CRISPR gRNA sequence
caagtggctgtgcacgtggc

SEQ ID NO: 186743 - DNA, 20 bp, Artificial
  CRISPR gRNA sequence
tgcacgtggcccatggtgtt

SEQ ID NO: 186744 - DNA, 20 bp, Artificial
  CRISPR gRNA sequence
ttatagatcccgtcacccac

SEQ ID NO: 186745 - DNA, 20 bp, Artificial
  CRISPR gRNA sequence
tagatcccgtcacccacgaa

SEQ ID NO: 186746 - DNA, 20 bp, Artificial
  CRISPR gRNA sequence
cagcactgcactataaagaa

SEQ ID NO: 186747 - DNA, 20 bp, Artificial
  CRISPR gRNA sequence
cactataaagaacccggaaa

SEQ ID NO: 186748 - DNA, 20 bp, Artificial
  CRISPR gRNA sequence
taaagaacccggaaaaaaag

SEQ ID NO: 186749 - DNA, 20 bp, Artificial
  CRISPR gRNA sequence
agggaacagactgaaggtcc

SEQ ID NO: 186750 - DNA, 20 bp, Artificial
  CRISPR gRNA sequence
aaggtcccaggtatccccat

SEQ ID NO: 186751 - DNA, 20 bp, Artificial
  CRISPR gRNA sequence
cggacagcagccccaacttc

SEQ ID NO: 186752 - DNA, 20 bp, Artificial
  CRISPR gRNA sequence
ggacagcagccccaacttcc

SEQ ID NO: 186753 - DNA, 20 bp, Artificial
  CRISPR gRNA sequence
ccaactccctcatttgcagg

SEQ ID NO: 186754 - DNA, 20 bp, Artificial
  CRISPR gRNA sequence
caactccctcatttgcaggg

SEQ ID NO: 186755 - DNA, 20 bp, Artificial
  CRISPR gRNA sequence
cctcatttgcagggtgcccc

SEQ ID NO: 186756 - DNA, 20 bp, Artificial
  CRISPR gRNA sequence
atttgcagggtgccccattt

SEQ ID NO: 186757 - DNA, 20 bp, Artificial
  CRISPR gRNA sequence
gcagggtgccccattttcag

SEQ ID NO: 186758 - DNA, 20 bp, Artificial
  CRISPR gRNA sequence
cagggtgccccattttcagc

SEQ ID NO: 186759 - DNA, 20 bp, Artificial
  CRISPR gRNA sequence
tcagcccccagacctggcta

SEQ ID NO: 186760 - DNA, 20 bp, Artificial
  CRISPR gRNA sequence
cagcccccagacctggctat

SEQ ID NO: 186761 - DNA, 20 bp, Artificial
  CRISPR gRNA sequence
agcccccagacctggctatg

SEQ ID NO: 186762 - DNA, 20 bp, Artificial
  CRISPR gRNA sequence
gctatggtgagaatggacat

SEQ ID NO: 186763 - DNA, 20 bp, Artificial
  CRISPR gRNA sequence
tggtgagaatggacatgaga

SEQ ID NO: 186764 - DNA, 20 bp, Artificial
  CRISPR gRNA sequence
agtttcgagtgaaggtatcg

SEQ ID NO: 186765 - DNA, 20 bp, Artificial
  CRISPR gRNA sequence
cgagtgaaggtatcggctga

SEQ ID NO: 186766 - DNA, 20 bp, Artificial
  CRISPR gRNA sequence
gagtgaaggtatcggctgag

SEQ ID NO: 186767 - DNA, 20 bp, Artificial
  CRISPR gRNA sequence
agccatcttgtagaatccag

SEQ ID NO: 186768 - DNA, 20 bp, Artificial
  CRISPR gRNA sequence
gtagaatccagtcagtgagg

SEQ ID NO: 186769 - DNA, 20 bp, Artificial
  CRISPR gRNA sequence
tagaatccagtcagtgaggc

SEQ ID NO: 186770 - DNA, 20 bp, Artificial
  CRISPR gRNA sequence
ccctggagaaagagaagaga

SEQ ID NO: 186771 - DNA, 20 bp, Artificial
  CRISPR gRNA sequence
gagaaagagaagagaggtca

SEQ ID NO: 186772 - DNA, 20 bp, Artificial
  CRISPR gRNA sequence
agtctaagtaggtcagttcc

SEQ ID NO: 186773 - DNA, 20 bp, Artificial
  CRISPR gRNA sequence
agtaggtcagttccagtcag

SEQ ID NO: 186774 - DNA, 20 bp, Artificial
  CRISPR gRNA sequence
cagtcagactggccccacca

SEQ ID NO: 186775 - DNA, 20 bp, Artificial
  CRISPR gRNA sequence
gccccaccacgcctcctccc

SEQ ID NO: 186776 - DNA, 20 bp, Artificial
  CRISPR gRNA sequence
ctccccctcaccattatcct

SEQ ID NO: 186777 - DNA, 20 bp, Artificial
  CRISPR gRNA sequence
cccctcaccattatcctgga

SEQ ID NO: 186778 - DNA, 20 bp, Artificial
  CRISPR gRNA sequence
accattatcctggagggcat

SEQ ID NO: 186779 - DNA, 20 bp, Artificial
  CRISPR gRNA sequence
tcctggagggcatcagcaga

SEQ ID NO: 186780 - DNA, 20 bp, Artificial
  CRISPR gRNA sequence
gagggcatcagcagaaagga

SEQ ID NO: 186781 - DNA, 20 bp, Artificial
  CRISPR gRNA sequence
acgtctcaatcccgaaccta

SEQ ID NO: 186782 - DNA, 20 bp, Artificial
  CRISPR gRNA sequence
aatcccgaacctaaataggc

SEQ ID NO: 186783 - DNA, 20 bp, Artificial
  CRISPR gRNA sequence
aataggctgccctggaactc

SEQ ID NO: 186784 - DNA, 20 bp, Artificial
  CRISPR gRNA sequence
ccctggaactcactaccctg

SEQ ID NO: 186785 - DNA, 20 bp, Artificial
  CRISPR gRNA sequence
gaactcactaccctgtggtt

SEQ ID NO: 186786 - DNA, 20 bp, Artificial
  CRISPR gRNA sequence
actaccctgtggttgctcta

SEQ ID NO: 186787 - DNA, 20 bp, Artificial
  CRISPR gRNA sequence
ccctgtggttgctctaccag

SEQ ID NO: 186788 - DNA, 20 bp, Artificial
  CRISPR gRNA sequence
tggttgctctaccagaactt

SEQ ID NO: 186789 - DNA, 20 bp, Artificial
  CRISPR gRNA sequence
ctctaccagaactttcagga

SEQ ID NO: 186790 - DNA, 20 bp, Artificial
  CRISPR gRNA sequence
taccagaactttcaggattt

SEQ ID NO: 186791 - DNA, 20 bp, Artificial
  CRISPR gRNA sequence
ccagaactttcaggatttta

SEQ ID NO: 186792 - DNA, 20 bp, Artificial
  CRISPR gRNA sequence
tcaggattttattaggaagg

SEQ ID NO: 186793 - DNA, 20 bp, Artificial
  CRISPR gRNA sequence
caggattttattaggaaggc

SEQ ID NO: 186794 - DNA, 20 bp, Artificial
  CRISPR gRNA sequence
aggattttattaggaaggct

SEQ ID NO: 186795 - DNA, 20 bp, Artificial
  CRISPR gRNA sequence
tattaggaaggctggagatc

SEQ ID NO: 186796 - DNA, 20 bp, Artificial
  CRISPR gRNA sequence
attaggaaggctggagatca

SEQ ID NO: 186797 - DNA, 20 bp, Artificial
  CRISPR gRNA sequence
ttaggaaggctggagatcat

SEQ ID NO: 186798 - DNA, 20 bp, Artificial
  CRISPR gRNA sequence
ggaaggctggagatcatgaa

SEQ ID NO: 186799 - DNA, 20 bp, Artificial
  CRISPR gRNA sequence
gagatcatgaagtagaaaag

SEQ ID NO: 186800 - DNA, 20 bp, Artificial
  CRISPR gRNA sequence
ctgttagagatgaggatgcc

SEQ ID NO: 186801 - DNA, 20 bp, Artificial
  CRISPR gRNA sequence
ttagagatgaggatgccccg

SEQ ID NO: 186802 - DNA, 20 bp, Artificial
  CRISPR gRNA sequence
gagatgaggatgccccgccc

SEQ ID NO: 186803 - DNA, 20 bp, Artificial
  CRISPR gRNA sequence
cggccccagagcaaaggatt

SEQ ID NO: 186804 - DNA, 20 bp, Artificial
  CRISPR gRNA sequence
ggccccagagcaaaggattt

SEQ ID NO: 186805 - DNA, 20 bp, Artificial
  CRISPR gRNA sequence
ccccgcttccggcgtggccc

SEQ ID NO: 186806 - DNA, 20 bp, Artificial
  CRISPR gRNA sequence
cccgcttccggcgtggccca

SEQ ID NO: 186807 - DNA, 20 bp, Artificial
  CRISPR gRNA sequence
ccggcgtggcccaaagaatc

SEQ ID NO: 186808 - DNA, 20 bp, Artificial
  CRISPR gRNA sequence
cggcgtggcccaaagaatca

SEQ ID NO: 186809 - DNA, 20 bp, Artificial
  CRISPR gRNA sequence
tggcccccgccagtccagtg

SEQ ID NO: 186810 - DNA, 20 bp, Artificial
  CRISPR gRNA sequence
gcccccgccagtccagtgcc

SEQ ID NO: 186811 - DNA, 20 bp, Artificial
  CRISPR gRNA sequence
cttctacaccgaagtggtgt

SEQ ID NO: 186812 - DNA, 20 bp, Artificial
  CRISPR gRNA sequence
ttctacaccgaagtggtgtt

SEQ ID NO: 186813 - DNA, 20 bp, Artificial
  CRISPR gRNA sequence
ctacaccgaagtggtgttcc

SEQ ID NO: 186814 - DNA, 20 bp, Artificial
  CRISPR gRNA sequence
tacaccgaagtggtgttcca

SEQ ID NO: 186815 - DNA, 20 bp, Artificial
  CRISPR gRNA sequence
caccgaagtggtgttccaag

SEQ ID NO: 186816 - DNA, 20 bp, Artificial
  CRISPR gRNA sequence
caagacccacgctaggagtc

SEQ ID NO: 186817 - DNA, 20 bp, Artificial
  CRISPR gRNA sequence
ggagtccttctcctgctcca

SEQ ID NO: 186818 - DNA, 20 bp, Artificial
  CRISPR gRNA sequence
ctcctgctccacatttccca

SEQ ID NO: 186819 - DNA, 20 bp, Artificial
  CRISPR gRNA sequence
tcctgctccacatttcccag

SEQ ID NO: 186820 - DNA, 20 bp, Artificial
  CRISPR gRNA sequence
ctgctccacatttcccagaa

SEQ ID NO: 186821 - DNA, 20 bp, Artificial
  CRISPR gRNA sequence
ctccacatttcccagaaccc

SEQ ID NO: 186822 - DNA, 20 bp, Artificial
  CRISPR gRNA sequence
cacatttcccagaacccacg

SEQ ID NO: 186823 - DNA, 20 bp, Artificial
  CRISPR gRNA sequence
cccagaacccacgctactct

SEQ ID NO: 186824 - DNA, 20 bp, Artificial
  CRISPR gRNA sequence
ccagaacccacgctactcta

SEQ ID NO: 186825 - DNA, 20 bp, Artificial
  CRISPR gRNA sequence
ctctaccttactgacaatta

SEQ ID NO: 186826 - DNA, 20 bp, Artificial
  CRISPR gRNA sequence
taccttactgacaattacct

SEQ ID NO: 186827 - DNA, 20 bp, Artificial
  CRISPR gRNA sequence
ccttactgacaattaccttt

SEQ ID NO: 186828 - DNA, 20 bp, Artificial
  CRISPR gRNA sequence
actgacaattacctttgatt

SEQ ID NO: 186829 - DNA, 20 bp, Artificial
  CRISPR gRNA sequence
ctgacaattacctttgattc

SEQ ID NO: 186830 - DNA, 20 bp, Artificial
  CRISPR gRNA sequence
acaattacctttgattcctg

SEQ ID NO: 186831 - DNA, 20 bp, Artificial
  CRISPR gRNA sequence
cctttgattcctgtcccagt

SEQ ID NO: 186832 - DNA, 20 bp, Artificial
  CRISPR gRNA sequence
tgattcctgtcccagtcccc

SEQ ID NO: 186833 - DNA, 20 bp, Artificial
  CRISPR gRNA sequence
gattcctgtcccagtcccct

SEQ ID NO: 186834 - DNA, 20 bp, Artificial
  CRISPR gRNA sequence
attcctgtcccagtcccctt

SEQ ID NO: 186835 - DNA, 20 bp, Artificial
  CRISPR gRNA sequence
ctgtcccagtccccttgtgt

SEQ ID NO: 186836 - DNA, 20 bp, Artificial
  CRISPR gRNA sequence
tcccagtccccttgtgtcct

SEQ ID NO: 186837 - DNA, 20 bp, Artificial
  CRISPR gRNA sequence
gtgtcctcccctcttgccct

SEQ ID NO: 186838 - DNA, 20 bp, Artificial
  CRISPR gRNA sequence
tgtcctcccctcttgccctg

SEQ ID NO: 186839 - DNA, 20 bp, Artificial
  CRISPR gRNA sequence
ccctcttgccctgcgttccc

SEQ ID NO: 186840 - DNA, 20 bp, Artificial
  CRISPR gRNA sequence
ttgccctgcgttccccttac

SEQ ID NO: 186841 - DNA, 20 bp, Artificial
  CRISPR gRNA sequence
gccctgcgttccccttacca

SEQ ID NO: 186842 - DNA, 20 bp, Artificial
  CRISPR gRNA sequence
ccctgcgttccccttaccaa

SEQ ID NO: 186843 - DNA, 20 bp, Artificial
  CRISPR gRNA sequence
cgttccccttaccaagagag

SEQ ID NO: 186844 - DNA, 20 bp, Artificial
  CRISPR gRNA sequence
cccttaccaagagaggagag

SEQ ID NO: 186845 - DNA, 20 bp, Artificial
  CRISPR gRNA sequence
accaagagaggagaggacca

SEQ ID NO: 186846 - DNA, 20 bp, Artificial
  CRISPR gRNA sequence
ccaagagaggagaggaccac

SEQ ID NO: 186847 - DNA, 20 bp, Artificial
  CRISPR gRNA sequence
cgagcccaggcagcctagaa

SEQ ID NO: 186848 - DNA, 20 bp, Artificial
  CRISPR gRNA sequence
gaagccgacgcacagggttt

SEQ ID NO: 186849 - DNA, 20 bp, Artificial
  CRISPR gRNA sequence
ccagagccgccctgaccgcc

SEQ ID NO: 186850 - DNA, 20 bp, Artificial
  CRISPR gRNA sequence
cagagccgccctgaccgccg

SEQ ID NO: 186851 - DNA, 20 bp, Artificial
  CRISPR gRNA sequence
accgccgggcacccagaggc

SEQ ID NO: 186852 - DNA, 20 bp, Artificial
  CRISPR gRNA sequence
ccgagtttgtgccacagggc

SEQ ID NO: 186853 - DNA, 20 bp, Artificial
  CRISPR gRNA sequence
gtgccacagggctgctgcgg

SEQ ID NO: 186854 - DNA, 20 bp, Artificial
  CRISPR gRNA sequence
tgccacagggctgctgcggg

SEQ ID NO: 186855 - DNA, 20 bp, Artificial
  CRISPR gRNA sequence
ctgcgggcagtgccgctgca

SEQ ID NO: 186856 - DNA, 20 bp, Artificial
  CRISPR gRNA sequence
cgggcagtgccgctgcataa

SEQ ID NO: 186857 - DNA, 20 bp, Artificial
  CRISPR gRNA sequence
cataactgacaacgaaggcg

SEQ ID NO: 186858 - DNA, 20 bp, Artificial
  CRISPR gRNA sequence
acaacgaaggcggtagggtg

SEQ ID NO: 186859 - DNA, 20 bp, Artificial
  CRISPR gRNA sequence
ccccagtgcagtagcctggt

SEQ ID NO: 186860 - DNA, 20 bp, Artificial
  CRISPR gRNA sequence
cccagtgcagtagcctggtg

SEQ ID NO: 186861 - DNA, 20 bp, Artificial
  CRISPR gRNA sequence
gtgctatccgcggacccggg

SEQ ID NO: 186862 - DNA, 20 bp, Artificial
  CRISPR gRNA sequence
tccgcggacccgggggctcc

SEQ ID NO: 186863 - DNA, 20 bp, Artificial
  CRISPR gRNA sequence
cccatgagatcagctctcgg

SEQ ID NO: 186864 - DNA, 20 bp, Artificial
  CRISPR gRNA sequence
tcggaacaaggcaagtcccg

SEQ ID NO: 186865 - DNA, 20 bp, Artificial
  CRISPR gRNA sequence
ggaacaaggcaagtcccggc

SEQ ID NO: 186866 - DNA, 20 bp, Artificial
  CRISPR gRNA sequence
atggcttcaaagcagccagc

SEQ ID NO: 186867 - DNA, 20 bp, Artificial
  CRISPR gRNA sequence
caaagcagccagccagccct

SEQ ID NO: 186868 - DNA, 20 bp, Artificial
  CRISPR gRNA sequence
aaagcagccagccagccctg

SEQ ID NO: 186869 - DNA, 20 bp, Artificial
  CRISPR gRNA sequence
ggcacctgcgttttcgctct

SEQ ID NO: 186870 - DNA, 20 bp, Artificial
  CRISPR gRNA sequence
cgttttcgctcttggagcca

SEQ ID NO: 186871 - DNA, 20 bp, Artificial
  CRISPR gRNA sequence
tcgctcttggagccaaccgt

SEQ ID NO: 186872 - DNA, 20 bp, Artificial
  CRISPR gRNA sequence
cgctcttggagccaaccgtt

SEQ ID NO: 186873 - DNA, 20 bp, Artificial
  CRISPR gRNA sequence
gctcttggagccaaccgttg

SEQ ID NO: 186874 - DNA, 20 bp, Artificial
  CRISPR gRNA sequence
ttggagccaaccgttgccct

SEQ ID NO: 186875 - DNA, 20 bp, Artificial
  CRISPR gRNA sequence
ggagccaaccgttgccctga

SEQ ID NO: 186876 - DNA, 20 bp, Artificial
  CRISPR gRNA sequence
gagccaaccgttgccctgag

SEQ ID NO: 186877 - DNA, 20 bp, Artificial
  CRISPR gRNA sequence
ccctgaggaccccgcaggcc

SEQ ID NO: 186878 - DNA, 20 bp, Artificial
  CRISPR gRNA sequence
aggaccccgcaggcccccag

SEQ ID NO: 186879 - DNA, 20 bp, Artificial
  CRISPR gRNA sequence
aggcccaccgcccagacccg

SEQ ID NO: 186880 - DNA, 20 bp, Artificial
  CRISPR gRNA sequence
tccccagccatgcgagagaa

SEQ ID NO: 186881 - DNA, 20 bp, Artificial
  CRISPR gRNA sequence
cggggaggcagcggcacccg

SEQ ID NO: 186882 - DNA, 20 bp, Artificial
  CRISPR gRNA sequence
gagctagccattggcactcg

SEQ ID NO: 186883 - DNA, 20 bp, Artificial
  CRISPR gRNA sequence
gccattggcactcggacgcc

SEQ ID NO: 186884 - DNA, 20 bp, Artificial
  CRISPR gRNA sequence
gcactcggacgccgtcccgg

SEQ ID NO: 186885 - DNA, 20 bp, Artificial
  CRISPR gRNA sequence
ggacgccgtcccggtcccgg

SEQ ID NO: 186886 - DNA, 20 bp, Artificial
  CRISPR gRNA sequence
ggactctccgcgccccggtg

SEQ ID NO: 186887 - DNA, 20 bp, Artificial
  CRISPR gRNA sequence
tccgcgccccggtggggcct

SEQ ID NO: 186888 - DNA, 20 bp, Artificial
  CRISPR gRNA sequence
cgcgccccggtggggcctga

SEQ ID NO: 186889 - DNA, 20 bp, Artificial
  CRISPR gRNA sequence
aagctccgggtaccgccgag

SEQ ID NO: 186890 - DNA, 20 bp, Artificial
  CRISPR gRNA sequence
cgggtaccgccgagtcctcc

SEQ ID NO: 186891 - DNA, 20 bp, Artificial
  CRISPR gRNA sequence
ccctactggcggctggggga

SEQ ID NO: 186892 - DNA, 20 bp, Artificial
  CRISPR gRNA sequence
ctggcggctgggggagggaa

SEQ ID NO: 186893 - DNA, 20 bp, Artificial
  CRISPR gRNA sequence
gcggctgggggagggaacga

SEQ ID NO: 186894 - DNA, 20 bp, Artificial
  CRISPR gRNA sequence
ggggagggaacgagggcggg

SEQ ID NO: 186895 - DNA, 20 bp, Artificial
  CRISPR gRNA sequence
tcggaaagtcccaggaacag

SEQ ID NO: 186896 - DNA, 20 bp, Artificial
  CRISPR gRNA sequence
ggaaagtcccaggaacaggc

SEQ ID NO: 186897 - DNA, 20 bp, Artificial
  CRISPR gRNA sequence
atcctgcgctggcgagaagc

SEQ ID NO: 186898 - DNA, 20 bp, Artificial
  CRISPR gRNA sequence
cgctggcgagaagctcagcc

SEQ ID NO: 186899 - DNA, 20 bp, Artificial
  CRISPR gRNA sequence
gcgagaagctcagccattta

SEQ ID NO: 186900 - DNA, 20 bp, Artificial
  CRISPR gRNA sequence
agccatttaggggaaagcga

SEQ ID NO: 186901 - DNA, 20 bp, Artificial
  CRISPR gRNA sequence
aggggaaagcgaaatcgaaa

SEQ ID NO: 186902 - DNA, 20 bp, Artificial
  CRISPR gRNA sequence
ggggaaagcgaaatcgaaag

SEQ ID NO: 186903 - DNA, 20 bp, Artificial
  CRISPR gRNA sequence
ctcactagataacgcctact

SEQ ID NO: 186904 - DNA, 20 bp, Artificial
  CRISPR gRNA sequence
actagataacgcctacttcc

SEQ ID NO: 186905 - DNA, 20 bp, Artificial
  CRISPR gRNA sequence
gataacgcctacttccaaaa

SEQ ID NO: 186906 - DNA, 20 bp, Artificial
  CRISPR gRNA sequence
cttccaaaagtggcctgccc

SEQ ID NO: 186907 - DNA, 20 bp, Artificial
  CRISPR gRNA sequence
ccaaaagtggcctgcccaga

SEQ ID NO: 186908 - DNA, 20 bp, Artificial
  CRISPR gRNA sequence
caaaagtggcctgcccagac

SEQ ID NO: 186909 - DNA, 20 bp, Artificial
  CRISPR gRNA sequence
cccagactattttggtagca

SEQ ID NO: 186910 - DNA, 20 bp, Artificial
  CRISPR gRNA sequence
ttttggtagcaagcgtggaa

SEQ ID NO: 186911 - DNA, 20 bp, Artificial
  CRISPR gRNA sequence
tggtagcaagcgtggaaatc

SEQ ID NO: 186912 - DNA, 20 bp, Artificial
  CRISPR gRNA sequence
ccacgcttgctaccaaaata

SEQ ID NO: 186913 - DNA, 20 bp, Artificial
  CRISPR gRNA sequence
cacgcttgctaccaaaatag

SEQ ID NO: 186914 - DNA, 20 bp, Artificial
  CRISPR gRNA sequence
gctaccaaaatagtctgggc

SEQ ID NO: 186915 - DNA, 20 bp, Artificial
  CRISPR gRNA sequence
ctaccaaaatagtctgggca

SEQ ID NO: 186916 - DNA, 20 bp, Artificial
  CRISPR gRNA sequence
ccaaaatagtctgggcaggc

SEQ ID NO: 186917 - DNA, 20 bp, Artificial
  CRISPR gRNA sequence
ggcaggccacttttggaagt

SEQ ID NO: 186918 - DNA, 20 bp, Artificial
  CRISPR gRNA sequence
ttggaagtaggcgttatcta

SEQ ID NO: 186919 - DNA, 20 bp, Artificial
  CRISPR gRNA sequence
tggaagtaggcgttatctag

SEQ ID NO: 186920 - DNA, 20 bp, Artificial
  CRISPR gRNA sequence
ggaagtaggcgttatctagt

SEQ ID NO: 186921 - DNA, 20 bp, Artificial
  CRISPR gRNA sequence
gaagtaggcgttatctagtg

SEQ ID NO: 186922 - DNA, 20 bp, Artificial
  CRISPR gRNA sequence
tctagtgagcaggcggccgc

SEQ ID NO: 186923 - DNA, 20 bp, Artificial
  CRISPR gRNA sequence
gtgagcaggcggccgctttc

SEQ ID NO: 186924 - DNA, 20 bp, Artificial
  CRISPR gRNA sequence
tcgatttcgctttcccctaa

SEQ ID NO: 186925 - DNA, 20 bp, Artificial
  CRISPR gRNA sequence
cgatttcgctttcccctaaa

SEQ ID NO: 186926 - DNA, 20 bp, Artificial
  CRISPR gRNA sequence
gatttcgctttcccctaaat

SEQ ID NO: 186927 - DNA, 20 bp, Artificial
  CRISPR gRNA sequence
cgctttcccctaaatggctg

SEQ ID NO: 186928 - DNA, 20 bp, Artificial
  CRISPR gRNA sequence
gctttcccctaaatggctga

SEQ ID NO: 186929 - DNA, 20 bp, Artificial
  CRISPR gRNA sequence
tcccctaaatggctgagctt

SEQ ID NO: 186930 - DNA, 20 bp, Artificial
  CRISPR gRNA sequence
cccctaaatggctgagcttc

SEQ ID NO: 186931 - DNA, 20 bp, Artificial
  CRISPR gRNA sequence
ccctaaatggctgagcttct

SEQ ID NO: 186932 - DNA, 20 bp, Artificial
  CRISPR gRNA sequence
aatggctgagcttctcgcca

SEQ ID NO: 186933 - DNA, 20 bp, Artificial
  CRISPR gRNA sequence
agcttctcgccagcgcagga

SEQ ID NO: 186934 - DNA, 20 bp, Artificial
  CRISPR gRNA sequence
ctcgccagcgcaggatcagc

SEQ ID NO: 186935 - DNA, 20 bp, Artificial
  CRISPR gRNA sequence
tcgccagcgcaggatcagcc

SEQ ID NO: 186936 - DNA, 20 bp, Artificial
  CRISPR gRNA sequence
gccagcgcaggatcagcctg

SEQ ID NO: 186937 - DNA, 20 bp, Artificial
  CRISPR gRNA sequence
ttcctgggactttccgagag

SEQ ID NO: 186938 - DNA, 20 bp, Artificial
  CRISPR gRNA sequence
ctgggactttccgagagccc

SEQ ID NO: 186939 - DNA, 20 bp, Artificial
  CRISPR gRNA sequence
ggactttccgagagccccgc

SEQ ID NO: 186940 - DNA, 20 bp, Artificial
  CRISPR gRNA sequence
tccgagagccccgccctcgt

SEQ ID NO: 186941 - DNA, 20 bp, Artificial
  CRISPR gRNA sequence
ccgagagccccgccctcgtt

SEQ ID NO: 186942 - DNA, 20 bp, Artificial
  CRISPR gRNA sequence
cgagagccccgccctcgttc

SEQ ID NO: 186943 - DNA, 20 bp, Artificial
  CRISPR gRNA sequence
gttccctcccccagccgcca

SEQ ID NO: 186944 - DNA, 20 bp, Artificial
  CRISPR gRNA sequence
cctcccccagccgccagtag

SEQ ID NO: 186945 - DNA, 20 bp, Artificial
  CRISPR gRNA sequence
ccccagccgccagtagggga

SEQ ID NO: 186946 - DNA, 20 bp, Artificial
  CRISPR gRNA sequence
ggcggtacccggagcttcag

SEQ ID NO: 186947 - DNA, 20 bp, Artificial
  CRISPR gRNA sequence
caggccccaccggggcgcgg

SEQ ID NO: 186948 - DNA, 20 bp, Artificial
  CRISPR gRNA sequence
aggccccaccggggcgcgga

SEQ ID NO: 186949 - DNA, 20 bp, Artificial
  CRISPR gRNA sequence
gctctaggtgtcccgctccc

SEQ ID NO: 186950 - DNA, 20 bp, Artificial
  CRISPR gRNA sequence
taggtgtcccgctccccgcg

SEQ ID NO: 186951 - DNA, 20 bp, Artificial
  CRISPR gRNA sequence
ggtgtcccgctccccgcggg

SEQ ID NO: 186952 - DNA, 20 bp, Artificial
  CRISPR gRNA sequence
cccgcgggtgccgctgcctc

SEQ ID NO: 186953 - DNA, 20 bp, Artificial
  CRISPR gRNA sequence
cctccccggagcttctctcg

SEQ ID NO: 186954 - DNA, 20 bp, Artificial
  CRISPR gRNA sequence
cccggagcttctctcgcatg

SEQ ID NO: 186955 - DNA, 20 bp, Artificial
  CRISPR gRNA sequence
ctctcgcatggctggggaca

SEQ ID NO: 186956 - DNA, 20 bp, Artificial
  CRISPR gRNA sequence
tctcgcatggctggggacag

SEQ ID NO: 186957 - DNA, 20 bp, Artificial
  CRISPR gRNA sequence
tcgcatggctggggacagta

SEQ ID NO: 186958 - DNA, 20 bp, Artificial
  CRISPR gRNA sequence
gcatggctggggacagtact

SEQ ID NO: 186959 - DNA, 20 bp, Artificial
  CRISPR gRNA sequence
gggacagtactgctacttct

SEQ ID NO: 186960 - DNA, 20 bp, Artificial
  CRISPR gRNA sequence
ctacttctcgccgactgggt

SEQ ID NO: 186961 - DNA, 20 bp, Artificial
  CRISPR gRNA sequence
cttctcgccgactgggtgct

SEQ ID NO: 186962 - DNA, 20 bp, Artificial
  CRISPR gRNA sequence
ctcgccgactgggtgctgct

SEQ ID NO: 186963 - DNA, 20 bp, Artificial
  CRISPR gRNA sequence
tcgccgactgggtgctgctc

SEQ ID NO: 186964 - DNA, 20 bp, Artificial
  CRISPR gRNA sequence
gccgactgggtgctgctccg

SEQ ID NO: 186965 - DNA, 20 bp, Artificial
  CRISPR gRNA sequence
ggtgctgctccggaccgcgc

SEQ ID NO: 186966 - DNA, 20 bp, Artificial
  CRISPR gRNA sequence
ctccggaccgcgctgccccg

SEQ ID NO: 186967 - DNA, 20 bp, Artificial
  CRISPR gRNA sequence
cggaccgcgctgccccgcat

SEQ ID NO: 186968 - DNA, 20 bp, Artificial
  CRISPR gRNA sequence
ccccgcatattctccctgct

SEQ ID NO: 186969 - DNA, 20 bp, Artificial
  CRISPR gRNA sequence
tccctgctggtgcccaccgc

SEQ ID NO: 186970 - DNA, 20 bp, Artificial
  CRISPR gRNA sequence
cctgctggtgcccaccgcgc

SEQ ID NO: 186971 - DNA, 20 bp, Artificial
  CRISPR gRNA sequence
ctggtgcccaccgcgctgcc

SEQ ID NO: 186972 - DNA, 20 bp, Artificial
  CRISPR gRNA sequence
gtgcccaccgcgctgccact

SEQ ID NO: 186973 - DNA, 20 bp, Artificial
  CRISPR gRNA sequence
ccactgctccgggtctgggc

SEQ ID NO: 186974 - DNA, 20 bp, Artificial
  CRISPR gRNA sequence
ctccgggtctgggcggtggg

SEQ ID NO: 186975 - DNA, 20 bp, Artificial
  CRISPR gRNA sequence
cgggtctgggcggtgggcct

SEQ ID NO: 186976 - DNA, 20 bp, Artificial
  CRISPR gRNA sequence
ggcggtgggcctgagccgct

SEQ ID NO: 186977 - DNA, 20 bp, Artificial
  CRISPR gRNA sequence
agccgctgggccgtgctctg

SEQ ID NO: 186978 - DNA, 20 bp, Artificial
  CRISPR gRNA sequence
ggccgtgctctggctggggg

SEQ ID NO: 186979 - DNA, 20 bp, Artificial
  CRISPR gRNA sequence
tggctgggggcctgcggggt

SEQ ID NO: 186980 - DNA, 20 bp, Artificial
  CRISPR gRNA sequence
gctgggggcctgcggggtcc

SEQ ID NO: 186981 - DNA, 20 bp, Artificial
  CRISPR gRNA sequence
ggggcctgcggggtcctcag

SEQ ID NO: 186982 - DNA, 20 bp, Artificial
  CRISPR gRNA sequence
cggggtcctcagggcaacgg

SEQ ID NO: 186983 - DNA, 20 bp, Artificial
  CRISPR gRNA sequence
agggcaacggttggctccaa

SEQ ID NO: 186984 - DNA, 20 bp, Artificial
  CRISPR gRNA sequence
gctccaagagcgaaaacgca

SEQ ID NO: 186985 - DNA, 20 bp, Artificial
  CRISPR gRNA sequence
caagagcgaaaacgcaggtg

SEQ ID NO: 186986 - DNA, 20 bp, Artificial
  CRISPR gRNA sequence
gctggctgctttgaagccat

SEQ ID NO: 186987 - DNA, 20 bp, Artificial
  CRISPR gRNA sequence
gctgctttgaagccattagc

SEQ ID NO: 186988 - DNA, 20 bp, Artificial
  CRISPR gRNA sequence
ctttgaagccattagctgcg

SEQ ID NO: 186989 - DNA, 20 bp, Artificial
  CRISPR gRNA sequence
tgaagccattagctgcggca

SEQ ID NO: 186990 - DNA, 20 bp, Artificial
  CRISPR gRNA sequence
gaagccattagctgcggcac

SEQ ID NO: 186991 - DNA, 20 bp, Artificial
  CRISPR gRNA sequence
aagccattagctgcggcact

SEQ ID NO: 186992 - DNA, 20 bp, Artificial
  CRISPR gRNA sequence
gctgcggcactgggcttggc

SEQ ID NO: 186993 - DNA, 20 bp, Artificial
  CRISPR gRNA sequence
cggcactgggcttggccctg

SEQ ID NO: 186994 - DNA, 20 bp, Artificial
  CRISPR gRNA sequence
ggcttggccctgccgggact

SEQ ID NO: 186995 - DNA, 20 bp, Artificial
  CRISPR gRNA sequence
ggccctgccgggacttgcct

SEQ ID NO: 186996 - DNA, 20 bp, Artificial
  CRISPR gRNA sequence
gccctgccgggacttgcctt

SEQ ID NO: 186997 - DNA, 20 bp, Artificial
  CRISPR gRNA sequence
ccgggacttgccttgttccg

SEQ ID NO: 186998 - DNA, 20 bp, Artificial
  CRISPR gRNA sequence
gccttgttccgagagctgat

SEQ ID NO: 186999 - DNA, 20 bp, Artificial
  CRISPR gRNA sequence
ccttgttccgagagctgatc

SEQ ID NO: 187000 - DNA, 20 bp, Artificial
  CRISPR gRNA sequence
gttccgagagctgatctcat

SEQ ID NO: 187001 - DNA, 20 bp, Artificial
  CRISPR gRNA sequence
ttccgagagctgatctcatg

SEQ ID NO: 187002 - DNA, 20 bp, Artificial
  CRISPR gRNA sequence
cgagagctgatctcatgggg

SEQ ID NO: 187003 - DNA, 20 bp, Artificial
  CRISPR gRNA sequence
atctcatggggagcccccgg

SEQ ID NO: 187004 - DNA, 20 bp, Artificial
  CRISPR gRNA sequence
atggggagcccccgggtccg

SEQ ID NO: 187005 - DNA, 20 bp, Artificial
  CRISPR gRNA sequence
ctgcactggggaagtcaccc

SEQ ID NO: 187006 - DNA, 20 bp, Artificial
  CRISPR gRNA sequence
cactggggaagtcaccctac

SEQ ID NO: 187007 - DNA, 20 bp, Artificial
  CRISPR gRNA sequence
gggaagtcaccctaccgcct

SEQ ID NO: 187008 - DNA, 20 bp, Artificial
  CRISPR gRNA sequence
ccgccttcgttgtcagttat

SEQ ID NO: 187009 - DNA, 20 bp, Artificial
  CRISPR gRNA sequence
cgttgtcagttatgcagcgg

SEQ ID NO: 187010 - DNA, 20 bp, Artificial
  CRISPR gRNA sequence
gttgtcagttatgcagcggc

SEQ ID NO: 187011 - DNA, 20 bp, Artificial
  CRISPR gRNA sequence
tcagttatgcagcggcactg

SEQ ID NO: 187012 - DNA, 20 bp, Artificial
  CRISPR gRNA sequence
tgcagcggcactgcccgcag

SEQ ID NO: 187013 - DNA, 20 bp, Artificial
  CRISPR gRNA sequence
cccgcagcagccctgtggca

SEQ ID NO: 187014 - DNA, 20 bp, Artificial
  CRISPR gRNA sequence
tggcacaaactcgggagcct

SEQ ID NO: 187015 - DNA, 20 bp, Artificial
  CRISPR gRNA sequence
gggagcctctgggtgcccgg

SEQ ID NO: 187016 - DNA, 20 bp, Artificial
  CRISPR gRNA sequence
tgggtgcccggcggtcaggg

SEQ ID NO: 187017 - DNA, 20 bp, Artificial
  CRISPR gRNA sequence
ggtgcccggcggtcagggcg

SEQ ID NO: 187018 - DNA, 20 bp, Artificial
  CRISPR gRNA sequence
tggaaaccctgtgcgtcggc

SEQ ID NO: 187019 - DNA, 20 bp, Artificial
  CRISPR gRNA sequence
gaaaccctgtgcgtcggctt

SEQ ID NO: 187020 - DNA, 20 bp, Artificial
  CRISPR gRNA sequence
tgcgtcggcttctaggctgc

SEQ ID NO: 187021 - DNA, 20 bp, Artificial
  CRISPR gRNA sequence
ctaggctgcctgggctcgga

SEQ ID NO: 187022 - DNA, 20 bp, Artificial
  CRISPR gRNA sequence
taggctgcctgggctcggag

SEQ ID NO: 187023 - DNA, 20 bp, Artificial
  CRISPR gRNA sequence
ggctgcctgggctcggagac

SEQ ID NO: 187024 - DNA, 20 bp, Artificial
  CRISPR gRNA sequence
cctgggctcggagacgcgcc

SEQ ID NO: 187025 - DNA, 20 bp, Artificial
  CRISPR gRNA sequence
ggctcggagacgcgccgcct

SEQ ID NO: 187026 - DNA, 20 bp, Artificial
  CRISPR gRNA sequence
ggagacgcgccgcctctcgc

SEQ ID NO: 187027 - DNA, 20 bp, Artificial
  CRISPR gRNA sequence
tcgctgttcctggtcctggt

SEQ ID NO: 187028 - DNA, 20 bp, Artificial
  CRISPR gRNA sequence
gctgttcctggtcctggtgg

SEQ ID NO: 187029 - DNA, 20 bp, Artificial
  CRISPR gRNA sequence
ttcctggtcctggtggtcct

SEQ ID NO: 187030 - DNA, 20 bp, Artificial
  CRISPR gRNA sequence
ctggtcctggtggtcctctc

SEQ ID NO: 187031 - DNA, 20 bp, Artificial
  CRISPR gRNA sequence
gtcctggtggtcctctcctc

SEQ ID NO: 187032 - DNA, 20 bp, Artificial
  CRISPR gRNA sequence
gtggtcctctcctctcttgg

SEQ ID NO: 187033 - DNA, 20 bp, Artificial
  CRISPR gRNA sequence
tcctctcttggtaaggggaa

SEQ ID NO: 187034 - DNA, 20 bp, Artificial
  CRISPR gRNA sequence
ctctcttggtaaggggaacg

SEQ ID NO: 187035 - DNA, 20 bp, Artificial
  CRISPR gRNA sequence
tcttggtaaggggaacgcag

SEQ ID NO: 187036 - DNA, 20 bp, Artificial
  CRISPR gRNA sequence
ttggtaaggggaacgcaggg

SEQ ID NO: 187037 - DNA, 20 bp, Artificial
  CRISPR gRNA sequence
ggtaaggggaacgcagggca

SEQ ID NO: 187038 - DNA, 20 bp, Artificial
  CRISPR gRNA sequence
gtaaggggaacgcagggcaa

SEQ ID NO: 187039 - DNA, 20 bp, Artificial
  CRISPR gRNA sequence
ggacaggaatcaaaggtaat

SEQ ID NO: 187040 - DNA, 20 bp, Artificial
  CRISPR gRNA sequence
tcagtaaggtagagtagcgt

SEQ ID NO: 187041 - DNA, 20 bp, Artificial
  CRISPR gRNA sequence
tgggaaatgtggagcaggag

SEQ ID NO: 187042 - DNA, 20 bp, Artificial
  CRISPR gRNA sequence
ggaaatgtggagcaggagaa

SEQ ID NO: 187043 - DNA, 20 bp, Artificial
  CRISPR gRNA sequence
ctagcgtgggtcttggaaca

SEQ ID NO: 187044 - DNA, 20 bp, Artificial
  CRISPR gRNA sequence
gcgtgggtcttggaacacca

SEQ ID NO: 187045 - DNA, 20 bp, Artificial
  CRISPR gRNA sequence
ggaacaccacttcggtgtag

SEQ ID NO: 187046 - DNA, 20 bp, Artificial
  CRISPR gRNA sequence
gaacaccacttcggtgtaga

SEQ ID NO: 187047 - DNA, 20 bp, Artificial
  CRISPR gRNA sequence
cggtgtagaagaaacggcac

SEQ ID NO: 187048 - DNA, 20 bp, Artificial
  CRISPR gRNA sequence
ggtgtagaagaaacggcact

SEQ ID NO: 187049 - DNA, 20 bp, Artificial
  CRISPR gRNA sequence
gactggcgggggccagaggt

SEQ ID NO: 187050 - DNA, 20 bp, Artificial
  CRISPR gRNA sequence
gcgggggccagaggttctgg

SEQ ID NO: 187051 - DNA, 20 bp, Artificial
  CRISPR gRNA sequence
tgggctccattgctgaccgg

SEQ ID NO: 187052 - DNA, 20 bp, Artificial
  CRISPR gRNA sequence
ggctccattgctgaccgggt

SEQ ID NO: 187053 - DNA, 20 bp, Artificial
  CRISPR gRNA sequence
cattgctgaccgggtcttga

SEQ ID NO: 187054 - DNA, 20 bp, Artificial
  CRISPR gRNA sequence
ctgaccgggtcttgattctt

SEQ ID NO: 187055 - DNA, 20 bp, Artificial
  CRISPR gRNA sequence
accgggtcttgattctttgg

SEQ ID NO: 187056 - DNA, 20 bp, Artificial
  CRISPR gRNA sequence
gattctttgggccacgccgg

SEQ ID NO: 187057 - DNA, 20 bp, Artificial
  CRISPR gRNA sequence
attctttgggccacgccgga

SEQ ID NO: 187058 - DNA, 20 bp, Artificial
  CRISPR gRNA sequence
tttgggccacgccggaagcg

SEQ ID NO: 187059 - DNA, 20 bp, Artificial
  CRISPR gRNA sequence
tgggccacgccggaagcggg

SEQ ID NO: 187060 - DNA, 20 bp, Artificial
  CRISPR gRNA sequence
gggccacgccggaagcgggg

SEQ ID NO: 187061 - DNA, 20 bp, Artificial
  CRISPR gRNA sequence
ggccacgccggaagcgggga

SEQ ID NO: 187062 - DNA, 20 bp, Artificial
  CRISPR gRNA sequence
tgctctggggccgaagggcg

SEQ ID NO: 187063 - DNA, 20 bp, Artificial
  CRISPR gRNA sequence
gctctggggccgaagggcgg

SEQ ID NO: 187064 - DNA, 20 bp, Artificial
  CRISPR gRNA sequence
ctctggggccgaagggcggg

SEQ ID NO: 187065 - DNA, 20 bp, Artificial
  CRISPR gRNA sequence
tggggccgaagggcggggca

SEQ ID NO: 187066 - DNA, 20 bp, Artificial
  CRISPR gRNA sequence
gggccgaagggcggggcatc

SEQ ID NO: 187067 - DNA, 20 bp, Artificial
  CRISPR gRNA sequence
atctctaacaggaggctttt

SEQ ID NO: 187068 - DNA, 20 bp, Artificial
  CRISPR gRNA sequence
taacaggaggcttttctact

SEQ ID NO: 187069 - DNA, 20 bp, Artificial
  CRISPR gRNA sequence
acaggaggcttttctacttc

SEQ ID NO: 187070 - DNA, 20 bp, Artificial
  CRISPR gRNA sequence
ttctacttcatgatctccag

SEQ ID NO: 187071 - DNA, 20 bp, Artificial
  CRISPR gRNA sequence
tctacttcatgatctccagc

SEQ ID NO: 187072 - DNA, 20 bp, Artificial
  CRISPR gRNA sequence
ctacttcatgatctccagcc

SEQ ID NO: 187073 - DNA, 20 bp, Artificial
  CRISPR gRNA sequence
tacttcatgatctccagcct

SEQ ID NO: 187074 - DNA, 20 bp, Artificial
  CRISPR gRNA sequence
cttcatgatctccagccttc

SEQ ID NO: 187075 - DNA, 20 bp, Artificial
  CRISPR gRNA sequence
catgatctccagccttccta

SEQ ID NO: 187076 - DNA, 20 bp, Artificial
  CRISPR gRNA sequence
atgatctccagccttcctaa

SEQ ID NO: 187077 - DNA, 20 bp, Artificial
  CRISPR gRNA sequence
cagccttcctaataaaatcc

SEQ ID NO: 187078 - DNA, 20 bp, Artificial
  CRISPR gRNA sequence
cctaataaaatcctgaaagt

SEQ ID NO: 187079 - DNA, 20 bp, Artificial
  CRISPR gRNA sequence
ctaataaaatcctgaaagtt

SEQ ID NO: 187080 - DNA, 20 bp, Artificial
  CRISPR gRNA sequence
ataaaatcctgaaagttctg

SEQ ID NO: 187081 - DNA, 20 bp, Artificial
  CRISPR gRNA sequence
aaagttctggtagagcaacc

SEQ ID NO: 187082 - DNA, 20 bp, Artificial
  CRISPR gRNA sequence
tggtagagcaaccacagggt

SEQ ID NO: 187083 - DNA, 20 bp, Artificial
  CRISPR gRNA sequence
gtagagcaaccacagggtag

SEQ ID NO: 187084 - DNA, 20 bp, Artificial
  CRISPR gRNA sequence
cagggcagcctatttaggtt

SEQ ID NO: 187085 - DNA, 20 bp, Artificial
  CRISPR gRNA sequence
tttaggttcgggattgagac

SEQ ID NO: 187086 - DNA, 20 bp, Artificial
  CRISPR gRNA sequence
aggttcgggattgagacgtc

SEQ ID NO: 187087 - DNA, 20 bp, Artificial
  CRISPR gRNA sequence
ggttcgggattgagacgtca

SEQ ID NO: 187088 - DNA, 20 bp, Artificial
  CRISPR gRNA sequence
gggattgagacgtcagtgtt

SEQ ID NO: 187089 - DNA, 20 bp, Artificial
  CRISPR gRNA sequence
agacgtcagtgtttcctttc

SEQ ID NO: 187090 - DNA, 20 bp, Artificial
  CRISPR gRNA sequence
cctttctgctgatgccctcc

SEQ ID NO: 187091 - DNA, 20 bp, Artificial
  CRISPR gRNA sequence
ctttctgctgatgccctcca

SEQ ID NO: 187092 - DNA, 20 bp, Artificial
  CRISPR gRNA sequence
tctgctgatgccctccagga

SEQ ID NO: 187093 - DNA, 20 bp, Artificial
  CRISPR gRNA sequence
ctgctgatgccctccaggat

SEQ ID NO: 187094 - DNA, 20 bp, Artificial
  CRISPR gRNA sequence
tgctgatgccctccaggata

SEQ ID NO: 187095 - DNA, 20 bp, Artificial
  CRISPR gRNA sequence
ctgatgccctccaggataat

SEQ ID NO: 187096 - DNA, 20 bp, Artificial
  CRISPR gRNA sequence
atgccctccaggataatggt

SEQ ID NO: 187097 - DNA, 20 bp, Artificial
  CRISPR gRNA sequence
caggataatggtgaggggga

SEQ ID NO: 187098 - DNA, 20 bp, Artificial
  CRISPR gRNA sequence
actggaactgacctacttag

SEQ ID NO: 187099 - DNA, 20 bp, Artificial
  CRISPR gRNA sequence
gaactgacctacttagactt

SEQ ID NO: 187100 - DNA, 20 bp, Artificial
  CRISPR gRNA sequence
acctacttagacttaatatt

SEQ ID NO: 187101 - DNA, 20 bp, Artificial
  CRISPR gRNA sequence
cttagacttaatatttgtgc

SEQ ID NO: 187102 - DNA, 20 bp, Artificial
  CRISPR gRNA sequence
agacttaatatttgtgcgtg

SEQ ID NO: 187103 - DNA, 20 bp, Artificial
  CRISPR gRNA sequence
gacttaatatttgtgcgtga

SEQ ID NO: 187104 - DNA, 20 bp, Artificial
  CRISPR gRNA sequence
aatatttgtgcgtgacctct

SEQ ID NO: 187105 - DNA, 20 bp, Artificial
  CRISPR gRNA sequence
atatttgtgcgtgacctctc

SEQ ID NO: 187106 - DNA, 20 bp, Artificial
  CRISPR gRNA sequence
gtgcgtgacctctcttctct

SEQ ID NO: 187107 - DNA, 20 bp, Artificial
  CRISPR gRNA sequence
tgcgtgacctctcttctctt

SEQ ID NO: 187108 - DNA, 20 bp, Artificial
  CRISPR gRNA sequence
tcttctctttctccagggga

SEQ ID NO: 187109 - DNA, 20 bp, Artificial
  CRISPR gRNA sequence
ttctctttctccaggggaga

SEQ ID NO: 187110 - DNA, 20 bp, Artificial
  CRISPR gRNA sequence
ctctttctccaggggagatg

SEQ ID NO: 187111 - DNA, 20 bp, Artificial
  CRISPR gRNA sequence
tctttctccaggggagatgg

SEQ ID NO: 187112 - DNA, 20 bp, Artificial
  CRISPR gRNA sequence
tttctccaggggagatggcc

SEQ ID NO: 187113 - DNA, 20 bp, Artificial
  CRISPR gRNA sequence
tctccaggggagatggccat

SEQ ID NO: 187114 - DNA, 20 bp, Artificial
  CRISPR gRNA sequence
ctccaggggagatggccatt

SEQ ID NO: 187115 - DNA, 20 bp, Artificial
  CRISPR gRNA sequence
tccaggggagatggccattc

SEQ ID NO: 187116 - DNA, 20 bp, Artificial
  CRISPR gRNA sequence
caggggagatggccattcca

SEQ ID NO: 187117 - DNA, 20 bp, Artificial
  CRISPR gRNA sequence
cattctttacgggccgcctc

SEQ ID NO: 187118 - DNA, 20 bp, Artificial
  CRISPR gRNA sequence
tttacgggccgcctcactga

SEQ ID NO: 187119 - DNA, 20 bp, Artificial
  CRISPR gRNA sequence
tacgggccgcctcactgact

SEQ ID NO: 187120 - DNA, 20 bp, Artificial
  CRISPR gRNA sequence
acgggccgcctcactgactg

SEQ ID NO: 187121 - DNA, 20 bp, Artificial
  CRISPR gRNA sequence
cgggccgcctcactgactgg

SEQ ID NO: 187122 - DNA, 20 bp, Artificial
  CRISPR gRNA sequence
actgactggattctacaaga

SEQ ID NO: 187123 - DNA, 20 bp, Artificial
  CRISPR gRNA sequence
actggattctacaagatggc

SEQ ID NO: 187124 - DNA, 20 bp, Artificial
  CRISPR gRNA sequence
gattctacaagatggctcag

SEQ ID NO: 187125 - DNA, 20 bp, Artificial
  CRISPR gRNA sequence
tacaagatggctcagccgat

SEQ ID NO: 187126 - DNA, 20 bp, Artificial
  CRISPR gRNA sequence
caagatggctcagccgatac

SEQ ID NO: 187127 - DNA, 20 bp, Artificial
  CRISPR gRNA sequence
agccgataccttcactcgaa

SEQ ID NO: 187128 - DNA, 20 bp, Artificial
  CRISPR gRNA sequence
cactcgaaacttaactctca

SEQ ID NO: 187129 - DNA, 20 bp, Artificial
  CRISPR gRNA sequence
actcgaaacttaactctcat

SEQ ID NO: 187130 - DNA, 20 bp, Artificial
  CRISPR gRNA sequence
gaaacttaactctcatgtcc

SEQ ID NO: 187131 - DNA, 20 bp, Artificial
  CRISPR gRNA sequence
aactctcatgtccattctca

SEQ ID NO: 187132 - DNA, 20 bp, Artificial
  CRISPR gRNA sequence
actctcatgtccattctcac

SEQ ID NO: 187133 - DNA, 20 bp, Artificial
  CRISPR gRNA sequence
tcatgtccattctcaccata

SEQ ID NO: 187134 - DNA, 20 bp, Artificial
  CRISPR gRNA sequence
atgtccattctcaccatagc

SEQ ID NO: 187135 - DNA, 20 bp, Artificial
  CRISPR gRNA sequence
tcaccatagccaggtctggg

SEQ ID NO: 187136 - DNA, 20 bp, Artificial
  CRISPR gRNA sequence
accatagccaggtctggggg

SEQ ID NO: 187137 - DNA, 20 bp, Artificial
  CRISPR gRNA sequence
ggggctgaaaatggggcacc

SEQ ID NO: 187138 - DNA, 20 bp, Artificial
  CRISPR gRNA sequence
aaaatggggcaccctgcaaa

SEQ ID NO: 187139 - DNA, 20 bp, Artificial
  CRISPR gRNA sequence
caaatgagggagttggaagt

SEQ ID NO: 187140 - DNA, 20 bp, Artificial
  CRISPR gRNA sequence
gaagttggggctgctgtccg

SEQ ID NO: 187141 - DNA, 20 bp, Artificial
  CRISPR gRNA sequence
gggctgctgtccgaaatgca

SEQ ID NO: 187142 - DNA, 20 bp, Artificial
  CRISPR gRNA sequence
ctgtccgaaatgcacttata

SEQ ID NO: 187143 - DNA, 20 bp, Artificial
  CRISPR gRNA sequence
tccgaaatgcacttatatgg

SEQ ID NO: 187144 - DNA, 20 bp, Artificial
  CRISPR gRNA sequence
atatggggatacctgggacc

SEQ ID NO: 187145 - DNA, 20 bp, Artificial
  CRISPR gRNA sequence
tatggggatacctgggacct

SEQ ID NO: 187146 - DNA, 20 bp, Artificial
  CRISPR gRNA sequence
ggaccttcagtctgttccct

SEQ ID NO: 187147 - DNA, 20 bp, Artificial
  CRISPR gRNA sequence
cagtctgttccctgaacaca

SEQ ID NO: 187148 - DNA, 20 bp, Artificial
  CRISPR gRNA sequence
agtctgttccctgaacacac

SEQ ID NO: 187149 - DNA, 20 bp, Artificial
  CRISPR gRNA sequence
ttccctgaacacaccctgat

SEQ ID NO: 187150 - DNA, 20 bp, Artificial
  CRISPR gRNA sequence
cctgaacacaccctgatccc

SEQ ID NO: 187151 - DNA, 20 bp, Artificial
  CRISPR gRNA sequence
aacacaccctgatccccttt

SEQ ID NO: 187152 - DNA, 20 bp, Artificial
  CRISPR gRNA sequence
atcccctttttttccgggtt

SEQ ID NO: 187153 - DNA, 20 bp, Artificial
  CRISPR gRNA sequence
tttttccgggttctttatag

SEQ ID NO: 187154 - DNA, 20 bp, Artificial
  CRISPR gRNA sequence
ttttccgggttctttatagt

SEQ ID NO: 187155 - DNA, 20 bp, Artificial
  CRISPR gRNA sequence
tttccgggttctttatagtg

SEQ ID NO: 187156 - DNA, 20 bp, Artificial
  CRISPR gRNA sequence
ttccgggttctttatagtgc

SEQ ID NO: 187157 - DNA, 20 bp, Artificial
  CRISPR gRNA sequence
tccgggttctttatagtgca

SEQ ID NO: 187158 - DNA, 20 bp, Artificial
  CRISPR gRNA sequence
ccgggttctttatagtgcag

SEQ ID NO: 187159 - DNA, 20 bp, Artificial
  CRISPR gRNA sequence
cgggttctttatagtgcagt

SEQ ID NO: 187160 - DNA, 20 bp, Artificial
  CRISPR gRNA sequence
tttatagtgcagtgctggag

SEQ ID NO: 187161 - DNA, 20 bp, Artificial
  CRISPR gRNA sequence
tatagtgcagtgctggagtt

SEQ ID NO: 187162 - DNA, 20 bp, Artificial
  CRISPR gRNA sequence
atagtgcagtgctggagttc

SEQ ID NO: 187163 - DNA, 20 bp, Artificial
  CRISPR gRNA sequence
tagtgcagtgctggagttcg

SEQ ID NO: 187164 - DNA, 20 bp, Artificial
  CRISPR gRNA sequence
gagttcgtgggtgacgggat

SEQ ID NO: 187165 - DNA, 20 bp, Artificial
  CRISPR gRNA sequence
gtgggtgacgggatctataa

SEQ ID NO: 187166 - DNA, 20 bp, Artificial
  CRISPR gRNA sequence
taacaacaccatgggccacg

SEQ ID NO: 187167 - DNA, 20 bp, Artificial
  CRISPR gRNA sequence
gcagggagaggtgtttgggg

SEQ ID NO: 187168 - DNA, 20 bp, Artificial
  CRISPR gRNA sequence
cagggagaggtgtttggggc

SEQ ID NO: 187169 - DNA, 20 bp, Artificial
  CRISPR gRNA sequence
ggggctgtcctgcgccagga

SEQ ID NO: 187170 - DNA, 20 bp, Artificial
  CRISPR gRNA sequence
gggctgtcctgcgccaggag

SEQ ID NO: 187171 - DNA, 20 bp, Artificial
  CRISPR gRNA sequence
tcctgcgccaggagacggag

SEQ ID NO: 187172 - DNA, 20 bp, Artificial
  CRISPR gRNA sequence
cgccaggagacggagttttt

SEQ ID NO: 187173 - DNA, 20 bp, Artificial
  CRISPR gRNA sequence
ttccaacagaaccagacagg

SEQ ID NO: 187174 - DNA, 20 bp, Artificial
  CRISPR gRNA sequence
tccaacagaaccagacaggt

SEQ ID NO: 187175 - DNA, 20 bp, Artificial
  CRISPR gRNA sequence
ccaacagaaccagacaggtt

SEQ ID NO: 187176 - DNA, 20 bp, Artificial
  CRISPR gRNA sequence
caacagaaccagacaggttt

SEQ ID NO: 187177 - DNA, 20 bp, Artificial
  CRISPR gRNA sequence
ctcctgaaactctttcatta

SEQ ID NO: 187178 - DNA, 20 bp, Artificial
  CRISPR gRNA sequence
tcctgaaactctttcattat

SEQ ID NO: 187179 - DNA, 20 bp, Artificial
  CRISPR gRNA sequence
ctgaaactctttcattatac

SEQ ID NO: 187180 - DNA, 20 bp, Artificial
  CRISPR gRNA sequence
aaactctttcattatacgcc

SEQ ID NO: 187181 - DNA, 20 bp, Artificial
  CRISPR gRNA sequence
tttcattatacgccatgtac

SEQ ID NO: 187182 - DNA, 20 bp, Artificial
  CRISPR gRNA sequence
tcattatacgccatgtactg

SEQ ID NO: 187183 - DNA, 20 bp, Artificial
  CRISPR gRNA sequence
cattatacgccatgtactgt

SEQ ID NO: 187184 - DNA, 20 bp, Artificial
  CRISPR gRNA sequence
attatacgccatgtactgtt

SEQ ID NO: 187185 - DNA, 20 bp, Artificial
  CRISPR gRNA sequence
tacgccatgtactgttcata

SEQ ID NO: 187186 - DNA, 20 bp, Artificial
  CRISPR gRNA sequence
ttcatatcctcatacatctg

SEQ ID NO: 187187 - DNA, 20 bp, Artificial
  CRISPR gRNA sequence
atatcctcatacatctgctt

SEQ ID NO: 187188 - DNA, 20 bp, Artificial
  CRISPR gRNA sequence
atacatctgctttgatctcc

SEQ ID NO: 187189 - DNA, 20 bp, Artificial
  CRISPR gRNA sequence
ctttgatctcccccctcccc

SEQ ID NO: 187190 - DNA, 20 bp, Artificial
  CRISPR gRNA sequence
tgatctcccccctccccgct

SEQ ID NO: 187191 - DNA, 20 bp, Artificial
  CRISPR gRNA sequence
gatctcccccctccccgctc

SEQ ID NO: 187192 - DNA, 20 bp, Artificial
  CRISPR gRNA sequence
atctcccccctccccgctct

SEQ ID NO: 187193 - DNA, 20 bp, Artificial
  CRISPR gRNA sequence
ccccctccccgctctctctc

SEQ ID NO: 187194 - DNA, 20 bp, Artificial
  CRISPR gRNA sequence
cccgctctctctctctcaca

SEQ ID NO: 187195 - DNA, 20 bp, Artificial
  CRISPR gRNA sequence
tctctctctcacacacacat

SEQ ID NO: 187196 - DNA, 20 bp, Artificial
  CRISPR gRNA sequence
tctctctcacacacacatac

SEQ ID NO: 187197 - DNA, 20 bp, Artificial
  CRISPR gRNA sequence
tctctcacacacacatacac

SEQ ID NO: 187198 - DNA, 20 bp, Artificial
  CRISPR gRNA sequence
tctcacacacacatacacac

SEQ ID NO: 187199 - DNA, 20 bp, Artificial
  CRISPR gRNA sequence
tcacacacacatacacacat

SEQ ID NO: 187200 - DNA, 20 bp, Artificial
  CRISPR gRNA sequence
acacacacatacacacattg

SEQ ID NO: 187201 - DNA, 20 bp, Artificial
  CRISPR gRNA sequence
ttccttctcattcttgatat

SEQ ID NO: 187202 - DNA, 20 bp, Artificial
  CRISPR gRNA sequence
cttctcattcttgatatacc

SEQ ID NO: 187203 - DNA, 20 bp, Artificial
  CRISPR gRNA sequence
ctcattcttgatataccctc

SEQ ID NO: 187204 - DNA, 20 bp, Artificial
  CRISPR gRNA sequence
tcattcttgatataccctct

SEQ ID NO: 187205 - DNA, 20 bp, Artificial
  CRISPR gRNA sequence
attcttgatataccctctcc

SEQ ID NO: 187206 - DNA, 20 bp, Artificial
  CRISPR gRNA sequence
ttgatataccctctccctgt

SEQ ID NO: 187207 - DNA, 20 bp, Artificial
  CRISPR gRNA sequence
gatataccctctccctgtct

SEQ ID NO: 187208 - DNA, 20 bp, Artificial
  CRISPR gRNA sequence
atataccctctccctgtctc

SEQ ID NO: 187209 - DNA, 20 bp, Artificial
  CRISPR gRNA sequence
tccctgtctctctctctctg

SEQ ID NO: 187210 - DNA, 20 bp, Artificial
  CRISPR gRNA sequence
cctgtctctctctctctgtc

SEQ ID NO: 187211 - DNA, 20 bp, Artificial
  CRISPR gRNA sequence
tctctctctctctgtctctg

SEQ ID NO: 187212 - DNA, 20 bp, Artificial
  CRISPR gRNA sequence
tctctctctgtctctgtctc

SEQ ID NO: 187213 - DNA, 20 bp, Artificial
  CRISPR gRNA sequence
tctctctgtctctgtctctc

SEQ ID NO: 187214 - DNA, 20 bp, Artificial
  CRISPR gRNA sequence
tctctgtctctgtctctctc

SEQ ID NO: 187215 - DNA, 20 bp, Artificial
  CRISPR gRNA sequence
tctgtctctgtctctctctc

SEQ ID NO: 187216 - DNA, 20 bp, Artificial
  CRISPR gRNA sequence
tgtctctgtctctctctctc

SEQ ID NO: 187217 - DNA, 20 bp, Artificial
  CRISPR gRNA sequence
tctctgtctctctctctctc

SEQ ID NO: 187218 - DNA, 20 bp, Artificial
  CRISPR gRNA sequence
tgtctctctctctctctctc

SEQ ID NO: 187219 - DNA, 20 bp, Artificial
  CRISPR gRNA sequence
tctctctctctctctctctc

SEQ ID NO: 187220 - DNA, 20 bp, Artificial
  CRISPR gRNA sequence
tctctctctctctctcacac

SEQ ID NO: 187221 - DNA, 20 bp, Artificial
  CRISPR gRNA sequence
tctctctctctctcacacac

SEQ ID NO: 187222 - DNA, 20 bp, Artificial
  CRISPR gRNA sequence
tctctctctctcacacacac

SEQ ID NO: 187223 - DNA, 20 bp, Artificial
  CRISPR gRNA sequence
tctctctctcacacacacac

SEQ ID NO: 187224 - DNA, 20 bp, Artificial
  CRISPR gRNA sequence
tctctctcacacacacacac

SEQ ID NO: 187225 - DNA, 20 bp, Artificial
  CRISPR gRNA sequence
tctctcacacacacacacac

SEQ ID NO: 187226 - DNA, 20 bp, Artificial
  CRISPR gRNA sequence
tctcacacacacacacacac

SEQ ID NO: 187227 - DNA, 20 bp, Artificial
  CRISPR gRNA sequence
tcacacacacacacacacaa

SEQ ID NO: 187228 - DNA, 20 bp, Artificial
  CRISPR gRNA sequence
acacacacacacacacaatt

SEQ ID NO: 187229 - DNA, 20 bp, Artificial
  CRISPR gRNA sequence
tttttctcattcttgatata

SEQ ID NO: 187230 - DNA, 20 bp, Artificial
  CRISPR gRNA sequence
ttctcattcttgatatacct

SEQ ID NO: 187231 - DNA, 20 bp, Artificial
  CRISPR gRNA sequence
tctcattcttgatatacctc

SEQ ID NO: 187232 - DNA, 20 bp, Artificial
  CRISPR gRNA sequence
ctcattcttgatatacctca

SEQ ID NO: 187233 - DNA, 20 bp, Artificial
  CRISPR gRNA sequence
tcattcttgatatacctcag

SEQ ID NO: 187234 - DNA, 20 bp, Artificial
  CRISPR gRNA sequence
attcttgatatacctcagga

SEQ ID NO: 187235 - DNA, 20 bp, Artificial
  CRISPR gRNA sequence
ttgatatacctcaggagcaa

SEQ ID NO: 187236 - DNA, 20 bp, Artificial
  CRISPR gRNA sequence
gatatacctcaggagcaaaa

SEQ ID NO: 187237 - DNA, 20 bp, Artificial
  CRISPR gRNA sequence
atatacctcaggagcaaaat

SEQ ID NO: 187238 - DNA, 20 bp, Artificial
  CRISPR gRNA sequence
aggagcaaaatattgtcctc

SEQ ID NO: 187239 - DNA, 20 bp, Artificial
  CRISPR gRNA sequence
tcctccttaccttaagaaaa

SEQ ID NO: 187240 - DNA, 20 bp, Artificial
  CRISPR gRNA sequence
cttaccttaagaaaaaccta

SEQ ID NO: 187241 - DNA, 20 bp, Artificial
  CRISPR gRNA sequence
accttaagaaaaacctagag

SEQ ID NO: 187242 - DNA, 20 bp, Artificial
  CRISPR gRNA sequence
ccttaagaaaaacctagagt

SEQ ID NO: 187243 - DNA, 20 bp, Artificial
  CRISPR gRNA sequence
aagaaaaacctagagttttc

SEQ ID NO: 187244 - DNA, 20 bp, Artificial
  CRISPR gRNA sequence
agaaaaacctagagttttca

SEQ ID NO: 187245 - DNA, 20 bp, Artificial
  CRISPR gRNA sequence
gagttttcatctagcatttt

SEQ ID NO: 187246 - DNA, 20 bp, Artificial
  CRISPR gRNA sequence
tcatctagcattttcttata

SEQ ID NO: 187247 - DNA, 20 bp, Artificial
  CRISPR gRNA sequence
catctagcattttcttataa

SEQ ID NO: 187248 - DNA, 20 bp, Artificial
  CRISPR gRNA sequence
atctagcattttcttataaa

SEQ ID NO: 187249 - DNA, 20 bp, Artificial
  CRISPR gRNA sequence
gcattttcttataaatctat

SEQ ID NO: 187250 - DNA, 20 bp, Artificial
  CRISPR gRNA sequence
tcttataaatctattcctat

SEQ ID NO: 187251 - DNA, 20 bp, Artificial
  CRISPR gRNA sequence
cttataaatctattcctatg

SEQ ID NO: 187252 - DNA, 20 bp, Artificial
  CRISPR gRNA sequence
ttataaatctattcctatgt

SEQ ID NO: 187253 - DNA, 20 bp, Artificial
  CRISPR gRNA sequence
ataaatctattcctatgtat

SEQ ID NO: 187254 - DNA, 20 bp, Artificial
  CRISPR gRNA sequence
taaatctattcctatgtatc

SEQ ID NO: 187255 - DNA, 20 bp, Artificial
  CRISPR gRNA sequence
ttcctatgtatccttagata

SEQ ID NO: 187256 - DNA, 20 bp, Artificial
  CRISPR gRNA sequence
ctatgtatccttagatagaa

SEQ ID NO: 187257 - DNA, 20 bp, Artificial
  CRISPR gRNA sequence
tgtatccttagatagaaacc

SEQ ID NO: 187258 - DNA, 20 bp, Artificial
  CRISPR gRNA sequence
agatagaaaccatagaattt

SEQ ID NO: 187259 - DNA, 20 bp, Artificial
  CRISPR gRNA sequence
gatagaaaccatagaatttc

SEQ ID NO: 187260 - DNA, 20 bp, Artificial
  CRISPR gRNA sequence
caaacctggaaattttgagc

SEQ ID NO: 187261 - DNA, 20 bp, Artificial
  CRISPR gRNA sequence
aaacctggaaattttgagct

SEQ ID NO: 187262 - DNA, 20 bp, Artificial
  CRISPR gRNA sequence
gaaattttgagctcatagag

SEQ ID NO: 187263 - DNA, 20 bp, Artificial
  CRISPR gRNA sequence
tgagctcatagagaccaact

SEQ ID NO: 187264 - DNA, 20 bp, Artificial
  CRISPR gRNA sequence
gagctcatagagaccaactg

SEQ ID NO: 187265 - DNA, 20 bp, Artificial
  CRISPR gRNA sequence
agctcatagagaccaactgc

SEQ ID NO: 187266 - DNA, 20 bp, Artificial
  CRISPR gRNA sequence
atagagaccaactgcctcat

SEQ ID NO: 187267 - DNA, 20 bp, Artificial
  CRISPR gRNA sequence
cctcatctgacagagaagga

SEQ ID NO: 187268 - DNA, 20 bp, Artificial
  CRISPR gRNA sequence
atctgacagagaaggaaact

SEQ ID NO: 187269 - DNA, 20 bp, Artificial
  CRISPR gRNA sequence
acagagaaggaaactgaggc

SEQ ID NO: 187270 - DNA, 20 bp, Artificial
  CRISPR gRNA sequence
aggccaagaccctaaatgct

SEQ ID NO: 187271 - DNA, 20 bp, Artificial
  CRISPR gRNA sequence
aatgctgaaactgcacagtt

SEQ ID NO: 187272 - DNA, 20 bp, Artificial
  CRISPR gRNA sequence
aaactgcacagttacatatg

SEQ ID NO: 187273 - DNA, 20 bp, Artificial
  CRISPR gRNA sequence
cacagttacatatggctaga

SEQ ID NO: 187274 - DNA, 20 bp, Artificial
  CRISPR gRNA sequence
catatggctagagacacact

SEQ ID NO: 187275 - DNA, 20 bp, Artificial
  CRISPR gRNA sequence
gagacacacttggggttaga

SEQ ID NO: 187276 - DNA, 20 bp, Artificial
  CRISPR gRNA sequence
ggggttagaaccctggtctc

SEQ ID NO: 187277 - DNA, 20 bp, Artificial
  CRISPR gRNA sequence
gggttagaaccctggtctct

SEQ ID NO: 187278 - DNA, 20 bp, Artificial
  CRISPR gRNA sequence
gaaccctggtctcttgagtg

SEQ ID NO: 187279 - DNA, 20 bp, Artificial
  CRISPR gRNA sequence
gtctcttgagtgctccacag

SEQ ID NO: 187280 - DNA, 20 bp, Artificial
  CRISPR gRNA sequence
ttgagtgctccacagacttc

SEQ ID NO: 187281 - DNA, 20 bp, Artificial
  CRISPR gRNA sequence
gagtgctccacagacttcgg

SEQ ID NO: 187282 - DNA, 20 bp, Artificial
  CRISPR gRNA sequence
agtgctccacagacttcggc

SEQ ID NO: 187283 - DNA, 20 bp, Artificial
  CRISPR gRNA sequence
cacagacttcggcatgcttt

SEQ ID NO: 187284 - DNA, 20 bp, Artificial
  CRISPR gRNA sequence
cggcatgctttctagcagca

SEQ ID NO: 187285 - DNA, 20 bp, Artificial
  CRISPR gRNA sequence
ggcatgctttctagcagcac

SEQ ID NO: 187286 - DNA, 20 bp, Artificial
  CRISPR gRNA sequence
tctagcagcactagaagctg

SEQ ID NO: 187287 - DNA, 20 bp, Artificial
  CRISPR gRNA sequence
ctagcagcactagaagctgt

SEQ ID NO: 187288 - DNA, 20 bp, Artificial
  CRISPR gRNA sequence
tagcagcactagaagctgta

SEQ ID NO: 187289 - DNA, 20 bp, Artificial
  CRISPR gRNA sequence
gcagcactagaagctgtaca

SEQ ID NO: 187290 - DNA, 20 bp, Artificial
  CRISPR gRNA sequence
gaagctgtacagttacatat

SEQ ID NO: 187291 - DNA, 20 bp, Artificial
  CRISPR gRNA sequence
tacagttacatatggctaga

SEQ ID NO: 187292 - DNA, 20 bp, Artificial
  CRISPR gRNA sequence
catatggctagagatagacc

SEQ ID NO: 187293 - DNA, 20 bp, Artificial
  CRISPR gRNA sequence
gagatagacctggggttaga

SEQ ID NO: 187294 - DNA, 20 bp, Artificial
  CRISPR gRNA sequence
gggttagaaccctagtccca

SEQ ID NO: 187295 - DNA, 20 bp, Artificial
  CRISPR gRNA sequence
gaaccctagtcccagtgagt

SEQ ID NO: 187296 - DNA, 20 bp, Artificial
  CRISPR gRNA sequence
gtcccagtgagtgctccaca

SEQ ID NO: 187297 - DNA, 20 bp, Artificial
  CRISPR gRNA sequence
cacagactttggcatgcttc

SEQ ID NO: 187298 - DNA, 20 bp, Artificial
  CRISPR gRNA sequence
tggcatgcttcctagcagca

SEQ ID NO: 187299 - DNA, 20 bp, Artificial
  CRISPR gRNA sequence
ggcatgcttcctagcagcac

SEQ ID NO: 187300 - DNA, 20 bp, Artificial
  CRISPR gRNA sequence
gcatgcttcctagcagcacc

SEQ ID NO: 187301 - DNA, 20 bp, Artificial
  CRISPR gRNA sequence
cctagcagcaccctcctcct

SEQ ID NO: 187302 - DNA, 20 bp, Artificial
  CRISPR gRNA sequence
ctagcagcaccctcctcctc

SEQ ID NO: 187303 - DNA, 20 bp, Artificial
  CRISPR gRNA sequence
gcagcaccctcctcctccat

SEQ ID NO: 187304 - DNA, 20 bp, Artificial
  CRISPR gRNA sequence
ctcctccatctctgttatgt

SEQ ID NO: 187305 - DNA, 20 bp, Artificial
  CRISPR gRNA sequence
ctccatctctgttatgtgac

SEQ ID NO: 187306 - DNA, 20 bp, Artificial
  CRISPR gRNA sequence
catctctgttatgtgaccag

SEQ ID NO: 187307 - DNA, 20 bp, Artificial
  CRISPR gRNA sequence
tgttatgtgaccagtttaag

SEQ ID NO: 187308 - DNA, 20 bp, Artificial
  CRISPR gRNA sequence
ttatgtgaccagtttaagct

SEQ ID NO: 187309 - DNA, 20 bp, Artificial
  CRISPR gRNA sequence
tgtgaccagtttaagctctt

SEQ ID NO: 187310 - DNA, 20 bp, Artificial
  CRISPR gRNA sequence
aagctcttcctgcctgtgtg

SEQ ID NO: 187311 - DNA, 20 bp, Artificial
  CRISPR gRNA sequence
agctcttcctgcctgtgtgt

SEQ ID NO: 187312 - DNA, 20 bp, Artificial
  CRISPR gRNA sequence
ttcctgcctgtgtgtatagc

SEQ ID NO: 187313 - DNA, 20 bp, Artificial
  CRISPR gRNA sequence
cctgcctgtgtgtatagcat

SEQ ID NO: 187314 - DNA, 20 bp, Artificial
  CRISPR gRNA sequence
ctgcctgtgtgtatagcatg

SEQ ID NO: 187315 - DNA, 20 bp, Artificial
  CRISPR gRNA sequence
cctgtgtgtatagcatggga

SEQ ID NO: 187316 - DNA, 20 bp, Artificial
  CRISPR gRNA sequence
tgtgtatagcatgggacata

SEQ ID NO: 187317 - DNA, 20 bp, Artificial
  CRISPR gRNA sequence
tctagggaacagaaagcttt

SEQ ID NO: 187318 - DNA, 20 bp, Artificial
  CRISPR gRNA sequence
tagggaacagaaagctttca

SEQ ID NO: 187319 - DNA, 20 bp, Artificial
  CRISPR gRNA sequence
gggaacagaaagctttcagg

SEQ ID NO: 187320 - DNA, 20 bp, Artificial
  CRISPR gRNA sequence
tcaggaaaatggaaattcac

SEQ ID NO: 187321 - DNA, 20 bp, Artificial
  CRISPR gRNA sequence
caggaaaatggaaattcaca

SEQ ID NO: 187322 - DNA, 20 bp, Artificial
  CRISPR gRNA sequence
aggaaaatggaaattcacat

SEQ ID NO: 187323 - DNA, 20 bp, Artificial
  CRISPR gRNA sequence
acatgtgcattaatgacttt

SEQ ID NO: 187324 - DNA, 20 bp, Artificial
  CRISPR gRNA sequence
atgactttataattaaaatg

SEQ ID NO: 187325 - DNA, 20 bp, Artificial
  CRISPR gRNA sequence
tataattaaaatgaaggtca

SEQ ID NO: 187326 - DNA, 20 bp, Artificial
  CRISPR gRNA sequence
ataattaaaatgaaggtcag

SEQ ID NO: 187327 - DNA, 20 bp, Artificial
  CRISPR gRNA sequence
taattaaaatgaaggtcagg

SEQ ID NO: 187328 - DNA, 20 bp, Artificial
  CRISPR gRNA sequence
aaatgaaggtcaggcctttc

SEQ ID NO: 187329 - DNA, 20 bp, Artificial
  CRISPR gRNA sequence
tcctctttaacactcatctt

SEQ ID NO: 187330 - DNA, 20 bp, Artificial
  CRISPR gRNA sequence
cctctttaacactcatcttc

SEQ ID NO: 187331 - DNA, 20 bp, Artificial
  CRISPR gRNA sequence
ctctttaacactcatcttcc

SEQ ID NO: 187332 - DNA, 20 bp, Artificial
  CRISPR gRNA sequence
tttaacactcatcttccctg

SEQ ID NO: 187333 - DNA, 20 bp, Artificial
  CRISPR gRNA sequence
taacactcatcttccctgca

SEQ ID NO: 187334 - DNA, 20 bp, Artificial
  CRISPR gRNA sequence
aacactcatcttccctgcac

SEQ ID NO: 187335 - DNA, 20 bp, Artificial
  CRISPR gRNA sequence
acactcatcttccctgcact

SEQ ID NO: 187336 - DNA, 20 bp, Artificial
  CRISPR gRNA sequence
atcttccctgcactgagatt

SEQ ID NO: 187337 - DNA, 20 bp, Artificial
  CRISPR gRNA sequence
ccctgcactgagatttgcag

SEQ ID NO: 187338 - DNA, 20 bp, Artificial
  CRISPR gRNA sequence
cctgcactgagatttgcaga

SEQ ID NO: 187339 - DNA, 20 bp, Artificial
  CRISPR gRNA sequence
cactgagatttgcagacctc

SEQ ID NO: 187340 - DNA, 20 bp, Artificial
  CRISPR gRNA sequence
agatttgcagacctctggag

SEQ ID NO: 187341 - DNA, 20 bp, Artificial
  CRISPR gRNA sequence
gcagacctctggagaaccct

SEQ ID NO: 187342 - DNA, 20 bp, Artificial
  CRISPR gRNA sequence
cagacctctggagaacccta

SEQ ID NO: 187343 - DNA, 20 bp, Artificial
  CRISPR gRNA sequence
tggagaaccctaaccttgtt

SEQ ID NO: 187344 - DNA, 20 bp, Artificial
  CRISPR gRNA sequence
gagaaccctaaccttgtttc

SEQ ID NO: 187345 - DNA, 20 bp, Artificial
  CRISPR gRNA sequence
accttgtttcctgcagcctc

SEQ ID NO: 187346 - DNA, 20 bp, Artificial
  CRISPR gRNA sequence
gtttcctgcagcctccttag

SEQ ID NO: 187347 - DNA, 20 bp, Artificial
  CRISPR gRNA sequence
tttcctgcagcctccttaga

SEQ ID NO: 187348 - DNA, 20 bp, Artificial
  CRISPR gRNA sequence
cctgcagcctccttagaacc

SEQ ID NO: 187349 - DNA, 20 bp, Artificial
  CRISPR gRNA sequence
ctgcagcctccttagaaccc

SEQ ID NO: 187350 - DNA, 20 bp, Artificial
  CRISPR gRNA sequence
cagcctccttagaaccccat

SEQ ID NO: 187351 - DNA, 20 bp, Artificial
  CRISPR gRNA sequence
cttagaaccccatgttgaca

SEQ ID NO: 187352 - DNA, 20 bp, Artificial
  CRISPR gRNA sequence
agaaccccatgttgacaccc

SEQ ID NO: 187353 - DNA, 20 bp, Artificial
  CRISPR gRNA sequence
gaaccccatgttgacacccc

SEQ ID NO: 187354 - DNA, 20 bp, Artificial
  CRISPR gRNA sequence
acacccctgaccctggcatc

SEQ ID NO: 187355 - DNA, 20 bp, Artificial
  CRISPR gRNA sequence
accctggcatcctggctcat

SEQ ID NO: 187356 - DNA, 20 bp, Artificial
  CRISPR gRNA sequence
gcatcctggctcattgttag

SEQ ID NO: 187357 - DNA, 20 bp, Artificial
  CRISPR gRNA sequence
gctcattgttagttcgtctc

SEQ ID NO: 187358 - DNA, 20 bp, Artificial
  CRISPR gRNA sequence
attgttagttcgtctcatca

SEQ ID NO: 187359 - DNA, 20 bp, Artificial
  CRISPR gRNA sequence
ttagttcgtctcatcacttg

SEQ ID NO: 187360 - DNA, 20 bp, Artificial
  CRISPR gRNA sequence
gttcgtctcatcacttggaa

SEQ ID NO: 187361 - DNA, 20 bp, Artificial
  CRISPR gRNA sequence
gtctcatcacttggaacctg

SEQ ID NO: 187362 - DNA, 20 bp, Artificial
  CRISPR gRNA sequence
atcacttggaacctgtctga

SEQ ID NO: 187363 - DNA, 20 bp, Artificial
  CRISPR gRNA sequence
ggaacctgtctgattcacct

SEQ ID NO: 187364 - DNA, 20 bp, Artificial
  CRISPR gRNA sequence
gaacctgtctgattcacctc

SEQ ID NO: 187365 - DNA, 20 bp, Artificial
  CRISPR gRNA sequence
tctgattcacctcactctct

SEQ ID NO: 187366 - DNA, 20 bp, Artificial
  CRISPR gRNA sequence
attcacctcactctcttctc

SEQ ID NO: 187367 - DNA, 20 bp, Artificial
  CRISPR gRNA sequence
acctcactctcttctcccca

SEQ ID NO: 187368 - DNA, 20 bp, Artificial
  CRISPR gRNA sequence
actctcttctccccaaccct

SEQ ID NO: 187369 - DNA, 20 bp, Artificial
  CRISPR gRNA sequence
tcttctccccaaccctgcag

SEQ ID NO: 187370 - DNA, 20 bp, Artificial
  CRISPR gRNA sequence
ttctccccaaccctgcaggt

SEQ ID NO: 187371 - DNA, 20 bp, Artificial
  CRISPR gRNA sequence
ctccccaaccctgcaggtaa

SEQ ID NO: 187372 - DNA, 20 bp, Artificial
  CRISPR gRNA sequence
tccccaaccctgcaggtaac

SEQ ID NO: 187373 - DNA, 20 bp, Artificial
  CRISPR gRNA sequence
cccaaccctgcaggtaacat

SEQ ID NO: 187374 - DNA, 20 bp, Artificial
  CRISPR gRNA sequence
caggtaacatcatgtctcgg

SEQ ID NO: 187375 - DNA, 20 bp, Artificial
  CRISPR gRNA sequence
gggtaacagaggacacgtcc

SEQ ID NO: 187376 - DNA, 20 bp, Artificial
  CRISPR gRNA sequence
agtgattctctgagtgagaa

SEQ ID NO: 187377 - DNA, 20 bp, Artificial
  CRISPR gRNA sequence
tctgagtgagaatctgagct

SEQ ID NO: 187378 - DNA, 20 bp, Artificial
  CRISPR gRNA sequence
tgagtgagaatctgagctta

SEQ ID NO: 187379 - DNA, 20 bp, Artificial
  CRISPR gRNA sequence
agtgagaatctgagcttatt

SEQ ID NO: 187380 - DNA, 20 bp, Artificial
  CRISPR gRNA sequence
agcttatttctgtggtacct

SEQ ID NO: 187381 - DNA, 20 bp, Artificial
  CRISPR gRNA sequence
atttctgtggtacctggtgc

SEQ ID NO: 187382 - DNA, 20 bp, Artificial
  CRISPR gRNA sequence
tttctgtggtacctggtgcg

SEQ ID NO: 187383 - DNA, 20 bp, Artificial
  CRISPR gRNA sequence
ctgtggtacctggtgcgagg

SEQ ID NO: 187384 - DNA, 20 bp, Artificial
  CRISPR gRNA sequence
tgtggtacctggtgcgaggc

SEQ ID NO: 187385 - DNA, 20 bp, Artificial
  CRISPR gRNA sequence
tggtacctggtgcgaggcct

SEQ ID NO: 187386 - DNA, 20 bp, Artificial
  CRISPR gRNA sequence
gtgcgaggcctatgtctctt

SEQ ID NO: 187387 - DNA, 20 bp, Artificial
  CRISPR gRNA sequence
tgtctcttggggatcatgct

SEQ ID NO: 187388 - DNA, 20 bp, Artificial
  CRISPR gRNA sequence
ttggggatcatgctctgggg

SEQ ID NO: 187389 - DNA, 20 bp, Artificial
  CRISPR gRNA sequence
ggggatcatgctctggggat

SEQ ID NO: 187390 - DNA, 20 bp, Artificial
  CRISPR gRNA sequence
gggatcatgctctggggatc

SEQ ID NO: 187391 - DNA, 20 bp, Artificial
  CRISPR gRNA sequence
tggggatcagtgtccctcac

SEQ ID NO: 187392 - DNA, 20 bp, Artificial
  CRISPR gRNA sequence
gggatcagtgtccctcacca

SEQ ID NO: 187393 - DNA, 20 bp, Artificial
  CRISPR gRNA sequence
accatggtcaccctgatcac

SEQ ID NO: 187394 - DNA, 20 bp, Artificial
  CRISPR gRNA sequence
atcaccctgcctctgctttt

SEQ ID NO: 187395 - DNA, 20 bp, Artificial
  CRISPR gRNA sequence
cctctgcttttccttctgcc

SEQ ID NO: 187396 - DNA, 20 bp, Artificial
  CRISPR gRNA sequence
tgcttttccttctgcccaag

SEQ ID NO: 187397 - DNA, 20 bp, Artificial
  CRISPR gRNA sequence
cttttccttctgcccaagaa

SEQ ID NO: 187398 - DNA, 20 bp, Artificial
  CRISPR gRNA sequence
ttccttctgcccaagaaggt

SEQ ID NO: 187399 - DNA, 20 bp, Artificial
  CRISPR gRNA sequence
tccttctgcccaagaaggtg

SEQ ID NO: 187400 - DNA, 20 bp, Artificial
  CRISPR gRNA sequence
ccttctgcccaagaaggtgg

SEQ ID NO: 187401 - DNA, 20 bp, Artificial
  CRISPR gRNA sequence
cttctgcccaagaaggtggg

SEQ ID NO: 187402 - DNA, 20 bp, Artificial
  CRISPR gRNA sequence
ctgcccaagaaggtgggaaa

SEQ ID NO: 187403 - DNA, 20 bp, Artificial
  CRISPR gRNA sequence
tgcccaagaaggtgggaaaa

SEQ ID NO: 187404 - DNA, 20 bp, Artificial
  CRISPR gRNA sequence
cccaagaaggtgggaaaatg

SEQ ID NO: 187405 - DNA, 20 bp, Artificial
  CRISPR gRNA sequence
atggagttggcccgctctac

SEQ ID NO: 187406 - DNA, 20 bp, Artificial
  CRISPR gRNA sequence
gcccgctctacacagaccct

SEQ ID NO: 187407 - DNA, 20 bp, Artificial
  CRISPR gRNA sequence
tacacagaccctcatctccc

SEQ ID NO: 187408 - DNA, 20 bp, Artificial
  CRISPR gRNA sequence
cacagaccctcatctcccag

SEQ ID NO: 187409 - DNA, 20 bp, Artificial
  CRISPR gRNA sequence
atctcccagacttggcagac

SEQ ID NO: 187410 - DNA, 20 bp, Artificial
  CRISPR gRNA sequence
ccagacttggcagactcagt

SEQ ID NO: 187411 - DNA, 20 bp, Artificial
  CRISPR gRNA sequence
ggcagactcagttcctctca

SEQ ID NO: 187412 - DNA, 20 bp, Artificial
  CRISPR gRNA sequence
gcagactcagttcctctcac

SEQ ID NO: 187413 - DNA, 20 bp, Artificial
  CRISPR gRNA sequence
agttcctctcacattgcttt

SEQ ID NO: 187414 - DNA, 20 bp, Artificial
  CRISPR gRNA sequence
ctctcacattgctttcagtc

SEQ ID NO: 187415 - DNA, 20 bp, Artificial
  CRISPR gRNA sequence
tcacattgctttcagtccag

SEQ ID NO: 187416 - DNA, 20 bp, Artificial
  CRISPR gRNA sequence
acattgctttcagtccagct

SEQ ID NO: 187417 - DNA, 20 bp, Artificial
  CRISPR gRNA sequence
ctttcagtccagctttcctg

SEQ ID NO: 187418 - DNA, 20 bp, Artificial
  CRISPR gRNA sequence
tcagtccagctttcctggca

SEQ ID NO: 187419 - DNA, 20 bp, Artificial
  CRISPR gRNA sequence
cagtccagctttcctggcac

SEQ ID NO: 187420 - DNA, 20 bp, Artificial
  CRISPR gRNA sequence
agtccagctttcctggcacc

SEQ ID NO: 187421 - DNA, 20 bp, Artificial
  CRISPR gRNA sequence
tcctggcacccttactgatt

SEQ ID NO: 187422 - DNA, 20 bp, Artificial
  CRISPR gRNA sequence
cctggcacccttactgattc

SEQ ID NO: 187423 - DNA, 20 bp, Artificial
  CRISPR gRNA sequence
ctggcacccttactgattct

SEQ ID NO: 187424 - DNA, 20 bp, Artificial
  CRISPR gRNA sequence
gcacccttactgattctcca

SEQ ID NO: 187425 - DNA, 20 bp, Artificial
  CRISPR gRNA sequence
actgattctccatcttcatg

SEQ ID NO: 187426 - DNA, 20 bp, Artificial
  CRISPR gRNA sequence
ctgattctccatcttcatgg

SEQ ID NO: 187427 - DNA, 20 bp, Artificial
  CRISPR gRNA sequence
attctccatcttcatggaac

SEQ ID NO: 187428 - DNA, 20 bp, Artificial
  CRISPR gRNA sequence
tccatcttcatggaacaccc

SEQ ID NO: 187429 - DNA, 20 bp, Artificial
  CRISPR gRNA sequence
catcttcatggaacaccctg

SEQ ID NO: 187430 - DNA, 20 bp, Artificial
  CRISPR gRNA sequence
catggaacaccctgtccctg

SEQ ID NO: 187431 - DNA, 20 bp, Artificial
  CRISPR gRNA sequence
atggaacaccctgtccctgt

SEQ ID NO: 187432 - DNA, 20 bp, Artificial
  CRISPR gRNA sequence
tccctgtggtccatgttccc

SEQ ID NO: 187433 - DNA, 20 bp, Artificial
  CRISPR gRNA sequence
tggtccatgttcccaggttg

SEQ ID NO: 187434 - DNA, 20 bp, Artificial
  CRISPR gRNA sequence
ccaggttgctcaacattaac

SEQ ID NO: 187435 - DNA, 20 bp, Artificial
  CRISPR gRNA sequence
ctcaacattaacctccatac

SEQ ID NO: 187436 - DNA, 20 bp, Artificial
  CRISPR gRNA sequence
aacattaacctccatactct

SEQ ID NO: 187437 - DNA, 20 bp, Artificial
  CRISPR gRNA sequence
acctccatactctctgggtc

SEQ ID NO: 187438 - DNA, 20 bp, Artificial
  CRISPR gRNA sequence
catactctctgggtcttctt

SEQ ID NO: 187439 - DNA, 20 bp, Artificial
  CRISPR gRNA sequence
tctgggtcttcttttctagc

SEQ ID NO: 187440 - DNA, 20 bp, Artificial
  CRISPR gRNA sequence
tgggtcttcttttctagctt

SEQ ID NO: 187441 - DNA, 20 bp, Artificial
  CRISPR gRNA sequence
ggtcttcttttctagcttct

SEQ ID NO: 187442 - DNA, 20 bp, Artificial
  CRISPR gRNA sequence
cttttctagcttctccccac

SEQ ID NO: 187443 - DNA, 20 bp, Artificial
  CRISPR gRNA sequence
ttttctagcttctccccaca

SEQ ID NO: 187444 - DNA, 20 bp, Artificial
  CRISPR gRNA sequence
ttctagcttctccccacaat

SEQ ID NO: 187445 - DNA, 20 bp, Artificial
  CRISPR gRNA sequence
tctagcttctccccacaatc

SEQ ID NO: 187446 - DNA, 20 bp, Artificial
  CRISPR gRNA sequence
ctagcttctccccacaatct

SEQ ID NO: 187447 - DNA, 20 bp, Artificial
  CRISPR gRNA sequence
tagcttctccccacaatctg

SEQ ID NO: 187448 - DNA, 20 bp, Artificial
  CRISPR gRNA sequence
gcttctccccacaatctgtc

SEQ ID NO: 187449 - DNA, 20 bp, Artificial
  CRISPR gRNA sequence
ctccccacaatctgtcttta

SEQ ID NO: 187450 - DNA, 20 bp, Artificial
  CRISPR gRNA sequence
tccccacaatctgtctttaa

SEQ ID NO: 187451 - DNA, 20 bp, Artificial
  CRISPR gRNA sequence
cccacaatctgtctttaaga

SEQ ID NO: 187452 - DNA, 20 bp, Artificial
  CRISPR gRNA sequence
tctttaagaatttgatcccc

SEQ ID NO: 187453 - DNA, 20 bp, Artificial
  CRISPR gRNA sequence
taagaatttgatccccaacc

SEQ ID NO: 187454 - DNA, 20 bp, Artificial
  CRISPR gRNA sequence
aagaatttgatccccaaccc

SEQ ID NO: 187455 - DNA, 20 bp, Artificial
  CRISPR gRNA sequence
agaatttgatccccaacccg

SEQ ID NO: 187456 - DNA, 20 bp, Artificial
  CRISPR gRNA sequence
gatccccaacccgttctgag

SEQ ID NO: 187457 - DNA, 20 bp, Artificial
  CRISPR gRNA sequence
atccccaacccgttctgagt

SEQ ID NO: 187458 - DNA, 20 bp, Artificial
  CRISPR gRNA sequence
tgagtcattttcctcttcct

SEQ ID NO: 187459 - DNA, 20 bp, Artificial
  CRISPR gRNA sequence
agtcattttcctcttcctcg

SEQ ID NO: 187460 - DNA, 20 bp, Artificial
  CRISPR gRNA sequence
tcctcttcctcgtatttctt

SEQ ID NO: 187461 - DNA, 20 bp, Artificial
  CRISPR gRNA sequence
cctcttcctcgtatttcttt

SEQ ID NO: 187462 - DNA, 20 bp, Artificial
  CRISPR gRNA sequence
ctcttcctcgtatttcttta

SEQ ID NO: 187463 - DNA, 20 bp, Artificial
  CRISPR gRNA sequence
ttcctcgtatttctttagca

SEQ ID NO: 187464 - DNA, 20 bp, Artificial
  CRISPR gRNA sequence
cctcgtatttctttagcatc

SEQ ID NO: 187465 - DNA, 20 bp, Artificial
  CRISPR gRNA sequence
ctcgtatttctttagcatcc

SEQ ID NO: 187466 - DNA, 20 bp, Artificial
  CRISPR gRNA sequence
gtatttctttagcatccaag

SEQ ID NO: 187467 - DNA, 20 bp, Artificial
  CRISPR gRNA sequence
ctttagcatccaaggggcat

SEQ ID NO: 187468 - DNA, 20 bp, Artificial
  CRISPR gRNA sequence
tttagcatccaaggggcata

SEQ ID NO: 187469 - DNA, 20 bp, Artificial
  CRISPR gRNA sequence
tagcatccaaggggcatagc

SEQ ID NO: 187470 - DNA, 20 bp, Artificial
  CRISPR gRNA sequence
agcatccaaggggcatagct

SEQ ID NO: 187471 - DNA, 20 bp, Artificial
  CRISPR gRNA sequence
gcatccaaggggcatagctg

SEQ ID NO: 187472 - DNA, 20 bp, Artificial
  CRISPR gRNA sequence
tgtctctttctcttttctcc

SEQ ID NO: 187473 - DNA, 20 bp, Artificial
  CRISPR gRNA sequence
tttctcttttctccttttcc

SEQ ID NO: 187474 - DNA, 20 bp, Artificial
  CRISPR gRNA sequence
tctcttttctccttttcctc

SEQ ID NO: 187475 - DNA, 20 bp, Artificial
  CRISPR gRNA sequence
ctcttttctccttttcctct

SEQ ID NO: 187476 - DNA, 20 bp, Artificial
  CRISPR gRNA sequence
tcttttctccttttcctctg

SEQ ID NO: 187477 - DNA, 20 bp, Artificial
  CRISPR gRNA sequence
ttttctccttttcctctgtc

SEQ ID NO: 187478 - DNA, 20 bp, Artificial
  CRISPR gRNA sequence
ttctccttttcctctgtctc

SEQ ID NO: 187479 - DNA, 20 bp, Artificial
  CRISPR gRNA sequence
tctccttttcctctgtctct

SEQ ID NO: 187480 - DNA, 20 bp, Artificial
  CRISPR gRNA sequence
ctccttttcctctgtctctt

SEQ ID NO: 187481 - DNA, 20 bp, Artificial
  CRISPR gRNA sequence
tccttttcctctgtctcttc

SEQ ID NO: 187482 - DNA, 20 bp, Artificial
  CRISPR gRNA sequence
cttttcctctgtctcttctc

SEQ ID NO: 187483 - DNA, 20 bp, Artificial
  CRISPR gRNA sequence
ttcctctgtctcttctcacc

SEQ ID NO: 187484 - DNA, 20 bp, Artificial
  CRISPR gRNA sequence
tcctctgtctcttctcacct

SEQ ID NO: 187485 - DNA, 20 bp, Artificial
  CRISPR gRNA sequence
cctctgtctcttctcacctt

SEQ ID NO: 187486 - DNA, 20 bp, Artificial
  CRISPR gRNA sequence
ctctgtctcttctcaccttt

SEQ ID NO: 187487 - DNA, 20 bp, Artificial
  CRISPR gRNA sequence
tgtctcttctcacctttaat

SEQ ID NO: 187488 - DNA, 20 bp, Artificial
  CRISPR gRNA sequence
tctcttctcacctttaattt

SEQ ID NO: 187489 - DNA, 20 bp, Artificial
  CRISPR gRNA sequence
ttctcacctttaatttccaa

SEQ ID NO: 187490 - DNA, 20 bp, Artificial
  CRISPR gRNA sequence
ctcacctttaatttccaaat

SEQ ID NO: 187491 - DNA, 20 bp, Artificial
  CRISPR gRNA sequence
tcacctttaatttccaaata

SEQ ID NO: 187492 - DNA, 20 bp, Artificial
  CRISPR gRNA sequence
acctttaatttccaaatagg

SEQ ID NO: 187493 - DNA, 20 bp, Artificial
  CRISPR gRNA sequence
taatttccaaataggtaact

SEQ ID NO: 187494 - DNA, 20 bp, Artificial
  CRISPR gRNA sequence
aatttccaaataggtaactc

SEQ ID NO: 187495 - DNA, 20 bp, Artificial
  CRISPR gRNA sequence
atttccaaataggtaactca

SEQ ID NO: 187496 - DNA, 20 bp, Artificial
  CRISPR gRNA sequence
ccaaataggtaactcaggta

SEQ ID NO: 187497 - DNA, 20 bp, Artificial
  CRISPR gRNA sequence
caaataggtaactcaggtat

SEQ ID NO: 187498 - DNA, 20 bp, Artificial
  CRISPR gRNA sequence
aggtattagtgtccctgatg

SEQ ID NO: 187499 - DNA, 20 bp, Artificial
  CRISPR gRNA sequence
gtgtccctgatggtttgcca

SEQ ID NO: 187500 - DNA, 20 bp, Artificial
  CRISPR gRNA sequence
atggtttgccaacccgtgtg

SEQ ID NO: 187501 - DNA, 20 bp, Artificial
  CRISPR gRNA sequence
gccaacccgtgtgacatctc

SEQ ID NO: 187502 - DNA, 20 bp, Artificial
  CRISPR gRNA sequence
ccaacccgtgtgacatctct

SEQ ID NO: 187503 - DNA, 20 bp, Artificial
  CRISPR gRNA sequence
ttgtccatgtatccacagtt

SEQ ID NO: 187504 - DNA, 20 bp, Artificial
  CRISPR gRNA sequence
gtccatgtatccacagttgc

SEQ ID NO: 187505 - DNA, 20 bp, Artificial
  CRISPR gRNA sequence
tccatgtatccacagttgct

SEQ ID NO: 187506 - DNA, 20 bp, Artificial
  CRISPR gRNA sequence
ctggaagtgcaggtgcggga

SEQ ID NO: 187507 - DNA, 20 bp, Artificial
  CRISPR gRNA sequence
gaagtgcaggtgcgggaatc

SEQ ID NO: 187508 - DNA, 20 bp, Artificial
  CRISPR gRNA sequence
tggcaaagtccagccaggtg

SEQ ID NO: 187509 - DNA, 20 bp, Artificial
  CRISPR gRNA sequence
gcaaagtccagccaggtggc

SEQ ID NO: 187510 - DNA, 20 bp, Artificial
  CRISPR gRNA sequence
aggctctgtcggccatgcct

SEQ ID NO: 187511 - DNA, 20 bp, Artificial
  CRISPR gRNA sequence
tgtcggccatgcctacagtt

SEQ ID NO: 187512 - DNA, 20 bp, Artificial
  CRISPR gRNA sequence
tcggccatgcctacagttcg

SEQ ID NO: 187513 - DNA, 20 bp, Artificial
  CRISPR gRNA sequence
cagttcgaagctttgccaac

SEQ ID NO: 187514 - DNA, 20 bp, Artificial
  CRISPR gRNA sequence
gaagctttgccaacgaggag

SEQ ID NO: 187515 - DNA, 20 bp, Artificial
  CRISPR gRNA sequence
tgccaacgaggagggcgaag

SEQ ID NO: 187516 - DNA, 20 bp, Artificial
  CRISPR gRNA sequence
gccaacgaggagggcgaagc

SEQ ID NO: 187517 - DNA, 20 bp, Artificial
  CRISPR gRNA sequence
ccaacgaggagggcgaagcc

SEQ ID NO: 187518 - DNA, 20 bp, Artificial
  CRISPR gRNA sequence
agggaaaagctgcaagaaat

SEQ ID NO: 187519 - DNA, 20 bp, Artificial
  CRISPR gRNA sequence
gggaaaagctgcaagaaata

SEQ ID NO: 187520 - DNA, 20 bp, Artificial
  CRISPR gRNA sequence
caagaaataaagacactcaa

SEQ ID NO: 187521 - DNA, 20 bp, Artificial
  CRISPR gRNA sequence
aaccagaaggaggctgtggc

SEQ ID NO: 187522 - DNA, 20 bp, Artificial
  CRISPR gRNA sequence
tggcctatgcagtcaactcc

SEQ ID NO: 187523 - DNA, 20 bp, Artificial
  CRISPR gRNA sequence
tgcagtcaactcctggacca

SEQ ID NO: 187524 - DNA, 20 bp, Artificial
  CRISPR gRNA sequence
ctggaccactagtgtgagca

SEQ ID NO: 187525 - DNA, 20 bp, Artificial
  CRISPR gRNA sequence
gaccactagtgtgagcacct

SEQ ID NO: 187526 - DNA, 20 bp, Artificial
  CRISPR gRNA sequence
gtgtgagcacctgaagatga

SEQ ID NO: 187527 - DNA, 20 bp, Artificial
  CRISPR gRNA sequence
aagatgaatacccattccct

SEQ ID NO: 187528 - DNA, 20 bp, Artificial
  CRISPR gRNA sequence
ccttgtccttaagatgccgt

SEQ ID NO: 187529 - DNA, 20 bp, Artificial
  CRISPR gRNA sequence
gtccttaagatgccgtgact

SEQ ID NO: 187530 - DNA, 20 bp, Artificial
  CRISPR gRNA sequence
tccttaagatgccgtgactc

SEQ ID NO: 187531 - DNA, 20 bp, Artificial
  CRISPR gRNA sequence
aagatgccgtgactccattc

SEQ ID NO: 187532 - DNA, 20 bp, Artificial
  CRISPR gRNA sequence
agatgccgtgactccattcc

SEQ ID NO: 187533 - DNA, 20 bp, Artificial
  CRISPR gRNA sequence
cattcccattcctatgaccc

SEQ ID NO: 187534 - DNA, 20 bp, Artificial
  CRISPR gRNA sequence
ccattcctatgaccctgctc

SEQ ID NO: 187535 - DNA, 20 bp, Artificial
  CRISPR gRNA sequence
ctatgaccctgctcccactc

SEQ ID NO: 187536 - DNA, 20 bp, Artificial
  CRISPR gRNA sequence
tgaccctgctcccactcctt

SEQ ID NO: 187537 - DNA, 20 bp, Artificial
  CRISPR gRNA sequence
ctcccactccttctttactg

SEQ ID NO: 187538 - DNA, 20 bp, Artificial
  CRISPR gRNA sequence
ccactccttctttactggga

SEQ ID NO: 187539 - DNA, 20 bp, Artificial
  CRISPR gRNA sequence
cttctttactgggaaatggt

SEQ ID NO: 187540 - DNA, 20 bp, Artificial
  CRISPR gRNA sequence
ctttactgggaaatggttgg

SEQ ID NO: 187541 - DNA, 20 bp, Artificial
  CRISPR gRNA sequence
tttactgggaaatggttggt

SEQ ID NO: 187542 - DNA, 20 bp, Artificial
  CRISPR gRNA sequence
tactgggaaatggttggttc

SEQ ID NO: 187543 - DNA, 20 bp, Artificial
  CRISPR gRNA sequence
actgggaaatggttggttca

SEQ ID NO: 187544 - DNA, 20 bp, Artificial
  CRISPR gRNA sequence
ctgggaaatggttggttcag

SEQ ID NO: 187545 - DNA, 20 bp, Artificial
  CRISPR gRNA sequence
ggaaatggttggttcagtat

SEQ ID NO: 187546 - DNA, 20 bp, Artificial
  CRISPR gRNA sequence
gttcagtattttcgtcctag

SEQ ID NO: 187547 - DNA, 20 bp, Artificial
  CRISPR gRNA sequence
agtattttcgtcctagcaac

SEQ ID NO: 187548 - DNA, 20 bp, Artificial
  CRISPR gRNA sequence
tcgtcctagcaacctgaggc

SEQ ID NO: 187549 - DNA, 20 bp, Artificial
  CRISPR gRNA sequence
cgtcctagcaacctgaggct

SEQ ID NO: 187550 - DNA, 20 bp, Artificial
  CRISPR gRNA sequence
gtcctagcaacctgaggctc

SEQ ID NO: 187551 - DNA, 20 bp, Artificial
  CRISPR gRNA sequence
gcaacctgaggctcaatgac

SEQ ID NO: 187552 - DNA, 20 bp, Artificial
  CRISPR gRNA sequence
aggctcaatgactctactca

SEQ ID NO: 187553 - DNA, 20 bp, Artificial
  CRISPR gRNA sequence
aatgactctactcagtgtcc

SEQ ID NO: 187554 - DNA, 20 bp, Artificial
  CRISPR gRNA sequence
tactcagtgtccctagcccc

SEQ ID NO: 187555 - DNA, 20 bp, Artificial
  CRISPR gRNA sequence
ctcagtgtccctagccccct

SEQ ID NO: 187556 - DNA, 20 bp, Artificial
  CRISPR gRNA sequence
agtgtccctagccccctccc

SEQ ID NO: 187557 - DNA, 20 bp, Artificial
  CRISPR gRNA sequence
gccccctccctctctttaaa

SEQ ID NO: 187558 - DNA, 20 bp, Artificial
  CRISPR gRNA sequence
cctctctttaaagatgctag

SEQ ID NO: 187559 - DNA, 20 bp, Artificial
  CRISPR gRNA sequence
tctttaaagatgctaggtgg

SEQ ID NO: 187560 - DNA, 20 bp, Artificial
  CRISPR gRNA sequence
tttaaagatgctaggtggct

SEQ ID NO: 187561 - DNA, 20 bp, Artificial
  CRISPR gRNA sequence
taaagatgctaggtggcttc

SEQ ID NO: 187562 - DNA, 20 bp, Artificial
  CRISPR gRNA sequence
aaagatgctaggtggcttcc

SEQ ID NO: 187563 - DNA, 20 bp, Artificial
  CRISPR gRNA sequence
aagatgctaggtggcttcct

SEQ ID NO: 187564 - DNA, 20 bp, Artificial
  CRISPR gRNA sequence
ggtggcttcctttcagtatg

SEQ ID NO: 187565 - DNA, 20 bp, Artificial
  CRISPR gRNA sequence
cctttcagtatggtacataa

SEQ ID NO: 187566 - DNA, 20 bp, Artificial
  CRISPR gRNA sequence
ctttcagtatggtacataaa

SEQ ID NO: 187567 - DNA, 20 bp, Artificial
  CRISPR gRNA sequence
tcagtatggtacataaaatc

SEQ ID NO: 187568 - DNA, 20 bp, Artificial
  CRISPR gRNA sequence
cagtatggtacataaaatcc

SEQ ID NO: 187569 - DNA, 20 bp, Artificial
  CRISPR gRNA sequence
agtatggtacataaaatcca

SEQ ID NO: 187570 - DNA, 20 bp, Artificial
  CRISPR gRNA sequence
gagagatgcgtgtcttccag

SEQ ID NO: 187571 - DNA, 20 bp, Artificial
  CRISPR gRNA sequence
ccagtcctagggccttcctt

SEQ ID NO: 187572 - DNA, 20 bp, Artificial
  CRISPR gRNA sequence
cagtcctagggccttccttt

SEQ ID NO: 187573 - DNA, 20 bp, Artificial
  CRISPR gRNA sequence
gggccttcctttgcctctca

SEQ ID NO: 187574 - DNA, 20 bp, Artificial
  CRISPR gRNA sequence
cctttgcctctcaggggaag

SEQ ID NO: 187575 - DNA, 20 bp, Artificial
  CRISPR gRNA sequence
ctttgcctctcaggggaagt

SEQ ID NO: 187576 - DNA, 20 bp, Artificial
  CRISPR gRNA sequence
tgcctctcaggggaagtgca

SEQ ID NO: 187577 - DNA, 20 bp, Artificial
  CRISPR gRNA sequence
gcctctcaggggaagtgcag

SEQ ID NO: 187578 - DNA, 20 bp, Artificial
  CRISPR gRNA sequence
cctctcaggggaagtgcagg

SEQ ID NO: 187579 - DNA, 20 bp, Artificial
  CRISPR gRNA sequence
tcaggggaagtgcagggcgc

SEQ ID NO: 187580 - DNA, 20 bp, Artificial
  CRISPR gRNA sequence
aggggaagtgcagggcgcca

SEQ ID NO: 187581 - DNA, 20 bp, Artificial
  CRISPR gRNA sequence
ttgcacctgggactgcttca

SEQ ID NO: 187582 - DNA, 20 bp, Artificial
  CRISPR gRNA sequence
gcacctgggactgcttcatg

SEQ ID NO: 187583 - DNA, 20 bp, Artificial
  CRISPR gRNA sequence
cacctgggactgcttcatgc

SEQ ID NO: 187584 - DNA, 20 bp, Artificial
  CRISPR gRNA sequence
ggactgcttcatgctggtac

SEQ ID NO: 187585 - DNA, 20 bp, Artificial
  CRISPR gRNA sequence
cttcatgctggtaccttgta

SEQ ID NO: 187586 - DNA, 20 bp, Artificial
  CRISPR gRNA sequence
catgctggtaccttgtagat

SEQ ID NO: 187587 - DNA, 20 bp, Artificial
  CRISPR gRNA sequence
atgctggtaccttgtagatt

SEQ ID NO: 187588 - DNA, 20 bp, Artificial
  CRISPR gRNA sequence
gtaccttgtagatttgttag

SEQ ID NO: 187589 - DNA, 20 bp, Artificial
  CRISPR gRNA sequence
gtagatttgttagtgagagt

SEQ ID NO: 187590 - DNA, 20 bp, Artificial
  CRISPR gRNA sequence
tagatttgttagtgagagtg

SEQ ID NO: 187591 - DNA, 20 bp, Artificial
  CRISPR gRNA sequence
gttagtgagagtgatgggaa

SEQ ID NO: 187592 - DNA, 20 bp, Artificial
  CRISPR gRNA sequence
ttagtgagagtgatgggaat

SEQ ID NO: 187593 - DNA, 20 bp, Artificial
  CRISPR gRNA sequence
gtgagagtgatgggaatagt

SEQ ID NO: 187594 - DNA, 20 bp, Artificial
  CRISPR gRNA sequence
tgatgcactggaaagagagc

SEQ ID NO: 187595 - DNA, 20 bp, Artificial
  CRISPR gRNA sequence
gaaagagagctacgccagtg

SEQ ID NO: 187596 - DNA, 20 bp, Artificial
  CRISPR gRNA sequence
cgccagtgatccgaagatcc

SEQ ID NO: 187597 - DNA, 20 bp, Artificial
  CRISPR gRNA sequence
gcttgatgatgcaatttact

SEQ ID NO: 187598 - DNA, 20 bp, Artificial
  CRISPR gRNA sequence
gatgatgcaatttacttgtc

SEQ ID NO: 187599 - DNA, 20 bp, Artificial
  CRISPR gRNA sequence
atgatgcaatttacttgtct

SEQ ID NO: 187600 - DNA, 20 bp, Artificial
  CRISPR gRNA sequence
acttgtcttgtgatcatgac

SEQ ID NO: 187601 - DNA, 20 bp, Artificial
  CRISPR gRNA sequence
cttgtcttgtgatcatgaca

SEQ ID NO: 187602 - DNA, 20 bp, Artificial
  CRISPR gRNA sequence
gtcttgtgatcatgacaaca

SEQ ID NO: 187603 - DNA, 20 bp, Artificial
  CRISPR gRNA sequence
tcttgtgatcatgacaacaa

SEQ ID NO: 187604 - DNA, 20 bp, Artificial
  CRISPR gRNA sequence
gtgatcatgacaacaaattt

SEQ ID NO: 187605 - DNA, 20 bp, Artificial
  CRISPR gRNA sequence
tgatcatgacaacaaattta

SEQ ID NO: 187606 - DNA, 20 bp, Artificial
  CRISPR gRNA sequence
accttctctgagactgtttc

SEQ ID NO: 187607 - DNA, 20 bp, Artificial
  CRISPR gRNA sequence
ccttctctgagactgtttcc

SEQ ID NO: 187608 - DNA, 20 bp, Artificial
  CRISPR gRNA sequence
ctctgagactgtttcctctt

SEQ ID NO: 187609 - DNA, 20 bp, Artificial
  CRISPR gRNA sequence
tctgagactgtttcctcttt

SEQ ID NO: 187610 - DNA, 20 bp, Artificial
  CRISPR gRNA sequence
tgagactgtttcctctttat

SEQ ID NO: 187611 - DNA, 20 bp, Artificial
  CRISPR gRNA sequence
agactgtttcctctttattt

SEQ ID NO: 187612 - DNA, 20 bp, Artificial
  CRISPR gRNA sequence
tttcctctttatttatttat

SEQ ID NO: 187613 - DNA, 20 bp, Artificial
  CRISPR gRNA sequence
cctctttatttatttatttg

SEQ ID NO: 187614 - DNA, 20 bp, Artificial
  CRISPR gRNA sequence
ctctttatttatttatttgt

SEQ ID NO: 187615 - DNA, 20 bp, Artificial
  CRISPR gRNA sequence
tttatttatttatttgtttg

SEQ ID NO: 187616 - DNA, 20 bp, Artificial
  CRISPR gRNA sequence
tatttatttatttgtttgtt

SEQ ID NO: 187617 - DNA, 20 bp, Artificial
  CRISPR gRNA sequence
atttatttatttgtttgttt

SEQ ID NO: 187618 - DNA, 20 bp, Artificial
  CRISPR gRNA sequence
tttatttatttgtttgtttg

SEQ ID NO: 187619 - DNA, 20 bp, Artificial
  CRISPR gRNA sequence
atttatttgtttgtttgttt

SEQ ID NO: 187620 - DNA, 20 bp, Artificial
  CRISPR gRNA sequence
tttatttgtttgtttgtttg

SEQ ID NO: 187621 - DNA, 20 bp, Artificial
  CRISPR gRNA sequence
atttgtttgtttgtttgttt

SEQ ID NO: 187622 - DNA, 20 bp, Artificial
  CRISPR gRNA sequence
tttgtttgtttgtttgttta

SEQ ID NO: 187623 - DNA, 20 bp, Artificial
  CRISPR gRNA sequence
gtttgtttgtttgtttattt

SEQ ID NO: 187624 - DNA, 20 bp, Artificial
  CRISPR gRNA sequence
tttgtttgtttgtttatttt

SEQ ID NO: 187625 - DNA, 20 bp, Artificial
  CRISPR gRNA sequence
gtttgtttgtttatttttac

SEQ ID NO: 187626 - DNA, 20 bp, Artificial
  CRISPR gRNA sequence
tttgtttgtttatttttact

SEQ ID NO: 187627 - DNA, 20 bp, Artificial
  CRISPR gRNA sequence
gtttgtttatttttacttat

SEQ ID NO: 187628 - DNA, 20 bp, Artificial
  CRISPR gRNA sequence
tttgtttatttttacttatt

SEQ ID NO: 187629 - DNA, 20 bp, Artificial
  CRISPR gRNA sequence
gtttatttttacttattatt

SEQ ID NO: 187630 - DNA, 20 bp, Artificial
  CRISPR gRNA sequence
tttatttttacttattatta

SEQ ID NO: 187631 - DNA, 20 bp, Artificial
  CRISPR gRNA sequence
atttttacttattattatta

SEQ ID NO: 187632 - DNA, 20 bp, Artificial
  CRISPR gRNA sequence
tttttacttattattattat

SEQ ID NO: 187633 - DNA, 20 bp, Artificial
  CRISPR gRNA sequence
ttacttattattattatttt

SEQ ID NO: 187634 - DNA, 20 bp, Artificial
  CRISPR gRNA sequence
tacttattattattattttt

SEQ ID NO: 187635 - DNA, 20 bp, Artificial
  CRISPR gRNA sequence
acttattattattatttttg

SEQ ID NO: 187636 - DNA, 20 bp, Artificial
  CRISPR gRNA sequence
cttattattattatttttga

SEQ ID NO: 187637 - DNA, 20 bp, Artificial
  CRISPR gRNA sequence
attattattatttttgagct

SEQ ID NO: 187638 - DNA, 20 bp, Artificial
  CRISPR gRNA sequence
ttattattatttttgagctg

SEQ ID NO: 187639 - DNA, 20 bp, Artificial
  CRISPR gRNA sequence
ttattatttttgagctggag

SEQ ID NO: 187640 - DNA, 20 bp, Artificial
  CRISPR gRNA sequence
ttatttttgagctggagtct

SEQ ID NO: 187641 - DNA, 20 bp, Artificial
  CRISPR gRNA sequence
tttttgagctggagtctcgc

SEQ ID NO: 187642 - DNA, 20 bp, Artificial
  CRISPR gRNA sequence
ttgagctggagtctcgcttt

SEQ ID NO: 187643 - DNA, 20 bp, Artificial
  CRISPR gRNA sequence
tgagctggagtctcgctttg

SEQ ID NO: 187644 - DNA, 20 bp, Artificial
  CRISPR gRNA sequence
gagctggagtctcgctttgt

SEQ ID NO: 187645 - DNA, 20 bp, Artificial
  CRISPR gRNA sequence
agctggagtctcgctttgtc

SEQ ID NO: 187646 - DNA, 20 bp, Artificial
  CRISPR gRNA sequence
gagtctcgctttgtcgccca

SEQ ID NO: 187647 - DNA, 20 bp, Artificial
  CRISPR gRNA sequence
gctttgtcgcccaggctgga

SEQ ID NO: 187648 - DNA, 20 bp, Artificial
  CRISPR gRNA sequence
tgtcgcccaggctggagtgc

SEQ ID NO: 187649 - DNA, 20 bp, Artificial
  CRISPR gRNA sequence
gtcgcccaggctggagtgca

SEQ ID NO: 187650 - DNA, 20 bp, Artificial
  CRISPR gRNA sequence
tcgcccaggctggagtgcag

SEQ ID NO: 187651 - DNA, 20 bp, Artificial
  CRISPR gRNA sequence
gagtgcagtggcgcgatctg

SEQ ID NO: 187652 - DNA, 20 bp, Artificial
  CRISPR gRNA sequence
ggctcactgcaagctccgcc

SEQ ID NO: 187653 - DNA, 20 bp, Artificial
  CRISPR gRNA sequence
actgcaagctccgcctcccg

SEQ ID NO: 187654 - DNA, 20 bp, Artificial
  CRISPR gRNA sequence
caagctccgcctcccgggtt

SEQ ID NO: 187655 - DNA, 20 bp, Artificial
  CRISPR gRNA sequence
cgcctcccgggttcacgccg

SEQ ID NO: 187656 - DNA, 20 bp, Artificial
  CRISPR gRNA sequence
ccgggttcacgccgttctcc

SEQ ID NO: 187657 - DNA, 20 bp, Artificial
  CRISPR gRNA sequence
acgccgttctcccgcctcag

SEQ ID NO: 187658 - DNA, 20 bp, Artificial
  CRISPR gRNA sequence
tcccgcctcagcctcctgag

SEQ ID NO: 187659 - DNA, 20 bp, Artificial
  CRISPR gRNA sequence
ccgcctcagcctcctgagta

SEQ ID NO: 187660 - DNA, 20 bp, Artificial
  CRISPR gRNA sequence
agcctcctgagtagctggga

SEQ ID NO: 187661 - DNA, 20 bp, Artificial
  CRISPR gRNA sequence
ctgagtagctgggactacag

SEQ ID NO: 187662 - DNA, 20 bp, Artificial
  CRISPR gRNA sequence
agtagctgggactacaggca

SEQ ID NO: 187663 - DNA, 20 bp, Artificial
  CRISPR gRNA sequence
ggactacaggcacccgccac

SEQ ID NO: 187664 - DNA, 20 bp, Artificial
  CRISPR gRNA sequence
caggcacccgccaccacgcc

SEQ ID NO: 187665 - DNA, 20 bp, Artificial
  CRISPR gRNA sequence
attttttttttttttttgta

SEQ ID NO: 187666 - DNA, 20 bp, Artificial
  CRISPR gRNA sequence
tttttttttttttgtatttt

SEQ ID NO: 187667 - DNA, 20 bp, Artificial
  CRISPR gRNA sequence
ttttttttttttgtattttt

SEQ ID NO: 187668 - DNA, 20 bp, Artificial
  CRISPR gRNA sequence
tttttttttttgtattttta

SEQ ID NO: 187669 - DNA, 20 bp, Artificial
  CRISPR gRNA sequence
ttttttttttgtatttttag

SEQ ID NO: 187670 - DNA, 20 bp, Artificial
  CRISPR gRNA sequence
tttttttttgtatttttagt

SEQ ID NO: 187671 - DNA, 20 bp, Artificial
  CRISPR gRNA sequence
ttttttttgtatttttagta

SEQ ID NO: 187672 - DNA, 20 bp, Artificial
  CRISPR gRNA sequence
tttttttgtatttttagtag

SEQ ID NO: 187673 - DNA, 20 bp, Artificial
  CRISPR gRNA sequence
ttttttgtatttttagtaga

SEQ ID NO: 187674 - DNA, 20 bp, Artificial
  CRISPR gRNA sequence
tttttgtatttttagtagag

SEQ ID NO: 187675 - DNA, 20 bp, Artificial
  CRISPR gRNA sequence
ttttgtatttttagtagaga

SEQ ID NO: 187676 - DNA, 20 bp, Artificial
  CRISPR gRNA sequence
tttgtatttttagtagagac

SEQ ID NO: 187677 - DNA, 20 bp, Artificial
  CRISPR gRNA sequence
ttgtatttttagtagagacg

SEQ ID NO: 187678 - DNA, 20 bp, Artificial
  CRISPR gRNA sequence
tgtatttttagtagagacga

SEQ ID NO: 187679 - DNA, 20 bp, Artificial
  CRISPR gRNA sequence
gtatttttagtagagacgag

SEQ ID NO: 187680 - DNA, 20 bp, Artificial
  CRISPR gRNA sequence
tatttttagtagagacgagg

SEQ ID NO: 187681 - DNA, 20 bp, Artificial
  CRISPR gRNA sequence
ttagtagagacgaggtttct

SEQ ID NO: 187682 - DNA, 20 bp, Artificial
  CRISPR gRNA sequence
tagtagagacgaggtttctc

SEQ ID NO: 187683 - DNA, 20 bp, Artificial
  CRISPR gRNA sequence
agtagagacgaggtttctcc

SEQ ID NO: 187684 - DNA, 20 bp, Artificial
  CRISPR gRNA sequence
gtagagacgaggtttctccg

SEQ ID NO: 187685 - DNA, 20 bp, Artificial
  CRISPR gRNA sequence
ctccgtgttagccaggatgg

SEQ ID NO: 187686 - DNA, 20 bp, Artificial
  CRISPR gRNA sequence
tccgtgttagccaggatggt

SEQ ID NO: 187687 - DNA, 20 bp, Artificial
  CRISPR gRNA sequence
cgtgttagccaggatggtct

SEQ ID NO: 187688 - DNA, 20 bp, Artificial
  CRISPR gRNA sequence
gccaggatggtctcaatctc

SEQ ID NO: 187689 - DNA, 20 bp, Artificial
  CRISPR gRNA sequence
aatctcctgaccttgtgatc

SEQ ID NO: 187690 - DNA, 20 bp, Artificial
  CRISPR gRNA sequence
ctgaccttgtgatccgccca

SEQ ID NO: 187691 - DNA, 20 bp, Artificial
  CRISPR gRNA sequence
accttgtgatccgcccactt

SEQ ID NO: 187692 - DNA, 20 bp, Artificial
  CRISPR gRNA sequence
gtgatccgcccacttcggcc

SEQ ID NO: 187693 - DNA, 20 bp, Artificial
  CRISPR gRNA sequence
tgatccgcccacttcggcct

SEQ ID NO: 187694 - DNA, 20 bp, Artificial
  CRISPR gRNA sequence
cggcctcccaaagtgctgga

SEQ ID NO: 187695 - DNA, 20 bp, Artificial
  CRISPR gRNA sequence
ggcctcccaaagtgctggaa

SEQ ID NO: 187696 - DNA, 20 bp, Artificial
  CRISPR gRNA sequence
ccaaagtgctggaattgcag

SEQ ID NO: 187697 - DNA, 20 bp, Artificial
  CRISPR gRNA sequence
gaattgcaggcatgagccac

SEQ ID NO: 187698 - DNA, 20 bp, Artificial
  CRISPR gRNA sequence
caggcatgagccactgcgcc

SEQ ID NO: 187699 - DNA, 20 bp, Artificial
  CRISPR gRNA sequence
cgcccgactggttgtttcct

SEQ ID NO: 187700 - DNA, 20 bp, Artificial
  CRISPR gRNA sequence
gttgtttcctcatttttcaa

SEQ ID NO: 187701 - DNA, 20 bp, Artificial
  CRISPR gRNA sequence
tttcctcatttttcaaaaat

SEQ ID NO: 187702 - DNA, 20 bp, Artificial
  CRISPR gRNA sequence
cctcatttttcaaaaatgga

SEQ ID NO: 187703 - DNA, 20 bp, Artificial
  CRISPR gRNA sequence
ctcatttttcaaaaatggag

SEQ ID NO: 187704 - DNA, 20 bp, Artificial
  CRISPR gRNA sequence
atttttcaaaaatggagtga

SEQ ID NO: 187705 - DNA, 20 bp, Artificial
  CRISPR gRNA sequence
ttcaaaaatggagtgatata

SEQ ID NO: 187706 - DNA, 20 bp, Artificial
  CRISPR gRNA sequence
tcaaaaatggagtgatataa

SEQ ID NO: 187707 - DNA, 20 bp, Artificial
  CRISPR gRNA sequence
caaaaatggagtgatataac

SEQ ID NO: 187708 - DNA, 20 bp, Artificial
  CRISPR gRNA sequence
aaaaatggagtgatataacc

SEQ ID NO: 187709 - DNA, 20 bp, Artificial
  CRISPR gRNA sequence
ctttataaggctcttcatgt

SEQ ID NO: 187710 - DNA, 20 bp, Artificial
  CRISPR gRNA sequence
tttataaggctcttcatgta

SEQ ID NO: 187711 - DNA, 20 bp, Artificial
  CRISPR gRNA sequence
tataaggctcttcatgtatt

SEQ ID NO: 187712 - DNA, 20 bp, Artificial
  CRISPR gRNA sequence
ataaggctcttcatgtatta

SEQ ID NO: 187713 - DNA, 20 bp, Artificial
  CRISPR gRNA sequence
taaggctcttcatgtattag

SEQ ID NO: 187714 - DNA, 20 bp, Artificial
  CRISPR gRNA sequence
ttcatgtattagctgacatc

SEQ ID NO: 187715 - DNA, 20 bp, Artificial
  CRISPR gRNA sequence
catgtattagctgacatcac

SEQ ID NO: 187716 - DNA, 20 bp, Artificial
  CRISPR gRNA sequence
atgtattagctgacatcaca

SEQ ID NO: 187717 - DNA, 20 bp, Artificial
  CRISPR gRNA sequence
gctgacatcacatgaatgaa

SEQ ID NO: 187718 - DNA, 20 bp, Artificial
  CRISPR gRNA sequence
acatcacatgaatgaaagcc

SEQ ID NO: 187719 - DNA, 20 bp, Artificial
  CRISPR gRNA sequence
ttgtgaagagtaaaatgctc

SEQ ID NO: 187720 - DNA, 20 bp, Artificial
  CRISPR gRNA sequence
tgtgaagagtaaaatgctcc

SEQ ID NO: 187721 - DNA, 20 bp, Artificial
  CRISPR gRNA sequence
gtgaagagtaaaatgctccc

SEQ ID NO: 187722 - DNA, 20 bp, Artificial
  CRISPR gRNA sequence
tgaagagtaaaatgctcccc

SEQ ID NO: 187723 - DNA, 20 bp, Artificial
  CRISPR gRNA sequence
cccagacaaggtgatagtgg

SEQ ID NO: 187724 - DNA, 20 bp, Artificial
  CRISPR gRNA sequence
tgacttgcatgatgtgcatt

SEQ ID NO: 187725 - DNA, 20 bp, Artificial
  CRISPR gRNA sequence
gcatgatgtgcattgagtca

SEQ ID NO: 187726 - DNA, 20 bp, Artificial
  CRISPR gRNA sequence
catgatgtgcattgagtcag

SEQ ID NO: 187727 - DNA, 20 bp, Artificial
  CRISPR gRNA sequence
agtcagactccatggggtct

SEQ ID NO: 187728 - DNA, 20 bp, Artificial
  CRISPR gRNA sequence
catggggtctctggttcatt

SEQ ID NO: 187729 - DNA, 20 bp, Artificial
  CRISPR gRNA sequence
tggttcattctcctgtctgc

SEQ ID NO: 187730 - DNA, 20 bp, Artificial
  CRISPR gRNA sequence
gttcattctcctgtctgcct

SEQ ID NO: 187731 - DNA, 20 bp, Artificial
  CRISPR gRNA sequence
attctcctgtctgcctattg

SEQ ID NO: 187732 - DNA, 20 bp, Artificial
  CRISPR gRNA sequence
tcctgtctgcctattgagcc

SEQ ID NO: 187733 - DNA, 20 bp, Artificial
  CRISPR gRNA sequence
ctgtctgcctattgagcctg

SEQ ID NO: 187734 - DNA, 20 bp, Artificial
  CRISPR gRNA sequence
tctgcctattgagcctgccg

SEQ ID NO: 187735 - DNA, 20 bp, Artificial
  CRISPR gRNA sequence
cctattgagcctgccgatgt

SEQ ID NO: 187736 - DNA, 20 bp, Artificial
  CRISPR gRNA sequence
ttgagcctgccgatgtcact

SEQ ID NO: 187737 - DNA, 20 bp, Artificial
  CRISPR gRNA sequence
agcctgccgatgtcacttag

SEQ ID NO: 187738 - DNA, 20 bp, Artificial
  CRISPR gRNA sequence
ccgatgtcacttaggagaca

SEQ ID NO: 187739 - DNA, 20 bp, Artificial
  CRISPR gRNA sequence
aggagacagggacttgatat

SEQ ID NO: 187740 - DNA, 20 bp, Artificial
  CRISPR gRNA sequence
ggagacagggacttgatatt

SEQ ID NO: 187741 - DNA, 20 bp, Artificial
  CRISPR gRNA sequence
gatatttccttcaggttaat

SEQ ID NO: 187742 - DNA, 20 bp, Artificial
  CRISPR gRNA sequence
atatttccttcaggttaatg

SEQ ID NO: 187743 - DNA, 20 bp, Artificial
  CRISPR gRNA sequence
ccttcaggttaatgactgtg

SEQ ID NO: 187744 - DNA, 20 bp, Artificial
  CRISPR gRNA sequence
cttcaggttaatgactgtgg

SEQ ID NO: 187745 - DNA, 20 bp, Artificial
  CRISPR gRNA sequence
caggttaatgactgtggttc

SEQ ID NO: 187746 - DNA, 20 bp, Artificial
  CRISPR gRNA sequence
aggttaatgactgtggttct

SEQ ID NO: 187747 - DNA, 20 bp, Artificial
  CRISPR gRNA sequence
atgactgtggttctttgtgt

SEQ ID NO: 187748 - DNA, 20 bp, Artificial
  CRISPR gRNA sequence
tggttctttgtgtcccctcc

SEQ ID NO: 187749 - DNA, 20 bp, Artificial
  CRISPR gRNA sequence
tttgtgtcccctccagattt

SEQ ID NO: 187750 - DNA, 20 bp, Artificial
  CRISPR gRNA sequence
tgtgtcccctccagatttct

SEQ ID NO: 187751 - DNA, 20 bp, Artificial
  CRISPR gRNA sequence
gtgtcccctccagatttctc

SEQ ID NO: 187752 - DNA, 20 bp, Artificial
  CRISPR gRNA sequence
tgtcccctccagatttctct

SEQ ID NO: 187753 - DNA, 20 bp, Artificial
  CRISPR gRNA sequence
cagatttctctacctcagtc

SEQ ID NO: 187754 - DNA, 20 bp, Artificial
  CRISPR gRNA sequence
ctctacctcagtcccttttt

SEQ ID NO: 187755 - DNA, 20 bp, Artificial
  CRISPR gRNA sequence
tctacctcagtccctttttt

SEQ ID NO: 187756 - DNA, 20 bp, Artificial
  CRISPR gRNA sequence
tacctcagtccctttttttg

SEQ ID NO: 187757 - DNA, 20 bp, Artificial
  CRISPR gRNA sequence
cctcagtccctttttttgtg

SEQ ID NO: 187758 - DNA, 20 bp, Artificial
  CRISPR gRNA sequence
agtccctttttttgtggtct

SEQ ID NO: 187759 - DNA, 20 bp, Artificial
  CRISPR gRNA sequence
tttttgtggtctctttatag

SEQ ID NO: 187760 - DNA, 20 bp, Artificial
  CRISPR gRNA sequence
ttttgtggtctctttataga

SEQ ID NO: 187761 - DNA, 20 bp, Artificial
  CRISPR gRNA sequence
tttgtggtctctttatagat

SEQ ID NO: 187762 - DNA, 20 bp, Artificial
  CRISPR gRNA sequence
ttgtggtctctttatagatt

SEQ ID NO: 187763 - DNA, 20 bp, Artificial
  CRISPR gRNA sequence
tgtggtctctttatagattt

SEQ ID NO: 187764 - DNA, 20 bp, Artificial
  CRISPR gRNA sequence
gtggtctctttatagatttc

SEQ ID NO: 187765 - DNA, 20 bp, Artificial
  CRISPR gRNA sequence
tggtctctttatagatttca

SEQ ID NO: 187766 - DNA, 20 bp, Artificial
  CRISPR gRNA sequence
tttatagatttcaggtatgc

SEQ ID NO: 187767 - DNA, 20 bp, Artificial
  CRISPR gRNA sequence
tatagatttcaggtatgctg

SEQ ID NO: 187768 - DNA, 20 bp, Artificial
  CRISPR gRNA sequence
atagatttcaggtatgctgc

SEQ ID NO: 187769 - DNA, 20 bp, Artificial
  CRISPR gRNA sequence
tagatttcaggtatgctgct

SEQ ID NO: 187770 - DNA, 20 bp, Artificial
  CRISPR gRNA sequence
caggtatgctgctgaaagtg

SEQ ID NO: 187771 - DNA, 20 bp, Artificial
  CRISPR gRNA sequence
aggtatgctgctgaaagtgg

SEQ ID NO: 187772 - DNA, 20 bp, Artificial
  CRISPR gRNA sequence
ctgaaagtgggaatcctcta

SEQ ID NO: 187773 - DNA, 20 bp, Artificial
  CRISPR gRNA sequence
aaagtgggaatcctctacat

SEQ ID NO: 187774 - DNA, 20 bp, Artificial
  CRISPR gRNA sequence
tacattggtgggcagctggt

SEQ ID NO: 187775 - DNA, 20 bp, Artificial
  CRISPR gRNA sequence
cattggtgggcagctggtga

SEQ ID NO: 187776 - DNA, 20 bp, Artificial
  CRISPR gRNA sequence
gtgggcagctggtgaccagt

SEQ ID NO: 187777 - DNA, 20 bp, Artificial
  CRISPR gRNA sequence
gtgaccagtggggctgtaag

SEQ ID NO: 187778 - DNA, 20 bp, Artificial
  CRISPR gRNA sequence
taagcagtgggaaccttgtc

SEQ ID NO: 187779 - DNA, 20 bp, Artificial
  CRISPR gRNA sequence
gtcacatttgttctctacca

SEQ ID NO: 187780 - DNA, 20 bp, Artificial
  CRISPR gRNA sequence
tcacatttgttctctaccag

SEQ ID NO: 187781 - DNA, 20 bp, Artificial
  CRISPR gRNA sequence
gttctctaccagatgcagtt

SEQ ID NO: 187782 - DNA, 20 bp, Artificial
  CRISPR gRNA sequence
ttctctaccagatgcagttc

SEQ ID NO: 187783 - DNA, 20 bp, Artificial
  CRISPR gRNA sequence
tctaccagatgcagttcacc

SEQ ID NO: 187784 - DNA, 20 bp, Artificial
  CRISPR gRNA sequence
taccagatgcagttcaccca

SEQ ID NO: 187785 - DNA, 20 bp, Artificial
  CRISPR gRNA sequence
ccagatgcagttcacccagg

SEQ ID NO: 187786 - DNA, 20 bp, Artificial
  CRISPR gRNA sequence
acccaggctgtggaggtgag

SEQ ID NO: 187787 - DNA, 20 bp, Artificial
  CRISPR gRNA sequence
tggaggtgaggtccctccac

SEQ ID NO: 187788 - DNA, 20 bp, Artificial
  CRISPR gRNA sequence
caccttcactccccagtgtg

SEQ ID NO: 187789 - DNA, 20 bp, Artificial
  CRISPR gRNA sequence
cactccccagtgtgattcct

SEQ ID NO: 187790 - DNA, 20 bp, Artificial
  CRISPR gRNA sequence
actccccagtgtgattcctt

SEQ ID NO: 187791 - DNA, 20 bp, Artificial
  CRISPR gRNA sequence
cccagtgtgattccttcctc

SEQ ID NO: 187792 - DNA, 20 bp, Artificial
  CRISPR gRNA sequence
cttcctctggcccagcacca

SEQ ID NO: 187793 - DNA, 20 bp, Artificial
  CRISPR gRNA sequence
cctctggcccagcaccatct

SEQ ID NO: 187794 - DNA, 20 bp, Artificial
  CRISPR gRNA sequence
ctctggcccagcaccatctg

SEQ ID NO: 187795 - DNA, 20 bp, Artificial
  CRISPR gRNA sequence
tggcccagcaccatctgtgt

SEQ ID NO: 187796 - DNA, 20 bp, Artificial
  CRISPR gRNA sequence
gcccagcaccatctgtgtga

SEQ ID NO: 187797 - DNA, 20 bp, Artificial
  CRISPR gRNA sequence
tgtgatgtccttccattctt

SEQ ID NO: 187798 - DNA, 20 bp, Artificial
  CRISPR gRNA sequence
ccattctttacccttcttgc

SEQ ID NO: 187799 - DNA, 20 bp, Artificial
  CRISPR gRNA sequence
cattctttacccttcttgct

SEQ ID NO: 187800 - DNA, 20 bp, Artificial
  CRISPR gRNA sequence
tttacccttcttgcttcaca

SEQ ID NO: 187801 - DNA, 20 bp, Artificial
  CRISPR gRNA sequence
tacccttcttgcttcacata

SEQ ID NO: 187802 - DNA, 20 bp, Artificial
  CRISPR gRNA sequence
acccttcttgcttcacataa

SEQ ID NO: 187803 - DNA, 20 bp, Artificial
  CRISPR gRNA sequence
cccttcttgcttcacataat

SEQ ID NO: 187804 - DNA, 20 bp, Artificial
  CRISPR gRNA sequence
cttgcttcacataatgctgg

SEQ ID NO: 187805 - DNA, 20 bp, Artificial
  CRISPR gRNA sequence
ttgcttcacataatgctggc

SEQ ID NO: 187806 - DNA, 20 bp, Artificial
  CRISPR gRNA sequence
gcttcacataatgctggcaa

SEQ ID NO: 187807 - DNA, 20 bp, Artificial
  CRISPR gRNA sequence
cttcacataatgctggcaag

SEQ ID NO: 187808 - DNA, 20 bp, Artificial
  CRISPR gRNA sequence
cacataatgctggcaagcag

SEQ ID NO: 187809 - DNA, 20 bp, Artificial
  CRISPR gRNA sequence
acataatgctggcaagcaga

SEQ ID NO: 187810 - DNA, 20 bp, Artificial
  CRISPR gRNA sequence
gcaagcagactacctcactt

SEQ ID NO: 187811 - DNA, 20 bp, Artificial
  CRISPR gRNA sequence
cctcactttcactattctta

SEQ ID NO: 187812 - DNA, 20 bp, Artificial
  CRISPR gRNA sequence
actttcactattcttacctc

SEQ ID NO: 187813 - DNA, 20 bp, Artificial
  CRISPR gRNA sequence
tcactattcttacctccctc

SEQ ID NO: 187814 - DNA, 20 bp, Artificial
  CRISPR gRNA sequence
cactattcttacctccctct

SEQ ID NO: 187815 - DNA, 20 bp, Artificial
  CRISPR gRNA sequence
actattcttacctccctcta

SEQ ID NO: 187816 - DNA, 20 bp, Artificial
  CRISPR gRNA sequence
ttcttacctccctctaggta

SEQ ID NO: 187817 - DNA, 20 bp, Artificial
  CRISPR gRNA sequence
ttacctccctctaggtactg

SEQ ID NO: 187818 - DNA, 20 bp, Artificial
  CRISPR gRNA sequence
acctccctctaggtactgct

SEQ ID NO: 187819 - DNA, 20 bp, Artificial
  CRISPR gRNA sequence
cctccctctaggtactgctc

SEQ ID NO: 187820 - DNA, 20 bp, Artificial
  CRISPR gRNA sequence
cctctaggtactgctctcca

SEQ ID NO: 187821 - DNA, 20 bp, Artificial
  CRISPR gRNA sequence
taggtactgctctccatcta

SEQ ID NO: 187822 - DNA, 20 bp, Artificial
  CRISPR gRNA sequence
ggtactgctctccatctacc

SEQ ID NO: 187823 - DNA, 20 bp, Artificial
  CRISPR gRNA sequence
ctctccatctaccccagagt

SEQ ID NO: 187824 - DNA, 20 bp, Artificial
  CRISPR gRNA sequence
tccatctaccccagagtaca

SEQ ID NO: 187825 - DNA, 20 bp, Artificial
  CRISPR gRNA sequence
catctaccccagagtacaga

SEQ ID NO: 187826 - DNA, 20 bp, Artificial
  CRISPR gRNA sequence
ccccagagtacagaaggctg

SEQ ID NO: 187827 - DNA, 20 bp, Artificial
  CRISPR gRNA sequence
tgggctcctcagagaaaata

SEQ ID NO: 187828 - DNA, 20 bp, Artificial
  CRISPR gRNA sequence
ctcagagaaaatatttgagt

SEQ ID NO: 187829 - DNA, 20 bp, Artificial
  CRISPR gRNA sequence
agagaaaatatttgagtacc

SEQ ID NO: 187830 - DNA, 20 bp, Artificial
  CRISPR gRNA sequence
gagtacctggaccgcacccc

SEQ ID NO: 187831 - DNA, 20 bp, Artificial
  CRISPR gRNA sequence
agtacctggaccgcacccct

SEQ ID NO: 187832 - DNA, 20 bp, Artificial
  CRISPR gRNA sequence
gaccgcacccctcgctgccc

SEQ ID NO: 187833 - DNA, 20 bp, Artificial
  CRISPR gRNA sequence
gctgcccacccagtggtctg

SEQ ID NO: 187834 - DNA, 20 bp, Artificial
  CRISPR gRNA sequence
cccacccagtggtctgttga

SEQ ID NO: 187835 - DNA, 20 bp, Artificial
  CRISPR gRNA sequence
ttgactcccttacacttgga

SEQ ID NO: 187836 - DNA, 20 bp, Artificial
  CRISPR gRNA sequence
actcccttacacttggaggg

SEQ ID NO: 187837 - DNA, 20 bp, Artificial
  CRISPR gRNA sequence
ccttacacttggagggcctt

SEQ ID NO: 187838 - DNA, 20 bp, Artificial
  CRISPR gRNA sequence
acacttggagggccttgtcc

SEQ ID NO: 187839 - DNA, 20 bp, Artificial
  CRISPR gRNA sequence
cacttggagggccttgtcca

SEQ ID NO: 187840 - DNA, 20 bp, Artificial
  CRISPR gRNA sequence
ggagggccttgtccagttcc

SEQ ID NO: 187841 - DNA, 20 bp, Artificial
  CRISPR gRNA sequence
gagggccttgtccagttcca

SEQ ID NO: 187842 - DNA, 20 bp, Artificial
  CRISPR gRNA sequence
gtccagttccaagatgtctc

SEQ ID NO: 187843 - DNA, 20 bp, Artificial
  CRISPR gRNA sequence
tccagttccaagatgtctcc

SEQ ID NO: 187844 - DNA, 20 bp, Artificial
  CRISPR gRNA sequence
caagatgtctcctttgccta

SEQ ID NO: 187845 - DNA, 20 bp, Artificial
  CRISPR gRNA sequence
ctttgcctacccaaaccgcc

SEQ ID NO: 187846 - DNA, 20 bp, Artificial
  CRISPR gRNA sequence
tgcctacccaaaccgcccag

SEQ ID NO: 187847 - DNA, 20 bp, Artificial
  CRISPR gRNA sequence
gcctacccaaaccgcccaga

SEQ ID NO: 187848 - DNA, 20 bp, Artificial
  CRISPR gRNA sequence
cctacccaaaccgcccagat

SEQ ID NO: 187849 - DNA, 20 bp, Artificial
  CRISPR gRNA sequence
cccaaaccgcccagatgtct

SEQ ID NO: 187850 - DNA, 20 bp, Artificial
  CRISPR gRNA sequence
agtgctacaggtacaaccta

SEQ ID NO: 187851 - DNA, 20 bp, Artificial
  CRISPR gRNA sequence
gtgctacaggtacaacctac

SEQ ID NO: 187852 - DNA, 20 bp, Artificial
  CRISPR gRNA sequence
caggtacaacctaccactcc

SEQ ID NO: 187853 - DNA, 20 bp, Artificial
  CRISPR gRNA sequence
ccactccctgtattccactg

SEQ ID NO: 187854 - DNA, 20 bp, Artificial
  CRISPR gRNA sequence
cctgtattccactggcccca

SEQ ID NO: 187855 - DNA, 20 bp, Artificial
  CRISPR gRNA sequence
tattccactggccccaactg

SEQ ID NO: 187856 - DNA, 20 bp, Artificial
  CRISPR gRNA sequence
cactggccccaactgcaatt

SEQ ID NO: 187857 - DNA, 20 bp, Artificial
  CRISPR gRNA sequence
gccccaactgcaattctgcc

SEQ ID NO: 187858 - DNA, 20 bp, Artificial
  CRISPR gRNA sequence
caattctgccatcctaaatt

SEQ ID NO: 187859 - DNA, 20 bp, Artificial
  CRISPR gRNA sequence
tgccatcctaaattttcttc

SEQ ID NO: 187860 - DNA, 20 bp, Artificial
  CRISPR gRNA sequence
ccatcctaaattttcttcct

SEQ ID NO: 187861 - DNA, 20 bp, Artificial
  CRISPR gRNA sequence
aattttcttcctgccttcag

SEQ ID NO: 187862 - DNA, 20 bp, Artificial
  CRISPR gRNA sequence
tcttcctgccttcagcctgc

SEQ ID NO: 187863 - DNA, 20 bp, Artificial
  CRISPR gRNA sequence
cttcctgccttcagcctgct

SEQ ID NO: 187864 - DNA, 20 bp, Artificial
  CRISPR gRNA sequence
ttcctgccttcagcctgctt

SEQ ID NO: 187865 - DNA, 20 bp, Artificial
  CRISPR gRNA sequence
cctgccttcagcctgcttac

SEQ ID NO: 187866 - DNA, 20 bp, Artificial
  CRISPR gRNA sequence
ctgccttcagcctgcttact

SEQ ID NO: 187867 - DNA, 20 bp, Artificial
  CRISPR gRNA sequence
ccttcagcctgcttactgcc

SEQ ID NO: 187868 - DNA, 20 bp, Artificial
  CRISPR gRNA sequence
cagcctgcttactgccaagc

SEQ ID NO: 187869 - DNA, 20 bp, Artificial
  CRISPR gRNA sequence
agcctgcttactgccaagca

SEQ ID NO: 187870 - DNA, 20 bp, Artificial
  CRISPR gRNA sequence
cttactgccaagcatatatc

SEQ ID NO: 187871 - DNA, 20 bp, Artificial
  CRISPR gRNA sequence
actgccaagcatatatcctc

SEQ ID NO: 187872 - DNA, 20 bp, Artificial
  CRISPR gRNA sequence
ctgccaagcatatatcctcc

SEQ ID NO: 187873 - DNA, 20 bp, Artificial
  CRISPR gRNA sequence
ccaagcatatatcctcccta

SEQ ID NO: 187874 - DNA, 20 bp, Artificial
  CRISPR gRNA sequence
cctaaccctttaaaggcaat

SEQ ID NO: 187875 - DNA, 20 bp, Artificial
  CRISPR gRNA sequence
accctttaaaggcaatggta

SEQ ID NO: 187876 - DNA, 20 bp, Artificial
  CRISPR gRNA sequence
taaaggcaatggtaggcatc

SEQ ID NO: 187877 - DNA, 20 bp, Artificial
  CRISPR gRNA sequence
aaaggcaatggtaggcatca

SEQ ID NO: 187878 - DNA, 20 bp, Artificial
  CRISPR gRNA sequence
aaggcaatggtaggcatcat

SEQ ID NO: 187879 - DNA, 20 bp, Artificial
  CRISPR gRNA sequence
ttccataaatcttccccaaa

SEQ ID NO: 187880 - DNA, 20 bp, Artificial
  CRISPR gRNA sequence
cataaatcttccccaaactc

SEQ ID NO: 187881 - DNA, 20 bp, Artificial
  CRISPR gRNA sequence
ccccaaactcaagaacccag

SEQ ID NO: 187882 - DNA, 20 bp, Artificial
  CRISPR gRNA sequence
cccaaactcaagaacccagt

SEQ ID NO: 187883 - DNA, 20 bp, Artificial
  CRISPR gRNA sequence
aagaacccagtttgggcttc

SEQ ID NO: 187884 - DNA, 20 bp, Artificial
  CRISPR gRNA sequence
gggcttccaaagagaatgag

SEQ ID NO: 187885 - DNA, 20 bp, Artificial
  CRISPR gRNA sequence
ggcttccaaagagaatgaga

SEQ ID NO: 187886 - DNA, 20 bp, Artificial
  CRISPR gRNA sequence
ccaaagagaatgagagaaga

SEQ ID NO: 187887 - DNA, 20 bp, Artificial
  CRISPR gRNA sequence
caaagagaatgagagaagag

SEQ ID NO: 187888 - DNA, 20 bp, Artificial
  CRISPR gRNA sequence
cgaagagagtgctctcacgt

SEQ ID NO: 187889 - DNA, 20 bp, Artificial
  CRISPR gRNA sequence
gaagagagtgctctcacgtt

SEQ ID NO: 187890 - DNA, 20 bp, Artificial
  CRISPR gRNA sequence
tcacgttccaaggaattgct

SEQ ID NO: 187891 - DNA, 20 bp, Artificial
  CRISPR gRNA sequence
acgttccaaggaattgctgc

SEQ ID NO: 187892 - DNA, 20 bp, Artificial
  CRISPR gRNA sequence
caaggaattgctgcagcaaa

SEQ ID NO: 187893 - DNA, 20 bp, Artificial
  CRISPR gRNA sequence
ctgcagcaaaatctgtgtct

SEQ ID NO: 187894 - DNA, 20 bp, Artificial
  CRISPR gRNA sequence
cagcaaaatctgtgtcttcg

SEQ ID NO: 187895 - DNA, 20 bp, Artificial
  CRISPR gRNA sequence
tgtcttcggtcttccatctt

SEQ ID NO: 187896 - DNA, 20 bp, Artificial
  CRISPR gRNA sequence
cggtcttccatctttccttt

SEQ ID NO: 187897 - DNA, 20 bp, Artificial
  CRISPR gRNA sequence
ggtcttccatctttcctttt

SEQ ID NO: 187898 - DNA, 20 bp, Artificial
  CRISPR gRNA sequence
ccatctttccttttcctttg

SEQ ID NO: 187899 - DNA, 20 bp, Artificial
  CRISPR gRNA sequence
catctttccttttcctttgt

SEQ ID NO: 187900 - DNA, 20 bp, Artificial
  CRISPR gRNA sequence
tccttttcctttgtaatttg

SEQ ID NO: 187901 - DNA, 20 bp, Artificial
  CRISPR gRNA sequence
ccttttcctttgtaatttgg

SEQ ID NO: 187902 - DNA, 20 bp, Artificial
  CRISPR gRNA sequence
cttttcctttgtaatttgga

SEQ ID NO: 187903 - DNA, 20 bp, Artificial
  CRISPR gRNA sequence
ttcctttgtaatttggaatg

SEQ ID NO: 187904 - DNA, 20 bp, Artificial
  CRISPR gRNA sequence
tcctttgtaatttggaatgt

SEQ ID NO: 187905 - DNA, 20 bp, Artificial
  CRISPR gRNA sequence
cctttgtaatttggaatgtg

SEQ ID NO: 187906 - DNA, 20 bp, Artificial
  CRISPR gRNA sequence
ctttgtaatttggaatgtga

SEQ ID NO: 187907 - DNA, 20 bp, Artificial
  CRISPR gRNA sequence
tgtaatttggaatgtgattt

SEQ ID NO: 187908 - DNA, 20 bp, Artificial
  CRISPR gRNA sequence
gtaatttggaatgtgatttt

SEQ ID NO: 187909 - DNA, 20 bp, Artificial
  CRISPR gRNA sequence
taatttggaatgtgattttt

SEQ ID NO: 187910 - DNA, 20 bp, Artificial
  CRISPR gRNA sequence
ggaatgtgatttttcccttt

SEQ ID NO: 187911 - DNA, 20 bp, Artificial
  CRISPR gRNA sequence
gaatgtgatttttccctttc

SEQ ID NO: 187912 - DNA, 20 bp, Artificial
  CRISPR gRNA sequence
ttccctttcctggtggtatc

SEQ ID NO: 187913 - DNA, 20 bp, Artificial
  CRISPR gRNA sequence
tccctttcctggtggtatct

SEQ ID NO: 187914 - DNA, 20 bp, Artificial
  CRISPR gRNA sequence
ccctttcctggtggtatctg

SEQ ID NO: 187915 - DNA, 20 bp, Artificial
  CRISPR gRNA sequence
cctttcctggtggtatctga

SEQ ID NO: 187916 - DNA, 20 bp, Artificial
  CRISPR gRNA sequence
tcctggtggtatctgacatc

SEQ ID NO: 187917 - DNA, 20 bp, Artificial
  CRISPR gRNA sequence
cctggtggtatctgacatca

SEQ ID NO: 187918 - DNA, 20 bp, Artificial
  CRISPR gRNA sequence
ctggtggtatctgacatcaa

SEQ ID NO: 187919 - DNA, 20 bp, Artificial
  CRISPR gRNA sequence
gtggtatctgacatcaagtg

SEQ ID NO: 187920 - DNA, 20 bp, Artificial
  CRISPR gRNA sequence
acatcaagtgtgtggcatag

SEQ ID NO: 187921 - DNA, 20 bp, Artificial
  CRISPR gRNA sequence
ggtctctgcccttgtctttg

SEQ ID NO: 187922 - DNA, 20 bp, Artificial
  CRISPR gRNA sequence
tgcccttgtctttgccgctt

SEQ ID NO: 187923 - DNA, 20 bp, Artificial
  CRISPR gRNA sequence
cccttgtctttgccgcttct

SEQ ID NO: 187924 - DNA, 20 bp, Artificial
  CRISPR gRNA sequence
gtctttgccgcttcttctat

SEQ ID NO: 187925 - DNA, 20 bp, Artificial
  CRISPR gRNA sequence
tctttgccgcttcttctatc

SEQ ID NO: 187926 - DNA, 20 bp, Artificial
  CRISPR gRNA sequence
tgccgcttcttctatctcta

SEQ ID NO: 187927 - DNA, 20 bp, Artificial
  CRISPR gRNA sequence
gccgcttcttctatctctac

SEQ ID NO: 187928 - DNA, 20 bp, Artificial
  CRISPR gRNA sequence
ccgcttcttctatctctact

SEQ ID NO: 187929 - DNA, 20 bp, Artificial
  CRISPR gRNA sequence
cttctatctctactccttgg

SEQ ID NO: 187930 - DNA, 20 bp, Artificial
  CRISPR gRNA sequence
ttctatctctactccttggg

SEQ ID NO: 187931 - DNA, 20 bp, Artificial
  CRISPR gRNA sequence
ctatctctactccttgggga

SEQ ID NO: 187932 - DNA, 20 bp, Artificial
  CRISPR gRNA sequence
tatctctactccttggggag

SEQ ID NO: 187933 - DNA, 20 bp, Artificial
  CRISPR gRNA sequence
tctctactccttggggaggc

SEQ ID NO: 187934 - DNA, 20 bp, Artificial
  CRISPR gRNA sequence
tactccttggggaggcatca

SEQ ID NO: 187935 - DNA, 20 bp, Artificial
  CRISPR gRNA sequence
ctccttggggaggcatcacc

SEQ ID NO: 187936 - DNA, 20 bp, Artificial
  CRISPR gRNA sequence
cttggggaggcatcacccag

SEQ ID NO: 187937 - DNA, 20 bp, Artificial
  CRISPR gRNA sequence
ggggaggcatcacccagaaa

SEQ ID NO: 187938 - DNA, 20 bp, Artificial
  CRISPR gRNA sequence
gggaggcatcacccagaaat

SEQ ID NO: 187939 - DNA, 20 bp, Artificial
  CRISPR gRNA sequence
tgcatgtgggagggtaggag

SEQ ID NO: 187940 - DNA, 20 bp, Artificial
  CRISPR gRNA sequence
ctatatttccctgtttttct

SEQ ID NO: 187941 - DNA, 20 bp, Artificial
  CRISPR gRNA sequence
tatatttccctgtttttctt

SEQ ID NO: 187942 - DNA, 20 bp, Artificial
  CRISPR gRNA sequence
tatttccctgtttttcttct

SEQ ID NO: 187943 - DNA, 20 bp, Artificial
  CRISPR gRNA sequence
ccctgtttttcttctggggt

SEQ ID NO: 187944 - DNA, 20 bp, Artificial
  CRISPR gRNA sequence
cctgtttttcttctggggta

SEQ ID NO: 187945 - DNA, 20 bp, Artificial
  CRISPR gRNA sequence
tttttcttctggggtaagac

SEQ ID NO: 187946 - DNA, 20 bp, Artificial
  CRISPR gRNA sequence
ttcttctggggtaagacatc

SEQ ID NO: 187947 - DNA, 20 bp, Artificial
  CRISPR gRNA sequence
tcttctggggtaagacatca

SEQ ID NO: 187948 - DNA, 20 bp, Artificial
  CRISPR gRNA sequence
cttctggggtaagacatcat

SEQ ID NO: 187949 - DNA, 20 bp, Artificial
  CRISPR gRNA sequence
ttctggggtaagacatcatg

SEQ ID NO: 187950 - DNA, 20 bp, Artificial
  CRISPR gRNA sequence
ctggggtaagacatcatgct

SEQ ID NO: 187951 - DNA, 20 bp, Artificial
  CRISPR gRNA sequence
tggggtaagacatcatgcta

SEQ ID NO: 187952 - DNA, 20 bp, Artificial
  CRISPR gRNA sequence
gggtaagacatcatgctatg

SEQ ID NO: 187953 - DNA, 20 bp, Artificial
  CRISPR gRNA sequence
tgtaacaaggcaatgacact

SEQ ID NO: 187954 - DNA, 20 bp, Artificial
  CRISPR gRNA sequence
tcaaggttagaggccttggt

SEQ ID NO: 187955 - DNA, 20 bp, Artificial
  CRISPR gRNA sequence
aaggttagaggccttggtag

SEQ ID NO: 187956 - DNA, 20 bp, Artificial
  CRISPR gRNA sequence
gaggccttggtagcctctta

SEQ ID NO: 187957 - DNA, 20 bp, Artificial
  CRISPR gRNA sequence
ggtagcctcttatcgtgtgc

SEQ ID NO: 187958 - DNA, 20 bp, Artificial
  CRISPR gRNA sequence
gtagcctcttatcgtgtgct

SEQ ID NO: 187959 - DNA, 20 bp, Artificial
  CRISPR gRNA sequence
ttatcgtgtgcttctctggc

SEQ ID NO: 187960 - DNA, 20 bp, Artificial
  CRISPR gRNA sequence
atcgtgtgcttctctggcct

SEQ ID NO: 187961 - DNA, 20 bp, Artificial
  CRISPR gRNA sequence
tcgtgtgcttctctggcctc

SEQ ID NO: 187962 - DNA, 20 bp, Artificial
  CRISPR gRNA sequence
ctctggcctctaggggctga

SEQ ID NO: 187963 - DNA, 20 bp, Artificial
  CRISPR gRNA sequence
tctggcctctaggggctgac

SEQ ID NO: 187964 - DNA, 20 bp, Artificial
  CRISPR gRNA sequence
tggcctctaggggctgacat

SEQ ID NO: 187965 - DNA, 20 bp, Artificial
  CRISPR gRNA sequence
gcctctaggggctgacattc

SEQ ID NO: 187966 - DNA, 20 bp, Artificial
  CRISPR gRNA sequence
taggggctgacattcaccct

SEQ ID NO: 187967 - DNA, 20 bp, Artificial
  CRISPR gRNA sequence
ggggctgacattcaccctac

SEQ ID NO: 187968 - DNA, 20 bp, Artificial
  CRISPR gRNA sequence
acattcaccctacgccctgg

SEQ ID NO: 187969 - DNA, 20 bp, Artificial
  CRISPR gRNA sequence
accctacgccctggcgaggt

SEQ ID NO: 187970 - DNA, 20 bp, Artificial
  CRISPR gRNA sequence
cgccctggcgaggtgacggc

SEQ ID NO: 187971 - DNA, 20 bp, Artificial
  CRISPR gRNA sequence
gcgaggtgacggcgctggtg

SEQ ID NO: 187972 - DNA, 20 bp, Artificial
  CRISPR gRNA sequence
gtgggacccaatgggtctgg

SEQ ID NO: 187973 - DNA, 20 bp, Artificial
  CRISPR gRNA sequence
ggaagagcacagtggctgcc

SEQ ID NO: 187974 - DNA, 20 bp, Artificial
  CRISPR gRNA sequence
ccctgctgcagaatctgtac

SEQ ID NO: 187975 - DNA, 20 bp, Artificial
  CRISPR gRNA sequence
ctgcagaatctgtaccagcc

SEQ ID NO: 187976 - DNA, 20 bp, Artificial
  CRISPR gRNA sequence
cagaatctgtaccagcccac

SEQ ID NO: 187977 - DNA, 20 bp, Artificial
  CRISPR gRNA sequence
taccagcccaccgggggaca

SEQ ID NO: 187978 - DNA, 20 bp, Artificial
  CRISPR gRNA sequence
ctgttggatgggaagcccct

SEQ ID NO: 187979 - DNA, 20 bp, Artificial
  CRISPR gRNA sequence
ttggatgggaagccccttcc

SEQ ID NO: 187980 - DNA, 20 bp, Artificial
  CRISPR gRNA sequence
gatgggaagccccttcccca

SEQ ID NO: 187981 - DNA, 20 bp, Artificial
  CRISPR gRNA sequence
ccccaatatgagcaccgcta

SEQ ID NO: 187982 - DNA, 20 bp, Artificial
  CRISPR gRNA sequence
cccaatatgagcaccgctac

SEQ ID NO: 187983 - DNA, 20 bp, Artificial
  CRISPR gRNA sequence
cctgcacaggcaggtatgga

SEQ ID NO: 187984 - DNA, 20 bp, Artificial
  CRISPR gRNA sequence
cacaggcaggtatggaagca

SEQ ID NO: 187985 - DNA, 20 bp, Artificial
  CRISPR gRNA sequence
gaaggagggcagggagcatc

SEQ ID NO: 187986 - DNA, 20 bp, Artificial
  CRISPR gRNA sequence
aaggagggcagggagcatca

SEQ ID NO: 187987 - DNA, 20 bp, Artificial
  CRISPR gRNA sequence
ttactgagcactctgaaaga

SEQ ID NO: 187988 - DNA, 20 bp, Artificial
  CRISPR gRNA sequence
actgagcactctgaaagagg

SEQ ID NO: 187989 - DNA, 20 bp, Artificial
  CRISPR gRNA sequence
ctgagcactctgaaagaggg

SEQ ID NO: 187990 - DNA, 20 bp, Artificial
  CRISPR gRNA sequence
agcactctgaaagaggggtt

SEQ ID NO: 187991 - DNA, 20 bp, Artificial
  CRISPR gRNA sequence
tgaaagaggggttagggaat

SEQ ID NO: 187992 - DNA, 20 bp, Artificial
  CRISPR gRNA sequence
aaagaggggttagggaatga

SEQ ID NO: 187993 - DNA, 20 bp, Artificial
  CRISPR gRNA sequence
gggaatgataagagaccttg

SEQ ID NO: 187994 - DNA, 20 bp, Artificial
  CRISPR gRNA sequence
gggtggagatggtggtgtag

SEQ ID NO: 187995 - DNA, 20 bp, Artificial
  CRISPR gRNA sequence
ggtggagatggtggtgtagt

SEQ ID NO: 187996 - DNA, 20 bp, Artificial
  CRISPR gRNA sequence
tgtgacatgttctcaataaa

SEQ ID NO: 187997 - DNA, 20 bp, Artificial
  CRISPR gRNA sequence
gtgacatgttctcaataaag

SEQ ID NO: 187998 - DNA, 20 bp, Artificial
  CRISPR gRNA sequence
tgacatgttctcaataaaga

SEQ ID NO: 187999 - DNA, 20 bp, Artificial
  CRISPR gRNA sequence
tcaataaagattttgagtct

SEQ ID NO: 188000 - DNA, 20 bp, Artificial
  CRISPR gRNA sequence
aataaagattttgagtcttc

SEQ ID NO: 188001 - DNA, 20 bp, Artificial
  CRISPR gRNA sequence
tgagtcttcgatctctagat

SEQ ID NO: 188002 - DNA, 20 bp, Artificial
  CRISPR gRNA sequence
gagtcttcgatctctagata

SEQ ID NO: 188003 - DNA, 20 bp, Artificial
  CRISPR gRNA sequence
agtcttcgatctctagataa

SEQ ID NO: 188004 - DNA, 20 bp, Artificial
  CRISPR gRNA sequence
cgatctctagataaccatac

SEQ ID NO: 188005 - DNA, 20 bp, Artificial
  CRISPR gRNA sequence
gatctctagataaccatact

SEQ ID NO: 188006 - DNA, 20 bp, Artificial
  CRISPR gRNA sequence
tagataaccatactcccatg

SEQ ID NO: 188007 - DNA, 20 bp, Artificial
  CRISPR gRNA sequence
gataaccatactcccatgtg

SEQ ID NO: 188008 - DNA, 20 bp, Artificial
  CRISPR gRNA sequence
ccatgtgccttgttctatga

SEQ ID NO: 188009 - DNA, 20 bp, Artificial
  CRISPR gRNA sequence
gttctatgactcttcatcat

SEQ ID NO: 188010 - DNA, 20 bp, Artificial
  CRISPR gRNA sequence
ttctatgactcttcatcata

SEQ ID NO: 188011 - DNA, 20 bp, Artificial
  CRISPR gRNA sequence
tatgactcttcatcatattt

SEQ ID NO: 188012 - DNA, 20 bp, Artificial
  CRISPR gRNA sequence
tgactcttcatcatatttca

SEQ ID NO: 188013 - DNA, 20 bp, Artificial
  CRISPR gRNA sequence
ttcatcatatttcatctcag

SEQ ID NO: 188014 - DNA, 20 bp, Artificial
  CRISPR gRNA sequence
catcatatttcatctcaggt

SEQ ID NO: 188015 - DNA, 20 bp, Artificial
  CRISPR gRNA sequence
atcatatttcatctcaggtg

SEQ ID NO: 188016 - DNA, 20 bp, Artificial
  CRISPR gRNA sequence
catctcaggtggctgcagtg

SEQ ID NO: 188017 - DNA, 20 bp, Artificial
  CRISPR gRNA sequence
atctcaggtggctgcagtgg

SEQ ID NO: 188018 - DNA, 20 bp, Artificial
  CRISPR gRNA sequence
aggtggctgcagtgggacaa

SEQ ID NO: 188019 - DNA, 20 bp, Artificial
  CRISPR gRNA sequence
cagtgggacaagagccacag

SEQ ID NO: 188020 - DNA, 20 bp, Artificial
  CRISPR gRNA sequence
ggaagaagtcttcaagaaaa

SEQ ID NO: 188021 - DNA, 20 bp, Artificial
  CRISPR gRNA sequence
gaagaagtcttcaagaaaat

SEQ ID NO: 188022 - DNA, 20 bp, Artificial
  CRISPR gRNA sequence
caagaaaatattgcctatgg

SEQ ID NO: 188023 - DNA, 20 bp, Artificial
  CRISPR gRNA sequence
aagaaaatattgcctatggc

SEQ ID NO: 188024 - DNA, 20 bp, Artificial
  CRISPR gRNA sequence
cctatggcctgacccagaag

SEQ ID NO: 188025 - DNA, 20 bp, Artificial
  CRISPR gRNA sequence
tggcctgacccagaagccaa

SEQ ID NO: 188026 - DNA, 20 bp, Artificial
  CRISPR gRNA sequence
acccagaagccaactatgga

SEQ ID NO: 188027 - DNA, 20 bp, Artificial
  CRISPR gRNA sequence
tggaggaaatcacagctgct

SEQ ID NO: 188028 - DNA, 20 bp, Artificial
  CRISPR gRNA sequence
ctgcagtaaagtctggggcc

SEQ ID NO: 188029 - DNA, 20 bp, Artificial
  CRISPR gRNA sequence
cagtaaagtctggggcccat

SEQ ID NO: 188030 - DNA, 20 bp, Artificial
  CRISPR gRNA sequence
gggcccatagtttcatctct

SEQ ID NO: 188031 - DNA, 20 bp, Artificial
  CRISPR gRNA sequence
catctctggactccctcagg

SEQ ID NO: 188032 - DNA, 20 bp, Artificial
  CRISPR gRNA sequence
atctctggactccctcaggg

SEQ ID NO: 188033 - DNA, 20 bp, Artificial
  CRISPR gRNA sequence
tggactccctcagggctatg

SEQ ID NO: 188034 - DNA, 20 bp, Artificial
  CRISPR gRNA sequence
gactccctcagggctatgac

SEQ ID NO: 188035 - DNA, 20 bp, Artificial
  CRISPR gRNA sequence
cctcagggctatgacacagg

SEQ ID NO: 188036 - DNA, 20 bp, Artificial
  CRISPR gRNA sequence
agggctatgacacaggtact

SEQ ID NO: 188037 - DNA, 20 bp, Artificial
  CRISPR gRNA sequence
tgacacaggtactctctcca

SEQ ID NO: 188038 - DNA, 20 bp, Artificial
  CRISPR gRNA sequence
tctccactcatctcaccacc

SEQ ID NO: 188039 - DNA, 20 bp, Artificial
  CRISPR gRNA sequence
tccactcatctcaccaccca

SEQ ID NO: 188040 - DNA, 20 bp, Artificial
  CRISPR gRNA sequence
cactcatctcaccacccagc

SEQ ID NO: 188041 - DNA, 20 bp, Artificial
  CRISPR gRNA sequence
atctcaccacccagccatct

SEQ ID NO: 188042 - DNA, 20 bp, Artificial
  CRISPR gRNA sequence
accacccagccatctttacc

SEQ ID NO: 188043 - DNA, 20 bp, Artificial
  CRISPR gRNA sequence
tacctttgctgaaaccccag

SEQ ID NO: 188044 - DNA, 20 bp, Artificial
  CRISPR gRNA sequence
acctttgctgaaaccccagt

SEQ ID NO: 188045 - DNA, 20 bp, Artificial
  CRISPR gRNA sequence
cctttgctgaaaccccagta

SEQ ID NO: 188046 - DNA, 20 bp, Artificial
  CRISPR gRNA sequence
tgctgaaaccccagtagtct

SEQ ID NO: 188047 - DNA, 20 bp, Artificial
  CRISPR gRNA sequence
gctgaaaccccagtagtctt

SEQ ID NO: 188048 - DNA, 20 bp, Artificial
  CRISPR gRNA sequence
ctgaaaccccagtagtcttg

SEQ ID NO: 188049 - DNA, 20 bp, Artificial
  CRISPR gRNA sequence
aaaccccagtagtcttgcct

SEQ ID NO: 188050 - DNA, 20 bp, Artificial
  CRISPR gRNA sequence
gcctttatccttcagttcct

SEQ ID NO: 188051 - DNA, 20 bp, Artificial
  CRISPR gRNA sequence
cctttatccttcagttcctc

SEQ ID NO: 188052 - DNA, 20 bp, Artificial
  CRISPR gRNA sequence
tatccttcagttcctcctta

SEQ ID NO: 188053 - DNA, 20 bp, Artificial
  CRISPR gRNA sequence
atccttcagttcctccttac

SEQ ID NO: 188054 - DNA, 20 bp, Artificial
  CRISPR gRNA sequence
tccttcagttcctccttact

SEQ ID NO: 188055 - DNA, 20 bp, Artificial
  CRISPR gRNA sequence
cagttcctccttactcatgg

SEQ ID NO: 188056 - DNA, 20 bp, Artificial
  CRISPR gRNA sequence
agttcctccttactcatgga

SEQ ID NO: 188057 - DNA, 20 bp, Artificial
  CRISPR gRNA sequence
ctccttactcatggacatca

SEQ ID NO: 188058 - DNA, 20 bp, Artificial
  CRISPR gRNA sequence
cttactcatggacatcaatt

SEQ ID NO: 188059 - DNA, 20 bp, Artificial
  CRISPR gRNA sequence
actcatggacatcaatttga

SEQ ID NO: 188060 - DNA, 20 bp, Artificial
  CRISPR gRNA sequence
ctcatggacatcaatttgaa

SEQ ID NO: 188061 - DNA, 20 bp, Artificial
  CRISPR gRNA sequence
atggacatcaatttgaagtt

SEQ ID NO: 188062 - DNA, 20 bp, Artificial
  CRISPR gRNA sequence
gaagttgtaagatcatgctc

SEQ ID NO: 188063 - DNA, 20 bp, Artificial
  CRISPR gRNA sequence
aagttgtaagatcatgctcc

SEQ ID NO: 188064 - DNA, 20 bp, Artificial
  CRISPR gRNA sequence
taagatcatgctcctatggc

SEQ ID NO: 188065 - DNA, 20 bp, Artificial
  CRISPR gRNA sequence
ctatggcttcttcatcctga

SEQ ID NO: 188066 - DNA, 20 bp, Artificial
  CRISPR gRNA sequence
tggcttcttcatcctgacat

SEQ ID NO: 188067 - DNA, 20 bp, Artificial
  CRISPR gRNA sequence
cttcatcctgacatcctcag

SEQ ID NO: 188068 - DNA, 20 bp, Artificial
  CRISPR gRNA sequence
ttcatcctgacatcctcagg

SEQ ID NO: 188069 - DNA, 20 bp, Artificial
  CRISPR gRNA sequence
catcctgacatcctcaggat

SEQ ID NO: 188070 - DNA, 20 bp, Artificial
  CRISPR gRNA sequence
atcctgacatcctcaggatt

SEQ ID NO: 188071 - DNA, 20 bp, Artificial
  CRISPR gRNA sequence
acatcctcaggattctgttc

SEQ ID NO: 188072 - DNA, 20 bp, Artificial
  CRISPR gRNA sequence
aggattctgttcatcttccc

SEQ ID NO: 188073 - DNA, 20 bp, Artificial
  CRISPR gRNA sequence
tgttcatcttcccagaatct

SEQ ID NO: 188074 - DNA, 20 bp, Artificial
  CRISPR gRNA sequence
ttcatcttcccagaatctcc

SEQ ID NO: 188075 - DNA, 20 bp, Artificial
  CRISPR gRNA sequence
atcttcccagaatctcccct

SEQ ID NO: 188076 - DNA, 20 bp, Artificial
  CRISPR gRNA sequence
cccagaatctcccctatcca

SEQ ID NO: 188077 - DNA, 20 bp, Artificial
  CRISPR gRNA sequence
ccagaatctcccctatccag

SEQ ID NO: 188078 - DNA, 20 bp, Artificial
  CRISPR gRNA sequence
ccctatccagctacaaccgt

SEQ ID NO: 188079 - DNA, 20 bp, Artificial
  CRISPR gRNA sequence
tccagctacaaccgtcagat

SEQ ID NO: 188080 - DNA, 20 bp, Artificial
  CRISPR gRNA sequence
caaccgtcagatcttggtgt

SEQ ID NO: 188081 - DNA, 20 bp, Artificial
  CRISPR gRNA sequence
ggtgtgtgtgagtgcgtgaa

SEQ ID NO: 188082 - DNA, 20 bp, Artificial
  CRISPR gRNA sequence
gtgtgtgtgagtgcgtgaat

SEQ ID NO: 188083 - DNA, 20 bp, Artificial
  CRISPR gRNA sequence
tgtgcatgtacatgcgtgca

SEQ ID NO: 188084 - DNA, 20 bp, Artificial
  CRISPR gRNA sequence
taccgttctcatcttggccc

SEQ ID NO: 188085 - DNA, 20 bp, Artificial
  CRISPR gRNA sequence
tcatcttggccctttgctct

SEQ ID NO: 188086 - DNA, 20 bp, Artificial
  CRISPR gRNA sequence
atcttggccctttgctctgc

SEQ ID NO: 188087 - DNA, 20 bp, Artificial
  CRISPR gRNA sequence
ggccctttgctctgcagagg

SEQ ID NO: 188088 - DNA, 20 bp, Artificial
  CRISPR gRNA sequence
gccctttgctctgcagaggt

SEQ ID NO: 188089 - DNA, 20 bp, Artificial
  CRISPR gRNA sequence
tgctctgcagaggtagacga

SEQ ID NO: 188090 - DNA, 20 bp, Artificial
  CRISPR gRNA sequence
gctctgcagaggtagacgag

SEQ ID NO: 188091 - DNA, 20 bp, Artificial
  CRISPR gRNA sequence
ctctgcagaggtagacgagg

SEQ ID NO: 188092 - DNA, 20 bp, Artificial
  CRISPR gRNA sequence
tgcagaggtagacgaggctg

SEQ ID NO: 188093 - DNA, 20 bp, Artificial
  CRISPR gRNA sequence
cagaggtagacgaggctggg

SEQ ID NO: 188094 - DNA, 20 bp, Artificial
  CRISPR gRNA sequence
ggagccagctgtcagggggt

SEQ ID NO: 188095 - DNA, 20 bp, Artificial
  CRISPR gRNA sequence
tcagggggtcagcgacaggc

SEQ ID NO: 188096 - DNA, 20 bp, Artificial
  CRISPR gRNA sequence
gcccgagcattgatccggaa

SEQ ID NO: 188097 - DNA, 20 bp, Artificial
  CRISPR gRNA sequence
atccggaaaccgtgtgtact

SEQ ID NO: 188098 - DNA, 20 bp, Artificial
  CRISPR gRNA sequence
atcctggatgatgccaccag

SEQ ID NO: 188099 - DNA, 20 bp, Artificial
  CRISPR gRNA sequence
tcctggatgatgccaccagt

SEQ ID NO: 188100 - DNA, 20 bp, Artificial
  CRISPR gRNA sequence
gatgatgccaccagtgccct

SEQ ID NO: 188101 - DNA, 20 bp, Artificial
  CRISPR gRNA sequence
gatgcaaacagccagttaca

SEQ ID NO: 188102 - DNA, 20 bp, Artificial
  CRISPR gRNA sequence
caggtgaggcagtcatcttc

SEQ ID NO: 188103 - DNA, 20 bp, Artificial
  CRISPR gRNA sequence
cttaatggctatatcccacc

SEQ ID NO: 188104 - DNA, 20 bp, Artificial
  CRISPR gRNA sequence
ttaatggctatatcccaccc

SEQ ID NO: 188105 - DNA, 20 bp, Artificial
  CRISPR gRNA sequence
aatggctatatcccacccaa

SEQ ID NO: 188106 - DNA, 20 bp, Artificial
  CRISPR gRNA sequence
atggctatatcccacccaat

SEQ ID NO: 188107 - DNA, 20 bp, Artificial
  CRISPR gRNA sequence
tatcccacccaatcttgctt

SEQ ID NO: 188108 - DNA, 20 bp, Artificial
  CRISPR gRNA sequence
gcttcttttatacatcttct

SEQ ID NO: 188109 - DNA, 20 bp, Artificial
  CRISPR gRNA sequence
cttcttttatacatcttctg

SEQ ID NO: 188110 - DNA, 20 bp, Artificial
  CRISPR gRNA sequence
cttttatacatcttctgtta

SEQ ID NO: 188111 - DNA, 20 bp, Artificial
  CRISPR gRNA sequence
ttttatacatcttctgttag

SEQ ID NO: 188112 - DNA, 20 bp, Artificial
  CRISPR gRNA sequence
ttatacatcttctgttagtt

SEQ ID NO: 188113 - DNA, 20 bp, Artificial
  CRISPR gRNA sequence
tatacatcttctgttagttt

SEQ ID NO: 188114 - DNA, 20 bp, Artificial
  CRISPR gRNA sequence
atacatcttctgttagtttt

SEQ ID NO: 188115 - DNA, 20 bp, Artificial
  CRISPR gRNA sequence
tacatcttctgttagtttta

SEQ ID NO: 188116 - DNA, 20 bp, Artificial
  CRISPR gRNA sequence
ctgttagttttactaacatc

SEQ ID NO: 188117 - DNA, 20 bp, Artificial
  CRISPR gRNA sequence
tgttagttttactaacatca

SEQ ID NO: 188118 - DNA, 20 bp, Artificial
  CRISPR gRNA sequence
ttagttttactaacatcata

SEQ ID NO: 188119 - DNA, 20 bp, Artificial
  CRISPR gRNA sequence
gttttactaacatcataatt

SEQ ID NO: 188120 - DNA, 20 bp, Artificial
  CRISPR gRNA sequence
tactaacatcataattatac

SEQ ID NO: 188121 - DNA, 20 bp, Artificial
  CRISPR gRNA sequence
actaacatcataattataca

SEQ ID NO: 188122 - DNA, 20 bp, Artificial
  CRISPR gRNA sequence
ctaacatcataattatacaa

SEQ ID NO: 188123 - DNA, 20 bp, Artificial
  CRISPR gRNA sequence
acatcataattatacaaacc

SEQ ID NO: 188124 - DNA, 20 bp, Artificial
  CRISPR gRNA sequence
tacaaaccagtccttgcagt

SEQ ID NO: 188125 - DNA, 20 bp, Artificial
  CRISPR gRNA sequence
gcagttctcagttcccaaat

SEQ ID NO: 188126 - DNA, 20 bp, Artificial
  CRISPR gRNA sequence
cagttctcagttcccaaatc

SEQ ID NO: 188127 - DNA, 20 bp, Artificial
  CRISPR gRNA sequence
tcagttcccaaatccagttc

SEQ ID NO: 188128 - DNA, 20 bp, Artificial
  CRISPR gRNA sequence
agttcccaaatccagttcca

SEQ ID NO: 188129 - DNA, 20 bp, Artificial
  CRISPR gRNA sequence
ccaaatccagttccattgga

SEQ ID NO: 188130 - DNA, 20 bp, Artificial
  CRISPR gRNA sequence
cattggatgcctccccaagg

SEQ ID NO: 188131 - DNA, 20 bp, Artificial
  CRISPR gRNA sequence
gatgcctccccaaggagtag

SEQ ID NO: 188132 - DNA, 20 bp, Artificial
  CRISPR gRNA sequence
cccaaggagtagagatagaa

SEQ ID NO: 188133 - DNA, 20 bp, Artificial
  CRISPR gRNA sequence
gaatcagttaaaagagacta

SEQ ID NO: 188134 - DNA, 20 bp, Artificial
  CRISPR gRNA sequence
aaagagactatctacaaact

SEQ ID NO: 188135 - DNA, 20 bp, Artificial
  CRISPR gRNA sequence
tctacaaactacagactgaa

SEQ ID NO: 188136 - DNA, 20 bp, Artificial
  CRISPR gRNA sequence
caaactacagactgaatttc

SEQ ID NO: 188137 - DNA, 20 bp, Artificial
  CRISPR gRNA sequence
cagactgaatttctttcttt

SEQ ID NO: 188138 - DNA, 20 bp, Artificial
  CRISPR gRNA sequence
aatttctttctttctttcct

SEQ ID NO: 188139 - DNA, 20 bp, Artificial
  CRISPR gRNA sequence
ctttctttctttcctttttt

SEQ ID NO: 188140 - DNA, 20 bp, Artificial
  CRISPR gRNA sequence
tttctttctttccttttttt

SEQ ID NO: 188141 - DNA, 20 bp, Artificial
  CRISPR gRNA sequence
tctttctttccttttttttt

SEQ ID NO: 188142 - DNA, 20 bp, Artificial
  CRISPR gRNA sequence
ctttctttcctttttttttt

SEQ ID NO: 188143 - DNA, 20 bp, Artificial
  CRISPR gRNA sequence
tttctttccttttttttttt

SEQ ID NO: 188144 - DNA, 20 bp, Artificial
  CRISPR gRNA sequence
tctttcctttttttttttta

SEQ ID NO: 188145 - DNA, 20 bp, Artificial
  CRISPR gRNA sequence
ctttccttttttttttttaa

SEQ ID NO: 188146 - DNA, 20 bp, Artificial
  CRISPR gRNA sequence
tttccttttttttttttaag

SEQ ID NO: 188147 - DNA, 20 bp, Artificial
  CRISPR gRNA sequence
tccttttttttttttaagac

SEQ ID NO: 188148 - DNA, 20 bp, Artificial
  CRISPR gRNA sequence
ccttttttttttttaagaca

SEQ ID NO: 188149 - DNA, 20 bp, Artificial
  CRISPR gRNA sequence
cttttttttttttaagacag

SEQ ID NO: 188150 - DNA, 20 bp, Artificial
  CRISPR gRNA sequence
ttttttttttaagacagtgt

SEQ ID NO: 188151 - DNA, 20 bp, Artificial
  CRISPR gRNA sequence
tttttttttaagacagtgtc

SEQ ID NO: 188152 - DNA, 20 bp, Artificial
  CRISPR gRNA sequence
ttttttttaagacagtgtct

SEQ ID NO: 188153 - DNA, 20 bp, Artificial
  CRISPR gRNA sequence
tttttttaagacagtgtctc

SEQ ID NO: 188154 - DNA, 20 bp, Artificial
  CRISPR gRNA sequence
ttttttaagacagtgtctca

SEQ ID NO: 188155 - DNA, 20 bp, Artificial
  CRISPR gRNA sequence
tttttaagacagtgtctcac

SEQ ID NO: 188156 - DNA, 20 bp, Artificial
  CRISPR gRNA sequence
ttttaagacagtgtctcact

SEQ ID NO: 188157 - DNA, 20 bp, Artificial
  CRISPR gRNA sequence
tttaagacagtgtctcactc

SEQ ID NO: 188158 - DNA, 20 bp, Artificial
  CRISPR gRNA sequence
ttaagacagtgtctcactca

SEQ ID NO: 188159 - DNA, 20 bp, Artificial
  CRISPR gRNA sequence
taagacagtgtctcactcag

SEQ ID NO: 188160 - DNA, 20 bp, Artificial
  CRISPR gRNA sequence
aagacagtgtctcactcagt

SEQ ID NO: 188161 - DNA, 20 bp, Artificial
  CRISPR gRNA sequence
agacagtgtctcactcagtt

SEQ ID NO: 188162 - DNA, 20 bp, Artificial
  CRISPR gRNA sequence
actcagttgcccaggctgga

SEQ ID NO: 188163 - DNA, 20 bp, Artificial
  CRISPR gRNA sequence
agttgcccaggctggagcgc

SEQ ID NO: 188164 - DNA, 20 bp, Artificial
  CRISPR gRNA sequence
cccaggctggagcgcagtgg

SEQ ID NO: 188165 - DNA, 20 bp, Artificial
  CRISPR gRNA sequence
gagcgcagtggcacaatctt

SEQ ID NO: 188166 - DNA, 20 bp, Artificial
  CRISPR gRNA sequence
ggctcactgcagcttcaacc

SEQ ID NO: 188167 - DNA, 20 bp, Artificial
  CRISPR gRNA sequence
gctcactgcagcttcaacct

SEQ ID NO: 188168 - DNA, 20 bp, Artificial
  CRISPR gRNA sequence
actgcagcttcaacctgctg

SEQ ID NO: 188169 - DNA, 20 bp, Artificial
  CRISPR gRNA sequence
cagcttcaacctgctgggct

SEQ ID NO: 188170 - DNA, 20 bp, Artificial
  CRISPR gRNA sequence
caacctgctgggctcaagcg

SEQ ID NO: 188171 - DNA, 20 bp, Artificial
  CRISPR gRNA sequence
aacctgctgggctcaagcga

SEQ ID NO: 188172 - DNA, 20 bp, Artificial
  CRISPR gRNA sequence
ctgggctcaagcgattctcc

SEQ ID NO: 188173 - DNA, 20 bp, Artificial
  CRISPR gRNA sequence
ggctcaagcgattctcccct

SEQ ID NO: 188174 - DNA, 20 bp, Artificial
  CRISPR gRNA sequence
aagcgattctcccctcagcc

SEQ ID NO: 188175 - DNA, 20 bp, Artificial
  CRISPR gRNA sequence
tcccctcagcctcccgagta

SEQ ID NO: 188176 - DNA, 20 bp, Artificial
  CRISPR gRNA sequence
ccctcagcctcccgagtagc

SEQ ID NO: 188177 - DNA, 20 bp, Artificial
  CRISPR gRNA sequence
agcctcccgagtagctggga

SEQ ID NO: 188178 - DNA, 20 bp, Artificial
  CRISPR gRNA sequence
ccgagtagctgggactacag

SEQ ID NO: 188179 - DNA, 20 bp, Artificial
  CRISPR gRNA sequence
ggactacaggtgtacaccac

SEQ ID NO: 188180 - DNA, 20 bp, Artificial
  CRISPR gRNA sequence
caggtgtacaccactatgcc

SEQ ID NO: 188181 - DNA, 20 bp, Artificial
  CRISPR gRNA sequence
tgcctggttgacttttatat

SEQ ID NO: 188182 - DNA, 20 bp, Artificial
  CRISPR gRNA sequence
gttgacttttatatttttag

SEQ ID NO: 188183 - DNA, 20 bp, Artificial
  CRISPR gRNA sequence
acttttatatttttagtaga

SEQ ID NO: 188184 - DNA, 20 bp, Artificial
  CRISPR gRNA sequence
ttatatttttagtagagatg

SEQ ID NO: 188185 - DNA, 20 bp, Artificial
  CRISPR gRNA sequence
tatatttttagtagagatgg

SEQ ID NO: 188186 - DNA, 20 bp, Artificial
  CRISPR gRNA sequence
atatttttagtagagatggg

SEQ ID NO: 188187 - DNA, 20 bp, Artificial
  CRISPR gRNA sequence
tatttttagtagagatgggt

SEQ ID NO: 188188 - DNA, 20 bp, Artificial
  CRISPR gRNA sequence
ttagtagagatgggtttcac

SEQ ID NO: 188189 - DNA, 20 bp, Artificial
  CRISPR gRNA sequence
tagtagagatgggtttcacc

SEQ ID NO: 188190 - DNA, 20 bp, Artificial
  CRISPR gRNA sequence
agtagagatgggtttcacca

SEQ ID NO: 188191 - DNA, 20 bp, Artificial
  CRISPR gRNA sequence
gtagagatgggtttcaccat

SEQ ID NO: 188192 - DNA, 20 bp, Artificial
  CRISPR gRNA sequence
caccatgttgcccaggctgg

SEQ ID NO: 188193 - DNA, 20 bp, Artificial
  CRISPR gRNA sequence
accatgttgcccaggctggc

SEQ ID NO: 188194 - DNA, 20 bp, Artificial
  CRISPR gRNA sequence
cccaggctggccttgaattc

SEQ ID NO: 188195 - DNA, 20 bp, Artificial
  CRISPR gRNA sequence
gccttgaattcctgagctca

SEQ ID NO: 188196 - DNA, 20 bp, Artificial
  CRISPR gRNA sequence
gaattcctgagctcaggtaa

SEQ ID NO: 188197 - DNA, 20 bp, Artificial
  CRISPR gRNA sequence
aattcctgagctcaggtaat

SEQ ID NO: 188198 - DNA, 20 bp, Artificial
  CRISPR gRNA sequence
ctgagctcaggtaatctgcc

SEQ ID NO: 188199 - DNA, 20 bp, Artificial
  CRISPR gRNA sequence
agctcaggtaatctgccccc

SEQ ID NO: 188200 - DNA, 20 bp, Artificial
  CRISPR gRNA sequence
aggtaatctgcccccctcag

SEQ ID NO: 188201 - DNA, 20 bp, Artificial
  CRISPR gRNA sequence
cccccctcagcctcccaaag

SEQ ID NO: 188202 - DNA, 20 bp, Artificial
  CRISPR gRNA sequence
agcctcccaaagggctgggg

SEQ ID NO: 188203 - DNA, 20 bp, Artificial
  CRISPR gRNA sequence
ccaaagggctggggttatag

SEQ ID NO: 188204 - DNA, 20 bp, Artificial
  CRISPR gRNA sequence
gggttataggtgtgagccac

SEQ ID NO: 188205 - DNA, 20 bp, Artificial
  CRISPR gRNA sequence
taggtgtgagccactgcgcc

SEQ ID NO: 188206 - DNA, 20 bp, Artificial
  CRISPR gRNA sequence
cgcccagtcctatagactga

SEQ ID NO: 188207 - DNA, 20 bp, Artificial
  CRISPR gRNA sequence
tagactgaatttctaaagcg

SEQ ID NO: 188208 - DNA, 20 bp, Artificial
  CRISPR gRNA sequence
aatttctaaagcgaaacata

SEQ ID NO: 188209 - DNA, 20 bp, Artificial
  CRISPR gRNA sequence
ctaaagcgaaacataaggaa

SEQ ID NO: 188210 - DNA, 20 bp, Artificial
  CRISPR gRNA sequence
taaagcgaaacataaggaaa

SEQ ID NO: 188211 - DNA, 20 bp, Artificial
  CRISPR gRNA sequence
aagcgaaacataaggaaaag

SEQ ID NO: 188212 - DNA, 20 bp, Artificial
  CRISPR gRNA sequence
ataatatcgtttatttaaaa

SEQ ID NO: 188213 - DNA, 20 bp, Artificial
  CRISPR gRNA sequence
atttaaaaaaattatttttt

SEQ ID NO: 188214 - DNA, 20 bp, Artificial
  CRISPR gRNA sequence
tttaaaaaaattattttttg

SEQ ID NO: 188215 - DNA, 20 bp, Artificial
  CRISPR gRNA sequence
aaaaaaattattttttgtac

SEQ ID NO: 188216 - DNA, 20 bp, Artificial
  CRISPR gRNA sequence
aaaaaattattttttgtaca

SEQ ID NO: 188217 - DNA, 20 bp, Artificial
  CRISPR gRNA sequence
ttttttgtacagacagcgtc

SEQ ID NO: 188218 - DNA, 20 bp, Artificial
  CRISPR gRNA sequence
tttgtacagacagcgtcccg

SEQ ID NO: 188219 - DNA, 20 bp, Artificial
  CRISPR gRNA sequence
ttgtacagacagcgtcccgc

SEQ ID NO: 188220 - DNA, 20 bp, Artificial
  CRISPR gRNA sequence
tgtacagacagcgtcccgct

SEQ ID NO: 188221 - DNA, 20 bp, Artificial
  CRISPR gRNA sequence
gtacagacagcgtcccgcta

SEQ ID NO: 188222 - DNA, 20 bp, Artificial
  CRISPR gRNA sequence
tacagacagcgtcccgctat

SEQ ID NO: 188223 - DNA, 20 bp, Artificial
  CRISPR gRNA sequence
tgttgcccaggctggccttg

SEQ ID NO: 188224 - DNA, 20 bp, Artificial
  CRISPR gRNA sequence
cccaggctggccttgaactc

SEQ ID NO: 188225 - DNA, 20 bp, Artificial
  CRISPR gRNA sequence
gccttgaactcctgggccca

SEQ ID NO: 188226 - DNA, 20 bp, Artificial
  CRISPR gRNA sequence
gaactcctgggcccaagtga

SEQ ID NO: 188227 - DNA, 20 bp, Artificial
  CRISPR gRNA sequence
aactcctgggcccaagtgat

SEQ ID NO: 188228 - DNA, 20 bp, Artificial
  CRISPR gRNA sequence
ctgggcccaagtgatcctcc

SEQ ID NO: 188229 - DNA, 20 bp, Artificial
  CRISPR gRNA sequence
ggcccaagtgatcctccctc

SEQ ID NO: 188230 - DNA, 20 bp, Artificial
  CRISPR gRNA sequence
cctccttgacctcccaaagt

SEQ ID NO: 188231 - DNA, 20 bp, Artificial
  CRISPR gRNA sequence
cttgacctcccaaagtgcta

SEQ ID NO: 188232 - DNA, 20 bp, Artificial
  CRISPR gRNA sequence
gacctcccaaagtgctagga

SEQ ID NO: 188233 - DNA, 20 bp, Artificial
  CRISPR gRNA sequence
acctcccaaagtgctaggat

SEQ ID NO: 188234 - DNA, 20 bp, Artificial
  CRISPR gRNA sequence
ccaaagtgctaggattatag

SEQ ID NO: 188235 - DNA, 20 bp, Artificial
  CRISPR gRNA sequence
ggattataggcatgagccac

SEQ ID NO: 188236 - DNA, 20 bp, Artificial
  CRISPR gRNA sequence
taggcatgagccaccgggcc

SEQ ID NO: 188237 - DNA, 20 bp, Artificial
  CRISPR gRNA sequence
atcatattaatattaattaa

SEQ ID NO: 188238 - DNA, 20 bp, Artificial
  CRISPR gRNA sequence
atattaattaagctagtctg

SEQ ID NO: 188239 - DNA, 20 bp, Artificial
  CRISPR gRNA sequence
attaagctagtctgtttaca

SEQ ID NO: 188240 - DNA, 20 bp, Artificial
  CRISPR gRNA sequence
agctagtctgtttacatgca

SEQ ID NO: 188241 - DNA, 20 bp, Artificial
  CRISPR gRNA sequence
gtctgtttacatgcactgtc

SEQ ID NO: 188242 - DNA, 20 bp, Artificial
  CRISPR gRNA sequence
tttacatgcactgtcactca

SEQ ID NO: 188243 - DNA, 20 bp, Artificial
  CRISPR gRNA sequence
acatgcactgtcactcattt

SEQ ID NO: 188244 - DNA, 20 bp, Artificial
  CRISPR gRNA sequence
catgcactgtcactcattta

SEQ ID NO: 188245 - DNA, 20 bp, Artificial
  CRISPR gRNA sequence
tcactcatttattcattagg

SEQ ID NO: 188246 - DNA, 20 bp, Artificial
  CRISPR gRNA sequence
atttattcattaggaatcct

SEQ ID NO: 188247 - DNA, 20 bp, Artificial
  CRISPR gRNA sequence
attcattaggaatccttctg

SEQ ID NO: 188248 - DNA, 20 bp, Artificial
  CRISPR gRNA sequence
ttcattaggaatccttctga

SEQ ID NO: 188249 - DNA, 20 bp, Artificial
  CRISPR gRNA sequence
attaggaatccttctgagct

SEQ ID NO: 188250 - DNA, 20 bp, Artificial
  CRISPR gRNA sequence
ggaatccttctgagctaggc

SEQ ID NO: 188251 - DNA, 20 bp, Artificial
  CRISPR gRNA sequence
ctgagctaggcatttatcat

SEQ ID NO: 188252 - DNA, 20 bp, Artificial
  CRISPR gRNA sequence
tgagctaggcatttatcatc

SEQ ID NO: 188253 - DNA, 20 bp, Artificial
  CRISPR gRNA sequence
agctaggcatttatcatcat

SEQ ID NO: 188254 - DNA, 20 bp, Artificial
  CRISPR gRNA sequence
ggcatttatcatcattctac

SEQ ID NO: 188255 - DNA, 20 bp, Artificial
  CRISPR gRNA sequence
atcatcattctacagatgac

SEQ ID NO: 188256 - DNA, 20 bp, Artificial
  CRISPR gRNA sequence
tcatcattctacagatgaca

SEQ ID NO: 188257 - DNA, 20 bp, Artificial
  CRISPR gRNA sequence
tacagatgacaaaatggagg

SEQ ID NO: 188258 - DNA, 20 bp, Artificial
  CRISPR gRNA sequence
cagatgacaaaatggaggtt

SEQ ID NO: 188259 - DNA, 20 bp, Artificial
  CRISPR gRNA sequence
aaagaggttgaataagctgc

SEQ ID NO: 188260 - DNA, 20 bp, Artificial
  CRISPR gRNA sequence
aataagctgctcatatagag

SEQ ID NO: 188261 - DNA, 20 bp, Artificial
  CRISPR gRNA sequence
ctcatatagaggtcatatag

SEQ ID NO: 188262 - DNA, 20 bp, Artificial
  CRISPR gRNA sequence
atatagaggtcatatagctt

SEQ ID NO: 188263 - DNA, 20 bp, Artificial
  CRISPR gRNA sequence
ttgagtggcgcagccttgac

SEQ ID NO: 188264 - DNA, 20 bp, Artificial
  CRISPR gRNA sequence
tgagtggcgcagccttgacc

SEQ ID NO: 188265 - DNA, 20 bp, Artificial
  CRISPR gRNA sequence
gagtggcgcagccttgaccc

SEQ ID NO: 188266 - DNA, 20 bp, Artificial
  CRISPR gRNA sequence
agtggcgcagccttgaccca

SEQ ID NO: 188267 - DNA, 20 bp, Artificial
  CRISPR gRNA sequence
gacccaaattcaggtctgcc

SEQ ID NO: 188268 - DNA, 20 bp, Artificial
  CRISPR gRNA sequence
acccaaattcaggtctgcct

SEQ ID NO: 188269 - DNA, 20 bp, Artificial
  CRISPR gRNA sequence
aggtctgcctgacttgaatg

SEQ ID NO: 188270 - DNA, 20 bp, Artificial
  CRISPR gRNA sequence
cctgacttgaatgctcatct

SEQ ID NO: 188271 - DNA, 20 bp, Artificial
  CRISPR gRNA sequence
acttgaatgctcatctcttt

SEQ ID NO: 188272 - DNA, 20 bp, Artificial
  CRISPR gRNA sequence
gaatgctcatctctttacta

SEQ ID NO: 188273 - DNA, 20 bp, Artificial
  CRISPR gRNA sequence
aatgctcatctctttactac

SEQ ID NO: 188274 - DNA, 20 bp, Artificial
  CRISPR gRNA sequence
atctctttactactaagtta

SEQ ID NO: 188275 - DNA, 20 bp, Artificial
  CRISPR gRNA sequence
tttactactaagttatattt

SEQ ID NO: 188276 - DNA, 20 bp, Artificial
  CRISPR gRNA sequence
tactactaagttatatttcc

SEQ ID NO: 188277 - DNA, 20 bp, Artificial
  CRISPR gRNA sequence
actactaagttatatttcct

SEQ ID NO: 188278 - DNA, 20 bp, Artificial
  CRISPR gRNA sequence
ctactaagttatatttcctt

SEQ ID NO: 188279 - DNA, 20 bp, Artificial
  CRISPR gRNA sequence
ctaagttatatttccttaaa

SEQ ID NO: 188280 - DNA, 20 bp, Artificial
  CRISPR gRNA sequence
agttatatttccttaaaatc

SEQ ID NO: 188281 - DNA, 20 bp, Artificial
  CRISPR gRNA sequence
tatttccttaaaatcgaata

SEQ ID NO: 188282 - DNA, 20 bp, Artificial
  CRISPR gRNA sequence
ccttaaaatcgaatataaaa

SEQ ID NO: 188283 - DNA, 20 bp, Artificial
  CRISPR gRNA sequence
cttaaaatcgaatataaaaa

SEQ ID NO: 188284 - DNA, 20 bp, Artificial
  CRISPR gRNA sequence
aaaatcgaatataaaaatgc

SEQ ID NO: 188285 - DNA, 20 bp, Artificial
  CRISPR gRNA sequence
aaatcgaatataaaaatgcc

SEQ ID NO: 188286 - DNA, 20 bp, Artificial
  CRISPR gRNA sequence
ttcaatagtctttattcttc

SEQ ID NO: 188287 - DNA, 20 bp, Artificial
  CRISPR gRNA sequence
aatagtctttattcttctgt

SEQ ID NO: 188288 - DNA, 20 bp, Artificial
  CRISPR gRNA sequence
tattcttctgtcacgtgttt

SEQ ID NO: 188289 - DNA, 20 bp, Artificial
  CRISPR gRNA sequence
attcttctgtcacgtgtttc

SEQ ID NO: 188290 - DNA, 20 bp, Artificial
  CRISPR gRNA sequence
ttcttctgtcacgtgtttca

SEQ ID NO: 188291 - DNA, 20 bp, Artificial
  CRISPR gRNA sequence
ttctgtcacgtgtttcaccc

SEQ ID NO: 188292 - DNA, 20 bp, Artificial
  CRISPR gRNA sequence
ctgtcacgtgtttcacccta

SEQ ID NO: 188293 - DNA, 20 bp, Artificial
  CRISPR gRNA sequence
tgtcacgtgtttcaccctag

SEQ ID NO: 188294 - DNA, 20 bp, Artificial
  CRISPR gRNA sequence
tcacgtgtttcaccctaggg

SEQ ID NO: 188295 - DNA, 20 bp, Artificial
  CRISPR gRNA sequence
caccctagggttctcatttt

SEQ ID NO: 188296 - DNA, 20 bp, Artificial
  CRISPR gRNA sequence
accctagggttctcattttt

SEQ ID NO: 188297 - DNA, 20 bp, Artificial
  CRISPR gRNA sequence
gggttctcatttttatccta

SEQ ID NO: 188298 - DNA, 20 bp, Artificial
  CRISPR gRNA sequence
tcatttttatcctacttttg

SEQ ID NO: 188299 - DNA, 20 bp, Artificial
  CRISPR gRNA sequence
atttttatcctacttttgca

SEQ ID NO: 188300 - DNA, 20 bp, Artificial
  CRISPR gRNA sequence
ttatcctacttttgcaccct

SEQ ID NO: 188301 - DNA, 20 bp, Artificial
  CRISPR gRNA sequence
tatcctacttttgcaccctt

SEQ ID NO: 188302 - DNA, 20 bp, Artificial
  CRISPR gRNA sequence
atcctacttttgcacccttc

SEQ ID NO: 188303 - DNA, 20 bp, Artificial
  CRISPR gRNA sequence
tcctacttttgcacccttca

SEQ ID NO: 188304 - DNA, 20 bp, Artificial
  CRISPR gRNA sequence
cttttgcacccttcatgtaa

SEQ ID NO: 188305 - DNA, 20 bp, Artificial
  CRISPR gRNA sequence
ttgcacccttcatgtaaaac

SEQ ID NO: 188306 - DNA, 20 bp, Artificial
  CRISPR gRNA sequence
tgcacccttcatgtaaaaca

SEQ ID NO: 188307 - DNA, 20 bp, Artificial
  CRISPR gRNA sequence
gcacccttcatgtaaaacag

SEQ ID NO: 188308 - DNA, 20 bp, Artificial
  CRISPR gRNA sequence
cacccttcatgtaaaacagt

SEQ ID NO: 188309 - DNA, 20 bp, Artificial
  CRISPR gRNA sequence
catgtaaaacagtccttaat

SEQ ID NO: 188310 - DNA, 20 bp, Artificial
  CRISPR gRNA sequence
atgtaaaacagtccttaatg

SEQ ID NO: 188311 - DNA, 20 bp, Artificial
  CRISPR gRNA sequence
aatgaaacaaagggtttgcg

SEQ ID NO: 188312 - DNA, 20 bp, Artificial
  CRISPR gRNA sequence
atgaaacaaagggtttgcgg

SEQ ID NO: 188313 - DNA, 20 bp, Artificial
  CRISPR gRNA sequence
gcggagaagtactcagaatg

SEQ ID NO: 188314 - DNA, 20 bp, Artificial
  CRISPR gRNA sequence
cggagaagtactcagaatgg

SEQ ID NO: 188315 - DNA, 20 bp, Artificial
  CRISPR gRNA sequence
agaatgggaaacgttggtgt

SEQ ID NO: 188316 - DNA, 20 bp, Artificial
  CRISPR gRNA sequence
gtgtccttggggttgttagc

SEQ ID NO: 188317 - DNA, 20 bp, Artificial
  CRISPR gRNA sequence
ggggttgttagcagagccag

SEQ ID NO: 188318 - DNA, 20 bp, Artificial
  CRISPR gRNA sequence
gggttgttagcagagccagc

SEQ ID NO: 188319 - DNA, 20 bp, Artificial
  CRISPR gRNA sequence
ttagcagagccagcagtgat

SEQ ID NO: 188320 - DNA, 20 bp, Artificial
  CRISPR gRNA sequence
gcagagccagcagtgatcct

SEQ ID NO: 188321 - DNA, 20 bp, Artificial
  CRISPR gRNA sequence
tgaggtcagtcccagccctg

SEQ ID NO: 188322 - DNA, 20 bp, Artificial
  CRISPR gRNA sequence
gaaacacaggtgtctccctg

SEQ ID NO: 188323 - DNA, 20 bp, Artificial
  CRISPR gRNA sequence
cctgggctgagggtagtccc

SEQ ID NO: 188324 - DNA, 20 bp, Artificial
  CRISPR gRNA sequence
ggctgagggtagtccccggc

SEQ ID NO: 188325 - DNA, 20 bp, Artificial
  CRISPR gRNA sequence
agggtagtccccggctctga

SEQ ID NO: 188326 - DNA, 20 bp, Artificial
  CRISPR gRNA sequence
tgacggtccgatgtctttcc

SEQ ID NO: 188327 - DNA, 20 bp, Artificial
  CRISPR gRNA sequence
acggtccgatgtctttcctc

SEQ ID NO: 188328 - DNA, 20 bp, Artificial
  CRISPR gRNA sequence
tcctcaggtggagcagctcc

SEQ ID NO: 188329 - DNA, 20 bp, Artificial
  CRISPR gRNA sequence
cctcaggtggagcagctcct

SEQ ID NO: 188330 - DNA, 20 bp, Artificial
  CRISPR gRNA sequence
ctcaggtggagcagctcctg

SEQ ID NO: 188331 - DNA, 20 bp, Artificial
  CRISPR gRNA sequence
aggtggagcagctcctgtac

SEQ ID NO: 188332 - DNA, 20 bp, Artificial
  CRISPR gRNA sequence
ctgtacgaaagccctgagcg

SEQ ID NO: 188333 - DNA, 20 bp, Artificial
  CRISPR gRNA sequence
tacgaaagccctgagcggta

SEQ ID NO: 188334 - DNA, 20 bp, Artificial
  CRISPR gRNA sequence
agcggtactcccgctcagtg

SEQ ID NO: 188335 - DNA, 20 bp, Artificial
  CRISPR gRNA sequence
ccgctcagtgcttctcatca

SEQ ID NO: 188336 - DNA, 20 bp, Artificial
  CRISPR gRNA sequence
agtgcttctcatcacccagc

SEQ ID NO: 188337 - DNA, 20 bp, Artificial
  CRISPR gRNA sequence
ctcatcacccagcacctcag

SEQ ID NO: 188338 - DNA, 20 bp, Artificial
  CRISPR gRNA sequence
tcatcacccagcacctcagc

SEQ ID NO: 188339 - DNA, 20 bp, Artificial
  CRISPR gRNA sequence
atcacccagcacctcagcct

SEQ ID NO: 188340 - DNA, 20 bp, Artificial
  CRISPR gRNA sequence
agcctggtggagcaggctga

SEQ ID NO: 188341 - DNA, 20 bp, Artificial
  CRISPR gRNA sequence
gtggagcaggctgaccacat

SEQ ID NO: 188342 - DNA, 20 bp, Artificial
  CRISPR gRNA sequence
accacatcctctttctggaa

SEQ ID NO: 188343 - DNA, 20 bp, Artificial
  CRISPR gRNA sequence
tttctggaaggaggcgctat

SEQ ID NO: 188344 - DNA, 20 bp, Artificial
  CRISPR gRNA sequence
tctggaaggaggcgctatcc

SEQ ID NO: 188345 - DNA, 20 bp, Artificial
  CRISPR gRNA sequence
ctggaaggaggcgctatccg

SEQ ID NO: 188346 - DNA, 20 bp, Artificial
  CRISPR gRNA sequence
tggaaggaggcgctatccgg

SEQ ID NO: 188347 - DNA, 20 bp, Artificial
  CRISPR gRNA sequence
gaaggaggcgctatccggga

SEQ ID NO: 188348 - DNA, 20 bp, Artificial
  CRISPR gRNA sequence
tccgggaggggggaacccac

SEQ ID NO: 188349 - DNA, 20 bp, Artificial
  CRISPR gRNA sequence
atggagaaaaaggggtgcta

SEQ ID NO: 188350 - DNA, 20 bp, Artificial
  CRISPR gRNA sequence
ctgggccatggtgcaggctc

SEQ ID NO: 188351 - DNA, 20 bp, Artificial
  CRISPR gRNA sequence
ggccatggtgcaggctcctg

SEQ ID NO: 188352 - DNA, 20 bp, Artificial
  CRISPR gRNA sequence
ctgcagatgctccagaatga

SEQ ID NO: 188353 - DNA, 20 bp, Artificial
  CRISPR gRNA sequence
cagatgctccagaatgaaag

SEQ ID NO: 188354 - DNA, 20 bp, Artificial
  CRISPR gRNA sequence
cagaatgaaagccttctcag

SEQ ID NO: 188355 - DNA, 20 bp, Artificial
  CRISPR gRNA sequence
ctcagacctgcgcactccat

SEQ ID NO: 188356 - DNA, 20 bp, Artificial
  CRISPR gRNA sequence
tcagacctgcgcactccatc

SEQ ID NO: 188357 - DNA, 20 bp, Artificial
  CRISPR gRNA sequence
agacctgcgcactccatctc

SEQ ID NO: 188358 - DNA, 20 bp, Artificial
  CRISPR gRNA sequence
cgcactccatctccctccct

SEQ ID NO: 188359 - DNA, 20 bp, Artificial
  CRISPR gRNA sequence
catctccctcccttttcttc

SEQ ID NO: 188360 - DNA, 20 bp, Artificial
  CRISPR gRNA sequence
cctcccttttcttctctctg

SEQ ID NO: 188361 - DNA, 20 bp, Artificial
  CRISPR gRNA sequence
ccttttcttctctctgtggt

SEQ ID NO: 188362 - DNA, 20 bp, Artificial
  CRISPR gRNA sequence
ttcttctctctgtggtggag

SEQ ID NO: 188363 - DNA, 20 bp, Artificial
  CRISPR gRNA sequence
tcttctctctgtggtggaga

SEQ ID NO: 188364 - DNA, 20 bp, Artificial
  CRISPR gRNA sequence
cttctctctgtggtggagaa

SEQ ID NO: 188365 - DNA, 20 bp, Artificial
  CRISPR gRNA sequence
ttctctctgtggtggagaac

SEQ ID NO: 188366 - DNA, 20 bp, Artificial
  CRISPR gRNA sequence
ctctctgtggtggagaacca

SEQ ID NO: 188367 - DNA, 20 bp, Artificial
  CRISPR gRNA sequence
tctctgtggtggagaaccac

SEQ ID NO: 188368 - DNA, 20 bp, Artificial
  CRISPR gRNA sequence
tctgtggtggagaaccacag

SEQ ID NO: 188369 - DNA, 20 bp, Artificial
  CRISPR gRNA sequence
tgtggtggagaaccacagct

SEQ ID NO: 188370 - DNA, 20 bp, Artificial
  CRISPR gRNA sequence
tggtggagaaccacagctgc

SEQ ID NO: 188371 - DNA, 20 bp, Artificial
  CRISPR gRNA sequence
cagagtaggcagctgcctcc

SEQ ID NO: 188372 - DNA, 20 bp, Artificial
  CRISPR gRNA sequence
taggtgacaggtttttagag

SEQ ID NO: 188373 - DNA, 20 bp, Artificial
  CRISPR gRNA sequence
aggtttttagagaagccaat

SEQ ID NO: 188374 - DNA, 20 bp, Artificial
  CRISPR gRNA sequence
gaagccaatcagcgtcgccg

SEQ ID NO: 188375 - DNA, 20 bp, Artificial
  CRISPR gRNA sequence
aatcagcgtcgccgcggtcc

SEQ ID NO: 188376 - DNA, 20 bp, Artificial
  CRISPR gRNA sequence
tcgccgcggtcctggttcta

SEQ ID NO: 188377 - DNA, 20 bp, Artificial
  CRISPR gRNA sequence
aaagtcctcgctcacccacc

SEQ ID NO: 188378 - DNA, 20 bp, Artificial
  CRISPR gRNA sequence
ccacccggactcattctccc

SEQ ID NO: 188379 - DNA, 20 bp, Artificial
  CRISPR gRNA sequence
actcattctccccagacgcc

SEQ ID NO: 188380 - DNA, 20 bp, Artificial
  CRISPR gRNA sequence
ctcattctccccagacgcca

SEQ ID NO: 188381 - DNA, 20 bp, Artificial
  CRISPR gRNA sequence
ttctccccagacgccaagga

SEQ ID NO: 188382 - DNA, 20 bp, Artificial
  CRISPR gRNA sequence
tccccagacgccaaggatgg

SEQ ID NO: 188383 - DNA, 20 bp, Artificial
  CRISPR gRNA sequence
gacgccaaggatggtggtca

SEQ ID NO: 188384 - DNA, 20 bp, Artificial
  CRISPR gRNA sequence
aaccctcttcctgctgctct

SEQ ID NO: 188385 - DNA, 20 bp, Artificial
  CRISPR gRNA sequence
accctcttcctgctgctctc

SEQ ID NO: 188386 - DNA, 20 bp, Artificial
  CRISPR gRNA sequence
ccctcttcctgctgctctcg

SEQ ID NO: 188387 - DNA, 20 bp, Artificial
  CRISPR gRNA sequence
cctcttcctgctgctctcgg

SEQ ID NO: 188388 - DNA, 20 bp, Artificial
  CRISPR gRNA sequence
cgggggccctgaccctgacc

SEQ ID NO: 188389 - DNA, 20 bp, Artificial
  CRISPR gRNA sequence
ccctgaccctgaccgagacc

SEQ ID NO: 188390 - DNA, 20 bp, Artificial
  CRISPR gRNA sequence
cctgaccctgaccgagacct

SEQ ID NO: 188391 - DNA, 20 bp, Artificial
  CRISPR gRNA sequence
gaccctgaccgagacctggg

SEQ ID NO: 188392 - DNA, 20 bp, Artificial
  CRISPR gRNA sequence
accctgaccgagacctgggc

SEQ ID NO: 188393 - DNA, 20 bp, Artificial
  CRISPR gRNA sequence
tgaccgagacctgggcgggt

SEQ ID NO: 188394 - DNA, 20 bp, Artificial
  CRISPR gRNA sequence
gagacctgggcgggtgagtg

SEQ ID NO: 188395 - DNA, 20 bp, Artificial
  CRISPR gRNA sequence
agacctgggcgggtgagtgc

SEQ ID NO: 188396 - DNA, 20 bp, Artificial
  CRISPR gRNA sequence
gacctgggcgggtgagtgcg

SEQ ID NO: 188397 - DNA, 20 bp, Artificial
  CRISPR gRNA sequence
tgggcgggtgagtgcggggt

SEQ ID NO: 188398 - DNA, 20 bp, Artificial
  CRISPR gRNA sequence
gggcgggtgagtgcggggtc

SEQ ID NO: 188399 - DNA, 20 bp, Artificial
  CRISPR gRNA sequence
gcgggtgagtgcggggtcag

SEQ ID NO: 188400 - DNA, 20 bp, Artificial
  CRISPR gRNA sequence
cgggtgagtgcggggtcagg

SEQ ID NO: 188401 - DNA, 20 bp, Artificial
  CRISPR gRNA sequence
gggtgagtgcggggtcagga

SEQ ID NO: 188402 - DNA, 20 bp, Artificial
  CRISPR gRNA sequence
gtgcggggtcaggagggaaa

SEQ ID NO: 188403 - DNA, 20 bp, Artificial
  CRISPR gRNA sequence
ggagggaaacggcccctgcg

SEQ ID NO: 188404 - DNA, 20 bp, Artificial
  CRISPR gRNA sequence
agggaaacggcccctgcgcg

SEQ ID NO: 188405 - DNA, 20 bp, Artificial
  CRISPR gRNA sequence
gggaaacggcccctgcgcgg

SEQ ID NO: 188406 - DNA, 20 bp, Artificial
  CRISPR gRNA sequence
gaaacggcccctgcgcggag

SEQ ID NO: 188407 - DNA, 20 bp, Artificial
  CRISPR gRNA sequence
aaacggcccctgcgcggagg

SEQ ID NO: 188408 - DNA, 20 bp, Artificial
  CRISPR gRNA sequence
aacggcccctgcgcggagga

SEQ ID NO: 188409 - DNA, 20 bp, Artificial
  CRISPR gRNA sequence
cggcccctgcgcggaggagg

SEQ ID NO: 188410 - DNA, 20 bp, Artificial
  CRISPR gRNA sequence
ggcccctgcgcggaggaggg

SEQ ID NO: 188411 - DNA, 20 bp, Artificial
  CRISPR gRNA sequence
gcccctgcgcggaggaggga

SEQ ID NO: 188412 - DNA, 20 bp, Artificial
  CRISPR gRNA sequence
cccctgcgcggaggagggag

SEQ ID NO: 188413 - DNA, 20 bp, Artificial
  CRISPR gRNA sequence
ggaggagggaggggcccgcc

SEQ ID NO: 188414 - DNA, 20 bp, Artificial
  CRISPR gRNA sequence
ggagggaggggcccgcctgg

SEQ ID NO: 188415 - DNA, 20 bp, Artificial
  CRISPR gRNA sequence
gagggaggggcccgcctggc

SEQ ID NO: 188416 - DNA, 20 bp, Artificial
  CRISPR gRNA sequence
agggaggggcccgcctggcg

SEQ ID NO: 188417 - DNA, 20 bp, Artificial
  CRISPR gRNA sequence
gggaggggcccgcctggcgg

SEQ ID NO: 188418 - DNA, 20 bp, Artificial
  CRISPR gRNA sequence
gggcccgcctggcgggggcg

SEQ ID NO: 188419 - DNA, 20 bp, Artificial
  CRISPR gRNA sequence
ggcccgcctggcgggggcgc

SEQ ID NO: 188420 - DNA, 20 bp, Artificial
  CRISPR gRNA sequence
cctggcgggggcgcaggact

SEQ ID NO: 188421 - DNA, 20 bp, Artificial
  CRISPR gRNA sequence
ggcgggggcgcaggactcgg

SEQ ID NO: 188422 - DNA, 20 bp, Artificial
  CRISPR gRNA sequence
gcaggactcggcagccgcgc

SEQ ID NO: 188423 - DNA, 20 bp, Artificial
  CRISPR gRNA sequence
caggactcggcagccgcgcc

SEQ ID NO: 188424 - DNA, 20 bp, Artificial
  CRISPR gRNA sequence
ggactcggcagccgcgccgg

SEQ ID NO: 188425 - DNA, 20 bp, Artificial
  CRISPR gRNA sequence
gactcggcagccgcgccggg

SEQ ID NO: 188426 - DNA, 20 bp, Artificial
  CRISPR gRNA sequence
ctcggcagccgcgccgggag

SEQ ID NO: 188427 - DNA, 20 bp, Artificial
  CRISPR gRNA sequence
tcggcagccgcgccgggagg

SEQ ID NO: 188428 - DNA, 20 bp, Artificial
  CRISPR gRNA sequence
cggcagccgcgccgggagga

SEQ ID NO: 188429 - DNA, 20 bp, Artificial
  CRISPR gRNA sequence
agccgcgccgggaggagggt

SEQ ID NO: 188430 - DNA, 20 bp, Artificial
  CRISPR gRNA sequence
gccgcgccgggaggagggtc

SEQ ID NO: 188431 - DNA, 20 bp, Artificial
  CRISPR gRNA sequence
gcgccgggaggagggtcggg

SEQ ID NO: 188432 - DNA, 20 bp, Artificial
  CRISPR gRNA sequence
cgccgggaggagggtcgggc

SEQ ID NO: 188433 - DNA, 20 bp, Artificial
  CRISPR gRNA sequence
tctcaacccctcctcgcccc

SEQ ID NO: 188434 - DNA, 20 bp, Artificial
  CRISPR gRNA sequence
ctcaacccctcctcgccccc

SEQ ID NO: 188435 - DNA, 20 bp, Artificial
  CRISPR gRNA sequence
cccccaggctcccactccat

SEQ ID NO: 188436 - DNA, 20 bp, Artificial
  CRISPR gRNA sequence
ccccaggctcccactccatg

SEQ ID NO: 188437 - DNA, 20 bp, Artificial
  CRISPR gRNA sequence
tcccactccatgaggtattt

SEQ ID NO: 188438 - DNA, 20 bp, Artificial
  CRISPR gRNA sequence
atttcagcgccgccgtgtcc

SEQ ID NO: 188439 - DNA, 20 bp, Artificial
  CRISPR gRNA sequence
agcgccgccgtgtcccggcc

SEQ ID NO: 188440 - DNA, 20 bp, Artificial
  CRISPR gRNA sequence
gccgtgtcccggcccggccg

SEQ ID NO: 188441 - DNA, 20 bp, Artificial
  CRISPR gRNA sequence
ccgtgtcccggcccggccgc

SEQ ID NO: 188442 - DNA, 20 bp, Artificial
  CRISPR gRNA sequence
cgtgtcccggcccggccgcg

SEQ ID NO: 188443 - DNA, 20 bp, Artificial
  CRISPR gRNA sequence
tgtcccggcccggccgcggg

SEQ ID NO: 188444 - DNA, 20 bp, Artificial
  CRISPR gRNA sequence
ggagccccgcttcatcgcca

SEQ ID NO: 188445 - DNA, 20 bp, Artificial
  CRISPR gRNA sequence
gagccccgcttcatcgccat

SEQ ID NO: 188446 - DNA, 20 bp, Artificial
  CRISPR gRNA sequence
cttcatcgccatgggctacg

SEQ ID NO: 188447 - DNA, 20 bp, Artificial
  CRISPR gRNA sequence
tgggctacgtggacgacacg

SEQ ID NO: 188448 - DNA, 20 bp, Artificial
  CRISPR gRNA sequence
tggacgacacgcagttcgtg

SEQ ID NO: 188449 - DNA, 20 bp, Artificial
  CRISPR gRNA sequence
acgcagttcgtgcggttcga

SEQ ID NO: 188450 - DNA, 20 bp, Artificial
  CRISPR gRNA sequence
cgtgcggttcgacagcgact

SEQ ID NO: 188451 - DNA, 20 bp, Artificial
  CRISPR gRNA sequence
gacagcgactcggcgtgtcc

SEQ ID NO: 188452 - DNA, 20 bp, Artificial
  CRISPR gRNA sequence
acagcgactcggcgtgtccg

SEQ ID NO: 188453 - DNA, 20 bp, Artificial
  CRISPR gRNA sequence
cgactcggcgtgtccgagga

SEQ ID NO: 188454 - DNA, 20 bp, Artificial
  CRISPR gRNA sequence
actcggcgtgtccgaggatg

SEQ ID NO: 188455 - DNA, 20 bp, Artificial
  CRISPR gRNA sequence
cgtgtccgaggatggagccg

SEQ ID NO: 188456 - DNA, 20 bp, Artificial
  CRISPR gRNA sequence
gtgtccgaggatggagccgc

SEQ ID NO: 188457 - DNA, 20 bp, Artificial
  CRISPR gRNA sequence
ggatggagccgcgggcgccg

SEQ ID NO: 188458 - DNA, 20 bp, Artificial
  CRISPR gRNA sequence
gatggagccgcgggcgccgt

SEQ ID NO: 188459 - DNA, 20 bp, Artificial
  CRISPR gRNA sequence
ggagccgcgggcgccgtggg

SEQ ID NO: 188460 - DNA, 20 bp, Artificial
  CRISPR gRNA sequence
agccgcgggcgccgtgggtg

SEQ ID NO: 188461 - DNA, 20 bp, Artificial
  CRISPR gRNA sequence
cgcgggcgccgtgggtggag

SEQ ID NO: 188462 - DNA, 20 bp, Artificial
  CRISPR gRNA sequence
gcgggcgccgtgggtggagc

SEQ ID NO: 188463 - DNA, 20 bp, Artificial
  CRISPR gRNA sequence
gggcgccgtgggtggagcag

SEQ ID NO: 188464 - DNA, 20 bp, Artificial
  CRISPR gRNA sequence
ggcgccgtgggtggagcagg

SEQ ID NO: 188465 - DNA, 20 bp, Artificial
  CRISPR gRNA sequence
gcgccgtgggtggagcagga

SEQ ID NO: 188466 - DNA, 20 bp, Artificial
  CRISPR gRNA sequence
cgccgtgggtggagcaggag

SEQ ID NO: 188467 - DNA, 20 bp, Artificial
  CRISPR gRNA sequence
gtgggtggagcaggaggggc

SEQ ID NO: 188468 - DNA, 20 bp, Artificial
  CRISPR gRNA sequence
gggtggagcaggaggggccg

SEQ ID NO: 188469 - DNA, 20 bp, Artificial
  CRISPR gRNA sequence
agcaggaggggccggagtat

SEQ ID NO: 188470 - DNA, 20 bp, Artificial
  CRISPR gRNA sequence
gcaggaggggccggagtatt

SEQ ID NO: 188471 - DNA, 20 bp, Artificial
  CRISPR gRNA sequence
ggaggggccggagtattggg

SEQ ID NO: 188472 - DNA, 20 bp, Artificial
  CRISPR gRNA sequence
aggggccggagtattgggaa

SEQ ID NO: 188473 - DNA, 20 bp, Artificial
  CRISPR gRNA sequence
ggggccggagtattgggaag

SEQ ID NO: 188474 - DNA, 20 bp, Artificial
  CRISPR gRNA sequence
ggccggagtattgggaagag

SEQ ID NO: 188475 - DNA, 20 bp, Artificial
  CRISPR gRNA sequence
agtattgggaagaggagaca

SEQ ID NO: 188476 - DNA, 20 bp, Artificial
  CRISPR gRNA sequence
aagaggagacacggaacacc

SEQ ID NO: 188477 - DNA, 20 bp, Artificial
  CRISPR gRNA sequence
agaggagacacggaacacca

SEQ ID NO: 188478 - DNA, 20 bp, Artificial
  CRISPR gRNA sequence
ggaacaccaaggcccacgca

SEQ ID NO: 188479 - DNA, 20 bp, Artificial
  CRISPR gRNA sequence
aaggcccacgcacagactga

SEQ ID NO: 188480 - DNA, 20 bp, Artificial
  CRISPR gRNA sequence
agactgacagaatgaacctg

SEQ ID NO: 188481 - DNA, 20 bp, Artificial
  CRISPR gRNA sequence
atgaacctgcagaccctgcg

SEQ ID NO: 188482 - DNA, 20 bp, Artificial
  CRISPR gRNA sequence
ccctgcgcggctactacaac

SEQ ID NO: 188483 - DNA, 20 bp, Artificial
  CRISPR gRNA sequence
ctgcgcggctactacaacca

SEQ ID NO: 188484 - DNA, 20 bp, Artificial
  CRISPR gRNA sequence
gcggctactacaaccagagc

SEQ ID NO: 188485 - DNA, 20 bp, Artificial
  CRISPR gRNA sequence
cggctactacaaccagagcg

SEQ ID NO: 188486 - DNA, 20 bp, Artificial
  CRISPR gRNA sequence
tactacaaccagagcgaggc

SEQ ID NO: 188487 - DNA, 20 bp, Artificial
  CRISPR gRNA sequence
acaaccagagcgaggccagt

SEQ ID NO: 188488 - DNA, 20 bp, Artificial
  CRISPR gRNA sequence
gcgaggccagtgagtaactc

SEQ ID NO: 188489 - DNA, 20 bp, Artificial
  CRISPR gRNA sequence
gccagtgagtaactccggcc

SEQ ID NO: 188490 - DNA, 20 bp, Artificial
  CRISPR gRNA sequence
ccagtgagtaactccggccc

SEQ ID NO: 188491 - DNA, 20 bp, Artificial
  CRISPR gRNA sequence
cagtgagtaactccggccca

SEQ ID NO: 188492 - DNA, 20 bp, Artificial
  CRISPR gRNA sequence
gtgagtaactccggcccagg

SEQ ID NO: 188493 - DNA, 20 bp, Artificial
  CRISPR gRNA sequence
agtaactccggcccagggag

SEQ ID NO: 188494 - DNA, 20 bp, Artificial
  CRISPR gRNA sequence
acccccacctccatgcccca

SEQ ID NO: 188495 - DNA, 20 bp, Artificial
  CRISPR gRNA sequence
ccacctccatgccccacgga

SEQ ID NO: 188496 - DNA, 20 bp, Artificial
  CRISPR gRNA sequence
tccatgccccacggacggcc

SEQ ID NO: 188497 - DNA, 20 bp, Artificial
  CRISPR gRNA sequence
ccatgccccacggacggccc

SEQ ID NO: 188498 - DNA, 20 bp, Artificial
  CRISPR gRNA sequence
cggacggcccgggtactccc

SEQ ID NO: 188499 - DNA, 20 bp, Artificial
  CRISPR gRNA sequence
cccgggtactcccgagtctc

SEQ ID NO: 188500 - DNA, 20 bp, Artificial
  CRISPR gRNA sequence
ccgggtactcccgagtctcc

SEQ ID NO: 188501 - DNA, 20 bp, Artificial
  CRISPR gRNA sequence
tactcccgagtctccgggtc

SEQ ID NO: 188502 - DNA, 20 bp, Artificial
  CRISPR gRNA sequence
actcccgagtctccgggtct

SEQ ID NO: 188503 - DNA, 20 bp, Artificial
  CRISPR gRNA sequence
ccgggtctgggatccacccc

SEQ ID NO: 188504 - DNA, 20 bp, Artificial
  CRISPR gRNA sequence
cgggtctgggatccaccccg

SEQ ID NO: 188505 - DNA, 20 bp, Artificial
  CRISPR gRNA sequence
tgggatccaccccgaggccg

SEQ ID NO: 188506 - DNA, 20 bp, Artificial
  CRISPR gRNA sequence
gggatccaccccgaggccgc

SEQ ID NO: 188507 - DNA, 20 bp, Artificial
  CRISPR gRNA sequence
ccgaggccgcgggacccgcc

SEQ ID NO: 188508 - DNA, 20 bp, Artificial
  CRISPR gRNA sequence
acccgcccagaccctctacc

SEQ ID NO: 188509 - DNA, 20 bp, Artificial
  CRISPR gRNA sequence
cccgcccagaccctctacct

SEQ ID NO: 188510 - DNA, 20 bp, Artificial
  CRISPR gRNA sequence
cgcccagaccctctacctgg

SEQ ID NO: 188511 - DNA, 20 bp, Artificial
  CRISPR gRNA sequence
cctctacctgggagaacccc

SEQ ID NO: 188512 - DNA, 20 bp, Artificial
  CRISPR gRNA sequence
ctctacctgggagaacccca

SEQ ID NO: 188513 - DNA, 20 bp, Artificial
  CRISPR gRNA sequence
cgcctttaccaaaatccccg

SEQ ID NO: 188514 - DNA, 20 bp, Artificial
  CRISPR gRNA sequence
gcctttaccaaaatccccgc

SEQ ID NO: 188515 - DNA, 20 bp, Artificial
  CRISPR gRNA sequence
tttaccaaaatccccgcggg

SEQ ID NO: 188516 - DNA, 20 bp, Artificial
  CRISPR gRNA sequence
ttaccaaaatccccgcgggt

SEQ ID NO: 188517 - DNA, 20 bp, Artificial
  CRISPR gRNA sequence
aaaatccccgcgggtgggtc

SEQ ID NO: 188518 - DNA, 20 bp, Artificial
  CRISPR gRNA sequence
aaatccccgcgggtgggtcc

SEQ ID NO: 188519 - DNA, 20 bp, Artificial
  CRISPR gRNA sequence
ccccgcgggtgggtccgggc

SEQ ID NO: 188520 - DNA, 20 bp, Artificial
  CRISPR gRNA sequence
cccgcgggtgggtccgggcg

SEQ ID NO: 188521 - DNA, 20 bp, Artificial
  CRISPR gRNA sequence
ccgcgggtgggtccgggcga

SEQ ID NO: 188522 - DNA, 20 bp, Artificial
  CRISPR gRNA sequence
gggtgggtccgggcgagggc

SEQ ID NO: 188523 - DNA, 20 bp, Artificial
  CRISPR gRNA sequence
ggtgggtccgggcgagggcg

SEQ ID NO: 188524 - DNA, 20 bp, Artificial
  CRISPR gRNA sequence
gtccgggcgagggcgaggct

SEQ ID NO: 188525 - DNA, 20 bp, Artificial
  CRISPR gRNA sequence
cgggcgagggcgaggctcgg

SEQ ID NO: 188526 - DNA, 20 bp, Artificial
  CRISPR gRNA sequence
gggcgagggcgaggctcggt

SEQ ID NO: 188527 - DNA, 20 bp, Artificial
  CRISPR gRNA sequence
cgagggcgaggctcggtggg

SEQ ID NO: 188528 - DNA, 20 bp, Artificial
  CRISPR gRNA sequence
gagggcgaggctcggtgggc

SEQ ID NO: 188529 - DNA, 20 bp, Artificial
  CRISPR gRNA sequence
agggcgaggctcggtgggcg

SEQ ID NO: 188530 - DNA, 20 bp, Artificial
  CRISPR gRNA sequence
ctcggtgggcggggctgacc

SEQ ID NO: 188531 - DNA, 20 bp, Artificial
  CRISPR gRNA sequence
tcggtgggcggggctgaccg

SEQ ID NO: 188532 - DNA, 20 bp, Artificial
  CRISPR gRNA sequence
cggtgggcggggctgaccga

SEQ ID NO: 188533 - DNA, 20 bp, Artificial
  CRISPR gRNA sequence
ggtgggcggggctgaccgag

SEQ ID NO: 188534 - DNA, 20 bp, Artificial
  CRISPR gRNA sequence
gtgggcggggctgaccgagg

SEQ ID NO: 188535 - DNA, 20 bp, Artificial
  CRISPR gRNA sequence
ggcggggctgaccgaggggg

SEQ ID NO: 188536 - DNA, 20 bp, Artificial
  CRISPR gRNA sequence
gcggggctgaccgagggggt

SEQ ID NO: 188537 - DNA, 20 bp, Artificial
  CRISPR gRNA sequence
cggggctgaccgagggggtg

SEQ ID NO: 188538 - DNA, 20 bp, Artificial
  CRISPR gRNA sequence
gctgaccgagggggtggggc

SEQ ID NO: 188539 - DNA, 20 bp, Artificial
  CRISPR gRNA sequence
ctgaccgagggggtggggcc

SEQ ID NO: 188540 - DNA, 20 bp, Artificial
  CRISPR gRNA sequence
ggccaggttctcacaccctc

SEQ ID NO: 188541 - DNA, 20 bp, Artificial
  CRISPR gRNA sequence
caggttctcacaccctccag

SEQ ID NO: 188542 - DNA, 20 bp, Artificial
  CRISPR gRNA sequence
cacaccctccagtggatgat

SEQ ID NO: 188543 - DNA, 20 bp, Artificial
  CRISPR gRNA sequence
gtggatgattggctgcgacc

SEQ ID NO: 188544 - DNA, 20 bp, Artificial
  CRISPR gRNA sequence
tggatgattggctgcgacct

SEQ ID NO: 188545 - DNA, 20 bp, Artificial
  CRISPR gRNA sequence
ggatgattggctgcgacctg

SEQ ID NO: 188546 - DNA, 20 bp, Artificial
  CRISPR gRNA sequence
ggctgcgacctggggtccga

SEQ ID NO: 188547 - DNA, 20 bp, Artificial
  CRISPR gRNA sequence
tccgacggacgcctcctccg

SEQ ID NO: 188548 - DNA, 20 bp, Artificial
  CRISPR gRNA sequence
ccgacggacgcctcctccgc

SEQ ID NO: 188549 - DNA, 20 bp, Artificial
  CRISPR gRNA sequence
gcctcctccgcgggtatgaa

SEQ ID NO: 188550 - DNA, 20 bp, Artificial
  CRISPR gRNA sequence
tatgaacagtatgcctacga

SEQ ID NO: 188551 - DNA, 20 bp, Artificial
  CRISPR gRNA sequence
aacagtatgcctacgatggc

SEQ ID NO: 188552 - DNA, 20 bp, Artificial
  CRISPR gRNA sequence
acagtatgcctacgatggca

SEQ ID NO: 188553 - DNA, 20 bp, Artificial
  CRISPR gRNA sequence
aggattacctcgccctgaac

SEQ ID NO: 188554 - DNA, 20 bp, Artificial
  CRISPR gRNA sequence
ggattacctcgccctgaacg

SEQ ID NO: 188555 - DNA, 20 bp, Artificial
  CRISPR gRNA sequence
tgaacgaggacctgcgctcc

SEQ ID NO: 188556 - DNA, 20 bp, Artificial
  CRISPR gRNA sequence
ggacctgcgctcctggaccg

SEQ ID NO: 188557 - DNA, 20 bp, Artificial
  CRISPR gRNA sequence
cctgcgctcctggaccgcag

SEQ ID NO: 188558 - DNA, 20 bp, Artificial
  CRISPR gRNA sequence
ctggaccgcagcggacactg

SEQ ID NO: 188559 - DNA, 20 bp, Artificial
  CRISPR gRNA sequence
ccgcagcggacactgcggct

SEQ ID NO: 188560 - DNA, 20 bp, Artificial
  CRISPR gRNA sequence
acactgcggctcagatctcc

SEQ ID NO: 188561 - DNA, 20 bp, Artificial
  CRISPR gRNA sequence
cggctcagatctccaagcgc

SEQ ID NO: 188562 - DNA, 20 bp, Artificial
  CRISPR gRNA sequence
agatctccaagcgcaagtgt

SEQ ID NO: 188563 - DNA, 20 bp, Artificial
  CRISPR gRNA sequence
gatctccaagcgcaagtgtg

SEQ ID NO: 188564 - DNA, 20 bp, Artificial
  CRISPR gRNA sequence
ctccaagcgcaagtgtgagg

SEQ ID NO: 188565 - DNA, 20 bp, Artificial
  CRISPR gRNA sequence
caagtgtgaggcggccaatg

SEQ ID NO: 188566 - DNA, 20 bp, Artificial
  CRISPR gRNA sequence
gcggccaatgtggctgaaca

SEQ ID NO: 188567 - DNA, 20 bp, Artificial
  CRISPR gRNA sequence
cggccaatgtggctgaacaa

SEQ ID NO: 188568 - DNA, 20 bp, Artificial
  CRISPR gRNA sequence
gccaatgtggctgaacaaag

SEQ ID NO: 188569 - DNA, 20 bp, Artificial
  CRISPR gRNA sequence
caatgtggctgaacaaagga

SEQ ID NO: 188570 - DNA, 20 bp, Artificial
  CRISPR gRNA sequence
tgaacaaaggagagcctacc

SEQ ID NO: 188571 - DNA, 20 bp, Artificial
  CRISPR gRNA sequence
aacaaaggagagcctacctg

SEQ ID NO: 188572 - DNA, 20 bp, Artificial
  CRISPR gRNA sequence
acaaaggagagcctacctgg

SEQ ID NO: 188573 - DNA, 20 bp, Artificial
  CRISPR gRNA sequence
caaaggagagcctacctgga

SEQ ID NO: 188574 - DNA, 20 bp, Artificial
  CRISPR gRNA sequence
ctacctggagggcacgtgcg

SEQ ID NO: 188575 - DNA, 20 bp, Artificial
  CRISPR gRNA sequence
acctggagggcacgtgcgtg

SEQ ID NO: 188576 - DNA, 20 bp, Artificial
  CRISPR gRNA sequence
tggagggcacgtgcgtggag

SEQ ID NO: 188577 - DNA, 20 bp, Artificial
  CRISPR gRNA sequence
acgtgcgtggagtggctcca

SEQ ID NO: 188578 - DNA, 20 bp, Artificial
  CRISPR gRNA sequence
ggagtggctccacagatacc

SEQ ID NO: 188579 - DNA, 20 bp, Artificial
  CRISPR gRNA sequence
agtggctccacagatacctg

SEQ ID NO: 188580 - DNA, 20 bp, Artificial
  CRISPR gRNA sequence
ctccacagatacctggagaa

SEQ ID NO: 188581 - DNA, 20 bp, Artificial
  CRISPR gRNA sequence
tccacagatacctggagaac

SEQ ID NO: 188582 - DNA, 20 bp, Artificial
  CRISPR gRNA sequence
acagatacctggagaacggg

SEQ ID NO: 188583 - DNA, 20 bp, Artificial
  CRISPR gRNA sequence
cagatacctggagaacggga

SEQ ID NO: 188584 - DNA, 20 bp, Artificial
  CRISPR gRNA sequence
gatacctggagaacgggaag

SEQ ID NO: 188585 - DNA, 20 bp, Artificial
  CRISPR gRNA sequence
agaacgggaaggagatgctg

SEQ ID NO: 188586 - DNA, 20 bp, Artificial
  CRISPR gRNA sequence
gaaggagatgctgcagcgcg

SEQ ID NO: 188587 - DNA, 20 bp, Artificial
  CRISPR gRNA sequence
aaggagatgctgcagcgcgc

SEQ ID NO: 188588 - DNA, 20 bp, Artificial
  CRISPR gRNA sequence
atgctgcagcgcgcgggtac

SEQ ID NO: 188589 - DNA, 20 bp, Artificial
  CRISPR gRNA sequence
tgctgcagcgcgcgggtacc

SEQ ID NO: 188590 - DNA, 20 bp, Artificial
  CRISPR gRNA sequence
gctgcagcgcgcgggtacca

SEQ ID NO: 188591 - DNA, 20 bp, Artificial
  CRISPR gRNA sequence
ctgcagcgcgcgggtaccag

SEQ ID NO: 188592 - DNA, 20 bp, Artificial
  CRISPR gRNA sequence
cagcgcgcgggtaccagggg

SEQ ID NO: 188593 - DNA, 20 bp, Artificial
  CRISPR gRNA sequence
cgcgcgggtaccaggggcag

SEQ ID NO: 188594 - DNA, 20 bp, Artificial
  CRISPR gRNA sequence
gcgcgggtaccaggggcagt

SEQ ID NO: 188595 - DNA, 20 bp, Artificial
  CRISPR gRNA sequence
cgcgggtaccaggggcagtg

SEQ ID NO: 188596 - DNA, 20 bp, Artificial
  CRISPR gRNA sequence
ggcgcctccctgatctcctg

SEQ ID NO: 188597 - DNA, 20 bp, Artificial
  CRISPR gRNA sequence
ctgatctcctgtagacctct

SEQ ID NO: 188598 - DNA, 20 bp, Artificial
  CRISPR gRNA sequence
ctcctgtagacctctcagcc

SEQ ID NO: 188599 - DNA, 20 bp, Artificial
  CRISPR gRNA sequence
gtagacctctcagcctggcc

SEQ ID NO: 188600 - DNA, 20 bp, Artificial
  CRISPR gRNA sequence
ctctcagcctggcctagcac

SEQ ID NO: 188601 - DNA, 20 bp, Artificial
  CRISPR gRNA sequence
tctcagcctggcctagcaca

SEQ ID NO: 188602 - DNA, 20 bp, Artificial
  CRISPR gRNA sequence
tcagcctggcctagcacaag

SEQ ID NO: 188603 - DNA, 20 bp, Artificial
  CRISPR gRNA sequence
agcctggcctagcacaagga

SEQ ID NO: 188604 - DNA, 20 bp, Artificial
  CRISPR gRNA sequence
gcctggcctagcacaaggag

SEQ ID NO: 188605 - DNA, 20 bp, Artificial
  CRISPR gRNA sequence
ctggcctagcacaaggagag

SEQ ID NO: 188606 - DNA, 20 bp, Artificial
  CRISPR gRNA sequence
tggcctagcacaaggagagg

SEQ ID NO: 188607 - DNA, 20 bp, Artificial
  CRISPR gRNA sequence
gcacaaggagaggaggaaaa

SEQ ID NO: 188608 - DNA, 20 bp, Artificial
  CRISPR gRNA sequence
cacaaggagaggaggaaaat

SEQ ID NO: 188609 - DNA, 20 bp, Artificial
  CRISPR gRNA sequence
gaggaaaatgggaccaacac

SEQ ID NO: 188610 - DNA, 20 bp, Artificial
  CRISPR gRNA sequence
ctagaatatcgccctccctc

SEQ ID NO: 188611 - DNA, 20 bp, Artificial
  CRISPR gRNA sequence
atcgccctccctctggtcct

SEQ ID NO: 188612 - DNA, 20 bp, Artificial
  CRISPR gRNA sequence
tcgccctccctctggtcctg

SEQ ID NO: 188613 - DNA, 20 bp, Artificial
  CRISPR gRNA sequence
cgccctccctctggtcctga

SEQ ID NO: 188614 - DNA, 20 bp, Artificial
  CRISPR gRNA sequence
ccctccctctggtcctgagg

SEQ ID NO: 188615 - DNA, 20 bp, Artificial
  CRISPR gRNA sequence
ctccctctggtcctgaggga

SEQ ID NO: 188616 - DNA, 20 bp, Artificial
  CRISPR gRNA sequence
tccctctggtcctgagggag

SEQ ID NO: 188617 - DNA, 20 bp, Artificial
  CRISPR gRNA sequence
ctgagggagaggaatcctcc

SEQ ID NO: 188618 - DNA, 20 bp, Artificial
  CRISPR gRNA sequence
tgagggagaggaatcctcct

SEQ ID NO: 188619 - DNA, 20 bp, Artificial
  CRISPR gRNA sequence
gaggaatcctcctgggtttc

SEQ ID NO: 188620 - DNA, 20 bp, Artificial
  CRISPR gRNA sequence
tgggtttccagatcctgtac

SEQ ID NO: 188621 - DNA, 20 bp, Artificial
  CRISPR gRNA sequence
ggtttccagatcctgtacca

SEQ ID NO: 188622 - DNA, 20 bp, Artificial
  CRISPR gRNA sequence
tttccagatcctgtaccaga

SEQ ID NO: 188623 - DNA, 20 bp, Artificial
  CRISPR gRNA sequence
ctgtaccagagagtgattct

SEQ ID NO: 188624 - DNA, 20 bp, Artificial
  CRISPR gRNA sequence
tgtaccagagagtgattctg

SEQ ID NO: 188625 - DNA, 20 bp, Artificial
  CRISPR gRNA sequence
gtaccagagagtgattctga

SEQ ID NO: 188626 - DNA, 20 bp, Artificial
  CRISPR gRNA sequence
tgagggcccgtcctgctctc

SEQ ID NO: 188627 - DNA, 20 bp, Artificial
  CRISPR gRNA sequence
gagggcccgtcctgctctct

SEQ ID NO: 188628 - DNA, 20 bp, Artificial
  CRISPR gRNA sequence
tcctgctctctgggacaatt

SEQ ID NO: 188629 - DNA, 20 bp, Artificial
  CRISPR gRNA sequence
cctgctctctgggacaatta

SEQ ID NO: 188630 - DNA, 20 bp, Artificial
  CRISPR gRNA sequence
ctgctctctgggacaattaa

SEQ ID NO: 188631 - DNA, 20 bp, Artificial
  CRISPR gRNA sequence
tctgggacaattaagggatg

SEQ ID NO: 188632 - DNA, 20 bp, Artificial
  CRISPR gRNA sequence
aattaagggatgaagtctct

SEQ ID NO: 188633 - DNA, 20 bp, Artificial
  CRISPR gRNA sequence
attaagggatgaagtctctg

SEQ ID NO: 188634 - DNA, 20 bp, Artificial
  CRISPR gRNA sequence
ttaagggatgaagtctctga

SEQ ID NO: 188635 - DNA, 20 bp, Artificial
  CRISPR gRNA sequence
aagggatgaagtctctgagg

SEQ ID NO: 188636 - DNA, 20 bp, Artificial
  CRISPR gRNA sequence
ggatgaagtctctgagggag

SEQ ID NO: 188637 - DNA, 20 bp, Artificial
  CRISPR gRNA sequence
atgaagtctctgagggagtg

SEQ ID NO: 188638 - DNA, 20 bp, Artificial
  CRISPR gRNA sequence
tgaagtctctgagggagtgg

SEQ ID NO: 188639 - DNA, 20 bp, Artificial
  CRISPR gRNA sequence
gaagtctctgagggagtgga

SEQ ID NO: 188640 - DNA, 20 bp, Artificial
  CRISPR gRNA sequence
aagtctctgagggagtggag

SEQ ID NO: 188641 - DNA, 20 bp, Artificial
  CRISPR gRNA sequence
tctctgagggagtggagggg

SEQ ID NO: 188642 - DNA, 20 bp, Artificial
  CRISPR gRNA sequence
gtggaggggaagacaatccc

SEQ ID NO: 188643 - DNA, 20 bp, Artificial
  CRISPR gRNA sequence
gaggggaagacaatccctgg

SEQ ID NO: 188644 - DNA, 20 bp, Artificial
  CRISPR gRNA sequence
acaatccctggaagactgat

SEQ ID NO: 188645 - DNA, 20 bp, Artificial
  CRISPR gRNA sequence
caatccctggaagactgatc

SEQ ID NO: 188646 - DNA, 20 bp, Artificial
  CRISPR gRNA sequence
aatccctggaagactgatca

SEQ ID NO: 188647 - DNA, 20 bp, Artificial
  CRISPR gRNA sequence
atccctggaagactgatcag

SEQ ID NO: 188648 - DNA, 20 bp, Artificial
  CRISPR gRNA sequence
aggggttccctttgacccca

SEQ ID NO: 188649 - DNA, 20 bp, Artificial
  CRISPR gRNA sequence
ggttccctttgaccccacag

SEQ ID NO: 188650 - DNA, 20 bp, Artificial
  CRISPR gRNA sequence
ctttgaccccacagcagcct

SEQ ID NO: 188651 - DNA, 20 bp, Artificial
  CRISPR gRNA sequence
ccccacagcagccttggcac

SEQ ID NO: 188652 - DNA, 20 bp, Artificial
  CRISPR gRNA sequence
cccacagcagccttggcacc

SEQ ID NO: 188653 - DNA, 20 bp, Artificial
  CRISPR gRNA sequence
ggcaccaggacttttcccct

SEQ ID NO: 188654 - DNA, 20 bp, Artificial
  CRISPR gRNA sequence
gcaccaggacttttcccctc

SEQ ID NO: 188655 - DNA, 20 bp, Artificial
  CRISPR gRNA sequence
tgcctcacactcaatgtgtg

SEQ ID NO: 188656 - DNA, 20 bp, Artificial
  CRISPR gRNA sequence
gcctcacactcaatgtgtgt

SEQ ID NO: 188657 - DNA, 20 bp, Artificial
  CRISPR gRNA sequence
cctcacactcaatgtgtgtg

SEQ ID NO: 188658 - DNA, 20 bp, Artificial
  CRISPR gRNA sequence
ctcacactcaatgtgtgtgg

SEQ ID NO: 188659 - DNA, 20 bp, Artificial
  CRISPR gRNA sequence
tgtgtgtgggggtctgactc

SEQ ID NO: 188660 - DNA, 20 bp, Artificial
  CRISPR gRNA sequence
ggtctgactccagctcctct

SEQ ID NO: 188661 - DNA, 20 bp, Artificial
  CRISPR gRNA sequence
tccagctcctctgagtccct

SEQ ID NO: 188662 - DNA, 20 bp, Artificial
  CRISPR gRNA sequence
tgagtcccttggcctccact

SEQ ID NO: 188663 - DNA, 20 bp, Artificial
  CRISPR gRNA sequence
gagtcccttggcctccactc

SEQ ID NO: 188664 - DNA, 20 bp, Artificial
  CRISPR gRNA sequence
cccttggcctccactcaggt

SEQ ID NO: 188665 - DNA, 20 bp, Artificial
  CRISPR gRNA sequence
gcctccactcaggtcagaac

SEQ ID NO: 188666 - DNA, 20 bp, Artificial
  CRISPR gRNA sequence
ctccactcaggtcagaaccg

SEQ ID NO: 188667 - DNA, 20 bp, Artificial
  CRISPR gRNA sequence
tccactcaggtcagaaccgg

SEQ ID NO: 188668 - DNA, 20 bp, Artificial
  CRISPR gRNA sequence
gaggtccctgctcccccgct

SEQ ID NO: 188669 - DNA, 20 bp, Artificial
  CRISPR gRNA sequence
ggtccctgctcccccgctca

SEQ ID NO: 188670 - DNA, 20 bp, Artificial
  CRISPR gRNA sequence
ctgctcccccgctcagagac

SEQ ID NO: 188671 - DNA, 20 bp, Artificial
  CRISPR gRNA sequence
ctcagagactagaactttcc

SEQ ID NO: 188672 - DNA, 20 bp, Artificial
  CRISPR gRNA sequence
tcagagactagaactttcca

SEQ ID NO: 188673 - DNA, 20 bp, Artificial
  CRISPR gRNA sequence
gactagaactttccaaggaa

SEQ ID NO: 188674 - DNA, 20 bp, Artificial
  CRISPR gRNA sequence
actagaactttccaaggaat

SEQ ID NO: 188675 - DNA, 20 bp, Artificial
  CRISPR gRNA sequence
tagaactttccaaggaatag

SEQ ID NO: 188676 - DNA, 20 bp, Artificial
  CRISPR gRNA sequence
caaggaataggagattatcc

SEQ ID NO: 188677 - DNA, 20 bp, Artificial
  CRISPR gRNA sequence
aaggaataggagattatccc

SEQ ID NO: 188678 - DNA, 20 bp, Artificial
  CRISPR gRNA sequence
ttatcccaggtgcccgtgtc

SEQ ID NO: 188679 - DNA, 20 bp, Artificial
  CRISPR gRNA sequence
tatcccaggtgcccgtgtcc

SEQ ID NO: 188680 - DNA, 20 bp, Artificial
  CRISPR gRNA sequence
ccaggtgcccgtgtccaggc

SEQ ID NO: 188681 - DNA, 20 bp, Artificial
  CRISPR gRNA sequence
cccgtgtccaggctggtgtc

SEQ ID NO: 188682 - DNA, 20 bp, Artificial
  CRISPR gRNA sequence
ccgtgtccaggctggtgtct

SEQ ID NO: 188683 - DNA, 20 bp, Artificial
  CRISPR gRNA sequence
ctgtgctcccttccccaccc

SEQ ID NO: 188684 - DNA, 20 bp, Artificial
  CRISPR gRNA sequence
tgtgctcccttccccacccc

SEQ ID NO: 188685 - DNA, 20 bp, Artificial
  CRISPR gRNA sequence
ccttccccaccccaggtatc

SEQ ID NO: 188686 - DNA, 20 bp, Artificial
  CRISPR gRNA sequence
ccaggtatctggttcattct

SEQ ID NO: 188687 - DNA, 20 bp, Artificial
  CRISPR gRNA sequence
caggtatctggttcattctt

SEQ ID NO: 188688 - DNA, 20 bp, Artificial
  CRISPR gRNA sequence
tatctggttcattcttagga

SEQ ID NO: 188689 - DNA, 20 bp, Artificial
  CRISPR gRNA sequence
attcttaggatggtcacatc

SEQ ID NO: 188690 - DNA, 20 bp, Artificial
  CRISPR gRNA sequence
ttcttaggatggtcacatcc

SEQ ID NO: 188691 - DNA, 20 bp, Artificial
  CRISPR gRNA sequence
tggtcacatccaggtgctgc

SEQ ID NO: 188692 - DNA, 20 bp, Artificial
  CRISPR gRNA sequence
gtcacatccaggtgctgctg

SEQ ID NO: 188693 - DNA, 20 bp, Artificial
  CRISPR gRNA sequence
gtgctgctggagtgtcccat

SEQ ID NO: 188694 - DNA, 20 bp, Artificial
  CRISPR gRNA sequence
gctgctggagtgtcccatga

SEQ ID NO: 188695 - DNA, 20 bp, Artificial
  CRISPR gRNA sequence
agtgtcccatgagagatgca

SEQ ID NO: 188696 - DNA, 20 bp, Artificial
  CRISPR gRNA sequence
aattttctgactcttccttt

SEQ ID NO: 188697 - DNA, 20 bp, Artificial
  CRISPR gRNA sequence
tcttcctttcagaccccccc

SEQ ID NO: 188698 - DNA, 20 bp, Artificial
  CRISPR gRNA sequence
accaccctgtctttgactat

SEQ ID NO: 188699 - DNA, 20 bp, Artificial
  CRISPR gRNA sequence
ccaccctgtctttgactatg

SEQ ID NO: 188700 - DNA, 20 bp, Artificial
  CRISPR gRNA sequence
tttgactatgaggccaccct

SEQ ID NO: 188701 - DNA, 20 bp, Artificial
  CRISPR gRNA sequence
ttgactatgaggccaccctg

SEQ ID NO: 188702 - DNA, 20 bp, Artificial
  CRISPR gRNA sequence
atgaggccaccctgaggtgc

SEQ ID NO: 188703 - DNA, 20 bp, Artificial
  CRISPR gRNA sequence
tgaggccaccctgaggtgct

SEQ ID NO: 188704 - DNA, 20 bp, Artificial
  CRISPR gRNA sequence
caccctgaggtgctgggccc

SEQ ID NO: 188705 - DNA, 20 bp, Artificial
  CRISPR gRNA sequence
accctgaggtgctgggccct

SEQ ID NO: 188706 - DNA, 20 bp, Artificial
  CRISPR gRNA sequence
ggccctgggcttctaccctg

SEQ ID NO: 188707 - DNA, 20 bp, Artificial
  CRISPR gRNA sequence
ccctgggcttctaccctgcg

SEQ ID NO: 188708 - DNA, 20 bp, Artificial
  CRISPR gRNA sequence
ctgcggagatcatactgacc

SEQ ID NO: 188709 - DNA, 20 bp, Artificial
  CRISPR gRNA sequence
cggagatcatactgacctgg

SEQ ID NO: 188710 - DNA, 20 bp, Artificial
  CRISPR gRNA sequence
agatcatactgacctggcag

SEQ ID NO: 188711 - DNA, 20 bp, Artificial
  CRISPR gRNA sequence
gatcatactgacctggcagc

SEQ ID NO: 188712 - DNA, 20 bp, Artificial
  CRISPR gRNA sequence
atactgacctggcagcggga

SEQ ID NO: 188713 - DNA, 20 bp, Artificial
  CRISPR gRNA sequence
tactgacctggcagcgggat

SEQ ID NO: 188714 - DNA, 20 bp, Artificial
  CRISPR gRNA sequence
actgacctggcagcgggatg

SEQ ID NO: 188715 - DNA, 20 bp, Artificial
  CRISPR gRNA sequence
tgacctggcagcgggatggg

SEQ ID NO: 188716 - DNA, 20 bp, Artificial
  CRISPR gRNA sequence
gacctggcagcgggatgggg

SEQ ID NO: 188717 - DNA, 20 bp, Artificial
  CRISPR gRNA sequence
ggcagcgggatggggaggac

SEQ ID NO: 188718 - DNA, 20 bp, Artificial
  CRISPR gRNA sequence
gggatggggaggaccagacc

SEQ ID NO: 188719 - DNA, 20 bp, Artificial
  CRISPR gRNA sequence
ggatggggaggaccagaccc

SEQ ID NO: 188720 - DNA, 20 bp, Artificial
  CRISPR gRNA sequence
ggaggaccagacccaggacg

SEQ ID NO: 188721 - DNA, 20 bp, Artificial
  CRISPR gRNA sequence
aggaccagacccaggacgtg

SEQ ID NO: 188722 - DNA, 20 bp, Artificial
  CRISPR gRNA sequence
gacccaggacgtggagctcg

SEQ ID NO: 188723 - DNA, 20 bp, Artificial
  CRISPR gRNA sequence
cccaggacgtggagctcgtg

SEQ ID NO: 188724 - DNA, 20 bp, Artificial
  CRISPR gRNA sequence
gacgtggagctcgtggagac

SEQ ID NO: 188725 - DNA, 20 bp, Artificial
  CRISPR gRNA sequence
acgtggagctcgtggagacc

SEQ ID NO: 188726 - DNA, 20 bp, Artificial
  CRISPR gRNA sequence
gctcgtggagaccaggcctg

SEQ ID NO: 188727 - DNA, 20 bp, Artificial
  CRISPR gRNA sequence
ctcgtggagaccaggcctgc

SEQ ID NO: 188728 - DNA, 20 bp, Artificial
  CRISPR gRNA sequence
tcgtggagaccaggcctgca

SEQ ID NO: 188729 - DNA, 20 bp, Artificial
  CRISPR gRNA sequence
cgtggagaccaggcctgcag

SEQ ID NO: 188730 - DNA, 20 bp, Artificial
  CRISPR gRNA sequence
gagaccaggcctgcagggga

SEQ ID NO: 188731 - DNA, 20 bp, Artificial
  CRISPR gRNA sequence
ctgcaggggatggaaccttc

SEQ ID NO: 188732 - DNA, 20 bp, Artificial
  CRISPR gRNA sequence
caggggatggaaccttccag

SEQ ID NO: 188733 - DNA, 20 bp, Artificial
  CRISPR gRNA sequence
gggatggaaccttccagaag

SEQ ID NO: 188734 - DNA, 20 bp, Artificial
  CRISPR gRNA sequence
ggatggaaccttccagaagt

SEQ ID NO: 188735 - DNA, 20 bp, Artificial
  CRISPR gRNA sequence
tggaaccttccagaagtggg

SEQ ID NO: 188736 - DNA, 20 bp, Artificial
  CRISPR gRNA sequence
cttccagaagtgggcagctg

SEQ ID NO: 188737 - DNA, 20 bp, Artificial
  CRISPR gRNA sequence
ccagaagtgggcagctgtgg

SEQ ID NO: 188738 - DNA, 20 bp, Artificial
  CRISPR gRNA sequence
gcagctgtggtggtgccttc

SEQ ID NO: 188739 - DNA, 20 bp, Artificial
  CRISPR gRNA sequence
agctgtggtggtgccttctg

SEQ ID NO: 188740 - DNA, 20 bp, Artificial
  CRISPR gRNA sequence
ctgtggtggtgccttctgga

SEQ ID NO: 188741 - DNA, 20 bp, Artificial
  CRISPR gRNA sequence
tgtggtggtgccttctggag

SEQ ID NO: 188742 - DNA, 20 bp, Artificial
  CRISPR gRNA sequence
tggtggtgccttctggagag

SEQ ID NO: 188743 - DNA, 20 bp, Artificial
  CRISPR gRNA sequence
tggtgccttctggagaggag

SEQ ID NO: 188744 - DNA, 20 bp, Artificial
  CRISPR gRNA sequence
gtgccttctggagaggagca

SEQ ID NO: 188745 - DNA, 20 bp, Artificial
  CRISPR gRNA sequence
agagatacacgtgccatgtg

SEQ ID NO: 188746 - DNA, 20 bp, Artificial
  CRISPR gRNA sequence
acacgtgccatgtgcagcat

SEQ ID NO: 188747 - DNA, 20 bp, Artificial
  CRISPR gRNA sequence
cacgtgccatgtgcagcatg

SEQ ID NO: 188748 - DNA, 20 bp, Artificial
  CRISPR gRNA sequence
acgtgccatgtgcagcatga

SEQ ID NO: 188749 - DNA, 20 bp, Artificial
  CRISPR gRNA sequence
cgtgccatgtgcagcatgag

SEQ ID NO: 188750 - DNA, 20 bp, Artificial
  CRISPR gRNA sequence
tgtgcagcatgaggggctgc

SEQ ID NO: 188751 - DNA, 20 bp, Artificial
  CRISPR gRNA sequence
tgcagcatgaggggctgccg

SEQ ID NO: 188752 - DNA, 20 bp, Artificial
  CRISPR gRNA sequence
ctgccggagcccctcatgct

SEQ ID NO: 188753 - DNA, 20 bp, Artificial
  CRISPR gRNA sequence
cggagcccctcatgctgaga

SEQ ID NO: 188754 - DNA, 20 bp, Artificial
  CRISPR gRNA sequence
gagcccctcatgctgagatg

SEQ ID NO: 188755 - DNA, 20 bp, Artificial
  CRISPR gRNA sequence
ccctcatgctgagatggagt

SEQ ID NO: 188756 - DNA, 20 bp, Artificial
  CRISPR gRNA sequence
cctcatgctgagatggagta

SEQ ID NO: 188757 - DNA, 20 bp, Artificial
  CRISPR gRNA sequence
tcatgctgagatggagtaag

SEQ ID NO: 188758 - DNA, 20 bp, Artificial
  CRISPR gRNA sequence
catgctgagatggagtaagg

SEQ ID NO: 188759 - DNA, 20 bp, Artificial
  CRISPR gRNA sequence
atgctgagatggagtaagga

SEQ ID NO: 188760 - DNA, 20 bp, Artificial
  CRISPR gRNA sequence
gctgagatggagtaaggagg

SEQ ID NO: 188761 - DNA, 20 bp, Artificial
  CRISPR gRNA sequence
agatggagtaaggagggaga

SEQ ID NO: 188762 - DNA, 20 bp, Artificial
  CRISPR gRNA sequence
atggagtaaggagggagatg

SEQ ID NO: 188763 - DNA, 20 bp, Artificial
  CRISPR gRNA sequence
tggagtaaggagggagatgg

SEQ ID NO: 188764 - DNA, 20 bp, Artificial
  CRISPR gRNA sequence
gatggaggcatcatgtctgt

SEQ ID NO: 188765 - DNA, 20 bp, Artificial
  CRISPR gRNA sequence
atggaggcatcatgtctgtt

SEQ ID NO: 188766 - DNA, 20 bp, Artificial
  CRISPR gRNA sequence
tggaggcatcatgtctgtta

SEQ ID NO: 188767 - DNA, 20 bp, Artificial
  CRISPR gRNA sequence
ggcatcatgtctgttaggga

SEQ ID NO: 188768 - DNA, 20 bp, Artificial
  CRISPR gRNA sequence
atcatgtctgttagggaaag

SEQ ID NO: 188769 - DNA, 20 bp, Artificial
  CRISPR gRNA sequence
tcatgtctgttagggaaagc

SEQ ID NO: 188770 - DNA, 20 bp, Artificial
  CRISPR gRNA sequence
atgtctgttagggaaagcag

SEQ ID NO: 188771 - DNA, 20 bp, Artificial
  CRISPR gRNA sequence
ggaaagcaggagcctctctg

SEQ ID NO: 188772 - DNA, 20 bp, Artificial
  CRISPR gRNA sequence
gcctctctgaagacctttaa

SEQ ID NO: 188773 - DNA, 20 bp, Artificial
  CRISPR gRNA sequence
cctctctgaagacctttaac

SEQ ID NO: 188774 - DNA, 20 bp, Artificial
  CRISPR gRNA sequence
ctctctgaagacctttaaca

SEQ ID NO: 188775 - DNA, 20 bp, Artificial
  CRISPR gRNA sequence
ctgaagacctttaacagggt

SEQ ID NO: 188776 - DNA, 20 bp, Artificial
  CRISPR gRNA sequence
aagacctttaacagggtcgg

SEQ ID NO: 188777 - DNA, 20 bp, Artificial
  CRISPR gRNA sequence
cctttaacagggtcggtggt

SEQ ID NO: 188778 - DNA, 20 bp, Artificial
  CRISPR gRNA sequence
ctttaacagggtcggtggtg

SEQ ID NO: 188779 - DNA, 20 bp, Artificial
  CRISPR gRNA sequence
tttaacagggtcggtggtga

SEQ ID NO: 188780 - DNA, 20 bp, Artificial
  CRISPR gRNA sequence
acagggtcggtggtgagggc

SEQ ID NO: 188781 - DNA, 20 bp, Artificial
  CRISPR gRNA sequence
cagggtcggtggtgagggct

SEQ ID NO: 188782 - DNA, 20 bp, Artificial
  CRISPR gRNA sequence
agggtcggtggtgagggctg

SEQ ID NO: 188783 - DNA, 20 bp, Artificial
  CRISPR gRNA sequence
gggtcggtggtgagggctgg

SEQ ID NO: 188784 - DNA, 20 bp, Artificial
  CRISPR gRNA sequence
cggtggtgagggctgggggt

SEQ ID NO: 188785 - DNA, 20 bp, Artificial
  CRISPR gRNA sequence
gtggtgagggctgggggtca

SEQ ID NO: 188786 - DNA, 20 bp, Artificial
  CRISPR gRNA sequence
ctcaccttcacctcctttcc

SEQ ID NO: 188787 - DNA, 20 bp, Artificial
  CRISPR gRNA sequence
caccttcacctcctttccca

SEQ ID NO: 188788 - DNA, 20 bp, Artificial
  CRISPR gRNA sequence
cttcacctcctttcccagag

SEQ ID NO: 188789 - DNA, 20 bp, Artificial
  CRISPR gRNA sequence
cctgcccaccatccccatca

SEQ ID NO: 188790 - DNA, 20 bp, Artificial
  CRISPR gRNA sequence
ctgcccaccatccccatcat

SEQ ID NO: 188791 - DNA, 20 bp, Artificial
  CRISPR gRNA sequence
cccatcatgggtatcgttgc

SEQ ID NO: 188792 - DNA, 20 bp, Artificial
  CRISPR gRNA sequence
catgggtatcgttgctggcc

SEQ ID NO: 188793 - DNA, 20 bp, Artificial
  CRISPR gRNA sequence
tgctggcctggttgtccttg

SEQ ID NO: 188794 - DNA, 20 bp, Artificial
  CRISPR gRNA sequence
cctggttgtccttgcagctg

SEQ ID NO: 188795 - DNA, 20 bp, Artificial
  CRISPR gRNA sequence
gtccttgcagctgtagtcac

SEQ ID NO: 188796 - DNA, 20 bp, Artificial
  CRISPR gRNA sequence
ccttgcagctgtagtcactg

SEQ ID NO: 188797 - DNA, 20 bp, Artificial
  CRISPR gRNA sequence
agctgtagtcactggagctg

SEQ ID NO: 188798 - DNA, 20 bp, Artificial
  CRISPR gRNA sequence
ctgcggtcgctgctgtgctg

SEQ ID NO: 188799 - DNA, 20 bp, Artificial
  CRISPR gRNA sequence
gcggtcgctgctgtgctgtg

SEQ ID NO: 188800 - DNA, 20 bp, Artificial
  CRISPR gRNA sequence
tcgctgctgtgctgtggaga

SEQ ID NO: 188801 - DNA, 20 bp, Artificial
  CRISPR gRNA sequence
ctgctgtgctgtggagaaag

SEQ ID NO: 188802 - DNA, 20 bp, Artificial
  CRISPR gRNA sequence
gctgtgctgtggagaaagaa

SEQ ID NO: 188803 - DNA, 20 bp, Artificial
  CRISPR gRNA sequence
gctgtggagaaagaagagct

SEQ ID NO: 188804 - DNA, 20 bp, Artificial
  CRISPR gRNA sequence
ctgtggagaaagaagagctc

SEQ ID NO: 188805 - DNA, 20 bp, Artificial
  CRISPR gRNA sequence
ggagaaagaagagctcaggt

SEQ ID NO: 188806 - DNA, 20 bp, Artificial
  CRISPR gRNA sequence
gagaaagaagagctcaggta

SEQ ID NO: 188807 - DNA, 20 bp, Artificial
  CRISPR gRNA sequence
aaagaagagctcaggtaagg

SEQ ID NO: 188808 - DNA, 20 bp, Artificial
  CRISPR gRNA sequence
aagaagagctcaggtaagga

SEQ ID NO: 188809 - DNA, 20 bp, Artificial
  CRISPR gRNA sequence
agaagagctcaggtaaggaa

SEQ ID NO: 188810 - DNA, 20 bp, Artificial
  CRISPR gRNA sequence
gaagagctcaggtaaggaag

SEQ ID NO: 188811 - DNA, 20 bp, Artificial
  CRISPR gRNA sequence
tcaggtaaggaaggggtgac

SEQ ID NO: 188812 - DNA, 20 bp, Artificial
  CRISPR gRNA sequence
ggtaaggaaggggtgacaag

SEQ ID NO: 188813 - DNA, 20 bp, Artificial
  CRISPR gRNA sequence
gtaaggaaggggtgacaagt

SEQ ID NO: 188814 - DNA, 20 bp, Artificial
  CRISPR gRNA sequence
taaggaaggggtgacaagtg

SEQ ID NO: 188815 - DNA, 20 bp, Artificial
  CRISPR gRNA sequence
aggggtgacaagtggggtct

SEQ ID NO: 188816 - DNA, 20 bp, Artificial
  CRISPR gRNA sequence
tctgagttttcttgtcccac

SEQ ID NO: 188817 - DNA, 20 bp, Artificial
  CRISPR gRNA sequence
ctgagttttcttgtcccact

SEQ ID NO: 188818 - DNA, 20 bp, Artificial
  CRISPR gRNA sequence
tgagttttcttgtcccactg

SEQ ID NO: 188819 - DNA, 20 bp, Artificial
  CRISPR gRNA sequence
gagttttcttgtcccactgg

SEQ ID NO: 188820 - DNA, 20 bp, Artificial
  CRISPR gRNA sequence
cttgtcccactgggggtttc

SEQ ID NO: 188821 - DNA, 20 bp, Artificial
  CRISPR gRNA sequence
ccactgggggtttcaagccc

SEQ ID NO: 188822 - DNA, 20 bp, Artificial
  CRISPR gRNA sequence
cactgggggtttcaagcccc

SEQ ID NO: 188823 - DNA, 20 bp, Artificial
  CRISPR gRNA sequence
tgggggtttcaagccccagg

SEQ ID NO: 188824 - DNA, 20 bp, Artificial
  CRISPR gRNA sequence
gggtttcaagccccaggtag

SEQ ID NO: 188825 - DNA, 20 bp, Artificial
  CRISPR gRNA sequence
aggtagaagtgtgccctgcc

SEQ ID NO: 188826 - DNA, 20 bp, Artificial
  CRISPR gRNA sequence
agtgtgccctgcctggttac

SEQ ID NO: 188827 - DNA, 20 bp, Artificial
  CRISPR gRNA sequence
gtgtgccctgcctggttact

SEQ ID NO: 188828 - DNA, 20 bp, Artificial
  CRISPR gRNA sequence
tgccctgcctggttactggg

SEQ ID NO: 188829 - DNA, 20 bp, Artificial
  CRISPR gRNA sequence
ggtgcttcccagtaaccagg

SEQ ID NO: 188830 - DNA, 20 bp, Artificial
  CRISPR gRNA sequence
gtgcttcccagtaaccaggc

SEQ ID NO: 188831 - DNA, 20 bp, Artificial
  CRISPR gRNA sequence
tgcttcccagtaaccaggca

SEQ ID NO: 188832 - DNA, 20 bp, Artificial
  CRISPR gRNA sequence
aggcagggcacacttctacc

SEQ ID NO: 188833 - DNA, 20 bp, Artificial
  CRISPR gRNA sequence
ggcagggcacacttctacct

SEQ ID NO: 188834 - DNA, 20 bp, Artificial
  CRISPR gRNA sequence
gcagggcacacttctacctg

SEQ ID NO: 188835 - DNA, 20 bp, Artificial
  CRISPR gRNA sequence
tacctggggcttgaaacccc

SEQ ID NO: 188836 - DNA, 20 bp, Artificial
  CRISPR gRNA sequence
ctggggcttgaaacccccag

SEQ ID NO: 188837 - DNA, 20 bp, Artificial
  CRISPR gRNA sequence
tggggcttgaaacccccagt

SEQ ID NO: 188838 - DNA, 20 bp, Artificial
  CRISPR gRNA sequence
cttgaaacccccagtgggac

SEQ ID NO: 188839 - DNA, 20 bp, Artificial
  CRISPR gRNA sequence
cccagtgggacaagaaaact

SEQ ID NO: 188840 - DNA, 20 bp, Artificial
  CRISPR gRNA sequence
ttgtcaccccttccttacct

SEQ ID NO: 188841 - DNA, 20 bp, Artificial
  CRISPR gRNA sequence
cctgagctcttctttctcca

SEQ ID NO: 188842 - DNA, 20 bp, Artificial
  CRISPR gRNA sequence
gctcttctttctccacagca

SEQ ID NO: 188843 - DNA, 20 bp, Artificial
  CRISPR gRNA sequence
cttctttctccacagcacag

SEQ ID NO: 188844 - DNA, 20 bp, Artificial
  CRISPR gRNA sequence
ccacagcacagcagcgaccg

SEQ ID NO: 188845 - DNA, 20 bp, Artificial
  CRISPR gRNA sequence
cacagcagcgaccgcagctc

SEQ ID NO: 188846 - DNA, 20 bp, Artificial
  CRISPR gRNA sequence
gaccgcagctccagtgacta

SEQ ID NO: 188847 - DNA, 20 bp, Artificial
  CRISPR gRNA sequence
gctccagtgactacagctgc

SEQ ID NO: 188848 - DNA, 20 bp, Artificial
  CRISPR gRNA sequence
ctccagtgactacagctgca

SEQ ID NO: 188849 - DNA, 20 bp, Artificial
  CRISPR gRNA sequence
actacagctgcaaggacaac

SEQ ID NO: 188850 - DNA, 20 bp, Artificial
  CRISPR gRNA sequence
ctacagctgcaaggacaacc

SEQ ID NO: 188851 - DNA, 20 bp, Artificial
  CRISPR gRNA sequence
agctgcaaggacaaccaggc

SEQ ID NO: 188852 - DNA, 20 bp, Artificial
  CRISPR gRNA sequence
gccagcaacgatacccatga

SEQ ID NO: 188853 - DNA, 20 bp, Artificial
  CRISPR gRNA sequence
ccagcaacgatacccatgat

SEQ ID NO: 188854 - DNA, 20 bp, Artificial
  CRISPR gRNA sequence
cagcaacgatacccatgatg

SEQ ID NO: 188855 - DNA, 20 bp, Artificial
  CRISPR gRNA sequence
aacgatacccatgatgggga

SEQ ID NO: 188856 - DNA, 20 bp, Artificial
  CRISPR gRNA sequence
gatacccatgatggggatgg

SEQ ID NO: 188857 - DNA, 20 bp, Artificial
  CRISPR gRNA sequence
atacccatgatggggatggt

SEQ ID NO: 188858 - DNA, 20 bp, Artificial
  CRISPR gRNA sequence
cccatgatggggatggtggg

SEQ ID NO: 188859 - DNA, 20 bp, Artificial
  CRISPR gRNA sequence
ccatgatggggatggtgggc

SEQ ID NO: 188860 - DNA, 20 bp, Artificial
  CRISPR gRNA sequence
catgatggggatggtgggca

SEQ ID NO: 188861 - DNA, 20 bp, Artificial
  CRISPR gRNA sequence
gatggggatggtgggcaggg

SEQ ID NO: 188862 - DNA, 20 bp, Artificial
  CRISPR gRNA sequence
gtgggcagggaagactgctc

SEQ ID NO: 188863 - DNA, 20 bp, Artificial
  CRISPR gRNA sequence
tgggcagggaagactgctct

SEQ ID NO: 188864 - DNA, 20 bp, Artificial
  CRISPR gRNA sequence
cagggaagactgctctggga

SEQ ID NO: 188865 - DNA, 20 bp, Artificial
  CRISPR gRNA sequence
agggaagactgctctgggaa

SEQ ID NO: 188866 - DNA, 20 bp, Artificial
  CRISPR gRNA sequence
ggaagactgctctgggaaag

SEQ ID NO: 188867 - DNA, 20 bp, Artificial
  CRISPR gRNA sequence
gaagactgctctgggaaagg

SEQ ID NO: 188868 - DNA, 20 bp, Artificial
  CRISPR gRNA sequence
ctgctctgggaaaggaggtg

SEQ ID NO: 188869 - DNA, 20 bp, Artificial
  CRISPR gRNA sequence
tgctctgggaaaggaggtga

SEQ ID NO: 188870 - DNA, 20 bp, Artificial
  CRISPR gRNA sequence
ctgggaaaggaggtgaaggt

SEQ ID NO: 188871 - DNA, 20 bp, Artificial
  CRISPR gRNA sequence
tgggaaaggaggtgaaggtg

SEQ ID NO: 188872 - DNA, 20 bp, Artificial
  CRISPR gRNA sequence
gggaaaggaggtgaaggtga

SEQ ID NO: 188873 - DNA, 20 bp, Artificial
  CRISPR gRNA sequence
aggtgagggtctctgacccc

SEQ ID NO: 188874 - DNA, 20 bp, Artificial
  CRISPR gRNA sequence
cctcaccaccgaccctgtta

SEQ ID NO: 188875 - DNA, 20 bp, Artificial
  CRISPR gRNA sequence
ctcaccaccgaccctgttaa

SEQ ID NO: 188876 - DNA, 20 bp, Artificial
  CRISPR gRNA sequence
ccgaccctgttaaaggtctt

SEQ ID NO: 188877 - DNA, 20 bp, Artificial
  CRISPR gRNA sequence
gaccctgttaaaggtcttca

SEQ ID NO: 188878 - DNA, 20 bp, Artificial
  CRISPR gRNA sequence
ccctgttaaaggtcttcaga

SEQ ID NO: 188879 - DNA, 20 bp, Artificial
  CRISPR gRNA sequence
cctgttaaaggtcttcagag

SEQ ID NO: 188880 - DNA, 20 bp, Artificial
  CRISPR gRNA sequence
gaggctcctgctttccctaa

SEQ ID NO: 188881 - DNA, 20 bp, Artificial
  CRISPR gRNA sequence
tctccctccttactccatct

SEQ ID NO: 188882 - DNA, 20 bp, Artificial
  CRISPR gRNA sequence
tccttactccatctcagcat

SEQ ID NO: 188883 - DNA, 20 bp, Artificial
  CRISPR gRNA sequence
ccttactccatctcagcatg

SEQ ID NO: 188884 - DNA, 20 bp, Artificial
  CRISPR gRNA sequence
cttactccatctcagcatga

SEQ ID NO: 188885 - DNA, 20 bp, Artificial
  CRISPR gRNA sequence
ttactccatctcagcatgag

SEQ ID NO: 188886 - DNA, 20 bp, Artificial
  CRISPR gRNA sequence
catctcagcatgaggggctc

SEQ ID NO: 188887 - DNA, 20 bp, Artificial
  CRISPR gRNA sequence
ctcagcatgaggggctccgg

SEQ ID NO: 188888 - DNA, 20 bp, Artificial
  CRISPR gRNA sequence
gcagcccctcatgctgcaca

SEQ ID NO: 188889 - DNA, 20 bp, Artificial
  CRISPR gRNA sequence
cgtgtatctctgctcctctc

SEQ ID NO: 188890 - DNA, 20 bp, Artificial
  CRISPR gRNA sequence
gtatctctgctcctctccag

SEQ ID NO: 188891 - DNA, 20 bp, Artificial
  CRISPR gRNA sequence
tatctctgctcctctccaga

SEQ ID NO: 188892 - DNA, 20 bp, Artificial
  CRISPR gRNA sequence
ctctccagaaggcaccacca

SEQ ID NO: 188893 - DNA, 20 bp, Artificial
  CRISPR gRNA sequence
ccaccacagctgcccacttc

SEQ ID NO: 188894 - DNA, 20 bp, Artificial
  CRISPR gRNA sequence
ccacagctgcccacttctgg

SEQ ID NO: 188895 - DNA, 20 bp, Artificial
  CRISPR gRNA sequence
cacagctgcccacttctgga

SEQ ID NO: 188896 - DNA, 20 bp, Artificial
  CRISPR gRNA sequence
ctggaaggttccatcccctg

SEQ ID NO: 188897 - DNA, 20 bp, Artificial
  CRISPR gRNA sequence
tggaaggttccatcccctgc

SEQ ID NO: 188898 - DNA, 20 bp, Artificial
  CRISPR gRNA sequence
ggttccatcccctgcaggcc

SEQ ID NO: 188899 - DNA, 20 bp, Artificial
  CRISPR gRNA sequence
cctgcaggcctggtctccac

SEQ ID NO: 188900 - DNA, 20 bp, Artificial
  CRISPR gRNA sequence
tctccacgagctccacgtcc

SEQ ID NO: 188901 - DNA, 20 bp, Artificial
  CRISPR gRNA sequence
ctccacgagctccacgtcct

SEQ ID NO: 188902 - DNA, 20 bp, Artificial
  CRISPR gRNA sequence
cgagctccacgtcctgggtc

SEQ ID NO: 188903 - DNA, 20 bp, Artificial
  CRISPR gRNA sequence
ggtcctccccatcccgctgc

SEQ ID NO: 188904 - DNA, 20 bp, Artificial
  CRISPR gRNA sequence
gtcctccccatcccgctgcc

SEQ ID NO: 188905 - DNA, 20 bp, Artificial
  CRISPR gRNA sequence
tccccatcccgctgccaggt

SEQ ID NO: 188906 - DNA, 20 bp, Artificial
  CRISPR gRNA sequence
ccaggtcagtatgatctccg

SEQ ID NO: 188907 - DNA, 20 bp, Artificial
  CRISPR gRNA sequence
caggtcagtatgatctccgc

SEQ ID NO: 188908 - DNA, 20 bp, Artificial
  CRISPR gRNA sequence
aggtcagtatgatctccgca

SEQ ID NO: 188909 - DNA, 20 bp, Artificial
  CRISPR gRNA sequence
tcagtatgatctccgcaggg

SEQ ID NO: 188910 - DNA, 20 bp, Artificial
  CRISPR gRNA sequence
gtatgatctccgcagggtag

SEQ ID NO: 188911 - DNA, 20 bp, Artificial
  CRISPR gRNA sequence
atctccgcagggtagaagcc

SEQ ID NO: 188912 - DNA, 20 bp, Artificial
  CRISPR gRNA sequence
tctccgcagggtagaagccc

SEQ ID NO: 188913 - DNA, 20 bp, Artificial
  CRISPR gRNA sequence
ctccgcagggtagaagccca

SEQ ID NO: 188914 - DNA, 20 bp, Artificial
  CRISPR gRNA sequence
cagggtagaagcccagggcc

SEQ ID NO: 188915 - DNA, 20 bp, Artificial
  CRISPR gRNA sequence
aagcccagggcccagcacct

SEQ ID NO: 188916 - DNA, 20 bp, Artificial
  CRISPR gRNA sequence
agcccagggcccagcacctc

SEQ ID NO: 188917 - DNA, 20 bp, Artificial
  CRISPR gRNA sequence
gcccagggcccagcacctca

SEQ ID NO: 188918 - DNA, 20 bp, Artificial
  CRISPR gRNA sequence
cagggcccagcacctcaggg

SEQ ID NO: 188919 - DNA, 20 bp, Artificial
  CRISPR gRNA sequence
agcacctcagggtggcctca

SEQ ID NO: 188920 - DNA, 20 bp, Artificial
  CRISPR gRNA sequence
tcagggtggcctcatagtca

SEQ ID NO: 188921 - DNA, 20 bp, Artificial
  CRISPR gRNA sequence
ggtggcctcatagtcaaaga

SEQ ID NO: 188922 - DNA, 20 bp, Artificial
  CRISPR gRNA sequence
gtggcctcatagtcaaagac

SEQ ID NO: 188923 - DNA, 20 bp, Artificial
  CRISPR gRNA sequence
tggcctcatagtcaaagaca

SEQ ID NO: 188924 - DNA, 20 bp, Artificial
  CRISPR gRNA sequence
cctcatagtcaaagacaggg

SEQ ID NO: 188925 - DNA, 20 bp, Artificial
  CRISPR gRNA sequence
catagtcaaagacagggtgg

SEQ ID NO: 188926 - DNA, 20 bp, Artificial
  CRISPR gRNA sequence
atagtcaaagacagggtggt

SEQ ID NO: 188927 - DNA, 20 bp, Artificial
  CRISPR gRNA sequence
gtggtgggtcacgtgtgtct

SEQ ID NO: 188928 - DNA, 20 bp, Artificial
  CRISPR gRNA sequence
tggtgggtcacgtgtgtctt

SEQ ID NO: 188929 - DNA, 20 bp, Artificial
  CRISPR gRNA sequence
ggtgggtcacgtgtgtcttg

SEQ ID NO: 188930 - DNA, 20 bp, Artificial
  CRISPR gRNA sequence
gtgggtcacgtgtgtcttgg

SEQ ID NO: 188931 - DNA, 20 bp, Artificial
  CRISPR gRNA sequence
tgggtcacgtgtgtcttggg

SEQ ID NO: 188932 - DNA, 20 bp, Artificial
  CRISPR gRNA sequence
gggtcacgtgtgtcttgggg

SEQ ID NO: 188933 - DNA, 20 bp, Artificial
  CRISPR gRNA sequence
tgtgtcttgggggggtctga

SEQ ID NO: 188934 - DNA, 20 bp, Artificial
  CRISPR gRNA sequence
gtgtcttgggggggtctgaa

SEQ ID NO: 188935 - DNA, 20 bp, Artificial
  CRISPR gRNA sequence
tcttgggggggtctgaaagg

SEQ ID NO: 188936 - DNA, 20 bp, Artificial
  CRISPR gRNA sequence
ttgggggggtctgaaaggaa

SEQ ID NO: 188937 - DNA, 20 bp, Artificial
  CRISPR gRNA sequence
gggggtctgaaaggaagagt

SEQ ID NO: 188938 - DNA, 20 bp, Artificial
  CRISPR gRNA sequence
aaggaagagtcagaaaattc

SEQ ID NO: 188939 - DNA, 20 bp, Artificial
  CRISPR gRNA sequence
caagcactttgcatctctca

SEQ ID NO: 188940 - DNA, 20 bp, Artificial
  CRISPR gRNA sequence
aagcactttgcatctctcat

SEQ ID NO: 188941 - DNA, 20 bp, Artificial
  CRISPR gRNA sequence
gcatctctcatgggacactc

SEQ ID NO: 188942 - DNA, 20 bp, Artificial
  CRISPR gRNA sequence
tctctcatgggacactccag

SEQ ID NO: 188943 - DNA, 20 bp, Artificial
  CRISPR gRNA sequence
tgggacactccagcagcacc

SEQ ID NO: 188944 - DNA, 20 bp, Artificial
  CRISPR gRNA sequence
cacctggatgtgaccatcct

SEQ ID NO: 188945 - DNA, 20 bp, Artificial
  CRISPR gRNA sequence
tgaccatcctaagaatgaac

SEQ ID NO: 188946 - DNA, 20 bp, Artificial
  CRISPR gRNA sequence
ctaagaatgaaccagatacc

SEQ ID NO: 188947 - DNA, 20 bp, Artificial
  CRISPR gRNA sequence
taagaatgaaccagatacct

SEQ ID NO: 188948 - DNA, 20 bp, Artificial
  CRISPR gRNA sequence
aagaatgaaccagatacctg

SEQ ID NO: 188949 - DNA, 20 bp, Artificial
  CRISPR gRNA sequence
aatgaaccagatacctgggg

SEQ ID NO: 188950 - DNA, 20 bp, Artificial
  CRISPR gRNA sequence
atgaaccagatacctggggt

SEQ ID NO: 188951 - DNA, 20 bp, Artificial
  CRISPR gRNA sequence
tgaaccagatacctggggtg

SEQ ID NO: 188952 - DNA, 20 bp, Artificial
  CRISPR gRNA sequence
accagatacctggggtgggg

SEQ ID NO: 188953 - DNA, 20 bp, Artificial
  CRISPR gRNA sequence
ccagatacctggggtgggga

SEQ ID NO: 188954 - DNA, 20 bp, Artificial
  CRISPR gRNA sequence
cagatacctggggtggggaa

SEQ ID NO: 188955 - DNA, 20 bp, Artificial
  CRISPR gRNA sequence
gatacctggggtggggaagg

SEQ ID NO: 188956 - DNA, 20 bp, Artificial
  CRISPR gRNA sequence
ctggggtggggaagggagca

SEQ ID NO: 188957 - DNA, 20 bp, Artificial
  CRISPR gRNA sequence
ggggaagggagcacagaacc

SEQ ID NO: 188958 - DNA, 20 bp, Artificial
  CRISPR gRNA sequence
ggagcacagaacccagacac

SEQ ID NO: 188959 - DNA, 20 bp, Artificial
  CRISPR gRNA sequence
acagaacccagacaccagcc

SEQ ID NO: 188960 - DNA, 20 bp, Artificial
  CRISPR gRNA sequence
cccagacaccagcctggaca

SEQ ID NO: 188961 - DNA, 20 bp, Artificial
  CRISPR gRNA sequence
ccagacaccagcctggacac

SEQ ID NO: 188962 - DNA, 20 bp, Artificial
  CRISPR gRNA sequence
ccagcctggacacgggcacc

SEQ ID NO: 188963 - DNA, 20 bp, Artificial
  CRISPR gRNA sequence
cagcctggacacgggcacct

SEQ ID NO: 188964 - DNA, 20 bp, Artificial
  CRISPR gRNA sequence
tgggataatctcctattcct

SEQ ID NO: 188965 - DNA, 20 bp, Artificial
  CRISPR gRNA sequence
ataatctcctattccttgga

SEQ ID NO: 188966 - DNA, 20 bp, Artificial
  CRISPR gRNA sequence
tcctattccttggaaagttc

SEQ ID NO: 188967 - DNA, 20 bp, Artificial
  CRISPR gRNA sequence
cttggaaagttctagtctct

SEQ ID NO: 188968 - DNA, 20 bp, Artificial
  CRISPR gRNA sequence
ggaaagttctagtctctgag

SEQ ID NO: 188969 - DNA, 20 bp, Artificial
  CRISPR gRNA sequence
gaaagttctagtctctgagc

SEQ ID NO: 188970 - DNA, 20 bp, Artificial
  CRISPR gRNA sequence
aaagttctagtctctgagcg

SEQ ID NO: 188971 - DNA, 20 bp, Artificial
  CRISPR gRNA sequence
aagttctagtctctgagcgg

SEQ ID NO: 188972 - DNA, 20 bp, Artificial
  CRISPR gRNA sequence
gttctagtctctgagcgggg

SEQ ID NO: 188973 - DNA, 20 bp, Artificial
  CRISPR gRNA sequence
ctagtctctgagcgggggag

SEQ ID NO: 188974 - DNA, 20 bp, Artificial
  CRISPR gRNA sequence
tagtctctgagcgggggagc

SEQ ID NO: 188975 - DNA, 20 bp, Artificial
  CRISPR gRNA sequence
agtctctgagcgggggagca

SEQ ID NO: 188976 - DNA, 20 bp, Artificial
  CRISPR gRNA sequence
agcgggggagcagggacctc

SEQ ID NO: 188977 - DNA, 20 bp, Artificial
  CRISPR gRNA sequence
gggacctccggttctgacct

SEQ ID NO: 188978 - DNA, 20 bp, Artificial
  CRISPR gRNA sequence
acctccggttctgacctgag

SEQ ID NO: 188979 - DNA, 20 bp, Artificial
  CRISPR gRNA sequence
ctccggttctgacctgagtg

SEQ ID NO: 188980 - DNA, 20 bp, Artificial
  CRISPR gRNA sequence
tccggttctgacctgagtgg

SEQ ID NO: 188981 - DNA, 20 bp, Artificial
  CRISPR gRNA sequence
ttctgacctgagtggaggcc

SEQ ID NO: 188982 - DNA, 20 bp, Artificial
  CRISPR gRNA sequence
tctgacctgagtggaggcca

SEQ ID NO: 188983 - DNA, 20 bp, Artificial
  CRISPR gRNA sequence
ctgacctgagtggaggccaa

SEQ ID NO: 188984 - DNA, 20 bp, Artificial
  CRISPR gRNA sequence
tgagtggaggccaagggact

SEQ ID NO: 188985 - DNA, 20 bp, Artificial
  CRISPR gRNA sequence
agtggaggccaagggactca

SEQ ID NO: 188986 - DNA, 20 bp, Artificial
  CRISPR gRNA sequence
gtggaggccaagggactcag

SEQ ID NO: 188987 - DNA, 20 bp, Artificial
  CRISPR gRNA sequence
ggaggccaagggactcagag

SEQ ID NO: 188988 - DNA, 20 bp, Artificial
  CRISPR gRNA sequence
gccaagggactcagaggagc

SEQ ID NO: 188989 - DNA, 20 bp, Artificial
  CRISPR gRNA sequence
caagggactcagaggagctg

SEQ ID NO: 188990 - DNA, 20 bp, Artificial
  CRISPR gRNA sequence
ggactcagaggagctggagt

SEQ ID NO: 188991 - DNA, 20 bp, Artificial
  CRISPR gRNA sequence
gtcagacccccacacacatt

SEQ ID NO: 188992 - DNA, 20 bp, Artificial
  CRISPR gRNA sequence
cccccacacacattgagtgt

SEQ ID NO: 188993 - DNA, 20 bp, Artificial
  CRISPR gRNA sequence
ccccacacacattgagtgtg

SEQ ID NO: 188994 - DNA, 20 bp, Artificial
  CRISPR gRNA sequence
cacacacattgagtgtgagg

SEQ ID NO: 188995 - DNA, 20 bp, Artificial
  CRISPR gRNA sequence
cacacattgagtgtgaggca

SEQ ID NO: 188996 - DNA, 20 bp, Artificial
  CRISPR gRNA sequence
ttgagtgtgaggcagagaac

SEQ ID NO: 188997 - DNA, 20 bp, Artificial
  CRISPR gRNA sequence
tgagtgtgaggcagagaaca

SEQ ID NO: 188998 - DNA, 20 bp, Artificial
  CRISPR gRNA sequence
tgaggcagagaacaaggcct

SEQ ID NO: 188999 - DNA, 20 bp, Artificial
  CRISPR gRNA sequence
gaggcagagaacaaggcctg

SEQ ID NO: 189000 - DNA, 20 bp, Artificial
  CRISPR gRNA sequence
aggcagagaacaaggcctga

SEQ ID NO: 189001 - DNA, 20 bp, Artificial
  CRISPR gRNA sequence
ggcagagaacaaggcctgag

SEQ ID NO: 189002 - DNA, 20 bp, Artificial
  CRISPR gRNA sequence
agaacaaggcctgaggggaa

SEQ ID NO: 189003 - DNA, 20 bp, Artificial
  CRISPR gRNA sequence
aggcctgaggggaaaagtcc

SEQ ID NO: 189004 - DNA, 20 bp, Artificial
  CRISPR gRNA sequence
aggggaaaagtcctggtgcc

SEQ ID NO: 189005 - DNA, 20 bp, Artificial
  CRISPR gRNA sequence
ggggaaaagtcctggtgcca

SEQ ID NO: 189006 - DNA, 20 bp, Artificial
  CRISPR gRNA sequence
tcctggtgccaaggctgctg

SEQ ID NO: 189007 - DNA, 20 bp, Artificial
  CRISPR gRNA sequence
cctggtgccaaggctgctgt

SEQ ID NO: 189008 - DNA, 20 bp, Artificial
  CRISPR gRNA sequence
ctggtgccaaggctgctgtg

SEQ ID NO: 189009 - DNA, 20 bp, Artificial
  CRISPR gRNA sequence
ccaaggctgctgtggggtca

SEQ ID NO: 189010 - DNA, 20 bp, Artificial
  CRISPR gRNA sequence
caaggctgctgtggggtcaa

SEQ ID NO: 189011 - DNA, 20 bp, Artificial
  CRISPR gRNA sequence
aaggctgctgtggggtcaaa

SEQ ID NO: 189012 - DNA, 20 bp, Artificial
  CRISPR gRNA sequence
ggtcaaagggaacccctgat

SEQ ID NO: 189013 - DNA, 20 bp, Artificial
  CRISPR gRNA sequence
ggaacccctgatcagtcttc

SEQ ID NO: 189014 - DNA, 20 bp, Artificial
  CRISPR gRNA sequence
gaacccctgatcagtcttcc

SEQ ID NO: 189015 - DNA, 20 bp, Artificial
  CRISPR gRNA sequence
aacccctgatcagtcttcca

SEQ ID NO: 189016 - DNA, 20 bp, Artificial
  CRISPR gRNA sequence
tgtcttcccctccactccct

SEQ ID NO: 189017 - DNA, 20 bp, Artificial
  CRISPR gRNA sequence
tcttcccctccactccctca

SEQ ID NO: 189018 - DNA, 20 bp, Artificial
  CRISPR gRNA sequence
acttcatcccttaattgtcc

SEQ ID NO: 189019 - DNA, 20 bp, Artificial
  CRISPR gRNA sequence
ttcatcccttaattgtccca

SEQ ID NO: 189020 - DNA, 20 bp, Artificial
  CRISPR gRNA sequence
catcccttaattgtcccaga

SEQ ID NO: 189021 - DNA, 20 bp, Artificial
  CRISPR gRNA sequence
cccttaattgtcccagagag

SEQ ID NO: 189022 - DNA, 20 bp, Artificial
  CRISPR gRNA sequence
ccttaattgtcccagagagc

SEQ ID NO: 189023 - DNA, 20 bp, Artificial
  CRISPR gRNA sequence
aattgtcccagagagcagga

SEQ ID NO: 189024 - DNA, 20 bp, Artificial
  CRISPR gRNA sequence
attgtcccagagagcaggac

SEQ ID NO: 189025 - DNA, 20 bp, Artificial
  CRISPR gRNA sequence
cagagagcaggacgggccct

SEQ ID NO: 189026 - DNA, 20 bp, Artificial
  CRISPR gRNA sequence
gggccctcagaatcactctc

SEQ ID NO: 189027 - DNA, 20 bp, Artificial
  CRISPR gRNA sequence
ctcagaatcactctctggta

SEQ ID NO: 189028 - DNA, 20 bp, Artificial
  CRISPR gRNA sequence
tcagaatcactctctggtac

SEQ ID NO: 189029 - DNA, 20 bp, Artificial
  CRISPR gRNA sequence
tcactctctggtacaggatc

SEQ ID NO: 189030 - DNA, 20 bp, Artificial
  CRISPR gRNA sequence
tggtacaggatctggaaacc

SEQ ID NO: 189031 - DNA, 20 bp, Artificial
  CRISPR gRNA sequence
ggtacaggatctggaaaccc

SEQ ID NO: 189032 - DNA, 20 bp, Artificial
  CRISPR gRNA sequence
tacaggatctggaaacccag

SEQ ID NO: 189033 - DNA, 20 bp, Artificial
  CRISPR gRNA sequence
acaggatctggaaacccagg

SEQ ID NO: 189034 - DNA, 20 bp, Artificial
  CRISPR gRNA sequence
ccaggaggattcctctccct

SEQ ID NO: 189035 - DNA, 20 bp, Artificial
  CRISPR gRNA sequence
caggaggattcctctccctc

SEQ ID NO: 189036 - DNA, 20 bp, Artificial
  CRISPR gRNA sequence
ggattcctctccctcaggac

SEQ ID NO: 189037 - DNA, 20 bp, Artificial
  CRISPR gRNA sequence
attcctctccctcaggacca

SEQ ID NO: 189038 - DNA, 20 bp, Artificial
  CRISPR gRNA sequence
ttcctctccctcaggaccag

SEQ ID NO: 189039 - DNA, 20 bp, Artificial
  CRISPR gRNA sequence
tcctctccctcaggaccaga

SEQ ID NO: 189040 - DNA, 20 bp, Artificial
  CRISPR gRNA sequence
ctctccctcaggaccagagg

SEQ ID NO: 189041 - DNA, 20 bp, Artificial
  CRISPR gRNA sequence
tctccctcaggaccagaggg

SEQ ID NO: 189042 - DNA, 20 bp, Artificial
  CRISPR gRNA sequence
ctccctcaggaccagaggga

SEQ ID NO: 189043 - DNA, 20 bp, Artificial
  CRISPR gRNA sequence
ccagagggagggcgatattc

SEQ ID NO: 189044 - DNA, 20 bp, Artificial
  CRISPR gRNA sequence
ggagggcgatattctagtgt

SEQ ID NO: 189045 - DNA, 20 bp, Artificial
  CRISPR gRNA sequence
ttttcctcctctccttgtgc

SEQ ID NO: 189046 - DNA, 20 bp, Artificial
  CRISPR gRNA sequence
tttcctcctctccttgtgct

SEQ ID NO: 189047 - DNA, 20 bp, Artificial
  CRISPR gRNA sequence
ctcctctccttgtgctaggc

SEQ ID NO: 189048 - DNA, 20 bp, Artificial
  CRISPR gRNA sequence
tcctctccttgtgctaggcc

SEQ ID NO: 189049 - DNA, 20 bp, Artificial
  CRISPR gRNA sequence
tccttgtgctaggccaggct

SEQ ID NO: 189050 - DNA, 20 bp, Artificial
  CRISPR gRNA sequence
cttgtgctaggccaggctga

SEQ ID NO: 189051 - DNA, 20 bp, Artificial
  CRISPR gRNA sequence
ttgtgctaggccaggctgag

SEQ ID NO: 189052 - DNA, 20 bp, Artificial
  CRISPR gRNA sequence
aggccaggctgagaggtcta

SEQ ID NO: 189053 - DNA, 20 bp, Artificial
  CRISPR gRNA sequence
ggccaggctgagaggtctac

SEQ ID NO: 189054 - DNA, 20 bp, Artificial
  CRISPR gRNA sequence
ccaggctgagaggtctacag

SEQ ID NO: 189055 - DNA, 20 bp, Artificial
  CRISPR gRNA sequence
ctgagaggtctacaggagat

SEQ ID NO: 189056 - DNA, 20 bp, Artificial
  CRISPR gRNA sequence
tgagaggtctacaggagatc

SEQ ID NO: 189057 - DNA, 20 bp, Artificial
  CRISPR gRNA sequence
gagaggtctacaggagatca

SEQ ID NO: 189058 - DNA, 20 bp, Artificial
  CRISPR gRNA sequence
gaggtctacaggagatcagg

SEQ ID NO: 189059 - DNA, 20 bp, Artificial
  CRISPR gRNA sequence
aggtctacaggagatcaggg

SEQ ID NO: 189060 - DNA, 20 bp, Artificial
  CRISPR gRNA sequence
gggaggcgccccactgcccc

SEQ ID NO: 189061 - DNA, 20 bp, Artificial
  CRISPR gRNA sequence
cccctggtacccgcgcgctg

SEQ ID NO: 189062 - DNA, 20 bp, Artificial
  CRISPR gRNA sequence
agcatctccttcccgttctc

SEQ ID NO: 189063 - DNA, 20 bp, Artificial
  CRISPR gRNA sequence
gcatctccttcccgttctcc

SEQ ID NO: 189064 - DNA, 20 bp, Artificial
  CRISPR gRNA sequence
tcccgttctccaggtatctg

SEQ ID NO: 189065 - DNA, 20 bp, Artificial
  CRISPR gRNA sequence
ccgttctccaggtatctgtg

SEQ ID NO: 189066 - DNA, 20 bp, Artificial
  CRISPR gRNA sequence
cactccacgcacgtgccctc

SEQ ID NO: 189067 - DNA, 20 bp, Artificial
  CRISPR gRNA sequence
actccacgcacgtgccctcc

SEQ ID NO: 189068 - DNA, 20 bp, Artificial
  CRISPR gRNA sequence
ccacgcacgtgccctccagg

SEQ ID NO: 189069 - DNA, 20 bp, Artificial
  CRISPR gRNA sequence
cacgcacgtgccctccaggt

SEQ ID NO: 189070 - DNA, 20 bp, Artificial
  CRISPR gRNA sequence
caggtaggctctcctttgtt

SEQ ID NO: 189071 - DNA, 20 bp, Artificial
  CRISPR gRNA sequence
tctcctttgttcagccacat

SEQ ID NO: 189072 - DNA, 20 bp, Artificial
  CRISPR gRNA sequence
ggccgcctcacacttgcgct

SEQ ID NO: 189073 - DNA, 20 bp, Artificial
  CRISPR gRNA sequence
ccgcctcacacttgcgcttg

SEQ ID NO: 189074 - DNA, 20 bp, Artificial
  CRISPR gRNA sequence
acacttgcgcttggagatct

SEQ ID NO: 189075 - DNA, 20 bp, Artificial
  CRISPR gRNA sequence
gcgcttggagatctgagccg

SEQ ID NO: 189076 - DNA, 20 bp, Artificial
  CRISPR gRNA sequence
ctgagccgcagtgtccgctg

SEQ ID NO: 189077 - DNA, 20 bp, Artificial
  CRISPR gRNA sequence
ccgcagtgtccgctgcggtc

SEQ ID NO: 189078 - DNA, 20 bp, Artificial
  CRISPR gRNA sequence
cgcagtgtccgctgcggtcc

SEQ ID NO: 189079 - DNA, 20 bp, Artificial
  CRISPR gRNA sequence
cagtgtccgctgcggtccag

SEQ ID NO: 189080 - DNA, 20 bp, Artificial
  CRISPR gRNA sequence
tccgctgcggtccaggagcg

SEQ ID NO: 189081 - DNA, 20 bp, Artificial
  CRISPR gRNA sequence
ccgctgcggtccaggagcgc

SEQ ID NO: 189082 - DNA, 20 bp, Artificial
  CRISPR gRNA sequence
caggagcgcaggtcctcgtt

SEQ ID NO: 189083 - DNA, 20 bp, Artificial
  CRISPR gRNA sequence
aggagcgcaggtcctcgttc

SEQ ID NO: 189084 - DNA, 20 bp, Artificial
  CRISPR gRNA sequence
ggagcgcaggtcctcgttca

SEQ ID NO: 189085 - DNA, 20 bp, Artificial
  CRISPR gRNA sequence
cgcaggtcctcgttcagggc

SEQ ID NO: 189086 - DNA, 20 bp, Artificial
  CRISPR gRNA sequence
gcaggtcctcgttcagggcg

SEQ ID NO: 189087 - DNA, 20 bp, Artificial
  CRISPR gRNA sequence
cgaggtaatccttgccatcg

SEQ ID NO: 189088 - DNA, 20 bp, Artificial
  CRISPR gRNA sequence
gaggtaatccttgccatcgt

SEQ ID NO: 189089 - DNA, 20 bp, Artificial
  CRISPR gRNA sequence
aggcatactgttcatacccg

SEQ ID NO: 189090 - DNA, 20 bp, Artificial
  CRISPR gRNA sequence
gcatactgttcatacccgcg

SEQ ID NO: 189091 - DNA, 20 bp, Artificial
  CRISPR gRNA sequence
catactgttcatacccgcgg

SEQ ID NO: 189092 - DNA, 20 bp, Artificial
  CRISPR gRNA sequence
tactgttcatacccgcggag

SEQ ID NO: 189093 - DNA, 20 bp, Artificial
  CRISPR gRNA sequence
actgttcatacccgcggagg

SEQ ID NO: 189094 - DNA, 20 bp, Artificial
  CRISPR gRNA sequence
cccgcggaggaggcgtccgt

SEQ ID NO: 189095 - DNA, 20 bp, Artificial
  CRISPR gRNA sequence
aggaggcgtccgtcggaccc

SEQ ID NO: 189096 - DNA, 20 bp, Artificial
  CRISPR gRNA sequence
ggaggcgtccgtcggacccc

SEQ ID NO: 189097 - DNA, 20 bp, Artificial
  CRISPR gRNA sequence
gtccgtcggaccccaggtcg

SEQ ID NO: 189098 - DNA, 20 bp, Artificial
  CRISPR gRNA sequence
ggtcgcagccaatcatccac

SEQ ID NO: 189099 - DNA, 20 bp, Artificial
  CRISPR gRNA sequence
tcgcagccaatcatccactg

SEQ ID NO: 189100 - DNA, 20 bp, Artificial
  CRISPR gRNA sequence
cgcagccaatcatccactgg

SEQ ID NO: 189101 - DNA, 20 bp, Artificial
  CRISPR gRNA sequence
gcagccaatcatccactgga

SEQ ID NO: 189102 - DNA, 20 bp, Artificial
  CRISPR gRNA sequence
aatcatccactggagggtgt

SEQ ID NO: 189103 - DNA, 20 bp, Artificial
  CRISPR gRNA sequence
cactggagggtgtgagaacc

SEQ ID NO: 189104 - DNA, 20 bp, Artificial
  CRISPR gRNA sequence
agaacctggccccaccccct

SEQ ID NO: 189105 - DNA, 20 bp, Artificial
  CRISPR gRNA sequence
cctggccccaccccctcggt

SEQ ID NO: 189106 - DNA, 20 bp, Artificial
  CRISPR gRNA sequence
ctcggtcagccccgcccacc

SEQ ID NO: 189107 - DNA, 20 bp, Artificial
  CRISPR gRNA sequence
caccgagcctcgccctcgcc

SEQ ID NO: 189108 - DNA, 20 bp, Artificial
  CRISPR gRNA sequence
ccctcgcccggacccacccg

SEQ ID NO: 189109 - DNA, 20 bp, Artificial
  CRISPR gRNA sequence
cctcgcccggacccacccgc

SEQ ID NO: 189110 - DNA, 20 bp, Artificial
  CRISPR gRNA sequence
ctcgcccggacccacccgcg

SEQ ID NO: 189111 - DNA, 20 bp, Artificial
  CRISPR gRNA sequence
ggacccacccgcggggattt

SEQ ID NO: 189112 - DNA, 20 bp, Artificial
  CRISPR gRNA sequence
cacccgcggggattttggta

SEQ ID NO: 189113 - DNA, 20 bp, Artificial
  CRISPR gRNA sequence
acccgcggggattttggtaa

SEQ ID NO: 189114 - DNA, 20 bp, Artificial
  CRISPR gRNA sequence
ggattttggtaaaggcgcct

SEQ ID NO: 189115 - DNA, 20 bp, Artificial
  CRISPR gRNA sequence
gattttggtaaaggcgcctt

SEQ ID NO: 189116 - DNA, 20 bp, Artificial
  CRISPR gRNA sequence
attttggtaaaggcgccttg

SEQ ID NO: 189117 - DNA, 20 bp, Artificial
  CRISPR gRNA sequence
aaggcgccttggggttctcc

SEQ ID NO: 189118 - DNA, 20 bp, Artificial
  CRISPR gRNA sequence
aggcgccttggggttctccc

SEQ ID NO: 189119 - DNA, 20 bp, Artificial
  CRISPR gRNA sequence
cgccttggggttctcccagg

SEQ ID NO: 189120 - DNA, 20 bp, Artificial
  CRISPR gRNA sequence
ccttggggttctcccaggta

SEQ ID NO: 189121 - DNA, 20 bp, Artificial
  CRISPR gRNA sequence
cttggggttctcccaggtag

SEQ ID NO: 189122 - DNA, 20 bp, Artificial
  CRISPR gRNA sequence
ttggggttctcccaggtaga

SEQ ID NO: 189123 - DNA, 20 bp, Artificial
  CRISPR gRNA sequence
gttctcccaggtagagggtc

SEQ ID NO: 189124 - DNA, 20 bp, Artificial
  CRISPR gRNA sequence
ttctcccaggtagagggtct

SEQ ID NO: 189125 - DNA, 20 bp, Artificial
  CRISPR gRNA sequence
tcccaggtagagggtctggg

SEQ ID NO: 189126 - DNA, 20 bp, Artificial
  CRISPR gRNA sequence
cccaggtagagggtctgggc

SEQ ID NO: 189127 - DNA, 20 bp, Artificial
  CRISPR gRNA sequence
gagggtctgggcgggtcccg

SEQ ID NO: 189128 - DNA, 20 bp, Artificial
  CRISPR gRNA sequence
ctgggcgggtcccgcggcct

SEQ ID NO: 189129 - DNA, 20 bp, Artificial
  CRISPR gRNA sequence
tgggcgggtcccgcggcctc

SEQ ID NO: 189130 - DNA, 20 bp, Artificial
  CRISPR gRNA sequence
gggcgggtcccgcggcctcg

SEQ ID NO: 189131 - DNA, 20 bp, Artificial
  CRISPR gRNA sequence
cgggtcccgcggcctcgggg

SEQ ID NO: 189132 - DNA, 20 bp, Artificial
  CRISPR gRNA sequence
cgcggcctcggggtggatcc

SEQ ID NO: 189133 - DNA, 20 bp, Artificial
  CRISPR gRNA sequence
ctcggggtggatcccagacc

SEQ ID NO: 189134 - DNA, 20 bp, Artificial
  CRISPR gRNA sequence
cggggtggatcccagacccg

SEQ ID NO: 189135 - DNA, 20 bp, Artificial
  CRISPR gRNA sequence
ggatcccagacccggagact

SEQ ID NO: 189136 - DNA, 20 bp, Artificial
  CRISPR gRNA sequence
gatcccagacccggagactc

SEQ ID NO: 189137 - DNA, 20 bp, Artificial
  CRISPR gRNA sequence
tcccagacccggagactcgg

SEQ ID NO: 189138 - DNA, 20 bp, Artificial
  CRISPR gRNA sequence
cccggagactcgggagtacc

SEQ ID NO: 189139 - DNA, 20 bp, Artificial
  CRISPR gRNA sequence
ccggagactcgggagtaccc

SEQ ID NO: 189140 - DNA, 20 bp, Artificial
  CRISPR gRNA sequence
gggagtacccgggccgtccg

SEQ ID NO: 189141 - DNA, 20 bp, Artificial
  CRISPR gRNA sequence
ggagtacccgggccgtccgt

SEQ ID NO: 189142 - DNA, 20 bp, Artificial
  CRISPR gRNA sequence
gagtacccgggccgtccgtg

SEQ ID NO: 189143 - DNA, 20 bp, Artificial
  CRISPR gRNA sequence
cccgggccgtccgtggggca

SEQ ID NO: 189144 - DNA, 20 bp, Artificial
  CRISPR gRNA sequence
cgggccgtccgtggggcatg

SEQ ID NO: 189145 - DNA, 20 bp, Artificial
  CRISPR gRNA sequence
gggccgtccgtggggcatgg

SEQ ID NO: 189146 - DNA, 20 bp, Artificial
  CRISPR gRNA sequence
ccgtccgtggggcatggagg

SEQ ID NO: 189147 - DNA, 20 bp, Artificial
  CRISPR gRNA sequence
cgtccgtggggcatggaggt

SEQ ID NO: 189148 - DNA, 20 bp, Artificial
  CRISPR gRNA sequence
gtccgtggggcatggaggtg

SEQ ID NO: 189149 - DNA, 20 bp, Artificial
  CRISPR gRNA sequence
tccgtggggcatggaggtgg

SEQ ID NO: 189150 - DNA, 20 bp, Artificial
  CRISPR gRNA sequence
gggggtcgtgatctgctccc

SEQ ID NO: 189151 - DNA, 20 bp, Artificial
  CRISPR gRNA sequence
ggggtcgtgatctgctccct

SEQ ID NO: 189152 - DNA, 20 bp, Artificial
  CRISPR gRNA sequence
tcgtgatctgctccctgggc

SEQ ID NO: 189153 - DNA, 20 bp, Artificial
  CRISPR gRNA sequence
gtgatctgctccctgggccg

SEQ ID NO: 189154 - DNA, 20 bp, Artificial
  CRISPR gRNA sequence
cctgggccggagttactcac

SEQ ID NO: 189155 - DNA, 20 bp, Artificial
  CRISPR gRNA sequence
gttactcactggcctcgctc

SEQ ID NO: 189156 - DNA, 20 bp, Artificial
  CRISPR gRNA sequence
cactggcctcgctctggttg

SEQ ID NO: 189157 - DNA, 20 bp, Artificial
  CRISPR gRNA sequence
tggcctcgctctggttgtag

SEQ ID NO: 189158 - DNA, 20 bp, Artificial
  CRISPR gRNA sequence
ctctggttgtagtagccgcg

SEQ ID NO: 189159 - DNA, 20 bp, Artificial
  CRISPR gRNA sequence
tctggttgtagtagccgcgc

SEQ ID NO: 189160 - DNA, 20 bp, Artificial
  CRISPR gRNA sequence
ctggttgtagtagccgcgca

SEQ ID NO: 189161 - DNA, 20 bp, Artificial
  CRISPR gRNA sequence
tagtagccgcgcagggtctg

SEQ ID NO: 189162 - DNA, 20 bp, Artificial
  CRISPR gRNA sequence
agtagccgcgcagggtctgc

SEQ ID NO: 189163 - DNA, 20 bp, Artificial
  CRISPR gRNA sequence
ggtctgcaggttcattctgt

SEQ ID NO: 189164 - DNA, 20 bp, Artificial
  CRISPR gRNA sequence
tcattctgtcagtctgtgcg

SEQ ID NO: 189165 - DNA, 20 bp, Artificial
  CRISPR gRNA sequence
cattctgtcagtctgtgcgt

SEQ ID NO: 189166 - DNA, 20 bp, Artificial
  CRISPR gRNA sequence
gtcagtctgtgcgtgggcct

SEQ ID NO: 189167 - DNA, 20 bp, Artificial
  CRISPR gRNA sequence
gtctcctcttcccaatactc

SEQ ID NO: 189168 - DNA, 20 bp, Artificial
  CRISPR gRNA sequence
ggcccctcctgctccaccca

SEQ ID NO: 189169 - DNA, 20 bp, Artificial
  CRISPR gRNA sequence
tgctccacccacggcgcccg

SEQ ID NO: 189170 - DNA, 20 bp, Artificial
  CRISPR gRNA sequence
ggcgcccgcggctccatcct

SEQ ID NO: 189171 - DNA, 20 bp, Artificial
  CRISPR gRNA sequence
gctccatcctcggacacgcc

SEQ ID NO: 189172 - DNA, 20 bp, Artificial
  CRISPR gRNA sequence
cgaactgcgtgtcgtccacg

SEQ ID NO: 189173 - DNA, 20 bp, Artificial
  CRISPR gRNA sequence
cgtgtcgtccacgtagccca

SEQ ID NO: 189174 - DNA, 20 bp, Artificial
  CRISPR gRNA sequence
ccacgtagcccatggcgatg

SEQ ID NO: 189175 - DNA, 20 bp, Artificial
  CRISPR gRNA sequence
cgtagcccatggcgatgaag

SEQ ID NO: 189176 - DNA, 20 bp, Artificial
  CRISPR gRNA sequence
gtagcccatggcgatgaagc

SEQ ID NO: 189177 - DNA, 20 bp, Artificial
  CRISPR gRNA sequence
tagcccatggcgatgaagcg

SEQ ID NO: 189178 - DNA, 20 bp, Artificial
  CRISPR gRNA sequence
cgatgaagcggggctccccg

SEQ ID NO: 189179 - DNA, 20 bp, Artificial
  CRISPR gRNA sequence
gaagcggggctccccgcggc

SEQ ID NO: 189180 - DNA, 20 bp, Artificial
  CRISPR gRNA sequence
aagcggggctccccgcggcc

SEQ ID NO: 189181 - DNA, 20 bp, Artificial
  CRISPR gRNA sequence
ggggctccccgcggccgggc

SEQ ID NO: 189182 - DNA, 20 bp, Artificial
  CRISPR gRNA sequence
gggctccccgcggccgggcc

SEQ ID NO: 189183 - DNA, 20 bp, Artificial
  CRISPR gRNA sequence
cccgcggccgggccgggaca

SEQ ID NO: 189184 - DNA, 20 bp, Artificial
  CRISPR gRNA sequence
gcggccgggccgggacacgg

SEQ ID NO: 189185 - DNA, 20 bp, Artificial
  CRISPR gRNA sequence
ggcggcgctgaaatacctca

SEQ ID NO: 189186 - DNA, 20 bp, Artificial
  CRISPR gRNA sequence
cggcgctgaaatacctcatg

SEQ ID NO: 189187 - DNA, 20 bp, Artificial
  CRISPR gRNA sequence
cgctgaaatacctcatggag

SEQ ID NO: 189188 - DNA, 20 bp, Artificial
  CRISPR gRNA sequence
gctgaaatacctcatggagt

SEQ ID NO: 189189 - DNA, 20 bp, Artificial
  CRISPR gRNA sequence
tgaaatacctcatggagtgg

SEQ ID NO: 189190 - DNA, 20 bp, Artificial
  CRISPR gRNA sequence
tacctcatggagtgggagcc

SEQ ID NO: 189191 - DNA, 20 bp, Artificial
  CRISPR gRNA sequence
acctcatggagtgggagcct

SEQ ID NO: 189192 - DNA, 20 bp, Artificial
  CRISPR gRNA sequence
cctcatggagtgggagcctg

SEQ ID NO: 189193 - DNA, 20 bp, Artificial
  CRISPR gRNA sequence
ctcatggagtgggagcctgg

SEQ ID NO: 189194 - DNA, 20 bp, Artificial
  CRISPR gRNA sequence
tggagtgggagcctgggggc

SEQ ID NO: 189195 - DNA, 20 bp, Artificial
  CRISPR gRNA sequence
ggagtgggagcctgggggcg

SEQ ID NO: 189196 - DNA, 20 bp, Artificial
  CRISPR gRNA sequence
agtgggagcctgggggcgag

SEQ ID NO: 189197 - DNA, 20 bp, Artificial
  CRISPR gRNA sequence
gtgggagcctgggggcgagg

SEQ ID NO: 189198 - DNA, 20 bp, Artificial
  CRISPR gRNA sequence
tgggagcctgggggcgagga

SEQ ID NO: 189199 - DNA, 20 bp, Artificial
  CRISPR gRNA sequence
gggagcctgggggcgaggag

SEQ ID NO: 189200 - DNA, 20 bp, Artificial
  CRISPR gRNA sequence
cctgggggcgaggaggggtt

SEQ ID NO: 189201 - DNA, 20 bp, Artificial
  CRISPR gRNA sequence
gacccgcccgaccctcctcc

SEQ ID NO: 189202 - DNA, 20 bp, Artificial
  CRISPR gRNA sequence
gcccgaccctcctcccggcg

SEQ ID NO: 189203 - DNA, 20 bp, Artificial
  CRISPR gRNA sequence
ctcctcccggcgcggctgcc

SEQ ID NO: 189204 - DNA, 20 bp, Artificial
  CRISPR gRNA sequence
gccgagtcctgcgcccccgc

SEQ ID NO: 189205 - DNA, 20 bp, Artificial
  CRISPR gRNA sequence
ccgagtcctgcgcccccgcc

SEQ ID NO: 189206 - DNA, 20 bp, Artificial
  CRISPR gRNA sequence
agtcctgcgcccccgccagg

SEQ ID NO: 189207 - DNA, 20 bp, Artificial
  CRISPR gRNA sequence
gtcctgcgcccccgccaggc

SEQ ID NO: 189208 - DNA, 20 bp, Artificial
  CRISPR gRNA sequence
gggcccctccctcctccgcg

SEQ ID NO: 189209 - DNA, 20 bp, Artificial
  CRISPR gRNA sequence
ggcccctccctcctccgcgc

SEQ ID NO: 189210 - DNA, 20 bp, Artificial
  CRISPR gRNA sequence
gcccctccctcctccgcgca

SEQ ID NO: 189211 - DNA, 20 bp, Artificial
  CRISPR gRNA sequence
cccctccctcctccgcgcag

SEQ ID NO: 189212 - DNA, 20 bp, Artificial
  CRISPR gRNA sequence
tgaccccgcactcacccgcc

SEQ ID NO: 189213 - DNA, 20 bp, Artificial
  CRISPR gRNA sequence
gaccccgcactcacccgccc

SEQ ID NO: 189214 - DNA, 20 bp, Artificial
  CRISPR gRNA sequence
gcactcacccgcccaggtct

SEQ ID NO: 189215 - DNA, 20 bp, Artificial
  CRISPR gRNA sequence
tcacccgcccaggtctcggt

SEQ ID NO: 189216 - DNA, 20 bp, Artificial
  CRISPR gRNA sequence
cacccgcccaggtctcggtc

SEQ ID NO: 189217 - DNA, 20 bp, Artificial
  CRISPR gRNA sequence
acccgcccaggtctcggtca

SEQ ID NO: 189218 - DNA, 20 bp, Artificial
  CRISPR gRNA sequence
gcccaggtctcggtcagggt

SEQ ID NO: 189219 - DNA, 20 bp, Artificial
  CRISPR gRNA sequence
cccaggtctcggtcagggtc

SEQ ID NO: 189220 - DNA, 20 bp, Artificial
  CRISPR gRNA sequence
ccaggtctcggtcagggtca

SEQ ID NO: 189221 - DNA, 20 bp, Artificial
  CRISPR gRNA sequence
cggtcagggtcagggccccc

SEQ ID NO: 189222 - DNA, 20 bp, Artificial
  CRISPR gRNA sequence
gtcagggtcagggcccccga

SEQ ID NO: 189223 - DNA, 20 bp, Artificial
  CRISPR gRNA sequence
agggtcagggcccccgagag

SEQ ID NO: 189224 - DNA, 20 bp, Artificial
  CRISPR gRNA sequence
gtcagggcccccgagagcag

SEQ ID NO: 189225 - DNA, 20 bp, Artificial
  CRISPR gRNA sequence
tcagggcccccgagagcagc

SEQ ID NO: 189226 - DNA, 20 bp, Artificial
  CRISPR gRNA sequence
gggcccccgagagcagcagg

SEQ ID NO: 189227 - DNA, 20 bp, Artificial
  CRISPR gRNA sequence
gcccccgagagcagcaggaa

SEQ ID NO: 189228 - DNA, 20 bp, Artificial
  CRISPR gRNA sequence
cccccgagagcagcaggaag

SEQ ID NO: 189229 - DNA, 20 bp, Artificial
  CRISPR gRNA sequence
ccccgagagcagcaggaaga

SEQ ID NO: 189230 - DNA, 20 bp, Artificial
  CRISPR gRNA sequence
agagcagcaggaagagggtt

SEQ ID NO: 189231 - DNA, 20 bp, Artificial
  CRISPR gRNA sequence
gagcagcaggaagagggttc

SEQ ID NO: 189232 - DNA, 20 bp, Artificial
  CRISPR gRNA sequence
agcagcaggaagagggttcg

SEQ ID NO: 189233 - DNA, 20 bp, Artificial
  CRISPR gRNA sequence
ggcgccatgaccaccatcct

SEQ ID NO: 189234 - DNA, 20 bp, Artificial
  CRISPR gRNA sequence
tgaccaccatccttggcgtc

SEQ ID NO: 189235 - DNA, 20 bp, Artificial
  CRISPR gRNA sequence
gaccaccatccttggcgtct

SEQ ID NO: 189236 - DNA, 20 bp, Artificial
  CRISPR gRNA sequence
accaccatccttggcgtctg

SEQ ID NO: 189237 - DNA, 20 bp, Artificial
  CRISPR gRNA sequence
caccatccttggcgtctggg

SEQ ID NO: 189238 - DNA, 20 bp, Artificial
  CRISPR gRNA sequence
ccttggcgtctggggagaat

SEQ ID NO: 189239 - DNA, 20 bp, Artificial
  CRISPR gRNA sequence
gcgtctggggagaatgagtc

SEQ ID NO: 189240 - DNA, 20 bp, Artificial
  CRISPR gRNA sequence
cgtctggggagaatgagtcc

SEQ ID NO: 189241 - DNA, 20 bp, Artificial
  CRISPR gRNA sequence
ctggggagaatgagtccggg

SEQ ID NO: 189242 - DNA, 20 bp, Artificial
  CRISPR gRNA sequence
tggggagaatgagtccgggt

SEQ ID NO: 189243 - DNA, 20 bp, Artificial
  CRISPR gRNA sequence
gagaatgagtccgggtgggt

SEQ ID NO: 189244 - DNA, 20 bp, Artificial
  CRISPR gRNA sequence
atgagtccgggtgggtgagc

SEQ ID NO: 189245 - DNA, 20 bp, Artificial
  CRISPR gRNA sequence
tgagtccgggtgggtgagcg

SEQ ID NO: 189246 - DNA, 20 bp, Artificial
  CRISPR gRNA sequence
gggtgggtgagcgaggactt

SEQ ID NO: 189247 - DNA, 20 bp, Artificial
  CRISPR gRNA sequence
gtgagcgaggactttagaac

SEQ ID NO: 189248 - DNA, 20 bp, Artificial
  CRISPR gRNA sequence
tgagcgaggactttagaacc

SEQ ID NO: 189249 - DNA, 20 bp, Artificial
  CRISPR gRNA sequence
ggactttagaaccaggaccg

SEQ ID NO: 189250 - DNA, 20 bp, Artificial
  CRISPR gRNA sequence
aggaccgcggcgacgctgat

SEQ ID NO: 189251 - DNA, 20 bp, Artificial
  CRISPR gRNA sequence
actcattctccccagacgcc

SEQ ID NO: 189252 - DNA, 20 bp, Artificial
  CRISPR gRNA sequence
tgaccctgaccgagacctgg

SEQ ID NO: 189253 - DNA, 20 bp, Artificial
  CRISPR gRNA sequence
cctgaccgagacctgggcgg

SEQ ID NO: 189254 - DNA, 20 bp, Artificial
  CRISPR gRNA sequence
gagacctgggcgggtgagtg

SEQ ID NO: 189255 - DNA, 20 bp, Artificial
  CRISPR gRNA sequence
ctcggcagccgcgccgggag

SEQ ID NO: 189256 - DNA, 20 bp, Artificial
  CRISPR gRNA sequence
cgcgccgggaggagggtcgg

SEQ ID NO: 189257 - DNA, 20 bp, Artificial
  CRISPR gRNA sequence
gacagcgactcggcgtgtcc

SEQ ID NO: 189258 - DNA, 20 bp, Artificial
  CRISPR gRNA sequence
aggatggagccgcgggcgcc

SEQ ID NO: 189259 - DNA, 20 bp, Artificial
  CRISPR gRNA sequence
gtgggtggagcaggaggggc

SEQ ID NO: 189260 - DNA, 20 bp, Artificial
  CRISPR gRNA sequence
aaggcccacgcacagactga

SEQ ID NO: 189261 - DNA, 20 bp, Artificial
  CRISPR gRNA sequence
ctacaaccagagcgaggcca

SEQ ID NO: 189262 - DNA, 20 bp, Artificial
  CRISPR gRNA sequence
ctccatgccccacggacggc

SEQ ID NO: 189263 - DNA, 20 bp, Artificial
  CRISPR gRNA sequence
cacggacggcccgggtactc

SEQ ID NO: 189264 - DNA, 20 bp, Artificial
  CRISPR gRNA sequence
gcccgggtactcccgagtct

SEQ ID NO: 189265 - DNA, 20 bp, Artificial
  CRISPR gRNA sequence
tactcccgagtctccgggtc

SEQ ID NO: 189266 - DNA, 20 bp, Artificial
  CRISPR gRNA sequence
gcgcctttaccaaaatcccc

SEQ ID NO: 189267 - DNA, 20 bp, Artificial
  CRISPR gRNA sequence
ctttaccaaaatccccgcgg

SEQ ID NO: 189268 - DNA, 20 bp, Artificial
  CRISPR gRNA sequence
cggtgggcggggctgaccga

SEQ ID NO: 189269 - DNA, 20 bp, Artificial
  CRISPR gRNA sequence
ccaggttctcacaccctcca

SEQ ID NO: 189270 - DNA, 20 bp, Artificial
  CRISPR gRNA sequence
gtggatgattggctgcgacc

SEQ ID NO: 189271 - DNA, 20 bp, Artificial
  CRISPR gRNA sequence
gtccgacggacgcctcctcc

SEQ ID NO: 189272 - DNA, 20 bp, Artificial
  CRISPR gRNA sequence
aacagtatgcctacgatggc

SEQ ID NO: 189273 - DNA, 20 bp, Artificial
  CRISPR gRNA sequence
ctacctggagggcacgtgcg

SEQ ID NO: 189274 - DNA, 20 bp, Artificial
  CRISPR gRNA sequence
ggaaggagatgctgcagcgc

SEQ ID NO: 189275 - DNA, 20 bp, Artificial
  CRISPR gRNA sequence
gaggaaaatgggaccaacac

SEQ ID NO: 189276 - DNA, 20 bp, Artificial
  CRISPR gRNA sequence
tccctctggtcctgagggag

SEQ ID NO: 189277 - DNA, 20 bp, Artificial
  CRISPR gRNA sequence
cctgagggagaggaatcctc

SEQ ID NO: 189278 - DNA, 20 bp, Artificial
  CRISPR gRNA sequence
ggtttccagatcctgtacca

SEQ ID NO: 189279 - DNA, 20 bp, Artificial
  CRISPR gRNA sequence
cctgctctctgggacaatta

SEQ ID NO: 189280 - DNA, 20 bp, Artificial
  CRISPR gRNA sequence
ttaagggatgaagtctctga

SEQ ID NO: 189281 - DNA, 20 bp, Artificial
  CRISPR gRNA sequence
caatccctggaagactgatc

SEQ ID NO: 189282 - DNA, 20 bp, Artificial
  CRISPR gRNA sequence
gcctcacactcaatgtgtgt

SEQ ID NO: 189283 - DNA, 20 bp, Artificial
  CRISPR gRNA sequence
ggggtctgactccagctcct

SEQ ID NO: 189284 - DNA, 20 bp, Artificial
  CRISPR gRNA sequence
tcagagactagaactttcca

SEQ ID NO: 189285 - DNA, 20 bp, Artificial
  CRISPR gRNA sequence
gcccgtgtccaggctggtgt

SEQ ID NO: 189286 - DNA, 20 bp, Artificial
  CRISPR gRNA sequence
ccaggtatctggttcattct

SEQ ID NO: 189287 - DNA, 20 bp, Artificial
  CRISPR gRNA sequence
tggtcacatccaggtgctgc

SEQ ID NO: 189288 - DNA, 20 bp, Artificial
  CRISPR gRNA sequence
ccatgagagatgcaaagtgc

SEQ ID NO: 189289 - DNA, 20 bp, Artificial
  CRISPR gRNA sequence
agatcatactgacctggcag

SEQ ID NO: 189290 - DNA, 20 bp, Artificial
  CRISPR gRNA sequence
tcgtggagaccaggcctgca

SEQ ID NO: 189291 - DNA, 20 bp, Artificial
  CRISPR gRNA sequence
cggagcccctcatgctgaga

SEQ ID NO: 189292 - DNA, 20 bp, Artificial
  CRISPR gRNA sequence
gcctctctgaagacctttaa

SEQ ID NO: 189293 - DNA, 20 bp, Artificial
  CRISPR gRNA sequence
cagggtcggtggtgagggct

SEQ ID NO: 189294 - DNA, 20 bp, Artificial
  CRISPR gRNA sequence
ccctgcccaccatccccatc

SEQ ID NO: 189295 - DNA, 20 bp, Artificial
  CRISPR gRNA sequence
aagaagagctcaggtaagga

SEQ ID NO: 189296 - DNA, 20 bp, Artificial
  CRISPR gRNA sequence
ggtaaggaaggggtgacaag

SEQ ID NO: 189297 - DNA, 20 bp, Artificial
  CRISPR gRNA sequence
gaaggggtgacaagtggggt

SEQ ID NO: 189298 - DNA, 20 bp, Artificial
  CRISPR gRNA sequence
ctgagttttcttgtcccact

SEQ ID NO: 189299 - DNA, 20 bp, Artificial
  CRISPR gRNA sequence
ccagcaacgatacccatgat

SEQ ID NO: 189300 - DNA, 20 bp, Artificial
  CRISPR gRNA sequence
ctgggaaaggaggtgaaggt

SEQ ID NO: 189301 - DNA, 20 bp, Artificial
  CRISPR gRNA sequence
gtctccacgagctccacgtc

SEQ ID NO: 189302 - DNA, 20 bp, Artificial
  CRISPR gRNA sequence
ccaggtcagtatgatctccg

SEQ ID NO: 189303 - DNA, 20 bp, Artificial
  CRISPR gRNA sequence
aagcccagggcccagcacct

SEQ ID NO: 189304 - DNA, 20 bp, Artificial
  CRISPR gRNA sequence
ggtggcctcatagtcaaaga

SEQ ID NO: 189305 - DNA, 20 bp, Artificial
  CRISPR gRNA sequence
tcatagtcaaagacagggtg

SEQ ID NO: 189306 - DNA, 20 bp, Artificial
  CRISPR gRNA sequence
gtgggtcacgtgtgtcttgg

SEQ ID NO: 189307 - DNA, 20 bp, Artificial
  CRISPR gRNA sequence
tcttgggggggtctgaaagg

SEQ ID NO: 189308 - DNA, 20 bp, Artificial
  CRISPR gRNA sequence
atgggacactccagcagcac

SEQ ID NO: 189309 - DNA, 20 bp, Artificial
  CRISPR gRNA sequence
cacctggatgtgaccatcct

SEQ ID NO: 189310 - DNA, 20 bp, Artificial
  CRISPR gRNA sequence
ctaagaatgaaccagatacc

SEQ ID NO: 189311 - DNA, 20 bp, Artificial
  CRISPR gRNA sequence
ccagcctggacacgggcacc

SEQ ID NO: 189312 - DNA, 20 bp, Artificial
  CRISPR gRNA sequence
cagggacctccggttctgac

SEQ ID NO: 189313 - DNA, 20 bp, Artificial
  CRISPR gRNA sequence
gccaagggactcagaggagc

SEQ ID NO: 189314 - DNA, 20 bp, Artificial
  CRISPR gRNA sequence
gagtcagacccccacacaca

SEQ ID NO: 189315 - DNA, 20 bp, Artificial
  CRISPR gRNA sequence
tcctggtgccaaggctgctg

SEQ ID NO: 189316 - DNA, 20 bp, Artificial
  CRISPR gRNA sequence
gaacccctgatcagtcttcc

SEQ ID NO: 189317 - DNA, 20 bp, Artificial
  CRISPR gRNA sequence
cagagagcaggacgggccct

SEQ ID NO: 189318 - DNA, 20 bp, Artificial
  CRISPR gRNA sequence
ctcagaatcactctctggta

SEQ ID NO: 189319 - DNA, 20 bp, Artificial
  CRISPR gRNA sequence
tacaggatctggaaacccag

SEQ ID NO: 189320 - DNA, 20 bp, Artificial
  CRISPR gRNA sequence
tcgcagccaatcatccactg

SEQ ID NO: 189321 - DNA, 20 bp, Artificial
  CRISPR gRNA sequence
cctcgcccggacccacccgc

SEQ ID NO: 189322 - DNA, 20 bp, Artificial
  CRISPR gRNA sequence
ggattttggtaaaggcgcct

SEQ ID NO: 189323 - DNA, 20 bp, Artificial
  CRISPR gRNA sequence
ccttggggttctcccaggta

SEQ ID NO: 189324 - DNA, 20 bp, Artificial
  CRISPR gRNA sequence
ctcccaggtagagggtctgg

SEQ ID NO: 189325 - DNA, 20 bp, Artificial
  CRISPR gRNA sequence
ctgggcgggtcccgcggcct

SEQ ID NO: 189326 - DNA, 20 bp, Artificial
  CRISPR gRNA sequence
gcgggtcccgcggcctcggg

SEQ ID NO: 189327 - DNA, 20 bp, Artificial
  CRISPR gRNA sequence
gatcccagacccggagactc

SEQ ID NO: 189328 - DNA, 20 bp, Artificial
  CRISPR gRNA sequence
cgtccgtggggcatggaggt

SEQ ID NO: 189329 - DNA, 20 bp, Artificial
  CRISPR gRNA sequence
tcgtgatctgctccctgggc

SEQ ID NO: 189330 - DNA, 20 bp, Artificial
  CRISPR gRNA sequence
ctctggttgtagtagccgcg

SEQ ID NO: 189331 - DNA, 20 bp, Artificial
  CRISPR gRNA sequence
cggctccatcctcggacacg

SEQ ID NO: 189332 - DNA, 20 bp, Artificial
  CRISPR gRNA sequence
ggcggcgctgaaatacctca

SEQ ID NO: 189333 - DNA, 20 bp, Artificial
  CRISPR gRNA sequence
gtgggagcctgggggcgagg

SEQ ID NO: 189334 - DNA, 20 bp, Artificial
  CRISPR gRNA sequence
ccctcctcccggcgcggctg

SEQ ID NO: 189335 - DNA, 20 bp, Artificial
  CRISPR gRNA sequence
tcacccgcccaggtctcggt

SEQ ID NO: 189336 - DNA, 20 bp, Artificial
  CRISPR gRNA sequence
gcccccgagagcagcaggaa

SEQ ID NO: 189337 - DNA, 20 bp, Artificial
  CRISPR gRNA sequence
caccatccttggcgtctggg

SEQ ID NO: 189338 - DNA, 20 bp, Artificial
  CRISPR gRNA sequence
atccttggcgtctggggaga

SEQ ID NO: 189339 - DNA, 20 bp, Artificial
  CRISPR gRNA sequence
ggcgtctggggagaatgagt

SEQ ID NO: 189340 - DNA, 20 bp, Artificial
  CRISPR gRNA sequence
tctggggagaatgagtccgg

SEQ ID NO: 189341 - DNA, 20 bp, Artificial
  CRISPR gRNA sequence
cccggcccggccgcggggag

SEQ ID NO: 189342 - DNA, 20 bp, Artificial
  CRISPR gRNA sequence
aggttctcacaccctccagt

SEQ ID NO: 189343 - DNA, 20 bp, Artificial
  CRISPR gRNA sequence
gaacagtatgcctacgatgg

SEQ ID NO: 189344 - DNA, 20 bp, Artificial
  CRISPR gRNA sequence
cctgagggagaggaatcctc

SEQ ID NO: 189345 - DNA, 20 bp, Artificial
  CRISPR gRNA sequence
tttccagatcctgtaccaga

SEQ ID NO: 189346 - DNA, 20 bp, Artificial
  CRISPR gRNA sequence
actagaactttccaaggaat

SEQ ID NO: 189347 - DNA, 20 bp, Artificial
  CRISPR gRNA sequence
agtgtcccatgagagatgca

SEQ ID NO: 189348 - DNA, 20 bp, Artificial
  CRISPR gRNA sequence
ccaccctgaggtgctgggcc

SEQ ID NO: 189349 - DNA, 20 bp, Artificial
  CRISPR gRNA sequence
gaaggggtgacaagtggggt

SEQ ID NO: 189350 - DNA, 20 bp, Artificial
  CRISPR gRNA sequence
ctgagttttcttgtcccact

SEQ ID NO: 189351 - DNA, 20 bp, Artificial
  CRISPR gRNA sequence
aggcagggcacacttctacc

SEQ ID NO: 189352 - DNA, 20 bp, Artificial
  CRISPR gRNA sequence
ttaaaggtcttcagagaggc

SEQ ID NO: 189353 - DNA, 20 bp, Artificial
  CRISPR gRNA sequence
ggaacccctgatcagtcttc

SEQ ID NO: 189354 - DNA, 20 bp, Artificial
  CRISPR gRNA sequence
gtacaggatctggaaaccca

SEQ ID NO: 189355 - DNA, 20 bp, Artificial
  CRISPR gRNA sequence
ccacattggccgcctcacac

SEQ ID NO: 189356 - DNA, 20 bp, Artificial
  CRISPR gRNA sequence
ccctcgcccggacccacccg

SEQ ID NO: 189357 - DNA, 20 bp, Artificial
  CRISPR gRNA sequence
ccctccctcctccgcgcagg

SEQ ID NO: 189358 - DNA, 20 bp, Artificial
  CRISPR gRNA sequence
tagaaccaggaccgcggcga

SEQ ID NO: 189359 - DNA, 20 bp, Artificial
  CRISPR gRNA sequence
ccaggaccgcggcgacgctg

SEQ ID NO: 189360 - DNA, 20 bp, Artificial
  CRISPR gRNA sequence
caaggcccacgcacagactg

SEQ ID NO: 189361 - DNA, 20 bp, Artificial
  CRISPR gRNA sequence
ggaggaaaatgggaccaaca

SEQ ID NO: 189362 - DNA, 20 bp, Artificial
  CRISPR gRNA sequence
tgcggtcgctgctgtgctgt

SEQ ID NO: 189363 - DNA, 20 bp, Artificial
  CRISPR gRNA sequence
gcttgaaacccccagtggga

SEQ ID NO: 189364 - DNA, 20 bp, Artificial
  CRISPR gRNA sequence
ggggggtctgaaaggaagag

SEQ ID NO: 189365 - DNA, 20 bp, Artificial
  CRISPR gRNA sequence
gcacctggatgtgaccatcc

SEQ ID NO: 189366 - DNA, 20 bp, Artificial
  CRISPR gRNA sequence
ccagagagcaggacgggccc

SEQ ID NO: 189367 - DNA, 20 bp, Artificial
  CRISPR gRNA sequence
ccaccatccttggcgtctgg

SEQ ID NO: 189368 - DNA, 20 bp, Artificial
  CRISPR gRNA sequence
tgaaacccccagtgggacaa

SEQ ID NO: 189369 - DNA, 20 bp, Artificial
  CRISPR gRNA sequence
cgacgctgattggcttctct

SEQ ID NO: 189370 - DNA, 20 bp, Artificial
  CRISPR gRNA sequence
ggtgacaggtttttagagaa

SEQ ID NO: 189371 - DNA, 20 bp, Artificial
  CRISPR gRNA sequence
ttagagaagccaatcagcgt

SEQ ID NO: 189372 - DNA, 20 bp, Artificial
  CRISPR gRNA sequence
tagagaagccaatcagcgtc

SEQ ID NO: 189373 - DNA, 20 bp, Artificial
  CRISPR gRNA sequence
agagaagccaatcagcgtcg

SEQ ID NO: 189374 - DNA, 20 bp, Artificial
  CRISPR gRNA sequence
gagaagccaatcagcgtcgc

SEQ ID NO: 189375 - DNA, 20 bp, Artificial
  CRISPR gRNA sequence
gttctaaagtcctcgctcac

SEQ ID NO: 189376 - DNA, 20 bp, Artificial
  CRISPR gRNA sequence
taaagtcctcgctcacccac

SEQ ID NO: 189377 - DNA, 20 bp, Artificial
  CRISPR gRNA sequence
aagtcctcgctcacccaccc

SEQ ID NO: 189378 - DNA, 20 bp, Artificial
  CRISPR gRNA sequence
gctcacccacccggactcat

SEQ ID NO: 189379 - DNA, 20 bp, Artificial
  CRISPR gRNA sequence
acccacccggactcattctc

SEQ ID NO: 189380 - DNA, 20 bp, Artificial
  CRISPR gRNA sequence
attctccccagacgccaagg

SEQ ID NO: 189381 - DNA, 20 bp, Artificial
  CRISPR gRNA sequence
tccccagacgccaaggatgg

SEQ ID NO: 189382 - DNA, 20 bp, Artificial
  CRISPR gRNA sequence
cccagacgccaaggatggtg

SEQ ID NO: 189383 - DNA, 20 bp, Artificial
  CRISPR gRNA sequence
ttcctgctgctctcgggggc

SEQ ID NO: 189384 - DNA, 20 bp, Artificial
  CRISPR gRNA sequence
cctgctgctctcgggggccc

SEQ ID NO: 189385 - DNA, 20 bp, Artificial
  CRISPR gRNA sequence
ctgctgctctcgggggccct

SEQ ID NO: 189386 - DNA, 20 bp, Artificial
  CRISPR gRNA sequence
ctgctctcgggggccctgac

SEQ ID NO: 189387 - DNA, 20 bp, Artificial
  CRISPR gRNA sequence
ctctcgggggccctgaccct

SEQ ID NO: 189388 - DNA, 20 bp, Artificial
  CRISPR gRNA sequence
tcgggggccctgaccctgac

SEQ ID NO: 189389 - DNA, 20 bp, Artificial
  CRISPR gRNA sequence
gggggccctgaccctgaccg

SEQ ID NO: 189390 - DNA, 20 bp, Artificial
  CRISPR gRNA sequence
accctgaccgagacctgggc

SEQ ID NO: 189391 - DNA, 20 bp, Artificial
  CRISPR gRNA sequence
accgagacctgggcgggtga

SEQ ID NO: 189392 - DNA, 20 bp, Artificial
  CRISPR gRNA sequence
ggcgggtgagtgcggggtca

SEQ ID NO: 189393 - DNA, 20 bp, Artificial
  CRISPR gRNA sequence
cgcggaggagggaggggccc

SEQ ID NO: 189394 - DNA, 20 bp, Artificial
  CRISPR gRNA sequence
gcgggggcgcaggactcggc

SEQ ID NO: 189395 - DNA, 20 bp, Artificial
  CRISPR gRNA sequence
ggcagccgcgccgggaggag

SEQ ID NO: 189396 - DNA, 20 bp, Artificial
  CRISPR gRNA sequence
aacccctcctcgcccccagg

SEQ ID NO: 189397 - DNA, 20 bp, Artificial
  CRISPR gRNA sequence
ctcgcccccaggctcccact

SEQ ID NO: 189398 - DNA, 20 bp, Artificial
  CRISPR gRNA sequence
gcccccaggctcccactcca

SEQ ID NO: 189399 - DNA, 20 bp, Artificial
  CRISPR gRNA sequence
ccactccatgaggtatttca

SEQ ID NO: 189400 - DNA, 20 bp, Artificial
  CRISPR gRNA sequence
catgaggtatttcagcgccg

SEQ ID NO: 189401 - DNA, 20 bp, Artificial
  CRISPR gRNA sequence
cagcgccgccgtgtcccggc

SEQ ID NO: 189402 - DNA, 20 bp, Artificial
  CRISPR gRNA sequence
agcgccgccgtgtcccggcc

SEQ ID NO: 189403 - DNA, 20 bp, Artificial
  CRISPR gRNA sequence
catcgccatgggctacgtgg

SEQ ID NO: 189404 - DNA, 20 bp, Artificial
  CRISPR gRNA sequence
atcgccatgggctacgtgga

SEQ ID NO: 189405 - DNA, 20 bp, Artificial
  CRISPR gRNA sequence
cgtggacgacacgcagttcg

SEQ ID NO: 189406 - DNA, 20 bp, Artificial
  CRISPR gRNA sequence
gtgcggttcgacagcgactc

SEQ ID NO: 189407 - DNA, 20 bp, Artificial
  CRISPR gRNA sequence
gacagcgactcggcgtgtcc

SEQ ID NO: 189408 - DNA, 20 bp, Artificial
  CRISPR gRNA sequence
ggcgtgtccgaggatggagc

SEQ ID NO: 189409 - DNA, 20 bp, Artificial
  CRISPR gRNA sequence
ggaagaggagacacggaaca

SEQ ID NO: 189410 - DNA, 20 bp, Artificial
  CRISPR gRNA sequence
acagaatgaacctgcagacc

SEQ ID NO: 189411 - DNA, 20 bp, Artificial
  CRISPR gRNA sequence
cagaccctgcgcggctacta

SEQ ID NO: 189412 - DNA, 20 bp, Artificial
  CRISPR gRNA sequence
cgcggctactacaaccagag

SEQ ID NO: 189413 - DNA, 20 bp, Artificial
  CRISPR gRNA sequence
ctacaaccagagcgaggcca

SEQ ID NO: 189414 - DNA, 20 bp, Artificial
  CRISPR gRNA sequence
caaccagagcgaggccagtg

SEQ ID NO: 189415 - DNA, 20 bp, Artificial
  CRISPR gRNA sequence
cggcccagggagcagatcac

SEQ ID NO: 189416 - DNA, 20 bp, Artificial
  CRISPR gRNA sequence
catgccccacggacggcccg

SEQ ID NO: 189417 - DNA, 20 bp, Artificial
  CRISPR gRNA sequence
ccgagtctccgggtctggga

SEQ ID NO: 189418 - DNA, 20 bp, Artificial
  CRISPR gRNA sequence
cgggtctgggatccaccccg

SEQ ID NO: 189419 - DNA, 20 bp, Artificial
  CRISPR gRNA sequence
ggatccaccccgaggccgcg

SEQ ID NO: 189420 - DNA, 20 bp, Artificial
  CRISPR gRNA sequence
tacctgggagaaccccaagg

SEQ ID NO: 189421 - DNA, 20 bp, Artificial
  CRISPR gRNA sequence
cctgggagaaccccaaggcg

SEQ ID NO: 189422 - DNA, 20 bp, Artificial
  CRISPR gRNA sequence
ggagaaccccaaggcgcctt

SEQ ID NO: 189423 - DNA, 20 bp, Artificial
  CRISPR gRNA sequence
taccaaaatccccgcgggtg

SEQ ID NO: 189424 - DNA, 20 bp, Artificial
  CRISPR gRNA sequence
accaaaatccccgcgggtgg

SEQ ID NO: 189425 - DNA, 20 bp, Artificial
  CRISPR gRNA sequence
ccaaaatccccgcgggtggg

SEQ ID NO: 189426 - DNA, 20 bp, Artificial
  CRISPR gRNA sequence
ggtgggcggggctgaccgag

SEQ ID NO: 189427 - DNA, 20 bp, Artificial
  CRISPR gRNA sequence
accgagggggtggggccagg

SEQ ID NO: 189428 - DNA, 20 bp, Artificial
  CRISPR gRNA sequence
tcacaccctccagtggatga

SEQ ID NO: 189429 - DNA, 20 bp, Artificial
  CRISPR gRNA sequence
acaccctccagtggatgatt

SEQ ID NO: 189430 - DNA, 20 bp, Artificial
  CRISPR gRNA sequence
cagtggatgattggctgcga

SEQ ID NO: 189431 - DNA, 20 bp, Artificial
  CRISPR gRNA sequence
gctgcgacctggggtccgac

SEQ ID NO: 189432 - DNA, 20 bp, Artificial
  CRISPR gRNA sequence
cgacctggggtccgacggac

SEQ ID NO: 189433 - DNA, 20 bp, Artificial
  CRISPR gRNA sequence
gggtccgacggacgcctcct

SEQ ID NO: 189434 - DNA, 20 bp, Artificial
  CRISPR gRNA sequence
ctccgcgggtatgaacagta

SEQ ID NO: 189435 - DNA, 20 bp, Artificial
  CRISPR gRNA sequence
cgcgggtatgaacagtatgc

SEQ ID NO: 189436 - DNA, 20 bp, Artificial
  CRISPR gRNA sequence
cgatggcaaggattacctcg

SEQ ID NO: 189437 - DNA, 20 bp, Artificial
  CRISPR gRNA sequence
cctcgccctgaacgaggacc

SEQ ID NO: 189438 - DNA, 20 bp, Artificial
  CRISPR gRNA sequence
gccctgaacgaggacctgcg

SEQ ID NO: 189439 - DNA, 20 bp, Artificial
  CRISPR gRNA sequence
aacgaggacctgcgctcctg

SEQ ID NO: 189440 - DNA, 20 bp, Artificial
  CRISPR gRNA sequence
cgctcctggaccgcagcgga

SEQ ID NO: 189441 - DNA, 20 bp, Artificial
  CRISPR gRNA sequence
ctggaccgcagcggacactg

SEQ ID NO: 189442 - DNA, 20 bp, Artificial
  CRISPR gRNA sequence
gaccgcagcggacactgcgg

SEQ ID NO: 189443 - DNA, 20 bp, Artificial
  CRISPR gRNA sequence
cggctcagatctccaagcgc

SEQ ID NO: 189444 - DNA, 20 bp, Artificial
  CRISPR gRNA sequence
agatctccaagcgcaagtgt

SEQ ID NO: 189445 - DNA, 20 bp, Artificial
  CRISPR gRNA sequence
caagcgcaagtgtgaggcgg

SEQ ID NO: 189446 - DNA, 20 bp, Artificial
  CRISPR gRNA sequence
aacaaaggagagcctacctg

SEQ ID NO: 189447 - DNA, 20 bp, Artificial
  CRISPR gRNA sequence
cctggagggcacgtgcgtgg

SEQ ID NO: 189448 - DNA, 20 bp, Artificial
  CRISPR gRNA sequence
gagggcacgtgcgtggagtg

SEQ ID NO: 189449 - DNA, 20 bp, Artificial
  CRISPR gRNA sequence
cacagatacctggagaacgg

SEQ ID NO: 189450 - DNA, 20 bp, Artificial
  CRISPR gRNA sequence
gagaacgggaaggagatgct

SEQ ID NO: 189451 - DNA, 20 bp, Artificial
  CRISPR gRNA sequence
cagcgcgcgggtaccagggg

SEQ ID NO: 189452 - DNA, 20 bp, Artificial
  CRISPR gRNA sequence
cctgatctcctgtagacctc

SEQ ID NO: 189453 - DNA, 20 bp, Artificial
  CRISPR gRNA sequence
atctcctgtagacctctcag

SEQ ID NO: 189454 - DNA, 20 bp, Artificial
  CRISPR gRNA sequence
ctgtagacctctcagcctgg

SEQ ID NO: 189455 - DNA, 20 bp, Artificial
  CRISPR gRNA sequence
tagacctctcagcctggcct

SEQ ID NO: 189456 - DNA, 20 bp, Artificial
  CRISPR gRNA sequence
tcagcctggcctagcacaag

SEQ ID NO: 189457 - DNA, 20 bp, Artificial
  CRISPR gRNA sequence
agcctggcctagcacaagga

SEQ ID NO: 189458 - DNA, 20 bp, Artificial
  CRISPR gRNA sequence
gcctagcacaaggagaggag

SEQ ID NO: 189459 - DNA, 20 bp, Artificial
  CRISPR gRNA sequence
gcacaaggagaggaggaaaa

SEQ ID NO: 189460 - DNA, 20 bp, Artificial
  CRISPR gRNA sequence
gaatatcgccctccctctgg

SEQ ID NO: 189461 - DNA, 20 bp, Artificial
  CRISPR gRNA sequence
cctctggtcctgagggagag

SEQ ID NO: 189462 - DNA, 20 bp, Artificial
  CRISPR gRNA sequence
tggtcctgagggagaggaat

SEQ ID NO: 189463 - DNA, 20 bp, Artificial
  CRISPR gRNA sequence
gtcctgagggagaggaatcc

SEQ ID NO: 189464 - DNA, 20 bp, Artificial
  CRISPR gRNA sequence
agggagaggaatcctcctgg

SEQ ID NO: 189465 - DNA, 20 bp, Artificial
  CRISPR gRNA sequence
ctgggtttccagatcctgta

SEQ ID NO: 189466 - DNA, 20 bp, Artificial
  CRISPR gRNA sequence
ggtttccagatcctgtacca

SEQ ID NO: 189467 - DNA, 20 bp, Artificial
  CRISPR gRNA sequence
ccagatcctgtaccagagag

SEQ ID NO: 189468 - DNA, 20 bp, Artificial
  CRISPR gRNA sequence
cagatcctgtaccagagagt

SEQ ID NO: 189469 - DNA, 20 bp, Artificial
  CRISPR gRNA sequence
taccagagagtgattctgag

SEQ ID NO: 189470 - DNA, 20 bp, Artificial
  CRISPR gRNA sequence
tgagggcccgtcctgctctc

SEQ ID NO: 189471 - DNA, 20 bp, Artificial
  CRISPR gRNA sequence
agggcccgtcctgctctctg

SEQ ID NO: 189472 - DNA, 20 bp, Artificial
  CRISPR gRNA sequence
ctctctgggacaattaaggg

SEQ ID NO: 189473 - DNA, 20 bp, Artificial
  CRISPR gRNA sequence
tctgggacaattaagggatg

SEQ ID NO: 189474 - DNA, 20 bp, Artificial
  CRISPR gRNA sequence
tgggacaattaagggatgaa

SEQ ID NO: 189475 - DNA, 20 bp, Artificial
  CRISPR gRNA sequence
ggacaattaagggatgaagt

SEQ ID NO: 189476 - DNA, 20 bp, Artificial
  CRISPR gRNA sequence
agggatgaagtctctgaggg

SEQ ID NO: 189477 - DNA, 20 bp, Artificial
  CRISPR gRNA sequence
tgagggagtggaggggaaga

SEQ ID NO: 189478 - DNA, 20 bp, Artificial
  CRISPR gRNA sequence
agggagtggaggggaagaca

SEQ ID NO: 189479 - DNA, 20 bp, Artificial
  CRISPR gRNA sequence
gaagactgatcaggggttcc

SEQ ID NO: 189480 - DNA, 20 bp, Artificial
  CRISPR gRNA sequence
atcaggggttccctttgacc

SEQ ID NO: 189481 - DNA, 20 bp, Artificial
  CRISPR gRNA sequence
cctttgaccccacagcagcc

SEQ ID NO: 189482 - DNA, 20 bp, Artificial
  CRISPR gRNA sequence
tgaccccacagcagccttgg

SEQ ID NO: 189483 - DNA, 20 bp, Artificial
  CRISPR gRNA sequence
gaccccacagcagccttggc

SEQ ID NO: 189484 - DNA, 20 bp, Artificial
  CRISPR gRNA sequence
accccacagcagccttggca

SEQ ID NO: 189485 - DNA, 20 bp, Artificial
  CRISPR gRNA sequence
ggcaccaggacttttcccct

SEQ ID NO: 189486 - DNA, 20 bp, Artificial
  CRISPR gRNA sequence
gcaccaggacttttcccctc

SEQ ID NO: 189487 - DNA, 20 bp, Artificial
  CRISPR gRNA sequence
ttcccctcaggccttgttct

SEQ ID NO: 189488 - DNA, 20 bp, Artificial
  CRISPR gRNA sequence
tcccctcaggccttgttctc

SEQ ID NO: 189489 - DNA, 20 bp, Artificial
  CRISPR gRNA sequence
cccctcaggccttgttctct

SEQ ID NO: 189490 - DNA, 20 bp, Artificial
  CRISPR gRNA sequence
ccctcaggccttgttctctg

SEQ ID NO: 189491 - DNA, 20 bp, Artificial
  CRISPR gRNA sequence
aggccttgttctctgcctca

SEQ ID NO: 189492 - DNA, 20 bp, Artificial
  CRISPR gRNA sequence
gttctctgcctcacactcaa

SEQ ID NO: 189493 - DNA, 20 bp, Artificial
  CRISPR gRNA sequence
ttctctgcctcacactcaat

SEQ ID NO: 189494 - DNA, 20 bp, Artificial
  CRISPR gRNA sequence
tctgcctcacactcaatgtg

SEQ ID NO: 189495 - DNA, 20 bp, Artificial
  CRISPR gRNA sequence
tgcctcacactcaatgtgtg

SEQ ID NO: 189496 - DNA, 20 bp, Artificial
  CRISPR gRNA sequence
cctcacactcaatgtgtgtg

SEQ ID NO: 189497 - DNA, 20 bp, Artificial
  CRISPR gRNA sequence
acactcaatgtgtgtggggg

SEQ ID NO: 189498 - DNA, 20 bp, Artificial
  CRISPR gRNA sequence
aatgtgtgtgggggtctgac

SEQ ID NO: 189499 - DNA, 20 bp, Artificial
  CRISPR gRNA sequence
actccagctcctctgagtcc

SEQ ID NO: 189500 - DNA, 20 bp, Artificial
  CRISPR gRNA sequence
cagctcctctgagtcccttg

SEQ ID NO: 189501 - DNA, 20 bp, Artificial
  CRISPR gRNA sequence
ctctgagtcccttggcctcc

SEQ ID NO: 189502 - DNA, 20 bp, Artificial
  CRISPR gRNA sequence
tgagtcccttggcctccact

SEQ ID NO: 189503 - DNA, 20 bp, Artificial
  CRISPR gRNA sequence
agtcccttggcctccactca

SEQ ID NO: 189504 - DNA, 20 bp, Artificial
  CRISPR gRNA sequence
ggcctccactcaggtcagaa

SEQ ID NO: 189505 - DNA, 20 bp, Artificial
  CRISPR gRNA sequence
gcctccactcaggtcagaac

SEQ ID NO: 189506 - DNA, 20 bp, Artificial
  CRISPR gRNA sequence
cactcaggtcagaaccggag

SEQ ID NO: 189507 - DNA, 20 bp, Artificial
  CRISPR gRNA sequence
aggtcagaaccggaggtccc

SEQ ID NO: 189508 - DNA, 20 bp, Artificial
  CRISPR gRNA sequence
ctcccccgctcagagactag

SEQ ID NO: 189509 - DNA, 20 bp, Artificial
  CRISPR gRNA sequence
ccccgctcagagactagaac

SEQ ID NO: 189510 - DNA, 20 bp, Artificial
  CRISPR gRNA sequence
agagactagaactttccaag

SEQ ID NO: 189511 - DNA, 20 bp, Artificial
  CRISPR gRNA sequence
gaactttccaaggaatagga

SEQ ID NO: 189512 - DNA, 20 bp, Artificial
  CRISPR gRNA sequence
tccaaggaataggagattat

SEQ ID NO: 189513 - DNA, 20 bp, Artificial
  CRISPR gRNA sequence
ccaaggaataggagattatc

SEQ ID NO: 189514 - DNA, 20 bp, Artificial
  CRISPR gRNA sequence
caaggaataggagattatcc

SEQ ID NO: 189515 - DNA, 20 bp, Artificial
  CRISPR gRNA sequence
tcccaggtgcccgtgtccag

SEQ ID NO: 189516 - DNA, 20 bp, Artificial
  CRISPR gRNA sequence
gtgtctgggttctgtgctcc

SEQ ID NO: 189517 - DNA, 20 bp, Artificial
  CRISPR gRNA sequence
ggttctgtgctcccttcccc

SEQ ID NO: 189518 - DNA, 20 bp, Artificial
  CRISPR gRNA sequence
tgtgctcccttccccacccc

SEQ ID NO: 189519 - DNA, 20 bp, Artificial
  CRISPR gRNA sequence
tgctcccttccccaccccag

SEQ ID NO: 189520 - DNA, 20 bp, Artificial
  CRISPR gRNA sequence
ccttccccaccccaggtatc

SEQ ID NO: 189521 - DNA, 20 bp, Artificial
  CRISPR gRNA sequence
ccccaccccaggtatctggt

SEQ ID NO: 189522 - DNA, 20 bp, Artificial
  CRISPR gRNA sequence
cccaccccaggtatctggtt

SEQ ID NO: 189523 - DNA, 20 bp, Artificial
  CRISPR gRNA sequence
gttcattcttaggatggtca

SEQ ID NO: 189524 - DNA, 20 bp, Artificial
  CRISPR gRNA sequence
attcttaggatggtcacatc

SEQ ID NO: 189525 - DNA, 20 bp, Artificial
  CRISPR gRNA sequence
ttaggatggtcacatccagg

SEQ ID NO: 189526 - DNA, 20 bp, Artificial
  CRISPR gRNA sequence
aggatggtcacatccaggtg

SEQ ID NO: 189527 - DNA, 20 bp, Artificial
  CRISPR gRNA sequence
ggatggtcacatccaggtgc

SEQ ID NO: 189528 - DNA, 20 bp, Artificial
  CRISPR gRNA sequence
ctggagtgtcccatgagaga

SEQ ID NO: 189529 - DNA, 20 bp, Artificial
  CRISPR gRNA sequence
gagtgtcccatgagagatgc

SEQ ID NO: 189530 - DNA, 20 bp, Artificial
  CRISPR gRNA sequence
gaattttctgactcttcctt

SEQ ID NO: 189531 - DNA, 20 bp, Artificial
  CRISPR gRNA sequence
aattttctgactcttccttt

SEQ ID NO: 189532 - DNA, 20 bp, Artificial
  CRISPR gRNA sequence
tctgactcttcctttcagac

SEQ ID NO: 189533 - DNA, 20 bp, Artificial
  CRISPR gRNA sequence
ctgactcttcctttcagacc

SEQ ID NO: 189534 - DNA, 20 bp, Artificial
  CRISPR gRNA sequence
tgactcttcctttcagaccc

SEQ ID NO: 189535 - DNA, 20 bp, Artificial
  CRISPR gRNA sequence
actcttcctttcagaccccc

SEQ ID NO: 189536 - DNA, 20 bp, Artificial
  CRISPR gRNA sequence
ttcctttcagacccccccaa

SEQ ID NO: 189537 - DNA, 20 bp, Artificial
  CRISPR gRNA sequence
cctttcagacccccccaaga

SEQ ID NO: 189538 - DNA, 20 bp, Artificial
  CRISPR gRNA sequence
ctttcagacccccccaagac

SEQ ID NO: 189539 - DNA, 20 bp, Artificial
  CRISPR gRNA sequence
tcagacccccccaagacaca

SEQ ID NO: 189540 - DNA, 20 bp, Artificial
  CRISPR gRNA sequence
cagacccccccaagacacac

SEQ ID NO: 189541 - DNA, 20 bp, Artificial
  CRISPR gRNA sequence
agacccccccaagacacacg

SEQ ID NO: 189542 - DNA, 20 bp, Artificial
  CRISPR gRNA sequence
tctttgactatgaggccacc

SEQ ID NO: 189543 - DNA, 20 bp, Artificial
  CRISPR gRNA sequence
tgactatgaggccaccctga

SEQ ID NO: 189544 - DNA, 20 bp, Artificial
  CRISPR gRNA sequence
gactatgaggccaccctgag

SEQ ID NO: 189545 - DNA, 20 bp, Artificial
  CRISPR gRNA sequence
actatgaggccaccctgagg

SEQ ID NO: 189546 - DNA, 20 bp, Artificial
  CRISPR gRNA sequence
tgaggccaccctgaggtgct

SEQ ID NO: 189547 - DNA, 20 bp, Artificial
  CRISPR gRNA sequence
aggtgctgggccctgggctt

SEQ ID NO: 189548 - DNA, 20 bp, Artificial
  CRISPR gRNA sequence
ggccctgggcttctaccctg

SEQ ID NO: 189549 - DNA, 20 bp, Artificial
  CRISPR gRNA sequence
ggcttctaccctgcggagat

SEQ ID NO: 189550 - DNA, 20 bp, Artificial
  CRISPR gRNA sequence
ctaccctgcggagatcatac

SEQ ID NO: 189551 - DNA, 20 bp, Artificial
  CRISPR gRNA sequence
taccctgcggagatcatact

SEQ ID NO: 189552 - DNA, 20 bp, Artificial
  CRISPR gRNA sequence
ccctgcggagatcatactga

SEQ ID NO: 189553 - DNA, 20 bp, Artificial
  CRISPR gRNA sequence
cggagatcatactgacctgg

SEQ ID NO: 189554 - DNA, 20 bp, Artificial
  CRISPR gRNA sequence
acctggcagcgggatgggga

SEQ ID NO: 189555 - DNA, 20 bp, Artificial
  CRISPR gRNA sequence
gcagcgggatggggaggacc

SEQ ID NO: 189556 - DNA, 20 bp, Artificial
  CRISPR gRNA sequence
gtggagaccaggcctgcagg

SEQ ID NO: 189557 - DNA, 20 bp, Artificial
  CRISPR gRNA sequence
caggggatggaaccttccag

SEQ ID NO: 189558 - DNA, 20 bp, Artificial
  CRISPR gRNA sequence
ccagaagtgggcagctgtgg

SEQ ID NO: 189559 - DNA, 20 bp, Artificial
  CRISPR gRNA sequence
cagaagtgggcagctgtggt

SEQ ID NO: 189560 - DNA, 20 bp, Artificial
  CRISPR gRNA sequence
tggtggtgccttctggagag

SEQ ID NO: 189561 - DNA, 20 bp, Artificial
  CRISPR gRNA sequence
ctggagaggagcagagatac

SEQ ID NO: 189562 - DNA, 20 bp, Artificial
  CRISPR gRNA sequence
tggagaggagcagagataca

SEQ ID NO: 189563 - DNA, 20 bp, Artificial
  CRISPR gRNA sequence
gagaggagcagagatacacg

SEQ ID NO: 189564 - DNA, 20 bp, Artificial
  CRISPR gRNA sequence
ccggagcccctcatgctgag

SEQ ID NO: 189565 - DNA, 20 bp, Artificial
  CRISPR gRNA sequence
atgctgagatggagtaagga

SEQ ID NO: 189566 - DNA, 20 bp, Artificial
  CRISPR gRNA sequence
agatggagtaaggagggaga

SEQ ID NO: 189567 - DNA, 20 bp, Artificial
  CRISPR gRNA sequence
ttagggaaagcaggagcctc

SEQ ID NO: 189568 - DNA, 20 bp, Artificial
  CRISPR gRNA sequence
gggaaagcaggagcctctct

SEQ ID NO: 189569 - DNA, 20 bp, Artificial
  CRISPR gRNA sequence
tctgaagacctttaacaggg

SEQ ID NO: 189570 - DNA, 20 bp, Artificial
  CRISPR gRNA sequence
tgaagacctttaacagggtc

SEQ ID NO: 189571 - DNA, 20 bp, Artificial
  CRISPR gRNA sequence
aagacctttaacagggtcgg

SEQ ID NO: 189572 - DNA, 20 bp, Artificial
  CRISPR gRNA sequence
taacagggtcggtggtgagg

SEQ ID NO: 189573 - DNA, 20 bp, Artificial
  CRISPR gRNA sequence
aacagggtcggtggtgaggg

SEQ ID NO: 189574 - DNA, 20 bp, Artificial
  CRISPR gRNA sequence
acagggtcggtggtgagggc

SEQ ID NO: 189575 - DNA, 20 bp, Artificial
  CRISPR gRNA sequence
ggggtcagagaccctcacct

SEQ ID NO: 189576 - DNA, 20 bp, Artificial
  CRISPR gRNA sequence
accttcacctcctttcccag

SEQ ID NO: 189577 - DNA, 20 bp, Artificial
  CRISPR gRNA sequence
cacctcctttcccagagcag

SEQ ID NO: 189578 - DNA, 20 bp, Artificial
  CRISPR gRNA sequence
acctcctttcccagagcagt

SEQ ID NO: 189579 - DNA, 20 bp, Artificial
  CRISPR gRNA sequence
ctttcccagagcagtcttcc

SEQ ID NO: 189580 - DNA, 20 bp, Artificial
  CRISPR gRNA sequence
tcccagagcagtcttccctg

SEQ ID NO: 189581 - DNA, 20 bp, Artificial
  CRISPR gRNA sequence
cccagagcagtcttccctgc

SEQ ID NO: 189582 - DNA, 20 bp, Artificial
  CRISPR gRNA sequence
ccagagcagtcttccctgcc

SEQ ID NO: 189583 - DNA, 20 bp, Artificial
  CRISPR gRNA sequence
ccctgcccaccatccccatc

SEQ ID NO: 189584 - DNA, 20 bp, Artificial
  CRISPR gRNA sequence
cctgcccaccatccccatca

SEQ ID NO: 189585 - DNA, 20 bp, Artificial
  CRISPR gRNA sequence
cccaccatccccatcatggg

SEQ ID NO: 189586 - DNA, 20 bp, Artificial
  CRISPR gRNA sequence
ctggcctggttgtccttgca

SEQ ID NO: 189587 - DNA, 20 bp, Artificial
  CRISPR gRNA sequence
gcctggttgtccttgcagct

SEQ ID NO: 189588 - DNA, 20 bp, Artificial
  CRISPR gRNA sequence
gttgtccttgcagctgtagt

SEQ ID NO: 189589 - DNA, 20 bp, Artificial
  CRISPR gRNA sequence
tccttgcagctgtagtcact

SEQ ID NO: 189590 - DNA, 20 bp, Artificial
  CRISPR gRNA sequence
gcagctgtagtcactggagc

SEQ ID NO: 189591 - DNA, 20 bp, Artificial
  CRISPR gRNA sequence
cagctgtagtcactggagct

SEQ ID NO: 189592 - DNA, 20 bp, Artificial
  CRISPR gRNA sequence
tagtcactggagctgcggtc

SEQ ID NO: 189593 - DNA, 20 bp, Artificial
  CRISPR gRNA sequence
gagctgcggtcgctgctgtg

SEQ ID NO: 189594 - DNA, 20 bp, Artificial
  CRISPR gRNA sequence
cggtcgctgctgtgctgtgg

SEQ ID NO: 189595 - DNA, 20 bp, Artificial
  CRISPR gRNA sequence
ctgtgctgtggagaaagaag

SEQ ID NO: 189596 - DNA, 20 bp, Artificial
  CRISPR gRNA sequence
tgctgtggagaaagaagagc

SEQ ID NO: 189597 - DNA, 20 bp, Artificial
  CRISPR gRNA sequence
tggagaaagaagagctcagg

SEQ ID NO: 189598 - DNA, 20 bp, Artificial
  CRISPR gRNA sequence
aggtaaggaaggggtgacaa

SEQ ID NO: 189599 - DNA, 20 bp, Artificial
  CRISPR gRNA sequence
agttttcttgtcccactggg

SEQ ID NO: 189600 - DNA, 20 bp, Artificial
  CRISPR gRNA sequence
tcttgtcccactgggggttt

SEQ ID NO: 189601 - DNA, 20 bp, Artificial
  CRISPR gRNA sequence
cttgtcccactgggggtttc

SEQ ID NO: 189602 - DNA, 20 bp, Artificial
  CRISPR gRNA sequence
ttgtcccactgggggtttca

SEQ ID NO: 189603 - DNA, 20 bp, Artificial
  CRISPR gRNA sequence
gtcccactgggggtttcaag

SEQ ID NO: 189604 - DNA, 20 bp, Artificial
  CRISPR gRNA sequence
tcccactgggggtttcaagc

SEQ ID NO: 189605 - DNA, 20 bp, Artificial
  CRISPR gRNA sequence
ggggtttcaagccccaggta

SEQ ID NO: 189606 - DNA, 20 bp, Artificial
  CRISPR gRNA sequence
caagccccaggtagaagtgt

SEQ ID NO: 189607 - DNA, 20 bp, Artificial
  CRISPR gRNA sequence
aagccccaggtagaagtgtg

SEQ ID NO: 189608 - DNA, 20 bp, Artificial
  CRISPR gRNA sequence
cctggttactgggaagcacc

SEQ ID NO: 189609 - DNA, 20 bp, Artificial
  CRISPR gRNA sequence
cccagtaaccaggcagggca

SEQ ID NO: 189610 - DNA, 20 bp, Artificial
  CRISPR gRNA sequence
ccagtaaccaggcagggcac

SEQ ID NO: 189611 - DNA, 20 bp, Artificial
  CRISPR gRNA sequence
ctacctggggcttgaaaccc

SEQ ID NO: 189612 - DNA, 20 bp, Artificial
  CRISPR gRNA sequence
tacctggggcttgaaacccc

SEQ ID NO: 189613 - DNA, 20 bp, Artificial
  CRISPR gRNA sequence
cctggggcttgaaaccccca

SEQ ID NO: 189614 - DNA, 20 bp, Artificial
  CRISPR gRNA sequence
gggcttgaaacccccagtgg

SEQ ID NO: 189615 - DNA, 20 bp, Artificial
  CRISPR gRNA sequence
gaaacccccagtgggacaag

SEQ ID NO: 189616 - DNA, 20 bp, Artificial
  CRISPR gRNA sequence
aaacccccagtgggacaaga

SEQ ID NO: 189617 - DNA, 20 bp, Artificial
  CRISPR gRNA sequence
agaccccacttgtcacccct

SEQ ID NO: 189618 - DNA, 20 bp, Artificial
  CRISPR gRNA sequence
gtcaccccttccttacctga

SEQ ID NO: 189619 - DNA, 20 bp, Artificial
  CRISPR gRNA sequence
tcaccccttccttacctgag

SEQ ID NO: 189620 - DNA, 20 bp, Artificial
  CRISPR gRNA sequence
ccttacctgagctcttcttt

SEQ ID NO: 189621 - DNA, 20 bp, Artificial
  CRISPR gRNA sequence
cttacctgagctcttctttc

SEQ ID NO: 189622 - DNA, 20 bp, Artificial
  CRISPR gRNA sequence
acctgagctcttctttctcc

SEQ ID NO: 189623 - DNA, 20 bp, Artificial
  CRISPR gRNA sequence
cctgagctcttctttctcca

SEQ ID NO: 189624 - DNA, 20 bp, Artificial
  CRISPR gRNA sequence
agctcttctttctccacagc

SEQ ID NO: 189625 - DNA, 20 bp, Artificial
  CRISPR gRNA sequence
ttctttctccacagcacagc

SEQ ID NO: 189626 - DNA, 20 bp, Artificial
  CRISPR gRNA sequence
ctttctccacagcacagcag

SEQ ID NO: 189627 - DNA, 20 bp, Artificial
  CRISPR gRNA sequence
tttctccacagcacagcagc

SEQ ID NO: 189628 - DNA, 20 bp, Artificial
  CRISPR gRNA sequence
tctccacagcacagcagcga

SEQ ID NO: 189629 - DNA, 20 bp, Artificial
  CRISPR gRNA sequence
ctccacagcacagcagcgac

SEQ ID NO: 189630 - DNA, 20 bp, Artificial
  CRISPR gRNA sequence
tccacagcacagcagcgacc

SEQ ID NO: 189631 - DNA, 20 bp, Artificial
  CRISPR gRNA sequence
cacagcacagcagcgaccgc

SEQ ID NO: 189632 - DNA, 20 bp, Artificial
  CRISPR gRNA sequence
cagtgactacagctgcaagg

SEQ ID NO: 189633 - DNA, 20 bp, Artificial
  CRISPR gRNA sequence
cagctgcaaggacaaccagg

SEQ ID NO: 189634 - DNA, 20 bp, Artificial
  CRISPR gRNA sequence
caaggacaaccaggccagca

SEQ ID NO: 189635 - DNA, 20 bp, Artificial
  CRISPR gRNA sequence
ctctgggaaaggaggtgaag

SEQ ID NO: 189636 - DNA, 20 bp, Artificial
  CRISPR gRNA sequence
tgggaaaggaggtgaaggtg

SEQ ID NO: 189637 - DNA, 20 bp, Artificial
  CRISPR gRNA sequence
ggaaaggaggtgaaggtgag

SEQ ID NO: 189638 - DNA, 20 bp, Artificial
  CRISPR gRNA sequence
tgacccccagccctcaccac

SEQ ID NO: 189639 - DNA, 20 bp, Artificial
  CRISPR gRNA sequence
acccccagccctcaccaccg

SEQ ID NO: 189640 - DNA, 20 bp, Artificial
  CRISPR gRNA sequence
accaccgaccctgttaaagg

SEQ ID NO: 189641 - DNA, 20 bp, Artificial
  CRISPR gRNA sequence
ttaaaggtcttcagagaggc

SEQ ID NO: 189642 - DNA, 20 bp, Artificial
  CRISPR gRNA sequence
aaggtcttcagagaggctcc

SEQ ID NO: 189643 - DNA, 20 bp, Artificial
  CRISPR gRNA sequence
cagagaggctcctgctttcc

SEQ ID NO: 189644 - DNA, 20 bp, Artificial
  CRISPR gRNA sequence
agagaggctcctgctttccc

SEQ ID NO: 189645 - DNA, 20 bp, Artificial
  CRISPR gRNA sequence
ctgctttccctaacagacat

SEQ ID NO: 189646 - DNA, 20 bp, Artificial
  CRISPR gRNA sequence
ctttccctaacagacatgat

SEQ ID NO: 189647 - DNA, 20 bp, Artificial
  CRISPR gRNA sequence
tccctaacagacatgatgcc

SEQ ID NO: 189648 - DNA, 20 bp, Artificial
  CRISPR gRNA sequence
ccctaacagacatgatgcct

SEQ ID NO: 189649 - DNA, 20 bp, Artificial
  CRISPR gRNA sequence
cctaacagacatgatgcctc

SEQ ID NO: 189650 - DNA, 20 bp, Artificial
  CRISPR gRNA sequence
acagacatgatgcctccatc

SEQ ID NO: 189651 - DNA, 20 bp, Artificial
  CRISPR gRNA sequence
catctccctccttactccat

SEQ ID NO: 189652 - DNA, 20 bp, Artificial
  CRISPR gRNA sequence
cctccttactccatctcagc

SEQ ID NO: 189653 - DNA, 20 bp, Artificial
  CRISPR gRNA sequence
cttactccatctcagcatga

SEQ ID NO: 189654 - DNA, 20 bp, Artificial
  CRISPR gRNA sequence
actccatctcagcatgaggg

SEQ ID NO: 189655 - DNA, 20 bp, Artificial
  CRISPR gRNA sequence
ctccatctcagcatgagggg

SEQ ID NO: 189656 - DNA, 20 bp, Artificial
  CRISPR gRNA sequence
catctcagcatgaggggctc

SEQ ID NO: 189657 - DNA, 20 bp, Artificial
  CRISPR gRNA sequence
agcatgaggggctccggcag

SEQ ID NO: 189658 - DNA, 20 bp, Artificial
  CRISPR gRNA sequence
cggcagcccctcatgctgca

SEQ ID NO: 189659 - DNA, 20 bp, Artificial
  CRISPR gRNA sequence
atgctgcacatggcacgtgt

SEQ ID NO: 189660 - DNA, 20 bp, Artificial
  CRISPR gRNA sequence
cacatggcacgtgtatctct

SEQ ID NO: 189661 - DNA, 20 bp, Artificial
  CRISPR gRNA sequence
tgctcctctccagaaggcac

SEQ ID NO: 189662 - DNA, 20 bp, Artificial
  CRISPR gRNA sequence
ctcctctccagaaggcacca

SEQ ID NO: 189663 - DNA, 20 bp, Artificial
  CRISPR gRNA sequence
ctctccagaaggcaccacca

SEQ ID NO: 189664 - DNA, 20 bp, Artificial
  CRISPR gRNA sequence
tccagaaggcaccaccacag

SEQ ID NO: 189665 - DNA, 20 bp, Artificial
  CRISPR gRNA sequence
cagaaggcaccaccacagct

SEQ ID NO: 189666 - DNA, 20 bp, Artificial
  CRISPR gRNA sequence
cccacttctggaaggttcca

SEQ ID NO: 189667 - DNA, 20 bp, Artificial
  CRISPR gRNA sequence
ctggaaggttccatcccctg

SEQ ID NO: 189668 - DNA, 20 bp, Artificial
  CRISPR gRNA sequence
tggaaggttccatcccctgc

SEQ ID NO: 189669 - DNA, 20 bp, Artificial
  CRISPR gRNA sequence
gaaggttccatcccctgcag

SEQ ID NO: 189670 - DNA, 20 bp, Artificial
  CRISPR gRNA sequence
catcccctgcaggcctggtc

SEQ ID NO: 189671 - DNA, 20 bp, Artificial
  CRISPR gRNA sequence
caggcctggtctccacgagc

SEQ ID NO: 189672 - DNA, 20 bp, Artificial
  CRISPR gRNA sequence
gtctccacgagctccacgtc

SEQ ID NO: 189673 - DNA, 20 bp, Artificial
  CRISPR gRNA sequence
cacgagctccacgtcctggg

SEQ ID NO: 189674 - DNA, 20 bp, Artificial
  CRISPR gRNA sequence
cacgtcctgggtctggtcct

SEQ ID NO: 189675 - DNA, 20 bp, Artificial
  CRISPR gRNA sequence
ggtctggtcctccccatccc

SEQ ID NO: 189676 - DNA, 20 bp, Artificial
  CRISPR gRNA sequence
gtcctccccatcccgctgcc

SEQ ID NO: 189677 - DNA, 20 bp, Artificial
  CRISPR gRNA sequence
cccatcccgctgccaggtca

SEQ ID NO: 189678 - DNA, 20 bp, Artificial
  CRISPR gRNA sequence
ccaggtcagtatgatctccg

SEQ ID NO: 189679 - DNA, 20 bp, Artificial
  CRISPR gRNA sequence
cgcagggtagaagcccaggg

SEQ ID NO: 189680 - DNA, 20 bp, Artificial
  CRISPR gRNA sequence
agggtggcctcatagtcaaa

SEQ ID NO: 189681 - DNA, 20 bp, Artificial
  CRISPR gRNA sequence
atagtcaaagacagggtggt

SEQ ID NO: 189682 - DNA, 20 bp, Artificial
  CRISPR gRNA sequence
gggggggtctgaaaggaaga

SEQ ID NO: 189683 - DNA, 20 bp, Artificial
  CRISPR gRNA sequence
ggggggtctgaaaggaagag

SEQ ID NO: 189684 - DNA, 20 bp, Artificial
  CRISPR gRNA sequence
aaaggaagagtcagaaaatt

SEQ ID NO: 189685 - DNA, 20 bp, Artificial
  CRISPR gRNA sequence
aagcactttgcatctctcat

SEQ ID NO: 189686 - DNA, 20 bp, Artificial
  CRISPR gRNA sequence
tgcatctctcatgggacact

SEQ ID NO: 189687 - DNA, 20 bp, Artificial
  CRISPR gRNA sequence
gcatctctcatgggacactc

SEQ ID NO: 189688 - DNA, 20 bp, Artificial
  CRISPR gRNA sequence
catctctcatgggacactcc

SEQ ID NO: 189689 - DNA, 20 bp, Artificial
  CRISPR gRNA sequence
tcatgggacactccagcagc

SEQ ID NO: 189690 - DNA, 20 bp, Artificial
  CRISPR gRNA sequence
atgggacactccagcagcac

SEQ ID NO: 189691 - DNA, 20 bp, Artificial
  CRISPR gRNA sequence
cagcagcacctggatgtgac

SEQ ID NO: 189692 - DNA, 20 bp, Artificial
  CRISPR gRNA sequence
gatgtgaccatcctaagaat

SEQ ID NO: 189693 - DNA, 20 bp, Artificial
  CRISPR gRNA sequence
agaatgaaccagatacctgg

SEQ ID NO: 189694 - DNA, 20 bp, Artificial
  CRISPR gRNA sequence
gggtggggaagggagcacag

SEQ ID NO: 189695 - DNA, 20 bp, Artificial
  CRISPR gRNA sequence
gacacgggcacctgggataa

SEQ ID NO: 189696 - DNA, 20 bp, Artificial
  CRISPR gRNA sequence
ggataatctcctattccttg

SEQ ID NO: 189697 - DNA, 20 bp, Artificial
  CRISPR gRNA sequence
ctattccttggaaagttcta

SEQ ID NO: 189698 - DNA, 20 bp, Artificial
  CRISPR gRNA sequence
ttccttggaaagttctagtc

SEQ ID NO: 189699 - DNA, 20 bp, Artificial
  CRISPR gRNA sequence
cttggaaagttctagtctct

SEQ ID NO: 189700 - DNA, 20 bp, Artificial
  CRISPR gRNA sequence
ggaaagttctagtctctgag

SEQ ID NO: 189701 - DNA, 20 bp, Artificial
  CRISPR gRNA sequence
gaaagttctagtctctgagc

SEQ ID NO: 189702 - DNA, 20 bp, Artificial
  CRISPR gRNA sequence
tagtctctgagcgggggagc

SEQ ID NO: 189703 - DNA, 20 bp, Artificial
  CRISPR gRNA sequence
gtctctgagcgggggagcag

SEQ ID NO: 189704 - DNA, 20 bp, Artificial
  CRISPR gRNA sequence
tgagcgggggagcagggacc

SEQ ID NO: 189705 - DNA, 20 bp, Artificial
  CRISPR gRNA sequence
agcgggggagcagggacctc

SEQ ID NO: 189706 - DNA, 20 bp, Artificial
  CRISPR gRNA sequence
cggttctgacctgagtggag

SEQ ID NO: 189707 - DNA, 20 bp, Artificial
  CRISPR gRNA sequence
tgacctgagtggaggccaag

SEQ ID NO: 189708 - DNA, 20 bp, Artificial
  CRISPR gRNA sequence
acctgagtggaggccaaggg

SEQ ID NO: 189709 - DNA, 20 bp, Artificial
  CRISPR gRNA sequence
agtggaggccaagggactca

SEQ ID NO: 189710 - DNA, 20 bp, Artificial
  CRISPR gRNA sequence
agaggagctggagtcagacc

SEQ ID NO: 189711 - DNA, 20 bp, Artificial
  CRISPR gRNA sequence
gagtcagacccccacacaca

SEQ ID NO: 189712 - DNA, 20 bp, Artificial
  CRISPR gRNA sequence
agtgtgaggcagagaacaag

SEQ ID NO: 189713 - DNA, 20 bp, Artificial
  CRISPR gRNA sequence
aggggaaaagtcctggtgcc

SEQ ID NO: 189714 - DNA, 20 bp, Artificial
  CRISPR gRNA sequence
gtgccaaggctgctgtgggg

SEQ ID NO: 189715 - DNA, 20 bp, Artificial
  CRISPR gRNA sequence
ctgtggggtcaaagggaacc

SEQ ID NO: 189716 - DNA, 20 bp, Artificial
  CRISPR gRNA sequence
tggggtcaaagggaacccct

SEQ ID NO: 189717 - DNA, 20 bp, Artificial
  CRISPR gRNA sequence
atcagtcttccagggattgt

SEQ ID NO: 189718 - DNA, 20 bp, Artificial
  CRISPR gRNA sequence
ccagggattgtcttcccctc

SEQ ID NO: 189719 - DNA, 20 bp, Artificial
  CRISPR gRNA sequence
cagggattgtcttcccctcc

SEQ ID NO: 189720 - DNA, 20 bp, Artificial
  CRISPR gRNA sequence
tcttcccctccactccctca

SEQ ID NO: 189721 - DNA, 20 bp, Artificial
  CRISPR gRNA sequence
cccctccactccctcagaga

SEQ ID NO: 189722 - DNA, 20 bp, Artificial
  CRISPR gRNA sequence
ccctccactccctcagagac

SEQ ID NO: 189723 - DNA, 20 bp, Artificial
  CRISPR gRNA sequence
cactccctcagagacttcat

SEQ ID NO: 189724 - DNA, 20 bp, Artificial
  CRISPR gRNA sequence
cctcagagacttcatccctt

SEQ ID NO: 189725 - DNA, 20 bp, Artificial
  CRISPR gRNA sequence
agagacttcatcccttaatt

SEQ ID NO: 189726 - DNA, 20 bp, Artificial
  CRISPR gRNA sequence
catcccttaattgtcccaga

SEQ ID NO: 189727 - DNA, 20 bp, Artificial
  CRISPR gRNA sequence
atcccttaattgtcccagag

SEQ ID NO: 189728 - DNA, 20 bp, Artificial
  CRISPR gRNA sequence
aattgtcccagagagcagga

SEQ ID NO: 189729 - DNA, 20 bp, Artificial
  CRISPR gRNA sequence
attgtcccagagagcaggac

SEQ ID NO: 189730 - DNA, 20 bp, Artificial
  CRISPR gRNA sequence
tcccagagagcaggacgggc

SEQ ID NO: 189731 - DNA, 20 bp, Artificial
  CRISPR gRNA sequence
agaatcactctctggtacag

SEQ ID NO: 189732 - DNA, 20 bp, Artificial
  CRISPR gRNA sequence
tctggtacaggatctggaaa

SEQ ID NO: 189733 - DNA, 20 bp, Artificial
  CRISPR gRNA sequence
tggtacaggatctggaaacc

SEQ ID NO: 189734 - DNA, 20 bp, Artificial
  CRISPR gRNA sequence
gtacaggatctggaaaccca

SEQ ID NO: 189735 - DNA, 20 bp, Artificial
  CRISPR gRNA sequence
gaaacccaggaggattcctc

SEQ ID NO: 189736 - DNA, 20 bp, Artificial
  CRISPR gRNA sequence
ctctccctcaggaccagagg

SEQ ID NO: 189737 - DNA, 20 bp, Artificial
  CRISPR gRNA sequence
tccctcaggaccagagggag

SEQ ID NO: 189738 - DNA, 20 bp, Artificial
  CRISPR gRNA sequence
cctcaggaccagagggaggg

SEQ ID NO: 189739 - DNA, 20 bp, Artificial
  CRISPR gRNA sequence
aggaccagagggagggcgat

SEQ ID NO: 189740 - DNA, 20 bp, Artificial
  CRISPR gRNA sequence
tagtgttggtcccattttcc

SEQ ID NO: 189741 - DNA, 20 bp, Artificial
  CRISPR gRNA sequence
gtgttggtcccattttcctc

SEQ ID NO: 189742 - DNA, 20 bp, Artificial
  CRISPR gRNA sequence
gtcccattttcctcctctcc

SEQ ID NO: 189743 - DNA, 20 bp, Artificial
  CRISPR gRNA sequence
tcctcctctccttgtgctag

SEQ ID NO: 189744 - DNA, 20 bp, Artificial
  CRISPR gRNA sequence
cctcctctccttgtgctagg

SEQ ID NO: 189745 - DNA, 20 bp, Artificial
  CRISPR gRNA sequence
ctcctctccttgtgctaggc

SEQ ID NO: 189746 - DNA, 20 bp, Artificial
  CRISPR gRNA sequence
ctctccttgtgctaggccag

SEQ ID NO: 189747 - DNA, 20 bp, Artificial
  CRISPR gRNA sequence
tccttgtgctaggccaggct

SEQ ID NO: 189748 - DNA, 20 bp, Artificial
  CRISPR gRNA sequence
cttgtgctaggccaggctga

SEQ ID NO: 189749 - DNA, 20 bp, Artificial
  CRISPR gRNA sequence
gtgctaggccaggctgagag

SEQ ID NO: 189750 - DNA, 20 bp, Artificial
  CRISPR gRNA sequence
tgctaggccaggctgagagg

SEQ ID NO: 189751 - DNA, 20 bp, Artificial
  CRISPR gRNA sequence
ggccaggctgagaggtctac

SEQ ID NO: 189752 - DNA, 20 bp, Artificial
  CRISPR gRNA sequence
agaggtctacaggagatcag

SEQ ID NO: 189753 - DNA, 20 bp, Artificial
  CRISPR gRNA sequence
caggagatcagggaggcgcc

SEQ ID NO: 189754 - DNA, 20 bp, Artificial
  CRISPR gRNA sequence
cccctggtacccgcgcgctg

SEQ ID NO: 189755 - DNA, 20 bp, Artificial
  CRISPR gRNA sequence
gtacccgcgcgctgcagcat

SEQ ID NO: 189756 - DNA, 20 bp, Artificial
  CRISPR gRNA sequence
cagcatctccttcccgttct

SEQ ID NO: 189757 - DNA, 20 bp, Artificial
  CRISPR gRNA sequence
cttcccgttctccaggtatc

SEQ ID NO: 189758 - DNA, 20 bp, Artificial
  CRISPR gRNA sequence
cccgttctccaggtatctgt

SEQ ID NO: 189759 - DNA, 20 bp, Artificial
  CRISPR gRNA sequence
ccgttctccaggtatctgtg

SEQ ID NO: 189760 - DNA, 20 bp, Artificial
  CRISPR gRNA sequence
tccaggtatctgtggagcca

SEQ ID NO: 189761 - DNA, 20 bp, Artificial
  CRISPR gRNA sequence
caggtatctgtggagccact

SEQ ID NO: 189762 - DNA, 20 bp, Artificial
  CRISPR gRNA sequence
tggagccactccacgcacgt

SEQ ID NO: 189763 - DNA, 20 bp, Artificial
  CRISPR gRNA sequence
cacgcacgtgccctccaggt

SEQ ID NO: 189764 - DNA, 20 bp, Artificial
  CRISPR gRNA sequence
caggtaggctctcctttgtt

SEQ ID NO: 189765 - DNA, 20 bp, Artificial
  CRISPR gRNA sequence
tcctttgttcagccacattg

SEQ ID NO: 189766 - DNA, 20 bp, Artificial
  CRISPR gRNA sequence
ctttgttcagccacattggc

SEQ ID NO: 189767 - DNA, 20 bp, Artificial
  CRISPR gRNA sequence
tgttcagccacattggccgc

SEQ ID NO: 189768 - DNA, 20 bp, Artificial
  CRISPR gRNA sequence
gttcagccacattggccgcc

SEQ ID NO: 189769 - DNA, 20 bp, Artificial
  CRISPR gRNA sequence
ttcagccacattggccgcct

SEQ ID NO: 189770 - DNA, 20 bp, Artificial
  CRISPR gRNA sequence
agccacattggccgcctcac

SEQ ID NO: 189771 - DNA, 20 bp, Artificial
  CRISPR gRNA sequence
gccgcctcacacttgcgctt

SEQ ID NO: 189772 - DNA, 20 bp, Artificial
  CRISPR gRNA sequence
acacttgcgcttggagatct

SEQ ID NO: 189773 - DNA, 20 bp, Artificial
  CRISPR gRNA sequence
gcgcttggagatctgagccg

SEQ ID NO: 189774 - DNA, 20 bp, Artificial
  CRISPR gRNA sequence
cgcttggagatctgagccgc

SEQ ID NO: 189775 - DNA, 20 bp, Artificial
  CRISPR gRNA sequence
ggagatctgagccgcagtgt

SEQ ID NO: 189776 - DNA, 20 bp, Artificial
  CRISPR gRNA sequence
gagatctgagccgcagtgtc

SEQ ID NO: 189777 - DNA, 20 bp, Artificial
  CRISPR gRNA sequence
agccgcagtgtccgctgcgg

SEQ ID NO: 189778 - DNA, 20 bp, Artificial
  CRISPR gRNA sequence
cggtccaggagcgcaggtcc

SEQ ID NO: 189779 - DNA, 20 bp, Artificial
  CRISPR gRNA sequence
gttcagggcgaggtaatcct

SEQ ID NO: 189780 - DNA, 20 bp, Artificial
  CRISPR gRNA sequence
agggcgaggtaatccttgcc

SEQ ID NO: 189781 - DNA, 20 bp, Artificial
  CRISPR gRNA sequence
gccatcgtaggcatactgtt

SEQ ID NO: 189782 - DNA, 20 bp, Artificial
  CRISPR gRNA sequence
ccatcgtaggcatactgttc

SEQ ID NO: 189783 - DNA, 20 bp, Artificial
  CRISPR gRNA sequence
ttcatacccgcggaggaggc

SEQ ID NO: 189784 - DNA, 20 bp, Artificial
  CRISPR gRNA sequence
atacccgcggaggaggcgtc

SEQ ID NO: 189785 - DNA, 20 bp, Artificial
  CRISPR gRNA sequence
gagggtgtgagaacctggcc

SEQ ID NO: 189786 - DNA, 20 bp, Artificial
  CRISPR gRNA sequence
gccccaccccctcggtcagc

SEQ ID NO: 189787 - DNA, 20 bp, Artificial
  CRISPR gRNA sequence
ggtcagccccgcccaccgag

SEQ ID NO: 189788 - DNA, 20 bp, Artificial
  CRISPR gRNA sequence
gccctcgcccggacccaccc

SEQ ID NO: 189789 - DNA, 20 bp, Artificial
  CRISPR gRNA sequence
gcccggacccacccgcgggg

SEQ ID NO: 189790 - DNA, 20 bp, Artificial
  CRISPR gRNA sequence
tggtaaaggcgccttggggt

SEQ ID NO: 189791 - DNA, 20 bp, Artificial
  CRISPR gRNA sequence
ggtaaaggcgccttggggtt

SEQ ID NO: 189792 - DNA, 20 bp, Artificial
  CRISPR gRNA sequence
gtaaaggcgccttggggttc

SEQ ID NO: 189793 - DNA, 20 bp, Artificial
  CRISPR gRNA sequence
ggggttctcccaggtagagg

SEQ ID NO: 189794 - DNA, 20 bp, Artificial
  CRISPR gRNA sequence
gggttctcccaggtagaggg

SEQ ID NO: 189795 - DNA, 20 bp, Artificial
  CRISPR gRNA sequence
tcccaggtagagggtctggg

SEQ ID NO: 189796 - DNA, 20 bp, Artificial
  CRISPR gRNA sequence
ccaggtagagggtctgggcg

SEQ ID NO: 189797 - DNA, 20 bp, Artificial
  CRISPR gRNA sequence
ggcgggtcccgcggcctcgg

SEQ ID NO: 189798 - DNA, 20 bp, Artificial
  CRISPR gRNA sequence
ggggtggatcccagacccgg

SEQ ID NO: 189799 - DNA, 20 bp, Artificial
  CRISPR gRNA sequence
gggagtacccgggccgtccg

SEQ ID NO: 189800 - DNA, 20 bp, Artificial
  CRISPR gRNA sequence
ctccctgggccggagttact

SEQ ID NO: 189801 - DNA, 20 bp, Artificial
  CRISPR gRNA sequence
cctgggccggagttactcac

SEQ ID NO: 189802 - DNA, 20 bp, Artificial
  CRISPR gRNA sequence
ggccggagttactcactggc

SEQ ID NO: 189803 - DNA, 20 bp, Artificial
  CRISPR gRNA sequence
ctcactggcctcgctctggt

SEQ ID NO: 189804 - DNA, 20 bp, Artificial
  CRISPR gRNA sequence
actggcctcgctctggttgt

SEQ ID NO: 189805 - DNA, 20 bp, Artificial
  CRISPR gRNA sequence
gcctcgctctggttgtagta

SEQ ID NO: 189806 - DNA, 20 bp, Artificial
  CRISPR gRNA sequence
gctctggttgtagtagccgc

SEQ ID NO: 189807 - DNA, 20 bp, Artificial
  CRISPR gRNA sequence
tggttgtagtagccgcgcag

SEQ ID NO: 189808 - DNA, 20 bp, Artificial
  CRISPR gRNA sequence
gttgtagtagccgcgcaggg

SEQ ID NO: 189809 - DNA, 20 bp, Artificial
  CRISPR gRNA sequence
tagtagccgcgcagggtctg

SEQ ID NO: 189810 - DNA, 20 bp, Artificial
  CRISPR gRNA sequence
caggttcattctgtcagtct

SEQ ID NO: 189811 - DNA, 20 bp, Artificial
  CRISPR gRNA sequence
attctgtcagtctgtgcgtg

SEQ ID NO: 189812 - DNA, 20 bp, Artificial
  CRISPR gRNA sequence
tgtcagtctgtgcgtgggcc

SEQ ID NO: 189813 - DNA, 20 bp, Artificial
  CRISPR gRNA sequence
tcagtctgtgcgtgggcctt

SEQ ID NO: 189814 - DNA, 20 bp, Artificial
  CRISPR gRNA sequence
tgcgtgggccttggtgttcc

SEQ ID NO: 189815 - DNA, 20 bp, Artificial
  CRISPR gRNA sequence
ggtgttccgtgtctcctctt

SEQ ID NO: 189816 - DNA, 20 bp, Artificial
  CRISPR gRNA sequence
gtgttccgtgtctcctcttc

SEQ ID NO: 189817 - DNA, 20 bp, Artificial
  CRISPR gRNA sequence
cgtgtctcctcttcccaata

SEQ ID NO: 189818 - DNA, 20 bp, Artificial
  CRISPR gRNA sequence
ctcttcccaatactccggcc

SEQ ID NO: 189819 - DNA, 20 bp, Artificial
  CRISPR gRNA sequence
ttcccaatactccggcccct

SEQ ID NO: 189820 - DNA, 20 bp, Artificial
  CRISPR gRNA sequence
cccaatactccggcccctcc

SEQ ID NO: 189821 - DNA, 20 bp, Artificial
  CRISPR gRNA sequence
ccaatactccggcccctcct

SEQ ID NO: 189822 - DNA, 20 bp, Artificial
  CRISPR gRNA sequence
cggcccctcctgctccaccc

SEQ ID NO: 189823 - DNA, 20 bp, Artificial
  CRISPR gRNA sequence
ctgctccacccacggcgccc

SEQ ID NO: 189824 - DNA, 20 bp, Artificial
  CRISPR gRNA sequence
ctccacccacggcgcccgcg

SEQ ID NO: 189825 - DNA, 20 bp, Artificial
  CRISPR gRNA sequence
cacccacggcgcccgcggct

SEQ ID NO: 189826 - DNA, 20 bp, Artificial
  CRISPR gRNA sequence
catcctcggacacgccgagt

SEQ ID NO: 189827 - DNA, 20 bp, Artificial
  CRISPR gRNA sequence
ggacacgccgagtcgctgtc

SEQ ID NO: 189828 - DNA, 20 bp, Artificial
  CRISPR gRNA sequence
tcgaaccgcacgaactgcgt

SEQ ID NO: 189829 - DNA, 20 bp, Artificial
  CRISPR gRNA sequence
cgtgtcgtccacgtagccca

SEQ ID NO: 189830 - DNA, 20 bp, Artificial
  CRISPR gRNA sequence
cccgcggccgggccgggaca

SEQ ID NO: 189831 - DNA, 20 bp, Artificial
  CRISPR gRNA sequence
aaatacctcatggagtggga

SEQ ID NO: 189832 - DNA, 20 bp, Artificial
  CRISPR gRNA sequence
atggagtgggagcctggggg

SEQ ID NO: 189833 - DNA, 20 bp, Artificial
  CRISPR gRNA sequence
ggggcgaggaggggttgaga

SEQ ID NO: 189834 - DNA, 20 bp, Artificial
  CRISPR gRNA sequence
agacccgcccgaccctcctc

SEQ ID NO: 189835 - DNA, 20 bp, Artificial
  CRISPR gRNA sequence
ctcccggcgcggctgccgag

SEQ ID NO: 189836 - DNA, 20 bp, Artificial
  CRISPR gRNA sequence
ccggcgcggctgccgagtcc

SEQ ID NO: 189837 - DNA, 20 bp, Artificial
  CRISPR gRNA sequence
ccgagtcctgcgcccccgcc

SEQ ID NO: 189838 - DNA, 20 bp, Artificial
  CRISPR gRNA sequence
cgcccccgccaggcgggccc

SEQ ID NO: 189839 - DNA, 20 bp, Artificial
  CRISPR gRNA sequence
cctcctccgcgcaggggccg

SEQ ID NO: 189840 - DNA, 20 bp, Artificial
  CRISPR gRNA sequence
ctccgcgcaggggccgtttc

SEQ ID NO: 189841 - DNA, 20 bp, Artificial
  CRISPR gRNA sequence
cgcgcaggggccgtttccct

SEQ ID NO: 189842 - DNA, 20 bp, Artificial
  CRISPR gRNA sequence
ccctcctgaccccgcactca

SEQ ID NO: 189843 - DNA, 20 bp, Artificial
  CRISPR gRNA sequence
cctcctgaccccgcactcac

SEQ ID NO: 189844 - DNA, 20 bp, Artificial
  CRISPR gRNA sequence
ctgaccccgcactcacccgc

SEQ ID NO: 189845 - DNA, 20 bp, Artificial
  CRISPR gRNA sequence
accccgcactcacccgccca

SEQ ID NO: 189846 - DNA, 20 bp, Artificial
  CRISPR gRNA sequence
acccgcccaggtctcggtca

SEQ ID NO: 189847 - DNA, 20 bp, Artificial
  CRISPR gRNA sequence
ggtcagggtcagggcccccg

SEQ ID NO: 189848 - DNA, 20 bp, Artificial
  CRISPR gRNA sequence
ggggcgccatgaccaccatc

SEQ ID NO: 189849 - DNA, 20 bp, Artificial
  CRISPR gRNA sequence
ggcgtctggggagaatgagt

SEQ ID NO: 189850 - DNA, 20 bp, Artificial
  CRISPR gRNA sequence
gcgtctggggagaatgagtc

SEQ ID NO: 189851 - DNA, 20 bp, Artificial
  CRISPR gRNA sequence
gggagaatgagtccgggtgg

SEQ ID NO: 189852 - DNA, 20 bp, Artificial
  CRISPR gRNA sequence
tagaaccaggaccgcggcga

SEQ ID NO: 189853 - DNA, 20 bp, Artificial
  CRISPR gRNA sequence
agaaccaggaccgcggcgac

SEQ ID NO: 189854 - DNA, 20 bp, Artificial
  CRISPR gRNA sequence
gaaccaggaccgcggcgacg

SEQ ID NO: 189855 - DNA, 20 bp, Artificial
  CRISPR gRNA sequence
attggcttctctaaaaacct

SEQ ID NO: 189856 - DNA, 20 bp, Artificial
  CRISPR gRNA sequence
gcttctctaaaaacctgtca

SEQ ID NO: 189857 - DNA, 20 bp, Artificial
  CRISPR gRNA sequence
ctctaaaaacctgtcaccta

SEQ ID NO: 189858 - DNA, 20 bp, Artificial
  CRISPR gRNA sequence
tctaaaaacctgtcacctaa

SEQ ID NO: 189859 - DNA, 20 bp, Artificial
  CRISPR gRNA sequence
gtttaagaactgctgattgc

SEQ ID NO: 189860 - DNA, 20 bp, Artificial
  CRISPR gRNA sequence
tttaagaactgctgattgct

SEQ ID NO: 189861 - DNA, 20 bp, Artificial
  CRISPR gRNA sequence
ctgattgctgggaaactctg

SEQ ID NO: 189862 - DNA, 20 bp, Artificial
  CRISPR gRNA sequence
ttcccgttcctctcgtaacc

SEQ ID NO: 189863 - DNA, 20 bp, Artificial
  CRISPR gRNA sequence
tggtcatgtgtccttcttcc

SEQ ID NO: 189864 - DNA, 20 bp, Artificial
  CRISPR gRNA sequence
cttcctggatactcatgacg

SEQ ID NO: 189865 - DNA, 20 bp, Artificial
  CRISPR gRNA sequence
ggatactcatgacgcagact

SEQ ID NO: 189866 - DNA, 20 bp, Artificial
  CRISPR gRNA sequence
gactcagttctcattcccaa

SEQ ID NO: 189867 - DNA, 20 bp, Artificial
  CRISPR gRNA sequence
actcagttctcattcccaat

SEQ ID NO: 189868 - DNA, 20 bp, Artificial
  CRISPR gRNA sequence
ttctcattcccaatgggtgt

SEQ ID NO: 189869 - DNA, 20 bp, Artificial
  CRISPR gRNA sequence
tctcattcccaatgggtgtc

SEQ ID NO: 189870 - DNA, 20 bp, Artificial
  CRISPR gRNA sequence
cccaatgggtgtcgggtttc

SEQ ID NO: 189871 - DNA, 20 bp, Artificial
  CRISPR gRNA sequence
caatgggtgtcgggtttcta

SEQ ID NO: 189872 - DNA, 20 bp, Artificial
  CRISPR gRNA sequence
tgggtgtcgggtttctagag

SEQ ID NO: 189873 - DNA, 20 bp, Artificial
  CRISPR gRNA sequence
gggtttctagagaagccaat

SEQ ID NO: 189874 - DNA, 20 bp, Artificial
  CRISPR gRNA sequence
cgccacgactcccgactata

SEQ ID NO: 189875 - DNA, 20 bp, Artificial
  CRISPR gRNA sequence
ccgactataaagtccccatc

SEQ ID NO: 189876 - DNA, 20 bp, Artificial
  CRISPR gRNA sequence
taaagtccccatccggactc

SEQ ID NO: 189877 - DNA, 20 bp, Artificial
  CRISPR gRNA sequence
agtccccatccggactcaag

SEQ ID NO: 189878 - DNA, 20 bp, Artificial
  CRISPR gRNA sequence
atccggactcaagaagttct

SEQ ID NO: 189879 - DNA, 20 bp, Artificial
  CRISPR gRNA sequence
tccggactcaagaagttctc

SEQ ID NO: 189880 - DNA, 20 bp, Artificial
  CRISPR gRNA sequence
ctcaagaagttctcaggact

SEQ ID NO: 189881 - DNA, 20 bp, Artificial
  CRISPR gRNA sequence
caagaagttctcaggactca

SEQ ID NO: 189882 - DNA, 20 bp, Artificial
  CRISPR gRNA sequence
aagaagttctcaggactcag

SEQ ID NO: 189883 - DNA, 20 bp, Artificial
  CRISPR gRNA sequence
agttctcaggactcagaggc

SEQ ID NO: 189884 - DNA, 20 bp, Artificial
  CRISPR gRNA sequence
gttctcaggactcagaggct

SEQ ID NO: 189885 - DNA, 20 bp, Artificial
  CRISPR gRNA sequence
ggactcagaggctgggatca

SEQ ID NO: 189886 - DNA, 20 bp, Artificial
  CRISPR gRNA sequence
ctcagaggctgggatcatgg

SEQ ID NO: 189887 - DNA, 20 bp, Artificial
  CRISPR gRNA sequence
gaggctgggatcatggtaga

SEQ ID NO: 189888 - DNA, 20 bp, Artificial
  CRISPR gRNA sequence
aaccctccttttactcctct

SEQ ID NO: 189889 - DNA, 20 bp, Artificial
  CRISPR gRNA sequence
ccctccttttactcctctcg

SEQ ID NO: 189890 - DNA, 20 bp, Artificial
  CRISPR gRNA sequence
cctccttttactcctctcgg

SEQ ID NO: 189891 - DNA, 20 bp, Artificial
  CRISPR gRNA sequence
tttactcctctcggaggccc

SEQ ID NO: 189892 - DNA, 20 bp, Artificial
  CRISPR gRNA sequence
cggaggccctggcccttacc

SEQ ID NO: 189893 - DNA, 20 bp, Artificial
  CRISPR gRNA sequence
ccctggcccttacccagacc

SEQ ID NO: 189894 - DNA, 20 bp, Artificial
  CRISPR gRNA sequence
cctggcccttacccagacct

SEQ ID NO: 189895 - DNA, 20 bp, Artificial
  CRISPR gRNA sequence
ggcccttacccagacctggg

SEQ ID NO: 189896 - DNA, 20 bp, Artificial
  CRISPR gRNA sequence
gcccttacccagacctgggc

SEQ ID NO: 189897 - DNA, 20 bp, Artificial
  CRISPR gRNA sequence
ttacccagacctgggcgggt

SEQ ID NO: 189898 - DNA, 20 bp, Artificial
  CRISPR gRNA sequence
cagacctgggcgggtgagtg

SEQ ID NO: 189899 - DNA, 20 bp, Artificial
  CRISPR gRNA sequence
agacctgggcgggtgagtgc

SEQ ID NO: 189900 - DNA, 20 bp, Artificial
  CRISPR gRNA sequence
gacctgggcgggtgagtgcg

SEQ ID NO: 189901 - DNA, 20 bp, Artificial
  CRISPR gRNA sequence
tgggcgggtgagtgcggggt

SEQ ID NO: 189902 - DNA, 20 bp, Artificial
  CRISPR gRNA sequence
gggcgggtgagtgcggggtc

SEQ ID NO: 189903 - DNA, 20 bp, Artificial
  CRISPR gRNA sequence
gggtgagtgcggggtcggga

SEQ ID NO: 189904 - DNA, 20 bp, Artificial
  CRISPR gRNA sequence
gtgcggggtcgggatggaaa

SEQ ID NO: 189905 - DNA, 20 bp, Artificial
  CRISPR gRNA sequence
gggatggaaacggcctctac

SEQ ID NO: 189906 - DNA, 20 bp, Artificial
  CRISPR gRNA sequence
ggatggaaacggcctctacc

SEQ ID NO: 189907 - DNA, 20 bp, Artificial
  CRISPR gRNA sequence
atggaaacggcctctaccgg

SEQ ID NO: 189908 - DNA, 20 bp, Artificial
  CRISPR gRNA sequence
gaaacggcctctaccgggag

SEQ ID NO: 189909 - DNA, 20 bp, Artificial
  CRISPR gRNA sequence
aacggcctctaccgggagta

SEQ ID NO: 189910 - DNA, 20 bp, Artificial
  CRISPR gRNA sequence
cggcctctaccgggagtaga

SEQ ID NO: 189911 - DNA, 20 bp, Artificial
  CRISPR gRNA sequence
ggcctctaccgggagtagag

SEQ ID NO: 189912 - DNA, 20 bp, Artificial
  CRISPR gRNA sequence
gcctctaccgggagtagaga

SEQ ID NO: 189913 - DNA, 20 bp, Artificial
  CRISPR gRNA sequence
cctctaccgggagtagagag

SEQ ID NO: 189914 - DNA, 20 bp, Artificial
  CRISPR gRNA sequence
taccgggagtagagaggggc

SEQ ID NO: 189915 - DNA, 20 bp, Artificial
  CRISPR gRNA sequence
ggagtagagaggggccggcc

SEQ ID NO: 189916 - DNA, 20 bp, Artificial
  CRISPR gRNA sequence
gtagagaggggccggcccgg

SEQ ID NO: 189917 - DNA, 20 bp, Artificial
  CRISPR gRNA sequence
tagagaggggccggcccggc

SEQ ID NO: 189918 - DNA, 20 bp, Artificial
  CRISPR gRNA sequence
agagaggggccggcccggcg

SEQ ID NO: 189919 - DNA, 20 bp, Artificial
  CRISPR gRNA sequence
gagaggggccggcccggcgg

SEQ ID NO: 189920 - DNA, 20 bp, Artificial
  CRISPR gRNA sequence
gggccggcccggcgggggcg

SEQ ID NO: 189921 - DNA, 20 bp, Artificial
  CRISPR gRNA sequence
ggccggcccggcgggggcga

SEQ ID NO: 189922 - DNA, 20 bp, Artificial
  CRISPR gRNA sequence
cccggcgggggcgaaggact

SEQ ID NO: 189923 - DNA, 20 bp, Artificial
  CRISPR gRNA sequence
ccggcgggggcgaaggactc

SEQ ID NO: 189924 - DNA, 20 bp, Artificial
  CRISPR gRNA sequence
cggcgggggcgaaggactcg

SEQ ID NO: 189925 - DNA, 20 bp, Artificial
  CRISPR gRNA sequence
gcgggggcgaaggactcggg

SEQ ID NO: 189926 - DNA, 20 bp, Artificial
  CRISPR gRNA sequence
aaggactcggggagccgcgc

SEQ ID NO: 189927 - DNA, 20 bp, Artificial
  CRISPR gRNA sequence
aggactcggggagccgcgcc

SEQ ID NO: 189928 - DNA, 20 bp, Artificial
  CRISPR gRNA sequence
gactcggggagccgcgccgg

SEQ ID NO: 189929 - DNA, 20 bp, Artificial
  CRISPR gRNA sequence
actcggggagccgcgccggg

SEQ ID NO: 189930 - DNA, 20 bp, Artificial
  CRISPR gRNA sequence
tcggggagccgcgccgggag

SEQ ID NO: 189931 - DNA, 20 bp, Artificial
  CRISPR gRNA sequence
cggggagccgcgccgggagg

SEQ ID NO: 189932 - DNA, 20 bp, Artificial
  CRISPR gRNA sequence
ggggagccgcgccgggagga

SEQ ID NO: 189933 - DNA, 20 bp, Artificial
  CRISPR gRNA sequence
agccgcgccgggaggagggt

SEQ ID NO: 189934 - DNA, 20 bp, Artificial
  CRISPR gRNA sequence
gccgcgccgggaggagggtc

SEQ ID NO: 189935 - DNA, 20 bp, Artificial
  CRISPR gRNA sequence
gaggagggtcgggccgatct

SEQ ID NO: 189936 - DNA, 20 bp, Artificial
  CRISPR gRNA sequence
tctcagcccctcctcgcccc

SEQ ID NO: 189937 - DNA, 20 bp, Artificial
  CRISPR gRNA sequence
ctcagcccctcctcgccccc

SEQ ID NO: 189938 - DNA, 20 bp, Artificial
  CRISPR gRNA sequence
ccccaggctcccactccttg

SEQ ID NO: 189939 - DNA, 20 bp, Artificial
  CRISPR gRNA sequence
atttccacacttccgtgtcc

SEQ ID NO: 189940 - DNA, 20 bp, Artificial
  CRISPR gRNA sequence
cacacttccgtgtcccggcc

SEQ ID NO: 189941 - DNA, 20 bp, Artificial
  CRISPR gRNA sequence
tccgtgtcccggcccggccg

SEQ ID NO: 189942 - DNA, 20 bp, Artificial
  CRISPR gRNA sequence
ccgtgtcccggcccggccgc

SEQ ID NO: 189943 - DNA, 20 bp, Artificial
  CRISPR gRNA sequence
cgtgtcccggcccggccgcg

SEQ ID NO: 189944 - DNA, 20 bp, Artificial
  CRISPR gRNA sequence
tgtcccggcccggccgcggg

SEQ ID NO: 189945 - DNA, 20 bp, Artificial
  CRISPR gRNA sequence
ggagccccgcttcatctctg

SEQ ID NO: 189946 - DNA, 20 bp, Artificial
  CRISPR gRNA sequence
gagccccgcttcatctctgt

SEQ ID NO: 189947 - DNA, 20 bp, Artificial
  CRISPR gRNA sequence
cttcatctctgtgggctacg

SEQ ID NO: 189948 - DNA, 20 bp, Artificial
  CRISPR gRNA sequence
tgggctacgtggacgacacc

SEQ ID NO: 189949 - DNA, 20 bp, Artificial
  CRISPR gRNA sequence
cgcttcgacaacgacgccgc

SEQ ID NO: 189950 - DNA, 20 bp, Artificial
  CRISPR gRNA sequence
gacaacgacgccgcgagtcc

SEQ ID NO: 189951 - DNA, 20 bp, Artificial
  CRISPR gRNA sequence
acaacgacgccgcgagtccg

SEQ ID NO: 189952 - DNA, 20 bp, Artificial
  CRISPR gRNA sequence
cgacgccgcgagtccgagga

SEQ ID NO: 189953 - DNA, 20 bp, Artificial
  CRISPR gRNA sequence
cgagtccgaggatggtgccg

SEQ ID NO: 189954 - DNA, 20 bp, Artificial
  CRISPR gRNA sequence
gagtccgaggatggtgccgc

SEQ ID NO: 189955 - DNA, 20 bp, Artificial
  CRISPR gRNA sequence
ggatggtgccgcgggcgccg

SEQ ID NO: 189956 - DNA, 20 bp, Artificial
  CRISPR gRNA sequence
ggtgccgcgggcgccgtgga

SEQ ID NO: 189957 - DNA, 20 bp, Artificial
  CRISPR gRNA sequence
tgccgcgggcgccgtggatg

SEQ ID NO: 189958 - DNA, 20 bp, Artificial
  CRISPR gRNA sequence
cgcgggcgccgtggatggag

SEQ ID NO: 189959 - DNA, 20 bp, Artificial
  CRISPR gRNA sequence
gcgggcgccgtggatggagc

SEQ ID NO: 189960 - DNA, 20 bp, Artificial
  CRISPR gRNA sequence
gggcgccgtggatggagcag

SEQ ID NO: 189961 - DNA, 20 bp, Artificial
  CRISPR gRNA sequence
ggcgccgtggatggagcagg

SEQ ID NO: 189962 - DNA, 20 bp, Artificial
  CRISPR gRNA sequence
gcgccgtggatggagcagga

SEQ ID NO: 189963 - DNA, 20 bp, Artificial
  CRISPR gRNA sequence
cgccgtggatggagcaggag

SEQ ID NO: 189964 - DNA, 20 bp, Artificial
  CRISPR gRNA sequence
gtggatggagcaggaggggt

SEQ ID NO: 189965 - DNA, 20 bp, Artificial
  CRISPR gRNA sequence
ggatggagcaggaggggtca

SEQ ID NO: 189966 - DNA, 20 bp, Artificial
  CRISPR gRNA sequence
agcaggaggggtcagagtat

SEQ ID NO: 189967 - DNA, 20 bp, Artificial
  CRISPR gRNA sequence
gcaggaggggtcagagtatt

SEQ ID NO: 189968 - DNA, 20 bp, Artificial
  CRISPR gRNA sequence
aggggtcagagtattgggac

SEQ ID NO: 189969 - DNA, 20 bp, Artificial
  CRISPR gRNA sequence
ggggtcagagtattgggacc

SEQ ID NO: 189970 - DNA, 20 bp, Artificial
  CRISPR gRNA sequence
ggtcagagtattgggaccgg

SEQ ID NO: 189971 - DNA, 20 bp, Artificial
  CRISPR gRNA sequence
agtattgggaccgggagaca

SEQ ID NO: 189972 - DNA, 20 bp, Artificial
  CRISPR gRNA sequence
tattgggaccgggagacacg

SEQ ID NO: 189973 - DNA, 20 bp, Artificial
  CRISPR gRNA sequence
gaccgggagacacggagcgc

SEQ ID NO: 189974 - DNA, 20 bp, Artificial
  CRISPR gRNA sequence
accgggagacacggagcgcc

SEQ ID NO: 189975 - DNA, 20 bp, Artificial
  CRISPR gRNA sequence
ccgggagacacggagcgcca

SEQ ID NO: 189976 - DNA, 20 bp, Artificial
  CRISPR gRNA sequence
ggagcgccagggacaccgca

SEQ ID NO: 189977 - DNA, 20 bp, Artificial
  CRISPR gRNA sequence
ggacaccgcacagattttcc

SEQ ID NO: 189978 - DNA, 20 bp, Artificial
  CRISPR gRNA sequence
agattttccgagtgaatctg

SEQ ID NO: 189979 - DNA, 20 bp, Artificial
  CRISPR gRNA sequence
gtgaatctgcggacgctgcg

SEQ ID NO: 189980 - DNA, 20 bp, Artificial
  CRISPR gRNA sequence
cgctgcgcggctactacaat

SEQ ID NO: 189981 - DNA, 20 bp, Artificial
  CRISPR gRNA sequence
ctgcgcggctactacaatca

SEQ ID NO: 189982 - DNA, 20 bp, Artificial
  CRISPR gRNA sequence
gcggctactacaatcagagc

SEQ ID NO: 189983 - DNA, 20 bp, Artificial
  CRISPR gRNA sequence
cggctactacaatcagagcg

SEQ ID NO: 189984 - DNA, 20 bp, Artificial
  CRISPR gRNA sequence
tactacaatcagagcgaggc

SEQ ID NO: 189985 - DNA, 20 bp, Artificial
  CRISPR gRNA sequence
acaatcagagcgaggccggt

SEQ ID NO: 189986 - DNA, 20 bp, Artificial
  CRISPR gRNA sequence
gcgaggccggtgagtgaccc

SEQ ID NO: 189987 - DNA, 20 bp, Artificial
  CRISPR gRNA sequence
ggccggtgagtgaccccggc

SEQ ID NO: 189988 - DNA, 20 bp, Artificial
  CRISPR gRNA sequence
gccggtgagtgaccccggcc

SEQ ID NO: 189989 - DNA, 20 bp, Artificial
  CRISPR gRNA sequence
ccggtgagtgaccccggcca

SEQ ID NO: 189990 - DNA, 20 bp, Artificial
  CRISPR gRNA sequence
cggtgagtgaccccggccag

SEQ ID NO: 189991 - DNA, 20 bp, Artificial
  CRISPR gRNA sequence
gtgagtgaccccggccaggg

SEQ ID NO: 189992 - DNA, 20 bp, Artificial
  CRISPR gRNA sequence
agtgaccccggccaggggag

SEQ ID NO: 189993 - DNA, 20 bp, Artificial
  CRISPR gRNA sequence
gtgaccccggccaggggagc

SEQ ID NO: 189994 - DNA, 20 bp, Artificial
  CRISPR gRNA sequence
cgacccctccccatccccca

SEQ ID NO: 189995 - DNA, 20 bp, Artificial
  CRISPR gRNA sequence
ccctccccatcccccacgga

SEQ ID NO: 189996 - DNA, 20 bp, Artificial
  CRISPR gRNA sequence
cccatcccccacggacggcg

SEQ ID NO: 189997 - DNA, 20 bp, Artificial
  CRISPR gRNA sequence
ccatcccccacggacggcgc

SEQ ID NO: 189998 - DNA, 20 bp, Artificial
  CRISPR gRNA sequence
cgcgggtcccctcgaatctt

SEQ ID NO: 189999 - DNA, 20 bp, Artificial
  CRISPR gRNA sequence
gcgggtcccctcgaatcttc

SEQ ID NO: 190000 - DNA, 20 bp, Artificial
  CRISPR gRNA sequence
cccctcgaatcttcgggtcc

SEQ ID NO: 190001 - DNA, 20 bp, Artificial
  CRISPR gRNA sequence
tcgggtcccagattcacccc

SEQ ID NO: 190002 - DNA, 20 bp, Artificial
  CRISPR gRNA sequence
cgggtcccagattcacccca

SEQ ID NO: 190003 - DNA, 20 bp, Artificial
  CRISPR gRNA sequence
ccagattcaccccaaggctg

SEQ ID NO: 190004 - DNA, 20 bp, Artificial
  CRISPR gRNA sequence
ccaaggctgcggaacccgcc

SEQ ID NO: 190005 - DNA, 20 bp, Artificial
  CRISPR gRNA sequence
tgcggaacccgcccagaccc

SEQ ID NO: 190006 - DNA, 20 bp, Artificial
  CRISPR gRNA sequence
aacccgcccagaccctagac

SEQ ID NO: 190007 - DNA, 20 bp, Artificial
  CRISPR gRNA sequence
acccgcccagaccctagacc

SEQ ID NO: 190008 - DNA, 20 bp, Artificial
  CRISPR gRNA sequence
cccgcccagaccctagaccg

SEQ ID NO: 190009 - DNA, 20 bp, Artificial
  CRISPR gRNA sequence
cgcccagaccctagaccggg

SEQ ID NO: 190010 - DNA, 20 bp, Artificial
  CRISPR gRNA sequence
cccagaccctagaccgggga

SEQ ID NO: 190011 - DNA, 20 bp, Artificial
  CRISPR gRNA sequence
ccctagaccggggagagtct

SEQ ID NO: 190012 - DNA, 20 bp, Artificial
  CRISPR gRNA sequence
cctagaccggggagagtctc

SEQ ID NO: 190013 - DNA, 20 bp, Artificial
  CRISPR gRNA sequence
gagtctcaggcgcctttacc

SEQ ID NO: 190014 - DNA, 20 bp, Artificial
  CRISPR gRNA sequence
gcctttacccggttcttttt

SEQ ID NO: 190015 - DNA, 20 bp, Artificial
  CRISPR gRNA sequence
tacccggttctttttcagtt

SEQ ID NO: 190016 - DNA, 20 bp, Artificial
  CRISPR gRNA sequence
acccggttctttttcagttt

SEQ ID NO: 190017 - DNA, 20 bp, Artificial
  CRISPR gRNA sequence
agtttaggccaaaatgccca

SEQ ID NO: 190018 - DNA, 20 bp, Artificial
  CRISPR gRNA sequence
gtttaggccaaaatgcccac

SEQ ID NO: 190019 - DNA, 20 bp, Artificial
  CRISPR gRNA sequence
tttaggccaaaatgcccaca

SEQ ID NO: 190020 - DNA, 20 bp, Artificial
  CRISPR gRNA sequence
aggccaaaatgcccacaggg

SEQ ID NO: 190021 - DNA, 20 bp, Artificial
  CRISPR gRNA sequence
ccaaaatgcccacagggtgg

SEQ ID NO: 190022 - DNA, 20 bp, Artificial
  CRISPR gRNA sequence
tgcccacagggtggtggcga

SEQ ID NO: 190023 - DNA, 20 bp, Artificial
  CRISPR gRNA sequence
gcccacagggtggtggcgac

SEQ ID NO: 190024 - DNA, 20 bp, Artificial
  CRISPR gRNA sequence
cccacagggtggtggcgacg

SEQ ID NO: 190025 - DNA, 20 bp, Artificial
  CRISPR gRNA sequence
ccacagggtggtggcgacgg

SEQ ID NO: 190026 - DNA, 20 bp, Artificial
  CRISPR gRNA sequence
cagggtggtggcgacggggg

SEQ ID NO: 190027 - DNA, 20 bp, Artificial
  CRISPR gRNA sequence
agggtggtggcgacgggggc

SEQ ID NO: 190028 - DNA, 20 bp, Artificial
  CRISPR gRNA sequence
gggtggtggcgacgggggcg

SEQ ID NO: 190029 - DNA, 20 bp, Artificial
  CRISPR gRNA sequence
gtggcgacgggggcggggct

SEQ ID NO: 190030 - DNA, 20 bp, Artificial
  CRISPR gRNA sequence
gcgacgggggcggggcttgg

SEQ ID NO: 190031 - DNA, 20 bp, Artificial
  CRISPR gRNA sequence
cgacgggggcggggcttggt

SEQ ID NO: 190032 - DNA, 20 bp, Artificial
  CRISPR gRNA sequence
cgggggcggggcttggtggg

SEQ ID NO: 190033 - DNA, 20 bp, Artificial
  CRISPR gRNA sequence
gggggcggggcttggtgggc

SEQ ID NO: 190034 - DNA, 20 bp, Artificial
  CRISPR gRNA sequence
cttggtgggcgggactgact

SEQ ID NO: 190035 - DNA, 20 bp, Artificial
  CRISPR gRNA sequence
ttggtgggcgggactgacta

SEQ ID NO: 190036 - DNA, 20 bp, Artificial
  CRISPR gRNA sequence
tggtgggcgggactgactaa

SEQ ID NO: 190037 - DNA, 20 bp, Artificial
  CRISPR gRNA sequence
ggtgggcgggactgactaag

SEQ ID NO: 190038 - DNA, 20 bp, Artificial
  CRISPR gRNA sequence
gggcgggactgactaagggg

SEQ ID NO: 190039 - DNA, 20 bp, Artificial
  CRISPR gRNA sequence
ggcgggactgactaaggggc

SEQ ID NO: 190040 - DNA, 20 bp, Artificial
  CRISPR gRNA sequence
gcgggactgactaaggggcg

SEQ ID NO: 190041 - DNA, 20 bp, Artificial
  CRISPR gRNA sequence
gactgactaaggggcggggc

SEQ ID NO: 190042 - DNA, 20 bp, Artificial
  CRISPR gRNA sequence
actgactaaggggcggggcc

SEQ ID NO: 190043 - DNA, 20 bp, Artificial
  CRISPR gRNA sequence
ctgactaaggggcggggcca

SEQ ID NO: 190044 - DNA, 20 bp, Artificial
  CRISPR gRNA sequence
ggccagggtctcacaccctg

SEQ ID NO: 190045 - DNA, 20 bp, Artificial
  CRISPR gRNA sequence
cagggtctcacaccctgcag

SEQ ID NO: 190046 - DNA, 20 bp, Artificial
  CRISPR gRNA sequence
cacaccctgcagtggatgca

SEQ ID NO: 190047 - DNA, 20 bp, Artificial
  CRISPR gRNA sequence
tgcagtggatgcatggctgc

SEQ ID NO: 190048 - DNA, 20 bp, Artificial
  CRISPR gRNA sequence
gtggatgcatggctgcgagc

SEQ ID NO: 190049 - DNA, 20 bp, Artificial
  CRISPR gRNA sequence
tggatgcatggctgcgagct

SEQ ID NO: 190050 - DNA, 20 bp, Artificial
  CRISPR gRNA sequence
ggatgcatggctgcgagctg

SEQ ID NO: 190051 - DNA, 20 bp, Artificial
  CRISPR gRNA sequence
ggctgcgagctggggcccga

SEQ ID NO: 190052 - DNA, 20 bp, Artificial
  CRISPR gRNA sequence
gctgcgagctggggcccgac

SEQ ID NO: 190053 - DNA, 20 bp, Artificial
  CRISPR gRNA sequence
cccgacgggcgcttcctccg

SEQ ID NO: 190054 - DNA, 20 bp, Artificial
  CRISPR gRNA sequence
ccgacgggcgcttcctccgc

SEQ ID NO: 190055 - DNA, 20 bp, Artificial
  CRISPR gRNA sequence
gcttcctccgcgggtatgaa

SEQ ID NO: 190056 - DNA, 20 bp, Artificial
  CRISPR gRNA sequence
tatgaacagttcgcctacga

SEQ ID NO: 190057 - DNA, 20 bp, Artificial
  CRISPR gRNA sequence
aacagttcgcctacgacggc

SEQ ID NO: 190058 - DNA, 20 bp, Artificial
  CRISPR gRNA sequence
acagttcgcctacgacggca

SEQ ID NO: 190059 - DNA, 20 bp, Artificial
  CRISPR gRNA sequence
aggattatctcaccctgaat

SEQ ID NO: 190060 - DNA, 20 bp, Artificial
  CRISPR gRNA sequence
ggattatctcaccctgaatg

SEQ ID NO: 190061 - DNA, 20 bp, Artificial
  CRISPR gRNA sequence
tgaatgaggacctgcgctcc

SEQ ID NO: 190062 - DNA, 20 bp, Artificial
  CRISPR gRNA sequence
ggacctgcgctcctggaccg

SEQ ID NO: 190063 - DNA, 20 bp, Artificial
  CRISPR gRNA sequence
cctgcgctcctggaccgcgg

SEQ ID NO: 190064 - DNA, 20 bp, Artificial
  CRISPR gRNA sequence
ctcctggaccgcggtggaca

SEQ ID NO: 190065 - DNA, 20 bp, Artificial
  CRISPR gRNA sequence
ctggaccgcggtggacacgg

SEQ ID NO: 190066 - DNA, 20 bp, Artificial
  CRISPR gRNA sequence
ccgcggtggacacggcggct

SEQ ID NO: 190067 - DNA, 20 bp, Artificial
  CRISPR gRNA sequence
acacggcggctcagatctcc

SEQ ID NO: 190068 - DNA, 20 bp, Artificial
  CRISPR gRNA sequence
cggctcagatctccgagcaa

SEQ ID NO: 190069 - DNA, 20 bp, Artificial
  CRISPR gRNA sequence
aaaagtcaaatgatgcctct

SEQ ID NO: 190070 - DNA, 20 bp, Artificial
  CRISPR gRNA sequence
aaagtcaaatgatgcctctg

SEQ ID NO: 190071 - DNA, 20 bp, Artificial
  CRISPR gRNA sequence
gtcaaatgatgcctctgagg

SEQ ID NO: 190072 - DNA, 20 bp, Artificial
  CRISPR gRNA sequence
caaatgatgcctctgaggcg

SEQ ID NO: 190073 - DNA, 20 bp, Artificial
  CRISPR gRNA sequence
atgcctctgaggcggagcac

SEQ ID NO: 190074 - DNA, 20 bp, Artificial
  CRISPR gRNA sequence
gcctctgaggcggagcacca

SEQ ID NO: 190075 - DNA, 20 bp, Artificial
  CRISPR gRNA sequence
ctctgaggcggagcaccaga

SEQ ID NO: 190076 - DNA, 20 bp, Artificial
  CRISPR gRNA sequence
ggagcaccagagagcctacc

SEQ ID NO: 190077 - DNA, 20 bp, Artificial
  CRISPR gRNA sequence
gcaccagagagcctacctgg

SEQ ID NO: 190078 - DNA, 20 bp, Artificial
  CRISPR gRNA sequence
ctacctggaagacacatgcg

SEQ ID NO: 190079 - DNA, 20 bp, Artificial
  CRISPR gRNA sequence
acctggaagacacatgcgtg

SEQ ID NO: 190080 - DNA, 20 bp, Artificial
  CRISPR gRNA sequence
tggaagacacatgcgtggag

SEQ ID NO: 190081 - DNA, 20 bp, Artificial
  CRISPR gRNA sequence
ggagtggctccacaaatacc

SEQ ID NO: 190082 - DNA, 20 bp, Artificial
  CRISPR gRNA sequence
agtggctccacaaatacctg

SEQ ID NO: 190083 - DNA, 20 bp, Artificial
  CRISPR gRNA sequence
ggctccacaaatacctggag

SEQ ID NO: 190084 - DNA, 20 bp, Artificial
  CRISPR gRNA sequence
gctccacaaatacctggaga

SEQ ID NO: 190085 - DNA, 20 bp, Artificial
  CRISPR gRNA sequence
ctccacaaatacctggagaa

SEQ ID NO: 190086 - DNA, 20 bp, Artificial
  CRISPR gRNA sequence
tccacaaatacctggagaag

SEQ ID NO: 190087 - DNA, 20 bp, Artificial
  CRISPR gRNA sequence
acaaatacctggagaagggg

SEQ ID NO: 190088 - DNA, 20 bp, Artificial
  CRISPR gRNA sequence
caaatacctggagaagggga

SEQ ID NO: 190089 - DNA, 20 bp, Artificial
  CRISPR gRNA sequence
aatacctggagaaggggaag

SEQ ID NO: 190090 - DNA, 20 bp, Artificial
  CRISPR gRNA sequence
gaaggagacgctgcttcacc

SEQ ID NO: 190091 - DNA, 20 bp, Artificial
  CRISPR gRNA sequence
aaggagacgctgcttcacct

SEQ ID NO: 190092 - DNA, 20 bp, Artificial
  CRISPR gRNA sequence
agacgctgcttcacctgggt

SEQ ID NO: 190093 - DNA, 20 bp, Artificial
  CRISPR gRNA sequence
acgctgcttcacctgggtaa

SEQ ID NO: 190094 - DNA, 20 bp, Artificial
  CRISPR gRNA sequence
cgctgcttcacctgggtaag

SEQ ID NO: 190095 - DNA, 20 bp, Artificial
  CRISPR gRNA sequence
gctgcttcacctgggtaaga

SEQ ID NO: 190096 - DNA, 20 bp, Artificial
  CRISPR gRNA sequence
cacctgggtaagagggtcca

SEQ ID NO: 190097 - DNA, 20 bp, Artificial
  CRISPR gRNA sequence
acctgggtaagagggtccac

SEQ ID NO: 190098 - DNA, 20 bp, Artificial
  CRISPR gRNA sequence
cctgggtaagagggtccaca

SEQ ID NO: 190099 - DNA, 20 bp, Artificial
  CRISPR gRNA sequence
ctactctcccaactccttct

SEQ ID NO: 190100 - DNA, 20 bp, Artificial
  CRISPR gRNA sequence
tactctcccaactccttctt

SEQ ID NO: 190101 - DNA, 20 bp, Artificial
  CRISPR gRNA sequence
ctcccaactccttcttgggc

SEQ ID NO: 190102 - DNA, 20 bp, Artificial
  CRISPR gRNA sequence
tcccaactccttcttgggct

SEQ ID NO: 190103 - DNA, 20 bp, Artificial
  CRISPR gRNA sequence
ttgggctaggactgtgccca

SEQ ID NO: 190104 - DNA, 20 bp, Artificial
  CRISPR gRNA sequence
aggactgtgcccacagctga

SEQ ID NO: 190105 - DNA, 20 bp, Artificial
  CRISPR gRNA sequence
cacagctgacagacctcaaa

SEQ ID NO: 190106 - DNA, 20 bp, Artificial
  CRISPR gRNA sequence
agctgacagacctcaaacag

SEQ ID NO: 190107 - DNA, 20 bp, Artificial
  CRISPR gRNA sequence
tgacagacctcaaacagtag

SEQ ID NO: 190108 - DNA, 20 bp, Artificial
  CRISPR gRNA sequence
acctcaaacagtagaagaaa

SEQ ID NO: 190109 - DNA, 20 bp, Artificial
  CRISPR gRNA sequence
cctcaaacagtagaagaaac

SEQ ID NO: 190110 - DNA, 20 bp, Artificial
  CRISPR gRNA sequence
ctcaaacagtagaagaaaca

SEQ ID NO: 190111 - DNA, 20 bp, Artificial
  CRISPR gRNA sequence
aacagtagaagaaacaggga

SEQ ID NO: 190112 - DNA, 20 bp, Artificial
  CRISPR gRNA sequence
cagtagaagaaacagggatg

SEQ ID NO: 190113 - DNA, 20 bp, Artificial
  CRISPR gRNA sequence
agtagaagaaacagggatgg

SEQ ID NO: 190114 - DNA, 20 bp, Artificial
  CRISPR gRNA sequence
gaagaaacagggatggaggc

SEQ ID NO: 190115 - DNA, 20 bp, Artificial
  CRISPR gRNA sequence
ccagaataccactcctccct

SEQ ID NO: 190116 - DNA, 20 bp, Artificial
  CRISPR gRNA sequence
ataccactcctcccttggat

SEQ ID NO: 190117 - DNA, 20 bp, Artificial
  CRISPR gRNA sequence
taccactcctcccttggatc

SEQ ID NO: 190118 - DNA, 20 bp, Artificial
  CRISPR gRNA sequence
ccactcctcccttggatcag

SEQ ID NO: 190119 - DNA, 20 bp, Artificial
  CRISPR gRNA sequence
actcctcccttggatcagga

SEQ ID NO: 190120 - DNA, 20 bp, Artificial
  CRISPR gRNA sequence
ctcctcccttggatcaggag

SEQ ID NO: 190121 - DNA, 20 bp, Artificial
  CRISPR gRNA sequence
tcctcccttggatcaggaga

SEQ ID NO: 190122 - DNA, 20 bp, Artificial
  CRISPR gRNA sequence
ctcccttggatcaggagagg

SEQ ID NO: 190123 - DNA, 20 bp, Artificial
  CRISPR gRNA sequence
aggagagggagctgtcacct

SEQ ID NO: 190124 - DNA, 20 bp, Artificial
  CRISPR gRNA sequence
ggagagggagctgtcacctg

SEQ ID NO: 190125 - DNA, 20 bp, Artificial
  CRISPR gRNA sequence
gggagctgtcacctgaggta

SEQ ID NO: 190126 - DNA, 20 bp, Artificial
  CRISPR gRNA sequence
ggagctgtcacctgaggtac

SEQ ID NO: 190127 - DNA, 20 bp, Artificial
  CRISPR gRNA sequence
agctgtcacctgaggtacag

SEQ ID NO: 190128 - DNA, 20 bp, Artificial
  CRISPR gRNA sequence
gtacaggagatcctatacca

SEQ ID NO: 190129 - DNA, 20 bp, Artificial
  CRISPR gRNA sequence
acaggagatcctataccaca

SEQ ID NO: 190130 - DNA, 20 bp, Artificial
  CRISPR gRNA sequence
accacagagtgactctctta

SEQ ID NO: 190131 - DNA, 20 bp, Artificial
  CRISPR gRNA sequence
ccacagagtgactctcttaa

SEQ ID NO: 190132 - DNA, 20 bp, Artificial
  CRISPR gRNA sequence
cacagagtgactctcttaaa

SEQ ID NO: 190133 - DNA, 20 bp, Artificial
  CRISPR gRNA sequence
gagtgactctcttaaagggc

SEQ ID NO: 190134 - DNA, 20 bp, Artificial
  CRISPR gRNA sequence
ttaaagggccagacctctct

SEQ ID NO: 190135 - DNA, 20 bp, Artificial
  CRISPR gRNA sequence
taaagggccagacctctctc

SEQ ID NO: 190136 - DNA, 20 bp, Artificial
  CRISPR gRNA sequence
aaagggccagacctctctca

SEQ ID NO: 190137 - DNA, 20 bp, Artificial
  CRISPR gRNA sequence
aagggccagacctctctcag

SEQ ID NO: 190138 - DNA, 20 bp, Artificial
  CRISPR gRNA sequence
gacctctctcaggggcaatt

SEQ ID NO: 190139 - DNA, 20 bp, Artificial
  CRISPR gRNA sequence
acctctctcaggggcaatta

SEQ ID NO: 190140 - DNA, 20 bp, Artificial
  CRISPR gRNA sequence
tcaggggcaattaaggaatc

SEQ ID NO: 190141 - DNA, 20 bp, Artificial
  CRISPR gRNA sequence
attaaggaatctagtctcgc

SEQ ID NO: 190142 - DNA, 20 bp, Artificial
  CRISPR gRNA sequence
taaggaatctagtctcgctg

SEQ ID NO: 190143 - DNA, 20 bp, Artificial
  CRISPR gRNA sequence
tcgctggagattccatcctt

SEQ ID NO: 190144 - DNA, 20 bp, Artificial
  CRISPR gRNA sequence
catccttcagatgaactgat

SEQ ID NO: 190145 - DNA, 20 bp, Artificial
  CRISPR gRNA sequence
ccttcagatgaactgatgag

SEQ ID NO: 190146 - DNA, 20 bp, Artificial
  CRISPR gRNA sequence
gagcagttctctttgactcc

SEQ ID NO: 190147 - DNA, 20 bp, Artificial
  CRISPR gRNA sequence
ttctctttgactcccagtat

SEQ ID NO: 190148 - DNA, 20 bp, Artificial
  CRISPR gRNA sequence
tctctttgactcccagtatt

SEQ ID NO: 190149 - DNA, 20 bp, Artificial
  CRISPR gRNA sequence
actcccagtattaggaatca

SEQ ID NO: 190150 - DNA, 20 bp, Artificial
  CRISPR gRNA sequence
ctcccagtattaggaatcac

SEQ ID NO: 190151 - DNA, 20 bp, Artificial
  CRISPR gRNA sequence
tcccagtattaggaatcacg

SEQ ID NO: 190152 - DNA, 20 bp, Artificial
  CRISPR gRNA sequence
cccagtattaggaatcacgg

SEQ ID NO: 190153 - DNA, 20 bp, Artificial
  CRISPR gRNA sequence
cagtattaggaatcacgggg

SEQ ID NO: 190154 - DNA, 20 bp, Artificial
  CRISPR gRNA sequence
tttctctcgtgcctgattct

SEQ ID NO: 190155 - DNA, 20 bp, Artificial
  CRISPR gRNA sequence
ctgattctcagccccacacc

SEQ ID NO: 190156 - DNA, 20 bp, Artificial
  CRISPR gRNA sequence
gattctcagccccacaccaa

SEQ ID NO: 190157 - DNA, 20 bp, Artificial
  CRISPR gRNA sequence
agccccacaccaagagtttt

SEQ ID NO: 190158 - DNA, 20 bp, Artificial
  CRISPR gRNA sequence
ccccacaccaagagtttttg

SEQ ID NO: 190159 - DNA, 20 bp, Artificial
  CRISPR gRNA sequence
cccacaccaagagtttttgg

SEQ ID NO: 190160 - DNA, 20 bp, Artificial
  CRISPR gRNA sequence
agtttttggaggtctgactc

SEQ ID NO: 190161 - DNA, 20 bp, Artificial
  CRISPR gRNA sequence
ggtctgactccagcttttct

SEQ ID NO: 190162 - DNA, 20 bp, Artificial
  CRISPR gRNA sequence
tccagcttttctcagtcact

SEQ ID NO: 190163 - DNA, 20 bp, Artificial
  CRISPR gRNA sequence
tcagtcactcagcatccaca

SEQ ID NO: 190164 - DNA, 20 bp, Artificial
  CRISPR gRNA sequence
cagtcactcagcatccacac

SEQ ID NO: 190165 - DNA, 20 bp, Artificial
  CRISPR gRNA sequence
cactcagcatccacacaggc

SEQ ID NO: 190166 - DNA, 20 bp, Artificial
  CRISPR gRNA sequence
actcagcatccacacaggcc

SEQ ID NO: 190167 - DNA, 20 bp, Artificial
  CRISPR gRNA sequence
gcatccacacaggccaggac

SEQ ID NO: 190168 - DNA, 20 bp, Artificial
  CRISPR gRNA sequence
tcccttttcaccttctaccc

SEQ ID NO: 190169 - DNA, 20 bp, Artificial
  CRISPR gRNA sequence
cccttttcaccttctaccct

SEQ ID NO: 190170 - DNA, 20 bp, Artificial
  CRISPR gRNA sequence
tttcaccttctaccctgggc

SEQ ID NO: 190171 - DNA, 20 bp, Artificial
  CRISPR gRNA sequence
gggctagctcatcccgattc

SEQ ID NO: 190172 - DNA, 20 bp, Artificial
  CRISPR gRNA sequence
tcccgattctagaactttcc

SEQ ID NO: 190173 - DNA, 20 bp, Artificial
  CRISPR gRNA sequence
cccgattctagaactttcca

SEQ ID NO: 190174 - DNA, 20 bp, Artificial
  CRISPR gRNA sequence
tctagaactttccaaggaat

SEQ ID NO: 190175 - DNA, 20 bp, Artificial
  CRISPR gRNA sequence
tagaactttccaaggaataa

SEQ ID NO: 190176 - DNA, 20 bp, Artificial
  CRISPR gRNA sequence
agaactttccaaggaataag

SEQ ID NO: 190177 - DNA, 20 bp, Artificial
  CRISPR gRNA sequence
caaggaataagaggctatcc

SEQ ID NO: 190178 - DNA, 20 bp, Artificial
  CRISPR gRNA sequence
agaggctatcccagatccct

SEQ ID NO: 190179 - DNA, 20 bp, Artificial
  CRISPR gRNA sequence
ctatcccagatccctaagtc

SEQ ID NO: 190180 - DNA, 20 bp, Artificial
  CRISPR gRNA sequence
tatcccagatccctaagtcc

SEQ ID NO: 190181 - DNA, 20 bp, Artificial
  CRISPR gRNA sequence
ccagatccctaagtccaggc

SEQ ID NO: 190182 - DNA, 20 bp, Artificial
  CRISPR gRNA sequence
cctaagtccaggctggtgtc

SEQ ID NO: 190183 - DNA, 20 bp, Artificial
  CRISPR gRNA sequence
ctaagtccaggctggtgtca

SEQ ID NO: 190184 - DNA, 20 bp, Artificial
  CRISPR gRNA sequence
ataattgtcctcttccttct

SEQ ID NO: 190185 - DNA, 20 bp, Artificial
  CRISPR gRNA sequence
taattgtcctcttccttctc

SEQ ID NO: 190186 - DNA, 20 bp, Artificial
  CRISPR gRNA sequence
tgtcctcttccttctcagga

SEQ ID NO: 190187 - DNA, 20 bp, Artificial
  CRISPR gRNA sequence
tccttctcaggatggtcaca

SEQ ID NO: 190188 - DNA, 20 bp, Artificial
  CRISPR gRNA sequence
ccttctcaggatggtcacat

SEQ ID NO: 190189 - DNA, 20 bp, Artificial
  CRISPR gRNA sequence
gatggtcacatgggtgctgc

SEQ ID NO: 190190 - DNA, 20 bp, Artificial
  CRISPR gRNA sequence
tggtcacatgggtgctgctg

SEQ ID NO: 190191 - DNA, 20 bp, Artificial
  CRISPR gRNA sequence
gtgctgctggagtgtcccat

SEQ ID NO: 190192 - DNA, 20 bp, Artificial
  CRISPR gRNA sequence
gctgctggagtgtcccatga

SEQ ID NO: 190193 - DNA, 20 bp, Artificial
  CRISPR gRNA sequence
agtgtcccatgagagataca

SEQ ID NO: 190194 - DNA, 20 bp, Artificial
  CRISPR gRNA sequence
aattttctgactcttcccct

SEQ ID NO: 190195 - DNA, 20 bp, Artificial
  CRISPR gRNA sequence
ttttctgactcttcccctca

SEQ ID NO: 190196 - DNA, 20 bp, Artificial
  CRISPR gRNA sequence
tcttcccctcagagccccca

SEQ ID NO: 190197 - DNA, 20 bp, Artificial
  CRISPR gRNA sequence
accaccccatctctgaccat

SEQ ID NO: 190198 - DNA, 20 bp, Artificial
  CRISPR gRNA sequence
ccaccccatctctgaccatg

SEQ ID NO: 190199 - DNA, 20 bp, Artificial
  CRISPR gRNA sequence
tctgaccatgaggccaccct

SEQ ID NO: 190200 - DNA, 20 bp, Artificial
  CRISPR gRNA sequence
ctgaccatgaggccaccctg

SEQ ID NO: 190201 - DNA, 20 bp, Artificial
  CRISPR gRNA sequence
atgaggccaccctgaggtgc

SEQ ID NO: 190202 - DNA, 20 bp, Artificial
  CRISPR gRNA sequence
tgaggccaccctgaggtgct

SEQ ID NO: 190203 - DNA, 20 bp, Artificial
  CRISPR gRNA sequence
caccctgaggtgctgggccc

SEQ ID NO: 190204 - DNA, 20 bp, Artificial
  CRISPR gRNA sequence
accctgaggtgctgggccct

SEQ ID NO: 190205 - DNA, 20 bp, Artificial
  CRISPR gRNA sequence
ggccctgggcttctaccctg

SEQ ID NO: 190206 - DNA, 20 bp, Artificial
  CRISPR gRNA sequence
ccctgggcttctaccctgcg

SEQ ID NO: 190207 - DNA, 20 bp, Artificial
  CRISPR gRNA sequence
ctgcggagatcacactgacc

SEQ ID NO: 190208 - DNA, 20 bp, Artificial
  CRISPR gRNA sequence
cggagatcacactgacctgg

SEQ ID NO: 190209 - DNA, 20 bp, Artificial
  CRISPR gRNA sequence
agatcacactgacctggcag

SEQ ID NO: 190210 - DNA, 20 bp, Artificial
  CRISPR gRNA sequence
gatcacactgacctggcagc

SEQ ID NO: 190211 - DNA, 20 bp, Artificial
  CRISPR gRNA sequence
acactgacctggcagcagga

SEQ ID NO: 190212 - DNA, 20 bp, Artificial
  CRISPR gRNA sequence
cactgacctggcagcaggat

SEQ ID NO: 190213 - DNA, 20 bp, Artificial
  CRISPR gRNA sequence
actgacctggcagcaggatg

SEQ ID NO: 190214 - DNA, 20 bp, Artificial
  CRISPR gRNA sequence
tgacctggcagcaggatggg

SEQ ID NO: 190215 - DNA, 20 bp, Artificial
  CRISPR gRNA sequence
gacctggcagcaggatgggg

SEQ ID NO: 190216 - DNA, 20 bp, Artificial
  CRISPR gRNA sequence
acctggcagcaggatgggga

SEQ ID NO: 190217 - DNA, 20 bp, Artificial
  CRISPR gRNA sequence
aggatggggagggccatacc

SEQ ID NO: 190218 - DNA, 20 bp, Artificial
  CRISPR gRNA sequence
ggatggggagggccataccc

SEQ ID NO: 190219 - DNA, 20 bp, Artificial
  CRISPR gRNA sequence
ggagggccatacccaggaca

SEQ ID NO: 190220 - DNA, 20 bp, Artificial
  CRISPR gRNA sequence
agggccatacccaggacacg

SEQ ID NO: 190221 - DNA, 20 bp, Artificial
  CRISPR gRNA sequence
tacccaggacacggagctcg

SEQ ID NO: 190222 - DNA, 20 bp, Artificial
  CRISPR gRNA sequence
cccaggacacggagctcgtg

SEQ ID NO: 190223 - DNA, 20 bp, Artificial
  CRISPR gRNA sequence
gacacggagctcgtggagac

SEQ ID NO: 190224 - DNA, 20 bp, Artificial
  CRISPR gRNA sequence
acacggagctcgtggagacc

SEQ ID NO: 190225 - DNA, 20 bp, Artificial
  CRISPR gRNA sequence
gctcgtggagaccaggcctg

SEQ ID NO: 190226 - DNA, 20 bp, Artificial
  CRISPR gRNA sequence
ctcgtggagaccaggcctgc

SEQ ID NO: 190227 - DNA, 20 bp, Artificial
  CRISPR gRNA sequence
tcgtggagaccaggcctgca

SEQ ID NO: 190228 - DNA, 20 bp, Artificial
  CRISPR gRNA sequence
cgtggagaccaggcctgcag

SEQ ID NO: 190229 - DNA, 20 bp, Artificial
  CRISPR gRNA sequence
gagaccaggcctgcagggga

SEQ ID NO: 190230 - DNA, 20 bp, Artificial
  CRISPR gRNA sequence
ctgcaggggatggaaccttc

SEQ ID NO: 190231 - DNA, 20 bp, Artificial
  CRISPR gRNA sequence
caggggatggaaccttccag

SEQ ID NO: 190232 - DNA, 20 bp, Artificial
  CRISPR gRNA sequence
gggatggaaccttccagaag

SEQ ID NO: 190233 - DNA, 20 bp, Artificial
  CRISPR gRNA sequence
ggatggaaccttccagaagt

SEQ ID NO: 190234 - DNA, 20 bp, Artificial
  CRISPR gRNA sequence
tggaaccttccagaagtggg

SEQ ID NO: 190235 - DNA, 20 bp, Artificial
  CRISPR gRNA sequence
cttccagaagtgggcagctg

SEQ ID NO: 190236 - DNA, 20 bp, Artificial
  CRISPR gRNA sequence
ccagaagtgggcagctgtgg

SEQ ID NO: 190237 - DNA, 20 bp, Artificial
  CRISPR gRNA sequence
gcagctgtggtggtgccttc

SEQ ID NO: 190238 - DNA, 20 bp, Artificial
  CRISPR gRNA sequence
agctgtggtggtgccttctg

SEQ ID NO: 190239 - DNA, 20 bp, Artificial
  CRISPR gRNA sequence
ctgtggtggtgccttctgga

SEQ ID NO: 190240 - DNA, 20 bp, Artificial
  CRISPR gRNA sequence
tgtggtggtgccttctggag

SEQ ID NO: 190241 - DNA, 20 bp, Artificial
  CRISPR gRNA sequence
tggtggtgccttctggagag

SEQ ID NO: 190242 - DNA, 20 bp, Artificial
  CRISPR gRNA sequence
tggtgccttctggagaggag

SEQ ID NO: 190243 - DNA, 20 bp, Artificial
  CRISPR gRNA sequence
gtgccttctggagaggagca

SEQ ID NO: 190244 - DNA, 20 bp, Artificial
  CRISPR gRNA sequence
agagatacacgtgccatgtg

SEQ ID NO: 190245 - DNA, 20 bp, Artificial
  CRISPR gRNA sequence
acacgtgccatgtgcagcat

SEQ ID NO: 190246 - DNA, 20 bp, Artificial
  CRISPR gRNA sequence
cacgtgccatgtgcagcatg

SEQ ID NO: 190247 - DNA, 20 bp, Artificial
  CRISPR gRNA sequence
acgtgccatgtgcagcatga

SEQ ID NO: 190248 - DNA, 20 bp, Artificial
  CRISPR gRNA sequence
cgtgccatgtgcagcatgag

SEQ ID NO: 190249 - DNA, 20 bp, Artificial
  CRISPR gRNA sequence
tgcagcatgaggggctaccc

SEQ ID NO: 190250 - DNA, 20 bp, Artificial
  CRISPR gRNA sequence
ctacccgagcccgtcaccct

SEQ ID NO: 190251 - DNA, 20 bp, Artificial
  CRISPR gRNA sequence
ccgagcccgtcaccctgaga

SEQ ID NO: 190252 - DNA, 20 bp, Artificial
  CRISPR gRNA sequence
gagcccgtcaccctgagatg

SEQ ID NO: 190253 - DNA, 20 bp, Artificial
  CRISPR gRNA sequence
ccgtcaccctgagatggagt

SEQ ID NO: 190254 - DNA, 20 bp, Artificial
  CRISPR gRNA sequence
cgtcaccctgagatggagta

SEQ ID NO: 190255 - DNA, 20 bp, Artificial
  CRISPR gRNA sequence
tcaccctgagatggagtaag

SEQ ID NO: 190256 - DNA, 20 bp, Artificial
  CRISPR gRNA sequence
caccctgagatggagtaagg

SEQ ID NO: 190257 - DNA, 20 bp, Artificial
  CRISPR gRNA sequence
accctgagatggagtaagga

SEQ ID NO: 190258 - DNA, 20 bp, Artificial
  CRISPR gRNA sequence
ccctgagatggagtaaggag

SEQ ID NO: 190259 - DNA, 20 bp, Artificial
  CRISPR gRNA sequence
cctgagatggagtaaggagg

SEQ ID NO: 190260 - DNA, 20 bp, Artificial
  CRISPR gRNA sequence
agatggagtaaggaggggga

SEQ ID NO: 190261 - DNA, 20 bp, Artificial
  CRISPR gRNA sequence
gatggagtaaggagggggat

SEQ ID NO: 190262 - DNA, 20 bp, Artificial
  CRISPR gRNA sequence
tggagtaaggagggggatgg

SEQ ID NO: 190263 - DNA, 20 bp, Artificial
  CRISPR gRNA sequence
ggagtaaggagggggatggg

SEQ ID NO: 190264 - DNA, 20 bp, Artificial
  CRISPR gRNA sequence
tgggaggtcatgtctcttct

SEQ ID NO: 190265 - DNA, 20 bp, Artificial
  CRISPR gRNA sequence
gggaggtcatgtctcttctc

SEQ ID NO: 190266 - DNA, 20 bp, Artificial
  CRISPR gRNA sequence
ggaggtcatgtctcttctca

SEQ ID NO: 190267 - DNA, 20 bp, Artificial
  CRISPR gRNA sequence
gtcatgtctcttctcaggga

SEQ ID NO: 190268 - DNA, 20 bp, Artificial
  CRISPR gRNA sequence
atgtctcttctcagggaaag

SEQ ID NO: 190269 - DNA, 20 bp, Artificial
  CRISPR gRNA sequence
tgtctcttctcagggaaagc

SEQ ID NO: 190270 - DNA, 20 bp, Artificial
  CRISPR gRNA sequence
tctcttctcagggaaagcgg

SEQ ID NO: 190271 - DNA, 20 bp, Artificial
  CRISPR gRNA sequence
agggaaagcgggagcccttc

SEQ ID NO: 190272 - DNA, 20 bp, Artificial
  CRISPR gRNA sequence
ggaaagcgggagcccttctg

SEQ ID NO: 190273 - DNA, 20 bp, Artificial
  CRISPR gRNA sequence
gcccttctggagcccttccg

SEQ ID NO: 190274 - DNA, 20 bp, Artificial
  CRISPR gRNA sequence
cccttctggagcccttccgc

SEQ ID NO: 190275 - DNA, 20 bp, Artificial
  CRISPR gRNA sequence
ccttctggagcccttccgca

SEQ ID NO: 190276 - DNA, 20 bp, Artificial
  CRISPR gRNA sequence
ctggagcccttccgcagggt

SEQ ID NO: 190277 - DNA, 20 bp, Artificial
  CRISPR gRNA sequence
tggagcccttccgcagggtc

SEQ ID NO: 190278 - DNA, 20 bp, Artificial
  CRISPR gRNA sequence
ggagcccttccgcagggtca

SEQ ID NO: 190279 - DNA, 20 bp, Artificial
  CRISPR gRNA sequence
ccttccgcagggtcagggct

SEQ ID NO: 190280 - DNA, 20 bp, Artificial
  CRISPR gRNA sequence
cttccgcagggtcagggctg

SEQ ID NO: 190281 - DNA, 20 bp, Artificial
  CRISPR gRNA sequence
gcagggtcagggctgaggcc

SEQ ID NO: 190282 - DNA, 20 bp, Artificial
  CRISPR gRNA sequence
cagggtcagggctgaggcct

SEQ ID NO: 190283 - DNA, 20 bp, Artificial
  CRISPR gRNA sequence
agggtcagggctgaggcctg

SEQ ID NO: 190284 - DNA, 20 bp, Artificial
  CRISPR gRNA sequence
gggtcagggctgaggcctgg

SEQ ID NO: 190285 - DNA, 20 bp, Artificial
  CRISPR gRNA sequence
cagggctgaggcctgggggt

SEQ ID NO: 190286 - DNA, 20 bp, Artificial
  CRISPR gRNA sequence
agggctgaggcctgggggtc

SEQ ID NO: 190287 - DNA, 20 bp, Artificial
  CRISPR gRNA sequence
gggctgaggcctgggggtca

SEQ ID NO: 190288 - DNA, 20 bp, Artificial
  CRISPR gRNA sequence
cttacgttcccctcttttcc

SEQ ID NO: 190289 - DNA, 20 bp, Artificial
  CRISPR gRNA sequence
tacgttcccctcttttccca

SEQ ID NO: 190290 - DNA, 20 bp, Artificial
  CRISPR gRNA sequence
ttcccctcttttcccagagc

SEQ ID NO: 190291 - DNA, 20 bp, Artificial
  CRISPR gRNA sequence
ttttcccagagccggcttcc

SEQ ID NO: 190292 - DNA, 20 bp, Artificial
  CRISPR gRNA sequence
ccagcccaccatccccatcg

SEQ ID NO: 190293 - DNA, 20 bp, Artificial
  CRISPR gRNA sequence
cagcccaccatccccatcgt

SEQ ID NO: 190294 - DNA, 20 bp, Artificial
  CRISPR gRNA sequence
cccatcgtgggcatcattgc

SEQ ID NO: 190295 - DNA, 20 bp, Artificial
  CRISPR gRNA sequence
cgtgggcatcattgctggcc

SEQ ID NO: 190296 - DNA, 20 bp, Artificial
  CRISPR gRNA sequence
attgctggcctggttctcct

SEQ ID NO: 190297 - DNA, 20 bp, Artificial
  CRISPR gRNA sequence
cctggttctccttggatctg

SEQ ID NO: 190298 - DNA, 20 bp, Artificial
  CRISPR gRNA sequence
ctccttggatctgtggtctc

SEQ ID NO: 190299 - DNA, 20 bp, Artificial
  CRISPR gRNA sequence
ccttggatctgtggtctctg

SEQ ID NO: 190300 - DNA, 20 bp, Artificial
  CRISPR gRNA sequence
atctgtggtctctggagctg

SEQ ID NO: 190301 - DNA, 20 bp, Artificial
  CRISPR gRNA sequence
ctgtggttgctgctgtgata

SEQ ID NO: 190302 - DNA, 20 bp, Artificial
  CRISPR gRNA sequence
gtggttgctgctgtgatatg

SEQ ID NO: 190303 - DNA, 20 bp, Artificial
  CRISPR gRNA sequence
tggttgctgctgtgatatgg

SEQ ID NO: 190304 - DNA, 20 bp, Artificial
  CRISPR gRNA sequence
ttgctgctgtgatatggagg

SEQ ID NO: 190305 - DNA, 20 bp, Artificial
  CRISPR gRNA sequence
ctgctgtgatatggaggaag

SEQ ID NO: 190306 - DNA, 20 bp, Artificial
  CRISPR gRNA sequence
gctgtgatatggaggaagaa

SEQ ID NO: 190307 - DNA, 20 bp, Artificial
  CRISPR gRNA sequence
gatatggaggaagaagagct

SEQ ID NO: 190308 - DNA, 20 bp, Artificial
  CRISPR gRNA sequence
atatggaggaagaagagctc

SEQ ID NO: 190309 - DNA, 20 bp, Artificial
  CRISPR gRNA sequence
tggaggaagaagagctcagg

SEQ ID NO: 190310 - DNA, 20 bp, Artificial
  CRISPR gRNA sequence
ggaggaagaagagctcaggt

SEQ ID NO: 190311 - DNA, 20 bp, Artificial
  CRISPR gRNA sequence
gaggaagaagagctcaggtg

SEQ ID NO: 190312 - DNA, 20 bp, Artificial
  CRISPR gRNA sequence
gaagaagagctcaggtgggg

SEQ ID NO: 190313 - DNA, 20 bp, Artificial
  CRISPR gRNA sequence
aagaagagctcaggtgggga

SEQ ID NO: 190314 - DNA, 20 bp, Artificial
  CRISPR gRNA sequence
agaagagctcaggtggggaa

SEQ ID NO: 190315 - DNA, 20 bp, Artificial
  CRISPR gRNA sequence
aagagctcaggtggggaagg

SEQ ID NO: 190316 - DNA, 20 bp, Artificial
  CRISPR gRNA sequence
agctcaggtggggaagggag

SEQ ID NO: 190317 - DNA, 20 bp, Artificial
  CRISPR gRNA sequence
gctcaggtggggaagggaga

SEQ ID NO: 190318 - DNA, 20 bp, Artificial
  CRISPR gRNA sequence
ctcaggtggggaagggagaa

SEQ ID NO: 190319 - DNA, 20 bp, Artificial
  CRISPR gRNA sequence
aggtggggaagggagaaggg

SEQ ID NO: 190320 - DNA, 20 bp, Artificial
  CRISPR gRNA sequence
ggtggggaagggagaagggt

SEQ ID NO: 190321 - DNA, 20 bp, Artificial
  CRISPR gRNA sequence
gtggggaagggagaagggtg

SEQ ID NO: 190322 - DNA, 20 bp, Artificial
  CRISPR gRNA sequence
aagggagaagggtggggtct

SEQ ID NO: 190323 - DNA, 20 bp, Artificial
  CRISPR gRNA sequence
tctgagttttcttgtcccac

SEQ ID NO: 190324 - DNA, 20 bp, Artificial
  CRISPR gRNA sequence
ctgagttttcttgtcccact

SEQ ID NO: 190325 - DNA, 20 bp, Artificial
  CRISPR gRNA sequence
cttgtcccactgggtgtttc

SEQ ID NO: 190326 - DNA, 20 bp, Artificial
  CRISPR gRNA sequence
ccactgggtgtttcaagccc

SEQ ID NO: 190327 - DNA, 20 bp, Artificial
  CRISPR gRNA sequence
cactgggtgtttcaagccct

SEQ ID NO: 190328 - DNA, 20 bp, Artificial
  CRISPR gRNA sequence
gtgtttcaagccctaggtaa

SEQ ID NO: 190329 - DNA, 20 bp, Artificial
  CRISPR gRNA sequence
agtgtgtcctgcctcgttac

SEQ ID NO: 190330 - DNA, 20 bp, Artificial
  CRISPR gRNA sequence
gtgtgtcctgcctcgttact

SEQ ID NO: 190331 - DNA, 20 bp, Artificial
  CRISPR gRNA sequence
tgtcctgcctcgttactggg

SEQ ID NO: 190332 - DNA, 20 bp, Artificial
  CRISPR gRNA sequence
gaagcaccatccacacacac

SEQ ID NO: 190333 - DNA, 20 bp, Artificial
  CRISPR gRNA sequence
tccacacacacgagcctacc

SEQ ID NO: 190334 - DNA, 20 bp, Artificial
  CRISPR gRNA sequence
acacacgagcctacccagcc

SEQ ID NO: 190335 - DNA, 20 bp, Artificial
  CRISPR gRNA sequence
cacacgagcctacccagcct

SEQ ID NO: 190336 - DNA, 20 bp, Artificial
  CRISPR gRNA sequence
acacgagcctacccagcctg

SEQ ID NO: 190337 - DNA, 20 bp, Artificial
  CRISPR gRNA sequence
cagcctggggccctgtgtgc

SEQ ID NO: 190338 - DNA, 20 bp, Artificial
  CRISPR gRNA sequence
agcacctactcttttttttt

SEQ ID NO: 190339 - DNA, 20 bp, Artificial
  CRISPR gRNA sequence
cctactctttttttttgaga

SEQ ID NO: 190340 - DNA, 20 bp, Artificial
  CRISPR gRNA sequence
tactctttttttttgagacg

SEQ ID NO: 190341 - DNA, 20 bp, Artificial
  CRISPR gRNA sequence
ttttttttgagacggagtct

SEQ ID NO: 190342 - DNA, 20 bp, Artificial
  CRISPR gRNA sequence
ggagtcttggctctgtcacc

SEQ ID NO: 190343 - DNA, 20 bp, Artificial
  CRISPR gRNA sequence
gagtcttggctctgtcaccc

SEQ ID NO: 190344 - DNA, 20 bp, Artificial
  CRISPR gRNA sequence
cttggctctgtcacccaggc

SEQ ID NO: 190345 - DNA, 20 bp, Artificial
  CRISPR gRNA sequence
tggctctgtcacccaggctg

SEQ ID NO: 190346 - DNA, 20 bp, Artificial
  CRISPR gRNA sequence
tcacccaggctggagtgcaa

SEQ ID NO: 190347 - DNA, 20 bp, Artificial
  CRISPR gRNA sequence
caggctggagtgcaatggcg

SEQ ID NO: 190348 - DNA, 20 bp, Artificial
  CRISPR gRNA sequence
ggagtgcaatggcgtggttt

SEQ ID NO: 190349 - DNA, 20 bp, Artificial
  CRISPR gRNA sequence
tcactgcaacctccgcctcc

SEQ ID NO: 190350 - DNA, 20 bp, Artificial
  CRISPR gRNA sequence
cactgcaacctccgcctccc

SEQ ID NO: 190351 - DNA, 20 bp, Artificial
  CRISPR gRNA sequence
aacctccgcctcccaggttc

SEQ ID NO: 190352 - DNA, 20 bp, Artificial
  CRISPR gRNA sequence
ttcaagcaattctcctgcct

SEQ ID NO: 190353 - DNA, 20 bp, Artificial
  CRISPR gRNA sequence
ttctcctgcctcagcctccc

SEQ ID NO: 190354 - DNA, 20 bp, Artificial
  CRISPR gRNA sequence
tcctgcctcagcctccctag

SEQ ID NO: 190355 - DNA, 20 bp, Artificial
  CRISPR gRNA sequence
gcctcagcctccctagtagc

SEQ ID NO: 190356 - DNA, 20 bp, Artificial
  CRISPR gRNA sequence
cctcagcctccctagtagct

SEQ ID NO: 190357 - DNA, 20 bp, Artificial
  CRISPR gRNA sequence
cacatgcgtgccaccacacc

SEQ ID NO: 190358 - DNA, 20 bp, Artificial
  CRISPR gRNA sequence
aatttttttttttgtatttt

SEQ ID NO: 190359 - DNA, 20 bp, Artificial
  CRISPR gRNA sequence
ttttttttttgtatttttag

SEQ ID NO: 190360 - DNA, 20 bp, Artificial
  CRISPR gRNA sequence
ttttttttgtatttttagtg

SEQ ID NO: 190361 - DNA, 20 bp, Artificial
  CRISPR gRNA sequence
ttttgtatttttagtggaga

SEQ ID NO: 190362 - DNA, 20 bp, Artificial
  CRISPR gRNA sequence
tttgtatttttagtggagat

SEQ ID NO: 190363 - DNA, 20 bp, Artificial
  CRISPR gRNA sequence
ttgtatttttagtggagatg

SEQ ID NO: 190364 - DNA, 20 bp, Artificial
  CRISPR gRNA sequence
gagatggggtttcactatgt

SEQ ID NO: 190365 - DNA, 20 bp, Artificial
  CRISPR gRNA sequence
tggggtttcactatgttggc

SEQ ID NO: 190366 - DNA, 20 bp, Artificial
  CRISPR gRNA sequence
ggggtttcactatgttggcc

SEQ ID NO: 190367 - DNA, 20 bp, Artificial
  CRISPR gRNA sequence
tttcactatgttggccaggc

SEQ ID NO: 190368 - DNA, 20 bp, Artificial
  CRISPR gRNA sequence
actttgtgatctgcctgcct

SEQ ID NO: 190369 - DNA, 20 bp, Artificial
  CRISPR gRNA sequence
ctgcctgcctcggcctccca

SEQ ID NO: 190370 - DNA, 20 bp, Artificial
  CRISPR gRNA sequence
gcctcggcctcccaaagtgc

SEQ ID NO: 190371 - DNA, 20 bp, Artificial
  CRISPR gRNA sequence
cctcggcctcccaaagtgct

SEQ ID NO: 190372 - DNA, 20 bp, Artificial
  CRISPR gRNA sequence
ctcccaaagtgctgggatta

SEQ ID NO: 190373 - DNA, 20 bp, Artificial
  CRISPR gRNA sequence
agtgctgggattacagtcgt

SEQ ID NO: 190374 - DNA, 20 bp, Artificial
  CRISPR gRNA sequence
cagtcgtgagccaccgcacc

SEQ ID NO: 190375 - DNA, 20 bp, Artificial
  CRISPR gRNA sequence
gccgcacctactcttttgta

SEQ ID NO: 190376 - DNA, 20 bp, Artificial
  CRISPR gRNA sequence
gtaaagcacctgtgacaatg

SEQ ID NO: 190377 - DNA, 20 bp, Artificial
  CRISPR gRNA sequence
taaagcacctgtgacaatga

SEQ ID NO: 190378 - DNA, 20 bp, Artificial
  CRISPR gRNA sequence
gcacctgtgacaatgaagga

SEQ ID NO: 190379 - DNA, 20 bp, Artificial
  CRISPR gRNA sequence
atttatcaccttgacgattg

SEQ ID NO: 190380 - DNA, 20 bp, Artificial
  CRISPR gRNA sequence
caccttgacgattgtggtga

SEQ ID NO: 190381 - DNA, 20 bp, Artificial
  CRISPR gRNA sequence
accttgacgattgtggtgat

SEQ ID NO: 190382 - DNA, 20 bp, Artificial
  CRISPR gRNA sequence
ccttgacgattgtggtgatg

SEQ ID NO: 190383 - DNA, 20 bp, Artificial
  CRISPR gRNA sequence
tggtgatggggacctgatcc

SEQ ID NO: 190384 - DNA, 20 bp, Artificial
  CRISPR gRNA sequence
tgatggggacctgatcccag

SEQ ID NO: 190385 - DNA, 20 bp, Artificial
  CRISPR gRNA sequence
ggacctgatcccagcagtca

SEQ ID NO: 190386 - DNA, 20 bp, Artificial
  CRISPR gRNA sequence
gacctgatcccagcagtcac

SEQ ID NO: 190387 - DNA, 20 bp, Artificial
  CRISPR gRNA sequence
atcccagcagtcacaggtca

SEQ ID NO: 190388 - DNA, 20 bp, Artificial
  CRISPR gRNA sequence
tcccagcagtcacaggtcac

SEQ ID NO: 190389 - DNA, 20 bp, Artificial
  CRISPR gRNA sequence
cccagcagtcacaggtcaca

SEQ ID NO: 190390 - DNA, 20 bp, Artificial
  CRISPR gRNA sequence
ccagcagtcacaggtcacag

SEQ ID NO: 190391 - DNA, 20 bp, Artificial
  CRISPR gRNA sequence
gcagtcacaggtcacagggg

SEQ ID NO: 190392 - DNA, 20 bp, Artificial
  CRISPR gRNA sequence
cagtcacaggtcacagggga

SEQ ID NO: 190393 - DNA, 20 bp, Artificial
  CRISPR gRNA sequence
acaggggaaggtccctgctg

SEQ ID NO: 190394 - DNA, 20 bp, Artificial
  CRISPR gRNA sequence
gggaaggtccctgctgaaga

SEQ ID NO: 190395 - DNA, 20 bp, Artificial
  CRISPR gRNA sequence
tccctgctgaagacagacct

SEQ ID NO: 190396 - DNA, 20 bp, Artificial
  CRISPR gRNA sequence
ctgctgaagacagacctcag

SEQ ID NO: 190397 - DNA, 20 bp, Artificial
  CRISPR gRNA sequence
tgctgaagacagacctcaga

SEQ ID NO: 190398 - DNA, 20 bp, Artificial
  CRISPR gRNA sequence
gctgaagacagacctcagaa

SEQ ID NO: 190399 - DNA, 20 bp, Artificial
  CRISPR gRNA sequence
gaagacagacctcagaaggg

SEQ ID NO: 190400 - DNA, 20 bp, Artificial
  CRISPR gRNA sequence
cctcagaagggcagttgatc

SEQ ID NO: 190401 - DNA, 20 bp, Artificial
  CRISPR gRNA sequence
ctcagaagggcagttgatcc

SEQ ID NO: 190402 - DNA, 20 bp, Artificial
  CRISPR gRNA sequence
cacgtttcctgatcctgccc

SEQ ID NO: 190403 - DNA, 20 bp, Artificial
  CRISPR gRNA sequence
acgtttcctgatcctgccct

SEQ ID NO: 190404 - DNA, 20 bp, Artificial
  CRISPR gRNA sequence
ctgatcctgccctgggtctg

SEQ ID NO: 190405 - DNA, 20 bp, Artificial
  CRISPR gRNA sequence
ctgccctgggtctgcagtca

SEQ ID NO: 190406 - DNA, 20 bp, Artificial
  CRISPR gRNA sequence
ctgggtctgcagtcacagtt

SEQ ID NO: 190407 - DNA, 20 bp, Artificial
  CRISPR gRNA sequence
tgggtctgcagtcacagttc

SEQ ID NO: 190408 - DNA, 20 bp, Artificial
  CRISPR gRNA sequence
cacagttcaggaaacttctc

SEQ ID NO: 190409 - DNA, 20 bp, Artificial
  CRISPR gRNA sequence
acagttcaggaaacttctct

SEQ ID NO: 190410 - DNA, 20 bp, Artificial
  CRISPR gRNA sequence
acttctctgggatccaaaac

SEQ ID NO: 190411 - DNA, 20 bp, Artificial
  CRISPR gRNA sequence
cttctctgggatccaaaact

SEQ ID NO: 190412 - DNA, 20 bp, Artificial
  CRISPR gRNA sequence
tctctgggatccaaaactag

SEQ ID NO: 190413 - DNA, 20 bp, Artificial
  CRISPR gRNA sequence
ctctgggatccaaaactagg

SEQ ID NO: 190414 - DNA, 20 bp, Artificial
  CRISPR gRNA sequence
ccaaaactaggaggttcctc

SEQ ID NO: 190415 - DNA, 20 bp, Artificial
  CRISPR gRNA sequence
caaaactaggaggttcctct

SEQ ID NO: 190416 - DNA, 20 bp, Artificial
  CRISPR gRNA sequence
gaggttcctctaggacctta

SEQ ID NO: 190417 - DNA, 20 bp, Artificial
  CRISPR gRNA sequence
ttatggccctgcctcctccc

SEQ ID NO: 190418 - DNA, 20 bp, Artificial
  CRISPR gRNA sequence
gcctcctccctggcccctca

SEQ ID NO: 190419 - DNA, 20 bp, Artificial
  CRISPR gRNA sequence
cctcctccctggcccctcac

SEQ ID NO: 190420 - DNA, 20 bp, Artificial
  CRISPR gRNA sequence
cacaggacattttcttccaa

SEQ ID NO: 190421 - DNA, 20 bp, Artificial
  CRISPR gRNA sequence
acaggacattttcttccaac

SEQ ID NO: 190422 - DNA, 20 bp, Artificial
  CRISPR gRNA sequence
ggacattttcttccaacagg

SEQ ID NO: 190423 - DNA, 20 bp, Artificial
  CRISPR gRNA sequence
ttttcttccaacaggtggaa

SEQ ID NO: 190424 - DNA, 20 bp, Artificial
  CRISPR gRNA sequence
tttcttccaacaggtggaaa

SEQ ID NO: 190425 - DNA, 20 bp, Artificial
  CRISPR gRNA sequence
tcttccaacaggtggaaaag

SEQ ID NO: 190426 - DNA, 20 bp, Artificial
  CRISPR gRNA sequence
cttccaacaggtggaaaagg

SEQ ID NO: 190427 - DNA, 20 bp, Artificial
  CRISPR gRNA sequence
ttccaacaggtggaaaagga

SEQ ID NO: 190428 - DNA, 20 bp, Artificial
  CRISPR gRNA sequence
ccaacaggtggaaaaggagg

SEQ ID NO: 190429 - DNA, 20 bp, Artificial
  CRISPR gRNA sequence
gaaaaggagggagctactct

SEQ ID NO: 190430 - DNA, 20 bp, Artificial
  CRISPR gRNA sequence
aaaaggagggagctactcta

SEQ ID NO: 190431 - DNA, 20 bp, Artificial
  CRISPR gRNA sequence
gagggagctactctaaggct

SEQ ID NO: 190432 - DNA, 20 bp, Artificial
  CRISPR gRNA sequence
gctactctaaggctgagtgt

SEQ ID NO: 190433 - DNA, 20 bp, Artificial
  CRISPR gRNA sequence
tctaaggctgagtgtaagtg

SEQ ID NO: 190434 - DNA, 20 bp, Artificial
  CRISPR gRNA sequence
ctaaggctgagtgtaagtgc

SEQ ID NO: 190435 - DNA, 20 bp, Artificial
  CRISPR gRNA sequence
taaggctgagtgtaagtgcg

SEQ ID NO: 190436 - DNA, 20 bp, Artificial
  CRISPR gRNA sequence
ggctgagtgtaagtgcgggg

SEQ ID NO: 190437 - DNA, 20 bp, Artificial
  CRISPR gRNA sequence
gctgagtgtaagtgcggggc

SEQ ID NO: 190438 - DNA, 20 bp, Artificial
  CRISPR gRNA sequence
tgagtgtaagtgcggggcgg

SEQ ID NO: 190439 - DNA, 20 bp, Artificial
  CRISPR gRNA sequence
gtaagtgcggggcgggagcg

SEQ ID NO: 190440 - DNA, 20 bp, Artificial
  CRISPR gRNA sequence
aagtgcggggcgggagcgtg

SEQ ID NO: 190441 - DNA, 20 bp, Artificial
  CRISPR gRNA sequence
agtgcggggcgggagcgtgg

SEQ ID NO: 190442 - DNA, 20 bp, Artificial
  CRISPR gRNA sequence
tgcggggcgggagcgtggag

SEQ ID NO: 190443 - DNA, 20 bp, Artificial
  CRISPR gRNA sequence
ctcctgcaccacatctcctg

SEQ ID NO: 190444 - DNA, 20 bp, Artificial
  CRISPR gRNA sequence
tcctgcaccacatctcctgt

SEQ ID NO: 190445 - DNA, 20 bp, Artificial
  CRISPR gRNA sequence
catctcctgtgggctctgac

SEQ ID NO: 190446 - DNA, 20 bp, Artificial
  CRISPR gRNA sequence
atctcctgtgggctctgacc

SEQ ID NO: 190447 - DNA, 20 bp, Artificial
  CRISPR gRNA sequence
gtcttgtttttgttctaccc

SEQ ID NO: 190448 - DNA, 20 bp, Artificial
  CRISPR gRNA sequence
tcttgtttttgttctacccc

SEQ ID NO: 190449 - DNA, 20 bp, Artificial
  CRISPR gRNA sequence
cttgtttttgttctacccca

SEQ ID NO: 190450 - DNA, 20 bp, Artificial
  CRISPR gRNA sequence
tgtttttgttctaccccagg

SEQ ID NO: 190451 - DNA, 20 bp, Artificial
  CRISPR gRNA sequence
tgttctaccccagggagcga

SEQ ID NO: 190452 - DNA, 20 bp, Artificial
  CRISPR gRNA sequence
ccccagggagcgacagtgcc

SEQ ID NO: 190453 - DNA, 20 bp, Artificial
  CRISPR gRNA sequence
cccagggagcgacagtgccc

SEQ ID NO: 190454 - DNA, 20 bp, Artificial
  CRISPR gRNA sequence
ccagggagcgacagtgccca

SEQ ID NO: 190455 - DNA, 20 bp, Artificial
  CRISPR gRNA sequence
cagggagcgacagtgcccag

SEQ ID NO: 190456 - DNA, 20 bp, Artificial
  CRISPR gRNA sequence
gcgacagtgcccaggggtct

SEQ ID NO: 190457 - DNA, 20 bp, Artificial
  CRISPR gRNA sequence
gcccaggggtctgagtctca

SEQ ID NO: 190458 - DNA, 20 bp, Artificial
  CRISPR gRNA sequence
tctgagtctcacagcttgta

SEQ ID NO: 190459 - DNA, 20 bp, Artificial
  CRISPR gRNA sequence
ctgagtctcacagcttgtaa

SEQ ID NO: 190460 - DNA, 20 bp, Artificial
  CRISPR gRNA sequence
gtctcacagcttgtaaaggt

SEQ ID NO: 190461 - DNA, 20 bp, Artificial
  CRISPR gRNA sequence
agcttgtaaaggtgagattc

SEQ ID NO: 190462 - DNA, 20 bp, Artificial
  CRISPR gRNA sequence
gcttgtaaaggtgagattct

SEQ ID NO: 190463 - DNA, 20 bp, Artificial
  CRISPR gRNA sequence
cttgtaaaggtgagattctg

SEQ ID NO: 190464 - DNA, 20 bp, Artificial
  CRISPR gRNA sequence
ttgtaaaggtgagattctgg

SEQ ID NO: 190465 - DNA, 20 bp, Artificial
  CRISPR gRNA sequence
ggtgagattctgggggtctg

SEQ ID NO: 190466 - DNA, 20 bp, Artificial
  CRISPR gRNA sequence
gagattctgggggtctgaag

SEQ ID NO: 190467 - DNA, 20 bp, Artificial
  CRISPR gRNA sequence
agattctgggggtctgaagt

SEQ ID NO: 190468 - DNA, 20 bp, Artificial
  CRISPR gRNA sequence
ttctgggggtctgaagtggg

SEQ ID NO: 190469 - DNA, 20 bp, Artificial
  CRISPR gRNA sequence
ctgggggtctgaagtgggtg

SEQ ID NO: 190470 - DNA, 20 bp, Artificial
  CRISPR gRNA sequence
tgggggtctgaagtgggtgg

SEQ ID NO: 190471 - DNA, 20 bp, Artificial
  CRISPR gRNA sequence
gggggtctgaagtgggtgga

SEQ ID NO: 190472 - DNA, 20 bp, Artificial
  CRISPR gRNA sequence
ggtctgaagtgggtggaggg

SEQ ID NO: 190473 - DNA, 20 bp, Artificial
  CRISPR gRNA sequence
gtctgaagtgggtggagggt

SEQ ID NO: 190474 - DNA, 20 bp, Artificial
  CRISPR gRNA sequence
tctgaagtgggtggagggtg

SEQ ID NO: 190475 - DNA, 20 bp, Artificial
  CRISPR gRNA sequence
gaagtgggtggagggtgggg

SEQ ID NO: 190476 - DNA, 20 bp, Artificial
  CRISPR gRNA sequence
agtgggtggagggtggggca

SEQ ID NO: 190477 - DNA, 20 bp, Artificial
  CRISPR gRNA sequence
gtgggtggagggtggggcag

SEQ ID NO: 190478 - DNA, 20 bp, Artificial
  CRISPR gRNA sequence
tgggtggagggtggggcaga

SEQ ID NO: 190479 - DNA, 20 bp, Artificial
  CRISPR gRNA sequence
gggtggagggtggggcagag

SEQ ID NO: 190480 - DNA, 20 bp, Artificial
  CRISPR gRNA sequence
ggagggtggggcagagggga

SEQ ID NO: 190481 - DNA, 20 bp, Artificial
  CRISPR gRNA sequence
gagggtggggcagaggggac

SEQ ID NO: 190482 - DNA, 20 bp, Artificial
  CRISPR gRNA sequence
tggggcagaggggacaggac

SEQ ID NO: 190483 - DNA, 20 bp, Artificial
  CRISPR gRNA sequence
ggggcagaggggacaggact

SEQ ID NO: 190484 - DNA, 20 bp, Artificial
  CRISPR gRNA sequence
gaggggacaggactgggttg

SEQ ID NO: 190485 - DNA, 20 bp, Artificial
  CRISPR gRNA sequence
aggggacaggactgggttgt

SEQ ID NO: 190486 - DNA, 20 bp, Artificial
  CRISPR gRNA sequence
ggggacaggactgggttgtg

SEQ ID NO: 190487 - DNA, 20 bp, Artificial
  CRISPR gRNA sequence
gttgtggggattttttgatt

SEQ ID NO: 190488 - DNA, 20 bp, Artificial
  CRISPR gRNA sequence
ttttttgattcagaattttt

SEQ ID NO: 190489 - DNA, 20 bp, Artificial
  CRISPR gRNA sequence
attcagaatttttgagtgtg

SEQ ID NO: 190490 - DNA, 20 bp, Artificial
  CRISPR gRNA sequence
cagaatttttgagtgtgtgg

SEQ ID NO: 190491 - DNA, 20 bp, Artificial
  CRISPR gRNA sequence
agaatttttgagtgtgtggt

SEQ ID NO: 190492 - DNA, 20 bp, Artificial
  CRISPR gRNA sequence
tgagtgtgtggtgggctgtt

SEQ ID NO: 190493 - DNA, 20 bp, Artificial
  CRISPR gRNA sequence
agtgtgtggtgggctgttca

SEQ ID NO: 190494 - DNA, 20 bp, Artificial
  CRISPR gRNA sequence
ttcatgactattttcttctg

SEQ ID NO: 190495 - DNA, 20 bp, Artificial
  CRISPR gRNA sequence
actattttcttctgtagcct

SEQ ID NO: 190496 - DNA, 20 bp, Artificial
  CRISPR gRNA sequence
ttttcttctgtagcctgaga

SEQ ID NO: 190497 - DNA, 20 bp, Artificial
  CRISPR gRNA sequence
cagctgccttgtgtgcgact

SEQ ID NO: 190498 - DNA, 20 bp, Artificial
  CRISPR gRNA sequence
ttgtgtgcgactgagatgca

SEQ ID NO: 190499 - DNA, 20 bp, Artificial
  CRISPR gRNA sequence
cagctgccttgtgtgcgact

SEQ ID NO: 190500 - DNA, 20 bp, Artificial
  CRISPR gRNA sequence
ccttgtgtgcgactgagatg

SEQ ID NO: 190501 - DNA, 20 bp, Artificial
  CRISPR gRNA sequence
cttgtgtgcgactgagatgc

SEQ ID NO: 190502 - DNA, 20 bp, Artificial
  CRISPR gRNA sequence
cacgcctcccctatgtgtct

SEQ ID NO: 190503 - DNA, 20 bp, Artificial
  CRISPR gRNA sequence
acgcctcccctatgtgtctt

SEQ ID NO: 190504 - DNA, 20 bp, Artificial
  CRISPR gRNA sequence
cgcctcccctatgtgtctta

SEQ ID NO: 190505 - DNA, 20 bp, Artificial
  CRISPR gRNA sequence
gcctcccctatgtgtcttag

SEQ ID NO: 190506 - DNA, 20 bp, Artificial
  CRISPR gRNA sequence
ctatgtgtcttaggggactc

SEQ ID NO: 190507 - DNA, 20 bp, Artificial
  CRISPR gRNA sequence
actctggcttctctttttgc

SEQ ID NO: 190508 - DNA, 20 bp, Artificial
  CRISPR gRNA sequence
ctctggcttctctttttgca

SEQ ID NO: 190509 - DNA, 20 bp, Artificial
  CRISPR gRNA sequence
tctggcttctctttttgcaa

SEQ ID NO: 190510 - DNA, 20 bp, Artificial
  CRISPR gRNA sequence
gaatctgtctgtgtccctgt

SEQ ID NO: 190511 - DNA, 20 bp, Artificial
  CRISPR gRNA sequence
tgtccctgttagcacaatgt

SEQ ID NO: 190512 - DNA, 20 bp, Artificial
  CRISPR gRNA sequence
gtccctgttagcacaatgtg

SEQ ID NO: 190513 - DNA, 20 bp, Artificial
  CRISPR gRNA sequence
ccctgttagcacaatgtgag

SEQ ID NO: 190514 - DNA, 20 bp, Artificial
  CRISPR gRNA sequence
cctgttagcacaatgtgagg

SEQ ID NO: 190515 - DNA, 20 bp, Artificial
  CRISPR gRNA sequence
gttagcacaatgtgaggagg

SEQ ID NO: 190516 - DNA, 20 bp, Artificial
  CRISPR gRNA sequence
tagcacaatgtgaggaggta

SEQ ID NO: 190517 - DNA, 20 bp, Artificial
  CRISPR gRNA sequence
aatgtgaggaggtagagaaa

SEQ ID NO: 190518 - DNA, 20 bp, Artificial
  CRISPR gRNA sequence
ttctcttttctattaaaaat

SEQ ID NO: 190519 - DNA, 20 bp, Artificial
  CRISPR gRNA sequence
ttctattaaaaataagaacc

SEQ ID NO: 190520 - DNA, 20 bp, Artificial
  CRISPR gRNA sequence
tctattaaaaataagaacct

SEQ ID NO: 190521 - DNA, 20 bp, Artificial
  CRISPR gRNA sequence
attaaaaataagaacctggg

SEQ ID NO: 190522 - DNA, 20 bp, Artificial
  CRISPR gRNA sequence
taaaaataagaacctgggca

SEQ ID NO: 190523 - DNA, 20 bp, Artificial
  CRISPR gRNA sequence
ataagaacctgggcagagtg

SEQ ID NO: 190524 - DNA, 20 bp, Artificial
  CRISPR gRNA sequence
agaacctgggcagagtgcgg

SEQ ID NO: 190525 - DNA, 20 bp, Artificial
  CRISPR gRNA sequence
gcagctcatgcctgtaatcc

SEQ ID NO: 190526 - DNA, 20 bp, Artificial
  CRISPR gRNA sequence
atgcctgtaatcccagcact

SEQ ID NO: 190527 - DNA, 20 bp, Artificial
  CRISPR gRNA sequence
tgcctgtaatcccagcactt

SEQ ID NO: 190528 - DNA, 20 bp, Artificial
  CRISPR gRNA sequence
gcctgtaatcccagcactta

SEQ ID NO: 190529 - DNA, 20 bp, Artificial
  CRISPR gRNA sequence
ctgtaatcccagcacttagg

SEQ ID NO: 190530 - DNA, 20 bp, Artificial
  CRISPR gRNA sequence
tgtaatcccagcacttaggg

SEQ ID NO: 190531 - DNA, 20 bp, Artificial
  CRISPR gRNA sequence
tcccagcacttagggaggcc

SEQ ID NO: 190532 - DNA, 20 bp, Artificial
  CRISPR gRNA sequence
cccagcacttagggaggccg

SEQ ID NO: 190533 - DNA, 20 bp, Artificial
  CRISPR gRNA sequence
cagcacttagggaggccgag

SEQ ID NO: 190534 - DNA, 20 bp, Artificial
  CRISPR gRNA sequence
agcacttagggaggccgagg

SEQ ID NO: 190535 - DNA, 20 bp, Artificial
  CRISPR gRNA sequence
gcacttagggaggccgagga

SEQ ID NO: 190536 - DNA, 20 bp, Artificial
  CRISPR gRNA sequence
cttagggaggccgaggaggg

SEQ ID NO: 190537 - DNA, 20 bp, Artificial
  CRISPR gRNA sequence
ggccgaggagggcagatcac

SEQ ID NO: 190538 - DNA, 20 bp, Artificial
  CRISPR gRNA sequence
gccgaggagggcagatcacg

SEQ ID NO: 190539 - DNA, 20 bp, Artificial
  CRISPR gRNA sequence
aggagggcagatcacgaggt

SEQ ID NO: 190540 - DNA, 20 bp, Artificial
  CRISPR gRNA sequence
ggagggcagatcacgaggtc

SEQ ID NO: 190541 - DNA, 20 bp, Artificial
  CRISPR gRNA sequence
agggcagatcacgaggtcag

SEQ ID NO: 190542 - DNA, 20 bp, Artificial
  CRISPR gRNA sequence
tcaggagatcgaaaccatcc

SEQ ID NO: 190543 - DNA, 20 bp, Artificial
  CRISPR gRNA sequence
cgaaaccatcctggctaaca

SEQ ID NO: 190544 - DNA, 20 bp, Artificial
  CRISPR gRNA sequence
tactaaaaaatacaaaaaat

SEQ ID NO: 190545 - DNA, 20 bp, Artificial
  CRISPR gRNA sequence
aaaaaatacaaaaaattagc

SEQ ID NO: 190546 - DNA, 20 bp, Artificial
  CRISPR gRNA sequence
aaaaatacaaaaaattagct

SEQ ID NO: 190547 - DNA, 20 bp, Artificial
  CRISPR gRNA sequence
tacaaaaaattagctgggcg

SEQ ID NO: 190548 - DNA, 20 bp, Artificial
  CRISPR gRNA sequence
caaaaaattagctgggcgca

SEQ ID NO: 190549 - DNA, 20 bp, Artificial
  CRISPR gRNA sequence
aaaaaattagctgggcgcag

SEQ ID NO: 190550 - DNA, 20 bp, Artificial
  CRISPR gRNA sequence
attagctgggcgcagaggca

SEQ ID NO: 190551 - DNA, 20 bp, Artificial
  CRISPR gRNA sequence
ttagctgggcgcagaggcac

SEQ ID NO: 190552 - DNA, 20 bp, Artificial
  CRISPR gRNA sequence
ggcgcagaggcacgggcctg

SEQ ID NO: 190553 - DNA, 20 bp, Artificial
  CRISPR gRNA sequence
gaggcacgggcctgtagtcc

SEQ ID NO: 190554 - DNA, 20 bp, Artificial
  CRISPR gRNA sequence
ggcctgtagtcccagctact

SEQ ID NO: 190555 - DNA, 20 bp, Artificial
  CRISPR gRNA sequence
gcctgtagtcccagctactc

SEQ ID NO: 190556 - DNA, 20 bp, Artificial
  CRISPR gRNA sequence
ctgtagtcccagctactcag

SEQ ID NO: 190557 - DNA, 20 bp, Artificial
  CRISPR gRNA sequence
tgtagtcccagctactcagg

SEQ ID NO: 190558 - DNA, 20 bp, Artificial
  CRISPR gRNA sequence
agtcccagctactcaggagg

SEQ ID NO: 190559 - DNA, 20 bp, Artificial
  CRISPR gRNA sequence
tcccagctactcaggaggcg

SEQ ID NO: 190560 - DNA, 20 bp, Artificial
  CRISPR gRNA sequence
cccagctactcaggaggcgg

SEQ ID NO: 190561 - DNA, 20 bp, Artificial
  CRISPR gRNA sequence
agctactcaggaggcggagg

SEQ ID NO: 190562 - DNA, 20 bp, Artificial
  CRISPR gRNA sequence
gctactcaggaggcggaggc

SEQ ID NO: 190563 - DNA, 20 bp, Artificial
  CRISPR gRNA sequence
tactcaggaggcggaggcag

SEQ ID NO: 190564 - DNA, 20 bp, Artificial
  CRISPR gRNA sequence
aggaggcggaggcaggagaa

SEQ ID NO: 190565 - DNA, 20 bp, Artificial
  CRISPR gRNA sequence
gcaggagaatggcgtcaacc

SEQ ID NO: 190566 - DNA, 20 bp, Artificial
  CRISPR gRNA sequence
caggagaatggcgtcaaccc

SEQ ID NO: 190567 - DNA, 20 bp, Artificial
  CRISPR gRNA sequence
ggagaatggcgtcaacccgg

SEQ ID NO: 190568 - DNA, 20 bp, Artificial
  CRISPR gRNA sequence
gagaatggcgtcaacccggg

SEQ ID NO: 190569 - DNA, 20 bp, Artificial
  CRISPR gRNA sequence
aatggcgtcaacccgggagg

SEQ ID NO: 190570 - DNA, 20 bp, Artificial
  CRISPR gRNA sequence
tggcgtcaacccgggaggcg

SEQ ID NO: 190571 - DNA, 20 bp, Artificial
  CRISPR gRNA sequence
ggcgtcaacccgggaggcgg

SEQ ID NO: 190572 - DNA, 20 bp, Artificial
  CRISPR gRNA sequence
aacccgggaggcggaggttg

SEQ ID NO: 190573 - DNA, 20 bp, Artificial
  CRISPR gRNA sequence
cgggaggcggaggttgcagt

SEQ ID NO: 190574 - DNA, 20 bp, Artificial
  CRISPR gRNA sequence
aggcggaggttgcagtgagc

SEQ ID NO: 190575 - DNA, 20 bp, Artificial
  CRISPR gRNA sequence
ggcggaggttgcagtgagcc

SEQ ID NO: 190576 - DNA, 20 bp, Artificial
  CRISPR gRNA sequence
aggattgtgcgactgcactc

SEQ ID NO: 190577 - DNA, 20 bp, Artificial
  CRISPR gRNA sequence
tgtgcgactgcactccagcc

SEQ ID NO: 190578 - DNA, 20 bp, Artificial
  CRISPR gRNA sequence
gtgcgactgcactccagcct

SEQ ID NO: 190579 - DNA, 20 bp, Artificial
  CRISPR gRNA sequence
ctgcactccagcctgggtga

SEQ ID NO: 190580 - DNA, 20 bp, Artificial
  CRISPR gRNA sequence
tgcactccagcctgggtgac

SEQ ID NO: 190581 - DNA, 20 bp, Artificial
  CRISPR gRNA sequence
gcactccagcctgggtgaca

SEQ ID NO: 190582 - DNA, 20 bp, Artificial
  CRISPR gRNA sequence
taaaaattgaaaaataaaaa

SEQ ID NO: 190583 - DNA, 20 bp, Artificial
  CRISPR gRNA sequence
tgaaaaataaaaaaagaacc

SEQ ID NO: 190584 - DNA, 20 bp, Artificial
  CRISPR gRNA sequence
ttcatattcttgcaatgaaa

SEQ ID NO: 190585 - DNA, 20 bp, Artificial
  CRISPR gRNA sequence
tcttgcaatgaaatggactt

SEQ ID NO: 190586 - DNA, 20 bp, Artificial
  CRISPR gRNA sequence
cttgcaatgaaatggacttg

SEQ ID NO: 190587 - DNA, 20 bp, Artificial
  CRISPR gRNA sequence
gcaatgaaatggacttgagg

SEQ ID NO: 190588 - DNA, 20 bp, Artificial
  CRISPR gRNA sequence
gaaatggacttgaggaagct

SEQ ID NO: 190589 - DNA, 20 bp, Artificial
  CRISPR gRNA sequence
acttgaggaagctaagatca

SEQ ID NO: 190590 - DNA, 20 bp, Artificial
  CRISPR gRNA sequence
gaggaagctaagatcatagc

SEQ ID NO: 190591 - DNA, 20 bp, Artificial
  CRISPR gRNA sequence
taagatcatagctagaaata

SEQ ID NO: 190592 - DNA, 20 bp, Artificial
  CRISPR gRNA sequence
tagaaatacagataattcca

SEQ ID NO: 190593 - DNA, 20 bp, Artificial
  CRISPR gRNA sequence
ataattccacagcacatctc

SEQ ID NO: 190594 - DNA, 20 bp, Artificial
  CRISPR gRNA sequence
cagcacatctctagcaaatt

SEQ ID NO: 190595 - DNA, 20 bp, Artificial
  CRISPR gRNA sequence
tttagcctattcctattctc

SEQ ID NO: 190596 - DNA, 20 bp, Artificial
  CRISPR gRNA sequence
gtaatcttgaccatatacct

SEQ ID NO: 190597 - DNA, 20 bp, Artificial
  CRISPR gRNA sequence
aatcttgaccatataccttg

SEQ ID NO: 190598 - DNA, 20 bp, Artificial
  CRISPR gRNA sequence
atattgttttcatactgctg

SEQ ID NO: 190599 - DNA, 20 bp, Artificial
  CRISPR gRNA sequence
ttccctccaacactcatgtt

SEQ ID NO: 190600 - DNA, 20 bp, Artificial
  CRISPR gRNA sequence
ttgagacttaatccctaatg

SEQ ID NO: 190601 - DNA, 20 bp, Artificial
  CRISPR gRNA sequence
ccctaatgtggcaatactga

SEQ ID NO: 190602 - DNA, 20 bp, Artificial
  CRISPR gRNA sequence
cctaatgtggcaatactgaa

SEQ ID NO: 190603 - DNA, 20 bp, Artificial
  CRISPR gRNA sequence
aatgtggcaatactgaaagg

SEQ ID NO: 190604 - DNA, 20 bp, Artificial
  CRISPR gRNA sequence
atgtggcaatactgaaaggt

SEQ ID NO: 190605 - DNA, 20 bp, Artificial
  CRISPR gRNA sequence
tgtggcaatactgaaaggtg

SEQ ID NO: 190606 - DNA, 20 bp, Artificial
  CRISPR gRNA sequence
tactgaaaggtggggccttt

SEQ ID NO: 190607 - DNA, 20 bp, Artificial
  CRISPR gRNA sequence
tggggcctttgagatgtgat

SEQ ID NO: 190608 - DNA, 20 bp, Artificial
  CRISPR gRNA sequence
ttgagatgtgattggatcgt

SEQ ID NO: 190609 - DNA, 20 bp, Artificial
  CRISPR gRNA sequence
tgagatgtgattggatcgta

SEQ ID NO: 190610 - DNA, 20 bp, Artificial
  CRISPR gRNA sequence
taaggctgtgccttcattca

SEQ ID NO: 190611 - DNA, 20 bp, Artificial
  CRISPR gRNA sequence
aaggctgtgccttcattcat

SEQ ID NO: 190612 - DNA, 20 bp, Artificial
  CRISPR gRNA sequence
tgccttcattcatgggttaa

SEQ ID NO: 190613 - DNA, 20 bp, Artificial
  CRISPR gRNA sequence
ttcatgggttaatggattaa

SEQ ID NO: 190614 - DNA, 20 bp, Artificial
  CRISPR gRNA sequence
tcatgggttaatggattaat

SEQ ID NO: 190615 - DNA, 20 bp, Artificial
  CRISPR gRNA sequence
aatggattaatgggttatca

SEQ ID NO: 190616 - DNA, 20 bp, Artificial
  CRISPR gRNA sequence
atggattaatgggttatcac

SEQ ID NO: 190617 - DNA, 20 bp, Artificial
  CRISPR gRNA sequence
ttaatgggttatcacaggaa

SEQ ID NO: 190618 - DNA, 20 bp, Artificial
  CRISPR gRNA sequence
taatgggttatcacaggaat

SEQ ID NO: 190619 - DNA, 20 bp, Artificial
  CRISPR gRNA sequence
ggttatcacaggaatgggac

SEQ ID NO: 190620 - DNA, 20 bp, Artificial
  CRISPR gRNA sequence
tatcacaggaatgggactgg

SEQ ID NO: 190621 - DNA, 20 bp, Artificial
  CRISPR gRNA sequence
aatgggactggtggctttat

SEQ ID NO: 190622 - DNA, 20 bp, Artificial
  CRISPR gRNA sequence
gggactggtggctttataag

SEQ ID NO: 190623 - DNA, 20 bp, Artificial
  CRISPR gRNA sequence
gactggtggctttataagaa

SEQ ID NO: 190624 - DNA, 20 bp, Artificial
  CRISPR gRNA sequence
actggtggctttataagaag

SEQ ID NO: 190625 - DNA, 20 bp, Artificial
  CRISPR gRNA sequence
tggctttataagaagaggaa

SEQ ID NO: 190626 - DNA, 20 bp, Artificial
  CRISPR gRNA sequence
gctttataagaagaggaaaa

SEQ ID NO: 190627 - DNA, 20 bp, Artificial
  CRISPR gRNA sequence
aagaagaggaaaagagaact

SEQ ID NO: 190628 - DNA, 20 bp, Artificial
  CRISPR gRNA sequence
agaggaaaagagaactgagc

SEQ ID NO: 190629 - DNA, 20 bp, Artificial
  CRISPR gRNA sequence
gagaactgagctagcatgcc

SEQ ID NO: 190630 - DNA, 20 bp, Artificial
  CRISPR gRNA sequence
gagctagcatgcccagccca

SEQ ID NO: 190631 - DNA, 20 bp, Artificial
  CRISPR gRNA sequence
gctagcatgcccagcccaca

SEQ ID NO: 190632 - DNA, 20 bp, Artificial
  CRISPR gRNA sequence
tagcatgcccagcccacaga

SEQ ID NO: 190633 - DNA, 20 bp, Artificial
  CRISPR gRNA sequence
agcccacagagagcctccac

SEQ ID NO: 190634 - DNA, 20 bp, Artificial
  CRISPR gRNA sequence
cccacagagagcctccacta

SEQ ID NO: 190635 - DNA, 20 bp, Artificial
  CRISPR gRNA sequence
gcctccactagagtgatgct

SEQ ID NO: 190636 - DNA, 20 bp, Artificial
  CRISPR gRNA sequence
tccactagagtgatgctaag

SEQ ID NO: 190637 - DNA, 20 bp, Artificial
  CRISPR gRNA sequence
gtgatgctaagtggaaatgt

SEQ ID NO: 190638 - DNA, 20 bp, Artificial
  CRISPR gRNA sequence
tgatgctaagtggaaatgtg

SEQ ID NO: 190639 - DNA, 20 bp, Artificial
  CRISPR gRNA sequence
ctaagtggaaatgtgaggtg

SEQ ID NO: 190640 - DNA, 20 bp, Artificial
  CRISPR gRNA sequence
aatgtgaggtgcagctgcca

SEQ ID NO: 190641 - DNA, 20 bp, Artificial
  CRISPR gRNA sequence
tgtgaggtgcagctgccaca

SEQ ID NO: 190642 - DNA, 20 bp, Artificial
  CRISPR gRNA sequence
gtgaggtgcagctgccacag

SEQ ID NO: 190643 - DNA, 20 bp, Artificial
  CRISPR gRNA sequence
tgaggtgcagctgccacaga

SEQ ID NO: 190644 - DNA, 20 bp, Artificial
  CRISPR gRNA sequence
ctgccacagagggcccccac

SEQ ID NO: 190645 - DNA, 20 bp, Artificial
  CRISPR gRNA sequence
tgccacagagggcccccacc

SEQ ID NO: 190646 - DNA, 20 bp, Artificial
  CRISPR gRNA sequence
gccacagagggcccccacca

SEQ ID NO: 190647 - DNA, 20 bp, Artificial
  CRISPR gRNA sequence
gcccccaccagggaaatgtc

SEQ ID NO: 190648 - DNA, 20 bp, Artificial
  CRISPR gRNA sequence
ccagggaaatgtctagtgtc

SEQ ID NO: 190649 - DNA, 20 bp, Artificial
  CRISPR gRNA sequence
gggaaatgtctagtgtctag

SEQ ID NO: 190650 - DNA, 20 bp, Artificial
  CRISPR gRNA sequence
tgtctagtgtctagtggatc

SEQ ID NO: 190651 - DNA, 20 bp, Artificial
  CRISPR gRNA sequence
gtctagtgtctagtggatcc

SEQ ID NO: 190652 - DNA, 20 bp, Artificial
  CRISPR gRNA sequence
tgtctagtggatccaggcca

SEQ ID NO: 190653 - DNA, 20 bp, Artificial
  CRISPR gRNA sequence
gtctagtggatccaggccac

SEQ ID NO: 190654 - DNA, 20 bp, Artificial
  CRISPR gRNA sequence
ctagtggatccaggccacag

SEQ ID NO: 190655 - DNA, 20 bp, Artificial
  CRISPR gRNA sequence
agtggatccaggccacagga

SEQ ID NO: 190656 - DNA, 20 bp, Artificial
  CRISPR gRNA sequence
tggatccaggccacaggaga

SEQ ID NO: 190657 - DNA, 20 bp, Artificial
  CRISPR gRNA sequence
ccacaggagagagtgccttg

SEQ ID NO: 190658 - DNA, 20 bp, Artificial
  CRISPR gRNA sequence
acaggagagagtgccttgtg

SEQ ID NO: 190659 - DNA, 20 bp, Artificial
  CRISPR gRNA sequence
gagagtgccttgtggagcgc

SEQ ID NO: 190660 - DNA, 20 bp, Artificial
  CRISPR gRNA sequence
agagtgccttgtggagcgct

SEQ ID NO: 190661 - DNA, 20 bp, Artificial
  CRISPR gRNA sequence
agtgccttgtggagcgctgg

SEQ ID NO: 190662 - DNA, 20 bp, Artificial
  CRISPR gRNA sequence
gccttgtggagcgctgggag

SEQ ID NO: 190663 - DNA, 20 bp, Artificial
  CRISPR gRNA sequence
ccttgtggagcgctgggagc

SEQ ID NO: 190664 - DNA, 20 bp, Artificial
  CRISPR gRNA sequence
gagcaggacctgaccaccac

SEQ ID NO: 190665 - DNA, 20 bp, Artificial
  CRISPR gRNA sequence
agcaggacctgaccaccacc

SEQ ID NO: 190666 - DNA, 20 bp, Artificial
  CRISPR gRNA sequence
cctgaccaccaccaggaccc

SEQ ID NO: 190667 - DNA, 20 bp, Artificial
  CRISPR gRNA sequence
ccaccaggaccccagaactg

SEQ ID NO: 190668 - DNA, 20 bp, Artificial
  CRISPR gRNA sequence
accaggaccccagaactgtg

SEQ ID NO: 190669 - DNA, 20 bp, Artificial
  CRISPR gRNA sequence
ggaccccagaactgtggagt

SEQ ID NO: 190670 - DNA, 20 bp, Artificial
  CRISPR gRNA sequence
ccccagaactgtggagtcag

SEQ ID NO: 190671 - DNA, 20 bp, Artificial
  CRISPR gRNA sequence
cagaactgtggagtcagtgg

SEQ ID NO: 190672 - DNA, 20 bp, Artificial
  CRISPR gRNA sequence
gtggagtcagtggcagcatg

SEQ ID NO: 190673 - DNA, 20 bp, Artificial
  CRISPR gRNA sequence
ggcagcatgcagcgccccct

SEQ ID NO: 190674 - DNA, 20 bp, Artificial
  CRISPR gRNA sequence
gcagcatgcagcgccccctt

SEQ ID NO: 190675 - DNA, 20 bp, Artificial
  CRISPR gRNA sequence
catgcagcgcccccttggga

SEQ ID NO: 190676 - DNA, 20 bp, Artificial
  CRISPR gRNA sequence
gcgcccccttgggaaagctt

SEQ ID NO: 190677 - DNA, 20 bp, Artificial
  CRISPR gRNA sequence
cgcccccttgggaaagcttt

SEQ ID NO: 190678 - DNA, 20 bp, Artificial
  CRISPR gRNA sequence
cttgggaaagctttaggcac

SEQ ID NO: 190679 - DNA, 20 bp, Artificial
  CRISPR gRNA sequence
caccagcctgcaacccattc

SEQ ID NO: 190680 - DNA, 20 bp, Artificial
  CRISPR gRNA sequence
cagcctgcaacccattcgag

SEQ ID NO: 190681 - DNA, 20 bp, Artificial
  CRISPR gRNA sequence
aacccattcgagcagccacg

SEQ ID NO: 190682 - DNA, 20 bp, Artificial
  CRISPR gRNA sequence
acccattcgagcagccacgt

SEQ ID NO: 190683 - DNA, 20 bp, Artificial
  CRISPR gRNA sequence
gcagccacgtaggctgcacc

SEQ ID NO: 190684 - DNA, 20 bp, Artificial
  CRISPR gRNA sequence
cacgtaggctgcacccagca

SEQ ID NO: 190685 - DNA, 20 bp, Artificial
  CRISPR gRNA sequence
ggctgcacccagcaaagcca

SEQ ID NO: 190686 - DNA, 20 bp, Artificial
  CRISPR gRNA sequence
gctgcacccagcaaagccac

SEQ ID NO: 190687 - DNA, 20 bp, Artificial
  CRISPR gRNA sequence
acccagcaaagccacaggca

SEQ ID NO: 190688 - DNA, 20 bp, Artificial
  CRISPR gRNA sequence
cccagcaaagccacaggcac

SEQ ID NO: 190689 - DNA, 20 bp, Artificial
  CRISPR gRNA sequence
ccagcaaagccacaggcacg

SEQ ID NO: 190690 - DNA, 20 bp, Artificial
  CRISPR gRNA sequence
ccacaggcacggggctacct

SEQ ID NO: 190691 - DNA, 20 bp, Artificial
  CRISPR gRNA sequence
cacaggcacggggctacctg

SEQ ID NO: 190692 - DNA, 20 bp, Artificial
  CRISPR gRNA sequence
cacggggctacctgaggcct

SEQ ID NO: 190693 - DNA, 20 bp, Artificial
  CRISPR gRNA sequence
acggggctacctgaggcctt

SEQ ID NO: 190694 - DNA, 20 bp, Artificial
  CRISPR gRNA sequence
cggggctacctgaggccttg

SEQ ID NO: 190695 - DNA, 20 bp, Artificial
  CRISPR gRNA sequence
ggggctacctgaggccttgg

SEQ ID NO: 190696 - DNA, 20 bp, Artificial
  CRISPR gRNA sequence
tgggggcccaatccctgctc

SEQ ID NO: 190697 - DNA, 20 bp, Artificial
  CRISPR gRNA sequence
ccctgctccagtgtgtccgt

SEQ ID NO: 190698 - DNA, 20 bp, Artificial
  CRISPR gRNA sequence
cctgctccagtgtgtccgtg

SEQ ID NO: 190699 - DNA, 20 bp, Artificial
  CRISPR gRNA sequence
gctccagtgtgtccgtgagg

SEQ ID NO: 190700 - DNA, 20 bp, Artificial
  CRISPR gRNA sequence
tgtccgtgaggcagcacacg

SEQ ID NO: 190701 - DNA, 20 bp, Artificial
  CRISPR gRNA sequence
gaggcagcacacgaagtcaa

SEQ ID NO: 190702 - DNA, 20 bp, Artificial
  CRISPR gRNA sequence
ggcagcacacgaagtcaaaa

SEQ ID NO: 190703 - DNA, 20 bp, Artificial
  CRISPR gRNA sequence
aagagattattctcttccca

SEQ ID NO: 190704 - DNA, 20 bp, Artificial
  CRISPR gRNA sequence
tctctcccatgaccctttaa

SEQ ID NO: 190705 - DNA, 20 bp, Artificial
  CRISPR gRNA sequence
cttcattcccctcaccttcc

SEQ ID NO: 190706 - DNA, 20 bp, Artificial
  CRISPR gRNA sequence
ttcattcccctcaccttccc

SEQ ID NO: 190707 - DNA, 20 bp, Artificial
  CRISPR gRNA sequence
tcaccttcccaggctgatct

SEQ ID NO: 190708 - DNA, 20 bp, Artificial
  CRISPR gRNA sequence
caccttcccaggctgatctg

SEQ ID NO: 190709 - DNA, 20 bp, Artificial
  CRISPR gRNA sequence
ctgatctgaggtaaactttg

SEQ ID NO: 190710 - DNA, 20 bp, Artificial
  CRISPR gRNA sequence
taaactttgaagtaaaataa

SEQ ID NO: 190711 - DNA, 20 bp, Artificial
  CRISPR gRNA sequence
gtaaaataaaagctgtgttt

SEQ ID NO: 190712 - DNA, 20 bp, Artificial
  CRISPR gRNA sequence
ttaattttttaaccacattc

SEQ ID NO: 190713 - DNA, 20 bp, Artificial
  CRISPR gRNA sequence
accacattcaagctatcctt

SEQ ID NO: 190714 - DNA, 20 bp, Artificial
  CRISPR gRNA sequence
tcctttggcttccaatgcca

SEQ ID NO: 190715 - DNA, 20 bp, Artificial
  CRISPR gRNA sequence
ttccaatgccatggtccacc

SEQ ID NO: 190716 - DNA, 20 bp, Artificial
  CRISPR gRNA sequence
ccacccagaactgcattcac

SEQ ID NO: 190717 - DNA, 20 bp, Artificial
  CRISPR gRNA sequence
ccagtgaatgcagttctggg

SEQ ID NO: 190718 - DNA, 20 bp, Artificial
  CRISPR gRNA sequence
atgcagttctgggtggacca

SEQ ID NO: 190719 - DNA, 20 bp, Artificial
  CRISPR gRNA sequence
ttctgggtggaccatggcat

SEQ ID NO: 190720 - DNA, 20 bp, Artificial
  CRISPR gRNA sequence
tgggtggaccatggcattgg

SEQ ID NO: 190721 - DNA, 20 bp, Artificial
  CRISPR gRNA sequence
gaccatggcattggaagcca

SEQ ID NO: 190722 - DNA, 20 bp, Artificial
  CRISPR gRNA sequence
accatggcattggaagccaa

SEQ ID NO: 190723 - DNA, 20 bp, Artificial
  CRISPR gRNA sequence
tggcattggaagccaaagga

SEQ ID NO: 190724 - DNA, 20 bp, Artificial
  CRISPR gRNA sequence
gccaaaggatagcttgaatg

SEQ ID NO: 190725 - DNA, 20 bp, Artificial
  CRISPR gRNA sequence
ggttaaaaaattaaaacaac

SEQ ID NO: 190726 - DNA, 20 bp, Artificial
  CRISPR gRNA sequence
gttaaaaaattaaaacaaca

SEQ ID NO: 190727 - DNA, 20 bp, Artificial
  CRISPR gRNA sequence
atacaaatgatgctcaaaca

SEQ ID NO: 190728 - DNA, 20 bp, Artificial
  CRISPR gRNA sequence
acagcttttattttacttca

SEQ ID NO: 190729 - DNA, 20 bp, Artificial
  CRISPR gRNA sequence
ttttacttcaaagtttacct

SEQ ID NO: 190730 - DNA, 20 bp, Artificial
  CRISPR gRNA sequence
cttcaaagtttacctcagat

SEQ ID NO: 190731 - DNA, 20 bp, Artificial
  CRISPR gRNA sequence
aagtttacctcagatcagcc

SEQ ID NO: 190732 - DNA, 20 bp, Artificial
  CRISPR gRNA sequence
agtttacctcagatcagcct

SEQ ID NO: 190733 - DNA, 20 bp, Artificial
  CRISPR gRNA sequence
ttacctcagatcagcctggg

SEQ ID NO: 190734 - DNA, 20 bp, Artificial
  CRISPR gRNA sequence
tacctcagatcagcctggga

SEQ ID NO: 190735 - DNA, 20 bp, Artificial
  CRISPR gRNA sequence
tcagatcagcctgggaaggt

SEQ ID NO: 190736 - DNA, 20 bp, Artificial
  CRISPR gRNA sequence
cagatcagcctgggaaggtg

SEQ ID NO: 190737 - DNA, 20 bp, Artificial
  CRISPR gRNA sequence
agatcagcctgggaaggtga

SEQ ID NO: 190738 - DNA, 20 bp, Artificial
  CRISPR gRNA sequence
gatcagcctgggaaggtgag

SEQ ID NO: 190739 - DNA, 20 bp, Artificial
  CRISPR gRNA sequence
ctgggaaggtgaggggaatg

SEQ ID NO: 190740 - DNA, 20 bp, Artificial
  CRISPR gRNA sequence
ggaaggtgaggggaatgaag

SEQ ID NO: 190741 - DNA, 20 bp, Artificial
  CRISPR gRNA sequence
gaatgaagcagatgctgtta

SEQ ID NO: 190742 - DNA, 20 bp, Artificial
  CRISPR gRNA sequence
aatgaagcagatgctgttaa

SEQ ID NO: 190743 - DNA, 20 bp, Artificial
  CRISPR gRNA sequence
atgaagcagatgctgttaaa

SEQ ID NO: 190744 - DNA, 20 bp, Artificial
  CRISPR gRNA sequence
cagatgctgttaaagggtca

SEQ ID NO: 190745 - DNA, 20 bp, Artificial
  CRISPR gRNA sequence
agatgctgttaaagggtcat

SEQ ID NO: 190746 - DNA, 20 bp, Artificial
  CRISPR gRNA sequence
atgctgttaaagggtcatgg

SEQ ID NO: 190747 - DNA, 20 bp, Artificial
  CRISPR gRNA sequence
gctgttaaagggtcatggga

SEQ ID NO: 190748 - DNA, 20 bp, Artificial
  CRISPR gRNA sequence
taaagggtcatgggagagaa

SEQ ID NO: 190749 - DNA, 20 bp, Artificial
  CRISPR gRNA sequence
aaagggtcatgggagagaaa

SEQ ID NO: 190750 - DNA, 20 bp, Artificial
  CRISPR gRNA sequence
tgggagagaaaaggtatctg

SEQ ID NO: 190751 - DNA, 20 bp, Artificial
  CRISPR gRNA sequence
gggagagaaaaggtatctgt

SEQ ID NO: 190752 - DNA, 20 bp, Artificial
  CRISPR gRNA sequence
agagaaaaggtatctgtggg

SEQ ID NO: 190753 - DNA, 20 bp, Artificial
  CRISPR gRNA sequence
agaaaaggtatctgtgggaa

SEQ ID NO: 190754 - DNA, 20 bp, Artificial
  CRISPR gRNA sequence
tgacttcgtgtgctgcctca

SEQ ID NO: 190755 - DNA, 20 bp, Artificial
  CRISPR gRNA sequence
gtgctgcctcacggacacac

SEQ ID NO: 190756 - DNA, 20 bp, Artificial
  CRISPR gRNA sequence
gctgcctcacggacacactg

SEQ ID NO: 190757 - DNA, 20 bp, Artificial
  CRISPR gRNA sequence
gcctcacggacacactggag

SEQ ID NO: 190758 - DNA, 20 bp, Artificial
  CRISPR gRNA sequence
cctcacggacacactggagc

SEQ ID NO: 190759 - DNA, 20 bp, Artificial
  CRISPR gRNA sequence
ctcacggacacactggagca

SEQ ID NO: 190760 - DNA, 20 bp, Artificial
  CRISPR gRNA sequence
ggacacactggagcagggat

SEQ ID NO: 190761 - DNA, 20 bp, Artificial
  CRISPR gRNA sequence
gacacactggagcagggatt

SEQ ID NO: 190762 - DNA, 20 bp, Artificial
  CRISPR gRNA sequence
ggagcagggattgggccccc

SEQ ID NO: 190763 - DNA, 20 bp, Artificial
  CRISPR gRNA sequence
gagcagggattgggccccca

SEQ ID NO: 190764 - DNA, 20 bp, Artificial
  CRISPR gRNA sequence
ggattgggcccccaaggcct

SEQ ID NO: 190765 - DNA, 20 bp, Artificial
  CRISPR gRNA sequence
gattgggcccccaaggcctc

SEQ ID NO: 190766 - DNA, 20 bp, Artificial
  CRISPR gRNA sequence
tgggcccccaaggcctcagg

SEQ ID NO: 190767 - DNA, 20 bp, Artificial
  CRISPR gRNA sequence
ctcaggtagccccgtgcctg

SEQ ID NO: 190768 - DNA, 20 bp, Artificial
  CRISPR gRNA sequence
ccccgtgcctgtggctttgc

SEQ ID NO: 190769 - DNA, 20 bp, Artificial
  CRISPR gRNA sequence
cccgtgcctgtggctttgct

SEQ ID NO: 190770 - DNA, 20 bp, Artificial
  CRISPR gRNA sequence
gcctgtggctttgctgggtg

SEQ ID NO: 190771 - DNA, 20 bp, Artificial
  CRISPR gRNA sequence
tttgctgggtgcagcctacg

SEQ ID NO: 190772 - DNA, 20 bp, Artificial
  CRISPR gRNA sequence
agcctacgtggctgctcgaa

SEQ ID NO: 190773 - DNA, 20 bp, Artificial
  CRISPR gRNA sequence
gcctacgtggctgctcgaat

SEQ ID NO: 190774 - DNA, 20 bp, Artificial
  CRISPR gRNA sequence
gtggctgctcgaatgggttg

SEQ ID NO: 190775 - DNA, 20 bp, Artificial
  CRISPR gRNA sequence
tggctgctcgaatgggttgc

SEQ ID NO: 190776 - DNA, 20 bp, Artificial
  CRISPR gRNA sequence
tgctcgaatgggttgcaggc

SEQ ID NO: 190777 - DNA, 20 bp, Artificial
  CRISPR gRNA sequence
gggttgcaggctggtgccta

SEQ ID NO: 190778 - DNA, 20 bp, Artificial
  CRISPR gRNA sequence
ctggtgcctaaagctttccc

SEQ ID NO: 190779 - DNA, 20 bp, Artificial
  CRISPR gRNA sequence
tggtgcctaaagctttccca

SEQ ID NO: 190780 - DNA, 20 bp, Artificial
  CRISPR gRNA sequence
ggtgcctaaagctttcccaa

SEQ ID NO: 190781 - DNA, 20 bp, Artificial
  CRISPR gRNA sequence
gtgcctaaagctttcccaag

SEQ ID NO: 190782 - DNA, 20 bp, Artificial
  CRISPR gRNA sequence
tgcctaaagctttcccaagg

SEQ ID NO: 190783 - DNA, 20 bp, Artificial
  CRISPR gRNA sequence
gcatgctgccactgactcca

SEQ ID NO: 190784 - DNA, 20 bp, Artificial
  CRISPR gRNA sequence
tgccactgactccacagttc

SEQ ID NO: 190785 - DNA, 20 bp, Artificial
  CRISPR gRNA sequence
gccactgactccacagttct

SEQ ID NO: 190786 - DNA, 20 bp, Artificial
  CRISPR gRNA sequence
ccactgactccacagttctg

SEQ ID NO: 190787 - DNA, 20 bp, Artificial
  CRISPR gRNA sequence
actccacagttctggggtcc

SEQ ID NO: 190788 - DNA, 20 bp, Artificial
  CRISPR gRNA sequence
ccacagttctggggtcctgg

SEQ ID NO: 190789 - DNA, 20 bp, Artificial
  CRISPR gRNA sequence
cagttctggggtcctggtgg

SEQ ID NO: 190790 - DNA, 20 bp, Artificial
  CRISPR gRNA sequence
tctggggtcctggtggtggt

SEQ ID NO: 190791 - DNA, 20 bp, Artificial
  CRISPR gRNA sequence
ctggggtcctggtggtggtc

SEQ ID NO: 190792 - DNA, 20 bp, Artificial
  CRISPR gRNA sequence
tggtggtcaggtcctgctcc

SEQ ID NO: 190793 - DNA, 20 bp, Artificial
  CRISPR gRNA sequence
tcctgctcccagcgctccac

SEQ ID NO: 190794 - DNA, 20 bp, Artificial
  CRISPR gRNA sequence
cctgctcccagcgctccaca

SEQ ID NO: 190795 - DNA, 20 bp, Artificial
  CRISPR gRNA sequence
ccacaaggcactctctcctg

SEQ ID NO: 190796 - DNA, 20 bp, Artificial
  CRISPR gRNA sequence
aggcactctctcctgtggcc

SEQ ID NO: 190797 - DNA, 20 bp, Artificial
  CRISPR gRNA sequence
ctcctgtggcctggatccac

SEQ ID NO: 190798 - DNA, 20 bp, Artificial
  CRISPR gRNA sequence
ggcctggatccactagacac

SEQ ID NO: 190799 - DNA, 20 bp, Artificial
  CRISPR gRNA sequence
ctagacactagacatttccc

SEQ ID NO: 190800 - DNA, 20 bp, Artificial
  CRISPR gRNA sequence
gacactagacatttccctgg

SEQ ID NO: 190801 - DNA, 20 bp, Artificial
  CRISPR gRNA sequence
acactagacatttccctggt

SEQ ID NO: 190802 - DNA, 20 bp, Artificial
  CRISPR gRNA sequence
cactagacatttccctggtg

SEQ ID NO: 190803 - DNA, 20 bp, Artificial
  CRISPR gRNA sequence
actagacatttccctggtgg

SEQ ID NO: 190804 - DNA, 20 bp, Artificial
  CRISPR gRNA sequence
tccctggtgggggccctctg

SEQ ID NO: 190805 - DNA, 20 bp, Artificial
  CRISPR gRNA sequence
ctggtgggggccctctgtgg

SEQ ID NO: 190806 - DNA, 20 bp, Artificial
  CRISPR gRNA sequence
ctgcacctcacatttccact

SEQ ID NO: 190807 - DNA, 20 bp, Artificial
  CRISPR gRNA sequence
atttccacttagcatcactc

SEQ ID NO: 190808 - DNA, 20 bp, Artificial
  CRISPR gRNA sequence
tccacttagcatcactctag

SEQ ID NO: 190809 - DNA, 20 bp, Artificial
  CRISPR gRNA sequence
cacttagcatcactctagtg

SEQ ID NO: 190810 - DNA, 20 bp, Artificial
  CRISPR gRNA sequence
acttagcatcactctagtgg

SEQ ID NO: 190811 - DNA, 20 bp, Artificial
  CRISPR gRNA sequence
actctagtggaggctctctg

SEQ ID NO: 190812 - DNA, 20 bp, Artificial
  CRISPR gRNA sequence
ctctagtggaggctctctgt

SEQ ID NO: 190813 - DNA, 20 bp, Artificial
  CRISPR gRNA sequence
agtggaggctctctgtgggc

SEQ ID NO: 190814 - DNA, 20 bp, Artificial
  CRISPR gRNA sequence
gtggaggctctctgtgggct

SEQ ID NO: 190815 - DNA, 20 bp, Artificial
  CRISPR gRNA sequence
tctctgtgggctgggcatgc

SEQ ID NO: 190816 - DNA, 20 bp, Artificial
  CRISPR gRNA sequence
gtgggctgggcatgctagct

SEQ ID NO: 190817 - DNA, 20 bp, Artificial
  CRISPR gRNA sequence
tctcttttcctcttcttata

SEQ ID NO: 190818 - DNA, 20 bp, Artificial
  CRISPR gRNA sequence
tcctcttcttataaagccac

SEQ ID NO: 190819 - DNA, 20 bp, Artificial
  CRISPR gRNA sequence
aatccattaacccatgaatg

SEQ ID NO: 190820 - DNA, 20 bp, Artificial
  CRISPR gRNA sequence
atccattaacccatgaatga

SEQ ID NO: 190821 - DNA, 20 bp, Artificial
  CRISPR gRNA sequence
ttaacccatgaatgaaggca

SEQ ID NO: 190822 - DNA, 20 bp, Artificial
  CRISPR gRNA sequence
tacgatccaatcacatctca

SEQ ID NO: 190823 - DNA, 20 bp, Artificial
  CRISPR gRNA sequence
acgatccaatcacatctcaa

SEQ ID NO: 190824 - DNA, 20 bp, Artificial
  CRISPR gRNA sequence
atctcaaaggccccaccttt

SEQ ID NO: 190825 - DNA, 20 bp, Artificial
  CRISPR gRNA sequence
acctttcagtattgccacat

SEQ ID NO: 190826 - DNA, 20 bp, Artificial
  CRISPR gRNA sequence
cctttcagtattgccacatt

SEQ ID NO: 190827 - DNA, 20 bp, Artificial
  CRISPR gRNA sequence
ctttcagtattgccacatta

SEQ ID NO: 190828 - DNA, 20 bp, Artificial
  CRISPR gRNA sequence
gtattgccacattagggatt

SEQ ID NO: 190829 - DNA, 20 bp, Artificial
  CRISPR gRNA sequence
tagggattaagtctcaacat

SEQ ID NO: 190830 - DNA, 20 bp, Artificial
  CRISPR gRNA sequence
ttaagtctcaacatgagtgt

SEQ ID NO: 190831 - DNA, 20 bp, Artificial
  CRISPR gRNA sequence
aagtctcaacatgagtgttg

SEQ ID NO: 190832 - DNA, 20 bp, Artificial
  CRISPR gRNA sequence
agtctcaacatgagtgttgg

SEQ ID NO: 190833 - DNA, 20 bp, Artificial
  CRISPR gRNA sequence
gtctcaacatgagtgttgga

SEQ ID NO: 190834 - DNA, 20 bp, Artificial
  CRISPR gRNA sequence
tggagggaacattcaaacca

SEQ ID NO: 190835 - DNA, 20 bp, Artificial
  CRISPR gRNA sequence
agggaacattcaaaccacag

SEQ ID NO: 190836 - DNA, 20 bp, Artificial
  CRISPR gRNA sequence
tgaaaacaatattcaactcc

SEQ ID NO: 190837 - DNA, 20 bp, Artificial
  CRISPR gRNA sequence
gaaaacaatattcaactcca

SEQ ID NO: 190838 - DNA, 20 bp, Artificial
  CRISPR gRNA sequence
atattcaactccaaggtata

SEQ ID NO: 190839 - DNA, 20 bp, Artificial
  CRISPR gRNA sequence
caactccaaggtatatggtc

SEQ ID NO: 190840 - DNA, 20 bp, Artificial
  CRISPR gRNA sequence
aaggtatatggtcaagatta

SEQ ID NO: 190841 - DNA, 20 bp, Artificial
  CRISPR gRNA sequence
aggtatatggtcaagattac

SEQ ID NO: 190842 - DNA, 20 bp, Artificial
  CRISPR gRNA sequence
tatatggtcaagattacagg

SEQ ID NO: 190843 - DNA, 20 bp, Artificial
  CRISPR gRNA sequence
tggtcaagattacaggtggt

SEQ ID NO: 190844 - DNA, 20 bp, Artificial
  CRISPR gRNA sequence
ggtcaagattacaggtggta

SEQ ID NO: 190845 - DNA, 20 bp, Artificial
  CRISPR gRNA sequence
agattacaggtggtaaggaa

SEQ ID NO: 190846 - DNA, 20 bp, Artificial
  CRISPR gRNA sequence
gattacaggtggtaaggaat

SEQ ID NO: 190847 - DNA, 20 bp, Artificial
  CRISPR gRNA sequence
acaggtggtaaggaataggc

SEQ ID NO: 190848 - DNA, 20 bp, Artificial
  CRISPR gRNA sequence
aggtggtaaggaataggcta

SEQ ID NO: 190849 - DNA, 20 bp, Artificial
  CRISPR gRNA sequence
gtaaggaataggctagagaa

SEQ ID NO: 190850 - DNA, 20 bp, Artificial
  CRISPR gRNA sequence
taaggaataggctagagaat

SEQ ID NO: 190851 - DNA, 20 bp, Artificial
  CRISPR gRNA sequence
aataggctagagaataggaa

SEQ ID NO: 190852 - DNA, 20 bp, Artificial
  CRISPR gRNA sequence
ataggctagagaataggaat

SEQ ID NO: 190853 - DNA, 20 bp, Artificial
  CRISPR gRNA sequence
taggaataggctaaatttgc

SEQ ID NO: 190854 - DNA, 20 bp, Artificial
  CRISPR gRNA sequence
ggaataggctaaatttgcta

SEQ ID NO: 190855 - DNA, 20 bp, Artificial
  CRISPR gRNA sequence
aatttgctagagatgtgctg

SEQ ID NO: 190856 - DNA, 20 bp, Artificial
  CRISPR gRNA sequence
tgtggaattatctgtatttc

SEQ ID NO: 190857 - DNA, 20 bp, Artificial
  CRISPR gRNA sequence
tgtatttctagctatgatct

SEQ ID NO: 190858 - DNA, 20 bp, Artificial
  CRISPR gRNA sequence
gctatgatcttagcttcctc

SEQ ID NO: 190859 - DNA, 20 bp, Artificial
  CRISPR gRNA sequence
cctcaagtccatttcattgc

SEQ ID NO: 190860 - DNA, 20 bp, Artificial
  CRISPR gRNA sequence
agaatatgaaaaattaaatt

SEQ ID NO: 190861 - DNA, 20 bp, Artificial
  CRISPR gRNA sequence
tgaaaaattaaattgagatc

SEQ ID NO: 190862 - DNA, 20 bp, Artificial
  CRISPR gRNA sequence
gaaaaattaaattgagatcc

SEQ ID NO: 190863 - DNA, 20 bp, Artificial
  CRISPR gRNA sequence
tttttcaatttttatttttt

SEQ ID NO: 190864 - DNA, 20 bp, Artificial
  CRISPR gRNA sequence
tcaatttttattttttgaga

SEQ ID NO: 190865 - DNA, 20 bp, Artificial
  CRISPR gRNA sequence
tggcgtttcaccctgtcacc

SEQ ID NO: 190866 - DNA, 20 bp, Artificial
  CRISPR gRNA sequence
ggcgtttcaccctgtcaccc

SEQ ID NO: 190867 - DNA, 20 bp, Artificial
  CRISPR gRNA sequence
tttcaccctgtcacccaggc

SEQ ID NO: 190868 - DNA, 20 bp, Artificial
  CRISPR gRNA sequence
tcaccctgtcacccaggctg

SEQ ID NO: 190869 - DNA, 20 bp, Artificial
  CRISPR gRNA sequence
ctgtcacccaggctggagtg

SEQ ID NO: 190870 - DNA, 20 bp, Artificial
  CRISPR gRNA sequence
ggagtgcagtcgcacaatcc

SEQ ID NO: 190871 - DNA, 20 bp, Artificial
  CRISPR gRNA sequence
tcactgcaacctccgcctcc

SEQ ID NO: 190872 - DNA, 20 bp, Artificial
  CRISPR gRNA sequence
cactgcaacctccgcctccc

SEQ ID NO: 190873 - DNA, 20 bp, Artificial
  CRISPR gRNA sequence
ttctcctgcctccgcctcct

SEQ ID NO: 190874 - DNA, 20 bp, Artificial
  CRISPR gRNA sequence
tcctgcctccgcctcctgag

SEQ ID NO: 190875 - DNA, 20 bp, Artificial
  CRISPR gRNA sequence
gcctccgcctcctgagtagc

SEQ ID NO: 190876 - DNA, 20 bp, Artificial
  CRISPR gRNA sequence
cctccgcctcctgagtagct

SEQ ID NO: 190877 - DNA, 20 bp, Artificial
  CRISPR gRNA sequence
ctcctgagtagctgggacta

SEQ ID NO: 190878 - DNA, 20 bp, Artificial
  CRISPR gRNA sequence
tcctgagtagctgggactac

SEQ ID NO: 190879 - DNA, 20 bp, Artificial
  CRISPR gRNA sequence
caggcccgtgcctctgcgcc

SEQ ID NO: 190880 - DNA, 20 bp, Artificial
  CRISPR gRNA sequence
agctaattttttgtattttt

SEQ ID NO: 190881 - DNA, 20 bp, Artificial
  CRISPR gRNA sequence
taattttttgtattttttag

SEQ ID NO: 190882 - DNA, 20 bp, Artificial
  CRISPR gRNA sequence
attttttgtattttttagta

SEQ ID NO: 190883 - DNA, 20 bp, Artificial
  CRISPR gRNA sequence
tttgtattttttagtagaga

SEQ ID NO: 190884 - DNA, 20 bp, Artificial
  CRISPR gRNA sequence
ttgtattttttagtagagac

SEQ ID NO: 190885 - DNA, 20 bp, Artificial
  CRISPR gRNA sequence
tgtattttttagtagagacg

SEQ ID NO: 190886 - DNA, 20 bp, Artificial
  CRISPR gRNA sequence
gagacggggtttcaccgtgt

SEQ ID NO: 190887 - DNA, 20 bp, Artificial
  CRISPR gRNA sequence
cggggtttcaccgtgttagc

SEQ ID NO: 190888 - DNA, 20 bp, Artificial
  CRISPR gRNA sequence
ggggtttcaccgtgttagcc

SEQ ID NO: 190889 - DNA, 20 bp, Artificial
  CRISPR gRNA sequence
tttcaccgtgttagccagga

SEQ ID NO: 190890 - DNA, 20 bp, Artificial
  CRISPR gRNA sequence
acctcgtgatctgccctcct

SEQ ID NO: 190891 - DNA, 20 bp, Artificial
  CRISPR gRNA sequence
ctgccctcctcggcctccct

SEQ ID NO: 190892 - DNA, 20 bp, Artificial
  CRISPR gRNA sequence
tcctcggcctccctaagtgc

SEQ ID NO: 190893 - DNA, 20 bp, Artificial
  CRISPR gRNA sequence
cctcggcctccctaagtgct

SEQ ID NO: 190894 - DNA, 20 bp, Artificial
  CRISPR gRNA sequence
ctccctaagtgctgggatta

SEQ ID NO: 190895 - DNA, 20 bp, Artificial
  CRISPR gRNA sequence
tccctaagtgctgggattac

SEQ ID NO: 190896 - DNA, 20 bp, Artificial
  CRISPR gRNA sequence
agtgctgggattacaggcat

SEQ ID NO: 190897 - DNA, 20 bp, Artificial
  CRISPR gRNA sequence
atgagctgccgcactctgcc

SEQ ID NO: 190898 - DNA, 20 bp, Artificial
  CRISPR gRNA sequence
tgagctgccgcactctgccc

SEQ ID NO: 190899 - DNA, 20 bp, Artificial
  CRISPR gRNA sequence
gcccaggttcttatttttaa

SEQ ID NO: 190900 - DNA, 20 bp, Artificial
  CRISPR gRNA sequence
ggttcttatttttaatagaa

SEQ ID NO: 190901 - DNA, 20 bp, Artificial
  CRISPR gRNA sequence
ttcttatttttaatagaaaa

SEQ ID NO: 190902 - DNA, 20 bp, Artificial
  CRISPR gRNA sequence
atttttaatagaaaagagaa

SEQ ID NO: 190903 - DNA, 20 bp, Artificial
  CRISPR gRNA sequence
tttttaatagaaaagagaac

SEQ ID NO: 190904 - DNA, 20 bp, Artificial
  CRISPR gRNA sequence
ttttaatagaaaagagaaca

SEQ ID NO: 190905 - DNA, 20 bp, Artificial
  CRISPR gRNA sequence
taatagaaaagagaacaggg

SEQ ID NO: 190906 - DNA, 20 bp, Artificial
  CRISPR gRNA sequence
aatagaaaagagaacaggga

SEQ ID NO: 190907 - DNA, 20 bp, Artificial
  CRISPR gRNA sequence
aagagaacagggaaggaaca

SEQ ID NO: 190908 - DNA, 20 bp, Artificial
  CRISPR gRNA sequence
agagaacagggaaggaacac

SEQ ID NO: 190909 - DNA, 20 bp, Artificial
  CRISPR gRNA sequence
aacagggaaggaacacaggt

SEQ ID NO: 190910 - DNA, 20 bp, Artificial
  CRISPR gRNA sequence
gaaggaacacaggtcagtgt

SEQ ID NO: 190911 - DNA, 20 bp, Artificial
  CRISPR gRNA sequence
aaggaacacaggtcagtgtg

SEQ ID NO: 190912 - DNA, 20 bp, Artificial
  CRISPR gRNA sequence
gaacacaggtcagtgtgagg

SEQ ID NO: 190913 - DNA, 20 bp, Artificial
  CRISPR gRNA sequence
aacacaggtcagtgtgagga

SEQ ID NO: 190914 - DNA, 20 bp, Artificial
  CRISPR gRNA sequence
acacaggtcagtgtgaggaa

SEQ ID NO: 190915 - DNA, 20 bp, Artificial
  CRISPR gRNA sequence
cacaggtcagtgtgaggaag

SEQ ID NO: 190916 - DNA, 20 bp, Artificial
  CRISPR gRNA sequence
acaggtcagtgtgaggaagg

SEQ ID NO: 190917 - DNA, 20 bp, Artificial
  CRISPR gRNA sequence
cagtgtgaggaagggggtca

SEQ ID NO: 190918 - DNA, 20 bp, Artificial
  CRISPR gRNA sequence
tgtgaggaagggggtcatgg

SEQ ID NO: 190919 - DNA, 20 bp, Artificial
  CRISPR gRNA sequence
gaagggggtcatggtagaca

SEQ ID NO: 190920 - DNA, 20 bp, Artificial
  CRISPR gRNA sequence
agggggtcatggtagacaca

SEQ ID NO: 190921 - DNA, 20 bp, Artificial
  CRISPR gRNA sequence
gggggtcatggtagacacag

SEQ ID NO: 190922 - DNA, 20 bp, Artificial
  CRISPR gRNA sequence
ggtcatggtagacacagagg

SEQ ID NO: 190923 - DNA, 20 bp, Artificial
  CRISPR gRNA sequence
acctcctcacattgtgctaa

SEQ ID NO: 190924 - DNA, 20 bp, Artificial
  CRISPR gRNA sequence
cctcctcacattgtgctaac

SEQ ID NO: 190925 - DNA, 20 bp, Artificial
  CRISPR gRNA sequence
ctcctcacattgtgctaaca

SEQ ID NO: 190926 - DNA, 20 bp, Artificial
  CRISPR gRNA sequence
acattgtgctaacagggaca

SEQ ID NO: 190927 - DNA, 20 bp, Artificial
  CRISPR gRNA sequence
tgtgctaacagggacacaga

SEQ ID NO: 190928 - DNA, 20 bp, Artificial
  CRISPR gRNA sequence
aacagggacacagacagatt

SEQ ID NO: 190929 - DNA, 20 bp, Artificial
  CRISPR gRNA sequence
cagggacacagacagattca

SEQ ID NO: 190930 - DNA, 20 bp, Artificial
  CRISPR gRNA sequence
agggacacagacagattcag

SEQ ID NO: 190931 - DNA, 20 bp, Artificial
  CRISPR gRNA sequence
gattcagaggcccttgcaaa

SEQ ID NO: 190932 - DNA, 20 bp, Artificial
  CRISPR gRNA sequence
ttcagaggcccttgcaaaaa

SEQ ID NO: 190933 - DNA, 20 bp, Artificial
  CRISPR gRNA sequence
agaggcccttgcaaaaagag

SEQ ID NO: 190934 - DNA, 20 bp, Artificial
  CRISPR gRNA sequence
gcccttgcaaaaagagaagc

SEQ ID NO: 190935 - DNA, 20 bp, Artificial
  CRISPR gRNA sequence
ccttgcaaaaagagaagcca

SEQ ID NO: 190936 - DNA, 20 bp, Artificial
  CRISPR gRNA sequence
aagagaagccagagtcccct

SEQ ID NO: 190937 - DNA, 20 bp, Artificial
  CRISPR gRNA sequence
ccagagtcccctaagacaca

SEQ ID NO: 190938 - DNA, 20 bp, Artificial
  CRISPR gRNA sequence
cagagtcccctaagacacat

SEQ ID NO: 190939 - DNA, 20 bp, Artificial
  CRISPR gRNA sequence
agagtcccctaagacacata

SEQ ID NO: 190940 - DNA, 20 bp, Artificial
  CRISPR gRNA sequence
gagtcccctaagacacatag

SEQ ID NO: 190941 - DNA, 20 bp, Artificial
  CRISPR gRNA sequence
gtcccctaagacacataggg

SEQ ID NO: 190942 - DNA, 20 bp, Artificial
  CRISPR gRNA sequence
tcccctaagacacatagggg

SEQ ID NO: 190943 - DNA, 20 bp, Artificial
  CRISPR gRNA sequence
aagacacataggggaggcgt

SEQ ID NO: 190944 - DNA, 20 bp, Artificial
  CRISPR gRNA sequence
agacacataggggaggcgtg

SEQ ID NO: 190945 - DNA, 20 bp, Artificial
  CRISPR gRNA sequence
cgtgaggaaatcctgcatct

SEQ ID NO: 190946 - DNA, 20 bp, Artificial
  CRISPR gRNA sequence
cctgcatctcagtcgcacac

SEQ ID NO: 190947 - DNA, 20 bp, Artificial
  CRISPR gRNA sequence
ctgcatctcagtcgcacaca

SEQ ID NO: 190948 - DNA, 20 bp, Artificial
  CRISPR gRNA sequence
catctcagtcgcacacaagg

SEQ ID NO: 190949 - DNA, 20 bp, Artificial
  CRISPR gRNA sequence
cacaaggcagctgtgcatct

SEQ ID NO: 190950 - DNA, 20 bp, Artificial
  CRISPR gRNA sequence
tgtgcatctcagtcgcacac

SEQ ID NO: 190951 - DNA, 20 bp, Artificial
  CRISPR gRNA sequence
gtgcatctcagtcgcacaca

SEQ ID NO: 190952 - DNA, 20 bp, Artificial
  CRISPR gRNA sequence
catctcagtcgcacacaagg

SEQ ID NO: 190953 - DNA, 20 bp, Artificial
  CRISPR gRNA sequence
cgcacacaaggcagctgtct

SEQ ID NO: 190954 - DNA, 20 bp, Artificial
  CRISPR gRNA sequence
gcacacaaggcagctgtctc

SEQ ID NO: 190955 - DNA, 20 bp, Artificial
  CRISPR gRNA sequence
aaggcagctgtctcaggcta

SEQ ID NO: 190956 - DNA, 20 bp, Artificial
  CRISPR gRNA sequence
gcagctgtctcaggctacag

SEQ ID NO: 190957 - DNA, 20 bp, Artificial
  CRISPR gRNA sequence
tctcaggctacagaagaaaa

SEQ ID NO: 190958 - DNA, 20 bp, Artificial
  CRISPR gRNA sequence
aaaatagtcatgaacaaatt

SEQ ID NO: 190959 - DNA, 20 bp, Artificial
  CRISPR gRNA sequence
aaatagtcatgaacaaattc

SEQ ID NO: 190960 - DNA, 20 bp, Artificial
  CRISPR gRNA sequence
agtcatgaacaaattcaggt

SEQ ID NO: 190961 - DNA, 20 bp, Artificial
  CRISPR gRNA sequence
gaacaaattcaggtcagtca

SEQ ID NO: 190962 - DNA, 20 bp, Artificial
  CRISPR gRNA sequence
aaattcaggtcagtcacggt

SEQ ID NO: 190963 - DNA, 20 bp, Artificial
  CRISPR gRNA sequence
gtaagtgatgacactctgaa

SEQ ID NO: 190964 - DNA, 20 bp, Artificial
  CRISPR gRNA sequence
atcaaaaaatccccacaacc

SEQ ID NO: 190965 - DNA, 20 bp, Artificial
  CRISPR gRNA sequence
gccccaccctccacccactt

SEQ ID NO: 190966 - DNA, 20 bp, Artificial
  CRISPR gRNA sequence
ctccacccacttcagacccc

SEQ ID NO: 190967 - DNA, 20 bp, Artificial
  CRISPR gRNA sequence
ccccagaatctcacctttac

SEQ ID NO: 190968 - DNA, 20 bp, Artificial
  CRISPR gRNA sequence
atctcacctttacaagctgt

SEQ ID NO: 190969 - DNA, 20 bp, Artificial
  CRISPR gRNA sequence
cctttacaagctgtgagact

SEQ ID NO: 190970 - DNA, 20 bp, Artificial
  CRISPR gRNA sequence
agctgtgagactcagacccc

SEQ ID NO: 190971 - DNA, 20 bp, Artificial
  CRISPR gRNA sequence
gctgtgagactcagacccct

SEQ ID NO: 190972 - DNA, 20 bp, Artificial
  CRISPR gRNA sequence
ccctgggcactgtcgctccc

SEQ ID NO: 190973 - DNA, 20 bp, Artificial
  CRISPR gRNA sequence
cctgggcactgtcgctccct

SEQ ID NO: 190974 - DNA, 20 bp, Artificial
  CRISPR gRNA sequence
ctgggcactgtcgctccctg

SEQ ID NO: 190975 - DNA, 20 bp, Artificial
  CRISPR gRNA sequence
ggcactgtcgctccctgggg

SEQ ID NO: 190976 - DNA, 20 bp, Artificial
  CRISPR gRNA sequence
ccctggggtagaacaaaaac

SEQ ID NO: 190977 - DNA, 20 bp, Artificial
  CRISPR gRNA sequence
ggtagaacaaaaacaagacc

SEQ ID NO: 190978 - DNA, 20 bp, Artificial
  CRISPR gRNA sequence
gaacaaaaacaagacctggt

SEQ ID NO: 190979 - DNA, 20 bp, Artificial
  CRISPR gRNA sequence
acaaaaacaagacctggtca

SEQ ID NO: 190980 - DNA, 20 bp, Artificial
  CRISPR gRNA sequence
caagacctggtcagagccca

SEQ ID NO: 190981 - DNA, 20 bp, Artificial
  CRISPR gRNA sequence
aagacctggtcagagcccac

SEQ ID NO: 190982 - DNA, 20 bp, Artificial
  CRISPR gRNA sequence
gacctggtcagagcccacag

SEQ ID NO: 190983 - DNA, 20 bp, Artificial
  CRISPR gRNA sequence
gtcagagcccacaggagatg

SEQ ID NO: 190984 - DNA, 20 bp, Artificial
  CRISPR gRNA sequence
agcccacaggagatgtggtg

SEQ ID NO: 190985 - DNA, 20 bp, Artificial
  CRISPR gRNA sequence
gcccacaggagatgtggtgc

SEQ ID NO: 190986 - DNA, 20 bp, Artificial
  CRISPR gRNA sequence
ccacaggagatgtggtgcag

SEQ ID NO: 190987 - DNA, 20 bp, Artificial
  CRISPR gRNA sequence
cacaggagatgtggtgcagg

SEQ ID NO: 190988 - DNA, 20 bp, Artificial
  CRISPR gRNA sequence
atgtggtgcaggaggaatta

SEQ ID NO: 190989 - DNA, 20 bp, Artificial
  CRISPR gRNA sequence
tgtggtgcaggaggaattat

SEQ ID NO: 190990 - DNA, 20 bp, Artificial
  CRISPR gRNA sequence
gtggtgcaggaggaattata

SEQ ID NO: 190991 - DNA, 20 bp, Artificial
  CRISPR gRNA sequence
gtgcaggaggaattataggg

SEQ ID NO: 190992 - DNA, 20 bp, Artificial
  CRISPR gRNA sequence
tgcaggaggaattatagggt

SEQ ID NO: 190993 - DNA, 20 bp, Artificial
  CRISPR gRNA sequence
ggaggaattatagggtgggc

SEQ ID NO: 190994 - DNA, 20 bp, Artificial
  CRISPR gRNA sequence
tcccgccccgcacttacact

SEQ ID NO: 190995 - DNA, 20 bp, Artificial
  CRISPR gRNA sequence
cccgcacttacactcagcct

SEQ ID NO: 190996 - DNA, 20 bp, Artificial
  CRISPR gRNA sequence
cgcacttacactcagcctta

SEQ ID NO: 190997 - DNA, 20 bp, Artificial
  CRISPR gRNA sequence
acttacactcagccttagag

SEQ ID NO: 190998 - DNA, 20 bp, Artificial
  CRISPR gRNA sequence
ctccctccttttccacctgt

SEQ ID NO: 190999 - DNA, 20 bp, Artificial
  CRISPR gRNA sequence
cctccttttccacctgttgg

SEQ ID NO: 191000 - DNA, 20 bp, Artificial
  CRISPR gRNA sequence
gttggaagaaaatgtcctgt

SEQ ID NO: 191001 - DNA, 20 bp, Artificial
  CRISPR gRNA sequence
ttggaagaaaatgtcctgtg

SEQ ID NO: 191002 - DNA, 20 bp, Artificial
  CRISPR gRNA sequence
tggaagaaaatgtcctgtga

SEQ ID NO: 191003 - DNA, 20 bp, Artificial
  CRISPR gRNA sequence
ggaagaaaatgtcctgtgag

SEQ ID NO: 191004 - DNA, 20 bp, Artificial
  CRISPR gRNA sequence
gaaaatgtcctgtgaggggc

SEQ ID NO: 191005 - DNA, 20 bp, Artificial
  CRISPR gRNA sequence
aaaatgtcctgtgaggggcc

SEQ ID NO: 191006 - DNA, 20 bp, Artificial
  CRISPR gRNA sequence
aaatgtcctgtgaggggcca

SEQ ID NO: 191007 - DNA, 20 bp, Artificial
  CRISPR gRNA sequence
atgtcctgtgaggggccagg

SEQ ID NO: 191008 - DNA, 20 bp, Artificial
  CRISPR gRNA sequence
tgtcctgtgaggggccaggg

SEQ ID NO: 191009 - DNA, 20 bp, Artificial
  CRISPR gRNA sequence
tcctgtgaggggccagggag

SEQ ID NO: 191010 - DNA, 20 bp, Artificial
  CRISPR gRNA sequence
cctgtgaggggccagggagg

SEQ ID NO: 191011 - DNA, 20 bp, Artificial
  CRISPR gRNA sequence
gtgaggggccagggaggagg

SEQ ID NO: 191012 - DNA, 20 bp, Artificial
  CRISPR gRNA sequence
tgaggggccagggaggaggc

SEQ ID NO: 191013 - DNA, 20 bp, Artificial
  CRISPR gRNA sequence
gaggggccagggaggaggca

SEQ ID NO: 191014 - DNA, 20 bp, Artificial
  CRISPR gRNA sequence
cagggaggaggcagggccat

SEQ ID NO: 191015 - DNA, 20 bp, Artificial
  CRISPR gRNA sequence
agggaggaggcagggccata

SEQ ID NO: 191016 - DNA, 20 bp, Artificial
  CRISPR gRNA sequence
gaggcagggccataaggtcc

SEQ ID NO: 191017 - DNA, 20 bp, Artificial
  CRISPR gRNA sequence
ggcagggccataaggtccta

SEQ ID NO: 191018 - DNA, 20 bp, Artificial
  CRISPR gRNA sequence
gcagggccataaggtcctag

SEQ ID NO: 191019 - DNA, 20 bp, Artificial
  CRISPR gRNA sequence
aaggtcctagaggaacctcc

SEQ ID NO: 191020 - DNA, 20 bp, Artificial
  CRISPR gRNA sequence
ctagaggaacctcctagttt

SEQ ID NO: 191021 - DNA, 20 bp, Artificial
  CRISPR gRNA sequence
aacctcctagttttggatcc

SEQ ID NO: 191022 - DNA, 20 bp, Artificial
  CRISPR gRNA sequence
cctcctagttttggatccca

SEQ ID NO: 191023 - DNA, 20 bp, Artificial
  CRISPR gRNA sequence
cctagttttggatcccagag

SEQ ID NO: 191024 - DNA, 20 bp, Artificial
  CRISPR gRNA sequence
agtttcctgaactgtgactg

SEQ ID NO: 191025 - DNA, 20 bp, Artificial
  CRISPR gRNA sequence
ctgaactgtgactgcagacc

SEQ ID NO: 191026 - DNA, 20 bp, Artificial
  CRISPR gRNA sequence
tgaactgtgactgcagaccc

SEQ ID NO: 191027 - DNA, 20 bp, Artificial
  CRISPR gRNA sequence
gaactgtgactgcagaccca

SEQ ID NO: 191028 - DNA, 20 bp, Artificial
  CRISPR gRNA sequence
ctgtgactgcagacccaggg

SEQ ID NO: 191029 - DNA, 20 bp, Artificial
  CRISPR gRNA sequence
tgtgactgcagacccagggc

SEQ ID NO: 191030 - DNA, 20 bp, Artificial
  CRISPR gRNA sequence
ctgcagacccagggcaggat

SEQ ID NO: 191031 - DNA, 20 bp, Artificial
  CRISPR gRNA sequence
tgcagacccagggcaggatc

SEQ ID NO: 191032 - DNA, 20 bp, Artificial
  CRISPR gRNA sequence
gggcaggatcaggaaacgtg

SEQ ID NO: 191033 - DNA, 20 bp, Artificial
  CRISPR gRNA sequence
aggatcaggaaacgtgaaga

SEQ ID NO: 191034 - DNA, 20 bp, Artificial
  CRISPR gRNA sequence
atcaggaaacgtgaagaaag

SEQ ID NO: 191035 - DNA, 20 bp, Artificial
  CRISPR gRNA sequence
tcaggaaacgtgaagaaagc

SEQ ID NO: 191036 - DNA, 20 bp, Artificial
  CRISPR gRNA sequence
aaacgtgaagaaagcaggtg

SEQ ID NO: 191037 - DNA, 20 bp, Artificial
  CRISPR gRNA sequence
aacgtgaagaaagcaggtgt

SEQ ID NO: 191038 - DNA, 20 bp, Artificial
  CRISPR gRNA sequence
aagaaagcaggtgtgggtcc

SEQ ID NO: 191039 - DNA, 20 bp, Artificial
  CRISPR gRNA sequence
cctggatcaactgcccttct

SEQ ID NO: 191040 - DNA, 20 bp, Artificial
  CRISPR gRNA sequence
ctggatcaactgcccttctg

SEQ ID NO: 191041 - DNA, 20 bp, Artificial
  CRISPR gRNA sequence
gcccttctgaggtctgtctt

SEQ ID NO: 191042 - DNA, 20 bp, Artificial
  CRISPR gRNA sequence
cttctgaggtctgtcttcag

SEQ ID NO: 191043 - DNA, 20 bp, Artificial
  CRISPR gRNA sequence
ttctgaggtctgtcttcagc

SEQ ID NO: 191044 - DNA, 20 bp, Artificial
  CRISPR gRNA sequence
tctgaggtctgtcttcagca

SEQ ID NO: 191045 - DNA, 20 bp, Artificial
  CRISPR gRNA sequence
cccctgtgacctgtgactgc

SEQ ID NO: 191046 - DNA, 20 bp, Artificial
  CRISPR gRNA sequence
ccctgtgacctgtgactgct

SEQ ID NO: 191047 - DNA, 20 bp, Artificial
  CRISPR gRNA sequence
tgacctgtgactgctgggat

SEQ ID NO: 191048 - DNA, 20 bp, Artificial
  CRISPR gRNA sequence
gacctgtgactgctgggatc

SEQ ID NO: 191049 - DNA, 20 bp, Artificial
  CRISPR gRNA sequence
tccccatcaccacaatcgtc

SEQ ID NO: 191050 - DNA, 20 bp, Artificial
  CRISPR gRNA sequence
ccccatcaccacaatcgtca

SEQ ID NO: 191051 - DNA, 20 bp, Artificial
  CRISPR gRNA sequence
aaatctgtccttcattgtca

SEQ ID NO: 191052 - DNA, 20 bp, Artificial
  CRISPR gRNA sequence
aatctgtccttcattgtcac

SEQ ID NO: 191053 - DNA, 20 bp, Artificial
  CRISPR gRNA sequence
ttgtcacaggtgctttacaa

SEQ ID NO: 191054 - DNA, 20 bp, Artificial
  CRISPR gRNA sequence
gtcacaggtgctttacaaaa

SEQ ID NO: 191055 - DNA, 20 bp, Artificial
  CRISPR gRNA sequence
acaggtgctttacaaaagag

SEQ ID NO: 191056 - DNA, 20 bp, Artificial
  CRISPR gRNA sequence
caggtgctttacaaaagagt

SEQ ID NO: 191057 - DNA, 20 bp, Artificial
  CRISPR gRNA sequence
gctttacaaaagagtaggtg

SEQ ID NO: 191058 - DNA, 20 bp, Artificial
  CRISPR gRNA sequence
tacaaaagagtaggtgcggc

SEQ ID NO: 191059 - DNA, 20 bp, Artificial
  CRISPR gRNA sequence
acaaaagagtaggtgcggct

SEQ ID NO: 191060 - DNA, 20 bp, Artificial
  CRISPR gRNA sequence
agagtaggtgcggctgggtg

SEQ ID NO: 191061 - DNA, 20 bp, Artificial
  CRISPR gRNA sequence
gtaggtgcggctgggtgcgg

SEQ ID NO: 191062 - DNA, 20 bp, Artificial
  CRISPR gRNA sequence
gtggctcacgactgtaatcc

SEQ ID NO: 191063 - DNA, 20 bp, Artificial
  CRISPR gRNA sequence
cgactgtaatcccagcactt

SEQ ID NO: 191064 - DNA, 20 bp, Artificial
  CRISPR gRNA sequence
gactgtaatcccagcacttt

SEQ ID NO: 191065 - DNA, 20 bp, Artificial
  CRISPR gRNA sequence
ctgtaatcccagcactttgg

SEQ ID NO: 191066 - DNA, 20 bp, Artificial
  CRISPR gRNA sequence
tgtaatcccagcactttggg

SEQ ID NO: 191067 - DNA, 20 bp, Artificial
  CRISPR gRNA sequence
tcccagcactttgggaggcc

SEQ ID NO: 191068 - DNA, 20 bp, Artificial
  CRISPR gRNA sequence
cccagcactttgggaggccg

SEQ ID NO: 191069 - DNA, 20 bp, Artificial
  CRISPR gRNA sequence
agcactttgggaggccgagg

SEQ ID NO: 191070 - DNA, 20 bp, Artificial
  CRISPR gRNA sequence
gcactttgggaggccgaggc

SEQ ID NO: 191071 - DNA, 20 bp, Artificial
  CRISPR gRNA sequence
ctttgggaggccgaggcagg

SEQ ID NO: 191072 - DNA, 20 bp, Artificial
  CRISPR gRNA sequence
gccgaggcaggcagatcaca

SEQ ID NO: 191073 - DNA, 20 bp, Artificial
  CRISPR gRNA sequence
aggcaggcagatcacaaagt

SEQ ID NO: 191074 - DNA, 20 bp, Artificial
  CRISPR gRNA sequence
ggcaggcagatcacaaagtc

SEQ ID NO: 191075 - DNA, 20 bp, Artificial
  CRISPR gRNA sequence
caggcagatcacaaagtcag

SEQ ID NO: 191076 - DNA, 20 bp, Artificial
  CRISPR gRNA sequence
gatcacaaagtcaggagttc

SEQ ID NO: 191077 - DNA, 20 bp, Artificial
  CRISPR gRNA sequence
caaagtcaggagttcgagac

SEQ ID NO: 191078 - DNA, 20 bp, Artificial
  CRISPR gRNA sequence
tcaggagttcgagaccagcc

SEQ ID NO: 191079 - DNA, 20 bp, Artificial
  CRISPR gRNA sequence
cgagaccagcctggccaaca

SEQ ID NO: 191080 - DNA, 20 bp, Artificial
  CRISPR gRNA sequence
aaaaatacaaaaaaaaaaat

SEQ ID NO: 191081 - DNA, 20 bp, Artificial
  CRISPR gRNA sequence
atacaaaaaaaaaaattagc

SEQ ID NO: 191082 - DNA, 20 bp, Artificial
  CRISPR gRNA sequence
tacaaaaaaaaaaattagcc

SEQ ID NO: 191083 - DNA, 20 bp, Artificial
  CRISPR gRNA sequence
aaaaaaaaattagccaggtg

SEQ ID NO: 191084 - DNA, 20 bp, Artificial
  CRISPR gRNA sequence
aaaaaattagccaggtgtgg

SEQ ID NO: 191085 - DNA, 20 bp, Artificial
  CRISPR gRNA sequence
ggtgtggtggcacgcatgtg

SEQ ID NO: 191086 - DNA, 20 bp, Artificial
  CRISPR gRNA sequence
gtggcacgcatgtgtagtcc

SEQ ID NO: 191087 - DNA, 20 bp, Artificial
  CRISPR gRNA sequence
gcatgtgtagtcccagctac

SEQ ID NO: 191088 - DNA, 20 bp, Artificial
  CRISPR gRNA sequence
catgtgtagtcccagctact

SEQ ID NO: 191089 - DNA, 20 bp, Artificial
  CRISPR gRNA sequence
atgtgtagtcccagctacta

SEQ ID NO: 191090 - DNA, 20 bp, Artificial
  CRISPR gRNA sequence
gtgtagtcccagctactagg

SEQ ID NO: 191091 - DNA, 20 bp, Artificial
  CRISPR gRNA sequence
tgtagtcccagctactaggg

SEQ ID NO: 191092 - DNA, 20 bp, Artificial
  CRISPR gRNA sequence
tcccagctactagggaggct

SEQ ID NO: 191093 - DNA, 20 bp, Artificial
  CRISPR gRNA sequence
cccagctactagggaggctg

SEQ ID NO: 191094 - DNA, 20 bp, Artificial
  CRISPR gRNA sequence
agctactagggaggctgagg

SEQ ID NO: 191095 - DNA, 20 bp, Artificial
  CRISPR gRNA sequence
gctactagggaggctgaggc

SEQ ID NO: 191096 - DNA, 20 bp, Artificial
  CRISPR gRNA sequence
tactagggaggctgaggcag

SEQ ID NO: 191097 - DNA, 20 bp, Artificial
  CRISPR gRNA sequence
gcaggagaattgcttgaacc

SEQ ID NO: 191098 - DNA, 20 bp, Artificial
  CRISPR gRNA sequence
caggagaattgcttgaacct

SEQ ID NO: 191099 - DNA, 20 bp, Artificial
  CRISPR gRNA sequence
ggagaattgcttgaacctgg

SEQ ID NO: 191100 - DNA, 20 bp, Artificial
  CRISPR gRNA sequence
gagaattgcttgaacctggg

SEQ ID NO: 191101 - DNA, 20 bp, Artificial
  CRISPR gRNA sequence
aattgcttgaacctgggagg

SEQ ID NO: 191102 - DNA, 20 bp, Artificial
  CRISPR gRNA sequence
ttgcttgaacctgggaggcg

SEQ ID NO: 191103 - DNA, 20 bp, Artificial
  CRISPR gRNA sequence
tgcttgaacctgggaggcgg

SEQ ID NO: 191104 - DNA, 20 bp, Artificial
  CRISPR gRNA sequence
aacctgggaggcggaggttg

SEQ ID NO: 191105 - DNA, 20 bp, Artificial
  CRISPR gRNA sequence
tgggaggcggaggttgcagt

SEQ ID NO: 191106 - DNA, 20 bp, Artificial
  CRISPR gRNA sequence
gaaaccacgccattgcactc

SEQ ID NO: 191107 - DNA, 20 bp, Artificial
  CRISPR gRNA sequence
cacgccattgcactccagcc

SEQ ID NO: 191108 - DNA, 20 bp, Artificial
  CRISPR gRNA sequence
acgccattgcactccagcct

SEQ ID NO: 191109 - DNA, 20 bp, Artificial
  CRISPR gRNA sequence
ttgcactccagcctgggtga

SEQ ID NO: 191110 - DNA, 20 bp, Artificial
  CRISPR gRNA sequence
gcactccagcctgggtgaca

SEQ ID NO: 191111 - DNA, 20 bp, Artificial
  CRISPR gRNA sequence
ccagcctgggtgacagagcc

SEQ ID NO: 191112 - DNA, 20 bp, Artificial
  CRISPR gRNA sequence
aagactccgtctcaaaaaaa

SEQ ID NO: 191113 - DNA, 20 bp, Artificial
  CRISPR gRNA sequence
gactccgtctcaaaaaaaaa

SEQ ID NO: 191114 - DNA, 20 bp, Artificial
  CRISPR gRNA sequence
tccgtctcaaaaaaaaagag

SEQ ID NO: 191115 - DNA, 20 bp, Artificial
  CRISPR gRNA sequence
ccgtctcaaaaaaaaagagt

SEQ ID NO: 191116 - DNA, 20 bp, Artificial
  CRISPR gRNA sequence
caaaaaaaaagagtaggtgc

SEQ ID NO: 191117 - DNA, 20 bp, Artificial
  CRISPR gRNA sequence
aaagagtaggtgctggcaca

SEQ ID NO: 191118 - DNA, 20 bp, Artificial
  CRISPR gRNA sequence
aagagtaggtgctggcacac

SEQ ID NO: 191119 - DNA, 20 bp, Artificial
  CRISPR gRNA sequence
agagtaggtgctggcacaca

SEQ ID NO: 191120 - DNA, 20 bp, Artificial
  CRISPR gRNA sequence
ggtgctggcacacagggccc

SEQ ID NO: 191121 - DNA, 20 bp, Artificial
  CRISPR gRNA sequence
gtgctggcacacagggcccc

SEQ ID NO: 191122 - DNA, 20 bp, Artificial
  CRISPR gRNA sequence
tggcacacagggccccaggc

SEQ ID NO: 191123 - DNA, 20 bp, Artificial
  CRISPR gRNA sequence
ggcacacagggccccaggct

SEQ ID NO: 191124 - DNA, 20 bp, Artificial
  CRISPR gRNA sequence
acacagggccccaggctggg

SEQ ID NO: 191125 - DNA, 20 bp, Artificial
  CRISPR gRNA sequence
cacagggccccaggctgggt

SEQ ID NO: 191126 - DNA, 20 bp, Artificial
  CRISPR gRNA sequence
gctgggtaggctcgtgtgtg

SEQ ID NO: 191127 - DNA, 20 bp, Artificial
  CRISPR gRNA sequence
ggtaggctcgtgtgtgtgga

SEQ ID NO: 191128 - DNA, 20 bp, Artificial
  CRISPR gRNA sequence
tgtgtgtggatggtgcttcc

SEQ ID NO: 191129 - DNA, 20 bp, Artificial
  CRISPR gRNA sequence
ggatggtgcttcccagtaac

SEQ ID NO: 191130 - DNA, 20 bp, Artificial
  CRISPR gRNA sequence
gatggtgcttcccagtaacg

SEQ ID NO: 191131 - DNA, 20 bp, Artificial
  CRISPR gRNA sequence
ggtgcttcccagtaacgagg

SEQ ID NO: 191132 - DNA, 20 bp, Artificial
  CRISPR gRNA sequence
gtgcttcccagtaacgaggc

SEQ ID NO: 191133 - DNA, 20 bp, Artificial
  CRISPR gRNA sequence
aggcaggacacacttttacc

SEQ ID NO: 191134 - DNA, 20 bp, Artificial
  CRISPR gRNA sequence
ggcaggacacacttttacct

SEQ ID NO: 191135 - DNA, 20 bp, Artificial
  CRISPR gRNA sequence
gcaggacacacttttaccta

SEQ ID NO: 191136 - DNA, 20 bp, Artificial
  CRISPR gRNA sequence
tacctagggcttgaaacacc

SEQ ID NO: 191137 - DNA, 20 bp, Artificial
  CRISPR gRNA sequence
ctagggcttgaaacacccag

SEQ ID NO: 191138 - DNA, 20 bp, Artificial
  CRISPR gRNA sequence
tagggcttgaaacacccagt

SEQ ID NO: 191139 - DNA, 20 bp, Artificial
  CRISPR gRNA sequence
cttgaaacacccagtgggac

SEQ ID NO: 191140 - DNA, 20 bp, Artificial
  CRISPR gRNA sequence
cccagtgggacaagaaaact

SEQ ID NO: 191141 - DNA, 20 bp, Artificial
  CRISPR gRNA sequence
cccttctcccttccccacct

SEQ ID NO: 191142 - DNA, 20 bp, Artificial
  CRISPR gRNA sequence
gctcttcttcctccatatca

SEQ ID NO: 191143 - DNA, 20 bp, Artificial
  CRISPR gRNA sequence
cttcttcctccatatcacag

SEQ ID NO: 191144 - DNA, 20 bp, Artificial
  CRISPR gRNA sequence
ccatatcacagcagcaacca

SEQ ID NO: 191145 - DNA, 20 bp, Artificial
  CRISPR gRNA sequence
cacagcagcaaccacagctc

SEQ ID NO: 191146 - DNA, 20 bp, Artificial
  CRISPR gRNA sequence
cagcagcaaccacagctcca

SEQ ID NO: 191147 - DNA, 20 bp, Artificial
  CRISPR gRNA sequence
aaccacagctccagagacca

SEQ ID NO: 191148 - DNA, 20 bp, Artificial
  CRISPR gRNA sequence
gctccagagaccacagatcc

SEQ ID NO: 191149 - DNA, 20 bp, Artificial
  CRISPR gRNA sequence
ctccagagaccacagatcca

SEQ ID NO: 191150 - DNA, 20 bp, Artificial
  CRISPR gRNA sequence
ccagagaccacagatccaag

SEQ ID NO: 191151 - DNA, 20 bp, Artificial
  CRISPR gRNA sequence
accacagatccaaggagaac

SEQ ID NO: 191152 - DNA, 20 bp, Artificial
  CRISPR gRNA sequence
ccacagatccaaggagaacc

SEQ ID NO: 191153 - DNA, 20 bp, Artificial
  CRISPR gRNA sequence
agatccaaggagaaccaggc

SEQ ID NO: 191154 - DNA, 20 bp, Artificial
  CRISPR gRNA sequence
gccagcaatgatgcccacga

SEQ ID NO: 191155 - DNA, 20 bp, Artificial
  CRISPR gRNA sequence
ccagcaatgatgcccacgat

SEQ ID NO: 191156 - DNA, 20 bp, Artificial
  CRISPR gRNA sequence
cagcaatgatgcccacgatg

SEQ ID NO: 191157 - DNA, 20 bp, Artificial
  CRISPR gRNA sequence
aatgatgcccacgatgggga

SEQ ID NO: 191158 - DNA, 20 bp, Artificial
  CRISPR gRNA sequence
gatgcccacgatggggatgg

SEQ ID NO: 191159 - DNA, 20 bp, Artificial
  CRISPR gRNA sequence
atgcccacgatggggatggt

SEQ ID NO: 191160 - DNA, 20 bp, Artificial
  CRISPR gRNA sequence
ccacgatggggatggtgggc

SEQ ID NO: 191161 - DNA, 20 bp, Artificial
  CRISPR gRNA sequence
cacgatggggatggtgggct

SEQ ID NO: 191162 - DNA, 20 bp, Artificial
  CRISPR gRNA sequence
gatggggatggtgggctggg

SEQ ID NO: 191163 - DNA, 20 bp, Artificial
  CRISPR gRNA sequence
gggatggtgggctgggaagc

SEQ ID NO: 191164 - DNA, 20 bp, Artificial
  CRISPR gRNA sequence
gtgggctgggaagccggctc

SEQ ID NO: 191165 - DNA, 20 bp, Artificial
  CRISPR gRNA sequence
tgggctgggaagccggctct

SEQ ID NO: 191166 - DNA, 20 bp, Artificial
  CRISPR gRNA sequence
tgggaagccggctctgggaa

SEQ ID NO: 191167 - DNA, 20 bp, Artificial
  CRISPR gRNA sequence
ggaagccggctctgggaaaa

SEQ ID NO: 191168 - DNA, 20 bp, Artificial
  CRISPR gRNA sequence
gaagccggctctgggaaaag

SEQ ID NO: 191169 - DNA, 20 bp, Artificial
  CRISPR gRNA sequence
aagccggctctgggaaaaga

SEQ ID NO: 191170 - DNA, 20 bp, Artificial
  CRISPR gRNA sequence
agccggctctgggaaaagag

SEQ ID NO: 191171 - DNA, 20 bp, Artificial
  CRISPR gRNA sequence
ctgggaaaagaggggaacgt

SEQ ID NO: 191172 - DNA, 20 bp, Artificial
  CRISPR gRNA sequence
tgggaaaagaggggaacgta

SEQ ID NO: 191173 - DNA, 20 bp, Artificial
  CRISPR gRNA sequence
gggaaaagaggggaacgtaa

SEQ ID NO: 191174 - DNA, 20 bp, Artificial
  CRISPR gRNA sequence
ggaaaagaggggaacgtaag

SEQ ID NO: 191175 - DNA, 20 bp, Artificial
  CRISPR gRNA sequence
acgtaaggggccctgacccc

SEQ ID NO: 191176 - DNA, 20 bp, Artificial
  CRISPR gRNA sequence
cgtaaggggccctgaccccc

SEQ ID NO: 191177 - DNA, 20 bp, Artificial
  CRISPR gRNA sequence
gggccctgacccccaggcct

SEQ ID NO: 191178 - DNA, 20 bp, Artificial
  CRISPR gRNA sequence
aggcctcagccctgaccctg

SEQ ID NO: 191179 - DNA, 20 bp, Artificial
  CRISPR gRNA sequence
cctcagccctgaccctgcgg

SEQ ID NO: 191180 - DNA, 20 bp, Artificial
  CRISPR gRNA sequence
ctcagccctgaccctgcgga

SEQ ID NO: 191181 - DNA, 20 bp, Artificial
  CRISPR gRNA sequence
tcagccctgaccctgcggaa

SEQ ID NO: 191182 - DNA, 20 bp, Artificial
  CRISPR gRNA sequence
ctgaccctgcggaagggctc

SEQ ID NO: 191183 - DNA, 20 bp, Artificial
  CRISPR gRNA sequence
accctgcggaagggctccag

SEQ ID NO: 191184 - DNA, 20 bp, Artificial
  CRISPR gRNA sequence
ccctgcggaagggctccaga

SEQ ID NO: 191185 - DNA, 20 bp, Artificial
  CRISPR gRNA sequence
cctgcggaagggctccagaa

SEQ ID NO: 191186 - DNA, 20 bp, Artificial
  CRISPR gRNA sequence
gaagggctcccgctttccct

SEQ ID NO: 191187 - DNA, 20 bp, Artificial
  CRISPR gRNA sequence
gggctcccgctttccctgag

SEQ ID NO: 191188 - DNA, 20 bp, Artificial
  CRISPR gRNA sequence
gctcccgctttccctgagaa

SEQ ID NO: 191189 - DNA, 20 bp, Artificial
  CRISPR gRNA sequence
tccccctccttactccatct

SEQ ID NO: 191190 - DNA, 20 bp, Artificial
  CRISPR gRNA sequence
ccccctccttactccatctc

SEQ ID NO: 191191 - DNA, 20 bp, Artificial
  CRISPR gRNA sequence
cccctccttactccatctca

SEQ ID NO: 191192 - DNA, 20 bp, Artificial
  CRISPR gRNA sequence
cttactccatctcagggtga

SEQ ID NO: 191193 - DNA, 20 bp, Artificial
  CRISPR gRNA sequence
ttactccatctcagggtgac

SEQ ID NO: 191194 - DNA, 20 bp, Artificial
  CRISPR gRNA sequence
ccatctcagggtgacgggct

SEQ ID NO: 191195 - DNA, 20 bp, Artificial
  CRISPR gRNA sequence
catctcagggtgacgggctc

SEQ ID NO: 191196 - DNA, 20 bp, Artificial
  CRISPR gRNA sequence
ctcagggtgacgggctcggg

SEQ ID NO: 191197 - DNA, 20 bp, Artificial
  CRISPR gRNA sequence
gtagcccctcatgctgcaca

SEQ ID NO: 191198 - DNA, 20 bp, Artificial
  CRISPR gRNA sequence
cgtgtatctctgctcctctc

SEQ ID NO: 191199 - DNA, 20 bp, Artificial
  CRISPR gRNA sequence
gtatctctgctcctctccag

SEQ ID NO: 191200 - DNA, 20 bp, Artificial
  CRISPR gRNA sequence
tatctctgctcctctccaga

SEQ ID NO: 191201 - DNA, 20 bp, Artificial
  CRISPR gRNA sequence
ctctccagaaggcaccacca

SEQ ID NO: 191202 - DNA, 20 bp, Artificial
  CRISPR gRNA sequence
ccaccacagctgcccacttc

SEQ ID NO: 191203 - DNA, 20 bp, Artificial
  CRISPR gRNA sequence
ccacagctgcccacttctgg

SEQ ID NO: 191204 - DNA, 20 bp, Artificial
  CRISPR gRNA sequence
cacagctgcccacttctgga

SEQ ID NO: 191205 - DNA, 20 bp, Artificial
  CRISPR gRNA sequence
ctggaaggttccatcccctg

SEQ ID NO: 191206 - DNA, 20 bp, Artificial
  CRISPR gRNA sequence
tggaaggttccatcccctgc

SEQ ID NO: 191207 - DNA, 20 bp, Artificial
  CRISPR gRNA sequence
ggttccatcccctgcaggcc

SEQ ID NO: 191208 - DNA, 20 bp, Artificial
  CRISPR gRNA sequence
cctgcaggcctggtctccac

SEQ ID NO: 191209 - DNA, 20 bp, Artificial
  CRISPR gRNA sequence
tctccacgagctccgtgtcc

SEQ ID NO: 191210 - DNA, 20 bp, Artificial
  CRISPR gRNA sequence
ctccacgagctccgtgtcct

SEQ ID NO: 191211 - DNA, 20 bp, Artificial
  CRISPR gRNA sequence
cgagctccgtgtcctgggta

SEQ ID NO: 191212 - DNA, 20 bp, Artificial
  CRISPR gRNA sequence
ggccctccccatcctgctgc

SEQ ID NO: 191213 - DNA, 20 bp, Artificial
  CRISPR gRNA sequence
gccctccccatcctgctgcc

SEQ ID NO: 191214 - DNA, 20 bp, Artificial
  CRISPR gRNA sequence
tccccatcctgctgccaggt

SEQ ID NO: 191215 - DNA, 20 bp, Artificial
  CRISPR gRNA sequence
ccaggtcagtgtgatctccg

SEQ ID NO: 191216 - DNA, 20 bp, Artificial
  CRISPR gRNA sequence
caggtcagtgtgatctccgc

SEQ ID NO: 191217 - DNA, 20 bp, Artificial
  CRISPR gRNA sequence
aggtcagtgtgatctccgca

SEQ ID NO: 191218 - DNA, 20 bp, Artificial
  CRISPR gRNA sequence
tcagtgtgatctccgcaggg

SEQ ID NO: 191219 - DNA, 20 bp, Artificial
  CRISPR gRNA sequence
gtgtgatctccgcagggtag

SEQ ID NO: 191220 - DNA, 20 bp, Artificial
  CRISPR gRNA sequence
atctccgcagggtagaagcc

SEQ ID NO: 191221 - DNA, 20 bp, Artificial
  CRISPR gRNA sequence
tctccgcagggtagaagccc

SEQ ID NO: 191222 - DNA, 20 bp, Artificial
  CRISPR gRNA sequence
ctccgcagggtagaagccca

SEQ ID NO: 191223 - DNA, 20 bp, Artificial
  CRISPR gRNA sequence
cagggtagaagcccagggcc

SEQ ID NO: 191224 - DNA, 20 bp, Artificial
  CRISPR gRNA sequence
aagcccagggcccagcacct

SEQ ID NO: 191225 - DNA, 20 bp, Artificial
  CRISPR gRNA sequence
agcccagggcccagcacctc

SEQ ID NO: 191226 - DNA, 20 bp, Artificial
  CRISPR gRNA sequence
gcccagggcccagcacctca

SEQ ID NO: 191227 - DNA, 20 bp, Artificial
  CRISPR gRNA sequence
cagggcccagcacctcaggg

SEQ ID NO: 191228 - DNA, 20 bp, Artificial
  CRISPR gRNA sequence
agcacctcagggtggcctca

SEQ ID NO: 191229 - DNA, 20 bp, Artificial
  CRISPR gRNA sequence
cctcagggtggcctcatggt

SEQ ID NO: 191230 - DNA, 20 bp, Artificial
  CRISPR gRNA sequence
tcagggtggcctcatggtca

SEQ ID NO: 191231 - DNA, 20 bp, Artificial
  CRISPR gRNA sequence
ggtggcctcatggtcagaga

SEQ ID NO: 191232 - DNA, 20 bp, Artificial
  CRISPR gRNA sequence
gtggcctcatggtcagagat

SEQ ID NO: 191233 - DNA, 20 bp, Artificial
  CRISPR gRNA sequence
tggcctcatggtcagagatg

SEQ ID NO: 191234 - DNA, 20 bp, Artificial
  CRISPR gRNA sequence
cctcatggtcagagatgggg

SEQ ID NO: 191235 - DNA, 20 bp, Artificial
  CRISPR gRNA sequence
atggtcagagatggggtggt

SEQ ID NO: 191236 - DNA, 20 bp, Artificial
  CRISPR gRNA sequence
tggtgagtcacgtgtgtctt

SEQ ID NO: 191237 - DNA, 20 bp, Artificial
  CRISPR gRNA sequence
ggtgagtcacgtgtgtcttt

SEQ ID NO: 191238 - DNA, 20 bp, Artificial
  CRISPR gRNA sequence
gtgagtcacgtgtgtctttg

SEQ ID NO: 191239 - DNA, 20 bp, Artificial
  CRISPR gRNA sequence
tgagtcacgtgtgtctttgg

SEQ ID NO: 191240 - DNA, 20 bp, Artificial
  CRISPR gRNA sequence
cgtgtgtctttgggggctct

SEQ ID NO: 191241 - DNA, 20 bp, Artificial
  CRISPR gRNA sequence
gtgtgtctttgggggctctg

SEQ ID NO: 191242 - DNA, 20 bp, Artificial
  CRISPR gRNA sequence
tgtgtctttgggggctctga

SEQ ID NO: 191243 - DNA, 20 bp, Artificial
  CRISPR gRNA sequence
gtgtctttgggggctctgag

SEQ ID NO: 191244 - DNA, 20 bp, Artificial
  CRISPR gRNA sequence
tctttgggggctctgagggg

SEQ ID NO: 191245 - DNA, 20 bp, Artificial
  CRISPR gRNA sequence
tttgggggctctgaggggaa

SEQ ID NO: 191246 - DNA, 20 bp, Artificial
  CRISPR gRNA sequence
ggggctctgaggggaagagt

SEQ ID NO: 191247 - DNA, 20 bp, Artificial
  CRISPR gRNA sequence
aggggaagagtcagaaaatt

SEQ ID NO: 191248 - DNA, 20 bp, Artificial
  CRISPR gRNA sequence
ggggaagagtcagaaaattc

SEQ ID NO: 191249 - DNA, 20 bp, Artificial
  CRISPR gRNA sequence
caggcactttgtatctctca

SEQ ID NO: 191250 - DNA, 20 bp, Artificial
  CRISPR gRNA sequence
aggcactttgtatctctcat

SEQ ID NO: 191251 - DNA, 20 bp, Artificial
  CRISPR gRNA sequence
gtatctctcatgggacactc

SEQ ID NO: 191252 - DNA, 20 bp, Artificial
  CRISPR gRNA sequence
tctctcatgggacactccag

SEQ ID NO: 191253 - DNA, 20 bp, Artificial
  CRISPR gRNA sequence
agcacccatgtgaccatcct

SEQ ID NO: 191254 - DNA, 20 bp, Artificial
  CRISPR gRNA sequence
acccatgtgaccatcctgag

SEQ ID NO: 191255 - DNA, 20 bp, Artificial
  CRISPR gRNA sequence
cccatgtgaccatcctgaga

SEQ ID NO: 191256 - DNA, 20 bp, Artificial
  CRISPR gRNA sequence
atgtgaccatcctgagaagg

SEQ ID NO: 191257 - DNA, 20 bp, Artificial
  CRISPR gRNA sequence
gtgaccatcctgagaaggaa

SEQ ID NO: 191258 - DNA, 20 bp, Artificial
  CRISPR gRNA sequence
tgaccatcctgagaaggaag

SEQ ID NO: 191259 - DNA, 20 bp, Artificial
  CRISPR gRNA sequence
gagaaggaagaggacaatta

SEQ ID NO: 191260 - DNA, 20 bp, Artificial
  CRISPR gRNA sequence
aaggaagaggacaattatag

SEQ ID NO: 191261 - DNA, 20 bp, Artificial
  CRISPR gRNA sequence
aggaagaggacaattatagt

SEQ ID NO: 191262 - DNA, 20 bp, Artificial
  CRISPR gRNA sequence
gaagaggacaattatagtag

SEQ ID NO: 191263 - DNA, 20 bp, Artificial
  CRISPR gRNA sequence
gaggacaattatagtaggag

SEQ ID NO: 191264 - DNA, 20 bp, Artificial
  CRISPR gRNA sequence
ggacaattatagtaggagaa

SEQ ID NO: 191265 - DNA, 20 bp, Artificial
  CRISPR gRNA sequence
gacaattatagtaggagaag

SEQ ID NO: 191266 - DNA, 20 bp, Artificial
  CRISPR gRNA sequence
agaggacaaaaccttgacac

SEQ ID NO: 191267 - DNA, 20 bp, Artificial
  CRISPR gRNA sequence
acaaaaccttgacaccagcc

SEQ ID NO: 191268 - DNA, 20 bp, Artificial
  CRISPR gRNA sequence
ccttgacaccagcctggact

SEQ ID NO: 191269 - DNA, 20 bp, Artificial
  CRISPR gRNA sequence
cttgacaccagcctggactt

SEQ ID NO: 191270 - DNA, 20 bp, Artificial
  CRISPR gRNA sequence
ttgacaccagcctggactta

SEQ ID NO: 191271 - DNA, 20 bp, Artificial
  CRISPR gRNA sequence
ccagcctggacttagggatc

SEQ ID NO: 191272 - DNA, 20 bp, Artificial
  CRISPR gRNA sequence
cagcctggacttagggatct

SEQ ID NO: 191273 - DNA, 20 bp, Artificial
  CRISPR gRNA sequence
ctggacttagggatctggga

SEQ ID NO: 191274 - DNA, 20 bp, Artificial
  CRISPR gRNA sequence
tgggatagcctcttattcct

SEQ ID NO: 191275 - DNA, 20 bp, Artificial
  CRISPR gRNA sequence
atagcctcttattccttgga

SEQ ID NO: 191276 - DNA, 20 bp, Artificial
  CRISPR gRNA sequence
tcttattccttggaaagttc

SEQ ID NO: 191277 - DNA, 20 bp, Artificial
  CRISPR gRNA sequence
tccttggaaagttctagaat

SEQ ID NO: 191278 - DNA, 20 bp, Artificial
  CRISPR gRNA sequence
ccttggaaagttctagaatc

SEQ ID NO: 191279 - DNA, 20 bp, Artificial
  CRISPR gRNA sequence
gaaagttctagaatcgggat

SEQ ID NO: 191280 - DNA, 20 bp, Artificial
  CRISPR gRNA sequence
gttctagaatcgggatgagc

SEQ ID NO: 191281 - DNA, 20 bp, Artificial
  CRISPR gRNA sequence
agaatcgggatgagctagcc

SEQ ID NO: 191282 - DNA, 20 bp, Artificial
  CRISPR gRNA sequence
gaatcgggatgagctagccc

SEQ ID NO: 191283 - DNA, 20 bp, Artificial
  CRISPR gRNA sequence
aatcgggatgagctagccca

SEQ ID NO: 191284 - DNA, 20 bp, Artificial
  CRISPR gRNA sequence
cgggatgagctagcccaggg

SEQ ID NO: 191285 - DNA, 20 bp, Artificial
  CRISPR gRNA sequence
gatgagctagcccagggtag

SEQ ID NO: 191286 - DNA, 20 bp, Artificial
  CRISPR gRNA sequence
atgagctagcccagggtaga

SEQ ID NO: 191287 - DNA, 20 bp, Artificial
  CRISPR gRNA sequence
agcccagggtagaaggtgaa

SEQ ID NO: 191288 - DNA, 20 bp, Artificial
  CRISPR gRNA sequence
gcccagggtagaaggtgaaa

SEQ ID NO: 191289 - DNA, 20 bp, Artificial
  CRISPR gRNA sequence
cccagggtagaaggtgaaaa

SEQ ID NO: 191290 - DNA, 20 bp, Artificial
  CRISPR gRNA sequence
agaaggtgaaaagggatttc

SEQ ID NO: 191291 - DNA, 20 bp, Artificial
  CRISPR gRNA sequence
tgaaaagggatttctggtcc

SEQ ID NO: 191292 - DNA, 20 bp, Artificial
  CRISPR gRNA sequence
atttctggtcctggcctgtg

SEQ ID NO: 191293 - DNA, 20 bp, Artificial
  CRISPR gRNA sequence
tcctggcctgtgtggatgct

SEQ ID NO: 191294 - DNA, 20 bp, Artificial
  CRISPR gRNA sequence
tgtgtggatgctgagtgact

SEQ ID NO: 191295 - DNA, 20 bp, Artificial
  CRISPR gRNA sequence
ggatgctgagtgactgagaa

SEQ ID NO: 191296 - DNA, 20 bp, Artificial
  CRISPR gRNA sequence
gctgagtgactgagaaaagc

SEQ ID NO: 191297 - DNA, 20 bp, Artificial
  CRISPR gRNA sequence
tgagtgactgagaaaagctg

SEQ ID NO: 191298 - DNA, 20 bp, Artificial
  CRISPR gRNA sequence
tgactgagaaaagctggagt

SEQ ID NO: 191299 - DNA, 20 bp, Artificial
  CRISPR gRNA sequence
gtcagacctccaaaaactct

SEQ ID NO: 191300 - DNA, 20 bp, Artificial
  CRISPR gRNA sequence
acctccaaaaactcttggtg

SEQ ID NO: 191301 - DNA, 20 bp, Artificial
  CRISPR gRNA sequence
cctccaaaaactcttggtgt

SEQ ID NO: 191302 - DNA, 20 bp, Artificial
  CRISPR gRNA sequence
ctccaaaaactcttggtgtg

SEQ ID NO: 191303 - DNA, 20 bp, Artificial
  CRISPR gRNA sequence
aaaactcttggtgtggggct

SEQ ID NO: 191304 - DNA, 20 bp, Artificial
  CRISPR gRNA sequence
cttggtgtggggctgagaat

SEQ ID NO: 191305 - DNA, 20 bp, Artificial
  CRISPR gRNA sequence
ttggtgtggggctgagaatc

SEQ ID NO: 191306 - DNA, 20 bp, Artificial
  CRISPR gRNA sequence
tggggctgagaatcaggcac

SEQ ID NO: 191307 - DNA, 20 bp, Artificial
  CRISPR gRNA sequence
gggctgagaatcaggcacga

SEQ ID NO: 191308 - DNA, 20 bp, Artificial
  CRISPR gRNA sequence
tcccccgtgattcctaatac

SEQ ID NO: 191309 - DNA, 20 bp, Artificial
  CRISPR gRNA sequence
cccccgtgattcctaatact

SEQ ID NO: 191310 - DNA, 20 bp, Artificial
  CRISPR gRNA sequence
cccgtgattcctaatactgg

SEQ ID NO: 191311 - DNA, 20 bp, Artificial
  CRISPR gRNA sequence
attcctaatactgggagtca

SEQ ID NO: 191312 - DNA, 20 bp, Artificial
  CRISPR gRNA sequence
tcctaatactgggagtcaaa

SEQ ID NO: 191313 - DNA, 20 bp, Artificial
  CRISPR gRNA sequence
agtcaaagagaactgctcat

SEQ ID NO: 191314 - DNA, 20 bp, Artificial
  CRISPR gRNA sequence
actgctcatcagttcatctg

SEQ ID NO: 191315 - DNA, 20 bp, Artificial
  CRISPR gRNA sequence
ctgctcatcagttcatctga

SEQ ID NO: 191316 - DNA, 20 bp, Artificial
  CRISPR gRNA sequence
tcatcagttcatctgaagga

SEQ ID NO: 191317 - DNA, 20 bp, Artificial
  CRISPR gRNA sequence
catctgaaggatggaatctc

SEQ ID NO: 191318 - DNA, 20 bp, Artificial
  CRISPR gRNA sequence
tgaaggatggaatctccagc

SEQ ID NO: 191319 - DNA, 20 bp, Artificial
  CRISPR gRNA sequence
gatggaatctccagcgagac

SEQ ID NO: 191320 - DNA, 20 bp, Artificial
  CRISPR gRNA sequence
tagattccttaattgcccct

SEQ ID NO: 191321 - DNA, 20 bp, Artificial
  CRISPR gRNA sequence
gattccttaattgcccctga

SEQ ID NO: 191322 - DNA, 20 bp, Artificial
  CRISPR gRNA sequence
ttccttaattgcccctgaga

SEQ ID NO: 191323 - DNA, 20 bp, Artificial
  CRISPR gRNA sequence
tccttaattgcccctgagag

SEQ ID NO: 191324 - DNA, 20 bp, Artificial
  CRISPR gRNA sequence
aattgcccctgagagaggtc

SEQ ID NO: 191325 - DNA, 20 bp, Artificial
  CRISPR gRNA sequence
tgagagaggtctggcccttt

SEQ ID NO: 191326 - DNA, 20 bp, Artificial
  CRISPR gRNA sequence
agagaggtctggccctttaa

SEQ ID NO: 191327 - DNA, 20 bp, Artificial
  CRISPR gRNA sequence
agaggtctggccctttaaga

SEQ ID NO: 191328 - DNA, 20 bp, Artificial
  CRISPR gRNA sequence
cctttaagagagtcactctg

SEQ ID NO: 191329 - DNA, 20 bp, Artificial
  CRISPR gRNA sequence
aagagagtcactctgtggta

SEQ ID NO: 191330 - DNA, 20 bp, Artificial
  CRISPR gRNA sequence
agagagtcactctgtggtat

SEQ ID NO: 191331 - DNA, 20 bp, Artificial
  CRISPR gRNA sequence
gtataggatctcctgtacct

SEQ ID NO: 191332 - DNA, 20 bp, Artificial
  CRISPR gRNA sequence
tataggatctcctgtacctc

SEQ ID NO: 191333 - DNA, 20 bp, Artificial
  CRISPR gRNA sequence
atctcctgtacctcaggtga

SEQ ID NO: 191334 - DNA, 20 bp, Artificial
  CRISPR gRNA sequence
acagctccctctcctgatcc

SEQ ID NO: 191335 - DNA, 20 bp, Artificial
  CRISPR gRNA sequence
cagctccctctcctgatcca

SEQ ID NO: 191336 - DNA, 20 bp, Artificial
  CRISPR gRNA sequence
agctccctctcctgatccaa

SEQ ID NO: 191337 - DNA, 20 bp, Artificial
  CRISPR gRNA sequence
ctccctctcctgatccaagg

SEQ ID NO: 191338 - DNA, 20 bp, Artificial
  CRISPR gRNA sequence
tccctctcctgatccaaggg

SEQ ID NO: 191339 - DNA, 20 bp, Artificial
  CRISPR gRNA sequence
cctctcctgatccaagggag

SEQ ID NO: 191340 - DNA, 20 bp, Artificial
  CRISPR gRNA sequence
ctcctgatccaagggaggag

SEQ ID NO: 191341 - DNA, 20 bp, Artificial
  CRISPR gRNA sequence
ccaagggaggagtggtattc

SEQ ID NO: 191342 - DNA, 20 bp, Artificial
  CRISPR gRNA sequence
ccctgtttcttctactgttt

SEQ ID NO: 191343 - DNA, 20 bp, Artificial
  CRISPR gRNA sequence
cctgtttcttctactgtttg

SEQ ID NO: 191344 - DNA, 20 bp, Artificial
  CRISPR gRNA sequence
ttctactgtttgaggtctgt

SEQ ID NO: 191345 - DNA, 20 bp, Artificial
  CRISPR gRNA sequence
tgtttgaggtctgtcagctg

SEQ ID NO: 191346 - DNA, 20 bp, Artificial
  CRISPR gRNA sequence
gtttgaggtctgtcagctgt

SEQ ID NO: 191347 - DNA, 20 bp, Artificial
  CRISPR gRNA sequence
aggtctgtcagctgtgggca

SEQ ID NO: 191348 - DNA, 20 bp, Artificial
  CRISPR gRNA sequence
gtcagctgtgggcacagtcc

SEQ ID NO: 191349 - DNA, 20 bp, Artificial
  CRISPR gRNA sequence
tgtgggcacagtcctagccc

SEQ ID NO: 191350 - DNA, 20 bp, Artificial
  CRISPR gRNA sequence
gggcacagtcctagcccaag

SEQ ID NO: 191351 - DNA, 20 bp, Artificial
  CRISPR gRNA sequence
ggcacagtcctagcccaaga

SEQ ID NO: 191352 - DNA, 20 bp, Artificial
  CRISPR gRNA sequence
cacagtcctagcccaagaag

SEQ ID NO: 191353 - DNA, 20 bp, Artificial
  CRISPR gRNA sequence
gtcctagcccaagaaggagt

SEQ ID NO: 191354 - DNA, 20 bp, Artificial
  CRISPR gRNA sequence
tcctagcccaagaaggagtt

SEQ ID NO: 191355 - DNA, 20 bp, Artificial
  CRISPR gRNA sequence
ctagcccaagaaggagttgg

SEQ ID NO: 191356 - DNA, 20 bp, Artificial
  CRISPR gRNA sequence
agcccaagaaggagttggga

SEQ ID NO: 191357 - DNA, 20 bp, Artificial
  CRISPR gRNA sequence
ccaagaaggagttgggagag

SEQ ID NO: 191358 - DNA, 20 bp, Artificial
  CRISPR gRNA sequence
gagttgggagagtagccctg

SEQ ID NO: 191359 - DNA, 20 bp, Artificial
  CRISPR gRNA sequence
gccctgtggaccctcttacc

SEQ ID NO: 191360 - DNA, 20 bp, Artificial
  CRISPR gRNA sequence
ccctgtggaccctcttaccc

SEQ ID NO: 191361 - DNA, 20 bp, Artificial
  CRISPR gRNA sequence
tggaccctcttacccaggtg

SEQ ID NO: 191362 - DNA, 20 bp, Artificial
  CRISPR gRNA sequence
accctcttacccaggtgaag

SEQ ID NO: 191363 - DNA, 20 bp, Artificial
  CRISPR gRNA sequence
agcgtctccttccccttctc

SEQ ID NO: 191364 - DNA, 20 bp, Artificial
  CRISPR gRNA sequence
gcgtctccttccccttctcc

SEQ ID NO: 191365 - DNA, 20 bp, Artificial
  CRISPR gRNA sequence
tccccttctccaggtatttg

SEQ ID NO: 191366 - DNA, 20 bp, Artificial
  CRISPR gRNA sequence
cccttctccaggtatttgtg

SEQ ID NO: 191367 - DNA, 20 bp, Artificial
  CRISPR gRNA sequence
cactccacgcatgtgtcttc

SEQ ID NO: 191368 - DNA, 20 bp, Artificial
  CRISPR gRNA sequence
actccacgcatgtgtcttcc

SEQ ID NO: 191369 - DNA, 20 bp, Artificial
  CRISPR gRNA sequence
ccacgcatgtgtcttccagg

SEQ ID NO: 191370 - DNA, 20 bp, Artificial
  CRISPR gRNA sequence
cacgcatgtgtcttccaggt

SEQ ID NO: 191371 - DNA, 20 bp, Artificial
  CRISPR gRNA sequence
tgtcttccaggtaggctctc

SEQ ID NO: 191372 - DNA, 20 bp, Artificial
  CRISPR gRNA sequence
ggctctctggtgctccgcct

SEQ ID NO: 191373 - DNA, 20 bp, Artificial
  CRISPR gRNA sequence
ctctctggtgctccgcctca

SEQ ID NO: 191374 - DNA, 20 bp, Artificial
  CRISPR gRNA sequence
tctctggtgctccgcctcag

SEQ ID NO: 191375 - DNA, 20 bp, Artificial
  CRISPR gRNA sequence
ggcatcatttgacttttgct

SEQ ID NO: 191376 - DNA, 20 bp, Artificial
  CRISPR gRNA sequence
catcatttgacttttgctcg

SEQ ID NO: 191377 - DNA, 20 bp, Artificial
  CRISPR gRNA sequence
tgacttttgctcggagatct

SEQ ID NO: 191378 - DNA, 20 bp, Artificial
  CRISPR gRNA sequence
ctgagccgccgtgtccaccg

SEQ ID NO: 191379 - DNA, 20 bp, Artificial
  CRISPR gRNA sequence
ccgccgtgtccaccgcggtc

SEQ ID NO: 191380 - DNA, 20 bp, Artificial
  CRISPR gRNA sequence
cgccgtgtccaccgcggtcc

SEQ ID NO: 191381 - DNA, 20 bp, Artificial
  CRISPR gRNA sequence
ccgtgtccaccgcggtccag

SEQ ID NO: 191382 - DNA, 20 bp, Artificial
  CRISPR gRNA sequence
tccaccgcggtccaggagcg

SEQ ID NO: 191383 - DNA, 20 bp, Artificial
  CRISPR gRNA sequence
ccaccgcggtccaggagcgc

SEQ ID NO: 191384 - DNA, 20 bp, Artificial
  CRISPR gRNA sequence
caggagcgcaggtcctcatt

SEQ ID NO: 191385 - DNA, 20 bp, Artificial
  CRISPR gRNA sequence
aggagcgcaggtcctcattc

SEQ ID NO: 191386 - DNA, 20 bp, Artificial
  CRISPR gRNA sequence
ggagcgcaggtcctcattca

SEQ ID NO: 191387 - DNA, 20 bp, Artificial
  CRISPR gRNA sequence
cgcaggtcctcattcagggt

SEQ ID NO: 191388 - DNA, 20 bp, Artificial
  CRISPR gRNA sequence
tgagataatccttgccgtcg

SEQ ID NO: 191389 - DNA, 20 bp, Artificial
  CRISPR gRNA sequence
gagataatccttgccgtcgt

SEQ ID NO: 191390 - DNA, 20 bp, Artificial
  CRISPR gRNA sequence
aggcgaactgttcatacccg

SEQ ID NO: 191391 - DNA, 20 bp, Artificial
  CRISPR gRNA sequence
gcgaactgttcatacccgcg

SEQ ID NO: 191392 - DNA, 20 bp, Artificial
  CRISPR gRNA sequence
cgaactgttcatacccgcgg

SEQ ID NO: 191393 - DNA, 20 bp, Artificial
  CRISPR gRNA sequence
actgttcatacccgcggagg

SEQ ID NO: 191394 - DNA, 20 bp, Artificial
  CRISPR gRNA sequence
cccgcggaggaagcgcccgt

SEQ ID NO: 191395 - DNA, 20 bp, Artificial
  CRISPR gRNA sequence
ccgcggaggaagcgcccgtc

SEQ ID NO: 191396 - DNA, 20 bp, Artificial
  CRISPR gRNA sequence
aggaagcgcccgtcgggccc

SEQ ID NO: 191397 - DNA, 20 bp, Artificial
  CRISPR gRNA sequence
gcccgtcgggccccagctcg

SEQ ID NO: 191398 - DNA, 20 bp, Artificial
  CRISPR gRNA sequence
tcgcagccatgcatccactg

SEQ ID NO: 191399 - DNA, 20 bp, Artificial
  CRISPR gRNA sequence
cgcagccatgcatccactgc

SEQ ID NO: 191400 - DNA, 20 bp, Artificial
  CRISPR gRNA sequence
gcagccatgcatccactgca

SEQ ID NO: 191401 - DNA, 20 bp, Artificial
  CRISPR gRNA sequence
atgcatccactgcagggtgt

SEQ ID NO: 191402 - DNA, 20 bp, Artificial
  CRISPR gRNA sequence
cactgcagggtgtgagaccc

SEQ ID NO: 191403 - DNA, 20 bp, Artificial
  CRISPR gRNA sequence
gagaccctggccccgcccct

SEQ ID NO: 191404 - DNA, 20 bp, Artificial
  CRISPR gRNA sequence
ccctggccccgccccttagt

SEQ ID NO: 191405 - DNA, 20 bp, Artificial
  CRISPR gRNA sequence
cttagtcagtcccgcccacc

SEQ ID NO: 191406 - DNA, 20 bp, Artificial
  CRISPR gRNA sequence
cccccgtcgccaccaccctg

SEQ ID NO: 191407 - DNA, 20 bp, Artificial
  CRISPR gRNA sequence
ccccgtcgccaccaccctgt

SEQ ID NO: 191408 - DNA, 20 bp, Artificial
  CRISPR gRNA sequence
ccaccaccctgtgggcattt

SEQ ID NO: 191409 - DNA, 20 bp, Artificial
  CRISPR gRNA sequence
cattttggcctaaactgaaa

SEQ ID NO: 191410 - DNA, 20 bp, Artificial
  CRISPR gRNA sequence
ggcctaaactgaaaaagaac

SEQ ID NO: 191411 - DNA, 20 bp, Artificial
  CRISPR gRNA sequence
gcctaaactgaaaaagaacc

SEQ ID NO: 191412 - DNA, 20 bp, Artificial
  CRISPR gRNA sequence
aactgaaaaagaaccgggta

SEQ ID NO: 191413 - DNA, 20 bp, Artificial
  CRISPR gRNA sequence
actgaaaaagaaccgggtaa

SEQ ID NO: 191414 - DNA, 20 bp, Artificial
  CRISPR gRNA sequence
agaaccgggtaaaggcgcct

SEQ ID NO: 191415 - DNA, 20 bp, Artificial
  CRISPR gRNA sequence
aaggcgcctgagactctccc

SEQ ID NO: 191416 - DNA, 20 bp, Artificial
  CRISPR gRNA sequence
gcctgagactctccccggtc

SEQ ID NO: 191417 - DNA, 20 bp, Artificial
  CRISPR gRNA sequence
cctgagactctccccggtct

SEQ ID NO: 191418 - DNA, 20 bp, Artificial
  CRISPR gRNA sequence
ctgagactctccccggtcta

SEQ ID NO: 191419 - DNA, 20 bp, Artificial
  CRISPR gRNA sequence
actctccccggtctagggtc

SEQ ID NO: 191420 - DNA, 20 bp, Artificial
  CRISPR gRNA sequence
ctctccccggtctagggtct

SEQ ID NO: 191421 - DNA, 20 bp, Artificial
  CRISPR gRNA sequence
tccccggtctagggtctggg

SEQ ID NO: 191422 - DNA, 20 bp, Artificial
  CRISPR gRNA sequence
ccccggtctagggtctgggc

SEQ ID NO: 191423 - DNA, 20 bp, Artificial
  CRISPR gRNA sequence
tagggtctgggcgggttccg

SEQ ID NO: 191424 - DNA, 20 bp, Artificial
  CRISPR gRNA sequence
ctgggcgggttccgcagcct

SEQ ID NO: 191425 - DNA, 20 bp, Artificial
  CRISPR gRNA sequence
tgggcgggttccgcagcctt

SEQ ID NO: 191426 - DNA, 20 bp, Artificial
  CRISPR gRNA sequence
gggcgggttccgcagccttg

SEQ ID NO: 191427 - DNA, 20 bp, Artificial
  CRISPR gRNA sequence
ccgcagccttggggtgaatc

SEQ ID NO: 191428 - DNA, 20 bp, Artificial
  CRISPR gRNA sequence
cgcagccttggggtgaatct

SEQ ID NO: 191429 - DNA, 20 bp, Artificial
  CRISPR gRNA sequence
tggggtgaatctgggacccg

SEQ ID NO: 191430 - DNA, 20 bp, Artificial
  CRISPR gRNA sequence
aatctgggacccgaagattc

SEQ ID NO: 191431 - DNA, 20 bp, Artificial
  CRISPR gRNA sequence
atctgggacccgaagattcg

SEQ ID NO: 191432 - DNA, 20 bp, Artificial
  CRISPR gRNA sequence
tctgggacccgaagattcga

SEQ ID NO: 191433 - DNA, 20 bp, Artificial
  CRISPR gRNA sequence
ctgggacccgaagattcgag

SEQ ID NO: 191434 - DNA, 20 bp, Artificial
  CRISPR gRNA sequence
gaggggacccgcgccgtccg

SEQ ID NO: 191435 - DNA, 20 bp, Artificial
  CRISPR gRNA sequence
aggggacccgcgccgtccgt

SEQ ID NO: 191436 - DNA, 20 bp, Artificial
  CRISPR gRNA sequence
ggggacccgcgccgtccgtg

SEQ ID NO: 191437 - DNA, 20 bp, Artificial
  CRISPR gRNA sequence
gggacccgcgccgtccgtgg

SEQ ID NO: 191438 - DNA, 20 bp, Artificial
  CRISPR gRNA sequence
cccgcgccgtccgtggggga

SEQ ID NO: 191439 - DNA, 20 bp, Artificial
  CRISPR gRNA sequence
ccgcgccgtccgtgggggat

SEQ ID NO: 191440 - DNA, 20 bp, Artificial
  CRISPR gRNA sequence
cgcgccgtccgtgggggatg

SEQ ID NO: 191441 - DNA, 20 bp, Artificial
  CRISPR gRNA sequence
cgccgtccgtgggggatggg

SEQ ID NO: 191442 - DNA, 20 bp, Artificial
  CRISPR gRNA sequence
gccgtccgtgggggatgggg

SEQ ID NO: 191443 - DNA, 20 bp, Artificial
  CRISPR gRNA sequence
ccgtccgtgggggatgggga

SEQ ID NO: 191444 - DNA, 20 bp, Artificial
  CRISPR gRNA sequence
cgtccgtgggggatggggag

SEQ ID NO: 191445 - DNA, 20 bp, Artificial
  CRISPR gRNA sequence
ggggtcgtgacctgctcccc

SEQ ID NO: 191446 - DNA, 20 bp, Artificial
  CRISPR gRNA sequence
tcgtgacctgctcccctggc

SEQ ID NO: 191447 - DNA, 20 bp, Artificial
  CRISPR gRNA sequence
cgtgacctgctcccctggcc

SEQ ID NO: 191448 - DNA, 20 bp, Artificial
  CRISPR gRNA sequence
gtgacctgctcccctggccg

SEQ ID NO: 191449 - DNA, 20 bp, Artificial
  CRISPR gRNA sequence
ccctggccggggtcactcac

SEQ ID NO: 191450 - DNA, 20 bp, Artificial
  CRISPR gRNA sequence
caccggcctcgctctgattg

SEQ ID NO: 191451 - DNA, 20 bp, Artificial
  CRISPR gRNA sequence
cggcctcgctctgattgtag

SEQ ID NO: 191452 - DNA, 20 bp, Artificial
  CRISPR gRNA sequence
ctctgattgtagtagccgcg

SEQ ID NO: 191453 - DNA, 20 bp, Artificial
  CRISPR gRNA sequence
tagtagccgcgcagcgtccg

SEQ ID NO: 191454 - DNA, 20 bp, Artificial
  CRISPR gRNA sequence
gcagcgtccgcagattcact

SEQ ID NO: 191455 - DNA, 20 bp, Artificial
  CRISPR gRNA sequence
attcactcggaaaatctgtg

SEQ ID NO: 191456 - DNA, 20 bp, Artificial
  CRISPR gRNA sequence
gaaaatctgtgcggtgtccc

SEQ ID NO: 191457 - DNA, 20 bp, Artificial
  CRISPR gRNA sequence
ccctggcgctccgtgtctcc

SEQ ID NO: 191458 - DNA, 20 bp, Artificial
  CRISPR gRNA sequence
gacccctcctgctccatcca

SEQ ID NO: 191459 - DNA, 20 bp, Artificial
  CRISPR gRNA sequence
tgctccatccacggcgcccg

SEQ ID NO: 191460 - DNA, 20 bp, Artificial
  CRISPR gRNA sequence
ggcgcccgcggcaccatcct

SEQ ID NO: 191461 - DNA, 20 bp, Artificial
  CRISPR gRNA sequence
cggcaccatcctcggactcg

SEQ ID NO: 191462 - DNA, 20 bp, Artificial
  CRISPR gRNA sequence
gactcgcggcgtcgttgtcg

SEQ ID NO: 191463 - DNA, 20 bp, Artificial
  CRISPR gRNA sequence
cgttgtcgaagcgcacgaac

SEQ ID NO: 191464 - DNA, 20 bp, Artificial
  CRISPR gRNA sequence
gttgtcgaagcgcacgaact

SEQ ID NO: 191465 - DNA, 20 bp, Artificial
  CRISPR gRNA sequence
cgaactgggtgtcgtccacg

SEQ ID NO: 191466 - DNA, 20 bp, Artificial
  CRISPR gRNA sequence
ggtgtcgtccacgtagccca

SEQ ID NO: 191467 - DNA, 20 bp, Artificial
  CRISPR gRNA sequence
tgtcgtccacgtagcccaca

SEQ ID NO: 191468 - DNA, 20 bp, Artificial
  CRISPR gRNA sequence
ccacgtagcccacagagatg

SEQ ID NO: 191469 - DNA, 20 bp, Artificial
  CRISPR gRNA sequence
cgtagcccacagagatgaag

SEQ ID NO: 191470 - DNA, 20 bp, Artificial
  CRISPR gRNA sequence
gtagcccacagagatgaagc

SEQ ID NO: 191471 - DNA, 20 bp, Artificial
  CRISPR gRNA sequence
tagcccacagagatgaagcg

SEQ ID NO: 191472 - DNA, 20 bp, Artificial
  CRISPR gRNA sequence
agatgaagcggggctccccg

SEQ ID NO: 191473 - DNA, 20 bp, Artificial
  CRISPR gRNA sequence
gaagcggggctccccgcggc

SEQ ID NO: 191474 - DNA, 20 bp, Artificial
  CRISPR gRNA sequence
aagcggggctccccgcggcc

SEQ ID NO: 191475 - DNA, 20 bp, Artificial
  CRISPR gRNA sequence
ggggctccccgcggccgggc

SEQ ID NO: 191476 - DNA, 20 bp, Artificial
  CRISPR gRNA sequence
gggctccccgcggccgggcc

SEQ ID NO: 191477 - DNA, 20 bp, Artificial
  CRISPR gRNA sequence
cccgcggccgggccgggaca

SEQ ID NO: 191478 - DNA, 20 bp, Artificial
  CRISPR gRNA sequence
gcggccgggccgggacacgg

SEQ ID NO: 191479 - DNA, 20 bp, Artificial
  CRISPR gRNA sequence
cgggccgggacacggaagtg

SEQ ID NO: 191480 - DNA, 20 bp, Artificial
  CRISPR gRNA sequence
cggaagtgtggaaatacttc

SEQ ID NO: 191481 - DNA, 20 bp, Artificial
  CRISPR gRNA sequence
ggaagtgtggaaatacttca

SEQ ID NO: 191482 - DNA, 20 bp, Artificial
  CRISPR gRNA sequence
aagtgtggaaatacttcaag

SEQ ID NO: 191483 - DNA, 20 bp, Artificial
  CRISPR gRNA sequence
tgtggaaatacttcaaggag

SEQ ID NO: 191484 - DNA, 20 bp, Artificial
  CRISPR gRNA sequence
gtggaaatacttcaaggagt

SEQ ID NO: 191485 - DNA, 20 bp, Artificial
  CRISPR gRNA sequence
ggaaatacttcaaggagtgg

SEQ ID NO: 191486 - DNA, 20 bp, Artificial
  CRISPR gRNA sequence
tacttcaaggagtgggagcc

SEQ ID NO: 191487 - DNA, 20 bp, Artificial
  CRISPR gRNA sequence
acttcaaggagtgggagcct

SEQ ID NO: 191488 - DNA, 20 bp, Artificial
  CRISPR gRNA sequence
cttcaaggagtgggagcctg

SEQ ID NO: 191489 - DNA, 20 bp, Artificial
  CRISPR gRNA sequence
ttcaaggagtgggagcctgg

SEQ ID NO: 191490 - DNA, 20 bp, Artificial
  CRISPR gRNA sequence
aggagtgggagcctgggggc

SEQ ID NO: 191491 - DNA, 20 bp, Artificial
  CRISPR gRNA sequence
ggagtgggagcctgggggcg

SEQ ID NO: 191492 - DNA, 20 bp, Artificial
  CRISPR gRNA sequence
agtgggagcctgggggcgag

SEQ ID NO: 191493 - DNA, 20 bp, Artificial
  CRISPR gRNA sequence
gtgggagcctgggggcgagg

SEQ ID NO: 191494 - DNA, 20 bp, Artificial
  CRISPR gRNA sequence
tgggagcctgggggcgagga

SEQ ID NO: 191495 - DNA, 20 bp, Artificial
  CRISPR gRNA sequence
gggagcctgggggcgaggag

SEQ ID NO: 191496 - DNA, 20 bp, Artificial
  CRISPR gRNA sequence
cctgggggcgaggaggggct

SEQ ID NO: 191497 - DNA, 20 bp, Artificial
  CRISPR gRNA sequence
gggcgaggaggggctgagat

SEQ ID NO: 191498 - DNA, 20 bp, Artificial
  CRISPR gRNA sequence
gatcggcccgaccctcctcc

SEQ ID NO: 191499 - DNA, 20 bp, Artificial
  CRISPR gRNA sequence
gcccgaccctcctcccggcg

SEQ ID NO: 191500 - DNA, 20 bp, Artificial
  CRISPR gRNA sequence
tcctcccggcgcggctcccc

SEQ ID NO: 191501 - DNA, 20 bp, Artificial
  CRISPR gRNA sequence
cccgagtccttcgcccccgc

SEQ ID NO: 191502 - DNA, 20 bp, Artificial
  CRISPR gRNA sequence
ccgagtccttcgcccccgcc

SEQ ID NO: 191503 - DNA, 20 bp, Artificial
  CRISPR gRNA sequence
gtccttcgcccccgccgggc

SEQ ID NO: 191504 - DNA, 20 bp, Artificial
  CRISPR gRNA sequence
ggccggcccctctctactcc

SEQ ID NO: 191505 - DNA, 20 bp, Artificial
  CRISPR gRNA sequence
cggcccctctctactcccgg

SEQ ID NO: 191506 - DNA, 20 bp, Artificial
  CRISPR gRNA sequence
gcccctctctactcccggta

SEQ ID NO: 191507 - DNA, 20 bp, Artificial
  CRISPR gRNA sequence
cccctctctactcccggtag

SEQ ID NO: 191508 - DNA, 20 bp, Artificial
  CRISPR gRNA sequence
cgaccccgcactcacccgcc

SEQ ID NO: 191509 - DNA, 20 bp, Artificial
  CRISPR gRNA sequence
gaccccgcactcacccgccc

SEQ ID NO: 191510 - DNA, 20 bp, Artificial
  CRISPR gRNA sequence
cgcactcacccgcccaggtc

SEQ ID NO: 191511 - DNA, 20 bp, Artificial
  CRISPR gRNA sequence
gcactcacccgcccaggtct

SEQ ID NO: 191512 - DNA, 20 bp, Artificial
  CRISPR gRNA sequence
tcacccgcccaggtctgggt

SEQ ID NO: 191513 - DNA, 20 bp, Artificial
  CRISPR gRNA sequence
cacccgcccaggtctgggta

SEQ ID NO: 191514 - DNA, 20 bp, Artificial
  CRISPR gRNA sequence
acccgcccaggtctgggtaa

SEQ ID NO: 191515 - DNA, 20 bp, Artificial
  CRISPR gRNA sequence
gcccaggtctgggtaagggc

SEQ ID NO: 191516 - DNA, 20 bp, Artificial
  CRISPR gRNA sequence
cccaggtctgggtaagggcc

SEQ ID NO: 191517 - DNA, 20 bp, Artificial
  CRISPR gRNA sequence
ccaggtctgggtaagggcca

SEQ ID NO: 191518 - DNA, 20 bp, Artificial
  CRISPR gRNA sequence
gggtaagggccagggcctcc

SEQ ID NO: 191519 - DNA, 20 bp, Artificial
  CRISPR gRNA sequence
gtaagggccagggcctccga

SEQ ID NO: 191520 - DNA, 20 bp, Artificial
  CRISPR gRNA sequence
taagggccagggcctccgag

SEQ ID NO: 191521 - DNA, 20 bp, Artificial
  CRISPR gRNA sequence
agggccagggcctccgagag

SEQ ID NO: 191522 - DNA, 20 bp, Artificial
  CRISPR gRNA sequence
agggcctccgagaggagtaa

SEQ ID NO: 191523 - DNA, 20 bp, Artificial
  CRISPR gRNA sequence
gggcctccgagaggagtaaa

SEQ ID NO: 191524 - DNA, 20 bp, Artificial
  CRISPR gRNA sequence
gcctccgagaggagtaaaag

SEQ ID NO: 191525 - DNA, 20 bp, Artificial
  CRISPR gRNA sequence
cctccgagaggagtaaaagg

SEQ ID NO: 191526 - DNA, 20 bp, Artificial
  CRISPR gRNA sequence
ctccgagaggagtaaaagga

SEQ ID NO: 191527 - DNA, 20 bp, Artificial
  CRISPR gRNA sequence
ggttccatctaccatgatcc

SEQ ID NO: 191528 - DNA, 20 bp, Artificial
  CRISPR gRNA sequence
ctaccatgatcccagcctct

SEQ ID NO: 191529 - DNA, 20 bp, Artificial
  CRISPR gRNA sequence
gatcccagcctctgagtcct

SEQ ID NO: 191530 - DNA, 20 bp, Artificial
  CRISPR gRNA sequence
ctgagtcctgagaacttctt

SEQ ID NO: 191531 - DNA, 20 bp, Artificial
  CRISPR gRNA sequence
tcctgagaacttcttgagtc

SEQ ID NO: 191532 - DNA, 20 bp, Artificial
  CRISPR gRNA sequence
gagaacttcttgagtccgga

SEQ ID NO: 191533 - DNA, 20 bp, Artificial
  CRISPR gRNA sequence
agaacttcttgagtccggat

SEQ ID NO: 191534 - DNA, 20 bp, Artificial
  CRISPR gRNA sequence
gaacttcttgagtccggatg

SEQ ID NO: 191535 - DNA, 20 bp, Artificial
  CRISPR gRNA sequence
gagtccggatggggacttta

SEQ ID NO: 191536 - DNA, 20 bp, Artificial
  CRISPR gRNA sequence
ccggatggggactttatagt

SEQ ID NO: 191537 - DNA, 20 bp, Artificial
  CRISPR gRNA sequence
cggatggggactttatagtc

SEQ ID NO: 191538 - DNA, 20 bp, Artificial
  CRISPR gRNA sequence
gatggggactttatagtcgg

SEQ ID NO: 191539 - DNA, 20 bp, Artificial
  CRISPR gRNA sequence
gactttatagtcgggagtcg

SEQ ID NO: 191540 - DNA, 20 bp, Artificial
  CRISPR gRNA sequence
ggagtcgtggcgacgctgat

SEQ ID NO: 191541 - DNA, 20 bp, Artificial
  CRISPR gRNA sequence
gcgacgctgattggcttctc

SEQ ID NO: 191542 - DNA, 20 bp, Artificial
  CRISPR gRNA sequence
tctagaaacccgacacccat

SEQ ID NO: 191543 - DNA, 20 bp, Artificial
  CRISPR gRNA sequence
ctagaaacccgacacccatt

SEQ ID NO: 191544 - DNA, 20 bp, Artificial
  CRISPR gRNA sequence
acccgacacccattgggaat

SEQ ID NO: 191545 - DNA, 20 bp, Artificial
  CRISPR gRNA sequence
acccattgggaatgagaact

SEQ ID NO: 191546 - DNA, 20 bp, Artificial
  CRISPR gRNA sequence
gagaactgagtctgcgtcat

SEQ ID NO: 191547 - DNA, 20 bp, Artificial
  CRISPR gRNA sequence
gagtctgcgtcatgagtatc

SEQ ID NO: 191548 - DNA, 20 bp, Artificial
  CRISPR gRNA sequence
agtctgcgtcatgagtatcc

SEQ ID NO: 191549 - DNA, 20 bp, Artificial
  CRISPR gRNA sequence
ctgcgtcatgagtatccagg

SEQ ID NO: 191550 - DNA, 20 bp, Artificial
  CRISPR gRNA sequence
cgtcatgagtatccaggaag

SEQ ID NO: 191551 - DNA, 20 bp, Artificial
  CRISPR gRNA sequence
gtcatgagtatccaggaaga

SEQ ID NO: 191552 - DNA, 20 bp, Artificial
  CRISPR gRNA sequence
caggaagaaggacacatgac

SEQ ID NO: 191553 - DNA, 20 bp, Artificial
  CRISPR gRNA sequence
aggaagaaggacacatgacc

SEQ ID NO: 191554 - DNA, 20 bp, Artificial
  CRISPR gRNA sequence
aggacacatgaccaggttac

SEQ ID NO: 191555 - DNA, 20 bp, Artificial
  CRISPR gRNA sequence
gacacatgaccaggttacga

SEQ ID NO: 191556 - DNA, 20 bp, Artificial
  CRISPR gRNA sequence
acacatgaccaggttacgag

SEQ ID NO: 191557 - DNA, 20 bp, Artificial
  CRISPR gRNA sequence
tgaccaggttacgagaggaa

SEQ ID NO: 191558 - DNA, 20 bp, Artificial
  CRISPR gRNA sequence
gaccaggttacgagaggaac

SEQ ID NO: 191559 - DNA, 20 bp, Artificial
  CRISPR gRNA sequence
acgagaggaacgggaaactg

SEQ ID NO: 191560 - DNA, 20 bp, Artificial
  CRISPR gRNA sequence
gagaggaacgggaaactgca

SEQ ID NO: 191561 - DNA, 20 bp, Artificial
  CRISPR gRNA sequence
cgggaaactgcagagtttcc

SEQ ID NO: 191562 - DNA, 20 bp, Artificial
  CRISPR gRNA sequence
ctgcagagtttcccagcaat

SEQ ID NO: 191563 - DNA, 20 bp, Artificial
  CRISPR gRNA sequence
cagagtttcccagcaatcag

SEQ ID NO: 191564 - DNA, 20 bp, Artificial
  CRISPR gRNA sequence
atcagcagttcttaaacttt

SEQ ID NO: 191565 - DNA, 20 bp, Artificial
  CRISPR gRNA sequence
tcagcagttcttaaactttt

SEQ ID NO: 191566 - DNA, 20 bp, Artificial
  CRISPR gRNA sequence
ctggtcatgtgtccttcttc

SEQ ID NO: 191567 - DNA, 20 bp, Artificial
  CRISPR gRNA sequence
agactcagttctcattccca

SEQ ID NO: 191568 - DNA, 20 bp, Artificial
  CRISPR gRNA sequence
gttctcattcccaatgggtg

SEQ ID NO: 191569 - DNA, 20 bp, Artificial
  CRISPR gRNA sequence
agttctcaggactcagaggc

SEQ ID NO: 191570 - DNA, 20 bp, Artificial
  CRISPR gRNA sequence
tggcccttacccagacctgg

SEQ ID NO: 191571 - DNA, 20 bp, Artificial
  CRISPR gRNA sequence
ccttacccagacctgggcgg

SEQ ID NO: 191572 - DNA, 20 bp, Artificial
  CRISPR gRNA sequence
cagacctgggcgggtgagtg

SEQ ID NO: 191573 - DNA, 20 bp, Artificial
  CRISPR gRNA sequence
tgggcgggtgagtgcggggt

SEQ ID NO: 191574 - DNA, 20 bp, Artificial
  CRISPR gRNA sequence
ggatggaaacggcctctacc

SEQ ID NO: 191575 - DNA, 20 bp, Artificial
  CRISPR gRNA sequence
tcggggagccgcgccgggag

SEQ ID NO: 191576 - DNA, 20 bp, Artificial
  CRISPR gRNA sequence
tgcgcttcgacaacgacgcc

SEQ ID NO: 191577 - DNA, 20 bp, Artificial
  CRISPR gRNA sequence
gacaacgacgccgcgagtcc

SEQ ID NO: 191578 - DNA, 20 bp, Artificial
  CRISPR gRNA sequence
aggatggtgccgcgggcgcc

SEQ ID NO: 191579 - DNA, 20 bp, Artificial
  CRISPR gRNA sequence
ggcgccgtggatggagcagg

SEQ ID NO: 191580 - DNA, 20 bp, Artificial
  CRISPR gRNA sequence
gtggatggagcaggaggggt

SEQ ID NO: 191581 - DNA, 20 bp, Artificial
  CRISPR gRNA sequence
agggacaccgcacagatttt

SEQ ID NO: 191582 - DNA, 20 bp, Artificial
  CRISPR gRNA sequence
acaccgcacagattttccga

SEQ ID NO: 191583 - DNA, 20 bp, Artificial
  CRISPR gRNA sequence
ctacaatcagagcgaggccg

SEQ ID NO: 191584 - DNA, 20 bp, Artificial
  CRISPR gRNA sequence
ccccatcccccacggacggc

SEQ ID NO: 191585 - DNA, 20 bp, Artificial
  CRISPR gRNA sequence
cacggacggcgcgggtcccc

SEQ ID NO: 191586 - DNA, 20 bp, Artificial
  CRISPR gRNA sequence
gcgcgggtcccctcgaatct

SEQ ID NO: 191587 - DNA, 20 bp, Artificial
  CRISPR gRNA sequence
cgcccagaccctagaccggg

SEQ ID NO: 191588 - DNA, 20 bp, Artificial
  CRISPR gRNA sequence
agtttaggccaaaatgccca

SEQ ID NO: 191589 - DNA, 20 bp, Artificial
  CRISPR gRNA sequence
gactgactaaggggcggggc

SEQ ID NO: 191590 - DNA, 20 bp, Artificial
  CRISPR gRNA sequence
ccagggtctcacaccctgca

SEQ ID NO: 191591 - DNA, 20 bp, Artificial
  CRISPR gRNA sequence
gcccgacgggcgcttcctcc

SEQ ID NO: 191592 - DNA, 20 bp, Artificial
  CRISPR gRNA sequence
aacagttcgcctacgacggc

SEQ ID NO: 191593 - DNA, 20 bp, Artificial
  CRISPR gRNA sequence
acggcaaggattatctcacc

SEQ ID NO: 191594 - DNA, 20 bp, Artificial
  CRISPR gRNA sequence
ctacctggaagacacatgcg

SEQ ID NO: 191595 - DNA, 20 bp, Artificial
  CRISPR gRNA sequence
ggaaggagacgctgcttcac

SEQ ID NO: 191596 - DNA, 20 bp, Artificial
  CRISPR gRNA sequence
acgctgcttcacctgggtaa

SEQ ID NO: 191597 - DNA, 20 bp, Artificial
  CRISPR gRNA sequence
cctcaaacagtagaagaaac

SEQ ID NO: 191598 - DNA, 20 bp, Artificial
  CRISPR gRNA sequence
gaagaaacagggatggaggc

SEQ ID NO: 191599 - DNA, 20 bp, Artificial
  CRISPR gRNA sequence
gccagaataccactcctccc

SEQ ID NO: 191600 - DNA, 20 bp, Artificial
  CRISPR gRNA sequence
gtacaggagatcctatacca

SEQ ID NO: 191601 - DNA, 20 bp, Artificial
  CRISPR gRNA sequence
acctctctcaggggcaatta

SEQ ID NO: 191602 - DNA, 20 bp, Artificial
  CRISPR gRNA sequence
tctctttgactcccagtatt

SEQ ID NO: 191603 - DNA, 20 bp, Artificial
  CRISPR gRNA sequence
cccagtattaggaatcacgg

SEQ ID NO: 191604 - DNA, 20 bp, Artificial
  CRISPR gRNA sequence
ctgattctcagccccacacc

SEQ ID NO: 191605 - DNA, 20 bp, Artificial
  CRISPR gRNA sequence
cccgattctagaactttcca

SEQ ID NO: 191606 - DNA, 20 bp, Artificial
  CRISPR gRNA sequence
ataattgtcctcttccttct

SEQ ID NO: 191607 - DNA, 20 bp, Artificial
  CRISPR gRNA sequence
ttccttctcaggatggtcac

SEQ ID NO: 191608 - DNA, 20 bp, Artificial
  CRISPR gRNA sequence
gatggtcacatgggtgctgc

SEQ ID NO: 191609 - DNA, 20 bp, Artificial
  CRISPR gRNA sequence
ccatgagagatacaaagtgc

SEQ ID NO: 191610 - DNA, 20 bp, Artificial
  CRISPR gRNA sequence
agatcacactgacctggcag

SEQ ID NO: 191611 - DNA, 20 bp, Artificial
  CRISPR gRNA sequence
tcgtggagaccaggcctgca

SEQ ID NO: 191612 - DNA, 20 bp, Artificial
  CRISPR gRNA sequence
ccgagcccgtcaccctgaga

SEQ ID NO: 191613 - DNA, 20 bp, Artificial
  CRISPR gRNA sequence
ccctgagatggagtaaggag

SEQ ID NO: 191614 - DNA, 20 bp, Artificial
  CRISPR gRNA sequence
gcccttctggagcccttccg

SEQ ID NO: 191615 - DNA, 20 bp, Artificial
  CRISPR gRNA sequence
cagggtcagggctgaggcct

SEQ ID NO: 191616 - DNA, 20 bp, Artificial
  CRISPR gRNA sequence
cattgctggcctggttctcc

SEQ ID NO: 191617 - DNA, 20 bp, Artificial
  CRISPR gRNA sequence
agctcaggtggggaagggag

SEQ ID NO: 191618 - DNA, 20 bp, Artificial
  CRISPR gRNA sequence
aggtggggaagggagaaggg

SEQ ID NO: 191619 - DNA, 20 bp, Artificial
  CRISPR gRNA sequence
ggaagggagaagggtggggt

SEQ ID NO: 191620 - DNA, 20 bp, Artificial
  CRISPR gRNA sequence
gtctgagttttcttgtccca

SEQ ID NO: 191621 - DNA, 20 bp, Artificial
  CRISPR gRNA sequence
cctactctttttttttgaga

SEQ ID NO: 191622 - DNA, 20 bp, Artificial
  CRISPR gRNA sequence
cttggctctgtcacccaggc

SEQ ID NO: 191623 - DNA, 20 bp, Artificial
  CRISPR gRNA sequence
ttttgtatttttagtggaga

SEQ ID NO: 191624 - DNA, 20 bp, Artificial
  CRISPR gRNA sequence
gcctcggcctcccaaagtgc

SEQ ID NO: 191625 - DNA, 20 bp, Artificial
  CRISPR gRNA sequence
tcacgtttcctgatcctgcc

SEQ ID NO: 191626 - DNA, 20 bp, Artificial
  CRISPR gRNA sequence
cacagttcaggaaacttctc

SEQ ID NO: 191627 - DNA, 20 bp, Artificial
  CRISPR gRNA sequence
aggagggagctactctaagg

SEQ ID NO: 191628 - DNA, 20 bp, Artificial
  CRISPR gRNA sequence
cccagggagcgacagtgccc

SEQ ID NO: 191629 - DNA, 20 bp, Artificial
  CRISPR gRNA sequence
gagcgacagtgcccaggggt

SEQ ID NO: 191630 - DNA, 20 bp, Artificial
  CRISPR gRNA sequence
gcttgtaaaggtgagattct

SEQ ID NO: 191631 - DNA, 20 bp, Artificial
  CRISPR gRNA sequence
tgagattctgggggtctgaa

SEQ ID NO: 191632 - DNA, 20 bp, Artificial
  CRISPR gRNA sequence
ctgggggtctgaagtgggtg

SEQ ID NO: 191633 - DNA, 20 bp, Artificial
  CRISPR gRNA sequence
gtggggcagaggggacagga

SEQ ID NO: 191634 - DNA, 20 bp, Artificial
  CRISPR gRNA sequence
aggggacaggactgggttgt

SEQ ID NO: 191635 - DNA, 20 bp, Artificial
  CRISPR gRNA sequence
gttgtggggattttttgatt

SEQ ID NO: 191636 - DNA, 20 bp, Artificial
  CRISPR gRNA sequence
gattttttgattcagaattt

SEQ ID NO: 191637 - DNA, 20 bp, Artificial
  CRISPR gRNA sequence
tgagtgtgtggtgggctgtt

SEQ ID NO: 191638 - DNA, 20 bp, Artificial
  CRISPR gRNA sequence
catcacttaccgtgactgac

SEQ ID NO: 191639 - DNA, 20 bp, Artificial
  CRISPR gRNA sequence
ccttgtgtgcgactgagatg

SEQ ID NO: 191640 - DNA, 20 bp, Artificial
  CRISPR gRNA sequence
ttctctttttgcaagggcct

SEQ ID NO: 191641 - DNA, 20 bp, Artificial
  CRISPR gRNA sequence
attaaaaataagaacctggg

SEQ ID NO: 191642 - DNA, 20 bp, Artificial
  CRISPR gRNA sequence
tactcaggaggcggaggcag

SEQ ID NO: 191643 - DNA, 20 bp, Artificial
  CRISPR gRNA sequence
aggcggaggttgcagtgagc

SEQ ID NO: 191644 - DNA, 20 bp, Artificial
  CRISPR gRNA sequence
ttgtgcgactgcactccagc

SEQ ID NO: 191645 - DNA, 20 bp, Artificial
  CRISPR gRNA sequence
ctgcactccagcctgggtga

SEQ ID NO: 191646 - DNA, 20 bp, Artificial
  CRISPR gRNA sequence
ttgaaaaataaaaaaagaac

SEQ ID NO: 191647 - DNA, 20 bp, Artificial
  CRISPR gRNA sequence
gtaatcttgaccatatacct

SEQ ID NO: 191648 - DNA, 20 bp, Artificial
  CRISPR gRNA sequence
cttgaccatataccttggag

SEQ ID NO: 191649 - DNA, 20 bp, Artificial
  CRISPR gRNA sequence
tgttttcatactgctgtggt

SEQ ID NO: 191650 - DNA, 20 bp, Artificial
  CRISPR gRNA sequence
gtggggcctttgagatgtga

SEQ ID NO: 191651 - DNA, 20 bp, Artificial
  CRISPR gRNA sequence
gtaaggctgtgccttcattc

SEQ ID NO: 191652 - DNA, 20 bp, Artificial
  CRISPR gRNA sequence
gtgccttcattcatgggtta

SEQ ID NO: 191653 - DNA, 20 bp, Artificial
  CRISPR gRNA sequence
attcatgggttaatggatta

SEQ ID NO: 191654 - DNA, 20 bp, Artificial
  CRISPR gRNA sequence
atggattaatgggttatcac

SEQ ID NO: 191655 - DNA, 20 bp, Artificial
  CRISPR gRNA sequence
agcccacagagagcctccac

SEQ ID NO: 191656 - DNA, 20 bp, Artificial
  CRISPR gRNA sequence
agggaaatgtctagtgtcta

SEQ ID NO: 191657 - DNA, 20 bp, Artificial
  CRISPR gRNA sequence
agtggatccaggccacagga

SEQ ID NO: 191658 - DNA, 20 bp, Artificial
  CRISPR gRNA sequence
ccaccaggaccccagaactg

SEQ ID NO: 191659 - DNA, 20 bp, Artificial
  CRISPR gRNA sequence
gaccatggcattggaagcca

SEQ ID NO: 191660 - DNA, 20 bp, Artificial
  CRISPR gRNA sequence
attggaagccaaaggatagc

SEQ ID NO: 191661 - DNA, 20 bp, Artificial
  CRISPR gRNA sequence
gatcagcctgggaaggtgag

SEQ ID NO: 191662 - DNA, 20 bp, Artificial
  CRISPR gRNA sequence
gaatgaagcagatgctgtta

SEQ ID NO: 191663 - DNA, 20 bp, Artificial
  CRISPR gRNA sequence
agaaaaggtatctgtgggaa

SEQ ID NO: 191664 - DNA, 20 bp, Artificial
  CRISPR gRNA sequence
cctcacggacacactggagc

SEQ ID NO: 191665 - DNA, 20 bp, Artificial
  CRISPR gRNA sequence
gccccgtgcctgtggctttg

SEQ ID NO: 191666 - DNA, 20 bp, Artificial
  CRISPR gRNA sequence
ggtgcagcctacgtggctgc

SEQ ID NO: 191667 - DNA, 20 bp, Artificial
  CRISPR gRNA sequence
cagcctacgtggctgctcga

SEQ ID NO: 191668 - DNA, 20 bp, Artificial
  CRISPR gRNA sequence
tgccactgactccacagttc

SEQ ID NO: 191669 - DNA, 20 bp, Artificial
  CRISPR gRNA sequence
aaggcactctctcctgtggc

SEQ ID NO: 191670 - DNA, 20 bp, Artificial
  CRISPR gRNA sequence
acccattaatccattaaccc

SEQ ID NO: 191671 - DNA, 20 bp, Artificial
  CRISPR gRNA sequence
cctttcagtattgccacatt

SEQ ID NO: 191672 - DNA, 20 bp, Artificial
  CRISPR gRNA sequence
attagggattaagtctcaac

SEQ ID NO: 191673 - DNA, 20 bp, Artificial
  CRISPR gRNA sequence
ggtcaagattacaggtggta

SEQ ID NO: 191674 - DNA, 20 bp, Artificial
  CRISPR gRNA sequence
aggtggtaaggaataggcta

SEQ ID NO: 191675 - DNA, 20 bp, Artificial
  CRISPR gRNA sequence
taaggaataggctagagaat

SEQ ID NO: 191676 - DNA, 20 bp, Artificial
  CRISPR gRNA sequence
aatttgctagagatgtgctg

SEQ ID NO: 191677 - DNA, 20 bp, Artificial
  CRISPR gRNA sequence
cctcaagtccatttcattgc

SEQ ID NO: 191678 - DNA, 20 bp, Artificial
  CRISPR gRNA sequence
tttcaccctgtcacccaggc

SEQ ID NO: 191679 - DNA, 20 bp, Artificial
  CRISPR gRNA sequence
ctcactgcaacctccgcctc

SEQ ID NO: 191680 - DNA, 20 bp, Artificial
  CRISPR gRNA sequence
cattctcctgcctccgcctc

SEQ ID NO: 191681 - DNA, 20 bp, Artificial
  CRISPR gRNA sequence
tttgtattttttagtagaga

SEQ ID NO: 191682 - DNA, 20 bp, Artificial
  CRISPR gRNA sequence
cggggtttcaccgtgttagc

SEQ ID NO: 191683 - DNA, 20 bp, Artificial
  CRISPR gRNA sequence
tcctcggcctccctaagtgc

SEQ ID NO: 191684 - DNA, 20 bp, Artificial
  CRISPR gRNA sequence
acacaggtcagtgtgaggaa

SEQ ID NO: 191685 - DNA, 20 bp, Artificial
  CRISPR gRNA sequence
gcccttgcaaaaagagaagc

SEQ ID NO: 191686 - DNA, 20 bp, Artificial
  CRISPR gRNA sequence
ccaccacacactcaaaaatt

SEQ ID NO: 191687 - DNA, 20 bp, Artificial
  CRISPR gRNA sequence
ctccacccacttcagacccc

SEQ ID NO: 191688 - DNA, 20 bp, Artificial
  CRISPR gRNA sequence
ccctgggcactgtcgctccc

SEQ ID NO: 191689 - DNA, 20 bp, Artificial
  CRISPR gRNA sequence
cacaggagatgtggtgcagg

SEQ ID NO: 191690 - DNA, 20 bp, Artificial
  CRISPR gRNA sequence
atgtggtgcaggaggaatta

SEQ ID NO: 191691 - DNA, 20 bp, Artificial
  CRISPR gRNA sequence
cccgcacttacactcagcct

SEQ ID NO: 191692 - DNA, 20 bp, Artificial
  CRISPR gRNA sequence
cctagaggaacctcctagtt

SEQ ID NO: 191693 - DNA, 20 bp, Artificial
  CRISPR gRNA sequence
ctgtgactgcagacccaggg

SEQ ID NO: 191694 - DNA, 20 bp, Artificial
  CRISPR gRNA sequence
gaaacgtgaagaaagcaggt

SEQ ID NO: 191695 - DNA, 20 bp, Artificial
  CRISPR gRNA sequence
gaagaaagcaggtgtgggtc

SEQ ID NO: 191696 - DNA, 20 bp, Artificial
  CRISPR gRNA sequence
cccctgtgacctgtgactgc

SEQ ID NO: 191697 - DNA, 20 bp, Artificial
  CRISPR gRNA sequence
ttgtcacaggtgctttacaa

SEQ ID NO: 191698 - DNA, 20 bp, Artificial
  CRISPR gRNA sequence
ttacaaaagagtaggtgcgg

SEQ ID NO: 191699 - DNA, 20 bp, Artificial
  CRISPR gRNA sequence
ggcaggcagatcacaaagtc

SEQ ID NO: 191700 - DNA, 20 bp, Artificial
  CRISPR gRNA sequence
tactagggaggctgaggcag

SEQ ID NO: 191701 - DNA, 20 bp, Artificial
  CRISPR gRNA sequence
ccacgccattgcactccagc

SEQ ID NO: 191702 - DNA, 20 bp, Artificial
  CRISPR gRNA sequence
aagactccgtctcaaaaaaa

SEQ ID NO: 191703 - DNA, 20 bp, Artificial
  CRISPR gRNA sequence
ctggcacacagggccccagg

SEQ ID NO: 191704 - DNA, 20 bp, Artificial
  CRISPR gRNA sequence
ggctgggtaggctcgtgtgt

SEQ ID NO: 191705 - DNA, 20 bp, Artificial
  CRISPR gRNA sequence
ccagcaatgatgcccacgat

SEQ ID NO: 191706 - DNA, 20 bp, Artificial
  CRISPR gRNA sequence
tccccctccttactccatct

SEQ ID NO: 191707 - DNA, 20 bp, Artificial
  CRISPR gRNA sequence
tccatctcagggtgacgggc

SEQ ID NO: 191708 - DNA, 20 bp, Artificial
  CRISPR gRNA sequence
gtctccacgagctccgtgtc

SEQ ID NO: 191709 - DNA, 20 bp, Artificial
  CRISPR gRNA sequence
ccaggtcagtgtgatctccg

SEQ ID NO: 191710 - DNA, 20 bp, Artificial
  CRISPR gRNA sequence
aagcccagggcccagcacct

SEQ ID NO: 191711 - DNA, 20 bp, Artificial
  CRISPR gRNA sequence
ggtggcctcatggtcagaga

SEQ ID NO: 191712 - DNA, 20 bp, Artificial
  CRISPR gRNA sequence
tcatggtcagagatggggtg

SEQ ID NO: 191713 - DNA, 20 bp, Artificial
  CRISPR gRNA sequence
tctttgggggctctgagggg

SEQ ID NO: 191714 - DNA, 20 bp, Artificial
  CRISPR gRNA sequence
cttgacaccagcctggactt

SEQ ID NO: 191715 - DNA, 20 bp, Artificial
  CRISPR gRNA sequence
ccagcctggacttagggatc

SEQ ID NO: 191716 - DNA, 20 bp, Artificial
  CRISPR gRNA sequence
tcttattccttggaaagttc

SEQ ID NO: 191717 - DNA, 20 bp, Artificial
  CRISPR gRNA sequence
tccttggaaagttctagaat

SEQ ID NO: 191718 - DNA, 20 bp, Artificial
  CRISPR gRNA sequence
agaatcgggatgagctagcc

SEQ ID NO: 191719 - DNA, 20 bp, Artificial
  CRISPR gRNA sequence
gcccagggtagaaggtgaaa

SEQ ID NO: 191720 - DNA, 20 bp, Artificial
  CRISPR gRNA sequence
gatttctggtcctggcctgt

SEQ ID NO: 191721 - DNA, 20 bp, Artificial
  CRISPR gRNA sequence
ggtcctggcctgtgtggatg

SEQ ID NO: 191722 - DNA, 20 bp, Artificial
  CRISPR gRNA sequence
gctgagtgactgagaaaagc

SEQ ID NO: 191723 - DNA, 20 bp, Artificial
  CRISPR gRNA sequence
aaaactcttggtgtggggct

SEQ ID NO: 191724 - DNA, 20 bp, Artificial
  CRISPR gRNA sequence
cccccgtgattcctaatact

SEQ ID NO: 191725 - DNA, 20 bp, Artificial
  CRISPR gRNA sequence
actgctcatcagttcatctg

SEQ ID NO: 191726 - DNA, 20 bp, Artificial
  CRISPR gRNA sequence
tcatcagttcatctgaagga

SEQ ID NO: 191727 - DNA, 20 bp, Artificial
  CRISPR gRNA sequence
agagaggtctggccctttaa

SEQ ID NO: 191728 - DNA, 20 bp, Artificial
  CRISPR gRNA sequence
aagagagtcactctgtggta

SEQ ID NO: 191729 - DNA, 20 bp, Artificial
  CRISPR gRNA sequence
tccctctcctgatccaaggg

SEQ ID NO: 191730 - DNA, 20 bp, Artificial
  CRISPR gRNA sequence
ggcacagtcctagcccaaga

SEQ ID NO: 191731 - DNA, 20 bp, Artificial
  CRISPR gRNA sequence
ctagcccaagaaggagttgg

SEQ ID NO: 191732 - DNA, 20 bp, Artificial
  CRISPR gRNA sequence
caggagcgcaggtcctcatt

SEQ ID NO: 191733 - DNA, 20 bp, Artificial
  CRISPR gRNA sequence
tcgcagccatgcatccactg

SEQ ID NO: 191734 - DNA, 20 bp, Artificial
  CRISPR gRNA sequence
tggcctaaactgaaaaagaa

SEQ ID NO: 191735 - DNA, 20 bp, Artificial
  CRISPR gRNA sequence
gcctgagactctccccggtc

SEQ ID NO: 191736 - DNA, 20 bp, Artificial
  CRISPR gRNA sequence
ctccccggtctagggtctgg

SEQ ID NO: 191737 - DNA, 20 bp, Artificial
  CRISPR gRNA sequence
ctgggcgggttccgcagcct

SEQ ID NO: 191738 - DNA, 20 bp, Artificial
  CRISPR gRNA sequence
gcgggttccgcagccttggg

SEQ ID NO: 191739 - DNA, 20 bp, Artificial
  CRISPR gRNA sequence
ggggacccgcgccgtccgtg

SEQ ID NO: 191740 - DNA, 20 bp, Artificial
  CRISPR gRNA sequence
gccgtccgtgggggatgggg

SEQ ID NO: 191741 - DNA, 20 bp, Artificial
  CRISPR gRNA sequence
tcgtgacctgctcccctggc

SEQ ID NO: 191742 - DNA, 20 bp, Artificial
  CRISPR gRNA sequence
tcgttgtcgaagcgcacgaa

SEQ ID NO: 191743 - DNA, 20 bp, Artificial
  CRISPR gRNA sequence
ggaagtgtggaaatacttca

SEQ ID NO: 191744 - DNA, 20 bp, Artificial
  CRISPR gRNA sequence
cctcctcccggcgcggctcc

SEQ ID NO: 191745 - DNA, 20 bp, Artificial
  CRISPR gRNA sequence
ccgcactcacccgcccaggt

SEQ ID NO: 191746 - DNA, 20 bp, Artificial
  CRISPR gRNA sequence
taagggccagggcctccgag

SEQ ID NO: 191747 - DNA, 20 bp, Artificial
  CRISPR gRNA sequence
gcctccgagaggagtaaaag

SEQ ID NO: 191748 - DNA, 20 bp, Artificial
  CRISPR gRNA sequence
atctaccatgatcccagcct

SEQ ID NO: 191749 - DNA, 20 bp, Artificial
  CRISPR gRNA sequence
ctctgagtcctgagaacttc

SEQ ID NO: 191750 - DNA, 20 bp, Artificial
  CRISPR gRNA sequence
gtcctgagaacttcttgagt

SEQ ID NO: 191751 - DNA, 20 bp, Artificial
  CRISPR gRNA sequence
cggatggggactttatagtc

SEQ ID NO: 191752 - DNA, 20 bp, Artificial
  CRISPR gRNA sequence
ctagaaacccgacacccatt

SEQ ID NO: 191753 - DNA, 20 bp, Artificial
  CRISPR gRNA sequence
acacccattgggaatgagaa

SEQ ID NO: 191754 - DNA, 20 bp, Artificial
  CRISPR gRNA sequence
atgagaactgagtctgcgtc

SEQ ID NO: 191755 - DNA, 20 bp, Artificial
  CRISPR gRNA sequence
acgagaggaacgggaaactg

SEQ ID NO: 191756 - DNA, 20 bp, Artificial
  CRISPR gRNA sequence
aaacctaaaagtttaagaac

SEQ ID NO: 191757 - DNA, 20 bp, Artificial
  CRISPR gRNA sequence
tgctgattgctgggaaactc

SEQ ID NO: 191758 - DNA, 20 bp, Artificial
  CRISPR gRNA sequence
gttctcattcccaatgggtg

SEQ ID NO: 191759 - DNA, 20 bp, Artificial
  CRISPR gRNA sequence
cccggcccggccgcggggag

SEQ ID NO: 191760 - DNA, 20 bp, Artificial
  CRISPR gRNA sequence
acgtggacgacacccagttc

SEQ ID NO: 191761 - DNA, 20 bp, Artificial
  CRISPR gRNA sequence
acggagcgccagggacaccg

SEQ ID NO: 191762 - DNA, 20 bp, Artificial
  CRISPR gRNA sequence
gtcccctcgaatcttcgggt

SEQ ID NO: 191763 - DNA, 20 bp, Artificial
  CRISPR gRNA sequence
gcgcctttacccggttcttt

SEQ ID NO: 191764 - DNA, 20 bp, Artificial
  CRISPR gRNA sequence
cagggtggtggcgacggggg

SEQ ID NO: 191765 - DNA, 20 bp, Artificial
  CRISPR gRNA sequence
gctgcgagctggggcccgac

SEQ ID NO: 191766 - DNA, 20 bp, Artificial
  CRISPR gRNA sequence
gaacagttcgcctacgacgg

SEQ ID NO: 191767 - DNA, 20 bp, Artificial
  CRISPR gRNA sequence
cctggagaaggggaaggaga

SEQ ID NO: 191768 - DNA, 20 bp, Artificial
  CRISPR gRNA sequence
attaaggaatctagtctcgc

SEQ ID NO: 191769 - DNA, 20 bp, Artificial
  CRISPR gRNA sequence
cccagtattaggaatcacgg

SEQ ID NO: 191770 - DNA, 20 bp, Artificial
  CRISPR gRNA sequence
cacgggggagtttctctcgt

SEQ ID NO: 191771 - DNA, 20 bp, Artificial
  CRISPR gRNA sequence
ctgattctcagccccacacc

SEQ ID NO: 191772 - DNA, 20 bp, Artificial
  CRISPR gRNA sequence
agagtttttggaggtctgac

SEQ ID NO: 191773 - DNA, 20 bp, Artificial
  CRISPR gRNA sequence
ttctaccctgggctagctca

SEQ ID NO: 191774 - DNA, 20 bp, Artificial
  CRISPR gRNA sequence
ccctaagtccaggctggtgt

SEQ ID NO: 191775 - DNA, 20 bp, Artificial
  CRISPR gRNA sequence
ccaccctgaggtgctgggcc

SEQ ID NO: 191776 - DNA, 20 bp, Artificial
  CRISPR gRNA sequence
cgttcccctcttttcccaga

SEQ ID NO: 191777 - DNA, 20 bp, Artificial
  CRISPR gRNA sequence
ggaagggagaagggtggggt

SEQ ID NO: 191778 - DNA, 20 bp, Artificial
  CRISPR gRNA sequence
ctgagttttcttgtcccact

SEQ ID NO: 191779 - DNA, 20 bp, Artificial
  CRISPR gRNA sequence
cccaggctggagtgcaatgg

SEQ ID NO: 191780 - DNA, 20 bp, Artificial
  CRISPR gRNA sequence
ttttgtatttttagtggaga

SEQ ID NO: 191781 - DNA, 20 bp, Artificial
  CRISPR gRNA sequence
tgcctcggcctcccaaagtg

SEQ ID NO: 191782 - DNA, 20 bp, Artificial
  CRISPR gRNA sequence
aagcacctgtgacaatgaag

SEQ ID NO: 191783 - DNA, 20 bp, Artificial
  CRISPR gRNA sequence
gaaggacagatttatcacct

SEQ ID NO: 191784 - DNA, 20 bp, Artificial
  CRISPR gRNA sequence
gcagttgatccaggacccac

SEQ ID NO: 191785 - DNA, 20 bp, Artificial
  CRISPR gRNA sequence
aggacccacacctgctttct

SEQ ID NO: 191786 - DNA, 20 bp, Artificial
  CRISPR gRNA sequence
tcctgtgggctctgaccagg

SEQ ID NO: 191787 - DNA, 20 bp, Artificial
  CRISPR gRNA sequence
gtgcccaggggtctgagtct

SEQ ID NO: 191788 - DNA, 20 bp, Artificial
  CRISPR gRNA sequence
gagtctcacagcttgtaaag

SEQ ID NO: 191789 - DNA, 20 bp, Artificial
  CRISPR gRNA sequence
gaggggacaggactgggttg

SEQ ID NO: 191790 - DNA, 20 bp, Artificial
  CRISPR gRNA sequence
aggactgggttgtggggatt

SEQ ID NO: 191791 - DNA, 20 bp, Artificial
  CRISPR gRNA sequence
gccttgtgtgcgactgagat

SEQ ID NO: 191792 - DNA, 20 bp, Artificial
  CRISPR gRNA sequence
ccctatgtgtcttaggggac

SEQ ID NO: 191793 - DNA, 20 bp, Artificial
  CRISPR gRNA sequence
gaggcggaggttgcagtgag

SEQ ID NO: 191794 - DNA, 20 bp, Artificial
  CRISPR gRNA sequence
ccatataccttggagttgaa

SEQ ID NO: 191795 - DNA, 20 bp, Artificial
  CRISPR gRNA sequence
gaatattgttttcatactgc

SEQ ID NO: 191796 - DNA, 20 bp, Artificial
  CRISPR gRNA sequence
tgaaaggtggggcctttgag

SEQ ID NO: 191797 - DNA, 20 bp, Artificial
  CRISPR gRNA sequence
tgtgccttcattcatgggtt

SEQ ID NO: 191798 - DNA, 20 bp, Artificial
  CRISPR gRNA sequence
gttatcacaggaatgggact

SEQ ID NO: 191799 - DNA, 20 bp, Artificial
  CRISPR gRNA sequence
agcatgcagcgcccccttgg

SEQ ID NO: 191800 - DNA, 20 bp, Artificial
  CRISPR gRNA sequence
gaggcagcacacgaagtcaa

SEQ ID NO: 191801 - DNA, 20 bp, Artificial
  CRISPR gRNA sequence
tcccatgaccctttaacagc

SEQ ID NO: 191802 - DNA, 20 bp, Artificial
  CRISPR gRNA sequence
actttgaagtaaaataaaag

SEQ ID NO: 191803 - DNA, 20 bp, Artificial
  CRISPR gRNA sequence
gcatcatttgtatttcattt

SEQ ID NO: 191804 - DNA, 20 bp, Artificial
  CRISPR gRNA sequence
catttgtgcgttttgtgcct

SEQ ID NO: 191805 - DNA, 20 bp, Artificial
  CRISPR gRNA sequence
taaccacattcaagctatcc

SEQ ID NO: 191806 - DNA, 20 bp, Artificial
  CRISPR gRNA sequence
catggcattggaagccaaag

SEQ ID NO: 191807 - DNA, 20 bp, Artificial
  CRISPR gRNA sequence
aaatacaaatgatgctcaaa

SEQ ID NO: 191808 - DNA, 20 bp, Artificial
  CRISPR gRNA sequence
acacagcttttattttactt

SEQ ID NO: 191809 - DNA, 20 bp, Artificial
  CRISPR gRNA sequence
gcctcacggacacactggag

SEQ ID NO: 191810 - DNA, 20 bp, Artificial
  CRISPR gRNA sequence
gcctcaggtagccccgtgcc

SEQ ID NO: 191811 - DNA, 20 bp, Artificial
  CRISPR gRNA sequence
atgggttgcaggctggtgcc

SEQ ID NO: 191812 - DNA, 20 bp, Artificial
  CRISPR gRNA sequence
acctttcagtattgccacat

SEQ ID NO: 191813 - DNA, 20 bp, Artificial
  CRISPR gRNA sequence
ttcaactccaaggtatatgg

SEQ ID NO: 191814 - DNA, 20 bp, Artificial
  CRISPR gRNA sequence
tctgtatttctagctatgat

SEQ ID NO: 191815 - DNA, 20 bp, Artificial
  CRISPR gRNA sequence
tcaatttttattttttgaga

SEQ ID NO: 191816 - DNA, 20 bp, Artificial
  CRISPR gRNA sequence
tttgtattttttagtagaga

SEQ ID NO: 191817 - DNA, 20 bp, Artificial
  CRISPR gRNA sequence
ggtttcaccgtgttagccag

SEQ ID NO: 191818 - DNA, 20 bp, Artificial
  CRISPR gRNA sequence
ctcctcggcctccctaagtg

SEQ ID NO: 191819 - DNA, 20 bp, Artificial
  CRISPR gRNA sequence
tcatggtagacacagaggtg

SEQ ID NO: 191820 - DNA, 20 bp, Artificial
  CRISPR gRNA sequence
attgtgctaacagggacaca

SEQ ID NO: 191821 - DNA, 20 bp, Artificial
  CRISPR gRNA sequence
ataaggtcctagaggaacct

SEQ ID NO: 191822 - DNA, 20 bp, Artificial
  CRISPR gRNA sequence
ctcctagttttggatcccag

SEQ ID NO: 191823 - DNA, 20 bp, Artificial
  CRISPR gRNA sequence
aatctgtccttcattgtcac

SEQ ID NO: 191824 - DNA, 20 bp, Artificial
  CRISPR gRNA sequence
tagggaggctgaggcaggag

SEQ ID NO: 191825 - DNA, 20 bp, Artificial
  CRISPR gRNA sequence
ggtaggctcgtgtgtgtgga

SEQ ID NO: 191826 - DNA, 20 bp, Artificial
  CRISPR gRNA sequence
aggcaggacacacttttacc

SEQ ID NO: 191827 - DNA, 20 bp, Artificial
  CRISPR gRNA sequence
cggaagggctccagaagggc

SEQ ID NO: 191828 - DNA, 20 bp, Artificial
  CRISPR gRNA sequence
agcccagggtagaaggtgaa

SEQ ID NO: 191829 - DNA, 20 bp, Artificial
  CRISPR gRNA sequence
caggcacgagagaaactccc

SEQ ID NO: 191830 - DNA, 20 bp, Artificial
  CRISPR gRNA sequence
aggatggaatctccagcgag

SEQ ID NO: 191831 - DNA, 20 bp, Artificial
  CRISPR gRNA sequence
agtggtattctggcctccat

SEQ ID NO: 191832 - DNA, 20 bp, Artificial
  CRISPR gRNA sequence
gcctccatccctgtttcttc

SEQ ID NO: 191833 - DNA, 20 bp, Artificial
  CRISPR gRNA sequence
cttggggtgaatctgggacc

SEQ ID NO: 191834 - DNA, 20 bp, Artificial
  CRISPR gRNA sequence
ggggtcactcaccggcctcg

SEQ ID NO: 191835 - DNA, 20 bp, Artificial
  CRISPR gRNA sequence
tgtagtagccgcgcagcgtc

SEQ ID NO: 191836 - DNA, 20 bp, Artificial
  CRISPR gRNA sequence
ccctctctactcccggtaga

SEQ ID NO: 191837 - DNA, 20 bp, Artificial
  CRISPR gRNA sequence
atagtcgggagtcgtggcga

SEQ ID NO: 191838 - DNA, 20 bp, Artificial
  CRISPR gRNA sequence
cgggagtcgtggcgacgctg

SEQ ID NO: 191839 - DNA, 20 bp, Artificial
  CRISPR gRNA sequence
acgagaggaacgggaaactg

SEQ ID NO: 191840 - DNA, 20 bp, Artificial
  CRISPR gRNA sequence
aatcagcagttcttaaactt

SEQ ID NO: 191841 - DNA, 20 bp, Artificial
  CRISPR gRNA sequence
ctgacagacctcaaacagta

SEQ ID NO: 191842 - DNA, 20 bp, Artificial
  CRISPR gRNA sequence
agaagaaacagggatggagg

SEQ ID NO: 191843 - DNA, 20 bp, Artificial
  CRISPR gRNA sequence
agcatccacacaggccagga

SEQ ID NO: 191844 - DNA, 20 bp, Artificial
  CRISPR gRNA sequence
ggttgtggggattttttgat

SEQ ID NO: 191845 - DNA, 20 bp, Artificial
  CRISPR gRNA sequence
ttagcacaatgtgaggaggt

SEQ ID NO: 191846 - DNA, 20 bp, Artificial
  CRISPR gRNA sequence
ctactcaggaggcggaggca

SEQ ID NO: 191847 - DNA, 20 bp, Artificial
  CRISPR gRNA sequence
tgaggaagctaagatcatag

SEQ ID NO: 191848 - DNA, 20 bp, Artificial
  CRISPR gRNA sequence
tgctgttaaagggtcatggg

SEQ ID NO: 191849 - DNA, 20 bp, Artificial
  CRISPR gRNA sequence
gagaaaaggtatctgtggga

SEQ ID NO: 191850 - DNA, 20 bp, Artificial
  CRISPR gRNA sequence
caggtggtaaggaataggct

SEQ ID NO: 191851 - DNA, 20 bp, Artificial
  CRISPR gRNA sequence
tcctcaagtccatttcattg

SEQ ID NO: 191852 - DNA, 20 bp, Artificial
  CRISPR gRNA sequence
tgcccaggttcttattttta

SEQ ID NO: 191853 - DNA, 20 bp, Artificial
  CRISPR gRNA sequence
ggcagctgtctcaggctaca

SEQ ID NO: 191854 - DNA, 20 bp, Artificial
  CRISPR gRNA sequence
cctccacccacttcagaccc

SEQ ID NO: 191855 - DNA, 20 bp, Artificial
  CRISPR gRNA sequence
ccctccttttccacctgttg

SEQ ID NO: 191856 - DNA, 20 bp, Artificial
  CRISPR gRNA sequence
agggcaggatcaggaaacgt

SEQ ID NO: 191857 - DNA, 20 bp, Artificial
  CRISPR gRNA sequence
ctactagggaggctgaggca

SEQ ID NO: 191858 - DNA, 20 bp, Artificial
  CRISPR gRNA sequence
gcttgaaacacccagtggga

SEQ ID NO: 191859 - DNA, 20 bp, Artificial
  CRISPR gRNA sequence
gggggctctgaggggaagag

SEQ ID NO: 191860 - DNA, 20 bp, Artificial
  CRISPR gRNA sequence
ctcttattccttggaaagtt

SEQ ID NO: 191861 - DNA, 20 bp, Artificial
  CRISPR gRNA sequence
ctgtgtggatgctgagtgac

SEQ ID NO: 191862 - DNA, 20 bp, Artificial
  CRISPR gRNA sequence
aaaaactcttggtgtggggc

SEQ ID NO: 191863 - DNA, 20 bp, Artificial
  CRISPR gRNA sequence
ggggctgagaatcaggcacg

SEQ ID NO: 191864 - DNA, 20 bp, Artificial
  CRISPR gRNA sequence
ggcgacgctgattggcttct

SEQ ID NO: 191865 - DNA, 20 bp, Artificial
  CRISPR gRNA sequence
caggaaacttctctgggatc

SEQ ID NO: 191866 - DNA, 20 bp, Artificial
  CRISPR gRNA sequence
cttgaatgtggttaaaaaat

SEQ ID NO: 191867 - DNA, 20 bp, Artificial
  CRISPR gRNA sequence
aaaattaaaacaacaaggca

SEQ ID NO: 191868 - DNA, 20 bp, Artificial
  CRISPR gRNA sequence
cattcaaaccacagcagtat

SEQ ID NO: 191869 - DNA, 20 bp, Artificial
  CRISPR gRNA sequence
gtcgctccctggggtagaac

SEQ ID NO: 191870 - DNA, 20 bp, Artificial
  CRISPR gRNA sequence
tgaaacacccagtgggacaa

SEQ ID NO: 191871 - DNA, 20 bp, Artificial
  CRISPR gRNA sequence
attatagtaggagaagagga

SEQ ID NO: 191872 - DNA, 20 bp, Artificial
  CRISPR gRNA sequence
aaagctggagtcagacctcc

SEQ ID NO: 191873 - DNA, 20 bp, Artificial
  CRISPR gRNA sequence
aaagtttaagaactgctgat

SEQ ID NO: 191874 - DNA, 20 bp, Artificial
  CRISPR gRNA sequence
aagaactgctgattgctggg

SEQ ID NO: 191875 - DNA, 20 bp, Artificial
  CRISPR gRNA sequence
agaactgctgattgctggga

SEQ ID NO: 191876 - DNA, 20 bp, Artificial
  CRISPR gRNA sequence
ctgattgctgggaaactctg

SEQ ID NO: 191877 - DNA, 20 bp, Artificial
  CRISPR gRNA sequence
attgctgggaaactctgcag

SEQ ID NO: 191878 - DNA, 20 bp, Artificial
  CRISPR gRNA sequence
ctgggaaactctgcagtttc

SEQ ID NO: 191879 - DNA, 20 bp, Artificial
  CRISPR gRNA sequence
ggaaactctgcagtttcccg

SEQ ID NO: 191880 - DNA, 20 bp, Artificial
  CRISPR gRNA sequence
tgcagtttcccgttcctctc

SEQ ID NO: 191881 - DNA, 20 bp, Artificial
  CRISPR gRNA sequence
cagtttcccgttcctctcgt

SEQ ID NO: 191882 - DNA, 20 bp, Artificial
  CRISPR gRNA sequence
cccgttcctctcgtaacctg

SEQ ID NO: 191883 - DNA, 20 bp, Artificial
  CRISPR gRNA sequence
ccgttcctctcgtaacctgg

SEQ ID NO: 191884 - DNA, 20 bp, Artificial
  CRISPR gRNA sequence
ctctcgtaacctggtcatgt

SEQ ID NO: 191885 - DNA, 20 bp, Artificial
  CRISPR gRNA sequence
tcgtaacctggtcatgtgtc

SEQ ID NO: 191886 - DNA, 20 bp, Artificial
  CRISPR gRNA sequence
gtaacctggtcatgtgtcct

SEQ ID NO: 191887 - DNA, 20 bp, Artificial
  CRISPR gRNA sequence
gtcatgtgtccttcttcctg

SEQ ID NO: 191888 - DNA, 20 bp, Artificial
  CRISPR gRNA sequence
cttcctggatactcatgacg

SEQ ID NO: 191889 - DNA, 20 bp, Artificial
  CRISPR gRNA sequence
ttcctggatactcatgacgc

SEQ ID NO: 191890 - DNA, 20 bp, Artificial
  CRISPR gRNA sequence
cctggatactcatgacgcag

SEQ ID NO: 191891 - DNA, 20 bp, Artificial
  CRISPR gRNA sequence
ctggatactcatgacgcaga

SEQ ID NO: 191892 - DNA, 20 bp, Artificial
  CRISPR gRNA sequence
gatactcatgacgcagactc

SEQ ID NO: 191893 - DNA, 20 bp, Artificial
  CRISPR gRNA sequence
atgacgcagactcagttctc

SEQ ID NO: 191894 - DNA, 20 bp, Artificial
  CRISPR gRNA sequence
agttctcattcccaatgggt

SEQ ID NO: 191895 - DNA, 20 bp, Artificial
  CRISPR gRNA sequence
tcattcccaatgggtgtcgg

SEQ ID NO: 191896 - DNA, 20 bp, Artificial
  CRISPR gRNA sequence
attcccaatgggtgtcgggt

SEQ ID NO: 191897 - DNA, 20 bp, Artificial
  CRISPR gRNA sequence
ccaatgggtgtcgggtttct

SEQ ID NO: 191898 - DNA, 20 bp, Artificial
  CRISPR gRNA sequence
ctagagaagccaatcagcgt

SEQ ID NO: 191899 - DNA, 20 bp, Artificial
  CRISPR gRNA sequence
tagagaagccaatcagcgtc

SEQ ID NO: 191900 - DNA, 20 bp, Artificial
  CRISPR gRNA sequence
gagaagccaatcagcgtcgc

SEQ ID NO: 191901 - DNA, 20 bp, Artificial
  CRISPR gRNA sequence
ccgactataaagtccccatc

SEQ ID NO: 191902 - DNA, 20 bp, Artificial
  CRISPR gRNA sequence
taaagtccccatccggactc

SEQ ID NO: 191903 - DNA, 20 bp, Artificial
  CRISPR gRNA sequence
aagaagttctcaggactcag

SEQ ID NO: 191904 - DNA, 20 bp, Artificial
  CRISPR gRNA sequence
tcaggactcagaggctggga

SEQ ID NO: 191905 - DNA, 20 bp, Artificial
  CRISPR gRNA sequence
aggactcagaggctgggatc

SEQ ID NO: 191906 - DNA, 20 bp, Artificial
  CRISPR gRNA sequence
agaggctgggatcatggtag

SEQ ID NO: 191907 - DNA, 20 bp, Artificial
  CRISPR gRNA sequence
ggatcatggtagatggaacc

SEQ ID NO: 191908 - DNA, 20 bp, Artificial
  CRISPR gRNA sequence
cttttactcctctcggaggc

SEQ ID NO: 191909 - DNA, 20 bp, Artificial
  CRISPR gRNA sequence
ttactcctctcggaggccct

SEQ ID NO: 191910 - DNA, 20 bp, Artificial
  CRISPR gRNA sequence
tactcctctcggaggccctg

SEQ ID NO: 191911 - DNA, 20 bp, Artificial
  CRISPR gRNA sequence
actcctctcggaggccctgg

SEQ ID NO: 191912 - DNA, 20 bp, Artificial
  CRISPR gRNA sequence
ctcctctcggaggccctggc

SEQ ID NO: 191913 - DNA, 20 bp, Artificial
  CRISPR gRNA sequence
ctctcggaggccctggccct

SEQ ID NO: 191914 - DNA, 20 bp, Artificial
  CRISPR gRNA sequence
tcggaggccctggcccttac

SEQ ID NO: 191915 - DNA, 20 bp, Artificial
  CRISPR gRNA sequence
ggaggccctggcccttaccc

SEQ ID NO: 191916 - DNA, 20 bp, Artificial
  CRISPR gRNA sequence
gcccttacccagacctgggc

SEQ ID NO: 191917 - DNA, 20 bp, Artificial
  CRISPR gRNA sequence
acccagacctgggcgggtga

SEQ ID NO: 191918 - DNA, 20 bp, Artificial
  CRISPR gRNA sequence
cccagacctgggcgggtgag

SEQ ID NO: 191919 - DNA, 20 bp, Artificial
  CRISPR gRNA sequence
ggcgggtgagtgcggggtcg

SEQ ID NO: 191920 - DNA, 20 bp, Artificial
  CRISPR gRNA sequence
taccgggagtagagaggggc

SEQ ID NO: 191921 - DNA, 20 bp, Artificial
  CRISPR gRNA sequence
ccgggagtagagaggggccg

SEQ ID NO: 191922 - DNA, 20 bp, Artificial
  CRISPR gRNA sequence
ggggagccgcgccgggagga

SEQ ID NO: 191923 - DNA, 20 bp, Artificial
  CRISPR gRNA sequence
agcccctcctcgcccccagg

SEQ ID NO: 191924 - DNA, 20 bp, Artificial
  CRISPR gRNA sequence
ctcgcccccaggctcccact

SEQ ID NO: 191925 - DNA, 20 bp, Artificial
  CRISPR gRNA sequence
gcccccaggctcccactcct

SEQ ID NO: 191926 - DNA, 20 bp, Artificial
  CRISPR gRNA sequence
ccactccttgaagtatttcc

SEQ ID NO: 191927 - DNA, 20 bp, Artificial
  CRISPR gRNA sequence
cttgaagtatttccacactt

SEQ ID NO: 191928 - DNA, 20 bp, Artificial
  CRISPR gRNA sequence
gaagtatttccacacttccg

SEQ ID NO: 191929 - DNA, 20 bp, Artificial
  CRISPR gRNA sequence
aagtatttccacacttccgt

SEQ ID NO: 191930 - DNA, 20 bp, Artificial
  CRISPR gRNA sequence
ccacacttccgtgtcccggc

SEQ ID NO: 191931 - DNA, 20 bp, Artificial
  CRISPR gRNA sequence
cacacttccgtgtcccggcc

SEQ ID NO: 191932 - DNA, 20 bp, Artificial
  CRISPR gRNA sequence
ccgtgtcccggcccggccgc

SEQ ID NO: 191933 - DNA, 20 bp, Artificial
  CRISPR gRNA sequence
cgtgtcccggcccggccgcg

SEQ ID NO: 191934 - DNA, 20 bp, Artificial
  CRISPR gRNA sequence
catctctgtgggctacgtgg

SEQ ID NO: 191935 - DNA, 20 bp, Artificial
  CRISPR gRNA sequence
atctctgtgggctacgtgga

SEQ ID NO: 191936 - DNA, 20 bp, Artificial
  CRISPR gRNA sequence
tgtgggctacgtggacgaca

SEQ ID NO: 191937 - DNA, 20 bp, Artificial
  CRISPR gRNA sequence
tgggctacgtggacgacacc

SEQ ID NO: 191938 - DNA, 20 bp, Artificial
  CRISPR gRNA sequence
cgtggacgacacccagttcg

SEQ ID NO: 191939 - DNA, 20 bp, Artificial
  CRISPR gRNA sequence
gtgcgcttcgacaacgacgc

SEQ ID NO: 191940 - DNA, 20 bp, Artificial
  CRISPR gRNA sequence
cgacaacgacgccgcgagtc

SEQ ID NO: 191941 - DNA, 20 bp, Artificial
  CRISPR gRNA sequence
gacaacgacgccgcgagtcc

SEQ ID NO: 191942 - DNA, 20 bp, Artificial
  CRISPR gRNA sequence
ggaccgggagacacggagcg

SEQ ID NO: 191943 - DNA, 20 bp, Artificial
  CRISPR gRNA sequence
tccgagtgaatctgcggacg

SEQ ID NO: 191944 - DNA, 20 bp, Artificial
  CRISPR gRNA sequence
ccgagtgaatctgcggacgc

SEQ ID NO: 191945 - DNA, 20 bp, Artificial
  CRISPR gRNA sequence
cgagtgaatctgcggacgct

SEQ ID NO: 191946 - DNA, 20 bp, Artificial
  CRISPR gRNA sequence
cggacgctgcgcggctacta

SEQ ID NO: 191947 - DNA, 20 bp, Artificial
  CRISPR gRNA sequence
cgcggctactacaatcagag

SEQ ID NO: 191948 - DNA, 20 bp, Artificial
  CRISPR gRNA sequence
ctacaatcagagcgaggccg

SEQ ID NO: 191949 - DNA, 20 bp, Artificial
  CRISPR gRNA sequence
caatcagagcgaggccggtg

SEQ ID NO: 191950 - DNA, 20 bp, Artificial
  CRISPR gRNA sequence
cccatcccccacggacggcg

SEQ ID NO: 191951 - DNA, 20 bp, Artificial
  CRISPR gRNA sequence
gaatcttcgggtcccagatt

SEQ ID NO: 191952 - DNA, 20 bp, Artificial
  CRISPR gRNA sequence
cgggtcccagattcacccca

SEQ ID NO: 191953 - DNA, 20 bp, Artificial
  CRISPR gRNA sequence
gggtcccagattcaccccaa

SEQ ID NO: 191954 - DNA, 20 bp, Artificial
  CRISPR gRNA sequence
accccaaggctgcggaaccc

SEQ ID NO: 191955 - DNA, 20 bp, Artificial
  CRISPR gRNA sequence
cggaacccgcccagacccta

SEQ ID NO: 191956 - DNA, 20 bp, Artificial
  CRISPR gRNA sequence
gaccggggagagtctcaggc

SEQ ID NO: 191957 - DNA, 20 bp, Artificial
  CRISPR gRNA sequence
aggcgcctttacccggttct

SEQ ID NO: 191958 - DNA, 20 bp, Artificial
  CRISPR gRNA sequence
tacccggttctttttcagtt

SEQ ID NO: 191959 - DNA, 20 bp, Artificial
  CRISPR gRNA sequence
acccggttctttttcagttt

SEQ ID NO: 191960 - DNA, 20 bp, Artificial
  CRISPR gRNA sequence
cccggttctttttcagttta

SEQ ID NO: 191961 - DNA, 20 bp, Artificial
  CRISPR gRNA sequence
tttttcagtttaggccaaaa

SEQ ID NO: 191962 - DNA, 20 bp, Artificial
  CRISPR gRNA sequence
tttcagtttaggccaaaatg

SEQ ID NO: 191963 - DNA, 20 bp, Artificial
  CRISPR gRNA sequence
ttcagtttaggccaaaatgc

SEQ ID NO: 191964 - DNA, 20 bp, Artificial
  CRISPR gRNA sequence
tcagtttaggccaaaatgcc

SEQ ID NO: 191965 - DNA, 20 bp, Artificial
  CRISPR gRNA sequence
cagtttaggccaaaatgccc

SEQ ID NO: 191966 - DNA, 20 bp, Artificial
  CRISPR gRNA sequence
agtttaggccaaaatgccca

SEQ ID NO: 191967 - DNA, 20 bp, Artificial
  CRISPR gRNA sequence
aggccaaaatgcccacaggg

SEQ ID NO: 191968 - DNA, 20 bp, Artificial
  CRISPR gRNA sequence
ggccaaaatgcccacagggt

SEQ ID NO: 191969 - DNA, 20 bp, Artificial
  CRISPR gRNA sequence
ggtgggcgggactgactaag

SEQ ID NO: 191970 - DNA, 20 bp, Artificial
  CRISPR gRNA sequence
gtgggcgggactgactaagg

SEQ ID NO: 191971 - DNA, 20 bp, Artificial
  CRISPR gRNA sequence
actaaggggcggggccaggg

SEQ ID NO: 191972 - DNA, 20 bp, Artificial
  CRISPR gRNA sequence
aggggcggggccagggtctc

SEQ ID NO: 191973 - DNA, 20 bp, Artificial
  CRISPR gRNA sequence
acaccctgcagtggatgcat

SEQ ID NO: 191974 - DNA, 20 bp, Artificial
  CRISPR gRNA sequence
cagtggatgcatggctgcga

SEQ ID NO: 191975 - DNA, 20 bp, Artificial
  CRISPR gRNA sequence
cgagctggggcccgacgggc

SEQ ID NO: 191976 - DNA, 20 bp, Artificial
  CRISPR gRNA sequence
gggcccgacgggcgcttcct

SEQ ID NO: 191977 - DNA, 20 bp, Artificial
  CRISPR gRNA sequence
cctccgcgggtatgaacagt

SEQ ID NO: 191978 - DNA, 20 bp, Artificial
  CRISPR gRNA sequence
ctccgcgggtatgaacagtt

SEQ ID NO: 191979 - DNA, 20 bp, Artificial
  CRISPR gRNA sequence
cgcgggtatgaacagttcgc

SEQ ID NO: 191980 - DNA, 20 bp, Artificial
  CRISPR gRNA sequence
gcctacgacggcaaggatta

SEQ ID NO: 191981 - DNA, 20 bp, Artificial
  CRISPR gRNA sequence
cgacggcaaggattatctca

SEQ ID NO: 191982 - DNA, 20 bp, Artificial
  CRISPR gRNA sequence
tctcaccctgaatgaggacc

SEQ ID NO: 191983 - DNA, 20 bp, Artificial
  CRISPR gRNA sequence
accctgaatgaggacctgcg

SEQ ID NO: 191984 - DNA, 20 bp, Artificial
  CRISPR gRNA sequence
aatgaggacctgcgctcctg

SEQ ID NO: 191985 - DNA, 20 bp, Artificial
  CRISPR gRNA sequence
cgctcctggaccgcggtgga

SEQ ID NO: 191986 - DNA, 20 bp, Artificial
  CRISPR gRNA sequence
ctggaccgcggtggacacgg

SEQ ID NO: 191987 - DNA, 20 bp, Artificial
  CRISPR gRNA sequence
gaccgcggtggacacggcgg

SEQ ID NO: 191988 - DNA, 20 bp, Artificial
  CRISPR gRNA sequence
agatctccgagcaaaagtca

SEQ ID NO: 191989 - DNA, 20 bp, Artificial
  CRISPR gRNA sequence
cgagcaaaagtcaaatgatg

SEQ ID NO: 191990 - DNA, 20 bp, Artificial
  CRISPR gRNA sequence
tgaggcggagcaccagagag

SEQ ID NO: 191991 - DNA, 20 bp, Artificial
  CRISPR gRNA sequence
aggcggagcaccagagagcc

SEQ ID NO: 191992 - DNA, 20 bp, Artificial
  CRISPR gRNA sequence
cctggaagacacatgcgtgg

SEQ ID NO: 191993 - DNA, 20 bp, Artificial
  CRISPR gRNA sequence
gaagacacatgcgtggagtg

SEQ ID NO: 191994 - DNA, 20 bp, Artificial
  CRISPR gRNA sequence
cacaaatacctggagaaggg

SEQ ID NO: 191995 - DNA, 20 bp, Artificial
  CRISPR gRNA sequence
gagaaggggaaggagacgct

SEQ ID NO: 191996 - DNA, 20 bp, Artificial
  CRISPR gRNA sequence
cttcacctgggtaagagggt

SEQ ID NO: 191997 - DNA, 20 bp, Artificial
  CRISPR gRNA sequence
cacctgggtaagagggtcca

SEQ ID NO: 191998 - DNA, 20 bp, Artificial
  CRISPR gRNA sequence
acctgggtaagagggtccac

SEQ ID NO: 191999 - DNA, 20 bp, Artificial
  CRISPR gRNA sequence
ggtaagagggtccacagggc

SEQ ID NO: 192000 - DNA, 20 bp, Artificial
  CRISPR gRNA sequence
ctctcccaactccttcttgg

SEQ ID NO: 192001 - DNA, 20 bp, Artificial
  CRISPR gRNA sequence
tcccaactccttcttgggct

SEQ ID NO: 192002 - DNA, 20 bp, Artificial
  CRISPR gRNA sequence
ccaactccttcttgggctag

SEQ ID NO: 192003 - DNA, 20 bp, Artificial
  CRISPR gRNA sequence
cttcttgggctaggactgtg

SEQ ID NO: 192004 - DNA, 20 bp, Artificial
  CRISPR gRNA sequence
cttgggctaggactgtgccc

SEQ ID NO: 192005 - DNA, 20 bp, Artificial
  CRISPR gRNA sequence
ttgggctaggactgtgccca

SEQ ID NO: 192006 - DNA, 20 bp, Artificial
  CRISPR gRNA sequence
gggctaggactgtgcccaca

SEQ ID NO: 192007 - DNA, 20 bp, Artificial
  CRISPR gRNA sequence
ggctaggactgtgcccacag

SEQ ID NO: 192008 - DNA, 20 bp, Artificial
  CRISPR gRNA sequence
ggactgtgcccacagctgac

SEQ ID NO: 192009 - DNA, 20 bp, Artificial
  CRISPR gRNA sequence
tgcccacagctgacagacct

SEQ ID NO: 192010 - DNA, 20 bp, Artificial
  CRISPR gRNA sequence
acagacctcaaacagtagaa

SEQ ID NO: 192011 - DNA, 20 bp, Artificial
  CRISPR gRNA sequence
aaacagtagaagaaacaggg

SEQ ID NO: 192012 - DNA, 20 bp, Artificial
  CRISPR gRNA sequence
ctcccttggatcaggagagg

SEQ ID NO: 192013 - DNA, 20 bp, Artificial
  CRISPR gRNA sequence
ccttggatcaggagagggag

SEQ ID NO: 192014 - DNA, 20 bp, Artificial
  CRISPR gRNA sequence
ggatcaggagagggagctgt

SEQ ID NO: 192015 - DNA, 20 bp, Artificial
  CRISPR gRNA sequence
gatcaggagagggagctgtc

SEQ ID NO: 192016 - DNA, 20 bp, Artificial
  CRISPR gRNA sequence
tcacctgaggtacaggagat

SEQ ID NO: 192017 - DNA, 20 bp, Artificial
  CRISPR gRNA sequence
aggtacaggagatcctatac

SEQ ID NO: 192018 - DNA, 20 bp, Artificial
  CRISPR gRNA sequence
taccacagagtgactctctt

SEQ ID NO: 192019 - DNA, 20 bp, Artificial
  CRISPR gRNA sequence
tcttaaagggccagacctct

SEQ ID NO: 192020 - DNA, 20 bp, Artificial
  CRISPR gRNA sequence
ttaaagggccagacctctct

SEQ ID NO: 192021 - DNA, 20 bp, Artificial
  CRISPR gRNA sequence
aaagggccagacctctctca

SEQ ID NO: 192022 - DNA, 20 bp, Artificial
  CRISPR gRNA sequence
aagggccagacctctctcag

SEQ ID NO: 192023 - DNA, 20 bp, Artificial
  CRISPR gRNA sequence
tctcaggggcaattaaggaa

SEQ ID NO: 192024 - DNA, 20 bp, Artificial
  CRISPR gRNA sequence
tcaggggcaattaaggaatc

SEQ ID NO: 192025 - DNA, 20 bp, Artificial
  CRISPR gRNA sequence
aggggcaattaaggaatcta

SEQ ID NO: 192026 - DNA, 20 bp, Artificial
  CRISPR gRNA sequence
aggaatctagtctcgctgga

SEQ ID NO: 192027 - DNA, 20 bp, Artificial
  CRISPR gRNA sequence
gtctcgctggagattccatc

SEQ ID NO: 192028 - DNA, 20 bp, Artificial
  CRISPR gRNA sequence
gctggagattccatccttca

SEQ ID NO: 192029 - DNA, 20 bp, Artificial
  CRISPR gRNA sequence
gagattccatccttcagatg

SEQ ID NO: 192030 - DNA, 20 bp, Artificial
  CRISPR gRNA sequence
catccttcagatgaactgat

SEQ ID NO: 192031 - DNA, 20 bp, Artificial
  CRISPR gRNA sequence
cagatgaactgatgagcagt

SEQ ID NO: 192032 - DNA, 20 bp, Artificial
  CRISPR gRNA sequence
agatgaactgatgagcagtt

SEQ ID NO: 192033 - DNA, 20 bp, Artificial
  CRISPR gRNA sequence
atgagcagttctctttgact

SEQ ID NO: 192034 - DNA, 20 bp, Artificial
  CRISPR gRNA sequence
tctttgactcccagtattag

SEQ ID NO: 192035 - DNA, 20 bp, Artificial
  CRISPR gRNA sequence
tttgactcccagtattagga

SEQ ID NO: 192036 - DNA, 20 bp, Artificial
  CRISPR gRNA sequence
tgactcccagtattaggaat

SEQ ID NO: 192037 - DNA, 20 bp, Artificial
  CRISPR gRNA sequence
gactcccagtattaggaatc

SEQ ID NO: 192038 - DNA, 20 bp, Artificial
  CRISPR gRNA sequence
actcccagtattaggaatca

SEQ ID NO: 192039 - DNA, 20 bp, Artificial
  CRISPR gRNA sequence
ccagtattaggaatcacggg

SEQ ID NO: 192040 - DNA, 20 bp, Artificial
  CRISPR gRNA sequence
ggaatcacgggggagtttct

SEQ ID NO: 192041 - DNA, 20 bp, Artificial
  CRISPR gRNA sequence
ctctcgtgcctgattctcag

SEQ ID NO: 192042 - DNA, 20 bp, Artificial
  CRISPR gRNA sequence
tctcgtgcctgattctcagc

SEQ ID NO: 192043 - DNA, 20 bp, Artificial
  CRISPR gRNA sequence
tcgtgcctgattctcagccc

SEQ ID NO: 192044 - DNA, 20 bp, Artificial
  CRISPR gRNA sequence
gtgcctgattctcagcccca

SEQ ID NO: 192045 - DNA, 20 bp, Artificial
  CRISPR gRNA sequence
attctcagccccacaccaag

SEQ ID NO: 192046 - DNA, 20 bp, Artificial
  CRISPR gRNA sequence
tcagccccacaccaagagtt

SEQ ID NO: 192047 - DNA, 20 bp, Artificial
  CRISPR gRNA sequence
agccccacaccaagagtttt

SEQ ID NO: 192048 - DNA, 20 bp, Artificial
  CRISPR gRNA sequence
ttggaggtctgactccagct

SEQ ID NO: 192049 - DNA, 20 bp, Artificial
  CRISPR gRNA sequence
tggaggtctgactccagctt

SEQ ID NO: 192050 - DNA, 20 bp, Artificial
  CRISPR gRNA sequence
ggaggtctgactccagcttt

SEQ ID NO: 192051 - DNA, 20 bp, Artificial
  CRISPR gRNA sequence
gaggtctgactccagctttt

SEQ ID NO: 192052 - DNA, 20 bp, Artificial
  CRISPR gRNA sequence
actccagcttttctcagtca

SEQ ID NO: 192053 - DNA, 20 bp, Artificial
  CRISPR gRNA sequence
cagcttttctcagtcactca

SEQ ID NO: 192054 - DNA, 20 bp, Artificial
  CRISPR gRNA sequence
ttctcagtcactcagcatcc

SEQ ID NO: 192055 - DNA, 20 bp, Artificial
  CRISPR gRNA sequence
tctcagtcactcagcatcca

SEQ ID NO: 192056 - DNA, 20 bp, Artificial
  CRISPR gRNA sequence
ctcagtcactcagcatccac

SEQ ID NO: 192057 - DNA, 20 bp, Artificial
  CRISPR gRNA sequence
tcagtcactcagcatccaca

SEQ ID NO: 192058 - DNA, 20 bp, Artificial
  CRISPR gRNA sequence
agtcactcagcatccacaca

SEQ ID NO: 192059 - DNA, 20 bp, Artificial
  CRISPR gRNA sequence
agcatccacacaggccagga

SEQ ID NO: 192060 - DNA, 20 bp, Artificial
  CRISPR gRNA sequence
ttcaccttctaccctgggct

SEQ ID NO: 192061 - DNA, 20 bp, Artificial
  CRISPR gRNA sequence
tcaccttctaccctgggcta

SEQ ID NO: 192062 - DNA, 20 bp, Artificial
  CRISPR gRNA sequence
caccttctaccctgggctag

SEQ ID NO: 192063 - DNA, 20 bp, Artificial
  CRISPR gRNA sequence
accttctaccctgggctagc

SEQ ID NO: 192064 - DNA, 20 bp, Artificial
  CRISPR gRNA sequence
ctaccctgggctagctcatc

SEQ ID NO: 192065 - DNA, 20 bp, Artificial
  CRISPR gRNA sequence
taccctgggctagctcatcc

SEQ ID NO: 192066 - DNA, 20 bp, Artificial
  CRISPR gRNA sequence
ccctgggctagctcatcccg

SEQ ID NO: 192067 - DNA, 20 bp, Artificial
  CRISPR gRNA sequence
ggctagctcatcccgattct

SEQ ID NO: 192068 - DNA, 20 bp, Artificial
  CRISPR gRNA sequence
gctcatcccgattctagaac

SEQ ID NO: 192069 - DNA, 20 bp, Artificial
  CRISPR gRNA sequence
atcccgattctagaactttc

SEQ ID NO: 192070 - DNA, 20 bp, Artificial
  CRISPR gRNA sequence
tagaactttccaaggaataa

SEQ ID NO: 192071 - DNA, 20 bp, Artificial
  CRISPR gRNA sequence
gaactttccaaggaataaga

SEQ ID NO: 192072 - DNA, 20 bp, Artificial
  CRISPR gRNA sequence
tccaaggaataagaggctat

SEQ ID NO: 192073 - DNA, 20 bp, Artificial
  CRISPR gRNA sequence
ccaaggaataagaggctatc

SEQ ID NO: 192074 - DNA, 20 bp, Artificial
  CRISPR gRNA sequence
caaggaataagaggctatcc

SEQ ID NO: 192075 - DNA, 20 bp, Artificial
  CRISPR gRNA sequence
tcccagatccctaagtccag

SEQ ID NO: 192076 - DNA, 20 bp, Artificial
  CRISPR gRNA sequence
agtccaggctggtgtcaagg

SEQ ID NO: 192077 - DNA, 20 bp, Artificial
  CRISPR gRNA sequence
gtgtcaaggttttgtcctct

SEQ ID NO: 192078 - DNA, 20 bp, Artificial
  CRISPR gRNA sequence
tgtcctcttctcctactata

SEQ ID NO: 192079 - DNA, 20 bp, Artificial
  CRISPR gRNA sequence
gtcctcttctcctactataa

SEQ ID NO: 192080 - DNA, 20 bp, Artificial
  CRISPR gRNA sequence
tcctcttctcctactataat

SEQ ID NO: 192081 - DNA, 20 bp, Artificial
  CRISPR gRNA sequence
ttctcctactataattgtcc

SEQ ID NO: 192082 - DNA, 20 bp, Artificial
  CRISPR gRNA sequence
ctcctactataattgtcctc

SEQ ID NO: 192083 - DNA, 20 bp, Artificial
  CRISPR gRNA sequence
tcctactataattgtcctct

SEQ ID NO: 192084 - DNA, 20 bp, Artificial
  CRISPR gRNA sequence
ctactataattgtcctcttc

SEQ ID NO: 192085 - DNA, 20 bp, Artificial
  CRISPR gRNA sequence
ctataattgtcctcttcctt

SEQ ID NO: 192086 - DNA, 20 bp, Artificial
  CRISPR gRNA sequence
taattgtcctcttccttctc

SEQ ID NO: 192087 - DNA, 20 bp, Artificial
  CRISPR gRNA sequence
tcctcttccttctcaggatg

SEQ ID NO: 192088 - DNA, 20 bp, Artificial
  CRISPR gRNA sequence
ttccttctcaggatggtcac

SEQ ID NO: 192089 - DNA, 20 bp, Artificial
  CRISPR gRNA sequence
ccttctcaggatggtcacat

SEQ ID NO: 192090 - DNA, 20 bp, Artificial
  CRISPR gRNA sequence
cttctcaggatggtcacatg

SEQ ID NO: 192091 - DNA, 20 bp, Artificial
  CRISPR gRNA sequence
ctcaggatggtcacatgggt

SEQ ID NO: 192092 - DNA, 20 bp, Artificial
  CRISPR gRNA sequence
tcaggatggtcacatgggtg

SEQ ID NO: 192093 - DNA, 20 bp, Artificial
  CRISPR gRNA sequence
aggatggtcacatgggtgct

SEQ ID NO: 192094 - DNA, 20 bp, Artificial
  CRISPR gRNA sequence
ctggagtgtcccatgagaga

SEQ ID NO: 192095 - DNA, 20 bp, Artificial
  CRISPR gRNA sequence
gagtgtcccatgagagatac

SEQ ID NO: 192096 - DNA, 20 bp, Artificial
  CRISPR gRNA sequence
aattttctgactcttcccct

SEQ ID NO: 192097 - DNA, 20 bp, Artificial
  CRISPR gRNA sequence
tctgactcttcccctcagag

SEQ ID NO: 192098 - DNA, 20 bp, Artificial
  CRISPR gRNA sequence
ctgactcttcccctcagagc

SEQ ID NO: 192099 - DNA, 20 bp, Artificial
  CRISPR gRNA sequence
tgactcttcccctcagagcc

SEQ ID NO: 192100 - DNA, 20 bp, Artificial
  CRISPR gRNA sequence
actcttcccctcagagcccc

SEQ ID NO: 192101 - DNA, 20 bp, Artificial
  CRISPR gRNA sequence
ttcccctcagagcccccaaa

SEQ ID NO: 192102 - DNA, 20 bp, Artificial
  CRISPR gRNA sequence
cccctcagagcccccaaaga

SEQ ID NO: 192103 - DNA, 20 bp, Artificial
  CRISPR gRNA sequence
ccctcagagcccccaaagac

SEQ ID NO: 192104 - DNA, 20 bp, Artificial
  CRISPR gRNA sequence
agagcccccaaagacacacg

SEQ ID NO: 192105 - DNA, 20 bp, Artificial
  CRISPR gRNA sequence
accaccccatctctgaccat

SEQ ID NO: 192106 - DNA, 20 bp, Artificial
  CRISPR gRNA sequence
tgaccatgaggccaccctga

SEQ ID NO: 192107 - DNA, 20 bp, Artificial
  CRISPR gRNA sequence
accatgaggccaccctgagg

SEQ ID NO: 192108 - DNA, 20 bp, Artificial
  CRISPR gRNA sequence
aggtgctgggccctgggctt

SEQ ID NO: 192109 - DNA, 20 bp, Artificial
  CRISPR gRNA sequence
ggccctgggcttctaccctg

SEQ ID NO: 192110 - DNA, 20 bp, Artificial
  CRISPR gRNA sequence
ggcttctaccctgcggagat

SEQ ID NO: 192111 - DNA, 20 bp, Artificial
  CRISPR gRNA sequence
ctaccctgcggagatcacac

SEQ ID NO: 192112 - DNA, 20 bp, Artificial
  CRISPR gRNA sequence
taccctgcggagatcacact

SEQ ID NO: 192113 - DNA, 20 bp, Artificial
  CRISPR gRNA sequence
ccctgcggagatcacactga

SEQ ID NO: 192114 - DNA, 20 bp, Artificial
  CRISPR gRNA sequence
cggagatcacactgacctgg

SEQ ID NO: 192115 - DNA, 20 bp, Artificial
  CRISPR gRNA sequence
acctggcagcaggatgggga

SEQ ID NO: 192116 - DNA, 20 bp, Artificial
  CRISPR gRNA sequence
gcagcaggatggggagggcc

SEQ ID NO: 192117 - DNA, 20 bp, Artificial
  CRISPR gRNA sequence
gtggagaccaggcctgcagg

SEQ ID NO: 192118 - DNA, 20 bp, Artificial
  CRISPR gRNA sequence
caggggatggaaccttccag

SEQ ID NO: 192119 - DNA, 20 bp, Artificial
  CRISPR gRNA sequence
ccagaagtgggcagctgtgg

SEQ ID NO: 192120 - DNA, 20 bp, Artificial
  CRISPR gRNA sequence
cagaagtgggcagctgtggt

SEQ ID NO: 192121 - DNA, 20 bp, Artificial
  CRISPR gRNA sequence
tggtggtgccttctggagag

SEQ ID NO: 192122 - DNA, 20 bp, Artificial
  CRISPR gRNA sequence
ctggagaggagcagagatac

SEQ ID NO: 192123 - DNA, 20 bp, Artificial
  CRISPR gRNA sequence
tggagaggagcagagataca

SEQ ID NO: 192124 - DNA, 20 bp, Artificial
  CRISPR gRNA sequence
gagaggagcagagatacacg

SEQ ID NO: 192125 - DNA, 20 bp, Artificial
  CRISPR gRNA sequence
cccgagcccgtcaccctgag

SEQ ID NO: 192126 - DNA, 20 bp, Artificial
  CRISPR gRNA sequence
agatggagtaaggaggggga

SEQ ID NO: 192127 - DNA, 20 bp, Artificial
  CRISPR gRNA sequence
ttctcagggaaagcgggagc

SEQ ID NO: 192128 - DNA, 20 bp, Artificial
  CRISPR gRNA sequence
ctcagggaaagcgggagccc

SEQ ID NO: 192129 - DNA, 20 bp, Artificial
  CRISPR gRNA sequence
tcagggaaagcgggagccct

SEQ ID NO: 192130 - DNA, 20 bp, Artificial
  CRISPR gRNA sequence
agggaaagcgggagcccttc

SEQ ID NO: 192131 - DNA, 20 bp, Artificial
  CRISPR gRNA sequence
ctggagcccttccgcagggt

SEQ ID NO: 192132 - DNA, 20 bp, Artificial
  CRISPR gRNA sequence
tggagcccttccgcagggtc

SEQ ID NO: 192133 - DNA, 20 bp, Artificial
  CRISPR gRNA sequence
gagcccttccgcagggtcag

SEQ ID NO: 192134 - DNA, 20 bp, Artificial
  CRISPR gRNA sequence
ccgcagggtcagggctgagg

SEQ ID NO: 192135 - DNA, 20 bp, Artificial
  CRISPR gRNA sequence
cgcagggtcagggctgaggc

SEQ ID NO: 192136 - DNA, 20 bp, Artificial
  CRISPR gRNA sequence
aggcctgggggtcagggccc

SEQ ID NO: 192137 - DNA, 20 bp, Artificial
  CRISPR gRNA sequence
ggggtcagggccccttacgt

SEQ ID NO: 192138 - DNA, 20 bp, Artificial
  CRISPR gRNA sequence
acgttcccctcttttcccag

SEQ ID NO: 192139 - DNA, 20 bp, Artificial
  CRISPR gRNA sequence
cgttcccctcttttcccaga

SEQ ID NO: 192140 - DNA, 20 bp, Artificial
  CRISPR gRNA sequence
ccctcttttcccagagccgg

SEQ ID NO: 192141 - DNA, 20 bp, Artificial
  CRISPR gRNA sequence
ttttcccagagccggcttcc

SEQ ID NO: 192142 - DNA, 20 bp, Artificial
  CRISPR gRNA sequence
ttcccagagccggcttccca

SEQ ID NO: 192143 - DNA, 20 bp, Artificial
  CRISPR gRNA sequence
tcccagagccggcttcccag

SEQ ID NO: 192144 - DNA, 20 bp, Artificial
  CRISPR gRNA sequence
cccagagccggcttcccagc

SEQ ID NO: 192145 - DNA, 20 bp, Artificial
  CRISPR gRNA sequence
ccagagccggcttcccagcc

SEQ ID NO: 192146 - DNA, 20 bp, Artificial
  CRISPR gRNA sequence
cccagcccaccatccccatc

SEQ ID NO: 192147 - DNA, 20 bp, Artificial
  CRISPR gRNA sequence
ccagcccaccatccccatcg

SEQ ID NO: 192148 - DNA, 20 bp, Artificial
  CRISPR gRNA sequence
ctggcctggttctccttgga

SEQ ID NO: 192149 - DNA, 20 bp, Artificial
  CRISPR gRNA sequence
gcctggttctccttggatct

SEQ ID NO: 192150 - DNA, 20 bp, Artificial
  CRISPR gRNA sequence
gttctccttggatctgtggt

SEQ ID NO: 192151 - DNA, 20 bp, Artificial
  CRISPR gRNA sequence
tccttggatctgtggtctct

SEQ ID NO: 192152 - DNA, 20 bp, Artificial
  CRISPR gRNA sequence
cttggatctgtggtctctgg

SEQ ID NO: 192153 - DNA, 20 bp, Artificial
  CRISPR gRNA sequence
ggatctgtggtctctggagc

SEQ ID NO: 192154 - DNA, 20 bp, Artificial
  CRISPR gRNA sequence
gatctgtggtctctggagct

SEQ ID NO: 192155 - DNA, 20 bp, Artificial
  CRISPR gRNA sequence
tggtctctggagctgtggtt

SEQ ID NO: 192156 - DNA, 20 bp, Artificial
  CRISPR gRNA sequence
tggagctgtggttgctgctg

SEQ ID NO: 192157 - DNA, 20 bp, Artificial
  CRISPR gRNA sequence
gagctgtggttgctgctgtg

SEQ ID NO: 192158 - DNA, 20 bp, Artificial
  CRISPR gRNA sequence
tggttgctgctgtgatatgg

SEQ ID NO: 192159 - DNA, 20 bp, Artificial
  CRISPR gRNA sequence
ctgctgtgatatggaggaag

SEQ ID NO: 192160 - DNA, 20 bp, Artificial
  CRISPR gRNA sequence
ctgtgatatggaggaagaag

SEQ ID NO: 192161 - DNA, 20 bp, Artificial
  CRISPR gRNA sequence
tgatatggaggaagaagagc

SEQ ID NO: 192162 - DNA, 20 bp, Artificial
  CRISPR gRNA sequence
aggtggggaagggagaaggg

SEQ ID NO: 192163 - DNA, 20 bp, Artificial
  CRISPR gRNA sequence
agttttcttgtcccactggg

SEQ ID NO: 192164 - DNA, 20 bp, Artificial
  CRISPR gRNA sequence
tcttgtcccactgggtgttt

SEQ ID NO: 192165 - DNA, 20 bp, Artificial
  CRISPR gRNA sequence
cttgtcccactgggtgtttc

SEQ ID NO: 192166 - DNA, 20 bp, Artificial
  CRISPR gRNA sequence
ttgtcccactgggtgtttca

SEQ ID NO: 192167 - DNA, 20 bp, Artificial
  CRISPR gRNA sequence
gtcccactgggtgtttcaag

SEQ ID NO: 192168 - DNA, 20 bp, Artificial
  CRISPR gRNA sequence
tcccactgggtgtttcaagc

SEQ ID NO: 192169 - DNA, 20 bp, Artificial
  CRISPR gRNA sequence
ggtgtttcaagccctaggta

SEQ ID NO: 192170 - DNA, 20 bp, Artificial
  CRISPR gRNA sequence
caagccctaggtaaaagtgt

SEQ ID NO: 192171 - DNA, 20 bp, Artificial
  CRISPR gRNA sequence
aagccctaggtaaaagtgtg

SEQ ID NO: 192172 - DNA, 20 bp, Artificial
  CRISPR gRNA sequence
ggtaaaagtgtgtcctgcct

SEQ ID NO: 192173 - DNA, 20 bp, Artificial
  CRISPR gRNA sequence
cctcgttactgggaagcacc

SEQ ID NO: 192174 - DNA, 20 bp, Artificial
  CRISPR gRNA sequence
gttactgggaagcaccatcc

SEQ ID NO: 192175 - DNA, 20 bp, Artificial
  CRISPR gRNA sequence
ctgggaagcaccatccacac

SEQ ID NO: 192176 - DNA, 20 bp, Artificial
  CRISPR gRNA sequence
ggaagcaccatccacacaca

SEQ ID NO: 192177 - DNA, 20 bp, Artificial
  CRISPR gRNA sequence
cccagcctggggccctgtgt

SEQ ID NO: 192178 - DNA, 20 bp, Artificial
  CRISPR gRNA sequence
gggccctgtgtgccagcacc

SEQ ID NO: 192179 - DNA, 20 bp, Artificial
  CRISPR gRNA sequence
tgtgccagcacctactcttt

SEQ ID NO: 192180 - DNA, 20 bp, Artificial
  CRISPR gRNA sequence
ctctttttttttgagacgga

SEQ ID NO: 192181 - DNA, 20 bp, Artificial
  CRISPR gRNA sequence
tttttttttgagacggagtc

SEQ ID NO: 192182 - DNA, 20 bp, Artificial
  CRISPR gRNA sequence
tttttttgagacggagtctt

SEQ ID NO: 192183 - DNA, 20 bp, Artificial
  CRISPR gRNA sequence
ttttttgagacggagtcttg

SEQ ID NO: 192184 - DNA, 20 bp, Artificial
  CRISPR gRNA sequence
tttttgagacggagtcttgg

SEQ ID NO: 192185 - DNA, 20 bp, Artificial
  CRISPR gRNA sequence
ttttgagacggagtcttggc

SEQ ID NO: 192186 - DNA, 20 bp, Artificial
  CRISPR gRNA sequence
tttgagacggagtcttggct

SEQ ID NO: 192187 - DNA, 20 bp, Artificial
  CRISPR gRNA sequence
ttgagacggagtcttggctc

SEQ ID NO: 192188 - DNA, 20 bp, Artificial
  CRISPR gRNA sequence
tgagacggagtcttggctct

SEQ ID NO: 192189 - DNA, 20 bp, Artificial
  CRISPR gRNA sequence
gagacggagtcttggctctg

SEQ ID NO: 192190 - DNA, 20 bp, Artificial
  CRISPR gRNA sequence
agacggagtcttggctctgt

SEQ ID NO: 192191 - DNA, 20 bp, Artificial
  CRISPR gRNA sequence
ggctctgtcacccaggctgg

SEQ ID NO: 192192 - DNA, 20 bp, Artificial
  CRISPR gRNA sequence
gctctgtcacccaggctgga

SEQ ID NO: 192193 - DNA, 20 bp, Artificial
  CRISPR gRNA sequence
tgtcacccaggctggagtgc

SEQ ID NO: 192194 - DNA, 20 bp, Artificial
  CRISPR gRNA sequence
tcacccaggctggagtgcaa

SEQ ID NO: 192195 - DNA, 20 bp, Artificial
  CRISPR gRNA sequence
gagtgcaatggcgtggtttc

SEQ ID NO: 192196 - DNA, 20 bp, Artificial
  CRISPR gRNA sequence
cagctcactgcaacctccgc

SEQ ID NO: 192197 - DNA, 20 bp, Artificial
  CRISPR gRNA sequence
agctcactgcaacctccgcc

SEQ ID NO: 192198 - DNA, 20 bp, Artificial
  CRISPR gRNA sequence
actgcaacctccgcctccca

SEQ ID NO: 192199 - DNA, 20 bp, Artificial
  CRISPR gRNA sequence
caacctccgcctcccaggtt

SEQ ID NO: 192200 - DNA, 20 bp, Artificial
  CRISPR gRNA sequence
cgcctcccaggttcaagcaa

SEQ ID NO: 192201 - DNA, 20 bp, Artificial
  CRISPR gRNA sequence
ccaggttcaagcaattctcc

SEQ ID NO: 192202 - DNA, 20 bp, Artificial
  CRISPR gRNA sequence
aagcaattctcctgcctcag

SEQ ID NO: 192203 - DNA, 20 bp, Artificial
  CRISPR gRNA sequence
tcctgcctcagcctccctag

SEQ ID NO: 192204 - DNA, 20 bp, Artificial
  CRISPR gRNA sequence
ctgcctcagcctccctagta

SEQ ID NO: 192205 - DNA, 20 bp, Artificial
  CRISPR gRNA sequence
cctcagcctccctagtagct

SEQ ID NO: 192206 - DNA, 20 bp, Artificial
  CRISPR gRNA sequence
agcctccctagtagctggga

SEQ ID NO: 192207 - DNA, 20 bp, Artificial
  CRISPR gRNA sequence
cctagtagctgggactacac

SEQ ID NO: 192208 - DNA, 20 bp, Artificial
  CRISPR gRNA sequence
gtagctgggactacacatgc

SEQ ID NO: 192209 - DNA, 20 bp, Artificial
  CRISPR gRNA sequence
ggactacacatgcgtgccac

SEQ ID NO: 192210 - DNA, 20 bp, Artificial
  CRISPR gRNA sequence
cacatgcgtgccaccacacc

SEQ ID NO: 192211 - DNA, 20 bp, Artificial
  CRISPR gRNA sequence
gctaatttttttttttgtat

SEQ ID NO: 192212 - DNA, 20 bp, Artificial
  CRISPR gRNA sequence
atttttttttttgtattttt

SEQ ID NO: 192213 - DNA, 20 bp, Artificial
  CRISPR gRNA sequence
ttttttttgtatttttagtg

SEQ ID NO: 192214 - DNA, 20 bp, Artificial
  CRISPR gRNA sequence
tttttttgtatttttagtgg

SEQ ID NO: 192215 - DNA, 20 bp, Artificial
  CRISPR gRNA sequence
ttttttgtatttttagtgga

SEQ ID NO: 192216 - DNA, 20 bp, Artificial
  CRISPR gRNA sequence
tttttgtatttttagtggag

SEQ ID NO: 192217 - DNA, 20 bp, Artificial
  CRISPR gRNA sequence
ttttgtatttttagtggaga

SEQ ID NO: 192218 - DNA, 20 bp, Artificial
  CRISPR gRNA sequence
tttgtatttttagtggagat

SEQ ID NO: 192219 - DNA, 20 bp, Artificial
  CRISPR gRNA sequence
ttgtatttttagtggagatg

SEQ ID NO: 192220 - DNA, 20 bp, Artificial
  CRISPR gRNA sequence
tgtatttttagtggagatgg

SEQ ID NO: 192221 - DNA, 20 bp, Artificial
  CRISPR gRNA sequence
gtatttttagtggagatggg

SEQ ID NO: 192222 - DNA, 20 bp, Artificial
  CRISPR gRNA sequence
tatttttagtggagatgggg

SEQ ID NO: 192223 - DNA, 20 bp, Artificial
  CRISPR gRNA sequence
ttagtggagatggggtttca

SEQ ID NO: 192224 - DNA, 20 bp, Artificial
  CRISPR gRNA sequence
tagtggagatggggtttcac

SEQ ID NO: 192225 - DNA, 20 bp, Artificial
  CRISPR gRNA sequence
agtggagatggggtttcact

SEQ ID NO: 192226 - DNA, 20 bp, Artificial
  CRISPR gRNA sequence
gtggagatggggtttcacta

SEQ ID NO: 192227 - DNA, 20 bp, Artificial
  CRISPR gRNA sequence
cactatgttggccaggctgg

SEQ ID NO: 192228 - DNA, 20 bp, Artificial
  CRISPR gRNA sequence
actatgttggccaggctggt

SEQ ID NO: 192229 - DNA, 20 bp, Artificial
  CRISPR gRNA sequence
tgttggccaggctggtctcg

SEQ ID NO: 192230 - DNA, 20 bp, Artificial
  CRISPR gRNA sequence
gccaggctggtctcgaactc

SEQ ID NO: 192231 - DNA, 20 bp, Artificial
  CRISPR gRNA sequence
gtctcgaactcctgactttg

SEQ ID NO: 192232 - DNA, 20 bp, Artificial
  CRISPR gRNA sequence
gaactcctgactttgtgatc

SEQ ID NO: 192233 - DNA, 20 bp, Artificial
  CRISPR gRNA sequence
ctgactttgtgatctgcctg

SEQ ID NO: 192234 - DNA, 20 bp, Artificial
  CRISPR gRNA sequence
actttgtgatctgcctgcct

SEQ ID NO: 192235 - DNA, 20 bp, Artificial
  CRISPR gRNA sequence
tgtgatctgcctgcctcggc

SEQ ID NO: 192236 - DNA, 20 bp, Artificial
  CRISPR gRNA sequence
gtgatctgcctgcctcggcc

SEQ ID NO: 192237 - DNA, 20 bp, Artificial
  CRISPR gRNA sequence
tgatctgcctgcctcggcct

SEQ ID NO: 192238 - DNA, 20 bp, Artificial
  CRISPR gRNA sequence
cctgcctcggcctcccaaag

SEQ ID NO: 192239 - DNA, 20 bp, Artificial
  CRISPR gRNA sequence
cctcggcctcccaaagtgct

SEQ ID NO: 192240 - DNA, 20 bp, Artificial
  CRISPR gRNA sequence
ggcctcccaaagtgctggga

SEQ ID NO: 192241 - DNA, 20 bp, Artificial
  CRISPR gRNA sequence
ccaaagtgctgggattacag

SEQ ID NO: 192242 - DNA, 20 bp, Artificial
  CRISPR gRNA sequence
ggattacagtcgtgagccac

SEQ ID NO: 192243 - DNA, 20 bp, Artificial
  CRISPR gRNA sequence
cagtcgtgagccaccgcacc

SEQ ID NO: 192244 - DNA, 20 bp, Artificial
  CRISPR gRNA sequence
ctcttttgtaaagcacctgt

SEQ ID NO: 192245 - DNA, 20 bp, Artificial
  CRISPR gRNA sequence
ttttgtaaagcacctgtgac

SEQ ID NO: 192246 - DNA, 20 bp, Artificial
  CRISPR gRNA sequence
ttgtaaagcacctgtgacaa

SEQ ID NO: 192247 - DNA, 20 bp, Artificial
  CRISPR gRNA sequence
tgtaaagcacctgtgacaat

SEQ ID NO: 192248 - DNA, 20 bp, Artificial
  CRISPR gRNA sequence
gtaaagcacctgtgacaatg

SEQ ID NO: 192249 - DNA, 20 bp, Artificial
  CRISPR gRNA sequence
taaagcacctgtgacaatga

SEQ ID NO: 192250 - DNA, 20 bp, Artificial
  CRISPR gRNA sequence
tgacaatgaaggacagattt

SEQ ID NO: 192251 - DNA, 20 bp, Artificial
  CRISPR gRNA sequence
atcaccttgacgattgtggt

SEQ ID NO: 192252 - DNA, 20 bp, Artificial
  CRISPR gRNA sequence
tcaccttgacgattgtggtg

SEQ ID NO: 192253 - DNA, 20 bp, Artificial
  CRISPR gRNA sequence
gacgattgtggtgatgggga

SEQ ID NO: 192254 - DNA, 20 bp, Artificial
  CRISPR gRNA sequence
acgattgtggtgatggggac

SEQ ID NO: 192255 - DNA, 20 bp, Artificial
  CRISPR gRNA sequence
tggtgatggggacctgatcc

SEQ ID NO: 192256 - DNA, 20 bp, Artificial
  CRISPR gRNA sequence
atcccagcagtcacaggtca

SEQ ID NO: 192257 - DNA, 20 bp, Artificial
  CRISPR gRNA sequence
ctgaagacagacctcagaag

SEQ ID NO: 192258 - DNA, 20 bp, Artificial
  CRISPR gRNA sequence
aagacagacctcagaagggc

SEQ ID NO: 192259 - DNA, 20 bp, Artificial
  CRISPR gRNA sequence
agaagggcagttgatccagg

SEQ ID NO: 192260 - DNA, 20 bp, Artificial
  CRISPR gRNA sequence
atccaggacccacacctgct

SEQ ID NO: 192261 - DNA, 20 bp, Artificial
  CRISPR gRNA sequence
ctttcttcacgtttcctgat

SEQ ID NO: 192262 - DNA, 20 bp, Artificial
  CRISPR gRNA sequence
tcttcacgtttcctgatcct

SEQ ID NO: 192263 - DNA, 20 bp, Artificial
  CRISPR gRNA sequence
cttcacgtttcctgatcctg

SEQ ID NO: 192264 - DNA, 20 bp, Artificial
  CRISPR gRNA sequence
ttcacgtttcctgatcctgc

SEQ ID NO: 192265 - DNA, 20 bp, Artificial
  CRISPR gRNA sequence
cacgtttcctgatcctgccc

SEQ ID NO: 192266 - DNA, 20 bp, Artificial
  CRISPR gRNA sequence
acgtttcctgatcctgccct

SEQ ID NO: 192267 - DNA, 20 bp, Artificial
  CRISPR gRNA sequence
cctgatcctgccctgggtct

SEQ ID NO: 192268 - DNA, 20 bp, Artificial
  CRISPR gRNA sequence
ctgatcctgccctgggtctg

SEQ ID NO: 192269 - DNA, 20 bp, Artificial
  CRISPR gRNA sequence
atcctgccctgggtctgcag

SEQ ID NO: 192270 - DNA, 20 bp, Artificial
  CRISPR gRNA sequence
ccctgggtctgcagtcacag

SEQ ID NO: 192271 - DNA, 20 bp, Artificial
  CRISPR gRNA sequence
ggtctgcagtcacagttcag

SEQ ID NO: 192272 - DNA, 20 bp, Artificial
  CRISPR gRNA sequence
cagtcacagttcaggaaact

SEQ ID NO: 192273 - DNA, 20 bp, Artificial
  CRISPR gRNA sequence
aggaaacttctctgggatcc

SEQ ID NO: 192274 - DNA, 20 bp, Artificial
  CRISPR gRNA sequence
ctctgggatccaaaactagg

SEQ ID NO: 192275 - DNA, 20 bp, Artificial
  CRISPR gRNA sequence
tctgggatccaaaactagga

SEQ ID NO: 192276 - DNA, 20 bp, Artificial
  CRISPR gRNA sequence
tgggatccaaaactaggagg

SEQ ID NO: 192277 - DNA, 20 bp, Artificial
  CRISPR gRNA sequence
ggatccaaaactaggaggtt

SEQ ID NO: 192278 - DNA, 20 bp, Artificial
  CRISPR gRNA sequence
ggaggttcctctaggacctt

SEQ ID NO: 192279 - DNA, 20 bp, Artificial
  CRISPR gRNA sequence
ctctaggaccttatggccct

SEQ ID NO: 192280 - DNA, 20 bp, Artificial
  CRISPR gRNA sequence
taggaccttatggccctgcc

SEQ ID NO: 192281 - DNA, 20 bp, Artificial
  CRISPR gRNA sequence
ggaccttatggccctgcctc

SEQ ID NO: 192282 - DNA, 20 bp, Artificial
  CRISPR gRNA sequence
atggccctgcctcctccctg

SEQ ID NO: 192283 - DNA, 20 bp, Artificial
  CRISPR gRNA sequence
tggccctgcctcctccctgg

SEQ ID NO: 192284 - DNA, 20 bp, Artificial
  CRISPR gRNA sequence
cctcctccctggcccctcac

SEQ ID NO: 192285 - DNA, 20 bp, Artificial
  CRISPR gRNA sequence
ctccctggcccctcacagga

SEQ ID NO: 192286 - DNA, 20 bp, Artificial
  CRISPR gRNA sequence
cctggcccctcacaggacat

SEQ ID NO: 192287 - DNA, 20 bp, Artificial
  CRISPR gRNA sequence
gcccctcacaggacattttc

SEQ ID NO: 192288 - DNA, 20 bp, Artificial
  CRISPR gRNA sequence
acaggacattttcttccaac

SEQ ID NO: 192289 - DNA, 20 bp, Artificial
  CRISPR gRNA sequence
tcttccaacaggtggaaaag

SEQ ID NO: 192290 - DNA, 20 bp, Artificial
  CRISPR gRNA sequence
cttccaacaggtggaaaagg

SEQ ID NO: 192291 - DNA, 20 bp, Artificial
  CRISPR gRNA sequence
ttccaacaggtggaaaagga

SEQ ID NO: 192292 - DNA, 20 bp, Artificial
  CRISPR gRNA sequence
ccaacaggtggaaaaggagg

SEQ ID NO: 192293 - DNA, 20 bp, Artificial
  CRISPR gRNA sequence
caacaggtggaaaaggaggg

SEQ ID NO: 192294 - DNA, 20 bp, Artificial
  CRISPR gRNA sequence
ctctaaggctgagtgtaagt

SEQ ID NO: 192295 - DNA, 20 bp, Artificial
  CRISPR gRNA sequence
taaggctgagtgtaagtgcg

SEQ ID NO: 192296 - DNA, 20 bp, Artificial
  CRISPR gRNA sequence
aggctgagtgtaagtgcggg

SEQ ID NO: 192297 - DNA, 20 bp, Artificial
  CRISPR gRNA sequence
agtgtaagtgcggggcggga

SEQ ID NO: 192298 - DNA, 20 bp, Artificial
  CRISPR gRNA sequence
gcccaccctataattcctcc

SEQ ID NO: 192299 - DNA, 20 bp, Artificial
  CRISPR gRNA sequence
taattcctcctgcaccacat

SEQ ID NO: 192300 - DNA, 20 bp, Artificial
  CRISPR gRNA sequence
ctcctgcaccacatctcctg

SEQ ID NO: 192301 - DNA, 20 bp, Artificial
  CRISPR gRNA sequence
ctgcaccacatctcctgtgg

SEQ ID NO: 192302 - DNA, 20 bp, Artificial
  CRISPR gRNA sequence
caccacatctcctgtgggct

SEQ ID NO: 192303 - DNA, 20 bp, Artificial
  CRISPR gRNA sequence
ctgtgggctctgaccaggtc

SEQ ID NO: 192304 - DNA, 20 bp, Artificial
  CRISPR gRNA sequence
tgggctctgaccaggtcttg

SEQ ID NO: 192305 - DNA, 20 bp, Artificial
  CRISPR gRNA sequence
tgaccaggtcttgtttttgt

SEQ ID NO: 192306 - DNA, 20 bp, Artificial
  CRISPR gRNA sequence
accaggtcttgtttttgttc

SEQ ID NO: 192307 - DNA, 20 bp, Artificial
  CRISPR gRNA sequence
gtttttgttctaccccaggg

SEQ ID NO: 192308 - DNA, 20 bp, Artificial
  CRISPR gRNA sequence
tttttgttctaccccaggga

SEQ ID NO: 192309 - DNA, 20 bp, Artificial
  CRISPR gRNA sequence
ttgttctaccccagggagcg

SEQ ID NO: 192310 - DNA, 20 bp, Artificial
  CRISPR gRNA sequence
tgttctaccccagggagcga

SEQ ID NO: 192311 - DNA, 20 bp, Artificial
  CRISPR gRNA sequence
gttctaccccagggagcgac

SEQ ID NO: 192312 - DNA, 20 bp, Artificial
  CRISPR gRNA sequence
ttctaccccagggagcgaca

SEQ ID NO: 192313 - DNA, 20 bp, Artificial
  CRISPR gRNA sequence
taccccagggagcgacagtg

SEQ ID NO: 192314 - DNA, 20 bp, Artificial
  CRISPR gRNA sequence
ccccagggagcgacagtgcc

SEQ ID NO: 192315 - DNA, 20 bp, Artificial
  CRISPR gRNA sequence
agtctcacagcttgtaaagg

SEQ ID NO: 192316 - DNA, 20 bp, Artificial
  CRISPR gRNA sequence
acagcttgtaaaggtgagat

SEQ ID NO: 192317 - DNA, 20 bp, Artificial
  CRISPR gRNA sequence
gtaaaggtgagattctgggg

SEQ ID NO: 192318 - DNA, 20 bp, Artificial
  CRISPR gRNA sequence
taaaggtgagattctggggg

SEQ ID NO: 192319 - DNA, 20 bp, Artificial
  CRISPR gRNA sequence
tgggggtctgaagtgggtgg

SEQ ID NO: 192320 - DNA, 20 bp, Artificial
  CRISPR gRNA sequence
ggggtctgaagtgggtggag

SEQ ID NO: 192321 - DNA, 20 bp, Artificial
  CRISPR gRNA sequence
aagtgggtggagggtggggc

SEQ ID NO: 192322 - DNA, 20 bp, Artificial
  CRISPR gRNA sequence
ggttgtggggattttttgat

SEQ ID NO: 192323 - DNA, 20 bp, Artificial
  CRISPR gRNA sequence
tggggattttttgattcaga

SEQ ID NO: 192324 - DNA, 20 bp, Artificial
  CRISPR gRNA sequence
tttgattcagaatttttgag

SEQ ID NO: 192325 - DNA, 20 bp, Artificial
  CRISPR gRNA sequence
ttgattcagaatttttgagt

SEQ ID NO: 192326 - DNA, 20 bp, Artificial
  CRISPR gRNA sequence
tgattcagaatttttgagtg

SEQ ID NO: 192327 - DNA, 20 bp, Artificial
  CRISPR gRNA sequence
gattcagaatttttgagtgt

SEQ ID NO: 192328 - DNA, 20 bp, Artificial
  CRISPR gRNA sequence
attcagaatttttgagtgtg

SEQ ID NO: 192329 - DNA, 20 bp, Artificial
  CRISPR gRNA sequence
agaatttttgagtgtgtggt

SEQ ID NO: 192330 - DNA, 20 bp, Artificial
  CRISPR gRNA sequence
ttgagtgtgtggtgggctgt

SEQ ID NO: 192331 - DNA, 20 bp, Artificial
  CRISPR gRNA sequence
tgagtgtgtggtgggctgtt

SEQ ID NO: 192332 - DNA, 20 bp, Artificial
  CRISPR gRNA sequence
gagtgtgtggtgggctgttc

SEQ ID NO: 192333 - DNA, 20 bp, Artificial
  CRISPR gRNA sequence
agtgtgtggtgggctgttca

SEQ ID NO: 192334 - DNA, 20 bp, Artificial
  CRISPR gRNA sequence
ttcagagtgtcatcacttac

SEQ ID NO: 192335 - DNA, 20 bp, Artificial
  CRISPR gRNA sequence
agagtgtcatcacttaccgt

SEQ ID NO: 192336 - DNA, 20 bp, Artificial
  CRISPR gRNA sequence
accgtgactgacctgaattt

SEQ ID NO: 192337 - DNA, 20 bp, Artificial
  CRISPR gRNA sequence
ccgtgactgacctgaatttg

SEQ ID NO: 192338 - DNA, 20 bp, Artificial
  CRISPR gRNA sequence
acctgaatttgttcatgact

SEQ ID NO: 192339 - DNA, 20 bp, Artificial
  CRISPR gRNA sequence
aatttgttcatgactatttt

SEQ ID NO: 192340 - DNA, 20 bp, Artificial
  CRISPR gRNA sequence
gttcatgactattttcttct

SEQ ID NO: 192341 - DNA, 20 bp, Artificial
  CRISPR gRNA sequence
ttcatgactattttcttctg

SEQ ID NO: 192342 - DNA, 20 bp, Artificial
  CRISPR gRNA sequence
atgactattttcttctgtag

SEQ ID NO: 192343 - DNA, 20 bp, Artificial
  CRISPR gRNA sequence
ttttcttctgtagcctgaga

SEQ ID NO: 192344 - DNA, 20 bp, Artificial
  CRISPR gRNA sequence
tcttctgtagcctgagacag

SEQ ID NO: 192345 - DNA, 20 bp, Artificial
  CRISPR gRNA sequence
cttctgtagcctgagacagc

SEQ ID NO: 192346 - DNA, 20 bp, Artificial
  CRISPR gRNA sequence
ttctgtagcctgagacagct

SEQ ID NO: 192347 - DNA, 20 bp, Artificial
  CRISPR gRNA sequence
ctgtagcctgagacagctgc

SEQ ID NO: 192348 - DNA, 20 bp, Artificial
  CRISPR gRNA sequence
tgtagcctgagacagctgcc

SEQ ID NO: 192349 - DNA, 20 bp, Artificial
  CRISPR gRNA sequence
tagcctgagacagctgcctt

SEQ ID NO: 192350 - DNA, 20 bp, Artificial
  CRISPR gRNA sequence
agacagctgccttgtgtgcg

SEQ ID NO: 192351 - DNA, 20 bp, Artificial
  CRISPR gRNA sequence
ccttgtgtgcgactgagatg

SEQ ID NO: 192352 - DNA, 20 bp, Artificial
  CRISPR gRNA sequence
gtgtgcgactgagatgcaca

SEQ ID NO: 192353 - DNA, 20 bp, Artificial
  CRISPR gRNA sequence
tgtgcgactgagatgcacag

SEQ ID NO: 192354 - DNA, 20 bp, Artificial
  CRISPR gRNA sequence
agatgcacagctgccttgtg

SEQ ID NO: 192355 - DNA, 20 bp, Artificial
  CRISPR gRNA sequence
ccttgtgtgcgactgagatg

SEQ ID NO: 192356 - DNA, 20 bp, Artificial
  CRISPR gRNA sequence
gtgtgcgactgagatgcagg

SEQ ID NO: 192357 - DNA, 20 bp, Artificial
  CRISPR gRNA sequence
tgtgcgactgagatgcagga

SEQ ID NO: 192358 - DNA, 20 bp, Artificial
  CRISPR gRNA sequence
agatgcaggatttcctcacg

SEQ ID NO: 192359 - DNA, 20 bp, Artificial
  CRISPR gRNA sequence
cctcacgcctcccctatgtg

SEQ ID NO: 192360 - DNA, 20 bp, Artificial
  CRISPR gRNA sequence
ctcacgcctcccctatgtgt

SEQ ID NO: 192361 - DNA, 20 bp, Artificial
  CRISPR gRNA sequence
acgcctcccctatgtgtctt

SEQ ID NO: 192362 - DNA, 20 bp, Artificial
  CRISPR gRNA sequence
ccctatgtgtcttaggggac

SEQ ID NO: 192363 - DNA, 20 bp, Artificial
  CRISPR gRNA sequence
tgtgtcttaggggactctgg

SEQ ID NO: 192364 - DNA, 20 bp, Artificial
  CRISPR gRNA sequence
aggggactctggcttctctt

SEQ ID NO: 192365 - DNA, 20 bp, Artificial
  CRISPR gRNA sequence
ggggactctggcttctcttt

SEQ ID NO: 192366 - DNA, 20 bp, Artificial
  CRISPR gRNA sequence
tggcttctctttttgcaagg

SEQ ID NO: 192367 - DNA, 20 bp, Artificial
  CRISPR gRNA sequence
gcttctctttttgcaagggc

SEQ ID NO: 192368 - DNA, 20 bp, Artificial
  CRISPR gRNA sequence
ctctttttgcaagggcctct

SEQ ID NO: 192369 - DNA, 20 bp, Artificial
  CRISPR gRNA sequence
tctttttgcaagggcctctg

SEQ ID NO: 192370 - DNA, 20 bp, Artificial
  CRISPR gRNA sequence
tttttgcaagggcctctgaa

SEQ ID NO: 192371 - DNA, 20 bp, Artificial
  CRISPR gRNA sequence
tttgcaagggcctctgaatc

SEQ ID NO: 192372 - DNA, 20 bp, Artificial
  CRISPR gRNA sequence
ttgcaagggcctctgaatct

SEQ ID NO: 192373 - DNA, 20 bp, Artificial
  CRISPR gRNA sequence
tgcaagggcctctgaatctg

SEQ ID NO: 192374 - DNA, 20 bp, Artificial
  CRISPR gRNA sequence
gcaagggcctctgaatctgt

SEQ ID NO: 192375 - DNA, 20 bp, Artificial
  CRISPR gRNA sequence
caagggcctctgaatctgtc

SEQ ID NO: 192376 - DNA, 20 bp, Artificial
  CRISPR gRNA sequence
tgaatctgtctgtgtccctg

SEQ ID NO: 192377 - DNA, 20 bp, Artificial
  CRISPR gRNA sequence
aatctgtctgtgtccctgtt

SEQ ID NO: 192378 - DNA, 20 bp, Artificial
  CRISPR gRNA sequence
tctgtgtccctgttagcaca

SEQ ID NO: 192379 - DNA, 20 bp, Artificial
  CRISPR gRNA sequence
tgtccctgttagcacaatgt

SEQ ID NO: 192380 - DNA, 20 bp, Artificial
  CRISPR gRNA sequence
ttagcacaatgtgaggaggt

SEQ ID NO: 192381 - DNA, 20 bp, Artificial
  CRISPR gRNA sequence
gcacaatgtgaggaggtaga

SEQ ID NO: 192382 - DNA, 20 bp, Artificial
  CRISPR gRNA sequence
tgtgtctaccatgaccccct

SEQ ID NO: 192383 - DNA, 20 bp, Artificial
  CRISPR gRNA sequence
tgtctaccatgacccccttc

SEQ ID NO: 192384 - DNA, 20 bp, Artificial
  CRISPR gRNA sequence
ccatgacccccttcctcaca

SEQ ID NO: 192385 - DNA, 20 bp, Artificial
  CRISPR gRNA sequence
cctcacactgacctgtgttc

SEQ ID NO: 192386 - DNA, 20 bp, Artificial
  CRISPR gRNA sequence
ctcacactgacctgtgttcc

SEQ ID NO: 192387 - DNA, 20 bp, Artificial
  CRISPR gRNA sequence
acactgacctgtgttccttc

SEQ ID NO: 192388 - DNA, 20 bp, Artificial
  CRISPR gRNA sequence
acctgtgttccttccctgtt

SEQ ID NO: 192389 - DNA, 20 bp, Artificial
  CRISPR gRNA sequence
tgttccttccctgttctctt

SEQ ID NO: 192390 - DNA, 20 bp, Artificial
  CRISPR gRNA sequence
cttccctgttctcttttcta

SEQ ID NO: 192391 - DNA, 20 bp, Artificial
  CRISPR gRNA sequence
ccctgttctcttttctatta

SEQ ID NO: 192392 - DNA, 20 bp, Artificial
  CRISPR gRNA sequence
cctgttctcttttctattaa

SEQ ID NO: 192393 - DNA, 20 bp, Artificial
  CRISPR gRNA sequence
ttctcttttctattaaaaat

SEQ ID NO: 192394 - DNA, 20 bp, Artificial
  CRISPR gRNA sequence
tcttttctattaaaaataag

SEQ ID NO: 192395 - DNA, 20 bp, Artificial
  CRISPR gRNA sequence
ttttctattaaaaataagaa

SEQ ID NO: 192396 - DNA, 20 bp, Artificial
  CRISPR gRNA sequence
ttctattaaaaataagaacc

SEQ ID NO: 192397 - DNA, 20 bp, Artificial
  CRISPR gRNA sequence
tctattaaaaataagaacct

SEQ ID NO: 192398 - DNA, 20 bp, Artificial
  CRISPR gRNA sequence
ctattaaaaataagaacctg

SEQ ID NO: 192399 - DNA, 20 bp, Artificial
  CRISPR gRNA sequence
tattaaaaataagaacctgg

SEQ ID NO: 192400 - DNA, 20 bp, Artificial
  CRISPR gRNA sequence
ttaaaaataagaacctgggc

SEQ ID NO: 192401 - DNA, 20 bp, Artificial
  CRISPR gRNA sequence
aaaataagaacctgggcaga

SEQ ID NO: 192402 - DNA, 20 bp, Artificial
  CRISPR gRNA sequence
ggcagagtgcggcagctcat

SEQ ID NO: 192403 - DNA, 20 bp, Artificial
  CRISPR gRNA sequence
atgcctgtaatcccagcact

SEQ ID NO: 192404 - DNA, 20 bp, Artificial
  CRISPR gRNA sequence
taatcccagcacttagggag

SEQ ID NO: 192405 - DNA, 20 bp, Artificial
  CRISPR gRNA sequence
agggaggccgaggagggcag

SEQ ID NO: 192406 - DNA, 20 bp, Artificial
  CRISPR gRNA sequence
gggaggccgaggagggcaga

SEQ ID NO: 192407 - DNA, 20 bp, Artificial
  CRISPR gRNA sequence
gctaacacggtgaaaccccg

SEQ ID NO: 192408 - DNA, 20 bp, Artificial
  CRISPR gRNA sequence
acacggtgaaaccccgtctc

SEQ ID NO: 192409 - DNA, 20 bp, Artificial
  CRISPR gRNA sequence
tactaaaaaatacaaaaaat

SEQ ID NO: 192410 - DNA, 20 bp, Artificial
  CRISPR gRNA sequence
ctaaaaaatacaaaaaatta

SEQ ID NO: 192411 - DNA, 20 bp, Artificial
  CRISPR gRNA sequence
aaaaatacaaaaaattagct

SEQ ID NO: 192412 - DNA, 20 bp, Artificial
  CRISPR gRNA sequence
gctgggcgcagaggcacggg

SEQ ID NO: 192413 - DNA, 20 bp, Artificial
  CRISPR gRNA sequence
ggcgcagaggcacgggcctg

SEQ ID NO: 192414 - DNA, 20 bp, Artificial
  CRISPR gRNA sequence
tagtcccagctactcaggag

SEQ ID NO: 192415 - DNA, 20 bp, Artificial
  CRISPR gRNA sequence
ctcaggaggcggaggcagga

SEQ ID NO: 192416 - DNA, 20 bp, Artificial
  CRISPR gRNA sequence
aggaggcggaggcaggagaa

SEQ ID NO: 192417 - DNA, 20 bp, Artificial
  CRISPR gRNA sequence
cagtgagccaggattgtgcg

SEQ ID NO: 192418 - DNA, 20 bp, Artificial
  CRISPR gRNA sequence
tgcgactgcactccagcctg

SEQ ID NO: 192419 - DNA, 20 bp, Artificial
  CRISPR gRNA sequence
cactccagcctgggtgacag

SEQ ID NO: 192420 - DNA, 20 bp, Artificial
  CRISPR gRNA sequence
cagcctgggtgacagggtga

SEQ ID NO: 192421 - DNA, 20 bp, Artificial
  CRISPR gRNA sequence
ggtgacagggtgaaacgcca

SEQ ID NO: 192422 - DNA, 20 bp, Artificial
  CRISPR gRNA sequence
aaaaaataaaaattgaaaaa

SEQ ID NO: 192423 - DNA, 20 bp, Artificial
  CRISPR gRNA sequence
aaaaataaaaaaagaacctg

SEQ ID NO: 192424 - DNA, 20 bp, Artificial
  CRISPR gRNA sequence
gatctcaatttaatttttca

SEQ ID NO: 192425 - DNA, 20 bp, Artificial
  CRISPR gRNA sequence
aatttaatttttcatattct

SEQ ID NO: 192426 - DNA, 20 bp, Artificial
  CRISPR gRNA sequence
aatttttcatattcttgcaa

SEQ ID NO: 192427 - DNA, 20 bp, Artificial
  CRISPR gRNA sequence
atttttcatattcttgcaat

SEQ ID NO: 192428 - DNA, 20 bp, Artificial
  CRISPR gRNA sequence
ttcatattcttgcaatgaaa

SEQ ID NO: 192429 - DNA, 20 bp, Artificial
  CRISPR gRNA sequence
tcatattcttgcaatgaaat

SEQ ID NO: 192430 - DNA, 20 bp, Artificial
  CRISPR gRNA sequence
catattcttgcaatgaaatg

SEQ ID NO: 192431 - DNA, 20 bp, Artificial
  CRISPR gRNA sequence
atattcttgcaatgaaatgg

SEQ ID NO: 192432 - DNA, 20 bp, Artificial
  CRISPR gRNA sequence
ttgcaatgaaatggacttga

SEQ ID NO: 192433 - DNA, 20 bp, Artificial
  CRISPR gRNA sequence
gcaatgaaatggacttgagg

SEQ ID NO: 192434 - DNA, 20 bp, Artificial
  CRISPR gRNA sequence
caatgaaatggacttgagga

SEQ ID NO: 192435 - DNA, 20 bp, Artificial
  CRISPR gRNA sequence
gaggaagctaagatcatagc

SEQ ID NO: 192436 - DNA, 20 bp, Artificial
  CRISPR gRNA sequence
aggaagctaagatcatagct

SEQ ID NO: 192437 - DNA, 20 bp, Artificial
  CRISPR gRNA sequence
agatcatagctagaaataca

SEQ ID NO: 192438 - DNA, 20 bp, Artificial
  CRISPR gRNA sequence
gaaatacagataattccaca

SEQ ID NO: 192439 - DNA, 20 bp, Artificial
  CRISPR gRNA sequence
cacagcacatctctagcaaa

SEQ ID NO: 192440 - DNA, 20 bp, Artificial
  CRISPR gRNA sequence
tagcaaatttagcctattcc

SEQ ID NO: 192441 - DNA, 20 bp, Artificial
  CRISPR gRNA sequence
gcaaatttagcctattccta

SEQ ID NO: 192442 - DNA, 20 bp, Artificial
  CRISPR gRNA sequence
agcctattcctattctctag

SEQ ID NO: 192443 - DNA, 20 bp, Artificial
  CRISPR gRNA sequence
gcctattcctattctctagc

SEQ ID NO: 192444 - DNA, 20 bp, Artificial
  CRISPR gRNA sequence
ttcctattctctagcctatt

SEQ ID NO: 192445 - DNA, 20 bp, Artificial
  CRISPR gRNA sequence
ctattctctagcctattcct

SEQ ID NO: 192446 - DNA, 20 bp, Artificial
  CRISPR gRNA sequence
ttctctagcctattccttac

SEQ ID NO: 192447 - DNA, 20 bp, Artificial
  CRISPR gRNA sequence
tctagcctattccttaccac

SEQ ID NO: 192448 - DNA, 20 bp, Artificial
  CRISPR gRNA sequence
tagcctattccttaccacct

SEQ ID NO: 192449 - DNA, 20 bp, Artificial
  CRISPR gRNA sequence
gcctattccttaccacctgt

SEQ ID NO: 192450 - DNA, 20 bp, Artificial
  CRISPR gRNA sequence
ttccttaccacctgtaatct

SEQ ID NO: 192451 - DNA, 20 bp, Artificial
  CRISPR gRNA sequence
cttaccacctgtaatcttga

SEQ ID NO: 192452 - DNA, 20 bp, Artificial
  CRISPR gRNA sequence
accacctgtaatcttgacca

SEQ ID NO: 192453 - DNA, 20 bp, Artificial
  CRISPR gRNA sequence
ccacctgtaatcttgaccat

SEQ ID NO: 192454 - DNA, 20 bp, Artificial
  CRISPR gRNA sequence
taatcttgaccatatacctt

SEQ ID NO: 192455 - DNA, 20 bp, Artificial
  CRISPR gRNA sequence
gaccatataccttggagttg

SEQ ID NO: 192456 - DNA, 20 bp, Artificial
  CRISPR gRNA sequence
accatataccttggagttga

SEQ ID NO: 192457 - DNA, 20 bp, Artificial
  CRISPR gRNA sequence
ggagttgaatattgttttca

SEQ ID NO: 192458 - DNA, 20 bp, Artificial
  CRISPR gRNA sequence
gagttgaatattgttttcat

SEQ ID NO: 192459 - DNA, 20 bp, Artificial
  CRISPR gRNA sequence
aatattgttttcatactgct

SEQ ID NO: 192460 - DNA, 20 bp, Artificial
  CRISPR gRNA sequence
ttttcatactgctgtggttt

SEQ ID NO: 192461 - DNA, 20 bp, Artificial
  CRISPR gRNA sequence
tcatactgctgtggtttgaa

SEQ ID NO: 192462 - DNA, 20 bp, Artificial
  CRISPR gRNA sequence
catactgctgtggtttgaat

SEQ ID NO: 192463 - DNA, 20 bp, Artificial
  CRISPR gRNA sequence
atactgctgtggtttgaatg

SEQ ID NO: 192464 - DNA, 20 bp, Artificial
  CRISPR gRNA sequence
ctgtggtttgaatgttccct

SEQ ID NO: 192465 - DNA, 20 bp, Artificial
  CRISPR gRNA sequence
tggtttgaatgttccctcca

SEQ ID NO: 192466 - DNA, 20 bp, Artificial
  CRISPR gRNA sequence
gaatgttccctccaacactc

SEQ ID NO: 192467 - DNA, 20 bp, Artificial
  CRISPR gRNA sequence
aatgttccctccaacactca

SEQ ID NO: 192468 - DNA, 20 bp, Artificial
  CRISPR gRNA sequence
cctccaacactcatgttgag

SEQ ID NO: 192469 - DNA, 20 bp, Artificial
  CRISPR gRNA sequence
caacactcatgttgagactt

SEQ ID NO: 192470 - DNA, 20 bp, Artificial
  CRISPR gRNA sequence
atgttgagacttaatcccta

SEQ ID NO: 192471 - DNA, 20 bp, Artificial
  CRISPR gRNA sequence
agacttaatccctaatgtgg

SEQ ID NO: 192472 - DNA, 20 bp, Artificial
  CRISPR gRNA sequence
aatccctaatgtggcaatac

SEQ ID NO: 192473 - DNA, 20 bp, Artificial
  CRISPR gRNA sequence
atccctaatgtggcaatact

SEQ ID NO: 192474 - DNA, 20 bp, Artificial
  CRISPR gRNA sequence
atgtggcaatactgaaaggt

SEQ ID NO: 192475 - DNA, 20 bp, Artificial
  CRISPR gRNA sequence
aaaggtggggcctttgagat

SEQ ID NO: 192476 - DNA, 20 bp, Artificial
  CRISPR gRNA sequence
tgagatgtgattggatcgta

SEQ ID NO: 192477 - DNA, 20 bp, Artificial
  CRISPR gRNA sequence
gagatgtgattggatcgtaa

SEQ ID NO: 192478 - DNA, 20 bp, Artificial
  CRISPR gRNA sequence
agatgtgattggatcgtaag

SEQ ID NO: 192479 - DNA, 20 bp, Artificial
  CRISPR gRNA sequence
gatcgtaaggctgtgccttc

SEQ ID NO: 192480 - DNA, 20 bp, Artificial
  CRISPR gRNA sequence
tgccttcattcatgggttaa

SEQ ID NO: 192481 - DNA, 20 bp, Artificial
  CRISPR gRNA sequence
cattcatgggttaatggatt

SEQ ID NO: 192482 - DNA, 20 bp, Artificial
  CRISPR gRNA sequence
attcatgggttaatggatta

SEQ ID NO: 192483 - DNA, 20 bp, Artificial
  CRISPR gRNA sequence
atgggttaatggattaatgg

SEQ ID NO: 192484 - DNA, 20 bp, Artificial
  CRISPR gRNA sequence
atggattaatgggttatcac

SEQ ID NO: 192485 - DNA, 20 bp, Artificial
  CRISPR gRNA sequence
atgggttatcacaggaatgg

SEQ ID NO: 192486 - DNA, 20 bp, Artificial
  CRISPR gRNA sequence
tcacaggaatgggactggtg

SEQ ID NO: 192487 - DNA, 20 bp, Artificial
  CRISPR gRNA sequence
gtggctttataagaagagga

SEQ ID NO: 192488 - DNA, 20 bp, Artificial
  CRISPR gRNA sequence
tataagaagaggaaaagaga

SEQ ID NO: 192489 - DNA, 20 bp, Artificial
  CRISPR gRNA sequence
ataagaagaggaaaagagaa

SEQ ID NO: 192490 - DNA, 20 bp, Artificial
  CRISPR gRNA sequence
taagaagaggaaaagagaac

SEQ ID NO: 192491 - DNA, 20 bp, Artificial
  CRISPR gRNA sequence
agctagcatgcccagcccac

SEQ ID NO: 192492 - DNA, 20 bp, Artificial
  CRISPR gRNA sequence
gcatgcccagcccacagaga

SEQ ID NO: 192493 - DNA, 20 bp, Artificial
  CRISPR gRNA sequence
cactagagtgatgctaagtg

SEQ ID NO: 192494 - DNA, 20 bp, Artificial
  CRISPR gRNA sequence
gagtgatgctaagtggaaat

SEQ ID NO: 192495 - DNA, 20 bp, Artificial
  CRISPR gRNA sequence
agtggaaatgtgaggtgcag

SEQ ID NO: 192496 - DNA, 20 bp, Artificial
  CRISPR gRNA sequence
ccacagagggcccccaccag

SEQ ID NO: 192497 - DNA, 20 bp, Artificial
  CRISPR gRNA sequence
gtgtctagtggatccaggcc

SEQ ID NO: 192498 - DNA, 20 bp, Artificial
  CRISPR gRNA sequence
gtggatccaggccacaggag

SEQ ID NO: 192499 - DNA, 20 bp, Artificial
  CRISPR gRNA sequence
gtggagcgctgggagcagga

SEQ ID NO: 192500 - DNA, 20 bp, Artificial
  CRISPR gRNA sequence
tggagcgctgggagcaggac

SEQ ID NO: 192501 - DNA, 20 bp, Artificial
  CRISPR gRNA sequence
ggagcaggacctgaccacca

SEQ ID NO: 192502 - DNA, 20 bp, Artificial
  CRISPR gRNA sequence
accaccaccaggaccccaga

SEQ ID NO: 192503 - DNA, 20 bp, Artificial
  CRISPR gRNA sequence
tggagtcagtggcagcatgc

SEQ ID NO: 192504 - DNA, 20 bp, Artificial
  CRISPR gRNA sequence
gggaaagctttaggcaccag

SEQ ID NO: 192505 - DNA, 20 bp, Artificial
  CRISPR gRNA sequence
ggaaagctttaggcaccagc

SEQ ID NO: 192506 - DNA, 20 bp, Artificial
  CRISPR gRNA sequence
taggcaccagcctgcaaccc

SEQ ID NO: 192507 - DNA, 20 bp, Artificial
  CRISPR gRNA sequence
aggcaccagcctgcaaccca

SEQ ID NO: 192508 - DNA, 20 bp, Artificial
  CRISPR gRNA sequence
ggcaccagcctgcaacccat

SEQ ID NO: 192509 - DNA, 20 bp, Artificial
  CRISPR gRNA sequence
caacccattcgagcagccac

SEQ ID NO: 192510 - DNA, 20 bp, Artificial
  CRISPR gRNA sequence
gagcagccacgtaggctgca

SEQ ID NO: 192511 - DNA, 20 bp, Artificial
  CRISPR gRNA sequence
cacccagcaaagccacaggc

SEQ ID NO: 192512 - DNA, 20 bp, Artificial
  CRISPR gRNA sequence
cctgaggccttgggggccca

SEQ ID NO: 192513 - DNA, 20 bp, Artificial
  CRISPR gRNA sequence
aggccttgggggcccaatcc

SEQ ID NO: 192514 - DNA, 20 bp, Artificial
  CRISPR gRNA sequence
gggggcccaatccctgctcc

SEQ ID NO: 192515 - DNA, 20 bp, Artificial
  CRISPR gRNA sequence
ggggcccaatccctgctcca

SEQ ID NO: 192516 - DNA, 20 bp, Artificial
  CRISPR gRNA sequence
ctccagtgtgtccgtgaggc

SEQ ID NO: 192517 - DNA, 20 bp, Artificial
  CRISPR gRNA sequence
cagtgtgtccgtgaggcagc

SEQ ID NO: 192518 - DNA, 20 bp, Artificial
  CRISPR gRNA sequence
ttctcttcccacagatacct

SEQ ID NO: 192519 - DNA, 20 bp, Artificial
  CRISPR gRNA sequence
tcttcccacagatacctttt

SEQ ID NO: 192520 - DNA, 20 bp, Artificial
  CRISPR gRNA sequence
ttcccacagataccttttct

SEQ ID NO: 192521 - DNA, 20 bp, Artificial
  CRISPR gRNA sequence
cccacagataccttttctct

SEQ ID NO: 192522 - DNA, 20 bp, Artificial
  CRISPR gRNA sequence
ccacagataccttttctctc

SEQ ID NO: 192523 - DNA, 20 bp, Artificial
  CRISPR gRNA sequence
ttctctcccatgacccttta

SEQ ID NO: 192524 - DNA, 20 bp, Artificial
  CRISPR gRNA sequence
tctctcccatgaccctttaa

SEQ ID NO: 192525 - DNA, 20 bp, Artificial
  CRISPR gRNA sequence
ctctcccatgaccctttaac

SEQ ID NO: 192526 - DNA, 20 bp, Artificial
  CRISPR gRNA sequence
tctcccatgaccctttaaca

SEQ ID NO: 192527 - DNA, 20 bp, Artificial
  CRISPR gRNA sequence
tcccatgaccctttaacagc

SEQ ID NO: 192528 - DNA, 20 bp, Artificial
  CRISPR gRNA sequence
ccatgaccctttaacagcat

SEQ ID NO: 192529 - DNA, 20 bp, Artificial
  CRISPR gRNA sequence
taacagcatctgcttcattc

SEQ ID NO: 192530 - DNA, 20 bp, Artificial
  CRISPR gRNA sequence
aacagcatctgcttcattcc

SEQ ID NO: 192531 - DNA, 20 bp, Artificial
  CRISPR gRNA sequence
acagcatctgcttcattccc

SEQ ID NO: 192532 - DNA, 20 bp, Artificial
  CRISPR gRNA sequence
cttcattcccctcaccttcc

SEQ ID NO: 192533 - DNA, 20 bp, Artificial
  CRISPR gRNA sequence
cattcccctcaccttcccag

SEQ ID NO: 192534 - DNA, 20 bp, Artificial
  CRISPR gRNA sequence
attcccctcaccttcccagg

SEQ ID NO: 192535 - DNA, 20 bp, Artificial
  CRISPR gRNA sequence
ccctcaccttcccaggctga

SEQ ID NO: 192536 - DNA, 20 bp, Artificial
  CRISPR gRNA sequence
accttcccaggctgatctga

SEQ ID NO: 192537 - DNA, 20 bp, Artificial
  CRISPR gRNA sequence
cccaggctgatctgaggtaa

SEQ ID NO: 192538 - DNA, 20 bp, Artificial
  CRISPR gRNA sequence
ccaggctgatctgaggtaaa

SEQ ID NO: 192539 - DNA, 20 bp, Artificial
  CRISPR gRNA sequence
atctgaggtaaactttgaag

SEQ ID NO: 192540 - DNA, 20 bp, Artificial
  CRISPR gRNA sequence
aggtaaactttgaagtaaaa

SEQ ID NO: 192541 - DNA, 20 bp, Artificial
  CRISPR gRNA sequence
tgaagtaaaataaaagctgt

SEQ ID NO: 192542 - DNA, 20 bp, Artificial
  CRISPR gRNA sequence
gaagtaaaataaaagctgtg

SEQ ID NO: 192543 - DNA, 20 bp, Artificial
  CRISPR gRNA sequence
aagtaaaataaaagctgtgt

SEQ ID NO: 192544 - DNA, 20 bp, Artificial
  CRISPR gRNA sequence
tgtttgagcatcatttgtat

SEQ ID NO: 192545 - DNA, 20 bp, Artificial
  CRISPR gRNA sequence
gagcatcatttgtatttcat

SEQ ID NO: 192546 - DNA, 20 bp, Artificial
  CRISPR gRNA sequence
agcatcatttgtatttcatt

SEQ ID NO: 192547 - DNA, 20 bp, Artificial
  CRISPR gRNA sequence
gtatttcatttgtgcgtttt

SEQ ID NO: 192548 - DNA, 20 bp, Artificial
  CRISPR gRNA sequence
tatttcatttgtgcgttttg

SEQ ID NO: 192549 - DNA, 20 bp, Artificial
  CRISPR gRNA sequence
catttgtgcgttttgtgcct

SEQ ID NO: 192550 - DNA, 20 bp, Artificial
  CRISPR gRNA sequence
atttgtgcgttttgtgcctt

SEQ ID NO: 192551 - DNA, 20 bp, Artificial
  CRISPR gRNA sequence
gtgcgttttgtgccttgttg

SEQ ID NO: 192552 - DNA, 20 bp, Artificial
  CRISPR gRNA sequence
tgcgttttgtgccttgttgt

SEQ ID NO: 192553 - DNA, 20 bp, Artificial
  CRISPR gRNA sequence
tgtgccttgttgttttaatt

SEQ ID NO: 192554 - DNA, 20 bp, Artificial
  CRISPR gRNA sequence
gtgccttgttgttttaattt

SEQ ID NO: 192555 - DNA, 20 bp, Artificial
  CRISPR gRNA sequence
tgccttgttgttttaatttt

SEQ ID NO: 192556 - DNA, 20 bp, Artificial
  CRISPR gRNA sequence
gttgttttaattttttaacc

SEQ ID NO: 192557 - DNA, 20 bp, Artificial
  CRISPR gRNA sequence
ttgttttaattttttaacca

SEQ ID NO: 192558 - DNA, 20 bp, Artificial
  CRISPR gRNA sequence
ttttaattttttaaccacat

SEQ ID NO: 192559 - DNA, 20 bp, Artificial
  CRISPR gRNA sequence
taattttttaaccacattca

SEQ ID NO: 192560 - DNA, 20 bp, Artificial
  CRISPR gRNA sequence
aattttttaaccacattcaa

SEQ ID NO: 192561 - DNA, 20 bp, Artificial
  CRISPR gRNA sequence
attttttaaccacattcaag

SEQ ID NO: 192562 - DNA, 20 bp, Artificial
  CRISPR gRNA sequence
tttaaccacattcaagctat

SEQ ID NO: 192563 - DNA, 20 bp, Artificial
  CRISPR gRNA sequence
ttaaccacattcaagctatc

SEQ ID NO: 192564 - DNA, 20 bp, Artificial
  CRISPR gRNA sequence
taaccacattcaagctatcc

SEQ ID NO: 192565 - DNA, 20 bp, Artificial
  CRISPR gRNA sequence
aaccacattcaagctatcct

SEQ ID NO: 192566 - DNA, 20 bp, Artificial
  CRISPR gRNA sequence
accacattcaagctatcctt

SEQ ID NO: 192567 - DNA, 20 bp, Artificial
  CRISPR gRNA sequence
aagctatcctttggcttcca

SEQ ID NO: 192568 - DNA, 20 bp, Artificial
  CRISPR gRNA sequence
tcctttggcttccaatgcca

SEQ ID NO: 192569 - DNA, 20 bp, Artificial
  CRISPR gRNA sequence
tggcttccaatgccatggtc

SEQ ID NO: 192570 - DNA, 20 bp, Artificial
  CRISPR gRNA sequence
ggcttccaatgccatggtcc

SEQ ID NO: 192571 - DNA, 20 bp, Artificial
  CRISPR gRNA sequence
gcttccaatgccatggtcca

SEQ ID NO: 192572 - DNA, 20 bp, Artificial
  CRISPR gRNA sequence
ccaatgccatggtccaccca

SEQ ID NO: 192573 - DNA, 20 bp, Artificial
  CRISPR gRNA sequence
caatgccatggtccacccag

SEQ ID NO: 192574 - DNA, 20 bp, Artificial
  CRISPR gRNA sequence
tgggtggaccatggcattgg

SEQ ID NO: 192575 - DNA, 20 bp, Artificial
  CRISPR gRNA sequence
ggtggaccatggcattggaa

SEQ ID NO: 192576 - DNA, 20 bp, Artificial
  CRISPR gRNA sequence
gaagccaaaggatagcttga

SEQ ID NO: 192577 - DNA, 20 bp, Artificial
  CRISPR gRNA sequence
gaatgtggttaaaaaattaa

SEQ ID NO: 192578 - DNA, 20 bp, Artificial
  CRISPR gRNA sequence
aatgtggttaaaaaattaaa

SEQ ID NO: 192579 - DNA, 20 bp, Artificial
  CRISPR gRNA sequence
aaaaattaaaacaacaaggc

SEQ ID NO: 192580 - DNA, 20 bp, Artificial
  CRISPR gRNA sequence
aaacaacaaggcacaaaacg

SEQ ID NO: 192581 - DNA, 20 bp, Artificial
  CRISPR gRNA sequence
aaacacagcttttattttac

SEQ ID NO: 192582 - DNA, 20 bp, Artificial
  CRISPR gRNA sequence
ttattttacttcaaagttta

SEQ ID NO: 192583 - DNA, 20 bp, Artificial
  CRISPR gRNA sequence
tattttacttcaaagtttac

SEQ ID NO: 192584 - DNA, 20 bp, Artificial
  CRISPR gRNA sequence
attttacttcaaagtttacc

SEQ ID NO: 192585 - DNA, 20 bp, Artificial
  CRISPR gRNA sequence
ttttacttcaaagtttacct

SEQ ID NO: 192586 - DNA, 20 bp, Artificial
  CRISPR gRNA sequence
tacttcaaagtttacctcag

SEQ ID NO: 192587 - DNA, 20 bp, Artificial
  CRISPR gRNA sequence
acttcaaagtttacctcaga

SEQ ID NO: 192588 - DNA, 20 bp, Artificial
  CRISPR gRNA sequence
cttcaaagtttacctcagat

SEQ ID NO: 192589 - DNA, 20 bp, Artificial
  CRISPR gRNA sequence
caaagtttacctcagatcag

SEQ ID NO: 192590 - DNA, 20 bp, Artificial
  CRISPR gRNA sequence
aaagtttacctcagatcagc

SEQ ID NO: 192591 - DNA, 20 bp, Artificial
  CRISPR gRNA sequence
acctcagatcagcctgggaa

SEQ ID NO: 192592 - DNA, 20 bp, Artificial
  CRISPR gRNA sequence
cctcagatcagcctgggaag

SEQ ID NO: 192593 - DNA, 20 bp, Artificial
  CRISPR gRNA sequence
agatcagcctgggaaggtga

SEQ ID NO: 192594 - DNA, 20 bp, Artificial
  CRISPR gRNA sequence
ggaaggtgaggggaatgaag

SEQ ID NO: 192595 - DNA, 20 bp, Artificial
  CRISPR gRNA sequence
ttaaagggtcatgggagaga

SEQ ID NO: 192596 - DNA, 20 bp, Artificial
  CRISPR gRNA sequence
aagggtcatgggagagaaaa

SEQ ID NO: 192597 - DNA, 20 bp, Artificial
  CRISPR gRNA sequence
tgggaagagaataatctctt

SEQ ID NO: 192598 - DNA, 20 bp, Artificial
  CRISPR gRNA sequence
ttttgacttcgtgtgctgcc

SEQ ID NO: 192599 - DNA, 20 bp, Artificial
  CRISPR gRNA sequence
ttgacttcgtgtgctgcctc

SEQ ID NO: 192600 - DNA, 20 bp, Artificial
  CRISPR gRNA sequence
tgacttcgtgtgctgcctca

SEQ ID NO: 192601 - DNA, 20 bp, Artificial
  CRISPR gRNA sequence
gacttcgtgtgctgcctcac

SEQ ID NO: 192602 - DNA, 20 bp, Artificial
  CRISPR gRNA sequence
acttcgtgtgctgcctcacg

SEQ ID NO: 192603 - DNA, 20 bp, Artificial
  CRISPR gRNA sequence
cgtgtgctgcctcacggaca

SEQ ID NO: 192604 - DNA, 20 bp, Artificial
  CRISPR gRNA sequence
gtgtgctgcctcacggacac

SEQ ID NO: 192605 - DNA, 20 bp, Artificial
  CRISPR gRNA sequence
cctcacggacacactggagc

SEQ ID NO: 192606 - DNA, 20 bp, Artificial
  CRISPR gRNA sequence
acggacacactggagcaggg

SEQ ID NO: 192607 - DNA, 20 bp, Artificial
  CRISPR gRNA sequence
gagcagggattgggccccca

SEQ ID NO: 192608 - DNA, 20 bp, Artificial
  CRISPR gRNA sequence
ggcccccaaggcctcaggta

SEQ ID NO: 192609 - DNA, 20 bp, Artificial
  CRISPR gRNA sequence
aggtagccccgtgcctgtgg

SEQ ID NO: 192610 - DNA, 20 bp, Artificial
  CRISPR gRNA sequence
tggctttgctgggtgcagcc

SEQ ID NO: 192611 - DNA, 20 bp, Artificial
  CRISPR gRNA sequence
tgctgggtgcagcctacgtg

SEQ ID NO: 192612 - DNA, 20 bp, Artificial
  CRISPR gRNA sequence
gctgggtgcagcctacgtgg

SEQ ID NO: 192613 - DNA, 20 bp, Artificial
  CRISPR gRNA sequence
ctgggtgcagcctacgtggc

SEQ ID NO: 192614 - DNA, 20 bp, Artificial
  CRISPR gRNA sequence
ggtgcagcctacgtggctgc

SEQ ID NO: 192615 - DNA, 20 bp, Artificial
  CRISPR gRNA sequence
cgtggctgctcgaatgggtt

SEQ ID NO: 192616 - DNA, 20 bp, Artificial
  CRISPR gRNA sequence
ctcgaatgggttgcaggctg

SEQ ID NO: 192617 - DNA, 20 bp, Artificial
  CRISPR gRNA sequence
gaatgggttgcaggctggtg

SEQ ID NO: 192618 - DNA, 20 bp, Artificial
  CRISPR gRNA sequence
caggctggtgcctaaagctt

SEQ ID NO: 192619 - DNA, 20 bp, Artificial
  CRISPR gRNA sequence
gtgcctaaagctttcccaag

SEQ ID NO: 192620 - DNA, 20 bp, Artificial
  CRISPR gRNA sequence
aagctttcccaagggggcgc

SEQ ID NO: 192621 - DNA, 20 bp, Artificial
  CRISPR gRNA sequence
tcccaagggggcgctgcatg

SEQ ID NO: 192622 - DNA, 20 bp, Artificial
  CRISPR gRNA sequence
cccaagggggcgctgcatgc

SEQ ID NO: 192623 - DNA, 20 bp, Artificial
  CRISPR gRNA sequence
ccaagggggcgctgcatgct

SEQ ID NO: 192624 - DNA, 20 bp, Artificial
  CRISPR gRNA sequence
catgctgccactgactccac

SEQ ID NO: 192625 - DNA, 20 bp, Artificial
  CRISPR gRNA sequence
ccactgactccacagttctg

SEQ ID NO: 192626 - DNA, 20 bp, Artificial
  CRISPR gRNA sequence
actccacagttctggggtcc

SEQ ID NO: 192627 - DNA, 20 bp, Artificial
  CRISPR gRNA sequence
cacagttctggggtcctggt

SEQ ID NO: 192628 - DNA, 20 bp, Artificial
  CRISPR gRNA sequence
tggggtcctggtggtggtca

SEQ ID NO: 192629 - DNA, 20 bp, Artificial
  CRISPR gRNA sequence
gggtcctggtggtggtcagg

SEQ ID NO: 192630 - DNA, 20 bp, Artificial
  CRISPR gRNA sequence
gtggtggtcaggtcctgctc

SEQ ID NO: 192631 - DNA, 20 bp, Artificial
  CRISPR gRNA sequence
ctcccagcgctccacaaggc

SEQ ID NO: 192632 - DNA, 20 bp, Artificial
  CRISPR gRNA sequence
ccagcgctccacaaggcact

SEQ ID NO: 192633 - DNA, 20 bp, Artificial
  CRISPR gRNA sequence
cacaaggcactctctcctgt

SEQ ID NO: 192634 - DNA, 20 bp, Artificial
  CRISPR gRNA sequence
tctcctgtggcctggatcca

SEQ ID NO: 192635 - DNA, 20 bp, Artificial
  CRISPR gRNA sequence
tcctgtggcctggatccact

SEQ ID NO: 192636 - DNA, 20 bp, Artificial
  CRISPR gRNA sequence
ctgtggcctggatccactag

SEQ ID NO: 192637 - DNA, 20 bp, Artificial
  CRISPR gRNA sequence
tggcctggatccactagaca

SEQ ID NO: 192638 - DNA, 20 bp, Artificial
  CRISPR gRNA sequence
gatccactagacactagaca

SEQ ID NO: 192639 - DNA, 20 bp, Artificial
  CRISPR gRNA sequence
gacactagacatttccctgg

SEQ ID NO: 192640 - DNA, 20 bp, Artificial
  CRISPR gRNA sequence
gacatttccctggtgggggc

SEQ ID NO: 192641 - DNA, 20 bp, Artificial
  CRISPR gRNA sequence
ccctggtgggggccctctgt

SEQ ID NO: 192642 - DNA, 20 bp, Artificial
  CRISPR gRNA sequence
cctggtgggggccctctgtg

SEQ ID NO: 192643 - DNA, 20 bp, Artificial
  CRISPR gRNA sequence
gtgggggccctctgtggcag

SEQ ID NO: 192644 - DNA, 20 bp, Artificial
  CRISPR gRNA sequence
tgtggcagctgcacctcaca

SEQ ID NO: 192645 - DNA, 20 bp, Artificial
  CRISPR gRNA sequence
tggcagctgcacctcacatt

SEQ ID NO: 192646 - DNA, 20 bp, Artificial
  CRISPR gRNA sequence
cacctcacatttccacttag

SEQ ID NO: 192647 - DNA, 20 bp, Artificial
  CRISPR gRNA sequence
acatttccacttagcatcac

SEQ ID NO: 192648 - DNA, 20 bp, Artificial
  CRISPR gRNA sequence
ccacttagcatcactctagt

SEQ ID NO: 192649 - DNA, 20 bp, Artificial
  CRISPR gRNA sequence
cacttagcatcactctagtg

SEQ ID NO: 192650 - DNA, 20 bp, Artificial
  CRISPR gRNA sequence
agcatcactctagtggaggc

SEQ ID NO: 192651 - DNA, 20 bp, Artificial
  CRISPR gRNA sequence
gcatcactctagtggaggct

SEQ ID NO: 192652 - DNA, 20 bp, Artificial
  CRISPR gRNA sequence
tagtggaggctctctgtggg

SEQ ID NO: 192653 - DNA, 20 bp, Artificial
  CRISPR gRNA sequence
gtggaggctctctgtgggct

SEQ ID NO: 192654 - DNA, 20 bp, Artificial
  CRISPR gRNA sequence
tctgtgggctgggcatgcta

SEQ ID NO: 192655 - DNA, 20 bp, Artificial
  CRISPR gRNA sequence
tgtgggctgggcatgctagc

SEQ ID NO: 192656 - DNA, 20 bp, Artificial
  CRISPR gRNA sequence
tgggctgggcatgctagctc

SEQ ID NO: 192657 - DNA, 20 bp, Artificial
  CRISPR gRNA sequence
ggcatgctagctcagttctc

SEQ ID NO: 192658 - DNA, 20 bp, Artificial
  CRISPR gRNA sequence
gctcagttctcttttcctct

SEQ ID NO: 192659 - DNA, 20 bp, Artificial
  CRISPR gRNA sequence
agttctcttttcctcttctt

SEQ ID NO: 192660 - DNA, 20 bp, Artificial
  CRISPR gRNA sequence
tcttttcctcttcttataaa

SEQ ID NO: 192661 - DNA, 20 bp, Artificial
  CRISPR gRNA sequence
ttttcctcttcttataaagc

SEQ ID NO: 192662 - DNA, 20 bp, Artificial
  CRISPR gRNA sequence
ttcctcttcttataaagcca

SEQ ID NO: 192663 - DNA, 20 bp, Artificial
  CRISPR gRNA sequence
tcctcttcttataaagccac

SEQ ID NO: 192664 - DNA, 20 bp, Artificial
  CRISPR gRNA sequence
cctcttcttataaagccacc

SEQ ID NO: 192665 - DNA, 20 bp, Artificial
  CRISPR gRNA sequence
ctcttcttataaagccacca

SEQ ID NO: 192666 - DNA, 20 bp, Artificial
  CRISPR gRNA sequence
ttcttataaagccaccagtc

SEQ ID NO: 192667 - DNA, 20 bp, Artificial
  CRISPR gRNA sequence
cttataaagccaccagtccc

SEQ ID NO: 192668 - DNA, 20 bp, Artificial
  CRISPR gRNA sequence
ttataaagccaccagtccca

SEQ ID NO: 192669 - DNA, 20 bp, Artificial
  CRISPR gRNA sequence
ataaagccaccagtcccatt

SEQ ID NO: 192670 - DNA, 20 bp, Artificial
  CRISPR gRNA sequence
taaagccaccagtcccattc

SEQ ID NO: 192671 - DNA, 20 bp, Artificial
  CRISPR gRNA sequence
ctgtgataacccattaatcc

SEQ ID NO: 192672 - DNA, 20 bp, Artificial
  CRISPR gRNA sequence
tgataacccattaatccatt

SEQ ID NO: 192673 - DNA, 20 bp, Artificial
  CRISPR gRNA sequence
atccattaacccatgaatga

SEQ ID NO: 192674 - DNA, 20 bp, Artificial
  CRISPR gRNA sequence
acccatgaatgaaggcacag

SEQ ID NO: 192675 - DNA, 20 bp, Artificial
  CRISPR gRNA sequence
acgatccaatcacatctcaa

SEQ ID NO: 192676 - DNA, 20 bp, Artificial
  CRISPR gRNA sequence
cgatccaatcacatctcaaa

SEQ ID NO: 192677 - DNA, 20 bp, Artificial
  CRISPR gRNA sequence
aaaggccccacctttcagta

SEQ ID NO: 192678 - DNA, 20 bp, Artificial
  CRISPR gRNA sequence
tcagtattgccacattaggg

SEQ ID NO: 192679 - DNA, 20 bp, Artificial
  CRISPR gRNA sequence
cagtattgccacattaggga

SEQ ID NO: 192680 - DNA, 20 bp, Artificial
  CRISPR gRNA sequence
agtattgccacattagggat

SEQ ID NO: 192681 - DNA, 20 bp, Artificial
  CRISPR gRNA sequence
ccacattagggattaagtct

SEQ ID NO: 192682 - DNA, 20 bp, Artificial
  CRISPR gRNA sequence
gggattaagtctcaacatga

SEQ ID NO: 192683 - DNA, 20 bp, Artificial
  CRISPR gRNA sequence
agtctcaacatgagtgttgg

SEQ ID NO: 192684 - DNA, 20 bp, Artificial
  CRISPR gRNA sequence
aacatgagtgttggagggaa

SEQ ID NO: 192685 - DNA, 20 bp, Artificial
  CRISPR gRNA sequence
gagggaacattcaaaccaca

SEQ ID NO: 192686 - DNA, 20 bp, Artificial
  CRISPR gRNA sequence
aaaccacagcagtatgaaaa

SEQ ID NO: 192687 - DNA, 20 bp, Artificial
  CRISPR gRNA sequence
aactccaaggtatatggtca

SEQ ID NO: 192688 - DNA, 20 bp, Artificial
  CRISPR gRNA sequence
caaggtatatggtcaagatt

SEQ ID NO: 192689 - DNA, 20 bp, Artificial
  CRISPR gRNA sequence
caggtggtaaggaataggct

SEQ ID NO: 192690 - DNA, 20 bp, Artificial
  CRISPR gRNA sequence
gagaataggaataggctaaa

SEQ ID NO: 192691 - DNA, 20 bp, Artificial
  CRISPR gRNA sequence
aatttgctagagatgtgctg

SEQ ID NO: 192692 - DNA, 20 bp, Artificial
  CRISPR gRNA sequence
gctagagatgtgctgtggaa

SEQ ID NO: 192693 - DNA, 20 bp, Artificial
  CRISPR gRNA sequence
ctagagatgtgctgtggaat

SEQ ID NO: 192694 - DNA, 20 bp, Artificial
  CRISPR gRNA sequence
gagatgtgctgtggaattat

SEQ ID NO: 192695 - DNA, 20 bp, Artificial
  CRISPR gRNA sequence
tggaattatctgtatttcta

SEQ ID NO: 192696 - DNA, 20 bp, Artificial
  CRISPR gRNA sequence
tctgtatttctagctatgat

SEQ ID NO: 192697 - DNA, 20 bp, Artificial
  CRISPR gRNA sequence
tatttctagctatgatctta

SEQ ID NO: 192698 - DNA, 20 bp, Artificial
  CRISPR gRNA sequence
ctagctatgatcttagcttc

SEQ ID NO: 192699 - DNA, 20 bp, Artificial
  CRISPR gRNA sequence
tagctatgatcttagcttcc

SEQ ID NO: 192700 - DNA, 20 bp, Artificial
  CRISPR gRNA sequence
gctatgatcttagcttcctc

SEQ ID NO: 192701 - DNA, 20 bp, Artificial
  CRISPR gRNA sequence
tgatcttagcttcctcaagt

SEQ ID NO: 192702 - DNA, 20 bp, Artificial
  CRISPR gRNA sequence
agcttcctcaagtccatttc

SEQ ID NO: 192703 - DNA, 20 bp, Artificial
  CRISPR gRNA sequence
gcttcctcaagtccatttca

SEQ ID NO: 192704 - DNA, 20 bp, Artificial
  CRISPR gRNA sequence
cctcaagtccatttcattgc

SEQ ID NO: 192705 - DNA, 20 bp, Artificial
  CRISPR gRNA sequence
ctcaagtccatttcattgca

SEQ ID NO: 192706 - DNA, 20 bp, Artificial
  CRISPR gRNA sequence
aagtccatttcattgcaaga

SEQ ID NO: 192707 - DNA, 20 bp, Artificial
  CRISPR gRNA sequence
cattgcaagaatatgaaaaa

SEQ ID NO: 192708 - DNA, 20 bp, Artificial
  CRISPR gRNA sequence
attgcaagaatatgaaaaat

SEQ ID NO: 192709 - DNA, 20 bp, Artificial
  CRISPR gRNA sequence
caagaatatgaaaaattaaa

SEQ ID NO: 192710 - DNA, 20 bp, Artificial
  CRISPR gRNA sequence
aattgagatccaggttcttt

SEQ ID NO: 192711 - DNA, 20 bp, Artificial
  CRISPR gRNA sequence
agatccaggttcttttttta

SEQ ID NO: 192712 - DNA, 20 bp, Artificial
  CRISPR gRNA sequence
tttttttatttttcaatttt

SEQ ID NO: 192713 - DNA, 20 bp, Artificial
  CRISPR gRNA sequence
tttttatttttcaattttta

SEQ ID NO: 192714 - DNA, 20 bp, Artificial
  CRISPR gRNA sequence
ttttatttttcaatttttat

SEQ ID NO: 192715 - DNA, 20 bp, Artificial
  CRISPR gRNA sequence
tttatttttcaatttttatt

SEQ ID NO: 192716 - DNA, 20 bp, Artificial
  CRISPR gRNA sequence
ttatttttcaatttttattt

SEQ ID NO: 192717 - DNA, 20 bp, Artificial
  CRISPR gRNA sequence
tatttttcaatttttatttt

SEQ ID NO: 192718 - DNA, 20 bp, Artificial
  CRISPR gRNA sequence
atttttcaatttttattttt

SEQ ID NO: 192719 - DNA, 20 bp, Artificial
  CRISPR gRNA sequence
tttttcaatttttatttttt

SEQ ID NO: 192720 - DNA, 20 bp, Artificial
  CRISPR gRNA sequence
ttcaatttttattttttgag

SEQ ID NO: 192721 - DNA, 20 bp, Artificial
  CRISPR gRNA sequence
tcaatttttattttttgaga

SEQ ID NO: 192722 - DNA, 20 bp, Artificial
  CRISPR gRNA sequence
caatttttattttttgagat

SEQ ID NO: 192723 - DNA, 20 bp, Artificial
  CRISPR gRNA sequence
aatttttattttttgagatg

SEQ ID NO: 192724 - DNA, 20 bp, Artificial
  CRISPR gRNA sequence
ttattttttgagatggcgtt

SEQ ID NO: 192725 - DNA, 20 bp, Artificial
  CRISPR gRNA sequence
tattttttgagatggcgttt

SEQ ID NO: 192726 - DNA, 20 bp, Artificial
  CRISPR gRNA sequence
attttttgagatggcgtttc

SEQ ID NO: 192727 - DNA, 20 bp, Artificial
  CRISPR gRNA sequence
ttttttgagatggcgtttca

SEQ ID NO: 192728 - DNA, 20 bp, Artificial
  CRISPR gRNA sequence
tttgagatggcgtttcaccc

SEQ ID NO: 192729 - DNA, 20 bp, Artificial
  CRISPR gRNA sequence
ttgagatggcgtttcaccct

SEQ ID NO: 192730 - DNA, 20 bp, Artificial
  CRISPR gRNA sequence
tgagatggcgtttcaccctg

SEQ ID NO: 192731 - DNA, 20 bp, Artificial
  CRISPR gRNA sequence
gagatggcgtttcaccctgt

SEQ ID NO: 192732 - DNA, 20 bp, Artificial
  CRISPR gRNA sequence
agatggcgtttcaccctgtc

SEQ ID NO: 192733 - DNA, 20 bp, Artificial
  CRISPR gRNA sequence
caccctgtcacccaggctgg

SEQ ID NO: 192734 - DNA, 20 bp, Artificial
  CRISPR gRNA sequence
accctgtcacccaggctgga

SEQ ID NO: 192735 - DNA, 20 bp, Artificial
  CRISPR gRNA sequence
tcacccaggctggagtgcag

SEQ ID NO: 192736 - DNA, 20 bp, Artificial
  CRISPR gRNA sequence
gagtgcagtcgcacaatcct

SEQ ID NO: 192737 - DNA, 20 bp, Artificial
  CRISPR gRNA sequence
gctcactgcaacctccgcct

SEQ ID NO: 192738 - DNA, 20 bp, Artificial
  CRISPR gRNA sequence
actgcaacctccgcctcccg

SEQ ID NO: 192739 - DNA, 20 bp, Artificial
  CRISPR gRNA sequence
caacctccgcctcccgggtt

SEQ ID NO: 192740 - DNA, 20 bp, Artificial
  CRISPR gRNA sequence
cgcctcccgggttgacgcca

SEQ ID NO: 192741 - DNA, 20 bp, Artificial
  CRISPR gRNA sequence
ccgggttgacgccattctcc

SEQ ID NO: 192742 - DNA, 20 bp, Artificial
  CRISPR gRNA sequence
acgccattctcctgcctccg

SEQ ID NO: 192743 - DNA, 20 bp, Artificial
  CRISPR gRNA sequence
tcctgcctccgcctcctgag

SEQ ID NO: 192744 - DNA, 20 bp, Artificial
  CRISPR gRNA sequence
ctgcctccgcctcctgagta

SEQ ID NO: 192745 - DNA, 20 bp, Artificial
  CRISPR gRNA sequence
cctccgcctcctgagtagct

SEQ ID NO: 192746 - DNA, 20 bp, Artificial
  CRISPR gRNA sequence
cgcctcctgagtagctggga

SEQ ID NO: 192747 - DNA, 20 bp, Artificial
  CRISPR gRNA sequence
ctgagtagctgggactacag

SEQ ID NO: 192748 - DNA, 20 bp, Artificial
  CRISPR gRNA sequence
agtagctgggactacaggcc

SEQ ID NO: 192749 - DNA, 20 bp, Artificial
  CRISPR gRNA sequence
ggactacaggcccgtgcctc

SEQ ID NO: 192750 - DNA, 20 bp, Artificial
  CRISPR gRNA sequence
caggcccgtgcctctgcgcc

SEQ ID NO: 192751 - DNA, 20 bp, Artificial
  CRISPR gRNA sequence
tgcgcccagctaattttttg

SEQ ID NO: 192752 - DNA, 20 bp, Artificial
  CRISPR gRNA sequence
cgcccagctaattttttgta

SEQ ID NO: 192753 - DNA, 20 bp, Artificial
  CRISPR gRNA sequence
attttttgtattttttagta

SEQ ID NO: 192754 - DNA, 20 bp, Artificial
  CRISPR gRNA sequence
tttgtattttttagtagaga

SEQ ID NO: 192755 - DNA, 20 bp, Artificial
  CRISPR gRNA sequence
ttgtattttttagtagagac

SEQ ID NO: 192756 - DNA, 20 bp, Artificial
  CRISPR gRNA sequence
tgtattttttagtagagacg

SEQ ID NO: 192757 - DNA, 20 bp, Artificial
  CRISPR gRNA sequence
gtattttttagtagagacgg

SEQ ID NO: 192758 - DNA, 20 bp, Artificial
  CRISPR gRNA sequence
tattttttagtagagacggg

SEQ ID NO: 192759 - DNA, 20 bp, Artificial
  CRISPR gRNA sequence
tttagtagagacggggtttc

SEQ ID NO: 192760 - DNA, 20 bp, Artificial
  CRISPR gRNA sequence
ttagtagagacggggtttca

SEQ ID NO: 192761 - DNA, 20 bp, Artificial
  CRISPR gRNA sequence
tagtagagacggggtttcac

SEQ ID NO: 192762 - DNA, 20 bp, Artificial
  CRISPR gRNA sequence
agtagagacggggtttcacc

SEQ ID NO: 192763 - DNA, 20 bp, Artificial
  CRISPR gRNA sequence
gtagagacggggtttcaccg

SEQ ID NO: 192764 - DNA, 20 bp, Artificial
  CRISPR gRNA sequence
caccgtgttagccaggatgg

SEQ ID NO: 192765 - DNA, 20 bp, Artificial
  CRISPR gRNA sequence
accgtgttagccaggatggt

SEQ ID NO: 192766 - DNA, 20 bp, Artificial
  CRISPR gRNA sequence
gccaggatggtttcgatctc

SEQ ID NO: 192767 - DNA, 20 bp, Artificial
  CRISPR gRNA sequence
cgatctcctgacctcgtgat

SEQ ID NO: 192768 - DNA, 20 bp, Artificial
  CRISPR gRNA sequence
gatctcctgacctcgtgatc

SEQ ID NO: 192769 - DNA, 20 bp, Artificial
  CRISPR gRNA sequence
ctgacctcgtgatctgccct

SEQ ID NO: 192770 - DNA, 20 bp, Artificial
  CRISPR gRNA sequence
acctcgtgatctgccctcct

SEQ ID NO: 192771 - DNA, 20 bp, Artificial
  CRISPR gRNA sequence
gtgatctgccctcctcggcc

SEQ ID NO: 192772 - DNA, 20 bp, Artificial
  CRISPR gRNA sequence
ccctcctcggcctccctaag

SEQ ID NO: 192773 - DNA, 20 bp, Artificial
  CRISPR gRNA sequence
ctcggcctccctaagtgctg

SEQ ID NO: 192774 - DNA, 20 bp, Artificial
  CRISPR gRNA sequence
ggcctccctaagtgctggga

SEQ ID NO: 192775 - DNA, 20 bp, Artificial
  CRISPR gRNA sequence
cctaagtgctgggattacag

SEQ ID NO: 192776 - DNA, 20 bp, Artificial
  CRISPR gRNA sequence
agtgctgggattacaggcat

SEQ ID NO: 192777 - DNA, 20 bp, Artificial
  CRISPR gRNA sequence
ggattacaggcatgagctgc

SEQ ID NO: 192778 - DNA, 20 bp, Artificial
  CRISPR gRNA sequence
caggcatgagctgccgcact

SEQ ID NO: 192779 - DNA, 20 bp, Artificial
  CRISPR gRNA sequence
ccgcactctgcccaggttct

SEQ ID NO: 192780 - DNA, 20 bp, Artificial
  CRISPR gRNA sequence
tgcccaggttcttattttta

SEQ ID NO: 192781 - DNA, 20 bp, Artificial
  CRISPR gRNA sequence
cccaggttcttatttttaat

SEQ ID NO: 192782 - DNA, 20 bp, Artificial
  CRISPR gRNA sequence
ttatttttaatagaaaagag

SEQ ID NO: 192783 - DNA, 20 bp, Artificial
  CRISPR gRNA sequence
atttttaatagaaaagagaa

SEQ ID NO: 192784 - DNA, 20 bp, Artificial
  CRISPR gRNA sequence
tttttaatagaaaagagaac

SEQ ID NO: 192785 - DNA, 20 bp, Artificial
  CRISPR gRNA sequence
ttaatagaaaagagaacagg

SEQ ID NO: 192786 - DNA, 20 bp, Artificial
  CRISPR gRNA sequence
taatagaaaagagaacaggg

SEQ ID NO: 192787 - DNA, 20 bp, Artificial
  CRISPR gRNA sequence
aatagaaaagagaacaggga

SEQ ID NO: 192788 - DNA, 20 bp, Artificial
  CRISPR gRNA sequence
atagaaaagagaacagggaa

SEQ ID NO: 192789 - DNA, 20 bp, Artificial
  CRISPR gRNA sequence
tttctctacctcctcacatt

SEQ ID NO: 192790 - DNA, 20 bp, Artificial
  CRISPR gRNA sequence
ctctacctcctcacattgtg

SEQ ID NO: 192791 - DNA, 20 bp, Artificial
  CRISPR gRNA sequence
tctacctcctcacattgtgc

SEQ ID NO: 192792 - DNA, 20 bp, Artificial
  CRISPR gRNA sequence
tacctcctcacattgtgcta

SEQ ID NO: 192793 - DNA, 20 bp, Artificial
  CRISPR gRNA sequence
cctcctcacattgtgctaac

SEQ ID NO: 192794 - DNA, 20 bp, Artificial
  CRISPR gRNA sequence
ctcacattgtgctaacaggg

SEQ ID NO: 192795 - DNA, 20 bp, Artificial
  CRISPR gRNA sequence
acattgtgctaacagggaca

SEQ ID NO: 192796 - DNA, 20 bp, Artificial
  CRISPR gRNA sequence
tgctaacagggacacagaca

SEQ ID NO: 192797 - DNA, 20 bp, Artificial
  CRISPR gRNA sequence
acagggacacagacagattc

SEQ ID NO: 192798 - DNA, 20 bp, Artificial
  CRISPR gRNA sequence
agaggcccttgcaaaaagag

SEQ ID NO: 192799 - DNA, 20 bp, Artificial
  CRISPR gRNA sequence
gcaaaaagagaagccagagt

SEQ ID NO: 192800 - DNA, 20 bp, Artificial
  CRISPR gRNA sequence
caaaaagagaagccagagtc

SEQ ID NO: 192801 - DNA, 20 bp, Artificial
  CRISPR gRNA sequence
agacacataggggaggcgtg

SEQ ID NO: 192802 - DNA, 20 bp, Artificial
  CRISPR gRNA sequence
catctcagtcgcacacaagg

SEQ ID NO: 192803 - DNA, 20 bp, Artificial
  CRISPR gRNA sequence
agtcgcacacaaggcagctg

SEQ ID NO: 192804 - DNA, 20 bp, Artificial
  CRISPR gRNA sequence
tgcatctcagtcgcacacaa

SEQ ID NO: 192805 - DNA, 20 bp, Artificial
  CRISPR gRNA sequence
agtcgcacacaaggcagctg

SEQ ID NO: 192806 - DNA, 20 bp, Artificial
  CRISPR gRNA sequence
tctcaggctacagaagaaaa

SEQ ID NO: 192807 - DNA, 20 bp, Artificial
  CRISPR gRNA sequence
aggctacagaagaaaatagt

SEQ ID NO: 192808 - DNA, 20 bp, Artificial
  CRISPR gRNA sequence
cagaagaaaatagtcatgaa

SEQ ID NO: 192809 - DNA, 20 bp, Artificial
  CRISPR gRNA sequence
aggtcagtcacggtaagtga

SEQ ID NO: 192810 - DNA, 20 bp, Artificial
  CRISPR gRNA sequence
tgaacagcccaccacacact

SEQ ID NO: 192811 - DNA, 20 bp, Artificial
  CRISPR gRNA sequence
aacagcccaccacacactca

SEQ ID NO: 192812 - DNA, 20 bp, Artificial
  CRISPR gRNA sequence
aaaaattctgaatcaaaaaa

SEQ ID NO: 192813 - DNA, 20 bp, Artificial
  CRISPR gRNA sequence
tgaatcaaaaaatccccaca

SEQ ID NO: 192814 - DNA, 20 bp, Artificial
  CRISPR gRNA sequence
aatcaaaaaatccccacaac

SEQ ID NO: 192815 - DNA, 20 bp, Artificial
  CRISPR gRNA sequence
tcccctctgccccaccctcc

SEQ ID NO: 192816 - DNA, 20 bp, Artificial
  CRISPR gRNA sequence
tgccccaccctccacccact

SEQ ID NO: 192817 - DNA, 20 bp, Artificial
  CRISPR gRNA sequence
ccccaccctccacccacttc

SEQ ID NO: 192818 - DNA, 20 bp, Artificial
  CRISPR gRNA sequence
cacccacttcagacccccag

SEQ ID NO: 192819 - DNA, 20 bp, Artificial
  CRISPR gRNA sequence
cagacccccagaatctcacc

SEQ ID NO: 192820 - DNA, 20 bp, Artificial
  CRISPR gRNA sequence
agacccccagaatctcacct

SEQ ID NO: 192821 - DNA, 20 bp, Artificial
  CRISPR gRNA sequence
acctttacaagctgtgagac

SEQ ID NO: 192822 - DNA, 20 bp, Artificial
  CRISPR gRNA sequence
tacaagctgtgagactcaga

SEQ ID NO: 192823 - DNA, 20 bp, Artificial
  CRISPR gRNA sequence
acaagctgtgagactcagac

SEQ ID NO: 192824 - DNA, 20 bp, Artificial
  CRISPR gRNA sequence
caagctgtgagactcagacc

SEQ ID NO: 192825 - DNA, 20 bp, Artificial
  CRISPR gRNA sequence
tgagactcagacccctgggc

SEQ ID NO: 192826 - DNA, 20 bp, Artificial
  CRISPR gRNA sequence
agacccctgggcactgtcgc

SEQ ID NO: 192827 - DNA, 20 bp, Artificial
  CRISPR gRNA sequence
ggcactgtcgctccctgggg

SEQ ID NO: 192828 - DNA, 20 bp, Artificial
  CRISPR gRNA sequence
tcgctccctggggtagaaca

SEQ ID NO: 192829 - DNA, 20 bp, Artificial
  CRISPR gRNA sequence
cctggggtagaacaaaaaca

SEQ ID NO: 192830 - DNA, 20 bp, Artificial
  CRISPR gRNA sequence
gggtagaacaaaaacaagac

SEQ ID NO: 192831 - DNA, 20 bp, Artificial
  CRISPR gRNA sequence
gtcagagcccacaggagatg

SEQ ID NO: 192832 - DNA, 20 bp, Artificial
  CRISPR gRNA sequence
tagggtgggcgagctcctcc

SEQ ID NO: 192833 - DNA, 20 bp, Artificial
  CRISPR gRNA sequence
ctccacgctcccgccccgca

SEQ ID NO: 192834 - DNA, 20 bp, Artificial
  CRISPR gRNA sequence
cacgctcccgccccgcactt

SEQ ID NO: 192835 - DNA, 20 bp, Artificial
  CRISPR gRNA sequence
ccgccccgcacttacactca

SEQ ID NO: 192836 - DNA, 20 bp, Artificial
  CRISPR gRNA sequence
acactcagccttagagtagc

SEQ ID NO: 192837 - DNA, 20 bp, Artificial
  CRISPR gRNA sequence
cactcagccttagagtagct

SEQ ID NO: 192838 - DNA, 20 bp, Artificial
  CRISPR gRNA sequence
agccttagagtagctccctc

SEQ ID NO: 192839 - DNA, 20 bp, Artificial
  CRISPR gRNA sequence
agagtagctccctccttttc

SEQ ID NO: 192840 - DNA, 20 bp, Artificial
  CRISPR gRNA sequence
gagtagctccctccttttcc

SEQ ID NO: 192841 - DNA, 20 bp, Artificial
  CRISPR gRNA sequence
cctccttttccacctgttgg

SEQ ID NO: 192842 - DNA, 20 bp, Artificial
  CRISPR gRNA sequence
cttttccacctgttggaaga

SEQ ID NO: 192843 - DNA, 20 bp, Artificial
  CRISPR gRNA sequence
ttccacctgttggaagaaaa

SEQ ID NO: 192844 - DNA, 20 bp, Artificial
  CRISPR gRNA sequence
tccacctgttggaagaaaat

SEQ ID NO: 192845 - DNA, 20 bp, Artificial
  CRISPR gRNA sequence
ccacctgttggaagaaaatg

SEQ ID NO: 192846 - DNA, 20 bp, Artificial
  CRISPR gRNA sequence
cacctgttggaagaaaatgt

SEQ ID NO: 192847 - DNA, 20 bp, Artificial
  CRISPR gRNA sequence
ttggaagaaaatgtcctgtg

SEQ ID NO: 192848 - DNA, 20 bp, Artificial
  CRISPR gRNA sequence
gaagaaaatgtcctgtgagg

SEQ ID NO: 192849 - DNA, 20 bp, Artificial
  CRISPR gRNA sequence
tgaggggccagggaggaggc

SEQ ID NO: 192850 - DNA, 20 bp, Artificial
  CRISPR gRNA sequence
gaggaacctcctagttttgg

SEQ ID NO: 192851 - DNA, 20 bp, Artificial
  CRISPR gRNA sequence
ctagttttggatcccagaga

SEQ ID NO: 192852 - DNA, 20 bp, Artificial
  CRISPR gRNA sequence
gttttggatcccagagaagt

SEQ ID NO: 192853 - DNA, 20 bp, Artificial
  CRISPR gRNA sequence
tggatcccagagaagtttcc

SEQ ID NO: 192854 - DNA, 20 bp, Artificial
  CRISPR gRNA sequence
ggatcccagagaagtttcct

SEQ ID NO: 192855 - DNA, 20 bp, Artificial
  CRISPR gRNA sequence
gatcccagagaagtttcctg

SEQ ID NO: 192856 - DNA, 20 bp, Artificial
  CRISPR gRNA sequence
cctgaactgtgactgcagac

SEQ ID NO: 192857 - DNA, 20 bp, Artificial
  CRISPR gRNA sequence
ctgaactgtgactgcagacc

SEQ ID NO: 192858 - DNA, 20 bp, Artificial
  CRISPR gRNA sequence
aactgtgactgcagacccag

SEQ ID NO: 192859 - DNA, 20 bp, Artificial
  CRISPR gRNA sequence
tgactgcagacccagggcag

SEQ ID NO: 192860 - DNA, 20 bp, Artificial
  CRISPR gRNA sequence
cagacccagggcaggatcag

SEQ ID NO: 192861 - DNA, 20 bp, Artificial
  CRISPR gRNA sequence
gatcaactgcccttctgagg

SEQ ID NO: 192862 - DNA, 20 bp, Artificial
  CRISPR gRNA sequence
cccttctgaggtctgtcttc

SEQ ID NO: 192863 - DNA, 20 bp, Artificial
  CRISPR gRNA sequence
ctgaggtctgtcttcagcag

SEQ ID NO: 192864 - DNA, 20 bp, Artificial
  CRISPR gRNA sequence
tgaggtctgtcttcagcagg

SEQ ID NO: 192865 - DNA, 20 bp, Artificial
  CRISPR gRNA sequence
aggtctgtcttcagcaggga

SEQ ID NO: 192866 - DNA, 20 bp, Artificial
  CRISPR gRNA sequence
tcttcagcagggaccttccc

SEQ ID NO: 192867 - DNA, 20 bp, Artificial
  CRISPR gRNA sequence
cagcagggaccttcccctgt

SEQ ID NO: 192868 - DNA, 20 bp, Artificial
  CRISPR gRNA sequence
agcagggaccttcccctgtg

SEQ ID NO: 192869 - DNA, 20 bp, Artificial
  CRISPR gRNA sequence
cccctgtgacctgtgactgc

SEQ ID NO: 192870 - DNA, 20 bp, Artificial
  CRISPR gRNA sequence
ccctgtgacctgtgactgct

SEQ ID NO: 192871 - DNA, 20 bp, Artificial
  CRISPR gRNA sequence
tgacctgtgactgctgggat

SEQ ID NO: 192872 - DNA, 20 bp, Artificial
  CRISPR gRNA sequence
tgactgctgggatcaggtcc

SEQ ID NO: 192873 - DNA, 20 bp, Artificial
  CRISPR gRNA sequence
ctgggatcaggtccccatca

SEQ ID NO: 192874 - DNA, 20 bp, Artificial
  CRISPR gRNA sequence
ggatcaggtccccatcacca

SEQ ID NO: 192875 - DNA, 20 bp, Artificial
  CRISPR gRNA sequence
tccttcattgtcacaggtgc

SEQ ID NO: 192876 - DNA, 20 bp, Artificial
  CRISPR gRNA sequence
cattgtcacaggtgctttac

SEQ ID NO: 192877 - DNA, 20 bp, Artificial
  CRISPR gRNA sequence
attgtcacaggtgctttaca

SEQ ID NO: 192878 - DNA, 20 bp, Artificial
  CRISPR gRNA sequence
tcacaggtgctttacaaaag

SEQ ID NO: 192879 - DNA, 20 bp, Artificial
  CRISPR gRNA sequence
tacaaaagagtaggtgcggc

SEQ ID NO: 192880 - DNA, 20 bp, Artificial
  CRISPR gRNA sequence
acaaaagagtaggtgcggct

SEQ ID NO: 192881 - DNA, 20 bp, Artificial
  CRISPR gRNA sequence
caaaagagtaggtgcggctg

SEQ ID NO: 192882 - DNA, 20 bp, Artificial
  CRISPR gRNA sequence
ggtgcggtggctcacgactg

SEQ ID NO: 192883 - DNA, 20 bp, Artificial
  CRISPR gRNA sequence
acgactgtaatcccagcact

SEQ ID NO: 192884 - DNA, 20 bp, Artificial
  CRISPR gRNA sequence
taatcccagcactttgggag

SEQ ID NO: 192885 - DNA, 20 bp, Artificial
  CRISPR gRNA sequence
tgggaggccgaggcaggcag

SEQ ID NO: 192886 - DNA, 20 bp, Artificial
  CRISPR gRNA sequence
gggaggccgaggcaggcaga

SEQ ID NO: 192887 - DNA, 20 bp, Artificial
  CRISPR gRNA sequence
ggaggccgaggcaggcagat

SEQ ID NO: 192888 - DNA, 20 bp, Artificial
  CRISPR gRNA sequence
gagaccagcctggccaacat

SEQ ID NO: 192889 - DNA, 20 bp, Artificial
  CRISPR gRNA sequence
gccaacatagtgaaacccca

SEQ ID NO: 192890 - DNA, 20 bp, Artificial
  CRISPR gRNA sequence
cactaaaaatacaaaaaaaa

SEQ ID NO: 192891 - DNA, 20 bp, Artificial
  CRISPR gRNA sequence
aaaatacaaaaaaaaaaatt

SEQ ID NO: 192892 - DNA, 20 bp, Artificial
  CRISPR gRNA sequence
gccaggtgtggtggcacgca

SEQ ID NO: 192893 - DNA, 20 bp, Artificial
  CRISPR gRNA sequence
ctagggaggctgaggcagga

SEQ ID NO: 192894 - DNA, 20 bp, Artificial
  CRISPR gRNA sequence
gggaggctgaggcaggagaa

SEQ ID NO: 192895 - DNA, 20 bp, Artificial
  CRISPR gRNA sequence
aggcaggagaattgcttgaa

SEQ ID NO: 192896 - DNA, 20 bp, Artificial
  CRISPR gRNA sequence
cttgaacctgggaggcggag

SEQ ID NO: 192897 - DNA, 20 bp, Artificial
  CRISPR gRNA sequence
gaacctgggaggcggaggtt

SEQ ID NO: 192898 - DNA, 20 bp, Artificial
  CRISPR gRNA sequence
aacctgggaggcggaggttg

SEQ ID NO: 192899 - DNA, 20 bp, Artificial
  CRISPR gRNA sequence
ggaggcggaggttgcagtga

SEQ ID NO: 192900 - DNA, 20 bp, Artificial
  CRISPR gRNA sequence
cagtgagctgaaaccacgcc

SEQ ID NO: 192901 - DNA, 20 bp, Artificial
  CRISPR gRNA sequence
aaaccacgccattgcactcc

SEQ ID NO: 192902 - DNA, 20 bp, Artificial
  CRISPR gRNA sequence
cactccagcctgggtgacag

SEQ ID NO: 192903 - DNA, 20 bp, Artificial
  CRISPR gRNA sequence
cagcctgggtgacagagcca

SEQ ID NO: 192904 - DNA, 20 bp, Artificial
  CRISPR gRNA sequence
ggtgacagagccaagactcc

SEQ ID NO: 192905 - DNA, 20 bp, Artificial
  CRISPR gRNA sequence
cgtctcaaaaaaaaagagta

SEQ ID NO: 192906 - DNA, 20 bp, Artificial
  CRISPR gRNA sequence
aaaaaaaaagagtaggtgct

SEQ ID NO: 192907 - DNA, 20 bp, Artificial
  CRISPR gRNA sequence
gcacacagggccccaggctg

SEQ ID NO: 192908 - DNA, 20 bp, Artificial
  CRISPR gRNA sequence
ggtaggctcgtgtgtgtgga

SEQ ID NO: 192909 - DNA, 20 bp, Artificial
  CRISPR gRNA sequence
gtgtgtgtggatggtgcttc

SEQ ID NO: 192910 - DNA, 20 bp, Artificial
  CRISPR gRNA sequence
cccagtaacgaggcaggaca

SEQ ID NO: 192911 - DNA, 20 bp, Artificial
  CRISPR gRNA sequence
ccagtaacgaggcaggacac

SEQ ID NO: 192912 - DNA, 20 bp, Artificial
  CRISPR gRNA sequence
ttacctagggcttgaaacac

SEQ ID NO: 192913 - DNA, 20 bp, Artificial
  CRISPR gRNA sequence
tacctagggcttgaaacacc

SEQ ID NO: 192914 - DNA, 20 bp, Artificial
  CRISPR gRNA sequence
acctagggcttgaaacaccc

SEQ ID NO: 192915 - DNA, 20 bp, Artificial
  CRISPR gRNA sequence
cctagggcttgaaacaccca

SEQ ID NO: 192916 - DNA, 20 bp, Artificial
  CRISPR gRNA sequence
gggcttgaaacacccagtgg

SEQ ID NO: 192917 - DNA, 20 bp, Artificial
  CRISPR gRNA sequence
gaaacacccagtgggacaag

SEQ ID NO: 192918 - DNA, 20 bp, Artificial
  CRISPR gRNA sequence
aaacacccagtgggacaaga

SEQ ID NO: 192919 - DNA, 20 bp, Artificial
  CRISPR gRNA sequence
agaccccacccttctccctt

SEQ ID NO: 192920 - DNA, 20 bp, Artificial
  CRISPR gRNA sequence
ctcccttccccacctgagct

SEQ ID NO: 192921 - DNA, 20 bp, Artificial
  CRISPR gRNA sequence
tcccttccccacctgagctc

SEQ ID NO: 192922 - DNA, 20 bp, Artificial
  CRISPR gRNA sequence
ccttccccacctgagctctt

SEQ ID NO: 192923 - DNA, 20 bp, Artificial
  CRISPR gRNA sequence
ccccacctgagctcttcttc

SEQ ID NO: 192924 - DNA, 20 bp, Artificial
  CRISPR gRNA sequence
cccacctgagctcttcttcc

SEQ ID NO: 192925 - DNA, 20 bp, Artificial
  CRISPR gRNA sequence
agctcttcttcctccatatc

SEQ ID NO: 192926 - DNA, 20 bp, Artificial
  CRISPR gRNA sequence
ttcttcctccatatcacagc

SEQ ID NO: 192927 - DNA, 20 bp, Artificial
  CRISPR gRNA sequence
cttcctccatatcacagcag

SEQ ID NO: 192928 - DNA, 20 bp, Artificial
  CRISPR gRNA sequence
ttcctccatatcacagcagc

SEQ ID NO: 192929 - DNA, 20 bp, Artificial
  CRISPR gRNA sequence
cctccatatcacagcagcaa

SEQ ID NO: 192930 - DNA, 20 bp, Artificial
  CRISPR gRNA sequence
ctccatatcacagcagcaac

SEQ ID NO: 192931 - DNA, 20 bp, Artificial
  CRISPR gRNA sequence
catatcacagcagcaaccac

SEQ ID NO: 192932 - DNA, 20 bp, Artificial
  CRISPR gRNA sequence
cagagaccacagatccaagg

SEQ ID NO: 192933 - DNA, 20 bp, Artificial
  CRISPR gRNA sequence
ggaagccggctctgggaaaa

SEQ ID NO: 192934 - DNA, 20 bp, Artificial
  CRISPR gRNA sequence
tgggaaaagaggggaacgta

SEQ ID NO: 192935 - DNA, 20 bp, Artificial
  CRISPR gRNA sequence
ggaaaagaggggaacgtaag

SEQ ID NO: 192936 - DNA, 20 bp, Artificial
  CRISPR gRNA sequence
acccccaggcctcagccctg

SEQ ID NO: 192937 - DNA, 20 bp, Artificial
  CRISPR gRNA sequence
agccctgaccctgcggaagg

SEQ ID NO: 192938 - DNA, 20 bp, Artificial
  CRISPR gRNA sequence
accctgcggaagggctccag

SEQ ID NO: 192939 - DNA, 20 bp, Artificial
  CRISPR gRNA sequence
cggaagggctccagaagggc

SEQ ID NO: 192940 - DNA, 20 bp, Artificial
  CRISPR gRNA sequence
cagaagggctcccgctttcc

SEQ ID NO: 192941 - DNA, 20 bp, Artificial
  CRISPR gRNA sequence
ccgctttccctgagaagaga

SEQ ID NO: 192942 - DNA, 20 bp, Artificial
  CRISPR gRNA sequence
tccctgagaagagacatgac

SEQ ID NO: 192943 - DNA, 20 bp, Artificial
  CRISPR gRNA sequence
ccctgagaagagacatgacc

SEQ ID NO: 192944 - DNA, 20 bp, Artificial
  CRISPR gRNA sequence
cctgagaagagacatgacct

SEQ ID NO: 192945 - DNA, 20 bp, Artificial
  CRISPR gRNA sequence
agaagagacatgacctccca

SEQ ID NO: 192946 - DNA, 20 bp, Artificial
  CRISPR gRNA sequence
ccatccccctccttactcca

SEQ ID NO: 192947 - DNA, 20 bp, Artificial
  CRISPR gRNA sequence
cttactccatctcagggtga

SEQ ID NO: 192948 - DNA, 20 bp, Artificial
  CRISPR gRNA sequence
actccatctcagggtgacgg

SEQ ID NO: 192949 - DNA, 20 bp, Artificial
  CRISPR gRNA sequence
ctccatctcagggtgacggg

SEQ ID NO: 192950 - DNA, 20 bp, Artificial
  CRISPR gRNA sequence
catctcagggtgacgggctc

SEQ ID NO: 192951 - DNA, 20 bp, Artificial
  CRISPR gRNA sequence
agggtgacgggctcgggtag

SEQ ID NO: 192952 - DNA, 20 bp, Artificial
  CRISPR gRNA sequence
gggtagcccctcatgctgca

SEQ ID NO: 192953 - DNA, 20 bp, Artificial
  CRISPR gRNA sequence
atgctgcacatggcacgtgt

SEQ ID NO: 192954 - DNA, 20 bp, Artificial
  CRISPR gRNA sequence
cacatggcacgtgtatctct

SEQ ID NO: 192955 - DNA, 20 bp, Artificial
  CRISPR gRNA sequence
tgctcctctccagaaggcac

SEQ ID NO: 192956 - DNA, 20 bp, Artificial
  CRISPR gRNA sequence
ctcctctccagaaggcacca

SEQ ID NO: 192957 - DNA, 20 bp, Artificial
  CRISPR gRNA sequence
ctctccagaaggcaccacca

SEQ ID NO: 192958 - DNA, 20 bp, Artificial
  CRISPR gRNA sequence
tccagaaggcaccaccacag

SEQ ID NO: 192959 - DNA, 20 bp, Artificial
  CRISPR gRNA sequence
cagaaggcaccaccacagct

SEQ ID NO: 192960 - DNA, 20 bp, Artificial
  CRISPR gRNA sequence
cccacttctggaaggttcca

SEQ ID NO: 192961 - DNA, 20 bp, Artificial
  CRISPR gRNA sequence
ctggaaggttccatcccctg

SEQ ID NO: 192962 - DNA, 20 bp, Artificial
  CRISPR gRNA sequence
tggaaggttccatcccctgc

SEQ ID NO: 192963 - DNA, 20 bp, Artificial
  CRISPR gRNA sequence
gaaggttccatcccctgcag

SEQ ID NO: 192964 - DNA, 20 bp, Artificial
  CRISPR gRNA sequence
catcccctgcaggcctggtc

SEQ ID NO: 192965 - DNA, 20 bp, Artificial
  CRISPR gRNA sequence
caggcctggtctccacgagc

SEQ ID NO: 192966 - DNA, 20 bp, Artificial
  CRISPR gRNA sequence
gtctccacgagctccgtgtc

SEQ ID NO: 192967 - DNA, 20 bp, Artificial
  CRISPR gRNA sequence
cacgagctccgtgtcctggg

SEQ ID NO: 192968 - DNA, 20 bp, Artificial
  CRISPR gRNA sequence
cgtgtcctgggtatggccct

SEQ ID NO: 192969 - DNA, 20 bp, Artificial
  CRISPR gRNA sequence
ggtatggccctccccatcct

SEQ ID NO: 192970 - DNA, 20 bp, Artificial
  CRISPR gRNA sequence
cccatcctgctgccaggtca

SEQ ID NO: 192971 - DNA, 20 bp, Artificial
  CRISPR gRNA sequence
ctgccaggtcagtgtgatct

SEQ ID NO: 192972 - DNA, 20 bp, Artificial
  CRISPR gRNA sequence
ccaggtcagtgtgatctccg

SEQ ID NO: 192973 - DNA, 20 bp, Artificial
  CRISPR gRNA sequence
cgcagggtagaagcccaggg

SEQ ID NO: 192974 - DNA, 20 bp, Artificial
  CRISPR gRNA sequence
agggtggcctcatggtcaga

SEQ ID NO: 192975 - DNA, 20 bp, Artificial
  CRISPR gRNA sequence
atggtcagagatggggtggt

SEQ ID NO: 192976 - DNA, 20 bp, Artificial
  CRISPR gRNA sequence
tgggggctctgaggggaaga

SEQ ID NO: 192977 - DNA, 20 bp, Artificial
  CRISPR gRNA sequence
gggggctctgaggggaagag

SEQ ID NO: 192978 - DNA, 20 bp, Artificial
  CRISPR gRNA sequence
ggggctctgaggggaagagt

SEQ ID NO: 192979 - DNA, 20 bp, Artificial
  CRISPR gRNA sequence
tgaggggaagagtcagaaaa

SEQ ID NO: 192980 - DNA, 20 bp, Artificial
  CRISPR gRNA sequence
aggggaagagtcagaaaatt

SEQ ID NO: 192981 - DNA, 20 bp, Artificial
  CRISPR gRNA sequence
aggcactttgtatctctcat

SEQ ID NO: 192982 - DNA, 20 bp, Artificial
  CRISPR gRNA sequence
tgtatctctcatgggacact

SEQ ID NO: 192983 - DNA, 20 bp, Artificial
  CRISPR gRNA sequence
gtatctctcatgggacactc

SEQ ID NO: 192984 - DNA, 20 bp, Artificial
  CRISPR gRNA sequence
tatctctcatgggacactcc

SEQ ID NO: 192985 - DNA, 20 bp, Artificial
  CRISPR gRNA sequence
tcatgggacactccagcagc

SEQ ID NO: 192986 - DNA, 20 bp, Artificial
  CRISPR gRNA sequence
atgggacactccagcagcac

SEQ ID NO: 192987 - DNA, 20 bp, Artificial
  CRISPR gRNA sequence
cagcagcacccatgtgacca

SEQ ID NO: 192988 - DNA, 20 bp, Artificial
  CRISPR gRNA sequence
agaaggaagaggacaattat

SEQ ID NO: 192989 - DNA, 20 bp, Artificial
  CRISPR gRNA sequence
tagtaggagaagaggacaaa

SEQ ID NO: 192990 - DNA, 20 bp, Artificial
  CRISPR gRNA sequence
gacaccagcctggacttagg

SEQ ID NO: 192991 - DNA, 20 bp, Artificial
  CRISPR gRNA sequence
acaccagcctggacttaggg

SEQ ID NO: 192992 - DNA, 20 bp, Artificial
  CRISPR gRNA sequence
gacttagggatctgggatag

SEQ ID NO: 192993 - DNA, 20 bp, Artificial
  CRISPR gRNA sequence
agggatctgggatagcctct

SEQ ID NO: 192994 - DNA, 20 bp, Artificial
  CRISPR gRNA sequence
gggatctgggatagcctctt

SEQ ID NO: 192995 - DNA, 20 bp, Artificial
  CRISPR gRNA sequence
ggatagcctcttattccttg

SEQ ID NO: 192996 - DNA, 20 bp, Artificial
  CRISPR gRNA sequence
ttattccttggaaagttcta

SEQ ID NO: 192997 - DNA, 20 bp, Artificial
  CRISPR gRNA sequence
attccttggaaagttctaga

SEQ ID NO: 192998 - DNA, 20 bp, Artificial
  CRISPR gRNA sequence
ttccttggaaagttctagaa

SEQ ID NO: 192999 - DNA, 20 bp, Artificial
  CRISPR gRNA sequence
cttggaaagttctagaatcg

SEQ ID NO: 193000 - DNA, 20 bp, Artificial
  CRISPR gRNA sequence
ggaaagttctagaatcggga

SEQ ID NO: 193001 - DNA, 20 bp, Artificial
  CRISPR gRNA sequence
gaaagttctagaatcgggat

SEQ ID NO: 193002 - DNA, 20 bp, Artificial
  CRISPR gRNA sequence
tagaatcgggatgagctagc

SEQ ID NO: 193003 - DNA, 20 bp, Artificial
  CRISPR gRNA sequence
gaatcgggatgagctagccc

SEQ ID NO: 193004 - DNA, 20 bp, Artificial
  CRISPR gRNA sequence
gcccagggtagaaggtgaaa

SEQ ID NO: 193005 - DNA, 20 bp, Artificial
  CRISPR gRNA sequence
ctggtcctggcctgtgtgga

SEQ ID NO: 193006 - DNA, 20 bp, Artificial
  CRISPR gRNA sequence
tggtcctggcctgtgtggat

SEQ ID NO: 193007 - DNA, 20 bp, Artificial
  CRISPR gRNA sequence
gtcctggcctgtgtggatgc

SEQ ID NO: 193008 - DNA, 20 bp, Artificial
  CRISPR gRNA sequence
gcctgtgtggatgctgagtg

SEQ ID NO: 193009 - DNA, 20 bp, Artificial
  CRISPR gRNA sequence
tgtggatgctgagtgactga

SEQ ID NO: 193010 - DNA, 20 bp, Artificial
  CRISPR gRNA sequence
agtgactgagaaaagctgga

SEQ ID NO: 193011 - DNA, 20 bp, Artificial
  CRISPR gRNA sequence
agaaaagctggagtcagacc

SEQ ID NO: 193012 - DNA, 20 bp, Artificial
  CRISPR gRNA sequence
gagtcagacctccaaaaact

SEQ ID NO: 193013 - DNA, 20 bp, Artificial
  CRISPR gRNA sequence
caaaaactcttggtgtgggg

SEQ ID NO: 193014 - DNA, 20 bp, Artificial
  CRISPR gRNA sequence
ttggtgtggggctgagaatc

SEQ ID NO: 193015 - DNA, 20 bp, Artificial
  CRISPR gRNA sequence
ggtgtggggctgagaatcag

SEQ ID NO: 193016 - DNA, 20 bp, Artificial
  CRISPR gRNA sequence
gtgtggggctgagaatcagg

SEQ ID NO: 193017 - DNA, 20 bp, Artificial
  CRISPR gRNA sequence
agaatcaggcacgagagaaa

SEQ ID NO: 193018 - DNA, 20 bp, Artificial
  CRISPR gRNA sequence
ccccgtgattcctaatactg

SEQ ID NO: 193019 - DNA, 20 bp, Artificial
  CRISPR gRNA sequence
ctaatactgggagtcaaaga

SEQ ID NO: 193020 - DNA, 20 bp, Artificial
  CRISPR gRNA sequence
atactgggagtcaaagagaa

SEQ ID NO: 193021 - DNA, 20 bp, Artificial
  CRISPR gRNA sequence
ggagtcaaagagaactgctc

SEQ ID NO: 193022 - DNA, 20 bp, Artificial
  CRISPR gRNA sequence
ctcatcagttcatctgaagg

SEQ ID NO: 193023 - DNA, 20 bp, Artificial
  CRISPR gRNA sequence
atcagttcatctgaaggatg

SEQ ID NO: 193024 - DNA, 20 bp, Artificial
  CRISPR gRNA sequence
atctgaaggatggaatctcc

SEQ ID NO: 193025 - DNA, 20 bp, Artificial
  CRISPR gRNA sequence
aaggatggaatctccagcga

SEQ ID NO: 193026 - DNA, 20 bp, Artificial
  CRISPR gRNA sequence
cagcgagactagattcctta

SEQ ID NO: 193027 - DNA, 20 bp, Artificial
  CRISPR gRNA sequence
gattccttaattgcccctga

SEQ ID NO: 193028 - DNA, 20 bp, Artificial
  CRISPR gRNA sequence
cttaattgcccctgagagag

SEQ ID NO: 193029 - DNA, 20 bp, Artificial
  CRISPR gRNA sequence
aattgcccctgagagaggtc

SEQ ID NO: 193030 - DNA, 20 bp, Artificial
  CRISPR gRNA sequence
attgcccctgagagaggtct

SEQ ID NO: 193031 - DNA, 20 bp, Artificial
  CRISPR gRNA sequence
cccctgagagaggtctggcc

SEQ ID NO: 193032 - DNA, 20 bp, Artificial
  CRISPR gRNA sequence
agagaggtctggccctttaa

SEQ ID NO: 193033 - DNA, 20 bp, Artificial
  CRISPR gRNA sequence
gccctttaagagagtcactc

SEQ ID NO: 193034 - DNA, 20 bp, Artificial
  CRISPR gRNA sequence
taagagagtcactctgtggt

SEQ ID NO: 193035 - DNA, 20 bp, Artificial
  CRISPR gRNA sequence
aagagagtcactctgtggta

SEQ ID NO: 193036 - DNA, 20 bp, Artificial
  CRISPR gRNA sequence
agagagtcactctgtggtat

SEQ ID NO: 193037 - DNA, 20 bp, Artificial
  CRISPR gRNA sequence
tgtggtataggatctcctgt

SEQ ID NO: 193038 - DNA, 20 bp, Artificial
  CRISPR gRNA sequence
tggtataggatctcctgtac

SEQ ID NO: 193039 - DNA, 20 bp, Artificial
  CRISPR gRNA sequence
ctgtacctcaggtgacagct

SEQ ID NO: 193040 - DNA, 20 bp, Artificial
  CRISPR gRNA sequence
tacctcaggtgacagctccc

SEQ ID NO: 193041 - DNA, 20 bp, Artificial
  CRISPR gRNA sequence
aggtgacagctccctctcct

SEQ ID NO: 193042 - DNA, 20 bp, Artificial
  CRISPR gRNA sequence
cctctcctgatccaagggag

SEQ ID NO: 193043 - DNA, 20 bp, Artificial
  CRISPR gRNA sequence
tcctgatccaagggaggagt

SEQ ID NO: 193044 - DNA, 20 bp, Artificial
  CRISPR gRNA sequence
ctgatccaagggaggagtgg

SEQ ID NO: 193045 - DNA, 20 bp, Artificial
  CRISPR gRNA sequence
atccaagggaggagtggtat

SEQ ID NO: 193046 - DNA, 20 bp, Artificial
  CRISPR gRNA sequence
tggcctccatccctgtttct

SEQ ID NO: 193047 - DNA, 20 bp, Artificial
  CRISPR gRNA sequence
gcctccatccctgtttcttc

SEQ ID NO: 193048 - DNA, 20 bp, Artificial
  CRISPR gRNA sequence
catccctgtttcttctactg

SEQ ID NO: 193049 - DNA, 20 bp, Artificial
  CRISPR gRNA sequence
tttcttctactgtttgaggt

SEQ ID NO: 193050 - DNA, 20 bp, Artificial
  CRISPR gRNA sequence
cttctactgtttgaggtctg

SEQ ID NO: 193051 - DNA, 20 bp, Artificial
  CRISPR gRNA sequence
ttctactgtttgaggtctgt

SEQ ID NO: 193052 - DNA, 20 bp, Artificial
  CRISPR gRNA sequence
ctactgtttgaggtctgtca

SEQ ID NO: 193053 - DNA, 20 bp, Artificial
  CRISPR gRNA sequence
tactgtttgaggtctgtcag

SEQ ID NO: 193054 - DNA, 20 bp, Artificial
  CRISPR gRNA sequence
ctgtttgaggtctgtcagct

SEQ ID NO: 193055 - DNA, 20 bp, Artificial
  CRISPR gRNA sequence
tttgaggtctgtcagctgtg

SEQ ID NO: 193056 - DNA, 20 bp, Artificial
  CRISPR gRNA sequence
gaggtctgtcagctgtgggc

SEQ ID NO: 193057 - DNA, 20 bp, Artificial
  CRISPR gRNA sequence
aggtctgtcagctgtgggca

SEQ ID NO: 193058 - DNA, 20 bp, Artificial
  CRISPR gRNA sequence
tcagctgtgggcacagtcct

SEQ ID NO: 193059 - DNA, 20 bp, Artificial
  CRISPR gRNA sequence
tgggcacagtcctagcccaa

SEQ ID NO: 193060 - DNA, 20 bp, Artificial
  CRISPR gRNA sequence
gcccaagaaggagttgggag

SEQ ID NO: 193061 - DNA, 20 bp, Artificial
  CRISPR gRNA sequence
ggagagtagccctgtggacc

SEQ ID NO: 193062 - DNA, 20 bp, Artificial
  CRISPR gRNA sequence
tggaccctcttacccaggtg

SEQ ID NO: 193063 - DNA, 20 bp, Artificial
  CRISPR gRNA sequence
ttacccaggtgaagcagcgt

SEQ ID NO: 193064 - DNA, 20 bp, Artificial
  CRISPR gRNA sequence
acccaggtgaagcagcgtct

SEQ ID NO: 193065 - DNA, 20 bp, Artificial
  CRISPR gRNA sequence
cccaggtgaagcagcgtctc

SEQ ID NO: 193066 - DNA, 20 bp, Artificial
  CRISPR gRNA sequence
cttccccttctccaggtatt

SEQ ID NO: 193067 - DNA, 20 bp, Artificial
  CRISPR gRNA sequence
ccccttctccaggtatttgt

SEQ ID NO: 193068 - DNA, 20 bp, Artificial
  CRISPR gRNA sequence
cccttctccaggtatttgtg

SEQ ID NO: 193069 - DNA, 20 bp, Artificial
  CRISPR gRNA sequence
ctccaggtatttgtggagcc

SEQ ID NO: 193070 - DNA, 20 bp, Artificial
  CRISPR gRNA sequence
tccaggtatttgtggagcca

SEQ ID NO: 193071 - DNA, 20 bp, Artificial
  CRISPR gRNA sequence
caggtatttgtggagccact

SEQ ID NO: 193072 - DNA, 20 bp, Artificial
  CRISPR gRNA sequence
gtggagccactccacgcatg

SEQ ID NO: 193073 - DNA, 20 bp, Artificial
  CRISPR gRNA sequence
tggagccactccacgcatgt

SEQ ID NO: 193074 - DNA, 20 bp, Artificial
  CRISPR gRNA sequence
cacgcatgtgtcttccaggt

SEQ ID NO: 193075 - DNA, 20 bp, Artificial
  CRISPR gRNA sequence
ccaggtaggctctctggtgc

SEQ ID NO: 193076 - DNA, 20 bp, Artificial
  CRISPR gRNA sequence
caggtaggctctctggtgct

SEQ ID NO: 193077 - DNA, 20 bp, Artificial
  CRISPR gRNA sequence
tctggtgctccgcctcagag

SEQ ID NO: 193078 - DNA, 20 bp, Artificial
  CRISPR gRNA sequence
tggtgctccgcctcagaggc

SEQ ID NO: 193079 - DNA, 20 bp, Artificial
  CRISPR gRNA sequence
gtgctccgcctcagaggcat

SEQ ID NO: 193080 - DNA, 20 bp, Artificial
  CRISPR gRNA sequence
cgcctcagaggcatcatttg

SEQ ID NO: 193081 - DNA, 20 bp, Artificial
  CRISPR gRNA sequence
agaggcatcatttgactttt

SEQ ID NO: 193082 - DNA, 20 bp, Artificial
  CRISPR gRNA sequence
gacttttgctcggagatctg

SEQ ID NO: 193083 - DNA, 20 bp, Artificial
  CRISPR gRNA sequence
acttttgctcggagatctga

SEQ ID NO: 193084 - DNA, 20 bp, Artificial
  CRISPR gRNA sequence
ttgctcggagatctgagccg

SEQ ID NO: 193085 - DNA, 20 bp, Artificial
  CRISPR gRNA sequence
tgctcggagatctgagccgc

SEQ ID NO: 193086 - DNA, 20 bp, Artificial
  CRISPR gRNA sequence
gctcggagatctgagccgcc

SEQ ID NO: 193087 - DNA, 20 bp, Artificial
  CRISPR gRNA sequence
ctcggagatctgagccgccg

SEQ ID NO: 193088 - DNA, 20 bp, Artificial
  CRISPR gRNA sequence
ggagatctgagccgccgtgt

SEQ ID NO: 193089 - DNA, 20 bp, Artificial
  CRISPR gRNA sequence
agccgccgtgtccaccgcgg

SEQ ID NO: 193090 - DNA, 20 bp, Artificial
  CRISPR gRNA sequence
attcagggtgagataatcct

SEQ ID NO: 193091 - DNA, 20 bp, Artificial
  CRISPR gRNA sequence
agggtgagataatccttgcc

SEQ ID NO: 193092 - DNA, 20 bp, Artificial
  CRISPR gRNA sequence
gccgtcgtaggcgaactgtt

SEQ ID NO: 193093 - DNA, 20 bp, Artificial
  CRISPR gRNA sequence
ccgtcgtaggcgaactgttc

SEQ ID NO: 193094 - DNA, 20 bp, Artificial
  CRISPR gRNA sequence
ttcatacccgcggaggaagc

SEQ ID NO: 193095 - DNA, 20 bp, Artificial
  CRISPR gRNA sequence
atacccgcggaggaagcgcc

SEQ ID NO: 193096 - DNA, 20 bp, Artificial
  CRISPR gRNA sequence
gcagccatgcatccactgca

SEQ ID NO: 193097 - DNA, 20 bp, Artificial
  CRISPR gRNA sequence
cagggtgtgagaccctggcc

SEQ ID NO: 193098 - DNA, 20 bp, Artificial
  CRISPR gRNA sequence
gccccgccccttagtcagtc

SEQ ID NO: 193099 - DNA, 20 bp, Artificial
  CRISPR gRNA sequence
agtcagtcccgcccaccaag

SEQ ID NO: 193100 - DNA, 20 bp, Artificial
  CRISPR gRNA sequence
gtcagtcccgcccaccaagc

SEQ ID NO: 193101 - DNA, 20 bp, Artificial
  CRISPR gRNA sequence
tgggcattttggcctaaact

SEQ ID NO: 193102 - DNA, 20 bp, Artificial
  CRISPR gRNA sequence
tggcctaaactgaaaaagaa

SEQ ID NO: 193103 - DNA, 20 bp, Artificial
  CRISPR gRNA sequence
ggcctaaactgaaaaagaac

SEQ ID NO: 193104 - DNA, 20 bp, Artificial
  CRISPR gRNA sequence
gcctaaactgaaaaagaacc

SEQ ID NO: 193105 - DNA, 20 bp, Artificial
  CRISPR gRNA sequence
aactgaaaaagaaccgggta

SEQ ID NO: 193106 - DNA, 20 bp, Artificial
  CRISPR gRNA sequence
aaaaagaaccgggtaaaggc

SEQ ID NO: 193107 - DNA, 20 bp, Artificial
  CRISPR gRNA sequence
agactctccccggtctaggg

SEQ ID NO: 193108 - DNA, 20 bp, Artificial
  CRISPR gRNA sequence
tccccggtctagggtctggg

SEQ ID NO: 193109 - DNA, 20 bp, Artificial
  CRISPR gRNA sequence
cccggtctagggtctgggcg

SEQ ID NO: 193110 - DNA, 20 bp, Artificial
  CRISPR gRNA sequence
gggtctgggcgggttccgca

SEQ ID NO: 193111 - DNA, 20 bp, Artificial
  CRISPR gRNA sequence
ggcgggttccgcagccttgg

SEQ ID NO: 193112 - DNA, 20 bp, Artificial
  CRISPR gRNA sequence
cgcagccttggggtgaatct

SEQ ID NO: 193113 - DNA, 20 bp, Artificial
  CRISPR gRNA sequence
ggggtgaatctgggacccga

SEQ ID NO: 193114 - DNA, 20 bp, Artificial
  CRISPR gRNA sequence
gggtgaatctgggacccgaa

SEQ ID NO: 193115 - DNA, 20 bp, Artificial
  CRISPR gRNA sequence
ggacccgaagattcgagggg

SEQ ID NO: 193116 - DNA, 20 bp, Artificial
  CRISPR gRNA sequence
gaggggacccgcgccgtccg

SEQ ID NO: 193117 - DNA, 20 bp, Artificial
  CRISPR gRNA sequence
ctcccctggccggggtcact

SEQ ID NO: 193118 - DNA, 20 bp, Artificial
  CRISPR gRNA sequence
ccctggccggggtcactcac

SEQ ID NO: 193119 - DNA, 20 bp, Artificial
  CRISPR gRNA sequence
gccggggtcactcaccggcc

SEQ ID NO: 193120 - DNA, 20 bp, Artificial
  CRISPR gRNA sequence
accggcctcgctctgattgt

SEQ ID NO: 193121 - DNA, 20 bp, Artificial
  CRISPR gRNA sequence
gctctgattgtagtagccgc

SEQ ID NO: 193122 - DNA, 20 bp, Artificial
  CRISPR gRNA sequence
tgattgtagtagccgcgcag

SEQ ID NO: 193123 - DNA, 20 bp, Artificial
  CRISPR gRNA sequence
attgtagtagccgcgcagcg

SEQ ID NO: 193124 - DNA, 20 bp, Artificial
  CRISPR gRNA sequence
tagtagccgcgcagcgtccg

SEQ ID NO: 193125 - DNA, 20 bp, Artificial
  CRISPR gRNA sequence
actcggaaaatctgtgcggt

SEQ ID NO: 193126 - DNA, 20 bp, Artificial
  CRISPR gRNA sequence
ggaaaatctgtgcggtgtcc

SEQ ID NO: 193127 - DNA, 20 bp, Artificial
  CRISPR gRNA sequence
tgcggtgtccctggcgctcc

SEQ ID NO: 193128 - DNA, 20 bp, Artificial
  CRISPR gRNA sequence
gcgctccgtgtctcccggtc

SEQ ID NO: 193129 - DNA, 20 bp, Artificial
  CRISPR gRNA sequence
cgtgtctcccggtcccaata

SEQ ID NO: 193130 - DNA, 20 bp, Artificial
  CRISPR gRNA sequence
ccggtcccaatactctgacc

SEQ ID NO: 193131 - DNA, 20 bp, Artificial
  CRISPR gRNA sequence
tgacccctcctgctccatcc

SEQ ID NO: 193132 - DNA, 20 bp, Artificial
  CRISPR gRNA sequence
acccctcctgctccatccac

SEQ ID NO: 193133 - DNA, 20 bp, Artificial
  CRISPR gRNA sequence
ctgctccatccacggcgccc

SEQ ID NO: 193134 - DNA, 20 bp, Artificial
  CRISPR gRNA sequence
ctccatccacggcgcccgcg

SEQ ID NO: 193135 - DNA, 20 bp, Artificial
  CRISPR gRNA sequence
catccacggcgcccgcggca

SEQ ID NO: 193136 - DNA, 20 bp, Artificial
  CRISPR gRNA sequence
ggactcgcggcgtcgttgtc

SEQ ID NO: 193137 - DNA, 20 bp, Artificial
  CRISPR gRNA sequence
gcggcgtcgttgtcgaagcg

SEQ ID NO: 193138 - DNA, 20 bp, Artificial
  CRISPR gRNA sequence
tcgaagcgcacgaactgggt

SEQ ID NO: 193139 - DNA, 20 bp, Artificial
  CRISPR gRNA sequence
ggtgtcgtccacgtagccca

SEQ ID NO: 193140 - DNA, 20 bp, Artificial
  CRISPR gRNA sequence
cccgcggccgggccgggaca

SEQ ID NO: 193141 - DNA, 20 bp, Artificial
  CRISPR gRNA sequence
caaggagtgggagcctgggg

SEQ ID NO: 193142 - DNA, 20 bp, Artificial
  CRISPR gRNA sequence
aaggagtgggagcctggggg

SEQ ID NO: 193143 - DNA, 20 bp, Artificial
  CRISPR gRNA sequence
ggggcgaggaggggctgaga

SEQ ID NO: 193144 - DNA, 20 bp, Artificial
  CRISPR gRNA sequence
agatcggcccgaccctcctc

SEQ ID NO: 193145 - DNA, 20 bp, Artificial
  CRISPR gRNA sequence
ctcccggcgcggctccccga

SEQ ID NO: 193146 - DNA, 20 bp, Artificial
  CRISPR gRNA sequence
ccggcgcggctccccgagtc

SEQ ID NO: 193147 - DNA, 20 bp, Artificial
  CRISPR gRNA sequence
cccgagtccttcgcccccgc

SEQ ID NO: 193148 - DNA, 20 bp, Artificial
  CRISPR gRNA sequence
cgcccccgccgggccggccc

SEQ ID NO: 193149 - DNA, 20 bp, Artificial
  CRISPR gRNA sequence
gcccccgccgggccggcccc

SEQ ID NO: 193150 - DNA, 20 bp, Artificial
  CRISPR gRNA sequence
tctactcccggtagaggccg

SEQ ID NO: 193151 - DNA, 20 bp, Artificial
  CRISPR gRNA sequence
tactcccggtagaggccgtt

SEQ ID NO: 193152 - DNA, 20 bp, Artificial
  CRISPR gRNA sequence
ctcccggtagaggccgtttc

SEQ ID NO: 193153 - DNA, 20 bp, Artificial
  CRISPR gRNA sequence
ccggtagaggccgtttccat

SEQ ID NO: 193154 - DNA, 20 bp, Artificial
  CRISPR gRNA sequence
ccatcccgaccccgcactca

SEQ ID NO: 193155 - DNA, 20 bp, Artificial
  CRISPR gRNA sequence
catcccgaccccgcactcac

SEQ ID NO: 193156 - DNA, 20 bp, Artificial
  CRISPR gRNA sequence
acccgcccaggtctgggtaa

SEQ ID NO: 193157 - DNA, 20 bp, Artificial
  CRISPR gRNA sequence
ggtaagggccagggcctccg

SEQ ID NO: 193158 - DNA, 20 bp, Artificial
  CRISPR gRNA sequence
cgagaggagtaaaaggaggg

SEQ ID NO: 193159 - DNA, 20 bp, Artificial
  CRISPR gRNA sequence
catctaccatgatcccagcc

SEQ ID NO: 193160 - DNA, 20 bp, Artificial
  CRISPR gRNA sequence
ccatgatcccagcctctgag

SEQ ID NO: 193161 - DNA, 20 bp, Artificial
  CRISPR gRNA sequence
tgagtcctgagaacttcttg

SEQ ID NO: 193162 - DNA, 20 bp, Artificial
  CRISPR gRNA sequence
agtcctgagaacttcttgag

SEQ ID NO: 193163 - DNA, 20 bp, Artificial
  CRISPR gRNA sequence
agaacttcttgagtccggat

SEQ ID NO: 193164 - DNA, 20 bp, Artificial
  CRISPR gRNA sequence
cttgagtccggatggggact

SEQ ID NO: 193165 - DNA, 20 bp, Artificial
  CRISPR gRNA sequence
ttgagtccggatggggactt

SEQ ID NO: 193166 - DNA, 20 bp, Artificial
  CRISPR gRNA sequence
gagtccggatggggacttta

SEQ ID NO: 193167 - DNA, 20 bp, Artificial
  CRISPR gRNA sequence
agtccggatggggactttat

SEQ ID NO: 193168 - DNA, 20 bp, Artificial
  CRISPR gRNA sequence
tatagtcgggagtcgtggcg

SEQ ID NO: 193169 - DNA, 20 bp, Artificial
  CRISPR gRNA sequence
atagtcgggagtcgtggcga

SEQ ID NO: 193170 - DNA, 20 bp, Artificial
  CRISPR gRNA sequence
tagtcgggagtcgtggcgac

SEQ ID NO: 193171 - DNA, 20 bp, Artificial
  CRISPR gRNA sequence
attggcttctctagaaaccc

SEQ ID NO: 193172 - DNA, 20 bp, Artificial
  CRISPR gRNA sequence
gcttctctagaaacccgaca

SEQ ID NO: 193173 - DNA, 20 bp, Artificial
  CRISPR gRNA sequence
ctctagaaacccgacaccca

SEQ ID NO: 193174 - DNA, 20 bp, Artificial
  CRISPR gRNA sequence
tctagaaacccgacacccat

SEQ ID NO: 193175 - DNA, 20 bp, Artificial
  CRISPR gRNA sequence
tagaaacccgacacccattg

SEQ ID NO: 193176 - DNA, 20 bp, Artificial
  CRISPR gRNA sequence
gaaacccgacacccattggg

SEQ ID NO: 193177 - DNA, 20 bp, Artificial
  CRISPR gRNA sequence
ggaatgagaactgagtctgc

SEQ ID NO: 193178 - DNA, 20 bp, Artificial
  CRISPR gRNA sequence
agtctgcgtcatgagtatcc

SEQ ID NO: 193179 - DNA, 20 bp, Artificial
  CRISPR gRNA sequence
cgtcatgagtatccaggaag

SEQ ID NO: 193180 - DNA, 20 bp, Artificial
  CRISPR gRNA sequence
cgagaggaacgggaaactgc

SEQ ID NO: 193181 - DNA, 20 bp, Artificial
  CRISPR gRNA sequence
cagagtttcccagcaatcag

SEQ ID NO: 193182 - DNA, 20 bp, Artificial
  CRISPR gRNA sequence
cccagcaatcagcagttctt

SEQ ID NO: 193183 - DNA, 20 bp, Artificial
  CRISPR gRNA sequence
ccagcaatcagcagttctta

SEQ ID NO: 193184 - DNA, 20 bp, Artificial
  CRISPR gRNA sequence
atattgtatgtttaattatt

SEQ ID NO: 193185 - DNA, 20 bp, Artificial
  CRISPR gRNA sequence
gtatgtttaattattaagtg

SEQ ID NO: 193186 - DNA, 20 bp, Artificial
  CRISPR gRNA sequence
tgtttaattattaagtgaag

SEQ ID NO: 193187 - DNA, 20 bp, Artificial
  CRISPR gRNA sequence
cttttcgtgttttccataat

SEQ ID NO: 193188 - DNA, 20 bp, Artificial
  CRISPR gRNA sequence
ttttcgtgttttccataatt

SEQ ID NO: 193189 - DNA, 20 bp, Artificial
  CRISPR gRNA sequence
tttcgtgttttccataatta

SEQ ID NO: 193190 - DNA, 20 bp, Artificial
  CRISPR gRNA sequence
tttccataattagggcattc

SEQ ID NO: 193191 - DNA, 20 bp, Artificial
  CRISPR gRNA sequence
cataattagggcattccaga

SEQ ID NO: 193192 - DNA, 20 bp, Artificial
  CRISPR gRNA sequence
ttagggcattccagaaagat

SEQ ID NO: 193193 - DNA, 20 bp, Artificial
  CRISPR gRNA sequence
tagggcattccagaaagatg

SEQ ID NO: 193194 - DNA, 20 bp, Artificial
  CRISPR gRNA sequence
tctttatattcatgacctac

SEQ ID NO: 193195 - DNA, 20 bp, Artificial
  CRISPR gRNA sequence
acctactggcatttgctgaa

SEQ ID NO: 193196 - DNA, 20 bp, Artificial
  CRISPR gRNA sequence
actggcatttgctgaacggt

SEQ ID NO: 193197 - DNA, 20 bp, Artificial
  CRISPR gRNA sequence
aagacaccaaatccttccat

SEQ ID NO: 193198 - DNA, 20 bp, Artificial
  CRISPR gRNA sequence
agacaccaaatccttccatt

SEQ ID NO: 193199 - DNA, 20 bp, Artificial
  CRISPR gRNA sequence
attttaaatattttaaccat

SEQ ID NO: 193200 - DNA, 20 bp, Artificial
  CRISPR gRNA sequence
aaatgcatgcaattttctta

SEQ ID NO: 193201 - DNA, 20 bp, Artificial
  CRISPR gRNA sequence
atgcatgcaattttcttata

SEQ ID NO: 193202 - DNA, 20 bp, Artificial
  CRISPR gRNA sequence
gcatgcaattttcttataga

SEQ ID NO: 193203 - DNA, 20 bp, Artificial
  CRISPR gRNA sequence
ctttcttctactttacacaa

SEQ ID NO: 193204 - DNA, 20 bp, Artificial
  CRISPR gRNA sequence
ttctactttacacaatggca

SEQ ID NO: 193205 - DNA, 20 bp, Artificial
  CRISPR gRNA sequence
ttctactttacgcaatgata

SEQ ID NO: 193206 - DNA, 20 bp, Artificial
  CRISPR gRNA sequence
tgtgtcattttgtaaaaata

SEQ ID NO: 193207 - DNA, 20 bp, Artificial
  CRISPR gRNA sequence
tgtcattttgtaaaaatata

SEQ ID NO: 193208 - DNA, 20 bp, Artificial
  CRISPR gRNA sequence
ttgtaaaaatatagagaata

SEQ ID NO: 193209 - DNA, 20 bp, Artificial
  CRISPR gRNA sequence
agagaatatagacaaattga

SEQ ID NO: 193210 - DNA, 20 bp, Artificial
  CRISPR gRNA sequence
ataatctattacccatttcc

SEQ ID NO: 193211 - DNA, 20 bp, Artificial
  CRISPR gRNA sequence
taatctattacccatttccc

SEQ ID NO: 193212 - DNA, 20 bp, Artificial
  CRISPR gRNA sequence
aatctattacccatttccca

SEQ ID NO: 193213 - DNA, 20 bp, Artificial
  CRISPR gRNA sequence
ggttaactactgaaaatatc

SEQ ID NO: 193214 - DNA, 20 bp, Artificial
  CRISPR gRNA sequence
gttaactactgaaaatatct

SEQ ID NO: 193215 - DNA, 20 bp, Artificial
  CRISPR gRNA sequence
ttaactactgaaaatatctg

SEQ ID NO: 193216 - DNA, 20 bp, Artificial
  CRISPR gRNA sequence
actgaaaatatctggggaaa

SEQ ID NO: 193217 - DNA, 20 bp, Artificial
  CRISPR gRNA sequence
tttatttgtttgctttcaac

SEQ ID NO: 193218 - DNA, 20 bp, Artificial
  CRISPR gRNA sequence
ttatttgtttgctttcaaca

SEQ ID NO: 193219 - DNA, 20 bp, Artificial
  CRISPR gRNA sequence
tgtttgctttcaacaaggcc

SEQ ID NO: 193220 - DNA, 20 bp, Artificial
  CRISPR gRNA sequence
gccaagatcctttgatcttt

SEQ ID NO: 193221 - DNA, 20 bp, Artificial
  CRISPR gRNA sequence
atcctttgatctttcagtct

SEQ ID NO: 193222 - DNA, 20 bp, Artificial
  CRISPR gRNA sequence
tgtgacatgcctttcctgat

SEQ ID NO: 193223 - DNA, 20 bp, Artificial
  CRISPR gRNA sequence
gtgacatgcctttcctgatg

SEQ ID NO: 193224 - DNA, 20 bp, Artificial
  CRISPR gRNA sequence
tttcctgatgaggatacttt

SEQ ID NO: 193225 - DNA, 20 bp, Artificial
  CRISPR gRNA sequence
ttcctgatgaggatacttta

SEQ ID NO: 193226 - DNA, 20 bp, Artificial
  CRISPR gRNA sequence
ctgatgaggatactttaagg

SEQ ID NO: 193227 - DNA, 20 bp, Artificial
  CRISPR gRNA sequence
atactttaaggaagaattgt

SEQ ID NO: 193228 - DNA, 20 bp, Artificial
  CRISPR gRNA sequence
aggaagaattgtaagataca

SEQ ID NO: 193229 - DNA, 20 bp, Artificial
  CRISPR gRNA sequence
gtaagatacatggaaaatgt

SEQ ID NO: 193230 - DNA, 20 bp, Artificial
  CRISPR gRNA sequence
taagatacatggaaaatgtc

SEQ ID NO: 193231 - DNA, 20 bp, Artificial
  CRISPR gRNA sequence
tggaaaatgtcaggctaaca

SEQ ID NO: 193232 - DNA, 20 bp, Artificial
  CRISPR gRNA sequence
atgtcaggctaacacagtac

SEQ ID NO: 193233 - DNA, 20 bp, Artificial
  CRISPR gRNA sequence
cataccaatgtacttcttgc

SEQ ID NO: 193234 - DNA, 20 bp, Artificial
  CRISPR gRNA sequence
cttgccagaaaactgatcaa

SEQ ID NO: 193235 - DNA, 20 bp, Artificial
  CRISPR gRNA sequence
cagaaaactgatcaaaagtt

SEQ ID NO: 193236 - DNA, 20 bp, Artificial
  CRISPR gRNA sequence
agaaaactgatcaaaagttt

SEQ ID NO: 193237 - DNA, 20 bp, Artificial
  CRISPR gRNA sequence
gaaaactgatcaaaagttta

SEQ ID NO: 193238 - DNA, 20 bp, Artificial
  CRISPR gRNA sequence
aactgatcaaaagtttaggg

SEQ ID NO: 193239 - DNA, 20 bp, Artificial
  CRISPR gRNA sequence
caaaagtttagggaagtaaa

SEQ ID NO: 193240 - DNA, 20 bp, Artificial
  CRISPR gRNA sequence
aaagtttagggaagtaaaaa

SEQ ID NO: 193241 - DNA, 20 bp, Artificial
  CRISPR gRNA sequence
aagtaaaaagagatgactgt

SEQ ID NO: 193242 - DNA, 20 bp, Artificial
  CRISPR gRNA sequence
aatctaccattccctctatg

SEQ ID NO: 193243 - DNA, 20 bp, Artificial
  CRISPR gRNA sequence
atctaccattccctctatgt

SEQ ID NO: 193244 - DNA, 20 bp, Artificial
  CRISPR gRNA sequence
taccattccctctatgtagg

SEQ ID NO: 193245 - DNA, 20 bp, Artificial
  CRISPR gRNA sequence
ccctctatgtaggaagcaaa

SEQ ID NO: 193246 - DNA, 20 bp, Artificial
  CRISPR gRNA sequence
cctctatgtaggaagcaaat

SEQ ID NO: 193247 - DNA, 20 bp, Artificial
  CRISPR gRNA sequence
agcaaataggtgtcctgtca

SEQ ID NO: 193248 - DNA, 20 bp, Artificial
  CRISPR gRNA sequence
gcaaataggtgtcctgtcaa

SEQ ID NO: 193249 - DNA, 20 bp, Artificial
  CRISPR gRNA sequence
tgtcctgtcaaaggacattc

SEQ ID NO: 193250 - DNA, 20 bp, Artificial
  CRISPR gRNA sequence
gtcctgtcaaaggacattct

SEQ ID NO: 193251 - DNA, 20 bp, Artificial
  CRISPR gRNA sequence
tcctgtcaaaggacattctg

SEQ ID NO: 193252 - DNA, 20 bp, Artificial
  CRISPR gRNA sequence
ggggatgtctacatgaaacc

SEQ ID NO: 193253 - DNA, 20 bp, Artificial
  CRISPR gRNA sequence
tacatgaaaccaagtctccc

SEQ ID NO: 193254 - DNA, 20 bp, Artificial
  CRISPR gRNA sequence
aaccaagtctccctggttgt

SEQ ID NO: 193255 - DNA, 20 bp, Artificial
  CRISPR gRNA sequence
accaagtctccctggttgta

SEQ ID NO: 193256 - DNA, 20 bp, Artificial
  CRISPR gRNA sequence
atctccatataatatttata

SEQ ID NO: 193257 - DNA, 20 bp, Artificial
  CRISPR gRNA sequence
taatatatgtttataaattg

SEQ ID NO: 193258 - DNA, 20 bp, Artificial
  CRISPR gRNA sequence
aatatatgtttataaattgt

SEQ ID NO: 193259 - DNA, 20 bp, Artificial
  CRISPR gRNA sequence
atatatgtttataaattgtg

SEQ ID NO: 193260 - DNA, 20 bp, Artificial
  CRISPR gRNA sequence
tatatgtttataaattgtgg

SEQ ID NO: 193261 - DNA, 20 bp, Artificial
  CRISPR gRNA sequence
aattgtgggggcaacttgtt

SEQ ID NO: 193262 - DNA, 20 bp, Artificial
  CRISPR gRNA sequence
taattttattattctgctat

SEQ ID NO: 193263 - DNA, 20 bp, Artificial
  CRISPR gRNA sequence
aattttattattctgctatt

SEQ ID NO: 193264 - DNA, 20 bp, Artificial
  CRISPR gRNA sequence
gctattgggacactgtgtct

SEQ ID NO: 193265 - DNA, 20 bp, Artificial
  CRISPR gRNA sequence
gggacactgtgtctcagcat

SEQ ID NO: 193266 - DNA, 20 bp, Artificial
  CRISPR gRNA sequence
ctgtgtctcagcatgagata

SEQ ID NO: 193267 - DNA, 20 bp, Artificial
  CRISPR gRNA sequence
agtgtcccaaaacatatttc

SEQ ID NO: 193268 - DNA, 20 bp, Artificial
  CRISPR gRNA sequence
aaaacatatttcaagcccat

SEQ ID NO: 193269 - DNA, 20 bp, Artificial
  CRISPR gRNA sequence
cattggataaaatatgtgtt

SEQ ID NO: 193270 - DNA, 20 bp, Artificial
  CRISPR gRNA sequence
ggataaaatatgtgtttagc

SEQ ID NO: 193271 - DNA, 20 bp, Artificial
  CRISPR gRNA sequence
ataatgataacataaccgac

SEQ ID NO: 193272 - DNA, 20 bp, Artificial
  CRISPR gRNA sequence
ataacataaccgaccagata

SEQ ID NO: 193273 - DNA, 20 bp, Artificial
  CRISPR gRNA sequence
gccaattttgtaaatgtttc

SEQ ID NO: 193274 - DNA, 20 bp, Artificial
  CRISPR gRNA sequence
ccaattttgtaaatgtttcg

SEQ ID NO: 193275 - DNA, 20 bp, Artificial
  CRISPR gRNA sequence
gaggaattttcccttttctg

SEQ ID NO: 193276 - DNA, 20 bp, Artificial
  CRISPR gRNA sequence
agattgtccttctttctttt

SEQ ID NO: 193277 - DNA, 20 bp, Artificial
  CRISPR gRNA sequence
ctttttagcatttactgtca

SEQ ID NO: 193278 - DNA, 20 bp, Artificial
  CRISPR gRNA sequence
catttactgtcacggttccc

SEQ ID NO: 193279 - DNA, 20 bp, Artificial
  CRISPR gRNA sequence
atttactgtcacggttccca

SEQ ID NO: 193280 - DNA, 20 bp, Artificial
  CRISPR gRNA sequence
ggttcccaaggacctatatg

SEQ ID NO: 193281 - DNA, 20 bp, Artificial
  CRISPR gRNA sequence
tcccaaggacctatatgtgg

SEQ ID NO: 193282 - DNA, 20 bp, Artificial
  CRISPR gRNA sequence
ccaaggacctatatgtggta

SEQ ID NO: 193283 - DNA, 20 bp, Artificial
  CRISPR gRNA sequence
gacctatatgtggtagagta

SEQ ID NO: 193284 - DNA, 20 bp, Artificial
  CRISPR gRNA sequence
ctatatgtggtagagtatgg

SEQ ID NO: 193285 - DNA, 20 bp, Artificial
  CRISPR gRNA sequence
gacaattgaatgcaaattcc

SEQ ID NO: 193286 - DNA, 20 bp, Artificial
  CRISPR gRNA sequence
aattgaatgcaaattcccag

SEQ ID NO: 193287 - DNA, 20 bp, Artificial
  CRISPR gRNA sequence
attcccagtagaaaaacaat

SEQ ID NO: 193288 - DNA, 20 bp, Artificial
  CRISPR gRNA sequence
agtagaaaaacaattagacc

SEQ ID NO: 193289 - DNA, 20 bp, Artificial
  CRISPR gRNA sequence
tggctgcactaattgtctat

SEQ ID NO: 193290 - DNA, 20 bp, Artificial
  CRISPR gRNA sequence
ggctgcactaattgtctatt

SEQ ID NO: 193291 - DNA, 20 bp, Artificial
  CRISPR gRNA sequence
actaattgtctattgggaaa

SEQ ID NO: 193292 - DNA, 20 bp, Artificial
  CRISPR gRNA sequence
taattgtctattgggaaatg

SEQ ID NO: 193293 - DNA, 20 bp, Artificial
  CRISPR gRNA sequence
aattgtctattgggaaatgg

SEQ ID NO: 193294 - DNA, 20 bp, Artificial
  CRISPR gRNA sequence
tctattgggaaatggaggat

SEQ ID NO: 193295 - DNA, 20 bp, Artificial
  CRISPR gRNA sequence
aacattattcaatttgtgca

SEQ ID NO: 193296 - DNA, 20 bp, Artificial
  CRISPR gRNA sequence
cattattcaatttgtgcatg

SEQ ID NO: 193297 - DNA, 20 bp, Artificial
  CRISPR gRNA sequence
ttattcaatttgtgcatgga

SEQ ID NO: 193298 - DNA, 20 bp, Artificial
  CRISPR gRNA sequence
tattcaatttgtgcatggag

SEQ ID NO: 193299 - DNA, 20 bp, Artificial
  CRISPR gRNA sequence
tcaatttgtgcatggagagg

SEQ ID NO: 193300 - DNA, 20 bp, Artificial
  CRISPR gRNA sequence
tgcatggagaggaagacctg

SEQ ID NO: 193301 - DNA, 20 bp, Artificial
  CRISPR gRNA sequence
gcatggagaggaagacctga

SEQ ID NO: 193302 - DNA, 20 bp, Artificial
  CRISPR gRNA sequence
gagaggaagacctgaaggtt

SEQ ID NO: 193303 - DNA, 20 bp, Artificial
  CRISPR gRNA sequence
gaagacctgaaggttcagca

SEQ ID NO: 193304 - DNA, 20 bp, Artificial
  CRISPR gRNA sequence
gacctgaaggttcagcatag

SEQ ID NO: 193305 - DNA, 20 bp, Artificial
  CRISPR gRNA sequence
aaggttcagcatagtagcta

SEQ ID NO: 193306 - DNA, 20 bp, Artificial
  CRISPR gRNA sequence
ttcagcatagtagctacaga

SEQ ID NO: 193307 - DNA, 20 bp, Artificial
  CRISPR gRNA sequence
cagcatagtagctacagaca

SEQ ID NO: 193308 - DNA, 20 bp, Artificial
  CRISPR gRNA sequence
agcatagtagctacagacag

SEQ ID NO: 193309 - DNA, 20 bp, Artificial
  CRISPR gRNA sequence
gcatagtagctacagacaga

SEQ ID NO: 193310 - DNA, 20 bp, Artificial
  CRISPR gRNA sequence
gtagctacagacagagggcc

SEQ ID NO: 193311 - DNA, 20 bp, Artificial
  CRISPR gRNA sequence
gacagagggcccggctgttg

SEQ ID NO: 193312 - DNA, 20 bp, Artificial
  CRISPR gRNA sequence
acagagggcccggctgttga

SEQ ID NO: 193313 - DNA, 20 bp, Artificial
  CRISPR gRNA sequence
gggcccggctgttgaaggac

SEQ ID NO: 193314 - DNA, 20 bp, Artificial
  CRISPR gRNA sequence
gttgaaggaccagctctccc

SEQ ID NO: 193315 - DNA, 20 bp, Artificial
  CRISPR gRNA sequence
ttgaaggaccagctctccct

SEQ ID NO: 193316 - DNA, 20 bp, Artificial
  CRISPR gRNA sequence
ccctgggaaatgctgcactt

SEQ ID NO: 193317 - DNA, 20 bp, Artificial
  CRISPR gRNA sequence
aaatgctgcacttcagatca

SEQ ID NO: 193318 - DNA, 20 bp, Artificial
  CRISPR gRNA sequence
agatcacagatgtgaaattg

SEQ ID NO: 193319 - DNA, 20 bp, Artificial
  CRISPR gRNA sequence
gatcacagatgtgaaattgc

SEQ ID NO: 193320 - DNA, 20 bp, Artificial
  CRISPR gRNA sequence
agatgtgaaattgcaggatg

SEQ ID NO: 193321 - DNA, 20 bp, Artificial
  CRISPR gRNA sequence
gatgtgaaattgcaggatgc

SEQ ID NO: 193322 - DNA, 20 bp, Artificial
  CRISPR gRNA sequence
atgtgaaattgcaggatgca

SEQ ID NO: 193323 - DNA, 20 bp, Artificial
  CRISPR gRNA sequence
tgtgaaattgcaggatgcag

SEQ ID NO: 193324 - DNA, 20 bp, Artificial
  CRISPR gRNA sequence
ggggtgtaccgctgcatgat

SEQ ID NO: 193325 - DNA, 20 bp, Artificial
  CRISPR gRNA sequence
taccgctgcatgatcagcta

SEQ ID NO: 193326 - DNA, 20 bp, Artificial
  CRISPR gRNA sequence
cgctgcatgatcagctatgg

SEQ ID NO: 193327 - DNA, 20 bp, Artificial
  CRISPR gRNA sequence
gctatggtggtgccgactac

SEQ ID NO: 193328 - DNA, 20 bp, Artificial
  CRISPR gRNA sequence
ctacaagcgaattactgtga

SEQ ID NO: 193329 - DNA, 20 bp, Artificial
  CRISPR gRNA sequence
cgaattactgtgaaagtcaa

SEQ ID NO: 193330 - DNA, 20 bp, Artificial
  CRISPR gRNA sequence
ttactgtgaaagtcaatggt

SEQ ID NO: 193331 - DNA, 20 bp, Artificial
  CRISPR gRNA sequence
gtcaatggtaagaattatta

SEQ ID NO: 193332 - DNA, 20 bp, Artificial
  CRISPR gRNA sequence
tggtaagaattattatagat

SEQ ID NO: 193333 - DNA, 20 bp, Artificial
  CRISPR gRNA sequence
gtaagaattattatagatga

SEQ ID NO: 193334 - DNA, 20 bp, Artificial
  CRISPR gRNA sequence
taagaattattatagatgag

SEQ ID NO: 193335 - DNA, 20 bp, Artificial
  CRISPR gRNA sequence
ctttattgaaaacatattcc

SEQ ID NO: 193336 - DNA, 20 bp, Artificial
  CRISPR gRNA sequence
aaaacatattccaagtgttg

SEQ ID NO: 193337 - DNA, 20 bp, Artificial
  CRISPR gRNA sequence
tgaagacttttcattcttgt

SEQ ID NO: 193338 - DNA, 20 bp, Artificial
  CRISPR gRNA sequence
agtccatacttattttcaaa

SEQ ID NO: 193339 - DNA, 20 bp, Artificial
  CRISPR gRNA sequence
atacttattttcaaacagaa

SEQ ID NO: 193340 - DNA, 20 bp, Artificial
  CRISPR gRNA sequence
tattttcaaacagaacagca

SEQ ID NO: 193341 - DNA, 20 bp, Artificial
  CRISPR gRNA sequence
acataattatccaatttctt

SEQ ID NO: 193342 - DNA, 20 bp, Artificial
  CRISPR gRNA sequence
tttcttgagcacctatttga

SEQ ID NO: 193343 - DNA, 20 bp, Artificial
  CRISPR gRNA sequence
agcacctatttgatagtcac

SEQ ID NO: 193344 - DNA, 20 bp, Artificial
  CRISPR gRNA sequence
tttgatagtcactggaaatc

SEQ ID NO: 193345 - DNA, 20 bp, Artificial
  CRISPR gRNA sequence
tgatagtcactggaaatcca

SEQ ID NO: 193346 - DNA, 20 bp, Artificial
  CRISPR gRNA sequence
aaatccagagacaaacaaca

SEQ ID NO: 193347 - DNA, 20 bp, Artificial
  CRISPR gRNA sequence
atccagagacaaacaacaca

SEQ ID NO: 193348 - DNA, 20 bp, Artificial
  CRISPR gRNA sequence
caacacagagccatgttcta

SEQ ID NO: 193349 - DNA, 20 bp, Artificial
  CRISPR gRNA sequence
gccatgttctacagtatgta

SEQ ID NO: 193350 - DNA, 20 bp, Artificial
  CRISPR gRNA sequence
agtatgtacagttttccaaa

SEQ ID NO: 193351 - DNA, 20 bp, Artificial
  CRISPR gRNA sequence
agttttccaaaaagaatttc

SEQ ID NO: 193352 - DNA, 20 bp, Artificial
  CRISPR gRNA sequence
ctttacttttttattacaaa

SEQ ID NO: 193353 - DNA, 20 bp, Artificial
  CRISPR gRNA sequence
acgtatacttgcaaataatt

SEQ ID NO: 193354 - DNA, 20 bp, Artificial
  CRISPR gRNA sequence
tgcaaataattcagatactg

SEQ ID NO: 193355 - DNA, 20 bp, Artificial
  CRISPR gRNA sequence
aaataattcagatactgtgg

SEQ ID NO: 193356 - DNA, 20 bp, Artificial
  CRISPR gRNA sequence
ataattcagatactgtggaa

SEQ ID NO: 193357 - DNA, 20 bp, Artificial
  CRISPR gRNA sequence
agagatcaaatgaattgcaa

SEQ ID NO: 193358 - DNA, 20 bp, Artificial
  CRISPR gRNA sequence
cccttcaccactatctccca

SEQ ID NO: 193359 - DNA, 20 bp, Artificial
  CRISPR gRNA sequence
ccactatctcccatggcatg

SEQ ID NO: 193360 - DNA, 20 bp, Artificial
  CRISPR gRNA sequence
actatctcccatggcatgca

SEQ ID NO: 193361 - DNA, 20 bp, Artificial
  CRISPR gRNA sequence
tatctcccatggcatgcaga

SEQ ID NO: 193362 - DNA, 20 bp, Artificial
  CRISPR gRNA sequence
tctcccatggcatgcagaga

SEQ ID NO: 193363 - DNA, 20 bp, Artificial
  CRISPR gRNA sequence
ccattatttgtgtgtccctc

SEQ ID NO: 193364 - DNA, 20 bp, Artificial
  CRISPR gRNA sequence
ctactatttttttattttat

SEQ ID NO: 193365 - DNA, 20 bp, Artificial
  CRISPR gRNA sequence
tactatttttttattttatt

SEQ ID NO: 193366 - DNA, 20 bp, Artificial
  CRISPR gRNA sequence
ttttattttattaggtccgt

SEQ ID NO: 193367 - DNA, 20 bp, Artificial
  CRISPR gRNA sequence
tccgtcagttttcctttttt

SEQ ID NO: 193368 - DNA, 20 bp, Artificial
  CRISPR gRNA sequence
caaatgcaaataaatatatt

SEQ ID NO: 193369 - DNA, 20 bp, Artificial
  CRISPR gRNA sequence
ttcagaacaaaccccactgt

SEQ ID NO: 193370 - DNA, 20 bp, Artificial
  CRISPR gRNA sequence
tcagaacaaaccccactgta

SEQ ID NO: 193371 - DNA, 20 bp, Artificial
  CRISPR gRNA sequence
ctgtaaggttcacattaaaa

SEQ ID NO: 193372 - DNA, 20 bp, Artificial
  CRISPR gRNA sequence
ttcacattaaaaaagacttg

SEQ ID NO: 193373 - DNA, 20 bp, Artificial
  CRISPR gRNA sequence
agacttgaagtcaccctatg

SEQ ID NO: 193374 - DNA, 20 bp, Artificial
  CRISPR gRNA sequence
agacaaaaaataatcacatt

SEQ ID NO: 193375 - DNA, 20 bp, Artificial
  CRISPR gRNA sequence
aataatcacattaagtgtga

SEQ ID NO: 193376 - DNA, 20 bp, Artificial
  CRISPR gRNA sequence
tgtgaaagaacctattcttc

SEQ ID NO: 193377 - DNA, 20 bp, Artificial
  CRISPR gRNA sequence
aagaacctattcttccagta

SEQ ID NO: 193378 - DNA, 20 bp, Artificial
  CRISPR gRNA sequence
agaacctattcttccagtac

SEQ ID NO: 193379 - DNA, 20 bp, Artificial
  CRISPR gRNA sequence
ctattcttccagtacaggat

SEQ ID NO: 193380 - DNA, 20 bp, Artificial
  CRISPR gRNA sequence
acaggataagccatacttac

SEQ ID NO: 193381 - DNA, 20 bp, Artificial
  CRISPR gRNA sequence
caggataagccatacttact

SEQ ID NO: 193382 - DNA, 20 bp, Artificial
  CRISPR gRNA sequence
aatctatactgatgttgtct

SEQ ID NO: 193383 - DNA, 20 bp, Artificial
  CRISPR gRNA sequence
atctatactgatgttgtctt

SEQ ID NO: 193384 - DNA, 20 bp, Artificial
  CRISPR gRNA sequence
tctatactgatgttgtcttg

SEQ ID NO: 193385 - DNA, 20 bp, Artificial
  CRISPR gRNA sequence
tgttgtcttggggaattgaa

SEQ ID NO: 193386 - DNA, 20 bp, Artificial
  CRISPR gRNA sequence
gttgtcttggggaattgaaa

SEQ ID NO: 193387 - DNA, 20 bp, Artificial
  CRISPR gRNA sequence
ttggggaattgaaaaggaac

SEQ ID NO: 193388 - DNA, 20 bp, Artificial
  CRISPR gRNA sequence
tggggaattgaaaaggaact

SEQ ID NO: 193389 - DNA, 20 bp, Artificial
  CRISPR gRNA sequence
gggaattgaaaaggaactag

SEQ ID NO: 193390 - DNA, 20 bp, Artificial
  CRISPR gRNA sequence
tgaaaaggaactaggagtgt

SEQ ID NO: 193391 - DNA, 20 bp, Artificial
  CRISPR gRNA sequence
aactaggagtgttagttcct

SEQ ID NO: 193392 - DNA, 20 bp, Artificial
  CRISPR gRNA sequence
agttcctcggtattgaccca

SEQ ID NO: 193393 - DNA, 20 bp, Artificial
  CRISPR gRNA sequence
ttgacccacagttatgttat

SEQ ID NO: 193394 - DNA, 20 bp, Artificial
  CRISPR gRNA sequence
tgacccacagttatgttatc

SEQ ID NO: 193395 - DNA, 20 bp, Artificial
  CRISPR gRNA sequence
gttatgttatcaggtcactt

SEQ ID NO: 193396 - DNA, 20 bp, Artificial
  CRISPR gRNA sequence
tatcaggtcacttgagttca

SEQ ID NO: 193397 - DNA, 20 bp, Artificial
  CRISPR gRNA sequence
ttgagttcaaagttttgtgt

SEQ ID NO: 193398 - DNA, 20 bp, Artificial
  CRISPR gRNA sequence
tcaaagttttgtgttggcac

SEQ ID NO: 193399 - DNA, 20 bp, Artificial
  CRISPR gRNA sequence
gttttgtgttggcactagct

SEQ ID NO: 193400 - DNA, 20 bp, Artificial
  CRISPR gRNA sequence
gtgttggcactagctaagta

SEQ ID NO: 193401 - DNA, 20 bp, Artificial
  CRISPR gRNA sequence
tgttggcactagctaagtaa

SEQ ID NO: 193402 - DNA, 20 bp, Artificial
  CRISPR gRNA sequence
acacctctgctttcattgtt

SEQ ID NO: 193403 - DNA, 20 bp, Artificial
  CRISPR gRNA sequence
gctttcattgttgagtttca

SEQ ID NO: 193404 - DNA, 20 bp, Artificial
  CRISPR gRNA sequence
ttgttgagtttcacagaatt

SEQ ID NO: 193405 - DNA, 20 bp, Artificial
  CRISPR gRNA sequence
gttgagtttcacagaattga

SEQ ID NO: 193406 - DNA, 20 bp, Artificial
  CRISPR gRNA sequence
ttcacagaattgagagctga

SEQ ID NO: 193407 - DNA, 20 bp, Artificial
  CRISPR gRNA sequence
tcacagaattgagagctgaa

SEQ ID NO: 193408 - DNA, 20 bp, Artificial
  CRISPR gRNA sequence
attgagagctgaaaggatcc

SEQ ID NO: 193409 - DNA, 20 bp, Artificial
  CRISPR gRNA sequence
ttgagagctgaaaggatccc

SEQ ID NO: 193410 - DNA, 20 bp, Artificial
  CRISPR gRNA sequence
agagctgaaaggatcccagg

SEQ ID NO: 193411 - DNA, 20 bp, Artificial
  CRISPR gRNA sequence
gagctgaaaggatcccaggc

SEQ ID NO: 193412 - DNA, 20 bp, Artificial
  CRISPR gRNA sequence
gctgaaaggatcccaggcag

SEQ ID NO: 193413 - DNA, 20 bp, Artificial
  CRISPR gRNA sequence
gaaaggatcccaggcaggag

SEQ ID NO: 193414 - DNA, 20 bp, Artificial
  CRISPR gRNA sequence
agctaatccaaactcccaca

SEQ ID NO: 193415 - DNA, 20 bp, Artificial
  CRISPR gRNA sequence
cacaaagaacaaaaatcccc

SEQ ID NO: 193416 - DNA, 20 bp, Artificial
  CRISPR gRNA sequence
caaagaacaaaaatccccca

SEQ ID NO: 193417 - DNA, 20 bp, Artificial
  CRISPR gRNA sequence
aaagaacaaaaatcccccag

SEQ ID NO: 193418 - DNA, 20 bp, Artificial
  CRISPR gRNA sequence
tgttcttatatttcctgcaa

SEQ ID NO: 193419 - DNA, 20 bp, Artificial
  CRISPR gRNA sequence
gtccctgtcatatcccacaa

SEQ ID NO: 193420 - DNA, 20 bp, Artificial
  CRISPR gRNA sequence
acaatggcctccctgccatt

SEQ ID NO: 193421 - DNA, 20 bp, Artificial
  CRISPR gRNA sequence
ctgttgaaattactccctaa

SEQ ID NO: 193422 - DNA, 20 bp, Artificial
  CRISPR gRNA sequence
tgaaattactccctaatagt

SEQ ID NO: 193423 - DNA, 20 bp, Artificial
  CRISPR gRNA sequence
taagctgaaatctgcccctc

SEQ ID NO: 193424 - DNA, 20 bp, Artificial
  CRISPR gRNA sequence
gaaatctgcccctctagttg

SEQ ID NO: 193425 - DNA, 20 bp, Artificial
  CRISPR gRNA sequence
tgcccctctagttgtagtct

SEQ ID NO: 193426 - DNA, 20 bp, Artificial
  CRISPR gRNA sequence
gcccctctagttgtagtctt

SEQ ID NO: 193427 - DNA, 20 bp, Artificial
  CRISPR gRNA sequence
atgaccttttaatatttgac

SEQ ID NO: 193428 - DNA, 20 bp, Artificial
  CRISPR gRNA sequence
agaattaaatcatctcccct

SEQ ID NO: 193429 - DNA, 20 bp, Artificial
  CRISPR gRNA sequence
ccccttggtctttccattcc

SEQ ID NO: 193430 - DNA, 20 bp, Artificial
  CRISPR gRNA sequence
cccttggtctttccattcct

SEQ ID NO: 193431 - DNA, 20 bp, Artificial
  CRISPR gRNA sequence
gggctaactaccatcaatct

SEQ ID NO: 193432 - DNA, 20 bp, Artificial
  CRISPR gRNA sequence
ggctaactaccatcaatctg

SEQ ID NO: 193433 - DNA, 20 bp, Artificial
  CRISPR gRNA sequence
gctaactaccatcaatctga

SEQ ID NO: 193434 - DNA, 20 bp, Artificial
  CRISPR gRNA sequence
aatctgagggctaacaatac

SEQ ID NO: 193435 - DNA, 20 bp, Artificial
  CRISPR gRNA sequence
ctgagggctaacaatacaag

SEQ ID NO: 193436 - DNA, 20 bp, Artificial
  CRISPR gRNA sequence
gctaacaatacaagtagaaa

SEQ ID NO: 193437 - DNA, 20 bp, Artificial
  CRISPR gRNA sequence
aactcaaaaacaaaatcatg

SEQ ID NO: 193438 - DNA, 20 bp, Artificial
  CRISPR gRNA sequence
actcaaaaacaaaatcatgt

SEQ ID NO: 193439 - DNA, 20 bp, Artificial
  CRISPR gRNA sequence
ctcaaaaacaaaatcatgtg

SEQ ID NO: 193440 - DNA, 20 bp, Artificial
  CRISPR gRNA sequence
aacaaaatcatgtggggatt

SEQ ID NO: 193441 - DNA, 20 bp, Artificial
  CRISPR gRNA sequence
caaaatcatgtggggattaa

SEQ ID NO: 193442 - DNA, 20 bp, Artificial
  CRISPR gRNA sequence
ggggattaagagaaatgtat

SEQ ID NO: 193443 - DNA, 20 bp, Artificial
  CRISPR gRNA sequence
tcagttttatgttgtatttc

SEQ ID NO: 193444 - DNA, 20 bp, Artificial
  CRISPR gRNA sequence
gtatttctggtccctgatac

SEQ ID NO: 193445 - DNA, 20 bp, Artificial
  CRISPR gRNA sequence
tctggtccctgatactggct

SEQ ID NO: 193446 - DNA, 20 bp, Artificial
  CRISPR gRNA sequence
ctggtccctgatactggctc

SEQ ID NO: 193447 - DNA, 20 bp, Artificial
  CRISPR gRNA sequence
caggtaatgccactattgtc

SEQ ID NO: 193448 - DNA, 20 bp, Artificial
  CRISPR gRNA sequence
gtaatgccactattgtcaag

SEQ ID NO: 193449 - DNA, 20 bp, Artificial
  CRISPR gRNA sequence
tcaagaagataccacttgta

SEQ ID NO: 193450 - DNA, 20 bp, Artificial
  CRISPR gRNA sequence
agaagataccacttgtaaag

SEQ ID NO: 193451 - DNA, 20 bp, Artificial
  CRISPR gRNA sequence
ctccattcatgacatctctt

SEQ ID NO: 193452 - DNA, 20 bp, Artificial
  CRISPR gRNA sequence
tgacatctcttgagatgttg

SEQ ID NO: 193453 - DNA, 20 bp, Artificial
  CRISPR gRNA sequence
gatgttgtggtttatacttt

SEQ ID NO: 193454 - DNA, 20 bp, Artificial
  CRISPR gRNA sequence
ttatactttcagtttttctc

SEQ ID NO: 193455 - DNA, 20 bp, Artificial
  CRISPR gRNA sequence
tccagtccatccgcaaatat

SEQ ID NO: 193456 - DNA, 20 bp, Artificial
  CRISPR gRNA sequence
ccagtccatccgcaaatatc

SEQ ID NO: 193457 - DNA, 20 bp, Artificial
  CRISPR gRNA sequence
tcaggcatctactgtgttcc

SEQ ID NO: 193458 - DNA, 20 bp, Artificial
  CRISPR gRNA sequence
tactgtgttccaagatatta

SEQ ID NO: 193459 - DNA, 20 bp, Artificial
  CRISPR gRNA sequence
ttaaagaaatcatcatgact

SEQ ID NO: 193460 - DNA, 20 bp, Artificial
  CRISPR gRNA sequence
tcatgacttagcctcatcaa

SEQ ID NO: 193461 - DNA, 20 bp, Artificial
  CRISPR gRNA sequence
agcctcatcaacagcattgc

SEQ ID NO: 193462 - DNA, 20 bp, Artificial
  CRISPR gRNA sequence
atcaacagcattgctagatc

SEQ ID NO: 193463 - DNA, 20 bp, Artificial
  CRISPR gRNA sequence
tcaacagcattgctagatct

SEQ ID NO: 193464 - DNA, 20 bp, Artificial
  CRISPR gRNA sequence
cagcattgctagatctggga

SEQ ID NO: 193465 - DNA, 20 bp, Artificial
  CRISPR gRNA sequence
attgctagatctgggatgga

SEQ ID NO: 193466 - DNA, 20 bp, Artificial
  CRISPR gRNA sequence
ttgctagatctgggatggaa

SEQ ID NO: 193467 - DNA, 20 bp, Artificial
  CRISPR gRNA sequence
ctagatctgggatggaaagg

SEQ ID NO: 193468 - DNA, 20 bp, Artificial
  CRISPR gRNA sequence
agatctgggatggaaaggaa

SEQ ID NO: 193469 - DNA, 20 bp, Artificial
  CRISPR gRNA sequence
ggaaaggaagagtataatcc

SEQ ID NO: 193470 - DNA, 20 bp, Artificial
  CRISPR gRNA sequence
aaggaagagtataatcctgg

SEQ ID NO: 193471 - DNA, 20 bp, Artificial
  CRISPR gRNA sequence
aagagtataatcctggcagt

SEQ ID NO: 193472 - DNA, 20 bp, Artificial
  CRISPR gRNA sequence
agagtataatcctggcagtc

SEQ ID NO: 193473 - DNA, 20 bp, Artificial
  CRISPR gRNA sequence
gtataatcctggcagtcagg

SEQ ID NO: 193474 - DNA, 20 bp, Artificial
  CRISPR gRNA sequence
taatcctggcagtcaggaag

SEQ ID NO: 193475 - DNA, 20 bp, Artificial
  CRISPR gRNA sequence
aatcctggcagtcaggaaga

SEQ ID NO: 193476 - DNA, 20 bp, Artificial
  CRISPR gRNA sequence
cctggcagtcaggaagaagg

SEQ ID NO: 193477 - DNA, 20 bp, Artificial
  CRISPR gRNA sequence
gtcaggaagaaggcagcata

SEQ ID NO: 193478 - DNA, 20 bp, Artificial
  CRISPR gRNA sequence
aagaaggcagcataaagtat

SEQ ID NO: 193479 - DNA, 20 bp, Artificial
  CRISPR gRNA sequence
ataagtttctgcttccaaaa

SEQ ID NO: 193480 - DNA, 20 bp, Artificial
  CRISPR gRNA sequence
taagtttctgcttccaaaaa

SEQ ID NO: 193481 - DNA, 20 bp, Artificial
  CRISPR gRNA sequence
ttccaaaaaaggtctctcat

SEQ ID NO: 193482 - DNA, 20 bp, Artificial
  CRISPR gRNA sequence
aaaggtctctcatcagcctg

SEQ ID NO: 193483 - DNA, 20 bp, Artificial
  CRISPR gRNA sequence
aaggtctctcatcagcctgt

SEQ ID NO: 193484 - DNA, 20 bp, Artificial
  CRISPR gRNA sequence
aggtctctcatcagcctgta

SEQ ID NO: 193485 - DNA, 20 bp, Artificial
  CRISPR gRNA sequence
gtctctcatcagcctgtagg

SEQ ID NO: 193486 - DNA, 20 bp, Artificial
  CRISPR gRNA sequence
atcagcctgtagggagtgtg

SEQ ID NO: 193487 - DNA, 20 bp, Artificial
  CRISPR gRNA sequence
tcagcctgtagggagtgtgt

SEQ ID NO: 193488 - DNA, 20 bp, Artificial
  CRISPR gRNA sequence
cagcctgtagggagtgtgta

SEQ ID NO: 193489 - DNA, 20 bp, Artificial
  CRISPR gRNA sequence
cctgtagggagtgtgtaggg

SEQ ID NO: 193490 - DNA, 20 bp, Artificial
  CRISPR gRNA sequence
ctgtagggagtgtgtaggga

SEQ ID NO: 193491 - DNA, 20 bp, Artificial
  CRISPR gRNA sequence
tgtagggagtgtgtagggaa

SEQ ID NO: 193492 - DNA, 20 bp, Artificial
  CRISPR gRNA sequence
gggagtgtgtagggaaggga

SEQ ID NO: 193493 - DNA, 20 bp, Artificial
  CRISPR gRNA sequence
ggaagggacagctgtccttg

SEQ ID NO: 193494 - DNA, 20 bp, Artificial
  CRISPR gRNA sequence
agggacagctgtccttgtag

SEQ ID NO: 193495 - DNA, 20 bp, Artificial
  CRISPR gRNA sequence
gggacagctgtccttgtagt

SEQ ID NO: 193496 - DNA, 20 bp, Artificial
  CRISPR gRNA sequence
ggacagctgtccttgtagta

SEQ ID NO: 193497 - DNA, 20 bp, Artificial
  CRISPR gRNA sequence
cagctgtccttgtagtaggg

SEQ ID NO: 193498 - DNA, 20 bp, Artificial
  CRISPR gRNA sequence
agctgtccttgtagtaggga

SEQ ID NO: 193499 - DNA, 20 bp, Artificial
  CRISPR gRNA sequence
gctgtccttgtagtagggaa

SEQ ID NO: 193500 - DNA, 20 bp, Artificial
  CRISPR gRNA sequence
tagtagggaagggttttatt

SEQ ID NO: 193501 - DNA, 20 bp, Artificial
  CRISPR gRNA sequence
agtagggaagggttttattc

SEQ ID NO: 193502 - DNA, 20 bp, Artificial
  CRISPR gRNA sequence
agggttttattcaggtcgtc

SEQ ID NO: 193503 - DNA, 20 bp, Artificial
  CRISPR gRNA sequence
gggttttattcaggtcgtct

SEQ ID NO: 193504 - DNA, 20 bp, Artificial
  CRISPR gRNA sequence
taatatcccttgtgtatctg

SEQ ID NO: 193505 - DNA, 20 bp, Artificial
  CRISPR gRNA sequence
atctgcagtctcctttgcca

SEQ ID NO: 193506 - DNA, 20 bp, Artificial
  CRISPR gRNA sequence
tttgccatggatcaacacaa

SEQ ID NO: 193507 - DNA, 20 bp, Artificial
  CRISPR gRNA sequence
ttgccatggatcaacacaat

SEQ ID NO: 193508 - DNA, 20 bp, Artificial
  CRISPR gRNA sequence
caacacaataggaaatcttc

SEQ ID NO: 193509 - DNA, 20 bp, Artificial
  CRISPR gRNA sequence
aggaaatcttccggcactga

SEQ ID NO: 193510 - DNA, 20 bp, Artificial
  CRISPR gRNA sequence
ccggcactgatggtttttcc

SEQ ID NO: 193511 - DNA, 20 bp, Artificial
  CRISPR gRNA sequence
cggcactgatggtttttcca

SEQ ID NO: 193512 - DNA, 20 bp, Artificial
  CRISPR gRNA sequence
ggcactgatggtttttccaa

SEQ ID NO: 193513 - DNA, 20 bp, Artificial
  CRISPR gRNA sequence
gcactgatggtttttccaag

SEQ ID NO: 193514 - DNA, 20 bp, Artificial
  CRISPR gRNA sequence
cactgatggtttttccaagg

SEQ ID NO: 193515 - DNA, 20 bp, Artificial
  CRISPR gRNA sequence
ctgatggtttttccaagggg

SEQ ID NO: 193516 - DNA, 20 bp, Artificial
  CRISPR gRNA sequence
ttccaagggggagttcttcc

SEQ ID NO: 193517 - DNA, 20 bp, Artificial
  CRISPR gRNA sequence
ccaagggggagttcttcctg

SEQ ID NO: 193518 - DNA, 20 bp, Artificial
  CRISPR gRNA sequence
ggggagttcttcctggagca

SEQ ID NO: 193519 - DNA, 20 bp, Artificial
  CRISPR gRNA sequence
gagcaaagcaaatgaccaac

SEQ ID NO: 193520 - DNA, 20 bp, Artificial
  CRISPR gRNA sequence
agcaaagcaaatgaccaacc

SEQ ID NO: 193521 - DNA, 20 bp, Artificial
  CRISPR gRNA sequence
gcaaatgaccaaccaggttt

SEQ ID NO: 193522 - DNA, 20 bp, Artificial
  CRISPR gRNA sequence
caaatgaccaaccaggtttg

SEQ ID NO: 193523 - DNA, 20 bp, Artificial
  CRISPR gRNA sequence
tgtattgtaaattacttaat

SEQ ID NO: 193524 - DNA, 20 bp, Artificial
  CRISPR gRNA sequence
tccatcttgtcatttgcata

SEQ ID NO: 193525 - DNA, 20 bp, Artificial
  CRISPR gRNA sequence
atcttgtcatttgcatacag

SEQ ID NO: 193526 - DNA, 20 bp, Artificial
  CRISPR gRNA sequence
tcatttgcatacagtggttt

SEQ ID NO: 193527 - DNA, 20 bp, Artificial
  CRISPR gRNA sequence
catttgcatacagtggtttt

SEQ ID NO: 193528 - DNA, 20 bp, Artificial
  CRISPR gRNA sequence
catacagtggttttgggatt

SEQ ID NO: 193529 - DNA, 20 bp, Artificial
  CRISPR gRNA sequence
agtggttttgggattgagtt

SEQ ID NO: 193530 - DNA, 20 bp, Artificial
  CRISPR gRNA sequence
attgagttcagctataccaa

SEQ ID NO: 193531 - DNA, 20 bp, Artificial
  CRISPR gRNA sequence
aagtctgaaccttctgcact

SEQ ID NO: 193532 - DNA, 20 bp, Artificial
  CRISPR gRNA sequence
gaaccttctgcacttagaac

SEQ ID NO: 193533 - DNA, 20 bp, Artificial
  CRISPR gRNA sequence
aaccttctgcacttagaaca

SEQ ID NO: 193534 - DNA, 20 bp, Artificial
  CRISPR gRNA sequence
cttagaacaaggcaaccacc

SEQ ID NO: 193535 - DNA, 20 bp, Artificial
  CRISPR gRNA sequence
caccaagcttcacttgcact

SEQ ID NO: 193536 - DNA, 20 bp, Artificial
  CRISPR gRNA sequence
accaagcttcacttgcactg

SEQ ID NO: 193537 - DNA, 20 bp, Artificial
  CRISPR gRNA sequence
cactgaggccgtgtctccaa

SEQ ID NO: 193538 - DNA, 20 bp, Artificial
  CRISPR gRNA sequence
gccgtgtctccaatggaaat

SEQ ID NO: 193539 - DNA, 20 bp, Artificial
  CRISPR gRNA sequence
ccgtgtctccaatggaaatg

SEQ ID NO: 193540 - DNA, 20 bp, Artificial
  CRISPR gRNA sequence
tgtctccaatggaaatgagg

SEQ ID NO: 193541 - DNA, 20 bp, Artificial
  CRISPR gRNA sequence
tccaatggaaatgaggcagc

SEQ ID NO: 193542 - DNA, 20 bp, Artificial
  CRISPR gRNA sequence
gaaatgaggcagctggcttg

SEQ ID NO: 193543 - DNA, 20 bp, Artificial
  CRISPR gRNA sequence
aaatgaggcagctggcttgc

SEQ ID NO: 193544 - DNA, 20 bp, Artificial
  CRISPR gRNA sequence
atgaggcagctggcttgcag

SEQ ID NO: 193545 - DNA, 20 bp, Artificial
  CRISPR gRNA sequence
cttgcaggagcttcccaact

SEQ ID NO: 193546 - DNA, 20 bp, Artificial
  CRISPR gRNA sequence
ttgcaggagcttcccaactc

SEQ ID NO: 193547 - DNA, 20 bp, Artificial
  CRISPR gRNA sequence
tgcaggagcttcccaactca

SEQ ID NO: 193548 - DNA, 20 bp, Artificial
  CRISPR gRNA sequence
aggagcttcccaactcaggg

SEQ ID NO: 193549 - DNA, 20 bp, Artificial
  CRISPR gRNA sequence
agcttcccaactcagggaag

SEQ ID NO: 193550 - DNA, 20 bp, Artificial
  CRISPR gRNA sequence
ctcagggaagtagaactcct

SEQ ID NO: 193551 - DNA, 20 bp, Artificial
  CRISPR gRNA sequence
tccatatgcaaatgatttca

SEQ ID NO: 193552 - DNA, 20 bp, Artificial
  CRISPR gRNA sequence
ttgaacttcacttcccatca

SEQ ID NO: 193553 - DNA, 20 bp, Artificial
  CRISPR gRNA sequence
ttcccatcacagcaaatgtg

SEQ ID NO: 193554 - DNA, 20 bp, Artificial
  CRISPR gRNA sequence
acagcaaatgtgtggtaaca

SEQ ID NO: 193555 - DNA, 20 bp, Artificial
  CRISPR gRNA sequence
gtggtaacatagcttcccca

SEQ ID NO: 193556 - DNA, 20 bp, Artificial
  CRISPR gRNA sequence
tggtaacatagcttccccac

SEQ ID NO: 193557 - DNA, 20 bp, Artificial
  CRISPR gRNA sequence
gtaacatagcttccccacag

SEQ ID NO: 193558 - DNA, 20 bp, Artificial
  CRISPR gRNA sequence
ccacaggagtttactcacca

SEQ ID NO: 193559 - DNA, 20 bp, Artificial
  CRISPR gRNA sequence
ttactcaccatggtatttta

SEQ ID NO: 193560 - DNA, 20 bp, Artificial
  CRISPR gRNA sequence
tactcaccatggtattttaa

SEQ ID NO: 193561 - DNA, 20 bp, Artificial
  CRISPR gRNA sequence
atttcaaaactgaaatttga

SEQ ID NO: 193562 - DNA, 20 bp, Artificial
  CRISPR gRNA sequence
aactgaaatttgaaagaatt

SEQ ID NO: 193563 - DNA, 20 bp, Artificial
  CRISPR gRNA sequence
aatttgaaagaatttagttt

SEQ ID NO: 193564 - DNA, 20 bp, Artificial
  CRISPR gRNA sequence
ctcaattatcactatcactt

SEQ ID NO: 193565 - DNA, 20 bp, Artificial
  CRISPR gRNA sequence
tcaattatcactatcacttc

SEQ ID NO: 193566 - DNA, 20 bp, Artificial
  CRISPR gRNA sequence
attgcacctttcttgtttgt

SEQ ID NO: 193567 - DNA, 20 bp, Artificial
  CRISPR gRNA sequence
ttgtttgtgagtttaaatgc

SEQ ID NO: 193568 - DNA, 20 bp, Artificial
  CRISPR gRNA sequence
gagtttaaatgccagactct

SEQ ID NO: 193569 - DNA, 20 bp, Artificial
  CRISPR gRNA sequence
agtttaaatgccagactctc

SEQ ID NO: 193570 - DNA, 20 bp, Artificial
  CRISPR gRNA sequence
ggccactaactttcaattaa

SEQ ID NO: 193571 - DNA, 20 bp, Artificial
  CRISPR gRNA sequence
tctttaatcgctgaacctaa

SEQ ID NO: 193572 - DNA, 20 bp, Artificial
  CRISPR gRNA sequence
ttaatcgctgaacctaacag

SEQ ID NO: 193573 - DNA, 20 bp, Artificial
  CRISPR gRNA sequence
taatcgctgaacctaacagc

SEQ ID NO: 193574 - DNA, 20 bp, Artificial
  CRISPR gRNA sequence
aatcgctgaacctaacagca

SEQ ID NO: 193575 - DNA, 20 bp, Artificial
  CRISPR gRNA sequence
gggaaaacgaaatgttcatt

SEQ ID NO: 193576 - DNA, 20 bp, Artificial
  CRISPR gRNA sequence
gaaatgttcattcagacttt

SEQ ID NO: 193577 - DNA, 20 bp, Artificial
  CRISPR gRNA sequence
agactttcagaaccttcaat

SEQ ID NO: 193578 - DNA, 20 bp, Artificial
  CRISPR gRNA sequence
ttcagaaccttcaatgagat

SEQ ID NO: 193579 - DNA, 20 bp, Artificial
  CRISPR gRNA sequence
tcagaaccttcaatgagatt

SEQ ID NO: 193580 - DNA, 20 bp, Artificial
  CRISPR gRNA sequence
gaaccttcaatgagattagg

SEQ ID NO: 193581 - DNA, 20 bp, Artificial
  CRISPR gRNA sequence
caatgagattaggcagctga

SEQ ID NO: 193582 - DNA, 20 bp, Artificial
  CRISPR gRNA sequence
attaggcagctgaaagatca

SEQ ID NO: 193583 - DNA, 20 bp, Artificial
  CRISPR gRNA sequence
tgaaagatcaaagtgttgca

SEQ ID NO: 193584 - DNA, 20 bp, Artificial
  CRISPR gRNA sequence
gttgcatagttgtcccgata

SEQ ID NO: 193585 - DNA, 20 bp, Artificial
  CRISPR gRNA sequence
gttgtcccgataaagctatt

SEQ ID NO: 193586 - DNA, 20 bp, Artificial
  CRISPR gRNA sequence
ataaagctatttggatcata

SEQ ID NO: 193587 - DNA, 20 bp, Artificial
  CRISPR gRNA sequence
ccatctctccccaaaattcc

SEQ ID NO: 193588 - DNA, 20 bp, Artificial
  CRISPR gRNA sequence
caaaattcccagccctgttt

SEQ ID NO: 193589 - DNA, 20 bp, Artificial
  CRISPR gRNA sequence
ccctgtttaagtgttctctg

SEQ ID NO: 193590 - DNA, 20 bp, Artificial
  CRISPR gRNA sequence
ctgtagcatttatctctatc

SEQ ID NO: 193591 - DNA, 20 bp, Artificial
  CRISPR gRNA sequence
tctctatctagtatattgtg

SEQ ID NO: 193592 - DNA, 20 bp, Artificial
  CRISPR gRNA sequence
gtttattgtctctctcctcc

SEQ ID NO: 193593 - DNA, 20 bp, Artificial
  CRISPR gRNA sequence
tcctagaatataaactccac

SEQ ID NO: 193594 - DNA, 20 bp, Artificial
  CRISPR gRNA sequence
atataaactccacaagcaca

SEQ ID NO: 193595 - DNA, 20 bp, Artificial
  CRISPR gRNA sequence
actccacaagcacaaagatt

SEQ ID NO: 193596 - DNA, 20 bp, Artificial
  CRISPR gRNA sequence
ctccacaagcacaaagattt

SEQ ID NO: 193597 - DNA, 20 bp, Artificial
  CRISPR gRNA sequence
ttataatattgttgcatccc

SEQ ID NO: 193598 - DNA, 20 bp, Artificial
  CRISPR gRNA sequence
tataatattgttgcatcccc

SEQ ID NO: 193599 - DNA, 20 bp, Artificial
  CRISPR gRNA sequence
ataatattgttgcatcccca

SEQ ID NO: 193600 - DNA, 20 bp, Artificial
  CRISPR gRNA sequence
catccccagggcctgatata

SEQ ID NO: 193601 - DNA, 20 bp, Artificial
  CRISPR gRNA sequence
ccccagggcctgatatacag

SEQ ID NO: 193602 - DNA, 20 bp, Artificial
  CRISPR gRNA sequence
ccagggcctgatatacagca

SEQ ID NO: 193603 - DNA, 20 bp, Artificial
  CRISPR gRNA sequence
gggcctgatatacagcagag

SEQ ID NO: 193604 - DNA, 20 bp, Artificial
  CRISPR gRNA sequence
cctgatatacagcagagtgg

SEQ ID NO: 193605 - DNA, 20 bp, Artificial
  CRISPR gRNA sequence
cagcagagtggtggtacgaa

SEQ ID NO: 193606 - DNA, 20 bp, Artificial
  CRISPR gRNA sequence
gcagagtggtggtacgaaaa

SEQ ID NO: 193607 - DNA, 20 bp, Artificial
  CRISPR gRNA sequence
cacacaaaaaaatatttgtt

SEQ ID NO: 193608 - DNA, 20 bp, Artificial
  CRISPR gRNA sequence
gaatgaatgatttcctcaaa

SEQ ID NO: 193609 - DNA, 20 bp, Artificial
  CRISPR gRNA sequence
aatgaatgatttcctcaaat

SEQ ID NO: 193610 - DNA, 20 bp, Artificial
  CRISPR gRNA sequence
atgatttcctcaaataggat

SEQ ID NO: 193611 - DNA, 20 bp, Artificial
  CRISPR gRNA sequence
ataggattagcctaaaattt

SEQ ID NO: 193612 - DNA, 20 bp, Artificial
  CRISPR gRNA sequence
taaaattttggaaacatgaa

SEQ ID NO: 193613 - DNA, 20 bp, Artificial
  CRISPR gRNA sequence
tttggaaacatgaacagatt

SEQ ID NO: 193614 - DNA, 20 bp, Artificial
  CRISPR gRNA sequence
gatatgtgaaaatttatttc

SEQ ID NO: 193615 - DNA, 20 bp, Artificial
  CRISPR gRNA sequence
tttatttccagactgttcat

SEQ ID NO: 193616 - DNA, 20 bp, Artificial
  CRISPR gRNA sequence
ttatttccagactgttcatc

SEQ ID NO: 193617 - DNA, 20 bp, Artificial
  CRISPR gRNA sequence
gactgttcatcaggaactgt

SEQ ID NO: 193618 - DNA, 20 bp, Artificial
  CRISPR gRNA sequence
tgttcatcaggaactgttag

SEQ ID NO: 193619 - DNA, 20 bp, Artificial
  CRISPR gRNA sequence
ggaactgttagcagcttcta

SEQ ID NO: 193620 - DNA, 20 bp, Artificial
  CRISPR gRNA sequence
gaactgttagcagcttctaa

SEQ ID NO: 193621 - DNA, 20 bp, Artificial
  CRISPR gRNA sequence
aactgttagcagcttctaaa

SEQ ID NO: 193622 - DNA, 20 bp, Artificial
  CRISPR gRNA sequence
gcagcttctaaagggtacac

SEQ ID NO: 193623 - DNA, 20 bp, Artificial
  CRISPR gRNA sequence
agcttctaaagggtacactg

SEQ ID NO: 193624 - DNA, 20 bp, Artificial
  CRISPR gRNA sequence
ttctaaagggtacactggag

SEQ ID NO: 193625 - DNA, 20 bp, Artificial
  CRISPR gRNA sequence
taaagggtacactggagcag

SEQ ID NO: 193626 - DNA, 20 bp, Artificial
  CRISPR gRNA sequence
agggtacactggagcagcag

SEQ ID NO: 193627 - DNA, 20 bp, Artificial
  CRISPR gRNA sequence
cactggagcagcagtagtaa

SEQ ID NO: 193628 - DNA, 20 bp, Artificial
  CRISPR gRNA sequence
actggagcagcagtagtaaa

SEQ ID NO: 193629 - DNA, 20 bp, Artificial
  CRISPR gRNA sequence
tggagcagcagtagtaaaag

SEQ ID NO: 193630 - DNA, 20 bp, Artificial
  CRISPR gRNA sequence
ggagcagcagtagtaaaagg

SEQ ID NO: 193631 - DNA, 20 bp, Artificial
  CRISPR gRNA sequence
gcagcagtagtaaaaggagg

SEQ ID NO: 193632 - DNA, 20 bp, Artificial
  CRISPR gRNA sequence
agcagtagtaaaaggaggaa

SEQ ID NO: 193633 - DNA, 20 bp, Artificial
  CRISPR gRNA sequence
gcagtagtaaaaggaggaag

SEQ ID NO: 193634 - DNA, 20 bp, Artificial
  CRISPR gRNA sequence
agtagtaaaaggaggaagag

SEQ ID NO: 193635 - DNA, 20 bp, Artificial
  CRISPR gRNA sequence
agtaaaaggaggaagaggag

SEQ ID NO: 193636 - DNA, 20 bp, Artificial
  CRISPR gRNA sequence
gctctgctactgctactatc

SEQ ID NO: 193637 - DNA, 20 bp, Artificial
  CRISPR gRNA sequence
ctatcgagtactactacaat

SEQ ID NO: 193638 - DNA, 20 bp, Artificial
  CRISPR gRNA sequence
cacttgcttattctgtgtgt

SEQ ID NO: 193639 - DNA, 20 bp, Artificial
  CRISPR gRNA sequence
acttgcttattctgtgtgtt

SEQ ID NO: 193640 - DNA, 20 bp, Artificial
  CRISPR gRNA sequence
actgaacactctgtctaaat

SEQ ID NO: 193641 - DNA, 20 bp, Artificial
  CRISPR gRNA sequence
taaattagttcatttcctcc

SEQ ID NO: 193642 - DNA, 20 bp, Artificial
  CRISPR gRNA sequence
tttcctcctggaaatgactc

SEQ ID NO: 193643 - DNA, 20 bp, Artificial
  CRISPR gRNA sequence
ttcctcctggaaatgactct

SEQ ID NO: 193644 - DNA, 20 bp, Artificial
  CRISPR gRNA sequence
tcctcctggaaatgactcta

SEQ ID NO: 193645 - DNA, 20 bp, Artificial
  CRISPR gRNA sequence
cctcctggaaatgactctag

SEQ ID NO: 193646 - DNA, 20 bp, Artificial
  CRISPR gRNA sequence
ctcctggaaatgactctagg

SEQ ID NO: 193647 - DNA, 20 bp, Artificial
  CRISPR gRNA sequence
tggaaatgactctagggggt

SEQ ID NO: 193648 - DNA, 20 bp, Artificial
  CRISPR gRNA sequence
gggtaagtgcttcatcatgt

SEQ ID NO: 193649 - DNA, 20 bp, Artificial
  CRISPR gRNA sequence
agtgcttcatcatgtaagat

SEQ ID NO: 193650 - DNA, 20 bp, Artificial
  CRISPR gRNA sequence
ttttgttgtgtctgaaatct

SEQ ID NO: 193651 - DNA, 20 bp, Artificial
  CRISPR gRNA sequence
ctgagtgtgtctttcaatga

SEQ ID NO: 193652 - DNA, 20 bp, Artificial
  CRISPR gRNA sequence
ggaatctttgattccatgat

SEQ ID NO: 193653 - DNA, 20 bp, Artificial
  CRISPR gRNA sequence
atctttgattccatgataag

SEQ ID NO: 193654 - DNA, 20 bp, Artificial
  CRISPR gRNA sequence
agtggtattattcccatttt

SEQ ID NO: 193655 - DNA, 20 bp, Artificial
  CRISPR gRNA sequence
gtggtattattcccatttta

SEQ ID NO: 193656 - DNA, 20 bp, Artificial
  CRISPR gRNA sequence
attattcccattttaaggat

SEQ ID NO: 193657 - DNA, 20 bp, Artificial
  CRISPR gRNA sequence
ttattcccattttaaggatg

SEQ ID NO: 193658 - DNA, 20 bp, Artificial
  CRISPR gRNA sequence
attttaaggatgaggaaact

SEQ ID NO: 193659 - DNA, 20 bp, Artificial
  CRISPR gRNA sequence
ttttaaggatgaggaaactg

SEQ ID NO: 193660 - DNA, 20 bp, Artificial
  CRISPR gRNA sequence
gatgaggaaactgaggtcca

SEQ ID NO: 193661 - DNA, 20 bp, Artificial
  CRISPR gRNA sequence
aactgaggtccaaagaaatt

SEQ ID NO: 193662 - DNA, 20 bp, Artificial
  CRISPR gRNA sequence
gtaatttgcccaaattcacc

SEQ ID NO: 193663 - DNA, 20 bp, Artificial
  CRISPR gRNA sequence
ttgcccaaattcacccagcc

SEQ ID NO: 193664 - DNA, 20 bp, Artificial
  CRISPR gRNA sequence
acccagcctagaaaatgata

SEQ ID NO: 193665 - DNA, 20 bp, Artificial
  CRISPR gRNA sequence
agcctagaaaatgataaagc

SEQ ID NO: 193666 - DNA, 20 bp, Artificial
  CRISPR gRNA sequence
ataaagctagttctaaaccc

SEQ ID NO: 193667 - DNA, 20 bp, Artificial
  CRISPR gRNA sequence
aagctagttctaaacccaag

SEQ ID NO: 193668 - DNA, 20 bp, Artificial
  CRISPR gRNA sequence
agttctaaacccaagcagat

SEQ ID NO: 193669 - DNA, 20 bp, Artificial
  CRISPR gRNA sequence
acccaagcagattagctctg

SEQ ID NO: 193670 - DNA, 20 bp, Artificial
  CRISPR gRNA sequence
agcagattagctctgaagtc

SEQ ID NO: 193671 - DNA, 20 bp, Artificial
  CRISPR gRNA sequence
gcagattagctctgaagtct

SEQ ID NO: 193672 - DNA, 20 bp, Artificial
  CRISPR gRNA sequence
attgcctatatttgtacctc

SEQ ID NO: 193673 - DNA, 20 bp, Artificial
  CRISPR gRNA sequence
gtacctctggtgtacgtatc

SEQ ID NO: 193674 - DNA, 20 bp, Artificial
  CRISPR gRNA sequence
aaactatcatgaccttttct

SEQ ID NO: 193675 - DNA, 20 bp, Artificial
  CRISPR gRNA sequence
tggttttgattgtccaacat

SEQ ID NO: 193676 - DNA, 20 bp, Artificial
  CRISPR gRNA sequence
ttgattgtccaacattagta

SEQ ID NO: 193677 - DNA, 20 bp, Artificial
  CRISPR gRNA sequence
ccaacattagtatagtgttc

SEQ ID NO: 193678 - DNA, 20 bp, Artificial
  CRISPR gRNA sequence
caacattagtatagtgttct

SEQ ID NO: 193679 - DNA, 20 bp, Artificial
  CRISPR gRNA sequence
tttactttctgttaatatat

SEQ ID NO: 193680 - DNA, 20 bp, Artificial
  CRISPR gRNA sequence
taatatataagttgtatcat

SEQ ID NO: 193681 - DNA, 20 bp, Artificial
  CRISPR gRNA sequence
ataagaaactgccgtttttg

SEQ ID NO: 193682 - DNA, 20 bp, Artificial
  CRISPR gRNA sequence
aagaaactgccgtttttgaa

SEQ ID NO: 193683 - DNA, 20 bp, Artificial
  CRISPR gRNA sequence
ccgtttttgaagagcaaaaa

SEQ ID NO: 193684 - DNA, 20 bp, Artificial
  CRISPR gRNA sequence
cgtttttgaagagcaaaaaa

SEQ ID NO: 193685 - DNA, 20 bp, Artificial
  CRISPR gRNA sequence
aaaaaaaggttgaatgttac

SEQ ID NO: 193686 - DNA, 20 bp, Artificial
  CRISPR gRNA sequence
tgaatgttaccagttacatc

SEQ ID NO: 193687 - DNA, 20 bp, Artificial
  CRISPR gRNA sequence
ttacatctggttcaacctaa

SEQ ID NO: 193688 - DNA, 20 bp, Artificial
  CRISPR gRNA sequence
aatagacatttgtacaaaaa

SEQ ID NO: 193689 - DNA, 20 bp, Artificial
  CRISPR gRNA sequence
tgtacaaaaacagacatttt

SEQ ID NO: 193690 - DNA, 20 bp, Artificial
  CRISPR gRNA sequence
tacaaaaacagacattttaa

SEQ ID NO: 193691 - DNA, 20 bp, Artificial
  CRISPR gRNA sequence
acaaaaacagacattttaag

SEQ ID NO: 193692 - DNA, 20 bp, Artificial
  CRISPR gRNA sequence
aatttaataaacaatatttt

SEQ ID NO: 193693 - DNA, 20 bp, Artificial
  CRISPR gRNA sequence
ttgtgatgcttcactatcat

SEQ ID NO: 193694 - DNA, 20 bp, Artificial
  CRISPR gRNA sequence
ctatcattagctaatatgtc

SEQ ID NO: 193695 - DNA, 20 bp, Artificial
  CRISPR gRNA sequence
tatcattagctaatatgtca

SEQ ID NO: 193696 - DNA, 20 bp, Artificial
  CRISPR gRNA sequence
tgtcaaggcataatatacct

SEQ ID NO: 193697 - DNA, 20 bp, Artificial
  CRISPR gRNA sequence
gtcaaggcataatatacctt

SEQ ID NO: 193698 - DNA, 20 bp, Artificial
  CRISPR gRNA sequence
tcaaggcataatatacctta

SEQ ID NO: 193699 - DNA, 20 bp, Artificial
  CRISPR gRNA sequence
ggtgaactttatcattaaca

SEQ ID NO: 193700 - DNA, 20 bp, Artificial
  CRISPR gRNA sequence
gtgaactttatcattaacaa

SEQ ID NO: 193701 - DNA, 20 bp, Artificial
  CRISPR gRNA sequence
aactttatcattaacaaagg

SEQ ID NO: 193702 - DNA, 20 bp, Artificial
  CRISPR gRNA sequence
ttatcattaacaaaggtgga

SEQ ID NO: 193703 - DNA, 20 bp, Artificial
  CRISPR gRNA sequence
tggatggtgtcaataatctt

SEQ ID NO: 193704 - DNA, 20 bp, Artificial
  CRISPR gRNA sequence
ggatggtgtcaataatcttg

SEQ ID NO: 193705 - DNA, 20 bp, Artificial
  CRISPR gRNA sequence
gtttttttatataacactgc

SEQ ID NO: 193706 - DNA, 20 bp, Artificial
  CRISPR gRNA sequence
tttttttatataacactgcg

SEQ ID NO: 193707 - DNA, 20 bp, Artificial
  CRISPR gRNA sequence
taacactgcgaggtctaatt

SEQ ID NO: 193708 - DNA, 20 bp, Artificial
  CRISPR gRNA sequence
ttactgtttaccacctcata

SEQ ID NO: 193709 - DNA, 20 bp, Artificial
  CRISPR gRNA sequence
ctgtttaccacctcatacag

SEQ ID NO: 193710 - DNA, 20 bp, Artificial
  CRISPR gRNA sequence
ctcatacagtggccgataaa

SEQ ID NO: 193711 - DNA, 20 bp, Artificial
  CRISPR gRNA sequence
gtcacttctgctgtttcctc

SEQ ID NO: 193712 - DNA, 20 bp, Artificial
  CRISPR gRNA sequence
tcacttctgctgtttcctct

SEQ ID NO: 193713 - DNA, 20 bp, Artificial
  CRISPR gRNA sequence
ctgggttgtgcttgaattat

SEQ ID NO: 193714 - DNA, 20 bp, Artificial
  CRISPR gRNA sequence
tgaattattagtattatctt

SEQ ID NO: 193715 - DNA, 20 bp, Artificial
  CRISPR gRNA sequence
ttagtattatcttcagtcct

SEQ ID NO: 193716 - DNA, 20 bp, Artificial
  CRISPR gRNA sequence
ttcagtcctcagtttctttg

SEQ ID NO: 193717 - DNA, 20 bp, Artificial
  CRISPR gRNA sequence
tcagtcctcagtttctttgt

SEQ ID NO: 193718 - DNA, 20 bp, Artificial
  CRISPR gRNA sequence
tttgtgggaaactttttaat

SEQ ID NO: 193719 - DNA, 20 bp, Artificial
  CRISPR gRNA sequence
aattagttgtttaattttgt

SEQ ID NO: 193720 - DNA, 20 bp, Artificial
  CRISPR gRNA sequence
agttgtttaattttgtaaga

SEQ ID NO: 193721 - DNA, 20 bp, Artificial
  CRISPR gRNA sequence
gtttaattttgtaagatggt

SEQ ID NO: 193722 - DNA, 20 bp, Artificial
  CRISPR gRNA sequence
attttgtaagatggttagtt

SEQ ID NO: 193723 - DNA, 20 bp, Artificial
  CRISPR gRNA sequence
atggttagtttagtcaaaat

SEQ ID NO: 193724 - DNA, 20 bp, Artificial
  CRISPR gRNA sequence
tagtttagtcaaaattagat

SEQ ID NO: 193725 - DNA, 20 bp, Artificial
  CRISPR gRNA sequence
gtttagtcaaaattagataa

SEQ ID NO: 193726 - DNA, 20 bp, Artificial
  CRISPR gRNA sequence
taagagaatttgaaaatccg

SEQ ID NO: 193727 - DNA, 20 bp, Artificial
  CRISPR gRNA sequence
gaaaatccgtagctacccca

SEQ ID NO: 193728 - DNA, 20 bp, Artificial
  CRISPR gRNA sequence
ccccaaagcaacctacacat

SEQ ID NO: 193729 - DNA, 20 bp, Artificial
  CRISPR gRNA sequence
atcataattttattgatttc

SEQ ID NO: 193730 - DNA, 20 bp, Artificial
  CRISPR gRNA sequence
ttgatttccagtgtttccac

SEQ ID NO: 193731 - DNA, 20 bp, Artificial
  CRISPR gRNA sequence
atttccagtgtttccactgg

SEQ ID NO: 193732 - DNA, 20 bp, Artificial
  CRISPR gRNA sequence
tccagtgtttccactggtag

SEQ ID NO: 193733 - DNA, 20 bp, Artificial
  CRISPR gRNA sequence
tggtagtggtttcattgata

SEQ ID NO: 193734 - DNA, 20 bp, Artificial
  CRISPR gRNA sequence
ggtagtggtttcattgatat

SEQ ID NO: 193735 - DNA, 20 bp, Artificial
  CRISPR gRNA sequence
tagtggtttcattgatatag

SEQ ID NO: 193736 - DNA, 20 bp, Artificial
  CRISPR gRNA sequence
acatcactcattatttattt

SEQ ID NO: 193737 - DNA, 20 bp, Artificial
  CRISPR gRNA sequence
atttcagtttcatttgatcc

SEQ ID NO: 193738 - DNA, 20 bp, Artificial
  CRISPR gRNA sequence
ttttgtattaactctctgtg

SEQ ID NO: 193739 - DNA, 20 bp, Artificial
  CRISPR gRNA sequence
cacaaatctattgctgtcct

SEQ ID NO: 193740 - DNA, 20 bp, Artificial
  CRISPR gRNA sequence
atctattgctgtccttggta

SEQ ID NO: 193741 - DNA, 20 bp, Artificial
  CRISPR gRNA sequence
tctattgctgtccttggtaa

SEQ ID NO: 193742 - DNA, 20 bp, Artificial
  CRISPR gRNA sequence
tgctgtccttggtaaaggaa

SEQ ID NO: 193743 - DNA, 20 bp, Artificial
  CRISPR gRNA sequence
ctgtccttggtaaaggaatg

SEQ ID NO: 193744 - DNA, 20 bp, Artificial
  CRISPR gRNA sequence
tggtaaaggaatggagaatt

SEQ ID NO: 193745 - DNA, 20 bp, Artificial
  CRISPR gRNA sequence
ggtaaaggaatggagaatta

SEQ ID NO: 193746 - DNA, 20 bp, Artificial
  CRISPR gRNA sequence
ggaatggagaattaaggctc

SEQ ID NO: 193747 - DNA, 20 bp, Artificial
  CRISPR gRNA sequence
gaattaaggctctagatcat

SEQ ID NO: 193748 - DNA, 20 bp, Artificial
  CRISPR gRNA sequence
ttaaggctctagatcattag

SEQ ID NO: 193749 - DNA, 20 bp, Artificial
  CRISPR gRNA sequence
gatcattagtggttacacta

SEQ ID NO: 193750 - DNA, 20 bp, Artificial
  CRISPR gRNA sequence
tagtggttacactatagtat

SEQ ID NO: 193751 - DNA, 20 bp, Artificial
  CRISPR gRNA sequence
tggttacactatagtattag

SEQ ID NO: 193752 - DNA, 20 bp, Artificial
  CRISPR gRNA sequence
atagtattagaagtaaaaaa

SEQ ID NO: 193753 - DNA, 20 bp, Artificial
  CRISPR gRNA sequence
aaagattataccaacaaaat

SEQ ID NO: 193754 - DNA, 20 bp, Artificial
  CRISPR gRNA sequence
gtaatgaataaacatgaata

SEQ ID NO: 193755 - DNA, 20 bp, Artificial
  CRISPR gRNA sequence
aataaagctcttatgctata

SEQ ID NO: 193756 - DNA, 20 bp, Artificial
  CRISPR gRNA sequence
ataaagctcttatgctatat

SEQ ID NO: 193757 - DNA, 20 bp, Artificial
  CRISPR gRNA sequence
aggtgcactaaacaatctac

SEQ ID NO: 193758 - DNA, 20 bp, Artificial
  CRISPR gRNA sequence
aaacaatctactagaattgt

SEQ ID NO: 193759 - DNA, 20 bp, Artificial
  CRISPR gRNA sequence
actacgtatcttaatcctga

SEQ ID NO: 193760 - DNA, 20 bp, Artificial
  CRISPR gRNA sequence
ctacgtatcttaatcctgaa

SEQ ID NO: 193761 - DNA, 20 bp, Artificial
  CRISPR gRNA sequence
tacgtatcttaatcctgaaa

SEQ ID NO: 193762 - DNA, 20 bp, Artificial
  CRISPR gRNA sequence
tgaatcaaactttcttcctt

SEQ ID NO: 193763 - DNA, 20 bp, Artificial
  CRISPR gRNA sequence
acttaaatgatttattaaaa

SEQ ID NO: 193764 - DNA, 20 bp, Artificial
  CRISPR gRNA sequence
aaatgatttattaaaatagc

SEQ ID NO: 193765 - DNA, 20 bp, Artificial
  CRISPR gRNA sequence
ttaaaatagccagcatttaa

SEQ ID NO: 193766 - DNA, 20 bp, Artificial
  CRISPR gRNA sequence
aaaatgtaaatatcataatg

SEQ ID NO: 193767 - DNA, 20 bp, Artificial
  CRISPR gRNA sequence
aatatcataatgtggtatcc

SEQ ID NO: 193768 - DNA, 20 bp, Artificial
  CRISPR gRNA sequence
tcataatgtggtatcctaga

SEQ ID NO: 193769 - DNA, 20 bp, Artificial
  CRISPR gRNA sequence
tggtatcctagatagcatcc

SEQ ID NO: 193770 - DNA, 20 bp, Artificial
  CRISPR gRNA sequence
tcctagatagcatcccagaa

SEQ ID NO: 193771 - DNA, 20 bp, Artificial
  CRISPR gRNA sequence
atagcatcccagaacagaaa

SEQ ID NO: 193772 - DNA, 20 bp, Artificial
  CRISPR gRNA sequence
tagcatcccagaacagaaaa

SEQ ID NO: 193773 - DNA, 20 bp, Artificial
  CRISPR gRNA sequence
ccagaacagaaaaaggatat

SEQ ID NO: 193774 - DNA, 20 bp, Artificial
  CRISPR gRNA sequence
cagaacagaaaaaggatatt

SEQ ID NO: 193775 - DNA, 20 bp, Artificial
  CRISPR gRNA sequence
agaacagaaaaaggatatta

SEQ ID NO: 193776 - DNA, 20 bp, Artificial
  CRISPR gRNA sequence
aaaggatattagggaaaaac

SEQ ID NO: 193777 - DNA, 20 bp, Artificial
  CRISPR gRNA sequence
aggatattagggaaaaactg

SEQ ID NO: 193778 - DNA, 20 bp, Artificial
  CRISPR gRNA sequence
ggatattagggaaaaactgg

SEQ ID NO: 193779 - DNA, 20 bp, Artificial
  CRISPR gRNA sequence
ttagggaaaaactggaggaa

SEQ ID NO: 193780 - DNA, 20 bp, Artificial
  CRISPR gRNA sequence
gaggaatggaataaattatg

SEQ ID NO: 193781 - DNA, 20 bp, Artificial
  CRISPR gRNA sequence
atggaataaattatgcagtt

SEQ ID NO: 193782 - DNA, 20 bp, Artificial
  CRISPR gRNA sequence
taataatgtactaacgtcct

SEQ ID NO: 193783 - DNA, 20 bp, Artificial
  CRISPR gRNA sequence
tagttatgacgattgtacca

SEQ ID NO: 193784 - DNA, 20 bp, Artificial
  CRISPR gRNA sequence
cgattgtaccatggtaatgt

SEQ ID NO: 193785 - DNA, 20 bp, Artificial
  CRISPR gRNA sequence
gtaatgtaagatactaacaa

SEQ ID NO: 193786 - DNA, 20 bp, Artificial
  CRISPR gRNA sequence
aatgtaagatactaacaata

SEQ ID NO: 193787 - DNA, 20 bp, Artificial
  CRISPR gRNA sequence
atgtaagatactaacaatag

SEQ ID NO: 193788 - DNA, 20 bp, Artificial
  CRISPR gRNA sequence
atactaacaatagaggaaac

SEQ ID NO: 193789 - DNA, 20 bp, Artificial
  CRISPR gRNA sequence
tactaacaatagaggaaacc

SEQ ID NO: 193790 - DNA, 20 bp, Artificial
  CRISPR gRNA sequence
aacaatagaggaaaccgggt

SEQ ID NO: 193791 - DNA, 20 bp, Artificial
  CRISPR gRNA sequence
acaatagaggaaaccgggta

SEQ ID NO: 193792 - DNA, 20 bp, Artificial
  CRISPR gRNA sequence
aatagaggaaaccgggtaag

SEQ ID NO: 193793 - DNA, 20 bp, Artificial
  CRISPR gRNA sequence
gaaaccgggtaaggagtata

SEQ ID NO: 193794 - DNA, 20 bp, Artificial
  CRISPR gRNA sequence
aatttaaaacttctaaaata

SEQ ID NO: 193795 - DNA, 20 bp, Artificial
  CRISPR gRNA sequence
gaacaaatttaaacattaaa

SEQ ID NO: 193796 - DNA, 20 bp, Artificial
  CRISPR gRNA sequence
taaacattaaaaagtatcac

SEQ ID NO: 193797 - DNA, 20 bp, Artificial
  CRISPR gRNA sequence
aaacattaaaaagtatcacc

SEQ ID NO: 193798 - DNA, 20 bp, Artificial
  CRISPR gRNA sequence
ggaacatatatcactgttta

SEQ ID NO: 193799 - DNA, 20 bp, Artificial
  CRISPR gRNA sequence
tctgatcattgacttcaaat

SEQ ID NO: 193800 - DNA, 20 bp, Artificial
  CRISPR gRNA sequence
tcattgacttcaaatcagaa

SEQ ID NO: 193801 - DNA, 20 bp, Artificial
  CRISPR gRNA sequence
agtgaatgacacctcaaaat

SEQ ID NO: 193802 - DNA, 20 bp, Artificial
  CRISPR gRNA sequence
gtgaatgacacctcaaaatc

SEQ ID NO: 193803 - DNA, 20 bp, Artificial
  CRISPR gRNA sequence
atcaggttttctgtttactg

SEQ ID NO: 193804 - DNA, 20 bp, Artificial
  CRISPR gRNA sequence
ttttctgtttactgaagtct

SEQ ID NO: 193805 - DNA, 20 bp, Artificial
  CRISPR gRNA sequence
tgtttactgaagtctaagaa

SEQ ID NO: 193806 - DNA, 20 bp, Artificial
  CRISPR gRNA sequence
tactgaagtctaagaaaaga

SEQ ID NO: 193807 - DNA, 20 bp, Artificial
  CRISPR gRNA sequence
tctaagaaaagaaagcatac

SEQ ID NO: 193808 - DNA, 20 bp, Artificial
  CRISPR gRNA sequence
agaaaagaaagcataccagc

SEQ ID NO: 193809 - DNA, 20 bp, Artificial
  CRISPR gRNA sequence
aaaagaaagcataccagctg

SEQ ID NO: 193810 - DNA, 20 bp, Artificial
  CRISPR gRNA sequence
aagaaagcataccagctgga

SEQ ID NO: 193811 - DNA, 20 bp, Artificial
  CRISPR gRNA sequence
tggagagattcatgtttata

SEQ ID NO: 193812 - DNA, 20 bp, Artificial
  CRISPR gRNA sequence
gagattcatgtttataaaga

SEQ ID NO: 193813 - DNA, 20 bp, Artificial
  CRISPR gRNA sequence
acaacaaaaataaaatatcc

SEQ ID NO: 193814 - DNA, 20 bp, Artificial
  CRISPR gRNA sequence
aaatatccaagaataaattt

SEQ ID NO: 193815 - DNA, 20 bp, Artificial
  CRISPR gRNA sequence
tatccaagaataaatttaag

SEQ ID NO: 193816 - DNA, 20 bp, Artificial
  CRISPR gRNA sequence
ccaagaataaatttaagaag

SEQ ID NO: 193817 - DNA, 20 bp, Artificial
  CRISPR gRNA sequence
ttaagaagaagcactttact

SEQ ID NO: 193818 - DNA, 20 bp, Artificial
  CRISPR gRNA sequence
catatgaaaacctgaacaaa

SEQ ID NO: 193819 - DNA, 20 bp, Artificial
  CRISPR gRNA sequence
tatgaaaacctgaacaaatg

SEQ ID NO: 193820 - DNA, 20 bp, Artificial
  CRISPR gRNA sequence
tgaaaacctgaacaaatgga

SEQ ID NO: 193821 - DNA, 20 bp, Artificial
  CRISPR gRNA sequence
gaaaacctgaacaaatggag

SEQ ID NO: 193822 - DNA, 20 bp, Artificial
  CRISPR gRNA sequence
aaaacctgaacaaatggaga

SEQ ID NO: 193823 - DNA, 20 bp, Artificial
  CRISPR gRNA sequence
agggatattttgtatttgaa

SEQ ID NO: 193824 - DNA, 20 bp, Artificial
  CRISPR gRNA sequence
atattttgtatttgaataga

SEQ ID NO: 193825 - DNA, 20 bp, Artificial
  CRISPR gRNA sequence
tatttgaatagaaagacttc

SEQ ID NO: 193826 - DNA, 20 bp, Artificial
  CRISPR gRNA sequence
atagaaagacttctggttta

SEQ ID NO: 193827 - DNA, 20 bp, Artificial
  CRISPR gRNA sequence
tctctttaaattattttttg

SEQ ID NO: 193828 - DNA, 20 bp, Artificial
  CRISPR gRNA sequence
attattttttgtagaaattt

SEQ ID NO: 193829 - DNA, 20 bp, Artificial
  CRISPR gRNA sequence
ttattttttgtagaaattta

SEQ ID NO: 193830 - DNA, 20 bp, Artificial
  CRISPR gRNA sequence
tattttttgtagaaatttaa

SEQ ID NO: 193831 - DNA, 20 bp, Artificial
  CRISPR gRNA sequence
attttttgtagaaatttaag

SEQ ID NO: 193832 - DNA, 20 bp, Artificial
  CRISPR gRNA sequence
tgtagaaatttaaggggtac

SEQ ID NO: 193833 - DNA, 20 bp, Artificial
  CRISPR gRNA sequence
tagaaatttaaggggtacaa

SEQ ID NO: 193834 - DNA, 20 bp, Artificial
  CRISPR gRNA sequence
aaatttaaggggtacaagag

SEQ ID NO: 193835 - DNA, 20 bp, Artificial
  CRISPR gRNA sequence
acaagagcagtgttgtcaca

SEQ ID NO: 193836 - DNA, 20 bp, Artificial
  CRISPR gRNA sequence
tgtcacatggatatattaca

SEQ ID NO: 193837 - DNA, 20 bp, Artificial
  CRISPR gRNA sequence
cacatggatatattacatag

SEQ ID NO: 193838 - DNA, 20 bp, Artificial
  CRISPR gRNA sequence
ggatatattacatagtggtg

SEQ ID NO: 193839 - DNA, 20 bp, Artificial
  CRISPR gRNA sequence
tattacatagtggtgaagtc

SEQ ID NO: 193840 - DNA, 20 bp, Artificial
  CRISPR gRNA sequence
attacatagtggtgaagtct

SEQ ID NO: 193841 - DNA, 20 bp, Artificial
  CRISPR gRNA sequence
ttacatagtggtgaagtctg

SEQ ID NO: 193842 - DNA, 20 bp, Artificial
  CRISPR gRNA sequence
agtggtgaagtctggggttt

SEQ ID NO: 193843 - DNA, 20 bp, Artificial
  CRISPR gRNA sequence
ttaatctttacattttgttt

SEQ ID NO: 193844 - DNA, 20 bp, Artificial
  CRISPR gRNA sequence
atgtaccaacatgattttta

SEQ ID NO: 193845 - DNA, 20 bp, Artificial
  CRISPR gRNA sequence
accaacatgatttttataga

SEQ ID NO: 193846 - DNA, 20 bp, Artificial
  CRISPR gRNA sequence
acatgatttttatagaaaga

SEQ ID NO: 193847 - DNA, 20 bp, Artificial
  CRISPR gRNA sequence
tcccaactttgaattgaatt

SEQ ID NO: 193848 - DNA, 20 bp, Artificial
  CRISPR gRNA sequence
cccaactttgaattgaattg

SEQ ID NO: 193849 - DNA, 20 bp, Artificial
  CRISPR gRNA sequence
aactttgaattgaattgagg

SEQ ID NO: 193850 - DNA, 20 bp, Artificial
  CRISPR gRNA sequence
ctttgaattgaattgaggca

SEQ ID NO: 193851 - DNA, 20 bp, Artificial
  CRISPR gRNA sequence
gaattgaattgaggcagagc

SEQ ID NO: 193852 - DNA, 20 bp, Artificial
  CRISPR gRNA sequence
ttgaattgaggcagagctag

SEQ ID NO: 193853 - DNA, 20 bp, Artificial
  CRISPR gRNA sequence
tgaattgaggcagagctagc

SEQ ID NO: 193854 - DNA, 20 bp, Artificial
  CRISPR gRNA sequence
gagctagcaggtgttcccca

SEQ ID NO: 193855 - DNA, 20 bp, Artificial
  CRISPR gRNA sequence
agcaggtgttccccacggct

SEQ ID NO: 193856 - DNA, 20 bp, Artificial
  CRISPR gRNA sequence
gcaggtgttccccacggctg

SEQ ID NO: 193857 - DNA, 20 bp, Artificial
  CRISPR gRNA sequence
ggctgaggcatctgaacatt

SEQ ID NO: 193858 - DNA, 20 bp, Artificial
  CRISPR gRNA sequence
aacattaagcatatccctct

SEQ ID NO: 193859 - DNA, 20 bp, Artificial
  CRISPR gRNA sequence
aagcatatccctctgagaac

SEQ ID NO: 193860 - DNA, 20 bp, Artificial
  CRISPR gRNA sequence
cattgatactctttctaatg

SEQ ID NO: 193861 - DNA, 20 bp, Artificial
  CRISPR gRNA sequence
gatactctttctaatgtgga

SEQ ID NO: 193862 - DNA, 20 bp, Artificial
  CRISPR gRNA sequence
tttctaatgtggacagcatc

SEQ ID NO: 193863 - DNA, 20 bp, Artificial
  CRISPR gRNA sequence
acagcatcaagctatgtacg

SEQ ID NO: 193864 - DNA, 20 bp, Artificial
  CRISPR gRNA sequence
tatgtacgtagttctgtgct

SEQ ID NO: 193865 - DNA, 20 bp, Artificial
  CRISPR gRNA sequence
cgtagttctgtgctcagcaa

SEQ ID NO: 193866 - DNA, 20 bp, Artificial
  CRISPR gRNA sequence
acttctttttgtttatgtcc

SEQ ID NO: 193867 - DNA, 20 bp, Artificial
  CRISPR gRNA sequence
ccatacaacaaaatcaacca

SEQ ID NO: 193868 - DNA, 20 bp, Artificial
  CRISPR gRNA sequence
caaaatcaaccaaagaattt

SEQ ID NO: 193869 - DNA, 20 bp, Artificial
  CRISPR gRNA sequence
caaccaaagaattttggttg

SEQ ID NO: 193870 - DNA, 20 bp, Artificial
  CRISPR gRNA sequence
aagaattttggttgtggatc

SEQ ID NO: 193871 - DNA, 20 bp, Artificial
  CRISPR gRNA sequence
ctgaacatgaactgacatgt

SEQ ID NO: 193872 - DNA, 20 bp, Artificial
  CRISPR gRNA sequence
tgaacatgaactgacatgtc

SEQ ID NO: 193873 - DNA, 20 bp, Artificial
  CRISPR gRNA sequence
atgaactgacatgtcaggct

SEQ ID NO: 193874 - DNA, 20 bp, Artificial
  CRISPR gRNA sequence
tgaactgacatgtcaggctg

SEQ ID NO: 193875 - DNA, 20 bp, Artificial
  CRISPR gRNA sequence
gaactgacatgtcaggctga

SEQ ID NO: 193876 - DNA, 20 bp, Artificial
  CRISPR gRNA sequence
gtcaggctgagggctacccc

SEQ ID NO: 193877 - DNA, 20 bp, Artificial
  CRISPR gRNA sequence
tcaggctgagggctacccca

SEQ ID NO: 193878 - DNA, 20 bp, Artificial
  CRISPR gRNA sequence
tgagggctaccccaaggccg

SEQ ID NO: 193879 - DNA, 20 bp, Artificial
  CRISPR gRNA sequence
accccaaggccgaagtcatc

SEQ ID NO: 193880 - DNA, 20 bp, Artificial
  CRISPR gRNA sequence
aaggccgaagtcatctggac

SEQ ID NO: 193881 - DNA, 20 bp, Artificial
  CRISPR gRNA sequence
gccgaagtcatctggacaag

SEQ ID NO: 193882 - DNA, 20 bp, Artificial
  CRISPR gRNA sequence
ctggacaagcagtgaccatc

SEQ ID NO: 193883 - DNA, 20 bp, Artificial
  CRISPR gRNA sequence
agcagtgaccatcaagtcct

SEQ ID NO: 193884 - DNA, 20 bp, Artificial
  CRISPR gRNA sequence
agtgaccatcaagtcctgag

SEQ ID NO: 193885 - DNA, 20 bp, Artificial
  CRISPR gRNA sequence
accatcaagtcctgagtggt

SEQ ID NO: 193886 - DNA, 20 bp, Artificial
  CRISPR gRNA sequence
agaccaccaccaccaattcc

SEQ ID NO: 193887 - DNA, 20 bp, Artificial
  CRISPR gRNA sequence
accaccaccaccaattccaa

SEQ ID NO: 193888 - DNA, 20 bp, Artificial
  CRISPR gRNA sequence
caccaccaccaattccaaga

SEQ ID NO: 193889 - DNA, 20 bp, Artificial
  CRISPR gRNA sequence
ccaccaccaattccaagaga

SEQ ID NO: 193890 - DNA, 20 bp, Artificial
  CRISPR gRNA sequence
caccaccaattccaagagag

SEQ ID NO: 193891 - DNA, 20 bp, Artificial
  CRISPR gRNA sequence
ccaccaattccaagagagag

SEQ ID NO: 193892 - DNA, 20 bp, Artificial
  CRISPR gRNA sequence
ccaattccaagagagaggag

SEQ ID NO: 193893 - DNA, 20 bp, Artificial
  CRISPR gRNA sequence
gagaagcttttcaatgtgac

SEQ ID NO: 193894 - DNA, 20 bp, Artificial
  CRISPR gRNA sequence
ttcaatgtgaccagcacact

SEQ ID NO: 193895 - DNA, 20 bp, Artificial
  CRISPR gRNA sequence
gaatcaacacaacaactaat

SEQ ID NO: 193896 - DNA, 20 bp, Artificial
  CRISPR gRNA sequence
gagattttctactgcacttt

SEQ ID NO: 193897 - DNA, 20 bp, Artificial
  CRISPR gRNA sequence
agattttctactgcactttt

SEQ ID NO: 193898 - DNA, 20 bp, Artificial
  CRISPR gRNA sequence
attttctactgcacttttag

SEQ ID NO: 193899 - DNA, 20 bp, Artificial
  CRISPR gRNA sequence
ctactgcacttttaggagat

SEQ ID NO: 193900 - DNA, 20 bp, Artificial
  CRISPR gRNA sequence
cttttaggagattagatcct

SEQ ID NO: 193901 - DNA, 20 bp, Artificial
  CRISPR gRNA sequence
ttttaggagattagatcctg

SEQ ID NO: 193902 - DNA, 20 bp, Artificial
  CRISPR gRNA sequence
agatcctgaggaaaaccata

SEQ ID NO: 193903 - DNA, 20 bp, Artificial
  CRISPR gRNA sequence
ggaaaaccatacagctgaat

SEQ ID NO: 193904 - DNA, 20 bp, Artificial
  CRISPR gRNA sequence
tacagctgaattggtcatcc

SEQ ID NO: 193905 - DNA, 20 bp, Artificial
  CRISPR gRNA sequence
acagctgaattggtcatccc

SEQ ID NO: 193906 - DNA, 20 bp, Artificial
  CRISPR gRNA sequence
atatgtctaacactgtcccc

SEQ ID NO: 193907 - DNA, 20 bp, Artificial
  CRISPR gRNA sequence
taacactgtcccctagcacc

SEQ ID NO: 193908 - DNA, 20 bp, Artificial
  CRISPR gRNA sequence
agcatgatgtctgcctatca

SEQ ID NO: 193909 - DNA, 20 bp, Artificial
  CRISPR gRNA sequence
gtctgcctatcatagtcatt

SEQ ID NO: 193910 - DNA, 20 bp, Artificial
  CRISPR gRNA sequence
attgttacttaataaacatt

SEQ ID NO: 193911 - DNA, 20 bp, Artificial
  CRISPR gRNA sequence
gttacttaataaacattcag

SEQ ID NO: 193912 - DNA, 20 bp, Artificial
  CRISPR gRNA sequence
aaacattcagcagatattta

SEQ ID NO: 193913 - DNA, 20 bp, Artificial
  CRISPR gRNA sequence
accttttgttccatgcattg

SEQ ID NO: 193914 - DNA, 20 bp, Artificial
  CRISPR gRNA sequence
ccatgcattgtagtactcat

SEQ ID NO: 193915 - DNA, 20 bp, Artificial
  CRISPR gRNA sequence
tagtactcattggatacaca

SEQ ID NO: 193916 - DNA, 20 bp, Artificial
  CRISPR gRNA sequence
ttggatacacatagaataat

SEQ ID NO: 193917 - DNA, 20 bp, Artificial
  CRISPR gRNA sequence
acacatagaataataagact

SEQ ID NO: 193918 - DNA, 20 bp, Artificial
  CRISPR gRNA sequence
aagactcagttcacactctt

SEQ ID NO: 193919 - DNA, 20 bp, Artificial
  CRISPR gRNA sequence
agactcagttcacactcttc

SEQ ID NO: 193920 - DNA, 20 bp, Artificial
  CRISPR gRNA sequence
agttcacactcttcaggaaa

SEQ ID NO: 193921 - DNA, 20 bp, Artificial
  CRISPR gRNA sequence
caggaaacagataaaaaact

SEQ ID NO: 193922 - DNA, 20 bp, Artificial
  CRISPR gRNA sequence
actaagaaacaaacaaaaaa

SEQ ID NO: 193923 - DNA, 20 bp, Artificial
  CRISPR gRNA sequence
ctaagaaacaaacaaaaaac

SEQ ID NO: 193924 - DNA, 20 bp, Artificial
  CRISPR gRNA sequence
acaggcaatccaacaccatg

SEQ ID NO: 193925 - DNA, 20 bp, Artificial
  CRISPR gRNA sequence
caggcaatccaacaccatgt

SEQ ID NO: 193926 - DNA, 20 bp, Artificial
  CRISPR gRNA sequence
ccatgtgggaaatgctttca

SEQ ID NO: 193927 - DNA, 20 bp, Artificial
  CRISPR gRNA sequence
gtgggaaatgctttcatagc

SEQ ID NO: 193928 - DNA, 20 bp, Artificial
  CRISPR gRNA sequence
tgggaaatgctttcatagcc

SEQ ID NO: 193929 - DNA, 20 bp, Artificial
  CRISPR gRNA sequence
gctttcatagccgggaaacc

SEQ ID NO: 193930 - DNA, 20 bp, Artificial
  CRISPR gRNA sequence
ctttcatagccgggaaacct

SEQ ID NO: 193931 - DNA, 20 bp, Artificial
  CRISPR gRNA sequence
tttcatagccgggaaacctg

SEQ ID NO: 193932 - DNA, 20 bp, Artificial
  CRISPR gRNA sequence
gggaaacctggggaatacct

SEQ ID NO: 193933 - DNA, 20 bp, Artificial
  CRISPR gRNA sequence
gaaacctggggaatacctga

SEQ ID NO: 193934 - DNA, 20 bp, Artificial
  CRISPR gRNA sequence
aaacctggggaatacctgag

SEQ ID NO: 193935 - DNA, 20 bp, Artificial
  CRISPR gRNA sequence
cctgagaggaatactcaatt

SEQ ID NO: 193936 - DNA, 20 bp, Artificial
  CRISPR gRNA sequence
ctgagaggaatactcaattc

SEQ ID NO: 193937 - DNA, 20 bp, Artificial
  CRISPR gRNA sequence
actcaattcaggccttgttt

SEQ ID NO: 193938 - DNA, 20 bp, Artificial
  CRISPR gRNA sequence
ctcaattcaggccttgtttc

SEQ ID NO: 193939 - DNA, 20 bp, Artificial
  CRISPR gRNA sequence
tgtttcaggaatccaaatcc

SEQ ID NO: 193940 - DNA, 20 bp, Artificial
  CRISPR gRNA sequence
gaatccaaatcctggcacat

SEQ ID NO: 193941 - DNA, 20 bp, Artificial
  CRISPR gRNA sequence
atccaaatcctggcacatca

SEQ ID NO: 193942 - DNA, 20 bp, Artificial
  CRISPR gRNA sequence
cagagctgcttccctctttc

SEQ ID NO: 193943 - DNA, 20 bp, Artificial
  CRISPR gRNA sequence
agagctgcttccctctttcc

SEQ ID NO: 193944 - DNA, 20 bp, Artificial
  CRISPR gRNA sequence
gagctgcttccctctttcca

SEQ ID NO: 193945 - DNA, 20 bp, Artificial
  CRISPR gRNA sequence
ctgcttccctctttccaggg

SEQ ID NO: 193946 - DNA, 20 bp, Artificial
  CRISPR gRNA sequence
cttccctctttccagggtgg

SEQ ID NO: 193947 - DNA, 20 bp, Artificial
  CRISPR gRNA sequence
ttccctctttccagggtggc

SEQ ID NO: 193948 - DNA, 20 bp, Artificial
  CRISPR gRNA sequence
ccagggtggcaggaaataaa

SEQ ID NO: 193949 - DNA, 20 bp, Artificial
  CRISPR gRNA sequence
ttctatcttatgccaaacat

SEQ ID NO: 193950 - DNA, 20 bp, Artificial
  CRISPR gRNA sequence
tctatcttatgccaaacatg

SEQ ID NO: 193951 - DNA, 20 bp, Artificial
  CRISPR gRNA sequence
ctatcttatgccaaacatga

SEQ ID NO: 193952 - DNA, 20 bp, Artificial
  CRISPR gRNA sequence
catgagggaccctttctccc

SEQ ID NO: 193953 - DNA, 20 bp, Artificial
  CRISPR gRNA sequence
ttctccccggtgcctctccc

SEQ ID NO: 193954 - DNA, 20 bp, Artificial
  CRISPR gRNA sequence
tctccccggtgcctctccca

SEQ ID NO: 193955 - DNA, 20 bp, Artificial
  CRISPR gRNA sequence
ccccggtgcctctcccaagg

SEQ ID NO: 193956 - DNA, 20 bp, Artificial
  CRISPR gRNA sequence
agtctacaatatttcaactc

SEQ ID NO: 193957 - DNA, 20 bp, Artificial
  CRISPR gRNA sequence
ctacaatatttcaactctag

SEQ ID NO: 193958 - DNA, 20 bp, Artificial
  CRISPR gRNA sequence
ttcaactctagcagtctgct

SEQ ID NO: 193959 - DNA, 20 bp, Artificial
  CRISPR gRNA sequence
ctagcagtctgcttagtgca

SEQ ID NO: 193960 - DNA, 20 bp, Artificial
  CRISPR gRNA sequence
ctgcttagtgcatagaacat

SEQ ID NO: 193961 - DNA, 20 bp, Artificial
  CRISPR gRNA sequence
tgcttagtgcatagaacatg

SEQ ID NO: 193962 - DNA, 20 bp, Artificial
  CRISPR gRNA sequence
aacatgaggctgtgtgtccc

SEQ ID NO: 193963 - DNA, 20 bp, Artificial
  CRISPR gRNA sequence
acatgaggctgtgtgtccct

SEQ ID NO: 193964 - DNA, 20 bp, Artificial
  CRISPR gRNA sequence
tgtgtccctgggcaaattac

SEQ ID NO: 193965 - DNA, 20 bp, Artificial
  CRISPR gRNA sequence
tgtgtgcttcactttccctg

SEQ ID NO: 193966 - DNA, 20 bp, Artificial
  CRISPR gRNA sequence
gtgtgcttcactttccctgt

SEQ ID NO: 193967 - DNA, 20 bp, Artificial
  CRISPR gRNA sequence
ctgtaggattataatctact

SEQ ID NO: 193968 - DNA, 20 bp, Artificial
  CRISPR gRNA sequence
aggattataatctactgagc

SEQ ID NO: 193969 - DNA, 20 bp, Artificial
  CRISPR gRNA sequence
ctactgagcaagcttattgt

SEQ ID NO: 193970 - DNA, 20 bp, Artificial
  CRISPR gRNA sequence
tactgagcaagcttattgta

SEQ ID NO: 193971 - DNA, 20 bp, Artificial
  CRISPR gRNA sequence
actgagcaagcttattgtaa

SEQ ID NO: 193972 - DNA, 20 bp, Artificial
  CRISPR gRNA sequence
agcaagcttattgtaagggt

SEQ ID NO: 193973 - DNA, 20 bp, Artificial
  CRISPR gRNA sequence
gcttattgtaagggtcagat

SEQ ID NO: 193974 - DNA, 20 bp, Artificial
  CRISPR gRNA sequence
tgtaagggtcagattagcaa

SEQ ID NO: 193975 - DNA, 20 bp, Artificial
  CRISPR gRNA sequence
acagtgtatgaaaatgattt

SEQ ID NO: 193976 - DNA, 20 bp, Artificial
  CRISPR gRNA sequence
ttttttatctcactactcta

SEQ ID NO: 193977 - DNA, 20 bp, Artificial
  CRISPR gRNA sequence
tttatctcactactctacag

SEQ ID NO: 193978 - DNA, 20 bp, Artificial
  CRISPR gRNA sequence
atctcactactctacagaag

SEQ ID NO: 193979 - DNA, 20 bp, Artificial
  CRISPR gRNA sequence
tctcactactctacagaagt

SEQ ID NO: 193980 - DNA, 20 bp, Artificial
  CRISPR gRNA sequence
cactactctacagaagtagg

SEQ ID NO: 193981 - DNA, 20 bp, Artificial
  CRISPR gRNA sequence
actactctacagaagtaggt

SEQ ID NO: 193982 - DNA, 20 bp, Artificial
  CRISPR gRNA sequence
ctactctacagaagtaggta

SEQ ID NO: 193983 - DNA, 20 bp, Artificial
  CRISPR gRNA sequence
ctctacagaagtaggtaggg

SEQ ID NO: 193984 - DNA, 20 bp, Artificial
  CRISPR gRNA sequence
tctacagaagtaggtagggt

SEQ ID NO: 193985 - DNA, 20 bp, Artificial
  CRISPR gRNA sequence
tacagaagtaggtagggtgg

SEQ ID NO: 193986 - DNA, 20 bp, Artificial
  CRISPR gRNA sequence
gaagtaggtagggtgggaga

SEQ ID NO: 193987 - DNA, 20 bp, Artificial
  CRISPR gRNA sequence
agtaggtagggtgggagaca

SEQ ID NO: 193988 - DNA, 20 bp, Artificial
  CRISPR gRNA sequence
ggtgggagacagagtctgat

SEQ ID NO: 193989 - DNA, 20 bp, Artificial
  CRISPR gRNA sequence
tgggagacagagtctgatga

SEQ ID NO: 193990 - DNA, 20 bp, Artificial
  CRISPR gRNA sequence
gggagacagagtctgatgag

SEQ ID NO: 193991 - DNA, 20 bp, Artificial
  CRISPR gRNA sequence
acagagtctgatgagaggct

SEQ ID NO: 193992 - DNA, 20 bp, Artificial
  CRISPR gRNA sequence
atgagaggctcagaatgtga

SEQ ID NO: 193993 - DNA, 20 bp, Artificial
  CRISPR gRNA sequence
gaggctcagaatgtgaaaga

SEQ ID NO: 193994 - DNA, 20 bp, Artificial
  CRISPR gRNA sequence
ctcagaatgtgaaagaaagt

SEQ ID NO: 193995 - DNA, 20 bp, Artificial
  CRISPR gRNA sequence
tcagaatgtgaaagaaagtg

SEQ ID NO: 193996 - DNA, 20 bp, Artificial
  CRISPR gRNA sequence
aatgtgaaagaaagtgaggc

SEQ ID NO: 193997 - DNA, 20 bp, Artificial
  CRISPR gRNA sequence
tgaaagaaagtgaggcgagt

SEQ ID NO: 193998 - DNA, 20 bp, Artificial
  CRISPR gRNA sequence
tgatatttaatataaacaca

SEQ ID NO: 193999 - DNA, 20 bp, Artificial
  CRISPR gRNA sequence
tataaacacaaagatattct

SEQ ID NO: 194000 - DNA, 20 bp, Artificial
  CRISPR gRNA sequence
aaacacaaagatattctgag

SEQ ID NO: 194001 - DNA, 20 bp, Artificial
  CRISPR gRNA sequence
acacaaagatattctgagaa

SEQ ID NO: 194002 - DNA, 20 bp, Artificial
  CRISPR gRNA sequence
cctcccccaatacatgttga

SEQ ID NO: 194003 - DNA, 20 bp, Artificial
  CRISPR gRNA sequence
ctcccccaatacatgttgat

SEQ ID NO: 194004 - DNA, 20 bp, Artificial
  CRISPR gRNA sequence
taggaaaatgccacgtactt

SEQ ID NO: 194005 - DNA, 20 bp, Artificial
  CRISPR gRNA sequence
agcaaaaacaactgaaaaat

SEQ ID NO: 194006 - DNA, 20 bp, Artificial
  CRISPR gRNA sequence
aaaacaactgaaaaattaga

SEQ ID NO: 194007 - DNA, 20 bp, Artificial
  CRISPR gRNA sequence
aactgaaaaattagatagaa

SEQ ID NO: 194008 - DNA, 20 bp, Artificial
  CRISPR gRNA sequence
tagatagaaaagtcaatcaa

SEQ ID NO: 194009 - DNA, 20 bp, Artificial
  CRISPR gRNA sequence
agatagaaaagtcaatcaat

SEQ ID NO: 194010 - DNA, 20 bp, Artificial
  CRISPR gRNA sequence
gaaaagtcaatcaataggaa

SEQ ID NO: 194011 - DNA, 20 bp, Artificial
  CRISPR gRNA sequence
atcaataggaaaagataatc

SEQ ID NO: 194012 - DNA, 20 bp, Artificial
  CRISPR gRNA sequence
tcaataggaaaagataatcc

SEQ ID NO: 194013 - DNA, 20 bp, Artificial
  CRISPR gRNA sequence
taggaaaagataatccagga

SEQ ID NO: 194014 - DNA, 20 bp, Artificial
  CRISPR gRNA sequence
atccaggacggtgttgtgaa

SEQ ID NO: 194015 - DNA, 20 bp, Artificial
  CRISPR gRNA sequence
aggacggtgttgtgaacaga

SEQ ID NO: 194016 - DNA, 20 bp, Artificial
  CRISPR gRNA sequence
gacggtgttgtgaacagaaa

SEQ ID NO: 194017 - DNA, 20 bp, Artificial
  CRISPR gRNA sequence
acggtgttgtgaacagaaag

SEQ ID NO: 194018 - DNA, 20 bp, Artificial
  CRISPR gRNA sequence
cggtgttgtgaacagaaaga

SEQ ID NO: 194019 - DNA, 20 bp, Artificial
  CRISPR gRNA sequence
ggtgttgtgaacagaaagag

SEQ ID NO: 194020 - DNA, 20 bp, Artificial
  CRISPR gRNA sequence
gtgttgtgaacagaaagagg

SEQ ID NO: 194021 - DNA, 20 bp, Artificial
  CRISPR gRNA sequence
gaaagagggggaaaaaactt

SEQ ID NO: 194022 - DNA, 20 bp, Artificial
  CRISPR gRNA sequence
gaaaaaactttagaaaatga

SEQ ID NO: 194023 - DNA, 20 bp, Artificial
  CRISPR gRNA sequence
aaaaaactttagaaaatgat

SEQ ID NO: 194024 - DNA, 20 bp, Artificial
  CRISPR gRNA sequence
aaaaactttagaaaatgatg

SEQ ID NO: 194025 - DNA, 20 bp, Artificial
  CRISPR gRNA sequence
aatgatggggatgctcttac

SEQ ID NO: 194026 - DNA, 20 bp, Artificial
  CRISPR gRNA sequence
atgatggggatgctcttact

SEQ ID NO: 194027 - DNA, 20 bp, Artificial
  CRISPR gRNA sequence
tgatggggatgctcttactg

SEQ ID NO: 194028 - DNA, 20 bp, Artificial
  CRISPR gRNA sequence
ggatgctcttactggggtac

SEQ ID NO: 194029 - DNA, 20 bp, Artificial
  CRISPR gRNA sequence
cttactggggtacgagtcct

SEQ ID NO: 194030 - DNA, 20 bp, Artificial
  CRISPR gRNA sequence
ttactggggtacgagtcctc

SEQ ID NO: 194031 - DNA, 20 bp, Artificial
  CRISPR gRNA sequence
cgagtcctcaggtattgaac

SEQ ID NO: 194032 - DNA, 20 bp, Artificial
  CRISPR gRNA sequence
tcaggtattgaactggcttt

SEQ ID NO: 194033 - DNA, 20 bp, Artificial
  CRISPR gRNA sequence
attgaactggctttcagtaa

SEQ ID NO: 194034 - DNA, 20 bp, Artificial
  CRISPR gRNA sequence
aactggctttcagtaaaagc

SEQ ID NO: 194035 - DNA, 20 bp, Artificial
  CRISPR gRNA sequence
gctttcagtaaaagctagat

SEQ ID NO: 194036 - DNA, 20 bp, Artificial
  CRISPR gRNA sequence
ttcagtaaaagctagattag

SEQ ID NO: 194037 - DNA, 20 bp, Artificial
  CRISPR gRNA sequence
tcagtaaaagctagattagt

SEQ ID NO: 194038 - DNA, 20 bp, Artificial
  CRISPR gRNA sequence
agtgggttcctgccatttac

SEQ ID NO: 194039 - DNA, 20 bp, Artificial
  CRISPR gRNA sequence
ttttatgacaacttacttgt

SEQ ID NO: 194040 - DNA, 20 bp, Artificial
  CRISPR gRNA sequence
tttatgacaacttacttgtt

SEQ ID NO: 194041 - DNA, 20 bp, Artificial
  CRISPR gRNA sequence
atgacaacttacttgttggg

SEQ ID NO: 194042 - DNA, 20 bp, Artificial
  CRISPR gRNA sequence
cttacttgttgggtggccta

SEQ ID NO: 194043 - DNA, 20 bp, Artificial
  CRISPR gRNA sequence
gtaactcacctaactgcact

SEQ ID NO: 194044 - DNA, 20 bp, Artificial
  CRISPR gRNA sequence
ctgtttcctcatctgtaaat

SEQ ID NO: 194045 - DNA, 20 bp, Artificial
  CRISPR gRNA sequence
tgtttcctcatctgtaaatt

SEQ ID NO: 194046 - DNA, 20 bp, Artificial
  CRISPR gRNA sequence
gtttcctcatctgtaaattg

SEQ ID NO: 194047 - DNA, 20 bp, Artificial
  CRISPR gRNA sequence
gggatttttttttaaatacc

SEQ ID NO: 194048 - DNA, 20 bp, Artificial
  CRISPR gRNA sequence
cctggcatgcctaactcata

SEQ ID NO: 194049 - DNA, 20 bp, Artificial
  CRISPR gRNA sequence
tgaaataaaacatacgtgaa

SEQ ID NO: 194050 - DNA, 20 bp, Artificial
  CRISPR gRNA sequence
gaaataaaacatacgtgaac

SEQ ID NO: 194051 - DNA, 20 bp, Artificial
  CRISPR gRNA sequence
gaacaggcattgtaaactgt

SEQ ID NO: 194052 - DNA, 20 bp, Artificial
  CRISPR gRNA sequence
gcattgtaaactgtaagtta

SEQ ID NO: 194053 - DNA, 20 bp, Artificial
  CRISPR gRNA sequence
taaactgtaagttacggaaa

SEQ ID NO: 194054 - DNA, 20 bp, Artificial
  CRISPR gRNA sequence
ctgtaagttacggaaaaagc

SEQ ID NO: 194055 - DNA, 20 bp, Artificial
  CRISPR gRNA sequence
tggctgttgttgtgtcttta

SEQ ID NO: 194056 - DNA, 20 bp, Artificial
  CRISPR gRNA sequence
tgtgtctttaaagtttcacc

SEQ ID NO: 194057 - DNA, 20 bp, Artificial
  CRISPR gRNA sequence
gtgtctttaaagtttcacct

SEQ ID NO: 194058 - DNA, 20 bp, Artificial
  CRISPR gRNA sequence
tctttaaagtttcacctggg

SEQ ID NO: 194059 - DNA, 20 bp, Artificial
  CRISPR gRNA sequence
aagtttcacctgggtagtca

SEQ ID NO: 194060 - DNA, 20 bp, Artificial
  CRISPR gRNA sequence
ttcacctgggtagtcaaaga

SEQ ID NO: 194061 - DNA, 20 bp, Artificial
  CRISPR gRNA sequence
gggtagtcaaagatggatca

SEQ ID NO: 194062 - DNA, 20 bp, Artificial
  CRISPR gRNA sequence
ggtagtcaaagatggatcat

SEQ ID NO: 194063 - DNA, 20 bp, Artificial
  CRISPR gRNA sequence
caaagatggatcatgggtct

SEQ ID NO: 194064 - DNA, 20 bp, Artificial
  CRISPR gRNA sequence
agatggatcatgggtctcag

SEQ ID NO: 194065 - DNA, 20 bp, Artificial
  CRISPR gRNA sequence
atggatcatgggtctcagtg

SEQ ID NO: 194066 - DNA, 20 bp, Artificial
  CRISPR gRNA sequence
ggatcatgggtctcagtgga

SEQ ID NO: 194067 - DNA, 20 bp, Artificial
  CRISPR gRNA sequence
atgggtctcagtggagagct

SEQ ID NO: 194068 - DNA, 20 bp, Artificial
  CRISPR gRNA sequence
gtctcagtggagagctgagc

SEQ ID NO: 194069 - DNA, 20 bp, Artificial
  CRISPR gRNA sequence
tctcagtggagagctgagcc

SEQ ID NO: 194070 - DNA, 20 bp, Artificial
  CRISPR gRNA sequence
cagtggagagctgagccagg

SEQ ID NO: 194071 - DNA, 20 bp, Artificial
  CRISPR gRNA sequence
agtggagagctgagccaggc

SEQ ID NO: 194072 - DNA, 20 bp, Artificial
  CRISPR gRNA sequence
tggagagctgagccaggcag

SEQ ID NO: 194073 - DNA, 20 bp, Artificial
  CRISPR gRNA sequence
gagccaggcaggagctgact

SEQ ID NO: 194074 - DNA, 20 bp, Artificial
  CRISPR gRNA sequence
agccaggcaggagctgacta

SEQ ID NO: 194075 - DNA, 20 bp, Artificial
  CRISPR gRNA sequence
gccaggcaggagctgactaa

SEQ ID NO: 194076 - DNA, 20 bp, Artificial
  CRISPR gRNA sequence
ggcaggagctgactaagggt

SEQ ID NO: 194077 - DNA, 20 bp, Artificial
  CRISPR gRNA sequence
caggagctgactaagggtga

SEQ ID NO: 194078 - DNA, 20 bp, Artificial
  CRISPR gRNA sequence
aggagctgactaagggtgag

SEQ ID NO: 194079 - DNA, 20 bp, Artificial
  CRISPR gRNA sequence
agctgactaagggtgagagg

SEQ ID NO: 194080 - DNA, 20 bp, Artificial
  CRISPR gRNA sequence
gctgactaagggtgagaggt

SEQ ID NO: 194081 - DNA, 20 bp, Artificial
  CRISPR gRNA sequence
tgactaagggtgagaggtgg

SEQ ID NO: 194082 - DNA, 20 bp, Artificial
  CRISPR gRNA sequence
taagggtgagaggtgggagt

SEQ ID NO: 194083 - DNA, 20 bp, Artificial
  CRISPR gRNA sequence
gggtgagaggtgggagttag

SEQ ID NO: 194084 - DNA, 20 bp, Artificial
  CRISPR gRNA sequence
ctctgaacatctgtgtacca

SEQ ID NO: 194085 - DNA, 20 bp, Artificial
  CRISPR gRNA sequence
tctgaacatctgtgtaccat

SEQ ID NO: 194086 - DNA, 20 bp, Artificial
  CRISPR gRNA sequence
ggaccccctttcctcctgca

SEQ ID NO: 194087 - DNA, 20 bp, Artificial
  CRISPR gRNA sequence
tttcctcctgcatggtaccc

SEQ ID NO: 194088 - DNA, 20 bp, Artificial
  CRISPR gRNA sequence
tcctgcatggtaccccagac

SEQ ID NO: 194089 - DNA, 20 bp, Artificial
  CRISPR gRNA sequence
cctgcatggtaccccagaca

SEQ ID NO: 194090 - DNA, 20 bp, Artificial
  CRISPR gRNA sequence
tgcatggtaccccagacaag

SEQ ID NO: 194091 - DNA, 20 bp, Artificial
  CRISPR gRNA sequence
ggtaccccagacaaggagcc

SEQ ID NO: 194092 - DNA, 20 bp, Artificial
  CRISPR gRNA sequence
ccccagacaaggagcctagt

SEQ ID NO: 194093 - DNA, 20 bp, Artificial
  CRISPR gRNA sequence
ccagacaaggagcctagtaa

SEQ ID NO: 194094 - DNA, 20 bp, Artificial
  CRISPR gRNA sequence
agcctagtaagagatactaa

SEQ ID NO: 194095 - DNA, 20 bp, Artificial
  CRISPR gRNA sequence
gatactaatggcttgttgtc

SEQ ID NO: 194096 - DNA, 20 bp, Artificial
  CRISPR gRNA sequence
tactaatggcttgttgtcca

SEQ ID NO: 194097 - DNA, 20 bp, Artificial
  CRISPR gRNA sequence
gtccagagatgttcaaactg

SEQ ID NO: 194098 - DNA, 20 bp, Artificial
  CRISPR gRNA sequence
ccagagatgttcaaactgca

SEQ ID NO: 194099 - DNA, 20 bp, Artificial
  CRISPR gRNA sequence
agatgttcaaactgcagaga

SEQ ID NO: 194100 - DNA, 20 bp, Artificial
  CRISPR gRNA sequence
ttcaaactgcagagaaagat

SEQ ID NO: 194101 - DNA, 20 bp, Artificial
  CRISPR gRNA sequence
gcagagaaagataagacaac

SEQ ID NO: 194102 - DNA, 20 bp, Artificial
  CRISPR gRNA sequence
aaagataagacaacaagcat

SEQ ID NO: 194103 - DNA, 20 bp, Artificial
  CRISPR gRNA sequence
ttggcctccaatcatgatga

SEQ ID NO: 194104 - DNA, 20 bp, Artificial
  CRISPR gRNA sequence
cctccaatcatgatgacaga

SEQ ID NO: 194105 - DNA, 20 bp, Artificial
  CRISPR gRNA sequence
ctccaatcatgatgacagat

SEQ ID NO: 194106 - DNA, 20 bp, Artificial
  CRISPR gRNA sequence
ccaatcatgatgacagatag

SEQ ID NO: 194107 - DNA, 20 bp, Artificial
  CRISPR gRNA sequence
caatcatgatgacagatagg

SEQ ID NO: 194108 - DNA, 20 bp, Artificial
  CRISPR gRNA sequence
atcatgatgacagataggag

SEQ ID NO: 194109 - DNA, 20 bp, Artificial
  CRISPR gRNA sequence
tcatgatgacagataggagg

SEQ ID NO: 194110 - DNA, 20 bp, Artificial
  CRISPR gRNA sequence
tgatgacagataggaggagg

SEQ ID NO: 194111 - DNA, 20 bp, Artificial
  CRISPR gRNA sequence
gatgacagataggaggaggt

SEQ ID NO: 194112 - DNA, 20 bp, Artificial
  CRISPR gRNA sequence
tgacagataggaggaggtgg

SEQ ID NO: 194113 - DNA, 20 bp, Artificial
  CRISPR gRNA sequence
aggaggaggtgggagctcct

SEQ ID NO: 194114 - DNA, 20 bp, Artificial
  CRISPR gRNA sequence
aggaggtgggagctccttag

SEQ ID NO: 194115 - DNA, 20 bp, Artificial
  CRISPR gRNA sequence
tgggagctccttagcagtgc

SEQ ID NO: 194116 - DNA, 20 bp, Artificial
  CRISPR gRNA sequence
agctccttagcagtgctggt

SEQ ID NO: 194117 - DNA, 20 bp, Artificial
  CRISPR gRNA sequence
tggccttccatgttctactg

SEQ ID NO: 194118 - DNA, 20 bp, Artificial
  CRISPR gRNA sequence
ggccttccatgttctactgt

SEQ ID NO: 194119 - DNA, 20 bp, Artificial
  CRISPR gRNA sequence
gccatctctgccatgtactg

SEQ ID NO: 194120 - DNA, 20 bp, Artificial
  CRISPR gRNA sequence
ccatctctgccatgtactgt

SEQ ID NO: 194121 - DNA, 20 bp, Artificial
  CRISPR gRNA sequence
tgccatgtactgtaggctac

SEQ ID NO: 194122 - DNA, 20 bp, Artificial
  CRISPR gRNA sequence
ggctactagcttctatatta

SEQ ID NO: 194123 - DNA, 20 bp, Artificial
  CRISPR gRNA sequence
gcttctatattaaagaatgc

SEQ ID NO: 194124 - DNA, 20 bp, Artificial
  CRISPR gRNA sequence
ttctatattaaagaatgcaa

SEQ ID NO: 194125 - DNA, 20 bp, Artificial
  CRISPR gRNA sequence
tctatattaaagaatgcaag

SEQ ID NO: 194126 - DNA, 20 bp, Artificial
  CRISPR gRNA sequence
ctatattaaagaatgcaaga

SEQ ID NO: 194127 - DNA, 20 bp, Artificial
  CRISPR gRNA sequence
tatattaaagaatgcaagag

SEQ ID NO: 194128 - DNA, 20 bp, Artificial
  CRISPR gRNA sequence
ttaaagaatgcaagaggggc

SEQ ID NO: 194129 - DNA, 20 bp, Artificial
  CRISPR gRNA sequence
taaagaatgcaagaggggcc

SEQ ID NO: 194130 - DNA, 20 bp, Artificial
  CRISPR gRNA sequence
aagaatgcaagaggggccag

SEQ ID NO: 194131 - DNA, 20 bp, Artificial
  CRISPR gRNA sequence
aatgcaagaggggccaggag

SEQ ID NO: 194132 - DNA, 20 bp, Artificial
  CRISPR gRNA sequence
tgcaagaggggccaggagcg

SEQ ID NO: 194133 - DNA, 20 bp, Artificial
  CRISPR gRNA sequence
gcaagaggggccaggagcgg

SEQ ID NO: 194134 - DNA, 20 bp, Artificial
  CRISPR gRNA sequence
gaggctcatgcctgtaatct

SEQ ID NO: 194135 - DNA, 20 bp, Artificial
  CRISPR gRNA sequence
tgcctgtaatctcagcactt

SEQ ID NO: 194136 - DNA, 20 bp, Artificial
  CRISPR gRNA sequence
gcctgtaatctcagcacttt

SEQ ID NO: 194137 - DNA, 20 bp, Artificial
  CRISPR gRNA sequence
ctgtaatctcagcactttgg

SEQ ID NO: 194138 - DNA, 20 bp, Artificial
  CRISPR gRNA sequence
tgtaatctcagcactttggg

SEQ ID NO: 194139 - DNA, 20 bp, Artificial
  CRISPR gRNA sequence
tctcagcactttgggaggcc

SEQ ID NO: 194140 - DNA, 20 bp, Artificial
  CRISPR gRNA sequence
ctcagcactttgggaggcca

SEQ ID NO: 194141 - DNA, 20 bp, Artificial
  CRISPR gRNA sequence
agcactttgggaggccaagg

SEQ ID NO: 194142 - DNA, 20 bp, Artificial
  CRISPR gRNA sequence
gcactttgggaggccaaggt

SEQ ID NO: 194143 - DNA, 20 bp, Artificial
  CRISPR gRNA sequence
ctttgggaggccaaggtggg

SEQ ID NO: 194144 - DNA, 20 bp, Artificial
  CRISPR gRNA sequence
ccaaggtgggcagatcactt

SEQ ID NO: 194145 - DNA, 20 bp, Artificial
  CRISPR gRNA sequence
caaggtgggcagatcacttg

SEQ ID NO: 194146 - DNA, 20 bp, Artificial
  CRISPR gRNA sequence
gtgggcagatcacttgaggt

SEQ ID NO: 194147 - DNA, 20 bp, Artificial
  CRISPR gRNA sequence
tgggcagatcacttgaggtc

SEQ ID NO: 194148 - DNA, 20 bp, Artificial
  CRISPR gRNA sequence
ggcagatcacttgaggtcag

SEQ ID NO: 194149 - DNA, 20 bp, Artificial
  CRISPR gRNA sequence
tgaggtcaggagtttgtgac

SEQ ID NO: 194150 - DNA, 20 bp, Artificial
  CRISPR gRNA sequence
tcaggagtttgtgaccagcc

SEQ ID NO: 194151 - DNA, 20 bp, Artificial
  CRISPR gRNA sequence
tgtgaccagcctggccaaca

SEQ ID NO: 194152 - DNA, 20 bp, Artificial
  CRISPR gRNA sequence
tttactaaaaatataaaaat

SEQ ID NO: 194153 - DNA, 20 bp, Artificial
  CRISPR gRNA sequence
ctaaaaatataaaaattagc

SEQ ID NO: 194154 - DNA, 20 bp, Artificial
  CRISPR gRNA sequence
taaaaatataaaaattagct

SEQ ID NO: 194155 - DNA, 20 bp, Artificial
  CRISPR gRNA sequence
atataaaaattagctgggtg

SEQ ID NO: 194156 - DNA, 20 bp, Artificial
  CRISPR gRNA sequence
taaaaattagctgggtgtgg

SEQ ID NO: 194157 - DNA, 20 bp, Artificial
  CRISPR gRNA sequence
gtggtgtgcacctgtaatcc

SEQ ID NO: 194158 - DNA, 20 bp, Artificial
  CRISPR gRNA sequence
cacctgtaatcccagctact

SEQ ID NO: 194159 - DNA, 20 bp, Artificial
  CRISPR gRNA sequence
acctgtaatcccagctactc

SEQ ID NO: 194160 - DNA, 20 bp, Artificial
  CRISPR gRNA sequence
ctgtaatcccagctactcgg

SEQ ID NO: 194161 - DNA, 20 bp, Artificial
  CRISPR gRNA sequence
tcccagctactcgggagact

SEQ ID NO: 194162 - DNA, 20 bp, Artificial
  CRISPR gRNA sequence
cccagctactcgggagactg

SEQ ID NO: 194163 - DNA, 20 bp, Artificial
  CRISPR gRNA sequence
tactcgggagactgaggcac

SEQ ID NO: 194164 - DNA, 20 bp, Artificial
  CRISPR gRNA sequence
gcacaagaattgcttgaacc

SEQ ID NO: 194165 - DNA, 20 bp, Artificial
  CRISPR gRNA sequence
cacaagaattgcttgaacct

SEQ ID NO: 194166 - DNA, 20 bp, Artificial
  CRISPR gRNA sequence
caagaattgcttgaacctgg

SEQ ID NO: 194167 - DNA, 20 bp, Artificial
  CRISPR gRNA sequence
aagaattgcttgaacctggg

SEQ ID NO: 194168 - DNA, 20 bp, Artificial
  CRISPR gRNA sequence
aattgcttgaacctgggagg

SEQ ID NO: 194169 - DNA, 20 bp, Artificial
  CRISPR gRNA sequence
tgcttgaacctgggaggcgg

SEQ ID NO: 194170 - DNA, 20 bp, Artificial
  CRISPR gRNA sequence
aacctgggaggcggaagttg

SEQ ID NO: 194171 - DNA, 20 bp, Artificial
  CRISPR gRNA sequence
tgggaggcggaagttgcagt

SEQ ID NO: 194172 - DNA, 20 bp, Artificial
  CRISPR gRNA sequence
ggcggaagttgcagtgagcc

SEQ ID NO: 194173 - DNA, 20 bp, Artificial
  CRISPR gRNA sequence
tgcgccactgcactccaccc

SEQ ID NO: 194174 - DNA, 20 bp, Artificial
  CRISPR gRNA sequence
gcgccactgcactccaccct

SEQ ID NO: 194175 - DNA, 20 bp, Artificial
  CRISPR gRNA sequence
ctgcactccaccctgggcaa

SEQ ID NO: 194176 - DNA, 20 bp, Artificial
  CRISPR gRNA sequence
gcactccaccctgggcaaca

SEQ ID NO: 194177 - DNA, 20 bp, Artificial
  CRISPR gRNA sequence
tccaccctgggcaacagaga

SEQ ID NO: 194178 - DNA, 20 bp, Artificial
  CRISPR gRNA sequence
gcctcaaaaaaaaaaaaaaa

SEQ ID NO: 194179 - DNA, 20 bp, Artificial
  CRISPR gRNA sequence
caaaaaaaaaaaaaaaaagc

SEQ ID NO: 194180 - DNA, 20 bp, Artificial
  CRISPR gRNA sequence
aaaaaaaaaaaaaaaagcaa

SEQ ID NO: 194181 - DNA, 20 bp, Artificial
  CRISPR gRNA sequence
aaaaaaaaaaaaaaagcaag

SEQ ID NO: 194182 - DNA, 20 bp, Artificial
  CRISPR gRNA sequence
aaaaaaaaaaaagcaagagg

SEQ ID NO: 194183 - DNA, 20 bp, Artificial
  CRISPR gRNA sequence
caagaggaagtgaaataatc

SEQ ID NO: 194184 - DNA, 20 bp, Artificial
  CRISPR gRNA sequence
aagaggaagtgaaataatca

SEQ ID NO: 194185 - DNA, 20 bp, Artificial
  CRISPR gRNA sequence
taatcaaggccgccatttaa

SEQ ID NO: 194186 - DNA, 20 bp, Artificial
  CRISPR gRNA sequence
caaggccgccatttaatagt

SEQ ID NO: 194187 - DNA, 20 bp, Artificial
  CRISPR gRNA sequence
ggccgccatttaatagtgag

SEQ ID NO: 194188 - DNA, 20 bp, Artificial
  CRISPR gRNA sequence
tagtgagcagccactccatg

SEQ ID NO: 194189 - DNA, 20 bp, Artificial
  CRISPR gRNA sequence
cactccatgtggtactgtgc

SEQ ID NO: 194190 - DNA, 20 bp, Artificial
  CRISPR gRNA sequence
tgcaagcacattataaatat

SEQ ID NO: 194191 - DNA, 20 bp, Artificial
  CRISPR gRNA sequence
attataaatattagcctcac

SEQ ID NO: 194192 - DNA, 20 bp, Artificial
  CRISPR gRNA sequence
tagcctcacaagaaatgtat

SEQ ID NO: 194193 - DNA, 20 bp, Artificial
  CRISPR gRNA sequence
agcatttgtattttgtacac

SEQ ID NO: 194194 - DNA, 20 bp, Artificial
  CRISPR gRNA sequence
ttgtattttgtacactggtt

SEQ ID NO: 194195 - DNA, 20 bp, Artificial
  CRISPR gRNA sequence
actggttaagtatcttgccc

SEQ ID NO: 194196 - DNA, 20 bp, Artificial
  CRISPR gRNA sequence
cttgcccaagacctcaaaac

SEQ ID NO: 194197 - DNA, 20 bp, Artificial
  CRISPR gRNA sequence
ccaagacctcaaaactggtt

SEQ ID NO: 194198 - DNA, 20 bp, Artificial
  CRISPR gRNA sequence
caagacctcaaaactggtta

SEQ ID NO: 194199 - DNA, 20 bp, Artificial
  CRISPR gRNA sequence
aagacctcaaaactggttaa

SEQ ID NO: 194200 - DNA, 20 bp, Artificial
  CRISPR gRNA sequence
acctcaaaactggttaaggg

SEQ ID NO: 194201 - DNA, 20 bp, Artificial
  CRISPR gRNA sequence
tcaaaactggttaagggcag

SEQ ID NO: 194202 - DNA, 20 bp, Artificial
  CRISPR gRNA sequence
tggttaagggcagcagaatt

SEQ ID NO: 194203 - DNA, 20 bp, Artificial
  CRISPR gRNA sequence
agggcagcagaatttagccc

SEQ ID NO: 194204 - DNA, 20 bp, Artificial
  CRISPR gRNA sequence
gccccagcaccaccttttca

SEQ ID NO: 194205 - DNA, 20 bp, Artificial
  CRISPR gRNA sequence
agcaccaccttttcaaagcc

SEQ ID NO: 194206 - DNA, 20 bp, Artificial
  CRISPR gRNA sequence
gcaccaccttttcaaagcct

SEQ ID NO: 194207 - DNA, 20 bp, Artificial
  CRISPR gRNA sequence
atgctgttcccattttaaca

SEQ ID NO: 194208 - DNA, 20 bp, Artificial
  CRISPR gRNA sequence
tgctgttcccattttaacac

SEQ ID NO: 194209 - DNA, 20 bp, Artificial
  CRISPR gRNA sequence
acacaggtatctcgccattc

SEQ ID NO: 194210 - DNA, 20 bp, Artificial
  CRISPR gRNA sequence
cattccagccactcaaactt

SEQ ID NO: 194211 - DNA, 20 bp, Artificial
  CRISPR gRNA sequence
ccactcaaactttggcattt

SEQ ID NO: 194212 - DNA, 20 bp, Artificial
  CRISPR gRNA sequence
catttaagaaaattatccta

SEQ ID NO: 194213 - DNA, 20 bp, Artificial
  CRISPR gRNA sequence
ctaaagctaaactaaacttc

SEQ ID NO: 194214 - DNA, 20 bp, Artificial
  CRISPR gRNA sequence
taaagctaaactaaacttca

SEQ ID NO: 194215 - DNA, 20 bp, Artificial
  CRISPR gRNA sequence
tcccatcaaaattttatctt

SEQ ID NO: 194216 - DNA, 20 bp, Artificial
  CRISPR gRNA sequence
atcaaaattttatctttagt

SEQ ID NO: 194217 - DNA, 20 bp, Artificial
  CRISPR gRNA sequence
tttcgttttgttttgttttt

SEQ ID NO: 194218 - DNA, 20 bp, Artificial
  CRISPR gRNA sequence
ttgtttttcagaactacctc

SEQ ID NO: 194219 - DNA, 20 bp, Artificial
  CRISPR gRNA sequence
ctggcacatcctccaaatga

SEQ ID NO: 194220 - DNA, 20 bp, Artificial
  CRISPR gRNA sequence
tggcacatcctccaaatgaa

SEQ ID NO: 194221 - DNA, 20 bp, Artificial
  CRISPR gRNA sequence
tccaaatgaaaggactcact

SEQ ID NO: 194222 - DNA, 20 bp, Artificial
  CRISPR gRNA sequence
aaggactcacttggtaattc

SEQ ID NO: 194223 - DNA, 20 bp, Artificial
  CRISPR gRNA sequence
aggactcacttggtaattct

SEQ ID NO: 194224 - DNA, 20 bp, Artificial
  CRISPR gRNA sequence
gactcacttggtaattctgg

SEQ ID NO: 194225 - DNA, 20 bp, Artificial
  CRISPR gRNA sequence
ggagccatcttattatgcct

SEQ ID NO: 194226 - DNA, 20 bp, Artificial
  CRISPR gRNA sequence
catcttattatgccttggtg

SEQ ID NO: 194227 - DNA, 20 bp, Artificial
  CRISPR gRNA sequence
ctgacattcatcttccgttt

SEQ ID NO: 194228 - DNA, 20 bp, Artificial
  CRISPR gRNA sequence
attcatcttccgtttaagaa

SEQ ID NO: 194229 - DNA, 20 bp, Artificial
  CRISPR gRNA sequence
ttcatcttccgtttaagaaa

SEQ ID NO: 194230 - DNA, 20 bp, Artificial
  CRISPR gRNA sequence
atcttccgtttaagaaaagg

SEQ ID NO: 194231 - DNA, 20 bp, Artificial
  CRISPR gRNA sequence
aggtagtatttccttaattg

SEQ ID NO: 194232 - DNA, 20 bp, Artificial
  CRISPR gRNA sequence
tagtatttccttaattgcag

SEQ ID NO: 194233 - DNA, 20 bp, Artificial
  CRISPR gRNA sequence
ttaattgcagtggtctccac

SEQ ID NO: 194234 - DNA, 20 bp, Artificial
  CRISPR gRNA sequence
taattgcagtggtctccact

SEQ ID NO: 194235 - DNA, 20 bp, Artificial
  CRISPR gRNA sequence
aattgcagtggtctccactg

SEQ ID NO: 194236 - DNA, 20 bp, Artificial
  CRISPR gRNA sequence
attgcagtggtctccactgg

SEQ ID NO: 194237 - DNA, 20 bp, Artificial
  CRISPR gRNA sequence
cagtggtctccactgggggt

SEQ ID NO: 194238 - DNA, 20 bp, Artificial
  CRISPR gRNA sequence
agtggtctccactgggggtg

SEQ ID NO: 194239 - DNA, 20 bp, Artificial
  CRISPR gRNA sequence
ggtctccactgggggtgagg

SEQ ID NO: 194240 - DNA, 20 bp, Artificial
  CRISPR gRNA sequence
gtctccactgggggtgagga

SEQ ID NO: 194241 - DNA, 20 bp, Artificial
  CRISPR gRNA sequence
tctccactgggggtgaggaa

SEQ ID NO: 194242 - DNA, 20 bp, Artificial
  CRISPR gRNA sequence
ctccactgggggtgaggaag

SEQ ID NO: 194243 - DNA, 20 bp, Artificial
  CRISPR gRNA sequence
actgggggtgaggaaggggt

SEQ ID NO: 194244 - DNA, 20 bp, Artificial
  CRISPR gRNA sequence
ggtgaggaaggggtgagaat

SEQ ID NO: 194245 - DNA, 20 bp, Artificial
  CRISPR gRNA sequence
aaggggtgagaattggatca

SEQ ID NO: 194246 - DNA, 20 bp, Artificial
  CRISPR gRNA sequence
gagaattggatcatggctgc

SEQ ID NO: 194247 - DNA, 20 bp, Artificial
  CRISPR gRNA sequence
agaattggatcatggctgca

SEQ ID NO: 194248 - DNA, 20 bp, Artificial
  CRISPR gRNA sequence
aaacccgacttaacctctgc

SEQ ID NO: 194249 - DNA, 20 bp, Artificial
  CRISPR gRNA sequence
aacccgacttaacctctgca

SEQ ID NO: 194250 - DNA, 20 bp, Artificial
  CRISPR gRNA sequence
ccgacttaacctctgcaagg

SEQ ID NO: 194251 - DNA, 20 bp, Artificial
  CRISPR gRNA sequence
aacctctgcaaggtggtgca

SEQ ID NO: 194252 - DNA, 20 bp, Artificial
  CRISPR gRNA sequence
acctctgcaaggtggtgcaa

SEQ ID NO: 194253 - DNA, 20 bp, Artificial
  CRISPR gRNA sequence
aaaggcattccactgttcaa

SEQ ID NO: 194254 - DNA, 20 bp, Artificial
  CRISPR gRNA sequence
gttcaacagcaattatattg

SEQ ID NO: 194255 - DNA, 20 bp, Artificial
  CRISPR gRNA sequence
acagcaattatattgaagct

SEQ ID NO: 194256 - DNA, 20 bp, Artificial
  CRISPR gRNA sequence
gcaattatattgaagctgag

SEQ ID NO: 194257 - DNA, 20 bp, Artificial
  CRISPR gRNA sequence
caattatattgaagctgagt

SEQ ID NO: 194258 - DNA, 20 bp, Artificial
  CRISPR gRNA sequence
ttgaagctgagtgggatcac

SEQ ID NO: 194259 - DNA, 20 bp, Artificial
  CRISPR gRNA sequence
tgaagctgagtgggatcact

SEQ ID NO: 194260 - DNA, 20 bp, Artificial
  CRISPR gRNA sequence
ctgagtgggatcactgggtg

SEQ ID NO: 194261 - DNA, 20 bp, Artificial
  CRISPR gRNA sequence
gggatcactgggtgaagatg

SEQ ID NO: 194262 - DNA, 20 bp, Artificial
  CRISPR gRNA sequence
actgggtgaagatgaagcgt

SEQ ID NO: 194263 - DNA, 20 bp, Artificial
  CRISPR gRNA sequence
ctgggtgaagatgaagcgta

SEQ ID NO: 194264 - DNA, 20 bp, Artificial
  CRISPR gRNA sequence
tgggtgaagatgaagcgtaa

SEQ ID NO: 194265 - DNA, 20 bp, Artificial
  CRISPR gRNA sequence
gggtgaagatgaagcgtaag

SEQ ID NO: 194266 - DNA, 20 bp, Artificial
  CRISPR gRNA sequence
gaagatgaagcgtaaggggt

SEQ ID NO: 194267 - DNA, 20 bp, Artificial
  CRISPR gRNA sequence
aagatgaagcgtaaggggtg

SEQ ID NO: 194268 - DNA, 20 bp, Artificial
  CRISPR gRNA sequence
agatgaagcgtaaggggtga

SEQ ID NO: 194269 - DNA, 20 bp, Artificial
  CRISPR gRNA sequence
gatgaagcgtaaggggtgag

SEQ ID NO: 194270 - DNA, 20 bp, Artificial
  CRISPR gRNA sequence
gaagcgtaaggggtgagggg

SEQ ID NO: 194271 - DNA, 20 bp, Artificial
  CRISPR gRNA sequence
aagcgtaaggggtgaggggc

SEQ ID NO: 194272 - DNA, 20 bp, Artificial
  CRISPR gRNA sequence
gcgtaaggggtgaggggcag

SEQ ID NO: 194273 - DNA, 20 bp, Artificial
  CRISPR gRNA sequence
aggggtgaggggcaggagaa

SEQ ID NO: 194274 - DNA, 20 bp, Artificial
  CRISPR gRNA sequence
ggggtgaggggcaggagaat

SEQ ID NO: 194275 - DNA, 20 bp, Artificial
  CRISPR gRNA sequence
gaggggcaggagaatgggta

SEQ ID NO: 194276 - DNA, 20 bp, Artificial
  CRISPR gRNA sequence
ggcaggagaatgggtatgga

SEQ ID NO: 194277 - DNA, 20 bp, Artificial
  CRISPR gRNA sequence
caggagaatgggtatggatg

SEQ ID NO: 194278 - DNA, 20 bp, Artificial
  CRISPR gRNA sequence
aggagaatgggtatggatgg

SEQ ID NO: 194279 - DNA, 20 bp, Artificial
  CRISPR gRNA sequence
agaatgggtatggatggagg

SEQ ID NO: 194280 - DNA, 20 bp, Artificial
  CRISPR gRNA sequence
atgggtatggatggaggtag

SEQ ID NO: 194281 - DNA, 20 bp, Artificial
  CRISPR gRNA sequence
atggatggaggtagaagatg

SEQ ID NO: 194282 - DNA, 20 bp, Artificial
  CRISPR gRNA sequence
gtagaagatgcagtgtcata

SEQ ID NO: 194283 - DNA, 20 bp, Artificial
  CRISPR gRNA sequence
ttctatcatgaaaataacca

SEQ ID NO: 194284 - DNA, 20 bp, Artificial
  CRISPR gRNA sequence
tgaaaataaccacagactta

SEQ ID NO: 194285 - DNA, 20 bp, Artificial
  CRISPR gRNA sequence
aaataaccacagacttacag

SEQ ID NO: 194286 - DNA, 20 bp, Artificial
  CRISPR gRNA sequence
ataaccacagacttacagaa

SEQ ID NO: 194287 - DNA, 20 bp, Artificial
  CRISPR gRNA sequence
ccacagacttacagaagaga

SEQ ID NO: 194288 - DNA, 20 bp, Artificial
  CRISPR gRNA sequence
acagacttacagaagagaaa

SEQ ID NO: 194289 - DNA, 20 bp, Artificial
  CRISPR gRNA sequence
gctaaaatgcccgtcatttt

SEQ ID NO: 194290 - DNA, 20 bp, Artificial
  CRISPR gRNA sequence
cgtcattttcagttgcattt

SEQ ID NO: 194291 - DNA, 20 bp, Artificial
  CRISPR gRNA sequence
gttgcattttagtcttgcat

SEQ ID NO: 194292 - DNA, 20 bp, Artificial
  CRISPR gRNA sequence
agtcttgcattagttgcaac

SEQ ID NO: 194293 - DNA, 20 bp, Artificial
  CRISPR gRNA sequence
ttgcattagttgcaaccagc

SEQ ID NO: 194294 - DNA, 20 bp, Artificial
  CRISPR gRNA sequence
agttgcaaccagctggtttc

SEQ ID NO: 194295 - DNA, 20 bp, Artificial
  CRISPR gRNA sequence
gttgcaaccagctggtttct

SEQ ID NO: 194296 - DNA, 20 bp, Artificial
  CRISPR gRNA sequence
agctggtttctgggtaccct

SEQ ID NO: 194297 - DNA, 20 bp, Artificial
  CRISPR gRNA sequence
ggtaccctaagtaataaaaa

SEQ ID NO: 194298 - DNA, 20 bp, Artificial
  CRISPR gRNA sequence
taataaaaatagttcctctg

SEQ ID NO: 194299 - DNA, 20 bp, Artificial
  CRISPR gRNA sequence
atagttcctctgtagaactg

SEQ ID NO: 194300 - DNA, 20 bp, Artificial
  CRISPR gRNA sequence
gaactgtagtatgtttacca

SEQ ID NO: 194301 - DNA, 20 bp, Artificial
  CRISPR gRNA sequence
actgtagtatgtttaccata

SEQ ID NO: 194302 - DNA, 20 bp, Artificial
  CRISPR gRNA sequence
agagtattttgcaaaatttt

SEQ ID NO: 194303 - DNA, 20 bp, Artificial
  CRISPR gRNA sequence
gtattttgcaaaatttttgg

SEQ ID NO: 194304 - DNA, 20 bp, Artificial
  CRISPR gRNA sequence
attttgcaaaatttttggta

SEQ ID NO: 194305 - DNA, 20 bp, Artificial
  CRISPR gRNA sequence
ttttgcaaaatttttggtag

SEQ ID NO: 194306 - DNA, 20 bp, Artificial
  CRISPR gRNA sequence
ttcatttctccatttacctg

SEQ ID NO: 194307 - DNA, 20 bp, Artificial
  CRISPR gRNA sequence
tcatttctccatttacctgt

SEQ ID NO: 194308 - DNA, 20 bp, Artificial
  CRISPR gRNA sequence
ctgtgggaacaattaaaatc

SEQ ID NO: 194309 - DNA, 20 bp, Artificial
  CRISPR gRNA sequence
tgtgggaacaattaaaatcc

SEQ ID NO: 194310 - DNA, 20 bp, Artificial
  CRISPR gRNA sequence
caattaaaatccaggaaaat

SEQ ID NO: 194311 - DNA, 20 bp, Artificial
  CRISPR gRNA sequence
caaataatttcctcccattt

SEQ ID NO: 194312 - DNA, 20 bp, Artificial
  CRISPR gRNA sequence
aatttcctcccatttaagat

SEQ ID NO: 194313 - DNA, 20 bp, Artificial
  CRISPR gRNA sequence
tcctcccatttaagatgagt

SEQ ID NO: 194314 - DNA, 20 bp, Artificial
  CRISPR gRNA sequence
ctcccatttaagatgagtca

SEQ ID NO: 194315 - DNA, 20 bp, Artificial
  CRISPR gRNA sequence
taaataattcctccaatact

SEQ ID NO: 194316 - DNA, 20 bp, Artificial
  CRISPR gRNA sequence
aataattcctccaatactta

SEQ ID NO: 194317 - DNA, 20 bp, Artificial
  CRISPR gRNA sequence
aattcctccaatacttagag

SEQ ID NO: 194318 - DNA, 20 bp, Artificial
  CRISPR gRNA sequence
aatacttagagaagtatacc

SEQ ID NO: 194319 - DNA, 20 bp, Artificial
  CRISPR gRNA sequence
tacttagagaagtataccaa

SEQ ID NO: 194320 - DNA, 20 bp, Artificial
  CRISPR gRNA sequence
gagaagtataccaagagatc

SEQ ID NO: 194321 - DNA, 20 bp, Artificial
  CRISPR gRNA sequence
tataccaagagatccagtga

SEQ ID NO: 194322 - DNA, 20 bp, Artificial
  CRISPR gRNA sequence
caagagatccagtgatggta

SEQ ID NO: 194323 - DNA, 20 bp, Artificial
  CRISPR gRNA sequence
agagatccagtgatggtata

SEQ ID NO: 194324 - DNA, 20 bp, Artificial
  CRISPR gRNA sequence
tagagttgtctgatgttaaa

SEQ ID NO: 194325 - DNA, 20 bp, Artificial
  CRISPR gRNA sequence
agagttgtctgatgttaaat

SEQ ID NO: 194326 - DNA, 20 bp, Artificial
  CRISPR gRNA sequence
gagttgtctgatgttaaata

SEQ ID NO: 194327 - DNA, 20 bp, Artificial
  CRISPR gRNA sequence
ttgtctgatgttaaataggg

SEQ ID NO: 194328 - DNA, 20 bp, Artificial
  CRISPR gRNA sequence
tctgatgttaaatagggaag

SEQ ID NO: 194329 - DNA, 20 bp, Artificial
  CRISPR gRNA sequence
ttaaatagggaagtagaata

SEQ ID NO: 194330 - DNA, 20 bp, Artificial
  CRISPR gRNA sequence
aatagggaagtagaatatgg

SEQ ID NO: 194331 - DNA, 20 bp, Artificial
  CRISPR gRNA sequence
atagggaagtagaatatgga

SEQ ID NO: 194332 - DNA, 20 bp, Artificial
  CRISPR gRNA sequence
tagggaagtagaatatggaa

SEQ ID NO: 194333 - DNA, 20 bp, Artificial
  CRISPR gRNA sequence
agggaagtagaatatggaag

SEQ ID NO: 194334 - DNA, 20 bp, Artificial
  CRISPR gRNA sequence
aatatggaaggggattccaa

SEQ ID NO: 194335 - DNA, 20 bp, Artificial
  CRISPR gRNA sequence
attccccataaccccttaca

SEQ ID NO: 194336 - DNA, 20 bp, Artificial
  CRISPR gRNA sequence
ttccccataaccccttacat

SEQ ID NO: 194337 - DNA, 20 bp, Artificial
  CRISPR gRNA sequence
tccccataaccccttacatg

SEQ ID NO: 194338 - DNA, 20 bp, Artificial
  CRISPR gRNA sequence
ccccataaccccttacatgg

SEQ ID NO: 194339 - DNA, 20 bp, Artificial
  CRISPR gRNA sequence
ataaccccttacatggggga

SEQ ID NO: 194340 - DNA, 20 bp, Artificial
  CRISPR gRNA sequence
accccttacatgggggaaag

SEQ ID NO: 194341 - DNA, 20 bp, Artificial
  CRISPR gRNA sequence
gggggaaagtagtgttaact

SEQ ID NO: 194342 - DNA, 20 bp, Artificial
  CRISPR gRNA sequence
gggaaagtagtgttaactga

SEQ ID NO: 194343 - DNA, 20 bp, Artificial
  CRISPR gRNA sequence
gaaagtagtgttaactgaga

SEQ ID NO: 194344 - DNA, 20 bp, Artificial
  CRISPR gRNA sequence
agtagtgttaactgagagag

SEQ ID NO: 194345 - DNA, 20 bp, Artificial
  CRISPR gRNA sequence
tagtgttaactgagagagta

SEQ ID NO: 194346 - DNA, 20 bp, Artificial
  CRISPR gRNA sequence
ttaactgagagagtagagat

SEQ ID NO: 194347 - DNA, 20 bp, Artificial
  CRISPR gRNA sequence
tccaaaaattatattcttaa

SEQ ID NO: 194348 - DNA, 20 bp, Artificial
  CRISPR gRNA sequence
ccaaaaattatattcttaac

SEQ ID NO: 194349 - DNA, 20 bp, Artificial
  CRISPR gRNA sequence
attatattcttaacaggact

SEQ ID NO: 194350 - DNA, 20 bp, Artificial
  CRISPR gRNA sequence
tattcttaacaggactgaga

SEQ ID NO: 194351 - DNA, 20 bp, Artificial
  CRISPR gRNA sequence
cttaacaggactgagatagc

SEQ ID NO: 194352 - DNA, 20 bp, Artificial
  CRISPR gRNA sequence
gactgagatagccagaatat

SEQ ID NO: 194353 - DNA, 20 bp, Artificial
  CRISPR gRNA sequence
actgagatagccagaatata

SEQ ID NO: 194354 - DNA, 20 bp, Artificial
  CRISPR gRNA sequence
atagccagaatataaggatc

SEQ ID NO: 194355 - DNA, 20 bp, Artificial
  CRISPR gRNA sequence
taaggatcaagtttcaatga

SEQ ID NO: 194356 - DNA, 20 bp, Artificial
  CRISPR gRNA sequence
gatcaagtttcaatgacagt

SEQ ID NO: 194357 - DNA, 20 bp, Artificial
  CRISPR gRNA sequence
ttcaatgacagtaagatcct

SEQ ID NO: 194358 - DNA, 20 bp, Artificial
  CRISPR gRNA sequence
atgacagtaagatcctgaga

SEQ ID NO: 194359 - DNA, 20 bp, Artificial
  CRISPR gRNA sequence
gacagtaagatcctgagatg

SEQ ID NO: 194360 - DNA, 20 bp, Artificial
  CRISPR gRNA sequence
agatggagttgatttgcaca

SEQ ID NO: 194361 - DNA, 20 bp, Artificial
  CRISPR gRNA sequence
cacaaagaaataattgttgc

SEQ ID NO: 194362 - DNA, 20 bp, Artificial
  CRISPR gRNA sequence
atgcattttgaatatttctc

SEQ ID NO: 194363 - DNA, 20 bp, Artificial
  CRISPR gRNA sequence
tgaatatttctctggaaaaa

SEQ ID NO: 194364 - DNA, 20 bp, Artificial
  CRISPR gRNA sequence
atttctctggaaaaaaagat

SEQ ID NO: 194365 - DNA, 20 bp, Artificial
  CRISPR gRNA sequence
ctctggaaaaaaagattagt

SEQ ID NO: 194366 - DNA, 20 bp, Artificial
  CRISPR gRNA sequence
tggaaaaaaagattagttgg

SEQ ID NO: 194367 - DNA, 20 bp, Artificial
  CRISPR gRNA sequence
aaaaaaagattagttggcag

SEQ ID NO: 194368 - DNA, 20 bp, Artificial
  CRISPR gRNA sequence
agattagttggcagtagaaa

SEQ ID NO: 194369 - DNA, 20 bp, Artificial
  CRISPR gRNA sequence
tagttggcagtagaaatgga

SEQ ID NO: 194370 - DNA, 20 bp, Artificial
  CRISPR gRNA sequence
tagaaatggatagaaatcaa

SEQ ID NO: 194371 - DNA, 20 bp, Artificial
  CRISPR gRNA sequence
caatagatattaaaatacct

SEQ ID NO: 194372 - DNA, 20 bp, Artificial
  CRISPR gRNA sequence
tattaaaatacctcagaatt

SEQ ID NO: 194373 - DNA, 20 bp, Artificial
  CRISPR gRNA sequence
ctcagaatttggttcatctc

SEQ ID NO: 194374 - DNA, 20 bp, Artificial
  CRISPR gRNA sequence
tcagaatttggttcatctct

SEQ ID NO: 194375 - DNA, 20 bp, Artificial
  CRISPR gRNA sequence
atttggttcatctctgggaa

SEQ ID NO: 194376 - DNA, 20 bp, Artificial
  CRISPR gRNA sequence
tgggaaaagatgaaaaataa

SEQ ID NO: 194377 - DNA, 20 bp, Artificial
  CRISPR gRNA sequence
aataaaagtgtatactcctc

SEQ ID NO: 194378 - DNA, 20 bp, Artificial
  CRISPR gRNA sequence
gtatactcctcaagaacatc

SEQ ID NO: 194379 - DNA, 20 bp, Artificial
  CRISPR gRNA sequence
tatactcctcaagaacatct

SEQ ID NO: 194380 - DNA, 20 bp, Artificial
  CRISPR gRNA sequence
tcaagaacatctaggatcaa

SEQ ID NO: 194381 - DNA, 20 bp, Artificial
  CRISPR gRNA sequence
attgaattaattaacctcat

SEQ ID NO: 194382 - DNA, 20 bp, Artificial
  CRISPR gRNA sequence
aattaattaacctcataagt

SEQ ID NO: 194383 - DNA, 20 bp, Artificial
  CRISPR gRNA sequence
attaattaacctcataagtt

SEQ ID NO: 194384 - DNA, 20 bp, Artificial
  CRISPR gRNA sequence
acctcataagttgggacctg

SEQ ID NO: 194385 - DNA, 20 bp, Artificial
  CRISPR gRNA sequence
taagttgggacctgtggaat

SEQ ID NO: 194386 - DNA, 20 bp, Artificial
  CRISPR gRNA sequence
aagttgggacctgtggaata

SEQ ID NO: 194387 - DNA, 20 bp, Artificial
  CRISPR gRNA sequence
tgtggaataaggatgtccac

SEQ ID NO: 194388 - DNA, 20 bp, Artificial
  CRISPR gRNA sequence
aggatgtccaccagacttcc

SEQ ID NO: 194389 - DNA, 20 bp, Artificial
  CRISPR gRNA sequence
ggatgtccaccagacttcct

SEQ ID NO: 194390 - DNA, 20 bp, Artificial
  CRISPR gRNA sequence
gatgtccaccagacttccta

SEQ ID NO: 194391 - DNA, 20 bp, Artificial
  CRISPR gRNA sequence
tagggattacaaatgtttca

SEQ ID NO: 194392 - DNA, 20 bp, Artificial
  CRISPR gRNA sequence
cagaacttgaaatttaaact

SEQ ID NO: 194393 - DNA, 20 bp, Artificial
  CRISPR gRNA sequence
agaacttgaaatttaaactt

SEQ ID NO: 194394 - DNA, 20 bp, Artificial
  CRISPR gRNA sequence
tttaaacttgggtcactgta

SEQ ID NO: 194395 - DNA, 20 bp, Artificial
  CRISPR gRNA sequence
ttaaacttgggtcactgtat

SEQ ID NO: 194396 - DNA, 20 bp, Artificial
  CRISPR gRNA sequence
ttgggtcactgtatgggatg

SEQ ID NO: 194397 - DNA, 20 bp, Artificial
  CRISPR gRNA sequence
gggtcactgtatgggatgta

SEQ ID NO: 194398 - DNA, 20 bp, Artificial
  CRISPR gRNA sequence
ggatgtagagctgtgctata

SEQ ID NO: 194399 - DNA, 20 bp, Artificial
  CRISPR gRNA sequence
aaaaatgatttctttttctc

SEQ ID NO: 194400 - DNA, 20 bp, Artificial
  CRISPR gRNA sequence
aaaatgatttctttttctca

SEQ ID NO: 194401 - DNA, 20 bp, Artificial
  CRISPR gRNA sequence
aaatgatttctttttctcaa

SEQ ID NO: 194402 - DNA, 20 bp, Artificial
  CRISPR gRNA sequence
atgatttctttttctcaagg

SEQ ID NO: 194403 - DNA, 20 bp, Artificial
  CRISPR gRNA sequence
tttttctcaagggagaatga

SEQ ID NO: 194404 - DNA, 20 bp, Artificial
  CRISPR gRNA sequence
atgatggatgtgaaaaaatg

SEQ ID NO: 194405 - DNA, 20 bp, Artificial
  CRISPR gRNA sequence
tgtgaaaaaatgtggcatcc

SEQ ID NO: 194406 - DNA, 20 bp, Artificial
  CRISPR gRNA sequence
gcatccaagatacaaactca

SEQ ID NO: 194407 - DNA, 20 bp, Artificial
  CRISPR gRNA sequence
tccaagatacaaactcaaag

SEQ ID NO: 194408 - DNA, 20 bp, Artificial
  CRISPR gRNA sequence
gatacaaactcaaagaagca

SEQ ID NO: 194409 - DNA, 20 bp, Artificial
  CRISPR gRNA sequence
acaaactcaaagaagcaaag

SEQ ID NO: 194410 - DNA, 20 bp, Artificial
  CRISPR gRNA sequence
actcaaagaagcaaagtggt

SEQ ID NO: 194411 - DNA, 20 bp, Artificial
  CRISPR gRNA sequence
aagcaaagtggtaagaatat

SEQ ID NO: 194412 - DNA, 20 bp, Artificial
  CRISPR gRNA sequence
caaagtggtaagaatatcag

SEQ ID NO: 194413 - DNA, 20 bp, Artificial
  CRISPR gRNA sequence
aaagtggtaagaatatcaga

SEQ ID NO: 194414 - DNA, 20 bp, Artificial
  CRISPR gRNA sequence
gtaagaatatcagaaggaat

SEQ ID NO: 194415 - DNA, 20 bp, Artificial
  CRISPR gRNA sequence
taagaatatcagaaggaatt

SEQ ID NO: 194416 - DNA, 20 bp, Artificial
  CRISPR gRNA sequence
gaatatcagaaggaattggg

SEQ ID NO: 194417 - DNA, 20 bp, Artificial
  CRISPR gRNA sequence
cagaaggaattgggaagtaa

SEQ ID NO: 194418 - DNA, 20 bp, Artificial
  CRISPR gRNA sequence
gaattgggaagtaaaagtca

SEQ ID NO: 194419 - DNA, 20 bp, Artificial
  CRISPR gRNA sequence
aattgggaagtaaaagtcaa

SEQ ID NO: 194420 - DNA, 20 bp, Artificial
  CRISPR gRNA sequence
taaaagtcaaaggaaacaaa

SEQ ID NO: 194421 - DNA, 20 bp, Artificial
  CRISPR gRNA sequence
tcaaaggaaacaaaaagcta

SEQ ID NO: 194422 - DNA, 20 bp, Artificial
  CRISPR gRNA sequence
aaaaagctaaagcaataaca

SEQ ID NO: 194423 - DNA, 20 bp, Artificial
  CRISPR gRNA sequence
aaagctaaagcaataacaaa

SEQ ID NO: 194424 - DNA, 20 bp, Artificial
  CRISPR gRNA sequence
aataacaaagagaaatccat

SEQ ID NO: 194425 - DNA, 20 bp, Artificial
  CRISPR gRNA sequence
cataatctcctctcctttta

SEQ ID NO: 194426 - DNA, 20 bp, Artificial
  CRISPR gRNA sequence
cctctccttttaaagaatgc

SEQ ID NO: 194427 - DNA, 20 bp, Artificial
  CRISPR gRNA sequence
gctggttcccctttgcctca

SEQ ID NO: 194428 - DNA, 20 bp, Artificial
  CRISPR gRNA sequence
ctttgcctcacagctaacac

SEQ ID NO: 194429 - DNA, 20 bp, Artificial
  CRISPR gRNA sequence
caagaactcctccaccgtct

SEQ ID NO: 194430 - DNA, 20 bp, Artificial
  CRISPR gRNA sequence
aagaactcctccaccgtctg

SEQ ID NO: 194431 - DNA, 20 bp, Artificial
  CRISPR gRNA sequence
gaactcctccaccgtctgag

SEQ ID NO: 194432 - DNA, 20 bp, Artificial
  CRISPR gRNA sequence
aactcctccaccgtctgagg

SEQ ID NO: 194433 - DNA, 20 bp, Artificial
  CRISPR gRNA sequence
ctccaccgtctgaggaggtt

SEQ ID NO: 194434 - DNA, 20 bp, Artificial
  CRISPR gRNA sequence
tccaccgtctgaggaggttt

SEQ ID NO: 194435 - DNA, 20 bp, Artificial
  CRISPR gRNA sequence
caccgtctgaggaggtttag

SEQ ID NO: 194436 - DNA, 20 bp, Artificial
  CRISPR gRNA sequence
cgtctgaggaggtttaggag

SEQ ID NO: 194437 - DNA, 20 bp, Artificial
  CRISPR gRNA sequence
gtctgaggaggtttaggagc

SEQ ID NO: 194438 - DNA, 20 bp, Artificial
  CRISPR gRNA sequence
tctgaggaggtttaggagca

SEQ ID NO: 194439 - DNA, 20 bp, Artificial
  CRISPR gRNA sequence
gaggaggtttaggagcaggg

SEQ ID NO: 194440 - DNA, 20 bp, Artificial
  CRISPR gRNA sequence
aggaggtttaggagcaggga

SEQ ID NO: 194441 - DNA, 20 bp, Artificial
  CRISPR gRNA sequence
ggaggtttaggagcagggaa

SEQ ID NO: 194442 - DNA, 20 bp, Artificial
  CRISPR gRNA sequence
gaggtttaggagcagggaag

SEQ ID NO: 194443 - DNA, 20 bp, Artificial
  CRISPR gRNA sequence
gtttaggagcagggaagggg

SEQ ID NO: 194444 - DNA, 20 bp, Artificial
  CRISPR gRNA sequence
tttaggagcagggaagggga

SEQ ID NO: 194445 - DNA, 20 bp, Artificial
  CRISPR gRNA sequence
taggagcagggaaggggaag

SEQ ID NO: 194446 - DNA, 20 bp, Artificial
  CRISPR gRNA sequence
agcagggaaggggaaggagt

SEQ ID NO: 194447 - DNA, 20 bp, Artificial
  CRISPR gRNA sequence
tcttctgttgccctgcaccc

SEQ ID NO: 194448 - DNA, 20 bp, Artificial
  CRISPR gRNA sequence
tctgttgccctgcaccctag

SEQ ID NO: 194449 - DNA, 20 bp, Artificial
  CRISPR gRNA sequence
tgcaccctagcagctccttg

SEQ ID NO: 194450 - DNA, 20 bp, Artificial
  CRISPR gRNA sequence
accctagcagctccttgcag

SEQ ID NO: 194451 - DNA, 20 bp, Artificial
  CRISPR gRNA sequence
ccctagcagctccttgcagc

SEQ ID NO: 194452 - DNA, 20 bp, Artificial
  CRISPR gRNA sequence
cctagcagctccttgcagca

SEQ ID NO: 194453 - DNA, 20 bp, Artificial
  CRISPR gRNA sequence
ctagcagctccttgcagcag

SEQ ID NO: 194454 - DNA, 20 bp, Artificial
  CRISPR gRNA sequence
agctccttgcagcaggggac

SEQ ID NO: 194455 - DNA, 20 bp, Artificial
  CRISPR gRNA sequence
gctccttgcagcaggggaca

SEQ ID NO: 194456 - DNA, 20 bp, Artificial
  CRISPR gRNA sequence
agcaggggacaaggatgact

SEQ ID NO: 194457 - DNA, 20 bp, Artificial
  CRISPR gRNA sequence
gcaggggacaaggatgactt

SEQ ID NO: 194458 - DNA, 20 bp, Artificial
  CRISPR gRNA sequence
ggggacaaggatgacttagg

SEQ ID NO: 194459 - DNA, 20 bp, Artificial
  CRISPR gRNA sequence
acaaggatgacttaggtgga

SEQ ID NO: 194460 - DNA, 20 bp, Artificial
  CRISPR gRNA sequence
gattctaaaatattgtgtgt

SEQ ID NO: 194461 - DNA, 20 bp, Artificial
  CRISPR gRNA sequence
tatgttaattgcaccatgca

SEQ ID NO: 194462 - DNA, 20 bp, Artificial
  CRISPR gRNA sequence
cccaccccttgccattacca

SEQ ID NO: 194463 - DNA, 20 bp, Artificial
  CRISPR gRNA sequence
caccccttgccattaccaaa

SEQ ID NO: 194464 - DNA, 20 bp, Artificial
  CRISPR gRNA sequence
ccccttgccattaccaaaga

SEQ ID NO: 194465 - DNA, 20 bp, Artificial
  CRISPR gRNA sequence
ccttgccattaccaaagaga

SEQ ID NO: 194466 - DNA, 20 bp, Artificial
  CRISPR gRNA sequence
ttgccattaccaaagagaga

SEQ ID NO: 194467 - DNA, 20 bp, Artificial
  CRISPR gRNA sequence
gccattaccaaagagagaga

SEQ ID NO: 194468 - DNA, 20 bp, Artificial
  CRISPR gRNA sequence
cattaccaaagagagagaga

SEQ ID NO: 194469 - DNA, 20 bp, Artificial
  CRISPR gRNA sequence
ttaccaaagagagagagaga

SEQ ID NO: 194470 - DNA, 20 bp, Artificial
  CRISPR gRNA sequence
accaaagagagagagagaga

SEQ ID NO: 194471 - DNA, 20 bp, Artificial
  CRISPR gRNA sequence
caaagagagagagagagaga

SEQ ID NO: 194472 - DNA, 20 bp, Artificial
  CRISPR gRNA sequence
aagagagagagagagagaga

SEQ ID NO: 194473 - DNA, 20 bp, Artificial
  CRISPR gRNA sequence
gagagagagagagagagaga

SEQ ID NO: 194474 - DNA, 20 bp, Artificial
  CRISPR gRNA sequence
agagagagagagagaaatac

SEQ ID NO: 194475 - DNA, 20 bp, Artificial
  CRISPR gRNA sequence
tagaatttatcctcatttta

SEQ ID NO: 194476 - DNA, 20 bp, Artificial
  CRISPR gRNA sequence
aatttatcctcattttacag

SEQ ID NO: 194477 - DNA, 20 bp, Artificial
  CRISPR gRNA sequence
tttatcctcattttacagta

SEQ ID NO: 194478 - DNA, 20 bp, Artificial
  CRISPR gRNA sequence
tcattttacagtagagaaaa

SEQ ID NO: 194479 - DNA, 20 bp, Artificial
  CRISPR gRNA sequence
attttacagtagagaaaaca

SEQ ID NO: 194480 - DNA, 20 bp, Artificial
  CRISPR gRNA sequence
ttttacagtagagaaaacag

SEQ ID NO: 194481 - DNA, 20 bp, Artificial
  CRISPR gRNA sequence
tttacagtagagaaaacaga

SEQ ID NO: 194482 - DNA, 20 bp, Artificial
  CRISPR gRNA sequence
agtagagaaaacagagggtc

SEQ ID NO: 194483 - DNA, 20 bp, Artificial
  CRISPR gRNA sequence
agagaaaacagagggtcaag

SEQ ID NO: 194484 - DNA, 20 bp, Artificial
  CRISPR gRNA sequence
agggtcaagaagataatgta

SEQ ID NO: 194485 - DNA, 20 bp, Artificial
  CRISPR gRNA sequence
gaagataatgtaaagtgccc

SEQ ID NO: 194486 - DNA, 20 bp, Artificial
  CRISPR gRNA sequence
gtaaagtgcccaagaacaca

SEQ ID NO: 194487 - DNA, 20 bp, Artificial
  CRISPR gRNA sequence
cacagctgatcacaaaaatc

SEQ ID NO: 194488 - DNA, 20 bp, Artificial
  CRISPR gRNA sequence
ctgatcacaaaaatcaagct

SEQ ID NO: 194489 - DNA, 20 bp, Artificial
  CRISPR gRNA sequence
tgatcacaaaaatcaagctt

SEQ ID NO: 194490 - DNA, 20 bp, Artificial
  CRISPR gRNA sequence
gatcacaaaaatcaagcttg

SEQ ID NO: 194491 - DNA, 20 bp, Artificial
  CRISPR gRNA sequence
atcacaaaaatcaagcttgg

SEQ ID NO: 194492 - DNA, 20 bp, Artificial
  CRISPR gRNA sequence
aaatcaagcttgggggccat

SEQ ID NO: 194493 - DNA, 20 bp, Artificial
  CRISPR gRNA sequence
gggggccattagcctaacca

SEQ ID NO: 194494 - DNA, 20 bp, Artificial
  CRISPR gRNA sequence
ctacaaatgtttacatttat

SEQ ID NO: 194495 - DNA, 20 bp, Artificial
  CRISPR gRNA sequence
caaatgtttacatttataag

SEQ ID NO: 194496 - DNA, 20 bp, Artificial
  CRISPR gRNA sequence
aaatgtttacatttataagc

SEQ ID NO: 194497 - DNA, 20 bp, Artificial
  CRISPR gRNA sequence
aatgtttacatttataagca

SEQ ID NO: 194498 - DNA, 20 bp, Artificial
  CRISPR gRNA sequence
gtttacatttataagcaggg

SEQ ID NO: 194499 - DNA, 20 bp, Artificial
  CRISPR gRNA sequence
cagggcagaaaaacctcatc

SEQ ID NO: 194500 - DNA, 20 bp, Artificial
  CRISPR gRNA sequence
agggcagaaaaacctcatcc

SEQ ID NO: 194501 - DNA, 20 bp, Artificial
  CRISPR gRNA sequence
ctcatccaggttattgaact

SEQ ID NO: 194502 - DNA, 20 bp, Artificial
  CRISPR gRNA sequence
atccaggttattgaactaag

SEQ ID NO: 194503 - DNA, 20 bp, Artificial
  CRISPR gRNA sequence
aggttattgaactaagaaga

SEQ ID NO: 194504 - DNA, 20 bp, Artificial
  CRISPR gRNA sequence
actaagaagaaagttatatt

SEQ ID NO: 194505 - DNA, 20 bp, Artificial
  CRISPR gRNA sequence
ctaagaagaaagttatatta

SEQ ID NO: 194506 - DNA, 20 bp, Artificial
  CRISPR gRNA sequence
ggtttctaatttttttaatg

SEQ ID NO: 194507 - DNA, 20 bp, Artificial
  CRISPR gRNA sequence
tctaatttttttaatgtagt

SEQ ID NO: 194508 - DNA, 20 bp, Artificial
  CRISPR gRNA sequence
tagaaaccaaacttaacaat

SEQ ID NO: 194509 - DNA, 20 bp, Artificial
  CRISPR gRNA sequence
ccaaacttaacaatgagccc

SEQ ID NO: 194510 - DNA, 20 bp, Artificial
  CRISPR gRNA sequence
taacaatgagcccaagttta

SEQ ID NO: 194511 - DNA, 20 bp, Artificial
  CRISPR gRNA sequence
caatgagcccaagtttaaag

SEQ ID NO: 194512 - DNA, 20 bp, Artificial
  CRISPR gRNA sequence
ttaaagcagtctaattaacc

SEQ ID NO: 194513 - DNA, 20 bp, Artificial
  CRISPR gRNA sequence
gcagtctaattaacctggac

SEQ ID NO: 194514 - DNA, 20 bp, Artificial
  CRISPR gRNA sequence
ctaattaacctggacaagct

SEQ ID NO: 194515 - DNA, 20 bp, Artificial
  CRISPR gRNA sequence
taattaacctggacaagctc

SEQ ID NO: 194516 - DNA, 20 bp, Artificial
  CRISPR gRNA sequence
taacctggacaagctcaggc

SEQ ID NO: 194517 - DNA, 20 bp, Artificial
  CRISPR gRNA sequence
ctcaggcaagtttcattctg

SEQ ID NO: 194518 - DNA, 20 bp, Artificial
  CRISPR gRNA sequence
aagtttcattctgtggccca

SEQ ID NO: 194519 - DNA, 20 bp, Artificial
  CRISPR gRNA sequence
atagcatcatctgtgttgta

SEQ ID NO: 194520 - DNA, 20 bp, Artificial
  CRISPR gRNA sequence
atcatctgtgttgtaaagct

SEQ ID NO: 194521 - DNA, 20 bp, Artificial
  CRISPR gRNA sequence
atctgtgttgtaaagctaag

SEQ ID NO: 194522 - DNA, 20 bp, Artificial
  CRISPR gRNA sequence
gctaagtagcaaatgttgtt

SEQ ID NO: 194523 - DNA, 20 bp, Artificial
  CRISPR gRNA sequence
ctaagtagcaaatgttgttt

SEQ ID NO: 194524 - DNA, 20 bp, Artificial
  CRISPR gRNA sequence
aaatgttgtttgggtcatgc

SEQ ID NO: 194525 - DNA, 20 bp, Artificial
  CRISPR gRNA sequence
aatgttgtttgggtcatgct

SEQ ID NO: 194526 - DNA, 20 bp, Artificial
  CRISPR gRNA sequence
atgttgtttgggtcatgctg

SEQ ID NO: 194527 - DNA, 20 bp, Artificial
  CRISPR gRNA sequence
tgttgtttgggtcatgctgg

SEQ ID NO: 194528 - DNA, 20 bp, Artificial
  CRISPR gRNA sequence
tttgggtcatgctgggggac

SEQ ID NO: 194529 - DNA, 20 bp, Artificial
  CRISPR gRNA sequence
acaagccatcccaatttgct

SEQ ID NO: 194530 - DNA, 20 bp, Artificial
  CRISPR gRNA sequence
caagccatcccaatttgctc

SEQ ID NO: 194531 - DNA, 20 bp, Artificial
  CRISPR gRNA sequence
atcccaatttgctcaggact

SEQ ID NO: 194532 - DNA, 20 bp, Artificial
  CRISPR gRNA sequence
tcccaatttgctcaggactg

SEQ ID NO: 194533 - DNA, 20 bp, Artificial
  CRISPR gRNA sequence
cccaatttgctcaggactga

SEQ ID NO: 194534 - DNA, 20 bp, Artificial
  CRISPR gRNA sequence
ccaatttgctcaggactgag

SEQ ID NO: 194535 - DNA, 20 bp, Artificial
  CRISPR gRNA sequence
ctcaggactgaggggttttc

SEQ ID NO: 194536 - DNA, 20 bp, Artificial
  CRISPR gRNA sequence
tcaggactgaggggttttcc

SEQ ID NO: 194537 - DNA, 20 bp, Artificial
  CRISPR gRNA sequence
ggttttccaggatatcatgt

SEQ ID NO: 194538 - DNA, 20 bp, Artificial
  CRISPR gRNA sequence
gttttccaggatatcatgta

SEQ ID NO: 194539 - DNA, 20 bp, Artificial
  CRISPR gRNA sequence
ggatatcatgtaaggataat

SEQ ID NO: 194540 - DNA, 20 bp, Artificial
  CRISPR gRNA sequence
gatatcatgtaaggataatt

SEQ ID NO: 194541 - DNA, 20 bp, Artificial
  CRISPR gRNA sequence
aaatttatcatttatcatat

SEQ ID NO: 194542 - DNA, 20 bp, Artificial
  CRISPR gRNA sequence
tttatcatatcagcaactat

SEQ ID NO: 194543 - DNA, 20 bp, Artificial
  CRISPR gRNA sequence
ctatgagttatgttttttat

SEQ ID NO: 194544 - DNA, 20 bp, Artificial
  CRISPR gRNA sequence
atttcttgttactttttccc

SEQ ID NO: 194545 - DNA, 20 bp, Artificial
  CRISPR gRNA sequence
aatatactattatcactctc

SEQ ID NO: 194546 - DNA, 20 bp, Artificial
  CRISPR gRNA sequence
tcactctccagatacacatt

SEQ ID NO: 194547 - DNA, 20 bp, Artificial
  CRISPR gRNA sequence
actctccagatacacatttg

SEQ ID NO: 194548 - DNA, 20 bp, Artificial
  CRISPR gRNA sequence
ctctccagatacacatttgg

SEQ ID NO: 194549 - DNA, 20 bp, Artificial
  CRISPR gRNA sequence
ctccagatacacatttggag

SEQ ID NO: 194550 - DNA, 20 bp, Artificial
  CRISPR gRNA sequence
catttggaggagacgtaatc

SEQ ID NO: 194551 - DNA, 20 bp, Artificial
  CRISPR gRNA sequence
gaggagacgtaatccagcat

SEQ ID NO: 194552 - DNA, 20 bp, Artificial
  CRISPR gRNA sequence
cattggaacttctgatcttc

SEQ ID NO: 194553 - DNA, 20 bp, Artificial
  CRISPR gRNA sequence
tggaacttctgatcttcaag

SEQ ID NO: 194554 - DNA, 20 bp, Artificial
  CRISPR gRNA sequence
ggaacttctgatcttcaagc

SEQ ID NO: 194555 - DNA, 20 bp, Artificial
  CRISPR gRNA sequence
gaacttctgatcttcaagca

SEQ ID NO: 194556 - DNA, 20 bp, Artificial
  CRISPR gRNA sequence
aagcagggattctcaacctg

SEQ ID NO: 194557 - DNA, 20 bp, Artificial
  CRISPR gRNA sequence
gggattctcaacctgtggtt

SEQ ID NO: 194558 - DNA, 20 bp, Artificial
  CRISPR gRNA sequence
ggattctcaacctgtggttt

SEQ ID NO: 194559 - DNA, 20 bp, Artificial
  CRISPR gRNA sequence
gattctcaacctgtggttta

SEQ ID NO: 194560 - DNA, 20 bp, Artificial
  CRISPR gRNA sequence
attctcaacctgtggtttag

SEQ ID NO: 194561 - DNA, 20 bp, Artificial
  CRISPR gRNA sequence
cctgtggtttaggggttcat

SEQ ID NO: 194562 - DNA, 20 bp, Artificial
  CRISPR gRNA sequence
ctgtggtttaggggttcatc

SEQ ID NO: 194563 - DNA, 20 bp, Artificial
  CRISPR gRNA sequence
tgtggtttaggggttcatcg

SEQ ID NO: 194564 - DNA, 20 bp, Artificial
  CRISPR gRNA sequence
tttaggggttcatcggggct

SEQ ID NO: 194565 - DNA, 20 bp, Artificial
  CRISPR gRNA sequence
tcatcggggctgagcgtgac

SEQ ID NO: 194566 - DNA, 20 bp, Artificial
  CRISPR gRNA sequence
atcggggctgagcgtgacaa

SEQ ID NO: 194567 - DNA, 20 bp, Artificial
  CRISPR gRNA sequence
tcggggctgagcgtgacaag

SEQ ID NO: 194568 - DNA, 20 bp, Artificial
  CRISPR gRNA sequence
gggctgagcgtgacaagagg

SEQ ID NO: 194569 - DNA, 20 bp, Artificial
  CRISPR gRNA sequence
ggctgagcgtgacaagagga

SEQ ID NO: 194570 - DNA, 20 bp, Artificial
  CRISPR gRNA sequence
agcgtgacaagaggaaggaa

SEQ ID NO: 194571 - DNA, 20 bp, Artificial
  CRISPR gRNA sequence
gcgtgacaagaggaaggaat

SEQ ID NO: 194572 - DNA, 20 bp, Artificial
  CRISPR gRNA sequence
aagaggaaggaatgggcccg

SEQ ID NO: 194573 - DNA, 20 bp, Artificial
  CRISPR gRNA sequence
ttccttcctcttgtcacgct

SEQ ID NO: 194574 - DNA, 20 bp, Artificial
  CRISPR gRNA sequence
cccgatgaacccctaaacca

SEQ ID NO: 194575 - DNA, 20 bp, Artificial
  CRISPR gRNA sequence
ccgatgaacccctaaaccac

SEQ ID NO: 194576 - DNA, 20 bp, Artificial
  CRISPR gRNA sequence
gaacccctaaaccacaggtt

SEQ ID NO: 194577 - DNA, 20 bp, Artificial
  CRISPR gRNA sequence
aggttgagaatccctgcttg

SEQ ID NO: 194578 - DNA, 20 bp, Artificial
  CRISPR gRNA sequence
gagaatccctgcttgaagat

SEQ ID NO: 194579 - DNA, 20 bp, Artificial
  CRISPR gRNA sequence
aatccctgcttgaagatcag

SEQ ID NO: 194580 - DNA, 20 bp, Artificial
  CRISPR gRNA sequence
aagatcagaagttccaatgc

SEQ ID NO: 194581 - DNA, 20 bp, Artificial
  CRISPR gRNA sequence
gtctcctccaaatgtgtatc

SEQ ID NO: 194582 - DNA, 20 bp, Artificial
  CRISPR gRNA sequence
ctcctccaaatgtgtatctg

SEQ ID NO: 194583 - DNA, 20 bp, Artificial
  CRISPR gRNA sequence
cctccaaatgtgtatctgga

SEQ ID NO: 194584 - DNA, 20 bp, Artificial
  CRISPR gRNA sequence
gtgtatctggagagtgataa

SEQ ID NO: 194585 - DNA, 20 bp, Artificial
  CRISPR gRNA sequence
ataatagtatattaatttca

SEQ ID NO: 194586 - DNA, 20 bp, Artificial
  CRISPR gRNA sequence
taatagtatattaatttcat

SEQ ID NO: 194587 - DNA, 20 bp, Artificial
  CRISPR gRNA sequence
tagtatattaatttcatggg

SEQ ID NO: 194588 - DNA, 20 bp, Artificial
  CRISPR gRNA sequence
tatattaatttcatgggaag

SEQ ID NO: 194589 - DNA, 20 bp, Artificial
  CRISPR gRNA sequence
taatttcatgggaagtggtc

SEQ ID NO: 194590 - DNA, 20 bp, Artificial
  CRISPR gRNA sequence
aatttcatgggaagtggtct

SEQ ID NO: 194591 - DNA, 20 bp, Artificial
  CRISPR gRNA sequence
atttcatgggaagtggtctg

SEQ ID NO: 194592 - DNA, 20 bp, Artificial
  CRISPR gRNA sequence
tgggaagtggtctggggaaa

SEQ ID NO: 194593 - DNA, 20 bp, Artificial
  CRISPR gRNA sequence
tggtctggggaaaaagtaac

SEQ ID NO: 194594 - DNA, 20 bp, Artificial
  CRISPR gRNA sequence
ctaataaaaaacataactca

SEQ ID NO: 194595 - DNA, 20 bp, Artificial
  CRISPR gRNA sequence
ataaatgataaatttgaaat

SEQ ID NO: 194596 - DNA, 20 bp, Artificial
  CRISPR gRNA sequence
aaatgataaatttgaaatga

SEQ ID NO: 194597 - DNA, 20 bp, Artificial
  CRISPR gRNA sequence
gataaatttgaaatgagaga

SEQ ID NO: 194598 - DNA, 20 bp, Artificial
  CRISPR gRNA sequence
aaatttgaaatgagagaaag

SEQ ID NO: 194599 - DNA, 20 bp, Artificial
  CRISPR gRNA sequence
tttgaaatgagagaaagcag

SEQ ID NO: 194600 - DNA, 20 bp, Artificial
  CRISPR gRNA sequence
ttgaaatgagagaaagcagc

SEQ ID NO: 194601 - DNA, 20 bp, Artificial
  CRISPR gRNA sequence
attatccttacatgatatcc

SEQ ID NO: 194602 - DNA, 20 bp, Artificial
  CRISPR gRNA sequence
tgatatcctggaaaacccct

SEQ ID NO: 194603 - DNA, 20 bp, Artificial
  CRISPR gRNA sequence
ctggaaaacccctcagtcct

SEQ ID NO: 194604 - DNA, 20 bp, Artificial
  CRISPR gRNA sequence
cccctcagtcctgagcaaat

SEQ ID NO: 194605 - DNA, 20 bp, Artificial
  CRISPR gRNA sequence
ccctcagtcctgagcaaatt

SEQ ID NO: 194606 - DNA, 20 bp, Artificial
  CRISPR gRNA sequence
cagtcctgagcaaattggga

SEQ ID NO: 194607 - DNA, 20 bp, Artificial
  CRISPR gRNA sequence
aattgggatggcttgtcccc

SEQ ID NO: 194608 - DNA, 20 bp, Artificial
  CRISPR gRNA sequence
cccaaacaacatttgctact

SEQ ID NO: 194609 - DNA, 20 bp, Artificial
  CRISPR gRNA sequence
tgctacttagctttacaaca

SEQ ID NO: 194610 - DNA, 20 bp, Artificial
  CRISPR gRNA sequence
ttacaacacagatgatgcta

SEQ ID NO: 194611 - DNA, 20 bp, Artificial
  CRISPR gRNA sequence
tacaacacagatgatgctat

SEQ ID NO: 194612 - DNA, 20 bp, Artificial
  CRISPR gRNA sequence
acagatgatgctatgggcca

SEQ ID NO: 194613 - DNA, 20 bp, Artificial
  CRISPR gRNA sequence
ccacagaatgaaacttgcct

SEQ ID NO: 194614 - DNA, 20 bp, Artificial
  CRISPR gRNA sequence
gaaacttgcctgagcttgtc

SEQ ID NO: 194615 - DNA, 20 bp, Artificial
  CRISPR gRNA sequence
aaacttgcctgagcttgtcc

SEQ ID NO: 194616 - DNA, 20 bp, Artificial
  CRISPR gRNA sequence
ctgagcttgtccaggttaat

SEQ ID NO: 194617 - DNA, 20 bp, Artificial
  CRISPR gRNA sequence
taattagactgctttaaact

SEQ ID NO: 194618 - DNA, 20 bp, Artificial
  CRISPR gRNA sequence
aattagactgctttaaactt

SEQ ID NO: 194619 - DNA, 20 bp, Artificial
  CRISPR gRNA sequence
ttaaacttgggctcattgtt

SEQ ID NO: 194620 - DNA, 20 bp, Artificial
  CRISPR gRNA sequence
cttgggctcattgttaagtt

SEQ ID NO: 194621 - DNA, 20 bp, Artificial
  CRISPR gRNA sequence
tctaactacattaaaaaaat

SEQ ID NO: 194622 - DNA, 20 bp, Artificial
  CRISPR gRNA sequence
ccttaatataactttcttct

SEQ ID NO: 194623 - DNA, 20 bp, Artificial
  CRISPR gRNA sequence
ttcttcttagttcaataacc

SEQ ID NO: 194624 - DNA, 20 bp, Artificial
  CRISPR gRNA sequence
cttagttcaataacctggat

SEQ ID NO: 194625 - DNA, 20 bp, Artificial
  CRISPR gRNA sequence
ttagttcaataacctggatg

SEQ ID NO: 194626 - DNA, 20 bp, Artificial
  CRISPR gRNA sequence
cttataaatgtaaacatttg

SEQ ID NO: 194627 - DNA, 20 bp, Artificial
  CRISPR gRNA sequence
tgtaaacatttgtagcaaaa

SEQ ID NO: 194628 - DNA, 20 bp, Artificial
  CRISPR gRNA sequence
atttgtagcaaaatggattg

SEQ ID NO: 194629 - DNA, 20 bp, Artificial
  CRISPR gRNA sequence
tgtagcaaaatggattgaag

SEQ ID NO: 194630 - DNA, 20 bp, Artificial
  CRISPR gRNA sequence
gcaaaatggattgaagcaga

SEQ ID NO: 194631 - DNA, 20 bp, Artificial
  CRISPR gRNA sequence
caaaatggattgaagcagat

SEQ ID NO: 194632 - DNA, 20 bp, Artificial
  CRISPR gRNA sequence
tggattgaagcagatgggtt

SEQ ID NO: 194633 - DNA, 20 bp, Artificial
  CRISPR gRNA sequence
gattgaagcagatgggttaa

SEQ ID NO: 194634 - DNA, 20 bp, Artificial
  CRISPR gRNA sequence
gaagcagatgggttaagagt

SEQ ID NO: 194635 - DNA, 20 bp, Artificial
  CRISPR gRNA sequence
aagcagatgggttaagagta

SEQ ID NO: 194636 - DNA, 20 bp, Artificial
  CRISPR gRNA sequence
agcagatgggttaagagtaa

SEQ ID NO: 194637 - DNA, 20 bp, Artificial
  CRISPR gRNA sequence
gggttaagagtaagggtctg

SEQ ID NO: 194638 - DNA, 20 bp, Artificial
  CRISPR gRNA sequence
taagagtaagggtctgtggt

SEQ ID NO: 194639 - DNA, 20 bp, Artificial
  CRISPR gRNA sequence
aagagtaagggtctgtggtt

SEQ ID NO: 194640 - DNA, 20 bp, Artificial
  CRISPR gRNA sequence
agggtctgtggttaggctaa

SEQ ID NO: 194641 - DNA, 20 bp, Artificial
  CRISPR gRNA sequence
tggttaggctaatggccccc

SEQ ID NO: 194642 - DNA, 20 bp, Artificial
  CRISPR gRNA sequence
ccaagcttgatttttgtgat

SEQ ID NO: 194643 - DNA, 20 bp, Artificial
  CRISPR gRNA sequence
tgtgatcagctgtgtgttct

SEQ ID NO: 194644 - DNA, 20 bp, Artificial
  CRISPR gRNA sequence
gtgatcagctgtgtgttctt

SEQ ID NO: 194645 - DNA, 20 bp, Artificial
  CRISPR gRNA sequence
tgttttctctactgtaaaat

SEQ ID NO: 194646 - DNA, 20 bp, Artificial
  CRISPR gRNA sequence
gttttctctactgtaaaatg

SEQ ID NO: 194647 - DNA, 20 bp, Artificial
  CRISPR gRNA sequence
tgtaaaatgaggataaattc

SEQ ID NO: 194648 - DNA, 20 bp, Artificial
  CRISPR gRNA sequence
tctctctctctctctctctt

SEQ ID NO: 194649 - DNA, 20 bp, Artificial
  CRISPR gRNA sequence
tctctctctctctttggtaa

SEQ ID NO: 194650 - DNA, 20 bp, Artificial
  CRISPR gRNA sequence
tctctctctttggtaatggc

SEQ ID NO: 194651 - DNA, 20 bp, Artificial
  CRISPR gRNA sequence
ctctctctttggtaatggca

SEQ ID NO: 194652 - DNA, 20 bp, Artificial
  CRISPR gRNA sequence
tctctctttggtaatggcaa

SEQ ID NO: 194653 - DNA, 20 bp, Artificial
  CRISPR gRNA sequence
ctctctttggtaatggcaag

SEQ ID NO: 194654 - DNA, 20 bp, Artificial
  CRISPR gRNA sequence
tctttggtaatggcaagggg

SEQ ID NO: 194655 - DNA, 20 bp, Artificial
  CRISPR gRNA sequence
ctttggtaatggcaaggggt

SEQ ID NO: 194656 - DNA, 20 bp, Artificial
  CRISPR gRNA sequence
tttggtaatggcaaggggtg

SEQ ID NO: 194657 - DNA, 20 bp, Artificial
  CRISPR gRNA sequence
ttggtaatggcaaggggtgg

SEQ ID NO: 194658 - DNA, 20 bp, Artificial
  CRISPR gRNA sequence
caaggggtgggggattaaat

SEQ ID NO: 194659 - DNA, 20 bp, Artificial
  CRISPR gRNA sequence
attaaatgagataccgtgca

SEQ ID NO: 194660 - DNA, 20 bp, Artificial
  CRISPR gRNA sequence
cgtgcatggtgcaattaaca

SEQ ID NO: 194661 - DNA, 20 bp, Artificial
  CRISPR gRNA sequence
aatactgacacacaatattt

SEQ ID NO: 194662 - DNA, 20 bp, Artificial
  CRISPR gRNA sequence
aattaattatccatccacct

SEQ ID NO: 194663 - DNA, 20 bp, Artificial
  CRISPR gRNA sequence
tcatccttgtcccctgctgc

SEQ ID NO: 194664 - DNA, 20 bp, Artificial
  CRISPR gRNA sequence
catccttgtcccctgctgca

SEQ ID NO: 194665 - DNA, 20 bp, Artificial
  CRISPR gRNA sequence
tccttgtcccctgctgcaag

SEQ ID NO: 194666 - DNA, 20 bp, Artificial
  CRISPR gRNA sequence
cccctgctgcaaggagctgc

SEQ ID NO: 194667 - DNA, 20 bp, Artificial
  CRISPR gRNA sequence
ccctgctgcaaggagctgct

SEQ ID NO: 194668 - DNA, 20 bp, Artificial
  CRISPR gRNA sequence
cctgctgcaaggagctgcta

SEQ ID NO: 194669 - DNA, 20 bp, Artificial
  CRISPR gRNA sequence
tgcaaggagctgctagggtg

SEQ ID NO: 194670 - DNA, 20 bp, Artificial
  CRISPR gRNA sequence
gcaaggagctgctagggtgc

SEQ ID NO: 194671 - DNA, 20 bp, Artificial
  CRISPR gRNA sequence
caaggagctgctagggtgca

SEQ ID NO: 194672 - DNA, 20 bp, Artificial
  CRISPR gRNA sequence
gctgctagggtgcagggcaa

SEQ ID NO: 194673 - DNA, 20 bp, Artificial
  CRISPR gRNA sequence
gctagggtgcagggcaacag

SEQ ID NO: 194674 - DNA, 20 bp, Artificial
  CRISPR gRNA sequence
ggtgcagggcaacagaagat

SEQ ID NO: 194675 - DNA, 20 bp, Artificial
  CRISPR gRNA sequence
caacagaagattagcaaatg

SEQ ID NO: 194676 - DNA, 20 bp, Artificial
  CRISPR gRNA sequence
tccctgctcctaaacctcct

SEQ ID NO: 194677 - DNA, 20 bp, Artificial
  CRISPR gRNA sequence
tgctcctaaacctcctcaga

SEQ ID NO: 194678 - DNA, 20 bp, Artificial
  CRISPR gRNA sequence
tcctaaacctcctcagacgg

SEQ ID NO: 194679 - DNA, 20 bp, Artificial
  CRISPR gRNA sequence
ctaaacctcctcagacggtg

SEQ ID NO: 194680 - DNA, 20 bp, Artificial
  CRISPR gRNA sequence
taaacctcctcagacggtgg

SEQ ID NO: 194681 - DNA, 20 bp, Artificial
  CRISPR gRNA sequence
aacctcctcagacggtggag

SEQ ID NO: 194682 - DNA, 20 bp, Artificial
  CRISPR gRNA sequence
cggtggaggagttcttgtgt

SEQ ID NO: 194683 - DNA, 20 bp, Artificial
  CRISPR gRNA sequence
ggagttcttgtgttagctgt

SEQ ID NO: 194684 - DNA, 20 bp, Artificial
  CRISPR gRNA sequence
gagttcttgtgttagctgtg

SEQ ID NO: 194685 - DNA, 20 bp, Artificial
  CRISPR gRNA sequence
cttgtgttagctgtgaggca

SEQ ID NO: 194686 - DNA, 20 bp, Artificial
  CRISPR gRNA sequence
ttgtgttagctgtgaggcaa

SEQ ID NO: 194687 - DNA, 20 bp, Artificial
  CRISPR gRNA sequence
tgtgttagctgtgaggcaaa

SEQ ID NO: 194688 - DNA, 20 bp, Artificial
  CRISPR gRNA sequence
gtgttagctgtgaggcaaag

SEQ ID NO: 194689 - DNA, 20 bp, Artificial
  CRISPR gRNA sequence
gctgtgaggcaaaggggaac

SEQ ID NO: 194690 - DNA, 20 bp, Artificial
  CRISPR gRNA sequence
ggggaaccagcattctttaa

SEQ ID NO: 194691 - DNA, 20 bp, Artificial
  CRISPR gRNA sequence
gggaaccagcattctttaaa

SEQ ID NO: 194692 - DNA, 20 bp, Artificial
  CRISPR gRNA sequence
gaaccagcattctttaaaag

SEQ ID NO: 194693 - DNA, 20 bp, Artificial
  CRISPR gRNA sequence
accagcattctttaaaagga

SEQ ID NO: 194694 - DNA, 20 bp, Artificial
  CRISPR gRNA sequence
ccagcattctttaaaaggag

SEQ ID NO: 194695 - DNA, 20 bp, Artificial
  CRISPR gRNA sequence
agcattctttaaaaggagag

SEQ ID NO: 194696 - DNA, 20 bp, Artificial
  CRISPR gRNA sequence
ggagaggagattatgactga

SEQ ID NO: 194697 - DNA, 20 bp, Artificial
  CRISPR gRNA sequence
atttctctttgttattgctt

SEQ ID NO: 194698 - DNA, 20 bp, Artificial
  CRISPR gRNA sequence
tcttaccactttgcttcttt

SEQ ID NO: 194699 - DNA, 20 bp, Artificial
  CRISPR gRNA sequence
gcttctttgagtttgtatct

SEQ ID NO: 194700 - DNA, 20 bp, Artificial
  CRISPR gRNA sequence
cacatccatcattctccctt

SEQ ID NO: 194701 - DNA, 20 bp, Artificial
  CRISPR gRNA sequence
catcattctcccttgagaaa

SEQ ID NO: 194702 - DNA, 20 bp, Artificial
  CRISPR gRNA sequence
aaatcatttttatttccata

SEQ ID NO: 194703 - DNA, 20 bp, Artificial
  CRISPR gRNA sequence
atttttatttccatatagca

SEQ ID NO: 194704 - DNA, 20 bp, Artificial
  CRISPR gRNA sequence
gcacagctctacatcccata

SEQ ID NO: 194705 - DNA, 20 bp, Artificial
  CRISPR gRNA sequence
tacatcccatacagtgaccc

SEQ ID NO: 194706 - DNA, 20 bp, Artificial
  CRISPR gRNA sequence
gtgacccaagtttaaatttc

SEQ ID NO: 194707 - DNA, 20 bp, Artificial
  CRISPR gRNA sequence
tgtgaaacatttgtaatccc

SEQ ID NO: 194708 - DNA, 20 bp, Artificial
  CRISPR gRNA sequence
gtgaaacatttgtaatccct

SEQ ID NO: 194709 - DNA, 20 bp, Artificial
  CRISPR gRNA sequence
aaacatttgtaatccctagg

SEQ ID NO: 194710 - DNA, 20 bp, Artificial
  CRISPR gRNA sequence
tttgtaatccctaggaagtc

SEQ ID NO: 194711 - DNA, 20 bp, Artificial
  CRISPR gRNA sequence
gtaatccctaggaagtctgg

SEQ ID NO: 194712 - DNA, 20 bp, Artificial
  CRISPR gRNA sequence
tggtggacatccttattcca

SEQ ID NO: 194713 - DNA, 20 bp, Artificial
  CRISPR gRNA sequence
ggtggacatccttattccac

SEQ ID NO: 194714 - DNA, 20 bp, Artificial
  CRISPR gRNA sequence
ttccacaggtcccaacttat

SEQ ID NO: 194715 - DNA, 20 bp, Artificial
  CRISPR gRNA sequence
tccacaggtcccaacttatg

SEQ ID NO: 194716 - DNA, 20 bp, Artificial
  CRISPR gRNA sequence
tatgaggttaattaattcaa

SEQ ID NO: 194717 - DNA, 20 bp, Artificial
  CRISPR gRNA sequence
ggttaattaattcaatagtg

SEQ ID NO: 194718 - DNA, 20 bp, Artificial
  CRISPR gRNA sequence
gttaattaattcaatagtgt

SEQ ID NO: 194719 - DNA, 20 bp, Artificial
  CRISPR gRNA sequence
ttaattaattcaatagtgta

SEQ ID NO: 194720 - DNA, 20 bp, Artificial
  CRISPR gRNA sequence
agggcacatgcttttgatcc

SEQ ID NO: 194721 - DNA, 20 bp, Artificial
  CRISPR gRNA sequence
ttttgatcctagatgttctt

SEQ ID NO: 194722 - DNA, 20 bp, Artificial
  CRISPR gRNA sequence
tttgatcctagatgttcttg

SEQ ID NO: 194723 - DNA, 20 bp, Artificial
  CRISPR gRNA sequence
tgatcctagatgttcttgag

SEQ ID NO: 194724 - DNA, 20 bp, Artificial
  CRISPR gRNA sequence
ttttatttttcatcttttcc

SEQ ID NO: 194725 - DNA, 20 bp, Artificial
  CRISPR gRNA sequence
ttatttttcatcttttccca

SEQ ID NO: 194726 - DNA, 20 bp, Artificial
  CRISPR gRNA sequence
ccagagatgaaccaaattct

SEQ ID NO: 194727 - DNA, 20 bp, Artificial
  CRISPR gRNA sequence
cagagatgaaccaaattctg

SEQ ID NO: 194728 - DNA, 20 bp, Artificial
  CRISPR gRNA sequence
tgccaactaatctttttttc

SEQ ID NO: 194729 - DNA, 20 bp, Artificial
  CRISPR gRNA sequence
ccaactaatctttttttcca

SEQ ID NO: 194730 - DNA, 20 bp, Artificial
  CRISPR gRNA sequence
gaaatattcaaaatgcatgc

SEQ ID NO: 194731 - DNA, 20 bp, Artificial
  CRISPR gRNA sequence
tgtgcaaatcaactccatct

SEQ ID NO: 194732 - DNA, 20 bp, Artificial
  CRISPR gRNA sequence
gtgcaaatcaactccatctc

SEQ ID NO: 194733 - DNA, 20 bp, Artificial
  CRISPR gRNA sequence
gaaacttgatccttatattc

SEQ ID NO: 194734 - DNA, 20 bp, Artificial
  CRISPR gRNA sequence
tccttatattctggctatct

SEQ ID NO: 194735 - DNA, 20 bp, Artificial
  CRISPR gRNA sequence
ctggctatctcagtcctgtt

SEQ ID NO: 194736 - DNA, 20 bp, Artificial
  CRISPR gRNA sequence
cctgttaagaatataatttt

SEQ ID NO: 194737 - DNA, 20 bp, Artificial
  CRISPR gRNA sequence
aagaatataatttttggaaa

SEQ ID NO: 194738 - DNA, 20 bp, Artificial
  CRISPR gRNA sequence
acagcttatctctactctct

SEQ ID NO: 194739 - DNA, 20 bp, Artificial
  CRISPR gRNA sequence
aacactactttcccccatgt

SEQ ID NO: 194740 - DNA, 20 bp, Artificial
  CRISPR gRNA sequence
acactactttcccccatgta

SEQ ID NO: 194741 - DNA, 20 bp, Artificial
  CRISPR gRNA sequence
cactactttcccccatgtaa

SEQ ID NO: 194742 - DNA, 20 bp, Artificial
  CRISPR gRNA sequence
actactttcccccatgtaag

SEQ ID NO: 194743 - DNA, 20 bp, Artificial
  CRISPR gRNA sequence
ttcccccatgtaaggggtta

SEQ ID NO: 194744 - DNA, 20 bp, Artificial
  CRISPR gRNA sequence
tcccccatgtaaggggttat

SEQ ID NO: 194745 - DNA, 20 bp, Artificial
  CRISPR gRNA sequence
cccccatgtaaggggttatg

SEQ ID NO: 194746 - DNA, 20 bp, Artificial
  CRISPR gRNA sequence
gggaatttttcaacgactat

SEQ ID NO: 194747 - DNA, 20 bp, Artificial
  CRISPR gRNA sequence
tctacttccctatttaacat

SEQ ID NO: 194748 - DNA, 20 bp, Artificial
  CRISPR gRNA sequence
agacaactctataccatcac

SEQ ID NO: 194749 - DNA, 20 bp, Artificial
  CRISPR gRNA sequence
tataccatcactggatctct

SEQ ID NO: 194750 - DNA, 20 bp, Artificial
  CRISPR gRNA sequence
atctcttggtatacttctct

SEQ ID NO: 194751 - DNA, 20 bp, Artificial
  CRISPR gRNA sequence
tggtatacttctctaagtat

SEQ ID NO: 194752 - DNA, 20 bp, Artificial
  CRISPR gRNA sequence
gtatacttctctaagtattg

SEQ ID NO: 194753 - DNA, 20 bp, Artificial
  CRISPR gRNA sequence
tatacttctctaagtattgg

SEQ ID NO: 194754 - DNA, 20 bp, Artificial
  CRISPR gRNA sequence
ttactctgactcatcttaaa

SEQ ID NO: 194755 - DNA, 20 bp, Artificial
  CRISPR gRNA sequence
tactctgactcatcttaaat

SEQ ID NO: 194756 - DNA, 20 bp, Artificial
  CRISPR gRNA sequence
ctctgactcatcttaaatgg

SEQ ID NO: 194757 - DNA, 20 bp, Artificial
  CRISPR gRNA sequence
tctgactcatcttaaatggg

SEQ ID NO: 194758 - DNA, 20 bp, Artificial
  CRISPR gRNA sequence
tttgaatatactcattttcc

SEQ ID NO: 194759 - DNA, 20 bp, Artificial
  CRISPR gRNA sequence
ctggattttaattgttccca

SEQ ID NO: 194760 - DNA, 20 bp, Artificial
  CRISPR gRNA sequence
tggattttaattgttcccac

SEQ ID NO: 194761 - DNA, 20 bp, Artificial
  CRISPR gRNA sequence
taattgttcccacaggtaaa

SEQ ID NO: 194762 - DNA, 20 bp, Artificial
  CRISPR gRNA sequence
attgttcccacaggtaaatg

SEQ ID NO: 194763 - DNA, 20 bp, Artificial
  CRISPR gRNA sequence
aaattttgcaaaatactcta

SEQ ID NO: 194764 - DNA, 20 bp, Artificial
  CRISPR gRNA sequence
actctatggtaaacatacta

SEQ ID NO: 194765 - DNA, 20 bp, Artificial
  CRISPR gRNA sequence
gtaaacatactacagttcta

SEQ ID NO: 194766 - DNA, 20 bp, Artificial
  CRISPR gRNA sequence
aaacatactacagttctaca

SEQ ID NO: 194767 - DNA, 20 bp, Artificial
  CRISPR gRNA sequence
aacatactacagttctacag

SEQ ID NO: 194768 - DNA, 20 bp, Artificial
  CRISPR gRNA sequence
gaggaactatttttattact

SEQ ID NO: 194769 - DNA, 20 bp, Artificial
  CRISPR gRNA sequence
aggaactatttttattactt

SEQ ID NO: 194770 - DNA, 20 bp, Artificial
  CRISPR gRNA sequence
ggaactatttttattactta

SEQ ID NO: 194771 - DNA, 20 bp, Artificial
  CRISPR gRNA sequence
tttttattacttagggtacc

SEQ ID NO: 194772 - DNA, 20 bp, Artificial
  CRISPR gRNA sequence
tacttagggtacccagaaac

SEQ ID NO: 194773 - DNA, 20 bp, Artificial
  CRISPR gRNA sequence
tagggtacccagaaaccagc

SEQ ID NO: 194774 - DNA, 20 bp, Artificial
  CRISPR gRNA sequence
cagctggttgcaactaatgc

SEQ ID NO: 194775 - DNA, 20 bp, Artificial
  CRISPR gRNA sequence
taaaatgcaactgaaaatga

SEQ ID NO: 194776 - DNA, 20 bp, Artificial
  CRISPR gRNA sequence
aaaatgcaactgaaaatgac

SEQ ID NO: 194777 - DNA, 20 bp, Artificial
  CRISPR gRNA sequence
actgaaaatgacgggcattt

SEQ ID NO: 194778 - DNA, 20 bp, Artificial
  CRISPR gRNA sequence
tttagctctttctcttctgt

SEQ ID NO: 194779 - DNA, 20 bp, Artificial
  CRISPR gRNA sequence
ctttctcttctgtaagtctg

SEQ ID NO: 194780 - DNA, 20 bp, Artificial
  CRISPR gRNA sequence
gtctgtggttattttcatga

SEQ ID NO: 194781 - DNA, 20 bp, Artificial
  CRISPR gRNA sequence
ccttacgcttcatcttcacc

SEQ ID NO: 194782 - DNA, 20 bp, Artificial
  CRISPR gRNA sequence
cttcacccagtgatcccact

SEQ ID NO: 194783 - DNA, 20 bp, Artificial
  CRISPR gRNA sequence
tcaatataattgctgttgaa

SEQ ID NO: 194784 - DNA, 20 bp, Artificial
  CRISPR gRNA sequence
atataattgctgttgaacag

SEQ ID NO: 194785 - DNA, 20 bp, Artificial
  CRISPR gRNA sequence
aatgcctttgcaccaccttg

SEQ ID NO: 194786 - DNA, 20 bp, Artificial
  CRISPR gRNA sequence
tgcctttgcaccaccttgca

SEQ ID NO: 194787 - DNA, 20 bp, Artificial
  CRISPR gRNA sequence
gcctttgcaccaccttgcag

SEQ ID NO: 194788 - DNA, 20 bp, Artificial
  CRISPR gRNA sequence
tgcaccaccttgcagaggtt

SEQ ID NO: 194789 - DNA, 20 bp, Artificial
  CRISPR gRNA sequence
ccaccttgcagaggttaagt

SEQ ID NO: 194790 - DNA, 20 bp, Artificial
  CRISPR gRNA sequence
caccttgcagaggttaagtc

SEQ ID NO: 194791 - DNA, 20 bp, Artificial
  CRISPR gRNA sequence
ggttaagtcgggtttccttg

SEQ ID NO: 194792 - DNA, 20 bp, Artificial
  CRISPR gRNA sequence
tctcaccccttcctcacccc

SEQ ID NO: 194793 - DNA, 20 bp, Artificial
  CRISPR gRNA sequence
caccccttcctcacccccag

SEQ ID NO: 194794 - DNA, 20 bp, Artificial
  CRISPR gRNA sequence
ccccttcctcacccccagtg

SEQ ID NO: 194795 - DNA, 20 bp, Artificial
  CRISPR gRNA sequence
cagtggagaccactgcaatt

SEQ ID NO: 194796 - DNA, 20 bp, Artificial
  CRISPR gRNA sequence
agtggagaccactgcaatta

SEQ ID NO: 194797 - DNA, 20 bp, Artificial
  CRISPR gRNA sequence
aaatactaccttttcttaaa

SEQ ID NO: 194798 - DNA, 20 bp, Artificial
  CRISPR gRNA sequence
tactaccttttcttaaacgg

SEQ ID NO: 194799 - DNA, 20 bp, Artificial
  CRISPR gRNA sequence
cttaaacggaagatgaatgt

SEQ ID NO: 194800 - DNA, 20 bp, Artificial
  CRISPR gRNA sequence
atgaatgtcagtgctacacc

SEQ ID NO: 194801 - DNA, 20 bp, Artificial
  CRISPR gRNA sequence
tgaatgtcagtgctacacca

SEQ ID NO: 194802 - DNA, 20 bp, Artificial
  CRISPR gRNA sequence
gtgctacaccaaggcataat

SEQ ID NO: 194803 - DNA, 20 bp, Artificial
  CRISPR gRNA sequence
tacaccaaggcataataaga

SEQ ID NO: 194804 - DNA, 20 bp, Artificial
  CRISPR gRNA sequence
aggcataataagatggctcc

SEQ ID NO: 194805 - DNA, 20 bp, Artificial
  CRISPR gRNA sequence
agatggctcccagaattacc

SEQ ID NO: 194806 - DNA, 20 bp, Artificial
  CRISPR gRNA sequence
ggctcccagaattaccaagt

SEQ ID NO: 194807 - DNA, 20 bp, Artificial
  CRISPR gRNA sequence
accaagtgagtcctttcatt

SEQ ID NO: 194808 - DNA, 20 bp, Artificial
  CRISPR gRNA sequence
caagtgagtcctttcatttg

SEQ ID NO: 194809 - DNA, 20 bp, Artificial
  CRISPR gRNA sequence
aagtgagtcctttcatttgg

SEQ ID NO: 194810 - DNA, 20 bp, Artificial
  CRISPR gRNA sequence
ctttcatttggaggatgtgc

SEQ ID NO: 194811 - DNA, 20 bp, Artificial
  CRISPR gRNA sequence
ttcatttggaggatgtgcca

SEQ ID NO: 194812 - DNA, 20 bp, Artificial
  CRISPR gRNA sequence
tcatttggaggatgtgccag

SEQ ID NO: 194813 - DNA, 20 bp, Artificial
  CRISPR gRNA sequence
tttggaggatgtgccagagg

SEQ ID NO: 194814 - DNA, 20 bp, Artificial
  CRISPR gRNA sequence
aaacgaaaacaaactgacta

SEQ ID NO: 194815 - DNA, 20 bp, Artificial
  CRISPR gRNA sequence
gactaaagataaaattttga

SEQ ID NO: 194816 - DNA, 20 bp, Artificial
  CRISPR gRNA sequence
actaaagataaaattttgat

SEQ ID NO: 194817 - DNA, 20 bp, Artificial
  CRISPR gRNA sequence
aaagataaaattttgatggg

SEQ ID NO: 194818 - DNA, 20 bp, Artificial
  CRISPR gRNA sequence
aagataaaattttgatggga

SEQ ID NO: 194819 - DNA, 20 bp, Artificial
  CRISPR gRNA sequence
agataaaattttgatgggaa

SEQ ID NO: 194820 - DNA, 20 bp, Artificial
  CRISPR gRNA sequence
gataaaattttgatgggaag

SEQ ID NO: 194821 - DNA, 20 bp, Artificial
  CRISPR gRNA sequence
aaattttgatgggaaggggt

SEQ ID NO: 194822 - DNA, 20 bp, Artificial
  CRISPR gRNA sequence
aattttgatgggaaggggtc

SEQ ID NO: 194823 - DNA, 20 bp, Artificial
  CRISPR gRNA sequence
ttttgatgggaaggggtcag

SEQ ID NO: 194824 - DNA, 20 bp, Artificial
  CRISPR gRNA sequence
atgggaaggggtcaggagaa

SEQ ID NO: 194825 - DNA, 20 bp, Artificial
  CRISPR gRNA sequence
caggagaatggtcatccttg

SEQ ID NO: 194826 - DNA, 20 bp, Artificial
  CRISPR gRNA sequence
gaatggtcatccttgaagtt

SEQ ID NO: 194827 - DNA, 20 bp, Artificial
  CRISPR gRNA sequence
gtcatccttgaagtttagtt

SEQ ID NO: 194828 - DNA, 20 bp, Artificial
  CRISPR gRNA sequence
cttgaagtttagtttagctt

SEQ ID NO: 194829 - DNA, 20 bp, Artificial
  CRISPR gRNA sequence
ttgaagtttagtttagcttt

SEQ ID NO: 194830 - DNA, 20 bp, Artificial
  CRISPR gRNA sequence
gataattttcttaaatgcca

SEQ ID NO: 194831 - DNA, 20 bp, Artificial
  CRISPR gRNA sequence
tttcttaaatgccaaagttt

SEQ ID NO: 194832 - DNA, 20 bp, Artificial
  CRISPR gRNA sequence
cttaaatgccaaagtttgag

SEQ ID NO: 194833 - DNA, 20 bp, Artificial
  CRISPR gRNA sequence
aatgccaaagtttgagtggc

SEQ ID NO: 194834 - DNA, 20 bp, Artificial
  CRISPR gRNA sequence
caaagtttgagtggctggaa

SEQ ID NO: 194835 - DNA, 20 bp, Artificial
  CRISPR gRNA sequence
gtttgagtggctggaatggc

SEQ ID NO: 194836 - DNA, 20 bp, Artificial
  CRISPR gRNA sequence
gcgagatacctgtgttaaaa

SEQ ID NO: 194837 - DNA, 20 bp, Artificial
  CRISPR gRNA sequence
cgagatacctgtgttaaaat

SEQ ID NO: 194838 - DNA, 20 bp, Artificial
  CRISPR gRNA sequence
tacctgtgttaaaatgggaa

SEQ ID NO: 194839 - DNA, 20 bp, Artificial
  CRISPR gRNA sequence
gtgttaaaatgggaacagca

SEQ ID NO: 194840 - DNA, 20 bp, Artificial
  CRISPR gRNA sequence
gttaaaatgggaacagcatg

SEQ ID NO: 194841 - DNA, 20 bp, Artificial
  CRISPR gRNA sequence
aaaatgggaacagcatggag

SEQ ID NO: 194842 - DNA, 20 bp, Artificial
  CRISPR gRNA sequence
ggaacagcatggagaagtgt

SEQ ID NO: 194843 - DNA, 20 bp, Artificial
  CRISPR gRNA sequence
acagcatggagaagtgtgag

SEQ ID NO: 194844 - DNA, 20 bp, Artificial
  CRISPR gRNA sequence
atggagaagtgtgagaagcc

SEQ ID NO: 194845 - DNA, 20 bp, Artificial
  CRISPR gRNA sequence
tggagaagtgtgagaagccc

SEQ ID NO: 194846 - DNA, 20 bp, Artificial
  CRISPR gRNA sequence
tgagaagcccaggctttgaa

SEQ ID NO: 194847 - DNA, 20 bp, Artificial
  CRISPR gRNA sequence
gagaagcccaggctttgaaa

SEQ ID NO: 194848 - DNA, 20 bp, Artificial
  CRISPR gRNA sequence
aagcccaggctttgaaaagg

SEQ ID NO: 194849 - DNA, 20 bp, Artificial
  CRISPR gRNA sequence
aggctttgaaaaggtggtgc

SEQ ID NO: 194850 - DNA, 20 bp, Artificial
  CRISPR gRNA sequence
ggctttgaaaaggtggtgct

SEQ ID NO: 194851 - DNA, 20 bp, Artificial
  CRISPR gRNA sequence
gctttgaaaaggtggtgctg

SEQ ID NO: 194852 - DNA, 20 bp, Artificial
  CRISPR gRNA sequence
taaattctgctgcccttaac

SEQ ID NO: 194853 - DNA, 20 bp, Artificial
  CRISPR gRNA sequence
tgctgcccttaaccagtttt

SEQ ID NO: 194854 - DNA, 20 bp, Artificial
  CRISPR gRNA sequence
gctgcccttaaccagttttg

SEQ ID NO: 194855 - DNA, 20 bp, Artificial
  CRISPR gRNA sequence
cttaaccagttttgaggtct

SEQ ID NO: 194856 - DNA, 20 bp, Artificial
  CRISPR gRNA sequence
ttaaccagttttgaggtctt

SEQ ID NO: 194857 - DNA, 20 bp, Artificial
  CRISPR gRNA sequence
ccagttttgaggtcttgggc

SEQ ID NO: 194858 - DNA, 20 bp, Artificial
  CRISPR gRNA sequence
tcttgggcaagatacttaac

SEQ ID NO: 194859 - DNA, 20 bp, Artificial
  CRISPR gRNA sequence
aatgctaatacatttcttgt

SEQ ID NO: 194860 - DNA, 20 bp, Artificial
  CRISPR gRNA sequence
atgctaatacatttcttgtg

SEQ ID NO: 194861 - DNA, 20 bp, Artificial
  CRISPR gRNA sequence
atatttataatgtgcttgca

SEQ ID NO: 194862 - DNA, 20 bp, Artificial
  CRISPR gRNA sequence
tgtgcttgcacagtaccaca

SEQ ID NO: 194863 - DNA, 20 bp, Artificial
  CRISPR gRNA sequence
tgcttgcacagtaccacatg

SEQ ID NO: 194864 - DNA, 20 bp, Artificial
  CRISPR gRNA sequence
ttgcacagtaccacatggag

SEQ ID NO: 194865 - DNA, 20 bp, Artificial
  CRISPR gRNA sequence
agtggctgctcactattaaa

SEQ ID NO: 194866 - DNA, 20 bp, Artificial
  CRISPR gRNA sequence
ggctgctcactattaaatgg

SEQ ID NO: 194867 - DNA, 20 bp, Artificial
  CRISPR gRNA sequence
tgcttttttttttttttttt

SEQ ID NO: 194868 - DNA, 20 bp, Artificial
  CRISPR gRNA sequence
gctttttttttttttttttg

SEQ ID NO: 194869 - DNA, 20 bp, Artificial
  CRISPR gRNA sequence
ttttttttttttttttgagg

SEQ ID NO: 194870 - DNA, 20 bp, Artificial
  CRISPR gRNA sequence
ttttttttttttttgaggca

SEQ ID NO: 194871 - DNA, 20 bp, Artificial
  CRISPR gRNA sequence
cagagtctttctctgttgcc

SEQ ID NO: 194872 - DNA, 20 bp, Artificial
  CRISPR gRNA sequence
agagtctttctctgttgccc

SEQ ID NO: 194873 - DNA, 20 bp, Artificial
  CRISPR gRNA sequence
gagtctttctctgttgccca

SEQ ID NO: 194874 - DNA, 20 bp, Artificial
  CRISPR gRNA sequence
tctttctctgttgcccaggg

SEQ ID NO: 194875 - DNA, 20 bp, Artificial
  CRISPR gRNA sequence
tttctctgttgcccagggtg

SEQ ID NO: 194876 - DNA, 20 bp, Artificial
  CRISPR gRNA sequence
ctgttgcccagggtggagtg

SEQ ID NO: 194877 - DNA, 20 bp, Artificial
  CRISPR gRNA sequence
ttgcccagggtggagtgcag

SEQ ID NO: 194878 - DNA, 20 bp, Artificial
  CRISPR gRNA sequence
tggagtgcagtggcgcaatc

SEQ ID NO: 194879 - DNA, 20 bp, Artificial
  CRISPR gRNA sequence
ggagtgcagtggcgcaatct

SEQ ID NO: 194880 - DNA, 20 bp, Artificial
  CRISPR gRNA sequence
tcactgcaacttccgcctcc

SEQ ID NO: 194881 - DNA, 20 bp, Artificial
  CRISPR gRNA sequence
cactgcaacttccgcctccc

SEQ ID NO: 194882 - DNA, 20 bp, Artificial
  CRISPR gRNA sequence
aacttccgcctcccaggttc

SEQ ID NO: 194883 - DNA, 20 bp, Artificial
  CRISPR gRNA sequence
ttcaagcaattcttgtgcct

SEQ ID NO: 194884 - DNA, 20 bp, Artificial
  CRISPR gRNA sequence
ttcttgtgcctcagtctccc

SEQ ID NO: 194885 - DNA, 20 bp, Artificial
  CRISPR gRNA sequence
ttgtgcctcagtctcccgag

SEQ ID NO: 194886 - DNA, 20 bp, Artificial
  CRISPR gRNA sequence
gcctcagtctcccgagtagc

SEQ ID NO: 194887 - DNA, 20 bp, Artificial
  CRISPR gRNA sequence
cctcagtctcccgagtagct

SEQ ID NO: 194888 - DNA, 20 bp, Artificial
  CRISPR gRNA sequence
ctcccgagtagctgggatta

SEQ ID NO: 194889 - DNA, 20 bp, Artificial
  CRISPR gRNA sequence
tcccgagtagctgggattac

SEQ ID NO: 194890 - DNA, 20 bp, Artificial
  CRISPR gRNA sequence
caggtgcacaccaccacacc

SEQ ID NO: 194891 - DNA, 20 bp, Artificial
  CRISPR gRNA sequence
ccagctaatttttatatttt

SEQ ID NO: 194892 - DNA, 20 bp, Artificial
  CRISPR gRNA sequence
taatttttatatttttagta

SEQ ID NO: 194893 - DNA, 20 bp, Artificial
  CRISPR gRNA sequence
aatttttatatttttagtaa

SEQ ID NO: 194894 - DNA, 20 bp, Artificial
  CRISPR gRNA sequence
ttttatatttttagtaaagg

SEQ ID NO: 194895 - DNA, 20 bp, Artificial
  CRISPR gRNA sequence
ttatatttttagtaaaggca

SEQ ID NO: 194896 - DNA, 20 bp, Artificial
  CRISPR gRNA sequence
aaggcagagtttcaccatgt

SEQ ID NO: 194897 - DNA, 20 bp, Artificial
  CRISPR gRNA sequence
cagagtttcaccatgttggc

SEQ ID NO: 194898 - DNA, 20 bp, Artificial
  CRISPR gRNA sequence
agagtttcaccatgttggcc

SEQ ID NO: 194899 - DNA, 20 bp, Artificial
  CRISPR gRNA sequence
tttcaccatgttggccaggc

SEQ ID NO: 194900 - DNA, 20 bp, Artificial
  CRISPR gRNA sequence
ggtcacaaactcctgacctc

SEQ ID NO: 194901 - DNA, 20 bp, Artificial
  CRISPR gRNA sequence
ctcaagtgatctgcccacct

SEQ ID NO: 194902 - DNA, 20 bp, Artificial
  CRISPR gRNA sequence
ctgcccaccttggcctccca

SEQ ID NO: 194903 - DNA, 20 bp, Artificial
  CRISPR gRNA sequence
ccttggcctcccaaagtgct

SEQ ID NO: 194904 - DNA, 20 bp, Artificial
  CRISPR gRNA sequence
ctcccaaagtgctgagatta

SEQ ID NO: 194905 - DNA, 20 bp, Artificial
  CRISPR gRNA sequence
tcccaaagtgctgagattac

SEQ ID NO: 194906 - DNA, 20 bp, Artificial
  CRISPR gRNA sequence
agtgctgagattacaggcat

SEQ ID NO: 194907 - DNA, 20 bp, Artificial
  CRISPR gRNA sequence
caggcatgagcctccgctcc

SEQ ID NO: 194908 - DNA, 20 bp, Artificial
  CRISPR gRNA sequence
ccctcttgcattctttaata

SEQ ID NO: 194909 - DNA, 20 bp, Artificial
  CRISPR gRNA sequence
tcttgcattctttaatatag

SEQ ID NO: 194910 - DNA, 20 bp, Artificial
  CRISPR gRNA sequence
gcattctttaatatagaagc

SEQ ID NO: 194911 - DNA, 20 bp, Artificial
  CRISPR gRNA sequence
ttctttaatatagaagctag

SEQ ID NO: 194912 - DNA, 20 bp, Artificial
  CRISPR gRNA sequence
atatagaagctagtagccta

SEQ ID NO: 194913 - DNA, 20 bp, Artificial
  CRISPR gRNA sequence
agctagtagcctacagtaca

SEQ ID NO: 194914 - DNA, 20 bp, Artificial
  CRISPR gRNA sequence
tagtagcctacagtacatgg

SEQ ID NO: 194915 - DNA, 20 bp, Artificial
  CRISPR gRNA sequence
gtagcctacagtacatggca

SEQ ID NO: 194916 - DNA, 20 bp, Artificial
  CRISPR gRNA sequence
cctacagtacatggcagaga

SEQ ID NO: 194917 - DNA, 20 bp, Artificial
  CRISPR gRNA sequence
tacatggcagagatggccca

SEQ ID NO: 194918 - DNA, 20 bp, Artificial
  CRISPR gRNA sequence
atggcagagatggcccacag

SEQ ID NO: 194919 - DNA, 20 bp, Artificial
  CRISPR gRNA sequence
agatggcccacagtagaaca

SEQ ID NO: 194920 - DNA, 20 bp, Artificial
  CRISPR gRNA sequence
tggcccacagtagaacatgg

SEQ ID NO: 194921 - DNA, 20 bp, Artificial
  CRISPR gRNA sequence
ggcccacagtagaacatgga

SEQ ID NO: 194922 - DNA, 20 bp, Artificial
  CRISPR gRNA sequence
gtagaacatggaaggccaac

SEQ ID NO: 194923 - DNA, 20 bp, Artificial
  CRISPR gRNA sequence
gaaggccaaccagcactgct

SEQ ID NO: 194924 - DNA, 20 bp, Artificial
  CRISPR gRNA sequence
aaggccaaccagcactgcta

SEQ ID NO: 194925 - DNA, 20 bp, Artificial
  CRISPR gRNA sequence
ggccaaccagcactgctaag

SEQ ID NO: 194926 - DNA, 20 bp, Artificial
  CRISPR gRNA sequence
ctcctatctgtcatcatgat

SEQ ID NO: 194927 - DNA, 20 bp, Artificial
  CRISPR gRNA sequence
cctatctgtcatcatgattg

SEQ ID NO: 194928 - DNA, 20 bp, Artificial
  CRISPR gRNA sequence
ctatctgtcatcatgattgg

SEQ ID NO: 194929 - DNA, 20 bp, Artificial
  CRISPR gRNA sequence
tgttgtcttatctttctctg

SEQ ID NO: 194930 - DNA, 20 bp, Artificial
  CRISPR gRNA sequence
ctctgcagtttgaacatctc

SEQ ID NO: 194931 - DNA, 20 bp, Artificial
  CRISPR gRNA sequence
tttgaacatctctggacaac

SEQ ID NO: 194932 - DNA, 20 bp, Artificial
  CRISPR gRNA sequence
atctctggacaacaagccat

SEQ ID NO: 194933 - DNA, 20 bp, Artificial
  CRISPR gRNA sequence
aagccattagtatctcttac

SEQ ID NO: 194934 - DNA, 20 bp, Artificial
  CRISPR gRNA sequence
agccattagtatctcttact

SEQ ID NO: 194935 - DNA, 20 bp, Artificial
  CRISPR gRNA sequence
ctcttactaggctccttgtc

SEQ ID NO: 194936 - DNA, 20 bp, Artificial
  CRISPR gRNA sequence
tcttactaggctccttgtct

SEQ ID NO: 194937 - DNA, 20 bp, Artificial
  CRISPR gRNA sequence
cttactaggctccttgtctg

SEQ ID NO: 194938 - DNA, 20 bp, Artificial
  CRISPR gRNA sequence
tccttgtctggggtaccatg

SEQ ID NO: 194939 - DNA, 20 bp, Artificial
  CRISPR gRNA sequence
ccttgtctggggtaccatgc

SEQ ID NO: 194940 - DNA, 20 bp, Artificial
  CRISPR gRNA sequence
ttgtctggggtaccatgcag

SEQ ID NO: 194941 - DNA, 20 bp, Artificial
  CRISPR gRNA sequence
tgtctggggtaccatgcagg

SEQ ID NO: 194942 - DNA, 20 bp, Artificial
  CRISPR gRNA sequence
tggggtaccatgcaggagga

SEQ ID NO: 194943 - DNA, 20 bp, Artificial
  CRISPR gRNA sequence
ggggtaccatgcaggaggaa

SEQ ID NO: 194944 - DNA, 20 bp, Artificial
  CRISPR gRNA sequence
gggtaccatgcaggaggaaa

SEQ ID NO: 194945 - DNA, 20 bp, Artificial
  CRISPR gRNA sequence
ggtaccatgcaggaggaaag

SEQ ID NO: 194946 - DNA, 20 bp, Artificial
  CRISPR gRNA sequence
gtaccatgcaggaggaaagg

SEQ ID NO: 194947 - DNA, 20 bp, Artificial
  CRISPR gRNA sequence
caggaggaaagggggtccca

SEQ ID NO: 194948 - DNA, 20 bp, Artificial
  CRISPR gRNA sequence
aaagggggtcccatggtaca

SEQ ID NO: 194949 - DNA, 20 bp, Artificial
  CRISPR gRNA sequence
tcccatggtacacagatgtt

SEQ ID NO: 194950 - DNA, 20 bp, Artificial
  CRISPR gRNA sequence
ccatggtacacagatgttca

SEQ ID NO: 194951 - DNA, 20 bp, Artificial
  CRISPR gRNA sequence
catggtacacagatgttcag

SEQ ID NO: 194952 - DNA, 20 bp, Artificial
  CRISPR gRNA sequence
taactcccacctctcaccct

SEQ ID NO: 194953 - DNA, 20 bp, Artificial
  CRISPR gRNA sequence
tcccacctctcacccttagt

SEQ ID NO: 194954 - DNA, 20 bp, Artificial
  CRISPR gRNA sequence
acccttagtcagctcctgcc

SEQ ID NO: 194955 - DNA, 20 bp, Artificial
  CRISPR gRNA sequence
tagtcagctcctgcctggct

SEQ ID NO: 194956 - DNA, 20 bp, Artificial
  CRISPR gRNA sequence
gcctggctcagctctccact

SEQ ID NO: 194957 - DNA, 20 bp, Artificial
  CRISPR gRNA sequence
atgatccatctttgactacc

SEQ ID NO: 194958 - DNA, 20 bp, Artificial
  CRISPR gRNA sequence
tgatccatctttgactaccc

SEQ ID NO: 194959 - DNA, 20 bp, Artificial
  CRISPR gRNA sequence
actacccaggtgaaacttta

SEQ ID NO: 194960 - DNA, 20 bp, Artificial
  CRISPR gRNA sequence
aaactttaaagacacaacaa

SEQ ID NO: 194961 - DNA, 20 bp, Artificial
  CRISPR gRNA sequence
tttaaagacacaacaacagc

SEQ ID NO: 194962 - DNA, 20 bp, Artificial
  CRISPR gRNA sequence
ccagctttttccgtaactta

SEQ ID NO: 194963 - DNA, 20 bp, Artificial
  CRISPR gRNA sequence
tgttcacgtatgttttattt

SEQ ID NO: 194964 - DNA, 20 bp, Artificial
  CRISPR gRNA sequence
cgtatgttttatttcagttt

SEQ ID NO: 194965 - DNA, 20 bp, Artificial
  CRISPR gRNA sequence
cagtttcagaacaactttat

SEQ ID NO: 194966 - DNA, 20 bp, Artificial
  CRISPR gRNA sequence
ttcagaacaactttatgagt

SEQ ID NO: 194967 - DNA, 20 bp, Artificial
  CRISPR gRNA sequence
tcagaacaactttatgagtt

SEQ ID NO: 194968 - DNA, 20 bp, Artificial
  CRISPR gRNA sequence
actttatgagttaggcatgc

SEQ ID NO: 194969 - DNA, 20 bp, Artificial
  CRISPR gRNA sequence
ctttatgagttaggcatgcc

SEQ ID NO: 194970 - DNA, 20 bp, Artificial
  CRISPR gRNA sequence
aaaaaaaaatccccaattta

SEQ ID NO: 194971 - DNA, 20 bp, Artificial
  CRISPR gRNA sequence
aaaatccccaatttacagat

SEQ ID NO: 194972 - DNA, 20 bp, Artificial
  CRISPR gRNA sequence
aaatccccaatttacagatg

SEQ ID NO: 194973 - DNA, 20 bp, Artificial
  CRISPR gRNA sequence
ccaatttacagatgaggaaa

SEQ ID NO: 194974 - DNA, 20 bp, Artificial
  CRISPR gRNA sequence
tacagatgaggaaacagact

SEQ ID NO: 194975 - DNA, 20 bp, Artificial
  CRISPR gRNA sequence
atgaggaaacagactcagtg

SEQ ID NO: 194976 - DNA, 20 bp, Artificial
  CRISPR gRNA sequence
ggaaacagactcagtgcagt

SEQ ID NO: 194977 - DNA, 20 bp, Artificial
  CRISPR gRNA sequence
gaaacagactcagtgcagtt

SEQ ID NO: 194978 - DNA, 20 bp, Artificial
  CRISPR gRNA sequence
cagactcagtgcagttaggt

SEQ ID NO: 194979 - DNA, 20 bp, Artificial
  CRISPR gRNA sequence
tgcagttaggtgagttactg

SEQ ID NO: 194980 - DNA, 20 bp, Artificial
  CRISPR gRNA sequence
gcagttaggtgagttactgt

SEQ ID NO: 194981 - DNA, 20 bp, Artificial
  CRISPR gRNA sequence
gttactgtaggccacccaac

SEQ ID NO: 194982 - DNA, 20 bp, Artificial
  CRISPR gRNA sequence
ctgtaggccacccaacaagt

SEQ ID NO: 194983 - DNA, 20 bp, Artificial
  CRISPR gRNA sequence
acaagtaagttgtcataaaa

SEQ ID NO: 194984 - DNA, 20 bp, Artificial
  CRISPR gRNA sequence
gtcataaaacagcttgtaaa

SEQ ID NO: 194985 - DNA, 20 bp, Artificial
  CRISPR gRNA sequence
ataaaacagcttgtaaatgg

SEQ ID NO: 194986 - DNA, 20 bp, Artificial
  CRISPR gRNA sequence
taaaacagcttgtaaatggc

SEQ ID NO: 194987 - DNA, 20 bp, Artificial
  CRISPR gRNA sequence
atggcaggaacccactaatc

SEQ ID NO: 194988 - DNA, 20 bp, Artificial
  CRISPR gRNA sequence
actaatctagcttttactga

SEQ ID NO: 194989 - DNA, 20 bp, Artificial
  CRISPR gRNA sequence
atctagcttttactgaaagc

SEQ ID NO: 194990 - DNA, 20 bp, Artificial
  CRISPR gRNA sequence
tgaaagccagttcaatacct

SEQ ID NO: 194991 - DNA, 20 bp, Artificial
  CRISPR gRNA sequence
gaaagccagttcaatacctg

SEQ ID NO: 194992 - DNA, 20 bp, Artificial
  CRISPR gRNA sequence
atacctgaggactcgtaccc

SEQ ID NO: 194993 - DNA, 20 bp, Artificial
  CRISPR gRNA sequence
ctgaggactcgtaccccagt

SEQ ID NO: 194994 - DNA, 20 bp, Artificial
  CRISPR gRNA sequence
gaggactcgtaccccagtaa

SEQ ID NO: 194995 - DNA, 20 bp, Artificial
  CRISPR gRNA sequence
agcatccccatcattttcta

SEQ ID NO: 194996 - DNA, 20 bp, Artificial
  CRISPR gRNA sequence
ttctgttcacaacaccgtcc

SEQ ID NO: 194997 - DNA, 20 bp, Artificial
  CRISPR gRNA sequence
gacttttctatctaattttt

SEQ ID NO: 194998 - DNA, 20 bp, Artificial
  CRISPR gRNA sequence
tttttcagttgtttttgctg

SEQ ID NO: 194999 - DNA, 20 bp, Artificial
  CRISPR gRNA sequence
gttgtttttgctgaagtacg

SEQ ID NO: 195000 - DNA, 20 bp, Artificial
  CRISPR gRNA sequence
attttcctatcaacatgtat

SEQ ID NO: 195001 - DNA, 20 bp, Artificial
  CRISPR gRNA sequence
ttttcctatcaacatgtatt

SEQ ID NO: 195002 - DNA, 20 bp, Artificial
  CRISPR gRNA sequence
tttcctatcaacatgtattg

SEQ ID NO: 195003 - DNA, 20 bp, Artificial
  CRISPR gRNA sequence
ttcctatcaacatgtattgg

SEQ ID NO: 195004 - DNA, 20 bp, Artificial
  CRISPR gRNA sequence
cctatcaacatgtattgggg

SEQ ID NO: 195005 - DNA, 20 bp, Artificial
  CRISPR gRNA sequence
ctatcaacatgtattggggg

SEQ ID NO: 195006 - DNA, 20 bp, Artificial
  CRISPR gRNA sequence
tatcaacatgtattggggga

SEQ ID NO: 195007 - DNA, 20 bp, Artificial
  CRISPR gRNA sequence
atcaacatgtattgggggag

SEQ ID NO: 195008 - DNA, 20 bp, Artificial
  CRISPR gRNA sequence
tcaacatgtattgggggagg

SEQ ID NO: 195009 - DNA, 20 bp, Artificial
  CRISPR gRNA sequence
acatgtattgggggaggggg

SEQ ID NO: 195010 - DNA, 20 bp, Artificial
  CRISPR gRNA sequence
gtattgggggagggggcagt

SEQ ID NO: 195011 - DNA, 20 bp, Artificial
  CRISPR gRNA sequence
ttgggggagggggcagtgag

SEQ ID NO: 195012 - DNA, 20 bp, Artificial
  CRISPR gRNA sequence
gggcagtgagcagctcttct

SEQ ID NO: 195013 - DNA, 20 bp, Artificial
  CRISPR gRNA sequence
ctcactttctttcacattct

SEQ ID NO: 195014 - DNA, 20 bp, Artificial
  CRISPR gRNA sequence
tcacattctgagcctctcat

SEQ ID NO: 195015 - DNA, 20 bp, Artificial
  CRISPR gRNA sequence
tcccaccctacctacttctg

SEQ ID NO: 195016 - DNA, 20 bp, Artificial
  CRISPR gRNA sequence
ccaccctacctacttctgta

SEQ ID NO: 195017 - DNA, 20 bp, Artificial
  CRISPR gRNA sequence
ccctacctacttctgtagag

SEQ ID NO: 195018 - DNA, 20 bp, Artificial
  CRISPR gRNA sequence
acctacttctgtagagtagt

SEQ ID NO: 195019 - DNA, 20 bp, Artificial
  CRISPR gRNA sequence
agtagtgagataaaaaaaaa

SEQ ID NO: 195020 - DNA, 20 bp, Artificial
  CRISPR gRNA sequence
aaaaaatagttgaatttgtg

SEQ ID NO: 195021 - DNA, 20 bp, Artificial
  CRISPR gRNA sequence
aaaaatagttgaatttgtgc

SEQ ID NO: 195022 - DNA, 20 bp, Artificial
  CRISPR gRNA sequence
agttgaatttgtgcaggcaa

SEQ ID NO: 195023 - DNA, 20 bp, Artificial
  CRISPR gRNA sequence
gctaatctgacccttacaat

SEQ ID NO: 195024 - DNA, 20 bp, Artificial
  CRISPR gRNA sequence
acccttacaataagcttgct

SEQ ID NO: 195025 - DNA, 20 bp, Artificial
  CRISPR gRNA sequence
cttacaataagcttgctcag

SEQ ID NO: 195026 - DNA, 20 bp, Artificial
  CRISPR gRNA sequence
ctcagtagattataatccta

SEQ ID NO: 195027 - DNA, 20 bp, Artificial
  CRISPR gRNA sequence
tcagtagattataatcctac

SEQ ID NO: 195028 - DNA, 20 bp, Artificial
  CRISPR gRNA sequence
cagtagattataatcctaca

SEQ ID NO: 195029 - DNA, 20 bp, Artificial
  CRISPR gRNA sequence
agattataatcctacaggga

SEQ ID NO: 195030 - DNA, 20 bp, Artificial
  CRISPR gRNA sequence
ataatcctacagggaaagtg

SEQ ID NO: 195031 - DNA, 20 bp, Artificial
  CRISPR gRNA sequence
tacagggaaagtgaagcaca

SEQ ID NO: 195032 - DNA, 20 bp, Artificial
  CRISPR gRNA sequence
agggaaagtgaagcacacag

SEQ ID NO: 195033 - DNA, 20 bp, Artificial
  CRISPR gRNA sequence
aagtgaagcacacagaagtc

SEQ ID NO: 195034 - DNA, 20 bp, Artificial
  CRISPR gRNA sequence
cagaagtctagtaatttgcc

SEQ ID NO: 195035 - DNA, 20 bp, Artificial
  CRISPR gRNA sequence
agaagtctagtaatttgccc

SEQ ID NO: 195036 - DNA, 20 bp, Artificial
  CRISPR gRNA sequence
gaagtctagtaatttgccca

SEQ ID NO: 195037 - DNA, 20 bp, Artificial
  CRISPR gRNA sequence
gtaatttgcccagggacaca

SEQ ID NO: 195038 - DNA, 20 bp, Artificial
  CRISPR gRNA sequence
agcctcatgttctatgcact

SEQ ID NO: 195039 - DNA, 20 bp, Artificial
  CRISPR gRNA sequence
ctcatgttctatgcactaag

SEQ ID NO: 195040 - DNA, 20 bp, Artificial
  CRISPR gRNA sequence
ctatgcactaagcagactgc

SEQ ID NO: 195041 - DNA, 20 bp, Artificial
  CRISPR gRNA sequence
atgcactaagcagactgcta

SEQ ID NO: 195042 - DNA, 20 bp, Artificial
  CRISPR gRNA sequence
ctgctagagttgaaatattg

SEQ ID NO: 195043 - DNA, 20 bp, Artificial
  CRISPR gRNA sequence
tgaaatattgtagactacct

SEQ ID NO: 195044 - DNA, 20 bp, Artificial
  CRISPR gRNA sequence
gaaatattgtagactacctt

SEQ ID NO: 195045 - DNA, 20 bp, Artificial
  CRISPR gRNA sequence
aatattgtagactaccttgg

SEQ ID NO: 195046 - DNA, 20 bp, Artificial
  CRISPR gRNA sequence
tattgtagactaccttggga

SEQ ID NO: 195047 - DNA, 20 bp, Artificial
  CRISPR gRNA sequence
attgtagactaccttgggag

SEQ ID NO: 195048 - DNA, 20 bp, Artificial
  CRISPR gRNA sequence
gactaccttgggagaggcac

SEQ ID NO: 195049 - DNA, 20 bp, Artificial
  CRISPR gRNA sequence
actaccttgggagaggcacc

SEQ ID NO: 195050 - DNA, 20 bp, Artificial
  CRISPR gRNA sequence
ctaccttgggagaggcaccg

SEQ ID NO: 195051 - DNA, 20 bp, Artificial
  CRISPR gRNA sequence
accttgggagaggcaccggg

SEQ ID NO: 195052 - DNA, 20 bp, Artificial
  CRISPR gRNA sequence
tgggagaggcaccggggaga

SEQ ID NO: 195053 - DNA, 20 bp, Artificial
  CRISPR gRNA sequence
gggagaggcaccggggagaa

SEQ ID NO: 195054 - DNA, 20 bp, Artificial
  CRISPR gRNA sequence
ggagaggcaccggggagaaa

SEQ ID NO: 195055 - DNA, 20 bp, Artificial
  CRISPR gRNA sequence
gagaaagggtccctcatgtt

SEQ ID NO: 195056 - DNA, 20 bp, Artificial
  CRISPR gRNA sequence
gggtccctcatgtttggcat

SEQ ID NO: 195057 - DNA, 20 bp, Artificial
  CRISPR gRNA sequence
ccctcatgtttggcataaga

SEQ ID NO: 195058 - DNA, 20 bp, Artificial
  CRISPR gRNA sequence
ccatttatttcctgccaccc

SEQ ID NO: 195059 - DNA, 20 bp, Artificial
  CRISPR gRNA sequence
ttatttcctgccaccctgga

SEQ ID NO: 195060 - DNA, 20 bp, Artificial
  CRISPR gRNA sequence
atttcctgccaccctggaaa

SEQ ID NO: 195061 - DNA, 20 bp, Artificial
  CRISPR gRNA sequence
tttcctgccaccctggaaag

SEQ ID NO: 195062 - DNA, 20 bp, Artificial
  CRISPR gRNA sequence
ttcctgccaccctggaaaga

SEQ ID NO: 195063 - DNA, 20 bp, Artificial
  CRISPR gRNA sequence
ctgccaccctggaaagaggg

SEQ ID NO: 195064 - DNA, 20 bp, Artificial
  CRISPR gRNA sequence
ccaccctggaaagagggaag

SEQ ID NO: 195065 - DNA, 20 bp, Artificial
  CRISPR gRNA sequence
gggaagcagctctgatgtgc

SEQ ID NO: 195066 - DNA, 20 bp, Artificial
  CRISPR gRNA sequence
ggaagcagctctgatgtgcc

SEQ ID NO: 195067 - DNA, 20 bp, Artificial
  CRISPR gRNA sequence
agctctgatgtgccaggatt

SEQ ID NO: 195068 - DNA, 20 bp, Artificial
  CRISPR gRNA sequence
aggatttggattcctgaaac

SEQ ID NO: 195069 - DNA, 20 bp, Artificial
  CRISPR gRNA sequence
ggatttggattcctgaaaca

SEQ ID NO: 195070 - DNA, 20 bp, Artificial
  CRISPR gRNA sequence
cctgaaacaaggcctgaatt

SEQ ID NO: 195071 - DNA, 20 bp, Artificial
  CRISPR gRNA sequence
cctgaattgagtattcctct

SEQ ID NO: 195072 - DNA, 20 bp, Artificial
  CRISPR gRNA sequence
ctgaattgagtattcctctc

SEQ ID NO: 195073 - DNA, 20 bp, Artificial
  CRISPR gRNA sequence
tattcctctcaggtattccc

SEQ ID NO: 195074 - DNA, 20 bp, Artificial
  CRISPR gRNA sequence
attcctctcaggtattcccc

SEQ ID NO: 195075 - DNA, 20 bp, Artificial
  CRISPR gRNA sequence
caggtattccccaggtttcc

SEQ ID NO: 195076 - DNA, 20 bp, Artificial
  CRISPR gRNA sequence
cccaggtttcccggctatga

SEQ ID NO: 195077 - DNA, 20 bp, Artificial
  CRISPR gRNA sequence
ctatgaaagcatttcccaca

SEQ ID NO: 195078 - DNA, 20 bp, Artificial
  CRISPR gRNA sequence
aagcatttcccacatggtgt

SEQ ID NO: 195079 - DNA, 20 bp, Artificial
  CRISPR gRNA sequence
cctgttttttgtttgtttct

SEQ ID NO: 195080 - DNA, 20 bp, Artificial
  CRISPR gRNA sequence
agttttttatctgtttcctg

SEQ ID NO: 195081 - DNA, 20 bp, Artificial
  CRISPR gRNA sequence
ttttttatctgtttcctgaa

SEQ ID NO: 195082 - DNA, 20 bp, Artificial
  CRISPR gRNA sequence
tttcctgaagagtgtgaact

SEQ ID NO: 195083 - DNA, 20 bp, Artificial
  CRISPR gRNA sequence
ttattctatgtgtatccaat

SEQ ID NO: 195084 - DNA, 20 bp, Artificial
  CRISPR gRNA sequence
ccaatgagtactacaatgca

SEQ ID NO: 195085 - DNA, 20 bp, Artificial
  CRISPR gRNA sequence
tactacaatgcatggaacaa

SEQ ID NO: 195086 - DNA, 20 bp, Artificial
  CRISPR gRNA sequence
actacaatgcatggaacaaa

SEQ ID NO: 195087 - DNA, 20 bp, Artificial
  CRISPR gRNA sequence
atatctgctgaatgtttatt

SEQ ID NO: 195088 - DNA, 20 bp, Artificial
  CRISPR gRNA sequence
atgtttattaagtaacaata

SEQ ID NO: 195089 - DNA, 20 bp, Artificial
  CRISPR gRNA sequence
tattaagtaacaatatggtt

SEQ ID NO: 195090 - DNA, 20 bp, Artificial
  CRISPR gRNA sequence
aacaatatggtttggatgaa

SEQ ID NO: 195091 - DNA, 20 bp, Artificial
  CRISPR gRNA sequence
caatatggtttggatgaatg

SEQ ID NO: 195092 - DNA, 20 bp, Artificial
  CRISPR gRNA sequence
aatatggtttggatgaatgg

SEQ ID NO: 195093 - DNA, 20 bp, Artificial
  CRISPR gRNA sequence
tggtttggatgaatggaggt

SEQ ID NO: 195094 - DNA, 20 bp, Artificial
  CRISPR gRNA sequence
ggtttggatgaatggaggtg

SEQ ID NO: 195095 - DNA, 20 bp, Artificial
  CRISPR gRNA sequence
gatgaatggaggtgaggaat

SEQ ID NO: 195096 - DNA, 20 bp, Artificial
  CRISPR gRNA sequence
atgaatggaggtgaggaatt

SEQ ID NO: 195097 - DNA, 20 bp, Artificial
  CRISPR gRNA sequence
taggatatattttgtaaaca

SEQ ID NO: 195098 - DNA, 20 bp, Artificial
  CRISPR gRNA sequence
caatcactgaatgactatga

SEQ ID NO: 195099 - DNA, 20 bp, Artificial
  CRISPR gRNA sequence
aatcactgaatgactatgat

SEQ ID NO: 195100 - DNA, 20 bp, Artificial
  CRISPR gRNA sequence
cactgaatgactatgatagg

SEQ ID NO: 195101 - DNA, 20 bp, Artificial
  CRISPR gRNA sequence
atgataggcagacatcatgc

SEQ ID NO: 195102 - DNA, 20 bp, Artificial
  CRISPR gRNA sequence
tgataggcagacatcatgct

SEQ ID NO: 195103 - DNA, 20 bp, Artificial
  CRISPR gRNA sequence
gcagacatcatgctaggtgc

SEQ ID NO: 195104 - DNA, 20 bp, Artificial
  CRISPR gRNA sequence
cagacatcatgctaggtgct

SEQ ID NO: 195105 - DNA, 20 bp, Artificial
  CRISPR gRNA sequence
agacatcatgctaggtgcta

SEQ ID NO: 195106 - DNA, 20 bp, Artificial
  CRISPR gRNA sequence
gacatcatgctaggtgctag

SEQ ID NO: 195107 - DNA, 20 bp, Artificial
  CRISPR gRNA sequence
tcatgctaggtgctagggga

SEQ ID NO: 195108 - DNA, 20 bp, Artificial
  CRISPR gRNA sequence
taggtgctaggggacagtgt

SEQ ID NO: 195109 - DNA, 20 bp, Artificial
  CRISPR gRNA sequence
cagtgttagacatattttaa

SEQ ID NO: 195110 - DNA, 20 bp, Artificial
  CRISPR gRNA sequence
catattttaatggacacatt

SEQ ID NO: 195111 - DNA, 20 bp, Artificial
  CRISPR gRNA sequence
gacacattcagaatattacc

SEQ ID NO: 195112 - DNA, 20 bp, Artificial
  CRISPR gRNA sequence
acacattcagaatattacct

SEQ ID NO: 195113 - DNA, 20 bp, Artificial
  CRISPR gRNA sequence
attacctgggatgaccaatt

SEQ ID NO: 195114 - DNA, 20 bp, Artificial
  CRISPR gRNA sequence
ggatgaccaattcagctgta

SEQ ID NO: 195115 - DNA, 20 bp, Artificial
  CRISPR gRNA sequence
ttcagctgtatggttttcct

SEQ ID NO: 195116 - DNA, 20 bp, Artificial
  CRISPR gRNA sequence
tcagctgtatggttttcctc

SEQ ID NO: 195117 - DNA, 20 bp, Artificial
  CRISPR gRNA sequence
ctcaggatctaatctcctaa

SEQ ID NO: 195118 - DNA, 20 bp, Artificial
  CRISPR gRNA sequence
gatctaatctcctaaaagtg

SEQ ID NO: 195119 - DNA, 20 bp, Artificial
  CRISPR gRNA sequence
ctaatctcctaaaagtgcag

SEQ ID NO: 195120 - DNA, 20 bp, Artificial
  CRISPR gRNA sequence
agtgcagtagaaaatctcat

SEQ ID NO: 195121 - DNA, 20 bp, Artificial
  CRISPR gRNA sequence
ttagttgttgtgttgattct

SEQ ID NO: 195122 - DNA, 20 bp, Artificial
  CRISPR gRNA sequence
tgtgttgattctcagtgtgc

SEQ ID NO: 195123 - DNA, 20 bp, Artificial
  CRISPR gRNA sequence
agtgtgctggtcacattgaa

SEQ ID NO: 195124 - DNA, 20 bp, Artificial
  CRISPR gRNA sequence
gaaaagcttctcctctctct

SEQ ID NO: 195125 - DNA, 20 bp, Artificial
  CRISPR gRNA sequence
cttctcctctctcttggaat

SEQ ID NO: 195126 - DNA, 20 bp, Artificial
  CRISPR gRNA sequence
ctcctctctcttggaattgg

SEQ ID NO: 195127 - DNA, 20 bp, Artificial
  CRISPR gRNA sequence
ctctctcttggaattggtgg

SEQ ID NO: 195128 - DNA, 20 bp, Artificial
  CRISPR gRNA sequence
tctcttggaattggtggtgg

SEQ ID NO: 195129 - DNA, 20 bp, Artificial
  CRISPR gRNA sequence
gtggtggtggtcttaccact

SEQ ID NO: 195130 - DNA, 20 bp, Artificial
  CRISPR gRNA sequence
tggtggtggtcttaccactc

SEQ ID NO: 195131 - DNA, 20 bp, Artificial
  CRISPR gRNA sequence
tcttaccactcaggacttga

SEQ ID NO: 195132 - DNA, 20 bp, Artificial
  CRISPR gRNA sequence
cttgatggtcactgcttgtc

SEQ ID NO: 195133 - DNA, 20 bp, Artificial
  CRISPR gRNA sequence
actgcttgtccagatgactt

SEQ ID NO: 195134 - DNA, 20 bp, Artificial
  CRISPR gRNA sequence
tgtccagatgacttcggcct

SEQ ID NO: 195135 - DNA, 20 bp, Artificial
  CRISPR gRNA sequence
gtccagatgacttcggcctt

SEQ ID NO: 195136 - DNA, 20 bp, Artificial
  CRISPR gRNA sequence
tccagatgacttcggccttg

SEQ ID NO: 195137 - DNA, 20 bp, Artificial
  CRISPR gRNA sequence
agatgacttcggccttgggg

SEQ ID NO: 195138 - DNA, 20 bp, Artificial
  CRISPR gRNA sequence
ttcggccttggggtagccct

SEQ ID NO: 195139 - DNA, 20 bp, Artificial
  CRISPR gRNA sequence
tagccctcagcctgacatgt

SEQ ID NO: 195140 - DNA, 20 bp, Artificial
  CRISPR gRNA sequence
ctgacatgtcagttcatgtt

SEQ ID NO: 195141 - DNA, 20 bp, Artificial
  CRISPR gRNA sequence
gacatgtcagttcatgttca

SEQ ID NO: 195142 - DNA, 20 bp, Artificial
  CRISPR gRNA sequence
acatgtcagttcatgttcag

SEQ ID NO: 195143 - DNA, 20 bp, Artificial
  CRISPR gRNA sequence
agttcatgttcagaggtgac

SEQ ID NO: 195144 - DNA, 20 bp, Artificial
  CRISPR gRNA sequence
gatccacaaccaaaattctt

SEQ ID NO: 195145 - DNA, 20 bp, Artificial
  CRISPR gRNA sequence
ctttggttgattttgttgta

SEQ ID NO: 195146 - DNA, 20 bp, Artificial
  CRISPR gRNA sequence
tttggttgattttgttgtat

SEQ ID NO: 195147 - DNA, 20 bp, Artificial
  CRISPR gRNA sequence
ttggttgattttgttgtatg

SEQ ID NO: 195148 - DNA, 20 bp, Artificial
  CRISPR gRNA sequence
ttgattttgttgtatggggc

SEQ ID NO: 195149 - DNA, 20 bp, Artificial
  CRISPR gRNA sequence
tgattttgttgtatggggct

SEQ ID NO: 195150 - DNA, 20 bp, Artificial
  CRISPR gRNA sequence
ggggctaggacataaacaaa

SEQ ID NO: 195151 - DNA, 20 bp, Artificial
  CRISPR gRNA sequence
gctaggacataaacaaaaag

SEQ ID NO: 195152 - DNA, 20 bp, Artificial
  CRISPR gRNA sequence
ggacataaacaaaaagaagt

SEQ ID NO: 195153 - DNA, 20 bp, Artificial
  CRISPR gRNA sequence
gacataaacaaaaagaagtc

SEQ ID NO: 195154 - DNA, 20 bp, Artificial
  CRISPR gRNA sequence
acataaacaaaaagaagtca

SEQ ID NO: 195155 - DNA, 20 bp, Artificial
  CRISPR gRNA sequence
aagaagtcagggcttttgct

SEQ ID NO: 195156 - DNA, 20 bp, Artificial
  CRISPR gRNA sequence
gtcagggcttttgctgagca

SEQ ID NO: 195157 - DNA, 20 bp, Artificial
  CRISPR gRNA sequence
tgagcacagaactacgtaca

SEQ ID NO: 195158 - DNA, 20 bp, Artificial
  CRISPR gRNA sequence
tagcttgatgctgtccacat

SEQ ID NO: 195159 - DNA, 20 bp, Artificial
  CRISPR gRNA sequence
ttgatgctgtccacattaga

SEQ ID NO: 195160 - DNA, 20 bp, Artificial
  CRISPR gRNA sequence
gatgctgtccacattagaaa

SEQ ID NO: 195161 - DNA, 20 bp, Artificial
  CRISPR gRNA sequence
cattagaaagagtatcaatg

SEQ ID NO: 195162 - DNA, 20 bp, Artificial
  CRISPR gRNA sequence
attagaaagagtatcaatgc

SEQ ID NO: 195163 - DNA, 20 bp, Artificial
  CRISPR gRNA sequence
gaaagagtatcaatgcaggc

SEQ ID NO: 195164 - DNA, 20 bp, Artificial
  CRISPR gRNA sequence
tatcaatgcaggctggttct

SEQ ID NO: 195165 - DNA, 20 bp, Artificial
  CRISPR gRNA sequence
tcaatgcaggctggttctca

SEQ ID NO: 195166 - DNA, 20 bp, Artificial
  CRISPR gRNA sequence
caatgcaggctggttctcag

SEQ ID NO: 195167 - DNA, 20 bp, Artificial
  CRISPR gRNA sequence
aatgcaggctggttctcaga

SEQ ID NO: 195168 - DNA, 20 bp, Artificial
  CRISPR gRNA sequence
agagggatatgcttaatgtt

SEQ ID NO: 195169 - DNA, 20 bp, Artificial
  CRISPR gRNA sequence
tgcttaatgttcagatgcct

SEQ ID NO: 195170 - DNA, 20 bp, Artificial
  CRISPR gRNA sequence
atgttcagatgcctcagccg

SEQ ID NO: 195171 - DNA, 20 bp, Artificial
  CRISPR gRNA sequence
tgttcagatgcctcagccgt

SEQ ID NO: 195172 - DNA, 20 bp, Artificial
  CRISPR gRNA sequence
gttcagatgcctcagccgtg

SEQ ID NO: 195173 - DNA, 20 bp, Artificial
  CRISPR gRNA sequence
cagccgtggggaacacctgc

SEQ ID NO: 195174 - DNA, 20 bp, Artificial
  CRISPR gRNA sequence
ctctgcctcaattcaattca

SEQ ID NO: 195175 - DNA, 20 bp, Artificial
  CRISPR gRNA sequence
gcctcaattcaattcaaagt

SEQ ID NO: 195176 - DNA, 20 bp, Artificial
  CRISPR gRNA sequence
cctcaattcaattcaaagtt

SEQ ID NO: 195177 - DNA, 20 bp, Artificial
  CRISPR gRNA sequence
attcaattcaaagttgggac

SEQ ID NO: 195178 - DNA, 20 bp, Artificial
  CRISPR gRNA sequence
attcaaagttgggacaagtt

SEQ ID NO: 195179 - DNA, 20 bp, Artificial
  CRISPR gRNA sequence
ttgggacaagtttggattaa

SEQ ID NO: 195180 - DNA, 20 bp, Artificial
  CRISPR gRNA sequence
tgggacaagtttggattaat

SEQ ID NO: 195181 - DNA, 20 bp, Artificial
  CRISPR gRNA sequence
tctttctataaaaatcatgt

SEQ ID NO: 195182 - DNA, 20 bp, Artificial
  CRISPR gRNA sequence
aatcatgttggtacatttat

SEQ ID NO: 195183 - DNA, 20 bp, Artificial
  CRISPR gRNA sequence
atcatgttggtacatttatt

SEQ ID NO: 195184 - DNA, 20 bp, Artificial
  CRISPR gRNA sequence
ttgggctcaaacaaaatgta

SEQ ID NO: 195185 - DNA, 20 bp, Artificial
  CRISPR gRNA sequence
attaatttacactaaaaccc

SEQ ID NO: 195186 - DNA, 20 bp, Artificial
  CRISPR gRNA sequence
tttctacaaaaaataattta

SEQ ID NO: 195187 - DNA, 20 bp, Artificial
  CRISPR gRNA sequence
tctacaaaaaataatttaaa

SEQ ID NO: 195188 - DNA, 20 bp, Artificial
  CRISPR gRNA sequence
aaagagaattatctttaaac

SEQ ID NO: 195189 - DNA, 20 bp, Artificial
  CRISPR gRNA sequence
gagaattatctttaaaccag

SEQ ID NO: 195190 - DNA, 20 bp, Artificial
  CRISPR gRNA sequence
aatatccctctccatttgtt

SEQ ID NO: 195191 - DNA, 20 bp, Artificial
  CRISPR gRNA sequence
atatccctctccatttgttc

SEQ ID NO: 195192 - DNA, 20 bp, Artificial
  CRISPR gRNA sequence
tcaggttttcatatgtttct

SEQ ID NO: 195193 - DNA, 20 bp, Artificial
  CRISPR gRNA sequence
ttttcatatgtttctcagta

SEQ ID NO: 195194 - DNA, 20 bp, Artificial
  CRISPR gRNA sequence
cttcttcttaaatttattct

SEQ ID NO: 195195 - DNA, 20 bp, Artificial
  CRISPR gRNA sequence
tttataaacatgaatctctc

SEQ ID NO: 195196 - DNA, 20 bp, Artificial
  CRISPR gRNA sequence
taaacatgaatctctccagc

SEQ ID NO: 195197 - DNA, 20 bp, Artificial
  CRISPR gRNA sequence
gctggtatgctttcttttct

SEQ ID NO: 195198 - DNA, 20 bp, Artificial
  CRISPR gRNA sequence
tgctttcttttcttagactt

SEQ ID NO: 195199 - DNA, 20 bp, Artificial
  CRISPR gRNA sequence
ttttcttagacttcagtaaa

SEQ ID NO: 195200 - DNA, 20 bp, Artificial
  CRISPR gRNA sequence
taaacagaaaacctgatttt

SEQ ID NO: 195201 - DNA, 20 bp, Artificial
  CRISPR gRNA sequence
aaacagaaaacctgattttg

SEQ ID NO: 195202 - DNA, 20 bp, Artificial
  CRISPR gRNA sequence
tcattcacttttctgatttg

SEQ ID NO: 195203 - DNA, 20 bp, Artificial
  CRISPR gRNA sequence
tctgatttgaagtcaatgat

SEQ ID NO: 195204 - DNA, 20 bp, Artificial
  CRISPR gRNA sequence
tgaagtcaatgatcagaaat

SEQ ID NO: 195205 - DNA, 20 bp, Artificial
  CRISPR gRNA sequence
aaattagatatgaaaataca

SEQ ID NO: 195206 - DNA, 20 bp, Artificial
  CRISPR gRNA sequence
catagtatttcatctgtaaa

SEQ ID NO: 195207 - DNA, 20 bp, Artificial
  CRISPR gRNA sequence
taaacagtgatatatgttcc

SEQ ID NO: 195208 - DNA, 20 bp, Artificial
  CRISPR gRNA sequence
tttaaatttgttctttattt

SEQ ID NO: 195209 - DNA, 20 bp, Artificial
  CRISPR gRNA sequence
aaatttgttctttattttag

SEQ ID NO: 195210 - DNA, 20 bp, Artificial
  CRISPR gRNA sequence
gaagttttaaatttacaaaa

SEQ ID NO: 195211 - DNA, 20 bp, Artificial
  CRISPR gRNA sequence
aaatttacaaaaaagttgca

SEQ ID NO: 195212 - DNA, 20 bp, Artificial
  CRISPR gRNA sequence
ttacaaaaaagttgcaaaga

SEQ ID NO: 195213 - DNA, 20 bp, Artificial
  CRISPR gRNA sequence
aaaaagttgcaaagatagta

SEQ ID NO: 195214 - DNA, 20 bp, Artificial
  CRISPR gRNA sequence
aaagttgcaaagatagtata

SEQ ID NO: 195215 - DNA, 20 bp, Artificial
  CRISPR gRNA sequence
gttactgtatactccttacc

SEQ ID NO: 195216 - DNA, 20 bp, Artificial
  CRISPR gRNA sequence
tacccggtttcctctattgt

SEQ ID NO: 195217 - DNA, 20 bp, Artificial
  CRISPR gRNA sequence
gttagtatcttacattacca

SEQ ID NO: 195218 - DNA, 20 bp, Artificial
  CRISPR gRNA sequence
atggtacaatcgtcataact

SEQ ID NO: 195219 - DNA, 20 bp, Artificial
  CRISPR gRNA sequence
tggtacaatcgtcataacta

SEQ ID NO: 195220 - DNA, 20 bp, Artificial
  CRISPR gRNA sequence
atcgtcataactaaggacgt

SEQ ID NO: 195221 - DNA, 20 bp, Artificial
  CRISPR gRNA sequence
cataatttattccattcctc

SEQ ID NO: 195222 - DNA, 20 bp, Artificial
  CRISPR gRNA sequence
ctaatatcctttttctgttc

SEQ ID NO: 195223 - DNA, 20 bp, Artificial
  CRISPR gRNA sequence
taatatcctttttctgttct

SEQ ID NO: 195224 - DNA, 20 bp, Artificial
  CRISPR gRNA sequence
ttctgttctgggatgctatc

SEQ ID NO: 195225 - DNA, 20 bp, Artificial
  CRISPR gRNA sequence
tctgttctgggatgctatct

SEQ ID NO: 195226 - DNA, 20 bp, Artificial
  CRISPR gRNA sequence
cattatgatatttacatttt

SEQ ID NO: 195227 - DNA, 20 bp, Artificial
  CRISPR gRNA sequence
cattttaagcttttaaatgc

SEQ ID NO: 195228 - DNA, 20 bp, Artificial
  CRISPR gRNA sequence
gctattttaataaatcattt

SEQ ID NO: 195229 - DNA, 20 bp, Artificial
  CRISPR gRNA sequence
tcatttaagtaattatgctc

SEQ ID NO: 195230 - DNA, 20 bp, Artificial
  CRISPR gRNA sequence
catttaagtaattatgctca

SEQ ID NO: 195231 - DNA, 20 bp, Artificial
  CRISPR gRNA sequence
ttaagtaattatgctcaagg

SEQ ID NO: 195232 - DNA, 20 bp, Artificial
  CRISPR gRNA sequence
gtaattatgctcaaggaaga

SEQ ID NO: 195233 - DNA, 20 bp, Artificial
  CRISPR gRNA sequence
aagaaagtttgattcaattt

SEQ ID NO: 195234 - DNA, 20 bp, Artificial
  CRISPR gRNA sequence
ttgattcaattttagatcat

SEQ ID NO: 195235 - DNA, 20 bp, Artificial
  CRISPR gRNA sequence
tcaattttagatcattggtt

SEQ ID NO: 195236 - DNA, 20 bp, Artificial
  CRISPR gRNA sequence
caattttagatcattggttt

SEQ ID NO: 195237 - DNA, 20 bp, Artificial
  CRISPR gRNA sequence
tcattggtttgggacccttt

SEQ ID NO: 195238 - DNA, 20 bp, Artificial
  CRISPR gRNA sequence
cattggtttgggaccctttc

SEQ ID NO: 195239 - DNA, 20 bp, Artificial
  CRISPR gRNA sequence
tttgggaccctttcaggatt

SEQ ID NO: 195240 - DNA, 20 bp, Artificial
  CRISPR gRNA sequence
cctttcaggattaagatacg

SEQ ID NO: 195241 - DNA, 20 bp, Artificial
  CRISPR gRNA sequence
acgtagtttgctgacaattc

SEQ ID NO: 195242 - DNA, 20 bp, Artificial
  CRISPR gRNA sequence
tagtttgctgacaattctag

SEQ ID NO: 195243 - DNA, 20 bp, Artificial
  CRISPR gRNA sequence
gacaattctagtagattgtt

SEQ ID NO: 195244 - DNA, 20 bp, Artificial
  CRISPR gRNA sequence
gattgtttagtgcacctata

SEQ ID NO: 195245 - DNA, 20 bp, Artificial
  CRISPR gRNA sequence
ttagtgcacctatatagcat

SEQ ID NO: 195246 - DNA, 20 bp, Artificial
  CRISPR gRNA sequence
agtgcacctatatagcataa

SEQ ID NO: 195247 - DNA, 20 bp, Artificial
  CRISPR gRNA sequence
tattcatgtttattcattac

SEQ ID NO: 195248 - DNA, 20 bp, Artificial
  CRISPR gRNA sequence
ttaacatgttcttattttgt

SEQ ID NO: 195249 - DNA, 20 bp, Artificial
  CRISPR gRNA sequence
tttttttacttctaatacta

SEQ ID NO: 195250 - DNA, 20 bp, Artificial
  CRISPR gRNA sequence
tagtgtaaccactaatgatc

SEQ ID NO: 195251 - DNA, 20 bp, Artificial
  CRISPR gRNA sequence
gtgtaaccactaatgatcta

SEQ ID NO: 195252 - DNA, 20 bp, Artificial
  CRISPR gRNA sequence
taattctccattcctttacc

SEQ ID NO: 195253 - DNA, 20 bp, Artificial
  CRISPR gRNA sequence
aattctccattcctttacca

SEQ ID NO: 195254 - DNA, 20 bp, Artificial
  CRISPR gRNA sequence
ctccattcctttaccaagga

SEQ ID NO: 195255 - DNA, 20 bp, Artificial
  CRISPR gRNA sequence
tcctttaccaaggacagcaa

SEQ ID NO: 195256 - DNA, 20 bp, Artificial
  CRISPR gRNA sequence
aaggacagcaatagatttgt

SEQ ID NO: 195257 - DNA, 20 bp, Artificial
  CRISPR gRNA sequence
aggacagcaatagatttgtg

SEQ ID NO: 195258 - DNA, 20 bp, Artificial
  CRISPR gRNA sequence
tttgtgaggtaatttcttca

SEQ ID NO: 195259 - DNA, 20 bp, Artificial
  CRISPR gRNA sequence
tgtgaggtaatttcttcaca

SEQ ID NO: 195260 - DNA, 20 bp, Artificial
  CRISPR gRNA sequence
tgaggtaatttcttcacaga

SEQ ID NO: 195261 - DNA, 20 bp, Artificial
  CRISPR gRNA sequence
cacagagagttaatacaaaa

SEQ ID NO: 195262 - DNA, 20 bp, Artificial
  CRISPR gRNA sequence
gagagttaatacaaaacggc

SEQ ID NO: 195263 - DNA, 20 bp, Artificial
  CRISPR gRNA sequence
agagttaatacaaaacggct

SEQ ID NO: 195264 - DNA, 20 bp, Artificial
  CRISPR gRNA sequence
atgaaactgaaataaataat

SEQ ID NO: 195265 - DNA, 20 bp, Artificial
  CRISPR gRNA sequence
tatatcaatgaaaccactac

SEQ ID NO: 195266 - DNA, 20 bp, Artificial
  CRISPR gRNA sequence
atcaatgaaaccactaccag

SEQ ID NO: 195267 - DNA, 20 bp, Artificial
  CRISPR gRNA sequence
accactaccagtggaaacac

SEQ ID NO: 195268 - DNA, 20 bp, Artificial
  CRISPR gRNA sequence
atttcaaaacacaaaaataa

SEQ ID NO: 195269 - DNA, 20 bp, Artificial
  CRISPR gRNA sequence
aaaataatagttcttatgtg

SEQ ID NO: 195270 - DNA, 20 bp, Artificial
  CRISPR gRNA sequence
aaataatagttcttatgtgt

SEQ ID NO: 195271 - DNA, 20 bp, Artificial
  CRISPR gRNA sequence
ttcttatgtgtaggttgctt

SEQ ID NO: 195272 - DNA, 20 bp, Artificial
  CRISPR gRNA sequence
tcttatgtgtaggttgcttt

SEQ ID NO: 195273 - DNA, 20 bp, Artificial
  CRISPR gRNA sequence
cttatgtgtaggttgctttg

SEQ ID NO: 195274 - DNA, 20 bp, Artificial
  CRISPR gRNA sequence
atgtgtaggttgctttgggg

SEQ ID NO: 195275 - DNA, 20 bp, Artificial
  CRISPR gRNA sequence
aggttgctttggggtagcta

SEQ ID NO: 195276 - DNA, 20 bp, Artificial
  CRISPR gRNA sequence
aaattaaacaactaattaaa

SEQ ID NO: 195277 - DNA, 20 bp, Artificial
  CRISPR gRNA sequence
taattaaaaagtttcccaca

SEQ ID NO: 195278 - DNA, 20 bp, Artificial
  CRISPR gRNA sequence
aagtttcccacaaagaaact

SEQ ID NO: 195279 - DNA, 20 bp, Artificial
  CRISPR gRNA sequence
agtttcccacaaagaaactg

SEQ ID NO: 195280 - DNA, 20 bp, Artificial
  CRISPR gRNA sequence
cacaaagaaactgaggactg

SEQ ID NO: 195281 - DNA, 20 bp, Artificial
  CRISPR gRNA sequence
gaagataatactaataattc

SEQ ID NO: 195282 - DNA, 20 bp, Artificial
  CRISPR gRNA sequence
ctaataattcaagcacaacc

SEQ ID NO: 195283 - DNA, 20 bp, Artificial
  CRISPR gRNA sequence
aataattcaagcacaaccca

SEQ ID NO: 195284 - DNA, 20 bp, Artificial
  CRISPR gRNA sequence
ataattcaagcacaacccag

SEQ ID NO: 195285 - DNA, 20 bp, Artificial
  CRISPR gRNA sequence
caagcacaacccagaggaaa

SEQ ID NO: 195286 - DNA, 20 bp, Artificial
  CRISPR gRNA sequence
gcacaacccagaggaaacag

SEQ ID NO: 195287 - DNA, 20 bp, Artificial
  CRISPR gRNA sequence
caacccagaggaaacagcag

SEQ ID NO: 195288 - DNA, 20 bp, Artificial
  CRISPR gRNA sequence
gcagaagtgacactttttat

SEQ ID NO: 195289 - DNA, 20 bp, Artificial
  CRISPR gRNA sequence
ctttttatcggccactgtat

SEQ ID NO: 195290 - DNA, 20 bp, Artificial
  CRISPR gRNA sequence
tttttatcggccactgtatg

SEQ ID NO: 195291 - DNA, 20 bp, Artificial
  CRISPR gRNA sequence
ttatcggccactgtatgagg

SEQ ID NO: 195292 - DNA, 20 bp, Artificial
  CRISPR gRNA sequence
ccactgtatgaggtggtaaa

SEQ ID NO: 195293 - DNA, 20 bp, Artificial
  CRISPR gRNA sequence
tgtatgaggtggtaaacagt

SEQ ID NO: 195294 - DNA, 20 bp, Artificial
  CRISPR gRNA sequence
gtaaacagtaagtacttaat

SEQ ID NO: 195295 - DNA, 20 bp, Artificial
  CRISPR gRNA sequence
aagtacttaattagacctcg

SEQ ID NO: 195296 - DNA, 20 bp, Artificial
  CRISPR gRNA sequence
tataaaaaaacacaaacctc

SEQ ID NO: 195297 - DNA, 20 bp, Artificial
  CRISPR gRNA sequence
atccacctttgttaatgata

SEQ ID NO: 195298 - DNA, 20 bp, Artificial
  CRISPR gRNA sequence
ttaatgataaagttcaccct

SEQ ID NO: 195299 - DNA, 20 bp, Artificial
  CRISPR gRNA sequence
taatgataaagttcacccta

SEQ ID NO: 195300 - DNA, 20 bp, Artificial
  CRISPR gRNA sequence
tatattatgccttgacatat

SEQ ID NO: 195301 - DNA, 20 bp, Artificial
  CRISPR gRNA sequence
cttgacatattagctaatga

SEQ ID NO: 195302 - DNA, 20 bp, Artificial
  CRISPR gRNA sequence
catattagctaatgatagtg

SEQ ID NO: 195303 - DNA, 20 bp, Artificial
  CRISPR gRNA sequence
tgatagtgaagcatcacaat

SEQ ID NO: 195304 - DNA, 20 bp, Artificial
  CRISPR gRNA sequence
gtttttgtacaaatgtctat

SEQ ID NO: 195305 - DNA, 20 bp, Artificial
  CRISPR gRNA sequence
tttttgtacaaatgtctatt

SEQ ID NO: 195306 - DNA, 20 bp, Artificial
  CRISPR gRNA sequence
aaatgtctattaggttgaac

SEQ ID NO: 195307 - DNA, 20 bp, Artificial
  CRISPR gRNA sequence
taggttgaaccagatgtaac

SEQ ID NO: 195308 - DNA, 20 bp, Artificial
  CRISPR gRNA sequence
ctttttttgctcttcaaaaa

SEQ ID NO: 195309 - DNA, 20 bp, Artificial
  CRISPR gRNA sequence
tttttgctcttcaaaaacgg

SEQ ID NO: 195310 - DNA, 20 bp, Artificial
  CRISPR gRNA sequence
tgatacaacttatatattaa

SEQ ID NO: 195311 - DNA, 20 bp, Artificial
  CRISPR gRNA sequence
acaacttatatattaacaga

SEQ ID NO: 195312 - DNA, 20 bp, Artificial
  CRISPR gRNA sequence
atgtgcatgcacaaacacac

SEQ ID NO: 195313 - DNA, 20 bp, Artificial
  CRISPR gRNA sequence
cacgagttcaaaatgtttta

SEQ ID NO: 195314 - DNA, 20 bp, Artificial
  CRISPR gRNA sequence
gttcaaaatgttttacagat

SEQ ID NO: 195315 - DNA, 20 bp, Artificial
  CRISPR gRNA sequence
aaatgttttacagatgagat

SEQ ID NO: 195316 - DNA, 20 bp, Artificial
  CRISPR gRNA sequence
atgagtaatcaaaatttttg

SEQ ID NO: 195317 - DNA, 20 bp, Artificial
  CRISPR gRNA sequence
aatcaaaatttttgcagacc

SEQ ID NO: 195318 - DNA, 20 bp, Artificial
  CRISPR gRNA sequence
ccagaacactatactaatgt

SEQ ID NO: 195319 - DNA, 20 bp, Artificial
  CRISPR gRNA sequence
aatgttggacaatcaaaacc

SEQ ID NO: 195320 - DNA, 20 bp, Artificial
  CRISPR gRNA sequence
tggacaatcaaaaccaagaa

SEQ ID NO: 195321 - DNA, 20 bp, Artificial
  CRISPR gRNA sequence
ggacaatcaaaaccaagaaa

SEQ ID NO: 195322 - DNA, 20 bp, Artificial
  CRISPR gRNA sequence
aaaccaagaaaaggtcatga

SEQ ID NO: 195323 - DNA, 20 bp, Artificial
  CRISPR gRNA sequence
aaaaggtcatgatagttttg

SEQ ID NO: 195324 - DNA, 20 bp, Artificial
  CRISPR gRNA sequence
atataacttgatacgtacac

SEQ ID NO: 195325 - DNA, 20 bp, Artificial
  CRISPR gRNA sequence
ataacttgatacgtacacca

SEQ ID NO: 195326 - DNA, 20 bp, Artificial
  CRISPR gRNA sequence
taacttgatacgtacaccag

SEQ ID NO: 195327 - DNA, 20 bp, Artificial
  CRISPR gRNA sequence
gtacaccagaggtacaaata

SEQ ID NO: 195328 - DNA, 20 bp, Artificial
  CRISPR gRNA sequence
tacaccagaggtacaaatat

SEQ ID NO: 195329 - DNA, 20 bp, Artificial
  CRISPR gRNA sequence
gtacaaatataggcaataaa

SEQ ID NO: 195330 - DNA, 20 bp, Artificial
  CRISPR gRNA sequence
caaatataggcaataaaaag

SEQ ID NO: 195331 - DNA, 20 bp, Artificial
  CRISPR gRNA sequence
ggcaataaaaagtggttatt

SEQ ID NO: 195332 - DNA, 20 bp, Artificial
  CRISPR gRNA sequence
gcaataaaaagtggttatta

SEQ ID NO: 195333 - DNA, 20 bp, Artificial
  CRISPR gRNA sequence
caataaaaagtggttattaa

SEQ ID NO: 195334 - DNA, 20 bp, Artificial
  CRISPR gRNA sequence
aaaagtggttattaagggcc

SEQ ID NO: 195335 - DNA, 20 bp, Artificial
  CRISPR gRNA sequence
gttattaagggcccagactt

SEQ ID NO: 195336 - DNA, 20 bp, Artificial
  CRISPR gRNA sequence
tattaagggcccagacttca

SEQ ID NO: 195337 - DNA, 20 bp, Artificial
  CRISPR gRNA sequence
gacttcagagctaatctgct

SEQ ID NO: 195338 - DNA, 20 bp, Artificial
  CRISPR gRNA sequence
acttcagagctaatctgctt

SEQ ID NO: 195339 - DNA, 20 bp, Artificial
  CRISPR gRNA sequence
agagctaatctgcttgggtt

SEQ ID NO: 195340 - DNA, 20 bp, Artificial
  CRISPR gRNA sequence
aatctgcttgggtttagaac

SEQ ID NO: 195341 - DNA, 20 bp, Artificial
  CRISPR gRNA sequence
gaactagctttatcattttc

SEQ ID NO: 195342 - DNA, 20 bp, Artificial
  CRISPR gRNA sequence
aactagctttatcattttct

SEQ ID NO: 195343 - DNA, 20 bp, Artificial
  CRISPR gRNA sequence
agctttatcattttctaggc

SEQ ID NO: 195344 - DNA, 20 bp, Artificial
  CRISPR gRNA sequence
gctttatcattttctaggct

SEQ ID NO: 195345 - DNA, 20 bp, Artificial
  CRISPR gRNA sequence
ttttctaggctgggtgaatt

SEQ ID NO: 195346 - DNA, 20 bp, Artificial
  CRISPR gRNA sequence
tttctaggctgggtgaattt

SEQ ID NO: 195347 - DNA, 20 bp, Artificial
  CRISPR gRNA sequence
ggcaaattacttaatttctt

SEQ ID NO: 195348 - DNA, 20 bp, Artificial
  CRISPR gRNA sequence
tacttaatttctttggacct

SEQ ID NO: 195349 - DNA, 20 bp, Artificial
  CRISPR gRNA sequence
cagtttcctcatccttaaaa

SEQ ID NO: 195350 - DNA, 20 bp, Artificial
  CRISPR gRNA sequence
agtttcctcatccttaaaat

SEQ ID NO: 195351 - DNA, 20 bp, Artificial
  CRISPR gRNA sequence
gggaataataccacttatca

SEQ ID NO: 195352 - DNA, 20 bp, Artificial
  CRISPR gRNA sequence
taccacttatcatggaatca

SEQ ID NO: 195353 - DNA, 20 bp, Artificial
  CRISPR gRNA sequence
atcaaagattccatcattga

SEQ ID NO: 195354 - DNA, 20 bp, Artificial
  CRISPR gRNA sequence
ccatcattgaaagacacact

SEQ ID NO: 195355 - DNA, 20 bp, Artificial
  CRISPR gRNA sequence
tgaaagacacactcagattt

SEQ ID NO: 195356 - DNA, 20 bp, Artificial
  CRISPR gRNA sequence
aatactcatcttacatgatg

SEQ ID NO: 195357 - DNA, 20 bp, Artificial
  CRISPR gRNA sequence
atgatgaagcacttaccccc

SEQ ID NO: 195358 - DNA, 20 bp, Artificial
  CRISPR gRNA sequence
gatgaagcacttacccccta

SEQ ID NO: 195359 - DNA, 20 bp, Artificial
  CRISPR gRNA sequence
ttaccccctagagtcatttc

SEQ ID NO: 195360 - DNA, 20 bp, Artificial
  CRISPR gRNA sequence
taccccctagagtcatttcc

SEQ ID NO: 195361 - DNA, 20 bp, Artificial
  CRISPR gRNA sequence
ccccctagagtcatttccag

SEQ ID NO: 195362 - DNA, 20 bp, Artificial
  CRISPR gRNA sequence
cccctagagtcatttccagg

SEQ ID NO: 195363 - DNA, 20 bp, Artificial
  CRISPR gRNA sequence
caggaggaaatgaactaatt

SEQ ID NO: 195364 - DNA, 20 bp, Artificial
  CRISPR gRNA sequence
aggaaatgaactaatttaga

SEQ ID NO: 195365 - DNA, 20 bp, Artificial
  CRISPR gRNA sequence
gaaatgaactaatttagaca

SEQ ID NO: 195366 - DNA, 20 bp, Artificial
  CRISPR gRNA sequence
actaatttagacagagtgtt

SEQ ID NO: 195367 - DNA, 20 bp, Artificial
  CRISPR gRNA sequence
tttagacagagtgttcagta

SEQ ID NO: 195368 - DNA, 20 bp, Artificial
  CRISPR gRNA sequence
ttagacagagtgttcagtac

SEQ ID NO: 195369 - DNA, 20 bp, Artificial
  CRISPR gRNA sequence
tagacagagtgttcagtaca

SEQ ID NO: 195370 - DNA, 20 bp, Artificial
  CRISPR gRNA sequence
tcagtacagggcctaacaca

SEQ ID NO: 195371 - DNA, 20 bp, Artificial
  CRISPR gRNA sequence
cagggcctaacacacagaat

SEQ ID NO: 195372 - DNA, 20 bp, Artificial
  CRISPR gRNA sequence
gcctaacacacagaataagc

SEQ ID NO: 195373 - DNA, 20 bp, Artificial
  CRISPR gRNA sequence
gaataagcaagtgctaattg

SEQ ID NO: 195374 - DNA, 20 bp, Artificial
  CRISPR gRNA sequence
taagcaagtgctaattgtag

SEQ ID NO: 195375 - DNA, 20 bp, Artificial
  CRISPR gRNA sequence
ctaattgtagtagtactcga

SEQ ID NO: 195376 - DNA, 20 bp, Artificial
  CRISPR gRNA sequence
attgtagtagtactcgatag

SEQ ID NO: 195377 - DNA, 20 bp, Artificial
  CRISPR gRNA sequence
gtagtagtactcgatagtag

SEQ ID NO: 195378 - DNA, 20 bp, Artificial
  CRISPR gRNA sequence
gtagtactcgatagtagcag

SEQ ID NO: 195379 - DNA, 20 bp, Artificial
  CRISPR gRNA sequence
gtactcgatagtagcagtag

SEQ ID NO: 195380 - DNA, 20 bp, Artificial
  CRISPR gRNA sequence
actcgatagtagcagtagca

SEQ ID NO: 195381 - DNA, 20 bp, Artificial
  CRISPR gRNA sequence
tccttttactactgctgctc

SEQ ID NO: 195382 - DNA, 20 bp, Artificial
  CRISPR gRNA sequence
tgctgctccagtgtaccctt

SEQ ID NO: 195383 - DNA, 20 bp, Artificial
  CRISPR gRNA sequence
tgctccagtgtaccctttag

SEQ ID NO: 195384 - DNA, 20 bp, Artificial
  CRISPR gRNA sequence
taccctttagaagctgctaa

SEQ ID NO: 195385 - DNA, 20 bp, Artificial
  CRISPR gRNA sequence
tgctaacagttcctgatgaa

SEQ ID NO: 195386 - DNA, 20 bp, Artificial
  CRISPR gRNA sequence
acagttcctgatgaacagtc

SEQ ID NO: 195387 - DNA, 20 bp, Artificial
  CRISPR gRNA sequence
tgttcatgtttccaaaattt

SEQ ID NO: 195388 - DNA, 20 bp, Artificial
  CRISPR gRNA sequence
gttcatgtttccaaaatttt

SEQ ID NO: 195389 - DNA, 20 bp, Artificial
  CRISPR gRNA sequence
attttaggctaatcctattt

SEQ ID NO: 195390 - DNA, 20 bp, Artificial
  CRISPR gRNA sequence
ttttaggctaatcctatttg

SEQ ID NO: 195391 - DNA, 20 bp, Artificial
  CRISPR gRNA sequence
accaccactctgctgtatat

SEQ ID NO: 195392 - DNA, 20 bp, Artificial
  CRISPR gRNA sequence
ccaccactctgctgtatatc

SEQ ID NO: 195393 - DNA, 20 bp, Artificial
  CRISPR gRNA sequence
ctctgctgtatatcaggccc

SEQ ID NO: 195394 - DNA, 20 bp, Artificial
  CRISPR gRNA sequence
tctgctgtatatcaggccct

SEQ ID NO: 195395 - DNA, 20 bp, Artificial
  CRISPR gRNA sequence
ctgctgtatatcaggccctg

SEQ ID NO: 195396 - DNA, 20 bp, Artificial
  CRISPR gRNA sequence
gatgcaacaatattataaaa

SEQ ID NO: 195397 - DNA, 20 bp, Artificial
  CRISPR gRNA sequence
atgcaacaatattataaaac

SEQ ID NO: 195398 - DNA, 20 bp, Artificial
  CRISPR gRNA sequence
ggcccaaatctttgtgcttg

SEQ ID NO: 195399 - DNA, 20 bp, Artificial
  CRISPR gRNA sequence
cccaaatctttgtgcttgtg

SEQ ID NO: 195400 - DNA, 20 bp, Artificial
  CRISPR gRNA sequence
tgcttgtggagtttatattc

SEQ ID NO: 195401 - DNA, 20 bp, Artificial
  CRISPR gRNA sequence
gcttgtggagtttatattct

SEQ ID NO: 195402 - DNA, 20 bp, Artificial
  CRISPR gRNA sequence
ttgtggagtttatattctag

SEQ ID NO: 195403 - DNA, 20 bp, Artificial
  CRISPR gRNA sequence
tgtggagtttatattctagg

SEQ ID NO: 195404 - DNA, 20 bp, Artificial
  CRISPR gRNA sequence
tggagtttatattctaggag

SEQ ID NO: 195405 - DNA, 20 bp, Artificial
  CRISPR gRNA sequence
gagtttatattctaggagga

SEQ ID NO: 195406 - DNA, 20 bp, Artificial
  CRISPR gRNA sequence
gtttatattctaggaggaga

SEQ ID NO: 195407 - DNA, 20 bp, Artificial
  CRISPR gRNA sequence
gagagagacaataaacaaaa

SEQ ID NO: 195408 - DNA, 20 bp, Artificial
  CRISPR gRNA sequence
agacaataaacaaaacagaa

SEQ ID NO: 195409 - DNA, 20 bp, Artificial
  CRISPR gRNA sequence
tgatatgctacacaatatac

SEQ ID NO: 195410 - DNA, 20 bp, Artificial
  CRISPR gRNA sequence
atgctacacaatatactaga

SEQ ID NO: 195411 - DNA, 20 bp, Artificial
  CRISPR gRNA sequence
gctacacaatatactagata

SEQ ID NO: 195412 - DNA, 20 bp, Artificial
  CRISPR gRNA sequence
ctagatagagataaatgcta

SEQ ID NO: 195413 - DNA, 20 bp, Artificial
  CRISPR gRNA sequence
agatagagataaatgctaca

SEQ ID NO: 195414 - DNA, 20 bp, Artificial
  CRISPR gRNA sequence
tgctacagagaacacttaaa

SEQ ID NO: 195415 - DNA, 20 bp, Artificial
  CRISPR gRNA sequence
gctacagagaacacttaaac

SEQ ID NO: 195416 - DNA, 20 bp, Artificial
  CRISPR gRNA sequence
ctacagagaacacttaaaca

SEQ ID NO: 195417 - DNA, 20 bp, Artificial
  CRISPR gRNA sequence
agagaacacttaaacagggc

SEQ ID NO: 195418 - DNA, 20 bp, Artificial
  CRISPR gRNA sequence
gagaacacttaaacagggct

SEQ ID NO: 195419 - DNA, 20 bp, Artificial
  CRISPR gRNA sequence
ttaaacagggctgggaattt

SEQ ID NO: 195420 - DNA, 20 bp, Artificial
  CRISPR gRNA sequence
taaacagggctgggaatttt

SEQ ID NO: 195421 - DNA, 20 bp, Artificial
  CRISPR gRNA sequence
aaacagggctgggaattttg

SEQ ID NO: 195422 - DNA, 20 bp, Artificial
  CRISPR gRNA sequence
acagggctgggaattttggg

SEQ ID NO: 195423 - DNA, 20 bp, Artificial
  CRISPR gRNA sequence
agggctgggaattttgggga

SEQ ID NO: 195424 - DNA, 20 bp, Artificial
  CRISPR gRNA sequence
ctgggaattttggggagaga

SEQ ID NO: 195425 - DNA, 20 bp, Artificial
  CRISPR gRNA sequence
tgggaattttggggagagat

SEQ ID NO: 195426 - DNA, 20 bp, Artificial
  CRISPR gRNA sequence
gggaattttggggagagatg

SEQ ID NO: 195427 - DNA, 20 bp, Artificial
  CRISPR gRNA sequence
attttggggagagatggggt

SEQ ID NO: 195428 - DNA, 20 bp, Artificial
  CRISPR gRNA sequence
ttggggagagatggggttgg

SEQ ID NO: 195429 - DNA, 20 bp, Artificial
  CRISPR gRNA sequence
tggggagagatggggttggt

SEQ ID NO: 195430 - DNA, 20 bp, Artificial
  CRISPR gRNA sequence
ggggagagatggggttggtg

SEQ ID NO: 195431 - DNA, 20 bp, Artificial
  CRISPR gRNA sequence
atggggttggtggggaatga

SEQ ID NO: 195432 - DNA, 20 bp, Artificial
  CRISPR gRNA sequence
gggttggtggggaatgacag

SEQ ID NO: 195433 - DNA, 20 bp, Artificial
  CRISPR gRNA sequence
gggaatgacagcagtcgatt

SEQ ID NO: 195434 - DNA, 20 bp, Artificial
  CRISPR gRNA sequence
tttggtccatatgatccaaa

SEQ ID NO: 195435 - DNA, 20 bp, Artificial
  CRISPR gRNA sequence
tatgatccaaatagctttat

SEQ ID NO: 195436 - DNA, 20 bp, Artificial
  CRISPR gRNA sequence
atgatccaaatagctttatc

SEQ ID NO: 195437 - DNA, 20 bp, Artificial
  CRISPR gRNA sequence
tatgcaacactttgatcttt

SEQ ID NO: 195438 - DNA, 20 bp, Artificial
  CRISPR gRNA sequence
tcagctgcctaatctcattg

SEQ ID NO: 195439 - DNA, 20 bp, Artificial
  CRISPR gRNA sequence
cagctgcctaatctcattga

SEQ ID NO: 195440 - DNA, 20 bp, Artificial
  CRISPR gRNA sequence
aatctcattgaaggttctga

SEQ ID NO: 195441 - DNA, 20 bp, Artificial
  CRISPR gRNA sequence
catttcgttttccctgctgt

SEQ ID NO: 195442 - DNA, 20 bp, Artificial
  CRISPR gRNA sequence
atttcgttttccctgctgtt

SEQ ID NO: 195443 - DNA, 20 bp, Artificial
  CRISPR gRNA sequence
gttttccctgctgttaggtt

SEQ ID NO: 195444 - DNA, 20 bp, Artificial
  CRISPR gRNA sequence
gctgttaggttcagcgatta

SEQ ID NO: 195445 - DNA, 20 bp, Artificial
  CRISPR gRNA sequence
agaaaaacacttttaattga

SEQ ID NO: 195446 - DNA, 20 bp, Artificial
  CRISPR gRNA sequence
aaacacttttaattgaaagt

SEQ ID NO: 195447 - DNA, 20 bp, Artificial
  CRISPR gRNA sequence
cacttttaattgaaagttag

SEQ ID NO: 195448 - DNA, 20 bp, Artificial
  CRISPR gRNA sequence
taattgaaagttagtggcct

SEQ ID NO: 195449 - DNA, 20 bp, Artificial
  CRISPR gRNA sequence
attgaaagttagtggcctga

SEQ ID NO: 195450 - DNA, 20 bp, Artificial
  CRISPR gRNA sequence
aagttagtggcctgagagtc

SEQ ID NO: 195451 - DNA, 20 bp, Artificial
  CRISPR gRNA sequence
tggcatttaaactcacaaac

SEQ ID NO: 195452 - DNA, 20 bp, Artificial
  CRISPR gRNA sequence
atttaaactcacaaacaaga

SEQ ID NO: 195453 - DNA, 20 bp, Artificial
  CRISPR gRNA sequence
tttaaactcacaaacaagaa

SEQ ID NO: 195454 - DNA, 20 bp, Artificial
  CRISPR gRNA sequence
gaaaggtgcaataacacccg

SEQ ID NO: 195455 - DNA, 20 bp, Artificial
  CRISPR gRNA sequence
tgcaataacacccgaagtga

SEQ ID NO: 195456 - DNA, 20 bp, Artificial
  CRISPR gRNA sequence
ccgaagtgatagtgataatt

SEQ ID NO: 195457 - DNA, 20 bp, Artificial
  CRISPR gRNA sequence
aactaaattctttcaaattt

SEQ ID NO: 195458 - DNA, 20 bp, Artificial
  CRISPR gRNA sequence
gtttcacctttaaaatacca

SEQ ID NO: 195459 - DNA, 20 bp, Artificial
  CRISPR gRNA sequence
cacctttaaaataccatggt

SEQ ID NO: 195460 - DNA, 20 bp, Artificial
  CRISPR gRNA sequence
ccatggtgagtaaactcctg

SEQ ID NO: 195461 - DNA, 20 bp, Artificial
  CRISPR gRNA sequence
catggtgagtaaactcctgt

SEQ ID NO: 195462 - DNA, 20 bp, Artificial
  CRISPR gRNA sequence
atggtgagtaaactcctgtg

SEQ ID NO: 195463 - DNA, 20 bp, Artificial
  CRISPR gRNA sequence
gtgagtaaactcctgtgggg

SEQ ID NO: 195464 - DNA, 20 bp, Artificial
  CRISPR gRNA sequence
ttaccacacatttgctgtga

SEQ ID NO: 195465 - DNA, 20 bp, Artificial
  CRISPR gRNA sequence
taccacacatttgctgtgat

SEQ ID NO: 195466 - DNA, 20 bp, Artificial
  CRISPR gRNA sequence
cacacatttgctgtgatggg

SEQ ID NO: 195467 - DNA, 20 bp, Artificial
  CRISPR gRNA sequence
atttgctgtgatgggaagtg

SEQ ID NO: 195468 - DNA, 20 bp, Artificial
  CRISPR gRNA sequence
tgatgggaagtgaagttcaa

SEQ ID NO: 195469 - DNA, 20 bp, Artificial
  CRISPR gRNA sequence
actgtgaaatcatttgcata

SEQ ID NO: 195470 - DNA, 20 bp, Artificial
  CRISPR gRNA sequence
tgtgaaatcatttgcatatg

SEQ ID NO: 195471 - DNA, 20 bp, Artificial
  CRISPR gRNA sequence
gtgaaatcatttgcatatgg

SEQ ID NO: 195472 - DNA, 20 bp, Artificial
  CRISPR gRNA sequence
atttgcatatggaggtgact

SEQ ID NO: 195473 - DNA, 20 bp, Artificial
  CRISPR gRNA sequence
tttgcatatggaggtgactc

SEQ ID NO: 195474 - DNA, 20 bp, Artificial
  CRISPR gRNA sequence
tgcatatggaggtgactcag

SEQ ID NO: 195475 - DNA, 20 bp, Artificial
  CRISPR gRNA sequence
ctcaggagttctacttccct

SEQ ID NO: 195476 - DNA, 20 bp, Artificial
  CRISPR gRNA sequence
ggagttctacttccctgagt

SEQ ID NO: 195477 - DNA, 20 bp, Artificial
  CRISPR gRNA sequence
gagttctacttccctgagtt

SEQ ID NO: 195478 - DNA, 20 bp, Artificial
  CRISPR gRNA sequence
ttctacttccctgagttggg

SEQ ID NO: 195479 - DNA, 20 bp, Artificial
  CRISPR gRNA sequence
ctgagttgggaagctcctgc

SEQ ID NO: 195480 - DNA, 20 bp, Artificial
  CRISPR gRNA sequence
gttgggaagctcctgcaagc

SEQ ID NO: 195481 - DNA, 20 bp, Artificial
  CRISPR gRNA sequence
gccagctgcctcatttccat

SEQ ID NO: 195482 - DNA, 20 bp, Artificial
  CRISPR gRNA sequence
cagctgcctcatttccattg

SEQ ID NO: 195483 - DNA, 20 bp, Artificial
  CRISPR gRNA sequence
cctcatttccattggagaca

SEQ ID NO: 195484 - DNA, 20 bp, Artificial
  CRISPR gRNA sequence
ttccattggagacacggcct

SEQ ID NO: 195485 - DNA, 20 bp, Artificial
  CRISPR gRNA sequence
tggagacacggcctcagtgc

SEQ ID NO: 195486 - DNA, 20 bp, Artificial
  CRISPR gRNA sequence
acacggcctcagtgcaagtg

SEQ ID NO: 195487 - DNA, 20 bp, Artificial
  CRISPR gRNA sequence
gcctcagtgcaagtgaagct

SEQ ID NO: 195488 - DNA, 20 bp, Artificial
  CRISPR gRNA sequence
tcagtgcaagtgaagcttgg

SEQ ID NO: 195489 - DNA, 20 bp, Artificial
  CRISPR gRNA sequence
cttggtggttgccttgttct

SEQ ID NO: 195490 - DNA, 20 bp, Artificial
  CRISPR gRNA sequence
tggttgccttgttctaagtg

SEQ ID NO: 195491 - DNA, 20 bp, Artificial
  CRISPR gRNA sequence
ttgccttgttctaagtgcag

SEQ ID NO: 195492 - DNA, 20 bp, Artificial
  CRISPR gRNA sequence
tgccttgttctaagtgcaga

SEQ ID NO: 195493 - DNA, 20 bp, Artificial
  CRISPR gRNA sequence
tgttctaagtgcagaaggtt

SEQ ID NO: 195494 - DNA, 20 bp, Artificial
  CRISPR gRNA sequence
gtgcagaaggttcagacttt

SEQ ID NO: 195495 - DNA, 20 bp, Artificial
  CRISPR gRNA sequence
gaaggttcagacttttggta

SEQ ID NO: 195496 - DNA, 20 bp, Artificial
  CRISPR gRNA sequence
aaccactgtatgcaaatgac

SEQ ID NO: 195497 - DNA, 20 bp, Artificial
  CRISPR gRNA sequence
actgtatgcaaatgacaaga

SEQ ID NO: 195498 - DNA, 20 bp, Artificial
  CRISPR gRNA sequence
atgcaaatgacaagatggat

SEQ ID NO: 195499 - DNA, 20 bp, Artificial
  CRISPR gRNA sequence
tgcaaatgacaagatggatt

SEQ ID NO: 195500 - DNA, 20 bp, Artificial
  CRISPR gRNA sequence
caaatgacaagatggattgg

SEQ ID NO: 195501 - DNA, 20 bp, Artificial
  CRISPR gRNA sequence
atgacaagatggattgggag

SEQ ID NO: 195502 - DNA, 20 bp, Artificial
  CRISPR gRNA sequence
ttgggagtagaatgccaatt

SEQ ID NO: 195503 - DNA, 20 bp, Artificial
  CRISPR gRNA sequence
aagtaatttacaatacaaaa

SEQ ID NO: 195504 - DNA, 20 bp, Artificial
  CRISPR gRNA sequence
aatggaattgtcaaacaaat

SEQ ID NO: 195505 - DNA, 20 bp, Artificial
  CRISPR gRNA sequence
atggaattgtcaaacaaatc

SEQ ID NO: 195506 - DNA, 20 bp, Artificial
  CRISPR gRNA sequence
acaaatcaggtcctcaaacc

SEQ ID NO: 195507 - DNA, 20 bp, Artificial
  CRISPR gRNA sequence
atcaggtcctcaaacctggt

SEQ ID NO: 195508 - DNA, 20 bp, Artificial
  CRISPR gRNA sequence
gttggtcatttgctttgctc

SEQ ID NO: 195509 - DNA, 20 bp, Artificial
  CRISPR gRNA sequence
ttggtcatttgctttgctcc

SEQ ID NO: 195510 - DNA, 20 bp, Artificial
  CRISPR gRNA sequence
gtcatttgctttgctccagg

SEQ ID NO: 195511 - DNA, 20 bp, Artificial
  CRISPR gRNA sequence
ctccaggaagaactccccct

SEQ ID NO: 195512 - DNA, 20 bp, Artificial
  CRISPR gRNA sequence
ctcccccttggaaaaaccat

SEQ ID NO: 195513 - DNA, 20 bp, Artificial
  CRISPR gRNA sequence
cttggaaaaaccatcagtgc

SEQ ID NO: 195514 - DNA, 20 bp, Artificial
  CRISPR gRNA sequence
ggaaaaaccatcagtgccgg

SEQ ID NO: 195515 - DNA, 20 bp, Artificial
  CRISPR gRNA sequence
tttcctattgtgttgatcca

SEQ ID NO: 195516 - DNA, 20 bp, Artificial
  CRISPR gRNA sequence
tattgtgttgatccatggca

SEQ ID NO: 195517 - DNA, 20 bp, Artificial
  CRISPR gRNA sequence
attgtgttgatccatggcaa

SEQ ID NO: 195518 - DNA, 20 bp, Artificial
  CRISPR gRNA sequence
tgtgttgatccatggcaaag

SEQ ID NO: 195519 - DNA, 20 bp, Artificial
  CRISPR gRNA sequence
atccatggcaaaggagactg

SEQ ID NO: 195520 - DNA, 20 bp, Artificial
  CRISPR gRNA sequence
aaaggagactgcagatacac

SEQ ID NO: 195521 - DNA, 20 bp, Artificial
  CRISPR gRNA sequence
aaggagactgcagatacaca

SEQ ID NO: 195522 - DNA, 20 bp, Artificial
  CRISPR gRNA sequence
aggagactgcagatacacaa

SEQ ID NO: 195523 - DNA, 20 bp, Artificial
  CRISPR gRNA sequence
cagatacacaagggatatta

SEQ ID NO: 195524 - DNA, 20 bp, Artificial
  CRISPR gRNA sequence
gatacacaagggatattatg

SEQ ID NO: 195525 - DNA, 20 bp, Artificial
  CRISPR gRNA sequence
acaagggatattatggagcc

SEQ ID NO: 195526 - DNA, 20 bp, Artificial
  CRISPR gRNA sequence
ataaaacccttccctactac

SEQ ID NO: 195527 - DNA, 20 bp, Artificial
  CRISPR gRNA sequence
taaaacccttccctactaca

SEQ ID NO: 195528 - DNA, 20 bp, Artificial
  CRISPR gRNA sequence
acccttccctactacaagga

SEQ ID NO: 195529 - DNA, 20 bp, Artificial
  CRISPR gRNA sequence
ccttccctacacactcccta

SEQ ID NO: 195530 - DNA, 20 bp, Artificial
  CRISPR gRNA sequence
cttccctacacactccctac

SEQ ID NO: 195531 - DNA, 20 bp, Artificial
  CRISPR gRNA sequence
cacactccctacaggctgat

SEQ ID NO: 195532 - DNA, 20 bp, Artificial
  CRISPR gRNA sequence
cactccctacaggctgatga

SEQ ID NO: 195533 - DNA, 20 bp, Artificial
  CRISPR gRNA sequence
ggctgatgagagaccttttt

SEQ ID NO: 195534 - DNA, 20 bp, Artificial
  CRISPR gRNA sequence
tgatgagagaccttttttgg

SEQ ID NO: 195535 - DNA, 20 bp, Artificial
  CRISPR gRNA sequence
tgagagaccttttttggaag

SEQ ID NO: 195536 - DNA, 20 bp, Artificial
  CRISPR gRNA sequence
gctgccttcttcctgactgc

SEQ ID NO: 195537 - DNA, 20 bp, Artificial
  CRISPR gRNA sequence
ctgccttcttcctgactgcc

SEQ ID NO: 195538 - DNA, 20 bp, Artificial
  CRISPR gRNA sequence
tatactcttcctttccatcc

SEQ ID NO: 195539 - DNA, 20 bp, Artificial
  CRISPR gRNA sequence
cttcctttccatcccagatc

SEQ ID NO: 195540 - DNA, 20 bp, Artificial
  CRISPR gRNA sequence
gatctagcaatgctgttgat

SEQ ID NO: 195541 - DNA, 20 bp, Artificial
  CRISPR gRNA sequence
atctagcaatgctgttgatg

SEQ ID NO: 195542 - DNA, 20 bp, Artificial
  CRISPR gRNA sequence
gcaatgctgttgatgaggct

SEQ ID NO: 195543 - DNA, 20 bp, Artificial
  CRISPR gRNA sequence
tgatgatttctttaatatct

SEQ ID NO: 195544 - DNA, 20 bp, Artificial
  CRISPR gRNA sequence
ttctttaatatcttggaaca

SEQ ID NO: 195545 - DNA, 20 bp, Artificial
  CRISPR gRNA sequence
tttaatatcttggaacacag

SEQ ID NO: 195546 - DNA, 20 bp, Artificial
  CRISPR gRNA sequence
cagtagatgcctgatatttg

SEQ ID NO: 195547 - DNA, 20 bp, Artificial
  CRISPR gRNA sequence
agatgcctgatatttgcgga

SEQ ID NO: 195548 - DNA, 20 bp, Artificial
  CRISPR gRNA sequence
cctgatatttgcggatggac

SEQ ID NO: 195549 - DNA, 20 bp, Artificial
  CRISPR gRNA sequence
tgatatttgcggatggactg

SEQ ID NO: 195550 - DNA, 20 bp, Artificial
  CRISPR gRNA sequence
atggactggagaaaaactga

SEQ ID NO: 195551 - DNA, 20 bp, Artificial
  CRISPR gRNA sequence
agtataaaccacaacatctc

SEQ ID NO: 195552 - DNA, 20 bp, Artificial
  CRISPR gRNA sequence
tataaaccacaacatctcaa

SEQ ID NO: 195553 - DNA, 20 bp, Artificial
  CRISPR gRNA sequence
atctcaagagatgtcatgaa

SEQ ID NO: 195554 - DNA, 20 bp, Artificial
  CRISPR gRNA sequence
ctcaagagatgtcatgaatg

SEQ ID NO: 195555 - DNA, 20 bp, Artificial
  CRISPR gRNA sequence
aagagatgtcatgaatggag

SEQ ID NO: 195556 - DNA, 20 bp, Artificial
  CRISPR gRNA sequence
gtcatgaatggagaagcata

SEQ ID NO: 195557 - DNA, 20 bp, Artificial
  CRISPR gRNA sequence
gaaaattaaatctactttac

SEQ ID NO: 195558 - DNA, 20 bp, Artificial
  CRISPR gRNA sequence
aattaaatctactttacaag

SEQ ID NO: 195559 - DNA, 20 bp, Artificial
  CRISPR gRNA sequence
aagtggtatcttcttgacaa

SEQ ID NO: 195560 - DNA, 20 bp, Artificial
  CRISPR gRNA sequence
tggtatcttcttgacaatag

SEQ ID NO: 195561 - DNA, 20 bp, Artificial
  CRISPR gRNA sequence
tgacaatagtggcattacct

SEQ ID NO: 195562 - DNA, 20 bp, Artificial
  CRISPR gRNA sequence
aatagtggcattacctgagc

SEQ ID NO: 195563 - DNA, 20 bp, Artificial
  CRISPR gRNA sequence
ggcattacctgagccagtat

SEQ ID NO: 195564 - DNA, 20 bp, Artificial
  CRISPR gRNA sequence
gcattacctgagccagtatc

SEQ ID NO: 195565 - DNA, 20 bp, Artificial
  CRISPR gRNA sequence
cattacctgagccagtatca

SEQ ID NO: 195566 - DNA, 20 bp, Artificial
  CRISPR gRNA sequence
cctgagccagtatcagggac

SEQ ID NO: 195567 - DNA, 20 bp, Artificial
  CRISPR gRNA sequence
ccccacatgattttgttttt

SEQ ID NO: 195568 - DNA, 20 bp, Artificial
  CRISPR gRNA sequence
tgattttgtttttgagttta

SEQ ID NO: 195569 - DNA, 20 bp, Artificial
  CRISPR gRNA sequence
gtttttgagtttatagttat

SEQ ID NO: 195570 - DNA, 20 bp, Artificial
  CRISPR gRNA sequence
atcattgattaataattgat

SEQ ID NO: 195571 - DNA, 20 bp, Artificial
  CRISPR gRNA sequence
attaataattgatcagtgat

SEQ ID NO: 195572 - DNA, 20 bp, Artificial
  CRISPR gRNA sequence
actttttctacttgtattgt

SEQ ID NO: 195573 - DNA, 20 bp, Artificial
  CRISPR gRNA sequence
ctacttgtattgttagccct

SEQ ID NO: 195574 - DNA, 20 bp, Artificial
  CRISPR gRNA sequence
attgttagccctcagattga

SEQ ID NO: 195575 - DNA, 20 bp, Artificial
  CRISPR gRNA sequence
gttagccctcagattgatgg

SEQ ID NO: 195576 - DNA, 20 bp, Artificial
  CRISPR gRNA sequence
gccctcagattgatggtagt

SEQ ID NO: 195577 - DNA, 20 bp, Artificial
  CRISPR gRNA sequence
cagattgatggtagttagcc

SEQ ID NO: 195578 - DNA, 20 bp, Artificial
  CRISPR gRNA sequence
agattgatggtagttagccc

SEQ ID NO: 195579 - DNA, 20 bp, Artificial
  CRISPR gRNA sequence
gatggtagttagcccaggaa

SEQ ID NO: 195580 - DNA, 20 bp, Artificial
  CRISPR gRNA sequence
gtagttagcccaggaatgga

SEQ ID NO: 195581 - DNA, 20 bp, Artificial
  CRISPR gRNA sequence
agcccaggaatggaaagacc

SEQ ID NO: 195582 - DNA, 20 bp, Artificial
  CRISPR gRNA sequence
gcccaggaatggaaagacca

SEQ ID NO: 195583 - DNA, 20 bp, Artificial
  CRISPR gRNA sequence
cccaggaatggaaagaccaa

SEQ ID NO: 195584 - DNA, 20 bp, Artificial
  CRISPR gRNA sequence
ccaggaatggaaagaccaag

SEQ ID NO: 195585 - DNA, 20 bp, Artificial
  CRISPR gRNA sequence
aggaatggaaagaccaaggg

SEQ ID NO: 195586 - DNA, 20 bp, Artificial
  CRISPR gRNA sequence
aaggggagatgatttaattc

SEQ ID NO: 195587 - DNA, 20 bp, Artificial
  CRISPR gRNA sequence
taattctagtcaaatattaa

SEQ ID NO: 195588 - DNA, 20 bp, Artificial
  CRISPR gRNA sequence
aattctagtcaaatattaaa

SEQ ID NO: 195589 - DNA, 20 bp, Artificial
  CRISPR gRNA sequence
catgtaaatgaaataatccc

SEQ ID NO: 195590 - DNA, 20 bp, Artificial
  CRISPR gRNA sequence
aataatcccaagactacaac

SEQ ID NO: 195591 - DNA, 20 bp, Artificial
  CRISPR gRNA sequence
taatcccaagactacaacta

SEQ ID NO: 195592 - DNA, 20 bp, Artificial
  CRISPR gRNA sequence
aatcccaagactacaactag

SEQ ID NO: 195593 - DNA, 20 bp, Artificial
  CRISPR gRNA sequence
atcccaagactacaactaga

SEQ ID NO: 195594 - DNA, 20 bp, Artificial
  CRISPR gRNA sequence
tcccaagactacaactagag

SEQ ID NO: 195595 - DNA, 20 bp, Artificial
  CRISPR gRNA sequence
caagactacaactagagggg

SEQ ID NO: 195596 - DNA, 20 bp, Artificial
  CRISPR gRNA sequence
acaactagaggggcagattt

SEQ ID NO: 195597 - DNA, 20 bp, Artificial
  CRISPR gRNA sequence
ggcagatttcagcttactat

SEQ ID NO: 195598 - DNA, 20 bp, Artificial
  CRISPR gRNA sequence
gcagatttcagcttactatt

SEQ ID NO: 195599 - DNA, 20 bp, Artificial
  CRISPR gRNA sequence
cagatttcagcttactatta

SEQ ID NO: 195600 - DNA, 20 bp, Artificial
  CRISPR gRNA sequence
gatttcagcttactattagg

SEQ ID NO: 195601 - DNA, 20 bp, Artificial
  CRISPR gRNA sequence
ctattagggagtaatttcaa

SEQ ID NO: 195602 - DNA, 20 bp, Artificial
  CRISPR gRNA sequence
tattagggagtaatttcaac

SEQ ID NO: 195603 - DNA, 20 bp, Artificial
  CRISPR gRNA sequence
ggagtaatttcaacaggata

SEQ ID NO: 195604 - DNA, 20 bp, Artificial
  CRISPR gRNA sequence
gtaatttcaacaggatatgg

SEQ ID NO: 195605 - DNA, 20 bp, Artificial
  CRISPR gRNA sequence
taatttcaacaggatatgga

SEQ ID NO: 195606 - DNA, 20 bp, Artificial
  CRISPR gRNA sequence
aatttcaacaggatatggaa

SEQ ID NO: 195607 - DNA, 20 bp, Artificial
  CRISPR gRNA sequence
atatggaagggatatccaaa

SEQ ID NO: 195608 - DNA, 20 bp, Artificial
  CRISPR gRNA sequence
tggaagggatatccaaatgg

SEQ ID NO: 195609 - DNA, 20 bp, Artificial
  CRISPR gRNA sequence
ggaagggatatccaaatggc

SEQ ID NO: 195610 - DNA, 20 bp, Artificial
  CRISPR gRNA sequence
gaagggatatccaaatggca

SEQ ID NO: 195611 - DNA, 20 bp, Artificial
  CRISPR gRNA sequence
agggatatccaaatggcagg

SEQ ID NO: 195612 - DNA, 20 bp, Artificial
  CRISPR gRNA sequence
gggatatccaaatggcaggg

SEQ ID NO: 195613 - DNA, 20 bp, Artificial
  CRISPR gRNA sequence
aaatggcagggaggccattg

SEQ ID NO: 195614 - DNA, 20 bp, Artificial
  CRISPR gRNA sequence
aatggcagggaggccattgt

SEQ ID NO: 195615 - DNA, 20 bp, Artificial
  CRISPR gRNA sequence
gaggccattgtgggatatga

SEQ ID NO: 195616 - DNA, 20 bp, Artificial
  CRISPR gRNA sequence
aggccattgtgggatatgac

SEQ ID NO: 195617 - DNA, 20 bp, Artificial
  CRISPR gRNA sequence
ggccattgtgggatatgaca

SEQ ID NO: 195618 - DNA, 20 bp, Artificial
  CRISPR gRNA sequence
atatgacagggacgccattg

SEQ ID NO: 195619 - DNA, 20 bp, Artificial
  CRISPR gRNA sequence
tatgacagggacgccattgc

SEQ ID NO: 195620 - DNA, 20 bp, Artificial
  CRISPR gRNA sequence
gacgccattgcaggaaatat

SEQ ID NO: 195621 - DNA, 20 bp, Artificial
  CRISPR gRNA sequence
cattgcaggaaatataagaa

SEQ ID NO: 195622 - DNA, 20 bp, Artificial
  CRISPR gRNA sequence
tgcaggaaatataagaacag

SEQ ID NO: 195623 - DNA, 20 bp, Artificial
  CRISPR gRNA sequence
tataagaacagaagatcctc

SEQ ID NO: 195624 - DNA, 20 bp, Artificial
  CRISPR gRNA sequence
ataagaacagaagatcctct

SEQ ID NO: 195625 - DNA, 20 bp, Artificial
  CRISPR gRNA sequence
taagaacagaagatcctctg

SEQ ID NO: 195626 - DNA, 20 bp, Artificial
  CRISPR gRNA sequence
aagaacagaagatcctctgg

SEQ ID NO: 195627 - DNA, 20 bp, Artificial
  CRISPR gRNA sequence
tgggggatttttgttctttg

SEQ ID NO: 195628 - DNA, 20 bp, Artificial
  CRISPR gRNA sequence
gggggatttttgttctttgt

SEQ ID NO: 195629 - DNA, 20 bp, Artificial
  CRISPR gRNA sequence
gggatttttgttctttgtgg

SEQ ID NO: 195630 - DNA, 20 bp, Artificial
  CRISPR gRNA sequence
ttttgttctttgtgggagtt

SEQ ID NO: 195631 - DNA, 20 bp, Artificial
  CRISPR gRNA sequence
ttctttgtgggagtttggat

SEQ ID NO: 195632 - DNA, 20 bp, Artificial
  CRISPR gRNA sequence
ttggattagctgctcctgcc

SEQ ID NO: 195633 - DNA, 20 bp, Artificial
  CRISPR gRNA sequence
tggattagctgctcctgcct

SEQ ID NO: 195634 - DNA, 20 bp, Artificial
  CRISPR gRNA sequence
gctcctgcctgggatccttt

SEQ ID NO: 195635 - DNA, 20 bp, Artificial
  CRISPR gRNA sequence
tctgtgaaactcaacaatga

SEQ ID NO: 195636 - DNA, 20 bp, Artificial
  CRISPR gRNA sequence
gtgaaactcaacaatgaaag

SEQ ID NO: 195637 - DNA, 20 bp, Artificial
  CRISPR gRNA sequence
gaaactcaacaatgaaagca

SEQ ID NO: 195638 - DNA, 20 bp, Artificial
  CRISPR gRNA sequence
aaactcaacaatgaaagcag

SEQ ID NO: 195639 - DNA, 20 bp, Artificial
  CRISPR gRNA sequence
cagaggtgttttcctttact

SEQ ID NO: 195640 - DNA, 20 bp, Artificial
  CRISPR gRNA sequence
ggtgttttcctttacttagc

SEQ ID NO: 195641 - DNA, 20 bp, Artificial
  CRISPR gRNA sequence
caacacaaaactttgaactc

SEQ ID NO: 195642 - DNA, 20 bp, Artificial
  CRISPR gRNA sequence
gtgacctgataacataactg

SEQ ID NO: 195643 - DNA, 20 bp, Artificial
  CRISPR gRNA sequence
tgacctgataacataactgt

SEQ ID NO: 195644 - DNA, 20 bp, Artificial
  CRISPR gRNA sequence
cataactgtgggtcaatacc

SEQ ID NO: 195645 - DNA, 20 bp, Artificial
  CRISPR gRNA sequence
ataactgtgggtcaataccg

SEQ ID NO: 195646 - DNA, 20 bp, Artificial
  CRISPR gRNA sequence
taccgaggaactaacactcc

SEQ ID NO: 195647 - DNA, 20 bp, Artificial
  CRISPR gRNA sequence
tagttccttttcaattcccc

SEQ ID NO: 195648 - DNA, 20 bp, Artificial
  CRISPR gRNA sequence
tcaattccccaagacaacat

SEQ ID NO: 195649 - DNA, 20 bp, Artificial
  CRISPR gRNA sequence
tccccaagacaacatcagta

SEQ ID NO: 195650 - DNA, 20 bp, Artificial
  CRISPR gRNA sequence
caacatcagtatagattttc

SEQ ID NO: 195651 - DNA, 20 bp, Artificial
  CRISPR gRNA sequence
tttcaagatgaatatatgcc

SEQ ID NO: 195652 - DNA, 20 bp, Artificial
  CRISPR gRNA sequence
aagatgaatatatgcccagt

SEQ ID NO: 195653 - DNA, 20 bp, Artificial
  CRISPR gRNA sequence
gaatatatgcccagtaagta

SEQ ID NO: 195654 - DNA, 20 bp, Artificial
  CRISPR gRNA sequence
aagtatggcttatcctgtac

SEQ ID NO: 195655 - DNA, 20 bp, Artificial
  CRISPR gRNA sequence
tatggcttatcctgtactgg

SEQ ID NO: 195656 - DNA, 20 bp, Artificial
  CRISPR gRNA sequence
cttatcctgtactggaagaa

SEQ ID NO: 195657 - DNA, 20 bp, Artificial
  CRISPR gRNA sequence
ttatcctgtactggaagaat

SEQ ID NO: 195658 - DNA, 20 bp, Artificial
  CRISPR gRNA sequence
gtgattattttttgtcttca

SEQ ID NO: 195659 - DNA, 20 bp, Artificial
  CRISPR gRNA sequence
tgattattttttgtcttcat

SEQ ID NO: 195660 - DNA, 20 bp, Artificial
  CRISPR gRNA sequence
gattattttttgtcttcata

SEQ ID NO: 195661 - DNA, 20 bp, Artificial
  CRISPR gRNA sequence
tgtcttcatagggtgacttc

SEQ ID NO: 195662 - DNA, 20 bp, Artificial
  CRISPR gRNA sequence
cttttttaatgtgaacctta

SEQ ID NO: 195663 - DNA, 20 bp, Artificial
  CRISPR gRNA sequence
ttttaatgtgaaccttacag

SEQ ID NO: 195664 - DNA, 20 bp, Artificial
  CRISPR gRNA sequence
tttaatgtgaaccttacagt

SEQ ID NO: 195665 - DNA, 20 bp, Artificial
  CRISPR gRNA sequence
ttaatgtgaaccttacagtg

SEQ ID NO: 195666 - DNA, 20 bp, Artificial
  CRISPR gRNA sequence
atatttatttgcatttgata

SEQ ID NO: 195667 - DNA, 20 bp, Artificial
  CRISPR gRNA sequence
atttatttgcatttgatata

SEQ ID NO: 195668 - DNA, 20 bp, Artificial
  CRISPR gRNA sequence
ttatttgcatttgatataga

SEQ ID NO: 195669 - DNA, 20 bp, Artificial
  CRISPR gRNA sequence
tatttgcatttgatatagag

SEQ ID NO: 195670 - DNA, 20 bp, Artificial
  CRISPR gRNA sequence
tgatatagagaggctcaaaa

SEQ ID NO: 195671 - DNA, 20 bp, Artificial
  CRISPR gRNA sequence
gatatagagaggctcaaaaa

SEQ ID NO: 195672 - DNA, 20 bp, Artificial
  CRISPR gRNA sequence
gctcaaaaaaggaaaactga

SEQ ID NO: 195673 - DNA, 20 bp, Artificial
  CRISPR gRNA sequence
gacctaataaaataaaaaaa

SEQ ID NO: 195674 - DNA, 20 bp, Artificial
  CRISPR gRNA sequence
ctaataaaataaaaaaatag

SEQ ID NO: 195675 - DNA, 20 bp, Artificial
  CRISPR gRNA sequence
tagttgaataaaaaaatttc

SEQ ID NO: 195676 - DNA, 20 bp, Artificial
  CRISPR gRNA sequence
gttgaataaaaaaatttctg

SEQ ID NO: 195677 - DNA, 20 bp, Artificial
  CRISPR gRNA sequence
ttgaataaaaaaatttctgg

SEQ ID NO: 195678 - DNA, 20 bp, Artificial
  CRISPR gRNA sequence
tgaataaaaaaatttctgga

SEQ ID NO: 195679 - DNA, 20 bp, Artificial
  CRISPR gRNA sequence
ctggagggacacacaaataa

SEQ ID NO: 195680 - DNA, 20 bp, Artificial
  CRISPR gRNA sequence
gttactctctctgcatgcca

SEQ ID NO: 195681 - DNA, 20 bp, Artificial
  CRISPR gRNA sequence
ttactctctctgcatgccat

SEQ ID NO: 195682 - DNA, 20 bp, Artificial
  CRISPR gRNA sequence
actctctctgcatgccatgg

SEQ ID NO: 195683 - DNA, 20 bp, Artificial
  CRISPR gRNA sequence
tctctgcatgccatgggaga

SEQ ID NO: 195684 - DNA, 20 bp, Artificial
  CRISPR gRNA sequence
ctgcatgccatgggagatag

SEQ ID NO: 195685 - DNA, 20 bp, Artificial
  CRISPR gRNA sequence
tgccatgggagatagtggtg

SEQ ID NO: 195686 - DNA, 20 bp, Artificial
  CRISPR gRNA sequence
gccatgggagatagtggtga

SEQ ID NO: 195687 - DNA, 20 bp, Artificial
  CRISPR gRNA sequence
ccatgggagatagtggtgaa

SEQ ID NO: 195688 - DNA, 20 bp, Artificial
  CRISPR gRNA sequence
atgggagatagtggtgaagg

SEQ ID NO: 195689 - DNA, 20 bp, Artificial
  CRISPR gRNA sequence
tgggagatagtggtgaaggg

SEQ ID NO: 195690 - DNA, 20 bp, Artificial
  CRISPR gRNA sequence
ggagatagtggtgaagggag

SEQ ID NO: 195691 - DNA, 20 bp, Artificial
  CRISPR gRNA sequence
gagatagtggtgaagggagg

SEQ ID NO: 195692 - DNA, 20 bp, Artificial
  CRISPR gRNA sequence
agatagtggtgaagggagga

SEQ ID NO: 195693 - DNA, 20 bp, Artificial
  CRISPR gRNA sequence
aattcatttgatctcttcca

SEQ ID NO: 195694 - DNA, 20 bp, Artificial
  CRISPR gRNA sequence
acagtatctgaattatttgc

SEQ ID NO: 195695 - DNA, 20 bp, Artificial
  CRISPR gRNA sequence
gtattccatttgtaataaaa

SEQ ID NO: 195696 - DNA, 20 bp, Artificial
  CRISPR gRNA sequence
ccatttgtaataaaaaagta

SEQ ID NO: 195697 - DNA, 20 bp, Artificial
  CRISPR gRNA sequence
tgtaataaaaaagtaaagac

SEQ ID NO: 195698 - DNA, 20 bp, Artificial
  CRISPR gRNA sequence
taaagactagaaattctttt

SEQ ID NO: 195699 - DNA, 20 bp, Artificial
  CRISPR gRNA sequence
ttggaaaactgtacatactg

SEQ ID NO: 195700 - DNA, 20 bp, Artificial
  CRISPR gRNA sequence
actgtacatactgtagaaca

SEQ ID NO: 195701 - DNA, 20 bp, Artificial
  CRISPR gRNA sequence
ggctctgtgttgtttgtctc

SEQ ID NO: 195702 - DNA, 20 bp, Artificial
  CRISPR gRNA sequence
gttgtttgtctctggatttc

SEQ ID NO: 195703 - DNA, 20 bp, Artificial
  CRISPR gRNA sequence
gatttccagtgactatcaaa

SEQ ID NO: 195704 - DNA, 20 bp, Artificial
  CRISPR gRNA sequence
atttccagtgactatcaaat

SEQ ID NO: 195705 - DNA, 20 bp, Artificial
  CRISPR gRNA sequence
tgactatcaaataggtgctc

SEQ ID NO: 195706 - DNA, 20 bp, Artificial
  CRISPR gRNA sequence
caaataggtgctcaagaaat

SEQ ID NO: 195707 - DNA, 20 bp, Artificial
  CRISPR gRNA sequence
gaattgaatgaatgaatgaa

SEQ ID NO: 195708 - DNA, 20 bp, Artificial
  CRISPR gRNA sequence
atgctgttctgtttgaaaat

SEQ ID NO: 195709 - DNA, 20 bp, Artificial
  CRISPR gRNA sequence
gttctgtttgaaaataagta

SEQ ID NO: 195710 - DNA, 20 bp, Artificial
  CRISPR gRNA sequence
gaaaataagtatggacttac

SEQ ID NO: 195711 - DNA, 20 bp, Artificial
  CRISPR gRNA sequence
tatggacttacaagaatgaa

SEQ ID NO: 195712 - DNA, 20 bp, Artificial
  CRISPR gRNA sequence
aatgaaaagtcttcaacact

SEQ ID NO: 195713 - DNA, 20 bp, Artificial
  CRISPR gRNA sequence
cttggaatatgttttcaata

SEQ ID NO: 195714 - DNA, 20 bp, Artificial
  CRISPR gRNA sequence
aatatgttttcaataaagat

SEQ ID NO: 195715 - DNA, 20 bp, Artificial
  CRISPR gRNA sequence
atatgttttcaataaagatc

SEQ ID NO: 195716 - DNA, 20 bp, Artificial
  CRISPR gRNA sequence
attcttaccattgactttca

SEQ ID NO: 195717 - DNA, 20 bp, Artificial
  CRISPR gRNA sequence
ctttcacagtaattcgcttg

SEQ ID NO: 195718 - DNA, 20 bp, Artificial
  CRISPR gRNA sequence
cacagtaattcgcttgtagt

SEQ ID NO: 195719 - DNA, 20 bp, Artificial
  CRISPR gRNA sequence
gcttgtagtcggcaccacca

SEQ ID NO: 195720 - DNA, 20 bp, Artificial
  CRISPR gRNA sequence
caccaccatagctgatcatg

SEQ ID NO: 195721 - DNA, 20 bp, Artificial
  CRISPR gRNA sequence
caccatagctgatcatgcag

SEQ ID NO: 195722 - DNA, 20 bp, Artificial
  CRISPR gRNA sequence
aatttcacatctgtgatctg

SEQ ID NO: 195723 - DNA, 20 bp, Artificial
  CRISPR gRNA sequence
cacatctgtgatctgaagtg

SEQ ID NO: 195724 - DNA, 20 bp, Artificial
  CRISPR gRNA sequence
atctgaagtgcagcatttcc

SEQ ID NO: 195725 - DNA, 20 bp, Artificial
  CRISPR gRNA sequence
tctgaagtgcagcatttccc

SEQ ID NO: 195726 - DNA, 20 bp, Artificial
  CRISPR gRNA sequence
ctgaagtgcagcatttccca

SEQ ID NO: 195727 - DNA, 20 bp, Artificial
  CRISPR gRNA sequence
gaagtgcagcatttcccagg

SEQ ID NO: 195728 - DNA, 20 bp, Artificial
  CRISPR gRNA sequence
agtgcagcatttcccaggga

SEQ ID NO: 195729 - DNA, 20 bp, Artificial
  CRISPR gRNA sequence
cagcatttcccagggagagc

SEQ ID NO: 195730 - DNA, 20 bp, Artificial
  CRISPR gRNA sequence
agggagagctggtccttcaa

SEQ ID NO: 195731 - DNA, 20 bp, Artificial
  CRISPR gRNA sequence
agagctggtccttcaacagc

SEQ ID NO: 195732 - DNA, 20 bp, Artificial
  CRISPR gRNA sequence
gagctggtccttcaacagcc

SEQ ID NO: 195733 - DNA, 20 bp, Artificial
  CRISPR gRNA sequence
acagccgggccctctgtctg

SEQ ID NO: 195734 - DNA, 20 bp, Artificial
  CRISPR gRNA sequence
tagctactatgctgaacctt

SEQ ID NO: 195735 - DNA, 20 bp, Artificial
  CRISPR gRNA sequence
agctactatgctgaaccttc

SEQ ID NO: 195736 - DNA, 20 bp, Artificial
  CRISPR gRNA sequence
tcttatcctccatttcccaa

SEQ ID NO: 195737 - DNA, 20 bp, Artificial
  CRISPR gRNA sequence
tccatttcccaatagacaat

SEQ ID NO: 195738 - DNA, 20 bp, Artificial
  CRISPR gRNA sequence
ttcccaatagacaattagtg

SEQ ID NO: 195739 - DNA, 20 bp, Artificial
  CRISPR gRNA sequence
caatagacaattagtgcagc

SEQ ID NO: 195740 - DNA, 20 bp, Artificial
  CRISPR gRNA sequence
aatagacaattagtgcagcc

SEQ ID NO: 195741 - DNA, 20 bp, Artificial
  CRISPR gRNA sequence
aggtctaattgtttttctac

SEQ ID NO: 195742 - DNA, 20 bp, Artificial
  CRISPR gRNA sequence
ggtctaattgtttttctact

SEQ ID NO: 195743 - DNA, 20 bp, Artificial
  CRISPR gRNA sequence
ctaccatactctaccacata

SEQ ID NO: 195744 - DNA, 20 bp, Artificial
  CRISPR gRNA sequence
taccatactctaccacatat

SEQ ID NO: 195745 - DNA, 20 bp, Artificial
  CRISPR gRNA sequence
ctctaccacatataggtcct

SEQ ID NO: 195746 - DNA, 20 bp, Artificial
  CRISPR gRNA sequence
tctaccacatataggtcctt

SEQ ID NO: 195747 - DNA, 20 bp, Artificial
  CRISPR gRNA sequence
taggtccttgggaaccgtga

SEQ ID NO: 195748 - DNA, 20 bp, Artificial
  CRISPR gRNA sequence
ccgtgacagtaaatgctaaa

SEQ ID NO: 195749 - DNA, 20 bp, Artificial
  CRISPR gRNA sequence
gacagtaaatgctaaaaaga

SEQ ID NO: 195750 - DNA, 20 bp, Artificial
  CRISPR gRNA sequence
agtaaatgctaaaaagaaag

SEQ ID NO: 195751 - DNA, 20 bp, Artificial
  CRISPR gRNA sequence
gtaaatgctaaaaagaaaga

SEQ ID NO: 195752 - DNA, 20 bp, Artificial
  CRISPR gRNA sequence
aaagaaagaaggacaatctt

SEQ ID NO: 195753 - DNA, 20 bp, Artificial
  CRISPR gRNA sequence
aagaaggacaatcttcagaa

SEQ ID NO: 195754 - DNA, 20 bp, Artificial
  CRISPR gRNA sequence
agaaggacaatcttcagaaa

SEQ ID NO: 195755 - DNA, 20 bp, Artificial
  CRISPR gRNA sequence
gaaggacaatcttcagaaaa

SEQ ID NO: 195756 - DNA, 20 bp, Artificial
  CRISPR gRNA sequence
cctcgaaacatttacaaaat

SEQ ID NO: 195757 - DNA, 20 bp, Artificial
  CRISPR gRNA sequence
aaacatttacaaaattggca

SEQ ID NO: 195758 - DNA, 20 bp, Artificial
  CRISPR gRNA sequence
cgtttataaatcactttatc

SEQ ID NO: 195759 - DNA, 20 bp, Artificial
  CRISPR gRNA sequence
tataaatcactttatctggt

SEQ ID NO: 195760 - DNA, 20 bp, Artificial
  CRISPR gRNA sequence
gttatgttatcattatattt

SEQ ID NO: 195761 - DNA, 20 bp, Artificial
  CRISPR gRNA sequence
taaacacatattttatccaa

SEQ ID NO: 195762 - DNA, 20 bp, Artificial
  CRISPR gRNA sequence
aaacacatattttatccaat

SEQ ID NO: 195763 - DNA, 20 bp, Artificial
  CRISPR gRNA sequence
aatgggcttgaaatatgttt

SEQ ID NO: 195764 - DNA, 20 bp, Artificial
  CRISPR gRNA sequence
atgggcttgaaatatgtttt

SEQ ID NO: 195765 - DNA, 20 bp, Artificial
  CRISPR gRNA sequence
gggacactatatctcatgct

SEQ ID NO: 195766 - DNA, 20 bp, Artificial
  CRISPR gRNA sequence
ctatatctcatgctgagaca

SEQ ID NO: 195767 - DNA, 20 bp, Artificial
  CRISPR gRNA sequence
gctgagacacagtgtcccaa

SEQ ID NO: 195768 - DNA, 20 bp, Artificial
  CRISPR gRNA sequence
gagacacagtgtcccaatag

SEQ ID NO: 195769 - DNA, 20 bp, Artificial
  CRISPR gRNA sequence
caatagcagaataataaaat

SEQ ID NO: 195770 - DNA, 20 bp, Artificial
  CRISPR gRNA sequence
aataataaaattagctaaac

SEQ ID NO: 195771 - DNA, 20 bp, Artificial
  CRISPR gRNA sequence
attactgtataaatattata

SEQ ID NO: 195772 - DNA, 20 bp, Artificial
  CRISPR gRNA sequence
tactgtataaatattatatg

SEQ ID NO: 195773 - DNA, 20 bp, Artificial
  CRISPR gRNA sequence
gtataaatattatatggaga

SEQ ID NO: 195774 - DNA, 20 bp, Artificial
  CRISPR gRNA sequence
ataaatattatatggagatg

SEQ ID NO: 195775 - DNA, 20 bp, Artificial
  CRISPR gRNA sequence
ggagatggagtccttacaac

SEQ ID NO: 195776 - DNA, 20 bp, Artificial
  CRISPR gRNA sequence
gagatggagtccttacaacc

SEQ ID NO: 195777 - DNA, 20 bp, Artificial
  CRISPR gRNA sequence
agatggagtccttacaacca

SEQ ID NO: 195778 - DNA, 20 bp, Artificial
  CRISPR gRNA sequence
atggagtccttacaaccagg

SEQ ID NO: 195779 - DNA, 20 bp, Artificial
  CRISPR gRNA sequence
tccttacaaccagggagact

SEQ ID NO: 195780 - DNA, 20 bp, Artificial
  CRISPR gRNA sequence
cagggagacttggtttcatg

SEQ ID NO: 195781 - DNA, 20 bp, Artificial
  CRISPR gRNA sequence
tggtttcatgtagacatccc

SEQ ID NO: 195782 - DNA, 20 bp, Artificial
  CRISPR gRNA sequence
atccccagaatgtcctttga

SEQ ID NO: 195783 - DNA, 20 bp, Artificial
  CRISPR gRNA sequence
tccccagaatgtcctttgac

SEQ ID NO: 195784 - DNA, 20 bp, Artificial
  CRISPR gRNA sequence
acacctatttgcttcctaca

SEQ ID NO: 195785 - DNA, 20 bp, Artificial
  CRISPR gRNA sequence
acctatttgcttcctacata

SEQ ID NO: 195786 - DNA, 20 bp, Artificial
  CRISPR gRNA sequence
cctatttgcttcctacatag

SEQ ID NO: 195787 - DNA, 20 bp, Artificial
  CRISPR gRNA sequence
ctatttgcttcctacataga

SEQ ID NO: 195788 - DNA, 20 bp, Artificial
  CRISPR gRNA sequence
tgcttcctacatagagggaa

SEQ ID NO: 195789 - DNA, 20 bp, Artificial
  CRISPR gRNA sequence
ttcctacatagagggaatgg

SEQ ID NO: 195790 - DNA, 20 bp, Artificial
  CRISPR gRNA sequence
gagggaatggtagattctaa

SEQ ID NO: 195791 - DNA, 20 bp, Artificial
  CRISPR gRNA sequence
tacttccctaaacttttgat

SEQ ID NO: 195792 - DNA, 20 bp, Artificial
  CRISPR gRNA sequence
taaacttttgatcagttttc

SEQ ID NO: 195793 - DNA, 20 bp, Artificial
  CRISPR gRNA sequence
cttttgatcagttttctggc

SEQ ID NO: 195794 - DNA, 20 bp, Artificial
  CRISPR gRNA sequence
ttgatcagttttctggcaag

SEQ ID NO: 195795 - DNA, 20 bp, Artificial
  CRISPR gRNA sequence
ttttctggcaagaagtacat

SEQ ID NO: 195796 - DNA, 20 bp, Artificial
  CRISPR gRNA sequence
tggcaagaagtacattggta

SEQ ID NO: 195797 - DNA, 20 bp, Artificial
  CRISPR gRNA sequence
gcaagaagtacattggtatg

SEQ ID NO: 195798 - DNA, 20 bp, Artificial
  CRISPR gRNA sequence
aagtacattggtatggagtt

SEQ ID NO: 195799 - DNA, 20 bp, Artificial
  CRISPR gRNA sequence
agtacattggtatggagttc

SEQ ID NO: 195800 - DNA, 20 bp, Artificial
  CRISPR gRNA sequence
cattggtatggagttcagga

SEQ ID NO: 195801 - DNA, 20 bp, Artificial
  CRISPR gRNA sequence
ttggtatggagttcaggaaa

SEQ ID NO: 195802 - DNA, 20 bp, Artificial
  CRISPR gRNA sequence
atggagttcaggaaagagca

SEQ ID NO: 195803 - DNA, 20 bp, Artificial
  CRISPR gRNA sequence
tggagttcaggaaagagcac

SEQ ID NO: 195804 - DNA, 20 bp, Artificial
  CRISPR gRNA sequence
ggagttcaggaaagagcaca

SEQ ID NO: 195805 - DNA, 20 bp, Artificial
  CRISPR gRNA sequence
gaaagagcacagggtgatgc

SEQ ID NO: 195806 - DNA, 20 bp, Artificial
  CRISPR gRNA sequence
gggtgatgccagtactgtgt

SEQ ID NO: 195807 - DNA, 20 bp, Artificial
  CRISPR gRNA sequence
tatcttacaattcttcctta

SEQ ID NO: 195808 - DNA, 20 bp, Artificial
  CRISPR gRNA sequence
cttccttaaagtatcctcat

SEQ ID NO: 195809 - DNA, 20 bp, Artificial
  CRISPR gRNA sequence
ttccttaaagtatcctcatc

SEQ ID NO: 195810 - DNA, 20 bp, Artificial
  CRISPR gRNA sequence
ttaaagtatcctcatcagga

SEQ ID NO: 195811 - DNA, 20 bp, Artificial
  CRISPR gRNA sequence
taaagtatcctcatcaggaa

SEQ ID NO: 195812 - DNA, 20 bp, Artificial
  CRISPR gRNA sequence
tcatcaggaaaggcatgtca

SEQ ID NO: 195813 - DNA, 20 bp, Artificial
  CRISPR gRNA sequence
atcaggaaaggcatgtcaca

SEQ ID NO: 195814 - DNA, 20 bp, Artificial
  CRISPR gRNA sequence
aggcatgtcacagagcaacc

SEQ ID NO: 195815 - DNA, 20 bp, Artificial
  CRISPR gRNA sequence
cacagagcaaccaagactga

SEQ ID NO: 195816 - DNA, 20 bp, Artificial
  CRISPR gRNA sequence
caaccaagactgaaagatca

SEQ ID NO: 195817 - DNA, 20 bp, Artificial
  CRISPR gRNA sequence
aaccaagactgaaagatcaa

SEQ ID NO: 195818 - DNA, 20 bp, Artificial
  CRISPR gRNA sequence
actgaaagatcaaaggatct

SEQ ID NO: 195819 - DNA, 20 bp, Artificial
  CRISPR gRNA sequence
aaggatcttggccttgttga

SEQ ID NO: 195820 - DNA, 20 bp, Artificial
  CRISPR gRNA sequence
aacaaataaatgtatacata

SEQ ID NO: 195821 - DNA, 20 bp, Artificial
  CRISPR gRNA sequence
acaaataaatgtatacatac

SEQ ID NO: 195822 - DNA, 20 bp, Artificial
  CRISPR gRNA sequence
atacatacaggccatttccc

SEQ ID NO: 195823 - DNA, 20 bp, Artificial
  CRISPR gRNA sequence
gccatttccccagatatttt

SEQ ID NO: 195824 - DNA, 20 bp, Artificial
  CRISPR gRNA sequence
atttccccagatattttcag

SEQ ID NO: 195825 - DNA, 20 bp, Artificial
  CRISPR gRNA sequence
atattttcagtagttaaccc

SEQ ID NO: 195826 - DNA, 20 bp, Artificial
  CRISPR gRNA sequence
tattttcagtagttaaccct

SEQ ID NO: 195827 - DNA, 20 bp, Artificial
  CRISPR gRNA sequence
cagtagttaaccctgggaaa

SEQ ID NO: 195828 - DNA, 20 bp, Artificial
  CRISPR gRNA sequence
agtagttaaccctgggaaat

SEQ ID NO: 195829 - DNA, 20 bp, Artificial
  CRISPR gRNA sequence
taaccctgggaaatgggtaa

SEQ ID NO: 195830 - DNA, 20 bp, Artificial
  CRISPR gRNA sequence
tatatttttacaaaatgaca

SEQ ID NO: 195831 - DNA, 20 bp, Artificial
  CRISPR gRNA sequence
atatttttacaaaatgacac

SEQ ID NO: 195832 - DNA, 20 bp, Artificial
  CRISPR gRNA sequence
ggtaactttatcattgcgta

SEQ ID NO: 195833 - DNA, 20 bp, Artificial
  CRISPR gRNA sequence
aactttatcattgcgtaaag

SEQ ID NO: 195834 - DNA, 20 bp, Artificial
  CRISPR gRNA sequence
ttatcattgcgtaaagtaga

SEQ ID NO: 195835 - DNA, 20 bp, Artificial
  CRISPR gRNA sequence
tcattgcgtaaagtagaaag

SEQ ID NO: 195836 - DNA, 20 bp, Artificial
  CRISPR gRNA sequence
gaagactttgccattgtgta

SEQ ID NO: 195837 - DNA, 20 bp, Artificial
  CRISPR gRNA sequence
gactttgccattgtgtaaag

SEQ ID NO: 195838 - DNA, 20 bp, Artificial
  CRISPR gRNA sequence
tttgccattgtgtaaagtag

SEQ ID NO: 195839 - DNA, 20 bp, Artificial
  CRISPR gRNA sequence
ccattgtgtaaagtagaaga

SEQ ID NO: 195840 - DNA, 20 bp, Artificial
  CRISPR gRNA sequence
gtgtaaagtagaagaaagaa

SEQ ID NO: 195841 - DNA, 20 bp, Artificial
  CRISPR gRNA sequence
gaatagaatgttctctctat

SEQ ID NO: 195842 - DNA, 20 bp, Artificial
  CRISPR gRNA sequence
tgcattttaaatgatcattt

SEQ ID NO: 195843 - DNA, 20 bp, Artificial
  CRISPR gRNA sequence
tcattttagttttaaactca

SEQ ID NO: 195844 - DNA, 20 bp, Artificial
  CRISPR gRNA sequence
tggttaaaatatttaaaata

SEQ ID NO: 195845 - DNA, 20 bp, Artificial
  CRISPR gRNA sequence
atttaaaatatagaacctaa

SEQ ID NO: 195846 - DNA, 20 bp, Artificial
  CRISPR gRNA sequence
taaaatatagaacctaatgg

SEQ ID NO: 195847 - DNA, 20 bp, Artificial
  CRISPR gRNA sequence
aaaatatagaacctaatgga

SEQ ID NO: 195848 - DNA, 20 bp, Artificial
  CRISPR gRNA sequence
tagaacctaatggaaggatt

SEQ ID NO: 195849 - DNA, 20 bp, Artificial
  CRISPR gRNA sequence
ggatttggtgtcttaccgtt

SEQ ID NO: 195850 - DNA, 20 bp, Artificial
  CRISPR gRNA sequence
tcttaccgttcagcaaatgc

SEQ ID NO: 195851 - DNA, 20 bp, Artificial
  CRISPR gRNA sequence
taccgttcagcaaatgccag

SEQ ID NO: 195852 - DNA, 20 bp, Artificial
  CRISPR gRNA sequence
accgttcagcaaatgccagt

SEQ ID NO: 195853 - DNA, 20 bp, Artificial
  CRISPR gRNA sequence
gccagtaggtcatgaatata

SEQ ID NO: 195854 - DNA, 20 bp, Artificial
  CRISPR gRNA sequence
gtaggtcatgaatataaaga

SEQ ID NO: 195855 - DNA, 20 bp, Artificial
  CRISPR gRNA sequence
agcaaatatcctcatctttc

SEQ ID NO: 195856 - DNA, 20 bp, Artificial
  CRISPR gRNA sequence
tttctggaatgccctaatta

SEQ ID NO: 195857 - DNA, 20 bp, Artificial
  CRISPR gRNA sequence
ctaattatggaaaacacgaa

SEQ ID NO: 195858 - DNA, 20 bp, Artificial
  CRISPR gRNA sequence
attatggaaaacacgaaaag

SEQ ID NO: 195859 - DNA, 20 bp, Artificial
  CRISPR gRNA sequence
aaacatacaatatgacaata

SEQ ID NO: 195860 - DNA, 20 bp, Artificial
  CRISPR gRNA sequence
aacatacaatatgacaatat

SEQ ID NO: 195861 - DNA, 20 bp, Artificial
  CRISPR gRNA sequence
caatatgacaatatgggact

SEQ ID NO: 195862 - DNA, 20 bp, Artificial
  CRISPR gRNA sequence
tatgacaatatgggacttgg

SEQ ID NO: 195863 - DNA, 20 bp, Artificial
  CRISPR gRNA sequence
ttagggcattccagaaagat

SEQ ID NO: 195864 - DNA, 20 bp, Artificial
  CRISPR gRNA sequence
atattttaaatattttaacc

SEQ ID NO: 195865 - DNA, 20 bp, Artificial
  CRISPR gRNA sequence
tgtcattttgtaaaaatata

SEQ ID NO: 195866 - DNA, 20 bp, Artificial
  CRISPR gRNA sequence
ataatctattacccatttcc

SEQ ID NO: 195867 - DNA, 20 bp, Artificial
  CRISPR gRNA sequence
tgtgacatgcctttcctgat

SEQ ID NO: 195868 - DNA, 20 bp, Artificial
  CRISPR gRNA sequence
ctgatgaggatactttaagg

SEQ ID NO: 195869 - DNA, 20 bp, Artificial
  CRISPR gRNA sequence
aagtaaaaagagatgactgt

SEQ ID NO: 195870 - DNA, 20 bp, Artificial
  CRISPR gRNA sequence
gtcctgtcaaaggacattct

SEQ ID NO: 195871 - DNA, 20 bp, Artificial
  CRISPR gRNA sequence
caaaacatatttcaagccca

SEQ ID NO: 195872 - DNA, 20 bp, Artificial
  CRISPR gRNA sequence
ccaattttgtaaatgtttcg

SEQ ID NO: 195873 - DNA, 20 bp, Artificial
  CRISPR gRNA sequence
tcccaaggacctatatgtgg

SEQ ID NO: 195874 - DNA, 20 bp, Artificial
  CRISPR gRNA sequence
gtatggtagcaatatgacaa

SEQ ID NO: 195875 - DNA, 20 bp, Artificial
  CRISPR gRNA sequence
taattgtctattgggaaatg

SEQ ID NO: 195876 - DNA, 20 bp, Artificial
  CRISPR gRNA sequence
agatcacagatgtgaaattg

SEQ ID NO: 195877 - DNA, 20 bp, Artificial
  CRISPR gRNA sequence
gatgtgaaattgcaggatgc

SEQ ID NO: 195878 - DNA, 20 bp, Artificial
  CRISPR gRNA sequence
tatggtggtgccgactacaa

SEQ ID NO: 195879 - DNA, 20 bp, Artificial
  CRISPR gRNA sequence
ttactgtgaaagtcaatggt

SEQ ID NO: 195880 - DNA, 20 bp, Artificial
  CRISPR gRNA sequence
ttcattcattcattcaattc

SEQ ID NO: 195881 - DNA, 20 bp, Artificial
  CRISPR gRNA sequence
agtatgtacagttttccaaa

SEQ ID NO: 195882 - DNA, 20 bp, Artificial
  CRISPR gRNA sequence
ctttacttttttattacaaa

SEQ ID NO: 195883 - DNA, 20 bp, Artificial
  CRISPR gRNA sequence
gatactgtggaagagatcaa

SEQ ID NO: 195884 - DNA, 20 bp, Artificial
  CRISPR gRNA sequence
tatctcccatggcatgcaga

SEQ ID NO: 195885 - DNA, 20 bp, Artificial
  CRISPR gRNA sequence
aagaacctattcttccagta

SEQ ID NO: 195886 - DNA, 20 bp, Artificial
  CRISPR gRNA sequence
tctatactgatgttgtcttg

SEQ ID NO: 195887 - DNA, 20 bp, Artificial
  CRISPR gRNA sequence
tggggaattgaaaaggaact

SEQ ID NO: 195888 - DNA, 20 bp, Artificial
  CRISPR gRNA sequence
cagttatgttatcaggtcac

SEQ ID NO: 195889 - DNA, 20 bp, Artificial
  CRISPR gRNA sequence
aaacacctctgctttcattg

SEQ ID NO: 195890 - DNA, 20 bp, Artificial
  CRISPR gRNA sequence
gctttcattgttgagtttca

SEQ ID NO: 195891 - DNA, 20 bp, Artificial
  CRISPR gRNA sequence
ttcacagaattgagagctga

SEQ ID NO: 195892 - DNA, 20 bp, Artificial
  CRISPR gRNA sequence
caaagaacaaaaatccccca

SEQ ID NO: 195893 - DNA, 20 bp, Artificial
  CRISPR gRNA sequence
cacaatggcctccctgccat

SEQ ID NO: 195894 - DNA, 20 bp, Artificial
  CRISPR gRNA sequence
tgcccctctagttgtagtct

SEQ ID NO: 195895 - DNA, 20 bp, Artificial
  CRISPR gRNA sequence
atgaccttttaatatttgac

SEQ ID NO: 195896 - DNA, 20 bp, Artificial
  CRISPR gRNA sequence
actcaaaaacaaaatcatgt

SEQ ID NO: 195897 - DNA, 20 bp, Artificial
  CRISPR gRNA sequence
atcaacagcattgctagatc

SEQ ID NO: 195898 - DNA, 20 bp, Artificial
  CRISPR gRNA sequence
ctagatctgggatggaaagg

SEQ ID NO: 195899 - DNA, 20 bp, Artificial
  CRISPR gRNA sequence
aggtctctcatcagcctgta

SEQ ID NO: 195900 - DNA, 20 bp, Artificial
  CRISPR gRNA sequence
cagctgtccttgtagtaggg

SEQ ID NO: 195901 - DNA, 20 bp, Artificial
  CRISPR gRNA sequence
tatctgcagtctcctttgcc

SEQ ID NO: 195902 - DNA, 20 bp, Artificial
  CRISPR gRNA sequence
cactgatggtttttccaagg

SEQ ID NO: 195903 - DNA, 20 bp, Artificial
  CRISPR gRNA sequence
tcatttgcatacagtggttt

SEQ ID NO: 195904 - DNA, 20 bp, Artificial
  CRISPR gRNA sequence
tgcatacagtggttttggga

SEQ ID NO: 195905 - DNA, 20 bp, Artificial
  CRISPR gRNA sequence
aactcagggaagtagaactc

SEQ ID NO: 195906 - DNA, 20 bp, Artificial
  CRISPR gRNA sequence
tggtaacatagcttccccac

SEQ ID NO: 195907 - DNA, 20 bp, Artificial
  CRISPR gRNA sequence
atttcaaaactgaaatttga

SEQ ID NO: 195908 - DNA, 20 bp, Artificial
  CRISPR gRNA sequence
aaatttgaaagaatttagtt

SEQ ID NO: 195909 - DNA, 20 bp, Artificial
  CRISPR gRNA sequence
actcaattatcactatcact

SEQ ID NO: 195910 - DNA, 20 bp, Artificial
  CRISPR gRNA sequence
ttattgcacctttcttgttt

SEQ ID NO: 195911 - DNA, 20 bp, Artificial
  CRISPR gRNA sequence
agttgtcccgataaagctat

SEQ ID NO: 195912 - DNA, 20 bp, Artificial
  CRISPR gRNA sequence
gtttattgtctctctcctcc

SEQ ID NO: 195913 - DNA, 20 bp, Artificial
  CRISPR gRNA sequence
ccccagggcctgatatacag

SEQ ID NO: 195914 - DNA, 20 bp, Artificial
  CRISPR gRNA sequence
agcacacaaaaaaatatttg

SEQ ID NO: 195915 - DNA, 20 bp, Artificial
  CRISPR gRNA sequence
aaaaaatatttgttgagtca

SEQ ID NO: 195916 - DNA, 20 bp, Artificial
  CRISPR gRNA sequence
aatatttgttgagtcaatga

SEQ ID NO: 195917 - DNA, 20 bp, Artificial
  CRISPR gRNA sequence
gaatgaatgatttcctcaaa

SEQ ID NO: 195918 - DNA, 20 bp, Artificial
  CRISPR gRNA sequence
ttttggaaacatgaacagat

SEQ ID NO: 195919 - DNA, 20 bp, Artificial
  CRISPR gRNA sequence
ggaactgttagcagcttcta

SEQ ID NO: 195920 - DNA, 20 bp, Artificial
  CRISPR gRNA sequence
cagctctgctactgctacta

SEQ ID NO: 195921 - DNA, 20 bp, Artificial
  CRISPR gRNA sequence
tcctcctggaaatgactcta

SEQ ID NO: 195922 - DNA, 20 bp, Artificial
  CRISPR gRNA sequence
taagtgcttcatcatgtaag

SEQ ID NO: 195923 - DNA, 20 bp, Artificial
  CRISPR gRNA sequence
cattttgttgtgtctgaaat

SEQ ID NO: 195924 - DNA, 20 bp, Artificial
  CRISPR gRNA sequence
ctgagtgtgtctttcaatga

SEQ ID NO: 195925 - DNA, 20 bp, Artificial
  CRISPR gRNA sequence
agtggtattattcccatttt

SEQ ID NO: 195926 - DNA, 20 bp, Artificial
  CRISPR gRNA sequence
tccaacattagtatagtgtt

SEQ ID NO: 195927 - DNA, 20 bp, Artificial
  CRISPR gRNA sequence
ttttgaagagcaaaaaaagg

SEQ ID NO: 195928 - DNA, 20 bp, Artificial
  CRISPR gRNA sequence
tgtcaaggcataatatacct

SEQ ID NO: 195929 - DNA, 20 bp, Artificial
  CRISPR gRNA sequence
gaactttatcattaacaaag

SEQ ID NO: 195930 - DNA, 20 bp, Artificial
  CRISPR gRNA sequence
tgtcacttctgctgtttcct

SEQ ID NO: 195931 - DNA, 20 bp, Artificial
  CRISPR gRNA sequence
ctgtttcctctgggttgtgc

SEQ ID NO: 195932 - DNA, 20 bp, Artificial
  CRISPR gRNA sequence
gtttagtcaaaattagataa

SEQ ID NO: 195933 - DNA, 20 bp, Artificial
  CRISPR gRNA sequence
ggtagtggtttcattgatat

SEQ ID NO: 195934 - DNA, 20 bp, Artificial
  CRISPR gRNA sequence
tctattgctgtccttggtaa

SEQ ID NO: 195935 - DNA, 20 bp, Artificial
  CRISPR gRNA sequence
ctgtccttggtaaaggaatg

SEQ ID NO: 195936 - DNA, 20 bp, Artificial
  CRISPR gRNA sequence
aacatgttaatgtacttgta

SEQ ID NO: 195937 - DNA, 20 bp, Artificial
  CRISPR gRNA sequence
tgtacttgtaatgaataaac

SEQ ID NO: 195938 - DNA, 20 bp, Artificial
  CRISPR gRNA sequence
aggtgcactaaacaatctac

SEQ ID NO: 195939 - DNA, 20 bp, Artificial
  CRISPR gRNA sequence
actacgtatcttaatcctga

SEQ ID NO: 195940 - DNA, 20 bp, Artificial
  CRISPR gRNA sequence
cccaaaccaatgatctaaaa

SEQ ID NO: 195941 - DNA, 20 bp, Artificial
  CRISPR gRNA sequence
atagcatcccagaacagaaa

SEQ ID NO: 195942 - DNA, 20 bp, Artificial
  CRISPR gRNA sequence
ggatattagggaaaaactgg

SEQ ID NO: 195943 - DNA, 20 bp, Artificial
  CRISPR gRNA sequence
ttagggaaaaactggaggaa

SEQ ID NO: 195944 - DNA, 20 bp, Artificial
  CRISPR gRNA sequence
gatactaacaatagaggaaa

SEQ ID NO: 195945 - DNA, 20 bp, Artificial
  CRISPR gRNA sequence
acaatagaggaaaccgggta

SEQ ID NO: 195946 - DNA, 20 bp, Artificial
  CRISPR gRNA sequence
attgacttcaaatcagaaaa

SEQ ID NO: 195947 - DNA, 20 bp, Artificial
  CRISPR gRNA sequence
acaacaaaaataaaatatcc

SEQ ID NO: 195948 - DNA, 20 bp, Artificial
  CRISPR gRNA sequence
gaaaacctgaacaaatggag

SEQ ID NO: 195949 - DNA, 20 bp, Artificial
  CRISPR gRNA sequence
tggagagggatattttgtat

SEQ ID NO: 195950 - DNA, 20 bp, Artificial
  CRISPR gRNA sequence
ttattttttgtagaaattta

SEQ ID NO: 195951 - DNA, 20 bp, Artificial
  CRISPR gRNA sequence
tacaagagcagtgttgtcac

SEQ ID NO: 195952 - DNA, 20 bp, Artificial
  CRISPR gRNA sequence
tattacatagtggtgaagtc

SEQ ID NO: 195953 - DNA, 20 bp, Artificial
  CRISPR gRNA sequence
aatccaaacttgtcccaact

SEQ ID NO: 195954 - DNA, 20 bp, Artificial
  CRISPR gRNA sequence
aaacttgtcccaactttgaa

SEQ ID NO: 195955 - DNA, 20 bp, Artificial
  CRISPR gRNA sequence
ccatacaacaaaatcaacca

SEQ ID NO: 195956 - DNA, 20 bp, Artificial
  CRISPR gRNA sequence
tcaaccaaagaattttggtt

SEQ ID NO: 195957 - DNA, 20 bp, Artificial
  CRISPR gRNA sequence
caagcagtgaccatcaagtc

SEQ ID NO: 195958 - DNA, 20 bp, Artificial
  CRISPR gRNA sequence
ttcaatgtgaccagcacact

SEQ ID NO: 195959 - DNA, 20 bp, Artificial
  CRISPR gRNA sequence
tcctgaggaaaaccatacag

SEQ ID NO: 195960 - DNA, 20 bp, Artificial
  CRISPR gRNA sequence
tggtcatcccaggtaatatt

SEQ ID NO: 195961 - DNA, 20 bp, Artificial
  CRISPR gRNA sequence
tcatagtcattcagtgattg

SEQ ID NO: 195962 - DNA, 20 bp, Artificial
  CRISPR gRNA sequence
attcagtgattgttgaataa

SEQ ID NO: 195963 - DNA, 20 bp, Artificial
  CRISPR gRNA sequence
agtgattgttgaataaatga

SEQ ID NO: 195964 - DNA, 20 bp, Artificial
  CRISPR gRNA sequence
attgttgaataaatgaatga

SEQ ID NO: 195965 - DNA, 20 bp, Artificial
  CRISPR gRNA sequence
aaacattcagcagatattta

SEQ ID NO: 195966 - DNA, 20 bp, Artificial
  CRISPR gRNA sequence
tccatgcattgtagtactca

SEQ ID NO: 195967 - DNA, 20 bp, Artificial
  CRISPR gRNA sequence
tagtactcattggatacaca

SEQ ID NO: 195968 - DNA, 20 bp, Artificial
  CRISPR gRNA sequence
tttcatagccgggaaacctg

SEQ ID NO: 195969 - DNA, 20 bp, Artificial
  CRISPR gRNA sequence
aaacctggggaatacctgag

SEQ ID NO: 195970 - DNA, 20 bp, Artificial
  CRISPR gRNA sequence
ctcaattcaggccttgtttc

SEQ ID NO: 195971 - DNA, 20 bp, Artificial
  CRISPR gRNA sequence
cagagctgcttccctctttc

SEQ ID NO: 195972 - DNA, 20 bp, Artificial
  CRISPR gRNA sequence
tgtgtgcttcactttccctg

SEQ ID NO: 195973 - DNA, 20 bp, Artificial
  CRISPR gRNA sequence
ctactgagcaagcttattgt

SEQ ID NO: 195974 - DNA, 20 bp, Artificial
  CRISPR gRNA sequence
cactactctacagaagtagg

SEQ ID NO: 195975 - DNA, 20 bp, Artificial
  CRISPR gRNA sequence
gaagtaggtagggtgggaga

SEQ ID NO: 195976 - DNA, 20 bp, Artificial
  CRISPR gRNA sequence
acagagtctgatgagaggct

SEQ ID NO: 195977 - DNA, 20 bp, Artificial
  CRISPR gRNA sequence
agaatgtgaaagaaagtgag

SEQ ID NO: 195978 - DNA, 20 bp, Artificial
  CRISPR gRNA sequence
aaaaaactttagaaaatgat

SEQ ID NO: 195979 - DNA, 20 bp, Artificial
  CRISPR gRNA sequence
aatgatggggatgctcttac

SEQ ID NO: 195980 - DNA, 20 bp, Artificial
  CRISPR gRNA sequence
ggggatgctcttactggggt

SEQ ID NO: 195981 - DNA, 20 bp, Artificial
  CRISPR gRNA sequence
tttcagtaaaagctagatta

SEQ ID NO: 195982 - DNA, 20 bp, Artificial
  CRISPR gRNA sequence
gttttatgacaacttacttg

SEQ ID NO: 195983 - DNA, 20 bp, Artificial
  CRISPR gRNA sequence
cagtaactcacctaactgca

SEQ ID NO: 195984 - DNA, 20 bp, Artificial
  CRISPR gRNA sequence
tgtttcctcatctgtaaatt

SEQ ID NO: 195985 - DNA, 20 bp, Artificial
  CRISPR gRNA sequence
ttgtgtctttaaagtttcac

SEQ ID NO: 195986 - DNA, 20 bp, Artificial
  CRISPR gRNA sequence
tttcacctgggtagtcaaag

SEQ ID NO: 195987 - DNA, 20 bp, Artificial
  CRISPR gRNA sequence
tgggtagtcaaagatggatc

SEQ ID NO: 195988 - DNA, 20 bp, Artificial
  CRISPR gRNA sequence
gagccaggcaggagctgact

SEQ ID NO: 195989 - DNA, 20 bp, Artificial
  CRISPR gRNA sequence
gctgactaagggtgagaggt

SEQ ID NO: 195990 - DNA, 20 bp, Artificial
  CRISPR gRNA sequence
ggctactagcttctatatta

SEQ ID NO: 195991 - DNA, 20 bp, Artificial
  CRISPR gRNA sequence
tgggcagatcacttgaggtc

SEQ ID NO: 195992 - DNA, 20 bp, Artificial
  CRISPR gRNA sequence
actaaaaatataaaaattag

SEQ ID NO: 195993 - DNA, 20 bp, Artificial
  CRISPR gRNA sequence
tactcgggagactgaggcac

SEQ ID NO: 195994 - DNA, 20 bp, Artificial
  CRISPR gRNA sequence
tcaaaactggttaagggcag

SEQ ID NO: 195995 - DNA, 20 bp, Artificial
  CRISPR gRNA sequence
ctaaagctaaactaaacttc

SEQ ID NO: 195996 - DNA, 20 bp, Artificial
  CRISPR gRNA sequence
taattgcagtggtctccact

SEQ ID NO: 195997 - DNA, 20 bp, Artificial
  CRISPR gRNA sequence
gtctccactgggggtgagga

SEQ ID NO: 195998 - DNA, 20 bp, Artificial
  CRISPR gRNA sequence
actgggggtgaggaaggggt

SEQ ID NO: 195999 - DNA, 20 bp, Artificial
  CRISPR gRNA sequence
gggtgaggaaggggtgagaa

SEQ ID NO: 196000 - DNA, 20 bp, Artificial
  CRISPR gRNA sequence
caacagcaattatattgaag

SEQ ID NO: 196001 - DNA, 20 bp, Artificial
  CRISPR gRNA sequence
gcaattatattgaagctgag

SEQ ID NO: 196002 - DNA, 20 bp, Artificial
  CRISPR gRNA sequence
attgaagctgagtgggatca

SEQ ID NO: 196003 - DNA, 20 bp, Artificial
  CRISPR gRNA sequence
ctgggtgaagatgaagcgta

SEQ ID NO: 196004 - DNA, 20 bp, Artificial
  CRISPR gRNA sequence
gcgtaaggggtgaggggcag

SEQ ID NO: 196005 - DNA, 20 bp, Artificial
  CRISPR gRNA sequence
aaggggtgaggggcaggaga

SEQ ID NO: 196006 - DNA, 20 bp, Artificial
  CRISPR gRNA sequence
tgaggggcaggagaatgggt

SEQ ID NO: 196007 - DNA, 20 bp, Artificial
  CRISPR gRNA sequence
tagttgcaaccagctggttt

SEQ ID NO: 196008 - DNA, 20 bp, Artificial
  CRISPR gRNA sequence
gaactgtagtatgtttacca

SEQ ID NO: 196009 - DNA, 20 bp, Artificial
  CRISPR gRNA sequence
attttgcaaaatttttggta

SEQ ID NO: 196010 - DNA, 20 bp, Artificial
  CRISPR gRNA sequence
aacaattaaaatccaggaaa

SEQ ID NO: 196011 - DNA, 20 bp, Artificial
  CRISPR gRNA sequence
ataatttcctcccatttaag

SEQ ID NO: 196012 - DNA, 20 bp, Artificial
  CRISPR gRNA sequence
tcctcccatttaagatgagt

SEQ ID NO: 196013 - DNA, 20 bp, Artificial
  CRISPR gRNA sequence
caagagatccagtgatggta

SEQ ID NO: 196014 - DNA, 20 bp, Artificial
  CRISPR gRNA sequence
tctgatgttaaatagggaag

SEQ ID NO: 196015 - DNA, 20 bp, Artificial
  CRISPR gRNA sequence
tagggaagtagaatatggaa

SEQ ID NO: 196016 - DNA, 20 bp, Artificial
  CRISPR gRNA sequence
gggaaagtagtgttaactga

SEQ ID NO: 196017 - DNA, 20 bp, Artificial
  CRISPR gRNA sequence
cttaacaggactgagatagc

SEQ ID NO: 196018 - DNA, 20 bp, Artificial
  CRISPR gRNA sequence
gactgagatagccagaatat

SEQ ID NO: 196019 - DNA, 20 bp, Artificial
  CRISPR gRNA sequence
atgacagtaagatcctgaga

SEQ ID NO: 196020 - DNA, 20 bp, Artificial
  CRISPR gRNA sequence
aattgttgccagcatgcatt

SEQ ID NO: 196021 - DNA, 20 bp, Artificial
  CRISPR gRNA sequence
aagattagttggcagtagaa

SEQ ID NO: 196022 - DNA, 20 bp, Artificial
  CRISPR gRNA sequence
caatagatattaaaatacct

SEQ ID NO: 196023 - DNA, 20 bp, Artificial
  CRISPR gRNA sequence
gtatactcctcaagaacatc

SEQ ID NO: 196024 - DNA, 20 bp, Artificial
  CRISPR gRNA sequence
aaagcatgtgccctacacta

SEQ ID NO: 196025 - DNA, 20 bp, Artificial
  CRISPR gRNA sequence
acctcataagttgggacctg

SEQ ID NO: 196026 - DNA, 20 bp, Artificial
  CRISPR gRNA sequence
taagttgggacctgtggaat

SEQ ID NO: 196027 - DNA, 20 bp, Artificial
  CRISPR gRNA sequence
ggatgtccaccagacttcct

SEQ ID NO: 196028 - DNA, 20 bp, Artificial
  CRISPR gRNA sequence
acagaacttgaaatttaaac

SEQ ID NO: 196029 - DNA, 20 bp, Artificial
  CRISPR gRNA sequence
tttaaacttgggtcactgta

SEQ ID NO: 196030 - DNA, 20 bp, Artificial
  CRISPR gRNA sequence
atgatttctttttctcaagg

SEQ ID NO: 196031 - DNA, 20 bp, Artificial
  CRISPR gRNA sequence
ctttttctcaagggagaatg

SEQ ID NO: 196032 - DNA, 20 bp, Artificial
  CRISPR gRNA sequence
actcaaagaagcaaagtggt

SEQ ID NO: 196033 - DNA, 20 bp, Artificial
  CRISPR gRNA sequence
aaagtggtaagaatatcaga

SEQ ID NO: 196034 - DNA, 20 bp, Artificial
  CRISPR gRNA sequence
cataatctcctctcctttta

SEQ ID NO: 196035 - DNA, 20 bp, Artificial
  CRISPR gRNA sequence
tttaggagcagggaagggga

SEQ ID NO: 196036 - DNA, 20 bp, Artificial
  CRISPR gRNA sequence
agctccttgcagcaggggac

SEQ ID NO: 196037 - DNA, 20 bp, Artificial
  CRISPR gRNA sequence
aggggacaaggatgacttag

SEQ ID NO: 196038 - DNA, 20 bp, Artificial
  CRISPR gRNA sequence
gacaaggatgacttaggtgg

SEQ ID NO: 196039 - DNA, 20 bp, Artificial
  CRISPR gRNA sequence
agagagagagagagaaatac

SEQ ID NO: 196040 - DNA, 20 bp, Artificial
  CRISPR gRNA sequence
attttacagtagagaaaaca

SEQ ID NO: 196041 - DNA, 20 bp, Artificial
  CRISPR gRNA sequence
agctaagtagcaaatgttgt

SEQ ID NO: 196042 - DNA, 20 bp, Artificial
  CRISPR gRNA sequence
tcccaatttgctcaggactg

SEQ ID NO: 196043 - DNA, 20 bp, Artificial
  CRISPR gRNA sequence
ctcaggactgaggggttttc

SEQ ID NO: 196044 - DNA, 20 bp, Artificial
  CRISPR gRNA sequence
ggttttccaggatatcatgt

SEQ ID NO: 196045 - DNA, 20 bp, Artificial
  CRISPR gRNA sequence
aggatatcatgtaaggataa

SEQ ID NO: 196046 - DNA, 20 bp, Artificial
  CRISPR gRNA sequence
catttatcatatcagcaact

SEQ ID NO: 196047 - DNA, 20 bp, Artificial
  CRISPR gRNA sequence
ggaacttctgatcttcaagc

SEQ ID NO: 196048 - DNA, 20 bp, Artificial
  CRISPR gRNA sequence
ggattctcaacctgtggttt

SEQ ID NO: 196049 - DNA, 20 bp, Artificial
  CRISPR gRNA sequence
ggctgagcgtgacaagagga

SEQ ID NO: 196050 - DNA, 20 bp, Artificial
  CRISPR gRNA sequence
gaacccctaaaccacaggtt

SEQ ID NO: 196051 - DNA, 20 bp, Artificial
  CRISPR gRNA sequence
gaagatcagaagttccaatg

SEQ ID NO: 196052 - DNA, 20 bp, Artificial
  CRISPR gRNA sequence
ctcctccaaatgtgtatctg

SEQ ID NO: 196053 - DNA, 20 bp, Artificial
  CRISPR gRNA sequence
cccctcagtcctgagcaaat

SEQ ID NO: 196054 - DNA, 20 bp, Artificial
  CRISPR gRNA sequence
acagatgatgctatgggcca

SEQ ID NO: 196055 - DNA, 20 bp, Artificial
  CRISPR gRNA sequence
tttcttcttagttcaataac

SEQ ID NO: 196056 - DNA, 20 bp, Artificial
  CRISPR gRNA sequence
atgtaaacatttgtagcaaa

SEQ ID NO: 196057 - DNA, 20 bp, Artificial
  CRISPR gRNA sequence
agcaaaatggattgaagcag

SEQ ID NO: 196058 - DNA, 20 bp, Artificial
  CRISPR gRNA sequence
tggattgaagcagatgggtt

SEQ ID NO: 196059 - DNA, 20 bp, Artificial
  CRISPR gRNA sequence
gaagcagatgggttaagagt

SEQ ID NO: 196060 - DNA, 20 bp, Artificial
  CRISPR gRNA sequence
tgttttctctactgtaaaat

SEQ ID NO: 196061 - DNA, 20 bp, Artificial
  CRISPR gRNA sequence
ctctctctttggtaatggca

SEQ ID NO: 196062 - DNA, 20 bp, Artificial
  CRISPR gRNA sequence
tttggtaatggcaaggggtg

SEQ ID NO: 196063 - DNA, 20 bp, Artificial
  CRISPR gRNA sequence
aatactgacacacaatattt

SEQ ID NO: 196064 - DNA, 20 bp, Artificial
  CRISPR gRNA sequence
cccctgctgcaaggagctgc

SEQ ID NO: 196065 - DNA, 20 bp, Artificial
  CRISPR gRNA sequence
taaacctcctcagacggtgg

SEQ ID NO: 196066 - DNA, 20 bp, Artificial
  CRISPR gRNA sequence
aggagaggagattatgactg

SEQ ID NO: 196067 - DNA, 20 bp, Artificial
  CRISPR gRNA sequence
attcttaccactttgcttct

SEQ ID NO: 196068 - DNA, 20 bp, Artificial
  CRISPR gRNA sequence
tgcttctttgagtttgtatc

SEQ ID NO: 196069 - DNA, 20 bp, Artificial
  CRISPR gRNA sequence
tttgatcctagatgttcttg

SEQ ID NO: 196070 - DNA, 20 bp, Artificial
  CRISPR gRNA sequence
tgtgcaaatcaactccatct

SEQ ID NO: 196071 - DNA, 20 bp, Artificial
  CRISPR gRNA sequence
ctggctatctcagtcctgtt

SEQ ID NO: 196072 - DNA, 20 bp, Artificial
  CRISPR gRNA sequence
acactactttcccccatgta

SEQ ID NO: 196073 - DNA, 20 bp, Artificial
  CRISPR gRNA sequence
cccccatgtaaggggttatg

SEQ ID NO: 196074 - DNA, 20 bp, Artificial
  CRISPR gRNA sequence
gggaatttttcaacgactat

SEQ ID NO: 196075 - DNA, 20 bp, Artificial
  CRISPR gRNA sequence
cagacaactctataccatca

SEQ ID NO: 196076 - DNA, 20 bp, Artificial
  CRISPR gRNA sequence
tatacttctctaagtattgg

SEQ ID NO: 196077 - DNA, 20 bp, Artificial
  CRISPR gRNA sequence
cttaaatgggaggaaattat

SEQ ID NO: 196078 - DNA, 20 bp, Artificial
  CRISPR gRNA sequence
atttgaatatactcattttc

SEQ ID NO: 196079 - DNA, 20 bp, Artificial
  CRISPR gRNA sequence
gaggaactatttttattact

SEQ ID NO: 196080 - DNA, 20 bp, Artificial
  CRISPR gRNA sequence
atataattgctgttgaacag

SEQ ID NO: 196081 - DNA, 20 bp, Artificial
  CRISPR gRNA sequence
accaccttgcagaggttaag

SEQ ID NO: 196082 - DNA, 20 bp, Artificial
  CRISPR gRNA sequence
taccttttcttaaacggaag

SEQ ID NO: 196083 - DNA, 20 bp, Artificial
  CRISPR gRNA sequence
aggcataataagatggctcc

SEQ ID NO: 196084 - DNA, 20 bp, Artificial
  CRISPR gRNA sequence
atggctcccagaattaccaa

SEQ ID NO: 196085 - DNA, 20 bp, Artificial
  CRISPR gRNA sequence
caagtgagtcctttcatttg

SEQ ID NO: 196086 - DNA, 20 bp, Artificial
  CRISPR gRNA sequence
aagataaaattttgatggga

SEQ ID NO: 196087 - DNA, 20 bp, Artificial
  CRISPR gRNA sequence
ttttgatgggaaggggtcag

SEQ ID NO: 196088 - DNA, 20 bp, Artificial
  CRISPR gRNA sequence
cttgaagtttagtttagctt

SEQ ID NO: 196089 - DNA, 20 bp, Artificial
  CRISPR gRNA sequence
attttcttaaatgccaaagt

SEQ ID NO: 196090 - DNA, 20 bp, Artificial
  CRISPR gRNA sequence
aatgccaaagtttgagtggc

SEQ ID NO: 196091 - DNA, 20 bp, Artificial
  CRISPR gRNA sequence
tgtgcttgcacagtaccaca

SEQ ID NO: 196092 - DNA, 20 bp, Artificial
  CRISPR gRNA sequence
ttttttttttttttttgagg

SEQ ID NO: 196093 - DNA, 20 bp, Artificial
  CRISPR gRNA sequence
cagagtctttctctgttgcc

SEQ ID NO: 196094 - DNA, 20 bp, Artificial
  CRISPR gRNA sequence
tctttctctgttgcccaggg

SEQ ID NO: 196095 - DNA, 20 bp, Artificial
  CRISPR gRNA sequence
aattcttgtgcctcagtctc

SEQ ID NO: 196096 - DNA, 20 bp, Artificial
  CRISPR gRNA sequence
gcctcagtctcccgagtagc

SEQ ID NO: 196097 - DNA, 20 bp, Artificial
  CRISPR gRNA sequence
ttttatatttttagtaaagg

SEQ ID NO: 196098 - DNA, 20 bp, Artificial
  CRISPR gRNA sequence
ctcttactaggctccttgtc

SEQ ID NO: 196099 - DNA, 20 bp, Artificial
  CRISPR gRNA sequence
gggtaccatgcaggaggaaa

SEQ ID NO: 196100 - DNA, 20 bp, Artificial
  CRISPR gRNA sequence
ttcagtttcagaacaacttt

SEQ ID NO: 196101 - DNA, 20 bp, Artificial
  CRISPR gRNA sequence
aacagactcagtgcagttag

SEQ ID NO: 196102 - DNA, 20 bp, Artificial
  CRISPR gRNA sequence
tttctgttcacaacaccgtc

SEQ ID NO: 196103 - DNA, 20 bp, Artificial
  CRISPR gRNA sequence
gggcagtgagcagctcttct

SEQ ID NO: 196104 - DNA, 20 bp, Artificial
  CRISPR gRNA sequence
tcccaccctacctacttctg

SEQ ID NO: 196105 - DNA, 20 bp, Artificial
  CRISPR gRNA sequence
agtgagataaaaaaaaatag

SEQ ID NO: 196106 - DNA, 20 bp, Artificial
  CRISPR gRNA sequence
ctatgcactaagcagactgc

SEQ ID NO: 196107 - DNA, 20 bp, Artificial
  CRISPR gRNA sequence
tgggagaggcaccggggaga

SEQ ID NO: 196108 - DNA, 20 bp, Artificial
  CRISPR gRNA sequence
gggaagcagctctgatgtgc

SEQ ID NO: 196109 - DNA, 20 bp, Artificial
  CRISPR gRNA sequence
cagctctgatgtgccaggat

SEQ ID NO: 196110 - DNA, 20 bp, Artificial
  CRISPR gRNA sequence
ttggattcctgaaacaaggc

SEQ ID NO: 196111 - DNA, 20 bp, Artificial
  CRISPR gRNA sequence
ttcctgaaacaaggcctgaa

SEQ ID NO: 196112 - DNA, 20 bp, Artificial
  CRISPR gRNA sequence
aaagcatttcccacatggtg

SEQ ID NO: 196113 - DNA, 20 bp, Artificial
  CRISPR gRNA sequence
agttttttatctgtttcctg

SEQ ID NO: 196114 - DNA, 20 bp, Artificial
  CRISPR gRNA sequence
tgtttcctgaagagtgtgaa

SEQ ID NO: 196115 - DNA, 20 bp, Artificial
  CRISPR gRNA sequence
tattattctatgtgtatcca

SEQ ID NO: 196116 - DNA, 20 bp, Artificial
  CRISPR gRNA sequence
gtatattccataaatatctg

SEQ ID NO: 196117 - DNA, 20 bp, Artificial
  CRISPR gRNA sequence
ttattaagtaacaatatggt

SEQ ID NO: 196118 - DNA, 20 bp, Artificial
  CRISPR gRNA sequence
taagtaacaatatggtttgg

SEQ ID NO: 196119 - DNA, 20 bp, Artificial
  CRISPR gRNA sequence
ggtttggatgaatggaggtg

SEQ ID NO: 196120 - DNA, 20 bp, Artificial
  CRISPR gRNA sequence
gatgaatggaggtgaggaat

SEQ ID NO: 196121 - DNA, 20 bp, Artificial
  CRISPR gRNA sequence
attcatttattcaacaatca

SEQ ID NO: 196122 - DNA, 20 bp, Artificial
  CRISPR gRNA sequence
catattttaatggacacatt

SEQ ID NO: 196123 - DNA, 20 bp, Artificial
  CRISPR gRNA sequence
gacacattcagaatattacc

SEQ ID NO: 196124 - DNA, 20 bp, Artificial
  CRISPR gRNA sequence
ttcagctgtatggttttcct

SEQ ID NO: 196125 - DNA, 20 bp, Artificial
  CRISPR gRNA sequence
gaaaagcttctcctctctct

SEQ ID NO: 196126 - DNA, 20 bp, Artificial
  CRISPR gRNA sequence
tgtccagatgacttcggcct

SEQ ID NO: 196127 - DNA, 20 bp, Artificial
  CRISPR gRNA sequence
cagttcatgttcagaggtga

SEQ ID NO: 196128 - DNA, 20 bp, Artificial
  CRISPR gRNA sequence
ttgatgctgtccacattaga

SEQ ID NO: 196129 - DNA, 20 bp, Artificial
  CRISPR gRNA sequence
caatgcaggctggttctcag

SEQ ID NO: 196130 - DNA, 20 bp, Artificial
  CRISPR gRNA sequence
aattcaaagttgggacaagt

SEQ ID NO: 196131 - DNA, 20 bp, Artificial
  CRISPR gRNA sequence
tgggacaagtttggattaat

SEQ ID NO: 196132 - DNA, 20 bp, Artificial
  CRISPR gRNA sequence
tctacaaaaaataatttaaa

SEQ ID NO: 196133 - DNA, 20 bp, Artificial
  CRISPR gRNA sequence
gcttcttcttaaatttattc

SEQ ID NO: 196134 - DNA, 20 bp, Artificial
  CRISPR gRNA sequence
ataaatctgtctttataaac

SEQ ID NO: 196135 - DNA, 20 bp, Artificial
  CRISPR gRNA sequence
aaaaagttgcaaagatagta

SEQ ID NO: 196136 - DNA, 20 bp, Artificial
  CRISPR gRNA sequence
ctaatatcctttttctgttc

SEQ ID NO: 196137 - DNA, 20 bp, Artificial
  CRISPR gRNA sequence
ttctgttctgggatgctatc

SEQ ID NO: 196138 - DNA, 20 bp, Artificial
  CRISPR gRNA sequence
tcattggtttgggacccttt

SEQ ID NO: 196139 - DNA, 20 bp, Artificial
  CRISPR gRNA sequence
tgtgaggtaatttcttcaca

SEQ ID NO: 196140 - DNA, 20 bp, Artificial
  CRISPR gRNA sequence
gagagttaatacaaaacggc

SEQ ID NO: 196141 - DNA, 20 bp, Artificial
  CRISPR gRNA sequence
aaatgaaactgaaataaata

SEQ ID NO: 196142 - DNA, 20 bp, Artificial
  CRISPR gRNA sequence
ttcttatgtgtaggttgctt

SEQ ID NO: 196143 - DNA, 20 bp, Artificial
  CRISPR gRNA sequence
taggttgctttggggtagct

SEQ ID NO: 196144 - DNA, 20 bp, Artificial
  CRISPR gRNA sequence
aaatgtgcatgcacaaacac

SEQ ID NO: 196145 - DNA, 20 bp, Artificial
  CRISPR gRNA sequence
caaaatgttttacagatgag

SEQ ID NO: 196146 - DNA, 20 bp, Artificial
  CRISPR gRNA sequence
agacttcagagctaatctgc

SEQ ID NO: 196147 - DNA, 20 bp, Artificial
  CRISPR gRNA sequence
tagctttatcattttctagg

SEQ ID NO: 196148 - DNA, 20 bp, Artificial
  CRISPR gRNA sequence
tttatcattttctaggctgg

SEQ ID NO: 196149 - DNA, 20 bp, Artificial
  CRISPR gRNA sequence
agtttcctcatccttaaaat

SEQ ID NO: 196150 - DNA, 20 bp, Artificial
  CRISPR gRNA sequence
gggaataataccacttatca

SEQ ID NO: 196151 - DNA, 20 bp, Artificial
  CRISPR gRNA sequence
atgatgaagcacttaccccc

SEQ ID NO: 196152 - DNA, 20 bp, Artificial
  CRISPR gRNA sequence
aggaaatgaactaatttaga

SEQ ID NO: 196153 - DNA, 20 bp, Artificial
  CRISPR gRNA sequence
tcagtacagggcctaacaca

SEQ ID NO: 196154 - DNA, 20 bp, Artificial
  CRISPR gRNA sequence
tctgctgtatatcaggccct

SEQ ID NO: 196155 - DNA, 20 bp, Artificial
  CRISPR gRNA sequence
ggcccaaatctttgtgcttg

SEQ ID NO: 196156 - DNA, 20 bp, Artificial
  CRISPR gRNA sequence
gagaacacttaaacagggct

SEQ ID NO: 196157 - DNA, 20 bp, Artificial
  CRISPR gRNA sequence
ctgggaattttggggagaga

SEQ ID NO: 196158 - DNA, 20 bp, Artificial
  CRISPR gRNA sequence
ggggagagatggggttggtg

SEQ ID NO: 196159 - DNA, 20 bp, Artificial
  CRISPR gRNA sequence
tcattgaaggttctgaaagt

SEQ ID NO: 196160 - DNA, 20 bp, Artificial
  CRISPR gRNA sequence
taattgaaagttagtggcct

SEQ ID NO: 196161 - DNA, 20 bp, Artificial
  CRISPR gRNA sequence
acccgaagtgatagtgataa

SEQ ID NO: 196162 - DNA, 20 bp, Artificial
  CRISPR gRNA sequence
gaagtgatagtgataattga

SEQ ID NO: 196163 - DNA, 20 bp, Artificial
  CRISPR gRNA sequence
ttcacctttaaaataccatg

SEQ ID NO: 196164 - DNA, 20 bp, Artificial
  CRISPR gRNA sequence
tttgcatatggaggtgactc

SEQ ID NO: 196165 - DNA, 20 bp, Artificial
  CRISPR gRNA sequence
gactcaggagttctacttcc

SEQ ID NO: 196166 - DNA, 20 bp, Artificial
  CRISPR gRNA sequence
cactgtatgcaaatgacaag

SEQ ID NO: 196167 - DNA, 20 bp, Artificial
  CRISPR gRNA sequence
tgcaaatgacaagatggatt

SEQ ID NO: 196168 - DNA, 20 bp, Artificial
  CRISPR gRNA sequence
atgacaagatggattgggag

SEQ ID NO: 196169 - DNA, 20 bp, Artificial
  CRISPR gRNA sequence
aagtaatttacaatacaaaa

SEQ ID NO: 196170 - DNA, 20 bp, Artificial
  CRISPR gRNA sequence
aaggagactgcagatacaca

SEQ ID NO: 196171 - DNA, 20 bp, Artificial
  CRISPR gRNA sequence
tattatggagcccagacgac

SEQ ID NO: 196172 - DNA, 20 bp, Artificial
  CRISPR gRNA sequence
gctgccttcttcctgactgc

SEQ ID NO: 196173 - DNA, 20 bp, Artificial
  CRISPR gRNA sequence
acagtagatgcctgatattt

SEQ ID NO: 196174 - DNA, 20 bp, Artificial
  CRISPR gRNA sequence
acaacatctcaagagatgtc

SEQ ID NO: 196175 - DNA, 20 bp, Artificial
  CRISPR gRNA sequence
atccccacatgattttgttt

SEQ ID NO: 196176 - DNA, 20 bp, Artificial
  CRISPR gRNA sequence
agattgatggtagttagccc

SEQ ID NO: 196177 - DNA, 20 bp, Artificial
  CRISPR gRNA sequence
cagatttcagcttactatta

SEQ ID NO: 196178 - DNA, 20 bp, Artificial
  CRISPR gRNA sequence
ctattagggagtaatttcaa

SEQ ID NO: 196179 - DNA, 20 bp, Artificial
  CRISPR gRNA sequence
taatttcaacaggatatgga

SEQ ID NO: 196180 - DNA, 20 bp, Artificial
  CRISPR gRNA sequence
aaatggcagggaggccattg

SEQ ID NO: 196181 - DNA, 20 bp, Artificial
  CRISPR gRNA sequence
taagaacagaagatcctctg

SEQ ID NO: 196182 - DNA, 20 bp, Artificial
  CRISPR gRNA sequence
gggggatttttgttctttgt

SEQ ID NO: 196183 - DNA, 20 bp, Artificial
  CRISPR gRNA sequence
tttttgttctttgtgggagt

SEQ ID NO: 196184 - DNA, 20 bp, Artificial
  CRISPR gRNA sequence
ttggattagctgctcctgcc

SEQ ID NO: 196185 - DNA, 20 bp, Artificial
  CRISPR gRNA sequence
agtgacctgataacataact

SEQ ID NO: 196186 - DNA, 20 bp, Artificial
  CRISPR gRNA sequence
catcagtatagattttcaag

SEQ ID NO: 196187 - DNA, 20 bp, Artificial
  CRISPR gRNA sequence
tatggcttatcctgtactgg

SEQ ID NO: 196188 - DNA, 20 bp, Artificial
  CRISPR gRNA sequence
gtgattattttttgtcttca

SEQ ID NO: 196189 - DNA, 20 bp, Artificial
  CRISPR gRNA sequence
ttttaatgtgaaccttacag

SEQ ID NO: 196190 - DNA, 20 bp, Artificial
  CRISPR gRNA sequence
accttacagtggggtttgtt

SEQ ID NO: 196191 - DNA, 20 bp, Artificial
  CRISPR gRNA sequence
ataaaataaaaaaatagtag

SEQ ID NO: 196192 - DNA, 20 bp, Artificial
  CRISPR gRNA sequence
tttgatctcttccacagtat

SEQ ID NO: 196193 - DNA, 20 bp, Artificial
  CRISPR gRNA sequence
tggctctgtgttgtttgtct

SEQ ID NO: 196194 - DNA, 20 bp, Artificial
  CRISPR gRNA sequence
tcaaataggtgctcaagaaa

SEQ ID NO: 196195 - DNA, 20 bp, Artificial
  CRISPR gRNA sequence
tcaagaaattggataattat

SEQ ID NO: 196196 - DNA, 20 bp, Artificial
  CRISPR gRNA sequence
gaaattggataattatgtga

SEQ ID NO: 196197 - DNA, 20 bp, Artificial
  CRISPR gRNA sequence
ataattatgtgaatgaattc

SEQ ID NO: 196198 - DNA, 20 bp, Artificial
  CRISPR gRNA sequence
tatgtgaatgaattcatgaa

SEQ ID NO: 196199 - DNA, 20 bp, Artificial
  CRISPR gRNA sequence
tgaatgaattcatgaattga

SEQ ID NO: 196200 - DNA, 20 bp, Artificial
  CRISPR gRNA sequence
tgaattcatgaattgaatga

SEQ ID NO: 196201 - DNA, 20 bp, Artificial
  CRISPR gRNA sequence
gaaaataagtatggacttac

SEQ ID NO: 196202 - DNA, 20 bp, Artificial
  CRISPR gRNA sequence
aatgaaaagtcttcaacact

SEQ ID NO: 196203 - DNA, 20 bp, Artificial
  CRISPR gRNA sequence
tcttcctctccatgcacaaa

SEQ ID NO: 196204 - DNA, 20 bp, Artificial
  CRISPR gRNA sequence
ggtctaattgtttttctact

SEQ ID NO: 196205 - DNA, 20 bp, Artificial
  CRISPR gRNA sequence
gagacacagtgtcccaatag

SEQ ID NO: 196206 - DNA, 20 bp, Artificial
  CRISPR gRNA sequence
gtataaatattatatggaga

SEQ ID NO: 196207 - DNA, 20 bp, Artificial
  CRISPR gRNA sequence
tggtttcatgtagacatccc

SEQ ID NO: 196208 - DNA, 20 bp, Artificial
  CRISPR gRNA sequence
ctatttgcttcctacataga

SEQ ID NO: 196209 - DNA, 20 bp, Artificial
  CRISPR gRNA sequence
tggcaagaagtacattggta

SEQ ID NO: 196210 - DNA, 20 bp, Artificial
  CRISPR gRNA sequence
atggagttcaggaaagagca

SEQ ID NO: 196211 - DNA, 20 bp, Artificial
  CRISPR gRNA sequence
caaccaagactgaaagatca

SEQ ID NO: 196212 - DNA, 20 bp, Artificial
  CRISPR gRNA sequence
tcagtagttaaccctgggaa

SEQ ID NO: 196213 - DNA, 20 bp, Artificial
  CRISPR gRNA sequence
ccattgtgtaaagtagaaga

SEQ ID NO: 196214 - DNA, 20 bp, Artificial
  CRISPR gRNA sequence
gtgtaaagtagaagaaagaa

SEQ ID NO: 196215 - DNA, 20 bp, Artificial
  CRISPR gRNA sequence
taaaatatagaacctaatgg

SEQ ID NO: 196216 - DNA, 20 bp, Artificial
  CRISPR gRNA sequence
tcagcaaatgccagtaggtc

SEQ ID NO: 196217 - DNA, 20 bp, Artificial
  CRISPR gRNA sequence
agcaaatatcctcatctttc

SEQ ID NO: 196218 - DNA, 20 bp, Artificial
  CRISPR gRNA sequence
aagtcccatattgtcatatt

SEQ ID NO: 196219 - DNA, 20 bp, Artificial
  CRISPR gRNA sequence
taagtgaagcagtcttcttt

SEQ ID NO: 196220 - DNA, 20 bp, Artificial
  CRISPR gRNA sequence
atattttaaatattttaacc

SEQ ID NO: 196221 - DNA, 20 bp, Artificial
  CRISPR gRNA sequence
tggcctgtatgtatacattt

SEQ ID NO: 196222 - DNA, 20 bp, Artificial
  CRISPR gRNA sequence
ctgtatgtatacatttattt

SEQ ID NO: 196223 - DNA, 20 bp, Artificial
  CRISPR gRNA sequence
ttcttgccagaaaactgatc

SEQ ID NO: 196224 - DNA, 20 bp, Artificial
  CRISPR gRNA sequence
tataatatttatacagtaat

SEQ ID NO: 196225 - DNA, 20 bp, Artificial
  CRISPR gRNA sequence
gtttataaattgtgggggca

SEQ ID NO: 196226 - DNA, 20 bp, Artificial
  CRISPR gRNA sequence
tcaagcccattggataaaat

SEQ ID NO: 196227 - DNA, 20 bp, Artificial
  CRISPR gRNA sequence
ataacataaccgaccagata

SEQ ID NO: 196228 - DNA, 20 bp, Artificial
  CRISPR gRNA sequence
aaacgctgtgccaattttgt

SEQ ID NO: 196229 - DNA, 20 bp, Artificial
  CRISPR gRNA sequence
tcgaggaattttcccttttc

SEQ ID NO: 196230 - DNA, 20 bp, Artificial
  CRISPR gRNA sequence
gagccatgttctacagtatg

SEQ ID NO: 196231 - DNA, 20 bp, Artificial
  CRISPR gRNA sequence
ttttttattttattaggtcc

SEQ ID NO: 196232 - DNA, 20 bp, Artificial
  CRISPR gRNA sequence
gttatcaggtcacttgagtt

SEQ ID NO: 196233 - DNA, 20 bp, Artificial
  CRISPR gRNA sequence
agctaagtaaaggaaaacac

SEQ ID NO: 196234 - DNA, 20 bp, Artificial
  CRISPR gRNA sequence
aaacacctctgctttcattg

SEQ ID NO: 196235 - DNA, 20 bp, Artificial
  CRISPR gRNA sequence
ctgcccctctagttgtagtc

SEQ ID NO: 196236 - DNA, 20 bp, Artificial
  CRISPR gRNA sequence
aactcaaaaacaaaatcatg

SEQ ID NO: 196237 - DNA, 20 bp, Artificial
  CRISPR gRNA sequence
gtggggattaagagaaatgt

SEQ ID NO: 196238 - DNA, 20 bp, Artificial
  CRISPR gRNA sequence
caagaagataccacttgtaa

SEQ ID NO: 196239 - DNA, 20 bp, Artificial
  CRISPR gRNA sequence
aattttcattatattttacc

SEQ ID NO: 196240 - DNA, 20 bp, Artificial
  CRISPR gRNA sequence
catgacatctcttgagatgt

SEQ ID NO: 196241 - DNA, 20 bp, Artificial
  CRISPR gRNA sequence
gagatgttgtggtttatact

SEQ ID NO: 196242 - DNA, 20 bp, Artificial
  CRISPR gRNA sequence
ggaagaaggcagcataaagt

SEQ ID NO: 196243 - DNA, 20 bp, Artificial
  CRISPR gRNA sequence
aggcagcataaagtataagt

SEQ ID NO: 196244 - DNA, 20 bp, Artificial
  CRISPR gRNA sequence
cagctgtccttgtagtaggg

SEQ ID NO: 196245 - DNA, 20 bp, Artificial
  CRISPR gRNA sequence
ataggaaatcttccggcact

SEQ ID NO: 196246 - DNA, 20 bp, Artificial
  CRISPR gRNA sequence
ggagcaaagcaaatgaccaa

SEQ ID NO: 196247 - DNA, 20 bp, Artificial
  CRISPR gRNA sequence
atgaccaaccaggtttgagg

SEQ ID NO: 196248 - DNA, 20 bp, Artificial
  CRISPR gRNA sequence
caaccaggtttgaggacctg

SEQ ID NO: 196249 - DNA, 20 bp, Artificial
  CRISPR gRNA sequence
ccatcttgtcatttgcatac

SEQ ID NO: 196250 - DNA, 20 bp, Artificial
  CRISPR gRNA sequence
gtcatttgcatacagtggtt

SEQ ID NO: 196251 - DNA, 20 bp, Artificial
  CRISPR gRNA sequence
cacttagaacaaggcaacca

SEQ ID NO: 196252 - DNA, 20 bp, Artificial
  CRISPR gRNA sequence
tctccaatggaaatgaggca

SEQ ID NO: 196253 - DNA, 20 bp, Artificial
  CRISPR gRNA sequence
aaatgaggcagctggcttgc

SEQ ID NO: 196254 - DNA, 20 bp, Artificial
  CRISPR gRNA sequence
cctgagtcacctccatatgc

SEQ ID NO: 196255 - DNA, 20 bp, Artificial
  CRISPR gRNA sequence
tcacagcaaatgtgtggtaa

SEQ ID NO: 196256 - DNA, 20 bp, Artificial
  CRISPR gRNA sequence
tggtaacatagcttccccac

SEQ ID NO: 196257 - DNA, 20 bp, Artificial
  CRISPR gRNA sequence
aaaactgaaatttgaaagaa

SEQ ID NO: 196258 - DNA, 20 bp, Artificial
  CRISPR gRNA sequence
gaaatttgaaagaatttagt

SEQ ID NO: 196259 - DNA, 20 bp, Artificial
  CRISPR gRNA sequence
ttcgggtgttattgcacctt

SEQ ID NO: 196260 - DNA, 20 bp, Artificial
  CRISPR gRNA sequence
ttattgcacctttcttgttt

SEQ ID NO: 196261 - DNA, 20 bp, Artificial
  CRISPR gRNA sequence
ggccactaactttcaattaa

SEQ ID NO: 196262 - DNA, 20 bp, Artificial
  CRISPR gRNA sequence
tcagactttcagaaccttca

SEQ ID NO: 196263 - DNA, 20 bp, Artificial
  CRISPR gRNA sequence
tctctccccaaaattcccag

SEQ ID NO: 196264 - DNA, 20 bp, Artificial
  CRISPR gRNA sequence
tagcatatcatatcatactt

SEQ ID NO: 196265 - DNA, 20 bp, Artificial
  CRISPR gRNA sequence
tatcatatcatacttttctg

SEQ ID NO: 196266 - DNA, 20 bp, Artificial
  CRISPR gRNA sequence
gaatataaactccacaagca

SEQ ID NO: 196267 - DNA, 20 bp, Artificial
  CRISPR gRNA sequence
ccacaagcacaaagatttgg

SEQ ID NO: 196268 - DNA, 20 bp, Artificial
  CRISPR gRNA sequence
tatttgttgagtcaatgaat

SEQ ID NO: 196269 - DNA, 20 bp, Artificial
  CRISPR gRNA sequence
tgaatgaatgatttcctcaa

SEQ ID NO: 196270 - DNA, 20 bp, Artificial
  CRISPR gRNA sequence
cctaaaattttggaaacatg

SEQ ID NO: 196271 - DNA, 20 bp, Artificial
  CRISPR gRNA sequence
actgttcatcaggaactgtt

SEQ ID NO: 196272 - DNA, 20 bp, Artificial
  CRISPR gRNA sequence
cgagtactactacaattagc

SEQ ID NO: 196273 - DNA, 20 bp, Artificial
  CRISPR gRNA sequence
tggaaatgactctagggggt

SEQ ID NO: 196274 - DNA, 20 bp, Artificial
  CRISPR gRNA sequence
gtgtctttcaatgatggaat

SEQ ID NO: 196275 - DNA, 20 bp, Artificial
  CRISPR gRNA sequence
taaagctagttctaaaccca

SEQ ID NO: 196276 - DNA, 20 bp, Artificial
  CRISPR gRNA sequence
caaaactatcatgacctttt

SEQ ID NO: 196277 - DNA, 20 bp, Artificial
  CRISPR gRNA sequence
ctatcatgaccttttcttgg

SEQ ID NO: 196278 - DNA, 20 bp, Artificial
  CRISPR gRNA sequence
gtgttctgggtctgcaaaaa

SEQ ID NO: 196279 - DNA, 20 bp, Artificial
  CRISPR gRNA sequence
ctgtaaaacattttgaactc

SEQ ID NO: 196280 - DNA, 20 bp, Artificial
  CRISPR gRNA sequence
taagttgtatcataagaaac

SEQ ID NO: 196281 - DNA, 20 bp, Artificial
  CRISPR gRNA sequence
aaaatttaataaacaatatt

SEQ ID NO: 196282 - DNA, 20 bp, Artificial
  CRISPR gRNA sequence
ttttcagtttttactaattg

SEQ ID NO: 196283 - DNA, 20 bp, Artificial
  CRISPR gRNA sequence
gtggatggtgtcaataatct

SEQ ID NO: 196284 - DNA, 20 bp, Artificial
  CRISPR gRNA sequence
ggtgtcaataatcttgaggt

SEQ ID NO: 196285 - DNA, 20 bp, Artificial
  CRISPR gRNA sequence
gcgaggtctaattaagtact

SEQ ID NO: 196286 - DNA, 20 bp, Artificial
  CRISPR gRNA sequence
ccgataaaaagtgtcacttc

SEQ ID NO: 196287 - DNA, 20 bp, Artificial
  CRISPR gRNA sequence
cttctgctgtttcctctggg

SEQ ID NO: 196288 - DNA, 20 bp, Artificial
  CRISPR gRNA sequence
tattagtattatcttcagtc

SEQ ID NO: 196289 - DNA, 20 bp, Artificial
  CRISPR gRNA sequence
ttgtgggaaactttttaatt

SEQ ID NO: 196290 - DNA, 20 bp, Artificial
  CRISPR gRNA sequence
ttgtttaattttgtaagatg

SEQ ID NO: 196291 - DNA, 20 bp, Artificial
  CRISPR gRNA sequence
acacataagaactattattt

SEQ ID NO: 196292 - DNA, 20 bp, Artificial
  CRISPR gRNA sequence
gtgttttgaaatcataattt

SEQ ID NO: 196293 - DNA, 20 bp, Artificial
  CRISPR gRNA sequence
atcataattttattgatttc

SEQ ID NO: 196294 - DNA, 20 bp, Artificial
  CRISPR gRNA sequence
tttccagtgtttccactggt

SEQ ID NO: 196295 - DNA, 20 bp, Artificial
  CRISPR gRNA sequence
aaacatcactcattatttat

SEQ ID NO: 196296 - DNA, 20 bp, Artificial
  CRISPR gRNA sequence
tttcagtttcatttgatcct

SEQ ID NO: 196297 - DNA, 20 bp, Artificial
  CRISPR gRNA sequence
ctatagtattagaagtaaaa

SEQ ID NO: 196298 - DNA, 20 bp, Artificial
  CRISPR gRNA sequence
ttccttgagcataattactt

SEQ ID NO: 196299 - DNA, 20 bp, Artificial
  CRISPR gRNA sequence
tattaaaatagccagcattt

SEQ ID NO: 196300 - DNA, 20 bp, Artificial
  CRISPR gRNA sequence
tggaggaatggaataaatta

SEQ ID NO: 196301 - DNA, 20 bp, Artificial
  CRISPR gRNA sequence
tgtactaacgtccttagtta

SEQ ID NO: 196302 - DNA, 20 bp, Artificial
  CRISPR gRNA sequence
gtatcaccaggaacatatat

SEQ ID NO: 196303 - DNA, 20 bp, Artificial
  CRISPR gRNA sequence
aagtgaatgacacctcaaaa

SEQ ID NO: 196304 - DNA, 20 bp, Artificial
  CRISPR gRNA sequence
tgacacctcaaaatcaggtt

SEQ ID NO: 196305 - DNA, 20 bp, Artificial
  CRISPR gRNA sequence
aaaagaaagcataccagctg

SEQ ID NO: 196306 - DNA, 20 bp, Artificial
  CRISPR gRNA sequence
agcataccagctggagagat

SEQ ID NO: 196307 - DNA, 20 bp, Artificial
  CRISPR gRNA sequence
gagagattcatgtttataaa

SEQ ID NO: 196308 - DNA, 20 bp, Artificial
  CRISPR gRNA sequence
tgtatttgaatagaaagact

SEQ ID NO: 196309 - DNA, 20 bp, Artificial
  CRISPR gRNA sequence
tattacatagtggtgaagtc

SEQ ID NO: 196310 - DNA, 20 bp, Artificial
  CRISPR gRNA sequence
agtgtaaattaatctttaca

SEQ ID NO: 196311 - DNA, 20 bp, Artificial
  CRISPR gRNA sequence
tgagcccaataaatgtacca

SEQ ID NO: 196312 - DNA, 20 bp, Artificial
  CRISPR gRNA sequence
cagcaaaagccctgacttct

SEQ ID NO: 196313 - DNA, 20 bp, Artificial
  CRISPR gRNA sequence
caccaattccaagagagagg

SEQ ID NO: 196314 - DNA, 20 bp, Artificial
  CRISPR gRNA sequence
gagaatcaacacaacaacta

SEQ ID NO: 196315 - DNA, 20 bp, Artificial
  CRISPR gRNA sequence
agattttctactgcactttt

SEQ ID NO: 196316 - DNA, 20 bp, Artificial
  CRISPR gRNA sequence
gtctgcctatcatagtcatt

SEQ ID NO: 196317 - DNA, 20 bp, Artificial
  CRISPR gRNA sequence
aaatgaatgaatgaataaca

SEQ ID NO: 196318 - DNA, 20 bp, Artificial
  CRISPR gRNA sequence
gcaatccaacaccatgtggg

SEQ ID NO: 196319 - DNA, 20 bp, Artificial
  CRISPR gRNA sequence
agaggaatactcaattcagg

SEQ ID NO: 196320 - DNA, 20 bp, Artificial
  CRISPR gRNA sequence
tccaaatcctggcacatcag

SEQ ID NO: 196321 - DNA, 20 bp, Artificial
  CRISPR gRNA sequence
acaatatttcaactctagca

SEQ ID NO: 196322 - DNA, 20 bp, Artificial
  CRISPR gRNA sequence
gggcaaattactagacttct

SEQ ID NO: 196323 - DNA, 20 bp, Artificial
  CRISPR gRNA sequence
ctgtgtgcttcactttccct

SEQ ID NO: 196324 - DNA, 20 bp, Artificial
  CRISPR gRNA sequence
gtaggattataatctactga

SEQ ID NO: 196325 - DNA, 20 bp, Artificial
  CRISPR gRNA sequence
tgagcaagcttattgtaagg

SEQ ID NO: 196326 - DNA, 20 bp, Artificial
  CRISPR gRNA sequence
agattagcaacagtgtatga

SEQ ID NO: 196327 - DNA, 20 bp, Artificial
  CRISPR gRNA sequence
tacgagtcctcaggtattga

SEQ ID NO: 196328 - DNA, 20 bp, Artificial
  CRISPR gRNA sequence
tgaactggctttcagtaaaa

SEQ ID NO: 196329 - DNA, 20 bp, Artificial
  CRISPR gRNA sequence
gtgggttcctgccatttaca

SEQ ID NO: 196330 - DNA, 20 bp, Artificial
  CRISPR gRNA sequence
aactcacctaactgcactga

SEQ ID NO: 196331 - DNA, 20 bp, Artificial
  CRISPR gRNA sequence
ctgtttcctcatctgtaaat

SEQ ID NO: 196332 - DNA, 20 bp, Artificial
  CRISPR gRNA sequence
gctggctgttgttgtgtctt

SEQ ID NO: 196333 - DNA, 20 bp, Artificial
  CRISPR gRNA sequence
ggagcctagtaagagatact

SEQ ID NO: 196334 - DNA, 20 bp, Artificial
  CRISPR gRNA sequence
tctgccatgtactgtaggct

SEQ ID NO: 196335 - DNA, 20 bp, Artificial
  CRISPR gRNA sequence
tgggcagatcacttgaggtc

SEQ ID NO: 196336 - DNA, 20 bp, Artificial
  CRISPR gRNA sequence
tcgggagactgaggcacaag

SEQ ID NO: 196337 - DNA, 20 bp, Artificial
  CRISPR gRNA sequence
gaggcggaagttgcagtgag

SEQ ID NO: 196338 - DNA, 20 bp, Artificial
  CRISPR gRNA sequence
cagcaccaccttttcaaagc

SEQ ID NO: 196339 - DNA, 20 bp, Artificial
  CRISPR gRNA sequence
ccatcaaaattttatcttta

SEQ ID NO: 196340 - DNA, 20 bp, Artificial
  CRISPR gRNA sequence
caaaattttatctttagtca

SEQ ID NO: 196341 - DNA, 20 bp, Artificial
  CRISPR gRNA sequence
tttatctttagtcagtttgt

SEQ ID NO: 196342 - DNA, 20 bp, Artificial
  CRISPR gRNA sequence
ctttagtcagtttgttttcg

SEQ ID NO: 196343 - DNA, 20 bp, Artificial
  CRISPR gRNA sequence
gtcagtttgttttcgttttg

SEQ ID NO: 196344 - DNA, 20 bp, Artificial
  CRISPR gRNA sequence
gtgtagcactgacattcatc

SEQ ID NO: 196345 - DNA, 20 bp, Artificial
  CRISPR gRNA sequence
aggtagaagatgcagtgtca

SEQ ID NO: 196346 - DNA, 20 bp, Artificial
  CRISPR gRNA sequence
tcttgcattagttgcaacca

SEQ ID NO: 196347 - DNA, 20 bp, Artificial
  CRISPR gRNA sequence
agttcctctgtagaactgta

SEQ ID NO: 196348 - DNA, 20 bp, Artificial
  CRISPR gRNA sequence
atagggaagtagaatatgga

SEQ ID NO: 196349 - DNA, 20 bp, Artificial
  CRISPR gRNA sequence
taactgagagagtagagata

SEQ ID NO: 196350 - DNA, 20 bp, Artificial
  CRISPR gRNA sequence
agatagccagaatataagga

SEQ ID NO: 196351 - DNA, 20 bp, Artificial
  CRISPR gRNA sequence
acagtaagatcctgagatgg

SEQ ID NO: 196352 - DNA, 20 bp, Artificial
  CRISPR gRNA sequence
tttgaatatttctctggaaa

SEQ ID NO: 196353 - DNA, 20 bp, Artificial
  CRISPR gRNA sequence
aggatgtccaccagacttcc

SEQ ID NO: 196354 - DNA, 20 bp, Artificial
  CRISPR gRNA sequence
ccagacttcctagggattac

SEQ ID NO: 196355 - DNA, 20 bp, Artificial
  CRISPR gRNA sequence
gctgtgctatatggaaataa

SEQ ID NO: 196356 - DNA, 20 bp, Artificial
  CRISPR gRNA sequence
agaactcctccaccgtctga

SEQ ID NO: 196357 - DNA, 20 bp, Artificial
  CRISPR gRNA sequence
ggagcagggaaggggaagga

SEQ ID NO: 196358 - DNA, 20 bp, Artificial
  CRISPR gRNA sequence
acttaggtggatggataatt

SEQ ID NO: 196359 - DNA, 20 bp, Artificial
  CRISPR gRNA sequence
cacacagctgatcacaaaaa

SEQ ID NO: 196360 - DNA, 20 bp, Artificial
  CRISPR gRNA sequence
cagacccttactcttaaccc

SEQ ID NO: 196361 - DNA, 20 bp, Artificial
  CRISPR gRNA sequence
gcttcaatccattttgctac

SEQ ID NO: 196362 - DNA, 20 bp, Artificial
  CRISPR gRNA sequence
aactaagaagaaagttatat

SEQ ID NO: 196363 - DNA, 20 bp, Artificial
  CRISPR gRNA sequence
aaccaaacttaacaatgagc

SEQ ID NO: 196364 - DNA, 20 bp, Artificial
  CRISPR gRNA sequence
attaacctggacaagctcag

SEQ ID NO: 196365 - DNA, 20 bp, Artificial
  CRISPR gRNA sequence
ttgtaaagctaagtagcaaa

SEQ ID NO: 196366 - DNA, 20 bp, Artificial
  CRISPR gRNA sequence
tcccaatttgctcaggactg

SEQ ID NO: 196367 - DNA, 20 bp, Artificial
  CRISPR gRNA sequence
aattgggtacaaatataacc

SEQ ID NO: 196368 - DNA, 20 bp, Artificial
  CRISPR gRNA sequence
atcatatcagcaactatgag

SEQ ID NO: 196369 - DNA, 20 bp, Artificial
  CRISPR gRNA sequence
aactatgagttatgtttttt

SEQ ID NO: 196370 - DNA, 20 bp, Artificial
  CRISPR gRNA sequence
tggaacttctgatcttcaag

SEQ ID NO: 196371 - DNA, 20 bp, Artificial
  CRISPR gRNA sequence
tcaagcagggattctcaacc

SEQ ID NO: 196372 - DNA, 20 bp, Artificial
  CRISPR gRNA sequence
ctaaaccacaggttgagaat

SEQ ID NO: 196373 - DNA, 20 bp, Artificial
  CRISPR gRNA sequence
tgaagatcagaagttccaat

SEQ ID NO: 196374 - DNA, 20 bp, Artificial
  CRISPR gRNA sequence
ctcagtcctgagcaaattgg

SEQ ID NO: 196375 - DNA, 20 bp, Artificial
  CRISPR gRNA sequence
gacccaaacaacatttgcta

SEQ ID NO: 196376 - DNA, 20 bp, Artificial
  CRISPR gRNA sequence
ggccacagaatgaaacttgc

SEQ ID NO: 196377 - DNA, 20 bp, Artificial
  CRISPR gRNA sequence
gagcttgtccaggttaatta

SEQ ID NO: 196378 - DNA, 20 bp, Artificial
  CRISPR gRNA sequence
ctttaaacttgggctcattg

SEQ ID NO: 196379 - DNA, 20 bp, Artificial
  CRISPR gRNA sequence
aacttgggctcattgttaag

SEQ ID NO: 196380 - DNA, 20 bp, Artificial
  CRISPR gRNA sequence
tcttagttcaataacctgga

SEQ ID NO: 196381 - DNA, 20 bp, Artificial
  CRISPR gRNA sequence
acctggatgaggtttttctg

SEQ ID NO: 196382 - DNA, 20 bp, Artificial
  CRISPR gRNA sequence
aatgtaaacatttgtagcaa

SEQ ID NO: 196383 - DNA, 20 bp, Artificial
  CRISPR gRNA sequence
tgtggttaggctaatggccc

SEQ ID NO: 196384 - DNA, 20 bp, Artificial
  CRISPR gRNA sequence
gttaggctaatggcccccaa

SEQ ID NO: 196385 - DNA, 20 bp, Artificial
  CRISPR gRNA sequence
tttacattatcttcttgacc

SEQ ID NO: 196386 - DNA, 20 bp, Artificial
  CRISPR gRNA sequence
ctttggtaatggcaaggggt

SEQ ID NO: 196387 - DNA, 20 bp, Artificial
  CRISPR gRNA sequence
ctgctagggtgcagggcaac

SEQ ID NO: 196388 - DNA, 20 bp, Artificial
  CRISPR gRNA sequence
ccagcattctttaaaaggag

SEQ ID NO: 196389 - DNA, 20 bp, Artificial
  CRISPR gRNA sequence
aaggagaggagattatgact

SEQ ID NO: 196390 - DNA, 20 bp, Artificial
  CRISPR gRNA sequence
actgatggatttctctttgt

SEQ ID NO: 196391 - DNA, 20 bp, Artificial
  CRISPR gRNA sequence
ggatttctctttgttattgc

SEQ ID NO: 196392 - DNA, 20 bp, Artificial
  CRISPR gRNA sequence
tctttgttattgctttagct

SEQ ID NO: 196393 - DNA, 20 bp, Artificial
  CRISPR gRNA sequence
tccttctgatattcttacca

SEQ ID NO: 196394 - DNA, 20 bp, Artificial
  CRISPR gRNA sequence
attcttaccactttgcttct

SEQ ID NO: 196395 - DNA, 20 bp, Artificial
  CRISPR gRNA sequence
tctacatcccatacagtgac

SEQ ID NO: 196396 - DNA, 20 bp, Artificial
  CRISPR gRNA sequence
ttaattcaatagtgtagggc

SEQ ID NO: 196397 - DNA, 20 bp, Artificial
  CRISPR gRNA sequence
ttctgaggtattttaatatc

SEQ ID NO: 196398 - DNA, 20 bp, Artificial
  CRISPR gRNA sequence
ttaagaatataatttttgga

SEQ ID NO: 196399 - DNA, 20 bp, Artificial
  CRISPR gRNA sequence
tatttgaatatactcatttt

SEQ ID NO: 196400 - DNA, 20 bp, Artificial
  CRISPR gRNA sequence
attctcctgcccctcacccc

SEQ ID NO: 196401 - DNA, 20 bp, Artificial
  CRISPR gRNA sequence
atcttcacccagtgatccca

SEQ ID NO: 196402 - DNA, 20 bp, Artificial
  CRISPR gRNA sequence
accaccttgcagaggttaag

SEQ ID NO: 196403 - DNA, 20 bp, Artificial
  CRISPR gRNA sequence
gtcaggagaatggtcatcct

SEQ ID NO: 196404 - DNA, 20 bp, Artificial
  CRISPR gRNA sequence
gagaatggtcatccttgaag

SEQ ID NO: 196405 - DNA, 20 bp, Artificial
  CRISPR gRNA sequence
tggtcatccttgaagtttag

SEQ ID NO: 196406 - DNA, 20 bp, Artificial
  CRISPR gRNA sequence
aggataattttcttaaatgc

SEQ ID NO: 196407 - DNA, 20 bp, Artificial
  CRISPR gRNA sequence
catggagaagtgtgagaagc

SEQ ID NO: 196408 - DNA, 20 bp, Artificial
  CRISPR gRNA sequence
gctaaattctgctgccctta

SEQ ID NO: 196409 - DNA, 20 bp, Artificial
  CRISPR gRNA sequence
ttgtgaggctaatatttata

SEQ ID NO: 196410 - DNA, 20 bp, Artificial
  CRISPR gRNA sequence
tgctcactattaaatggcgg

SEQ ID NO: 196411 - DNA, 20 bp, Artificial
  CRISPR gRNA sequence
gccttgattatttcacttcc

SEQ ID NO: 196412 - DNA, 20 bp, Artificial
  CRISPR gRNA sequence
tgcctcagtctcccgagtag

SEQ ID NO: 196413 - DNA, 20 bp, Artificial
  CRISPR gRNA sequence
ttttatatttttagtaaagg

SEQ ID NO: 196414 - DNA, 20 bp, Artificial
  CRISPR gRNA sequence
caccttggcctcccaaagtg

SEQ ID NO: 196415 - DNA, 20 bp, Artificial
  CRISPR gRNA sequence
ccacctcctcctatctgtca

SEQ ID NO: 196416 - DNA, 20 bp, Artificial
  CRISPR gRNA sequence
ctgtcatcatgattggaggc

SEQ ID NO: 196417 - DNA, 20 bp, Artificial
  CRISPR gRNA sequence
cttgttgtcttatctttctc

SEQ ID NO: 196418 - DNA, 20 bp, Artificial
  CRISPR gRNA sequence
actttaaagacacaacaaca

SEQ ID NO: 196419 - DNA, 20 bp, Artificial
  CRISPR gRNA sequence
agccagctttttccgtaact

SEQ ID NO: 196420 - DNA, 20 bp, Artificial
  CRISPR gRNA sequence
agtttacaatgcctgttcac

SEQ ID NO: 196421 - DNA, 20 bp, Artificial
  CRISPR gRNA sequence
cctgttcacgtatgttttat

SEQ ID NO: 196422 - DNA, 20 bp, Artificial
  CRISPR gRNA sequence
caacaagtaagttgtcataa

SEQ ID NO: 196423 - DNA, 20 bp, Artificial
  CRISPR gRNA sequence
aaatggcaggaacccactaa

SEQ ID NO: 196424 - DNA, 20 bp, Artificial
  CRISPR gRNA sequence
agagcatccccatcattttc

SEQ ID NO: 196425 - DNA, 20 bp, Artificial
  CRISPR gRNA sequence
ctttctgttcacaacaccgt

SEQ ID NO: 196426 - DNA, 20 bp, Artificial
  CRISPR gRNA sequence
cgtcctggattatcttttcc

SEQ ID NO: 196427 - DNA, 20 bp, Artificial
  CRISPR gRNA sequence
acttttctatctaatttttc

SEQ ID NO: 196428 - DNA, 20 bp, Artificial
  CRISPR gRNA sequence
cagctcttctcagaatatct

SEQ ID NO: 196429 - DNA, 20 bp, Artificial
  CRISPR gRNA sequence
ttgctaatctgacccttaca

SEQ ID NO: 196430 - DNA, 20 bp, Artificial
  CRISPR gRNA sequence
cccttacaataagcttgctc

SEQ ID NO: 196431 - DNA, 20 bp, Artificial
  CRISPR gRNA sequence
caccggggagaaagggtccc

SEQ ID NO: 196432 - DNA, 20 bp, Artificial
  CRISPR gRNA sequence
agggaagcagctctgatgtg

SEQ ID NO: 196433 - DNA, 20 bp, Artificial
  CRISPR gRNA sequence
gcagctctgatgtgccagga

SEQ ID NO: 196434 - DNA, 20 bp, Artificial
  CRISPR gRNA sequence
gtattcctctcaggtattcc

SEQ ID NO: 196435 - DNA, 20 bp, Artificial
  CRISPR gRNA sequence
gaaagcatttcccacatggt

SEQ ID NO: 196436 - DNA, 20 bp, Artificial
  CRISPR gRNA sequence
ttcccacatggtgttggatt

SEQ ID NO: 196437 - DNA, 20 bp, Artificial
  CRISPR gRNA sequence
atggtgttggattgcctgtt

SEQ ID NO: 196438 - DNA, 20 bp, Artificial
  CRISPR gRNA sequence
tgttggattgcctgtttttt

SEQ ID NO: 196439 - DNA, 20 bp, Artificial
  CRISPR gRNA sequence
tgcctgttttttgtttgttt

SEQ ID NO: 196440 - DNA, 20 bp, Artificial
  CRISPR gRNA sequence
tgtttgtttcttagtttttt

SEQ ID NO: 196441 - DNA, 20 bp, Artificial
  CRISPR gRNA sequence
atattccataaatatctgct

SEQ ID NO: 196442 - DNA, 20 bp, Artificial
  CRISPR gRNA sequence
gaatgtttattaagtaacaa

SEQ ID NO: 196443 - DNA, 20 bp, Artificial
  CRISPR gRNA sequence
tgggatgaccaattcagctg

SEQ ID NO: 196444 - DNA, 20 bp, Artificial
  CRISPR gRNA sequence
gaaaatctcattagttgttg

SEQ ID NO: 196445 - DNA, 20 bp, Artificial
  CRISPR gRNA sequence
tcagtgtgctggtcacattg

SEQ ID NO: 196446 - DNA, 20 bp, Artificial
  CRISPR gRNA sequence
accactcaggacttgatggt

SEQ ID NO: 196447 - DNA, 20 bp, Artificial
  CRISPR gRNA sequence
atccacaaccaaaattcttt

SEQ ID NO: 196448 - DNA, 20 bp, Artificial
  CRISPR gRNA sequence
ggacataaacaaaaagaagt

SEQ ID NO: 196449 - DNA, 20 bp, Artificial
  CRISPR gRNA sequence
gctgagcacagaactacgta

SEQ ID NO: 196450 - DNA, 20 bp, Artificial
  CRISPR gRNA sequence
gcaggctggttctcagaggg

SEQ ID NO: 196451 - DNA, 20 bp, Artificial
  CRISPR gRNA sequence
caattcaattcaaagttggg

SEQ ID NO: 196452 - DNA, 20 bp, Artificial
  CRISPR gRNA sequence
caattcaaagttgggacaag

SEQ ID NO: 196453 - DNA, 20 bp, Artificial
  CRISPR gRNA sequence
tattgggctcaaacaaaatg

SEQ ID NO: 196454 - DNA, 20 bp, Artificial
  CRISPR gRNA sequence
aaatatccctctccatttgt

SEQ ID NO: 196455 - DNA, 20 bp, Artificial
  CRISPR gRNA sequence
ctccatttgttcaggttttc

SEQ ID NO: 196456 - DNA, 20 bp, Artificial
  CRISPR gRNA sequence
ttttcatatgtttctcagta

SEQ ID NO: 196457 - DNA, 20 bp, Artificial
  CRISPR gRNA sequence
aacatgaatctctccagctg

SEQ ID NO: 196458 - DNA, 20 bp, Artificial
  CRISPR gRNA sequence
tagacttcagtaaacagaaa

SEQ ID NO: 196459 - DNA, 20 bp, Artificial
  CRISPR gRNA sequence
ttttgaggtgtcattcactt

SEQ ID NO: 196460 - DNA, 20 bp, Artificial
  CRISPR gRNA sequence
atgttcctggtgatactttt

SEQ ID NO: 196461 - DNA, 20 bp, Artificial
  CRISPR gRNA sequence
ttaaatttgttctttatttt

SEQ ID NO: 196462 - DNA, 20 bp, Artificial
  CRISPR gRNA sequence
gagttactgtatactcctta

SEQ ID NO: 196463 - DNA, 20 bp, Artificial
  CRISPR gRNA sequence
tgcataatttattccattcc

SEQ ID NO: 196464 - DNA, 20 bp, Artificial
  CRISPR gRNA sequence
cacattatgatatttacatt

SEQ ID NO: 196465 - DNA, 20 bp, Artificial
  CRISPR gRNA sequence
aagtaattatgctcaaggaa

SEQ ID NO: 196466 - DNA, 20 bp, Artificial
  CRISPR gRNA sequence
aattatgctcaaggaagaaa

SEQ ID NO: 196467 - DNA, 20 bp, Artificial
  CRISPR gRNA sequence
gtttgattcaattttagatc

SEQ ID NO: 196468 - DNA, 20 bp, Artificial
  CRISPR gRNA sequence
atcattggtttgggaccctt

SEQ ID NO: 196469 - DNA, 20 bp, Artificial
  CRISPR gRNA sequence
accctttcaggattaagata

SEQ ID NO: 196470 - DNA, 20 bp, Artificial
  CRISPR gRNA sequence
cgtagtttgctgacaattct

SEQ ID NO: 196471 - DNA, 20 bp, Artificial
  CRISPR gRNA sequence
gtttgctgacaattctagta

SEQ ID NO: 196472 - DNA, 20 bp, Artificial
  CRISPR gRNA sequence
ttagtgcacctatatagcat

SEQ ID NO: 196473 - DNA, 20 bp, Artificial
  CRISPR gRNA sequence
atatagcataagagctttat

SEQ ID NO: 196474 - DNA, 20 bp, Artificial
  CRISPR gRNA sequence
attcctttaccaaggacagc

SEQ ID NO: 196475 - DNA, 20 bp, Artificial
  CRISPR gRNA sequence
aaactgaaataaataatgag

SEQ ID NO: 196476 - DNA, 20 bp, Artificial
  CRISPR gRNA sequence
aacactggaaatcaataaaa

SEQ ID NO: 196477 - DNA, 20 bp, Artificial
  CRISPR gRNA sequence
aataatagttcttatgtgta

SEQ ID NO: 196478 - DNA, 20 bp, Artificial
  CRISPR gRNA sequence
gtaggttgctttggggtagc

SEQ ID NO: 196479 - DNA, 20 bp, Artificial
  CRISPR gRNA sequence
caaaattaaacaactaatta

SEQ ID NO: 196480 - DNA, 20 bp, Artificial
  CRISPR gRNA sequence
tatataaaaaaacacaaacc

SEQ ID NO: 196481 - DNA, 20 bp, Artificial
  CRISPR gRNA sequence
caattagtaaaaactgaaaa

SEQ ID NO: 196482 - DNA, 20 bp, Artificial
  CRISPR gRNA sequence
ttatttcaacctcttaaaat

SEQ ID NO: 196483 - DNA, 20 bp, Artificial
  CRISPR gRNA sequence
tttttttgctcttcaaaaac

SEQ ID NO: 196484 - DNA, 20 bp, Artificial
  CRISPR gRNA sequence
tgcacaaacacacgagttca

SEQ ID NO: 196485 - DNA, 20 bp, Artificial
  CRISPR gRNA sequence
caaaaccaagaaaaggtcat

SEQ ID NO: 196486 - DNA, 20 bp, Artificial
  CRISPR gRNA sequence
gggcccagacttcagagcta

SEQ ID NO: 196487 - DNA, 20 bp, Artificial
  CRISPR gRNA sequence
agacttcagagctaatctgc

SEQ ID NO: 196488 - DNA, 20 bp, Artificial
  CRISPR gRNA sequence
ctaatctgcttgggtttaga

SEQ ID NO: 196489 - DNA, 20 bp, Artificial
  CRISPR gRNA sequence
attacttaatttctttggac

SEQ ID NO: 196490 - DNA, 20 bp, Artificial
  CRISPR gRNA sequence
aataccacttatcatggaat

SEQ ID NO: 196491 - DNA, 20 bp, Artificial
  CRISPR gRNA sequence
ttccatcattgaaagacaca

SEQ ID NO: 196492 - DNA, 20 bp, Artificial
  CRISPR gRNA sequence
tttcacatatccaaatctgt

SEQ ID NO: 196493 - DNA, 20 bp, Artificial
  CRISPR gRNA sequence
tataaaacaggcccaaatct

SEQ ID NO: 196494 - DNA, 20 bp, Artificial
  CRISPR gRNA sequence
ggcccaaatctttgtgcttg

SEQ ID NO: 196495 - DNA, 20 bp, Artificial
  CRISPR gRNA sequence
ggttggtggggaatgacagc

SEQ ID NO: 196496 - DNA, 20 bp, Artificial
  CRISPR gRNA sequence
gatttggtccatatgatcca

SEQ ID NO: 196497 - DNA, 20 bp, Artificial
  CRISPR gRNA sequence
tctgaaagtctgaatgaaca

SEQ ID NO: 196498 - DNA, 20 bp, Artificial
  CRISPR gRNA sequence
gttttccctgctgttaggtt

SEQ ID NO: 196499 - DNA, 20 bp, Artificial
  CRISPR gRNA sequence
aaaactaaattctttcaaat

SEQ ID NO: 196500 - DNA, 20 bp, Artificial
  CRISPR gRNA sequence
tctttcaaatttcagttttg

SEQ ID NO: 196501 - DNA, 20 bp, Artificial
  CRISPR gRNA sequence
agacacggcctcagtgcaag

SEQ ID NO: 196502 - DNA, 20 bp, Artificial
  CRISPR gRNA sequence
ccactgtatgcaaatgacaa

SEQ ID NO: 196503 - DNA, 20 bp, Artificial
  CRISPR gRNA sequence
gtcctcaaacctggttggtc

SEQ ID NO: 196504 - DNA, 20 bp, Artificial
  CRISPR gRNA sequence
ttggaaaaaccatcagtgcc

SEQ ID NO: 196505 - DNA, 20 bp, Artificial
  CRISPR gRNA sequence
tgctgccttcttcctgactg

SEQ ID NO: 196506 - DNA, 20 bp, Artificial
  CRISPR gRNA sequence
ctgttgatgaggctaagtca

SEQ ID NO: 196507 - DNA, 20 bp, Artificial
  CRISPR gRNA sequence
atacatttctcttaatcccc

SEQ ID NO: 196508 - DNA, 20 bp, Artificial
  CRISPR gRNA sequence
ttctcttaatccccacatga

SEQ ID NO: 196509 - DNA, 20 bp, Artificial
  CRISPR gRNA sequence
atccccacatgattttgttt

SEQ ID NO: 196510 - DNA, 20 bp, Artificial
  CRISPR gRNA sequence
agtttatagttatcagtgat

SEQ ID NO: 196511 - DNA, 20 bp, Artificial
  CRISPR gRNA sequence
ttctacttgtattgttagcc

SEQ ID NO: 196512 - DNA, 20 bp, Artificial
  CRISPR gRNA sequence
ggaatggaaagaccaagggg

SEQ ID NO: 196513 - DNA, 20 bp, Artificial
  CRISPR gRNA sequence
cccaagactacaactagagg

SEQ ID NO: 196514 - DNA, 20 bp, Artificial
  CRISPR gRNA sequence
ctacaactagaggggcagat

SEQ ID NO: 196515 - DNA, 20 bp, Artificial
  CRISPR gRNA sequence
ataagaacagaagatcctct

SEQ ID NO: 196516 - DNA, 20 bp, Artificial
  CRISPR gRNA sequence
gggggatttttgttctttgt

SEQ ID NO: 196517 - DNA, 20 bp, Artificial
  CRISPR gRNA sequence
atttttgttctttgtgggag

SEQ ID NO: 196518 - DNA, 20 bp, Artificial
  CRISPR gRNA sequence
aaactcaacaatgaaagcag

SEQ ID NO: 196519 - DNA, 20 bp, Artificial
  CRISPR gRNA sequence
attccccaagacaacatcag

SEQ ID NO: 196520 - DNA, 20 bp, Artificial
  CRISPR gRNA sequence
atgaatatatgcccagtaag

SEQ ID NO: 196521 - DNA, 20 bp, Artificial
  CRISPR gRNA sequence
aataggttctttcacactta

SEQ ID NO: 196522 - DNA, 20 bp, Artificial
  CRISPR gRNA sequence
ttttaatgtgaaccttacag

SEQ ID NO: 196523 - DNA, 20 bp, Artificial
  CRISPR gRNA sequence
tactgtagaacatggctctg

SEQ ID NO: 196524 - DNA, 20 bp, Artificial
  CRISPR gRNA sequence
atggctctgtgttgtttgtc

SEQ ID NO: 196525 - DNA, 20 bp, Artificial
  CRISPR gRNA sequence
tgaatgaacagactatgctg

SEQ ID NO: 196526 - DNA, 20 bp, Artificial
  CRISPR gRNA sequence
aaaagtcttcaacacttgga

SEQ ID NO: 196527 - DNA, 20 bp, Artificial
  CRISPR gRNA sequence
taccattgactttcacagta

SEQ ID NO: 196528 - DNA, 20 bp, Artificial
  CRISPR gRNA sequence
caattagtgcagccaggtct

SEQ ID NO: 196529 - DNA, 20 bp, Artificial
  CRISPR gRNA sequence
aaacatttacaaaattggca

SEQ ID NO: 196530 - DNA, 20 bp, Artificial
  CRISPR gRNA sequence
ctaaacacatattttatcca

SEQ ID NO: 196531 - DNA, 20 bp, Artificial
  CRISPR gRNA sequence
ttttatccaatgggcttgaa

SEQ ID NO: 196532 - DNA, 20 bp, Artificial
  CRISPR gRNA sequence
agtccttacaaccagggaga

SEQ ID NO: 196533 - DNA, 20 bp, Artificial
  CRISPR gRNA sequence
tgtcctttgacaggacacct

SEQ ID NO: 196534 - DNA, 20 bp, Artificial
  CRISPR gRNA sequence
gcttcctacatagagggaat

SEQ ID NO: 196535 - DNA, 20 bp, Artificial
  CRISPR gRNA sequence
tttacttccctaaacttttg

SEQ ID NO: 196536 - DNA, 20 bp, Artificial
  CRISPR gRNA sequence
gttaaccctgggaaatgggt

SEQ ID NO: 196537 - DNA, 20 bp, Artificial
  CRISPR gRNA sequence
catgcattttaaatgatcat

SEQ ID NO: 196538 - DNA, 20 bp, Artificial
  CRISPR gRNA sequence
ttaaaatatagaacctaatg

SEQ ID NO: 196539 - DNA, 20 bp, Artificial
  CRISPR gRNA sequence
tatggaaaacacgaaaagaa

SEQ ID NO: 196540 - DNA, 20 bp, Artificial
  CRISPR gRNA sequence
ttttccataattagggcatt

SEQ ID NO: 196541 - DNA, 20 bp, Artificial
  CRISPR gRNA sequence
gtgtcattttgtaaaaatat

SEQ ID NO: 196542 - DNA, 20 bp, Artificial
  CRISPR gRNA sequence
cctgatgaggatactttaag

SEQ ID NO: 196543 - DNA, 20 bp, Artificial
  CRISPR gRNA sequence
ccataccaatgtacttcttg

SEQ ID NO: 196544 - DNA, 20 bp, Artificial
  CRISPR gRNA sequence
gaagtaaaaagagatgactg

SEQ ID NO: 196545 - DNA, 20 bp, Artificial
  CRISPR gRNA sequence
caattgaatgcaaattccca

SEQ ID NO: 196546 - DNA, 20 bp, Artificial
  CRISPR gRNA sequence
attactgtgaaagtcaatgg

SEQ ID NO: 196547 - DNA, 20 bp, Artificial
  CRISPR gRNA sequence
cagtatgtacagttttccaa

SEQ ID NO: 196548 - DNA, 20 bp, Artificial
  CRISPR gRNA sequence
accattatttgtgtgtccct

SEQ ID NO: 196549 - DNA, 20 bp, Artificial
  CRISPR gRNA sequence
tgctttcattgttgagtttc

SEQ ID NO: 196550 - DNA, 20 bp, Artificial
  CRISPR gRNA sequence
gatgaccttttaatatttga

SEQ ID NO: 196551 - DNA, 20 bp, Artificial
  CRISPR gRNA sequence
tctgagggctaacaatacaa

SEQ ID NO: 196552 - DNA, 20 bp, Artificial
  CRISPR gRNA sequence
acaaaatcatgtggggatta

SEQ ID NO: 196553 - DNA, 20 bp, Artificial
  CRISPR gRNA sequence
ctactgtgttccaagatatt

SEQ ID NO: 196554 - DNA, 20 bp, Artificial
  CRISPR gRNA sequence
catttcaaaactgaaatttg

SEQ ID NO: 196555 - DNA, 20 bp, Artificial
  CRISPR gRNA sequence
tgtttattgtctctctcctc

SEQ ID NO: 196556 - DNA, 20 bp, Artificial
  CRISPR gRNA sequence
ggatgaggaaactgaggtcc

SEQ ID NO: 196557 - DNA, 20 bp, Artificial
  CRISPR gRNA sequence
tttgcccaaattcacccagc

SEQ ID NO: 196558 - DNA, 20 bp, Artificial
  CRISPR gRNA sequence
ttaatatataagttgtatca

SEQ ID NO: 196559 - DNA, 20 bp, Artificial
  CRISPR gRNA sequence
agtttagtcaaaattagata

SEQ ID NO: 196560 - DNA, 20 bp, Artificial
  CRISPR gRNA sequence
gttttgtattaactctctgt

SEQ ID NO: 196561 - DNA, 20 bp, Artificial
  CRISPR gRNA sequence
gctgtccttggtaaaggaat

SEQ ID NO: 196562 - DNA, 20 bp, Artificial
  CRISPR gRNA sequence
taggtgcactaaacaatcta

SEQ ID NO: 196563 - DNA, 20 bp, Artificial
  CRISPR gRNA sequence
atcctagatagcatcccaga

SEQ ID NO: 196564 - DNA, 20 bp, Artificial
  CRISPR gRNA sequence
ttctgatcattgacttcaaa

SEQ ID NO: 196565 - DNA, 20 bp, Artificial
  CRISPR gRNA sequence
gttttctgtttactgaagtc

SEQ ID NO: 196566 - DNA, 20 bp, Artificial
  CRISPR gRNA sequence
ctgtttactgaagtctaaga

SEQ ID NO: 196567 - DNA, 20 bp, Artificial
  CRISPR gRNA sequence
aacaacaaaaataaaatatc

SEQ ID NO: 196568 - DNA, 20 bp, Artificial
  CRISPR gRNA sequence
tttaagaagaagcactttac

SEQ ID NO: 196569 - DNA, 20 bp, Artificial
  CRISPR gRNA sequence
gagggatattttgtatttga

SEQ ID NO: 196570 - DNA, 20 bp, Artificial
  CRISPR gRNA sequence
ttctctttaaattatttttt

SEQ ID NO: 196571 - DNA, 20 bp, Artificial
  CRISPR gRNA sequence
aatgtaccaacatgattttt

SEQ ID NO: 196572 - DNA, 20 bp, Artificial
  CRISPR gRNA sequence
cccatacaacaaaatcaacc

SEQ ID NO: 196573 - DNA, 20 bp, Artificial
  CRISPR gRNA sequence
tttcaatgtgaccagcacac

SEQ ID NO: 196574 - DNA, 20 bp, Artificial
  CRISPR gRNA sequence
gtagtactcattggatacac

SEQ ID NO: 196575 - DNA, 20 bp, Artificial
  CRISPR gRNA sequence
tcaggaaacagataaaaaac

SEQ ID NO: 196576 - DNA, 20 bp, Artificial
  CRISPR gRNA sequence
gacagagtctgatgagaggc

SEQ ID NO: 196577 - DNA, 20 bp, Artificial
  CRISPR gRNA sequence
gatgagaggctcagaatgtg

SEQ ID NO: 196578 - DNA, 20 bp, Artificial
  CRISPR gRNA sequence
aaaaacaactgaaaaattag

SEQ ID NO: 196579 - DNA, 20 bp, Artificial
  CRISPR gRNA sequence
aatccaggacggtgttgtga

SEQ ID NO: 196580 - DNA, 20 bp, Artificial
  CRISPR gRNA sequence
agaaagagggggaaaaaact

SEQ ID NO: 196581 - DNA, 20 bp, Artificial
  CRISPR gRNA sequence
tccagagatgttcaaactgc

SEQ ID NO: 196582 - DNA, 20 bp, Artificial
  CRISPR gRNA sequence
aggctactagcttctatatt

SEQ ID NO: 196583 - DNA, 20 bp, Artificial
  CRISPR gRNA sequence
ctactcgggagactgaggca

SEQ ID NO: 196584 - DNA, 20 bp, Artificial
  CRISPR gRNA sequence
tgcactccaccctgggcaac

SEQ ID NO: 196585 - DNA, 20 bp, Artificial
  CRISPR gRNA sequence
cattataaatattagcctca

SEQ ID NO: 196586 - DNA, 20 bp, Artificial
  CRISPR gRNA sequence
ctcaaaactggttaagggca

SEQ ID NO: 196587 - DNA, 20 bp, Artificial
  CRISPR gRNA sequence
gccactcaaactttggcatt

SEQ ID NO: 196588 - DNA, 20 bp, Artificial
  CRISPR gRNA sequence
actgacattcatcttccgtt

SEQ ID NO: 196589 - DNA, 20 bp, Artificial
  CRISPR gRNA sequence
cactgggggtgaggaagggg

SEQ ID NO: 196590 - DNA, 20 bp, Artificial
  CRISPR gRNA sequence
agcgtaaggggtgaggggca

SEQ ID NO: 196591 - DNA, 20 bp, Artificial
  CRISPR gRNA sequence
aataaccacagacttacaga

SEQ ID NO: 196592 - DNA, 20 bp, Artificial
  CRISPR gRNA sequence
gtctgatgttaaatagggaa

SEQ ID NO: 196593 - DNA, 20 bp, Artificial
  CRISPR gRNA sequence
tcttaacaggactgagatag

SEQ ID NO: 196594 - DNA, 20 bp, Artificial
  CRISPR gRNA sequence
gagatggagttgatttgcac

SEQ ID NO: 196595 - DNA, 20 bp, Artificial
  CRISPR gRNA sequence
gaaaaaaagattagttggca

SEQ ID NO: 196596 - DNA, 20 bp, Artificial
  CRISPR gRNA sequence
ttagttggcagtagaaatgg

SEQ ID NO: 196597 - DNA, 20 bp, Artificial
  CRISPR gRNA sequence
tcaatagatattaaaatacc

SEQ ID NO: 196598 - DNA, 20 bp, Artificial
  CRISPR gRNA sequence
aatgatttctttttctcaag

SEQ ID NO: 196599 - DNA, 20 bp, Artificial
  CRISPR gRNA sequence
aactcaaagaagcaaagtgg

SEQ ID NO: 196600 - DNA, 20 bp, Artificial
  CRISPR gRNA sequence
aaaagctaaagcaataacaa

SEQ ID NO: 196601 - DNA, 20 bp, Artificial
  CRISPR gRNA sequence
tcataatctcctctcctttt

SEQ ID NO: 196602 - DNA, 20 bp, Artificial
  CRISPR gRNA sequence
agagagagagagagagagag

SEQ ID NO: 196603 - DNA, 20 bp, Artificial
  CRISPR gRNA sequence
gagagagagagagagaaata

SEQ ID NO: 196604 - DNA, 20 bp, Artificial
  CRISPR gRNA sequence
atttatcctcattttacagt

SEQ ID NO: 196605 - DNA, 20 bp, Artificial
  CRISPR gRNA sequence
tgtttacatttataagcagg

SEQ ID NO: 196606 - DNA, 20 bp, Artificial
  CRISPR gRNA sequence
catccaggttattgaactaa

SEQ ID NO: 196607 - DNA, 20 bp, Artificial
  CRISPR gRNA sequence
ttctaatttttttaatgtag

SEQ ID NO: 196608 - DNA, 20 bp, Artificial
  CRISPR gRNA sequence
tgaacccctaaaccacaggt

SEQ ID NO: 196609 - DNA, 20 bp, Artificial
  CRISPR gRNA sequence
gtggtctggggaaaaagtaa

SEQ ID NO: 196610 - DNA, 20 bp, Artificial
  CRISPR gRNA sequence
taaatgataaatttgaaatg

SEQ ID NO: 196611 - DNA, 20 bp, Artificial
  CRISPR gRNA sequence
cacagatgatgctatgggcc

SEQ ID NO: 196612 - DNA, 20 bp, Artificial
  CRISPR gRNA sequence
ttctaactacattaaaaaaa

SEQ ID NO: 196613 - DNA, 20 bp, Artificial
  CRISPR gRNA sequence
caatactgacacacaatatt

SEQ ID NO: 196614 - DNA, 20 bp, Artificial
  CRISPR gRNA sequence
tcacatccatcattctccct

SEQ ID NO: 196615 - DNA, 20 bp, Artificial
  CRISPR gRNA sequence
ccatcattctcccttgagaa

SEQ ID NO: 196616 - DNA, 20 bp, Artificial
  CRISPR gRNA sequence
gccaactaatctttttttcc

SEQ ID NO: 196617 - DNA, 20 bp, Artificial
  CRISPR gRNA sequence
tctggctatctcagtcctgt

SEQ ID NO: 196618 - DNA, 20 bp, Artificial
  CRISPR gRNA sequence
aattgttcccacaggtaaat

SEQ ID NO: 196619 - DNA, 20 bp, Artificial
  CRISPR gRNA sequence
atttttattacttagggtac

SEQ ID NO: 196620 - DNA, 20 bp, Artificial
  CRISPR gRNA sequence
agtctgtggttattttcatg

SEQ ID NO: 196621 - DNA, 20 bp, Artificial
  CRISPR gRNA sequence
aaggcataataagatggctc

SEQ ID NO: 196622 - DNA, 20 bp, Artificial
  CRISPR gRNA sequence
attttgatgggaaggggtca

SEQ ID NO: 196623 - DNA, 20 bp, Artificial
  CRISPR gRNA sequence
ggggcagtgagcagctcttc

SEQ ID NO: 196624 - DNA, 20 bp, Artificial
  CRISPR gRNA sequence
taccttgggagaggcaccgg

SEQ ID NO: 196625 - DNA, 20 bp, Artificial
  CRISPR gRNA sequence
tccctcatgtttggcataag

SEQ ID NO: 196626 - DNA, 20 bp, Artificial
  CRISPR gRNA sequence
acatattttaatggacacat

SEQ ID NO: 196627 - DNA, 20 bp, Artificial
  CRISPR gRNA sequence
tctaatctcctaaaagtgca

SEQ ID NO: 196628 - DNA, 20 bp, Artificial
  CRISPR gRNA sequence
atagcttgatgctgtccaca

SEQ ID NO: 196629 - DNA, 20 bp, Artificial
  CRISPR gRNA sequence
ttctacaaaaaataatttaa

SEQ ID NO: 196630 - DNA, 20 bp, Artificial
  CRISPR gRNA sequence
cttttcttagacttcagtaa

SEQ ID NO: 196631 - DNA, 20 bp, Artificial
  CRISPR gRNA sequence
ttctgatttgaagtcaatga

SEQ ID NO: 196632 - DNA, 20 bp, Artificial
  CRISPR gRNA sequence
tttaagtaattatgctcaag

SEQ ID NO: 196633 - DNA, 20 bp, Artificial
  CRISPR gRNA sequence
ctaattaaaaagtttcccac

SEQ ID NO: 196634 - DNA, 20 bp, Artificial
  CRISPR gRNA sequence
atgatacaacttatatatta

SEQ ID NO: 196635 - DNA, 20 bp, Artificial
  CRISPR gRNA sequence
taatgttggacaatcaaaac

SEQ ID NO: 196636 - DNA, 20 bp, Artificial
  CRISPR gRNA sequence
ttcagtacagggcctaacac

SEQ ID NO: 196637 - DNA, 20 bp, Artificial
  CRISPR gRNA sequence
ggagagagacaataaacaaa

SEQ ID NO: 196638 - DNA, 20 bp, Artificial
  CRISPR gRNA sequence
tgctgttaggttcagcgatt

SEQ ID NO: 196639 - DNA, 20 bp, Artificial
  CRISPR gRNA sequence
ctggcatttaaactcacaaa

SEQ ID NO: 196640 - DNA, 20 bp, Artificial
  CRISPR gRNA sequence
aatgacaagatggattggga

SEQ ID NO: 196641 - DNA, 20 bp, Artificial
  CRISPR gRNA sequence
atgagagaccttttttggaa

SEQ ID NO: 196642 - DNA, 20 bp, Artificial
  CRISPR gRNA sequence
ctgatatttgcggatggact

SEQ ID NO: 196643 - DNA, 20 bp, Artificial
  CRISPR gRNA sequence
acctgagccagtatcaggga

SEQ ID NO: 196644 - DNA, 20 bp, Artificial
  CRISPR gRNA sequence
gtatggcttatcctgtactg

SEQ ID NO: 196645 - DNA, 20 bp, Artificial
  CRISPR gRNA sequence
ttgtaataaaaaagtaaaga

SEQ ID NO: 196646 - DNA, 20 bp, Artificial
  CRISPR gRNA sequence
gtgactatcaaataggtgct

SEQ ID NO: 196647 - DNA, 20 bp, Artificial
  CRISPR gRNA sequence
tgaaaataagtatggactta

SEQ ID NO: 196648 - DNA, 20 bp, Artificial
  CRISPR gRNA sequence
accgtgacagtaaatgctaa

SEQ ID NO: 196649 - DNA, 20 bp, Artificial
  CRISPR gRNA sequence
aaaagaaagaaggacaatct

SEQ ID NO: 196650 - DNA, 20 bp, Artificial
  CRISPR gRNA sequence
tgagacacagtgtcccaata

SEQ ID NO: 196651 - DNA, 20 bp, Artificial
  CRISPR gRNA sequence
ttggtttcatgtagacatcc

SEQ ID NO: 196652 - DNA, 20 bp, Artificial
  CRISPR gRNA sequence
taactttatcattgcgtaaa

SEQ ID NO: 196653 - DNA, 20 bp, Artificial
  CRISPR gRNA sequence
ctttgccattgtgtaaagta

SEQ ID NO: 196654 - DNA, 20 bp, Artificial
  CRISPR gRNA sequence
gccattgtgtaaagtagaag

SEQ ID NO: 196655 - DNA, 20 bp, Artificial
  CRISPR gRNA sequence
tgtgtaaagtagaagaaaga

SEQ ID NO: 196656 - DNA, 20 bp, Artificial
  CRISPR gRNA sequence
agaatagaatgttctctcta

SEQ ID NO: 196657 - DNA, 20 bp, Artificial
  CRISPR gRNA sequence
aaatattttaaccatgagtt

SEQ ID NO: 196658 - DNA, 20 bp, Artificial
  CRISPR gRNA sequence
taccaatgtacttcttgcca

SEQ ID NO: 196659 - DNA, 20 bp, Artificial
  CRISPR gRNA sequence
cagcatgagatatagtgtcc

SEQ ID NO: 196660 - DNA, 20 bp, Artificial
  CRISPR gRNA sequence
tgaatgcaaattcccagtag

SEQ ID NO: 196661 - DNA, 20 bp, Artificial
  CRISPR gRNA sequence
tgagaggcctgatctttatt

SEQ ID NO: 196662 - DNA, 20 bp, Artificial
  CRISPR gRNA sequence
ttggcactagctaagtaaag

SEQ ID NO: 196663 - DNA, 20 bp, Artificial
  CRISPR gRNA sequence
tcactgataactataaactc

SEQ ID NO: 196664 - DNA, 20 bp, Artificial
  CRISPR gRNA sequence
attttaaaggtgaaacattt

SEQ ID NO: 196665 - DNA, 20 bp, Artificial
  CRISPR gRNA sequence
tcgctgaacctaacagcagg

SEQ ID NO: 196666 - DNA, 20 bp, Artificial
  CRISPR gRNA sequence
atcaagttatatgttgactt

SEQ ID NO: 196667 - DNA, 20 bp, Artificial
  CRISPR gRNA sequence
ttgattactcatctcatctg

SEQ ID NO: 196668 - DNA, 20 bp, Artificial
  CRISPR gRNA sequence
aacctaatagacatttgtac

SEQ ID NO: 196669 - DNA, 20 bp, Artificial
  CRISPR gRNA sequence
tttcattgatataggagtat

SEQ ID NO: 196670 - DNA, 20 bp, Artificial
  CRISPR gRNA sequence
acagaaaaaggatattaggg

SEQ ID NO: 196671 - DNA, 20 bp, Artificial
  CRISPR gRNA sequence
ttgcaacttttttgtaaatt

SEQ ID NO: 196672 - DNA, 20 bp, Artificial
  CRISPR gRNA sequence
cactttactgagaaacatat

SEQ ID NO: 196673 - DNA, 20 bp, Artificial
  CRISPR gRNA sequence
ttaggagattagatcctgag

SEQ ID NO: 196674 - DNA, 20 bp, Artificial
  CRISPR gRNA sequence
cactcttcaggaaacagata

SEQ ID NO: 196675 - DNA, 20 bp, Artificial
  CRISPR gRNA sequence
aaaaaactaagaaacaaaca

SEQ ID NO: 196676 - DNA, 20 bp, Artificial
  CRISPR gRNA sequence
aaaatgccacgtacttcagc

SEQ ID NO: 196677 - DNA, 20 bp, Artificial
  CRISPR gRNA sequence
tgtgaacagaaagaggggga

SEQ ID NO: 196678 - DNA, 20 bp, Artificial
  CRISPR gRNA sequence
aagttgttctgaaactgaaa

SEQ ID NO: 196679 - DNA, 20 bp, Artificial
  CRISPR gRNA sequence
aagtatcttgcccaagacct

SEQ ID NO: 196680 - DNA, 20 bp, Artificial
  CRISPR gRNA sequence
tatcctcattttacagtaga

SEQ ID NO: 196681 - DNA, 20 bp, Artificial
  CRISPR gRNA sequence
tacatttataagcagggcag

SEQ ID NO: 196682 - DNA, 20 bp, Artificial
  CRISPR gRNA sequence
aagtaacaagaaatctaata

SEQ ID NO: 196683 - DNA, 20 bp, Artificial
  CRISPR gRNA sequence
tatccttacatgatatcctg

SEQ ID NO: 196684 - DNA, 20 bp, Artificial
  CRISPR gRNA sequence
tggttattttcatgatagaa

SEQ ID NO: 196685 - DNA, 20 bp, Artificial
  CRISPR gRNA sequence
atgtgccagaggtagttctg

SEQ ID NO: 196686 - DNA, 20 bp, Artificial
  CRISPR gRNA sequence
ccagaggtagttctgaaaaa

SEQ ID NO: 196687 - DNA, 20 bp, Artificial
  CRISPR gRNA sequence
ggtagttctgaaaaacaaaa

SEQ ID NO: 196688 - DNA, 20 bp, Artificial
  CRISPR gRNA sequence
tctgaaaaacaaaacaaaac

SEQ ID NO: 196689 - DNA, 20 bp, Artificial
  CRISPR gRNA sequence
acccaacaagtaagttgtca

SEQ ID NO: 196690 - DNA, 20 bp, Artificial
  CRISPR gRNA sequence
atgtaaagattaatttacac

SEQ ID NO: 196691 - DNA, 20 bp, Artificial
  CRISPR gRNA sequence
ttcttagacttcagtaaaca

SEQ ID NO: 196692 - DNA, 20 bp, Artificial
  CRISPR gRNA sequence
ttcttcacagagagttaata

SEQ ID NO: 196693 - DNA, 20 bp, Artificial
  CRISPR gRNA sequence
aatcaataaaattatgattt

SEQ ID NO: 196694 - DNA, 20 bp, Artificial
  CRISPR gRNA sequence
gacctcgcagtgttatataa

SEQ ID NO: 196695 - DNA, 20 bp, Artificial
  CRISPR gRNA sequence
agtgaagcatcacaattagt

SEQ ID NO: 196696 - DNA, 20 bp, Artificial
  CRISPR gRNA sequence
tcaacctttttttgctcttc

SEQ ID NO: 196697 - DNA, 20 bp, Artificial
  CRISPR gRNA sequence
ctatactaatgttggacaat

SEQ ID NO: 196698 - DNA, 20 bp, Artificial
  CRISPR gRNA sequence
ctggggatgcaacaatatta

SEQ ID NO: 196699 - DNA, 20 bp, Artificial
  CRISPR gRNA sequence
aggaggagagagacaataaa

SEQ ID NO: 196700 - DNA, 20 bp, Artificial
  CRISPR gRNA sequence
gttaggttcagcgattaaag

SEQ ID NO: 196701 - DNA, 20 bp, Artificial
  CRISPR gRNA sequence
tagtgataattgagtgaatc

SEQ ID NO: 196702 - DNA, 20 bp, Artificial
  CRISPR gRNA sequence
ggtatagctgaactcaatcc

SEQ ID NO: 196703 - DNA, 20 bp, Artificial
  CRISPR gRNA sequence
caggaagaactcccccttgg

SEQ ID NO: 196704 - DNA, 20 bp, Artificial
  CRISPR gRNA sequence
tggagcccagacgacctgaa

SEQ ID NO: 196705 - DNA, 20 bp, Artificial
  CRISPR gRNA sequence
tatttgcggatggactggag

SEQ ID NO: 196706 - DNA, 20 bp, Artificial
  CRISPR gRNA sequence
cagggaccagaaatacaaca

SEQ ID NO: 196707 - DNA, 20 bp, Artificial
  CRISPR gRNA sequence
ttacttagctagtgccaaca

SEQ ID NO: 196708 - DNA, 20 bp, Artificial
  CRISPR gRNA sequence
tatagagaggctcaaaaaag

SEQ ID NO: 196709 - DNA, 20 bp, Artificial
  CRISPR gRNA sequence
aagactagaaattctttttg

SEQ ID NO: 196710 - DNA, 20 bp, Artificial
  CRISPR gRNA sequence
tctggaatgccctaattatg

SEQ ID NO: 196711 - DNA, 20 bp, Artificial
  CRISPR gRNA sequence
gaaccaccaagtcccatatt

SEQ ID NO: 196712 - DNA, 20 bp, Artificial
  CRISPR gRNA sequence
tcatattgtatgtttaatta

SEQ ID NO: 196713 - DNA, 20 bp, Artificial
  CRISPR gRNA sequence
tatgtttaattattaagtga

SEQ ID NO: 196714 - DNA, 20 bp, Artificial
  CRISPR gRNA sequence
aattattaagtgaagcagtc

SEQ ID NO: 196715 - DNA, 20 bp, Artificial
  CRISPR gRNA sequence
attattaagtgaagcagtct

SEQ ID NO: 196716 - DNA, 20 bp, Artificial
  CRISPR gRNA sequence
ttaagtgaagcagtcttctt

SEQ ID NO: 196717 - DNA, 20 bp, Artificial
  CRISPR gRNA sequence
agtgaagcagtcttcttttc

SEQ ID NO: 196718 - DNA, 20 bp, Artificial
  CRISPR gRNA sequence
cttttcgtgttttccataat

SEQ ID NO: 196719 - DNA, 20 bp, Artificial
  CRISPR gRNA sequence
ttttcgtgttttccataatt

SEQ ID NO: 196720 - DNA, 20 bp, Artificial
  CRISPR gRNA sequence
ttcgtgttttccataattag

SEQ ID NO: 196721 - DNA, 20 bp, Artificial
  CRISPR gRNA sequence
tcgtgttttccataattagg

SEQ ID NO: 196722 - DNA, 20 bp, Artificial
  CRISPR gRNA sequence
cgtgttttccataattaggg

SEQ ID NO: 196723 - DNA, 20 bp, Artificial
  CRISPR gRNA sequence
gtgttttccataattagggc

SEQ ID NO: 196724 - DNA, 20 bp, Artificial
  CRISPR gRNA sequence
tccataattagggcattcca

SEQ ID NO: 196725 - DNA, 20 bp, Artificial
  CRISPR gRNA sequence
ccataattagggcattccag

SEQ ID NO: 196726 - DNA, 20 bp, Artificial
  CRISPR gRNA sequence
cataattagggcattccaga

SEQ ID NO: 196727 - DNA, 20 bp, Artificial
  CRISPR gRNA sequence
gggcattccagaaagatgag

SEQ ID NO: 196728 - DNA, 20 bp, Artificial
  CRISPR gRNA sequence
cagaaagatgaggatatttg

SEQ ID NO: 196729 - DNA, 20 bp, Artificial
  CRISPR gRNA sequence
gctgtctttatattcatgac

SEQ ID NO: 196730 - DNA, 20 bp, Artificial
  CRISPR gRNA sequence
ctgtctttatattcatgacc

SEQ ID NO: 196731 - DNA, 20 bp, Artificial
  CRISPR gRNA sequence
tctttatattcatgacctac

SEQ ID NO: 196732 - DNA, 20 bp, Artificial
  CRISPR gRNA sequence
tatattcatgacctactggc

SEQ ID NO: 196733 - DNA, 20 bp, Artificial
  CRISPR gRNA sequence
atattcatgacctactggca

SEQ ID NO: 196734 - DNA, 20 bp, Artificial
  CRISPR gRNA sequence
tattcatgacctactggcat

SEQ ID NO: 196735 - DNA, 20 bp, Artificial
  CRISPR gRNA sequence
atgacctactggcatttgct

SEQ ID NO: 196736 - DNA, 20 bp, Artificial
  CRISPR gRNA sequence
ctggcatttgctgaacggta

SEQ ID NO: 196737 - DNA, 20 bp, Artificial
  CRISPR gRNA sequence
gcatttgctgaacggtaaga

SEQ ID NO: 196738 - DNA, 20 bp, Artificial
  CRISPR gRNA sequence
gctgaacggtaagacaccaa

SEQ ID NO: 196739 - DNA, 20 bp, Artificial
  CRISPR gRNA sequence
ctgaacggtaagacaccaaa

SEQ ID NO: 196740 - DNA, 20 bp, Artificial
  CRISPR gRNA sequence
aacggtaagacaccaaatcc

SEQ ID NO: 196741 - DNA, 20 bp, Artificial
  CRISPR gRNA sequence
ccattaggttctatatttta

SEQ ID NO: 196742 - DNA, 20 bp, Artificial
  CRISPR gRNA sequence
cattaggttctatattttaa

SEQ ID NO: 196743 - DNA, 20 bp, Artificial
  CRISPR gRNA sequence
ggttctatattttaaatatt

SEQ ID NO: 196744 - DNA, 20 bp, Artificial
  CRISPR gRNA sequence
tatattttaaatattttaac

SEQ ID NO: 196745 - DNA, 20 bp, Artificial
  CRISPR gRNA sequence
tattttaaatattttaacca

SEQ ID NO: 196746 - DNA, 20 bp, Artificial
  CRISPR gRNA sequence
taaatattttaaccatgagt

SEQ ID NO: 196747 - DNA, 20 bp, Artificial
  CRISPR gRNA sequence
aaatattttaaccatgagtt

SEQ ID NO: 196748 - DNA, 20 bp, Artificial
  CRISPR gRNA sequence
aatattttaaccatgagttt

SEQ ID NO: 196749 - DNA, 20 bp, Artificial
  CRISPR gRNA sequence
taaccatgagtttaaaacta

SEQ ID NO: 196750 - DNA, 20 bp, Artificial
  CRISPR gRNA sequence
aaccatgagtttaaaactaa

SEQ ID NO: 196751 - DNA, 20 bp, Artificial
  CRISPR gRNA sequence
accatgagtttaaaactaaa

SEQ ID NO: 196752 - DNA, 20 bp, Artificial
  CRISPR gRNA sequence
aaaactaaaatgatcattta

SEQ ID NO: 196753 - DNA, 20 bp, Artificial
  CRISPR gRNA sequence
aaactaaaatgatcatttaa

SEQ ID NO: 196754 - DNA, 20 bp, Artificial
  CRISPR gRNA sequence
aaatgatcatttaaaatgca

SEQ ID NO: 196755 - DNA, 20 bp, Artificial
  CRISPR gRNA sequence
aaaatgcatgcaattttctt

SEQ ID NO: 196756 - DNA, 20 bp, Artificial
  CRISPR gRNA sequence
aaatgcatgcaattttctta

SEQ ID NO: 196757 - DNA, 20 bp, Artificial
  CRISPR gRNA sequence
tcttatagagagaacattct

SEQ ID NO: 196758 - DNA, 20 bp, Artificial
  CRISPR gRNA sequence
cttatagagagaacattcta

SEQ ID NO: 196759 - DNA, 20 bp, Artificial
  CRISPR gRNA sequence
ttatagagagaacattctat

SEQ ID NO: 196760 - DNA, 20 bp, Artificial
  CRISPR gRNA sequence
atagagagaacattctattc

SEQ ID NO: 196761 - DNA, 20 bp, Artificial
  CRISPR gRNA sequence
tagagagaacattctattct

SEQ ID NO: 196762 - DNA, 20 bp, Artificial
  CRISPR gRNA sequence
tattctttcttctactttac

SEQ ID NO: 196763 - DNA, 20 bp, Artificial
  CRISPR gRNA sequence
ttctttcttctactttacac

SEQ ID NO: 196764 - DNA, 20 bp, Artificial
  CRISPR gRNA sequence
tttcttctactttacacaat

SEQ ID NO: 196765 - DNA, 20 bp, Artificial
  CRISPR gRNA sequence
tcttctactttacacaatgg

SEQ ID NO: 196766 - DNA, 20 bp, Artificial
  CRISPR gRNA sequence
cttctactttacacaatggc

SEQ ID NO: 196767 - DNA, 20 bp, Artificial
  CRISPR gRNA sequence
ttctactttacacaatggca

SEQ ID NO: 196768 - DNA, 20 bp, Artificial
  CRISPR gRNA sequence
ctactttacacaatggcaaa

SEQ ID NO: 196769 - DNA, 20 bp, Artificial
  CRISPR gRNA sequence
tactttacacaatggcaaag

SEQ ID NO: 196770 - DNA, 20 bp, Artificial
  CRISPR gRNA sequence
ctttacacaatggcaaagtc

SEQ ID NO: 196771 - DNA, 20 bp, Artificial
  CRISPR gRNA sequence
tacacaatggcaaagtcttc

SEQ ID NO: 196772 - DNA, 20 bp, Artificial
  CRISPR gRNA sequence
acacaatggcaaagtcttct

SEQ ID NO: 196773 - DNA, 20 bp, Artificial
  CRISPR gRNA sequence
cacaatggcaaagtcttctt

SEQ ID NO: 196774 - DNA, 20 bp, Artificial
  CRISPR gRNA sequence
ctttctactttacgcaatga

SEQ ID NO: 196775 - DNA, 20 bp, Artificial
  CRISPR gRNA sequence
tttctactttacgcaatgat

SEQ ID NO: 196776 - DNA, 20 bp, Artificial
  CRISPR gRNA sequence
tctactttacgcaatgataa

SEQ ID NO: 196777 - DNA, 20 bp, Artificial
  CRISPR gRNA sequence
ctactttacgcaatgataaa

SEQ ID NO: 196778 - DNA, 20 bp, Artificial
  CRISPR gRNA sequence
tactttacgcaatgataaag

SEQ ID NO: 196779 - DNA, 20 bp, Artificial
  CRISPR gRNA sequence
ctttacgcaatgataaagtt

SEQ ID NO: 196780 - DNA, 20 bp, Artificial
  CRISPR gRNA sequence
tacgcaatgataaagttacc

SEQ ID NO: 196781 - DNA, 20 bp, Artificial
  CRISPR gRNA sequence
acgcaatgataaagttacct

SEQ ID NO: 196782 - DNA, 20 bp, Artificial
  CRISPR gRNA sequence
cgcaatgataaagttacctg

SEQ ID NO: 196783 - DNA, 20 bp, Artificial
  CRISPR gRNA sequence
cctgtgtcattttgtaaaaa

SEQ ID NO: 196784 - DNA, 20 bp, Artificial
  CRISPR gRNA sequence
tgtcattttgtaaaaatata

SEQ ID NO: 196785 - DNA, 20 bp, Artificial
  CRISPR gRNA sequence
tgtaaaaatatagagaatat

SEQ ID NO: 196786 - DNA, 20 bp, Artificial
  CRISPR gRNA sequence
gtaaaaatatagagaatata

SEQ ID NO: 196787 - DNA, 20 bp, Artificial
  CRISPR gRNA sequence
taaaaatatagagaatatag

SEQ ID NO: 196788 - DNA, 20 bp, Artificial
  CRISPR gRNA sequence
aaagacacaaaataatctat

SEQ ID NO: 196789 - DNA, 20 bp, Artificial
  CRISPR gRNA sequence
ttacccatttcccagggtta

SEQ ID NO: 196790 - DNA, 20 bp, Artificial
  CRISPR gRNA sequence
cccatttcccagggttaact

SEQ ID NO: 196791 - DNA, 20 bp, Artificial
  CRISPR gRNA sequence
cccagggttaactactgaaa

SEQ ID NO: 196792 - DNA, 20 bp, Artificial
  CRISPR gRNA sequence
ccagggttaactactgaaaa

SEQ ID NO: 196793 - DNA, 20 bp, Artificial
  CRISPR gRNA sequence
actactgaaaatatctgggg

SEQ ID NO: 196794 - DNA, 20 bp, Artificial
  CRISPR gRNA sequence
ctgaaaatatctggggaaat

SEQ ID NO: 196795 - DNA, 20 bp, Artificial
  CRISPR gRNA sequence
aaaatatctggggaaatggc

SEQ ID NO: 196796 - DNA, 20 bp, Artificial
  CRISPR gRNA sequence
gggaaatggcctgtatgtat

SEQ ID NO: 196797 - DNA, 20 bp, Artificial
  CRISPR gRNA sequence
tatgtatacatttatttgtt

SEQ ID NO: 196798 - DNA, 20 bp, Artificial
  CRISPR gRNA sequence
atttgtttgctttcaacaag

SEQ ID NO: 196799 - DNA, 20 bp, Artificial
  CRISPR gRNA sequence
tttgtttgctttcaacaagg

SEQ ID NO: 196800 - DNA, 20 bp, Artificial
  CRISPR gRNA sequence
gtttgctttcaacaaggcca

SEQ ID NO: 196801 - DNA, 20 bp, Artificial
  CRISPR gRNA sequence
tttgctttcaacaaggccaa

SEQ ID NO: 196802 - DNA, 20 bp, Artificial
  CRISPR gRNA sequence
gctttcaacaaggccaagat

SEQ ID NO: 196803 - DNA, 20 bp, Artificial
  CRISPR gRNA sequence
ctttcaacaaggccaagatc

SEQ ID NO: 196804 - DNA, 20 bp, Artificial
  CRISPR gRNA sequence
tcaacaaggccaagatcctt

SEQ ID NO: 196805 - DNA, 20 bp, Artificial
  CRISPR gRNA sequence
caacaaggccaagatccttt

SEQ ID NO: 196806 - DNA, 20 bp, Artificial
  CRISPR gRNA sequence
aacaaggccaagatcctttg

SEQ ID NO: 196807 - DNA, 20 bp, Artificial
  CRISPR gRNA sequence
tgatctttcagtcttggttg

SEQ ID NO: 196808 - DNA, 20 bp, Artificial
  CRISPR gRNA sequence
gatctttcagtcttggttgc

SEQ ID NO: 196809 - DNA, 20 bp, Artificial
  CRISPR gRNA sequence
atctttcagtcttggttgct

SEQ ID NO: 196810 - DNA, 20 bp, Artificial
  CRISPR gRNA sequence
tcagtcttggttgctctgtg

SEQ ID NO: 196811 - DNA, 20 bp, Artificial
  CRISPR gRNA sequence
cagtcttggttgctctgtga

SEQ ID NO: 196812 - DNA, 20 bp, Artificial
  CRISPR gRNA sequence
agtcttggttgctctgtgac

SEQ ID NO: 196813 - DNA, 20 bp, Artificial
  CRISPR gRNA sequence
ggttgctctgtgacatgcct

SEQ ID NO: 196814 - DNA, 20 bp, Artificial
  CRISPR gRNA sequence
gttgctctgtgacatgcctt

SEQ ID NO: 196815 - DNA, 20 bp, Artificial
  CRISPR gRNA sequence
ctctgtgacatgcctttcct

SEQ ID NO: 196816 - DNA, 20 bp, Artificial
  CRISPR gRNA sequence
tgtgacatgcctttcctgat

SEQ ID NO: 196817 - DNA, 20 bp, Artificial
  CRISPR gRNA sequence
tgacatgcctttcctgatga

SEQ ID NO: 196818 - DNA, 20 bp, Artificial
  CRISPR gRNA sequence
tcctgatgaggatactttaa

SEQ ID NO: 196819 - DNA, 20 bp, Artificial
  CRISPR gRNA sequence
cctgatgaggatactttaag

SEQ ID NO: 196820 - DNA, 20 bp, Artificial
  CRISPR gRNA sequence
ctgatgaggatactttaagg

SEQ ID NO: 196821 - DNA, 20 bp, Artificial
  CRISPR gRNA sequence
atgaggatactttaaggaag

SEQ ID NO: 196822 - DNA, 20 bp, Artificial
  CRISPR gRNA sequence
taaggaagaattgtaagata

SEQ ID NO: 196823 - DNA, 20 bp, Artificial
  CRISPR gRNA sequence
aaggaagaattgtaagatac

SEQ ID NO: 196824 - DNA, 20 bp, Artificial
  CRISPR gRNA sequence
aggaagaattgtaagataca

SEQ ID NO: 196825 - DNA, 20 bp, Artificial
  CRISPR gRNA sequence
taagatacatggaaaatgtc

SEQ ID NO: 196826 - DNA, 20 bp, Artificial
  CRISPR gRNA sequence
acacagtactggcatcaccc

SEQ ID NO: 196827 - DNA, 20 bp, Artificial
  CRISPR gRNA sequence
gcatcaccctgtgctctttc

SEQ ID NO: 196828 - DNA, 20 bp, Artificial
  CRISPR gRNA sequence
tgctctttcctgaactccat

SEQ ID NO: 196829 - DNA, 20 bp, Artificial
  CRISPR gRNA sequence
tttcctgaactccataccaa

SEQ ID NO: 196830 - DNA, 20 bp, Artificial
  CRISPR gRNA sequence
tcctgaactccataccaatg

SEQ ID NO: 196831 - DNA, 20 bp, Artificial
  CRISPR gRNA sequence
cctgaactccataccaatgt

SEQ ID NO: 196832 - DNA, 20 bp, Artificial
  CRISPR gRNA sequence
ctgaactccataccaatgta

SEQ ID NO: 196833 - DNA, 20 bp, Artificial
  CRISPR gRNA sequence
aactccataccaatgtactt

SEQ ID NO: 196834 - DNA, 20 bp, Artificial
  CRISPR gRNA sequence
cataccaatgtacttcttgc

SEQ ID NO: 196835 - DNA, 20 bp, Artificial
  CRISPR gRNA sequence
cttgccagaaaactgatcaa

SEQ ID NO: 196836 - DNA, 20 bp, Artificial
  CRISPR gRNA sequence
ttgccagaaaactgatcaaa

SEQ ID NO: 196837 - DNA, 20 bp, Artificial
  CRISPR gRNA sequence
gccagaaaactgatcaaaag

SEQ ID NO: 196838 - DNA, 20 bp, Artificial
  CRISPR gRNA sequence
ccagaaaactgatcaaaagt

SEQ ID NO: 196839 - DNA, 20 bp, Artificial
  CRISPR gRNA sequence
atcaaaagtttagggaagta

SEQ ID NO: 196840 - DNA, 20 bp, Artificial
  CRISPR gRNA sequence
agggaagtaaaaagagatga

SEQ ID NO: 196841 - DNA, 20 bp, Artificial
  CRISPR gRNA sequence
gggaagtaaaaagagatgac

SEQ ID NO: 196842 - DNA, 20 bp, Artificial
  CRISPR gRNA sequence
ttagaatctaccattccctc

SEQ ID NO: 196843 - DNA, 20 bp, Artificial
  CRISPR gRNA sequence
gaatctaccattccctctat

SEQ ID NO: 196844 - DNA, 20 bp, Artificial
  CRISPR gRNA sequence
ccattccctctatgtaggaa

SEQ ID NO: 196845 - DNA, 20 bp, Artificial
  CRISPR gRNA sequence
cctctatgtaggaagcaaat

SEQ ID NO: 196846 - DNA, 20 bp, Artificial
  CRISPR gRNA sequence
tatgtaggaagcaaataggt

SEQ ID NO: 196847 - DNA, 20 bp, Artificial
  CRISPR gRNA sequence
tgtaggaagcaaataggtgt

SEQ ID NO: 196848 - DNA, 20 bp, Artificial
  CRISPR gRNA sequence
tcaaaggacattctggggat

SEQ ID NO: 196849 - DNA, 20 bp, Artificial
  CRISPR gRNA sequence
tggggatgtctacatgaaac

SEQ ID NO: 196850 - DNA, 20 bp, Artificial
  CRISPR gRNA sequence
gggatgtctacatgaaacca

SEQ ID NO: 196851 - DNA, 20 bp, Artificial
  CRISPR gRNA sequence
catgaaaccaagtctccctg

SEQ ID NO: 196852 - DNA, 20 bp, Artificial
  CRISPR gRNA sequence
cctggttgtaaggactccat

SEQ ID NO: 196853 - DNA, 20 bp, Artificial
  CRISPR gRNA sequence
gttgtaaggactccatctcc

SEQ ID NO: 196854 - DNA, 20 bp, Artificial
  CRISPR gRNA sequence
taaggactccatctccatat

SEQ ID NO: 196855 - DNA, 20 bp, Artificial
  CRISPR gRNA sequence
catctccatataatatttat

SEQ ID NO: 196856 - DNA, 20 bp, Artificial
  CRISPR gRNA sequence
catataatatttatacagta

SEQ ID NO: 196857 - DNA, 20 bp, Artificial
  CRISPR gRNA sequence
atacagtaatatatgtttat

SEQ ID NO: 196858 - DNA, 20 bp, Artificial
  CRISPR gRNA sequence
tacagtaatatatgtttata

SEQ ID NO: 196859 - DNA, 20 bp, Artificial
  CRISPR gRNA sequence
ataaattgtgggggcaactt

SEQ ID NO: 196860 - DNA, 20 bp, Artificial
  CRISPR gRNA sequence
taaattgtgggggcaacttg

SEQ ID NO: 196861 - DNA, 20 bp, Artificial
  CRISPR gRNA sequence
tgggggcaacttgtttagct

SEQ ID NO: 196862 - DNA, 20 bp, Artificial
  CRISPR gRNA sequence
gtttagctaattttattatt

SEQ ID NO: 196863 - DNA, 20 bp, Artificial
  CRISPR gRNA sequence
tttagctaattttattattc

SEQ ID NO: 196864 - DNA, 20 bp, Artificial
  CRISPR gRNA sequence
agctaattttattattctgc

SEQ ID NO: 196865 - DNA, 20 bp, Artificial
  CRISPR gRNA sequence
gctaattttattattctgct

SEQ ID NO: 196866 - DNA, 20 bp, Artificial
  CRISPR gRNA sequence
attttattattctgctattg

SEQ ID NO: 196867 - DNA, 20 bp, Artificial
  CRISPR gRNA sequence
tattattctgctattgggac

SEQ ID NO: 196868 - DNA, 20 bp, Artificial
  CRISPR gRNA sequence
attattctgctattgggaca

SEQ ID NO: 196869 - DNA, 20 bp, Artificial
  CRISPR gRNA sequence
ttattctgctattgggacac

SEQ ID NO: 196870 - DNA, 20 bp, Artificial
  CRISPR gRNA sequence
ttctgctattgggacactgt

SEQ ID NO: 196871 - DNA, 20 bp, Artificial
  CRISPR gRNA sequence
tgctattgggacactgtgtc

SEQ ID NO: 196872 - DNA, 20 bp, Artificial
  CRISPR gRNA sequence
ctattgggacactgtgtctc

SEQ ID NO: 196873 - DNA, 20 bp, Artificial
  CRISPR gRNA sequence
ttgggacactgtgtctcagc

SEQ ID NO: 196874 - DNA, 20 bp, Artificial
  CRISPR gRNA sequence
ggacactgtgtctcagcatg

SEQ ID NO: 196875 - DNA, 20 bp, Artificial
  CRISPR gRNA sequence
tgtctcagcatgagatatag

SEQ ID NO: 196876 - DNA, 20 bp, Artificial
  CRISPR gRNA sequence
agcatgagatatagtgtccc

SEQ ID NO: 196877 - DNA, 20 bp, Artificial
  CRISPR gRNA sequence
caagcccattggataaaata

SEQ ID NO: 196878 - DNA, 20 bp, Artificial
  CRISPR gRNA sequence
aagcccattggataaaatat

SEQ ID NO: 196879 - DNA, 20 bp, Artificial
  CRISPR gRNA sequence
gataaaatatgtgtttagca

SEQ ID NO: 196880 - DNA, 20 bp, Artificial
  CRISPR gRNA sequence
agcaagttcttaaatataat

SEQ ID NO: 196881 - DNA, 20 bp, Artificial
  CRISPR gRNA sequence
gcaagttcttaaatataatg

SEQ ID NO: 196882 - DNA, 20 bp, Artificial
  CRISPR gRNA sequence
ttaaatataatgataacata

SEQ ID NO: 196883 - DNA, 20 bp, Artificial
  CRISPR gRNA sequence
aaatataatgataacataac

SEQ ID NO: 196884 - DNA, 20 bp, Artificial
  CRISPR gRNA sequence
aatataatgataacataacc

SEQ ID NO: 196885 - DNA, 20 bp, Artificial
  CRISPR gRNA sequence
ataaacgctgtgccaatttt

SEQ ID NO: 196886 - DNA, 20 bp, Artificial
  CRISPR gRNA sequence
taaacgctgtgccaattttg

SEQ ID NO: 196887 - DNA, 20 bp, Artificial
  CRISPR gRNA sequence
tgccaattttgtaaatgttt

SEQ ID NO: 196888 - DNA, 20 bp, Artificial
  CRISPR gRNA sequence
tgtaaatgtttcgaggaatt

SEQ ID NO: 196889 - DNA, 20 bp, Artificial
  CRISPR gRNA sequence
gtaaatgtttcgaggaattt

SEQ ID NO: 196890 - DNA, 20 bp, Artificial
  CRISPR gRNA sequence
taaatgtttcgaggaatttt

SEQ ID NO: 196891 - DNA, 20 bp, Artificial
  CRISPR gRNA sequence
cgaggaattttcccttttct

SEQ ID NO: 196892 - DNA, 20 bp, Artificial
  CRISPR gRNA sequence
gaggaattttcccttttctg

SEQ ID NO: 196893 - DNA, 20 bp, Artificial
  CRISPR gRNA sequence
tcccttttctgaagattgtc

SEQ ID NO: 196894 - DNA, 20 bp, Artificial
  CRISPR gRNA sequence
cccttttctgaagattgtcc

SEQ ID NO: 196895 - DNA, 20 bp, Artificial
  CRISPR gRNA sequence
ccttttctgaagattgtcct

SEQ ID NO: 196896 - DNA, 20 bp, Artificial
  CRISPR gRNA sequence
ttctgaagattgtccttctt

SEQ ID NO: 196897 - DNA, 20 bp, Artificial
  CRISPR gRNA sequence
tctgaagattgtccttcttt

SEQ ID NO: 196898 - DNA, 20 bp, Artificial
  CRISPR gRNA sequence
ctgaagattgtccttctttc

SEQ ID NO: 196899 - DNA, 20 bp, Artificial
  CRISPR gRNA sequence
tgaagattgtccttctttct

SEQ ID NO: 196900 - DNA, 20 bp, Artificial
  CRISPR gRNA sequence
aagattgtccttctttcttt

SEQ ID NO: 196901 - DNA, 20 bp, Artificial
  CRISPR gRNA sequence
tccttctttctttttagcat

SEQ ID NO: 196902 - DNA, 20 bp, Artificial
  CRISPR gRNA sequence
ctttctttttagcatttact

SEQ ID NO: 196903 - DNA, 20 bp, Artificial
  CRISPR gRNA sequence
tttctttttagcatttactg

SEQ ID NO: 196904 - DNA, 20 bp, Artificial
  CRISPR gRNA sequence
tctttttagcatttactgtc

SEQ ID NO: 196905 - DNA, 20 bp, Artificial
  CRISPR gRNA sequence
ctttttagcatttactgtca

SEQ ID NO: 196906 - DNA, 20 bp, Artificial
  CRISPR gRNA sequence
tttttagcatttactgtcac

SEQ ID NO: 196907 - DNA, 20 bp, Artificial
  CRISPR gRNA sequence
tttagcatttactgtcacgg

SEQ ID NO: 196908 - DNA, 20 bp, Artificial
  CRISPR gRNA sequence
ttagcatttactgtcacggt

SEQ ID NO: 196909 - DNA, 20 bp, Artificial
  CRISPR gRNA sequence
tagcatttactgtcacggtt

SEQ ID NO: 196910 - DNA, 20 bp, Artificial
  CRISPR gRNA sequence
agcatttactgtcacggttc

SEQ ID NO: 196911 - DNA, 20 bp, Artificial
  CRISPR gRNA sequence
gcatttactgtcacggttcc

SEQ ID NO: 196912 - DNA, 20 bp, Artificial
  CRISPR gRNA sequence
actgtcacggttcccaagga

SEQ ID NO: 196913 - DNA, 20 bp, Artificial
  CRISPR gRNA sequence
ctgtcacggttcccaaggac

SEQ ID NO: 196914 - DNA, 20 bp, Artificial
  CRISPR gRNA sequence
tcacggttcccaaggaccta

SEQ ID NO: 196915 - DNA, 20 bp, Artificial
  CRISPR gRNA sequence
ccaaggacctatatgtggta

SEQ ID NO: 196916 - DNA, 20 bp, Artificial
  CRISPR gRNA sequence
tatgtggtagagtatggtag

SEQ ID NO: 196917 - DNA, 20 bp, Artificial
  CRISPR gRNA sequence
aatgcaaattcccagtagaa

SEQ ID NO: 196918 - DNA, 20 bp, Artificial
  CRISPR gRNA sequence
ccagtagaaaaacaattaga

SEQ ID NO: 196919 - DNA, 20 bp, Artificial
  CRISPR gRNA sequence
gacctggctgcactaattgt

SEQ ID NO: 196920 - DNA, 20 bp, Artificial
  CRISPR gRNA sequence
gctgcactaattgtctattg

SEQ ID NO: 196921 - DNA, 20 bp, Artificial
  CRISPR gRNA sequence
cactaattgtctattgggaa

SEQ ID NO: 196922 - DNA, 20 bp, Artificial
  CRISPR gRNA sequence
attgtctattgggaaatgga

SEQ ID NO: 196923 - DNA, 20 bp, Artificial
  CRISPR gRNA sequence
tctattgggaaatggaggat

SEQ ID NO: 196924 - DNA, 20 bp, Artificial
  CRISPR gRNA sequence
ttgggaaatggaggataaga

SEQ ID NO: 196925 - DNA, 20 bp, Artificial
  CRISPR gRNA sequence
ggaaatggaggataagaaca

SEQ ID NO: 196926 - DNA, 20 bp, Artificial
  CRISPR gRNA sequence
ttcaatttgtgcatggagag

SEQ ID NO: 196927 - DNA, 20 bp, Artificial
  CRISPR gRNA sequence
aatttgtgcatggagaggaa

SEQ ID NO: 196928 - DNA, 20 bp, Artificial
  CRISPR gRNA sequence
gtgcatggagaggaagacct

SEQ ID NO: 196929 - DNA, 20 bp, Artificial
  CRISPR gRNA sequence
tgcatggagaggaagacctg

SEQ ID NO: 196930 - DNA, 20 bp, Artificial
  CRISPR gRNA sequence
aaggttcagcatagtagcta

SEQ ID NO: 196931 - DNA, 20 bp, Artificial
  CRISPR gRNA sequence
agcatagtagctacagacag

SEQ ID NO: 196932 - DNA, 20 bp, Artificial
  CRISPR gRNA sequence
cagacagagggcccggctgt

SEQ ID NO: 196933 - DNA, 20 bp, Artificial
  CRISPR gRNA sequence
ttgaaggaccagctctccct

SEQ ID NO: 196934 - DNA, 20 bp, Artificial
  CRISPR gRNA sequence
aaggaccagctctccctggg

SEQ ID NO: 196935 - DNA, 20 bp, Artificial
  CRISPR gRNA sequence
tccctgggaaatgctgcact

SEQ ID NO: 196936 - DNA, 20 bp, Artificial
  CRISPR gRNA sequence
cctgggaaatgctgcacttc

SEQ ID NO: 196937 - DNA, 20 bp, Artificial
  CRISPR gRNA sequence
ggaaatgctgcacttcagat

SEQ ID NO: 196938 - DNA, 20 bp, Artificial
  CRISPR gRNA sequence
cacttcagatcacagatgtg

SEQ ID NO: 196939 - DNA, 20 bp, Artificial
  CRISPR gRNA sequence
cagatcacagatgtgaaatt

SEQ ID NO: 196940 - DNA, 20 bp, Artificial
  CRISPR gRNA sequence
agatcacagatgtgaaattg

SEQ ID NO: 196941 - DNA, 20 bp, Artificial
  CRISPR gRNA sequence
caggatgcaggggtgtaccg

SEQ ID NO: 196942 - DNA, 20 bp, Artificial
  CRISPR gRNA sequence
catgatcagctatggtggtg

SEQ ID NO: 196943 - DNA, 20 bp, Artificial
  CRISPR gRNA sequence
tggtggtgccgactacaagc

SEQ ID NO: 196944 - DNA, 20 bp, Artificial
  CRISPR gRNA sequence
caagcgaattactgtgaaag

SEQ ID NO: 196945 - DNA, 20 bp, Artificial
  CRISPR gRNA sequence
ctgtgaaagtcaatggtaag

SEQ ID NO: 196946 - DNA, 20 bp, Artificial
  CRISPR gRNA sequence
tgaaagtcaatggtaagaat

SEQ ID NO: 196947 - DNA, 20 bp, Artificial
  CRISPR gRNA sequence
ttatagatgagaggcctgat

SEQ ID NO: 196948 - DNA, 20 bp, Artificial
  CRISPR gRNA sequence
tagatgagaggcctgatctt

SEQ ID NO: 196949 - DNA, 20 bp, Artificial
  CRISPR gRNA sequence
atctttattgaaaacatatt

SEQ ID NO: 196950 - DNA, 20 bp, Artificial
  CRISPR gRNA sequence
tattgaaaacatattccaag

SEQ ID NO: 196951 - DNA, 20 bp, Artificial
  CRISPR gRNA sequence
attgaaaacatattccaagt

SEQ ID NO: 196952 - DNA, 20 bp, Artificial
  CRISPR gRNA sequence
ttgaaaacatattccaagtg

SEQ ID NO: 196953 - DNA, 20 bp, Artificial
  CRISPR gRNA sequence
aaaacatattccaagtgttg

SEQ ID NO: 196954 - DNA, 20 bp, Artificial
  CRISPR gRNA sequence
caagtgttgaagacttttca

SEQ ID NO: 196955 - DNA, 20 bp, Artificial
  CRISPR gRNA sequence
aagacttttcattcttgtaa

SEQ ID NO: 196956 - DNA, 20 bp, Artificial
  CRISPR gRNA sequence
ttcattcttgtaagtccata

SEQ ID NO: 196957 - DNA, 20 bp, Artificial
  CRISPR gRNA sequence
tcattcttgtaagtccatac

SEQ ID NO: 196958 - DNA, 20 bp, Artificial
  CRISPR gRNA sequence
cattcttgtaagtccatact

SEQ ID NO: 196959 - DNA, 20 bp, Artificial
  CRISPR gRNA sequence
attcttgtaagtccatactt

SEQ ID NO: 196960 - DNA, 20 bp, Artificial
  CRISPR gRNA sequence
ttgtaagtccatacttattt

SEQ ID NO: 196961 - DNA, 20 bp, Artificial
  CRISPR gRNA sequence
gtaagtccatacttattttc

SEQ ID NO: 196962 - DNA, 20 bp, Artificial
  CRISPR gRNA sequence
taagtccatacttattttca

SEQ ID NO: 196963 - DNA, 20 bp, Artificial
  CRISPR gRNA sequence
attttcaaacagaacagcat

SEQ ID NO: 196964 - DNA, 20 bp, Artificial
  CRISPR gRNA sequence
ttttcaaacagaacagcata

SEQ ID NO: 196965 - DNA, 20 bp, Artificial
  CRISPR gRNA sequence
tcaaacagaacagcatagtc

SEQ ID NO: 196966 - DNA, 20 bp, Artificial
  CRISPR gRNA sequence
caaacagaacagcatagtct

SEQ ID NO: 196967 - DNA, 20 bp, Artificial
  CRISPR gRNA sequence
aaacagaacagcatagtctg

SEQ ID NO: 196968 - DNA, 20 bp, Artificial
  CRISPR gRNA sequence
ttcattcattcattcaattc

SEQ ID NO: 196969 - DNA, 20 bp, Artificial
  CRISPR gRNA sequence
attcattcattcaattcatg

SEQ ID NO: 196970 - DNA, 20 bp, Artificial
  CRISPR gRNA sequence
attcattcaattcatgaatt

SEQ ID NO: 196971 - DNA, 20 bp, Artificial
  CRISPR gRNA sequence
attcaattcatgaattcatt

SEQ ID NO: 196972 - DNA, 20 bp, Artificial
  CRISPR gRNA sequence
aattcatgaattcattcaca

SEQ ID NO: 196973 - DNA, 20 bp, Artificial
  CRISPR gRNA sequence
atgaattcattcacataatt

SEQ ID NO: 196974 - DNA, 20 bp, Artificial
  CRISPR gRNA sequence
attcacataattatccaatt

SEQ ID NO: 196975 - DNA, 20 bp, Artificial
  CRISPR gRNA sequence
acataattatccaatttctt

SEQ ID NO: 196976 - DNA, 20 bp, Artificial
  CRISPR gRNA sequence
tccaatttcttgagcaccta

SEQ ID NO: 196977 - DNA, 20 bp, Artificial
  CRISPR gRNA sequence
cttgagcacctatttgatag

SEQ ID NO: 196978 - DNA, 20 bp, Artificial
  CRISPR gRNA sequence
ttgagcacctatttgatagt

SEQ ID NO: 196979 - DNA, 20 bp, Artificial
  CRISPR gRNA sequence
gagcacctatttgatagtca

SEQ ID NO: 196980 - DNA, 20 bp, Artificial
  CRISPR gRNA sequence
agcacctatttgatagtcac

SEQ ID NO: 196981 - DNA, 20 bp, Artificial
  CRISPR gRNA sequence
tttgatagtcactggaaatc

SEQ ID NO: 196982 - DNA, 20 bp, Artificial
  CRISPR gRNA sequence
gatagtcactggaaatccag

SEQ ID NO: 196983 - DNA, 20 bp, Artificial
  CRISPR gRNA sequence
atagtcactggaaatccaga

SEQ ID NO: 196984 - DNA, 20 bp, Artificial
  CRISPR gRNA sequence
gaaatccagagacaaacaac

SEQ ID NO: 196985 - DNA, 20 bp, Artificial
  CRISPR gRNA sequence
tacagtatgtacagttttcc

SEQ ID NO: 196986 - DNA, 20 bp, Artificial
  CRISPR gRNA sequence
cagtatgtacagttttccaa

SEQ ID NO: 196987 - DNA, 20 bp, Artificial
  CRISPR gRNA sequence
tccaaaaagaatttctagtc

SEQ ID NO: 196988 - DNA, 20 bp, Artificial
  CRISPR gRNA sequence
ccaaaaagaatttctagtct

SEQ ID NO: 196989 - DNA, 20 bp, Artificial
  CRISPR gRNA sequence
caaaaagaatttctagtctt

SEQ ID NO: 196990 - DNA, 20 bp, Artificial
  CRISPR gRNA sequence
ctagtctttacttttttatt

SEQ ID NO: 196991 - DNA, 20 bp, Artificial
  CRISPR gRNA sequence
tagtctttacttttttatta

SEQ ID NO: 196992 - DNA, 20 bp, Artificial
  CRISPR gRNA sequence
gtctttacttttttattaca

SEQ ID NO: 196993 - DNA, 20 bp, Artificial
  CRISPR gRNA sequence
tacttttttattacaaatgg

SEQ ID NO: 196994 - DNA, 20 bp, Artificial
  CRISPR gRNA sequence
acttttttattacaaatgga

SEQ ID NO: 196995 - DNA, 20 bp, Artificial
  CRISPR gRNA sequence
cttttttattacaaatggaa

SEQ ID NO: 196996 - DNA, 20 bp, Artificial
  CRISPR gRNA sequence
ttttattacaaatggaatac

SEQ ID NO: 196997 - DNA, 20 bp, Artificial
  CRISPR gRNA sequence
tttattacaaatggaatacg

SEQ ID NO: 196998 - DNA, 20 bp, Artificial
  CRISPR gRNA sequence
ttattacaaatggaatacgt

SEQ ID NO: 196999 - DNA, 20 bp, Artificial
  CRISPR gRNA sequence
tattacaaatggaatacgta

SEQ ID NO: 197000 - DNA, 20 bp, Artificial
  CRISPR gRNA sequence
attacaaatggaatacgtat

SEQ ID NO: 197001 - DNA, 20 bp, Artificial
  CRISPR gRNA sequence
ttacaaatggaatacgtata

SEQ ID NO: 197002 - DNA, 20 bp, Artificial
  CRISPR gRNA sequence
caaatggaatacgtatactt

SEQ ID NO: 197003 - DNA, 20 bp, Artificial
  CRISPR gRNA sequence
gcaaataattcagatactgt

SEQ ID NO: 197004 - DNA, 20 bp, Artificial
  CRISPR gRNA sequence
caaataattcagatactgtg

SEQ ID NO: 197005 - DNA, 20 bp, Artificial
  CRISPR gRNA sequence
agatactgtggaagagatca

SEQ ID NO: 197006 - DNA, 20 bp, Artificial
  CRISPR gRNA sequence
tggaagagatcaaatgaatt

SEQ ID NO: 197007 - DNA, 20 bp, Artificial
  CRISPR gRNA sequence
caaaagtgtccctcctccct

SEQ ID NO: 197008 - DNA, 20 bp, Artificial
  CRISPR gRNA sequence
ctcccttcaccactatctcc

SEQ ID NO: 197009 - DNA, 20 bp, Artificial
  CRISPR gRNA sequence
ccttcaccactatctcccat

SEQ ID NO: 197010 - DNA, 20 bp, Artificial
  CRISPR gRNA sequence
caccactatctcccatggca

SEQ ID NO: 197011 - DNA, 20 bp, Artificial
  CRISPR gRNA sequence
accactatctcccatggcat

SEQ ID NO: 197012 - DNA, 20 bp, Artificial
  CRISPR gRNA sequence
tctcccatggcatgcagaga

SEQ ID NO: 197013 - DNA, 20 bp, Artificial
  CRISPR gRNA sequence
ccatggcatgcagagagagt

SEQ ID NO: 197014 - DNA, 20 bp, Artificial
  CRISPR gRNA sequence
tttgtgtgtccctccagaaa

SEQ ID NO: 197015 - DNA, 20 bp, Artificial
  CRISPR gRNA sequence
gtgtgtccctccagaaattt

SEQ ID NO: 197016 - DNA, 20 bp, Artificial
  CRISPR gRNA sequence
tgtgtccctccagaaatttt

SEQ ID NO: 197017 - DNA, 20 bp, Artificial
  CRISPR gRNA sequence
cagaaatttttttattcaac

SEQ ID NO: 197018 - DNA, 20 bp, Artificial
  CRISPR gRNA sequence
ttttattcaactactatttt

SEQ ID NO: 197019 - DNA, 20 bp, Artificial
  CRISPR gRNA sequence
tttattcaactactattttt

SEQ ID NO: 197020 - DNA, 20 bp, Artificial
  CRISPR gRNA sequence
ttattcaactactatttttt

SEQ ID NO: 197021 - DNA, 20 bp, Artificial
  CRISPR gRNA sequence
tattcaactactattttttt

SEQ ID NO: 197022 - DNA, 20 bp, Artificial
  CRISPR gRNA sequence
attcaactactattttttta

SEQ ID NO: 197023 - DNA, 20 bp, Artificial
  CRISPR gRNA sequence
ttcaactactatttttttat

SEQ ID NO: 197024 - DNA, 20 bp, Artificial
  CRISPR gRNA sequence
aactactatttttttatttt

SEQ ID NO: 197025 - DNA, 20 bp, Artificial
  CRISPR gRNA sequence
ctatttttttattttattag

SEQ ID NO: 197026 - DNA, 20 bp, Artificial
  CRISPR gRNA sequence
tttttttattttattaggtc

SEQ ID NO: 197027 - DNA, 20 bp, Artificial
  CRISPR gRNA sequence
ttttattttattaggtccgt

SEQ ID NO: 197028 - DNA, 20 bp, Artificial
  CRISPR gRNA sequence
tttattttattaggtccgtc

SEQ ID NO: 197029 - DNA, 20 bp, Artificial
  CRISPR gRNA sequence
ttattttattaggtccgtca

SEQ ID NO: 197030 - DNA, 20 bp, Artificial
  CRISPR gRNA sequence
tattttattaggtccgtcag

SEQ ID NO: 197031 - DNA, 20 bp, Artificial
  CRISPR gRNA sequence
attttattaggtccgtcagt

SEQ ID NO: 197032 - DNA, 20 bp, Artificial
  CRISPR gRNA sequence
ttttattaggtccgtcagtt

SEQ ID NO: 197033 - DNA, 20 bp, Artificial
  CRISPR gRNA sequence
tattaggtccgtcagttttc

SEQ ID NO: 197034 - DNA, 20 bp, Artificial
  CRISPR gRNA sequence
attaggtccgtcagttttcc

SEQ ID NO: 197035 - DNA, 20 bp, Artificial
  CRISPR gRNA sequence
ttaggtccgtcagttttcct

SEQ ID NO: 197036 - DNA, 20 bp, Artificial
  CRISPR gRNA sequence
ggtccgtcagttttcctttt

SEQ ID NO: 197037 - DNA, 20 bp, Artificial
  CRISPR gRNA sequence
tccttttttgagcctctcta

SEQ ID NO: 197038 - DNA, 20 bp, Artificial
  CRISPR gRNA sequence
ccttttttgagcctctctat

SEQ ID NO: 197039 - DNA, 20 bp, Artificial
  CRISPR gRNA sequence
cttttttgagcctctctata

SEQ ID NO: 197040 - DNA, 20 bp, Artificial
  CRISPR gRNA sequence
ttttgagcctctctatatca

SEQ ID NO: 197041 - DNA, 20 bp, Artificial
  CRISPR gRNA sequence
tttgagcctctctatatcaa

SEQ ID NO: 197042 - DNA, 20 bp, Artificial
  CRISPR gRNA sequence
ttgagcctctctatatcaaa

SEQ ID NO: 197043 - DNA, 20 bp, Artificial
  CRISPR gRNA sequence
tgagcctctctatatcaaat

SEQ ID NO: 197044 - DNA, 20 bp, Artificial
  CRISPR gRNA sequence
gagcctctctatatcaaatg

SEQ ID NO: 197045 - DNA, 20 bp, Artificial
  CRISPR gRNA sequence
agcctctctatatcaaatgc

SEQ ID NO: 197046 - DNA, 20 bp, Artificial
  CRISPR gRNA sequence
tctatatcaaatgcaaataa

SEQ ID NO: 197047 - DNA, 20 bp, Artificial
  CRISPR gRNA sequence
tatatcaaatgcaaataaat

SEQ ID NO: 197048 - DNA, 20 bp, Artificial
  CRISPR gRNA sequence
tatcaaatgcaaataaatat

SEQ ID NO: 197049 - DNA, 20 bp, Artificial
  CRISPR gRNA sequence
agaacaaaccccactgtaag

SEQ ID NO: 197050 - DNA, 20 bp, Artificial
  CRISPR gRNA sequence
taaggttcacattaaaaaag

SEQ ID NO: 197051 - DNA, 20 bp, Artificial
  CRISPR gRNA sequence
acattaaaaaagacttgaag

SEQ ID NO: 197052 - DNA, 20 bp, Artificial
  CRISPR gRNA sequence
aaaaagacttgaagtcaccc

SEQ ID NO: 197053 - DNA, 20 bp, Artificial
  CRISPR gRNA sequence
gaagtcaccctatgaagaca

SEQ ID NO: 197054 - DNA, 20 bp, Artificial
  CRISPR gRNA sequence
aagtcaccctatgaagacaa

SEQ ID NO: 197055 - DNA, 20 bp, Artificial
  CRISPR gRNA sequence
tgaagacaaaaaataatcac

SEQ ID NO: 197056 - DNA, 20 bp, Artificial
  CRISPR gRNA sequence
agtgtgaaagaacctattct

SEQ ID NO: 197057 - DNA, 20 bp, Artificial
  CRISPR gRNA sequence
ttcttccagtacaggataag

SEQ ID NO: 197058 - DNA, 20 bp, Artificial
  CRISPR gRNA sequence
ttccagtacaggataagcca

SEQ ID NO: 197059 - DNA, 20 bp, Artificial
  CRISPR gRNA sequence
ccagtacaggataagccata

SEQ ID NO: 197060 - DNA, 20 bp, Artificial
  CRISPR gRNA sequence
cagtacaggataagccatac

SEQ ID NO: 197061 - DNA, 20 bp, Artificial
  CRISPR gRNA sequence
actgggcatatattcatctt

SEQ ID NO: 197062 - DNA, 20 bp, Artificial
  CRISPR gRNA sequence
ctgggcatatattcatcttg

SEQ ID NO: 197063 - DNA, 20 bp, Artificial
  CRISPR gRNA sequence
ggcatatattcatcttgaaa

SEQ ID NO: 197064 - DNA, 20 bp, Artificial
  CRISPR gRNA sequence
atcttgaaaatctatactga

SEQ ID NO: 197065 - DNA, 20 bp, Artificial
  CRISPR gRNA sequence
gaaaatctatactgatgttg

SEQ ID NO: 197066 - DNA, 20 bp, Artificial
  CRISPR gRNA sequence
aaaatctatactgatgttgt

SEQ ID NO: 197067 - DNA, 20 bp, Artificial
  CRISPR gRNA sequence
tactgatgttgtcttgggga

SEQ ID NO: 197068 - DNA, 20 bp, Artificial
  CRISPR gRNA sequence
atgttgtcttggggaattga

SEQ ID NO: 197069 - DNA, 20 bp, Artificial
  CRISPR gRNA sequence
tcttggggaattgaaaagga

SEQ ID NO: 197070 - DNA, 20 bp, Artificial
  CRISPR gRNA sequence
ggggaattgaaaaggaacta

SEQ ID NO: 197071 - DNA, 20 bp, Artificial
  CRISPR gRNA sequence
gggaattgaaaaggaactag

SEQ ID NO: 197072 - DNA, 20 bp, Artificial
  CRISPR gRNA sequence
aaaaggaactaggagtgtta

SEQ ID NO: 197073 - DNA, 20 bp, Artificial
  CRISPR gRNA sequence
ggagtgttagttcctcggta

SEQ ID NO: 197074 - DNA, 20 bp, Artificial
  CRISPR gRNA sequence
gttcctcggtattgacccac

SEQ ID NO: 197075 - DNA, 20 bp, Artificial
  CRISPR gRNA sequence
ctcggtattgacccacagtt

SEQ ID NO: 197076 - DNA, 20 bp, Artificial
  CRISPR gRNA sequence
ggtattgacccacagttatg

SEQ ID NO: 197077 - DNA, 20 bp, Artificial
  CRISPR gRNA sequence
acccacagttatgttatcag

SEQ ID NO: 197078 - DNA, 20 bp, Artificial
  CRISPR gRNA sequence
tgttatcaggtcacttgagt

SEQ ID NO: 197079 - DNA, 20 bp, Artificial
  CRISPR gRNA sequence
tcaggtcacttgagttcaaa

SEQ ID NO: 197080 - DNA, 20 bp, Artificial
  CRISPR gRNA sequence
gagttcaaagttttgtgttg

SEQ ID NO: 197081 - DNA, 20 bp, Artificial
  CRISPR gRNA sequence
agttcaaagttttgtgttgg

SEQ ID NO: 197082 - DNA, 20 bp, Artificial
  CRISPR gRNA sequence
aaagttttgtgttggcacta

SEQ ID NO: 197083 - DNA, 20 bp, Artificial
  CRISPR gRNA sequence
tgtgttggcactagctaagt

SEQ ID NO: 197084 - DNA, 20 bp, Artificial
  CRISPR gRNA sequence
gtgttggcactagctaagta

SEQ ID NO: 197085 - DNA, 20 bp, Artificial
  CRISPR gRNA sequence
tgttggcactagctaagtaa

SEQ ID NO: 197086 - DNA, 20 bp, Artificial
  CRISPR gRNA sequence
gcactagctaagtaaaggaa

SEQ ID NO: 197087 - DNA, 20 bp, Artificial
  CRISPR gRNA sequence
gctaagtaaaggaaaacacc

SEQ ID NO: 197088 - DNA, 20 bp, Artificial
  CRISPR gRNA sequence
agtaaaggaaaacacctctg

SEQ ID NO: 197089 - DNA, 20 bp, Artificial
  CRISPR gRNA sequence
tgctttcattgttgagtttc

SEQ ID NO: 197090 - DNA, 20 bp, Artificial
  CRISPR gRNA sequence
ctttcattgttgagtttcac

SEQ ID NO: 197091 - DNA, 20 bp, Artificial
  CRISPR gRNA sequence
tcattgttgagtttcacaga

SEQ ID NO: 197092 - DNA, 20 bp, Artificial
  CRISPR gRNA sequence
cattgttgagtttcacagaa

SEQ ID NO: 197093 - DNA, 20 bp, Artificial
  CRISPR gRNA sequence
attgttgagtttcacagaat

SEQ ID NO: 197094 - DNA, 20 bp, Artificial
  CRISPR gRNA sequence
ttgagtttcacagaattgag

SEQ ID NO: 197095 - DNA, 20 bp, Artificial
  CRISPR gRNA sequence
agtttcacagaattgagagc

SEQ ID NO: 197096 - DNA, 20 bp, Artificial
  CRISPR gRNA sequence
cacagaattgagagctgaaa

SEQ ID NO: 197097 - DNA, 20 bp, Artificial
  CRISPR gRNA sequence
acagaattgagagctgaaag

SEQ ID NO: 197098 - DNA, 20 bp, Artificial
  CRISPR gRNA sequence
agagctgaaaggatcccagg

SEQ ID NO: 197099 - DNA, 20 bp, Artificial
  CRISPR gRNA sequence
aaaggatcccaggcaggagc

SEQ ID NO: 197100 - DNA, 20 bp, Artificial
  CRISPR gRNA sequence
atccaaactcccacaaagaa

SEQ ID NO: 197101 - DNA, 20 bp, Artificial
  CRISPR gRNA sequence
ccacaaagaacaaaaatccc

SEQ ID NO: 197102 - DNA, 20 bp, Artificial
  CRISPR gRNA sequence
ctgttcttatatttcctgca

SEQ ID NO: 197103 - DNA, 20 bp, Artificial
  CRISPR gRNA sequence
tgttcttatatttcctgcaa

SEQ ID NO: 197104 - DNA, 20 bp, Artificial
  CRISPR gRNA sequence
ttcttatatttcctgcaatg

SEQ ID NO: 197105 - DNA, 20 bp, Artificial
  CRISPR gRNA sequence
ttatatttcctgcaatggcg

SEQ ID NO: 197106 - DNA, 20 bp, Artificial
  CRISPR gRNA sequence
atatttcctgcaatggcgtc

SEQ ID NO: 197107 - DNA, 20 bp, Artificial
  CRISPR gRNA sequence
tatttcctgcaatggcgtcc

SEQ ID NO: 197108 - DNA, 20 bp, Artificial
  CRISPR gRNA sequence
cctgcaatggcgtccctgtc

SEQ ID NO: 197109 - DNA, 20 bp, Artificial
  CRISPR gRNA sequence
ctgcaatggcgtccctgtca

SEQ ID NO: 197110 - DNA, 20 bp, Artificial
  CRISPR gRNA sequence
caatggcgtccctgtcatat

SEQ ID NO: 197111 - DNA, 20 bp, Artificial
  CRISPR gRNA sequence
tcatatcccacaatggcctc

SEQ ID NO: 197112 - DNA, 20 bp, Artificial
  CRISPR gRNA sequence
cctgccatttggatatccct

SEQ ID NO: 197113 - DNA, 20 bp, Artificial
  CRISPR gRNA sequence
ccatttggatatcccttcca

SEQ ID NO: 197114 - DNA, 20 bp, Artificial
  CRISPR gRNA sequence
ggatatcccttccatatcct

SEQ ID NO: 197115 - DNA, 20 bp, Artificial
  CRISPR gRNA sequence
gatatcccttccatatcctg

SEQ ID NO: 197116 - DNA, 20 bp, Artificial
  CRISPR gRNA sequence
ccatatcctgttgaaattac

SEQ ID NO: 197117 - DNA, 20 bp, Artificial
  CRISPR gRNA sequence
catatcctgttgaaattact

SEQ ID NO: 197118 - DNA, 20 bp, Artificial
  CRISPR gRNA sequence
ttgaaattactccctaatag

SEQ ID NO: 197119 - DNA, 20 bp, Artificial
  CRISPR gRNA sequence
aaattactccctaatagtaa

SEQ ID NO: 197120 - DNA, 20 bp, Artificial
  CRISPR gRNA sequence
ctccctaatagtaagctgaa

SEQ ID NO: 197121 - DNA, 20 bp, Artificial
  CRISPR gRNA sequence
cctaatagtaagctgaaatc

SEQ ID NO: 197122 - DNA, 20 bp, Artificial
  CRISPR gRNA sequence
atagtaagctgaaatctgcc

SEQ ID NO: 197123 - DNA, 20 bp, Artificial
  CRISPR gRNA sequence
aaatctgcccctctagttgt

SEQ ID NO: 197124 - DNA, 20 bp, Artificial
  CRISPR gRNA sequence
cccctctagttgtagtcttg

SEQ ID NO: 197125 - DNA, 20 bp, Artificial
  CRISPR gRNA sequence
tagttgtagtcttgggatta

SEQ ID NO: 197126 - DNA, 20 bp, Artificial
  CRISPR gRNA sequence
gttgtagtcttgggattatt

SEQ ID NO: 197127 - DNA, 20 bp, Artificial
  CRISPR gRNA sequence
tagtcttgggattatttcat

SEQ ID NO: 197128 - DNA, 20 bp, Artificial
  CRISPR gRNA sequence
gggattatttcatttacatg

SEQ ID NO: 197129 - DNA, 20 bp, Artificial
  CRISPR gRNA sequence
ggattatttcatttacatga

SEQ ID NO: 197130 - DNA, 20 bp, Artificial
  CRISPR gRNA sequence
tttcatttacatgatgacct

SEQ ID NO: 197131 - DNA, 20 bp, Artificial
  CRISPR gRNA sequence
catttacatgatgacctttt

SEQ ID NO: 197132 - DNA, 20 bp, Artificial
  CRISPR gRNA sequence
atttacatgatgacctttta

SEQ ID NO: 197133 - DNA, 20 bp, Artificial
  CRISPR gRNA sequence
acatgatgaccttttaatat

SEQ ID NO: 197134 - DNA, 20 bp, Artificial
  CRISPR gRNA sequence
catgatgaccttttaatatt

SEQ ID NO: 197135 - DNA, 20 bp, Artificial
  CRISPR gRNA sequence
ttaatatttgactagaatta

SEQ ID NO: 197136 - DNA, 20 bp, Artificial
  CRISPR gRNA sequence
taatatttgactagaattaa

SEQ ID NO: 197137 - DNA, 20 bp, Artificial
  CRISPR gRNA sequence
aatatttgactagaattaaa

SEQ ID NO: 197138 - DNA, 20 bp, Artificial
  CRISPR gRNA sequence
atatttgactagaattaaat

SEQ ID NO: 197139 - DNA, 20 bp, Artificial
  CRISPR gRNA sequence
gactagaattaaatcatctc

SEQ ID NO: 197140 - DNA, 20 bp, Artificial
  CRISPR gRNA sequence
actagaattaaatcatctcc

SEQ ID NO: 197141 - DNA, 20 bp, Artificial
  CRISPR gRNA sequence
gaattaaatcatctcccctt

SEQ ID NO: 197142 - DNA, 20 bp, Artificial
  CRISPR gRNA sequence
aatcatctccccttggtctt

SEQ ID NO: 197143 - DNA, 20 bp, Artificial
  CRISPR gRNA sequence
cccttggtctttccattcct

SEQ ID NO: 197144 - DNA, 20 bp, Artificial
  CRISPR gRNA sequence
ggtctttccattcctgggct

SEQ ID NO: 197145 - DNA, 20 bp, Artificial
  CRISPR gRNA sequence
gtctttccattcctgggcta

SEQ ID NO: 197146 - DNA, 20 bp, Artificial
  CRISPR gRNA sequence
tccattcctgggctaactac

SEQ ID NO: 197147 - DNA, 20 bp, Artificial
  CRISPR gRNA sequence
ccattcctgggctaactacc

SEQ ID NO: 197148 - DNA, 20 bp, Artificial
  CRISPR gRNA sequence
cattcctgggctaactacca

SEQ ID NO: 197149 - DNA, 20 bp, Artificial
  CRISPR gRNA sequence
ctgggctaactaccatcaat

SEQ ID NO: 197150 - DNA, 20 bp, Artificial
  CRISPR gRNA sequence
ggctaactaccatcaatctg

SEQ ID NO: 197151 - DNA, 20 bp, Artificial
  CRISPR gRNA sequence
actaccatcaatctgagggc

SEQ ID NO: 197152 - DNA, 20 bp, Artificial
  CRISPR gRNA sequence
ccatcaatctgagggctaac

SEQ ID NO: 197153 - DNA, 20 bp, Artificial
  CRISPR gRNA sequence
agggctaacaatacaagtag

SEQ ID NO: 197154 - DNA, 20 bp, Artificial
  CRISPR gRNA sequence
acaatacaagtagaaaaagt

SEQ ID NO: 197155 - DNA, 20 bp, Artificial
  CRISPR gRNA sequence
gtcactgatcactgatcaat

SEQ ID NO: 197156 - DNA, 20 bp, Artificial
  CRISPR gRNA sequence
tcactgatcactgatcaatt

SEQ ID NO: 197157 - DNA, 20 bp, Artificial
  CRISPR gRNA sequence
atcactgatcaattattaat

SEQ ID NO: 197158 - DNA, 20 bp, Artificial
  CRISPR gRNA sequence
atcaattattaatcaatgat

SEQ ID NO: 197159 - DNA, 20 bp, Artificial
  CRISPR gRNA sequence
ttaatcaatgatcactgata

SEQ ID NO: 197160 - DNA, 20 bp, Artificial
  CRISPR gRNA sequence
atcaatgatcactgataact

SEQ ID NO: 197161 - DNA, 20 bp, Artificial
  CRISPR gRNA sequence
ataactataaactcaaaaac

SEQ ID NO: 197162 - DNA, 20 bp, Artificial
  CRISPR gRNA sequence
taaactcaaaaacaaaatca

SEQ ID NO: 197163 - DNA, 20 bp, Artificial
  CRISPR gRNA sequence
aaaaacaaaatcatgtgggg

SEQ ID NO: 197164 - DNA, 20 bp, Artificial
  CRISPR gRNA sequence
agagaaatgtatcagtttta

SEQ ID NO: 197165 - DNA, 20 bp, Artificial
  CRISPR gRNA sequence
tatgttgtatttctggtccc

SEQ ID NO: 197166 - DNA, 20 bp, Artificial
  CRISPR gRNA sequence
atgttgtatttctggtccct

SEQ ID NO: 197167 - DNA, 20 bp, Artificial
  CRISPR gRNA sequence
tgttgtatttctggtccctg

SEQ ID NO: 197168 - DNA, 20 bp, Artificial
  CRISPR gRNA sequence
tatttctggtccctgatact

SEQ ID NO: 197169 - DNA, 20 bp, Artificial
  CRISPR gRNA sequence
ctggtccctgatactggctc

SEQ ID NO: 197170 - DNA, 20 bp, Artificial
  CRISPR gRNA sequence
tggtccctgatactggctca

SEQ ID NO: 197171 - DNA, 20 bp, Artificial
  CRISPR gRNA sequence
gtccctgatactggctcagg

SEQ ID NO: 197172 - DNA, 20 bp, Artificial
  CRISPR gRNA sequence
atactggctcaggtaatgcc

SEQ ID NO: 197173 - DNA, 20 bp, Artificial
  CRISPR gRNA sequence
gctcaggtaatgccactatt

SEQ ID NO: 197174 - DNA, 20 bp, Artificial
  CRISPR gRNA sequence
aggtaatgccactattgtca

SEQ ID NO: 197175 - DNA, 20 bp, Artificial
  CRISPR gRNA sequence
ttgtcaagaagataccactt

SEQ ID NO: 197176 - DNA, 20 bp, Artificial
  CRISPR gRNA sequence
tcaagaagataccacttgta

SEQ ID NO: 197177 - DNA, 20 bp, Artificial
  CRISPR gRNA sequence
gtaaagtagatttaattttc

SEQ ID NO: 197178 - DNA, 20 bp, Artificial
  CRISPR gRNA sequence
taaagtagatttaattttca

SEQ ID NO: 197179 - DNA, 20 bp, Artificial
  CRISPR gRNA sequence
aattttcattatattttacc

SEQ ID NO: 197180 - DNA, 20 bp, Artificial
  CRISPR gRNA sequence
attttcattatattttacca

SEQ ID NO: 197181 - DNA, 20 bp, Artificial
  CRISPR gRNA sequence
tcattatattttaccatatg

SEQ ID NO: 197182 - DNA, 20 bp, Artificial
  CRISPR gRNA sequence
cattatattttaccatatgc

SEQ ID NO: 197183 - DNA, 20 bp, Artificial
  CRISPR gRNA sequence
attatattttaccatatgct

SEQ ID NO: 197184 - DNA, 20 bp, Artificial
  CRISPR gRNA sequence
tattttaccatatgcttctc

SEQ ID NO: 197185 - DNA, 20 bp, Artificial
  CRISPR gRNA sequence
taccatatgcttctccattc

SEQ ID NO: 197186 - DNA, 20 bp, Artificial
  CRISPR gRNA sequence
accatatgcttctccattca

SEQ ID NO: 197187 - DNA, 20 bp, Artificial
  CRISPR gRNA sequence
ccatatgcttctccattcat

SEQ ID NO: 197188 - DNA, 20 bp, Artificial
  CRISPR gRNA sequence
ctccattcatgacatctctt

SEQ ID NO: 197189 - DNA, 20 bp, Artificial
  CRISPR gRNA sequence
tccattcatgacatctcttg

SEQ ID NO: 197190 - DNA, 20 bp, Artificial
  CRISPR gRNA sequence
cattcatgacatctcttgag

SEQ ID NO: 197191 - DNA, 20 bp, Artificial
  CRISPR gRNA sequence
atgacatctcttgagatgtt

SEQ ID NO: 197192 - DNA, 20 bp, Artificial
  CRISPR gRNA sequence
ttgagatgttgtggtttata

SEQ ID NO: 197193 - DNA, 20 bp, Artificial
  CRISPR gRNA sequence
gagatgttgtggtttatact

SEQ ID NO: 197194 - DNA, 20 bp, Artificial
  CRISPR gRNA sequence
agatgttgtggtttatactt

SEQ ID NO: 197195 - DNA, 20 bp, Artificial
  CRISPR gRNA sequence
tggtttatactttcagtttt

SEQ ID NO: 197196 - DNA, 20 bp, Artificial
  CRISPR gRNA sequence
atactttcagtttttctcca

SEQ ID NO: 197197 - DNA, 20 bp, Artificial
  CRISPR gRNA sequence
tactttcagtttttctccag

SEQ ID NO: 197198 - DNA, 20 bp, Artificial
  CRISPR gRNA sequence
tcagtttttctccagtccat

SEQ ID NO: 197199 - DNA, 20 bp, Artificial
  CRISPR gRNA sequence
cagtttttctccagtccatc

SEQ ID NO: 197200 - DNA, 20 bp, Artificial
  CRISPR gRNA sequence
agtttttctccagtccatcc

SEQ ID NO: 197201 - DNA, 20 bp, Artificial
  CRISPR gRNA sequence
ttctccagtccatccgcaaa

SEQ ID NO: 197202 - DNA, 20 bp, Artificial
  CRISPR gRNA sequence
tctccagtccatccgcaaat

SEQ ID NO: 197203 - DNA, 20 bp, Artificial
  CRISPR gRNA sequence
ctccagtccatccgcaaata

SEQ ID NO: 197204 - DNA, 20 bp, Artificial
  CRISPR gRNA sequence
tccagtccatccgcaaatat

SEQ ID NO: 197205 - DNA, 20 bp, Artificial
  CRISPR gRNA sequence
cagtccatccgcaaatatca

SEQ ID NO: 197206 - DNA, 20 bp, Artificial
  CRISPR gRNA sequence
ctgtgttccaagatattaaa

SEQ ID NO: 197207 - DNA, 20 bp, Artificial
  CRISPR gRNA sequence
tgttccaagatattaaagaa

SEQ ID NO: 197208 - DNA, 20 bp, Artificial
  CRISPR gRNA sequence
caagatattaaagaaatcat

SEQ ID NO: 197209 - DNA, 20 bp, Artificial
  CRISPR gRNA sequence
aagaaatcatcatgacttag

SEQ ID NO: 197210 - DNA, 20 bp, Artificial
  CRISPR gRNA sequence
agcctcatcaacagcattgc

SEQ ID NO: 197211 - DNA, 20 bp, Artificial
  CRISPR gRNA sequence
gcctcatcaacagcattgct

SEQ ID NO: 197212 - DNA, 20 bp, Artificial
  CRISPR gRNA sequence
atcaacagcattgctagatc

SEQ ID NO: 197213 - DNA, 20 bp, Artificial
  CRISPR gRNA sequence
ctagatctgggatggaaagg

SEQ ID NO: 197214 - DNA, 20 bp, Artificial
  CRISPR gRNA sequence
gatctgggatggaaaggaag

SEQ ID NO: 197215 - DNA, 20 bp, Artificial
  CRISPR gRNA sequence
ggatggaaaggaagagtata

SEQ ID NO: 197216 - DNA, 20 bp, Artificial
  CRISPR gRNA sequence
gcagtcaggaagaaggcagc

SEQ ID NO: 197217 - DNA, 20 bp, Artificial
  CRISPR gRNA sequence
ctgcttccaaaaaaggtctc

SEQ ID NO: 197218 - DNA, 20 bp, Artificial
  CRISPR gRNA sequence
tgcttccaaaaaaggtctct

SEQ ID NO: 197219 - DNA, 20 bp, Artificial
  CRISPR gRNA sequence
cttccaaaaaaggtctctca

SEQ ID NO: 197220 - DNA, 20 bp, Artificial
  CRISPR gRNA sequence
ccaaaaaaggtctctcatca

SEQ ID NO: 197221 - DNA, 20 bp, Artificial
  CRISPR gRNA sequence
caaaaaaggtctctcatcag

SEQ ID NO: 197222 - DNA, 20 bp, Artificial
  CRISPR gRNA sequence
tcatcagcctgtagggagtg

SEQ ID NO: 197223 - DNA, 20 bp, Artificial
  CRISPR gRNA sequence
atcagcctgtagggagtgtg

SEQ ID NO: 197224 - DNA, 20 bp, Artificial
  CRISPR gRNA sequence
tagggagtgtgtagggaagg

SEQ ID NO: 197225 - DNA, 20 bp, Artificial
  CRISPR gRNA sequence
tccttgtagtagggaagggt

SEQ ID NO: 197226 - DNA, 20 bp, Artificial
  CRISPR gRNA sequence
gtagtagggaagggttttat

SEQ ID NO: 197227 - DNA, 20 bp, Artificial
  CRISPR gRNA sequence
tagtagggaagggttttatt

SEQ ID NO: 197228 - DNA, 20 bp, Artificial
  CRISPR gRNA sequence
tattcaggtcgtctgggctc

SEQ ID NO: 197229 - DNA, 20 bp, Artificial
  CRISPR gRNA sequence
attcaggtcgtctgggctcc

SEQ ID NO: 197230 - DNA, 20 bp, Artificial
  CRISPR gRNA sequence
ttcaggtcgtctgggctcca

SEQ ID NO: 197231 - DNA, 20 bp, Artificial
  CRISPR gRNA sequence
aggtcgtctgggctccataa

SEQ ID NO: 197232 - DNA, 20 bp, Artificial
  CRISPR gRNA sequence
ggctccataatatcccttgt

SEQ ID NO: 197233 - DNA, 20 bp, Artificial
  CRISPR gRNA sequence
cataatatcccttgtgtatc

SEQ ID NO: 197234 - DNA, 20 bp, Artificial
  CRISPR gRNA sequence
gtgtatctgcagtctccttt

SEQ ID NO: 197235 - DNA, 20 bp, Artificial
  CRISPR gRNA sequence
tgtatctgcagtctcctttg

SEQ ID NO: 197236 - DNA, 20 bp, Artificial
  CRISPR gRNA sequence
cagtctcctttgccatggat

SEQ ID NO: 197237 - DNA, 20 bp, Artificial
  CRISPR gRNA sequence
ctttgccatggatcaacaca

SEQ ID NO: 197238 - DNA, 20 bp, Artificial
  CRISPR gRNA sequence
tgccatggatcaacacaata

SEQ ID NO: 197239 - DNA, 20 bp, Artificial
  CRISPR gRNA sequence
gccatggatcaacacaatag

SEQ ID NO: 197240 - DNA, 20 bp, Artificial
  CRISPR gRNA sequence
ccatggatcaacacaatagg

SEQ ID NO: 197241 - DNA, 20 bp, Artificial
  CRISPR gRNA sequence
ccggcactgatggtttttcc

SEQ ID NO: 197242 - DNA, 20 bp, Artificial
  CRISPR gRNA sequence
cggcactgatggtttttcca

SEQ ID NO: 197243 - DNA, 20 bp, Artificial
  CRISPR gRNA sequence
atggtttttccaagggggag

SEQ ID NO: 197244 - DNA, 20 bp, Artificial
  CRISPR gRNA sequence
ttccaagggggagttcttcc

SEQ ID NO: 197245 - DNA, 20 bp, Artificial
  CRISPR gRNA sequence
tccaagggggagttcttcct

SEQ ID NO: 197246 - DNA, 20 bp, Artificial
  CRISPR gRNA sequence
ccaagggggagttcttcctg

SEQ ID NO: 197247 - DNA, 20 bp, Artificial
  CRISPR gRNA sequence
caagggggagttcttcctgg

SEQ ID NO: 197248 - DNA, 20 bp, Artificial
  CRISPR gRNA sequence
ttcctggagcaaagcaaatg

SEQ ID NO: 197249 - DNA, 20 bp, Artificial
  CRISPR gRNA sequence
cctggagcaaagcaaatgac

SEQ ID NO: 197250 - DNA, 20 bp, Artificial
  CRISPR gRNA sequence
ctggagcaaagcaaatgacc

SEQ ID NO: 197251 - DNA, 20 bp, Artificial
  CRISPR gRNA sequence
gagcaaagcaaatgaccaac

SEQ ID NO: 197252 - DNA, 20 bp, Artificial
  CRISPR gRNA sequence
gaggacctgatttgtttgac

SEQ ID NO: 197253 - DNA, 20 bp, Artificial
  CRISPR gRNA sequence
aggacctgatttgtttgaca

SEQ ID NO: 197254 - DNA, 20 bp, Artificial
  CRISPR gRNA sequence
atttgtttgacaattccatt

SEQ ID NO: 197255 - DNA, 20 bp, Artificial
  CRISPR gRNA sequence
gtttgacaattccattttgt

SEQ ID NO: 197256 - DNA, 20 bp, Artificial
  CRISPR gRNA sequence
tttgacaattccattttgta

SEQ ID NO: 197257 - DNA, 20 bp, Artificial
  CRISPR gRNA sequence
gacaattccattttgtattg

SEQ ID NO: 197258 - DNA, 20 bp, Artificial
  CRISPR gRNA sequence
acaattccattttgtattgt

SEQ ID NO: 197259 - DNA, 20 bp, Artificial
  CRISPR gRNA sequence
cattttgtattgtaaattac

SEQ ID NO: 197260 - DNA, 20 bp, Artificial
  CRISPR gRNA sequence
tgtattgtaaattacttaat

SEQ ID NO: 197261 - DNA, 20 bp, Artificial
  CRISPR gRNA sequence
gtattgtaaattacttaatt

SEQ ID NO: 197262 - DNA, 20 bp, Artificial
  CRISPR gRNA sequence
tattgtaaattacttaattg

SEQ ID NO: 197263 - DNA, 20 bp, Artificial
  CRISPR gRNA sequence
taaattacttaattggcatt

SEQ ID NO: 197264 - DNA, 20 bp, Artificial
  CRISPR gRNA sequence
cttaattggcattctactcc

SEQ ID NO: 197265 - DNA, 20 bp, Artificial
  CRISPR gRNA sequence
aattggcattctactcccaa

SEQ ID NO: 197266 - DNA, 20 bp, Artificial
  CRISPR gRNA sequence
attggcattctactcccaat

SEQ ID NO: 197267 - DNA, 20 bp, Artificial
  CRISPR gRNA sequence
gcattctactcccaatccat

SEQ ID NO: 197268 - DNA, 20 bp, Artificial
  CRISPR gRNA sequence
tactcccaatccatcttgtc

SEQ ID NO: 197269 - DNA, 20 bp, Artificial
  CRISPR gRNA sequence
ctcccaatccatcttgtcat

SEQ ID NO: 197270 - DNA, 20 bp, Artificial
  CRISPR gRNA sequence
ccaatccatcttgtcatttg

SEQ ID NO: 197271 - DNA, 20 bp, Artificial
  CRISPR gRNA sequence
gtcatttgcatacagtggtt

SEQ ID NO: 197272 - DNA, 20 bp, Artificial
  CRISPR gRNA sequence
tcatttgcatacagtggttt

SEQ ID NO: 197273 - DNA, 20 bp, Artificial
  CRISPR gRNA sequence
gcatacagtggttttgggat

SEQ ID NO: 197274 - DNA, 20 bp, Artificial
  CRISPR gRNA sequence
catacagtggttttgggatt

SEQ ID NO: 197275 - DNA, 20 bp, Artificial
  CRISPR gRNA sequence
tgggattgagttcagctata

SEQ ID NO: 197276 - DNA, 20 bp, Artificial
  CRISPR gRNA sequence
gggattgagttcagctatac

SEQ ID NO: 197277 - DNA, 20 bp, Artificial
  CRISPR gRNA sequence
ggattgagttcagctatacc

SEQ ID NO: 197278 - DNA, 20 bp, Artificial
  CRISPR gRNA sequence
agttcagctataccaaaagt

SEQ ID NO: 197279 - DNA, 20 bp, Artificial
  CRISPR gRNA sequence
agctataccaaaagtctgaa

SEQ ID NO: 197280 - DNA, 20 bp, Artificial
  CRISPR gRNA sequence
taccaaaagtctgaaccttc

SEQ ID NO: 197281 - DNA, 20 bp, Artificial
  CRISPR gRNA sequence
aaccttctgcacttagaaca

SEQ ID NO: 197282 - DNA, 20 bp, Artificial
  CRISPR gRNA sequence
ctgcacttagaacaaggcaa

SEQ ID NO: 197283 - DNA, 20 bp, Artificial
  CRISPR gRNA sequence
tgcacttagaacaaggcaac

SEQ ID NO: 197284 - DNA, 20 bp, Artificial
  CRISPR gRNA sequence
cacttagaacaaggcaacca

SEQ ID NO: 197285 - DNA, 20 bp, Artificial
  CRISPR gRNA sequence
agaacaaggcaaccaccaag

SEQ ID NO: 197286 - DNA, 20 bp, Artificial
  CRISPR gRNA sequence
gaacaaggcaaccaccaagc

SEQ ID NO: 197287 - DNA, 20 bp, Artificial
  CRISPR gRNA sequence
cacttgcactgaggccgtgt

SEQ ID NO: 197288 - DNA, 20 bp, Artificial
  CRISPR gRNA sequence
acttgcactgaggccgtgtc

SEQ ID NO: 197289 - DNA, 20 bp, Artificial
  CRISPR gRNA sequence
gcactgaggccgtgtctcca

SEQ ID NO: 197290 - DNA, 20 bp, Artificial
  CRISPR gRNA sequence
cactgaggccgtgtctccaa

SEQ ID NO: 197291 - DNA, 20 bp, Artificial
  CRISPR gRNA sequence
aggccgtgtctccaatggaa

SEQ ID NO: 197292 - DNA, 20 bp, Artificial
  CRISPR gRNA sequence
caatggaaatgaggcagctg

SEQ ID NO: 197293 - DNA, 20 bp, Artificial
  CRISPR gRNA sequence
gcttgcaggagcttcccaac

SEQ ID NO: 197294 - DNA, 20 bp, Artificial
  CRISPR gRNA sequence
gcaggagcttcccaactcag

SEQ ID NO: 197295 - DNA, 20 bp, Artificial
  CRISPR gRNA sequence
caggagcttcccaactcagg

SEQ ID NO: 197296 - DNA, 20 bp, Artificial
  CRISPR gRNA sequence
cccaactcagggaagtagaa

SEQ ID NO: 197297 - DNA, 20 bp, Artificial
  CRISPR gRNA sequence
ccaactcagggaagtagaac

SEQ ID NO: 197298 - DNA, 20 bp, Artificial
  CRISPR gRNA sequence
agggaagtagaactcctgag

SEQ ID NO: 197299 - DNA, 20 bp, Artificial
  CRISPR gRNA sequence
ctgagtcacctccatatgca

SEQ ID NO: 197300 - DNA, 20 bp, Artificial
  CRISPR gRNA sequence
agtcacctccatatgcaaat

SEQ ID NO: 197301 - DNA, 20 bp, Artificial
  CRISPR gRNA sequence
catatgcaaatgatttcaca

SEQ ID NO: 197302 - DNA, 20 bp, Artificial
  CRISPR gRNA sequence
cacagtaatgctgttgaact

SEQ ID NO: 197303 - DNA, 20 bp, Artificial
  CRISPR gRNA sequence
acagtaatgctgttgaactt

SEQ ID NO: 197304 - DNA, 20 bp, Artificial
  CRISPR gRNA sequence
ttgaacttcacttcccatca

SEQ ID NO: 197305 - DNA, 20 bp, Artificial
  CRISPR gRNA sequence
aacttcacttcccatcacag

SEQ ID NO: 197306 - DNA, 20 bp, Artificial
  CRISPR gRNA sequence
cacttcccatcacagcaaat

SEQ ID NO: 197307 - DNA, 20 bp, Artificial
  CRISPR gRNA sequence
acttcccatcacagcaaatg

SEQ ID NO: 197308 - DNA, 20 bp, Artificial
  CRISPR gRNA sequence
cccatcacagcaaatgtgtg

SEQ ID NO: 197309 - DNA, 20 bp, Artificial
  CRISPR gRNA sequence
ccatcacagcaaatgtgtgg

SEQ ID NO: 197310 - DNA, 20 bp, Artificial
  CRISPR gRNA sequence
ccccacaggagtttactcac

SEQ ID NO: 197311 - DNA, 20 bp, Artificial
  CRISPR gRNA sequence
cccacaggagtttactcacc

SEQ ID NO: 197312 - DNA, 20 bp, Artificial
  CRISPR gRNA sequence
actcaccatggtattttaaa

SEQ ID NO: 197313 - DNA, 20 bp, Artificial
  CRISPR gRNA sequence
ctcaccatggtattttaaag

SEQ ID NO: 197314 - DNA, 20 bp, Artificial
  CRISPR gRNA sequence
accatggtattttaaaggtg

SEQ ID NO: 197315 - DNA, 20 bp, Artificial
  CRISPR gRNA sequence
taaaggtgaaacatttcaaa

SEQ ID NO: 197316 - DNA, 20 bp, Artificial
  CRISPR gRNA sequence
aaaggtgaaacatttcaaaa

SEQ ID NO: 197317 - DNA, 20 bp, Artificial
  CRISPR gRNA sequence
aaggtgaaacatttcaaaac

SEQ ID NO: 197318 - DNA, 20 bp, Artificial
  CRISPR gRNA sequence
caaaactgaaatttgaaaga

SEQ ID NO: 197319 - DNA, 20 bp, Artificial
  CRISPR gRNA sequence
aaaactgaaatttgaaagaa

SEQ ID NO: 197320 - DNA, 20 bp, Artificial
  CRISPR gRNA sequence
aaatttgaaagaatttagtt

SEQ ID NO: 197321 - DNA, 20 bp, Artificial
  CRISPR gRNA sequence
gaaagaatttagttttggat

SEQ ID NO: 197322 - DNA, 20 bp, Artificial
  CRISPR gRNA sequence
aaagaatttagttttggatt

SEQ ID NO: 197323 - DNA, 20 bp, Artificial
  CRISPR gRNA sequence
agttttggattcactcaatt

SEQ ID NO: 197324 - DNA, 20 bp, Artificial
  CRISPR gRNA sequence
gttttggattcactcaatta

SEQ ID NO: 197325 - DNA, 20 bp, Artificial
  CRISPR gRNA sequence
tggattcactcaattatcac

SEQ ID NO: 197326 - DNA, 20 bp, Artificial
  CRISPR gRNA sequence
ggattcactcaattatcact

SEQ ID NO: 197327 - DNA, 20 bp, Artificial
  CRISPR gRNA sequence
gattcactcaattatcacta

SEQ ID NO: 197328 - DNA, 20 bp, Artificial
  CRISPR gRNA sequence
actcaattatcactatcact

SEQ ID NO: 197329 - DNA, 20 bp, Artificial
  CRISPR gRNA sequence
aattatcactatcacttcgg

SEQ ID NO: 197330 - DNA, 20 bp, Artificial
  CRISPR gRNA sequence
tcactatcacttcgggtgtt

SEQ ID NO: 197331 - DNA, 20 bp, Artificial
  CRISPR gRNA sequence
tcacttcgggtgttattgca

SEQ ID NO: 197332 - DNA, 20 bp, Artificial
  CRISPR gRNA sequence
cgggtgttattgcacctttc

SEQ ID NO: 197333 - DNA, 20 bp, Artificial
  CRISPR gRNA sequence
gggtgttattgcacctttct

SEQ ID NO: 197334 - DNA, 20 bp, Artificial
  CRISPR gRNA sequence
ttgcacctttcttgtttgtg

SEQ ID NO: 197335 - DNA, 20 bp, Artificial
  CRISPR gRNA sequence
cacctttcttgtttgtgagt

SEQ ID NO: 197336 - DNA, 20 bp, Artificial
  CRISPR gRNA sequence
tcttgtttgtgagtttaaat

SEQ ID NO: 197337 - DNA, 20 bp, Artificial
  CRISPR gRNA sequence
cttgtttgtgagtttaaatg

SEQ ID NO: 197338 - DNA, 20 bp, Artificial
  CRISPR gRNA sequence
ttgtttgtgagtttaaatgc

SEQ ID NO: 197339 - DNA, 20 bp, Artificial
  CRISPR gRNA sequence
gtttgtgagtttaaatgcca

SEQ ID NO: 197340 - DNA, 20 bp, Artificial
  CRISPR gRNA sequence
tttgtgagtttaaatgccag

SEQ ID NO: 197341 - DNA, 20 bp, Artificial
  CRISPR gRNA sequence
gtgagtttaaatgccagact

SEQ ID NO: 197342 - DNA, 20 bp, Artificial
  CRISPR gRNA sequence
tgagtttaaatgccagactc

SEQ ID NO: 197343 - DNA, 20 bp, Artificial
  CRISPR gRNA sequence
aaatgccagactctcaggcc

SEQ ID NO: 197344 - DNA, 20 bp, Artificial
  CRISPR gRNA sequence
aatgccagactctcaggcca

SEQ ID NO: 197345 - DNA, 20 bp, Artificial
  CRISPR gRNA sequence
tcaggccactaactttcaat

SEQ ID NO: 197346 - DNA, 20 bp, Artificial
  CRISPR gRNA sequence
aggccactaactttcaatta

SEQ ID NO: 197347 - DNA, 20 bp, Artificial
  CRISPR gRNA sequence
actttcaattaaaagtgttt

SEQ ID NO: 197348 - DNA, 20 bp, Artificial
  CRISPR gRNA sequence
tcaattaaaagtgtttttct

SEQ ID NO: 197349 - DNA, 20 bp, Artificial
  CRISPR gRNA sequence
caattaaaagtgtttttctt

SEQ ID NO: 197350 - DNA, 20 bp, Artificial
  CRISPR gRNA sequence
aattaaaagtgtttttcttt

SEQ ID NO: 197351 - DNA, 20 bp, Artificial
  CRISPR gRNA sequence
aaagtgtttttctttaatcg

SEQ ID NO: 197352 - DNA, 20 bp, Artificial
  CRISPR gRNA sequence
ttctttaatcgctgaaccta

SEQ ID NO: 197353 - DNA, 20 bp, Artificial
  CRISPR gRNA sequence
tctttaatcgctgaacctaa

SEQ ID NO: 197354 - DNA, 20 bp, Artificial
  CRISPR gRNA sequence
ctttaatcgctgaacctaac

SEQ ID NO: 197355 - DNA, 20 bp, Artificial
  CRISPR gRNA sequence
tttaatcgctgaacctaaca

SEQ ID NO: 197356 - DNA, 20 bp, Artificial
  CRISPR gRNA sequence
taatcgctgaacctaacagc

SEQ ID NO: 197357 - DNA, 20 bp, Artificial
  CRISPR gRNA sequence
aatcgctgaacctaacagca

SEQ ID NO: 197358 - DNA, 20 bp, Artificial
  CRISPR gRNA sequence
atcgctgaacctaacagcag

SEQ ID NO: 197359 - DNA, 20 bp, Artificial
  CRISPR gRNA sequence
aacctaacagcagggaaaac

SEQ ID NO: 197360 - DNA, 20 bp, Artificial
  CRISPR gRNA sequence
acagcagggaaaacgaaatg

SEQ ID NO: 197361 - DNA, 20 bp, Artificial
  CRISPR gRNA sequence
attcagactttcagaacctt

SEQ ID NO: 197362 - DNA, 20 bp, Artificial
  CRISPR gRNA sequence
agactttcagaaccttcaat

SEQ ID NO: 197363 - DNA, 20 bp, Artificial
  CRISPR gRNA sequence
tcagaaccttcaatgagatt

SEQ ID NO: 197364 - DNA, 20 bp, Artificial
  CRISPR gRNA sequence
cagaaccttcaatgagatta

SEQ ID NO: 197365 - DNA, 20 bp, Artificial
  CRISPR gRNA sequence
agaaccttcaatgagattag

SEQ ID NO: 197366 - DNA, 20 bp, Artificial
  CRISPR gRNA sequence
caatgagattaggcagctga

SEQ ID NO: 197367 - DNA, 20 bp, Artificial
  CRISPR gRNA sequence
aatgagattaggcagctgaa

SEQ ID NO: 197368 - DNA, 20 bp, Artificial
  CRISPR gRNA sequence
ggcagctgaaagatcaaagt

SEQ ID NO: 197369 - DNA, 20 bp, Artificial
  CRISPR gRNA sequence
aaagatcaaagtgttgcata

SEQ ID NO: 197370 - DNA, 20 bp, Artificial
  CRISPR gRNA sequence
catagttgtcccgataaagc

SEQ ID NO: 197371 - DNA, 20 bp, Artificial
  CRISPR gRNA sequence
tcccgataaagctatttgga

SEQ ID NO: 197372 - DNA, 20 bp, Artificial
  CRISPR gRNA sequence
tttggatcatatggaccaaa

SEQ ID NO: 197373 - DNA, 20 bp, Artificial
  CRISPR gRNA sequence
ggatcatatggaccaaatcg

SEQ ID NO: 197374 - DNA, 20 bp, Artificial
  CRISPR gRNA sequence
gatcatatggaccaaatcga

SEQ ID NO: 197375 - DNA, 20 bp, Artificial
  CRISPR gRNA sequence
ctgtcattccccaccaaccc

SEQ ID NO: 197376 - DNA, 20 bp, Artificial
  CRISPR gRNA sequence
tcattccccaccaaccccat

SEQ ID NO: 197377 - DNA, 20 bp, Artificial
  CRISPR gRNA sequence
cccaccaaccccatctctcc

SEQ ID NO: 197378 - DNA, 20 bp, Artificial
  CRISPR gRNA sequence
tccccaaaattcccagccct

SEQ ID NO: 197379 - DNA, 20 bp, Artificial
  CRISPR gRNA sequence
cccaaaattcccagccctgt

SEQ ID NO: 197380 - DNA, 20 bp, Artificial
  CRISPR gRNA sequence
ccagccctgtttaagtgttc

SEQ ID NO: 197381 - DNA, 20 bp, Artificial
  CRISPR gRNA sequence
tttaagtgttctctgtagca

SEQ ID NO: 197382 - DNA, 20 bp, Artificial
  CRISPR gRNA sequence
aagtgttctctgtagcattt

SEQ ID NO: 197383 - DNA, 20 bp, Artificial
  CRISPR gRNA sequence
agtgttctctgtagcattta

SEQ ID NO: 197384 - DNA, 20 bp, Artificial
  CRISPR gRNA sequence
tctgtagcatttatctctat

SEQ ID NO: 197385 - DNA, 20 bp, Artificial
  CRISPR gRNA sequence
tgtagcatttatctctatct

SEQ ID NO: 197386 - DNA, 20 bp, Artificial
  CRISPR gRNA sequence
tagcatttatctctatctag

SEQ ID NO: 197387 - DNA, 20 bp, Artificial
  CRISPR gRNA sequence
atctctatctagtatattgt

SEQ ID NO: 197388 - DNA, 20 bp, Artificial
  CRISPR gRNA sequence
tctctatctagtatattgtg

SEQ ID NO: 197389 - DNA, 20 bp, Artificial
  CRISPR gRNA sequence
tatctagtatattgtgtagc

SEQ ID NO: 197390 - DNA, 20 bp, Artificial
  CRISPR gRNA sequence
tctagtatattgtgtagcat

SEQ ID NO: 197391 - DNA, 20 bp, Artificial
  CRISPR gRNA sequence
gtatattgtgtagcatatca

SEQ ID NO: 197392 - DNA, 20 bp, Artificial
  CRISPR gRNA sequence
tgtagcatatcatatcatac

SEQ ID NO: 197393 - DNA, 20 bp, Artificial
  CRISPR gRNA sequence
ttctgttttgtttattgtct

SEQ ID NO: 197394 - DNA, 20 bp, Artificial
  CRISPR gRNA sequence
tctgttttgtttattgtctc

SEQ ID NO: 197395 - DNA, 20 bp, Artificial
  CRISPR gRNA sequence
ctgttttgtttattgtctct

SEQ ID NO: 197396 - DNA, 20 bp, Artificial
  CRISPR gRNA sequence
tgttttgtttattgtctctc

SEQ ID NO: 197397 - DNA, 20 bp, Artificial
  CRISPR gRNA sequence
ttttgtttattgtctctctc

SEQ ID NO: 197398 - DNA, 20 bp, Artificial
  CRISPR gRNA sequence
tgtttattgtctctctcctc

SEQ ID NO: 197399 - DNA, 20 bp, Artificial
  CRISPR gRNA sequence
gtttattgtctctctcctcc

SEQ ID NO: 197400 - DNA, 20 bp, Artificial
  CRISPR gRNA sequence
tttattgtctctctcctcct

SEQ ID NO: 197401 - DNA, 20 bp, Artificial
  CRISPR gRNA sequence
attgtctctctcctcctaga

SEQ ID NO: 197402 - DNA, 20 bp, Artificial
  CRISPR gRNA sequence
ttgtctctctcctcctagaa

SEQ ID NO: 197403 - DNA, 20 bp, Artificial
  CRISPR gRNA sequence
tctctctcctcctagaatat

SEQ ID NO: 197404 - DNA, 20 bp, Artificial
  CRISPR gRNA sequence
tctcctcctagaatataaac

SEQ ID NO: 197405 - DNA, 20 bp, Artificial
  CRISPR gRNA sequence
tcctcctagaatataaactc

SEQ ID NO: 197406 - DNA, 20 bp, Artificial
  CRISPR gRNA sequence
ctcctagaatataaactcca

SEQ ID NO: 197407 - DNA, 20 bp, Artificial
  CRISPR gRNA sequence
ctagaatataaactccacaa

SEQ ID NO: 197408 - DNA, 20 bp, Artificial
  CRISPR gRNA sequence
gaatataaactccacaagca

SEQ ID NO: 197409 - DNA, 20 bp, Artificial
  CRISPR gRNA sequence
cacaagcacaaagatttggg

SEQ ID NO: 197410 - DNA, 20 bp, Artificial
  CRISPR gRNA sequence
gggcctgttttataatattg

SEQ ID NO: 197411 - DNA, 20 bp, Artificial
  CRISPR gRNA sequence
ggcctgttttataatattgt

SEQ ID NO: 197412 - DNA, 20 bp, Artificial
  CRISPR gRNA sequence
ttttataatattgttgcatc

SEQ ID NO: 197413 - DNA, 20 bp, Artificial
  CRISPR gRNA sequence
tataatattgttgcatcccc

SEQ ID NO: 197414 - DNA, 20 bp, Artificial
  CRISPR gRNA sequence
ataatattgttgcatcccca

SEQ ID NO: 197415 - DNA, 20 bp, Artificial
  CRISPR gRNA sequence
taatattgttgcatccccag

SEQ ID NO: 197416 - DNA, 20 bp, Artificial
  CRISPR gRNA sequence
ttgcatccccagggcctgat

SEQ ID NO: 197417 - DNA, 20 bp, Artificial
  CRISPR gRNA sequence
catccccagggcctgatata

SEQ ID NO: 197418 - DNA, 20 bp, Artificial
  CRISPR gRNA sequence
atatacagcagagtggtggt

SEQ ID NO: 197419 - DNA, 20 bp, Artificial
  CRISPR gRNA sequence
gttgagtcaatgaatgaatg

SEQ ID NO: 197420 - DNA, 20 bp, Artificial
  CRISPR gRNA sequence
ttgagtcaatgaatgaatga

SEQ ID NO: 197421 - DNA, 20 bp, Artificial
  CRISPR gRNA sequence
agtcaatgaatgaatgattt

SEQ ID NO: 197422 - DNA, 20 bp, Artificial
  CRISPR gRNA sequence
cctcaaataggattagccta

SEQ ID NO: 197423 - DNA, 20 bp, Artificial
  CRISPR gRNA sequence
ctcaaataggattagcctaa

SEQ ID NO: 197424 - DNA, 20 bp, Artificial
  CRISPR gRNA sequence
aaataggattagcctaaaat

SEQ ID NO: 197425 - DNA, 20 bp, Artificial
  CRISPR gRNA sequence
gcctaaaattttggaaacat

SEQ ID NO: 197426 - DNA, 20 bp, Artificial
  CRISPR gRNA sequence
aaattttggaaacatgaaca

SEQ ID NO: 197427 - DNA, 20 bp, Artificial
  CRISPR gRNA sequence
tggaaacatgaacagatttg

SEQ ID NO: 197428 - DNA, 20 bp, Artificial
  CRISPR gRNA sequence
ggaaacatgaacagatttgg

SEQ ID NO: 197429 - DNA, 20 bp, Artificial
  CRISPR gRNA sequence
gaaacatgaacagatttgga

SEQ ID NO: 197430 - DNA, 20 bp, Artificial
  CRISPR gRNA sequence
ggatatgtgaaaatttattt

SEQ ID NO: 197431 - DNA, 20 bp, Artificial
  CRISPR gRNA sequence
gatatgtgaaaatttatttc

SEQ ID NO: 197432 - DNA, 20 bp, Artificial
  CRISPR gRNA sequence
atttccagactgttcatcag

SEQ ID NO: 197433 - DNA, 20 bp, Artificial
  CRISPR gRNA sequence
tttccagactgttcatcagg

SEQ ID NO: 197434 - DNA, 20 bp, Artificial
  CRISPR gRNA sequence
ccagactgttcatcaggaac

SEQ ID NO: 197435 - DNA, 20 bp, Artificial
  CRISPR gRNA sequence
cagactgttcatcaggaact

SEQ ID NO: 197436 - DNA, 20 bp, Artificial
  CRISPR gRNA sequence
ttcatcaggaactgttagca

SEQ ID NO: 197437 - DNA, 20 bp, Artificial
  CRISPR gRNA sequence
atcaggaactgttagcagct

SEQ ID NO: 197438 - DNA, 20 bp, Artificial
  CRISPR gRNA sequence
ttagcagcttctaaagggta

SEQ ID NO: 197439 - DNA, 20 bp, Artificial
  CRISPR gRNA sequence
gcagcttctaaagggtacac

SEQ ID NO: 197440 - DNA, 20 bp, Artificial
  CRISPR gRNA sequence
ctaaagggtacactggagca

SEQ ID NO: 197441 - DNA, 20 bp, Artificial
  CRISPR gRNA sequence
taaagggtacactggagcag

SEQ ID NO: 197442 - DNA, 20 bp, Artificial
  CRISPR gRNA sequence
aagggtacactggagcagca

SEQ ID NO: 197443 - DNA, 20 bp, Artificial
  CRISPR gRNA sequence
gagcagcagtagtaaaagga

SEQ ID NO: 197444 - DNA, 20 bp, Artificial
  CRISPR gRNA sequence
tgctactgctactatcgagt

SEQ ID NO: 197445 - DNA, 20 bp, Artificial
  CRISPR gRNA sequence
ctactgctactatcgagtac

SEQ ID NO: 197446 - DNA, 20 bp, Artificial
  CRISPR gRNA sequence
ctgctactatcgagtactac

SEQ ID NO: 197447 - DNA, 20 bp, Artificial
  CRISPR gRNA sequence
ctactatcgagtactactac

SEQ ID NO: 197448 - DNA, 20 bp, Artificial
  CRISPR gRNA sequence
ctatcgagtactactacaat

SEQ ID NO: 197449 - DNA, 20 bp, Artificial
  CRISPR gRNA sequence
tcgagtactactacaattag

SEQ ID NO: 197450 - DNA, 20 bp, Artificial
  CRISPR gRNA sequence
ctacaattagcacttgctta

SEQ ID NO: 197451 - DNA, 20 bp, Artificial
  CRISPR gRNA sequence
caattagcacttgcttattc

SEQ ID NO: 197452 - DNA, 20 bp, Artificial
  CRISPR gRNA sequence
gcacttgcttattctgtgtg

SEQ ID NO: 197453 - DNA, 20 bp, Artificial
  CRISPR gRNA sequence
gcttattctgtgtgttaggc

SEQ ID NO: 197454 - DNA, 20 bp, Artificial
  CRISPR gRNA sequence
cttattctgtgtgttaggcc

SEQ ID NO: 197455 - DNA, 20 bp, Artificial
  CRISPR gRNA sequence
attctgtgtgttaggccctg

SEQ ID NO: 197456 - DNA, 20 bp, Artificial
  CRISPR gRNA sequence
ttctgtgtgttaggccctgt

SEQ ID NO: 197457 - DNA, 20 bp, Artificial
  CRISPR gRNA sequence
tgtgtgttaggccctgtact

SEQ ID NO: 197458 - DNA, 20 bp, Artificial
  CRISPR gRNA sequence
tgtgttaggccctgtactga

SEQ ID NO: 197459 - DNA, 20 bp, Artificial
  CRISPR gRNA sequence
ggccctgtactgaacactct

SEQ ID NO: 197460 - DNA, 20 bp, Artificial
  CRISPR gRNA sequence
tactgaacactctgtctaaa

SEQ ID NO: 197461 - DNA, 20 bp, Artificial
  CRISPR gRNA sequence
aacactctgtctaaattagt

SEQ ID NO: 197462 - DNA, 20 bp, Artificial
  CRISPR gRNA sequence
tgtctaaattagttcatttc

SEQ ID NO: 197463 - DNA, 20 bp, Artificial
  CRISPR gRNA sequence
tctaaattagttcatttcct

SEQ ID NO: 197464 - DNA, 20 bp, Artificial
  CRISPR gRNA sequence
aattagttcatttcctcctg

SEQ ID NO: 197465 - DNA, 20 bp, Artificial
  CRISPR gRNA sequence
gttcatttcctcctggaaat

SEQ ID NO: 197466 - DNA, 20 bp, Artificial
  CRISPR gRNA sequence
atttcctcctggaaatgact

SEQ ID NO: 197467 - DNA, 20 bp, Artificial
  CRISPR gRNA sequence
cctcctggaaatgactctag

SEQ ID NO: 197468 - DNA, 20 bp, Artificial
  CRISPR gRNA sequence
ctcctggaaatgactctagg

SEQ ID NO: 197469 - DNA, 20 bp, Artificial
  CRISPR gRNA sequence
ctggaaatgactctaggggg

SEQ ID NO: 197470 - DNA, 20 bp, Artificial
  CRISPR gRNA sequence
gaaatgactctagggggtaa

SEQ ID NO: 197471 - DNA, 20 bp, Artificial
  CRISPR gRNA sequence
tagggggtaagtgcttcatc

SEQ ID NO: 197472 - DNA, 20 bp, Artificial
  CRISPR gRNA sequence
gggggtaagtgcttcatcat

SEQ ID NO: 197473 - DNA, 20 bp, Artificial
  CRISPR gRNA sequence
catcatgtaagatgagtatt

SEQ ID NO: 197474 - DNA, 20 bp, Artificial
  CRISPR gRNA sequence
atcatgtaagatgagtattt

SEQ ID NO: 197475 - DNA, 20 bp, Artificial
  CRISPR gRNA sequence
ttcacattttgttgtgtctg

SEQ ID NO: 197476 - DNA, 20 bp, Artificial
  CRISPR gRNA sequence
tcacattttgttgtgtctga

SEQ ID NO: 197477 - DNA, 20 bp, Artificial
  CRISPR gRNA sequence
cacattttgttgtgtctgaa

SEQ ID NO: 197478 - DNA, 20 bp, Artificial
  CRISPR gRNA sequence
acattttgttgtgtctgaaa

SEQ ID NO: 197479 - DNA, 20 bp, Artificial
  CRISPR gRNA sequence
tgttgtgtctgaaatctgag

SEQ ID NO: 197480 - DNA, 20 bp, Artificial
  CRISPR gRNA sequence
gttgtgtctgaaatctgagt

SEQ ID NO: 197481 - DNA, 20 bp, Artificial
  CRISPR gRNA sequence
ttgtgtctgaaatctgagtg

SEQ ID NO: 197482 - DNA, 20 bp, Artificial
  CRISPR gRNA sequence
tgtctgaaatctgagtgtgt

SEQ ID NO: 197483 - DNA, 20 bp, Artificial
  CRISPR gRNA sequence
aaatctgagtgtgtctttca

SEQ ID NO: 197484 - DNA, 20 bp, Artificial
  CRISPR gRNA sequence
agtgtgtctttcaatgatgg

SEQ ID NO: 197485 - DNA, 20 bp, Artificial
  CRISPR gRNA sequence
tcaatgatggaatctttgat

SEQ ID NO: 197486 - DNA, 20 bp, Artificial
  CRISPR gRNA sequence
caatgatggaatctttgatt

SEQ ID NO: 197487 - DNA, 20 bp, Artificial
  CRISPR gRNA sequence
aatgatggaatctttgattc

SEQ ID NO: 197488 - DNA, 20 bp, Artificial
  CRISPR gRNA sequence
tgattccatgataagtggta

SEQ ID NO: 197489 - DNA, 20 bp, Artificial
  CRISPR gRNA sequence
gattccatgataagtggtat

SEQ ID NO: 197490 - DNA, 20 bp, Artificial
  CRISPR gRNA sequence
attccatgataagtggtatt

SEQ ID NO: 197491 - DNA, 20 bp, Artificial
  CRISPR gRNA sequence
catgataagtggtattattc

SEQ ID NO: 197492 - DNA, 20 bp, Artificial
  CRISPR gRNA sequence
ttcccattttaaggatgagg

SEQ ID NO: 197493 - DNA, 20 bp, Artificial
  CRISPR gRNA sequence
ccattttaaggatgaggaaa

SEQ ID NO: 197494 - DNA, 20 bp, Artificial
  CRISPR gRNA sequence
taaggatgaggaaactgagg

SEQ ID NO: 197495 - DNA, 20 bp, Artificial
  CRISPR gRNA sequence
aaggatgaggaaactgaggt

SEQ ID NO: 197496 - DNA, 20 bp, Artificial
  CRISPR gRNA sequence
aggatgaggaaactgaggtc

SEQ ID NO: 197497 - DNA, 20 bp, Artificial
  CRISPR gRNA sequence
aggtccaaagaaattaagta

SEQ ID NO: 197498 - DNA, 20 bp, Artificial
  CRISPR gRNA sequence
agtaatttgcccaaattcac

SEQ ID NO: 197499 - DNA, 20 bp, Artificial
  CRISPR gRNA sequence
gcccaaattcacccagccta

SEQ ID NO: 197500 - DNA, 20 bp, Artificial
  CRISPR gRNA sequence
cccaaattcacccagcctag

SEQ ID NO: 197501 - DNA, 20 bp, Artificial
  CRISPR gRNA sequence
acccagcctagaaaatgata

SEQ ID NO: 197502 - DNA, 20 bp, Artificial
  CRISPR gRNA sequence
gaaaatgataaagctagttc

SEQ ID NO: 197503 - DNA, 20 bp, Artificial
  CRISPR gRNA sequence
gttctaaacccaagcagatt

SEQ ID NO: 197504 - DNA, 20 bp, Artificial
  CRISPR gRNA sequence
taaacccaagcagattagct

SEQ ID NO: 197505 - DNA, 20 bp, Artificial
  CRISPR gRNA sequence
aacccaagcagattagctct

SEQ ID NO: 197506 - DNA, 20 bp, Artificial
  CRISPR gRNA sequence
gctctgaagtctgggccctt

SEQ ID NO: 197507 - DNA, 20 bp, Artificial
  CRISPR gRNA sequence
tgaagtctgggcccttaata

SEQ ID NO: 197508 - DNA, 20 bp, Artificial
  CRISPR gRNA sequence
aagtctgggcccttaataac

SEQ ID NO: 197509 - DNA, 20 bp, Artificial
  CRISPR gRNA sequence
ggcccttaataaccactttt

SEQ ID NO: 197510 - DNA, 20 bp, Artificial
  CRISPR gRNA sequence
aataaccactttttattgcc

SEQ ID NO: 197511 - DNA, 20 bp, Artificial
  CRISPR gRNA sequence
ataaccactttttattgcct

SEQ ID NO: 197512 - DNA, 20 bp, Artificial
  CRISPR gRNA sequence
tttattgcctatatttgtac

SEQ ID NO: 197513 - DNA, 20 bp, Artificial
  CRISPR gRNA sequence
ttattgcctatatttgtacc

SEQ ID NO: 197514 - DNA, 20 bp, Artificial
  CRISPR gRNA sequence
tattgcctatatttgtacct

SEQ ID NO: 197515 - DNA, 20 bp, Artificial
  CRISPR gRNA sequence
attgcctatatttgtacctc

SEQ ID NO: 197516 - DNA, 20 bp, Artificial
  CRISPR gRNA sequence
ttgcctatatttgtacctct

SEQ ID NO: 197517 - DNA, 20 bp, Artificial
  CRISPR gRNA sequence
cctatatttgtacctctggt

SEQ ID NO: 197518 - DNA, 20 bp, Artificial
  CRISPR gRNA sequence
tatttgtacctctggtgtac

SEQ ID NO: 197519 - DNA, 20 bp, Artificial
  CRISPR gRNA sequence
gtacctctggtgtacgtatc

SEQ ID NO: 197520 - DNA, 20 bp, Artificial
  CRISPR gRNA sequence
tacctctggtgtacgtatca

SEQ ID NO: 197521 - DNA, 20 bp, Artificial
  CRISPR gRNA sequence
tggtgtacgtatcaagttat

SEQ ID NO: 197522 - DNA, 20 bp, Artificial
  CRISPR gRNA sequence
gtgtacgtatcaagttatat

SEQ ID NO: 197523 - DNA, 20 bp, Artificial
  CRISPR gRNA sequence
tatgttgacttcaaaactat

SEQ ID NO: 197524 - DNA, 20 bp, Artificial
  CRISPR gRNA sequence
acttcaaaactatcatgacc

SEQ ID NO: 197525 - DNA, 20 bp, Artificial
  CRISPR gRNA sequence
caaaactatcatgacctttt

SEQ ID NO: 197526 - DNA, 20 bp, Artificial
  CRISPR gRNA sequence
aaaactatcatgaccttttc

SEQ ID NO: 197527 - DNA, 20 bp, Artificial
  CRISPR gRNA sequence
tcatgaccttttcttggttt

SEQ ID NO: 197528 - DNA, 20 bp, Artificial
  CRISPR gRNA sequence
ttcttggttttgattgtcca

SEQ ID NO: 197529 - DNA, 20 bp, Artificial
  CRISPR gRNA sequence
tcttggttttgattgtccaa

SEQ ID NO: 197530 - DNA, 20 bp, Artificial
  CRISPR gRNA sequence
cttggttttgattgtccaac

SEQ ID NO: 197531 - DNA, 20 bp, Artificial
  CRISPR gRNA sequence
ttggttttgattgtccaaca

SEQ ID NO: 197532 - DNA, 20 bp, Artificial
  CRISPR gRNA sequence
ggttttgattgtccaacatt

SEQ ID NO: 197533 - DNA, 20 bp, Artificial
  CRISPR gRNA sequence
gttttgattgtccaacatta

SEQ ID NO: 197534 - DNA, 20 bp, Artificial
  CRISPR gRNA sequence
tgattgtccaacattagtat

SEQ ID NO: 197535 - DNA, 20 bp, Artificial
  CRISPR gRNA sequence
gattgtccaacattagtata

SEQ ID NO: 197536 - DNA, 20 bp, Artificial
  CRISPR gRNA sequence
attgtccaacattagtatag

SEQ ID NO: 197537 - DNA, 20 bp, Artificial
  CRISPR gRNA sequence
tccaacattagtatagtgtt

SEQ ID NO: 197538 - DNA, 20 bp, Artificial
  CRISPR gRNA sequence
gtatagtgttctgggtctgc

SEQ ID NO: 197539 - DNA, 20 bp, Artificial
  CRISPR gRNA sequence
tgggtctgcaaaaattttga

SEQ ID NO: 197540 - DNA, 20 bp, Artificial
  CRISPR gRNA sequence
ggtctgcaaaaattttgatt

SEQ ID NO: 197541 - DNA, 20 bp, Artificial
  CRISPR gRNA sequence
caaaaattttgattactcat

SEQ ID NO: 197542 - DNA, 20 bp, Artificial
  CRISPR gRNA sequence
tgattactcatctcatctgt

SEQ ID NO: 197543 - DNA, 20 bp, Artificial
  CRISPR gRNA sequence
gattactcatctcatctgta

SEQ ID NO: 197544 - DNA, 20 bp, Artificial
  CRISPR gRNA sequence
attactcatctcatctgtaa

SEQ ID NO: 197545 - DNA, 20 bp, Artificial
  CRISPR gRNA sequence
ctcatctcatctgtaaaaca

SEQ ID NO: 197546 - DNA, 20 bp, Artificial
  CRISPR gRNA sequence
atctcatctgtaaaacattt

SEQ ID NO: 197547 - DNA, 20 bp, Artificial
  CRISPR gRNA sequence
atctgtaaaacattttgaac

SEQ ID NO: 197548 - DNA, 20 bp, Artificial
  CRISPR gRNA sequence
taaaacattttgaactcgtg

SEQ ID NO: 197549 - DNA, 20 bp, Artificial
  CRISPR gRNA sequence
tgaactcgtgtgtttgtgca

SEQ ID NO: 197550 - DNA, 20 bp, Artificial
  CRISPR gRNA sequence
gaactcgtgtgtttgtgcat

SEQ ID NO: 197551 - DNA, 20 bp, Artificial
  CRISPR gRNA sequence
aactcgtgtgtttgtgcatg

SEQ ID NO: 197552 - DNA, 20 bp, Artificial
  CRISPR gRNA sequence
gtgtgtttgtgcatgcacat

SEQ ID NO: 197553 - DNA, 20 bp, Artificial
  CRISPR gRNA sequence
gtgcatgcacatttgtgtgt

SEQ ID NO: 197554 - DNA, 20 bp, Artificial
  CRISPR gRNA sequence
tgcatgcacatttgtgtgta

SEQ ID NO: 197555 - DNA, 20 bp, Artificial
  CRISPR gRNA sequence
gtgtgtaattataaaaattt

SEQ ID NO: 197556 - DNA, 20 bp, Artificial
  CRISPR gRNA sequence
tgtgtaattataaaaatttt

SEQ ID NO: 197557 - DNA, 20 bp, Artificial
  CRISPR gRNA sequence
taaaaattttactttctgtt

SEQ ID NO: 197558 - DNA, 20 bp, Artificial
  CRISPR gRNA sequence
tactttctgttaatatataa

SEQ ID NO: 197559 - DNA, 20 bp, Artificial
  CRISPR gRNA sequence
actttctgttaatatataag

SEQ ID NO: 197560 - DNA, 20 bp, Artificial
  CRISPR gRNA sequence
ctttctgttaatatataagt

SEQ ID NO: 197561 - DNA, 20 bp, Artificial
  CRISPR gRNA sequence
tctgttaatatataagttgt

SEQ ID NO: 197562 - DNA, 20 bp, Artificial
  CRISPR gRNA sequence
ctgttaatatataagttgta

SEQ ID NO: 197563 - DNA, 20 bp, Artificial
  CRISPR gRNA sequence
tgttaatatataagttgtat

SEQ ID NO: 197564 - DNA, 20 bp, Artificial
  CRISPR gRNA sequence
ttaatatataagttgtatca

SEQ ID NO: 197565 - DNA, 20 bp, Artificial
  CRISPR gRNA sequence
atatataagttgtatcataa

SEQ ID NO: 197566 - DNA, 20 bp, Artificial
  CRISPR gRNA sequence
tatcataagaaactgccgtt

SEQ ID NO: 197567 - DNA, 20 bp, Artificial
  CRISPR gRNA sequence
ccgtttttgaagagcaaaaa

SEQ ID NO: 197568 - DNA, 20 bp, Artificial
  CRISPR gRNA sequence
ttgaagagcaaaaaaaggtt

SEQ ID NO: 197569 - DNA, 20 bp, Artificial
  CRISPR gRNA sequence
tgaagagcaaaaaaaggttg

SEQ ID NO: 197570 - DNA, 20 bp, Artificial
  CRISPR gRNA sequence
gaagagcaaaaaaaggttga

SEQ ID NO: 197571 - DNA, 20 bp, Artificial
  CRISPR gRNA sequence
aagagcaaaaaaaggttgaa

SEQ ID NO: 197572 - DNA, 20 bp, Artificial
  CRISPR gRNA sequence
aatgttaccagttacatctg

SEQ ID NO: 197573 - DNA, 20 bp, Artificial
  CRISPR gRNA sequence
ccagttacatctggttcaac

SEQ ID NO: 197574 - DNA, 20 bp, Artificial
  CRISPR gRNA sequence
catctggttcaacctaatag

SEQ ID NO: 197575 - DNA, 20 bp, Artificial
  CRISPR gRNA sequence
gttcaacctaatagacattt

SEQ ID NO: 197576 - DNA, 20 bp, Artificial
  CRISPR gRNA sequence
aacctaatagacatttgtac

SEQ ID NO: 197577 - DNA, 20 bp, Artificial
  CRISPR gRNA sequence
atagacatttgtacaaaaac

SEQ ID NO: 197578 - DNA, 20 bp, Artificial
  CRISPR gRNA sequence
gtacaaaaacagacatttta

SEQ ID NO: 197579 - DNA, 20 bp, Artificial
  CRISPR gRNA sequence
tacaaaaacagacattttaa

SEQ ID NO: 197580 - DNA, 20 bp, Artificial
  CRISPR gRNA sequence
taagaggttgaaataaaaat

SEQ ID NO: 197581 - DNA, 20 bp, Artificial
  CRISPR gRNA sequence
aagaggttgaaataaaaatt

SEQ ID NO: 197582 - DNA, 20 bp, Artificial
  CRISPR gRNA sequence
agaggttgaaataaaaattt

SEQ ID NO: 197583 - DNA, 20 bp, Artificial
  CRISPR gRNA sequence
aaataaaaatttaataaaca

SEQ ID NO: 197584 - DNA, 20 bp, Artificial
  CRISPR gRNA sequence
aataaacaatattttcagtt

SEQ ID NO: 197585 - DNA, 20 bp, Artificial
  CRISPR gRNA sequence
ataaacaatattttcagttt

SEQ ID NO: 197586 - DNA, 20 bp, Artificial
  CRISPR gRNA sequence
tcagtttttactaattgtga

SEQ ID NO: 197587 - DNA, 20 bp, Artificial
  CRISPR gRNA sequence
cagtttttactaattgtgat

SEQ ID NO: 197588 - DNA, 20 bp, Artificial
  CRISPR gRNA sequence
agtttttactaattgtgatg

SEQ ID NO: 197589 - DNA, 20 bp, Artificial
  CRISPR gRNA sequence
ttactaattgtgatgcttca

SEQ ID NO: 197590 - DNA, 20 bp, Artificial
  CRISPR gRNA sequence
tactaattgtgatgcttcac

SEQ ID NO: 197591 - DNA, 20 bp, Artificial
  CRISPR gRNA sequence
actaattgtgatgcttcact

SEQ ID NO: 197592 - DNA, 20 bp, Artificial
  CRISPR gRNA sequence
ctaattgtgatgcttcacta

SEQ ID NO: 197593 - DNA, 20 bp, Artificial
  CRISPR gRNA sequence
attgtgatgcttcactatca

SEQ ID NO: 197594 - DNA, 20 bp, Artificial
  CRISPR gRNA sequence
tgatgcttcactatcattag

SEQ ID NO: 197595 - DNA, 20 bp, Artificial
  CRISPR gRNA sequence
cactatcattagctaatatg

SEQ ID NO: 197596 - DNA, 20 bp, Artificial
  CRISPR gRNA sequence
actatcattagctaatatgt

SEQ ID NO: 197597 - DNA, 20 bp, Artificial
  CRISPR gRNA sequence
tcattagctaatatgtcaag

SEQ ID NO: 197598 - DNA, 20 bp, Artificial
  CRISPR gRNA sequence
gctaatatgtcaaggcataa

SEQ ID NO: 197599 - DNA, 20 bp, Artificial
  CRISPR gRNA sequence
atatgtcaaggcataatata

SEQ ID NO: 197600 - DNA, 20 bp, Artificial
  CRISPR gRNA sequence
agggtgaactttatcattaa

SEQ ID NO: 197601 - DNA, 20 bp, Artificial
  CRISPR gRNA sequence
gggtgaactttatcattaac

SEQ ID NO: 197602 - DNA, 20 bp, Artificial
  CRISPR gRNA sequence
tatcattaacaaaggtggat

SEQ ID NO: 197603 - DNA, 20 bp, Artificial
  CRISPR gRNA sequence
atcattaacaaaggtggatg

SEQ ID NO: 197604 - DNA, 20 bp, Artificial
  CRISPR gRNA sequence
tcattaacaaaggtggatgg

SEQ ID NO: 197605 - DNA, 20 bp, Artificial
  CRISPR gRNA sequence
acaaaggtggatggtgtcaa

SEQ ID NO: 197606 - DNA, 20 bp, Artificial
  CRISPR gRNA sequence
gaggtttgtgtttttttata

SEQ ID NO: 197607 - DNA, 20 bp, Artificial
  CRISPR gRNA sequence
aggtttgtgtttttttatat

SEQ ID NO: 197608 - DNA, 20 bp, Artificial
  CRISPR gRNA sequence
gtgtttttttatataacact

SEQ ID NO: 197609 - DNA, 20 bp, Artificial
  CRISPR gRNA sequence
tgtttttttatataacactg

SEQ ID NO: 197610 - DNA, 20 bp, Artificial
  CRISPR gRNA sequence
ttttatataacactgcgagg

SEQ ID NO: 197611 - DNA, 20 bp, Artificial
  CRISPR gRNA sequence
tttatataacactgcgaggt

SEQ ID NO: 197612 - DNA, 20 bp, Artificial
  CRISPR gRNA sequence
ttatataacactgcgaggtc

SEQ ID NO: 197613 - DNA, 20 bp, Artificial
  CRISPR gRNA sequence
tatataacactgcgaggtct

SEQ ID NO: 197614 - DNA, 20 bp, Artificial
  CRISPR gRNA sequence
atataacactgcgaggtcta

SEQ ID NO: 197615 - DNA, 20 bp, Artificial
  CRISPR gRNA sequence
tataacactgcgaggtctaa

SEQ ID NO: 197616 - DNA, 20 bp, Artificial
  CRISPR gRNA sequence
cgaggtctaattaagtactt

SEQ ID NO: 197617 - DNA, 20 bp, Artificial
  CRISPR gRNA sequence
attaagtacttactgtttac

SEQ ID NO: 197618 - DNA, 20 bp, Artificial
  CRISPR gRNA sequence
agtacttactgtttaccacc

SEQ ID NO: 197619 - DNA, 20 bp, Artificial
  CRISPR gRNA sequence
actgtttaccacctcataca

SEQ ID NO: 197620 - DNA, 20 bp, Artificial
  CRISPR gRNA sequence
ctgtttaccacctcatacag

SEQ ID NO: 197621 - DNA, 20 bp, Artificial
  CRISPR gRNA sequence
tttaccacctcatacagtgg

SEQ ID NO: 197622 - DNA, 20 bp, Artificial
  CRISPR gRNA sequence
accacctcatacagtggccg

SEQ ID NO: 197623 - DNA, 20 bp, Artificial
  CRISPR gRNA sequence
ccacctcatacagtggccga

SEQ ID NO: 197624 - DNA, 20 bp, Artificial
  CRISPR gRNA sequence
atacagtggccgataaaaag

SEQ ID NO: 197625 - DNA, 20 bp, Artificial
  CRISPR gRNA sequence
ctgctgtttcctctgggttg

SEQ ID NO: 197626 - DNA, 20 bp, Artificial
  CRISPR gRNA sequence
tgctgtttcctctgggttgt

SEQ ID NO: 197627 - DNA, 20 bp, Artificial
  CRISPR gRNA sequence
ctgtttcctctgggttgtgc

SEQ ID NO: 197628 - DNA, 20 bp, Artificial
  CRISPR gRNA sequence
tttcctctgggttgtgcttg

SEQ ID NO: 197629 - DNA, 20 bp, Artificial
  CRISPR gRNA sequence
cctctgggttgtgcttgaat

SEQ ID NO: 197630 - DNA, 20 bp, Artificial
  CRISPR gRNA sequence
ctctgggttgtgcttgaatt

SEQ ID NO: 197631 - DNA, 20 bp, Artificial
  CRISPR gRNA sequence
tgggttgtgcttgaattatt

SEQ ID NO: 197632 - DNA, 20 bp, Artificial
  CRISPR gRNA sequence
ggttgtgcttgaattattag

SEQ ID NO: 197633 - DNA, 20 bp, Artificial
  CRISPR gRNA sequence
tgcttgaattattagtatta

SEQ ID NO: 197634 - DNA, 20 bp, Artificial
  CRISPR gRNA sequence
gaattattagtattatcttc

SEQ ID NO: 197635 - DNA, 20 bp, Artificial
  CRISPR gRNA sequence
aattattagtattatcttca

SEQ ID NO: 197636 - DNA, 20 bp, Artificial
  CRISPR gRNA sequence
ttagtattatcttcagtcct

SEQ ID NO: 197637 - DNA, 20 bp, Artificial
  CRISPR gRNA sequence
gtattatcttcagtcctcag

SEQ ID NO: 197638 - DNA, 20 bp, Artificial
  CRISPR gRNA sequence
tcttcagtcctcagtttctt

SEQ ID NO: 197639 - DNA, 20 bp, Artificial
  CRISPR gRNA sequence
cagtcctcagtttctttgtg

SEQ ID NO: 197640 - DNA, 20 bp, Artificial
  CRISPR gRNA sequence
agtcctcagtttctttgtgg

SEQ ID NO: 197641 - DNA, 20 bp, Artificial
  CRISPR gRNA sequence
agtttctttgtgggaaactt

SEQ ID NO: 197642 - DNA, 20 bp, Artificial
  CRISPR gRNA sequence
ctttgtgggaaactttttaa

SEQ ID NO: 197643 - DNA, 20 bp, Artificial
  CRISPR gRNA sequence
tttgtgggaaactttttaat

SEQ ID NO: 197644 - DNA, 20 bp, Artificial
  CRISPR gRNA sequence
tgtgggaaactttttaatta

SEQ ID NO: 197645 - DNA, 20 bp, Artificial
  CRISPR gRNA sequence
gtgggaaactttttaattag

SEQ ID NO: 197646 - DNA, 20 bp, Artificial
  CRISPR gRNA sequence
tgggaaactttttaattagt

SEQ ID NO: 197647 - DNA, 20 bp, Artificial
  CRISPR gRNA sequence
tttaattagttgtttaattt

SEQ ID NO: 197648 - DNA, 20 bp, Artificial
  CRISPR gRNA sequence
ttaattagttgtttaatttt

SEQ ID NO: 197649 - DNA, 20 bp, Artificial
  CRISPR gRNA sequence
taattagttgtttaattttg

SEQ ID NO: 197650 - DNA, 20 bp, Artificial
  CRISPR gRNA sequence
aattagttgtttaattttgt

SEQ ID NO: 197651 - DNA, 20 bp, Artificial
  CRISPR gRNA sequence
attagttgtttaattttgta

SEQ ID NO: 197652 - DNA, 20 bp, Artificial
  CRISPR gRNA sequence
gttgtttaattttgtaagat

SEQ ID NO: 197653 - DNA, 20 bp, Artificial
  CRISPR gRNA sequence
tttaattttgtaagatggtt

SEQ ID NO: 197654 - DNA, 20 bp, Artificial
  CRISPR gRNA sequence
aattttgtaagatggttagt

SEQ ID NO: 197655 - DNA, 20 bp, Artificial
  CRISPR gRNA sequence
attttgtaagatggttagtt

SEQ ID NO: 197656 - DNA, 20 bp, Artificial
  CRISPR gRNA sequence
tgtaagatggttagtttagt

SEQ ID NO: 197657 - DNA, 20 bp, Artificial
  CRISPR gRNA sequence
gtaagatggttagtttagtc

SEQ ID NO: 197658 - DNA, 20 bp, Artificial
  CRISPR gRNA sequence
taagatggttagtttagtca

SEQ ID NO: 197659 - DNA, 20 bp, Artificial
  CRISPR gRNA sequence
gtttagtcaaaattagataa

SEQ ID NO: 197660 - DNA, 20 bp, Artificial
  CRISPR gRNA sequence
agtcaaaattagataagaga

SEQ ID NO: 197661 - DNA, 20 bp, Artificial
  CRISPR gRNA sequence
gtcaaaattagataagagaa

SEQ ID NO: 197662 - DNA, 20 bp, Artificial
  CRISPR gRNA sequence
gataagagaatttgaaaatc

SEQ ID NO: 197663 - DNA, 20 bp, Artificial
  CRISPR gRNA sequence
gaaaatccgtagctacccca

SEQ ID NO: 197664 - DNA, 20 bp, Artificial
  CRISPR gRNA sequence
aaaatccgtagctaccccaa

SEQ ID NO: 197665 - DNA, 20 bp, Artificial
  CRISPR gRNA sequence
ccccaaagcaacctacacat

SEQ ID NO: 197666 - DNA, 20 bp, Artificial
  CRISPR gRNA sequence
cacataagaactattatttt

SEQ ID NO: 197667 - DNA, 20 bp, Artificial
  CRISPR gRNA sequence
ttatttttgtgttttgaaat

SEQ ID NO: 197668 - DNA, 20 bp, Artificial
  CRISPR gRNA sequence
tttttgtgttttgaaatcat

SEQ ID NO: 197669 - DNA, 20 bp, Artificial
  CRISPR gRNA sequence
ttgtgttttgaaatcataat

SEQ ID NO: 197670 - DNA, 20 bp, Artificial
  CRISPR gRNA sequence
tgtgttttgaaatcataatt

SEQ ID NO: 197671 - DNA, 20 bp, Artificial
  CRISPR gRNA sequence
gtgttttgaaatcataattt

SEQ ID NO: 197672 - DNA, 20 bp, Artificial
  CRISPR gRNA sequence
tgttttgaaatcataatttt

SEQ ID NO: 197673 - DNA, 20 bp, Artificial
  CRISPR gRNA sequence
tgaaatcataattttattga

SEQ ID NO: 197674 - DNA, 20 bp, Artificial
  CRISPR gRNA sequence
gaaatcataattttattgat

SEQ ID NO: 197675 - DNA, 20 bp, Artificial
  CRISPR gRNA sequence
aaatcataattttattgatt

SEQ ID NO: 197676 - DNA, 20 bp, Artificial
  CRISPR gRNA sequence
tattgatttccagtgtttcc

SEQ ID NO: 197677 - DNA, 20 bp, Artificial
  CRISPR gRNA sequence
attgatttccagtgtttcca

SEQ ID NO: 197678 - DNA, 20 bp, Artificial
  CRISPR gRNA sequence
ttgatttccagtgtttccac

SEQ ID NO: 197679 - DNA, 20 bp, Artificial
  CRISPR gRNA sequence
atttccagtgtttccactgg

SEQ ID NO: 197680 - DNA, 20 bp, Artificial
  CRISPR gRNA sequence
ccagtgtttccactggtagt

SEQ ID NO: 197681 - DNA, 20 bp, Artificial
  CRISPR gRNA sequence
cagtgtttccactggtagtg

SEQ ID NO: 197682 - DNA, 20 bp, Artificial
  CRISPR gRNA sequence
ccactggtagtggtttcatt

SEQ ID NO: 197683 - DNA, 20 bp, Artificial
  CRISPR gRNA sequence
cactggtagtggtttcattg

SEQ ID NO: 197684 - DNA, 20 bp, Artificial
  CRISPR gRNA sequence
gtagtggtttcattgatata

SEQ ID NO: 197685 - DNA, 20 bp, Artificial
  CRISPR gRNA sequence
cattgatataggagtatcaa

SEQ ID NO: 197686 - DNA, 20 bp, Artificial
  CRISPR gRNA sequence
attgatataggagtatcaaa

SEQ ID NO: 197687 - DNA, 20 bp, Artificial
  CRISPR gRNA sequence
atataggagtatcaaaacat

SEQ ID NO: 197688 - DNA, 20 bp, Artificial
  CRISPR gRNA sequence
attatttatttcagtttcat

SEQ ID NO: 197689 - DNA, 20 bp, Artificial
  CRISPR gRNA sequence
tttatttcagtttcatttga

SEQ ID NO: 197690 - DNA, 20 bp, Artificial
  CRISPR gRNA sequence
atttcagtttcatttgatcc

SEQ ID NO: 197691 - DNA, 20 bp, Artificial
  CRISPR gRNA sequence
tttcagtttcatttgatcct

SEQ ID NO: 197692 - DNA, 20 bp, Artificial
  CRISPR gRNA sequence
cagtttcatttgatcctagc

SEQ ID NO: 197693 - DNA, 20 bp, Artificial
  CRISPR gRNA sequence
agtttcatttgatcctagcc

SEQ ID NO: 197694 - DNA, 20 bp, Artificial
  CRISPR gRNA sequence
catttgatcctagccgtttt

SEQ ID NO: 197695 - DNA, 20 bp, Artificial
  CRISPR gRNA sequence
atttgatcctagccgttttg

SEQ ID NO: 197696 - DNA, 20 bp, Artificial
  CRISPR gRNA sequence
gatcctagccgttttgtatt

SEQ ID NO: 197697 - DNA, 20 bp, Artificial
  CRISPR gRNA sequence
atcctagccgttttgtatta

SEQ ID NO: 197698 - DNA, 20 bp, Artificial
  CRISPR gRNA sequence
gccgttttgtattaactctc

SEQ ID NO: 197699 - DNA, 20 bp, Artificial
  CRISPR gRNA sequence
tgtattaactctctgtgaag

SEQ ID NO: 197700 - DNA, 20 bp, Artificial
  CRISPR gRNA sequence
gtattaactctctgtgaaga

SEQ ID NO: 197701 - DNA, 20 bp, Artificial
  CRISPR gRNA sequence
tattaactctctgtgaagaa

SEQ ID NO: 197702 - DNA, 20 bp, Artificial
  CRISPR gRNA sequence
actctctgtgaagaaattac

SEQ ID NO: 197703 - DNA, 20 bp, Artificial
  CRISPR gRNA sequence
tctgtgaagaaattacctca

SEQ ID NO: 197704 - DNA, 20 bp, Artificial
  CRISPR gRNA sequence
tgtgaagaaattacctcaca

SEQ ID NO: 197705 - DNA, 20 bp, Artificial
  CRISPR gRNA sequence
tgaagaaattacctcacaaa

SEQ ID NO: 197706 - DNA, 20 bp, Artificial
  CRISPR gRNA sequence
cctcacaaatctattgctgt

SEQ ID NO: 197707 - DNA, 20 bp, Artificial
  CRISPR gRNA sequence
acaaatctattgctgtcctt

SEQ ID NO: 197708 - DNA, 20 bp, Artificial
  CRISPR gRNA sequence
ttgctgtccttggtaaagga

SEQ ID NO: 197709 - DNA, 20 bp, Artificial
  CRISPR gRNA sequence
ctgtccttggtaaaggaatg

SEQ ID NO: 197710 - DNA, 20 bp, Artificial
  CRISPR gRNA sequence
tccttggtaaaggaatggag

SEQ ID NO: 197711 - DNA, 20 bp, Artificial
  CRISPR gRNA sequence
ggtaaaggaatggagaatta

SEQ ID NO: 197712 - DNA, 20 bp, Artificial
  CRISPR gRNA sequence
gtaaaggaatggagaattaa

SEQ ID NO: 197713 - DNA, 20 bp, Artificial
  CRISPR gRNA sequence
aggctctagatcattagtgg

SEQ ID NO: 197714 - DNA, 20 bp, Artificial
  CRISPR gRNA sequence
tagatcattagtggttacac

SEQ ID NO: 197715 - DNA, 20 bp, Artificial
  CRISPR gRNA sequence
gatcattagtggttacacta

SEQ ID NO: 197716 - DNA, 20 bp, Artificial
  CRISPR gRNA sequence
gtggttacactatagtatta

SEQ ID NO: 197717 - DNA, 20 bp, Artificial
  CRISPR gRNA sequence
cactatagtattagaagtaa

SEQ ID NO: 197718 - DNA, 20 bp, Artificial
  CRISPR gRNA sequence
tagtattagaagtaaaaaaa

SEQ ID NO: 197719 - DNA, 20 bp, Artificial
  CRISPR gRNA sequence
gaagtaaaaaaaagattata

SEQ ID NO: 197720 - DNA, 20 bp, Artificial
  CRISPR gRNA sequence
taccaacaaaataagaacat

SEQ ID NO: 197721 - DNA, 20 bp, Artificial
  CRISPR gRNA sequence
atgtacttgtaatgaataaa

SEQ ID NO: 197722 - DNA, 20 bp, Artificial
  CRISPR gRNA sequence
gtaatgaataaacatgaata

SEQ ID NO: 197723 - DNA, 20 bp, Artificial
  CRISPR gRNA sequence
taatgaataaacatgaataa

SEQ ID NO: 197724 - DNA, 20 bp, Artificial
  CRISPR gRNA sequence
ttatgctatataggtgcact

SEQ ID NO: 197725 - DNA, 20 bp, Artificial
  CRISPR gRNA sequence
atgctatataggtgcactaa

SEQ ID NO: 197726 - DNA, 20 bp, Artificial
  CRISPR gRNA sequence
tgctatataggtgcactaaa

SEQ ID NO: 197727 - DNA, 20 bp, Artificial
  CRISPR gRNA sequence
tataggtgcactaaacaatc

SEQ ID NO: 197728 - DNA, 20 bp, Artificial
  CRISPR gRNA sequence
aacaatctactagaattgtc

SEQ ID NO: 197729 - DNA, 20 bp, Artificial
  CRISPR gRNA sequence
ctagaattgtcagcaaacta

SEQ ID NO: 197730 - DNA, 20 bp, Artificial
  CRISPR gRNA sequence
gaattgtcagcaaactacgt

SEQ ID NO: 197731 - DNA, 20 bp, Artificial
  CRISPR gRNA sequence
tcagcaaactacgtatctta

SEQ ID NO: 197732 - DNA, 20 bp, Artificial
  CRISPR gRNA sequence
cgtatcttaatcctgaaagg

SEQ ID NO: 197733 - DNA, 20 bp, Artificial
  CRISPR gRNA sequence
aatcctgaaagggtcccaaa

SEQ ID NO: 197734 - DNA, 20 bp, Artificial
  CRISPR gRNA sequence
atcctgaaagggtcccaaac

SEQ ID NO: 197735 - DNA, 20 bp, Artificial
  CRISPR gRNA sequence
aaagggtcccaaaccaatga

SEQ ID NO: 197736 - DNA, 20 bp, Artificial
  CRISPR gRNA sequence
aaattgaatcaaactttctt

SEQ ID NO: 197737 - DNA, 20 bp, Artificial
  CRISPR gRNA sequence
aatcaaactttcttccttga

SEQ ID NO: 197738 - DNA, 20 bp, Artificial
  CRISPR gRNA sequence
tcttccttgagcataattac

SEQ ID NO: 197739 - DNA, 20 bp, Artificial
  CRISPR gRNA sequence
cttccttgagcataattact

SEQ ID NO: 197740 - DNA, 20 bp, Artificial
  CRISPR gRNA sequence
ttccttgagcataattactt

SEQ ID NO: 197741 - DNA, 20 bp, Artificial
  CRISPR gRNA sequence
ccttgagcataattacttaa

SEQ ID NO: 197742 - DNA, 20 bp, Artificial
  CRISPR gRNA sequence
cttgagcataattacttaaa

SEQ ID NO: 197743 - DNA, 20 bp, Artificial
  CRISPR gRNA sequence
gagcataattacttaaatga

SEQ ID NO: 197744 - DNA, 20 bp, Artificial
  CRISPR gRNA sequence
agcataattacttaaatgat

SEQ ID NO: 197745 - DNA, 20 bp, Artificial
  CRISPR gRNA sequence
cttaaatgatttattaaaat

SEQ ID NO: 197746 - DNA, 20 bp, Artificial
  CRISPR gRNA sequence
aaatgatttattaaaatagc

SEQ ID NO: 197747 - DNA, 20 bp, Artificial
  CRISPR gRNA sequence
aatgatttattaaaatagcc

SEQ ID NO: 197748 - DNA, 20 bp, Artificial
  CRISPR gRNA sequence
attaaaatagccagcattta

SEQ ID NO: 197749 - DNA, 20 bp, Artificial
  CRISPR gRNA sequence
ttaaaatagccagcatttaa

SEQ ID NO: 197750 - DNA, 20 bp, Artificial
  CRISPR gRNA sequence
aaatagccagcatttaaaag

SEQ ID NO: 197751 - DNA, 20 bp, Artificial
  CRISPR gRNA sequence
aaaagcttaaaatgtaaata

SEQ ID NO: 197752 - DNA, 20 bp, Artificial
  CRISPR gRNA sequence
aaagcttaaaatgtaaatat

SEQ ID NO: 197753 - DNA, 20 bp, Artificial
  CRISPR gRNA sequence
aaaatgtaaatatcataatg

SEQ ID NO: 197754 - DNA, 20 bp, Artificial
  CRISPR gRNA sequence
aaatgtaaatatcataatgt

SEQ ID NO: 197755 - DNA, 20 bp, Artificial
  CRISPR gRNA sequence
gatagcatcccagaacagaa

SEQ ID NO: 197756 - DNA, 20 bp, Artificial
  CRISPR gRNA sequence
gggaaaaactggaggaatgg

SEQ ID NO: 197757 - DNA, 20 bp, Artificial
  CRISPR gRNA sequence
gaggaatggaataaattatg

SEQ ID NO: 197758 - DNA, 20 bp, Artificial
  CRISPR gRNA sequence
tgcagtttagttattaataa

SEQ ID NO: 197759 - DNA, 20 bp, Artificial
  CRISPR gRNA sequence
agttattaataatgtactaa

SEQ ID NO: 197760 - DNA, 20 bp, Artificial
  CRISPR gRNA sequence
gttattaataatgtactaac

SEQ ID NO: 197761 - DNA, 20 bp, Artificial
  CRISPR gRNA sequence
ttaataatgtactaacgtcc

SEQ ID NO: 197762 - DNA, 20 bp, Artificial
  CRISPR gRNA sequence
ataatgtactaacgtcctta

SEQ ID NO: 197763 - DNA, 20 bp, Artificial
  CRISPR gRNA sequence
acgtccttagttatgacgat

SEQ ID NO: 197764 - DNA, 20 bp, Artificial
  CRISPR gRNA sequence
agttatgacgattgtaccat

SEQ ID NO: 197765 - DNA, 20 bp, Artificial
  CRISPR gRNA sequence
gttatgacgattgtaccatg

SEQ ID NO: 197766 - DNA, 20 bp, Artificial
  CRISPR gRNA sequence
tgacgattgtaccatggtaa

SEQ ID NO: 197767 - DNA, 20 bp, Artificial
  CRISPR gRNA sequence
taccatggtaatgtaagata

SEQ ID NO: 197768 - DNA, 20 bp, Artificial
  CRISPR gRNA sequence
acaatagaggaaaccgggta

SEQ ID NO: 197769 - DNA, 20 bp, Artificial
  CRISPR gRNA sequence
tatactatctttgcaacttt

SEQ ID NO: 197770 - DNA, 20 bp, Artificial
  CRISPR gRNA sequence
tactatctttgcaacttttt

SEQ ID NO: 197771 - DNA, 20 bp, Artificial
  CRISPR gRNA sequence
tctttgcaacttttttgtaa

SEQ ID NO: 197772 - DNA, 20 bp, Artificial
  CRISPR gRNA sequence
tgcaacttttttgtaaattt

SEQ ID NO: 197773 - DNA, 20 bp, Artificial
  CRISPR gRNA sequence
gcaacttttttgtaaattta

SEQ ID NO: 197774 - DNA, 20 bp, Artificial
  CRISPR gRNA sequence
caacttttttgtaaatttaa

SEQ ID NO: 197775 - DNA, 20 bp, Artificial
  CRISPR gRNA sequence
ttttgtaaatttaaaacttc

SEQ ID NO: 197776 - DNA, 20 bp, Artificial
  CRISPR gRNA sequence
tttgtaaatttaaaacttct

SEQ ID NO: 197777 - DNA, 20 bp, Artificial
  CRISPR gRNA sequence
ttgtaaatttaaaacttcta

SEQ ID NO: 197778 - DNA, 20 bp, Artificial
  CRISPR gRNA sequence
tgtaaatttaaaacttctaa

SEQ ID NO: 197779 - DNA, 20 bp, Artificial
  CRISPR gRNA sequence
gtaaatttaaaacttctaaa

SEQ ID NO: 197780 - DNA, 20 bp, Artificial
  CRISPR gRNA sequence
taaatttaaaacttctaaaa

SEQ ID NO: 197781 - DNA, 20 bp, Artificial
  CRISPR gRNA sequence
aaaacttctaaaataaagaa

SEQ ID NO: 197782 - DNA, 20 bp, Artificial
  CRISPR gRNA sequence
aaacttctaaaataaagaac

SEQ ID NO: 197783 - DNA, 20 bp, Artificial
  CRISPR gRNA sequence
ctaaaataaagaacaaattt

SEQ ID NO: 197784 - DNA, 20 bp, Artificial
  CRISPR gRNA sequence
taaaataaagaacaaattta

SEQ ID NO: 197785 - DNA, 20 bp, Artificial
  CRISPR gRNA sequence
aaataaagaacaaatttaaa

SEQ ID NO: 197786 - DNA, 20 bp, Artificial
  CRISPR gRNA sequence
aaacattaaaaagtatcacc

SEQ ID NO: 197787 - DNA, 20 bp, Artificial
  CRISPR gRNA sequence
aacattaaaaagtatcacca

SEQ ID NO: 197788 - DNA, 20 bp, Artificial
  CRISPR gRNA sequence
aaaagtatcaccaggaacat

SEQ ID NO: 197789 - DNA, 20 bp, Artificial
  CRISPR gRNA sequence
tttacagatgaaatactatg

SEQ ID NO: 197790 - DNA, 20 bp, Artificial
  CRISPR gRNA sequence
acagatgaaatactatgtat

SEQ ID NO: 197791 - DNA, 20 bp, Artificial
  CRISPR gRNA sequence
cagatgaaatactatgtatt

SEQ ID NO: 197792 - DNA, 20 bp, Artificial
  CRISPR gRNA sequence
tgtattttcatatctaattt

SEQ ID NO: 197793 - DNA, 20 bp, Artificial
  CRISPR gRNA sequence
tcatatctaatttctgatca

SEQ ID NO: 197794 - DNA, 20 bp, Artificial
  CRISPR gRNA sequence
catatctaatttctgatcat

SEQ ID NO: 197795 - DNA, 20 bp, Artificial
  CRISPR gRNA sequence
atatctaatttctgatcatt

SEQ ID NO: 197796 - DNA, 20 bp, Artificial
  CRISPR gRNA sequence
atttctgatcattgacttca

SEQ ID NO: 197797 - DNA, 20 bp, Artificial
  CRISPR gRNA sequence
ctgatcattgacttcaaatc

SEQ ID NO: 197798 - DNA, 20 bp, Artificial
  CRISPR gRNA sequence
tgatcattgacttcaaatca

SEQ ID NO: 197799 - DNA, 20 bp, Artificial
  CRISPR gRNA sequence
atcattgacttcaaatcaga

SEQ ID NO: 197800 - DNA, 20 bp, Artificial
  CRISPR gRNA sequence
acttcaaatcagaaaagtga

SEQ ID NO: 197801 - DNA, 20 bp, Artificial
  CRISPR gRNA sequence
caaatcagaaaagtgaatga

SEQ ID NO: 197802 - DNA, 20 bp, Artificial
  CRISPR gRNA sequence
aaatcagaaaagtgaatgac

SEQ ID NO: 197803 - DNA, 20 bp, Artificial
  CRISPR gRNA sequence
aaaatcaggttttctgttta

SEQ ID NO: 197804 - DNA, 20 bp, Artificial
  CRISPR gRNA sequence
tctgtttactgaagtctaag

SEQ ID NO: 197805 - DNA, 20 bp, Artificial
  CRISPR gRNA sequence
ctgtttactgaagtctaaga

SEQ ID NO: 197806 - DNA, 20 bp, Artificial
  CRISPR gRNA sequence
tgtttactgaagtctaagaa

SEQ ID NO: 197807 - DNA, 20 bp, Artificial
  CRISPR gRNA sequence
tttactgaagtctaagaaaa

SEQ ID NO: 197808 - DNA, 20 bp, Artificial
  CRISPR gRNA sequence
actgaagtctaagaaaagaa

SEQ ID NO: 197809 - DNA, 20 bp, Artificial
  CRISPR gRNA sequence
ctgaagtctaagaaaagaaa

SEQ ID NO: 197810 - DNA, 20 bp, Artificial
  CRISPR gRNA sequence
aagtctaagaaaagaaagca

SEQ ID NO: 197811 - DNA, 20 bp, Artificial
  CRISPR gRNA sequence
agaaaagaaagcataccagc

SEQ ID NO: 197812 - DNA, 20 bp, Artificial
  CRISPR gRNA sequence
gagagattcatgtttataaa

SEQ ID NO: 197813 - DNA, 20 bp, Artificial
  CRISPR gRNA sequence
atgtttataaagacagattt

SEQ ID NO: 197814 - DNA, 20 bp, Artificial
  CRISPR gRNA sequence
ataaagacagatttataaca

SEQ ID NO: 197815 - DNA, 20 bp, Artificial
  CRISPR gRNA sequence
taaagacagatttataacaa

SEQ ID NO: 197816 - DNA, 20 bp, Artificial
  CRISPR gRNA sequence
ataacaacaaaaataaaata

SEQ ID NO: 197817 - DNA, 20 bp, Artificial
  CRISPR gRNA sequence
taacaacaaaaataaaatat

SEQ ID NO: 197818 - DNA, 20 bp, Artificial
  CRISPR gRNA sequence
aagaagaagcactttactga

SEQ ID NO: 197819 - DNA, 20 bp, Artificial
  CRISPR gRNA sequence
agaagaagcactttactgag

SEQ ID NO: 197820 - DNA, 20 bp, Artificial
  CRISPR gRNA sequence
tactgagaaacatatgaaaa

SEQ ID NO: 197821 - DNA, 20 bp, Artificial
  CRISPR gRNA sequence
actgagaaacatatgaaaac

SEQ ID NO: 197822 - DNA, 20 bp, Artificial
  CRISPR gRNA sequence
ctgagaaacatatgaaaacc

SEQ ID NO: 197823 - DNA, 20 bp, Artificial
  CRISPR gRNA sequence
agaaacatatgaaaacctga

SEQ ID NO: 197824 - DNA, 20 bp, Artificial
  CRISPR gRNA sequence
aacaaatggagagggatatt

SEQ ID NO: 197825 - DNA, 20 bp, Artificial
  CRISPR gRNA sequence
tgtatttgaatagaaagact

SEQ ID NO: 197826 - DNA, 20 bp, Artificial
  CRISPR gRNA sequence
gtatttgaatagaaagactt

SEQ ID NO: 197827 - DNA, 20 bp, Artificial
  CRISPR gRNA sequence
tatttgaatagaaagacttc

SEQ ID NO: 197828 - DNA, 20 bp, Artificial
  CRISPR gRNA sequence
gaatagaaagacttctggtt

SEQ ID NO: 197829 - DNA, 20 bp, Artificial
  CRISPR gRNA sequence
aatagaaagacttctggttt

SEQ ID NO: 197830 - DNA, 20 bp, Artificial
  CRISPR gRNA sequence
ctggtttaaagataattctc

SEQ ID NO: 197831 - DNA, 20 bp, Artificial
  CRISPR gRNA sequence
tggtttaaagataattctct

SEQ ID NO: 197832 - DNA, 20 bp, Artificial
  CRISPR gRNA sequence
gtttaaagataattctcttt

SEQ ID NO: 197833 - DNA, 20 bp, Artificial
  CRISPR gRNA sequence
aaagataattctctttaaat

SEQ ID NO: 197834 - DNA, 20 bp, Artificial
  CRISPR gRNA sequence
aagataattctctttaaatt

SEQ ID NO: 197835 - DNA, 20 bp, Artificial
  CRISPR gRNA sequence
tctttaaattattttttgta

SEQ ID NO: 197836 - DNA, 20 bp, Artificial
  CRISPR gRNA sequence
tttaaattattttttgtaga

SEQ ID NO: 197837 - DNA, 20 bp, Artificial
  CRISPR gRNA sequence
taaattattttttgtagaaa

SEQ ID NO: 197838 - DNA, 20 bp, Artificial
  CRISPR gRNA sequence
aaattattttttgtagaaat

SEQ ID NO: 197839 - DNA, 20 bp, Artificial
  CRISPR gRNA sequence
aattattttttgtagaaatt

SEQ ID NO: 197840 - DNA, 20 bp, Artificial
  CRISPR gRNA sequence
ttttttgtagaaatttaagg

SEQ ID NO: 197841 - DNA, 20 bp, Artificial
  CRISPR gRNA sequence
tttgtagaaatttaaggggt

SEQ ID NO: 197842 - DNA, 20 bp, Artificial
  CRISPR gRNA sequence
ttgtagaaatttaaggggta

SEQ ID NO: 197843 - DNA, 20 bp, Artificial
  CRISPR gRNA sequence
tgtagaaatttaaggggtac

SEQ ID NO: 197844 - DNA, 20 bp, Artificial
  CRISPR gRNA sequence
gtagaaatttaaggggtaca

SEQ ID NO: 197845 - DNA, 20 bp, Artificial
  CRISPR gRNA sequence
tagaaatttaaggggtacaa

SEQ ID NO: 197846 - DNA, 20 bp, Artificial
  CRISPR gRNA sequence
aaggggtacaagagcagtgt

SEQ ID NO: 197847 - DNA, 20 bp, Artificial
  CRISPR gRNA sequence
aggggtacaagagcagtgtt

SEQ ID NO: 197848 - DNA, 20 bp, Artificial
  CRISPR gRNA sequence
tcacatggatatattacata

SEQ ID NO: 197849 - DNA, 20 bp, Artificial
  CRISPR gRNA sequence
catagtggtgaagtctgggg

SEQ ID NO: 197850 - DNA, 20 bp, Artificial
  CRISPR gRNA sequence
gggttttagtgtaaattaat

SEQ ID NO: 197851 - DNA, 20 bp, Artificial
  CRISPR gRNA sequence
tagtgtaaattaatctttac

SEQ ID NO: 197852 - DNA, 20 bp, Artificial
  CRISPR gRNA sequence
agtgtaaattaatctttaca

SEQ ID NO: 197853 - DNA, 20 bp, Artificial
  CRISPR gRNA sequence
gtgtaaattaatctttacat

SEQ ID NO: 197854 - DNA, 20 bp, Artificial
  CRISPR gRNA sequence
atctttacattttgtttgag

SEQ ID NO: 197855 - DNA, 20 bp, Artificial
  CRISPR gRNA sequence
tacattttgtttgagcccaa

SEQ ID NO: 197856 - DNA, 20 bp, Artificial
  CRISPR gRNA sequence
acattttgtttgagcccaat

SEQ ID NO: 197857 - DNA, 20 bp, Artificial
  CRISPR gRNA sequence
cattttgtttgagcccaata

SEQ ID NO: 197858 - DNA, 20 bp, Artificial
  CRISPR gRNA sequence
tgtttgagcccaataaatgt

SEQ ID NO: 197859 - DNA, 20 bp, Artificial
  CRISPR gRNA sequence
gtttgagcccaataaatgta

SEQ ID NO: 197860 - DNA, 20 bp, Artificial
  CRISPR gRNA sequence
tttgagcccaataaatgtac

SEQ ID NO: 197861 - DNA, 20 bp, Artificial
  CRISPR gRNA sequence
gagcccaataaatgtaccaa

SEQ ID NO: 197862 - DNA, 20 bp, Artificial
  CRISPR gRNA sequence
agcccaataaatgtaccaac

SEQ ID NO: 197863 - DNA, 20 bp, Artificial
  CRISPR gRNA sequence
ttatagaaagatagtcattc

SEQ ID NO: 197864 - DNA, 20 bp, Artificial
  CRISPR gRNA sequence
tatagaaagatagtcattcc

SEQ ID NO: 197865 - DNA, 20 bp, Artificial
  CRISPR gRNA sequence
atagaaagatagtcattcct

SEQ ID NO: 197866 - DNA, 20 bp, Artificial
  CRISPR gRNA sequence
tagaaagatagtcattccta

SEQ ID NO: 197867 - DNA, 20 bp, Artificial
  CRISPR gRNA sequence
ctattaatccaaacttgtcc

SEQ ID NO: 197868 - DNA, 20 bp, Artificial
  CRISPR gRNA sequence
ttaatccaaacttgtcccaa

SEQ ID NO: 197869 - DNA, 20 bp, Artificial
  CRISPR gRNA sequence
atccaaacttgtcccaactt

SEQ ID NO: 197870 - DNA, 20 bp, Artificial
  CRISPR gRNA sequence
gtcccaactttgaattgaat

SEQ ID NO: 197871 - DNA, 20 bp, Artificial
  CRISPR gRNA sequence
tcccaactttgaattgaatt

SEQ ID NO: 197872 - DNA, 20 bp, Artificial
  CRISPR gRNA sequence
tgaattgaattgaggcagag

SEQ ID NO: 197873 - DNA, 20 bp, Artificial
  CRISPR gRNA sequence
gaattgaattgaggcagagc

SEQ ID NO: 197874 - DNA, 20 bp, Artificial
  CRISPR gRNA sequence
aattgaattgaggcagagct

SEQ ID NO: 197875 - DNA, 20 bp, Artificial
  CRISPR gRNA sequence
aattgaggcagagctagcag

SEQ ID NO: 197876 - DNA, 20 bp, Artificial
  CRISPR gRNA sequence
aggcagagctagcaggtgtt

SEQ ID NO: 197877 - DNA, 20 bp, Artificial
  CRISPR gRNA sequence
gcaggtgttccccacggctg

SEQ ID NO: 197878 - DNA, 20 bp, Artificial
  CRISPR gRNA sequence
cccacggctgaggcatctga

SEQ ID NO: 197879 - DNA, 20 bp, Artificial
  CRISPR gRNA sequence
aggcatctgaacattaagca

SEQ ID NO: 197880 - DNA, 20 bp, Artificial
  CRISPR gRNA sequence
aacattaagcatatccctct

SEQ ID NO: 197881 - DNA, 20 bp, Artificial
  CRISPR gRNA sequence
agcatatccctctgagaacc

SEQ ID NO: 197882 - DNA, 20 bp, Artificial
  CRISPR gRNA sequence
tgagaaccagcctgcattga

SEQ ID NO: 197883 - DNA, 20 bp, Artificial
  CRISPR gRNA sequence
agaaccagcctgcattgata

SEQ ID NO: 197884 - DNA, 20 bp, Artificial
  CRISPR gRNA sequence
cattgatactctttctaatg

SEQ ID NO: 197885 - DNA, 20 bp, Artificial
  CRISPR gRNA sequence
atactctttctaatgtggac

SEQ ID NO: 197886 - DNA, 20 bp, Artificial
  CRISPR gRNA sequence
tttctaatgtggacagcatc

SEQ ID NO: 197887 - DNA, 20 bp, Artificial
  CRISPR gRNA sequence
tctaatgtggacagcatcaa

SEQ ID NO: 197888 - DNA, 20 bp, Artificial
  CRISPR gRNA sequence
ctaatgtggacagcatcaag

SEQ ID NO: 197889 - DNA, 20 bp, Artificial
  CRISPR gRNA sequence
taatgtggacagcatcaagc

SEQ ID NO: 197890 - DNA, 20 bp, Artificial
  CRISPR gRNA sequence
atgtggacagcatcaagcta

SEQ ID NO: 197891 - DNA, 20 bp, Artificial
  CRISPR gRNA sequence
tgtacgtagttctgtgctca

SEQ ID NO: 197892 - DNA, 20 bp, Artificial
  CRISPR gRNA sequence
tgtgctcagcaaaagccctg

SEQ ID NO: 197893 - DNA, 20 bp, Artificial
  CRISPR gRNA sequence
tgctcagcaaaagccctgac

SEQ ID NO: 197894 - DNA, 20 bp, Artificial
  CRISPR gRNA sequence
agcaaaagccctgacttctt

SEQ ID NO: 197895 - DNA, 20 bp, Artificial
  CRISPR gRNA sequence
acttctttttgtttatgtcc

SEQ ID NO: 197896 - DNA, 20 bp, Artificial
  CRISPR gRNA sequence
ctttttgtttatgtcctagc

SEQ ID NO: 197897 - DNA, 20 bp, Artificial
  CRISPR gRNA sequence
tttttgtttatgtcctagcc

SEQ ID NO: 197898 - DNA, 20 bp, Artificial
  CRISPR gRNA sequence
tttgtttatgtcctagcccc

SEQ ID NO: 197899 - DNA, 20 bp, Artificial
  CRISPR gRNA sequence
ttgtttatgtcctagcccca

SEQ ID NO: 197900 - DNA, 20 bp, Artificial
  CRISPR gRNA sequence
tgtttatgtcctagccccat

SEQ ID NO: 197901 - DNA, 20 bp, Artificial
  CRISPR gRNA sequence
gtttatgtcctagccccata

SEQ ID NO: 197902 - DNA, 20 bp, Artificial
  CRISPR gRNA sequence
tttatgtcctagccccatac

SEQ ID NO: 197903 - DNA, 20 bp, Artificial
  CRISPR gRNA sequence
atgtcctagccccatacaac

SEQ ID NO: 197904 - DNA, 20 bp, Artificial
  CRISPR gRNA sequence
tgtcctagccccatacaaca

SEQ ID NO: 197905 - DNA, 20 bp, Artificial
  CRISPR gRNA sequence
gccccatacaacaaaatcaa

SEQ ID NO: 197906 - DNA, 20 bp, Artificial
  CRISPR gRNA sequence
tggttgtggatccagtcacc

SEQ ID NO: 197907 - DNA, 20 bp, Artificial
  CRISPR gRNA sequence
ggttgtggatccagtcacct

SEQ ID NO: 197908 - DNA, 20 bp, Artificial
  CRISPR gRNA sequence
gttgtggatccagtcacctc

SEQ ID NO: 197909 - DNA, 20 bp, Artificial
  CRISPR gRNA sequence
tggatccagtcacctctgaa

SEQ ID NO: 197910 - DNA, 20 bp, Artificial
  CRISPR gRNA sequence
tgaacatgaactgacatgtc

SEQ ID NO: 197911 - DNA, 20 bp, Artificial
  CRISPR gRNA sequence
aacatgaactgacatgtcag

SEQ ID NO: 197912 - DNA, 20 bp, Artificial
  CRISPR gRNA sequence
acatgtcaggctgagggcta

SEQ ID NO: 197913 - DNA, 20 bp, Artificial
  CRISPR gRNA sequence
agggctaccccaaggccgaa

SEQ ID NO: 197914 - DNA, 20 bp, Artificial
  CRISPR gRNA sequence
ccccaaggccgaagtcatct

SEQ ID NO: 197915 - DNA, 20 bp, Artificial
  CRISPR gRNA sequence
gacaagcagtgaccatcaag

SEQ ID NO: 197916 - DNA, 20 bp, Artificial
  CRISPR gRNA sequence
agtggtaagaccaccaccac

SEQ ID NO: 197917 - DNA, 20 bp, Artificial
  CRISPR gRNA sequence
caagagagaggagaagcttt

SEQ ID NO: 197918 - DNA, 20 bp, Artificial
  CRISPR gRNA sequence
ttcaatgtgaccagcacact

SEQ ID NO: 197919 - DNA, 20 bp, Artificial
  CRISPR gRNA sequence
tcaatgtgaccagcacactg

SEQ ID NO: 197920 - DNA, 20 bp, Artificial
  CRISPR gRNA sequence
caatgtgaccagcacactga

SEQ ID NO: 197921 - DNA, 20 bp, Artificial
  CRISPR gRNA sequence
aatgtgaccagcacactgag

SEQ ID NO: 197922 - DNA, 20 bp, Artificial
  CRISPR gRNA sequence
agaatcaacacaacaactaa

SEQ ID NO: 197923 - DNA, 20 bp, Artificial
  CRISPR gRNA sequence
atgagattttctactgcact

SEQ ID NO: 197924 - DNA, 20 bp, Artificial
  CRISPR gRNA sequence
tctactgcacttttaggaga

SEQ ID NO: 197925 - DNA, 20 bp, Artificial
  CRISPR gRNA sequence
ctactgcacttttaggagat
